United States Patent 7,250,289 (METHODS OF GENETIC ANALYSIS OF MOUSE) - sequence listing, part 13

SEQ ID NO: 483295 - DNA, 25 bp, Mus musculus
gagctgcttccgcattcaacagcag

SEQ ID NO: 483296 - DNA, 25 bp, Mus musculus
gagctgcttccggattcaacagcag

SEQ ID NO: 483297 - DNA, 25 bp, Mus musculus
gagctgcttccgtctttagatcaag

SEQ ID NO: 483298 - DNA, 25 bp, Mus musculus
gagctgcttcgcctagaattggcag

SEQ ID NO: 483299 - DNA, 25 bp, Mus musculus
gagctgcttcgcgtagaattggcag

SEQ ID NO: 483300 - DNA, 25 bp, Mus musculus
gagctgcttctgaagctctggtgtc

SEQ ID NO: 483301 - DNA, 25 bp, Mus musculus
gagctgcttctgtagctctggtgtc

SEQ ID NO: 483302 - DNA, 25 bp, Mus musculus
gagctgcttgctcagaacgcttgca

SEQ ID NO: 483303 - DNA, 25 bp, Mus musculus
gagctgcttgctgagaacgcttgca

SEQ ID NO: 483304 - DNA, 25 bp, Mus musculus
gagctgcttggtctggatcccctag

SEQ ID NO: 483305 - DNA, 25 bp, Mus musculus
gagctgcttggtgtggatcccctag

SEQ ID NO: 483306 - DNA, 25 bp, Mus musculus
gagctgcttgtcaaacaaacagggc

SEQ ID NO: 483307 - DNA, 25 bp, Mus musculus
gagctgcttgtctaacaaacagggc

SEQ ID NO: 483308 - DNA, 25 bp, Mus musculus
gagctgctttagagtgtccgcaaca

SEQ ID NO: 483309 - DNA, 25 bp, Mus musculus
gagctgctttagtgtgtccgcaaca

SEQ ID NO: 483310 - DNA, 25 bp, Mus musculus
gagctgctttttagggattatcttt

SEQ ID NO: 483311 - DNA, 25 bp, Mus musculus
gagctgcttttttgggattatcttt

SEQ ID NO: 483312 - DNA, 25 bp, Mus musculus
gagctggaaactcctctagagagga

SEQ ID NO: 483313 - DNA, 25 bp, Mus musculus
gagctggaaactgctctagagagga

SEQ ID NO: 483314 - DNA, 25 bp, Mus musculus
gagctggaaataccaatgcccattg

SEQ ID NO: 483315 - DNA, 25 bp, Mus musculus
gagctggaaatagcaatgcccattg

SEQ ID NO: 483316 - DNA, 25 bp, Mus musculus
gagctggaacacaaaagcccattag

SEQ ID NO: 483317 - DNA, 25 bp, Mus musculus
gagctggaacacaaaggcagactag

SEQ ID NO: 483318 - DNA, 25 bp, Mus musculus
gagctggaacactaaagcccattag

SEQ ID NO: 483319 - DNA, 25 bp, Mus musculus
gagctggaacactaaggcagactag

SEQ ID NO: 483320 - DNA, 25 bp, Mus musculus
gagctggaaccaagttgtagacctt

SEQ ID NO: 483321 - DNA, 25 bp, Mus musculus
gagctggaaccatgttgtagacctt

SEQ ID NO: 483322 - DNA, 25 bp, Mus musculus
gagctggaacttattgccattctac

SEQ ID NO: 483323 - DNA, 25 bp, Mus musculus
gagctggaactttttgccattctac

SEQ ID NO: 483324 - DNA, 25 bp, Mus musculus
gagctggaagagatctccgtgggcg

SEQ ID NO: 483325 - DNA, 25 bp, Mus musculus
gagctggaagagttctccgtgggcg

SEQ ID NO: 483326 - DNA, 25 bp, Mus musculus
gagctggaagcacggttacctccta

SEQ ID NO: 483327 - DNA, 25 bp, Mus musculus
gagctggaagcagggttacctccta

SEQ ID NO: 483328 - DNA, 25 bp, Mus musculus
gagctggaagctactgccaataata

SEQ ID NO: 483329 - DNA, 25 bp, Mus musculus
gagctggaagcttctgccaataata

SEQ ID NO: 483330 - DNA, 25 bp, Mus musculus
gagctggaatcccttgatcttctag

SEQ ID NO: 483331 - DNA, 25 bp, Mus musculus
gagctggaatccgttgatcttctag

SEQ ID NO: 483332 - DNA, 25 bp, Mus musculus
gagctggacattaccgcgggagaca

SEQ ID NO: 483333 - DNA, 25 bp, Mus musculus
gagctggacatttccgcgggagaca

SEQ ID NO: 483334 - DNA, 25 bp, Mus musculus
gagctggaccagcatctggcagcaa

SEQ ID NO: 483335 - DNA, 25 bp, Mus musculus
gagctggaccaggatctggcagcaa

SEQ ID NO: 483336 - DNA, 25 bp, Mus musculus
gagctggaccatcaacagacccgca

SEQ ID NO: 483337 - DNA, 25 bp, Mus musculus
gagctggaccatgaacagacccgca

SEQ ID NO: 483338 - DNA, 25 bp, Mus musculus
gagctggaccctcgcgatgtgataa

SEQ ID NO: 483339 - DNA, 25 bp, Mus musculus
gagctggaccctggcgatgtgataa

SEQ ID NO: 483340 - DNA, 25 bp, Mus musculus
gagctggaccggactgggtttaatc

SEQ ID NO: 483341 - DNA, 25 bp, Mus musculus
gagctggaccggtctgggtttaatc

SEQ ID NO: 483342 - DNA, 25 bp, Mus musculus
gagctggacttcaaatgcactgttc

SEQ ID NO: 483343 - DNA, 25 bp, Mus musculus
gagctggacttcagactatcgaggt

SEQ ID NO: 483344 - DNA, 25 bp, Mus musculus
gagctggacttctaatgcactgttc

SEQ ID NO: 483345 - DNA, 25 bp, Mus musculus
gagctggacttctgactatcgaggt

SEQ ID NO: 483346 - DNA, 25 bp, Mus musculus
gagctggagaccaagtcccgagtga

SEQ ID NO: 483347 - DNA, 25 bp, Mus musculus
gagctggagacctagtcccgagtga

SEQ ID NO: 483348 - DNA, 25 bp, Mus musculus
gagctggagactcgactctaactca

SEQ ID NO: 483349 - DNA, 25 bp, Mus musculus
gagctggagactggactctaactca

SEQ ID NO: 483350 - DNA, 25 bp, Mus musculus
gagctggagcccaacggtgtttgct

SEQ ID NO: 483351 - DNA, 25 bp, Mus musculus
gagctggagccctacggtgtttgct

SEQ ID NO: 483352 - DNA, 25 bp, Mus musculus
gagctggagccgcagtcttccacag

SEQ ID NO: 483353 - DNA, 25 bp, Mus musculus
gagctggagccggagtcttccacag

SEQ ID NO: 483354 - DNA, 25 bp, Mus musculus
gagctggagcgccagatccgcatca

SEQ ID NO: 483355 - DNA, 25 bp, Mus musculus
gagctggagcgcgagatccgcatca

SEQ ID NO: 483356 - DNA, 25 bp, Mus musculus
gagctggagcgtcactacggcctac

SEQ ID NO: 483357 - DNA, 25 bp, Mus musculus
gagctggagcgtgactacggcctac

SEQ ID NO: 483358 - DNA, 25 bp, Mus musculus
gagctggagcttaacaattggtgta

SEQ ID NO: 483359 - DNA, 25 bp, Mus musculus
gagctggagcttattgcttctaacc

SEQ ID NO: 483360 - DNA, 25 bp, Mus musculus
gagctggagctttacaattggtgta

SEQ ID NO: 483361 - DNA, 25 bp, Mus musculus
gagctggagctttttgcttctaacc

SEQ ID NO: 483362 - DNA, 25 bp, Mus musculus
gagctggaggatatctcccactcag

SEQ ID NO: 483363 - DNA, 25 bp, Mus musculus
gagctggaggatttctcccactcag

SEQ ID NO: 483364 - DNA, 25 bp, Mus musculus
gagctggaggcgacatcttagtgat

SEQ ID NO: 483365 - DNA, 25 bp, Mus musculus
gagctggaggcgtcatcttagtgat

SEQ ID NO: 483366 - DNA, 25 bp, Mus musculus
gagctggatccaaacaatttgtgcc

SEQ ID NO: 483367 - DNA, 25 bp, Mus musculus
gagctggatccatacaatttgtgcc

SEQ ID NO: 483368 - DNA, 25 bp, Mus musculus
gagctggatgcccttcatgaagccc

SEQ ID NO: 483369 - DNA, 25 bp, Mus musculus
gagctggatgccgttcatgaagccc

SEQ ID NO: 483370 - DNA, 25 bp, Mus musculus
gagctggattccatagggggccaaa

SEQ ID NO: 483371 - DNA, 25 bp, Mus musculus
gagctggattccttagggggccaaa

SEQ ID NO: 483372 - DNA, 25 bp, Mus musculus
gagctggattctaacccagacagtg

SEQ ID NO: 483373 - DNA, 25 bp, Mus musculus
gagctggattcttacccagacagtg

SEQ ID NO: 483374 - DNA, 25 bp, Mus musculus
gagctggattgcataacctgggcta

SEQ ID NO: 483375 - DNA, 25 bp, Mus musculus
gagctggattgcttaacctgggcta

SEQ ID NO: 483376 - DNA, 25 bp, Mus musculus
gagctggcaaagacaccaagtctgc

SEQ ID NO: 483377 - DNA, 25 bp, Mus musculus
gagctggcaaagtcaccaagtctgc

SEQ ID NO: 483378 - DNA, 25 bp, Mus musculus
gagctggcaaccacgctgcgggtat

SEQ ID NO: 483379 - DNA, 25 bp, Mus musculus
gagctggcaacctcgctgcgggtat

SEQ ID NO: 483380 - DNA, 25 bp, Mus musculus
gagctggcacacatcgatgaagaaa

SEQ ID NO: 483381 - DNA, 25 bp, Mus musculus
gagctggcacacttcgatgaagaaa

SEQ ID NO: 483382 - DNA, 25 bp, Mus musculus
gagctggcacagcacagtgaatctc

SEQ ID NO: 483383 - DNA, 25 bp, Mus musculus
gagctggcacaggacagtgaatctc

SEQ ID NO: 483384 - DNA, 25 bp, Mus musculus
gagctggcagaaccttggtcccacc

SEQ ID NO: 483385 - DNA, 25 bp, Mus musculus
gagctggcagaagcttggtcccacc

SEQ ID NO: 483386 - DNA, 25 bp, Mus musculus
gagctggcagctagttgcacatggc

SEQ ID NO: 483387 - DNA, 25 bp, Mus musculus
gagctggcagcttgttgcacatggc

SEQ ID NO: 483388 - DNA, 25 bp, Mus musculus
gagctggcaggtctacagctctgcc

SEQ ID NO: 483389 - DNA, 25 bp, Mus musculus
gagctggcaggtgtacagctctgcc

SEQ ID NO: 483390 - DNA, 25 bp, Mus musculus
gagctggcatgcctgcaatttacac

SEQ ID NO: 483391 - DNA, 25 bp, Mus musculus
gagctggcatgcgtgcaatttacac

SEQ ID NO: 483392 - DNA, 25 bp, Mus musculus
gagctggcattaacgtgggctacac

SEQ ID NO: 483393 - DNA, 25 bp, Mus musculus
gagctggcattatcgtgggctacac

SEQ ID NO: 483394 - DNA, 25 bp, Mus musculus
gagctggccagaacggacacggtta

SEQ ID NO: 483395 - DNA, 25 bp, Mus musculus
gagctggccagatcggacacggtta

SEQ ID NO: 483396 - DNA, 25 bp, Mus musculus
gagctggccataattttaggtttct

SEQ ID NO: 483397 - DNA, 25 bp, Mus musculus
gagctggccatacacttcatctgat

SEQ ID NO: 483398 - DNA, 25 bp, Mus musculus
gagctggccatagacttcatctgat

SEQ ID NO: 483399 - DNA, 25 bp, Mus musculus
gagctggccatatttttaggtttct

SEQ ID NO: 483400 - DNA, 25 bp, Mus musculus
gagctggcccagaatggcatcattt

SEQ ID NO: 483401 - DNA, 25 bp, Mus musculus
gagctggcccagtatggcatcattt

SEQ ID NO: 483402 - DNA, 25 bp, Mus musculus
gagctggcccggatggtttctgtcc

SEQ ID NO: 483403 - DNA, 25 bp, Mus musculus
gagctggcccggttggtttctgtcc

SEQ ID NO: 483404 - DNA, 25 bp, Mus musculus
gagctggccctgacatttggttaag

SEQ ID NO: 483405 - DNA, 25 bp, Mus musculus
gagctggccctgtcatttggttaag

SEQ ID NO: 483406 - DNA, 25 bp, Mus musculus
gagctggccgtgatatccctgaaag

SEQ ID NO: 483407 - DNA, 25 bp, Mus musculus
gagctggccgtgttatccctgaaag

SEQ ID NO: 483408 - DNA, 25 bp, Mus musculus
gagctggcctatcataatttgcaca

SEQ ID NO: 483409 - DNA, 25 bp, Mus musculus
gagctggcctatgataatttgcaca

SEQ ID NO: 483410 - DNA, 25 bp, Mus musculus
gagctggcctctctgctgagagaat

SEQ ID NO: 483411 - DNA, 25 bp, Mus musculus
gagctggcctctgtgctgagagaat

SEQ ID NO: 483412 - DNA, 25 bp, Mus musculus
gagctggcctgactcattggcacaa

SEQ ID NO: 483413 - DNA, 25 bp, Mus musculus
gagctggcctgagtcattggcacaa

SEQ ID NO: 483414 - DNA, 25 bp, Mus musculus
gagctggcctgcaggtcagcctctc

SEQ ID NO: 483415 - DNA, 25 bp, Mus musculus
gagctggcctgctggtcagcctctc

SEQ ID NO: 483416 - DNA, 25 bp, Mus musculus
gagctggcgctcaaagagcgcatcc

SEQ ID NO: 483417 - DNA, 25 bp, Mus musculus
gagctggcgctctaagagcgcatcc

SEQ ID NO: 483418 - DNA, 25 bp, Mus musculus
gagctggcggacatctctgatgtag

SEQ ID NO: 483419 - DNA, 25 bp, Mus musculus
gagctggcggacttctctgatgtag

SEQ ID NO: 483420 - DNA, 25 bp, Mus musculus
gagctggcgggcaagattgtttttt

SEQ ID NO: 483421 - DNA, 25 bp, Mus musculus
gagctggcgggctagattgtttttt

SEQ ID NO: 483422 - DNA, 25 bp, Mus musculus
gagctggctaagagcaagatcgaca

SEQ ID NO: 483423 - DNA, 25 bp, Mus musculus
gagctggctaagtgcaagatcgaca

SEQ ID NO: 483424 - DNA, 25 bp, Mus musculus
gagctggctatcaaaatttacttta

SEQ ID NO: 483425 - DNA, 25 bp, Mus musculus
gagctggctatctaaatttacttta

SEQ ID NO: 483426 - DNA, 25 bp, Mus musculus
gagctggctctgaactaggagacaa

SEQ ID NO: 483427 - DNA, 25 bp, Mus musculus
gagctggctctgtactaggagacaa

SEQ ID NO: 483428 - DNA, 25 bp, Mus musculus
gagctggctgcaaatttcacggaga

SEQ ID NO: 483429 - DNA, 25 bp, Mus musculus
gagctggctgcatatttcacggaga

SEQ ID NO: 483430 - DNA, 25 bp, Mus musculus
gagctggctgccatcacaaagaacc

SEQ ID NO: 483431 - DNA, 25 bp, Mus musculus
gagctggctgccatggttgtatcca

SEQ ID NO: 483432 - DNA, 25 bp, Mus musculus
gagctggctgccttcacaaagaacc

SEQ ID NO: 483433 - DNA, 25 bp, Mus musculus
gagctggctgccttggttgtatcca

SEQ ID NO: 483434 - DNA, 25 bp, Mus musculus
gagctggctggaactgcgacgtctt

SEQ ID NO: 483435 - DNA, 25 bp, Mus musculus
gagctggctggatctgcgacgtctt

SEQ ID NO: 483436 - DNA, 25 bp, Mus musculus
gagctggcttaaactagactgtggg

SEQ ID NO: 483437 - DNA, 25 bp, Mus musculus
gagctggcttaatctagactgtggg

SEQ ID NO: 483438 - DNA, 25 bp, Mus musculus
gagctggcttgcagatcttctgtaa

SEQ ID NO: 483439 - DNA, 25 bp, Mus musculus
gagctggcttgctgatcttctgtaa

SEQ ID NO: 483440 - DNA, 25 bp, Mus musculus
gagctgggaaacactgttgcctgct

SEQ ID NO: 483441 - DNA, 25 bp, Mus musculus
gagctgggaaactctgttgcctgct

SEQ ID NO: 483442 - DNA, 25 bp, Mus musculus
gagctgggaacgactcacggataaa

SEQ ID NO: 483443 - DNA, 25 bp, Mus musculus
gagctgggaacgtctcacggataaa

SEQ ID NO: 483444 - DNA, 25 bp, Mus musculus
gagctgggaactcaatgcaccctct

SEQ ID NO: 483445 - DNA, 25 bp, Mus musculus
gagctgggaactgaatgcaccctct

SEQ ID NO: 483446 - DNA, 25 bp, Mus musculus
gagctgggaccgacatcaaaactta

SEQ ID NO: 483447 - DNA, 25 bp, Mus musculus
gagctgggaccgtcatcaaaactta

SEQ ID NO: 483448 - DNA, 25 bp, Mus musculus
gagctgggatgaaggaatcacaact

SEQ ID NO: 483449 - DNA, 25 bp, Mus musculus
gagctgggatgatggaatcacaact

SEQ ID NO: 483450 - DNA, 25 bp, Mus musculus
gagctgggcaaacacattcttggaa

SEQ ID NO: 483451 - DNA, 25 bp, Mus musculus
gagctgggcaaagacattcttggaa

SEQ ID NO: 483452 - DNA, 25 bp, Mus musculus
gagctgggcacacaacatgcactta

SEQ ID NO: 483453 - DNA, 25 bp, Mus musculus
gagctgggcacagaacatgcactta

SEQ ID NO: 483454 - DNA, 25 bp, Mus musculus
gagctgggcagaaactactctctat

SEQ ID NO: 483455 - DNA, 25 bp, Mus musculus
gagctgggcagatactactctctat

SEQ ID NO: 483456 - DNA, 25 bp, Mus musculus
gagctgggcatcacctggccagcac

SEQ ID NO: 483457 - DNA, 25 bp, Mus musculus
gagctgggcatctcctggccagcac

SEQ ID NO: 483458 - DNA, 25 bp, Mus musculus
gagctgggcattataaggcctaact

SEQ ID NO: 483459 - DNA, 25 bp, Mus musculus
gagctgggcattttaaggcctaact

SEQ ID NO: 483460 - DNA, 25 bp, Mus musculus
gagctgggccctagtgtatgtatac

SEQ ID NO: 483461 - DNA, 25 bp, Mus musculus
gagctgggcccttgtgtatgtatac

SEQ ID NO: 483462 - DNA, 25 bp, Mus musculus
gagctgggcctaaccaagagtgcct

SEQ ID NO: 483463 - DNA, 25 bp, Mus musculus
gagctgggcctatccaagagtgcct

SEQ ID NO: 483464 - DNA, 25 bp, Mus musculus
gagctgggcgacatccatatgcaac

SEQ ID NO: 483465 - DNA, 25 bp, Mus musculus
gagctgggcgacttccatatgcaac

SEQ ID NO: 483466 - DNA, 25 bp, Mus musculus
gagctgggctacagctgtgacagat

SEQ ID NO: 483467 - DNA, 25 bp, Mus musculus
gagctgggctactgctgtgacagat

SEQ ID NO: 483468 - DNA, 25 bp, Mus musculus
gagctgggctgacacaccaccggaa

SEQ ID NO: 483469 - DNA, 25 bp, Mus musculus
gagctgggctgagacaccaccggaa

SEQ ID NO: 483470 - DNA, 25 bp, Mus musculus
gagctgggctgtactaagctaccca

SEQ ID NO: 483471 - DNA, 25 bp, Mus musculus
gagctgggctgttctaagctaccca

SEQ ID NO: 483472 - DNA, 25 bp, Mus musculus
gagctgggcttacgccttgctttac

SEQ ID NO: 483473 - DNA, 25 bp, Mus musculus
gagctgggcttaggccttgctttac

SEQ ID NO: 483474 - DNA, 25 bp, Mus musculus
gagctgggcttcaagcggtacaaca

SEQ ID NO: 483475 - DNA, 25 bp, Mus musculus
gagctgggcttctagcggtacaaca

SEQ ID NO: 483476 - DNA, 25 bp, Mus musculus
gagctgggctttcactacggtgacc

SEQ ID NO: 483477 - DNA, 25 bp, Mus musculus
gagctgggctttgactacggtgacc

SEQ ID NO: 483478 - DNA, 25 bp, Mus musculus
gagctgggtcataaaagccttccat

SEQ ID NO: 483479 - DNA, 25 bp, Mus musculus
gagctgggtcattaaagccttccat

SEQ ID NO: 483480 - DNA, 25 bp, Mus musculus
gagctgggtcctcccaaagtgtcag

SEQ ID NO: 483481 - DNA, 25 bp, Mus musculus
gagctgggtcctgccaaagtgtcag

SEQ ID NO: 483482 - DNA, 25 bp, Mus musculus
gagctgggtcgtaagtttgccctaa

SEQ ID NO: 483483 - DNA, 25 bp, Mus musculus
gagctgggtcgttagtttgccctaa

SEQ ID NO: 483484 - DNA, 25 bp, Mus musculus
gagctgggtcttcccgttttaggat

SEQ ID NO: 483485 - DNA, 25 bp, Mus musculus
gagctgggtcttgccgttttaggat

SEQ ID NO: 483486 - DNA, 25 bp, Mus musculus
gagctgggtgaaatcatctcttctt

SEQ ID NO: 483487 - DNA, 25 bp, Mus musculus
gagctgggtgaattcatctcttctt

SEQ ID NO: 483488 - DNA, 25 bp, Mus musculus
gagctgggttatccaatttctgatg

SEQ ID NO: 483489 - DNA, 25 bp, Mus musculus
gagctgggttatgcaatttctgatg

SEQ ID NO: 483490 - DNA, 25 bp, Mus musculus
gagctgggttctcaaaaagttacaa

SEQ ID NO: 483491 - DNA, 25 bp, Mus musculus
gagctgggttctgaaaaagttacaa

SEQ ID NO: 483492 - DNA, 25 bp, Mus musculus
gagctgggtttgaaagccctcttat

SEQ ID NO: 483493 - DNA, 25 bp, Mus musculus
gagctgggtttgtaagccctcttat

SEQ ID NO: 483494 - DNA, 25 bp, Mus musculus
gagctggtactcaaagtgaggattc

SEQ ID NO: 483495 - DNA, 25 bp, Mus musculus
gagctggtactctaagtgaggattc

SEQ ID NO: 483496 - DNA, 25 bp, Mus musculus
gagctggtacttacctctgagagca

SEQ ID NO: 483497 - DNA, 25 bp, Mus musculus
gagctggtactttcctctgagagca

SEQ ID NO: 483498 - DNA, 25 bp, Mus musculus
gagctggtatgacagctgaagccta

SEQ ID NO: 483499 - DNA, 25 bp, Mus musculus
gagctggtatgagagctgaagccta

SEQ ID NO: 483500 - DNA, 25 bp, Mus musculus
gagctggtcaccaagatcgaccaca

SEQ ID NO: 483501 - DNA, 25 bp, Mus musculus
gagctggtcacctagatcgaccaca

SEQ ID NO: 483502 - DNA, 25 bp, Mus musculus
gagctggtccatctgcttaattggt

SEQ ID NO: 483503 - DNA, 25 bp, Mus musculus
gagctggtccatgtgcttaattggt

SEQ ID NO: 483504 - DNA, 25 bp, Mus musculus
gagctggtcccacaatgggtctgtt

SEQ ID NO: 483505 - DNA, 25 bp, Mus musculus
gagctggtcccagaatgggtctgtt

SEQ ID NO: 483506 - DNA, 25 bp, Mus musculus
gagctggtccccatggttgaattgg

SEQ ID NO: 483507 - DNA, 25 bp, Mus musculus
gagctggtccccttggttgaattgg

SEQ ID NO: 483508 - DNA, 25 bp, Mus musculus
gagctggtcgagactcattctttac

SEQ ID NO: 483509 - DNA, 25 bp, Mus musculus
gagctggtcgagtctcattctttac

SEQ ID NO: 483510 - DNA, 25 bp, Mus musculus
gagctggtctagattatcatgtaaa

SEQ ID NO: 483511 - DNA, 25 bp, Mus musculus
gagctggtctagtttatcatgtaaa

SEQ ID NO: 483512 - DNA, 25 bp, Mus musculus
gagctggtctgaacaggcgagacat

SEQ ID NO: 483513 - DNA, 25 bp, Mus musculus
gagctggtctgatcaggcgagacat

SEQ ID NO: 483514 - DNA, 25 bp, Mus musculus
gagctggtctttccaaccaacttca

SEQ ID NO: 483515 - DNA, 25 bp, Mus musculus
gagctggtctttgcaaccaacttca

SEQ ID NO: 483516 - DNA, 25 bp, Mus musculus
gagctggtgaccatctggagtcagc

SEQ ID NO: 483517 - DNA, 25 bp, Mus musculus
gagctggtgaccttctggagtcagc

SEQ ID NO: 483518 - DNA, 25 bp, Mus musculus
gagctggtgagcacacatggctact

SEQ ID NO: 483519 - DNA, 25 bp, Mus musculus
gagctggtgagctcacatggctact

SEQ ID NO: 483520 - DNA, 25 bp, Mus musculus
gagctggtgcgacactacctggatc

SEQ ID NO: 483521 - DNA, 25 bp, Mus musculus
gagctggtgcgagactacctggatc

SEQ ID NO: 483522 - DNA, 25 bp, Mus musculus
gagctggtggctaacatgttctgta

SEQ ID NO: 483523 - DNA, 25 bp, Mus musculus
gagctggtggcttacatgttctgta

SEQ ID NO: 483524 - DNA, 25 bp, Mus musculus
gagctggtgtgaccttgacactttt

SEQ ID NO: 483525 - DNA, 25 bp, Mus musculus
gagctggtgtgagcttgacactttt

SEQ ID NO: 483526 - DNA, 25 bp, Mus musculus
gagctggttcctaacagaggcgcat

SEQ ID NO: 483527 - DNA, 25 bp, Mus musculus
gagctggttccttacagaggcgcat

SEQ ID NO: 483528 - DNA, 25 bp, Mus musculus
gagctggttcgaagaggccaagttc

SEQ ID NO: 483529 - DNA, 25 bp, Mus musculus
gagctggttcgatgaggccaagttc

SEQ ID NO: 483530 - DNA, 25 bp, Mus musculus
gagctggttctgacctgtcactaag

SEQ ID NO: 483531 - DNA, 25 bp, Mus musculus
gagctggttctgtcctgtcactaag

SEQ ID NO: 483532 - DNA, 25 bp, Mus musculus
gagctggtttctcatccacaggatt

SEQ ID NO: 483533 - DNA, 25 bp, Mus musculus
gagctggtttctgatccacaggatt

SEQ ID NO: 483534 - DNA, 25 bp, Mus musculus
gagctgtaaaagactactgaccata

SEQ ID NO: 483535 - DNA, 25 bp, Mus musculus
gagctgtaaaagtctactgaccata

SEQ ID NO: 483536 - DNA, 25 bp, Mus musculus
gagctgtaacatcagagtagaggca

SEQ ID NO: 483537 - DNA, 25 bp, Mus musculus
gagctgtaacatgagagtagaggca

SEQ ID NO: 483538 - DNA, 25 bp, Mus musculus
gagctgtaaggtcagaccctatttc

SEQ ID NO: 483539 - DNA, 25 bp, Mus musculus
gagctgtaaggtgagaccctatttc

SEQ ID NO: 483540 - DNA, 25 bp, Mus musculus
gagctgtaagtgctctcagcttttg

SEQ ID NO: 483541 - DNA, 25 bp, Mus musculus
gagctgtaagtggtctcagcttttg

SEQ ID NO: 483542 - DNA, 25 bp, Mus musculus
gagctgtaattcacatggcgattta

SEQ ID NO: 483543 - DNA, 25 bp, Mus musculus
gagctgtaattctcatggcgattta

SEQ ID NO: 483544 - DNA, 25 bp, Mus musculus
gagctgtacaagatcggaatcacgt

SEQ ID NO: 483545 - DNA, 25 bp, Mus musculus
gagctgtacaagttcggaatcacgt

SEQ ID NO: 483546 - DNA, 25 bp, Mus musculus
gagctgtacagcatgcatgagtact

SEQ ID NO: 483547 - DNA, 25 bp, Mus musculus
gagctgtacagcttgcatgagtact

SEQ ID NO: 483548 - DNA, 25 bp, Mus musculus
gagctgtacaggagacgactttagt

SEQ ID NO: 483549 - DNA, 25 bp, Mus musculus
gagctgtacaggtgacgactttagt

SEQ ID NO: 483550 - DNA, 25 bp, Mus musculus
gagctgtaccagctggcttttcaga

SEQ ID NO: 483551 - DNA, 25 bp, Mus musculus
gagctgtaccaggtggcttttcaga

SEQ ID NO: 483552 - DNA, 25 bp, Mus musculus
gagctgtactaaccacttactctag

SEQ ID NO: 483553 - DNA, 25 bp, Mus musculus
gagctgtactaagcacttactctag

SEQ ID NO: 483554 - DNA, 25 bp, Mus musculus
gagctgtactgcatactcaggacaa

SEQ ID NO: 483555 - DNA, 25 bp, Mus musculus
gagctgtactgcttactcaggacaa

SEQ ID NO: 483556 - DNA, 25 bp, Mus musculus
gagctgtagaatagttacctatctt

SEQ ID NO: 483557 - DNA, 25 bp, Mus musculus
gagctgtagaattgttacctatctt

SEQ ID NO: 483558 - DNA, 25 bp, Mus musculus
gagctgtagccaatgggacactgta

SEQ ID NO: 483559 - DNA, 25 bp, Mus musculus
gagctgtagccattgggacactgta

SEQ ID NO: 483560 - DNA, 25 bp, Mus musculus
gagctgtagtaccattagaaactgt

SEQ ID NO: 483561 - DNA, 25 bp, Mus musculus
gagctgtagtacgattagaaactgt

SEQ ID NO: 483562 - DNA, 25 bp, Mus musculus
gagctgtagtcaaaaattcttcatt

SEQ ID NO: 483563 - DNA, 25 bp, Mus musculus
gagctgtagtcataaattcttcatt

SEQ ID NO: 483564 - DNA, 25 bp, Mus musculus
gagctgtagttaagaagcccaaggc

SEQ ID NO: 483565 - DNA, 25 bp, Mus musculus
gagctgtagttatgaagcccaaggc

SEQ ID NO: 483566 - DNA, 25 bp, Mus musculus
gagctgtatagtcctctacctagtt

SEQ ID NO: 483567 - DNA, 25 bp, Mus musculus
gagctgtatagtgctctacctagtt

SEQ ID NO: 483568 - DNA, 25 bp, Mus musculus
gagctgtatcctcttaaactttgag

SEQ ID NO: 483569 - DNA, 25 bp, Mus musculus
gagctgtatcctgttaaactttgag

SEQ ID NO: 483570 - DNA, 25 bp, Mus musculus
gagctgtatgcccaggaaatatttc

SEQ ID NO: 483571 - DNA, 25 bp, Mus musculus
gagctgtatgccgaggaaatatttc

SEQ ID NO: 483572 - DNA, 25 bp, Mus musculus
gagctgtatggacccttcaccagtg

SEQ ID NO: 483573 - DNA, 25 bp, Mus musculus
gagctgtatggagccttcaccagtg

SEQ ID NO: 483574 - DNA, 25 bp, Mus musculus
gagctgtattgtcagacgcacgcga

SEQ ID NO: 483575 - DNA, 25 bp, Mus musculus
gagctgtattgtcatgcatgtccca

SEQ ID NO: 483576 - DNA, 25 bp, Mus musculus
gagctgtattgtgagacgcacgcga

SEQ ID NO: 483577 - DNA, 25 bp, Mus musculus
gagctgtattgtgatgcatgtccca

SEQ ID NO: 483578 - DNA, 25 bp, Mus musculus
gagctgtcaaaaaatagagtcccaa

SEQ ID NO: 483579 - DNA, 25 bp, Mus musculus
gagctgtcaaaatatagagtcccaa

SEQ ID NO: 483580 - DNA, 25 bp, Mus musculus
gagctgtcaaggatgatggtcctaa

SEQ ID NO: 483581 - DNA, 25 bp, Mus musculus
gagctgtcaaggttgatggtcctaa

SEQ ID NO: 483582 - DNA, 25 bp, Mus musculus
gagctgtcaccaagtcggagaaatt

SEQ ID NO: 483583 - DNA, 25 bp, Mus musculus
gagctgtcaccatgtcggagaaatt

SEQ ID NO: 483584 - DNA, 25 bp, Mus musculus
gagctgtcacgaaaggagaagctga

SEQ ID NO: 483585 - DNA, 25 bp, Mus musculus
gagctgtcacgataggagaagctga

SEQ ID NO: 483586 - DNA, 25 bp, Mus musculus
gagctgtcagcccaaattgagcttg

SEQ ID NO: 483587 - DNA, 25 bp, Mus musculus
gagctgtcagccgaaattgagcttg

SEQ ID NO: 483588 - DNA, 25 bp, Mus musculus
gagctgtcagctccctaagaaatca

SEQ ID NO: 483589 - DNA, 25 bp, Mus musculus
gagctgtcagctcctgagtataact

SEQ ID NO: 483590 - DNA, 25 bp, Mus musculus
gagctgtcagctgcctaagaaatca

SEQ ID NO: 483591 - DNA, 25 bp, Mus musculus
gagctgtcagctgctgagtataact

SEQ ID NO: 483592 - DNA, 25 bp, Mus musculus
gagctgtcaggcacgtcaggcctca

SEQ ID NO: 483593 - DNA, 25 bp, Mus musculus
gagctgtcaggctcgtcaggcctca

SEQ ID NO: 483594 - DNA, 25 bp, Mus musculus
gagctgtcatcaatcagtgagcccc

SEQ ID NO: 483595 - DNA, 25 bp, Mus musculus
gagctgtcatcattcagtgagcccc

SEQ ID NO: 483596 - DNA, 25 bp, Mus musculus
gagctgtccaaacgcgagtctgtgt

SEQ ID NO: 483597 - DNA, 25 bp, Mus musculus
gagctgtccaaaggcgagtctgtgt

SEQ ID NO: 483598 - DNA, 25 bp, Mus musculus
gagctgtccagaagaaatgccactt

SEQ ID NO: 483599 - DNA, 25 bp, Mus musculus
gagctgtccagatgaaatgccactt

SEQ ID NO: 483600 - DNA, 25 bp, Mus musculus
gagctgtccagcatggcagattgca

SEQ ID NO: 483601 - DNA, 25 bp, Mus musculus
gagctgtccagcttggcagattgca

SEQ ID NO: 483602 - DNA, 25 bp, Mus musculus
gagctgtccagtccacgagtgacta

SEQ ID NO: 483603 - DNA, 25 bp, Mus musculus
gagctgtccagtgcacgagtgacta

SEQ ID NO: 483604 - DNA, 25 bp, Mus musculus
gagctgtccctgcttttaattgtat

SEQ ID NO: 483605 - DNA, 25 bp, Mus musculus
gagctgtccctggttttaattgtat

SEQ ID NO: 483606 - DNA, 25 bp, Mus musculus
gagctgtcctaaagtattgattttc

SEQ ID NO: 483607 - DNA, 25 bp, Mus musculus
gagctgtcctaatgtattgattttc

SEQ ID NO: 483608 - DNA, 25 bp, Mus musculus
gagctgtcgacaaatccgagtccaa

SEQ ID NO: 483609 - DNA, 25 bp, Mus musculus
gagctgtcgacatatccgagtccaa

SEQ ID NO: 483610 - DNA, 25 bp, Mus musculus
gagctgtcgatcacccagtggtggt

SEQ ID NO: 483611 - DNA, 25 bp, Mus musculus
gagctgtcgatctcccagtggtggt

SEQ ID NO: 483612 - DNA, 25 bp, Mus musculus
gagctgtctaaactccatctgctgc

SEQ ID NO: 483613 - DNA, 25 bp, Mus musculus
gagctgtctaaagtccatctgctgc

SEQ ID NO: 483614 - DNA, 25 bp, Mus musculus
gagctgtctaaccaggatgcttcac

SEQ ID NO: 483615 - DNA, 25 bp, Mus musculus
gagctgtctaacgaggatgcttcac

SEQ ID NO: 483616 - DNA, 25 bp, Mus musculus
gagctgtctactcagaggtcttaag

SEQ ID NO: 483617 - DNA, 25 bp, Mus musculus
gagctgtctactgagaggtcttaag

SEQ ID NO: 483618 - DNA, 25 bp, Mus musculus
gagctgtctagcctctaatttgtag

SEQ ID NO: 483619 - DNA, 25 bp, Mus musculus
gagctgtctagcgtctaatttgtag

SEQ ID NO: 483620 - DNA, 25 bp, Mus musculus
gagctgtctcagcagatcaacatga

SEQ ID NO: 483621 - DNA, 25 bp, Mus musculus
gagctgtctcaggagatcaacatga

SEQ ID NO: 483622 - DNA, 25 bp, Mus musculus
gagctgtctcctagaactggactct

SEQ ID NO: 483623 - DNA, 25 bp, Mus musculus
gagctgtctccttgaactggactct

SEQ ID NO: 483624 - DNA, 25 bp, Mus musculus
gagctgtctctgaacaaagcatgaa

SEQ ID NO: 483625 - DNA, 25 bp, Mus musculus
gagctgtctctgtacaaagcatgaa

SEQ ID NO: 483626 - DNA, 25 bp, Mus musculus
gagctgtctgaacgcatggcttcct

SEQ ID NO: 483627 - DNA, 25 bp, Mus musculus
gagctgtctgaaggcatggcttcct

SEQ ID NO: 483628 - DNA, 25 bp, Mus musculus
gagctgtctgtcatgtgagacccaa

SEQ ID NO: 483629 - DNA, 25 bp, Mus musculus
gagctgtctgtcttgtgagacccaa

SEQ ID NO: 483630 - DNA, 25 bp, Mus musculus
gagctgtctgttccaaaactctctc

SEQ ID NO: 483631 - DNA, 25 bp, Mus musculus
gagctgtctgttgcaaaactctctc

SEQ ID NO: 483632 - DNA, 25 bp, Mus musculus
gagctgtcttagagtaggcacgcct

SEQ ID NO: 483633 - DNA, 25 bp, Mus musculus
gagctgtcttagtgtaggcacgcct

SEQ ID NO: 483634 - DNA, 25 bp, Mus musculus
gagctgtcttatctgtcatagtcca

SEQ ID NO: 483635 - DNA, 25 bp, Mus musculus
gagctgtcttatgtgtcatagtcca

SEQ ID NO: 483636 - DNA, 25 bp, Mus musculus
gagctgtcttttacacccttgaatt

SEQ ID NO: 483637 - DNA, 25 bp, Mus musculus
gagctgtctttttcacccttgaatt

SEQ ID NO: 483638 - DNA, 25 bp, Mus musculus
gagctgtgacaaaggccagtctttt

SEQ ID NO: 483639 - DNA, 25 bp, Mus musculus
gagctgtgacaatggccagtctttt

SEQ ID NO: 483640 - DNA, 25 bp, Mus musculus
gagctgtgacacaattccctaatgt

SEQ ID NO: 483641 - DNA, 25 bp, Mus musculus
gagctgtgacactattccctaatgt

SEQ ID NO: 483642 - DNA, 25 bp, Mus musculus
gagctgtgacagatgtgacggcaaa

SEQ ID NO: 483643 - DNA, 25 bp, Mus musculus
gagctgtgacagttgtgacggcaaa

SEQ ID NO: 483644 - DNA, 25 bp, Mus musculus
gagctgtgactcagttgcttcatta

SEQ ID NO: 483645 - DNA, 25 bp, Mus musculus
gagctgtgactcattattggattca

SEQ ID NO: 483646 - DNA, 25 bp, Mus musculus
gagctgtgactctgttgcttcatta

SEQ ID NO: 483647 - DNA, 25 bp, Mus musculus
gagctgtgactctttattggattca

SEQ ID NO: 483648 - DNA, 25 bp, Mus musculus
gagctgtgaggtcagttttgctaaa

SEQ ID NO: 483649 - DNA, 25 bp, Mus musculus
gagctgtgaggtgagttttgctaaa

SEQ ID NO: 483650 - DNA, 25 bp, Mus musculus
gagctgtgcagcagacctgtataga

SEQ ID NO: 483651 - DNA, 25 bp, Mus musculus
gagctgtgcagctgacctgtataga

SEQ ID NO: 483652 - DNA, 25 bp, Mus musculus
gagctgtgccagatgctagacacat

SEQ ID NO: 483653 - DNA, 25 bp, Mus musculus
gagctgtgccagttgctagacacat

SEQ ID NO: 483654 - DNA, 25 bp, Mus musculus
gagctgtgcgccaaagatgcagttc

SEQ ID NO: 483655 - DNA, 25 bp, Mus musculus
gagctgtgcgcctaagatgcagttc

SEQ ID NO: 483656 - DNA, 25 bp, Mus musculus
gagctgtggaccctaccatgtgata

SEQ ID NO: 483657 - DNA, 25 bp, Mus musculus
gagctgtggaccgtaccatgtgata

SEQ ID NO: 483658 - DNA, 25 bp, Mus musculus
gagctgtggctcaagtttcaaggta

SEQ ID NO: 483659 - DNA, 25 bp, Mus musculus
gagctgtggctctagtttcaaggta

SEQ ID NO: 483660 - DNA, 25 bp, Mus musculus
gagctgtgggatctgcctacatttt

SEQ ID NO: 483661 - DNA, 25 bp, Mus musculus
gagctgtgggatgtgcctacatttt

SEQ ID NO: 483662 - DNA, 25 bp, Mus musculus
gagctgtgggccagggtcctacacc

SEQ ID NO: 483663 - DNA, 25 bp, Mus musculus
gagctgtgggcctgggtcctacacc

SEQ ID NO: 483664 - DNA, 25 bp, Mus musculus
gagctgtggtgcatagccggtattc

SEQ ID NO: 483665 - DNA, 25 bp, Mus musculus
gagctgtggtgcttagccggtattc

SEQ ID NO: 483666 - DNA, 25 bp, Mus musculus
gagctgtgtacacaggtttgccgct

SEQ ID NO: 483667 - DNA, 25 bp, Mus musculus
gagctgtgtacagaggtttgccgct

SEQ ID NO: 483668 - DNA, 25 bp, Mus musculus
gagctgtgtccaaccagacgggcta

SEQ ID NO: 483669 - DNA, 25 bp, Mus musculus
gagctgtgtccatccagacgggcta

SEQ ID NO: 483670 - DNA, 25 bp, Mus musculus
gagctgtgtgaaagtccagagttac

SEQ ID NO: 483671 - DNA, 25 bp, Mus musculus
gagctgtgtgaatgtccagagttac

SEQ ID NO: 483672 - DNA, 25 bp, Mus musculus
gagctgtgttcaccatgtgagccat

SEQ ID NO: 483673 - DNA, 25 bp, Mus musculus
gagctgtgttcagcatgtgagccat

SEQ ID NO: 483674 - DNA, 25 bp, Mus musculus
gagctgtgttttcaggtggtaacct

SEQ ID NO: 483675 - DNA, 25 bp, Mus musculus
gagctgtgttttgaggtggtaacct

SEQ ID NO: 483676 - DNA, 25 bp, Mus musculus
gagctgttagtcagatagtcaaaat

SEQ ID NO: 483677 - DNA, 25 bp, Mus musculus
gagctgttagtctgatagtcaaaat

SEQ ID NO: 483678 - DNA, 25 bp, Mus musculus
gagctgttatgcagtttcctagcta

SEQ ID NO: 483679 - DNA, 25 bp, Mus musculus
gagctgttatgctgtttcctagcta

SEQ ID NO: 483680 - DNA, 25 bp, Mus musculus
gagctgttattaatccacatggttt

SEQ ID NO: 483681 - DNA, 25 bp, Mus musculus
gagctgttattattccacatggttt

SEQ ID NO: 483682 - DNA, 25 bp, Mus musculus
gagctgttcaagatcaccattggta

SEQ ID NO: 483683 - DNA, 25 bp, Mus musculus
gagctgttcaagttcaccattggta

SEQ ID NO: 483684 - DNA, 25 bp, Mus musculus
gagctgttcaggacaccaggattct

SEQ ID NO: 483685 - DNA, 25 bp, Mus musculus
gagctgttcaggtcaccaggattct

SEQ ID NO: 483686 - DNA, 25 bp, Mus musculus
gagctgttcccaaggtagaaggcag

SEQ ID NO: 483687 - DNA, 25 bp, Mus musculus
gagctgttcccatggtagaaggcag

SEQ ID NO: 483688 - DNA, 25 bp, Mus musculus
gagctgttccctactgtaacccgga

SEQ ID NO: 483689 - DNA, 25 bp, Mus musculus
gagctgttccctcccaataaacaaa

SEQ ID NO: 483690 - DNA, 25 bp, Mus musculus
gagctgttccctgccaataaacaaa

SEQ ID NO: 483691 - DNA, 25 bp, Mus musculus
gagctgttcccttctgtaacccgga

SEQ ID NO: 483692 - DNA, 25 bp, Mus musculus
gagctgttctatagcgatcaaccct

SEQ ID NO: 483693 - DNA, 25 bp, Mus musculus
gagctgttctattgcgatcaaccct

SEQ ID NO: 483694 - DNA, 25 bp, Mus musculus
gagctgttgaagataccctgactta

SEQ ID NO: 483695 - DNA, 25 bp, Mus musculus
gagctgttgaagttaccctgactta

SEQ ID NO: 483696 - DNA, 25 bp, Mus musculus
gagctgttgcgtactgtatcatatt

SEQ ID NO: 483697 - DNA, 25 bp, Mus musculus
gagctgttgcgttctgtatcatatt

SEQ ID NO: 483698 - DNA, 25 bp, Mus musculus
gagctgttgctgaacccctgaagct

SEQ ID NO: 483699 - DNA, 25 bp, Mus musculus
gagctgttgctgtacccctgaagct

SEQ ID NO: 483700 - DNA, 25 bp, Mus musculus
gagctgttggttcatgaataggccc

SEQ ID NO: 483701 - DNA, 25 bp, Mus musculus
gagctgttggttgatgaataggccc

SEQ ID NO: 483702 - DNA, 25 bp, Mus musculus
gagctgttgtgacatgtccaggccc

SEQ ID NO: 483703 - DNA, 25 bp, Mus musculus
gagctgttgtgagatgtccaggccc

SEQ ID NO: 483704 - DNA, 25 bp, Mus musculus
gagctgtttagaaacattgattggt

SEQ ID NO: 483705 - DNA, 25 bp, Mus musculus
gagctgtttagatacattgattggt

SEQ ID NO: 483706 - DNA, 25 bp, Mus musculus
gagctgtttagtctgaaatataggt

SEQ ID NO: 483707 - DNA, 25 bp, Mus musculus
gagctgtttagtgtgaaatataggt

SEQ ID NO: 483708 - DNA, 25 bp, Mus musculus
gagctgtttcaaagttaccgtcttt

SEQ ID NO: 483709 - DNA, 25 bp, Mus musculus
gagctgtttcaatgttaccgtcttt

SEQ ID NO: 483710 - DNA, 25 bp, Mus musculus
gagctgtttcataggaattccggta

SEQ ID NO: 483711 - DNA, 25 bp, Mus musculus
gagctgtttcatcgcgctgagagca

SEQ ID NO: 483712 - DNA, 25 bp, Mus musculus
gagctgtttcatggcgctgagagca

SEQ ID NO: 483713 - DNA, 25 bp, Mus musculus
gagctgtttcattggaattccggta

SEQ ID NO: 483714 - DNA, 25 bp, Mus musculus
gagctgtttcttcagcctagaaact

SEQ ID NO: 483715 - DNA, 25 bp, Mus musculus
gagctgtttcttcaggccctatgaa

SEQ ID NO: 483716 - DNA, 25 bp, Mus musculus
gagctgtttcttgagcctagaaact

SEQ ID NO: 483717 - DNA, 25 bp, Mus musculus
gagctgtttcttgaggccctatgaa

SEQ ID NO: 483718 - DNA, 25 bp, Mus musculus
gagctgtttgataagacatgctttt

SEQ ID NO: 483719 - DNA, 25 bp, Mus musculus
gagctgtttgattagacatgctttt

SEQ ID NO: 483720 - DNA, 25 bp, Mus musculus
gagctgtttgcaacatgtctgttga

SEQ ID NO: 483721 - DNA, 25 bp, Mus musculus
gagctgtttgcatcatgtctgttga

SEQ ID NO: 483722 - DNA, 25 bp, Mus musculus
gagctgttttatcgcattgtcttga

SEQ ID NO: 483723 - DNA, 25 bp, Mus musculus
gagctgttttatctccaatggctgt

SEQ ID NO: 483724 - DNA, 25 bp, Mus musculus
gagctgttttatggcattgtcttga

SEQ ID NO: 483725 - DNA, 25 bp, Mus musculus
gagctgttttatgtccaatggctgt

SEQ ID NO: 483726 - DNA, 25 bp, Mus musculus
gagctgttttcgctgatggttgtca

SEQ ID NO: 483727 - DNA, 25 bp, Mus musculus
gagctgttttcggtgatggttgtca

SEQ ID NO: 483728 - DNA, 25 bp, Mus musculus
gagctgttttggacctaaactgtaa

SEQ ID NO: 483729 - DNA, 25 bp, Mus musculus
gagctgttttggtcctaaactgtaa

SEQ ID NO: 483730 - DNA, 25 bp, Mus musculus
gagcttaaaaacatgttcacactac

SEQ ID NO: 483731 - DNA, 25 bp, Mus musculus
gagcttaaaaacttgttcacactac

SEQ ID NO: 483732 - DNA, 25 bp, Mus musculus
gagcttaaaaatcctttcttacttt

SEQ ID NO: 483733 - DNA, 25 bp, Mus musculus
gagcttaaaaatgctttcttacttt

SEQ ID NO: 483734 - DNA, 25 bp, Mus musculus
gagcttaaaccccttgtatatttgc

SEQ ID NO: 483735 - DNA, 25 bp, Mus musculus
gagcttaaacccgttgtatatttgc

SEQ ID NO: 483736 - DNA, 25 bp, Mus musculus
gagcttaaccctacctggactgctg

SEQ ID NO: 483737 - DNA, 25 bp, Mus musculus
gagcttaacccttcctggactgctg

SEQ ID NO: 483738 - DNA, 25 bp, Mus musculus
gagcttaacttcagtcgtcaatgag

SEQ ID NO: 483739 - DNA, 25 bp, Mus musculus
gagcttaacttctgtcgtcaatgag

SEQ ID NO: 483740 - DNA, 25 bp, Mus musculus
gagcttaaggtaccacgtgtgccac

SEQ ID NO: 483741 - DNA, 25 bp, Mus musculus
gagcttaaggtagcacgtgtgccac

SEQ ID NO: 483742 - DNA, 25 bp, Mus musculus
gagcttaatcaaaagtgcacagttt

SEQ ID NO: 483743 - DNA, 25 bp, Mus musculus
gagcttaatcaatagtgcacagttt

SEQ ID NO: 483744 - DNA, 25 bp, Mus musculus
gagcttaatctccatgaaggccacg

SEQ ID NO: 483745 - DNA, 25 bp, Mus musculus
gagcttaatctcgatgaaggccacg

SEQ ID NO: 483746 - DNA, 25 bp, Mus musculus
gagcttaatggcaaacagcaggttt

SEQ ID NO: 483747 - DNA, 25 bp, Mus musculus
gagcttaatggctaacagcaggttt

SEQ ID NO: 483748 - DNA, 25 bp, Mus musculus
gagcttaattctattcaacgtgaac

SEQ ID NO: 483749 - DNA, 25 bp, Mus musculus
gagcttaattcttttcaacgtgaac

SEQ ID NO: 483750 - DNA, 25 bp, Mus musculus
gagcttacacatcgcttcaaaatag

SEQ ID NO: 483751 - DNA, 25 bp, Mus musculus
gagcttacacatggcttcaaaatag

SEQ ID NO: 483752 - DNA, 25 bp, Mus musculus
gagcttacagacattatcctggcca

SEQ ID NO: 483753 - DNA, 25 bp, Mus musculus
gagcttacagactttatcctggcca

SEQ ID NO: 483754 - DNA, 25 bp, Mus musculus
gagcttacagtacacctctaaagga

SEQ ID NO: 483755 - DNA, 25 bp, Mus musculus
gagcttacagtagacctctaaagga

SEQ ID NO: 483756 - DNA, 25 bp, Mus musculus
gagcttacagtgaacctggaagagg

SEQ ID NO: 483757 - DNA, 25 bp, Mus musculus
gagcttacagtgtacctggaagagg

SEQ ID NO: 483758 - DNA, 25 bp, Mus musculus
gagcttaccaagcactaccaaggcg

SEQ ID NO: 483759 - DNA, 25 bp, Mus musculus
gagcttaccaagcatgcaggccaag

SEQ ID NO: 483760 - DNA, 25 bp, Mus musculus
gagcttaccaaggactaccaaggcg

SEQ ID NO: 483761 - DNA, 25 bp, Mus musculus
gagcttaccaaggatgcaggccaag

SEQ ID NO: 483762 - DNA, 25 bp, Mus musculus
gagcttacccacaaatgacaggact

SEQ ID NO: 483763 - DNA, 25 bp, Mus musculus
gagcttacccactaatgacaggact

SEQ ID NO: 483764 - DNA, 25 bp, Mus musculus
gagcttactaacatattttcctgca

SEQ ID NO: 483765 - DNA, 25 bp, Mus musculus
gagcttactaacttattttcctgca

SEQ ID NO: 483766 - DNA, 25 bp, Mus musculus
gagcttactgagatcttttcctgga

SEQ ID NO: 483767 - DNA, 25 bp, Mus musculus
gagcttactgagttcttttcctgga

SEQ ID NO: 483768 - DNA, 25 bp, Mus musculus
gagcttactgtcactactgttcctg

SEQ ID NO: 483769 - DNA, 25 bp, Mus musculus
gagcttactgtctctactgttcctg

SEQ ID NO: 483770 - DNA, 25 bp, Mus musculus
gagcttacttccctggtggttataa

SEQ ID NO: 483771 - DNA, 25 bp, Mus musculus
gagcttacttccgtggtggttataa

SEQ ID NO: 483772 - DNA, 25 bp, Mus musculus
gagcttactttgaagtctctgtttt

SEQ ID NO: 483773 - DNA, 25 bp, Mus musculus
gagcttactttgtagtctctgtttt

SEQ ID NO: 483774 - DNA, 25 bp, Mus musculus
gagcttagaaagacactcactctga

SEQ ID NO: 483775 - DNA, 25 bp, Mus musculus
gagcttagaaagtcactcactctga

SEQ ID NO: 483776 - DNA, 25 bp, Mus musculus
gagcttagacctactgattcctaca

SEQ ID NO: 483777 - DNA, 25 bp, Mus musculus
gagcttagaccttctgattcctaca

SEQ ID NO: 483778 - DNA, 25 bp, Mus musculus
gagcttagactcatgtttcttccaa

SEQ ID NO: 483779 - DNA, 25 bp, Mus musculus
gagcttagactcttgtttcttccaa

SEQ ID NO: 483780 - DNA, 25 bp, Mus musculus
gagcttagagagatcttctttcgaa

SEQ ID NO: 483781 - DNA, 25 bp, Mus musculus
gagcttagagagttcttctttcgaa

SEQ ID NO: 483782 - DNA, 25 bp, Mus musculus
gagcttagatcccagcctgaaaagg

SEQ ID NO: 483783 - DNA, 25 bp, Mus musculus
gagcttagatccgagcctgaaaagg

SEQ ID NO: 483784 - DNA, 25 bp, Mus musculus
gagcttagcaccatgaaccttcctc

SEQ ID NO: 483785 - DNA, 25 bp, Mus musculus
gagcttagcaccttgaaccttcctc

SEQ ID NO: 483786 - DNA, 25 bp, Mus musculus
gagcttagcatacaggatgactggg

SEQ ID NO: 483787 - DNA, 25 bp, Mus musculus
gagcttagcatagaggatgactggg

SEQ ID NO: 483788 - DNA, 25 bp, Mus musculus
gagcttagcatcatcgcatgtcttt

SEQ ID NO: 483789 - DNA, 25 bp, Mus musculus
gagcttagcatcttcgcatgtcttt

SEQ ID NO: 483790 - DNA, 25 bp, Mus musculus
gagcttagctatcccttctatggat

SEQ ID NO: 483791 - DNA, 25 bp, Mus musculus
gagcttagctatgccttctatggat

SEQ ID NO: 483792 - DNA, 25 bp, Mus musculus
gagcttaggaaacccagccctggaa

SEQ ID NO: 483793 - DNA, 25 bp, Mus musculus
gagcttaggaaagccagccctggaa

SEQ ID NO: 483794 - DNA, 25 bp, Mus musculus
gagcttaggatgaggcttattaccc

SEQ ID NO: 483795 - DNA, 25 bp, Mus musculus
gagcttaggatgtggcttattaccc

SEQ ID NO: 483796 - DNA, 25 bp, Mus musculus
gagcttagggtacttctatttcatt

SEQ ID NO: 483797 - DNA, 25 bp, Mus musculus
gagcttagggtagttctatttcatt

SEQ ID NO: 483798 - DNA, 25 bp, Mus musculus
gagcttaggtatctggtacttccta

SEQ ID NO: 483799 - DNA, 25 bp, Mus musculus
gagcttaggtatgtggtacttccta

SEQ ID NO: 483800 - DNA, 25 bp, Mus musculus
gagcttagtcctagttattagatac

SEQ ID NO: 483801 - DNA, 25 bp, Mus musculus
gagcttagtccttgttattagatac

SEQ ID NO: 483802 - DNA, 25 bp, Mus musculus
gagcttagtttcatagctaccaaga

SEQ ID NO: 483803 - DNA, 25 bp, Mus musculus
gagcttagtttcttagctaccaaga

SEQ ID NO: 483804 - DNA, 25 bp, Mus musculus
gagcttatcaatagttagcttttgt

SEQ ID NO: 483805 - DNA, 25 bp, Mus musculus
gagcttatcaattgttagcttttgt

SEQ ID NO: 483806 - DNA, 25 bp, Mus musculus
gagcttatccggagacaaaccctgg

SEQ ID NO: 483807 - DNA, 25 bp, Mus musculus
gagcttatccggtgacaaaccctgg

SEQ ID NO: 483808 - DNA, 25 bp, Mus musculus
gagcttatctgaagacttcacacct

SEQ ID NO: 483809 - DNA, 25 bp, Mus musculus
gagcttatctgatgacttcacacct

SEQ ID NO: 483810 - DNA, 25 bp, Mus musculus
gagcttatgcatctacttctgagaa

SEQ ID NO: 483811 - DNA, 25 bp, Mus musculus
gagcttatgcatgtacttctgagaa

SEQ ID NO: 483812 - DNA, 25 bp, Mus musculus
gagcttatgctaaatattttaggga

SEQ ID NO: 483813 - DNA, 25 bp, Mus musculus
gagcttatgctatatattttaggga

SEQ ID NO: 483814 - DNA, 25 bp, Mus musculus
gagcttatgctcagaacaacagtgt

SEQ ID NO: 483815 - DNA, 25 bp, Mus musculus
gagcttatgctctgaacaacagtgt

SEQ ID NO: 483816 - DNA, 25 bp, Mus musculus
gagcttatgcttatactatgaccct

SEQ ID NO: 483817 - DNA, 25 bp, Mus musculus
gagcttatgcttatcagctatactt

SEQ ID NO: 483818 - DNA, 25 bp, Mus musculus
gagcttatgcttttactatgaccct

SEQ ID NO: 483819 - DNA, 25 bp, Mus musculus
gagcttatgcttttcagctatactt

SEQ ID NO: 483820 - DNA, 25 bp, Mus musculus
gagcttatggagcataatgcctgag

SEQ ID NO: 483821 - DNA, 25 bp, Mus musculus
gagcttatggaggataatgcctgag

SEQ ID NO: 483822 - DNA, 25 bp, Mus musculus
gagcttatggctccgtgaaggcaaa

SEQ ID NO: 483823 - DNA, 25 bp, Mus musculus
gagcttatggctgcgtgaaggcaaa

SEQ ID NO: 483824 - DNA, 25 bp, Mus musculus
gagcttatgggtcgccaggatcaac

SEQ ID NO: 483825 - DNA, 25 bp, Mus musculus
gagcttatgggtggccaggatcaac

SEQ ID NO: 483826 - DNA, 25 bp, Mus musculus
gagcttatgtctctatgatttgagg

SEQ ID NO: 483827 - DNA, 25 bp, Mus musculus
gagcttatgtctgtatgatttgagg

SEQ ID NO: 483828 - DNA, 25 bp, Mus musculus
gagcttattatgctaccccaggctg

SEQ ID NO: 483829 - DNA, 25 bp, Mus musculus
gagcttattatggtaccccaggctg

SEQ ID NO: 483830 - DNA, 25 bp, Mus musculus
gagcttattccaaccaactgtgtat

SEQ ID NO: 483831 - DNA, 25 bp, Mus musculus
gagcttattccatccaactgtgtat

SEQ ID NO: 483832 - DNA, 25 bp, Mus musculus
gagcttattgctaggtgtgtatctg

SEQ ID NO: 483833 - DNA, 25 bp, Mus musculus
gagcttattgcttggtgtgtatctg

SEQ ID NO: 483834 - DNA, 25 bp, Mus musculus
gagcttatttctacacatactctgt

SEQ ID NO: 483835 - DNA, 25 bp, Mus musculus
gagcttatttcttcacatactctgt

SEQ ID NO: 483836 - DNA, 25 bp, Mus musculus
gagcttattttcagtcaactatatt

SEQ ID NO: 483837 - DNA, 25 bp, Mus musculus
gagcttattttctgtcaactatatt

SEQ ID NO: 483838 - DNA, 25 bp, Mus musculus
gagcttcaagaaatatcccgactat

SEQ ID NO: 483839 - DNA, 25 bp, Mus musculus
gagcttcaagaattatcccgactat

SEQ ID NO: 483840 - DNA, 25 bp, Mus musculus
gagcttcaagctacaggagtgttag

SEQ ID NO: 483841 - DNA, 25 bp, Mus musculus
gagcttcaagctatgacctttggtc

SEQ ID NO: 483842 - DNA, 25 bp, Mus musculus
gagcttcaagcttcaggagtgttag

SEQ ID NO: 483843 - DNA, 25 bp, Mus musculus
gagcttcaagctttgacctttggtc

SEQ ID NO: 483844 - DNA, 25 bp, Mus musculus
gagcttcaatgacacagactcctct

SEQ ID NO: 483845 - DNA, 25 bp, Mus musculus
gagcttcaatgagacagactcctct

SEQ ID NO: 483846 - DNA, 25 bp, Mus musculus
gagcttcacagtcctttgagtggtt

SEQ ID NO: 483847 - DNA, 25 bp, Mus musculus
gagcttcacagtgctttgagtggtt

SEQ ID NO: 483848 - DNA, 25 bp, Mus musculus
gagcttcacattcaacactggctga

SEQ ID NO: 483849 - DNA, 25 bp, Mus musculus
gagcttcacattgaacactggctga

SEQ ID NO: 483850 - DNA, 25 bp, Mus musculus
gagcttcaccctcgctgccttgtgg

SEQ ID NO: 483851 - DNA, 25 bp, Mus musculus
gagcttcaccctggctgccttgtgg

SEQ ID NO: 483852 - DNA, 25 bp, Mus musculus
gagcttcacggaatctccttgggaa

SEQ ID NO: 483853 - DNA, 25 bp, Mus musculus
gagcttcacggattctccttgggaa

SEQ ID NO: 483854 - DNA, 25 bp, Mus musculus
gagcttcagaacaagtccctggtcc

SEQ ID NO: 483855 - DNA, 25 bp, Mus musculus
gagcttcagaactagtccctggtcc

SEQ ID NO: 483856 - DNA, 25 bp, Mus musculus
gagcttcagacaagcagactctgtt

SEQ ID NO: 483857 - DNA, 25 bp, Mus musculus
gagcttcagacatgcagactctgtt

SEQ ID NO: 483858 - DNA, 25 bp, Mus musculus
gagcttcagagcatgctatgtcatt

SEQ ID NO: 483859 - DNA, 25 bp, Mus musculus
gagcttcagagcttgctatgtcatt

SEQ ID NO: 483860 - DNA, 25 bp, Mus musculus
gagcttcagcagagatacgcggatt

SEQ ID NO: 483861 - DNA, 25 bp, Mus musculus
gagcttcagcagtgatacgcggatt

SEQ ID NO: 483862 - DNA, 25 bp, Mus musculus
gagcttcagcttcagtgtgtcattc

SEQ ID NO: 483863 - DNA, 25 bp, Mus musculus
gagcttcagcttgagtgtgtcattc

SEQ ID NO: 483864 - DNA, 25 bp, Mus musculus
gagcttcaggaactgtcattatcca

SEQ ID NO: 483865 - DNA, 25 bp, Mus musculus
gagcttcaggaagtgtcattatcca

SEQ ID NO: 483866 - DNA, 25 bp, Mus musculus
gagcttcaggcccagtgtgcatcct

SEQ ID NO: 483867 - DNA, 25 bp, Mus musculus
gagcttcaggccgagtgtgcatcct

SEQ ID NO: 483868 - DNA, 25 bp, Mus musculus
gagcttcagggaatctgcacgatgg

SEQ ID NO: 483869 - DNA, 25 bp, Mus musculus
gagcttcagggattctgcacgatgg

SEQ ID NO: 483870 - DNA, 25 bp, Mus musculus
gagcttcagggtactccgggaagca

SEQ ID NO: 483871 - DNA, 25 bp, Mus musculus
gagcttcagggttctccgggaagca

SEQ ID NO: 483872 - DNA, 25 bp, Mus musculus
gagcttcaggttcatggacacttat

SEQ ID NO: 483873 - DNA, 25 bp, Mus musculus
gagcttcaggttgatggacacttat

SEQ ID NO: 483874 - DNA, 25 bp, Mus musculus
gagcttcagttcaattatctcatga

SEQ ID NO: 483875 - DNA, 25 bp, Mus musculus
gagcttcagttctattatctcatga

SEQ ID NO: 483876 - DNA, 25 bp, Mus musculus
gagcttcagtttaacaacctggcca

SEQ ID NO: 483877 - DNA, 25 bp, Mus musculus
gagcttcagttttacaacctggcca

SEQ ID NO: 483878 - DNA, 25 bp, Mus musculus
gagcttcatatactaatgctgattt

SEQ ID NO: 483879 - DNA, 25 bp, Mus musculus
gagcttcatatagtaatgctgattt

SEQ ID NO: 483880 - DNA, 25 bp, Mus musculus
gagcttcatgagagccaataccttc

SEQ ID NO: 483881 - DNA, 25 bp, Mus musculus
gagcttcatgagtgccaataccttc

SEQ ID NO: 483882 - DNA, 25 bp, Mus musculus
gagcttcatgccatatcatattcaa

SEQ ID NO: 483883 - DNA, 25 bp, Mus musculus
gagcttcatgccctggatcaaaaga

SEQ ID NO: 483884 - DNA, 25 bp, Mus musculus
gagcttcatgccgtggatcaaaaga

SEQ ID NO: 483885 - DNA, 25 bp, Mus musculus
gagcttcatgccttatcatattcaa

SEQ ID NO: 483886 - DNA, 25 bp, Mus musculus
gagcttcatgtccacattgtctttg

SEQ ID NO: 483887 - DNA, 25 bp, Mus musculus
gagcttcatgtcgacattgtctttg

SEQ ID NO: 483888 - DNA, 25 bp, Mus musculus
gagcttcattaaatatttttctgga

SEQ ID NO: 483889 - DNA, 25 bp, Mus musculus
gagcttcattaattatttttctgga

SEQ ID NO: 483890 - DNA, 25 bp, Mus musculus
gagcttcattgtatccctttatgtg

SEQ ID NO: 483891 - DNA, 25 bp, Mus musculus
gagcttcattgtattgggttctaaa

SEQ ID NO: 483892 - DNA, 25 bp, Mus musculus
gagcttcattgtttccctttatgtg

SEQ ID NO: 483893 - DNA, 25 bp, Mus musculus
gagcttcattgttttgggttctaaa

SEQ ID NO: 483894 - DNA, 25 bp, Mus musculus
gagcttccaaacagagagtggatgc

SEQ ID NO: 483895 - DNA, 25 bp, Mus musculus
gagcttccaaactgagagtggatgc

SEQ ID NO: 483896 - DNA, 25 bp, Mus musculus
gagcttccaaatagacttccatacc

SEQ ID NO: 483897 - DNA, 25 bp, Mus musculus
gagcttccaaattgacttccatacc

SEQ ID NO: 483898 - DNA, 25 bp, Mus musculus
gagcttccaaggactgattaatagt

SEQ ID NO: 483899 - DNA, 25 bp, Mus musculus
gagcttccaaggtctgattaatagt

SEQ ID NO: 483900 - DNA, 25 bp, Mus musculus
gagcttccaagtacctcagattata

SEQ ID NO: 483901 - DNA, 25 bp, Mus musculus
gagcttccaagttcctcagattata

SEQ ID NO: 483902 - DNA, 25 bp, Mus musculus
gagcttccaatacatcccaagttga

SEQ ID NO: 483903 - DNA, 25 bp, Mus musculus
gagcttccaatagatcccaagttga

SEQ ID NO: 483904 - DNA, 25 bp, Mus musculus
gagcttccacctcctattacagatt

SEQ ID NO: 483905 - DNA, 25 bp, Mus musculus
gagcttccacctgctattacagatt

SEQ ID NO: 483906 - DNA, 25 bp, Mus musculus
gagcttccagaacaggtccaaaagg

SEQ ID NO: 483907 - DNA, 25 bp, Mus musculus
gagcttccagaagaggtccaaaagg

SEQ ID NO: 483908 - DNA, 25 bp, Mus musculus
gagcttccagctcatagcaaatcat

SEQ ID NO: 483909 - DNA, 25 bp, Mus musculus
gagcttccagctgatagcaaatcat

SEQ ID NO: 483910 - DNA, 25 bp, Mus musculus
gagcttccaggaagtctactttgta

SEQ ID NO: 483911 - DNA, 25 bp, Mus musculus
gagcttccaggatgtctactttgta

SEQ ID NO: 483912 - DNA, 25 bp, Mus musculus
gagcttccagtcatgtgacgggatt

SEQ ID NO: 483913 - DNA, 25 bp, Mus musculus
gagcttccagtcttgtgacgggatt

SEQ ID NO: 483914 - DNA, 25 bp, Mus musculus
gagcttccagtgaacccgcaggccg

SEQ ID NO: 483915 - DNA, 25 bp, Mus musculus
gagcttccagtgtacccgcaggccg

SEQ ID NO: 483916 - DNA, 25 bp, Mus musculus
gagcttccatagagggacacccaga

SEQ ID NO: 483917 - DNA, 25 bp, Mus musculus
gagcttccatagtgggacacccaga

SEQ ID NO: 483918 - DNA, 25 bp, Mus musculus
gagcttcccaaactgaggctgtcgg

SEQ ID NO: 483919 - DNA, 25 bp, Mus musculus
gagcttcccaaagtgaggctgtcgg

SEQ ID NO: 483920 - DNA, 25 bp, Mus musculus
gagcttcccaagagttccccatgaa

SEQ ID NO: 483921 - DNA, 25 bp, Mus musculus
gagcttcccaagtgttccccatgaa

SEQ ID NO: 483922 - DNA, 25 bp, Mus musculus
gagcttcccagaccaaaaaaggcag

SEQ ID NO: 483923 - DNA, 25 bp, Mus musculus
gagcttcccagagcaaaaaaggcag

SEQ ID NO: 483924 - DNA, 25 bp, Mus musculus
gagcttccccaaaggccagtaacag

SEQ ID NO: 483925 - DNA, 25 bp, Mus musculus
gagcttccccaatggccagtaacag

SEQ ID NO: 483926 - DNA, 25 bp, Mus musculus
gagcttcccgcaccagaactggaaa

SEQ ID NO: 483927 - DNA, 25 bp, Mus musculus
gagcttcccgcagcagaactggaaa

SEQ ID NO: 483928 - DNA, 25 bp, Mus musculus
gagcttcccggaattctttcttcac

SEQ ID NO: 483929 - DNA, 25 bp, Mus musculus
gagcttcccggaccggcatggtaaa

SEQ ID NO: 483930 - DNA, 25 bp, Mus musculus
gagcttcccggagcggcatggtaaa

SEQ ID NO: 483931 - DNA, 25 bp, Mus musculus
gagcttcccggatttctttcttcac

SEQ ID NO: 483932 - DNA, 25 bp, Mus musculus
gagcttcccgggagccctgaagcta

SEQ ID NO: 483933 - DNA, 25 bp, Mus musculus
gagcttcccgggtgccctgaagcta

SEQ ID NO: 483934 - DNA, 25 bp, Mus musculus
gagcttccggacatggttgcacccc

SEQ ID NO: 483935 - DNA, 25 bp, Mus musculus
gagcttccggacttggttgcacccc

SEQ ID NO: 483936 - DNA, 25 bp, Mus musculus
gagcttcctataatcccactttaaa

SEQ ID NO: 483937 - DNA, 25 bp, Mus musculus
gagcttcctatattcccactttaaa

SEQ ID NO: 483938 - DNA, 25 bp, Mus musculus
gagcttcctatgctcgaaggtgcaa

SEQ ID NO: 483939 - DNA, 25 bp, Mus musculus
gagcttcctatggtcgaaggtgcaa

SEQ ID NO: 483940 - DNA, 25 bp, Mus musculus
gagcttcctcacatggatgcaacat

SEQ ID NO: 483941 - DNA, 25 bp, Mus musculus
gagcttcctcacttggatgcaacat

SEQ ID NO: 483942 - DNA, 25 bp, Mus musculus
gagcttcctgctcaatgcttgagat

SEQ ID NO: 483943 - DNA, 25 bp, Mus musculus
gagcttcctgctcgcttctaaaagg

SEQ ID NO: 483944 - DNA, 25 bp, Mus musculus
gagcttcctgctgaatgcttgagat

SEQ ID NO: 483945 - DNA, 25 bp, Mus musculus
gagcttcctgctggcttctaaaagg

SEQ ID NO: 483946 - DNA, 25 bp, Mus musculus
gagcttcctggtactcggatatcca

SEQ ID NO: 483947 - DNA, 25 bp, Mus musculus
gagcttcctggtactgtcttgcatc

SEQ ID NO: 483948 - DNA, 25 bp, Mus musculus
gagcttcctggttctcggatatcca

SEQ ID NO: 483949 - DNA, 25 bp, Mus musculus
gagcttcctggttctgtcttgcatc

SEQ ID NO: 483950 - DNA, 25 bp, Mus musculus
gagcttccttacaagtttgttcttc

SEQ ID NO: 483951 - DNA, 25 bp, Mus musculus
gagcttccttactagtttgttcttc

SEQ ID NO: 483952 - DNA, 25 bp, Mus musculus
gagcttccttccattatgcatgcta

SEQ ID NO: 483953 - DNA, 25 bp, Mus musculus
gagcttccttcctttatgcatgcta

SEQ ID NO: 483954 - DNA, 25 bp, Mus musculus
gagcttccttgtattcaagtgtgct

SEQ ID NO: 483955 - DNA, 25 bp, Mus musculus
gagcttccttgttttcaagtgtgct

SEQ ID NO: 483956 - DNA, 25 bp, Mus musculus
gagcttcgcaataaggaacgcatct

SEQ ID NO: 483957 - DNA, 25 bp, Mus musculus
gagcttcgcaattaggaacgcatct

SEQ ID NO: 483958 - DNA, 25 bp, Mus musculus
gagcttcgcagcaggagacgtcact

SEQ ID NO: 483959 - DNA, 25 bp, Mus musculus
gagcttcgcagctggagacgtcact

SEQ ID NO: 483960 - DNA, 25 bp, Mus musculus
gagcttcggagtcttccctgcacgt

SEQ ID NO: 483961 - DNA, 25 bp, Mus musculus
gagcttcggagtgttccctgcacgt

SEQ ID NO: 483962 - DNA, 25 bp, Mus musculus
gagcttcgggccaaagttcagaatg

SEQ ID NO: 483963 - DNA, 25 bp, Mus musculus
gagcttcgggcctaagttcagaatg

SEQ ID NO: 483964 - DNA, 25 bp, Mus musculus
gagcttcgggtcctgattgacgatt

SEQ ID NO: 483965 - DNA, 25 bp, Mus musculus
gagcttcgggtcgtgattgacgatt

SEQ ID NO: 483966 - DNA, 25 bp, Mus musculus
gagcttcgggtgactgggttctaca

SEQ ID NO: 483967 - DNA, 25 bp, Mus musculus
gagcttcgggtgtctgggttctaca

SEQ ID NO: 483968 - DNA, 25 bp, Mus musculus
gagcttcggtttagatacactgttt

SEQ ID NO: 483969 - DNA, 25 bp, Mus musculus
gagcttcggttttgatacactgttt

SEQ ID NO: 483970 - DNA, 25 bp, Mus musculus
gagcttcgtcaacctagtggaacat

SEQ ID NO: 483971 - DNA, 25 bp, Mus musculus
gagcttcgtcaagctagtggaacat

SEQ ID NO: 483972 - DNA, 25 bp, Mus musculus
gagcttcgttttctacacgtgtgac

SEQ ID NO: 483973 - DNA, 25 bp, Mus musculus
gagcttcgttttgtacacgtgtgac

SEQ ID NO: 483974 - DNA, 25 bp, Mus musculus
gagcttctacagaacgagatccagg

SEQ ID NO: 483975 - DNA, 25 bp, Mus musculus
gagcttctacagtacgagatccagg

SEQ ID NO: 483976 - DNA, 25 bp, Mus musculus
gagcttctactaacctccattaaag

SEQ ID NO: 483977 - DNA, 25 bp, Mus musculus
gagcttctactatcctccattaaag

SEQ ID NO: 483978 - DNA, 25 bp, Mus musculus
gagcttctagagacttgttcctact

SEQ ID NO: 483979 - DNA, 25 bp, Mus musculus
gagcttctagagtcttgttcctact

SEQ ID NO: 483980 - DNA, 25 bp, Mus musculus
gagcttctaggaccagccaggatgc

SEQ ID NO: 483981 - DNA, 25 bp, Mus musculus
gagcttctaggagcagccaggatgc

SEQ ID NO: 483982 - DNA, 25 bp, Mus musculus
gagcttctagtcctatgtaaacata

SEQ ID NO: 483983 - DNA, 25 bp, Mus musculus
gagcttctagtcgtatgtaaacata

SEQ ID NO: 483984 - DNA, 25 bp, Mus musculus
gagcttctcagaaactgtctcagta

SEQ ID NO: 483985 - DNA, 25 bp, Mus musculus
gagcttctcagatactgtctcagta

SEQ ID NO: 483986 - DNA, 25 bp, Mus musculus
gagcttctcataagagggtcccaga

SEQ ID NO: 483987 - DNA, 25 bp, Mus musculus
gagcttctcatatgagggtcccaga

SEQ ID NO: 483988 - DNA, 25 bp, Mus musculus
gagcttctcatcaccaaggctaaga

SEQ ID NO: 483989 - DNA, 25 bp, Mus musculus
gagcttctcatctccaaggctaaga

SEQ ID NO: 483990 - DNA, 25 bp, Mus musculus
gagcttctcccaacagtcctgatgg

SEQ ID NO: 483991 - DNA, 25 bp, Mus musculus
gagcttctcccatcagtcctgatgg

SEQ ID NO: 483992 - DNA, 25 bp, Mus musculus
gagcttctccggaagcgagacagca

SEQ ID NO: 483993 - DNA, 25 bp, Mus musculus
gagcttctccggtagcgagacagca

SEQ ID NO: 483994 - DNA, 25 bp, Mus musculus
gagcttctgaggctctccccagaat

SEQ ID NO: 483995 - DNA, 25 bp, Mus musculus
gagcttctgagggtctccccagaat

SEQ ID NO: 483996 - DNA, 25 bp, Mus musculus
gagcttctgcagactttgggagtcc

SEQ ID NO: 483997 - DNA, 25 bp, Mus musculus
gagcttctgcagtctttgggagtcc

SEQ ID NO: 483998 - DNA, 25 bp, Mus musculus
gagcttctggacataatcagggcca

SEQ ID NO: 483999 - DNA, 25 bp, Mus musculus
gagcttctggacttaatcagggcca

SEQ ID NO: 484000 - DNA, 25 bp, Mus musculus
gagcttctggccaatcaatacaaca

SEQ ID NO: 484001 - DNA, 25 bp, Mus musculus
gagcttctggcctatcaatacaaca

SEQ ID NO: 484002 - DNA, 25 bp, Mus musculus
gagcttcttgctatctaaacttact

SEQ ID NO: 484003 - DNA, 25 bp, Mus musculus
gagcttcttgctttctaaacttact

SEQ ID NO: 484004 - DNA, 25 bp, Mus musculus
gagcttctttaacttcctgctgtca

SEQ ID NO: 484005 - DNA, 25 bp, Mus musculus
gagcttctttaagttcctgctgtca

SEQ ID NO: 484006 - DNA, 25 bp, Mus musculus
gagcttctttatacatctctggcgc

SEQ ID NO: 484007 - DNA, 25 bp, Mus musculus
gagcttctttattcatctctggcgc

SEQ ID NO: 484008 - DNA, 25 bp, Mus musculus
gagcttgaagacaactcactgtatg

SEQ ID NO: 484009 - DNA, 25 bp, Mus musculus
gagcttgaagactactcactgtatg

SEQ ID NO: 484010 - DNA, 25 bp, Mus musculus
gagcttgaagctagcaacctggacc

SEQ ID NO: 484011 - DNA, 25 bp, Mus musculus
gagcttgaagctcgacgtcattcag

SEQ ID NO: 484012 - DNA, 25 bp, Mus musculus
gagcttgaagctggacgtcattcag

SEQ ID NO: 484013 - DNA, 25 bp, Mus musculus
gagcttgaagcttgcaacctggacc

SEQ ID NO: 484014 - DNA, 25 bp, Mus musculus
gagcttgaagttagccaggattacc

SEQ ID NO: 484015 - DNA, 25 bp, Mus musculus
gagcttgaagtttgccaggattacc

SEQ ID NO: 484016 - DNA, 25 bp, Mus musculus
gagcttgaatttcgatcctatctaa

SEQ ID NO: 484017 - DNA, 25 bp, Mus musculus
gagcttgaatttggatcctatctaa

SEQ ID NO: 484018 - DNA, 25 bp, Mus musculus
gagcttgacaacaggcaggtgccga

SEQ ID NO: 484019 - DNA, 25 bp, Mus musculus
gagcttgacaactggcaggtgccga

SEQ ID NO: 484020 - DNA, 25 bp, Mus musculus
gagcttgaccagctcaggcccttca

SEQ ID NO: 484021 - DNA, 25 bp, Mus musculus
gagcttgaccaggtcaggcccttca

SEQ ID NO: 484022 - DNA, 25 bp, Mus musculus
gagcttgactctattacaccaggca

SEQ ID NO: 484023 - DNA, 25 bp, Mus musculus
gagcttgactcttttacaccaggca

SEQ ID NO: 484024 - DNA, 25 bp, Mus musculus
gagcttgacttgcacattagagaaa

SEQ ID NO: 484025 - DNA, 25 bp, Mus musculus
gagcttgacttggacattagagaaa

SEQ ID NO: 484026 - DNA, 25 bp, Mus musculus
gagcttgagaccagtcagactcaca

SEQ ID NO: 484027 - DNA, 25 bp, Mus musculus
gagcttgagacctgtcagactcaca

SEQ ID NO: 484028 - DNA, 25 bp, Mus musculus
gagcttgagatacaccagacacatt

SEQ ID NO: 484029 - DNA, 25 bp, Mus musculus
gagcttgagatagaccagacacatt

SEQ ID NO: 484030 - DNA, 25 bp, Mus musculus
gagcttgagccaccggaatgttcca

SEQ ID NO: 484031 - DNA, 25 bp, Mus musculus
gagcttgagccagcggaatgttcca

SEQ ID NO: 484032 - DNA, 25 bp, Mus musculus
gagcttgaggctctgaggcatcatt

SEQ ID NO: 484033 - DNA, 25 bp, Mus musculus
gagcttgaggctgtgaggcatcatt

SEQ ID NO: 484034 - DNA, 25 bp, Mus musculus
gagcttgagggccagcacacagcat

SEQ ID NO: 484035 - DNA, 25 bp, Mus musculus
gagcttgagggcgagcacacagcat

SEQ ID NO: 484036 - DNA, 25 bp, Mus musculus
gagcttgagtccctggagaaacaca

SEQ ID NO: 484037 - DNA, 25 bp, Mus musculus
gagcttgagtccgtggagaaacaca

SEQ ID NO: 484038 - DNA, 25 bp, Mus musculus
gagcttgagttcatgctatttgtta

SEQ ID NO: 484039 - DNA, 25 bp, Mus musculus
gagcttgagttcttgctatttgtta

SEQ ID NO: 484040 - DNA, 25 bp, Mus musculus
gagcttgatagtcaaccctgcaggt

SEQ ID NO: 484041 - DNA, 25 bp, Mus musculus
gagcttgatagtgaaccctgcaggt

SEQ ID NO: 484042 - DNA, 25 bp, Mus musculus
gagcttgatcaccagttgtttccat

SEQ ID NO: 484043 - DNA, 25 bp, Mus musculus
gagcttgatcacgagttgtttccat

SEQ ID NO: 484044 - DNA, 25 bp, Mus musculus
gagcttgatcctcttttgaattttt

SEQ ID NO: 484045 - DNA, 25 bp, Mus musculus
gagcttgatcctgttttgaattttt

SEQ ID NO: 484046 - DNA, 25 bp, Mus musculus
gagcttgatctccagaatccatatt

SEQ ID NO: 484047 - DNA, 25 bp, Mus musculus
gagcttgatctcgagaatccatatt

SEQ ID NO: 484048 - DNA, 25 bp, Mus musculus
gagcttgatgctcagtagggccaca

SEQ ID NO: 484049 - DNA, 25 bp, Mus musculus
gagcttgatgctgagtagggccaca

SEQ ID NO: 484050 - DNA, 25 bp, Mus musculus
gagcttgcaaacaaaccagagcata

SEQ ID NO: 484051 - DNA, 25 bp, Mus musculus
gagcttgcaaactaaccagagcata

SEQ ID NO: 484052 - DNA, 25 bp, Mus musculus
gagcttgcacagctctcactgattg

SEQ ID NO: 484053 - DNA, 25 bp, Mus musculus
gagcttgcacaggtctcactgattg

SEQ ID NO: 484054 - DNA, 25 bp, Mus musculus
gagcttgcacctattcatgactgag

SEQ ID NO: 484055 - DNA, 25 bp, Mus musculus
gagcttgcaccttttcatgactgag

SEQ ID NO: 484056 - DNA, 25 bp, Mus musculus
gagcttgcagaacatccatggccca

SEQ ID NO: 484057 - DNA, 25 bp, Mus musculus
gagcttgcagaagatccatggccca

SEQ ID NO: 484058 - DNA, 25 bp, Mus musculus
gagcttgcaggaactccgaggctaa

SEQ ID NO: 484059 - DNA, 25 bp, Mus musculus
gagcttgcaggatctccgaggctaa

SEQ ID NO: 484060 - DNA, 25 bp, Mus musculus
gagcttgccaagcttgcgtgtccaa

SEQ ID NO: 484061 - DNA, 25 bp, Mus musculus
gagcttgccaaggttgcgtgtccaa

SEQ ID NO: 484062 - DNA, 25 bp, Mus musculus
gagcttgccaataagatgcttgcac

SEQ ID NO: 484063 - DNA, 25 bp, Mus musculus
gagcttgccaattagatgcttgcac

SEQ ID NO: 484064 - DNA, 25 bp, Mus musculus
gagcttgccagacggacagtttttc

SEQ ID NO: 484065 - DNA, 25 bp, Mus musculus
gagcttgccagagggacagtttttc

SEQ ID NO: 484066 - DNA, 25 bp, Mus musculus
gagcttgccatgcttattgtgtctg

SEQ ID NO: 484067 - DNA, 25 bp, Mus musculus
gagcttgccatggttattgtgtctg

SEQ ID NO: 484068 - DNA, 25 bp, Mus musculus
gagcttgccctgcttggctcaggat

SEQ ID NO: 484069 - DNA, 25 bp, Mus musculus
gagcttgccctggttggctcaggat

SEQ ID NO: 484070 - DNA, 25 bp, Mus musculus
gagcttgccgttagctgaatctagg

SEQ ID NO: 484071 - DNA, 25 bp, Mus musculus
gagcttgccgtttgctgaatctagg

SEQ ID NO: 484072 - DNA, 25 bp, Mus musculus
gagcttgcctatatctgtctaatca

SEQ ID NO: 484073 - DNA, 25 bp, Mus musculus
gagcttgcctatttctgtctaatca

SEQ ID NO: 484074 - DNA, 25 bp, Mus musculus
gagcttgcctgccaaattgaagact

SEQ ID NO: 484075 - DNA, 25 bp, Mus musculus
gagcttgcctgcgaaattgaagact

SEQ ID NO: 484076 - DNA, 25 bp, Mus musculus
gagcttgccttaatttgcttcacat

SEQ ID NO: 484077 - DNA, 25 bp, Mus musculus
gagcttgccttattttgcttcacat

SEQ ID NO: 484078 - DNA, 25 bp, Mus musculus
gagcttgcgattaggtcactgggaa

SEQ ID NO: 484079 - DNA, 25 bp, Mus musculus
gagcttgcgatttggtcactgggaa

SEQ ID NO: 484080 - DNA, 25 bp, Mus musculus
gagcttgctaataatctttgtttct

SEQ ID NO: 484081 - DNA, 25 bp, Mus musculus
gagcttgctaattatctttgtttct

SEQ ID NO: 484082 - DNA, 25 bp, Mus musculus
gagcttgctaggctcctcagatcac

SEQ ID NO: 484083 - DNA, 25 bp, Mus musculus
gagcttgctaggctgagcactccca

SEQ ID NO: 484084 - DNA, 25 bp, Mus musculus
gagcttgctagggtcctcagatcac

SEQ ID NO: 484085 - DNA, 25 bp, Mus musculus
gagcttgctagggtgagcactccca

SEQ ID NO: 484086 - DNA, 25 bp, Mus musculus
gagcttgctcagatgtgggacacac

SEQ ID NO: 484087 - DNA, 25 bp, Mus musculus
gagcttgctcagttgtgggacacac

SEQ ID NO: 484088 - DNA, 25 bp, Mus musculus
gagcttgctctcaacgctatgcata

SEQ ID NO: 484089 - DNA, 25 bp, Mus musculus
gagcttgctctctacgctatgcata

SEQ ID NO: 484090 - DNA, 25 bp, Mus musculus
gagcttgctgacaaggctggtggta

SEQ ID NO: 484091 - DNA, 25 bp, Mus musculus
gagcttgctgactaggctggtggta

SEQ ID NO: 484092 - DNA, 25 bp, Mus musculus
gagcttgctgagaaaatgcccatac

SEQ ID NO: 484093 - DNA, 25 bp, Mus musculus
gagcttgctgagtaaatgcccatac

SEQ ID NO: 484094 - DNA, 25 bp, Mus musculus
gagcttgcttcaaatgaatgtggtt

SEQ ID NO: 484095 - DNA, 25 bp, Mus musculus
gagcttgcttcaacctccaagtgta

SEQ ID NO: 484096 - DNA, 25 bp, Mus musculus
gagcttgcttcatatgaatgtggtt

SEQ ID NO: 484097 - DNA, 25 bp, Mus musculus
gagcttgcttcatcctccaagtgta

SEQ ID NO: 484098 - DNA, 25 bp, Mus musculus
gagcttggaaatcccacctagagac

SEQ ID NO: 484099 - DNA, 25 bp, Mus musculus
gagcttggaaatgccacctagagac

SEQ ID NO: 484100 - DNA, 25 bp, Mus musculus
gagcttggaccaaccactgagagca

SEQ ID NO: 484101 - DNA, 25 bp, Mus musculus
gagcttggaccacaaacgacctcct

SEQ ID NO: 484102 - DNA, 25 bp, Mus musculus
gagcttggaccagaaacgacctcct

SEQ ID NO: 484103 - DNA, 25 bp, Mus musculus
gagcttggaccatccactgagagca

SEQ ID NO: 484104 - DNA, 25 bp, Mus musculus
gagcttggacccatgagcaagatga

SEQ ID NO: 484105 - DNA, 25 bp, Mus musculus
gagcttggacccttgagcaagatga

SEQ ID NO: 484106 - DNA, 25 bp, Mus musculus
gagcttggactaagattcctctgta

SEQ ID NO: 484107 - DNA, 25 bp, Mus musculus
gagcttggactatgattcctctgta

SEQ ID NO: 484108 - DNA, 25 bp, Mus musculus
gagcttggatctctgacaaatacct

SEQ ID NO: 484109 - DNA, 25 bp, Mus musculus
gagcttggatctgtgacaaatacct

SEQ ID NO: 484110 - DNA, 25 bp, Mus musculus
gagcttggatgcaggccccgaaggg

SEQ ID NO: 484111 - DNA, 25 bp, Mus musculus
gagcttggatgctggccccgaaggg

SEQ ID NO: 484112 - DNA, 25 bp, Mus musculus
gagcttggattcagggcactagtgc

SEQ ID NO: 484113 - DNA, 25 bp, Mus musculus
gagcttggattctgggcactagtgc

SEQ ID NO: 484114 - DNA, 25 bp, Mus musculus
gagcttggcaaaatgttctttgttt

SEQ ID NO: 484115 - DNA, 25 bp, Mus musculus
gagcttggcaaattgttctttgttt

SEQ ID NO: 484116 - DNA, 25 bp, Mus musculus
gagcttggcaccaaagtttctcatg

SEQ ID NO: 484117 - DNA, 25 bp, Mus musculus
gagcttggcacctaagtttctcatg

SEQ ID NO: 484118 - DNA, 25 bp, Mus musculus
gagcttggctctataactacagtag

SEQ ID NO: 484119 - DNA, 25 bp, Mus musculus
gagcttggctctttaactacagtag

SEQ ID NO: 484120 - DNA, 25 bp, Mus musculus
gagcttgggtggacagtgacaaact

SEQ ID NO: 484121 - DNA, 25 bp, Mus musculus
gagcttgggtggtcagtgacaaact

SEQ ID NO: 484122 - DNA, 25 bp, Mus musculus
gagcttgggttcagtgtgaacaact

SEQ ID NO: 484123 - DNA, 25 bp, Mus musculus
gagcttgggttcagtgtgaagaact

SEQ ID NO: 484124 - DNA, 25 bp, Mus musculus
gagcttgggttctgtgtgaacaact

SEQ ID NO: 484125 - DNA, 25 bp, Mus musculus
gagcttgggttctgtgtgaagaact

SEQ ID NO: 484126 - DNA, 25 bp, Mus musculus
gagcttggtcagatttaccgggaca

SEQ ID NO: 484127 - DNA, 25 bp, Mus musculus
gagcttggtcagttttaccgggaca

SEQ ID NO: 484128 - DNA, 25 bp, Mus musculus
gagcttggtggtaatgcattcgtct

SEQ ID NO: 484129 - DNA, 25 bp, Mus musculus
gagcttggtggttatgcattcgtct

SEQ ID NO: 484130 - DNA, 25 bp, Mus musculus
gagcttggtgttcatatgtatcttt

SEQ ID NO: 484131 - DNA, 25 bp, Mus musculus
gagcttggtgttcccatctgggaaa

SEQ ID NO: 484132 - DNA, 25 bp, Mus musculus
gagcttggtgttgatatgtatcttt

SEQ ID NO: 484133 - DNA, 25 bp, Mus musculus
gagcttggtgttgccatctgggaaa

SEQ ID NO: 484134 - DNA, 25 bp, Mus musculus
gagcttggttgaacatttttggaca

SEQ ID NO: 484135 - DNA, 25 bp, Mus musculus
gagcttggttgactttaattttctc

SEQ ID NO: 484136 - DNA, 25 bp, Mus musculus
gagcttggttgagtttaattttctc

SEQ ID NO: 484137 - DNA, 25 bp, Mus musculus
gagcttggttgatcatttttggaca

SEQ ID NO: 484138 - DNA, 25 bp, Mus musculus
gagcttggttgtaagagtgcttacc

SEQ ID NO: 484139 - DNA, 25 bp, Mus musculus
gagcttggttgttagagtgcttacc

SEQ ID NO: 484140 - DNA, 25 bp, Mus musculus
gagcttggttttatcttcctttgta

SEQ ID NO: 484141 - DNA, 25 bp, Mus musculus
gagcttggttttcgcaataccctgc

SEQ ID NO: 484142 - DNA, 25 bp, Mus musculus
gagcttggttttggcaataccctgc

SEQ ID NO: 484143 - DNA, 25 bp, Mus musculus
gagcttggttttttcttcctttgta

SEQ ID NO: 484144 - DNA, 25 bp, Mus musculus
gagcttgtaaatctggcccagggtt

SEQ ID NO: 484145 - DNA, 25 bp, Mus musculus
gagcttgtaaatgtggcccagggtt

SEQ ID NO: 484146 - DNA, 25 bp, Mus musculus
gagcttgtaagccatccagagttta

SEQ ID NO: 484147 - DNA, 25 bp, Mus musculus
gagcttgtaagcgatccagagttta

SEQ ID NO: 484148 - DNA, 25 bp, Mus musculus
gagcttgtaaggcaagagtcaactg

SEQ ID NO: 484149 - DNA, 25 bp, Mus musculus
gagcttgtaagggaagagtcaactg

SEQ ID NO: 484150 - DNA, 25 bp, Mus musculus
gagcttgtaatgaaattcatccctt

SEQ ID NO: 484151 - DNA, 25 bp, Mus musculus
gagcttgtaatgtaattcatccctt

SEQ ID NO: 484152 - DNA, 25 bp, Mus musculus
gagcttgtacagagctgatttgcag

SEQ ID NO: 484153 - DNA, 25 bp, Mus musculus
gagcttgtacagatcagcttccaac

SEQ ID NO: 484154 - DNA, 25 bp, Mus musculus
gagcttgtacagtgctgatttgcag

SEQ ID NO: 484155 - DNA, 25 bp, Mus musculus
gagcttgtacagttcagcttccaac

SEQ ID NO: 484156 - DNA, 25 bp, Mus musculus
gagcttgtactgacggttttcattt

SEQ ID NO: 484157 - DNA, 25 bp, Mus musculus
gagcttgtactgtcggttttcattt

SEQ ID NO: 484158 - DNA, 25 bp, Mus musculus
gagcttgtagctacctcagtgtaag

SEQ ID NO: 484159 - DNA, 25 bp, Mus musculus
gagcttgtagctccatagtagagaa

SEQ ID NO: 484160 - DNA, 25 bp, Mus musculus
gagcttgtagctcccatgactttgc

SEQ ID NO: 484161 - DNA, 25 bp, Mus musculus
gagcttgtagctgcatagtagagaa

SEQ ID NO: 484162 - DNA, 25 bp, Mus musculus
gagcttgtagctgccatgactttgc

SEQ ID NO: 484163 - DNA, 25 bp, Mus musculus
gagcttgtagcttcctcagtgtaag

SEQ ID NO: 484164 - DNA, 25 bp, Mus musculus
gagcttgtaggactcacatcttagt

SEQ ID NO: 484165 - DNA, 25 bp, Mus musculus
gagcttgtaggagtcacatcttagt

SEQ ID NO: 484166 - DNA, 25 bp, Mus musculus
gagcttgtatacagcaagacaggtc

SEQ ID NO: 484167 - DNA, 25 bp, Mus musculus
gagcttgtatactgcaagacaggtc

SEQ ID NO: 484168 - DNA, 25 bp, Mus musculus
gagcttgtatcacagcatgcacaca

SEQ ID NO: 484169 - DNA, 25 bp, Mus musculus
gagcttgtatcagagcatgcacaca

SEQ ID NO: 484170 - DNA, 25 bp, Mus musculus
gagcttgtatccaagtagtactgca

SEQ ID NO: 484171 - DNA, 25 bp, Mus musculus
gagcttgtatcctagtagtactgca

SEQ ID NO: 484172 - DNA, 25 bp, Mus musculus
gagcttgtcaatcctccatttgttt

SEQ ID NO: 484173 - DNA, 25 bp, Mus musculus
gagcttgtcaatgctccatttgttt

SEQ ID NO: 484174 - DNA, 25 bp, Mus musculus
gagcttgtcactaggcagaggaatt

SEQ ID NO: 484175 - DNA, 25 bp, Mus musculus
gagcttgtcacttggcagaggaatt

SEQ ID NO: 484176 - DNA, 25 bp, Mus musculus
gagcttgtcagcagttggcttcaga

SEQ ID NO: 484177 - DNA, 25 bp, Mus musculus
gagcttgtcagctgttggcttcaga

SEQ ID NO: 484178 - DNA, 25 bp, Mus musculus
gagcttgtccccatggatcttataa

SEQ ID NO: 484179 - DNA, 25 bp, Mus musculus
gagcttgtccccttggatcttataa

SEQ ID NO: 484180 - DNA, 25 bp, Mus musculus
gagcttgtccctcaatgttagtctg

SEQ ID NO: 484181 - DNA, 25 bp, Mus musculus
gagcttgtccctgaatgttagtctg

SEQ ID NO: 484182 - DNA, 25 bp, Mus musculus
gagcttgtcctaattgcccattgta

SEQ ID NO: 484183 - DNA, 25 bp, Mus musculus
gagcttgtcctatttgcccattgta

SEQ ID NO: 484184 - DNA, 25 bp, Mus musculus
gagcttgtctgtctccaaaatgtga

SEQ ID NO: 484185 - DNA, 25 bp, Mus musculus
gagcttgtctgtgtccaaaatgtga

SEQ ID NO: 484186 - DNA, 25 bp, Mus musculus
gagcttgtgaaacatgtgaccctgg

SEQ ID NO: 484187 - DNA, 25 bp, Mus musculus
gagcttgtgaaagatgtgaccctgg

SEQ ID NO: 484188 - DNA, 25 bp, Mus musculus
gagcttgtgatcctgtgttgtttta

SEQ ID NO: 484189 - DNA, 25 bp, Mus musculus
gagcttgtgatcgtgtgttgtttta

SEQ ID NO: 484190 - DNA, 25 bp, Mus musculus
gagcttgtgcaaccgttggtcaaat

SEQ ID NO: 484191 - DNA, 25 bp, Mus musculus
gagcttgtgcaagcgttggtcaaat

SEQ ID NO: 484192 - DNA, 25 bp, Mus musculus
gagcttgtgcctagattgttttaac

SEQ ID NO: 484193 - DNA, 25 bp, Mus musculus
gagcttgtgccttgattgttttaac

SEQ ID NO: 484194 - DNA, 25 bp, Mus musculus
gagcttgtgcttcgtttgggtttca

SEQ ID NO: 484195 - DNA, 25 bp, Mus musculus
gagcttgtgcttggtttgggtttca

SEQ ID NO: 484196 - DNA, 25 bp, Mus musculus
gagcttgtggctctattgtaatgtc

SEQ ID NO: 484197 - DNA, 25 bp, Mus musculus
gagcttgtggctgtattgtaatgtc

SEQ ID NO: 484198 - DNA, 25 bp, Mus musculus
gagcttgtgggcaccgtccccaggt

SEQ ID NO: 484199 - DNA, 25 bp, Mus musculus
gagcttgtgggctccgtccccaggt

SEQ ID NO: 484200 - DNA, 25 bp, Mus musculus
gagcttgtggtacacttggctactc

SEQ ID NO: 484201 - DNA, 25 bp, Mus musculus
gagcttgtggtagacttggctactc

SEQ ID NO: 484202 - DNA, 25 bp, Mus musculus
gagcttgtggttacatgagctgata

SEQ ID NO: 484203 - DNA, 25 bp, Mus musculus
gagcttgtggttcgcatcatagatt

SEQ ID NO: 484204 - DNA, 25 bp, Mus musculus
gagcttgtggttggcatcatagatt

SEQ ID NO: 484205 - DNA, 25 bp, Mus musculus
gagcttgtggtttcatgagctgata

SEQ ID NO: 484206 - DNA, 25 bp, Mus musculus
gagcttgttaatcttatgtggtctt

SEQ ID NO: 484207 - DNA, 25 bp, Mus musculus
gagcttgttaatgttatgtggtctt

SEQ ID NO: 484208 - DNA, 25 bp, Mus musculus
gagcttgttatgattgagaccattg

SEQ ID NO: 484209 - DNA, 25 bp, Mus musculus
gagcttgttatgtttgagaccattg

SEQ ID NO: 484210 - DNA, 25 bp, Mus musculus
gagcttgttcacagcagttgttctg

SEQ ID NO: 484211 - DNA, 25 bp, Mus musculus
gagcttgttcactgcagttgttctg

SEQ ID NO: 484212 - DNA, 25 bp, Mus musculus
gagcttgttcatctccagatgcgaa

SEQ ID NO: 484213 - DNA, 25 bp, Mus musculus
gagcttgttcatgtccagatgcgaa

SEQ ID NO: 484214 - DNA, 25 bp, Mus musculus
gagcttgttccaagtgtggattcct

SEQ ID NO: 484215 - DNA, 25 bp, Mus musculus
gagcttgttccatgtgtggattcct

SEQ ID NO: 484216 - DNA, 25 bp, Mus musculus
gagcttgttgatcagcttgccaaag

SEQ ID NO: 484217 - DNA, 25 bp, Mus musculus
gagcttgttgatgagcttgccaaag

SEQ ID NO: 484218 - DNA, 25 bp, Mus musculus
gagcttgttgctacagttccagcat

SEQ ID NO: 484219 - DNA, 25 bp, Mus musculus
gagcttgttgcttcagttccagcat

SEQ ID NO: 484220 - DNA, 25 bp, Mus musculus
gagcttgtttaactcattccccaag

SEQ ID NO: 484221 - DNA, 25 bp, Mus musculus
gagcttgtttaagtcattccccaag

SEQ ID NO: 484222 - DNA, 25 bp, Mus musculus
gagcttgtttatcctagtaatccca

SEQ ID NO: 484223 - DNA, 25 bp, Mus musculus
gagcttgtttatgctagtaatccca

SEQ ID NO: 484224 - DNA, 25 bp, Mus musculus
gagctttaacagcacattggcacta

SEQ ID NO: 484225 - DNA, 25 bp, Mus musculus
gagctttaacaggacattggcacta

SEQ ID NO: 484226 - DNA, 25 bp, Mus musculus
gagctttaagaacagccctttgggt

SEQ ID NO: 484227 - DNA, 25 bp, Mus musculus
gagctttaagaagagccctttgggt

SEQ ID NO: 484228 - DNA, 25 bp, Mus musculus
gagctttaagacacgttctctccga

SEQ ID NO: 484229 - DNA, 25 bp, Mus musculus
gagctttaagactcgttctctccga

SEQ ID NO: 484230 - DNA, 25 bp, Mus musculus
gagctttaagagcctttacgggaat

SEQ ID NO: 484231 - DNA, 25 bp, Mus musculus
gagctttaagaggctttacgggaat

SEQ ID NO: 484232 - DNA, 25 bp, Mus musculus
gagctttaatgaatcacagtgcagt

SEQ ID NO: 484233 - DNA, 25 bp, Mus musculus
gagctttaatgattcacagtgcagt

SEQ ID NO: 484234 - DNA, 25 bp, Mus musculus
gagctttacagtaccaacagttcat

SEQ ID NO: 484235 - DNA, 25 bp, Mus musculus
gagctttacagttccaacagttcat

SEQ ID NO: 484236 - DNA, 25 bp, Mus musculus
gagctttacatcatcatttcgactg

SEQ ID NO: 484237 - DNA, 25 bp, Mus musculus
gagctttacatcttcatttcgactg

SEQ ID NO: 484238 - DNA, 25 bp, Mus musculus
gagctttacattcccaacaataagg

SEQ ID NO: 484239 - DNA, 25 bp, Mus musculus
gagctttacattgccaacaataagg

SEQ ID NO: 484240 - DNA, 25 bp, Mus musculus
gagctttactcgctcatgaagacat

SEQ ID NO: 484241 - DNA, 25 bp, Mus musculus
gagctttactcggtcatgaagacat

SEQ ID NO: 484242 - DNA, 25 bp, Mus musculus
gagctttactgcaggtgtacatgaa

SEQ ID NO: 484243 - DNA, 25 bp, Mus musculus
gagctttactgctggtgtacatgaa

SEQ ID NO: 484244 - DNA, 25 bp, Mus musculus
gagctttacttacttcctatcaata

SEQ ID NO: 484245 - DNA, 25 bp, Mus musculus
gagctttacttagttcctatcaata

SEQ ID NO: 484246 - DNA, 25 bp, Mus musculus
gagctttaggctaaccactgattct

SEQ ID NO: 484247 - DNA, 25 bp, Mus musculus
gagctttaggcttaccactgattct

SEQ ID NO: 484248 - DNA, 25 bp, Mus musculus
gagctttagtaactcatgacagagc

SEQ ID NO: 484249 - DNA, 25 bp, Mus musculus
gagctttagtaagtcatgacagagc

SEQ ID NO: 484250 - DNA, 25 bp, Mus musculus
gagctttagtataccctgcttcaag

SEQ ID NO: 484251 - DNA, 25 bp, Mus musculus
gagctttagtattccctgcttcaag

SEQ ID NO: 484252 - DNA, 25 bp, Mus musculus
gagctttatcttcatgacagtcgtg

SEQ ID NO: 484253 - DNA, 25 bp, Mus musculus
gagctttatcttcttgctgggatac

SEQ ID NO: 484254 - DNA, 25 bp, Mus musculus
gagctttatcttgatgacagtcgtg

SEQ ID NO: 484255 - DNA, 25 bp, Mus musculus
gagctttatcttgttgctgggatac

SEQ ID NO: 484256 - DNA, 25 bp, Mus musculus
gagctttatgacaagacctgccagt

SEQ ID NO: 484257 - DNA, 25 bp, Mus musculus
gagctttatgactagacctgccagt

SEQ ID NO: 484258 - DNA, 25 bp, Mus musculus
gagctttcaagtactaacatataga

SEQ ID NO: 484259 - DNA, 25 bp, Mus musculus
gagctttcaagttctaacatataga

SEQ ID NO: 484260 - DNA, 25 bp, Mus musculus
gagctttcactcatatgggagatcc

SEQ ID NO: 484261 - DNA, 25 bp, Mus musculus
gagctttcactcttatgggagatcc

SEQ ID NO: 484262 - DNA, 25 bp, Mus musculus
gagctttcactgacattctggttat

SEQ ID NO: 484263 - DNA, 25 bp, Mus musculus
gagctttcactgtcattctggttat

SEQ ID NO: 484264 - DNA, 25 bp, Mus musculus
gagctttcagagaatgtccgtaacc

SEQ ID NO: 484265 - DNA, 25 bp, Mus musculus
gagctttcagagacggaagcccttc

SEQ ID NO: 484266 - DNA, 25 bp, Mus musculus
gagctttcagagtatgtccgtaacc

SEQ ID NO: 484267 - DNA, 25 bp, Mus musculus
gagctttcagagtcggaagcccttc

SEQ ID NO: 484268 - DNA, 25 bp, Mus musculus
gagctttcaggaattcttcggcaga

SEQ ID NO: 484269 - DNA, 25 bp, Mus musculus
gagctttcaggacgagccatttccc

SEQ ID NO: 484270 - DNA, 25 bp, Mus musculus
gagctttcaggaggagccatttccc

SEQ ID NO: 484271 - DNA, 25 bp, Mus musculus
gagctttcaggatttcttcggcaga

SEQ ID NO: 484272 - DNA, 25 bp, Mus musculus
gagctttcaggcctgcacagaaatg

SEQ ID NO: 484273 - DNA, 25 bp, Mus musculus
gagctttcaggcgtgcacagaaatg

SEQ ID NO: 484274 - DNA, 25 bp, Mus musculus
gagctttcattcaatttttcttgtt

SEQ ID NO: 484275 - DNA, 25 bp, Mus musculus
gagctttcattctatttttcttgtt

SEQ ID NO: 484276 - DNA, 25 bp, Mus musculus
gagctttcattgactctgcatgtgt

SEQ ID NO: 484277 - DNA, 25 bp, Mus musculus
gagctttcattgtctctgcatgtgt

SEQ ID NO: 484278 - DNA, 25 bp, Mus musculus
gagctttccaatagtattaaccacc

SEQ ID NO: 484279 - DNA, 25 bp, Mus musculus
gagctttccaattgtattaaccacc

SEQ ID NO: 484280 - DNA, 25 bp, Mus musculus
gagctttccacaacactatgcattt

SEQ ID NO: 484281 - DNA, 25 bp, Mus musculus
gagctttccacatcactatgcattt

SEQ ID NO: 484282 - DNA, 25 bp, Mus musculus
gagctttccatgcagacttctcatg

SEQ ID NO: 484283 - DNA, 25 bp, Mus musculus
gagctttccatggagacttctcatg

SEQ ID NO: 484284 - DNA, 25 bp, Mus musculus
gagctttcccatcattttgagcccc

SEQ ID NO: 484285 - DNA, 25 bp, Mus musculus
gagctttcccatctacgcggtgact

SEQ ID NO: 484286 - DNA, 25 bp, Mus musculus
gagctttcccatgattttgagcccc

SEQ ID NO: 484287 - DNA, 25 bp, Mus musculus
gagctttcccatgtacgcggtgact

SEQ ID NO: 484288 - DNA, 25 bp, Mus musculus
gagctttccctccacaggctgagaa

SEQ ID NO: 484289 - DNA, 25 bp, Mus musculus
gagctttccctcgacaggctgagaa

SEQ ID NO: 484290 - DNA, 25 bp, Mus musculus
gagctttcccttctctacgttagat

SEQ ID NO: 484291 - DNA, 25 bp, Mus musculus
gagctttcccttgtctacgttagat

SEQ ID NO: 484292 - DNA, 25 bp, Mus musculus
gagctttcctatcacctttcaattg

SEQ ID NO: 484293 - DNA, 25 bp, Mus musculus
gagctttcctatgacctttcaattg

SEQ ID NO: 484294 - DNA, 25 bp, Mus musculus
gagctttcgcagagtgaggatcaac

SEQ ID NO: 484295 - DNA, 25 bp, Mus musculus
gagctttcgcagtgtgaggatcaac

SEQ ID NO: 484296 - DNA, 25 bp, Mus musculus
gagctttcgcatatagtgaggccct

SEQ ID NO: 484297 - DNA, 25 bp, Mus musculus
gagctttcgcatttagtgaggccct

SEQ ID NO: 484298 - DNA, 25 bp, Mus musculus
gagctttcggcaactggaaatctga

SEQ ID NO: 484299 - DNA, 25 bp, Mus musculus
gagctttcggcatctggaaatctga

SEQ ID NO: 484300 - DNA, 25 bp, Mus musculus
gagctttcgggtctgaattcggtat

SEQ ID NO: 484301 - DNA, 25 bp, Mus musculus
gagctttcgggtgtgaattcggtat

SEQ ID NO: 484302 - DNA, 25 bp, Mus musculus
gagctttcgtacatatttttctaat

SEQ ID NO: 484303 - DNA, 25 bp, Mus musculus
gagctttcgtacttatttttctaat

SEQ ID NO: 484304 - DNA, 25 bp, Mus musculus
gagctttcgtcgcacaggcaagtct

SEQ ID NO: 484305 - DNA, 25 bp, Mus musculus
gagctttcgtcggacaggcaagtct

SEQ ID NO: 484306 - DNA, 25 bp, Mus musculus
gagctttcgtttcctgtcagtgaag

SEQ ID NO: 484307 - DNA, 25 bp, Mus musculus
gagctttcgtttgctgtcagtgaag

SEQ ID NO: 484308 - DNA, 25 bp, Mus musculus
gagctttctacaatctgtacgcagg

SEQ ID NO: 484309 - DNA, 25 bp, Mus musculus
gagctttctacattctgtacgcagg

SEQ ID NO: 484310 - DNA, 25 bp, Mus musculus
gagctttctagaattggctgcatca

SEQ ID NO: 484311 - DNA, 25 bp, Mus musculus
gagctttctagatttggctgcatca

SEQ ID NO: 484312 - DNA, 25 bp, Mus musculus
gagctttctataatcagaagcgaaa

SEQ ID NO: 484313 - DNA, 25 bp, Mus musculus
gagctttctatattcagaagcgaaa

SEQ ID NO: 484314 - DNA, 25 bp, Mus musculus
gagctttctattattgtctttactg

SEQ ID NO: 484315 - DNA, 25 bp, Mus musculus
gagctttctatttttgtctttactg

SEQ ID NO: 484316 - DNA, 25 bp, Mus musculus
gagctttctcgaactgacctgaacg

SEQ ID NO: 484317 - DNA, 25 bp, Mus musculus
gagctttctcgatctgacctgaacg

SEQ ID NO: 484318 - DNA, 25 bp, Mus musculus
gagctttctctaccaaaaaggcctc

SEQ ID NO: 484319 - DNA, 25 bp, Mus musculus
gagctttctctagcaaaaaggcctc

SEQ ID NO: 484320 - DNA, 25 bp, Mus musculus
gagctttctctgaaaccgaagccag

SEQ ID NO: 484321 - DNA, 25 bp, Mus musculus
gagctttctctgtaaccgaagccag

SEQ ID NO: 484322 - DNA, 25 bp, Mus musculus
gagctttctcttatcttcagtttaa

SEQ ID NO: 484323 - DNA, 25 bp, Mus musculus
gagctttctcttttcttcagtttaa

SEQ ID NO: 484324 - DNA, 25 bp, Mus musculus
gagctttctgaaaaggaccaagttg

SEQ ID NO: 484325 - DNA, 25 bp, Mus musculus
gagctttctgaataggaccaagttg

SEQ ID NO: 484326 - DNA, 25 bp, Mus musculus
gagctttctgagaccttgggagcca

SEQ ID NO: 484327 - DNA, 25 bp, Mus musculus
gagctttctgagctcgctgagtgta

SEQ ID NO: 484328 - DNA, 25 bp, Mus musculus
gagctttctgaggtcgctgagtgta

SEQ ID NO: 484329 - DNA, 25 bp, Mus musculus
gagctttctgagtccttgggagcca

SEQ ID NO: 484330 - DNA, 25 bp, Mus musculus
gagctttcttatatctgtacccaat

SEQ ID NO: 484331 - DNA, 25 bp, Mus musculus
gagctttcttatttctgtacccaat

SEQ ID NO: 484332 - DNA, 25 bp, Mus musculus
gagctttcttccctcagtcagggtg

SEQ ID NO: 484333 - DNA, 25 bp, Mus musculus
gagctttcttccgtcagtcagggtg

SEQ ID NO: 484334 - DNA, 25 bp, Mus musculus
gagctttctttgactacctcaatat

SEQ ID NO: 484335 - DNA, 25 bp, Mus musculus
gagctttctttgtctacctcaatat

SEQ ID NO: 484336 - DNA, 25 bp, Mus musculus
gagctttgacacacagtctttataa

SEQ ID NO: 484337 - DNA, 25 bp, Mus musculus
gagctttgacactcagtctttataa

SEQ ID NO: 484338 - DNA, 25 bp, Mus musculus
gagctttgagtgacacacgagtgtt

SEQ ID NO: 484339 - DNA, 25 bp, Mus musculus
gagctttgagtgtcacacgagtgtt

SEQ ID NO: 484340 - DNA, 25 bp, Mus musculus
gagctttgatgtaccgtggatctgt

SEQ ID NO: 484341 - DNA, 25 bp, Mus musculus
gagctttgatgtccgagaggtcatt

SEQ ID NO: 484342 - DNA, 25 bp, Mus musculus
gagctttgatgtgcgagaggtcatt

SEQ ID NO: 484343 - DNA, 25 bp, Mus musculus
gagctttgatgttccgtggatctgt

SEQ ID NO: 484344 - DNA, 25 bp, Mus musculus
gagctttgcaagcagaggaccctat

SEQ ID NO: 484345 - DNA, 25 bp, Mus musculus
gagctttgcaaggagaggaccctat

SEQ ID NO: 484346 - DNA, 25 bp, Mus musculus
gagctttgcagtattccttttttga

SEQ ID NO: 484347 - DNA, 25 bp, Mus musculus
gagctttgcagttttccttttttga

SEQ ID NO: 484348 - DNA, 25 bp, Mus musculus
gagctttgcataagcacccatgttt

SEQ ID NO: 484349 - DNA, 25 bp, Mus musculus
gagctttgcatatgcacccatgttt

SEQ ID NO: 484350 - DNA, 25 bp, Mus musculus
gagctttgcctcctttatatgtata

SEQ ID NO: 484351 - DNA, 25 bp, Mus musculus
gagctttgcctcgtttatatgtata

SEQ ID NO: 484352 - DNA, 25 bp, Mus musculus
gagctttgctcaattttgtatcctt

SEQ ID NO: 484353 - DNA, 25 bp, Mus musculus
gagctttgctcatttttgtatcctt

SEQ ID NO: 484354 - DNA, 25 bp, Mus musculus
gagctttgctccaggacaatttcaa

SEQ ID NO: 484355 - DNA, 25 bp, Mus musculus
gagctttgctcctggacaatttcaa

SEQ ID NO: 484356 - DNA, 25 bp, Mus musculus
gagctttgctgaatacagtgttaga

SEQ ID NO: 484357 - DNA, 25 bp, Mus musculus
gagctttgctgattacagtgttaga

SEQ ID NO: 484358 - DNA, 25 bp, Mus musculus
gagctttgctggagcatagttgctc

SEQ ID NO: 484359 - DNA, 25 bp, Mus musculus
gagctttgctggtgcatagttgctc

SEQ ID NO: 484360 - DNA, 25 bp, Mus musculus
gagctttgctgtatcattaactgtg

SEQ ID NO: 484361 - DNA, 25 bp, Mus musculus
gagctttgctgtttcattaactgtg

SEQ ID NO: 484362 - DNA, 25 bp, Mus musculus
gagctttgcttaaaatcgcaccaga

SEQ ID NO: 484363 - DNA, 25 bp, Mus musculus
gagctttgcttaaagctgctcccag

SEQ ID NO: 484364 - DNA, 25 bp, Mus musculus
gagctttgcttataatcgcaccaga

SEQ ID NO: 484365 - DNA, 25 bp, Mus musculus
gagctttgcttatagctgctcccag

SEQ ID NO: 484366 - DNA, 25 bp, Mus musculus
gagctttggacgatgggtttcaaga

SEQ ID NO: 484367 - DNA, 25 bp, Mus musculus
gagctttggacgttgggtttcaaga

SEQ ID NO: 484368 - DNA, 25 bp, Mus musculus
gagctttggatgcagtaggcacctc

SEQ ID NO: 484369 - DNA, 25 bp, Mus musculus
gagctttggatggagtaggcacctc

SEQ ID NO: 484370 - DNA, 25 bp, Mus musculus
gagctttgggaacttccataggcaa

SEQ ID NO: 484371 - DNA, 25 bp, Mus musculus
gagctttgggaagttccataggcaa

SEQ ID NO: 484372 - DNA, 25 bp, Mus musculus
gagctttgggttcctgtagctcctg

SEQ ID NO: 484373 - DNA, 25 bp, Mus musculus
gagctttgggttgctgtagctcctg

SEQ ID NO: 484374 - DNA, 25 bp, Mus musculus
gagctttggttgcataatttttcag

SEQ ID NO: 484375 - DNA, 25 bp, Mus musculus
gagctttggttggataatttttcag

SEQ ID NO: 484376 - DNA, 25 bp, Mus musculus
gagctttgtaaaaccagaggcccct

SEQ ID NO: 484377 - DNA, 25 bp, Mus musculus
gagctttgtaaatccagaggcccct

SEQ ID NO: 484378 - DNA, 25 bp, Mus musculus
gagctttgtagactttttaggcctg

SEQ ID NO: 484379 - DNA, 25 bp, Mus musculus
gagctttgtagagtttttaggcctg

SEQ ID NO: 484380 - DNA, 25 bp, Mus musculus
gagctttgtagtctcatcgcagcag

SEQ ID NO: 484381 - DNA, 25 bp, Mus musculus
gagctttgtagtgtcatcgcagcag

SEQ ID NO: 484382 - DNA, 25 bp, Mus musculus
gagctttgtattctctcgggtcaaa

SEQ ID NO: 484383 - DNA, 25 bp, Mus musculus
gagctttgtattgtctcgggtcaaa

SEQ ID NO: 484384 - DNA, 25 bp, Mus musculus
gagctttgtgaactctacagttcta

SEQ ID NO: 484385 - DNA, 25 bp, Mus musculus
gagctttgtgaagtctacagttcta

SEQ ID NO: 484386 - DNA, 25 bp, Mus musculus
gagctttgtgcaagctggcattcac

SEQ ID NO: 484387 - DNA, 25 bp, Mus musculus
gagctttgtgcaagtaccctgctgc

SEQ ID NO: 484388 - DNA, 25 bp, Mus musculus
gagctttgtgcaattcctgcagtat

SEQ ID NO: 484389 - DNA, 25 bp, Mus musculus
gagctttgtgcatgctggcattcac

SEQ ID NO: 484390 - DNA, 25 bp, Mus musculus
gagctttgtgcatgtaccctgctgc

SEQ ID NO: 484391 - DNA, 25 bp, Mus musculus
gagctttgtgcatttcctgcagtat

SEQ ID NO: 484392 - DNA, 25 bp, Mus musculus
gagctttgtgctatatgtacttaac

SEQ ID NO: 484393 - DNA, 25 bp, Mus musculus
gagctttgtgctcaggtctaaggta

SEQ ID NO: 484394 - DNA, 25 bp, Mus musculus
gagctttgtgctgaggtctaaggta

SEQ ID NO: 484395 - DNA, 25 bp, Mus musculus
gagctttgtgctttatgtacttaac

SEQ ID NO: 484396 - DNA, 25 bp, Mus musculus
gagctttgtggtactgtcttagtca

SEQ ID NO: 484397 - DNA, 25 bp, Mus musculus
gagctttgtggttctgtcttagtca

SEQ ID NO: 484398 - DNA, 25 bp, Mus musculus
gagctttgtgtgctatttcaagtat

SEQ ID NO: 484399 - DNA, 25 bp, Mus musculus
gagctttgtgtggtatttcaagtat

SEQ ID NO: 484400 - DNA, 25 bp, Mus musculus
gagctttgtgttcataggtgtgcat

SEQ ID NO: 484401 - DNA, 25 bp, Mus musculus
gagctttgtgttgataggtgtgcat

SEQ ID NO: 484402 - DNA, 25 bp, Mus musculus
gagctttgttctagtttgagccact

SEQ ID NO: 484403 - DNA, 25 bp, Mus musculus
gagctttgttcttgtttgagccact

SEQ ID NO: 484404 - DNA, 25 bp, Mus musculus
gagcttttaaacaaacttgacttga

SEQ ID NO: 484405 - DNA, 25 bp, Mus musculus
gagcttttaaactaacttgacttga

SEQ ID NO: 484406 - DNA, 25 bp, Mus musculus
gagcttttaaatattcacactgttg

SEQ ID NO: 484407 - DNA, 25 bp, Mus musculus
gagcttttaaattttcacactgttg

SEQ ID NO: 484408 - DNA, 25 bp, Mus musculus
gagcttttaaggatctcaactccct

SEQ ID NO: 484409 - DNA, 25 bp, Mus musculus
gagcttttaaggttctcaactccct

SEQ ID NO: 484410 - DNA, 25 bp, Mus musculus
gagcttttaatgcattctccctaaa

SEQ ID NO: 484411 - DNA, 25 bp, Mus musculus
gagcttttaatggattctccctaaa

SEQ ID NO: 484412 - DNA, 25 bp, Mus musculus
gagcttttacgtacaacaagacact

SEQ ID NO: 484413 - DNA, 25 bp, Mus musculus
gagcttttacgttcaacaagacact

SEQ ID NO: 484414 - DNA, 25 bp, Mus musculus
gagcttttataccattcatattctt

SEQ ID NO: 484415 - DNA, 25 bp, Mus musculus
gagcttttatacgattcatattctt

SEQ ID NO: 484416 - DNA, 25 bp, Mus musculus
gagcttttcaagcaaattcttcctt

SEQ ID NO: 484417 - DNA, 25 bp, Mus musculus
gagcttttcaaggaaattcttcctt

SEQ ID NO: 484418 - DNA, 25 bp, Mus musculus
gagcttttccatcaagtcactgtgt

SEQ ID NO: 484419 - DNA, 25 bp, Mus musculus
gagcttttccatgaagtcactgtgt

SEQ ID NO: 484420 - DNA, 25 bp, Mus musculus
gagcttttccctattgtgatttccg

SEQ ID NO: 484421 - DNA, 25 bp, Mus musculus
gagcttttcccttttgtgatttccg

SEQ ID NO: 484422 - DNA, 25 bp, Mus musculus
gagcttttctaactgtatgtcccag

SEQ ID NO: 484423 - DNA, 25 bp, Mus musculus
gagcttttctaagtgtatgtcccag

SEQ ID NO: 484424 - DNA, 25 bp, Mus musculus
gagcttttgagaatactttactctc

SEQ ID NO: 484425 - DNA, 25 bp, Mus musculus
gagcttttgagattactttactctc

SEQ ID NO: 484426 - DNA, 25 bp, Mus musculus
gagcttttgataatcagtctcctgt

SEQ ID NO: 484427 - DNA, 25 bp, Mus musculus
gagcttttgatattcagtctcctgt

SEQ ID NO: 484428 - DNA, 25 bp, Mus musculus
gagcttttgcagcatccgtttttaa

SEQ ID NO: 484429 - DNA, 25 bp, Mus musculus
gagcttttgcaggatccgtttttaa

SEQ ID NO: 484430 - DNA, 25 bp, Mus musculus
gagcttttgctaagagcagcagcca

SEQ ID NO: 484431 - DNA, 25 bp, Mus musculus
gagcttttgctatgagcagcagcca

SEQ ID NO: 484432 - DNA, 25 bp, Mus musculus
gagcttttggacaaccgaacacaca

SEQ ID NO: 484433 - DNA, 25 bp, Mus musculus
gagcttttggacatgcactgtttat

SEQ ID NO: 484434 - DNA, 25 bp, Mus musculus
gagcttttggactaccgaacacaca

SEQ ID NO: 484435 - DNA, 25 bp, Mus musculus
gagcttttggacttgcactgtttat

SEQ ID NO: 484436 - DNA, 25 bp, Mus musculus
gagcttttggttaacagactttcat

SEQ ID NO: 484437 - DNA, 25 bp, Mus musculus
gagcttttggtttacagactttcat

SEQ ID NO: 484438 - DNA, 25 bp, Mus musculus
gagcttttgttacataatgctgaaa

SEQ ID NO: 484439 - DNA, 25 bp, Mus musculus
gagcttttgttagataatgctgaaa

SEQ ID NO: 484440 - DNA, 25 bp, Mus musculus
gagctttttatgacaggtggacatc

SEQ ID NO: 484441 - DNA, 25 bp, Mus musculus
gagctttttatgtcaggtggacatc

SEQ ID NO: 484442 - DNA, 25 bp, Mus musculus
gagctttttgagaacacccagagta

SEQ ID NO: 484443 - DNA, 25 bp, Mus musculus
gagctttttgagtacacccagagta

SEQ ID NO: 484444 - DNA, 25 bp, Mus musculus
gagcttttttatctctgtacccaat

SEQ ID NO: 484445 - DNA, 25 bp, Mus musculus
gagcttttttatgtctgtacccaat

SEQ ID NO: 484446 - DNA, 25 bp, Mus musculus
gaggaaaaacatcaacgtgcaggtg

SEQ ID NO: 484447 - DNA, 25 bp, Mus musculus
gaggaaaaacatgaacgtgcaggtg

SEQ ID NO: 484448 - DNA, 25 bp, Mus musculus
gaggaaaaagtgataattgagccca

SEQ ID NO: 484449 - DNA, 25 bp, Mus musculus
gaggaaaaagtgttaattgagccca

SEQ ID NO: 484450 - DNA, 25 bp, Mus musculus
gaggaaaaagttcctactgccatta

SEQ ID NO: 484451 - DNA, 25 bp, Mus musculus
gaggaaaaagttgctactgccatta

SEQ ID NO: 484452 - DNA, 25 bp, Mus musculus
gaggaaaacatgacagtgcggaaat

SEQ ID NO: 484453 - DNA, 25 bp, Mus musculus
gaggaaaacatgtcagtgcggaaat

SEQ ID NO: 484454 - DNA, 25 bp, Mus musculus
gaggaaaacttgatgcggctttgaa

SEQ ID NO: 484455 - DNA, 25 bp, Mus musculus
gaggaaaacttgttgcggctttgaa

SEQ ID NO: 484456 - DNA, 25 bp, Mus musculus
gaggaaaactttcagcatcaacttt

SEQ ID NO: 484457 - DNA, 25 bp, Mus musculus
gaggaaaactttgagcatcaacttt

SEQ ID NO: 484458 - DNA, 25 bp, Mus musculus
gaggaaaagagcctcctcactcggg

SEQ ID NO: 484459 - DNA, 25 bp, Mus musculus
gaggaaaagagcgtcctcactcggg

SEQ ID NO: 484460 - DNA, 25 bp, Mus musculus
gaggaaaaggccagtcacttctgta

SEQ ID NO: 484461 - DNA, 25 bp, Mus musculus
gaggaaaaggcctgtcacttctgta

SEQ ID NO: 484462 - DNA, 25 bp, Mus musculus
gaggaaaagtgacctggctgccaca

SEQ ID NO: 484463 - DNA, 25 bp, Mus musculus
gaggaaaagtgagctggctgccaca

SEQ ID NO: 484464 - DNA, 25 bp, Mus musculus
gaggaaaagttccactcaaaacaca

SEQ ID NO: 484465 - DNA, 25 bp, Mus musculus
gaggaaaagttcgactcaaaacaca

SEQ ID NO: 484466 - DNA, 25 bp, Mus musculus
gaggaaaatatgatccctctgccag

SEQ ID NO: 484467 - DNA, 25 bp, Mus musculus
gaggaaaatatgttccctctgccag

SEQ ID NO: 484468 - DNA, 25 bp, Mus musculus
gaggaaaatccccataatgctcttc

SEQ ID NO: 484469 - DNA, 25 bp, Mus musculus
gaggaaaatcccgataatgctcttc

SEQ ID NO: 484470 - DNA, 25 bp, Mus musculus
gaggaaaatgcactccattgtctat

SEQ ID NO: 484471 - DNA, 25 bp, Mus musculus
gaggaaaatgcagtccattgtctat

SEQ ID NO: 484472 - DNA, 25 bp, Mus musculus
gaggaaacaagaaccctcaccatga

SEQ ID NO: 484473 - DNA, 25 bp, Mus musculus
gaggaaacaagacagatcttctgga

SEQ ID NO: 484474 - DNA, 25 bp, Mus musculus
gaggaaacaagagagatcttctgga

SEQ ID NO: 484475 - DNA, 25 bp, Mus musculus
gaggaaacaagatccctcaccatga

SEQ ID NO: 484476 - DNA, 25 bp, Mus musculus
gaggaaacaccgatttgtccctaag

SEQ ID NO: 484477 - DNA, 25 bp, Mus musculus
gaggaaacaccgttttgtccctaag

SEQ ID NO: 484478 - DNA, 25 bp, Mus musculus
gaggaaacacctagaggccccgcat

SEQ ID NO: 484479 - DNA, 25 bp, Mus musculus
gaggaaacaccttgaggccccgcat

SEQ ID NO: 484480 - DNA, 25 bp, Mus musculus
gaggaaacacggaacccacggagca

SEQ ID NO: 484481 - DNA, 25 bp, Mus musculus
gaggaaacacggtacccacggagca

SEQ ID NO: 484482 - DNA, 25 bp, Mus musculus
gaggaaacactgacatccatttaca

SEQ ID NO: 484483 - DNA, 25 bp, Mus musculus
gaggaaacactgtcatccatttaca

SEQ ID NO: 484484 - DNA, 25 bp, Mus musculus
gaggaaacagcaacaccccaaggtt

SEQ ID NO: 484485 - DNA, 25 bp, Mus musculus
gaggaaacagcatcaccccaaggtt

SEQ ID NO: 484486 - DNA, 25 bp, Mus musculus
gaggaaacagtgactcaccttctaa

SEQ ID NO: 484487 - DNA, 25 bp, Mus musculus
gaggaaacagtgtctcaccttctaa

SEQ ID NO: 484488 - DNA, 25 bp, Mus musculus
gaggaaacatctcactgcccaggtg

SEQ ID NO: 484489 - DNA, 25 bp, Mus musculus
gaggaaacatctgactgcccaggtg

SEQ ID NO: 484490 - DNA, 25 bp, Mus musculus
gaggaaaccaatacagctcccagat

SEQ ID NO: 484491 - DNA, 25 bp, Mus musculus
gaggaaaccaattcagctcccagat

SEQ ID NO: 484492 - DNA, 25 bp, Mus musculus
gaggaaaccatgatggcagtctcac

SEQ ID NO: 484493 - DNA, 25 bp, Mus musculus
gaggaaaccatgttggcagtctcac

SEQ ID NO: 484494 - DNA, 25 bp, Mus musculus
gaggaaacccagagggctcccaagg

SEQ ID NO: 484495 - DNA, 25 bp, Mus musculus
gaggaaacccagtgggctcccaagg

SEQ ID NO: 484496 - DNA, 25 bp, Mus musculus
gaggaaaccctacacaaagcagcag

SEQ ID NO: 484497 - DNA, 25 bp, Mus musculus
gaggaaaccctagacaaagcagcag

SEQ ID NO: 484498 - DNA, 25 bp, Mus musculus
gaggaaacctgaaaccactttctag

SEQ ID NO: 484499 - DNA, 25 bp, Mus musculus
gaggaaacctgataccactttctag

SEQ ID NO: 484500 - DNA, 25 bp, Mus musculus
gaggaaaccttgcttggtcctcctt

SEQ ID NO: 484501 - DNA, 25 bp, Mus musculus
gaggaaaccttggttggtcctcctt

SEQ ID NO: 484502 - DNA, 25 bp, Mus musculus
gaggaaacggctctccccatggagc

SEQ ID NO: 484503 - DNA, 25 bp, Mus musculus
gaggaaacggctgtccccatggagc

SEQ ID NO: 484504 - DNA, 25 bp, Mus musculus
gaggaaacgttcaccctgtctacta

SEQ ID NO: 484505 - DNA, 25 bp, Mus musculus
gaggaaacgttctccctgtctacta

SEQ ID NO: 484506 - DNA, 25 bp, Mus musculus
gaggaaactacaagccacacctacc

SEQ ID NO: 484507 - DNA, 25 bp, Mus musculus
gaggaaactacatgccacacctacc

SEQ ID NO: 484508 - DNA, 25 bp, Mus musculus
gaggaaactcgacccacgtccgtgc

SEQ ID NO: 484509 - DNA, 25 bp, Mus musculus
gaggaaactcgagccacgtccgtgc

SEQ ID NO: 484510 - DNA, 25 bp, Mus musculus
gaggaaactctcacgggtacccaga

SEQ ID NO: 484511 - DNA, 25 bp, Mus musculus
gaggaaactctctcgggtacccaga

SEQ ID NO: 484512 - DNA, 25 bp, Mus musculus
gaggaaactctgatattgtgttaca

SEQ ID NO: 484513 - DNA, 25 bp, Mus musculus
gaggaaactctgttattgtgttaca

SEQ ID NO: 484514 - DNA, 25 bp, Mus musculus
gaggaaactgagactagcatacact

SEQ ID NO: 484515 - DNA, 25 bp, Mus musculus
gaggaaactgagtctagcatacact

SEQ ID NO: 484516 - DNA, 25 bp, Mus musculus
gaggaaactgcacacttttaccaag

SEQ ID NO: 484517 - DNA, 25 bp, Mus musculus
gaggaaactgcagacttttaccaag

SEQ ID NO: 484518 - DNA, 25 bp, Mus musculus
gaggaaactgtcatcacatgaactg

SEQ ID NO: 484519 - DNA, 25 bp, Mus musculus
gaggaaactgtcttcacatgaactg

SEQ ID NO: 484520 - DNA, 25 bp, Mus musculus
gaggaaacttccagtttatctgggt

SEQ ID NO: 484521 - DNA, 25 bp, Mus musculus
gaggaaacttcctgtttatctgggt

SEQ ID NO: 484522 - DNA, 25 bp, Mus musculus
gaggaaagagaaaccatgtttattc

SEQ ID NO: 484523 - DNA, 25 bp, Mus musculus
gaggaaagagaatccatgtttattc

SEQ ID NO: 484524 - DNA, 25 bp, Mus musculus
gaggaaagagagctttgtctgcatt

SEQ ID NO: 484525 - DNA, 25 bp, Mus musculus
gaggaaagagaggtttgtctgcatt

SEQ ID NO: 484526 - DNA, 25 bp, Mus musculus
gaggaaagatctcgacccttggatc

SEQ ID NO: 484527 - DNA, 25 bp, Mus musculus
gaggaaagatctggacccttggatc

SEQ ID NO: 484528 - DNA, 25 bp, Mus musculus
gaggaaagcctgaggcaacccagct

SEQ ID NO: 484529 - DNA, 25 bp, Mus musculus
gaggaaagcctgtggcaacccagct

SEQ ID NO: 484530 - DNA, 25 bp, Mus musculus
gaggaaagctaacgctgtacttttc

SEQ ID NO: 484531 - DNA, 25 bp, Mus musculus
gaggaaagctaaggctgtacttttc

SEQ ID NO: 484532 - DNA, 25 bp, Mus musculus
gaggaaaggctcaaagtgctgacca

SEQ ID NO: 484533 - DNA, 25 bp, Mus musculus
gaggaaaggctctaagtgctgacca

SEQ ID NO: 484534 - DNA, 25 bp, Mus musculus
gaggaaagtccccaactccgttctg

SEQ ID NO: 484535 - DNA, 25 bp, Mus musculus
gaggaaagtcccgaactccgttctg

SEQ ID NO: 484536 - DNA, 25 bp, Mus musculus
gaggaaagtcctactcttcggaata

SEQ ID NO: 484537 - DNA, 25 bp, Mus musculus
gaggaaagtccttctcttcggaata

SEQ ID NO: 484538 - DNA, 25 bp, Mus musculus
gaggaaagtctaaccttctttcatt

SEQ ID NO: 484539 - DNA, 25 bp, Mus musculus
gaggaaagtctatccttctttcatt

SEQ ID NO: 484540 - DNA, 25 bp, Mus musculus
gaggaaagttccacttaccaccaca

SEQ ID NO: 484541 - DNA, 25 bp, Mus musculus
gaggaaagttcctcttaccaccaca

SEQ ID NO: 484542 - DNA, 25 bp, Mus musculus
gaggaaatacccactgccggagaat

SEQ ID NO: 484543 - DNA, 25 bp, Mus musculus
gaggaaataccctctgccggagaat

SEQ ID NO: 484544 - DNA, 25 bp, Mus musculus
gaggaaatagcgaatcttgttaaga

SEQ ID NO: 484545 - DNA, 25 bp, Mus musculus
gaggaaatagcgtatcttgttaaga

SEQ ID NO: 484546 - DNA, 25 bp, Mus musculus
gaggaaatagctcttcccttctttc

SEQ ID NO: 484547 - DNA, 25 bp, Mus musculus
gaggaaatagctgttcccttctttc

SEQ ID NO: 484548 - DNA, 25 bp, Mus musculus
gaggaaatattcagccacactggtc

SEQ ID NO: 484549 - DNA, 25 bp, Mus musculus
gaggaaatattctgccacactggtc

SEQ ID NO: 484550 - DNA, 25 bp, Mus musculus
gaggaaatcaaacccagagcttcta

SEQ ID NO: 484551 - DNA, 25 bp, Mus musculus
gaggaaatcaaagccagagcttcta

SEQ ID NO: 484552 - DNA, 25 bp, Mus musculus
gaggaaatcaccagtgcctttctcc

SEQ ID NO: 484553 - DNA, 25 bp, Mus musculus
gaggaaatcacctgtgcctttctcc

SEQ ID NO: 484554 - DNA, 25 bp, Mus musculus
gaggaaatccctacatacttgaaca

SEQ ID NO: 484555 - DNA, 25 bp, Mus musculus
gaggaaatcccttcatacttgaaca

SEQ ID NO: 484556 - DNA, 25 bp, Mus musculus
gaggaaatccggcacgctcgacacc

SEQ ID NO: 484557 - DNA, 25 bp, Mus musculus
gaggaaatccgggacgctcgacacc

SEQ ID NO: 484558 - DNA, 25 bp, Mus musculus
gaggaaatcctcaccatcctggaag

SEQ ID NO: 484559 - DNA, 25 bp, Mus musculus
gaggaaatcctctccatcctggaag

SEQ ID NO: 484560 - DNA, 25 bp, Mus musculus
gaggaaatcgcacataagtttttaa

SEQ ID NO: 484561 - DNA, 25 bp, Mus musculus
gaggaaatcgcagataagtttttaa

SEQ ID NO: 484562 - DNA, 25 bp, Mus musculus
gaggaaatcgctattctatgtggag

SEQ ID NO: 484563 - DNA, 25 bp, Mus musculus
gaggaaatcgcttttctatgtggag

SEQ ID NO: 484564 - DNA, 25 bp, Mus musculus
gaggaaatctacagtcggcctccac

SEQ ID NO: 484565 - DNA, 25 bp, Mus musculus
gaggaaatctactgtcggcctccac

SEQ ID NO: 484566 - DNA, 25 bp, Mus musculus
gaggaaatctctattgtgttctaca

SEQ ID NO: 484567 - DNA, 25 bp, Mus musculus
gaggaaatctctcgctttggaagga

SEQ ID NO: 484568 - DNA, 25 bp, Mus musculus
gaggaaatctctggctttggaagga

SEQ ID NO: 484569 - DNA, 25 bp, Mus musculus
gaggaaatctcttttgtgttctaca

SEQ ID NO: 484570 - DNA, 25 bp, Mus musculus
gaggaaatctggactcctataagat

SEQ ID NO: 484571 - DNA, 25 bp, Mus musculus
gaggaaatctggtctcctataagat

SEQ ID NO: 484572 - DNA, 25 bp, Mus musculus
gaggaaatctttagtcgatccataa

SEQ ID NO: 484573 - DNA, 25 bp, Mus musculus
gaggaaatcttttgtcgatccataa

SEQ ID NO: 484574 - DNA, 25 bp, Mus musculus
gaggaaatgacactacgctttcaca

SEQ ID NO: 484575 - DNA, 25 bp, Mus musculus
gaggaaatgacagtacgctttcaca

SEQ ID NO: 484576 - DNA, 25 bp, Mus musculus
gaggaaatgaccaaatcacttagag

SEQ ID NO: 484577 - DNA, 25 bp, Mus musculus
gaggaaatgacctaatcacttagag

SEQ ID NO: 484578 - DNA, 25 bp, Mus musculus
gaggaaatgatactcttcttctaca

SEQ ID NO: 484579 - DNA, 25 bp, Mus musculus
gaggaaatgatagtcttcttctaca

SEQ ID NO: 484580 - DNA, 25 bp, Mus musculus
gaggaaatgcctccggtgacccaga

SEQ ID NO: 484581 - DNA, 25 bp, Mus musculus
gaggaaatgcctgcggtgacccaga

SEQ ID NO: 484582 - DNA, 25 bp, Mus musculus
gaggaaatgctacggctactgccac

SEQ ID NO: 484583 - DNA, 25 bp, Mus musculus
gaggaaatgctagggctactgccac

SEQ ID NO: 484584 - DNA, 25 bp, Mus musculus
gaggaaatgcttctcatgtcctccc

SEQ ID NO: 484585 - DNA, 25 bp, Mus musculus
gaggaaatgcttgtcatgtcctccc

SEQ ID NO: 484586 - DNA, 25 bp, Mus musculus
gaggaaatggagcagctcttagaaa

SEQ ID NO: 484587 - DNA, 25 bp, Mus musculus
gaggaaatggaggagctcttagaaa

SEQ ID NO: 484588 - DNA, 25 bp, Mus musculus
gaggaaatggcactcatgctttctt

SEQ ID NO: 484589 - DNA, 25 bp, Mus musculus
gaggaaatggcagtcatgctttctt

SEQ ID NO: 484590 - DNA, 25 bp, Mus musculus
gaggaaatgtctcgctaaggagtat

SEQ ID NO: 484591 - DNA, 25 bp, Mus musculus
gaggaaatgtctggctaaggagtat

SEQ ID NO: 484592 - DNA, 25 bp, Mus musculus
gaggaaattactatattgtctcaat

SEQ ID NO: 484593 - DNA, 25 bp, Mus musculus
gaggaaattactttattgtctcaat

SEQ ID NO: 484594 - DNA, 25 bp, Mus musculus
gaggaaattagacccctgttgctag

SEQ ID NO: 484595 - DNA, 25 bp, Mus musculus
gaggaaattagagccctgttgctag

SEQ ID NO: 484596 - DNA, 25 bp, Mus musculus
gaggaaattccgagccaccctttat

SEQ ID NO: 484597 - DNA, 25 bp, Mus musculus
gaggaaattccgtgccaccctttat

SEQ ID NO: 484598 - DNA, 25 bp, Mus musculus
gaggaacaacaaagcatccccttaa

SEQ ID NO: 484599 - DNA, 25 bp, Mus musculus
gaggaacaacaatgcatccccttaa

SEQ ID NO: 484600 - DNA, 25 bp, Mus musculus
gaggaacaaccacccaggttgacct

SEQ ID NO: 484601 - DNA, 25 bp, Mus musculus
gaggaacaaccagccaggttgacct

SEQ ID NO: 484602 - DNA, 25 bp, Mus musculus
gaggaacaactcataaaagctctga

SEQ ID NO: 484603 - DNA, 25 bp, Mus musculus
gaggaacaactcttaaaagctctga

SEQ ID NO: 484604 - DNA, 25 bp, Mus musculus
gaggaacaatgacctgttctagctg

SEQ ID NO: 484605 - DNA, 25 bp, Mus musculus
gaggaacaatgagctgttctagctg

SEQ ID NO: 484606 - DNA, 25 bp, Mus musculus
gaggaacacactatttgatcatggc

SEQ ID NO: 484607 - DNA, 25 bp, Mus musculus
gaggaacacactttttgatcatggc

SEQ ID NO: 484608 - DNA, 25 bp, Mus musculus
gaggaacaccatcatcagtcaaggg

SEQ ID NO: 484609 - DNA, 25 bp, Mus musculus
gaggaacaccatgatcagtcaaggg

SEQ ID NO: 484610 - DNA, 25 bp, Mus musculus
gaggaacaccccaaagagtccgact

SEQ ID NO: 484611 - DNA, 25 bp, Mus musculus
gaggaacacccctaagagtccgact

SEQ ID NO: 484612 - DNA, 25 bp, Mus musculus
gaggaacacccgaatgcagctcacg

SEQ ID NO: 484613 - DNA, 25 bp, Mus musculus
gaggaacacccgtatgcagctcacg

SEQ ID NO: 484614 - DNA, 25 bp, Mus musculus
gaggaacaccgacaaccctgtgaat

SEQ ID NO: 484615 - DNA, 25 bp, Mus musculus
gaggaacaccgagaaccctgtgaat

SEQ ID NO: 484616 - DNA, 25 bp, Mus musculus
gaggaacacggacgccttgctataa

SEQ ID NO: 484617 - DNA, 25 bp, Mus musculus
gaggaacacggaggccttgctataa

SEQ ID NO: 484618 - DNA, 25 bp, Mus musculus
gaggaacacgttaccattctggaat

SEQ ID NO: 484619 - DNA, 25 bp, Mus musculus
gaggaacacgtttccattctggaat

SEQ ID NO: 484620 - DNA, 25 bp, Mus musculus
gaggaacaggcccatctaacatctc

SEQ ID NO: 484621 - DNA, 25 bp, Mus musculus
gaggaacaggccgatctaacatctc

SEQ ID NO: 484622 - DNA, 25 bp, Mus musculus
gaggaacaggtgactgagccgccac

SEQ ID NO: 484623 - DNA, 25 bp, Mus musculus
gaggaacaggtgtctgagccgccac

SEQ ID NO: 484624 - DNA, 25 bp, Mus musculus
gaggaacagtcaactagtctaccaa

SEQ ID NO: 484625 - DNA, 25 bp, Mus musculus
gaggaacagtcatctagtctaccaa

SEQ ID NO: 484626 - DNA, 25 bp, Mus musculus
gaggaacagttcacctttcccgttg

SEQ ID NO: 484627 - DNA, 25 bp, Mus musculus
gaggaacagttctcctttcccgttg

SEQ ID NO: 484628 - DNA, 25 bp, Mus musculus
gaggaacataataccctttgaccag

SEQ ID NO: 484629 - DNA, 25 bp, Mus musculus
gaggaacataattccctttgaccag

SEQ ID NO: 484630 - DNA, 25 bp, Mus musculus
gaggaacatccacggtctgtttgct

SEQ ID NO: 484631 - DNA, 25 bp, Mus musculus
gaggaacatccagggtctgtttgct

SEQ ID NO: 484632 - DNA, 25 bp, Mus musculus
gaggaacatcccctttcaaatggaa

SEQ ID NO: 484633 - DNA, 25 bp, Mus musculus
gaggaacatcccgtttcaaatggaa

SEQ ID NO: 484634 - DNA, 25 bp, Mus musculus
gaggaacatcctccttctctagctc

SEQ ID NO: 484635 - DNA, 25 bp, Mus musculus
gaggaacatcctgcttctctagctc

SEQ ID NO: 484636 - DNA, 25 bp, Mus musculus
gaggaacattccctttgaaacgtgc

SEQ ID NO: 484637 - DNA, 25 bp, Mus musculus
gaggaacattccgtttgaaacgtgc

SEQ ID NO: 484638 - DNA, 25 bp, Mus musculus
gaggaaccaagtctgtcgtgatcaa

SEQ ID NO: 484639 - DNA, 25 bp, Mus musculus
gaggaaccaagtgtgtcgtgatcaa

SEQ ID NO: 484640 - DNA, 25 bp, Mus musculus
gaggaaccactgacctagataaaat

SEQ ID NO: 484641 - DNA, 25 bp, Mus musculus
gaggaaccactgtcctagataaaat

SEQ ID NO: 484642 - DNA, 25 bp, Mus musculus
gaggaaccacttaacatacttactg

SEQ ID NO: 484643 - DNA, 25 bp, Mus musculus
gaggaaccactttacatacttactg

SEQ ID NO: 484644 - DNA, 25 bp, Mus musculus
gaggaaccagagacccatgggaaga

SEQ ID NO: 484645 - DNA, 25 bp, Mus musculus
gaggaaccagagtcccatgggaaga

SEQ ID NO: 484646 - DNA, 25 bp, Mus musculus
gaggaaccagcaaagaaagtgtcac

SEQ ID NO: 484647 - DNA, 25 bp, Mus musculus
gaggaaccagcatagaaagtgtcac

SEQ ID NO: 484648 - DNA, 25 bp, Mus musculus
gaggaaccagccaggccttctgctt

SEQ ID NO: 484649 - DNA, 25 bp, Mus musculus
gaggaaccagcctggccttctgctt

SEQ ID NO: 484650 - DNA, 25 bp, Mus musculus
gaggaaccaggaacttgttcttaag

SEQ ID NO: 484651 - DNA, 25 bp, Mus musculus
gaggaaccaggatcttgttcttaag

SEQ ID NO: 484652 - DNA, 25 bp, Mus musculus
gaggaaccagtccactactatgcca

SEQ ID NO: 484653 - DNA, 25 bp, Mus musculus
gaggaaccagtcgactactatgcca

SEQ ID NO: 484654 - DNA, 25 bp, Mus musculus
gaggaaccagtgacttgctcacata

SEQ ID NO: 484655 - DNA, 25 bp, Mus musculus
gaggaaccagtgtcttgctcacata

SEQ ID NO: 484656 - DNA, 25 bp, Mus musculus
gaggaaccagttctctagactccat

SEQ ID NO: 484657 - DNA, 25 bp, Mus musculus
gaggaaccagttgtctagactccat

SEQ ID NO: 484658 - DNA, 25 bp, Mus musculus
gaggaacccaaaccttaatcacaga

SEQ ID NO: 484659 - DNA, 25 bp, Mus musculus
gaggaacccaaagcttaatcacaga

SEQ ID NO: 484660 - DNA, 25 bp, Mus musculus
gaggaacccaagaccaagccaggct

SEQ ID NO: 484661 - DNA, 25 bp, Mus musculus
gaggaacccaagtccaagccaggct

SEQ ID NO: 484662 - DNA, 25 bp, Mus musculus
gaggaacccacaattcatgagcgta

SEQ ID NO: 484663 - DNA, 25 bp, Mus musculus
gaggaacccacacttgtgttgttgt

SEQ ID NO: 484664 - DNA, 25 bp, Mus musculus
gaggaacccacagttgtgttgttgt

SEQ ID NO: 484665 - DNA, 25 bp, Mus musculus
gaggaacccacatttcatgagcgta

SEQ ID NO: 484666 - DNA, 25 bp, Mus musculus
gaggaacccacccatgcagaccaag

SEQ ID NO: 484667 - DNA, 25 bp, Mus musculus
gaggaacccaccgatgcagaccaag

SEQ ID NO: 484668 - DNA, 25 bp, Mus musculus
gaggaacccagaactttcttacagt

SEQ ID NO: 484669 - DNA, 25 bp, Mus musculus
gaggaacccagatctttcttacagt

SEQ ID NO: 484670 - DNA, 25 bp, Mus musculus
gaggaaccgcaaacagctgtgaagc

SEQ ID NO: 484671 - DNA, 25 bp, Mus musculus
gaggaaccgcaatcagctgtgaagc

SEQ ID NO: 484672 - DNA, 25 bp, Mus musculus
gaggaaccgcccatactgatttcca

SEQ ID NO: 484673 - DNA, 25 bp, Mus musculus
gaggaaccgcccttactgatttcca

SEQ ID NO: 484674 - DNA, 25 bp, Mus musculus
gaggaaccgcttcctgtgcacagag

SEQ ID NO: 484675 - DNA, 25 bp, Mus musculus
gaggaaccgcttgctgtgcacagag

SEQ ID NO: 484676 - DNA, 25 bp, Mus musculus
gaggaaccgggaagatttgcacaca

SEQ ID NO: 484677 - DNA, 25 bp, Mus musculus
gaggaaccgggatgatttgcacaca

SEQ ID NO: 484678 - DNA, 25 bp, Mus musculus
gaggaacctacacagccagagctcc

SEQ ID NO: 484679 - DNA, 25 bp, Mus musculus
gaggaacctacagagccagagctcc

SEQ ID NO: 484680 - DNA, 25 bp, Mus musculus
gaggaacctaccatgaaatcccctt

SEQ ID NO: 484681 - DNA, 25 bp, Mus musculus
gaggaacctaccttgaaatcccctt

SEQ ID NO: 484682 - DNA, 25 bp, Mus musculus
gaggaacctagtagcagtcttacaa

SEQ ID NO: 484683 - DNA, 25 bp, Mus musculus
gaggaacctagttgcagtcttacaa

SEQ ID NO: 484684 - DNA, 25 bp, Mus musculus
gaggaacctcgcacaccaggagctg

SEQ ID NO: 484685 - DNA, 25 bp, Mus musculus
gaggaacctcgctcaccaggagctg

SEQ ID NO: 484686 - DNA, 25 bp, Mus musculus
gaggaacctcttctggaacatcaag

SEQ ID NO: 484687 - DNA, 25 bp, Mus musculus
gaggaacctcttgtggaacatcaag

SEQ ID NO: 484688 - DNA, 25 bp, Mus musculus
gaggaacctgaaccgaccatttatc

SEQ ID NO: 484689 - DNA, 25 bp, Mus musculus
gaggaacctgaagcgaccatttatc

SEQ ID NO: 484690 - DNA, 25 bp, Mus musculus
gaggaacctgctcttgttagtgaaa

SEQ ID NO: 484691 - DNA, 25 bp, Mus musculus
gaggaacctgctgttgttagtgaaa

SEQ ID NO: 484692 - DNA, 25 bp, Mus musculus
gaggaacctggtccgcatgcgtctc

SEQ ID NO: 484693 - DNA, 25 bp, Mus musculus
gaggaacctggtgcgcatgcgtctc

SEQ ID NO: 484694 - DNA, 25 bp, Mus musculus
gaggaacctgtcataccggctggag

SEQ ID NO: 484695 - DNA, 25 bp, Mus musculus
gaggaacctgtcttaccggctggag

SEQ ID NO: 484696 - DNA, 25 bp, Mus musculus
gaggaacctgttattgagagcgcca

SEQ ID NO: 484697 - DNA, 25 bp, Mus musculus
gaggaacctgtttttgagagcgcca

SEQ ID NO: 484698 - DNA, 25 bp, Mus musculus
gaggaaccttccagggtcatgaaga

SEQ ID NO: 484699 - DNA, 25 bp, Mus musculus
gaggaaccttcctgggtcatgaaga

SEQ ID NO: 484700 - DNA, 25 bp, Mus musculus
gaggaacgccccagccaggagctaa

SEQ ID NO: 484701 - DNA, 25 bp, Mus musculus
gaggaacgcccctgccaggagctaa

SEQ ID NO: 484702 - DNA, 25 bp, Mus musculus
gaggaacgccgcactgtggtagaca

SEQ ID NO: 484703 - DNA, 25 bp, Mus musculus
gaggaacgccgcagaggccaagcac

SEQ ID NO: 484704 - DNA, 25 bp, Mus musculus
gaggaacgccgctctgtggtagaca

SEQ ID NO: 484705 - DNA, 25 bp, Mus musculus
gaggaacgccgctgaggccaagcac

SEQ ID NO: 484706 - DNA, 25 bp, Mus musculus
gaggaacggagacaaaaccatcatg

SEQ ID NO: 484707 - DNA, 25 bp, Mus musculus
gaggaacggagagaaaaccatcatg

SEQ ID NO: 484708 - DNA, 25 bp, Mus musculus
gaggaacggccgcatgctctctagt

SEQ ID NO: 484709 - DNA, 25 bp, Mus musculus
gaggaacggccggatgctctctagt

SEQ ID NO: 484710 - DNA, 25 bp, Mus musculus
gaggaacgggccacacggatctagt

SEQ ID NO: 484711 - DNA, 25 bp, Mus musculus
gaggaacgggccatgagagcaaaac

SEQ ID NO: 484712 - DNA, 25 bp, Mus musculus
gaggaacgggcctcacggatctagt

SEQ ID NO: 484713 - DNA, 25 bp, Mus musculus
gaggaacgggccttgagagcaaaac

SEQ ID NO: 484714 - DNA, 25 bp, Mus musculus
gaggaacgtaagacagccagccttg

SEQ ID NO: 484715 - DNA, 25 bp, Mus musculus
gaggaacgtaagtcagccagccttg

SEQ ID NO: 484716 - DNA, 25 bp, Mus musculus
gaggaacgtgcccaactgctacagc

SEQ ID NO: 484717 - DNA, 25 bp, Mus musculus
gaggaacgtgccgaactgctacagc

SEQ ID NO: 484718 - DNA, 25 bp, Mus musculus
gaggaactaagaccatacacagact

SEQ ID NO: 484719 - DNA, 25 bp, Mus musculus
gaggaactaagagcatacacagact

SEQ ID NO: 484720 - DNA, 25 bp, Mus musculus
gaggaactacccatatgccatgagg

SEQ ID NO: 484721 - DNA, 25 bp, Mus musculus
gaggaactacccttatgccatgagg

SEQ ID NO: 484722 - DNA, 25 bp, Mus musculus
gaggaactagcccatgtatatgaca

SEQ ID NO: 484723 - DNA, 25 bp, Mus musculus
gaggaactagccgatgtatatgaca

SEQ ID NO: 484724 - DNA, 25 bp, Mus musculus
gaggaactaggcaatcacatctaca

SEQ ID NO: 484725 - DNA, 25 bp, Mus musculus
gaggaactaggctatcacatctaca

SEQ ID NO: 484726 - DNA, 25 bp, Mus musculus
gaggaactagtaccataaacgctgc

SEQ ID NO: 484727 - DNA, 25 bp, Mus musculus
gaggaactagtagcataaacgctgc

SEQ ID NO: 484728 - DNA, 25 bp, Mus musculus
gaggaactcagccagccctttggag

SEQ ID NO: 484729 - DNA, 25 bp, Mus musculus
gaggaactcagcgagccctttggag

SEQ ID NO: 484730 - DNA, 25 bp, Mus musculus
gaggaactcattcttgcttataagt

SEQ ID NO: 484731 - DNA, 25 bp, Mus musculus
gaggaactcattgttgcttataagt

SEQ ID NO: 484732 - DNA, 25 bp, Mus musculus
gaggaactctcccactcttgaaagc

SEQ ID NO: 484733 - DNA, 25 bp, Mus musculus
gaggaactctccgactcttgaaagc

SEQ ID NO: 484734 - DNA, 25 bp, Mus musculus
gaggaactctgacgcatctgcagtt

SEQ ID NO: 484735 - DNA, 25 bp, Mus musculus
gaggaactctgaggcatctgcagtt

SEQ ID NO: 484736 - DNA, 25 bp, Mus musculus
gaggaactcttactcatctaacatc

SEQ ID NO: 484737 - DNA, 25 bp, Mus musculus
gaggaactcttagtcatctaacatc

SEQ ID NO: 484738 - DNA, 25 bp, Mus musculus
gaggaactcttgaagaccctggatc

SEQ ID NO: 484739 - DNA, 25 bp, Mus musculus
gaggaactcttgtagaccctggatc

SEQ ID NO: 484740 - DNA, 25 bp, Mus musculus
gaggaactgaataccccaggaccca

SEQ ID NO: 484741 - DNA, 25 bp, Mus musculus
gaggaactgaattccccaggaccca

SEQ ID NO: 484742 - DNA, 25 bp, Mus musculus
gaggaactgctcagcctaaactgca

SEQ ID NO: 484743 - DNA, 25 bp, Mus musculus
gaggaactgctctgcctaaactgca

SEQ ID NO: 484744 - DNA, 25 bp, Mus musculus
gaggaactgcttctacactggatgt

SEQ ID NO: 484745 - DNA, 25 bp, Mus musculus
gaggaactgcttgtacactggatgt

SEQ ID NO: 484746 - DNA, 25 bp, Mus musculus
gaggaactggcaaacctactgactg

SEQ ID NO: 484747 - DNA, 25 bp, Mus musculus
gaggaactggcatacctactgactg

SEQ ID NO: 484748 - DNA, 25 bp, Mus musculus
gaggaactggctactgtcatcaact

SEQ ID NO: 484749 - DNA, 25 bp, Mus musculus
gaggaactggctcggcaccagacac

SEQ ID NO: 484750 - DNA, 25 bp, Mus musculus
gaggaactggctcttaattatgatc

SEQ ID NO: 484751 - DNA, 25 bp, Mus musculus
gaggaactggctgggcaccagacac

SEQ ID NO: 484752 - DNA, 25 bp, Mus musculus
gaggaactggctgttaattatgatc

SEQ ID NO: 484753 - DNA, 25 bp, Mus musculus
gaggaactggcttctgtcatcaact

SEQ ID NO: 484754 - DNA, 25 bp, Mus musculus
gaggaactgggcactcatacaccct

SEQ ID NO: 484755 - DNA, 25 bp, Mus musculus
gaggaactgggcagaccgcctcaaa

SEQ ID NO: 484756 - DNA, 25 bp, Mus musculus
gaggaactgggctctcatacaccct

SEQ ID NO: 484757 - DNA, 25 bp, Mus musculus
gaggaactgggctgaccgcctcaaa

SEQ ID NO: 484758 - DNA, 25 bp, Mus musculus
gaggaactgtggatttctacccttg

SEQ ID NO: 484759 - DNA, 25 bp, Mus musculus
gaggaactgtggttttctacccttg

SEQ ID NO: 484760 - DNA, 25 bp, Mus musculus
gaggaactgtttctccactagagag

SEQ ID NO: 484761 - DNA, 25 bp, Mus musculus
gaggaactgtttgtccactagagag

SEQ ID NO: 484762 - DNA, 25 bp, Mus musculus
gaggaacttaaacatcctagctccc

SEQ ID NO: 484763 - DNA, 25 bp, Mus musculus
gaggaacttaaagatcctagctccc

SEQ ID NO: 484764 - DNA, 25 bp, Mus musculus
gaggaacttatgctttcttttggct

SEQ ID NO: 484765 - DNA, 25 bp, Mus musculus
gaggaacttatggtttcttttggct

SEQ ID NO: 484766 - DNA, 25 bp, Mus musculus
gaggaacttcaaataccacctttct

SEQ ID NO: 484767 - DNA, 25 bp, Mus musculus
gaggaacttcaactccttgtttcct

SEQ ID NO: 484768 - DNA, 25 bp, Mus musculus
gaggaacttcaagtccttgtttcct

SEQ ID NO: 484769 - DNA, 25 bp, Mus musculus
gaggaacttcaattaccacctttct

SEQ ID NO: 484770 - DNA, 25 bp, Mus musculus
gaggaacttctcagccacgagtttt

SEQ ID NO: 484771 - DNA, 25 bp, Mus musculus
gaggaacttctctgccacgagtttt

SEQ ID NO: 484772 - DNA, 25 bp, Mus musculus
gaggaacttctgagtggcttctgct

SEQ ID NO: 484773 - DNA, 25 bp, Mus musculus
gaggaacttctgtgtggcttctgct

SEQ ID NO: 484774 - DNA, 25 bp, Mus musculus
gaggaacttgaactttcctgtgtaa

SEQ ID NO: 484775 - DNA, 25 bp, Mus musculus
gaggaacttgaagtttcctgtgtaa

SEQ ID NO: 484776 - DNA, 25 bp, Mus musculus
gaggaacttgatctcttgattacaa

SEQ ID NO: 484777 - DNA, 25 bp, Mus musculus
gaggaacttgatgtcttgattacaa

SEQ ID NO: 484778 - DNA, 25 bp, Mus musculus
gaggaacttgtcataatggctgaga

SEQ ID NO: 484779 - DNA, 25 bp, Mus musculus
gaggaacttgtcttaatggctgaga

SEQ ID NO: 484780 - DNA, 25 bp, Mus musculus
gaggaactttccaatctgcctagaa

SEQ ID NO: 484781 - DNA, 25 bp, Mus musculus
gaggaactttcctatctgcctagaa

SEQ ID NO: 484782 - DNA, 25 bp, Mus musculus
gaggaagaaccaacgaccagcactg

SEQ ID NO: 484783 - DNA, 25 bp, Mus musculus
gaggaagaaccatcgaccagcactg

SEQ ID NO: 484784 - DNA, 25 bp, Mus musculus
gaggaagaacggacgctgcagtaac

SEQ ID NO: 484785 - DNA, 25 bp, Mus musculus
gaggaagaacggtcgctgcagtaac

SEQ ID NO: 484786 - DNA, 25 bp, Mus musculus
gaggaagacacacctgaggagctat

SEQ ID NO: 484787 - DNA, 25 bp, Mus musculus
gaggaagacacagctgaggagctat

SEQ ID NO: 484788 - DNA, 25 bp, Mus musculus
gaggaagacaccatctatcgctcgg

SEQ ID NO: 484789 - DNA, 25 bp, Mus musculus
gaggaagacaccttctatcgctcgg

SEQ ID NO: 484790 - DNA, 25 bp, Mus musculus
gaggaagacagaaccctttcccacc

SEQ ID NO: 484791 - DNA, 25 bp, Mus musculus
gaggaagacagatccctttcccacc

SEQ ID NO: 484792 - DNA, 25 bp, Mus musculus
gaggaagacaggcttccagtgatct

SEQ ID NO: 484793 - DNA, 25 bp, Mus musculus
gaggaagacagggttccagtgatct

SEQ ID NO: 484794 - DNA, 25 bp, Mus musculus
gaggaagacagtcgcccctgagaac

SEQ ID NO: 484795 - DNA, 25 bp, Mus musculus
gaggaagacagtggcccctgagaac

SEQ ID NO: 484796 - DNA, 25 bp, Mus musculus
gaggaagacatccaatatcaacctt

SEQ ID NO: 484797 - DNA, 25 bp, Mus musculus
gaggaagacatcgaatatcaacctt

SEQ ID NO: 484798 - DNA, 25 bp, Mus musculus
gaggaagaccacaaccagcgtgtga

SEQ ID NO: 484799 - DNA, 25 bp, Mus musculus
gaggaagaccactaccagcgtgtga

SEQ ID NO: 484800 - DNA, 25 bp, Mus musculus
gaggaagaccagcacgaatttacaa

SEQ ID NO: 484801 - DNA, 25 bp, Mus musculus
gaggaagaccaggacgaatttacaa

SEQ ID NO: 484802 - DNA, 25 bp, Mus musculus
gaggaagacctcaccttaccaactg

SEQ ID NO: 484803 - DNA, 25 bp, Mus musculus
gaggaagacctctccttaccaactg

SEQ ID NO: 484804 - DNA, 25 bp, Mus musculus
gaggaagacgccactgtgggctcca

SEQ ID NO: 484805 - DNA, 25 bp, Mus musculus
gaggaagacgcctctgtgggctcca

SEQ ID NO: 484806 - DNA, 25 bp, Mus musculus
gaggaagacgctacagtggcagctt

SEQ ID NO: 484807 - DNA, 25 bp, Mus musculus
gaggaagacgcttcagtggcagctt

SEQ ID NO: 484808 - DNA, 25 bp, Mus musculus
gaggaagactgtaaaaccatgacca

SEQ ID NO: 484809 - DNA, 25 bp, Mus musculus
gaggaagactgttaaaccatgacca

SEQ ID NO: 484810 - DNA, 25 bp, Mus musculus
gaggaagagactcccacccacagag

SEQ ID NO: 484811 - DNA, 25 bp, Mus musculus
gaggaagagactgccacccacagag

SEQ ID NO: 484812 - DNA, 25 bp, Mus musculus
gaggaagagatgaatcgcccgcacc

SEQ ID NO: 484813 - DNA, 25 bp, Mus musculus
gaggaagagatgtatcgcccgcacc

SEQ ID NO: 484814 - DNA, 25 bp, Mus musculus
gaggaagagcccctggactactatg

SEQ ID NO: 484815 - DNA, 25 bp, Mus musculus
gaggaagagcccgtggactactatg

SEQ ID NO: 484816 - DNA, 25 bp, Mus musculus
gaggaagagctcatgcccaaagcta

SEQ ID NO: 484817 - DNA, 25 bp, Mus musculus
gaggaagagctcttgcccaaagcta

SEQ ID NO: 484818 - DNA, 25 bp, Mus musculus
gaggaagagctgaccgttgcctacg

SEQ ID NO: 484819 - DNA, 25 bp, Mus musculus
gaggaagagctgtccgttgcctacg

SEQ ID NO: 484820 - DNA, 25 bp, Mus musculus
gaggaagaggcgacatcacaaggat

SEQ ID NO: 484821 - DNA, 25 bp, Mus musculus
gaggaagaggcgtcatcacaaggat

SEQ ID NO: 484822 - DNA, 25 bp, Mus musculus
gaggaagaggtcctggtacttttca

SEQ ID NO: 484823 - DNA, 25 bp, Mus musculus
gaggaagaggtcgtggtacttttca

SEQ ID NO: 484824 - DNA, 25 bp, Mus musculus
gaggaagagtccattaacatccaga

SEQ ID NO: 484825 - DNA, 25 bp, Mus musculus
gaggaagagtcctttaacatccaga

SEQ ID NO: 484826 - DNA, 25 bp, Mus musculus
gaggaagagttcaccctccatattc

SEQ ID NO: 484827 - DNA, 25 bp, Mus musculus
gaggaagagttctccctccatattc

SEQ ID NO: 484828 - DNA, 25 bp, Mus musculus
gaggaagataaacgtcacccgccct

SEQ ID NO: 484829 - DNA, 25 bp, Mus musculus
gaggaagataaaggtcacccgccct

SEQ ID NO: 484830 - DNA, 25 bp, Mus musculus
gaggaagatcccacaacagtgcaga

SEQ ID NO: 484831 - DNA, 25 bp, Mus musculus
gaggaagatccctcaacagtgcaga

SEQ ID NO: 484832 - DNA, 25 bp, Mus musculus
gaggaagatctgaagtcaatcaaca

SEQ ID NO: 484833 - DNA, 25 bp, Mus musculus
gaggaagatctgtagtcaatcaaca

SEQ ID NO: 484834 - DNA, 25 bp, Mus musculus
gaggaagatgctctttgcctatccc

SEQ ID NO: 484835 - DNA, 25 bp, Mus musculus
gaggaagatgctgtttgcctatccc

SEQ ID NO: 484836 - DNA, 25 bp, Mus musculus
gaggaagcaaccattcaacagatat

SEQ ID NO: 484837 - DNA, 25 bp, Mus musculus
gaggaagcaacctttcaacagatat

SEQ ID NO: 484838 - DNA, 25 bp, Mus musculus
gaggaagcactgataagcacattgt

SEQ ID NO: 484839 - DNA, 25 bp, Mus musculus
gaggaagcactgttaagcacattgt

SEQ ID NO: 484840 - DNA, 25 bp, Mus musculus
gaggaagcagcactgaaagcccctg

SEQ ID NO: 484841 - DNA, 25 bp, Mus musculus
gaggaagcagcagtgaaagcccctg

SEQ ID NO: 484842 - DNA, 25 bp, Mus musculus
gaggaagcagtgagtctagatctct

SEQ ID NO: 484843 - DNA, 25 bp, Mus musculus
gaggaagcagtgtgtctagatctct

SEQ ID NO: 484844 - DNA, 25 bp, Mus musculus
gaggaagcatataaggcccaaaatc

SEQ ID NO: 484845 - DNA, 25 bp, Mus musculus
gaggaagcatattaggcccaaaatc

SEQ ID NO: 484846 - DNA, 25 bp, Mus musculus
gaggaagcatctagtctggagtcca

SEQ ID NO: 484847 - DNA, 25 bp, Mus musculus
gaggaagcatcttgtctggagtcca

SEQ ID NO: 484848 - DNA, 25 bp, Mus musculus
gaggaagccacaaagtttctggccc

SEQ ID NO: 484849 - DNA, 25 bp, Mus musculus
gaggaagccacatagtttctggccc

SEQ ID NO: 484850 - DNA, 25 bp, Mus musculus
gaggaagccaccacggaggacgtct

SEQ ID NO: 484851 - DNA, 25 bp, Mus musculus
gaggaagccaccctgtggttttctt

SEQ ID NO: 484852 - DNA, 25 bp, Mus musculus
gaggaagccaccgtgtggttttctt

SEQ ID NO: 484853 - DNA, 25 bp, Mus musculus
gaggaagccacctcggaggacgtct

SEQ ID NO: 484854 - DNA, 25 bp, Mus musculus
gaggaagccagtcttcctggcatca

SEQ ID NO: 484855 - DNA, 25 bp, Mus musculus
gaggaagccagtgttcctggcatca

SEQ ID NO: 484856 - DNA, 25 bp, Mus musculus
gaggaagccataccagctgctcctt

SEQ ID NO: 484857 - DNA, 25 bp, Mus musculus
gaggaagccatagcagctgctcctt

SEQ ID NO: 484858 - DNA, 25 bp, Mus musculus
gaggaagccatgaacgccgcctact

SEQ ID NO: 484859 - DNA, 25 bp, Mus musculus
gaggaagccatgtacgccgcctact

SEQ ID NO: 484860 - DNA, 25 bp, Mus musculus
gaggaagcccaaacttgacagccat

SEQ ID NO: 484861 - DNA, 25 bp, Mus musculus
gaggaagcccaatcttgacagccat

SEQ ID NO: 484862 - DNA, 25 bp, Mus musculus
gaggaagcccacagtgttcacccgt

SEQ ID NO: 484863 - DNA, 25 bp, Mus musculus
gaggaagcccactgtgttcacccgt

SEQ ID NO: 484864 - DNA, 25 bp, Mus musculus
gaggaagccccacccatgtggtttc

SEQ ID NO: 484865 - DNA, 25 bp, Mus musculus
gaggaagccccagccatgtggtttc

SEQ ID NO: 484866 - DNA, 25 bp, Mus musculus
gaggaagccctaatcaactgcaggt

SEQ ID NO: 484867 - DNA, 25 bp, Mus musculus
gaggaagccctattcaactgcaggt

SEQ ID NO: 484868 - DNA, 25 bp, Mus musculus
gaggaagccctcaccatataaaatt

SEQ ID NO: 484869 - DNA, 25 bp, Mus musculus
gaggaagccctcagcacaggttgtc

SEQ ID NO: 484870 - DNA, 25 bp, Mus musculus
gaggaagccctctccatataaaatt

SEQ ID NO: 484871 - DNA, 25 bp, Mus musculus
gaggaagccctctgcacaggttgtc

SEQ ID NO: 484872 - DNA, 25 bp, Mus musculus
gaggaagccctgaccatcaaaaaca

SEQ ID NO: 484873 - DNA, 25 bp, Mus musculus
gaggaagccctgctcatacacctgg

SEQ ID NO: 484874 - DNA, 25 bp, Mus musculus
gaggaagccctggtcatacacctgg

SEQ ID NO: 484875 - DNA, 25 bp, Mus musculus
gaggaagccctgtccatcaaaaaca

SEQ ID NO: 484876 - DNA, 25 bp, Mus musculus
gaggaagccgttataccagaagagt

SEQ ID NO: 484877 - DNA, 25 bp, Mus musculus
gaggaagccgttttaccagaagagt

SEQ ID NO: 484878 - DNA, 25 bp, Mus musculus
gaggaagcgaagatgccccaactgt

SEQ ID NO: 484879 - DNA, 25 bp, Mus musculus
gaggaagcgaagttgccccaactgt

SEQ ID NO: 484880 - DNA, 25 bp, Mus musculus
gaggaagcgcacagtaagccctgaa

SEQ ID NO: 484881 - DNA, 25 bp, Mus musculus
gaggaagcgcactgtaagccctgaa

SEQ ID NO: 484882 - DNA, 25 bp, Mus musculus
gaggaagcgcatagctctgcagaaa

SEQ ID NO: 484883 - DNA, 25 bp, Mus musculus
gaggaagcgcattgctctgcagaaa

SEQ ID NO: 484884 - DNA, 25 bp, Mus musculus
gaggaagcgctcacgtggcaaccga

SEQ ID NO: 484885 - DNA, 25 bp, Mus musculus
gaggaagcgctctcgtggcaaccga

SEQ ID NO: 484886 - DNA, 25 bp, Mus musculus
gaggaagcggacatggaagatggga

SEQ ID NO: 484887 - DNA, 25 bp, Mus musculus
gaggaagcggacttggaagatggga

SEQ ID NO: 484888 - DNA, 25 bp, Mus musculus
gaggaagctagactatatcatctga

SEQ ID NO: 484889 - DNA, 25 bp, Mus musculus
gaggaagctagagtatatcatctga

SEQ ID NO: 484890 - DNA, 25 bp, Mus musculus
gaggaagctatgaaaccccaagaaa

SEQ ID NO: 484891 - DNA, 25 bp, Mus musculus
gaggaagctatgtaaccccaagaaa

SEQ ID NO: 484892 - DNA, 25 bp, Mus musculus
gaggaagctcacacactcaagagca

SEQ ID NO: 484893 - DNA, 25 bp, Mus musculus
gaggaagctcactcactcaagagca

SEQ ID NO: 484894 - DNA, 25 bp, Mus musculus
gaggaagctctgatagtgcccttgt

SEQ ID NO: 484895 - DNA, 25 bp, Mus musculus
gaggaagctctgttagtgcccttgt

SEQ ID NO: 484896 - DNA, 25 bp, Mus musculus
gaggaagctcttcggtttgtattaa

SEQ ID NO: 484897 - DNA, 25 bp, Mus musculus
gaggaagctcttgggtttgtattaa

SEQ ID NO: 484898 - DNA, 25 bp, Mus musculus
gaggaagctgaaaagcagaccggaa

SEQ ID NO: 484899 - DNA, 25 bp, Mus musculus
gaggaagctgaacccggcagaccct

SEQ ID NO: 484900 - DNA, 25 bp, Mus musculus
gaggaagctgaagccggcagaccct

SEQ ID NO: 484901 - DNA, 25 bp, Mus musculus
gaggaagctgaatagcagaccggaa

SEQ ID NO: 484902 - DNA, 25 bp, Mus musculus
gaggaagctgctataggccctctaa

SEQ ID NO: 484903 - DNA, 25 bp, Mus musculus
gaggaagctgctccatgcatacata

SEQ ID NO: 484904 - DNA, 25 bp, Mus musculus
gaggaagctgctcggcaccaagcca

SEQ ID NO: 484905 - DNA, 25 bp, Mus musculus
gaggaagctgctgcatgcatacata

SEQ ID NO: 484906 - DNA, 25 bp, Mus musculus
gaggaagctgctgggcaccaagcca

SEQ ID NO: 484907 - DNA, 25 bp, Mus musculus
gaggaagctgctttaggccctctaa

SEQ ID NO: 484908 - DNA, 25 bp, Mus musculus
gaggaagcttcaaagtcacagtctt

SEQ ID NO: 484909 - DNA, 25 bp, Mus musculus
gaggaagcttcatagtcacagtctt

SEQ ID NO: 484910 - DNA, 25 bp, Mus musculus
gaggaagcttctcctttgcgcctta

SEQ ID NO: 484911 - DNA, 25 bp, Mus musculus
gaggaagcttctgctttgcgcctta

SEQ ID NO: 484912 - DNA, 25 bp, Mus musculus
gaggaagcttgaatctgctacgcat

SEQ ID NO: 484913 - DNA, 25 bp, Mus musculus
gaggaagcttgattctgctacgcat

SEQ ID NO: 484914 - DNA, 25 bp, Mus musculus
gaggaagcttgcctgctttgttacc

SEQ ID NO: 484915 - DNA, 25 bp, Mus musculus
gaggaagcttgcgtgctttgttacc

SEQ ID NO: 484916 - DNA, 25 bp, Mus musculus
gaggaagcttttcttttactccatt

SEQ ID NO: 484917 - DNA, 25 bp, Mus musculus
gaggaagcttttgttttactccatt

SEQ ID NO: 484918 - DNA, 25 bp, Mus musculus
gaggaaggacccagttgccaggctc

SEQ ID NO: 484919 - DNA, 25 bp, Mus musculus
gaggaaggaccctgttgccaggctc

SEQ ID NO: 484920 - DNA, 25 bp, Mus musculus
gaggaaggagccaaaccgccttgct

SEQ ID NO: 484921 - DNA, 25 bp, Mus musculus
gaggaaggagcctaaccgccttgct

SEQ ID NO: 484922 - DNA, 25 bp, Mus musculus
gaggaaggagtgacaccctcccgtg

SEQ ID NO: 484923 - DNA, 25 bp, Mus musculus
gaggaaggagtgtcaccctcccgtg

SEQ ID NO: 484924 - DNA, 25 bp, Mus musculus
gaggaaggccaacactccaggtccc

SEQ ID NO: 484925 - DNA, 25 bp, Mus musculus
gaggaaggccaagactccaggtccc

SEQ ID NO: 484926 - DNA, 25 bp, Mus musculus
gaggaaggccttctatcacattccg

SEQ ID NO: 484927 - DNA, 25 bp, Mus musculus
gaggaaggccttgtatcacattccg

SEQ ID NO: 484928 - DNA, 25 bp, Mus musculus
gaggaaggctacacgcagtgctccc

SEQ ID NO: 484929 - DNA, 25 bp, Mus musculus
gaggaaggctactcgcagtgctccc

SEQ ID NO: 484930 - DNA, 25 bp, Mus musculus
gaggaaggctgtccacaagatctgc

SEQ ID NO: 484931 - DNA, 25 bp, Mus musculus
gaggaaggctgtgcacaagatctgc

SEQ ID NO: 484932 - DNA, 25 bp, Mus musculus
gaggaaggctttaggccattcttgg

SEQ ID NO: 484933 - DNA, 25 bp, Mus musculus
gaggaaggcttttggccattcttgg

SEQ ID NO: 484934 - DNA, 25 bp, Mus musculus
gaggaagggcaacttctcgcggccc

SEQ ID NO: 484935 - DNA, 25 bp, Mus musculus
gaggaagggcaagttctcgcggccc

SEQ ID NO: 484936 - DNA, 25 bp, Mus musculus
gaggaagggcctactagtgaccctg

SEQ ID NO: 484937 - DNA, 25 bp, Mus musculus
gaggaagggccttctagtgaccctg

SEQ ID NO: 484938 - DNA, 25 bp, Mus musculus
gaggaaggtagaacgctatgagtta

SEQ ID NO: 484939 - DNA, 25 bp, Mus musculus
gaggaaggtagatcgctatgagtta

SEQ ID NO: 484940 - DNA, 25 bp, Mus musculus
gaggaaggtctgactccttgaatcc

SEQ ID NO: 484941 - DNA, 25 bp, Mus musculus
gaggaaggtctgtctccttgaatcc

SEQ ID NO: 484942 - DNA, 25 bp, Mus musculus
gaggaaggttcacgtggcccaatct

SEQ ID NO: 484943 - DNA, 25 bp, Mus musculus
gaggaaggttcaggtggcccaatct

SEQ ID NO: 484944 - DNA, 25 bp, Mus musculus
gaggaagtaactctacaggacactt

SEQ ID NO: 484945 - DNA, 25 bp, Mus musculus
gaggaagtaactgtacaggacactt

SEQ ID NO: 484946 - DNA, 25 bp, Mus musculus
gaggaagtacctacacctggacttt

SEQ ID NO: 484947 - DNA, 25 bp, Mus musculus
gaggaagtaccttcacctggacttt

SEQ ID NO: 484948 - DNA, 25 bp, Mus musculus
gaggaagtactaataccaaccaaca

SEQ ID NO: 484949 - DNA, 25 bp, Mus musculus
gaggaagtactattaccaaccaaca

SEQ ID NO: 484950 - DNA, 25 bp, Mus musculus
gaggaagtagatattcaacaagggc

SEQ ID NO: 484951 - DNA, 25 bp, Mus musculus
gaggaagtagattttcaacaagggc

SEQ ID NO: 484952 - DNA, 25 bp, Mus musculus
gaggaagtatgcagttctctatcag

SEQ ID NO: 484953 - DNA, 25 bp, Mus musculus
gaggaagtatgctgttctctatcag

SEQ ID NO: 484954 - DNA, 25 bp, Mus musculus
gaggaagtcatgcttttgcaactga

SEQ ID NO: 484955 - DNA, 25 bp, Mus musculus
gaggaagtcatggttttgcaactga

SEQ ID NO: 484956 - DNA, 25 bp, Mus musculus
gaggaagtccaaaccagccaacctg

SEQ ID NO: 484957 - DNA, 25 bp, Mus musculus
gaggaagtccaatccagccaacctg

SEQ ID NO: 484958 - DNA, 25 bp, Mus musculus
gaggaagtccacacaggccggagat

SEQ ID NO: 484959 - DNA, 25 bp, Mus musculus
gaggaagtccactcaggccggagat

SEQ ID NO: 484960 - DNA, 25 bp, Mus musculus
gaggaagtcccaagtcgcacattga

SEQ ID NO: 484961 - DNA, 25 bp, Mus musculus
gaggaagtcccatgtcgcacattga

SEQ ID NO: 484962 - DNA, 25 bp, Mus musculus
gaggaagtctgaaccacaggctaga

SEQ ID NO: 484963 - DNA, 25 bp, Mus musculus
gaggaagtctgatccacaggctaga

SEQ ID NO: 484964 - DNA, 25 bp, Mus musculus
gaggaagtctgccacaactggcttt

SEQ ID NO: 484965 - DNA, 25 bp, Mus musculus
gaggaagtctgcgacaactggcttt

SEQ ID NO: 484966 - DNA, 25 bp, Mus musculus
gaggaagtctggagtctgccgctaa

SEQ ID NO: 484967 - DNA, 25 bp, Mus musculus
gaggaagtctggtgtctgccgctaa

SEQ ID NO: 484968 - DNA, 25 bp, Mus musculus
gaggaagtctgtccaacaaggcccc

SEQ ID NO: 484969 - DNA, 25 bp, Mus musculus
gaggaagtctgtgcaacaaggcccc

SEQ ID NO: 484970 - DNA, 25 bp, Mus musculus
gaggaagtgatacaccccagctcag

SEQ ID NO: 484971 - DNA, 25 bp, Mus musculus
gaggaagtgatagaccccagctcag

SEQ ID NO: 484972 - DNA, 25 bp, Mus musculus
gaggaagtgctcatatgtacaacca

SEQ ID NO: 484973 - DNA, 25 bp, Mus musculus
gaggaagtgctcttatgtacaacca

SEQ ID NO: 484974 - DNA, 25 bp, Mus musculus
gaggaagtggctcagttcatacagt

SEQ ID NO: 484975 - DNA, 25 bp, Mus musculus
gaggaagtggctgagttcatacagt

SEQ ID NO: 484976 - DNA, 25 bp, Mus musculus
gaggaagtgtggacattctaacaac

SEQ ID NO: 484977 - DNA, 25 bp, Mus musculus
gaggaagtgtggtcattctaacaac

SEQ ID NO: 484978 - DNA, 25 bp, Mus musculus
gaggaagttattcctgatgccattt

SEQ ID NO: 484979 - DNA, 25 bp, Mus musculus
gaggaagttattgctgatgccattt

SEQ ID NO: 484980 - DNA, 25 bp, Mus musculus
gaggaagttctacacgaggcttacc

SEQ ID NO: 484981 - DNA, 25 bp, Mus musculus
gaggaagttctacgttggctctcct

SEQ ID NO: 484982 - DNA, 25 bp, Mus musculus
gaggaagttctagacgaggcttacc

SEQ ID NO: 484983 - DNA, 25 bp, Mus musculus
gaggaagttctaggttggctctcct

SEQ ID NO: 484984 - DNA, 25 bp, Mus musculus
gaggaagttctcaacatacgcagag

SEQ ID NO: 484985 - DNA, 25 bp, Mus musculus
gaggaagttctctacatacgcagag

SEQ ID NO: 484986 - DNA, 25 bp, Mus musculus
gaggaagtttccaaactgtgcccct

SEQ ID NO: 484987 - DNA, 25 bp, Mus musculus
gaggaagtttcctaactgtgcccct

SEQ ID NO: 484988 - DNA, 25 bp, Mus musculus
gaggaataacatagccctggccttg

SEQ ID NO: 484989 - DNA, 25 bp, Mus musculus
gaggaataacattgccctggccttg

SEQ ID NO: 484990 - DNA, 25 bp, Mus musculus
gaggaataacctctccagcagaccc

SEQ ID NO: 484991 - DNA, 25 bp, Mus musculus
gaggaataacctgtccagcagaccc

SEQ ID NO: 484992 - DNA, 25 bp, Mus musculus
gaggaataatgcaggtcttcagaaa

SEQ ID NO: 484993 - DNA, 25 bp, Mus musculus
gaggaataatgctggtcttcagaaa

SEQ ID NO: 484994 - DNA, 25 bp, Mus musculus
gaggaatacctgacggctattgaga

SEQ ID NO: 484995 - DNA, 25 bp, Mus musculus
gaggaatacctgtcggctattgaga

SEQ ID NO: 484996 - DNA, 25 bp, Mus musculus
gaggaataccttagctggacccagc

SEQ ID NO: 484997 - DNA, 25 bp, Mus musculus
gaggaatacctttgctggacccagc

SEQ ID NO: 484998 - DNA, 25 bp, Mus musculus
gaggaatacttcaagtgcaagaaat

SEQ ID NO: 484999 - DNA, 25 bp, Mus musculus
gaggaatacttctagtgcaagaaat

SEQ ID NO: 485000 - DNA, 25 bp, Mus musculus
gaggaatagcctactggaagatttc

SEQ ID NO: 485001 - DNA, 25 bp, Mus musculus
gaggaatagccttctggaagatttc

SEQ ID NO: 485002 - DNA, 25 bp, Mus musculus
gaggaatagttgacaaagccaaaac

SEQ ID NO: 485003 - DNA, 25 bp, Mus musculus
gaggaatagttgtcaaagccaaaac

SEQ ID NO: 485004 - DNA, 25 bp, Mus musculus
gaggaatatatcactgcctatccaa

SEQ ID NO: 485005 - DNA, 25 bp, Mus musculus
gaggaatatatctctgcctatccaa

SEQ ID NO: 485006 - DNA, 25 bp, Mus musculus
gaggaatatcaccagatgcttggct

SEQ ID NO: 485007 - DNA, 25 bp, Mus musculus
gaggaatatcacgagatgcttggct

SEQ ID NO: 485008 - DNA, 25 bp, Mus musculus
gaggaatatccgatcaaacgctcat

SEQ ID NO: 485009 - DNA, 25 bp, Mus musculus
gaggaatatccgttcaaacgctcat

SEQ ID NO: 485010 - DNA, 25 bp, Mus musculus
gaggaatatctcatcctattagtga

SEQ ID NO: 485011 - DNA, 25 bp, Mus musculus
gaggaatatctcttcctattagtga

SEQ ID NO: 485012 - DNA, 25 bp, Mus musculus
gaggaatatgacctcttggagaaga

SEQ ID NO: 485013 - DNA, 25 bp, Mus musculus
gaggaatatgacctgacccttagtt

SEQ ID NO: 485014 - DNA, 25 bp, Mus musculus
gaggaatatgacgtcttggagaaga

SEQ ID NO: 485015 - DNA, 25 bp, Mus musculus
gaggaatatgacgtgacccttagtt

SEQ ID NO: 485016 - DNA, 25 bp, Mus musculus
gaggaatattgcattttactatgaa

SEQ ID NO: 485017 - DNA, 25 bp, Mus musculus
gaggaatattgctttttactatgaa

SEQ ID NO: 485018 - DNA, 25 bp, Mus musculus
gaggaatcacacaataactgcagat

SEQ ID NO: 485019 - DNA, 25 bp, Mus musculus
gaggaatcacactataactgcagat

SEQ ID NO: 485020 - DNA, 25 bp, Mus musculus
gaggaatcagagaccttagctccct

SEQ ID NO: 485021 - DNA, 25 bp, Mus musculus
gaggaatcagagtccttagctccct

SEQ ID NO: 485022 - DNA, 25 bp, Mus musculus
gaggaatcagatcctttatacccgc

SEQ ID NO: 485023 - DNA, 25 bp, Mus musculus
gaggaatcagatgctttatacccgc

SEQ ID NO: 485024 - DNA, 25 bp, Mus musculus
gaggaatcagtcactaacacttgtc

SEQ ID NO: 485025 - DNA, 25 bp, Mus musculus
gaggaatcagtctctaacacttgtc

SEQ ID NO: 485026 - DNA, 25 bp, Mus musculus
gaggaatccaatctagtacacttag

SEQ ID NO: 485027 - DNA, 25 bp, Mus musculus
gaggaatccaatgtagtacacttag

SEQ ID NO: 485028 - DNA, 25 bp, Mus musculus
gaggaatccaggctcactcaggaaa

SEQ ID NO: 485029 - DNA, 25 bp, Mus musculus
gaggaatccagggtcactcaggaaa

SEQ ID NO: 485030 - DNA, 25 bp, Mus musculus
gaggaatcccaaaatcagtgcccgg

SEQ ID NO: 485031 - DNA, 25 bp, Mus musculus
gaggaatcccaatatcagtgcccgg

SEQ ID NO: 485032 - DNA, 25 bp, Mus musculus
gaggaatccctgaagacctgcatcc

SEQ ID NO: 485033 - DNA, 25 bp, Mus musculus
gaggaatccctgtagacctgcatcc

SEQ ID NO: 485034 - DNA, 25 bp, Mus musculus
gaggaatcctcaatttgcatctgga

SEQ ID NO: 485035 - DNA, 25 bp, Mus musculus
gaggaatcctcattttgcatctgga

SEQ ID NO: 485036 - DNA, 25 bp, Mus musculus
gaggaatcctttagagagggacaaa

SEQ ID NO: 485037 - DNA, 25 bp, Mus musculus
gaggaatccttttgagagggacaaa

SEQ ID NO: 485038 - DNA, 25 bp, Mus musculus
gaggaatcgaacaccggagcgtcct

SEQ ID NO: 485039 - DNA, 25 bp, Mus musculus
gaggaatcgaactccggagcgtcct

SEQ ID NO: 485040 - DNA, 25 bp, Mus musculus
gaggaatcggctaaaacatgagctt

SEQ ID NO: 485041 - DNA, 25 bp, Mus musculus
gaggaatcggcttaaacatgagctt

SEQ ID NO: 485042 - DNA, 25 bp, Mus musculus
gaggaatctagacagcctctgtcct

SEQ ID NO: 485043 - DNA, 25 bp, Mus musculus
gaggaatctagagagcctctgtcct

SEQ ID NO: 485044 - DNA, 25 bp, Mus musculus
gaggaatcttggctctgaagagccc

SEQ ID NO: 485045 - DNA, 25 bp, Mus musculus
gaggaatcttgggtctgaagagccc

SEQ ID NO: 485046 - DNA, 25 bp, Mus musculus
gaggaatgacagaaaccccaccgta

SEQ ID NO: 485047 - DNA, 25 bp, Mus musculus
gaggaatgacagtaaccccaccgta

SEQ ID NO: 485048 - DNA, 25 bp, Mus musculus
gaggaatgagttcctttaaaaccag

SEQ ID NO: 485049 - DNA, 25 bp, Mus musculus
gaggaatgagttgctttaaaaccag

SEQ ID NO: 485050 - DNA, 25 bp, Mus musculus
gaggaatgcacgacctttttccaga

SEQ ID NO: 485051 - DNA, 25 bp, Mus musculus
gaggaatgcacgtcctttttccaga

SEQ ID NO: 485052 - DNA, 25 bp, Mus musculus
gaggaatgcactactgaaagtcaaa

SEQ ID NO: 485053 - DNA, 25 bp, Mus musculus
gaggaatgcacttctgaaagtcaaa

SEQ ID NO: 485054 - DNA, 25 bp, Mus musculus
gaggaatgcgcacctgccaggacct

SEQ ID NO: 485055 - DNA, 25 bp, Mus musculus
gaggaatgcgcagctgccaggacct

SEQ ID NO: 485056 - DNA, 25 bp, Mus musculus
gaggaatggctaccaacattttgat

SEQ ID NO: 485057 - DNA, 25 bp, Mus musculus
gaggaatggctagcaacattttgat

SEQ ID NO: 485058 - DNA, 25 bp, Mus musculus
gaggaatgggaactcttgccccagc

SEQ ID NO: 485059 - DNA, 25 bp, Mus musculus
gaggaatgggaagtcttgccccagc

SEQ ID NO: 485060 - DNA, 25 bp, Mus musculus
gaggaatgggctactccacacaagc

SEQ ID NO: 485061 - DNA, 25 bp, Mus musculus
gaggaatgggcttctccacacaagc

SEQ ID NO: 485062 - DNA, 25 bp, Mus musculus
gaggaatgtagaatttcccaaattc

SEQ ID NO: 485063 - DNA, 25 bp, Mus musculus
gaggaatgtagattttcccaaattc

SEQ ID NO: 485064 - DNA, 25 bp, Mus musculus
gaggaatgtatcattatgtttaccc

SEQ ID NO: 485065 - DNA, 25 bp, Mus musculus
gaggaatgtatctttatgtttaccc

SEQ ID NO: 485066 - DNA, 25 bp, Mus musculus
gaggaatgtcatagtagagtcacca

SEQ ID NO: 485067 - DNA, 25 bp, Mus musculus
gaggaatgtcattgtagagtcacca

SEQ ID NO: 485068 - DNA, 25 bp, Mus musculus
gaggaatgtcttcaccaggtcctag

SEQ ID NO: 485069 - DNA, 25 bp, Mus musculus
gaggaatgtcttgaccaggtcctag

SEQ ID NO: 485070 - DNA, 25 bp, Mus musculus
gaggaatgtttaacgcaccgggaag

SEQ ID NO: 485071 - DNA, 25 bp, Mus musculus
gaggaatgtttatcgcaccgggaag

SEQ ID NO: 485072 - DNA, 25 bp, Mus musculus
gaggaatgtttcagtcccgggagac

SEQ ID NO: 485073 - DNA, 25 bp, Mus musculus
gaggaatgtttctgtcccgggagac

SEQ ID NO: 485074 - DNA, 25 bp, Mus musculus
gaggaattactgctctccagggatg

SEQ ID NO: 485075 - DNA, 25 bp, Mus musculus
gaggaattactggtctccagggatg

SEQ ID NO: 485076 - DNA, 25 bp, Mus musculus
gaggaattacttatcggacattgac

SEQ ID NO: 485077 - DNA, 25 bp, Mus musculus
gaggaattacttttcggacattgac

SEQ ID NO: 485078 - DNA, 25 bp, Mus musculus
gaggaattattgactctgtattaca

SEQ ID NO: 485079 - DNA, 25 bp, Mus musculus
gaggaattattgtctctgtattaca

SEQ ID NO: 485080 - DNA, 25 bp, Mus musculus
gaggaattcaacacaggtcccctct

SEQ ID NO: 485081 - DNA, 25 bp, Mus musculus
gaggaattcaactcaggtcccctct

SEQ ID NO: 485082 - DNA, 25 bp, Mus musculus
gaggaattcatactcccctgtgaag

SEQ ID NO: 485083 - DNA, 25 bp, Mus musculus
gaggaattcatagtcccctgtgaag

SEQ ID NO: 485084 - DNA, 25 bp, Mus musculus
gaggaattcatccatcctattggag

SEQ ID NO: 485085 - DNA, 25 bp, Mus musculus
gaggaattcatcgatcctattggag

SEQ ID NO: 485086 - DNA, 25 bp, Mus musculus
gaggaattccaaagccagagtcaga

SEQ ID NO: 485087 - DNA, 25 bp, Mus musculus
gaggaattccaatgccagagtcaga

SEQ ID NO: 485088 - DNA, 25 bp, Mus musculus
gaggaattccagaagcgtgccaaac

SEQ ID NO: 485089 - DNA, 25 bp, Mus musculus
gaggaattccagtagcgtgccaaac

SEQ ID NO: 485090 - DNA, 25 bp, Mus musculus
gaggaattccatatagggcaagagc

SEQ ID NO: 485091 - DNA, 25 bp, Mus musculus
gaggaattccatttagggcaagagc

SEQ ID NO: 485092 - DNA, 25 bp, Mus musculus
gaggaattccctccaagtctgagga

SEQ ID NO: 485093 - DNA, 25 bp, Mus musculus
gaggaattccctgcaagtctgagga

SEQ ID NO: 485094 - DNA, 25 bp, Mus musculus
gaggaattcctaaggttttaccaga

SEQ ID NO: 485095 - DNA, 25 bp, Mus musculus
gaggaattcctaccatctatatgaa

SEQ ID NO: 485096 - DNA, 25 bp, Mus musculus
gaggaattcctagcatctatatgaa

SEQ ID NO: 485097 - DNA, 25 bp, Mus musculus
gaggaattcctatggttttaccaga

SEQ ID NO: 485098 - DNA, 25 bp, Mus musculus
gaggaattcctgagagctacagaga

SEQ ID NO: 485099 - DNA, 25 bp, Mus musculus
gaggaattcctgtgagctacagaga

SEQ ID NO: 485100 - DNA, 25 bp, Mus musculus
gaggaattccttcagctttggtatc

SEQ ID NO: 485101 - DNA, 25 bp, Mus musculus
gaggaattccttgagctttggtatc

SEQ ID NO: 485102 - DNA, 25 bp, Mus musculus
gaggaattcgggaaatcaccctgtg

SEQ ID NO: 485103 - DNA, 25 bp, Mus musculus
gaggaattcgggtaatcaccctgtg

SEQ ID NO: 485104 - DNA, 25 bp, Mus musculus
gaggaattcggtatcagcttcagcc

SEQ ID NO: 485105 - DNA, 25 bp, Mus musculus
gaggaattcggtttcagcttcagcc

SEQ ID NO: 485106 - DNA, 25 bp, Mus musculus
gaggaattcgtgcaaagaccctgcc

SEQ ID NO: 485107 - DNA, 25 bp, Mus musculus
gaggaattcgtggaaagaccctgcc

SEQ ID NO: 485108 - DNA, 25 bp, Mus musculus
gaggaattcgttctacccaaggagc

SEQ ID NO: 485109 - DNA, 25 bp, Mus musculus
gaggaattcgttgtacccaaggagc

SEQ ID NO: 485110 - DNA, 25 bp, Mus musculus
gaggaattctaacttcgctgccttc

SEQ ID NO: 485111 - DNA, 25 bp, Mus musculus
gaggaattctaagttcgctgccttc

SEQ ID NO: 485112 - DNA, 25 bp, Mus musculus
gaggaattctgcatgccaacaaaga

SEQ ID NO: 485113 - DNA, 25 bp, Mus musculus
gaggaattctgcttgccaacaaaga

SEQ ID NO: 485114 - DNA, 25 bp, Mus musculus
gaggaattctgtaactgataatcgt

SEQ ID NO: 485115 - DNA, 25 bp, Mus musculus
gaggaattctgttactgataatcgt

SEQ ID NO: 485116 - DNA, 25 bp, Mus musculus
gaggaattctttaatgcaggtcatc

SEQ ID NO: 485117 - DNA, 25 bp, Mus musculus
gaggaattcttttatgcaggtcatc

SEQ ID NO: 485118 - DNA, 25 bp, Mus musculus
gaggaattggcaactcctggctgtc

SEQ ID NO: 485119 - DNA, 25 bp, Mus musculus
gaggaattggcatctcctggctgtc

SEQ ID NO: 485120 - DNA, 25 bp, Mus musculus
gaggaatttccactacagatgctgt

SEQ ID NO: 485121 - DNA, 25 bp, Mus musculus
gaggaatttccagtacagatgctgt

SEQ ID NO: 485122 - DNA, 25 bp, Mus musculus
gaggaatttcccaaatgatccaaat

SEQ ID NO: 485123 - DNA, 25 bp, Mus musculus
gaggaatttccctaatgatccaaat

SEQ ID NO: 485124 - DNA, 25 bp, Mus musculus
gaggaatttcctaactggggccaag

SEQ ID NO: 485125 - DNA, 25 bp, Mus musculus
gaggaatttccttactggggccaag

SEQ ID NO: 485126 - DNA, 25 bp, Mus musculus
gaggaatttcgccaccgcatgcgca

SEQ ID NO: 485127 - DNA, 25 bp, Mus musculus
gaggaatttcgcgaccgcatgcgca

SEQ ID NO: 485128 - DNA, 25 bp, Mus musculus
gaggaatttggaaccaacctgtctt

SEQ ID NO: 485129 - DNA, 25 bp, Mus musculus
gaggaatttggatccaacctgtctt

SEQ ID NO: 485130 - DNA, 25 bp, Mus musculus
gaggaattttccagaaggcagggcc

SEQ ID NO: 485131 - DNA, 25 bp, Mus musculus
gaggaattttcctgaaggcagggcc

SEQ ID NO: 485132 - DNA, 25 bp, Mus musculus
gaggaattttttcccacgattatat

SEQ ID NO: 485133 - DNA, 25 bp, Mus musculus
gaggaattttttgccacgattatat

SEQ ID NO: 485134 - DNA, 25 bp, Mus musculus
gaggacaaaaggattggtctgtgac

SEQ ID NO: 485135 - DNA, 25 bp, Mus musculus
gaggacaaaaggtttggtctgtgac

SEQ ID NO: 485136 - DNA, 25 bp, Mus musculus
gaggacaaaatgctattgccagaag

SEQ ID NO: 485137 - DNA, 25 bp, Mus musculus
gaggacaaaatggtattgccagaag

SEQ ID NO: 485138 - DNA, 25 bp, Mus musculus
gaggacaaacttcagaacacagccc

SEQ ID NO: 485139 - DNA, 25 bp, Mus musculus
gaggacaaacttgagaacacagccc

SEQ ID NO: 485140 - DNA, 25 bp, Mus musculus
gaggacaaatccagtctacttaaat

SEQ ID NO: 485141 - DNA, 25 bp, Mus musculus
gaggacaaatcctgtctacttaaat

SEQ ID NO: 485142 - DNA, 25 bp, Mus musculus
gaggacaaatctactcaggtgaatg

SEQ ID NO: 485143 - DNA, 25 bp, Mus musculus
gaggacaaatcttctcaggtgaatg

SEQ ID NO: 485144 - DNA, 25 bp, Mus musculus
gaggacaacatcactctggtctgga

SEQ ID NO: 485145 - DNA, 25 bp, Mus musculus
gaggacaacatctctctggtctgga

SEQ ID NO: 485146 - DNA, 25 bp, Mus musculus
gaggacaaccctatggccagtaggt

SEQ ID NO: 485147 - DNA, 25 bp, Mus musculus
gaggacaaccctttggccagtaggt

SEQ ID NO: 485148 - DNA, 25 bp, Mus musculus
gaggacaacgacaccgtaaagcgta

SEQ ID NO: 485149 - DNA, 25 bp, Mus musculus
gaggacaacgactccgtaaagcgta

SEQ ID NO: 485150 - DNA, 25 bp, Mus musculus
gaggacaactgtcactttagcatgt

SEQ ID NO: 485151 - DNA, 25 bp, Mus musculus
gaggacaactgtgactttagcatgt

SEQ ID NO: 485152 - DNA, 25 bp, Mus musculus
gaggacaagataaggcctactttac

SEQ ID NO: 485153 - DNA, 25 bp, Mus musculus
gaggacaagatatggcctactttac

SEQ ID NO: 485154 - DNA, 25 bp, Mus musculus
gaggacaagatgctcggcccctagc

SEQ ID NO: 485155 - DNA, 25 bp, Mus musculus
gaggacaagatggtcggcccctagc

SEQ ID NO: 485156 - DNA, 25 bp, Mus musculus
gaggacaagcaacgctactgtgtga

SEQ ID NO: 485157 - DNA, 25 bp, Mus musculus
gaggacaagcaaggctactgtgtga

SEQ ID NO: 485158 - DNA, 25 bp, Mus musculus
gaggacaagcagatgaccctggaga

SEQ ID NO: 485159 - DNA, 25 bp, Mus musculus
gaggacaagcagttgaccctggaga

SEQ ID NO: 485160 - DNA, 25 bp, Mus musculus
gaggacaagctactgctccagacac

SEQ ID NO: 485161 - DNA, 25 bp, Mus musculus
gaggacaagctagtgctccagacac

SEQ ID NO: 485162 - DNA, 25 bp, Mus musculus
gaggacaagtatccttagtcctgct

SEQ ID NO: 485163 - DNA, 25 bp, Mus musculus
gaggacaagtatgcttagtcctgct

SEQ ID NO: 485164 - DNA, 25 bp, Mus musculus
gaggacaagtctacgttgagtacgc

SEQ ID NO: 485165 - DNA, 25 bp, Mus musculus
gaggacaagtcttcgttgagtacgc

SEQ ID NO: 485166 - DNA, 25 bp, Mus musculus
gaggacaagttgcagaaatcgattc

SEQ ID NO: 485167 - DNA, 25 bp, Mus musculus
gaggacaagttggagaaatcgattc

SEQ ID NO: 485168 - DNA, 25 bp, Mus musculus
gaggacaatccgaacatcaaatatc

SEQ ID NO: 485169 - DNA, 25 bp, Mus musculus
gaggacaatccgtacatcaaatatc

SEQ ID NO: 485170 - DNA, 25 bp, Mus musculus
gaggacaatgaaaccttgtttgctt

SEQ ID NO: 485171 - DNA, 25 bp, Mus musculus
gaggacaatgaatccttgtttgctt

SEQ ID NO: 485172 - DNA, 25 bp, Mus musculus
gaggacaatgatcatggtctttctt

SEQ ID NO: 485173 - DNA, 25 bp, Mus musculus
gaggacaatgatgatggtctttctt

SEQ ID NO: 485174 - DNA, 25 bp, Mus musculus
gaggacacaaacagcttttcatctt

SEQ ID NO: 485175 - DNA, 25 bp, Mus musculus
gaggacacaaactgcttttcatctt

SEQ ID NO: 485176 - DNA, 25 bp, Mus musculus
gaggacacaagtccttttgccctgt

SEQ ID NO: 485177 - DNA, 25 bp, Mus musculus
gaggacacaagtgcttttgccctgt

SEQ ID NO: 485178 - DNA, 25 bp, Mus musculus
gaggacacacacaccctgagggcaa

SEQ ID NO: 485179 - DNA, 25 bp, Mus musculus
gaggacacacacagagccggcacag

SEQ ID NO: 485180 - DNA, 25 bp, Mus musculus
gaggacacacacctctacagtacta

SEQ ID NO: 485181 - DNA, 25 bp, Mus musculus
gaggacacacacgtctacagtacta

SEQ ID NO: 485182 - DNA, 25 bp, Mus musculus
gaggacacacactccctgagggcaa

SEQ ID NO: 485183 - DNA, 25 bp, Mus musculus
gaggacacacactgagccggcacag

SEQ ID NO: 485184 - DNA, 25 bp, Mus musculus
gaggacacacatagaccgtggccaa

SEQ ID NO: 485185 - DNA, 25 bp, Mus musculus
gaggacacacattgaccgtggccaa

SEQ ID NO: 485186 - DNA, 25 bp, Mus musculus
gaggacacaccgaaccatgtcatgt

SEQ ID NO: 485187 - DNA, 25 bp, Mus musculus
gaggacacaccgtaccatgtcatgt

SEQ ID NO: 485188 - DNA, 25 bp, Mus musculus
gaggacacacgtctgtggcaccaaa

SEQ ID NO: 485189 - DNA, 25 bp, Mus musculus
gaggacacacgtgtgtggcaccaaa

SEQ ID NO: 485190 - DNA, 25 bp, Mus musculus
gaggacacactcagctgctatttaa

SEQ ID NO: 485191 - DNA, 25 bp, Mus musculus
gaggacacactctgctgctatttaa

SEQ ID NO: 485192 - DNA, 25 bp, Mus musculus
gaggacacacttatggcacagatct

SEQ ID NO: 485193 - DNA, 25 bp, Mus musculus
gaggacacacttttggcacagatct

SEQ ID NO: 485194 - DNA, 25 bp, Mus musculus
gaggacacagaaccttttcttttcc

SEQ ID NO: 485195 - DNA, 25 bp, Mus musculus
gaggacacagaagcttttcttttcc

SEQ ID NO: 485196 - DNA, 25 bp, Mus musculus
gaggacacaggcaggctttgcacct

SEQ ID NO: 485197 - DNA, 25 bp, Mus musculus
gaggacacaggctggctttgcacct

SEQ ID NO: 485198 - DNA, 25 bp, Mus musculus
gaggacacagtccaccatggtcatt

SEQ ID NO: 485199 - DNA, 25 bp, Mus musculus
gaggacacagtcgaccatggtcatt

SEQ ID NO: 485200 - DNA, 25 bp, Mus musculus
gaggacacagttacccagcgatgac

SEQ ID NO: 485201 - DNA, 25 bp, Mus musculus
gaggacacagtttcccagcgatgac

SEQ ID NO: 485202 - DNA, 25 bp, Mus musculus
gaggacacatccatgcatctcaggg

SEQ ID NO: 485203 - DNA, 25 bp, Mus musculus
gaggacacatccttgcatctcaggg

SEQ ID NO: 485204 - DNA, 25 bp, Mus musculus
gaggacacatggaaggaccctgcct

SEQ ID NO: 485205 - DNA, 25 bp, Mus musculus
gaggacacatggtaggaccctgcct

SEQ ID NO: 485206 - DNA, 25 bp, Mus musculus
gaggacacatgtagactagataggt

SEQ ID NO: 485207 - DNA, 25 bp, Mus musculus
gaggacacatgttgactagataggt

SEQ ID NO: 485208 - DNA, 25 bp, Mus musculus
gaggacacattacgccctctgcaag

SEQ ID NO: 485209 - DNA, 25 bp, Mus musculus
gaggacacattaggccctctgcaag

SEQ ID NO: 485210 - DNA, 25 bp, Mus musculus
gaggacaccaccaactggctacgat

SEQ ID NO: 485211 - DNA, 25 bp, Mus musculus
gaggacaccacctactggctacgat

SEQ ID NO: 485212 - DNA, 25 bp, Mus musculus
gaggacacccatatctgggcacttt

SEQ ID NO: 485213 - DNA, 25 bp, Mus musculus
gaggacacccatttctgggcacttt

SEQ ID NO: 485214 - DNA, 25 bp, Mus musculus
gaggacaccttcatcggtatctgga

SEQ ID NO: 485215 - DNA, 25 bp, Mus musculus
gaggacaccttcttcggtatctgga

SEQ ID NO: 485216 - DNA, 25 bp, Mus musculus
gaggacacgtcaacatatttctgtg

SEQ ID NO: 485217 - DNA, 25 bp, Mus musculus
gaggacacgtcatcatatttctgtg

SEQ ID NO: 485218 - DNA, 25 bp, Mus musculus
gaggacacgtctcctccagagggaa

SEQ ID NO: 485219 - DNA, 25 bp, Mus musculus
gaggacacgtctgctccagagggaa

SEQ ID NO: 485220 - DNA, 25 bp, Mus musculus
gaggacacgtggctcctccctcttt

SEQ ID NO: 485221 - DNA, 25 bp, Mus musculus
gaggacacgtgggtcctccctcttt

SEQ ID NO: 485222 - DNA, 25 bp, Mus musculus
gaggacactaacaccaactttactt

SEQ ID NO: 485223 - DNA, 25 bp, Mus musculus
gaggacactaactccaactttactt

SEQ ID NO: 485224 - DNA, 25 bp, Mus musculus
gaggacactacaagcaatttttgca

SEQ ID NO: 485225 - DNA, 25 bp, Mus musculus
gaggacactacatgcaatttttgca

SEQ ID NO: 485226 - DNA, 25 bp, Mus musculus
gaggacactagcacggtggaaccct

SEQ ID NO: 485227 - DNA, 25 bp, Mus musculus
gaggacactagctcggtggaaccct

SEQ ID NO: 485228 - DNA, 25 bp, Mus musculus
gaggacactcctcatggttttcacc

SEQ ID NO: 485229 - DNA, 25 bp, Mus musculus
gaggacactcctgatggttttcacc

SEQ ID NO: 485230 - DNA, 25 bp, Mus musculus
gaggacactctactctacacagcaa

SEQ ID NO: 485231 - DNA, 25 bp, Mus musculus
gaggacactctagtctacacagcaa

SEQ ID NO: 485232 - DNA, 25 bp, Mus musculus
gaggacactgataaccaagatggct

SEQ ID NO: 485233 - DNA, 25 bp, Mus musculus
gaggacactgattaccaagatggct

SEQ ID NO: 485234 - DNA, 25 bp, Mus musculus
gaggacactgctaccagagcatctt

SEQ ID NO: 485235 - DNA, 25 bp, Mus musculus
gaggacactgcttccagagcatctt

SEQ ID NO: 485236 - DNA, 25 bp, Mus musculus
gaggacactggcactaccaatggga

SEQ ID NO: 485237 - DNA, 25 bp, Mus musculus
gaggacactggcagcttaccagaat

SEQ ID NO: 485238 - DNA, 25 bp, Mus musculus
gaggacactggctctaccaatggga

SEQ ID NO: 485239 - DNA, 25 bp, Mus musculus
gaggacactggctgcttaccagaat

SEQ ID NO: 485240 - DNA, 25 bp, Mus musculus
gaggacactgggagatctccatcaa

SEQ ID NO: 485241 - DNA, 25 bp, Mus musculus
gaggacactgggtgatctccatcaa

SEQ ID NO: 485242 - DNA, 25 bp, Mus musculus
gaggacacttcaagagcacggcaga

SEQ ID NO: 485243 - DNA, 25 bp, Mus musculus
gaggacacttcaatgtttggtgcat

SEQ ID NO: 485244 - DNA, 25 bp, Mus musculus
gaggacacttcatgagcacggcaga

SEQ ID NO: 485245 - DNA, 25 bp, Mus musculus
gaggacacttcattgtttggtgcat

SEQ ID NO: 485246 - DNA, 25 bp, Mus musculus
gaggacacttgtacactaagtgtaa

SEQ ID NO: 485247 - DNA, 25 bp, Mus musculus
gaggacacttgttcactaagtgtaa

SEQ ID NO: 485248 - DNA, 25 bp, Mus musculus
gaggacactttcatactgaaaccgt

SEQ ID NO: 485249 - DNA, 25 bp, Mus musculus
gaggacactttcatcgcagacctgg

SEQ ID NO: 485250 - DNA, 25 bp, Mus musculus
gaggacactttcttactgaaaccgt

SEQ ID NO: 485251 - DNA, 25 bp, Mus musculus
gaggacactttcttcgcagacctgg

SEQ ID NO: 485252 - DNA, 25 bp, Mus musculus
gaggacacttttccctgtattctta

SEQ ID NO: 485253 - DNA, 25 bp, Mus musculus
gaggacacttttgcctgtattctta

SEQ ID NO: 485254 - DNA, 25 bp, Mus musculus
gaggacagacagaaccactgagaaa

SEQ ID NO: 485255 - DNA, 25 bp, Mus musculus
gaggacagacagtaccactgagaaa

SEQ ID NO: 485256 - DNA, 25 bp, Mus musculus
gaggacagagacagctactacatca

SEQ ID NO: 485257 - DNA, 25 bp, Mus musculus
gaggacagagactgctactacatca

SEQ ID NO: 485258 - DNA, 25 bp, Mus musculus
gaggacagagctattttgctatgat

SEQ ID NO: 485259 - DNA, 25 bp, Mus musculus
gaggacagagcttttttgctatgat

SEQ ID NO: 485260 - DNA, 25 bp, Mus musculus
gaggacagaggcaatgcatacatat

SEQ ID NO: 485261 - DNA, 25 bp, Mus musculus
gaggacagaggctatgcatacatat

SEQ ID NO: 485262 - DNA, 25 bp, Mus musculus
gaggacagagtcagcagtaccgatg

SEQ ID NO: 485263 - DNA, 25 bp, Mus musculus
gaggacagagtcagcgactgcaccc

SEQ ID NO: 485264 - DNA, 25 bp, Mus musculus
gaggacagagtctgcagtaccgatg

SEQ ID NO: 485265 - DNA, 25 bp, Mus musculus
gaggacagagtctgcgactgcaccc

SEQ ID NO: 485266 - DNA, 25 bp, Mus musculus
gaggacagatggctcacatcttcct

SEQ ID NO: 485267 - DNA, 25 bp, Mus musculus
gaggacagatgggtcacatcttcct

SEQ ID NO: 485268 - DNA, 25 bp, Mus musculus
gaggacagattcatacatatcatgg

SEQ ID NO: 485269 - DNA, 25 bp, Mus musculus
gaggacagattcttacatatcatgg

SEQ ID NO: 485270 - DNA, 25 bp, Mus musculus
gaggacagcaagcattgtaccgaga

SEQ ID NO: 485271 - DNA, 25 bp, Mus musculus
gaggacagcaaggattgtaccgaga

SEQ ID NO: 485272 - DNA, 25 bp, Mus musculus
gaggacagcattatactatcttaat

SEQ ID NO: 485273 - DNA, 25 bp, Mus musculus
gaggacagcattttactatcttaat

SEQ ID NO: 485274 - DNA, 25 bp, Mus musculus
gaggacagccccagctgaaggacat

SEQ ID NO: 485275 - DNA, 25 bp, Mus musculus
gaggacagccccataaactggatga

SEQ ID NO: 485276 - DNA, 25 bp, Mus musculus
gaggacagcccctgctgaaggacat

SEQ ID NO: 485277 - DNA, 25 bp, Mus musculus
gaggacagccccttaaactggatga

SEQ ID NO: 485278 - DNA, 25 bp, Mus musculus
gaggacagccggaccgagccaacgc

SEQ ID NO: 485279 - DNA, 25 bp, Mus musculus
gaggacagccggtccgagccaacgc

SEQ ID NO: 485280 - DNA, 25 bp, Mus musculus
gaggacagccttcagctacatttct

SEQ ID NO: 485281 - DNA, 25 bp, Mus musculus
gaggacagccttgagctacatttct

SEQ ID NO: 485282 - DNA, 25 bp, Mus musculus
gaggacagcgagatcatcaccaaca

SEQ ID NO: 485283 - DNA, 25 bp, Mus musculus
gaggacagcgagttcatcaccaaca

SEQ ID NO: 485284 - DNA, 25 bp, Mus musculus
gaggacagcgcacatggcatctgta

SEQ ID NO: 485285 - DNA, 25 bp, Mus musculus
gaggacagcgcagatggcatctgta

SEQ ID NO: 485286 - DNA, 25 bp, Mus musculus
gaggacagcgccaggactttccgat

SEQ ID NO: 485287 - DNA, 25 bp, Mus musculus
gaggacagcgccatgataacgacgg

SEQ ID NO: 485288 - DNA, 25 bp, Mus musculus
gaggacagcgcctggactttccgat

SEQ ID NO: 485289 - DNA, 25 bp, Mus musculus
gaggacagcgccttgataacgacgg

SEQ ID NO: 485290 - DNA, 25 bp, Mus musculus
gaggacagcggtagtgcctttctca

SEQ ID NO: 485291 - DNA, 25 bp, Mus musculus
gaggacagcggttgtgcctttctca

SEQ ID NO: 485292 - DNA, 25 bp, Mus musculus
gaggacagctccagtacagctactt

SEQ ID NO: 485293 - DNA, 25 bp, Mus musculus
gaggacagctcctgtacagctactt

SEQ ID NO: 485294 - DNA, 25 bp, Mus musculus
gaggacagcttcctgagttttccca

SEQ ID NO: 485295 - DNA, 25 bp, Mus musculus
gaggacagcttcgtgagttttccca

SEQ ID NO: 485296 - DNA, 25 bp, Mus musculus
gaggacaggatgctgctcatgtctc

SEQ ID NO: 485297 - DNA, 25 bp, Mus musculus
gaggacaggatgctttcgctcatca

SEQ ID NO: 485298 - DNA, 25 bp, Mus musculus
gaggacaggatggtgctcatgtctc

SEQ ID NO: 485299 - DNA, 25 bp, Mus musculus
gaggacaggatggtttcgctcatca

SEQ ID NO: 485300 - DNA, 25 bp, Mus musculus
gaggacaggcaacgtcattcaccaa

SEQ ID NO: 485301 - DNA, 25 bp, Mus musculus
gaggacaggcaaggtcattcaccaa

SEQ ID NO: 485302 - DNA, 25 bp, Mus musculus
gaggacaggttcaagctgactcccc

SEQ ID NO: 485303 - DNA, 25 bp, Mus musculus
gaggacaggttctagctgactcccc

SEQ ID NO: 485304 - DNA, 25 bp, Mus musculus
gaggacagtcgtcgctgtaaaactt

SEQ ID NO: 485305 - DNA, 25 bp, Mus musculus
gaggacagtcgtggctgtaaaactt

SEQ ID NO: 485306 - DNA, 25 bp, Mus musculus
gaggacagtgacatctacttctgcg

SEQ ID NO: 485307 - DNA, 25 bp, Mus musculus
gaggacagtgacttctacttctgcg

SEQ ID NO: 485308 - DNA, 25 bp, Mus musculus
gaggacagtgtccagtcttgactca

SEQ ID NO: 485309 - DNA, 25 bp, Mus musculus
gaggacagtgtcgagtcttgactca

SEQ ID NO: 485310 - DNA, 25 bp, Mus musculus
gaggacatagaaccaggccccttgt

SEQ ID NO: 485311 - DNA, 25 bp, Mus musculus
gaggacatagaagcaggccccttgt

SEQ ID NO: 485312 - DNA, 25 bp, Mus musculus
gaggacatagtcattctagctacag

SEQ ID NO: 485313 - DNA, 25 bp, Mus musculus
gaggacatagtctttctagctacag

SEQ ID NO: 485314 - DNA, 25 bp, Mus musculus
gaggacatcaacattatcactggtg

SEQ ID NO: 485315 - DNA, 25 bp, Mus musculus
gaggacatcaactttatcactggtg

SEQ ID NO: 485316 - DNA, 25 bp, Mus musculus
gaggacatcacactgatcatagctg

SEQ ID NO: 485317 - DNA, 25 bp, Mus musculus
gaggacatcacagtgatcatagctg

SEQ ID NO: 485318 - DNA, 25 bp, Mus musculus
gaggacatcatccttagcttaggct

SEQ ID NO: 485319 - DNA, 25 bp, Mus musculus
gaggacatcatcgttagcttaggct

SEQ ID NO: 485320 - DNA, 25 bp, Mus musculus
gaggacatcattaagcccttgtgta

SEQ ID NO: 485321 - DNA, 25 bp, Mus musculus
gaggacatcatttagcccttgtgta

SEQ ID NO: 485322 - DNA, 25 bp, Mus musculus
gaggacatccaacacaacctgctgc

SEQ ID NO: 485323 - DNA, 25 bp, Mus musculus
gaggacatccaagacaacctgctgc

SEQ ID NO: 485324 - DNA, 25 bp, Mus musculus
gaggacatccatctcagggaactgg

SEQ ID NO: 485325 - DNA, 25 bp, Mus musculus
gaggacatccatgtcagggaactgg

SEQ ID NO: 485326 - DNA, 25 bp, Mus musculus
gaggacatccgaacccattagagag

SEQ ID NO: 485327 - DNA, 25 bp, Mus musculus
gaggacatccgatcccattagagag

SEQ ID NO: 485328 - DNA, 25 bp, Mus musculus
gaggacatccgcagaggcatcgtgc

SEQ ID NO: 485329 - DNA, 25 bp, Mus musculus
gaggacatccgctgaggcatcgtgc

SEQ ID NO: 485330 - DNA, 25 bp, Mus musculus
gaggacatcctacgcagggaacact

SEQ ID NO: 485331 - DNA, 25 bp, Mus musculus
gaggacatcctaggcagggaacact

SEQ ID NO: 485332 - DNA, 25 bp, Mus musculus
gaggacatctacaaccgcaagttta

SEQ ID NO: 485333 - DNA, 25 bp, Mus musculus
gaggacatctactaccgcaagttta

SEQ ID NO: 485334 - DNA, 25 bp, Mus musculus
gaggacatctgacgacggcgcacac

SEQ ID NO: 485335 - DNA, 25 bp, Mus musculus
gaggacatctgaggacggcgcacac

SEQ ID NO: 485336 - DNA, 25 bp, Mus musculus
gaggacatcttgcacttcatggaaa

SEQ ID NO: 485337 - DNA, 25 bp, Mus musculus
gaggacatcttggacttcatggaaa

SEQ ID NO: 485338 - DNA, 25 bp, Mus musculus
gaggacatgctaaggtgtgctacaa

SEQ ID NO: 485339 - DNA, 25 bp, Mus musculus
gaggacatgctatggtgtgctacaa

SEQ ID NO: 485340 - DNA, 25 bp, Mus musculus
gaggacatggctaatctttcttaat

SEQ ID NO: 485341 - DNA, 25 bp, Mus musculus
gaggacatggcttatctttcttaat

SEQ ID NO: 485342 - DNA, 25 bp, Mus musculus
gaggacatgtgactttctaaagctt

SEQ ID NO: 485343 - DNA, 25 bp, Mus musculus
gaggacatgtgagtttctaaagctt

SEQ ID NO: 485344 - DNA, 25 bp, Mus musculus
gaggacatgttcatcatacttatct

SEQ ID NO: 485345 - DNA, 25 bp, Mus musculus
gaggacatgttcttcatacttatct

SEQ ID NO: 485346 - DNA, 25 bp, Mus musculus
gaggacatgtttaccccatctgacc

SEQ ID NO: 485347 - DNA, 25 bp, Mus musculus
gaggacatgttttccccatctgacc

SEQ ID NO: 485348 - DNA, 25 bp, Mus musculus
gaggacattagccaacacatcaaag

SEQ ID NO: 485349 - DNA, 25 bp, Mus musculus
gaggacattagcgaacacatcaaag

SEQ ID NO: 485350 - DNA, 25 bp, Mus musculus
gaggacattcctacccgaaataggt

SEQ ID NO: 485351 - DNA, 25 bp, Mus musculus
gaggacattcctcactgcaaagtac

SEQ ID NO: 485352 - DNA, 25 bp, Mus musculus
gaggacattcctgactgcaaagtac

SEQ ID NO: 485353 - DNA, 25 bp, Mus musculus
gaggacattccttcccgaaataggt

SEQ ID NO: 485354 - DNA, 25 bp, Mus musculus
gaggacattgaacgcctgaccgtac

SEQ ID NO: 485355 - DNA, 25 bp, Mus musculus
gaggacattgaaggcctgaccgtac

SEQ ID NO: 485356 - DNA, 25 bp, Mus musculus
gaggacattggcatcattttatact

SEQ ID NO: 485357 - DNA, 25 bp, Mus musculus
gaggacattggcttcattttatact

SEQ ID NO: 485358 - DNA, 25 bp, Mus musculus
gaggacattgttatcctgccccaac

SEQ ID NO: 485359 - DNA, 25 bp, Mus musculus
gaggacattgttttcctgccccaac

SEQ ID NO: 485360 - DNA, 25 bp, Mus musculus
gaggaccaaaaacagatgccagaca

SEQ ID NO: 485361 - DNA, 25 bp, Mus musculus
gaggaccaaaaagagatgccagaca

SEQ ID NO: 485362 - DNA, 25 bp, Mus musculus
gaggaccaaagaccaggcccagacc

SEQ ID NO: 485363 - DNA, 25 bp, Mus musculus
gaggaccaaagagcaggcccagacc

SEQ ID NO: 485364 - DNA, 25 bp, Mus musculus
gaggaccaaagcacctgcacaggga

SEQ ID NO: 485365 - DNA, 25 bp, Mus musculus
gaggaccaaagctcctgcacaggga

SEQ ID NO: 485366 - DNA, 25 bp, Mus musculus
gaggaccaacctatgatggactgat

SEQ ID NO: 485367 - DNA, 25 bp, Mus musculus
gaggaccaacctttgatggactgat

SEQ ID NO: 485368 - DNA, 25 bp, Mus musculus
gaggaccaagaacctcccagttaca

SEQ ID NO: 485369 - DNA, 25 bp, Mus musculus
gaggaccaagaacttcatcaggcac

SEQ ID NO: 485370 - DNA, 25 bp, Mus musculus
gaggaccaagaagctcccagttaca

SEQ ID NO: 485371 - DNA, 25 bp, Mus musculus
gaggaccaagaagttcatcaggcac

SEQ ID NO: 485372 - DNA, 25 bp, Mus musculus
gaggaccaagcaatctccttggcta

SEQ ID NO: 485373 - DNA, 25 bp, Mus musculus
gaggaccaagcattctccttggcta

SEQ ID NO: 485374 - DNA, 25 bp, Mus musculus
gaggaccaaggtaccattcttagaa

SEQ ID NO: 485375 - DNA, 25 bp, Mus musculus
gaggaccaaggtcagcctgtgacta

SEQ ID NO: 485376 - DNA, 25 bp, Mus musculus
gaggaccaaggtgagcctgtgacta

SEQ ID NO: 485377 - DNA, 25 bp, Mus musculus
gaggaccaaggttccattcttagaa

SEQ ID NO: 485378 - DNA, 25 bp, Mus musculus
gaggaccaataaaagcttcaaccag

SEQ ID NO: 485379 - DNA, 25 bp, Mus musculus
gaggaccaataatagcttcaaccag

SEQ ID NO: 485380 - DNA, 25 bp, Mus musculus
gaggaccaatgacccttggagagaa

SEQ ID NO: 485381 - DNA, 25 bp, Mus musculus
gaggaccaatgagccttggagagaa

SEQ ID NO: 485382 - DNA, 25 bp, Mus musculus
gaggaccaatgccaagttgttaact

SEQ ID NO: 485383 - DNA, 25 bp, Mus musculus
gaggaccaatgcgaagttgttaact

SEQ ID NO: 485384 - DNA, 25 bp, Mus musculus
gaggaccaatgtaacaagccagcaa

SEQ ID NO: 485385 - DNA, 25 bp, Mus musculus
gaggaccaatgttacaagccagcaa

SEQ ID NO: 485386 - DNA, 25 bp, Mus musculus
gaggaccaatttatataagctgaat

SEQ ID NO: 485387 - DNA, 25 bp, Mus musculus
gaggaccaatttttataagctgaat

SEQ ID NO: 485388 - DNA, 25 bp, Mus musculus
gaggaccacatacaagtctccaaca

SEQ ID NO: 485389 - DNA, 25 bp, Mus musculus
gaggaccacatagaagtctccaaca

SEQ ID NO: 485390 - DNA, 25 bp, Mus musculus
gaggaccactctctgagtgctatta

SEQ ID NO: 485391 - DNA, 25 bp, Mus musculus
gaggaccactctgtgagtgctatta

SEQ ID NO: 485392 - DNA, 25 bp, Mus musculus
gaggaccactgcactagagactgtt

SEQ ID NO: 485393 - DNA, 25 bp, Mus musculus
gaggaccactgctctagagactgtt

SEQ ID NO: 485394 - DNA, 25 bp, Mus musculus
gaggaccactggaaataaagattca

SEQ ID NO: 485395 - DNA, 25 bp, Mus musculus
gaggaccactggactagacttatta

SEQ ID NO: 485396 - DNA, 25 bp, Mus musculus
gaggaccactggtaataaagattca

SEQ ID NO: 485397 - DNA, 25 bp, Mus musculus
gaggaccactggtctagacttatta

SEQ ID NO: 485398 - DNA, 25 bp, Mus musculus
gaggaccagacacccctccatgggt

SEQ ID NO: 485399 - DNA, 25 bp, Mus musculus
gaggaccagacagccctccatgggt

SEQ ID NO: 485400 - DNA, 25 bp, Mus musculus
gaggaccagactcaggtgcctttac

SEQ ID NO: 485401 - DNA, 25 bp, Mus musculus
gaggaccagactgaggtgcctttac

SEQ ID NO: 485402 - DNA, 25 bp, Mus musculus
gaggaccagagtactcactctagca

SEQ ID NO: 485403 - DNA, 25 bp, Mus musculus
gaggaccagagttctcactctagca

SEQ ID NO: 485404 - DNA, 25 bp, Mus musculus
gaggaccagcacctataccaggtgg

SEQ ID NO: 485405 - DNA, 25 bp, Mus musculus
gaggaccagcacgtataccaggtgg

SEQ ID NO: 485406 - DNA, 25 bp, Mus musculus
gaggaccaggaacctccctgtcaca

SEQ ID NO: 485407 - DNA, 25 bp, Mus musculus
gaggaccaggaagctccctgtcaca

SEQ ID NO: 485408 - DNA, 25 bp, Mus musculus
gaggaccaggcacacgttatgtcac

SEQ ID NO: 485409 - DNA, 25 bp, Mus musculus
gaggaccaggcagacgttatgtcac

SEQ ID NO: 485410 - DNA, 25 bp, Mus musculus
gaggaccaggctcgagatgtcaata

SEQ ID NO: 485411 - DNA, 25 bp, Mus musculus
gaggaccaggctggagatgtcaata

SEQ ID NO: 485412 - DNA, 25 bp, Mus musculus
gaggaccagggtccatgtcgtccca

SEQ ID NO: 485413 - DNA, 25 bp, Mus musculus
gaggaccagggtgcatgtcgtccca

SEQ ID NO: 485414 - DNA, 25 bp, Mus musculus
gaggaccaggttctctcctgcgact

SEQ ID NO: 485415 - DNA, 25 bp, Mus musculus
gaggaccaggttgtctcctgcgact

SEQ ID NO: 485416 - DNA, 25 bp, Mus musculus
gaggaccagtccagatttaagctct

SEQ ID NO: 485417 - DNA, 25 bp, Mus musculus
gaggaccagtcctgatttaagctct

SEQ ID NO: 485418 - DNA, 25 bp, Mus musculus
gaggaccagtctctggatctgcaaa

SEQ ID NO: 485419 - DNA, 25 bp, Mus musculus
gaggaccagtctgtggatctgcaaa

SEQ ID NO: 485420 - DNA, 25 bp, Mus musculus
gaggaccagtgccagtttgtgtaca

SEQ ID NO: 485421 - DNA, 25 bp, Mus musculus
gaggaccagtgcgagtttgtgtaca

SEQ ID NO: 485422 - DNA, 25 bp, Mus musculus
gaggaccatcacaagttcagggaaa

SEQ ID NO: 485423 - DNA, 25 bp, Mus musculus
gaggaccatcacacacattgatagt

SEQ ID NO: 485424 - DNA, 25 bp, Mus musculus
gaggaccatcactagttcagggaaa

SEQ ID NO: 485425 - DNA, 25 bp, Mus musculus
gaggaccatcactcacattgatagt

SEQ ID NO: 485426 - DNA, 25 bp, Mus musculus
gaggaccatgtgaattcttcagaac

SEQ ID NO: 485427 - DNA, 25 bp, Mus musculus
gaggaccatgtgtattcttcagaac

SEQ ID NO: 485428 - DNA, 25 bp, Mus musculus
gaggaccattgaagctcggctcaac

SEQ ID NO: 485429 - DNA, 25 bp, Mus musculus
gaggaccattgatgctcggctcaac

SEQ ID NO: 485430 - DNA, 25 bp, Mus musculus
gaggaccattttaggcattccgaca

SEQ ID NO: 485431 - DNA, 25 bp, Mus musculus
gaggaccatttttggcattccgaca

SEQ ID NO: 485432 - DNA, 25 bp, Mus musculus
gaggacccaagcaagatctgacccg

SEQ ID NO: 485433 - DNA, 25 bp, Mus musculus
gaggacccaagctagatctgacccg

SEQ ID NO: 485434 - DNA, 25 bp, Mus musculus
gaggacccaaggaccatgctggata

SEQ ID NO: 485435 - DNA, 25 bp, Mus musculus
gaggacccaaggtccatgctggata

SEQ ID NO: 485436 - DNA, 25 bp, Mus musculus
gaggacccactcaagggcctagaga

SEQ ID NO: 485437 - DNA, 25 bp, Mus musculus
gaggacccactctagggcctagaga

SEQ ID NO: 485438 - DNA, 25 bp, Mus musculus
gaggacccactgagtaatgtttgtg

SEQ ID NO: 485439 - DNA, 25 bp, Mus musculus
gaggacccactgtgtaatgtttgtg

SEQ ID NO: 485440 - DNA, 25 bp, Mus musculus
gaggacccagccatagaaggcatag

SEQ ID NO: 485441 - DNA, 25 bp, Mus musculus
gaggacccagccttagaaggcatag

SEQ ID NO: 485442 - DNA, 25 bp, Mus musculus
gaggacccaggaaaggtaaatgcct

SEQ ID NO: 485443 - DNA, 25 bp, Mus musculus
gaggacccaggactgagcacccaca

SEQ ID NO: 485444 - DNA, 25 bp, Mus musculus
gaggacccaggagtgagcacccaca

SEQ ID NO: 485445 - DNA, 25 bp, Mus musculus
gaggacccaggataggtaaatgcct

SEQ ID NO: 485446 - DNA, 25 bp, Mus musculus
gaggacccaggcatcagtggcagca

SEQ ID NO: 485447 - DNA, 25 bp, Mus musculus
gaggacccaggcttcagtggcagca

SEQ ID NO: 485448 - DNA, 25 bp, Mus musculus
gaggacccaggtaagattgccaaca

SEQ ID NO: 485449 - DNA, 25 bp, Mus musculus
gaggacccaggttagattgccaaca

SEQ ID NO: 485450 - DNA, 25 bp, Mus musculus
gaggaccccaaactctagagattgc

SEQ ID NO: 485451 - DNA, 25 bp, Mus musculus
gaggaccccaaagtctagagattgc

SEQ ID NO: 485452 - DNA, 25 bp, Mus musculus
gaggaccccagtatgctgctttgac

SEQ ID NO: 485453 - DNA, 25 bp, Mus musculus
gaggaccccagtttgctgctttgac

SEQ ID NO: 485454 - DNA, 25 bp, Mus musculus
gaggaccccatgcagattttgaaaa

SEQ ID NO: 485455 - DNA, 25 bp, Mus musculus
gaggaccccatggagattttgaaaa

SEQ ID NO: 485456 - DNA, 25 bp, Mus musculus
gaggaccccgctaatgaacaatttt

SEQ ID NO: 485457 - DNA, 25 bp, Mus musculus
gaggaccccgcttatgaacaatttt

SEQ ID NO: 485458 - DNA, 25 bp, Mus musculus
gaggacccctgcatgggccctagga

SEQ ID NO: 485459 - DNA, 25 bp, Mus musculus
gaggacccctgcttgggccctagga

SEQ ID NO: 485460 - DNA, 25 bp, Mus musculus
gaggacccgctgctgaacctggtat

SEQ ID NO: 485461 - DNA, 25 bp, Mus musculus
gaggacccgctggtgaacctggtat

SEQ ID NO: 485462 - DNA, 25 bp, Mus musculus
gaggacccgtagatgctttatatat

SEQ ID NO: 485463 - DNA, 25 bp, Mus musculus
gaggacccgtagttgctttatatat

SEQ ID NO: 485464 - DNA, 25 bp, Mus musculus
gaggaccctcctaaactgtgttcag

SEQ ID NO: 485465 - DNA, 25 bp, Mus musculus
gaggaccctccttaactgtgttcag

SEQ ID NO: 485466 - DNA, 25 bp, Mus musculus
gaggaccctcgtcaaactttatgtg

SEQ ID NO: 485467 - DNA, 25 bp, Mus musculus
gaggaccctcgtgaaactttatgtg

SEQ ID NO: 485468 - DNA, 25 bp, Mus musculus
gaggaccctctgacttaagggacca

SEQ ID NO: 485469 - DNA, 25 bp, Mus musculus
gaggaccctctgtcttaagggacca

SEQ ID NO: 485470 - DNA, 25 bp, Mus musculus
gaggaccctgacacaattccatgaa

SEQ ID NO: 485471 - DNA, 25 bp, Mus musculus
gaggaccctgactcaattccatgaa

SEQ ID NO: 485472 - DNA, 25 bp, Mus musculus
gaggaccctgagaagcaaacactgc

SEQ ID NO: 485473 - DNA, 25 bp, Mus musculus
gaggaccctgagtagcaaacactgc

SEQ ID NO: 485474 - DNA, 25 bp, Mus musculus
gaggaccctgctaatgaaccacttt

SEQ ID NO: 485475 - DNA, 25 bp, Mus musculus
gaggaccctgcttatgaaccacttt

SEQ ID NO: 485476 - DNA, 25 bp, Mus musculus
gaggaccctggtaccaaggtgctat

SEQ ID NO: 485477 - DNA, 25 bp, Mus musculus
gaggaccctggttccaaggtgctat

SEQ ID NO: 485478 - DNA, 25 bp, Mus musculus
gaggacccttgcatgtctgagcgta

SEQ ID NO: 485479 - DNA, 25 bp, Mus musculus
gaggacccttgcttgtctgagcgta

SEQ ID NO: 485480 - DNA, 25 bp, Mus musculus
gaggaccctttgcagatgacccggt

SEQ ID NO: 485481 - DNA, 25 bp, Mus musculus
gaggaccctttggagatgacccggt

SEQ ID NO: 485482 - DNA, 25 bp, Mus musculus
gaggaccgacatagacccgatgcca

SEQ ID NO: 485483 - DNA, 25 bp, Mus musculus
gaggaccgacattgacccgatgcca

SEQ ID NO: 485484 - DNA, 25 bp, Mus musculus
gaggaccgcaagattgcctgtgctg

SEQ ID NO: 485485 - DNA, 25 bp, Mus musculus
gaggaccgcaagtttgcctgtgctg

SEQ ID NO: 485486 - DNA, 25 bp, Mus musculus
gaggaccgcgcccaccgggagcgtg

SEQ ID NO: 485487 - DNA, 25 bp, Mus musculus
gaggaccgcgccgaccgggagcgtg

SEQ ID NO: 485488 - DNA, 25 bp, Mus musculus
gaggaccggctacaccgaaagctgt

SEQ ID NO: 485489 - DNA, 25 bp, Mus musculus
gaggaccggctagaccgaaagctgt

SEQ ID NO: 485490 - DNA, 25 bp, Mus musculus
gaggaccggctccagttatcagctg

SEQ ID NO: 485491 - DNA, 25 bp, Mus musculus
gaggaccggctcgagttatcagctg

SEQ ID NO: 485492 - DNA, 25 bp, Mus musculus
gaggaccgggatactattcttagtg

SEQ ID NO: 485493 - DNA, 25 bp, Mus musculus
gaggaccgggattctattcttagtg

SEQ ID NO: 485494 - DNA, 25 bp, Mus musculus
gaggaccgtaggcaatacccagaga

SEQ ID NO: 485495 - DNA, 25 bp, Mus musculus
gaggaccgtagggaatacccagaga

SEQ ID NO: 485496 - DNA, 25 bp, Mus musculus
gaggaccgtgaaacacttgggccaa

SEQ ID NO: 485497 - DNA, 25 bp, Mus musculus
gaggaccgtgaacataagtttgact

SEQ ID NO: 485498 - DNA, 25 bp, Mus musculus
gaggaccgtgaagataagtttgact

SEQ ID NO: 485499 - DNA, 25 bp, Mus musculus
gaggaccgtgaatcacttgggccaa

SEQ ID NO: 485500 - DNA, 25 bp, Mus musculus
gaggaccgtgatctttcgaaaccaa

SEQ ID NO: 485501 - DNA, 25 bp, Mus musculus
gaggaccgtgatgtttcgaaaccaa

SEQ ID NO: 485502 - DNA, 25 bp, Mus musculus
gaggaccgttctaccttgactttgg

SEQ ID NO: 485503 - DNA, 25 bp, Mus musculus
gaggaccgttcttccttgactttgg

SEQ ID NO: 485504 - DNA, 25 bp, Mus musculus
gaggacctaccacacagcattcaag

SEQ ID NO: 485505 - DNA, 25 bp, Mus musculus
gaggacctaccagacagcattcaag

SEQ ID NO: 485506 - DNA, 25 bp, Mus musculus
gaggacctagacactggcgtgaaag

SEQ ID NO: 485507 - DNA, 25 bp, Mus musculus
gaggacctagactctggcgtgaaag

SEQ ID NO: 485508 - DNA, 25 bp, Mus musculus
gaggacctatgcctagtggaatcca

SEQ ID NO: 485509 - DNA, 25 bp, Mus musculus
gaggacctatgcgtagtggaatcca

SEQ ID NO: 485510 - DNA, 25 bp, Mus musculus
gaggacctatggatcttagatactg

SEQ ID NO: 485511 - DNA, 25 bp, Mus musculus
gaggacctatggttcttagatactg

SEQ ID NO: 485512 - DNA, 25 bp, Mus musculus
gaggacctatgtctgtctcacgtgc

SEQ ID NO: 485513 - DNA, 25 bp, Mus musculus
gaggacctatgtgtgtctcacgtgc

SEQ ID NO: 485514 - DNA, 25 bp, Mus musculus
gaggacctcaccctcagagtagaaa

SEQ ID NO: 485515 - DNA, 25 bp, Mus musculus
gaggacctcaccctgaaggtactgg

SEQ ID NO: 485516 - DNA, 25 bp, Mus musculus
gaggacctcaccgtcagagtagaaa

SEQ ID NO: 485517 - DNA, 25 bp, Mus musculus
gaggacctcaccgtgaaggtactgg

SEQ ID NO: 485518 - DNA, 25 bp, Mus musculus
gaggacctcagaattacttgtaaac

SEQ ID NO: 485519 - DNA, 25 bp, Mus musculus
gaggacctcagatttacttgtaaac

SEQ ID NO: 485520 - DNA, 25 bp, Mus musculus
gaggacctcaggatagtttatatgt

SEQ ID NO: 485521 - DNA, 25 bp, Mus musculus
gaggacctcaggttagtttatatgt

SEQ ID NO: 485522 - DNA, 25 bp, Mus musculus
gaggacctcagtcagatcccaaacc

SEQ ID NO: 485523 - DNA, 25 bp, Mus musculus
gaggacctcagtgagatcccaaacc

SEQ ID NO: 485524 - DNA, 25 bp, Mus musculus
gaggacctcatgacaagcagagcac

SEQ ID NO: 485525 - DNA, 25 bp, Mus musculus
gaggacctcatgtcaagcagagcac

SEQ ID NO: 485526 - DNA, 25 bp, Mus musculus
gaggacctccaaccccagatttctt

SEQ ID NO: 485527 - DNA, 25 bp, Mus musculus
gaggacctccaagcccagatttctt

SEQ ID NO: 485528 - DNA, 25 bp, Mus musculus
gaggacctccggagacctgtgaaaa

SEQ ID NO: 485529 - DNA, 25 bp, Mus musculus
gaggacctccggtgacctgtgaaaa

SEQ ID NO: 485530 - DNA, 25 bp, Mus musculus
gaggacctctgaagcacccacaggc

SEQ ID NO: 485531 - DNA, 25 bp, Mus musculus
gaggacctctgatgcacccacaggc

SEQ ID NO: 485532 - DNA, 25 bp, Mus musculus
gaggacctctggactgcaaggtaga

SEQ ID NO: 485533 - DNA, 25 bp, Mus musculus
gaggacctctggtctgcaaggtaga

SEQ ID NO: 485534 - DNA, 25 bp, Mus musculus
gaggacctgactacagtacctgaac

SEQ ID NO: 485535 - DNA, 25 bp, Mus musculus
gaggacctgacttcagtacctgaac

SEQ ID NO: 485536 - DNA, 25 bp, Mus musculus
gaggacctgagacctgggacctcca

SEQ ID NO: 485537 - DNA, 25 bp, Mus musculus
gaggacctgagactgctcatggaac

SEQ ID NO: 485538 - DNA, 25 bp, Mus musculus
gaggacctgagagctgggacctcca

SEQ ID NO: 485539 - DNA, 25 bp, Mus musculus
gaggacctgagagtgctcatggaac

SEQ ID NO: 485540 - DNA, 25 bp, Mus musculus
gaggacctgagcacctgcccacggg

SEQ ID NO: 485541 - DNA, 25 bp, Mus musculus
gaggacctgagcactaatctcacgc

SEQ ID NO: 485542 - DNA, 25 bp, Mus musculus
gaggacctgagctcctgcccacggg

SEQ ID NO: 485543 - DNA, 25 bp, Mus musculus
gaggacctgagctctaatctcacgc

SEQ ID NO: 485544 - DNA, 25 bp, Mus musculus
gaggacctgagtacactttttgtaa

SEQ ID NO: 485545 - DNA, 25 bp, Mus musculus
gaggacctgagttcactttttgtaa

SEQ ID NO: 485546 - DNA, 25 bp, Mus musculus
gaggacctgcccacgggcgtgaaat

SEQ ID NO: 485547 - DNA, 25 bp, Mus musculus
gaggacctgccctcgggcgtgaaat

SEQ ID NO: 485548 - DNA, 25 bp, Mus musculus
gaggacctgcctactgctgatgagc

SEQ ID NO: 485549 - DNA, 25 bp, Mus musculus
gaggacctgccttctgctgatgagc

SEQ ID NO: 485550 - DNA, 25 bp, Mus musculus
gaggacctggaactggccatcgccc

SEQ ID NO: 485551 - DNA, 25 bp, Mus musculus
gaggacctggaagtggccatcgccc

SEQ ID NO: 485552 - DNA, 25 bp, Mus musculus
gaggacctggacctgattctgaacc

SEQ ID NO: 485553 - DNA, 25 bp, Mus musculus
gaggacctggacgtgattctgaacc

SEQ ID NO: 485554 - DNA, 25 bp, Mus musculus
gaggacctggcgagcatccctgccg

SEQ ID NO: 485555 - DNA, 25 bp, Mus musculus
gaggacctggcgtgcatccctgccg

SEQ ID NO: 485556 - DNA, 25 bp, Mus musculus
gaggacctggctcgatcctcagcac

SEQ ID NO: 485557 - DNA, 25 bp, Mus musculus
gaggacctggctggatcctcagcac

SEQ ID NO: 485558 - DNA, 25 bp, Mus musculus
gaggacctggtaaacctggagccta

SEQ ID NO: 485559 - DNA, 25 bp, Mus musculus
gaggacctggtatacctggagccta

SEQ ID NO: 485560 - DNA, 25 bp, Mus musculus
gaggacctgtccagcgaggctgaca

SEQ ID NO: 485561 - DNA, 25 bp, Mus musculus
gaggacctgtcctgcgaggctgaca

SEQ ID NO: 485562 - DNA, 25 bp, Mus musculus
gaggacctgttgacttaaggaccaa

SEQ ID NO: 485563 - DNA, 25 bp, Mus musculus
gaggacctgttgatattggcccaga

SEQ ID NO: 485564 - DNA, 25 bp, Mus musculus
gaggacctgttgtcttaaggaccaa

SEQ ID NO: 485565 - DNA, 25 bp, Mus musculus
gaggacctgttgttattggcccaga

SEQ ID NO: 485566 - DNA, 25 bp, Mus musculus
gaggaccttaagacagagtatgctg

SEQ ID NO: 485567 - DNA, 25 bp, Mus musculus
gaggaccttaagtcagagtatgctg

SEQ ID NO: 485568 - DNA, 25 bp, Mus musculus
gaggacctttaactatgtgcattat

SEQ ID NO: 485569 - DNA, 25 bp, Mus musculus
gaggacctttaagtatgtgcattat

SEQ ID NO: 485570 - DNA, 25 bp, Mus musculus
gaggacctttgtagtcagtcatcgt

SEQ ID NO: 485571 - DNA, 25 bp, Mus musculus
gaggacctttgttgtcagtcatcgt

SEQ ID NO: 485572 - DNA, 25 bp, Mus musculus
gaggacgaatacagctactacaagg

SEQ ID NO: 485573 - DNA, 25 bp, Mus musculus
gaggacgaatactgctactacaagg

SEQ ID NO: 485574 - DNA, 25 bp, Mus musculus
gaggacgaatctaccctatgagagg

SEQ ID NO: 485575 - DNA, 25 bp, Mus musculus
gaggacgaatctcctccaggaggac

SEQ ID NO: 485576 - DNA, 25 bp, Mus musculus
gaggacgaatctgctccaggaggac

SEQ ID NO: 485577 - DNA, 25 bp, Mus musculus
gaggacgaatcttccctatgagagg

SEQ ID NO: 485578 - DNA, 25 bp, Mus musculus
gaggacgacagaaatcacacagcaa

SEQ ID NO: 485579 - DNA, 25 bp, Mus musculus
gaggacgacagatatcacacagcaa

SEQ ID NO: 485580 - DNA, 25 bp, Mus musculus
gaggacgacattagtcacctgaatc

SEQ ID NO: 485581 - DNA, 25 bp, Mus musculus
gaggacgacatttgtcacctgaatc

SEQ ID NO: 485582 - DNA, 25 bp, Mus musculus
gaggacgagagaatccagaagcttc

SEQ ID NO: 485583 - DNA, 25 bp, Mus musculus
gaggacgagagattccagaagcttc

SEQ ID NO: 485584 - DNA, 25 bp, Mus musculus
gaggacgagcccactgaaacagaga

SEQ ID NO: 485585 - DNA, 25 bp, Mus musculus
gaggacgagccctctgaaacagaga

SEQ ID NO: 485586 - DNA, 25 bp, Mus musculus
gaggacgagctcatggagttctcag

SEQ ID NO: 485587 - DNA, 25 bp, Mus musculus
gaggacgagctcttggagttctcag

SEQ ID NO: 485588 - DNA, 25 bp, Mus musculus
gaggacgagtccacgggtcttaaga

SEQ ID NO: 485589 - DNA, 25 bp, Mus musculus
gaggacgagtcctcgggtcttaaga

SEQ ID NO: 485590 - DNA, 25 bp, Mus musculus
gaggacgatcatcagccgaagccat

SEQ ID NO: 485591 - DNA, 25 bp, Mus musculus
gaggacgatcatgagccgaagccat

SEQ ID NO: 485592 - DNA, 25 bp, Mus musculus
gaggacgatcctctcatctgtaact

SEQ ID NO: 485593 - DNA, 25 bp, Mus musculus
gaggacgatcctgtcatctgtaact

SEQ ID NO: 485594 - DNA, 25 bp, Mus musculus
gaggacgcacacactgaccaaattt

SEQ ID NO: 485595 - DNA, 25 bp, Mus musculus
gaggacgcacactctgaccaaattt

SEQ ID NO: 485596 - DNA, 25 bp, Mus musculus
gaggacgcagctcagtttgctacga

SEQ ID NO: 485597 - DNA, 25 bp, Mus musculus
gaggacgcagctgagtttgctacga

SEQ ID NO: 485598 - DNA, 25 bp, Mus musculus
gaggacgcattaatacgataacatt

SEQ ID NO: 485599 - DNA, 25 bp, Mus musculus
gaggacgcattattacgataacatt

SEQ ID NO: 485600 - DNA, 25 bp, Mus musculus
gaggacgccatcaagcaacatccat

SEQ ID NO: 485601 - DNA, 25 bp, Mus musculus
gaggacgccatctagcaacatccat

SEQ ID NO: 485602 - DNA, 25 bp, Mus musculus
gaggacgccggaccagaatgtacca

SEQ ID NO: 485603 - DNA, 25 bp, Mus musculus
gaggacgccggagcagaatgtacca

SEQ ID NO: 485604 - DNA, 25 bp, Mus musculus
gaggacgcgtataagccgatgtcaa

SEQ ID NO: 485605 - DNA, 25 bp, Mus musculus
gaggacgcgtattagccgatgtcaa

SEQ ID NO: 485606 - DNA, 25 bp, Mus musculus
gaggacgctggacggccttgctggc

SEQ ID NO: 485607 - DNA, 25 bp, Mus musculus
gaggacgctggagggccttgctggc

SEQ ID NO: 485608 - DNA, 25 bp, Mus musculus
gaggacggaaacctgcttgtcactc

SEQ ID NO: 485609 - DNA, 25 bp, Mus musculus
gaggacggaaacgtgcttgtcactc

SEQ ID NO: 485610 - DNA, 25 bp, Mus musculus
gaggacggacgcactactgaagtca

SEQ ID NO: 485611 - DNA, 25 bp, Mus musculus
gaggacggacgctctactgaagtca

SEQ ID NO: 485612 - DNA, 25 bp, Mus musculus
gaggacgggagtccggccctggaga

SEQ ID NO: 485613 - DNA, 25 bp, Mus musculus
gaggacgggagtgcggccctggaga

SEQ ID NO: 485614 - DNA, 25 bp, Mus musculus
gaggacggtagccatattaatatca

SEQ ID NO: 485615 - DNA, 25 bp, Mus musculus
gaggacggtagcgatattaatatca

SEQ ID NO: 485616 - DNA, 25 bp, Mus musculus
gaggacggtgagatctgtttgaaca

SEQ ID NO: 485617 - DNA, 25 bp, Mus musculus
gaggacggtgagttctgtttgaaca

SEQ ID NO: 485618 - DNA, 25 bp, Mus musculus
gaggacgtatatccttttatggatc

SEQ ID NO: 485619 - DNA, 25 bp, Mus musculus
gaggacgtatatgcttttatggatc

SEQ ID NO: 485620 - DNA, 25 bp, Mus musculus
gaggacgtcagcatcataaatatca

SEQ ID NO: 485621 - DNA, 25 bp, Mus musculus
gaggacgtcagcttcataaatatca

SEQ ID NO: 485622 - DNA, 25 bp, Mus musculus
gaggacgtcatcatagccttggaag

SEQ ID NO: 485623 - DNA, 25 bp, Mus musculus
gaggacgtcatcttagccttggaag

SEQ ID NO: 485624 - DNA, 25 bp, Mus musculus
gaggacgtgaatatgagcctaccgt

SEQ ID NO: 485625 - DNA, 25 bp, Mus musculus
gaggacgtgaatttgagcctaccgt

SEQ ID NO: 485626 - DNA, 25 bp, Mus musculus
gaggacgtggatctctccctatgcc

SEQ ID NO: 485627 - DNA, 25 bp, Mus musculus
gaggacgtggatgtctccctatgcc

SEQ ID NO: 485628 - DNA, 25 bp, Mus musculus
gaggacgttatcatgattatgaact

SEQ ID NO: 485629 - DNA, 25 bp, Mus musculus
gaggacgttatcttgattatgaact

SEQ ID NO: 485630 - DNA, 25 bp, Mus musculus
gaggacgttgatctactctggaaac

SEQ ID NO: 485631 - DNA, 25 bp, Mus musculus
gaggacgttgatgtactctggaaac

SEQ ID NO: 485632 - DNA, 25 bp, Mus musculus
gaggacgttgtacccagttatctta

SEQ ID NO: 485633 - DNA, 25 bp, Mus musculus
gaggacgttgtagccagttatctta

SEQ ID NO: 485634 - DNA, 25 bp, Mus musculus
gaggacgtttatctaattgtggaat

SEQ ID NO: 485635 - DNA, 25 bp, Mus musculus
gaggacgtttatgtaattgtggaat

SEQ ID NO: 485636 - DNA, 25 bp, Mus musculus
gaggactaacacaagggatcaggga

SEQ ID NO: 485637 - DNA, 25 bp, Mus musculus
gaggactaacacagactagcccaag

SEQ ID NO: 485638 - DNA, 25 bp, Mus musculus
gaggactaacactagggatcaggga

SEQ ID NO: 485639 - DNA, 25 bp, Mus musculus
gaggactaacactgactagcccaag

SEQ ID NO: 485640 - DNA, 25 bp, Mus musculus
gaggactaacttatcatccctgttc

SEQ ID NO: 485641 - DNA, 25 bp, Mus musculus
gaggactaacttttcatccctgttc

SEQ ID NO: 485642 - DNA, 25 bp, Mus musculus
gaggactaatccaaggccatactgt

SEQ ID NO: 485643 - DNA, 25 bp, Mus musculus
gaggactaatcctaggccatactgt

SEQ ID NO: 485644 - DNA, 25 bp, Mus musculus
gaggactacaacagccaagtggtca

SEQ ID NO: 485645 - DNA, 25 bp, Mus musculus
gaggactacaactgccaagtggtca

SEQ ID NO: 485646 - DNA, 25 bp, Mus musculus
gaggactacatccacaacctgctag

SEQ ID NO: 485647 - DNA, 25 bp, Mus musculus
gaggactacatcgacaacctgctag

SEQ ID NO: 485648 - DNA, 25 bp, Mus musculus
gaggactaccagatcgttgagcgcc

SEQ ID NO: 485649 - DNA, 25 bp, Mus musculus
gaggactaccagttcgttgagcgcc

SEQ ID NO: 485650 - DNA, 25 bp, Mus musculus
gaggactacggacggctgctcttca

SEQ ID NO: 485651 - DNA, 25 bp, Mus musculus
gaggactacggagggctgctcttca

SEQ ID NO: 485652 - DNA, 25 bp, Mus musculus
gaggactagaggagctgtctaacca

SEQ ID NO: 485653 - DNA, 25 bp, Mus musculus
gaggactagaggtgctgtctaacca

SEQ ID NO: 485654 - DNA, 25 bp, Mus musculus
gaggactagtggaatttttcagtat

SEQ ID NO: 485655 - DNA, 25 bp, Mus musculus
gaggactagtggtatttttcagtat

SEQ ID NO: 485656 - DNA, 25 bp, Mus musculus
gaggactagtgtctgtcctcttgtc

SEQ ID NO: 485657 - DNA, 25 bp, Mus musculus
gaggactagtgtgtgtcctcttgtc

SEQ ID NO: 485658 - DNA, 25 bp, Mus musculus
gaggactatctcaccatcatgattg

SEQ ID NO: 485659 - DNA, 25 bp, Mus musculus
gaggactatctctccatcatgattg

SEQ ID NO: 485660 - DNA, 25 bp, Mus musculus
gaggactatgacattattggagaaa

SEQ ID NO: 485661 - DNA, 25 bp, Mus musculus
gaggactatgactttattggagaaa

SEQ ID NO: 485662 - DNA, 25 bp, Mus musculus
gaggactatgccataactgctagtg

SEQ ID NO: 485663 - DNA, 25 bp, Mus musculus
gaggactatgccttaactgctagtg

SEQ ID NO: 485664 - DNA, 25 bp, Mus musculus
gaggactatttccaagcctgtgaca

SEQ ID NO: 485665 - DNA, 25 bp, Mus musculus
gaggactatttcgaagcctgtgaca

SEQ ID NO: 485666 - DNA, 25 bp, Mus musculus
gaggactattttagatacgccagat

SEQ ID NO: 485667 - DNA, 25 bp, Mus musculus
gaggactatttttgatacgccagat

SEQ ID NO: 485668 - DNA, 25 bp, Mus musculus
gaggactcaaaccacacatgcttct

SEQ ID NO: 485669 - DNA, 25 bp, Mus musculus
gaggactcaaacgacacatgcttct

SEQ ID NO: 485670 - DNA, 25 bp, Mus musculus
gaggactcaagtagtccctcgtcaa

SEQ ID NO: 485671 - DNA, 25 bp, Mus musculus
gaggactcaagttgtccctcgtcaa

SEQ ID NO: 485672 - DNA, 25 bp, Mus musculus
gaggactcacataaacaccgtcgtg

SEQ ID NO: 485673 - DNA, 25 bp, Mus musculus
gaggactcacattaacaccgtcgtg

SEQ ID NO: 485674 - DNA, 25 bp, Mus musculus
gaggactcaggccacacaaagctgt

SEQ ID NO: 485675 - DNA, 25 bp, Mus musculus
gaggactcaggcgacacaaagctgt

SEQ ID NO: 485676 - DNA, 25 bp, Mus musculus
gaggactcaggtctctgttcagagc

SEQ ID NO: 485677 - DNA, 25 bp, Mus musculus
gaggactcaggtgtctgttcagagc

SEQ ID NO: 485678 - DNA, 25 bp, Mus musculus
gaggactcattactctggcttgaag

SEQ ID NO: 485679 - DNA, 25 bp, Mus musculus
gaggactcattagtctggcttgaag

SEQ ID NO: 485680 - DNA, 25 bp, Mus musculus
gaggactccaggctccaggttccag

SEQ ID NO: 485681 - DNA, 25 bp, Mus musculus
gaggactccagggtccaggttccag

SEQ ID NO: 485682 - DNA, 25 bp, Mus musculus
gaggactccgatcgagacgtctcat

SEQ ID NO: 485683 - DNA, 25 bp, Mus musculus
gaggactccgatggagacgtctcat

SEQ ID NO: 485684 - DNA, 25 bp, Mus musculus
gaggactcctgtaaactcatgtgga

SEQ ID NO: 485685 - DNA, 25 bp, Mus musculus
gaggactcctgttaactcatgtgga

SEQ ID NO: 485686 - DNA, 25 bp, Mus musculus
gaggactccttgaatgtatatagtg

SEQ ID NO: 485687 - DNA, 25 bp, Mus musculus
gaggactccttgtatgtatatagtg

SEQ ID NO: 485688 - DNA, 25 bp, Mus musculus
gaggactcggagacatatttctacc

SEQ ID NO: 485689 - DNA, 25 bp, Mus musculus
gaggactcggagtcatatttctacc

SEQ ID NO: 485690 - DNA, 25 bp, Mus musculus
gaggactctatcaggaagccgggca

SEQ ID NO: 485691 - DNA, 25 bp, Mus musculus
gaggactctatctggaagccgggca

SEQ ID NO: 485692 - DNA, 25 bp, Mus musculus
gaggactctccaagttaggcacaga

SEQ ID NO: 485693 - DNA, 25 bp, Mus musculus
gaggactctccacgatttcttggca

SEQ ID NO: 485694 - DNA, 25 bp, Mus musculus
gaggactctccaggatttcttggca

SEQ ID NO: 485695 - DNA, 25 bp, Mus musculus
gaggactctccatgttaggcacaga

SEQ ID NO: 485696 - DNA, 25 bp, Mus musculus
gaggactctctgcaaaggaacccac

SEQ ID NO: 485697 - DNA, 25 bp, Mus musculus
gaggactctctggaaaggaacccac

SEQ ID NO: 485698 - DNA, 25 bp, Mus musculus
gaggactctgacaacctgttagacc

SEQ ID NO: 485699 - DNA, 25 bp, Mus musculus
gaggactctgacaagatgaagccca

SEQ ID NO: 485700 - DNA, 25 bp, Mus musculus
gaggactctgactacctgttagacc

SEQ ID NO: 485701 - DNA, 25 bp, Mus musculus
gaggactctgactagatgaagccca

SEQ ID NO: 485702 - DNA, 25 bp, Mus musculus
gaggactctgccacgggatctgatg

SEQ ID NO: 485703 - DNA, 25 bp, Mus musculus
gaggactctgcctcgggatctgatg

SEQ ID NO: 485704 - DNA, 25 bp, Mus musculus
gaggactctggtcatatcagtgata

SEQ ID NO: 485705 - DNA, 25 bp, Mus musculus
gaggactctggtgatatcagtgata

SEQ ID NO: 485706 - DNA, 25 bp, Mus musculus
gaggactcttaactgggccttacaa

SEQ ID NO: 485707 - DNA, 25 bp, Mus musculus
gaggactcttaagtgggccttacaa

SEQ ID NO: 485708 - DNA, 25 bp, Mus musculus
gaggactcttagagcactgatggat

SEQ ID NO: 485709 - DNA, 25 bp, Mus musculus
gaggactcttagtgcactgatggat

SEQ ID NO: 485710 - DNA, 25 bp, Mus musculus
gaggactgaattactcatgtatact

SEQ ID NO: 485711 - DNA, 25 bp, Mus musculus
gaggactgaatttctcatgtatact

SEQ ID NO: 485712 - DNA, 25 bp, Mus musculus
gaggactgaccaaagttcttgtgac

SEQ ID NO: 485713 - DNA, 25 bp, Mus musculus
gaggactgaccatagttcttgtgac

SEQ ID NO: 485714 - DNA, 25 bp, Mus musculus
gaggactgaggcatcccggcgctac

SEQ ID NO: 485715 - DNA, 25 bp, Mus musculus
gaggactgaggcttcccggcgctac

SEQ ID NO: 485716 - DNA, 25 bp, Mus musculus
gaggactgagtacactgcctcgccc

SEQ ID NO: 485717 - DNA, 25 bp, Mus musculus
gaggactgagtagactgcctcgccc

SEQ ID NO: 485718 - DNA, 25 bp, Mus musculus
gaggactgatgtatctttctaacac

SEQ ID NO: 485719 - DNA, 25 bp, Mus musculus
gaggactgatgtttctttctaacac

SEQ ID NO: 485720 - DNA, 25 bp, Mus musculus
gaggactgcagaatgctttctctta

SEQ ID NO: 485721 - DNA, 25 bp, Mus musculus
gaggactgcagattgctttctctta

SEQ ID NO: 485722 - DNA, 25 bp, Mus musculus
gaggactgcagtaatccacaggctt

SEQ ID NO: 485723 - DNA, 25 bp, Mus musculus
gaggactgcagttatccacaggctt

SEQ ID NO: 485724 - DNA, 25 bp, Mus musculus
gaggactgcatcaggttggctttct

SEQ ID NO: 485725 - DNA, 25 bp, Mus musculus
gaggactgcatctggttggctttct

SEQ ID NO: 485726 - DNA, 25 bp, Mus musculus
gaggactgccaccagcacacctaga

SEQ ID NO: 485727 - DNA, 25 bp, Mus musculus
gaggactgccacgagcacacctaga

SEQ ID NO: 485728 - DNA, 25 bp, Mus musculus
gaggactgccagcaactgtacatat

SEQ ID NO: 485729 - DNA, 25 bp, Mus musculus
gaggactgccaggaactgtacatat

SEQ ID NO: 485730 - DNA, 25 bp, Mus musculus
gaggactgccccaagtagttcagcc

SEQ ID NO: 485731 - DNA, 25 bp, Mus musculus
gaggactgcccctagtagttcagcc

SEQ ID NO: 485732 - DNA, 25 bp, Mus musculus
gaggactgcctgctaccaaaggtga

SEQ ID NO: 485733 - DNA, 25 bp, Mus musculus
gaggactgcctggtaccaaaggtga

SEQ ID NO: 485734 - DNA, 25 bp, Mus musculus
gaggactgctatctgaactcagtga

SEQ ID NO: 485735 - DNA, 25 bp, Mus musculus
gaggactgctatgtgaactcagtga

SEQ ID NO: 485736 - DNA, 25 bp, Mus musculus
gaggactgctgtaaccttttgcagt

SEQ ID NO: 485737 - DNA, 25 bp, Mus musculus
gaggactgctgttaccttttgcagt

SEQ ID NO: 485738 - DNA, 25 bp, Mus musculus
gaggactgctttcagaagtcttcta

SEQ ID NO: 485739 - DNA, 25 bp, Mus musculus
gaggactgctttgagaagtcttcta

SEQ ID NO: 485740 - DNA, 25 bp, Mus musculus
gaggactggaatcccgtgttgtctt

SEQ ID NO: 485741 - DNA, 25 bp, Mus musculus
gaggactggaatgccgtgttgtctt

SEQ ID NO: 485742 - DNA, 25 bp, Mus musculus
gaggactggccaatcaaggtcactg

SEQ ID NO: 485743 - DNA, 25 bp, Mus musculus
gaggactggccattcaaggtcactg

SEQ ID NO: 485744 - DNA, 25 bp, Mus musculus
gaggactgggacaaggcagccaaca

SEQ ID NO: 485745 - DNA, 25 bp, Mus musculus
gaggactgggactaggcagccaaca

SEQ ID NO: 485746 - DNA, 25 bp, Mus musculus
gaggactgtactccatcgaagtgct

SEQ ID NO: 485747 - DNA, 25 bp, Mus musculus
gaggactgtactgcatcgaagtgct

SEQ ID NO: 485748 - DNA, 25 bp, Mus musculus
gaggactgtcagactgtggcttagc

SEQ ID NO: 485749 - DNA, 25 bp, Mus musculus
gaggactgtcagtctgtggcttagc

SEQ ID NO: 485750 - DNA, 25 bp, Mus musculus
gaggactgtccgaaactactgttta

SEQ ID NO: 485751 - DNA, 25 bp, Mus musculus
gaggactgtccgtaactactgttta

SEQ ID NO: 485752 - DNA, 25 bp, Mus musculus
gaggactgtgaactggttgaacccc

SEQ ID NO: 485753 - DNA, 25 bp, Mus musculus
gaggactgtgaagtggttgaacccc

SEQ ID NO: 485754 - DNA, 25 bp, Mus musculus
gaggactgtgaccttatgttaaaaa

SEQ ID NO: 485755 - DNA, 25 bp, Mus musculus
gaggactgtgacgttatgttaaaaa

SEQ ID NO: 485756 - DNA, 25 bp, Mus musculus
gaggactgtggtctgcatcatcata

SEQ ID NO: 485757 - DNA, 25 bp, Mus musculus
gaggactgtggtgtgcatcatcata

SEQ ID NO: 485758 - DNA, 25 bp, Mus musculus
gaggactgtgtcaaagcccacatag

SEQ ID NO: 485759 - DNA, 25 bp, Mus musculus
gaggactgtgtcaacatgaaaaaac

SEQ ID NO: 485760 - DNA, 25 bp, Mus musculus
gaggactgtgtcctcagtagtgctt

SEQ ID NO: 485761 - DNA, 25 bp, Mus musculus
gaggactgtgtcgtcagtagtgctt

SEQ ID NO: 485762 - DNA, 25 bp, Mus musculus
gaggactgtgtctaagcccacatag

SEQ ID NO: 485763 - DNA, 25 bp, Mus musculus
gaggactgtgtctacatgaaaaaac

SEQ ID NO: 485764 - DNA, 25 bp, Mus musculus
gaggactgttcaaaagcccaggaca

SEQ ID NO: 485765 - DNA, 25 bp, Mus musculus
gaggactgttcataagcccaggaca

SEQ ID NO: 485766 - DNA, 25 bp, Mus musculus
gaggactgttcccaaggtcagctgt

SEQ ID NO: 485767 - DNA, 25 bp, Mus musculus
gaggactgttccgaaggtcagctgt

SEQ ID NO: 485768 - DNA, 25 bp, Mus musculus
gaggacttacggctctgaaccactc

SEQ ID NO: 485769 - DNA, 25 bp, Mus musculus
gaggacttacgggtctgaaccactc

SEQ ID NO: 485770 - DNA, 25 bp, Mus musculus
gaggacttactcagctagtatctaa

SEQ ID NO: 485771 - DNA, 25 bp, Mus musculus
gaggacttactctgctagtatctaa

SEQ ID NO: 485772 - DNA, 25 bp, Mus musculus
gaggacttactgctcttctacagaa

SEQ ID NO: 485773 - DNA, 25 bp, Mus musculus
gaggacttactggtcttctacagaa

SEQ ID NO: 485774 - DNA, 25 bp, Mus musculus
gaggacttatctaccaccaactccg

SEQ ID NO: 485775 - DNA, 25 bp, Mus musculus
gaggacttatcttccaccaactccg

SEQ ID NO: 485776 - DNA, 25 bp, Mus musculus
gaggacttcaacacctgttggaact

SEQ ID NO: 485777 - DNA, 25 bp, Mus musculus
gaggacttcaactcctgttggaact

SEQ ID NO: 485778 - DNA, 25 bp, Mus musculus
gaggacttcacaagagtattatttg

SEQ ID NO: 485779 - DNA, 25 bp, Mus musculus
gaggacttcacatgagtattatttg

SEQ ID NO: 485780 - DNA, 25 bp, Mus musculus
gaggacttcactattaatggcatta

SEQ ID NO: 485781 - DNA, 25 bp, Mus musculus
gaggacttcactctacaccttgagg

SEQ ID NO: 485782 - DNA, 25 bp, Mus musculus
gaggacttcactgtacaccttgagg

SEQ ID NO: 485783 - DNA, 25 bp, Mus musculus
gaggacttcacttttaatggcatta

SEQ ID NO: 485784 - DNA, 25 bp, Mus musculus
gaggacttcagactgtccacataaa

SEQ ID NO: 485785 - DNA, 25 bp, Mus musculus
gaggacttcagagtgtccacataaa

SEQ ID NO: 485786 - DNA, 25 bp, Mus musculus
gaggacttccatattgatccggtgc

SEQ ID NO: 485787 - DNA, 25 bp, Mus musculus
gaggacttccattttgatccggtgc

SEQ ID NO: 485788 - DNA, 25 bp, Mus musculus
gaggacttccctaacactaacaatg

SEQ ID NO: 485789 - DNA, 25 bp, Mus musculus
gaggacttcccttacactaacaatg

SEQ ID NO: 485790 - DNA, 25 bp, Mus musculus
gaggacttcctgatgcagcgaagac

SEQ ID NO: 485791 - DNA, 25 bp, Mus musculus
gaggacttcctgttgcagcgaagac

SEQ ID NO: 485792 - DNA, 25 bp, Mus musculus
gaggacttctccagaaactgaatgg

SEQ ID NO: 485793 - DNA, 25 bp, Mus musculus
gaggacttctccatgaggaactgtg

SEQ ID NO: 485794 - DNA, 25 bp, Mus musculus
gaggacttctcctgaaactgaatgg

SEQ ID NO: 485795 - DNA, 25 bp, Mus musculus
gaggacttctccttgaggaactgtg

SEQ ID NO: 485796 - DNA, 25 bp, Mus musculus
gaggacttctctcacttctatgaat

SEQ ID NO: 485797 - DNA, 25 bp, Mus musculus
gaggacttctctgacttctatgaat

SEQ ID NO: 485798 - DNA, 25 bp, Mus musculus
gaggacttgacaacttctgactttt

SEQ ID NO: 485799 - DNA, 25 bp, Mus musculus
gaggacttgacatcttctgactttt

SEQ ID NO: 485800 - DNA, 25 bp, Mus musculus
gaggacttgagcactaatcacgaga

SEQ ID NO: 485801 - DNA, 25 bp, Mus musculus
gaggacttgagctctaatcacgaga

SEQ ID NO: 485802 - DNA, 25 bp, Mus musculus
gaggacttgatcatgttcctaggac

SEQ ID NO: 485803 - DNA, 25 bp, Mus musculus
gaggacttgatcttgttcctaggac

SEQ ID NO: 485804 - DNA, 25 bp, Mus musculus
gaggacttgctcaggccaattccaa

SEQ ID NO: 485805 - DNA, 25 bp, Mus musculus
gaggacttgctctggccaattccaa

SEQ ID NO: 485806 - DNA, 25 bp, Mus musculus
gaggacttggaacctagtgaagaac

SEQ ID NO: 485807 - DNA, 25 bp, Mus musculus
gaggacttggaagctagtgaagaac

SEQ ID NO: 485808 - DNA, 25 bp, Mus musculus
gaggacttggccacaagcctgaaga

SEQ ID NO: 485809 - DNA, 25 bp, Mus musculus
gaggacttggccacattttctcaaa

SEQ ID NO: 485810 - DNA, 25 bp, Mus musculus
gaggacttggcctcaagcctgaaga

SEQ ID NO: 485811 - DNA, 25 bp, Mus musculus
gaggacttggcctcattttctcaaa

SEQ ID NO: 485812 - DNA, 25 bp, Mus musculus
gaggacttggtcactgtgtctctgt

SEQ ID NO: 485813 - DNA, 25 bp, Mus musculus
gaggacttggtctctgtgtctctgt

SEQ ID NO: 485814 - DNA, 25 bp, Mus musculus
gaggacttggttcgctcatttacct

SEQ ID NO: 485815 - DNA, 25 bp, Mus musculus
gaggacttggttggctcatttacct

SEQ ID NO: 485816 - DNA, 25 bp, Mus musculus
gaggacttgtctagcatgtataaaa

SEQ ID NO: 485817 - DNA, 25 bp, Mus musculus
gaggacttgtcttgcatgtataaaa

SEQ ID NO: 485818 - DNA, 25 bp, Mus musculus
gaggacttgtgtacagttccccgaa

SEQ ID NO: 485819 - DNA, 25 bp, Mus musculus
gaggacttgtgttcagttccccgaa

SEQ ID NO: 485820 - DNA, 25 bp, Mus musculus
gaggactttcagaccaccgaactta

SEQ ID NO: 485821 - DNA, 25 bp, Mus musculus
gaggactttcagtccaccgaactta

SEQ ID NO: 485822 - DNA, 25 bp, Mus musculus
gaggactttccaccctctgagatgg

SEQ ID NO: 485823 - DNA, 25 bp, Mus musculus
gaggactttccagcctctgagatgg

SEQ ID NO: 485824 - DNA, 25 bp, Mus musculus
gaggactttcctctgatcgagacag

SEQ ID NO: 485825 - DNA, 25 bp, Mus musculus
gaggactttcctgtgatcgagacag

SEQ ID NO: 485826 - DNA, 25 bp, Mus musculus
gaggactttctacggaggaaccaag

SEQ ID NO: 485827 - DNA, 25 bp, Mus musculus
gaggactttctagggaggaaccaag

SEQ ID NO: 485828 - DNA, 25 bp, Mus musculus
gaggactttcttaaagctactgggc

SEQ ID NO: 485829 - DNA, 25 bp, Mus musculus
gaggactttctttaagctactgggc

SEQ ID NO: 485830 - DNA, 25 bp, Mus musculus
gaggactttgaacgccgttgaccgc

SEQ ID NO: 485831 - DNA, 25 bp, Mus musculus
gaggactttgaaggccgttgaccgc

SEQ ID NO: 485832 - DNA, 25 bp, Mus musculus
gaggactttgtaagctgcctggaga

SEQ ID NO: 485833 - DNA, 25 bp, Mus musculus
gaggactttgtatgctgcctggaga

SEQ ID NO: 485834 - DNA, 25 bp, Mus musculus
gaggactttgtgcttgggctctcca

SEQ ID NO: 485835 - DNA, 25 bp, Mus musculus
gaggactttgtggttgggctctcca

SEQ ID NO: 485836 - DNA, 25 bp, Mus musculus
gaggagaaaaatctgacctggattt

SEQ ID NO: 485837 - DNA, 25 bp, Mus musculus
gaggagaaaaatgtgacctggattt

SEQ ID NO: 485838 - DNA, 25 bp, Mus musculus
gaggagaaaacacagccagttgttg

SEQ ID NO: 485839 - DNA, 25 bp, Mus musculus
gaggagaaaacagagccagttgttg

SEQ ID NO: 485840 - DNA, 25 bp, Mus musculus
gaggagaaacatcaacctctcccct

SEQ ID NO: 485841 - DNA, 25 bp, Mus musculus
gaggagaaacatgaacctctcccct

SEQ ID NO: 485842 - DNA, 25 bp, Mus musculus
gaggagaaactaactcatcccgtct

SEQ ID NO: 485843 - DNA, 25 bp, Mus musculus
gaggagaaactatctcatcccgtct

SEQ ID NO: 485844 - DNA, 25 bp, Mus musculus
gaggagaaatgcatttgtagatcat

SEQ ID NO: 485845 - DNA, 25 bp, Mus musculus
gaggagaaatgcttttgtagatcat

SEQ ID NO: 485846 - DNA, 25 bp, Mus musculus
gaggagaacacccagctttgaactg

SEQ ID NO: 485847 - DNA, 25 bp, Mus musculus
gaggagaacaccgagctttgaactg

SEQ ID NO: 485848 - DNA, 25 bp, Mus musculus
gaggagaacccaccctctaagttca

SEQ ID NO: 485849 - DNA, 25 bp, Mus musculus
gaggagaacccagcctctaagttca

SEQ ID NO: 485850 - DNA, 25 bp, Mus musculus
gaggagaacccgcacctacgcaagg

SEQ ID NO: 485851 - DNA, 25 bp, Mus musculus
gaggagaacccgcactaatccgagt

SEQ ID NO: 485852 - DNA, 25 bp, Mus musculus
gaggagaacccggacctacgcaagg

SEQ ID NO: 485853 - DNA, 25 bp, Mus musculus
gaggagaacccggactaatccgagt

SEQ ID NO: 485854 - DNA, 25 bp, Mus musculus
gaggagaatcacacttcttttgaag

SEQ ID NO: 485855 - DNA, 25 bp, Mus musculus
gaggagaatcactcttcttttgaag

SEQ ID NO: 485856 - DNA, 25 bp, Mus musculus
gaggagaatccgagacctttatttc

SEQ ID NO: 485857 - DNA, 25 bp, Mus musculus
gaggagaatccgtgacctttatttc

SEQ ID NO: 485858 - DNA, 25 bp, Mus musculus
gaggagaatgaccagctgatccgct

SEQ ID NO: 485859 - DNA, 25 bp, Mus musculus
gaggagaatgacgagctgatccgct

SEQ ID NO: 485860 - DNA, 25 bp, Mus musculus
gaggagaatgtaaatttgtcagttt

SEQ ID NO: 485861 - DNA, 25 bp, Mus musculus
gaggagaatgtatatttgtcagttt

SEQ ID NO: 485862 - DNA, 25 bp, Mus musculus
gaggagaattccaattttagggatt

SEQ ID NO: 485863 - DNA, 25 bp, Mus musculus
gaggagaattcctattttagggatt

SEQ ID NO: 485864 - DNA, 25 bp, Mus musculus
gaggagacaaaccatgcaggaaaca

SEQ ID NO: 485865 - DNA, 25 bp, Mus musculus
gaggagacaaacgatgcaggaaaca

SEQ ID NO: 485866 - DNA, 25 bp, Mus musculus
gaggagacacaactggaccatacta

SEQ ID NO: 485867 - DNA, 25 bp, Mus musculus
gaggagacacaagtggaccatacta

SEQ ID NO: 485868 - DNA, 25 bp, Mus musculus
gaggagacaccaagatcttctaaaa

SEQ ID NO: 485869 - DNA, 25 bp, Mus musculus
gaggagacaccatgatcttctaaaa

SEQ ID NO: 485870 - DNA, 25 bp, Mus musculus
gaggagacacggagaccctgactaa

SEQ ID NO: 485871 - DNA, 25 bp, Mus musculus
gaggagacacggtgaccctgactaa

SEQ ID NO: 485872 - DNA, 25 bp, Mus musculus
gaggagacaggcactctactaccga

SEQ ID NO: 485873 - DNA, 25 bp, Mus musculus
gaggagacaggctctctactaccga

SEQ ID NO: 485874 - DNA, 25 bp, Mus musculus
gaggagacagttctggcagctttcc

SEQ ID NO: 485875 - DNA, 25 bp, Mus musculus
gaggagacagttgtggcagctttcc

SEQ ID NO: 485876 - DNA, 25 bp, Mus musculus
gaggagacatctcagcagccatcga

SEQ ID NO: 485877 - DNA, 25 bp, Mus musculus
gaggagacatctgagcagccatcga

SEQ ID NO: 485878 - DNA, 25 bp, Mus musculus
gaggagacattaattcgcatcattg

SEQ ID NO: 485879 - DNA, 25 bp, Mus musculus
gaggagacattatttcgcatcattg

SEQ ID NO: 485880 - DNA, 25 bp, Mus musculus
gaggagaccaaacgccgttactgca

SEQ ID NO: 485881 - DNA, 25 bp, Mus musculus
gaggagaccaaaggccgttactgca

SEQ ID NO: 485882 - DNA, 25 bp, Mus musculus
gaggagaccaaccagctcatgctct

SEQ ID NO: 485883 - DNA, 25 bp, Mus musculus
gaggagaccaacgagctcatgctct

SEQ ID NO: 485884 - DNA, 25 bp, Mus musculus
gaggagaccaataagctgcttcaaa

SEQ ID NO: 485885 - DNA, 25 bp, Mus musculus
gaggagaccaattagctgcttcaaa

SEQ ID NO: 485886 - DNA, 25 bp, Mus musculus
gaggagaccaggcttctgatcccat

SEQ ID NO: 485887 - DNA, 25 bp, Mus musculus
gaggagaccagggttctgatcccat

SEQ ID NO: 485888 - DNA, 25 bp, Mus musculus
gaggagaccagtaaccccgagagga

SEQ ID NO: 485889 - DNA, 25 bp, Mus musculus
gaggagaccagttaccccgagagga

SEQ ID NO: 485890 - DNA, 25 bp, Mus musculus
gaggagaccataccaagccactaga

SEQ ID NO: 485891 - DNA, 25 bp, Mus musculus
gaggagaccatagcaagccactaga

SEQ ID NO: 485892 - DNA, 25 bp, Mus musculus
gaggagaccatgcactatccactgg

SEQ ID NO: 485893 - DNA, 25 bp, Mus musculus
gaggagaccatggactatccactgg

SEQ ID NO: 485894 - DNA, 25 bp, Mus musculus
gaggagacccctaagtagctcatct

SEQ ID NO: 485895 - DNA, 25 bp, Mus musculus
gaggagaccccttagtagctcatct

SEQ ID NO: 485896 - DNA, 25 bp, Mus musculus
gaggagaccctacgaacgcctaaga

SEQ ID NO: 485897 - DNA, 25 bp, Mus musculus
gaggagaccctaggaacgcctaaga

SEQ ID NO: 485898 - DNA, 25 bp, Mus musculus
gaggagaccgccaagcagatccttt

SEQ ID NO: 485899 - DNA, 25 bp, Mus musculus
gaggagaccgcctagcagatccttt

SEQ ID NO: 485900 - DNA, 25 bp, Mus musculus
gaggagacctcaccacggagccctt

SEQ ID NO: 485901 - DNA, 25 bp, Mus musculus
gaggagacctcagcacggagccctt

SEQ ID NO: 485902 - DNA, 25 bp, Mus musculus
gaggagacgccactgcgctacagca

SEQ ID NO: 485903 - DNA, 25 bp, Mus musculus
gaggagacgccagtgcgctacagca

SEQ ID NO: 485904 - DNA, 25 bp, Mus musculus
gaggagacgtgcctctcaactgaaa

SEQ ID NO: 485905 - DNA, 25 bp, Mus musculus
gaggagacgtgcgtctcaactgaaa

SEQ ID NO: 485906 - DNA, 25 bp, Mus musculus
gaggagactcaacggttcatcagga

SEQ ID NO: 485907 - DNA, 25 bp, Mus musculus
gaggagactcaagggttcatcagga

SEQ ID NO: 485908 - DNA, 25 bp, Mus musculus
gaggagactcatatgccagcagata

SEQ ID NO: 485909 - DNA, 25 bp, Mus musculus
gaggagactcatttgccagcagata

SEQ ID NO: 485910 - DNA, 25 bp, Mus musculus
gaggagactggaatactcgaagcaa

SEQ ID NO: 485911 - DNA, 25 bp, Mus musculus
gaggagactggattactcgaagcaa

SEQ ID NO: 485912 - DNA, 25 bp, Mus musculus
gaggagagaagccaacagctcaata

SEQ ID NO: 485913 - DNA, 25 bp, Mus musculus
gaggagagaagcctattgctcaaga

SEQ ID NO: 485914 - DNA, 25 bp, Mus musculus
gaggagagaagcgaacagctcaata

SEQ ID NO: 485915 - DNA, 25 bp, Mus musculus
gaggagagaagcgtattgctcaaga

SEQ ID NO: 485916 - DNA, 25 bp, Mus musculus
gaggagagacccactgtcaatgaca

SEQ ID NO: 485917 - DNA, 25 bp, Mus musculus
gaggagagaccctctgtcaatgaca

SEQ ID NO: 485918 - DNA, 25 bp, Mus musculus
gaggagagacttctgatccatcctg

SEQ ID NO: 485919 - DNA, 25 bp, Mus musculus
gaggagagacttgtgatccatcctg

SEQ ID NO: 485920 - DNA, 25 bp, Mus musculus
gaggagagatgccagcaactcagta

SEQ ID NO: 485921 - DNA, 25 bp, Mus musculus
gaggagagatgccttccaatccctg

SEQ ID NO: 485922 - DNA, 25 bp, Mus musculus
gaggagagatgcgagcaactcagta

SEQ ID NO: 485923 - DNA, 25 bp, Mus musculus
gaggagagatgcgttccaatccctg

SEQ ID NO: 485924 - DNA, 25 bp, Mus musculus
gaggagagcaaaaacttactacttc

SEQ ID NO: 485925 - DNA, 25 bp, Mus musculus
gaggagagcaaatacttactacttc

SEQ ID NO: 485926 - DNA, 25 bp, Mus musculus
gaggagagccatatctatacttgca

SEQ ID NO: 485927 - DNA, 25 bp, Mus musculus
gaggagagccatttctatacttgca

SEQ ID NO: 485928 - DNA, 25 bp, Mus musculus
gaggagagccgtctgtgccgcgagc

SEQ ID NO: 485929 - DNA, 25 bp, Mus musculus
gaggagagccgtgtgtgccgcgagc

SEQ ID NO: 485930 - DNA, 25 bp, Mus musculus
gaggagagcctcacagataacctga

SEQ ID NO: 485931 - DNA, 25 bp, Mus musculus
gaggagagcctctcagataacctga

SEQ ID NO: 485932 - DNA, 25 bp, Mus musculus
gaggagagccttaagtgttcatgta

SEQ ID NO: 485933 - DNA, 25 bp, Mus musculus
gaggagagccttatacattttgctt

SEQ ID NO: 485934 - DNA, 25 bp, Mus musculus
gaggagagcctttagtgttcatgta

SEQ ID NO: 485935 - DNA, 25 bp, Mus musculus
gaggagagccttttacattttgctt

SEQ ID NO: 485936 - DNA, 25 bp, Mus musculus
gaggagagcgccacgggcattttca

SEQ ID NO: 485937 - DNA, 25 bp, Mus musculus
gaggagagcgcctcgggcattttca

SEQ ID NO: 485938 - DNA, 25 bp, Mus musculus
gaggagagctctaactatcgacatg

SEQ ID NO: 485939 - DNA, 25 bp, Mus musculus
gaggagagctcttactatcgacatg

SEQ ID NO: 485940 - DNA, 25 bp, Mus musculus
gaggagagctgaacccagtgcctgg

SEQ ID NO: 485941 - DNA, 25 bp, Mus musculus
gaggagagctgatcccagtgcctgg

SEQ ID NO: 485942 - DNA, 25 bp, Mus musculus
gaggagagctgcagacacacactga

SEQ ID NO: 485943 - DNA, 25 bp, Mus musculus
gaggagagctgctgacacacactga

SEQ ID NO: 485944 - DNA, 25 bp, Mus musculus
gaggagagctggacattgcttcacc

SEQ ID NO: 485945 - DNA, 25 bp, Mus musculus
gaggagagctggtcattgcttcacc

SEQ ID NO: 485946 - DNA, 25 bp, Mus musculus
gaggagagctgtctcctgaacccaa

SEQ ID NO: 485947 - DNA, 25 bp, Mus musculus
gaggagagctgtgtcctgaacccaa

SEQ ID NO: 485948 - DNA, 25 bp, Mus musculus
gaggagagcttcagggtccatctct

SEQ ID NO: 485949 - DNA, 25 bp, Mus musculus
gaggagagcttctgggtccatctct

SEQ ID NO: 485950 - DNA, 25 bp, Mus musculus
gaggagaggcagcgctggcagctag

SEQ ID NO: 485951 - DNA, 25 bp, Mus musculus
gaggagaggcagggctggcagctag

SEQ ID NO: 485952 - DNA, 25 bp, Mus musculus
gaggagaggccgcatccacattgat

SEQ ID NO: 485953 - DNA, 25 bp, Mus musculus
gaggagaggccggatccacattgat

SEQ ID NO: 485954 - DNA, 25 bp, Mus musculus
gaggagaggttcagggtctctcagg

SEQ ID NO: 485955 - DNA, 25 bp, Mus musculus
gaggagaggttctgggtctctcagg

SEQ ID NO: 485956 - DNA, 25 bp, Mus musculus
gaggagagtcctcagaaccctgcac

SEQ ID NO: 485957 - DNA, 25 bp, Mus musculus
gaggagagtcctgagaaccctgcac

SEQ ID NO: 485958 - DNA, 25 bp, Mus musculus
gaggagagttgtacacccattatgg

SEQ ID NO: 485959 - DNA, 25 bp, Mus musculus
gaggagagttgttcacccattatgg

SEQ ID NO: 485960 - DNA, 25 bp, Mus musculus
gaggagagtttcagactcccgtgct

SEQ ID NO: 485961 - DNA, 25 bp, Mus musculus
gaggagagtttctgactcccgtgct

SEQ ID NO: 485962 - DNA, 25 bp, Mus musculus
gaggagataacaaccattctgttta

SEQ ID NO: 485963 - DNA, 25 bp, Mus musculus
gaggagataacatccattctgttta

SEQ ID NO: 485964 - DNA, 25 bp, Mus musculus
gaggagataacccaggcccagcgac

SEQ ID NO: 485965 - DNA, 25 bp, Mus musculus
gaggagataaccgaggcccagcgac

SEQ ID NO: 485966 - DNA, 25 bp, Mus musculus
gaggagataactcggcatatgcaaa

SEQ ID NO: 485967 - DNA, 25 bp, Mus musculus
gaggagataactgggcatatgcaaa

SEQ ID NO: 485968 - DNA, 25 bp, Mus musculus
gaggagatagataccaggaccacaa

SEQ ID NO: 485969 - DNA, 25 bp, Mus musculus
gaggagatagattccaggaccacaa

SEQ ID NO: 485970 - DNA, 25 bp, Mus musculus
gaggagatatgcattctgaggattt

SEQ ID NO: 485971 - DNA, 25 bp, Mus musculus
gaggagatatgctttctgaggattt

SEQ ID NO: 485972 - DNA, 25 bp, Mus musculus
gaggagatcaaaaccctgtgtgagg

SEQ ID NO: 485973 - DNA, 25 bp, Mus musculus
gaggagatcaaatccctgtgtgagg

SEQ ID NO: 485974 - DNA, 25 bp, Mus musculus
gaggagatcaagcttctctctgaca

SEQ ID NO: 485975 - DNA, 25 bp, Mus musculus
gaggagatcaaggttctctctgaca

SEQ ID NO: 485976 - DNA, 25 bp, Mus musculus
gaggagatcaccaaatttgaggagc

SEQ ID NO: 485977 - DNA, 25 bp, Mus musculus
gaggagatcacctaatttgaggagc

SEQ ID NO: 485978 - DNA, 25 bp, Mus musculus
gaggagatcataaatcccactgtct

SEQ ID NO: 485979 - DNA, 25 bp, Mus musculus
gaggagatcatatatcccactgtct

SEQ ID NO: 485980 - DNA, 25 bp, Mus musculus
gaggagatcatcctgctttcagact

SEQ ID NO: 485981 - DNA, 25 bp, Mus musculus
gaggagatcatcgtgctttcagact

SEQ ID NO: 485982 - DNA, 25 bp, Mus musculus
gaggagatcattcatgccatcaggc

SEQ ID NO: 485983 - DNA, 25 bp, Mus musculus
gaggagatcattgatgccatcaggc

SEQ ID NO: 485984 - DNA, 25 bp, Mus musculus
gaggagatcctgctggctttgcaca

SEQ ID NO: 485985 - DNA, 25 bp, Mus musculus
gaggagatcctggtggctttgcaca

SEQ ID NO: 485986 - DNA, 25 bp, Mus musculus
gaggagatcgatccccagctacagg

SEQ ID NO: 485987 - DNA, 25 bp, Mus musculus
gaggagatcgatgcccagctacagg

SEQ ID NO: 485988 - DNA, 25 bp, Mus musculus
gaggagatcgccattatccccagca

SEQ ID NO: 485989 - DNA, 25 bp, Mus musculus
gaggagatcgcctttatccccagca

SEQ ID NO: 485990 - DNA, 25 bp, Mus musculus
gaggagatctccatgcgccgaatgg

SEQ ID NO: 485991 - DNA, 25 bp, Mus musculus
gaggagatctccttgcgccgaatgg

SEQ ID NO: 485992 - DNA, 25 bp, Mus musculus
gaggagatctgacgttgctgcttaa

SEQ ID NO: 485993 - DNA, 25 bp, Mus musculus
gaggagatctgaggttgctgcttaa

SEQ ID NO: 485994 - DNA, 25 bp, Mus musculus
gaggagatctgcaagttcattctgt

SEQ ID NO: 485995 - DNA, 25 bp, Mus musculus
gaggagatctgctagttcattctgt

SEQ ID NO: 485996 - DNA, 25 bp, Mus musculus
gaggagatgactcctcacatagtgt

SEQ ID NO: 485997 - DNA, 25 bp, Mus musculus
gaggagatgactgctcacatagtgt

SEQ ID NO: 485998 - DNA, 25 bp, Mus musculus
gaggagatgctcacacacgacagtc

SEQ ID NO: 485999 - DNA, 25 bp, Mus musculus
gaggagatgctctcacacgacagtc

SEQ ID NO: 486000 - DNA, 25 bp, Mus musculus
gaggagatgggtaaccttctcacta

SEQ ID NO: 486001 - DNA, 25 bp, Mus musculus
gaggagatgggttaccttctcacta

SEQ ID NO: 486002 - DNA, 25 bp, Mus musculus
gaggagatggttacaaaggctaact

SEQ ID NO: 486003 - DNA, 25 bp, Mus musculus
gaggagatggtttcaaaggctaact

SEQ ID NO: 486004 - DNA, 25 bp, Mus musculus
gaggagatgtctacactccgggcca

SEQ ID NO: 486005 - DNA, 25 bp, Mus musculus
gaggagatgtcttcactccgggcca

SEQ ID NO: 486006 - DNA, 25 bp, Mus musculus
gaggagattacactcctggcagctg

SEQ ID NO: 486007 - DNA, 25 bp, Mus musculus
gaggagattacagtcctggcagctg

SEQ ID NO: 486008 - DNA, 25 bp, Mus musculus
gaggagattagcacagcgcttgctg

SEQ ID NO: 486009 - DNA, 25 bp, Mus musculus
gaggagattagctcagcgcttgctg

SEQ ID NO: 486010 - DNA, 25 bp, Mus musculus
gaggagattcctaccagaattcaag

SEQ ID NO: 486011 - DNA, 25 bp, Mus musculus
gaggagattccttccagaattcaag

SEQ ID NO: 486012 - DNA, 25 bp, Mus musculus
gaggagattcgtatccaaaccaaag

SEQ ID NO: 486013 - DNA, 25 bp, Mus musculus
gaggagattcgtttccaaaccaaag

SEQ ID NO: 486014 - DNA, 25 bp, Mus musculus
gaggagcaaatcactcttgccagac

SEQ ID NO: 486015 - DNA, 25 bp, Mus musculus
gaggagcaaatctctcttgccagac

SEQ ID NO: 486016 - DNA, 25 bp, Mus musculus
gaggagcaaattccccaaatcccag

SEQ ID NO: 486017 - DNA, 25 bp, Mus musculus
gaggagcaaattgcccaaatcccag

SEQ ID NO: 486018 - DNA, 25 bp, Mus musculus
gaggagcacacaaagtctgactgga

SEQ ID NO: 486019 - DNA, 25 bp, Mus musculus
gaggagcacacatagtctgactgga

SEQ ID NO: 486020 - DNA, 25 bp, Mus musculus
gaggagcacatgctccgaagactcc

SEQ ID NO: 486021 - DNA, 25 bp, Mus musculus
gaggagcacatggtccgaagactcc

SEQ ID NO: 486022 - DNA, 25 bp, Mus musculus
gaggagcaccaacggcaacaccagc

SEQ ID NO: 486023 - DNA, 25 bp, Mus musculus
gaggagcaccaagggcaacaccagc

SEQ ID NO: 486024 - DNA, 25 bp, Mus musculus
gaggagcacctgacagtgctgcaca

SEQ ID NO: 486025 - DNA, 25 bp, Mus musculus
gaggagcacctgtcagtgctgcaca

SEQ ID NO: 486026 - DNA, 25 bp, Mus musculus
gaggagcaccttagcgaaactgcag

SEQ ID NO: 486027 - DNA, 25 bp, Mus musculus
gaggagcacctttgcgaaactgcag

SEQ ID NO: 486028 - DNA, 25 bp, Mus musculus
gaggagcactagctctgcttcacgc

SEQ ID NO: 486029 - DNA, 25 bp, Mus musculus
gaggagcactaggtctgcttcacgc

SEQ ID NO: 486030 - DNA, 25 bp, Mus musculus
gaggagcactgcagctcttcctctg

SEQ ID NO: 486031 - DNA, 25 bp, Mus musculus
gaggagcactgctgctcttcctctg

SEQ ID NO: 486032 - DNA, 25 bp, Mus musculus
gaggagcagaccagacatcgtttgt

SEQ ID NO: 486033 - DNA, 25 bp, Mus musculus
gaggagcagacctgacatcgtttgt

SEQ ID NO: 486034 - DNA, 25 bp, Mus musculus
gaggagcagagcctaactccaagtc

SEQ ID NO: 486035 - DNA, 25 bp, Mus musculus
gaggagcagagcgtaactccaagtc

SEQ ID NO: 486036 - DNA, 25 bp, Mus musculus
gaggagcagcaaatgtgtgttatac

SEQ ID NO: 486037 - DNA, 25 bp, Mus musculus
gaggagcagcaattgtgtgttatac

SEQ ID NO: 486038 - DNA, 25 bp, Mus musculus
gaggagcagcgcataaccacgactt

SEQ ID NO: 486039 - DNA, 25 bp, Mus musculus
gaggagcagcgcttaaccacgactt

SEQ ID NO: 486040 - DNA, 25 bp, Mus musculus
gaggagcaggagagagcaccaccct

SEQ ID NO: 486041 - DNA, 25 bp, Mus musculus
gaggagcaggagtgagcaccaccct

SEQ ID NO: 486042 - DNA, 25 bp, Mus musculus
gaggagcagtctctgttgtacagat

SEQ ID NO: 486043 - DNA, 25 bp, Mus musculus
gaggagcagtctgtgttgtacagat

SEQ ID NO: 486044 - DNA, 25 bp, Mus musculus
gaggagcataccatcactgtgcatg

SEQ ID NO: 486045 - DNA, 25 bp, Mus musculus
gaggagcataccttcactgtgcatg

SEQ ID NO: 486046 - DNA, 25 bp, Mus musculus
gaggagcatatgaatctctcttttt

SEQ ID NO: 486047 - DNA, 25 bp, Mus musculus
gaggagcatatgtatctctcttttt

SEQ ID NO: 486048 - DNA, 25 bp, Mus musculus
gaggagcatcaaagctgagcctgaa

SEQ ID NO: 486049 - DNA, 25 bp, Mus musculus
gaggagcatcaacacctgttatttt

SEQ ID NO: 486050 - DNA, 25 bp, Mus musculus
gaggagcatcaagacctgttatttt

SEQ ID NO: 486051 - DNA, 25 bp, Mus musculus
gaggagcatcaatgctgagcctgaa

SEQ ID NO: 486052 - DNA, 25 bp, Mus musculus
gaggagcatcataattctgcagcct

SEQ ID NO: 486053 - DNA, 25 bp, Mus musculus
gaggagcatcattattctgcagcct

SEQ ID NO: 486054 - DNA, 25 bp, Mus musculus
gaggagcatgaacacacattccaag

SEQ ID NO: 486055 - DNA, 25 bp, Mus musculus
gaggagcatgaagacacattccaag

SEQ ID NO: 486056 - DNA, 25 bp, Mus musculus
gaggagcatgaccaagaagactgta

SEQ ID NO: 486057 - DNA, 25 bp, Mus musculus
gaggagcatgacgaagaagactgta

SEQ ID NO: 486058 - DNA, 25 bp, Mus musculus
gaggagcatggccactcctggatta

SEQ ID NO: 486059 - DNA, 25 bp, Mus musculus
gaggagcatggcgactcctggatta

SEQ ID NO: 486060 - DNA, 25 bp, Mus musculus
gaggagccaaatcactgcagtgaat

SEQ ID NO: 486061 - DNA, 25 bp, Mus musculus
gaggagccaaatgactgcagtgaat

SEQ ID NO: 486062 - DNA, 25 bp, Mus musculus
gaggagccaacacagcaggtcatca

SEQ ID NO: 486063 - DNA, 25 bp, Mus musculus
gaggagccaacagagcaggtcatca

SEQ ID NO: 486064 - DNA, 25 bp, Mus musculus
gaggagccacatctggacgtccagc

SEQ ID NO: 486065 - DNA, 25 bp, Mus musculus
gaggagccacatgtggacgtccagc

SEQ ID NO: 486066 - DNA, 25 bp, Mus musculus
gaggagccaccaatacattctcagg

SEQ ID NO: 486067 - DNA, 25 bp, Mus musculus
gaggagccaccattacattctcagg

SEQ ID NO: 486068 - DNA, 25 bp, Mus musculus
gaggagccagaaacacatccagtct

SEQ ID NO: 486069 - DNA, 25 bp, Mus musculus
gaggagccagaatcacatccagtct

SEQ ID NO: 486070 - DNA, 25 bp, Mus musculus
gaggagccagctcagatgattctag

SEQ ID NO: 486071 - DNA, 25 bp, Mus musculus
gaggagccagctgagatgattctag

SEQ ID NO: 486072 - DNA, 25 bp, Mus musculus
gaggagccaggcatctgatgacagc

SEQ ID NO: 486073 - DNA, 25 bp, Mus musculus
gaggagccaggcttctgatgacagc

SEQ ID NO: 486074 - DNA, 25 bp, Mus musculus
gaggagccagtcagaacctgccagc

SEQ ID NO: 486075 - DNA, 25 bp, Mus musculus
gaggagccagtctgaacctgccagc

SEQ ID NO: 486076 - DNA, 25 bp, Mus musculus
gaggagccagtgacattgccatagg

SEQ ID NO: 486077 - DNA, 25 bp, Mus musculus
gaggagccagtgtcattgccatagg

SEQ ID NO: 486078 - DNA, 25 bp, Mus musculus
gaggagccatagccagtttcccctc

SEQ ID NO: 486079 - DNA, 25 bp, Mus musculus
gaggagccataggcagtttcccctc

SEQ ID NO: 486080 - DNA, 25 bp, Mus musculus
gaggagccatcgagaccctcagaca

SEQ ID NO: 486081 - DNA, 25 bp, Mus musculus
gaggagccatcgtgaccctcagaca

SEQ ID NO: 486082 - DNA, 25 bp, Mus musculus
gaggagccatgcaaacatcactaca

SEQ ID NO: 486083 - DNA, 25 bp, Mus musculus
gaggagccatgctaacatcactaca

SEQ ID NO: 486084 - DNA, 25 bp, Mus musculus
gaggagccattcacatttaaatcgt

SEQ ID NO: 486085 - DNA, 25 bp, Mus musculus
gaggagccattctcatttaaatcgt

SEQ ID NO: 486086 - DNA, 25 bp, Mus musculus
gaggagcccacaaagtctcctgctg

SEQ ID NO: 486087 - DNA, 25 bp, Mus musculus
gaggagcccacatagtctcctgctg

SEQ ID NO: 486088 - DNA, 25 bp, Mus musculus
gaggagcccagcaagctgctgagaa

SEQ ID NO: 486089 - DNA, 25 bp, Mus musculus
gaggagcccagcatgcatggataca

SEQ ID NO: 486090 - DNA, 25 bp, Mus musculus
gaggagcccagctagctgctgagaa

SEQ ID NO: 486091 - DNA, 25 bp, Mus musculus
gaggagcccagcttgcatggataca

SEQ ID NO: 486092 - DNA, 25 bp, Mus musculus
gaggagccctgcaagcaagcaataa

SEQ ID NO: 486093 - DNA, 25 bp, Mus musculus
gaggagccctgctagcaagcaataa

SEQ ID NO: 486094 - DNA, 25 bp, Mus musculus
gaggagccgccaattcataaagaag

SEQ ID NO: 486095 - DNA, 25 bp, Mus musculus
gaggagccgccatttcataaagaag

SEQ ID NO: 486096 - DNA, 25 bp, Mus musculus
gaggagccgctgagggccagccgaa

SEQ ID NO: 486097 - DNA, 25 bp, Mus musculus
gaggagccgctgtgggccagccgaa

SEQ ID NO: 486098 - DNA, 25 bp, Mus musculus
gaggagccgtcactgcctgaagccc

SEQ ID NO: 486099 - DNA, 25 bp, Mus musculus
gaggagccgtcagtgcctgaagccc

SEQ ID NO: 486100 - DNA, 25 bp, Mus musculus
gaggagcctacacaaaccacagagc

SEQ ID NO: 486101 - DNA, 25 bp, Mus musculus
gaggagcctacagaaaccacagagc

SEQ ID NO: 486102 - DNA, 25 bp, Mus musculus
gaggagcctatactgatttatgata

SEQ ID NO: 486103 - DNA, 25 bp, Mus musculus
gaggagcctatagtgatttatgata

SEQ ID NO: 486104 - DNA, 25 bp, Mus musculus
gaggagcctccaaatatctgtcagc

SEQ ID NO: 486105 - DNA, 25 bp, Mus musculus
gaggagcctccatatatctgtcagc

SEQ ID NO: 486106 - DNA, 25 bp, Mus musculus
gaggagcctcctacatccaccaaga

SEQ ID NO: 486107 - DNA, 25 bp, Mus musculus
gaggagcctcctattgacagcatca

SEQ ID NO: 486108 - DNA, 25 bp, Mus musculus
gaggagcctccttcatccaccaaga

SEQ ID NO: 486109 - DNA, 25 bp, Mus musculus
gaggagcctccttttgacagcatca

SEQ ID NO: 486110 - DNA, 25 bp, Mus musculus
gaggagcctcgtagccacagtttgc

SEQ ID NO: 486111 - DNA, 25 bp, Mus musculus
gaggagcctcgttgccacagtttgc

SEQ ID NO: 486112 - DNA, 25 bp, Mus musculus
gaggagcctggtaaacttatattgt

SEQ ID NO: 486113 - DNA, 25 bp, Mus musculus
gaggagcctggttaacttatattgt

SEQ ID NO: 486114 - DNA, 25 bp, Mus musculus
gaggagcgaggcaccggcatcccct

SEQ ID NO: 486115 - DNA, 25 bp, Mus musculus
gaggagcgaggctccggcatcccct

SEQ ID NO: 486116 - DNA, 25 bp, Mus musculus
gaggagcgccacagggctgaagtct

SEQ ID NO: 486117 - DNA, 25 bp, Mus musculus
gaggagcgccactgggctgaagtct

SEQ ID NO: 486118 - DNA, 25 bp, Mus musculus
gaggagcgcccgaaccctgtaaata

SEQ ID NO: 486119 - DNA, 25 bp, Mus musculus
gaggagcgcccgtaccctgtaaata

SEQ ID NO: 486120 - DNA, 25 bp, Mus musculus
gaggagcgcggactgctttatttta

SEQ ID NO: 486121 - DNA, 25 bp, Mus musculus
gaggagcgcggagtgctttatttta

SEQ ID NO: 486122 - DNA, 25 bp, Mus musculus
gaggagcgcttcctcaagaacattg

SEQ ID NO: 486123 - DNA, 25 bp, Mus musculus
gaggagcgcttcgtcaagaacattg

SEQ ID NO: 486124 - DNA, 25 bp, Mus musculus
gaggagcggacacagcacaacttct

SEQ ID NO: 486125 - DNA, 25 bp, Mus musculus
gaggagcggacagagcacaacttct

SEQ ID NO: 486126 - DNA, 25 bp, Mus musculus
gaggagcggcaacgaaccacaccat

SEQ ID NO: 486127 - DNA, 25 bp, Mus musculus
gaggagcggcaaggaaccacaccat

SEQ ID NO: 486128 - DNA, 25 bp, Mus musculus
gaggagcggccaaactgtgagatct

SEQ ID NO: 486129 - DNA, 25 bp, Mus musculus
gaggagcggccatactgtgagatct

SEQ ID NO: 486130 - DNA, 25 bp, Mus musculus
gaggagcgggagcacctggatgctg

SEQ ID NO: 486131 - DNA, 25 bp, Mus musculus
gaggagcgggaggacctggatgctg

SEQ ID NO: 486132 - DNA, 25 bp, Mus musculus
gaggagctacagctttttcactttt

SEQ ID NO: 486133 - DNA, 25 bp, Mus musculus
gaggagctacaggtttttcactttt

SEQ ID NO: 486134 - DNA, 25 bp, Mus musculus
gaggagctacataaggtcacatcat

SEQ ID NO: 486135 - DNA, 25 bp, Mus musculus
gaggagctacattaggtcacatcat

SEQ ID NO: 486136 - DNA, 25 bp, Mus musculus
gaggagctaccccagcagaggcaaa

SEQ ID NO: 486137 - DNA, 25 bp, Mus musculus
gaggagctacccgagcagaggcaaa

SEQ ID NO: 486138 - DNA, 25 bp, Mus musculus
gaggagctagcacattcaaatctgt

SEQ ID NO: 486139 - DNA, 25 bp, Mus musculus
gaggagctagcagattcaaatctgt

SEQ ID NO: 486140 - DNA, 25 bp, Mus musculus
gaggagctatgtacagttcttcttt

SEQ ID NO: 486141 - DNA, 25 bp, Mus musculus
gaggagctatgtctgaagaatagta

SEQ ID NO: 486142 - DNA, 25 bp, Mus musculus
gaggagctatgtgtgaagaatagta

SEQ ID NO: 486143 - DNA, 25 bp, Mus musculus
gaggagctatgttcagttcttcttt

SEQ ID NO: 486144 - DNA, 25 bp, Mus musculus
gaggagctattaaaggaccgcaaca

SEQ ID NO: 486145 - DNA, 25 bp, Mus musculus
gaggagctattataggaccgcaaca

SEQ ID NO: 486146 - DNA, 25 bp, Mus musculus
gaggagctcaaccagtctctgaagg

SEQ ID NO: 486147 - DNA, 25 bp, Mus musculus
gaggagctcaacgagtctctgaagg

SEQ ID NO: 486148 - DNA, 25 bp, Mus musculus
gaggagctcacaattaagaaacttt

SEQ ID NO: 486149 - DNA, 25 bp, Mus musculus
gaggagctcacatttaagaaacttt

SEQ ID NO: 486150 - DNA, 25 bp, Mus musculus
gaggagctcagcaaactgcggcgct

SEQ ID NO: 486151 - DNA, 25 bp, Mus musculus
gaggagctcagctaactgcggcgct

SEQ ID NO: 486152 - DNA, 25 bp, Mus musculus
gaggagctcattagcgtaggtttgt

SEQ ID NO: 486153 - DNA, 25 bp, Mus musculus
gaggagctcatttgcgtaggtttgt

SEQ ID NO: 486154 - DNA, 25 bp, Mus musculus
gaggagctcctgctgaatggcaaaa

SEQ ID NO: 486155 - DNA, 25 bp, Mus musculus
gaggagctcctggtgaatggcaaaa

SEQ ID NO: 486156 - DNA, 25 bp, Mus musculus
gaggagctctgaagcaaccaggctg

SEQ ID NO: 486157 - DNA, 25 bp, Mus musculus
gaggagctctgatgcaaccaggctg

SEQ ID NO: 486158 - DNA, 25 bp, Mus musculus
gaggagctctttcactgccccaggg

SEQ ID NO: 486159 - DNA, 25 bp, Mus musculus
gaggagctctttctgtttataacag

SEQ ID NO: 486160 - DNA, 25 bp, Mus musculus
gaggagctctttgactgccccaggg

SEQ ID NO: 486161 - DNA, 25 bp, Mus musculus
gaggagctctttgtgtttataacag

SEQ ID NO: 486162 - DNA, 25 bp, Mus musculus
gaggagctgaaaacgccagccataa

SEQ ID NO: 486163 - DNA, 25 bp, Mus musculus
gaggagctgaaaattgttaccaaca

SEQ ID NO: 486164 - DNA, 25 bp, Mus musculus
gaggagctgaaatcgccagccataa

SEQ ID NO: 486165 - DNA, 25 bp, Mus musculus
gaggagctgaaatttgttaccaaca

SEQ ID NO: 486166 - DNA, 25 bp, Mus musculus
gaggagctgaacagaaactgccatt

SEQ ID NO: 486167 - DNA, 25 bp, Mus musculus
gaggagctgaactgaaactgccatt

SEQ ID NO: 486168 - DNA, 25 bp, Mus musculus
gaggagctgcccactatcacggtga

SEQ ID NO: 486169 - DNA, 25 bp, Mus musculus
gaggagctgcccatcggaggtcccc

SEQ ID NO: 486170 - DNA, 25 bp, Mus musculus
gaggagctgccctctatcacggtga

SEQ ID NO: 486171 - DNA, 25 bp, Mus musculus
gaggagctgcccttcggaggtcccc

SEQ ID NO: 486172 - DNA, 25 bp, Mus musculus
gaggagctgccgactgcggctctca

SEQ ID NO: 486173 - DNA, 25 bp, Mus musculus
gaggagctgccgtctgcggctctca

SEQ ID NO: 486174 - DNA, 25 bp, Mus musculus
gaggagctgctcagtttacagaaca

SEQ ID NO: 486175 - DNA, 25 bp, Mus musculus
gaggagctgctctgtttacagaaca

SEQ ID NO: 486176 - DNA, 25 bp, Mus musculus
gaggagctggctagatggtcacacc

SEQ ID NO: 486177 - DNA, 25 bp, Mus musculus
gaggagctggcttgatggtcacacc

SEQ ID NO: 486178 - DNA, 25 bp, Mus musculus
gaggagctgggaagccattgctcat

SEQ ID NO: 486179 - DNA, 25 bp, Mus musculus
gaggagctgggatgccattgctcat

SEQ ID NO: 486180 - DNA, 25 bp, Mus musculus
gaggagctgggtccaattcccaacc

SEQ ID NO: 486181 - DNA, 25 bp, Mus musculus
gaggagctgggtgcaattcccaacc

SEQ ID NO: 486182 - DNA, 25 bp, Mus musculus
gaggagctgtctctctcagttggaa

SEQ ID NO: 486183 - DNA, 25 bp, Mus musculus
gaggagctgtctgtctcagttggaa

SEQ ID NO: 486184 - DNA, 25 bp, Mus musculus
gaggagcttaaaacctatcaccaag

SEQ ID NO: 486185 - DNA, 25 bp, Mus musculus
gaggagcttaaatcctatcaccaag

SEQ ID NO: 486186 - DNA, 25 bp, Mus musculus
gaggagcttattcagtcctcgcctc

SEQ ID NO: 486187 - DNA, 25 bp, Mus musculus
gaggagcttattgagtcctcgcctc

SEQ ID NO: 486188 - DNA, 25 bp, Mus musculus
gaggagcttcgaaactacatggaga

SEQ ID NO: 486189 - DNA, 25 bp, Mus musculus
gaggagcttcgatactacatggaga

SEQ ID NO: 486190 - DNA, 25 bp, Mus musculus
gaggagcttcggattgattctttta

SEQ ID NO: 486191 - DNA, 25 bp, Mus musculus
gaggagcttcggtttgattctttta

SEQ ID NO: 486192 - DNA, 25 bp, Mus musculus
gaggagcttgaacaccacgatacag

SEQ ID NO: 486193 - DNA, 25 bp, Mus musculus
gaggagcttgaagaccacgatacag

SEQ ID NO: 486194 - DNA, 25 bp, Mus musculus
gaggagcttgataagccagcgtgaa

SEQ ID NO: 486195 - DNA, 25 bp, Mus musculus
gaggagcttgattagccagcgtgaa

SEQ ID NO: 486196 - DNA, 25 bp, Mus musculus
gaggagctttacacaatgatttgtc

SEQ ID NO: 486197 - DNA, 25 bp, Mus musculus
gaggagctttactcaatgatttgtc

SEQ ID NO: 486198 - DNA, 25 bp, Mus musculus
gaggagctttccatgggcaaccatt

SEQ ID NO: 486199 - DNA, 25 bp, Mus musculus
gaggagctttccttgggcaaccatt

SEQ ID NO: 486200 - DNA, 25 bp, Mus musculus
gaggagctttttagagaccctcaaa

SEQ ID NO: 486201 - DNA, 25 bp, Mus musculus
gaggagcttttttgagaccctcaaa

SEQ ID NO: 486202 - DNA, 25 bp, Mus musculus
gaggaggaaccaactctccagagcc

SEQ ID NO: 486203 - DNA, 25 bp, Mus musculus
gaggaggaaccatctctccagagcc

SEQ ID NO: 486204 - DNA, 25 bp, Mus musculus
gaggaggaacgcaatcaagcagaac

SEQ ID NO: 486205 - DNA, 25 bp, Mus musculus
gaggaggaacgctatcaagcagaac

SEQ ID NO: 486206 - DNA, 25 bp, Mus musculus
gaggaggaactgacccacgcagaca

SEQ ID NO: 486207 - DNA, 25 bp, Mus musculus
gaggaggaactgtcccacgcagaca

SEQ ID NO: 486208 - DNA, 25 bp, Mus musculus
gaggaggaagacagatccctttccc

SEQ ID NO: 486209 - DNA, 25 bp, Mus musculus
gaggaggaagacctccccaaacaga

SEQ ID NO: 486210 - DNA, 25 bp, Mus musculus
gaggaggaagacgtccccaaacaga

SEQ ID NO: 486211 - DNA, 25 bp, Mus musculus
gaggaggaagactgatccctttccc

SEQ ID NO: 486212 - DNA, 25 bp, Mus musculus
gaggaggaagcaacttcgccagcac

SEQ ID NO: 486213 - DNA, 25 bp, Mus musculus
gaggaggaagcatcttcgccagcac

SEQ ID NO: 486214 - DNA, 25 bp, Mus musculus
gaggaggacagtaccaaggtccccg

SEQ ID NO: 486215 - DNA, 25 bp, Mus musculus
gaggaggacagtactactatgacaa

SEQ ID NO: 486216 - DNA, 25 bp, Mus musculus
gaggaggacagttccaaggtccccg

SEQ ID NO: 486217 - DNA, 25 bp, Mus musculus
gaggaggacagttctactatgacaa

SEQ ID NO: 486218 - DNA, 25 bp, Mus musculus
gaggaggacgttaggaagttgtgtt

SEQ ID NO: 486219 - DNA, 25 bp, Mus musculus
gaggaggacgtttggaagttgtgtt

SEQ ID NO: 486220 - DNA, 25 bp, Mus musculus
gaggaggactccacggattcgcagt

SEQ ID NO: 486221 - DNA, 25 bp, Mus musculus
gaggaggactcccactctccacagt

SEQ ID NO: 486222 - DNA, 25 bp, Mus musculus
gaggaggactccgactctccacagt

SEQ ID NO: 486223 - DNA, 25 bp, Mus musculus
gaggaggactcctcggattcgcagt

SEQ ID NO: 486224 - DNA, 25 bp, Mus musculus
gaggaggagatcaccaaatttgagg

SEQ ID NO: 486225 - DNA, 25 bp, Mus musculus
gaggaggagatctccaaatttgagg

SEQ ID NO: 486226 - DNA, 25 bp, Mus musculus
gaggaggaggcacctacccgaatcc

SEQ ID NO: 486227 - DNA, 25 bp, Mus musculus
gaggaggaggcagctacccgaatcc

SEQ ID NO: 486228 - DNA, 25 bp, Mus musculus
gaggaggaggtacgcacacaatatc

SEQ ID NO: 486229 - DNA, 25 bp, Mus musculus
gaggaggaggtaggcacacaatatc

SEQ ID NO: 486230 - DNA, 25 bp, Mus musculus
gaggaggagtccagcccaaataccc

SEQ ID NO: 486231 - DNA, 25 bp, Mus musculus
gaggaggagtcctgcccaaataccc

SEQ ID NO: 486232 - DNA, 25 bp, Mus musculus
gaggaggatacacacatgccactat

SEQ ID NO: 486233 - DNA, 25 bp, Mus musculus
gaggaggatacagacatgccactat

SEQ ID NO: 486234 - DNA, 25 bp, Mus musculus
gaggaggatcctcggctacttagca

SEQ ID NO: 486235 - DNA, 25 bp, Mus musculus
gaggaggatcctgggctacttagca

SEQ ID NO: 486236 - DNA, 25 bp, Mus musculus
gaggaggatctaaaccacggtgcta

SEQ ID NO: 486237 - DNA, 25 bp, Mus musculus
gaggaggatctataccacggtgcta

SEQ ID NO: 486238 - DNA, 25 bp, Mus musculus
gaggaggcagagctctttcctattg

SEQ ID NO: 486239 - DNA, 25 bp, Mus musculus
gaggaggcagaggtctttcctattg

SEQ ID NO: 486240 - DNA, 25 bp, Mus musculus
gaggaggcagcaacgacaccaatta

SEQ ID NO: 486241 - DNA, 25 bp, Mus musculus
gaggaggcagcatcgacaccaatta

SEQ ID NO: 486242 - DNA, 25 bp, Mus musculus
gaggaggcagcgctcctccctgcat

SEQ ID NO: 486243 - DNA, 25 bp, Mus musculus
gaggaggcagcggtcctccctgcat

SEQ ID NO: 486244 - DNA, 25 bp, Mus musculus
gaggaggcaggccatgcccttcaaa

SEQ ID NO: 486245 - DNA, 25 bp, Mus musculus
gaggaggcaggcgatgcccttcaaa

SEQ ID NO: 486246 - DNA, 25 bp, Mus musculus
gaggaggcaggtcacatctgaacac

SEQ ID NO: 486247 - DNA, 25 bp, Mus musculus
gaggaggcaggtgacatctgaacac

SEQ ID NO: 486248 - DNA, 25 bp, Mus musculus
gaggaggcattaaagcttaaagctt

SEQ ID NO: 486249 - DNA, 25 bp, Mus musculus
gaggaggcattatagcttaaagctt

SEQ ID NO: 486250 - DNA, 25 bp, Mus musculus
gaggaggcattcaggcaattctaaa

SEQ ID NO: 486251 - DNA, 25 bp, Mus musculus
gaggaggcattctggcaattctaaa

SEQ ID NO: 486252 - DNA, 25 bp, Mus musculus
gaggaggcatttattaacacagcaa

SEQ ID NO: 486253 - DNA, 25 bp, Mus musculus
gaggaggcattttttaacacagcaa

SEQ ID NO: 486254 - DNA, 25 bp, Mus musculus
gaggaggccattcacaaactgagca

SEQ ID NO: 486255 - DNA, 25 bp, Mus musculus
gaggaggccattgacaaactgagca

SEQ ID NO: 486256 - DNA, 25 bp, Mus musculus
gaggaggcctagaacctgccctgat

SEQ ID NO: 486257 - DNA, 25 bp, Mus musculus
gaggaggcctagtacctgccctgat

SEQ ID NO: 486258 - DNA, 25 bp, Mus musculus
gaggaggcgcagcaccctctgccat

SEQ ID NO: 486259 - DNA, 25 bp, Mus musculus
gaggaggcgcaggaccctctgccat

SEQ ID NO: 486260 - DNA, 25 bp, Mus musculus
gaggaggcggtacctatcttctgtc

SEQ ID NO: 486261 - DNA, 25 bp, Mus musculus
gaggaggcggtagctatcttctgtc

SEQ ID NO: 486262 - DNA, 25 bp, Mus musculus
gaggaggcgttgatctacgccatgc

SEQ ID NO: 486263 - DNA, 25 bp, Mus musculus
gaggaggcgttgttctacgccatgc

SEQ ID NO: 486264 - DNA, 25 bp, Mus musculus
gaggaggctcatcagttacgatcag

SEQ ID NO: 486265 - DNA, 25 bp, Mus musculus
gaggaggctcatgagttacgatcag

SEQ ID NO: 486266 - DNA, 25 bp, Mus musculus
gaggaggctcctaggttttgccgac

SEQ ID NO: 486267 - DNA, 25 bp, Mus musculus
gaggaggctccttggttttgccgac

SEQ ID NO: 486268 - DNA, 25 bp, Mus musculus
gaggaggctcttactcactcaagaa

SEQ ID NO: 486269 - DNA, 25 bp, Mus musculus
gaggaggctctttctcactcaagaa

SEQ ID NO: 486270 - DNA, 25 bp, Mus musculus
gaggaggctgccacactgtgtgctc

SEQ ID NO: 486271 - DNA, 25 bp, Mus musculus
gaggaggctgcctcactgtgtgctc

SEQ ID NO: 486272 - DNA, 25 bp, Mus musculus
gaggaggctgctaccaaggactagt

SEQ ID NO: 486273 - DNA, 25 bp, Mus musculus
gaggaggctgcttccaaggactagt

SEQ ID NO: 486274 - DNA, 25 bp, Mus musculus
gaggaggctgtcacctaaggctaaa

SEQ ID NO: 486275 - DNA, 25 bp, Mus musculus
gaggaggctgtctcctaaggctaaa

SEQ ID NO: 486276 - DNA, 25 bp, Mus musculus
gaggagggacccaccacagccctta

SEQ ID NO: 486277 - DNA, 25 bp, Mus musculus
gaggagggaccctccacagccctta

SEQ ID NO: 486278 - DNA, 25 bp, Mus musculus
gaggagggagttacacctctgccct

SEQ ID NO: 486279 - DNA, 25 bp, Mus musculus
gaggagggagtttcacctctgccct

SEQ ID NO: 486280 - DNA, 25 bp, Mus musculus
gaggagggattcatatcttggagat

SEQ ID NO: 486281 - DNA, 25 bp, Mus musculus
gaggagggattcttatcttggagat

SEQ ID NO: 486282 - DNA, 25 bp, Mus musculus
gaggagggcacccagaatctgccac

SEQ ID NO: 486283 - DNA, 25 bp, Mus musculus
gaggagggcaccgagaatctgccac

SEQ ID NO: 486284 - DNA, 25 bp, Mus musculus
gaggagggcatgacttcatcacttt

SEQ ID NO: 486285 - DNA, 25 bp, Mus musculus
gaggagggcatgtcttcatcacttt

SEQ ID NO: 486286 - DNA, 25 bp, Mus musculus
gaggagggcattactgtatttcagg

SEQ ID NO: 486287 - DNA, 25 bp, Mus musculus
gaggagggcatttctgtatttcagg

SEQ ID NO: 486288 - DNA, 25 bp, Mus musculus
gaggagggcttccagtaagcttccc

SEQ ID NO: 486289 - DNA, 25 bp, Mus musculus
gaggagggcttcgagtaagcttccc

SEQ ID NO: 486290 - DNA, 25 bp, Mus musculus
gaggagggtccaagtggctccaaaa

SEQ ID NO: 486291 - DNA, 25 bp, Mus musculus
gaggagggtccatgtggctccaaaa

SEQ ID NO: 486292 - DNA, 25 bp, Mus musculus
gaggaggtacaccagagcccttgat

SEQ ID NO: 486293 - DNA, 25 bp, Mus musculus
gaggaggtacacgagagcccttgat

SEQ ID NO: 486294 - DNA, 25 bp, Mus musculus
gaggaggtactgagtttctgtataa

SEQ ID NO: 486295 - DNA, 25 bp, Mus musculus
gaggaggtactgtgtttctgtataa

SEQ ID NO: 486296 - DNA, 25 bp, Mus musculus
gaggaggtatacaaagacacaatta

SEQ ID NO: 486297 - DNA, 25 bp, Mus musculus
gaggaggtatactaagacacaatta

SEQ ID NO: 486298 - DNA, 25 bp, Mus musculus
gaggaggtcaacactgcactttctg

SEQ ID NO: 486299 - DNA, 25 bp, Mus musculus
gaggaggtcaactctgcactttctg

SEQ ID NO: 486300 - DNA, 25 bp, Mus musculus
gaggaggtcacacaacaatgtacaa

SEQ ID NO: 486301 - DNA, 25 bp, Mus musculus
gaggaggtcacagaacaatgtacaa

SEQ ID NO: 486302 - DNA, 25 bp, Mus musculus
gaggaggtctctagcatctgtagga

SEQ ID NO: 486303 - DNA, 25 bp, Mus musculus
gaggaggtctcttgcatctgtagga

SEQ ID NO: 486304 - DNA, 25 bp, Mus musculus
gaggaggtcttaccacactggctgt

SEQ ID NO: 486305 - DNA, 25 bp, Mus musculus
gaggaggtcttagcacactggctgt

SEQ ID NO: 486306 - DNA, 25 bp, Mus musculus
gaggaggtctttcgaagctacgttt

SEQ ID NO: 486307 - DNA, 25 bp, Mus musculus
gaggaggtctttggaagctacgttt

SEQ ID NO: 486308 - DNA, 25 bp, Mus musculus
gaggaggtgaagacactgctcccat

SEQ ID NO: 486309 - DNA, 25 bp, Mus musculus
gaggaggtgaagtcactgctcccat

SEQ ID NO: 486310 - DNA, 25 bp, Mus musculus
gaggaggtgctgagaccctctcttc

SEQ ID NO: 486311 - DNA, 25 bp, Mus musculus
gaggaggtgctgtgaccctctcttc

SEQ ID NO: 486312 - DNA, 25 bp, Mus musculus
gaggaggtgggaatctcttctataa

SEQ ID NO: 486313 - DNA, 25 bp, Mus musculus
gaggaggtgggattctcttctataa

SEQ ID NO: 486314 - DNA, 25 bp, Mus musculus
gaggaggtgtccatctatggcttct

SEQ ID NO: 486315 - DNA, 25 bp, Mus musculus
gaggaggtgtccttctatggcttct

SEQ ID NO: 486316 - DNA, 25 bp, Mus musculus
gaggaggttaacaatagcacagaat

SEQ ID NO: 486317 - DNA, 25 bp, Mus musculus
gaggaggttaactatagcacagaat

SEQ ID NO: 486318 - DNA, 25 bp, Mus musculus
gaggaggtttaaaagtgtcagcaac

SEQ ID NO: 486319 - DNA, 25 bp, Mus musculus
gaggaggtttaatagtgtcagcaac

SEQ ID NO: 486320 - DNA, 25 bp, Mus musculus
gaggagtaaagcacatctctcttag

SEQ ID NO: 486321 - DNA, 25 bp, Mus musculus
gaggagtaaagctcatctctcttag

SEQ ID NO: 486322 - DNA, 25 bp, Mus musculus
gaggagtaacttctgacacctgtac

SEQ ID NO: 486323 - DNA, 25 bp, Mus musculus
gaggagtaacttgtgacacctgtac

SEQ ID NO: 486324 - DNA, 25 bp, Mus musculus
gaggagtacatcaagcgcgccctgg

SEQ ID NO: 486325 - DNA, 25 bp, Mus musculus
gaggagtacatcctgtccttcgaga

SEQ ID NO: 486326 - DNA, 25 bp, Mus musculus
gaggagtacatcgtgtccttcgaga

SEQ ID NO: 486327 - DNA, 25 bp, Mus musculus
gaggagtacatctagcgcgccctgg

SEQ ID NO: 486328 - DNA, 25 bp, Mus musculus
gaggagtaccaacatcacacccagt

SEQ ID NO: 486329 - DNA, 25 bp, Mus musculus
gaggagtaccaagatcacacccagt

SEQ ID NO: 486330 - DNA, 25 bp, Mus musculus
gaggagtaccccaaattctgcaatt

SEQ ID NO: 486331 - DNA, 25 bp, Mus musculus
gaggagtacccctaattctgcaatt

SEQ ID NO: 486332 - DNA, 25 bp, Mus musculus
gaggagtacctgaccagcttgggca

SEQ ID NO: 486333 - DNA, 25 bp, Mus musculus
gaggagtacctgtccagcttgggca

SEQ ID NO: 486334 - DNA, 25 bp, Mus musculus
gaggagtacgagacccgattcctgt

SEQ ID NO: 486335 - DNA, 25 bp, Mus musculus
gaggagtacgagtcccgattcctgt

SEQ ID NO: 486336 - DNA, 25 bp, Mus musculus
gaggagtactagcaaggccttctga

SEQ ID NO: 486337 - DNA, 25 bp, Mus musculus
gaggagtactaggaaggccttctga

SEQ ID NO: 486338 - DNA, 25 bp, Mus musculus
gaggagtagaaacctttgcccacct

SEQ ID NO: 486339 - DNA, 25 bp, Mus musculus
gaggagtagaaagctttgcccacct

SEQ ID NO: 486340 - DNA, 25 bp, Mus musculus
gaggagtagccacctatcctctggc

SEQ ID NO: 486341 - DNA, 25 bp, Mus musculus
gaggagtagccagctatcctctggc

SEQ ID NO: 486342 - DNA, 25 bp, Mus musculus
gaggagtatctcagctcggaagcat

SEQ ID NO: 486343 - DNA, 25 bp, Mus musculus
gaggagtatctctgctcggaagcat

SEQ ID NO: 486344 - DNA, 25 bp, Mus musculus
gaggagtatgcgcaccttaccacac

SEQ ID NO: 486345 - DNA, 25 bp, Mus musculus
gaggagtatgcggaccttaccacac

SEQ ID NO: 486346 - DNA, 25 bp, Mus musculus
gaggagtattccacttgttccacac

SEQ ID NO: 486347 - DNA, 25 bp, Mus musculus
gaggagtattcctcttgttccacac

SEQ ID NO: 486348 - DNA, 25 bp, Mus musculus
gaggagtcagaaaacgccgagaagt

SEQ ID NO: 486349 - DNA, 25 bp, Mus musculus
gaggagtcagaatacgccgagaagt

SEQ ID NO: 486350 - DNA, 25 bp, Mus musculus
gaggagtcagatacgatagcctttt

SEQ ID NO: 486351 - DNA, 25 bp, Mus musculus
gaggagtcagattcgatagcctttt

SEQ ID NO: 486352 - DNA, 25 bp, Mus musculus
gaggagtcagctatactttgccaga

SEQ ID NO: 486353 - DNA, 25 bp, Mus musculus
gaggagtcagctttactttgccaga

SEQ ID NO: 486354 - DNA, 25 bp, Mus musculus
gaggagtcatacagtgctgcggctc

SEQ ID NO: 486355 - DNA, 25 bp, Mus musculus
gaggagtcatactgtgctgcggctc

SEQ ID NO: 486356 - DNA, 25 bp, Mus musculus
gaggagtccaaaagcctggtccgaa

SEQ ID NO: 486357 - DNA, 25 bp, Mus musculus
gaggagtccaaatgcctggtccgaa

SEQ ID NO: 486358 - DNA, 25 bp, Mus musculus
gaggagtccatgagtagcgaaagca

SEQ ID NO: 486359 - DNA, 25 bp, Mus musculus
gaggagtccatgtgtagcgaaagca

SEQ ID NO: 486360 - DNA, 25 bp, Mus musculus
gaggagtccccaactggaacaaggt

SEQ ID NO: 486361 - DNA, 25 bp, Mus musculus
gaggagtccccatctggaacaaggt

SEQ ID NO: 486362 - DNA, 25 bp, Mus musculus
gaggagtccctaaaccaactcggcc

SEQ ID NO: 486363 - DNA, 25 bp, Mus musculus
gaggagtccctataccaactcggcc

SEQ ID NO: 486364 - DNA, 25 bp, Mus musculus
gaggagtccggccagtgtctttctc

SEQ ID NO: 486365 - DNA, 25 bp, Mus musculus
gaggagtccggcgagtgtctttctc

SEQ ID NO: 486366 - DNA, 25 bp, Mus musculus
gaggagtccgtcagcctggctgcca

SEQ ID NO: 486367 - DNA, 25 bp, Mus musculus
gaggagtccgtctgcctggctgcca

SEQ ID NO: 486368 - DNA, 25 bp, Mus musculus
gaggagtcctttcagcaattcagca

SEQ ID NO: 486369 - DNA, 25 bp, Mus musculus
gaggagtcctttgagcaattcagca

SEQ ID NO: 486370 - DNA, 25 bp, Mus musculus
gaggagtcgccaagagcaaagccca

SEQ ID NO: 486371 - DNA, 25 bp, Mus musculus
gaggagtcgccatgagcaaagccca

SEQ ID NO: 486372 - DNA, 25 bp, Mus musculus
gaggagtctatcagtatttctcttt

SEQ ID NO: 486373 - DNA, 25 bp, Mus musculus
gaggagtctatctgtatttctcttt

SEQ ID NO: 486374 - DNA, 25 bp, Mus musculus
gaggagtctcccagcagattcgaga

SEQ ID NO: 486375 - DNA, 25 bp, Mus musculus
gaggagtctccctgcagattcgaga

SEQ ID NO: 486376 - DNA, 25 bp, Mus musculus
gaggagtctcctctatttgaagaac

SEQ ID NO: 486377 - DNA, 25 bp, Mus musculus
gaggagtctcctgtatttgaagaac

SEQ ID NO: 486378 - DNA, 25 bp, Mus musculus
gaggagtctgaacacttatgctgaa

SEQ ID NO: 486379 - DNA, 25 bp, Mus musculus
gaggagtctgaagacttatgctgaa

SEQ ID NO: 486380 - DNA, 25 bp, Mus musculus
gaggagtctgctagaggagccactt

SEQ ID NO: 486381 - DNA, 25 bp, Mus musculus
gaggagtctgctcaagtgccgtctt

SEQ ID NO: 486382 - DNA, 25 bp, Mus musculus
gaggagtctgctgaagtgccgtctt

SEQ ID NO: 486383 - DNA, 25 bp, Mus musculus
gaggagtctgcttgaggagccactt

SEQ ID NO: 486384 - DNA, 25 bp, Mus musculus
gaggagtcttggctcccgcccttct

SEQ ID NO: 486385 - DNA, 25 bp, Mus musculus
gaggagtcttgggtcccgcccttct

SEQ ID NO: 486386 - DNA, 25 bp, Mus musculus
gaggagtgaagtccagatgggaaca

SEQ ID NO: 486387 - DNA, 25 bp, Mus musculus
gaggagtgaagtgcagatgggaaca

SEQ ID NO: 486388 - DNA, 25 bp, Mus musculus
gaggagtgaccaataagccaactgt

SEQ ID NO: 486389 - DNA, 25 bp, Mus musculus
gaggagtgaccattaagccaactgt

SEQ ID NO: 486390 - DNA, 25 bp, Mus musculus
gaggagtgactacttttgatccctt

SEQ ID NO: 486391 - DNA, 25 bp, Mus musculus
gaggagtgactagttttgatccctt

SEQ ID NO: 486392 - DNA, 25 bp, Mus musculus
gaggagtgactgcacacttgtattt

SEQ ID NO: 486393 - DNA, 25 bp, Mus musculus
gaggagtgactggacacttgtattt

SEQ ID NO: 486394 - DNA, 25 bp, Mus musculus
gaggagtgagcacacagcatcataa

SEQ ID NO: 486395 - DNA, 25 bp, Mus musculus
gaggagtgagcagacagcatcataa

SEQ ID NO: 486396 - DNA, 25 bp, Mus musculus
gaggagtgagccatctgctggtcat

SEQ ID NO: 486397 - DNA, 25 bp, Mus musculus
gaggagtgagccttctgctggtcat

SEQ ID NO: 486398 - DNA, 25 bp, Mus musculus
gaggagtgctatccagtcttcatat

SEQ ID NO: 486399 - DNA, 25 bp, Mus musculus
gaggagtgctatgcagtcttcatat

SEQ ID NO: 486400 - DNA, 25 bp, Mus musculus
gaggagtgctttatcgggagtaccc

SEQ ID NO: 486401 - DNA, 25 bp, Mus musculus
gaggagtgctttttcgggagtaccc

SEQ ID NO: 486402 - DNA, 25 bp, Mus musculus
gaggagtggactcacgtctaaatct

SEQ ID NO: 486403 - DNA, 25 bp, Mus musculus
gaggagtggactgacgtctaaatct

SEQ ID NO: 486404 - DNA, 25 bp, Mus musculus
gaggagtggagaattctggtcttaa

SEQ ID NO: 486405 - DNA, 25 bp, Mus musculus
gaggagtggagatttctggtcttaa

SEQ ID NO: 486406 - DNA, 25 bp, Mus musculus
gaggagtggcacatacccatttgcg

SEQ ID NO: 486407 - DNA, 25 bp, Mus musculus
gaggagtggcacttacccatttgcg

SEQ ID NO: 486408 - DNA, 25 bp, Mus musculus
gaggagtggctaacaacagtctctt

SEQ ID NO: 486409 - DNA, 25 bp, Mus musculus
gaggagtggctatcaacagtctctt

SEQ ID NO: 486410 - DNA, 25 bp, Mus musculus
gaggagtggctgcattttaatgccc

SEQ ID NO: 486411 - DNA, 25 bp, Mus musculus
gaggagtggctggattttaatgccc

SEQ ID NO: 486412 - DNA, 25 bp, Mus musculus
gaggagtggcttacaacacgcctgc

SEQ ID NO: 486413 - DNA, 25 bp, Mus musculus
gaggagtggctttcaacacgcctgc

SEQ ID NO: 486414 - DNA, 25 bp, Mus musculus
gaggagtgggtcactctctagccct

SEQ ID NO: 486415 - DNA, 25 bp, Mus musculus
gaggagtgggtctctctctagccct

SEQ ID NO: 486416 - DNA, 25 bp, Mus musculus
gaggagtgtcaaaccctatctacaa

SEQ ID NO: 486417 - DNA, 25 bp, Mus musculus
gaggagtgtcaatccctatctacaa

SEQ ID NO: 486418 - DNA, 25 bp, Mus musculus
gaggagtgtctgacccagaggcctc

SEQ ID NO: 486419 - DNA, 25 bp, Mus musculus
gaggagtgtctgtcccagaggcctc

SEQ ID NO: 486420 - DNA, 25 bp, Mus musculus
gaggagtgtgtgctattcacctacc

SEQ ID NO: 486421 - DNA, 25 bp, Mus musculus
gaggagtgtgtggtattcacctacc

SEQ ID NO: 486422 - DNA, 25 bp, Mus musculus
gaggagttactcacagtctggtgga

SEQ ID NO: 486423 - DNA, 25 bp, Mus musculus
gaggagttactcatgacatgtctaa

SEQ ID NO: 486424 - DNA, 25 bp, Mus musculus
gaggagttactctcagtctggtgga

SEQ ID NO: 486425 - DNA, 25 bp, Mus musculus
gaggagttactcttgacatgtctaa

SEQ ID NO: 486426 - DNA, 25 bp, Mus musculus
gaggagttagacctgtgcacacagt

SEQ ID NO: 486427 - DNA, 25 bp, Mus musculus
gaggagttagacgtgtgcacacagt

SEQ ID NO: 486428 - DNA, 25 bp, Mus musculus
gaggagttagcccttgcgacgacta

SEQ ID NO: 486429 - DNA, 25 bp, Mus musculus
gaggagttagccgttgcgacgacta

SEQ ID NO: 486430 - DNA, 25 bp, Mus musculus
gaggagttatgaagtcccatcccta

SEQ ID NO: 486431 - DNA, 25 bp, Mus musculus
gaggagttatgatgtcccatcccta

SEQ ID NO: 486432 - DNA, 25 bp, Mus musculus
gaggagttcatcaaaccaccattgt

SEQ ID NO: 486433 - DNA, 25 bp, Mus musculus
gaggagttcatctaaccaccattgt

SEQ ID NO: 486434 - DNA, 25 bp, Mus musculus
gaggagttcattctgggcgtttcta

SEQ ID NO: 486435 - DNA, 25 bp, Mus musculus
gaggagttcattgtgggcgtttcta

SEQ ID NO: 486436 - DNA, 25 bp, Mus musculus
gaggagttccacaaacacccacctg

SEQ ID NO: 486437 - DNA, 25 bp, Mus musculus
gaggagttccactaacacccacctg

SEQ ID NO: 486438 - DNA, 25 bp, Mus musculus
gaggagttccgcagatccgtgcgat

SEQ ID NO: 486439 - DNA, 25 bp, Mus musculus
gaggagttccgctgatccgtgcgat

SEQ ID NO: 486440 - DNA, 25 bp, Mus musculus
gaggagttccttccgatggtgataa

SEQ ID NO: 486441 - DNA, 25 bp, Mus musculus
gaggagttccttgcgatggtgataa

SEQ ID NO: 486442 - DNA, 25 bp, Mus musculus
gaggagttgagaaccgctgcactat

SEQ ID NO: 486443 - DNA, 25 bp, Mus musculus
gaggagttgagatccgctgcactat

SEQ ID NO: 486444 - DNA, 25 bp, Mus musculus
gaggagttgctcatatgcagcttcc

SEQ ID NO: 486445 - DNA, 25 bp, Mus musculus
gaggagttgctcttatgcagcttcc

SEQ ID NO: 486446 - DNA, 25 bp, Mus musculus
gaggagttgcttacacttcaagact

SEQ ID NO: 486447 - DNA, 25 bp, Mus musculus
gaggagttgctttcacttcaagact

SEQ ID NO: 486448 - DNA, 25 bp, Mus musculus
gaggagttggagatgctgctaaaaa

SEQ ID NO: 486449 - DNA, 25 bp, Mus musculus
gaggagttggagttgctgctaaaaa

SEQ ID NO: 486450 - DNA, 25 bp, Mus musculus
gaggagttggccagtcagtcatcat

SEQ ID NO: 486451 - DNA, 25 bp, Mus musculus
gaggagttggcctgtcagtcatcat

SEQ ID NO: 486452 - DNA, 25 bp, Mus musculus
gaggagttgtgcagatcctgcccac

SEQ ID NO: 486453 - DNA, 25 bp, Mus musculus
gaggagttgtgctgatcctgcccac

SEQ ID NO: 486454 - DNA, 25 bp, Mus musculus
gaggagtttcatcagccttcctact

SEQ ID NO: 486455 - DNA, 25 bp, Mus musculus
gaggagtttcatcctttcttgtttt

SEQ ID NO: 486456 - DNA, 25 bp, Mus musculus
gaggagtttcatgagccttcctact

SEQ ID NO: 486457 - DNA, 25 bp, Mus musculus
gaggagtttcatgctttcttgtttt

SEQ ID NO: 486458 - DNA, 25 bp, Mus musculus
gaggagtttgatacaaggtcagcct

SEQ ID NO: 486459 - DNA, 25 bp, Mus musculus
gaggagtttgattcaaggtcagcct

SEQ ID NO: 486460 - DNA, 25 bp, Mus musculus
gaggagtttgcaccggtttcagaac

SEQ ID NO: 486461 - DNA, 25 bp, Mus musculus
gaggagtttgcagcggtttcagaac

SEQ ID NO: 486462 - DNA, 25 bp, Mus musculus
gaggagtttgtcatagtcccactgt

SEQ ID NO: 486463 - DNA, 25 bp, Mus musculus
gaggagtttgtcattcgctgttaaa

SEQ ID NO: 486464 - DNA, 25 bp, Mus musculus
gaggagtttgtcttagtcccactgt

SEQ ID NO: 486465 - DNA, 25 bp, Mus musculus
gaggagtttgtctttcgctgttaaa

SEQ ID NO: 486466 - DNA, 25 bp, Mus musculus
gaggagtttgttcagcagttattac

SEQ ID NO: 486467 - DNA, 25 bp, Mus musculus
gaggagtttgttgagcagttattac

SEQ ID NO: 486468 - DNA, 25 bp, Mus musculus
gaggataaaaaccttgctctttaag

SEQ ID NO: 486469 - DNA, 25 bp, Mus musculus
gaggataaaaacgttgctctttaag

SEQ ID NO: 486470 - DNA, 25 bp, Mus musculus
gaggataaacacatcacagcttcaa

SEQ ID NO: 486471 - DNA, 25 bp, Mus musculus
gaggataaacacttcacagcttcaa

SEQ ID NO: 486472 - DNA, 25 bp, Mus musculus
gaggataaagacagggtatactccc

SEQ ID NO: 486473 - DNA, 25 bp, Mus musculus
gaggataaagactgggtatactccc

SEQ ID NO: 486474 - DNA, 25 bp, Mus musculus
gaggataaccttcgaatatattagt

SEQ ID NO: 486475 - DNA, 25 bp, Mus musculus
gaggataaccttggaatatattagt

SEQ ID NO: 486476 - DNA, 25 bp, Mus musculus
gaggataactggaccaaagacagac

SEQ ID NO: 486477 - DNA, 25 bp, Mus musculus
gaggataactggtccaaagacagac

SEQ ID NO: 486478 - DNA, 25 bp, Mus musculus
gaggataatccaaagcactgacagt

SEQ ID NO: 486479 - DNA, 25 bp, Mus musculus
gaggataatccatagcactgacagt

SEQ ID NO: 486480 - DNA, 25 bp, Mus musculus
gaggataatgggatgccagttcatc

SEQ ID NO: 486481 - DNA, 25 bp, Mus musculus
gaggataatgggttgccagttcatc

SEQ ID NO: 486482 - DNA, 25 bp, Mus musculus
gaggatacacacatgccactatgcc

SEQ ID NO: 486483 - DNA, 25 bp, Mus musculus
gaggatacacacttgccactatgcc

SEQ ID NO: 486484 - DNA, 25 bp, Mus musculus
gaggatacagctattgccagaggaa

SEQ ID NO: 486485 - DNA, 25 bp, Mus musculus
gaggatacagcttttgccagaggaa

SEQ ID NO: 486486 - DNA, 25 bp, Mus musculus
gaggatacagtcatcacagagtgca

SEQ ID NO: 486487 - DNA, 25 bp, Mus musculus
gaggatacagtcttcacagagtgca

SEQ ID NO: 486488 - DNA, 25 bp, Mus musculus
gaggatacagttcgcttattgagaa

SEQ ID NO: 486489 - DNA, 25 bp, Mus musculus
gaggatacagttggcttattgagaa

SEQ ID NO: 486490 - DNA, 25 bp, Mus musculus
gaggatacatatacgcattgccaaa

SEQ ID NO: 486491 - DNA, 25 bp, Mus musculus
gaggatacatattcgcattgccaaa

SEQ ID NO: 486492 - DNA, 25 bp, Mus musculus
gaggatacatggcaccctggatttc

SEQ ID NO: 486493 - DNA, 25 bp, Mus musculus
gaggatacatgggaccctggatttc

SEQ ID NO: 486494 - DNA, 25 bp, Mus musculus
gaggatacattcaacactgtgttaa

SEQ ID NO: 486495 - DNA, 25 bp, Mus musculus
gaggatacattctacactgtgttaa

SEQ ID NO: 486496 - DNA, 25 bp, Mus musculus
gaggataccgggatggcaccattta

SEQ ID NO: 486497 - DNA, 25 bp, Mus musculus
gaggataccgggttggcaccattta

SEQ ID NO: 486498 - DNA, 25 bp, Mus musculus
gaggatacctcacctggagtgttat

SEQ ID NO: 486499 - DNA, 25 bp, Mus musculus
gaggatacctcagctggagtgttat

SEQ ID NO: 486500 - DNA, 25 bp, Mus musculus
gaggatacctctctcggcctcttaa

SEQ ID NO: 486501 - DNA, 25 bp, Mus musculus
gaggatacctctgtcggcctcttaa

SEQ ID NO: 486502 - DNA, 25 bp, Mus musculus
gaggatacgtcgcagaccatcagct

SEQ ID NO: 486503 - DNA, 25 bp, Mus musculus
gaggatacgtcggagaccatcagct

SEQ ID NO: 486504 - DNA, 25 bp, Mus musculus
gaggatactttacagcctattccag

SEQ ID NO: 486505 - DNA, 25 bp, Mus musculus
gaggatactttagagcctattccag

SEQ ID NO: 486506 - DNA, 25 bp, Mus musculus
gaggatagatggatttctctggtat

SEQ ID NO: 486507 - DNA, 25 bp, Mus musculus
gaggatagatggttttctctggtat

SEQ ID NO: 486508 - DNA, 25 bp, Mus musculus
gaggatagatttcttctgcttgact

SEQ ID NO: 486509 - DNA, 25 bp, Mus musculus
gaggatagatttgttctgcttgact

SEQ ID NO: 486510 - DNA, 25 bp, Mus musculus
gaggatagcactattggattttaga

SEQ ID NO: 486511 - DNA, 25 bp, Mus musculus
gaggatagcacttttggattttaga

SEQ ID NO: 486512 - DNA, 25 bp, Mus musculus
gaggatagctcacttcttcgcaaga

SEQ ID NO: 486513 - DNA, 25 bp, Mus musculus
gaggatagctcagttcttcgcaaga

SEQ ID NO: 486514 - DNA, 25 bp, Mus musculus
gaggatagctctacaaagccaggcc

SEQ ID NO: 486515 - DNA, 25 bp, Mus musculus
gaggatagctcttcaaagccaggcc

SEQ ID NO: 486516 - DNA, 25 bp, Mus musculus
gaggatagtcttattgtactccatt

SEQ ID NO: 486517 - DNA, 25 bp, Mus musculus
gaggatagtctttttgtactccatt

SEQ ID NO: 486518 - DNA, 25 bp, Mus musculus
gaggatatcaatattcagagtgcat

SEQ ID NO: 486519 - DNA, 25 bp, Mus musculus
gaggatatcaattttcagagtgcat

SEQ ID NO: 486520 - DNA, 25 bp, Mus musculus
gaggatatcgaactccccaaggcca

SEQ ID NO: 486521 - DNA, 25 bp, Mus musculus
gaggatatcgaagtccccaaggcca

SEQ ID NO: 486522 - DNA, 25 bp, Mus musculus
gaggatatctatccctgagcttctc

SEQ ID NO: 486523 - DNA, 25 bp, Mus musculus
gaggatatctatgcctgagcttctc

SEQ ID NO: 486524 - DNA, 25 bp, Mus musculus
gaggatatgaaaccagaccacatta

SEQ ID NO: 486525 - DNA, 25 bp, Mus musculus
gaggatatgaaagcagaccacatta

SEQ ID NO: 486526 - DNA, 25 bp, Mus musculus
gaggatatggatactcccgattcta

SEQ ID NO: 486527 - DNA, 25 bp, Mus musculus
gaggatatggattctcccgattcta

SEQ ID NO: 486528 - DNA, 25 bp, Mus musculus
gaggatatggtcacatcgactcaga

SEQ ID NO: 486529 - DNA, 25 bp, Mus musculus
gaggatatggtctcatcgactcaga

SEQ ID NO: 486530 - DNA, 25 bp, Mus musculus
gaggatattaccatgctcttaaaca

SEQ ID NO: 486531 - DNA, 25 bp, Mus musculus
gaggatattaccttgctcttaaaca

SEQ ID NO: 486532 - DNA, 25 bp, Mus musculus
gaggatattcaaacacatggtgaac

SEQ ID NO: 486533 - DNA, 25 bp, Mus musculus
gaggatattcaatcacatggtgaac

SEQ ID NO: 486534 - DNA, 25 bp, Mus musculus
gaggatattcctactgtgccttcga

SEQ ID NO: 486535 - DNA, 25 bp, Mus musculus
gaggatattccttctgtgccttcga

SEQ ID NO: 486536 - DNA, 25 bp, Mus musculus
gaggatattgccagtgtcctaacca

SEQ ID NO: 486537 - DNA, 25 bp, Mus musculus
gaggatattgcctgtgtcctaacca

SEQ ID NO: 486538 - DNA, 25 bp, Mus musculus
gaggatatttgtcttctgggtttta

SEQ ID NO: 486539 - DNA, 25 bp, Mus musculus
gaggatatttgtgttctgggtttta

SEQ ID NO: 486540 - DNA, 25 bp, Mus musculus
gaggatcaacagatcccagttctgg

SEQ ID NO: 486541 - DNA, 25 bp, Mus musculus
gaggatcaacagttcccagttctgg

SEQ ID NO: 486542 - DNA, 25 bp, Mus musculus
gaggatcaacatactctcttggtaa

SEQ ID NO: 486543 - DNA, 25 bp, Mus musculus
gaggatcaacattctctcttggtaa

SEQ ID NO: 486544 - DNA, 25 bp, Mus musculus
gaggatcaagccaagccaggacctt

SEQ ID NO: 486545 - DNA, 25 bp, Mus musculus
gaggatcaagcctagccaggacctt

SEQ ID NO: 486546 - DNA, 25 bp, Mus musculus
gaggatcaagctatctccccgcagt

SEQ ID NO: 486547 - DNA, 25 bp, Mus musculus
gaggatcaagctttctccccgcagt

SEQ ID NO: 486548 - DNA, 25 bp, Mus musculus
gaggatcaaggaccttcctagcccc

SEQ ID NO: 486549 - DNA, 25 bp, Mus musculus
gaggatcaaggagcttcctagcccc

SEQ ID NO: 486550 - DNA, 25 bp, Mus musculus
gaggatcacaagacagcagcacaag

SEQ ID NO: 486551 - DNA, 25 bp, Mus musculus
gaggatcacaagtcagcagcacaag

SEQ ID NO: 486552 - DNA, 25 bp, Mus musculus
gaggatcacagactcagacctgcca

SEQ ID NO: 486553 - DNA, 25 bp, Mus musculus
gaggatcacagagtcagacctgcca

SEQ ID NO: 486554 - DNA, 25 bp, Mus musculus
gaggatcacagtaccttattgtgac

SEQ ID NO: 486555 - DNA, 25 bp, Mus musculus
gaggatcacagttccttattgtgac

SEQ ID NO: 486556 - DNA, 25 bp, Mus musculus
gaggatcaccctaccagagtcattt

SEQ ID NO: 486557 - DNA, 25 bp, Mus musculus
gaggatcacccttccagagtcattt

SEQ ID NO: 486558 - DNA, 25 bp, Mus musculus
gaggatcaccggaacgaattccact

SEQ ID NO: 486559 - DNA, 25 bp, Mus musculus
gaggatcaccggtacgaattccact

SEQ ID NO: 486560 - DNA, 25 bp, Mus musculus
gaggatcactgcaaccttgtgctag

SEQ ID NO: 486561 - DNA, 25 bp, Mus musculus
gaggatcactgctaccttgtgctag

SEQ ID NO: 486562 - DNA, 25 bp, Mus musculus
gaggatcagactaagtaggccacca

SEQ ID NO: 486563 - DNA, 25 bp, Mus musculus
gaggatcagacttagtaggccacca

SEQ ID NO: 486564 - DNA, 25 bp, Mus musculus
gaggatcagcccaaatcctctggcc

SEQ ID NO: 486565 - DNA, 25 bp, Mus musculus
gaggatcagccctaatcctctggcc

SEQ ID NO: 486566 - DNA, 25 bp, Mus musculus
gaggatcagcctcacttttatcata

SEQ ID NO: 486567 - DNA, 25 bp, Mus musculus
gaggatcagcctgacttttatcata

SEQ ID NO: 486568 - DNA, 25 bp, Mus musculus
gaggatcagtccagttatctaccac

SEQ ID NO: 486569 - DNA, 25 bp, Mus musculus
gaggatcagtcctgttatctaccac

SEQ ID NO: 486570 - DNA, 25 bp, Mus musculus
gaggatcagtgcacagatgaacgaa

SEQ ID NO: 486571 - DNA, 25 bp, Mus musculus
gaggatcagtgctcagatgaacgaa

SEQ ID NO: 486572 - DNA, 25 bp, Mus musculus
gaggatcatgctaccactgcatcag

SEQ ID NO: 486573 - DNA, 25 bp, Mus musculus
gaggatcatgcttccactgcatcag

SEQ ID NO: 486574 - DNA, 25 bp, Mus musculus
gaggatcatttcagtagccttgcct

SEQ ID NO: 486575 - DNA, 25 bp, Mus musculus
gaggatcatttctgtagccttgcct

SEQ ID NO: 486576 - DNA, 25 bp, Mus musculus
gaggatcattttactttggaaacac

SEQ ID NO: 486577 - DNA, 25 bp, Mus musculus
gaggatcatttttctttggaaacac

SEQ ID NO: 486578 - DNA, 25 bp, Mus musculus
gaggatccaaagcagctacttagga

SEQ ID NO: 486579 - DNA, 25 bp, Mus musculus
gaggatccaaaggagctacttagga

SEQ ID NO: 486580 - DNA, 25 bp, Mus musculus
gaggatccaagtatgcgtcccagtt

SEQ ID NO: 486581 - DNA, 25 bp, Mus musculus
gaggatccaagtttgcgtcccagtt

SEQ ID NO: 486582 - DNA, 25 bp, Mus musculus
gaggatccaattcgcacctttaggt

SEQ ID NO: 486583 - DNA, 25 bp, Mus musculus
gaggatccaattggcacctttaggt

SEQ ID NO: 486584 - DNA, 25 bp, Mus musculus
gaggatccactcagacgaacagtat

SEQ ID NO: 486585 - DNA, 25 bp, Mus musculus
gaggatccactctgacgaacagtat

SEQ ID NO: 486586 - DNA, 25 bp, Mus musculus
gaggatccagaaatcagttctcagc

SEQ ID NO: 486587 - DNA, 25 bp, Mus musculus
gaggatccagaattcagttctcagc

SEQ ID NO: 486588 - DNA, 25 bp, Mus musculus
gaggatccagctccagtgtcaggac

SEQ ID NO: 486589 - DNA, 25 bp, Mus musculus
gaggatccagctgcagtgtcaggac

SEQ ID NO: 486590 - DNA, 25 bp, Mus musculus
gaggatcccaagaagttccccttag

SEQ ID NO: 486591 - DNA, 25 bp, Mus musculus
gaggatcccaagtagttccccttag

SEQ ID NO: 486592 - DNA, 25 bp, Mus musculus
gaggatcccaggaagcatagcctat

SEQ ID NO: 486593 - DNA, 25 bp, Mus musculus
gaggatcccaggataaggccagcct

SEQ ID NO: 486594 - DNA, 25 bp, Mus musculus
gaggatcccaggtagcatagcctat

SEQ ID NO: 486595 - DNA, 25 bp, Mus musculus
gaggatcccaggttaaggccagcct

SEQ ID NO: 486596 - DNA, 25 bp, Mus musculus
gaggatcccatactttaggccatga

SEQ ID NO: 486597 - DNA, 25 bp, Mus musculus
gaggatcccatagtttaggccatga

SEQ ID NO: 486598 - DNA, 25 bp, Mus musculus
gaggatcccctaaattctggcgatg

SEQ ID NO: 486599 - DNA, 25 bp, Mus musculus
gaggatcccctatattctggcgatg

SEQ ID NO: 486600 - DNA, 25 bp, Mus musculus
gaggatccgagacctcattgctcaa

SEQ ID NO: 486601 - DNA, 25 bp, Mus musculus
gaggatccgagagctcattgctcaa

SEQ ID NO: 486602 - DNA, 25 bp, Mus musculus
gaggatccggaacgagttccccaag

SEQ ID NO: 486603 - DNA, 25 bp, Mus musculus
gaggatccggaaggagttccccaag

SEQ ID NO: 486604 - DNA, 25 bp, Mus musculus
gaggatccgggcaattctgaatgat

SEQ ID NO: 486605 - DNA, 25 bp, Mus musculus
gaggatccgggctattctgaatgat

SEQ ID NO: 486606 - DNA, 25 bp, Mus musculus
gaggatcctaaacatcgcccgtctg

SEQ ID NO: 486607 - DNA, 25 bp, Mus musculus
gaggatcctaaagatcgcccgtctg

SEQ ID NO: 486608 - DNA, 25 bp, Mus musculus
gaggatcctgacaatgggtagcaag

SEQ ID NO: 486609 - DNA, 25 bp, Mus musculus
gaggatcctgactatgggtagcaag

SEQ ID NO: 486610 - DNA, 25 bp, Mus musculus
gaggatcctgtactgatgatgtcac

SEQ ID NO: 486611 - DNA, 25 bp, Mus musculus
gaggatcctgtagtgatgatgtcac

SEQ ID NO: 486612 - DNA, 25 bp, Mus musculus
gaggatcctgttagcatccgttgct

SEQ ID NO: 486613 - DNA, 25 bp, Mus musculus
gaggatcctgttcatgtagttgtat

SEQ ID NO: 486614 - DNA, 25 bp, Mus musculus
gaggatcctgttgatgtagttgtat

SEQ ID NO: 486615 - DNA, 25 bp, Mus musculus
gaggatcctgtttgcatccgttgct

SEQ ID NO: 486616 - DNA, 25 bp, Mus musculus
gaggatccttccataacagctttaa

SEQ ID NO: 486617 - DNA, 25 bp, Mus musculus
gaggatccttccttaacagctttaa

SEQ ID NO: 486618 - DNA, 25 bp, Mus musculus
gaggatccttgacgctaggcagcat

SEQ ID NO: 486619 - DNA, 25 bp, Mus musculus
gaggatccttgaggctaggcagcat

SEQ ID NO: 486620 - DNA, 25 bp, Mus musculus
gaggatccttttatggagcccagac

SEQ ID NO: 486621 - DNA, 25 bp, Mus musculus
gaggatccttttttggagcccagac

SEQ ID NO: 486622 - DNA, 25 bp, Mus musculus
gaggatcgaccactccgaatttgaa

SEQ ID NO: 486623 - DNA, 25 bp, Mus musculus
gaggatcgaccagtccgaatttgaa

SEQ ID NO: 486624 - DNA, 25 bp, Mus musculus
gaggatcgtcctcatggtatctaat

SEQ ID NO: 486625 - DNA, 25 bp, Mus musculus
gaggatcgtcctgatggtatctaat

SEQ ID NO: 486626 - DNA, 25 bp, Mus musculus
gaggatcgtgagaaacccacttaca

SEQ ID NO: 486627 - DNA, 25 bp, Mus musculus
gaggatcgtgagtaacccacttaca

SEQ ID NO: 486628 - DNA, 25 bp, Mus musculus
gaggatcgttaacgccgcacagcaa

SEQ ID NO: 486629 - DNA, 25 bp, Mus musculus
gaggatcgttaaggccgcacagcaa

SEQ ID NO: 486630 - DNA, 25 bp, Mus musculus
gaggatctaaacatgctgtagcatt

SEQ ID NO: 486631 - DNA, 25 bp, Mus musculus
gaggatctaaacttgctgtagcatt

SEQ ID NO: 486632 - DNA, 25 bp, Mus musculus
gaggatctaacactgtgtagtccag

SEQ ID NO: 486633 - DNA, 25 bp, Mus musculus
gaggatctaacagtgtgtagtccag

SEQ ID NO: 486634 - DNA, 25 bp, Mus musculus
gaggatctaatgatctcttctggct

SEQ ID NO: 486635 - DNA, 25 bp, Mus musculus
gaggatctaatgttctcttctggct

SEQ ID NO: 486636 - DNA, 25 bp, Mus musculus
gaggatctaattctcagcgtcttcc

SEQ ID NO: 486637 - DNA, 25 bp, Mus musculus
gaggatctaattgtcagcgtcttcc

SEQ ID NO: 486638 - DNA, 25 bp, Mus musculus
gaggatctacatccatgtgacgtca

SEQ ID NO: 486639 - DNA, 25 bp, Mus musculus
gaggatctacatgcatgtgacgtca

SEQ ID NO: 486640 - DNA, 25 bp, Mus musculus
gaggatctagctactcttctcagag

SEQ ID NO: 486641 - DNA, 25 bp, Mus musculus
gaggatctagcttctcttctcagag

SEQ ID NO: 486642 - DNA, 25 bp, Mus musculus
gaggatctcaaaccacagcccaagc

SEQ ID NO: 486643 - DNA, 25 bp, Mus musculus
gaggatctcaaagcacagcccaagc

SEQ ID NO: 486644 - DNA, 25 bp, Mus musculus
gaggatctcaagatctaaacgaagt

SEQ ID NO: 486645 - DNA, 25 bp, Mus musculus
gaggatctcaagttctaaacgaagt

SEQ ID NO: 486646 - DNA, 25 bp, Mus musculus
gaggatctcagaattaatgctctct

SEQ ID NO: 486647 - DNA, 25 bp, Mus musculus
gaggatctcagatttaatgctctct

SEQ ID NO: 486648 - DNA, 25 bp, Mus musculus
gaggatctcagtcccgatgtcgatg

SEQ ID NO: 486649 - DNA, 25 bp, Mus musculus
gaggatctcagtgccgatgtcgatg

SEQ ID NO: 486650 - DNA, 25 bp, Mus musculus
gaggatctccctctaaatatttccc

SEQ ID NO: 486651 - DNA, 25 bp, Mus musculus
gaggatctccctgtaaatatttccc

SEQ ID NO: 486652 - DNA, 25 bp, Mus musculus
gaggatctccttctcttgaatatgt

SEQ ID NO: 486653 - DNA, 25 bp, Mus musculus
gaggatctccttgtcttgaatatgt

SEQ ID NO: 486654 - DNA, 25 bp, Mus musculus
gaggatctcgagactaaggttagcc

SEQ ID NO: 486655 - DNA, 25 bp, Mus musculus
gaggatctcgagtctaaggttagcc

SEQ ID NO: 486656 - DNA, 25 bp, Mus musculus
gaggatctctcaacgtctagagggc

SEQ ID NO: 486657 - DNA, 25 bp, Mus musculus
gaggatctctcatcgtctagagggc

SEQ ID NO: 486658 - DNA, 25 bp, Mus musculus
gaggatctcttacagtcaatgtcat

SEQ ID NO: 486659 - DNA, 25 bp, Mus musculus
gaggatctcttagagtcaatgtcat

SEQ ID NO: 486660 - DNA, 25 bp, Mus musculus
gaggatctgcagctaccgcattaca

SEQ ID NO: 486661 - DNA, 25 bp, Mus musculus
gaggatctgcaggtaccgcattaca

SEQ ID NO: 486662 - DNA, 25 bp, Mus musculus
gaggatctggaactcaaacgtgctt

SEQ ID NO: 486663 - DNA, 25 bp, Mus musculus
gaggatctggaagtcaaacgtgctt

SEQ ID NO: 486664 - DNA, 25 bp, Mus musculus
gaggatctggctactgggaaacagt

SEQ ID NO: 486665 - DNA, 25 bp, Mus musculus
gaggatctggcttctgggaaacagt

SEQ ID NO: 486666 - DNA, 25 bp, Mus musculus
gaggatcttactatcaccagcaggt

SEQ ID NO: 486667 - DNA, 25 bp, Mus musculus
gaggatcttactttcaccagcaggt

SEQ ID NO: 486668 - DNA, 25 bp, Mus musculus
gaggatcttattatttgatccacaa

SEQ ID NO: 486669 - DNA, 25 bp, Mus musculus
gaggatcttattttttgatccacaa

SEQ ID NO: 486670 - DNA, 25 bp, Mus musculus
gaggatcttcggcacacctttgcag

SEQ ID NO: 486671 - DNA, 25 bp, Mus musculus
gaggatcttcgggacacctttgcag

SEQ ID NO: 486672 - DNA, 25 bp, Mus musculus
gaggatcttggcagactaattcaaa

SEQ ID NO: 486673 - DNA, 25 bp, Mus musculus
gaggatcttggctgactaattcaaa

SEQ ID NO: 486674 - DNA, 25 bp, Mus musculus
gaggatcttgtgagtccaaagccag

SEQ ID NO: 486675 - DNA, 25 bp, Mus musculus
gaggatcttgtgtgtccaaagccag

SEQ ID NO: 486676 - DNA, 25 bp, Mus musculus
gaggatctttttaagtggtgaatac

SEQ ID NO: 486677 - DNA, 25 bp, Mus musculus
gaggatctttttctatgacgcagag

SEQ ID NO: 486678 - DNA, 25 bp, Mus musculus
gaggatctttttctcagtgacagcc

SEQ ID NO: 486679 - DNA, 25 bp, Mus musculus
gaggatctttttgtatgacgcagag

SEQ ID NO: 486680 - DNA, 25 bp, Mus musculus
gaggatctttttgtcagtgacagcc

SEQ ID NO: 486681 - DNA, 25 bp, Mus musculus
gaggatcttttttagtggtgaatac

SEQ ID NO: 486682 - DNA, 25 bp, Mus musculus
gaggatgaaagacagcccgcacaca

SEQ ID NO: 486683 - DNA, 25 bp, Mus musculus
gaggatgaaagagagcccgcacaca

SEQ ID NO: 486684 - DNA, 25 bp, Mus musculus
gaggatgaacacctagagctcagag

SEQ ID NO: 486685 - DNA, 25 bp, Mus musculus
gaggatgaacacgtagagctcagag

SEQ ID NO: 486686 - DNA, 25 bp, Mus musculus
gaggatgaacttagtcccctacttt

SEQ ID NO: 486687 - DNA, 25 bp, Mus musculus
gaggatgaactttgtcccctacttt

SEQ ID NO: 486688 - DNA, 25 bp, Mus musculus
gaggatgaagcacgtgctgcccggg

SEQ ID NO: 486689 - DNA, 25 bp, Mus musculus
gaggatgaagcaggtgctgcccggg

SEQ ID NO: 486690 - DNA, 25 bp, Mus musculus
gaggatgaagctaactgctgttcta

SEQ ID NO: 486691 - DNA, 25 bp, Mus musculus
gaggatgaagcttactgctgttcta

SEQ ID NO: 486692 - DNA, 25 bp, Mus musculus
gaggatgaatcccttaaccagcctg

SEQ ID NO: 486693 - DNA, 25 bp, Mus musculus
gaggatgaatccgttaaccagcctg

SEQ ID NO: 486694 - DNA, 25 bp, Mus musculus
gaggatgaatctctcgccccagact

SEQ ID NO: 486695 - DNA, 25 bp, Mus musculus
gaggatgaatctgtcgccccagact

SEQ ID NO: 486696 - DNA, 25 bp, Mus musculus
gaggatgacaacagtaccccgtggt

SEQ ID NO: 486697 - DNA, 25 bp, Mus musculus
gaggatgacaactgtaccccgtggt

SEQ ID NO: 486698 - DNA, 25 bp, Mus musculus
gaggatgacaccctgccttctgaca

SEQ ID NO: 486699 - DNA, 25 bp, Mus musculus
gaggatgacaccgtgccttctgaca

SEQ ID NO: 486700 - DNA, 25 bp, Mus musculus
gaggatgacaggcacgttgcaccta

SEQ ID NO: 486701 - DNA, 25 bp, Mus musculus
gaggatgacagggacgttgcaccta

SEQ ID NO: 486702 - DNA, 25 bp, Mus musculus
gaggatgacccacactactgtatat

SEQ ID NO: 486703 - DNA, 25 bp, Mus musculus
gaggatgacccagactactgtatat

SEQ ID NO: 486704 - DNA, 25 bp, Mus musculus
gaggatgacctcatcccttgcacgt

SEQ ID NO: 486705 - DNA, 25 bp, Mus musculus
gaggatgacctcttcccttgcacgt

SEQ ID NO: 486706 - DNA, 25 bp, Mus musculus
gaggatgaccttcaagctccggatc

SEQ ID NO: 486707 - DNA, 25 bp, Mus musculus
gaggatgaccttgaagctccggatc

SEQ ID NO: 486708 - DNA, 25 bp, Mus musculus
gaggatgactcacaggttgcccctg

SEQ ID NO: 486709 - DNA, 25 bp, Mus musculus
gaggatgactcagaggttgcccctg

SEQ ID NO: 486710 - DNA, 25 bp, Mus musculus
gaggatgagcctagctgaagagctt

SEQ ID NO: 486711 - DNA, 25 bp, Mus musculus
gaggatgagccttgctgaagagctt

SEQ ID NO: 486712 - DNA, 25 bp, Mus musculus
gaggatgataccactaatcagacca

SEQ ID NO: 486713 - DNA, 25 bp, Mus musculus
gaggatgatacctctaatcagacca

SEQ ID NO: 486714 - DNA, 25 bp, Mus musculus
gaggatgatattcgcgctcttcgag

SEQ ID NO: 486715 - DNA, 25 bp, Mus musculus
gaggatgatattggcgctcttcgag

SEQ ID NO: 486716 - DNA, 25 bp, Mus musculus
gaggatgatctaactccaagccttt

SEQ ID NO: 486717 - DNA, 25 bp, Mus musculus
gaggatgatctatctccaagccttt

SEQ ID NO: 486718 - DNA, 25 bp, Mus musculus
gaggatgatgtgagcctgcattctt

SEQ ID NO: 486719 - DNA, 25 bp, Mus musculus
gaggatgatgtgtgcctgcattctt

SEQ ID NO: 486720 - DNA, 25 bp, Mus musculus
gaggatgcaaacaagatttctcata

SEQ ID NO: 486721 - DNA, 25 bp, Mus musculus
gaggatgcaaactagatttctcata

SEQ ID NO: 486722 - DNA, 25 bp, Mus musculus
gaggatgcaattctccagacttatt

SEQ ID NO: 486723 - DNA, 25 bp, Mus musculus
gaggatgcaattgtccagacttatt

SEQ ID NO: 486724 - DNA, 25 bp, Mus musculus
gaggatgcacctataaatctgcaga

SEQ ID NO: 486725 - DNA, 25 bp, Mus musculus
gaggatgcacctttaaatctgcaga

SEQ ID NO: 486726 - DNA, 25 bp, Mus musculus
gaggatgcacttaaactccagcggc

SEQ ID NO: 486727 - DNA, 25 bp, Mus musculus
gaggatgcactttaactccagcggc

SEQ ID NO: 486728 - DNA, 25 bp, Mus musculus
gaggatgcagatcaagacattgata

SEQ ID NO: 486729 - DNA, 25 bp, Mus musculus
gaggatgcagatgaagacattgata

SEQ ID NO: 486730 - DNA, 25 bp, Mus musculus
gaggatgcagcaccccattcaaaac

SEQ ID NO: 486731 - DNA, 25 bp, Mus musculus
gaggatgcagcagcccattcaaaac

SEQ ID NO: 486732 - DNA, 25 bp, Mus musculus
gaggatgccaataactttctacagt

SEQ ID NO: 486733 - DNA, 25 bp, Mus musculus
gaggatgccaattactttctacagt

SEQ ID NO: 486734 - DNA, 25 bp, Mus musculus
gaggatgccactatcctgactatag

SEQ ID NO: 486735 - DNA, 25 bp, Mus musculus
gaggatgccactttcctgactatag

SEQ ID NO: 486736 - DNA, 25 bp, Mus musculus
gaggatgccagactcaccagttgtc

SEQ ID NO: 486737 - DNA, 25 bp, Mus musculus
gaggatgccagagtcaccagttgtc

SEQ ID NO: 486738 - DNA, 25 bp, Mus musculus
gaggatgccagcaccaggtacaagc

SEQ ID NO: 486739 - DNA, 25 bp, Mus musculus
gaggatgccagcctttctacaatca

SEQ ID NO: 486740 - DNA, 25 bp, Mus musculus
gaggatgccagcgtttctacaatca

SEQ ID NO: 486741 - DNA, 25 bp, Mus musculus
gaggatgccagctccaggtacaagc

SEQ ID NO: 486742 - DNA, 25 bp, Mus musculus
gaggatgcccatagaagcctggcac

SEQ ID NO: 486743 - DNA, 25 bp, Mus musculus
gaggatgcccatctgtaggttttta

SEQ ID NO: 486744 - DNA, 25 bp, Mus musculus
gaggatgcccatgtgtaggttttta

SEQ ID NO: 486745 - DNA, 25 bp, Mus musculus
gaggatgcccattgaagcctggcac

SEQ ID NO: 486746 - DNA, 25 bp, Mus musculus
gaggatgccctaagccccttgtaga

SEQ ID NO: 486747 - DNA, 25 bp, Mus musculus
gaggatgccctatgccccttgtaga

SEQ ID NO: 486748 - DNA, 25 bp, Mus musculus
gaggatgcctaacggaaccaaccaa

SEQ ID NO: 486749 - DNA, 25 bp, Mus musculus
gaggatgcctaagggaaccaaccaa

SEQ ID NO: 486750 - DNA, 25 bp, Mus musculus
gaggatgcctccacagtcccaaagg

SEQ ID NO: 486751 - DNA, 25 bp, Mus musculus
gaggatgcctcctcagtcccaaagg

SEQ ID NO: 486752 - DNA, 25 bp, Mus musculus
gaggatgccttcaacaaatgggaga

SEQ ID NO: 486753 - DNA, 25 bp, Mus musculus
gaggatgccttctacaaatgggaga

SEQ ID NO: 486754 - DNA, 25 bp, Mus musculus
gaggatgctaatccttttcttaaca

SEQ ID NO: 486755 - DNA, 25 bp, Mus musculus
gaggatgctaatgcttttcttaaca

SEQ ID NO: 486756 - DNA, 25 bp, Mus musculus
gaggatgctagaaccacaaatgttt

SEQ ID NO: 486757 - DNA, 25 bp, Mus musculus
gaggatgctagatccacaaatgttt

SEQ ID NO: 486758 - DNA, 25 bp, Mus musculus
gaggatgctcacacttatgcaacaa

SEQ ID NO: 486759 - DNA, 25 bp, Mus musculus
gaggatgctcactcttatgcaacaa

SEQ ID NO: 486760 - DNA, 25 bp, Mus musculus
gaggatgctcatcggatctggctct

SEQ ID NO: 486761 - DNA, 25 bp, Mus musculus
gaggatgctcatgggatctggctct

SEQ ID NO: 486762 - DNA, 25 bp, Mus musculus
gaggatgctcctctgttggactgac

SEQ ID NO: 486763 - DNA, 25 bp, Mus musculus
gaggatgctcctgtgttggactgac

SEQ ID NO: 486764 - DNA, 25 bp, Mus musculus
gaggatgctctactggttgtttcca

SEQ ID NO: 486765 - DNA, 25 bp, Mus musculus
gaggatgctctagtggttgtttcca

SEQ ID NO: 486766 - DNA, 25 bp, Mus musculus
gaggatgctgatctctcgaaacctg

SEQ ID NO: 486767 - DNA, 25 bp, Mus musculus
gaggatgctgatgtctcgaaacctg

SEQ ID NO: 486768 - DNA, 25 bp, Mus musculus
gaggatgctggcaacttaaaggtcc

SEQ ID NO: 486769 - DNA, 25 bp, Mus musculus
gaggatgctggctacttaaaggtcc

SEQ ID NO: 486770 - DNA, 25 bp, Mus musculus
gaggatgcttccagagatgcttgat

SEQ ID NO: 486771 - DNA, 25 bp, Mus musculus
gaggatgcttcctgagatgcttgat

SEQ ID NO: 486772 - DNA, 25 bp, Mus musculus
gaggatgcttgaactgcttttctga

SEQ ID NO: 486773 - DNA, 25 bp, Mus musculus
gaggatgcttgatctgcttttctga

SEQ ID NO: 486774 - DNA, 25 bp, Mus musculus
gaggatgcttggaaccttaatggga

SEQ ID NO: 486775 - DNA, 25 bp, Mus musculus
gaggatgcttggtaccttaatggga

SEQ ID NO: 486776 - DNA, 25 bp, Mus musculus
gaggatgcttttatctgttttatgc

SEQ ID NO: 486777 - DNA, 25 bp, Mus musculus
gaggatgcttttcactttgtcagtt

SEQ ID NO: 486778 - DNA, 25 bp, Mus musculus
gaggatgcttttgactttgtcagtt

SEQ ID NO: 486779 - DNA, 25 bp, Mus musculus
gaggatgcttttttctgttttatgc

SEQ ID NO: 486780 - DNA, 25 bp, Mus musculus
gaggatggcaagactccaactcagc

SEQ ID NO: 486781 - DNA, 25 bp, Mus musculus
gaggatggcaagtctccaactcagc

SEQ ID NO: 486782 - DNA, 25 bp, Mus musculus
gaggatggcacaagatcttcacagc

SEQ ID NO: 486783 - DNA, 25 bp, Mus musculus
gaggatggcacatgatcttcacagc

SEQ ID NO: 486784 - DNA, 25 bp, Mus musculus
gaggatggcagcactgtcgctgaca

SEQ ID NO: 486785 - DNA, 25 bp, Mus musculus
gaggatggcagctctgtcgctgaca

SEQ ID NO: 486786 - DNA, 25 bp, Mus musculus
gaggatggcatcaagaacttcttca

SEQ ID NO: 486787 - DNA, 25 bp, Mus musculus
gaggatggcatctagaacttcttca

SEQ ID NO: 486788 - DNA, 25 bp, Mus musculus
gaggatggcatgaccagctagcccc

SEQ ID NO: 486789 - DNA, 25 bp, Mus musculus
gaggatggcatgtccagctagcccc

SEQ ID NO: 486790 - DNA, 25 bp, Mus musculus
gaggatggcctgcaagtctttcacc

SEQ ID NO: 486791 - DNA, 25 bp, Mus musculus
gaggatggcctggaagtctttcacc

SEQ ID NO: 486792 - DNA, 25 bp, Mus musculus
gaggatggcgctcgtcttactacga

SEQ ID NO: 486793 - DNA, 25 bp, Mus musculus
gaggatggcgctggtcttactacga

SEQ ID NO: 486794 - DNA, 25 bp, Mus musculus
gaggatggctaactcgccaacccta

SEQ ID NO: 486795 - DNA, 25 bp, Mus musculus
gaggatggctaagtcgccaacccta

SEQ ID NO: 486796 - DNA, 25 bp, Mus musculus
gaggatgggcctcccttctttctca

SEQ ID NO: 486797 - DNA, 25 bp, Mus musculus
gaggatgggcctgccttctttctca

SEQ ID NO: 486798 - DNA, 25 bp, Mus musculus
gaggatgggttcaggcattcagtat

SEQ ID NO: 486799 - DNA, 25 bp, Mus musculus
gaggatgggttctggcattcagtat

SEQ ID NO: 486800 - DNA, 25 bp, Mus musculus
gaggatggttccaataacattcgaa

SEQ ID NO: 486801 - DNA, 25 bp, Mus musculus
gaggatggttcctataacattcgaa

SEQ ID NO: 486802 - DNA, 25 bp, Mus musculus
gaggatgtaattcggctataccaac

SEQ ID NO: 486803 - DNA, 25 bp, Mus musculus
gaggatgtaattgggctataccaac

SEQ ID NO: 486804 - DNA, 25 bp, Mus musculus
gaggatgtacacagctgagactctg

SEQ ID NO: 486805 - DNA, 25 bp, Mus musculus
gaggatgtacactgctgagactctg

SEQ ID NO: 486806 - DNA, 25 bp, Mus musculus
gaggatgtatagatccccgaggaca

SEQ ID NO: 486807 - DNA, 25 bp, Mus musculus
gaggatgtatagttccccgaggaca

SEQ ID NO: 486808 - DNA, 25 bp, Mus musculus
gaggatgtatccatgtcttttatct

SEQ ID NO: 486809 - DNA, 25 bp, Mus musculus
gaggatgtatccttgtcttttatct

SEQ ID NO: 486810 - DNA, 25 bp, Mus musculus
gaggatgtatctcgacccatgtccc

SEQ ID NO: 486811 - DNA, 25 bp, Mus musculus
gaggatgtatctggacccatgtccc

SEQ ID NO: 486812 - DNA, 25 bp, Mus musculus
gaggatgtcaacagacccatgcctg

SEQ ID NO: 486813 - DNA, 25 bp, Mus musculus
gaggatgtcaactgacccatgcctg

SEQ ID NO: 486814 - DNA, 25 bp, Mus musculus
gaggatgtcaccagagctcatttgg

SEQ ID NO: 486815 - DNA, 25 bp, Mus musculus
gaggatgtcacctgagctcatttgg

SEQ ID NO: 486816 - DNA, 25 bp, Mus musculus
gaggatgtcagacgaggccccacaa

SEQ ID NO: 486817 - DNA, 25 bp, Mus musculus
gaggatgtcagaggaggccccacaa

SEQ ID NO: 486818 - DNA, 25 bp, Mus musculus
gaggatgtcagcacagcactacagt

SEQ ID NO: 486819 - DNA, 25 bp, Mus musculus
gaggatgtcagctcagcactacagt

SEQ ID NO: 486820 - DNA, 25 bp, Mus musculus
gaggatgtcctcagacttccacata

SEQ ID NO: 486821 - DNA, 25 bp, Mus musculus
gaggatgtcctctgacttccacata

SEQ ID NO: 486822 - DNA, 25 bp, Mus musculus
gaggatgtctgcacagcactgctaa

SEQ ID NO: 486823 - DNA, 25 bp, Mus musculus
gaggatgtctgctcagcactgctaa

SEQ ID NO: 486824 - DNA, 25 bp, Mus musculus
gaggatgtcttccatgatcagtcat

SEQ ID NO: 486825 - DNA, 25 bp, Mus musculus
gaggatgtcttcgatgatcagtcat

SEQ ID NO: 486826 - DNA, 25 bp, Mus musculus
gaggatgtgcagatggcctaccgct

SEQ ID NO: 486827 - DNA, 25 bp, Mus musculus
gaggatgtgcagttggcctaccgct

SEQ ID NO: 486828 - DNA, 25 bp, Mus musculus
gaggatgtgcctagccttatagact

SEQ ID NO: 486829 - DNA, 25 bp, Mus musculus
gaggatgtgccttgccttatagact

SEQ ID NO: 486830 - DNA, 25 bp, Mus musculus
gaggatgtgctaagaggttgcaaac

SEQ ID NO: 486831 - DNA, 25 bp, Mus musculus
gaggatgtgctatgaggttgcaaac

SEQ ID NO: 486832 - DNA, 25 bp, Mus musculus
gaggatgtggatagccgatcttccc

SEQ ID NO: 486833 - DNA, 25 bp, Mus musculus
gaggatgtggattgccgatcttccc

SEQ ID NO: 486834 - DNA, 25 bp, Mus musculus
gaggatgtggccattgacctgtcca

SEQ ID NO: 486835 - DNA, 25 bp, Mus musculus
gaggatgtggcctttgacctgtcca

SEQ ID NO: 486836 - DNA, 25 bp, Mus musculus
gaggatgtggtcagagcccttccac

SEQ ID NO: 486837 - DNA, 25 bp, Mus musculus
gaggatgtggtctgagcccttccac

SEQ ID NO: 486838 - DNA, 25 bp, Mus musculus
gaggatgttaggcttcgtctttcac

SEQ ID NO: 486839 - DNA, 25 bp, Mus musculus
gaggatgttagggttcgtctttcac

SEQ ID NO: 486840 - DNA, 25 bp, Mus musculus
gaggatgttgcaatttgtgtgaccg

SEQ ID NO: 486841 - DNA, 25 bp, Mus musculus
gaggatgttgcattttgtgtgaccg

SEQ ID NO: 486842 - DNA, 25 bp, Mus musculus
gaggatgttgtacacacgccgtaac

SEQ ID NO: 486843 - DNA, 25 bp, Mus musculus
gaggatgttgtagacacgccgtaac

SEQ ID NO: 486844 - DNA, 25 bp, Mus musculus
gaggatgttgtccacctctggaagc

SEQ ID NO: 486845 - DNA, 25 bp, Mus musculus
gaggatgttgtccatactgtattta

SEQ ID NO: 486846 - DNA, 25 bp, Mus musculus
gaggatgttgtcgacctctggaagc

SEQ ID NO: 486847 - DNA, 25 bp, Mus musculus
gaggatgttgtcgatactgtattta

SEQ ID NO: 486848 - DNA, 25 bp, Mus musculus
gaggatgtttacaatccacacatta

SEQ ID NO: 486849 - DNA, 25 bp, Mus musculus
gaggatgtttactatccacacatta

SEQ ID NO: 486850 - DNA, 25 bp, Mus musculus
gaggatgtttcactcaatcatgcat

SEQ ID NO: 486851 - DNA, 25 bp, Mus musculus
gaggatgtttcagtcaatcatgcat

SEQ ID NO: 486852 - DNA, 25 bp, Mus musculus
gaggatgtttctaagtacccagacc

SEQ ID NO: 486853 - DNA, 25 bp, Mus musculus
gaggatgtttcttagtacccagacc

SEQ ID NO: 486854 - DNA, 25 bp, Mus musculus
gaggatgttttcagctcgtgaggaa

SEQ ID NO: 486855 - DNA, 25 bp, Mus musculus
gaggatgttttctgctcgtgaggaa

SEQ ID NO: 486856 - DNA, 25 bp, Mus musculus
gaggattaaggccttcatagtaatt

SEQ ID NO: 486857 - DNA, 25 bp, Mus musculus
gaggattaaggcgttcatagtaatt

SEQ ID NO: 486858 - DNA, 25 bp, Mus musculus
gaggattaattaatacttggctgaa

SEQ ID NO: 486859 - DNA, 25 bp, Mus musculus
gaggattaattattacttggctgaa

SEQ ID NO: 486860 - DNA, 25 bp, Mus musculus
gaggattacaggatccagcctgcct

SEQ ID NO: 486861 - DNA, 25 bp, Mus musculus
gaggattacaggttccagcctgcct

SEQ ID NO: 486862 - DNA, 25 bp, Mus musculus
gaggattacatcctgctgaccgttc

SEQ ID NO: 486863 - DNA, 25 bp, Mus musculus
gaggattacatcgtgctgaccgttc

SEQ ID NO: 486864 - DNA, 25 bp, Mus musculus
gaggattacgtcagtgtggctgctt

SEQ ID NO: 486865 - DNA, 25 bp, Mus musculus
gaggattacgtctgtgtggctgctt

SEQ ID NO: 486866 - DNA, 25 bp, Mus musculus
gaggattatcacaccggtagcagtt

SEQ ID NO: 486867 - DNA, 25 bp, Mus musculus
gaggattatcactccggtagcagtt

SEQ ID NO: 486868 - DNA, 25 bp, Mus musculus
gaggattatcagcttcatggagtga

SEQ ID NO: 486869 - DNA, 25 bp, Mus musculus
gaggattatcaggttcatggagtga

SEQ ID NO: 486870 - DNA, 25 bp, Mus musculus
gaggattatcatacactccggattt

SEQ ID NO: 486871 - DNA, 25 bp, Mus musculus
gaggattatcattcactccggattt

SEQ ID NO: 486872 - DNA, 25 bp, Mus musculus
gaggattatccacgccggatgcagt

SEQ ID NO: 486873 - DNA, 25 bp, Mus musculus
gaggattatccaggccggatgcagt

SEQ ID NO: 486874 - DNA, 25 bp, Mus musculus
gaggattcactgctttcttttcata

SEQ ID NO: 486875 - DNA, 25 bp, Mus musculus
gaggattcactggtttcttttcata

SEQ ID NO: 486876 - DNA, 25 bp, Mus musculus
gaggattcacttaaaactgcacttt

SEQ ID NO: 486877 - DNA, 25 bp, Mus musculus
gaggattcactttaaactgcacttt

SEQ ID NO: 486878 - DNA, 25 bp, Mus musculus
gaggattcaggaaaccagcccagcc

SEQ ID NO: 486879 - DNA, 25 bp, Mus musculus
gaggattcaggataccagcccagcc

SEQ ID NO: 486880 - DNA, 25 bp, Mus musculus
gaggattcagtgaccttatgtggaa

SEQ ID NO: 486881 - DNA, 25 bp, Mus musculus
gaggattcagtgtccttatgtggaa

SEQ ID NO: 486882 - DNA, 25 bp, Mus musculus
gaggattcatagctaccccgaaggg

SEQ ID NO: 486883 - DNA, 25 bp, Mus musculus
gaggattcataggtaccccgaaggg

SEQ ID NO: 486884 - DNA, 25 bp, Mus musculus
gaggattccaagaactgtaagcagc

SEQ ID NO: 486885 - DNA, 25 bp, Mus musculus
gaggattccaagtactgtaagcagc

SEQ ID NO: 486886 - DNA, 25 bp, Mus musculus
gaggattccagaacttgccatcaac

SEQ ID NO: 486887 - DNA, 25 bp, Mus musculus
gaggattccagatcttgccatcaac

SEQ ID NO: 486888 - DNA, 25 bp, Mus musculus
gaggattcccatcgactgtgtgctc

SEQ ID NO: 486889 - DNA, 25 bp, Mus musculus
gaggattcccatggactgtgtgctc

SEQ ID NO: 486890 - DNA, 25 bp, Mus musculus
gaggattccctcaacaaaagcctgc

SEQ ID NO: 486891 - DNA, 25 bp, Mus musculus
gaggattccctctacaaaagcctgc

SEQ ID NO: 486892 - DNA, 25 bp, Mus musculus
gaggattcctaaattccatgacaaa

SEQ ID NO: 486893 - DNA, 25 bp, Mus musculus
gaggattcctaatttccatgacaaa

SEQ ID NO: 486894 - DNA, 25 bp, Mus musculus
gaggattcctggcacatctcgccaa

SEQ ID NO: 486895 - DNA, 25 bp, Mus musculus
gaggattcctgggacatctcgccaa

SEQ ID NO: 486896 - DNA, 25 bp, Mus musculus
gaggattcgaggactgctatcgccc

SEQ ID NO: 486897 - DNA, 25 bp, Mus musculus
gaggattcgaggtctgctatcgccc

SEQ ID NO: 486898 - DNA, 25 bp, Mus musculus
gaggattctaaccaattgtgctggc

SEQ ID NO: 486899 - DNA, 25 bp, Mus musculus
gaggattctaacgaattgtgctggc

SEQ ID NO: 486900 - DNA, 25 bp, Mus musculus
gaggattctaagattgagacagctt

SEQ ID NO: 486901 - DNA, 25 bp, Mus musculus
gaggattctaagtttgagacagctt

SEQ ID NO: 486902 - DNA, 25 bp, Mus musculus
gaggattctcatctccctaatgtga

SEQ ID NO: 486903 - DNA, 25 bp, Mus musculus
gaggattctcatgtccctaatgtga

SEQ ID NO: 486904 - DNA, 25 bp, Mus musculus
gaggattctccaatccagagataag

SEQ ID NO: 486905 - DNA, 25 bp, Mus musculus
gaggattctccattccagagataag

SEQ ID NO: 486906 - DNA, 25 bp, Mus musculus
gaggattctcctagatttttcaaaa

SEQ ID NO: 486907 - DNA, 25 bp, Mus musculus
gaggattctcctcgaggctcggaaa

SEQ ID NO: 486908 - DNA, 25 bp, Mus musculus
gaggattctcctggaggctcggaaa

SEQ ID NO: 486909 - DNA, 25 bp, Mus musculus
gaggattctccttgatttttcaaaa

SEQ ID NO: 486910 - DNA, 25 bp, Mus musculus
gaggattctgcccatgtgtttgcag

SEQ ID NO: 486911 - DNA, 25 bp, Mus musculus
gaggattctgccgatgtgtttgcag

SEQ ID NO: 486912 - DNA, 25 bp, Mus musculus
gaggattctgctctttgatttctct

SEQ ID NO: 486913 - DNA, 25 bp, Mus musculus
gaggattctgctgtttgatttctct

SEQ ID NO: 486914 - DNA, 25 bp, Mus musculus
gaggattgacacacagcatgagtta

SEQ ID NO: 486915 - DNA, 25 bp, Mus musculus
gaggattgacacagccatccatcat

SEQ ID NO: 486916 - DNA, 25 bp, Mus musculus
gaggattgacactcagcatgagtta

SEQ ID NO: 486917 - DNA, 25 bp, Mus musculus
gaggattgacactgccatccatcat

SEQ ID NO: 486918 - DNA, 25 bp, Mus musculus
gaggattgacctctctgactaccag

SEQ ID NO: 486919 - DNA, 25 bp, Mus musculus
gaggattgacctgtctgactaccag

SEQ ID NO: 486920 - DNA, 25 bp, Mus musculus
gaggattgccacaagcttcagagca

SEQ ID NO: 486921 - DNA, 25 bp, Mus musculus
gaggattgccactagcttcagagca

SEQ ID NO: 486922 - DNA, 25 bp, Mus musculus
gaggattgccatacctcatgcattg

SEQ ID NO: 486923 - DNA, 25 bp, Mus musculus
gaggattgccattcctcatgcattg

SEQ ID NO: 486924 - DNA, 25 bp, Mus musculus
gaggattgctacaagctcaaggcta

SEQ ID NO: 486925 - DNA, 25 bp, Mus musculus
gaggattgctactagctcaaggcta

SEQ ID NO: 486926 - DNA, 25 bp, Mus musculus
gaggattgctgcacatctgtggact

SEQ ID NO: 486927 - DNA, 25 bp, Mus musculus
gaggattgctgctcatctgtggact

SEQ ID NO: 486928 - DNA, 25 bp, Mus musculus
gaggattgcttgactccatgagttt

SEQ ID NO: 486929 - DNA, 25 bp, Mus musculus
gaggattgcttgtctccatgagttt

SEQ ID NO: 486930 - DNA, 25 bp, Mus musculus
gaggattggcacattcatcggctgt

SEQ ID NO: 486931 - DNA, 25 bp, Mus musculus
gaggattggcactttcatcggctgt

SEQ ID NO: 486932 - DNA, 25 bp, Mus musculus
gaggattgggcccttggattcccta

SEQ ID NO: 486933 - DNA, 25 bp, Mus musculus
gaggattgggccgttggattcccta

SEQ ID NO: 486934 - DNA, 25 bp, Mus musculus
gaggattgtcagaggcgcctatgat

SEQ ID NO: 486935 - DNA, 25 bp, Mus musculus
gaggattgtcagtggcgcctatgat

SEQ ID NO: 486936 - DNA, 25 bp, Mus musculus
gaggattgtgggacctttaagttgt

SEQ ID NO: 486937 - DNA, 25 bp, Mus musculus
gaggattgtgggtcctttaagttgt

SEQ ID NO: 486938 - DNA, 25 bp, Mus musculus
gaggattgttaaactgtgcagcaga

SEQ ID NO: 486939 - DNA, 25 bp, Mus musculus
gaggattgttaatctgtgcagcaga

SEQ ID NO: 486940 - DNA, 25 bp, Mus musculus
gaggatttaccacttgttttaacag

SEQ ID NO: 486941 - DNA, 25 bp, Mus musculus
gaggatttaccagttgttttaacag

SEQ ID NO: 486942 - DNA, 25 bp, Mus musculus
gaggatttacggagtacctgctaca

SEQ ID NO: 486943 - DNA, 25 bp, Mus musculus
gaggatttacggtgtacctgctaca

SEQ ID NO: 486944 - DNA, 25 bp, Mus musculus
gaggatttacttaacattcgagact

SEQ ID NO: 486945 - DNA, 25 bp, Mus musculus
gaggatttactttacattcgagact

SEQ ID NO: 486946 - DNA, 25 bp, Mus musculus
gaggatttaggtcaagtgcttgcct

SEQ ID NO: 486947 - DNA, 25 bp, Mus musculus
gaggatttaggtgaagtgcttgcct

SEQ ID NO: 486948 - DNA, 25 bp, Mus musculus
gaggatttatacagaattgtcatca

SEQ ID NO: 486949 - DNA, 25 bp, Mus musculus
gaggatttatactgaattgtcatca

SEQ ID NO: 486950 - DNA, 25 bp, Mus musculus
gaggatttatgtacccaccataggc

SEQ ID NO: 486951 - DNA, 25 bp, Mus musculus
gaggatttatgttcccaccataggc

SEQ ID NO: 486952 - DNA, 25 bp, Mus musculus
gaggatttattgactcaggaaagat

SEQ ID NO: 486953 - DNA, 25 bp, Mus musculus
gaggatttattgtctcaggaaagat

SEQ ID NO: 486954 - DNA, 25 bp, Mus musculus
gaggatttcaaaacaagatggttga

SEQ ID NO: 486955 - DNA, 25 bp, Mus musculus
gaggatttcaaatcaagatggttga

SEQ ID NO: 486956 - DNA, 25 bp, Mus musculus
gaggatttcagaccctgcctcattt

SEQ ID NO: 486957 - DNA, 25 bp, Mus musculus
gaggatttcagagcctgcctcattt

SEQ ID NO: 486958 - DNA, 25 bp, Mus musculus
gaggatttcatccaattcgccacgg

SEQ ID NO: 486959 - DNA, 25 bp, Mus musculus
gaggatttcatcgaattcgccacgg

SEQ ID NO: 486960 - DNA, 25 bp, Mus musculus
gaggatttccccaagcaaggaccaa

SEQ ID NO: 486961 - DNA, 25 bp, Mus musculus
gaggatttcccctagcaaggaccaa

SEQ ID NO: 486962 - DNA, 25 bp, Mus musculus
gaggatttcctcagacacaatgcta

SEQ ID NO: 486963 - DNA, 25 bp, Mus musculus
gaggatttcctctgacacaatgcta

SEQ ID NO: 486964 - DNA, 25 bp, Mus musculus
gaggatttcttaacggatgcaattt

SEQ ID NO: 486965 - DNA, 25 bp, Mus musculus
gaggatttcttatcggatgcaattt

SEQ ID NO: 486966 - DNA, 25 bp, Mus musculus
gaggatttctttatggactgatgta

SEQ ID NO: 486967 - DNA, 25 bp, Mus musculus
gaggatttctttttggactgatgta

SEQ ID NO: 486968 - DNA, 25 bp, Mus musculus
gaggatttgagcagtcgatctccca

SEQ ID NO: 486969 - DNA, 25 bp, Mus musculus
gaggatttgagccttgttccagacc

SEQ ID NO: 486970 - DNA, 25 bp, Mus musculus
gaggatttgagcgttgttccagacc

SEQ ID NO: 486971 - DNA, 25 bp, Mus musculus
gaggatttgagctgtcgatctccca

SEQ ID NO: 486972 - DNA, 25 bp, Mus musculus
gaggatttgaggatgaactcttaag

SEQ ID NO: 486973 - DNA, 25 bp, Mus musculus
gaggatttgaggttgaactcttaag

SEQ ID NO: 486974 - DNA, 25 bp, Mus musculus
gaggatttgccgctcaaactgacag

SEQ ID NO: 486975 - DNA, 25 bp, Mus musculus
gaggatttgccggtcaaactgacag

SEQ ID NO: 486976 - DNA, 25 bp, Mus musculus
gaggatttgttcatctctagaaggc

SEQ ID NO: 486977 - DNA, 25 bp, Mus musculus
gaggatttgttcttctctagaaggc

SEQ ID NO: 486978 - DNA, 25 bp, Mus musculus
gaggatttgtttacagccacccaag

SEQ ID NO: 486979 - DNA, 25 bp, Mus musculus
gaggatttgttttcagccacccaag

SEQ ID NO: 486980 - DNA, 25 bp, Mus musculus
gaggattttaagagatatggtgaga

SEQ ID NO: 486981 - DNA, 25 bp, Mus musculus
gaggattttaagtgatatggtgaga

SEQ ID NO: 486982 - DNA, 25 bp, Mus musculus
gaggattttagacctttgaaacaat

SEQ ID NO: 486983 - DNA, 25 bp, Mus musculus
gaggattttagagctttgaaacaat

SEQ ID NO: 486984 - DNA, 25 bp, Mus musculus
gaggattttgagagggttcaacaca

SEQ ID NO: 486985 - DNA, 25 bp, Mus musculus
gaggattttgagtgggttcaacaca

SEQ ID NO: 486986 - DNA, 25 bp, Mus musculus
gaggatttttcactatgtgcctagc

SEQ ID NO: 486987 - DNA, 25 bp, Mus musculus
gaggatttttcagtatgtgcctagc

SEQ ID NO: 486988 - DNA, 25 bp, Mus musculus
gaggcaaaaggccagaccctgcttc

SEQ ID NO: 486989 - DNA, 25 bp, Mus musculus
gaggcaaaaggcgagaccctgcttc

SEQ ID NO: 486990 - DNA, 25 bp, Mus musculus
gaggcaaaagtaactcattgttcga

SEQ ID NO: 486991 - DNA, 25 bp, Mus musculus
gaggcaaaagtatctcattgttcga

SEQ ID NO: 486992 - DNA, 25 bp, Mus musculus
gaggcaaaagttcacctgcggttta

SEQ ID NO: 486993 - DNA, 25 bp, Mus musculus
gaggcaaaagttgacctgcggttta

SEQ ID NO: 486994 - DNA, 25 bp, Mus musculus
gaggcaaacactactggtcaggccc

SEQ ID NO: 486995 - DNA, 25 bp, Mus musculus
gaggcaaacacttctggtcaggccc

SEQ ID NO: 486996 - DNA, 25 bp, Mus musculus
gaggcaaacccacatcaccttgcga

SEQ ID NO: 486997 - DNA, 25 bp, Mus musculus
gaggcaaacccagatcaccttgcga

SEQ ID NO: 486998 - DNA, 25 bp, Mus musculus
gaggcaaacgtcactcagtggcaag

SEQ ID NO: 486999 - DNA, 25 bp, Mus musculus
gaggcaaacgtctctcagtggcaag

SEQ ID NO: 487000 - DNA, 25 bp, Mus musculus
gaggcaaactgaccaccataattta

SEQ ID NO: 487001 - DNA, 25 bp, Mus musculus
gaggcaaactgagcaccataattta

SEQ ID NO: 487002 - DNA, 25 bp, Mus musculus
gaggcaaagcaacctgtcccatggg

SEQ ID NO: 487003 - DNA, 25 bp, Mus musculus
gaggcaaagcaagctgtcccatggg

SEQ ID NO: 487004 - DNA, 25 bp, Mus musculus
gaggcaaagcaccaggatcccttaa

SEQ ID NO: 487005 - DNA, 25 bp, Mus musculus
gaggcaaagcacgaggatcccttaa

SEQ ID NO: 487006 - DNA, 25 bp, Mus musculus
gaggcaaagcctaataagagagaaa

SEQ ID NO: 487007 - DNA, 25 bp, Mus musculus
gaggcaaagccttataagagagaaa

SEQ ID NO: 487008 - DNA, 25 bp, Mus musculus
gaggcaaaggccatctcctgaggga

SEQ ID NO: 487009 - DNA, 25 bp, Mus musculus
gaggcaaaggccttctcctgaggga

SEQ ID NO: 487010 - DNA, 25 bp, Mus musculus
gaggcaaagggtcctgttgtcacaa

SEQ ID NO: 487011 - DNA, 25 bp, Mus musculus
gaggcaaagggtgctgttgtcacaa

SEQ ID NO: 487012 - DNA, 25 bp, Mus musculus
gaggcaaagtctcatgacccagaaa

SEQ ID NO: 487013 - DNA, 25 bp, Mus musculus
gaggcaaagtctgatgacccagaaa

SEQ ID NO: 487014 - DNA, 25 bp, Mus musculus
gaggcaaagtttagatcgatctcca

SEQ ID NO: 487015 - DNA, 25 bp, Mus musculus
gaggcaaagttttgatcgatctcca

SEQ ID NO: 487016 - DNA, 25 bp, Mus musculus
gaggcaaatcgaagggaaagtcgtt

SEQ ID NO: 487017 - DNA, 25 bp, Mus musculus
gaggcaaatcgatgggaaagtcgtt

SEQ ID NO: 487018 - DNA, 25 bp, Mus musculus
gaggcaaatctcctcagtgtcactg

SEQ ID NO: 487019 - DNA, 25 bp, Mus musculus
gaggcaaatctcgtcagtgtcactg

SEQ ID NO: 487020 - DNA, 25 bp, Mus musculus
gaggcaaatggaactttataagttc

SEQ ID NO: 487021 - DNA, 25 bp, Mus musculus
gaggcaaatggatctttataagttc

SEQ ID NO: 487022 - DNA, 25 bp, Mus musculus
gaggcaaattccaactgtgtgtaat

SEQ ID NO: 487023 - DNA, 25 bp, Mus musculus
gaggcaaattcctactgtgtgtaat

SEQ ID NO: 487024 - DNA, 25 bp, Mus musculus
gaggcaaatttactgtccccaaaat

SEQ ID NO: 487025 - DNA, 25 bp, Mus musculus
gaggcaaatttagtgtccccaaaat

SEQ ID NO: 487026 - DNA, 25 bp, Mus musculus
gaggcaacaaagacttacgactcat

SEQ ID NO: 487027 - DNA, 25 bp, Mus musculus
gaggcaacaaagtcttacgactcat

SEQ ID NO: 487028 - DNA, 25 bp, Mus musculus
gaggcaacaagcacggtgcctatct

SEQ ID NO: 487029 - DNA, 25 bp, Mus musculus
gaggcaacaagctcggtgcctatct

SEQ ID NO: 487030 - DNA, 25 bp, Mus musculus
gaggcaacacataacagtgacttat

SEQ ID NO: 487031 - DNA, 25 bp, Mus musculus
gaggcaacacatctgctgaggcaaa

SEQ ID NO: 487032 - DNA, 25 bp, Mus musculus
gaggcaacacatgtgctgaggcaaa

SEQ ID NO: 487033 - DNA, 25 bp, Mus musculus
gaggcaacacattacagtgacttat

SEQ ID NO: 487034 - DNA, 25 bp, Mus musculus
gaggcaacaccaaagggatgtgaca

SEQ ID NO: 487035 - DNA, 25 bp, Mus musculus
gaggcaacaccatagggatgtgaca

SEQ ID NO: 487036 - DNA, 25 bp, Mus musculus
gaggcaacagccatgggttctcttc

SEQ ID NO: 487037 - DNA, 25 bp, Mus musculus
gaggcaacagccttgggttctcttc

SEQ ID NO: 487038 - DNA, 25 bp, Mus musculus
gaggcaacagtgctcagagtcctaa

SEQ ID NO: 487039 - DNA, 25 bp, Mus musculus
gaggcaacagtggtcagagtcctaa

SEQ ID NO: 487040 - DNA, 25 bp, Mus musculus
gaggcaacatccaaatcaacagctt

SEQ ID NO: 487041 - DNA, 25 bp, Mus musculus
gaggcaacatcctaatcaacagctt

SEQ ID NO: 487042 - DNA, 25 bp, Mus musculus
gaggcaaccattattaacattctgt

SEQ ID NO: 487043 - DNA, 25 bp, Mus musculus
gaggcaaccatttttaacattctgt

SEQ ID NO: 487044 - DNA, 25 bp, Mus musculus
gaggcaacccggaagtatttctgga

SEQ ID NO: 487045 - DNA, 25 bp, Mus musculus
gaggcaacccggtagtatttctgga

SEQ ID NO: 487046 - DNA, 25 bp, Mus musculus
gaggcaaccctacagaccagtatga

SEQ ID NO: 487047 - DNA, 25 bp, Mus musculus
gaggcaaccctagagaccagtatga

SEQ ID NO: 487048 - DNA, 25 bp, Mus musculus
gaggcaaccgtaccaggtgcgcaca

SEQ ID NO: 487049 - DNA, 25 bp, Mus musculus
gaggcaaccgtagcaggtgcgcaca

SEQ ID NO: 487050 - DNA, 25 bp, Mus musculus
gaggcaacctgtatcacggagatgt

SEQ ID NO: 487051 - DNA, 25 bp, Mus musculus
gaggcaacctgtttcacggagatgt

SEQ ID NO: 487052 - DNA, 25 bp, Mus musculus
gaggcaaccttgactattcacagta

SEQ ID NO: 487053 - DNA, 25 bp, Mus musculus
gaggcaaccttgtctattcacagta

SEQ ID NO: 487054 - DNA, 25 bp, Mus musculus
gaggcaacgaataccgtctcagaat

SEQ ID NO: 487055 - DNA, 25 bp, Mus musculus
gaggcaacgaattccgtctcagaat

SEQ ID NO: 487056 - DNA, 25 bp, Mus musculus
gaggcaacgtccagggtcctaagtc

SEQ ID NO: 487057 - DNA, 25 bp, Mus musculus
gaggcaacgtcctgggtcctaagtc

SEQ ID NO: 487058 - DNA, 25 bp, Mus musculus
gaggcaacgtgacgcgcatccccag

SEQ ID NO: 487059 - DNA, 25 bp, Mus musculus
gaggcaacgtgaggcgcatccccag

SEQ ID NO: 487060 - DNA, 25 bp, Mus musculus
gaggcaactaacatctttcatcgaa

SEQ ID NO: 487061 - DNA, 25 bp, Mus musculus
gaggcaactaacttctttcatcgaa

SEQ ID NO: 487062 - DNA, 25 bp, Mus musculus
gaggcaactagaactagcattggta

SEQ ID NO: 487063 - DNA, 25 bp, Mus musculus
gaggcaactagatctagcattggta

SEQ ID NO: 487064 - DNA, 25 bp, Mus musculus
gaggcaactcatcaactctcgaggt

SEQ ID NO: 487065 - DNA, 25 bp, Mus musculus
gaggcaactcatgaactctcgaggt

SEQ ID NO: 487066 - DNA, 25 bp, Mus musculus
gaggcaactgccattaccatactca

SEQ ID NO: 487067 - DNA, 25 bp, Mus musculus
gaggcaactgcctttaccatactca

SEQ ID NO: 487068 - DNA, 25 bp, Mus musculus
gaggcaactgggatccccatggaat

SEQ ID NO: 487069 - DNA, 25 bp, Mus musculus
gaggcaactgggttccccatggaat

SEQ ID NO: 487070 - DNA, 25 bp, Mus musculus
gaggcaacttcccagttaatctcat

SEQ ID NO: 487071 - DNA, 25 bp, Mus musculus
gaggcaacttccgagttaatctcat

SEQ ID NO: 487072 - DNA, 25 bp, Mus musculus
gaggcaagaacaaacctaccccata

SEQ ID NO: 487073 - DNA, 25 bp, Mus musculus
gaggcaagaacatacctaccccata

SEQ ID NO: 487074 - DNA, 25 bp, Mus musculus
gaggcaagaaggcaattcagttcag

SEQ ID NO: 487075 - DNA, 25 bp, Mus musculus
gaggcaagaagggaattcagttcag

SEQ ID NO: 487076 - DNA, 25 bp, Mus musculus
gaggcaagactaaaaccaggctgat

SEQ ID NO: 487077 - DNA, 25 bp, Mus musculus
gaggcaagactataaccaggctgat

SEQ ID NO: 487078 - DNA, 25 bp, Mus musculus
gaggcaagagaacttccttgtcttc

SEQ ID NO: 487079 - DNA, 25 bp, Mus musculus
gaggcaagagaagttccttgtcttc

SEQ ID NO: 487080 - DNA, 25 bp, Mus musculus
gaggcaagatgcatctggacagcaa

SEQ ID NO: 487081 - DNA, 25 bp, Mus musculus
gaggcaagatgcttctggacagcaa

SEQ ID NO: 487082 - DNA, 25 bp, Mus musculus
gaggcaagattgacccgcagccaag

SEQ ID NO: 487083 - DNA, 25 bp, Mus musculus
gaggcaagattgtcccgcagccaag

SEQ ID NO: 487084 - DNA, 25 bp, Mus musculus
gaggcaagcacacgacacatcagtt

SEQ ID NO: 487085 - DNA, 25 bp, Mus musculus
gaggcaagcacaggacacatcagtt

SEQ ID NO: 487086 - DNA, 25 bp, Mus musculus
gaggcaagccaactgatcattaata

SEQ ID NO: 487087 - DNA, 25 bp, Mus musculus
gaggcaagccaagtgatcattaata

SEQ ID NO: 487088 - DNA, 25 bp, Mus musculus
gaggcaagccgtagctaggtaacta

SEQ ID NO: 487089 - DNA, 25 bp, Mus musculus
gaggcaagccgtcccacaccagaaa

SEQ ID NO: 487090 - DNA, 25 bp, Mus musculus
gaggcaagccgtgccacaccagaaa

SEQ ID NO: 487091 - DNA, 25 bp, Mus musculus
gaggcaagccgttgctaggtaacta

SEQ ID NO: 487092 - DNA, 25 bp, Mus musculus
gaggcaagggaaactcaatgagctt

SEQ ID NO: 487093 - DNA, 25 bp, Mus musculus
gaggcaagggaatctcaatgagctt

SEQ ID NO: 487094 - DNA, 25 bp, Mus musculus
gaggcaagggacacgtttccatgtc

SEQ ID NO: 487095 - DNA, 25 bp, Mus musculus
gaggcaagggacatggactccctgt

SEQ ID NO: 487096 - DNA, 25 bp, Mus musculus
gaggcaagggactcgtttccatgtc

SEQ ID NO: 487097 - DNA, 25 bp, Mus musculus
gaggcaagggacttggactccctgt

SEQ ID NO: 487098 - DNA, 25 bp, Mus musculus
gaggcaagtattctctcaaacacct

SEQ ID NO: 487099 - DNA, 25 bp, Mus musculus
gaggcaagtattgtctcaaacacct

SEQ ID NO: 487100 - DNA, 25 bp, Mus musculus
gaggcaagtgccattctatttgaat

SEQ ID NO: 487101 - DNA, 25 bp, Mus musculus
gaggcaagtgcctttctatttgaat

SEQ ID NO: 487102 - DNA, 25 bp, Mus musculus
gaggcaagtttaccaccaatcatct

SEQ ID NO: 487103 - DNA, 25 bp, Mus musculus
gaggcaagtttagcaccaatcatct

SEQ ID NO: 487104 - DNA, 25 bp, Mus musculus
gaggcaagtttcattctggactgaa

SEQ ID NO: 487105 - DNA, 25 bp, Mus musculus
gaggcaagtttctttctggactgaa

SEQ ID NO: 487106 - DNA, 25 bp, Mus musculus
gaggcaataaccaatgggtccccta

SEQ ID NO: 487107 - DNA, 25 bp, Mus musculus
gaggcaataacctatgggtccccta

SEQ ID NO: 487108 - DNA, 25 bp, Mus musculus
gaggcaataagcattcttgggtaga

SEQ ID NO: 487109 - DNA, 25 bp, Mus musculus
gaggcaataagctttcttgggtaga

SEQ ID NO: 487110 - DNA, 25 bp, Mus musculus
gaggcaataggaacttctctttcag

SEQ ID NO: 487111 - DNA, 25 bp, Mus musculus
gaggcaataggatcttctctttcag

SEQ ID NO: 487112 - DNA, 25 bp, Mus musculus
gaggcaatagttaacacctgtgtgt

SEQ ID NO: 487113 - DNA, 25 bp, Mus musculus
gaggcaatagtttacacctgtgtgt

SEQ ID NO: 487114 - DNA, 25 bp, Mus musculus
gaggcaatcagaaccttaggtcttc

SEQ ID NO: 487115 - DNA, 25 bp, Mus musculus
gaggcaatcagatccttaggtcttc

SEQ ID NO: 487116 - DNA, 25 bp, Mus musculus
gaggcaatcatcagtgccatttccg

SEQ ID NO: 487117 - DNA, 25 bp, Mus musculus
gaggcaatcatctgtgccatttccg

SEQ ID NO: 487118 - DNA, 25 bp, Mus musculus
gaggcaatcgccaaagttcttaatg

SEQ ID NO: 487119 - DNA, 25 bp, Mus musculus
gaggcaatcgcctaagttcttaatg

SEQ ID NO: 487120 - DNA, 25 bp, Mus musculus
gaggcaatcgttccgtcccactaag

SEQ ID NO: 487121 - DNA, 25 bp, Mus musculus
gaggcaatcgttgcgtcccactaag

SEQ ID NO: 487122 - DNA, 25 bp, Mus musculus
gaggcaatgaaaactccagagctga

SEQ ID NO: 487123 - DNA, 25 bp, Mus musculus
gaggcaatgaaatctccagagctga

SEQ ID NO: 487124 - DNA, 25 bp, Mus musculus
gaggcaatgatcaggcggcttctgc

SEQ ID NO: 487125 - DNA, 25 bp, Mus musculus
gaggcaatgatctggcggcttctgc

SEQ ID NO: 487126 - DNA, 25 bp, Mus musculus
gaggcaatgcataattgtgtagcca

SEQ ID NO: 487127 - DNA, 25 bp, Mus musculus
gaggcaatgcatacctctattgttc

SEQ ID NO: 487128 - DNA, 25 bp, Mus musculus
gaggcaatgcattattgtgtagcca

SEQ ID NO: 487129 - DNA, 25 bp, Mus musculus
gaggcaatgcattcctctattgttc

SEQ ID NO: 487130 - DNA, 25 bp, Mus musculus
gaggcaatgccaaggctcactcata

SEQ ID NO: 487131 - DNA, 25 bp, Mus musculus
gaggcaatgccatggctcactcata

SEQ ID NO: 487132 - DNA, 25 bp, Mus musculus
gaggcaatggtcaccagatccgttg

SEQ ID NO: 487133 - DNA, 25 bp, Mus musculus
gaggcaatggtctccagatccgttg

SEQ ID NO: 487134 - DNA, 25 bp, Mus musculus
gaggcaatggtgctgcatccgtaca

SEQ ID NO: 487135 - DNA, 25 bp, Mus musculus
gaggcaatggtggtgcatccgtaca

SEQ ID NO: 487136 - DNA, 25 bp, Mus musculus
gaggcaatgtccagctggcagctca

SEQ ID NO: 487137 - DNA, 25 bp, Mus musculus
gaggcaatgtcctgctggcagctca

SEQ ID NO: 487138 - DNA, 25 bp, Mus musculus
gaggcaatgtctctcctttgctaaa

SEQ ID NO: 487139 - DNA, 25 bp, Mus musculus
gaggcaatgtctgtcctttgctaaa

SEQ ID NO: 487140 - DNA, 25 bp, Mus musculus
gaggcaattctgagagattctcccc

SEQ ID NO: 487141 - DNA, 25 bp, Mus musculus
gaggcaattctgcagaccactggaa

SEQ ID NO: 487142 - DNA, 25 bp, Mus musculus
gaggcaattctggagaccactggaa

SEQ ID NO: 487143 - DNA, 25 bp, Mus musculus
gaggcaattctgtgagattctcccc

SEQ ID NO: 487144 - DNA, 25 bp, Mus musculus
gaggcaatttcacactaatcacaaa

SEQ ID NO: 487145 - DNA, 25 bp, Mus musculus
gaggcaatttcagactaatcacaaa

SEQ ID NO: 487146 - DNA, 25 bp, Mus musculus
gaggcacaaactatctttaggatta

SEQ ID NO: 487147 - DNA, 25 bp, Mus musculus
gaggcacaaactttctttaggatta

SEQ ID NO: 487148 - DNA, 25 bp, Mus musculus
gaggcacaaagacgaccccggtagc

SEQ ID NO: 487149 - DNA, 25 bp, Mus musculus
gaggcacaaagaggaccccggtagc

SEQ ID NO: 487150 - DNA, 25 bp, Mus musculus
gaggcacaaatgatactatcagtag

SEQ ID NO: 487151 - DNA, 25 bp, Mus musculus
gaggcacaaatgttactatcagtag

SEQ ID NO: 487152 - DNA, 25 bp, Mus musculus
gaggcacaaccactcaggttttcaa

SEQ ID NO: 487153 - DNA, 25 bp, Mus musculus
gaggcacaaccagtcaggttttcaa

SEQ ID NO: 487154 - DNA, 25 bp, Mus musculus
gaggcacaagctcgtcattgaaata

SEQ ID NO: 487155 - DNA, 25 bp, Mus musculus
gaggcacaagctggtcattgaaata

SEQ ID NO: 487156 - DNA, 25 bp, Mus musculus
gaggcacacaataggcccgctgcag

SEQ ID NO: 487157 - DNA, 25 bp, Mus musculus
gaggcacacaatccagactatgagc

SEQ ID NO: 487158 - DNA, 25 bp, Mus musculus
gaggcacacaatgcagactatgagc

SEQ ID NO: 487159 - DNA, 25 bp, Mus musculus
gaggcacacaattggcccgctgcag

SEQ ID NO: 487160 - DNA, 25 bp, Mus musculus
gaggcacacactaggtatatatcat

SEQ ID NO: 487161 - DNA, 25 bp, Mus musculus
gaggcacacactcgattctttattt

SEQ ID NO: 487162 - DNA, 25 bp, Mus musculus
gaggcacacactggattctttattt

SEQ ID NO: 487163 - DNA, 25 bp, Mus musculus
gaggcacacacttggtatatatcat

SEQ ID NO: 487164 - DNA, 25 bp, Mus musculus
gaggcacaccgtcacgacatactat

SEQ ID NO: 487165 - DNA, 25 bp, Mus musculus
gaggcacaccgtgacgacatactat

SEQ ID NO: 487166 - DNA, 25 bp, Mus musculus
gaggcacactcgcaacattattaca

SEQ ID NO: 487167 - DNA, 25 bp, Mus musculus
gaggcacactcggaacattattaca

SEQ ID NO: 487168 - DNA, 25 bp, Mus musculus
gaggcacactgaacgatcagctctg

SEQ ID NO: 487169 - DNA, 25 bp, Mus musculus
gaggcacactgatcgatcagctctg

SEQ ID NO: 487170 - DNA, 25 bp, Mus musculus
gaggcacactgccaatcacgctcgg

SEQ ID NO: 487171 - DNA, 25 bp, Mus musculus
gaggcacactgcgaatcacgctcgg

SEQ ID NO: 487172 - DNA, 25 bp, Mus musculus
gaggcacagaagaatactaagcttt

SEQ ID NO: 487173 - DNA, 25 bp, Mus musculus
gaggcacagaagtatactaagcttt

SEQ ID NO: 487174 - DNA, 25 bp, Mus musculus
gaggcacagacgaacttcaccaaga

SEQ ID NO: 487175 - DNA, 25 bp, Mus musculus
gaggcacagacgtacttcaccaaga

SEQ ID NO: 487176 - DNA, 25 bp, Mus musculus
gaggcacagaggatctcagcttcac

SEQ ID NO: 487177 - DNA, 25 bp, Mus musculus
gaggcacagaggttctcagcttcac

SEQ ID NO: 487178 - DNA, 25 bp, Mus musculus
gaggcacagataaggtgcatagcca

SEQ ID NO: 487179 - DNA, 25 bp, Mus musculus
gaggcacagatatggtgcatagcca

SEQ ID NO: 487180 - DNA, 25 bp, Mus musculus
gaggcacagcaccacaaaatctgtc

SEQ ID NO: 487181 - DNA, 25 bp, Mus musculus
gaggcacagcacgacaaaatctgtc

SEQ ID NO: 487182 - DNA, 25 bp, Mus musculus
gaggcacagcatcaagggacagcac

SEQ ID NO: 487183 - DNA, 25 bp, Mus musculus
gaggcacagcatgaagggacagcac

SEQ ID NO: 487184 - DNA, 25 bp, Mus musculus
gaggcacagccactactcaggaaga

SEQ ID NO: 487185 - DNA, 25 bp, Mus musculus
gaggcacagccagtactcaggaaga

SEQ ID NO: 487186 - DNA, 25 bp, Mus musculus
gaggcacagggcattctgaagtcat

SEQ ID NO: 487187 - DNA, 25 bp, Mus musculus
gaggcacagggctttctgaagtcat

SEQ ID NO: 487188 - DNA, 25 bp, Mus musculus
gaggcacagtatatgcaatcctgaa

SEQ ID NO: 487189 - DNA, 25 bp, Mus musculus
gaggcacagtatttgcaatcctgaa

SEQ ID NO: 487190 - DNA, 25 bp, Mus musculus
gaggcacagtcaaagttacccatga

SEQ ID NO: 487191 - DNA, 25 bp, Mus musculus
gaggcacagtcatagttacccatga

SEQ ID NO: 487192 - DNA, 25 bp, Mus musculus
gaggcacagtctatggacacggctg

SEQ ID NO: 487193 - DNA, 25 bp, Mus musculus
gaggcacagtctttggacacggctg

SEQ ID NO: 487194 - DNA, 25 bp, Mus musculus
gaggcacataagatgctcaccagcg

SEQ ID NO: 487195 - DNA, 25 bp, Mus musculus
gaggcacataagttgctcaccagcg

SEQ ID NO: 487196 - DNA, 25 bp, Mus musculus
gaggcacataataccaagcaataca

SEQ ID NO: 487197 - DNA, 25 bp, Mus musculus
gaggcacataattccaagcaataca

SEQ ID NO: 487198 - DNA, 25 bp, Mus musculus
gaggcacatagcagtggacccaaca

SEQ ID NO: 487199 - DNA, 25 bp, Mus musculus
gaggcacatagctgtggacccaaca

SEQ ID NO: 487200 - DNA, 25 bp, Mus musculus
gaggcacatcaacggctcctaactg

SEQ ID NO: 487201 - DNA, 25 bp, Mus musculus
gaggcacatcaagggctcctaactg

SEQ ID NO: 487202 - DNA, 25 bp, Mus musculus
gaggcacatgatctccaaagaatta

SEQ ID NO: 487203 - DNA, 25 bp, Mus musculus
gaggcacatgatgtccaaagaatta

SEQ ID NO: 487204 - DNA, 25 bp, Mus musculus
gaggcacatgccatgtttatttgag

SEQ ID NO: 487205 - DNA, 25 bp, Mus musculus
gaggcacatgccttgtttatttgag

SEQ ID NO: 487206 - DNA, 25 bp, Mus musculus
gaggcacatgctagattcagacact

SEQ ID NO: 487207 - DNA, 25 bp, Mus musculus
gaggcacatgctctatagtgtatgg

SEQ ID NO: 487208 - DNA, 25 bp, Mus musculus
gaggcacatgctgtatagtgtatgg

SEQ ID NO: 487209 - DNA, 25 bp, Mus musculus
gaggcacatgcttgattcagacact

SEQ ID NO: 487210 - DNA, 25 bp, Mus musculus
gaggcacatgtgaacttcctgtaca

SEQ ID NO: 487211 - DNA, 25 bp, Mus musculus
gaggcacatgtgtacttcctgtaca

SEQ ID NO: 487212 - DNA, 25 bp, Mus musculus
gaggcacattatctgtcaacctgaa

SEQ ID NO: 487213 - DNA, 25 bp, Mus musculus
gaggcacattatgtgtcaacctgaa

SEQ ID NO: 487214 - DNA, 25 bp, Mus musculus
gaggcacattcaagcaataaaacta

SEQ ID NO: 487215 - DNA, 25 bp, Mus musculus
gaggcacattcatgcaataaaacta

SEQ ID NO: 487216 - DNA, 25 bp, Mus musculus
gaggcacattggagcatgtgtgttt

SEQ ID NO: 487217 - DNA, 25 bp, Mus musculus
gaggcacattggtgcatgtgtgttt

SEQ ID NO: 487218 - DNA, 25 bp, Mus musculus
gaggcaccaaatcatcaacccaaat

SEQ ID NO: 487219 - DNA, 25 bp, Mus musculus
gaggcaccaaatgatcaacccaaat

SEQ ID NO: 487220 - DNA, 25 bp, Mus musculus
gaggcaccaaccaactggatggcat

SEQ ID NO: 487221 - DNA, 25 bp, Mus musculus
gaggcaccaacctactggatggcat

SEQ ID NO: 487222 - DNA, 25 bp, Mus musculus
gaggcaccaagtcggctccctgaaa

SEQ ID NO: 487223 - DNA, 25 bp, Mus musculus
gaggcaccaagtgggctccctgaaa

SEQ ID NO: 487224 - DNA, 25 bp, Mus musculus
gaggcaccactgcacaaggcctgtg

SEQ ID NO: 487225 - DNA, 25 bp, Mus musculus
gaggcaccactggacaaggcctgtg

SEQ ID NO: 487226 - DNA, 25 bp, Mus musculus
gaggcaccagagacctataagaatg

SEQ ID NO: 487227 - DNA, 25 bp, Mus musculus
gaggcaccagagtcctataagaatg

SEQ ID NO: 487228 - DNA, 25 bp, Mus musculus
gaggcaccagatatcacagcagaca

SEQ ID NO: 487229 - DNA, 25 bp, Mus musculus
gaggcaccagatttcacagcagaca

SEQ ID NO: 487230 - DNA, 25 bp, Mus musculus
gaggcaccagctcgttgtgcttaga

SEQ ID NO: 487231 - DNA, 25 bp, Mus musculus
gaggcaccagctggttgtgcttaga

SEQ ID NO: 487232 - DNA, 25 bp, Mus musculus
gaggcaccaggaacatctacgacag

SEQ ID NO: 487233 - DNA, 25 bp, Mus musculus
gaggcaccaggatcatctacgacag

SEQ ID NO: 487234 - DNA, 25 bp, Mus musculus
gaggcaccatagatgtttgagcagg

SEQ ID NO: 487235 - DNA, 25 bp, Mus musculus
gaggcaccatagttgtttgagcagg

SEQ ID NO: 487236 - DNA, 25 bp, Mus musculus
gaggcaccatatcagaaagcagttt

SEQ ID NO: 487237 - DNA, 25 bp, Mus musculus
gaggcaccatatccgattgacagga

SEQ ID NO: 487238 - DNA, 25 bp, Mus musculus
gaggcaccatatgagaaagcagttt

SEQ ID NO: 487239 - DNA, 25 bp, Mus musculus
gaggcaccatatgcgattgacagga

SEQ ID NO: 487240 - DNA, 25 bp, Mus musculus
gaggcaccatgacctccacagctgg

SEQ ID NO: 487241 - DNA, 25 bp, Mus musculus
gaggcaccatgagctccacagctgg

SEQ ID NO: 487242 - DNA, 25 bp, Mus musculus
gaggcacccagcaccccggtttgta

SEQ ID NO: 487243 - DNA, 25 bp, Mus musculus
gaggcacccagctccccggtttgta

SEQ ID NO: 487244 - DNA, 25 bp, Mus musculus
gaggcacccaggcttctaaaaactg

SEQ ID NO: 487245 - DNA, 25 bp, Mus musculus
gaggcacccagggttctaaaaactg

SEQ ID NO: 487246 - DNA, 25 bp, Mus musculus
gaggcaccgaataggcagtgattta

SEQ ID NO: 487247 - DNA, 25 bp, Mus musculus
gaggcaccgaattggcagtgattta

SEQ ID NO: 487248 - DNA, 25 bp, Mus musculus
gaggcaccgcaacttttgatgggac

SEQ ID NO: 487249 - DNA, 25 bp, Mus musculus
gaggcaccgcaagttttgatgggac

SEQ ID NO: 487250 - DNA, 25 bp, Mus musculus
gaggcaccgcacatcagaaaaatta

SEQ ID NO: 487251 - DNA, 25 bp, Mus musculus
gaggcaccgcacttcagaaaaatta

SEQ ID NO: 487252 - DNA, 25 bp, Mus musculus
gaggcacctcaaaaacctcagccgt

SEQ ID NO: 487253 - DNA, 25 bp, Mus musculus
gaggcacctcaataacctcagccgt

SEQ ID NO: 487254 - DNA, 25 bp, Mus musculus
gaggcacctcggctctgaaagagcc

SEQ ID NO: 487255 - DNA, 25 bp, Mus musculus
gaggcacctcgggtctgaaagagcc

SEQ ID NO: 487256 - DNA, 25 bp, Mus musculus
gaggcacctgatcgccgaaggcact

SEQ ID NO: 487257 - DNA, 25 bp, Mus musculus
gaggcacctgatggccgaaggcact

SEQ ID NO: 487258 - DNA, 25 bp, Mus musculus
gaggcacctggcatctgactaggag

SEQ ID NO: 487259 - DNA, 25 bp, Mus musculus
gaggcacctggcttctgactaggag

SEQ ID NO: 487260 - DNA, 25 bp, Mus musculus
gaggcacctggtagtagtagacaac

SEQ ID NO: 487261 - DNA, 25 bp, Mus musculus
gaggcacctggttgtagtagacaac

SEQ ID NO: 487262 - DNA, 25 bp, Mus musculus
gaggcaccttagataatggcgattt

SEQ ID NO: 487263 - DNA, 25 bp, Mus musculus
gaggcaccttagttaatggcgattt

SEQ ID NO: 487264 - DNA, 25 bp, Mus musculus
gaggcacgagacagctacgacaaca

SEQ ID NO: 487265 - DNA, 25 bp, Mus musculus
gaggcacgagactgctacgacaaca

SEQ ID NO: 487266 - DNA, 25 bp, Mus musculus
gaggcacgatagctggctacacagt

SEQ ID NO: 487267 - DNA, 25 bp, Mus musculus
gaggcacgataggtggctacacagt

SEQ ID NO: 487268 - DNA, 25 bp, Mus musculus
gaggcacgctggactggcaagacaa

SEQ ID NO: 487269 - DNA, 25 bp, Mus musculus
gaggcacgctggtctggcaagacaa

SEQ ID NO: 487270 - DNA, 25 bp, Mus musculus
gaggcacggaacactgaactgacct

SEQ ID NO: 487271 - DNA, 25 bp, Mus musculus
gaggcacggaactctgaactgacct

SEQ ID NO: 487272 - DNA, 25 bp, Mus musculus
gaggcacggtggctcttctctactg

SEQ ID NO: 487273 - DNA, 25 bp, Mus musculus
gaggcacggtgggtcttctctactg

SEQ ID NO: 487274 - DNA, 25 bp, Mus musculus
gaggcactacaaccagtcattcatg

SEQ ID NO: 487275 - DNA, 25 bp, Mus musculus
gaggcactacaagcagtcattcatg

SEQ ID NO: 487276 - DNA, 25 bp, Mus musculus
gaggcactatgcctgagtaccggct

SEQ ID NO: 487277 - DNA, 25 bp, Mus musculus
gaggcactatgcgtgagtaccggct

SEQ ID NO: 487278 - DNA, 25 bp, Mus musculus
gaggcactattacccaaccatgaag

SEQ ID NO: 487279 - DNA, 25 bp, Mus musculus
gaggcactattagccaaccatgaag

SEQ ID NO: 487280 - DNA, 25 bp, Mus musculus
gaggcactcaataagttatcaagta

SEQ ID NO: 487281 - DNA, 25 bp, Mus musculus
gaggcactcaattagttatcaagta

SEQ ID NO: 487282 - DNA, 25 bp, Mus musculus
gaggcactcagcaatcaatgggcat

SEQ ID NO: 487283 - DNA, 25 bp, Mus musculus
gaggcactcagctatcaatgggcat

SEQ ID NO: 487284 - DNA, 25 bp, Mus musculus
gaggcactcattagcacatgggcat

SEQ ID NO: 487285 - DNA, 25 bp, Mus musculus
gaggcactcatttgcacatgggcat

SEQ ID NO: 487286 - DNA, 25 bp, Mus musculus
gaggcactgaaacgtgtcttcatca

SEQ ID NO: 487287 - DNA, 25 bp, Mus musculus
gaggcactgaaaggtgtcttcatca

SEQ ID NO: 487288 - DNA, 25 bp, Mus musculus
gaggcactgacaaccaataaattaa

SEQ ID NO: 487289 - DNA, 25 bp, Mus musculus
gaggcactgacacccgttcctgatt

SEQ ID NO: 487290 - DNA, 25 bp, Mus musculus
gaggcactgacagccgttcctgatt

SEQ ID NO: 487291 - DNA, 25 bp, Mus musculus
gaggcactgacatccaataaattaa

SEQ ID NO: 487292 - DNA, 25 bp, Mus musculus
gaggcactgactacaataaagtcta

SEQ ID NO: 487293 - DNA, 25 bp, Mus musculus
gaggcactgacttcaataaagtcta

SEQ ID NO: 487294 - DNA, 25 bp, Mus musculus
gaggcactgatcagcttgaccacca

SEQ ID NO: 487295 - DNA, 25 bp, Mus musculus
gaggcactgatctgcttgaccacca

SEQ ID NO: 487296 - DNA, 25 bp, Mus musculus
gaggcactgcagaagcagcccttgg

SEQ ID NO: 487297 - DNA, 25 bp, Mus musculus
gaggcactgcagtagcagcccttgg

SEQ ID NO: 487298 - DNA, 25 bp, Mus musculus
gaggcactggacaaagatccttctg

SEQ ID NO: 487299 - DNA, 25 bp, Mus musculus
gaggcactggactaagatccttctg

SEQ ID NO: 487300 - DNA, 25 bp, Mus musculus
gaggcactggatctgaccctgagca

SEQ ID NO: 487301 - DNA, 25 bp, Mus musculus
gaggcactggatgtgaccctgagca

SEQ ID NO: 487302 - DNA, 25 bp, Mus musculus
gaggcactggcaatgtctctgctcc

SEQ ID NO: 487303 - DNA, 25 bp, Mus musculus
gaggcactggcattgtctctgctcc

SEQ ID NO: 487304 - DNA, 25 bp, Mus musculus
gaggcactgtaacaacaccctggat

SEQ ID NO: 487305 - DNA, 25 bp, Mus musculus
gaggcactgtaagaacaccctggat

SEQ ID NO: 487306 - DNA, 25 bp, Mus musculus
gaggcactgtcgcaagtcacctact

SEQ ID NO: 487307 - DNA, 25 bp, Mus musculus
gaggcactgtcggaagtcacctact

SEQ ID NO: 487308 - DNA, 25 bp, Mus musculus
gaggcactgtggctgtttctccatt

SEQ ID NO: 487309 - DNA, 25 bp, Mus musculus
gaggcactgtgggtgtttctccatt

SEQ ID NO: 487310 - DNA, 25 bp, Mus musculus
gaggcactgtgtcttggtgttttat

SEQ ID NO: 487311 - DNA, 25 bp, Mus musculus
gaggcactgtgtgttggtgttttat

SEQ ID NO: 487312 - DNA, 25 bp, Mus musculus
gaggcacttaacacatttcagtttg

SEQ ID NO: 487313 - DNA, 25 bp, Mus musculus
gaggcacttaacctgcgccgacgaa

SEQ ID NO: 487314 - DNA, 25 bp, Mus musculus
gaggcacttaacgtgcgccgacgaa

SEQ ID NO: 487315 - DNA, 25 bp, Mus musculus
gaggcacttaactcatttcagtttg

SEQ ID NO: 487316 - DNA, 25 bp, Mus musculus
gaggcacttaatatgatcttttatt

SEQ ID NO: 487317 - DNA, 25 bp, Mus musculus
gaggcacttaatttgatcttttatt

SEQ ID NO: 487318 - DNA, 25 bp, Mus musculus
gaggcacttaccacaacaagtcctt

SEQ ID NO: 487319 - DNA, 25 bp, Mus musculus
gaggcacttacctcaacaagtcctt

SEQ ID NO: 487320 - DNA, 25 bp, Mus musculus
gaggcacttcagaccagagggtttg

SEQ ID NO: 487321 - DNA, 25 bp, Mus musculus
gaggcacttcagtccagagggtttg

SEQ ID NO: 487322 - DNA, 25 bp, Mus musculus
gaggcacttcatctaaagctactag

SEQ ID NO: 487323 - DNA, 25 bp, Mus musculus
gaggcacttcatgtaaagctactag

SEQ ID NO: 487324 - DNA, 25 bp, Mus musculus
gaggcacttgctaacaggctgttca

SEQ ID NO: 487325 - DNA, 25 bp, Mus musculus
gaggcacttgcttacaggctgttca

SEQ ID NO: 487326 - DNA, 25 bp, Mus musculus
gaggcactttctctttaccatgacc

SEQ ID NO: 487327 - DNA, 25 bp, Mus musculus
gaggcactttctgtttaccatgacc

SEQ ID NO: 487328 - DNA, 25 bp, Mus musculus
gaggcacttttgaattcatttggac

SEQ ID NO: 487329 - DNA, 25 bp, Mus musculus
gaggcacttttgtattcatttggac

SEQ ID NO: 487330 - DNA, 25 bp, Mus musculus
gaggcagaaacaaagcacccaagtc

SEQ ID NO: 487331 - DNA, 25 bp, Mus musculus
gaggcagaaacatagcacccaagtc

SEQ ID NO: 487332 - DNA, 25 bp, Mus musculus
gaggcagaaaccataaagcccctga

SEQ ID NO: 487333 - DNA, 25 bp, Mus musculus
gaggcagaaaccttaaagcccctga

SEQ ID NO: 487334 - DNA, 25 bp, Mus musculus
gaggcagaaactcatgctcatgttt

SEQ ID NO: 487335 - DNA, 25 bp, Mus musculus
gaggcagaaactgatgctcatgttt

SEQ ID NO: 487336 - DNA, 25 bp, Mus musculus
gaggcagaacataccttggttagaa

SEQ ID NO: 487337 - DNA, 25 bp, Mus musculus
gaggcagaacattccttggttagaa

SEQ ID NO: 487338 - DNA, 25 bp, Mus musculus
gaggcagaactgcactctttgtttt

SEQ ID NO: 487339 - DNA, 25 bp, Mus musculus
gaggcagaactggactctttgtttt

SEQ ID NO: 487340 - DNA, 25 bp, Mus musculus
gaggcagaaggcagcccgctctccg

SEQ ID NO: 487341 - DNA, 25 bp, Mus musculus
gaggcagaaggctgcccgctctccg

SEQ ID NO: 487342 - DNA, 25 bp, Mus musculus
gaggcagaagtaaccagttcatggt

SEQ ID NO: 487343 - DNA, 25 bp, Mus musculus
gaggcagaagtacccagtcactacc

SEQ ID NO: 487344 - DNA, 25 bp, Mus musculus
gaggcagaagtagccagtcactacc

SEQ ID NO: 487345 - DNA, 25 bp, Mus musculus
gaggcagaagtatccagttcatggt

SEQ ID NO: 487346 - DNA, 25 bp, Mus musculus
gaggcagaagttaccatccctacta

SEQ ID NO: 487347 - DNA, 25 bp, Mus musculus
gaggcagaagtttccatccctacta

SEQ ID NO: 487348 - DNA, 25 bp, Mus musculus
gaggcagaatcaccagcattaacat

SEQ ID NO: 487349 - DNA, 25 bp, Mus musculus
gaggcagaatcagcagcattaacat

SEQ ID NO: 487350 - DNA, 25 bp, Mus musculus
gaggcagacacaattccaggccgca

SEQ ID NO: 487351 - DNA, 25 bp, Mus musculus
gaggcagacacatttccaggccgca

SEQ ID NO: 487352 - DNA, 25 bp, Mus musculus
gaggcagacagactgaggcaccaca

SEQ ID NO: 487353 - DNA, 25 bp, Mus musculus
gaggcagacagagtgaggcaccaca

SEQ ID NO: 487354 - DNA, 25 bp, Mus musculus
gaggcagacagtactgtgcagacga

SEQ ID NO: 487355 - DNA, 25 bp, Mus musculus
gaggcagacagttctgtgcagacga

SEQ ID NO: 487356 - DNA, 25 bp, Mus musculus
gaggcagacataacgttgtgtggta

SEQ ID NO: 487357 - DNA, 25 bp, Mus musculus
gaggcagacatatcgttgtgtggta

SEQ ID NO: 487358 - DNA, 25 bp, Mus musculus
gaggcagacccgcaagaagaagcaa

SEQ ID NO: 487359 - DNA, 25 bp, Mus musculus
gaggcagacccggaagaagaagcaa

SEQ ID NO: 487360 - DNA, 25 bp, Mus musculus
gaggcagacctcaaggttaacacaa

SEQ ID NO: 487361 - DNA, 25 bp, Mus musculus
gaggcagacctctaggttaacacaa

SEQ ID NO: 487362 - DNA, 25 bp, Mus musculus
gaggcagacgacatccagtacccgt

SEQ ID NO: 487363 - DNA, 25 bp, Mus musculus
gaggcagacgacttccagtacccgt

SEQ ID NO: 487364 - DNA, 25 bp, Mus musculus
gaggcagacgatatgagcatagata

SEQ ID NO: 487365 - DNA, 25 bp, Mus musculus
gaggcagacgatttgagcatagata

SEQ ID NO: 487366 - DNA, 25 bp, Mus musculus
gaggcagacggaaaccaagactctt

SEQ ID NO: 487367 - DNA, 25 bp, Mus musculus
gaggcagacggataccaagactctt

SEQ ID NO: 487368 - DNA, 25 bp, Mus musculus
gaggcagactacacgcttatgatca

SEQ ID NO: 487369 - DNA, 25 bp, Mus musculus
gaggcagactactcgcttatgatca

SEQ ID NO: 487370 - DNA, 25 bp, Mus musculus
gaggcagactcgacagttcaagagc

SEQ ID NO: 487371 - DNA, 25 bp, Mus musculus
gaggcagactcgtcagttcaagagc

SEQ ID NO: 487372 - DNA, 25 bp, Mus musculus
gaggcagactctcgatcaactgagt

SEQ ID NO: 487373 - DNA, 25 bp, Mus musculus
gaggcagactctggatcaactgagt

SEQ ID NO: 487374 - DNA, 25 bp, Mus musculus
gaggcagacttaactggtaaggcaa

SEQ ID NO: 487375 - DNA, 25 bp, Mus musculus
gaggcagacttacatttttctccag

SEQ ID NO: 487376 - DNA, 25 bp, Mus musculus
gaggcagacttagatttttctccag

SEQ ID NO: 487377 - DNA, 25 bp, Mus musculus
gaggcagacttatctggtaaggcaa

SEQ ID NO: 487378 - DNA, 25 bp, Mus musculus
gaggcagacttcctacatcagggac

SEQ ID NO: 487379 - DNA, 25 bp, Mus musculus
gaggcagacttcgtacatcagggac

SEQ ID NO: 487380 - DNA, 25 bp, Mus musculus
gaggcagagaagctgtgtccacccc

SEQ ID NO: 487381 - DNA, 25 bp, Mus musculus
gaggcagagaaggtgtgtccacccc

SEQ ID NO: 487382 - DNA, 25 bp, Mus musculus
gaggcagagaccaagacatgtcagt

SEQ ID NO: 487383 - DNA, 25 bp, Mus musculus
gaggcagagacctagacatgtcagt

SEQ ID NO: 487384 - DNA, 25 bp, Mus musculus
gaggcagagatgatcgcccttgctg

SEQ ID NO: 487385 - DNA, 25 bp, Mus musculus
gaggcagagatgttcgcccttgctg

SEQ ID NO: 487386 - DNA, 25 bp, Mus musculus
gaggcagagctacgaaattccccag

SEQ ID NO: 487387 - DNA, 25 bp, Mus musculus
gaggcagagctaggaaattccccag

SEQ ID NO: 487388 - DNA, 25 bp, Mus musculus
gaggcagagctcatcctgaaaaaat

SEQ ID NO: 487389 - DNA, 25 bp, Mus musculus
gaggcagagctcttcctgaaaaaat

SEQ ID NO: 487390 - DNA, 25 bp, Mus musculus
gaggcagagcttaaccagacagcat

SEQ ID NO: 487391 - DNA, 25 bp, Mus musculus
gaggcagagctttaccagacagcat

SEQ ID NO: 487392 - DNA, 25 bp, Mus musculus
gaggcagaggctctcagacgtcttt

SEQ ID NO: 487393 - DNA, 25 bp, Mus musculus
gaggcagaggctgtcagacgtcttt

SEQ ID NO: 487394 - DNA, 25 bp, Mus musculus
gaggcagagtccacgtatgatcagc

SEQ ID NO: 487395 - DNA, 25 bp, Mus musculus
gaggcagagtcctcgtatgatcagc

SEQ ID NO: 487396 - DNA, 25 bp, Mus musculus
gaggcagagtctatcactaatcaag

SEQ ID NO: 487397 - DNA, 25 bp, Mus musculus
gaggcagagtctttcactaatcaag

SEQ ID NO: 487398 - DNA, 25 bp, Mus musculus
gaggcagagtgcattactagtgtgt

SEQ ID NO: 487399 - DNA, 25 bp, Mus musculus
gaggcagagtgctttactagtgtgt

SEQ ID NO: 487400 - DNA, 25 bp, Mus musculus
gaggcagagttcacactagaaccta

SEQ ID NO: 487401 - DNA, 25 bp, Mus musculus
gaggcagagttccagacagaattat

SEQ ID NO: 487402 - DNA, 25 bp, Mus musculus
gaggcagagttcgagacagaattat

SEQ ID NO: 487403 - DNA, 25 bp, Mus musculus
gaggcagagttctcactagaaccta

SEQ ID NO: 487404 - DNA, 25 bp, Mus musculus
gaggcagatatccagcagttagctt

SEQ ID NO: 487405 - DNA, 25 bp, Mus musculus
gaggcagatatcgagcagttagctt

SEQ ID NO: 487406 - DNA, 25 bp, Mus musculus
gaggcagatcaccttgggtccctga

SEQ ID NO: 487407 - DNA, 25 bp, Mus musculus
gaggcagatcacgttgggtccctga

SEQ ID NO: 487408 - DNA, 25 bp, Mus musculus
gaggcagatctaattatggtaccgg

SEQ ID NO: 487409 - DNA, 25 bp, Mus musculus
gaggcagatctatttatggtaccgg

SEQ ID NO: 487410 - DNA, 25 bp, Mus musculus
gaggcagatctgagatttgcttcta

SEQ ID NO: 487411 - DNA, 25 bp, Mus musculus
gaggcagatctgtgatttgcttcta

SEQ ID NO: 487412 - DNA, 25 bp, Mus musculus
gaggcagatgatcacagccaactct

SEQ ID NO: 487413 - DNA, 25 bp, Mus musculus
gaggcagatgatgacagccaactct

SEQ ID NO: 487414 - DNA, 25 bp, Mus musculus
gaggcagatgctaaccagcttctca

SEQ ID NO: 487415 - DNA, 25 bp, Mus musculus
gaggcagatgcttaccagcttctca

SEQ ID NO: 487416 - DNA, 25 bp, Mus musculus
gaggcagattataaccacacagaac

SEQ ID NO: 487417 - DNA, 25 bp, Mus musculus
gaggcagattatctttagatcttac

SEQ ID NO: 487418 - DNA, 25 bp, Mus musculus
gaggcagattatgtttagatcttac

SEQ ID NO: 487419 - DNA, 25 bp, Mus musculus
gaggcagattattaccacacagaac

SEQ ID NO: 487420 - DNA, 25 bp, Mus musculus
gaggcagattgtacagacgcatttc

SEQ ID NO: 487421 - DNA, 25 bp, Mus musculus
gaggcagattgttcagacgcatttc

SEQ ID NO: 487422 - DNA, 25 bp, Mus musculus
gaggcagcaagcacctttcatatac

SEQ ID NO: 487423 - DNA, 25 bp, Mus musculus
gaggcagcaagctcctttcatatac

SEQ ID NO: 487424 - DNA, 25 bp, Mus musculus
gaggcagcaatgattcttcctttca

SEQ ID NO: 487425 - DNA, 25 bp, Mus musculus
gaggcagcaatgtttcttcctttca

SEQ ID NO: 487426 - DNA, 25 bp, Mus musculus
gaggcagcacatctggcttgttctt

SEQ ID NO: 487427 - DNA, 25 bp, Mus musculus
gaggcagcacatgtggcttgttctt

SEQ ID NO: 487428 - DNA, 25 bp, Mus musculus
gaggcagcactacaaaacttgcgaa

SEQ ID NO: 487429 - DNA, 25 bp, Mus musculus
gaggcagcactagaaaacttgcgaa

SEQ ID NO: 487430 - DNA, 25 bp, Mus musculus
gaggcagcactcagagttgtccagt

SEQ ID NO: 487431 - DNA, 25 bp, Mus musculus
gaggcagcactctgagttgtccagt

SEQ ID NO: 487432 - DNA, 25 bp, Mus musculus
gaggcagcacttagcaaccatattt

SEQ ID NO: 487433 - DNA, 25 bp, Mus musculus
gaggcagcactttgcaaccatattt

SEQ ID NO: 487434 - DNA, 25 bp, Mus musculus
gaggcagcagaaagacttgggtcta

SEQ ID NO: 487435 - DNA, 25 bp, Mus musculus
gaggcagcagaatgacttgggtcta

SEQ ID NO: 487436 - DNA, 25 bp, Mus musculus
gaggcagcagagaacttacacagat

SEQ ID NO: 487437 - DNA, 25 bp, Mus musculus
gaggcagcagagtacttacacagat

SEQ ID NO: 487438 - DNA, 25 bp, Mus musculus
gaggcagcaggcacgcaggtaaatc

SEQ ID NO: 487439 - DNA, 25 bp, Mus musculus
gaggcagcaggctcgcaggtaaatc

SEQ ID NO: 487440 - DNA, 25 bp, Mus musculus
gaggcagcaggtacatgaatgagtt

SEQ ID NO: 487441 - DNA, 25 bp, Mus musculus
gaggcagcaggttcatgaatgagtt

SEQ ID NO: 487442 - DNA, 25 bp, Mus musculus
gaggcagcatctcaacaaagatctg

SEQ ID NO: 487443 - DNA, 25 bp, Mus musculus
gaggcagcatctgaacaaagatctg

SEQ ID NO: 487444 - DNA, 25 bp, Mus musculus
gaggcagcatgtacttgtaattcta

SEQ ID NO: 487445 - DNA, 25 bp, Mus musculus
gaggcagcatgttcttgtaattcta

SEQ ID NO: 487446 - DNA, 25 bp, Mus musculus
gaggcagcattgatacccaaggcac

SEQ ID NO: 487447 - DNA, 25 bp, Mus musculus
gaggcagcattgttacccaaggcac

SEQ ID NO: 487448 - DNA, 25 bp, Mus musculus
gaggcagccaacagtggttactcct

SEQ ID NO: 487449 - DNA, 25 bp, Mus musculus
gaggcagccaacatggcacacgcgt

SEQ ID NO: 487450 - DNA, 25 bp, Mus musculus
gaggcagccaactgtggttactcct

SEQ ID NO: 487451 - DNA, 25 bp, Mus musculus
gaggcagccaacttggcacacgcgt

SEQ ID NO: 487452 - DNA, 25 bp, Mus musculus
gaggcagccacgaccctggaatgtt

SEQ ID NO: 487453 - DNA, 25 bp, Mus musculus
gaggcagccacgataacacctggat

SEQ ID NO: 487454 - DNA, 25 bp, Mus musculus
gaggcagccacgtccctggaatgtt

SEQ ID NO: 487455 - DNA, 25 bp, Mus musculus
gaggcagccacgttaacacctggat

SEQ ID NO: 487456 - DNA, 25 bp, Mus musculus
gaggcagccagcaggtctcagcagc

SEQ ID NO: 487457 - DNA, 25 bp, Mus musculus
gaggcagccagcataacatttgtaa

SEQ ID NO: 487458 - DNA, 25 bp, Mus musculus
gaggcagccagctggtctcagcagc

SEQ ID NO: 487459 - DNA, 25 bp, Mus musculus
gaggcagccagcttaacatttgtaa

SEQ ID NO: 487460 - DNA, 25 bp, Mus musculus
gaggcagccagtcatcacatgcaga

SEQ ID NO: 487461 - DNA, 25 bp, Mus musculus
gaggcagccagtgatcacatgcaga

SEQ ID NO: 487462 - DNA, 25 bp, Mus musculus
gaggcagccatcaggctttgtcaag

SEQ ID NO: 487463 - DNA, 25 bp, Mus musculus
gaggcagccatctggctttgtcaag

SEQ ID NO: 487464 - DNA, 25 bp, Mus musculus
gaggcagcccgtctgtgtgaaatca

SEQ ID NO: 487465 - DNA, 25 bp, Mus musculus
gaggcagcccgtgtgtgtgaaatca

SEQ ID NO: 487466 - DNA, 25 bp, Mus musculus
gaggcagccgtgaacagtctccgca

SEQ ID NO: 487467 - DNA, 25 bp, Mus musculus
gaggcagccgtgtacagtctccgca

SEQ ID NO: 487468 - DNA, 25 bp, Mus musculus
gaggcagcctaaaatctggtttgaa

SEQ ID NO: 487469 - DNA, 25 bp, Mus musculus
gaggcagcctaatatctggtttgaa

SEQ ID NO: 487470 - DNA, 25 bp, Mus musculus
gaggcagcctttagtatacattccc

SEQ ID NO: 487471 - DNA, 25 bp, Mus musculus
gaggcagccttttgtatacattccc

SEQ ID NO: 487472 - DNA, 25 bp, Mus musculus
gaggcagcgaacagccccagcatta

SEQ ID NO: 487473 - DNA, 25 bp, Mus musculus
gaggcagcgaactgccccagcatta

SEQ ID NO: 487474 - DNA, 25 bp, Mus musculus
gaggcagcgatcaccggcagcatca

SEQ ID NO: 487475 - DNA, 25 bp, Mus musculus
gaggcagcgatctccggcagcatca

SEQ ID NO: 487476 - DNA, 25 bp, Mus musculus
gaggcagcgctaatcatcaccagaa

SEQ ID NO: 487477 - DNA, 25 bp, Mus musculus
gaggcagcgctattcatcaccagaa

SEQ ID NO: 487478 - DNA, 25 bp, Mus musculus
gaggcagctcaccaacatgtgcgat

SEQ ID NO: 487479 - DNA, 25 bp, Mus musculus
gaggcagctcacgaacatgtgcgat

SEQ ID NO: 487480 - DNA, 25 bp, Mus musculus
gaggcagctctgaacagcagcttaa

SEQ ID NO: 487481 - DNA, 25 bp, Mus musculus
gaggcagctctgtacagcagcttaa

SEQ ID NO: 487482 - DNA, 25 bp, Mus musculus
gaggcagctgaaaagcacttcccaa

SEQ ID NO: 487483 - DNA, 25 bp, Mus musculus
gaggcagctgaatagcacttcccaa

SEQ ID NO: 487484 - DNA, 25 bp, Mus musculus
gaggcagctgcacacatgagccttc

SEQ ID NO: 487485 - DNA, 25 bp, Mus musculus
gaggcagctgcagacatgagccttc

SEQ ID NO: 487486 - DNA, 25 bp, Mus musculus
gaggcagctggcaattttcacaaag

SEQ ID NO: 487487 - DNA, 25 bp, Mus musculus
gaggcagctggctattttcacaaag

SEQ ID NO: 487488 - DNA, 25 bp, Mus musculus
gaggcagcttctccggactggcctt

SEQ ID NO: 487489 - DNA, 25 bp, Mus musculus
gaggcagcttctgcggactggcctt

SEQ ID NO: 487490 - DNA, 25 bp, Mus musculus
gaggcagcttggaacatatcgactt

SEQ ID NO: 487491 - DNA, 25 bp, Mus musculus
gaggcagcttggtacatatcgactt

SEQ ID NO: 487492 - DNA, 25 bp, Mus musculus
gaggcagctttcaaaacccctgaga

SEQ ID NO: 487493 - DNA, 25 bp, Mus musculus
gaggcagctttctaaacccctgaga

SEQ ID NO: 487494 - DNA, 25 bp, Mus musculus
gaggcaggaaaaatgtcacaggttt

SEQ ID NO: 487495 - DNA, 25 bp, Mus musculus
gaggcaggaaaattgtcacaggttt

SEQ ID NO: 487496 - DNA, 25 bp, Mus musculus
gaggcaggaagcaccatagaacttt

SEQ ID NO: 487497 - DNA, 25 bp, Mus musculus
gaggcaggaagctccatagaacttt

SEQ ID NO: 487498 - DNA, 25 bp, Mus musculus
gaggcaggacacactggccctcagg

SEQ ID NO: 487499 - DNA, 25 bp, Mus musculus
gaggcaggacactctggccctcagg

SEQ ID NO: 487500 - DNA, 25 bp, Mus musculus
gaggcaggacataccatgcagagcc

SEQ ID NO: 487501 - DNA, 25 bp, Mus musculus
gaggcaggacatacgtttgagttca

SEQ ID NO: 487502 - DNA, 25 bp, Mus musculus
gaggcaggacatcgctgtcatttta

SEQ ID NO: 487503 - DNA, 25 bp, Mus musculus
gaggcaggacatggctgtcatttta

SEQ ID NO: 487504 - DNA, 25 bp, Mus musculus
gaggcaggacattccatgcagagcc

SEQ ID NO: 487505 - DNA, 25 bp, Mus musculus
gaggcaggacattcgtttgagttca

SEQ ID NO: 487506 - DNA, 25 bp, Mus musculus
gaggcaggaccaagccatctgagtt

SEQ ID NO: 487507 - DNA, 25 bp, Mus musculus
gaggcaggaccatgccatctgagtt

SEQ ID NO: 487508 - DNA, 25 bp, Mus musculus
gaggcaggacctcctatggcttcag

SEQ ID NO: 487509 - DNA, 25 bp, Mus musculus
gaggcaggacctgctatggcttcag

SEQ ID NO: 487510 - DNA, 25 bp, Mus musculus
gaggcaggactccaatatgcccttc

SEQ ID NO: 487511 - DNA, 25 bp, Mus musculus
gaggcaggactcgaatatgcccttc

SEQ ID NO: 487512 - DNA, 25 bp, Mus musculus
gaggcaggacttctttgcatacagt

SEQ ID NO: 487513 - DNA, 25 bp, Mus musculus
gaggcaggacttgtttgcatacagt

SEQ ID NO: 487514 - DNA, 25 bp, Mus musculus
gaggcaggagaaatccttgagtaca

SEQ ID NO: 487515 - DNA, 25 bp, Mus musculus
gaggcaggagaattccttgagtaca

SEQ ID NO: 487516 - DNA, 25 bp, Mus musculus
gaggcaggagcaaagcacccaggct

SEQ ID NO: 487517 - DNA, 25 bp, Mus musculus
gaggcaggagcatagcacccaggct

SEQ ID NO: 487518 - DNA, 25 bp, Mus musculus
gaggcaggcaaaacaccagcacggc

SEQ ID NO: 487519 - DNA, 25 bp, Mus musculus
gaggcaggcaaatcaccagcacggc

SEQ ID NO: 487520 - DNA, 25 bp, Mus musculus
gaggcaggcaggaccttggaatccc

SEQ ID NO: 487521 - DNA, 25 bp, Mus musculus
gaggcaggcaggatgctacctttac

SEQ ID NO: 487522 - DNA, 25 bp, Mus musculus
gaggcaggcaggctgatttctgaat

SEQ ID NO: 487523 - DNA, 25 bp, Mus musculus
gaggcaggcagggtgatttctgaat

SEQ ID NO: 487524 - DNA, 25 bp, Mus musculus
gaggcaggcaggtccttggaatccc

SEQ ID NO: 487525 - DNA, 25 bp, Mus musculus
gaggcaggcaggttgctacctttac

SEQ ID NO: 487526 - DNA, 25 bp, Mus musculus
gaggcaggcatgcagttctcttcac

SEQ ID NO: 487527 - DNA, 25 bp, Mus musculus
gaggcaggcatggagttctcttcac

SEQ ID NO: 487528 - DNA, 25 bp, Mus musculus
gaggcaggccggacaaacaagagct

SEQ ID NO: 487529 - DNA, 25 bp, Mus musculus
gaggcaggccggtcaaacaagagct

SEQ ID NO: 487530 - DNA, 25 bp, Mus musculus
gaggcaggcggaaccacagcgcttt

SEQ ID NO: 487531 - DNA, 25 bp, Mus musculus
gaggcaggcggatccacagcgcttt

SEQ ID NO: 487532 - DNA, 25 bp, Mus musculus
gaggcaggcggtctgatatctcaaa

SEQ ID NO: 487533 - DNA, 25 bp, Mus musculus
gaggcaggcggtgtgatatctcaaa

SEQ ID NO: 487534 - DNA, 25 bp, Mus musculus
gaggcaggctgacacaacagctcca

SEQ ID NO: 487535 - DNA, 25 bp, Mus musculus
gaggcaggctgagacaacagctcca

SEQ ID NO: 487536 - DNA, 25 bp, Mus musculus
gaggcagggaaccaggcacccaaac

SEQ ID NO: 487537 - DNA, 25 bp, Mus musculus
gaggcagggaacgaggcacccaaac

SEQ ID NO: 487538 - DNA, 25 bp, Mus musculus
gaggcagggaccaggagccatttcc

SEQ ID NO: 487539 - DNA, 25 bp, Mus musculus
gaggcagggacctggagccatttcc

SEQ ID NO: 487540 - DNA, 25 bp, Mus musculus
gaggcagggacgacctctatgtctc

SEQ ID NO: 487541 - DNA, 25 bp, Mus musculus
gaggcagggacgtcctctatgtctc

SEQ ID NO: 487542 - DNA, 25 bp, Mus musculus
gaggcagggccacctcttgtgctct

SEQ ID NO: 487543 - DNA, 25 bp, Mus musculus
gaggcagggccagctcttgtgctct

SEQ ID NO: 487544 - DNA, 25 bp, Mus musculus
gaggcagggcctagtgacatcacta

SEQ ID NO: 487545 - DNA, 25 bp, Mus musculus
gaggcagggcctcatgcatatcctg

SEQ ID NO: 487546 - DNA, 25 bp, Mus musculus
gaggcagggcctgatgcatatcctg

SEQ ID NO: 487547 - DNA, 25 bp, Mus musculus
gaggcagggccttgtgacatcacta

SEQ ID NO: 487548 - DNA, 25 bp, Mus musculus
gaggcagggtcgctagatccttcct

SEQ ID NO: 487549 - DNA, 25 bp, Mus musculus
gaggcagggtcggtagatccttcct

SEQ ID NO: 487550 - DNA, 25 bp, Mus musculus
gaggcaggtagtccttttgcctttt

SEQ ID NO: 487551 - DNA, 25 bp, Mus musculus
gaggcaggtagtgcttttgcctttt

SEQ ID NO: 487552 - DNA, 25 bp, Mus musculus
gaggcaggtccaagctaagcttcca

SEQ ID NO: 487553 - DNA, 25 bp, Mus musculus
gaggcaggtccatgctaagcttcca

SEQ ID NO: 487554 - DNA, 25 bp, Mus musculus
gaggcaggtgttcgctacacattca

SEQ ID NO: 487555 - DNA, 25 bp, Mus musculus
gaggcaggtgttggctacacattca

SEQ ID NO: 487556 - DNA, 25 bp, Mus musculus
gaggcaggttaacttacatggtatt

SEQ ID NO: 487557 - DNA, 25 bp, Mus musculus
gaggcaggttaagttacatggtatt

SEQ ID NO: 487558 - DNA, 25 bp, Mus musculus
gaggcagtaccaacagctgcacctt

SEQ ID NO: 487559 - DNA, 25 bp, Mus musculus
gaggcagtaccatcagctgcacctt

SEQ ID NO: 487560 - DNA, 25 bp, Mus musculus
gaggcagtacttccctaatgatgaa

SEQ ID NO: 487561 - DNA, 25 bp, Mus musculus
gaggcagtacttgcctaatgatgaa

SEQ ID NO: 487562 - DNA, 25 bp, Mus musculus
gaggcagtatttccttacatgataa

SEQ ID NO: 487563 - DNA, 25 bp, Mus musculus
gaggcagtatttgcttacatgataa

SEQ ID NO: 487564 - DNA, 25 bp, Mus musculus
gaggcagtcaaaactgtgagtttga

SEQ ID NO: 487565 - DNA, 25 bp, Mus musculus
gaggcagtcaaaccgaatgctcagg

SEQ ID NO: 487566 - DNA, 25 bp, Mus musculus
gaggcagtcaaagcgaatgctcagg

SEQ ID NO: 487567 - DNA, 25 bp, Mus musculus
gaggcagtcaaatctgtgagtttga

SEQ ID NO: 487568 - DNA, 25 bp, Mus musculus
gaggcagtcacacccataagctatt

SEQ ID NO: 487569 - DNA, 25 bp, Mus musculus
gaggcagtcacagccataagctatt

SEQ ID NO: 487570 - DNA, 25 bp, Mus musculus
gaggcagtcagtccacatcacagaa

SEQ ID NO: 487571 - DNA, 25 bp, Mus musculus
gaggcagtcagtgcacatcacagaa

SEQ ID NO: 487572 - DNA, 25 bp, Mus musculus
gaggcagtcctgagcttgggcacat

SEQ ID NO: 487573 - DNA, 25 bp, Mus musculus
gaggcagtcctgatatccgaaggct

SEQ ID NO: 487574 - DNA, 25 bp, Mus musculus
gaggcagtcctgtgcttgggcacat

SEQ ID NO: 487575 - DNA, 25 bp, Mus musculus
gaggcagtcctgttatccgaaggct

SEQ ID NO: 487576 - DNA, 25 bp, Mus musculus
gaggcagtccttcagttgagatttc

SEQ ID NO: 487577 - DNA, 25 bp, Mus musculus
gaggcagtccttgagttgagatttc

SEQ ID NO: 487578 - DNA, 25 bp, Mus musculus
gaggcagtctgtaggtagatgctcc

SEQ ID NO: 487579 - DNA, 25 bp, Mus musculus
gaggcagtctgttggtagatgctcc

SEQ ID NO: 487580 - DNA, 25 bp, Mus musculus
gaggcagtgatactcccacaggaga

SEQ ID NO: 487581 - DNA, 25 bp, Mus musculus
gaggcagtgatagtcccacaggaga

SEQ ID NO: 487582 - DNA, 25 bp, Mus musculus
gaggcagtgcatatcaccagtcaac

SEQ ID NO: 487583 - DNA, 25 bp, Mus musculus
gaggcagtgcatttcaccagtcaac

SEQ ID NO: 487584 - DNA, 25 bp, Mus musculus
gaggcagtgccaatgaacaagctgt

SEQ ID NO: 487585 - DNA, 25 bp, Mus musculus
gaggcagtgccattgaacaagctgt

SEQ ID NO: 487586 - DNA, 25 bp, Mus musculus
gaggcagtgcgtcaacaggccataa

SEQ ID NO: 487587 - DNA, 25 bp, Mus musculus
gaggcagtgcgtgaacaggccataa

SEQ ID NO: 487588 - DNA, 25 bp, Mus musculus
gaggcagtgggacttattcctgtat

SEQ ID NO: 487589 - DNA, 25 bp, Mus musculus
gaggcagtgggagttattcctgtat

SEQ ID NO: 487590 - DNA, 25 bp, Mus musculus
gaggcagtgtatacaaccttttgtt

SEQ ID NO: 487591 - DNA, 25 bp, Mus musculus
gaggcagtgtattcaaccttttgtt

SEQ ID NO: 487592 - DNA, 25 bp, Mus musculus
gaggcagtgtgtccttctccatcca

SEQ ID NO: 487593 - DNA, 25 bp, Mus musculus
gaggcagtgtgtgcttctccatcca

SEQ ID NO: 487594 - DNA, 25 bp, Mus musculus
gaggcagttacactattgaatacat

SEQ ID NO: 487595 - DNA, 25 bp, Mus musculus
gaggcagttacagtattgaatacat

SEQ ID NO: 487596 - DNA, 25 bp, Mus musculus
gaggcagttactcaacccttgggct

SEQ ID NO: 487597 - DNA, 25 bp, Mus musculus
gaggcagttactgaacccttgggct

SEQ ID NO: 487598 - DNA, 25 bp, Mus musculus
gaggcagttatgacagcactaaaca

SEQ ID NO: 487599 - DNA, 25 bp, Mus musculus
gaggcagttatgtcagcactaaaca

SEQ ID NO: 487600 - DNA, 25 bp, Mus musculus
gaggcagttattatacatacataca

SEQ ID NO: 487601 - DNA, 25 bp, Mus musculus
gaggcagttattttacatacataca

SEQ ID NO: 487602 - DNA, 25 bp, Mus musculus
gaggcagtttttagtaaactcttag

SEQ ID NO: 487603 - DNA, 25 bp, Mus musculus
gaggcagtttttccaagcagagcaa

SEQ ID NO: 487604 - DNA, 25 bp, Mus musculus
gaggcagtttttgcaagcagagcaa

SEQ ID NO: 487605 - DNA, 25 bp, Mus musculus
gaggcagttttttgtaaactcttag

SEQ ID NO: 487606 - DNA, 25 bp, Mus musculus
gaggcataagacacacatctaaatt

SEQ ID NO: 487607 - DNA, 25 bp, Mus musculus
gaggcataagactcacatctaaatt

SEQ ID NO: 487608 - DNA, 25 bp, Mus musculus
gaggcataccccaagaagaggctga

SEQ ID NO: 487609 - DNA, 25 bp, Mus musculus
gaggcatacccctagaagaggctga

SEQ ID NO: 487610 - DNA, 25 bp, Mus musculus
gaggcataccctagaacttagtttt

SEQ ID NO: 487611 - DNA, 25 bp, Mus musculus
gaggcatacccttgaacttagtttt

SEQ ID NO: 487612 - DNA, 25 bp, Mus musculus
gaggcatacttaatggtccacatgg

SEQ ID NO: 487613 - DNA, 25 bp, Mus musculus
gaggcatacttacttcaatcctgaa

SEQ ID NO: 487614 - DNA, 25 bp, Mus musculus
gaggcatacttagttcaatcctgaa

SEQ ID NO: 487615 - DNA, 25 bp, Mus musculus
gaggcatacttattggtccacatgg

SEQ ID NO: 487616 - DNA, 25 bp, Mus musculus
gaggcatagcaaattccaagacagc

SEQ ID NO: 487617 - DNA, 25 bp, Mus musculus
gaggcatagcaatttccaagacagc

SEQ ID NO: 487618 - DNA, 25 bp, Mus musculus
gaggcataggcacgcttgtttctga

SEQ ID NO: 487619 - DNA, 25 bp, Mus musculus
gaggcataggcaggcttgtttctga

SEQ ID NO: 487620 - DNA, 25 bp, Mus musculus
gaggcatagtctcggtcgatttcac

SEQ ID NO: 487621 - DNA, 25 bp, Mus musculus
gaggcatagtctctataactgcatg

SEQ ID NO: 487622 - DNA, 25 bp, Mus musculus
gaggcatagtctgggtcgatttcac

SEQ ID NO: 487623 - DNA, 25 bp, Mus musculus
gaggcatagtctgtataactgcatg

SEQ ID NO: 487624 - DNA, 25 bp, Mus musculus
gaggcatatacaaatttattctccc

SEQ ID NO: 487625 - DNA, 25 bp, Mus musculus
gaggcatatacatatttattctccc

SEQ ID NO: 487626 - DNA, 25 bp, Mus musculus
gaggcatatgcacgtatctgtgcaa

SEQ ID NO: 487627 - DNA, 25 bp, Mus musculus
gaggcatatgcaggtatctgtgcaa

SEQ ID NO: 487628 - DNA, 25 bp, Mus musculus
gaggcatatgccagtatcggtgcat

SEQ ID NO: 487629 - DNA, 25 bp, Mus musculus
gaggcatatgcctgtatcggtgcat

SEQ ID NO: 487630 - DNA, 25 bp, Mus musculus
gaggcatatgcgctgtcatttttcc

SEQ ID NO: 487631 - DNA, 25 bp, Mus musculus
gaggcatatgcggtgtcatttttcc

SEQ ID NO: 487632 - DNA, 25 bp, Mus musculus
gaggcatcaactcccagtgccaacg

SEQ ID NO: 487633 - DNA, 25 bp, Mus musculus
gaggcatcaactgccagtgccaacg

SEQ ID NO: 487634 - DNA, 25 bp, Mus musculus
gaggcatcaattatcacagacttat

SEQ ID NO: 487635 - DNA, 25 bp, Mus musculus
gaggcatcaattttcacagacttat

SEQ ID NO: 487636 - DNA, 25 bp, Mus musculus
gaggcatcacagagcccgggaagct

SEQ ID NO: 487637 - DNA, 25 bp, Mus musculus
gaggcatcacagtgcccgggaagct

SEQ ID NO: 487638 - DNA, 25 bp, Mus musculus
gaggcatcagaaatgcattcacgta

SEQ ID NO: 487639 - DNA, 25 bp, Mus musculus
gaggcatcagaattgcattcacgta

SEQ ID NO: 487640 - DNA, 25 bp, Mus musculus
gaggcatcagatagcgtgtctagta

SEQ ID NO: 487641 - DNA, 25 bp, Mus musculus
gaggcatcagattgcgtgtctagta

SEQ ID NO: 487642 - DNA, 25 bp, Mus musculus
gaggcatcaggcagtgttcatctca

SEQ ID NO: 487643 - DNA, 25 bp, Mus musculus
gaggcatcaggctgtgttcatctca

SEQ ID NO: 487644 - DNA, 25 bp, Mus musculus
gaggcatcagtgacttcagtagacc

SEQ ID NO: 487645 - DNA, 25 bp, Mus musculus
gaggcatcagtgtcttcagtagacc

SEQ ID NO: 487646 - DNA, 25 bp, Mus musculus
gaggcatcagttaccttctatatgt

SEQ ID NO: 487647 - DNA, 25 bp, Mus musculus
gaggcatcagtttccttctatatgt

SEQ ID NO: 487648 - DNA, 25 bp, Mus musculus
gaggcatcatagcaactgagccctg

SEQ ID NO: 487649 - DNA, 25 bp, Mus musculus
gaggcatcataggaactgagccctg

SEQ ID NO: 487650 - DNA, 25 bp, Mus musculus
gaggcatcatgcaccaaattgacaa

SEQ ID NO: 487651 - DNA, 25 bp, Mus musculus
gaggcatcatgctccaaattgacaa

SEQ ID NO: 487652 - DNA, 25 bp, Mus musculus
gaggcatcatggctatccagatcaa

SEQ ID NO: 487653 - DNA, 25 bp, Mus musculus
gaggcatcatgggtatccagatcaa

SEQ ID NO: 487654 - DNA, 25 bp, Mus musculus
gaggcatcatgtccaagaaatctgt

SEQ ID NO: 487655 - DNA, 25 bp, Mus musculus
gaggcatcatgtgcaagaaatctgt

SEQ ID NO: 487656 - DNA, 25 bp, Mus musculus
gaggcatcattcatgtccgtatata

SEQ ID NO: 487657 - DNA, 25 bp, Mus musculus
gaggcatcattcttgtccgtatata

SEQ ID NO: 487658 - DNA, 25 bp, Mus musculus
gaggcatccagtcactcatacaaat

SEQ ID NO: 487659 - DNA, 25 bp, Mus musculus
gaggcatccagtgactcatacaaat

SEQ ID NO: 487660 - DNA, 25 bp, Mus musculus
gaggcatccattatcatgctgatat

SEQ ID NO: 487661 - DNA, 25 bp, Mus musculus
gaggcatccattttcatgctgatat

SEQ ID NO: 487662 - DNA, 25 bp, Mus musculus
gaggcatcccaacttacatatacta

SEQ ID NO: 487663 - DNA, 25 bp, Mus musculus
gaggcatcccaagttacatatacta

SEQ ID NO: 487664 - DNA, 25 bp, Mus musculus
gaggcatcccctctcgagtttgcca

SEQ ID NO: 487665 - DNA, 25 bp, Mus musculus
gaggcatcccctgtcgagtttgcca

SEQ ID NO: 487666 - DNA, 25 bp, Mus musculus
gaggcatccgccaacagaagagcta

SEQ ID NO: 487667 - DNA, 25 bp, Mus musculus
gaggcatccgcctacagaagagcta

SEQ ID NO: 487668 - DNA, 25 bp, Mus musculus
gaggcatccggtctacatgcacgta

SEQ ID NO: 487669 - DNA, 25 bp, Mus musculus
gaggcatccggtgtacatgcacgta

SEQ ID NO: 487670 - DNA, 25 bp, Mus musculus
gaggcatcctcaataagacagtgca

SEQ ID NO: 487671 - DNA, 25 bp, Mus musculus
gaggcatcctcattaagacagtgca

SEQ ID NO: 487672 - DNA, 25 bp, Mus musculus
gaggcatcctgcactgtgtcaacat

SEQ ID NO: 487673 - DNA, 25 bp, Mus musculus
gaggcatcctgctctgtgtcaacat

SEQ ID NO: 487674 - DNA, 25 bp, Mus musculus
gaggcatccttacgactgataggtt

SEQ ID NO: 487675 - DNA, 25 bp, Mus musculus
gaggcatccttaggactgataggtt

SEQ ID NO: 487676 - DNA, 25 bp, Mus musculus
gaggcatcgaggatcacatcgtcgc

SEQ ID NO: 487677 - DNA, 25 bp, Mus musculus
gaggcatcgaggttcacatcgtcgc

SEQ ID NO: 487678 - DNA, 25 bp, Mus musculus
gaggcatcgcaccagagaacattgt

SEQ ID NO: 487679 - DNA, 25 bp, Mus musculus
gaggcatcgcacgagagaacattgt

SEQ ID NO: 487680 - DNA, 25 bp, Mus musculus
gaggcatctaaacaacccagtctga

SEQ ID NO: 487681 - DNA, 25 bp, Mus musculus
gaggcatctaaagaacccagtctga

SEQ ID NO: 487682 - DNA, 25 bp, Mus musculus
gaggcatctaagagatttcagtctt

SEQ ID NO: 487683 - DNA, 25 bp, Mus musculus
gaggcatctaagtgatttcagtctt

SEQ ID NO: 487684 - DNA, 25 bp, Mus musculus
gaggcatctcaaatccactgacaga

SEQ ID NO: 487685 - DNA, 25 bp, Mus musculus
gaggcatctcaattccactgacaga

SEQ ID NO: 487686 - DNA, 25 bp, Mus musculus
gaggcatctctcatcttggacaatt

SEQ ID NO: 487687 - DNA, 25 bp, Mus musculus
gaggcatctctcttcttggacaatt

SEQ ID NO: 487688 - DNA, 25 bp, Mus musculus
gaggcatctgagaacctttcggtca

SEQ ID NO: 487689 - DNA, 25 bp, Mus musculus
gaggcatctgagtacctttcggtca

SEQ ID NO: 487690 - DNA, 25 bp, Mus musculus
gaggcatctgtgaaaccaggttcct

SEQ ID NO: 487691 - DNA, 25 bp, Mus musculus
gaggcatctgtgtaaccaggttcct

SEQ ID NO: 487692 - DNA, 25 bp, Mus musculus
gaggcatcttcgagaccaagtttct

SEQ ID NO: 487693 - DNA, 25 bp, Mus musculus
gaggcatcttcgtgaccaagtttct

SEQ ID NO: 487694 - DNA, 25 bp, Mus musculus
gaggcatgaagaacaggagctcaag

SEQ ID NO: 487695 - DNA, 25 bp, Mus musculus
gaggcatgaagatcaggagctcaag

SEQ ID NO: 487696 - DNA, 25 bp, Mus musculus
gaggcatgacagacacctctgttct

SEQ ID NO: 487697 - DNA, 25 bp, Mus musculus
gaggcatgacagtcacctctgttct

SEQ ID NO: 487698 - DNA, 25 bp, Mus musculus
gaggcatgacgtatgacgcactcca

SEQ ID NO: 487699 - DNA, 25 bp, Mus musculus
gaggcatgacgtttgacgcactcca

SEQ ID NO: 487700 - DNA, 25 bp, Mus musculus
gaggcatgagccagtgtttcagcag

SEQ ID NO: 487701 - DNA, 25 bp, Mus musculus
gaggcatgagcctgtgtttcagcag

SEQ ID NO: 487702 - DNA, 25 bp, Mus musculus
gaggcatgaggtacaccaatgagtt

SEQ ID NO: 487703 - DNA, 25 bp, Mus musculus
gaggcatgaggttcaccaatgagtt

SEQ ID NO: 487704 - DNA, 25 bp, Mus musculus
gaggcatgatggagcgtgatcataa

SEQ ID NO: 487705 - DNA, 25 bp, Mus musculus
gaggcatgatggtgcgtgatcataa

SEQ ID NO: 487706 - DNA, 25 bp, Mus musculus
gaggcatggaaaaatcattcacact

SEQ ID NO: 487707 - DNA, 25 bp, Mus musculus
gaggcatggaaatatcattcacact

SEQ ID NO: 487708 - DNA, 25 bp, Mus musculus
gaggcatggatcacagcatctgtag

SEQ ID NO: 487709 - DNA, 25 bp, Mus musculus
gaggcatggatctcagcatctgtag

SEQ ID NO: 487710 - DNA, 25 bp, Mus musculus
gaggcatggcagctcgtgttcaaca

SEQ ID NO: 487711 - DNA, 25 bp, Mus musculus
gaggcatggcaggtcgtgttcaaca

SEQ ID NO: 487712 - DNA, 25 bp, Mus musculus
gaggcatggccccagagacttcgtc

SEQ ID NO: 487713 - DNA, 25 bp, Mus musculus
gaggcatggcccgagagacttcgtc

SEQ ID NO: 487714 - DNA, 25 bp, Mus musculus
gaggcatggctgagtaccagtaccc

SEQ ID NO: 487715 - DNA, 25 bp, Mus musculus
gaggcatggctgtgtaccagtaccc

SEQ ID NO: 487716 - DNA, 25 bp, Mus musculus
gaggcatggcttacataccttgaag

SEQ ID NO: 487717 - DNA, 25 bp, Mus musculus
gaggcatggctttcataccttgaag

SEQ ID NO: 487718 - DNA, 25 bp, Mus musculus
gaggcatgggaaagaggtaaataca

SEQ ID NO: 487719 - DNA, 25 bp, Mus musculus
gaggcatgggaatgaggtaaataca

SEQ ID NO: 487720 - DNA, 25 bp, Mus musculus
gaggcatgggcgatagctcagccta

SEQ ID NO: 487721 - DNA, 25 bp, Mus musculus
gaggcatgggcgttagctcagccta

SEQ ID NO: 487722 - DNA, 25 bp, Mus musculus
gaggcatgtcaacgcgttttagtat

SEQ ID NO: 487723 - DNA, 25 bp, Mus musculus
gaggcatgtcaaggcgttttagtat

SEQ ID NO: 487724 - DNA, 25 bp, Mus musculus
gaggcatgtccaatgatcaggcttt

SEQ ID NO: 487725 - DNA, 25 bp, Mus musculus
gaggcatgtccattgatcaggcttt

SEQ ID NO: 487726 - DNA, 25 bp, Mus musculus
gaggcatgtctaacctgccatggat

SEQ ID NO: 487727 - DNA, 25 bp, Mus musculus
gaggcatgtctatcctgccatggat

SEQ ID NO: 487728 - DNA, 25 bp, Mus musculus
gaggcatgtgaaactgtccaaaaaa

SEQ ID NO: 487729 - DNA, 25 bp, Mus musculus
gaggcatgtgaatctgtccaaaaaa

SEQ ID NO: 487730 - DNA, 25 bp, Mus musculus
gaggcatgtgacacactccgacagg

SEQ ID NO: 487731 - DNA, 25 bp, Mus musculus
gaggcatgtgactcactccgacagg

SEQ ID NO: 487732 - DNA, 25 bp, Mus musculus
gaggcatgtggcaatggctatagca

SEQ ID NO: 487733 - DNA, 25 bp, Mus musculus
gaggcatgtggctatggctatagca

SEQ ID NO: 487734 - DNA, 25 bp, Mus musculus
gaggcatgtttaccacctacttcca

SEQ ID NO: 487735 - DNA, 25 bp, Mus musculus
gaggcatgtttagcacctacttcca

SEQ ID NO: 487736 - DNA, 25 bp, Mus musculus
gaggcattagctatttctaaagcca

SEQ ID NO: 487737 - DNA, 25 bp, Mus musculus
gaggcattagctttttctaaagcca

SEQ ID NO: 487738 - DNA, 25 bp, Mus musculus
gaggcattagttatcattcaatcct

SEQ ID NO: 487739 - DNA, 25 bp, Mus musculus
gaggcattagttttcattcaatcct

SEQ ID NO: 487740 - DNA, 25 bp, Mus musculus
gaggcattatgactaaatctccagt

SEQ ID NO: 487741 - DNA, 25 bp, Mus musculus
gaggcattatgagtaaatctccagt

SEQ ID NO: 487742 - DNA, 25 bp, Mus musculus
gaggcattatgcaaactgttagtga

SEQ ID NO: 487743 - DNA, 25 bp, Mus musculus
gaggcattatgctaactgttagtga

SEQ ID NO: 487744 - DNA, 25 bp, Mus musculus
gaggcattattcaggtgctctgcga

SEQ ID NO: 487745 - DNA, 25 bp, Mus musculus
gaggcattattctggtgctctgcga

SEQ ID NO: 487746 - DNA, 25 bp, Mus musculus
gaggcattcagtaacctggactcag

SEQ ID NO: 487747 - DNA, 25 bp, Mus musculus
gaggcattcagttacctggactcag

SEQ ID NO: 487748 - DNA, 25 bp, Mus musculus
gaggcattccaaaccatgttcttat

SEQ ID NO: 487749 - DNA, 25 bp, Mus musculus
gaggcattccaatccatgttcttat

SEQ ID NO: 487750 - DNA, 25 bp, Mus musculus
gaggcattccagacctgacatgttt

SEQ ID NO: 487751 - DNA, 25 bp, Mus musculus
gaggcattccagtcctgacatgttt

SEQ ID NO: 487752 - DNA, 25 bp, Mus musculus
gaggcattcccacaactgcatggta

SEQ ID NO: 487753 - DNA, 25 bp, Mus musculus
gaggcattcccagaactgcatggta

SEQ ID NO: 487754 - DNA, 25 bp, Mus musculus
gaggcattccctagcaagcagccaa

SEQ ID NO: 487755 - DNA, 25 bp, Mus musculus
gaggcattccctctcaggatgtgaa

SEQ ID NO: 487756 - DNA, 25 bp, Mus musculus
gaggcattccctgtcaggatgtgaa

SEQ ID NO: 487757 - DNA, 25 bp, Mus musculus
gaggcattcccttgcaagcagccaa

SEQ ID NO: 487758 - DNA, 25 bp, Mus musculus
gaggcattgaagatccatccccaaa

SEQ ID NO: 487759 - DNA, 25 bp, Mus musculus
gaggcattgaagcaatatgtgtcat

SEQ ID NO: 487760 - DNA, 25 bp, Mus musculus
gaggcattgaaggaatatgtgtcat

SEQ ID NO: 487761 - DNA, 25 bp, Mus musculus
gaggcattgaagttccatccccaaa

SEQ ID NO: 487762 - DNA, 25 bp, Mus musculus
gaggcattgctgaaatctttcccat

SEQ ID NO: 487763 - DNA, 25 bp, Mus musculus
gaggcattgctgtaatctttcccat

SEQ ID NO: 487764 - DNA, 25 bp, Mus musculus
gaggcattgtggatctgcagtgttt

SEQ ID NO: 487765 - DNA, 25 bp, Mus musculus
gaggcattgtggttctgcagtgttt

SEQ ID NO: 487766 - DNA, 25 bp, Mus musculus
gaggcatttcacaaaccttgcatca

SEQ ID NO: 487767 - DNA, 25 bp, Mus musculus
gaggcatttcactaaccttgcatca

SEQ ID NO: 487768 - DNA, 25 bp, Mus musculus
gaggcatttcctcggtgttgttcct

SEQ ID NO: 487769 - DNA, 25 bp, Mus musculus
gaggcatttcctgggtgttgttcct

SEQ ID NO: 487770 - DNA, 25 bp, Mus musculus
gaggcatttgaccacttgtttacca

SEQ ID NO: 487771 - DNA, 25 bp, Mus musculus
gaggcatttgacgacttgtttacca

SEQ ID NO: 487772 - DNA, 25 bp, Mus musculus
gaggcatttgcacaacactgtacag

SEQ ID NO: 487773 - DNA, 25 bp, Mus musculus
gaggcatttgcagaacactgtacag

SEQ ID NO: 487774 - DNA, 25 bp, Mus musculus
gaggcatttgctatcctagtgaaac

SEQ ID NO: 487775 - DNA, 25 bp, Mus musculus
gaggcatttgctttcctagtgaaac

SEQ ID NO: 487776 - DNA, 25 bp, Mus musculus
gaggcattttacatgggcgttcttc

SEQ ID NO: 487777 - DNA, 25 bp, Mus musculus
gaggcattttacttgggcgttcttc

SEQ ID NO: 487778 - DNA, 25 bp, Mus musculus
gaggcattttcccagtgaggttcct

SEQ ID NO: 487779 - DNA, 25 bp, Mus musculus
gaggcattttccgagtgaggttcct

SEQ ID NO: 487780 - DNA, 25 bp, Mus musculus
gaggcattttctagagataaccgat

SEQ ID NO: 487781 - DNA, 25 bp, Mus musculus
gaggcattttcttgagataaccgat

SEQ ID NO: 487782 - DNA, 25 bp, Mus musculus
gaggcattttgaagaagttcacaga

SEQ ID NO: 487783 - DNA, 25 bp, Mus musculus
gaggcattttgatgaagttcacaga

SEQ ID NO: 487784 - DNA, 25 bp, Mus musculus
gaggcatttttcacctcctaaaata

SEQ ID NO: 487785 - DNA, 25 bp, Mus musculus
gaggcatttttctcctcctaaaata

SEQ ID NO: 487786 - DNA, 25 bp, Mus musculus
gaggccaaaagacatataatagaac

SEQ ID NO: 487787 - DNA, 25 bp, Mus musculus
gaggccaaaagagatataatagaac

SEQ ID NO: 487788 - DNA, 25 bp, Mus musculus
gaggccaaacttccaagctatcttg

SEQ ID NO: 487789 - DNA, 25 bp, Mus musculus
gaggccaaacttcctcaagatcagt

SEQ ID NO: 487790 - DNA, 25 bp, Mus musculus
gaggccaaacttgcaagctatcttg

SEQ ID NO: 487791 - DNA, 25 bp, Mus musculus
gaggccaaacttgctcaagatcagt

SEQ ID NO: 487792 - DNA, 25 bp, Mus musculus
gaggccaaagacagcttatccgaat

SEQ ID NO: 487793 - DNA, 25 bp, Mus musculus
gaggccaaagactgcttatccgaat

SEQ ID NO: 487794 - DNA, 25 bp, Mus musculus
gaggccaaagatattcccaccgaat

SEQ ID NO: 487795 - DNA, 25 bp, Mus musculus
gaggccaaagattttcccaccgaat

SEQ ID NO: 487796 - DNA, 25 bp, Mus musculus
gaggccaaagccaggtcctcacgcg

SEQ ID NO: 487797 - DNA, 25 bp, Mus musculus
gaggccaaagcctggtcctcacgcg

SEQ ID NO: 487798 - DNA, 25 bp, Mus musculus
gaggccaaagctcgtgtgacccaaa

SEQ ID NO: 487799 - DNA, 25 bp, Mus musculus
gaggccaaagctggtgtgacccaaa

SEQ ID NO: 487800 - DNA, 25 bp, Mus musculus
gaggccaaaggcaaggaatgccctg

SEQ ID NO: 487801 - DNA, 25 bp, Mus musculus
gaggccaaaggcattatattccacc

SEQ ID NO: 487802 - DNA, 25 bp, Mus musculus
gaggccaaaggctaggaatgccctg

SEQ ID NO: 487803 - DNA, 25 bp, Mus musculus
gaggccaaaggctttatattccacc

SEQ ID NO: 487804 - DNA, 25 bp, Mus musculus
gaggccaaaggtcattcgcatttct

SEQ ID NO: 487805 - DNA, 25 bp, Mus musculus
gaggccaaaggtgattcgcatttct

SEQ ID NO: 487806 - DNA, 25 bp, Mus musculus
gaggccaaatccattaacggctgta

SEQ ID NO: 487807 - DNA, 25 bp, Mus musculus
gaggccaaatcctttaacggctgta

SEQ ID NO: 487808 - DNA, 25 bp, Mus musculus
gaggccaaatgtcattccacacgtg

SEQ ID NO: 487809 - DNA, 25 bp, Mus musculus
gaggccaaatgtgattccacacgtg

SEQ ID NO: 487810 - DNA, 25 bp, Mus musculus
gaggccaacaagcagtttatcaagt

SEQ ID NO: 487811 - DNA, 25 bp, Mus musculus
gaggccaacaaggagtttatcaagt

SEQ ID NO: 487812 - DNA, 25 bp, Mus musculus
gaggccaacagacccaagtattgga

SEQ ID NO: 487813 - DNA, 25 bp, Mus musculus
gaggccaacagagccaagtattgga

SEQ ID NO: 487814 - DNA, 25 bp, Mus musculus
gaggccaacatgatcagcatcatca

SEQ ID NO: 487815 - DNA, 25 bp, Mus musculus
gaggccaacatgttcagcatcatca

SEQ ID NO: 487816 - DNA, 25 bp, Mus musculus
gaggccaacctaaaccttgagtctg

SEQ ID NO: 487817 - DNA, 25 bp, Mus musculus
gaggccaacctataccttgagtctg

SEQ ID NO: 487818 - DNA, 25 bp, Mus musculus
gaggccaacgaccacagaccaggta

SEQ ID NO: 487819 - DNA, 25 bp, Mus musculus
gaggccaacgacgacagaccaggta

SEQ ID NO: 487820 - DNA, 25 bp, Mus musculus
gaggccaacgtgcagttatcattaa

SEQ ID NO: 487821 - DNA, 25 bp, Mus musculus
gaggccaacgtggagttatcattaa

SEQ ID NO: 487822 - DNA, 25 bp, Mus musculus
gaggccaactatctggaccagtatc

SEQ ID NO: 487823 - DNA, 25 bp, Mus musculus
gaggccaactatgtggaccagtatc

SEQ ID NO: 487824 - DNA, 25 bp, Mus musculus
gaggccaagactaagaccagcatcc

SEQ ID NO: 487825 - DNA, 25 bp, Mus musculus
gaggccaagacttagaccagcatcc

SEQ ID NO: 487826 - DNA, 25 bp, Mus musculus
gaggccaagatcagtagctttgttt

SEQ ID NO: 487827 - DNA, 25 bp, Mus musculus
gaggccaagatctgtagctttgttt

SEQ ID NO: 487828 - DNA, 25 bp, Mus musculus
gaggccaagcagaactagtcaggag

SEQ ID NO: 487829 - DNA, 25 bp, Mus musculus
gaggccaagcagaaggtaccacctg

SEQ ID NO: 487830 - DNA, 25 bp, Mus musculus
gaggccaagcagtactagtcaggag

SEQ ID NO: 487831 - DNA, 25 bp, Mus musculus
gaggccaagcagtaggtaccacctg

SEQ ID NO: 487832 - DNA, 25 bp, Mus musculus
gaggccaaggaaatctgcatgtatt

SEQ ID NO: 487833 - DNA, 25 bp, Mus musculus
gaggccaaggaattctgcatgtatt

SEQ ID NO: 487834 - DNA, 25 bp, Mus musculus
gaggccaaggcgcaaaccaagagct

SEQ ID NO: 487835 - DNA, 25 bp, Mus musculus
gaggccaaggcggaaaccaagagct

SEQ ID NO: 487836 - DNA, 25 bp, Mus musculus
gaggccaaggtaagtctggtgatct

SEQ ID NO: 487837 - DNA, 25 bp, Mus musculus
gaggccaaggtatgtctggtgatct

SEQ ID NO: 487838 - DNA, 25 bp, Mus musculus
gaggccaagtcacgatcccactaga

SEQ ID NO: 487839 - DNA, 25 bp, Mus musculus
gaggccaagtcaggatcccactaga

SEQ ID NO: 487840 - DNA, 25 bp, Mus musculus
gaggccaagtctaaccaaggacctt

SEQ ID NO: 487841 - DNA, 25 bp, Mus musculus
gaggccaagtcttaccaaggacctt

SEQ ID NO: 487842 - DNA, 25 bp, Mus musculus
gaggccaagtggagctttctttgtc

SEQ ID NO: 487843 - DNA, 25 bp, Mus musculus
gaggccaagtggtgctttctttgtc

SEQ ID NO: 487844 - DNA, 25 bp, Mus musculus
gaggccaagttaacaagactatttc

SEQ ID NO: 487845 - DNA, 25 bp, Mus musculus
gaggccaagttatcaagactatttc

SEQ ID NO: 487846 - DNA, 25 bp, Mus musculus
gaggccaataaacactggttttggt

SEQ ID NO: 487847 - DNA, 25 bp, Mus musculus
gaggccaataaagactggttttggt

SEQ ID NO: 487848 - DNA, 25 bp, Mus musculus
gaggccaataatctgtttcgtcaga

SEQ ID NO: 487849 - DNA, 25 bp, Mus musculus
gaggccaataatgtgtttcgtcaga

SEQ ID NO: 487850 - DNA, 25 bp, Mus musculus
gaggccaatcctaacttaacataca

SEQ ID NO: 487851 - DNA, 25 bp, Mus musculus
gaggccaatccttacttaacataca

SEQ ID NO: 487852 - DNA, 25 bp, Mus musculus
gaggccaatgcaaatccttttcagg

SEQ ID NO: 487853 - DNA, 25 bp, Mus musculus
gaggccaatgcatatccttttcagg

SEQ ID NO: 487854 - DNA, 25 bp, Mus musculus
gaggccaatggacaaaccgcatcaa

SEQ ID NO: 487855 - DNA, 25 bp, Mus musculus
gaggccaatggagaaaccgcatcaa

SEQ ID NO: 487856 - DNA, 25 bp, Mus musculus
gaggccaatgtaaatgttaaactta

SEQ ID NO: 487857 - DNA, 25 bp, Mus musculus
gaggccaatgtatatgttaaactta

SEQ ID NO: 487858 - DNA, 25 bp, Mus musculus
gaggccaattaaccttcattgttgt

SEQ ID NO: 487859 - DNA, 25 bp, Mus musculus
gaggccaattaagcttcattgttgt

SEQ ID NO: 487860 - DNA, 25 bp, Mus musculus
gaggccacaaacatcagtgacacgg

SEQ ID NO: 487861 - DNA, 25 bp, Mus musculus
gaggccacaaacttcagtgacacgg

SEQ ID NO: 487862 - DNA, 25 bp, Mus musculus
gaggccacaacacttttttcaaaca

SEQ ID NO: 487863 - DNA, 25 bp, Mus musculus
gaggccacaacagttttttcaaaca

SEQ ID NO: 487864 - DNA, 25 bp, Mus musculus
gaggccacaaggaccagatctagtc

SEQ ID NO: 487865 - DNA, 25 bp, Mus musculus
gaggccacaaggatggattgggatt

SEQ ID NO: 487866 - DNA, 25 bp, Mus musculus
gaggccacaaggtccagatctagtc

SEQ ID NO: 487867 - DNA, 25 bp, Mus musculus
gaggccacaaggttggattgggatt

SEQ ID NO: 487868 - DNA, 25 bp, Mus musculus
gaggccacactcataacaatgtcta

SEQ ID NO: 487869 - DNA, 25 bp, Mus musculus
gaggccacactcttaacaatgtcta

SEQ ID NO: 487870 - DNA, 25 bp, Mus musculus
gaggccacagaaagctcctgagagg

SEQ ID NO: 487871 - DNA, 25 bp, Mus musculus
gaggccacagaacctattactcctg

SEQ ID NO: 487872 - DNA, 25 bp, Mus musculus
gaggccacagaagctattactcctg

SEQ ID NO: 487873 - DNA, 25 bp, Mus musculus
gaggccacagaatgctcctgagagg

SEQ ID NO: 487874 - DNA, 25 bp, Mus musculus
gaggccacagcccatgctgaagagc

SEQ ID NO: 487875 - DNA, 25 bp, Mus musculus
gaggccacagccgatgctgaagagc

SEQ ID NO: 487876 - DNA, 25 bp, Mus musculus
gaggccacaggaaagacagagagac

SEQ ID NO: 487877 - DNA, 25 bp, Mus musculus
gaggccacaggatagacagagagac

SEQ ID NO: 487878 - DNA, 25 bp, Mus musculus
gaggccacaggccaactcgtgagca

SEQ ID NO: 487879 - DNA, 25 bp, Mus musculus
gaggccacaggcgaactcgtgagca

SEQ ID NO: 487880 - DNA, 25 bp, Mus musculus
gaggccacagttctatcctcaaaac

SEQ ID NO: 487881 - DNA, 25 bp, Mus musculus
gaggccacagttgtatcctcaaaac

SEQ ID NO: 487882 - DNA, 25 bp, Mus musculus
gaggccacatgaatagaccagtgta

SEQ ID NO: 487883 - DNA, 25 bp, Mus musculus
gaggccacatgattagaccagtgta

SEQ ID NO: 487884 - DNA, 25 bp, Mus musculus
gaggccaccaaaagcattagccacc

SEQ ID NO: 487885 - DNA, 25 bp, Mus musculus
gaggccaccaaacattctctggatg

SEQ ID NO: 487886 - DNA, 25 bp, Mus musculus
gaggccaccaaagattctctggatg

SEQ ID NO: 487887 - DNA, 25 bp, Mus musculus
gaggccaccaaatgcattagccacc

SEQ ID NO: 487888 - DNA, 25 bp, Mus musculus
gaggccaccaacagtgccagcttgt

SEQ ID NO: 487889 - DNA, 25 bp, Mus musculus
gaggccaccaacatttcttagttct

SEQ ID NO: 487890 - DNA, 25 bp, Mus musculus
gaggccaccaactgtgccagcttgt

SEQ ID NO: 487891 - DNA, 25 bp, Mus musculus
gaggccaccaacttttcttagttct

SEQ ID NO: 487892 - DNA, 25 bp, Mus musculus
gaggccaccctcatggagctttaat

SEQ ID NO: 487893 - DNA, 25 bp, Mus musculus
gaggccaccctcttggagctttaat

SEQ ID NO: 487894 - DNA, 25 bp, Mus musculus
gaggccaccgtcactgagatgagga

SEQ ID NO: 487895 - DNA, 25 bp, Mus musculus
gaggccaccgtctctgagatgagga

SEQ ID NO: 487896 - DNA, 25 bp, Mus musculus
gaggccaccgtgatgtcccgagtaa

SEQ ID NO: 487897 - DNA, 25 bp, Mus musculus
gaggccaccgtgttgtcccgagtaa

SEQ ID NO: 487898 - DNA, 25 bp, Mus musculus
gaggccacctcgattgtaggagctt

SEQ ID NO: 487899 - DNA, 25 bp, Mus musculus
gaggccacctcgtttgtaggagctt

SEQ ID NO: 487900 - DNA, 25 bp, Mus musculus
gaggccacctgaatctgtatagtcc

SEQ ID NO: 487901 - DNA, 25 bp, Mus musculus
gaggccacctgattctgtatagtcc

SEQ ID NO: 487902 - DNA, 25 bp, Mus musculus
gaggccaccttaactaggcctgagg

SEQ ID NO: 487903 - DNA, 25 bp, Mus musculus
gaggccaccttatctaggcctgagg

SEQ ID NO: 487904 - DNA, 25 bp, Mus musculus
gaggccacgtgactgttgcgttccc

SEQ ID NO: 487905 - DNA, 25 bp, Mus musculus
gaggccacgtgagtgttgcgttccc

SEQ ID NO: 487906 - DNA, 25 bp, Mus musculus
gaggccactcagctctcaggtgtaa

SEQ ID NO: 487907 - DNA, 25 bp, Mus musculus
gaggccactcaggtctcaggtgtaa

SEQ ID NO: 487908 - DNA, 25 bp, Mus musculus
gaggccactcctcatatgagtagct

SEQ ID NO: 487909 - DNA, 25 bp, Mus musculus
gaggccactcctgatatgagtagct

SEQ ID NO: 487910 - DNA, 25 bp, Mus musculus
gaggccactgacagaagctgctctg

SEQ ID NO: 487911 - DNA, 25 bp, Mus musculus
gaggccactgactgaagctgctctg

SEQ ID NO: 487912 - DNA, 25 bp, Mus musculus
gaggccactgagcaactctgcttat

SEQ ID NO: 487913 - DNA, 25 bp, Mus musculus
gaggccactgaggaactctgcttat

SEQ ID NO: 487914 - DNA, 25 bp, Mus musculus
gaggccactggcatggatgctatgc

SEQ ID NO: 487915 - DNA, 25 bp, Mus musculus
gaggccactggcttggatgctatgc

SEQ ID NO: 487916 - DNA, 25 bp, Mus musculus
gaggccacttagcaaccttgtgtcc

SEQ ID NO: 487917 - DNA, 25 bp, Mus musculus
gaggccacttaggaaccttgtgtcc

SEQ ID NO: 487918 - DNA, 25 bp, Mus musculus
gaggccacttatatcattgtcttct

SEQ ID NO: 487919 - DNA, 25 bp, Mus musculus
gaggccacttatttcattgtcttct

SEQ ID NO: 487920 - DNA, 25 bp, Mus musculus
gaggccactttaaagccattgtttc

SEQ ID NO: 487921 - DNA, 25 bp, Mus musculus
gaggccactttatagccattgtttc

SEQ ID NO: 487922 - DNA, 25 bp, Mus musculus
gaggccagaacgctaaagctcctgc

SEQ ID NO: 487923 - DNA, 25 bp, Mus musculus
gaggccagaacggtaaagctcctgc

SEQ ID NO: 487924 - DNA, 25 bp, Mus musculus
gaggccagaatactgctctctggac

SEQ ID NO: 487925 - DNA, 25 bp, Mus musculus
gaggccagaatagtgctctctggac

SEQ ID NO: 487926 - DNA, 25 bp, Mus musculus
gaggccagaatcacttagaactgta

SEQ ID NO: 487927 - DNA, 25 bp, Mus musculus
gaggccagaatctcttagaactgta

SEQ ID NO: 487928 - DNA, 25 bp, Mus musculus
gaggccagacaacccatgatctacc

SEQ ID NO: 487929 - DNA, 25 bp, Mus musculus
gaggccagacaagccatgatctacc

SEQ ID NO: 487930 - DNA, 25 bp, Mus musculus
gaggccagacacagttttgatacca

SEQ ID NO: 487931 - DNA, 25 bp, Mus musculus
gaggccagacactgttttgatacca

SEQ ID NO: 487932 - DNA, 25 bp, Mus musculus
gaggccagacgtataggttctcctg

SEQ ID NO: 487933 - DNA, 25 bp, Mus musculus
gaggccagacgtttaggttctcctg

SEQ ID NO: 487934 - DNA, 25 bp, Mus musculus
gaggccagactcacggtctcagcaa

SEQ ID NO: 487935 - DNA, 25 bp, Mus musculus
gaggccagactctcggtctcagcaa

SEQ ID NO: 487936 - DNA, 25 bp, Mus musculus
gaggccagagcaacactcctgtctg

SEQ ID NO: 487937 - DNA, 25 bp, Mus musculus
gaggccagagcatcactcctgtctg

SEQ ID NO: 487938 - DNA, 25 bp, Mus musculus
gaggccagagccatcgggttcaccc

SEQ ID NO: 487939 - DNA, 25 bp, Mus musculus
gaggccagagccttcgggttcaccc

SEQ ID NO: 487940 - DNA, 25 bp, Mus musculus
gaggccagagctacggaactatttc

SEQ ID NO: 487941 - DNA, 25 bp, Mus musculus
gaggccagagcttcggaactatttc

SEQ ID NO: 487942 - DNA, 25 bp, Mus musculus
gaggccagaggaacccgagactaga

SEQ ID NO: 487943 - DNA, 25 bp, Mus musculus
gaggccagaggatcccgagactaga

SEQ ID NO: 487944 - DNA, 25 bp, Mus musculus
gaggccagagtaccaactgtataga

SEQ ID NO: 487945 - DNA, 25 bp, Mus musculus
gaggccagagtagcaactgtataga

SEQ ID NO: 487946 - DNA, 25 bp, Mus musculus
gaggccagagttagatgtccagcgc

SEQ ID NO: 487947 - DNA, 25 bp, Mus musculus
gaggccagagtttgatgtccagcgc

SEQ ID NO: 487948 - DNA, 25 bp, Mus musculus
gaggccagatgaaagagttcacgga

SEQ ID NO: 487949 - DNA, 25 bp, Mus musculus
gaggccagatgatagagttcacgga

SEQ ID NO: 487950 - DNA, 25 bp, Mus musculus
gaggccagcaagatttccatgtact

SEQ ID NO: 487951 - DNA, 25 bp, Mus musculus
gaggccagcaagttttccatgtact

SEQ ID NO: 487952 - DNA, 25 bp, Mus musculus
gaggccagcacaccttactcaggag

SEQ ID NO: 487953 - DNA, 25 bp, Mus musculus
gaggccagcacagcttactcaggag

SEQ ID NO: 487954 - DNA, 25 bp, Mus musculus
gaggccagcaccaggatgcaggaca

SEQ ID NO: 487955 - DNA, 25 bp, Mus musculus
gaggccagcacctggatgcaggaca

SEQ ID NO: 487956 - DNA, 25 bp, Mus musculus
gaggccagcatccaaattcctgaaa

SEQ ID NO: 487957 - DNA, 25 bp, Mus musculus
gaggccagcatcgaaattcctgaaa

SEQ ID NO: 487958 - DNA, 25 bp, Mus musculus
gaggccagccataacctgtgggtaa

SEQ ID NO: 487959 - DNA, 25 bp, Mus musculus
gaggccagccattacctgtgggtaa

SEQ ID NO: 487960 - DNA, 25 bp, Mus musculus
gaggccagccctatcagatcataga

SEQ ID NO: 487961 - DNA, 25 bp, Mus musculus
gaggccagccctttcagatcataga

SEQ ID NO: 487962 - DNA, 25 bp, Mus musculus
gaggccagcctaaatttgaactgca

SEQ ID NO: 487963 - DNA, 25 bp, Mus musculus
gaggccagcctaccctactgaatga

SEQ ID NO: 487964 - DNA, 25 bp, Mus musculus
gaggccagcctagcctactgaatga

SEQ ID NO: 487965 - DNA, 25 bp, Mus musculus
gaggccagcctatatttgaactgca

SEQ ID NO: 487966 - DNA, 25 bp, Mus musculus
gaggccagcgccatttggaatcact

SEQ ID NO: 487967 - DNA, 25 bp, Mus musculus
gaggccagcgccttttggaatcact

SEQ ID NO: 487968 - DNA, 25 bp, Mus musculus
gaggccagcgcgcttacaagagatc

SEQ ID NO: 487969 - DNA, 25 bp, Mus musculus
gaggccagcgcggttacaagagatc

SEQ ID NO: 487970 - DNA, 25 bp, Mus musculus
gaggccagcggaacagttttaattt

SEQ ID NO: 487971 - DNA, 25 bp, Mus musculus
gaggccagcggatcagttttaattt

SEQ ID NO: 487972 - DNA, 25 bp, Mus musculus
gaggccagcgtgatacctgtggtta

SEQ ID NO: 487973 - DNA, 25 bp, Mus musculus
gaggccagcgtgttacctgtggtta

SEQ ID NO: 487974 - DNA, 25 bp, Mus musculus
gaggccagctctacatactcccttg

SEQ ID NO: 487975 - DNA, 25 bp, Mus musculus
gaggccagctcttcatactcccttg

SEQ ID NO: 487976 - DNA, 25 bp, Mus musculus
gaggccagctggatcacataagatc

SEQ ID NO: 487977 - DNA, 25 bp, Mus musculus
gaggccagctggttcacataagatc

SEQ ID NO: 487978 - DNA, 25 bp, Mus musculus
gaggccagcttaatgaagttaaaca

SEQ ID NO: 487979 - DNA, 25 bp, Mus musculus
gaggccagcttattgaagttaaaca

SEQ ID NO: 487980 - DNA, 25 bp, Mus musculus
gaggccaggactaagattgtactat

SEQ ID NO: 487981 - DNA, 25 bp, Mus musculus
gaggccaggacttagattgtactat

SEQ ID NO: 487982 - DNA, 25 bp, Mus musculus
gaggccaggagcatcgtgggcagat

SEQ ID NO: 487983 - DNA, 25 bp, Mus musculus
gaggccaggagcttcgtgggcagat

SEQ ID NO: 487984 - DNA, 25 bp, Mus musculus
gaggccaggccgcagtaacaacagc

SEQ ID NO: 487985 - DNA, 25 bp, Mus musculus
gaggccaggccggagtaacaacagc

SEQ ID NO: 487986 - DNA, 25 bp, Mus musculus
gaggccagggttatgttcattgtct

SEQ ID NO: 487987 - DNA, 25 bp, Mus musculus
gaggccagggttttgttcattgtct

SEQ ID NO: 487988 - DNA, 25 bp, Mus musculus
gaggccaggttgatcccggaagaat

SEQ ID NO: 487989 - DNA, 25 bp, Mus musculus
gaggccaggttgttcccggaagaat

SEQ ID NO: 487990 - DNA, 25 bp, Mus musculus
gaggccaggtttcactttccaatga

SEQ ID NO: 487991 - DNA, 25 bp, Mus musculus
gaggccaggtttgactttccaatga

SEQ ID NO: 487992 - DNA, 25 bp, Mus musculus
gaggccagtaaaacagaccatccag

SEQ ID NO: 487993 - DNA, 25 bp, Mus musculus
gaggccagtaaatcagaccatccag

SEQ ID NO: 487994 - DNA, 25 bp, Mus musculus
gaggccagtagcaagaactgttttc

SEQ ID NO: 487995 - DNA, 25 bp, Mus musculus
gaggccagtagctagaactgttttc

SEQ ID NO: 487996 - DNA, 25 bp, Mus musculus
gaggccagtcaccagtccagattgt

SEQ ID NO: 487997 - DNA, 25 bp, Mus musculus
gaggccagtcacgagtccagattgt

SEQ ID NO: 487998 - DNA, 25 bp, Mus musculus
gaggccagtcggactaagagtctaa

SEQ ID NO: 487999 - DNA, 25 bp, Mus musculus
gaggccagtcggtctaagagtctaa

SEQ ID NO: 488000 - DNA, 25 bp, Mus musculus
gaggccagtgaaattagctcagtaa

SEQ ID NO: 488001 - DNA, 25 bp, Mus musculus
gaggccagtgaactcagcaagctca

SEQ ID NO: 488002 - DNA, 25 bp, Mus musculus
gaggccagtgaagtcagcaagctca

SEQ ID NO: 488003 - DNA, 25 bp, Mus musculus
gaggccagtgaatttagctcagtaa

SEQ ID NO: 488004 - DNA, 25 bp, Mus musculus
gaggccagtggcaccatctttaaag

SEQ ID NO: 488005 - DNA, 25 bp, Mus musculus
gaggccagtggctccatctttaaag

SEQ ID NO: 488006 - DNA, 25 bp, Mus musculus
gaggccagtgttagctgacatcagc

SEQ ID NO: 488007 - DNA, 25 bp, Mus musculus
gaggccagtgtttgctgacatcagc

SEQ ID NO: 488008 - DNA, 25 bp, Mus musculus
gaggccataaagctgtgccacacca

SEQ ID NO: 488009 - DNA, 25 bp, Mus musculus
gaggccataaaggtgtgccacacca

SEQ ID NO: 488010 - DNA, 25 bp, Mus musculus
gaggccataaatcaactatccctgt

SEQ ID NO: 488011 - DNA, 25 bp, Mus musculus
gaggccataaatgaactatccctgt

SEQ ID NO: 488012 - DNA, 25 bp, Mus musculus
gaggccataatactgatgaaagact

SEQ ID NO: 488013 - DNA, 25 bp, Mus musculus
gaggccataatagtgatgaaagact

SEQ ID NO: 488014 - DNA, 25 bp, Mus musculus
gaggccatactacagggttctttat

SEQ ID NO: 488015 - DNA, 25 bp, Mus musculus
gaggccatactagagggttctttat

SEQ ID NO: 488016 - DNA, 25 bp, Mus musculus
gaggccatatgtaaaaccaccctgg

SEQ ID NO: 488017 - DNA, 25 bp, Mus musculus
gaggccatatgttaaaccaccctgg

SEQ ID NO: 488018 - DNA, 25 bp, Mus musculus
gaggccatcagcatgcggcccagca

SEQ ID NO: 488019 - DNA, 25 bp, Mus musculus
gaggccatcagcttgcggcccagca

SEQ ID NO: 488020 - DNA, 25 bp, Mus musculus
gaggccatccacaacttcgtagaag

SEQ ID NO: 488021 - DNA, 25 bp, Mus musculus
gaggccatccactacttcgtagaag

SEQ ID NO: 488022 - DNA, 25 bp, Mus musculus
gaggccatccttccaaattggtgat

SEQ ID NO: 488023 - DNA, 25 bp, Mus musculus
gaggccatccttgcaaattggtgat

SEQ ID NO: 488024 - DNA, 25 bp, Mus musculus
gaggccatcgcacagcttgatacac

SEQ ID NO: 488025 - DNA, 25 bp, Mus musculus
gaggccatcgcagagcttgatacac

SEQ ID NO: 488026 - DNA, 25 bp, Mus musculus
gaggccatcttgattggatctatat

SEQ ID NO: 488027 - DNA, 25 bp, Mus musculus
gaggccatcttgtttggatctatat

SEQ ID NO: 488028 - DNA, 25 bp, Mus musculus
gaggccatctttagacatattccag

SEQ ID NO: 488029 - DNA, 25 bp, Mus musculus
gaggccatcttttgacatattccag

SEQ ID NO: 488030 - DNA, 25 bp, Mus musculus
gaggccatgaatcagatcagagcca

SEQ ID NO: 488031 - DNA, 25 bp, Mus musculus
gaggccatgaatgagatcagagcca

SEQ ID NO: 488032 - DNA, 25 bp, Mus musculus
gaggccatgcagaactttgacacag

SEQ ID NO: 488033 - DNA, 25 bp, Mus musculus
gaggccatgcagtactttgacacag

SEQ ID NO: 488034 - DNA, 25 bp, Mus musculus
gaggccatgctgctgttcctttaac

SEQ ID NO: 488035 - DNA, 25 bp, Mus musculus
gaggccatgctggtgttcctttaac

SEQ ID NO: 488036 - DNA, 25 bp, Mus musculus
gaggccatggctaaacatctgaagt

SEQ ID NO: 488037 - DNA, 25 bp, Mus musculus
gaggccatggcttaacatctgaagt

SEQ ID NO: 488038 - DNA, 25 bp, Mus musculus
gaggccatgggtataagtctccagc

SEQ ID NO: 488039 - DNA, 25 bp, Mus musculus
gaggccatgggtttaagtctccagc

SEQ ID NO: 488040 - DNA, 25 bp, Mus musculus
gaggccatggtacgttcctggatat

SEQ ID NO: 488041 - DNA, 25 bp, Mus musculus
gaggccatggtaggttcctggatat

SEQ ID NO: 488042 - DNA, 25 bp, Mus musculus
gaggccatgtcaagaagccaactgt

SEQ ID NO: 488043 - DNA, 25 bp, Mus musculus
gaggccatgtcatgaagccaactgt

SEQ ID NO: 488044 - DNA, 25 bp, Mus musculus
gaggccatgtgtaggtagcacatac

SEQ ID NO: 488045 - DNA, 25 bp, Mus musculus
gaggccatgtgttggtagcacatac

SEQ ID NO: 488046 - DNA, 25 bp, Mus musculus
gaggccattaatcccttctggtggc

SEQ ID NO: 488047 - DNA, 25 bp, Mus musculus
gaggccattaatgccttctggtggc

SEQ ID NO: 488048 - DNA, 25 bp, Mus musculus
gaggccattacaattttcttggagg

SEQ ID NO: 488049 - DNA, 25 bp, Mus musculus
gaggccattacatttttcttggagg

SEQ ID NO: 488050 - DNA, 25 bp, Mus musculus
gaggccattcagatcttaaccatca

SEQ ID NO: 488051 - DNA, 25 bp, Mus musculus
gaggccattcagttcttaaccatca

SEQ ID NO: 488052 - DNA, 25 bp, Mus musculus
gaggccattccaacagcaaggcgta

SEQ ID NO: 488053 - DNA, 25 bp, Mus musculus
gaggccattccacatcgtttttaaa

SEQ ID NO: 488054 - DNA, 25 bp, Mus musculus
gaggccattccagatcgtttttaaa

SEQ ID NO: 488055 - DNA, 25 bp, Mus musculus
gaggccattccatcagcaaggcgta

SEQ ID NO: 488056 - DNA, 25 bp, Mus musculus
gaggccattccgacagtggagctga

SEQ ID NO: 488057 - DNA, 25 bp, Mus musculus
gaggccattccgtcagtggagctga

SEQ ID NO: 488058 - DNA, 25 bp, Mus musculus
gaggccattcgaagacatccccaaa

SEQ ID NO: 488059 - DNA, 25 bp, Mus musculus
gaggccattcgatgacatccccaaa

SEQ ID NO: 488060 - DNA, 25 bp, Mus musculus
gaggccattgccatagaaatccagt

SEQ ID NO: 488061 - DNA, 25 bp, Mus musculus
gaggccattgccttagaaatccagt

SEQ ID NO: 488062 - DNA, 25 bp, Mus musculus
gaggccattgggaggctaccagctt

SEQ ID NO: 488063 - DNA, 25 bp, Mus musculus
gaggccattgggtggctaccagctt

SEQ ID NO: 488064 - DNA, 25 bp, Mus musculus
gaggccatttagacgctttactttg

SEQ ID NO: 488065 - DNA, 25 bp, Mus musculus
gaggccatttagtcgctttactttg

SEQ ID NO: 488066 - DNA, 25 bp, Mus musculus
gaggccattttcattactgagttaa

SEQ ID NO: 488067 - DNA, 25 bp, Mus musculus
gaggccattttcctctatcaatgga

SEQ ID NO: 488068 - DNA, 25 bp, Mus musculus
gaggccattttcgtctatcaatgga

SEQ ID NO: 488069 - DNA, 25 bp, Mus musculus
gaggccattttctttactgagttaa

SEQ ID NO: 488070 - DNA, 25 bp, Mus musculus
gaggcccaaacaaggagattaggaa

SEQ ID NO: 488071 - DNA, 25 bp, Mus musculus
gaggcccaaacatggagattaggaa

SEQ ID NO: 488072 - DNA, 25 bp, Mus musculus
gaggcccaagagatacccagactga

SEQ ID NO: 488073 - DNA, 25 bp, Mus musculus
gaggcccaagagttacccagactga

SEQ ID NO: 488074 - DNA, 25 bp, Mus musculus
gaggcccaaggccatgggacaccct

SEQ ID NO: 488075 - DNA, 25 bp, Mus musculus
gaggcccaaggcgatgggacaccct

SEQ ID NO: 488076 - DNA, 25 bp, Mus musculus
gaggcccaagtccaagcactagcat

SEQ ID NO: 488077 - DNA, 25 bp, Mus musculus
gaggcccaagtcgaagcactagcat

SEQ ID NO: 488078 - DNA, 25 bp, Mus musculus
gaggcccacagacaatcaggtaaca

SEQ ID NO: 488079 - DNA, 25 bp, Mus musculus
gaggcccacagagaatcaggtaaca

SEQ ID NO: 488080 - DNA, 25 bp, Mus musculus
gaggcccaccaaacggagacgtcat

SEQ ID NO: 488081 - DNA, 25 bp, Mus musculus
gaggcccaccaatcggagacgtcat

SEQ ID NO: 488082 - DNA, 25 bp, Mus musculus
gaggcccacgtcaaaggttgatgtc

SEQ ID NO: 488083 - DNA, 25 bp, Mus musculus
gaggcccacgtctaaggttgatgtc

SEQ ID NO: 488084 - DNA, 25 bp, Mus musculus
gaggcccagacaatggaccttgacc

SEQ ID NO: 488085 - DNA, 25 bp, Mus musculus
gaggcccagacattggaccttgacc

SEQ ID NO: 488086 - DNA, 25 bp, Mus musculus
gaggcccagaccaactttcggttag

SEQ ID NO: 488087 - DNA, 25 bp, Mus musculus
gaggcccagacctactttcggttag

SEQ ID NO: 488088 - DNA, 25 bp, Mus musculus
gaggcccagagaagatgtcattgaa

SEQ ID NO: 488089 - DNA, 25 bp, Mus musculus
gaggcccagagacaatcagaccgaa

SEQ ID NO: 488090 - DNA, 25 bp, Mus musculus
gaggcccagagagaatcagaccgaa

SEQ ID NO: 488091 - DNA, 25 bp, Mus musculus
gaggcccagagatgatgtcattgaa

SEQ ID NO: 488092 - DNA, 25 bp, Mus musculus
gaggcccagctcagaggaaccacaa

SEQ ID NO: 488093 - DNA, 25 bp, Mus musculus
gaggcccagctctgaggaaccacaa

SEQ ID NO: 488094 - DNA, 25 bp, Mus musculus
gaggcccaggatctgatttaagata

SEQ ID NO: 488095 - DNA, 25 bp, Mus musculus
gaggcccaggatgtgatttaagata

SEQ ID NO: 488096 - DNA, 25 bp, Mus musculus
gaggcccagtaactgcaggttgaca

SEQ ID NO: 488097 - DNA, 25 bp, Mus musculus
gaggcccagtaagtgcaggttgaca

SEQ ID NO: 488098 - DNA, 25 bp, Mus musculus
gaggcccagtcaagtttgagagtct

SEQ ID NO: 488099 - DNA, 25 bp, Mus musculus
gaggcccagtcaccgtccttgagtt

SEQ ID NO: 488100 - DNA, 25 bp, Mus musculus
gaggcccagtcagcgtccttgagtt

SEQ ID NO: 488101 - DNA, 25 bp, Mus musculus
gaggcccagtcatgtttgagagtct

SEQ ID NO: 488102 - DNA, 25 bp, Mus musculus
gaggcccagttgataaactctgtca

SEQ ID NO: 488103 - DNA, 25 bp, Mus musculus
gaggcccagttgttaaactctgtca

SEQ ID NO: 488104 - DNA, 25 bp, Mus musculus
gaggcccataataactttactactg

SEQ ID NO: 488105 - DNA, 25 bp, Mus musculus
gaggcccataattactttactactg

SEQ ID NO: 488106 - DNA, 25 bp, Mus musculus
gaggcccatatacgaaattctaact

SEQ ID NO: 488107 - DNA, 25 bp, Mus musculus
gaggcccatataggaaattctaact

SEQ ID NO: 488108 - DNA, 25 bp, Mus musculus
gaggcccatgtgatagcaggtattc

SEQ ID NO: 488109 - DNA, 25 bp, Mus musculus
gaggcccatgtgttagcaggtattc

SEQ ID NO: 488110 - DNA, 25 bp, Mus musculus
gaggcccatttaaattaggtcatct

SEQ ID NO: 488111 - DNA, 25 bp, Mus musculus
gaggcccatttatattaggtcatct

SEQ ID NO: 488112 - DNA, 25 bp, Mus musculus
gaggccccaaaaataggctgcggga

SEQ ID NO: 488113 - DNA, 25 bp, Mus musculus
gaggccccaaaattaggctgcggga

SEQ ID NO: 488114 - DNA, 25 bp, Mus musculus
gaggccccaagaaatttttatccat

SEQ ID NO: 488115 - DNA, 25 bp, Mus musculus
gaggccccaagacaccatctggctg

SEQ ID NO: 488116 - DNA, 25 bp, Mus musculus
gaggccccaagagaccatctggctg

SEQ ID NO: 488117 - DNA, 25 bp, Mus musculus
gaggccccaagatatttttatccat

SEQ ID NO: 488118 - DNA, 25 bp, Mus musculus
gaggccccagcaaagaatttataca

SEQ ID NO: 488119 - DNA, 25 bp, Mus musculus
gaggccccagcatagaatttataca

SEQ ID NO: 488120 - DNA, 25 bp, Mus musculus
gaggccccaggtagtcatgacatcg

SEQ ID NO: 488121 - DNA, 25 bp, Mus musculus
gaggccccaggtatacttctcagca

SEQ ID NO: 488122 - DNA, 25 bp, Mus musculus
gaggccccaggtcacatatctcagt

SEQ ID NO: 488123 - DNA, 25 bp, Mus musculus
gaggccccaggtgacatatctcagt

SEQ ID NO: 488124 - DNA, 25 bp, Mus musculus
gaggccccaggttgtcatgacatcg

SEQ ID NO: 488125 - DNA, 25 bp, Mus musculus
gaggccccaggtttacttctcagca

SEQ ID NO: 488126 - DNA, 25 bp, Mus musculus
gaggccccataaagaagaccccaga

SEQ ID NO: 488127 - DNA, 25 bp, Mus musculus
gaggccccataatgaagaccccaga

SEQ ID NO: 488128 - DNA, 25 bp, Mus musculus
gaggccccattaagtgcgtgtttac

SEQ ID NO: 488129 - DNA, 25 bp, Mus musculus
gaggccccattatgtgcgtgtttac

SEQ ID NO: 488130 - DNA, 25 bp, Mus musculus
gaggccccgagaaaagtctgtcagc

SEQ ID NO: 488131 - DNA, 25 bp, Mus musculus
gaggccccgagataagtctgtcagc

SEQ ID NO: 488132 - DNA, 25 bp, Mus musculus
gaggccccgccgacctatgagcaga

SEQ ID NO: 488133 - DNA, 25 bp, Mus musculus
gaggccccgccgtcctatgagcaga

SEQ ID NO: 488134 - DNA, 25 bp, Mus musculus
gaggcccctacccgtcgttagtgcg

SEQ ID NO: 488135 - DNA, 25 bp, Mus musculus
gaggcccctaccggtcgttagtgcg

SEQ ID NO: 488136 - DNA, 25 bp, Mus musculus
gaggcccctctaaggttatttctag

SEQ ID NO: 488137 - DNA, 25 bp, Mus musculus
gaggcccctctatggttatttctag

SEQ ID NO: 488138 - DNA, 25 bp, Mus musculus
gaggcccctgagacgtgctgagcat

SEQ ID NO: 488139 - DNA, 25 bp, Mus musculus
gaggcccctgagtcgtgctgagcat

SEQ ID NO: 488140 - DNA, 25 bp, Mus musculus
gaggcccctggtagtgattcattta

SEQ ID NO: 488141 - DNA, 25 bp, Mus musculus
gaggcccctggttgtgattcattta

SEQ ID NO: 488142 - DNA, 25 bp, Mus musculus
gaggccccttaacttagatgtatta

SEQ ID NO: 488143 - DNA, 25 bp, Mus musculus
gaggccccttaagttagatgtatta

SEQ ID NO: 488144 - DNA, 25 bp, Mus musculus
gaggccccttctcggttggtcagat

SEQ ID NO: 488145 - DNA, 25 bp, Mus musculus
gaggccccttctgggttggtcagat

SEQ ID NO: 488146 - DNA, 25 bp, Mus musculus
gaggcccgaagtcactttgaggaaa

SEQ ID NO: 488147 - DNA, 25 bp, Mus musculus
gaggcccgaagtgactttgaggaaa

SEQ ID NO: 488148 - DNA, 25 bp, Mus musculus
gaggcccgaatgaccctagaaacta

SEQ ID NO: 488149 - DNA, 25 bp, Mus musculus
gaggcccgaatgtccctagaaacta

SEQ ID NO: 488150 - DNA, 25 bp, Mus musculus
gaggcccgcgctatgtctggagtct

SEQ ID NO: 488151 - DNA, 25 bp, Mus musculus
gaggcccgcgctttgtctggagtct

SEQ ID NO: 488152 - DNA, 25 bp, Mus musculus
gaggcccgctcgatgctctcgatgg

SEQ ID NO: 488153 - DNA, 25 bp, Mus musculus
gaggcccgctcgttgctctcgatgg

SEQ ID NO: 488154 - DNA, 25 bp, Mus musculus
gaggcccggacaagttaagattcaa

SEQ ID NO: 488155 - DNA, 25 bp, Mus musculus
gaggcccggacatgttaagattcaa

SEQ ID NO: 488156 - DNA, 25 bp, Mus musculus
gaggcccggcccatgaaagacgaga

SEQ ID NO: 488157 - DNA, 25 bp, Mus musculus
gaggcccggcccttgaaagacgaga

SEQ ID NO: 488158 - DNA, 25 bp, Mus musculus
gaggccctaagtaaccacattgaat

SEQ ID NO: 488159 - DNA, 25 bp, Mus musculus
gaggccctaagtactcagaatgcac

SEQ ID NO: 488160 - DNA, 25 bp, Mus musculus
gaggccctaagttaccacattgaat

SEQ ID NO: 488161 - DNA, 25 bp, Mus musculus
gaggccctaagttctcagaatgcac

SEQ ID NO: 488162 - DNA, 25 bp, Mus musculus
gaggccctagataagctctgcagaa

SEQ ID NO: 488163 - DNA, 25 bp, Mus musculus
gaggccctagattagctctgcagaa

SEQ ID NO: 488164 - DNA, 25 bp, Mus musculus
gaggccctagcaaagctgagttcta

SEQ ID NO: 488165 - DNA, 25 bp, Mus musculus
gaggccctagcatagctgagttcta

SEQ ID NO: 488166 - DNA, 25 bp, Mus musculus
gaggccctagccaaagatggagagt

SEQ ID NO: 488167 - DNA, 25 bp, Mus musculus
gaggccctagcctaagatggagagt

SEQ ID NO: 488168 - DNA, 25 bp, Mus musculus
gaggccctaggcagcctgaaacagc

SEQ ID NO: 488169 - DNA, 25 bp, Mus musculus
gaggccctaggctgcctgaaacagc

SEQ ID NO: 488170 - DNA, 25 bp, Mus musculus
gaggccctagttaggtaaaccatat

SEQ ID NO: 488171 - DNA, 25 bp, Mus musculus
gaggccctagtttggtaaaccatat

SEQ ID NO: 488172 - DNA, 25 bp, Mus musculus
gaggccctcaggactgttttgggac

SEQ ID NO: 488173 - DNA, 25 bp, Mus musculus
gaggccctcaggtctgttttgggac

SEQ ID NO: 488174 - DNA, 25 bp, Mus musculus
gaggccctcgccagacttcagtaaa

SEQ ID NO: 488175 - DNA, 25 bp, Mus musculus
gaggccctcgcctgacttcagtaaa

SEQ ID NO: 488176 - DNA, 25 bp, Mus musculus
gaggccctctttcgaactccctagg

SEQ ID NO: 488177 - DNA, 25 bp, Mus musculus
gaggccctctttggaactccctagg

SEQ ID NO: 488178 - DNA, 25 bp, Mus musculus
gaggccctgcaaataatacctaatg

SEQ ID NO: 488179 - DNA, 25 bp, Mus musculus
gaggccctgcaaccatttgaaaaat

SEQ ID NO: 488180 - DNA, 25 bp, Mus musculus
gaggccctgcaagcatttgaaaaat

SEQ ID NO: 488181 - DNA, 25 bp, Mus musculus
gaggccctgcaattaatacctaatg

SEQ ID NO: 488182 - DNA, 25 bp, Mus musculus
gaggccctgctgagtgacctgcatg

SEQ ID NO: 488183 - DNA, 25 bp, Mus musculus
gaggccctgctgtgtgacctgcatg

SEQ ID NO: 488184 - DNA, 25 bp, Mus musculus
gaggccctggataagtgcaattgtt

SEQ ID NO: 488185 - DNA, 25 bp, Mus musculus
gaggccctggattagtgcaattgtt

SEQ ID NO: 488186 - DNA, 25 bp, Mus musculus
gaggccctggctactatactcatga

SEQ ID NO: 488187 - DNA, 25 bp, Mus musculus
gaggccctggctagagcttgccttg

SEQ ID NO: 488188 - DNA, 25 bp, Mus musculus
gaggccctggcttctatactcatga

SEQ ID NO: 488189 - DNA, 25 bp, Mus musculus
gaggccctggcttgagcttgccttg

SEQ ID NO: 488190 - DNA, 25 bp, Mus musculus
gaggccctgggaagttctacccact

SEQ ID NO: 488191 - DNA, 25 bp, Mus musculus
gaggccctgggaatagatgcacaac

SEQ ID NO: 488192 - DNA, 25 bp, Mus musculus
gaggccctgggatgttctacccact

SEQ ID NO: 488193 - DNA, 25 bp, Mus musculus
gaggccctgggattagatgcacaac

SEQ ID NO: 488194 - DNA, 25 bp, Mus musculus
gaggccctgtaaatggaatgagtcc

SEQ ID NO: 488195 - DNA, 25 bp, Mus musculus
gaggccctgtaattggaatgagtcc

SEQ ID NO: 488196 - DNA, 25 bp, Mus musculus
gaggcccttagaagattcctggtcc

SEQ ID NO: 488197 - DNA, 25 bp, Mus musculus
gaggcccttagatgattcctggtcc

SEQ ID NO: 488198 - DNA, 25 bp, Mus musculus
gaggcccttcagagcattaattatc

SEQ ID NO: 488199 - DNA, 25 bp, Mus musculus
gaggcccttcagtgcattaattatc

SEQ ID NO: 488200 - DNA, 25 bp, Mus musculus
gaggcccttcataattgctgcagaa

SEQ ID NO: 488201 - DNA, 25 bp, Mus musculus
gaggcccttcattattgctgcagaa

SEQ ID NO: 488202 - DNA, 25 bp, Mus musculus
gaggcccttcccaaagtattaatgt

SEQ ID NO: 488203 - DNA, 25 bp, Mus musculus
gaggcccttccctaagtattaatgt

SEQ ID NO: 488204 - DNA, 25 bp, Mus musculus
gaggcccttgagacttagaagccag

SEQ ID NO: 488205 - DNA, 25 bp, Mus musculus
gaggcccttgagtcttagaagccag

SEQ ID NO: 488206 - DNA, 25 bp, Mus musculus
gaggcccttgctacagaattgggca

SEQ ID NO: 488207 - DNA, 25 bp, Mus musculus
gaggcccttgcttcagaattgggca

SEQ ID NO: 488208 - DNA, 25 bp, Mus musculus
gaggcccttggacgtcacacaggac

SEQ ID NO: 488209 - DNA, 25 bp, Mus musculus
gaggcccttggaggtcacacaggac

SEQ ID NO: 488210 - DNA, 25 bp, Mus musculus
gaggcccttgggaacacagtgaccc

SEQ ID NO: 488211 - DNA, 25 bp, Mus musculus
gaggcccttgggtacacagtgaccc

SEQ ID NO: 488212 - DNA, 25 bp, Mus musculus
gaggcccttggtcttatgaagagtc

SEQ ID NO: 488213 - DNA, 25 bp, Mus musculus
gaggcccttggtgttatgaagagtc

SEQ ID NO: 488214 - DNA, 25 bp, Mus musculus
gaggccctttgccaacaatcaggat

SEQ ID NO: 488215 - DNA, 25 bp, Mus musculus
gaggccctttgcgaacaatcaggat

SEQ ID NO: 488216 - DNA, 25 bp, Mus musculus
gaggcccttttacttcatcatctaa

SEQ ID NO: 488217 - DNA, 25 bp, Mus musculus
gaggcccttttagttcatcatctaa

SEQ ID NO: 488218 - DNA, 25 bp, Mus musculus
gaggcccttttcagccacacaagtt

SEQ ID NO: 488219 - DNA, 25 bp, Mus musculus
gaggcccttttctgccacacaagtt

SEQ ID NO: 488220 - DNA, 25 bp, Mus musculus
gaggccgaacataccaagtagcaga

SEQ ID NO: 488221 - DNA, 25 bp, Mus musculus
gaggccgaacattccaagtagcaga

SEQ ID NO: 488222 - DNA, 25 bp, Mus musculus
gaggccgacctccaaacaatgagaa

SEQ ID NO: 488223 - DNA, 25 bp, Mus musculus
gaggccgacctcgaaacaatgagaa

SEQ ID NO: 488224 - DNA, 25 bp, Mus musculus
gaggccgagagtcatattttctcta

SEQ ID NO: 488225 - DNA, 25 bp, Mus musculus
gaggccgagagtgatattttctcta

SEQ ID NO: 488226 - DNA, 25 bp, Mus musculus
gaggccgaggcccagttctatgaac

SEQ ID NO: 488227 - DNA, 25 bp, Mus musculus
gaggccgaggccgagttctatgaac

SEQ ID NO: 488228 - DNA, 25 bp, Mus musculus
gaggccgccgatagcttccggaaat

SEQ ID NO: 488229 - DNA, 25 bp, Mus musculus
gaggccgccgattgcttccggaaat

SEQ ID NO: 488230 - DNA, 25 bp, Mus musculus
gaggccgcgactagtggtcacgcca

SEQ ID NO: 488231 - DNA, 25 bp, Mus musculus
gaggccgcgacttgtggtcacgcca

SEQ ID NO: 488232 - DNA, 25 bp, Mus musculus
gaggccgcggacaaagagcttctaa

SEQ ID NO: 488233 - DNA, 25 bp, Mus musculus
gaggccgcggactaagagcttctaa

SEQ ID NO: 488234 - DNA, 25 bp, Mus musculus
gaggccgctaccagttcaattactt

SEQ ID NO: 488235 - DNA, 25 bp, Mus musculus
gaggccgctacctgttcaattactt

SEQ ID NO: 488236 - DNA, 25 bp, Mus musculus
gaggccgctgggaaactgcctgctt

SEQ ID NO: 488237 - DNA, 25 bp, Mus musculus
gaggccgctgggtaactgcctgctt

SEQ ID NO: 488238 - DNA, 25 bp, Mus musculus
gaggccggaaagctgacatcctgtt

SEQ ID NO: 488239 - DNA, 25 bp, Mus musculus
gaggccggaaaggtgacatcctgtt

SEQ ID NO: 488240 - DNA, 25 bp, Mus musculus
gaggccggaactattgctatacttt

SEQ ID NO: 488241 - DNA, 25 bp, Mus musculus
gaggccggaacttttgctatacttt

SEQ ID NO: 488242 - DNA, 25 bp, Mus musculus
gaggccggacctaagaccaggatga

SEQ ID NO: 488243 - DNA, 25 bp, Mus musculus
gaggccggaccttagaccaggatga

SEQ ID NO: 488244 - DNA, 25 bp, Mus musculus
gaggccggatgaatcttctagttgt

SEQ ID NO: 488245 - DNA, 25 bp, Mus musculus
gaggccggatgattcttctagttgt

SEQ ID NO: 488246 - DNA, 25 bp, Mus musculus
gaggccggatgcagtggcaccaatc

SEQ ID NO: 488247 - DNA, 25 bp, Mus musculus
gaggccggatgctgtggcaccaatc

SEQ ID NO: 488248 - DNA, 25 bp, Mus musculus
gaggccggcagtatcggcttttaat

SEQ ID NO: 488249 - DNA, 25 bp, Mus musculus
gaggccggcagtttcggcttttaat

SEQ ID NO: 488250 - DNA, 25 bp, Mus musculus
gaggccggctctatatataatgaca

SEQ ID NO: 488251 - DNA, 25 bp, Mus musculus
gaggccggctctttatataatgaca

SEQ ID NO: 488252 - DNA, 25 bp, Mus musculus
gaggccggcttgagctactgaatga

SEQ ID NO: 488253 - DNA, 25 bp, Mus musculus
gaggccggcttgtgctactgaatga

SEQ ID NO: 488254 - DNA, 25 bp, Mus musculus
gaggccgtacaacatggcttaccac

SEQ ID NO: 488255 - DNA, 25 bp, Mus musculus
gaggccgtacaagatggcttaccac

SEQ ID NO: 488256 - DNA, 25 bp, Mus musculus
gaggccgtagataggacacatgcaa

SEQ ID NO: 488257 - DNA, 25 bp, Mus musculus
gaggccgtagattggacacatgcaa

SEQ ID NO: 488258 - DNA, 25 bp, Mus musculus
gaggccgtcagaaattagtcccata

SEQ ID NO: 488259 - DNA, 25 bp, Mus musculus
gaggccgtcagatattagtcccata

SEQ ID NO: 488260 - DNA, 25 bp, Mus musculus
gaggccgtccggaggttgaagtcca

SEQ ID NO: 488261 - DNA, 25 bp, Mus musculus
gaggccgtccggtggttgaagtcca

SEQ ID NO: 488262 - DNA, 25 bp, Mus musculus
gaggccgttcccagaccagcgagac

SEQ ID NO: 488263 - DNA, 25 bp, Mus musculus
gaggccgttccctgaccagcgagac

SEQ ID NO: 488264 - DNA, 25 bp, Mus musculus
gaggccgttgaacctagatctctat

SEQ ID NO: 488265 - DNA, 25 bp, Mus musculus
gaggccgttgaagctagatctctat

SEQ ID NO: 488266 - DNA, 25 bp, Mus musculus
gaggccgttgtcagaaacctgctaa

SEQ ID NO: 488267 - DNA, 25 bp, Mus musculus
gaggccgttgtctgaaacctgctaa

SEQ ID NO: 488268 - DNA, 25 bp, Mus musculus
gaggccgtttataaggatgttctgc

SEQ ID NO: 488269 - DNA, 25 bp, Mus musculus
gaggccgtttattaggatgttctgc

SEQ ID NO: 488270 - DNA, 25 bp, Mus musculus
gaggcctaaaaccatccagaacttc

SEQ ID NO: 488271 - DNA, 25 bp, Mus musculus
gaggcctaaaacgatccagaacttc

SEQ ID NO: 488272 - DNA, 25 bp, Mus musculus
gaggcctaaagtctttccgagacaa

SEQ ID NO: 488273 - DNA, 25 bp, Mus musculus
gaggcctaaagtgtttccgagacaa

SEQ ID NO: 488274 - DNA, 25 bp, Mus musculus
gaggcctaaatccaactcggcagga

SEQ ID NO: 488275 - DNA, 25 bp, Mus musculus
gaggcctaaatcgaactcggcagga

SEQ ID NO: 488276 - DNA, 25 bp, Mus musculus
gaggcctaacgtcttctggatgacc

SEQ ID NO: 488277 - DNA, 25 bp, Mus musculus
gaggcctaacgtgttctggatgacc

SEQ ID NO: 488278 - DNA, 25 bp, Mus musculus
gaggcctaagccatggcatttaagt

SEQ ID NO: 488279 - DNA, 25 bp, Mus musculus
gaggcctaagccttggcatttaagt

SEQ ID NO: 488280 - DNA, 25 bp, Mus musculus
gaggcctacaatccagttgtgcgct

SEQ ID NO: 488281 - DNA, 25 bp, Mus musculus
gaggcctacaatgcagttgtgcgct

SEQ ID NO: 488282 - DNA, 25 bp, Mus musculus
gaggcctacacaatttactgccaaa

SEQ ID NO: 488283 - DNA, 25 bp, Mus musculus
gaggcctacacattttactgccaaa

SEQ ID NO: 488284 - DNA, 25 bp, Mus musculus
gaggcctacagccactaccttaaag

SEQ ID NO: 488285 - DNA, 25 bp, Mus musculus
gaggcctacagccagtaccctgttc

SEQ ID NO: 488286 - DNA, 25 bp, Mus musculus
gaggcctacagcgactaccttaaag

SEQ ID NO: 488287 - DNA, 25 bp, Mus musculus
gaggcctacagcgagtaccctgttc

SEQ ID NO: 488288 - DNA, 25 bp, Mus musculus
gaggcctacctgctgtgtcctgaaa

SEQ ID NO: 488289 - DNA, 25 bp, Mus musculus
gaggcctacctggtgtgtcctgaaa

SEQ ID NO: 488290 - DNA, 25 bp, Mus musculus
gaggcctacgagctgcgtttaagac

SEQ ID NO: 488291 - DNA, 25 bp, Mus musculus
gaggcctacgaggtgcgtttaagac

SEQ ID NO: 488292 - DNA, 25 bp, Mus musculus
gaggcctacttcagaaagtcctcat

SEQ ID NO: 488293 - DNA, 25 bp, Mus musculus
gaggcctacttcagtcatatcatgg

SEQ ID NO: 488294 - DNA, 25 bp, Mus musculus
gaggcctacttctgaaagtcctcat

SEQ ID NO: 488295 - DNA, 25 bp, Mus musculus
gaggcctacttctgtcatatcatgg

SEQ ID NO: 488296 - DNA, 25 bp, Mus musculus
gaggcctactttaaagcagctggtg

SEQ ID NO: 488297 - DNA, 25 bp, Mus musculus
gaggcctacttttaagcagctggtg

SEQ ID NO: 488298 - DNA, 25 bp, Mus musculus
gaggcctagaacacagtgccttagg

SEQ ID NO: 488299 - DNA, 25 bp, Mus musculus
gaggcctagaactcagtgccttagg

SEQ ID NO: 488300 - DNA, 25 bp, Mus musculus
gaggcctagacactgtccacgtgga

SEQ ID NO: 488301 - DNA, 25 bp, Mus musculus
gaggcctagacagtgtccacgtgga

SEQ ID NO: 488302 - DNA, 25 bp, Mus musculus
gaggcctagaccatgccactgctca

SEQ ID NO: 488303 - DNA, 25 bp, Mus musculus
gaggcctagaccttgccactgctca

SEQ ID NO: 488304 - DNA, 25 bp, Mus musculus
gaggcctagaggctcaaggaacact

SEQ ID NO: 488305 - DNA, 25 bp, Mus musculus
gaggcctagagggtcaaggaacact

SEQ ID NO: 488306 - DNA, 25 bp, Mus musculus
gaggcctagcctaatcaagaaagaa

SEQ ID NO: 488307 - DNA, 25 bp, Mus musculus
gaggcctagcctactggtgctgcag

SEQ ID NO: 488308 - DNA, 25 bp, Mus musculus
gaggcctagccttatcaagaaagaa

SEQ ID NO: 488309 - DNA, 25 bp, Mus musculus
gaggcctagccttctggtgctgcag

SEQ ID NO: 488310 - DNA, 25 bp, Mus musculus
gaggcctagggaactggattttcat

SEQ ID NO: 488311 - DNA, 25 bp, Mus musculus
gaggcctagggatctggattttcat

SEQ ID NO: 488312 - DNA, 25 bp, Mus musculus
gaggcctatgacattgttcctgact

SEQ ID NO: 488313 - DNA, 25 bp, Mus musculus
gaggcctatgactttgttcctgact

SEQ ID NO: 488314 - DNA, 25 bp, Mus musculus
gaggcctatgggattgattttcgaa

SEQ ID NO: 488315 - DNA, 25 bp, Mus musculus
gaggcctatgggtttgattttcgaa

SEQ ID NO: 488316 - DNA, 25 bp, Mus musculus
gaggcctcaaagagaagcaccagaa

SEQ ID NO: 488317 - DNA, 25 bp, Mus musculus
gaggcctcaaagtgaagcaccagaa

SEQ ID NO: 488318 - DNA, 25 bp, Mus musculus
gaggcctcaagtccactcagtgcta

SEQ ID NO: 488319 - DNA, 25 bp, Mus musculus
gaggcctcaagtgcactcagtgcta

SEQ ID NO: 488320 - DNA, 25 bp, Mus musculus
gaggcctcagaaaagcctgcctaat

SEQ ID NO: 488321 - DNA, 25 bp, Mus musculus
gaggcctcagaatagcctgcctaat

SEQ ID NO: 488322 - DNA, 25 bp, Mus musculus
gaggcctcagacacaggcgtagtcc

SEQ ID NO: 488323 - DNA, 25 bp, Mus musculus
gaggcctcagactcaggcgtagtcc

SEQ ID NO: 488324 - DNA, 25 bp, Mus musculus
gaggcctcaggacattcaggctcga

SEQ ID NO: 488325 - DNA, 25 bp, Mus musculus
gaggcctcaggagattcaggctcga

SEQ ID NO: 488326 - DNA, 25 bp, Mus musculus
gaggcctcatgcaggaacattgctt

SEQ ID NO: 488327 - DNA, 25 bp, Mus musculus
gaggcctcatgctggaacattgctt

SEQ ID NO: 488328 - DNA, 25 bp, Mus musculus
gaggcctccataacacagacagaga

SEQ ID NO: 488329 - DNA, 25 bp, Mus musculus
gaggcctccatatcacagacagaga

SEQ ID NO: 488330 - DNA, 25 bp, Mus musculus
gaggcctccgccatggagcttagca

SEQ ID NO: 488331 - DNA, 25 bp, Mus musculus
gaggcctccgccttggagcttagca

SEQ ID NO: 488332 - DNA, 25 bp, Mus musculus
gaggcctcctggaactagttataga

SEQ ID NO: 488333 - DNA, 25 bp, Mus musculus
gaggcctcctggtactagttataga

SEQ ID NO: 488334 - DNA, 25 bp, Mus musculus
gaggcctccttaacctggaaagatc

SEQ ID NO: 488335 - DNA, 25 bp, Mus musculus
gaggcctccttaccaggctttgatg

SEQ ID NO: 488336 - DNA, 25 bp, Mus musculus
gaggcctccttagcaggctttgatg

SEQ ID NO: 488337 - DNA, 25 bp, Mus musculus
gaggcctccttatcctggaaagatc

SEQ ID NO: 488338 - DNA, 25 bp, Mus musculus
gaggcctcgaaactgcatactgtat

SEQ ID NO: 488339 - DNA, 25 bp, Mus musculus
gaggcctcgaaagtgcatactgtat

SEQ ID NO: 488340 - DNA, 25 bp, Mus musculus
gaggcctcgatgaccctctgaaggg

SEQ ID NO: 488341 - DNA, 25 bp, Mus musculus
gaggcctcgatgtccctctgaaggg

SEQ ID NO: 488342 - DNA, 25 bp, Mus musculus
gaggcctctaggatcaagctattca

SEQ ID NO: 488343 - DNA, 25 bp, Mus musculus
gaggcctctaggttcaagctattca

SEQ ID NO: 488344 - DNA, 25 bp, Mus musculus
gaggcctctctcaggaagatgccct

SEQ ID NO: 488345 - DNA, 25 bp, Mus musculus
gaggcctctctctggaagatgccct

SEQ ID NO: 488346 - DNA, 25 bp, Mus musculus
gaggcctctgctaagtttcagtgtt

SEQ ID NO: 488347 - DNA, 25 bp, Mus musculus
gaggcctctgcttagtttcagtgtt

SEQ ID NO: 488348 - DNA, 25 bp, Mus musculus
gaggcctctggaaatgtactagtga

SEQ ID NO: 488349 - DNA, 25 bp, Mus musculus
gaggcctctggatatgtactagtga

SEQ ID NO: 488350 - DNA, 25 bp, Mus musculus
gaggcctcttgcagggacatgagaa

SEQ ID NO: 488351 - DNA, 25 bp, Mus musculus
gaggcctcttgctgggacatgagaa

SEQ ID NO: 488352 - DNA, 25 bp, Mus musculus
gaggcctgaaagcaaggcccacctg

SEQ ID NO: 488353 - DNA, 25 bp, Mus musculus
gaggcctgaaaggaaggcccacctg

SEQ ID NO: 488354 - DNA, 25 bp, Mus musculus
gaggcctgaactactatggtgtgaa

SEQ ID NO: 488355 - DNA, 25 bp, Mus musculus
gaggcctgaacttctatggtgtgaa

SEQ ID NO: 488356 - DNA, 25 bp, Mus musculus
gaggcctgacagatatgcagcactg

SEQ ID NO: 488357 - DNA, 25 bp, Mus musculus
gaggcctgacagttatgcagcactg

SEQ ID NO: 488358 - DNA, 25 bp, Mus musculus
gaggcctgacatagggagctcgcac

SEQ ID NO: 488359 - DNA, 25 bp, Mus musculus
gaggcctgacattgggagctcgcac

SEQ ID NO: 488360 - DNA, 25 bp, Mus musculus
gaggcctgacttagtttcttgtctc

SEQ ID NO: 488361 - DNA, 25 bp, Mus musculus
gaggcctgactttgtttcttgtctc

SEQ ID NO: 488362 - DNA, 25 bp, Mus musculus
gaggcctgagaaaccgcagccgaga

SEQ ID NO: 488363 - DNA, 25 bp, Mus musculus
gaggcctgagaatccgcagccgaga

SEQ ID NO: 488364 - DNA, 25 bp, Mus musculus
gaggcctgagaccatcagtcactaa

SEQ ID NO: 488365 - DNA, 25 bp, Mus musculus
gaggcctgagacgatcagtcactaa

SEQ ID NO: 488366 - DNA, 25 bp, Mus musculus
gaggcctgaggcagttccagggcaa

SEQ ID NO: 488367 - DNA, 25 bp, Mus musculus
gaggcctgaggctgttccagggcaa

SEQ ID NO: 488368 - DNA, 25 bp, Mus musculus
gaggcctgagtcaccagtagtacaa

SEQ ID NO: 488369 - DNA, 25 bp, Mus musculus
gaggcctgagtctccagtagtacaa

SEQ ID NO: 488370 - DNA, 25 bp, Mus musculus
gaggcctgagtgactctcttgaaaa

SEQ ID NO: 488371 - DNA, 25 bp, Mus musculus
gaggcctgagtgtctctcttgaaaa

SEQ ID NO: 488372 - DNA, 25 bp, Mus musculus
gaggcctgccaacgtcaaatttact

SEQ ID NO: 488373 - DNA, 25 bp, Mus musculus
gaggcctgccaaggtcaaatttact

SEQ ID NO: 488374 - DNA, 25 bp, Mus musculus
gaggcctgccacagtttgctgagct

SEQ ID NO: 488375 - DNA, 25 bp, Mus musculus
gaggcctgccactgtttgctgagct

SEQ ID NO: 488376 - DNA, 25 bp, Mus musculus
gaggcctgcctcataggcagccaga

SEQ ID NO: 488377 - DNA, 25 bp, Mus musculus
gaggcctgcctcttaggcagccaga

SEQ ID NO: 488378 - DNA, 25 bp, Mus musculus
gaggcctgcgatcactacaagctgt

SEQ ID NO: 488379 - DNA, 25 bp, Mus musculus
gaggcctgcgatgactacaagctgt

SEQ ID NO: 488380 - DNA, 25 bp, Mus musculus
gaggcctgctaaacaaatacttcca

SEQ ID NO: 488381 - DNA, 25 bp, Mus musculus
gaggcctgctaatcaaatacttcca

SEQ ID NO: 488382 - DNA, 25 bp, Mus musculus
gaggcctgctagagggcaccgcttt

SEQ ID NO: 488383 - DNA, 25 bp, Mus musculus
gaggcctgctagtgggcaccgcttt

SEQ ID NO: 488384 - DNA, 25 bp, Mus musculus
gaggcctgctcaacaagactccttg

SEQ ID NO: 488385 - DNA, 25 bp, Mus musculus
gaggcctgctcatcaagactccttg

SEQ ID NO: 488386 - DNA, 25 bp, Mus musculus
gaggcctgctccaggaaggaaagac

SEQ ID NO: 488387 - DNA, 25 bp, Mus musculus
gaggcctgctcctggaaggaaagac

SEQ ID NO: 488388 - DNA, 25 bp, Mus musculus
gaggcctggaatagatttgtggttc

SEQ ID NO: 488389 - DNA, 25 bp, Mus musculus
gaggcctggaattgatttgtggttc

SEQ ID NO: 488390 - DNA, 25 bp, Mus musculus
gaggcctggacaagtattgaacaca

SEQ ID NO: 488391 - DNA, 25 bp, Mus musculus
gaggcctggacatgtattgaacaca

SEQ ID NO: 488392 - DNA, 25 bp, Mus musculus
gaggcctggactcagatctaaagct

SEQ ID NO: 488393 - DNA, 25 bp, Mus musculus
gaggcctggactgagatctaaagct

SEQ ID NO: 488394 - DNA, 25 bp, Mus musculus
gaggcctggagcatttcaaacacta

SEQ ID NO: 488395 - DNA, 25 bp, Mus musculus
gaggcctggagcttttcaaacacta

SEQ ID NO: 488396 - DNA, 25 bp, Mus musculus
gaggcctgggaacttcatcacctat

SEQ ID NO: 488397 - DNA, 25 bp, Mus musculus
gaggcctgggaagttcatcacctat

SEQ ID NO: 488398 - DNA, 25 bp, Mus musculus
gaggcctggtatagacctacagctt

SEQ ID NO: 488399 - DNA, 25 bp, Mus musculus
gaggcctggtattgacctacagctt

SEQ ID NO: 488400 - DNA, 25 bp, Mus musculus
gaggcctgtagactgttctagccga

SEQ ID NO: 488401 - DNA, 25 bp, Mus musculus
gaggcctgtagagtgttctagccga

SEQ ID NO: 488402 - DNA, 25 bp, Mus musculus
gaggcctgtcaaagctatgctccta

SEQ ID NO: 488403 - DNA, 25 bp, Mus musculus
gaggcctgtcaatgctatgctccta

SEQ ID NO: 488404 - DNA, 25 bp, Mus musculus
gaggcctgtcccactgttggtcgtg

SEQ ID NO: 488405 - DNA, 25 bp, Mus musculus
gaggcctgtccctctgttggtcgtg

SEQ ID NO: 488406 - DNA, 25 bp, Mus musculus
gaggcctgtgacaccaagtggtttc

SEQ ID NO: 488407 - DNA, 25 bp, Mus musculus
gaggcctgtgactccaagtggtttc

SEQ ID NO: 488408 - DNA, 25 bp, Mus musculus
gaggcctgtgtacaacttcagtact

SEQ ID NO: 488409 - DNA, 25 bp, Mus musculus
gaggcctgtgtagaacttcagtact

SEQ ID NO: 488410 - DNA, 25 bp, Mus musculus
gaggcctgtgtgaaatctctcgttc

SEQ ID NO: 488411 - DNA, 25 bp, Mus musculus
gaggcctgtgtgaagatgccctaga

SEQ ID NO: 488412 - DNA, 25 bp, Mus musculus
gaggcctgtgtgtaatctctcgttc

SEQ ID NO: 488413 - DNA, 25 bp, Mus musculus
gaggcctgtgtgtagatgccctaga

SEQ ID NO: 488414 - DNA, 25 bp, Mus musculus
gaggcctgttcaaggacatccaaag

SEQ ID NO: 488415 - DNA, 25 bp, Mus musculus
gaggcctgttcatggacatccaaag

SEQ ID NO: 488416 - DNA, 25 bp, Mus musculus
gaggcctgttccctcctgagttaga

SEQ ID NO: 488417 - DNA, 25 bp, Mus musculus
gaggcctgttccgtcctgagttaga

SEQ ID NO: 488418 - DNA, 25 bp, Mus musculus
gaggcctgttgacgacaatgttgat

SEQ ID NO: 488419 - DNA, 25 bp, Mus musculus
gaggcctgttgaggacaatgttgat

SEQ ID NO: 488420 - DNA, 25 bp, Mus musculus
gaggccttaaaaaatccctgtgaaa

SEQ ID NO: 488421 - DNA, 25 bp, Mus musculus
gaggccttaaaatatccctgtgaaa

SEQ ID NO: 488422 - DNA, 25 bp, Mus musculus
gaggccttaaggaacctatcttgca

SEQ ID NO: 488423 - DNA, 25 bp, Mus musculus
gaggccttaaggtacctatcttgca

SEQ ID NO: 488424 - DNA, 25 bp, Mus musculus
gaggccttaatgatgctctagctag

SEQ ID NO: 488425 - DNA, 25 bp, Mus musculus
gaggccttaatgttgctctagctag

SEQ ID NO: 488426 - DNA, 25 bp, Mus musculus
gaggccttacctcacaagctaagtt

SEQ ID NO: 488427 - DNA, 25 bp, Mus musculus
gaggccttacctgacaagctaagtt

SEQ ID NO: 488428 - DNA, 25 bp, Mus musculus
gaggccttactgctgtagtctatat

SEQ ID NO: 488429 - DNA, 25 bp, Mus musculus
gaggccttactggtgtagtctatat

SEQ ID NO: 488430 - DNA, 25 bp, Mus musculus
gaggccttaggcaattctgtttttc

SEQ ID NO: 488431 - DNA, 25 bp, Mus musculus
gaggccttaggctattctgtttttc

SEQ ID NO: 488432 - DNA, 25 bp, Mus musculus
gaggccttatataaatctttagact

SEQ ID NO: 488433 - DNA, 25 bp, Mus musculus
gaggccttatattaatctttagact

SEQ ID NO: 488434 - DNA, 25 bp, Mus musculus
gaggccttcaagctattcgaccggg

SEQ ID NO: 488435 - DNA, 25 bp, Mus musculus
gaggccttcaaggtattcgaccggg

SEQ ID NO: 488436 - DNA, 25 bp, Mus musculus
gaggccttcatcagacggcaagctt

SEQ ID NO: 488437 - DNA, 25 bp, Mus musculus
gaggccttcatctgacggcaagctt

SEQ ID NO: 488438 - DNA, 25 bp, Mus musculus
gaggccttcatgatcgagattctaa

SEQ ID NO: 488439 - DNA, 25 bp, Mus musculus
gaggccttcatgttcgagattctaa

SEQ ID NO: 488440 - DNA, 25 bp, Mus musculus
gaggccttcgtgatgtattatttta

SEQ ID NO: 488441 - DNA, 25 bp, Mus musculus
gaggccttcgtgttgtattatttta

SEQ ID NO: 488442 - DNA, 25 bp, Mus musculus
gaggccttctctaatgcagtattca

SEQ ID NO: 488443 - DNA, 25 bp, Mus musculus
gaggccttctctccacaaaaagtag

SEQ ID NO: 488444 - DNA, 25 bp, Mus musculus
gaggccttctctgcacaaaaagtag

SEQ ID NO: 488445 - DNA, 25 bp, Mus musculus
gaggccttctcttatgcagtattca

SEQ ID NO: 488446 - DNA, 25 bp, Mus musculus
gaggccttctgacactcatgtgctt

SEQ ID NO: 488447 - DNA, 25 bp, Mus musculus
gaggccttctgagactcatgtgctt

SEQ ID NO: 488448 - DNA, 25 bp, Mus musculus
gaggccttctggattttaacctgca

SEQ ID NO: 488449 - DNA, 25 bp, Mus musculus
gaggccttctggtttttaacctgca

SEQ ID NO: 488450 - DNA, 25 bp, Mus musculus
gaggccttgaaaatactgatactac

SEQ ID NO: 488451 - DNA, 25 bp, Mus musculus
gaggccttgaaattactgatactac

SEQ ID NO: 488452 - DNA, 25 bp, Mus musculus
gaggccttgacaccagtggcttcat

SEQ ID NO: 488453 - DNA, 25 bp, Mus musculus
gaggccttgacaccattagctgaac

SEQ ID NO: 488454 - DNA, 25 bp, Mus musculus
gaggccttgacagcagtggcttcat

SEQ ID NO: 488455 - DNA, 25 bp, Mus musculus
gaggccttgacagcattagctgaac

SEQ ID NO: 488456 - DNA, 25 bp, Mus musculus
gaggccttgactaaggatatcctga

SEQ ID NO: 488457 - DNA, 25 bp, Mus musculus
gaggccttgacttaggatatcctga

SEQ ID NO: 488458 - DNA, 25 bp, Mus musculus
gaggccttgaggctattcatgccaa

SEQ ID NO: 488459 - DNA, 25 bp, Mus musculus
gaggccttgagggtattcatgccaa

SEQ ID NO: 488460 - DNA, 25 bp, Mus musculus
gaggccttgcagctctttaaagagg

SEQ ID NO: 488461 - DNA, 25 bp, Mus musculus
gaggccttgcaggtctttaaagagg

SEQ ID NO: 488462 - DNA, 25 bp, Mus musculus
gaggccttgcccctgaagctcatcg

SEQ ID NO: 488463 - DNA, 25 bp, Mus musculus
gaggccttgcccgtgaagctcatcg

SEQ ID NO: 488464 - DNA, 25 bp, Mus musculus
gaggccttgctcaatctgagtcaga

SEQ ID NO: 488465 - DNA, 25 bp, Mus musculus
gaggccttgctctatctgagtcaga

SEQ ID NO: 488466 - DNA, 25 bp, Mus musculus
gaggccttggacacctttttgttgt

SEQ ID NO: 488467 - DNA, 25 bp, Mus musculus
gaggccttggactcctttttgttgt

SEQ ID NO: 488468 - DNA, 25 bp, Mus musculus
gaggccttggatatggcagccatca

SEQ ID NO: 488469 - DNA, 25 bp, Mus musculus
gaggccttggatttggcagccatca

SEQ ID NO: 488470 - DNA, 25 bp, Mus musculus
gaggccttggctccgaaacaaacaa

SEQ ID NO: 488471 - DNA, 25 bp, Mus musculus
gaggccttggctgcgaaacaaacaa

SEQ ID NO: 488472 - DNA, 25 bp, Mus musculus
gaggcctttaatcgcttggtcattg

SEQ ID NO: 488473 - DNA, 25 bp, Mus musculus
gaggcctttaatggcttggtcattg

SEQ ID NO: 488474 - DNA, 25 bp, Mus musculus
gaggcctttagaatccagcctgcct

SEQ ID NO: 488475 - DNA, 25 bp, Mus musculus
gaggcctttagattccagcctgcct

SEQ ID NO: 488476 - DNA, 25 bp, Mus musculus
gaggcctttaggaatttcagaatca

SEQ ID NO: 488477 - DNA, 25 bp, Mus musculus
gaggcctttaggtatttcagaatca

SEQ ID NO: 488478 - DNA, 25 bp, Mus musculus
gaggcctttcaacaccctaagctgg

SEQ ID NO: 488479 - DNA, 25 bp, Mus musculus
gaggcctttcaagaccctaagctgg

SEQ ID NO: 488480 - DNA, 25 bp, Mus musculus
gaggcctttcccaacagtgtacaat

SEQ ID NO: 488481 - DNA, 25 bp, Mus musculus
gaggcctttccctacagtgtacaat

SEQ ID NO: 488482 - DNA, 25 bp, Mus musculus
gaggcctttgatccatttatgacca

SEQ ID NO: 488483 - DNA, 25 bp, Mus musculus
gaggcctttgatgcatttatgacca

SEQ ID NO: 488484 - DNA, 25 bp, Mus musculus
gaggccttttataaacgtcatacca

SEQ ID NO: 488485 - DNA, 25 bp, Mus musculus
gaggccttttattaacgtcatacca

SEQ ID NO: 488486 - DNA, 25 bp, Mus musculus
gaggccttttgaaatagtgtcatac

SEQ ID NO: 488487 - DNA, 25 bp, Mus musculus
gaggccttttgatatagtgtcatac

SEQ ID NO: 488488 - DNA, 25 bp, Mus musculus
gaggcgaaacaactccacggagtca

SEQ ID NO: 488489 - DNA, 25 bp, Mus musculus
gaggcgaaacaagtccacggagtca

SEQ ID NO: 488490 - DNA, 25 bp, Mus musculus
gaggcgaagactcaccttctggaat

SEQ ID NO: 488491 - DNA, 25 bp, Mus musculus
gaggcgaagactgaccttctggaat

SEQ ID NO: 488492 - DNA, 25 bp, Mus musculus
gaggcgaaggcaacagtcgcttcac

SEQ ID NO: 488493 - DNA, 25 bp, Mus musculus
gaggcgaaggcatcagtcgcttcac

SEQ ID NO: 488494 - DNA, 25 bp, Mus musculus
gaggcgaaggcgcacactcctacag

SEQ ID NO: 488495 - DNA, 25 bp, Mus musculus
gaggcgaaggcggacactcctacag

SEQ ID NO: 488496 - DNA, 25 bp, Mus musculus
gaggcgaatctcattatctcggatt

SEQ ID NO: 488497 - DNA, 25 bp, Mus musculus
gaggcgaatctctttatctcggatt

SEQ ID NO: 488498 - DNA, 25 bp, Mus musculus
gaggcgacaattctctgaactgttg

SEQ ID NO: 488499 - DNA, 25 bp, Mus musculus
gaggcgacaattgtctgaactgttg

SEQ ID NO: 488500 - DNA, 25 bp, Mus musculus
gaggcgacagagatgactccaacta

SEQ ID NO: 488501 - DNA, 25 bp, Mus musculus
gaggcgacagagttgactccaacta

SEQ ID NO: 488502 - DNA, 25 bp, Mus musculus
gaggcgacccgcctgggccagaggg

SEQ ID NO: 488503 - DNA, 25 bp, Mus musculus
gaggcgacccgcgtgggccagaggg

SEQ ID NO: 488504 - DNA, 25 bp, Mus musculus
gaggcgaccgcgaccgtgaagtcgg

SEQ ID NO: 488505 - DNA, 25 bp, Mus musculus
gaggcgaccgcgtccgtgaagtcgg

SEQ ID NO: 488506 - DNA, 25 bp, Mus musculus
gaggcgagccaacaagaagcgtttc

SEQ ID NO: 488507 - DNA, 25 bp, Mus musculus
gaggcgagccaagaagaagcgtttc

SEQ ID NO: 488508 - DNA, 25 bp, Mus musculus
gaggcgaggcacagtgctttccctt

SEQ ID NO: 488509 - DNA, 25 bp, Mus musculus
gaggcgaggcactgtgctttccctt

SEQ ID NO: 488510 - DNA, 25 bp, Mus musculus
gaggcgataggaattgttcgaatca

SEQ ID NO: 488511 - DNA, 25 bp, Mus musculus
gaggcgataggatttgttcgaatca

SEQ ID NO: 488512 - DNA, 25 bp, Mus musculus
gaggcgatggtacgctcttgtccct

SEQ ID NO: 488513 - DNA, 25 bp, Mus musculus
gaggcgatggtaggctcttgtccct

SEQ ID NO: 488514 - DNA, 25 bp, Mus musculus
gaggcgatgtatctatccaatgcat

SEQ ID NO: 488515 - DNA, 25 bp, Mus musculus
gaggcgatgtatgtatccaatgcat

SEQ ID NO: 488516 - DNA, 25 bp, Mus musculus
gaggcgattactatctattcaatgt

SEQ ID NO: 488517 - DNA, 25 bp, Mus musculus
gaggcgattactttctattcaatgt

SEQ ID NO: 488518 - DNA, 25 bp, Mus musculus
gaggcgattgctagcagagaaactt

SEQ ID NO: 488519 - DNA, 25 bp, Mus musculus
gaggcgattgcttgcagagaaactt

SEQ ID NO: 488520 - DNA, 25 bp, Mus musculus
gaggcgcaaataaactttttcgaat

SEQ ID NO: 488521 - DNA, 25 bp, Mus musculus
gaggcgcaaatatactttttcgaat

SEQ ID NO: 488522 - DNA, 25 bp, Mus musculus
gaggcgcacataacggcagatgcat

SEQ ID NO: 488523 - DNA, 25 bp, Mus musculus
gaggcgcacatatcggcagatgcat

SEQ ID NO: 488524 - DNA, 25 bp, Mus musculus
gaggcgccacttaccaactaaaggt

SEQ ID NO: 488525 - DNA, 25 bp, Mus musculus
gaggcgccactttccaactaaaggt

SEQ ID NO: 488526 - DNA, 25 bp, Mus musculus
gaggcgccagatcccattggtaaag

SEQ ID NO: 488527 - DNA, 25 bp, Mus musculus
gaggcgccagatgccattggtaaag

SEQ ID NO: 488528 - DNA, 25 bp, Mus musculus
gaggcgccaggcacactgatcccaa

SEQ ID NO: 488529 - DNA, 25 bp, Mus musculus
gaggcgccaggctcactgatcccaa

SEQ ID NO: 488530 - DNA, 25 bp, Mus musculus
gaggcgccatgaatgcggtttctct

SEQ ID NO: 488531 - DNA, 25 bp, Mus musculus
gaggcgccatgattgcggtttctct

SEQ ID NO: 488532 - DNA, 25 bp, Mus musculus
gaggcgcggaccacatcgagaatca

SEQ ID NO: 488533 - DNA, 25 bp, Mus musculus
gaggcgcggacctcatcgagaatca

SEQ ID NO: 488534 - DNA, 25 bp, Mus musculus
gaggcgcggtcactcctgagtacac

SEQ ID NO: 488535 - DNA, 25 bp, Mus musculus
gaggcgcggtcagtcctgagtacac

SEQ ID NO: 488536 - DNA, 25 bp, Mus musculus
gaggcgctaaggaacctaactttgt

SEQ ID NO: 488537 - DNA, 25 bp, Mus musculus
gaggcgctaaggtacctaactttgt

SEQ ID NO: 488538 - DNA, 25 bp, Mus musculus
gaggcgctccttatctaactggaag

SEQ ID NO: 488539 - DNA, 25 bp, Mus musculus
gaggcgctccttttctaactggaag

SEQ ID NO: 488540 - DNA, 25 bp, Mus musculus
gaggcgctgcgcacaaaccgggaaa

SEQ ID NO: 488541 - DNA, 25 bp, Mus musculus
gaggcgctgcgctcaaaccgggaaa

SEQ ID NO: 488542 - DNA, 25 bp, Mus musculus
gaggcgctgctcaaggcttgccaac

SEQ ID NO: 488543 - DNA, 25 bp, Mus musculus
gaggcgctgctctaggcttgccaac

SEQ ID NO: 488544 - DNA, 25 bp, Mus musculus
gaggcgctggcaagcccgaatcggt

SEQ ID NO: 488545 - DNA, 25 bp, Mus musculus
gaggcgctggcatgcccgaatcggt

SEQ ID NO: 488546 - DNA, 25 bp, Mus musculus
gaggcgctgggtaccctcttcagca

SEQ ID NO: 488547 - DNA, 25 bp, Mus musculus
gaggcgctgggttccctcttcagca

SEQ ID NO: 488548 - DNA, 25 bp, Mus musculus
gaggcgctgtacagtgactatctcc

SEQ ID NO: 488549 - DNA, 25 bp, Mus musculus
gaggcgctgtactgtgactatctcc

SEQ ID NO: 488550 - DNA, 25 bp, Mus musculus
gaggcgctgtgcagtttcattcggt

SEQ ID NO: 488551 - DNA, 25 bp, Mus musculus
gaggcgctgtgctgtttcattcggt

SEQ ID NO: 488552 - DNA, 25 bp, Mus musculus
gaggcgcttgtgagctcaccaggca

SEQ ID NO: 488553 - DNA, 25 bp, Mus musculus
gaggcgcttgtgtgctcaccaggca

SEQ ID NO: 488554 - DNA, 25 bp, Mus musculus
gaggcggaaatgagccttcaactca

SEQ ID NO: 488555 - DNA, 25 bp, Mus musculus
gaggcggaaatgtgccttcaactca

SEQ ID NO: 488556 - DNA, 25 bp, Mus musculus
gaggcggacacacaacgtcttggaa

SEQ ID NO: 488557 - DNA, 25 bp, Mus musculus
gaggcggacacagaacgtcttggaa

SEQ ID NO: 488558 - DNA, 25 bp, Mus musculus
gaggcggatcagcaaatctctccaa

SEQ ID NO: 488559 - DNA, 25 bp, Mus musculus
gaggcggatcaggaaatctctccaa

SEQ ID NO: 488560 - DNA, 25 bp, Mus musculus
gaggcggatctccagcctggaatca

SEQ ID NO: 488561 - DNA, 25 bp, Mus musculus
gaggcggatctcgagcctggaatca

SEQ ID NO: 488562 - DNA, 25 bp, Mus musculus
gaggcggcacctcggcggcggtgat

SEQ ID NO: 488563 - DNA, 25 bp, Mus musculus
gaggcggcacctgggcggcggtgat

SEQ ID NO: 488564 - DNA, 25 bp, Mus musculus
gaggcggcatgcatctgggtacacc

SEQ ID NO: 488565 - DNA, 25 bp, Mus musculus
gaggcggcatgcttctgggtacacc

SEQ ID NO: 488566 - DNA, 25 bp, Mus musculus
gaggcggcatgtactaactcctaga

SEQ ID NO: 488567 - DNA, 25 bp, Mus musculus
gaggcggcatgttctaactcctaga

SEQ ID NO: 488568 - DNA, 25 bp, Mus musculus
gaggcggcctgaacggacatttgac

SEQ ID NO: 488569 - DNA, 25 bp, Mus musculus
gaggcggcctgatcggacatttgac

SEQ ID NO: 488570 - DNA, 25 bp, Mus musculus
gaggcggcggctacgtcatgtccca

SEQ ID NO: 488571 - DNA, 25 bp, Mus musculus
gaggcggcggcttcgtcatgtccca

SEQ ID NO: 488572 - DNA, 25 bp, Mus musculus
gaggcggcttttcccttgaaaggca

SEQ ID NO: 488573 - DNA, 25 bp, Mus musculus
gaggcggcttttgccttgaaaggca

SEQ ID NO: 488574 - DNA, 25 bp, Mus musculus
gaggcgggacaacagccagtacccc

SEQ ID NO: 488575 - DNA, 25 bp, Mus musculus
gaggcgggacaagagccagtacccc

SEQ ID NO: 488576 - DNA, 25 bp, Mus musculus
gaggcgggagctaatcttggctata

SEQ ID NO: 488577 - DNA, 25 bp, Mus musculus
gaggcgggagcttatcttggctata

SEQ ID NO: 488578 - DNA, 25 bp, Mus musculus
gaggcgggcatcacatctcctggga

SEQ ID NO: 488579 - DNA, 25 bp, Mus musculus
gaggcgggcatctcatctcctggga

SEQ ID NO: 488580 - DNA, 25 bp, Mus musculus
gaggcgggttggagctaaattcaca

SEQ ID NO: 488581 - DNA, 25 bp, Mus musculus
gaggcgggttggtgctaaattcaca

SEQ ID NO: 488582 - DNA, 25 bp, Mus musculus
gaggcggttccaccagaagtttcac

SEQ ID NO: 488583 - DNA, 25 bp, Mus musculus
gaggcggttccagcagaagtttcac

SEQ ID NO: 488584 - DNA, 25 bp, Mus musculus
gaggcggttgtgaaatcttcgtact

SEQ ID NO: 488585 - DNA, 25 bp, Mus musculus
gaggcggttgtgtaatcttcgtact

SEQ ID NO: 488586 - DNA, 25 bp, Mus musculus
gaggcggtttcaagttactattcaa

SEQ ID NO: 488587 - DNA, 25 bp, Mus musculus
gaggcggtttcatgttactattcaa

SEQ ID NO: 488588 - DNA, 25 bp, Mus musculus
gaggcgtaaatcaccactatatcca

SEQ ID NO: 488589 - DNA, 25 bp, Mus musculus
gaggcgtaaatctccactatatcca

SEQ ID NO: 488590 - DNA, 25 bp, Mus musculus
gaggcgtataacctgatctgtacat

SEQ ID NO: 488591 - DNA, 25 bp, Mus musculus
gaggcgtataacgtgatctgtacat

SEQ ID NO: 488592 - DNA, 25 bp, Mus musculus
gaggcgtatgtaaattttgagaacc

SEQ ID NO: 488593 - DNA, 25 bp, Mus musculus
gaggcgtatgtatattttgagaacc

SEQ ID NO: 488594 - DNA, 25 bp, Mus musculus
gaggcgtcattaaaactatcaacag

SEQ ID NO: 488595 - DNA, 25 bp, Mus musculus
gaggcgtcattataactatcaacag

SEQ ID NO: 488596 - DNA, 25 bp, Mus musculus
gaggcgtgattgacattctcaagca

SEQ ID NO: 488597 - DNA, 25 bp, Mus musculus
gaggcgtgattgtcattctcaagca

SEQ ID NO: 488598 - DNA, 25 bp, Mus musculus
gaggcgtgcttgaaaccgagaacca

SEQ ID NO: 488599 - DNA, 25 bp, Mus musculus
gaggcgtgcttgtaaccgagaacca

SEQ ID NO: 488600 - DNA, 25 bp, Mus musculus
gaggcgtggtctccctagtaactag

SEQ ID NO: 488601 - DNA, 25 bp, Mus musculus
gaggcgtggtctgcctagtaactag

SEQ ID NO: 488602 - DNA, 25 bp, Mus musculus
gaggcgttgcctaatgttttaacac

SEQ ID NO: 488603 - DNA, 25 bp, Mus musculus
gaggcgttgccttatgttttaacac

SEQ ID NO: 488604 - DNA, 25 bp, Mus musculus
gaggcgtttacgagctgtaatcaca

SEQ ID NO: 488605 - DNA, 25 bp, Mus musculus
gaggcgtttacgtgctgtaatcaca

SEQ ID NO: 488606 - DNA, 25 bp, Mus musculus
gaggcgtttattccgtggattcata

SEQ ID NO: 488607 - DNA, 25 bp, Mus musculus
gaggcgtttattgcgtggattcata

SEQ ID NO: 488608 - DNA, 25 bp, Mus musculus
gaggcgttttacattctgacctatg

SEQ ID NO: 488609 - DNA, 25 bp, Mus musculus
gaggcgttttactttctgacctatg

SEQ ID NO: 488610 - DNA, 25 bp, Mus musculus
gaggcgttttccctaatggcacctg

SEQ ID NO: 488611 - DNA, 25 bp, Mus musculus
gaggcgttttccgtaatggcacctg

SEQ ID NO: 488612 - DNA, 25 bp, Mus musculus
gaggcgttttggatcctgaattgat

SEQ ID NO: 488613 - DNA, 25 bp, Mus musculus
gaggcgttttggttcctgaattgat

SEQ ID NO: 488614 - DNA, 25 bp, Mus musculus
gaggctaaagttaccctgagaacat

SEQ ID NO: 488615 - DNA, 25 bp, Mus musculus
gaggctaaagtttccctgagaacat

SEQ ID NO: 488616 - DNA, 25 bp, Mus musculus
gaggctaacctcaaagatatttttt

SEQ ID NO: 488617 - DNA, 25 bp, Mus musculus
gaggctaacctctaagatatttttt

SEQ ID NO: 488618 - DNA, 25 bp, Mus musculus
gaggctaagcgcatggccatcatga

SEQ ID NO: 488619 - DNA, 25 bp, Mus musculus
gaggctaagcgcttggccatcatga

SEQ ID NO: 488620 - DNA, 25 bp, Mus musculus
gaggctaatagcaccagctgaggta

SEQ ID NO: 488621 - DNA, 25 bp, Mus musculus
gaggctaatagctccagctgaggta

SEQ ID NO: 488622 - DNA, 25 bp, Mus musculus
gaggctaatatgcttgttcacttga

SEQ ID NO: 488623 - DNA, 25 bp, Mus musculus
gaggctaatatggttgttcacttga

SEQ ID NO: 488624 - DNA, 25 bp, Mus musculus
gaggctaatctcaacctgaaccagg

SEQ ID NO: 488625 - DNA, 25 bp, Mus musculus
gaggctaatctctacctgaaccagg

SEQ ID NO: 488626 - DNA, 25 bp, Mus musculus
gaggctaatgtaattccgatgtcgg

SEQ ID NO: 488627 - DNA, 25 bp, Mus musculus
gaggctaatgtatttccgatgtcgg

SEQ ID NO: 488628 - DNA, 25 bp, Mus musculus
gaggctaatttgagcttcgtggata

SEQ ID NO: 488629 - DNA, 25 bp, Mus musculus
gaggctaatttgtgcttcgtggata

SEQ ID NO: 488630 - DNA, 25 bp, Mus musculus
gaggctacaaaaactaaccctggat

SEQ ID NO: 488631 - DNA, 25 bp, Mus musculus
gaggctacaaaatctaaccctggat

SEQ ID NO: 488632 - DNA, 25 bp, Mus musculus
gaggctacaaggatcatgtcagttc

SEQ ID NO: 488633 - DNA, 25 bp, Mus musculus
gaggctacaaggcagcgctaactag

SEQ ID NO: 488634 - DNA, 25 bp, Mus musculus
gaggctacaagggagcgctaactag

SEQ ID NO: 488635 - DNA, 25 bp, Mus musculus
gaggctacaaggttcatgtcagttc

SEQ ID NO: 488636 - DNA, 25 bp, Mus musculus
gaggctacaattactggcagccaga

SEQ ID NO: 488637 - DNA, 25 bp, Mus musculus
gaggctacaatttctggcagccaga

SEQ ID NO: 488638 - DNA, 25 bp, Mus musculus
gaggctacagacacaccgatcgtca

SEQ ID NO: 488639 - DNA, 25 bp, Mus musculus
gaggctacagacattacagggtatt

SEQ ID NO: 488640 - DNA, 25 bp, Mus musculus
gaggctacagacattgacagcatca

SEQ ID NO: 488641 - DNA, 25 bp, Mus musculus
gaggctacagactcaccgatcgtca

SEQ ID NO: 488642 - DNA, 25 bp, Mus musculus
gaggctacagactttacagggtatt

SEQ ID NO: 488643 - DNA, 25 bp, Mus musculus
gaggctacagactttgacagcatca

SEQ ID NO: 488644 - DNA, 25 bp, Mus musculus
gaggctacagcccagaaactagacg

SEQ ID NO: 488645 - DNA, 25 bp, Mus musculus
gaggctacagccgagaaactagacg

SEQ ID NO: 488646 - DNA, 25 bp, Mus musculus
gaggctacaggtcaagtttgtttat

SEQ ID NO: 488647 - DNA, 25 bp, Mus musculus
gaggctacaggtgaagtttgtttat

SEQ ID NO: 488648 - DNA, 25 bp, Mus musculus
gaggctacagtccttttttacagta

SEQ ID NO: 488649 - DNA, 25 bp, Mus musculus
gaggctacagtcgttttttacagta

SEQ ID NO: 488650 - DNA, 25 bp, Mus musculus
gaggctaccatgacttcagcgtgaa

SEQ ID NO: 488651 - DNA, 25 bp, Mus musculus
gaggctaccatgtcttcagcgtgaa

SEQ ID NO: 488652 - DNA, 25 bp, Mus musculus
gaggctacccggatacggagccgat

SEQ ID NO: 488653 - DNA, 25 bp, Mus musculus
gaggctacccggttacggagccgat

SEQ ID NO: 488654 - DNA, 25 bp, Mus musculus
gaggctacgttaaaatgaccgacca

SEQ ID NO: 488655 - DNA, 25 bp, Mus musculus
gaggctacgttataatgaccgacca

SEQ ID NO: 488656 - DNA, 25 bp, Mus musculus
gaggctactaaacccaataggcagt

SEQ ID NO: 488657 - DNA, 25 bp, Mus musculus
gaggctactaaagccaataggcagt

SEQ ID NO: 488658 - DNA, 25 bp, Mus musculus
gaggctactctccttcaatcagaag

SEQ ID NO: 488659 - DNA, 25 bp, Mus musculus
gaggctactctcgttcaatcagaag

SEQ ID NO: 488660 - DNA, 25 bp, Mus musculus
gaggctactcttaaagatgttcatt

SEQ ID NO: 488661 - DNA, 25 bp, Mus musculus
gaggctactctttaagatgttcatt

SEQ ID NO: 488662 - DNA, 25 bp, Mus musculus
gaggctactgaaacccgaatttgac

SEQ ID NO: 488663 - DNA, 25 bp, Mus musculus
gaggctactgaatcccgaatttgac

SEQ ID NO: 488664 - DNA, 25 bp, Mus musculus
gaggctactgctcattgccagtttt

SEQ ID NO: 488665 - DNA, 25 bp, Mus musculus
gaggctactgctgattgccagtttt

SEQ ID NO: 488666 - DNA, 25 bp, Mus musculus
gaggctactgtgatgttttcatgcg

SEQ ID NO: 488667 - DNA, 25 bp, Mus musculus
gaggctactgtgttgttttcatgcg

SEQ ID NO: 488668 - DNA, 25 bp, Mus musculus
gaggctagactacatcacagcagaa

SEQ ID NO: 488669 - DNA, 25 bp, Mus musculus
gaggctagactagatcacagcagaa

SEQ ID NO: 488670 - DNA, 25 bp, Mus musculus
gaggctagaggtccattgaaagcac

SEQ ID NO: 488671 - DNA, 25 bp, Mus musculus
gaggctagaggtgcattgaaagcac

SEQ ID NO: 488672 - DNA, 25 bp, Mus musculus
gaggctagagtaacatgcatttgaa

SEQ ID NO: 488673 - DNA, 25 bp, Mus musculus
gaggctagagtatcatgcatttgaa

SEQ ID NO: 488674 - DNA, 25 bp, Mus musculus
gaggctagcaatagagaccaccacc

SEQ ID NO: 488675 - DNA, 25 bp, Mus musculus
gaggctagcaattgagaccaccacc

SEQ ID NO: 488676 - DNA, 25 bp, Mus musculus
gaggctagcacaagtgtatcattct

SEQ ID NO: 488677 - DNA, 25 bp, Mus musculus
gaggctagcacatgtgtatcattct

SEQ ID NO: 488678 - DNA, 25 bp, Mus musculus
gaggctagcaccacttagggaaaca

SEQ ID NO: 488679 - DNA, 25 bp, Mus musculus
gaggctagcacctcttagggaaaca

SEQ ID NO: 488680 - DNA, 25 bp, Mus musculus
gaggctagcatacaaggatcatcat

SEQ ID NO: 488681 - DNA, 25 bp, Mus musculus
gaggctagcatagaaggatcatcat

SEQ ID NO: 488682 - DNA, 25 bp, Mus musculus
gaggctagcatgacctgcagaacat

SEQ ID NO: 488683 - DNA, 25 bp, Mus musculus
gaggctagcatgctcaataaagata

SEQ ID NO: 488684 - DNA, 25 bp, Mus musculus
gaggctagcatggtcaataaagata

SEQ ID NO: 488685 - DNA, 25 bp, Mus musculus
gaggctagcatgtcctgcagaacat

SEQ ID NO: 488686 - DNA, 25 bp, Mus musculus
gaggctagccagattacagagtttc

SEQ ID NO: 488687 - DNA, 25 bp, Mus musculus
gaggctagccagtttacagagtttc

SEQ ID NO: 488688 - DNA, 25 bp, Mus musculus
gaggctagcctacaatgcaactaaa

SEQ ID NO: 488689 - DNA, 25 bp, Mus musculus
gaggctagcctagaatgcaactaaa

SEQ ID NO: 488690 - DNA, 25 bp, Mus musculus
gaggctagccttcggcaacatatca

SEQ ID NO: 488691 - DNA, 25 bp, Mus musculus
gaggctagccttgggcaacatatca

SEQ ID NO: 488692 - DNA, 25 bp, Mus musculus
gaggctagcttcagcaacctggtga

SEQ ID NO: 488693 - DNA, 25 bp, Mus musculus
gaggctagcttcctggagacttcgt

SEQ ID NO: 488694 - DNA, 25 bp, Mus musculus
gaggctagcttcgtggagacttcgt

SEQ ID NO: 488695 - DNA, 25 bp, Mus musculus
gaggctagcttctgcaacctggtga

SEQ ID NO: 488696 - DNA, 25 bp, Mus musculus
gaggctaggaaaattacccatccag

SEQ ID NO: 488697 - DNA, 25 bp, Mus musculus
gaggctaggaaatttacccatccag

SEQ ID NO: 488698 - DNA, 25 bp, Mus musculus
gaggctaggtaacatactcagacca

SEQ ID NO: 488699 - DNA, 25 bp, Mus musculus
gaggctaggtaagatactcagacca

SEQ ID NO: 488700 - DNA, 25 bp, Mus musculus
gaggctagtaccaacatgaccacac

SEQ ID NO: 488701 - DNA, 25 bp, Mus musculus
gaggctagtacctacatgaccacac

SEQ ID NO: 488702 - DNA, 25 bp, Mus musculus
gaggctagtcataggctggatttat

SEQ ID NO: 488703 - DNA, 25 bp, Mus musculus
gaggctagtcattggctggatttat

SEQ ID NO: 488704 - DNA, 25 bp, Mus musculus
gaggctagtcccaggaaccgatata

SEQ ID NO: 488705 - DNA, 25 bp, Mus musculus
gaggctagtccctggaaccgatata

SEQ ID NO: 488706 - DNA, 25 bp, Mus musculus
gaggctagtggcaggtgtatcccaa

SEQ ID NO: 488707 - DNA, 25 bp, Mus musculus
gaggctagtggctggtgtatcccaa

SEQ ID NO: 488708 - DNA, 25 bp, Mus musculus
gaggctagtgtacatattctggtga

SEQ ID NO: 488709 - DNA, 25 bp, Mus musculus
gaggctagtgtagatattctggtga

SEQ ID NO: 488710 - DNA, 25 bp, Mus musculus
gaggctatacagatcatcagctcac

SEQ ID NO: 488711 - DNA, 25 bp, Mus musculus
gaggctatacagttcatcagctcac

SEQ ID NO: 488712 - DNA, 25 bp, Mus musculus
gaggctatacctcaaattagctgtg

SEQ ID NO: 488713 - DNA, 25 bp, Mus musculus
gaggctatacctgaaattagctgtg

SEQ ID NO: 488714 - DNA, 25 bp, Mus musculus
gaggctatagtgcactgttttcatt

SEQ ID NO: 488715 - DNA, 25 bp, Mus musculus
gaggctatagtggactgttttcatt

SEQ ID NO: 488716 - DNA, 25 bp, Mus musculus
gaggctatatagctaccttgcccac

SEQ ID NO: 488717 - DNA, 25 bp, Mus musculus
gaggctatataggtaccttgcccac

SEQ ID NO: 488718 - DNA, 25 bp, Mus musculus
gaggctatcacacggcattcagagt

SEQ ID NO: 488719 - DNA, 25 bp, Mus musculus
gaggctatcacagggcattcagagt

SEQ ID NO: 488720 - DNA, 25 bp, Mus musculus
gaggctatcaggctatttacattta

SEQ ID NO: 488721 - DNA, 25 bp, Mus musculus
gaggctatcagggtatttacattta

SEQ ID NO: 488722 - DNA, 25 bp, Mus musculus
gaggctatcgccatcaagcggatgc

SEQ ID NO: 488723 - DNA, 25 bp, Mus musculus
gaggctatcgccttcaagcggatgc

SEQ ID NO: 488724 - DNA, 25 bp, Mus musculus
gaggctatgacaaccctaactttgt

SEQ ID NO: 488725 - DNA, 25 bp, Mus musculus
gaggctatgacatccctaactttgt

SEQ ID NO: 488726 - DNA, 25 bp, Mus musculus
gaggctatgagcacatgaatctttt

SEQ ID NO: 488727 - DNA, 25 bp, Mus musculus
gaggctatgagctcatgaatctttt

SEQ ID NO: 488728 - DNA, 25 bp, Mus musculus
gaggctatgataccacacacttgtg

SEQ ID NO: 488729 - DNA, 25 bp, Mus musculus
gaggctatgatagcacacacttgtg

SEQ ID NO: 488730 - DNA, 25 bp, Mus musculus
gaggctatgatgaccttcagaccat

SEQ ID NO: 488731 - DNA, 25 bp, Mus musculus
gaggctatgatgtccttcagaccat

SEQ ID NO: 488732 - DNA, 25 bp, Mus musculus
gaggctatggcacatgaaagcatga

SEQ ID NO: 488733 - DNA, 25 bp, Mus musculus
gaggctatggcagatgaaagcatga

SEQ ID NO: 488734 - DNA, 25 bp, Mus musculus
gaggctatgggaatccaaaggacag

SEQ ID NO: 488735 - DNA, 25 bp, Mus musculus
gaggctatgggattccaaaggacag

SEQ ID NO: 488736 - DNA, 25 bp, Mus musculus
gaggctatgtagaccaaattttctg

SEQ ID NO: 488737 - DNA, 25 bp, Mus musculus
gaggctatgtagtccaaattttctg

SEQ ID NO: 488738 - DNA, 25 bp, Mus musculus
gaggctatgtatacttggccttagc

SEQ ID NO: 488739 - DNA, 25 bp, Mus musculus
gaggctatgtattcttggccttagc

SEQ ID NO: 488740 - DNA, 25 bp, Mus musculus
gaggctatgtctcaccagaggctcc

SEQ ID NO: 488741 - DNA, 25 bp, Mus musculus
gaggctatgtctgaccagaggctcc

SEQ ID NO: 488742 - DNA, 25 bp, Mus musculus
gaggctatgtgaccaattctcatca

SEQ ID NO: 488743 - DNA, 25 bp, Mus musculus
gaggctatgtgagcaattctcatca

SEQ ID NO: 488744 - DNA, 25 bp, Mus musculus
gaggctatgtggattgtaatattct

SEQ ID NO: 488745 - DNA, 25 bp, Mus musculus
gaggctatgtggtttgtaatattct

SEQ ID NO: 488746 - DNA, 25 bp, Mus musculus
gaggctattaggagccttgttgctg

SEQ ID NO: 488747 - DNA, 25 bp, Mus musculus
gaggctattaggtgccttgttgctg

SEQ ID NO: 488748 - DNA, 25 bp, Mus musculus
gaggctattctcaattcgggtgcta

SEQ ID NO: 488749 - DNA, 25 bp, Mus musculus
gaggctattctctattcgggtgcta

SEQ ID NO: 488750 - DNA, 25 bp, Mus musculus
gaggctatttgcacaactggcatct

SEQ ID NO: 488751 - DNA, 25 bp, Mus musculus
gaggctatttgctcaactggcatct

SEQ ID NO: 488752 - DNA, 25 bp, Mus musculus
gaggctattttgatctatactcccg

SEQ ID NO: 488753 - DNA, 25 bp, Mus musculus
gaggctattttgttctatactcccg

SEQ ID NO: 488754 - DNA, 25 bp, Mus musculus
gaggctatttttcttgagccagaga

SEQ ID NO: 488755 - DNA, 25 bp, Mus musculus
gaggctatttttgttgagccagaga

SEQ ID NO: 488756 - DNA, 25 bp, Mus musculus
gaggctcaaaatcctgaattctctc

SEQ ID NO: 488757 - DNA, 25 bp, Mus musculus
gaggctcaaaatgctgaattctctc

SEQ ID NO: 488758 - DNA, 25 bp, Mus musculus
gaggctcaaatgcatcacttccaac

SEQ ID NO: 488759 - DNA, 25 bp, Mus musculus
gaggctcaaatggatcacttccaac

SEQ ID NO: 488760 - DNA, 25 bp, Mus musculus
gaggctcaacctcattgaatgtgcc

SEQ ID NO: 488761 - DNA, 25 bp, Mus musculus
gaggctcaacctgattgaatgtgcc

SEQ ID NO: 488762 - DNA, 25 bp, Mus musculus
gaggctcaaggtaggctttttccat

SEQ ID NO: 488763 - DNA, 25 bp, Mus musculus
gaggctcaaggttggctttttccat

SEQ ID NO: 488764 - DNA, 25 bp, Mus musculus
gaggctcaagtgaacccggaacgta

SEQ ID NO: 488765 - DNA, 25 bp, Mus musculus
gaggctcaagtgtacccggaacgta

SEQ ID NO: 488766 - DNA, 25 bp, Mus musculus
gaggctcaatctcacattggcttgt

SEQ ID NO: 488767 - DNA, 25 bp, Mus musculus
gaggctcaatctgacattggcttgt

SEQ ID NO: 488768 - DNA, 25 bp, Mus musculus
gaggctcaatgccaggagttctcta

SEQ ID NO: 488769 - DNA, 25 bp, Mus musculus
gaggctcaatgcgaggagttctcta

SEQ ID NO: 488770 - DNA, 25 bp, Mus musculus
gaggctcaatggattgaagccagcc

SEQ ID NO: 488771 - DNA, 25 bp, Mus musculus
gaggctcaatggtttgaagccagcc

SEQ ID NO: 488772 - DNA, 25 bp, Mus musculus
gaggctcaattcatcatttatactt

SEQ ID NO: 488773 - DNA, 25 bp, Mus musculus
gaggctcaattcttcatttatactt

SEQ ID NO: 488774 - DNA, 25 bp, Mus musculus
gaggctcacaatccttgatctcatg

SEQ ID NO: 488775 - DNA, 25 bp, Mus musculus
gaggctcacaatgcttgatctcatg

SEQ ID NO: 488776 - DNA, 25 bp, Mus musculus
gaggctcacataataaccactgttc

SEQ ID NO: 488777 - DNA, 25 bp, Mus musculus
gaggctcacatattaaccactgttc

SEQ ID NO: 488778 - DNA, 25 bp, Mus musculus
gaggctcacattcggttttgagaca

SEQ ID NO: 488779 - DNA, 25 bp, Mus musculus
gaggctcacattgggttttgagaca

SEQ ID NO: 488780 - DNA, 25 bp, Mus musculus
gaggctcaccaactaaggtctggga

SEQ ID NO: 488781 - DNA, 25 bp, Mus musculus
gaggctcaccaagtaaggtctggga

SEQ ID NO: 488782 - DNA, 25 bp, Mus musculus
gaggctcacgagcacgactttaaaa

SEQ ID NO: 488783 - DNA, 25 bp, Mus musculus
gaggctcacgaggacgactttaaaa

SEQ ID NO: 488784 - DNA, 25 bp, Mus musculus
gaggctcacgttacttctctttaca

SEQ ID NO: 488785 - DNA, 25 bp, Mus musculus
gaggctcacgtttcttctctttaca

SEQ ID NO: 488786 - DNA, 25 bp, Mus musculus
gaggctcacttgaatttggaacatg

SEQ ID NO: 488787 - DNA, 25 bp, Mus musculus
gaggctcacttgatctagttttaaa

SEQ ID NO: 488788 - DNA, 25 bp, Mus musculus
gaggctcacttgtatttggaacatg

SEQ ID NO: 488789 - DNA, 25 bp, Mus musculus
gaggctcacttgttctagttttaaa

SEQ ID NO: 488790 - DNA, 25 bp, Mus musculus
gaggctcagacaatctaacatctta

SEQ ID NO: 488791 - DNA, 25 bp, Mus musculus
gaggctcagacattctaacatctta

SEQ ID NO: 488792 - DNA, 25 bp, Mus musculus
gaggctcagaccagagcttggagat

SEQ ID NO: 488793 - DNA, 25 bp, Mus musculus
gaggctcagacctgagcttggagat

SEQ ID NO: 488794 - DNA, 25 bp, Mus musculus
gaggctcagagaaattggacaattt

SEQ ID NO: 488795 - DNA, 25 bp, Mus musculus
gaggctcagagatattggacaattt

SEQ ID NO: 488796 - DNA, 25 bp, Mus musculus
gaggctcagagcctacctaagtgaa

SEQ ID NO: 488797 - DNA, 25 bp, Mus musculus
gaggctcagagcgtacctaagtgaa

SEQ ID NO: 488798 - DNA, 25 bp, Mus musculus
gaggctcagagtaacccattaatat

SEQ ID NO: 488799 - DNA, 25 bp, Mus musculus
gaggctcagagtatccatttggttt

SEQ ID NO: 488800 - DNA, 25 bp, Mus musculus
gaggctcagagttacccattaatat

SEQ ID NO: 488801 - DNA, 25 bp, Mus musculus
gaggctcagagtttccatttggttt

SEQ ID NO: 488802 - DNA, 25 bp, Mus musculus
gaggctcagatcagttgtatcagtt

SEQ ID NO: 488803 - DNA, 25 bp, Mus musculus
gaggctcagatctgttgtatcagtt

SEQ ID NO: 488804 - DNA, 25 bp, Mus musculus
gaggctcagcagaattgtgtcggat

SEQ ID NO: 488805 - DNA, 25 bp, Mus musculus
gaggctcagcagtattgtgtcggat

SEQ ID NO: 488806 - DNA, 25 bp, Mus musculus
gaggctcagcatatcataaaccttt

SEQ ID NO: 488807 - DNA, 25 bp, Mus musculus
gaggctcagcatttcataaaccttt

SEQ ID NO: 488808 - DNA, 25 bp, Mus musculus
gaggctcagcgacctggacattaga

SEQ ID NO: 488809 - DNA, 25 bp, Mus musculus
gaggctcagcgagctggacattaga

SEQ ID NO: 488810 - DNA, 25 bp, Mus musculus
gaggctcaggaccttaaccacagtt

SEQ ID NO: 488811 - DNA, 25 bp, Mus musculus
gaggctcaggacgttaaccacagtt

SEQ ID NO: 488812 - DNA, 25 bp, Mus musculus
gaggctcagggtagttttttgcgtc

SEQ ID NO: 488813 - DNA, 25 bp, Mus musculus
gaggctcagggttgttttttgcgtc

SEQ ID NO: 488814 - DNA, 25 bp, Mus musculus
gaggctcagtacagcagtctgttca

SEQ ID NO: 488815 - DNA, 25 bp, Mus musculus
gaggctcagtactgcagtctgttca

SEQ ID NO: 488816 - DNA, 25 bp, Mus musculus
gaggctcagtggatcaggactagca

SEQ ID NO: 488817 - DNA, 25 bp, Mus musculus
gaggctcagtggttcaggactagca

SEQ ID NO: 488818 - DNA, 25 bp, Mus musculus
gaggctcagtgtaagcatggcttgt

SEQ ID NO: 488819 - DNA, 25 bp, Mus musculus
gaggctcagtgttagcatggcttgt

SEQ ID NO: 488820 - DNA, 25 bp, Mus musculus
gaggctcataatcacagtgccaact

SEQ ID NO: 488821 - DNA, 25 bp, Mus musculus
gaggctcataatgacagtgccaact

SEQ ID NO: 488822 - DNA, 25 bp, Mus musculus
gaggctcatagcatccaattggaga

SEQ ID NO: 488823 - DNA, 25 bp, Mus musculus
gaggctcatagcttccaattggaga

SEQ ID NO: 488824 - DNA, 25 bp, Mus musculus
gaggctcatattagaccattttgtt

SEQ ID NO: 488825 - DNA, 25 bp, Mus musculus
gaggctcatatttgaccattttgtt

SEQ ID NO: 488826 - DNA, 25 bp, Mus musculus
gaggctcatcagaactgtcacgtgg

SEQ ID NO: 488827 - DNA, 25 bp, Mus musculus
gaggctcatcagtactgtcacgtgg

SEQ ID NO: 488828 - DNA, 25 bp, Mus musculus
gaggctcatgctcaggtttgcatca

SEQ ID NO: 488829 - DNA, 25 bp, Mus musculus
gaggctcatgctgaggtttgcatca

SEQ ID NO: 488830 - DNA, 25 bp, Mus musculus
gaggctcatgtcagtcccagagtgt

SEQ ID NO: 488831 - DNA, 25 bp, Mus musculus
gaggctcatgtctgtcccagagtgt

SEQ ID NO: 488832 - DNA, 25 bp, Mus musculus
gaggctccaagaatgctctgtactt

SEQ ID NO: 488833 - DNA, 25 bp, Mus musculus
gaggctccaagacttgacactgtta

SEQ ID NO: 488834 - DNA, 25 bp, Mus musculus
gaggctccaagagttgacactgtta

SEQ ID NO: 488835 - DNA, 25 bp, Mus musculus
gaggctccaagattgctctgtactt

SEQ ID NO: 488836 - DNA, 25 bp, Mus musculus
gaggctccaagtccaattaatgata

SEQ ID NO: 488837 - DNA, 25 bp, Mus musculus
gaggctccaagtgcaattaatgata

SEQ ID NO: 488838 - DNA, 25 bp, Mus musculus
gaggctccaccaaagactgaatcaa

SEQ ID NO: 488839 - DNA, 25 bp, Mus musculus
gaggctccaccatagactgaatcaa

SEQ ID NO: 488840 - DNA, 25 bp, Mus musculus
gaggctccactgaaataacagtcaa

SEQ ID NO: 488841 - DNA, 25 bp, Mus musculus
gaggctccactgtaataacagtcaa

SEQ ID NO: 488842 - DNA, 25 bp, Mus musculus
gaggctccagcaaggaatgatccta

SEQ ID NO: 488843 - DNA, 25 bp, Mus musculus
gaggctccagcacgatgtggctaca

SEQ ID NO: 488844 - DNA, 25 bp, Mus musculus
gaggctccagcaggatgtggctaca

SEQ ID NO: 488845 - DNA, 25 bp, Mus musculus
gaggctccagcatggaatgatccta

SEQ ID NO: 488846 - DNA, 25 bp, Mus musculus
gaggctccagcgaggcgtcgccatc

SEQ ID NO: 488847 - DNA, 25 bp, Mus musculus
gaggctccagcgtggcgtcgccatc

SEQ ID NO: 488848 - DNA, 25 bp, Mus musculus
gaggctcccacaaagactcaacggt

SEQ ID NO: 488849 - DNA, 25 bp, Mus musculus
gaggctcccacatagactcaacggt

SEQ ID NO: 488850 - DNA, 25 bp, Mus musculus
gaggctcccatcacaggttatatgt

SEQ ID NO: 488851 - DNA, 25 bp, Mus musculus
gaggctcccatctcaggttatatgt

SEQ ID NO: 488852 - DNA, 25 bp, Mus musculus
gaggctccccagaatggttttatac

SEQ ID NO: 488853 - DNA, 25 bp, Mus musculus
gaggctccccagtatggttttatac

SEQ ID NO: 488854 - DNA, 25 bp, Mus musculus
gaggctcccggacacagaagacttc

SEQ ID NO: 488855 - DNA, 25 bp, Mus musculus
gaggctcccggagacagaagacttc

SEQ ID NO: 488856 - DNA, 25 bp, Mus musculus
gaggctccctatcctaaaaatgcag

SEQ ID NO: 488857 - DNA, 25 bp, Mus musculus
gaggctccctatgctaaaaatgcag

SEQ ID NO: 488858 - DNA, 25 bp, Mus musculus
gaggctccctgtagagctgtggtta

SEQ ID NO: 488859 - DNA, 25 bp, Mus musculus
gaggctccctgttgagctgtggtta

SEQ ID NO: 488860 - DNA, 25 bp, Mus musculus
gaggctcccttaacaggcggctttg

SEQ ID NO: 488861 - DNA, 25 bp, Mus musculus
gaggctcccttatcaggcggctttg

SEQ ID NO: 488862 - DNA, 25 bp, Mus musculus
gaggctccgctacctagactacact

SEQ ID NO: 488863 - DNA, 25 bp, Mus musculus
gaggctccgctagctagactacact

SEQ ID NO: 488864 - DNA, 25 bp, Mus musculus
gaggctccgctcagcatcctggaga

SEQ ID NO: 488865 - DNA, 25 bp, Mus musculus
gaggctccgctctgcatcctggaga

SEQ ID NO: 488866 - DNA, 25 bp, Mus musculus
gaggctccgtgcaacgcatctgtga

SEQ ID NO: 488867 - DNA, 25 bp, Mus musculus
gaggctccgtgcagagaaactgttg

SEQ ID NO: 488868 - DNA, 25 bp, Mus musculus
gaggctccgtgctacgcatctgtga

SEQ ID NO: 488869 - DNA, 25 bp, Mus musculus
gaggctccgtgctgagaaactgttg

SEQ ID NO: 488870 - DNA, 25 bp, Mus musculus
gaggctccgtttccaagcgattcaa

SEQ ID NO: 488871 - DNA, 25 bp, Mus musculus
gaggctccgtttgcaagcgattcaa

SEQ ID NO: 488872 - DNA, 25 bp, Mus musculus
gaggctcctagtaaatatcacagta

SEQ ID NO: 488873 - DNA, 25 bp, Mus musculus
gaggctcctagttaatatcacagta

SEQ ID NO: 488874 - DNA, 25 bp, Mus musculus
gaggctcctcaaccgactgtgttcc

SEQ ID NO: 488875 - DNA, 25 bp, Mus musculus
gaggctcctcaagcgactgtgttcc

SEQ ID NO: 488876 - DNA, 25 bp, Mus musculus
gaggctcctcacagaggctgtcgaa

SEQ ID NO: 488877 - DNA, 25 bp, Mus musculus
gaggctcctcactgaggctgtcgaa

SEQ ID NO: 488878 - DNA, 25 bp, Mus musculus
gaggctcctcccacagatgccttta

SEQ ID NO: 488879 - DNA, 25 bp, Mus musculus
gaggctcctccctcagatgccttta

SEQ ID NO: 488880 - DNA, 25 bp, Mus musculus
gaggctcctcggacactggacagag

SEQ ID NO: 488881 - DNA, 25 bp, Mus musculus
gaggctcctcggtcactggacagag

SEQ ID NO: 488882 - DNA, 25 bp, Mus musculus
gaggctcctcttccctgagtttaga

SEQ ID NO: 488883 - DNA, 25 bp, Mus musculus
gaggctcctcttgcctgagtttaga

SEQ ID NO: 488884 - DNA, 25 bp, Mus musculus
gaggctcctgacaactacgaggtta

SEQ ID NO: 488885 - DNA, 25 bp, Mus musculus
gaggctcctgactactacgaggtta

SEQ ID NO: 488886 - DNA, 25 bp, Mus musculus
gaggctcctgagaagggttcgccct

SEQ ID NO: 488887 - DNA, 25 bp, Mus musculus
gaggctcctgagtagggttcgccct

SEQ ID NO: 488888 - DNA, 25 bp, Mus musculus
gaggctcctgccagggactaagaaa

SEQ ID NO: 488889 - DNA, 25 bp, Mus musculus
gaggctcctgcctgggactaagaaa

SEQ ID NO: 488890 - DNA, 25 bp, Mus musculus
gaggctcctggacatagagcattgt

SEQ ID NO: 488891 - DNA, 25 bp, Mus musculus
gaggctcctggagatagagcattgt

SEQ ID NO: 488892 - DNA, 25 bp, Mus musculus
gaggctcctgggagtccgccgatcc

SEQ ID NO: 488893 - DNA, 25 bp, Mus musculus
gaggctcctgggtgtccgccgatcc

SEQ ID NO: 488894 - DNA, 25 bp, Mus musculus
gaggctcctgtgagatgaccactta

SEQ ID NO: 488895 - DNA, 25 bp, Mus musculus
gaggctcctgtgtgatgaccactta

SEQ ID NO: 488896 - DNA, 25 bp, Mus musculus
gaggctccttcacgtaggatgtact

SEQ ID NO: 488897 - DNA, 25 bp, Mus musculus
gaggctccttcaggtaggatgtact

SEQ ID NO: 488898 - DNA, 25 bp, Mus musculus
gaggctccttctcaggctgcagtga

SEQ ID NO: 488899 - DNA, 25 bp, Mus musculus
gaggctccttctgaggctgcagtga

SEQ ID NO: 488900 - DNA, 25 bp, Mus musculus
gaggctcctttaaagagtgtttgtg

SEQ ID NO: 488901 - DNA, 25 bp, Mus musculus
gaggctcctttatagagtgtttgtg

SEQ ID NO: 488902 - DNA, 25 bp, Mus musculus
gaggctcgaggaactggtttccgca

SEQ ID NO: 488903 - DNA, 25 bp, Mus musculus
gaggctcgaggatctggtttccgca

SEQ ID NO: 488904 - DNA, 25 bp, Mus musculus
gaggctcgcagcacctagagaaacc

SEQ ID NO: 488905 - DNA, 25 bp, Mus musculus
gaggctcgcagctcctagagaaacc

SEQ ID NO: 488906 - DNA, 25 bp, Mus musculus
gaggctcgctgaacctagagtctag

SEQ ID NO: 488907 - DNA, 25 bp, Mus musculus
gaggctcgctgatcctagagtctag

SEQ ID NO: 488908 - DNA, 25 bp, Mus musculus
gaggctcggaaaaagctcgcccaga

SEQ ID NO: 488909 - DNA, 25 bp, Mus musculus
gaggctcggaaatagctcgcccaga

SEQ ID NO: 488910 - DNA, 25 bp, Mus musculus
gaggctcggagtatgtatttaaatt

SEQ ID NO: 488911 - DNA, 25 bp, Mus musculus
gaggctcggagtttgtatttaaatt

SEQ ID NO: 488912 - DNA, 25 bp, Mus musculus
gaggctcggtatcgtttttcaaata

SEQ ID NO: 488913 - DNA, 25 bp, Mus musculus
gaggctcggtatggtttttcaaata

SEQ ID NO: 488914 - DNA, 25 bp, Mus musculus
gaggctcgtgggattgatctacata

SEQ ID NO: 488915 - DNA, 25 bp, Mus musculus
gaggctcgtgggtttgatctacata

SEQ ID NO: 488916 - DNA, 25 bp, Mus musculus
gaggctcgtgtgagggctacttccc

SEQ ID NO: 488917 - DNA, 25 bp, Mus musculus
gaggctcgtgtgtgggctacttccc

SEQ ID NO: 488918 - DNA, 25 bp, Mus musculus
gaggctctaacactgaaggcagtct

SEQ ID NO: 488919 - DNA, 25 bp, Mus musculus
gaggctctaacagtgaaggcagtct

SEQ ID NO: 488920 - DNA, 25 bp, Mus musculus
gaggctctacatcccgaactggata

SEQ ID NO: 488921 - DNA, 25 bp, Mus musculus
gaggctctacatgccgaactggata

SEQ ID NO: 488922 - DNA, 25 bp, Mus musculus
gaggctctacggcaagtctttgtac

SEQ ID NO: 488923 - DNA, 25 bp, Mus musculus
gaggctctacgggaagtctttgtac

SEQ ID NO: 488924 - DNA, 25 bp, Mus musculus
gaggctctacttcaagactgtgaaa

SEQ ID NO: 488925 - DNA, 25 bp, Mus musculus
gaggctctacttgaagactgtgaaa

SEQ ID NO: 488926 - DNA, 25 bp, Mus musculus
gaggctctaggaactttgggctaca

SEQ ID NO: 488927 - DNA, 25 bp, Mus musculus
gaggctctaggatctttgggctaca

SEQ ID NO: 488928 - DNA, 25 bp, Mus musculus
gaggctctattcatgaagtgccact

SEQ ID NO: 488929 - DNA, 25 bp, Mus musculus
gaggctctattcttgaagtgccact

SEQ ID NO: 488930 - DNA, 25 bp, Mus musculus
gaggctctcaaaaacgggcggttct

SEQ ID NO: 488931 - DNA, 25 bp, Mus musculus
gaggctctcaaatacgggcggttct

SEQ ID NO: 488932 - DNA, 25 bp, Mus musculus
gaggctctcactactgaaattctac

SEQ ID NO: 488933 - DNA, 25 bp, Mus musculus
gaggctctcacttctgaaattctac

SEQ ID NO: 488934 - DNA, 25 bp, Mus musculus
gaggctctcagaactcctggactgg

SEQ ID NO: 488935 - DNA, 25 bp, Mus musculus
gaggctctcagatctcctggactgg

SEQ ID NO: 488936 - DNA, 25 bp, Mus musculus
gaggctctcagcattacctcaatat

SEQ ID NO: 488937 - DNA, 25 bp, Mus musculus
gaggctctcagctttacctcaatat

SEQ ID NO: 488938 - DNA, 25 bp, Mus musculus
gaggctctccaaagttctgagttct

SEQ ID NO: 488939 - DNA, 25 bp, Mus musculus
gaggctctccaatgttctgagttct

SEQ ID NO: 488940 - DNA, 25 bp, Mus musculus
gaggctctccgaatgaggttgcaga

SEQ ID NO: 488941 - DNA, 25 bp, Mus musculus
gaggctctccgattgaggttgcaga

SEQ ID NO: 488942 - DNA, 25 bp, Mus musculus
gaggctctctcaccttttgaagaac

SEQ ID NO: 488943 - DNA, 25 bp, Mus musculus
gaggctctctcagcttttgaagaac

SEQ ID NO: 488944 - DNA, 25 bp, Mus musculus
gaggctctgaaacaactccctgtac

SEQ ID NO: 488945 - DNA, 25 bp, Mus musculus
gaggctctgaaagaactccctgtac

SEQ ID NO: 488946 - DNA, 25 bp, Mus musculus
gaggctctgaagacgctaagggcaa

SEQ ID NO: 488947 - DNA, 25 bp, Mus musculus
gaggctctgaagtcgctaagggcaa

SEQ ID NO: 488948 - DNA, 25 bp, Mus musculus
gaggctctgacactctataacctga

SEQ ID NO: 488949 - DNA, 25 bp, Mus musculus
gaggctctgacagtctataacctga

SEQ ID NO: 488950 - DNA, 25 bp, Mus musculus
gaggctctgactcatcttgttagat

SEQ ID NO: 488951 - DNA, 25 bp, Mus musculus
gaggctctgactgatcttgttagat

SEQ ID NO: 488952 - DNA, 25 bp, Mus musculus
gaggctctgagaagacacagaccat

SEQ ID NO: 488953 - DNA, 25 bp, Mus musculus
gaggctctgagatgacacagaccat

SEQ ID NO: 488954 - DNA, 25 bp, Mus musculus
gaggctctgcatcgctttagaagac

SEQ ID NO: 488955 - DNA, 25 bp, Mus musculus
gaggctctgcatggctttagaagac

SEQ ID NO: 488956 - DNA, 25 bp, Mus musculus
gaggctctgccaacctatgtgtgca

SEQ ID NO: 488957 - DNA, 25 bp, Mus musculus
gaggctctgccactctcaggaccag

SEQ ID NO: 488958 - DNA, 25 bp, Mus musculus
gaggctctgccagtctcaggaccag

SEQ ID NO: 488959 - DNA, 25 bp, Mus musculus
gaggctctgccatcctatgtgtgca

SEQ ID NO: 488960 - DNA, 25 bp, Mus musculus
gaggctctgctcaaagagtccagga

SEQ ID NO: 488961 - DNA, 25 bp, Mus musculus
gaggctctgctcagttttattctct

SEQ ID NO: 488962 - DNA, 25 bp, Mus musculus
gaggctctgctctaagagtccagga

SEQ ID NO: 488963 - DNA, 25 bp, Mus musculus
gaggctctgctctgttttattctct

SEQ ID NO: 488964 - DNA, 25 bp, Mus musculus
gaggctctggaaatgcaccagtgtt

SEQ ID NO: 488965 - DNA, 25 bp, Mus musculus
gaggctctggaattgcaccagtgtt

SEQ ID NO: 488966 - DNA, 25 bp, Mus musculus
gaggctctgggcatgtacatgtaca

SEQ ID NO: 488967 - DNA, 25 bp, Mus musculus
gaggctctgggcttgtacatgtaca

SEQ ID NO: 488968 - DNA, 25 bp, Mus musculus
gaggctctggtcacctgtacatacg

SEQ ID NO: 488969 - DNA, 25 bp, Mus musculus
gaggctctggtctcctgtacatacg

SEQ ID NO: 488970 - DNA, 25 bp, Mus musculus
gaggctctgtacaggcagctgacgg

SEQ ID NO: 488971 - DNA, 25 bp, Mus musculus
gaggctctgtactggcagctgacgg

SEQ ID NO: 488972 - DNA, 25 bp, Mus musculus
gaggctctgttgaaagaccctgtct

SEQ ID NO: 488973 - DNA, 25 bp, Mus musculus
gaggctctgttgtaagaccctgtct

SEQ ID NO: 488974 - DNA, 25 bp, Mus musculus
gaggctcttaagagtgctctagtca

SEQ ID NO: 488975 - DNA, 25 bp, Mus musculus
gaggctcttaagtgtgctctagtca

SEQ ID NO: 488976 - DNA, 25 bp, Mus musculus
gaggctcttaataccttggattcat

SEQ ID NO: 488977 - DNA, 25 bp, Mus musculus
gaggctcttaattccttggattcat

SEQ ID NO: 488978 - DNA, 25 bp, Mus musculus
gaggctcttcacagttagatttttt

SEQ ID NO: 488979 - DNA, 25 bp, Mus musculus
gaggctcttcactgttagatttttt

SEQ ID NO: 488980 - DNA, 25 bp, Mus musculus
gaggctcttcatatcagatgtacca

SEQ ID NO: 488981 - DNA, 25 bp, Mus musculus
gaggctcttcatttcagatgtacca

SEQ ID NO: 488982 - DNA, 25 bp, Mus musculus
gaggctcttgctctagattgacaac

SEQ ID NO: 488983 - DNA, 25 bp, Mus musculus
gaggctcttgctgtagattgacaac

SEQ ID NO: 488984 - DNA, 25 bp, Mus musculus
gaggctcttggccataaggctccac

SEQ ID NO: 488985 - DNA, 25 bp, Mus musculus
gaggctcttggcgataaggctccac

SEQ ID NO: 488986 - DNA, 25 bp, Mus musculus
gaggctcttgggattctctgtgacc

SEQ ID NO: 488987 - DNA, 25 bp, Mus musculus
gaggctcttgggtttctctgtgacc

SEQ ID NO: 488988 - DNA, 25 bp, Mus musculus
gaggctcttgtcatcgaaacccgga

SEQ ID NO: 488989 - DNA, 25 bp, Mus musculus
gaggctcttgtcttcgaaacccgga

SEQ ID NO: 488990 - DNA, 25 bp, Mus musculus
gaggctctttatagagcttccacct

SEQ ID NO: 488991 - DNA, 25 bp, Mus musculus
gaggctctttattgagcttccacct

SEQ ID NO: 488992 - DNA, 25 bp, Mus musculus
gaggctctttcacacctggtataaa

SEQ ID NO: 488993 - DNA, 25 bp, Mus musculus
gaggctctttcagacctggtataaa

SEQ ID NO: 488994 - DNA, 25 bp, Mus musculus
gaggctcttttaatctgtcccgaat

SEQ ID NO: 488995 - DNA, 25 bp, Mus musculus
gaggctcttttattctgtcccgaat

SEQ ID NO: 488996 - DNA, 25 bp, Mus musculus
gaggctcttttcacagagtccagca

SEQ ID NO: 488997 - DNA, 25 bp, Mus musculus
gaggctcttttcctgttggcatcat

SEQ ID NO: 488998 - DNA, 25 bp, Mus musculus
gaggctcttttcgtgttggcatcat

SEQ ID NO: 488999 - DNA, 25 bp, Mus musculus
gaggctcttttctcagagtccagca

SEQ ID NO: 489000 - DNA, 25 bp, Mus musculus
gaggctgaaacaatctcattaagtt

SEQ ID NO: 489001 - DNA, 25 bp, Mus musculus
gaggctgaaacattctcattaagtt

SEQ ID NO: 489002 - DNA, 25 bp, Mus musculus
gaggctgaaatcacagaccaggacc

SEQ ID NO: 489003 - DNA, 25 bp, Mus musculus
gaggctgaaatctcagaccaggacc

SEQ ID NO: 489004 - DNA, 25 bp, Mus musculus
gaggctgaacacacttcatgttagc

SEQ ID NO: 489005 - DNA, 25 bp, Mus musculus
gaggctgaacactcttcatgttagc

SEQ ID NO: 489006 - DNA, 25 bp, Mus musculus
gaggctgaacagcaattcttgccct

SEQ ID NO: 489007 - DNA, 25 bp, Mus musculus
gaggctgaacaggaattcttgccct

SEQ ID NO: 489008 - DNA, 25 bp, Mus musculus
gaggctgaaccaaacctgagaattc

SEQ ID NO: 489009 - DNA, 25 bp, Mus musculus
gaggctgaaccatacctgagaattc

SEQ ID NO: 489010 - DNA, 25 bp, Mus musculus
gaggctgaactgatggaatccagga

SEQ ID NO: 489011 - DNA, 25 bp, Mus musculus
gaggctgaactgcaacatttacaac

SEQ ID NO: 489012 - DNA, 25 bp, Mus musculus
gaggctgaactggaacatttacaac

SEQ ID NO: 489013 - DNA, 25 bp, Mus musculus
gaggctgaactgttggaatccagga

SEQ ID NO: 489014 - DNA, 25 bp, Mus musculus
gaggctgaacttcatgtcctgtctg

SEQ ID NO: 489015 - DNA, 25 bp, Mus musculus
gaggctgaacttgatgtcctgtctg

SEQ ID NO: 489016 - DNA, 25 bp, Mus musculus
gaggctgaagccaaaatcaacttat

SEQ ID NO: 489017 - DNA, 25 bp, Mus musculus
gaggctgaagcctaaatcaacttat

SEQ ID NO: 489018 - DNA, 25 bp, Mus musculus
gaggctgaaggactctgctcccgca

SEQ ID NO: 489019 - DNA, 25 bp, Mus musculus
gaggctgaaggagtctgctcccgca

SEQ ID NO: 489020 - DNA, 25 bp, Mus musculus
gaggctgaattgatcatccaggaga

SEQ ID NO: 489021 - DNA, 25 bp, Mus musculus
gaggctgaattgttcatccaggaga

SEQ ID NO: 489022 - DNA, 25 bp, Mus musculus
gaggctgacaagaaccatctgtatg

SEQ ID NO: 489023 - DNA, 25 bp, Mus musculus
gaggctgacaagtaccatctgtatg

SEQ ID NO: 489024 - DNA, 25 bp, Mus musculus
gaggctgacacaaccaccatcgctg

SEQ ID NO: 489025 - DNA, 25 bp, Mus musculus
gaggctgacacaattctactcttcc

SEQ ID NO: 489026 - DNA, 25 bp, Mus musculus
gaggctgacacatccaccatcgctg

SEQ ID NO: 489027 - DNA, 25 bp, Mus musculus
gaggctgacacatttctactcttcc

SEQ ID NO: 489028 - DNA, 25 bp, Mus musculus
gaggctgacagtaggctaattttaa

SEQ ID NO: 489029 - DNA, 25 bp, Mus musculus
gaggctgacagttggctaattttaa

SEQ ID NO: 489030 - DNA, 25 bp, Mus musculus
gaggctgacccaagcaattttgcta

SEQ ID NO: 489031 - DNA, 25 bp, Mus musculus
gaggctgacccatgcaattttgcta

SEQ ID NO: 489032 - DNA, 25 bp, Mus musculus
gaggctgaccggatgcttgatatgg

SEQ ID NO: 489033 - DNA, 25 bp, Mus musculus
gaggctgaccggttgcttgatatgg

SEQ ID NO: 489034 - DNA, 25 bp, Mus musculus
gaggctgacctaccctacaagagtg

SEQ ID NO: 489035 - DNA, 25 bp, Mus musculus
gaggctgacctagcctacaagagtg

SEQ ID NO: 489036 - DNA, 25 bp, Mus musculus
gaggctgaccttcaaggcctggcct

SEQ ID NO: 489037 - DNA, 25 bp, Mus musculus
gaggctgaccttgaaggcctggcct

SEQ ID NO: 489038 - DNA, 25 bp, Mus musculus
gaggctgacggcattggagtcccct

SEQ ID NO: 489039 - DNA, 25 bp, Mus musculus
gaggctgacggctttggagtcccct

SEQ ID NO: 489040 - DNA, 25 bp, Mus musculus
gaggctgactccctgcttgaaaacg

SEQ ID NO: 489041 - DNA, 25 bp, Mus musculus
gaggctgactccgtgcttgaaaacg

SEQ ID NO: 489042 - DNA, 25 bp, Mus musculus
gaggctgactcgagcactggcagtc

SEQ ID NO: 489043 - DNA, 25 bp, Mus musculus
gaggctgactcgtgcactggcagtc

SEQ ID NO: 489044 - DNA, 25 bp, Mus musculus
gaggctgacttgacatgtggcgcca

SEQ ID NO: 489045 - DNA, 25 bp, Mus musculus
gaggctgacttgtcatgtggcgcca

SEQ ID NO: 489046 - DNA, 25 bp, Mus musculus
gaggctgagaaacaactacgggaac

SEQ ID NO: 489047 - DNA, 25 bp, Mus musculus
gaggctgagaaagaactacgggaac

SEQ ID NO: 489048 - DNA, 25 bp, Mus musculus
gaggctgagaccacaggaatcctag

SEQ ID NO: 489049 - DNA, 25 bp, Mus musculus
gaggctgagacctcaggaatcctag

SEQ ID NO: 489050 - DNA, 25 bp, Mus musculus
gaggctgagactcctcaaagaacat

SEQ ID NO: 489051 - DNA, 25 bp, Mus musculus
gaggctgagactctctcctgttaga

SEQ ID NO: 489052 - DNA, 25 bp, Mus musculus
gaggctgagactctgcagtccttct

SEQ ID NO: 489053 - DNA, 25 bp, Mus musculus
gaggctgagactgctcaaagaacat

SEQ ID NO: 489054 - DNA, 25 bp, Mus musculus
gaggctgagactgtctcctgttaga

SEQ ID NO: 489055 - DNA, 25 bp, Mus musculus
gaggctgagactgtgcagtccttct

SEQ ID NO: 489056 - DNA, 25 bp, Mus musculus
gaggctgagatccaaaacctttcat

SEQ ID NO: 489057 - DNA, 25 bp, Mus musculus
gaggctgagatcgaaaacctttcat

SEQ ID NO: 489058 - DNA, 25 bp, Mus musculus
gaggctgagcccacactaggtcatc

SEQ ID NO: 489059 - DNA, 25 bp, Mus musculus
gaggctgagccctcactaggtcatc

SEQ ID NO: 489060 - DNA, 25 bp, Mus musculus
gaggctgagcgacggcgacgctcca

SEQ ID NO: 489061 - DNA, 25 bp, Mus musculus
gaggctgagcgagggcgacgctcca

SEQ ID NO: 489062 - DNA, 25 bp, Mus musculus
gaggctgagctcaagcatggaccta

SEQ ID NO: 489063 - DNA, 25 bp, Mus musculus
gaggctgagctctagcatggaccta

SEQ ID NO: 489064 - DNA, 25 bp, Mus musculus
gaggctgaggctcatagcatccaat

SEQ ID NO: 489065 - DNA, 25 bp, Mus musculus
gaggctgaggctgatagcatccaat

SEQ ID NO: 489066 - DNA, 25 bp, Mus musculus
gaggctgagggaatgttactaagtt

SEQ ID NO: 489067 - DNA, 25 bp, Mus musculus
gaggctgagggattgttactaagtt

SEQ ID NO: 489068 - DNA, 25 bp, Mus musculus
gaggctgagggtagcactcatctta

SEQ ID NO: 489069 - DNA, 25 bp, Mus musculus
gaggctgagggttgcactcatctta

SEQ ID NO: 489070 - DNA, 25 bp, Mus musculus
gaggctgatcagagccgcctgactt

SEQ ID NO: 489071 - DNA, 25 bp, Mus musculus
gaggctgatcagaggacttccaagt

SEQ ID NO: 489072 - DNA, 25 bp, Mus musculus
gaggctgatcagtgccgcctgactt

SEQ ID NO: 489073 - DNA, 25 bp, Mus musculus
gaggctgatcagtggacttccaagt

SEQ ID NO: 489074 - DNA, 25 bp, Mus musculus
gaggctgatctcaaaaccttgcaca

SEQ ID NO: 489075 - DNA, 25 bp, Mus musculus
gaggctgatctctaaaccttgcaca

SEQ ID NO: 489076 - DNA, 25 bp, Mus musculus
gaggctgatcttaccagttcttgaa

SEQ ID NO: 489077 - DNA, 25 bp, Mus musculus
gaggctgatctttccagttcttgaa

SEQ ID NO: 489078 - DNA, 25 bp, Mus musculus
gaggctgatgctctctgctcaagcc

SEQ ID NO: 489079 - DNA, 25 bp, Mus musculus
gaggctgatgctgtctgctcaagcc

SEQ ID NO: 489080 - DNA, 25 bp, Mus musculus
gaggctgatgtaaacccatgggcaa

SEQ ID NO: 489081 - DNA, 25 bp, Mus musculus
gaggctgatgtatacccatgggcaa

SEQ ID NO: 489082 - DNA, 25 bp, Mus musculus
gaggctgatgtgacatttcaactta

SEQ ID NO: 489083 - DNA, 25 bp, Mus musculus
gaggctgatgtgtcatttcaactta

SEQ ID NO: 489084 - DNA, 25 bp, Mus musculus
gaggctgcaaagcatctcttgtata

SEQ ID NO: 489085 - DNA, 25 bp, Mus musculus
gaggctgcaaaggatctcttgtata

SEQ ID NO: 489086 - DNA, 25 bp, Mus musculus
gaggctgcaaatacattctgcacgg

SEQ ID NO: 489087 - DNA, 25 bp, Mus musculus
gaggctgcaaattcattctgcacgg

SEQ ID NO: 489088 - DNA, 25 bp, Mus musculus
gaggctgcaacgagagcttccgagc

SEQ ID NO: 489089 - DNA, 25 bp, Mus musculus
gaggctgcaacgtgagcttccgagc

SEQ ID NO: 489090 - DNA, 25 bp, Mus musculus
gaggctgcaccgaggcctctgctct

SEQ ID NO: 489091 - DNA, 25 bp, Mus musculus
gaggctgcaccgtggcctctgctct

SEQ ID NO: 489092 - DNA, 25 bp, Mus musculus
gaggctgcagagacgaaatacttac

SEQ ID NO: 489093 - DNA, 25 bp, Mus musculus
gaggctgcagagtcgaaatacttac

SEQ ID NO: 489094 - DNA, 25 bp, Mus musculus
gaggctgcagcaacagctaacccag

SEQ ID NO: 489095 - DNA, 25 bp, Mus musculus
gaggctgcagcacatcttcctacag

SEQ ID NO: 489096 - DNA, 25 bp, Mus musculus
gaggctgcagcagatcttcctacag

SEQ ID NO: 489097 - DNA, 25 bp, Mus musculus
gaggctgcagcatcagctaacccag

SEQ ID NO: 489098 - DNA, 25 bp, Mus musculus
gaggctgcagcccacgagtcaaacc

SEQ ID NO: 489099 - DNA, 25 bp, Mus musculus
gaggctgcagccgacgagtcaaacc

SEQ ID NO: 489100 - DNA, 25 bp, Mus musculus
gaggctgcagggacaaactccttgc

SEQ ID NO: 489101 - DNA, 25 bp, Mus musculus
gaggctgcagggtcaaactccttgc

SEQ ID NO: 489102 - DNA, 25 bp, Mus musculus
gaggctgcagtcactaccgagtgac

SEQ ID NO: 489103 - DNA, 25 bp, Mus musculus
gaggctgcagtcactcaaggaaaag

SEQ ID NO: 489104 - DNA, 25 bp, Mus musculus
gaggctgcagtcagcatcctgaaca

SEQ ID NO: 489105 - DNA, 25 bp, Mus musculus
gaggctgcagtctctaccgagtgac

SEQ ID NO: 489106 - DNA, 25 bp, Mus musculus
gaggctgcagtctctcaaggaaaag

SEQ ID NO: 489107 - DNA, 25 bp, Mus musculus
gaggctgcagtctgcatcctgaaca

SEQ ID NO: 489108 - DNA, 25 bp, Mus musculus
gaggctgcagtgacatattctaggt

SEQ ID NO: 489109 - DNA, 25 bp, Mus musculus
gaggctgcagtgcacgatacccaga

SEQ ID NO: 489110 - DNA, 25 bp, Mus musculus
gaggctgcagtggacgatacccaga

SEQ ID NO: 489111 - DNA, 25 bp, Mus musculus
gaggctgcagtgtcatattctaggt

SEQ ID NO: 489112 - DNA, 25 bp, Mus musculus
gaggctgcagttattaccatgacaa

SEQ ID NO: 489113 - DNA, 25 bp, Mus musculus
gaggctgcagtttttaccatgacaa

SEQ ID NO: 489114 - DNA, 25 bp, Mus musculus
gaggctgcatcccatctctgaagct

SEQ ID NO: 489115 - DNA, 25 bp, Mus musculus
gaggctgcatccgatctctgaagct

SEQ ID NO: 489116 - DNA, 25 bp, Mus musculus
gaggctgcatgtcgctgacccccaa

SEQ ID NO: 489117 - DNA, 25 bp, Mus musculus
gaggctgcatgtggctgacccccaa

SEQ ID NO: 489118 - DNA, 25 bp, Mus musculus
gaggctgcattaagtgtctcagact

SEQ ID NO: 489119 - DNA, 25 bp, Mus musculus
gaggctgcattatgtgtctcagact

SEQ ID NO: 489120 - DNA, 25 bp, Mus musculus
gaggctgcattcatttaaagctact

SEQ ID NO: 489121 - DNA, 25 bp, Mus musculus
gaggctgcattcttttaaagctact

SEQ ID NO: 489122 - DNA, 25 bp, Mus musculus
gaggctgccagtatagcagttctta

SEQ ID NO: 489123 - DNA, 25 bp, Mus musculus
gaggctgccagtattcaataagtct

SEQ ID NO: 489124 - DNA, 25 bp, Mus musculus
gaggctgccagtttagcagttctta

SEQ ID NO: 489125 - DNA, 25 bp, Mus musculus
gaggctgccagttttcaataagtct

SEQ ID NO: 489126 - DNA, 25 bp, Mus musculus
gaggctgccatcatgggtgaccgca

SEQ ID NO: 489127 - DNA, 25 bp, Mus musculus
gaggctgccatcattcaaatagcat

SEQ ID NO: 489128 - DNA, 25 bp, Mus musculus
gaggctgccatcttgggtgaccgca

SEQ ID NO: 489129 - DNA, 25 bp, Mus musculus
gaggctgccatctttcaaatagcat

SEQ ID NO: 489130 - DNA, 25 bp, Mus musculus
gaggctgccctgctgaagcgaccta

SEQ ID NO: 489131 - DNA, 25 bp, Mus musculus
gaggctgccctggtgaagcgaccta

SEQ ID NO: 489132 - DNA, 25 bp, Mus musculus
gaggctgccgaccaaatctgcaaga

SEQ ID NO: 489133 - DNA, 25 bp, Mus musculus
gaggctgccgacgaaatctgcaaga

SEQ ID NO: 489134 - DNA, 25 bp, Mus musculus
gaggctgcctagattctgagagcat

SEQ ID NO: 489135 - DNA, 25 bp, Mus musculus
gaggctgcctagtttctgagagcat

SEQ ID NO: 489136 - DNA, 25 bp, Mus musculus
gaggctgcctgcatcacaaccagac

SEQ ID NO: 489137 - DNA, 25 bp, Mus musculus
gaggctgcctgcttcacaaccagac

SEQ ID NO: 489138 - DNA, 25 bp, Mus musculus
gaggctgcgaaactcacctgtgaga

SEQ ID NO: 489139 - DNA, 25 bp, Mus musculus
gaggctgcgaaagtcacctgtgaga

SEQ ID NO: 489140 - DNA, 25 bp, Mus musculus
gaggctgcgactaccgaacaaaaac

SEQ ID NO: 489141 - DNA, 25 bp, Mus musculus
gaggctgcgacttccgaacaaaaac

SEQ ID NO: 489142 - DNA, 25 bp, Mus musculus
gaggctgcgcatctctgtactagag

SEQ ID NO: 489143 - DNA, 25 bp, Mus musculus
gaggctgcgcatgtctgtactagag

SEQ ID NO: 489144 - DNA, 25 bp, Mus musculus
gaggctgcgcctcaatctcaaggag

SEQ ID NO: 489145 - DNA, 25 bp, Mus musculus
gaggctgcgcctgaatctcaaggag

SEQ ID NO: 489146 - DNA, 25 bp, Mus musculus
gaggctgcgggaacagctcctgaaa

SEQ ID NO: 489147 - DNA, 25 bp, Mus musculus
gaggctgcgggatcagctcctgaaa

SEQ ID NO: 489148 - DNA, 25 bp, Mus musculus
gaggctgctccacgtttatactgat

SEQ ID NO: 489149 - DNA, 25 bp, Mus musculus
gaggctgctccaggtttatactgat

SEQ ID NO: 489150 - DNA, 25 bp, Mus musculus
gaggctgctcctcgagtatggcttt

SEQ ID NO: 489151 - DNA, 25 bp, Mus musculus
gaggctgctcctggagtatggcttt

SEQ ID NO: 489152 - DNA, 25 bp, Mus musculus
gaggctgctttgacttggcacagaa

SEQ ID NO: 489153 - DNA, 25 bp, Mus musculus
gaggctgctttgtcttggcacagaa

SEQ ID NO: 489154 - DNA, 25 bp, Mus musculus
gaggctggaaacacacccattgtca

SEQ ID NO: 489155 - DNA, 25 bp, Mus musculus
gaggctggaaactcacccattgtca

SEQ ID NO: 489156 - DNA, 25 bp, Mus musculus
gaggctggacagctcttgcaaagta

SEQ ID NO: 489157 - DNA, 25 bp, Mus musculus
gaggctggacaggtcttgcaaagta

SEQ ID NO: 489158 - DNA, 25 bp, Mus musculus
gaggctggacccaggccttaacagc

SEQ ID NO: 489159 - DNA, 25 bp, Mus musculus
gaggctggaccctggccttaacagc

SEQ ID NO: 489160 - DNA, 25 bp, Mus musculus
gaggctggacttcatttccttgttc

SEQ ID NO: 489161 - DNA, 25 bp, Mus musculus
gaggctggacttgatttccttgttc

SEQ ID NO: 489162 - DNA, 25 bp, Mus musculus
gaggctggagagaacccattttgat

SEQ ID NO: 489163 - DNA, 25 bp, Mus musculus
gaggctggagagtacccattttgat

SEQ ID NO: 489164 - DNA, 25 bp, Mus musculus
gaggctggagatccaacactcctcc

SEQ ID NO: 489165 - DNA, 25 bp, Mus musculus
gaggctggagatcggcctcctagtg

SEQ ID NO: 489166 - DNA, 25 bp, Mus musculus
gaggctggagatgcaacactcctcc

SEQ ID NO: 489167 - DNA, 25 bp, Mus musculus
gaggctggagatgggcctcctagtg

SEQ ID NO: 489168 - DNA, 25 bp, Mus musculus
gaggctggagctatagtgttaatga

SEQ ID NO: 489169 - DNA, 25 bp, Mus musculus
gaggctggagctcacaccgacatga

SEQ ID NO: 489170 - DNA, 25 bp, Mus musculus
gaggctggagctgacaccgacatga

SEQ ID NO: 489171 - DNA, 25 bp, Mus musculus
gaggctggagctttagtgttaatga

SEQ ID NO: 489172 - DNA, 25 bp, Mus musculus
gaggctggatacatctcatctgaaa

SEQ ID NO: 489173 - DNA, 25 bp, Mus musculus
gaggctggatacttctcatctgaaa

SEQ ID NO: 489174 - DNA, 25 bp, Mus musculus
gaggctggatataacccatccaaga

SEQ ID NO: 489175 - DNA, 25 bp, Mus musculus
gaggctggatattacccatccaaga

SEQ ID NO: 489176 - DNA, 25 bp, Mus musculus
gaggctggatcaccgggacctatcc

SEQ ID NO: 489177 - DNA, 25 bp, Mus musculus
gaggctggatcagcgggacctatcc

SEQ ID NO: 489178 - DNA, 25 bp, Mus musculus
gaggctggatgacttccatcttctg

SEQ ID NO: 489179 - DNA, 25 bp, Mus musculus
gaggctggatgagttccatcttctg

SEQ ID NO: 489180 - DNA, 25 bp, Mus musculus
gaggctggcaaaacaaatcttgaac

SEQ ID NO: 489181 - DNA, 25 bp, Mus musculus
gaggctggcaaatcaaatcttgaac

SEQ ID NO: 489182 - DNA, 25 bp, Mus musculus
gaggctggcaagatcacgtgcttgt

SEQ ID NO: 489183 - DNA, 25 bp, Mus musculus
gaggctggcaagttcacgtgcttgt

SEQ ID NO: 489184 - DNA, 25 bp, Mus musculus
gaggctggcagaaaaccctgggaac

SEQ ID NO: 489185 - DNA, 25 bp, Mus musculus
gaggctggcagactttccatatcat

SEQ ID NO: 489186 - DNA, 25 bp, Mus musculus
gaggctggcagagtttccatatcat

SEQ ID NO: 489187 - DNA, 25 bp, Mus musculus
gaggctggcagataaccctgggaac

SEQ ID NO: 489188 - DNA, 25 bp, Mus musculus
gaggctggcagtagctatacacaaa

SEQ ID NO: 489189 - DNA, 25 bp, Mus musculus
gaggctggcagttgctatacacaaa

SEQ ID NO: 489190 - DNA, 25 bp, Mus musculus
gaggctggcattacacaaagacatt

SEQ ID NO: 489191 - DNA, 25 bp, Mus musculus
gaggctggcatttcacaaagacatt

SEQ ID NO: 489192 - DNA, 25 bp, Mus musculus
gaggctggccttagacattatgaaa

SEQ ID NO: 489193 - DNA, 25 bp, Mus musculus
gaggctggcctttgacattatgaaa

SEQ ID NO: 489194 - DNA, 25 bp, Mus musculus
gaggctggcgttcgatacataccat

SEQ ID NO: 489195 - DNA, 25 bp, Mus musculus
gaggctggcgttggatacataccat

SEQ ID NO: 489196 - DNA, 25 bp, Mus musculus
gaggctgggaggaaacctccatccc

SEQ ID NO: 489197 - DNA, 25 bp, Mus musculus
gaggctgggaggtaacctccatccc

SEQ ID NO: 489198 - DNA, 25 bp, Mus musculus
gaggctgggcagacttgaaattcac

SEQ ID NO: 489199 - DNA, 25 bp, Mus musculus
gaggctgggcagcattgctcttcca

SEQ ID NO: 489200 - DNA, 25 bp, Mus musculus
gaggctgggcaggattgctcttcca

SEQ ID NO: 489201 - DNA, 25 bp, Mus musculus
gaggctgggcagtcttgaaattcac

SEQ ID NO: 489202 - DNA, 25 bp, Mus musculus
gaggctgggtatctcccgtctacag

SEQ ID NO: 489203 - DNA, 25 bp, Mus musculus
gaggctgggtatgtcccgtctacag

SEQ ID NO: 489204 - DNA, 25 bp, Mus musculus
gaggctggtcagaatttaccctgct

SEQ ID NO: 489205 - DNA, 25 bp, Mus musculus
gaggctggtcagtatttaccctgct

SEQ ID NO: 489206 - DNA, 25 bp, Mus musculus
gaggctggtcctctgaaccttgatc

SEQ ID NO: 489207 - DNA, 25 bp, Mus musculus
gaggctggtcctgtgaaccttgatc

SEQ ID NO: 489208 - DNA, 25 bp, Mus musculus
gaggctggtggtatctgtacagctt

SEQ ID NO: 489209 - DNA, 25 bp, Mus musculus
gaggctggtggtttctgtacagctt

SEQ ID NO: 489210 - DNA, 25 bp, Mus musculus
gaggctggtgtaacactccaattca

SEQ ID NO: 489211 - DNA, 25 bp, Mus musculus
gaggctggtgtatcactccaattca

SEQ ID NO: 489212 - DNA, 25 bp, Mus musculus
gaggctgtaaaaatgccggagtcac

SEQ ID NO: 489213 - DNA, 25 bp, Mus musculus
gaggctgtaaaattgccggagtcac

SEQ ID NO: 489214 - DNA, 25 bp, Mus musculus
gaggctgtaaccaatctgtgcaaca

SEQ ID NO: 489215 - DNA, 25 bp, Mus musculus
gaggctgtaacctatctgtgcaaca

SEQ ID NO: 489216 - DNA, 25 bp, Mus musculus
gaggctgtacagcatttattggtgc

SEQ ID NO: 489217 - DNA, 25 bp, Mus musculus
gaggctgtacaggatttattggtgc

SEQ ID NO: 489218 - DNA, 25 bp, Mus musculus
gaggctgtagatctcagttctgtgt

SEQ ID NO: 489219 - DNA, 25 bp, Mus musculus
gaggctgtagatgtcagttctgtgt

SEQ ID NO: 489220 - DNA, 25 bp, Mus musculus
gaggctgtatccagatggagtcccc

SEQ ID NO: 489221 - DNA, 25 bp, Mus musculus
gaggctgtatcctgatggagtcccc

SEQ ID NO: 489222 - DNA, 25 bp, Mus musculus
gaggctgtcaatcggtaccgagcac

SEQ ID NO: 489223 - DNA, 25 bp, Mus musculus
gaggctgtcaatgggtaccgagcac

SEQ ID NO: 489224 - DNA, 25 bp, Mus musculus
gaggctgtcacaaggttcattcata

SEQ ID NO: 489225 - DNA, 25 bp, Mus musculus
gaggctgtcacatggttcattcata

SEQ ID NO: 489226 - DNA, 25 bp, Mus musculus
gaggctgtcacccagactttgaatt

SEQ ID NO: 489227 - DNA, 25 bp, Mus musculus
gaggctgtcaccgagactttgaatt

SEQ ID NO: 489228 - DNA, 25 bp, Mus musculus
gaggctgtcatactctacagagtta

SEQ ID NO: 489229 - DNA, 25 bp, Mus musculus
gaggctgtcatagtctacagagtta

SEQ ID NO: 489230 - DNA, 25 bp, Mus musculus
gaggctgtccaaaacatggctgttt

SEQ ID NO: 489231 - DNA, 25 bp, Mus musculus
gaggctgtccaatacatggctgttt

SEQ ID NO: 489232 - DNA, 25 bp, Mus musculus
gaggctgtccctaaccaatagatta

SEQ ID NO: 489233 - DNA, 25 bp, Mus musculus
gaggctgtccctcttcagagataaa

SEQ ID NO: 489234 - DNA, 25 bp, Mus musculus
gaggctgtccctgttcagagataaa

SEQ ID NO: 489235 - DNA, 25 bp, Mus musculus
gaggctgtcccttaccaatagatta

SEQ ID NO: 489236 - DNA, 25 bp, Mus musculus
gaggctgtcctgagacctctctagt

SEQ ID NO: 489237 - DNA, 25 bp, Mus musculus
gaggctgtcctgtgacctctctagt

SEQ ID NO: 489238 - DNA, 25 bp, Mus musculus
gaggctgtctgaagatgcttgaaaa

SEQ ID NO: 489239 - DNA, 25 bp, Mus musculus
gaggctgtctgacttacagtcttgt

SEQ ID NO: 489240 - DNA, 25 bp, Mus musculus
gaggctgtctgagttacagtcttgt

SEQ ID NO: 489241 - DNA, 25 bp, Mus musculus
gaggctgtctgatgatgcttgaaaa

SEQ ID NO: 489242 - DNA, 25 bp, Mus musculus
gaggctgtctttcatgtggtgtcac

SEQ ID NO: 489243 - DNA, 25 bp, Mus musculus
gaggctgtctttgatgtggtgtcac

SEQ ID NO: 489244 - DNA, 25 bp, Mus musculus
gaggctgtgaacacacaccgggaca

SEQ ID NO: 489245 - DNA, 25 bp, Mus musculus
gaggctgtgaactcacaccgggaca

SEQ ID NO: 489246 - DNA, 25 bp, Mus musculus
gaggctgtgatacacgttggctctt

SEQ ID NO: 489247 - DNA, 25 bp, Mus musculus
gaggctgtgatagacgttggctctt

SEQ ID NO: 489248 - DNA, 25 bp, Mus musculus
gaggctgtgcatacatccaattagt

SEQ ID NO: 489249 - DNA, 25 bp, Mus musculus
gaggctgtgcattcatccaattagt

SEQ ID NO: 489250 - DNA, 25 bp, Mus musculus
gaggctgtgctaagcagctaaccgt

SEQ ID NO: 489251 - DNA, 25 bp, Mus musculus
gaggctgtgctatgcagctaaccgt

SEQ ID NO: 489252 - DNA, 25 bp, Mus musculus
gaggctgtgctcaggaatttttcaa

SEQ ID NO: 489253 - DNA, 25 bp, Mus musculus
gaggctgtgctctggaatttttcaa

SEQ ID NO: 489254 - DNA, 25 bp, Mus musculus
gaggctgtgctgcaagtcttataga

SEQ ID NO: 489255 - DNA, 25 bp, Mus musculus
gaggctgtgctggaagtcttataga

SEQ ID NO: 489256 - DNA, 25 bp, Mus musculus
gaggctgtggacatgttgactccca

SEQ ID NO: 489257 - DNA, 25 bp, Mus musculus
gaggctgtggacttgttgactccca

SEQ ID NO: 489258 - DNA, 25 bp, Mus musculus
gaggctgtggagactaactttgaaa

SEQ ID NO: 489259 - DNA, 25 bp, Mus musculus
gaggctgtggagtctaactttgaaa

SEQ ID NO: 489260 - DNA, 25 bp, Mus musculus
gaggctgtggccacctacagacgcc

SEQ ID NO: 489261 - DNA, 25 bp, Mus musculus
gaggctgtggcctcctacagacgcc

SEQ ID NO: 489262 - DNA, 25 bp, Mus musculus
gaggctgtgtccaaagactttgctt

SEQ ID NO: 489263 - DNA, 25 bp, Mus musculus
gaggctgtgtcctaagactttgctt

SEQ ID NO: 489264 - DNA, 25 bp, Mus musculus
gaggctgtgtctcctcttgagaagt

SEQ ID NO: 489265 - DNA, 25 bp, Mus musculus
gaggctgtgtctgctcttgagaagt

SEQ ID NO: 489266 - DNA, 25 bp, Mus musculus
gaggctgtgtgcacgagacccatct

SEQ ID NO: 489267 - DNA, 25 bp, Mus musculus
gaggctgtgtgctcgagacccatct

SEQ ID NO: 489268 - DNA, 25 bp, Mus musculus
gaggctgtgttgaacgagatctcca

SEQ ID NO: 489269 - DNA, 25 bp, Mus musculus
gaggctgtgttgcattctggtatcc

SEQ ID NO: 489270 - DNA, 25 bp, Mus musculus
gaggctgtgttggattctggtatcc

SEQ ID NO: 489271 - DNA, 25 bp, Mus musculus
gaggctgtgttgtacgagatctcca

SEQ ID NO: 489272 - DNA, 25 bp, Mus musculus
gaggctgtgtttaatttgcacctgc

SEQ ID NO: 489273 - DNA, 25 bp, Mus musculus
gaggctgtgtttcaagtgtctgaca

SEQ ID NO: 489274 - DNA, 25 bp, Mus musculus
gaggctgtgtttctatgtcttgaaa

SEQ ID NO: 489275 - DNA, 25 bp, Mus musculus
gaggctgtgtttgaagtgtctgaca

SEQ ID NO: 489276 - DNA, 25 bp, Mus musculus
gaggctgtgtttgtatgtcttgaaa

SEQ ID NO: 489277 - DNA, 25 bp, Mus musculus
gaggctgtgttttatttgcacctgc

SEQ ID NO: 489278 - DNA, 25 bp, Mus musculus
gaggctgttactcctgtatcacata

SEQ ID NO: 489279 - DNA, 25 bp, Mus musculus
gaggctgttactgctgtatcacata

SEQ ID NO: 489280 - DNA, 25 bp, Mus musculus
gaggctgttagactaaccaggacaa

SEQ ID NO: 489281 - DNA, 25 bp, Mus musculus
gaggctgttagagtaaccaggacaa

SEQ ID NO: 489282 - DNA, 25 bp, Mus musculus
gaggctgttatgcaaaggacgtaat

SEQ ID NO: 489283 - DNA, 25 bp, Mus musculus
gaggctgttatggaaaggacgtaat

SEQ ID NO: 489284 - DNA, 25 bp, Mus musculus
gaggctgttcaaaatggttgctgtt

SEQ ID NO: 489285 - DNA, 25 bp, Mus musculus
gaggctgttcaatatggttgctgtt

SEQ ID NO: 489286 - DNA, 25 bp, Mus musculus
gaggctgttcggattcctgataaaa

SEQ ID NO: 489287 - DNA, 25 bp, Mus musculus
gaggctgttcggtttcctgataaaa

SEQ ID NO: 489288 - DNA, 25 bp, Mus musculus
gaggctgttgaacattccacattca

SEQ ID NO: 489289 - DNA, 25 bp, Mus musculus
gaggctgttgaagattccacattca

SEQ ID NO: 489290 - DNA, 25 bp, Mus musculus
gaggctgttgctagctcagattttt

SEQ ID NO: 489291 - DNA, 25 bp, Mus musculus
gaggctgttgcttgctcagattttt

SEQ ID NO: 489292 - DNA, 25 bp, Mus musculus
gaggctgttggaatctctctctgta

SEQ ID NO: 489293 - DNA, 25 bp, Mus musculus
gaggctgttggattctctctctgta

SEQ ID NO: 489294 - DNA, 25 bp, Mus musculus
gaggctgttggtacatcgacaggaa

SEQ ID NO: 489295 - DNA, 25 bp, Mus musculus
gaggctgttggttcatcgacaggaa

SEQ ID NO: 489296 - DNA, 25 bp, Mus musculus
gaggctgtttcacagtaccgtggat

SEQ ID NO: 489297 - DNA, 25 bp, Mus musculus
gaggctgtttcagagtaccgtggat

SEQ ID NO: 489298 - DNA, 25 bp, Mus musculus
gaggctgttttgagtgaagtttgac

SEQ ID NO: 489299 - DNA, 25 bp, Mus musculus
gaggctgttttgtgtgaagtttgac

SEQ ID NO: 489300 - DNA, 25 bp, Mus musculus
gaggcttaaaggcagctaaaactaa

SEQ ID NO: 489301 - DNA, 25 bp, Mus musculus
gaggcttaaagggagctaaaactaa

SEQ ID NO: 489302 - DNA, 25 bp, Mus musculus
gaggcttaacacacagcgagtcgaa

SEQ ID NO: 489303 - DNA, 25 bp, Mus musculus
gaggcttaacactcagcgagtcgaa

SEQ ID NO: 489304 - DNA, 25 bp, Mus musculus
gaggcttacaacatggacaccaact

SEQ ID NO: 489305 - DNA, 25 bp, Mus musculus
gaggcttacaacttggacaccaact

SEQ ID NO: 489306 - DNA, 25 bp, Mus musculus
gaggcttacagcaaaaggcttctct

SEQ ID NO: 489307 - DNA, 25 bp, Mus musculus
gaggcttacagctaaaggcttctct

SEQ ID NO: 489308 - DNA, 25 bp, Mus musculus
gaggcttacataacttctcagtgca

SEQ ID NO: 489309 - DNA, 25 bp, Mus musculus
gaggcttacatatcttctcagtgca

SEQ ID NO: 489310 - DNA, 25 bp, Mus musculus
gaggcttacatgaaaccttgtttaa

SEQ ID NO: 489311 - DNA, 25 bp, Mus musculus
gaggcttacatgtaaccttgtttaa

SEQ ID NO: 489312 - DNA, 25 bp, Mus musculus
gaggcttacgtcactcaaaaattaa

SEQ ID NO: 489313 - DNA, 25 bp, Mus musculus
gaggcttacgtctctcaaaaattaa

SEQ ID NO: 489314 - DNA, 25 bp, Mus musculus
gaggcttacttactcatgctctgta

SEQ ID NO: 489315 - DNA, 25 bp, Mus musculus
gaggcttacttagtcatgctctgta

SEQ ID NO: 489316 - DNA, 25 bp, Mus musculus
gaggcttagaagacaaaccacagag

SEQ ID NO: 489317 - DNA, 25 bp, Mus musculus
gaggcttagaagtcaaaccacagag

SEQ ID NO: 489318 - DNA, 25 bp, Mus musculus
gaggcttagagccaaccaaacccgt

SEQ ID NO: 489319 - DNA, 25 bp, Mus musculus
gaggcttagagcgaaccaaacccgt

SEQ ID NO: 489320 - DNA, 25 bp, Mus musculus
gaggcttagattacacgtcttctcg

SEQ ID NO: 489321 - DNA, 25 bp, Mus musculus
gaggcttagatttcacgtcttctcg

SEQ ID NO: 489322 - DNA, 25 bp, Mus musculus
gaggcttagcaaagttttctaactt

SEQ ID NO: 489323 - DNA, 25 bp, Mus musculus
gaggcttagcaatgttttctaactt

SEQ ID NO: 489324 - DNA, 25 bp, Mus musculus
gaggcttagcttcgacagttcacac

SEQ ID NO: 489325 - DNA, 25 bp, Mus musculus
gaggcttagcttggacagttcacac

SEQ ID NO: 489326 - DNA, 25 bp, Mus musculus
gaggcttaggcacatcagctttgct

SEQ ID NO: 489327 - DNA, 25 bp, Mus musculus
gaggcttaggcagatcagctttgct

SEQ ID NO: 489328 - DNA, 25 bp, Mus musculus
gaggcttaggccagaacctcctggc

SEQ ID NO: 489329 - DNA, 25 bp, Mus musculus
gaggcttaggcctgaacctcctggc

SEQ ID NO: 489330 - DNA, 25 bp, Mus musculus
gaggcttagtggatgtcttctcact

SEQ ID NO: 489331 - DNA, 25 bp, Mus musculus
gaggcttagtggttgtcttctcact

SEQ ID NO: 489332 - DNA, 25 bp, Mus musculus
gaggcttataccaccctcagctaca

SEQ ID NO: 489333 - DNA, 25 bp, Mus musculus
gaggcttatacctccctcagctaca

SEQ ID NO: 489334 - DNA, 25 bp, Mus musculus
gaggcttatcagatgggccacgcgc

SEQ ID NO: 489335 - DNA, 25 bp, Mus musculus
gaggcttatcagttgggccacgcgc

SEQ ID NO: 489336 - DNA, 25 bp, Mus musculus
gaggcttattctctaaagtttcgtg

SEQ ID NO: 489337 - DNA, 25 bp, Mus musculus
gaggcttattctgtaaagtttcgtg

SEQ ID NO: 489338 - DNA, 25 bp, Mus musculus
gaggcttatttgctaattccagagt

SEQ ID NO: 489339 - DNA, 25 bp, Mus musculus
gaggcttatttggtaattccagagt

SEQ ID NO: 489340 - DNA, 25 bp, Mus musculus
gaggcttcaagcaacaacatatttt

SEQ ID NO: 489341 - DNA, 25 bp, Mus musculus
gaggcttcaagctacaacatatttt

SEQ ID NO: 489342 - DNA, 25 bp, Mus musculus
gaggcttcagaactgtgacctgata

SEQ ID NO: 489343 - DNA, 25 bp, Mus musculus
gaggcttcagaagtgtgacctgata

SEQ ID NO: 489344 - DNA, 25 bp, Mus musculus
gaggcttcagcactgtacctggcac

SEQ ID NO: 489345 - DNA, 25 bp, Mus musculus
gaggcttcagcagtgtacctggcac

SEQ ID NO: 489346 - DNA, 25 bp, Mus musculus
gaggcttcagctccgtagaaccata

SEQ ID NO: 489347 - DNA, 25 bp, Mus musculus
gaggcttcagctgcgtagaaccata

SEQ ID NO: 489348 - DNA, 25 bp, Mus musculus
gaggcttcaggtatgtgcctgttga

SEQ ID NO: 489349 - DNA, 25 bp, Mus musculus
gaggcttcaggtttgtgcctgttga

SEQ ID NO: 489350 - DNA, 25 bp, Mus musculus
gaggcttcattgaggacgtcacaca

SEQ ID NO: 489351 - DNA, 25 bp, Mus musculus
gaggcttcattgtggacgtcacaca

SEQ ID NO: 489352 - DNA, 25 bp, Mus musculus
gaggcttccagacactcagcaagat

SEQ ID NO: 489353 - DNA, 25 bp, Mus musculus
gaggcttccagagactcagcaagat

SEQ ID NO: 489354 - DNA, 25 bp, Mus musculus
gaggcttcccagaggcacaggctga

SEQ ID NO: 489355 - DNA, 25 bp, Mus musculus
gaggcttcccagtggcacaggctga

SEQ ID NO: 489356 - DNA, 25 bp, Mus musculus
gaggcttccgacattgcggccggtc

SEQ ID NO: 489357 - DNA, 25 bp, Mus musculus
gaggcttccgactttgcggccggtc

SEQ ID NO: 489358 - DNA, 25 bp, Mus musculus
gaggcttccttacgtcagcaccttc

SEQ ID NO: 489359 - DNA, 25 bp, Mus musculus
gaggcttccttaggtcagcaccttc

SEQ ID NO: 489360 - DNA, 25 bp, Mus musculus
gaggcttccttcactggcagttgga

SEQ ID NO: 489361 - DNA, 25 bp, Mus musculus
gaggcttccttctctggcagttgga

SEQ ID NO: 489362 - DNA, 25 bp, Mus musculus
gaggcttcggatcaattcgctcaga

SEQ ID NO: 489363 - DNA, 25 bp, Mus musculus
gaggcttcggatgaattcgctcaga

SEQ ID NO: 489364 - DNA, 25 bp, Mus musculus
gaggcttcggtgaaccctgccagtc

SEQ ID NO: 489365 - DNA, 25 bp, Mus musculus
gaggcttcggtgtaccctgccagtc

SEQ ID NO: 489366 - DNA, 25 bp, Mus musculus
gaggcttcggttacctcaaatttct

SEQ ID NO: 489367 - DNA, 25 bp, Mus musculus
gaggcttcggtttcctcaaatttct

SEQ ID NO: 489368 - DNA, 25 bp, Mus musculus
gaggcttcgttcatggaatttttat

SEQ ID NO: 489369 - DNA, 25 bp, Mus musculus
gaggcttcgttcttggaatttttat

SEQ ID NO: 489370 - DNA, 25 bp, Mus musculus
gaggcttcgtttctgggatcccact

SEQ ID NO: 489371 - DNA, 25 bp, Mus musculus
gaggcttcgtttgtgggatcccact

SEQ ID NO: 489372 - DNA, 25 bp, Mus musculus
gaggcttctagcaagggaagtattt

SEQ ID NO: 489373 - DNA, 25 bp, Mus musculus
gaggcttctagctagggaagtattt

SEQ ID NO: 489374 - DNA, 25 bp, Mus musculus
gaggcttctatactagctaccttca

SEQ ID NO: 489375 - DNA, 25 bp, Mus musculus
gaggcttctatagtagctaccttca

SEQ ID NO: 489376 - DNA, 25 bp, Mus musculus
gaggcttctctaacttatactgtct

SEQ ID NO: 489377 - DNA, 25 bp, Mus musculus
gaggcttctctatcttatactgtct

SEQ ID NO: 489378 - DNA, 25 bp, Mus musculus
gaggcttctctgagtaactaacttg

SEQ ID NO: 489379 - DNA, 25 bp, Mus musculus
gaggcttctctgtgtaactaacttg

SEQ ID NO: 489380 - DNA, 25 bp, Mus musculus
gaggcttctgacaagaatttgaaac

SEQ ID NO: 489381 - DNA, 25 bp, Mus musculus
gaggcttctgactagaatttgaaac

SEQ ID NO: 489382 - DNA, 25 bp, Mus musculus
gaggcttctgatctattgggctaat

SEQ ID NO: 489383 - DNA, 25 bp, Mus musculus
gaggcttctgatgtattgggctaat

SEQ ID NO: 489384 - DNA, 25 bp, Mus musculus
gaggcttctgttcactgtttaatta

SEQ ID NO: 489385 - DNA, 25 bp, Mus musculus
gaggcttctgttgactgtttaatta

SEQ ID NO: 489386 - DNA, 25 bp, Mus musculus
gaggcttcttatccgtctttcaaaa

SEQ ID NO: 489387 - DNA, 25 bp, Mus musculus
gaggcttcttatgcgtctttcaaaa

SEQ ID NO: 489388 - DNA, 25 bp, Mus musculus
gaggcttcttggagcgacagtgtac

SEQ ID NO: 489389 - DNA, 25 bp, Mus musculus
gaggcttcttggtgcgacagtgtac

SEQ ID NO: 489390 - DNA, 25 bp, Mus musculus
gaggcttcttgtctagtctgttaac

SEQ ID NO: 489391 - DNA, 25 bp, Mus musculus
gaggcttcttgtgtagtctgttaac

SEQ ID NO: 489392 - DNA, 25 bp, Mus musculus
gaggcttctttcaagatacttcagg

SEQ ID NO: 489393 - DNA, 25 bp, Mus musculus
gaggcttctttctagatacttcagg

SEQ ID NO: 489394 - DNA, 25 bp, Mus musculus
gaggcttgaataacttttccccttt

SEQ ID NO: 489395 - DNA, 25 bp, Mus musculus
gaggcttgaatatcttttccccttt

SEQ ID NO: 489396 - DNA, 25 bp, Mus musculus
gaggcttgacaaagtgtatgctgta

SEQ ID NO: 489397 - DNA, 25 bp, Mus musculus
gaggcttgacaatgtgtatgctgta

SEQ ID NO: 489398 - DNA, 25 bp, Mus musculus
gaggcttgagatacttagttgaact

SEQ ID NO: 489399 - DNA, 25 bp, Mus musculus
gaggcttgagattcttagttgaact

SEQ ID NO: 489400 - DNA, 25 bp, Mus musculus
gaggcttgagctcacagcaggccag

SEQ ID NO: 489401 - DNA, 25 bp, Mus musculus
gaggcttgagctgacagcaggccag

SEQ ID NO: 489402 - DNA, 25 bp, Mus musculus
gaggcttgatcaaaaagactttgca

SEQ ID NO: 489403 - DNA, 25 bp, Mus musculus
gaggcttgatcataaagactttgca

SEQ ID NO: 489404 - DNA, 25 bp, Mus musculus
gaggcttgcagccaatcctgatgac

SEQ ID NO: 489405 - DNA, 25 bp, Mus musculus
gaggcttgcagcgaatcctgatgac

SEQ ID NO: 489406 - DNA, 25 bp, Mus musculus
gaggcttgccagactaaatcagcag

SEQ ID NO: 489407 - DNA, 25 bp, Mus musculus
gaggcttgccagtctaaatcagcag

SEQ ID NO: 489408 - DNA, 25 bp, Mus musculus
gaggcttgcggaacctatctgccgg

SEQ ID NO: 489409 - DNA, 25 bp, Mus musculus
gaggcttgcggatcctatctgccgg

SEQ ID NO: 489410 - DNA, 25 bp, Mus musculus
gaggcttgctcaaggaggtctccat

SEQ ID NO: 489411 - DNA, 25 bp, Mus musculus
gaggcttgctcatggaggtctccat

SEQ ID NO: 489412 - DNA, 25 bp, Mus musculus
gaggcttgctgtaccctatcagggc

SEQ ID NO: 489413 - DNA, 25 bp, Mus musculus
gaggcttgctgttccctatcagggc

SEQ ID NO: 489414 - DNA, 25 bp, Mus musculus
gaggcttggcggctaacatattctt

SEQ ID NO: 489415 - DNA, 25 bp, Mus musculus
gaggcttggcgggtaacatattctt

SEQ ID NO: 489416 - DNA, 25 bp, Mus musculus
gaggcttggcttcagttactctgca

SEQ ID NO: 489417 - DNA, 25 bp, Mus musculus
gaggcttggcttgagttactctgca

SEQ ID NO: 489418 - DNA, 25 bp, Mus musculus
gaggcttgggctaacgtgatcatgt

SEQ ID NO: 489419 - DNA, 25 bp, Mus musculus
gaggcttgggcttacgtgatcatgt

SEQ ID NO: 489420 - DNA, 25 bp, Mus musculus
gaggcttggtatactctgaataagt

SEQ ID NO: 489421 - DNA, 25 bp, Mus musculus
gaggcttggtattctctgaataagt

SEQ ID NO: 489422 - DNA, 25 bp, Mus musculus
gaggcttggtccaagtagctgagta

SEQ ID NO: 489423 - DNA, 25 bp, Mus musculus
gaggcttggtccatatctgatttag

SEQ ID NO: 489424 - DNA, 25 bp, Mus musculus
gaggcttggtcctagtagctgagta

SEQ ID NO: 489425 - DNA, 25 bp, Mus musculus
gaggcttggtccttatctgatttag

SEQ ID NO: 489426 - DNA, 25 bp, Mus musculus
gaggcttggttaagggctactccca

SEQ ID NO: 489427 - DNA, 25 bp, Mus musculus
gaggcttggttatgggctactccca

SEQ ID NO: 489428 - DNA, 25 bp, Mus musculus
gaggcttgtagaacagaacctgaac

SEQ ID NO: 489429 - DNA, 25 bp, Mus musculus
gaggcttgtagatcagaacctgaac

SEQ ID NO: 489430 - DNA, 25 bp, Mus musculus
gaggcttgtagcaatcaactgaaaa

SEQ ID NO: 489431 - DNA, 25 bp, Mus musculus
gaggcttgtagctatcaactgaaaa

SEQ ID NO: 489432 - DNA, 25 bp, Mus musculus
gaggcttgtatgaagtgttggttac

SEQ ID NO: 489433 - DNA, 25 bp, Mus musculus
gaggcttgtatgtagtgttggttac

SEQ ID NO: 489434 - DNA, 25 bp, Mus musculus
gaggcttgtctgatgcttgaatata

SEQ ID NO: 489435 - DNA, 25 bp, Mus musculus
gaggcttgtctgttgcttgaatata

SEQ ID NO: 489436 - DNA, 25 bp, Mus musculus
gaggcttgtgacactgactgacatg

SEQ ID NO: 489437 - DNA, 25 bp, Mus musculus
gaggcttgtgactctgactgacatg

SEQ ID NO: 489438 - DNA, 25 bp, Mus musculus
gaggcttgtggcctggtttctaacc

SEQ ID NO: 489439 - DNA, 25 bp, Mus musculus
gaggcttgtggcgtggtttctaacc

SEQ ID NO: 489440 - DNA, 25 bp, Mus musculus
gaggcttgtgttatgcactctcaat

SEQ ID NO: 489441 - DNA, 25 bp, Mus musculus
gaggcttgtgttttgcactctcaat

SEQ ID NO: 489442 - DNA, 25 bp, Mus musculus
gaggcttgttagaatacatccatct

SEQ ID NO: 489443 - DNA, 25 bp, Mus musculus
gaggcttgttagtatacatccatct

SEQ ID NO: 489444 - DNA, 25 bp, Mus musculus
gaggcttgtttgaggcttcatttct

SEQ ID NO: 489445 - DNA, 25 bp, Mus musculus
gaggcttgtttgtggcttcatttct

SEQ ID NO: 489446 - DNA, 25 bp, Mus musculus
gaggcttgttttcacactacagaga

SEQ ID NO: 489447 - DNA, 25 bp, Mus musculus
gaggcttgttttgacactacagaga

SEQ ID NO: 489448 - DNA, 25 bp, Mus musculus
gaggctttaaggctaataagatagt

SEQ ID NO: 489449 - DNA, 25 bp, Mus musculus
gaggctttaagggtaataagatagt

SEQ ID NO: 489450 - DNA, 25 bp, Mus musculus
gaggctttaccgcatcttttggata

SEQ ID NO: 489451 - DNA, 25 bp, Mus musculus
gaggctttaccggatcttttggata

SEQ ID NO: 489452 - DNA, 25 bp, Mus musculus
gaggctttacctcggtgacatgctc

SEQ ID NO: 489453 - DNA, 25 bp, Mus musculus
gaggctttacctgggtgacatgctc

SEQ ID NO: 489454 - DNA, 25 bp, Mus musculus
gaggctttatcacacatggactttc

SEQ ID NO: 489455 - DNA, 25 bp, Mus musculus
gaggctttatcagacatggactttc

SEQ ID NO: 489456 - DNA, 25 bp, Mus musculus
gaggctttatccagcggccaatgga

SEQ ID NO: 489457 - DNA, 25 bp, Mus musculus
gaggctttatcctgcggccaatgga

SEQ ID NO: 489458 - DNA, 25 bp, Mus musculus
gaggctttattcactttcaaaaaca

SEQ ID NO: 489459 - DNA, 25 bp, Mus musculus
gaggctttattctctttcaaaaaca

SEQ ID NO: 489460 - DNA, 25 bp, Mus musculus
gaggctttatttattggatcactga

SEQ ID NO: 489461 - DNA, 25 bp, Mus musculus
gaggctttattttttggatcactga

SEQ ID NO: 489462 - DNA, 25 bp, Mus musculus
gaggctttcaggattcctgatggga

SEQ ID NO: 489463 - DNA, 25 bp, Mus musculus
gaggctttcaggtttcctgatggga

SEQ ID NO: 489464 - DNA, 25 bp, Mus musculus
gaggctttcatacacatcagttacc

SEQ ID NO: 489465 - DNA, 25 bp, Mus musculus
gaggctttcatagacatcagttacc

SEQ ID NO: 489466 - DNA, 25 bp, Mus musculus
gaggctttccatctacggtgttgac

SEQ ID NO: 489467 - DNA, 25 bp, Mus musculus
gaggctttccatgtacggtgttgac

SEQ ID NO: 489468 - DNA, 25 bp, Mus musculus
gaggctttccctagggtggagaaat

SEQ ID NO: 489469 - DNA, 25 bp, Mus musculus
gaggctttccctctacagaactggt

SEQ ID NO: 489470 - DNA, 25 bp, Mus musculus
gaggctttccctgtacagaactggt

SEQ ID NO: 489471 - DNA, 25 bp, Mus musculus
gaggctttcccttgggtggagaaat

SEQ ID NO: 489472 - DNA, 25 bp, Mus musculus
gaggctttccgcagtaacctgaaga

SEQ ID NO: 489473 - DNA, 25 bp, Mus musculus
gaggctttccgctgtaacctgaaga

SEQ ID NO: 489474 - DNA, 25 bp, Mus musculus
gaggctttccttattgtcttactat

SEQ ID NO: 489475 - DNA, 25 bp, Mus musculus
gaggctttcctttttgtcttactat

SEQ ID NO: 489476 - DNA, 25 bp, Mus musculus
gaggctttctaacttgcatattcaa

SEQ ID NO: 489477 - DNA, 25 bp, Mus musculus
gaggctttctaagttgcatattcaa

SEQ ID NO: 489478 - DNA, 25 bp, Mus musculus
gaggctttctgacatttgttgttcc

SEQ ID NO: 489479 - DNA, 25 bp, Mus musculus
gaggctttctgagatttgttgttcc

SEQ ID NO: 489480 - DNA, 25 bp, Mus musculus
gaggctttctgcattgacataaata

SEQ ID NO: 489481 - DNA, 25 bp, Mus musculus
gaggctttctgctttgacataaata

SEQ ID NO: 489482 - DNA, 25 bp, Mus musculus
gaggctttctgtatcgtttgccaaa

SEQ ID NO: 489483 - DNA, 25 bp, Mus musculus
gaggctttctgtttcgtttgccaaa

SEQ ID NO: 489484 - DNA, 25 bp, Mus musculus
gaggctttcttactagtgatgtctt

SEQ ID NO: 489485 - DNA, 25 bp, Mus musculus
gaggctttcttagtagtgatgtctt

SEQ ID NO: 489486 - DNA, 25 bp, Mus musculus
gaggctttcttgagcagcagctata

SEQ ID NO: 489487 - DNA, 25 bp, Mus musculus
gaggctttcttgtgcagcagctata

SEQ ID NO: 489488 - DNA, 25 bp, Mus musculus
gaggctttgaatcggacaccctatt

SEQ ID NO: 489489 - DNA, 25 bp, Mus musculus
gaggctttgaatgggacaccctatt

SEQ ID NO: 489490 - DNA, 25 bp, Mus musculus
gaggctttgacaccccaggtcatca

SEQ ID NO: 489491 - DNA, 25 bp, Mus musculus
gaggctttgacagcccaggtcatca

SEQ ID NO: 489492 - DNA, 25 bp, Mus musculus
gaggctttgagcattttatacatgt

SEQ ID NO: 489493 - DNA, 25 bp, Mus musculus
gaggctttgagctttttatacatgt

SEQ ID NO: 489494 - DNA, 25 bp, Mus musculus
gaggctttgattctcctttgtggca

SEQ ID NO: 489495 - DNA, 25 bp, Mus musculus
gaggctttgattgtcctttgtggca

SEQ ID NO: 489496 - DNA, 25 bp, Mus musculus
gaggctttgccgaaggattggggta

SEQ ID NO: 489497 - DNA, 25 bp, Mus musculus
gaggctttgccgtaggattggggta

SEQ ID NO: 489498 - DNA, 25 bp, Mus musculus
gaggctttgctgcaattttatcgca

SEQ ID NO: 489499 - DNA, 25 bp, Mus musculus
gaggctttgctggaattttatcgca

SEQ ID NO: 489500 - DNA, 25 bp, Mus musculus
gaggctttggccaaaccatgtggcc

SEQ ID NO: 489501 - DNA, 25 bp, Mus musculus
gaggctttggcctaaccatgtggcc

SEQ ID NO: 489502 - DNA, 25 bp, Mus musculus
gaggctttggctccattattcagct

SEQ ID NO: 489503 - DNA, 25 bp, Mus musculus
gaggctttggctgcattattcagct

SEQ ID NO: 489504 - DNA, 25 bp, Mus musculus
gaggctttgtaaatgccctttctat

SEQ ID NO: 489505 - DNA, 25 bp, Mus musculus
gaggctttgtaattgccctttctat

SEQ ID NO: 489506 - DNA, 25 bp, Mus musculus
gaggctttgtgaattccagtcgtcc

SEQ ID NO: 489507 - DNA, 25 bp, Mus musculus
gaggctttgtgatttccagtcgtcc

SEQ ID NO: 489508 - DNA, 25 bp, Mus musculus
gaggctttgtgtagtagctcttcag

SEQ ID NO: 489509 - DNA, 25 bp, Mus musculus
gaggctttgtgtctgatccaggact

SEQ ID NO: 489510 - DNA, 25 bp, Mus musculus
gaggctttgtgtgtgatccaggact

SEQ ID NO: 489511 - DNA, 25 bp, Mus musculus
gaggctttgtgttgtagctcttcag

SEQ ID NO: 489512 - DNA, 25 bp, Mus musculus
gaggctttgttgatgctggaccatc

SEQ ID NO: 489513 - DNA, 25 bp, Mus musculus
gaggctttgttgttgctggaccatc

SEQ ID NO: 489514 - DNA, 25 bp, Mus musculus
gaggcttttagacctgttcacaaca

SEQ ID NO: 489515 - DNA, 25 bp, Mus musculus
gaggcttttagactcaacggctggc

SEQ ID NO: 489516 - DNA, 25 bp, Mus musculus
gaggcttttagagctgttcacaaca

SEQ ID NO: 489517 - DNA, 25 bp, Mus musculus
gaggcttttagagtcaacggctggc

SEQ ID NO: 489518 - DNA, 25 bp, Mus musculus
gaggcttttagcagagtccaggtat

SEQ ID NO: 489519 - DNA, 25 bp, Mus musculus
gaggcttttagctgagtccaggtat

SEQ ID NO: 489520 - DNA, 25 bp, Mus musculus
gaggcttttctactcaagttcttca

SEQ ID NO: 489521 - DNA, 25 bp, Mus musculus
gaggcttttctagtcaagttcttca

SEQ ID NO: 489522 - DNA, 25 bp, Mus musculus
gaggcttttgacaatgggcagctga

SEQ ID NO: 489523 - DNA, 25 bp, Mus musculus
gaggcttttgactatgggcagctga

SEQ ID NO: 489524 - DNA, 25 bp, Mus musculus
gaggcttttgccctatctggaaaac

SEQ ID NO: 489525 - DNA, 25 bp, Mus musculus
gaggcttttgccgtatctggaaaac

SEQ ID NO: 489526 - DNA, 25 bp, Mus musculus
gaggcttttgtcatgggcaggtaaa

SEQ ID NO: 489527 - DNA, 25 bp, Mus musculus
gaggcttttgtcttgggcaggtaaa

SEQ ID NO: 489528 - DNA, 25 bp, Mus musculus
gaggcttttgtgcattttgaggtca

SEQ ID NO: 489529 - DNA, 25 bp, Mus musculus
gaggcttttgtggattttgaggtca

SEQ ID NO: 489530 - DNA, 25 bp, Mus musculus
gaggctttttacattcagaagatgc

SEQ ID NO: 489531 - DNA, 25 bp, Mus musculus
gaggctttttactttcagaagatgc

SEQ ID NO: 489532 - DNA, 25 bp, Mus musculus
gaggctttttctagggaagaccaca

SEQ ID NO: 489533 - DNA, 25 bp, Mus musculus
gaggctttttcttgggaagaccaca

SEQ ID NO: 489534 - DNA, 25 bp, Mus musculus
gaggctttttgaatgctggtgcccc

SEQ ID NO: 489535 - DNA, 25 bp, Mus musculus
gaggctttttgattgctggtgcccc

SEQ ID NO: 489536 - DNA, 25 bp, Mus musculus
gaggctttttgccacacctttattt

SEQ ID NO: 489537 - DNA, 25 bp, Mus musculus
gaggctttttgcgacacctttattt

SEQ ID NO: 489538 - DNA, 25 bp, Mus musculus
gagggaaaacgtactctccttgcta

SEQ ID NO: 489539 - DNA, 25 bp, Mus musculus
gagggaaaacgttctctccttgcta

SEQ ID NO: 489540 - DNA, 25 bp, Mus musculus
gagggaaaagccagctctcatcttt

SEQ ID NO: 489541 - DNA, 25 bp, Mus musculus
gagggaaaagcctgctctcatcttt

SEQ ID NO: 489542 - DNA, 25 bp, Mus musculus
gagggaaaatttcctttctgcactt

SEQ ID NO: 489543 - DNA, 25 bp, Mus musculus
gagggaaaatttgctttctgcactt

SEQ ID NO: 489544 - DNA, 25 bp, Mus musculus
gagggaaacacccacaaacagcaaa

SEQ ID NO: 489545 - DNA, 25 bp, Mus musculus
gagggaaacaccgacaaacagcaaa

SEQ ID NO: 489546 - DNA, 25 bp, Mus musculus
gagggaaacattacgcctgcgctca

SEQ ID NO: 489547 - DNA, 25 bp, Mus musculus
gagggaaacatttcgcctgcgctca

SEQ ID NO: 489548 - DNA, 25 bp, Mus musculus
gagggaaaccatctacttcctataa

SEQ ID NO: 489549 - DNA, 25 bp, Mus musculus
gagggaaaccatgtacttcctataa

SEQ ID NO: 489550 - DNA, 25 bp, Mus musculus
gagggaaaccctagctcaactgcag

SEQ ID NO: 489551 - DNA, 25 bp, Mus musculus
gagggaaacccttgctcaactgcag

SEQ ID NO: 489552 - DNA, 25 bp, Mus musculus
gagggaaactaaacttactgctaag

SEQ ID NO: 489553 - DNA, 25 bp, Mus musculus
gagggaaactaatcttactgctaag

SEQ ID NO: 489554 - DNA, 25 bp, Mus musculus
gagggaaactgacaacacacttgta

SEQ ID NO: 489555 - DNA, 25 bp, Mus musculus
gagggaaactgagaacacacttgta

SEQ ID NO: 489556 - DNA, 25 bp, Mus musculus
gagggaaagatcattcctgcctgga

SEQ ID NO: 489557 - DNA, 25 bp, Mus musculus
gagggaaagatctttcctgcctgga

SEQ ID NO: 489558 - DNA, 25 bp, Mus musculus
gagggaaagctgagcctagcaagaa

SEQ ID NO: 489559 - DNA, 25 bp, Mus musculus
gagggaaagctgtgcctagcaagaa

SEQ ID NO: 489560 - DNA, 25 bp, Mus musculus
gagggaaatatgacctgttcttaac

SEQ ID NO: 489561 - DNA, 25 bp, Mus musculus
gagggaaatatgtcctgttcttaac

SEQ ID NO: 489562 - DNA, 25 bp, Mus musculus
gagggaaatcgtccgtgacatcaaa

SEQ ID NO: 489563 - DNA, 25 bp, Mus musculus
gagggaaatcgtgcgtgacatcaaa

SEQ ID NO: 489564 - DNA, 25 bp, Mus musculus
gagggaaatcttcgagagagggctt

SEQ ID NO: 489565 - DNA, 25 bp, Mus musculus
gagggaaatcttggagagagggctt

SEQ ID NO: 489566 - DNA, 25 bp, Mus musculus
gagggaaattgccacctgaaggaaa

SEQ ID NO: 489567 - DNA, 25 bp, Mus musculus
gagggaaattgcgacctgaaggaaa

SEQ ID NO: 489568 - DNA, 25 bp, Mus musculus
gagggaaattgtcctccagcctaaa

SEQ ID NO: 489569 - DNA, 25 bp, Mus musculus
gagggaaattgtgctccagcctaaa

SEQ ID NO: 489570 - DNA, 25 bp, Mus musculus
gagggaaatttcagactacagtttt

SEQ ID NO: 489571 - DNA, 25 bp, Mus musculus
gagggaaatttcagatgctatttaa

SEQ ID NO: 489572 - DNA, 25 bp, Mus musculus
gagggaaatttctgactacagtttt

SEQ ID NO: 489573 - DNA, 25 bp, Mus musculus
gagggaaatttctgatgctatttaa

SEQ ID NO: 489574 - DNA, 25 bp, Mus musculus
gagggaacaagaacccatctctact

SEQ ID NO: 489575 - DNA, 25 bp, Mus musculus
gagggaacaagatcccatctctact

SEQ ID NO: 489576 - DNA, 25 bp, Mus musculus
gagggaacacagctgcttacctact

SEQ ID NO: 489577 - DNA, 25 bp, Mus musculus
gagggaacacaggtgcttacctact

SEQ ID NO: 489578 - DNA, 25 bp, Mus musculus
gagggaacacatcctaattctcttg

SEQ ID NO: 489579 - DNA, 25 bp, Mus musculus
gagggaacacatgctaattctcttg

SEQ ID NO: 489580 - DNA, 25 bp, Mus musculus
gagggaacacctaatctcagaatgt

SEQ ID NO: 489581 - DNA, 25 bp, Mus musculus
gagggaacaccttatctcagaatgt

SEQ ID NO: 489582 - DNA, 25 bp, Mus musculus
gagggaacagctatttattttgcta

SEQ ID NO: 489583 - DNA, 25 bp, Mus musculus
gagggaacagctttttattttgcta

SEQ ID NO: 489584 - DNA, 25 bp, Mus musculus
gagggaacaggcattctctacaaac

SEQ ID NO: 489585 - DNA, 25 bp, Mus musculus
gagggaacaggctttctctacaaac

SEQ ID NO: 489586 - DNA, 25 bp, Mus musculus
gagggaacatcaagctgagccagaa

SEQ ID NO: 489587 - DNA, 25 bp, Mus musculus
gagggaacatcatgctgagccagaa

SEQ ID NO: 489588 - DNA, 25 bp, Mus musculus
gagggaacccatatgcatgtggcat

SEQ ID NO: 489589 - DNA, 25 bp, Mus musculus
gagggaacccatttgcatgtggcat

SEQ ID NO: 489590 - DNA, 25 bp, Mus musculus
gagggaacccctatcaagatcacag

SEQ ID NO: 489591 - DNA, 25 bp, Mus musculus
gagggaacccctttcaagatcacag

SEQ ID NO: 489592 - DNA, 25 bp, Mus musculus
gagggaaccctccacaggaaagcat

SEQ ID NO: 489593 - DNA, 25 bp, Mus musculus
gagggaaccctcgacaggaaagcat

SEQ ID NO: 489594 - DNA, 25 bp, Mus musculus
gagggaacgctgcttgacttctaac

SEQ ID NO: 489595 - DNA, 25 bp, Mus musculus
gagggaacgctggttgacttctaac

SEQ ID NO: 489596 - DNA, 25 bp, Mus musculus
gagggaactagtcttttgtgaattt

SEQ ID NO: 489597 - DNA, 25 bp, Mus musculus
gagggaactagtgttttgtgaattt

SEQ ID NO: 489598 - DNA, 25 bp, Mus musculus
gagggaactcagacatcttagtgtt

SEQ ID NO: 489599 - DNA, 25 bp, Mus musculus
gagggaactcagtcatcttagtgtt

SEQ ID NO: 489600 - DNA, 25 bp, Mus musculus
gagggaactctcatgctgctagcca

SEQ ID NO: 489601 - DNA, 25 bp, Mus musculus
gagggaactctcttgctgctagcca

SEQ ID NO: 489602 - DNA, 25 bp, Mus musculus
gagggaactcttcgcccatactaag

SEQ ID NO: 489603 - DNA, 25 bp, Mus musculus
gagggaactcttcgtacctggaaat

SEQ ID NO: 489604 - DNA, 25 bp, Mus musculus
gagggaactcttggcccatactaag

SEQ ID NO: 489605 - DNA, 25 bp, Mus musculus
gagggaactcttggtacctggaaat

SEQ ID NO: 489606 - DNA, 25 bp, Mus musculus
gagggaagaacacagccatgcattt

SEQ ID NO: 489607 - DNA, 25 bp, Mus musculus
gagggaagaacagagccatgcattt

SEQ ID NO: 489608 - DNA, 25 bp, Mus musculus
gagggaagactgaccttcctgctca

SEQ ID NO: 489609 - DNA, 25 bp, Mus musculus
gagggaagactgtccttcctgctca

SEQ ID NO: 489610 - DNA, 25 bp, Mus musculus
gagggaagacttaaaacactttctg

SEQ ID NO: 489611 - DNA, 25 bp, Mus musculus
gagggaagactttaaacactttctg

SEQ ID NO: 489612 - DNA, 25 bp, Mus musculus
gagggaagagctccactatccttcc

SEQ ID NO: 489613 - DNA, 25 bp, Mus musculus
gagggaagagctgcactatccttcc

SEQ ID NO: 489614 - DNA, 25 bp, Mus musculus
gagggaagatgcactccactgcctg

SEQ ID NO: 489615 - DNA, 25 bp, Mus musculus
gagggaagatgctctccactgcctg

SEQ ID NO: 489616 - DNA, 25 bp, Mus musculus
gagggaagccttacttcacattgat

SEQ ID NO: 489617 - DNA, 25 bp, Mus musculus
gagggaagcctttcttcacattgat

SEQ ID NO: 489618 - DNA, 25 bp, Mus musculus
gagggaagctgcagttttcgttgta

SEQ ID NO: 489619 - DNA, 25 bp, Mus musculus
gagggaagctgctgttttcgttgta

SEQ ID NO: 489620 - DNA, 25 bp, Mus musculus
gagggaaggactaagtttgcaccct

SEQ ID NO: 489621 - DNA, 25 bp, Mus musculus
gagggaaggacttagtttgcaccct

SEQ ID NO: 489622 - DNA, 25 bp, Mus musculus
gagggaagggatagaccccgctcct

SEQ ID NO: 489623 - DNA, 25 bp, Mus musculus
gagggaagggattgaccccgctcct

SEQ ID NO: 489624 - DNA, 25 bp, Mus musculus
gagggaagtatcagtggccacatca

SEQ ID NO: 489625 - DNA, 25 bp, Mus musculus
gagggaagtatctgtggccacatca

SEQ ID NO: 489626 - DNA, 25 bp, Mus musculus
gagggaagtcacagtggccaggctt

SEQ ID NO: 489627 - DNA, 25 bp, Mus musculus
gagggaagtcactgtggccaggctt

SEQ ID NO: 489628 - DNA, 25 bp, Mus musculus
gagggaagtctgattgtcctcctac

SEQ ID NO: 489629 - DNA, 25 bp, Mus musculus
gagggaagtctgtttgtcctcctac

SEQ ID NO: 489630 - DNA, 25 bp, Mus musculus
gagggaatacaccagaacttgcttg

SEQ ID NO: 489631 - DNA, 25 bp, Mus musculus
gagggaatacacgagaacttgcttg

SEQ ID NO: 489632 - DNA, 25 bp, Mus musculus
gagggaatacagatatacctacatt

SEQ ID NO: 489633 - DNA, 25 bp, Mus musculus
gagggaatacagttatacctacatt

SEQ ID NO: 489634 - DNA, 25 bp, Mus musculus
gagggaatagtacctaactggccaa

SEQ ID NO: 489635 - DNA, 25 bp, Mus musculus
gagggaatagtagctaactggccaa

SEQ ID NO: 489636 - DNA, 25 bp, Mus musculus
gagggaatcacacccaataaacagt

SEQ ID NO: 489637 - DNA, 25 bp, Mus musculus
gagggaatcacagccaataaacagt

SEQ ID NO: 489638 - DNA, 25 bp, Mus musculus
gagggaatcatcagcgctgttcgtt

SEQ ID NO: 489639 - DNA, 25 bp, Mus musculus
gagggaatcatctgcgctgttcgtt

SEQ ID NO: 489640 - DNA, 25 bp, Mus musculus
gagggaatcccacctaagggattta

SEQ ID NO: 489641 - DNA, 25 bp, Mus musculus
gagggaatcccagctaagggattta

SEQ ID NO: 489642 - DNA, 25 bp, Mus musculus
gagggaatccggaagtgccttgcct

SEQ ID NO: 489643 - DNA, 25 bp, Mus musculus
gagggaatccggtagtgccttgcct

SEQ ID NO: 489644 - DNA, 25 bp, Mus musculus
gagggaatcctgaagtcaagttaac

SEQ ID NO: 489645 - DNA, 25 bp, Mus musculus
gagggaatcctgtagtcaagttaac

SEQ ID NO: 489646 - DNA, 25 bp, Mus musculus
gagggaatctagaccagtgcttaag

SEQ ID NO: 489647 - DNA, 25 bp, Mus musculus
gagggaatctagtccagtgcttaag

SEQ ID NO: 489648 - DNA, 25 bp, Mus musculus
gagggaatctcaaggaatcagcagc

SEQ ID NO: 489649 - DNA, 25 bp, Mus musculus
gagggaatctcatggaatcagcagc

SEQ ID NO: 489650 - DNA, 25 bp, Mus musculus
gagggaatctgccatttcgaaaacg

SEQ ID NO: 489651 - DNA, 25 bp, Mus musculus
gagggaatctgcctcactacctgct

SEQ ID NO: 489652 - DNA, 25 bp, Mus musculus
gagggaatctgcgatttcgaaaacg

SEQ ID NO: 489653 - DNA, 25 bp, Mus musculus
gagggaatctgcgtcactacctgct

SEQ ID NO: 489654 - DNA, 25 bp, Mus musculus
gagggaatcttactcttcatttggt

SEQ ID NO: 489655 - DNA, 25 bp, Mus musculus
gagggaatcttagtcttcatttggt

SEQ ID NO: 489656 - DNA, 25 bp, Mus musculus
gagggaatgattaaggtgagaccta

SEQ ID NO: 489657 - DNA, 25 bp, Mus musculus
gagggaatgatttaggtgagaccta

SEQ ID NO: 489658 - DNA, 25 bp, Mus musculus
gagggaatgtcaacactgaagccaa

SEQ ID NO: 489659 - DNA, 25 bp, Mus musculus
gagggaatgtcatcactgaagccaa

SEQ ID NO: 489660 - DNA, 25 bp, Mus musculus
gagggaattacacacaacataccat

SEQ ID NO: 489661 - DNA, 25 bp, Mus musculus
gagggaattacagacaacataccat

SEQ ID NO: 489662 - DNA, 25 bp, Mus musculus
gagggaattcatcggctttttctaa

SEQ ID NO: 489663 - DNA, 25 bp, Mus musculus
gagggaattcatgggctttttctaa

SEQ ID NO: 489664 - DNA, 25 bp, Mus musculus
gagggaattcctccatttgaagcag

SEQ ID NO: 489665 - DNA, 25 bp, Mus musculus
gagggaattcctgcatttgaagcag

SEQ ID NO: 489666 - DNA, 25 bp, Mus musculus
gagggaattcgcaatgggccatgac

SEQ ID NO: 489667 - DNA, 25 bp, Mus musculus
gagggaattcgctatgggccatgac

SEQ ID NO: 489668 - DNA, 25 bp, Mus musculus
gagggaattctacatagagccgttt

SEQ ID NO: 489669 - DNA, 25 bp, Mus musculus
gagggaattctagatagagccgttt

SEQ ID NO: 489670 - DNA, 25 bp, Mus musculus
gagggaattgtaagctcctcccagt

SEQ ID NO: 489671 - DNA, 25 bp, Mus musculus
gagggaattgtatgctcctcccagt

SEQ ID NO: 489672 - DNA, 25 bp, Mus musculus
gagggaatttagctgactccttaaa

SEQ ID NO: 489673 - DNA, 25 bp, Mus musculus
gagggaatttaggtgactccttaaa

SEQ ID NO: 489674 - DNA, 25 bp, Mus musculus
gagggaatttccaccattaatttct

SEQ ID NO: 489675 - DNA, 25 bp, Mus musculus
gagggaatttcctccattaatttct

SEQ ID NO: 489676 - DNA, 25 bp, Mus musculus
gagggaattttcacacttgtttcta

SEQ ID NO: 489677 - DNA, 25 bp, Mus musculus
gagggaattttcatgccagagtgcc

SEQ ID NO: 489678 - DNA, 25 bp, Mus musculus
gagggaattttctcacttgtttcta

SEQ ID NO: 489679 - DNA, 25 bp, Mus musculus
gagggaattttcttgccagagtgcc

SEQ ID NO: 489680 - DNA, 25 bp, Mus musculus
gagggacaaaggagtctgtaactaa

SEQ ID NO: 489681 - DNA, 25 bp, Mus musculus
gagggacaaaggtgtctgtaactaa

SEQ ID NO: 489682 - DNA, 25 bp, Mus musculus
gagggacaactgagctggtcttcct

SEQ ID NO: 489683 - DNA, 25 bp, Mus musculus
gagggacaactgtgctggtcttcct

SEQ ID NO: 489684 - DNA, 25 bp, Mus musculus
gagggacaagcaattagacagctga

SEQ ID NO: 489685 - DNA, 25 bp, Mus musculus
gagggacaagcatttagacagctga

SEQ ID NO: 489686 - DNA, 25 bp, Mus musculus
gagggacaagccagcctgcttcctg

SEQ ID NO: 489687 - DNA, 25 bp, Mus musculus
gagggacaagcctgcctgcttcctg

SEQ ID NO: 489688 - DNA, 25 bp, Mus musculus
gagggacacaatctctgcttccaag

SEQ ID NO: 489689 - DNA, 25 bp, Mus musculus
gagggacacaatgtctgcttccaag

SEQ ID NO: 489690 - DNA, 25 bp, Mus musculus
gagggacacactcctgatgtgtgat

SEQ ID NO: 489691 - DNA, 25 bp, Mus musculus
gagggacacactgctgatgtgtgat

SEQ ID NO: 489692 - DNA, 25 bp, Mus musculus
gagggacacatgaagcaaacatttc

SEQ ID NO: 489693 - DNA, 25 bp, Mus musculus
gagggacacatgagccagcctgagt

SEQ ID NO: 489694 - DNA, 25 bp, Mus musculus
gagggacacatgtagcaaacatttc

SEQ ID NO: 489695 - DNA, 25 bp, Mus musculus
gagggacacatgtgccagcctgagt

SEQ ID NO: 489696 - DNA, 25 bp, Mus musculus
gagggacacctcactgaatggcttc

SEQ ID NO: 489697 - DNA, 25 bp, Mus musculus
gagggacacctctctgaatggcttc

SEQ ID NO: 489698 - DNA, 25 bp, Mus musculus
gagggacactctagggacataacat

SEQ ID NO: 489699 - DNA, 25 bp, Mus musculus
gagggacactcttgggacataacat

SEQ ID NO: 489700 - DNA, 25 bp, Mus musculus
gagggacacttaatgtctccatttt

SEQ ID NO: 489701 - DNA, 25 bp, Mus musculus
gagggacacttattgtctccatttt

SEQ ID NO: 489702 - DNA, 25 bp, Mus musculus
gagggacacttgacacttccaacca

SEQ ID NO: 489703 - DNA, 25 bp, Mus musculus
gagggacacttgtcacttccaacca

SEQ ID NO: 489704 - DNA, 25 bp, Mus musculus
gagggacagactcgatgccattatt

SEQ ID NO: 489705 - DNA, 25 bp, Mus musculus
gagggacagactggatgccattatt

SEQ ID NO: 489706 - DNA, 25 bp, Mus musculus
gagggacagcctcagctaacaatta

SEQ ID NO: 489707 - DNA, 25 bp, Mus musculus
gagggacagcctgagctaacaatta

SEQ ID NO: 489708 - DNA, 25 bp, Mus musculus
gagggacagcgcaattccattcaga

SEQ ID NO: 489709 - DNA, 25 bp, Mus musculus
gagggacagcgctattccattcaga

SEQ ID NO: 489710 - DNA, 25 bp, Mus musculus
gagggacagctcaggataggacaaa

SEQ ID NO: 489711 - DNA, 25 bp, Mus musculus
gagggacagctctggataggacaaa

SEQ ID NO: 489712 - DNA, 25 bp, Mus musculus
gagggacagcttaggcatcagacat

SEQ ID NO: 489713 - DNA, 25 bp, Mus musculus
gagggacagctttggcatcagacat

SEQ ID NO: 489714 - DNA, 25 bp, Mus musculus
gagggacaggataccgtgactccag

SEQ ID NO: 489715 - DNA, 25 bp, Mus musculus
gagggacaggattccgtgactccag

SEQ ID NO: 489716 - DNA, 25 bp, Mus musculus
gagggacaggctattgaggattcta

SEQ ID NO: 489717 - DNA, 25 bp, Mus musculus
gagggacaggcttttgaggattcta

SEQ ID NO: 489718 - DNA, 25 bp, Mus musculus
gagggacagtgtagctttattttac

SEQ ID NO: 489719 - DNA, 25 bp, Mus musculus
gagggacagtgttgctttattttac

SEQ ID NO: 489720 - DNA, 25 bp, Mus musculus
gagggacagttaatccatgttctct

SEQ ID NO: 489721 - DNA, 25 bp, Mus musculus
gagggacagttattccatgttctct

SEQ ID NO: 489722 - DNA, 25 bp, Mus musculus
gagggacatcgaccatctcaccggt

SEQ ID NO: 489723 - DNA, 25 bp, Mus musculus
gagggacatcgagcatctcaccggt

SEQ ID NO: 489724 - DNA, 25 bp, Mus musculus
gagggacatcttcagggctaacatc

SEQ ID NO: 489725 - DNA, 25 bp, Mus musculus
gagggacatcttcctatgattaacc

SEQ ID NO: 489726 - DNA, 25 bp, Mus musculus
gagggacatcttgagggctaacatc

SEQ ID NO: 489727 - DNA, 25 bp, Mus musculus
gagggacatcttgctatgattaacc

SEQ ID NO: 489728 - DNA, 25 bp, Mus musculus
gagggacatgacattctttcagcac

SEQ ID NO: 489729 - DNA, 25 bp, Mus musculus
gagggacatgactttctttcagcac

SEQ ID NO: 489730 - DNA, 25 bp, Mus musculus
gagggacatgtcactctcaggatga

SEQ ID NO: 489731 - DNA, 25 bp, Mus musculus
gagggacatgtctctctcaggatga

SEQ ID NO: 489732 - DNA, 25 bp, Mus musculus
gagggacattgtaactgccataggt

SEQ ID NO: 489733 - DNA, 25 bp, Mus musculus
gagggacattgttactgccataggt

SEQ ID NO: 489734 - DNA, 25 bp, Mus musculus
gagggaccaacacactgggcagtca

SEQ ID NO: 489735 - DNA, 25 bp, Mus musculus
gagggaccaacagactgggcagtca

SEQ ID NO: 489736 - DNA, 25 bp, Mus musculus
gagggaccaaggaacagccagtgaa

SEQ ID NO: 489737 - DNA, 25 bp, Mus musculus
gagggaccaaggtacagccagtgaa

SEQ ID NO: 489738 - DNA, 25 bp, Mus musculus
gagggaccacccagttctgtgattc

SEQ ID NO: 489739 - DNA, 25 bp, Mus musculus
gagggaccaccctgttctgtgattc

SEQ ID NO: 489740 - DNA, 25 bp, Mus musculus
gagggaccagaacgactccacggcc

SEQ ID NO: 489741 - DNA, 25 bp, Mus musculus
gagggaccagaaggactccacggcc

SEQ ID NO: 489742 - DNA, 25 bp, Mus musculus
gagggaccaggaatactgccttttg

SEQ ID NO: 489743 - DNA, 25 bp, Mus musculus
gagggaccaggattactgccttttg

SEQ ID NO: 489744 - DNA, 25 bp, Mus musculus
gagggaccaggtacagggtctttct

SEQ ID NO: 489745 - DNA, 25 bp, Mus musculus
gagggaccaggttcagggtctttct

SEQ ID NO: 489746 - DNA, 25 bp, Mus musculus
gagggaccagtcctcagaaaggttt

SEQ ID NO: 489747 - DNA, 25 bp, Mus musculus
gagggaccagtcgtcagaaaggttt

SEQ ID NO: 489748 - DNA, 25 bp, Mus musculus
gagggaccagttatggcaactcatt

SEQ ID NO: 489749 - DNA, 25 bp, Mus musculus
gagggaccagttttggcaactcatt

SEQ ID NO: 489750 - DNA, 25 bp, Mus musculus
gagggacccagaccaccttagacaa

SEQ ID NO: 489751 - DNA, 25 bp, Mus musculus
gagggacccagagcaccttagacaa

SEQ ID NO: 489752 - DNA, 25 bp, Mus musculus
gagggacccagcattcgaggcccac

SEQ ID NO: 489753 - DNA, 25 bp, Mus musculus
gagggacccagctttcgaggcccac

SEQ ID NO: 489754 - DNA, 25 bp, Mus musculus
gagggacccagtcgctgttcatgca

SEQ ID NO: 489755 - DNA, 25 bp, Mus musculus
gagggacccagtggctgttcatgca

SEQ ID NO: 489756 - DNA, 25 bp, Mus musculus
gagggacccatgctgcatttgtaat

SEQ ID NO: 489757 - DNA, 25 bp, Mus musculus
gagggacccatggtgcatttgtaat

SEQ ID NO: 489758 - DNA, 25 bp, Mus musculus
gagggaccccaacagatgacacctt

SEQ ID NO: 489759 - DNA, 25 bp, Mus musculus
gagggaccccaagagatgacacctt

SEQ ID NO: 489760 - DNA, 25 bp, Mus musculus
gagggaccccagcttaagtcggatc

SEQ ID NO: 489761 - DNA, 25 bp, Mus musculus
gagggaccccaggttaagtcggatc

SEQ ID NO: 489762 - DNA, 25 bp, Mus musculus
gagggacccgatacaaattcttagg

SEQ ID NO: 489763 - DNA, 25 bp, Mus musculus
gagggacccgattcaaattcttagg

SEQ ID NO: 489764 - DNA, 25 bp, Mus musculus
gagggaccgaaaacgctaccagcag

SEQ ID NO: 489765 - DNA, 25 bp, Mus musculus
gagggaccgaaatcgctaccagcag

SEQ ID NO: 489766 - DNA, 25 bp, Mus musculus
gagggaccgatgaatccactggaat

SEQ ID NO: 489767 - DNA, 25 bp, Mus musculus
gagggaccgatgtatccactggaat

SEQ ID NO: 489768 - DNA, 25 bp, Mus musculus
gagggaccgtcactcatcagcaaga

SEQ ID NO: 489769 - DNA, 25 bp, Mus musculus
gagggaccgtcagtcatcagcaaga

SEQ ID NO: 489770 - DNA, 25 bp, Mus musculus
gagggacctccaacttcgggctggc

SEQ ID NO: 489771 - DNA, 25 bp, Mus musculus
gagggacctccatcttcgggctggc

SEQ ID NO: 489772 - DNA, 25 bp, Mus musculus
gagggacctcctatgattgacagct

SEQ ID NO: 489773 - DNA, 25 bp, Mus musculus
gagggacctcctttgattgacagct

SEQ ID NO: 489774 - DNA, 25 bp, Mus musculus
gagggacctcgacaccagagtacaa

SEQ ID NO: 489775 - DNA, 25 bp, Mus musculus
gagggacctcgagaccagagtacaa

SEQ ID NO: 489776 - DNA, 25 bp, Mus musculus
gagggacctcttctgggcaaacgtt

SEQ ID NO: 489777 - DNA, 25 bp, Mus musculus
gagggacctcttgtgggcaaacgtt

SEQ ID NO: 489778 - DNA, 25 bp, Mus musculus
gagggacctgaactgattaacgtgt

SEQ ID NO: 489779 - DNA, 25 bp, Mus musculus
gagggacctgaagtgattaacgtgt

SEQ ID NO: 489780 - DNA, 25 bp, Mus musculus
gagggacctgggaaacacaaagagc

SEQ ID NO: 489781 - DNA, 25 bp, Mus musculus
gagggacctgggtaacacaaagagc

SEQ ID NO: 489782 - DNA, 25 bp, Mus musculus
gagggaccttatactatcaaaaaag

SEQ ID NO: 489783 - DNA, 25 bp, Mus musculus
gagggaccttattctatcaaaaaag

SEQ ID NO: 489784 - DNA, 25 bp, Mus musculus
gagggacgacaaccagtctgcactg

SEQ ID NO: 489785 - DNA, 25 bp, Mus musculus
gagggacgacaagcagtctgcactg

SEQ ID NO: 489786 - DNA, 25 bp, Mus musculus
gagggacgaccaaatttatttcagt

SEQ ID NO: 489787 - DNA, 25 bp, Mus musculus
gagggacgaccatatttatttcagt

SEQ ID NO: 489788 - DNA, 25 bp, Mus musculus
gagggacgcaggaaccaccaaccaa

SEQ ID NO: 489789 - DNA, 25 bp, Mus musculus
gagggacgcaggtaccaccaaccaa

SEQ ID NO: 489790 - DNA, 25 bp, Mus musculus
gagggacgctctacagacctggaga

SEQ ID NO: 489791 - DNA, 25 bp, Mus musculus
gagggacgctcttcagacctggaga

SEQ ID NO: 489792 - DNA, 25 bp, Mus musculus
gagggacggctcacaaggccttgac

SEQ ID NO: 489793 - DNA, 25 bp, Mus musculus
gagggacggctctcaaggccttgac

SEQ ID NO: 489794 - DNA, 25 bp, Mus musculus
gagggacggcttcttattatcactt

SEQ ID NO: 489795 - DNA, 25 bp, Mus musculus
gagggacggcttgttattatcactt

SEQ ID NO: 489796 - DNA, 25 bp, Mus musculus
gagggacggtgacagtatccactac

SEQ ID NO: 489797 - DNA, 25 bp, Mus musculus
gagggacggtgagagtatccactac

SEQ ID NO: 489798 - DNA, 25 bp, Mus musculus
gagggacgtttgaggcagtttactt

SEQ ID NO: 489799 - DNA, 25 bp, Mus musculus
gagggacgtttgtggcagtttactt

SEQ ID NO: 489800 - DNA, 25 bp, Mus musculus
gagggactactgagcttaacaacga

SEQ ID NO: 489801 - DNA, 25 bp, Mus musculus
gagggactactgtgcttaacaacga

SEQ ID NO: 489802 - DNA, 25 bp, Mus musculus
gagggactaggccaaagatagtcac

SEQ ID NO: 489803 - DNA, 25 bp, Mus musculus
gagggactaggcgaaagatagtcac

SEQ ID NO: 489804 - DNA, 25 bp, Mus musculus
gagggactagttattcaggccagcc

SEQ ID NO: 489805 - DNA, 25 bp, Mus musculus
gagggactagtttttcaggccagcc

SEQ ID NO: 489806 - DNA, 25 bp, Mus musculus
gagggactatggcttgttaatcagt

SEQ ID NO: 489807 - DNA, 25 bp, Mus musculus
gagggactatgggttgttaatcagt

SEQ ID NO: 489808 - DNA, 25 bp, Mus musculus
gagggactcaaactagagctgccaa

SEQ ID NO: 489809 - DNA, 25 bp, Mus musculus
gagggactcaaagtagagctgccaa

SEQ ID NO: 489810 - DNA, 25 bp, Mus musculus
gagggactccacagtgacaatcctt

SEQ ID NO: 489811 - DNA, 25 bp, Mus musculus
gagggactccactgtgacaatcctt

SEQ ID NO: 489812 - DNA, 25 bp, Mus musculus
gagggactctatagtcactgcagga

SEQ ID NO: 489813 - DNA, 25 bp, Mus musculus
gagggactctattgtcactgcagga

SEQ ID NO: 489814 - DNA, 25 bp, Mus musculus
gagggactctcacggacttcaaaaa

SEQ ID NO: 489815 - DNA, 25 bp, Mus musculus
gagggactctcagggacttcaaaaa

SEQ ID NO: 489816 - DNA, 25 bp, Mus musculus
gagggactctccatgtatccagtta

SEQ ID NO: 489817 - DNA, 25 bp, Mus musculus
gagggactctccttgtatccagtta

SEQ ID NO: 489818 - DNA, 25 bp, Mus musculus
gagggactgaaaatgttctgcatgt

SEQ ID NO: 489819 - DNA, 25 bp, Mus musculus
gagggactgaaattgttctgcatgt

SEQ ID NO: 489820 - DNA, 25 bp, Mus musculus
gagggactgaatccctaactcacca

SEQ ID NO: 489821 - DNA, 25 bp, Mus musculus
gagggactgaatgcctaactcacca

SEQ ID NO: 489822 - DNA, 25 bp, Mus musculus
gagggactgcagaatggcttcattt

SEQ ID NO: 489823 - DNA, 25 bp, Mus musculus
gagggactgcagtatggcttcattt

SEQ ID NO: 489824 - DNA, 25 bp, Mus musculus
gagggactgcataatgttcactgtg

SEQ ID NO: 489825 - DNA, 25 bp, Mus musculus
gagggactgcattatgttcactgtg

SEQ ID NO: 489826 - DNA, 25 bp, Mus musculus
gagggactggatacgcaagcaactg

SEQ ID NO: 489827 - DNA, 25 bp, Mus musculus
gagggactggattcgcaagcaactg

SEQ ID NO: 489828 - DNA, 25 bp, Mus musculus
gagggactgtttccgagcccagttt

SEQ ID NO: 489829 - DNA, 25 bp, Mus musculus
gagggactgtttgcgagcccagttt

SEQ ID NO: 489830 - DNA, 25 bp, Mus musculus
gagggacttacaactttcttgtttt

SEQ ID NO: 489831 - DNA, 25 bp, Mus musculus
gagggacttacatctttcttgtttt

SEQ ID NO: 489832 - DNA, 25 bp, Mus musculus
gagggacttccaacctaaggagaag

SEQ ID NO: 489833 - DNA, 25 bp, Mus musculus
gagggacttccatcctaaggagaag

SEQ ID NO: 489834 - DNA, 25 bp, Mus musculus
gagggacttcccatgcctaaggact

SEQ ID NO: 489835 - DNA, 25 bp, Mus musculus
gagggacttcccttgcctaaggact

SEQ ID NO: 489836 - DNA, 25 bp, Mus musculus
gagggacttctcattggaatgctag

SEQ ID NO: 489837 - DNA, 25 bp, Mus musculus
gagggacttctctttggaatgctag

SEQ ID NO: 489838 - DNA, 25 bp, Mus musculus
gagggacttcttatccagtagctct

SEQ ID NO: 489839 - DNA, 25 bp, Mus musculus
gagggacttcttttccagtagctct

SEQ ID NO: 489840 - DNA, 25 bp, Mus musculus
gagggacttgacatcacaggccatg

SEQ ID NO: 489841 - DNA, 25 bp, Mus musculus
gagggacttgacatcttaaacaact

SEQ ID NO: 489842 - DNA, 25 bp, Mus musculus
gagggacttgacttcacaggccatg

SEQ ID NO: 489843 - DNA, 25 bp, Mus musculus
gagggacttgacttcttaaacaact

SEQ ID NO: 489844 - DNA, 25 bp, Mus musculus
gagggacttgtaatctgctgcagcc

SEQ ID NO: 489845 - DNA, 25 bp, Mus musculus
gagggacttgtattctgctgcagcc

SEQ ID NO: 489846 - DNA, 25 bp, Mus musculus
gagggacttgtgacccctatgtgac

SEQ ID NO: 489847 - DNA, 25 bp, Mus musculus
gagggacttgtgtcccctatgtgac

SEQ ID NO: 489848 - DNA, 25 bp, Mus musculus
gagggactttgccttttctgagaag

SEQ ID NO: 489849 - DNA, 25 bp, Mus musculus
gagggactttgcgttttctgagaag

SEQ ID NO: 489850 - DNA, 25 bp, Mus musculus
gagggagaacacatgtattacgctt

SEQ ID NO: 489851 - DNA, 25 bp, Mus musculus
gagggagaacacttgtattacgctt

SEQ ID NO: 489852 - DNA, 25 bp, Mus musculus
gagggagaactcattcttgcctggc

SEQ ID NO: 489853 - DNA, 25 bp, Mus musculus
gagggagaactctttcttgcctggc

SEQ ID NO: 489854 - DNA, 25 bp, Mus musculus
gagggagaagccctccgtctatcca

SEQ ID NO: 489855 - DNA, 25 bp, Mus musculus
gagggagaagccgtccgtctatcca

SEQ ID NO: 489856 - DNA, 25 bp, Mus musculus
gagggagaagtaagcccattctaca

SEQ ID NO: 489857 - DNA, 25 bp, Mus musculus
gagggagaagtatgcccattctaca

SEQ ID NO: 489858 - DNA, 25 bp, Mus musculus
gagggagaagttcccgtccaagctc

SEQ ID NO: 489859 - DNA, 25 bp, Mus musculus
gagggagaagttgccgtccaagctc

SEQ ID NO: 489860 - DNA, 25 bp, Mus musculus
gagggagaattacttcccagcctcc

SEQ ID NO: 489861 - DNA, 25 bp, Mus musculus
gagggagaattagttcccagcctcc

SEQ ID NO: 489862 - DNA, 25 bp, Mus musculus
gagggagacacacgagctcttttta

SEQ ID NO: 489863 - DNA, 25 bp, Mus musculus
gagggagacacaggagctcttttta

SEQ ID NO: 489864 - DNA, 25 bp, Mus musculus
gagggagacactcccatttggagac

SEQ ID NO: 489865 - DNA, 25 bp, Mus musculus
gagggagacactgccatttggagac

SEQ ID NO: 489866 - DNA, 25 bp, Mus musculus
gagggagacattacatttaggacca

SEQ ID NO: 489867 - DNA, 25 bp, Mus musculus
gagggagacatttcatttaggacca

SEQ ID NO: 489868 - DNA, 25 bp, Mus musculus
gagggagacctcagctagtcagtca

SEQ ID NO: 489869 - DNA, 25 bp, Mus musculus
gagggagacctctgctagtcagtca

SEQ ID NO: 489870 - DNA, 25 bp, Mus musculus
gagggagaccttcccatttcgtggc

SEQ ID NO: 489871 - DNA, 25 bp, Mus musculus
gagggagaccttgccatttcgtggc

SEQ ID NO: 489872 - DNA, 25 bp, Mus musculus
gagggagactacactgacccttgtt

SEQ ID NO: 489873 - DNA, 25 bp, Mus musculus
gagggagactactctgacccttgtt

SEQ ID NO: 489874 - DNA, 25 bp, Mus musculus
gagggagactccaagcatcaacatc

SEQ ID NO: 489875 - DNA, 25 bp, Mus musculus
gagggagactcctagcatcaacatc

SEQ ID NO: 489876 - DNA, 25 bp, Mus musculus
gagggagagcagcttctcgacacct

SEQ ID NO: 489877 - DNA, 25 bp, Mus musculus
gagggagagcaggttctcgacacct

SEQ ID NO: 489878 - DNA, 25 bp, Mus musculus
gagggagaggttcttcaccttcaaa

SEQ ID NO: 489879 - DNA, 25 bp, Mus musculus
gagggagaggttgttcaccttcaaa

SEQ ID NO: 489880 - DNA, 25 bp, Mus musculus
gagggagagttcaccagcctgcctc

SEQ ID NO: 489881 - DNA, 25 bp, Mus musculus
gagggagagttctccagcctgcctc

SEQ ID NO: 489882 - DNA, 25 bp, Mus musculus
gagggagatgacctgcacccttttc

SEQ ID NO: 489883 - DNA, 25 bp, Mus musculus
gagggagatgacgtgcacccttttc

SEQ ID NO: 489884 - DNA, 25 bp, Mus musculus
gagggagatgcgagtttactccctt

SEQ ID NO: 489885 - DNA, 25 bp, Mus musculus
gagggagatgcgtgtttactccctt

SEQ ID NO: 489886 - DNA, 25 bp, Mus musculus
gagggagcacagagctctgacccat

SEQ ID NO: 489887 - DNA, 25 bp, Mus musculus
gagggagcacagtgctctgacccat

SEQ ID NO: 489888 - DNA, 25 bp, Mus musculus
gagggagcacgtcggcacggaccat

SEQ ID NO: 489889 - DNA, 25 bp, Mus musculus
gagggagcacgtgggcacggaccat

SEQ ID NO: 489890 - DNA, 25 bp, Mus musculus
gagggagcatccacctccaggaagt

SEQ ID NO: 489891 - DNA, 25 bp, Mus musculus
gagggagcatcctcctccaggaagt

SEQ ID NO: 489892 - DNA, 25 bp, Mus musculus
gagggagccaccacctacctggtga

SEQ ID NO: 489893 - DNA, 25 bp, Mus musculus
gagggagccacctcctacctggtga

SEQ ID NO: 489894 - DNA, 25 bp, Mus musculus
gagggagccattcgagctgactaca

SEQ ID NO: 489895 - DNA, 25 bp, Mus musculus
gagggagccattggagctgactaca

SEQ ID NO: 489896 - DNA, 25 bp, Mus musculus
gagggagcccatatctttttcatac

SEQ ID NO: 489897 - DNA, 25 bp, Mus musculus
gagggagcccatttctttttcatac

SEQ ID NO: 489898 - DNA, 25 bp, Mus musculus
gagggagccctcatgtacaaatgaa

SEQ ID NO: 489899 - DNA, 25 bp, Mus musculus
gagggagccctcttgtacaaatgaa

SEQ ID NO: 489900 - DNA, 25 bp, Mus musculus
gagggagccggaaagattgctcagt

SEQ ID NO: 489901 - DNA, 25 bp, Mus musculus
gagggagccggatagattgctcagt

SEQ ID NO: 489902 - DNA, 25 bp, Mus musculus
gagggagccggcacctttgctctgt

SEQ ID NO: 489903 - DNA, 25 bp, Mus musculus
gagggagccggctcctttgctctgt

SEQ ID NO: 489904 - DNA, 25 bp, Mus musculus
gagggagcctatatcactcgtgtaa

SEQ ID NO: 489905 - DNA, 25 bp, Mus musculus
gagggagcctatttcactcgtgtaa

SEQ ID NO: 489906 - DNA, 25 bp, Mus musculus
gagggagcggagacaaacccagttt

SEQ ID NO: 489907 - DNA, 25 bp, Mus musculus
gagggagcggagtcaaacccagttt

SEQ ID NO: 489908 - DNA, 25 bp, Mus musculus
gagggagctacaatagacaccagat

SEQ ID NO: 489909 - DNA, 25 bp, Mus musculus
gagggagctacattagacaccagat

SEQ ID NO: 489910 - DNA, 25 bp, Mus musculus
gagggagctatgctaccattctgcc

SEQ ID NO: 489911 - DNA, 25 bp, Mus musculus
gagggagctatggtaccattctgcc

SEQ ID NO: 489912 - DNA, 25 bp, Mus musculus
gagggagctcccatctaagctgaat

SEQ ID NO: 489913 - DNA, 25 bp, Mus musculus
gagggagctcccctgttgaatttat

SEQ ID NO: 489914 - DNA, 25 bp, Mus musculus
gagggagctcccgtgttgaatttat

SEQ ID NO: 489915 - DNA, 25 bp, Mus musculus
gagggagctcccttctaagctgaat

SEQ ID NO: 489916 - DNA, 25 bp, Mus musculus
gagggagctcttatccatggatgtc

SEQ ID NO: 489917 - DNA, 25 bp, Mus musculus
gagggagctcttttccatggatgtc

SEQ ID NO: 489918 - DNA, 25 bp, Mus musculus
gagggagctggactctctcacagaa

SEQ ID NO: 489919 - DNA, 25 bp, Mus musculus
gagggagctggagtctctcacagaa

SEQ ID NO: 489920 - DNA, 25 bp, Mus musculus
gagggagcttgcagcagccataatt

SEQ ID NO: 489921 - DNA, 25 bp, Mus musculus
gagggagcttgctgcagccataatt

SEQ ID NO: 489922 - DNA, 25 bp, Mus musculus
gagggagctttccagtaactgccga

SEQ ID NO: 489923 - DNA, 25 bp, Mus musculus
gagggagctttcgagtaactgccga

SEQ ID NO: 489924 - DNA, 25 bp, Mus musculus
gagggagctttgaacttaatgatat

SEQ ID NO: 489925 - DNA, 25 bp, Mus musculus
gagggagctttgtacttaatgatat

SEQ ID NO: 489926 - DNA, 25 bp, Mus musculus
gagggaggaaaccacctctcttaga

SEQ ID NO: 489927 - DNA, 25 bp, Mus musculus
gagggaggaaacgacctctcttaga

SEQ ID NO: 489928 - DNA, 25 bp, Mus musculus
gagggaggaatcacactgcctgtcc

SEQ ID NO: 489929 - DNA, 25 bp, Mus musculus
gagggaggaatcctgtactgcccac

SEQ ID NO: 489930 - DNA, 25 bp, Mus musculus
gagggaggaatcgtgtactgcccac

SEQ ID NO: 489931 - DNA, 25 bp, Mus musculus
gagggaggaatctcactgcctgtcc

SEQ ID NO: 489932 - DNA, 25 bp, Mus musculus
gagggaggacacctcatctcttctc

SEQ ID NO: 489933 - DNA, 25 bp, Mus musculus
gagggaggacacgtcatctcttctc

SEQ ID NO: 489934 - DNA, 25 bp, Mus musculus
gagggaggacgcagaaccttcacag

SEQ ID NO: 489935 - DNA, 25 bp, Mus musculus
gagggaggacgctgaaccttcacag

SEQ ID NO: 489936 - DNA, 25 bp, Mus musculus
gagggaggagccaaccaggtactta

SEQ ID NO: 489937 - DNA, 25 bp, Mus musculus
gagggaggagcctaccaggtactta

SEQ ID NO: 489938 - DNA, 25 bp, Mus musculus
gagggaggcagacaattgactagct

SEQ ID NO: 489939 - DNA, 25 bp, Mus musculus
gagggaggcagagaattgactagct

SEQ ID NO: 489940 - DNA, 25 bp, Mus musculus
gagggaggcaggaacattcatgtcc

SEQ ID NO: 489941 - DNA, 25 bp, Mus musculus
gagggaggcaggtacattcatgtcc

SEQ ID NO: 489942 - DNA, 25 bp, Mus musculus
gagggaggcgttagattctgcccac

SEQ ID NO: 489943 - DNA, 25 bp, Mus musculus
gagggaggcgtttgattctgcccac

SEQ ID NO: 489944 - DNA, 25 bp, Mus musculus
gagggaggcttccagtaaaccactt

SEQ ID NO: 489945 - DNA, 25 bp, Mus musculus
gagggaggcttcgagtaaaccactt

SEQ ID NO: 489946 - DNA, 25 bp, Mus musculus
gagggaggctttactactcaaccat

SEQ ID NO: 489947 - DNA, 25 bp, Mus musculus
gagggaggctttcgagcaactcttc

SEQ ID NO: 489948 - DNA, 25 bp, Mus musculus
gagggaggctttggagcaactcttc

SEQ ID NO: 489949 - DNA, 25 bp, Mus musculus
gagggaggcttttctactcaaccat

SEQ ID NO: 489950 - DNA, 25 bp, Mus musculus
gagggagggacaaggcaagctgaaa

SEQ ID NO: 489951 - DNA, 25 bp, Mus musculus
gagggagggacatggcaagctgaaa

SEQ ID NO: 489952 - DNA, 25 bp, Mus musculus
gagggagggcagactccattttaca

SEQ ID NO: 489953 - DNA, 25 bp, Mus musculus
gagggagggcagtctccattttaca

SEQ ID NO: 489954 - DNA, 25 bp, Mus musculus
gagggagggtcacctctcctgctcc

SEQ ID NO: 489955 - DNA, 25 bp, Mus musculus
gagggagggtcagctctcctgctcc

SEQ ID NO: 489956 - DNA, 25 bp, Mus musculus
gagggagggtttctctcccaacgct

SEQ ID NO: 489957 - DNA, 25 bp, Mus musculus
gagggagggtttgtctcccaacgct

SEQ ID NO: 489958 - DNA, 25 bp, Mus musculus
gagggagtatggagccactttgacc

SEQ ID NO: 489959 - DNA, 25 bp, Mus musculus
gagggagtatggtgccactttgacc

SEQ ID NO: 489960 - DNA, 25 bp, Mus musculus
gagggagtcacacgcccaggcatac

SEQ ID NO: 489961 - DNA, 25 bp, Mus musculus
gagggagtcacaggcccaggcatac

SEQ ID NO: 489962 - DNA, 25 bp, Mus musculus
gagggagtcactcaagttacacgct

SEQ ID NO: 489963 - DNA, 25 bp, Mus musculus
gagggagtcactgaagttacacgct

SEQ ID NO: 489964 - DNA, 25 bp, Mus musculus
gagggagtcagccacagtcacctgc

SEQ ID NO: 489965 - DNA, 25 bp, Mus musculus
gagggagtcagcgacagtcacctgc

SEQ ID NO: 489966 - DNA, 25 bp, Mus musculus
gagggagtccaacatcattcacatg

SEQ ID NO: 489967 - DNA, 25 bp, Mus musculus
gagggagtccaagatcattcacatg

SEQ ID NO: 489968 - DNA, 25 bp, Mus musculus
gagggagtcctcagtctagcataga

SEQ ID NO: 489969 - DNA, 25 bp, Mus musculus
gagggagtcctctgtctagcataga

SEQ ID NO: 489970 - DNA, 25 bp, Mus musculus
gagggagtctcgcagctcgccatct

SEQ ID NO: 489971 - DNA, 25 bp, Mus musculus
gagggagtctcggagctcgccatct

SEQ ID NO: 489972 - DNA, 25 bp, Mus musculus
gagggagtctgcagcccactatgaa

SEQ ID NO: 489973 - DNA, 25 bp, Mus musculus
gagggagtctgctgcccactatgaa

SEQ ID NO: 489974 - DNA, 25 bp, Mus musculus
gagggagtcttacttttcaccgtag

SEQ ID NO: 489975 - DNA, 25 bp, Mus musculus
gagggagtcttagttttcaccgtag

SEQ ID NO: 489976 - DNA, 25 bp, Mus musculus
gagggagtggccattcctagaacct

SEQ ID NO: 489977 - DNA, 25 bp, Mus musculus
gagggagtggcctttcctagaacct

SEQ ID NO: 489978 - DNA, 25 bp, Mus musculus
gagggagtgttgcacgcactatcaa

SEQ ID NO: 489979 - DNA, 25 bp, Mus musculus
gagggagtgttggacgcactatcaa

SEQ ID NO: 489980 - DNA, 25 bp, Mus musculus
gagggagttcaacattctccataat

SEQ ID NO: 489981 - DNA, 25 bp, Mus musculus
gagggagttcaagattctccataat

SEQ ID NO: 489982 - DNA, 25 bp, Mus musculus
gagggagttcacagtctcatggagt

SEQ ID NO: 489983 - DNA, 25 bp, Mus musculus
gagggagttcactgtctcatggagt

SEQ ID NO: 489984 - DNA, 25 bp, Mus musculus
gagggagttcatcccgccagggctc

SEQ ID NO: 489985 - DNA, 25 bp, Mus musculus
gagggagttcatgccgccagggctc

SEQ ID NO: 489986 - DNA, 25 bp, Mus musculus
gagggagttctcactgtcagttgga

SEQ ID NO: 489987 - DNA, 25 bp, Mus musculus
gagggagttctctctgtcagttgga

SEQ ID NO: 489988 - DNA, 25 bp, Mus musculus
gagggagttctgatccatgtgcaga

SEQ ID NO: 489989 - DNA, 25 bp, Mus musculus
gagggagttctgttccatgtgcaga

SEQ ID NO: 489990 - DNA, 25 bp, Mus musculus
gagggataccagaccccagaacaga

SEQ ID NO: 489991 - DNA, 25 bp, Mus musculus
gagggataccagtccccagaacaga

SEQ ID NO: 489992 - DNA, 25 bp, Mus musculus
gagggatacctaattcacgttgggt

SEQ ID NO: 489993 - DNA, 25 bp, Mus musculus
gagggatacctatttcacgttgggt

SEQ ID NO: 489994 - DNA, 25 bp, Mus musculus
gagggatacctcagatttttctttt

SEQ ID NO: 489995 - DNA, 25 bp, Mus musculus
gagggatacctctgatttttctttt

SEQ ID NO: 489996 - DNA, 25 bp, Mus musculus
gagggatacgatccccacaaccgag

SEQ ID NO: 489997 - DNA, 25 bp, Mus musculus
gagggatacgatgcccacaaccgag

SEQ ID NO: 489998 - DNA, 25 bp, Mus musculus
gagggatacttcacttgtatataag

SEQ ID NO: 489999 - DNA, 25 bp, Mus musculus
gagggatacttctcttgtatataag

SEQ ID NO: 490000 - DNA, 25 bp, Mus musculus
gagggataggccattccttgtgctg

SEQ ID NO: 490001 - DNA, 25 bp, Mus musculus
gagggataggcctttccttgtgctg

SEQ ID NO: 490002 - DNA, 25 bp, Mus musculus
gagggatatagtagcctaccctaat

SEQ ID NO: 490003 - DNA, 25 bp, Mus musculus
gagggatatagttgcctaccctaat

SEQ ID NO: 490004 - DNA, 25 bp, Mus musculus
gagggatatctactccacagtcatc

SEQ ID NO: 490005 - DNA, 25 bp, Mus musculus
gagggatatctagtccacagtcatc

SEQ ID NO: 490006 - DNA, 25 bp, Mus musculus
gagggatatggtcgctaccttgatc

SEQ ID NO: 490007 - DNA, 25 bp, Mus musculus
gagggatatggtggctaccttgatc

SEQ ID NO: 490008 - DNA, 25 bp, Mus musculus
gagggatattaacctttaccacact

SEQ ID NO: 490009 - DNA, 25 bp, Mus musculus
gagggatattaagctttaccacact

SEQ ID NO: 490010 - DNA, 25 bp, Mus musculus
gagggatcaatcaccatggaacagt

SEQ ID NO: 490011 - DNA, 25 bp, Mus musculus
gagggatcaatctccatggaacagt

SEQ ID NO: 490012 - DNA, 25 bp, Mus musculus
gagggatccactagctgcctgagag

SEQ ID NO: 490013 - DNA, 25 bp, Mus musculus
gagggatccacttgctgcctgagag

SEQ ID NO: 490014 - DNA, 25 bp, Mus musculus
gagggatccatacagcattttgcgt

SEQ ID NO: 490015 - DNA, 25 bp, Mus musculus
gagggatccatagagcattttgcgt

SEQ ID NO: 490016 - DNA, 25 bp, Mus musculus
gagggatccattaaaacactaccgt

SEQ ID NO: 490017 - DNA, 25 bp, Mus musculus
gagggatccatttaaacactaccgt

SEQ ID NO: 490018 - DNA, 25 bp, Mus musculus
gagggatcccagaacgatgccaagt

SEQ ID NO: 490019 - DNA, 25 bp, Mus musculus
gagggatcccagtacgatgccaagt

SEQ ID NO: 490020 - DNA, 25 bp, Mus musculus
gagggatcccatataaagcattaca

SEQ ID NO: 490021 - DNA, 25 bp, Mus musculus
gagggatcccatttaaagcattaca

SEQ ID NO: 490022 - DNA, 25 bp, Mus musculus
gagggatcctataggacccgcctga

SEQ ID NO: 490023 - DNA, 25 bp, Mus musculus
gagggatcctattggacccgcctga

SEQ ID NO: 490024 - DNA, 25 bp, Mus musculus
gagggatcctcaagtctttcatgac

SEQ ID NO: 490025 - DNA, 25 bp, Mus musculus
gagggatcctcatgtctttcatgac

SEQ ID NO: 490026 - DNA, 25 bp, Mus musculus
gagggatcctctagcgggacagtcc

SEQ ID NO: 490027 - DNA, 25 bp, Mus musculus
gagggatcctctcaactagatcctt

SEQ ID NO: 490028 - DNA, 25 bp, Mus musculus
gagggatcctctgaactagatcctt

SEQ ID NO: 490029 - DNA, 25 bp, Mus musculus
gagggatcctcttgcgggacagtcc

SEQ ID NO: 490030 - DNA, 25 bp, Mus musculus
gagggatcctggcagccctttgcct

SEQ ID NO: 490031 - DNA, 25 bp, Mus musculus
gagggatcctgggagccctttgcct

SEQ ID NO: 490032 - DNA, 25 bp, Mus musculus
gagggatccttacggtaccatgacc

SEQ ID NO: 490033 - DNA, 25 bp, Mus musculus
gagggatccttagggtaccatgacc

SEQ ID NO: 490034 - DNA, 25 bp, Mus musculus
gagggatcggtgaattcccatacat

SEQ ID NO: 490035 - DNA, 25 bp, Mus musculus
gagggatcggtgtattcccatacat

SEQ ID NO: 490036 - DNA, 25 bp, Mus musculus
gagggatcgtgtaagtttcctatca

SEQ ID NO: 490037 - DNA, 25 bp, Mus musculus
gagggatcgtgttagtttcctatca

SEQ ID NO: 490038 - DNA, 25 bp, Mus musculus
gagggatctagtctgccagcgttca

SEQ ID NO: 490039 - DNA, 25 bp, Mus musculus
gagggatctagtgtgccagcgttca

SEQ ID NO: 490040 - DNA, 25 bp, Mus musculus
gagggatctctcagttgtgtatatc

SEQ ID NO: 490041 - DNA, 25 bp, Mus musculus
gagggatctctctgttgtgtatatc

SEQ ID NO: 490042 - DNA, 25 bp, Mus musculus
gagggatctgtaagtgctatggttt

SEQ ID NO: 490043 - DNA, 25 bp, Mus musculus
gagggatctgtatgtgctatggttt

SEQ ID NO: 490044 - DNA, 25 bp, Mus musculus
gagggatgaactccagtctccagga

SEQ ID NO: 490045 - DNA, 25 bp, Mus musculus
gagggatgaactgcagtctccagga

SEQ ID NO: 490046 - DNA, 25 bp, Mus musculus
gagggatgacaccagaacaccacag

SEQ ID NO: 490047 - DNA, 25 bp, Mus musculus
gagggatgacacgagaacaccacag

SEQ ID NO: 490048 - DNA, 25 bp, Mus musculus
gagggatgaggcccctcccgcatca

SEQ ID NO: 490049 - DNA, 25 bp, Mus musculus
gagggatgaggcgcctcccgcatca

SEQ ID NO: 490050 - DNA, 25 bp, Mus musculus
gagggatgagtacctgcctccacac

SEQ ID NO: 490051 - DNA, 25 bp, Mus musculus
gagggatgagtagctgcctccacac

SEQ ID NO: 490052 - DNA, 25 bp, Mus musculus
gagggatgcaagagcctggcaactc

SEQ ID NO: 490053 - DNA, 25 bp, Mus musculus
gagggatgcaagtgcctggcaactc

SEQ ID NO: 490054 - DNA, 25 bp, Mus musculus
gagggatgcgaaactccaaaaaaca

SEQ ID NO: 490055 - DNA, 25 bp, Mus musculus
gagggatgcgaatctccaaaaaaca

SEQ ID NO: 490056 - DNA, 25 bp, Mus musculus
gagggatgctctcgctggttaccac

SEQ ID NO: 490057 - DNA, 25 bp, Mus musculus
gagggatgctctggctggttaccac

SEQ ID NO: 490058 - DNA, 25 bp, Mus musculus
gagggatgcttcatagacatcttta

SEQ ID NO: 490059 - DNA, 25 bp, Mus musculus
gagggatgcttcttagacatcttta

SEQ ID NO: 490060 - DNA, 25 bp, Mus musculus
gagggatgggccatcatgttttctc

SEQ ID NO: 490061 - DNA, 25 bp, Mus musculus
gagggatgggccttcatgttttctc

SEQ ID NO: 490062 - DNA, 25 bp, Mus musculus
gagggatggtgtaatctaagagttt

SEQ ID NO: 490063 - DNA, 25 bp, Mus musculus
gagggatggtgttatctaagagttt

SEQ ID NO: 490064 - DNA, 25 bp, Mus musculus
gagggatgtatcaaacagcactaat

SEQ ID NO: 490065 - DNA, 25 bp, Mus musculus
gagggatgtatctaacagcactaat

SEQ ID NO: 490066 - DNA, 25 bp, Mus musculus
gagggatgtctaaacatgactttct

SEQ ID NO: 490067 - DNA, 25 bp, Mus musculus
gagggatgtctatacatgactttct

SEQ ID NO: 490068 - DNA, 25 bp, Mus musculus
gagggatgtgctagacctagttttt

SEQ ID NO: 490069 - DNA, 25 bp, Mus musculus
gagggatgtgcttgacctagttttt

SEQ ID NO: 490070 - DNA, 25 bp, Mus musculus
gagggatgttggacagagcccattt

SEQ ID NO: 490071 - DNA, 25 bp, Mus musculus
gagggatgttggtcagagcccattt

SEQ ID NO: 490072 - DNA, 25 bp, Mus musculus
gagggattcaataactcctgatata

SEQ ID NO: 490073 - DNA, 25 bp, Mus musculus
gagggattcaattactcctgatata

SEQ ID NO: 490074 - DNA, 25 bp, Mus musculus
gagggattcaggctcagccgtaact

SEQ ID NO: 490075 - DNA, 25 bp, Mus musculus
gagggattcagggtcagccgtaact

SEQ ID NO: 490076 - DNA, 25 bp, Mus musculus
gagggattcctcagacgactgtatg

SEQ ID NO: 490077 - DNA, 25 bp, Mus musculus
gagggattcctctgacgactgtatg

SEQ ID NO: 490078 - DNA, 25 bp, Mus musculus
gagggattccttattgcttaggctt

SEQ ID NO: 490079 - DNA, 25 bp, Mus musculus
gagggattcctttttgcttaggctt

SEQ ID NO: 490080 - DNA, 25 bp, Mus musculus
gagggattctccatttgggttccat

SEQ ID NO: 490081 - DNA, 25 bp, Mus musculus
gagggattctccttttgggttccat

SEQ ID NO: 490082 - DNA, 25 bp, Mus musculus
gagggatttaaacacccagctctct

SEQ ID NO: 490083 - DNA, 25 bp, Mus musculus
gagggatttaaagacccagctctct

SEQ ID NO: 490084 - DNA, 25 bp, Mus musculus
gagggatttccacactgtacgctga

SEQ ID NO: 490085 - DNA, 25 bp, Mus musculus
gagggatttccagactgtacgctga

SEQ ID NO: 490086 - DNA, 25 bp, Mus musculus
gagggatttcccacaagctttcgtt

SEQ ID NO: 490087 - DNA, 25 bp, Mus musculus
gagggatttccctcaagctttcgtt

SEQ ID NO: 490088 - DNA, 25 bp, Mus musculus
gagggatttcttaaaggccggcaga

SEQ ID NO: 490089 - DNA, 25 bp, Mus musculus
gagggatttctttaaggccggcaga

SEQ ID NO: 490090 - DNA, 25 bp, Mus musculus
gagggatttgtcacccatcatgtgc

SEQ ID NO: 490091 - DNA, 25 bp, Mus musculus
gagggatttgtctcccatcatgtgc

SEQ ID NO: 490092 - DNA, 25 bp, Mus musculus
gagggattttccatgatctaattga

SEQ ID NO: 490093 - DNA, 25 bp, Mus musculus
gagggattttccttgatctaattga

SEQ ID NO: 490094 - DNA, 25 bp, Mus musculus
gagggattttttccactctataaag

SEQ ID NO: 490095 - DNA, 25 bp, Mus musculus
gagggattttttgcactctataaag

SEQ ID NO: 490096 - DNA, 25 bp, Mus musculus
gagggcaaaatccttttctatattt

SEQ ID NO: 490097 - DNA, 25 bp, Mus musculus
gagggcaaaatcgttttctatattt

SEQ ID NO: 490098 - DNA, 25 bp, Mus musculus
gagggcaaagacattccttttgtgg

SEQ ID NO: 490099 - DNA, 25 bp, Mus musculus
gagggcaaagactttccttttgtgg

SEQ ID NO: 490100 - DNA, 25 bp, Mus musculus
gagggcaaattacccttcatttcca

SEQ ID NO: 490101 - DNA, 25 bp, Mus musculus
gagggcaaattagccttcatttcca

SEQ ID NO: 490102 - DNA, 25 bp, Mus musculus
gagggcaacagtcttaacaggcgta

SEQ ID NO: 490103 - DNA, 25 bp, Mus musculus
gagggcaacagtgttaacaggcgta

SEQ ID NO: 490104 - DNA, 25 bp, Mus musculus
gagggcaacccaaagagagggctct

SEQ ID NO: 490105 - DNA, 25 bp, Mus musculus
gagggcaacccatagagagggctct

SEQ ID NO: 490106 - DNA, 25 bp, Mus musculus
gagggcaacgcgaacactgaggaac

SEQ ID NO: 490107 - DNA, 25 bp, Mus musculus
gagggcaacgcgtacactgaggaac

SEQ ID NO: 490108 - DNA, 25 bp, Mus musculus
gagggcaacggcaacactgtatcca

SEQ ID NO: 490109 - DNA, 25 bp, Mus musculus
gagggcaacggctacactgtatcca

SEQ ID NO: 490110 - DNA, 25 bp, Mus musculus
gagggcaactggatcgatgaagcaa

SEQ ID NO: 490111 - DNA, 25 bp, Mus musculus
gagggcaactggttcgatgaagcaa

SEQ ID NO: 490112 - DNA, 25 bp, Mus musculus
gagggcaacttgacgtgtttaagaa

SEQ ID NO: 490113 - DNA, 25 bp, Mus musculus
gagggcaacttgtcgtgtttaagaa

SEQ ID NO: 490114 - DNA, 25 bp, Mus musculus
gagggcaagcttcctgcaaaacgct

SEQ ID NO: 490115 - DNA, 25 bp, Mus musculus
gagggcaagcttgctgcaaaacgct

SEQ ID NO: 490116 - DNA, 25 bp, Mus musculus
gagggcaatctactgaagctactga

SEQ ID NO: 490117 - DNA, 25 bp, Mus musculus
gagggcaatctagtgaagctactga

SEQ ID NO: 490118 - DNA, 25 bp, Mus musculus
gagggcaattacatgctgacgtgct

SEQ ID NO: 490119 - DNA, 25 bp, Mus musculus
gagggcaattacttgctgacgtgct

SEQ ID NO: 490120 - DNA, 25 bp, Mus musculus
gagggcaattccctcatcgtaggga

SEQ ID NO: 490121 - DNA, 25 bp, Mus musculus
gagggcaattccgtcatcgtaggga

SEQ ID NO: 490122 - DNA, 25 bp, Mus musculus
gagggcaatttaattctggcttttg

SEQ ID NO: 490123 - DNA, 25 bp, Mus musculus
gagggcaatttatttctggcttttg

SEQ ID NO: 490124 - DNA, 25 bp, Mus musculus
gagggcacaaaaccatctgttcctg

SEQ ID NO: 490125 - DNA, 25 bp, Mus musculus
gagggcacaaaagcatctgttcctg

SEQ ID NO: 490126 - DNA, 25 bp, Mus musculus
gagggcacaaagatttccactgaat

SEQ ID NO: 490127 - DNA, 25 bp, Mus musculus
gagggcacaaagttttccactgaat

SEQ ID NO: 490128 - DNA, 25 bp, Mus musculus
gagggcacacagaacttgtctttta

SEQ ID NO: 490129 - DNA, 25 bp, Mus musculus
gagggcacacagtacttgtctttta

SEQ ID NO: 490130 - DNA, 25 bp, Mus musculus
gagggcacacccatctgaatccagt

SEQ ID NO: 490131 - DNA, 25 bp, Mus musculus
gagggcacacccttctgaatccagt

SEQ ID NO: 490132 - DNA, 25 bp, Mus musculus
gagggcacactgaatgtcataaatt

SEQ ID NO: 490133 - DNA, 25 bp, Mus musculus
gagggcacactgtatgtcataaatt

SEQ ID NO: 490134 - DNA, 25 bp, Mus musculus
gagggcacagcaatagatcttagtt

SEQ ID NO: 490135 - DNA, 25 bp, Mus musculus
gagggcacagcattagatcttagtt

SEQ ID NO: 490136 - DNA, 25 bp, Mus musculus
gagggcacaggcaagaagattcaca

SEQ ID NO: 490137 - DNA, 25 bp, Mus musculus
gagggcacaggctagaagattcaca

SEQ ID NO: 490138 - DNA, 25 bp, Mus musculus
gagggcacaggtcacagttatacaa

SEQ ID NO: 490139 - DNA, 25 bp, Mus musculus
gagggcacaggtgacagttatacaa

SEQ ID NO: 490140 - DNA, 25 bp, Mus musculus
gagggcacatgacttctttctggca

SEQ ID NO: 490141 - DNA, 25 bp, Mus musculus
gagggcacatgagttctttctggca

SEQ ID NO: 490142 - DNA, 25 bp, Mus musculus
gagggcaccagacctcccggaactg

SEQ ID NO: 490143 - DNA, 25 bp, Mus musculus
gagggcaccagagctcccggaactg

SEQ ID NO: 490144 - DNA, 25 bp, Mus musculus
gagggcaccagcacatgggtgtctt

SEQ ID NO: 490145 - DNA, 25 bp, Mus musculus
gagggcaccagctcatgggtgtctt

SEQ ID NO: 490146 - DNA, 25 bp, Mus musculus
gagggcacccacagtgcatcactaa

SEQ ID NO: 490147 - DNA, 25 bp, Mus musculus
gagggcacccactgtgcatcactaa

SEQ ID NO: 490148 - DNA, 25 bp, Mus musculus
gagggcacccggaacatcgtgacag

SEQ ID NO: 490149 - DNA, 25 bp, Mus musculus
gagggcacccggcattcagatgaaa

SEQ ID NO: 490150 - DNA, 25 bp, Mus musculus
gagggcacccgggattcagatgaaa

SEQ ID NO: 490151 - DNA, 25 bp, Mus musculus
gagggcacccggtacatcgtgacag

SEQ ID NO: 490152 - DNA, 25 bp, Mus musculus
gagggcacccttactagtttgtaga

SEQ ID NO: 490153 - DNA, 25 bp, Mus musculus
gagggcaccctttctagtttgtaga

SEQ ID NO: 490154 - DNA, 25 bp, Mus musculus
gagggcaccttaatggagctctgca

SEQ ID NO: 490155 - DNA, 25 bp, Mus musculus
gagggcaccttattggagctctgca

SEQ ID NO: 490156 - DNA, 25 bp, Mus musculus
gagggcacgcctagaacacggtgtc

SEQ ID NO: 490157 - DNA, 25 bp, Mus musculus
gagggcacgccttgaacacggtgtc

SEQ ID NO: 490158 - DNA, 25 bp, Mus musculus
gagggcactgggaaccttagcagca

SEQ ID NO: 490159 - DNA, 25 bp, Mus musculus
gagggcactgggtaccttagcagca

SEQ ID NO: 490160 - DNA, 25 bp, Mus musculus
gagggcagaaacctcattcctttct

SEQ ID NO: 490161 - DNA, 25 bp, Mus musculus
gagggcagaaacgtcattcctttct

SEQ ID NO: 490162 - DNA, 25 bp, Mus musculus
gagggcagacagcttggactcttca

SEQ ID NO: 490163 - DNA, 25 bp, Mus musculus
gagggcagacaggttggactcttca

SEQ ID NO: 490164 - DNA, 25 bp, Mus musculus
gagggcagacatcactggacgatac

SEQ ID NO: 490165 - DNA, 25 bp, Mus musculus
gagggcagacatgactggacgatac

SEQ ID NO: 490166 - DNA, 25 bp, Mus musculus
gagggcagaccacagtacatctctt

SEQ ID NO: 490167 - DNA, 25 bp, Mus musculus
gagggcagaccagagtacatctctt

SEQ ID NO: 490168 - DNA, 25 bp, Mus musculus
gagggcagactgacaaggacttcct

SEQ ID NO: 490169 - DNA, 25 bp, Mus musculus
gagggcagactgtcaaggacttcct

SEQ ID NO: 490170 - DNA, 25 bp, Mus musculus
gagggcagagatagcaaaccaagtc

SEQ ID NO: 490171 - DNA, 25 bp, Mus musculus
gagggcagagattgcaaaccaagtc

SEQ ID NO: 490172 - DNA, 25 bp, Mus musculus
gagggcagatacctaactcaggaaa

SEQ ID NO: 490173 - DNA, 25 bp, Mus musculus
gagggcagatacgtaactcaggaaa

SEQ ID NO: 490174 - DNA, 25 bp, Mus musculus
gagggcagatatcctggacccagtt

SEQ ID NO: 490175 - DNA, 25 bp, Mus musculus
gagggcagatatgctggacccagtt

SEQ ID NO: 490176 - DNA, 25 bp, Mus musculus
gagggcagatgtcacttgaaaagca

SEQ ID NO: 490177 - DNA, 25 bp, Mus musculus
gagggcagatgtgacttgaaaagca

SEQ ID NO: 490178 - DNA, 25 bp, Mus musculus
gagggcagattcaccctgaaaccat

SEQ ID NO: 490179 - DNA, 25 bp, Mus musculus
gagggcagattctccctgaaaccat

SEQ ID NO: 490180 - DNA, 25 bp, Mus musculus
gagggcagattgctgagtatctaac

SEQ ID NO: 490181 - DNA, 25 bp, Mus musculus
gagggcagattggtgagtatctaac

SEQ ID NO: 490182 - DNA, 25 bp, Mus musculus
gagggcagcactcagcagacttcct

SEQ ID NO: 490183 - DNA, 25 bp, Mus musculus
gagggcagcactgagcagacttcct

SEQ ID NO: 490184 - DNA, 25 bp, Mus musculus
gagggcagccccatgatggctctgt

SEQ ID NO: 490185 - DNA, 25 bp, Mus musculus
gagggcagccccttgatggctctgt

SEQ ID NO: 490186 - DNA, 25 bp, Mus musculus
gagggcagcctacactacctagcaa

SEQ ID NO: 490187 - DNA, 25 bp, Mus musculus
gagggcagcctagactacctagcaa

SEQ ID NO: 490188 - DNA, 25 bp, Mus musculus
gagggcagcgccaccctgcttgcag

SEQ ID NO: 490189 - DNA, 25 bp, Mus musculus
gagggcagcgcctccctgcttgcag

SEQ ID NO: 490190 - DNA, 25 bp, Mus musculus
gagggcagctcgagccaccaaagaa

SEQ ID NO: 490191 - DNA, 25 bp, Mus musculus
gagggcagctcgtgccaccaaagaa

SEQ ID NO: 490192 - DNA, 25 bp, Mus musculus
gagggcagctgaattacttttgttg

SEQ ID NO: 490193 - DNA, 25 bp, Mus musculus
gagggcagctgatttacttttgttg

SEQ ID NO: 490194 - DNA, 25 bp, Mus musculus
gagggcagcttgagagactttccca

SEQ ID NO: 490195 - DNA, 25 bp, Mus musculus
gagggcagcttgtgagactttccca

SEQ ID NO: 490196 - DNA, 25 bp, Mus musculus
gagggcaggagcagtcacaccctag

SEQ ID NO: 490197 - DNA, 25 bp, Mus musculus
gagggcaggagctgtcacaccctag

SEQ ID NO: 490198 - DNA, 25 bp, Mus musculus
gagggcaggattcttatttacattc

SEQ ID NO: 490199 - DNA, 25 bp, Mus musculus
gagggcaggattgttatttacattc

SEQ ID NO: 490200 - DNA, 25 bp, Mus musculus
gagggcaggctgagataaacagttt

SEQ ID NO: 490201 - DNA, 25 bp, Mus musculus
gagggcaggctgtgataaacagttt

SEQ ID NO: 490202 - DNA, 25 bp, Mus musculus
gagggcagggaaatgtccccttgct

SEQ ID NO: 490203 - DNA, 25 bp, Mus musculus
gagggcagggaattgtccccttgct

SEQ ID NO: 490204 - DNA, 25 bp, Mus musculus
gagggcagggcacaccttgtttaca

SEQ ID NO: 490205 - DNA, 25 bp, Mus musculus
gagggcagggcagaccttgtttaca

SEQ ID NO: 490206 - DNA, 25 bp, Mus musculus
gagggcagggccaaagcaccataca

SEQ ID NO: 490207 - DNA, 25 bp, Mus musculus
gagggcagggccacttctcgtcgtc

SEQ ID NO: 490208 - DNA, 25 bp, Mus musculus
gagggcagggcctaagcaccataca

SEQ ID NO: 490209 - DNA, 25 bp, Mus musculus
gagggcagggcctcttctcgtcgtc

SEQ ID NO: 490210 - DNA, 25 bp, Mus musculus
gagggcaggtccaaagccttcagca

SEQ ID NO: 490211 - DNA, 25 bp, Mus musculus
gagggcaggtcctaagccttcagca

SEQ ID NO: 490212 - DNA, 25 bp, Mus musculus
gagggcaggtttatatccaaggacc

SEQ ID NO: 490213 - DNA, 25 bp, Mus musculus
gagggcaggtttttatccaaggacc

SEQ ID NO: 490214 - DNA, 25 bp, Mus musculus
gagggcagtaaaacttccgctacgg

SEQ ID NO: 490215 - DNA, 25 bp, Mus musculus
gagggcagtaaatcttccgctacgg

SEQ ID NO: 490216 - DNA, 25 bp, Mus musculus
gagggcagtactcataactcatgta

SEQ ID NO: 490217 - DNA, 25 bp, Mus musculus
gagggcagtactgataactcatgta

SEQ ID NO: 490218 - DNA, 25 bp, Mus musculus
gagggcagtctgatacatttcatct

SEQ ID NO: 490219 - DNA, 25 bp, Mus musculus
gagggcagtctgttacatttcatct

SEQ ID NO: 490220 - DNA, 25 bp, Mus musculus
gagggcagtcttccttgtaactata

SEQ ID NO: 490221 - DNA, 25 bp, Mus musculus
gagggcagtcttgcttgtaactata

SEQ ID NO: 490222 - DNA, 25 bp, Mus musculus
gagggcagtgaacaccatcctggac

SEQ ID NO: 490223 - DNA, 25 bp, Mus musculus
gagggcagtgaagaccatcctggac

SEQ ID NO: 490224 - DNA, 25 bp, Mus musculus
gagggcagtgaccttcccttctgtg

SEQ ID NO: 490225 - DNA, 25 bp, Mus musculus
gagggcagtgacgttcccttctgtg

SEQ ID NO: 490226 - DNA, 25 bp, Mus musculus
gagggcagtgccagggcagcccaaa

SEQ ID NO: 490227 - DNA, 25 bp, Mus musculus
gagggcagtgcctgggcagcccaaa

SEQ ID NO: 490228 - DNA, 25 bp, Mus musculus
gagggcagttccattcatatgcttc

SEQ ID NO: 490229 - DNA, 25 bp, Mus musculus
gagggcagttcctttcatatgcttc

SEQ ID NO: 490230 - DNA, 25 bp, Mus musculus
gagggcatacaacttccaggcctgt

SEQ ID NO: 490231 - DNA, 25 bp, Mus musculus
gagggcatacaagttccaggcctgt

SEQ ID NO: 490232 - DNA, 25 bp, Mus musculus
gagggcatagttctccagagcgtca

SEQ ID NO: 490233 - DNA, 25 bp, Mus musculus
gagggcatagttgtccagagcgtca

SEQ ID NO: 490234 - DNA, 25 bp, Mus musculus
gagggcatatttatgcacacatgta

SEQ ID NO: 490235 - DNA, 25 bp, Mus musculus
gagggcatatttttgcacacatgta

SEQ ID NO: 490236 - DNA, 25 bp, Mus musculus
gagggcatcaagcaacttaaccagc

SEQ ID NO: 490237 - DNA, 25 bp, Mus musculus
gagggcatcaagcacttcttcagca

SEQ ID NO: 490238 - DNA, 25 bp, Mus musculus
gagggcatcaaggaacttaaccagc

SEQ ID NO: 490239 - DNA, 25 bp, Mus musculus
gagggcatcaaggacttcttcagca

SEQ ID NO: 490240 - DNA, 25 bp, Mus musculus
gagggcatcacaaactgagctttta

SEQ ID NO: 490241 - DNA, 25 bp, Mus musculus
gagggcatcacatactgagctttta

SEQ ID NO: 490242 - DNA, 25 bp, Mus musculus
gagggcatcaggactgttcactgca

SEQ ID NO: 490243 - DNA, 25 bp, Mus musculus
gagggcatcaggtctgttcactgca

SEQ ID NO: 490244 - DNA, 25 bp, Mus musculus
gagggcatcagtaatattcagtgtg

SEQ ID NO: 490245 - DNA, 25 bp, Mus musculus
gagggcatcagttatattcagtgtg

SEQ ID NO: 490246 - DNA, 25 bp, Mus musculus
gagggcatccgtatgctaagcagac

SEQ ID NO: 490247 - DNA, 25 bp, Mus musculus
gagggcatccgtttgctaagcagac

SEQ ID NO: 490248 - DNA, 25 bp, Mus musculus
gagggcatcgacatactcatgacac

SEQ ID NO: 490249 - DNA, 25 bp, Mus musculus
gagggcatcgacttactcatgacac

SEQ ID NO: 490250 - DNA, 25 bp, Mus musculus
gagggcatcgtccacagactcagag

SEQ ID NO: 490251 - DNA, 25 bp, Mus musculus
gagggcatcgtcgacagactcagag

SEQ ID NO: 490252 - DNA, 25 bp, Mus musculus
gagggcatctccctgatgccaggat

SEQ ID NO: 490253 - DNA, 25 bp, Mus musculus
gagggcatctccgtgatgccaggat

SEQ ID NO: 490254 - DNA, 25 bp, Mus musculus
gagggcatctctcaccctgaagcag

SEQ ID NO: 490255 - DNA, 25 bp, Mus musculus
gagggcatctctgaccctgaagcag

SEQ ID NO: 490256 - DNA, 25 bp, Mus musculus
gagggcatctgtcgcaccaacaggt

SEQ ID NO: 490257 - DNA, 25 bp, Mus musculus
gagggcatctgtggcaccaacaggt

SEQ ID NO: 490258 - DNA, 25 bp, Mus musculus
gagggcatgaagatgctgctcttaa

SEQ ID NO: 490259 - DNA, 25 bp, Mus musculus
gagggcatgaagttgctgctcttaa

SEQ ID NO: 490260 - DNA, 25 bp, Mus musculus
gagggcatgaggcattgtcacccca

SEQ ID NO: 490261 - DNA, 25 bp, Mus musculus
gagggcatgagggattgtcacccca

SEQ ID NO: 490262 - DNA, 25 bp, Mus musculus
gagggcatgggacccaacattccta

SEQ ID NO: 490263 - DNA, 25 bp, Mus musculus
gagggcatgggagccaacattccta

SEQ ID NO: 490264 - DNA, 25 bp, Mus musculus
gagggcattatgagctgtaccccag

SEQ ID NO: 490265 - DNA, 25 bp, Mus musculus
gagggcattatgtgctgtaccccag

SEQ ID NO: 490266 - DNA, 25 bp, Mus musculus
gagggcattcccatgcacaagggtg

SEQ ID NO: 490267 - DNA, 25 bp, Mus musculus
gagggcattcccttgcacaagggtg

SEQ ID NO: 490268 - DNA, 25 bp, Mus musculus
gagggcattgaaacagctatgtctt

SEQ ID NO: 490269 - DNA, 25 bp, Mus musculus
gagggcattgaatcagctatgtctt

SEQ ID NO: 490270 - DNA, 25 bp, Mus musculus
gagggcattgtgagcaattccatca

SEQ ID NO: 490271 - DNA, 25 bp, Mus musculus
gagggcattgtgtgcaattccatca

SEQ ID NO: 490272 - DNA, 25 bp, Mus musculus
gagggcatttcaaaagctacaacag

SEQ ID NO: 490273 - DNA, 25 bp, Mus musculus
gagggcatttcacatcttatcgata

SEQ ID NO: 490274 - DNA, 25 bp, Mus musculus
gagggcatttcagatcttatcgata

SEQ ID NO: 490275 - DNA, 25 bp, Mus musculus
gagggcatttcataagctacaacag

SEQ ID NO: 490276 - DNA, 25 bp, Mus musculus
gagggcattttgatgttttacgaca

SEQ ID NO: 490277 - DNA, 25 bp, Mus musculus
gagggcattttgttgttttacgaca

SEQ ID NO: 490278 - DNA, 25 bp, Mus musculus
gagggcatttttcacagacagtttg

SEQ ID NO: 490279 - DNA, 25 bp, Mus musculus
gagggcatttttgacagacagtttg

SEQ ID NO: 490280 - DNA, 25 bp, Mus musculus
gagggccaaaccagagacacagatc

SEQ ID NO: 490281 - DNA, 25 bp, Mus musculus
gagggccaaacctgagacacagatc

SEQ ID NO: 490282 - DNA, 25 bp, Mus musculus
gagggccaaagtatttcccatcaga

SEQ ID NO: 490283 - DNA, 25 bp, Mus musculus
gagggccaaagtttttcccatcaga

SEQ ID NO: 490284 - DNA, 25 bp, Mus musculus
gagggccaacacatgggcatgtatc

SEQ ID NO: 490285 - DNA, 25 bp, Mus musculus
gagggccaacacttgggcatgtatc

SEQ ID NO: 490286 - DNA, 25 bp, Mus musculus
gagggccaaggtccaccttccgtgt

SEQ ID NO: 490287 - DNA, 25 bp, Mus musculus
gagggccaaggtgcaccttccgtgt

SEQ ID NO: 490288 - DNA, 25 bp, Mus musculus
gagggccaagtacttcctgttgcca

SEQ ID NO: 490289 - DNA, 25 bp, Mus musculus
gagggccaagtagttcctgttgcca

SEQ ID NO: 490290 - DNA, 25 bp, Mus musculus
gagggccaagtgaaaatttcaaagt

SEQ ID NO: 490291 - DNA, 25 bp, Mus musculus
gagggccaagtgtaaatttcaaagt

SEQ ID NO: 490292 - DNA, 25 bp, Mus musculus
gagggccacactcgcaacatcagtt

SEQ ID NO: 490293 - DNA, 25 bp, Mus musculus
gagggccacactggcaacatcagtt

SEQ ID NO: 490294 - DNA, 25 bp, Mus musculus
gagggccaccttaggagccggcggc

SEQ ID NO: 490295 - DNA, 25 bp, Mus musculus
gagggccacctttggagccggcggc

SEQ ID NO: 490296 - DNA, 25 bp, Mus musculus
gagggccacggacaaagcacctgaa

SEQ ID NO: 490297 - DNA, 25 bp, Mus musculus
gagggccacggagaaagcacctgaa

SEQ ID NO: 490298 - DNA, 25 bp, Mus musculus
gagggccagcaccagggcattacaa

SEQ ID NO: 490299 - DNA, 25 bp, Mus musculus
gagggccagcacgagggcattacaa

SEQ ID NO: 490300 - DNA, 25 bp, Mus musculus
gagggccagcctatcaagagcagag

SEQ ID NO: 490301 - DNA, 25 bp, Mus musculus
gagggccagcctttcaagagcagag

SEQ ID NO: 490302 - DNA, 25 bp, Mus musculus
gagggccagcttcttcttagcagta

SEQ ID NO: 490303 - DNA, 25 bp, Mus musculus
gagggccagcttgttcttagcagta

SEQ ID NO: 490304 - DNA, 25 bp, Mus musculus
gagggccaggttagaagtcattgta

SEQ ID NO: 490305 - DNA, 25 bp, Mus musculus
gagggccaggtttgaagtcattgta

SEQ ID NO: 490306 - DNA, 25 bp, Mus musculus
gagggccagtggacgcgcttcccca

SEQ ID NO: 490307 - DNA, 25 bp, Mus musculus
gagggccagtggtcgcgcttcccca

SEQ ID NO: 490308 - DNA, 25 bp, Mus musculus
gagggccatatcatatctgtggaca

SEQ ID NO: 490309 - DNA, 25 bp, Mus musculus
gagggccatatcttatctgtggaca

SEQ ID NO: 490310 - DNA, 25 bp, Mus musculus
gagggccatctcattcacacaaaca

SEQ ID NO: 490311 - DNA, 25 bp, Mus musculus
gagggccatctctttcacacaaaca

SEQ ID NO: 490312 - DNA, 25 bp, Mus musculus
gagggccatcttaagtgggctcatg

SEQ ID NO: 490313 - DNA, 25 bp, Mus musculus
gagggccatctttagtgggctcatg

SEQ ID NO: 490314 - DNA, 25 bp, Mus musculus
gagggccatgctaacgaggaagact

SEQ ID NO: 490315 - DNA, 25 bp, Mus musculus
gagggccatgcttacgaggaagact

SEQ ID NO: 490316 - DNA, 25 bp, Mus musculus
gagggccatggaactcccagagttc

SEQ ID NO: 490317 - DNA, 25 bp, Mus musculus
gagggccatggatctcccagagttc

SEQ ID NO: 490318 - DNA, 25 bp, Mus musculus
gagggcccaagaaacatgcatcttt

SEQ ID NO: 490319 - DNA, 25 bp, Mus musculus
gagggcccaagacgactgtaccaaa

SEQ ID NO: 490320 - DNA, 25 bp, Mus musculus
gagggcccaagaggactgtaccaaa

SEQ ID NO: 490321 - DNA, 25 bp, Mus musculus
gagggcccaagatacatgcatcttt

SEQ ID NO: 490322 - DNA, 25 bp, Mus musculus
gagggcccaattcatttaggtgcat

SEQ ID NO: 490323 - DNA, 25 bp, Mus musculus
gagggcccaattgatttaggtgcat

SEQ ID NO: 490324 - DNA, 25 bp, Mus musculus
gagggcccactgagtgttgtctttt

SEQ ID NO: 490325 - DNA, 25 bp, Mus musculus
gagggcccactgtgtgttgtctttt

SEQ ID NO: 490326 - DNA, 25 bp, Mus musculus
gagggcccatttagtcatccagact

SEQ ID NO: 490327 - DNA, 25 bp, Mus musculus
gagggcccattttgtcatccagact

SEQ ID NO: 490328 - DNA, 25 bp, Mus musculus
gagggccccaaacaactggatcagg

SEQ ID NO: 490329 - DNA, 25 bp, Mus musculus
gagggccccaaagaactggatcagg

SEQ ID NO: 490330 - DNA, 25 bp, Mus musculus
gagggccccagtatggaggattcat

SEQ ID NO: 490331 - DNA, 25 bp, Mus musculus
gagggccccagtttggaggattcat

SEQ ID NO: 490332 - DNA, 25 bp, Mus musculus
gagggcccccacagtgcaggaaagc

SEQ ID NO: 490333 - DNA, 25 bp, Mus musculus
gagggcccccactgtgcaggaaagc

SEQ ID NO: 490334 - DNA, 25 bp, Mus musculus
gagggccccttcatgggagctagat

SEQ ID NO: 490335 - DNA, 25 bp, Mus musculus
gagggccccttcttgggagctagat

SEQ ID NO: 490336 - DNA, 25 bp, Mus musculus
gagggccctcgacggtcatatccaa

SEQ ID NO: 490337 - DNA, 25 bp, Mus musculus
gagggccctcgagggtcatatccaa

SEQ ID NO: 490338 - DNA, 25 bp, Mus musculus
gagggccctgtaagcacaagccttt

SEQ ID NO: 490339 - DNA, 25 bp, Mus musculus
gagggccctgtatgcacaagccttt

SEQ ID NO: 490340 - DNA, 25 bp, Mus musculus
gagggccctgtcagtactgtagaga

SEQ ID NO: 490341 - DNA, 25 bp, Mus musculus
gagggccctgtctgtactgtagaga

SEQ ID NO: 490342 - DNA, 25 bp, Mus musculus
gagggcccttacacttgggagaaat

SEQ ID NO: 490343 - DNA, 25 bp, Mus musculus
gagggcccttactcttgggagaaat

SEQ ID NO: 490344 - DNA, 25 bp, Mus musculus
gagggcccttcacgacctcacatat

SEQ ID NO: 490345 - DNA, 25 bp, Mus musculus
gagggcccttcaggacctcacatat

SEQ ID NO: 490346 - DNA, 25 bp, Mus musculus
gagggccctttaatgaatttgtagt

SEQ ID NO: 490347 - DNA, 25 bp, Mus musculus
gagggccctttattgaatttgtagt

SEQ ID NO: 490348 - DNA, 25 bp, Mus musculus
gagggccgagaaactttggcacagt

SEQ ID NO: 490349 - DNA, 25 bp, Mus musculus
gagggccgagaatctttggcacagt

SEQ ID NO: 490350 - DNA, 25 bp, Mus musculus
gagggccgaggcaacccaggatcta

SEQ ID NO: 490351 - DNA, 25 bp, Mus musculus
gagggccgaggctacccaggatcta

SEQ ID NO: 490352 - DNA, 25 bp, Mus musculus
gagggccggtgcattgcaaatcaac

SEQ ID NO: 490353 - DNA, 25 bp, Mus musculus
gagggccggtgctttgcaaatcaac

SEQ ID NO: 490354 - DNA, 25 bp, Mus musculus
gagggcctaagacctccttacaaaa

SEQ ID NO: 490355 - DNA, 25 bp, Mus musculus
gagggcctaagagctccttacaaaa

SEQ ID NO: 490356 - DNA, 25 bp, Mus musculus
gagggcctacacatgagaccttatt

SEQ ID NO: 490357 - DNA, 25 bp, Mus musculus
gagggcctacacttgagaccttatt

SEQ ID NO: 490358 - DNA, 25 bp, Mus musculus
gagggcctaggcctaccccctagag

SEQ ID NO: 490359 - DNA, 25 bp, Mus musculus
gagggcctaggcgtaccccctagag

SEQ ID NO: 490360 - DNA, 25 bp, Mus musculus
gagggcctatttcatcgggttccca

SEQ ID NO: 490361 - DNA, 25 bp, Mus musculus
gagggcctatttgatcgggttccca

SEQ ID NO: 490362 - DNA, 25 bp, Mus musculus
gagggcctcagcctttagaatacta

SEQ ID NO: 490363 - DNA, 25 bp, Mus musculus
gagggcctcagcgtttagaatacta

SEQ ID NO: 490364 - DNA, 25 bp, Mus musculus
gagggcctccctccagacaacagag

SEQ ID NO: 490365 - DNA, 25 bp, Mus musculus
gagggcctccctgcagacaacagag

SEQ ID NO: 490366 - DNA, 25 bp, Mus musculus
gagggcctccttaggatctcccagg

SEQ ID NO: 490367 - DNA, 25 bp, Mus musculus
gagggcctcctttggatctcccagg

SEQ ID NO: 490368 - DNA, 25 bp, Mus musculus
gagggcctcgatatgcgaaccgctc

SEQ ID NO: 490369 - DNA, 25 bp, Mus musculus
gagggcctcgatttgcgaaccgctc

SEQ ID NO: 490370 - DNA, 25 bp, Mus musculus
gagggcctctgcaccatgaagctgt

SEQ ID NO: 490371 - DNA, 25 bp, Mus musculus
gagggcctctgctccatgaagctgt

SEQ ID NO: 490372 - DNA, 25 bp, Mus musculus
gagggcctgaaccttgatgactgtt

SEQ ID NO: 490373 - DNA, 25 bp, Mus musculus
gagggcctgaacgttgatgactgtt

SEQ ID NO: 490374 - DNA, 25 bp, Mus musculus
gagggcctgacaagaaccatatgat

SEQ ID NO: 490375 - DNA, 25 bp, Mus musculus
gagggcctgacatgaaccatatgat

SEQ ID NO: 490376 - DNA, 25 bp, Mus musculus
gagggcctgatcagcagtggccaac

SEQ ID NO: 490377 - DNA, 25 bp, Mus musculus
gagggcctgatctgcagtggccaac

SEQ ID NO: 490378 - DNA, 25 bp, Mus musculus
gagggcctggctctaaattctcagt

SEQ ID NO: 490379 - DNA, 25 bp, Mus musculus
gagggcctggctgtaaattctcagt

SEQ ID NO: 490380 - DNA, 25 bp, Mus musculus
gagggcctgttgaagaattctctcc

SEQ ID NO: 490381 - DNA, 25 bp, Mus musculus
gagggcctgttgagcgtcatctgtc

SEQ ID NO: 490382 - DNA, 25 bp, Mus musculus
gagggcctgttgtagaattctctcc

SEQ ID NO: 490383 - DNA, 25 bp, Mus musculus
gagggcctgttgtgcgtcatctgtc

SEQ ID NO: 490384 - DNA, 25 bp, Mus musculus
gagggcctgtttcagatggtactct

SEQ ID NO: 490385 - DNA, 25 bp, Mus musculus
gagggcctgtttgagatggtactct

SEQ ID NO: 490386 - DNA, 25 bp, Mus musculus
gagggccttcagactaaagatctct

SEQ ID NO: 490387 - DNA, 25 bp, Mus musculus
gagggccttcagtctaaagatctct

SEQ ID NO: 490388 - DNA, 25 bp, Mus musculus
gagggccttgacagtcctggaagaa

SEQ ID NO: 490389 - DNA, 25 bp, Mus musculus
gagggccttgactgtcctggaagaa

SEQ ID NO: 490390 - DNA, 25 bp, Mus musculus
gagggccttgtcctttcatcgagga

SEQ ID NO: 490391 - DNA, 25 bp, Mus musculus
gagggccttgtcgtttcatcgagga

SEQ ID NO: 490392 - DNA, 25 bp, Mus musculus
gagggccttttcctggctcagaagt

SEQ ID NO: 490393 - DNA, 25 bp, Mus musculus
gagggccttttcgtggctcagaagt

SEQ ID NO: 490394 - DNA, 25 bp, Mus musculus
gagggcgaactgcacaggccgcccg

SEQ ID NO: 490395 - DNA, 25 bp, Mus musculus
gagggcgaactggacaggccgcccg

SEQ ID NO: 490396 - DNA, 25 bp, Mus musculus
gagggcgacacaaaagacaagaaag

SEQ ID NO: 490397 - DNA, 25 bp, Mus musculus
gagggcgacacataagacaagaaag

SEQ ID NO: 490398 - DNA, 25 bp, Mus musculus
gagggcgactctcgccgtcaacaac

SEQ ID NO: 490399 - DNA, 25 bp, Mus musculus
gagggcgactctggccgtcaacaac

SEQ ID NO: 490400 - DNA, 25 bp, Mus musculus
gagggcgagtaaacacagtacacaa

SEQ ID NO: 490401 - DNA, 25 bp, Mus musculus
gagggcgagtaatcacagtacacaa

SEQ ID NO: 490402 - DNA, 25 bp, Mus musculus
gagggcgcagatctccttaggaata

SEQ ID NO: 490403 - DNA, 25 bp, Mus musculus
gagggcgcagatgtccttaggaata

SEQ ID NO: 490404 - DNA, 25 bp, Mus musculus
gagggcgcccttacacttaaaatcg

SEQ ID NO: 490405 - DNA, 25 bp, Mus musculus
gagggcgccctttcacttaaaatcg

SEQ ID NO: 490406 - DNA, 25 bp, Mus musculus
gagggcgcgcctaggccctgcaaca

SEQ ID NO: 490407 - DNA, 25 bp, Mus musculus
gagggcgcgccttggccctgcaaca

SEQ ID NO: 490408 - DNA, 25 bp, Mus musculus
gagggcgcttgtacaacattttaca

SEQ ID NO: 490409 - DNA, 25 bp, Mus musculus
gagggcgcttgttcaacattttaca

SEQ ID NO: 490410 - DNA, 25 bp, Mus musculus
gagggctaaatgagagactgctatt

SEQ ID NO: 490411 - DNA, 25 bp, Mus musculus
gagggctaaatgtgagactgctatt

SEQ ID NO: 490412 - DNA, 25 bp, Mus musculus
gagggctacacacgaacgctctctg

SEQ ID NO: 490413 - DNA, 25 bp, Mus musculus
gagggctacacaggaacgctctctg

SEQ ID NO: 490414 - DNA, 25 bp, Mus musculus
gagggctacaccaagtaacacagat

SEQ ID NO: 490415 - DNA, 25 bp, Mus musculus
gagggctacacctagtaacacagat

SEQ ID NO: 490416 - DNA, 25 bp, Mus musculus
gagggctacatcacttgttcccaaa

SEQ ID NO: 490417 - DNA, 25 bp, Mus musculus
gagggctacatcaggttcttgggaa

SEQ ID NO: 490418 - DNA, 25 bp, Mus musculus
gagggctacatctcttgttcccaaa

SEQ ID NO: 490419 - DNA, 25 bp, Mus musculus
gagggctacatctggttcttgggaa

SEQ ID NO: 490420 - DNA, 25 bp, Mus musculus
gagggctacgatcagttccacaacc

SEQ ID NO: 490421 - DNA, 25 bp, Mus musculus
gagggctacgatgagttccacaacc

SEQ ID NO: 490422 - DNA, 25 bp, Mus musculus
gagggctactacaaggctatttcaa

SEQ ID NO: 490423 - DNA, 25 bp, Mus musculus
gagggctactactaggctatttcaa

SEQ ID NO: 490424 - DNA, 25 bp, Mus musculus
gagggctagaagcaacatgttgaaa

SEQ ID NO: 490425 - DNA, 25 bp, Mus musculus
gagggctagaaggaacatgttgaaa

SEQ ID NO: 490426 - DNA, 25 bp, Mus musculus
gagggctagcgaaagcatgtgcctt

SEQ ID NO: 490427 - DNA, 25 bp, Mus musculus
gagggctagcgatagcatgtgcctt

SEQ ID NO: 490428 - DNA, 25 bp, Mus musculus
gagggctaggctacaacttgcgcat

SEQ ID NO: 490429 - DNA, 25 bp, Mus musculus
gagggctaggcttcaacttgcgcat

SEQ ID NO: 490430 - DNA, 25 bp, Mus musculus
gagggctatccgagtcaccagggca

SEQ ID NO: 490431 - DNA, 25 bp, Mus musculus
gagggctatccgtgtcaccagggca

SEQ ID NO: 490432 - DNA, 25 bp, Mus musculus
gagggctattacaaagggctttgca

SEQ ID NO: 490433 - DNA, 25 bp, Mus musculus
gagggctattactaagggctttgca

SEQ ID NO: 490434 - DNA, 25 bp, Mus musculus
gagggctcaacactgtttcccttac

SEQ ID NO: 490435 - DNA, 25 bp, Mus musculus
gagggctcaacagtgtttcccttac

SEQ ID NO: 490436 - DNA, 25 bp, Mus musculus
gagggctcacacagaaggtcagcat

SEQ ID NO: 490437 - DNA, 25 bp, Mus musculus
gagggctcacactgaaggtcagcat

SEQ ID NO: 490438 - DNA, 25 bp, Mus musculus
gagggctcaccaaaccgtccaaaat

SEQ ID NO: 490439 - DNA, 25 bp, Mus musculus
gagggctcaccataccgtccaaaat

SEQ ID NO: 490440 - DNA, 25 bp, Mus musculus
gagggctcacctcgatcagttcaaa

SEQ ID NO: 490441 - DNA, 25 bp, Mus musculus
gagggctcacctggatcagttcaaa

SEQ ID NO: 490442 - DNA, 25 bp, Mus musculus
gagggctcacgcaagcataaggaca

SEQ ID NO: 490443 - DNA, 25 bp, Mus musculus
gagggctcacgctagcataaggaca

SEQ ID NO: 490444 - DNA, 25 bp, Mus musculus
gagggctcagagaccagaagccaga

SEQ ID NO: 490445 - DNA, 25 bp, Mus musculus
gagggctcagagtccagaagccaga

SEQ ID NO: 490446 - DNA, 25 bp, Mus musculus
gagggctcagcaacccgggacacga

SEQ ID NO: 490447 - DNA, 25 bp, Mus musculus
gagggctcagcaccgtataccttca

SEQ ID NO: 490448 - DNA, 25 bp, Mus musculus
gagggctcagcagcgtataccttca

SEQ ID NO: 490449 - DNA, 25 bp, Mus musculus
gagggctcagcatcccgggacacga

SEQ ID NO: 490450 - DNA, 25 bp, Mus musculus
gagggctcagccaaagctcctgggt

SEQ ID NO: 490451 - DNA, 25 bp, Mus musculus
gagggctcagcctaagctcctgggt

SEQ ID NO: 490452 - DNA, 25 bp, Mus musculus
gagggctcagtaaatgctggctgaa

SEQ ID NO: 490453 - DNA, 25 bp, Mus musculus
gagggctcagtatatgctggctgaa

SEQ ID NO: 490454 - DNA, 25 bp, Mus musculus
gagggctcagttcaagtgttgacct

SEQ ID NO: 490455 - DNA, 25 bp, Mus musculus
gagggctcagttgaagtgttgacct

SEQ ID NO: 490456 - DNA, 25 bp, Mus musculus
gagggctccaagatcaggacgctct

SEQ ID NO: 490457 - DNA, 25 bp, Mus musculus
gagggctccaagttcaggacgctct

SEQ ID NO: 490458 - DNA, 25 bp, Mus musculus
gagggctccaatagcaccacatatg

SEQ ID NO: 490459 - DNA, 25 bp, Mus musculus
gagggctccaattgcaccacatatg

SEQ ID NO: 490460 - DNA, 25 bp, Mus musculus
gagggctcccatattaaactgcaag

SEQ ID NO: 490461 - DNA, 25 bp, Mus musculus
gagggctcccattttaaactgcaag

SEQ ID NO: 490462 - DNA, 25 bp, Mus musculus
gagggctcctagagttgtttactga

SEQ ID NO: 490463 - DNA, 25 bp, Mus musculus
gagggctcctagtgttgtttactga

SEQ ID NO: 490464 - DNA, 25 bp, Mus musculus
gagggctcctcactagttgtatgca

SEQ ID NO: 490465 - DNA, 25 bp, Mus musculus
gagggctcctcagtagttgtatgca

SEQ ID NO: 490466 - DNA, 25 bp, Mus musculus
gagggctcctgacacaagcgctgaa

SEQ ID NO: 490467 - DNA, 25 bp, Mus musculus
gagggctcctgagacaagcgctgaa

SEQ ID NO: 490468 - DNA, 25 bp, Mus musculus
gagggctcctgtccatcgctggaat

SEQ ID NO: 490469 - DNA, 25 bp, Mus musculus
gagggctcctgtgcatcgctggaat

SEQ ID NO: 490470 - DNA, 25 bp, Mus musculus
gagggctctgcacccgaagaagcaa

SEQ ID NO: 490471 - DNA, 25 bp, Mus musculus
gagggctctgcagccgaagaagcaa

SEQ ID NO: 490472 - DNA, 25 bp, Mus musculus
gagggctgaagtagtgcctagaaaa

SEQ ID NO: 490473 - DNA, 25 bp, Mus musculus
gagggctgaagttgtgcctagaaaa

SEQ ID NO: 490474 - DNA, 25 bp, Mus musculus
gagggctgacagcacagatctgatc

SEQ ID NO: 490475 - DNA, 25 bp, Mus musculus
gagggctgacaggacagatctgatc

SEQ ID NO: 490476 - DNA, 25 bp, Mus musculus
gagggctgacccaactttacatgaa

SEQ ID NO: 490477 - DNA, 25 bp, Mus musculus
gagggctgaccctactttacatgaa

SEQ ID NO: 490478 - DNA, 25 bp, Mus musculus
gagggctgacgcactgagccgttct

SEQ ID NO: 490479 - DNA, 25 bp, Mus musculus
gagggctgacgctctgagccgttct

SEQ ID NO: 490480 - DNA, 25 bp, Mus musculus
gagggctgagatacccaaggagaat

SEQ ID NO: 490481 - DNA, 25 bp, Mus musculus
gagggctgagattcccaaggagaat

SEQ ID NO: 490482 - DNA, 25 bp, Mus musculus
gagggctgagctcatcttttcaaac

SEQ ID NO: 490483 - DNA, 25 bp, Mus musculus
gagggctgagctgatcttttcaaac

SEQ ID NO: 490484 - DNA, 25 bp, Mus musculus
gagggctgatcacctggcacatttt

SEQ ID NO: 490485 - DNA, 25 bp, Mus musculus
gagggctgatcagctggcacatttt

SEQ ID NO: 490486 - DNA, 25 bp, Mus musculus
gagggctgatgcacactagtgaacc

SEQ ID NO: 490487 - DNA, 25 bp, Mus musculus
gagggctgatgctcactagtgaacc

SEQ ID NO: 490488 - DNA, 25 bp, Mus musculus
gagggctgcaatagctggtttccat

SEQ ID NO: 490489 - DNA, 25 bp, Mus musculus
gagggctgcaatccaccatgggtca

SEQ ID NO: 490490 - DNA, 25 bp, Mus musculus
gagggctgcaatgcaccatgggtca

SEQ ID NO: 490491 - DNA, 25 bp, Mus musculus
gagggctgcaattgctggtttccat

SEQ ID NO: 490492 - DNA, 25 bp, Mus musculus
gagggctgcaccaataaattcccag

SEQ ID NO: 490493 - DNA, 25 bp, Mus musculus
gagggctgcacctataaattcccag

SEQ ID NO: 490494 - DNA, 25 bp, Mus musculus
gagggctgcatgaacttagttatca

SEQ ID NO: 490495 - DNA, 25 bp, Mus musculus
gagggctgcatgtacttagttatca

SEQ ID NO: 490496 - DNA, 25 bp, Mus musculus
gagggctgcattaagcttttgttga

SEQ ID NO: 490497 - DNA, 25 bp, Mus musculus
gagggctgcattagaatgggctcaa

SEQ ID NO: 490498 - DNA, 25 bp, Mus musculus
gagggctgcatttagcttttgttga

SEQ ID NO: 490499 - DNA, 25 bp, Mus musculus
gagggctgcatttgaatgggctcaa

SEQ ID NO: 490500 - DNA, 25 bp, Mus musculus
gagggctgccagcactactgcagct

SEQ ID NO: 490501 - DNA, 25 bp, Mus musculus
gagggctgccaggactactgcagct

SEQ ID NO: 490502 - DNA, 25 bp, Mus musculus
gagggctgcgctaaagtctttgaac

SEQ ID NO: 490503 - DNA, 25 bp, Mus musculus
gagggctgcgcttaagtctttgaac

SEQ ID NO: 490504 - DNA, 25 bp, Mus musculus
gagggctgctccagaaagatgctgc

SEQ ID NO: 490505 - DNA, 25 bp, Mus musculus
gagggctgctcctgaaagatgctgc

SEQ ID NO: 490506 - DNA, 25 bp, Mus musculus
gagggctggcccattacttgtcaca

SEQ ID NO: 490507 - DNA, 25 bp, Mus musculus
gagggctggccctttacttgtcaca

SEQ ID NO: 490508 - DNA, 25 bp, Mus musculus
gagggctggcttctgtcatgtaatc

SEQ ID NO: 490509 - DNA, 25 bp, Mus musculus
gagggctggcttgtgtcatgtaatc

SEQ ID NO: 490510 - DNA, 25 bp, Mus musculus
gagggctggtctaaagtggactact

SEQ ID NO: 490511 - DNA, 25 bp, Mus musculus
gagggctggtcttaagtggactact

SEQ ID NO: 490512 - DNA, 25 bp, Mus musculus
gagggctgtaccagacgggcacaca

SEQ ID NO: 490513 - DNA, 25 bp, Mus musculus
gagggctgtaccaggctaaagtctg

SEQ ID NO: 490514 - DNA, 25 bp, Mus musculus
gagggctgtacctgacgggcacaca

SEQ ID NO: 490515 - DNA, 25 bp, Mus musculus
gagggctgtacctggctaaagtctg

SEQ ID NO: 490516 - DNA, 25 bp, Mus musculus
gagggctgtcaaatctacctgtgtg

SEQ ID NO: 490517 - DNA, 25 bp, Mus musculus
gagggctgtcaattctacctgtgtg

SEQ ID NO: 490518 - DNA, 25 bp, Mus musculus
gagggctgttgaaatcccaggctat

SEQ ID NO: 490519 - DNA, 25 bp, Mus musculus
gagggctgttgatatcccaggctat

SEQ ID NO: 490520 - DNA, 25 bp, Mus musculus
gagggcttaaacaagcaatggcggc

SEQ ID NO: 490521 - DNA, 25 bp, Mus musculus
gagggcttaaactagcaatggcggc

SEQ ID NO: 490522 - DNA, 25 bp, Mus musculus
gagggcttacccatgcaaggcagcc

SEQ ID NO: 490523 - DNA, 25 bp, Mus musculus
gagggcttacccttgcaaggcagcc

SEQ ID NO: 490524 - DNA, 25 bp, Mus musculus
gagggcttactgaaggccaattcat

SEQ ID NO: 490525 - DNA, 25 bp, Mus musculus
gagggcttactgtaggccaattcat

SEQ ID NO: 490526 - DNA, 25 bp, Mus musculus
gagggcttcaagattacagcttttg

SEQ ID NO: 490527 - DNA, 25 bp, Mus musculus
gagggcttcaagtttacagcttttg

SEQ ID NO: 490528 - DNA, 25 bp, Mus musculus
gagggcttcataacctgacataagg

SEQ ID NO: 490529 - DNA, 25 bp, Mus musculus
gagggcttcatatcctgacataagg

SEQ ID NO: 490530 - DNA, 25 bp, Mus musculus
gagggcttccatattgagacaacaa

SEQ ID NO: 490531 - DNA, 25 bp, Mus musculus
gagggcttccatctttttgaggcac

SEQ ID NO: 490532 - DNA, 25 bp, Mus musculus
gagggcttccatgtttttgaggcac

SEQ ID NO: 490533 - DNA, 25 bp, Mus musculus
gagggcttccattttgagacaacaa

SEQ ID NO: 490534 - DNA, 25 bp, Mus musculus
gagggcttctcgaaattagttggaa

SEQ ID NO: 490535 - DNA, 25 bp, Mus musculus
gagggcttctcgtaattagttggaa

SEQ ID NO: 490536 - DNA, 25 bp, Mus musculus
gagggcttgaacattgaccagacag

SEQ ID NO: 490537 - DNA, 25 bp, Mus musculus
gagggcttgaactttgaccagacag

SEQ ID NO: 490538 - DNA, 25 bp, Mus musculus
gagggcttgatcattcgtggtgcat

SEQ ID NO: 490539 - DNA, 25 bp, Mus musculus
gagggcttgatctttcgtggtgcat

SEQ ID NO: 490540 - DNA, 25 bp, Mus musculus
gagggcttgcagcattacaccataa

SEQ ID NO: 490541 - DNA, 25 bp, Mus musculus
gagggcttgcaggattacaccataa

SEQ ID NO: 490542 - DNA, 25 bp, Mus musculus
gagggcttgctcctaggacatgcta

SEQ ID NO: 490543 - DNA, 25 bp, Mus musculus
gagggcttgctcctttcagaagatg

SEQ ID NO: 490544 - DNA, 25 bp, Mus musculus
gagggcttgctcgtaggacatgcta

SEQ ID NO: 490545 - DNA, 25 bp, Mus musculus
gagggcttgctcgtttcagaagatg

SEQ ID NO: 490546 - DNA, 25 bp, Mus musculus
gagggcttggtgcaacattctttta

SEQ ID NO: 490547 - DNA, 25 bp, Mus musculus
gagggcttggtggaacattctttta

SEQ ID NO: 490548 - DNA, 25 bp, Mus musculus
gagggctttaagagttccttccttg

SEQ ID NO: 490549 - DNA, 25 bp, Mus musculus
gagggctttaagtgttccttccttg

SEQ ID NO: 490550 - DNA, 25 bp, Mus musculus
gagggctttagcaattgttccctta

SEQ ID NO: 490551 - DNA, 25 bp, Mus musculus
gagggctttagctattgttccctta

SEQ ID NO: 490552 - DNA, 25 bp, Mus musculus
gagggctttcagcatgctccagatg

SEQ ID NO: 490553 - DNA, 25 bp, Mus musculus
gagggctttcaggatgctccagatg

SEQ ID NO: 490554 - DNA, 25 bp, Mus musculus
gagggctttgaactcctaagcacta

SEQ ID NO: 490555 - DNA, 25 bp, Mus musculus
gagggctttgaagtcctaagcacta

SEQ ID NO: 490556 - DNA, 25 bp, Mus musculus
gagggctttgagcatctctgttcta

SEQ ID NO: 490557 - DNA, 25 bp, Mus musculus
gagggctttgaggatctctgttcta

SEQ ID NO: 490558 - DNA, 25 bp, Mus musculus
gagggctttgtaccagtgagtattt

SEQ ID NO: 490559 - DNA, 25 bp, Mus musculus
gagggctttgtagcagtgagtattt

SEQ ID NO: 490560 - DNA, 25 bp, Mus musculus
gagggcttttgtcaaattcccaaca

SEQ ID NO: 490561 - DNA, 25 bp, Mus musculus
gagggcttttgtgaaattcccaaca

SEQ ID NO: 490562 - DNA, 25 bp, Mus musculus
gaggggacacctacggacacgagca

SEQ ID NO: 490563 - DNA, 25 bp, Mus musculus
gaggggacaccttcggacacgagca

SEQ ID NO: 490564 - DNA, 25 bp, Mus musculus
gaggggagactacatctcctccctg

SEQ ID NO: 490565 - DNA, 25 bp, Mus musculus
gaggggagactagatctcctccctg

SEQ ID NO: 490566 - DNA, 25 bp, Mus musculus
gaggggatccagcagcagttacaac

SEQ ID NO: 490567 - DNA, 25 bp, Mus musculus
gaggggatccaggagcagttacaac

SEQ ID NO: 490568 - DNA, 20 bp, Mus musculus
gaggggcatcctcagcaatg

SEQ ID NO: 490569 - DNA, 25 bp, Mus musculus
gaggggccggatatctcaacagatt

SEQ ID NO: 490570 - DNA, 25 bp, Mus musculus
gaggggccggatttctcaacagatt

SEQ ID NO: 490571 - DNA, 20 bp, Mus musculus
gaggggcctcctcagcaatg

SEQ ID NO: 490572 - DNA, 20 bp, Mus musculus
gaggggcgtcctcagcaatg

SEQ ID NO: 490573 - DNA, 25 bp, Mus musculus
gaggggctgcccagtgaaaatcaat

SEQ ID NO: 490574 - DNA, 25 bp, Mus musculus
gaggggctgccctgtgaaaatcaat

SEQ ID NO: 490575 - DNA, 20 bp, Mus musculus
gaggggcttcctcagcaatg

SEQ ID NO: 490576 - DNA, 25 bp, Mus musculus
gaggggtgagacatcattttctatt

SEQ ID NO: 490577 - DNA, 25 bp, Mus musculus
gaggggtgagacttcattttctatt

SEQ ID NO: 490578 - DNA, 25 bp, Mus musculus
gaggggttggaaacctcaacacacg

SEQ ID NO: 490579 - DNA, 25 bp, Mus musculus
gaggggttggaatcctcaacacacg

SEQ ID NO: 490580 - DNA, 25 bp, Mus musculus
gagggtaaaaaacctgcagacttag

SEQ ID NO: 490581 - DNA, 25 bp, Mus musculus
gagggtaaaaaagctgcagacttag

SEQ ID NO: 490582 - DNA, 25 bp, Mus musculus
gagggtaaatccaacggatccggct

SEQ ID NO: 490583 - DNA, 25 bp, Mus musculus
gagggtaaatcctacggatccggct

SEQ ID NO: 490584 - DNA, 25 bp, Mus musculus
gagggtaacaggattatccgagatg

SEQ ID NO: 490585 - DNA, 25 bp, Mus musculus
gagggtaacaggtttatccgagatg

SEQ ID NO: 490586 - DNA, 25 bp, Mus musculus
gagggtaacgctccctaccaccggg

SEQ ID NO: 490587 - DNA, 25 bp, Mus musculus
gagggtaacgctgcctaccaccggg

SEQ ID NO: 490588 - DNA, 25 bp, Mus musculus
gagggtaactcacgtaaagatgctt

SEQ ID NO: 490589 - DNA, 25 bp, Mus musculus
gagggtaactcaggtaaagatgctt

SEQ ID NO: 490590 - DNA, 25 bp, Mus musculus
gagggtaagaccattgcaattggaa

SEQ ID NO: 490591 - DNA, 25 bp, Mus musculus
gagggtaagacctttgcaattggaa

SEQ ID NO: 490592 - DNA, 25 bp, Mus musculus
gagggtaagactcatgttctatgaa

SEQ ID NO: 490593 - DNA, 25 bp, Mus musculus
gagggtaagactgatgttctatgaa

SEQ ID NO: 490594 - DNA, 25 bp, Mus musculus
gagggtaaggtgacacccctaggca

SEQ ID NO: 490595 - DNA, 25 bp, Mus musculus
gagggtaaggtgtcacccctaggca

SEQ ID NO: 490596 - DNA, 25 bp, Mus musculus
gagggtaagtgacggccttgcctga

SEQ ID NO: 490597 - DNA, 25 bp, Mus musculus
gagggtaagtgagggccttgcctga

SEQ ID NO: 490598 - DNA, 25 bp, Mus musculus
gagggtaatacaatcagacagcttt

SEQ ID NO: 490599 - DNA, 25 bp, Mus musculus
gagggtaatacattcagacagcttt

SEQ ID NO: 490600 - DNA, 25 bp, Mus musculus
gagggtaatcctcccaaagccatga

SEQ ID NO: 490601 - DNA, 25 bp, Mus musculus
gagggtaatcctgccaaagccatga

SEQ ID NO: 490602 - DNA, 25 bp, Mus musculus
gagggtaatctccaccaggtttaat

SEQ ID NO: 490603 - DNA, 25 bp, Mus musculus
gagggtaatctcgaccaggtttaat

SEQ ID NO: 490604 - DNA, 25 bp, Mus musculus
gagggtaatctgcttaacatctaga

SEQ ID NO: 490605 - DNA, 25 bp, Mus musculus
gagggtaatctggttaacatctaga

SEQ ID NO: 490606 - DNA, 25 bp, Mus musculus
gagggtaattgcacataactttaag

SEQ ID NO: 490607 - DNA, 25 bp, Mus musculus
gagggtaattgctcataactttaag

SEQ ID NO: 490608 - DNA, 25 bp, Mus musculus
gagggtacacacattgcaggtcact

SEQ ID NO: 490609 - DNA, 25 bp, Mus musculus
gagggtacacactttgcaggtcact

SEQ ID NO: 490610 - DNA, 25 bp, Mus musculus
gagggtacaccacgcaactgctcta

SEQ ID NO: 490611 - DNA, 25 bp, Mus musculus
gagggtacaccaggcaactgctcta

SEQ ID NO: 490612 - DNA, 25 bp, Mus musculus
gagggtacagacattccgttcatgc

SEQ ID NO: 490613 - DNA, 25 bp, Mus musculus
gagggtacagactttccgttcatgc

SEQ ID NO: 490614 - DNA, 25 bp, Mus musculus
gagggtacagtaatacacacttaag

SEQ ID NO: 490615 - DNA, 25 bp, Mus musculus
gagggtacagtattacacacttaag

SEQ ID NO: 490616 - DNA, 25 bp, Mus musculus
gagggtacgttcaagtgcttctaac

SEQ ID NO: 490617 - DNA, 25 bp, Mus musculus
gagggtacgttctagtgcttctaac

SEQ ID NO: 490618 - DNA, 25 bp, Mus musculus
gagggtactgacagctgtctgtcca

SEQ ID NO: 490619 - DNA, 25 bp, Mus musculus
gagggtactgactgctgtctgtcca

SEQ ID NO: 490620 - DNA, 25 bp, Mus musculus
gagggtacttcacgtctggtgataa

SEQ ID NO: 490621 - DNA, 25 bp, Mus musculus
gagggtacttcaggtctggtgataa

SEQ ID NO: 490622 - DNA, 25 bp, Mus musculus
gagggtacttgtaaaggactgcttt

SEQ ID NO: 490623 - DNA, 25 bp, Mus musculus
gagggtacttgttaaggactgcttt

SEQ ID NO: 490624 - DNA, 25 bp, Mus musculus
gagggtagaaccagcgtaagctcat

SEQ ID NO: 490625 - DNA, 25 bp, Mus musculus
gagggtagaacctgcgtaagctcat

SEQ ID NO: 490626 - DNA, 25 bp, Mus musculus
gagggtagagtcagtccgtcaacat

SEQ ID NO: 490627 - DNA, 25 bp, Mus musculus
gagggtagagtcctttcgtctatga

SEQ ID NO: 490628 - DNA, 25 bp, Mus musculus
gagggtagagtcgtttcgtctatga

SEQ ID NO: 490629 - DNA, 25 bp, Mus musculus
gagggtagagtctgtccgtcaacat

SEQ ID NO: 490630 - DNA, 25 bp, Mus musculus
gagggtagccagctcaaggcctaaa

SEQ ID NO: 490631 - DNA, 25 bp, Mus musculus
gagggtagccaggtcaaggcctaaa

SEQ ID NO: 490632 - DNA, 25 bp, Mus musculus
gagggtaggtatcttatctcacacc

SEQ ID NO: 490633 - DNA, 25 bp, Mus musculus
gagggtaggtatgttatctcacacc

SEQ ID NO: 490634 - DNA, 25 bp, Mus musculus
gagggtagttgcacatttcacaaga

SEQ ID NO: 490635 - DNA, 25 bp, Mus musculus
gagggtagttgctcatttcacaaga

SEQ ID NO: 490636 - DNA, 25 bp, Mus musculus
gagggtataaacctacccctcagct

SEQ ID NO: 490637 - DNA, 25 bp, Mus musculus
gagggtataaacgtacccctcagct

SEQ ID NO: 490638 - DNA, 25 bp, Mus musculus
gagggtatagcactacccatgtttt

SEQ ID NO: 490639 - DNA, 25 bp, Mus musculus
gagggtatagcagtacccatgtttt

SEQ ID NO: 490640 - DNA, 25 bp, Mus musculus
gagggtatatttatcttgttaacaa

SEQ ID NO: 490641 - DNA, 25 bp, Mus musculus
gagggtatatttttcttgttaacaa

SEQ ID NO: 490642 - DNA, 25 bp, Mus musculus
gagggtatcaaactatgtccacaac

SEQ ID NO: 490643 - DNA, 25 bp, Mus musculus
gagggtatcaaagtatgtccacaac

SEQ ID NO: 490644 - DNA, 25 bp, Mus musculus
gagggtatcaagaccccctggaact

SEQ ID NO: 490645 - DNA, 25 bp, Mus musculus
gagggtatcaagtccccctggaact

SEQ ID NO: 490646 - DNA, 25 bp, Mus musculus
gagggtatcatcaccatcgagtctc

SEQ ID NO: 490647 - DNA, 25 bp, Mus musculus
gagggtatcatctccatcgagtctc

SEQ ID NO: 490648 - DNA, 25 bp, Mus musculus
gagggtatccttagacaacagccat

SEQ ID NO: 490649 - DNA, 25 bp, Mus musculus
gagggtatcctttgacaacagccat

SEQ ID NO: 490650 - DNA, 25 bp, Mus musculus
gagggtatgacacaactcgggtcac

SEQ ID NO: 490651 - DNA, 25 bp, Mus musculus
gagggtatgacagaactcgggtcac

SEQ ID NO: 490652 - DNA, 25 bp, Mus musculus
gagggtatgcagcatccagcgcaac

SEQ ID NO: 490653 - DNA, 25 bp, Mus musculus
gagggtatgcaggatccagcgcaac

SEQ ID NO: 490654 - DNA, 25 bp, Mus musculus
gagggtattatgaaacccttcagaa

SEQ ID NO: 490655 - DNA, 25 bp, Mus musculus
gagggtattatgtaacccttcagaa

SEQ ID NO: 490656 - DNA, 25 bp, Mus musculus
gagggtattctaagtgttttgcatt

SEQ ID NO: 490657 - DNA, 25 bp, Mus musculus
gagggtattctatgtgttttgcatt

SEQ ID NO: 490658 - DNA, 25 bp, Mus musculus
gagggtattgttaaaccactctaat

SEQ ID NO: 490659 - DNA, 25 bp, Mus musculus
gagggtattgttcagctcactccgt

SEQ ID NO: 490660 - DNA, 25 bp, Mus musculus
gagggtattgttgagctcactccgt

SEQ ID NO: 490661 - DNA, 25 bp, Mus musculus
gagggtattgtttaaccactctaat

SEQ ID NO: 490662 - DNA, 25 bp, Mus musculus
gagggtcaaaccatattttacacct

SEQ ID NO: 490663 - DNA, 25 bp, Mus musculus
gagggtcaaaccatcacaagtcaga

SEQ ID NO: 490664 - DNA, 25 bp, Mus musculus
gagggtcaaaccttattttacacct

SEQ ID NO: 490665 - DNA, 25 bp, Mus musculus
gagggtcaaaccttcacaagtcaga

SEQ ID NO: 490666 - DNA, 25 bp, Mus musculus
gagggtcaacaacccgcggtagcta

SEQ ID NO: 490667 - DNA, 25 bp, Mus musculus
gagggtcaacaagccgcggtagcta

SEQ ID NO: 490668 - DNA, 25 bp, Mus musculus
gagggtcaactgacttgctaccaag

SEQ ID NO: 490669 - DNA, 25 bp, Mus musculus
gagggtcaactgtcttgctaccaag

SEQ ID NO: 490670 - DNA, 25 bp, Mus musculus
gagggtcaagctaatgagttccaga

SEQ ID NO: 490671 - DNA, 25 bp, Mus musculus
gagggtcaagcttatgagttccaga

SEQ ID NO: 490672 - DNA, 25 bp, Mus musculus
gagggtcaatatactgggttacaaa

SEQ ID NO: 490673 - DNA, 25 bp, Mus musculus
gagggtcaatattctgggttacaaa

SEQ ID NO: 490674 - DNA, 25 bp, Mus musculus
gagggtcacccactgagtgctttaa

SEQ ID NO: 490675 - DNA, 25 bp, Mus musculus
gagggtcacccagtgagtgctttaa

SEQ ID NO: 490676 - DNA, 25 bp, Mus musculus
gagggtcacttgactagtcctgcag

SEQ ID NO: 490677 - DNA, 25 bp, Mus musculus
gagggtcacttgtctagtcctgcag

SEQ ID NO: 490678 - DNA, 25 bp, Mus musculus
gagggtcagcctcagaggtatccaa

SEQ ID NO: 490679 - DNA, 25 bp, Mus musculus
gagggtcagcctgagaggtatccaa

SEQ ID NO: 490680 - DNA, 25 bp, Mus musculus
gagggtcagctgaaacagtcattaa

SEQ ID NO: 490681 - DNA, 25 bp, Mus musculus
gagggtcagctgtaacagtcattaa

SEQ ID NO: 490682 - DNA, 25 bp, Mus musculus
gagggtcaggaaatcccggtcatcc

SEQ ID NO: 490683 - DNA, 25 bp, Mus musculus
gagggtcaggaattcccggtcatcc

SEQ ID NO: 490684 - DNA, 25 bp, Mus musculus
gagggtcagggacccaccaactcat

SEQ ID NO: 490685 - DNA, 25 bp, Mus musculus
gagggtcagggagccaccaactcat

SEQ ID NO: 490686 - DNA, 25 bp, Mus musculus
gagggtcaggtcacttatgtatgaa

SEQ ID NO: 490687 - DNA, 25 bp, Mus musculus
gagggtcaggtctcttatgtatgaa

SEQ ID NO: 490688 - DNA, 25 bp, Mus musculus
gagggtcatagacaatcccattgaa

SEQ ID NO: 490689 - DNA, 25 bp, Mus musculus
gagggtcatagagaatcccattgaa

SEQ ID NO: 490690 - DNA, 25 bp, Mus musculus
gagggtcataggctacaatgcctat

SEQ ID NO: 490691 - DNA, 25 bp, Mus musculus
gagggtcatagggtacaatgcctat

SEQ ID NO: 490692 - DNA, 25 bp, Mus musculus
gagggtcatggaacatccctgggcc

SEQ ID NO: 490693 - DNA, 25 bp, Mus musculus
gagggtcatggatcatccctgggcc

SEQ ID NO: 490694 - DNA, 25 bp, Mus musculus
gagggtcattaaagctgagtccata

SEQ ID NO: 490695 - DNA, 25 bp, Mus musculus
gagggtcattaatgctgagtccata

SEQ ID NO: 490696 - DNA, 25 bp, Mus musculus
gagggtcattttcttattggttcat

SEQ ID NO: 490697 - DNA, 25 bp, Mus musculus
gagggtcattttgttattggttcat

SEQ ID NO: 490698 - DNA, 25 bp, Mus musculus
gagggtccaaaacaactggtatccg

SEQ ID NO: 490699 - DNA, 25 bp, Mus musculus
gagggtccaaaacagatgactctgg

SEQ ID NO: 490700 - DNA, 25 bp, Mus musculus
gagggtccaaaagaactggtatccg

SEQ ID NO: 490701 - DNA, 25 bp, Mus musculus
gagggtccaaaagagatgactctgg

SEQ ID NO: 490702 - DNA, 25 bp, Mus musculus
gagggtccaaatactttgctgtctg

SEQ ID NO: 490703 - DNA, 25 bp, Mus musculus
gagggtccaaattctttgctgtctg

SEQ ID NO: 490704 - DNA, 25 bp, Mus musculus
gagggtccacagacaagtgctgtct

SEQ ID NO: 490705 - DNA, 25 bp, Mus musculus
gagggtccacagagaaccttgatca

SEQ ID NO: 490706 - DNA, 25 bp, Mus musculus
gagggtccacagtcaagtgctgtct

SEQ ID NO: 490707 - DNA, 25 bp, Mus musculus
gagggtccacagtgaaccttgatca

SEQ ID NO: 490708 - DNA, 25 bp, Mus musculus
gagggtccacatcggctacgctaca

SEQ ID NO: 490709 - DNA, 25 bp, Mus musculus
gagggtccacatgggctacgctaca

SEQ ID NO: 490710 - DNA, 25 bp, Mus musculus
gagggtccaccccagacactgttat

SEQ ID NO: 490711 - DNA, 25 bp, Mus musculus
gagggtccacccgagacactgttat

SEQ ID NO: 490712 - DNA, 25 bp, Mus musculus
gagggtccagacagagcatccacga

SEQ ID NO: 490713 - DNA, 25 bp, Mus musculus
gagggtccagactgagcatccacga

SEQ ID NO: 490714 - DNA, 25 bp, Mus musculus
gagggtccagataccagtgcacact

SEQ ID NO: 490715 - DNA, 25 bp, Mus musculus
gagggtccagattccagtgcacact

SEQ ID NO: 490716 - DNA, 25 bp, Mus musculus
gagggtccaggcattggatcaacat

SEQ ID NO: 490717 - DNA, 25 bp, Mus musculus
gagggtccaggctttggatcaacat

SEQ ID NO: 490718 - DNA, 25 bp, Mus musculus
gagggtccccatagcatcaagtttg

SEQ ID NO: 490719 - DNA, 25 bp, Mus musculus
gagggtccccattgcatcaagtttg

SEQ ID NO: 490720 - DNA, 25 bp, Mus musculus
gagggtccggagactgaacccatct

SEQ ID NO: 490721 - DNA, 25 bp, Mus musculus
gagggtccggagtctgaacccatct

SEQ ID NO: 490722 - DNA, 25 bp, Mus musculus
gagggtcctcacaaggttcaggctg

SEQ ID NO: 490723 - DNA, 25 bp, Mus musculus
gagggtcctcactaggttcaggctg

SEQ ID NO: 490724 - DNA, 25 bp, Mus musculus
gagggtcctgataggctacatagtg

SEQ ID NO: 490725 - DNA, 25 bp, Mus musculus
gagggtcctgattggctacatagtg

SEQ ID NO: 490726 - DNA, 25 bp, Mus musculus
gagggtcctgtcatggaacacctag

SEQ ID NO: 490727 - DNA, 25 bp, Mus musculus
gagggtcctgtcttggaacacctag

SEQ ID NO: 490728 - DNA, 25 bp, Mus musculus
gagggtccttcaacatccaagtgag

SEQ ID NO: 490729 - DNA, 25 bp, Mus musculus
gagggtccttcaagtgagatttgct

SEQ ID NO: 490730 - DNA, 25 bp, Mus musculus
gagggtccttcatcatccaagtgag

SEQ ID NO: 490731 - DNA, 25 bp, Mus musculus
gagggtccttcatgtgagatttgct

SEQ ID NO: 490732 - DNA, 25 bp, Mus musculus
gagggtcgaacgcacatctttaaga

SEQ ID NO: 490733 - DNA, 25 bp, Mus musculus
gagggtcgaacggacatctttaaga

SEQ ID NO: 490734 - DNA, 25 bp, Mus musculus
gagggtcgatccagcaagccaggcc

SEQ ID NO: 490735 - DNA, 25 bp, Mus musculus
gagggtcgatcctgcaagccaggcc

SEQ ID NO: 490736 - DNA, 25 bp, Mus musculus
gagggtctacatacattcttttaca

SEQ ID NO: 490737 - DNA, 25 bp, Mus musculus
gagggtctacattcattcttttaca

SEQ ID NO: 490738 - DNA, 25 bp, Mus musculus
gagggtctagcaaagatcttctgaa

SEQ ID NO: 490739 - DNA, 25 bp, Mus musculus
gagggtctagcatagatcttctgaa

SEQ ID NO: 490740 - DNA, 25 bp, Mus musculus
gagggtctcatgctacctgtctgca

SEQ ID NO: 490741 - DNA, 25 bp, Mus musculus
gagggtctcatggtacctgtctgca

SEQ ID NO: 490742 - DNA, 25 bp, Mus musculus
gagggtctccacagttagtgtgtct

SEQ ID NO: 490743 - DNA, 25 bp, Mus musculus
gagggtctccactgttagtgtgtct

SEQ ID NO: 490744 - DNA, 25 bp, Mus musculus
gagggtctccatcggaaatctcttg

SEQ ID NO: 490745 - DNA, 25 bp, Mus musculus
gagggtctccatgggaaatctcttg

SEQ ID NO: 490746 - DNA, 25 bp, Mus musculus
gagggtctcggtagttttccatgcc

SEQ ID NO: 490747 - DNA, 25 bp, Mus musculus
gagggtctcggttgttttccatgcc

SEQ ID NO: 490748 - DNA, 25 bp, Mus musculus
gagggtctcgtgcaaatgtagctat

SEQ ID NO: 490749 - DNA, 25 bp, Mus musculus
gagggtctcgtggaaatgtagctat

SEQ ID NO: 490750 - DNA, 25 bp, Mus musculus
gagggtctctctccccagagaacat

SEQ ID NO: 490751 - DNA, 25 bp, Mus musculus
gagggtctctctgcccagagaacat

SEQ ID NO: 490752 - DNA, 25 bp, Mus musculus
gagggtctctgaaggcaactcagtc

SEQ ID NO: 490753 - DNA, 25 bp, Mus musculus
gagggtctctgatggcaactcagtc

SEQ ID NO: 490754 - DNA, 25 bp, Mus musculus
gagggtctctgtacacccaggaagt

SEQ ID NO: 490755 - DNA, 25 bp, Mus musculus
gagggtctctgttcacccaggaagt

SEQ ID NO: 490756 - DNA, 25 bp, Mus musculus
gagggtctcttcaatgattacgtcg

SEQ ID NO: 490757 - DNA, 25 bp, Mus musculus
gagggtctcttctatgattacgtcg

SEQ ID NO: 490758 - DNA, 25 bp, Mus musculus
gagggtctgaacatatccaccagtc

SEQ ID NO: 490759 - DNA, 25 bp, Mus musculus
gagggtctgaacttatccaccagtc

SEQ ID NO: 490760 - DNA, 25 bp, Mus musculus
gagggtctgcctccatcagcctagg

SEQ ID NO: 490761 - DNA, 25 bp, Mus musculus
gagggtctgcctgcatcagcctagg

SEQ ID NO: 490762 - DNA, 25 bp, Mus musculus
gagggtctgcgtcaacagttttctt

SEQ ID NO: 490763 - DNA, 25 bp, Mus musculus
gagggtctgcgtgaacagttttctt

SEQ ID NO: 490764 - DNA, 25 bp, Mus musculus
gagggtctggccaagctgcagtcct

SEQ ID NO: 490765 - DNA, 25 bp, Mus musculus
gagggtctggcctagctgcagtcct

SEQ ID NO: 490766 - DNA, 25 bp, Mus musculus
gagggtctgtccaaatttccaggga

SEQ ID NO: 490767 - DNA, 25 bp, Mus musculus
gagggtctgtcctaatttccaggga

SEQ ID NO: 490768 - DNA, 25 bp, Mus musculus
gagggtcttacaccttagtgcaagt

SEQ ID NO: 490769 - DNA, 25 bp, Mus musculus
gagggtcttacagcttagtgcaagt

SEQ ID NO: 490770 - DNA, 25 bp, Mus musculus
gagggtcttatgattgcctggagcc

SEQ ID NO: 490771 - DNA, 25 bp, Mus musculus
gagggtcttatgtttgcctggagcc

SEQ ID NO: 490772 - DNA, 25 bp, Mus musculus
gagggtcttattagttaccccagct

SEQ ID NO: 490773 - DNA, 25 bp, Mus musculus
gagggtcttatttgttaccccagct

SEQ ID NO: 490774 - DNA, 25 bp, Mus musculus
gagggtcttcaaaaactttcgagtt

SEQ ID NO: 490775 - DNA, 25 bp, Mus musculus
gagggtcttcaataactttcgagtt

SEQ ID NO: 490776 - DNA, 25 bp, Mus musculus
gagggtcttctcctttggacgccat

SEQ ID NO: 490777 - DNA, 25 bp, Mus musculus
gagggtcttctcgtttggacgccat

SEQ ID NO: 490778 - DNA, 25 bp, Mus musculus
gagggtcttgaacattacttttgaa

SEQ ID NO: 490779 - DNA, 25 bp, Mus musculus
gagggtcttgaagattacttttgaa

SEQ ID NO: 490780 - DNA, 25 bp, Mus musculus
gagggtcttgccaattaagtactga

SEQ ID NO: 490781 - DNA, 25 bp, Mus musculus
gagggtcttgcctattaagtactga

SEQ ID NO: 490782 - DNA, 25 bp, Mus musculus
gagggtcttggaacaattacttaca

SEQ ID NO: 490783 - DNA, 25 bp, Mus musculus
gagggtcttggatcaattacttaca

SEQ ID NO: 490784 - DNA, 25 bp, Mus musculus
gagggtctttgcagggcctgttaaa

SEQ ID NO: 490785 - DNA, 25 bp, Mus musculus
gagggtctttgccattagactgctt

SEQ ID NO: 490786 - DNA, 25 bp, Mus musculus
gagggtctttgcgattagactgctt

SEQ ID NO: 490787 - DNA, 25 bp, Mus musculus
gagggtctttgctgggcctgttaaa

SEQ ID NO: 490788 - DNA, 25 bp, Mus musculus
gagggtgaacagagtttacttcatc

SEQ ID NO: 490789 - DNA, 25 bp, Mus musculus
gagggtgaacagtgtttacttcatc

SEQ ID NO: 490790 - DNA, 25 bp, Mus musculus
gagggtgaaccaatgggccccagca

SEQ ID NO: 490791 - DNA, 25 bp, Mus musculus
gagggtgaaccattgggccccagca

SEQ ID NO: 490792 - DNA, 25 bp, Mus musculus
gagggtgaatcacacctgtgtctga

SEQ ID NO: 490793 - DNA, 25 bp, Mus musculus
gagggtgaatcagacctgtgtctga

SEQ ID NO: 490794 - DNA, 25 bp, Mus musculus
gagggtgacactacttgaaaggact

SEQ ID NO: 490795 - DNA, 25 bp, Mus musculus
gagggtgacacttcttgaaaggact

SEQ ID NO: 490796 - DNA, 25 bp, Mus musculus
gagggtgacagtctctcgaactgaa

SEQ ID NO: 490797 - DNA, 25 bp, Mus musculus
gagggtgacagtgtctcgaactgaa

SEQ ID NO: 490798 - DNA, 25 bp, Mus musculus
gagggtgaccctcatgcttttggac

SEQ ID NO: 490799 - DNA, 25 bp, Mus musculus
gagggtgaccctgatgcttttggac

SEQ ID NO: 490800 - DNA, 25 bp, Mus musculus
gagggtgacggtcccccccagcttt

SEQ ID NO: 490801 - DNA, 25 bp, Mus musculus
gagggtgacggtgccccccagcttt

SEQ ID NO: 490802 - DNA, 25 bp, Mus musculus
gagggtgactgcattactcaggcta

SEQ ID NO: 490803 - DNA, 25 bp, Mus musculus
gagggtgactgctttactcaggcta

SEQ ID NO: 490804 - DNA, 25 bp, Mus musculus
gagggtgactttcaaatgcttagaa

SEQ ID NO: 490805 - DNA, 25 bp, Mus musculus
gagggtgactttgaaatgcttagaa

SEQ ID NO: 490806 - DNA, 25 bp, Mus musculus
gagggtgagaagcactcccctcgcc

SEQ ID NO: 490807 - DNA, 25 bp, Mus musculus
gagggtgagaaggactcccctcgcc

SEQ ID NO: 490808 - DNA, 25 bp, Mus musculus
gagggtgagactacctacatccgag

SEQ ID NO: 490809 - DNA, 25 bp, Mus musculus
gagggtgagactccctgtgttactt

SEQ ID NO: 490810 - DNA, 25 bp, Mus musculus
gagggtgagactgcctgtgttactt

SEQ ID NO: 490811 - DNA, 25 bp, Mus musculus
gagggtgagacttcctacatccgag

SEQ ID NO: 490812 - DNA, 25 bp, Mus musculus
gagggtgagcctattatcattatat

SEQ ID NO: 490813 - DNA, 25 bp, Mus musculus
gagggtgagccttttatcattatat

SEQ ID NO: 490814 - DNA, 25 bp, Mus musculus
gagggtgagcgactcctgtactgta

SEQ ID NO: 490815 - DNA, 25 bp, Mus musculus
gagggtgagcgagtcctgtactgta

SEQ ID NO: 490816 - DNA, 25 bp, Mus musculus
gagggtgagctaaccttctatgact

SEQ ID NO: 490817 - DNA, 25 bp, Mus musculus
gagggtgagctatccttctatgact

SEQ ID NO: 490818 - DNA, 25 bp, Mus musculus
gagggtgagctcctttggtttacaa

SEQ ID NO: 490819 - DNA, 25 bp, Mus musculus
gagggtgagctcgtttggtttacaa

SEQ ID NO: 490820 - DNA, 25 bp, Mus musculus
gagggtgagctgcagcctcaggccc

SEQ ID NO: 490821 - DNA, 25 bp, Mus musculus
gagggtgagctggagcctcaggccc

SEQ ID NO: 490822 - DNA, 25 bp, Mus musculus
gagggtgaggaaaattaactttcca

SEQ ID NO: 490823 - DNA, 25 bp, Mus musculus
gagggtgaggaatattaactttcca

SEQ ID NO: 490824 - DNA, 25 bp, Mus musculus
gagggtgaggccagtgacccatccc

SEQ ID NO: 490825 - DNA, 25 bp, Mus musculus
gagggtgaggcctgtgacccatccc

SEQ ID NO: 490826 - DNA, 25 bp, Mus musculus
gagggtgagtctatgactgttatgt

SEQ ID NO: 490827 - DNA, 25 bp, Mus musculus
gagggtgagtctttgactgttatgt

SEQ ID NO: 490828 - DNA, 25 bp, Mus musculus
gagggtgatccgctatttgtaacag

SEQ ID NO: 490829 - DNA, 25 bp, Mus musculus
gagggtgatccggtatttgtaacag

SEQ ID NO: 490830 - DNA, 25 bp, Mus musculus
gagggtgatctgcagcatctcttct

SEQ ID NO: 490831 - DNA, 25 bp, Mus musculus
gagggtgatctggagcatctcttct

SEQ ID NO: 490832 - DNA, 25 bp, Mus musculus
gagggtgatgaaccacaccgctcca

SEQ ID NO: 490833 - DNA, 25 bp, Mus musculus
gagggtgatgaagcacaccgctcca

SEQ ID NO: 490834 - DNA, 25 bp, Mus musculus
gagggtgatgcaacctccaagtccc

SEQ ID NO: 490835 - DNA, 25 bp, Mus musculus
gagggtgatgcatcctccaagtccc

SEQ ID NO: 490836 - DNA, 25 bp, Mus musculus
gagggtgatgtgaaagctgcttttt

SEQ ID NO: 490837 - DNA, 25 bp, Mus musculus
gagggtgatgtgtaagctgcttttt

SEQ ID NO: 490838 - DNA, 25 bp, Mus musculus
gagggtgattaactcatgggttcat

SEQ ID NO: 490839 - DNA, 25 bp, Mus musculus
gagggtgattaagtcatgggttcat

SEQ ID NO: 490840 - DNA, 25 bp, Mus musculus
gagggtgcaacaccagaccagactg

SEQ ID NO: 490841 - DNA, 25 bp, Mus musculus
gagggtgcaacagcagaccagactg

SEQ ID NO: 490842 - DNA, 25 bp, Mus musculus
gagggtgcatctagctgtagctgtc

SEQ ID NO: 490843 - DNA, 25 bp, Mus musculus
gagggtgcatcttgctgtagctgtc

SEQ ID NO: 490844 - DNA, 25 bp, Mus musculus
gagggtgccaaacctttagcaccaa

SEQ ID NO: 490845 - DNA, 25 bp, Mus musculus
gagggtgccaaagctttagcaccaa

SEQ ID NO: 490846 - DNA, 25 bp, Mus musculus
gagggtgccaccaacccacaaatta

SEQ ID NO: 490847 - DNA, 25 bp, Mus musculus
gagggtgccacctacccacaaatta

SEQ ID NO: 490848 - DNA, 25 bp, Mus musculus
gagggtgcctgaaacacagctcttc

SEQ ID NO: 490849 - DNA, 25 bp, Mus musculus
gagggtgcctgaagacctactgtgt

SEQ ID NO: 490850 - DNA, 25 bp, Mus musculus
gagggtgcctgatacacagctcttc

SEQ ID NO: 490851 - DNA, 25 bp, Mus musculus
gagggtgcctgatgacctactgtgt

SEQ ID NO: 490852 - DNA, 25 bp, Mus musculus
gagggtgcgctgagcaatattgtca

SEQ ID NO: 490853 - DNA, 25 bp, Mus musculus
gagggtgcgctgtgcaatattgtca

SEQ ID NO: 490854 - DNA, 25 bp, Mus musculus
gagggtgctatgattcactttttgt

SEQ ID NO: 490855 - DNA, 25 bp, Mus musculus
gagggtgctatgtttcactttttgt

SEQ ID NO: 490856 - DNA, 25 bp, Mus musculus
gagggtgctattctcctttttgaat

SEQ ID NO: 490857 - DNA, 25 bp, Mus musculus
gagggtgctattgtcctttttgaat

SEQ ID NO: 490858 - DNA, 25 bp, Mus musculus
gagggtgctcggatcaccagcagca

SEQ ID NO: 490859 - DNA, 25 bp, Mus musculus
gagggtgctcggttcaccagcagca

SEQ ID NO: 490860 - DNA, 25 bp, Mus musculus
gagggtgcttggaatctaacatgtt

SEQ ID NO: 490861 - DNA, 25 bp, Mus musculus
gagggtgcttggtatctaacatgtt

SEQ ID NO: 490862 - DNA, 25 bp, Mus musculus
gagggtgcttgtccaatatgagaac

SEQ ID NO: 490863 - DNA, 25 bp, Mus musculus
gagggtgcttgtgcaatatgagaac

SEQ ID NO: 490864 - DNA, 25 bp, Mus musculus
gagggtggacatagccatgtcaaga

SEQ ID NO: 490865 - DNA, 25 bp, Mus musculus
gagggtggacattgccatgtcaaga

SEQ ID NO: 490866 - DNA, 25 bp, Mus musculus
gagggtggacctccttcttactctg

SEQ ID NO: 490867 - DNA, 25 bp, Mus musculus
gagggtggacctgcttcttactctg

SEQ ID NO: 490868 - DNA, 25 bp, Mus musculus
gagggtggcagaacccatcaaccac

SEQ ID NO: 490869 - DNA, 25 bp, Mus musculus
gagggtggcagatcccatcaaccac

SEQ ID NO: 490870 - DNA, 25 bp, Mus musculus
gagggtggcataccatttgcctata

SEQ ID NO: 490871 - DNA, 25 bp, Mus musculus
gagggtggcatagcatttgcctata

SEQ ID NO: 490872 - DNA, 25 bp, Mus musculus
gagggtggccccagacaagcacaga

SEQ ID NO: 490873 - DNA, 25 bp, Mus musculus
gagggtggcccctgacaagcacaga

SEQ ID NO: 490874 - DNA, 25 bp, Mus musculus
gagggtggcctgaaatcctttgagc

SEQ ID NO: 490875 - DNA, 25 bp, Mus musculus
gagggtggcctgtaatcctttgagc

SEQ ID NO: 490876 - DNA, 25 bp, Mus musculus
gagggtggctctaaaaagctctcag

SEQ ID NO: 490877 - DNA, 25 bp, Mus musculus
gagggtggctcttaaaagctctcag

SEQ ID NO: 490878 - DNA, 25 bp, Mus musculus
gagggtggctgaaagcaactgactt

SEQ ID NO: 490879 - DNA, 25 bp, Mus musculus
gagggtggctgatagcaactgactt

SEQ ID NO: 490880 - DNA, 25 bp, Mus musculus
gagggtggcttaaacaaaccttact

SEQ ID NO: 490881 - DNA, 25 bp, Mus musculus
gagggtggcttatacaaaccttact

SEQ ID NO: 490882 - DNA, 25 bp, Mus musculus
gagggtggcttcagtgtttaccctg

SEQ ID NO: 490883 - DNA, 25 bp, Mus musculus
gagggtggcttctgtgtttaccctg

SEQ ID NO: 490884 - DNA, 25 bp, Mus musculus
gagggtgggaagatctctttataat

SEQ ID NO: 490885 - DNA, 25 bp, Mus musculus
gagggtgggaagttctctttataat

SEQ ID NO: 490886 - DNA, 25 bp, Mus musculus
gagggtgggcaactcccacttccat

SEQ ID NO: 490887 - DNA, 25 bp, Mus musculus
gagggtgggcaagtcccacttccat

SEQ ID NO: 490888 - DNA, 25 bp, Mus musculus
gagggtgggcagagcttcccttcat

SEQ ID NO: 490889 - DNA, 25 bp, Mus musculus
gagggtgggcagtgcttcccttcat

SEQ ID NO: 490890 - DNA, 25 bp, Mus musculus
gagggtgggtctcacatttgctttt

SEQ ID NO: 490891 - DNA, 25 bp, Mus musculus
gagggtgggtctgacatttgctttt

SEQ ID NO: 490892 - DNA, 25 bp, Mus musculus
gagggtgggtggctatagcggactt

SEQ ID NO: 490893 - DNA, 25 bp, Mus musculus
gagggtgggtgggtatagcggactt

SEQ ID NO: 490894 - DNA, 25 bp, Mus musculus
gagggtggtatcatccggagtcact

SEQ ID NO: 490895 - DNA, 25 bp, Mus musculus
gagggtggtatcttccggagtcact

SEQ ID NO: 490896 - DNA, 25 bp, Mus musculus
gagggtggtccgaactgtccaaagt

SEQ ID NO: 490897 - DNA, 25 bp, Mus musculus
gagggtggtccgtactgtccaaagt

SEQ ID NO: 490898 - DNA, 25 bp, Mus musculus
gagggtgtagaaatcaaactctatt

SEQ ID NO: 490899 - DNA, 25 bp, Mus musculus
gagggtgtagaattcaaactctatt

SEQ ID NO: 490900 - DNA, 25 bp, Mus musculus
gagggtgtagtgattcctactttat

SEQ ID NO: 490901 - DNA, 25 bp, Mus musculus
gagggtgtagtgtttcctactttat

SEQ ID NO: 490902 - DNA, 25 bp, Mus musculus
gagggtgtatggacagtatcttcaa

SEQ ID NO: 490903 - DNA, 25 bp, Mus musculus
gagggtgtatggtcagtatcttcaa

SEQ ID NO: 490904 - DNA, 25 bp, Mus musculus
gagggtgtcaaaatcccagaaactg

SEQ ID NO: 490905 - DNA, 25 bp, Mus musculus
gagggtgtcaaattcccagaaactg

SEQ ID NO: 490906 - DNA, 25 bp, Mus musculus
gagggtgtcaagattgtgttttcat

SEQ ID NO: 490907 - DNA, 25 bp, Mus musculus
gagggtgtcaagtttgtgttttcat

SEQ ID NO: 490908 - DNA, 25 bp, Mus musculus
gagggtgtcacacctctaccatgag

SEQ ID NO: 490909 - DNA, 25 bp, Mus musculus
gagggtgtcacagctctaccatgag

SEQ ID NO: 490910 - DNA, 25 bp, Mus musculus
gagggtgtcaccaaaacttctacga

SEQ ID NO: 490911 - DNA, 25 bp, Mus musculus
gagggtgtcaccagtcccactgagg

SEQ ID NO: 490912 - DNA, 25 bp, Mus musculus
gagggtgtcacctaaacttctacga

SEQ ID NO: 490913 - DNA, 25 bp, Mus musculus
gagggtgtcacctgtcccactgagg

SEQ ID NO: 490914 - DNA, 25 bp, Mus musculus
gagggtgtcaggcatatcctatcct

SEQ ID NO: 490915 - DNA, 25 bp, Mus musculus
gagggtgtcagggatatcctatcct

SEQ ID NO: 490916 - DNA, 25 bp, Mus musculus
gagggtgtcattcctatttacaaat

SEQ ID NO: 490917 - DNA, 25 bp, Mus musculus
gagggtgtcattgctatttacaaat

SEQ ID NO: 490918 - DNA, 25 bp, Mus musculus
gagggtgtccccattcaagttctca

SEQ ID NO: 490919 - DNA, 25 bp, Mus musculus
gagggtgtcccctttcaagttctca

SEQ ID NO: 490920 - DNA, 25 bp, Mus musculus
gagggtgtcttgaatccacttttca

SEQ ID NO: 490921 - DNA, 25 bp, Mus musculus
gagggtgtcttgtatccacttttca

SEQ ID NO: 490922 - DNA, 25 bp, Mus musculus
gagggtgtgcacacgcgccagctac

SEQ ID NO: 490923 - DNA, 25 bp, Mus musculus
gagggtgtgcactcgcgccagctac

SEQ ID NO: 490924 - DNA, 25 bp, Mus musculus
gagggtgtggacacgacaaatatct

SEQ ID NO: 490925 - DNA, 25 bp, Mus musculus
gagggtgtggactcgacaaatatct

SEQ ID NO: 490926 - DNA, 25 bp, Mus musculus
gagggtgtggcactagtcccaatat

SEQ ID NO: 490927 - DNA, 25 bp, Mus musculus
gagggtgtggcagtagtcccaatat

SEQ ID NO: 490928 - DNA, 25 bp, Mus musculus
gagggtgtgtagcttcccagcaatc

SEQ ID NO: 490929 - DNA, 25 bp, Mus musculus
gagggtgtgtaggttcccagcaatc

SEQ ID NO: 490930 - DNA, 25 bp, Mus musculus
gagggtgttcgcaaattcacatggc

SEQ ID NO: 490931 - DNA, 25 bp, Mus musculus
gagggtgttcgcagaaggattttta

SEQ ID NO: 490932 - DNA, 25 bp, Mus musculus
gagggtgttcgctaattcacatggc

SEQ ID NO: 490933 - DNA, 25 bp, Mus musculus
gagggtgttcgctgaaggattttta

SEQ ID NO: 490934 - DNA, 25 bp, Mus musculus
gagggtgttgcaattctggaagtaa

SEQ ID NO: 490935 - DNA, 25 bp, Mus musculus
gagggtgttgcatttctggaagtaa

SEQ ID NO: 490936 - DNA, 25 bp, Mus musculus
gagggtgtttcaagtcacatctgtt

SEQ ID NO: 490937 - DNA, 25 bp, Mus musculus
gagggtgtttcatgtcacatctgtt

SEQ ID NO: 490938 - DNA, 25 bp, Mus musculus
gagggttaatacagcgggtcccaga

SEQ ID NO: 490939 - DNA, 25 bp, Mus musculus
gagggttaatactgcgggtcccaga

SEQ ID NO: 490940 - DNA, 25 bp, Mus musculus
gagggttaatcgatgccttacaatg

SEQ ID NO: 490941 - DNA, 25 bp, Mus musculus
gagggttaatcgttgccttacaatg

SEQ ID NO: 490942 - DNA, 25 bp, Mus musculus
gagggttacatacgatttctccatt

SEQ ID NO: 490943 - DNA, 25 bp, Mus musculus
gagggttacataggatttctccatt

SEQ ID NO: 490944 - DNA, 25 bp, Mus musculus
gagggttactccaagttcagggcca

SEQ ID NO: 490945 - DNA, 25 bp, Mus musculus
gagggttactcctagttcagggcca

SEQ ID NO: 490946 - DNA, 25 bp, Mus musculus
gagggttagctgacttggagaaact

SEQ ID NO: 490947 - DNA, 25 bp, Mus musculus
gagggttagctgtcttggagaaact

SEQ ID NO: 490948 - DNA, 25 bp, Mus musculus
gagggttagggcacatactcaccaa

SEQ ID NO: 490949 - DNA, 25 bp, Mus musculus
gagggttagggctcatactcaccaa

SEQ ID NO: 490950 - DNA, 25 bp, Mus musculus
gagggttagtttatgatcagcacaa

SEQ ID NO: 490951 - DNA, 25 bp, Mus musculus
gagggttagtttatgtccacattca

SEQ ID NO: 490952 - DNA, 25 bp, Mus musculus
gagggttagtttttgatcagcacaa

SEQ ID NO: 490953 - DNA, 25 bp, Mus musculus
gagggttagtttttgtccacattca

SEQ ID NO: 490954 - DNA, 25 bp, Mus musculus
gagggttatcagatttctcccctgt

SEQ ID NO: 490955 - DNA, 25 bp, Mus musculus
gagggttatcagttttctcccctgt

SEQ ID NO: 490956 - DNA, 25 bp, Mus musculus
gagggttatgcaactgtacagtcta

SEQ ID NO: 490957 - DNA, 25 bp, Mus musculus
gagggttatgcatctgtacagtcta

SEQ ID NO: 490958 - DNA, 25 bp, Mus musculus
gagggttattctagcctacatagta

SEQ ID NO: 490959 - DNA, 25 bp, Mus musculus
gagggttattcttgcctacatagta

SEQ ID NO: 490960 - DNA, 25 bp, Mus musculus
gagggttcacatcgcatagtcctga

SEQ ID NO: 490961 - DNA, 25 bp, Mus musculus
gagggttcacatggcatagtcctga

SEQ ID NO: 490962 - DNA, 25 bp, Mus musculus
gagggttcaccgcagcaagagaaac

SEQ ID NO: 490963 - DNA, 25 bp, Mus musculus
gagggttcaccggagcaagagaaac

SEQ ID NO: 490964 - DNA, 25 bp, Mus musculus
gagggttcacctagatcagagccaa

SEQ ID NO: 490965 - DNA, 25 bp, Mus musculus
gagggttcaccttgatcagagccaa

SEQ ID NO: 490966 - DNA, 25 bp, Mus musculus
gagggttcagaaacgccccaggaag

SEQ ID NO: 490967 - DNA, 25 bp, Mus musculus
gagggttcagaatcgccccaggaag

SEQ ID NO: 490968 - DNA, 25 bp, Mus musculus
gagggttcagacaccttttgggata

SEQ ID NO: 490969 - DNA, 25 bp, Mus musculus
gagggttcagactccttttgggata

SEQ ID NO: 490970 - DNA, 25 bp, Mus musculus
gagggttccactctcttgagagctt

SEQ ID NO: 490971 - DNA, 25 bp, Mus musculus
gagggttccactgtcttgagagctt

SEQ ID NO: 490972 - DNA, 25 bp, Mus musculus
gagggttccagcctaaatgcctgcc

SEQ ID NO: 490973 - DNA, 25 bp, Mus musculus
gagggttccagcgtaaatgcctgcc

SEQ ID NO: 490974 - DNA, 25 bp, Mus musculus
gagggttccctgaaggctctgctgt

SEQ ID NO: 490975 - DNA, 25 bp, Mus musculus
gagggttccctgtaggctctgctgt

SEQ ID NO: 490976 - DNA, 25 bp, Mus musculus
gagggttccggcattgctgctagaa

SEQ ID NO: 490977 - DNA, 25 bp, Mus musculus
gagggttccggctttgctgctagaa

SEQ ID NO: 490978 - DNA, 25 bp, Mus musculus
gagggttctccacgactgaactaca

SEQ ID NO: 490979 - DNA, 25 bp, Mus musculus
gagggttctccaggactgaactaca

SEQ ID NO: 490980 - DNA, 25 bp, Mus musculus
gagggttctctgatcagtagcttca

SEQ ID NO: 490981 - DNA, 25 bp, Mus musculus
gagggttctctgttcagtagcttca

SEQ ID NO: 490982 - DNA, 25 bp, Mus musculus
gagggttctgaactaagccactgaa

SEQ ID NO: 490983 - DNA, 25 bp, Mus musculus
gagggttctgaagtaagccactgaa

SEQ ID NO: 490984 - DNA, 25 bp, Mus musculus
gagggttctgacatccaggtatttg

SEQ ID NO: 490985 - DNA, 25 bp, Mus musculus
gagggttctgacttccaggtatttg

SEQ ID NO: 490986 - DNA, 25 bp, Mus musculus
gagggttcttcgattcatgatggca

SEQ ID NO: 490987 - DNA, 25 bp, Mus musculus
gagggttcttcgtttcatgatggca

SEQ ID NO: 490988 - DNA, 25 bp, Mus musculus
gagggttcttctaagtgtatgcttg

SEQ ID NO: 490989 - DNA, 25 bp, Mus musculus
gagggttcttcttagtgtatgcttg

SEQ ID NO: 490990 - DNA, 25 bp, Mus musculus
gagggttcttgaagccagactgact

SEQ ID NO: 490991 - DNA, 25 bp, Mus musculus
gagggttcttgatgccagactgact

SEQ ID NO: 490992 - DNA, 25 bp, Mus musculus
gagggttgagtaatctttctggctt

SEQ ID NO: 490993 - DNA, 25 bp, Mus musculus
gagggttgagtattctttctggctt

SEQ ID NO: 490994 - DNA, 25 bp, Mus musculus
gagggttgctatacttccattgtac

SEQ ID NO: 490995 - DNA, 25 bp, Mus musculus
gagggttgctattcttccattgtac

SEQ ID NO: 490996 - DNA, 25 bp, Mus musculus
gagggttgctcaatctataaccact

SEQ ID NO: 490997 - DNA, 25 bp, Mus musculus
gagggttgctcattctataaccact

SEQ ID NO: 490998 - DNA, 25 bp, Mus musculus
gagggttgcttacagtggactatca

SEQ ID NO: 490999 - DNA, 25 bp, Mus musculus
gagggttgcttagagtggactatca

SEQ ID NO: 491000 - DNA, 25 bp, Mus musculus
gagggttggcacatacctagaaatc

SEQ ID NO: 491001 - DNA, 25 bp, Mus musculus
gagggttggcacttacctagaaatc

SEQ ID NO: 491002 - DNA, 25 bp, Mus musculus
gagggttgtcttagcaaaggcctta

SEQ ID NO: 491003 - DNA, 25 bp, Mus musculus
gagggttgtctttgcaaaggcctta

SEQ ID NO: 491004 - DNA, 25 bp, Mus musculus
gagggttgtggcattaacagctgct

SEQ ID NO: 491005 - DNA, 25 bp, Mus musculus
gagggttgtggctttaacagctgct

SEQ ID NO: 491006 - DNA, 25 bp, Mus musculus
gagggttgtgtaactctaccacatt

SEQ ID NO: 491007 - DNA, 25 bp, Mus musculus
gagggttgtgtatctctaccacatt

SEQ ID NO: 491008 - DNA, 25 bp, Mus musculus
gagggttgttccaagatcttatcca

SEQ ID NO: 491009 - DNA, 25 bp, Mus musculus
gagggttgttcctagatcttatcca

SEQ ID NO: 491010 - DNA, 25 bp, Mus musculus
gagggtttacgtatcatgctgagct

SEQ ID NO: 491011 - DNA, 25 bp, Mus musculus
gagggtttacgtttcatgctgagct

SEQ ID NO: 491012 - DNA, 25 bp, Mus musculus
gagggtttagtcattagaacaatca

SEQ ID NO: 491013 - DNA, 25 bp, Mus musculus
gagggtttagtctttagaacaatca

SEQ ID NO: 491014 - DNA, 25 bp, Mus musculus
gagggtttatgccagccagcctagc

SEQ ID NO: 491015 - DNA, 25 bp, Mus musculus
gagggtttatgcgagccagcctagc

SEQ ID NO: 491016 - DNA, 25 bp, Mus musculus
gagggtttcctacgacactcagatt

SEQ ID NO: 491017 - DNA, 25 bp, Mus musculus
gagggtttcctactgtacagctaca

SEQ ID NO: 491018 - DNA, 25 bp, Mus musculus
gagggtttcctaggacactcagatt

SEQ ID NO: 491019 - DNA, 25 bp, Mus musculus
gagggtttcctagtgtacagctaca

SEQ ID NO: 491020 - DNA, 25 bp, Mus musculus
gagggtttcttacgcatcctgttaa

SEQ ID NO: 491021 - DNA, 25 bp, Mus musculus
gagggtttcttaggcatcctgttaa

SEQ ID NO: 491022 - DNA, 25 bp, Mus musculus
gagggtttcttgctttcagaattat

SEQ ID NO: 491023 - DNA, 25 bp, Mus musculus
gagggtttcttggtttcagaattat

SEQ ID NO: 491024 - DNA, 25 bp, Mus musculus
gagggtttgcctattgagccgtctc

SEQ ID NO: 491025 - DNA, 25 bp, Mus musculus
gagggtttgccttttgagccgtctc

SEQ ID NO: 491026 - DNA, 25 bp, Mus musculus
gagggtttggaaaatgaattactgt

SEQ ID NO: 491027 - DNA, 25 bp, Mus musculus
gagggtttggaatatgaattactgt

SEQ ID NO: 491028 - DNA, 25 bp, Mus musculus
gagggtttgtctcttacagcaagtt

SEQ ID NO: 491029 - DNA, 25 bp, Mus musculus
gagggtttgtctgttacagcaagtt

SEQ ID NO: 491030 - DNA, 25 bp, Mus musculus
gagggttttagcacctgaaactgga

SEQ ID NO: 491031 - DNA, 25 bp, Mus musculus
gagggttttagctcctgaaactgga

SEQ ID NO: 491032 - DNA, 25 bp, Mus musculus
gagggttttctgaacttactttgtg

SEQ ID NO: 491033 - DNA, 25 bp, Mus musculus
gagggttttctgtacttactttgtg

SEQ ID NO: 491034 - DNA, 25 bp, Mus musculus
gaggtaaaagacctccagctgcatc

SEQ ID NO: 491035 - DNA, 25 bp, Mus musculus
gaggtaaaagacgtccagctgcatc

SEQ ID NO: 491036 - DNA, 25 bp, Mus musculus
gaggtaaaagcgacccttcagccta

SEQ ID NO: 491037 - DNA, 25 bp, Mus musculus
gaggtaaaagcgtcccttcagccta

SEQ ID NO: 491038 - DNA, 25 bp, Mus musculus
gaggtaaaatcgatctgctcccagc

SEQ ID NO: 491039 - DNA, 25 bp, Mus musculus
gaggtaaaatcgttctgctcccagc

SEQ ID NO: 491040 - DNA, 25 bp, Mus musculus
gaggtaaaccaccaagtcagcattt

SEQ ID NO: 491041 - DNA, 25 bp, Mus musculus
gaggtaaaccacgaagtcagcattt

SEQ ID NO: 491042 - DNA, 25 bp, Mus musculus
gaggtaaatcctaccagagtaagca

SEQ ID NO: 491043 - DNA, 25 bp, Mus musculus
gaggtaaatccttccagagtaagca

SEQ ID NO: 491044 - DNA, 25 bp, Mus musculus
gaggtaaatgagcacttctcactaa

SEQ ID NO: 491045 - DNA, 25 bp, Mus musculus
gaggtaaatgaggacttctcactaa

SEQ ID NO: 491046 - DNA, 25 bp, Mus musculus
gaggtaaattctcatgtggtacttg

SEQ ID NO: 491047 - DNA, 25 bp, Mus musculus
gaggtaaattctgatgtggtacttg

SEQ ID NO: 491048 - DNA, 25 bp, Mus musculus
gaggtaacaactccctcttctcgag

SEQ ID NO: 491049 - DNA, 25 bp, Mus musculus
gaggtaacaactgcctcttctcgag

SEQ ID NO: 491050 - DNA, 25 bp, Mus musculus
gaggtaacactgaccttacaacact

SEQ ID NO: 491051 - DNA, 25 bp, Mus musculus
gaggtaacactgtccttacaacact

SEQ ID NO: 491052 - DNA, 25 bp, Mus musculus
gaggtaacatgtctggttgtaccaa

SEQ ID NO: 491053 - DNA, 25 bp, Mus musculus
gaggtaacatgtgtggttgtaccaa

SEQ ID NO: 491054 - DNA, 25 bp, Mus musculus
gaggtaacatttactgatgaggtgt

SEQ ID NO: 491055 - DNA, 25 bp, Mus musculus
gaggtaacatttatccatagccaat

SEQ ID NO: 491056 - DNA, 25 bp, Mus musculus
gaggtaacattttctgatgaggtgt

SEQ ID NO: 491057 - DNA, 25 bp, Mus musculus
gaggtaacatttttccatagccaat

SEQ ID NO: 491058 - DNA, 25 bp, Mus musculus
gaggtaaccagtaccaattctccac

SEQ ID NO: 491059 - DNA, 25 bp, Mus musculus
gaggtaaccagttccaattctccac

SEQ ID NO: 491060 - DNA, 25 bp, Mus musculus
gaggtaacccccatacacagtgaag

SEQ ID NO: 491061 - DNA, 25 bp, Mus musculus
gaggtaacccccttacacagtgaag

SEQ ID NO: 491062 - DNA, 25 bp, Mus musculus
gaggtaacctctagtcataatttct

SEQ ID NO: 491063 - DNA, 25 bp, Mus musculus
gaggtaacctcttgtcataatttct

SEQ ID NO: 491064 - DNA, 25 bp, Mus musculus
gaggtaaccttgagtgtgtgcatca

SEQ ID NO: 491065 - DNA, 25 bp, Mus musculus
gaggtaaccttgtgtgtgtgcatca

SEQ ID NO: 491066 - DNA, 25 bp, Mus musculus
gaggtaacgcagatacagcactgta

SEQ ID NO: 491067 - DNA, 25 bp, Mus musculus
gaggtaacgcagttacagcactgta

SEQ ID NO: 491068 - DNA, 25 bp, Mus musculus
gaggtaactgagatttctctaaaag

SEQ ID NO: 491069 - DNA, 25 bp, Mus musculus
gaggtaactgagttttctctaaaag

SEQ ID NO: 491070 - DNA, 25 bp, Mus musculus
gaggtaactttgcacttgtgctgca

SEQ ID NO: 491071 - DNA, 25 bp, Mus musculus
gaggtaactttggacttgtgctgca

SEQ ID NO: 491072 - DNA, 25 bp, Mus musculus
gaggtaagaccaacctgactctctg

SEQ ID NO: 491073 - DNA, 25 bp, Mus musculus
gaggtaagaccatcctgactctctg

SEQ ID NO: 491074 - DNA, 25 bp, Mus musculus
gaggtaagacctagattcctacatg

SEQ ID NO: 491075 - DNA, 25 bp, Mus musculus
gaggtaagaccttgattcctacatg

SEQ ID NO: 491076 - DNA, 25 bp, Mus musculus
gaggtaagagctagttcaccccatc

SEQ ID NO: 491077 - DNA, 25 bp, Mus musculus
gaggtaagagcttgttcaccccatc

SEQ ID NO: 491078 - DNA, 25 bp, Mus musculus
gaggtaagcccaagctaaaacccca

SEQ ID NO: 491079 - DNA, 25 bp, Mus musculus
gaggtaagcccatgctaaaacccca

SEQ ID NO: 491080 - DNA, 25 bp, Mus musculus
gaggtaagccttatccacagaatat

SEQ ID NO: 491081 - DNA, 25 bp, Mus musculus
gaggtaagccttttccacagaatat

SEQ ID NO: 491082 - DNA, 25 bp, Mus musculus
gaggtaaggagcaaccagcagcctc

SEQ ID NO: 491083 - DNA, 25 bp, Mus musculus
gaggtaaggagctaccagcagcctc

SEQ ID NO: 491084 - DNA, 25 bp, Mus musculus
gaggtaaggttacagcactgattgt

SEQ ID NO: 491085 - DNA, 25 bp, Mus musculus
gaggtaaggttagagcactgattgt

SEQ ID NO: 491086 - DNA, 25 bp, Mus musculus
gaggtaaggttcactgtccactatg

SEQ ID NO: 491087 - DNA, 25 bp, Mus musculus
gaggtaaggttctctgtccactatg

SEQ ID NO: 491088 - DNA, 25 bp, Mus musculus
gaggtaagtaccctcaaaacttcat

SEQ ID NO: 491089 - DNA, 25 bp, Mus musculus
gaggtaagtaccgtcaaaacttcat

SEQ ID NO: 491090 - DNA, 25 bp, Mus musculus
gaggtaagtgccagtgctgtgcaca

SEQ ID NO: 491091 - DNA, 25 bp, Mus musculus
gaggtaagtgcctgtgctgtgcaca

SEQ ID NO: 491092 - DNA, 25 bp, Mus musculus
gaggtaagtttcagcttctccaagt

SEQ ID NO: 491093 - DNA, 25 bp, Mus musculus
gaggtaagtttctgcttctccaagt

SEQ ID NO: 491094 - DNA, 25 bp, Mus musculus
gaggtaatacatactatcaggagat

SEQ ID NO: 491095 - DNA, 25 bp, Mus musculus
gaggtaatacattctatcaggagat

SEQ ID NO: 491096 - DNA, 25 bp, Mus musculus
gaggtaatctcaagctttgtccaga

SEQ ID NO: 491097 - DNA, 25 bp, Mus musculus
gaggtaatctcatgctttgtccaga

SEQ ID NO: 491098 - DNA, 25 bp, Mus musculus
gaggtaatgcctctggtcgtcgtac

SEQ ID NO: 491099 - DNA, 25 bp, Mus musculus
gaggtaatgcctgtggtcgtcgtac

SEQ ID NO: 491100 - DNA, 25 bp, Mus musculus
gaggtaatgttgcaaatccgcccat

SEQ ID NO: 491101 - DNA, 25 bp, Mus musculus
gaggtaatgttggaaatccgcccat

SEQ ID NO: 491102 - DNA, 25 bp, Mus musculus
gaggtaattttcctcccagctttga

SEQ ID NO: 491103 - DNA, 25 bp, Mus musculus
gaggtaattttcgtcccagctttga

SEQ ID NO: 491104 - DNA, 25 bp, Mus musculus
gaggtacaactgagtcctgtgtcat

SEQ ID NO: 491105 - DNA, 25 bp, Mus musculus
gaggtacaactgtgtcctgtgtcat

SEQ ID NO: 491106 - DNA, 25 bp, Mus musculus
gaggtacacagcagacttgatcaga

SEQ ID NO: 491107 - DNA, 25 bp, Mus musculus
gaggtacacagctgacttgatcaga

SEQ ID NO: 491108 - DNA, 25 bp, Mus musculus
gaggtacactatagcctggcgcaga

SEQ ID NO: 491109 - DNA, 25 bp, Mus musculus
gaggtacactattgcctggcgcaga

SEQ ID NO: 491110 - DNA, 25 bp, Mus musculus
gaggtacactgtactacagataata

SEQ ID NO: 491111 - DNA, 25 bp, Mus musculus
gaggtacactgttctacagataata

SEQ ID NO: 491112 - DNA, 25 bp, Mus musculus
gaggtacaggacaggagaatcatcc

SEQ ID NO: 491113 - DNA, 25 bp, Mus musculus
gaggtacaggactggagaatcatcc

SEQ ID NO: 491114 - DNA, 25 bp, Mus musculus
gaggtacagtatattctacagtgga

SEQ ID NO: 491115 - DNA, 25 bp, Mus musculus
gaggtacagtattttctacagtgga

SEQ ID NO: 491116 - DNA, 25 bp, Mus musculus
gaggtacatagccatctgctttgat

SEQ ID NO: 491117 - DNA, 25 bp, Mus musculus
gaggtacatagcgatctgctttgat

SEQ ID NO: 491118 - DNA, 25 bp, Mus musculus
gaggtacatttccatccttgtaacc

SEQ ID NO: 491119 - DNA, 25 bp, Mus musculus
gaggtacatttcgatccttgtaacc

SEQ ID NO: 491120 - DNA, 25 bp, Mus musculus
gaggtaccaactatggttgatacaa

SEQ ID NO: 491121 - DNA, 25 bp, Mus musculus
gaggtaccaactttggttgatacaa

SEQ ID NO: 491122 - DNA, 25 bp, Mus musculus
gaggtaccacaaagtttcccgggct

SEQ ID NO: 491123 - DNA, 25 bp, Mus musculus
gaggtaccacaatgtttcccgggct

SEQ ID NO: 491124 - DNA, 25 bp, Mus musculus
gaggtaccagaactttggttcccag

SEQ ID NO: 491125 - DNA, 25 bp, Mus musculus
gaggtaccagaagtttggttcccag

SEQ ID NO: 491126 - DNA, 25 bp, Mus musculus
gaggtaccagaccacgagaccctga

SEQ ID NO: 491127 - DNA, 25 bp, Mus musculus
gaggtaccagacgacgagaccctga

SEQ ID NO: 491128 - DNA, 25 bp, Mus musculus
gaggtacccagaaatgcagcaagtc

SEQ ID NO: 491129 - DNA, 25 bp, Mus musculus
gaggtacccagatatgcagcaagtc

SEQ ID NO: 491130 - DNA, 25 bp, Mus musculus
gaggtaccctctccagtggtaggca

SEQ ID NO: 491131 - DNA, 25 bp, Mus musculus
gaggtaccctctgcagtggtaggca

SEQ ID NO: 491132 - DNA, 25 bp, Mus musculus
gaggtaccggcacctctggttcctg

SEQ ID NO: 491133 - DNA, 25 bp, Mus musculus
gaggtaccggcagctctggttcctg

SEQ ID NO: 491134 - DNA, 25 bp, Mus musculus
gaggtaccgtgtatccttgacattc

SEQ ID NO: 491135 - DNA, 25 bp, Mus musculus
gaggtaccgtgtttccttgacattc

SEQ ID NO: 491136 - DNA, 25 bp, Mus musculus
gaggtacctcccaggacattgggga

SEQ ID NO: 491137 - DNA, 25 bp, Mus musculus
gaggtacctccctggacattgggga

SEQ ID NO: 491138 - DNA, 25 bp, Mus musculus
gaggtacctggtacaggacccagca

SEQ ID NO: 491139 - DNA, 25 bp, Mus musculus
gaggtacctggttcaggacccagca

SEQ ID NO: 491140 - DNA, 25 bp, Mus musculus
gaggtacggtgaacgctgcttctca

SEQ ID NO: 491141 - DNA, 25 bp, Mus musculus
gaggtacggtgatcgctgcttctca

SEQ ID NO: 491142 - DNA, 25 bp, Mus musculus
gaggtactaaacaccaactccttca

SEQ ID NO: 491143 - DNA, 25 bp, Mus musculus
gaggtactaaactccaactccttca

SEQ ID NO: 491144 - DNA, 25 bp, Mus musculus
gaggtactagacagctcaaagagaa

SEQ ID NO: 491145 - DNA, 25 bp, Mus musculus
gaggtactagactgctcaaagagaa

SEQ ID NO: 491146 - DNA, 25 bp, Mus musculus
gaggtactatgaacgatttttaaaa

SEQ ID NO: 491147 - DNA, 25 bp, Mus musculus
gaggtactatgatcgatttttaaaa

SEQ ID NO: 491148 - DNA, 25 bp, Mus musculus
gaggtactcaaacgctagtttagca

SEQ ID NO: 491149 - DNA, 25 bp, Mus musculus
gaggtactcaaaggctagtttagca

SEQ ID NO: 491150 - DNA, 25 bp, Mus musculus
gaggtactcataaaacatttgttag

SEQ ID NO: 491151 - DNA, 25 bp, Mus musculus
gaggtactcatataacatttgttag

SEQ ID NO: 491152 - DNA, 25 bp, Mus musculus
gaggtactccaacatattgcaggct

SEQ ID NO: 491153 - DNA, 25 bp, Mus musculus
gaggtactccaagatattgcaggct

SEQ ID NO: 491154 - DNA, 25 bp, Mus musculus
gaggtactctctaaggagcaaacca

SEQ ID NO: 491155 - DNA, 25 bp, Mus musculus
gaggtactctcttaggagcaaacca

SEQ ID NO: 491156 - DNA, 25 bp, Mus musculus
gaggtactgtgtaacactctgcaca

SEQ ID NO: 491157 - DNA, 25 bp, Mus musculus
gaggtactgtgttacactctgcaca

SEQ ID NO: 491158 - DNA, 25 bp, Mus musculus
gaggtacttaccagcatcaatgcgg

SEQ ID NO: 491159 - DNA, 25 bp, Mus musculus
gaggtacttacctgcatcaatgcgg

SEQ ID NO: 491160 - DNA, 25 bp, Mus musculus
gaggtacttctgaactggtttccac

SEQ ID NO: 491161 - DNA, 25 bp, Mus musculus
gaggtacttctgatgtggtgtctta

SEQ ID NO: 491162 - DNA, 25 bp, Mus musculus
gaggtacttctgtactggtttccac

SEQ ID NO: 491163 - DNA, 25 bp, Mus musculus
gaggtacttctgttgtggtgtctta

SEQ ID NO: 491164 - DNA, 25 bp, Mus musculus
gaggtacttcttcatctgctggagc

SEQ ID NO: 491165 - DNA, 25 bp, Mus musculus
gaggtacttcttgatctgctggagc

SEQ ID NO: 491166 - DNA, 25 bp, Mus musculus
gaggtagaaactcctggccgagacc

SEQ ID NO: 491167 - DNA, 25 bp, Mus musculus
gaggtagaaactgctggccgagacc

SEQ ID NO: 491168 - DNA, 25 bp, Mus musculus
gaggtagaagtaattctcccaaagt

SEQ ID NO: 491169 - DNA, 25 bp, Mus musculus
gaggtagaagtatttctcccaaagt

SEQ ID NO: 491170 - DNA, 25 bp, Mus musculus
gaggtagaagttagcgcatctttaa

SEQ ID NO: 491171 - DNA, 25 bp, Mus musculus
gaggtagaagtttgcgcatctttaa

SEQ ID NO: 491172 - DNA, 25 bp, Mus musculus
gaggtagacattcctggcagcttcc

SEQ ID NO: 491173 - DNA, 25 bp, Mus musculus
gaggtagacattgctggcagcttcc

SEQ ID NO: 491174 - DNA, 25 bp, Mus musculus
gaggtagacctcaattattgggata

SEQ ID NO: 491175 - DNA, 25 bp, Mus musculus
gaggtagacctctattattgggata

SEQ ID NO: 491176 - DNA, 25 bp, Mus musculus
gaggtagagcccaggtccatcagct

SEQ ID NO: 491177 - DNA, 25 bp, Mus musculus
gaggtagagccctggtccatcagct

SEQ ID NO: 491178 - DNA, 25 bp, Mus musculus
gaggtagagggcctcctcaaccaga

SEQ ID NO: 491179 - DNA, 25 bp, Mus musculus
gaggtagagggcgtcctcaaccaga

SEQ ID NO: 491180 - DNA, 25 bp, Mus musculus
gaggtagatattatttccactttac

SEQ ID NO: 491181 - DNA, 25 bp, Mus musculus
gaggtagatattttttccactttac

SEQ ID NO: 491182 - DNA, 25 bp, Mus musculus
gaggtagatcgtctcagtgccctga

SEQ ID NO: 491183 - DNA, 25 bp, Mus musculus
gaggtagatcgtgtcagtgccctga

SEQ ID NO: 491184 - DNA, 25 bp, Mus musculus
gaggtagattacattgtccgtttat

SEQ ID NO: 491185 - DNA, 25 bp, Mus musculus
gaggtagattactttgtccgtttat

SEQ ID NO: 491186 - DNA, 25 bp, Mus musculus
gaggtagattcaaagttctgggaac

SEQ ID NO: 491187 - DNA, 25 bp, Mus musculus
gaggtagattcatagttctgggaac

SEQ ID NO: 491188 - DNA, 25 bp, Mus musculus
gaggtagatttacgcctgacttaaa

SEQ ID NO: 491189 - DNA, 25 bp, Mus musculus
gaggtagatttaggcctgacttaaa

SEQ ID NO: 491190 - DNA, 25 bp, Mus musculus
gaggtagcaaccatagcaccacaca

SEQ ID NO: 491191 - DNA, 25 bp, Mus musculus
gaggtagcaaccttagcaccacaca

SEQ ID NO: 491192 - DNA, 25 bp, Mus musculus
gaggtagcaattccttagtgtgcaa

SEQ ID NO: 491193 - DNA, 25 bp, Mus musculus
gaggtagcaattgcttagtgtgcaa

SEQ ID NO: 491194 - DNA, 25 bp, Mus musculus
gaggtagccaacaaacaattcctag

SEQ ID NO: 491195 - DNA, 25 bp, Mus musculus
gaggtagccaactaacaattcctag

SEQ ID NO: 491196 - DNA, 25 bp, Mus musculus
gaggtagccaataccggaggctctt

SEQ ID NO: 491197 - DNA, 25 bp, Mus musculus
gaggtagccaattccggaggctctt

SEQ ID NO: 491198 - DNA, 25 bp, Mus musculus
gaggtagctgatatcttaattaagg

SEQ ID NO: 491199 - DNA, 25 bp, Mus musculus
gaggtagctgatttcttaattaagg

SEQ ID NO: 491200 - DNA, 25 bp, Mus musculus
gaggtagctggcacttgtataatgg

SEQ ID NO: 491201 - DNA, 25 bp, Mus musculus
gaggtagctggctcttgtataatgg

SEQ ID NO: 491202 - DNA, 25 bp, Mus musculus
gaggtagcttatatcgacacttaat

SEQ ID NO: 491203 - DNA, 25 bp, Mus musculus
gaggtagcttatttcgacacttaat

SEQ ID NO: 491204 - DNA, 25 bp, Mus musculus
gaggtagctttaatgcctgaataca

SEQ ID NO: 491205 - DNA, 25 bp, Mus musculus
gaggtagctttattgcctgaataca

SEQ ID NO: 491206 - DNA, 25 bp, Mus musculus
gaggtaggaagaacctaagtccaat

SEQ ID NO: 491207 - DNA, 25 bp, Mus musculus
gaggtaggaagatcctaagtccaat

SEQ ID NO: 491208 - DNA, 25 bp, Mus musculus
gaggtaggagctaggccttccatga

SEQ ID NO: 491209 - DNA, 25 bp, Mus musculus
gaggtaggagcttggccttccatga

SEQ ID NO: 491210 - DNA, 25 bp, Mus musculus
gaggtaggcaagactctatgagctt

SEQ ID NO: 491211 - DNA, 25 bp, Mus musculus
gaggtaggcaagtctctatgagctt

SEQ ID NO: 491212 - DNA, 25 bp, Mus musculus
gaggtagggcctattaccagaccag

SEQ ID NO: 491213 - DNA, 25 bp, Mus musculus
gaggtagggccttttaccagaccag

SEQ ID NO: 491214 - DNA, 25 bp, Mus musculus
gaggtagggtttatcagttgaatct

SEQ ID NO: 491215 - DNA, 25 bp, Mus musculus
gaggtagggtttttcagttgaatct

SEQ ID NO: 491216 - DNA, 25 bp, Mus musculus
gaggtaggtcagcattccctcctca

SEQ ID NO: 491217 - DNA, 25 bp, Mus musculus
gaggtaggtcaggattccctcctca

SEQ ID NO: 491218 - DNA, 25 bp, Mus musculus
gaggtaggtctgagaattgcatgtt

SEQ ID NO: 491219 - DNA, 25 bp, Mus musculus
gaggtaggtctgtgaattgcatgtt

SEQ ID NO: 491220 - DNA, 25 bp, Mus musculus
gaggtaggtggaacactgcaagttt

SEQ ID NO: 491221 - DNA, 25 bp, Mus musculus
gaggtaggtggatcactgcaagttt

SEQ ID NO: 491222 - DNA, 25 bp, Mus musculus
gaggtagtatgcattccttggtgct

SEQ ID NO: 491223 - DNA, 25 bp, Mus musculus
gaggtagtatgctttccttggtgct

SEQ ID NO: 491224 - DNA, 25 bp, Mus musculus
gaggtagtcatacttcagaaccact

SEQ ID NO: 491225 - DNA, 25 bp, Mus musculus
gaggtagtcatagttcagaaccact

SEQ ID NO: 491226 - DNA, 25 bp, Mus musculus
gaggtagtccagagcagcaacacca

SEQ ID NO: 491227 - DNA, 25 bp, Mus musculus
gaggtagtccagtgcagcaacacca

SEQ ID NO: 491228 - DNA, 25 bp, Mus musculus
gaggtagtcttgacccaaaagcaat

SEQ ID NO: 491229 - DNA, 25 bp, Mus musculus
gaggtagtcttgtcccaaaagcaat

SEQ ID NO: 491230 - DNA, 25 bp, Mus musculus
gaggtagtgctccagtttctctgta

SEQ ID NO: 491231 - DNA, 25 bp, Mus musculus
gaggtagtgctcgagtttctctgta

SEQ ID NO: 491232 - DNA, 25 bp, Mus musculus
gaggtagttcaaactggagttaaat

SEQ ID NO: 491233 - DNA, 25 bp, Mus musculus
gaggtagttcaatctggagttaaat

SEQ ID NO: 491234 - DNA, 25 bp, Mus musculus
gaggtagttgccatgcctatttaat

SEQ ID NO: 491235 - DNA, 25 bp, Mus musculus
gaggtagttgccttgcctatttaat

SEQ ID NO: 491236 - DNA, 25 bp, Mus musculus
gaggtagttttccaacagatcacag

SEQ ID NO: 491237 - DNA, 25 bp, Mus musculus
gaggtagttttcgaacagatcacag

SEQ ID NO: 491238 - DNA, 25 bp, Mus musculus
gaggtataaaacacccagtgctatg

SEQ ID NO: 491239 - DNA, 25 bp, Mus musculus
gaggtataaaactcccagtgctatg

SEQ ID NO: 491240 - DNA, 25 bp, Mus musculus
gaggtataatggaccccgagggcca

SEQ ID NO: 491241 - DNA, 25 bp, Mus musculus
gaggtataatggtccccgagggcca

SEQ ID NO: 491242 - DNA, 25 bp, Mus musculus
gaggtatacaaaccttaggtctaat

SEQ ID NO: 491243 - DNA, 25 bp, Mus musculus
gaggtatacaaagcttaggtctaat

SEQ ID NO: 491244 - DNA, 25 bp, Mus musculus
gaggtataccaactgttctgctaga

SEQ ID NO: 491245 - DNA, 25 bp, Mus musculus
gaggtataccaagtgttctgctaga

SEQ ID NO: 491246 - DNA, 25 bp, Mus musculus
gaggtatactccctgcagtgagctg

SEQ ID NO: 491247 - DNA, 25 bp, Mus musculus
gaggtatactccgtgcagtgagctg

SEQ ID NO: 491248 - DNA, 25 bp, Mus musculus
gaggtatagcaccatggcttctctg

SEQ ID NO: 491249 - DNA, 25 bp, Mus musculus
gaggtatagcacgatggcttctctg

SEQ ID NO: 491250 - DNA, 25 bp, Mus musculus
gaggtatagggaacacagctctaca

SEQ ID NO: 491251 - DNA, 25 bp, Mus musculus
gaggtatagggatcacagctctaca

SEQ ID NO: 491252 - DNA, 25 bp, Mus musculus
gaggtatatcatcaccagagactat

SEQ ID NO: 491253 - DNA, 25 bp, Mus musculus
gaggtatatcatgaccagagactat

SEQ ID NO: 491254 - DNA, 25 bp, Mus musculus
gaggtatatgccccactggaccctg

SEQ ID NO: 491255 - DNA, 25 bp, Mus musculus
gaggtatatgccgcactggaccctg

SEQ ID NO: 491256 - DNA, 25 bp, Mus musculus
gaggtatcactcagggtgccaagta

SEQ ID NO: 491257 - DNA, 25 bp, Mus musculus
gaggtatcactctgggtgccaagta

SEQ ID NO: 491258 - DNA, 25 bp, Mus musculus
gaggtatcaggtacacagtgcatgc

SEQ ID NO: 491259 - DNA, 25 bp, Mus musculus
gaggtatcaggttcacagtgcatgc

SEQ ID NO: 491260 - DNA, 25 bp, Mus musculus
gaggtatcatgcatcatgttggcat

SEQ ID NO: 491261 - DNA, 25 bp, Mus musculus
gaggtatcatgcttcatgttggcat

SEQ ID NO: 491262 - DNA, 25 bp, Mus musculus
gaggtatccagtatcctggaccgaa

SEQ ID NO: 491263 - DNA, 25 bp, Mus musculus
gaggtatccagtttcctggaccgaa

SEQ ID NO: 491264 - DNA, 25 bp, Mus musculus
gaggtatccatgcaggagtccgcca

SEQ ID NO: 491265 - DNA, 25 bp, Mus musculus
gaggtatccatggaggagtccgcca

SEQ ID NO: 491266 - DNA, 25 bp, Mus musculus
gaggtatccttaacatgctgacttc

SEQ ID NO: 491267 - DNA, 25 bp, Mus musculus
gaggtatccttatcatgctgacttc

SEQ ID NO: 491268 - DNA, 25 bp, Mus musculus
gaggtatctctaccattggcctttc

SEQ ID NO: 491269 - DNA, 25 bp, Mus musculus
gaggtatctctagcattggcctttc

SEQ ID NO: 491270 - DNA, 25 bp, Mus musculus
gaggtatctgggagaacctaccctt

SEQ ID NO: 491271 - DNA, 25 bp, Mus musculus
gaggtatctgggtgaacctaccctt

SEQ ID NO: 491272 - DNA, 25 bp, Mus musculus
gaggtatctgtaactttgaaagcaa

SEQ ID NO: 491273 - DNA, 25 bp, Mus musculus
gaggtatctgtatctttgaaagcaa

SEQ ID NO: 491274 - DNA, 25 bp, Mus musculus
gaggtatcttggaatctcggtactc

SEQ ID NO: 491275 - DNA, 25 bp, Mus musculus
gaggtatcttggtatctcggtactc

SEQ ID NO: 491276 - DNA, 25 bp, Mus musculus
gaggtatcttttccagctacattat

SEQ ID NO: 491277 - DNA, 25 bp, Mus musculus
gaggtatcttttctggacgattccc

SEQ ID NO: 491278 - DNA, 25 bp, Mus musculus
gaggtatcttttgcagctacattat

SEQ ID NO: 491279 - DNA, 25 bp, Mus musculus
gaggtatcttttgtggacgattccc

SEQ ID NO: 491280 - DNA, 25 bp, Mus musculus
gaggtatgaaccattgcgattaaaa

SEQ ID NO: 491281 - DNA, 25 bp, Mus musculus
gaggtatgaacctttgcgattaaaa

SEQ ID NO: 491282 - DNA, 25 bp, Mus musculus
gaggtatgacagatggaaagtccag

SEQ ID NO: 491283 - DNA, 25 bp, Mus musculus
gaggtatgacagttggaaagtccag

SEQ ID NO: 491284 - DNA, 25 bp, Mus musculus
gaggtatgagctcacgcttagcacc

SEQ ID NO: 491285 - DNA, 25 bp, Mus musculus
gaggtatgagctgacgcttagcacc

SEQ ID NO: 491286 - DNA, 25 bp, Mus musculus
gaggtatggccgatggaccgtacca

SEQ ID NO: 491287 - DNA, 25 bp, Mus musculus
gaggtatggccgttggaccgtacca

SEQ ID NO: 491288 - DNA, 25 bp, Mus musculus
gaggtatggtctccagtccccggat

SEQ ID NO: 491289 - DNA, 25 bp, Mus musculus
gaggtatggtctgcagtccccggat

SEQ ID NO: 491290 - DNA, 25 bp, Mus musculus
gaggtatgtatcacccgagaactct

SEQ ID NO: 491291 - DNA, 25 bp, Mus musculus
gaggtatgtatctcccgagaactct

SEQ ID NO: 491292 - DNA, 25 bp, Mus musculus
gaggtatgtctgataactcaccaca

SEQ ID NO: 491293 - DNA, 25 bp, Mus musculus
gaggtatgtctgttaactcaccaca

SEQ ID NO: 491294 - DNA, 25 bp, Mus musculus
gaggtatgtggacctcatagtctat

SEQ ID NO: 491295 - DNA, 25 bp, Mus musculus
gaggtatgtggagctcatagtctat

SEQ ID NO: 491296 - DNA, 25 bp, Mus musculus
gaggtattactacaacggcgcttcc

SEQ ID NO: 491297 - DNA, 25 bp, Mus musculus
gaggtattactagaacggcgcttcc

SEQ ID NO: 491298 - DNA, 25 bp, Mus musculus
gaggtattacttattccttgccaag

SEQ ID NO: 491299 - DNA, 25 bp, Mus musculus
gaggtattactttttccttgccaag

SEQ ID NO: 491300 - DNA, 25 bp, Mus musculus
gaggtattatctcggtcttcagccg

SEQ ID NO: 491301 - DNA, 25 bp, Mus musculus
gaggtattatctgggtcttcagccg

SEQ ID NO: 491302 - DNA, 25 bp, Mus musculus
gaggtattccaccatcctcttgttg

SEQ ID NO: 491303 - DNA, 25 bp, Mus musculus
gaggtattccacgatcctcttgttg

SEQ ID NO: 491304 - DNA, 25 bp, Mus musculus
gaggtattgaccacaccatgtctgc

SEQ ID NO: 491305 - DNA, 25 bp, Mus musculus
gaggtattgacctcaccatgtctgc

SEQ ID NO: 491306 - DNA, 25 bp, Mus musculus
gaggtattgactatgagagcacaga

SEQ ID NO: 491307 - DNA, 25 bp, Mus musculus
gaggtattgactttgagagcacaga

SEQ ID NO: 491308 - DNA, 25 bp, Mus musculus
gaggtattgatgacagccctctccg

SEQ ID NO: 491309 - DNA, 25 bp, Mus musculus
gaggtattgatgtcagccctctccg

SEQ ID NO: 491310 - DNA, 25 bp, Mus musculus
gaggtatttgctcttctcctgaaga

SEQ ID NO: 491311 - DNA, 25 bp, Mus musculus
gaggtatttgctgttctcctgaaga

SEQ ID NO: 491312 - DNA, 25 bp, Mus musculus
gaggtattttgaactcaaccactct

SEQ ID NO: 491313 - DNA, 25 bp, Mus musculus
gaggtattttgatctcaaccactct

SEQ ID NO: 491314 - DNA, 25 bp, Mus musculus
gaggtcaaacctctcgtggaacctg

SEQ ID NO: 491315 - DNA, 25 bp, Mus musculus
gaggtcaaacctgtcgtggaacctg

SEQ ID NO: 491316 - DNA, 25 bp, Mus musculus
gaggtcaaactgcagttctcacatt

SEQ ID NO: 491317 - DNA, 25 bp, Mus musculus
gaggtcaaactggagttctcacatt

SEQ ID NO: 491318 - DNA, 25 bp, Mus musculus
gaggtcaaatgcaaccctttaaggg

SEQ ID NO: 491319 - DNA, 25 bp, Mus musculus
gaggtcaaatgctaccctttaaggg

SEQ ID NO: 491320 - DNA, 25 bp, Mus musculus
gaggtcaacatcacccaaagcattc

SEQ ID NO: 491321 - DNA, 25 bp, Mus musculus
gaggtcaacatctcccaaagcattc

SEQ ID NO: 491322 - DNA, 25 bp, Mus musculus
gaggtcaacatgatcttctaagtca

SEQ ID NO: 491323 - DNA, 25 bp, Mus musculus
gaggtcaacatgttcttctaagtca

SEQ ID NO: 491324 - DNA, 25 bp, Mus musculus
gaggtcaaccaaattcctgtgggtc

SEQ ID NO: 491325 - DNA, 25 bp, Mus musculus
gaggtcaaccaatttcctgtgggtc

SEQ ID NO: 491326 - DNA, 25 bp, Mus musculus
gaggtcaacgtgaggtccacagcca

SEQ ID NO: 491327 - DNA, 25 bp, Mus musculus
gaggtcaacgtgtggtccacagcca

SEQ ID NO: 491328 - DNA, 25 bp, Mus musculus
gaggtcaactgcctcggccaggact

SEQ ID NO: 491329 - DNA, 25 bp, Mus musculus
gaggtcaactgcgtcggccaggact

SEQ ID NO: 491330 - DNA, 25 bp, Mus musculus
gaggtcaagaagccctatgtggagg

SEQ ID NO: 491331 - DNA, 25 bp, Mus musculus
gaggtcaagaaggcctatgtggagg

SEQ ID NO: 491332 - DNA, 25 bp, Mus musculus
gaggtcaagaccacgttgctgacac

SEQ ID NO: 491333 - DNA, 25 bp, Mus musculus
gaggtcaagaccaggtggcacaacc

SEQ ID NO: 491334 - DNA, 25 bp, Mus musculus
gaggtcaagacctcgttgctgacac

SEQ ID NO: 491335 - DNA, 25 bp, Mus musculus
gaggtcaagacctggtggcacaacc

SEQ ID NO: 491336 - DNA, 25 bp, Mus musculus
gaggtcaagaggctcagctcccatc

SEQ ID NO: 491337 - DNA, 25 bp, Mus musculus
gaggtcaagagggtcagctcccatc

SEQ ID NO: 491338 - DNA, 25 bp, Mus musculus
gaggtcaagccaatgcctgcaagtt

SEQ ID NO: 491339 - DNA, 25 bp, Mus musculus
gaggtcaagccattgcctgcaagtt

SEQ ID NO: 491340 - DNA, 25 bp, Mus musculus
gaggtcaagctcagatcccaaaact

SEQ ID NO: 491341 - DNA, 25 bp, Mus musculus
gaggtcaagctctgatcccaaaact

SEQ ID NO: 491342 - DNA, 25 bp, Mus musculus
gaggtcaatattaccacctgggcca

SEQ ID NO: 491343 - DNA, 25 bp, Mus musculus
gaggtcaatatttccacctgggcca

SEQ ID NO: 491344 - DNA, 25 bp, Mus musculus
gaggtcaatccccaatggtaccttc

SEQ ID NO: 491345 - DNA, 25 bp, Mus musculus
gaggtcaatcccgaatggtaccttc

SEQ ID NO: 491346 - DNA, 25 bp, Mus musculus
gaggtcaattctagaggtcaggact

SEQ ID NO: 491347 - DNA, 25 bp, Mus musculus
gaggtcaattcttgaggtcaggact

SEQ ID NO: 491348 - DNA, 25 bp, Mus musculus
gaggtcacaaacactggtcacaggt

SEQ ID NO: 491349 - DNA, 25 bp, Mus musculus
gaggtcacaaactctggtcacaggt

SEQ ID NO: 491350 - DNA, 25 bp, Mus musculus
gaggtcacacagaaagctctgtctt

SEQ ID NO: 491351 - DNA, 25 bp, Mus musculus
gaggtcacacagtaagctctgtctt

SEQ ID NO: 491352 - DNA, 25 bp, Mus musculus
gaggtcacagcaagttttacttgta

SEQ ID NO: 491353 - DNA, 25 bp, Mus musculus
gaggtcacagcatgttttacttgta

SEQ ID NO: 491354 - DNA, 25 bp, Mus musculus
gaggtcacaggcaccacttaggtat

SEQ ID NO: 491355 - DNA, 25 bp, Mus musculus
gaggtcacaggctccacttaggtat

SEQ ID NO: 491356 - DNA, 25 bp, Mus musculus
gaggtcacatcaactactgtcgaat

SEQ ID NO: 491357 - DNA, 25 bp, Mus musculus
gaggtcacatcatctactgtcgaat

SEQ ID NO: 491358 - DNA, 25 bp, Mus musculus
gaggtcacatctaatgtcttgagca

SEQ ID NO: 491359 - DNA, 25 bp, Mus musculus
gaggtcacatcttatgtcttgagca

SEQ ID NO: 491360 - DNA, 25 bp, Mus musculus
gaggtcacatggctaacttcagtct

SEQ ID NO: 491361 - DNA, 25 bp, Mus musculus
gaggtcacatgggtaacttcagtct

SEQ ID NO: 491362 - DNA, 25 bp, Mus musculus
gaggtcacatgtatccatctctccg

SEQ ID NO: 491363 - DNA, 25 bp, Mus musculus
gaggtcacatgtttccatctctccg

SEQ ID NO: 491364 - DNA, 25 bp, Mus musculus
gaggtcacattccaggaggctcagc

SEQ ID NO: 491365 - DNA, 25 bp, Mus musculus
gaggtcacattcgaggaggctcagc

SEQ ID NO: 491366 - DNA, 25 bp, Mus musculus
gaggtcaccagaaagttatatatga

SEQ ID NO: 491367 - DNA, 25 bp, Mus musculus
gaggtcaccagatagttatatatga

SEQ ID NO: 491368 - DNA, 25 bp, Mus musculus
gaggtcaccctgatgtggctaccat

SEQ ID NO: 491369 - DNA, 25 bp, Mus musculus
gaggtcaccctgttgtggctaccat

SEQ ID NO: 491370 - DNA, 25 bp, Mus musculus
gaggtcaccggactttactgtttgt

SEQ ID NO: 491371 - DNA, 25 bp, Mus musculus
gaggtcaccggagtttactgtttgt

SEQ ID NO: 491372 - DNA, 25 bp, Mus musculus
gaggtcacctcacaccctgagtttc

SEQ ID NO: 491373 - DNA, 25 bp, Mus musculus
gaggtcacctcagaccctgagtttc

SEQ ID NO: 491374 - DNA, 25 bp, Mus musculus
gaggtcactcctatttgtgtctcac

SEQ ID NO: 491375 - DNA, 25 bp, Mus musculus
gaggtcactcctttttgtgtctcac

SEQ ID NO: 491376 - DNA, 25 bp, Mus musculus
gaggtcactcgtaacatggacttca

SEQ ID NO: 491377 - DNA, 25 bp, Mus musculus
gaggtcactcgttacatggacttca

SEQ ID NO: 491378 - DNA, 25 bp, Mus musculus
gaggtcactctcattgaaacacgtt

SEQ ID NO: 491379 - DNA, 25 bp, Mus musculus
gaggtcactctctttgaaacacgtt

SEQ ID NO: 491380 - DNA, 25 bp, Mus musculus
gaggtcactgcaattgactggaaat

SEQ ID NO: 491381 - DNA, 25 bp, Mus musculus
gaggtcactgcatttgactggaaat

SEQ ID NO: 491382 - DNA, 25 bp, Mus musculus
gaggtcactggtcaccacattccca

SEQ ID NO: 491383 - DNA, 25 bp, Mus musculus
gaggtcactggtgaccacattccca

SEQ ID NO: 491384 - DNA, 25 bp, Mus musculus
gaggtcactttgaaccggtgtgtac

SEQ ID NO: 491385 - DNA, 25 bp, Mus musculus
gaggtcactttgtaccggtgtgtac

SEQ ID NO: 491386 - DNA, 25 bp, Mus musculus
gaggtcagagaaccagtagccagaa

SEQ ID NO: 491387 - DNA, 25 bp, Mus musculus
gaggtcagagaactcatcccacgga

SEQ ID NO: 491388 - DNA, 25 bp, Mus musculus
gaggtcagagaagcagtagccagaa

SEQ ID NO: 491389 - DNA, 25 bp, Mus musculus
gaggtcagagaagtcatcccacgga

SEQ ID NO: 491390 - DNA, 25 bp, Mus musculus
gaggtcagagctaccagattcaatc

SEQ ID NO: 491391 - DNA, 25 bp, Mus musculus
gaggtcagagcttccagattcaatc

SEQ ID NO: 491392 - DNA, 25 bp, Mus musculus
gaggtcagaggtaccctggacatat

SEQ ID NO: 491393 - DNA, 25 bp, Mus musculus
gaggtcagaggtcactgatgggaat

SEQ ID NO: 491394 - DNA, 25 bp, Mus musculus
gaggtcagaggtgactgatgggaat

SEQ ID NO: 491395 - DNA, 25 bp, Mus musculus
gaggtcagaggttccctggacatat

SEQ ID NO: 491396 - DNA, 25 bp, Mus musculus
gaggtcagatgcagaaaccatttga

SEQ ID NO: 491397 - DNA, 25 bp, Mus musculus
gaggtcagatgctgaaaccatttga

SEQ ID NO: 491398 - DNA, 25 bp, Mus musculus
gaggtcagcccgcttggcaaagcaa

SEQ ID NO: 491399 - DNA, 25 bp, Mus musculus
gaggtcagcccggttggcaaagcaa

SEQ ID NO: 491400 - DNA, 25 bp, Mus musculus
gaggtcaggcatcggatttaccact

SEQ ID NO: 491401 - DNA, 25 bp, Mus musculus
gaggtcaggcatgggatttaccact

SEQ ID NO: 491402 - DNA, 25 bp, Mus musculus
gaggtcagggccaaaactggaacca

SEQ ID NO: 491403 - DNA, 25 bp, Mus musculus
gaggtcagggcctaaactggaacca

SEQ ID NO: 491404 - DNA, 25 bp, Mus musculus
gaggtcaggtctccatgcttgagca

SEQ ID NO: 491405 - DNA, 25 bp, Mus musculus
gaggtcaggtctgcatgcttgagca

SEQ ID NO: 491406 - DNA, 25 bp, Mus musculus
gaggtcagtaggctgtcttcagaac

SEQ ID NO: 491407 - DNA, 25 bp, Mus musculus
gaggtcagtagggtgtcttcagaac

SEQ ID NO: 491408 - DNA, 25 bp, Mus musculus
gaggtcagtcacctggcgtttgcat

SEQ ID NO: 491409 - DNA, 25 bp, Mus musculus
gaggtcagtcacgtggcgtttgcat

SEQ ID NO: 491410 - DNA, 25 bp, Mus musculus
gaggtcagtcagcttggagccatta

SEQ ID NO: 491411 - DNA, 25 bp, Mus musculus
gaggtcagtcaggttggagccatta

SEQ ID NO: 491412 - DNA, 25 bp, Mus musculus
gaggtcagtctcagggaatctctcc

SEQ ID NO: 491413 - DNA, 25 bp, Mus musculus
gaggtcagtctctgggaatctctcc

SEQ ID NO: 491414 - DNA, 25 bp, Mus musculus
gaggtcagtctgaaactgatcttgt

SEQ ID NO: 491415 - DNA, 25 bp, Mus musculus
gaggtcagtctgtaactgatcttgt

SEQ ID NO: 491416 - DNA, 25 bp, Mus musculus
gaggtcagtgcaaagtccagcctgc

SEQ ID NO: 491417 - DNA, 25 bp, Mus musculus
gaggtcagtgcatagtccagcctgc

SEQ ID NO: 491418 - DNA, 25 bp, Mus musculus
gaggtcagtggcatttaactgttta

SEQ ID NO: 491419 - DNA, 25 bp, Mus musculus
gaggtcagtggcttttaactgttta

SEQ ID NO: 491420 - DNA, 25 bp, Mus musculus
gaggtcagtggtcttacctgaagaa

SEQ ID NO: 491421 - DNA, 25 bp, Mus musculus
gaggtcagtggtgttacctgaagaa

SEQ ID NO: 491422 - DNA, 25 bp, Mus musculus
gaggtcagtttcagtgctggtaaca

SEQ ID NO: 491423 - DNA, 25 bp, Mus musculus
gaggtcagtttctgtgctggtaaca

SEQ ID NO: 491424 - DNA, 25 bp, Mus musculus
gaggtcataaagacaaatgtctttt

SEQ ID NO: 491425 - DNA, 25 bp, Mus musculus
gaggtcataaagtcaaatgtctttt

SEQ ID NO: 491426 - DNA, 25 bp, Mus musculus
gaggtcataataagctttcccatca

SEQ ID NO: 491427 - DNA, 25 bp, Mus musculus
gaggtcataatatgctttcccatca

SEQ ID NO: 491428 - DNA, 25 bp, Mus musculus
gaggtcataatgctgaactatcact

SEQ ID NO: 491429 - DNA, 25 bp, Mus musculus
gaggtcataatggtgaactatcact

SEQ ID NO: 491430 - DNA, 25 bp, Mus musculus
gaggtcataccaaggccataacttt

SEQ ID NO: 491431 - DNA, 25 bp, Mus musculus
gaggtcataccatggccataacttt

SEQ ID NO: 491432 - DNA, 25 bp, Mus musculus
gaggtcatataacaactactctatg

SEQ ID NO: 491433 - DNA, 25 bp, Mus musculus
gaggtcatataagaactactctatg

SEQ ID NO: 491434 - DNA, 25 bp, Mus musculus
gaggtcatattgcttcaaggttaag

SEQ ID NO: 491435 - DNA, 25 bp, Mus musculus
gaggtcatattggttcaaggttaag

SEQ ID NO: 491436 - DNA, 25 bp, Mus musculus
gaggtcatcatgagtcccagaaagt

SEQ ID NO: 491437 - DNA, 25 bp, Mus musculus
gaggtcatcatgtgtcccagaaagt

SEQ ID NO: 491438 - DNA, 25 bp, Mus musculus
gaggtcatcctcaattgtatagcaa

SEQ ID NO: 491439 - DNA, 25 bp, Mus musculus
gaggtcatcctctattgtatagcaa

SEQ ID NO: 491440 - DNA, 25 bp, Mus musculus
gaggtcatcctgcacaatctctttg

SEQ ID NO: 491441 - DNA, 25 bp, Mus musculus
gaggtcatcctggacaatctctttg

SEQ ID NO: 491442 - DNA, 25 bp, Mus musculus
gaggtcatccttcgtaatgtagtag

SEQ ID NO: 491443 - DNA, 25 bp, Mus musculus
gaggtcatccttggtaatgtagtag

SEQ ID NO: 491444 - DNA, 25 bp, Mus musculus
gaggtcatctcccatcaagacttca

SEQ ID NO: 491445 - DNA, 25 bp, Mus musculus
gaggtcatctccgatcaagacttca

SEQ ID NO: 491446 - DNA, 25 bp, Mus musculus
gaggtcatgcagaaagttccccttt

SEQ ID NO: 491447 - DNA, 25 bp, Mus musculus
gaggtcatgcagtaagttccccttt

SEQ ID NO: 491448 - DNA, 25 bp, Mus musculus
gaggtcatgctccaggacatatttg

SEQ ID NO: 491449 - DNA, 25 bp, Mus musculus
gaggtcatgctcctttggcattatc

SEQ ID NO: 491450 - DNA, 25 bp, Mus musculus
gaggtcatgctcgaggacatatttg

SEQ ID NO: 491451 - DNA, 25 bp, Mus musculus
gaggtcatgctcgtttggcattatc

SEQ ID NO: 491452 - DNA, 25 bp, Mus musculus
gaggtcatggacagcagcatgccat

SEQ ID NO: 491453 - DNA, 25 bp, Mus musculus
gaggtcatggactgcagcatgccat

SEQ ID NO: 491454 - DNA, 25 bp, Mus musculus
gaggtcatggtcaggagcaccattc

SEQ ID NO: 491455 - DNA, 25 bp, Mus musculus
gaggtcatggtctggagcaccattc

SEQ ID NO: 491456 - DNA, 25 bp, Mus musculus
gaggtcatggttaagcttggctcta

SEQ ID NO: 491457 - DNA, 25 bp, Mus musculus
gaggtcatggtttagcttggctcta

SEQ ID NO: 491458 - DNA, 25 bp, Mus musculus
gaggtcatgtaaactgcattcttat

SEQ ID NO: 491459 - DNA, 25 bp, Mus musculus
gaggtcatgtaatctgcattcttat

SEQ ID NO: 491460 - DNA, 25 bp, Mus musculus
gaggtcatgtgtacggaatccatct

SEQ ID NO: 491461 - DNA, 25 bp, Mus musculus
gaggtcatgtgttcggaatccatct

SEQ ID NO: 491462 - DNA, 25 bp, Mus musculus
gaggtcattcacagttcaccatttt

SEQ ID NO: 491463 - DNA, 25 bp, Mus musculus
gaggtcattcactgttcaccatttt

SEQ ID NO: 491464 - DNA, 25 bp, Mus musculus
gaggtcattcatcaggcaacgagtc

SEQ ID NO: 491465 - DNA, 25 bp, Mus musculus
gaggtcattcatgaggcaacgagtc

SEQ ID NO: 491466 - DNA, 25 bp, Mus musculus
gaggtcattctgagcctatagctaa

SEQ ID NO: 491467 - DNA, 25 bp, Mus musculus
gaggtcattctgtgcctatagctaa

SEQ ID NO: 491468 - DNA, 25 bp, Mus musculus
gaggtcatttctcggtgaaggcctt

SEQ ID NO: 491469 - DNA, 25 bp, Mus musculus
gaggtcatttctgggtgaaggcctt

SEQ ID NO: 491470 - DNA, 25 bp, Mus musculus
gaggtcatttttcatctgcagattc

SEQ ID NO: 491471 - DNA, 25 bp, Mus musculus
gaggtcatttttgatctgcagattc

SEQ ID NO: 491472 - DNA, 25 bp, Mus musculus
gaggtccaaagcaattccagccagc

SEQ ID NO: 491473 - DNA, 25 bp, Mus musculus
gaggtccaaagctattccagccagc

SEQ ID NO: 491474 - DNA, 25 bp, Mus musculus
gaggtccaaatcatcctatctgttt

SEQ ID NO: 491475 - DNA, 25 bp, Mus musculus
gaggtccaaatcttcctatctgttt

SEQ ID NO: 491476 - DNA, 25 bp, Mus musculus
gaggtccaagaaagctggccgccat

SEQ ID NO: 491477 - DNA, 25 bp, Mus musculus
gaggtccaagaatgctggccgccat

SEQ ID NO: 491478 - DNA, 25 bp, Mus musculus
gaggtccaaggacccaccagcagaa

SEQ ID NO: 491479 - DNA, 25 bp, Mus musculus
gaggtccaaggagccaccagcagaa

SEQ ID NO: 491480 - DNA, 25 bp, Mus musculus
gaggtccaagggaatccatgtgttc

SEQ ID NO: 491481 - DNA, 25 bp, Mus musculus
gaggtccaagggtatccatgtgttc

SEQ ID NO: 491482 - DNA, 25 bp, Mus musculus
gaggtccaagtgcacaagcacatga

SEQ ID NO: 491483 - DNA, 25 bp, Mus musculus
gaggtccaagtggacaagcacatga

SEQ ID NO: 491484 - DNA, 25 bp, Mus musculus
gaggtccaattcattacctggagca

SEQ ID NO: 491485 - DNA, 25 bp, Mus musculus
gaggtccaattctttacctggagca

SEQ ID NO: 491486 - DNA, 25 bp, Mus musculus
gaggtccaattgcattccagtcagt

SEQ ID NO: 491487 - DNA, 25 bp, Mus musculus
gaggtccaattggattccagtcagt

SEQ ID NO: 491488 - DNA, 25 bp, Mus musculus
gaggtccaatttattttagagcaat

SEQ ID NO: 491489 - DNA, 25 bp, Mus musculus
gaggtccaattttttttagagcaat

SEQ ID NO: 491490 - DNA, 25 bp, Mus musculus
gaggtccaccacaagcaggagagca

SEQ ID NO: 491491 - DNA, 25 bp, Mus musculus
gaggtccaccactagcaggagagca

SEQ ID NO: 491492 - DNA, 25 bp, Mus musculus
gaggtccactccatctgagttagag

SEQ ID NO: 491493 - DNA, 25 bp, Mus musculus
gaggtccactccttctgagttagag

SEQ ID NO: 491494 - DNA, 25 bp, Mus musculus
gaggtccagagccatctcattcagg

SEQ ID NO: 491495 - DNA, 25 bp, Mus musculus
gaggtccagagcgatctcattcagg

SEQ ID NO: 491496 - DNA, 25 bp, Mus musculus
gaggtccagctgatctttgaattgg

SEQ ID NO: 491497 - DNA, 25 bp, Mus musculus
gaggtccagctgttctttgaattgg

SEQ ID NO: 491498 - DNA, 25 bp, Mus musculus
gaggtccagtcactggatggccact

SEQ ID NO: 491499 - DNA, 25 bp, Mus musculus
gaggtccagtcagtggatggccact

SEQ ID NO: 491500 - DNA, 25 bp, Mus musculus
gaggtccatgctctgactttctgca

SEQ ID NO: 491501 - DNA, 25 bp, Mus musculus
gaggtccatgctgtgactttctgca

SEQ ID NO: 491502 - DNA, 25 bp, Mus musculus
gaggtccatggtcctaggcagccat

SEQ ID NO: 491503 - DNA, 25 bp, Mus musculus
gaggtccatggtgctaggcagccat

SEQ ID NO: 491504 - DNA, 25 bp, Mus musculus
gaggtccatgtaataataagaggtc

SEQ ID NO: 491505 - DNA, 25 bp, Mus musculus
gaggtccatgtattaataagaggtc

SEQ ID NO: 491506 - DNA, 25 bp, Mus musculus
gaggtccattccaagagcaatatat

SEQ ID NO: 491507 - DNA, 25 bp, Mus musculus
gaggtccattcctagagcaatatat

SEQ ID NO: 491508 - DNA, 25 bp, Mus musculus
gaggtcccacttacctggaggacga

SEQ ID NO: 491509 - DNA, 25 bp, Mus musculus
gaggtcccactttcctggaggacga

SEQ ID NO: 491510 - DNA, 25 bp, Mus musculus
gaggtcccagacaagcttctatatt

SEQ ID NO: 491511 - DNA, 25 bp, Mus musculus
gaggtcccagacagcggttcacgga

SEQ ID NO: 491512 - DNA, 25 bp, Mus musculus
gaggtcccagacatgattgtagaaa

SEQ ID NO: 491513 - DNA, 25 bp, Mus musculus
gaggtcccagactagcttctatatt

SEQ ID NO: 491514 - DNA, 25 bp, Mus musculus
gaggtcccagactgcggttcacgga

SEQ ID NO: 491515 - DNA, 25 bp, Mus musculus
gaggtcccagacttgattgtagaaa

SEQ ID NO: 491516 - DNA, 25 bp, Mus musculus
gaggtcccaggaagactgactttcc

SEQ ID NO: 491517 - DNA, 25 bp, Mus musculus
gaggtcccaggactacccatgtatg

SEQ ID NO: 491518 - DNA, 25 bp, Mus musculus
gaggtcccaggagtacccatgtatg

SEQ ID NO: 491519 - DNA, 25 bp, Mus musculus
gaggtcccaggatgactgactttcc

SEQ ID NO: 491520 - DNA, 25 bp, Mus musculus
gaggtcccatgtccttggcagtgtc

SEQ ID NO: 491521 - DNA, 25 bp, Mus musculus
gaggtcccatgtgcttggcagtgtc

SEQ ID NO: 491522 - DNA, 25 bp, Mus musculus
gaggtcccattcagctgtggcaatt

SEQ ID NO: 491523 - DNA, 25 bp, Mus musculus
gaggtcccattctgctgtggcaatt

SEQ ID NO: 491524 - DNA, 25 bp, Mus musculus
gaggtccctcgaaagactcctggat

SEQ ID NO: 491525 - DNA, 25 bp, Mus musculus
gaggtccctcgatagactcctggat

SEQ ID NO: 491526 - DNA, 25 bp, Mus musculus
gaggtccctgggatcagttgccagc

SEQ ID NO: 491527 - DNA, 25 bp, Mus musculus
gaggtccctgggttcagttgccagc

SEQ ID NO: 491528 - DNA, 25 bp, Mus musculus
gaggtcccttgtcggagctaactct

SEQ ID NO: 491529 - DNA, 25 bp, Mus musculus
gaggtcccttgtgggagctaactct

SEQ ID NO: 491530 - DNA, 25 bp, Mus musculus
gaggtccgaggaaccttgtacagaa

SEQ ID NO: 491531 - DNA, 25 bp, Mus musculus
gaggtccgaggatccttgtacagaa

SEQ ID NO: 491532 - DNA, 25 bp, Mus musculus
gaggtccgggccattgacccagaca

SEQ ID NO: 491533 - DNA, 25 bp, Mus musculus
gaggtccgggcctttgacccagaca

SEQ ID NO: 491534 - DNA, 25 bp, Mus musculus
gaggtccgtttacttctagaattcg

SEQ ID NO: 491535 - DNA, 25 bp, Mus musculus
gaggtccgtttagttctagaattcg

SEQ ID NO: 491536 - DNA, 25 bp, Mus musculus
gaggtcctaagcacatacattacaa

SEQ ID NO: 491537 - DNA, 25 bp, Mus musculus
gaggtcctaagctcatacattacaa

SEQ ID NO: 491538 - DNA, 25 bp, Mus musculus
gaggtcctacataggctgaatgaag

SEQ ID NO: 491539 - DNA, 25 bp, Mus musculus
gaggtcctacattggctgaatgaag

SEQ ID NO: 491540 - DNA, 25 bp, Mus musculus
gaggtcctagagaacaatgccttag

SEQ ID NO: 491541 - DNA, 25 bp, Mus musculus
gaggtcctagagtacaatgccttag

SEQ ID NO: 491542 - DNA, 25 bp, Mus musculus
gaggtcctagtcattgaatattgtc

SEQ ID NO: 491543 - DNA, 25 bp, Mus musculus
gaggtcctagtctttgaatattgtc

SEQ ID NO: 491544 - DNA, 25 bp, Mus musculus
gaggtcctcatgaattaagcgctgt

SEQ ID NO: 491545 - DNA, 25 bp, Mus musculus
gaggtcctcatgtattaagcgctgt

SEQ ID NO: 491546 - DNA, 25 bp, Mus musculus
gaggtcctctgccaagaacttacag

SEQ ID NO: 491547 - DNA, 25 bp, Mus musculus
gaggtcctctgcgaagaacttacag

SEQ ID NO: 491548 - DNA, 25 bp, Mus musculus
gaggtcctgaaaaattcctagattt

SEQ ID NO: 491549 - DNA, 25 bp, Mus musculus
gaggtcctgaaatattcctagattt

SEQ ID NO: 491550 - DNA, 25 bp, Mus musculus
gaggtcctgcatcctgtgatcatga

SEQ ID NO: 491551 - DNA, 25 bp, Mus musculus
gaggtcctgcatgctgtgatcatga

SEQ ID NO: 491552 - DNA, 25 bp, Mus musculus
gaggtcctgccaaccgggaggaaaa

SEQ ID NO: 491553 - DNA, 25 bp, Mus musculus
gaggtcctgccatccgggaggaaaa

SEQ ID NO: 491554 - DNA, 25 bp, Mus musculus
gaggtcctgctccactactgcgagg

SEQ ID NO: 491555 - DNA, 25 bp, Mus musculus
gaggtcctgctcgactactgcgagg

SEQ ID NO: 491556 - DNA, 25 bp, Mus musculus
gaggtcctgcttactggactcgtca

SEQ ID NO: 491557 - DNA, 25 bp, Mus musculus
gaggtcctgctttctggactcgtca

SEQ ID NO: 491558 - DNA, 25 bp, Mus musculus
gaggtcctggccaagatactatata

SEQ ID NO: 491559 - DNA, 25 bp, Mus musculus
gaggtcctggcctagatactatata

SEQ ID NO: 491560 - DNA, 25 bp, Mus musculus
gaggtcctgtggagtgtgtccccac

SEQ ID NO: 491561 - DNA, 25 bp, Mus musculus
gaggtcctgtggtgtgtgtccccac

SEQ ID NO: 491562 - DNA, 25 bp, Mus musculus
gaggtccttaaacttgatgggcaag

SEQ ID NO: 491563 - DNA, 25 bp, Mus musculus
gaggtccttaaagttgatgggcaag

SEQ ID NO: 491564 - DNA, 25 bp, Mus musculus
gaggtccttaccatgctgctatgac

SEQ ID NO: 491565 - DNA, 25 bp, Mus musculus
gaggtccttaccttgctgctatgac

SEQ ID NO: 491566 - DNA, 25 bp, Mus musculus
gaggtccttctgcatggaaagccaa

SEQ ID NO: 491567 - DNA, 25 bp, Mus musculus
gaggtccttctggatggaaagccaa

SEQ ID NO: 491568 - DNA, 25 bp, Mus musculus
gaggtccttgacacagcagttcaac

SEQ ID NO: 491569 - DNA, 25 bp, Mus musculus
gaggtccttgactcagcagttcaac

SEQ ID NO: 491570 - DNA, 25 bp, Mus musculus
gaggtcctttcaaggagcctgtaga

SEQ ID NO: 491571 - DNA, 25 bp, Mus musculus
gaggtcctttcatggagcctgtaga

SEQ ID NO: 491572 - DNA, 25 bp, Mus musculus
gaggtcgacaatcgcagtgagactt

SEQ ID NO: 491573 - DNA, 25 bp, Mus musculus
gaggtcgacaatggcagtgagactt

SEQ ID NO: 491574 - DNA, 25 bp, Mus musculus
gaggtcgcagacacagtacttgctg

SEQ ID NO: 491575 - DNA, 25 bp, Mus musculus
gaggtcgcagactcagtacttgctg

SEQ ID NO: 491576 - DNA, 25 bp, Mus musculus
gaggtcgccaaccatttaacccttg

SEQ ID NO: 491577 - DNA, 25 bp, Mus musculus
gaggtcgccaacgatttaacccttg

SEQ ID NO: 491578 - DNA, 25 bp, Mus musculus
gaggtcgcctctaaacaaagactct

SEQ ID NO: 491579 - DNA, 25 bp, Mus musculus
gaggtcgcctcttaacaaagactct

SEQ ID NO: 491580 - DNA, 25 bp, Mus musculus
gaggtcggcctcctaagatcaaaat

SEQ ID NO: 491581 - DNA, 25 bp, Mus musculus
gaggtcggcctcgtaagatcaaaat

SEQ ID NO: 491582 - DNA, 25 bp, Mus musculus
gaggtcgggaccagagttcacctta

SEQ ID NO: 491583 - DNA, 25 bp, Mus musculus
gaggtcgggacctgagttcacctta

SEQ ID NO: 491584 - DNA, 25 bp, Mus musculus
gaggtcgtaggaatgttgctgatca

SEQ ID NO: 491585 - DNA, 25 bp, Mus musculus
gaggtcgtaggattgttgctgatca

SEQ ID NO: 491586 - DNA, 25 bp, Mus musculus
gaggtcgtatatacgaaaactgcca

SEQ ID NO: 491587 - DNA, 25 bp, Mus musculus
gaggtcgtatattcgaaaactgcca

SEQ ID NO: 491588 - DNA, 25 bp, Mus musculus
gaggtcgtccagagctgcgatagta

SEQ ID NO: 491589 - DNA, 25 bp, Mus musculus
gaggtcgtccagtgctgcgatagta

SEQ ID NO: 491590 - DNA, 25 bp, Mus musculus
gaggtcgtccatctcccgagaagag

SEQ ID NO: 491591 - DNA, 25 bp, Mus musculus
gaggtcgtccatgtcccgagaagag

SEQ ID NO: 491592 - DNA, 25 bp, Mus musculus
gaggtcgtctgcagggttttgccct

SEQ ID NO: 491593 - DNA, 25 bp, Mus musculus
gaggtcgtctgctgggttttgccct

SEQ ID NO: 491594 - DNA, 25 bp, Mus musculus
gaggtcgtggtaagtcagcaaccca

SEQ ID NO: 491595 - DNA, 25 bp, Mus musculus
gaggtcgtggtatgtcagcaaccca

SEQ ID NO: 491596 - DNA, 25 bp, Mus musculus
gaggtctaaacaatgtcaaacatct

SEQ ID NO: 491597 - DNA, 25 bp, Mus musculus
gaggtctaaacattgtcaaacatct

SEQ ID NO: 491598 - DNA, 25 bp, Mus musculus
gaggtctaatccagaagatcccgca

SEQ ID NO: 491599 - DNA, 25 bp, Mus musculus
gaggtctaatcctgaagatcccgca

SEQ ID NO: 491600 - DNA, 25 bp, Mus musculus
gaggtctaccatcacacacgtgttt

SEQ ID NO: 491601 - DNA, 25 bp, Mus musculus
gaggtctaccatgacacacgtgttt

SEQ ID NO: 491602 - DNA, 25 bp, Mus musculus
gaggtctacgccagtatgaaggaag

SEQ ID NO: 491603 - DNA, 25 bp, Mus musculus
gaggtctacgcctgtatgaaggaag

SEQ ID NO: 491604 - DNA, 25 bp, Mus musculus
gaggtctactctatacggaacttca

SEQ ID NO: 491605 - DNA, 25 bp, Mus musculus
gaggtctactctttacggaacttca

SEQ ID NO: 491606 - DNA, 25 bp, Mus musculus
gaggtctactttctagctcttaagc

SEQ ID NO: 491607 - DNA, 25 bp, Mus musculus
gaggtctactttgtagctcttaagc

SEQ ID NO: 491608 - DNA, 25 bp, Mus musculus
gaggtctaggaaaatgcatctgtct

SEQ ID NO: 491609 - DNA, 25 bp, Mus musculus
gaggtctaggaatatgcatctgtct

SEQ ID NO: 491610 - DNA, 25 bp, Mus musculus
gaggtctaggctagttgtggctaac

SEQ ID NO: 491611 - DNA, 25 bp, Mus musculus
gaggtctaggcttgttgtggctaac

SEQ ID NO: 491612 - DNA, 25 bp, Mus musculus
gaggtctaggtgattttctttactg

SEQ ID NO: 491613 - DNA, 25 bp, Mus musculus
gaggtctaggtgtttttctttactg

SEQ ID NO: 491614 - DNA, 25 bp, Mus musculus
gaggtctataacatccctagctagg

SEQ ID NO: 491615 - DNA, 25 bp, Mus musculus
gaggtctataacttccctagctagg

SEQ ID NO: 491616 - DNA, 25 bp, Mus musculus
gaggtctataccagcaagggctgac

SEQ ID NO: 491617 - DNA, 25 bp, Mus musculus
gaggtctatacctgcaagggctgac

SEQ ID NO: 491618 - DNA, 25 bp, Mus musculus
gaggtctatgaaacaagcaagcttg

SEQ ID NO: 491619 - DNA, 25 bp, Mus musculus
gaggtctatgaatcaagcaagcttg

SEQ ID NO: 491620 - DNA, 25 bp, Mus musculus
gaggtctatgttacttgtacctgaa

SEQ ID NO: 491621 - DNA, 25 bp, Mus musculus
gaggtctatgtttcttgtacctgaa

SEQ ID NO: 491622 - DNA, 25 bp, Mus musculus
gaggtctatttacaggaatttgagc

SEQ ID NO: 491623 - DNA, 25 bp, Mus musculus
gaggtctatttagaggaatttgagc

SEQ ID NO: 491624 - DNA, 25 bp, Mus musculus
gaggtctcaagccacccatacaaag

SEQ ID NO: 491625 - DNA, 25 bp, Mus musculus
gaggtctcaagcgacccatacaaag

SEQ ID NO: 491626 - DNA, 25 bp, Mus musculus
gaggtctcacagcaggcatggttat

SEQ ID NO: 491627 - DNA, 25 bp, Mus musculus
gaggtctcacaggaggcatggttat

SEQ ID NO: 491628 - DNA, 25 bp, Mus musculus
gaggtctcaccaaattttctaattt

SEQ ID NO: 491629 - DNA, 25 bp, Mus musculus
gaggtctcaccatattttctaattt

SEQ ID NO: 491630 - DNA, 25 bp, Mus musculus
gaggtctcacctcgtgctatacaga

SEQ ID NO: 491631 - DNA, 25 bp, Mus musculus
gaggtctcacctggtgctatacaga

SEQ ID NO: 491632 - DNA, 25 bp, Mus musculus
gaggtctcactcactatgttgtgta

SEQ ID NO: 491633 - DNA, 25 bp, Mus musculus
gaggtctcactctctatgttgtgta

SEQ ID NO: 491634 - DNA, 25 bp, Mus musculus
gaggtctccaagagtgtgattgcac

SEQ ID NO: 491635 - DNA, 25 bp, Mus musculus
gaggtctccaagtgtgtgattgcac

SEQ ID NO: 491636 - DNA, 25 bp, Mus musculus
gaggtctccatgaacaggctcatca

SEQ ID NO: 491637 - DNA, 25 bp, Mus musculus
gaggtctccatgctacagagtctac

SEQ ID NO: 491638 - DNA, 25 bp, Mus musculus
gaggtctccatggtacagagtctac

SEQ ID NO: 491639 - DNA, 25 bp, Mus musculus
gaggtctccatgtacaggctcatca

SEQ ID NO: 491640 - DNA, 25 bp, Mus musculus
gaggtctccctgactgaggacttca

SEQ ID NO: 491641 - DNA, 25 bp, Mus musculus
gaggtctccctgtctgaggacttca

SEQ ID NO: 491642 - DNA, 25 bp, Mus musculus
gaggtctccggccaaacaagcagac

SEQ ID NO: 491643 - DNA, 25 bp, Mus musculus
gaggtctccggcgaaacaagcagac

SEQ ID NO: 491644 - DNA, 25 bp, Mus musculus
gaggtctcctccactgagtgaatct

SEQ ID NO: 491645 - DNA, 25 bp, Mus musculus
gaggtctcctcctctgagtgaatct

SEQ ID NO: 491646 - DNA, 25 bp, Mus musculus
gaggtctcctgtagacagcttgagc

SEQ ID NO: 491647 - DNA, 25 bp, Mus musculus
gaggtctcctgttgacagcttgagc

SEQ ID NO: 491648 - DNA, 25 bp, Mus musculus
gaggtctcgtgtaaatatagtgtca

SEQ ID NO: 491649 - DNA, 25 bp, Mus musculus
gaggtctcgtgttaatatagtgtca

SEQ ID NO: 491650 - DNA, 25 bp, Mus musculus
gaggtctctacaaggaagactcgaa

SEQ ID NO: 491651 - DNA, 25 bp, Mus musculus
gaggtctctacatggaagactcgaa

SEQ ID NO: 491652 - DNA, 25 bp, Mus musculus
gaggtctctaccattttggagggag

SEQ ID NO: 491653 - DNA, 25 bp, Mus musculus
gaggtctctacctttttggagggag

SEQ ID NO: 491654 - DNA, 25 bp, Mus musculus
gaggtctctagactttttcaccctt

SEQ ID NO: 491655 - DNA, 25 bp, Mus musculus
gaggtctctagagtttttcaccctt

SEQ ID NO: 491656 - DNA, 25 bp, Mus musculus
gaggtctctccgcataaggtgcctt

SEQ ID NO: 491657 - DNA, 25 bp, Mus musculus
gaggtctctccggataaggtgcctt

SEQ ID NO: 491658 - DNA, 25 bp, Mus musculus
gaggtctctctacttggaaagccat

SEQ ID NO: 491659 - DNA, 25 bp, Mus musculus
gaggtctctctagttggaaagccat

SEQ ID NO: 491660 - DNA, 25 bp, Mus musculus
gaggtctctgccacagaatttctgc

SEQ ID NO: 491661 - DNA, 25 bp, Mus musculus
gaggtctctgcctcagaatttctgc

SEQ ID NO: 491662 - DNA, 25 bp, Mus musculus
gaggtctctggtaaaacgtctccct

SEQ ID NO: 491663 - DNA, 25 bp, Mus musculus
gaggtctctggttaaacgtctccct

SEQ ID NO: 491664 - DNA, 25 bp, Mus musculus
gaggtctctgtcaacagctctgtgg

SEQ ID NO: 491665 - DNA, 25 bp, Mus musculus
gaggtctctgtctacagctctgtgg

SEQ ID NO: 491666 - DNA, 25 bp, Mus musculus
gaggtctcttgacgacagtccactg

SEQ ID NO: 491667 - DNA, 25 bp, Mus musculus
gaggtctcttgaggacagtccactg

SEQ ID NO: 491668 - DNA, 25 bp, Mus musculus
gaggtctgacatctttatcatgtac

SEQ ID NO: 491669 - DNA, 25 bp, Mus musculus
gaggtctgacatgtttatcatgtac

SEQ ID NO: 491670 - DNA, 25 bp, Mus musculus
gaggtctgaccgcaacaatttaagg

SEQ ID NO: 491671 - DNA, 25 bp, Mus musculus
gaggtctgaccggaacaatttaagg

SEQ ID NO: 491672 - DNA, 25 bp, Mus musculus
gaggtctgagatccctctatttcct

SEQ ID NO: 491673 - DNA, 25 bp, Mus musculus
gaggtctgagatgcctctatttcct

SEQ ID NO: 491674 - DNA, 25 bp, Mus musculus
gaggtctgatataatatccatccag

SEQ ID NO: 491675 - DNA, 25 bp, Mus musculus
gaggtctgatattatatccatccag

SEQ ID NO: 491676 - DNA, 25 bp, Mus musculus
gaggtctgccatctgacttagattt

SEQ ID NO: 491677 - DNA, 25 bp, Mus musculus
gaggtctgccatgtgacttagattt

SEQ ID NO: 491678 - DNA, 25 bp, Mus musculus
gaggtctgcctgattaaactttaat

SEQ ID NO: 491679 - DNA, 25 bp, Mus musculus
gaggtctgcctgtttaaactttaat

SEQ ID NO: 491680 - DNA, 25 bp, Mus musculus
gaggtctgctccaaaggtaacgtgt

SEQ ID NO: 491681 - DNA, 25 bp, Mus musculus
gaggtctgctcctaaggtaacgtgt

SEQ ID NO: 491682 - DNA, 25 bp, Mus musculus
gaggtctgcttacactcaaggctgt

SEQ ID NO: 491683 - DNA, 25 bp, Mus musculus
gaggtctgcttagactcaaggctgt

SEQ ID NO: 491684 - DNA, 25 bp, Mus musculus
gaggtctgcttgatggtctgagaca

SEQ ID NO: 491685 - DNA, 25 bp, Mus musculus
gaggtctgcttgttggtctgagaca

SEQ ID NO: 491686 - DNA, 25 bp, Mus musculus
gaggtctggccactaaaactcttag

SEQ ID NO: 491687 - DNA, 25 bp, Mus musculus
gaggtctggccagtaaaactcttag

SEQ ID NO: 491688 - DNA, 25 bp, Mus musculus
gaggtctggccccatattgaagata

SEQ ID NO: 491689 - DNA, 25 bp, Mus musculus
gaggtctggcccgatattgaagata

SEQ ID NO: 491690 - DNA, 25 bp, Mus musculus
gaggtctgggccactgaaccaagac

SEQ ID NO: 491691 - DNA, 25 bp, Mus musculus
gaggtctgggcctctgaaccaagac

SEQ ID NO: 491692 - DNA, 25 bp, Mus musculus
gaggtctgtaacatgctgagagcca

SEQ ID NO: 491693 - DNA, 25 bp, Mus musculus
gaggtctgtaacttgctgagagcca

SEQ ID NO: 491694 - DNA, 25 bp, Mus musculus
gaggtctgtaagctagcctgtgtta

SEQ ID NO: 491695 - DNA, 25 bp, Mus musculus
gaggtctgtaaggtagcctgtgtta

SEQ ID NO: 491696 - DNA, 25 bp, Mus musculus
gaggtctgtagcaccgttcactact

SEQ ID NO: 491697 - DNA, 25 bp, Mus musculus
gaggtctgtagctccgttcactact

SEQ ID NO: 491698 - DNA, 25 bp, Mus musculus
gaggtctgtgcccagtggtatccac

SEQ ID NO: 491699 - DNA, 25 bp, Mus musculus
gaggtctgtgccgagtggtatccac

SEQ ID NO: 491700 - DNA, 25 bp, Mus musculus
gaggtctgtggacacttcagagcac

SEQ ID NO: 491701 - DNA, 25 bp, Mus musculus
gaggtctgtggagacttcagagcac

SEQ ID NO: 491702 - DNA, 25 bp, Mus musculus
gaggtctgtgtgaggtcactatctc

SEQ ID NO: 491703 - DNA, 25 bp, Mus musculus
gaggtctgtgtgtggtcactatctc

SEQ ID NO: 491704 - DNA, 25 bp, Mus musculus
gaggtcttaaacatcctggcgttga

SEQ ID NO: 491705 - DNA, 25 bp, Mus musculus
gaggtcttaaacttcctggcgttga

SEQ ID NO: 491706 - DNA, 25 bp, Mus musculus
gaggtcttaatcacaggatgaagtc

SEQ ID NO: 491707 - DNA, 25 bp, Mus musculus
gaggtcttaatctcaggatgaagtc

SEQ ID NO: 491708 - DNA, 25 bp, Mus musculus
gaggtcttacctattatgtcaataa

SEQ ID NO: 491709 - DNA, 25 bp, Mus musculus
gaggtcttaccttttatgtcaataa

SEQ ID NO: 491710 - DNA, 25 bp, Mus musculus
gaggtcttatctatgcatttataaa

SEQ ID NO: 491711 - DNA, 25 bp, Mus musculus
gaggtcttatctttgcatttataaa

SEQ ID NO: 491712 - DNA, 25 bp, Mus musculus
gaggtcttcatacaagaggaggcca

SEQ ID NO: 491713 - DNA, 25 bp, Mus musculus
gaggtcttcatagaagaggaggcca

SEQ ID NO: 491714 - DNA, 25 bp, Mus musculus
gaggtcttcattctgaggagccaat

SEQ ID NO: 491715 - DNA, 25 bp, Mus musculus
gaggtcttcattgtgaggagccaat

SEQ ID NO: 491716 - DNA, 25 bp, Mus musculus
gaggtcttccagctatactttcatt

SEQ ID NO: 491717 - DNA, 25 bp, Mus musculus
gaggtcttccaggtatactttcatt

SEQ ID NO: 491718 - DNA, 25 bp, Mus musculus
gaggtcttccttcaacatcaggctt

SEQ ID NO: 491719 - DNA, 25 bp, Mus musculus
gaggtcttccttctaaagtgtgaca

SEQ ID NO: 491720 - DNA, 25 bp, Mus musculus
gaggtcttccttgaacatcaggctt

SEQ ID NO: 491721 - DNA, 25 bp, Mus musculus
gaggtcttccttgtaaagtgtgaca

SEQ ID NO: 491722 - DNA, 25 bp, Mus musculus
gaggtcttcgaaagcccaggccttg

SEQ ID NO: 491723 - DNA, 25 bp, Mus musculus
gaggtcttcgaatgcccaggccttg

SEQ ID NO: 491724 - DNA, 25 bp, Mus musculus
gaggtcttctgtccattagtgctgt

SEQ ID NO: 491725 - DNA, 25 bp, Mus musculus
gaggtcttctgtgcattagtgctgt

SEQ ID NO: 491726 - DNA, 25 bp, Mus musculus
gaggtcttcttaccctcaataggaa

SEQ ID NO: 491727 - DNA, 25 bp, Mus musculus
gaggtcttcttagcctcaataggaa

SEQ ID NO: 491728 - DNA, 25 bp, Mus musculus
gaggtcttgaggatctgtgttctct

SEQ ID NO: 491729 - DNA, 25 bp, Mus musculus
gaggtcttgaggttctgtgttctct

SEQ ID NO: 491730 - DNA, 25 bp, Mus musculus
gaggtcttgcaaaggtgctctttat

SEQ ID NO: 491731 - DNA, 25 bp, Mus musculus
gaggtcttgcaatggtgctctttat

SEQ ID NO: 491732 - DNA, 25 bp, Mus musculus
gaggtcttggctagacttcagacag

SEQ ID NO: 491733 - DNA, 25 bp, Mus musculus
gaggtcttggcttgacttcagacag

SEQ ID NO: 491734 - DNA, 25 bp, Mus musculus
gaggtcttgggcctctgccacatac

SEQ ID NO: 491735 - DNA, 25 bp, Mus musculus
gaggtcttgggcgtctgccacatac

SEQ ID NO: 491736 - DNA, 25 bp, Mus musculus
gaggtcttgggtatagttcttagca

SEQ ID NO: 491737 - DNA, 25 bp, Mus musculus
gaggtcttgggtttagttcttagca

SEQ ID NO: 491738 - DNA, 25 bp, Mus musculus
gaggtctttacaaatagtcccagca

SEQ ID NO: 491739 - DNA, 25 bp, Mus musculus
gaggtctttacatatagtcccagca

SEQ ID NO: 491740 - DNA, 25 bp, Mus musculus
gaggtctttctgagggctttgtcaa

SEQ ID NO: 491741 - DNA, 25 bp, Mus musculus
gaggtctttctgtgggctttgtcaa

SEQ ID NO: 491742 - DNA, 25 bp, Mus musculus
gaggtctttgagagacccagctcaa

SEQ ID NO: 491743 - DNA, 25 bp, Mus musculus
gaggtctttgagtgacccagctcaa

SEQ ID NO: 491744 - DNA, 25 bp, Mus musculus
gaggtctttgtgctccctgcagaca

SEQ ID NO: 491745 - DNA, 25 bp, Mus musculus
gaggtctttgtggtccctgcagaca

SEQ ID NO: 491746 - DNA, 25 bp, Mus musculus
gaggtctttgttatagtaagctatg

SEQ ID NO: 491747 - DNA, 25 bp, Mus musculus
gaggtctttgttttagtaagctatg

SEQ ID NO: 491748 - DNA, 25 bp, Mus musculus
gaggtcttttatagatattcctaca

SEQ ID NO: 491749 - DNA, 25 bp, Mus musculus
gaggtcttttattgatattcctaca

SEQ ID NO: 491750 - DNA, 25 bp, Mus musculus
gaggtcttttccatattaacttaat

SEQ ID NO: 491751 - DNA, 25 bp, Mus musculus
gaggtcttttccttattaacttaat

SEQ ID NO: 491752 - DNA, 25 bp, Mus musculus
gaggtgaaaagcaagttgggaactt

SEQ ID NO: 491753 - DNA, 25 bp, Mus musculus
gaggtgaaaagctagttgggaactt

SEQ ID NO: 491754 - DNA, 25 bp, Mus musculus
gaggtgaaagttcggcattttaatt

SEQ ID NO: 491755 - DNA, 25 bp, Mus musculus
gaggtgaaagttgggcattttaatt

SEQ ID NO: 491756 - DNA, 25 bp, Mus musculus
gaggtgaaatggctcttttgtttat

SEQ ID NO: 491757 - DNA, 25 bp, Mus musculus
gaggtgaaatgggtcttttgtttat

SEQ ID NO: 491758 - DNA, 25 bp, Mus musculus
gaggtgaacactcgattgttttagc

SEQ ID NO: 491759 - DNA, 25 bp, Mus musculus
gaggtgaacactggattgttttagc

SEQ ID NO: 491760 - DNA, 25 bp, Mus musculus
gaggtgaaccagattctcatcaagt

SEQ ID NO: 491761 - DNA, 25 bp, Mus musculus
gaggtgaaccagtttctcatcaagt

SEQ ID NO: 491762 - DNA, 25 bp, Mus musculus
gaggtgaagcaccaacatcccagtc

SEQ ID NO: 491763 - DNA, 25 bp, Mus musculus
gaggtgaagcacgaacatcccagtc

SEQ ID NO: 491764 - DNA, 25 bp, Mus musculus
gaggtgaagtctatgcctttacaca

SEQ ID NO: 491765 - DNA, 25 bp, Mus musculus
gaggtgaagtctttgcctttacaca

SEQ ID NO: 491766 - DNA, 25 bp, Mus musculus
gaggtgaatctgacttcttctgact

SEQ ID NO: 491767 - DNA, 25 bp, Mus musculus
gaggtgaatctgtcttcttctgact

SEQ ID NO: 491768 - DNA, 25 bp, Mus musculus
gaggtgaatgttactattctgaact

SEQ ID NO: 491769 - DNA, 25 bp, Mus musculus
gaggtgaatgtttctattctgaact

SEQ ID NO: 491770 - DNA, 25 bp, Mus musculus
gaggtgacaaccaattcacagacac

SEQ ID NO: 491771 - DNA, 25 bp, Mus musculus
gaggtgacaacctattcacagacac

SEQ ID NO: 491772 - DNA, 25 bp, Mus musculus
gaggtgacaattaaagtttcatcgt

SEQ ID NO: 491773 - DNA, 25 bp, Mus musculus
gaggtgacaattattctcccttcag

SEQ ID NO: 491774 - DNA, 25 bp, Mus musculus
gaggtgacaatttaagtttcatcgt

SEQ ID NO: 491775 - DNA, 25 bp, Mus musculus
gaggtgacaatttttctcccttcag

SEQ ID NO: 491776 - DNA, 25 bp, Mus musculus
gaggtgacaccaagtgactctccag

SEQ ID NO: 491777 - DNA, 25 bp, Mus musculus
gaggtgacaccatgtgactctccag

SEQ ID NO: 491778 - DNA, 25 bp, Mus musculus
gaggtgacacctaagggttctgaaa

SEQ ID NO: 491779 - DNA, 25 bp, Mus musculus
gaggtgacacctctttggtctacat

SEQ ID NO: 491780 - DNA, 25 bp, Mus musculus
gaggtgacacctgtttggtctacat

SEQ ID NO: 491781 - DNA, 25 bp, Mus musculus
gaggtgacaccttagggttctgaaa

SEQ ID NO: 491782 - DNA, 25 bp, Mus musculus
gaggtgacagaacactggctgccac

SEQ ID NO: 491783 - DNA, 25 bp, Mus musculus
gaggtgacagaagactggctgccac

SEQ ID NO: 491784 - DNA, 25 bp, Mus musculus
gaggtgacaggtactcttcgaatca

SEQ ID NO: 491785 - DNA, 25 bp, Mus musculus
gaggtgacaggttctcttcgaatca

SEQ ID NO: 491786 - DNA, 25 bp, Mus musculus
gaggtgacatttaacggtttcttgt

SEQ ID NO: 491787 - DNA, 25 bp, Mus musculus
gaggtgacattttacggtttcttgt

SEQ ID NO: 491788 - DNA, 25 bp, Mus musculus
gaggtgaccaagacgatactgccca

SEQ ID NO: 491789 - DNA, 25 bp, Mus musculus
gaggtgaccaagtcgatactgccca

SEQ ID NO: 491790 - DNA, 25 bp, Mus musculus
gaggtgaccacacaccatgagcgct

SEQ ID NO: 491791 - DNA, 25 bp, Mus musculus
gaggtgaccacagaccatgagcgct

SEQ ID NO: 491792 - DNA, 25 bp, Mus musculus
gaggtgaccactataaacttcgctt

SEQ ID NO: 491793 - DNA, 25 bp, Mus musculus
gaggtgaccactttaaacttcgctt

SEQ ID NO: 491794 - DNA, 25 bp, Mus musculus
gaggtgaccagaaaggttctctttt

SEQ ID NO: 491795 - DNA, 25 bp, Mus musculus
gaggtgaccagataggttctctttt

SEQ ID NO: 491796 - DNA, 25 bp, Mus musculus
gaggtgaccaggaagttttaacagt

SEQ ID NO: 491797 - DNA, 25 bp, Mus musculus
gaggtgaccaggtagttttaacagt

SEQ ID NO: 491798 - DNA, 25 bp, Mus musculus
gaggtgaccctcagatgacagagga

SEQ ID NO: 491799 - DNA, 25 bp, Mus musculus
gaggtgaccctctgatgacagagga

SEQ ID NO: 491800 - DNA, 25 bp, Mus musculus
gaggtgacccttataatgggactga

SEQ ID NO: 491801 - DNA, 25 bp, Mus musculus
gaggtgacccttttaatgggactga

SEQ ID NO: 491802 - DNA, 25 bp, Mus musculus
gaggtgaccgtcatgggagtggcca

SEQ ID NO: 491803 - DNA, 25 bp, Mus musculus
gaggtgaccgtcttgggagtggcca

SEQ ID NO: 491804 - DNA, 25 bp, Mus musculus
gaggtgacctccataggtctctgaa

SEQ ID NO: 491805 - DNA, 25 bp, Mus musculus
gaggtgacctccttaggtctctgaa

SEQ ID NO: 491806 - DNA, 25 bp, Mus musculus
gaggtgacctgcagctctcagggaa

SEQ ID NO: 491807 - DNA, 25 bp, Mus musculus
gaggtgacctgctgctctcagggaa

SEQ ID NO: 491808 - DNA, 25 bp, Mus musculus
gaggtgaccttcattagtgggatca

SEQ ID NO: 491809 - DNA, 25 bp, Mus musculus
gaggtgaccttctttagtgggatca

SEQ ID NO: 491810 - DNA, 25 bp, Mus musculus
gaggtgacgcggaaataccaggaaa

SEQ ID NO: 491811 - DNA, 25 bp, Mus musculus
gaggtgacgcggtaataccaggaaa

SEQ ID NO: 491812 - DNA, 25 bp, Mus musculus
gaggtgacgctgatttcattgcttc

SEQ ID NO: 491813 - DNA, 25 bp, Mus musculus
gaggtgacgctgttttcattgcttc

SEQ ID NO: 491814 - DNA, 25 bp, Mus musculus
gaggtgactagaacctgactgacta

SEQ ID NO: 491815 - DNA, 25 bp, Mus musculus
gaggtgactagatcctgactgacta

SEQ ID NO: 491816 - DNA, 25 bp, Mus musculus
gaggtgactgaccatgtacctgcag

SEQ ID NO: 491817 - DNA, 25 bp, Mus musculus
gaggtgactgacgatgtacctgcag

SEQ ID NO: 491818 - DNA, 25 bp, Mus musculus
gaggtgactgggaggtcccttcaat

SEQ ID NO: 491819 - DNA, 25 bp, Mus musculus
gaggtgactgggtggtcccttcaat

SEQ ID NO: 491820 - DNA, 25 bp, Mus musculus
gaggtgacttgacaaacagcataca

SEQ ID NO: 491821 - DNA, 25 bp, Mus musculus
gaggtgacttgagaaacagcataca

SEQ ID NO: 491822 - DNA, 25 bp, Mus musculus
gaggtgactttaagccaggctctgt

SEQ ID NO: 491823 - DNA, 25 bp, Mus musculus
gaggtgactttatgccaggctctgt

SEQ ID NO: 491824 - DNA, 25 bp, Mus musculus
gaggtgagacatcctaatttcatga

SEQ ID NO: 491825 - DNA, 25 bp, Mus musculus
gaggtgagacatgctaatttcatga

SEQ ID NO: 491826 - DNA, 25 bp, Mus musculus
gaggtgagagctcatgtcctttctc

SEQ ID NO: 491827 - DNA, 25 bp, Mus musculus
gaggtgagagctgatgtcctttctc

SEQ ID NO: 491828 - DNA, 25 bp, Mus musculus
gaggtgagcaccacagaaaggccat

SEQ ID NO: 491829 - DNA, 25 bp, Mus musculus
gaggtgagcacctcagaaaggccat

SEQ ID NO: 491830 - DNA, 25 bp, Mus musculus
gaggtgagcactaaatcctttgagc

SEQ ID NO: 491831 - DNA, 25 bp, Mus musculus
gaggtgagcacttaatcctttgagc

SEQ ID NO: 491832 - DNA, 25 bp, Mus musculus
gaggtgagccaacgccgacttctgc

SEQ ID NO: 491833 - DNA, 25 bp, Mus musculus
gaggtgagccaaggccgacttctgc

SEQ ID NO: 491834 - DNA, 25 bp, Mus musculus
gaggtgagcccacgtaagactatga

SEQ ID NO: 491835 - DNA, 25 bp, Mus musculus
gaggtgagcccaggtaagactatga

SEQ ID NO: 491836 - DNA, 25 bp, Mus musculus
gaggtgagcctaacattacatacag

SEQ ID NO: 491837 - DNA, 25 bp, Mus musculus
gaggtgagcctatcattacatacag

SEQ ID NO: 491838 - DNA, 25 bp, Mus musculus
gaggtgaggtcaccctatgctgtat

SEQ ID NO: 491839 - DNA, 25 bp, Mus musculus
gaggtgaggtcagcctatgctgtat

SEQ ID NO: 491840 - DNA, 25 bp, Mus musculus
gaggtgataccactccgacaaggtt

SEQ ID NO: 491841 - DNA, 25 bp, Mus musculus
gaggtgataccagtccgacaaggtt

SEQ ID NO: 491842 - DNA, 25 bp, Mus musculus
gaggtgatcacccaagaccaggaac

SEQ ID NO: 491843 - DNA, 25 bp, Mus musculus
gaggtgatcaccgaagaccaggaac

SEQ ID NO: 491844 - DNA, 25 bp, Mus musculus
gaggtgatcactagacctggccttc

SEQ ID NO: 491845 - DNA, 25 bp, Mus musculus
gaggtgatcacttgacctggccttc

SEQ ID NO: 491846 - DNA, 25 bp, Mus musculus
gaggtgatcttaccctgtgaacaca

SEQ ID NO: 491847 - DNA, 25 bp, Mus musculus
gaggtgatcttagcctgtgaacaca

SEQ ID NO: 491848 - DNA, 25 bp, Mus musculus
gaggtgatgaaaaaccatgcaacta

SEQ ID NO: 491849 - DNA, 25 bp, Mus musculus
gaggtgatgaaataccatgcaacta

SEQ ID NO: 491850 - DNA, 25 bp, Mus musculus
gaggtgatgagaatccctagctcac

SEQ ID NO: 491851 - DNA, 25 bp, Mus musculus
gaggtgatgagattccctagctcac

SEQ ID NO: 491852 - DNA, 25 bp, Mus musculus
gaggtgatgagtactttgtttttcc

SEQ ID NO: 491853 - DNA, 25 bp, Mus musculus
gaggtgatgagttctttgtttttcc

SEQ ID NO: 491854 - DNA, 25 bp, Mus musculus
gaggtgatggccactcatgagtcct

SEQ ID NO: 491855 - DNA, 25 bp, Mus musculus
gaggtgatggccctattccagcaac

SEQ ID NO: 491856 - DNA, 25 bp, Mus musculus
gaggtgatggccgtattccagcaac

SEQ ID NO: 491857 - DNA, 25 bp, Mus musculus
gaggtgatggcctctcatgagtcct

SEQ ID NO: 491858 - DNA, 25 bp, Mus musculus
gaggtgatggtgacccagacagcac

SEQ ID NO: 491859 - DNA, 25 bp, Mus musculus
gaggtgatggtgtcccagacagcac

SEQ ID NO: 491860 - DNA, 25 bp, Mus musculus
gaggtgattcccatggcagcagtga

SEQ ID NO: 491861 - DNA, 25 bp, Mus musculus
gaggtgattcccttggcagcagtga

SEQ ID NO: 491862 - DNA, 25 bp, Mus musculus
gaggtgatttatctcctggcttttg

SEQ ID NO: 491863 - DNA, 25 bp, Mus musculus
gaggtgatttatgtcctggcttttg

SEQ ID NO: 491864 - DNA, 25 bp, Mus musculus
gaggtgcaaacaaccaccctaaggt

SEQ ID NO: 491865 - DNA, 25 bp, Mus musculus
gaggtgcaaacatccaccctaaggt

SEQ ID NO: 491866 - DNA, 25 bp, Mus musculus
gaggtgcaaactccctgcgaatgtg

SEQ ID NO: 491867 - DNA, 25 bp, Mus musculus
gaggtgcaaactgcctgcgaatgtg

SEQ ID NO: 491868 - DNA, 25 bp, Mus musculus
gaggtgcaaagtcagcaaccatcgt

SEQ ID NO: 491869 - DNA, 25 bp, Mus musculus
gaggtgcaaagtgagcaaccatcgt

SEQ ID NO: 491870 - DNA, 25 bp, Mus musculus
gaggtgcaactgaattccaaaaggg

SEQ ID NO: 491871 - DNA, 25 bp, Mus musculus
gaggtgcaactgtattccaaaaggg

SEQ ID NO: 491872 - DNA, 25 bp, Mus musculus
gaggtgcaagcccagatttacaaga

SEQ ID NO: 491873 - DNA, 25 bp, Mus musculus
gaggtgcaagccgagatttacaaga

SEQ ID NO: 491874 - DNA, 25 bp, Mus musculus
gaggtgcaagctcaatgactttttt

SEQ ID NO: 491875 - DNA, 25 bp, Mus musculus
gaggtgcaagctgaatgactttttt

SEQ ID NO: 491876 - DNA, 25 bp, Mus musculus
gaggtgcaagttcccattatagaaa

SEQ ID NO: 491877 - DNA, 25 bp, Mus musculus
gaggtgcaagttgccattatagaaa

SEQ ID NO: 491878 - DNA, 25 bp, Mus musculus
gaggtgcaatgcacagccttcctca

SEQ ID NO: 491879 - DNA, 25 bp, Mus musculus
gaggtgcaatgctcagccttcctca

SEQ ID NO: 491880 - DNA, 25 bp, Mus musculus
gaggtgcacaaacatccacctgctg

SEQ ID NO: 491881 - DNA, 25 bp, Mus musculus
gaggtgcacaaagatccacctgctg

SEQ ID NO: 491882 - DNA, 25 bp, Mus musculus
gaggtgcacagaaaaccagtttagt

SEQ ID NO: 491883 - DNA, 25 bp, Mus musculus
gaggtgcacagataaccagtttagt

SEQ ID NO: 491884 - DNA, 25 bp, Mus musculus
gaggtgcactcaagccatgaaactt

SEQ ID NO: 491885 - DNA, 25 bp, Mus musculus
gaggtgcactcatgccatgaaactt

SEQ ID NO: 491886 - DNA, 25 bp, Mus musculus
gaggtgcagatcctgatcacgtacc

SEQ ID NO: 491887 - DNA, 25 bp, Mus musculus
gaggtgcagatcgtgatcacgtacc

SEQ ID NO: 491888 - DNA, 25 bp, Mus musculus
gaggtgcagcttctaggagattata

SEQ ID NO: 491889 - DNA, 25 bp, Mus musculus
gaggtgcagcttgtaggagattata

SEQ ID NO: 491890 - DNA, 25 bp, Mus musculus
gaggtgcagtccctaatgttgcaga

SEQ ID NO: 491891 - DNA, 25 bp, Mus musculus
gaggtgcagtccgtaatgttgcaga

SEQ ID NO: 491892 - DNA, 25 bp, Mus musculus
gaggtgcagtgtcagtccccgactt

SEQ ID NO: 491893 - DNA, 25 bp, Mus musculus
gaggtgcagtgtgagtccccgactt

SEQ ID NO: 491894 - DNA, 25 bp, Mus musculus
gaggtgcatcaacccgagacctgga

SEQ ID NO: 491895 - DNA, 25 bp, Mus musculus
gaggtgcatcaagccgagacctgga

SEQ ID NO: 491896 - DNA, 25 bp, Mus musculus
gaggtgcattatattcttcatgttt

SEQ ID NO: 491897 - DNA, 25 bp, Mus musculus
gaggtgcattattttcttcatgttt

SEQ ID NO: 491898 - DNA, 25 bp, Mus musculus
gaggtgcattttcttaggtcagcta

SEQ ID NO: 491899 - DNA, 25 bp, Mus musculus
gaggtgcattttgttaggtcagcta

SEQ ID NO: 491900 - DNA, 25 bp, Mus musculus
gaggtgccaacaatgatgaaggtaa

SEQ ID NO: 491901 - DNA, 25 bp, Mus musculus
gaggtgccaacattgatgaaggtaa

SEQ ID NO: 491902 - DNA, 25 bp, Mus musculus
gaggtgccacttcagaatcttacgt

SEQ ID NO: 491903 - DNA, 25 bp, Mus musculus
gaggtgccacttcgcctacttgctt

SEQ ID NO: 491904 - DNA, 25 bp, Mus musculus
gaggtgccacttgagaatcttacgt

SEQ ID NO: 491905 - DNA, 25 bp, Mus musculus
gaggtgccacttggcctacttgctt

SEQ ID NO: 491906 - DNA, 25 bp, Mus musculus
gaggtgccaggcaacttccagggcc

SEQ ID NO: 491907 - DNA, 25 bp, Mus musculus
gaggtgccaggctacttccagggcc

SEQ ID NO: 491908 - DNA, 25 bp, Mus musculus
gaggtgcccagaagtactcttcact

SEQ ID NO: 491909 - DNA, 25 bp, Mus musculus
gaggtgcccagatgtactcttcact

SEQ ID NO: 491910 - DNA, 25 bp, Mus musculus
gaggtgcccagtattcagctgttga

SEQ ID NO: 491911 - DNA, 25 bp, Mus musculus
gaggtgcccagttttcagctgttga

SEQ ID NO: 491912 - DNA, 25 bp, Mus musculus
gaggtgcccctcctgaaaaagtagg

SEQ ID NO: 491913 - DNA, 25 bp, Mus musculus
gaggtgcccctcgtgaaaaagtagg

SEQ ID NO: 491914 - DNA, 25 bp, Mus musculus
gaggtgcccgatcagtttgagattt

SEQ ID NO: 491915 - DNA, 25 bp, Mus musculus
gaggtgcccgatgagtttgagattt

SEQ ID NO: 491916 - DNA, 25 bp, Mus musculus
gaggtgcccgtactccacacggaaa

SEQ ID NO: 491917 - DNA, 25 bp, Mus musculus
gaggtgcccgtagtccacacggaaa

SEQ ID NO: 491918 - DNA, 25 bp, Mus musculus
gaggtgccctacagtgagataccac

SEQ ID NO: 491919 - DNA, 25 bp, Mus musculus
gaggtgccctactgtgagataccac

SEQ ID NO: 491920 - DNA, 25 bp, Mus musculus
gaggtgccgaacaccgtgcacttaa

SEQ ID NO: 491921 - DNA, 25 bp, Mus musculus
gaggtgccgaactccgtgcacttaa

SEQ ID NO: 491922 - DNA, 25 bp, Mus musculus
gaggtgcctagcagtgttcctgaga

SEQ ID NO: 491923 - DNA, 25 bp, Mus musculus
gaggtgcctagctgtgttcctgaga

SEQ ID NO: 491924 - DNA, 25 bp, Mus musculus
gaggtgcctccaaggacagcagtaa

SEQ ID NO: 491925 - DNA, 25 bp, Mus musculus
gaggtgcctccatggacagcagtaa

SEQ ID NO: 491926 - DNA, 25 bp, Mus musculus
gaggtgccttcaagggcccaagatt

SEQ ID NO: 491927 - DNA, 25 bp, Mus musculus
gaggtgccttcatgggcccaagatt

SEQ ID NO: 491928 - DNA, 25 bp, Mus musculus
gaggtgcggaagaacaaagaatcca

SEQ ID NO: 491929 - DNA, 25 bp, Mus musculus
gaggtgcggaagtacaaagaatcca

SEQ ID NO: 491930 - DNA, 25 bp, Mus musculus
gaggtgcgtcccagaggtccagcaa

SEQ ID NO: 491931 - DNA, 25 bp, Mus musculus
gaggtgcgtccctgaggtccagcaa

SEQ ID NO: 491932 - DNA, 25 bp, Mus musculus
gaggtgctacttaaatccgagtgac

SEQ ID NO: 491933 - DNA, 25 bp, Mus musculus
gaggtgctactttaatccgagtgac

SEQ ID NO: 491934 - DNA, 25 bp, Mus musculus
gaggtgctcctgagttcagccagga

SEQ ID NO: 491935 - DNA, 25 bp, Mus musculus
gaggtgctcctgtgttcagccagga

SEQ ID NO: 491936 - DNA, 25 bp, Mus musculus
gaggtgctccttaaaatctctaggt

SEQ ID NO: 491937 - DNA, 25 bp, Mus musculus
gaggtgctcctttaaatctctaggt

SEQ ID NO: 491938 - DNA, 25 bp, Mus musculus
gaggtgctctgtctttcctaggaca

SEQ ID NO: 491939 - DNA, 25 bp, Mus musculus
gaggtgctctgtgtttcctaggaca

SEQ ID NO: 491940 - DNA, 25 bp, Mus musculus
gaggtgctcttcaaatctcccttag

SEQ ID NO: 491941 - DNA, 25 bp, Mus musculus
gaggtgctcttctaatctcccttag

SEQ ID NO: 491942 - DNA, 25 bp, Mus musculus
gaggtgctgcctagagcattttttc

SEQ ID NO: 491943 - DNA, 25 bp, Mus musculus
gaggtgctgccttgagcattttttc

SEQ ID NO: 491944 - DNA, 25 bp, Mus musculus
gaggtgctggcactaccaggcataa

SEQ ID NO: 491945 - DNA, 25 bp, Mus musculus
gaggtgctggcagtaccaggcataa

SEQ ID NO: 491946 - DNA, 25 bp, Mus musculus
gaggtgctggctcggatctctttct

SEQ ID NO: 491947 - DNA, 25 bp, Mus musculus
gaggtgctggctgggatctctttct

SEQ ID NO: 491948 - DNA, 25 bp, Mus musculus
gaggtgctgggccttcaacttctac

SEQ ID NO: 491949 - DNA, 25 bp, Mus musculus
gaggtgctgggcgttcaacttctac

SEQ ID NO: 491950 - DNA, 25 bp, Mus musculus
gaggtgctggttctcttattagccc

SEQ ID NO: 491951 - DNA, 25 bp, Mus musculus
gaggtgctggttgtcttattagccc

SEQ ID NO: 491952 - DNA, 25 bp, Mus musculus
gaggtgctgtagaagctgccctgtc

SEQ ID NO: 491953 - DNA, 25 bp, Mus musculus
gaggtgctgtagtagctgccctgtc

SEQ ID NO: 491954 - DNA, 25 bp, Mus musculus
gaggtgctgtctccagagccttgaa

SEQ ID NO: 491955 - DNA, 25 bp, Mus musculus
gaggtgctgtctgcagagccttgaa

SEQ ID NO: 491956 - DNA, 25 bp, Mus musculus
gaggtgctgtgcagacaagctgcct

SEQ ID NO: 491957 - DNA, 25 bp, Mus musculus
gaggtgctgtgctgacaagctgcct

SEQ ID NO: 491958 - DNA, 25 bp, Mus musculus
gaggtgcttgcaattgtttgtatac

SEQ ID NO: 491959 - DNA, 25 bp, Mus musculus
gaggtgcttgcatttgtttgtatac

SEQ ID NO: 491960 - DNA, 25 bp, Mus musculus
gaggtgcttttacagaccgctaata

SEQ ID NO: 491961 - DNA, 25 bp, Mus musculus
gaggtgcttttagagaccgctaata

SEQ ID NO: 491962 - DNA, 25 bp, Mus musculus
gaggtggaaactcatccccgaacta

SEQ ID NO: 491963 - DNA, 25 bp, Mus musculus
gaggtggaaactgatccccgaacta

SEQ ID NO: 491964 - DNA, 25 bp, Mus musculus
gaggtggaaatcagccgcttccgag

SEQ ID NO: 491965 - DNA, 25 bp, Mus musculus
gaggtggaaatctgccgcttccgag

SEQ ID NO: 491966 - DNA, 25 bp, Mus musculus
gaggtggaagacataaatctagaac

SEQ ID NO: 491967 - DNA, 25 bp, Mus musculus
gaggtggaagacttaaatctagaac

SEQ ID NO: 491968 - DNA, 25 bp, Mus musculus
gaggtggaattcagcacagatctta

SEQ ID NO: 491969 - DNA, 25 bp, Mus musculus
gaggtggaattctgcacagatctta

SEQ ID NO: 491970 - DNA, 25 bp, Mus musculus
gaggtggacaatcacccctgatgcc

SEQ ID NO: 491971 - DNA, 25 bp, Mus musculus
gaggtggacaatgacccctgatgcc

SEQ ID NO: 491972 - DNA, 25 bp, Mus musculus
gaggtggacattatttccccaattt

SEQ ID NO: 491973 - DNA, 25 bp, Mus musculus
gaggtggacattttttccccaattt

SEQ ID NO: 491974 - DNA, 25 bp, Mus musculus
gaggtggacccaactctagaaccag

SEQ ID NO: 491975 - DNA, 25 bp, Mus musculus
gaggtggacccacaagtgagttttc

SEQ ID NO: 491976 - DNA, 25 bp, Mus musculus
gaggtggacccagaagtgagttttc

SEQ ID NO: 491977 - DNA, 25 bp, Mus musculus
gaggtggacccatctctagaaccag

SEQ ID NO: 491978 - DNA, 25 bp, Mus musculus
gaggtggaccccatgctgaccctgg

SEQ ID NO: 491979 - DNA, 25 bp, Mus musculus
gaggtggaccccttgctgaccctgg

SEQ ID NO: 491980 - DNA, 25 bp, Mus musculus
gaggtggaccgcacggaattcgaac

SEQ ID NO: 491981 - DNA, 25 bp, Mus musculus
gaggtggaccgctcggaattcgaac

SEQ ID NO: 491982 - DNA, 25 bp, Mus musculus
gaggtggaccttctggtatatctca

SEQ ID NO: 491983 - DNA, 25 bp, Mus musculus
gaggtggaccttgtggtatatctca

SEQ ID NO: 491984 - DNA, 25 bp, Mus musculus
gaggtggactacaacacttttcatg

SEQ ID NO: 491985 - DNA, 25 bp, Mus musculus
gaggtggactactacacttttcatg

SEQ ID NO: 491986 - DNA, 25 bp, Mus musculus
gaggtggactctatgtttcctttca

SEQ ID NO: 491987 - DNA, 25 bp, Mus musculus
gaggtggactctttgtttcctttca

SEQ ID NO: 491988 - DNA, 25 bp, Mus musculus
gaggtggagacccatgccccgtgcg

SEQ ID NO: 491989 - DNA, 25 bp, Mus musculus
gaggtggagaccgatgccccgtgcg

SEQ ID NO: 491990 - DNA, 25 bp, Mus musculus
gaggtggagccaacctataactcat

SEQ ID NO: 491991 - DNA, 25 bp, Mus musculus
gaggtggagccacccgctcctagaa

SEQ ID NO: 491992 - DNA, 25 bp, Mus musculus
gaggtggagccactctcctgaacaa

SEQ ID NO: 491993 - DNA, 25 bp, Mus musculus
gaggtggagccagccgctcctagaa

SEQ ID NO: 491994 - DNA, 25 bp, Mus musculus
gaggtggagccagtctcctgaacaa

SEQ ID NO: 491995 - DNA, 25 bp, Mus musculus
gaggtggagccatcctataactcat

SEQ ID NO: 491996 - DNA, 25 bp, Mus musculus
gaggtggagcctcaaactaaaacct

SEQ ID NO: 491997 - DNA, 25 bp, Mus musculus
gaggtggagcctgaaactaaaacct

SEQ ID NO: 491998 - DNA, 25 bp, Mus musculus
gaggtggaggaacccattgctcttt

SEQ ID NO: 491999 - DNA, 25 bp, Mus musculus
gaggtggaggaagccattgctcttt

SEQ ID NO: 492000 - DNA, 25 bp, Mus musculus
gaggtggaggacacattttgcccta

SEQ ID NO: 492001 - DNA, 25 bp, Mus musculus
gaggtggaggactcattttgcccta

SEQ ID NO: 492002 - DNA, 25 bp, Mus musculus
gaggtggaggccatctagatcccca

SEQ ID NO: 492003 - DNA, 25 bp, Mus musculus
gaggtggaggccttctagatcccca

SEQ ID NO: 492004 - DNA, 25 bp, Mus musculus
gaggtggagggcattcccacccaga

SEQ ID NO: 492005 - DNA, 25 bp, Mus musculus
gaggtggagggctttcccacccaga

SEQ ID NO: 492006 - DNA, 25 bp, Mus musculus
gaggtggagtcacgctgcacaacat

SEQ ID NO: 492007 - DNA, 25 bp, Mus musculus
gaggtggagtcaggctgcacaacat

SEQ ID NO: 492008 - DNA, 25 bp, Mus musculus
gaggtggagtccactgctgaccctg

SEQ ID NO: 492009 - DNA, 25 bp, Mus musculus
gaggtggagtcctctgctgaccctg

SEQ ID NO: 492010 - DNA, 25 bp, Mus musculus
gaggtggatcacaagcagagtcaaa

SEQ ID NO: 492011 - DNA, 25 bp, Mus musculus
gaggtggatcactagcagagtcaaa

SEQ ID NO: 492012 - DNA, 25 bp, Mus musculus
gaggtggatccccacaccaaggaga

SEQ ID NO: 492013 - DNA, 25 bp, Mus musculus
gaggtggatcccgacaccaaggaga

SEQ ID NO: 492014 - DNA, 25 bp, Mus musculus
gaggtggcactaccagtctgtctaa

SEQ ID NO: 492015 - DNA, 25 bp, Mus musculus
gaggtggcactagcagtctgtctaa

SEQ ID NO: 492016 - DNA, 25 bp, Mus musculus
gaggtggcaggaattctacctagtc

SEQ ID NO: 492017 - DNA, 25 bp, Mus musculus
gaggtggcaggatttctacctagtc

SEQ ID NO: 492018 - DNA, 25 bp, Mus musculus
gaggtggcatcaaaccgattccaaa

SEQ ID NO: 492019 - DNA, 25 bp, Mus musculus
gaggtggcatcataccgattccaaa

SEQ ID NO: 492020 - DNA, 25 bp, Mus musculus
gaggtggcatccacaagcccgggca

SEQ ID NO: 492021 - DNA, 25 bp, Mus musculus
gaggtggcatcctcaagcccgggca

SEQ ID NO: 492022 - DNA, 25 bp, Mus musculus
gaggtggccacacaagcagtgttat

SEQ ID NO: 492023 - DNA, 25 bp, Mus musculus
gaggtggccacagaagcagtgttat

SEQ ID NO: 492024 - DNA, 25 bp, Mus musculus
gaggtggcccgtaagctggtcatca

SEQ ID NO: 492025 - DNA, 25 bp, Mus musculus
gaggtggcccgttagctggtcatca

SEQ ID NO: 492026 - DNA, 25 bp, Mus musculus
gaggtggcctcacgaacgcctacaa

SEQ ID NO: 492027 - DNA, 25 bp, Mus musculus
gaggtggcctcaggaacgcctacaa

SEQ ID NO: 492028 - DNA, 25 bp, Mus musculus
gaggtggccttgatcagttaaactt

SEQ ID NO: 492029 - DNA, 25 bp, Mus musculus
gaggtggccttgttcagttaaactt

SEQ ID NO: 492030 - DNA, 25 bp, Mus musculus
gaggtggcgcagacagttctcagca

SEQ ID NO: 492031 - DNA, 25 bp, Mus musculus
gaggtggcgcagtcagttctcagca

SEQ ID NO: 492032 - DNA, 25 bp, Mus musculus
gaggtggctagcaaaaggaataata

SEQ ID NO: 492033 - DNA, 25 bp, Mus musculus
gaggtggctagctaaaggaataata

SEQ ID NO: 492034 - DNA, 25 bp, Mus musculus
gaggtggctataatccgcgaggcac

SEQ ID NO: 492035 - DNA, 25 bp, Mus musculus
gaggtggctatattccgcgaggcac

SEQ ID NO: 492036 - DNA, 25 bp, Mus musculus
gaggtggctcatcaaaggttgctac

SEQ ID NO: 492037 - DNA, 25 bp, Mus musculus
gaggtggctcatgaaaggttgctac

SEQ ID NO: 492038 - DNA, 25 bp, Mus musculus
gaggtggctcggacgcgtgccccga

SEQ ID NO: 492039 - DNA, 25 bp, Mus musculus
gaggtggctcggtcgcgtgccccga

SEQ ID NO: 492040 - DNA, 25 bp, Mus musculus
gaggtggctgcacacccctagagaa

SEQ ID NO: 492041 - DNA, 25 bp, Mus musculus
gaggtggctgcagacccctagagaa

SEQ ID NO: 492042 - DNA, 25 bp, Mus musculus
gaggtggctggccacatctttgaca

SEQ ID NO: 492043 - DNA, 25 bp, Mus musculus
gaggtggctggcgacatctttgaca

SEQ ID NO: 492044 - DNA, 25 bp, Mus musculus
gaggtggctgggaaacacttgtaca

SEQ ID NO: 492045 - DNA, 25 bp, Mus musculus
gaggtggctgggtaacacttgtaca

SEQ ID NO: 492046 - DNA, 25 bp, Mus musculus
gaggtggcttcgagcctaagagcat

SEQ ID NO: 492047 - DNA, 25 bp, Mus musculus
gaggtggcttcgtgcctaagagcat

SEQ ID NO: 492048 - DNA, 25 bp, Mus musculus
gaggtggcttgaacaagaactcagg

SEQ ID NO: 492049 - DNA, 25 bp, Mus musculus
gaggtggcttgatcaagaactcagg

SEQ ID NO: 492050 - DNA, 25 bp, Mus musculus
gaggtggctttgagtctgccagact

SEQ ID NO: 492051 - DNA, 25 bp, Mus musculus
gaggtggctttgtgtctgccagact

SEQ ID NO: 492052 - DNA, 25 bp, Mus musculus
gaggtggcttttaggagcaaacaca

SEQ ID NO: 492053 - DNA, 25 bp, Mus musculus
gaggtggctttttggagcaaacaca

SEQ ID NO: 492054 - DNA, 25 bp, Mus musculus
gaggtgggcagcaagctactgtaaa

SEQ ID NO: 492055 - DNA, 25 bp, Mus musculus
gaggtgggcagctagctactgtaaa

SEQ ID NO: 492056 - DNA, 25 bp, Mus musculus
gaggtgggccagcttatcagccttc

SEQ ID NO: 492057 - DNA, 25 bp, Mus musculus
gaggtgggccaggttatcagccttc

SEQ ID NO: 492058 - DNA, 25 bp, Mus musculus
gaggtgggcctcacatacttaatga

SEQ ID NO: 492059 - DNA, 25 bp, Mus musculus
gaggtgggcctctcatacttaatga

SEQ ID NO: 492060 - DNA, 25 bp, Mus musculus
gaggtgggcgttcctttcttacaga

SEQ ID NO: 492061 - DNA, 25 bp, Mus musculus
gaggtgggcgttgctttcttacaga

SEQ ID NO: 492062 - DNA, 25 bp, Mus musculus
gaggtgggtaatactgctttttgcc

SEQ ID NO: 492063 - DNA, 25 bp, Mus musculus
gaggtgggtaattctgctttttgcc

SEQ ID NO: 492064 - DNA, 25 bp, Mus musculus
gaggtgggttatacagtctggctaa

SEQ ID NO: 492065 - DNA, 25 bp, Mus musculus
gaggtgggttattcagtctggctaa

SEQ ID NO: 492066 - DNA, 25 bp, Mus musculus
gaggtggtaacaaggttccacagaa

SEQ ID NO: 492067 - DNA, 25 bp, Mus musculus
gaggtggtaacatggttccacagaa

SEQ ID NO: 492068 - DNA, 25 bp, Mus musculus
gaggtggtaacgaatctccaggtta

SEQ ID NO: 492069 - DNA, 25 bp, Mus musculus
gaggtggtaacgtatctccaggtta

SEQ ID NO: 492070 - DNA, 25 bp, Mus musculus
gaggtggtaagcatcatcatgtttt

SEQ ID NO: 492071 - DNA, 25 bp, Mus musculus
gaggtggtaagcttcatcatgtttt

SEQ ID NO: 492072 - DNA, 25 bp, Mus musculus
gaggtggtaccaatactcctggcgc

SEQ ID NO: 492073 - DNA, 25 bp, Mus musculus
gaggtggtaccattactcctggcgc

SEQ ID NO: 492074 - DNA, 25 bp, Mus musculus
gaggtggtacctctcagaaactcac

SEQ ID NO: 492075 - DNA, 25 bp, Mus musculus
gaggtggtacctgtcagaaactcac

SEQ ID NO: 492076 - DNA, 25 bp, Mus musculus
gaggtggtagaactaatcccttact

SEQ ID NO: 492077 - DNA, 25 bp, Mus musculus
gaggtggtagaagtaatcccttact

SEQ ID NO: 492078 - DNA, 25 bp, Mus musculus
gaggtggtatacagtgcccatgcct

SEQ ID NO: 492079 - DNA, 25 bp, Mus musculus
gaggtggtatactgtgcccatgcct

SEQ ID NO: 492080 - DNA, 25 bp, Mus musculus
gaggtggtatcgattttgctttata

SEQ ID NO: 492081 - DNA, 25 bp, Mus musculus
gaggtggtatcgtttttgctttata

SEQ ID NO: 492082 - DNA, 25 bp, Mus musculus
gaggtggtcagaccaaagaacttag

SEQ ID NO: 492083 - DNA, 25 bp, Mus musculus
gaggtggtcagagcaaagaacttag

SEQ ID NO: 492084 - DNA, 25 bp, Mus musculus
gaggtggtccaacaactaagagcag

SEQ ID NO: 492085 - DNA, 25 bp, Mus musculus
gaggtggtccaagaactaagagcag

SEQ ID NO: 492086 - DNA, 25 bp, Mus musculus
gaggtggtcgggagcctctgcccgg

SEQ ID NO: 492087 - DNA, 25 bp, Mus musculus
gaggtggtcgggtgcctctgcccgg

SEQ ID NO: 492088 - DNA, 25 bp, Mus musculus
gaggtggtctcacattccctggtca

SEQ ID NO: 492089 - DNA, 25 bp, Mus musculus
gaggtggtctcagattccctggtca

SEQ ID NO: 492090 - DNA, 25 bp, Mus musculus
gaggtggtctcgctcaagagattca

SEQ ID NO: 492091 - DNA, 25 bp, Mus musculus
gaggtggtctcggtcaagagattca

SEQ ID NO: 492092 - DNA, 25 bp, Mus musculus
gaggtggtctgtaattcaattgttt

SEQ ID NO: 492093 - DNA, 25 bp, Mus musculus
gaggtggtctgttattcaattgttt

SEQ ID NO: 492094 - DNA, 25 bp, Mus musculus
gaggtggtcttgaaaaggtcgccaa

SEQ ID NO: 492095 - DNA, 25 bp, Mus musculus
gaggtggtcttgtaaaggtcgccaa

SEQ ID NO: 492096 - DNA, 25 bp, Mus musculus
gaggtggtggctctatcatttcccc

SEQ ID NO: 492097 - DNA, 25 bp, Mus musculus
gaggtggtggctgtatcatttcccc

SEQ ID NO: 492098 - DNA, 25 bp, Mus musculus
gaggtggtgtcccaagcctttgtcc

SEQ ID NO: 492099 - DNA, 25 bp, Mus musculus
gaggtggtgtccgaagcctttgtcc

SEQ ID NO: 492100 - DNA, 25 bp, Mus musculus
gaggtggttaatatgtgcatcggaa

SEQ ID NO: 492101 - DNA, 25 bp, Mus musculus
gaggtggttaatttgtgcatcggaa

SEQ ID NO: 492102 - DNA, 25 bp, Mus musculus
gaggtggttctcatagtcttgaaaa

SEQ ID NO: 492103 - DNA, 25 bp, Mus musculus
gaggtggttctcttagtcttgaaaa

SEQ ID NO: 492104 - DNA, 25 bp, Mus musculus
gaggtggttcttagtacacacgact

SEQ ID NO: 492105 - DNA, 25 bp, Mus musculus
gaggtggttctttgtacacacgact

SEQ ID NO: 492106 - DNA, 25 bp, Mus musculus
gaggtggtttacagtccagtctgcc

SEQ ID NO: 492107 - DNA, 25 bp, Mus musculus
gaggtggtttactgtccagtctgcc

SEQ ID NO: 492108 - DNA, 25 bp, Mus musculus
gaggtggtttttacctggtgagcat

SEQ ID NO: 492109 - DNA, 25 bp, Mus musculus
gaggtggttttttcctggtgagcat

SEQ ID NO: 492110 - DNA, 25 bp, Mus musculus
gaggtgtaatttctgaagccatcaa

SEQ ID NO: 492111 - DNA, 25 bp, Mus musculus
gaggtgtaatttgtgaagccatcaa

SEQ ID NO: 492112 - DNA, 25 bp, Mus musculus
gaggtgtacatacctaccttttcgg

SEQ ID NO: 492113 - DNA, 25 bp, Mus musculus
gaggtgtacatagctaccttttcgg

SEQ ID NO: 492114 - DNA, 25 bp, Mus musculus
gaggtgtacattagtcttgcctttt

SEQ ID NO: 492115 - DNA, 25 bp, Mus musculus
gaggtgtacatttgtcttgcctttt

SEQ ID NO: 492116 - DNA, 25 bp, Mus musculus
gaggtgtacgacagcctggattact

SEQ ID NO: 492117 - DNA, 25 bp, Mus musculus
gaggtgtacgactgcctggattact

SEQ ID NO: 492118 - DNA, 25 bp, Mus musculus
gaggtgtactttatacagtgtcgta

SEQ ID NO: 492119 - DNA, 25 bp, Mus musculus
gaggtgtactttttacagtgtcgta

SEQ ID NO: 492120 - DNA, 25 bp, Mus musculus
gaggtgtagcacatagccatcatag

SEQ ID NO: 492121 - DNA, 25 bp, Mus musculus
gaggtgtagcacttagccatcatag

SEQ ID NO: 492122 - DNA, 25 bp, Mus musculus
gaggtgtagcttccttctgtgatgc

SEQ ID NO: 492123 - DNA, 25 bp, Mus musculus
gaggtgtagcttgcttctgtgatgc

SEQ ID NO: 492124 - DNA, 25 bp, Mus musculus
gaggtgtagtccatcaccacgggaa

SEQ ID NO: 492125 - DNA, 25 bp, Mus musculus
gaggtgtagtccttcaccacgggaa

SEQ ID NO: 492126 - DNA, 25 bp, Mus musculus
gaggtgtatactcaccagttatcca

SEQ ID NO: 492127 - DNA, 25 bp, Mus musculus
gaggtgtatactgaccagttatcca

SEQ ID NO: 492128 - DNA, 25 bp, Mus musculus
gaggtgtcaactctgaaattgtaca

SEQ ID NO: 492129 - DNA, 25 bp, Mus musculus
gaggtgtcaactgtgaaattgtaca

SEQ ID NO: 492130 - DNA, 25 bp, Mus musculus
gaggtgtccaaaaattttagtaaat

SEQ ID NO: 492131 - DNA, 25 bp, Mus musculus
gaggtgtccaaatattttagtaaat

SEQ ID NO: 492132 - DNA, 25 bp, Mus musculus
gaggtgtccactagagtgaagccat

SEQ ID NO: 492133 - DNA, 25 bp, Mus musculus
gaggtgtccacttgagtgaagccat

SEQ ID NO: 492134 - DNA, 25 bp, Mus musculus
gaggtgtccattacggtaatcgtct

SEQ ID NO: 492135 - DNA, 25 bp, Mus musculus
gaggtgtccatttcggtaatcgtct

SEQ ID NO: 492136 - DNA, 25 bp, Mus musculus
gaggtgtccccgaaggcgtcgccac

SEQ ID NO: 492137 - DNA, 25 bp, Mus musculus
gaggtgtccccgtaggcgtcgccac

SEQ ID NO: 492138 - DNA, 25 bp, Mus musculus
gaggtgtcctcccagcacgtggaaa

SEQ ID NO: 492139 - DNA, 25 bp, Mus musculus
gaggtgtcctccgagcacgtggaaa

SEQ ID NO: 492140 - DNA, 25 bp, Mus musculus
gaggtgtcctgaaacgcaagaatct

SEQ ID NO: 492141 - DNA, 25 bp, Mus musculus
gaggtgtcctgatacgcaagaatct

SEQ ID NO: 492142 - DNA, 25 bp, Mus musculus
gaggtgtcgaaacccgccagtgtca

SEQ ID NO: 492143 - DNA, 25 bp, Mus musculus
gaggtgtcgaaagccgccagtgtca

SEQ ID NO: 492144 - DNA, 25 bp, Mus musculus
gaggtgtcgttcatttgtgacgtca

SEQ ID NO: 492145 - DNA, 25 bp, Mus musculus
gaggtgtcgttcttttgtgacgtca

SEQ ID NO: 492146 - DNA, 25 bp, Mus musculus
gaggtgtctgatagtgctttagcca

SEQ ID NO: 492147 - DNA, 25 bp, Mus musculus
gaggtgtctgattgtgctttagcca

SEQ ID NO: 492148 - DNA, 25 bp, Mus musculus
gaggtgtgaataccagcgtccgaca

SEQ ID NO: 492149 - DNA, 25 bp, Mus musculus
gaggtgtgaatagcagcgtccgaca

SEQ ID NO: 492150 - DNA, 25 bp, Mus musculus
gaggtgtgagccattgtacttagtt

SEQ ID NO: 492151 - DNA, 25 bp, Mus musculus
gaggtgtgagcctttgtacttagtt

SEQ ID NO: 492152 - DNA, 25 bp, Mus musculus
gaggtgtgattaagctcccagctgc

SEQ ID NO: 492153 - DNA, 25 bp, Mus musculus
gaggtgtgattatgctcccagctgc

SEQ ID NO: 492154 - DNA, 25 bp, Mus musculus
gaggtgtgcagaaccatgaccaaag

SEQ ID NO: 492155 - DNA, 25 bp, Mus musculus
gaggtgtgcagatccatgaccaaag

SEQ ID NO: 492156 - DNA, 25 bp, Mus musculus
gaggtgtgcccaaatgtttccagaa

SEQ ID NO: 492157 - DNA, 25 bp, Mus musculus
gaggtgtgcccatatgtttccagaa

SEQ ID NO: 492158 - DNA, 25 bp, Mus musculus
gaggtgtgcggcatcgcaccctacg

SEQ ID NO: 492159 - DNA, 25 bp, Mus musculus
gaggtgtgcggcttcgcaccctacg

SEQ ID NO: 492160 - DNA, 25 bp, Mus musculus
gaggtgtgctaaaggctgccctccg

SEQ ID NO: 492161 - DNA, 25 bp, Mus musculus
gaggtgtgctaatggctgccctccg

SEQ ID NO: 492162 - DNA, 25 bp, Mus musculus
gaggtgtgctaccacagctaagctg

SEQ ID NO: 492163 - DNA, 25 bp, Mus musculus
gaggtgtgctacgacagctaagctg

SEQ ID NO: 492164 - DNA, 25 bp, Mus musculus
gaggtgtgctgacctaagacccaaa

SEQ ID NO: 492165 - DNA, 25 bp, Mus musculus
gaggtgtgctgagctaagacccaaa

SEQ ID NO: 492166 - DNA, 25 bp, Mus musculus
gaggtgtggccaacatccttaggct

SEQ ID NO: 492167 - DNA, 25 bp, Mus musculus
gaggtgtggccatcatccttaggct

SEQ ID NO: 492168 - DNA, 25 bp, Mus musculus
gaggtgtggctaacagtcaatgact

SEQ ID NO: 492169 - DNA, 25 bp, Mus musculus
gaggtgtggctaagcattcttagac

SEQ ID NO: 492170 - DNA, 25 bp, Mus musculus
gaggtgtggctatcagtcaatgact

SEQ ID NO: 492171 - DNA, 25 bp, Mus musculus
gaggtgtggctatgcattcttagac

SEQ ID NO: 492172 - DNA, 25 bp, Mus musculus
gaggtgtgtatacatttccccagat

SEQ ID NO: 492173 - DNA, 25 bp, Mus musculus
gaggtgtgtatagatttccccagat

SEQ ID NO: 492174 - DNA, 25 bp, Mus musculus
gaggtgtgtcaccacggaagctttt

SEQ ID NO: 492175 - DNA, 25 bp, Mus musculus
gaggtgtgtcacgacggaagctttt

SEQ ID NO: 492176 - DNA, 25 bp, Mus musculus
gaggtgtgtcttactggagactctg

SEQ ID NO: 492177 - DNA, 25 bp, Mus musculus
gaggtgtgtctttctggagactctg

SEQ ID NO: 492178 - DNA, 25 bp, Mus musculus
gaggtgtgtgagactgacaagccaa

SEQ ID NO: 492179 - DNA, 25 bp, Mus musculus
gaggtgtgtgagtctgacaagccaa

SEQ ID NO: 492180 - DNA, 25 bp, Mus musculus
gaggtgtgttatcactgctttttgt

SEQ ID NO: 492181 - DNA, 25 bp, Mus musculus
gaggtgtgttatgactgctttttgt

SEQ ID NO: 492182 - DNA, 25 bp, Mus musculus
gaggtgttagctcagccagagattc

SEQ ID NO: 492183 - DNA, 25 bp, Mus musculus
gaggtgttagctgagccagagattc

SEQ ID NO: 492184 - DNA, 25 bp, Mus musculus
gaggtgttcataactgaggaaattc

SEQ ID NO: 492185 - DNA, 25 bp, Mus musculus
gaggtgttcataattatatcagact

SEQ ID NO: 492186 - DNA, 25 bp, Mus musculus
gaggtgttcatatctgaggaaattc

SEQ ID NO: 492187 - DNA, 25 bp, Mus musculus
gaggtgttcatatttatatcagact

SEQ ID NO: 492188 - DNA, 25 bp, Mus musculus
gaggtgttcctcataagcatcatag

SEQ ID NO: 492189 - DNA, 25 bp, Mus musculus
gaggtgttcctcttaagcatcatag

SEQ ID NO: 492190 - DNA, 25 bp, Mus musculus
gaggtgttccttcggaaagcatccc

SEQ ID NO: 492191 - DNA, 25 bp, Mus musculus
gaggtgttccttgggaaagcatccc

SEQ ID NO: 492192 - DNA, 25 bp, Mus musculus
gaggtgttctgtatcttgttctttg

SEQ ID NO: 492193 - DNA, 25 bp, Mus musculus
gaggtgttctgtttcttgttctttg

SEQ ID NO: 492194 - DNA, 25 bp, Mus musculus
gaggtgttcttcaaagccagtgtca

SEQ ID NO: 492195 - DNA, 25 bp, Mus musculus
gaggtgttcttctaagccagtgtca

SEQ ID NO: 492196 - DNA, 25 bp, Mus musculus
gaggtgttgcagagactgtcacaga

SEQ ID NO: 492197 - DNA, 25 bp, Mus musculus
gaggtgttgcagtgactgtcacaga

SEQ ID NO: 492198 - DNA, 25 bp, Mus musculus
gaggtgttgcctccactccacagga

SEQ ID NO: 492199 - DNA, 25 bp, Mus musculus
gaggtgttgcctgcactccacagga

SEQ ID NO: 492200 - DNA, 25 bp, Mus musculus
gaggtgttgcttatggtctagtgac

SEQ ID NO: 492201 - DNA, 25 bp, Mus musculus
gaggtgttgcttttggtctagtgac

SEQ ID NO: 492202 - DNA, 25 bp, Mus musculus
gaggtgtttaacattctagtgatga

SEQ ID NO: 492203 - DNA, 25 bp, Mus musculus
gaggtgtttaactttctagtgatga

SEQ ID NO: 492204 - DNA, 25 bp, Mus musculus
gaggtgtttagaaagtctgttgtca

SEQ ID NO: 492205 - DNA, 25 bp, Mus musculus
gaggtgtttagatagtctgttgtca

SEQ ID NO: 492206 - DNA, 25 bp, Mus musculus
gaggtgtttctactttgtccatcaa

SEQ ID NO: 492207 - DNA, 25 bp, Mus musculus
gaggtgtttctagtttgtccatcaa

SEQ ID NO: 492208 - DNA, 25 bp, Mus musculus
gaggtgtttgcaagtggccattccc

SEQ ID NO: 492209 - DNA, 25 bp, Mus musculus
gaggtgtttgcatgtggccattccc

SEQ ID NO: 492210 - DNA, 25 bp, Mus musculus
gaggttaaaacccttcacattccat

SEQ ID NO: 492211 - DNA, 25 bp, Mus musculus
gaggttaaaaccgttcacattccat

SEQ ID NO: 492212 - DNA, 25 bp, Mus musculus
gaggttaacagcaatgccatacaag

SEQ ID NO: 492213 - DNA, 25 bp, Mus musculus
gaggttaacagctatgccatacaag

SEQ ID NO: 492214 - DNA, 25 bp, Mus musculus
gaggttaactgtccaactataaaaa

SEQ ID NO: 492215 - DNA, 25 bp, Mus musculus
gaggttaactgtgcaactataaaaa

SEQ ID NO: 492216 - DNA, 25 bp, Mus musculus
gaggttaacttcaactacatgagac

SEQ ID NO: 492217 - DNA, 25 bp, Mus musculus
gaggttaacttctactacatgagac

SEQ ID NO: 492218 - DNA, 25 bp, Mus musculus
gaggttaaggacactttcactcagt

SEQ ID NO: 492219 - DNA, 25 bp, Mus musculus
gaggttaaggactctttcactcagt

SEQ ID NO: 492220 - DNA, 25 bp, Mus musculus
gaggttaatattatgtctgcacttg

SEQ ID NO: 492221 - DNA, 25 bp, Mus musculus
gaggttaatattttgtctgcacttg

SEQ ID NO: 492222 - DNA, 25 bp, Mus musculus
gaggttacagctatctcgtatcaca

SEQ ID NO: 492223 - DNA, 25 bp, Mus musculus
gaggttacagctttctcgtatcaca

SEQ ID NO: 492224 - DNA, 25 bp, Mus musculus
gaggttacagtgagcgccatcatgc

SEQ ID NO: 492225 - DNA, 25 bp, Mus musculus
gaggttacagtgtgcgccatcatgc

SEQ ID NO: 492226 - DNA, 25 bp, Mus musculus
gaggttacagttagagcccacttgt

SEQ ID NO: 492227 - DNA, 25 bp, Mus musculus
gaggttacagtttgagcccacttgt

SEQ ID NO: 492228 - DNA, 25 bp, Mus musculus
gaggttacatctatctgtgacaaca

SEQ ID NO: 492229 - DNA, 25 bp, Mus musculus
gaggttacatctttctgtgacaaca

SEQ ID NO: 492230 - DNA, 25 bp, Mus musculus
gaggttaccagcagagacctatctt

SEQ ID NO: 492231 - DNA, 25 bp, Mus musculus
gaggttaccagctgagacctatctt

SEQ ID NO: 492232 - DNA, 25 bp, Mus musculus
gaggttaccatgaaacacttttatt

SEQ ID NO: 492233 - DNA, 25 bp, Mus musculus
gaggttaccatgtaacacttttatt

SEQ ID NO: 492234 - DNA, 25 bp, Mus musculus
gaggttaccccaaggaatgtggaat

SEQ ID NO: 492235 - DNA, 25 bp, Mus musculus
gaggttaccccatggaatgtggaat

SEQ ID NO: 492236 - DNA, 25 bp, Mus musculus
gaggttacccctaggtgagcagtag

SEQ ID NO: 492237 - DNA, 25 bp, Mus musculus
gaggttaccccttggtgagcagtag

SEQ ID NO: 492238 - DNA, 25 bp, Mus musculus
gaggttacctacagctacttcatgt

SEQ ID NO: 492239 - DNA, 25 bp, Mus musculus
gaggttacctactgctacttcatgt

SEQ ID NO: 492240 - DNA, 25 bp, Mus musculus
gaggttacctagctctatccttaag

SEQ ID NO: 492241 - DNA, 25 bp, Mus musculus
gaggttacctaggtctatccttaag

SEQ ID NO: 492242 - DNA, 25 bp, Mus musculus
gaggttacctcaactgaagtgtcag

SEQ ID NO: 492243 - DNA, 25 bp, Mus musculus
gaggttacctcatctgaagtgtcag

SEQ ID NO: 492244 - DNA, 25 bp, Mus musculus
gaggttacctgcaatagatgataca

SEQ ID NO: 492245 - DNA, 25 bp, Mus musculus
gaggttacctgctatagatgataca

SEQ ID NO: 492246 - DNA, 25 bp, Mus musculus
gaggttacggatatggatctggcta

SEQ ID NO: 492247 - DNA, 25 bp, Mus musculus
gaggttacggatttggatctggcta

SEQ ID NO: 492248 - DNA, 25 bp, Mus musculus
gaggttactacccatcacttgggat

SEQ ID NO: 492249 - DNA, 25 bp, Mus musculus
gaggttactaccgatcacttgggat

SEQ ID NO: 492250 - DNA, 25 bp, Mus musculus
gaggttactgtacgttaaatctgaa

SEQ ID NO: 492251 - DNA, 25 bp, Mus musculus
gaggttactgtaggttaaatctgaa

SEQ ID NO: 492252 - DNA, 25 bp, Mus musculus
gaggttacttagaaactgttttgag

SEQ ID NO: 492253 - DNA, 25 bp, Mus musculus
gaggttacttagtaactgttttgag

SEQ ID NO: 492254 - DNA, 25 bp, Mus musculus
gaggttagaatcaaatggcagtgta

SEQ ID NO: 492255 - DNA, 25 bp, Mus musculus
gaggttagaatctaatggcagtgta

SEQ ID NO: 492256 - DNA, 25 bp, Mus musculus
gaggttagaggtaccttctgtccac

SEQ ID NO: 492257 - DNA, 25 bp, Mus musculus
gaggttagaggttccttctgtccac

SEQ ID NO: 492258 - DNA, 25 bp, Mus musculus
gaggttagatttactgggatcccct

SEQ ID NO: 492259 - DNA, 25 bp, Mus musculus
gaggttagatttcaccctggcagtg

SEQ ID NO: 492260 - DNA, 25 bp, Mus musculus
gaggttagatttgaccctggcagtg

SEQ ID NO: 492261 - DNA, 25 bp, Mus musculus
gaggttagattttctgggatcccct

SEQ ID NO: 492262 - DNA, 25 bp, Mus musculus
gaggttagctctccaagtccagact

SEQ ID NO: 492263 - DNA, 25 bp, Mus musculus
gaggttagctctgcaagtccagact

SEQ ID NO: 492264 - DNA, 25 bp, Mus musculus
gaggttaggagtacaccccagtcct

SEQ ID NO: 492265 - DNA, 25 bp, Mus musculus
gaggttaggagttcaccccagtcct

SEQ ID NO: 492266 - DNA, 25 bp, Mus musculus
gaggttagtcctagctcatttggaa

SEQ ID NO: 492267 - DNA, 25 bp, Mus musculus
gaggttagtccttgctcatttggaa

SEQ ID NO: 492268 - DNA, 25 bp, Mus musculus
gaggttagtgctccattattcaatg

SEQ ID NO: 492269 - DNA, 25 bp, Mus musculus
gaggttagtgctgcattattcaatg

SEQ ID NO: 492270 - DNA, 25 bp, Mus musculus
gaggttatacatcttctgattcact

SEQ ID NO: 492271 - DNA, 25 bp, Mus musculus
gaggttatacatgttctgattcact

SEQ ID NO: 492272 - DNA, 25 bp, Mus musculus
gaggttatacttatcctcagtgtat

SEQ ID NO: 492273 - DNA, 25 bp, Mus musculus
gaggttatacttttcctcagtgtat

SEQ ID NO: 492274 - DNA, 25 bp, Mus musculus
gaggttataggtatcatccccagct

SEQ ID NO: 492275 - DNA, 25 bp, Mus musculus
gaggttataggtttcatccccagct

SEQ ID NO: 492276 - DNA, 25 bp, Mus musculus
gaggttatatacaatgagcccacaa

SEQ ID NO: 492277 - DNA, 25 bp, Mus musculus
gaggttatatactatgagcccacaa

SEQ ID NO: 492278 - DNA, 25 bp, Mus musculus
gaggttatatccctttctttgtatc

SEQ ID NO: 492279 - DNA, 25 bp, Mus musculus
gaggttatatccgtttctttgtatc

SEQ ID NO: 492280 - DNA, 25 bp, Mus musculus
gaggttatattgcaactgaccttta

SEQ ID NO: 492281 - DNA, 25 bp, Mus musculus
gaggttatattggaactgaccttta

SEQ ID NO: 492282 - DNA, 25 bp, Mus musculus
gaggttatcatccagcggctagaca

SEQ ID NO: 492283 - DNA, 25 bp, Mus musculus
gaggttatcatcgagcggctagaca

SEQ ID NO: 492284 - DNA, 25 bp, Mus musculus
gaggttatcccccatagccaagctg

SEQ ID NO: 492285 - DNA, 25 bp, Mus musculus
gaggttatccccgatagccaagctg

SEQ ID NO: 492286 - DNA, 25 bp, Mus musculus
gaggttatcctcattgatccgttcc

SEQ ID NO: 492287 - DNA, 25 bp, Mus musculus
gaggttatcctctttgatccgttcc

SEQ ID NO: 492288 - DNA, 25 bp, Mus musculus
gaggttatctagcacttaagtttca

SEQ ID NO: 492289 - DNA, 25 bp, Mus musculus
gaggttatctaggacttaagtttca

SEQ ID NO: 492290 - DNA, 25 bp, Mus musculus
gaggttatctccaaattaatcacaa

SEQ ID NO: 492291 - DNA, 25 bp, Mus musculus
gaggttatctcctaattaatcacaa

SEQ ID NO: 492292 - DNA, 25 bp, Mus musculus
gaggttatgaatatccccaggcgtt

SEQ ID NO: 492293 - DNA, 25 bp, Mus musculus
gaggttatgaatttccccaggcgtt

SEQ ID NO: 492294 - DNA, 25 bp, Mus musculus
gaggttatgggcaggtcttatatcc

SEQ ID NO: 492295 - DNA, 25 bp, Mus musculus
gaggttatgggctggtcttatatcc

SEQ ID NO: 492296 - DNA, 25 bp, Mus musculus
gaggttattcagaccttcaagctgc

SEQ ID NO: 492297 - DNA, 25 bp, Mus musculus
gaggttattcagtccttcaagctgc

SEQ ID NO: 492298 - DNA, 25 bp, Mus musculus
gaggttattctcatttcggatgcca

SEQ ID NO: 492299 - DNA, 25 bp, Mus musculus
gaggttattctcttttcggatgcca

SEQ ID NO: 492300 - DNA, 25 bp, Mus musculus
gaggttatttgacactttatttatg

SEQ ID NO: 492301 - DNA, 25 bp, Mus musculus
gaggttatttgagactttatttatg

SEQ ID NO: 492302 - DNA, 25 bp, Mus musculus
gaggttcaaacaatcttccactgac

SEQ ID NO: 492303 - DNA, 25 bp, Mus musculus
gaggttcaaacattcttccactgac

SEQ ID NO: 492304 - DNA, 25 bp, Mus musculus
gaggttcaacttcgaccctgagtcc

SEQ ID NO: 492305 - DNA, 25 bp, Mus musculus
gaggttcaacttggaccctgagtcc

SEQ ID NO: 492306 - DNA, 25 bp, Mus musculus
gaggttcaagccagggagtcagcat

SEQ ID NO: 492307 - DNA, 25 bp, Mus musculus
gaggttcaagcctgggagtcagcat

SEQ ID NO: 492308 - DNA, 25 bp, Mus musculus
gaggttcaaggcctttaagagtagt

SEQ ID NO: 492309 - DNA, 25 bp, Mus musculus
gaggttcaaggcgtttaagagtagt

SEQ ID NO: 492310 - DNA, 25 bp, Mus musculus
gaggttcaatgcaagccttggctac

SEQ ID NO: 492311 - DNA, 25 bp, Mus musculus
gaggttcaatgctagccttggctac

SEQ ID NO: 492312 - DNA, 25 bp, Mus musculus
gaggttcaccaacggaggacccagt

SEQ ID NO: 492313 - DNA, 25 bp, Mus musculus
gaggttcaccaagggaggacccagt

SEQ ID NO: 492314 - DNA, 25 bp, Mus musculus
gaggttcaccacctctgtggtctgt

SEQ ID NO: 492315 - DNA, 25 bp, Mus musculus
gaggttcaccacgtctgtggtctgt

SEQ ID NO: 492316 - DNA, 25 bp, Mus musculus
gaggttcacgacctccgtggtccgt

SEQ ID NO: 492317 - DNA, 25 bp, Mus musculus
gaggttcacgacgtccgtggtccgt

SEQ ID NO: 492318 - DNA, 25 bp, Mus musculus
gaggttcactctataaacatcaagg

SEQ ID NO: 492319 - DNA, 25 bp, Mus musculus
gaggttcactctttaaacatcaagg

SEQ ID NO: 492320 - DNA, 25 bp, Mus musculus
gaggttcagaacagtggccaaataa

SEQ ID NO: 492321 - DNA, 25 bp, Mus musculus
gaggttcagaactgtggccaaataa

SEQ ID NO: 492322 - DNA, 25 bp, Mus musculus
gaggttcagacaagcatctagtgac

SEQ ID NO: 492323 - DNA, 25 bp, Mus musculus
gaggttcagacatgcatctagtgac

SEQ ID NO: 492324 - DNA, 25 bp, Mus musculus
gaggttcagacgagcctggaaacaa

SEQ ID NO: 492325 - DNA, 25 bp, Mus musculus
gaggttcagacgtgcctggaaacaa

SEQ ID NO: 492326 - DNA, 25 bp, Mus musculus
gaggttcagagcagagcaccatcag

SEQ ID NO: 492327 - DNA, 25 bp, Mus musculus
gaggttcagagctgagcaccatcag

SEQ ID NO: 492328 - DNA, 25 bp, Mus musculus
gaggttcagctcaggtgtttcgtga

SEQ ID NO: 492329 - DNA, 25 bp, Mus musculus
gaggttcagctctggtgtttcgtga

SEQ ID NO: 492330 - DNA, 25 bp, Mus musculus
gaggttcaggcgcacagtgttccca

SEQ ID NO: 492331 - DNA, 25 bp, Mus musculus
gaggttcaggcggacagtgttccca

SEQ ID NO: 492332 - DNA, 25 bp, Mus musculus
gaggttcagggcatcaccccaacaa

SEQ ID NO: 492333 - DNA, 25 bp, Mus musculus
gaggttcagggcttcaccccaacaa

SEQ ID NO: 492334 - DNA, 25 bp, Mus musculus
gaggttcaggttaatgtccctgtct

SEQ ID NO: 492335 - DNA, 25 bp, Mus musculus
gaggttcaggtttatgtccctgtct

SEQ ID NO: 492336 - DNA, 25 bp, Mus musculus
gaggttcatatacttcaagccccag

SEQ ID NO: 492337 - DNA, 25 bp, Mus musculus
gaggttcatatagttcaagccccag

SEQ ID NO: 492338 - DNA, 25 bp, Mus musculus
gaggttcatggtagtactttttgta

SEQ ID NO: 492339 - DNA, 25 bp, Mus musculus
gaggttcatggttgtactttttgta

SEQ ID NO: 492340 - DNA, 25 bp, Mus musculus
gaggttcattacattctaggaccat

SEQ ID NO: 492341 - DNA, 25 bp, Mus musculus
gaggttcattactttctaggaccat

SEQ ID NO: 492342 - DNA, 25 bp, Mus musculus
gaggttcattccagagtctttgtta

SEQ ID NO: 492343 - DNA, 25 bp, Mus musculus
gaggttcattccagttgtgacccga

SEQ ID NO: 492344 - DNA, 25 bp, Mus musculus
gaggttcattcctgagtctttgtta

SEQ ID NO: 492345 - DNA, 25 bp, Mus musculus
gaggttcattcctgttgtgacccga

SEQ ID NO: 492346 - DNA, 25 bp, Mus musculus
gaggttcattgaagaggtaactggt

SEQ ID NO: 492347 - DNA, 25 bp, Mus musculus
gaggttcattgatgaggtaactggt

SEQ ID NO: 492348 - DNA, 25 bp, Mus musculus
gaggttccagaactttctctgagct

SEQ ID NO: 492349 - DNA, 25 bp, Mus musculus
gaggttccagaagtttctctgagct

SEQ ID NO: 492350 - DNA, 25 bp, Mus musculus
gaggttccatatcaaccttcgctgt

SEQ ID NO: 492351 - DNA, 25 bp, Mus musculus
gaggttccatatgaaccttcgctgt

SEQ ID NO: 492352 - DNA, 25 bp, Mus musculus
gaggttcccaaaaggatagccacag

SEQ ID NO: 492353 - DNA, 25 bp, Mus musculus
gaggttcccaaatggatagccacag

SEQ ID NO: 492354 - DNA, 25 bp, Mus musculus
gaggttcccaacatgatcactagat

SEQ ID NO: 492355 - DNA, 25 bp, Mus musculus
gaggttcccaacttgatcactagat

SEQ ID NO: 492356 - DNA, 25 bp, Mus musculus
gaggttcccaagcaggctacagaaa

SEQ ID NO: 492357 - DNA, 25 bp, Mus musculus
gaggttcccaaggaggctacagaaa

SEQ ID NO: 492358 - DNA, 25 bp, Mus musculus
gaggttcccatcattgcttgttaaa

SEQ ID NO: 492359 - DNA, 25 bp, Mus musculus
gaggttcccatctttgcttgttaaa

SEQ ID NO: 492360 - DNA, 25 bp, Mus musculus
gaggttcccttaatttcttcagtat

SEQ ID NO: 492361 - DNA, 25 bp, Mus musculus
gaggttcccttattttcttcagtat

SEQ ID NO: 492362 - DNA, 25 bp, Mus musculus
gaggttcccttgctcatgttgttac

SEQ ID NO: 492363 - DNA, 25 bp, Mus musculus
gaggttcccttggtcatgttgttac

SEQ ID NO: 492364 - DNA, 25 bp, Mus musculus
gaggttcctcaacgtagactcccag

SEQ ID NO: 492365 - DNA, 25 bp, Mus musculus
gaggttcctcaaggtagactcccag

SEQ ID NO: 492366 - DNA, 25 bp, Mus musculus
gaggttcctccacattggatttgga

SEQ ID NO: 492367 - DNA, 25 bp, Mus musculus
gaggttcctccagattggatttgga

SEQ ID NO: 492368 - DNA, 25 bp, Mus musculus
gaggttcctctgctaccagtgattt

SEQ ID NO: 492369 - DNA, 25 bp, Mus musculus
gaggttcctctggtaccagtgattt

SEQ ID NO: 492370 - DNA, 25 bp, Mus musculus
gaggttcctgacatatcagtgccca

SEQ ID NO: 492371 - DNA, 25 bp, Mus musculus
gaggttcctgacttatcagtgccca

SEQ ID NO: 492372 - DNA, 25 bp, Mus musculus
gaggttcctgttcaagttcctaaag

SEQ ID NO: 492373 - DNA, 25 bp, Mus musculus
gaggttcctgttgaagttcctaaag

SEQ ID NO: 492374 - DNA, 25 bp, Mus musculus
gaggttcctttaaagcacctccact

SEQ ID NO: 492375 - DNA, 25 bp, Mus musculus
gaggttcctttatagcacctccact

SEQ ID NO: 492376 - DNA, 25 bp, Mus musculus
gaggttcgctaactgttggattcta

SEQ ID NO: 492377 - DNA, 25 bp, Mus musculus
gaggttcgctaagtgttggattcta

SEQ ID NO: 492378 - DNA, 25 bp, Mus musculus
gaggttcgctccctccttaaggaca

SEQ ID NO: 492379 - DNA, 25 bp, Mus musculus
gaggttcgctccgtccttaaggaca

SEQ ID NO: 492380 - DNA, 25 bp, Mus musculus
gaggttctaacaagtctgtagacaa

SEQ ID NO: 492381 - DNA, 25 bp, Mus musculus
gaggttctaacatgtctgtagacaa

SEQ ID NO: 492382 - DNA, 25 bp, Mus musculus
gaggttctacgcatgtcccttgtgc

SEQ ID NO: 492383 - DNA, 25 bp, Mus musculus
gaggttctacgcttgtcccttgtgc

SEQ ID NO: 492384 - DNA, 25 bp, Mus musculus
gaggttctactaagctttgtacttg

SEQ ID NO: 492385 - DNA, 25 bp, Mus musculus
gaggttctactatgctttgtacttg

SEQ ID NO: 492386 - DNA, 25 bp, Mus musculus
gaggttctacttcagatccagccta

SEQ ID NO: 492387 - DNA, 25 bp, Mus musculus
gaggttctacttgagatccagccta

SEQ ID NO: 492388 - DNA, 25 bp, Mus musculus
gaggttctcagacgcatccggttca

SEQ ID NO: 492389 - DNA, 25 bp, Mus musculus
gaggttctcagaggcatccggttca

SEQ ID NO: 492390 - DNA, 25 bp, Mus musculus
gaggttctccttatgttgttagcta

SEQ ID NO: 492391 - DNA, 25 bp, Mus musculus
gaggttctccttttgttgttagcta

SEQ ID NO: 492392 - DNA, 25 bp, Mus musculus
gaggttctctcaatggtggtgttaa

SEQ ID NO: 492393 - DNA, 25 bp, Mus musculus
gaggttctctcattggtggtgttaa

SEQ ID NO: 492394 - DNA, 25 bp, Mus musculus
gaggttctctggcatgcttctgttt

SEQ ID NO: 492395 - DNA, 25 bp, Mus musculus
gaggttctctgggatgcttctgttt

SEQ ID NO: 492396 - DNA, 25 bp, Mus musculus
gaggttctgagcatgtcctgagcca

SEQ ID NO: 492397 - DNA, 25 bp, Mus musculus
gaggttctgagcttgtcctgagcca

SEQ ID NO: 492398 - DNA, 25 bp, Mus musculus
gaggttctgcagattgggtgcaaac

SEQ ID NO: 492399 - DNA, 25 bp, Mus musculus
gaggttctgcagtttgggtgcaaac

SEQ ID NO: 492400 - DNA, 25 bp, Mus musculus
gaggttctgcctactaattctttat

SEQ ID NO: 492401 - DNA, 25 bp, Mus musculus
gaggttctgccttctaattctttat

SEQ ID NO: 492402 - DNA, 25 bp, Mus musculus
gaggttctggaactgtgaaacacat

SEQ ID NO: 492403 - DNA, 25 bp, Mus musculus
gaggttctggaagtgtgaaacacat

SEQ ID NO: 492404 - DNA, 25 bp, Mus musculus
gaggttctggagactcggagactta

SEQ ID NO: 492405 - DNA, 25 bp, Mus musculus
gaggttctggagtctcggagactta

SEQ ID NO: 492406 - DNA, 25 bp, Mus musculus
gaggttctgtatatgctcctgtgga

SEQ ID NO: 492407 - DNA, 25 bp, Mus musculus
gaggttctgtatttgctcctgtgga

SEQ ID NO: 492408 - DNA, 25 bp, Mus musculus
gaggttctgtgaaatcttacactat

SEQ ID NO: 492409 - DNA, 25 bp, Mus musculus
gaggttctgtgatatcttacactat

SEQ ID NO: 492410 - DNA, 25 bp, Mus musculus
gaggttctttaactcagttcggctt

SEQ ID NO: 492411 - DNA, 25 bp, Mus musculus
gaggttctttaagtcagttcggctt

SEQ ID NO: 492412 - DNA, 25 bp, Mus musculus
gaggttctttatcatgcctccagac

SEQ ID NO: 492413 - DNA, 25 bp, Mus musculus
gaggttctttatgatgcctccagac

SEQ ID NO: 492414 - DNA, 25 bp, Mus musculus
gaggttctttccagcattttctttc

SEQ ID NO: 492415 - DNA, 25 bp, Mus musculus
gaggttctttcctgcattttctttc

SEQ ID NO: 492416 - DNA, 25 bp, Mus musculus
gaggttctttgcacgctgggctgta

SEQ ID NO: 492417 - DNA, 25 bp, Mus musculus
gaggttctttgctcgctgggctgta

SEQ ID NO: 492418 - DNA, 25 bp, Mus musculus
gaggttcttttgctcttcgtgaatt

SEQ ID NO: 492419 - DNA, 25 bp, Mus musculus
gaggttcttttggtcttcgtgaatt

SEQ ID NO: 492420 - DNA, 25 bp, Mus musculus
gaggttgaactactgcactactgga

SEQ ID NO: 492421 - DNA, 25 bp, Mus musculus
gaggttgaactagtgcactactgga

SEQ ID NO: 492422 - DNA, 25 bp, Mus musculus
gaggttgaatgtcctttaccacttc

SEQ ID NO: 492423 - DNA, 25 bp, Mus musculus
gaggttgaatgtgctttaccacttc

SEQ ID NO: 492424 - DNA, 25 bp, Mus musculus
gaggttgacagtacacttattcagt

SEQ ID NO: 492425 - DNA, 25 bp, Mus musculus
gaggttgacagtactaacaatgtga

SEQ ID NO: 492426 - DNA, 25 bp, Mus musculus
gaggttgacagttcacttattcagt

SEQ ID NO: 492427 - DNA, 25 bp, Mus musculus
gaggttgacagttctaacaatgtga

SEQ ID NO: 492428 - DNA, 25 bp, Mus musculus
gaggttgacatcactccatggagcc

SEQ ID NO: 492429 - DNA, 25 bp, Mus musculus
gaggttgacatctctccatggagcc

SEQ ID NO: 492430 - DNA, 25 bp, Mus musculus
gaggttgaccagacgaagccttcct

SEQ ID NO: 492431 - DNA, 25 bp, Mus musculus
gaggttgaccagtcgaagccttcct

SEQ ID NO: 492432 - DNA, 25 bp, Mus musculus
gaggttgacctgaacaactctgacc

SEQ ID NO: 492433 - DNA, 25 bp, Mus musculus
gaggttgacctgtacaactctgacc

SEQ ID NO: 492434 - DNA, 25 bp, Mus musculus
gaggttgacgtccagcagcacactt

SEQ ID NO: 492435 - DNA, 25 bp, Mus musculus
gaggttgacgtcgagcagcacactt

SEQ ID NO: 492436 - DNA, 25 bp, Mus musculus
gaggttgacgttcgaagcagccaca

SEQ ID NO: 492437 - DNA, 25 bp, Mus musculus
gaggttgacgttggaagcagccaca

SEQ ID NO: 492438 - DNA, 25 bp, Mus musculus
gaggttgactccacttcccctgcat

SEQ ID NO: 492439 - DNA, 25 bp, Mus musculus
gaggttgactcctcttcccctgcat

SEQ ID NO: 492440 - DNA, 25 bp, Mus musculus
gaggttgagcctatttgagtattta

SEQ ID NO: 492441 - DNA, 25 bp, Mus musculus
gaggttgagcctttttgagtattta

SEQ ID NO: 492442 - DNA, 25 bp, Mus musculus
gaggttgagcgtatgctagtatgca

SEQ ID NO: 492443 - DNA, 25 bp, Mus musculus
gaggttgagcgtttgctagtatgca

SEQ ID NO: 492444 - DNA, 25 bp, Mus musculus
gaggttgagtctagctcacccagaa

SEQ ID NO: 492445 - DNA, 25 bp, Mus musculus
gaggttgagtcttgctcacccagaa

SEQ ID NO: 492446 - DNA, 25 bp, Mus musculus
gaggttgataacattgcttgcggta

SEQ ID NO: 492447 - DNA, 25 bp, Mus musculus
gaggttgataactttgcttgcggta

SEQ ID NO: 492448 - DNA, 25 bp, Mus musculus
gaggttgatcttcactttgtgagct

SEQ ID NO: 492449 - DNA, 25 bp, Mus musculus
gaggttgatcttgactttgtgagct

SEQ ID NO: 492450 - DNA, 25 bp, Mus musculus
gaggttgattacagcggattaagag

SEQ ID NO: 492451 - DNA, 25 bp, Mus musculus
gaggttgattactgcggattaagag

SEQ ID NO: 492452 - DNA, 25 bp, Mus musculus
gaggttgcagacaggtttcacccgc

SEQ ID NO: 492453 - DNA, 25 bp, Mus musculus
gaggttgcagactggtttcacccgc

SEQ ID NO: 492454 - DNA, 25 bp, Mus musculus
gaggttgcagtcctgaatcttcaac

SEQ ID NO: 492455 - DNA, 25 bp, Mus musculus
gaggttgcagtcgtgaatcttcaac

SEQ ID NO: 492456 - DNA, 25 bp, Mus musculus
gaggttgcatggctgacagtcattt

SEQ ID NO: 492457 - DNA, 25 bp, Mus musculus
gaggttgcatgggtgacagtcattt

SEQ ID NO: 492458 - DNA, 25 bp, Mus musculus
gaggttgccaaacacctgtaccaga

SEQ ID NO: 492459 - DNA, 25 bp, Mus musculus
gaggttgccaaagacctgtaccaga

SEQ ID NO: 492460 - DNA, 25 bp, Mus musculus
gaggttgccaaccttcagctcatgg

SEQ ID NO: 492461 - DNA, 25 bp, Mus musculus
gaggttgccaacgttcagctcatgg

SEQ ID NO: 492462 - DNA, 25 bp, Mus musculus
gaggttgcctgtatttacaacccag

SEQ ID NO: 492463 - DNA, 25 bp, Mus musculus
gaggttgcctgtttttacaacccag

SEQ ID NO: 492464 - DNA, 25 bp, Mus musculus
gaggttgcctttccagtggacctag

SEQ ID NO: 492465 - DNA, 25 bp, Mus musculus
gaggttgcctttgcagtggacctag

SEQ ID NO: 492466 - DNA, 25 bp, Mus musculus
gaggttgctaaaaatcctgcagcat

SEQ ID NO: 492467 - DNA, 25 bp, Mus musculus
gaggttgctaaatatcctgcagcat

SEQ ID NO: 492468 - DNA, 25 bp, Mus musculus
gaggttgctcccatgctgtttaaag

SEQ ID NO: 492469 - DNA, 25 bp, Mus musculus
gaggttgctcccttgctgtttaaag

SEQ ID NO: 492470 - DNA, 25 bp, Mus musculus
gaggttgctgctaaaattccttttt

SEQ ID NO: 492471 - DNA, 25 bp, Mus musculus
gaggttgctgcttaaattccttttt

SEQ ID NO: 492472 - DNA, 25 bp, Mus musculus
gaggttgctgtacctactgtcattt

SEQ ID NO: 492473 - DNA, 25 bp, Mus musculus
gaggttgctgtagctactgtcattt

SEQ ID NO: 492474 - DNA, 25 bp, Mus musculus
gaggttggaattaaagctccagcag

SEQ ID NO: 492475 - DNA, 25 bp, Mus musculus
gaggttggaatttaagctccagcag

SEQ ID NO: 492476 - DNA, 25 bp, Mus musculus
gaggttggaccacctgttcatacac

SEQ ID NO: 492477 - DNA, 25 bp, Mus musculus
gaggttggaccagctgttcatacac

SEQ ID NO: 492478 - DNA, 25 bp, Mus musculus
gaggttggacctcgtgtatttttca

SEQ ID NO: 492479 - DNA, 25 bp, Mus musculus
gaggttggacctggtgtatttttca

SEQ ID NO: 492480 - DNA, 25 bp, Mus musculus
gaggttggcaacagtttggcaaaca

SEQ ID NO: 492481 - DNA, 25 bp, Mus musculus
gaggttggcaactgtttggcaaaca

SEQ ID NO: 492482 - DNA, 25 bp, Mus musculus
gaggttggcactaagacccaggaca

SEQ ID NO: 492483 - DNA, 25 bp, Mus musculus
gaggttggcacttagacccaggaca

SEQ ID NO: 492484 - DNA, 25 bp, Mus musculus
gaggttggcagaaattctgttgctt

SEQ ID NO: 492485 - DNA, 25 bp, Mus musculus
gaggttggcagatattctgttgctt

SEQ ID NO: 492486 - DNA, 25 bp, Mus musculus
gaggttggcttaaaactgttctggg

SEQ ID NO: 492487 - DNA, 25 bp, Mus musculus
gaggttggcttataactgttctggg

SEQ ID NO: 492488 - DNA, 25 bp, Mus musculus
gaggttgggacaatctctgagttgt

SEQ ID NO: 492489 - DNA, 25 bp, Mus musculus
gaggttgggacattctctgagttgt

SEQ ID NO: 492490 - DNA, 25 bp, Mus musculus
gaggttgggcaactactccccagac

SEQ ID NO: 492491 - DNA, 25 bp, Mus musculus
gaggttgggcaagtactccccagac

SEQ ID NO: 492492 - DNA, 25 bp, Mus musculus
gaggttggtcacaaaagtccctgag

SEQ ID NO: 492493 - DNA, 25 bp, Mus musculus
gaggttggtcactaaagtccctgag

SEQ ID NO: 492494 - DNA, 25 bp, Mus musculus
gaggttggtctgagtactagtcatt

SEQ ID NO: 492495 - DNA, 25 bp, Mus musculus
gaggttggtctgtgtactagtcatt

SEQ ID NO: 492496 - DNA, 25 bp, Mus musculus
gaggttgtaaacacactccagcagc

SEQ ID NO: 492497 - DNA, 25 bp, Mus musculus
gaggttgtaaactcactccagcagc

SEQ ID NO: 492498 - DNA, 25 bp, Mus musculus
gaggttgtcaaaatccttggtggtt

SEQ ID NO: 492499 - DNA, 25 bp, Mus musculus
gaggttgtcaaattccttggtggtt

SEQ ID NO: 492500 - DNA, 25 bp, Mus musculus
gaggttgtcagccagattaaccctg

SEQ ID NO: 492501 - DNA, 25 bp, Mus musculus
gaggttgtcagcgagattaaccctg

SEQ ID NO: 492502 - DNA, 25 bp, Mus musculus
gaggttgtcatcaatctcaatgctt

SEQ ID NO: 492503 - DNA, 25 bp, Mus musculus
gaggttgtcatctatctcaatgctt

SEQ ID NO: 492504 - DNA, 25 bp, Mus musculus
gaggttgtccaacatgcaagcccct

SEQ ID NO: 492505 - DNA, 25 bp, Mus musculus
gaggttgtccaacgcagagccacag

SEQ ID NO: 492506 - DNA, 25 bp, Mus musculus
gaggttgtccaagatgcaagcccct

SEQ ID NO: 492507 - DNA, 25 bp, Mus musculus
gaggttgtccaaggcagagccacag

SEQ ID NO: 492508 - DNA, 25 bp, Mus musculus
gaggttgtgccaataagagccactg

SEQ ID NO: 492509 - DNA, 25 bp, Mus musculus
gaggttgtgccattaagagccactg

SEQ ID NO: 492510 - DNA, 25 bp, Mus musculus
gaggttgtggtcatgcctatctaga

SEQ ID NO: 492511 - DNA, 25 bp, Mus musculus
gaggttgtggtcttgcctatctaga

SEQ ID NO: 492512 - DNA, 25 bp, Mus musculus
gaggttgtgtatctagcatgtaata

SEQ ID NO: 492513 - DNA, 25 bp, Mus musculus
gaggttgtgtatgtagcatgtaata

SEQ ID NO: 492514 - DNA, 25 bp, Mus musculus
gaggttgttcaactctcagagacca

SEQ ID NO: 492515 - DNA, 25 bp, Mus musculus
gaggttgttcaagtctcagagacca

SEQ ID NO: 492516 - DNA, 25 bp, Mus musculus
gaggttgttcatcagccgaaccaac

SEQ ID NO: 492517 - DNA, 25 bp, Mus musculus
gaggttgttcatgagccgaaccaac

SEQ ID NO: 492518 - DNA, 25 bp, Mus musculus
gaggttgttgctcaatgatagtact

SEQ ID NO: 492519 - DNA, 25 bp, Mus musculus
gaggttgttgctgaatgatagtact

SEQ ID NO: 492520 - DNA, 25 bp, Mus musculus
gaggttgtttctctgaacttatcta

SEQ ID NO: 492521 - DNA, 25 bp, Mus musculus
gaggttgtttctgtgaacttatcta

SEQ ID NO: 492522 - DNA, 25 bp, Mus musculus
gaggttgtttgtaaccattggccgg

SEQ ID NO: 492523 - DNA, 25 bp, Mus musculus
gaggttgtttgttaccattggccgg

SEQ ID NO: 492524 - DNA, 25 bp, Mus musculus
gaggttgttttcaaggctcaacact

SEQ ID NO: 492525 - DNA, 25 bp, Mus musculus
gaggttgttttctaggctcaacact

SEQ ID NO: 492526 - DNA, 25 bp, Mus musculus
gaggtttaaactcccctgtgacctt

SEQ ID NO: 492527 - DNA, 25 bp, Mus musculus
gaggtttaaactgccctgtgacctt

SEQ ID NO: 492528 - DNA, 25 bp, Mus musculus
gaggtttaaccgactcagctcaaga

SEQ ID NO: 492529 - DNA, 25 bp, Mus musculus
gaggtttaaccgtctcagctcaaga

SEQ ID NO: 492530 - DNA, 25 bp, Mus musculus
gaggtttaattacccttaattgcat

SEQ ID NO: 492531 - DNA, 25 bp, Mus musculus
gaggtttaattagccttaattgcat

SEQ ID NO: 492532 - DNA, 25 bp, Mus musculus
gaggtttacaaaatacatctttgat

SEQ ID NO: 492533 - DNA, 25 bp, Mus musculus
gaggtttacaaattacatctttgat

SEQ ID NO: 492534 - DNA, 25 bp, Mus musculus
gaggtttacaggacacactcctcca

SEQ ID NO: 492535 - DNA, 25 bp, Mus musculus
gaggtttacaggtcacactcctcca

SEQ ID NO: 492536 - DNA, 25 bp, Mus musculus
gaggtttacattcagacagttttag

SEQ ID NO: 492537 - DNA, 25 bp, Mus musculus
gaggtttacattgagacagttttag

SEQ ID NO: 492538 - DNA, 25 bp, Mus musculus
gaggtttaccctcggaagctcagca

SEQ ID NO: 492539 - DNA, 25 bp, Mus musculus
gaggtttaccctgggaagctcagca

SEQ ID NO: 492540 - DNA, 25 bp, Mus musculus
gaggtttacctgcaagtgccacatg

SEQ ID NO: 492541 - DNA, 25 bp, Mus musculus
gaggtttacctggaagtgccacatg

SEQ ID NO: 492542 - DNA, 25 bp, Mus musculus
gaggtttacgtaccttacagttttg

SEQ ID NO: 492543 - DNA, 25 bp, Mus musculus
gaggtttacgtagcttacagttttg

SEQ ID NO: 492544 - DNA, 25 bp, Mus musculus
gaggtttatcgcatatgtggcatac

SEQ ID NO: 492545 - DNA, 25 bp, Mus musculus
gaggtttatcgcttatgtggcatac

SEQ ID NO: 492546 - DNA, 25 bp, Mus musculus
gaggtttcaaagagcagccatcggt

SEQ ID NO: 492547 - DNA, 25 bp, Mus musculus
gaggtttcaaagtgcagccatcggt

SEQ ID NO: 492548 - DNA, 25 bp, Mus musculus
gaggtttcaaatccccatgtcactc

SEQ ID NO: 492549 - DNA, 25 bp, Mus musculus
gaggtttcaaatgcccatgtcactc

SEQ ID NO: 492550 - DNA, 25 bp, Mus musculus
gaggtttcaattcaatcagccattt

SEQ ID NO: 492551 - DNA, 25 bp, Mus musculus
gaggtttcaattgaatcagccattt

SEQ ID NO: 492552 - DNA, 25 bp, Mus musculus
gaggtttcacggctgagcaccaaaa

SEQ ID NO: 492553 - DNA, 25 bp, Mus musculus
gaggtttcacgggtgagcaccaaaa

SEQ ID NO: 492554 - DNA, 25 bp, Mus musculus
gaggtttcagaactcaataggaagc

SEQ ID NO: 492555 - DNA, 25 bp, Mus musculus
gaggtttcagaagtcaataggaagc

SEQ ID NO: 492556 - DNA, 25 bp, Mus musculus
gaggtttcagctcttagatcgcttt

SEQ ID NO: 492557 - DNA, 25 bp, Mus musculus
gaggtttcagctgttagatcgcttt

SEQ ID NO: 492558 - DNA, 25 bp, Mus musculus
gaggtttccaccaatcagcagcagt

SEQ ID NO: 492559 - DNA, 25 bp, Mus musculus
gaggtttccacctatcagcagcagt

SEQ ID NO: 492560 - DNA, 25 bp, Mus musculus
gaggtttccagaagcgtagccacca

SEQ ID NO: 492561 - DNA, 25 bp, Mus musculus
gaggtttccagaccatttatagatc

SEQ ID NO: 492562 - DNA, 25 bp, Mus musculus
gaggtttccagagcatttatagatc

SEQ ID NO: 492563 - DNA, 25 bp, Mus musculus
gaggtttccagatgcgtagccacca

SEQ ID NO: 492564 - DNA, 25 bp, Mus musculus
gaggtttccagtatcaaactgctct

SEQ ID NO: 492565 - DNA, 25 bp, Mus musculus
gaggtttccagtttcaaactgctct

SEQ ID NO: 492566 - DNA, 25 bp, Mus musculus
gaggtttcctcactgtagccttaac

SEQ ID NO: 492567 - DNA, 25 bp, Mus musculus
gaggtttcctcagtgtagccttaac

SEQ ID NO: 492568 - DNA, 25 bp, Mus musculus
gaggtttcctgtcgagcgtcgccat

SEQ ID NO: 492569 - DNA, 25 bp, Mus musculus
gaggtttcctgtggagcgtcgccat

SEQ ID NO: 492570 - DNA, 25 bp, Mus musculus
gaggtttccttcaacaatgtgacag

SEQ ID NO: 492571 - DNA, 25 bp, Mus musculus
gaggtttccttctacaatgtgacag

SEQ ID NO: 492572 - DNA, 25 bp, Mus musculus
gaggtttcggttctccttagacttg

SEQ ID NO: 492573 - DNA, 25 bp, Mus musculus
gaggtttcggttgtccttagacttg

SEQ ID NO: 492574 - DNA, 25 bp, Mus musculus
gaggtttcgtgtccgattttgtttg

SEQ ID NO: 492575 - DNA, 25 bp, Mus musculus
gaggtttcgtgtgcgattttgtttg

SEQ ID NO: 492576 - DNA, 25 bp, Mus musculus
gaggtttctaacattagtattttca

SEQ ID NO: 492577 - DNA, 25 bp, Mus musculus
gaggtttctaactttagtattttca

SEQ ID NO: 492578 - DNA, 25 bp, Mus musculus
gaggtttctaatcgccatgctgttc

SEQ ID NO: 492579 - DNA, 25 bp, Mus musculus
gaggtttctaatggccatgctgttc

SEQ ID NO: 492580 - DNA, 25 bp, Mus musculus
gaggtttctccaacttagtgacatt

SEQ ID NO: 492581 - DNA, 25 bp, Mus musculus
gaggtttctccatcttagtgacatt

SEQ ID NO: 492582 - DNA, 25 bp, Mus musculus
gaggtttctgccacgaggcctgata

SEQ ID NO: 492583 - DNA, 25 bp, Mus musculus
gaggtttctgcctcgaggcctgata

SEQ ID NO: 492584 - DNA, 25 bp, Mus musculus
gaggtttctgtaccgcaagcaaatt

SEQ ID NO: 492585 - DNA, 25 bp, Mus musculus
gaggtttctgtagcgcaagcaaatt

SEQ ID NO: 492586 - DNA, 25 bp, Mus musculus
gaggtttcttctcgttagttgtaca

SEQ ID NO: 492587 - DNA, 25 bp, Mus musculus
gaggtttcttctggttagttgtaca

SEQ ID NO: 492588 - DNA, 25 bp, Mus musculus
gaggtttcttggaaatgctttgtac

SEQ ID NO: 492589 - DNA, 25 bp, Mus musculus
gaggtttcttggtaatgctttgtac

SEQ ID NO: 492590 - DNA, 25 bp, Mus musculus
gaggtttgaacacggctctcgtcac

SEQ ID NO: 492591 - DNA, 25 bp, Mus musculus
gaggtttgaacagggctctcgtcac

SEQ ID NO: 492592 - DNA, 25 bp, Mus musculus
gaggtttgaaccagagcgtgaataa

SEQ ID NO: 492593 - DNA, 25 bp, Mus musculus
gaggtttgaacctgagcgtgaataa

SEQ ID NO: 492594 - DNA, 25 bp, Mus musculus
gaggtttgacaccactctgaacaca

SEQ ID NO: 492595 - DNA, 25 bp, Mus musculus
gaggtttgacacgactctgaacaca

SEQ ID NO: 492596 - DNA, 25 bp, Mus musculus
gaggtttgagacaatggccatactg

SEQ ID NO: 492597 - DNA, 25 bp, Mus musculus
gaggtttgagactatggccatactg

SEQ ID NO: 492598 - DNA, 25 bp, Mus musculus
gaggtttgaggcagcggcatcctaa

SEQ ID NO: 492599 - DNA, 25 bp, Mus musculus
gaggtttgaggctgcggcatcctaa

SEQ ID NO: 492600 - DNA, 25 bp, Mus musculus
gaggtttgcgagatggacttcagtt

SEQ ID NO: 492601 - DNA, 25 bp, Mus musculus
gaggtttgcgagttggacttcagtt

SEQ ID NO: 492602 - DNA, 25 bp, Mus musculus
gaggtttgcggtatgcatttgcatt

SEQ ID NO: 492603 - DNA, 25 bp, Mus musculus
gaggtttgcggtttgcatttgcatt

SEQ ID NO: 492604 - DNA, 25 bp, Mus musculus
gaggtttggaaaatctaggccagca

SEQ ID NO: 492605 - DNA, 25 bp, Mus musculus
gaggtttggaaattctaggccagca

SEQ ID NO: 492606 - DNA, 25 bp, Mus musculus
gaggtttggagtattcgctcaggca

SEQ ID NO: 492607 - DNA, 25 bp, Mus musculus
gaggtttggagttttcgctcaggca

SEQ ID NO: 492608 - DNA, 25 bp, Mus musculus
gaggtttggataactgcctggccaa

SEQ ID NO: 492609 - DNA, 25 bp, Mus musculus
gaggtttggatatctgcctggccaa

SEQ ID NO: 492610 - DNA, 25 bp, Mus musculus
gaggtttggctaccatccataagtt

SEQ ID NO: 492611 - DNA, 25 bp, Mus musculus
gaggtttggctagcatccataagtt

SEQ ID NO: 492612 - DNA, 25 bp, Mus musculus
gaggtttgggcacttctagaagaca

SEQ ID NO: 492613 - DNA, 25 bp, Mus musculus
gaggtttgggcagttctagaagaca

SEQ ID NO: 492614 - DNA, 25 bp, Mus musculus
gaggtttgtaaaactcacccacctg

SEQ ID NO: 492615 - DNA, 25 bp, Mus musculus
gaggtttgtaaatctcacccacctg

SEQ ID NO: 492616 - DNA, 25 bp, Mus musculus
gaggtttgtagtagactcttttcaa

SEQ ID NO: 492617 - DNA, 25 bp, Mus musculus
gaggtttgtagttgactcttttcaa

SEQ ID NO: 492618 - DNA, 25 bp, Mus musculus
gaggtttgtccccttaattgttcat

SEQ ID NO: 492619 - DNA, 25 bp, Mus musculus
gaggtttgtcccgttaattgttcat

SEQ ID NO: 492620 - DNA, 25 bp, Mus musculus
gaggtttgtcctaagctatctgaat

SEQ ID NO: 492621 - DNA, 25 bp, Mus musculus
gaggtttgtccttagctatctgaat

SEQ ID NO: 492622 - DNA, 25 bp, Mus musculus
gaggtttgtgtcatggccattcatt

SEQ ID NO: 492623 - DNA, 25 bp, Mus musculus
gaggtttgtgtccataccatctaaa

SEQ ID NO: 492624 - DNA, 25 bp, Mus musculus
gaggtttgtgtcgataccatctaaa

SEQ ID NO: 492625 - DNA, 25 bp, Mus musculus
gaggtttgtgtcttggccattcatt

SEQ ID NO: 492626 - DNA, 25 bp, Mus musculus
gaggtttgttgcacgcgacagccct

SEQ ID NO: 492627 - DNA, 25 bp, Mus musculus
gaggtttgttgctcgcgacagccct

SEQ ID NO: 492628 - DNA, 25 bp, Mus musculus
gaggtttgttttaatggcgtgtgtt

SEQ ID NO: 492629 - DNA, 25 bp, Mus musculus
gaggtttgttttcaagtacttcaga

SEQ ID NO: 492630 - DNA, 25 bp, Mus musculus
gaggtttgttttgaagtacttcaga

SEQ ID NO: 492631 - DNA, 25 bp, Mus musculus
gaggtttgtttttatggcgtgtgtt

SEQ ID NO: 492632 - DNA, 25 bp, Mus musculus
gaggttttacaaatgcacacaggat

SEQ ID NO: 492633 - DNA, 25 bp, Mus musculus
gaggttttacaattgcacacaggat

SEQ ID NO: 492634 - DNA, 25 bp, Mus musculus
gaggttttagtaatcgaactcttag

SEQ ID NO: 492635 - DNA, 25 bp, Mus musculus
gaggttttagtattcgaactcttag

SEQ ID NO: 492636 - DNA, 25 bp, Mus musculus
gaggttttatagaccagccttggta

SEQ ID NO: 492637 - DNA, 25 bp, Mus musculus
gaggttttatagtccagccttggta

SEQ ID NO: 492638 - DNA, 25 bp, Mus musculus
gaggttttatgtcgctcccaggatt

SEQ ID NO: 492639 - DNA, 25 bp, Mus musculus
gaggttttatgtggctcccaggatt

SEQ ID NO: 492640 - DNA, 25 bp, Mus musculus
gaggttttatttctagaggagacaa

SEQ ID NO: 492641 - DNA, 25 bp, Mus musculus
gaggttttatttgtagaggagacaa

SEQ ID NO: 492642 - DNA, 25 bp, Mus musculus
gaggttttcaaacatccgaactaat

SEQ ID NO: 492643 - DNA, 25 bp, Mus musculus
gaggttttcaaagatccgaactaat

SEQ ID NO: 492644 - DNA, 25 bp, Mus musculus
gaggttttcaatagtatctaagcat

SEQ ID NO: 492645 - DNA, 25 bp, Mus musculus
gaggttttcaattgtatctaagcat

SEQ ID NO: 492646 - DNA, 25 bp, Mus musculus
gaggttttcaccacagggctgagac

SEQ ID NO: 492647 - DNA, 25 bp, Mus musculus
gaggttttcacctcagggctgagac

SEQ ID NO: 492648 - DNA, 25 bp, Mus musculus
gaggttttcagtaggactgagcatt

SEQ ID NO: 492649 - DNA, 25 bp, Mus musculus
gaggttttcagttggactgagcatt

SEQ ID NO: 492650 - DNA, 25 bp, Mus musculus
gaggttttccatcacaagtgcgtag

SEQ ID NO: 492651 - DNA, 25 bp, Mus musculus
gaggttttccatgacaagtgcgtag

SEQ ID NO: 492652 - DNA, 25 bp, Mus musculus
gaggttttctatcgatttctggcaa

SEQ ID NO: 492653 - DNA, 25 bp, Mus musculus
gaggttttctatggatttctggcaa

SEQ ID NO: 492654 - DNA, 25 bp, Mus musculus
gaggttttctctatcagctgcagac

SEQ ID NO: 492655 - DNA, 25 bp, Mus musculus
gaggttttctctttcagctgcagac

SEQ ID NO: 492656 - DNA, 25 bp, Mus musculus
gaggttttcttgaactctctcattt

SEQ ID NO: 492657 - DNA, 25 bp, Mus musculus
gaggttttcttgtactctctcattt

SEQ ID NO: 492658 - DNA, 25 bp, Mus musculus
gaggttttgaccataaaagattcca

SEQ ID NO: 492659 - DNA, 25 bp, Mus musculus
gaggttttgaccttaaaagattcca

SEQ ID NO: 492660 - DNA, 25 bp, Mus musculus
gaggttttgccgcaggactgtctac

SEQ ID NO: 492661 - DNA, 25 bp, Mus musculus
gaggttttgccggaggactgtctac

SEQ ID NO: 492662 - DNA, 25 bp, Mus musculus
gaggttttgctgagagccactttct

SEQ ID NO: 492663 - DNA, 25 bp, Mus musculus
gaggttttgctgtgagccactttct

SEQ ID NO: 492664 - DNA, 25 bp, Mus musculus
gaggttttgggcaggcaatatttca

SEQ ID NO: 492665 - DNA, 25 bp, Mus musculus
gaggttttgggctggcaatatttca

SEQ ID NO: 492666 - DNA, 25 bp, Mus musculus
gaggttttgtctatgtttcaatggg

SEQ ID NO: 492667 - DNA, 25 bp, Mus musculus
gaggttttgtctttgtttcaatggg

SEQ ID NO: 492668 - DNA, 25 bp, Mus musculus
gaggttttgttcattatccagtgaa

SEQ ID NO: 492669 - DNA, 25 bp, Mus musculus
gaggttttgttctttatccagtgaa

SEQ ID NO: 492670 - DNA, 25 bp, Mus musculus
gaggttttgtttatgctgttttgca

SEQ ID NO: 492671 - DNA, 25 bp, Mus musculus
gaggttttgtttttgctgttttgca

SEQ ID NO: 492672 - DNA, 25 bp, Mus musculus
gaggtttttaaactgctctttgttg

SEQ ID NO: 492673 - DNA, 25 bp, Mus musculus
gaggtttttaaagtgctctttgttg

SEQ ID NO: 492674 - DNA, 25 bp, Mus musculus
gaggtttttcaactgccagtgtcaa

SEQ ID NO: 492675 - DNA, 25 bp, Mus musculus
gaggtttttcaagtgccagtgtcaa

SEQ ID NO: 492676 - DNA, 25 bp, Mus musculus
gaggtttttcacagggttcagacac

SEQ ID NO: 492677 - DNA, 25 bp, Mus musculus
gaggtttttcactgggttcagacac

SEQ ID NO: 492678 - DNA, 25 bp, Mus musculus
gaggtttttcatatgctacttgact

SEQ ID NO: 492679 - DNA, 25 bp, Mus musculus
gaggtttttcatttgctacttgact

SEQ ID NO: 492680 - DNA, 25 bp, Mus musculus
gaggtttttctcaccgttaattcat

SEQ ID NO: 492681 - DNA, 25 bp, Mus musculus
gaggtttttctctccgttaattcat

SEQ ID NO: 492682 - DNA, 25 bp, Mus musculus
gaggtttttgcactgaaatatcaca

SEQ ID NO: 492683 - DNA, 25 bp, Mus musculus
gaggtttttgcagtgaaatatcaca

SEQ ID NO: 492684 - DNA, 25 bp, Mus musculus
gaggtttttgccatcctgaacaagt

SEQ ID NO: 492685 - DNA, 25 bp, Mus musculus
gaggtttttgccttcctgaacaagt

SEQ ID NO: 492686 - DNA, 25 bp, Mus musculus
gagtaaaaactaaagcctgggcatg

SEQ ID NO: 492687 - DNA, 25 bp, Mus musculus
gagtaaaaactatagcctgggcatg

SEQ ID NO: 492688 - DNA, 25 bp, Mus musculus
gagtaaaactttcctttcgccatct

SEQ ID NO: 492689 - DNA, 25 bp, Mus musculus
gagtaaaactttgctttcgccatct

SEQ ID NO: 492690 - DNA, 25 bp, Mus musculus
gagtaaaagcgtacatcatcagaaa

SEQ ID NO: 492691 - DNA, 25 bp, Mus musculus
gagtaaaagcgttcatcatcagaaa

SEQ ID NO: 492692 - DNA, 25 bp, Mus musculus
gagtaaaatcgtattcctgtttcag

SEQ ID NO: 492693 - DNA, 25 bp, Mus musculus
gagtaaaatcgttttcctgtttcag

SEQ ID NO: 492694 - DNA, 25 bp, Mus musculus
gagtaaaattgtatcaaagagacat

SEQ ID NO: 492695 - DNA, 25 bp, Mus musculus
gagtaaaattgtctccccatgctca

SEQ ID NO: 492696 - DNA, 25 bp, Mus musculus
gagtaaaattgtgtccccatgctca

SEQ ID NO: 492697 - DNA, 25 bp, Mus musculus
gagtaaaattgtttcaaagagacat

SEQ ID NO: 492698 - DNA, 25 bp, Mus musculus
gagtaaacaaacaggccagccagcc

SEQ ID NO: 492699 - DNA, 25 bp, Mus musculus
gagtaaacaaactggccagccagcc

SEQ ID NO: 492700 - DNA, 25 bp, Mus musculus
gagtaaacagccatgtcttgcctca

SEQ ID NO: 492701 - DNA, 25 bp, Mus musculus
gagtaaacagccttgtcttgcctca

SEQ ID NO: 492702 - DNA, 25 bp, Mus musculus
gagtaaacccctcaggcactgtttt

SEQ ID NO: 492703 - DNA, 25 bp, Mus musculus
gagtaaacccctgaggcactgtttt

SEQ ID NO: 492704 - DNA, 25 bp, Mus musculus
gagtaaacccgtctcaagccgtgta

SEQ ID NO: 492705 - DNA, 25 bp, Mus musculus
gagtaaacccgtgtcaagccgtgta

SEQ ID NO: 492706 - DNA, 25 bp, Mus musculus
gagtaaaccctactaccatgaattt

SEQ ID NO: 492707 - DNA, 25 bp, Mus musculus
gagtaaaccctagtaccatgaattt

SEQ ID NO: 492708 - DNA, 25 bp, Mus musculus
gagtaaacctccaaacctggatttg

SEQ ID NO: 492709 - DNA, 25 bp, Mus musculus
gagtaaacctcctaacctggatttg

SEQ ID NO: 492710 - DNA, 25 bp, Mus musculus
gagtaaacgcataccgatctacgag

SEQ ID NO: 492711 - DNA, 25 bp, Mus musculus
gagtaaacgcattccgatctacgag

SEQ ID NO: 492712 - DNA, 25 bp, Mus musculus
gagtaaacgctgacgcttgtcgtgc

SEQ ID NO: 492713 - DNA, 25 bp, Mus musculus
gagtaaacgctgtcgcttgtcgtgc

SEQ ID NO: 492714 - DNA, 25 bp, Mus musculus
gagtaaactaccctaacccgtgctg

SEQ ID NO: 492715 - DNA, 25 bp, Mus musculus
gagtaaactaccgtaacccgtgctg

SEQ ID NO: 492716 - DNA, 25 bp, Mus musculus
gagtaaactgcactttaatctctgt

SEQ ID NO: 492717 - DNA, 25 bp, Mus musculus
gagtaaactgcagtttaatctctgt

SEQ ID NO: 492718 - DNA, 25 bp, Mus musculus
gagtaaactgttacagcatcaccac

SEQ ID NO: 492719 - DNA, 25 bp, Mus musculus
gagtaaactgtttcagcatcaccac

SEQ ID NO: 492720 - DNA, 25 bp, Mus musculus
gagtaaacttcacaacctcagggtt

SEQ ID NO: 492721 - DNA, 25 bp, Mus musculus
gagtaaacttcagaacctcagggtt

SEQ ID NO: 492722 - DNA, 25 bp, Mus musculus
gagtaaagacggctccaacccagag

SEQ ID NO: 492723 - DNA, 25 bp, Mus musculus
gagtaaagacgggtccaacccagag

SEQ ID NO: 492724 - DNA, 25 bp, Mus musculus
gagtaaagagcccttcttgccatcc

SEQ ID NO: 492725 - DNA, 25 bp, Mus musculus
gagtaaagagccgttcttgccatcc

SEQ ID NO: 492726 - DNA, 25 bp, Mus musculus
gagtaaagagcgcgctcttccctgt

SEQ ID NO: 492727 - DNA, 25 bp, Mus musculus
gagtaaagagcgggctcttccctgt

SEQ ID NO: 492728 - DNA, 25 bp, Mus musculus
gagtaaagatctcaccatgggttag

SEQ ID NO: 492729 - DNA, 25 bp, Mus musculus
gagtaaagatctgaccatgggttag

SEQ ID NO: 492730 - DNA, 25 bp, Mus musculus
gagtaaagattaatcctcttatttt

SEQ ID NO: 492731 - DNA, 25 bp, Mus musculus
gagtaaagattattcctcttatttt

SEQ ID NO: 492732 - DNA, 25 bp, Mus musculus
gagtaaagccctacgctcgaatgga

SEQ ID NO: 492733 - DNA, 25 bp, Mus musculus
gagtaaagcccttcgctcgaatgga

SEQ ID NO: 492734 - DNA, 25 bp, Mus musculus
gagtaaaggctccactgggtcatcc

SEQ ID NO: 492735 - DNA, 25 bp, Mus musculus
gagtaaaggctcgactgggtcatcc

SEQ ID NO: 492736 - DNA, 25 bp, Mus musculus
gagtaaagttgtacccaagggctag

SEQ ID NO: 492737 - DNA, 25 bp, Mus musculus
gagtaaagttgttcccaagggctag

SEQ ID NO: 492738 - DNA, 25 bp, Mus musculus
gagtaaataataacttaccagactt

SEQ ID NO: 492739 - DNA, 25 bp, Mus musculus
gagtaaataatatcttaccagactt

SEQ ID NO: 492740 - DNA, 25 bp, Mus musculus
gagtaaatacgtcctgttcctgggt

SEQ ID NO: 492741 - DNA, 25 bp, Mus musculus
gagtaaatacgtgctgttcctgggt

SEQ ID NO: 492742 - DNA, 25 bp, Mus musculus
gagtaaatcagcacaaaccctgcca

SEQ ID NO: 492743 - DNA, 25 bp, Mus musculus
gagtaaatcagctcaaaccctgcca

SEQ ID NO: 492744 - DNA, 25 bp, Mus musculus
gagtaaatgctacaccggtttcaat

SEQ ID NO: 492745 - DNA, 25 bp, Mus musculus
gagtaaatgctagaccggtttcaat

SEQ ID NO: 492746 - DNA, 25 bp, Mus musculus
gagtaaatgttcctgtcacgaaggt

SEQ ID NO: 492747 - DNA, 25 bp, Mus musculus
gagtaaatgttcgtgtcacgaaggt

SEQ ID NO: 492748 - DNA, 25 bp, Mus musculus
gagtaaattccaacagttctatcag

SEQ ID NO: 492749 - DNA, 25 bp, Mus musculus
gagtaaattccatcagttctatcag

SEQ ID NO: 492750 - DNA, 25 bp, Mus musculus
gagtaaattgcccatagttcagtat

SEQ ID NO: 492751 - DNA, 25 bp, Mus musculus
gagtaaattgccgatagttcagtat

SEQ ID NO: 492752 - DNA, 25 bp, Mus musculus
gagtaaattgggaagtttccagatg

SEQ ID NO: 492753 - DNA, 25 bp, Mus musculus
gagtaaattgggtagtttccagatg

SEQ ID NO: 492754 - DNA, 25 bp, Mus musculus
gagtaacaaagtatgcagctgagac

SEQ ID NO: 492755 - DNA, 25 bp, Mus musculus
gagtaacaaagtttgcagctgagac

SEQ ID NO: 492756 - DNA, 25 bp, Mus musculus
gagtaacaacctagcttgtatcagc

SEQ ID NO: 492757 - DNA, 25 bp, Mus musculus
gagtaacaaccttgcttgtatcagc

SEQ ID NO: 492758 - DNA, 25 bp, Mus musculus
gagtaacaacgcctacctcatagga

SEQ ID NO: 492759 - DNA, 25 bp, Mus musculus
gagtaacaacgcgtacctcatagga

SEQ ID NO: 492760 - DNA, 25 bp, Mus musculus
gagtaacaagtcctgatatcccctt

SEQ ID NO: 492761 - DNA, 25 bp, Mus musculus
gagtaacaagtcgtgatatcccctt

SEQ ID NO: 492762 - DNA, 25 bp, Mus musculus
gagtaacacgacagtgcccaatgcc

SEQ ID NO: 492763 - DNA, 25 bp, Mus musculus
gagtaacacgactgtgcccaatgcc

SEQ ID NO: 492764 - DNA, 25 bp, Mus musculus
gagtaacactatccaagaacatctt

SEQ ID NO: 492765 - DNA, 25 bp, Mus musculus
gagtaacactatgcaagaacatctt

SEQ ID NO: 492766 - DNA, 25 bp, Mus musculus
gagtaacactgaccaagtgcatggt

SEQ ID NO: 492767 - DNA, 25 bp, Mus musculus
gagtaacactgagcaagtgcatggt

SEQ ID NO: 492768 - DNA, 25 bp, Mus musculus
gagtaacagaacagtcttttcttat

SEQ ID NO: 492769 - DNA, 25 bp, Mus musculus
gagtaacagaactgtcttttcttat

SEQ ID NO: 492770 - DNA, 25 bp, Mus musculus
gagtaacagatacccctacttctgt

SEQ ID NO: 492771 - DNA, 25 bp, Mus musculus
gagtaacagatagccctacttctgt

SEQ ID NO: 492772 - DNA, 25 bp, Mus musculus
gagtaacagcagaacagcacctttg

SEQ ID NO: 492773 - DNA, 25 bp, Mus musculus
gagtaacagcagtacagcacctttg

SEQ ID NO: 492774 - DNA, 25 bp, Mus musculus
gagtaacagcccaccggagtgtaaa

SEQ ID NO: 492775 - DNA, 25 bp, Mus musculus
gagtaacagccctccggagtgtaaa

SEQ ID NO: 492776 - DNA, 25 bp, Mus musculus
gagtaaccacaaatagccactgcgc

SEQ ID NO: 492777 - DNA, 25 bp, Mus musculus
gagtaaccacaattagccactgcgc

SEQ ID NO: 492778 - DNA, 25 bp, Mus musculus
gagtaaccagaccacaagtccccag

SEQ ID NO: 492779 - DNA, 25 bp, Mus musculus
gagtaaccagacgacaagtccccag

SEQ ID NO: 492780 - DNA, 25 bp, Mus musculus
gagtaaccagagctgctgaaccata

SEQ ID NO: 492781 - DNA, 25 bp, Mus musculus
gagtaaccagaggtgctgaaccata

SEQ ID NO: 492782 - DNA, 25 bp, Mus musculus
gagtaacccagtctctatagcagag

SEQ ID NO: 492783 - DNA, 25 bp, Mus musculus
gagtaacccagtgtctatagcagag

SEQ ID NO: 492784 - DNA, 25 bp, Mus musculus
gagtaaccccagaacttttgtactg

SEQ ID NO: 492785 - DNA, 25 bp, Mus musculus
gagtaaccccagtacttttgtactg

SEQ ID NO: 492786 - DNA, 25 bp, Mus musculus
gagtaaccctcaagaacggcgcact

SEQ ID NO: 492787 - DNA, 25 bp, Mus musculus
gagtaaccctcatgaacggcgcact

SEQ ID NO: 492788 - DNA, 25 bp, Mus musculus
gagtaaccgcttcctaaaccatttg

SEQ ID NO: 492789 - DNA, 25 bp, Mus musculus
gagtaaccgcttgctaaaccatttg

SEQ ID NO: 492790 - DNA, 25 bp, Mus musculus
gagtaaccgggaccacattcccagg

SEQ ID NO: 492791 - DNA, 25 bp, Mus musculus
gagtaaccgggagcacattcccagg

SEQ ID NO: 492792 - DNA, 25 bp, Mus musculus
gagtaacctgttcgtttgataaact

SEQ ID NO: 492793 - DNA, 25 bp, Mus musculus
gagtaacctgttggtttgataaact

SEQ ID NO: 492794 - DNA, 25 bp, Mus musculus
gagtaaccttgcatcaggcatgcga

SEQ ID NO: 492795 - DNA, 25 bp, Mus musculus
gagtaaccttgcttcaggcatgcga

SEQ ID NO: 492796 - DNA, 25 bp, Mus musculus
gagtaacgaaatagttctgagctaa

SEQ ID NO: 492797 - DNA, 25 bp, Mus musculus
gagtaacgaaattgttctgagctaa

SEQ ID NO: 492798 - DNA, 25 bp, Mus musculus
gagtaacgacttagtgtctcaggct

SEQ ID NO: 492799 - DNA, 25 bp, Mus musculus
gagtaacgactttgtgtctcaggct

SEQ ID NO: 492800 - DNA, 25 bp, Mus musculus
gagtaacgcagtcctttgcttcagt

SEQ ID NO: 492801 - DNA, 25 bp, Mus musculus
gagtaacgcagtgctttgcttcagt

SEQ ID NO: 492802 - DNA, 25 bp, Mus musculus
gagtaacggaaccagacccaatgtt

SEQ ID NO: 492803 - DNA, 25 bp, Mus musculus
gagtaacggaacgagacccaatgtt

SEQ ID NO: 492804 - DNA, 25 bp, Mus musculus
gagtaactaagtattctgagcagaa

SEQ ID NO: 492805 - DNA, 25 bp, Mus musculus
gagtaactaagttttctgagcagaa

SEQ ID NO: 492806 - DNA, 25 bp, Mus musculus
gagtaactaattagctgcctgaaac

SEQ ID NO: 492807 - DNA, 25 bp, Mus musculus
gagtaactaatttgctgcctgaaac

SEQ ID NO: 492808 - DNA, 25 bp, Mus musculus
gagtaactagtgagtcaccagaaga

SEQ ID NO: 492809 - DNA, 25 bp, Mus musculus
gagtaactagtgtgtcaccagaaga

SEQ ID NO: 492810 - DNA, 25 bp, Mus musculus
gagtaactatggctggcttgcttca

SEQ ID NO: 492811 - DNA, 25 bp, Mus musculus
gagtaactatgggtggcttgcttca

SEQ ID NO: 492812 - DNA, 25 bp, Mus musculus
gagtaactcagaatttgccttttgg

SEQ ID NO: 492813 - DNA, 25 bp, Mus musculus
gagtaactcagattttgccttttgg

SEQ ID NO: 492814 - DNA, 25 bp, Mus musculus
gagtaactgagaattccctggctct

SEQ ID NO: 492815 - DNA, 25 bp, Mus musculus
gagtaactgagatttccctggctct

SEQ ID NO: 492816 - DNA, 25 bp, Mus musculus
gagtaactgatgaaccttggctgga

SEQ ID NO: 492817 - DNA, 25 bp, Mus musculus
gagtaactgatgtaccttggctgga

SEQ ID NO: 492818 - DNA, 25 bp, Mus musculus
gagtaactgcatctgtagacctgtc

SEQ ID NO: 492819 - DNA, 25 bp, Mus musculus
gagtaactgcatgtgtagacctgtc

SEQ ID NO: 492820 - DNA, 25 bp, Mus musculus
gagtaacttgaaaacagtatctggg

SEQ ID NO: 492821 - DNA, 25 bp, Mus musculus
gagtaacttgaatacagtatctggg

SEQ ID NO: 492822 - DNA, 25 bp, Mus musculus
gagtaactttcgataggacaggcct

SEQ ID NO: 492823 - DNA, 25 bp, Mus musculus
gagtaactttcgttaggacaggcct

SEQ ID NO: 492824 - DNA, 25 bp, Mus musculus
gagtaacttttcaccaagctggaag

SEQ ID NO: 492825 - DNA, 25 bp, Mus musculus
gagtaacttttctccaagctggaag

SEQ ID NO: 492826 - DNA, 25 bp, Mus musculus
gagtaagaacagagtccgcctgtcc

SEQ ID NO: 492827 - DNA, 25 bp, Mus musculus
gagtaagaacagtgtccgcctgtcc

SEQ ID NO: 492828 - DNA, 25 bp, Mus musculus
gagtaagaacctcaaccatgttgaa

SEQ ID NO: 492829 - DNA, 25 bp, Mus musculus
gagtaagaacctgaaccatgttgaa

SEQ ID NO: 492830 - DNA, 25 bp, Mus musculus
gagtaagaattcacaaacgacgctg

SEQ ID NO: 492831 - DNA, 25 bp, Mus musculus
gagtaagaattctcaaacgacgctg

SEQ ID NO: 492832 - DNA, 25 bp, Mus musculus
gagtaagaccacaacttcatctcag

SEQ ID NO: 492833 - DNA, 25 bp, Mus musculus
gagtaagaccactacttcatctcag

SEQ ID NO: 492834 - DNA, 25 bp, Mus musculus
gagtaagaccggcttttgttcttca

SEQ ID NO: 492835 - DNA, 25 bp, Mus musculus
gagtaagaccgggttttgttcttca

SEQ ID NO: 492836 - DNA, 25 bp, Mus musculus
gagtaagactcccattctgcaacct

SEQ ID NO: 492837 - DNA, 25 bp, Mus musculus
gagtaagactccgattctgcaacct

SEQ ID NO: 492838 - DNA, 25 bp, Mus musculus
gagtaagactgtaacaacaacaaca

SEQ ID NO: 492839 - DNA, 25 bp, Mus musculus
gagtaagactgttacaacaacaaca

SEQ ID NO: 492840 - DNA, 25 bp, Mus musculus
gagtaagactttacgctcaatcaca

SEQ ID NO: 492841 - DNA, 25 bp, Mus musculus
gagtaagacttttcgctcaatcaca

SEQ ID NO: 492842 - DNA, 25 bp, Mus musculus
gagtaagagacgagccagtgcccct

SEQ ID NO: 492843 - DNA, 25 bp, Mus musculus
gagtaagagacgtgccagtgcccct

SEQ ID NO: 492844 - DNA, 25 bp, Mus musculus
gagtaagagctaatcctatcctgga

SEQ ID NO: 492845 - DNA, 25 bp, Mus musculus
gagtaagagctattcctatcctgga

SEQ ID NO: 492846 - DNA, 25 bp, Mus musculus
gagtaagatcaacccagcccatatc

SEQ ID NO: 492847 - DNA, 25 bp, Mus musculus
gagtaagatcaagccagcccatatc

SEQ ID NO: 492848 - DNA, 25 bp, Mus musculus
gagtaagatgagcagagtcacctag

SEQ ID NO: 492849 - DNA, 25 bp, Mus musculus
gagtaagatgaggagagtcacctag

SEQ ID NO: 492850 - DNA, 25 bp, Mus musculus
gagtaagcactccatagctgttctt

SEQ ID NO: 492851 - DNA, 25 bp, Mus musculus
gagtaagcactcgatagctgttctt

SEQ ID NO: 492852 - DNA, 25 bp, Mus musculus
gagtaagcagctaagccccatttgg

SEQ ID NO: 492853 - DNA, 25 bp, Mus musculus
gagtaagcagcttagccccatttgg

SEQ ID NO: 492854 - DNA, 25 bp, Mus musculus
gagtaagcagtcatcccgtcatagg

SEQ ID NO: 492855 - DNA, 25 bp, Mus musculus
gagtaagcagtcttcccgtcatagg

SEQ ID NO: 492856 - DNA, 25 bp, Mus musculus
gagtaagcatctacattccaacagg

SEQ ID NO: 492857 - DNA, 25 bp, Mus musculus
gagtaagcatcttcattccaacagg

SEQ ID NO: 492858 - DNA, 25 bp, Mus musculus
gagtaagccccacatgaacaaggat

SEQ ID NO: 492859 - DNA, 25 bp, Mus musculus
gagtaagccccagatgaacaaggat

SEQ ID NO: 492860 - DNA, 25 bp, Mus musculus
gagtaagctctcaggctcaggaaaa

SEQ ID NO: 492861 - DNA, 25 bp, Mus musculus
gagtaagctctctggctcaggaaaa

SEQ ID NO: 492862 - DNA, 25 bp, Mus musculus
gagtaagctcttagggagcccttct

SEQ ID NO: 492863 - DNA, 25 bp, Mus musculus
gagtaagctctttgggagcccttct

SEQ ID NO: 492864 - DNA, 25 bp, Mus musculus
gagtaagctggaaggtccacctcca

SEQ ID NO: 492865 - DNA, 25 bp, Mus musculus
gagtaagctggatggtccacctcca

SEQ ID NO: 492866 - DNA, 25 bp, Mus musculus
gagtaaggacaaaggcctatccaaa

SEQ ID NO: 492867 - DNA, 25 bp, Mus musculus
gagtaaggacaatggcctatccaaa

SEQ ID NO: 492868 - DNA, 25 bp, Mus musculus
gagtaaggatggacagtttagtttt

SEQ ID NO: 492869 - DNA, 25 bp, Mus musculus
gagtaaggatggtcagtttagtttt

SEQ ID NO: 492870 - DNA, 25 bp, Mus musculus
gagtaaggcaccagctcgaatgaca

SEQ ID NO: 492871 - DNA, 25 bp, Mus musculus
gagtaaggcacctgctcgaatgaca

SEQ ID NO: 492872 - DNA, 25 bp, Mus musculus
gagtaaggccatattctgttttgat

SEQ ID NO: 492873 - DNA, 25 bp, Mus musculus
gagtaaggccattttctgttttgat

SEQ ID NO: 492874 - DNA, 25 bp, Mus musculus
gagtaaggctctcctctacgggacc

SEQ ID NO: 492875 - DNA, 25 bp, Mus musculus
gagtaaggctctcggtgaacagctc

SEQ ID NO: 492876 - DNA, 25 bp, Mus musculus
gagtaaggctctgctctacgggacc

SEQ ID NO: 492877 - DNA, 25 bp, Mus musculus
gagtaaggctctgggtgaacagctc

SEQ ID NO: 492878 - DNA, 25 bp, Mus musculus
gagtaaggctgaccctgtgttcctg

SEQ ID NO: 492879 - DNA, 25 bp, Mus musculus
gagtaaggctgagcctgtgttcctg

SEQ ID NO: 492880 - DNA, 25 bp, Mus musculus
gagtaagggagtaactgtctcctgg

SEQ ID NO: 492881 - DNA, 25 bp, Mus musculus
gagtaagggagttactgtctcctgg

SEQ ID NO: 492882 - DNA, 25 bp, Mus musculus
gagtaagggcatcgttatctgaaat

SEQ ID NO: 492883 - DNA, 25 bp, Mus musculus
gagtaagggcatggttatctgaaat

SEQ ID NO: 492884 - DNA, 25 bp, Mus musculus
gagtaagggcctcttctcgcctcca

SEQ ID NO: 492885 - DNA, 25 bp, Mus musculus
gagtaagggcctgttctcgcctcca

SEQ ID NO: 492886 - DNA, 25 bp, Mus musculus
gagtaagggctgatgtcatcgcctg

SEQ ID NO: 492887 - DNA, 25 bp, Mus musculus
gagtaagggctgttgtcatcgcctg

SEQ ID NO: 492888 - DNA, 25 bp, Mus musculus
gagtaaggtattaggcaatttttgt

SEQ ID NO: 492889 - DNA, 25 bp, Mus musculus
gagtaaggtatttggcaatttttgt

SEQ ID NO: 492890 - DNA, 25 bp, Mus musculus
gagtaaggtcgacagttaaaatgat

SEQ ID NO: 492891 - DNA, 25 bp, Mus musculus
gagtaaggtcgagagttaaaatgat

SEQ ID NO: 492892 - DNA, 25 bp, Mus musculus
gagtaagtacaaaaggagccacatt

SEQ ID NO: 492893 - DNA, 25 bp, Mus musculus
gagtaagtacaataggagccacatt

SEQ ID NO: 492894 - DNA, 25 bp, Mus musculus
gagtaagtactcagcgatgtaacac

SEQ ID NO: 492895 - DNA, 25 bp, Mus musculus
gagtaagtactctgcgatgtaacac

SEQ ID NO: 492896 - DNA, 25 bp, Mus musculus
gagtaagtagctatctgctctgatc

SEQ ID NO: 492897 - DNA, 25 bp, Mus musculus
gagtaagtagctttctgctctgatc

SEQ ID NO: 492898 - DNA, 25 bp, Mus musculus
gagtaagtcagcatttacctgttga

SEQ ID NO: 492899 - DNA, 25 bp, Mus musculus
gagtaagtcagcttttacctgttga

SEQ ID NO: 492900 - DNA, 25 bp, Mus musculus
gagtaagtcgtgacttggcctagaa

SEQ ID NO: 492901 - DNA, 25 bp, Mus musculus
gagtaagtcgtgtcttggcctagaa

SEQ ID NO: 492902 - DNA, 25 bp, Mus musculus
gagtaagtctttccctgtgtacttg

SEQ ID NO: 492903 - DNA, 25 bp, Mus musculus
gagtaagtctttgcctgtgtacttg

SEQ ID NO: 492904 - DNA, 25 bp, Mus musculus
gagtaagtgtcacgtgtgatattca

SEQ ID NO: 492905 - DNA, 25 bp, Mus musculus
gagtaagtgtcaggtgtgatattca

SEQ ID NO: 492906 - DNA, 25 bp, Mus musculus
gagtaagttctaagcttgtgagagc

SEQ ID NO: 492907 - DNA, 25 bp, Mus musculus
gagtaagttctatgcttgtgagagc

SEQ ID NO: 492908 - DNA, 25 bp, Mus musculus
gagtaagtttagcatatatcccatt

SEQ ID NO: 492909 - DNA, 25 bp, Mus musculus
gagtaagtttaggatatatcccatt

SEQ ID NO: 492910 - DNA, 25 bp, Mus musculus
gagtaagtttatacaggctgcacac

SEQ ID NO: 492911 - DNA, 25 bp, Mus musculus
gagtaagtttattcaggctgcacac

SEQ ID NO: 492912 - DNA, 25 bp, Mus musculus
gagtaagtttttctgccaaatcaag

SEQ ID NO: 492913 - DNA, 25 bp, Mus musculus
gagtaagtttttgtgccaaatcaag

SEQ ID NO: 492914 - DNA, 25 bp, Mus musculus
gagtaataacacctctcaggaatca

SEQ ID NO: 492915 - DNA, 25 bp, Mus musculus
gagtaataacacgtctcaggaatca

SEQ ID NO: 492916 - DNA, 25 bp, Mus musculus
gagtaataaccaattgatccaaaat

SEQ ID NO: 492917 - DNA, 25 bp, Mus musculus
gagtaataaccatttgatccaaaat

SEQ ID NO: 492918 - DNA, 25 bp, Mus musculus
gagtaatacctgcaacaaccatcaa

SEQ ID NO: 492919 - DNA, 25 bp, Mus musculus
gagtaatacctggaacaaccatcaa

SEQ ID NO: 492920 - DNA, 25 bp, Mus musculus
gagtaatagccactccctagaaaat

SEQ ID NO: 492921 - DNA, 25 bp, Mus musculus
gagtaatagccagtccctagaaaat

SEQ ID NO: 492922 - DNA, 25 bp, Mus musculus
gagtaatatacacccattgttctag

SEQ ID NO: 492923 - DNA, 25 bp, Mus musculus
gagtaatatacagccattgttctag

SEQ ID NO: 492924 - DNA, 25 bp, Mus musculus
gagtaatatgccctattcgtgccct

SEQ ID NO: 492925 - DNA, 25 bp, Mus musculus
gagtaatatgccgtattcgtgccct

SEQ ID NO: 492926 - DNA, 25 bp, Mus musculus
gagtaatattagactgtgttttcca

SEQ ID NO: 492927 - DNA, 25 bp, Mus musculus
gagtaatattagtctgtgttttcca

SEQ ID NO: 492928 - DNA, 25 bp, Mus musculus
gagtaatcacggcactttgcttact

SEQ ID NO: 492929 - DNA, 25 bp, Mus musculus
gagtaatcacgggactttgcttact

SEQ ID NO: 492930 - DNA, 25 bp, Mus musculus
gagtaatcatgaatccaccgagtaa

SEQ ID NO: 492931 - DNA, 25 bp, Mus musculus
gagtaatcatgattccaccgagtaa

SEQ ID NO: 492932 - DNA, 25 bp, Mus musculus
gagtaatccaggctcggagaatcac

SEQ ID NO: 492933 - DNA, 25 bp, Mus musculus
gagtaatccagggtcggagaatcac

SEQ ID NO: 492934 - DNA, 25 bp, Mus musculus
gagtaatccagtcatatgcccatct

SEQ ID NO: 492935 - DNA, 25 bp, Mus musculus
gagtaatccagtgatatgcccatct

SEQ ID NO: 492936 - DNA, 25 bp, Mus musculus
gagtaatcctccagtgtatgtcata

SEQ ID NO: 492937 - DNA, 25 bp, Mus musculus
gagtaatcctcctgtgtatgtcata

SEQ ID NO: 492938 - DNA, 25 bp, Mus musculus
gagtaatcgtgtaacgtccttctct

SEQ ID NO: 492939 - DNA, 25 bp, Mus musculus
gagtaatcgtgttacgtccttctct

SEQ ID NO: 492940 - DNA, 25 bp, Mus musculus
gagtaatctttcaactgtggtttga

SEQ ID NO: 492941 - DNA, 25 bp, Mus musculus
gagtaatctttctactgtggtttga

SEQ ID NO: 492942 - DNA, 25 bp, Mus musculus
gagtaatgataacccctcaaccctc

SEQ ID NO: 492943 - DNA, 25 bp, Mus musculus
gagtaatgataagccctcaaccctc

SEQ ID NO: 492944 - DNA, 25 bp, Mus musculus
gagtaatgcagaatgcgtgccttca

SEQ ID NO: 492945 - DNA, 25 bp, Mus musculus
gagtaatgcagattgcgtgccttca

SEQ ID NO: 492946 - DNA, 25 bp, Mus musculus
gagtaatggcatatagtctagttga

SEQ ID NO: 492947 - DNA, 25 bp, Mus musculus
gagtaatggcatttagtctagttga

SEQ ID NO: 492948 - DNA, 25 bp, Mus musculus
gagtaatggtcacccacttagtctc

SEQ ID NO: 492949 - DNA, 25 bp, Mus musculus
gagtaatggtcagccacttagtctc

SEQ ID NO: 492950 - DNA, 25 bp, Mus musculus
gagtaatgtaccaaatgcagtcaga

SEQ ID NO: 492951 - DNA, 25 bp, Mus musculus
gagtaatgtacctaatgcagtcaga

SEQ ID NO: 492952 - DNA, 25 bp, Mus musculus
gagtaatgtcaacttaccgttggaa

SEQ ID NO: 492953 - DNA, 25 bp, Mus musculus
gagtaatgtcaagttaccgttggaa

SEQ ID NO: 492954 - DNA, 25 bp, Mus musculus
gagtaattattcaattccccattga

SEQ ID NO: 492955 - DNA, 25 bp, Mus musculus
gagtaattattctattccccattga

SEQ ID NO: 492956 - DNA, 25 bp, Mus musculus
gagtaattcaataatctccctcttt

SEQ ID NO: 492957 - DNA, 25 bp, Mus musculus
gagtaattcaattatctccctcttt

SEQ ID NO: 492958 - DNA, 25 bp, Mus musculus
gagtaattccacagccttatttatt

SEQ ID NO: 492959 - DNA, 25 bp, Mus musculus
gagtaattccactgccttatttatt

SEQ ID NO: 492960 - DNA, 25 bp, Mus musculus
gagtaattccatctcattctggaga

SEQ ID NO: 492961 - DNA, 25 bp, Mus musculus
gagtaattccatgtcattctggaga

SEQ ID NO: 492962 - DNA, 25 bp, Mus musculus
gagtaattcccactggtctttctcc

SEQ ID NO: 492963 - DNA, 25 bp, Mus musculus
gagtaattcccagtggtctttctcc

SEQ ID NO: 492964 - DNA, 25 bp, Mus musculus
gagtaattctggacattatctcctt

SEQ ID NO: 492965 - DNA, 25 bp, Mus musculus
gagtaattctggtcattatctcctt

SEQ ID NO: 492966 - DNA, 25 bp, Mus musculus
gagtaattgcagagcctggcctaga

SEQ ID NO: 492967 - DNA, 25 bp, Mus musculus
gagtaattgcagtgcctggcctaga

SEQ ID NO: 492968 - DNA, 25 bp, Mus musculus
gagtaatttcatactcctcacatga

SEQ ID NO: 492969 - DNA, 25 bp, Mus musculus
gagtaatttcattctcctcacatga

SEQ ID NO: 492970 - DNA, 25 bp, Mus musculus
gagtaatttgaaccacggacttgca

SEQ ID NO: 492971 - DNA, 25 bp, Mus musculus
gagtaatttgaagcacggacttgca

SEQ ID NO: 492972 - DNA, 25 bp, Mus musculus
gagtaattttaacccatattctaca

SEQ ID NO: 492973 - DNA, 25 bp, Mus musculus
gagtaattttaagccatattctaca

SEQ ID NO: 492974 - DNA, 25 bp, Mus musculus
gagtaattttctcccactgagtgac

SEQ ID NO: 492975 - DNA, 25 bp, Mus musculus
gagtaattttctgccactgagtgac

SEQ ID NO: 492976 - DNA, 25 bp, Mus musculus
gagtacaaacagctgatcgaatcat

SEQ ID NO: 492977 - DNA, 25 bp, Mus musculus
gagtacaaacaggtgatcgaatcat

SEQ ID NO: 492978 - DNA, 25 bp, Mus musculus
gagtacaaaggcattctcggctgct

SEQ ID NO: 492979 - DNA, 25 bp, Mus musculus
gagtacaaaggctttctcggctgct

SEQ ID NO: 492980 - DNA, 25 bp, Mus musculus
gagtacaaagtcatccacagctgca

SEQ ID NO: 492981 - DNA, 25 bp, Mus musculus
gagtacaaagtcttccacagctgca

SEQ ID NO: 492982 - DNA, 25 bp, Mus musculus
gagtacaacctccttgtggtgggaa

SEQ ID NO: 492983 - DNA, 25 bp, Mus musculus
gagtacaacctcgttgtggtgggaa

SEQ ID NO: 492984 - DNA, 25 bp, Mus musculus
gagtacaagaggctctccaacgcca

SEQ ID NO: 492985 - DNA, 25 bp, Mus musculus
gagtacaagagggtctccaacgcca

SEQ ID NO: 492986 - DNA, 25 bp, Mus musculus
gagtacaagcaactcggacctctca

SEQ ID NO: 492987 - DNA, 25 bp, Mus musculus
gagtacaagcaagtcggacctctca

SEQ ID NO: 492988 - DNA, 25 bp, Mus musculus
gagtacaagcgaagcgtgctgctaa

SEQ ID NO: 492989 - DNA, 25 bp, Mus musculus
gagtacaagcgatgcgtgctgctaa

SEQ ID NO: 492990 - DNA, 25 bp, Mus musculus
gagtacaaggtcagcatcatgttca

SEQ ID NO: 492991 - DNA, 25 bp, Mus musculus
gagtacaaggtctgcatcatgttca

SEQ ID NO: 492992 - DNA, 25 bp, Mus musculus
gagtacaagtccctttgctttcaca

SEQ ID NO: 492993 - DNA, 25 bp, Mus musculus
gagtacaagtccgtttgctttcaca

SEQ ID NO: 492994 - DNA, 25 bp, Mus musculus
gagtacaagtgcagatgtcccaccc

SEQ ID NO: 492995 - DNA, 25 bp, Mus musculus
gagtacaagtgctgatgtcccaccc

SEQ ID NO: 492996 - DNA, 25 bp, Mus musculus
gagtacaatcgcatggtgtttcaac

SEQ ID NO: 492997 - DNA, 25 bp, Mus musculus
gagtacaatcgcttggtgtttcaac

SEQ ID NO: 492998 - DNA, 25 bp, Mus musculus
gagtacaatgctccaggaagccaca

SEQ ID NO: 492999 - DNA, 25 bp, Mus musculus
gagtacaatgctgcaggaagccaca

SEQ ID NO: 493000 - DNA, 25 bp, Mus musculus
gagtacaattccatgcaaaaagaca

SEQ ID NO: 493001 - DNA, 25 bp, Mus musculus
gagtacaattccttgcaaaaagaca

SEQ ID NO: 493002 - DNA, 25 bp, Mus musculus
gagtacacaatgcaccccgctttct

SEQ ID NO: 493003 - DNA, 25 bp, Mus musculus
gagtacacaatggaccccgctttct

SEQ ID NO: 493004 - DNA, 25 bp, Mus musculus
gagtacacacacacaatcccgaaag

SEQ ID NO: 493005 - DNA, 25 bp, Mus musculus
gagtacacacactcaatcccgaaag

SEQ ID NO: 493006 - DNA, 25 bp, Mus musculus
gagtacacacgtcactgagcaagcg

SEQ ID NO: 493007 - DNA, 25 bp, Mus musculus
gagtacacacgtgactgagcaagcg

SEQ ID NO: 493008 - DNA, 25 bp, Mus musculus
gagtacacagtaagtgagcccatta

SEQ ID NO: 493009 - DNA, 25 bp, Mus musculus
gagtacacagtatgtgagcccatta

SEQ ID NO: 493010 - DNA, 25 bp, Mus musculus
gagtacacatttaccataagctttt

SEQ ID NO: 493011 - DNA, 25 bp, Mus musculus
gagtacacattttccataagctttt

SEQ ID NO: 493012 - DNA, 25 bp, Mus musculus
gagtacaccaacatctcaagggtct

SEQ ID NO: 493013 - DNA, 25 bp, Mus musculus
gagtacaccaacttctcaagggtct

SEQ ID NO: 493014 - DNA, 25 bp, Mus musculus
gagtacaccatacataccttggagg

SEQ ID NO: 493015 - DNA, 25 bp, Mus musculus
gagtacaccatagataccttggagg

SEQ ID NO: 493016 - DNA, 25 bp, Mus musculus
gagtacacgagtatagggcggagca

SEQ ID NO: 493017 - DNA, 25 bp, Mus musculus
gagtacacgagtttagggcggagca

SEQ ID NO: 493018 - DNA, 25 bp, Mus musculus
gagtacacggacagcggcgagggct

SEQ ID NO: 493019 - DNA, 25 bp, Mus musculus
gagtacacggactgcggcgagggct

SEQ ID NO: 493020 - DNA, 25 bp, Mus musculus
gagtacagaattcgcacctgtggca

SEQ ID NO: 493021 - DNA, 25 bp, Mus musculus
gagtacagaattggcacctgtggca

SEQ ID NO: 493022 - DNA, 25 bp, Mus musculus
gagtacagagggagccactgctgct

SEQ ID NO: 493023 - DNA, 25 bp, Mus musculus
gagtacagagggtgccactgctgct

SEQ ID NO: 493024 - DNA, 25 bp, Mus musculus
gagtacagcatccaggccgcaggca

SEQ ID NO: 493025 - DNA, 25 bp, Mus musculus
gagtacagcatcgaggccgcaggca

SEQ ID NO: 493026 - DNA, 25 bp, Mus musculus
gagtacagcctgagagagttcatgg

SEQ ID NO: 493027 - DNA, 25 bp, Mus musculus
gagtacagcctgtgagagttcatgg

SEQ ID NO: 493028 - DNA, 25 bp, Mus musculus
gagtacagcgtaccagtcctgcagt

SEQ ID NO: 493029 - DNA, 25 bp, Mus musculus
gagtacagcgtagcagtcctgcagt

SEQ ID NO: 493030 - DNA, 25 bp, Mus musculus
gagtacagctcaaagcaccaggcag

SEQ ID NO: 493031 - DNA, 25 bp, Mus musculus
gagtacagctcatagcaccaggcag

SEQ ID NO: 493032 - DNA, 25 bp, Mus musculus
gagtacaggaaaacacgggagagaa

SEQ ID NO: 493033 - DNA, 25 bp, Mus musculus
gagtacaggaaatcacgggagagaa

SEQ ID NO: 493034 - DNA, 25 bp, Mus musculus
gagtacaggatcacgtgggttctga

SEQ ID NO: 493035 - DNA, 25 bp, Mus musculus
gagtacaggatctcgtgggttctga

SEQ ID NO: 493036 - DNA, 25 bp, Mus musculus
gagtacagtaaccactttaccatga

SEQ ID NO: 493037 - DNA, 25 bp, Mus musculus
gagtacagtaacgactttaccatga

SEQ ID NO: 493038 - DNA, 25 bp, Mus musculus
gagtacagtcagaaccccaggaaga

SEQ ID NO: 493039 - DNA, 25 bp, Mus musculus
gagtacagtcagtaccccaggaaga

SEQ ID NO: 493040 - DNA, 25 bp, Mus musculus
gagtacagtgaaatccttccagctc

SEQ ID NO: 493041 - DNA, 25 bp, Mus musculus
gagtacagtgaattccttccagctc

SEQ ID NO: 493042 - DNA, 25 bp, Mus musculus
gagtacagtgccatcaaatcagacg

SEQ ID NO: 493043 - DNA, 25 bp, Mus musculus
gagtacagtgccttcaaatcagacg

SEQ ID NO: 493044 - DNA, 25 bp, Mus musculus
gagtacagtggaatgcttccaacaa

SEQ ID NO: 493045 - DNA, 25 bp, Mus musculus
gagtacagtggattgcttccaacaa

SEQ ID NO: 493046 - DNA, 25 bp, Mus musculus
gagtacagtggtatctccaaagcct

SEQ ID NO: 493047 - DNA, 25 bp, Mus musculus
gagtacagtggtttctccaaagcct

SEQ ID NO: 493048 - DNA, 25 bp, Mus musculus
gagtacagtttacgtttcatacttt

SEQ ID NO: 493049 - DNA, 25 bp, Mus musculus
gagtacagtttaggtttcatacttt

SEQ ID NO: 493050 - DNA, 25 bp, Mus musculus
gagtacataacaatgaccttcctaa

SEQ ID NO: 493051 - DNA, 25 bp, Mus musculus
gagtacataacattgaccttcctaa

SEQ ID NO: 493052 - DNA, 25 bp, Mus musculus
gagtacataataaccatcttgctga

SEQ ID NO: 493053 - DNA, 25 bp, Mus musculus
gagtacataatatccatcttgctga

SEQ ID NO: 493054 - DNA, 25 bp, Mus musculus
gagtacatacctctgtcctagaagc

SEQ ID NO: 493055 - DNA, 25 bp, Mus musculus
gagtacatacctgtgtcctagaagc

SEQ ID NO: 493056 - DNA, 25 bp, Mus musculus
gagtacatcaaacagaaccccatgg

SEQ ID NO: 493057 - DNA, 25 bp, Mus musculus
gagtacatcaaagagaaccccatgg

SEQ ID NO: 493058 - DNA, 25 bp, Mus musculus
gagtacatcccccagggaatctgaa

SEQ ID NO: 493059 - DNA, 25 bp, Mus musculus
gagtacatccccgagggaatctgaa

SEQ ID NO: 493060 - DNA, 25 bp, Mus musculus
gagtacatcgtcacatttctgttgc

SEQ ID NO: 493061 - DNA, 25 bp, Mus musculus
gagtacatcgtctcatttctgttgc

SEQ ID NO: 493062 - DNA, 25 bp, Mus musculus
gagtacatcgtgcatctcatgttcc

SEQ ID NO: 493063 - DNA, 25 bp, Mus musculus
gagtacatcgtggatctcatgttcc

SEQ ID NO: 493064 - DNA, 25 bp, Mus musculus
gagtacatgcagactggttacagct

SEQ ID NO: 493065 - DNA, 25 bp, Mus musculus
gagtacatgcagtctggttacagct

SEQ ID NO: 493066 - DNA, 25 bp, Mus musculus
gagtacatggtgagactgtgaatta

SEQ ID NO: 493067 - DNA, 25 bp, Mus musculus
gagtacatggtgtgactgtgaatta

SEQ ID NO: 493068 - DNA, 25 bp, Mus musculus
gagtacatgttcacagtgcagggca

SEQ ID NO: 493069 - DNA, 25 bp, Mus musculus
gagtacatgttctcagtgcagggca

SEQ ID NO: 493070 - DNA, 25 bp, Mus musculus
gagtacattattcaggccactgcag

SEQ ID NO: 493071 - DNA, 25 bp, Mus musculus
gagtacattattgaggccactgcag

SEQ ID NO: 493072 - DNA, 25 bp, Mus musculus
gagtacattcatactggtctttcat

SEQ ID NO: 493073 - DNA, 25 bp, Mus musculus
gagtacattcattctggtctttcat

SEQ ID NO: 493074 - DNA, 25 bp, Mus musculus
gagtacattcgtccgctgcagcggc

SEQ ID NO: 493075 - DNA, 25 bp, Mus musculus
gagtacattcgtgcgctgcagcggc

SEQ ID NO: 493076 - DNA, 25 bp, Mus musculus
gagtacattgatcgcattgccatac

SEQ ID NO: 493077 - DNA, 25 bp, Mus musculus
gagtacattgatggcattgccatac

SEQ ID NO: 493078 - DNA, 25 bp, Mus musculus
gagtacattgttcttcagatcctat

SEQ ID NO: 493079 - DNA, 25 bp, Mus musculus
gagtacattgttgttcagatcctat

SEQ ID NO: 493080 - DNA, 25 bp, Mus musculus
gagtacatttgcaaaccagcctttc

SEQ ID NO: 493081 - DNA, 25 bp, Mus musculus
gagtacatttgctaaccagcctttc

SEQ ID NO: 493082 - DNA, 25 bp, Mus musculus
gagtaccaagtgacttaagtgctaa

SEQ ID NO: 493083 - DNA, 25 bp, Mus musculus
gagtaccaagtgtcttaagtgctaa

SEQ ID NO: 493084 - DNA, 25 bp, Mus musculus
gagtaccacaaactctaccatatga

SEQ ID NO: 493085 - DNA, 25 bp, Mus musculus
gagtaccacaaagtctaccatatga

SEQ ID NO: 493086 - DNA, 25 bp, Mus musculus
gagtaccacaacattaatcatctaa

SEQ ID NO: 493087 - DNA, 25 bp, Mus musculus
gagtaccacaactttaatcatctaa

SEQ ID NO: 493088 - DNA, 25 bp, Mus musculus
gagtaccacctcagatgcttcagaa

SEQ ID NO: 493089 - DNA, 25 bp, Mus musculus
gagtaccacctctgatgcttcagaa

SEQ ID NO: 493090 - DNA, 25 bp, Mus musculus
gagtaccactgcactgggaccaggg

SEQ ID NO: 493091 - DNA, 25 bp, Mus musculus
gagtaccactgctctgggaccaggg

SEQ ID NO: 493092 - DNA, 25 bp, Mus musculus
gagtaccagctgaacgattcggcag

SEQ ID NO: 493093 - DNA, 25 bp, Mus musculus
gagtaccagctgtacgattcggcag

SEQ ID NO: 493094 - DNA, 25 bp, Mus musculus
gagtaccagcttcattacacttgta

SEQ ID NO: 493095 - DNA, 25 bp, Mus musculus
gagtaccagcttgattacacttgta

SEQ ID NO: 493096 - DNA, 25 bp, Mus musculus
gagtaccagggcaccaacttagatg

SEQ ID NO: 493097 - DNA, 25 bp, Mus musculus
gagtaccagggctccaacttagatg

SEQ ID NO: 493098 - DNA, 25 bp, Mus musculus
gagtaccagttgcttttgaactcag

SEQ ID NO: 493099 - DNA, 25 bp, Mus musculus
gagtaccagttggttttgaactcag

SEQ ID NO: 493100 - DNA, 25 bp, Mus musculus
gagtacccaaggataacaccagcca

SEQ ID NO: 493101 - DNA, 25 bp, Mus musculus
gagtacccaaggttaacaccagcca

SEQ ID NO: 493102 - DNA, 25 bp, Mus musculus
gagtacccaatacgtgaggcttcta

SEQ ID NO: 493103 - DNA, 25 bp, Mus musculus
gagtacccaataggtgaggcttcta

SEQ ID NO: 493104 - DNA, 25 bp, Mus musculus
gagtacccacaaagtgctaggcact

SEQ ID NO: 493105 - DNA, 25 bp, Mus musculus
gagtacccacaatgtgctaggcact

SEQ ID NO: 493106 - DNA, 25 bp, Mus musculus
gagtacccacttagaccactggagt

SEQ ID NO: 493107 - DNA, 25 bp, Mus musculus
gagtacccactttgaccactggagt

SEQ ID NO: 493108 - DNA, 25 bp, Mus musculus
gagtaccccacaaggctgttccagg

SEQ ID NO: 493109 - DNA, 25 bp, Mus musculus
gagtaccccacatggctgttccagg

SEQ ID NO: 493110 - DNA, 25 bp, Mus musculus
gagtacccctacaagtgccgtgagt

SEQ ID NO: 493111 - DNA, 25 bp, Mus musculus
gagtacccctactagtgccgtgagt

SEQ ID NO: 493112 - DNA, 25 bp, Mus musculus
gagtacccctgacgtactttaggca

SEQ ID NO: 493113 - DNA, 25 bp, Mus musculus
gagtacccctgaggtactttaggca

SEQ ID NO: 493114 - DNA, 25 bp, Mus musculus
gagtaccctaggagctaaagggtct

SEQ ID NO: 493115 - DNA, 25 bp, Mus musculus
gagtaccctaggtgctaaagggtct

SEQ ID NO: 493116 - DNA, 25 bp, Mus musculus
gagtacccttttcccctagagagat

SEQ ID NO: 493117 - DNA, 25 bp, Mus musculus
gagtacccttttgccctagagagat

SEQ ID NO: 493118 - DNA, 25 bp, Mus musculus
gagtaccgaggcagctcgcccgacg

SEQ ID NO: 493119 - DNA, 25 bp, Mus musculus
gagtaccgaggctgctcgcccgacg

SEQ ID NO: 493120 - DNA, 25 bp, Mus musculus
gagtaccggtgccttttcaaagaca

SEQ ID NO: 493121 - DNA, 25 bp, Mus musculus
gagtaccggtgcgttttcaaagaca

SEQ ID NO: 493122 - DNA, 25 bp, Mus musculus
gagtaccgtatacaggctggaccac

SEQ ID NO: 493123 - DNA, 25 bp, Mus musculus
gagtaccgtatagaggctggaccac

SEQ ID NO: 493124 - DNA, 25 bp, Mus musculus
gagtacctctatacttggcaaattc

SEQ ID NO: 493125 - DNA, 25 bp, Mus musculus
gagtacctctattcttggcaaattc

SEQ ID NO: 493126 - DNA, 25 bp, Mus musculus
gagtacctgaaaatcctaagctcaa

SEQ ID NO: 493127 - DNA, 25 bp, Mus musculus
gagtacctgaaattcctaagctcaa

SEQ ID NO: 493128 - DNA, 25 bp, Mus musculus
gagtacctgcccagttacgcgaggc

SEQ ID NO: 493129 - DNA, 25 bp, Mus musculus
gagtacctgccctgttacgcgaggc

SEQ ID NO: 493130 - DNA, 25 bp, Mus musculus
gagtacctgggactctagcctgcag

SEQ ID NO: 493131 - DNA, 25 bp, Mus musculus
gagtacctgggagtctagcctgcag

SEQ ID NO: 493132 - DNA, 25 bp, Mus musculus
gagtacctggttaagacacagctgt

SEQ ID NO: 493133 - DNA, 25 bp, Mus musculus
gagtacctggtttagacacagctgt

SEQ ID NO: 493134 - DNA, 25 bp, Mus musculus
gagtaccttgctaatagagcaggct

SEQ ID NO: 493135 - DNA, 25 bp, Mus musculus
gagtaccttgcttatagagcaggct

SEQ ID NO: 493136 - DNA, 25 bp, Mus musculus
gagtacctttccagggtctgaacac

SEQ ID NO: 493137 - DNA, 25 bp, Mus musculus
gagtacctttcctgggtctgaacac

SEQ ID NO: 493138 - DNA, 25 bp, Mus musculus
gagtacgaactcctagccaaggagt

SEQ ID NO: 493139 - DNA, 25 bp, Mus musculus
gagtacgaactcgtagccaaggagt

SEQ ID NO: 493140 - DNA, 25 bp, Mus musculus
gagtacgaccccaatgttcttaagt

SEQ ID NO: 493141 - DNA, 25 bp, Mus musculus
gagtacgacccctatgttcttaagt

SEQ ID NO: 493142 - DNA, 25 bp, Mus musculus
gagtacgacttgaggcacttagcat

SEQ ID NO: 493143 - DNA, 25 bp, Mus musculus
gagtacgacttgtggcacttagcat

SEQ ID NO: 493144 - DNA, 25 bp, Mus musculus
gagtacgaggtcacctggagtccac

SEQ ID NO: 493145 - DNA, 25 bp, Mus musculus
gagtacgaggtctcctggagtccac

SEQ ID NO: 493146 - DNA, 25 bp, Mus musculus
gagtacgatgtgagtgctatctgtc

SEQ ID NO: 493147 - DNA, 25 bp, Mus musculus
gagtacgatgtgtgtgctatctgtc

SEQ ID NO: 493148 - DNA, 25 bp, Mus musculus
gagtacgccacgaggaaccgagact

SEQ ID NO: 493149 - DNA, 25 bp, Mus musculus
gagtacgccacgtggaaccgagact

SEQ ID NO: 493150 - DNA, 25 bp, Mus musculus
gagtacgccgccctcaactttgtgt

SEQ ID NO: 493151 - DNA, 25 bp, Mus musculus
gagtacgccgccgtcaactttgtgt

SEQ ID NO: 493152 - DNA, 25 bp, Mus musculus
gagtacgctcctctttgggttcttt

SEQ ID NO: 493153 - DNA, 25 bp, Mus musculus
gagtacgctcctgtttgggttcttt

SEQ ID NO: 493154 - DNA, 25 bp, Mus musculus
gagtacggccttcgcatttacatca

SEQ ID NO: 493155 - DNA, 25 bp, Mus musculus
gagtacggccttggcatttacatca

SEQ ID NO: 493156 - DNA, 25 bp, Mus musculus
gagtacgggttgagatccattttcc

SEQ ID NO: 493157 - DNA, 25 bp, Mus musculus
gagtacgggttgtgatccattttcc

SEQ ID NO: 493158 - DNA, 25 bp, Mus musculus
gagtacggttcgatttgacacacta

SEQ ID NO: 493159 - DNA, 25 bp, Mus musculus
gagtacggttcgttttgacacacta

SEQ ID NO: 493160 - DNA, 25 bp, Mus musculus
gagtacgtccaacccaaccctagga

SEQ ID NO: 493161 - DNA, 25 bp, Mus musculus
gagtacgtccaagccaaccctagga

SEQ ID NO: 493162 - DNA, 25 bp, Mus musculus
gagtacgtgcgtcgacatctgtcaa

SEQ ID NO: 493163 - DNA, 25 bp, Mus musculus
gagtacgtgcgtggacatctgtcaa

SEQ ID NO: 493164 - DNA, 25 bp, Mus musculus
gagtacgttaggagccagtacccca

SEQ ID NO: 493165 - DNA, 25 bp, Mus musculus
gagtacgttaggtgccagtacccca

SEQ ID NO: 493166 - DNA, 25 bp, Mus musculus
gagtacgtttttagaatctggcctt

SEQ ID NO: 493167 - DNA, 25 bp, Mus musculus
gagtacgttttttgaatctggcctt

SEQ ID NO: 493168 - DNA, 25 bp, Mus musculus
gagtactaacccaattctgtcattc

SEQ ID NO: 493169 - DNA, 25 bp, Mus musculus
gagtactaaccctattctgtcattc

SEQ ID NO: 493170 - DNA, 25 bp, Mus musculus
gagtactaagtccattccttgagcc

SEQ ID NO: 493171 - DNA, 25 bp, Mus musculus
gagtactaagtcgattccttgagcc

SEQ ID NO: 493172 - DNA, 25 bp, Mus musculus
gagtactaatttccctaccagaccc

SEQ ID NO: 493173 - DNA, 25 bp, Mus musculus
gagtactaatttgcctaccagaccc

SEQ ID NO: 493174 - DNA, 25 bp, Mus musculus
gagtactacaggctctcctcagtga

SEQ ID NO: 493175 - DNA, 25 bp, Mus musculus
gagtactacagggtctcctcagtga

SEQ ID NO: 493176 - DNA, 25 bp, Mus musculus
gagtactacgagctgttggagcaca

SEQ ID NO: 493177 - DNA, 25 bp, Mus musculus
gagtactacgaggtgttggagcaca

SEQ ID NO: 493178 - DNA, 25 bp, Mus musculus
gagtactacttgatcataactaacc

SEQ ID NO: 493179 - DNA, 25 bp, Mus musculus
gagtactacttgttcataactaacc

SEQ ID NO: 493180 - DNA, 25 bp, Mus musculus
gagtactatatgactgcccatagaa

SEQ ID NO: 493181 - DNA, 25 bp, Mus musculus
gagtactatatgtctgcccatagaa

SEQ ID NO: 493182 - DNA, 25 bp, Mus musculus
gagtactatcaccttaagaaccata

SEQ ID NO: 493183 - DNA, 25 bp, Mus musculus
gagtactatcacgttaagaaccata

SEQ ID NO: 493184 - DNA, 25 bp, Mus musculus
gagtactatgctattgctcagcaga

SEQ ID NO: 493185 - DNA, 25 bp, Mus musculus
gagtactatgcttttgctcagcaga

SEQ ID NO: 493186 - DNA, 25 bp, Mus musculus
gagtactatgtaaaccgtgcccacg

SEQ ID NO: 493187 - DNA, 25 bp, Mus musculus
gagtactatgtataccgtgcccacg

SEQ ID NO: 493188 - DNA, 25 bp, Mus musculus
gagtactattaacatggtccctgat

SEQ ID NO: 493189 - DNA, 25 bp, Mus musculus
gagtactattaagatggtccctgat

SEQ ID NO: 493190 - DNA, 25 bp, Mus musculus
gagtactattacattgtccaggaaa

SEQ ID NO: 493191 - DNA, 25 bp, Mus musculus
gagtactattactttgtccaggaaa

SEQ ID NO: 493192 - DNA, 25 bp, Mus musculus
gagtactattggagtcttccaaaca

SEQ ID NO: 493193 - DNA, 25 bp, Mus musculus
gagtactattggtgtcttccaaaca

SEQ ID NO: 493194 - DNA, 25 bp, Mus musculus
gagtactcacacatatagactacat

SEQ ID NO: 493195 - DNA, 25 bp, Mus musculus
gagtactcacacttatagactacat

SEQ ID NO: 493196 - DNA, 25 bp, Mus musculus
gagtactcactcactgaaaatggaa

SEQ ID NO: 493197 - DNA, 25 bp, Mus musculus
gagtactcactctctgaaaatggaa

SEQ ID NO: 493198 - DNA, 25 bp, Mus musculus
gagtactcagctcacagttggcatt

SEQ ID NO: 493199 - DNA, 25 bp, Mus musculus
gagtactcagctgacagttggcatt

SEQ ID NO: 493200 - DNA, 25 bp, Mus musculus
gagtactccatactgaatatgtata

SEQ ID NO: 493201 - DNA, 25 bp, Mus musculus
gagtactccatagtgaatatgtata

SEQ ID NO: 493202 - DNA, 25 bp, Mus musculus
gagtactctctaacccaagtcatta

SEQ ID NO: 493203 - DNA, 25 bp, Mus musculus
gagtactctctatcccaagtcatta

SEQ ID NO: 493204 - DNA, 25 bp, Mus musculus
gagtactctgctaggtatagcccaa

SEQ ID NO: 493205 - DNA, 25 bp, Mus musculus
gagtactctgcttggtatagcccaa

SEQ ID NO: 493206 - DNA, 25 bp, Mus musculus
gagtactgacttctttccatgttct

SEQ ID NO: 493207 - DNA, 25 bp, Mus musculus
gagtactgacttgtttccatgttct

SEQ ID NO: 493208 - DNA, 25 bp, Mus musculus
gagtactgagccaagacgctgacct

SEQ ID NO: 493209 - DNA, 25 bp, Mus musculus
gagtactgagcctagacgctgacct

SEQ ID NO: 493210 - DNA, 25 bp, Mus musculus
gagtactgatccactgcggaggcta

SEQ ID NO: 493211 - DNA, 25 bp, Mus musculus
gagtactgatcctctgcggaggcta

SEQ ID NO: 493212 - DNA, 25 bp, Mus musculus
gagtactgcattctagtctccatat

SEQ ID NO: 493213 - DNA, 25 bp, Mus musculus
gagtactgcattctgttacggatca

SEQ ID NO: 493214 - DNA, 25 bp, Mus musculus
gagtactgcattgtagtctccatat

SEQ ID NO: 493215 - DNA, 25 bp, Mus musculus
gagtactgcattgtgttacggatca

SEQ ID NO: 493216 - DNA, 25 bp, Mus musculus
gagtactgccgcagagctggacaag

SEQ ID NO: 493217 - DNA, 25 bp, Mus musculus
gagtactgccgctgagctggacaag

SEQ ID NO: 493218 - DNA, 25 bp, Mus musculus
gagtactgcgttcttacgatgtcat

SEQ ID NO: 493219 - DNA, 25 bp, Mus musculus
gagtactgcgttgttacgatgtcat

SEQ ID NO: 493220 - DNA, 25 bp, Mus musculus
gagtactgctagagcctgttaaatc

SEQ ID NO: 493221 - DNA, 25 bp, Mus musculus
gagtactgctagtgcctgttaaatc

SEQ ID NO: 493222 - DNA, 25 bp, Mus musculus
gagtactgctcgatacacagaccag

SEQ ID NO: 493223 - DNA, 25 bp, Mus musculus
gagtactgctcgttacacagaccag

SEQ ID NO: 493224 - DNA, 25 bp, Mus musculus
gagtactggaatcgccgacgacgac

SEQ ID NO: 493225 - DNA, 25 bp, Mus musculus
gagtactggaatggccgacgacgac

SEQ ID NO: 493226 - DNA, 25 bp, Mus musculus
gagtactggactctatgaccccact

SEQ ID NO: 493227 - DNA, 25 bp, Mus musculus
gagtactggactgtatgaccccact

SEQ ID NO: 493228 - DNA, 25 bp, Mus musculus
gagtactggataagggactgcctca

SEQ ID NO: 493229 - DNA, 25 bp, Mus musculus
gagtactggatatgggactgcctca

SEQ ID NO: 493230 - DNA, 25 bp, Mus musculus
gagtactggattctccgaaattcat

SEQ ID NO: 493231 - DNA, 25 bp, Mus musculus
gagtactggattgtccgaaattcat

SEQ ID NO: 493232 - DNA, 25 bp, Mus musculus
gagtactgggtcaagatggtccaaa

SEQ ID NO: 493233 - DNA, 25 bp, Mus musculus
gagtactgggtctagatggtccaaa

SEQ ID NO: 493234 - DNA, 25 bp, Mus musculus
gagtactgtaacatttgctttcact

SEQ ID NO: 493235 - DNA, 25 bp, Mus musculus
gagtactgtaacttttgctttcact

SEQ ID NO: 493236 - DNA, 25 bp, Mus musculus
gagtactgtctcaaggtgctggaga

SEQ ID NO: 493237 - DNA, 25 bp, Mus musculus
gagtactgtctctaggtgctggaga

SEQ ID NO: 493238 - DNA, 25 bp, Mus musculus
gagtactgtgagaggctcctggtcc

SEQ ID NO: 493239 - DNA, 25 bp, Mus musculus
gagtactgtgagtggctcctggtcc

SEQ ID NO: 493240 - DNA, 25 bp, Mus musculus
gagtactgtgtgagtcagcccaaaa

SEQ ID NO: 493241 - DNA, 25 bp, Mus musculus
gagtactgtgtgtgtcagcccaaaa

SEQ ID NO: 493242 - DNA, 25 bp, Mus musculus
gagtacttaaatctctacctacagg

SEQ ID NO: 493243 - DNA, 25 bp, Mus musculus
gagtacttaaatgtctacctacagg

SEQ ID NO: 493244 - DNA, 25 bp, Mus musculus
gagtacttaacaacgaacatcctcg

SEQ ID NO: 493245 - DNA, 25 bp, Mus musculus
gagtacttaacatcgaacatcctcg

SEQ ID NO: 493246 - DNA, 25 bp, Mus musculus
gagtacttaagtatggacaccgtgg

SEQ ID NO: 493247 - DNA, 25 bp, Mus musculus
gagtacttaagtttggacaccgtgg

SEQ ID NO: 493248 - DNA, 25 bp, Mus musculus
gagtacttactcaagattgattgga

SEQ ID NO: 493249 - DNA, 25 bp, Mus musculus
gagtacttactctagattgattgga

SEQ ID NO: 493250 - DNA, 25 bp, Mus musculus
gagtacttagcaacggagcggcaat

SEQ ID NO: 493251 - DNA, 25 bp, Mus musculus
gagtacttagcatcggagcggcaat

SEQ ID NO: 493252 - DNA, 25 bp, Mus musculus
gagtacttcaatataaatcctgtca

SEQ ID NO: 493253 - DNA, 25 bp, Mus musculus
gagtacttcaatttaaatcctgtca

SEQ ID NO: 493254 - DNA, 25 bp, Mus musculus
gagtacttctgacaccagcagttga

SEQ ID NO: 493255 - DNA, 25 bp, Mus musculus
gagtacttctgagaccagcagttga

SEQ ID NO: 493256 - DNA, 25 bp, Mus musculus
gagtacttgattcatgtgtttccac

SEQ ID NO: 493257 - DNA, 25 bp, Mus musculus
gagtacttgattgatgtgtttccac

SEQ ID NO: 493258 - DNA, 25 bp, Mus musculus
gagtacttggtcatagaccagtgta

SEQ ID NO: 493259 - DNA, 25 bp, Mus musculus
gagtacttggtcttagaccagtgta

SEQ ID NO: 493260 - DNA, 25 bp, Mus musculus
gagtacttggtgacacctcggtgga

SEQ ID NO: 493261 - DNA, 25 bp, Mus musculus
gagtacttggtgtcacctcggtgga

SEQ ID NO: 493262 - DNA, 25 bp, Mus musculus
gagtacttgtgcatgaagccctgtt

SEQ ID NO: 493263 - DNA, 25 bp, Mus musculus
gagtacttgtgcttgaagccctgtt

SEQ ID NO: 493264 - DNA, 25 bp, Mus musculus
gagtacttgtggactctcaggagtg

SEQ ID NO: 493265 - DNA, 25 bp, Mus musculus
gagtacttgtggtctctcaggagtg

SEQ ID NO: 493266 - DNA, 25 bp, Mus musculus
gagtactttacacagaagttccact

SEQ ID NO: 493267 - DNA, 25 bp, Mus musculus
gagtactttacagagaagttccact

SEQ ID NO: 493268 - DNA, 25 bp, Mus musculus
gagtactttagtccctaaggattca

SEQ ID NO: 493269 - DNA, 25 bp, Mus musculus
gagtactttagtgcctaaggattca

SEQ ID NO: 493270 - DNA, 25 bp, Mus musculus
gagtactttatccactgaacaccct

SEQ ID NO: 493271 - DNA, 25 bp, Mus musculus
gagtactttatcgactgaacaccct

SEQ ID NO: 493272 - DNA, 25 bp, Mus musculus
gagtactttcaaagcttggtacgca

SEQ ID NO: 493273 - DNA, 25 bp, Mus musculus
gagtactttcaatgcttggtacgca

SEQ ID NO: 493274 - DNA, 25 bp, Mus musculus
gagtactttctaacctattgttaga

SEQ ID NO: 493275 - DNA, 25 bp, Mus musculus
gagtactttctatcctattgttaga

SEQ ID NO: 493276 - DNA, 25 bp, Mus musculus
gagtactttgtacctttatgagatg

SEQ ID NO: 493277 - DNA, 25 bp, Mus musculus
gagtactttgtagctttatgagatg

SEQ ID NO: 493278 - DNA, 25 bp, Mus musculus
gagtagaaaagaaagcagcccctat

SEQ ID NO: 493279 - DNA, 25 bp, Mus musculus
gagtagaaaagatagcagcccctat

SEQ ID NO: 493280 - DNA, 25 bp, Mus musculus
gagtagaagggtagacttgagtttc

SEQ ID NO: 493281 - DNA, 25 bp, Mus musculus
gagtagaagggttgacttgagtttc

SEQ ID NO: 493282 - DNA, 25 bp, Mus musculus
gagtagaatataccaacaccatctc

SEQ ID NO: 493283 - DNA, 25 bp, Mus musculus
gagtagaatatagcaacaccatctc

SEQ ID NO: 493284 - DNA, 25 bp, Mus musculus
gagtagaatattaatcaccacgtga

SEQ ID NO: 493285 - DNA, 25 bp, Mus musculus
gagtagaatatttatcaccacgtga

SEQ ID NO: 493286 - DNA, 25 bp, Mus musculus
gagtagaatcatcaagtactgccct

SEQ ID NO: 493287 - DNA, 25 bp, Mus musculus
gagtagaatcatgaagtactgccct

SEQ ID NO: 493288 - DNA, 25 bp, Mus musculus
gagtagaatgttacgaggcgtttaa

SEQ ID NO: 493289 - DNA, 25 bp, Mus musculus
gagtagaatgtttcgaggcgtttaa

SEQ ID NO: 493290 - DNA, 25 bp, Mus musculus
gagtagaattatcgcccgaaggacc

SEQ ID NO: 493291 - DNA, 25 bp, Mus musculus
gagtagaattatggcccgaaggacc

SEQ ID NO: 493292 - DNA, 25 bp, Mus musculus
gagtagacaactctttccctcgaaa

SEQ ID NO: 493293 - DNA, 25 bp, Mus musculus
gagtagacaactgtttccctcgaaa

SEQ ID NO: 493294 - DNA, 25 bp, Mus musculus
gagtagacagcgcacagatgcctct

SEQ ID NO: 493295 - DNA, 25 bp, Mus musculus
gagtagacagcggacagatgcctct

SEQ ID NO: 493296 - DNA, 25 bp, Mus musculus
gagtagacaggcagaggtcacctca

SEQ ID NO: 493297 - DNA, 25 bp, Mus musculus
gagtagacaggctgaggtcacctca

SEQ ID NO: 493298 - DNA, 25 bp, Mus musculus
gagtagacagtactggtcctcatct

SEQ ID NO: 493299 - DNA, 25 bp, Mus musculus
gagtagacagtagtggtcctcatct

SEQ ID NO: 493300 - DNA, 25 bp, Mus musculus
gagtagacatttcccactatatatt

SEQ ID NO: 493301 - DNA, 25 bp, Mus musculus
gagtagacatttgccactatatatt

SEQ ID NO: 493302 - DNA, 25 bp, Mus musculus
gagtagaccatcattcagtatctgt

SEQ ID NO: 493303 - DNA, 25 bp, Mus musculus
gagtagaccatctttcagtatctgt

SEQ ID NO: 493304 - DNA, 25 bp, Mus musculus
gagtagacttaccattttacctata

SEQ ID NO: 493305 - DNA, 25 bp, Mus musculus
gagtagacttacgattttacctata

SEQ ID NO: 493306 - DNA, 25 bp, Mus musculus
gagtagactttgatatcacagcaac

SEQ ID NO: 493307 - DNA, 25 bp, Mus musculus
gagtagactttgttatcacagcaac

SEQ ID NO: 493308 - DNA, 25 bp, Mus musculus
gagtagagagagaccctggtgtctt

SEQ ID NO: 493309 - DNA, 25 bp, Mus musculus
gagtagagagagtccctggtgtctt

SEQ ID NO: 493310 - DNA, 25 bp, Mus musculus
gagtagagagctctaccgagactta

SEQ ID NO: 493311 - DNA, 25 bp, Mus musculus
gagtagagagctgtaccgagactta

SEQ ID NO: 493312 - DNA, 25 bp, Mus musculus
gagtagagctttagatgagttgaaa

SEQ ID NO: 493313 - DNA, 25 bp, Mus musculus
gagtagagcttttgatgagttgaaa

SEQ ID NO: 493314 - DNA, 25 bp, Mus musculus
gagtagagtccaaaccagttctgtt

SEQ ID NO: 493315 - DNA, 25 bp, Mus musculus
gagtagagtccataccagttctgtt

SEQ ID NO: 493316 - DNA, 25 bp, Mus musculus
gagtagagtgataatcttacaatgt

SEQ ID NO: 493317 - DNA, 25 bp, Mus musculus
gagtagagtgattatcttacaatgt

SEQ ID NO: 493318 - DNA, 25 bp, Mus musculus
gagtagagttacacactcagtcaca

SEQ ID NO: 493319 - DNA, 25 bp, Mus musculus
gagtagagttactcactcagtcaca

SEQ ID NO: 493320 - DNA, 25 bp, Mus musculus
gagtagagttggacacctttgcctt

SEQ ID NO: 493321 - DNA, 25 bp, Mus musculus
gagtagagttggtcacctttgcctt

SEQ ID NO: 493322 - DNA, 25 bp, Mus musculus
gagtagatacacagtgccactttag

SEQ ID NO: 493323 - DNA, 25 bp, Mus musculus
gagtagatacactgtgccactttag

SEQ ID NO: 493324 - DNA, 25 bp, Mus musculus
gagtagatacagcatttccaggagc

SEQ ID NO: 493325 - DNA, 25 bp, Mus musculus
gagtagatacaggatttccaggagc

SEQ ID NO: 493326 - DNA, 25 bp, Mus musculus
gagtagatacgaattttgaggcaaa

SEQ ID NO: 493327 - DNA, 25 bp, Mus musculus
gagtagatacgatttttgaggcaaa

SEQ ID NO: 493328 - DNA, 25 bp, Mus musculus
gagtagatcccactgctgatcctga

SEQ ID NO: 493329 - DNA, 25 bp, Mus musculus
gagtagatcccagtgctgatcctga

SEQ ID NO: 493330 - DNA, 25 bp, Mus musculus
gagtagatcctgaactgttgtacat

SEQ ID NO: 493331 - DNA, 25 bp, Mus musculus
gagtagatcctgtactgttgtacat

SEQ ID NO: 493332 - DNA, 25 bp, Mus musculus
gagtagatctgtcaagcaggccctg

SEQ ID NO: 493333 - DNA, 25 bp, Mus musculus
gagtagatctgtgaagcaggccctg

SEQ ID NO: 493334 - DNA, 25 bp, Mus musculus
gagtagatgcagatgttgtcagcag

SEQ ID NO: 493335 - DNA, 25 bp, Mus musculus
gagtagatgcagttgttgtcagcag

SEQ ID NO: 493336 - DNA, 25 bp, Mus musculus
gagtagatggccaggttcactttgt

SEQ ID NO: 493337 - DNA, 25 bp, Mus musculus
gagtagatggcctggttcactttgt

SEQ ID NO: 493338 - DNA, 25 bp, Mus musculus
gagtagatgtccatagagccctcct

SEQ ID NO: 493339 - DNA, 25 bp, Mus musculus
gagtagatgtccttagagccctcct

SEQ ID NO: 493340 - DNA, 25 bp, Mus musculus
gagtagatgtgacagctatctcaat

SEQ ID NO: 493341 - DNA, 25 bp, Mus musculus
gagtagatgtgagagctatctcaat

SEQ ID NO: 493342 - DNA, 25 bp, Mus musculus
gagtagattctcaccttctaatgtg

SEQ ID NO: 493343 - DNA, 25 bp, Mus musculus
gagtagattctctccttctaatgtg

SEQ ID NO: 493344 - DNA, 25 bp, Mus musculus
gagtagattctgctcatctgtgtta

SEQ ID NO: 493345 - DNA, 25 bp, Mus musculus
gagtagattctggtcatctgtgtta

SEQ ID NO: 493346 - DNA, 25 bp, Mus musculus
gagtagatttcgaggctgcagatgt

SEQ ID NO: 493347 - DNA, 25 bp, Mus musculus
gagtagatttcgtggctgcagatgt

SEQ ID NO: 493348 - DNA, 25 bp, Mus musculus
gagtagatttgaaacctgtgggaga

SEQ ID NO: 493349 - DNA, 25 bp, Mus musculus
gagtagatttgatacctgtgggaga

SEQ ID NO: 493350 - DNA, 25 bp, Mus musculus
gagtagcaactgaaaataatgtccc

SEQ ID NO: 493351 - DNA, 25 bp, Mus musculus
gagtagcaactgtaaataatgtccc

SEQ ID NO: 493352 - DNA, 25 bp, Mus musculus
gagtagcaagccaaacaacttacta

SEQ ID NO: 493353 - DNA, 25 bp, Mus musculus
gagtagcaagcctaacaacttacta

SEQ ID NO: 493354 - DNA, 25 bp, Mus musculus
gagtagcaattgatcttaaccacaa

SEQ ID NO: 493355 - DNA, 25 bp, Mus musculus
gagtagcaattgttcttaaccacaa

SEQ ID NO: 493356 - DNA, 25 bp, Mus musculus
gagtagcacattaggcatgtcgtga

SEQ ID NO: 493357 - DNA, 25 bp, Mus musculus
gagtagcacatttggcatgtcgtga

SEQ ID NO: 493358 - DNA, 25 bp, Mus musculus
gagtagcaccatagcatttctgatt

SEQ ID NO: 493359 - DNA, 25 bp, Mus musculus
gagtagcaccattgcatttctgatt

SEQ ID NO: 493360 - DNA, 25 bp, Mus musculus
gagtagcactaccaatcttgtaagg

SEQ ID NO: 493361 - DNA, 25 bp, Mus musculus
gagtagcactacgaatcttgtaagg

SEQ ID NO: 493362 - DNA, 25 bp, Mus musculus
gagtagcagaaaaaccaccctactt

SEQ ID NO: 493363 - DNA, 25 bp, Mus musculus
gagtagcagaaataccaccctactt

SEQ ID NO: 493364 - DNA, 25 bp, Mus musculus
gagtagcagaagatcccggcctgga

SEQ ID NO: 493365 - DNA, 25 bp, Mus musculus
gagtagcagaagttcccggcctgga

SEQ ID NO: 493366 - DNA, 25 bp, Mus musculus
gagtagcagcagcatgtctaccttc

SEQ ID NO: 493367 - DNA, 25 bp, Mus musculus
gagtagcagcaggatgtctaccttc

SEQ ID NO: 493368 - DNA, 25 bp, Mus musculus
gagtagcaggcaagcagacacacag

SEQ ID NO: 493369 - DNA, 25 bp, Mus musculus
gagtagcaggcatgcagacacacag

SEQ ID NO: 493370 - DNA, 25 bp, Mus musculus
gagtagcaggcgagtgacacaccga

SEQ ID NO: 493371 - DNA, 25 bp, Mus musculus
gagtagcaggcgtgtgacacaccga

SEQ ID NO: 493372 - DNA, 25 bp, Mus musculus
gagtagcagggcactttcatcttgt

SEQ ID NO: 493373 - DNA, 25 bp, Mus musculus
gagtagcagggctctttcatcttgt

SEQ ID NO: 493374 - DNA, 25 bp, Mus musculus
gagtagcatagtcgcctttgtggaa

SEQ ID NO: 493375 - DNA, 25 bp, Mus musculus
gagtagcatagtggcctttgtggaa

SEQ ID NO: 493376 - DNA, 25 bp, Mus musculus
gagtagcatcctctctaaatcactg

SEQ ID NO: 493377 - DNA, 25 bp, Mus musculus
gagtagcatcctgtctaaatcactg

SEQ ID NO: 493378 - DNA, 25 bp, Mus musculus
gagtagcatttgcttccagctggag

SEQ ID NO: 493379 - DNA, 25 bp, Mus musculus
gagtagcatttggttccagctggag

SEQ ID NO: 493380 - DNA, 25 bp, Mus musculus
gagtagccaacactgccaaggccta

SEQ ID NO: 493381 - DNA, 25 bp, Mus musculus
gagtagccaacagtgccaaggccta

SEQ ID NO: 493382 - DNA, 25 bp, Mus musculus
gagtagccaacgagggtgcccagca

SEQ ID NO: 493383 - DNA, 25 bp, Mus musculus
gagtagccaacgtgggtgcccagca

SEQ ID NO: 493384 - DNA, 25 bp, Mus musculus
gagtagccagccattcagacgtgag

SEQ ID NO: 493385 - DNA, 25 bp, Mus musculus
gagtagccagcctttcagacgtgag

SEQ ID NO: 493386 - DNA, 25 bp, Mus musculus
gagtagccagctattctacagaagt

SEQ ID NO: 493387 - DNA, 25 bp, Mus musculus
gagtagccagcttttctacagaagt

SEQ ID NO: 493388 - DNA, 25 bp, Mus musculus
gagtagccagtgaggtttccgttct

SEQ ID NO: 493389 - DNA, 25 bp, Mus musculus
gagtagccagtgtggtttccgttct

SEQ ID NO: 493390 - DNA, 25 bp, Mus musculus
gagtagcccacccactgctgaaata

SEQ ID NO: 493391 - DNA, 25 bp, Mus musculus
gagtagcccaccgactgctgaaata

SEQ ID NO: 493392 - DNA, 25 bp, Mus musculus
gagtagccgagcatcctgcggttgt

SEQ ID NO: 493393 - DNA, 25 bp, Mus musculus
gagtagccgagcttcctgcggttgt

SEQ ID NO: 493394 - DNA, 25 bp, Mus musculus
gagtagccggaacctgacacaccta

SEQ ID NO: 493395 - DNA, 25 bp, Mus musculus
gagtagccggaagctgacacaccta

SEQ ID NO: 493396 - DNA, 25 bp, Mus musculus
gagtagcctgtgcatttgctgttat

SEQ ID NO: 493397 - DNA, 25 bp, Mus musculus
gagtagcctgtggatttgctgttat

SEQ ID NO: 493398 - DNA, 25 bp, Mus musculus
gagtagcgacgaccactggctgttc

SEQ ID NO: 493399 - DNA, 25 bp, Mus musculus
gagtagcgacgagcactggctgttc

SEQ ID NO: 493400 - DNA, 25 bp, Mus musculus
gagtagcgggtgagcagcttcttac

SEQ ID NO: 493401 - DNA, 25 bp, Mus musculus
gagtagcgggtgtgcagcttcttac

SEQ ID NO: 493402 - DNA, 25 bp, Mus musculus
gagtagcgtgctaataaagctcagg

SEQ ID NO: 493403 - DNA, 25 bp, Mus musculus
gagtagcgtgcttataaagctcagg

SEQ ID NO: 493404 - DNA, 25 bp, Mus musculus
gagtagctatacctaatcctgcagt

SEQ ID NO: 493405 - DNA, 25 bp, Mus musculus
gagtagctatacgtaatcctgcagt

SEQ ID NO: 493406 - DNA, 25 bp, Mus musculus
gagtagctcacacttacctgcaaat

SEQ ID NO: 493407 - DNA, 25 bp, Mus musculus
gagtagctcacagttacctgcaaat

SEQ ID NO: 493408 - DNA, 25 bp, Mus musculus
gagtagctcagtaccctaaaattaa

SEQ ID NO: 493409 - DNA, 25 bp, Mus musculus
gagtagctcagttccctaaaattaa

SEQ ID NO: 493410 - DNA, 25 bp, Mus musculus
gagtagctccacaggaggccaatac

SEQ ID NO: 493411 - DNA, 25 bp, Mus musculus
gagtagctccactggaggccaatac

SEQ ID NO: 493412 - DNA, 25 bp, Mus musculus
gagtagctcctgacacctctcagaa

SEQ ID NO: 493413 - DNA, 25 bp, Mus musculus
gagtagctcctgctgcttggcacat

SEQ ID NO: 493414 - DNA, 25 bp, Mus musculus
gagtagctcctggtgcttggcacat

SEQ ID NO: 493415 - DNA, 25 bp, Mus musculus
gagtagctcctgtcacctctcagaa

SEQ ID NO: 493416 - DNA, 25 bp, Mus musculus
gagtagctctcacagtcctcagaca

SEQ ID NO: 493417 - DNA, 25 bp, Mus musculus
gagtagctctcagagtcctcagaca

SEQ ID NO: 493418 - DNA, 25 bp, Mus musculus
gagtagctctgaaaaccttgctgat

SEQ ID NO: 493419 - DNA, 25 bp, Mus musculus
gagtagctctgataaccttgctgat

SEQ ID NO: 493420 - DNA, 25 bp, Mus musculus
gagtagctgactactattctcttcc

SEQ ID NO: 493421 - DNA, 25 bp, Mus musculus
gagtagctgacttctattctcttcc

SEQ ID NO: 493422 - DNA, 25 bp, Mus musculus
gagtagctgcttcctctcagatgaa

SEQ ID NO: 493423 - DNA, 25 bp, Mus musculus
gagtagctgcttgctctcagatgaa

SEQ ID NO: 493424 - DNA, 25 bp, Mus musculus
gagtagcttatcaccttaacggaaa

SEQ ID NO: 493425 - DNA, 25 bp, Mus musculus
gagtagcttatctccttaacggaaa

SEQ ID NO: 493426 - DNA, 25 bp, Mus musculus
gagtagcttgctaatcttggctgtt

SEQ ID NO: 493427 - DNA, 25 bp, Mus musculus
gagtagcttgcttatcttggctgtt

SEQ ID NO: 493428 - DNA, 25 bp, Mus musculus
gagtaggaagacacctttctccttg

SEQ ID NO: 493429 - DNA, 25 bp, Mus musculus
gagtaggaagactcctttctccttg

SEQ ID NO: 493430 - DNA, 25 bp, Mus musculus
gagtaggagaaaacgccttccctgg

SEQ ID NO: 493431 - DNA, 25 bp, Mus musculus
gagtaggagaaatcgccttccctgg

SEQ ID NO: 493432 - DNA, 25 bp, Mus musculus
gagtaggagaccattattcgaccta

SEQ ID NO: 493433 - DNA, 25 bp, Mus musculus
gagtaggagacctttattcgaccta

SEQ ID NO: 493434 - DNA, 25 bp, Mus musculus
gagtaggatgccaccaggacatgta

SEQ ID NO: 493435 - DNA, 25 bp, Mus musculus
gagtaggatgcctccaggacatgta

SEQ ID NO: 493436 - DNA, 25 bp, Mus musculus
gagtaggattctaatcaatcgtcgc

SEQ ID NO: 493437 - DNA, 25 bp, Mus musculus
gagtaggattcttatcaatcgtcgc

SEQ ID NO: 493438 - DNA, 25 bp, Mus musculus
gagtaggattgcatcgttcactaaa

SEQ ID NO: 493439 - DNA, 25 bp, Mus musculus
gagtaggattgcttcgttcactaaa

SEQ ID NO: 493440 - DNA, 25 bp, Mus musculus
gagtaggcagctactacaccagtgt

SEQ ID NO: 493441 - DNA, 25 bp, Mus musculus
gagtaggcagcttctacaccagtgt

SEQ ID NO: 493442 - DNA, 25 bp, Mus musculus
gagtaggcatgcactaaaggttgaa

SEQ ID NO: 493443 - DNA, 25 bp, Mus musculus
gagtaggcatgctctaaaggttgaa

SEQ ID NO: 493444 - DNA, 25 bp, Mus musculus
gagtaggccaaactaatttctgtaa

SEQ ID NO: 493445 - DNA, 25 bp, Mus musculus
gagtaggccaaagtaatttctgtaa

SEQ ID NO: 493446 - DNA, 25 bp, Mus musculus
gagtaggccatgacaaacacttgct

SEQ ID NO: 493447 - DNA, 25 bp, Mus musculus
gagtaggccatgtcaaacacttgct

SEQ ID NO: 493448 - DNA, 25 bp, Mus musculus
gagtaggctgataccgggaactctt

SEQ ID NO: 493449 - DNA, 25 bp, Mus musculus
gagtaggctgattccgggaactctt

SEQ ID NO: 493450 - DNA, 25 bp, Mus musculus
gagtaggctggcagcatcctaagga

SEQ ID NO: 493451 - DNA, 25 bp, Mus musculus
gagtaggctggctgcatcctaagga

SEQ ID NO: 493452 - DNA, 25 bp, Mus musculus
gagtaggctgggactaacttcagtt

SEQ ID NO: 493453 - DNA, 25 bp, Mus musculus
gagtaggctgggtctaacttcagtt

SEQ ID NO: 493454 - DNA, 25 bp, Mus musculus
gagtaggcttggctctagaattcta

SEQ ID NO: 493455 - DNA, 25 bp, Mus musculus
gagtaggcttgggtctagaattcta

SEQ ID NO: 493456 - DNA, 25 bp, Mus musculus
gagtagggaatacacctgaaaccag

SEQ ID NO: 493457 - DNA, 25 bp, Mus musculus
gagtagggaatagacctgaaaccag

SEQ ID NO: 493458 - DNA, 25 bp, Mus musculus
gagtagggagtaactgaccaaaata

SEQ ID NO: 493459 - DNA, 25 bp, Mus musculus
gagtagggagtatctgaccaaaata

SEQ ID NO: 493460 - DNA, 25 bp, Mus musculus
gagtagggcctgatcttttggagta

SEQ ID NO: 493461 - DNA, 25 bp, Mus musculus
gagtagggcctgttcttttggagta

SEQ ID NO: 493462 - DNA, 25 bp, Mus musculus
gagtaggtagcgattctcacccggg

SEQ ID NO: 493463 - DNA, 25 bp, Mus musculus
gagtaggtagcgtttctcacccggg

SEQ ID NO: 493464 - DNA, 25 bp, Mus musculus
gagtaggtatatcccctgtgtttcc

SEQ ID NO: 493465 - DNA, 25 bp, Mus musculus
gagtaggtatatgccctgtgtttcc

SEQ ID NO: 493466 - DNA, 25 bp, Mus musculus
gagtaggtcacactctccagagaaa

SEQ ID NO: 493467 - DNA, 25 bp, Mus musculus
gagtaggtcacagtctccagagaaa

SEQ ID NO: 493468 - DNA, 25 bp, Mus musculus
gagtaggtcatacctgtgcattttt

SEQ ID NO: 493469 - DNA, 25 bp, Mus musculus
gagtaggtcatagctgtgcattttt

SEQ ID NO: 493470 - DNA, 25 bp, Mus musculus
gagtaggtgacgacatcctgcttgt

SEQ ID NO: 493471 - DNA, 25 bp, Mus musculus
gagtaggtgacgtcatcctgcttgt

SEQ ID NO: 493472 - DNA, 25 bp, Mus musculus
gagtaggtgcttcaaccacacagct

SEQ ID NO: 493473 - DNA, 25 bp, Mus musculus
gagtaggtgcttgaaccacacagct

SEQ ID NO: 493474 - DNA, 25 bp, Mus musculus
gagtaggtggtaatcaagaagcccc

SEQ ID NO: 493475 - DNA, 25 bp, Mus musculus
gagtaggtggtattcaagaagcccc

SEQ ID NO: 493476 - DNA, 25 bp, Mus musculus
gagtaggtgttcatctatgtgcata

SEQ ID NO: 493477 - DNA, 25 bp, Mus musculus
gagtaggtgttcttctatgtgcata

SEQ ID NO: 493478 - DNA, 25 bp, Mus musculus
gagtaggttcatcgctctgtgtcac

SEQ ID NO: 493479 - DNA, 25 bp, Mus musculus
gagtaggttcatggctctgtgtcac

SEQ ID NO: 493480 - DNA, 25 bp, Mus musculus
gagtaggttcttcgtacttaggact

SEQ ID NO: 493481 - DNA, 25 bp, Mus musculus
gagtaggttcttggtacttaggact

SEQ ID NO: 493482 - DNA, 25 bp, Mus musculus
gagtagtaactgaactgtagctatc

SEQ ID NO: 493483 - DNA, 25 bp, Mus musculus
gagtagtaactgtactgtagctatc

SEQ ID NO: 493484 - DNA, 25 bp, Mus musculus
gagtagtaagccaggctctagccaa

SEQ ID NO: 493485 - DNA, 25 bp, Mus musculus
gagtagtaagcctggctctagccaa

SEQ ID NO: 493486 - DNA, 25 bp, Mus musculus
gagtagtaagtcaccctacacttcc

SEQ ID NO: 493487 - DNA, 25 bp, Mus musculus
gagtagtaagtctccctacacttcc

SEQ ID NO: 493488 - DNA, 25 bp, Mus musculus
gagtagtaattcctttctagttgtt

SEQ ID NO: 493489 - DNA, 25 bp, Mus musculus
gagtagtaattcgtttctagttgtt

SEQ ID NO: 493490 - DNA, 25 bp, Mus musculus
gagtagtactatcgttgacctgtga

SEQ ID NO: 493491 - DNA, 25 bp, Mus musculus
gagtagtactatggttgacctgtga

SEQ ID NO: 493492 - DNA, 25 bp, Mus musculus
gagtagtagtcacctgcaagtctcc

SEQ ID NO: 493493 - DNA, 25 bp, Mus musculus
gagtagtagtcagctgcaagtctcc

SEQ ID NO: 493494 - DNA, 25 bp, Mus musculus
gagtagtagttcattggattcctgt

SEQ ID NO: 493495 - DNA, 25 bp, Mus musculus
gagtagtagttctttggattcctgt

SEQ ID NO: 493496 - DNA, 25 bp, Mus musculus
gagtagtattctcccacaggactgt

SEQ ID NO: 493497 - DNA, 25 bp, Mus musculus
gagtagtattctgccacaggactgt

SEQ ID NO: 493498 - DNA, 25 bp, Mus musculus
gagtagtcacccatgtacagagcta

SEQ ID NO: 493499 - DNA, 25 bp, Mus musculus
gagtagtcacccttgtacagagcta

SEQ ID NO: 493500 - DNA, 25 bp, Mus musculus
gagtagtcactcaggatcaccgaga

SEQ ID NO: 493501 - DNA, 25 bp, Mus musculus
gagtagtcactctggatcaccgaga

SEQ ID NO: 493502 - DNA, 25 bp, Mus musculus
gagtagtcaggtatttcatttacaa

SEQ ID NO: 493503 - DNA, 25 bp, Mus musculus
gagtagtcaggtttttcatttacaa

SEQ ID NO: 493504 - DNA, 25 bp, Mus musculus
gagtagtcattgataagactgtatt

SEQ ID NO: 493505 - DNA, 25 bp, Mus musculus
gagtagtcattgttaagactgtatt

SEQ ID NO: 493506 - DNA, 25 bp, Mus musculus
gagtagtctctaaacttggccttaa

SEQ ID NO: 493507 - DNA, 25 bp, Mus musculus
gagtagtctctaacattattcaaat

SEQ ID NO: 493508 - DNA, 25 bp, Mus musculus
gagtagtctctatacttggccttaa

SEQ ID NO: 493509 - DNA, 25 bp, Mus musculus
gagtagtctctatcattattcaaat

SEQ ID NO: 493510 - DNA, 25 bp, Mus musculus
gagtagtcttcgcaggcctctgaat

SEQ ID NO: 493511 - DNA, 25 bp, Mus musculus
gagtagtcttcggaggcctctgaat

SEQ ID NO: 493512 - DNA, 25 bp, Mus musculus
gagtagtctttaatcacagtacatt

SEQ ID NO: 493513 - DNA, 25 bp, Mus musculus
gagtagtctttattcacagtacatt

SEQ ID NO: 493514 - DNA, 25 bp, Mus musculus
gagtagtctttcacaatgtctcttg

SEQ ID NO: 493515 - DNA, 25 bp, Mus musculus
gagtagtctttctcaatgtctcttg

SEQ ID NO: 493516 - DNA, 25 bp, Mus musculus
gagtagtgaactccggaagcacaaa

SEQ ID NO: 493517 - DNA, 25 bp, Mus musculus
gagtagtgaactgcggaagcacaaa

SEQ ID NO: 493518 - DNA, 25 bp, Mus musculus
gagtagtgctcaatataaatagcta

SEQ ID NO: 493519 - DNA, 25 bp, Mus musculus
gagtagtgctcattataaatagcta

SEQ ID NO: 493520 - DNA, 25 bp, Mus musculus
gagtagtggctcatgtctataatcc

SEQ ID NO: 493521 - DNA, 25 bp, Mus musculus
gagtagtggctcttgtctataatcc

SEQ ID NO: 493522 - DNA, 25 bp, Mus musculus
gagtagtgtttgcttcagcaggagg

SEQ ID NO: 493523 - DNA, 25 bp, Mus musculus
gagtagtgtttggttcagcaggagg

SEQ ID NO: 493524 - DNA, 25 bp, Mus musculus
gagtagttacccatttatctgtcat

SEQ ID NO: 493525 - DNA, 25 bp, Mus musculus
gagtagttacccttttatctgtcat

SEQ ID NO: 493526 - DNA, 25 bp, Mus musculus
gagtagttagccaccagagctttat

SEQ ID NO: 493527 - DNA, 25 bp, Mus musculus
gagtagttagcctccagagctttat

SEQ ID NO: 493528 - DNA, 25 bp, Mus musculus
gagtagttatgtcatccattcacag

SEQ ID NO: 493529 - DNA, 25 bp, Mus musculus
gagtagttatgtgatccattcacag

SEQ ID NO: 493530 - DNA, 25 bp, Mus musculus
gagtagttcatcagacactgacatg

SEQ ID NO: 493531 - DNA, 25 bp, Mus musculus
gagtagttcatctgacactgacatg

SEQ ID NO: 493532 - DNA, 25 bp, Mus musculus
gagtagttcctaccactttatggga

SEQ ID NO: 493533 - DNA, 25 bp, Mus musculus
gagtagttcctagcactttatggga

SEQ ID NO: 493534 - DNA, 25 bp, Mus musculus
gagtagttcctcatttaattccaaa

SEQ ID NO: 493535 - DNA, 25 bp, Mus musculus
gagtagttcctcttttaattccaaa

SEQ ID NO: 493536 - DNA, 25 bp, Mus musculus
gagtagttcgacaggagtgcttatt

SEQ ID NO: 493537 - DNA, 25 bp, Mus musculus
gagtagttcgactggagtgcttatt

SEQ ID NO: 493538 - DNA, 25 bp, Mus musculus
gagtagttgattattgcacgcttct

SEQ ID NO: 493539 - DNA, 25 bp, Mus musculus
gagtagttgatttttgcacgcttct

SEQ ID NO: 493540 - DNA, 25 bp, Mus musculus
gagtagttggtgctttaacccctga

SEQ ID NO: 493541 - DNA, 25 bp, Mus musculus
gagtagttggtggtttaacccctga

SEQ ID NO: 493542 - DNA, 25 bp, Mus musculus
gagtagtttcaaccatacatgccct

SEQ ID NO: 493543 - DNA, 25 bp, Mus musculus
gagtagtttcaagcatacatgccct

SEQ ID NO: 493544 - DNA, 25 bp, Mus musculus
gagtagtttcttctccctaaattat

SEQ ID NO: 493545 - DNA, 25 bp, Mus musculus
gagtagtttcttgtccctaaattat

SEQ ID NO: 493546 - DNA, 25 bp, Mus musculus
gagtataaaaacctccagctcaggg

SEQ ID NO: 493547 - DNA, 25 bp, Mus musculus
gagtataaaaacgtccagctcaggg

SEQ ID NO: 493548 - DNA, 25 bp, Mus musculus
gagtataaacctcggaacccctctg

SEQ ID NO: 493549 - DNA, 25 bp, Mus musculus
gagtataaacctgggaacccctctg

SEQ ID NO: 493550 - DNA, 25 bp, Mus musculus
gagtataaacttcgcaatgcttagg

SEQ ID NO: 493551 - DNA, 25 bp, Mus musculus
gagtataaacttggcaatgcttagg

SEQ ID NO: 493552 - DNA, 25 bp, Mus musculus
gagtataaccgaaatctgccttccg

SEQ ID NO: 493553 - DNA, 25 bp, Mus musculus
gagtataaccgatatctgccttccg

SEQ ID NO: 493554 - DNA, 25 bp, Mus musculus
gagtataactctaggctctgtcaag

SEQ ID NO: 493555 - DNA, 25 bp, Mus musculus
gagtataactcttggctctgtcaag

SEQ ID NO: 493556 - DNA, 25 bp, Mus musculus
gagtataagctgacttcataccggg

SEQ ID NO: 493557 - DNA, 25 bp, Mus musculus
gagtataagctgtcttcataccggg

SEQ ID NO: 493558 - DNA, 25 bp, Mus musculus
gagtataatcaccaacgtgtgcatg

SEQ ID NO: 493559 - DNA, 25 bp, Mus musculus
gagtataatcacgaacgtgtgcatg

SEQ ID NO: 493560 - DNA, 25 bp, Mus musculus
gagtataatcccactgacagcccaa

SEQ ID NO: 493561 - DNA, 25 bp, Mus musculus
gagtataatccctctgacagcccaa

SEQ ID NO: 493562 - DNA, 25 bp, Mus musculus
gagtatacaacaaacccacatcctg

SEQ ID NO: 493563 - DNA, 25 bp, Mus musculus
gagtatacaacatacccacatcctg

SEQ ID NO: 493564 - DNA, 25 bp, Mus musculus
gagtatacacatctcattagctatc

SEQ ID NO: 493565 - DNA, 25 bp, Mus musculus
gagtatacacatgtcattagctatc

SEQ ID NO: 493566 - DNA, 25 bp, Mus musculus
gagtatacagctatattcaggctaa

SEQ ID NO: 493567 - DNA, 25 bp, Mus musculus
gagtatacagctttattcaggctaa

SEQ ID NO: 493568 - DNA, 25 bp, Mus musculus
gagtatacagttccatgtgcccatc

SEQ ID NO: 493569 - DNA, 25 bp, Mus musculus
gagtatacagttgcatgtgcccatc

SEQ ID NO: 493570 - DNA, 25 bp, Mus musculus
gagtatactaccacctttaagataa

SEQ ID NO: 493571 - DNA, 25 bp, Mus musculus
gagtatactacctcctttaagataa

SEQ ID NO: 493572 - DNA, 25 bp, Mus musculus
gagtatactcgcagttgattttcaa

SEQ ID NO: 493573 - DNA, 25 bp, Mus musculus
gagtatactcgctgttgattttcaa

SEQ ID NO: 493574 - DNA, 25 bp, Mus musculus
gagtatactcttcaacagccaccag

SEQ ID NO: 493575 - DNA, 25 bp, Mus musculus
gagtatactcttgaacagccaccag

SEQ ID NO: 493576 - DNA, 25 bp, Mus musculus
gagtatacttatatttcatcattta

SEQ ID NO: 493577 - DNA, 25 bp, Mus musculus
gagtatacttatttttcatcattta

SEQ ID NO: 493578 - DNA, 25 bp, Mus musculus
gagtatactttgacatttgctagaa

SEQ ID NO: 493579 - DNA, 25 bp, Mus musculus
gagtatactttgtcatttgctagaa

SEQ ID NO: 493580 - DNA, 25 bp, Mus musculus
gagtatagaacccactatggataat

SEQ ID NO: 493581 - DNA, 25 bp, Mus musculus
gagtatagaaccgactatggataat

SEQ ID NO: 493582 - DNA, 25 bp, Mus musculus
gagtatagcattattgtggaatatc

SEQ ID NO: 493583 - DNA, 25 bp, Mus musculus
gagtatagcatttttgtggaatatc

SEQ ID NO: 493584 - DNA, 25 bp, Mus musculus
gagtatagccatcagtccagggaca

SEQ ID NO: 493585 - DNA, 25 bp, Mus musculus
gagtatagccatgagtccagggaca

SEQ ID NO: 493586 - DNA, 25 bp, Mus musculus
gagtataggaacagctggctttcca

SEQ ID NO: 493587 - DNA, 25 bp, Mus musculus
gagtataggaactgctggctttcca

SEQ ID NO: 493588 - DNA, 25 bp, Mus musculus
gagtataggagtctgtcctcgtcgc

SEQ ID NO: 493589 - DNA, 25 bp, Mus musculus
gagtataggagtgtgtcctcgtcgc

SEQ ID NO: 493590 - DNA, 25 bp, Mus musculus
gagtatatacggacagtcacgtttt

SEQ ID NO: 493591 - DNA, 25 bp, Mus musculus
gagtatatacggtcagtcacgtttt

SEQ ID NO: 493592 - DNA, 25 bp, Mus musculus
gagtatatactgcattgtttcatag

SEQ ID NO: 493593 - DNA, 25 bp, Mus musculus
gagtatatactggattgtttcatag

SEQ ID NO: 493594 - DNA, 25 bp, Mus musculus
gagtatatcaacaagcctatggcat

SEQ ID NO: 493595 - DNA, 25 bp, Mus musculus
gagtatatcaactagcctatggcat

SEQ ID NO: 493596 - DNA, 25 bp, Mus musculus
gagtatatcatgaaaatacgcacat

SEQ ID NO: 493597 - DNA, 25 bp, Mus musculus
gagtatatcatgtaaatacgcacat

SEQ ID NO: 493598 - DNA, 25 bp, Mus musculus
gagtatatctaaataggccgggcag

SEQ ID NO: 493599 - DNA, 25 bp, Mus musculus
gagtatatctaattaggccgggcag

SEQ ID NO: 493600 - DNA, 25 bp, Mus musculus
gagtatatctacctaaattaatgag

SEQ ID NO: 493601 - DNA, 25 bp, Mus musculus
gagtatatctacgtaaattaatgag

SEQ ID NO: 493602 - DNA, 25 bp, Mus musculus
gagtatatctgccaatagacttgac

SEQ ID NO: 493603 - DNA, 25 bp, Mus musculus
gagtatatctgcgaatagacttgac

SEQ ID NO: 493604 - DNA, 25 bp, Mus musculus
gagtatattcataagacgggcttaa

SEQ ID NO: 493605 - DNA, 25 bp, Mus musculus
gagtatattcattagacgggcttaa

SEQ ID NO: 493606 - DNA, 25 bp, Mus musculus
gagtatatttttaatccaggaggca

SEQ ID NO: 493607 - DNA, 25 bp, Mus musculus
gagtatattttttatccaggaggca

SEQ ID NO: 493608 - DNA, 25 bp, Mus musculus
gagtatcaaactctgtcactggaca

SEQ ID NO: 493609 - DNA, 25 bp, Mus musculus
gagtatcaaactgtgtcactggaca

SEQ ID NO: 493610 - DNA, 25 bp, Mus musculus
gagtatcaacaacagcaagcagttc

SEQ ID NO: 493611 - DNA, 25 bp, Mus musculus
gagtatcaacaagagcaagcagttc

SEQ ID NO: 493612 - DNA, 25 bp, Mus musculus
gagtatcaccatatacaccagggcc

SEQ ID NO: 493613 - DNA, 25 bp, Mus musculus
gagtatcaccatttacaccagggcc

SEQ ID NO: 493614 - DNA, 25 bp, Mus musculus
gagtatcaccttcagatagcctaac

SEQ ID NO: 493615 - DNA, 25 bp, Mus musculus
gagtatcaccttgagatagcctaac

SEQ ID NO: 493616 - DNA, 25 bp, Mus musculus
gagtatcactccagcatgattgcag

SEQ ID NO: 493617 - DNA, 25 bp, Mus musculus
gagtatcactcctgcatgattgcag

SEQ ID NO: 493618 - DNA, 25 bp, Mus musculus
gagtatcactgtactgaagctaaaa

SEQ ID NO: 493619 - DNA, 25 bp, Mus musculus
gagtatcactgttctgaagctaaaa

SEQ ID NO: 493620 - DNA, 25 bp, Mus musculus
gagtatcagaagatctttccttcaa

SEQ ID NO: 493621 - DNA, 25 bp, Mus musculus
gagtatcagaagttctttccttcaa

SEQ ID NO: 493622 - DNA, 25 bp, Mus musculus
gagtatcagaatctctcaacaagaa

SEQ ID NO: 493623 - DNA, 25 bp, Mus musculus
gagtatcagaatgtctcaacaagaa

SEQ ID NO: 493624 - DNA, 25 bp, Mus musculus
gagtatcagggacagtacccttccc

SEQ ID NO: 493625 - DNA, 25 bp, Mus musculus
gagtatcagggagagtacccttccc

SEQ ID NO: 493626 - DNA, 25 bp, Mus musculus
gagtatcagtccaactctctaatcc

SEQ ID NO: 493627 - DNA, 25 bp, Mus musculus
gagtatcagtcctactctctaatcc

SEQ ID NO: 493628 - DNA, 25 bp, Mus musculus
gagtatcataacaaccaatggtaca

SEQ ID NO: 493629 - DNA, 25 bp, Mus musculus
gagtatcataactaccaatggtaca

SEQ ID NO: 493630 - DNA, 25 bp, Mus musculus
gagtatcatggactgcgccacagga

SEQ ID NO: 493631 - DNA, 25 bp, Mus musculus
gagtatcatggagtgcgccacagga

SEQ ID NO: 493632 - DNA, 25 bp, Mus musculus
gagtatcatgtgctgtttaatcttg

SEQ ID NO: 493633 - DNA, 25 bp, Mus musculus
gagtatcatgtggtgtttaatcttg

SEQ ID NO: 493634 - DNA, 25 bp, Mus musculus
gagtatccactacgcgctcatgggt

SEQ ID NO: 493635 - DNA, 25 bp, Mus musculus
gagtatccactaggcgctcatgggt

SEQ ID NO: 493636 - DNA, 25 bp, Mus musculus
gagtatccagcgcatggtagtcctc

SEQ ID NO: 493637 - DNA, 25 bp, Mus musculus
gagtatccagcggatggtagtcctc

SEQ ID NO: 493638 - DNA, 25 bp, Mus musculus
gagtatccatagacagtatggccat

SEQ ID NO: 493639 - DNA, 25 bp, Mus musculus
gagtatccatagtcagtatggccat

SEQ ID NO: 493640 - DNA, 25 bp, Mus musculus
gagtatcccaatcagagcagattca

SEQ ID NO: 493641 - DNA, 25 bp, Mus musculus
gagtatcccaatgagagcagattca

SEQ ID NO: 493642 - DNA, 25 bp, Mus musculus
gagtatcccagaagtaaagacacaa

SEQ ID NO: 493643 - DNA, 25 bp, Mus musculus
gagtatcccagatgtaaagacacaa

SEQ ID NO: 493644 - DNA, 25 bp, Mus musculus
gagtatccctacacgttgttatgtt

SEQ ID NO: 493645 - DNA, 25 bp, Mus musculus
gagtatccctactcgttgttatgtt

SEQ ID NO: 493646 - DNA, 25 bp, Mus musculus
gagtatcccttacctaaatatgtgg

SEQ ID NO: 493647 - DNA, 25 bp, Mus musculus
gagtatcccttagctaaatatgtgg

SEQ ID NO: 493648 - DNA, 25 bp, Mus musculus
gagtatcccttgaattggaatgttc

SEQ ID NO: 493649 - DNA, 25 bp, Mus musculus
gagtatcccttgtattggaatgttc

SEQ ID NO: 493650 - DNA, 25 bp, Mus musculus
gagtatccgagaatccttctgtaaa

SEQ ID NO: 493651 - DNA, 25 bp, Mus musculus
gagtatccgagattccttctgtaaa

SEQ ID NO: 493652 - DNA, 25 bp, Mus musculus
gagtatcctcagacatacatgcagt

SEQ ID NO: 493653 - DNA, 25 bp, Mus musculus
gagtatcctcagtcatacatgcagt

SEQ ID NO: 493654 - DNA, 25 bp, Mus musculus
gagtatcctcctctgaaaagacgta

SEQ ID NO: 493655 - DNA, 25 bp, Mus musculus
gagtatcctcctgtgaaaagacgta

SEQ ID NO: 493656 - DNA, 25 bp, Mus musculus
gagtatcctgagactgttgttcgac

SEQ ID NO: 493657 - DNA, 25 bp, Mus musculus
gagtatcctgagtctgttgttcgac

SEQ ID NO: 493658 - DNA, 25 bp, Mus musculus
gagtatcctggaacatctcgatcct

SEQ ID NO: 493659 - DNA, 25 bp, Mus musculus
gagtatcctggatcatctcgatcct

SEQ ID NO: 493660 - DNA, 25 bp, Mus musculus
gagtatccttgaatgctgggtgtct

SEQ ID NO: 493661 - DNA, 25 bp, Mus musculus
gagtatccttgattgctgggtgtct

SEQ ID NO: 493662 - DNA, 25 bp, Mus musculus
gagtatcgttgtcatttctaccagc

SEQ ID NO: 493663 - DNA, 25 bp, Mus musculus
gagtatcgttgtgatttctaccagc

SEQ ID NO: 493664 - DNA, 25 bp, Mus musculus
gagtatctacctacatctatgaatg

SEQ ID NO: 493665 - DNA, 25 bp, Mus musculus
gagtatctaccttcatctatgaatg

SEQ ID NO: 493666 - DNA, 25 bp, Mus musculus
gagtatctagtcataggtatgcaat

SEQ ID NO: 493667 - DNA, 25 bp, Mus musculus
gagtatctagtcttaggtatgcaat

SEQ ID NO: 493668 - DNA, 25 bp, Mus musculus
gagtatctatgaactatcacgtgta

SEQ ID NO: 493669 - DNA, 25 bp, Mus musculus
gagtatctatgatctatcacgtgta

SEQ ID NO: 493670 - DNA, 25 bp, Mus musculus
gagtatctattgcttttctggtaca

SEQ ID NO: 493671 - DNA, 25 bp, Mus musculus
gagtatctattggttttctggtaca

SEQ ID NO: 493672 - DNA, 25 bp, Mus musculus
gagtatctcaaaatcaggtcagcct

SEQ ID NO: 493673 - DNA, 25 bp, Mus musculus
gagtatctcaaattcaggtcagcct

SEQ ID NO: 493674 - DNA, 25 bp, Mus musculus
gagtatctccagactatgtggcact

SEQ ID NO: 493675 - DNA, 25 bp, Mus musculus
gagtatctccagtctatgtggcact

SEQ ID NO: 493676 - DNA, 25 bp, Mus musculus
gagtatctccgtctctgagaggtca

SEQ ID NO: 493677 - DNA, 25 bp, Mus musculus
gagtatctccgtgtctgagaggtca

SEQ ID NO: 493678 - DNA, 25 bp, Mus musculus
gagtatctctcacttgattcctgtg

SEQ ID NO: 493679 - DNA, 25 bp, Mus musculus
gagtatctctcagttgattcctgtg

SEQ ID NO: 493680 - DNA, 25 bp, Mus musculus
gagtatctgcgtcggaagccagcta

SEQ ID NO: 493681 - DNA, 25 bp, Mus musculus
gagtatctgcgtgggaagccagcta

SEQ ID NO: 493682 - DNA, 25 bp, Mus musculus
gagtatctgctgattaaatcaaaat

SEQ ID NO: 493683 - DNA, 25 bp, Mus musculus
gagtatctgctgtttaaatcaaaat

SEQ ID NO: 493684 - DNA, 25 bp, Mus musculus
gagtatctgtccctgatttattact

SEQ ID NO: 493685 - DNA, 25 bp, Mus musculus
gagtatctgtccgtgatttattact

SEQ ID NO: 493686 - DNA, 25 bp, Mus musculus
gagtatcttgaccacctggcaccat

SEQ ID NO: 493687 - DNA, 25 bp, Mus musculus
gagtatcttgacgacctggcaccat

SEQ ID NO: 493688 - DNA, 25 bp, Mus musculus
gagtatcttgtgagtgcatgtagtg

SEQ ID NO: 493689 - DNA, 25 bp, Mus musculus
gagtatcttgtgtgtgcatgtagtg

SEQ ID NO: 493690 - DNA, 25 bp, Mus musculus
gagtatctttctactaatccagccc

SEQ ID NO: 493691 - DNA, 25 bp, Mus musculus
gagtatctttcttctaatccagccc

SEQ ID NO: 493692 - DNA, 25 bp, Mus musculus
gagtatctttgccatgtctacgtcc

SEQ ID NO: 493693 - DNA, 25 bp, Mus musculus
gagtatctttgcgatgtctacgtcc

SEQ ID NO: 493694 - DNA, 25 bp, Mus musculus
gagtatgaacgactacaagcgaagc

SEQ ID NO: 493695 - DNA, 25 bp, Mus musculus
gagtatgaacgagtacaagcgaagc

SEQ ID NO: 493696 - DNA, 25 bp, Mus musculus
gagtatgacgatattgctttggctt

SEQ ID NO: 493697 - DNA, 25 bp, Mus musculus
gagtatgacgattttgctttggctt

SEQ ID NO: 493698 - DNA, 25 bp, Mus musculus
gagtatgacgtgactccggagacca

SEQ ID NO: 493699 - DNA, 25 bp, Mus musculus
gagtatgacgtgtctccggagacca

SEQ ID NO: 493700 - DNA, 25 bp, Mus musculus
gagtatgactatccgtagcccaagg

SEQ ID NO: 493701 - DNA, 25 bp, Mus musculus
gagtatgactatgcgtagcccaagg

SEQ ID NO: 493702 - DNA, 25 bp, Mus musculus
gagtatgagcctaattagactgtta

SEQ ID NO: 493703 - DNA, 25 bp, Mus musculus
gagtatgagccttattagactgtta

SEQ ID NO: 493704 - DNA, 25 bp, Mus musculus
gagtatgagctaacttttctacatt

SEQ ID NO: 493705 - DNA, 25 bp, Mus musculus
gagtatgagctatcttttctacatt

SEQ ID NO: 493706 - DNA, 25 bp, Mus musculus
gagtatgaggccacagccgctggtc

SEQ ID NO: 493707 - DNA, 25 bp, Mus musculus
gagtatgaggcctcagccgctggtc

SEQ ID NO: 493708 - DNA, 25 bp, Mus musculus
gagtatgagggcaccctttctagtt

SEQ ID NO: 493709 - DNA, 25 bp, Mus musculus
gagtatgagggctccctttctagtt

SEQ ID NO: 493710 - DNA, 25 bp, Mus musculus
gagtatgataccacaaataaatgtt

SEQ ID NO: 493711 - DNA, 25 bp, Mus musculus
gagtatgatacctcaaataaatgtt

SEQ ID NO: 493712 - DNA, 25 bp, Mus musculus
gagtatgatgaaaatgcccagctag

SEQ ID NO: 493713 - DNA, 25 bp, Mus musculus
gagtatgatgaatatgcccagctag

SEQ ID NO: 493714 - DNA, 25 bp, Mus musculus
gagtatgatgatcgcaccccagcta

SEQ ID NO: 493715 - DNA, 25 bp, Mus musculus
gagtatgatgatggcaccccagcta

SEQ ID NO: 493716 - DNA, 25 bp, Mus musculus
gagtatgcaaatacccctgggaggt

SEQ ID NO: 493717 - DNA, 25 bp, Mus musculus
gagtatgcaaattcccctgggaggt

SEQ ID NO: 493718 - DNA, 25 bp, Mus musculus
gagtatgcaactaacttggcctctt

SEQ ID NO: 493719 - DNA, 25 bp, Mus musculus
gagtatgcaacttacttggcctctt

SEQ ID NO: 493720 - DNA, 25 bp, Mus musculus
gagtatgcacacatttagcttgctt

SEQ ID NO: 493721 - DNA, 25 bp, Mus musculus
gagtatgcacacttttagcttgctt

SEQ ID NO: 493722 - DNA, 25 bp, Mus musculus
gagtatgcagaaatccgagtcaagt

SEQ ID NO: 493723 - DNA, 25 bp, Mus musculus
gagtatgcagaattccgagtcaagt

SEQ ID NO: 493724 - DNA, 25 bp, Mus musculus
gagtatgcatctcactgcttagtgt

SEQ ID NO: 493725 - DNA, 25 bp, Mus musculus
gagtatgcatctgactgcttagtgt

SEQ ID NO: 493726 - DNA, 25 bp, Mus musculus
gagtatgcatgcctcttgattttac

SEQ ID NO: 493727 - DNA, 25 bp, Mus musculus
gagtatgcatgcgtcttgattttac

SEQ ID NO: 493728 - DNA, 25 bp, Mus musculus
gagtatgccagtatcttattgttaa

SEQ ID NO: 493729 - DNA, 25 bp, Mus musculus
gagtatgccagtatgacttgaaata

SEQ ID NO: 493730 - DNA, 25 bp, Mus musculus
gagtatgccagtttcttattgttaa

SEQ ID NO: 493731 - DNA, 25 bp, Mus musculus
gagtatgccagtttgacttgaaata

SEQ ID NO: 493732 - DNA, 25 bp, Mus musculus
gagtatgccatccagagcaagcgat

SEQ ID NO: 493733 - DNA, 25 bp, Mus musculus
gagtatgccatcgagagcaagcgat

SEQ ID NO: 493734 - DNA, 25 bp, Mus musculus
gagtatgccctgaaaatcatcaaga

SEQ ID NO: 493735 - DNA, 25 bp, Mus musculus
gagtatgccctgtaaatcatcaaga

SEQ ID NO: 493736 - DNA, 25 bp, Mus musculus
gagtatgccgctcgctgcaagaagc

SEQ ID NO: 493737 - DNA, 25 bp, Mus musculus
gagtatgccgctggctgcaagaagc

SEQ ID NO: 493738 - DNA, 25 bp, Mus musculus
gagtatgcctttcgtatctatgatt

SEQ ID NO: 493739 - DNA, 25 bp, Mus musculus
gagtatgcctttggtatctatgatt

SEQ ID NO: 493740 - DNA, 25 bp, Mus musculus
gagtatgcgtagctttctgtgttcc

SEQ ID NO: 493741 - DNA, 25 bp, Mus musculus
gagtatgcgtaggtttctgtgttcc

SEQ ID NO: 493742 - DNA, 25 bp, Mus musculus
gagtatgctcaacattcaggtccat

SEQ ID NO: 493743 - DNA, 25 bp, Mus musculus
gagtatgctcaagattcaggtccat

SEQ ID NO: 493744 - DNA, 25 bp, Mus musculus
gagtatgctcctcttcttggctcct

SEQ ID NO: 493745 - DNA, 25 bp, Mus musculus
gagtatgctcctgttcttggctcct

SEQ ID NO: 493746 - DNA, 25 bp, Mus musculus
gagtatgctctcaatatatcctgta

SEQ ID NO: 493747 - DNA, 25 bp, Mus musculus
gagtatgctctctatatatcctgta

SEQ ID NO: 493748 - DNA, 25 bp, Mus musculus
gagtatgctttcacggagggaaata

SEQ ID NO: 493749 - DNA, 25 bp, Mus musculus
gagtatgctttctcggagggaaata

SEQ ID NO: 493750 - DNA, 25 bp, Mus musculus
gagtatggaacactcactgagacac

SEQ ID NO: 493751 - DNA, 25 bp, Mus musculus
gagtatggaacagtcactgagacac

SEQ ID NO: 493752 - DNA, 25 bp, Mus musculus
gagtatggagccactttgaccactt

SEQ ID NO: 493753 - DNA, 25 bp, Mus musculus
gagtatggagcctctttgaccactt

SEQ ID NO: 493754 - DNA, 25 bp, Mus musculus
gagtatggcaggacctgagagcttc

SEQ ID NO: 493755 - DNA, 25 bp, Mus musculus
gagtatggcaggtcctgagagcttc

SEQ ID NO: 493756 - DNA, 25 bp, Mus musculus
gagtatggccaacattacaaaaggg

SEQ ID NO: 493757 - DNA, 25 bp, Mus musculus
gagtatggccaagattacaaaaggg

SEQ ID NO: 493758 - DNA, 25 bp, Mus musculus
gagtatggccctcttgttcagttag

SEQ ID NO: 493759 - DNA, 25 bp, Mus musculus
gagtatggccctgttgttcagttag

SEQ ID NO: 493760 - DNA, 25 bp, Mus musculus
gagtatggcctaaagtcccagtgca

SEQ ID NO: 493761 - DNA, 25 bp, Mus musculus
gagtatggcctatagtcccagtgca

SEQ ID NO: 493762 - DNA, 25 bp, Mus musculus
gagtatggctagaaacccaggtcca

SEQ ID NO: 493763 - DNA, 25 bp, Mus musculus
gagtatggctagtaacccaggtcca

SEQ ID NO: 493764 - DNA, 25 bp, Mus musculus
gagtatggctcaccattaggacact

SEQ ID NO: 493765 - DNA, 25 bp, Mus musculus
gagtatggctcagcattaggacact

SEQ ID NO: 493766 - DNA, 25 bp, Mus musculus
gagtatggctctcactagcagccct

SEQ ID NO: 493767 - DNA, 25 bp, Mus musculus
gagtatggctctgactagcagccct

SEQ ID NO: 493768 - DNA, 25 bp, Mus musculus
gagtatggctgtcttaacagcacaa

SEQ ID NO: 493769 - DNA, 25 bp, Mus musculus
gagtatggctgtgttaacagcacaa

SEQ ID NO: 493770 - DNA, 25 bp, Mus musculus
gagtatggcttgcatacagtcaaca

SEQ ID NO: 493771 - DNA, 25 bp, Mus musculus
gagtatggcttggatacagtcaaca

SEQ ID NO: 493772 - DNA, 25 bp, Mus musculus
gagtatgggcctcagtgctcacgac

SEQ ID NO: 493773 - DNA, 25 bp, Mus musculus
gagtatgggcctgagtgctcacgac

SEQ ID NO: 493774 - DNA, 25 bp, Mus musculus
gagtatggtcacatggttccacgaa

SEQ ID NO: 493775 - DNA, 25 bp, Mus musculus
gagtatggtcacttggttccacgaa

SEQ ID NO: 493776 - DNA, 25 bp, Mus musculus
gagtatggtcccattgtgtcattgt

SEQ ID NO: 493777 - DNA, 25 bp, Mus musculus
gagtatggtccctttgtgtcattgt

SEQ ID NO: 493778 - DNA, 25 bp, Mus musculus
gagtatggttgtcctcaaacccaca

SEQ ID NO: 493779 - DNA, 25 bp, Mus musculus
gagtatggttgtgctcaaacccaca

SEQ ID NO: 493780 - DNA, 25 bp, Mus musculus
gagtatgtacgtactaatttccaga

SEQ ID NO: 493781 - DNA, 25 bp, Mus musculus
gagtatgtacgttctaatttccaga

SEQ ID NO: 493782 - DNA, 25 bp, Mus musculus
gagtatgtacttcctagcttttata

SEQ ID NO: 493783 - DNA, 25 bp, Mus musculus
gagtatgtacttgctagcttttata

SEQ ID NO: 493784 - DNA, 25 bp, Mus musculus
gagtatgtattaacatttcaaccca

SEQ ID NO: 493785 - DNA, 25 bp, Mus musculus
gagtatgtattatcatttcaaccca

SEQ ID NO: 493786 - DNA, 25 bp, Mus musculus
gagtatgtcatacaattttgctttg

SEQ ID NO: 493787 - DNA, 25 bp, Mus musculus
gagtatgtcatagaattttgctttg

SEQ ID NO: 493788 - DNA, 25 bp, Mus musculus
gagtatgtcctaatgctcgttgata

SEQ ID NO: 493789 - DNA, 25 bp, Mus musculus
gagtatgtcctattgctcgttgata

SEQ ID NO: 493790 - DNA, 25 bp, Mus musculus
gagtatgtcttcattcaaatgtaca

SEQ ID NO: 493791 - DNA, 25 bp, Mus musculus
gagtatgtcttctttcaaatgtaca

SEQ ID NO: 493792 - DNA, 25 bp, Mus musculus
gagtatgtgcgtccccagtacccat

SEQ ID NO: 493793 - DNA, 25 bp, Mus musculus
gagtatgtgcgtgcccagtacccat

SEQ ID NO: 493794 - DNA, 25 bp, Mus musculus
gagtatgtggacctcttgccttgaa

SEQ ID NO: 493795 - DNA, 25 bp, Mus musculus
gagtatgtggacgtcttgccttgaa

SEQ ID NO: 493796 - DNA, 25 bp, Mus musculus
gagtatgtggatcatcttgtcatta

SEQ ID NO: 493797 - DNA, 25 bp, Mus musculus
gagtatgtggatgatcttgtcatta

SEQ ID NO: 493798 - DNA, 25 bp, Mus musculus
gagtatgtgggcaactgctcacact

SEQ ID NO: 493799 - DNA, 25 bp, Mus musculus
gagtatgtgggctactgctcacact

SEQ ID NO: 493800 - DNA, 25 bp, Mus musculus
gagtatgttgtgatgcaccgcaagc

SEQ ID NO: 493801 - DNA, 25 bp, Mus musculus
gagtatgttgtgttgcaccgcaagc

SEQ ID NO: 493802 - DNA, 25 bp, Mus musculus
gagtatgtttctctataccaagcaa

SEQ ID NO: 493803 - DNA, 25 bp, Mus musculus
gagtatgtttctgtataccaagcaa

SEQ ID NO: 493804 - DNA, 25 bp, Mus musculus
gagtattaactcagtacctgacaat

SEQ ID NO: 493805 - DNA, 25 bp, Mus musculus
gagtattaactctgtacctgacaat

SEQ ID NO: 493806 - DNA, 25 bp, Mus musculus
gagtattaatctattgtcagccata

SEQ ID NO: 493807 - DNA, 25 bp, Mus musculus
gagtattaatcttttgtcagccata

SEQ ID NO: 493808 - DNA, 25 bp, Mus musculus
gagtattaccttcgtaccaaagcca

SEQ ID NO: 493809 - DNA, 25 bp, Mus musculus
gagtattaccttggtaccaaagcca

SEQ ID NO: 493810 - DNA, 25 bp, Mus musculus
gagtattactgccaagcccggaact

SEQ ID NO: 493811 - DNA, 25 bp, Mus musculus
gagtattactgcgaagcccggaact

SEQ ID NO: 493812 - DNA, 25 bp, Mus musculus
gagtattaggtcactctatagtgat

SEQ ID NO: 493813 - DNA, 25 bp, Mus musculus
gagtattaggtctctctatagtgat

SEQ ID NO: 493814 - DNA, 25 bp, Mus musculus
gagtattatatcctggtacacttaa

SEQ ID NO: 493815 - DNA, 25 bp, Mus musculus
gagtattatatcgtggtacacttaa

SEQ ID NO: 493816 - DNA, 25 bp, Mus musculus
gagtattattccacagaagattttt

SEQ ID NO: 493817 - DNA, 25 bp, Mus musculus
gagtattattcctcagaagattttt

SEQ ID NO: 493818 - DNA, 25 bp, Mus musculus
gagtattcatctatcggcagcccac

SEQ ID NO: 493819 - DNA, 25 bp, Mus musculus
gagtattcatctttcggcagcccac

SEQ ID NO: 493820 - DNA, 25 bp, Mus musculus
gagtattcatgaacagctgcgtctg

SEQ ID NO: 493821 - DNA, 25 bp, Mus musculus
gagtattcatgatcagctgcgtctg

SEQ ID NO: 493822 - DNA, 25 bp, Mus musculus
gagtattcctcactacagtatgtat

SEQ ID NO: 493823 - DNA, 25 bp, Mus musculus
gagtattcctcagtacagtatgtat

SEQ ID NO: 493824 - DNA, 25 bp, Mus musculus
gagtattcctgcaaactttgcgaca

SEQ ID NO: 493825 - DNA, 25 bp, Mus musculus
gagtattcctgctaactttgcgaca

SEQ ID NO: 493826 - DNA, 25 bp, Mus musculus
gagtattcgaagctttgggcacact

SEQ ID NO: 493827 - DNA, 25 bp, Mus musculus
gagtattcgaaggtttgggcacact

SEQ ID NO: 493828 - DNA, 25 bp, Mus musculus
gagtattctaagatcattccctgta

SEQ ID NO: 493829 - DNA, 25 bp, Mus musculus
gagtattctaagttcattccctgta

SEQ ID NO: 493830 - DNA, 25 bp, Mus musculus
gagtattctccacttgtaattgctt

SEQ ID NO: 493831 - DNA, 25 bp, Mus musculus
gagtattctccagttgtaattgctt

SEQ ID NO: 493832 - DNA, 25 bp, Mus musculus
gagtattctcctaagagccgataca

SEQ ID NO: 493833 - DNA, 25 bp, Mus musculus
gagtattctccttagagccgataca

SEQ ID NO: 493834 - DNA, 25 bp, Mus musculus
gagtattctggtcggctaacaacaa

SEQ ID NO: 493835 - DNA, 25 bp, Mus musculus
gagtattctggtgggctaacaacaa

SEQ ID NO: 493836 - DNA, 25 bp, Mus musculus
gagtattcttgtcagctttgggatt

SEQ ID NO: 493837 - DNA, 25 bp, Mus musculus
gagtattcttgtgagctttgggatt

SEQ ID NO: 493838 - DNA, 25 bp, Mus musculus
gagtattgatttacacagctttgga

SEQ ID NO: 493839 - DNA, 25 bp, Mus musculus
gagtattgattttcacagctttgga

SEQ ID NO: 493840 - DNA, 25 bp, Mus musculus
gagtattgccataagtgactgcatt

SEQ ID NO: 493841 - DNA, 25 bp, Mus musculus
gagtattgccatcatctgaggtctg

SEQ ID NO: 493842 - DNA, 25 bp, Mus musculus
gagtattgccatgatctgaggtctg

SEQ ID NO: 493843 - DNA, 25 bp, Mus musculus
gagtattgccattagtgactgcatt

SEQ ID NO: 493844 - DNA, 25 bp, Mus musculus
gagtattgctatacgactaatcggt

SEQ ID NO: 493845 - DNA, 25 bp, Mus musculus
gagtattgctattcgactaatcggt

SEQ ID NO: 493846 - DNA, 25 bp, Mus musculus
gagtattgctttagcgtgcacagta

SEQ ID NO: 493847 - DNA, 25 bp, Mus musculus
gagtattgcttttgcgtgcacagta

SEQ ID NO: 493848 - DNA, 25 bp, Mus musculus
gagtattggcgccttaaccagcaac

SEQ ID NO: 493849 - DNA, 25 bp, Mus musculus
gagtattggcgcgttaaccagcaac

SEQ ID NO: 493850 - DNA, 25 bp, Mus musculus
gagtattgtaggcaacctttccact

SEQ ID NO: 493851 - DNA, 25 bp, Mus musculus
gagtattgtagggaacctttccact

SEQ ID NO: 493852 - DNA, 25 bp, Mus musculus
gagtattgtggtaactatggcacta

SEQ ID NO: 493853 - DNA, 25 bp, Mus musculus
gagtattgtggttactatggcacta

SEQ ID NO: 493854 - DNA, 25 bp, Mus musculus
gagtatttaagtcctgcacattttt

SEQ ID NO: 493855 - DNA, 25 bp, Mus musculus
gagtatttaagtctcactgttcact

SEQ ID NO: 493856 - DNA, 25 bp, Mus musculus
gagtatttaagtgctgcacattttt

SEQ ID NO: 493857 - DNA, 25 bp, Mus musculus
gagtatttaagtgtcactgttcact

SEQ ID NO: 493858 - DNA, 25 bp, Mus musculus
gagtatttacagattgtggaacagt

SEQ ID NO: 493859 - DNA, 25 bp, Mus musculus
gagtatttacagtttgtggaacagt

SEQ ID NO: 493860 - DNA, 25 bp, Mus musculus
gagtatttacgacccacagcatgaa

SEQ ID NO: 493861 - DNA, 25 bp, Mus musculus
gagtatttacgagccacagcatgaa

SEQ ID NO: 493862 - DNA, 25 bp, Mus musculus
gagtatttagagcactattggtatt

SEQ ID NO: 493863 - DNA, 25 bp, Mus musculus
gagtatttagaggactattggtatt

SEQ ID NO: 493864 - DNA, 25 bp, Mus musculus
gagtatttagccctctacattcctg

SEQ ID NO: 493865 - DNA, 25 bp, Mus musculus
gagtatttagccgtctacattcctg

SEQ ID NO: 493866 - DNA, 25 bp, Mus musculus
gagtatttcaaactgcacgagcttt

SEQ ID NO: 493867 - DNA, 25 bp, Mus musculus
gagtatttcaaagtgcacgagcttt

SEQ ID NO: 493868 - DNA, 25 bp, Mus musculus
gagtatttcacaacctcctatcact

SEQ ID NO: 493869 - DNA, 25 bp, Mus musculus
gagtatttcacatcctcctatcact

SEQ ID NO: 493870 - DNA, 25 bp, Mus musculus
gagtatttcaccacagccatgggaa

SEQ ID NO: 493871 - DNA, 25 bp, Mus musculus
gagtatttcacctcagccatgggaa

SEQ ID NO: 493872 - DNA, 25 bp, Mus musculus
gagtatttcagtctatgtgccatat

SEQ ID NO: 493873 - DNA, 25 bp, Mus musculus
gagtatttcagtgtatgtgccatat

SEQ ID NO: 493874 - DNA, 25 bp, Mus musculus
gagtatttctacacaaaaagcttag

SEQ ID NO: 493875 - DNA, 25 bp, Mus musculus
gagtatttctactcaaaaagcttag

SEQ ID NO: 493876 - DNA, 25 bp, Mus musculus
gagtatttctagacaatggcatgtc

SEQ ID NO: 493877 - DNA, 25 bp, Mus musculus
gagtatttctagatgtcgaagtcaa

SEQ ID NO: 493878 - DNA, 25 bp, Mus musculus
gagtatttctagtcaatggcatgtc

SEQ ID NO: 493879 - DNA, 25 bp, Mus musculus
gagtatttctagttgtcgaagtcaa

SEQ ID NO: 493880 - DNA, 25 bp, Mus musculus
gagtatttcttacgcctggtgggta

SEQ ID NO: 493881 - DNA, 25 bp, Mus musculus
gagtatttcttaggcctggtgggta

SEQ ID NO: 493882 - DNA, 25 bp, Mus musculus
gagtatttctttaatgtgttcggta

SEQ ID NO: 493883 - DNA, 25 bp, Mus musculus
gagtatttcttttatgtgttcggta

SEQ ID NO: 493884 - DNA, 25 bp, Mus musculus
gagtatttgcatcgcatgtgcttcc

SEQ ID NO: 493885 - DNA, 25 bp, Mus musculus
gagtatttgcatggcatgtgcttcc

SEQ ID NO: 493886 - DNA, 25 bp, Mus musculus
gagtatttgcgcaatttgcctctgc

SEQ ID NO: 493887 - DNA, 25 bp, Mus musculus
gagtatttgcgctatttgcctctgc

SEQ ID NO: 493888 - DNA, 25 bp, Mus musculus
gagtatttgctgaatgacctcgagc

SEQ ID NO: 493889 - DNA, 25 bp, Mus musculus
gagtatttgctgtatgacctcgagc

SEQ ID NO: 493890 - DNA, 25 bp, Mus musculus
gagtatttggaccagtagtcttggc

SEQ ID NO: 493891 - DNA, 25 bp, Mus musculus
gagtatttggacgagtagtcttggc

SEQ ID NO: 493892 - DNA, 25 bp, Mus musculus
gagtatttggcacatgatggcttaa

SEQ ID NO: 493893 - DNA, 25 bp, Mus musculus
gagtatttggcagatgatggcttaa

SEQ ID NO: 493894 - DNA, 25 bp, Mus musculus
gagtatttggtaatttcccattagc

SEQ ID NO: 493895 - DNA, 25 bp, Mus musculus
gagtatttggtattttcccattagc

SEQ ID NO: 493896 - DNA, 25 bp, Mus musculus
gagtatttggttatgcacgaagtct

SEQ ID NO: 493897 - DNA, 25 bp, Mus musculus
gagtatttggttttgcacgaagtct

SEQ ID NO: 493898 - DNA, 25 bp, Mus musculus
gagtattttacccaagatcgcagtc

SEQ ID NO: 493899 - DNA, 25 bp, Mus musculus
gagtattttaccgaagatcgcagtc

SEQ ID NO: 493900 - DNA, 25 bp, Mus musculus
gagtattttactctatggaacatgt

SEQ ID NO: 493901 - DNA, 25 bp, Mus musculus
gagtattttactgtatggaacatgt

SEQ ID NO: 493902 - DNA, 25 bp, Mus musculus
gagtattttagactccctgcttttg

SEQ ID NO: 493903 - DNA, 25 bp, Mus musculus
gagtattttagagtccctgcttttg

SEQ ID NO: 493904 - DNA, 25 bp, Mus musculus
gagtattttcataactccctaaata

SEQ ID NO: 493905 - DNA, 25 bp, Mus musculus
gagtattttcattactccctaaata

SEQ ID NO: 493906 - DNA, 25 bp, Mus musculus
gagtattttgtccatctgagattct

SEQ ID NO: 493907 - DNA, 25 bp, Mus musculus
gagtattttgtcgatctgagattct

SEQ ID NO: 493908 - DNA, 25 bp, Mus musculus
gagtattttgttcaccttcatgggt

SEQ ID NO: 493909 - DNA, 25 bp, Mus musculus
gagtattttgttgaccttcatgggt

SEQ ID NO: 493910 - DNA, 25 bp, Mus musculus
gagtatttttgtacaagatccagat

SEQ ID NO: 493911 - DNA, 25 bp, Mus musculus
gagtatttttgttcaagatccagat

SEQ ID NO: 493912 - DNA, 25 bp, Mus musculus
gagtattttttccttgtgagatgta

SEQ ID NO: 493913 - DNA, 25 bp, Mus musculus
gagtattttttcgttgtgagatgta

SEQ ID NO: 493914 - DNA, 25 bp, Mus musculus
gagtcaaaacctagcgggttctctt

SEQ ID NO: 493915 - DNA, 25 bp, Mus musculus
gagtcaaaaccttgcgggttctctt

SEQ ID NO: 493916 - DNA, 25 bp, Mus musculus
gagtcaaaactcaaaagtggtcagg

SEQ ID NO: 493917 - DNA, 25 bp, Mus musculus
gagtcaaaactctaaagtggtcagg

SEQ ID NO: 493918 - DNA, 25 bp, Mus musculus
gagtcaaaagaaaaagcctacccag

SEQ ID NO: 493919 - DNA, 25 bp, Mus musculus
gagtcaaaagaataagcctacccag

SEQ ID NO: 493920 - DNA, 25 bp, Mus musculus
gagtcaaaatagacctgcggttttt

SEQ ID NO: 493921 - DNA, 25 bp, Mus musculus
gagtcaaaatagtcctgcggttttt

SEQ ID NO: 493922 - DNA, 25 bp, Mus musculus
gagtcaaaatgtaccgaccgacaga

SEQ ID NO: 493923 - DNA, 25 bp, Mus musculus
gagtcaaaatgttccgaccgacaga

SEQ ID NO: 493924 - DNA, 25 bp, Mus musculus
gagtcaaacatacctgtcagccctc

SEQ ID NO: 493925 - DNA, 25 bp, Mus musculus
gagtcaaacatagctgtcagccctc

SEQ ID NO: 493926 - DNA, 25 bp, Mus musculus
gagtcaaagactcacttggacattt

SEQ ID NO: 493927 - DNA, 25 bp, Mus musculus
gagtcaaagactgacttggacattt

SEQ ID NO: 493928 - DNA, 25 bp, Mus musculus
gagtcaaagatgaccctaggcaaga

SEQ ID NO: 493929 - DNA, 25 bp, Mus musculus
gagtcaaagatgtccctaggcaaga

SEQ ID NO: 493930 - DNA, 25 bp, Mus musculus
gagtcaaagccaagcttgtcctcaa

SEQ ID NO: 493931 - DNA, 25 bp, Mus musculus
gagtcaaagccacattgataccatc

SEQ ID NO: 493932 - DNA, 25 bp, Mus musculus
gagtcaaagccagattgataccatc

SEQ ID NO: 493933 - DNA, 25 bp, Mus musculus
gagtcaaagccatgcttgtcctcaa

SEQ ID NO: 493934 - DNA, 25 bp, Mus musculus
gagtcaaaggagaattattccacag

SEQ ID NO: 493935 - DNA, 25 bp, Mus musculus
gagtcaaaggagtattattccacag

SEQ ID NO: 493936 - DNA, 25 bp, Mus musculus
gagtcaaagggcacatcagtgtgtc

SEQ ID NO: 493937 - DNA, 25 bp, Mus musculus
gagtcaaagggctcatcagtgtgtc

SEQ ID NO: 493938 - DNA, 25 bp, Mus musculus
gagtcaaaggtcacgctgaaacttc

SEQ ID NO: 493939 - DNA, 25 bp, Mus musculus
gagtcaaaggtctcgctgaaacttc

SEQ ID NO: 493940 - DNA, 25 bp, Mus musculus
gagtcaaaggttcctcccgaattcg

SEQ ID NO: 493941 - DNA, 25 bp, Mus musculus
gagtcaaaggttgctcccgaattcg

SEQ ID NO: 493942 - DNA, 25 bp, Mus musculus
gagtcaaatccaatttctgggtgaa

SEQ ID NO: 493943 - DNA, 25 bp, Mus musculus
gagtcaaatccacggagctctgtgc

SEQ ID NO: 493944 - DNA, 25 bp, Mus musculus
gagtcaaatccagggagctctgtgc

SEQ ID NO: 493945 - DNA, 25 bp, Mus musculus
gagtcaaatccattttctgggtgaa

SEQ ID NO: 493946 - DNA, 25 bp, Mus musculus
gagtcaaatctaagacatcgttttc

SEQ ID NO: 493947 - DNA, 25 bp, Mus musculus
gagtcaaatctatgacatcgttttc

SEQ ID NO: 493948 - DNA, 25 bp, Mus musculus
gagtcaaatgggactgtccttcagc

SEQ ID NO: 493949 - DNA, 25 bp, Mus musculus
gagtcaaatgggtctgtccttcagc

SEQ ID NO: 493950 - DNA, 25 bp, Mus musculus
gagtcaaattatcctaccagtcttt

SEQ ID NO: 493951 - DNA, 25 bp, Mus musculus
gagtcaaattatgctaccagtcttt

SEQ ID NO: 493952 - DNA, 25 bp, Mus musculus
gagtcaaattgaactaacccagtat

SEQ ID NO: 493953 - DNA, 25 bp, Mus musculus
gagtcaaattgatctaacccagtat

SEQ ID NO: 493954 - DNA, 25 bp, Mus musculus
gagtcaacacagcagcatgttccct

SEQ ID NO: 493955 - DNA, 25 bp, Mus musculus
gagtcaacacaggagcatgttccct

SEQ ID NO: 493956 - DNA, 25 bp, Mus musculus
gagtcaacatagaaccccagtgctg

SEQ ID NO: 493957 - DNA, 25 bp, Mus musculus
gagtcaacatagtaccccagtgctg

SEQ ID NO: 493958 - DNA, 25 bp, Mus musculus
gagtcaacattacatgattcttcaa

SEQ ID NO: 493959 - DNA, 25 bp, Mus musculus
gagtcaacattagatgattcttcaa

SEQ ID NO: 493960 - DNA, 25 bp, Mus musculus
gagtcaacattgacttcaactatga

SEQ ID NO: 493961 - DNA, 25 bp, Mus musculus
gagtcaacattgtcttcaactatga

SEQ ID NO: 493962 - DNA, 25 bp, Mus musculus
gagtcaaccataatatccagtacag

SEQ ID NO: 493963 - DNA, 25 bp, Mus musculus
gagtcaaccatattatccagtacag

SEQ ID NO: 493964 - DNA, 25 bp, Mus musculus
gagtcaaccgaaaggcacttcttta

SEQ ID NO: 493965 - DNA, 25 bp, Mus musculus
gagtcaaccgaatggcacttcttta

SEQ ID NO: 493966 - DNA, 25 bp, Mus musculus
gagtcaacgctcaagatgggttttt

SEQ ID NO: 493967 - DNA, 25 bp, Mus musculus
gagtcaacgctctagatgggttttt

SEQ ID NO: 493968 - DNA, 25 bp, Mus musculus
gagtcaactaacctgtaccttcagg

SEQ ID NO: 493969 - DNA, 25 bp, Mus musculus
gagtcaactaacgtgtaccttcagg

SEQ ID NO: 493970 - DNA, 25 bp, Mus musculus
gagtcaactgccaagtgccaggaat

SEQ ID NO: 493971 - DNA, 25 bp, Mus musculus
gagtcaactgcctagtgccaggaat

SEQ ID NO: 493972 - DNA, 25 bp, Mus musculus
gagtcaactgttcctcctgaaggct

SEQ ID NO: 493973 - DNA, 25 bp, Mus musculus
gagtcaactgttgctcctgaaggct

SEQ ID NO: 493974 - DNA, 25 bp, Mus musculus
gagtcaacttcaagagcgagcccag

SEQ ID NO: 493975 - DNA, 25 bp, Mus musculus
gagtcaacttcatgagcgagcccag

SEQ ID NO: 493976 - DNA, 25 bp, Mus musculus
gagtcaacttgtattccatgtctcc

SEQ ID NO: 493977 - DNA, 25 bp, Mus musculus
gagtcaacttgttttccatgtctcc

SEQ ID NO: 493978 - DNA, 25 bp, Mus musculus
gagtcaagaactcaactggctcctt

SEQ ID NO: 493979 - DNA, 25 bp, Mus musculus
gagtcaagaactgaactggctcctt

SEQ ID NO: 493980 - DNA, 25 bp, Mus musculus
gagtcaagagccctgagtgcacaag

SEQ ID NO: 493981 - DNA, 25 bp, Mus musculus
gagtcaagagccgtgagtgcacaag

SEQ ID NO: 493982 - DNA, 25 bp, Mus musculus
gagtcaagatccacagggttccatc

SEQ ID NO: 493983 - DNA, 25 bp, Mus musculus
gagtcaagatcctcagggttccatc

SEQ ID NO: 493984 - DNA, 25 bp, Mus musculus
gagtcaagcaatacagtttctgtgt

SEQ ID NO: 493985 - DNA, 25 bp, Mus musculus
gagtcaagcaattcagtttctgtgt

SEQ ID NO: 493986 - DNA, 25 bp, Mus musculus
gagtcaagcacccaaatgcacagcg

SEQ ID NO: 493987 - DNA, 25 bp, Mus musculus
gagtcaagcaccgaaatgcacagcg

SEQ ID NO: 493988 - DNA, 25 bp, Mus musculus
gagtcaagccgcacttgtgccttgc

SEQ ID NO: 493989 - DNA, 25 bp, Mus musculus
gagtcaagccgctcttgtgccttgc

SEQ ID NO: 493990 - DNA, 25 bp, Mus musculus
gagtcaagctcaacagggtcttctt

SEQ ID NO: 493991 - DNA, 25 bp, Mus musculus
gagtcaagctcatcagggtcttctt

SEQ ID NO: 493992 - DNA, 25 bp, Mus musculus
gagtcaaggcacaactttcgagaga

SEQ ID NO: 493993 - DNA, 25 bp, Mus musculus
gagtcaaggcactactttcgagaga

SEQ ID NO: 493994 - DNA, 25 bp, Mus musculus
gagtcaaggcctactcttaggttac

SEQ ID NO: 493995 - DNA, 25 bp, Mus musculus
gagtcaaggccttctcttaggttac

SEQ ID NO: 493996 - DNA, 25 bp, Mus musculus
gagtcaaggctgacatgtgggttaa

SEQ ID NO: 493997 - DNA, 25 bp, Mus musculus
gagtcaaggctgtcatgtgggttaa

SEQ ID NO: 493998 - DNA, 25 bp, Mus musculus
gagtcaagggtgacagccagagcaa

SEQ ID NO: 493999 - DNA, 25 bp, Mus musculus
gagtcaagggtgtcagccagagcaa

SEQ ID NO: 494000 - DNA, 25 bp, Mus musculus
gagtcaaggttaacctaaggaaaga

SEQ ID NO: 494001 - DNA, 25 bp, Mus musculus
gagtcaaggttatcctaaggaaaga

SEQ ID NO: 494002 - DNA, 25 bp, Mus musculus
gagtcaagtaagagaccctcctcat

SEQ ID NO: 494003 - DNA, 25 bp, Mus musculus
gagtcaagtaagtgaccctcctcat

SEQ ID NO: 494004 - DNA, 25 bp, Mus musculus
gagtcaagtcctcactatctagcat

SEQ ID NO: 494005 - DNA, 25 bp, Mus musculus
gagtcaagtcctgactatctagcat

SEQ ID NO: 494006 - DNA, 25 bp, Mus musculus
gagtcaagtctacgtgagctccctg

SEQ ID NO: 494007 - DNA, 25 bp, Mus musculus
gagtcaagtctaggtgagctccctg

SEQ ID NO: 494008 - DNA, 25 bp, Mus musculus
gagtcaagtctcaagatggcctttc

SEQ ID NO: 494009 - DNA, 25 bp, Mus musculus
gagtcaagtctctagatggcctttc

SEQ ID NO: 494010 - DNA, 25 bp, Mus musculus
gagtcaagttccaggttattcttca

SEQ ID NO: 494011 - DNA, 25 bp, Mus musculus
gagtcaagttcctggttattcttca

SEQ ID NO: 494012 - DNA, 25 bp, Mus musculus
gagtcaagttctcgtgtttaccgat

SEQ ID NO: 494013 - DNA, 25 bp, Mus musculus
gagtcaagttctggtgtttaccgat

SEQ ID NO: 494014 - DNA, 25 bp, Mus musculus
gagtcaatactccatcaacccagag

SEQ ID NO: 494015 - DNA, 25 bp, Mus musculus
gagtcaatactcgatcaacccagag

SEQ ID NO: 494016 - DNA, 25 bp, Mus musculus
gagtcaatagatcactggcttctct

SEQ ID NO: 494017 - DNA, 25 bp, Mus musculus
gagtcaatagatgactggcttctct

SEQ ID NO: 494018 - DNA, 25 bp, Mus musculus
gagtcaataggtaaaaatgcttact

SEQ ID NO: 494019 - DNA, 25 bp, Mus musculus
gagtcaataggttaaaatgcttact

SEQ ID NO: 494020 - DNA, 25 bp, Mus musculus
gagtcaatcagaatatccaagtcct

SEQ ID NO: 494021 - DNA, 25 bp, Mus musculus
gagtcaatcagattatccaagtcct

SEQ ID NO: 494022 - DNA, 25 bp, Mus musculus
gagtcaatctttcctaaccagtttg

SEQ ID NO: 494023 - DNA, 25 bp, Mus musculus
gagtcaatctttgctaaccagtttg

SEQ ID NO: 494024 - DNA, 25 bp, Mus musculus
gagtcaatgaagagtggtgtcctat

SEQ ID NO: 494025 - DNA, 25 bp, Mus musculus
gagtcaatgaagtgtggtgtcctat

SEQ ID NO: 494026 - DNA, 25 bp, Mus musculus
gagtcaatgagaccttacatacaga

SEQ ID NO: 494027 - DNA, 25 bp, Mus musculus
gagtcaatgagagcttacatacaga

SEQ ID NO: 494028 - DNA, 25 bp, Mus musculus
gagtcaatggctctatttaaccaat

SEQ ID NO: 494029 - DNA, 25 bp, Mus musculus
gagtcaatggctgtatttaaccaat

SEQ ID NO: 494030 - DNA, 25 bp, Mus musculus
gagtcaatgtttatgcgattctctt

SEQ ID NO: 494031 - DNA, 25 bp, Mus musculus
gagtcaatgtttttgcgattctctt

SEQ ID NO: 494032 - DNA, 25 bp, Mus musculus
gagtcaattcccaaaatccacatct

SEQ ID NO: 494033 - DNA, 25 bp, Mus musculus
gagtcaattccctaaatccacatct

SEQ ID NO: 494034 - DNA, 25 bp, Mus musculus
gagtcaatttcaaccgtaagcctta

SEQ ID NO: 494035 - DNA, 25 bp, Mus musculus
gagtcaatttcatccgtaagcctta

SEQ ID NO: 494036 - DNA, 25 bp, Mus musculus
gagtcacaaaatacgcttctctgat

SEQ ID NO: 494037 - DNA, 25 bp, Mus musculus
gagtcacaaaattcgcttctctgat

SEQ ID NO: 494038 - DNA, 25 bp, Mus musculus
gagtcacaagcacacacagggttgt

SEQ ID NO: 494039 - DNA, 25 bp, Mus musculus
gagtcacaagcagacacagggttgt

SEQ ID NO: 494040 - DNA, 25 bp, Mus musculus
gagtcacacactatgcagcgcggga

SEQ ID NO: 494041 - DNA, 25 bp, Mus musculus
gagtcacacactatgtcctaggaag

SEQ ID NO: 494042 - DNA, 25 bp, Mus musculus
gagtcacacactttgcagcgcggga

SEQ ID NO: 494043 - DNA, 25 bp, Mus musculus
gagtcacacactttgtcctaggaag

SEQ ID NO: 494044 - DNA, 25 bp, Mus musculus
gagtcacacagtctaataaaccaac

SEQ ID NO: 494045 - DNA, 25 bp, Mus musculus
gagtcacacagtgtaataaaccaac

SEQ ID NO: 494046 - DNA, 25 bp, Mus musculus
gagtcacacatcattctagtactga

SEQ ID NO: 494047 - DNA, 25 bp, Mus musculus
gagtcacacatctttctagtactga

SEQ ID NO: 494048 - DNA, 25 bp, Mus musculus
gagtcacacatgactctctggagag

SEQ ID NO: 494049 - DNA, 25 bp, Mus musculus
gagtcacacatgactttcccaacat

SEQ ID NO: 494050 - DNA, 25 bp, Mus musculus
gagtcacacatgtctctctggagag

SEQ ID NO: 494051 - DNA, 25 bp, Mus musculus
gagtcacacatgtctttcccaacat

SEQ ID NO: 494052 - DNA, 25 bp, Mus musculus
gagtcacaccagacacaagtccaga

SEQ ID NO: 494053 - DNA, 25 bp, Mus musculus
gagtcacaccagatgtcaacaccaa

SEQ ID NO: 494054 - DNA, 25 bp, Mus musculus
gagtcacaccagtcacaagtccaga

SEQ ID NO: 494055 - DNA, 25 bp, Mus musculus
gagtcacaccagttgtcaacaccaa

SEQ ID NO: 494056 - DNA, 25 bp, Mus musculus
gagtcacacctaaagctttgctatt

SEQ ID NO: 494057 - DNA, 25 bp, Mus musculus
gagtcacacctatagctttgctatt

SEQ ID NO: 494058 - DNA, 25 bp, Mus musculus
gagtcacacgcacaataaaccagtt

SEQ ID NO: 494059 - DNA, 25 bp, Mus musculus
gagtcacacgcagaataaaccagtt

SEQ ID NO: 494060 - DNA, 25 bp, Mus musculus
gagtcacacggcacaccatgtgtgt

SEQ ID NO: 494061 - DNA, 25 bp, Mus musculus
gagtcacacggctcaccatgtgtgt

SEQ ID NO: 494062 - DNA, 25 bp, Mus musculus
gagtcacacgtgagcagtctggaaa

SEQ ID NO: 494063 - DNA, 25 bp, Mus musculus
gagtcacacgtgtgcagtctggaaa

SEQ ID NO: 494064 - DNA, 25 bp, Mus musculus
gagtcacagaacagcaacctgggca

SEQ ID NO: 494065 - DNA, 25 bp, Mus musculus
gagtcacagaactgcaacctgggca

SEQ ID NO: 494066 - DNA, 25 bp, Mus musculus
gagtcacagaagctgtcccacgtgt

SEQ ID NO: 494067 - DNA, 25 bp, Mus musculus
gagtcacagaaggtgtcccacgtgt

SEQ ID NO: 494068 - DNA, 25 bp, Mus musculus
gagtcacagaatccattggtcaatg

SEQ ID NO: 494069 - DNA, 25 bp, Mus musculus
gagtcacagaatgcattggtcaatg

SEQ ID NO: 494070 - DNA, 25 bp, Mus musculus
gagtcacagactaggaaagttctcc

SEQ ID NO: 494071 - DNA, 25 bp, Mus musculus
gagtcacagactcggcactctgtct

SEQ ID NO: 494072 - DNA, 25 bp, Mus musculus
gagtcacagactgggcactctgtct

SEQ ID NO: 494073 - DNA, 25 bp, Mus musculus
gagtcacagacttggaaagttctcc

SEQ ID NO: 494074 - DNA, 25 bp, Mus musculus
gagtcacagcagagggacttgcctc

SEQ ID NO: 494075 - DNA, 25 bp, Mus musculus
gagtcacagcagtgggacttgcctc

SEQ ID NO: 494076 - DNA, 25 bp, Mus musculus
gagtcacagcctaaaacttcaccat

SEQ ID NO: 494077 - DNA, 25 bp, Mus musculus
gagtcacagccttaaacttcaccat

SEQ ID NO: 494078 - DNA, 25 bp, Mus musculus
gagtcacaggaaaacgcctcaagca

SEQ ID NO: 494079 - DNA, 25 bp, Mus musculus
gagtcacaggaatacgcctcaagca

SEQ ID NO: 494080 - DNA, 25 bp, Mus musculus
gagtcacaggcacttccccaggaaa

SEQ ID NO: 494081 - DNA, 25 bp, Mus musculus
gagtcacaggcagttccccaggaaa

SEQ ID NO: 494082 - DNA, 25 bp, Mus musculus
gagtcacaggtcagaagctccaagg

SEQ ID NO: 494083 - DNA, 25 bp, Mus musculus
gagtcacaggtctgaagctccaagg

SEQ ID NO: 494084 - DNA, 25 bp, Mus musculus
gagtcacagttaccacacctaggaa

SEQ ID NO: 494085 - DNA, 25 bp, Mus musculus
gagtcacagttagcacacctaggaa

SEQ ID NO: 494086 - DNA, 25 bp, Mus musculus
gagtcacataaaacattcgctgtta

SEQ ID NO: 494087 - DNA, 25 bp, Mus musculus
gagtcacataaatcattcgctgtta

SEQ ID NO: 494088 - DNA, 25 bp, Mus musculus
gagtcacataatcatccaggcgagc

SEQ ID NO: 494089 - DNA, 25 bp, Mus musculus
gagtcacataatgatccaggcgagc

SEQ ID NO: 494090 - DNA, 25 bp, Mus musculus
gagtcacatagcagatatccatcct

SEQ ID NO: 494091 - DNA, 25 bp, Mus musculus
gagtcacatagctgatatccatcct

SEQ ID NO: 494092 - DNA, 25 bp, Mus musculus
gagtcacatagtatcttttacctag

SEQ ID NO: 494093 - DNA, 25 bp, Mus musculus
gagtcacatagtttcttttacctag

SEQ ID NO: 494094 - DNA, 25 bp, Mus musculus
gagtcacatcatccctgtgcgggtt

SEQ ID NO: 494095 - DNA, 25 bp, Mus musculus
gagtcacatcatgcctgtgcgggtt

SEQ ID NO: 494096 - DNA, 25 bp, Mus musculus
gagtcacatctgaaagtgcatgcca

SEQ ID NO: 494097 - DNA, 25 bp, Mus musculus
gagtcacatctgtaagtgcatgcca

SEQ ID NO: 494098 - DNA, 25 bp, Mus musculus
gagtcacatgcgcaatctagccaag

SEQ ID NO: 494099 - DNA, 25 bp, Mus musculus
gagtcacatgcggaatctagccaag

SEQ ID NO: 494100 - DNA, 25 bp, Mus musculus
gagtcacatgctcaatctccatttt

SEQ ID NO: 494101 - DNA, 25 bp, Mus musculus
gagtcacatgctgaatctccatttt

SEQ ID NO: 494102 - DNA, 25 bp, Mus musculus
gagtcacatggccaaacctactgga

SEQ ID NO: 494103 - DNA, 25 bp, Mus musculus
gagtcacatggcgaaacctactgga

SEQ ID NO: 494104 - DNA, 25 bp, Mus musculus
gagtcacatggtagtttcggtcata

SEQ ID NO: 494105 - DNA, 25 bp, Mus musculus
gagtcacatggttgtttcggtcata

SEQ ID NO: 494106 - DNA, 25 bp, Mus musculus
gagtcacattcactcttgttcaaac

SEQ ID NO: 494107 - DNA, 25 bp, Mus musculus
gagtcacattcagtcttgttcaaac

SEQ ID NO: 494108 - DNA, 25 bp, Mus musculus
gagtcacattgtaataccattcaag

SEQ ID NO: 494109 - DNA, 25 bp, Mus musculus
gagtcacattgttataccattcaag

SEQ ID NO: 494110 - DNA, 25 bp, Mus musculus
gagtcacatttgacatctgagatga

SEQ ID NO: 494111 - DNA, 25 bp, Mus musculus
gagtcacatttgtcatctgagatga

SEQ ID NO: 494112 - DNA, 25 bp, Mus musculus
gagtcacattttatcccctgagagt

SEQ ID NO: 494113 - DNA, 25 bp, Mus musculus
gagtcacattttttcccctgagagt

SEQ ID NO: 494114 - DNA, 25 bp, Mus musculus
gagtcaccaaccaggcgattttacc

SEQ ID NO: 494115 - DNA, 25 bp, Mus musculus
gagtcaccaacctggcgattttacc

SEQ ID NO: 494116 - DNA, 25 bp, Mus musculus
gagtcaccagaaccaactcacagga

SEQ ID NO: 494117 - DNA, 25 bp, Mus musculus
gagtcaccagaagcaactcacagga

SEQ ID NO: 494118 - DNA, 25 bp, Mus musculus
gagtcaccagctcgactggagtgat

SEQ ID NO: 494119 - DNA, 25 bp, Mus musculus
gagtcaccagctggactggagtgat

SEQ ID NO: 494120 - DNA, 25 bp, Mus musculus
gagtcaccaggaacaccatccagaa

SEQ ID NO: 494121 - DNA, 25 bp, Mus musculus
gagtcaccaggatcaccatccagaa

SEQ ID NO: 494122 - DNA, 25 bp, Mus musculus
gagtcaccatagactgtaatccaat

SEQ ID NO: 494123 - DNA, 25 bp, Mus musculus
gagtcaccatagtctgtaatccaat

SEQ ID NO: 494124 - DNA, 25 bp, Mus musculus
gagtcaccatctctgtacatctcta

SEQ ID NO: 494125 - DNA, 25 bp, Mus musculus
gagtcaccatctgtgtacatctcta

SEQ ID NO: 494126 - DNA, 25 bp, Mus musculus
gagtcaccatggcttccttatggaa

SEQ ID NO: 494127 - DNA, 25 bp, Mus musculus
gagtcaccatgggttccttatggaa

SEQ ID NO: 494128 - DNA, 25 bp, Mus musculus
gagtcaccatgtcttacagagcagt

SEQ ID NO: 494129 - DNA, 25 bp, Mus musculus
gagtcaccatgtgttacagagcagt

SEQ ID NO: 494130 - DNA, 25 bp, Mus musculus
gagtcacccaggcatccgtgaaaaa

SEQ ID NO: 494131 - DNA, 25 bp, Mus musculus
gagtcacccagggatccgtgaaaaa

SEQ ID NO: 494132 - DNA, 25 bp, Mus musculus
gagtcaccctatagtaagcctaaat

SEQ ID NO: 494133 - DNA, 25 bp, Mus musculus
gagtcaccctattgtaagcctaaat

SEQ ID NO: 494134 - DNA, 25 bp, Mus musculus
gagtcacccttaatcctgtaagtaa

SEQ ID NO: 494135 - DNA, 25 bp, Mus musculus
gagtcacccttattcctgtaagtaa

SEQ ID NO: 494136 - DNA, 25 bp, Mus musculus
gagtcacctaaacttcggcggcact

SEQ ID NO: 494137 - DNA, 25 bp, Mus musculus
gagtcacctaaagttcggcggcact

SEQ ID NO: 494138 - DNA, 25 bp, Mus musculus
gagtcacctaggaccatcgagacac

SEQ ID NO: 494139 - DNA, 25 bp, Mus musculus
gagtcacctaggtccatcgagacac

SEQ ID NO: 494140 - DNA, 25 bp, Mus musculus
gagtcacctcccagtagatttgtag

SEQ ID NO: 494141 - DNA, 25 bp, Mus musculus
gagtcacctccctgtagatttgtag

SEQ ID NO: 494142 - DNA, 25 bp, Mus musculus
gagtcacctcggaatgcctagggag

SEQ ID NO: 494143 - DNA, 25 bp, Mus musculus
gagtcacctcggtatgcctagggag

SEQ ID NO: 494144 - DNA, 25 bp, Mus musculus
gagtcacctcgtaagaaatccagat

SEQ ID NO: 494145 - DNA, 25 bp, Mus musculus
gagtcacctcgttagaaatccagat

SEQ ID NO: 494146 - DNA, 25 bp, Mus musculus
gagtcacctgagaacttaacatttt

SEQ ID NO: 494147 - DNA, 25 bp, Mus musculus
gagtcacctgagtacttaacatttt

SEQ ID NO: 494148 - DNA, 25 bp, Mus musculus
gagtcacctgctcgtagtagacatg

SEQ ID NO: 494149 - DNA, 25 bp, Mus musculus
gagtcacctgctggtagtagacatg

SEQ ID NO: 494150 - DNA, 25 bp, Mus musculus
gagtcacctgtaatcctgcaggcag

SEQ ID NO: 494151 - DNA, 25 bp, Mus musculus
gagtcacctgtattcctgcaggcag

SEQ ID NO: 494152 - DNA, 25 bp, Mus musculus
gagtcacctgtgagtcagccgcaga

SEQ ID NO: 494153 - DNA, 25 bp, Mus musculus
gagtcacctgtgtgtcagccgcaga

SEQ ID NO: 494154 - DNA, 25 bp, Mus musculus
gagtcaccttcaatttcctgttact

SEQ ID NO: 494155 - DNA, 25 bp, Mus musculus
gagtcaccttcattttcctgttact

SEQ ID NO: 494156 - DNA, 25 bp, Mus musculus
gagtcaccttgcattagttcattcc

SEQ ID NO: 494157 - DNA, 25 bp, Mus musculus
gagtcaccttgctttagttcattcc

SEQ ID NO: 494158 - DNA, 25 bp, Mus musculus
gagtcacctttgagcacacaccaag

SEQ ID NO: 494159 - DNA, 25 bp, Mus musculus
gagtcacctttgtgcacacaccaag

SEQ ID NO: 494160 - DNA, 25 bp, Mus musculus
gagtcacgacgtagccagaatacca

SEQ ID NO: 494161 - DNA, 25 bp, Mus musculus
gagtcacgacgttgccagaatacca

SEQ ID NO: 494162 - DNA, 25 bp, Mus musculus
gagtcacggcagcacaagatccagc

SEQ ID NO: 494163 - DNA, 25 bp, Mus musculus
gagtcacggcaggacaagatccagc

SEQ ID NO: 494164 - DNA, 25 bp, Mus musculus
gagtcacgggacatgtgcttcggct

SEQ ID NO: 494165 - DNA, 25 bp, Mus musculus
gagtcacgggacttgtgcttcggct

SEQ ID NO: 494166 - DNA, 25 bp, Mus musculus
gagtcacgggctaccttagaattgg

SEQ ID NO: 494167 - DNA, 25 bp, Mus musculus
gagtcacgggcttccttagaattgg

SEQ ID NO: 494168 - DNA, 25 bp, Mus musculus
gagtcacgtccgactaaaaccggat

SEQ ID NO: 494169 - DNA, 25 bp, Mus musculus
gagtcacgtccgtctaaaaccggat

SEQ ID NO: 494170 - DNA, 25 bp, Mus musculus
gagtcacgtggaaagggcctctcct

SEQ ID NO: 494171 - DNA, 25 bp, Mus musculus
gagtcacgtggatagggcctctcct

SEQ ID NO: 494172 - DNA, 25 bp, Mus musculus
gagtcactaagaaccctccaatcag

SEQ ID NO: 494173 - DNA, 25 bp, Mus musculus
gagtcactaagatccctccaatcag

SEQ ID NO: 494174 - DNA, 25 bp, Mus musculus
gagtcactactccacatggtggtag

SEQ ID NO: 494175 - DNA, 25 bp, Mus musculus
gagtcactactcgacatggtggtag

SEQ ID NO: 494176 - DNA, 25 bp, Mus musculus
gagtcactagtcagtattcatgctt

SEQ ID NO: 494177 - DNA, 25 bp, Mus musculus
gagtcactagtctgtattcatgctt

SEQ ID NO: 494178 - DNA, 25 bp, Mus musculus
gagtcactagtgaccaacagccttt

SEQ ID NO: 494179 - DNA, 25 bp, Mus musculus
gagtcactagtgtccaacagccttt

SEQ ID NO: 494180 - DNA, 25 bp, Mus musculus
gagtcactcagcaaggccttatatc

SEQ ID NO: 494181 - DNA, 25 bp, Mus musculus
gagtcactcagctaggccttatatc

SEQ ID NO: 494182 - DNA, 25 bp, Mus musculus
gagtcactcaggattggaccagaac

SEQ ID NO: 494183 - DNA, 25 bp, Mus musculus
gagtcactcaggtttggaccagaac

SEQ ID NO: 494184 - DNA, 25 bp, Mus musculus
gagtcactgactctgttcacacaac

SEQ ID NO: 494185 - DNA, 25 bp, Mus musculus
gagtcactgactgtgttcacacaac

SEQ ID NO: 494186 - DNA, 25 bp, Mus musculus
gagtcactgattccagctttgctga

SEQ ID NO: 494187 - DNA, 25 bp, Mus musculus
gagtcactgattgcagctttgctga

SEQ ID NO: 494188 - DNA, 25 bp, Mus musculus
gagtcactgcagcagcaagtgctct

SEQ ID NO: 494189 - DNA, 25 bp, Mus musculus
gagtcactgcagctatgggcatttg

SEQ ID NO: 494190 - DNA, 25 bp, Mus musculus
gagtcactgcagcttctttgtgtta

SEQ ID NO: 494191 - DNA, 25 bp, Mus musculus
gagtcactgcaggagcaagtgctct

SEQ ID NO: 494192 - DNA, 25 bp, Mus musculus
gagtcactgcaggtatgggcatttg

SEQ ID NO: 494193 - DNA, 25 bp, Mus musculus
gagtcactgcaggttctttgtgtta

SEQ ID NO: 494194 - DNA, 25 bp, Mus musculus
gagtcactgctaatatactcattgt

SEQ ID NO: 494195 - DNA, 25 bp, Mus musculus
gagtcactgctattatactcattgt

SEQ ID NO: 494196 - DNA, 25 bp, Mus musculus
gagtcactggtcaaggaaatggaga

SEQ ID NO: 494197 - DNA, 25 bp, Mus musculus
gagtcactggtctaggaaatggaga

SEQ ID NO: 494198 - DNA, 25 bp, Mus musculus
gagtcactggtgcaaacattttcat

SEQ ID NO: 494199 - DNA, 25 bp, Mus musculus
gagtcactggtggaaacattttcat

SEQ ID NO: 494200 - DNA, 25 bp, Mus musculus
gagtcactgtaaccataaactacct

SEQ ID NO: 494201 - DNA, 25 bp, Mus musculus
gagtcactgtaagcataaactacct

SEQ ID NO: 494202 - DNA, 25 bp, Mus musculus
gagtcactgtaccatgattctactt

SEQ ID NO: 494203 - DNA, 25 bp, Mus musculus
gagtcactgtacgatgattctactt

SEQ ID NO: 494204 - DNA, 25 bp, Mus musculus
gagtcactgtagctcaagagccgtt

SEQ ID NO: 494205 - DNA, 25 bp, Mus musculus
gagtcactgtaggtcaagagccgtt

SEQ ID NO: 494206 - DNA, 25 bp, Mus musculus
gagtcactgtgaatccctatgagtt

SEQ ID NO: 494207 - DNA, 25 bp, Mus musculus
gagtcactgtgattccctatgagtt

SEQ ID NO: 494208 - DNA, 25 bp, Mus musculus
gagtcactgtggacagatccaccat

SEQ ID NO: 494209 - DNA, 25 bp, Mus musculus
gagtcactgtggtcagatccaccat

SEQ ID NO: 494210 - DNA, 25 bp, Mus musculus
gagtcactgttccagggttagctct

SEQ ID NO: 494211 - DNA, 25 bp, Mus musculus
gagtcactgttcgagggttagctct

SEQ ID NO: 494212 - DNA, 25 bp, Mus musculus
gagtcactgttgatcggcagcctgg

SEQ ID NO: 494213 - DNA, 25 bp, Mus musculus
gagtcactgttgttcggcagcctgg

SEQ ID NO: 494214 - DNA, 25 bp, Mus musculus
gagtcacttactcaagtagcacatc

SEQ ID NO: 494215 - DNA, 25 bp, Mus musculus
gagtcacttactgaagtagcacatc

SEQ ID NO: 494216 - DNA, 25 bp, Mus musculus
gagtcacttagaactctcattgctt

SEQ ID NO: 494217 - DNA, 25 bp, Mus musculus
gagtcacttagatctctcattgctt

SEQ ID NO: 494218 - DNA, 25 bp, Mus musculus
gagtcacttattactgcaattcaag

SEQ ID NO: 494219 - DNA, 25 bp, Mus musculus
gagtcacttatttctgcaattcaag

SEQ ID NO: 494220 - DNA, 25 bp, Mus musculus
gagtcacttcacatgctctgtaaag

SEQ ID NO: 494221 - DNA, 25 bp, Mus musculus
gagtcacttcacttgctctgtaaag

SEQ ID NO: 494222 - DNA, 25 bp, Mus musculus
gagtcacttccaagttatgggaaat

SEQ ID NO: 494223 - DNA, 25 bp, Mus musculus
gagtcacttccatgttatgggaaat

SEQ ID NO: 494224 - DNA, 25 bp, Mus musculus
gagtcacttctaaaggttcctagta

SEQ ID NO: 494225 - DNA, 25 bp, Mus musculus
gagtcacttctataggttcctagta

SEQ ID NO: 494226 - DNA, 25 bp, Mus musculus
gagtcacttctgacggaggcaggcc

SEQ ID NO: 494227 - DNA, 25 bp, Mus musculus
gagtcacttctgtcggaggcaggcc

SEQ ID NO: 494228 - DNA, 25 bp, Mus musculus
gagtcagaaaggacctcgaggccct

SEQ ID NO: 494229 - DNA, 25 bp, Mus musculus
gagtcagaaaggtcctcgaggccct

SEQ ID NO: 494230 - DNA, 25 bp, Mus musculus
gagtcagaacatctcaatcaaagtt

SEQ ID NO: 494231 - DNA, 25 bp, Mus musculus
gagtcagaacatgtcaatcaaagtt

SEQ ID NO: 494232 - DNA, 25 bp, Mus musculus
gagtcagaagctacggaaatcacaa

SEQ ID NO: 494233 - DNA, 25 bp, Mus musculus
gagtcagaagcttcggaaatcacaa

SEQ ID NO: 494234 - DNA, 25 bp, Mus musculus
gagtcagaattgcatttgacaccat

SEQ ID NO: 494235 - DNA, 25 bp, Mus musculus
gagtcagaattggatttgacaccat

SEQ ID NO: 494236 - DNA, 25 bp, Mus musculus
gagtcagacagaatcctgaaggtca

SEQ ID NO: 494237 - DNA, 25 bp, Mus musculus
gagtcagacagattcctgaaggtca

SEQ ID NO: 494238 - DNA, 25 bp, Mus musculus
gagtcagacatgcaggtccagattt

SEQ ID NO: 494239 - DNA, 25 bp, Mus musculus
gagtcagacatgcttcacaggcttc

SEQ ID NO: 494240 - DNA, 25 bp, Mus musculus
gagtcagacatggaggtccagattt

SEQ ID NO: 494241 - DNA, 25 bp, Mus musculus
gagtcagacatggttcacaggcttc

SEQ ID NO: 494242 - DNA, 25 bp, Mus musculus
gagtcagaccatccttggtgtttct

SEQ ID NO: 494243 - DNA, 25 bp, Mus musculus
gagtcagaccatgcttggtgtttct

SEQ ID NO: 494244 - DNA, 25 bp, Mus musculus
gagtcagacccaaaagcctgcttgt

SEQ ID NO: 494245 - DNA, 25 bp, Mus musculus
gagtcagacccataagcctgcttgt

SEQ ID NO: 494246 - DNA, 25 bp, Mus musculus
gagtcagacgataccctctaggtca

SEQ ID NO: 494247 - DNA, 25 bp, Mus musculus
gagtcagacgattccctctaggtca

SEQ ID NO: 494248 - DNA, 25 bp, Mus musculus
gagtcagactcaacctgtaagcatt

SEQ ID NO: 494249 - DNA, 25 bp, Mus musculus
gagtcagactcatcctgtaagcatt

SEQ ID NO: 494250 - DNA, 25 bp, Mus musculus
gagtcagactctacaagatcaagct

SEQ ID NO: 494251 - DNA, 25 bp, Mus musculus
gagtcagactcttcaagatcaagct

SEQ ID NO: 494252 - DNA, 25 bp, Mus musculus
gagtcagactgaagtcattggacct

SEQ ID NO: 494253 - DNA, 25 bp, Mus musculus
gagtcagactgatgtcattggacct

SEQ ID NO: 494254 - DNA, 25 bp, Mus musculus
gagtcagacttacttactcccaggg

SEQ ID NO: 494255 - DNA, 25 bp, Mus musculus
gagtcagacttagttactcccaggg

SEQ ID NO: 494256 - DNA, 25 bp, Mus musculus
gagtcagagacaacccctgtagctg

SEQ ID NO: 494257 - DNA, 25 bp, Mus musculus
gagtcagagacatcccctgtagctg

SEQ ID NO: 494258 - DNA, 25 bp, Mus musculus
gagtcagagagtaggccaggctttt

SEQ ID NO: 494259 - DNA, 25 bp, Mus musculus
gagtcagagagttggccaggctttt

SEQ ID NO: 494260 - DNA, 25 bp, Mus musculus
gagtcagagcacagggtgtgttcca

SEQ ID NO: 494261 - DNA, 25 bp, Mus musculus
gagtcagagcactgggtgtgttcca

SEQ ID NO: 494262 - DNA, 25 bp, Mus musculus
gagtcagagcctagtctgttagact

SEQ ID NO: 494263 - DNA, 25 bp, Mus musculus
gagtcagagccttgtctgttagact

SEQ ID NO: 494264 - DNA, 25 bp, Mus musculus
gagtcagagctgatccggcagagct

SEQ ID NO: 494265 - DNA, 25 bp, Mus musculus
gagtcagagctgttccggcagagct

SEQ ID NO: 494266 - DNA, 25 bp, Mus musculus
gagtcagaggacatcattgttttaa

SEQ ID NO: 494267 - DNA, 25 bp, Mus musculus
gagtcagaggacttcattgttttaa

SEQ ID NO: 494268 - DNA, 25 bp, Mus musculus
gagtcagaggccacctcagagccag

SEQ ID NO: 494269 - DNA, 25 bp, Mus musculus
gagtcagaggcctcctcagagccag

SEQ ID NO: 494270 - DNA, 25 bp, Mus musculus
gagtcagagtcaaacaccagtgtgg

SEQ ID NO: 494271 - DNA, 25 bp, Mus musculus
gagtcagagtcatacaccagtgtgg

SEQ ID NO: 494272 - DNA, 25 bp, Mus musculus
gagtcagataccctgggcctggatt

SEQ ID NO: 494273 - DNA, 25 bp, Mus musculus
gagtcagataccgtgggcctggatt

SEQ ID NO: 494274 - DNA, 25 bp, Mus musculus
gagtcagatagaccaccatggagat

SEQ ID NO: 494275 - DNA, 25 bp, Mus musculus
gagtcagatagagcaccatggagat

SEQ ID NO: 494276 - DNA, 25 bp, Mus musculus
gagtcagatccacgcttttacagaa

SEQ ID NO: 494277 - DNA, 25 bp, Mus musculus
gagtcagatccaggcttttacagaa

SEQ ID NO: 494278 - DNA, 25 bp, Mus musculus
gagtcagatcccctgctccaggcag

SEQ ID NO: 494279 - DNA, 25 bp, Mus musculus
gagtcagatcccgtgctccaggcag

SEQ ID NO: 494280 - DNA, 25 bp, Mus musculus
gagtcagatcgcacagatcctggaa

SEQ ID NO: 494281 - DNA, 25 bp, Mus musculus
gagtcagatcgctcagatcctggaa

SEQ ID NO: 494282 - DNA, 25 bp, Mus musculus
gagtcagatgatattattttccgat

SEQ ID NO: 494283 - DNA, 25 bp, Mus musculus
gagtcagatgattttattttccgat

SEQ ID NO: 494284 - DNA, 25 bp, Mus musculus
gagtcagatgcaaagctttcctcct

SEQ ID NO: 494285 - DNA, 25 bp, Mus musculus
gagtcagatgcatagctttcctcct

SEQ ID NO: 494286 - DNA, 25 bp, Mus musculus
gagtcagatgtcacggcatcggaac

SEQ ID NO: 494287 - DNA, 25 bp, Mus musculus
gagtcagatgtctcggcatcggaac

SEQ ID NO: 494288 - DNA, 25 bp, Mus musculus
gagtcagattacagatcccaggcag

SEQ ID NO: 494289 - DNA, 25 bp, Mus musculus
gagtcagattactgatcccaggcag

SEQ ID NO: 494290 - DNA, 25 bp, Mus musculus
gagtcagcactcatctgcagtctgt

SEQ ID NO: 494291 - DNA, 25 bp, Mus musculus
gagtcagcactcttctgcagtctgt

SEQ ID NO: 494292 - DNA, 25 bp, Mus musculus
gagtcagcagacacttagtactctg

SEQ ID NO: 494293 - DNA, 25 bp, Mus musculus
gagtcagcagactcttagtactctg

SEQ ID NO: 494294 - DNA, 25 bp, Mus musculus
gagtcagcagggattcttttaagga

SEQ ID NO: 494295 - DNA, 25 bp, Mus musculus
gagtcagcagggtttcttttaagga

SEQ ID NO: 494296 - DNA, 25 bp, Mus musculus
gagtcagcagttctgaagcaaagtc

SEQ ID NO: 494297 - DNA, 25 bp, Mus musculus
gagtcagcagttgtgaagcaaagtc

SEQ ID NO: 494298 - DNA, 25 bp, Mus musculus
gagtcagccaaaaccgtgtaatcaa

SEQ ID NO: 494299 - DNA, 25 bp, Mus musculus
gagtcagccaaatccgtgtaatcaa

SEQ ID NO: 494300 - DNA, 25 bp, Mus musculus
gagtcagcccatcacagaactacta

SEQ ID NO: 494301 - DNA, 25 bp, Mus musculus
gagtcagcccatgacagaactacta

SEQ ID NO: 494302 - DNA, 25 bp, Mus musculus
gagtcagccctacccatggattagc

SEQ ID NO: 494303 - DNA, 25 bp, Mus musculus
gagtcagccctagccatggattagc

SEQ ID NO: 494304 - DNA, 25 bp, Mus musculus
gagtcagccggccaatgcagaatcg

SEQ ID NO: 494305 - DNA, 25 bp, Mus musculus
gagtcagccggcgaatgcagaatcg

SEQ ID NO: 494306 - DNA, 25 bp, Mus musculus
gagtcagcctcacatcccaagagca

SEQ ID NO: 494307 - DNA, 25 bp, Mus musculus
gagtcagcctcagatcccaagagca

SEQ ID NO: 494308 - DNA, 25 bp, Mus musculus
gagtcagcctctatatgagaccgtg

SEQ ID NO: 494309 - DNA, 25 bp, Mus musculus
gagtcagcctctttatgagaccgtg

SEQ ID NO: 494310 - DNA, 25 bp, Mus musculus
gagtcagcctgaattgatctgcccg

SEQ ID NO: 494311 - DNA, 25 bp, Mus musculus
gagtcagcctgactgaactcagtgt

SEQ ID NO: 494312 - DNA, 25 bp, Mus musculus
gagtcagcctgagtgaactcagtgt

SEQ ID NO: 494313 - DNA, 25 bp, Mus musculus
gagtcagcctgatttgatctgcccg

SEQ ID NO: 494314 - DNA, 25 bp, Mus musculus
gagtcagcgccgaatcttgtggaca

SEQ ID NO: 494315 - DNA, 25 bp, Mus musculus
gagtcagcgccgtatcttgtggaca

SEQ ID NO: 494316 - DNA, 25 bp, Mus musculus
gagtcagcgctcctatagttttcat

SEQ ID NO: 494317 - DNA, 25 bp, Mus musculus
gagtcagcgctcgtatagttttcat

SEQ ID NO: 494318 - DNA, 25 bp, Mus musculus
gagtcagcgctgaatgtatgtcatg

SEQ ID NO: 494319 - DNA, 25 bp, Mus musculus
gagtcagcgctgtatgtatgtcatg

SEQ ID NO: 494320 - DNA, 25 bp, Mus musculus
gagtcagcgttgcaggttcacagca

SEQ ID NO: 494321 - DNA, 25 bp, Mus musculus
gagtcagcgttggaggttcacagca

SEQ ID NO: 494322 - DNA, 25 bp, Mus musculus
gagtcagctactcagagctctggaa

SEQ ID NO: 494323 - DNA, 25 bp, Mus musculus
gagtcagctactgagagctctggaa

SEQ ID NO: 494324 - DNA, 25 bp, Mus musculus
gagtcagctagccagtgtctcgaga

SEQ ID NO: 494325 - DNA, 25 bp, Mus musculus
gagtcagctagcgagtgtctcgaga

SEQ ID NO: 494326 - DNA, 25 bp, Mus musculus
gagtcagctataacaaacgatgttt

SEQ ID NO: 494327 - DNA, 25 bp, Mus musculus
gagtcagctatatcaaacgatgttt

SEQ ID NO: 494328 - DNA, 25 bp, Mus musculus
gagtcagctcgtcaacctcctgtgt

SEQ ID NO: 494329 - DNA, 25 bp, Mus musculus
gagtcagctcgtgaacctcctgtgt

SEQ ID NO: 494330 - DNA, 25 bp, Mus musculus
gagtcagctctgagtcagcttgtag

SEQ ID NO: 494331 - DNA, 25 bp, Mus musculus
gagtcagctctgtgtcagcttgtag

SEQ ID NO: 494332 - DNA, 25 bp, Mus musculus
gagtcagctcttattcttgggagta

SEQ ID NO: 494333 - DNA, 25 bp, Mus musculus
gagtcagctcttattgtagatgtct

SEQ ID NO: 494334 - DNA, 25 bp, Mus musculus
gagtcagctctttttcttgggagta

SEQ ID NO: 494335 - DNA, 25 bp, Mus musculus
gagtcagctctttttgtagatgtct

SEQ ID NO: 494336 - DNA, 25 bp, Mus musculus
gagtcagctgtcctgtctgattctg

SEQ ID NO: 494337 - DNA, 25 bp, Mus musculus
gagtcagctgtcgtgtctgattctg

SEQ ID NO: 494338 - DNA, 25 bp, Mus musculus
gagtcagcttgcatatctatccaga

SEQ ID NO: 494339 - DNA, 25 bp, Mus musculus
gagtcagcttgcttatctatccaga

SEQ ID NO: 494340 - DNA, 25 bp, Mus musculus
gagtcagcttttcatgggtgattat

SEQ ID NO: 494341 - DNA, 25 bp, Mus musculus
gagtcagcttttgatgggtgattat

SEQ ID NO: 494342 - DNA, 25 bp, Mus musculus
gagtcaggaacacctctaaaccacc

SEQ ID NO: 494343 - DNA, 25 bp, Mus musculus
gagtcaggaacagctctaaaccacc

SEQ ID NO: 494344 - DNA, 25 bp, Mus musculus
gagtcaggacacaattctgcccgaa

SEQ ID NO: 494345 - DNA, 25 bp, Mus musculus
gagtcaggacactattctgcccgaa

SEQ ID NO: 494346 - DNA, 25 bp, Mus musculus
gagtcaggacatatgagttctcgtc

SEQ ID NO: 494347 - DNA, 25 bp, Mus musculus
gagtcaggacatttgagttctcgtc

SEQ ID NO: 494348 - DNA, 25 bp, Mus musculus
gagtcaggacccacatttcttctgg

SEQ ID NO: 494349 - DNA, 25 bp, Mus musculus
gagtcaggaccctcatttcttctgg

SEQ ID NO: 494350 - DNA, 25 bp, Mus musculus
gagtcaggactgctacttgccactt

SEQ ID NO: 494351 - DNA, 25 bp, Mus musculus
gagtcaggactggtacttgccactt

SEQ ID NO: 494352 - DNA, 25 bp, Mus musculus
gagtcaggacttccctgtggacacc

SEQ ID NO: 494353 - DNA, 25 bp, Mus musculus
gagtcaggacttgcctgtggacacc

SEQ ID NO: 494354 - DNA, 25 bp, Mus musculus
gagtcaggagaccttctgttgtcag

SEQ ID NO: 494355 - DNA, 25 bp, Mus musculus
gagtcaggagacgttctgttgtcag

SEQ ID NO: 494356 - DNA, 25 bp, Mus musculus
gagtcaggaggtcagaacccctccc

SEQ ID NO: 494357 - DNA, 25 bp, Mus musculus
gagtcaggaggtgagaacccctccc

SEQ ID NO: 494358 - DNA, 25 bp, Mus musculus
gagtcaggctaccatccttatgagg

SEQ ID NO: 494359 - DNA, 25 bp, Mus musculus
gagtcaggctacgatccttatgagg

SEQ ID NO: 494360 - DNA, 25 bp, Mus musculus
gagtcaggctagatttagttcattg

SEQ ID NO: 494361 - DNA, 25 bp, Mus musculus
gagtcaggctagttttagttcattg

SEQ ID NO: 494362 - DNA, 25 bp, Mus musculus
gagtcaggcttgctatttacactag

SEQ ID NO: 494363 - DNA, 25 bp, Mus musculus
gagtcaggcttggtatttacactag

SEQ ID NO: 494364 - DNA, 25 bp, Mus musculus
gagtcagggaacaaatggtcctaca

SEQ ID NO: 494365 - DNA, 25 bp, Mus musculus
gagtcagggaactaatggtcctaca

SEQ ID NO: 494366 - DNA, 25 bp, Mus musculus
gagtcagggacaaccactgctctat

SEQ ID NO: 494367 - DNA, 25 bp, Mus musculus
gagtcagggacatccactgctctat

SEQ ID NO: 494368 - DNA, 25 bp, Mus musculus
gagtcagggcagcatttccagcccc

SEQ ID NO: 494369 - DNA, 25 bp, Mus musculus
gagtcagggcaggatttccagcccc

SEQ ID NO: 494370 - DNA, 25 bp, Mus musculus
gagtcagggctgaataccacatcac

SEQ ID NO: 494371 - DNA, 25 bp, Mus musculus
gagtcagggctgtataccacatcac

SEQ ID NO: 494372 - DNA, 25 bp, Mus musculus
gagtcagggtcgctctcagtcttct

SEQ ID NO: 494373 - DNA, 25 bp, Mus musculus
gagtcagggtcggtctcagtcttct

SEQ ID NO: 494374 - DNA, 25 bp, Mus musculus
gagtcaggtaagctggtgcattcct

SEQ ID NO: 494375 - DNA, 25 bp, Mus musculus
gagtcaggtaaggtggtgcattcct

SEQ ID NO: 494376 - DNA, 25 bp, Mus musculus
gagtcaggtcaaaccttcagagctg

SEQ ID NO: 494377 - DNA, 25 bp, Mus musculus
gagtcaggtcaatccttcagagctg

SEQ ID NO: 494378 - DNA, 25 bp, Mus musculus
gagtcaggtcagagtcagccatttc

SEQ ID NO: 494379 - DNA, 25 bp, Mus musculus
gagtcaggtcagtgtcagccatttc

SEQ ID NO: 494380 - DNA, 25 bp, Mus musculus
gagtcaggtcccagcttagaatcac

SEQ ID NO: 494381 - DNA, 25 bp, Mus musculus
gagtcaggtccctgcttagaatcac

SEQ ID NO: 494382 - DNA, 25 bp, Mus musculus
gagtcaggtgggacacacatcggat

SEQ ID NO: 494383 - DNA, 25 bp, Mus musculus
gagtcaggtgggtcacacatcggat

SEQ ID NO: 494384 - DNA, 25 bp, Mus musculus
gagtcaggttgcctttcggtattaa

SEQ ID NO: 494385 - DNA, 25 bp, Mus musculus
gagtcaggttgcgtttcggtattaa

SEQ ID NO: 494386 - DNA, 25 bp, Mus musculus
gagtcaggtttaaaggcctccttgc

SEQ ID NO: 494387 - DNA, 25 bp, Mus musculus
gagtcaggtttataggcctccttgc

SEQ ID NO: 494388 - DNA, 25 bp, Mus musculus
gagtcaggttttcttcagttagatg

SEQ ID NO: 494389 - DNA, 25 bp, Mus musculus
gagtcaggttttgttcagttagatg

SEQ ID NO: 494390 - DNA, 25 bp, Mus musculus
gagtcagtaactataagccaggtgt

SEQ ID NO: 494391 - DNA, 25 bp, Mus musculus
gagtcagtaactttaagccaggtgt

SEQ ID NO: 494392 - DNA, 25 bp, Mus musculus
gagtcagtagcacatcacttgtcta

SEQ ID NO: 494393 - DNA, 25 bp, Mus musculus
gagtcagtagcagatcacttgtcta

SEQ ID NO: 494394 - DNA, 25 bp, Mus musculus
gagtcagtaggcacaacttctgatt

SEQ ID NO: 494395 - DNA, 25 bp, Mus musculus
gagtcagtaggctcaacttctgatt

SEQ ID NO: 494396 - DNA, 25 bp, Mus musculus
gagtcagtagtcaatgcatgttgta

SEQ ID NO: 494397 - DNA, 25 bp, Mus musculus
gagtcagtagtctatgcatgttgta

SEQ ID NO: 494398 - DNA, 25 bp, Mus musculus
gagtcagtcaagacctggatccaat

SEQ ID NO: 494399 - DNA, 25 bp, Mus musculus
gagtcagtcaagtcctggatccaat

SEQ ID NO: 494400 - DNA, 25 bp, Mus musculus
gagtcagtccctaaactttgcaatt

SEQ ID NO: 494401 - DNA, 25 bp, Mus musculus
gagtcagtcccttaactttgcaatt

SEQ ID NO: 494402 - DNA, 25 bp, Mus musculus
gagtcagtcctacgatgcaggctta

SEQ ID NO: 494403 - DNA, 25 bp, Mus musculus
gagtcagtcctaggatgcaggctta

SEQ ID NO: 494404 - DNA, 25 bp, Mus musculus
gagtcagtcgtgaatttaagagttc

SEQ ID NO: 494405 - DNA, 25 bp, Mus musculus
gagtcagtcgtgtatttaagagttc

SEQ ID NO: 494406 - DNA, 25 bp, Mus musculus
gagtcagtctatccagaacacaagt

SEQ ID NO: 494407 - DNA, 25 bp, Mus musculus
gagtcagtctatgcagaacacaagt

SEQ ID NO: 494408 - DNA, 25 bp, Mus musculus
gagtcagtctcaccatcttcaatta

SEQ ID NO: 494409 - DNA, 25 bp, Mus musculus
gagtcagtctcagcatcttcaatta

SEQ ID NO: 494410 - DNA, 25 bp, Mus musculus
gagtcagtctctaatcatatgggat

SEQ ID NO: 494411 - DNA, 25 bp, Mus musculus
gagtcagtctctcaggcctggatac

SEQ ID NO: 494412 - DNA, 25 bp, Mus musculus
gagtcagtctctgaggcctggatac

SEQ ID NO: 494413 - DNA, 25 bp, Mus musculus
gagtcagtctcttatcatatgggat

SEQ ID NO: 494414 - DNA, 25 bp, Mus musculus
gagtcagtctgcatctaagacaccc

SEQ ID NO: 494415 - DNA, 25 bp, Mus musculus
gagtcagtctgcctccagaaatggc

SEQ ID NO: 494416 - DNA, 25 bp, Mus musculus
gagtcagtctgcgtccagaaatggc

SEQ ID NO: 494417 - DNA, 25 bp, Mus musculus
gagtcagtctgcttctaagacaccc

SEQ ID NO: 494418 - DNA, 25 bp, Mus musculus
gagtcagtgaacctgcggagggcaa

SEQ ID NO: 494419 - DNA, 25 bp, Mus musculus
gagtcagtgaacgtgcggagggcaa

SEQ ID NO: 494420 - DNA, 25 bp, Mus musculus
gagtcagtgagccaatatttcccaa

SEQ ID NO: 494421 - DNA, 25 bp, Mus musculus
gagtcagtgagcgaatatttcccaa

SEQ ID NO: 494422 - DNA, 25 bp, Mus musculus
gagtcagtgagtaggtttcctttcc

SEQ ID NO: 494423 - DNA, 25 bp, Mus musculus
gagtcagtgagttggtttcctttcc

SEQ ID NO: 494424 - DNA, 25 bp, Mus musculus
gagtcagtgcaaagccttgtttctt

SEQ ID NO: 494425 - DNA, 25 bp, Mus musculus
gagtcagtgcaatgccttgtttctt

SEQ ID NO: 494426 - DNA, 25 bp, Mus musculus
gagtcagtgcccctggagttcatcc

SEQ ID NO: 494427 - DNA, 25 bp, Mus musculus
gagtcagtgcccgtggagttcatcc

SEQ ID NO: 494428 - DNA, 25 bp, Mus musculus
gagtcagtgcctcgcaccgtaggca

SEQ ID NO: 494429 - DNA, 25 bp, Mus musculus
gagtcagtgcctggcaccgtaggca

SEQ ID NO: 494430 - DNA, 25 bp, Mus musculus
gagtcagtgctcatcctttgtgtga

SEQ ID NO: 494431 - DNA, 25 bp, Mus musculus
gagtcagtgctcatggacctcaaag

SEQ ID NO: 494432 - DNA, 25 bp, Mus musculus
gagtcagtgctcttcctttgtgtga

SEQ ID NO: 494433 - DNA, 25 bp, Mus musculus
gagtcagtgctcttggacctcaaag

SEQ ID NO: 494434 - DNA, 25 bp, Mus musculus
gagtcagtgtccaggctgcagtcag

SEQ ID NO: 494435 - DNA, 25 bp, Mus musculus
gagtcagtgtccagtatttgatccc

SEQ ID NO: 494436 - DNA, 25 bp, Mus musculus
gagtcagtgtcctggctgcagtcag

SEQ ID NO: 494437 - DNA, 25 bp, Mus musculus
gagtcagtgtcctgtatttgatccc

SEQ ID NO: 494438 - DNA, 25 bp, Mus musculus
gagtcagttcaaacttaggaacaac

SEQ ID NO: 494439 - DNA, 25 bp, Mus musculus
gagtcagttcaatcttaggaacaac

SEQ ID NO: 494440 - DNA, 25 bp, Mus musculus
gagtcagttcctaagtgttcaccaa

SEQ ID NO: 494441 - DNA, 25 bp, Mus musculus
gagtcagttccttagtgttcaccaa

SEQ ID NO: 494442 - DNA, 25 bp, Mus musculus
gagtcagttctcaaaccatgtaggt

SEQ ID NO: 494443 - DNA, 25 bp, Mus musculus
gagtcagttctcaactttcactctg

SEQ ID NO: 494444 - DNA, 25 bp, Mus musculus
gagtcagttctctaaccatgtaggt

SEQ ID NO: 494445 - DNA, 25 bp, Mus musculus
gagtcagttctctactttcactctg

SEQ ID NO: 494446 - DNA, 25 bp, Mus musculus
gagtcagttgagaccaaatgccata

SEQ ID NO: 494447 - DNA, 25 bp, Mus musculus
gagtcagttgagtccaaatgccata

SEQ ID NO: 494448 - DNA, 25 bp, Mus musculus
gagtcagttttccttcagcgcgtgc

SEQ ID NO: 494449 - DNA, 25 bp, Mus musculus
gagtcagttttcgttcagcgcgtgc

SEQ ID NO: 494450 - DNA, 25 bp, Mus musculus
gagtcagttttgagtcctttcagat

SEQ ID NO: 494451 - DNA, 25 bp, Mus musculus
gagtcagttttgtgtcctttcagat

SEQ ID NO: 494452 - DNA, 25 bp, Mus musculus
gagtcagtttttcaacttgcatatc

SEQ ID NO: 494453 - DNA, 25 bp, Mus musculus
gagtcagtttttgaacttgcatatc

SEQ ID NO: 494454 - DNA, 25 bp, Mus musculus
gagtcataaaataccagccagcctg

SEQ ID NO: 494455 - DNA, 25 bp, Mus musculus
gagtcataaaattccagccagcctg

SEQ ID NO: 494456 - DNA, 25 bp, Mus musculus
gagtcataaatcaagcctcatcccc

SEQ ID NO: 494457 - DNA, 25 bp, Mus musculus
gagtcataaatctagcctcatcccc

SEQ ID NO: 494458 - DNA, 25 bp, Mus musculus
gagtcataatccaagtgaattacta

SEQ ID NO: 494459 - DNA, 25 bp, Mus musculus
gagtcataatcctagtgaattacta

SEQ ID NO: 494460 - DNA, 25 bp, Mus musculus
gagtcataatggctacgtcactgga

SEQ ID NO: 494461 - DNA, 25 bp, Mus musculus
gagtcataatgggtacgtcactgga

SEQ ID NO: 494462 - DNA, 25 bp, Mus musculus
gagtcatagaccaggatgtgttcct

SEQ ID NO: 494463 - DNA, 25 bp, Mus musculus
gagtcatagacctggatgtgttcct

SEQ ID NO: 494464 - DNA, 25 bp, Mus musculus
gagtcataggatcttcccaggatct

SEQ ID NO: 494465 - DNA, 25 bp, Mus musculus
gagtcataggatgttcccaggatct

SEQ ID NO: 494466 - DNA, 25 bp, Mus musculus
gagtcatagggaagctggcaaccaa

SEQ ID NO: 494467 - DNA, 25 bp, Mus musculus
gagtcatagggatgctggcaaccaa

SEQ ID NO: 494468 - DNA, 25 bp, Mus musculus
gagtcataggtgactcactcacctt

SEQ ID NO: 494469 - DNA, 25 bp, Mus musculus
gagtcataggtgtctcactcacctt

SEQ ID NO: 494470 - DNA, 25 bp, Mus musculus
gagtcatagtcacgtggatgtctgt

SEQ ID NO: 494471 - DNA, 25 bp, Mus musculus
gagtcatagtcaggtggatgtctgt

SEQ ID NO: 494472 - DNA, 25 bp, Mus musculus
gagtcatagtctagcctacattgtt

SEQ ID NO: 494473 - DNA, 25 bp, Mus musculus
gagtcatagtcttgcctacattgtt

SEQ ID NO: 494474 - DNA, 25 bp, Mus musculus
gagtcatatatccaaacttatgcta

SEQ ID NO: 494475 - DNA, 25 bp, Mus musculus
gagtcatatatcgaaacttatgcta

SEQ ID NO: 494476 - DNA, 25 bp, Mus musculus
gagtcatatcatatcacggctgttt

SEQ ID NO: 494477 - DNA, 25 bp, Mus musculus
gagtcatatcatttcacggctgttt

SEQ ID NO: 494478 - DNA, 25 bp, Mus musculus
gagtcatatccaaagcctccatagt

SEQ ID NO: 494479 - DNA, 25 bp, Mus musculus
gagtcatatccatagcctccatagt

SEQ ID NO: 494480 - DNA, 25 bp, Mus musculus
gagtcatattcaaattctacccata

SEQ ID NO: 494481 - DNA, 25 bp, Mus musculus
gagtcatattcatattctacccata

SEQ ID NO: 494482 - DNA, 25 bp, Mus musculus
gagtcatattctaatcaccatttcc

SEQ ID NO: 494483 - DNA, 25 bp, Mus musculus
gagtcatattctctaccataagtga

SEQ ID NO: 494484 - DNA, 25 bp, Mus musculus
gagtcatattctgtaccataagtga

SEQ ID NO: 494485 - DNA, 25 bp, Mus musculus
gagtcatattcttatcaccatttcc

SEQ ID NO: 494486 - DNA, 25 bp, Mus musculus
gagtcatattgaaccctgatcctat

SEQ ID NO: 494487 - DNA, 25 bp, Mus musculus
gagtcatattgatccctgatcctat

SEQ ID NO: 494488 - DNA, 25 bp, Mus musculus
gagtcatcaaccatcaagtgccaag

SEQ ID NO: 494489 - DNA, 25 bp, Mus musculus
gagtcatcaaccttcaagtgccaag

SEQ ID NO: 494490 - DNA, 25 bp, Mus musculus
gagtcatcactaaaatcccagaatt

SEQ ID NO: 494491 - DNA, 25 bp, Mus musculus
gagtcatcactataatcccagaatt

SEQ ID NO: 494492 - DNA, 25 bp, Mus musculus
gagtcatcagaacggtctctctaac

SEQ ID NO: 494493 - DNA, 25 bp, Mus musculus
gagtcatcagaagggtctctctaac

SEQ ID NO: 494494 - DNA, 25 bp, Mus musculus
gagtcatcagtaaccacatgtcctc

SEQ ID NO: 494495 - DNA, 25 bp, Mus musculus
gagtcatcagtatccacatgtcctc

SEQ ID NO: 494496 - DNA, 25 bp, Mus musculus
gagtcatcatctccttttgtctgag

SEQ ID NO: 494497 - DNA, 25 bp, Mus musculus
gagtcatcatctgcttttgtctgag

SEQ ID NO: 494498 - DNA, 25 bp, Mus musculus
gagtcatccatcaagcaattgtaag

SEQ ID NO: 494499 - DNA, 25 bp, Mus musculus
gagtcatccatctagcaattgtaag

SEQ ID NO: 494500 - DNA, 25 bp, Mus musculus
gagtcatcccaactgtaacttggag

SEQ ID NO: 494501 - DNA, 25 bp, Mus musculus
gagtcatcccaagtgtaacttggag

SEQ ID NO: 494502 - DNA, 25 bp, Mus musculus
gagtcatcctgaaatcatgttattt

SEQ ID NO: 494503 - DNA, 25 bp, Mus musculus
gagtcatcctgatatcatgttattt

SEQ ID NO: 494504 - DNA, 25 bp, Mus musculus
gagtcatcgattaggtcatccatat

SEQ ID NO: 494505 - DNA, 25 bp, Mus musculus
gagtcatcgatttggtcatccatat

SEQ ID NO: 494506 - DNA, 25 bp, Mus musculus
gagtcatctaaaacagacttcgctg

SEQ ID NO: 494507 - DNA, 25 bp, Mus musculus
gagtcatctaaatcagacttcgctg

SEQ ID NO: 494508 - DNA, 25 bp, Mus musculus
gagtcatctacacatgtgcaccgct

SEQ ID NO: 494509 - DNA, 25 bp, Mus musculus
gagtcatctacagatgtgcaccgct

SEQ ID NO: 494510 - DNA, 25 bp, Mus musculus
gagtcatctcaaatccacaatataa

SEQ ID NO: 494511 - DNA, 25 bp, Mus musculus
gagtcatctcaattccacaatataa

SEQ ID NO: 494512 - DNA, 25 bp, Mus musculus
gagtcatctcacaggtgcttatgta

SEQ ID NO: 494513 - DNA, 25 bp, Mus musculus
gagtcatctcaccttcctgctgaat

SEQ ID NO: 494514 - DNA, 25 bp, Mus musculus
gagtcatctcacgttcctgctgaat

SEQ ID NO: 494515 - DNA, 25 bp, Mus musculus
gagtcatctcactggtgcttatgta

SEQ ID NO: 494516 - DNA, 25 bp, Mus musculus
gagtcatctcagaggcactcagggt

SEQ ID NO: 494517 - DNA, 25 bp, Mus musculus
gagtcatctcagtggcactcagggt

SEQ ID NO: 494518 - DNA, 25 bp, Mus musculus
gagtcatctcctcagctggatttta

SEQ ID NO: 494519 - DNA, 25 bp, Mus musculus
gagtcatctcctgagctggatttta

SEQ ID NO: 494520 - DNA, 25 bp, Mus musculus
gagtcatcttcaactgtatagcaag

SEQ ID NO: 494521 - DNA, 25 bp, Mus musculus
gagtcatcttcatctgtatagcaag

SEQ ID NO: 494522 - DNA, 25 bp, Mus musculus
gagtcatcttctccaaactgtgttc

SEQ ID NO: 494523 - DNA, 25 bp, Mus musculus
gagtcatcttctgcaaactgtgttc

SEQ ID NO: 494524 - DNA, 25 bp, Mus musculus
gagtcatgaatacaggatcacagtt

SEQ ID NO: 494525 - DNA, 25 bp, Mus musculus
gagtcatgaatagaggatcacagtt

SEQ ID NO: 494526 - DNA, 25 bp, Mus musculus
gagtcatgacgcatttacacatcct

SEQ ID NO: 494527 - DNA, 25 bp, Mus musculus
gagtcatgacgcttttacacatcct

SEQ ID NO: 494528 - DNA, 25 bp, Mus musculus
gagtcatgatctcctcaggatcctc

SEQ ID NO: 494529 - DNA, 25 bp, Mus musculus
gagtcatgatctgctcaggatcctc

SEQ ID NO: 494530 - DNA, 25 bp, Mus musculus
gagtcatgattcatcctgacccaga

SEQ ID NO: 494531 - DNA, 25 bp, Mus musculus
gagtcatgattcttcctgacccaga

SEQ ID NO: 494532 - DNA, 25 bp, Mus musculus
gagtcatgcagtacctctatctcag

SEQ ID NO: 494533 - DNA, 25 bp, Mus musculus
gagtcatgcagttcctctatctcag

SEQ ID NO: 494534 - DNA, 25 bp, Mus musculus
gagtcatgccacctgaacaactgat

SEQ ID NO: 494535 - DNA, 25 bp, Mus musculus
gagtcatgccacgtgaacaactgat

SEQ ID NO: 494536 - DNA, 25 bp, Mus musculus
gagtcatgcgcacaagaccaccagg

SEQ ID NO: 494537 - DNA, 25 bp, Mus musculus
gagtcatgcgcagaagaccaccagg

SEQ ID NO: 494538 - DNA, 25 bp, Mus musculus
gagtcatgctaacagtttgtatttg

SEQ ID NO: 494539 - DNA, 25 bp, Mus musculus
gagtcatgctaagagtttgtatttg

SEQ ID NO: 494540 - DNA, 25 bp, Mus musculus
gagtcatgctgccactgagacacag

SEQ ID NO: 494541 - DNA, 25 bp, Mus musculus
gagtcatgctgcgactgagacacag

SEQ ID NO: 494542 - DNA, 25 bp, Mus musculus
gagtcatgctgtcacctcagagctg

SEQ ID NO: 494543 - DNA, 25 bp, Mus musculus
gagtcatgctgtgacctcagagctg

SEQ ID NO: 494544 - DNA, 25 bp, Mus musculus
gagtcatgcttgctgagtatctcat

SEQ ID NO: 494545 - DNA, 25 bp, Mus musculus
gagtcatgcttggtgagtatctcat

SEQ ID NO: 494546 - DNA, 25 bp, Mus musculus
gagtcatgctttaagagtttacttt

SEQ ID NO: 494547 - DNA, 25 bp, Mus musculus
gagtcatgcttttagagtttacttt

SEQ ID NO: 494548 - DNA, 25 bp, Mus musculus
gagtcatggaatccatcgccgttaa

SEQ ID NO: 494549 - DNA, 25 bp, Mus musculus
gagtcatggaatgcatcgccgttaa

SEQ ID NO: 494550 - DNA, 25 bp, Mus musculus
gagtcatggacgacaggcctggcct

SEQ ID NO: 494551 - DNA, 25 bp, Mus musculus
gagtcatggacgtcaggcctggcct

SEQ ID NO: 494552 - DNA, 25 bp, Mus musculus
gagtcatggagacactaggcctcat

SEQ ID NO: 494553 - DNA, 25 bp, Mus musculus
gagtcatggagactcctctgcatcc

SEQ ID NO: 494554 - DNA, 25 bp, Mus musculus
gagtcatggagagactaggcctcat

SEQ ID NO: 494555 - DNA, 25 bp, Mus musculus
gagtcatggagagtcctctgcatcc

SEQ ID NO: 494556 - DNA, 25 bp, Mus musculus
gagtcatggccaccacagtggtagc

SEQ ID NO: 494557 - DNA, 25 bp, Mus musculus
gagtcatggccagcacagtggtagc

SEQ ID NO: 494558 - DNA, 25 bp, Mus musculus
gagtcatggccgcaaagcccagtgc

SEQ ID NO: 494559 - DNA, 25 bp, Mus musculus
gagtcatggccggaaagcccagtgc

SEQ ID NO: 494560 - DNA, 25 bp, Mus musculus
gagtcatggctcagtcttcagaaaa

SEQ ID NO: 494561 - DNA, 25 bp, Mus musculus
gagtcatggctctgtcttcagaaaa

SEQ ID NO: 494562 - DNA, 25 bp, Mus musculus
gagtcatggctgcacaagcttttag

SEQ ID NO: 494563 - DNA, 25 bp, Mus musculus
gagtcatggctggacaagcttttag

SEQ ID NO: 494564 - DNA, 25 bp, Mus musculus
gagtcatggtccatgctccgaacct

SEQ ID NO: 494565 - DNA, 25 bp, Mus musculus
gagtcatggtccttgctccgaacct

SEQ ID NO: 494566 - DNA, 25 bp, Mus musculus
gagtcatggtgcaagttcctgtctc

SEQ ID NO: 494567 - DNA, 25 bp, Mus musculus
gagtcatggtgctagttcctgtctc

SEQ ID NO: 494568 - DNA, 25 bp, Mus musculus
gagtcatgtaatctattgttgttgc

SEQ ID NO: 494569 - DNA, 25 bp, Mus musculus
gagtcatgtaatgtattgttgttgc

SEQ ID NO: 494570 - DNA, 25 bp, Mus musculus
gagtcatgtgcaatctgcctttgga

SEQ ID NO: 494571 - DNA, 25 bp, Mus musculus
gagtcatgtgcattctgcctttgga

SEQ ID NO: 494572 - DNA, 25 bp, Mus musculus
gagtcatgttccactaaggtggttc

SEQ ID NO: 494573 - DNA, 25 bp, Mus musculus
gagtcatgttcctctaaggtggttc

SEQ ID NO: 494574 - DNA, 25 bp, Mus musculus
gagtcattaaaccagttcatctgaa

SEQ ID NO: 494575 - DNA, 25 bp, Mus musculus
gagtcattaaacgagttcatctgaa

SEQ ID NO: 494576 - DNA, 25 bp, Mus musculus
gagtcattatctctgaaacagtttc

SEQ ID NO: 494577 - DNA, 25 bp, Mus musculus
gagtcattatctgtgaaacagtttc

SEQ ID NO: 494578 - DNA, 25 bp, Mus musculus
gagtcattatgaaaagttccatcac

SEQ ID NO: 494579 - DNA, 25 bp, Mus musculus
gagtcattatgataagttccatcac

SEQ ID NO: 494580 - DNA, 25 bp, Mus musculus
gagtcattcaggctccagaggctaa

SEQ ID NO: 494581 - DNA, 25 bp, Mus musculus
gagtcattcagggtccagaggctaa

SEQ ID NO: 494582 - DNA, 25 bp, Mus musculus
gagtcattccagctttgctagtcca

SEQ ID NO: 494583 - DNA, 25 bp, Mus musculus
gagtcattccaggtttgctagtcca

SEQ ID NO: 494584 - DNA, 25 bp, Mus musculus
gagtcattcgttacaaatgaccgtc

SEQ ID NO: 494585 - DNA, 25 bp, Mus musculus
gagtcattcgtttcaaatgaccgtc

SEQ ID NO: 494586 - DNA, 25 bp, Mus musculus
gagtcattctgtcagctcaagcttt

SEQ ID NO: 494587 - DNA, 25 bp, Mus musculus
gagtcattctgtgagctcaagcttt

SEQ ID NO: 494588 - DNA, 25 bp, Mus musculus
gagtcattgagtcaacgtccatctt

SEQ ID NO: 494589 - DNA, 25 bp, Mus musculus
gagtcattgagtgaacgtccatctt

SEQ ID NO: 494590 - DNA, 25 bp, Mus musculus
gagtcattgcatcactagctacaaa

SEQ ID NO: 494591 - DNA, 25 bp, Mus musculus
gagtcattgcatgactagctacaaa

SEQ ID NO: 494592 - DNA, 25 bp, Mus musculus
gagtcattgctgctagaatcggtct

SEQ ID NO: 494593 - DNA, 25 bp, Mus musculus
gagtcattgctggtagaatcggtct

SEQ ID NO: 494594 - DNA, 25 bp, Mus musculus
gagtcattgcttctagtatcgagaa

SEQ ID NO: 494595 - DNA, 25 bp, Mus musculus
gagtcattgcttgtagtatcgagaa

SEQ ID NO: 494596 - DNA, 25 bp, Mus musculus
gagtcattggataatggtgtgtcac

SEQ ID NO: 494597 - DNA, 25 bp, Mus musculus
gagtcattggattatggtgtgtcac

SEQ ID NO: 494598 - DNA, 25 bp, Mus musculus
gagtcattgtagatctccagctcag

SEQ ID NO: 494599 - DNA, 25 bp, Mus musculus
gagtcattgtagttctccagctcag

SEQ ID NO: 494600 - DNA, 25 bp, Mus musculus
gagtcatttaaacctctcccgtata

SEQ ID NO: 494601 - DNA, 25 bp, Mus musculus
gagtcatttaaagctctcccgtata

SEQ ID NO: 494602 - DNA, 25 bp, Mus musculus
gagtcatttctccagacttaataaa

SEQ ID NO: 494603 - DNA, 25 bp, Mus musculus
gagtcatttctcgagacttaataaa

SEQ ID NO: 494604 - DNA, 25 bp, Mus musculus
gagtcatttgccagagacctgccag

SEQ ID NO: 494605 - DNA, 25 bp, Mus musculus
gagtcatttgcctgagacctgccag

SEQ ID NO: 494606 - DNA, 25 bp, Mus musculus
gagtcatttggacttttgtcggctt

SEQ ID NO: 494607 - DNA, 25 bp, Mus musculus
gagtcatttggagttttgtcggctt

SEQ ID NO: 494608 - DNA, 25 bp, Mus musculus
gagtcattttccaaggtttctagtt

SEQ ID NO: 494609 - DNA, 25 bp, Mus musculus
gagtcattttcctaggtttctagtt

SEQ ID NO: 494610 - DNA, 25 bp, Mus musculus
gagtccaaaagcaccaagtctgtgg

SEQ ID NO: 494611 - DNA, 25 bp, Mus musculus
gagtccaaaagctccaagtctgtgg

SEQ ID NO: 494612 - DNA, 25 bp, Mus musculus
gagtccaaacagaacccgaagccct

SEQ ID NO: 494613 - DNA, 25 bp, Mus musculus
gagtccaaacagtacccgaagccct

SEQ ID NO: 494614 - DNA, 25 bp, Mus musculus
gagtccaaagataagtcctctaaga

SEQ ID NO: 494615 - DNA, 25 bp, Mus musculus
gagtccaaagattagtcctctaaga

SEQ ID NO: 494616 - DNA, 25 bp, Mus musculus
gagtccaaagccagggtaccagctg

SEQ ID NO: 494617 - DNA, 25 bp, Mus musculus
gagtccaaagcctgggtaccagctg

SEQ ID NO: 494618 - DNA, 25 bp, Mus musculus
gagtccaaaggacagagttgcttct

SEQ ID NO: 494619 - DNA, 25 bp, Mus musculus
gagtccaaaggacctggcacactgt

SEQ ID NO: 494620 - DNA, 25 bp, Mus musculus
gagtccaaaggagagagttgcttct

SEQ ID NO: 494621 - DNA, 25 bp, Mus musculus
gagtccaaaggagctggcacactgt

SEQ ID NO: 494622 - DNA, 25 bp, Mus musculus
gagtccaaaggtatgctttcatttc

SEQ ID NO: 494623 - DNA, 25 bp, Mus musculus
gagtccaaaggtttgctttcatttc

SEQ ID NO: 494624 - DNA, 25 bp, Mus musculus
gagtccaaatcgaacctccggcgac

SEQ ID NO: 494625 - DNA, 25 bp, Mus musculus
gagtccaaatcgtacctccggcgac

SEQ ID NO: 494626 - DNA, 25 bp, Mus musculus
gagtccaaccctaaagatccagcag

SEQ ID NO: 494627 - DNA, 25 bp, Mus musculus
gagtccaacccttaagatccagcag

SEQ ID NO: 494628 - DNA, 25 bp, Mus musculus
gagtccaacgggcgcctgtcttcag

SEQ ID NO: 494629 - DNA, 25 bp, Mus musculus
gagtccaacgggggcctgtcttcag

SEQ ID NO: 494630 - DNA, 25 bp, Mus musculus
gagtccaagcagacaccaacacggt

SEQ ID NO: 494631 - DNA, 25 bp, Mus musculus
gagtccaagcagtcaccaacacggt

SEQ ID NO: 494632 - DNA, 25 bp, Mus musculus
gagtccaagccgagccactaacact

SEQ ID NO: 494633 - DNA, 25 bp, Mus musculus
gagtccaagccgtgccactaacact

SEQ ID NO: 494634 - DNA, 25 bp, Mus musculus
gagtccaaggccatctttggttaca

SEQ ID NO: 494635 - DNA, 25 bp, Mus musculus
gagtccaaggccttctttggttaca

SEQ ID NO: 494636 - DNA, 25 bp, Mus musculus
gagtccaaggtcagcaagcaactat

SEQ ID NO: 494637 - DNA, 25 bp, Mus musculus
gagtccaaggtctgcaagcaactat

SEQ ID NO: 494638 - DNA, 25 bp, Mus musculus
gagtccaagtccacatcactgaaag

SEQ ID NO: 494639 - DNA, 25 bp, Mus musculus
gagtccaagtcctcatcactgaaag

SEQ ID NO: 494640 - DNA, 25 bp, Mus musculus
gagtccaagtctcgcacatgcacta

SEQ ID NO: 494641 - DNA, 25 bp, Mus musculus
gagtccaagtctggcacatgcacta

SEQ ID NO: 494642 - DNA, 25 bp, Mus musculus
gagtccaatctcagcaccttataaa

SEQ ID NO: 494643 - DNA, 25 bp, Mus musculus
gagtccaatctctgcaccttataaa

SEQ ID NO: 494644 - DNA, 25 bp, Mus musculus
gagtccaatgcaaaaactaaacttg

SEQ ID NO: 494645 - DNA, 25 bp, Mus musculus
gagtccaatgcataaactaaacttg

SEQ ID NO: 494646 - DNA, 25 bp, Mus musculus
gagtccaatgtgctgattgctgcta

SEQ ID NO: 494647 - DNA, 25 bp, Mus musculus
gagtccaatgtggtgattgctgcta

SEQ ID NO: 494648 - DNA, 25 bp, Mus musculus
gagtccaattcccagatggaggctg

SEQ ID NO: 494649 - DNA, 25 bp, Mus musculus
gagtccaattccgagatggaggctg

SEQ ID NO: 494650 - DNA, 25 bp, Mus musculus
gagtccacatgacactttgacctga

SEQ ID NO: 494651 - DNA, 25 bp, Mus musculus
gagtccacatgagactttgacctga

SEQ ID NO: 494652 - DNA, 25 bp, Mus musculus
gagtccacatggaatgcaactgcat

SEQ ID NO: 494653 - DNA, 25 bp, Mus musculus
gagtccacatggtatgcaactgcat

SEQ ID NO: 494654 - DNA, 25 bp, Mus musculus
gagtccacattcctgttccgtaatc

SEQ ID NO: 494655 - DNA, 25 bp, Mus musculus
gagtccacattcgtgttccgtaatc

SEQ ID NO: 494656 - DNA, 25 bp, Mus musculus
gagtccaccaaaagatgccaccaga

SEQ ID NO: 494657 - DNA, 25 bp, Mus musculus
gagtccaccaaatgatgccaccaga

SEQ ID NO: 494658 - DNA, 25 bp, Mus musculus
gagtccaccagaccattcagacaac

SEQ ID NO: 494659 - DNA, 25 bp, Mus musculus
gagtccaccagagcattcagacaac

SEQ ID NO: 494660 - DNA, 25 bp, Mus musculus
gagtccaccccacaagagatccttt

SEQ ID NO: 494661 - DNA, 25 bp, Mus musculus
gagtccaccccagaagagatccttt

SEQ ID NO: 494662 - DNA, 25 bp, Mus musculus
gagtccaccctgacaggctctaggg

SEQ ID NO: 494663 - DNA, 25 bp, Mus musculus
gagtccaccctgtcaggctctaggg

SEQ ID NO: 494664 - DNA, 25 bp, Mus musculus
gagtccacccttcatctggtgttga

SEQ ID NO: 494665 - DNA, 25 bp, Mus musculus
gagtccacccttgatctggtgttga

SEQ ID NO: 494666 - DNA, 25 bp, Mus musculus
gagtccaccgacagagactactgtt

SEQ ID NO: 494667 - DNA, 25 bp, Mus musculus
gagtccaccgactgagactactgtt

SEQ ID NO: 494668 - DNA, 25 bp, Mus musculus
gagtccaccgcacttagaccagagg

SEQ ID NO: 494669 - DNA, 25 bp, Mus musculus
gagtccaccgcagttagaccagagg

SEQ ID NO: 494670 - DNA, 25 bp, Mus musculus
gagtccacctctagaattttatctt

SEQ ID NO: 494671 - DNA, 25 bp, Mus musculus
gagtccacctcttgaattttatctt

SEQ ID NO: 494672 - DNA, 25 bp, Mus musculus
gagtccacctgtcatggaatataat

SEQ ID NO: 494673 - DNA, 25 bp, Mus musculus
gagtccacctgtgatggaatataat

SEQ ID NO: 494674 - DNA, 25 bp, Mus musculus
gagtccacgaagctggatcaccttc

SEQ ID NO: 494675 - DNA, 25 bp, Mus musculus
gagtccacgaaggtggatcaccttc

SEQ ID NO: 494676 - DNA, 25 bp, Mus musculus
gagtccacgagaatactatatctga

SEQ ID NO: 494677 - DNA, 25 bp, Mus musculus
gagtccacgagattactatatctga

SEQ ID NO: 494678 - DNA, 25 bp, Mus musculus
gagtccacgagtatacagagtgctt

SEQ ID NO: 494679 - DNA, 25 bp, Mus musculus
gagtccacgagtttacagagtgctt

SEQ ID NO: 494680 - DNA, 25 bp, Mus musculus
gagtccactaaaactgccttcagta

SEQ ID NO: 494681 - DNA, 25 bp, Mus musculus
gagtccactaaatctgccttcagta

SEQ ID NO: 494682 - DNA, 25 bp, Mus musculus
gagtccactcctcaaggtctcagag

SEQ ID NO: 494683 - DNA, 25 bp, Mus musculus
gagtccactcctgaaggtctcagag

SEQ ID NO: 494684 - DNA, 25 bp, Mus musculus
gagtccactgaaatgttctcttgaa

SEQ ID NO: 494685 - DNA, 25 bp, Mus musculus
gagtccactgaattgttctcttgaa

SEQ ID NO: 494686 - DNA, 25 bp, Mus musculus
gagtccactgatagtcatttggtga

SEQ ID NO: 494687 - DNA, 25 bp, Mus musculus
gagtccactgattgtcatttggtga

SEQ ID NO: 494688 - DNA, 25 bp, Mus musculus
gagtccactgttatctgggcatata

SEQ ID NO: 494689 - DNA, 25 bp, Mus musculus
gagtccactgttttctgggcatata

SEQ ID NO: 494690 - DNA, 25 bp, Mus musculus
gagtccagaagactggcacaggact

SEQ ID NO: 494691 - DNA, 25 bp, Mus musculus
gagtccagaagagtggcacaggact

SEQ ID NO: 494692 - DNA, 25 bp, Mus musculus
gagtccagacacatgctatagagca

SEQ ID NO: 494693 - DNA, 25 bp, Mus musculus
gagtccagacacttgctatagagca

SEQ ID NO: 494694 - DNA, 25 bp, Mus musculus
gagtccagacagcccgatgttacct

SEQ ID NO: 494695 - DNA, 25 bp, Mus musculus
gagtccagacaggccgatgttacct

SEQ ID NO: 494696 - DNA, 25 bp, Mus musculus
gagtccagacgtcctctagagatta

SEQ ID NO: 494697 - DNA, 25 bp, Mus musculus
gagtccagacgtgctctagagatta

SEQ ID NO: 494698 - DNA, 25 bp, Mus musculus
gagtccagagccagattttgcctgt

SEQ ID NO: 494699 - DNA, 25 bp, Mus musculus
gagtccagagcctgattttgcctgt

SEQ ID NO: 494700 - DNA, 25 bp, Mus musculus
gagtccagagctagccttggaggca

SEQ ID NO: 494701 - DNA, 25 bp, Mus musculus
gagtccagagcttgccttggaggca

SEQ ID NO: 494702 - DNA, 25 bp, Mus musculus
gagtccagagtcacctgaagtttgt

SEQ ID NO: 494703 - DNA, 25 bp, Mus musculus
gagtccagagtcactgaaaccctgc

SEQ ID NO: 494704 - DNA, 25 bp, Mus musculus
gagtccagagtctcctgaagtttgt

SEQ ID NO: 494705 - DNA, 25 bp, Mus musculus
gagtccagagtctctgaaaccctgc

SEQ ID NO: 494706 - DNA, 25 bp, Mus musculus
gagtccagatctcctgtacacagca

SEQ ID NO: 494707 - DNA, 25 bp, Mus musculus
gagtccagatctgctgtacacagca

SEQ ID NO: 494708 - DNA, 25 bp, Mus musculus
gagtccagatggctaattctaaata

SEQ ID NO: 494709 - DNA, 25 bp, Mus musculus
gagtccagatgggtaattctaaata

SEQ ID NO: 494710 - DNA, 25 bp, Mus musculus
gagtccagattactgttagactcca

SEQ ID NO: 494711 - DNA, 25 bp, Mus musculus
gagtccagattagtgttagactcca

SEQ ID NO: 494712 - DNA, 25 bp, Mus musculus
gagtccagatttcaattctctagtt

SEQ ID NO: 494713 - DNA, 25 bp, Mus musculus
gagtccagatttgaattctctagtt

SEQ ID NO: 494714 - DNA, 25 bp, Mus musculus
gagtccagccaacactgtggccagg

SEQ ID NO: 494715 - DNA, 25 bp, Mus musculus
gagtccagccaagactgtggccagg

SEQ ID NO: 494716 - DNA, 25 bp, Mus musculus
gagtccagccgcagactaggcttag

SEQ ID NO: 494717 - DNA, 25 bp, Mus musculus
gagtccagccgctgactaggcttag

SEQ ID NO: 494718 - DNA, 25 bp, Mus musculus
gagtccagcttgctctaccacagag

SEQ ID NO: 494719 - DNA, 25 bp, Mus musculus
gagtccagcttggtctaccacagag

SEQ ID NO: 494720 - DNA, 25 bp, Mus musculus
gagtccaggagaccttgtttctaaa

SEQ ID NO: 494721 - DNA, 25 bp, Mus musculus
gagtccaggagagcttgtttctaaa

SEQ ID NO: 494722 - DNA, 25 bp, Mus musculus
gagtccaggataccgccccaaatat

SEQ ID NO: 494723 - DNA, 25 bp, Mus musculus
gagtccaggatagcgccccaaatat

SEQ ID NO: 494724 - DNA, 25 bp, Mus musculus
gagtccaggattctgtcatttcaac

SEQ ID NO: 494725 - DNA, 25 bp, Mus musculus
gagtccaggattgtgtcatttcaac

SEQ ID NO: 494726 - DNA, 25 bp, Mus musculus
gagtccaggcccagtggtggacagc

SEQ ID NO: 494727 - DNA, 25 bp, Mus musculus
gagtccaggccctgtggtggacagc

SEQ ID NO: 494728 - DNA, 25 bp, Mus musculus
gagtccaggcctaacagccatggag

SEQ ID NO: 494729 - DNA, 25 bp, Mus musculus
gagtccaggccttacagccatggag

SEQ ID NO: 494730 - DNA, 25 bp, Mus musculus
gagtccaggcggagccttcagagaa

SEQ ID NO: 494731 - DNA, 25 bp, Mus musculus
gagtccaggcggtgccttcagagaa

SEQ ID NO: 494732 - DNA, 25 bp, Mus musculus
gagtccaggctaagcttcagtgaca

SEQ ID NO: 494733 - DNA, 25 bp, Mus musculus
gagtccaggctatgcttcagtgaca

SEQ ID NO: 494734 - DNA, 25 bp, Mus musculus
gagtccaggcttatttccatgtgtc

SEQ ID NO: 494735 - DNA, 25 bp, Mus musculus
gagtccaggcttttttccatgtgtc

SEQ ID NO: 494736 - DNA, 25 bp, Mus musculus
gagtccagggcaaaggcacccagga

SEQ ID NO: 494737 - DNA, 25 bp, Mus musculus
gagtccagggcaaattttataatac

SEQ ID NO: 494738 - DNA, 25 bp, Mus musculus
gagtccagggcataggcacccagga

SEQ ID NO: 494739 - DNA, 25 bp, Mus musculus
gagtccagggcatattttataatac

SEQ ID NO: 494740 - DNA, 25 bp, Mus musculus
gagtccaggtcaatttcacacatta

SEQ ID NO: 494741 - DNA, 25 bp, Mus musculus
gagtccaggtcattttcacacatta

SEQ ID NO: 494742 - DNA, 25 bp, Mus musculus
gagtccaggtctcgttaattgccag

SEQ ID NO: 494743 - DNA, 25 bp, Mus musculus
gagtccaggtctggttaattgccag

SEQ ID NO: 494744 - DNA, 25 bp, Mus musculus
gagtccagtcgaagattggctcctt

SEQ ID NO: 494745 - DNA, 25 bp, Mus musculus
gagtccagtcgatgattggctcctt

SEQ ID NO: 494746 - DNA, 25 bp, Mus musculus
gagtccagtgatcaaaacagtaaga

SEQ ID NO: 494747 - DNA, 25 bp, Mus musculus
gagtccagtgatgaaaacagtaaga

SEQ ID NO: 494748 - DNA, 25 bp, Mus musculus
gagtccagtggactttatctccaga

SEQ ID NO: 494749 - DNA, 25 bp, Mus musculus
gagtccagtggagtttatctccaga

SEQ ID NO: 494750 - DNA, 25 bp, Mus musculus
gagtccagttgtattccactggcta

SEQ ID NO: 494751 - DNA, 25 bp, Mus musculus
gagtccagttgttttccactggcta

SEQ ID NO: 494752 - DNA, 25 bp, Mus musculus
gagtccagttttctctatttcatga

SEQ ID NO: 494753 - DNA, 25 bp, Mus musculus
gagtccagttttgtctatttcatga

SEQ ID NO: 494754 - DNA, 25 bp, Mus musculus
gagtccataacccaaaatttctgcg

SEQ ID NO: 494755 - DNA, 25 bp, Mus musculus
gagtccataaccgaaaatttctgcg

SEQ ID NO: 494756 - DNA, 25 bp, Mus musculus
gagtccatagacaagctcatctaat

SEQ ID NO: 494757 - DNA, 25 bp, Mus musculus
gagtccatagactagctcatctaat

SEQ ID NO: 494758 - DNA, 25 bp, Mus musculus
gagtccatattgatcctataggcat

SEQ ID NO: 494759 - DNA, 25 bp, Mus musculus
gagtccatattgttcctataggcat

SEQ ID NO: 494760 - DNA, 25 bp, Mus musculus
gagtccatcacaaccaggatctcga

SEQ ID NO: 494761 - DNA, 25 bp, Mus musculus
gagtccatcacatccaggatctcga

SEQ ID NO: 494762 - DNA, 25 bp, Mus musculus
gagtccatcatccatatctcagtgg

SEQ ID NO: 494763 - DNA, 25 bp, Mus musculus
gagtccatcatcgatatctcagtgg

SEQ ID NO: 494764 - DNA, 25 bp, Mus musculus
gagtccatctcaccttatttcattg

SEQ ID NO: 494765 - DNA, 25 bp, Mus musculus
gagtccatctcagcttatttcattg

SEQ ID NO: 494766 - DNA, 25 bp, Mus musculus
gagtccatctggacagagccagcct

SEQ ID NO: 494767 - DNA, 25 bp, Mus musculus
gagtccatctggagttgtcctgtcg

SEQ ID NO: 494768 - DNA, 25 bp, Mus musculus
gagtccatctggtcagagccagcct

SEQ ID NO: 494769 - DNA, 25 bp, Mus musculus
gagtccatctggtgttgtcctgtcg

SEQ ID NO: 494770 - DNA, 25 bp, Mus musculus
gagtccatgaaaacaaacagtacac

SEQ ID NO: 494771 - DNA, 25 bp, Mus musculus
gagtccatgaaatcaaacagtacac

SEQ ID NO: 494772 - DNA, 25 bp, Mus musculus
gagtccatgaatacctaccttcaga

SEQ ID NO: 494773 - DNA, 25 bp, Mus musculus
gagtccatgaattcctaccttcaga

SEQ ID NO: 494774 - DNA, 25 bp, Mus musculus
gagtccatgctgacagttaactgat

SEQ ID NO: 494775 - DNA, 25 bp, Mus musculus
gagtccatgctgtcagttaactgat

SEQ ID NO: 494776 - DNA, 25 bp, Mus musculus
gagtccatggacaccagaattgaga

SEQ ID NO: 494777 - DNA, 25 bp, Mus musculus
gagtccatggactccagaattgaga

SEQ ID NO: 494778 - DNA, 25 bp, Mus musculus
gagtccatgggcattgtgaatagcg

SEQ ID NO: 494779 - DNA, 25 bp, Mus musculus
gagtccatgggctttgtgaatagcg

SEQ ID NO: 494780 - DNA, 25 bp, Mus musculus
gagtccatgtataacaacgatgcct

SEQ ID NO: 494781 - DNA, 25 bp, Mus musculus
gagtccatgtattacaacgatgcct

SEQ ID NO: 494782 - DNA, 25 bp, Mus musculus
gagtccatgtgacaggaaccgaact

SEQ ID NO: 494783 - DNA, 25 bp, Mus musculus
gagtccatgtgagaggaaccgaact

SEQ ID NO: 494784 - DNA, 25 bp, Mus musculus
gagtccatgtgcagggctgagtcca

SEQ ID NO: 494785 - DNA, 25 bp, Mus musculus
gagtccatgtgctgggctgagtcca

SEQ ID NO: 494786 - DNA, 25 bp, Mus musculus
gagtccattgagcaaaccttgtctt

SEQ ID NO: 494787 - DNA, 25 bp, Mus musculus
gagtccattgaggaaaccttgtctt

SEQ ID NO: 494788 - DNA, 25 bp, Mus musculus
gagtccatttctaccatttgtcaaa

SEQ ID NO: 494789 - DNA, 25 bp, Mus musculus
gagtccatttcttccatttgtcaaa

SEQ ID NO: 494790 - DNA, 25 bp, Mus musculus
gagtcccaaaatctatgaagtacct

SEQ ID NO: 494791 - DNA, 25 bp, Mus musculus
gagtcccaaaatgtatgaagtacct

SEQ ID NO: 494792 - DNA, 25 bp, Mus musculus
gagtcccaagaaccaactgttcact

SEQ ID NO: 494793 - DNA, 25 bp, Mus musculus
gagtcccaagaagcaactgttcact

SEQ ID NO: 494794 - DNA, 25 bp, Mus musculus
gagtcccaagacattaaggctcagt

SEQ ID NO: 494795 - DNA, 25 bp, Mus musculus
gagtcccaagactttaaggctcagt

SEQ ID NO: 494796 - DNA, 25 bp, Mus musculus
gagtcccaagagcaaccccattgac

SEQ ID NO: 494797 - DNA, 25 bp, Mus musculus
gagtcccaagaggaaccccattgac

SEQ ID NO: 494798 - DNA, 25 bp, Mus musculus
gagtcccaatttctatatcagtgtt

SEQ ID NO: 494799 - DNA, 25 bp, Mus musculus
gagtcccaatttctcatgtttgaat

SEQ ID NO: 494800 - DNA, 25 bp, Mus musculus
gagtcccaatttgtatatcagtgtt

SEQ ID NO: 494801 - DNA, 25 bp, Mus musculus
gagtcccaatttgtcatgtttgaat

SEQ ID NO: 494802 - DNA, 25 bp, Mus musculus
gagtcccacggccaaatcagaacga

SEQ ID NO: 494803 - DNA, 25 bp, Mus musculus
gagtcccacggcgaaatcagaacga

SEQ ID NO: 494804 - DNA, 25 bp, Mus musculus
gagtcccacttgactatgactttca

SEQ ID NO: 494805 - DNA, 25 bp, Mus musculus
gagtcccacttgtctatgactttca

SEQ ID NO: 494806 - DNA, 25 bp, Mus musculus
gagtcccagatccagtatgtacctg

SEQ ID NO: 494807 - DNA, 25 bp, Mus musculus
gagtcccagatcgagtatgtacctg

SEQ ID NO: 494808 - DNA, 25 bp, Mus musculus
gagtcccagctgacagtcaagatga

SEQ ID NO: 494809 - DNA, 25 bp, Mus musculus
gagtcccagctgtcagtcaagatga

SEQ ID NO: 494810 - DNA, 25 bp, Mus musculus
gagtcccaggaaagtcaggtctaca

SEQ ID NO: 494811 - DNA, 25 bp, Mus musculus
gagtcccaggaatgtcaggtctaca

SEQ ID NO: 494812 - DNA, 25 bp, Mus musculus
gagtcccaggacattaaactctgac

SEQ ID NO: 494813 - DNA, 25 bp, Mus musculus
gagtcccaggactttaaactctgac

SEQ ID NO: 494814 - DNA, 25 bp, Mus musculus
gagtcccaggatagcccggagcctg

SEQ ID NO: 494815 - DNA, 25 bp, Mus musculus
gagtcccaggattgcccggagcctg

SEQ ID NO: 494816 - DNA, 25 bp, Mus musculus
gagtcccagggtaactagacatttg

SEQ ID NO: 494817 - DNA, 25 bp, Mus musculus
gagtcccagggttactagacatttg

SEQ ID NO: 494818 - DNA, 25 bp, Mus musculus
gagtcccagtctcaggaaagtttaa

SEQ ID NO: 494819 - DNA, 25 bp, Mus musculus
gagtcccagtctgaggaaagtttaa

SEQ ID NO: 494820 - DNA, 25 bp, Mus musculus
gagtcccagttgcagtttcccacat

SEQ ID NO: 494821 - DNA, 25 bp, Mus musculus
gagtcccagttggagtttcccacat

SEQ ID NO: 494822 - DNA, 25 bp, Mus musculus
gagtcccatctaatcaagcttgcca

SEQ ID NO: 494823 - DNA, 25 bp, Mus musculus
gagtcccatctattcaagcttgcca

SEQ ID NO: 494824 - DNA, 25 bp, Mus musculus
gagtcccatctcatgaaatggttgg

SEQ ID NO: 494825 - DNA, 25 bp, Mus musculus
gagtcccatctcttgaaatggttgg

SEQ ID NO: 494826 - DNA, 25 bp, Mus musculus
gagtcccatgacattctgagctata

SEQ ID NO: 494827 - DNA, 25 bp, Mus musculus
gagtcccatgactttctgagctata

SEQ ID NO: 494828 - DNA, 25 bp, Mus musculus
gagtcccatggaactaactgtctcc

SEQ ID NO: 494829 - DNA, 25 bp, Mus musculus
gagtcccatggatctaactgtctcc

SEQ ID NO: 494830 - DNA, 25 bp, Mus musculus
gagtcccattgacgaattccctgag

SEQ ID NO: 494831 - DNA, 25 bp, Mus musculus
gagtcccattgaggaattccctgag

SEQ ID NO: 494832 - DNA, 25 bp, Mus musculus
gagtcccatttcaggcaggagtgta

SEQ ID NO: 494833 - DNA, 25 bp, Mus musculus
gagtcccatttctggcaggagtgta

SEQ ID NO: 494834 - DNA, 25 bp, Mus musculus
gagtccccacaaacctggaagaagc

SEQ ID NO: 494835 - DNA, 25 bp, Mus musculus
gagtccccacaatcctggaagaagc

SEQ ID NO: 494836 - DNA, 25 bp, Mus musculus
gagtccccacttacaagcggtttgg

SEQ ID NO: 494837 - DNA, 25 bp, Mus musculus
gagtccccactttcaagcggtttgg

SEQ ID NO: 494838 - DNA, 25 bp, Mus musculus
gagtccccagacagcggattaccag

SEQ ID NO: 494839 - DNA, 25 bp, Mus musculus
gagtccccagactgcggattaccag

SEQ ID NO: 494840 - DNA, 25 bp, Mus musculus
gagtccccaggcacagtctgatgat

SEQ ID NO: 494841 - DNA, 25 bp, Mus musculus
gagtccccaggctcagtctgatgat

SEQ ID NO: 494842 - DNA, 25 bp, Mus musculus
gagtccccgaaacgtcctgctgtgc

SEQ ID NO: 494843 - DNA, 25 bp, Mus musculus
gagtccccgaaaggtcctgctgtgc

SEQ ID NO: 494844 - DNA, 25 bp, Mus musculus
gagtccccgactctgggatacatga

SEQ ID NO: 494845 - DNA, 25 bp, Mus musculus
gagtccccgactgtgggatacatga

SEQ ID NO: 494846 - DNA, 25 bp, Mus musculus
gagtccccgaggaggtgacgtatct

SEQ ID NO: 494847 - DNA, 25 bp, Mus musculus
gagtccccgaggtggtgacgtatct

SEQ ID NO: 494848 - DNA, 25 bp, Mus musculus
gagtccccgatgaacgattttctgg

SEQ ID NO: 494849 - DNA, 25 bp, Mus musculus
gagtccccgatgtacgattttctgg

SEQ ID NO: 494850 - DNA, 25 bp, Mus musculus
gagtccccgcagatgaaggactttt

SEQ ID NO: 494851 - DNA, 25 bp, Mus musculus
gagtccccgcagttgaaggactttt

SEQ ID NO: 494852 - DNA, 25 bp, Mus musculus
gagtccccggaaagttgccactggg

SEQ ID NO: 494853 - DNA, 25 bp, Mus musculus
gagtccccggaatgttgccactggg

SEQ ID NO: 494854 - DNA, 25 bp, Mus musculus
gagtcccctactaacttattttgtg

SEQ ID NO: 494855 - DNA, 25 bp, Mus musculus
gagtcccctacttacttattttgtg

SEQ ID NO: 494856 - DNA, 25 bp, Mus musculus
gagtcccctcacacaggaaatagca

SEQ ID NO: 494857 - DNA, 25 bp, Mus musculus
gagtcccctcactcaggaaatagca

SEQ ID NO: 494858 - DNA, 25 bp, Mus musculus
gagtcccctccaattgttgaggaat

SEQ ID NO: 494859 - DNA, 25 bp, Mus musculus
gagtcccctccatttgttgaggaat

SEQ ID NO: 494860 - DNA, 25 bp, Mus musculus
gagtcccctgctcaagaggcaacta

SEQ ID NO: 494861 - DNA, 25 bp, Mus musculus
gagtcccctgctgaagaggcaacta

SEQ ID NO: 494862 - DNA, 25 bp, Mus musculus
gagtcccctggaagtcctcatttaa

SEQ ID NO: 494863 - DNA, 25 bp, Mus musculus
gagtcccctggatgtcctcatttaa

SEQ ID NO: 494864 - DNA, 25 bp, Mus musculus
gagtcccctgttcaaaacagtgcag

SEQ ID NO: 494865 - DNA, 25 bp, Mus musculus
gagtcccctgttgaaaacagtgcag

SEQ ID NO: 494866 - DNA, 25 bp, Mus musculus
gagtcccgagagacacgttatagct

SEQ ID NO: 494867 - DNA, 25 bp, Mus musculus
gagtcccgagagtcacgttatagct

SEQ ID NO: 494868 - DNA, 25 bp, Mus musculus
gagtcccgatccagtaggcgacact

SEQ ID NO: 494869 - DNA, 25 bp, Mus musculus
gagtcccgatcctgtaggcgacact

SEQ ID NO: 494870 - DNA, 25 bp, Mus musculus
gagtcccgattaattttcttcttga

SEQ ID NO: 494871 - DNA, 25 bp, Mus musculus
gagtcccgattatttttcttcttga

SEQ ID NO: 494872 - DNA, 25 bp, Mus musculus
gagtcccgggaaaatctcggtcatt

SEQ ID NO: 494873 - DNA, 25 bp, Mus musculus
gagtcccgggaatatctcggtcatt

SEQ ID NO: 494874 - DNA, 25 bp, Mus musculus
gagtcccgtgatattccaagctatg

SEQ ID NO: 494875 - DNA, 25 bp, Mus musculus
gagtcccgtgattttccaagctatg

SEQ ID NO: 494876 - DNA, 25 bp, Mus musculus
gagtccctaggacttgagtctttag

SEQ ID NO: 494877 - DNA, 25 bp, Mus musculus
gagtccctaggagttgagtctttag

SEQ ID NO: 494878 - DNA, 25 bp, Mus musculus
gagtccctagggacacaccagctca

SEQ ID NO: 494879 - DNA, 25 bp, Mus musculus
gagtccctagggtcacaccagctca

SEQ ID NO: 494880 - DNA, 25 bp, Mus musculus
gagtccctcattaacttgtaccatg

SEQ ID NO: 494881 - DNA, 25 bp, Mus musculus
gagtccctcatttacttgtaccatg

SEQ ID NO: 494882 - DNA, 25 bp, Mus musculus
gagtccctccctagtagagcgaaca

SEQ ID NO: 494883 - DNA, 25 bp, Mus musculus
gagtccctcccttgtagagcgaaca

SEQ ID NO: 494884 - DNA, 25 bp, Mus musculus
gagtccctcctcactggagtaaaag

SEQ ID NO: 494885 - DNA, 25 bp, Mus musculus
gagtccctcctctctggagtaaaag

SEQ ID NO: 494886 - DNA, 25 bp, Mus musculus
gagtccctccttcaacaagcgcaag

SEQ ID NO: 494887 - DNA, 25 bp, Mus musculus
gagtccctccttgaacaagcgcaag

SEQ ID NO: 494888 - DNA, 25 bp, Mus musculus
gagtccctctatcaaggacattcga

SEQ ID NO: 494889 - DNA, 25 bp, Mus musculus
gagtccctctatgaaggacattcga

SEQ ID NO: 494890 - DNA, 25 bp, Mus musculus
gagtccctctcactgctggtaaagg

SEQ ID NO: 494891 - DNA, 25 bp, Mus musculus
gagtccctctcagtgctggtaaagg

SEQ ID NO: 494892 - DNA, 25 bp, Mus musculus
gagtccctgaaaagtaacggaaatg

SEQ ID NO: 494893 - DNA, 25 bp, Mus musculus
gagtccctgaaatgtaacggaaatg

SEQ ID NO: 494894 - DNA, 25 bp, Mus musculus
gagtccctgagaaggacccgcattg

SEQ ID NO: 494895 - DNA, 25 bp, Mus musculus
gagtccctgagatggacccgcattg

SEQ ID NO: 494896 - DNA, 25 bp, Mus musculus
gagtccctgaggcagaaccgtacaa

SEQ ID NO: 494897 - DNA, 25 bp, Mus musculus
gagtccctgaggctcgttctaatcg

SEQ ID NO: 494898 - DNA, 25 bp, Mus musculus
gagtccctgagggagaaccgtacaa

SEQ ID NO: 494899 - DNA, 25 bp, Mus musculus
gagtccctgagggtcgttctaatcg

SEQ ID NO: 494900 - DNA, 25 bp, Mus musculus
gagtccctgagtagctctgtcaagg

SEQ ID NO: 494901 - DNA, 25 bp, Mus musculus
gagtccctgagttgctctgtcaagg

SEQ ID NO: 494902 - DNA, 25 bp, Mus musculus
gagtccctgccccaggaaatcaaag

SEQ ID NO: 494903 - DNA, 25 bp, Mus musculus
gagtccctgcccgaggaaatcaaag

SEQ ID NO: 494904 - DNA, 25 bp, Mus musculus
gagtccctgcttacctaagatggag

SEQ ID NO: 494905 - DNA, 25 bp, Mus musculus
gagtccctgctttcctaagatggag

SEQ ID NO: 494906 - DNA, 25 bp, Mus musculus
gagtccctgggcatgcaaagccaac

SEQ ID NO: 494907 - DNA, 25 bp, Mus musculus
gagtccctgggcttgcaaagccaac

SEQ ID NO: 494908 - DNA, 25 bp, Mus musculus
gagtccctgggtattccacattaca

SEQ ID NO: 494909 - DNA, 25 bp, Mus musculus
gagtccctgggtccatggccaaaat

SEQ ID NO: 494910 - DNA, 25 bp, Mus musculus
gagtccctgggtgcatggccaaaat

SEQ ID NO: 494911 - DNA, 25 bp, Mus musculus
gagtccctgggttttccacattaca

SEQ ID NO: 494912 - DNA, 25 bp, Mus musculus
gagtccctgtatacctgcacagaga

SEQ ID NO: 494913 - DNA, 25 bp, Mus musculus
gagtccctgtattcctgcacagaga

SEQ ID NO: 494914 - DNA, 25 bp, Mus musculus
gagtccctgtgcatatagttgctaa

SEQ ID NO: 494915 - DNA, 25 bp, Mus musculus
gagtccctgtgcttatagttgctaa

SEQ ID NO: 494916 - DNA, 25 bp, Mus musculus
gagtcccttaacactggtgaggtca

SEQ ID NO: 494917 - DNA, 25 bp, Mus musculus
gagtcccttaactctggtgaggtca

SEQ ID NO: 494918 - DNA, 25 bp, Mus musculus
gagtcccttccgctgcgtgcaatag

SEQ ID NO: 494919 - DNA, 25 bp, Mus musculus
gagtcccttccggtgcgtgcaatag

SEQ ID NO: 494920 - DNA, 25 bp, Mus musculus
gagtcccttcgtcgtactaagaatg

SEQ ID NO: 494921 - DNA, 25 bp, Mus musculus
gagtcccttcgtggtactaagaatg

SEQ ID NO: 494922 - DNA, 25 bp, Mus musculus
gagtcccttctactttatgtagact

SEQ ID NO: 494923 - DNA, 25 bp, Mus musculus
gagtcccttctagtttatgtagact

SEQ ID NO: 494924 - DNA, 25 bp, Mus musculus
gagtcccttctcaaacagactgtgt

SEQ ID NO: 494925 - DNA, 25 bp, Mus musculus
gagtcccttctctaacagactgtgt

SEQ ID NO: 494926 - DNA, 25 bp, Mus musculus
gagtcccttgcaagcgtagagcatt

SEQ ID NO: 494927 - DNA, 25 bp, Mus musculus
gagtcccttgcatgcgtagagcatt

SEQ ID NO: 494928 - DNA, 25 bp, Mus musculus
gagtcccttggtaaattcttgcatg

SEQ ID NO: 494929 - DNA, 25 bp, Mus musculus
gagtcccttggttaattcttgcatg

SEQ ID NO: 494930 - DNA, 25 bp, Mus musculus
gagtcccttgttaattaatattttg

SEQ ID NO: 494931 - DNA, 25 bp, Mus musculus
gagtcccttgtttattaatattttg

SEQ ID NO: 494932 - DNA, 25 bp, Mus musculus
gagtccctttaccacaaagacgtag

SEQ ID NO: 494933 - DNA, 25 bp, Mus musculus
gagtccctttacgacaaagacgtag

SEQ ID NO: 494934 - DNA, 25 bp, Mus musculus
gagtccctttgtaagtgttttccat

SEQ ID NO: 494935 - DNA, 25 bp, Mus musculus
gagtccctttgttagtgttttccat

SEQ ID NO: 494936 - DNA, 25 bp, Mus musculus
gagtcccttttgcatgattgtctta

SEQ ID NO: 494937 - DNA, 25 bp, Mus musculus
gagtcccttttggatgattgtctta

SEQ ID NO: 494938 - DNA, 25 bp, Mus musculus
gagtccgaatgtcttaatccatcag

SEQ ID NO: 494939 - DNA, 25 bp, Mus musculus
gagtccgaatgtgttaatccatcag

SEQ ID NO: 494940 - DNA, 25 bp, Mus musculus
gagtccgaattgctgccactgaata

SEQ ID NO: 494941 - DNA, 25 bp, Mus musculus
gagtccgaattggtgccactgaata

SEQ ID NO: 494942 - DNA, 25 bp, Mus musculus
gagtccgacgcacccacagtcagtg

SEQ ID NO: 494943 - DNA, 25 bp, Mus musculus
gagtccgacgcagccacagtcagtg

SEQ ID NO: 494944 - DNA, 25 bp, Mus musculus
gagtccgactccatcctactgagga

SEQ ID NO: 494945 - DNA, 25 bp, Mus musculus
gagtccgactccttcctactgagga

SEQ ID NO: 494946 - DNA, 25 bp, Mus musculus
gagtccgagacacccaccaagaatg

SEQ ID NO: 494947 - DNA, 25 bp, Mus musculus
gagtccgagacagccaccaagaatg

SEQ ID NO: 494948 - DNA, 25 bp, Mus musculus
gagtccgaggagactgaagatgaca

SEQ ID NO: 494949 - DNA, 25 bp, Mus musculus
gagtccgaggagtctgaagatgaca

SEQ ID NO: 494950 - DNA, 25 bp, Mus musculus
gagtccgaggtgatccacgcgtgca

SEQ ID NO: 494951 - DNA, 25 bp, Mus musculus
gagtccgaggtgttccacgcgtgca

SEQ ID NO: 494952 - DNA, 25 bp, Mus musculus
gagtccgagtgtcatgcctggcaaa

SEQ ID NO: 494953 - DNA, 25 bp, Mus musculus
gagtccgagtgtgatgcctggcaaa

SEQ ID NO: 494954 - DNA, 25 bp, Mus musculus
gagtccgatagtattctcaccctgg

SEQ ID NO: 494955 - DNA, 25 bp, Mus musculus
gagtccgatagttttctcaccctgg

SEQ ID NO: 494956 - DNA, 25 bp, Mus musculus
gagtccgatggcctgctcaaaatca

SEQ ID NO: 494957 - DNA, 25 bp, Mus musculus
gagtccgatggcgtgctcaaaatca

SEQ ID NO: 494958 - DNA, 25 bp, Mus musculus
gagtccgatgtcaccaacaagccag

SEQ ID NO: 494959 - DNA, 25 bp, Mus musculus
gagtccgatgtctccaacaagccag

SEQ ID NO: 494960 - DNA, 25 bp, Mus musculus
gagtccgccaagcaactcacttact

SEQ ID NO: 494961 - DNA, 25 bp, Mus musculus
gagtccgccaaggaactcacttact

SEQ ID NO: 494962 - DNA, 25 bp, Mus musculus
gagtccgcctcaccacaggcaaaga

SEQ ID NO: 494963 - DNA, 25 bp, Mus musculus
gagtccgcctcagcacaggcaaaga

SEQ ID NO: 494964 - DNA, 25 bp, Mus musculus
gagtccggaaggacaccacctttct

SEQ ID NO: 494965 - DNA, 25 bp, Mus musculus
gagtccggaaggtcaccacctttct

SEQ ID NO: 494966 - DNA, 25 bp, Mus musculus
gagtccggaggacatgtacattcaa

SEQ ID NO: 494967 - DNA, 25 bp, Mus musculus
gagtccggaggagatgtacattcaa

SEQ ID NO: 494968 - DNA, 25 bp, Mus musculus
gagtccggccacactagagaggcag

SEQ ID NO: 494969 - DNA, 25 bp, Mus musculus
gagtccggccactctagagaggcag

SEQ ID NO: 494970 - DNA, 25 bp, Mus musculus
gagtccggtctactttttacatctt

SEQ ID NO: 494971 - DNA, 25 bp, Mus musculus
gagtccggtctagtttttacatctt

SEQ ID NO: 494972 - DNA, 25 bp, Mus musculus
gagtccgtatctattcaaacccaat

SEQ ID NO: 494973 - DNA, 25 bp, Mus musculus
gagtccgtatcttttcaaacccaat

SEQ ID NO: 494974 - DNA, 25 bp, Mus musculus
gagtccgtcccaaggaagtgctaga

SEQ ID NO: 494975 - DNA, 25 bp, Mus musculus
gagtccgtcccatggaagtgctaga

SEQ ID NO: 494976 - DNA, 25 bp, Mus musculus
gagtccgtggccatacgtgagtgac

SEQ ID NO: 494977 - DNA, 25 bp, Mus musculus
gagtccgtggccttacgtgagtgac

SEQ ID NO: 494978 - DNA, 25 bp, Mus musculus
gagtccgtggctcctataaccatgg

SEQ ID NO: 494979 - DNA, 25 bp, Mus musculus
gagtccgtggctgctataaccatgg

SEQ ID NO: 494980 - DNA, 25 bp, Mus musculus
gagtccgtgtgacgccatgagcatc

SEQ ID NO: 494981 - DNA, 25 bp, Mus musculus
gagtccgtgtgaggccatgagcatc

SEQ ID NO: 494982 - DNA, 25 bp, Mus musculus
gagtcctaaactacactgtaccgtg

SEQ ID NO: 494983 - DNA, 25 bp, Mus musculus
gagtcctaaacttcactgtaccgtg

SEQ ID NO: 494984 - DNA, 25 bp, Mus musculus
gagtcctaaataacattcctgctta

SEQ ID NO: 494985 - DNA, 25 bp, Mus musculus
gagtcctaaatatcattcctgctta

SEQ ID NO: 494986 - DNA, 25 bp, Mus musculus
gagtcctaaccaaaacacaccgaag

SEQ ID NO: 494987 - DNA, 25 bp, Mus musculus
gagtcctaaccataacacaccgaag

SEQ ID NO: 494988 - DNA, 25 bp, Mus musculus
gagtcctaagagagctttggccatt

SEQ ID NO: 494989 - DNA, 25 bp, Mus musculus
gagtcctaagagtgctttggccatt

SEQ ID NO: 494990 - DNA, 25 bp, Mus musculus
gagtcctaagctattgcgatttttt

SEQ ID NO: 494991 - DNA, 25 bp, Mus musculus
gagtcctaagcttttgcgatttttt

SEQ ID NO: 494992 - DNA, 25 bp, Mus musculus
gagtcctaagtgatgggttctgcct

SEQ ID NO: 494993 - DNA, 25 bp, Mus musculus
gagtcctaagtgttgggttctgcct

SEQ ID NO: 494994 - DNA, 25 bp, Mus musculus
gagtcctaattacaagctccgtctg

SEQ ID NO: 494995 - DNA, 25 bp, Mus musculus
gagtcctaattagaagctccgtctg

SEQ ID NO: 494996 - DNA, 25 bp, Mus musculus
gagtcctacattctgaatggctctg

SEQ ID NO: 494997 - DNA, 25 bp, Mus musculus
gagtcctacattgtgaatggctctg

SEQ ID NO: 494998 - DNA, 25 bp, Mus musculus
gagtcctaccaacatcagtcagtat

SEQ ID NO: 494999 - DNA, 25 bp, Mus musculus
gagtcctaccaagatcagtcagtat

SEQ ID NO: 495000 - DNA, 25 bp, Mus musculus
gagtcctaccttatgtactgtgcag

SEQ ID NO: 495001 - DNA, 25 bp, Mus musculus
gagtcctaccttctaattacaatta

SEQ ID NO: 495002 - DNA, 25 bp, Mus musculus
gagtcctaccttgtaattacaatta

SEQ ID NO: 495003 - DNA, 25 bp, Mus musculus
gagtcctaccttttgtactgtgcag

SEQ ID NO: 495004 - DNA, 25 bp, Mus musculus
gagtcctacgtcagtcgtacatgta

SEQ ID NO: 495005 - DNA, 25 bp, Mus musculus
gagtcctacgtctgtcgtacatgta

SEQ ID NO: 495006 - DNA, 25 bp, Mus musculus
gagtcctagaccctaatgtctgtaa

SEQ ID NO: 495007 - DNA, 25 bp, Mus musculus
gagtcctagaccgtaatgtctgtaa

SEQ ID NO: 495008 - DNA, 25 bp, Mus musculus
gagtcctagtcaactgttctttacc

SEQ ID NO: 495009 - DNA, 25 bp, Mus musculus
gagtcctagtcatctgttctttacc

SEQ ID NO: 495010 - DNA, 25 bp, Mus musculus
gagtcctatagaacactgcattctg

SEQ ID NO: 495011 - DNA, 25 bp, Mus musculus
gagtcctatagatcactgcattctg

SEQ ID NO: 495012 - DNA, 25 bp, Mus musculus
gagtcctatataattcaacagtggc

SEQ ID NO: 495013 - DNA, 25 bp, Mus musculus
gagtcctatatatttcaacagtggc

SEQ ID NO: 495014 - DNA, 25 bp, Mus musculus
gagtcctatattacattgtgggtga

SEQ ID NO: 495015 - DNA, 25 bp, Mus musculus
gagtcctatatttcattgtgggtga

SEQ ID NO: 495016 - DNA, 25 bp, Mus musculus
gagtcctatgacctcttttaaactt

SEQ ID NO: 495017 - DNA, 25 bp, Mus musculus
gagtcctatgacgtcttttaaactt

SEQ ID NO: 495018 - DNA, 25 bp, Mus musculus
gagtcctatggaaactttgcactga

SEQ ID NO: 495019 - DNA, 25 bp, Mus musculus
gagtcctatggatactttgcactga

SEQ ID NO: 495020 - DNA, 25 bp, Mus musculus
gagtcctatgtgacatggtccccca

SEQ ID NO: 495021 - DNA, 25 bp, Mus musculus
gagtcctatgtgtcatggtccccca

SEQ ID NO: 495022 - DNA, 25 bp, Mus musculus
gagtcctcaagcattgaccatcatg

SEQ ID NO: 495023 - DNA, 25 bp, Mus musculus
gagtcctcaagctttgaccatcatg

SEQ ID NO: 495024 - DNA, 25 bp, Mus musculus
gagtcctcaagtcaattccattgat

SEQ ID NO: 495025 - DNA, 25 bp, Mus musculus
gagtcctcaagtgaattccattgat

SEQ ID NO: 495026 - DNA, 25 bp, Mus musculus
gagtcctcaatcatggcacagggat

SEQ ID NO: 495027 - DNA, 25 bp, Mus musculus
gagtcctcaatcttggcacagggat

SEQ ID NO: 495028 - DNA, 25 bp, Mus musculus
gagtcctcaatgaagttgtgttcag

SEQ ID NO: 495029 - DNA, 25 bp, Mus musculus
gagtcctcaatgtagttgtgttcag

SEQ ID NO: 495030 - DNA, 25 bp, Mus musculus
gagtcctcacacaggaacctgtcaa

SEQ ID NO: 495031 - DNA, 25 bp, Mus musculus
gagtcctcacactggaacctgtcaa

SEQ ID NO: 495032 - DNA, 25 bp, Mus musculus
gagtcctcacttccactgatgtttt

SEQ ID NO: 495033 - DNA, 25 bp, Mus musculus
gagtcctcacttgcactgatgtttt

SEQ ID NO: 495034 - DNA, 25 bp, Mus musculus
gagtcctcatataaacattagcttt

SEQ ID NO: 495035 - DNA, 25 bp, Mus musculus
gagtcctcatattaacattagcttt

SEQ ID NO: 495036 - DNA, 25 bp, Mus musculus
gagtcctcatcaatgggatccaggg

SEQ ID NO: 495037 - DNA, 25 bp, Mus musculus
gagtcctcatcattgggatccaggg

SEQ ID NO: 495038 - DNA, 25 bp, Mus musculus
gagtcctcattgaacacgagatgga

SEQ ID NO: 495039 - DNA, 25 bp, Mus musculus
gagtcctcattgaccataaactatg

SEQ ID NO: 495040 - DNA, 25 bp, Mus musculus
gagtcctcattgtacacgagatgga

SEQ ID NO: 495041 - DNA, 25 bp, Mus musculus
gagtcctcattgtccataaactatg

SEQ ID NO: 495042 - DNA, 25 bp, Mus musculus
gagtcctccacaagaccttgtgaat

SEQ ID NO: 495043 - DNA, 25 bp, Mus musculus
gagtcctccacatgaccttgtgaat

SEQ ID NO: 495044 - DNA, 25 bp, Mus musculus
gagtcctccagcagggatgacgaag

SEQ ID NO: 495045 - DNA, 25 bp, Mus musculus
gagtcctccagctgggatgacgaag

SEQ ID NO: 495046 - DNA, 25 bp, Mus musculus
gagtcctccatcatgattaggagaa

SEQ ID NO: 495047 - DNA, 25 bp, Mus musculus
gagtcctccatccaagaaggctttt

SEQ ID NO: 495048 - DNA, 25 bp, Mus musculus
gagtcctccatcgaagaaggctttt

SEQ ID NO: 495049 - DNA, 25 bp, Mus musculus
gagtcctccatcttgattaggagaa

SEQ ID NO: 495050 - DNA, 25 bp, Mus musculus
gagtcctccctgctgagtaaagcta

SEQ ID NO: 495051 - DNA, 25 bp, Mus musculus
gagtcctccctggtgagtaaagcta

SEQ ID NO: 495052 - DNA, 25 bp, Mus musculus
gagtcctccgtgatgggaatgacaa

SEQ ID NO: 495053 - DNA, 25 bp, Mus musculus
gagtcctccgtgttgggaatgacaa

SEQ ID NO: 495054 - DNA, 25 bp, Mus musculus
gagtcctcctctcgcattgttgaat

SEQ ID NO: 495055 - DNA, 25 bp, Mus musculus
gagtcctcctctggcattgttgaat

SEQ ID NO: 495056 - DNA, 25 bp, Mus musculus
gagtcctccttgaatgtatcaacag

SEQ ID NO: 495057 - DNA, 25 bp, Mus musculus
gagtcctccttgtatgtatcaacag

SEQ ID NO: 495058 - DNA, 25 bp, Mus musculus
gagtcctcgcacactttaacatgtt

SEQ ID NO: 495059 - DNA, 25 bp, Mus musculus
gagtcctcgcactctttaacatgtt

SEQ ID NO: 495060 - DNA, 25 bp, Mus musculus
gagtcctctctgaggctcacgggtg

SEQ ID NO: 495061 - DNA, 25 bp, Mus musculus
gagtcctctctgtggctcacgggtg

SEQ ID NO: 495062 - DNA, 25 bp, Mus musculus
gagtcctctgagacgctggatccag

SEQ ID NO: 495063 - DNA, 25 bp, Mus musculus
gagtcctctgagtcgctggatccag

SEQ ID NO: 495064 - DNA, 25 bp, Mus musculus
gagtcctctgcacgagtccatgctg

SEQ ID NO: 495065 - DNA, 25 bp, Mus musculus
gagtcctctgcaggagtccatgctg

SEQ ID NO: 495066 - DNA, 25 bp, Mus musculus
gagtcctctggccacagtggagatt

SEQ ID NO: 495067 - DNA, 25 bp, Mus musculus
gagtcctctggcgacagtggagatt

SEQ ID NO: 495068 - DNA, 25 bp, Mus musculus
gagtcctctgtcagcaatgttatct

SEQ ID NO: 495069 - DNA, 25 bp, Mus musculus
gagtcctctgtctgcaatgttatct

SEQ ID NO: 495070 - DNA, 25 bp, Mus musculus
gagtcctgaaatatgttcatagatt

SEQ ID NO: 495071 - DNA, 25 bp, Mus musculus
gagtcctgaaatttgttcatagatt

SEQ ID NO: 495072 - DNA, 25 bp, Mus musculus
gagtcctgaaccattaccttaccct

SEQ ID NO: 495073 - DNA, 25 bp, Mus musculus
gagtcctgaacctttaccttaccct

SEQ ID NO: 495074 - DNA, 25 bp, Mus musculus
gagtcctgaagtcaaatgttaccta

SEQ ID NO: 495075 - DNA, 25 bp, Mus musculus
gagtcctgaagtgaaatgttaccta

SEQ ID NO: 495076 - DNA, 25 bp, Mus musculus
gagtcctgagccagtgcgactgaga

SEQ ID NO: 495077 - DNA, 25 bp, Mus musculus
gagtcctgagcctgtgcgactgaga

SEQ ID NO: 495078 - DNA, 25 bp, Mus musculus
gagtcctgagctcaagctagctata

SEQ ID NO: 495079 - DNA, 25 bp, Mus musculus
gagtcctgagctgaagctagctata

SEQ ID NO: 495080 - DNA, 25 bp, Mus musculus
gagtcctgaggtatccgagtccttt

SEQ ID NO: 495081 - DNA, 25 bp, Mus musculus
gagtcctgaggtcactgctgctcac

SEQ ID NO: 495082 - DNA, 25 bp, Mus musculus
gagtcctgaggtgactgctgctcac

SEQ ID NO: 495083 - DNA, 25 bp, Mus musculus
gagtcctgaggtttccgagtccttt

SEQ ID NO: 495084 - DNA, 25 bp, Mus musculus
gagtcctgagtcatgaagcctctga

SEQ ID NO: 495085 - DNA, 25 bp, Mus musculus
gagtcctgagtcttgaagcctctga

SEQ ID NO: 495086 - DNA, 25 bp, Mus musculus
gagtcctgatggaaccatgaaccaa

SEQ ID NO: 495087 - DNA, 25 bp, Mus musculus
gagtcctgatggtaccatgaaccaa

SEQ ID NO: 495088 - DNA, 25 bp, Mus musculus
gagtcctgatttatgctaggcccag

SEQ ID NO: 495089 - DNA, 25 bp, Mus musculus
gagtcctgatttttgctaggcccag

SEQ ID NO: 495090 - DNA, 25 bp, Mus musculus
gagtcctgcagccaataaattgcca

SEQ ID NO: 495091 - DNA, 25 bp, Mus musculus
gagtcctgcagcgaataaattgcca

SEQ ID NO: 495092 - DNA, 25 bp, Mus musculus
gagtcctgcaggatattagtctttg

SEQ ID NO: 495093 - DNA, 25 bp, Mus musculus
gagtcctgcaggttattagtctttg

SEQ ID NO: 495094 - DNA, 25 bp, Mus musculus
gagtcctgcatgctggccaacttta

SEQ ID NO: 495095 - DNA, 25 bp, Mus musculus
gagtcctgcatggtggccaacttta

SEQ ID NO: 495096 - DNA, 25 bp, Mus musculus
gagtcctgccaacatgtctattggt

SEQ ID NO: 495097 - DNA, 25 bp, Mus musculus
gagtcctgccaacgtcaaccaatac

SEQ ID NO: 495098 - DNA, 25 bp, Mus musculus
gagtcctgccaagatgtctattggt

SEQ ID NO: 495099 - DNA, 25 bp, Mus musculus
gagtcctgccaaggtcaaccaatac

SEQ ID NO: 495100 - DNA, 25 bp, Mus musculus
gagtcctgccttatacatggacaaa

SEQ ID NO: 495101 - DNA, 25 bp, Mus musculus
gagtcctgccttttacatggacaaa

SEQ ID NO: 495102 - DNA, 25 bp, Mus musculus
gagtcctgcgatacttgagttagag

SEQ ID NO: 495103 - DNA, 25 bp, Mus musculus
gagtcctgcgattcttgagttagag

SEQ ID NO: 495104 - DNA, 25 bp, Mus musculus
gagtcctggactcaagtgtcacagt

SEQ ID NO: 495105 - DNA, 25 bp, Mus musculus
gagtcctggactgaagtgtcacagt

SEQ ID NO: 495106 - DNA, 25 bp, Mus musculus
gagtcctggagcacgagaatcttcc

SEQ ID NO: 495107 - DNA, 25 bp, Mus musculus
gagtcctggagccttcaacttcttg

SEQ ID NO: 495108 - DNA, 25 bp, Mus musculus
gagtcctggagcgttcaacttcttg

SEQ ID NO: 495109 - DNA, 25 bp, Mus musculus
gagtcctggagctcgagaatcttcc

SEQ ID NO: 495110 - DNA, 25 bp, Mus musculus
gagtcctggataattgttgccatag

SEQ ID NO: 495111 - DNA, 25 bp, Mus musculus
gagtcctggatatttgttgccatag

SEQ ID NO: 495112 - DNA, 25 bp, Mus musculus
gagtcctggcccaatgttgaattcc

SEQ ID NO: 495113 - DNA, 25 bp, Mus musculus
gagtcctggccctatgttgaattcc

SEQ ID NO: 495114 - DNA, 25 bp, Mus musculus
gagtcctggcctatgatatgagagc

SEQ ID NO: 495115 - DNA, 25 bp, Mus musculus
gagtcctggcctttgatatgagagc

SEQ ID NO: 495116 - DNA, 25 bp, Mus musculus
gagtcctggctacaccgtaagcaca

SEQ ID NO: 495117 - DNA, 25 bp, Mus musculus
gagtcctggctagaccgtaagcaca

SEQ ID NO: 495118 - DNA, 25 bp, Mus musculus
gagtcctggctgatcctacatatta

SEQ ID NO: 495119 - DNA, 25 bp, Mus musculus
gagtcctggctgttcctacatatta

SEQ ID NO: 495120 - DNA, 25 bp, Mus musculus
gagtcctgggctcattctggacaaa

SEQ ID NO: 495121 - DNA, 25 bp, Mus musculus
gagtcctgggctgattctggacaaa

SEQ ID NO: 495122 - DNA, 25 bp, Mus musculus
gagtcctggtcaagaaatagcataa

SEQ ID NO: 495123 - DNA, 25 bp, Mus musculus
gagtcctggtcatgaaatagcataa

SEQ ID NO: 495124 - DNA, 25 bp, Mus musculus
gagtcctgtatacagtgcagagcct

SEQ ID NO: 495125 - DNA, 25 bp, Mus musculus
gagtcctgtatagagtgcagagcct

SEQ ID NO: 495126 - DNA, 25 bp, Mus musculus
gagtcctgtcctcagcatcgcagtc

SEQ ID NO: 495127 - DNA, 25 bp, Mus musculus
gagtcctgtcctgagcatcgcagtc

SEQ ID NO: 495128 - DNA, 25 bp, Mus musculus
gagtcctgtgctacagtacttgttt

SEQ ID NO: 495129 - DNA, 25 bp, Mus musculus
gagtcctgtgcttcagtacttgttt

SEQ ID NO: 495130 - DNA, 25 bp, Mus musculus
gagtcctgtgttatcagtccatgcc

SEQ ID NO: 495131 - DNA, 25 bp, Mus musculus
gagtcctgtgttttcagtccatgcc

SEQ ID NO: 495132 - DNA, 25 bp, Mus musculus
gagtcctgttctcaatgggttgcct

SEQ ID NO: 495133 - DNA, 25 bp, Mus musculus
gagtcctgttctgaatgggttgcct

SEQ ID NO: 495134 - DNA, 25 bp, Mus musculus
gagtcctgttgtaggaagactggta

SEQ ID NO: 495135 - DNA, 25 bp, Mus musculus
gagtcctgttgttggaagactggta

SEQ ID NO: 495136 - DNA, 25 bp, Mus musculus
gagtccttaaatcagcttagtctat

SEQ ID NO: 495137 - DNA, 25 bp, Mus musculus
gagtccttaaatgagcttagtctat

SEQ ID NO: 495138 - DNA, 25 bp, Mus musculus
gagtccttaacaatagtggtgtgct

SEQ ID NO: 495139 - DNA, 25 bp, Mus musculus
gagtccttaacattagtggtgtgct

SEQ ID NO: 495140 - DNA, 25 bp, Mus musculus
gagtccttaccgacagaagcacagg

SEQ ID NO: 495141 - DNA, 25 bp, Mus musculus
gagtccttaccgtcagaagcacagg

SEQ ID NO: 495142 - DNA, 25 bp, Mus musculus
gagtccttactgaatactaccttag

SEQ ID NO: 495143 - DNA, 25 bp, Mus musculus
gagtccttactgtatactaccttag

SEQ ID NO: 495144 - DNA, 25 bp, Mus musculus
gagtccttagctcggagtctctgca

SEQ ID NO: 495145 - DNA, 25 bp, Mus musculus
gagtccttagctgggagtctctgca

SEQ ID NO: 495146 - DNA, 25 bp, Mus musculus
gagtccttatatatgcaatgttaca

SEQ ID NO: 495147 - DNA, 25 bp, Mus musculus
gagtccttatatttgcaatgttaca

SEQ ID NO: 495148 - DNA, 25 bp, Mus musculus
gagtccttatgtctcagtggtacag

SEQ ID NO: 495149 - DNA, 25 bp, Mus musculus
gagtccttatgtgtcagtggtacag

SEQ ID NO: 495150 - DNA, 25 bp, Mus musculus
gagtccttcagaattccacattagt

SEQ ID NO: 495151 - DNA, 25 bp, Mus musculus
gagtccttcagatttccacattagt

SEQ ID NO: 495152 - DNA, 25 bp, Mus musculus
gagtccttcattccagagtgtgatc

SEQ ID NO: 495153 - DNA, 25 bp, Mus musculus
gagtccttcattgcagagtgtgatc

SEQ ID NO: 495154 - DNA, 25 bp, Mus musculus
gagtccttcggcattccctgggtag

SEQ ID NO: 495155 - DNA, 25 bp, Mus musculus
gagtccttcggctttccctgggtag

SEQ ID NO: 495156 - DNA, 25 bp, Mus musculus
gagtccttctcacggtaattttgtt

SEQ ID NO: 495157 - DNA, 25 bp, Mus musculus
gagtccttctcagggtaattttgtt

SEQ ID NO: 495158 - DNA, 25 bp, Mus musculus
gagtccttgcacatccagatttcaa

SEQ ID NO: 495159 - DNA, 25 bp, Mus musculus
gagtccttgcacttccagatttcaa

SEQ ID NO: 495160 - DNA, 25 bp, Mus musculus
gagtccttgcctagcatggatgaga

SEQ ID NO: 495161 - DNA, 25 bp, Mus musculus
gagtccttgccttgcatggatgaga

SEQ ID NO: 495162 - DNA, 25 bp, Mus musculus
gagtccttgctcagagactgctcta

SEQ ID NO: 495163 - DNA, 25 bp, Mus musculus
gagtccttgctctgagactgctcta

SEQ ID NO: 495164 - DNA, 25 bp, Mus musculus
gagtccttgctgaggtttcaatagc

SEQ ID NO: 495165 - DNA, 25 bp, Mus musculus
gagtccttgctgcttatcatttcaa

SEQ ID NO: 495166 - DNA, 25 bp, Mus musculus
gagtccttgctggttatcatttcaa

SEQ ID NO: 495167 - DNA, 25 bp, Mus musculus
gagtccttgctgtggtttcaatagc

SEQ ID NO: 495168 - DNA, 25 bp, Mus musculus
gagtccttggaacggatcctctcct

SEQ ID NO: 495169 - DNA, 25 bp, Mus musculus
gagtccttggaagggatcctctcct

SEQ ID NO: 495170 - DNA, 25 bp, Mus musculus
gagtccttggtcaccgcgtagcggc

SEQ ID NO: 495171 - DNA, 25 bp, Mus musculus
gagtccttggtctccgcgtagcggc

SEQ ID NO: 495172 - DNA, 25 bp, Mus musculus
gagtccttggttccttgagaggcta

SEQ ID NO: 495173 - DNA, 25 bp, Mus musculus
gagtccttggttgcttgagaggcta

SEQ ID NO: 495174 - DNA, 25 bp, Mus musculus
gagtccttgtaacctcggtgaactt

SEQ ID NO: 495175 - DNA, 25 bp, Mus musculus
gagtccttgtaagctcggtgaactt

SEQ ID NO: 495176 - DNA, 25 bp, Mus musculus
gagtccttgtccattttatcacttt

SEQ ID NO: 495177 - DNA, 25 bp, Mus musculus
gagtccttgtcctttttatcacttt

SEQ ID NO: 495178 - DNA, 25 bp, Mus musculus
gagtccttgtgtcatcgtcatacgt

SEQ ID NO: 495179 - DNA, 25 bp, Mus musculus
gagtccttgtgtgatcgtcatacgt

SEQ ID NO: 495180 - DNA, 25 bp, Mus musculus
gagtcctttcagagttcatgggcca

SEQ ID NO: 495181 - DNA, 25 bp, Mus musculus
gagtcctttcagtgttcatgggcca

SEQ ID NO: 495182 - DNA, 25 bp, Mus musculus
gagtcctttcgtctatgattgaatc

SEQ ID NO: 495183 - DNA, 25 bp, Mus musculus
gagtcctttcgtgtatgattgaatc

SEQ ID NO: 495184 - DNA, 25 bp, Mus musculus
gagtcctttctcaggttttgttcag

SEQ ID NO: 495185 - DNA, 25 bp, Mus musculus
gagtcctttctctggttttgttcag

SEQ ID NO: 495186 - DNA, 25 bp, Mus musculus
gagtcctttgagatgggtggtatcc

SEQ ID NO: 495187 - DNA, 25 bp, Mus musculus
gagtcctttgagttgggtggtatcc

SEQ ID NO: 495188 - DNA, 25 bp, Mus musculus
gagtcctttgtacgcgatgtaaact

SEQ ID NO: 495189 - DNA, 25 bp, Mus musculus
gagtcctttgtaggcgatgtaaact

SEQ ID NO: 495190 - DNA, 25 bp, Mus musculus
gagtcctttttgctactgaatctga

SEQ ID NO: 495191 - DNA, 25 bp, Mus musculus
gagtcctttttggtactgaatctga

SEQ ID NO: 495192 - DNA, 25 bp, Mus musculus
gagtcgaatccaagacaacttcaat

SEQ ID NO: 495193 - DNA, 25 bp, Mus musculus
gagtcgaatccatgacaacttcaat

SEQ ID NO: 495194 - DNA, 25 bp, Mus musculus
gagtcgaattatcggcagaatctgc

SEQ ID NO: 495195 - DNA, 25 bp, Mus musculus
gagtcgaattatgggcagaatctgc

SEQ ID NO: 495196 - DNA, 25 bp, Mus musculus
gagtcgacaccaatgtgtcataata

SEQ ID NO: 495197 - DNA, 25 bp, Mus musculus
gagtcgacaccattgtgtcataata

SEQ ID NO: 495198 - DNA, 25 bp, Mus musculus
gagtcgacatctatggttgctcgtc

SEQ ID NO: 495199 - DNA, 25 bp, Mus musculus
gagtcgacatctttggttgctcgtc

SEQ ID NO: 495200 - DNA, 25 bp, Mus musculus
gagtcgactgttccacactgtgtat

SEQ ID NO: 495201 - DNA, 25 bp, Mus musculus
gagtcgactgttgcacactgtgtat

SEQ ID NO: 495202 - DNA, 25 bp, Mus musculus
gagtcgactttcaagtttacagata

SEQ ID NO: 495203 - DNA, 25 bp, Mus musculus
gagtcgactttctagtttacagata

SEQ ID NO: 495204 - DNA, 25 bp, Mus musculus
gagtcgagagtacccagctcagtag

SEQ ID NO: 495205 - DNA, 25 bp, Mus musculus
gagtcgagagtagccagctcagtag

SEQ ID NO: 495206 - DNA, 25 bp, Mus musculus
gagtcgaggaagactccaggtcatt

SEQ ID NO: 495207 - DNA, 25 bp, Mus musculus
gagtcgaggaagtctccaggtcatt

SEQ ID NO: 495208 - DNA, 25 bp, Mus musculus
gagtcgaggtcaaacctctcgtgga

SEQ ID NO: 495209 - DNA, 25 bp, Mus musculus
gagtcgaggtcatacctctcgtgga

SEQ ID NO: 495210 - DNA, 25 bp, Mus musculus
gagtcgaggtttaggcagcttcaga

SEQ ID NO: 495211 - DNA, 25 bp, Mus musculus
gagtcgaggttttggcagcttcaga

SEQ ID NO: 495212 - DNA, 25 bp, Mus musculus
gagtcgagtgtacgaccttgtgcct

SEQ ID NO: 495213 - DNA, 25 bp, Mus musculus
gagtcgagtgtaggaccttgtgcct

SEQ ID NO: 495214 - DNA, 25 bp, Mus musculus
gagtcgatgcacagacgaagggaac

SEQ ID NO: 495215 - DNA, 25 bp, Mus musculus
gagtcgatgcactgacgaagggaac

SEQ ID NO: 495216 - DNA, 25 bp, Mus musculus
gagtcgatgccacagatgcccacta

SEQ ID NO: 495217 - DNA, 25 bp, Mus musculus
gagtcgatgccagagatgcccacta

SEQ ID NO: 495218 - DNA, 25 bp, Mus musculus
gagtcgcagagcagagtgtttttaa

SEQ ID NO: 495219 - DNA, 25 bp, Mus musculus
gagtcgcagagctgagtgtttttaa

SEQ ID NO: 495220 - DNA, 25 bp, Mus musculus
gagtcgcagaggagccacacttgat

SEQ ID NO: 495221 - DNA, 25 bp, Mus musculus
gagtcgcagaggtgccacacttgat

SEQ ID NO: 495222 - DNA, 25 bp, Mus musculus
gagtcgccgaacaaagcaaaccaat

SEQ ID NO: 495223 - DNA, 25 bp, Mus musculus
gagtcgccgaactaagcaaaccaat

SEQ ID NO: 495224 - DNA, 25 bp, Mus musculus
gagtcgcctggaacacagagaagta

SEQ ID NO: 495225 - DNA, 25 bp, Mus musculus
gagtcgcctggatcacagagaagta

SEQ ID NO: 495226 - DNA, 25 bp, Mus musculus
gagtcgccttatcaggagcttcagg

SEQ ID NO: 495227 - DNA, 25 bp, Mus musculus
gagtcgccttatgaggagcttcagg

SEQ ID NO: 495228 - DNA, 25 bp, Mus musculus
gagtcgcgcgttacccaggaggaaa

SEQ ID NO: 495229 - DNA, 25 bp, Mus musculus
gagtcgcgcgtttcccaggaggaaa

SEQ ID NO: 495230 - DNA, 25 bp, Mus musculus
gagtcgcgtagtaccagatgaaact

SEQ ID NO: 495231 - DNA, 25 bp, Mus musculus
gagtcgcgtagttccagatgaaact

SEQ ID NO: 495232 - DNA, 25 bp, Mus musculus
gagtcgctcacgattgacatggatc

SEQ ID NO: 495233 - DNA, 25 bp, Mus musculus
gagtcgctcacgtttgacatggatc

SEQ ID NO: 495234 - DNA, 25 bp, Mus musculus
gagtcgctcccgcacgcgttcttgt

SEQ ID NO: 495235 - DNA, 25 bp, Mus musculus
gagtcgctcccggacgcgttcttgt

SEQ ID NO: 495236 - DNA, 25 bp, Mus musculus
gagtcgctccctcgcttttaatttg

SEQ ID NO: 495237 - DNA, 25 bp, Mus musculus
gagtcgctccctggcttttaatttg

SEQ ID NO: 495238 - DNA, 25 bp, Mus musculus
gagtcgctctgccacaattgtcttg

SEQ ID NO: 495239 - DNA, 25 bp, Mus musculus
gagtcgctctgcgacaattgtcttg

SEQ ID NO: 495240 - DNA, 25 bp, Mus musculus
gagtcgctgcgtcctaatgatgaac

SEQ ID NO: 495241 - DNA, 25 bp, Mus musculus
gagtcgctgcgtgctaatgatgaac

SEQ ID NO: 495242 - DNA, 25 bp, Mus musculus
gagtcgctgctcagggaaacattct

SEQ ID NO: 495243 - DNA, 25 bp, Mus musculus
gagtcgctgctctgggaaacattct

SEQ ID NO: 495244 - DNA, 25 bp, Mus musculus
gagtcgctttggacagtgaacctaa

SEQ ID NO: 495245 - DNA, 25 bp, Mus musculus
gagtcgctttggctttgcactgcag

SEQ ID NO: 495246 - DNA, 25 bp, Mus musculus
gagtcgctttgggtttgcactgcag

SEQ ID NO: 495247 - DNA, 25 bp, Mus musculus
gagtcgctttggtcagtgaacctaa

SEQ ID NO: 495248 - DNA, 25 bp, Mus musculus
gagtcgcttttgcagagtggataca

SEQ ID NO: 495249 - DNA, 25 bp, Mus musculus
gagtcgcttttggagagtggataca

SEQ ID NO: 495250 - DNA, 25 bp, Mus musculus
gagtcggaatcccagtttacacatc

SEQ ID NO: 495251 - DNA, 25 bp, Mus musculus
gagtcggaatccgagtttacacatc

SEQ ID NO: 495252 - DNA, 25 bp, Mus musculus
gagtcggaccccatatcatgtgaac

SEQ ID NO: 495253 - DNA, 25 bp, Mus musculus
gagtcggaccccttatcatgtgaac

SEQ ID NO: 495254 - DNA, 25 bp, Mus musculus
gagtcggactatagttttgcctgag

SEQ ID NO: 495255 - DNA, 25 bp, Mus musculus
gagtcggactattgttttgcctgag

SEQ ID NO: 495256 - DNA, 25 bp, Mus musculus
gagtcggagagcaccagcgaatcca

SEQ ID NO: 495257 - DNA, 25 bp, Mus musculus
gagtcggagagctccagcgaatcca

SEQ ID NO: 495258 - DNA, 25 bp, Mus musculus
gagtcggaggaacacctgacaccca

SEQ ID NO: 495259 - DNA, 25 bp, Mus musculus
gagtcggaggaagacctgacaccca

SEQ ID NO: 495260 - DNA, 25 bp, Mus musculus
gagtcggaggctattgagtttcctt

SEQ ID NO: 495261 - DNA, 25 bp, Mus musculus
gagtcggaggcttttgagtttcctt

SEQ ID NO: 495262 - DNA, 25 bp, Mus musculus
gagtcggagtacacaatcatggtaa

SEQ ID NO: 495263 - DNA, 25 bp, Mus musculus
gagtcggagtactcaatcatggtaa

SEQ ID NO: 495264 - DNA, 25 bp, Mus musculus
gagtcggagtccacggccacagatc

SEQ ID NO: 495265 - DNA, 25 bp, Mus musculus
gagtcggagtcctcggccacagatc

SEQ ID NO: 495266 - DNA, 25 bp, Mus musculus
gagtcggcagataaagcattttata

SEQ ID NO: 495267 - DNA, 25 bp, Mus musculus
gagtcggcagattaagcattttata

SEQ ID NO: 495268 - DNA, 25 bp, Mus musculus
gagtcggcattcagttttgtcttca

SEQ ID NO: 495269 - DNA, 25 bp, Mus musculus
gagtcggcattctgttttgtcttca

SEQ ID NO: 495270 - DNA, 25 bp, Mus musculus
gagtcggccaccctatcatcgagat

SEQ ID NO: 495271 - DNA, 25 bp, Mus musculus
gagtcggccaccgtatcatcgagat

SEQ ID NO: 495272 - DNA, 25 bp, Mus musculus
gagtcggccagaactgacgattctc

SEQ ID NO: 495273 - DNA, 25 bp, Mus musculus
gagtcggccagatctgacgattctc

SEQ ID NO: 495274 - DNA, 25 bp, Mus musculus
gagtcggcctgcactgtgaagagat

SEQ ID NO: 495275 - DNA, 25 bp, Mus musculus
gagtcggcctgctctgtgaagagat

SEQ ID NO: 495276 - DNA, 25 bp, Mus musculus
gagtcggctaaacatttggtgctta

SEQ ID NO: 495277 - DNA, 25 bp, Mus musculus
gagtcggctaaagatttggtgctta

SEQ ID NO: 495278 - DNA, 25 bp, Mus musculus
gagtcggctttcaggtaaatcgctt

SEQ ID NO: 495279 - DNA, 25 bp, Mus musculus
gagtcggctttctggtaaatcgctt

SEQ ID NO: 495280 - DNA, 25 bp, Mus musculus
gagtcgggactgaatgagccatctg

SEQ ID NO: 495281 - DNA, 25 bp, Mus musculus
gagtcgggactgtatgagccatctg

SEQ ID NO: 495282 - DNA, 25 bp, Mus musculus
gagtcgggcaaacaaggccatcact

SEQ ID NO: 495283 - DNA, 25 bp, Mus musculus
gagtcgggcaaagaaggccatcact

SEQ ID NO: 495284 - DNA, 25 bp, Mus musculus
gagtcgggtctgctttctaaagtgt

SEQ ID NO: 495285 - DNA, 25 bp, Mus musculus
gagtcgggtctggtttctaaagtgt

SEQ ID NO: 495286 - DNA, 25 bp, Mus musculus
gagtcgggtgtaactctgggtttaa

SEQ ID NO: 495287 - DNA, 25 bp, Mus musculus
gagtcgggtgtatctctgggtttaa

SEQ ID NO: 495288 - DNA, 25 bp, Mus musculus
gagtcggtactaatgtgtcctggga

SEQ ID NO: 495289 - DNA, 25 bp, Mus musculus
gagtcggtactattgtgtcctggga

SEQ ID NO: 495290 - DNA, 25 bp, Mus musculus
gagtcggttgttatcctgagttcta

SEQ ID NO: 495291 - DNA, 25 bp, Mus musculus
gagtcggttgttttcctgagttcta

SEQ ID NO: 495292 - DNA, 25 bp, Mus musculus
gagtcggttttgacccagaaagcta

SEQ ID NO: 495293 - DNA, 25 bp, Mus musculus
gagtcggttttgtcccagaaagcta

SEQ ID NO: 495294 - DNA, 25 bp, Mus musculus
gagtcggtttttccgtcctctcagg

SEQ ID NO: 495295 - DNA, 25 bp, Mus musculus
gagtcggtttttgcgtcctctcagg

SEQ ID NO: 495296 - DNA, 25 bp, Mus musculus
gagtcgtacactcagatctattcag

SEQ ID NO: 495297 - DNA, 25 bp, Mus musculus
gagtcgtacactgagatctattcag

SEQ ID NO: 495298 - DNA, 25 bp, Mus musculus
gagtcgtacattatgcactgcatct

SEQ ID NO: 495299 - DNA, 25 bp, Mus musculus
gagtcgtacattttgcactgcatct

SEQ ID NO: 495300 - DNA, 25 bp, Mus musculus
gagtcgtagcttcaagccgtccaac

SEQ ID NO: 495301 - DNA, 25 bp, Mus musculus
gagtcgtagcttgaagccgtccaac

SEQ ID NO: 495302 - DNA, 25 bp, Mus musculus
gagtcgtatggcatggagctcacaa

SEQ ID NO: 495303 - DNA, 25 bp, Mus musculus
gagtcgtatggcttggagctcacaa

SEQ ID NO: 495304 - DNA, 25 bp, Mus musculus
gagtcgtcactcatgaaagttactt

SEQ ID NO: 495305 - DNA, 25 bp, Mus musculus
gagtcgtcactcttgaaagttactt

SEQ ID NO: 495306 - DNA, 25 bp, Mus musculus
gagtcgtcagagagtccatcattcg

SEQ ID NO: 495307 - DNA, 25 bp, Mus musculus
gagtcgtcagagtgtccatcattcg

SEQ ID NO: 495308 - DNA, 25 bp, Mus musculus
gagtcgtccactacacactgtgggc

SEQ ID NO: 495309 - DNA, 25 bp, Mus musculus
gagtcgtccacttcacactgtgggc

SEQ ID NO: 495310 - DNA, 25 bp, Mus musculus
gagtcgtccctcaggcggtgacaga

SEQ ID NO: 495311 - DNA, 25 bp, Mus musculus
gagtcgtccctctggcggtgacaga

SEQ ID NO: 495312 - DNA, 25 bp, Mus musculus
gagtcgtcctatacaggcgtgggat

SEQ ID NO: 495313 - DNA, 25 bp, Mus musculus
gagtcgtcctattcaggcgtgggat

SEQ ID NO: 495314 - DNA, 25 bp, Mus musculus
gagtcgtcgtagacggagacttgta

SEQ ID NO: 495315 - DNA, 25 bp, Mus musculus
gagtcgtcgtagtcggagacttgta

SEQ ID NO: 495316 - DNA, 25 bp, Mus musculus
gagtcgtctgagcagagtggcactg

SEQ ID NO: 495317 - DNA, 25 bp, Mus musculus
gagtcgtctgaggagagtggcactg

SEQ ID NO: 495318 - DNA, 25 bp, Mus musculus
gagtcgtcttcacggagtcagagcc

SEQ ID NO: 495319 - DNA, 25 bp, Mus musculus
gagtcgtcttcagggagtcagagcc

SEQ ID NO: 495320 - DNA, 25 bp, Mus musculus
gagtcgtcttctagtgatggttgta

SEQ ID NO: 495321 - DNA, 25 bp, Mus musculus
gagtcgtcttcttgtgatggttgta

SEQ ID NO: 495322 - DNA, 25 bp, Mus musculus
gagtcgtgaccaacgaacgcagcaa

SEQ ID NO: 495323 - DNA, 25 bp, Mus musculus
gagtcgtgaccatcgaacgcagcaa

SEQ ID NO: 495324 - DNA, 25 bp, Mus musculus
gagtcgtgagacatctgtgttgcag

SEQ ID NO: 495325 - DNA, 25 bp, Mus musculus
gagtcgtgagacttctgtgttgcag

SEQ ID NO: 495326 - DNA, 25 bp, Mus musculus
gagtcgtgccgcagcatggtgaacc

SEQ ID NO: 495327 - DNA, 25 bp, Mus musculus
gagtcgtgccgctgcatggtgaacc

SEQ ID NO: 495328 - DNA, 25 bp, Mus musculus
gagtcgttcaagcagacggatgtct

SEQ ID NO: 495329 - DNA, 25 bp, Mus musculus
gagtcgttcaaggagacggatgtct

SEQ ID NO: 495330 - DNA, 25 bp, Mus musculus
gagtcgttcatcaatgacatcccca

SEQ ID NO: 495331 - DNA, 25 bp, Mus musculus
gagtcgttcatctatgacatcccca

SEQ ID NO: 495332 - DNA, 25 bp, Mus musculus
gagtcgttcctgaaaatggcttaac

SEQ ID NO: 495333 - DNA, 25 bp, Mus musculus
gagtcgttcctgtaaatggcttaac

SEQ ID NO: 495334 - DNA, 25 bp, Mus musculus
gagtcgttctcaactaagtacgtcc

SEQ ID NO: 495335 - DNA, 25 bp, Mus musculus
gagtcgttctcatctaagtacgtcc

SEQ ID NO: 495336 - DNA, 25 bp, Mus musculus
gagtcgttgagtacccaagtccaag

SEQ ID NO: 495337 - DNA, 25 bp, Mus musculus
gagtcgttgagttcccaagtccaag

SEQ ID NO: 495338 - DNA, 25 bp, Mus musculus
gagtcgttggttatcagtcagttga

SEQ ID NO: 495339 - DNA, 25 bp, Mus musculus
gagtcgttggttttcagtcagttga

SEQ ID NO: 495340 - DNA, 25 bp, Mus musculus
gagtcgttgtttatcctatagttgg

SEQ ID NO: 495341 - DNA, 25 bp, Mus musculus
gagtcgttgtttttcctatagttgg

SEQ ID NO: 495342 - DNA, 25 bp, Mus musculus
gagtcgtttcttacataaccatttt

SEQ ID NO: 495343 - DNA, 25 bp, Mus musculus
gagtcgtttctttcataaccatttt

SEQ ID NO: 495344 - DNA, 25 bp, Mus musculus
gagtcgtttttcagtctatagtcag

SEQ ID NO: 495345 - DNA, 25 bp, Mus musculus
gagtcgtttttctgtctatagtcag

SEQ ID NO: 495346 - DNA, 25 bp, Mus musculus
gagtctaaatccagcagttacaagt

SEQ ID NO: 495347 - DNA, 25 bp, Mus musculus
gagtctaaatcctgcagttacaagt

SEQ ID NO: 495348 - DNA, 25 bp, Mus musculus
gagtctaagactctgtcccctttat

SEQ ID NO: 495349 - DNA, 25 bp, Mus musculus
gagtctaagactgtgtcccctttat

SEQ ID NO: 495350 - DNA, 25 bp, Mus musculus
gagtctaagattccttccccttatt

SEQ ID NO: 495351 - DNA, 25 bp, Mus musculus
gagtctaagattgcttccccttatt

SEQ ID NO: 495352 - DNA, 25 bp, Mus musculus
gagtctaagtaaaacagcagggcta

SEQ ID NO: 495353 - DNA, 25 bp, Mus musculus
gagtctaagtaatacagcagggcta

SEQ ID NO: 495354 - DNA, 25 bp, Mus musculus
gagtctaagttcatgtctccttaca

SEQ ID NO: 495355 - DNA, 25 bp, Mus musculus
gagtctaagttcttgtctccttaca

SEQ ID NO: 495356 - DNA, 25 bp, Mus musculus
gagtctaatcaactttttgcttcat

SEQ ID NO: 495357 - DNA, 25 bp, Mus musculus
gagtctaatcaagtttttgcttcat

SEQ ID NO: 495358 - DNA, 25 bp, Mus musculus
gagtctaattgtaagacatttctta

SEQ ID NO: 495359 - DNA, 25 bp, Mus musculus
gagtctaattgttagacatttctta

SEQ ID NO: 495360 - DNA, 25 bp, Mus musculus
gagtctacacagactttcagggagg

SEQ ID NO: 495361 - DNA, 25 bp, Mus musculus
gagtctacacagtctttcagggagg

SEQ ID NO: 495362 - DNA, 25 bp, Mus musculus
gagtctacacgaatcttaggtattg

SEQ ID NO: 495363 - DNA, 25 bp, Mus musculus
gagtctacacgattcttaggtattg

SEQ ID NO: 495364 - DNA, 25 bp, Mus musculus
gagtctacagcacttgtttcttttt

SEQ ID NO: 495365 - DNA, 25 bp, Mus musculus
gagtctacagcagttgtttcttttt

SEQ ID NO: 495366 - DNA, 25 bp, Mus musculus
gagtctacagtgagacccttgtcag

SEQ ID NO: 495367 - DNA, 25 bp, Mus musculus
gagtctacagtgatggttctccgaa

SEQ ID NO: 495368 - DNA, 25 bp, Mus musculus
gagtctacagtgtgacccttgtcag

SEQ ID NO: 495369 - DNA, 25 bp, Mus musculus
gagtctacagtgttggttctccgaa

SEQ ID NO: 495370 - DNA, 25 bp, Mus musculus
gagtctacctgtactcgttcatcag

SEQ ID NO: 495371 - DNA, 25 bp, Mus musculus
gagtctacctgttctcgttcatcag

SEQ ID NO: 495372 - DNA, 25 bp, Mus musculus
gagtctaccttacacttttgctgta

SEQ ID NO: 495373 - DNA, 25 bp, Mus musculus
gagtctaccttagacttttgctgta

SEQ ID NO: 495374 - DNA, 25 bp, Mus musculus
gagtctacgttgatggcttctgaca

SEQ ID NO: 495375 - DNA, 25 bp, Mus musculus
gagtctacgttgttggcttctgaca

SEQ ID NO: 495376 - DNA, 25 bp, Mus musculus
gagtctacgtttcatattgccttaa

SEQ ID NO: 495377 - DNA, 25 bp, Mus musculus
gagtctacgtttgatattgccttaa

SEQ ID NO: 495378 - DNA, 25 bp, Mus musculus
gagtctactcaaaggcatgatgctg

SEQ ID NO: 495379 - DNA, 25 bp, Mus musculus
gagtctactcaatggcatgatgctg

SEQ ID NO: 495380 - DNA, 25 bp, Mus musculus
gagtctagaatgatggtctctgaag

SEQ ID NO: 495381 - DNA, 25 bp, Mus musculus
gagtctagaatgttggtctctgaag

SEQ ID NO: 495382 - DNA, 25 bp, Mus musculus
gagtctagaattcagggacatgtag

SEQ ID NO: 495383 - DNA, 25 bp, Mus musculus
gagtctagaattgagggacatgtag

SEQ ID NO: 495384 - DNA, 25 bp, Mus musculus
gagtctagacagagacgacgaccta

SEQ ID NO: 495385 - DNA, 25 bp, Mus musculus
gagtctagacagtgacgacgaccta

SEQ ID NO: 495386 - DNA, 25 bp, Mus musculus
gagtctagagacacacagtattatg

SEQ ID NO: 495387 - DNA, 25 bp, Mus musculus
gagtctagagactcacagtattatg

SEQ ID NO: 495388 - DNA, 25 bp, Mus musculus
gagtctagagtaatcctgcttgata

SEQ ID NO: 495389 - DNA, 25 bp, Mus musculus
gagtctagagtattcctgcttgata

SEQ ID NO: 495390 - DNA, 25 bp, Mus musculus
gagtctagattcaatctcagtgcta

SEQ ID NO: 495391 - DNA, 25 bp, Mus musculus
gagtctagattctatctcagtgcta

SEQ ID NO: 495392 - DNA, 25 bp, Mus musculus
gagtctagatttatgtcctgctgcc

SEQ ID NO: 495393 - DNA, 25 bp, Mus musculus
gagtctagatttttgtcctgctgcc

SEQ ID NO: 495394 - DNA, 25 bp, Mus musculus
gagtctagccccaaagtccaaggta

SEQ ID NO: 495395 - DNA, 25 bp, Mus musculus
gagtctagcccctaagtccaaggta

SEQ ID NO: 495396 - DNA, 25 bp, Mus musculus
gagtctagcttcaccggtgaggaaa

SEQ ID NO: 495397 - DNA, 25 bp, Mus musculus
gagtctagcttctccggtgaggaaa

SEQ ID NO: 495398 - DNA, 25 bp, Mus musculus
gagtctaggaacactgacgcccctg

SEQ ID NO: 495399 - DNA, 25 bp, Mus musculus
gagtctaggaactctgacgcccctg

SEQ ID NO: 495400 - DNA, 25 bp, Mus musculus
gagtctaggccgaactccccgtcat

SEQ ID NO: 495401 - DNA, 25 bp, Mus musculus
gagtctaggccgtactccccgtcat

SEQ ID NO: 495402 - DNA, 25 bp, Mus musculus
gagtctaggcgcacagacatcagac

SEQ ID NO: 495403 - DNA, 25 bp, Mus musculus
gagtctaggcgctcagacatcagac

SEQ ID NO: 495404 - DNA, 25 bp, Mus musculus
gagtctagggcaagaggacctgttc

SEQ ID NO: 495405 - DNA, 25 bp, Mus musculus
gagtctagggcatgaggacctgttc

SEQ ID NO: 495406 - DNA, 25 bp, Mus musculus
gagtctaggtcacatctcatgcaga

SEQ ID NO: 495407 - DNA, 25 bp, Mus musculus
gagtctaggtcagatctcatgcaga

SEQ ID NO: 495408 - DNA, 25 bp, Mus musculus
gagtctaggtgacatcattcagtct

SEQ ID NO: 495409 - DNA, 25 bp, Mus musculus
gagtctaggtgagatcattcagtct

SEQ ID NO: 495410 - DNA, 25 bp, Mus musculus
gagtctagtgtacccaaagcacaaa

SEQ ID NO: 495411 - DNA, 25 bp, Mus musculus
gagtctagtgtagccaaagcacaaa

SEQ ID NO: 495412 - DNA, 25 bp, Mus musculus
gagtctagttagctttctcactggt

SEQ ID NO: 495413 - DNA, 25 bp, Mus musculus
gagtctagttaggtttctcactggt

SEQ ID NO: 495414 - DNA, 25 bp, Mus musculus
gagtctagtttcacagtaaacaagc

SEQ ID NO: 495415 - DNA, 25 bp, Mus musculus
gagtctagtttctcagtaaacaagc

SEQ ID NO: 495416 - DNA, 25 bp, Mus musculus
gagtctagttttcttgaccccgagt

SEQ ID NO: 495417 - DNA, 25 bp, Mus musculus
gagtctagttttgttgaccccgagt

SEQ ID NO: 495418 - DNA, 25 bp, Mus musculus
gagtctatagacatgtcctcaaagg

SEQ ID NO: 495419 - DNA, 25 bp, Mus musculus
gagtctatagacttgtcctcaaagg

SEQ ID NO: 495420 - DNA, 25 bp, Mus musculus
gagtctatatcacagtgctgggtgt

SEQ ID NO: 495421 - DNA, 25 bp, Mus musculus
gagtctatatcagagtgctgggtgt

SEQ ID NO: 495422 - DNA, 25 bp, Mus musculus
gagtctatatttcctttctcagagc

SEQ ID NO: 495423 - DNA, 25 bp, Mus musculus
gagtctatatttgctttctcagagc

SEQ ID NO: 495424 - DNA, 25 bp, Mus musculus
gagtctatcagtcctttaaacatca

SEQ ID NO: 495425 - DNA, 25 bp, Mus musculus
gagtctatcagtgctttaaacatca

SEQ ID NO: 495426 - DNA, 25 bp, Mus musculus
gagtctatcctaattactgcttctg

SEQ ID NO: 495427 - DNA, 25 bp, Mus musculus
gagtctatcctatttactgcttctg

SEQ ID NO: 495428 - DNA, 25 bp, Mus musculus
gagtctatcctcaggacttagaact

SEQ ID NO: 495429 - DNA, 25 bp, Mus musculus
gagtctatcctctggacttagaact

SEQ ID NO: 495430 - DNA, 25 bp, Mus musculus
gagtctatctagagcttagcgcaga

SEQ ID NO: 495431 - DNA, 25 bp, Mus musculus
gagtctatctagtgcttagcgcaga

SEQ ID NO: 495432 - DNA, 25 bp, Mus musculus
gagtctatgacaagctaccccaaat

SEQ ID NO: 495433 - DNA, 25 bp, Mus musculus
gagtctatgacatgctaccccaaat

SEQ ID NO: 495434 - DNA, 25 bp, Mus musculus
gagtctatgaccaaggccaggctga

SEQ ID NO: 495435 - DNA, 25 bp, Mus musculus
gagtctatgacctaggccaggctga

SEQ ID NO: 495436 - DNA, 25 bp, Mus musculus
gagtctatgatcaattctgcccttt

SEQ ID NO: 495437 - DNA, 25 bp, Mus musculus
gagtctatgatctattctgcccttt

SEQ ID NO: 495438 - DNA, 25 bp, Mus musculus
gagtctatgccgagctgtcaaagcg

SEQ ID NO: 495439 - DNA, 25 bp, Mus musculus
gagtctatgccgtgctgtcaaagcg

SEQ ID NO: 495440 - DNA, 25 bp, Mus musculus
gagtctatggccagtgacaacatct

SEQ ID NO: 495441 - DNA, 25 bp, Mus musculus
gagtctatggcctgtgacaacatct

SEQ ID NO: 495442 - DNA, 25 bp, Mus musculus
gagtctatggtaatcttgttgcccc

SEQ ID NO: 495443 - DNA, 25 bp, Mus musculus
gagtctatggtattcttgttgcccc

SEQ ID NO: 495444 - DNA, 25 bp, Mus musculus
gagtctattaggcattctgatattt

SEQ ID NO: 495445 - DNA, 25 bp, Mus musculus
gagtctattagggattctgatattt

SEQ ID NO: 495446 - DNA, 25 bp, Mus musculus
gagtctattcctaattctgacagaa

SEQ ID NO: 495447 - DNA, 25 bp, Mus musculus
gagtctattccttattctgacagaa

SEQ ID NO: 495448 - DNA, 25 bp, Mus musculus
gagtctattgatcctgcggttgtcc

SEQ ID NO: 495449 - DNA, 25 bp, Mus musculus
gagtctattgatgctgcggttgtcc

SEQ ID NO: 495450 - DNA, 25 bp, Mus musculus
gagtctatttgtcgtcactagcact

SEQ ID NO: 495451 - DNA, 25 bp, Mus musculus
gagtctatttgtggtcactagcact

SEQ ID NO: 495452 - DNA, 25 bp, Mus musculus
gagtctcaaaagatgcttgaagcta

SEQ ID NO: 495453 - DNA, 25 bp, Mus musculus
gagtctcaaaagttgcttgaagcta

SEQ ID NO: 495454 - DNA, 25 bp, Mus musculus
gagtctcaaacaactgaagtcaatt

SEQ ID NO: 495455 - DNA, 25 bp, Mus musculus
gagtctcaaacaataggtgaccagt

SEQ ID NO: 495456 - DNA, 25 bp, Mus musculus
gagtctcaaacatctgaagtcaatt

SEQ ID NO: 495457 - DNA, 25 bp, Mus musculus
gagtctcaaacattaggtgaccagt

SEQ ID NO: 495458 - DNA, 25 bp, Mus musculus
gagtctcaaagccatccctaggaac

SEQ ID NO: 495459 - DNA, 25 bp, Mus musculus
gagtctcaaagcgatccctaggaac

SEQ ID NO: 495460 - DNA, 25 bp, Mus musculus
gagtctcaactgagttactatacaa

SEQ ID NO: 495461 - DNA, 25 bp, Mus musculus
gagtctcaactgtgttactatacaa

SEQ ID NO: 495462 - DNA, 25 bp, Mus musculus
gagtctcaagagaaccagagtcagc

SEQ ID NO: 495463 - DNA, 25 bp, Mus musculus
gagtctcaagagtaccagagtcagc

SEQ ID NO: 495464 - DNA, 25 bp, Mus musculus
gagtctcaaggccaggcttttcttt

SEQ ID NO: 495465 - DNA, 25 bp, Mus musculus
gagtctcaaggcgaggcttttcttt

SEQ ID NO: 495466 - DNA, 25 bp, Mus musculus
gagtctcacctgattactgacaact

SEQ ID NO: 495467 - DNA, 25 bp, Mus musculus
gagtctcacctgtttactgacaact

SEQ ID NO: 495468 - DNA, 25 bp, Mus musculus
gagtctcacggtcggtttctgtcat

SEQ ID NO: 495469 - DNA, 25 bp, Mus musculus
gagtctcacggtgggtttctgtcat

SEQ ID NO: 495470 - DNA, 25 bp, Mus musculus
gagtctcactatacatatattctga

SEQ ID NO: 495471 - DNA, 25 bp, Mus musculus
gagtctcactattcatatattctga

SEQ ID NO: 495472 - DNA, 25 bp, Mus musculus
gagtctcactcacatttgttttcag

SEQ ID NO: 495473 - DNA, 25 bp, Mus musculus
gagtctcactcagatttgttttcag

SEQ ID NO: 495474 - DNA, 25 bp, Mus musculus
gagtctcacttccagtgtttcaagt

SEQ ID NO: 495475 - DNA, 25 bp, Mus musculus
gagtctcacttcgagtgtttcaagt

SEQ ID NO: 495476 - DNA, 25 bp, Mus musculus
gagtctcagagacgccattgtgtga

SEQ ID NO: 495477 - DNA, 25 bp, Mus musculus
gagtctcagagactatgcacacaaa

SEQ ID NO: 495478 - DNA, 25 bp, Mus musculus
gagtctcagagaggccattgtgtga

SEQ ID NO: 495479 - DNA, 25 bp, Mus musculus
gagtctcagagagtatgcacacaaa

SEQ ID NO: 495480 - DNA, 25 bp, Mus musculus
gagtctcagagtctctcattaggaa

SEQ ID NO: 495481 - DNA, 25 bp, Mus musculus
gagtctcagagtgtctcattaggaa

SEQ ID NO: 495482 - DNA, 25 bp, Mus musculus
gagtctcagattatctaaggaccaa

SEQ ID NO: 495483 - DNA, 25 bp, Mus musculus
gagtctcagattttctaaggaccaa

SEQ ID NO: 495484 - DNA, 25 bp, Mus musculus
gagtctcagcaaaagaaacgcaggg

SEQ ID NO: 495485 - DNA, 25 bp, Mus musculus
gagtctcagcaatagaaacgcaggg

SEQ ID NO: 495486 - DNA, 25 bp, Mus musculus
gagtctcagcttcatgggtgcagcc

SEQ ID NO: 495487 - DNA, 25 bp, Mus musculus
gagtctcagcttgatgggtgcagcc

SEQ ID NO: 495488 - DNA, 25 bp, Mus musculus
gagtctcagggaaggcaggcaacac

SEQ ID NO: 495489 - DNA, 25 bp, Mus musculus
gagtctcagggatggcaggcaacac

SEQ ID NO: 495490 - DNA, 25 bp, Mus musculus
gagtctcagtgtctgaggccctgac

SEQ ID NO: 495491 - DNA, 25 bp, Mus musculus
gagtctcagtgtgtgaggccctgac

SEQ ID NO: 495492 - DNA, 25 bp, Mus musculus
gagtctcatcacagaaggcacccaa

SEQ ID NO: 495493 - DNA, 25 bp, Mus musculus
gagtctcatcactgaaggcacccaa

SEQ ID NO: 495494 - DNA, 25 bp, Mus musculus
gagtctcatccccttctactgcaaa

SEQ ID NO: 495495 - DNA, 25 bp, Mus musculus
gagtctcatcccgttctactgcaaa

SEQ ID NO: 495496 - DNA, 25 bp, Mus musculus
gagtctcatgttagctgatggttta

SEQ ID NO: 495497 - DNA, 25 bp, Mus musculus
gagtctcatgtttgctgatggttta

SEQ ID NO: 495498 - DNA, 25 bp, Mus musculus
gagtctcatttgacacatgggctgt

SEQ ID NO: 495499 - DNA, 25 bp, Mus musculus
gagtctcatttgtcacatgggctgt

SEQ ID NO: 495500 - DNA, 25 bp, Mus musculus
gagtctccaagacaactgattcatt

SEQ ID NO: 495501 - DNA, 25 bp, Mus musculus
gagtctccaagagaactgattcatt

SEQ ID NO: 495502 - DNA, 25 bp, Mus musculus
gagtctccacaaaccttgaagaaac

SEQ ID NO: 495503 - DNA, 25 bp, Mus musculus
gagtctccacaatccttgaagaaac

SEQ ID NO: 495504 - DNA, 25 bp, Mus musculus
gagtctccagcacccgtcgaagggt

SEQ ID NO: 495505 - DNA, 25 bp, Mus musculus
gagtctccagcagccgtcgaagggt

SEQ ID NO: 495506 - DNA, 25 bp, Mus musculus
gagtctccagcccttgtggtcactg

SEQ ID NO: 495507 - DNA, 25 bp, Mus musculus
gagtctccagccgttgtggtcactg

SEQ ID NO: 495508 - DNA, 25 bp, Mus musculus
gagtctccaggaagcaaaagctgtg

SEQ ID NO: 495509 - DNA, 25 bp, Mus musculus
gagtctccaggatgcaaaagctgtg

SEQ ID NO: 495510 - DNA, 25 bp, Mus musculus
gagtctccagtgatgaggcataccc

SEQ ID NO: 495511 - DNA, 25 bp, Mus musculus
gagtctccagtgttgaggcataccc

SEQ ID NO: 495512 - DNA, 25 bp, Mus musculus
gagtctccatgcattaacaggttgt

SEQ ID NO: 495513 - DNA, 25 bp, Mus musculus
gagtctccatgctttaacaggttgt

SEQ ID NO: 495514 - DNA, 25 bp, Mus musculus
gagtctccatgtacaatagcaccca

SEQ ID NO: 495515 - DNA, 25 bp, Mus musculus
gagtctccatgttcaatagcaccca

SEQ ID NO: 495516 - DNA, 25 bp, Mus musculus
gagtctccgacaagtctgatgtcat

SEQ ID NO: 495517 - DNA, 25 bp, Mus musculus
gagtctccgacatgtctgatgtcat

SEQ ID NO: 495518 - DNA, 25 bp, Mus musculus
gagtctccgctgagacaggaagcca

SEQ ID NO: 495519 - DNA, 25 bp, Mus musculus
gagtctccgctgtgacaggaagcca

SEQ ID NO: 495520 - DNA, 25 bp, Mus musculus
gagtctccggtgcatcatttaatct

SEQ ID NO: 495521 - DNA, 25 bp, Mus musculus
gagtctccggtggatcatttaatct

SEQ ID NO: 495522 - DNA, 25 bp, Mus musculus
gagtctccgttgctcatgcctgagc

SEQ ID NO: 495523 - DNA, 25 bp, Mus musculus
gagtctccgttggtcatgcctgagc

SEQ ID NO: 495524 - DNA, 25 bp, Mus musculus
gagtctcctcataacttatgtgtgc

SEQ ID NO: 495525 - DNA, 25 bp, Mus musculus
gagtctcctcattacttatgtgtgc

SEQ ID NO: 495526 - DNA, 25 bp, Mus musculus
gagtctcctcggcaaactgttcaac

SEQ ID NO: 495527 - DNA, 25 bp, Mus musculus
gagtctcctcggctttggcaaaatc

SEQ ID NO: 495528 - DNA, 25 bp, Mus musculus
gagtctcctcgggaaactgttcaac

SEQ ID NO: 495529 - DNA, 25 bp, Mus musculus
gagtctcctcgggtttggcaaaatc

SEQ ID NO: 495530 - DNA, 25 bp, Mus musculus
gagtctcctgagcatgtgaaccggc

SEQ ID NO: 495531 - DNA, 25 bp, Mus musculus
gagtctcctgaggatgtgaaccggc

SEQ ID NO: 495532 - DNA, 25 bp, Mus musculus
gagtctcctgatcccaggttgccag

SEQ ID NO: 495533 - DNA, 25 bp, Mus musculus
gagtctcctgatgccaggttgccag

SEQ ID NO: 495534 - DNA, 25 bp, Mus musculus
gagtctcctggacagttattcttgg

SEQ ID NO: 495535 - DNA, 25 bp, Mus musculus
gagtctcctggagagttattcttgg

SEQ ID NO: 495536 - DNA, 25 bp, Mus musculus
gagtctcctggcaggcctgaagcat

SEQ ID NO: 495537 - DNA, 25 bp, Mus musculus
gagtctcctggctggcctgaagcat

SEQ ID NO: 495538 - DNA, 25 bp, Mus musculus
gagtctccttatatagctcaggttg

SEQ ID NO: 495539 - DNA, 25 bp, Mus musculus
gagtctccttatttagctcaggttg

SEQ ID NO: 495540 - DNA, 25 bp, Mus musculus
gagtctccttccctttcagaatatt

SEQ ID NO: 495541 - DNA, 25 bp, Mus musculus
gagtctccttccgtttcagaatatt

SEQ ID NO: 495542 - DNA, 25 bp, Mus musculus
gagtctccttgtcaatagaactgca

SEQ ID NO: 495543 - DNA, 25 bp, Mus musculus
gagtctccttgtccttgatgtcaaa

SEQ ID NO: 495544 - DNA, 25 bp, Mus musculus
gagtctccttgtgaatagaactgca

SEQ ID NO: 495545 - DNA, 25 bp, Mus musculus
gagtctccttgtgcttgatgtcaaa

SEQ ID NO: 495546 - DNA, 25 bp, Mus musculus
gagtctcctttaaaatgatctacct

SEQ ID NO: 495547 - DNA, 25 bp, Mus musculus
gagtctcctttataatgatctacct

SEQ ID NO: 495548 - DNA, 25 bp, Mus musculus
gagtctcgactcaccaggcagtctg

SEQ ID NO: 495549 - DNA, 25 bp, Mus musculus
gagtctcgactctccaggcagtctg

SEQ ID NO: 495550 - DNA, 25 bp, Mus musculus
gagtctcgatggatgcttgctaaac

SEQ ID NO: 495551 - DNA, 25 bp, Mus musculus
gagtctcgatggttgcttgctaaac

SEQ ID NO: 495552 - DNA, 25 bp, Mus musculus
gagtctcggacacaactggttcctc

SEQ ID NO: 495553 - DNA, 25 bp, Mus musculus
gagtctcggacagaactggttcctc

SEQ ID NO: 495554 - DNA, 25 bp, Mus musculus
gagtctcgggaaccttgcataactt

SEQ ID NO: 495555 - DNA, 25 bp, Mus musculus
gagtctcgggaagcttgcataactt

SEQ ID NO: 495556 - DNA, 25 bp, Mus musculus
gagtctcggtagctgtcatccggct

SEQ ID NO: 495557 - DNA, 25 bp, Mus musculus
gagtctcggtaggtgtcatccggct

SEQ ID NO: 495558 - DNA, 25 bp, Mus musculus
gagtctcggtttcctttcctataat

SEQ ID NO: 495559 - DNA, 25 bp, Mus musculus
gagtctcggtttgctttcctataat

SEQ ID NO: 495560 - DNA, 25 bp, Mus musculus
gagtctcgtctaaagaagctcccaa

SEQ ID NO: 495561 - DNA, 25 bp, Mus musculus
gagtctcgtctatagaagctcccaa

SEQ ID NO: 495562 - DNA, 25 bp, Mus musculus
gagtctctaccaccattaactgtct

SEQ ID NO: 495563 - DNA, 25 bp, Mus musculus
gagtctctaccagcattaactgtct

SEQ ID NO: 495564 - DNA, 25 bp, Mus musculus
gagtctctagccaagttgcgacgtg

SEQ ID NO: 495565 - DNA, 25 bp, Mus musculus
gagtctctagcctagttgcgacgtg

SEQ ID NO: 495566 - DNA, 25 bp, Mus musculus
gagtctctcaaaattctgtttatct

SEQ ID NO: 495567 - DNA, 25 bp, Mus musculus
gagtctctcaaatttctgtttatct

SEQ ID NO: 495568 - DNA, 25 bp, Mus musculus
gagtctctcagacattctgtagttc

SEQ ID NO: 495569 - DNA, 25 bp, Mus musculus
gagtctctcagagattctgtagttc

SEQ ID NO: 495570 - DNA, 25 bp, Mus musculus
gagtctctcagtctgatcactctat

SEQ ID NO: 495571 - DNA, 25 bp, Mus musculus
gagtctctcagtgtgatcactctat

SEQ ID NO: 495572 - DNA, 25 bp, Mus musculus
gagtctctcattaggaaaaactaga

SEQ ID NO: 495573 - DNA, 25 bp, Mus musculus
gagtctctcattctggcagaacgca

SEQ ID NO: 495574 - DNA, 25 bp, Mus musculus
gagtctctcattgtggcagaacgca

SEQ ID NO: 495575 - DNA, 25 bp, Mus musculus
gagtctctcatttggaaaaactaga

SEQ ID NO: 495576 - DNA, 25 bp, Mus musculus
gagtctctccctcgaaagacaacct

SEQ ID NO: 495577 - DNA, 25 bp, Mus musculus
gagtctctccctggaaagacaacct

SEQ ID NO: 495578 - DNA, 25 bp, Mus musculus
gagtctctcctacagacaagctggg

SEQ ID NO: 495579 - DNA, 25 bp, Mus musculus
gagtctctcctagagacaagctggg

SEQ ID NO: 495580 - DNA, 25 bp, Mus musculus
gagtctctcgccatttaggcaagtg

SEQ ID NO: 495581 - DNA, 25 bp, Mus musculus
gagtctctcgccttttaggcaagtg

SEQ ID NO: 495582 - DNA, 25 bp, Mus musculus
gagtctctgactctatgggaagtta

SEQ ID NO: 495583 - DNA, 25 bp, Mus musculus
gagtctctgactgtatgggaagtta

SEQ ID NO: 495584 - DNA, 25 bp, Mus musculus
gagtctctgatccaaacatgtttct

SEQ ID NO: 495585 - DNA, 25 bp, Mus musculus
gagtctctgatcgaaacatgtttct

SEQ ID NO: 495586 - DNA, 25 bp, Mus musculus
gagtctctgcggagatcctgtgtct

SEQ ID NO: 495587 - DNA, 25 bp, Mus musculus
gagtctctgcggtgatcctgtgtct

SEQ ID NO: 495588 - DNA, 25 bp, Mus musculus
gagtctctgctgattcttaattaaa

SEQ ID NO: 495589 - DNA, 25 bp, Mus musculus
gagtctctgctgcagctcaggagaa

SEQ ID NO: 495590 - DNA, 25 bp, Mus musculus
gagtctctgctggagctcaggagaa

SEQ ID NO: 495591 - DNA, 25 bp, Mus musculus
gagtctctgctgtttcttaattaaa

SEQ ID NO: 495592 - DNA, 25 bp, Mus musculus
gagtctctgcttacatttcctggat

SEQ ID NO: 495593 - DNA, 25 bp, Mus musculus
gagtctctgctttcatttcctggat

SEQ ID NO: 495594 - DNA, 25 bp, Mus musculus
gagtctctggaaccctctttacaat

SEQ ID NO: 495595 - DNA, 25 bp, Mus musculus
gagtctctggaagcctctttacaat

SEQ ID NO: 495596 - DNA, 25 bp, Mus musculus
gagtctctgttcatctataggcttt

SEQ ID NO: 495597 - DNA, 25 bp, Mus musculus
gagtctctgttcatttttagtatcc

SEQ ID NO: 495598 - DNA, 25 bp, Mus musculus
gagtctctgttcttctataggcttt

SEQ ID NO: 495599 - DNA, 25 bp, Mus musculus
gagtctctgttcttttttagtatcc

SEQ ID NO: 495600 - DNA, 25 bp, Mus musculus
gagtctcttaaacctccaggtactg

SEQ ID NO: 495601 - DNA, 25 bp, Mus musculus
gagtctcttaaagctccaggtactg

SEQ ID NO: 495602 - DNA, 25 bp, Mus musculus
gagtctcttagacaaaggccctctg

SEQ ID NO: 495603 - DNA, 25 bp, Mus musculus
gagtctcttagagaaaggccctctg

SEQ ID NO: 495604 - DNA, 25 bp, Mus musculus
gagtctcttataattcctgaactaa

SEQ ID NO: 495605 - DNA, 25 bp, Mus musculus
gagtctcttatatttcctgaactaa

SEQ ID NO: 495606 - DNA, 25 bp, Mus musculus
gagtctcttatcagatccatgctgt

SEQ ID NO: 495607 - DNA, 25 bp, Mus musculus
gagtctcttatctgatccatgctgt

SEQ ID NO: 495608 - DNA, 25 bp, Mus musculus
gagtctcttgacatttgctatttag

SEQ ID NO: 495609 - DNA, 25 bp, Mus musculus
gagtctcttgacttttgctatttag

SEQ ID NO: 495610 - DNA, 25 bp, Mus musculus
gagtctcttgtcaagagagcagcat

SEQ ID NO: 495611 - DNA, 25 bp, Mus musculus
gagtctcttgtctagagagcagcat

SEQ ID NO: 495612 - DNA, 25 bp, Mus musculus
gagtctctttcgactcattcaaggg

SEQ ID NO: 495613 - DNA, 25 bp, Mus musculus
gagtctctttcgtctcattcaaggg

SEQ ID NO: 495614 - DNA, 25 bp, Mus musculus
gagtctctttttctcaatttaccgt

SEQ ID NO: 495615 - DNA, 25 bp, Mus musculus
gagtctctttttgtcaatttaccgt

SEQ ID NO: 495616 - DNA, 25 bp, Mus musculus
gagtctgaaaggcagtattccacta

SEQ ID NO: 495617 - DNA, 25 bp, Mus musculus
gagtctgaaagggagtattccacta

SEQ ID NO: 495618 - DNA, 25 bp, Mus musculus
gagtctgaacgtattcttaagcttt

SEQ ID NO: 495619 - DNA, 25 bp, Mus musculus
gagtctgaacgttttcttaagcttt

SEQ ID NO: 495620 - DNA, 25 bp, Mus musculus
gagtctgaagcaccaccgggtccgc

SEQ ID NO: 495621 - DNA, 25 bp, Mus musculus
gagtctgaagcagcaccgggtccgc

SEQ ID NO: 495622 - DNA, 25 bp, Mus musculus
gagtctgaagctccagggacctttt

SEQ ID NO: 495623 - DNA, 25 bp, Mus musculus
gagtctgaagctgcagggacctttt

SEQ ID NO: 495624 - DNA, 25 bp, Mus musculus
gagtctgaatcaacttactttgcaa

SEQ ID NO: 495625 - DNA, 25 bp, Mus musculus
gagtctgaatcatcttactttgcaa

SEQ ID NO: 495626 - DNA, 25 bp, Mus musculus
gagtctgacaaacccttcatgtcca

SEQ ID NO: 495627 - DNA, 25 bp, Mus musculus
gagtctgacaaagccttcatgtcca

SEQ ID NO: 495628 - DNA, 25 bp, Mus musculus
gagtctgacaagatggacctctttg

SEQ ID NO: 495629 - DNA, 25 bp, Mus musculus
gagtctgacaagttggacctctttg

SEQ ID NO: 495630 - DNA, 25 bp, Mus musculus
gagtctgacatcagtcaccagatta

SEQ ID NO: 495631 - DNA, 25 bp, Mus musculus
gagtctgacatctgtcaccagatta

SEQ ID NO: 495632 - DNA, 25 bp, Mus musculus
gagtctgacgagagttgtgctgttt

SEQ ID NO: 495633 - DNA, 25 bp, Mus musculus
gagtctgacgagtgttgtgctgttt

SEQ ID NO: 495634 - DNA, 25 bp, Mus musculus
gagtctgacgttcctgaacacaaca

SEQ ID NO: 495635 - DNA, 25 bp, Mus musculus
gagtctgacgttgctgaacacaaca

SEQ ID NO: 495636 - DNA, 25 bp, Mus musculus
gagtctgactctacatttgttttca

SEQ ID NO: 495637 - DNA, 25 bp, Mus musculus
gagtctgactcttcatttgttttca

SEQ ID NO: 495638 - DNA, 25 bp, Mus musculus
gagtctgacttcacagttgagttgc

SEQ ID NO: 495639 - DNA, 25 bp, Mus musculus
gagtctgacttcaccaacaacgtgg

SEQ ID NO: 495640 - DNA, 25 bp, Mus musculus
gagtctgacttctcagttgagttgc

SEQ ID NO: 495641 - DNA, 25 bp, Mus musculus
gagtctgacttctccaacaacgtgg

SEQ ID NO: 495642 - DNA, 25 bp, Mus musculus
gagtctgagactcgcctggatacat

SEQ ID NO: 495643 - DNA, 25 bp, Mus musculus
gagtctgagactggcctggatacat

SEQ ID NO: 495644 - DNA, 25 bp, Mus musculus
gagtctgagattacagctgctgcct

SEQ ID NO: 495645 - DNA, 25 bp, Mus musculus
gagtctgagatttcagctgctgcct

SEQ ID NO: 495646 - DNA, 25 bp, Mus musculus
gagtctgagcaaagaagttctgaga

SEQ ID NO: 495647 - DNA, 25 bp, Mus musculus
gagtctgagcaacacagacccaact

SEQ ID NO: 495648 - DNA, 25 bp, Mus musculus
gagtctgagcaagacagacccaact

SEQ ID NO: 495649 - DNA, 25 bp, Mus musculus
gagtctgagcaatgaagttctgaga

SEQ ID NO: 495650 - DNA, 25 bp, Mus musculus
gagtctgagcagaagtttacttttt

SEQ ID NO: 495651 - DNA, 25 bp, Mus musculus
gagtctgagcagtagtttacttttt

SEQ ID NO: 495652 - DNA, 25 bp, Mus musculus
gagtctgagcatagctgagccctga

SEQ ID NO: 495653 - DNA, 25 bp, Mus musculus
gagtctgagcattgctgagccctga

SEQ ID NO: 495654 - DNA, 25 bp, Mus musculus
gagtctgagctcagagcttccgagc

SEQ ID NO: 495655 - DNA, 25 bp, Mus musculus
gagtctgagctctgagcttccgagc

SEQ ID NO: 495656 - DNA, 25 bp, Mus musculus
gagtctgagggtagtttatccaccc

SEQ ID NO: 495657 - DNA, 25 bp, Mus musculus
gagtctgagggttgtttatccaccc

SEQ ID NO: 495658 - DNA, 25 bp, Mus musculus
gagtctgagtctcgttcgagcctaa

SEQ ID NO: 495659 - DNA, 25 bp, Mus musculus
gagtctgagtctggttcgagcctaa

SEQ ID NO: 495660 - DNA, 25 bp, Mus musculus
gagtctgagtttcgccttaacacct

SEQ ID NO: 495661 - DNA, 25 bp, Mus musculus
gagtctgagtttggccttaacacct

SEQ ID NO: 495662 - DNA, 25 bp, Mus musculus
gagtctgatacaatgcaaaccttga

SEQ ID NO: 495663 - DNA, 25 bp, Mus musculus
gagtctgatacattgcaaaccttga

SEQ ID NO: 495664 - DNA, 25 bp, Mus musculus
gagtctgatcagattcagccaggag

SEQ ID NO: 495665 - DNA, 25 bp, Mus musculus
gagtctgatcagtttcagccaggag

SEQ ID NO: 495666 - DNA, 25 bp, Mus musculus
gagtctgatctcaggcacagatgat

SEQ ID NO: 495667 - DNA, 25 bp, Mus musculus
gagtctgatctctggcacagatgat

SEQ ID NO: 495668 - DNA, 25 bp, Mus musculus
gagtctgatctgctaaaaactgcct

SEQ ID NO: 495669 - DNA, 25 bp, Mus musculus
gagtctgatctggtaaaaactgcct

SEQ ID NO: 495670 - DNA, 25 bp, Mus musculus
gagtctgatgccaagccatgaggtg

SEQ ID NO: 495671 - DNA, 25 bp, Mus musculus
gagtctgatgcctagccatgaggtg

SEQ ID NO: 495672 - DNA, 25 bp, Mus musculus
gagtctgatgtcacccatcactatt

SEQ ID NO: 495673 - DNA, 25 bp, Mus musculus
gagtctgatgtcatggttgggccct

SEQ ID NO: 495674 - DNA, 25 bp, Mus musculus
gagtctgatgtctcccatcactatt

SEQ ID NO: 495675 - DNA, 25 bp, Mus musculus
gagtctgatgtcttggttgggccct

SEQ ID NO: 495676 - DNA, 25 bp, Mus musculus
gagtctgattcaagtccttcatctt

SEQ ID NO: 495677 - DNA, 25 bp, Mus musculus
gagtctgattcatgtccttcatctt

SEQ ID NO: 495678 - DNA, 25 bp, Mus musculus
gagtctgcaagcaaaacccatgagc

SEQ ID NO: 495679 - DNA, 25 bp, Mus musculus
gagtctgcaagcctcagaagccctg

SEQ ID NO: 495680 - DNA, 25 bp, Mus musculus
gagtctgcaagcgtcagaagccctg

SEQ ID NO: 495681 - DNA, 25 bp, Mus musculus
gagtctgcaagctaaacccatgagc

SEQ ID NO: 495682 - DNA, 25 bp, Mus musculus
gagtctgcagagcttggtaatctag

SEQ ID NO: 495683 - DNA, 25 bp, Mus musculus
gagtctgcagaggttggtaatctag

SEQ ID NO: 495684 - DNA, 25 bp, Mus musculus
gagtctgcagatagaggccacctta

SEQ ID NO: 495685 - DNA, 25 bp, Mus musculus
gagtctgcagattgaggccacctta

SEQ ID NO: 495686 - DNA, 25 bp, Mus musculus
gagtctgcatttagaaagctgtcta

SEQ ID NO: 495687 - DNA, 25 bp, Mus musculus
gagtctgcatttctggagcgccatc

SEQ ID NO: 495688 - DNA, 25 bp, Mus musculus
gagtctgcatttgtggagcgccatc

SEQ ID NO: 495689 - DNA, 25 bp, Mus musculus
gagtctgcattttgaaagctgtcta

SEQ ID NO: 495690 - DNA, 25 bp, Mus musculus
gagtctgccaagcacaattgtcctc

SEQ ID NO: 495691 - DNA, 25 bp, Mus musculus
gagtctgccaaggacaattgtcctc

SEQ ID NO: 495692 - DNA, 25 bp, Mus musculus
gagtctgccacacctaatggaccag

SEQ ID NO: 495693 - DNA, 25 bp, Mus musculus
gagtctgccacagctaatggaccag

SEQ ID NO: 495694 - DNA, 25 bp, Mus musculus
gagtctgccagaactcactggtgaa

SEQ ID NO: 495695 - DNA, 25 bp, Mus musculus
gagtctgccagatctcactggtgaa

SEQ ID NO: 495696 - DNA, 25 bp, Mus musculus
gagtctgccatgattcaaatatcaa

SEQ ID NO: 495697 - DNA, 25 bp, Mus musculus
gagtctgccatgtttcaaatatcaa

SEQ ID NO: 495698 - DNA, 25 bp, Mus musculus
gagtctgccattagagaccctaact

SEQ ID NO: 495699 - DNA, 25 bp, Mus musculus
gagtctgccatttgagaccctaact

SEQ ID NO: 495700 - DNA, 25 bp, Mus musculus
gagtctgcccacagtcgagatcgat

SEQ ID NO: 495701 - DNA, 25 bp, Mus musculus
gagtctgcccactgtcgagatcgat

SEQ ID NO: 495702 - DNA, 25 bp, Mus musculus
gagtctgccctgctctaatggaact

SEQ ID NO: 495703 - DNA, 25 bp, Mus musculus
gagtctgccctggtctaatggaact

SEQ ID NO: 495704 - DNA, 25 bp, Mus musculus
gagtctgccgctaattaatcttatt

SEQ ID NO: 495705 - DNA, 25 bp, Mus musculus
gagtctgccgcttattaatcttatt

SEQ ID NO: 495706 - DNA, 25 bp, Mus musculus
gagtctgcctatattccagtggata

SEQ ID NO: 495707 - DNA, 25 bp, Mus musculus
gagtctgcctatcacaacaaagtct

SEQ ID NO: 495708 - DNA, 25 bp, Mus musculus
gagtctgcctatgacaacaaagtct

SEQ ID NO: 495709 - DNA, 25 bp, Mus musculus
gagtctgcctattttccagtggata

SEQ ID NO: 495710 - DNA, 25 bp, Mus musculus
gagtctgcctgtccatttgattgat

SEQ ID NO: 495711 - DNA, 25 bp, Mus musculus
gagtctgcctgtgcatttgattgat

SEQ ID NO: 495712 - DNA, 25 bp, Mus musculus
gagtctgcgcctcgataccaaggat

SEQ ID NO: 495713 - DNA, 25 bp, Mus musculus
gagtctgcgcctggataccaaggat

SEQ ID NO: 495714 - DNA, 25 bp, Mus musculus
gagtctgcggcactgggacctcctc

SEQ ID NO: 495715 - DNA, 25 bp, Mus musculus
gagtctgcggcagtgggacctcctc

SEQ ID NO: 495716 - DNA, 25 bp, Mus musculus
gagtctgcgggcacaaagtgaagaa

SEQ ID NO: 495717 - DNA, 25 bp, Mus musculus
gagtctgcgggctcaaagtgaagaa

SEQ ID NO: 495718 - DNA, 25 bp, Mus musculus
gagtctgcgtggctgtctagtttac

SEQ ID NO: 495719 - DNA, 25 bp, Mus musculus
gagtctgcgtgggtgtctagtttac

SEQ ID NO: 495720 - DNA, 25 bp, Mus musculus
gagtctgctataataacacctgttg

SEQ ID NO: 495721 - DNA, 25 bp, Mus musculus
gagtctgctatattaacacctgttg

SEQ ID NO: 495722 - DNA, 25 bp, Mus musculus
gagtctgctatcagactcctggaag

SEQ ID NO: 495723 - DNA, 25 bp, Mus musculus
gagtctgctatctgactcctggaag

SEQ ID NO: 495724 - DNA, 25 bp, Mus musculus
gagtctgctcagattccgattcagg

SEQ ID NO: 495725 - DNA, 25 bp, Mus musculus
gagtctgctcagtttccgattcagg

SEQ ID NO: 495726 - DNA, 25 bp, Mus musculus
gagtctgctcatatttaaggacctc

SEQ ID NO: 495727 - DNA, 25 bp, Mus musculus
gagtctgctcatttttaaggacctc

SEQ ID NO: 495728 - DNA, 25 bp, Mus musculus
gagtctgctccaatgatgatgaaga

SEQ ID NO: 495729 - DNA, 25 bp, Mus musculus
gagtctgctccattgatgatgaaga

SEQ ID NO: 495730 - DNA, 25 bp, Mus musculus
gagtctgctctaacatgggcttgcc

SEQ ID NO: 495731 - DNA, 25 bp, Mus musculus
gagtctgctctatcatgggcttgcc

SEQ ID NO: 495732 - DNA, 25 bp, Mus musculus
gagtctgctggcagaagtcatttat

SEQ ID NO: 495733 - DNA, 25 bp, Mus musculus
gagtctgctggctgaagtcatttat

SEQ ID NO: 495734 - DNA, 25 bp, Mus musculus
gagtctgctgtccattaactcggac

SEQ ID NO: 495735 - DNA, 25 bp, Mus musculus
gagtctgctgtcgattaactcggac

SEQ ID NO: 495736 - DNA, 25 bp, Mus musculus
gagtctgctgtgaagcttgagaaag

SEQ ID NO: 495737 - DNA, 25 bp, Mus musculus
gagtctgctgtgtagcttgagaaag

SEQ ID NO: 495738 - DNA, 25 bp, Mus musculus
gagtctgctgttcagttaagccttt

SEQ ID NO: 495739 - DNA, 25 bp, Mus musculus
gagtctgctgttgagttaagccttt

SEQ ID NO: 495740 - DNA, 25 bp, Mus musculus
gagtctgcttctctctttatgttac

SEQ ID NO: 495741 - DNA, 25 bp, Mus musculus
gagtctgcttctgtctttatgttac

SEQ ID NO: 495742 - DNA, 25 bp, Mus musculus
gagtctgcttttacggacccggaga

SEQ ID NO: 495743 - DNA, 25 bp, Mus musculus
gagtctgcttttcaaaattgcctgt

SEQ ID NO: 495744 - DNA, 25 bp, Mus musculus
gagtctgcttttgaaaattgcctgt

SEQ ID NO: 495745 - DNA, 25 bp, Mus musculus
gagtctgctttttcggacccggaga

SEQ ID NO: 495746 - DNA, 25 bp, Mus musculus
gagtctggaaaacagccgtctccaa

SEQ ID NO: 495747 - DNA, 25 bp, Mus musculus
gagtctggaaaagagccgtctccaa

SEQ ID NO: 495748 - DNA, 25 bp, Mus musculus
gagtctggaaacacgatcccttggt

SEQ ID NO: 495749 - DNA, 25 bp, Mus musculus
gagtctggaaactcgatcccttggt

SEQ ID NO: 495750 - DNA, 25 bp, Mus musculus
gagtctggaccaatgatctactgga

SEQ ID NO: 495751 - DNA, 25 bp, Mus musculus
gagtctggaccattgatctactgga

SEQ ID NO: 495752 - DNA, 25 bp, Mus musculus
gagtctggacccaggcaggcattgt

SEQ ID NO: 495753 - DNA, 25 bp, Mus musculus
gagtctggaccctggcaggcattgt

SEQ ID NO: 495754 - DNA, 25 bp, Mus musculus
gagtctggactcaagaaccgctccg

SEQ ID NO: 495755 - DNA, 25 bp, Mus musculus
gagtctggactcagagctgccatat

SEQ ID NO: 495756 - DNA, 25 bp, Mus musculus
gagtctggactctagaaccgctccg

SEQ ID NO: 495757 - DNA, 25 bp, Mus musculus
gagtctggactctgagctgccatat

SEQ ID NO: 495758 - DNA, 25 bp, Mus musculus
gagtctggactgcttgcactgtgca

SEQ ID NO: 495759 - DNA, 25 bp, Mus musculus
gagtctggactggttgcactgtgca

SEQ ID NO: 495760 - DNA, 25 bp, Mus musculus
gagtctggagacagcagggctcact

SEQ ID NO: 495761 - DNA, 25 bp, Mus musculus
gagtctggagactgcagggctcact

SEQ ID NO: 495762 - DNA, 25 bp, Mus musculus
gagtctggagtcaacaactctgact

SEQ ID NO: 495763 - DNA, 25 bp, Mus musculus
gagtctggagtctacaactctgact

SEQ ID NO: 495764 - DNA, 25 bp, Mus musculus
gagtctggagtgacattctgtgtga

SEQ ID NO: 495765 - DNA, 25 bp, Mus musculus
gagtctggagtgtcattctgtgtga

SEQ ID NO: 495766 - DNA, 25 bp, Mus musculus
gagtctggatgaaatcagcattttt

SEQ ID NO: 495767 - DNA, 25 bp, Mus musculus
gagtctggatgatatcagcattttt

SEQ ID NO: 495768 - DNA, 25 bp, Mus musculus
gagtctggcagaaagttatgcccag

SEQ ID NO: 495769 - DNA, 25 bp, Mus musculus
gagtctggcagatagttatgcccag

SEQ ID NO: 495770 - DNA, 25 bp, Mus musculus
gagtctggccccagcagaggaagct

SEQ ID NO: 495771 - DNA, 25 bp, Mus musculus
gagtctggcccctgcagaggaagct

SEQ ID NO: 495772 - DNA, 25 bp, Mus musculus
gagtctggcctaaacagcatctgaa

SEQ ID NO: 495773 - DNA, 25 bp, Mus musculus
gagtctggcctatacagcatctgaa

SEQ ID NO: 495774 - DNA, 25 bp, Mus musculus
gagtctggctgtattagctctaggg

SEQ ID NO: 495775 - DNA, 25 bp, Mus musculus
gagtctggctgttttagctctaggg

SEQ ID NO: 495776 - DNA, 25 bp, Mus musculus
gagtctggctttataaagctgttgt

SEQ ID NO: 495777 - DNA, 25 bp, Mus musculus
gagtctggctttttaaagctgttgt

SEQ ID NO: 495778 - DNA, 25 bp, Mus musculus
gagtctgggcagaattaatagctag

SEQ ID NO: 495779 - DNA, 25 bp, Mus musculus
gagtctgggcagtattaatagctag

SEQ ID NO: 495780 - DNA, 25 bp, Mus musculus
gagtctgggtctcaattcagccgca

SEQ ID NO: 495781 - DNA, 25 bp, Mus musculus
gagtctgggtctgaattcagccgca

SEQ ID NO: 495782 - DNA, 25 bp, Mus musculus
gagtctggtaatcaacaccacttgt

SEQ ID NO: 495783 - DNA, 25 bp, Mus musculus
gagtctggtaatgaacaccacttgt

SEQ ID NO: 495784 - DNA, 25 bp, Mus musculus
gagtctggtgcgatgtatccgatgt

SEQ ID NO: 495785 - DNA, 25 bp, Mus musculus
gagtctggtgcgttgtatccgatgt

SEQ ID NO: 495786 - DNA, 25 bp, Mus musculus
gagtctggtgggacagcagcttcct

SEQ ID NO: 495787 - DNA, 25 bp, Mus musculus
gagtctggtgggtcagcagcttcct

SEQ ID NO: 495788 - DNA, 25 bp, Mus musculus
gagtctggtggtaagtccgaagtca

SEQ ID NO: 495789 - DNA, 25 bp, Mus musculus
gagtctggtggttagtccgaagtca

SEQ ID NO: 495790 - DNA, 25 bp, Mus musculus
gagtctggttctcagaattcattta

SEQ ID NO: 495791 - DNA, 25 bp, Mus musculus
gagtctggttctgagaattcattta

SEQ ID NO: 495792 - DNA, 25 bp, Mus musculus
gagtctgtaaacacctctattaaaa

SEQ ID NO: 495793 - DNA, 25 bp, Mus musculus
gagtctgtaaactcctctattaaaa

SEQ ID NO: 495794 - DNA, 25 bp, Mus musculus
gagtctgtagacaccgcacagcacg

SEQ ID NO: 495795 - DNA, 25 bp, Mus musculus
gagtctgtagaccatgttcctcggg

SEQ ID NO: 495796 - DNA, 25 bp, Mus musculus
gagtctgtagacgatgttcctcggg

SEQ ID NO: 495797 - DNA, 25 bp, Mus musculus
gagtctgtagactccgcacagcacg

SEQ ID NO: 495798 - DNA, 25 bp, Mus musculus
gagtctgtagctcttcagtggatct

SEQ ID NO: 495799 - DNA, 25 bp, Mus musculus
gagtctgtagctgttcagtggatct

SEQ ID NO: 495800 - DNA, 25 bp, Mus musculus
gagtctgtagttcttcctgttaata

SEQ ID NO: 495801 - DNA, 25 bp, Mus musculus
gagtctgtagttgttcctgttaata

SEQ ID NO: 495802 - DNA, 25 bp, Mus musculus
gagtctgtataaagctgtgcccagc

SEQ ID NO: 495803 - DNA, 25 bp, Mus musculus
gagtctgtataaatcctcccaggaa

SEQ ID NO: 495804 - DNA, 25 bp, Mus musculus
gagtctgtataatgctgtgcccagc

SEQ ID NO: 495805 - DNA, 25 bp, Mus musculus
gagtctgtataattcctcccaggaa

SEQ ID NO: 495806 - DNA, 25 bp, Mus musculus
gagtctgtatcaatgagccctgaag

SEQ ID NO: 495807 - DNA, 25 bp, Mus musculus
gagtctgtatcattgagccctgaag

SEQ ID NO: 495808 - DNA, 25 bp, Mus musculus
gagtctgtattaagccaggcttgat

SEQ ID NO: 495809 - DNA, 25 bp, Mus musculus
gagtctgtattatgccaggcttgat

SEQ ID NO: 495810 - DNA, 25 bp, Mus musculus
gagtctgtatttaatggcctgaagc

SEQ ID NO: 495811 - DNA, 25 bp, Mus musculus
gagtctgtattttatggcctgaagc

SEQ ID NO: 495812 - DNA, 25 bp, Mus musculus
gagtctgtcaccaggatcattaaga

SEQ ID NO: 495813 - DNA, 25 bp, Mus musculus
gagtctgtcacctggatcattaaga

SEQ ID NO: 495814 - DNA, 25 bp, Mus musculus
gagtctgtcagacgccaaacttcca

SEQ ID NO: 495815 - DNA, 25 bp, Mus musculus
gagtctgtcagaggccaaacttcca

SEQ ID NO: 495816 - DNA, 25 bp, Mus musculus
gagtctgtcaggcattgtccaccca

SEQ ID NO: 495817 - DNA, 25 bp, Mus musculus
gagtctgtcagggattgtccaccca

SEQ ID NO: 495818 - DNA, 25 bp, Mus musculus
gagtctgtctaacctaatgaccagg

SEQ ID NO: 495819 - DNA, 25 bp, Mus musculus
gagtctgtctaagctaatgaccagg

SEQ ID NO: 495820 - DNA, 25 bp, Mus musculus
gagtctgtctctagggctttttaga

SEQ ID NO: 495821 - DNA, 25 bp, Mus musculus
gagtctgtctcttgggctttttaga

SEQ ID NO: 495822 - DNA, 25 bp, Mus musculus
gagtctgtctgactgtcctgtgtgc

SEQ ID NO: 495823 - DNA, 25 bp, Mus musculus
gagtctgtctgagtgtcctgtgtgc

SEQ ID NO: 495824 - DNA, 25 bp, Mus musculus
gagtctgtcttccacctgctggtgc

SEQ ID NO: 495825 - DNA, 25 bp, Mus musculus
gagtctgtcttcgacctgctggtgc

SEQ ID NO: 495826 - DNA, 25 bp, Mus musculus
gagtctgtgacaaccttggatacta

SEQ ID NO: 495827 - DNA, 25 bp, Mus musculus
gagtctgtgacatccttggatacta

SEQ ID NO: 495828 - DNA, 25 bp, Mus musculus
gagtctgtgattcacctgcattcat

SEQ ID NO: 495829 - DNA, 25 bp, Mus musculus
gagtctgtgattgacctgcattcat

SEQ ID NO: 495830 - DNA, 25 bp, Mus musculus
gagtctgtgccactgatgttttcaa

SEQ ID NO: 495831 - DNA, 25 bp, Mus musculus
gagtctgtgccagtgatgttttcaa

SEQ ID NO: 495832 - DNA, 25 bp, Mus musculus
gagtctgtgcccactatggaagaat

SEQ ID NO: 495833 - DNA, 25 bp, Mus musculus
gagtctgtgccctctatggaagaat

SEQ ID NO: 495834 - DNA, 25 bp, Mus musculus
gagtctgtgcggatcctgaagagca

SEQ ID NO: 495835 - DNA, 25 bp, Mus musculus
gagtctgtgcggttcctgaagagca

SEQ ID NO: 495836 - DNA, 25 bp, Mus musculus
gagtctgtgcgtactgatctgaaaa

SEQ ID NO: 495837 - DNA, 25 bp, Mus musculus
gagtctgtgcgttctgatctgaaaa

SEQ ID NO: 495838 - DNA, 25 bp, Mus musculus
gagtctgtgctcaaactctgtcagc

SEQ ID NO: 495839 - DNA, 25 bp, Mus musculus
gagtctgtgctcagtctcaagtgac

SEQ ID NO: 495840 - DNA, 25 bp, Mus musculus
gagtctgtgctctaactctgtcagc

SEQ ID NO: 495841 - DNA, 25 bp, Mus musculus
gagtctgtgctctgtctcaagtgac

SEQ ID NO: 495842 - DNA, 25 bp, Mus musculus
gagtctgtggatctactctgcttac

SEQ ID NO: 495843 - DNA, 25 bp, Mus musculus
gagtctgtggatgtactctgcttac

SEQ ID NO: 495844 - DNA, 25 bp, Mus musculus
gagtctgtggcaagttagctccctc

SEQ ID NO: 495845 - DNA, 25 bp, Mus musculus
gagtctgtggcatgttagctccctc

SEQ ID NO: 495846 - DNA, 25 bp, Mus musculus
gagtctgtgggcaatcataaatatt

SEQ ID NO: 495847 - DNA, 25 bp, Mus musculus
gagtctgtgggctatcataaatatt

SEQ ID NO: 495848 - DNA, 25 bp, Mus musculus
gagtctgtggtacatttcaagttac

SEQ ID NO: 495849 - DNA, 25 bp, Mus musculus
gagtctgtggtagatttcaagttac

SEQ ID NO: 495850 - DNA, 25 bp, Mus musculus
gagtctgtgtcaaacatggctgaag

SEQ ID NO: 495851 - DNA, 25 bp, Mus musculus
gagtctgtgtcatacatggctgaag

SEQ ID NO: 495852 - DNA, 25 bp, Mus musculus
gagtctgtgtctacatgacctagtt

SEQ ID NO: 495853 - DNA, 25 bp, Mus musculus
gagtctgtgtcttcatgacctagtt

SEQ ID NO: 495854 - DNA, 25 bp, Mus musculus
gagtctgtgtgacttatccgtcatg

SEQ ID NO: 495855 - DNA, 25 bp, Mus musculus
gagtctgtgtgagttatccgtcatg

SEQ ID NO: 495856 - DNA, 25 bp, Mus musculus
gagtctgtgtgcactcgcaatgttc

SEQ ID NO: 495857 - DNA, 25 bp, Mus musculus
gagtctgtgtgcctcctgcgtcata

SEQ ID NO: 495858 - DNA, 25 bp, Mus musculus
gagtctgtgtgcgtcctgcgtcata

SEQ ID NO: 495859 - DNA, 25 bp, Mus musculus
gagtctgtgtgctctcgcaatgttc

SEQ ID NO: 495860 - DNA, 25 bp, Mus musculus
gagtctgtgttgatactttgcacta

SEQ ID NO: 495861 - DNA, 25 bp, Mus musculus
gagtctgtgttgttactttgcacta

SEQ ID NO: 495862 - DNA, 25 bp, Mus musculus
gagtctgtgtttctgtaccacttga

SEQ ID NO: 495863 - DNA, 25 bp, Mus musculus
gagtctgtgtttgtgtaccacttga

SEQ ID NO: 495864 - DNA, 25 bp, Mus musculus
gagtctgttctcagcctggtgtagc

SEQ ID NO: 495865 - DNA, 25 bp, Mus musculus
gagtctgttctctgcctggtgtagc

SEQ ID NO: 495866 - DNA, 25 bp, Mus musculus
gagtctgttctgatgcttgcattgc

SEQ ID NO: 495867 - DNA, 25 bp, Mus musculus
gagtctgttctgttgcttgcattgc

SEQ ID NO: 495868 - DNA, 25 bp, Mus musculus
gagtctgttgaaatcatccacccta

SEQ ID NO: 495869 - DNA, 25 bp, Mus musculus
gagtctgttgaattcatccacccta

SEQ ID NO: 495870 - DNA, 25 bp, Mus musculus
gagtctgttggcagtttcataccac

SEQ ID NO: 495871 - DNA, 25 bp, Mus musculus
gagtctgttggctgtttcataccac

SEQ ID NO: 495872 - DNA, 25 bp, Mus musculus
gagtctgttgggaagcggcctggct

SEQ ID NO: 495873 - DNA, 25 bp, Mus musculus
gagtctgttgggtagcggcctggct

SEQ ID NO: 495874 - DNA, 25 bp, Mus musculus
gagtctgttgtaacatatctgtgga

SEQ ID NO: 495875 - DNA, 25 bp, Mus musculus
gagtctgttgtatcatatctgtgga

SEQ ID NO: 495876 - DNA, 25 bp, Mus musculus
gagtctgtttagctgtacctggtat

SEQ ID NO: 495877 - DNA, 25 bp, Mus musculus
gagtctgtttaggtgtacctggtat

SEQ ID NO: 495878 - DNA, 25 bp, Mus musculus
gagtctgtttctaagtgttcattat

SEQ ID NO: 495879 - DNA, 25 bp, Mus musculus
gagtctgtttctattggatgcttca

SEQ ID NO: 495880 - DNA, 25 bp, Mus musculus
gagtctgtttctcaggcaaccactg

SEQ ID NO: 495881 - DNA, 25 bp, Mus musculus
gagtctgtttctgaggcaaccactg

SEQ ID NO: 495882 - DNA, 25 bp, Mus musculus
gagtctgtttcttagtgttcattat

SEQ ID NO: 495883 - DNA, 25 bp, Mus musculus
gagtctgtttcttttggatgcttca

SEQ ID NO: 495884 - DNA, 25 bp, Mus musculus
gagtctgtttgcaattcctgggatc

SEQ ID NO: 495885 - DNA, 25 bp, Mus musculus
gagtctgtttgctattcctgggatc

SEQ ID NO: 495886 - DNA, 25 bp, Mus musculus
gagtcttaaaagatcctattatcat

SEQ ID NO: 495887 - DNA, 25 bp, Mus musculus
gagtcttaaaagttcctattatcat

SEQ ID NO: 495888 - DNA, 25 bp, Mus musculus
gagtcttaaattccatctgccttct

SEQ ID NO: 495889 - DNA, 25 bp, Mus musculus
gagtcttaaattgcatctgccttct

SEQ ID NO: 495890 - DNA, 25 bp, Mus musculus
gagtcttaacaacacacactttggt

SEQ ID NO: 495891 - DNA, 25 bp, Mus musculus
gagtcttaacaagacacactttggt

SEQ ID NO: 495892 - DNA, 25 bp, Mus musculus
gagtcttaagacattctccttgtgt

SEQ ID NO: 495893 - DNA, 25 bp, Mus musculus
gagtcttaagactttctccttgtgt

SEQ ID NO: 495894 - DNA, 25 bp, Mus musculus
gagtcttaagtaaccactgttattt

SEQ ID NO: 495895 - DNA, 25 bp, Mus musculus
gagtcttaagtatccactgttattt

SEQ ID NO: 495896 - DNA, 25 bp, Mus musculus
gagtcttaatctatctagcttcctg

SEQ ID NO: 495897 - DNA, 25 bp, Mus musculus
gagtcttaatctttctagcttcctg

SEQ ID NO: 495898 - DNA, 25 bp, Mus musculus
gagtcttaatgaccactgtacttca

SEQ ID NO: 495899 - DNA, 25 bp, Mus musculus
gagtcttaatgagcactgtacttca

SEQ ID NO: 495900 - DNA, 25 bp, Mus musculus
gagtcttacttaccatttcacattt

SEQ ID NO: 495901 - DNA, 25 bp, Mus musculus
gagtcttacttagcatttcacattt

SEQ ID NO: 495902 - DNA, 25 bp, Mus musculus
gagtcttagagaatcctgccttact

SEQ ID NO: 495903 - DNA, 25 bp, Mus musculus
gagtcttagagattcctgccttact

SEQ ID NO: 495904 - DNA, 25 bp, Mus musculus
gagtcttagagcaaccatatgtgtg

SEQ ID NO: 495905 - DNA, 25 bp, Mus musculus
gagtcttagagctaccatatgtgtg

SEQ ID NO: 495906 - DNA, 25 bp, Mus musculus
gagtcttaggctctcatttcataaa

SEQ ID NO: 495907 - DNA, 25 bp, Mus musculus
gagtcttaggctgtcatttcataaa

SEQ ID NO: 495908 - DNA, 25 bp, Mus musculus
gagtcttaggtgctatctgtacaca

SEQ ID NO: 495909 - DNA, 25 bp, Mus musculus
gagtcttaggtggtatctgtacaca

SEQ ID NO: 495910 - DNA, 25 bp, Mus musculus
gagtcttagtctatgttttctagct

SEQ ID NO: 495911 - DNA, 25 bp, Mus musculus
gagtcttagtctttgttttctagct

SEQ ID NO: 495912 - DNA, 25 bp, Mus musculus
gagtcttatagaatgtgccgtactg

SEQ ID NO: 495913 - DNA, 25 bp, Mus musculus
gagtcttatagattgtgccgtactg

SEQ ID NO: 495914 - DNA, 25 bp, Mus musculus
gagtcttcaaatacatgcaccttaa

SEQ ID NO: 495915 - DNA, 25 bp, Mus musculus
gagtcttcaaattcatgcaccttaa

SEQ ID NO: 495916 - DNA, 25 bp, Mus musculus
gagtcttcaagacgatactgagcca

SEQ ID NO: 495917 - DNA, 25 bp, Mus musculus
gagtcttcaagaggatactgagcca

SEQ ID NO: 495918 - DNA, 25 bp, Mus musculus
gagtcttcacaactcttgtgacttc

SEQ ID NO: 495919 - DNA, 25 bp, Mus musculus
gagtcttcacaagtcttgtgacttc

SEQ ID NO: 495920 - DNA, 25 bp, Mus musculus
gagtcttcacacaatgtcatttcca

SEQ ID NO: 495921 - DNA, 25 bp, Mus musculus
gagtcttcacactatgtcatttcca

SEQ ID NO: 495922 - DNA, 25 bp, Mus musculus
gagtcttcactcaagaacaccttga

SEQ ID NO: 495923 - DNA, 25 bp, Mus musculus
gagtcttcactcagcactatagata

SEQ ID NO: 495924 - DNA, 25 bp, Mus musculus
gagtcttcactctagaacaccttga

SEQ ID NO: 495925 - DNA, 25 bp, Mus musculus
gagtcttcactctgcactatagata

SEQ ID NO: 495926 - DNA, 25 bp, Mus musculus
gagtcttcagaaatagcttttgctt

SEQ ID NO: 495927 - DNA, 25 bp, Mus musculus
gagtcttcagaattagcttttgctt

SEQ ID NO: 495928 - DNA, 25 bp, Mus musculus
gagtcttcagacatgtcaaaactat

SEQ ID NO: 495929 - DNA, 25 bp, Mus musculus
gagtcttcagacttgtcaaaactat

SEQ ID NO: 495930 - DNA, 25 bp, Mus musculus
gagtcttcaggtcccaggcgtctac

SEQ ID NO: 495931 - DNA, 25 bp, Mus musculus
gagtcttcaggtgccaggcgtctac

SEQ ID NO: 495932 - DNA, 25 bp, Mus musculus
gagtcttcatcaagagcagcggcaa

SEQ ID NO: 495933 - DNA, 25 bp, Mus musculus
gagtcttcatcatgagcagcggcaa

SEQ ID NO: 495934 - DNA, 25 bp, Mus musculus
gagtcttcatccatttgtgtttttc

SEQ ID NO: 495935 - DNA, 25 bp, Mus musculus
gagtcttcatccttttgtgtttttc

SEQ ID NO: 495936 - DNA, 25 bp, Mus musculus
gagtcttcatggcagttaccaccta

SEQ ID NO: 495937 - DNA, 25 bp, Mus musculus
gagtcttcatgggagttaccaccta

SEQ ID NO: 495938 - DNA, 25 bp, Mus musculus
gagtcttccacactaacccatttgg

SEQ ID NO: 495939 - DNA, 25 bp, Mus musculus
gagtcttccacagtaacccatttgg

SEQ ID NO: 495940 - DNA, 25 bp, Mus musculus
gagtcttccacccatgttgtggcac

SEQ ID NO: 495941 - DNA, 25 bp, Mus musculus
gagtcttccaccctacacaaaggtt

SEQ ID NO: 495942 - DNA, 25 bp, Mus musculus
gagtcttccaccgatgttgtggcac

SEQ ID NO: 495943 - DNA, 25 bp, Mus musculus
gagtcttccaccgtacacaaaggtt

SEQ ID NO: 495944 - DNA, 25 bp, Mus musculus
gagtcttccagtatacatttaccca

SEQ ID NO: 495945 - DNA, 25 bp, Mus musculus
gagtcttccagtttacatttaccca

SEQ ID NO: 495946 - DNA, 25 bp, Mus musculus
gagtcttccctgactacctaaagca

SEQ ID NO: 495947 - DNA, 25 bp, Mus musculus
gagtcttccctgtctacctaaagca

SEQ ID NO: 495948 - DNA, 25 bp, Mus musculus
gagtcttcctagctatctctgggaa

SEQ ID NO: 495949 - DNA, 25 bp, Mus musculus
gagtcttcctaggtatctctgggaa

SEQ ID NO: 495950 - DNA, 25 bp, Mus musculus
gagtcttcggacatttcacatgaat

SEQ ID NO: 495951 - DNA, 25 bp, Mus musculus
gagtcttcggacttttcacatgaat

SEQ ID NO: 495952 - DNA, 25 bp, Mus musculus
gagtcttcggctatcatggactagg

SEQ ID NO: 495953 - DNA, 25 bp, Mus musculus
gagtcttcggctttcatggactagg

SEQ ID NO: 495954 - DNA, 25 bp, Mus musculus
gagtcttcgtagctaaccacttcag

SEQ ID NO: 495955 - DNA, 25 bp, Mus musculus
gagtcttcgtaggtaaccacttcag

SEQ ID NO: 495956 - DNA, 25 bp, Mus musculus
gagtcttctcacagtaacatcgtgt

SEQ ID NO: 495957 - DNA, 25 bp, Mus musculus
gagtcttctcactgtaacatcgtgt

SEQ ID NO: 495958 - DNA, 25 bp, Mus musculus
gagtcttctcctattcagagccaaa

SEQ ID NO: 495959 - DNA, 25 bp, Mus musculus
gagtcttctccttttcagagccaaa

SEQ ID NO: 495960 - DNA, 25 bp, Mus musculus
gagtcttctctcaagggcttgtttt

SEQ ID NO: 495961 - DNA, 25 bp, Mus musculus
gagtcttctctctagggcttgtttt

SEQ ID NO: 495962 - DNA, 25 bp, Mus musculus
gagtcttctgaacaggacgctagac

SEQ ID NO: 495963 - DNA, 25 bp, Mus musculus
gagtcttctgaagaggacgctagac

SEQ ID NO: 495964 - DNA, 25 bp, Mus musculus
gagtcttctgacctatctacggacc

SEQ ID NO: 495965 - DNA, 25 bp, Mus musculus
gagtcttctgacgtatctacggacc

SEQ ID NO: 495966 - DNA, 25 bp, Mus musculus
gagtcttctgagaaaggcgatgctt

SEQ ID NO: 495967 - DNA, 25 bp, Mus musculus
gagtcttctgagtaaggcgatgctt

SEQ ID NO: 495968 - DNA, 25 bp, Mus musculus
gagtcttctgcaatgtctaaccatg

SEQ ID NO: 495969 - DNA, 25 bp, Mus musculus
gagtcttctgcattgtctaaccatg

SEQ ID NO: 495970 - DNA, 25 bp, Mus musculus
gagtcttctgcccatttaactagat

SEQ ID NO: 495971 - DNA, 25 bp, Mus musculus
gagtcttctgccgatttaactagat

SEQ ID NO: 495972 - DNA, 25 bp, Mus musculus
gagtcttctggtcagacatcctctg

SEQ ID NO: 495973 - DNA, 25 bp, Mus musculus
gagtcttctggtgagacatcctctg

SEQ ID NO: 495974 - DNA, 25 bp, Mus musculus
gagtcttctgtacagctcatgctgc

SEQ ID NO: 495975 - DNA, 25 bp, Mus musculus
gagtcttctgtagagctcatgctgc

SEQ ID NO: 495976 - DNA, 25 bp, Mus musculus
gagtcttctgtcacctggtatggga

SEQ ID NO: 495977 - DNA, 25 bp, Mus musculus
gagtcttctgtctcctggtatggga

SEQ ID NO: 495978 - DNA, 25 bp, Mus musculus
gagtcttcttacattatgaccatta

SEQ ID NO: 495979 - DNA, 25 bp, Mus musculus
gagtcttcttactttatgaccatta

SEQ ID NO: 495980 - DNA, 25 bp, Mus musculus
gagtcttcttcactattctctaaat

SEQ ID NO: 495981 - DNA, 25 bp, Mus musculus
gagtcttcttcagtattctctaaat

SEQ ID NO: 495982 - DNA, 25 bp, Mus musculus
gagtcttctttcagtaggagacctt

SEQ ID NO: 495983 - DNA, 25 bp, Mus musculus
gagtcttctttctgtaggagacctt

SEQ ID NO: 495984 - DNA, 25 bp, Mus musculus
gagtcttgaaatacttgcttttgtt

SEQ ID NO: 495985 - DNA, 25 bp, Mus musculus
gagtcttgaaattcttgcttttgtt

SEQ ID NO: 495986 - DNA, 25 bp, Mus musculus
gagtcttgacttccagtttctctgt

SEQ ID NO: 495987 - DNA, 25 bp, Mus musculus
gagtcttgacttgcagtttctctgt

SEQ ID NO: 495988 - DNA, 25 bp, Mus musculus
gagtcttgagttcgtcacatctgct

SEQ ID NO: 495989 - DNA, 25 bp, Mus musculus
gagtcttgagttggtcacatctgct

SEQ ID NO: 495990 - DNA, 25 bp, Mus musculus
gagtcttgatcaaaccctagccggg

SEQ ID NO: 495991 - DNA, 25 bp, Mus musculus
gagtcttgatcataccctagccggg

SEQ ID NO: 495992 - DNA, 25 bp, Mus musculus
gagtcttgcaggatggctcatactt

SEQ ID NO: 495993 - DNA, 25 bp, Mus musculus
gagtcttgcaggttggctcatactt

SEQ ID NO: 495994 - DNA, 25 bp, Mus musculus
gagtcttgctaacctgcaggagcga

SEQ ID NO: 495995 - DNA, 25 bp, Mus musculus
gagtcttgctaagctgcaggagcga

SEQ ID NO: 495996 - DNA, 25 bp, Mus musculus
gagtcttgctacacagcccaggctc

SEQ ID NO: 495997 - DNA, 25 bp, Mus musculus
gagtcttgctactcagcccaggctc

SEQ ID NO: 495998 - DNA, 25 bp, Mus musculus
gagtcttggcacattccttcaagaa

SEQ ID NO: 495999 - DNA, 25 bp, Mus musculus
gagtcttggcactttccttcaagaa

SEQ ID NO: 496000 - DNA, 25 bp, Mus musculus
gagtcttggccacgctagtacagca

SEQ ID NO: 496001 - DNA, 25 bp, Mus musculus
gagtcttggccaggctagtacagca

SEQ ID NO: 496002 - DNA, 25 bp, Mus musculus
gagtcttgggcaacttagtcttcag

SEQ ID NO: 496003 - DNA, 25 bp, Mus musculus
gagtcttgggcatcttagtcttcag

SEQ ID NO: 496004 - DNA, 25 bp, Mus musculus
gagtcttggtatatcttcttgagtc

SEQ ID NO: 496005 - DNA, 25 bp, Mus musculus
gagtcttggtatcatttttgtgttc

SEQ ID NO: 496006 - DNA, 25 bp, Mus musculus
gagtcttggtatgatttttgtgttc

SEQ ID NO: 496007 - DNA, 25 bp, Mus musculus
gagtcttggtatttcttcttgagtc

SEQ ID NO: 496008 - DNA, 25 bp, Mus musculus
gagtcttgtcataaaacagccacct

SEQ ID NO: 496009 - DNA, 25 bp, Mus musculus
gagtcttgtcattaaacagccacct

SEQ ID NO: 496010 - DNA, 25 bp, Mus musculus
gagtcttgtgagctaacacactcta

SEQ ID NO: 496011 - DNA, 25 bp, Mus musculus
gagtcttgtgaggtaacacactcta

SEQ ID NO: 496012 - DNA, 25 bp, Mus musculus
gagtcttgttcacatgtcatcacct

SEQ ID NO: 496013 - DNA, 25 bp, Mus musculus
gagtcttgttcagatgtcatcacct

SEQ ID NO: 496014 - DNA, 25 bp, Mus musculus
gagtctttaaaccacaggatctttc

SEQ ID NO: 496015 - DNA, 25 bp, Mus musculus
gagtctttaaacgacaggatctttc

SEQ ID NO: 496016 - DNA, 25 bp, Mus musculus
gagtctttaactacatttcagatga

SEQ ID NO: 496017 - DNA, 25 bp, Mus musculus
gagtctttaacttcatttcagatga

SEQ ID NO: 496018 - DNA, 25 bp, Mus musculus
gagtctttacagagccttgacaggc

SEQ ID NO: 496019 - DNA, 25 bp, Mus musculus
gagtctttacagtgccttgacaggc

SEQ ID NO: 496020 - DNA, 25 bp, Mus musculus
gagtctttactaagacgtcacatca

SEQ ID NO: 496021 - DNA, 25 bp, Mus musculus
gagtctttactatgacgtcacatca

SEQ ID NO: 496022 - DNA, 25 bp, Mus musculus
gagtctttactgacaccacgtttgg

SEQ ID NO: 496023 - DNA, 25 bp, Mus musculus
gagtctttactgtcaccacgtttgg

SEQ ID NO: 496024 - DNA, 25 bp, Mus musculus
gagtctttagtgaggacctgcccgg

SEQ ID NO: 496025 - DNA, 25 bp, Mus musculus
gagtctttagtgtggacctgcccgg

SEQ ID NO: 496026 - DNA, 25 bp, Mus musculus
gagtctttccccaacagggttacat

SEQ ID NO: 496027 - DNA, 25 bp, Mus musculus
gagtctttcccctacagggttacat

SEQ ID NO: 496028 - DNA, 25 bp, Mus musculus
gagtctttcgatatgctgctgaaca

SEQ ID NO: 496029 - DNA, 25 bp, Mus musculus
gagtctttcgatttgctgctgaaca

SEQ ID NO: 496030 - DNA, 25 bp, Mus musculus
gagtctttctacagtttacccagga

SEQ ID NO: 496031 - DNA, 25 bp, Mus musculus
gagtctttctactgtttacccagga

SEQ ID NO: 496032 - DNA, 25 bp, Mus musculus
gagtctttctcaatgtggtctttgt

SEQ ID NO: 496033 - DNA, 25 bp, Mus musculus
gagtctttctcattgtggtctttgt

SEQ ID NO: 496034 - DNA, 25 bp, Mus musculus
gagtctttctctcgcctactctgaa

SEQ ID NO: 496035 - DNA, 25 bp, Mus musculus
gagtctttctctctaaaagttccct

SEQ ID NO: 496036 - DNA, 25 bp, Mus musculus
gagtctttctctggcctactctgaa

SEQ ID NO: 496037 - DNA, 25 bp, Mus musculus
gagtctttctctgtaaaagttccct

SEQ ID NO: 496038 - DNA, 25 bp, Mus musculus
gagtctttctttattcttcagtctg

SEQ ID NO: 496039 - DNA, 25 bp, Mus musculus
gagtctttcttttttcttcagtctg

SEQ ID NO: 496040 - DNA, 25 bp, Mus musculus
gagtctttgccacttaacactgttg

SEQ ID NO: 496041 - DNA, 25 bp, Mus musculus
gagtctttgccagttaacactgttg

SEQ ID NO: 496042 - DNA, 25 bp, Mus musculus
gagtctttgctaattcactctaagt

SEQ ID NO: 496043 - DNA, 25 bp, Mus musculus
gagtctttgctatttcactctaagt

SEQ ID NO: 496044 - DNA, 25 bp, Mus musculus
gagtctttggagatcctggcacaat

SEQ ID NO: 496045 - DNA, 25 bp, Mus musculus
gagtctttggagttcctggcacaat

SEQ ID NO: 496046 - DNA, 25 bp, Mus musculus
gagtctttggcaagctcttctgaat

SEQ ID NO: 496047 - DNA, 25 bp, Mus musculus
gagtctttggcatgctcttctgaat

SEQ ID NO: 496048 - DNA, 25 bp, Mus musculus
gagtctttggctcggtaccctagca

SEQ ID NO: 496049 - DNA, 25 bp, Mus musculus
gagtctttggctgggtaccctagca

SEQ ID NO: 496050 - DNA, 25 bp, Mus musculus
gagtctttgtatagggttgggcttc

SEQ ID NO: 496051 - DNA, 25 bp, Mus musculus
gagtctttgtattgggttgggcttc

SEQ ID NO: 496052 - DNA, 25 bp, Mus musculus
gagtcttttagtagagggaagtcac

SEQ ID NO: 496053 - DNA, 25 bp, Mus musculus
gagtcttttagttgagggaagtcac

SEQ ID NO: 496054 - DNA, 25 bp, Mus musculus
gagtcttttctcctggtgtcacaac

SEQ ID NO: 496055 - DNA, 25 bp, Mus musculus
gagtcttttctcgtggtgtcacaac

SEQ ID NO: 496056 - DNA, 25 bp, Mus musculus
gagtcttttgaacgttctggtgcca

SEQ ID NO: 496057 - DNA, 25 bp, Mus musculus
gagtcttttgaaggttctggtgcca

SEQ ID NO: 496058 - DNA, 25 bp, Mus musculus
gagtcttttgccaacatgtttatgt

SEQ ID NO: 496059 - DNA, 25 bp, Mus musculus
gagtcttttgcctacatgtttatgt

SEQ ID NO: 496060 - DNA, 25 bp, Mus musculus
gagtcttttgctcagaagggtcgat

SEQ ID NO: 496061 - DNA, 25 bp, Mus musculus
gagtcttttgctgagaagggtcgat

SEQ ID NO: 496062 - DNA, 25 bp, Mus musculus
gagtcttttgtcaaactcaaagtca

SEQ ID NO: 496063 - DNA, 25 bp, Mus musculus
gagtcttttgtctaactcaaagtca

SEQ ID NO: 496064 - DNA, 25 bp, Mus musculus
gagtctttttcaaccttggtggcat

SEQ ID NO: 496065 - DNA, 25 bp, Mus musculus
gagtctttttcatccttggtggcat

SEQ ID NO: 496066 - DNA, 25 bp, Mus musculus
gagtgaaaaactcgctctcaggagt

SEQ ID NO: 496067 - DNA, 25 bp, Mus musculus
gagtgaaaaactggctctcaggagt

SEQ ID NO: 496068 - DNA, 25 bp, Mus musculus
gagtgaaaacagagcggagtgaccc

SEQ ID NO: 496069 - DNA, 25 bp, Mus musculus
gagtgaaaacagctcttcaagagtt

SEQ ID NO: 496070 - DNA, 25 bp, Mus musculus
gagtgaaaacaggtcttcaagagtt

SEQ ID NO: 496071 - DNA, 25 bp, Mus musculus
gagtgaaaacagtgcggagtgaccc

SEQ ID NO: 496072 - DNA, 25 bp, Mus musculus
gagtgaaaactcagatgctgacaat

SEQ ID NO: 496073 - DNA, 25 bp, Mus musculus
gagtgaaaactcaggccgggattgt

SEQ ID NO: 496074 - DNA, 25 bp, Mus musculus
gagtgaaaactctgatgctgacaat

SEQ ID NO: 496075 - DNA, 25 bp, Mus musculus
gagtgaaaactctggccgggattgt

SEQ ID NO: 496076 - DNA, 25 bp, Mus musculus
gagtgaaaactgctctctgtctcca

SEQ ID NO: 496077 - DNA, 25 bp, Mus musculus
gagtgaaaactggtctctgtctcca

SEQ ID NO: 496078 - DNA, 25 bp, Mus musculus
gagtgaaaacttccatgattgcagg

SEQ ID NO: 496079 - DNA, 25 bp, Mus musculus
gagtgaaaacttgcatgattgcagg

SEQ ID NO: 496080 - DNA, 25 bp, Mus musculus
gagtgaaaagccagccgggtacttg

SEQ ID NO: 496081 - DNA, 25 bp, Mus musculus
gagtgaaaagcctgccgggtacttg

SEQ ID NO: 496082 - DNA, 25 bp, Mus musculus
gagtgaaaccgcataattagctata

SEQ ID NO: 496083 - DNA, 25 bp, Mus musculus
gagtgaaaccgcttaattagctata

SEQ ID NO: 496084 - DNA, 25 bp, Mus musculus
gagtgaaactcacgccacaggagcc

SEQ ID NO: 496085 - DNA, 25 bp, Mus musculus
gagtgaaactcaggccacaggagcc

SEQ ID NO: 496086 - DNA, 25 bp, Mus musculus
gagtgaaagaacatcctgtgctttt

SEQ ID NO: 496087 - DNA, 25 bp, Mus musculus
gagtgaaagaacttcctgtgctttt

SEQ ID NO: 496088 - DNA, 25 bp, Mus musculus
gagtgaaagactcagccctaagaca

SEQ ID NO: 496089 - DNA, 25 bp, Mus musculus
gagtgaaagactgagccctaagaca

SEQ ID NO: 496090 - DNA, 25 bp, Mus musculus
gagtgaaagcatccctcagattccc

SEQ ID NO: 496091 - DNA, 25 bp, Mus musculus
gagtgaaagcatgcctcagattccc

SEQ ID NO: 496092 - DNA, 25 bp, Mus musculus
gagtgaaagcctagtgcctgtcaag

SEQ ID NO: 496093 - DNA, 25 bp, Mus musculus
gagtgaaagccttgtgcctgtcaag

SEQ ID NO: 496094 - DNA, 25 bp, Mus musculus
gagtgaaatactccttacccagggt

SEQ ID NO: 496095 - DNA, 25 bp, Mus musculus
gagtgaaatactgcttacccagggt

SEQ ID NO: 496096 - DNA, 25 bp, Mus musculus
gagtgaaatctcctaaaagcctagg

SEQ ID NO: 496097 - DNA, 25 bp, Mus musculus
gagtgaaatctcgtaaaagcctagg

SEQ ID NO: 496098 - DNA, 25 bp, Mus musculus
gagtgaaatgcaacctaagtgctat

SEQ ID NO: 496099 - DNA, 25 bp, Mus musculus
gagtgaaatgcatcctaagtgctat

SEQ ID NO: 496100 - DNA, 25 bp, Mus musculus
gagtgaaatgttcctcacaaggcaa

SEQ ID NO: 496101 - DNA, 25 bp, Mus musculus
gagtgaaatgttgctcacaaggcaa

SEQ ID NO: 496102 - DNA, 25 bp, Mus musculus
gagtgaaattaacacccacctggtc

SEQ ID NO: 496103 - DNA, 25 bp, Mus musculus
gagtgaaattaagacccacctggtc

SEQ ID NO: 496104 - DNA, 25 bp, Mus musculus
gagtgaaattctccatcaatgaaag

SEQ ID NO: 496105 - DNA, 25 bp, Mus musculus
gagtgaaattctgcatcaatgaaag

SEQ ID NO: 496106 - DNA, 25 bp, Mus musculus
gagtgaaattggacacagccctcct

SEQ ID NO: 496107 - DNA, 25 bp, Mus musculus
gagtgaaattggtcacagccctcct

SEQ ID NO: 496108 - DNA, 25 bp, Mus musculus
gagtgaacaaggaagaggtctacaa

SEQ ID NO: 496109 - DNA, 25 bp, Mus musculus
gagtgaacaaggtagaggtctacaa

SEQ ID NO: 496110 - DNA, 25 bp, Mus musculus
gagtgaaccctaacaccaatgggag

SEQ ID NO: 496111 - DNA, 25 bp, Mus musculus
gagtgaaccctatcaccaatgggag

SEQ ID NO: 496112 - DNA, 25 bp, Mus musculus
gagtgaaccttaccacacgtgaaga

SEQ ID NO: 496113 - DNA, 25 bp, Mus musculus
gagtgaaccttagcacacgtgaaga

SEQ ID NO: 496114 - DNA, 25 bp, Mus musculus
gagtgaaccttgagcacttgcaata

SEQ ID NO: 496115 - DNA, 25 bp, Mus musculus
gagtgaaccttgtgcacttgcaata

SEQ ID NO: 496116 - DNA, 25 bp, Mus musculus
gagtgaacggaaactagaagcattg

SEQ ID NO: 496117 - DNA, 25 bp, Mus musculus
gagtgaacggaatctagaagcattg

SEQ ID NO: 496118 - DNA, 25 bp, Mus musculus
gagtgaactggacaacctggaatgt

SEQ ID NO: 496119 - DNA, 25 bp, Mus musculus
gagtgaactggagaacctggaatgt

SEQ ID NO: 496120 - DNA, 25 bp, Mus musculus
gagtgaactgtacaatctcaaggac

SEQ ID NO: 496121 - DNA, 25 bp, Mus musculus
gagtgaactgtagaatctcaaggac

SEQ ID NO: 496122 - DNA, 25 bp, Mus musculus
gagtgaagacacaaagaccaagttt

SEQ ID NO: 496123 - DNA, 25 bp, Mus musculus
gagtgaagacacagccgaaggcatt

SEQ ID NO: 496124 - DNA, 25 bp, Mus musculus
gagtgaagacactaagaccaagttt

SEQ ID NO: 496125 - DNA, 25 bp, Mus musculus
gagtgaagacactgccgaaggcatt

SEQ ID NO: 496126 - DNA, 25 bp, Mus musculus
gagtgaagacgacgactgcccttga

SEQ ID NO: 496127 - DNA, 25 bp, Mus musculus
gagtgaagacgaggactgcccttga

SEQ ID NO: 496128 - DNA, 25 bp, Mus musculus
gagtgaagctccaagccatattggc

SEQ ID NO: 496129 - DNA, 25 bp, Mus musculus
gagtgaagctcctagccatattggc

SEQ ID NO: 496130 - DNA, 25 bp, Mus musculus
gagtgaaggacaaatactcttgtgg

SEQ ID NO: 496131 - DNA, 25 bp, Mus musculus
gagtgaaggacatatactcttgtgg

SEQ ID NO: 496132 - DNA, 25 bp, Mus musculus
gagtgaaggcgtaaaatccattaga

SEQ ID NO: 496133 - DNA, 25 bp, Mus musculus
gagtgaaggcgttaaatccattaga

SEQ ID NO: 496134 - DNA, 25 bp, Mus musculus
gagtgaagggagcagtcttccctca

SEQ ID NO: 496135 - DNA, 25 bp, Mus musculus
gagtgaagggaggagtcttccctca

SEQ ID NO: 496136 - DNA, 25 bp, Mus musculus
gagtgaaggtcgcaacgccacccac

SEQ ID NO: 496137 - DNA, 25 bp, Mus musculus
gagtgaaggtcggaacgccacccac

SEQ ID NO: 496138 - DNA, 25 bp, Mus musculus
gagtgaagtcctctcatccataaaa

SEQ ID NO: 496139 - DNA, 25 bp, Mus musculus
gagtgaagtcctgtcatccataaaa

SEQ ID NO: 496140 - DNA, 25 bp, Mus musculus
gagtgaagtctaaaacaagctcttt

SEQ ID NO: 496141 - DNA, 25 bp, Mus musculus
gagtgaagtctataacaagctcttt

SEQ ID NO: 496142 - DNA, 25 bp, Mus musculus
gagtgaagtcttatccatggacatg

SEQ ID NO: 496143 - DNA, 25 bp, Mus musculus
gagtgaagtcttttccatggacatg

SEQ ID NO: 496144 - DNA, 25 bp, Mus musculus
gagtgaatcactatgctggtttcag

SEQ ID NO: 496145 - DNA, 25 bp, Mus musculus
gagtgaatcactttgctggtttcag

SEQ ID NO: 496146 - DNA, 25 bp, Mus musculus
gagtgaatccacagtctgtcctgtc

SEQ ID NO: 496147 - DNA, 25 bp, Mus musculus
gagtgaatccactgtctgtcctgtc

SEQ ID NO: 496148 - DNA, 25 bp, Mus musculus
gagtgaatcctgataccatcctgag

SEQ ID NO: 496149 - DNA, 25 bp, Mus musculus
gagtgaatcctgttaccatcctgag

SEQ ID NO: 496150 - DNA, 25 bp, Mus musculus
gagtgaatctaaaaccagtctggac

SEQ ID NO: 496151 - DNA, 25 bp, Mus musculus
gagtgaatctaataccagtctggac

SEQ ID NO: 496152 - DNA, 25 bp, Mus musculus
gagtgaatgtaaaaatgccacctca

SEQ ID NO: 496153 - DNA, 25 bp, Mus musculus
gagtgaatgtaataatgccacctca

SEQ ID NO: 496154 - DNA, 25 bp, Mus musculus
gagtgaatgtatccatgcccagtgt

SEQ ID NO: 496155 - DNA, 25 bp, Mus musculus
gagtgaatgtatgcatgcccagtgt

SEQ ID NO: 496156 - DNA, 25 bp, Mus musculus
gagtgaattaatccggcagctctgc

SEQ ID NO: 496157 - DNA, 25 bp, Mus musculus
gagtgaattaatgcggcagctctgc

SEQ ID NO: 496158 - DNA, 25 bp, Mus musculus
gagtgaattgccaccacaaggcaga

SEQ ID NO: 496159 - DNA, 25 bp, Mus musculus
gagtgaattgcctccacaaggcaga

SEQ ID NO: 496160 - DNA, 25 bp, Mus musculus
gagtgaatttagctggctcatccca

SEQ ID NO: 496161 - DNA, 25 bp, Mus musculus
gagtgaatttaggtggctcatccca

SEQ ID NO: 496162 - DNA, 25 bp, Mus musculus
gagtgacaaactaatctatagcctt

SEQ ID NO: 496163 - DNA, 25 bp, Mus musculus
gagtgacaaacttatctatagcctt

SEQ ID NO: 496164 - DNA, 25 bp, Mus musculus
gagtgacaaatgatgccaggagtgc

SEQ ID NO: 496165 - DNA, 25 bp, Mus musculus
gagtgacaaatgttgccaggagtgc

SEQ ID NO: 496166 - DNA, 25 bp, Mus musculus
gagtgacaactgatgccctcttaaa

SEQ ID NO: 496167 - DNA, 25 bp, Mus musculus
gagtgacaactgttgccctcttaaa

SEQ ID NO: 496168 - DNA, 25 bp, Mus musculus
gagtgacaagccacagaatgttaca

SEQ ID NO: 496169 - DNA, 25 bp, Mus musculus
gagtgacaagcccaactccattctt

SEQ ID NO: 496170 - DNA, 25 bp, Mus musculus
gagtgacaagccgaactccattctt

SEQ ID NO: 496171 - DNA, 25 bp, Mus musculus
gagtgacaagcctcagaatgttaca

SEQ ID NO: 496172 - DNA, 25 bp, Mus musculus
gagtgacaagtcaccgctgctaatc

SEQ ID NO: 496173 - DNA, 25 bp, Mus musculus
gagtgacaagtctccgctgctaatc

SEQ ID NO: 496174 - DNA, 25 bp, Mus musculus
gagtgacacacaagtcagtgttctg

SEQ ID NO: 496175 - DNA, 25 bp, Mus musculus
gagtgacacacatgtcagtgttctg

SEQ ID NO: 496176 - DNA, 25 bp, Mus musculus
gagtgacacacccaagagcagcatc

SEQ ID NO: 496177 - DNA, 25 bp, Mus musculus
gagtgacacaccgaagagcagcatc

SEQ ID NO: 496178 - DNA, 25 bp, Mus musculus
gagtgacacactcggtcttaggtga

SEQ ID NO: 496179 - DNA, 25 bp, Mus musculus
gagtgacacactgggtcttaggtga

SEQ ID NO: 496180 - DNA, 25 bp, Mus musculus
gagtgacacagcaggcttattgttc

SEQ ID NO: 496181 - DNA, 25 bp, Mus musculus
gagtgacacagctggcttattgttc

SEQ ID NO: 496182 - DNA, 25 bp, Mus musculus
gagtgacacccaagctgtccagata

SEQ ID NO: 496183 - DNA, 25 bp, Mus musculus
gagtgacacccatgctgtccagata

SEQ ID NO: 496184 - DNA, 25 bp, Mus musculus
gagtgacactgaatggcctaaaaga

SEQ ID NO: 496185 - DNA, 25 bp, Mus musculus
gagtgacactgattggcctaaaaga

SEQ ID NO: 496186 - DNA, 25 bp, Mus musculus
gagtgacactgtagcgctttcatca

SEQ ID NO: 496187 - DNA, 25 bp, Mus musculus
gagtgacactgttgcgctttcatca

SEQ ID NO: 496188 - DNA, 25 bp, Mus musculus
gagtgacacttgctgatctgctcgt

SEQ ID NO: 496189 - DNA, 25 bp, Mus musculus
gagtgacacttggtgatctgctcgt

SEQ ID NO: 496190 - DNA, 25 bp, Mus musculus
gagtgacactttcccaagatgcgac

SEQ ID NO: 496191 - DNA, 25 bp, Mus musculus
gagtgacactttgccaagatgcgac

SEQ ID NO: 496192 - DNA, 25 bp, Mus musculus
gagtgacagaggccgactgtaccaa

SEQ ID NO: 496193 - DNA, 25 bp, Mus musculus
gagtgacagagggcgactgtaccaa

SEQ ID NO: 496194 - DNA, 25 bp, Mus musculus
gagtgacagcaaagatcagagatca

SEQ ID NO: 496195 - DNA, 25 bp, Mus musculus
gagtgacagcaatgatcagagatca

SEQ ID NO: 496196 - DNA, 25 bp, Mus musculus
gagtgacagcacacttggtatttaa

SEQ ID NO: 496197 - DNA, 25 bp, Mus musculus
gagtgacagcactcttggtatttaa

SEQ ID NO: 496198 - DNA, 25 bp, Mus musculus
gagtgacagcagaccaggcagatcc

SEQ ID NO: 496199 - DNA, 25 bp, Mus musculus
gagtgacagcagtccaggcagatcc

SEQ ID NO: 496200 - DNA, 25 bp, Mus musculus
gagtgacaggcactgacatcggcct

SEQ ID NO: 496201 - DNA, 25 bp, Mus musculus
gagtgacaggcagtgacatcggcct

SEQ ID NO: 496202 - DNA, 25 bp, Mus musculus
gagtgacaggtcctcagttttccag

SEQ ID NO: 496203 - DNA, 25 bp, Mus musculus
gagtgacaggtcgtcagttttccag

SEQ ID NO: 496204 - DNA, 25 bp, Mus musculus
gagtgacatattctcatccccacag

SEQ ID NO: 496205 - DNA, 25 bp, Mus musculus
gagtgacatattgtcatccccacag

SEQ ID NO: 496206 - DNA, 25 bp, Mus musculus
gagtgacatcaaatccatctacata

SEQ ID NO: 496207 - DNA, 25 bp, Mus musculus
gagtgacatcaattccatctacata

SEQ ID NO: 496208 - DNA, 25 bp, Mus musculus
gagtgacatcacagcaatgctggtc

SEQ ID NO: 496209 - DNA, 25 bp, Mus musculus
gagtgacatcactgcaatgctggtc

SEQ ID NO: 496210 - DNA, 25 bp, Mus musculus
gagtgacatcataaccctggtggaa

SEQ ID NO: 496211 - DNA, 25 bp, Mus musculus
gagtgacatcattaccctggtggaa

SEQ ID NO: 496212 - DNA, 25 bp, Mus musculus
gagtgacatcttacaacatgtagct

SEQ ID NO: 496213 - DNA, 25 bp, Mus musculus
gagtgacatctttcaacatgtagct

SEQ ID NO: 496214 - DNA, 25 bp, Mus musculus
gagtgacatgaccatcttttgggaa

SEQ ID NO: 496215 - DNA, 25 bp, Mus musculus
gagtgacatgacgatcttttgggaa

SEQ ID NO: 496216 - DNA, 25 bp, Mus musculus
gagtgacatgttctttggccttaac

SEQ ID NO: 496217 - DNA, 25 bp, Mus musculus
gagtgacatgttgtttggccttaac

SEQ ID NO: 496218 - DNA, 25 bp, Mus musculus
gagtgacattgtaaaaatgccacat

SEQ ID NO: 496219 - DNA, 25 bp, Mus musculus
gagtgacattgttaaaatgccacat

SEQ ID NO: 496220 - DNA, 25 bp, Mus musculus
gagtgacatttactggatgattcct

SEQ ID NO: 496221 - DNA, 25 bp, Mus musculus
gagtgacatttagtggatgattcct

SEQ ID NO: 496222 - DNA, 25 bp, Mus musculus
gagtgacatttcaaaagatgttcta

SEQ ID NO: 496223 - DNA, 25 bp, Mus musculus
gagtgacatttccttgagccggttt

SEQ ID NO: 496224 - DNA, 25 bp, Mus musculus
gagtgacatttcgttgagccggttt

SEQ ID NO: 496225 - DNA, 25 bp, Mus musculus
gagtgacatttctaaagatgttcta

SEQ ID NO: 496226 - DNA, 25 bp, Mus musculus
gagtgaccaaggctttccaaagtag

SEQ ID NO: 496227 - DNA, 25 bp, Mus musculus
gagtgaccaagggtttccaaagtag

SEQ ID NO: 496228 - DNA, 25 bp, Mus musculus
gagtgaccagggacttatatgtgac

SEQ ID NO: 496229 - DNA, 25 bp, Mus musculus
gagtgaccagggtcttatatgtgac

SEQ ID NO: 496230 - DNA, 25 bp, Mus musculus
gagtgaccagtgaactttatggact

SEQ ID NO: 496231 - DNA, 25 bp, Mus musculus
gagtgaccagtgtactttatggact

SEQ ID NO: 496232 - DNA, 25 bp, Mus musculus
gagtgaccatgccttgatgctgcgc

SEQ ID NO: 496233 - DNA, 25 bp, Mus musculus
gagtgaccatgcgttgatgctgcgc

SEQ ID NO: 496234 - DNA, 25 bp, Mus musculus
gagtgacccactacaaataaccttt

SEQ ID NO: 496235 - DNA, 25 bp, Mus musculus
gagtgacccacttcaaataaccttt

SEQ ID NO: 496236 - DNA, 25 bp, Mus musculus
gagtgacccagtcgaaactctttca

SEQ ID NO: 496237 - DNA, 25 bp, Mus musculus
gagtgacccagtggaaactctttca

SEQ ID NO: 496238 - DNA, 25 bp, Mus musculus
gagtgaccctaaaactgaccgtcct

SEQ ID NO: 496239 - DNA, 25 bp, Mus musculus
gagtgaccctaatactgaccgtcct

SEQ ID NO: 496240 - DNA, 25 bp, Mus musculus
gagtgaccctataatgcttctcaag

SEQ ID NO: 496241 - DNA, 25 bp, Mus musculus
gagtgaccctattatgcttctcaag

SEQ ID NO: 496242 - DNA, 25 bp, Mus musculus
gagtgaccctccacaaatatctgta

SEQ ID NO: 496243 - DNA, 25 bp, Mus musculus
gagtgaccctcctcaaatatctgta

SEQ ID NO: 496244 - DNA, 25 bp, Mus musculus
gagtgaccctctctttcaactaata

SEQ ID NO: 496245 - DNA, 25 bp, Mus musculus
gagtgaccctctgtttcaactaata

SEQ ID NO: 496246 - DNA, 25 bp, Mus musculus
gagtgaccctttcctagaaacaagc

SEQ ID NO: 496247 - DNA, 25 bp, Mus musculus
gagtgaccctttgctagaaacaagc

SEQ ID NO: 496248 - DNA, 25 bp, Mus musculus
gagtgaccgaagactgcctggaaca

SEQ ID NO: 496249 - DNA, 25 bp, Mus musculus
gagtgaccgaagtctgcctggaaca

SEQ ID NO: 496250 - DNA, 25 bp, Mus musculus
gagtgacctaccaacaaaagagaca

SEQ ID NO: 496251 - DNA, 25 bp, Mus musculus
gagtgacctacctacaaaagagaca

SEQ ID NO: 496252 - DNA, 25 bp, Mus musculus
gagtgacctataatttcttacccag

SEQ ID NO: 496253 - DNA, 25 bp, Mus musculus
gagtgacctatattttcttacccag

SEQ ID NO: 496254 - DNA, 25 bp, Mus musculus
gagtgacctatcagtctccttccat

SEQ ID NO: 496255 - DNA, 25 bp, Mus musculus
gagtgacctatctgtctccttccat

SEQ ID NO: 496256 - DNA, 25 bp, Mus musculus
gagtgacctattaaacttcatccag

SEQ ID NO: 496257 - DNA, 25 bp, Mus musculus
gagtgacctatttaacttcatccag

SEQ ID NO: 496258 - DNA, 25 bp, Mus musculus
gagtgacctcaacatttctgggatg

SEQ ID NO: 496259 - DNA, 25 bp, Mus musculus
gagtgacctcaagatttctgggatg

SEQ ID NO: 496260 - DNA, 25 bp, Mus musculus
gagtgacctgacaagctttacctaa

SEQ ID NO: 496261 - DNA, 25 bp, Mus musculus
gagtgacctgactagctttacctaa

SEQ ID NO: 496262 - DNA, 25 bp, Mus musculus
gagtgaccttagaatgtgaccctta

SEQ ID NO: 496263 - DNA, 25 bp, Mus musculus
gagtgaccttagtatgtgaccctta

SEQ ID NO: 496264 - DNA, 25 bp, Mus musculus
gagtgaccttctaagcattcgggct

SEQ ID NO: 496265 - DNA, 25 bp, Mus musculus
gagtgaccttcttagcattcgggct

SEQ ID NO: 496266 - DNA, 25 bp, Mus musculus
gagtgacctttgaatgtagtttgag

SEQ ID NO: 496267 - DNA, 25 bp, Mus musculus
gagtgacctttgtatgtagtttgag

SEQ ID NO: 496268 - DNA, 25 bp, Mus musculus
gagtgacgaccgcacacgctttgtt

SEQ ID NO: 496269 - DNA, 25 bp, Mus musculus
gagtgacgaccggacacgctttgtt

SEQ ID NO: 496270 - DNA, 25 bp, Mus musculus
gagtgacgctatattactgtattcg

SEQ ID NO: 496271 - DNA, 25 bp, Mus musculus
gagtgacgctattttactgtattcg

SEQ ID NO: 496272 - DNA, 25 bp, Mus musculus
gagtgacgtcacagttggactcatt

SEQ ID NO: 496273 - DNA, 25 bp, Mus musculus
gagtgacgtcactgttggactcatt

SEQ ID NO: 496274 - DNA, 25 bp, Mus musculus
gagtgacgtctgatttgggccttca

SEQ ID NO: 496275 - DNA, 25 bp, Mus musculus
gagtgacgtctgttttgggccttca

SEQ ID NO: 496276 - DNA, 25 bp, Mus musculus
gagtgactaactcctatctgggaga

SEQ ID NO: 496277 - DNA, 25 bp, Mus musculus
gagtgactaactgctatctgggaga

SEQ ID NO: 496278 - DNA, 25 bp, Mus musculus
gagtgactaagcatgcccagatggt

SEQ ID NO: 496279 - DNA, 25 bp, Mus musculus
gagtgactaagcttgcccagatggt

SEQ ID NO: 496280 - DNA, 25 bp, Mus musculus
gagtgactagaaatgtcccctgctt

SEQ ID NO: 496281 - DNA, 25 bp, Mus musculus
gagtgactagaattgtcccctgctt

SEQ ID NO: 496282 - DNA, 25 bp, Mus musculus
gagtgactagccacctaagtgagag

SEQ ID NO: 496283 - DNA, 25 bp, Mus musculus
gagtgactagcctcctaagtgagag

SEQ ID NO: 496284 - DNA, 25 bp, Mus musculus
gagtgactattgctcccagtgaaga

SEQ ID NO: 496285 - DNA, 25 bp, Mus musculus
gagtgactattggtcccagtgaaga

SEQ ID NO: 496286 - DNA, 25 bp, Mus musculus
gagtgactcactaagattttgttcc

SEQ ID NO: 496287 - DNA, 25 bp, Mus musculus
gagtgactcacttagattttgttcc

SEQ ID NO: 496288 - DNA, 25 bp, Mus musculus
gagtgactcagcatggaaatcccat

SEQ ID NO: 496289 - DNA, 25 bp, Mus musculus
gagtgactcagcttggaaatcccat

SEQ ID NO: 496290 - DNA, 25 bp, Mus musculus
gagtgactcatacctgcctgtaact

SEQ ID NO: 496291 - DNA, 25 bp, Mus musculus
gagtgactcatagctgcctgtaact

SEQ ID NO: 496292 - DNA, 25 bp, Mus musculus
gagtgactccagagactccgagcag

SEQ ID NO: 496293 - DNA, 25 bp, Mus musculus
gagtgactccagtgactccgagcag

SEQ ID NO: 496294 - DNA, 25 bp, Mus musculus
gagtgactccatattacaagcagca

SEQ ID NO: 496295 - DNA, 25 bp, Mus musculus
gagtgactccattttacaagcagca

SEQ ID NO: 496296 - DNA, 25 bp, Mus musculus
gagtgactcctgctccctccagaag

SEQ ID NO: 496297 - DNA, 25 bp, Mus musculus
gagtgactcctggtccctccagaag

SEQ ID NO: 496298 - DNA, 25 bp, Mus musculus
gagtgactcgatcacaaggttatcg

SEQ ID NO: 496299 - DNA, 25 bp, Mus musculus
gagtgactcgatgacaaggttatcg

SEQ ID NO: 496300 - DNA, 25 bp, Mus musculus
gagtgactctctctcagaacaaaca

SEQ ID NO: 496301 - DNA, 25 bp, Mus musculus
gagtgactctctgtcagaacaaaca

SEQ ID NO: 496302 - DNA, 25 bp, Mus musculus
gagtgactgaatactgccggcaaac

SEQ ID NO: 496303 - DNA, 25 bp, Mus musculus
gagtgactgaattctgccggcaaac

SEQ ID NO: 496304 - DNA, 25 bp, Mus musculus
gagtgactgagaaccgtctatggtt

SEQ ID NO: 496305 - DNA, 25 bp, Mus musculus
gagtgactgagatccgtctatggtt

SEQ ID NO: 496306 - DNA, 25 bp, Mus musculus
gagtgactgcagagaatgtatttat

SEQ ID NO: 496307 - DNA, 25 bp, Mus musculus
gagtgactgcagtgaatgtatttat

SEQ ID NO: 496308 - DNA, 25 bp, Mus musculus
gagtgactggttaccggatccacaa

SEQ ID NO: 496309 - DNA, 25 bp, Mus musculus
gagtgactggttccatttcaagcct

SEQ ID NO: 496310 - DNA, 25 bp, Mus musculus
gagtgactggttgcatttcaagcct

SEQ ID NO: 496311 - DNA, 25 bp, Mus musculus
gagtgactggtttccggatccacaa

SEQ ID NO: 496312 - DNA, 25 bp, Mus musculus
gagtgactgtcccttgtgaagaatt

SEQ ID NO: 496313 - DNA, 25 bp, Mus musculus
gagtgactgtccgttgtgaagaatt

SEQ ID NO: 496314 - DNA, 25 bp, Mus musculus
gagtgactgtgccagattcctacct

SEQ ID NO: 496315 - DNA, 25 bp, Mus musculus
gagtgactgtgcgagattcctacct

SEQ ID NO: 496316 - DNA, 25 bp, Mus musculus
gagtgactgttgctcgtcattctga

SEQ ID NO: 496317 - DNA, 25 bp, Mus musculus
gagtgactgttggtcgtcattctga

SEQ ID NO: 496318 - DNA, 25 bp, Mus musculus
gagtgacttatccagcttttagtct

SEQ ID NO: 496319 - DNA, 25 bp, Mus musculus
gagtgacttatcgagcttttagtct

SEQ ID NO: 496320 - DNA, 25 bp, Mus musculus
gagtgacttcagcagattcatttct

SEQ ID NO: 496321 - DNA, 25 bp, Mus musculus
gagtgacttcaggagattcatttct

SEQ ID NO: 496322 - DNA, 25 bp, Mus musculus
gagtgacttcatagcctgtcatgat

SEQ ID NO: 496323 - DNA, 25 bp, Mus musculus
gagtgacttcatccaaggttactgt

SEQ ID NO: 496324 - DNA, 25 bp, Mus musculus
gagtgacttcatgcaaggttactgt

SEQ ID NO: 496325 - DNA, 25 bp, Mus musculus
gagtgacttcattgcctgtcatgat

SEQ ID NO: 496326 - DNA, 25 bp, Mus musculus
gagtgacttcctctttgtgcattca

SEQ ID NO: 496327 - DNA, 25 bp, Mus musculus
gagtgacttcctgtttgtgcattca

SEQ ID NO: 496328 - DNA, 25 bp, Mus musculus
gagtgacttcttactacttctaaat

SEQ ID NO: 496329 - DNA, 25 bp, Mus musculus
gagtgacttctttctacttctaaat

SEQ ID NO: 496330 - DNA, 25 bp, Mus musculus
gagtgagaaagcagtaggcatattt

SEQ ID NO: 496331 - DNA, 25 bp, Mus musculus
gagtgagaaagctgtaggcatattt

SEQ ID NO: 496332 - DNA, 25 bp, Mus musculus
gagtgagaagaaaccctggcctcag

SEQ ID NO: 496333 - DNA, 25 bp, Mus musculus
gagtgagaagaatccctggcctcag

SEQ ID NO: 496334 - DNA, 25 bp, Mus musculus
gagtgagaatgcacgcttggccctc

SEQ ID NO: 496335 - DNA, 25 bp, Mus musculus
gagtgagaatgctcgcttggccctc

SEQ ID NO: 496336 - DNA, 25 bp, Mus musculus
gagtgagacactacagatactgcaa

SEQ ID NO: 496337 - DNA, 25 bp, Mus musculus
gagtgagacacttcagatactgcaa

SEQ ID NO: 496338 - DNA, 25 bp, Mus musculus
gagtgagacctgagtgaacccagcc

SEQ ID NO: 496339 - DNA, 25 bp, Mus musculus
gagtgagacctgtgtgaacccagcc

SEQ ID NO: 496340 - DNA, 25 bp, Mus musculus
gagtgagacttcattgtatgacttc

SEQ ID NO: 496341 - DNA, 25 bp, Mus musculus
gagtgagacttctttgtatgacttc

SEQ ID NO: 496342 - DNA, 25 bp, Mus musculus
gagtgagagcatctaccgcagcaaa

SEQ ID NO: 496343 - DNA, 25 bp, Mus musculus
gagtgagagcatgtaccgcagcaaa

SEQ ID NO: 496344 - DNA, 25 bp, Mus musculus
gagtgagaggaacttttaaccccat

SEQ ID NO: 496345 - DNA, 25 bp, Mus musculus
gagtgagaggaagttttaaccccat

SEQ ID NO: 496346 - DNA, 25 bp, Mus musculus
gagtgagatctgacacagtcctctt

SEQ ID NO: 496347 - DNA, 25 bp, Mus musculus
gagtgagatctgtcacagtcctctt

SEQ ID NO: 496348 - DNA, 25 bp, Mus musculus
gagtgagatgcacgctcatccatca

SEQ ID NO: 496349 - DNA, 25 bp, Mus musculus
gagtgagatgcaggctcatccatca

SEQ ID NO: 496350 - DNA, 25 bp, Mus musculus
gagtgagattatacagcaagcaaac

SEQ ID NO: 496351 - DNA, 25 bp, Mus musculus
gagtgagattattcagcaagcaaac

SEQ ID NO: 496352 - DNA, 25 bp, Mus musculus
gagtgagatttgactcagcagcaat

SEQ ID NO: 496353 - DNA, 25 bp, Mus musculus
gagtgagatttgtctcagcagcaat

SEQ ID NO: 496354 - DNA, 25 bp, Mus musculus
gagtgagcacaacgtagcgtccaat

SEQ ID NO: 496355 - DNA, 25 bp, Mus musculus
gagtgagcacaaggtagcgtccaat

SEQ ID NO: 496356 - DNA, 25 bp, Mus musculus
gagtgagcaccaagatatggcctaa

SEQ ID NO: 496357 - DNA, 25 bp, Mus musculus
gagtgagcaccatgatatggcctaa

SEQ ID NO: 496358 - DNA, 25 bp, Mus musculus
gagtgagcacctaataatggagatt

SEQ ID NO: 496359 - DNA, 25 bp, Mus musculus
gagtgagcaccttataatggagatt

SEQ ID NO: 496360 - DNA, 25 bp, Mus musculus
gagtgagcacgtccattctgctttc

SEQ ID NO: 496361 - DNA, 25 bp, Mus musculus
gagtgagcacgtgcattctgctttc

SEQ ID NO: 496362 - DNA, 25 bp, Mus musculus
gagtgagcactgaccttgtaaagat

SEQ ID NO: 496363 - DNA, 25 bp, Mus musculus
gagtgagcactgtccttgtaaagat

SEQ ID NO: 496364 - DNA, 25 bp, Mus musculus
gagtgagcacttagatgcccactat

SEQ ID NO: 496365 - DNA, 25 bp, Mus musculus
gagtgagcactttgatgcccactat

SEQ ID NO: 496366 - DNA, 25 bp, Mus musculus
gagtgagccaccctacccagctaat

SEQ ID NO: 496367 - DNA, 25 bp, Mus musculus
gagtgagccaccgtacccagctaat

SEQ ID NO: 496368 - DNA, 25 bp, Mus musculus
gagtgagccgagaccaagcatgtaa

SEQ ID NO: 496369 - DNA, 25 bp, Mus musculus
gagtgagccgagtccaagcatgtaa

SEQ ID NO: 496370 - DNA, 25 bp, Mus musculus
gagtgagcggctagaccctggctta

SEQ ID NO: 496371 - DNA, 25 bp, Mus musculus
gagtgagcggcttgaccctggctta

SEQ ID NO: 496372 - DNA, 25 bp, Mus musculus
gagtgagctcctaggtctctggcca

SEQ ID NO: 496373 - DNA, 25 bp, Mus musculus
gagtgagctccttggtctctggcca

SEQ ID NO: 496374 - DNA, 25 bp, Mus musculus
gagtgagctgaaatccctttctcaa

SEQ ID NO: 496375 - DNA, 25 bp, Mus musculus
gagtgagctgaattccctttctcaa

SEQ ID NO: 496376 - DNA, 25 bp, Mus musculus
gagtgagctgcaacctgagagcctc

SEQ ID NO: 496377 - DNA, 25 bp, Mus musculus
gagtgagctgcatcctgagagcctc

SEQ ID NO: 496378 - DNA, 25 bp, Mus musculus
gagtgagctgtgctgccttagaaat

SEQ ID NO: 496379 - DNA, 25 bp, Mus musculus
gagtgagctgtggtgccttagaaat

SEQ ID NO: 496380 - DNA, 25 bp, Mus musculus
gagtgagcttagcatgcttggcctt

SEQ ID NO: 496381 - DNA, 25 bp, Mus musculus
gagtgagcttaggatgcttggcctt

SEQ ID NO: 496382 - DNA, 25 bp, Mus musculus
gagtgagcttccagagcccgagcaa

SEQ ID NO: 496383 - DNA, 25 bp, Mus musculus
gagtgagcttcctgagcccgagcaa

SEQ ID NO: 496384 - DNA, 25 bp, Mus musculus
gagtgaggaattcacactgctcaga

SEQ ID NO: 496385 - DNA, 25 bp, Mus musculus
gagtgaggaattgacactgctcaga

SEQ ID NO: 496386 - DNA, 25 bp, Mus musculus
gagtgaggactcagctcggtctttc

SEQ ID NO: 496387 - DNA, 25 bp, Mus musculus
gagtgaggactctgctcggtctttc

SEQ ID NO: 496388 - DNA, 25 bp, Mus musculus
gagtgaggatctctgcagatgccat

SEQ ID NO: 496389 - DNA, 25 bp, Mus musculus
gagtgaggatctgtgcagatgccat

SEQ ID NO: 496390 - DNA, 25 bp, Mus musculus
gagtgaggattcagccagacttgaa

SEQ ID NO: 496391 - DNA, 25 bp, Mus musculus
gagtgaggattctgccagacttgaa

SEQ ID NO: 496392 - DNA, 25 bp, Mus musculus
gagtgaggatttcccatgtcccagg

SEQ ID NO: 496393 - DNA, 25 bp, Mus musculus
gagtgaggatttgccatgtcccagg

SEQ ID NO: 496394 - DNA, 25 bp, Mus musculus
gagtgaggccaaattacaatccaag

SEQ ID NO: 496395 - DNA, 25 bp, Mus musculus
gagtgaggccaatttacaatccaag

SEQ ID NO: 496396 - DNA, 25 bp, Mus musculus
gagtgaggcccaccatatgtctaac

SEQ ID NO: 496397 - DNA, 25 bp, Mus musculus
gagtgaggcccagcatatgtctaac

SEQ ID NO: 496398 - DNA, 25 bp, Mus musculus
gagtgaggccgaacttgaactcaag

SEQ ID NO: 496399 - DNA, 25 bp, Mus musculus
gagtgaggccgatcttgaactcaag

SEQ ID NO: 496400 - DNA, 25 bp, Mus musculus
gagtgaggcctcaagttagctgctg

SEQ ID NO: 496401 - DNA, 25 bp, Mus musculus
gagtgaggcctctagttagctgctg

SEQ ID NO: 496402 - DNA, 25 bp, Mus musculus
gagtgagggcgcagaggaagtcctg

SEQ ID NO: 496403 - DNA, 25 bp, Mus musculus
gagtgagggcgctgaggaagtcctg

SEQ ID NO: 496404 - DNA, 25 bp, Mus musculus
gagtgaggtcctcgagatcctgtca

SEQ ID NO: 496405 - DNA, 25 bp, Mus musculus
gagtgaggtcctggagatcctgtca

SEQ ID NO: 496406 - DNA, 25 bp, Mus musculus
gagtgaggtgacattccctttgaaa

SEQ ID NO: 496407 - DNA, 25 bp, Mus musculus
gagtgaggtgactttccctttgaaa

SEQ ID NO: 496408 - DNA, 25 bp, Mus musculus
gagtgaggtgctataacatggagaa

SEQ ID NO: 496409 - DNA, 25 bp, Mus musculus
gagtgaggtgctttaacatggagaa

SEQ ID NO: 496410 - DNA, 25 bp, Mus musculus
gagtgagtaccgcttttctttagtt

SEQ ID NO: 496411 - DNA, 25 bp, Mus musculus
gagtgagtaccggttttctttagtt

SEQ ID NO: 496412 - DNA, 25 bp, Mus musculus
gagtgagtaggtagcatctttgccc

SEQ ID NO: 496413 - DNA, 25 bp, Mus musculus
gagtgagtaggttgcatctttgccc

SEQ ID NO: 496414 - DNA, 25 bp, Mus musculus
gagtgagtatgcatctcagtctcaa

SEQ ID NO: 496415 - DNA, 25 bp, Mus musculus
gagtgagtatgcttctcagtctcaa

SEQ ID NO: 496416 - DNA, 25 bp, Mus musculus
gagtgagtccccatggtgatttatt

SEQ ID NO: 496417 - DNA, 25 bp, Mus musculus
gagtgagtccccttggtgatttatt

SEQ ID NO: 496418 - DNA, 25 bp, Mus musculus
gagtgagtccttcctgggtagattt

SEQ ID NO: 496419 - DNA, 25 bp, Mus musculus
gagtgagtccttgctgggtagattt

SEQ ID NO: 496420 - DNA, 25 bp, Mus musculus
gagtgagtcttacatggaaacagtt

SEQ ID NO: 496421 - DNA, 25 bp, Mus musculus
gagtgagtcttagatggaaacagtt

SEQ ID NO: 496422 - DNA, 25 bp, Mus musculus
gagtgagtgcaacccggctttagac

SEQ ID NO: 496423 - DNA, 25 bp, Mus musculus
gagtgagtgcaagccggctttagac

SEQ ID NO: 496424 - DNA, 25 bp, Mus musculus
gagtgagtgcctacgggtccaagaa

SEQ ID NO: 496425 - DNA, 25 bp, Mus musculus
gagtgagtgccttcgggtccaagaa

SEQ ID NO: 496426 - DNA, 25 bp, Mus musculus
gagtgagtgtcaccgctgtgtcaac

SEQ ID NO: 496427 - DNA, 25 bp, Mus musculus
gagtgagtgtcagcgctgtgtcaac

SEQ ID NO: 496428 - DNA, 25 bp, Mus musculus
gagtgagtgtctaaggcgtttccct

SEQ ID NO: 496429 - DNA, 25 bp, Mus musculus
gagtgagtgtcttaggcgtttccct

SEQ ID NO: 496430 - DNA, 25 bp, Mus musculus
gagtgagttaccaccctatgcagat

SEQ ID NO: 496431 - DNA, 25 bp, Mus musculus
gagtgagttacctccctatgcagat

SEQ ID NO: 496432 - DNA, 25 bp, Mus musculus
gagtgagttctcaaatactgtgccc

SEQ ID NO: 496433 - DNA, 25 bp, Mus musculus
gagtgagttctcatgagtttttaac

SEQ ID NO: 496434 - DNA, 25 bp, Mus musculus
gagtgagttctctaatactgtgccc

SEQ ID NO: 496435 - DNA, 25 bp, Mus musculus
gagtgagttctcttgagtttttaac

SEQ ID NO: 496436 - DNA, 25 bp, Mus musculus
gagtgagttgttaacctctgggtga

SEQ ID NO: 496437 - DNA, 25 bp, Mus musculus
gagtgagttgtttacctctgggtga

SEQ ID NO: 496438 - DNA, 25 bp, Mus musculus
gagtgagtttccatcctgcgggacc

SEQ ID NO: 496439 - DNA, 25 bp, Mus musculus
gagtgagtttccttcctgcgggacc

SEQ ID NO: 496440 - DNA, 25 bp, Mus musculus
gagtgataacgtcttgaatttggaa

SEQ ID NO: 496441 - DNA, 25 bp, Mus musculus
gagtgataacgtgttgaatttggaa

SEQ ID NO: 496442 - DNA, 25 bp, Mus musculus
gagtgataagcccacaagctctctt

SEQ ID NO: 496443 - DNA, 25 bp, Mus musculus
gagtgataagccgacaagctctctt

SEQ ID NO: 496444 - DNA, 25 bp, Mus musculus
gagtgatacccacttaaggttataa

SEQ ID NO: 496445 - DNA, 25 bp, Mus musculus
gagtgatacccagttaaggttataa

SEQ ID NO: 496446 - DNA, 25 bp, Mus musculus
gagtgatacttactgaggcccctta

SEQ ID NO: 496447 - DNA, 25 bp, Mus musculus
gagtgatacttagtgaggcccctta

SEQ ID NO: 496448 - DNA, 25 bp, Mus musculus
gagtgatacttcacaacatcagacg

SEQ ID NO: 496449 - DNA, 25 bp, Mus musculus
gagtgatacttctcaacatcagacg

SEQ ID NO: 496450 - DNA, 25 bp, Mus musculus
gagtgatatcacatctatgtaattt

SEQ ID NO: 496451 - DNA, 25 bp, Mus musculus
gagtgatatcacttctatgtaattt

SEQ ID NO: 496452 - DNA, 25 bp, Mus musculus
gagtgatatgaaacccaacctgaga

SEQ ID NO: 496453 - DNA, 25 bp, Mus musculus
gagtgatatgaatcccaacctgaga

SEQ ID NO: 496454 - DNA, 25 bp, Mus musculus
gagtgatatgtcctctccctcagga

SEQ ID NO: 496455 - DNA, 25 bp, Mus musculus
gagtgatatgtcgtctccctcagga

SEQ ID NO: 496456 - DNA, 25 bp, Mus musculus
gagtgatcacctatccaagcatgtc

SEQ ID NO: 496457 - DNA, 25 bp, Mus musculus
gagtgatcacctttccaagcatgtc

SEQ ID NO: 496458 - DNA, 25 bp, Mus musculus
gagtgatcactgatcatttgaaaat

SEQ ID NO: 496459 - DNA, 25 bp, Mus musculus
gagtgatcactgttcatttgaaaat

SEQ ID NO: 496460 - DNA, 25 bp, Mus musculus
gagtgatcagtccttcttatagctt

SEQ ID NO: 496461 - DNA, 25 bp, Mus musculus
gagtgatcagtcgttcttatagctt

SEQ ID NO: 496462 - DNA, 25 bp, Mus musculus
gagtgatcataaattctttcctgtc

SEQ ID NO: 496463 - DNA, 25 bp, Mus musculus
gagtgatcataatttctttcctgtc

SEQ ID NO: 496464 - DNA, 25 bp, Mus musculus
gagtgatccacgactgaactgttcc

SEQ ID NO: 496465 - DNA, 25 bp, Mus musculus
gagtgatccacgtctgaactgttcc

SEQ ID NO: 496466 - DNA, 25 bp, Mus musculus
gagtgatccaggatcaccaccggga

SEQ ID NO: 496467 - DNA, 25 bp, Mus musculus
gagtgatccaggttcaccaccggga

SEQ ID NO: 496468 - DNA, 25 bp, Mus musculus
gagtgatcccagcatcggcaagcga

SEQ ID NO: 496469 - DNA, 25 bp, Mus musculus
gagtgatcccaggatcggcaagcga

SEQ ID NO: 496470 - DNA, 25 bp, Mus musculus
gagtgatccccaccacaggaaggct

SEQ ID NO: 496471 - DNA, 25 bp, Mus musculus
gagtgatccccagcacaggaaggct

SEQ ID NO: 496472 - DNA, 25 bp, Mus musculus
gagtgatcccctcaaggattacaac

SEQ ID NO: 496473 - DNA, 25 bp, Mus musculus
gagtgatcccctgaaggattacaac

SEQ ID NO: 496474 - DNA, 25 bp, Mus musculus
gagtgatccctgagcagtcagtgat

SEQ ID NO: 496475 - DNA, 25 bp, Mus musculus
gagtgatccctgtgcagtcagtgat

SEQ ID NO: 496476 - DNA, 25 bp, Mus musculus
gagtgatccgcaaggagctctgtgc

SEQ ID NO: 496477 - DNA, 25 bp, Mus musculus
gagtgatccgcatggagctctgtgc

SEQ ID NO: 496478 - DNA, 25 bp, Mus musculus
gagtgatcctccacagattaatgaa

SEQ ID NO: 496479 - DNA, 25 bp, Mus musculus
gagtgatcctcctcagattaatgaa

SEQ ID NO: 496480 - DNA, 25 bp, Mus musculus
gagtgatcgagcagctccaaggcca

SEQ ID NO: 496481 - DNA, 25 bp, Mus musculus
gagtgatcgagctgctccaaggcca

SEQ ID NO: 496482 - DNA, 25 bp, Mus musculus
gagtgatctcgaagcagactctgga

SEQ ID NO: 496483 - DNA, 25 bp, Mus musculus
gagtgatctcgatgcagactctgga

SEQ ID NO: 496484 - DNA, 25 bp, Mus musculus
gagtgatcttaaaacccactcgggt

SEQ ID NO: 496485 - DNA, 25 bp, Mus musculus
gagtgatcttaatacccactcgggt

SEQ ID NO: 496486 - DNA, 25 bp, Mus musculus
gagtgatctttaaaattgccttagg

SEQ ID NO: 496487 - DNA, 25 bp, Mus musculus
gagtgatctttactactcttgcata

SEQ ID NO: 496488 - DNA, 25 bp, Mus musculus
gagtgatctttagtactcttgcata

SEQ ID NO: 496489 - DNA, 25 bp, Mus musculus
gagtgatctttataattgccttagg

SEQ ID NO: 496490 - DNA, 25 bp, Mus musculus
gagtgatgaactccctcataccaga

SEQ ID NO: 496491 - DNA, 25 bp, Mus musculus
gagtgatgaactgcctcataccaga

SEQ ID NO: 496492 - DNA, 25 bp, Mus musculus
gagtgatgacggactacccaaccaa

SEQ ID NO: 496493 - DNA, 25 bp, Mus musculus
gagtgatgacggtctacccaaccaa

SEQ ID NO: 496494 - DNA, 25 bp, Mus musculus
gagtgatgaggtacgcaagaacctg

SEQ ID NO: 496495 - DNA, 25 bp, Mus musculus
gagtgatgaggttcgcaagaacctg

SEQ ID NO: 496496 - DNA, 25 bp, Mus musculus
gagtgatgataccttcgttcttacc

SEQ ID NO: 496497 - DNA, 25 bp, Mus musculus
gagtgatgatacgttcgttcttacc

SEQ ID NO: 496498 - DNA, 25 bp, Mus musculus
gagtgatgatagctctggtgatcct

SEQ ID NO: 496499 - DNA, 25 bp, Mus musculus
gagtgatgataggtctggtgatcct

SEQ ID NO: 496500 - DNA, 25 bp, Mus musculus
gagtgatgcaatatggtcccatgta

SEQ ID NO: 496501 - DNA, 25 bp, Mus musculus
gagtgatgcaatttggtcccatgta

SEQ ID NO: 496502 - DNA, 25 bp, Mus musculus
gagtgatgccgaatctcattttgga

SEQ ID NO: 496503 - DNA, 25 bp, Mus musculus
gagtgatgccgattctcattttgga

SEQ ID NO: 496504 - DNA, 25 bp, Mus musculus
gagtgatgcctacccgatgacagaa

SEQ ID NO: 496505 - DNA, 25 bp, Mus musculus
gagtgatgcctagccgatgacagaa

SEQ ID NO: 496506 - DNA, 25 bp, Mus musculus
gagtgatggataactcttctcaatt

SEQ ID NO: 496507 - DNA, 25 bp, Mus musculus
gagtgatggatatctcttctcaatt

SEQ ID NO: 496508 - DNA, 25 bp, Mus musculus
gagtgatggcacaacatattctata

SEQ ID NO: 496509 - DNA, 25 bp, Mus musculus
gagtgatggcactacatattctata

SEQ ID NO: 496510 - DNA, 25 bp, Mus musculus
gagtgatgggtcaattctacatttt

SEQ ID NO: 496511 - DNA, 25 bp, Mus musculus
gagtgatgggtctattctacatttt

SEQ ID NO: 496512 - DNA, 25 bp, Mus musculus
gagtgattaacacgccagagctcaa

SEQ ID NO: 496513 - DNA, 25 bp, Mus musculus
gagtgattaacaggccagagctcaa

SEQ ID NO: 496514 - DNA, 25 bp, Mus musculus
gagtgattacaaataggcaacctat

SEQ ID NO: 496515 - DNA, 25 bp, Mus musculus
gagtgattacaattaggcaacctat

SEQ ID NO: 496516 - DNA, 25 bp, Mus musculus
gagtgattagtacatttgcccacat

SEQ ID NO: 496517 - DNA, 25 bp, Mus musculus
gagtgattagtagatttgcccacat

SEQ ID NO: 496518 - DNA, 25 bp, Mus musculus
gagtgattattcctgtttaccctgt

SEQ ID NO: 496519 - DNA, 25 bp, Mus musculus
gagtgattattcgtgtttaccctgt

SEQ ID NO: 496520 - DNA, 25 bp, Mus musculus
gagtgattccaaaaggcgctggcct

SEQ ID NO: 496521 - DNA, 25 bp, Mus musculus
gagtgattccaataggcgctggcct

SEQ ID NO: 496522 - DNA, 25 bp, Mus musculus
gagtgattccatagacttccattga

SEQ ID NO: 496523 - DNA, 25 bp, Mus musculus
gagtgattccatccttaattactaa

SEQ ID NO: 496524 - DNA, 25 bp, Mus musculus
gagtgattccatgcttaattactaa

SEQ ID NO: 496525 - DNA, 25 bp, Mus musculus
gagtgattccattgacttccattga

SEQ ID NO: 496526 - DNA, 25 bp, Mus musculus
gagtgattcccaataaacccacctt

SEQ ID NO: 496527 - DNA, 25 bp, Mus musculus
gagtgattcccattaaacccacctt

SEQ ID NO: 496528 - DNA, 25 bp, Mus musculus
gagtgattcctaagcctaccagcta

SEQ ID NO: 496529 - DNA, 25 bp, Mus musculus
gagtgattcctatgcctaccagcta

SEQ ID NO: 496530 - DNA, 25 bp, Mus musculus
gagtgattctttagcactgtgtatt

SEQ ID NO: 496531 - DNA, 25 bp, Mus musculus
gagtgattcttttgcactgtgtatt

SEQ ID NO: 496532 - DNA, 25 bp, Mus musculus
gagtgattgatactgctgctgccaa

SEQ ID NO: 496533 - DNA, 25 bp, Mus musculus
gagtgattgatagtgctgctgccaa

SEQ ID NO: 496534 - DNA, 25 bp, Mus musculus
gagtgattgggaatgcgcagtaaac

SEQ ID NO: 496535 - DNA, 25 bp, Mus musculus
gagtgattgggattgcgcagtaaac

SEQ ID NO: 496536 - DNA, 25 bp, Mus musculus
gagtgattgggcacacccagactgc

SEQ ID NO: 496537 - DNA, 25 bp, Mus musculus
gagtgattgggctcacccagactgc

SEQ ID NO: 496538 - DNA, 25 bp, Mus musculus
gagtgattgtcaaaccagggcctga

SEQ ID NO: 496539 - DNA, 25 bp, Mus musculus
gagtgattgtcataccagggcctga

SEQ ID NO: 496540 - DNA, 25 bp, Mus musculus
gagtgattgtgccacatgacctcat

SEQ ID NO: 496541 - DNA, 25 bp, Mus musculus
gagtgattgtgcgacatgacctcat

SEQ ID NO: 496542 - DNA, 25 bp, Mus musculus
gagtgatttacgacatctcagggca

SEQ ID NO: 496543 - DNA, 25 bp, Mus musculus
gagtgatttacgtcatctcagggca

SEQ ID NO: 496544 - DNA, 25 bp, Mus musculus
gagtgatttactctctggagctagg

SEQ ID NO: 496545 - DNA, 25 bp, Mus musculus
gagtgatttactgtctggagctagg

SEQ ID NO: 496546 - DNA, 25 bp, Mus musculus
gagtgatttattcgtcctacgggac

SEQ ID NO: 496547 - DNA, 25 bp, Mus musculus
gagtgatttattggtcctacgggac

SEQ ID NO: 496548 - DNA, 25 bp, Mus musculus
gagtgatttcatattcccatattaa

SEQ ID NO: 496549 - DNA, 25 bp, Mus musculus
gagtgatttcattttcccatattaa

SEQ ID NO: 496550 - DNA, 25 bp, Mus musculus
gagtgatttctgcacaaacctcaat

SEQ ID NO: 496551 - DNA, 25 bp, Mus musculus
gagtgatttctggacaaacctcaat

SEQ ID NO: 496552 - DNA, 25 bp, Mus musculus
gagtgattttggagcccacgcagtg

SEQ ID NO: 496553 - DNA, 25 bp, Mus musculus
gagtgattttggtgcccacgcagtg

SEQ ID NO: 496554 - DNA, 25 bp, Mus musculus
gagtgcaacaatatggaaatccaag

SEQ ID NO: 496555 - DNA, 25 bp, Mus musculus
gagtgcaacaatttggaaatccaag

SEQ ID NO: 496556 - DNA, 25 bp, Mus musculus
gagtgcaagacaattttaggtgtgg

SEQ ID NO: 496557 - DNA, 25 bp, Mus musculus
gagtgcaagacatttttaggtgtgg

SEQ ID NO: 496558 - DNA, 25 bp, Mus musculus
gagtgcaagcacatggttaagcttt

SEQ ID NO: 496559 - DNA, 25 bp, Mus musculus
gagtgcaagcacttggttaagcttt

SEQ ID NO: 496560 - DNA, 25 bp, Mus musculus
gagtgcaagctgcagagccctctga

SEQ ID NO: 496561 - DNA, 25 bp, Mus musculus
gagtgcaagctggagagccctctga

SEQ ID NO: 496562 - DNA, 25 bp, Mus musculus
gagtgcaaggataaagctcaggctt

SEQ ID NO: 496563 - DNA, 25 bp, Mus musculus
gagtgcaaggattaagctcaggctt

SEQ ID NO: 496564 - DNA, 25 bp, Mus musculus
gagtgcaagtaccagttccaggctt

SEQ ID NO: 496565 - DNA, 25 bp, Mus musculus
gagtgcaagtacgagttccaggctt

SEQ ID NO: 496566 - DNA, 25 bp, Mus musculus
gagtgcaattccattagagaccaga

SEQ ID NO: 496567 - DNA, 25 bp, Mus musculus
gagtgcaattcctttagagaccaga

SEQ ID NO: 496568 - DNA, 25 bp, Mus musculus
gagtgcaattttcccttctaagcag

SEQ ID NO: 496569 - DNA, 25 bp, Mus musculus
gagtgcaattttgccttctaagcag

SEQ ID NO: 496570 - DNA, 25 bp, Mus musculus
gagtgcacaagcatatcttcttttt

SEQ ID NO: 496571 - DNA, 25 bp, Mus musculus
gagtgcacaagcttatcttcttttt

SEQ ID NO: 496572 - DNA, 25 bp, Mus musculus
gagtgcacactaccgagtcttgata

SEQ ID NO: 496573 - DNA, 25 bp, Mus musculus
gagtgcacactagcgagtcttgata

SEQ ID NO: 496574 - DNA, 25 bp, Mus musculus
gagtgcacacttcctttgagatctg

SEQ ID NO: 496575 - DNA, 25 bp, Mus musculus
gagtgcacacttgctttgagatctg

SEQ ID NO: 496576 - DNA, 25 bp, Mus musculus
gagtgcacagcccaggacgcgtaca

SEQ ID NO: 496577 - DNA, 25 bp, Mus musculus
gagtgcacagccgaggacgcgtaca

SEQ ID NO: 496578 - DNA, 25 bp, Mus musculus
gagtgcacagtgagtcccagtccat

SEQ ID NO: 496579 - DNA, 25 bp, Mus musculus
gagtgcacagtgtgtcccagtccat

SEQ ID NO: 496580 - DNA, 25 bp, Mus musculus
gagtgcacatggctgccctaagaac

SEQ ID NO: 496581 - DNA, 25 bp, Mus musculus
gagtgcacatgggtgccctaagaac

SEQ ID NO: 496582 - DNA, 25 bp, Mus musculus
gagtgcaccaatcggctctcaagat

SEQ ID NO: 496583 - DNA, 25 bp, Mus musculus
gagtgcaccaatgggctctcaagat

SEQ ID NO: 496584 - DNA, 25 bp, Mus musculus
gagtgcactaataatgtggcccata

SEQ ID NO: 496585 - DNA, 25 bp, Mus musculus
gagtgcactaattatgtggcccata

SEQ ID NO: 496586 - DNA, 25 bp, Mus musculus
gagtgcactcagacaataagacagt

SEQ ID NO: 496587 - DNA, 25 bp, Mus musculus
gagtgcactcagtcaataagacagt

SEQ ID NO: 496588 - DNA, 25 bp, Mus musculus
gagtgcactggaaggcttatgagcc

SEQ ID NO: 496589 - DNA, 25 bp, Mus musculus
gagtgcactggatggcttatgagcc

SEQ ID NO: 496590 - DNA, 25 bp, Mus musculus
gagtgcactttacagcctgcgtggt

SEQ ID NO: 496591 - DNA, 25 bp, Mus musculus
gagtgcactttagagcctgcgtggt

SEQ ID NO: 496592 - DNA, 25 bp, Mus musculus
gagtgcagaagcctacagcccagtg

SEQ ID NO: 496593 - DNA, 25 bp, Mus musculus
gagtgcagaagcgtacagcccagtg

SEQ ID NO: 496594 - DNA, 25 bp, Mus musculus
gagtgcagacaaccatcaccacgca

SEQ ID NO: 496595 - DNA, 25 bp, Mus musculus
gagtgcagacaagcatcaccacgca

SEQ ID NO: 496596 - DNA, 25 bp, Mus musculus
gagtgcagacagacctctaaaggta

SEQ ID NO: 496597 - DNA, 25 bp, Mus musculus
gagtgcagacagtcctctaaaggta

SEQ ID NO: 496598 - DNA, 25 bp, Mus musculus
gagtgcagacgcagaacacttccac

SEQ ID NO: 496599 - DNA, 25 bp, Mus musculus
gagtgcagacgctgaacacttccac

SEQ ID NO: 496600 - DNA, 25 bp, Mus musculus
gagtgcagactcacaccaattggtg

SEQ ID NO: 496601 - DNA, 25 bp, Mus musculus
gagtgcagactcaggtggcacccaa

SEQ ID NO: 496602 - DNA, 25 bp, Mus musculus
gagtgcagactctcaccaattggtg

SEQ ID NO: 496603 - DNA, 25 bp, Mus musculus
gagtgcagactctggtggcacccaa

SEQ ID NO: 496604 - DNA, 25 bp, Mus musculus
gagtgcagagaacgttcctggtccc

SEQ ID NO: 496605 - DNA, 25 bp, Mus musculus
gagtgcagagaaggttcctggtccc

SEQ ID NO: 496606 - DNA, 25 bp, Mus musculus
gagtgcagcaatacccttttacgga

SEQ ID NO: 496607 - DNA, 25 bp, Mus musculus
gagtgcagcaattcccttttacgga

SEQ ID NO: 496608 - DNA, 25 bp, Mus musculus
gagtgcagcagacacgcaggccatt

SEQ ID NO: 496609 - DNA, 25 bp, Mus musculus
gagtgcagcagagacgcaggccatt

SEQ ID NO: 496610 - DNA, 25 bp, Mus musculus
gagtgcagcatcatacacagtattt

SEQ ID NO: 496611 - DNA, 25 bp, Mus musculus
gagtgcagcatcttacacagtattt

SEQ ID NO: 496612 - DNA, 25 bp, Mus musculus
gagtgcagcccaccaagaatgtcaa

SEQ ID NO: 496613 - DNA, 25 bp, Mus musculus
gagtgcagcccagcaagaatgtcaa

SEQ ID NO: 496614 - DNA, 25 bp, Mus musculus
gagtgcagccctaaagtgtcagcca

SEQ ID NO: 496615 - DNA, 25 bp, Mus musculus
gagtgcagcccttaagtgtcagcca

SEQ ID NO: 496616 - DNA, 25 bp, Mus musculus
gagtgcagctacaaaaatgattgta

SEQ ID NO: 496617 - DNA, 25 bp, Mus musculus
gagtgcagctactaaaatgattgta

SEQ ID NO: 496618 - DNA, 25 bp, Mus musculus
gagtgcagctggcaaccaccaaggc

SEQ ID NO: 496619 - DNA, 25 bp, Mus musculus
gagtgcagctgggaaccaccaaggc

SEQ ID NO: 496620 - DNA, 25 bp, Mus musculus
gagtgcaggcccacttggattgcag

SEQ ID NO: 496621 - DNA, 25 bp, Mus musculus
gagtgcaggccctcttggattgcag

SEQ ID NO: 496622 - DNA, 25 bp, Mus musculus
gagtgcagtctcagtgtgaacccgc

SEQ ID NO: 496623 - DNA, 25 bp, Mus musculus
gagtgcagtctctgtgtgaacccgc

SEQ ID NO: 496624 - DNA, 25 bp, Mus musculus
gagtgcagtgcaagtggtaaagcct

SEQ ID NO: 496625 - DNA, 25 bp, Mus musculus
gagtgcagtgcacagataccctctc

SEQ ID NO: 496626 - DNA, 25 bp, Mus musculus
gagtgcagtgcagagataccctctc

SEQ ID NO: 496627 - DNA, 25 bp, Mus musculus
gagtgcagtgcatgtggtaaagcct

SEQ ID NO: 496628 - DNA, 25 bp, Mus musculus
gagtgcagtgtacaaatctttcatt

SEQ ID NO: 496629 - DNA, 25 bp, Mus musculus
gagtgcagtgtagaaatctttcatt

SEQ ID NO: 496630 - DNA, 25 bp, Mus musculus
gagtgcagttgacgccatcagagtc

SEQ ID NO: 496631 - DNA, 25 bp, Mus musculus
gagtgcagttgaggccatcagagtc

SEQ ID NO: 496632 - DNA, 25 bp, Mus musculus
gagtgcatagccaagctgccactta

SEQ ID NO: 496633 - DNA, 25 bp, Mus musculus
gagtgcatagcctagctgccactta

SEQ ID NO: 496634 - DNA, 25 bp, Mus musculus
gagtgcatatgaccgagagaagcaa

SEQ ID NO: 496635 - DNA, 25 bp, Mus musculus
gagtgcatatgagcgagagaagcaa

SEQ ID NO: 496636 - DNA, 25 bp, Mus musculus
gagtgcatatgtctgactgccccac

SEQ ID NO: 496637 - DNA, 25 bp, Mus musculus
gagtgcatatgtgtgactgccccac

SEQ ID NO: 496638 - DNA, 25 bp, Mus musculus
gagtgcatcagaagtgtttcaattc

SEQ ID NO: 496639 - DNA, 25 bp, Mus musculus
gagtgcatcagatgtgtttcaattc

SEQ ID NO: 496640 - DNA, 25 bp, Mus musculus
gagtgcatcagcagaagactcagtt

SEQ ID NO: 496641 - DNA, 25 bp, Mus musculus
gagtgcatcagctgaagactcagtt

SEQ ID NO: 496642 - DNA, 25 bp, Mus musculus
gagtgcatcccacgagttgtctgac

SEQ ID NO: 496643 - DNA, 25 bp, Mus musculus
gagtgcatcccaggagttgtctgac

SEQ ID NO: 496644 - DNA, 25 bp, Mus musculus
gagtgcatcctcagaaatgacctca

SEQ ID NO: 496645 - DNA, 25 bp, Mus musculus
gagtgcatcctctgaaatgacctca

SEQ ID NO: 496646 - DNA, 25 bp, Mus musculus
gagtgcatcctgctttattttgtgt

SEQ ID NO: 496647 - DNA, 25 bp, Mus musculus
gagtgcatcctggtttattttgtgt

SEQ ID NO: 496648 - DNA, 25 bp, Mus musculus
gagtgcatcgccatgagcaacagca

SEQ ID NO: 496649 - DNA, 25 bp, Mus musculus
gagtgcatcgccttgagcaacagca

SEQ ID NO: 496650 - DNA, 25 bp, Mus musculus
gagtgcatctcaagagcgctctaga

SEQ ID NO: 496651 - DNA, 25 bp, Mus musculus
gagtgcatctcatgagcgctctaga

SEQ ID NO: 496652 - DNA, 25 bp, Mus musculus
gagtgcatctgcatgtacataaatt

SEQ ID NO: 496653 - DNA, 25 bp, Mus musculus
gagtgcatctgcttgtacataaatt

SEQ ID NO: 496654 - DNA, 25 bp, Mus musculus
gagtgcatgatgaggctcctagact

SEQ ID NO: 496655 - DNA, 25 bp, Mus musculus
gagtgcatgatgtggctcctagact

SEQ ID NO: 496656 - DNA, 25 bp, Mus musculus
gagtgcatgcacacaaccttacatg

SEQ ID NO: 496657 - DNA, 25 bp, Mus musculus
gagtgcatgcactcaaccttacatg

SEQ ID NO: 496658 - DNA, 25 bp, Mus musculus
gagtgcatgctgaacacatccatat

SEQ ID NO: 496659 - DNA, 25 bp, Mus musculus
gagtgcatgctgtacacatccatat

SEQ ID NO: 496660 - DNA, 25 bp, Mus musculus
gagtgcatggatcatcttcaccttt

SEQ ID NO: 496661 - DNA, 25 bp, Mus musculus
gagtgcatggatgatcttcaccttt

SEQ ID NO: 496662 - DNA, 25 bp, Mus musculus
gagtgcatggctcccgctgatctat

SEQ ID NO: 496663 - DNA, 25 bp, Mus musculus
gagtgcatggctgccgctgatctat

SEQ ID NO: 496664 - DNA, 25 bp, Mus musculus
gagtgcattcagatctgtatcagaa

SEQ ID NO: 496665 - DNA, 25 bp, Mus musculus
gagtgcattcagttctgtatcagaa

SEQ ID NO: 496666 - DNA, 25 bp, Mus musculus
gagtgcattccaagctctggcagaa

SEQ ID NO: 496667 - DNA, 25 bp, Mus musculus
gagtgcattccatgctctggcagaa

SEQ ID NO: 496668 - DNA, 25 bp, Mus musculus
gagtgcattggtctctccagggact

SEQ ID NO: 496669 - DNA, 25 bp, Mus musculus
gagtgcattggtgtctccagggact

SEQ ID NO: 496670 - DNA, 25 bp, Mus musculus
gagtgcatttatccagcctctgaga

SEQ ID NO: 496671 - DNA, 25 bp, Mus musculus
gagtgcatttatgcagcctctgaga

SEQ ID NO: 496672 - DNA, 25 bp, Mus musculus
gagtgccaagcgaagagtctctgct

SEQ ID NO: 496673 - DNA, 25 bp, Mus musculus
gagtgccaagcgtagagtctctgct

SEQ ID NO: 496674 - DNA, 25 bp, Mus musculus
gagtgccaaggacaaccccaggtat

SEQ ID NO: 496675 - DNA, 25 bp, Mus musculus
gagtgccaaggagaaccccaggtat

SEQ ID NO: 496676 - DNA, 25 bp, Mus musculus
gagtgccaagggatctagggccaaa

SEQ ID NO: 496677 - DNA, 25 bp, Mus musculus
gagtgccaagggttctagggccaaa

SEQ ID NO: 496678 - DNA, 25 bp, Mus musculus
gagtgccaattccatgatgagtcag

SEQ ID NO: 496679 - DNA, 25 bp, Mus musculus
gagtgccaattcgatgatgagtcag

SEQ ID NO: 496680 - DNA, 25 bp, Mus musculus
gagtgccacactagtgagttccagt

SEQ ID NO: 496681 - DNA, 25 bp, Mus musculus
gagtgccacacttgtgagttccagt

SEQ ID NO: 496682 - DNA, 25 bp, Mus musculus
gagtgccaccacctgagtatcaggc

SEQ ID NO: 496683 - DNA, 25 bp, Mus musculus
gagtgccaccacgtgagtatcaggc

SEQ ID NO: 496684 - DNA, 25 bp, Mus musculus
gagtgccacgagagttgaacctcat

SEQ ID NO: 496685 - DNA, 25 bp, Mus musculus
gagtgccacgagtgttgaacctcat

SEQ ID NO: 496686 - DNA, 25 bp, Mus musculus
gagtgccactatcatgtgtatttct

SEQ ID NO: 496687 - DNA, 25 bp, Mus musculus
gagtgccactatgatgtgtatttct

SEQ ID NO: 496688 - DNA, 25 bp, Mus musculus
gagtgccactcaatgggcggagtct

SEQ ID NO: 496689 - DNA, 25 bp, Mus musculus
gagtgccactcattgggcggagtct

SEQ ID NO: 496690 - DNA, 25 bp, Mus musculus
gagtgccactccactgtgttgacag

SEQ ID NO: 496691 - DNA, 25 bp, Mus musculus
gagtgccactcctctgtgttgacag

SEQ ID NO: 496692 - DNA, 25 bp, Mus musculus
gagtgccacttacccagacacagag

SEQ ID NO: 496693 - DNA, 25 bp, Mus musculus
gagtgccacttagccagacacagag

SEQ ID NO: 496694 - DNA, 25 bp, Mus musculus
gagtgccagacaacacagaatgcaa

SEQ ID NO: 496695 - DNA, 25 bp, Mus musculus
gagtgccagacatcacagaatgcaa

SEQ ID NO: 496696 - DNA, 25 bp, Mus musculus
gagtgccagcagctcccagtaggtc

SEQ ID NO: 496697 - DNA, 25 bp, Mus musculus
gagtgccagcagctgatactattcc

SEQ ID NO: 496698 - DNA, 25 bp, Mus musculus
gagtgccagcaggtcccagtaggtc

SEQ ID NO: 496699 - DNA, 25 bp, Mus musculus
gagtgccagcaggtgatactattcc

SEQ ID NO: 496700 - DNA, 25 bp, Mus musculus
gagtgccaggccatgagactacagc

SEQ ID NO: 496701 - DNA, 25 bp, Mus musculus
gagtgccaggccttgagactacagc

SEQ ID NO: 496702 - DNA, 25 bp, Mus musculus
gagtgccagtatctgtatcacaggg

SEQ ID NO: 496703 - DNA, 25 bp, Mus musculus
gagtgccagtatgtgtatcacaggg

SEQ ID NO: 496704 - DNA, 25 bp, Mus musculus
gagtgccatagtaagcttctgttaa

SEQ ID NO: 496705 - DNA, 25 bp, Mus musculus
gagtgccatagttagcttctgttaa

SEQ ID NO: 496706 - DNA, 25 bp, Mus musculus
gagtgccatataagtagtgagacca

SEQ ID NO: 496707 - DNA, 25 bp, Mus musculus
gagtgccatatatgtagtgagacca

SEQ ID NO: 496708 - DNA, 25 bp, Mus musculus
gagtgccatcctacaaaacagttgc

SEQ ID NO: 496709 - DNA, 25 bp, Mus musculus
gagtgccatcctcatcctgctgtga

SEQ ID NO: 496710 - DNA, 25 bp, Mus musculus
gagtgccatcctgatcctgctgtga

SEQ ID NO: 496711 - DNA, 25 bp, Mus musculus
gagtgccatccttcaaaacagttgc

SEQ ID NO: 496712 - DNA, 25 bp, Mus musculus
gagtgccatggacaccctcatcaat

SEQ ID NO: 496713 - DNA, 25 bp, Mus musculus
gagtgccatggagaccctcatcaat

SEQ ID NO: 496714 - DNA, 25 bp, Mus musculus
gagtgccattgtaatttgtctgcct

SEQ ID NO: 496715 - DNA, 25 bp, Mus musculus
gagtgccattgttatttgtctgcct

SEQ ID NO: 496716 - DNA, 25 bp, Mus musculus
gagtgccatttgaaagcttttgtat

SEQ ID NO: 496717 - DNA, 25 bp, Mus musculus
gagtgccatttgtaagcttttgtat

SEQ ID NO: 496718 - DNA, 25 bp, Mus musculus
gagtgccattttctctggatactgt

SEQ ID NO: 496719 - DNA, 25 bp, Mus musculus
gagtgccattttgtctggatactgt

SEQ ID NO: 496720 - DNA, 25 bp, Mus musculus
gagtgcccaatactgtttggctttt

SEQ ID NO: 496721 - DNA, 25 bp, Mus musculus
gagtgcccaatagtgtttggctttt

SEQ ID NO: 496722 - DNA, 25 bp, Mus musculus
gagtgcccactgattaaagccatgc

SEQ ID NO: 496723 - DNA, 25 bp, Mus musculus
gagtgcccactgtttaaagccatgc

SEQ ID NO: 496724 - DNA, 25 bp, Mus musculus
gagtgcccatagattcttttcctaa

SEQ ID NO: 496725 - DNA, 25 bp, Mus musculus
gagtgcccatagtttcttttcctaa

SEQ ID NO: 496726 - DNA, 25 bp, Mus musculus
gagtgccccagactttaactgtgta

SEQ ID NO: 496727 - DNA, 25 bp, Mus musculus
gagtgccccagagtttaactgtgta

SEQ ID NO: 496728 - DNA, 25 bp, Mus musculus
gagtgccctctcacactgtcaaata

SEQ ID NO: 496729 - DNA, 25 bp, Mus musculus
gagtgccctctctcactgtcaaata

SEQ ID NO: 496730 - DNA, 25 bp, Mus musculus
gagtgccctctgaaattctatctta

SEQ ID NO: 496731 - DNA, 25 bp, Mus musculus
gagtgccctctgtaattctatctta

SEQ ID NO: 496732 - DNA, 25 bp, Mus musculus
gagtgccctgataactttacttata

SEQ ID NO: 496733 - DNA, 25 bp, Mus musculus
gagtgccctgattactttacttata

SEQ ID NO: 496734 - DNA, 25 bp, Mus musculus
gagtgccctggaaattgtcctggta

SEQ ID NO: 496735 - DNA, 25 bp, Mus musculus
gagtgccctggatattgtcctggta

SEQ ID NO: 496736 - DNA, 25 bp, Mus musculus
gagtgcctaatcaacaacttgaata

SEQ ID NO: 496737 - DNA, 25 bp, Mus musculus
gagtgcctaatcatgtggttataat

SEQ ID NO: 496738 - DNA, 25 bp, Mus musculus
gagtgcctaatctacaacttgaata

SEQ ID NO: 496739 - DNA, 25 bp, Mus musculus
gagtgcctaatcttgtggttataat

SEQ ID NO: 496740 - DNA, 25 bp, Mus musculus
gagtgcctaggaatacttgaattga

SEQ ID NO: 496741 - DNA, 25 bp, Mus musculus
gagtgcctaggattacttgaattga

SEQ ID NO: 496742 - DNA, 25 bp, Mus musculus
gagtgcctatcaccctgtcagtgac

SEQ ID NO: 496743 - DNA, 25 bp, Mus musculus
gagtgcctatcagcctgtcagtgac

SEQ ID NO: 496744 - DNA, 25 bp, Mus musculus
gagtgcctcctactgtcaagagtac

SEQ ID NO: 496745 - DNA, 25 bp, Mus musculus
gagtgcctcctagtgtcaagagtac

SEQ ID NO: 496746 - DNA, 25 bp, Mus musculus
gagtgcctgaaacaaagacttccaa

SEQ ID NO: 496747 - DNA, 25 bp, Mus musculus
gagtgcctgaaagaaagacttccaa

SEQ ID NO: 496748 - DNA, 25 bp, Mus musculus
gagtgcctgactcgttctggctatc

SEQ ID NO: 496749 - DNA, 25 bp, Mus musculus
gagtgcctgactggttctggctatc

SEQ ID NO: 496750 - DNA, 25 bp, Mus musculus
gagtgcctgaggactggaccaccaa

SEQ ID NO: 496751 - DNA, 25 bp, Mus musculus
gagtgcctgaggtctggaccaccaa

SEQ ID NO: 496752 - DNA, 25 bp, Mus musculus
gagtgcctgataaaagctgctttgg

SEQ ID NO: 496753 - DNA, 25 bp, Mus musculus
gagtgcctgatataagctgctttgg

SEQ ID NO: 496754 - DNA, 25 bp, Mus musculus
gagtgcctgatgacaatgaagcccc

SEQ ID NO: 496755 - DNA, 25 bp, Mus musculus
gagtgcctgatgtcaatgaagcccc

SEQ ID NO: 496756 - DNA, 25 bp, Mus musculus
gagtgcctgattctcattcctgaac

SEQ ID NO: 496757 - DNA, 25 bp, Mus musculus
gagtgcctgattgtcattcctgaac

SEQ ID NO: 496758 - DNA, 25 bp, Mus musculus
gagtgcctgcaaagaagcctgagtt

SEQ ID NO: 496759 - DNA, 25 bp, Mus musculus
gagtgcctgcaatgaagcctgagtt

SEQ ID NO: 496760 - DNA, 25 bp, Mus musculus
gagtgcctgcagaacttgattttaa

SEQ ID NO: 496761 - DNA, 25 bp, Mus musculus
gagtgcctgcagacacctagaaatg

SEQ ID NO: 496762 - DNA, 25 bp, Mus musculus
gagtgcctgcagtacttgattttaa

SEQ ID NO: 496763 - DNA, 25 bp, Mus musculus
gagtgcctgcagtcacctagaaatg

SEQ ID NO: 496764 - DNA, 25 bp, Mus musculus
gagtgcctgctcaagaggagcccta

SEQ ID NO: 496765 - DNA, 25 bp, Mus musculus
gagtgcctgctctagaggagcccta

SEQ ID NO: 496766 - DNA, 25 bp, Mus musculus
gagtgcctggcaaccggcatcgtaa

SEQ ID NO: 496767 - DNA, 25 bp, Mus musculus
gagtgcctggcatccggcatcgtaa

SEQ ID NO: 496768 - DNA, 25 bp, Mus musculus
gagtgcctggcgcttaacagatgtt

SEQ ID NO: 496769 - DNA, 25 bp, Mus musculus
gagtgcctggcggttaacagatgtt

SEQ ID NO: 496770 - DNA, 25 bp, Mus musculus
gagtgcctggctatcatgcagaagc

SEQ ID NO: 496771 - DNA, 25 bp, Mus musculus
gagtgcctggctttcatgcagaagc

SEQ ID NO: 496772 - DNA, 25 bp, Mus musculus
gagtgcctgggtatcttatacccca

SEQ ID NO: 496773 - DNA, 25 bp, Mus musculus
gagtgcctgggtttcttatacccca

SEQ ID NO: 496774 - DNA, 25 bp, Mus musculus
gagtgcctggttattgtggaagtca

SEQ ID NO: 496775 - DNA, 25 bp, Mus musculus
gagtgcctggtttttgtggaagtca

SEQ ID NO: 496776 - DNA, 25 bp, Mus musculus
gagtgcctgtaaagcttaattgcca

SEQ ID NO: 496777 - DNA, 25 bp, Mus musculus
gagtgcctgtaatgcttaattgcca

SEQ ID NO: 496778 - DNA, 25 bp, Mus musculus
gagtgcctgtctcagtttggcctcc

SEQ ID NO: 496779 - DNA, 25 bp, Mus musculus
gagtgcctgtctgagtttggcctcc

SEQ ID NO: 496780 - DNA, 25 bp, Mus musculus
gagtgcctgtggattatgcttgaag

SEQ ID NO: 496781 - DNA, 25 bp, Mus musculus
gagtgcctgtggtttatgcttgaag

SEQ ID NO: 496782 - DNA, 25 bp, Mus musculus
gagtgccttaaaattctcctcacag

SEQ ID NO: 496783 - DNA, 25 bp, Mus musculus
gagtgccttaaatttctcctcacag

SEQ ID NO: 496784 - DNA, 25 bp, Mus musculus
gagtgccttcaaatgatgtgctctg

SEQ ID NO: 496785 - DNA, 25 bp, Mus musculus
gagtgccttcaattgatgtgctctg

SEQ ID NO: 496786 - DNA, 25 bp, Mus musculus
gagtgccttcataaacggagcctgc

SEQ ID NO: 496787 - DNA, 25 bp, Mus musculus
gagtgccttcattaacggagcctgc

SEQ ID NO: 496788 - DNA, 25 bp, Mus musculus
gagtgccttggacatgatgaattta

SEQ ID NO: 496789 - DNA, 25 bp, Mus musculus
gagtgccttggagatgatgaattta

SEQ ID NO: 496790 - DNA, 25 bp, Mus musculus
gagtgccttgttaacagggttgact

SEQ ID NO: 496791 - DNA, 25 bp, Mus musculus
gagtgccttgtttacagggttgact

SEQ ID NO: 496792 - DNA, 25 bp, Mus musculus
gagtgcctttgacctgtaatgacca

SEQ ID NO: 496793 - DNA, 25 bp, Mus musculus
gagtgcctttgagctgtaatgacca

SEQ ID NO: 496794 - DNA, 25 bp, Mus musculus
gagtgccttttaatctcacacaatg

SEQ ID NO: 496795 - DNA, 25 bp, Mus musculus
gagtgccttttattctcacacaatg

SEQ ID NO: 496796 - DNA, 25 bp, Mus musculus
gagtgcgaactgcagaccatgactg

SEQ ID NO: 496797 - DNA, 25 bp, Mus musculus
gagtgcgaactggagaccatgactg

SEQ ID NO: 496798 - DNA, 25 bp, Mus musculus
gagtgcgacatccagaccttcgtgc

SEQ ID NO: 496799 - DNA, 25 bp, Mus musculus
gagtgcgacatcgagaccttcgtgc

SEQ ID NO: 496800 - DNA, 25 bp, Mus musculus
gagtgcgagctaaacagacaaacct

SEQ ID NO: 496801 - DNA, 25 bp, Mus musculus
gagtgcgagctatacagacaaacct

SEQ ID NO: 496802 - DNA, 25 bp, Mus musculus
gagtgcgcaacaccttccagaacct

SEQ ID NO: 496803 - DNA, 25 bp, Mus musculus
gagtgcgcaacagcttccagaacct

SEQ ID NO: 496804 - DNA, 25 bp, Mus musculus
gagtgcgccctgcagatcatcaaag

SEQ ID NO: 496805 - DNA, 25 bp, Mus musculus
gagtgcgccctggagatcatcaaag

SEQ ID NO: 496806 - DNA, 25 bp, Mus musculus
gagtgcgcgttccatctggagaaaa

SEQ ID NO: 496807 - DNA, 25 bp, Mus musculus
gagtgcgcgttcgatctggagaaaa

SEQ ID NO: 496808 - DNA, 25 bp, Mus musculus
gagtgcgctactaaattccagctat

SEQ ID NO: 496809 - DNA, 25 bp, Mus musculus
gagtgcgctacttaattccagctat

SEQ ID NO: 496810 - DNA, 25 bp, Mus musculus
gagtgcgctggcagcttagaaacca

SEQ ID NO: 496811 - DNA, 25 bp, Mus musculus
gagtgcgctggctgcttagaaacca

SEQ ID NO: 496812 - DNA, 25 bp, Mus musculus
gagtgcgctgtaactaatcaattgg

SEQ ID NO: 496813 - DNA, 25 bp, Mus musculus
gagtgcgctgtatctaatcaattgg

SEQ ID NO: 496814 - DNA, 25 bp, Mus musculus
gagtgcggaaccctttatacccatt

SEQ ID NO: 496815 - DNA, 25 bp, Mus musculus
gagtgcggaaccgtttatacccatt

SEQ ID NO: 496816 - DNA, 25 bp, Mus musculus
gagtgcggcaacagcgagtccgaaa

SEQ ID NO: 496817 - DNA, 25 bp, Mus musculus
gagtgcggcaactgcgagtccgaaa

SEQ ID NO: 496818 - DNA, 25 bp, Mus musculus
gagtgcggccaacgattctcccagc

SEQ ID NO: 496819 - DNA, 25 bp, Mus musculus
gagtgcggccaaggattctcccagc

SEQ ID NO: 496820 - DNA, 25 bp, Mus musculus
gagtgcgggaaaagctttacttcta

SEQ ID NO: 496821 - DNA, 25 bp, Mus musculus
gagtgcgggaaatgctttacttcta

SEQ ID NO: 496822 - DNA, 25 bp, Mus musculus
gagtgcgggaagactcccttgaagc

SEQ ID NO: 496823 - DNA, 25 bp, Mus musculus
gagtgcgggaagtctcccttgaagc

SEQ ID NO: 496824 - DNA, 25 bp, Mus musculus
gagtgcggtcaactacaggtccaaa

SEQ ID NO: 496825 - DNA, 25 bp, Mus musculus
gagtgcggtcaagtacaggtccaaa

SEQ ID NO: 496826 - DNA, 25 bp, Mus musculus
gagtgcgtaaacactcgccgtgcgg

SEQ ID NO: 496827 - DNA, 25 bp, Mus musculus
gagtgcgtaaactctcgccgtgcgg

SEQ ID NO: 496828 - DNA, 25 bp, Mus musculus
gagtgcgtgagtctctacatgtaat

SEQ ID NO: 496829 - DNA, 25 bp, Mus musculus
gagtgcgtgagtgtctacatgtaat

SEQ ID NO: 496830 - DNA, 25 bp, Mus musculus
gagtgcgtgcccacgtcagagagca

SEQ ID NO: 496831 - DNA, 25 bp, Mus musculus
gagtgcgtgccctcgtcagagagca

SEQ ID NO: 496832 - DNA, 25 bp, Mus musculus
gagtgcgttggccagactgttttca

SEQ ID NO: 496833 - DNA, 25 bp, Mus musculus
gagtgcgttggcgagactgttttca

SEQ ID NO: 496834 - DNA, 25 bp, Mus musculus
gagtgcgttgtgatgtatcctgaag

SEQ ID NO: 496835 - DNA, 25 bp, Mus musculus
gagtgcgttgtgttgtatcctgaag

SEQ ID NO: 496836 - DNA, 25 bp, Mus musculus
gagtgctaaactctggacttaaaag

SEQ ID NO: 496837 - DNA, 25 bp, Mus musculus
gagtgctaaactgtggacttaaaag

SEQ ID NO: 496838 - DNA, 25 bp, Mus musculus
gagtgctaaagcctggttctgactg

SEQ ID NO: 496839 - DNA, 25 bp, Mus musculus
gagtgctaaagcgtggttctgactg

SEQ ID NO: 496840 - DNA, 25 bp, Mus musculus
gagtgctaaatacctcaagccttga

SEQ ID NO: 496841 - DNA, 25 bp, Mus musculus
gagtgctaaatagctcaagccttga

SEQ ID NO: 496842 - DNA, 25 bp, Mus musculus
gagtgctaaattcgcctgttgagaa

SEQ ID NO: 496843 - DNA, 25 bp, Mus musculus
gagtgctaaattggcctgttgagaa

SEQ ID NO: 496844 - DNA, 25 bp, Mus musculus
gagtgctaactactacttgaaacta

SEQ ID NO: 496845 - DNA, 25 bp, Mus musculus
gagtgctaactagtacttgaaacta

SEQ ID NO: 496846 - DNA, 25 bp, Mus musculus
gagtgctaactcatttcaggagcat

SEQ ID NO: 496847 - DNA, 25 bp, Mus musculus
gagtgctaactcttttcaggagcat

SEQ ID NO: 496848 - DNA, 25 bp, Mus musculus
gagtgctaactgcttgggctctgca

SEQ ID NO: 496849 - DNA, 25 bp, Mus musculus
gagtgctaactggttgggctctgca

SEQ ID NO: 496850 - DNA, 25 bp, Mus musculus
gagtgctaagacataccaagttatt

SEQ ID NO: 496851 - DNA, 25 bp, Mus musculus
gagtgctaagacttaccaagttatt

SEQ ID NO: 496852 - DNA, 25 bp, Mus musculus
gagtgctaatgaccagtgaaacatt

SEQ ID NO: 496853 - DNA, 25 bp, Mus musculus
gagtgctaatgagcagtgaaacatt

SEQ ID NO: 496854 - DNA, 25 bp, Mus musculus
gagtgctacagaaacaataggttca

SEQ ID NO: 496855 - DNA, 25 bp, Mus musculus
gagtgctacagacgagtgaccctta

SEQ ID NO: 496856 - DNA, 25 bp, Mus musculus
gagtgctacagaggagtgaccctta

SEQ ID NO: 496857 - DNA, 25 bp, Mus musculus
gagtgctacagatacaataggttca

SEQ ID NO: 496858 - DNA, 25 bp, Mus musculus
gagtgctacaggctaccaggctctg

SEQ ID NO: 496859 - DNA, 25 bp, Mus musculus
gagtgctacagggtaccaggctctg

SEQ ID NO: 496860 - DNA, 25 bp, Mus musculus
gagtgctacataccaataccttgaa

SEQ ID NO: 496861 - DNA, 25 bp, Mus musculus
gagtgctacatagcaataccttgaa

SEQ ID NO: 496862 - DNA, 25 bp, Mus musculus
gagtgctacatgaatcggagaattc

SEQ ID NO: 496863 - DNA, 25 bp, Mus musculus
gagtgctacatgtatcggagaattc

SEQ ID NO: 496864 - DNA, 25 bp, Mus musculus
gagtgctacattacgtaccgctcat

SEQ ID NO: 496865 - DNA, 25 bp, Mus musculus
gagtgctacatttcgtaccgctcat

SEQ ID NO: 496866 - DNA, 25 bp, Mus musculus
gagtgctactggcttctcttgctgt

SEQ ID NO: 496867 - DNA, 25 bp, Mus musculus
gagtgctactgggttctcttgctgt

SEQ ID NO: 496868 - DNA, 25 bp, Mus musculus
gagtgctacttcctgagtcaaacca

SEQ ID NO: 496869 - DNA, 25 bp, Mus musculus
gagtgctacttcgtgagtcaaacca

SEQ ID NO: 496870 - DNA, 25 bp, Mus musculus
gagtgctagcatcccggtataccaa

SEQ ID NO: 496871 - DNA, 25 bp, Mus musculus
gagtgctagcatgccggtataccaa

SEQ ID NO: 496872 - DNA, 25 bp, Mus musculus
gagtgctagtgaagttagaatcttt

SEQ ID NO: 496873 - DNA, 25 bp, Mus musculus
gagtgctagtgatgttagaatcttt

SEQ ID NO: 496874 - DNA, 25 bp, Mus musculus
gagtgctataacagcctgggagttt

SEQ ID NO: 496875 - DNA, 25 bp, Mus musculus
gagtgctataactgcctgggagttt

SEQ ID NO: 496876 - DNA, 25 bp, Mus musculus
gagtgctatcaaattctgtagactt

SEQ ID NO: 496877 - DNA, 25 bp, Mus musculus
gagtgctatcaatttctgtagactt

SEQ ID NO: 496878 - DNA, 25 bp, Mus musculus
gagtgctatgtgcagctgagctctc

SEQ ID NO: 496879 - DNA, 25 bp, Mus musculus
gagtgctatgtggagctgagctctc

SEQ ID NO: 496880 - DNA, 25 bp, Mus musculus
gagtgctatttaaacatctgtctta

SEQ ID NO: 496881 - DNA, 25 bp, Mus musculus
gagtgctatttatacatctgtctta

SEQ ID NO: 496882 - DNA, 25 bp, Mus musculus
gagtgctcacagctgaatatctatt

SEQ ID NO: 496883 - DNA, 25 bp, Mus musculus
gagtgctcacaggtgaatatctatt

SEQ ID NO: 496884 - DNA, 25 bp, Mus musculus
gagtgctcacatctatatttccctg

SEQ ID NO: 496885 - DNA, 25 bp, Mus musculus
gagtgctcacatgtatatttccctg

SEQ ID NO: 496886 - DNA, 25 bp, Mus musculus
gagtgctcaccgaattccaaagaaa

SEQ ID NO: 496887 - DNA, 25 bp, Mus musculus
gagtgctcaccgtattccaaagaaa

SEQ ID NO: 496888 - DNA, 25 bp, Mus musculus
gagtgctcactcaagataggtaggt

SEQ ID NO: 496889 - DNA, 25 bp, Mus musculus
gagtgctcactctagataggtaggt

SEQ ID NO: 496890 - DNA, 25 bp, Mus musculus
gagtgctcagcaattggctataatt

SEQ ID NO: 496891 - DNA, 25 bp, Mus musculus
gagtgctcagcatttggctataatt

SEQ ID NO: 496892 - DNA, 25 bp, Mus musculus
gagtgctcagctcttcaatttgatt

SEQ ID NO: 496893 - DNA, 25 bp, Mus musculus
gagtgctcagctgttcaatttgatt

SEQ ID NO: 496894 - DNA, 25 bp, Mus musculus
gagtgctcagttcttctttgtggtc

SEQ ID NO: 496895 - DNA, 25 bp, Mus musculus
gagtgctcagttgttctttgtggtc

SEQ ID NO: 496896 - DNA, 25 bp, Mus musculus
gagtgctcattgagtggaagtcctt

SEQ ID NO: 496897 - DNA, 25 bp, Mus musculus
gagtgctcattgtgtggaagtcctt

SEQ ID NO: 496898 - DNA, 25 bp, Mus musculus
gagtgctccaaaagaatcttttcga

SEQ ID NO: 496899 - DNA, 25 bp, Mus musculus
gagtgctccaaatgaatcttttcga

SEQ ID NO: 496900 - DNA, 25 bp, Mus musculus
gagtgctccaccagttttctgggac

SEQ ID NO: 496901 - DNA, 25 bp, Mus musculus
gagtgctccacctgttttctgggac

SEQ ID NO: 496902 - DNA, 25 bp, Mus musculus
gagtgctccactagagggacagaga

SEQ ID NO: 496903 - DNA, 25 bp, Mus musculus
gagtgctccacttgagggacagaga

SEQ ID NO: 496904 - DNA, 25 bp, Mus musculus
gagtgctcgagcatggactctaaaa

SEQ ID NO: 496905 - DNA, 25 bp, Mus musculus
gagtgctcgagcttggactctaaaa

SEQ ID NO: 496906 - DNA, 25 bp, Mus musculus
gagtgctcggaaatgcctcctccca

SEQ ID NO: 496907 - DNA, 25 bp, Mus musculus
gagtgctcggaattgcctcctccca

SEQ ID NO: 496908 - DNA, 25 bp, Mus musculus
gagtgctctcagaatgaccctggac

SEQ ID NO: 496909 - DNA, 25 bp, Mus musculus
gagtgctctcagtatgaccctggac

SEQ ID NO: 496910 - DNA, 25 bp, Mus musculus
gagtgctctcctcaagttgatataa

SEQ ID NO: 496911 - DNA, 25 bp, Mus musculus
gagtgctctcctgaagttgatataa

SEQ ID NO: 496912 - DNA, 25 bp, Mus musculus
gagtgctctctccaggttaaggtga

SEQ ID NO: 496913 - DNA, 25 bp, Mus musculus
gagtgctctctcgaggttaaggtga

SEQ ID NO: 496914 - DNA, 25 bp, Mus musculus
gagtgctctgatagcagactccact

SEQ ID NO: 496915 - DNA, 25 bp, Mus musculus
gagtgctctgattgcagactccact

SEQ ID NO: 496916 - DNA, 25 bp, Mus musculus
gagtgctctgcactgggttcctctt

SEQ ID NO: 496917 - DNA, 25 bp, Mus musculus
gagtgctctgcagtgggttcctctt

SEQ ID NO: 496918 - DNA, 25 bp, Mus musculus
gagtgctcttgcactgaattcgcag

SEQ ID NO: 496919 - DNA, 25 bp, Mus musculus
gagtgctcttgctctgaattcgcag

SEQ ID NO: 496920 - DNA, 25 bp, Mus musculus
gagtgctgaaaactaatcgtagttt

SEQ ID NO: 496921 - DNA, 25 bp, Mus musculus
gagtgctgaaaagtaatcgtagttt

SEQ ID NO: 496922 - DNA, 25 bp, Mus musculus
gagtgctgacgcatgagtttcaccc

SEQ ID NO: 496923 - DNA, 25 bp, Mus musculus
gagtgctgacgccttactggcaatg

SEQ ID NO: 496924 - DNA, 25 bp, Mus musculus
gagtgctgacgcgttactggcaatg

SEQ ID NO: 496925 - DNA, 25 bp, Mus musculus
gagtgctgacgcttgagtttcaccc

SEQ ID NO: 496926 - DNA, 25 bp, Mus musculus
gagtgctgactccttgcttgtttga

SEQ ID NO: 496927 - DNA, 25 bp, Mus musculus
gagtgctgactcgttgcttgtttga

SEQ ID NO: 496928 - DNA, 25 bp, Mus musculus
gagtgctgatacatgtgtgtcctgc

SEQ ID NO: 496929 - DNA, 25 bp, Mus musculus
gagtgctgatacttgtgtgtcctgc

SEQ ID NO: 496930 - DNA, 25 bp, Mus musculus
gagtgctgatctcaatgtggattca

SEQ ID NO: 496931 - DNA, 25 bp, Mus musculus
gagtgctgatctgaatgtggattca

SEQ ID NO: 496932 - DNA, 25 bp, Mus musculus
gagtgctgcccacccatagaagcag

SEQ ID NO: 496933 - DNA, 25 bp, Mus musculus
gagtgctgcccagccatagaagcag

SEQ ID NO: 496934 - DNA, 25 bp, Mus musculus
gagtgctgccgaaactgtaaccaaa

SEQ ID NO: 496935 - DNA, 25 bp, Mus musculus
gagtgctgccgatactgtaaccaaa

SEQ ID NO: 496936 - DNA, 25 bp, Mus musculus
gagtgctgccggcatcgagtccctt

SEQ ID NO: 496937 - DNA, 25 bp, Mus musculus
gagtgctgccgggatcgagtccctt

SEQ ID NO: 496938 - DNA, 25 bp, Mus musculus
gagtgctgcctgattcttctgcaag

SEQ ID NO: 496939 - DNA, 25 bp, Mus musculus
gagtgctgcctgtttcttctgcaag

SEQ ID NO: 496940 - DNA, 25 bp, Mus musculus
gagtgctgctgtcaacccagtagtt

SEQ ID NO: 496941 - DNA, 25 bp, Mus musculus
gagtgctgctgtgaacccagtagtt

SEQ ID NO: 496942 - DNA, 25 bp, Mus musculus
gagtgctgcttgatgtatctgctgc

SEQ ID NO: 496943 - DNA, 25 bp, Mus musculus
gagtgctgcttgttgtatctgctgc

SEQ ID NO: 496944 - DNA, 25 bp, Mus musculus
gagtgctggaatcgctgctcctcct

SEQ ID NO: 496945 - DNA, 25 bp, Mus musculus
gagtgctggaatggctgctcctcct

SEQ ID NO: 496946 - DNA, 25 bp, Mus musculus
gagtgctggagccttttcagtccct

SEQ ID NO: 496947 - DNA, 25 bp, Mus musculus
gagtgctggagcgttttcagtccct

SEQ ID NO: 496948 - DNA, 25 bp, Mus musculus
gagtgctggatgctacagccatctt

SEQ ID NO: 496949 - DNA, 25 bp, Mus musculus
gagtgctggatggtacagccatctt

SEQ ID NO: 496950 - DNA, 25 bp, Mus musculus
gagtgctggcaactgttatcctagt

SEQ ID NO: 496951 - DNA, 25 bp, Mus musculus
gagtgctggcaagtgttatcctagt

SEQ ID NO: 496952 - DNA, 25 bp, Mus musculus
gagtgctggctaacgaccaatggtc

SEQ ID NO: 496953 - DNA, 25 bp, Mus musculus
gagtgctggctatcgaccaatggtc

SEQ ID NO: 496954 - DNA, 25 bp, Mus musculus
gagtgctgggatacactatccttta

SEQ ID NO: 496955 - DNA, 25 bp, Mus musculus
gagtgctgggatccatcctgaattc

SEQ ID NO: 496956 - DNA, 25 bp, Mus musculus
gagtgctgggatgcatcctgaattc

SEQ ID NO: 496957 - DNA, 25 bp, Mus musculus
gagtgctgggattcactatccttta

SEQ ID NO: 496958 - DNA, 25 bp, Mus musculus
gagtgctgggtgactcttcactgaa

SEQ ID NO: 496959 - DNA, 25 bp, Mus musculus
gagtgctgggtgcttctttcacaaa

SEQ ID NO: 496960 - DNA, 25 bp, Mus musculus
gagtgctgggtggttctttcacaaa

SEQ ID NO: 496961 - DNA, 25 bp, Mus musculus
gagtgctgggtgtctcttcactgaa

SEQ ID NO: 496962 - DNA, 25 bp, Mus musculus
gagtgctgtaccagcatccatgtgt

SEQ ID NO: 496963 - DNA, 25 bp, Mus musculus
gagtgctgtacctgcatccatgtgt

SEQ ID NO: 496964 - DNA, 25 bp, Mus musculus
gagtgctgtaggaatgcctgcattt

SEQ ID NO: 496965 - DNA, 25 bp, Mus musculus
gagtgctgtaggtatgcctgcattt

SEQ ID NO: 496966 - DNA, 25 bp, Mus musculus
gagtgctgtctgaaactgttgtgct

SEQ ID NO: 496967 - DNA, 25 bp, Mus musculus
gagtgctgtctgtaactgttgtgct

SEQ ID NO: 496968 - DNA, 25 bp, Mus musculus
gagtgctgtgataataaacggcctg

SEQ ID NO: 496969 - DNA, 25 bp, Mus musculus
gagtgctgtgattataaacggcctg

SEQ ID NO: 496970 - DNA, 25 bp, Mus musculus
gagtgctgtggaagtgcattcccag

SEQ ID NO: 496971 - DNA, 25 bp, Mus musculus
gagtgctgtggatgtgcattcccag

SEQ ID NO: 496972 - DNA, 25 bp, Mus musculus
gagtgctgtgtactcccaaaggaga

SEQ ID NO: 496973 - DNA, 25 bp, Mus musculus
gagtgctgtgtagtcccaaaggaga

SEQ ID NO: 496974 - DNA, 25 bp, Mus musculus
gagtgctgtgtgatccaggtaccca

SEQ ID NO: 496975 - DNA, 25 bp, Mus musculus
gagtgctgtgtgttccaggtaccca

SEQ ID NO: 496976 - DNA, 25 bp, Mus musculus
gagtgctgttcactgtagtcgatct

SEQ ID NO: 496977 - DNA, 25 bp, Mus musculus
gagtgctgttcagtgtagtcgatct

SEQ ID NO: 496978 - DNA, 25 bp, Mus musculus
gagtgctgttccaacccagaaacaa

SEQ ID NO: 496979 - DNA, 25 bp, Mus musculus
gagtgctgttccaggtgcacacagg

SEQ ID NO: 496980 - DNA, 25 bp, Mus musculus
gagtgctgttcctacccagaaacaa

SEQ ID NO: 496981 - DNA, 25 bp, Mus musculus
gagtgctgttcctggtgcacacagg

SEQ ID NO: 496982 - DNA, 25 bp, Mus musculus
gagtgcttaactcgcatgcagaact

SEQ ID NO: 496983 - DNA, 25 bp, Mus musculus
gagtgcttaactggcatgcagaact

SEQ ID NO: 496984 - DNA, 25 bp, Mus musculus
gagtgcttactcaccgcagaagaac

SEQ ID NO: 496985 - DNA, 25 bp, Mus musculus
gagtgcttactctccgcagaagaac

SEQ ID NO: 496986 - DNA, 25 bp, Mus musculus
gagtgcttagcccaagagctcccgc

SEQ ID NO: 496987 - DNA, 25 bp, Mus musculus
gagtgcttagccgaagagctcccgc

SEQ ID NO: 496988 - DNA, 25 bp, Mus musculus
gagtgcttaggccactgtgaccacc

SEQ ID NO: 496989 - DNA, 25 bp, Mus musculus
gagtgcttaggcgactgtgaccacc

SEQ ID NO: 496990 - DNA, 25 bp, Mus musculus
gagtgcttcacacctgtgtcccaca

SEQ ID NO: 496991 - DNA, 25 bp, Mus musculus
gagtgcttcacagctgtgtcccaca

SEQ ID NO: 496992 - DNA, 25 bp, Mus musculus
gagtgcttcagactctctatcctcc

SEQ ID NO: 496993 - DNA, 25 bp, Mus musculus
gagtgcttcagagtctctatcctcc

SEQ ID NO: 496994 - DNA, 25 bp, Mus musculus
gagtgcttccagaaccgcaacagga

SEQ ID NO: 496995 - DNA, 25 bp, Mus musculus
gagtgcttccagtaccgcaacagga

SEQ ID NO: 496996 - DNA, 25 bp, Mus musculus
gagtgcttcctacaggatcctttta

SEQ ID NO: 496997 - DNA, 25 bp, Mus musculus
gagtgcttcctactcttaacatgct

SEQ ID NO: 496998 - DNA, 25 bp, Mus musculus
gagtgcttcctagaggatcctttta

SEQ ID NO: 496999 - DNA, 25 bp, Mus musculus
gagtgcttcctagtcttaacatgct

SEQ ID NO: 497000 - DNA, 25 bp, Mus musculus
gagtgcttcctcaattagttcgtgc

SEQ ID NO: 497001 - DNA, 25 bp, Mus musculus
gagtgcttcctctattagttcgtgc

SEQ ID NO: 497002 - DNA, 25 bp, Mus musculus
gagtgcttcctgaattgtctgtaaa

SEQ ID NO: 497003 - DNA, 25 bp, Mus musculus
gagtgcttcctgtattgtctgtaaa

SEQ ID NO: 497004 - DNA, 25 bp, Mus musculus
gagtgcttcggtataagcccgcagg

SEQ ID NO: 497005 - DNA, 25 bp, Mus musculus
gagtgcttcggtttaagcccgcagg

SEQ ID NO: 497006 - DNA, 25 bp, Mus musculus
gagtgcttctatcacaagagagtca

SEQ ID NO: 497007 - DNA, 25 bp, Mus musculus
gagtgcttctatgacaagagagtca

SEQ ID NO: 497008 - DNA, 25 bp, Mus musculus
gagtgcttctgacaatactcccagt

SEQ ID NO: 497009 - DNA, 25 bp, Mus musculus
gagtgcttctgagaatactcccagt

SEQ ID NO: 497010 - DNA, 25 bp, Mus musculus
gagtgcttgacccaagtcagtcata

SEQ ID NO: 497011 - DNA, 25 bp, Mus musculus
gagtgcttgaccgaagtcagtcata

SEQ ID NO: 497012 - DNA, 25 bp, Mus musculus
gagtgcttgactctatattcagagg

SEQ ID NO: 497013 - DNA, 25 bp, Mus musculus
gagtgcttgactgtatattcagagg

SEQ ID NO: 497014 - DNA, 25 bp, Mus musculus
gagtgcttgattaccagtagtaaat

SEQ ID NO: 497015 - DNA, 25 bp, Mus musculus
gagtgcttgatttccagtagtaaat

SEQ ID NO: 497016 - DNA, 25 bp, Mus musculus
gagtgcttgccaacgttgcttcttg

SEQ ID NO: 497017 - DNA, 25 bp, Mus musculus
gagtgcttgccatcgttgcttcttg

SEQ ID NO: 497018 - DNA, 25 bp, Mus musculus
gagtgcttgctgatctttcaaagga

SEQ ID NO: 497019 - DNA, 25 bp, Mus musculus
gagtgcttgctgctaagtctgttga

SEQ ID NO: 497020 - DNA, 25 bp, Mus musculus
gagtgcttgctgcttgtccttagaa

SEQ ID NO: 497021 - DNA, 25 bp, Mus musculus
gagtgcttgctggtaagtctgttga

SEQ ID NO: 497022 - DNA, 25 bp, Mus musculus
gagtgcttgctggttgtccttagaa

SEQ ID NO: 497023 - DNA, 25 bp, Mus musculus
gagtgcttgctgttctttcaaagga

SEQ ID NO: 497024 - DNA, 25 bp, Mus musculus
gagtgcttgcttacacgtacagggt

SEQ ID NO: 497025 - DNA, 25 bp, Mus musculus
gagtgcttgctttcacgtacagggt

SEQ ID NO: 497026 - DNA, 25 bp, Mus musculus
gagtgcttggagagttcttcctaat

SEQ ID NO: 497027 - DNA, 25 bp, Mus musculus
gagtgcttggagtgttcttcctaat

SEQ ID NO: 497028 - DNA, 25 bp, Mus musculus
gagtgcttgtacagcgtagaccctg

SEQ ID NO: 497029 - DNA, 25 bp, Mus musculus
gagtgcttgtactgcgtagaccctg

SEQ ID NO: 497030 - DNA, 25 bp, Mus musculus
gagtgctttaagctggtctctggca

SEQ ID NO: 497031 - DNA, 25 bp, Mus musculus
gagtgctttaaggtggtctctggca

SEQ ID NO: 497032 - DNA, 25 bp, Mus musculus
gagtgctttaatccatcttatccag

SEQ ID NO: 497033 - DNA, 25 bp, Mus musculus
gagtgctttaatgcatcttatccag

SEQ ID NO: 497034 - DNA, 25 bp, Mus musculus
gagtgctttaccatcgagcaaaaga

SEQ ID NO: 497035 - DNA, 25 bp, Mus musculus
gagtgctttaccttcgagcaaaaga

SEQ ID NO: 497036 - DNA, 25 bp, Mus musculus
gagtgctttataattagattatatt

SEQ ID NO: 497037 - DNA, 25 bp, Mus musculus
gagtgctttatatttagattatatt

SEQ ID NO: 497038 - DNA, 25 bp, Mus musculus
gagtgctttattataggttccagga

SEQ ID NO: 497039 - DNA, 25 bp, Mus musculus
gagtgctttattttaggttccagga

SEQ ID NO: 497040 - DNA, 25 bp, Mus musculus
gagtgctttcatatattctgcatgg

SEQ ID NO: 497041 - DNA, 25 bp, Mus musculus
gagtgctttcatttattctgcatgg

SEQ ID NO: 497042 - DNA, 25 bp, Mus musculus
gagtgctttggaatttaatcccttt

SEQ ID NO: 497043 - DNA, 25 bp, Mus musculus
gagtgctttggattttaatcccttt

SEQ ID NO: 497044 - DNA, 25 bp, Mus musculus
gagtgctttgtcaccatggaaactg

SEQ ID NO: 497045 - DNA, 25 bp, Mus musculus
gagtgctttgtcagaattagtatgt

SEQ ID NO: 497046 - DNA, 25 bp, Mus musculus
gagtgctttgtctccatggaaactg

SEQ ID NO: 497047 - DNA, 25 bp, Mus musculus
gagtgctttgtctgaattagtatgt

SEQ ID NO: 497048 - DNA, 25 bp, Mus musculus
gagtgcttttaacgctatccctgtc

SEQ ID NO: 497049 - DNA, 25 bp, Mus musculus
gagtgcttttaaggctatccctgtc

SEQ ID NO: 497050 - DNA, 25 bp, Mus musculus
gagtgcttttctagttacagttgct

SEQ ID NO: 497051 - DNA, 25 bp, Mus musculus
gagtgcttttcttgttacagttgct

SEQ ID NO: 497052 - DNA, 25 bp, Mus musculus
gagtgcttttgcatcctggaagatc

SEQ ID NO: 497053 - DNA, 25 bp, Mus musculus
gagtgcttttgcttcctggaagatc

SEQ ID NO: 497054 - DNA, 25 bp, Mus musculus
gagtgcttttgtatgggagccacac

SEQ ID NO: 497055 - DNA, 25 bp, Mus musculus
gagtgcttttgtttgggagccacac

SEQ ID NO: 497056 - DNA, 25 bp, Mus musculus
gagtgctttttcatcagaatcctgc

SEQ ID NO: 497057 - DNA, 25 bp, Mus musculus
gagtgctttttcttcagaatcctgc

SEQ ID NO: 497058 - DNA, 25 bp, Mus musculus
gagtgctttttgcagacactgagat

SEQ ID NO: 497059 - DNA, 25 bp, Mus musculus
gagtgctttttggagacactgagat

SEQ ID NO: 497060 - DNA, 25 bp, Mus musculus
gagtggaaaccaagctgaggccaaa

SEQ ID NO: 497061 - DNA, 25 bp, Mus musculus
gagtggaaaccatgctgaggccaaa

SEQ ID NO: 497062 - DNA, 25 bp, Mus musculus
gagtggaaactcacaccggagcctg

SEQ ID NO: 497063 - DNA, 25 bp, Mus musculus
gagtggaaactctcaccggagcctg

SEQ ID NO: 497064 - DNA, 25 bp, Mus musculus
gagtggaaacttcggacatacgcct

SEQ ID NO: 497065 - DNA, 25 bp, Mus musculus
gagtggaaacttgggacatacgcct

SEQ ID NO: 497066 - DNA, 25 bp, Mus musculus
gagtggaaatgaccattacaaaagc

SEQ ID NO: 497067 - DNA, 25 bp, Mus musculus
gagtggaaatgagcattacaaaagc

SEQ ID NO: 497068 - DNA, 25 bp, Mus musculus
gagtggaaatgcaccttaacttggt

SEQ ID NO: 497069 - DNA, 25 bp, Mus musculus
gagtggaaatgctccttaacttggt

SEQ ID NO: 497070 - DNA, 25 bp, Mus musculus
gagtggaaattaatctgggttgaat

SEQ ID NO: 497071 - DNA, 25 bp, Mus musculus
gagtggaaattattctgggttgaat

SEQ ID NO: 497072 - DNA, 25 bp, Mus musculus
gagtggaactccctgaaacatgatt

SEQ ID NO: 497073 - DNA, 25 bp, Mus musculus
gagtggaactccgtgaaacatgatt

SEQ ID NO: 497074 - DNA, 25 bp, Mus musculus
gagtggaactggctcttgagatcaa

SEQ ID NO: 497075 - DNA, 25 bp, Mus musculus
gagtggaactgggtcttgagatcaa

SEQ ID NO: 497076 - DNA, 25 bp, Mus musculus
gagtggaaggccagcatcctattat

SEQ ID NO: 497077 - DNA, 25 bp, Mus musculus
gagtggaaggcctgcatcctattat

SEQ ID NO: 497078 - DNA, 25 bp, Mus musculus
gagtggaagtctcgtccacagctac

SEQ ID NO: 497079 - DNA, 25 bp, Mus musculus
gagtggaagtctggtccacagctac

SEQ ID NO: 497080 - DNA, 25 bp, Mus musculus
gagtggaagttcaatgctagctaca

SEQ ID NO: 497081 - DNA, 25 bp, Mus musculus
gagtggaagttctatgctagctaca

SEQ ID NO: 497082 - DNA, 25 bp, Mus musculus
gagtggaatggtatcccatgtgaca

SEQ ID NO: 497083 - DNA, 25 bp, Mus musculus
gagtggaatggtttcccatgtgaca

SEQ ID NO: 497084 - DNA, 25 bp, Mus musculus
gagtggacaagaccttcctgtcttc

SEQ ID NO: 497085 - DNA, 25 bp, Mus musculus
gagtggacaagagcttcctgtcttc

SEQ ID NO: 497086 - DNA, 25 bp, Mus musculus
gagtggacaataaaaggttctactt

SEQ ID NO: 497087 - DNA, 25 bp, Mus musculus
gagtggacaatataaggttctactt

SEQ ID NO: 497088 - DNA, 25 bp, Mus musculus
gagtggacacagaagcccttgcgct

SEQ ID NO: 497089 - DNA, 25 bp, Mus musculus
gagtggacacagtagcccttgcgct

SEQ ID NO: 497090 - DNA, 25 bp, Mus musculus
gagtggacaccgctatcgtctgtat

SEQ ID NO: 497091 - DNA, 25 bp, Mus musculus
gagtggacaccggtatcgtctgtat

SEQ ID NO: 497092 - DNA, 25 bp, Mus musculus
gagtggacactcacccgtggtcagt

SEQ ID NO: 497093 - DNA, 25 bp, Mus musculus
gagtggacactctcccgtggtcagt

SEQ ID NO: 497094 - DNA, 25 bp, Mus musculus
gagtggacagatccagcactgcctc

SEQ ID NO: 497095 - DNA, 25 bp, Mus musculus
gagtggacagatgcagcactgcctc

SEQ ID NO: 497096 - DNA, 25 bp, Mus musculus
gagtggacatccacaggctgaatcc

SEQ ID NO: 497097 - DNA, 25 bp, Mus musculus
gagtggacatcctcaggctgaatcc

SEQ ID NO: 497098 - DNA, 25 bp, Mus musculus
gagtggaccaacaacgggaaaacag

SEQ ID NO: 497099 - DNA, 25 bp, Mus musculus
gagtggaccaactacgggaaaacag

SEQ ID NO: 497100 - DNA, 25 bp, Mus musculus
gagtggaccacacccaaggactgga

SEQ ID NO: 497101 - DNA, 25 bp, Mus musculus
gagtggaccacagccaaggactgga

SEQ ID NO: 497102 - DNA, 25 bp, Mus musculus
gagtggacccacaacagcatgaagc

SEQ ID NO: 497103 - DNA, 25 bp, Mus musculus
gagtggacccactacagcatgaagc

SEQ ID NO: 497104 - DNA, 25 bp, Mus musculus
gagtggacctccacggcgattttaa

SEQ ID NO: 497105 - DNA, 25 bp, Mus musculus
gagtggacctcctcggcgattttaa

SEQ ID NO: 497106 - DNA, 25 bp, Mus musculus
gagtggactatcaagtgagcctaaa

SEQ ID NO: 497107 - DNA, 25 bp, Mus musculus
gagtggactatctagtgagcctaaa

SEQ ID NO: 497108 - DNA, 25 bp, Mus musculus
gagtggactcctaccctgggttgta

SEQ ID NO: 497109 - DNA, 25 bp, Mus musculus
gagtggactccttccctgggttgta

SEQ ID NO: 497110 - DNA, 25 bp, Mus musculus
gagtggactctcaggctaatatata

SEQ ID NO: 497111 - DNA, 25 bp, Mus musculus
gagtggactctctggctaatatata

SEQ ID NO: 497112 - DNA, 25 bp, Mus musculus
gagtggacttagcttgctgctttgt

SEQ ID NO: 497113 - DNA, 25 bp, Mus musculus
gagtggacttaggttgctgctttgt

SEQ ID NO: 497114 - DNA, 25 bp, Mus musculus
gagtggagacaccagcatccagact

SEQ ID NO: 497115 - DNA, 25 bp, Mus musculus
gagtggagacacgagcatccagact

SEQ ID NO: 497116 - DNA, 25 bp, Mus musculus
gagtggagactaccctctggcatgc

SEQ ID NO: 497117 - DNA, 25 bp, Mus musculus
gagtggagactagcctctggcatgc

SEQ ID NO: 497118 - DNA, 25 bp, Mus musculus
gagtggagagaccagcaacacacat

SEQ ID NO: 497119 - DNA, 25 bp, Mus musculus
gagtggagagacgagcaacacacat

SEQ ID NO: 497120 - DNA, 25 bp, Mus musculus
gagtggagagcaatttcctcccagt

SEQ ID NO: 497121 - DNA, 25 bp, Mus musculus
gagtggagagcattttcctcccagt

SEQ ID NO: 497122 - DNA, 25 bp, Mus musculus
gagtggagagccactctttctgtcc

SEQ ID NO: 497123 - DNA, 25 bp, Mus musculus
gagtggagagcctctctttctgtcc

SEQ ID NO: 497124 - DNA, 25 bp, Mus musculus
gagtggagatgcacaaaccctggcc

SEQ ID NO: 497125 - DNA, 25 bp, Mus musculus
gagtggagatgctcaaaccctggcc

SEQ ID NO: 497126 - DNA, 25 bp, Mus musculus
gagtggagcgtcactactacctgga

SEQ ID NO: 497127 - DNA, 25 bp, Mus musculus
gagtggagcgtctctactacctgga

SEQ ID NO: 497128 - DNA, 25 bp, Mus musculus
gagtggagctgcagcttcacatgct

SEQ ID NO: 497129 - DNA, 25 bp, Mus musculus
gagtggagctgctgcttcacatgct

SEQ ID NO: 497130 - DNA, 25 bp, Mus musculus
gagtggaggttgcttcatttcatct

SEQ ID NO: 497131 - DNA, 25 bp, Mus musculus
gagtggaggttggttcatttcatct

SEQ ID NO: 497132 - DNA, 25 bp, Mus musculus
gagtggagtccaactacctgaatgt

SEQ ID NO: 497133 - DNA, 25 bp, Mus musculus
gagtggagtccatctacctgaatgt

SEQ ID NO: 497134 - DNA, 25 bp, Mus musculus
gagtggagtggcctttcccaaacct

SEQ ID NO: 497135 - DNA, 25 bp, Mus musculus
gagtggagtggcgtttcccaaacct

SEQ ID NO: 497136 - DNA, 25 bp, Mus musculus
gagtggatacacatttgagctattc

SEQ ID NO: 497137 - DNA, 25 bp, Mus musculus
gagtggatacacttttgagctattc

SEQ ID NO: 497138 - DNA, 25 bp, Mus musculus
gagtggatccacacaacaccagaat

SEQ ID NO: 497139 - DNA, 25 bp, Mus musculus
gagtggatccactcaacaccagaat

SEQ ID NO: 497140 - DNA, 25 bp, Mus musculus
gagtggatccagatgctgcagcctg

SEQ ID NO: 497141 - DNA, 25 bp, Mus musculus
gagtggatccagttgctgcagcctg

SEQ ID NO: 497142 - DNA, 25 bp, Mus musculus
gagtggatcctaagcagattctggg

SEQ ID NO: 497143 - DNA, 25 bp, Mus musculus
gagtggatcctatgcagattctggg

SEQ ID NO: 497144 - DNA, 25 bp, Mus musculus
gagtggatctcacggcccaatgtgc

SEQ ID NO: 497145 - DNA, 25 bp, Mus musculus
gagtggatctcagggcccaatgtgc

SEQ ID NO: 497146 - DNA, 25 bp, Mus musculus
gagtggatgaccacagcagcatcct

SEQ ID NO: 497147 - DNA, 25 bp, Mus musculus
gagtggatgacctcagcagcatcct

SEQ ID NO: 497148 - DNA, 25 bp, Mus musculus
gagtggatgatgatccctctcaagg

SEQ ID NO: 497149 - DNA, 25 bp, Mus musculus
gagtggatgatgttccctctcaagg

SEQ ID NO: 497150 - DNA, 25 bp, Mus musculus
gagtggatggcgataatcttcgaga

SEQ ID NO: 497151 - DNA, 25 bp, Mus musculus
gagtggatggcgttaatcttcgaga

SEQ ID NO: 497152 - DNA, 25 bp, Mus musculus
gagtggatgtgcacccactttgaag

SEQ ID NO: 497153 - DNA, 25 bp, Mus musculus
gagtggatgtgctcccactttgaag

SEQ ID NO: 497154 - DNA, 25 bp, Mus musculus
gagtggattagcacggatctttgaa

SEQ ID NO: 497155 - DNA, 25 bp, Mus musculus
gagtggattagctcggatctttgaa

SEQ ID NO: 497156 - DNA, 25 bp, Mus musculus
gagtggattattcgtgctgtctcct

SEQ ID NO: 497157 - DNA, 25 bp, Mus musculus
gagtggattattggtgctgtctcct

SEQ ID NO: 497158 - DNA, 25 bp, Mus musculus
gagtggattcaccagctaccatgca

SEQ ID NO: 497159 - DNA, 25 bp, Mus musculus
gagtggattcacgagctaccatgca

SEQ ID NO: 497160 - DNA, 25 bp, Mus musculus
gagtggattgttagattgatgttta

SEQ ID NO: 497161 - DNA, 25 bp, Mus musculus
gagtggattgtttgattgatgttta

SEQ ID NO: 497162 - DNA, 25 bp, Mus musculus
gagtggatttagacacagcgcacgt

SEQ ID NO: 497163 - DNA, 25 bp, Mus musculus
gagtggatttagtcacagcgcacgt

SEQ ID NO: 497164 - DNA, 25 bp, Mus musculus
gagtggcaaagcagcgttggcacct

SEQ ID NO: 497165 - DNA, 25 bp, Mus musculus
gagtggcaaagctgcgttggcacct

SEQ ID NO: 497166 - DNA, 25 bp, Mus musculus
gagtggcaagcaacaaatcagattt

SEQ ID NO: 497167 - DNA, 25 bp, Mus musculus
gagtggcaagcatcaaatcagattt

SEQ ID NO: 497168 - DNA, 25 bp, Mus musculus
gagtggcaagtcacattgattatcc

SEQ ID NO: 497169 - DNA, 25 bp, Mus musculus
gagtggcaagtctcattgattatcc

SEQ ID NO: 497170 - DNA, 25 bp, Mus musculus
gagtggcacaagacgaccaaaatga

SEQ ID NO: 497171 - DNA, 25 bp, Mus musculus
gagtggcacaagtcgaccaaaatga

SEQ ID NO: 497172 - DNA, 25 bp, Mus musculus
gagtggcacactattggcagacagt

SEQ ID NO: 497173 - DNA, 25 bp, Mus musculus
gagtggcacacttttggcagacagt

SEQ ID NO: 497174 - DNA, 25 bp, Mus musculus
gagtggcaccagctattctgatatc

SEQ ID NO: 497175 - DNA, 25 bp, Mus musculus
gagtggcaccaggtattctgatatc

SEQ ID NO: 497176 - DNA, 25 bp, Mus musculus
gagtggcactgcagtgattcacatc

SEQ ID NO: 497177 - DNA, 25 bp, Mus musculus
gagtggcactgctgtgattcacatc

SEQ ID NO: 497178 - DNA, 25 bp, Mus musculus
gagtggcactgtccatactgatggc

SEQ ID NO: 497179 - DNA, 25 bp, Mus musculus
gagtggcactgtgcatactgatggc

SEQ ID NO: 497180 - DNA, 25 bp, Mus musculus
gagtggcagaccagtaaacactact

SEQ ID NO: 497181 - DNA, 25 bp, Mus musculus
gagtggcagacctgtaaacactact

SEQ ID NO: 497182 - DNA, 25 bp, Mus musculus
gagtggcagatccttcttcagatac

SEQ ID NO: 497183 - DNA, 25 bp, Mus musculus
gagtggcagatcgttcttcagatac

SEQ ID NO: 497184 - DNA, 25 bp, Mus musculus
gagtggcagcctcgagttcagcatt

SEQ ID NO: 497185 - DNA, 25 bp, Mus musculus
gagtggcagcctggagttcagcatt

SEQ ID NO: 497186 - DNA, 25 bp, Mus musculus
gagtggcagctaataattttacagg

SEQ ID NO: 497187 - DNA, 25 bp, Mus musculus
gagtggcagctattaattttacagg

SEQ ID NO: 497188 - DNA, 25 bp, Mus musculus
gagtggcagcttagacagtctgtga

SEQ ID NO: 497189 - DNA, 25 bp, Mus musculus
gagtggcagcttctagatggcttta

SEQ ID NO: 497190 - DNA, 25 bp, Mus musculus
gagtggcagcttctcttattataac

SEQ ID NO: 497191 - DNA, 25 bp, Mus musculus
gagtggcagcttgtagatggcttta

SEQ ID NO: 497192 - DNA, 25 bp, Mus musculus
gagtggcagcttgtcttattataac

SEQ ID NO: 497193 - DNA, 25 bp, Mus musculus
gagtggcagctttgacagtctgtga

SEQ ID NO: 497194 - DNA, 25 bp, Mus musculus
gagtggcaggacacctgttctaacc

SEQ ID NO: 497195 - DNA, 25 bp, Mus musculus
gagtggcaggactcctgttctaacc

SEQ ID NO: 497196 - DNA, 25 bp, Mus musculus
gagtggcaggccaaggcccctccga

SEQ ID NO: 497197 - DNA, 25 bp, Mus musculus
gagtggcaggcctaggcccctccga

SEQ ID NO: 497198 - DNA, 25 bp, Mus musculus
gagtggcagtccatctcagagatcg

SEQ ID NO: 497199 - DNA, 25 bp, Mus musculus
gagtggcagtccttctcagagatcg

SEQ ID NO: 497200 - DNA, 25 bp, Mus musculus
gagtggcatgatacagactggatac

SEQ ID NO: 497201 - DNA, 25 bp, Mus musculus
gagtggcatgattcagactggatac

SEQ ID NO: 497202 - DNA, 25 bp, Mus musculus
gagtggcatgtcatcattattctgt

SEQ ID NO: 497203 - DNA, 25 bp, Mus musculus
gagtggcatgtcttcattattctgt

SEQ ID NO: 497204 - DNA, 25 bp, Mus musculus
gagtggcatttaatcagtgtattgc

SEQ ID NO: 497205 - DNA, 25 bp, Mus musculus
gagtggcatttattcagtgtattgc

SEQ ID NO: 497206 - DNA, 25 bp, Mus musculus
gagtggccaacgcagtgctagccct

SEQ ID NO: 497207 - DNA, 25 bp, Mus musculus
gagtggccaacggagtgctagccct

SEQ ID NO: 497208 - DNA, 25 bp, Mus musculus
gagtggccaagtcatctcccattgg

SEQ ID NO: 497209 - DNA, 25 bp, Mus musculus
gagtggccaagtgatctcccattgg

SEQ ID NO: 497210 - DNA, 25 bp, Mus musculus
gagtggccacagcacatggtgccaa

SEQ ID NO: 497211 - DNA, 25 bp, Mus musculus
gagtggccacaggacatggtgccaa

SEQ ID NO: 497212 - DNA, 25 bp, Mus musculus
gagtggccacgcagctagacagtat

SEQ ID NO: 497213 - DNA, 25 bp, Mus musculus
gagtggccacgctgctagacagtat

SEQ ID NO: 497214 - DNA, 25 bp, Mus musculus
gagtggccactcatccaattgtaat

SEQ ID NO: 497215 - DNA, 25 bp, Mus musculus
gagtggccactcttccaattgtaat

SEQ ID NO: 497216 - DNA, 25 bp, Mus musculus
gagtggccagaaaaactctgtgttt

SEQ ID NO: 497217 - DNA, 25 bp, Mus musculus
gagtggccagaataactctgtgttt

SEQ ID NO: 497218 - DNA, 25 bp, Mus musculus
gagtggccagcaaacatacaagaag

SEQ ID NO: 497219 - DNA, 25 bp, Mus musculus
gagtggccagcatacatacaagaag

SEQ ID NO: 497220 - DNA, 25 bp, Mus musculus
gagtggccagctagtacaatgcctt

SEQ ID NO: 497221 - DNA, 25 bp, Mus musculus
gagtggccagcttgtacaatgcctt

SEQ ID NO: 497222 - DNA, 25 bp, Mus musculus
gagtggccattacaacgttcaggaa

SEQ ID NO: 497223 - DNA, 25 bp, Mus musculus
gagtggccattagaacgttcaggaa

SEQ ID NO: 497224 - DNA, 25 bp, Mus musculus
gagtggccatttagaccagctacat

SEQ ID NO: 497225 - DNA, 25 bp, Mus musculus
gagtggccattttgaccagctacat

SEQ ID NO: 497226 - DNA, 25 bp, Mus musculus
gagtggcccagtaagccctgttaga

SEQ ID NO: 497227 - DNA, 25 bp, Mus musculus
gagtggcccagttagccctgttaga

SEQ ID NO: 497228 - DNA, 25 bp, Mus musculus
gagtggccccacagcgcaaggactg

SEQ ID NO: 497229 - DNA, 25 bp, Mus musculus
gagtggccccactgcgcaaggactg

SEQ ID NO: 497230 - DNA, 25 bp, Mus musculus
gagtggccccatattggcactacgt

SEQ ID NO: 497231 - DNA, 25 bp, Mus musculus
gagtggccccattttggcactacgt

SEQ ID NO: 497232 - DNA, 25 bp, Mus musculus
gagtggccctcaatagacaagcctt

SEQ ID NO: 497233 - DNA, 25 bp, Mus musculus
gagtggccctcattagacaagcctt

SEQ ID NO: 497234 - DNA, 25 bp, Mus musculus
gagtggccctgaaccaggattccga

SEQ ID NO: 497235 - DNA, 25 bp, Mus musculus
gagtggccctgatccaggattccga

SEQ ID NO: 497236 - DNA, 25 bp, Mus musculus
gagtggccctgcctgacacagaatt

SEQ ID NO: 497237 - DNA, 25 bp, Mus musculus
gagtggccctgcgtgacacagaatt

SEQ ID NO: 497238 - DNA, 25 bp, Mus musculus
gagtggccggacacccagctaaggt

SEQ ID NO: 497239 - DNA, 25 bp, Mus musculus
gagtggccggactcccagctaaggt

SEQ ID NO: 497240 - DNA, 25 bp, Mus musculus
gagtggcctaagcatgcagggcaga

SEQ ID NO: 497241 - DNA, 25 bp, Mus musculus
gagtggcctaagctcaattcaggat

SEQ ID NO: 497242 - DNA, 25 bp, Mus musculus
gagtggcctaaggatgcagggcaga

SEQ ID NO: 497243 - DNA, 25 bp, Mus musculus
gagtggcctaaggtcaattcaggat

SEQ ID NO: 497244 - DNA, 25 bp, Mus musculus
gagtggcctagcatcttaattaaaa

SEQ ID NO: 497245 - DNA, 25 bp, Mus musculus
gagtggcctagcttcttaattaaaa

SEQ ID NO: 497246 - DNA, 25 bp, Mus musculus
gagtggcctatgctgtcacatcaaa

SEQ ID NO: 497247 - DNA, 25 bp, Mus musculus
gagtggcctatggtgtcacatcaaa

SEQ ID NO: 497248 - DNA, 25 bp, Mus musculus
gagtggcctctacggagatcttcct

SEQ ID NO: 497249 - DNA, 25 bp, Mus musculus
gagtggcctctagggagatcttcct

SEQ ID NO: 497250 - DNA, 25 bp, Mus musculus
gagtggcctctgaacctctgcccag

SEQ ID NO: 497251 - DNA, 25 bp, Mus musculus
gagtggcctctgtacctctgcccag

SEQ ID NO: 497252 - DNA, 25 bp, Mus musculus
gagtggcctggcacatcaatgacat

SEQ ID NO: 497253 - DNA, 25 bp, Mus musculus
gagtggcctggctcatcaatgacat

SEQ ID NO: 497254 - DNA, 25 bp, Mus musculus
gagtggccttcaccttgctggagaa

SEQ ID NO: 497255 - DNA, 25 bp, Mus musculus
gagtggccttcagcttgctggagaa

SEQ ID NO: 497256 - DNA, 25 bp, Mus musculus
gagtggcctttaaccctgagcagag

SEQ ID NO: 497257 - DNA, 25 bp, Mus musculus
gagtggcctttatccctgagcagag

SEQ ID NO: 497258 - DNA, 25 bp, Mus musculus
gagtggcgatgacacacgttttgta

SEQ ID NO: 497259 - DNA, 25 bp, Mus musculus
gagtggcgatgagacacgttttgta

SEQ ID NO: 497260 - DNA, 25 bp, Mus musculus
gagtggcgatgcactgttacatctt

SEQ ID NO: 497261 - DNA, 25 bp, Mus musculus
gagtggcgatgctctgttacatctt

SEQ ID NO: 497262 - DNA, 25 bp, Mus musculus
gagtggcgggcaacttctttaccca

SEQ ID NO: 497263 - DNA, 25 bp, Mus musculus
gagtggcgggcatcttctttaccca

SEQ ID NO: 497264 - DNA, 25 bp, Mus musculus
gagtggcgtgatacgaccagagaaa

SEQ ID NO: 497265 - DNA, 25 bp, Mus musculus
gagtggcgtgattcgaccagagaaa

SEQ ID NO: 497266 - DNA, 25 bp, Mus musculus
gagtggctaaatatagtccccaata

SEQ ID NO: 497267 - DNA, 25 bp, Mus musculus
gagtggctaaatttagtccccaata

SEQ ID NO: 497268 - DNA, 25 bp, Mus musculus
gagtggctaagcatagtacgcactt

SEQ ID NO: 497269 - DNA, 25 bp, Mus musculus
gagtggctaagcttagtacgcactt

SEQ ID NO: 497270 - DNA, 25 bp, Mus musculus
gagtggctaattagagagggacccc

SEQ ID NO: 497271 - DNA, 25 bp, Mus musculus
gagtggctaatttgagagggacccc

SEQ ID NO: 497272 - DNA, 25 bp, Mus musculus
gagtggctacatccacagcctcttt

SEQ ID NO: 497273 - DNA, 25 bp, Mus musculus
gagtggctacatgcacagcctcttt

SEQ ID NO: 497274 - DNA, 25 bp, Mus musculus
gagtggctatcactattatcaattt

SEQ ID NO: 497275 - DNA, 25 bp, Mus musculus
gagtggctatcagtattatcaattt

SEQ ID NO: 497276 - DNA, 25 bp, Mus musculus
gagtggctatgtacatcagtgttca

SEQ ID NO: 497277 - DNA, 25 bp, Mus musculus
gagtggctatgttcatcagtgttca

SEQ ID NO: 497278 - DNA, 25 bp, Mus musculus
gagtggctcctacacagactggaga

SEQ ID NO: 497279 - DNA, 25 bp, Mus musculus
gagtggctcctagacagactggaga

SEQ ID NO: 497280 - DNA, 25 bp, Mus musculus
gagtggctcctcagtgaacctttac

SEQ ID NO: 497281 - DNA, 25 bp, Mus musculus
gagtggctcctctgtgaacctttac

SEQ ID NO: 497282 - DNA, 25 bp, Mus musculus
gagtggctctagcactccctaccag

SEQ ID NO: 497283 - DNA, 25 bp, Mus musculus
gagtggctctaggactccctaccag

SEQ ID NO: 497284 - DNA, 25 bp, Mus musculus
gagtggctggaactgattgtttcta

SEQ ID NO: 497285 - DNA, 25 bp, Mus musculus
gagtggctggaagtgattgtttcta

SEQ ID NO: 497286 - DNA, 25 bp, Mus musculus
gagtggctggaccagacctgaacac

SEQ ID NO: 497287 - DNA, 25 bp, Mus musculus
gagtggctggacgagacctgaacac

SEQ ID NO: 497288 - DNA, 25 bp, Mus musculus
gagtggctggcgatatcattactaa

SEQ ID NO: 497289 - DNA, 25 bp, Mus musculus
gagtggctggcgttatcattactaa

SEQ ID NO: 497290 - DNA, 25 bp, Mus musculus
gagtggctgtgcatgttcacaaagt

SEQ ID NO: 497291 - DNA, 25 bp, Mus musculus
gagtggctgtgcttgttcacaaagt

SEQ ID NO: 497292 - DNA, 25 bp, Mus musculus
gagtggcttatgaaccagttccaaa

SEQ ID NO: 497293 - DNA, 25 bp, Mus musculus
gagtggcttatgtaccagttccaaa

SEQ ID NO: 497294 - DNA, 25 bp, Mus musculus
gagtggcttccgagaatccaacagt

SEQ ID NO: 497295 - DNA, 25 bp, Mus musculus
gagtggcttccgtgaatccaacagt

SEQ ID NO: 497296 - DNA, 25 bp, Mus musculus
gagtggcttctcagggatgaatccc

SEQ ID NO: 497297 - DNA, 25 bp, Mus musculus
gagtggcttctctgggatgaatccc

SEQ ID NO: 497298 - DNA, 25 bp, Mus musculus
gagtggcttctgcacatgtcttaaa

SEQ ID NO: 497299 - DNA, 25 bp, Mus musculus
gagtggcttctggacatgtcttaaa

SEQ ID NO: 497300 - DNA, 25 bp, Mus musculus
gagtgggaaactctgagatctaaca

SEQ ID NO: 497301 - DNA, 25 bp, Mus musculus
gagtgggaaactgtgagatctaaca

SEQ ID NO: 497302 - DNA, 25 bp, Mus musculus
gagtgggaactgagcaagaccctcc

SEQ ID NO: 497303 - DNA, 25 bp, Mus musculus
gagtgggaactgagcttcttactta

SEQ ID NO: 497304 - DNA, 25 bp, Mus musculus
gagtgggaactgatcttgctataaa

SEQ ID NO: 497305 - DNA, 25 bp, Mus musculus
gagtgggaactgtgcaagaccctcc

SEQ ID NO: 497306 - DNA, 25 bp, Mus musculus
gagtgggaactgtgcttcttactta

SEQ ID NO: 497307 - DNA, 25 bp, Mus musculus
gagtgggaactgttcttgctataaa

SEQ ID NO: 497308 - DNA, 25 bp, Mus musculus
gagtgggaagacctccccagtcact

SEQ ID NO: 497309 - DNA, 25 bp, Mus musculus
gagtgggaagacgtccccagtcact

SEQ ID NO: 497310 - DNA, 25 bp, Mus musculus
gagtgggaagtaactaagtcaattt

SEQ ID NO: 497311 - DNA, 25 bp, Mus musculus
gagtgggaagtatctaagtcaattt

SEQ ID NO: 497312 - DNA, 25 bp, Mus musculus
gagtgggaatataggttctagcacc

SEQ ID NO: 497313 - DNA, 25 bp, Mus musculus
gagtgggaatattggttctagcacc

SEQ ID NO: 497314 - DNA, 25 bp, Mus musculus
gagtgggaatcccttcatatttgcc

SEQ ID NO: 497315 - DNA, 25 bp, Mus musculus
gagtgggaatccgttcatatttgcc

SEQ ID NO: 497316 - DNA, 25 bp, Mus musculus
gagtgggaccaaaacctattgtcta

SEQ ID NO: 497317 - DNA, 25 bp, Mus musculus
gagtgggaccaatacctattgtcta

SEQ ID NO: 497318 - DNA, 25 bp, Mus musculus
gagtgggaccgcatgatttcagaca

SEQ ID NO: 497319 - DNA, 25 bp, Mus musculus
gagtgggaccgcttgatttcagaca

SEQ ID NO: 497320 - DNA, 25 bp, Mus musculus
gagtgggactctagcccttcccaaa

SEQ ID NO: 497321 - DNA, 25 bp, Mus musculus
gagtgggactcttgcccttcccaaa

SEQ ID NO: 497322 - DNA, 25 bp, Mus musculus
gagtgggacttcactacccagttaa

SEQ ID NO: 497323 - DNA, 25 bp, Mus musculus
gagtgggacttctctacccagttaa

SEQ ID NO: 497324 - DNA, 25 bp, Mus musculus
gagtgggagagcatccattgtccaa

SEQ ID NO: 497325 - DNA, 25 bp, Mus musculus
gagtgggagagcttccattgtccaa

SEQ ID NO: 497326 - DNA, 25 bp, Mus musculus
gagtgggagccgatgccagcactaa

SEQ ID NO: 497327 - DNA, 25 bp, Mus musculus
gagtgggagccgttgccagcactaa

SEQ ID NO: 497328 - DNA, 25 bp, Mus musculus
gagtgggatctcagggacctatacc

SEQ ID NO: 497329 - DNA, 25 bp, Mus musculus
gagtgggatctctgggacctatacc

SEQ ID NO: 497330 - DNA, 25 bp, Mus musculus
gagtgggatggcacattgcagcctc

SEQ ID NO: 497331 - DNA, 25 bp, Mus musculus
gagtgggatggctcattgcagcctc

SEQ ID NO: 497332 - DNA, 25 bp, Mus musculus
gagtgggatgtaagttcaagctata

SEQ ID NO: 497333 - DNA, 25 bp, Mus musculus
gagtgggatgtatgttcaagctata

SEQ ID NO: 497334 - DNA, 25 bp, Mus musculus
gagtgggattccaccataacccgag

SEQ ID NO: 497335 - DNA, 25 bp, Mus musculus
gagtgggattcctccataacccgag

SEQ ID NO: 497336 - DNA, 25 bp, Mus musculus
gagtgggcaagtctgtatagacatc

SEQ ID NO: 497337 - DNA, 25 bp, Mus musculus
gagtgggcaagtgtgtatagacatc

SEQ ID NO: 497338 - DNA, 25 bp, Mus musculus
gagtgggcacatacatgtcagcagt

SEQ ID NO: 497339 - DNA, 25 bp, Mus musculus
gagtgggcacattcatgtcagcagt

SEQ ID NO: 497340 - DNA, 25 bp, Mus musculus
gagtgggcactgctccttcatagga

SEQ ID NO: 497341 - DNA, 25 bp, Mus musculus
gagtgggcactggtccttcatagga

SEQ ID NO: 497342 - DNA, 25 bp, Mus musculus
gagtgggcaggcaaacatcctctgt

SEQ ID NO: 497343 - DNA, 25 bp, Mus musculus
gagtgggcaggctaacatcctctgt

SEQ ID NO: 497344 - DNA, 25 bp, Mus musculus
gagtgggcagtcagaaccatacagc

SEQ ID NO: 497345 - DNA, 25 bp, Mus musculus
gagtgggcagtctgaaccatacagc

SEQ ID NO: 497346 - DNA, 25 bp, Mus musculus
gagtgggcatggaaccatacatcat

SEQ ID NO: 497347 - DNA, 25 bp, Mus musculus
gagtgggcatggtaccatacatcat

SEQ ID NO: 497348 - DNA, 25 bp, Mus musculus
gagtgggccaggagcgctttaccct

SEQ ID NO: 497349 - DNA, 25 bp, Mus musculus
gagtgggccaggtgcgctttaccct

SEQ ID NO: 497350 - DNA, 25 bp, Mus musculus
gagtgggccataatctcaatgctcc

SEQ ID NO: 497351 - DNA, 25 bp, Mus musculus
gagtgggccatattctcaatgctcc

SEQ ID NO: 497352 - DNA, 25 bp, Mus musculus
gagtgggcctttaaggatttgcgtt

SEQ ID NO: 497353 - DNA, 25 bp, Mus musculus
gagtgggccttttaggatttgcgtt

SEQ ID NO: 497354 - DNA, 25 bp, Mus musculus
gagtgggctaccacccagaagtggt

SEQ ID NO: 497355 - DNA, 25 bp, Mus musculus
gagtgggctacctcccagaagtggt

SEQ ID NO: 497356 - DNA, 25 bp, Mus musculus
gagtgggctggacctgatatcatca

SEQ ID NO: 497357 - DNA, 25 bp, Mus musculus
gagtgggctggagctgatatcatca

SEQ ID NO: 497358 - DNA, 25 bp, Mus musculus
gagtgggctgtgcatattatcccta

SEQ ID NO: 497359 - DNA, 25 bp, Mus musculus
gagtgggctgtggatattatcccta

SEQ ID NO: 497360 - DNA, 25 bp, Mus musculus
gagtgggcttatacatccagtgaag

SEQ ID NO: 497361 - DNA, 25 bp, Mus musculus
gagtgggcttattcatccagtgaag

SEQ ID NO: 497362 - DNA, 25 bp, Mus musculus
gagtgggcttcaagaatgcgctctt

SEQ ID NO: 497363 - DNA, 25 bp, Mus musculus
gagtgggcttcatgaatgcgctctt

SEQ ID NO: 497364 - DNA, 25 bp, Mus musculus
gagtgggctttacacaccagacaca

SEQ ID NO: 497365 - DNA, 25 bp, Mus musculus
gagtgggctttagacaccagacaca

SEQ ID NO: 497366 - DNA, 25 bp, Mus musculus
gagtgggctttcattgtgaattatc

SEQ ID NO: 497367 - DNA, 25 bp, Mus musculus
gagtgggctttctttgtgaattatc

SEQ ID NO: 497368 - DNA, 25 bp, Mus musculus
gagtggggcattaccagcagagttc

SEQ ID NO: 497369 - DNA, 25 bp, Mus musculus
gagtggggcatttccagcagagttc

SEQ ID NO: 497370 - DNA, 25 bp, Mus musculus
gagtgggtaccgatgcagtcattta

SEQ ID NO: 497371 - DNA, 25 bp, Mus musculus
gagtgggtaccgttgcagtcattta

SEQ ID NO: 497372 - DNA, 25 bp, Mus musculus
gagtgggtactgaaatctctactat

SEQ ID NO: 497373 - DNA, 25 bp, Mus musculus
gagtgggtactgtaatctctactat

SEQ ID NO: 497374 - DNA, 25 bp, Mus musculus
gagtgggtatcgcagaagacttcct

SEQ ID NO: 497375 - DNA, 25 bp, Mus musculus
gagtgggtatcggagaagacttcct

SEQ ID NO: 497376 - DNA, 25 bp, Mus musculus
gagtgggtccatacctactggaaga

SEQ ID NO: 497377 - DNA, 25 bp, Mus musculus
gagtgggtccattcctactggaaga

SEQ ID NO: 497378 - DNA, 25 bp, Mus musculus
gagtgggtctacaatctccatcaca

SEQ ID NO: 497379 - DNA, 25 bp, Mus musculus
gagtgggtctactatctccatcaca

SEQ ID NO: 497380 - DNA, 25 bp, Mus musculus
gagtgggtgagcatgaagcttaccc

SEQ ID NO: 497381 - DNA, 25 bp, Mus musculus
gagtgggtgagcttgaagcttaccc

SEQ ID NO: 497382 - DNA, 25 bp, Mus musculus
gagtgggtgcagagccagtacccca

SEQ ID NO: 497383 - DNA, 25 bp, Mus musculus
gagtgggtgcagtgccagtacccca

SEQ ID NO: 497384 - DNA, 25 bp, Mus musculus
gagtgggtgcctacagtaccaggac

SEQ ID NO: 497385 - DNA, 25 bp, Mus musculus
gagtgggtgccttcagtaccaggac

SEQ ID NO: 497386 - DNA, 25 bp, Mus musculus
gagtgggttagcaagcagtgctcca

SEQ ID NO: 497387 - DNA, 25 bp, Mus musculus
gagtgggttagctagcagtgctcca

SEQ ID NO: 497388 - DNA, 25 bp, Mus musculus
gagtgggttcagaatcctcggcatc

SEQ ID NO: 497389 - DNA, 25 bp, Mus musculus
gagtgggttcagtatcctcggcatc

SEQ ID NO: 497390 - DNA, 25 bp, Mus musculus
gagtgggttgaccttggacctaatt

SEQ ID NO: 497391 - DNA, 25 bp, Mus musculus
gagtgggttgacgttggacctaatt

SEQ ID NO: 497392 - DNA, 25 bp, Mus musculus
gagtgggtttcaaggccctggacta

SEQ ID NO: 497393 - DNA, 25 bp, Mus musculus
gagtgggtttcatggccctggacta

SEQ ID NO: 497394 - DNA, 25 bp, Mus musculus
gagtggtaactcagggtctggtttt

SEQ ID NO: 497395 - DNA, 25 bp, Mus musculus
gagtggtaactctgggtctggtttt

SEQ ID NO: 497396 - DNA, 25 bp, Mus musculus
gagtggtacaacctctacatttgag

SEQ ID NO: 497397 - DNA, 25 bp, Mus musculus
gagtggtacaacgtctacatttgag

SEQ ID NO: 497398 - DNA, 25 bp, Mus musculus
gagtggtacagaccttttaagttcc

SEQ ID NO: 497399 - DNA, 25 bp, Mus musculus
gagtggtacagagcttttaagttcc

SEQ ID NO: 497400 - DNA, 25 bp, Mus musculus
gagtggtacattactctatgaactt

SEQ ID NO: 497401 - DNA, 25 bp, Mus musculus
gagtggtacatttctctatgaactt

SEQ ID NO: 497402 - DNA, 25 bp, Mus musculus
gagtggtaccacatatctgtagtcc

SEQ ID NO: 497403 - DNA, 25 bp, Mus musculus
gagtggtaccacttatctgtagtcc

SEQ ID NO: 497404 - DNA, 25 bp, Mus musculus
gagtggtacggtccaacggccatac

SEQ ID NO: 497405 - DNA, 25 bp, Mus musculus
gagtggtacggtgcaacggccatac

SEQ ID NO: 497406 - DNA, 25 bp, Mus musculus
gagtggtactctatatttctgagaa

SEQ ID NO: 497407 - DNA, 25 bp, Mus musculus
gagtggtactctttatttctgagaa

SEQ ID NO: 497408 - DNA, 25 bp, Mus musculus
gagtggtactgaccactaccctcaa

SEQ ID NO: 497409 - DNA, 25 bp, Mus musculus
gagtggtactgagcactaccctcaa

SEQ ID NO: 497410 - DNA, 25 bp, Mus musculus
gagtggtatatacctccttcactgt

SEQ ID NO: 497411 - DNA, 25 bp, Mus musculus
gagtggtatatagctccttcactgt

SEQ ID NO: 497412 - DNA, 25 bp, Mus musculus
gagtggtatccacatgacatggaag

SEQ ID NO: 497413 - DNA, 25 bp, Mus musculus
gagtggtatccagatgacatggaag

SEQ ID NO: 497414 - DNA, 25 bp, Mus musculus
gagtggtatgctccgagctgtacta

SEQ ID NO: 497415 - DNA, 25 bp, Mus musculus
gagtggtatgctgcgagctgtacta

SEQ ID NO: 497416 - DNA, 25 bp, Mus musculus
gagtggtatttaacttccaacaaat

SEQ ID NO: 497417 - DNA, 25 bp, Mus musculus
gagtggtatttatcttccaacaaat

SEQ ID NO: 497418 - DNA, 25 bp, Mus musculus
gagtggtcagagacccatgatcgag

SEQ ID NO: 497419 - DNA, 25 bp, Mus musculus
gagtggtcagagtcccatgatcgag

SEQ ID NO: 497420 - DNA, 25 bp, Mus musculus
gagtggtcaggtagcctctgtctca

SEQ ID NO: 497421 - DNA, 25 bp, Mus musculus
gagtggtcaggttgcctctgtctca

SEQ ID NO: 497422 - DNA, 25 bp, Mus musculus
gagtggtcagtcattggccttgcag

SEQ ID NO: 497423 - DNA, 25 bp, Mus musculus
gagtggtcagtctttggccttgcag

SEQ ID NO: 497424 - DNA, 25 bp, Mus musculus
gagtggtcatcgaattcacctcacc

SEQ ID NO: 497425 - DNA, 25 bp, Mus musculus
gagtggtcatcgtattcacctcacc

SEQ ID NO: 497426 - DNA, 25 bp, Mus musculus
gagtggtcatgcagtgtgaaaccta

SEQ ID NO: 497427 - DNA, 25 bp, Mus musculus
gagtggtcatgctgtgtgaaaccta

SEQ ID NO: 497428 - DNA, 25 bp, Mus musculus
gagtggtccaaaacgagctctggga

SEQ ID NO: 497429 - DNA, 25 bp, Mus musculus
gagtggtccaaatcgagctctggga

SEQ ID NO: 497430 - DNA, 25 bp, Mus musculus
gagtggtcctccaaggtgacccagt

SEQ ID NO: 497431 - DNA, 25 bp, Mus musculus
gagtggtcctcctaggtgacccagt

SEQ ID NO: 497432 - DNA, 25 bp, Mus musculus
gagtggtctttaaaaggcttctgct

SEQ ID NO: 497433 - DNA, 25 bp, Mus musculus
gagtggtctttataaggcttctgct

SEQ ID NO: 497434 - DNA, 25 bp, Mus musculus
gagtggtgagcaaggtgacttcaac

SEQ ID NO: 497435 - DNA, 25 bp, Mus musculus
gagtggtgagcatggtgacttcaac

SEQ ID NO: 497436 - DNA, 25 bp, Mus musculus
gagtggtgagccatctatctgtctg

SEQ ID NO: 497437 - DNA, 25 bp, Mus musculus
gagtggtgagccttctatctgtctg

SEQ ID NO: 497438 - DNA, 25 bp, Mus musculus
gagtggtgataaactgcctttaagt

SEQ ID NO: 497439 - DNA, 25 bp, Mus musculus
gagtggtgataatctgcctttaagt

SEQ ID NO: 497440 - DNA, 25 bp, Mus musculus
gagtggtgatccagcccgacatcta

SEQ ID NO: 497441 - DNA, 25 bp, Mus musculus
gagtggtgatcctgcccgacatcta

SEQ ID NO: 497442 - DNA, 25 bp, Mus musculus
gagtggtgcacactgtcacttctct

SEQ ID NO: 497443 - DNA, 25 bp, Mus musculus
gagtggtgcacagtgtcacttctct

SEQ ID NO: 497444 - DNA, 25 bp, Mus musculus
gagtggtgccacctatggatcttca

SEQ ID NO: 497445 - DNA, 25 bp, Mus musculus
gagtggtgccacgtatggatcttca

SEQ ID NO: 497446 - DNA, 25 bp, Mus musculus
gagtggtgccgtcccctcgtctgca

SEQ ID NO: 497447 - DNA, 25 bp, Mus musculus
gagtggtgccgtgccctcgtctgca

SEQ ID NO: 497448 - DNA, 25 bp, Mus musculus
gagtggtgctgacgaccccgactct

SEQ ID NO: 497449 - DNA, 25 bp, Mus musculus
gagtggtgctgaggaccccgactct

SEQ ID NO: 497450 - DNA, 25 bp, Mus musculus
gagtggtggaagacttttctcgatt

SEQ ID NO: 497451 - DNA, 25 bp, Mus musculus
gagtggtggaagtcttttctcgatt

SEQ ID NO: 497452 - DNA, 25 bp, Mus musculus
gagtggtggcaaagtcaggatttct

SEQ ID NO: 497453 - DNA, 25 bp, Mus musculus
gagtggtggcaatgtcaggatttct

SEQ ID NO: 497454 - DNA, 25 bp, Mus musculus
gagtggtggcttactagtgcccatc

SEQ ID NO: 497455 - DNA, 25 bp, Mus musculus
gagtggtggctttctagtgcccatc

SEQ ID NO: 497456 - DNA, 25 bp, Mus musculus
gagtggtgggacagtgaccttccaa

SEQ ID NO: 497457 - DNA, 25 bp, Mus musculus
gagtggtgggactgtgaccttccaa

SEQ ID NO: 497458 - DNA, 25 bp, Mus musculus
gagtggtgggtcaatcattcaaatt

SEQ ID NO: 497459 - DNA, 25 bp, Mus musculus
gagtggtgggtctatcattcaaatt

SEQ ID NO: 497460 - DNA, 25 bp, Mus musculus
gagtggtggtccatgggataacctt

SEQ ID NO: 497461 - DNA, 25 bp, Mus musculus
gagtggtggtccttgggataacctt

SEQ ID NO: 497462 - DNA, 25 bp, Mus musculus
gagtggtgtgaaaatcgtgagaaca

SEQ ID NO: 497463 - DNA, 25 bp, Mus musculus
gagtggtgtgaatatcgtgagaaca

SEQ ID NO: 497464 - DNA, 25 bp, Mus musculus
gagtggtgttcaatcccacaacaca

SEQ ID NO: 497465 - DNA, 25 bp, Mus musculus
gagtggtgttcattcccacaacaca

SEQ ID NO: 497466 - DNA, 25 bp, Mus musculus
gagtggtgttgtacgagctcttcac

SEQ ID NO: 497467 - DNA, 25 bp, Mus musculus
gagtggtgttgttcgagctcttcac

SEQ ID NO: 497468 - DNA, 25 bp, Mus musculus
gagtggttagccctcacttgtcacc

SEQ ID NO: 497469 - DNA, 25 bp, Mus musculus
gagtggttagccgtcacttgtcacc

SEQ ID NO: 497470 - DNA, 25 bp, Mus musculus
gagtggttcagacaccagcccagat

SEQ ID NO: 497471 - DNA, 25 bp, Mus musculus
gagtggttcagagaccagcccagat

SEQ ID NO: 497472 - DNA, 25 bp, Mus musculus
gagtggttcgatagccaaccgacta

SEQ ID NO: 497473 - DNA, 25 bp, Mus musculus
gagtggttcgattgccaaccgacta

SEQ ID NO: 497474 - DNA, 25 bp, Mus musculus
gagtggttcgtcacggcgttcgtca

SEQ ID NO: 497475 - DNA, 25 bp, Mus musculus
gagtggttcgtctcggcgttcgtca

SEQ ID NO: 497476 - DNA, 25 bp, Mus musculus
gagtggttgaaaacagaatgcctga

SEQ ID NO: 497477 - DNA, 25 bp, Mus musculus
gagtggttgaaatcagaatgcctga

SEQ ID NO: 497478 - DNA, 25 bp, Mus musculus
gagtggtttcctatgacctttagca

SEQ ID NO: 497479 - DNA, 25 bp, Mus musculus
gagtggtttcctttgacctttagca

SEQ ID NO: 497480 - DNA, 25 bp, Mus musculus
gagtggtttctgattatttcactgt

SEQ ID NO: 497481 - DNA, 25 bp, Mus musculus
gagtggtttctgtttatttcactgt

SEQ ID NO: 497482 - DNA, 25 bp, Mus musculus
gagtggtttcttcggactgcattga

SEQ ID NO: 497483 - DNA, 25 bp, Mus musculus
gagtggtttcttgggactgcattga

SEQ ID NO: 497484 - DNA, 25 bp, Mus musculus
gagtggtttgccagtatgcacgtat

SEQ ID NO: 497485 - DNA, 25 bp, Mus musculus
gagtggtttgcctgtatgcacgtat

SEQ ID NO: 497486 - DNA, 25 bp, Mus musculus
gagtggttttccagcagaacatctt

SEQ ID NO: 497487 - DNA, 25 bp, Mus musculus
gagtggttttcctgcagaacatctt

SEQ ID NO: 497488 - DNA, 25 bp, Mus musculus
gagtgtaaactaattttatcctcat

SEQ ID NO: 497489 - DNA, 25 bp, Mus musculus
gagtgtaaactatttttatcctcat

SEQ ID NO: 497490 - DNA, 25 bp, Mus musculus
gagtgtaaatggcttgtcttataaa

SEQ ID NO: 497491 - DNA, 25 bp, Mus musculus
gagtgtaaatgggttgtcttataaa

SEQ ID NO: 497492 - DNA, 25 bp, Mus musculus
gagtgtaacagtcggcttgtgctct

SEQ ID NO: 497493 - DNA, 25 bp, Mus musculus
gagtgtaacagtgggcttgtgctct

SEQ ID NO: 497494 - DNA, 25 bp, Mus musculus
gagtgtaaccctacaactacccttg

SEQ ID NO: 497495 - DNA, 25 bp, Mus musculus
gagtgtaacccttcaactacccttg

SEQ ID NO: 497496 - DNA, 25 bp, Mus musculus
gagtgtaactcaagattcctcgagt

SEQ ID NO: 497497 - DNA, 25 bp, Mus musculus
gagtgtaactcatgattcctcgagt

SEQ ID NO: 497498 - DNA, 25 bp, Mus musculus
gagtgtaatctgacagtatcacgct

SEQ ID NO: 497499 - DNA, 25 bp, Mus musculus
gagtgtaatctgtcagtatcacgct

SEQ ID NO: 497500 - DNA, 25 bp, Mus musculus
gagtgtaattatacccatttgtgtg

SEQ ID NO: 497501 - DNA, 25 bp, Mus musculus
gagtgtaattattcccatttgtgtg

SEQ ID NO: 497502 - DNA, 25 bp, Mus musculus
gagtgtaattctattatcttcctga

SEQ ID NO: 497503 - DNA, 25 bp, Mus musculus
gagtgtaattcttttatcttcctga

SEQ ID NO: 497504 - DNA, 25 bp, Mus musculus
gagtgtacaattccattctcgaatg

SEQ ID NO: 497505 - DNA, 25 bp, Mus musculus
gagtgtacaattgcattctcgaatg

SEQ ID NO: 497506 - DNA, 25 bp, Mus musculus
gagtgtacacacctaagctatgcta

SEQ ID NO: 497507 - DNA, 25 bp, Mus musculus
gagtgtacacacgtaagctatgcta

SEQ ID NO: 497508 - DNA, 25 bp, Mus musculus
gagtgtacagatattatttatgcat

SEQ ID NO: 497509 - DNA, 25 bp, Mus musculus
gagtgtacagattttatttatgcat

SEQ ID NO: 497510 - DNA, 25 bp, Mus musculus
gagtgtacatctatttcttgtttct

SEQ ID NO: 497511 - DNA, 25 bp, Mus musculus
gagtgtacatctttttcttgtttct

SEQ ID NO: 497512 - DNA, 25 bp, Mus musculus
gagtgtaccattaacttgattgttg

SEQ ID NO: 497513 - DNA, 25 bp, Mus musculus
gagtgtaccatttacttgattgttg

SEQ ID NO: 497514 - DNA, 25 bp, Mus musculus
gagtgtacccagagatttaacagga

SEQ ID NO: 497515 - DNA, 25 bp, Mus musculus
gagtgtacccagtgatttaacagga

SEQ ID NO: 497516 - DNA, 25 bp, Mus musculus
gagtgtacccatcgcaaatgctcca

SEQ ID NO: 497517 - DNA, 25 bp, Mus musculus
gagtgtacccatggcaaatgctcca

SEQ ID NO: 497518 - DNA, 25 bp, Mus musculus
gagtgtacctccaagtatttttggc

SEQ ID NO: 497519 - DNA, 25 bp, Mus musculus
gagtgtacctcctagtatttttggc

SEQ ID NO: 497520 - DNA, 25 bp, Mus musculus
gagtgtacctcgctgtattttcaaa

SEQ ID NO: 497521 - DNA, 25 bp, Mus musculus
gagtgtacctcggtgtattttcaaa

SEQ ID NO: 497522 - DNA, 25 bp, Mus musculus
gagtgtaccttcagatgtctggcta

SEQ ID NO: 497523 - DNA, 25 bp, Mus musculus
gagtgtaccttctgatgtctggcta

SEQ ID NO: 497524 - DNA, 25 bp, Mus musculus
gagtgtaccttgcactgattacctc

SEQ ID NO: 497525 - DNA, 25 bp, Mus musculus
gagtgtaccttggactgattacctc

SEQ ID NO: 497526 - DNA, 25 bp, Mus musculus
gagtgtactagcattttgttttcaa

SEQ ID NO: 497527 - DNA, 25 bp, Mus musculus
gagtgtactagctttttgttttcaa

SEQ ID NO: 497528 - DNA, 25 bp, Mus musculus
gagtgtactgagaggattccccaga

SEQ ID NO: 497529 - DNA, 25 bp, Mus musculus
gagtgtactgagtggattccccaga

SEQ ID NO: 497530 - DNA, 25 bp, Mus musculus
gagtgtactttacttcacgtttgta

SEQ ID NO: 497531 - DNA, 25 bp, Mus musculus
gagtgtactttagttcacgtttgta

SEQ ID NO: 497532 - DNA, 25 bp, Mus musculus
gagtgtacttttctgcttgaacgct

SEQ ID NO: 497533 - DNA, 25 bp, Mus musculus
gagtgtacttttgtgcttgaacgct

SEQ ID NO: 497534 - DNA, 25 bp, Mus musculus
gagtgtagaaatccttcaccctggg

SEQ ID NO: 497535 - DNA, 25 bp, Mus musculus
gagtgtagaaatgcttcaccctggg

SEQ ID NO: 497536 - DNA, 25 bp, Mus musculus
gagtgtagacgtaaccctgcatgca

SEQ ID NO: 497537 - DNA, 25 bp, Mus musculus
gagtgtagacgttaccctgcatgca

SEQ ID NO: 497538 - DNA, 25 bp, Mus musculus
gagtgtagcccactctacagagagg

SEQ ID NO: 497539 - DNA, 25 bp, Mus musculus
gagtgtagcccagtctacagagagg

SEQ ID NO: 497540 - DNA, 25 bp, Mus musculus
gagtgtagcgcccacctgctgaatc

SEQ ID NO: 497541 - DNA, 25 bp, Mus musculus
gagtgtagcgccgacctgctgaatc

SEQ ID NO: 497542 - DNA, 25 bp, Mus musculus
gagtgtaggcataataagtcttata

SEQ ID NO: 497543 - DNA, 25 bp, Mus musculus
gagtgtaggcattataagtcttata

SEQ ID NO: 497544 - DNA, 25 bp, Mus musculus
gagtgtaggtacagtccagcagaca

SEQ ID NO: 497545 - DNA, 25 bp, Mus musculus
gagtgtaggtactgtccagcagaca

SEQ ID NO: 497546 - DNA, 25 bp, Mus musculus
gagtgtaggtgtaccaggatcctcc

SEQ ID NO: 497547 - DNA, 25 bp, Mus musculus
gagtgtaggtgttccaggatcctcc

SEQ ID NO: 497548 - DNA, 25 bp, Mus musculus
gagtgtagtctgattagtgccatat

SEQ ID NO: 497549 - DNA, 25 bp, Mus musculus
gagtgtagtctgtttagtgccatat

SEQ ID NO: 497550 - DNA, 25 bp, Mus musculus
gagtgtagttaacagcccgcatcag

SEQ ID NO: 497551 - DNA, 25 bp, Mus musculus
gagtgtagttaacgcctctgctctg

SEQ ID NO: 497552 - DNA, 25 bp, Mus musculus
gagtgtagttaagagcccgcatcag

SEQ ID NO: 497553 - DNA, 25 bp, Mus musculus
gagtgtagttaaggcctctgctctg

SEQ ID NO: 497554 - DNA, 25 bp, Mus musculus
gagtgtagttccatttctgaacagc

SEQ ID NO: 497555 - DNA, 25 bp, Mus musculus
gagtgtagttccttttctgaacagc

SEQ ID NO: 497556 - DNA, 25 bp, Mus musculus
gagtgtagtttcaggtccctttggc

SEQ ID NO: 497557 - DNA, 25 bp, Mus musculus
gagtgtagtttctggtccctttggc

SEQ ID NO: 497558 - DNA, 25 bp, Mus musculus
gagtgtataccaactttgccatcct

SEQ ID NO: 497559 - DNA, 25 bp, Mus musculus
gagtgtataccatctttgccatcct

SEQ ID NO: 497560 - DNA, 25 bp, Mus musculus
gagtgtataggaccctctgtgcgtt

SEQ ID NO: 497561 - DNA, 25 bp, Mus musculus
gagtgtataggagcctctgtgcgtt

SEQ ID NO: 497562 - DNA, 25 bp, Mus musculus
gagtgtatatcgataccatgcacaa

SEQ ID NO: 497563 - DNA, 25 bp, Mus musculus
gagtgtatatcgttaccatgcacaa

SEQ ID NO: 497564 - DNA, 25 bp, Mus musculus
gagtgtatcacaccatctttctgta

SEQ ID NO: 497565 - DNA, 25 bp, Mus musculus
gagtgtatcacagcatctttctgta

SEQ ID NO: 497566 - DNA, 25 bp, Mus musculus
gagtgtatccagatagtagagagct

SEQ ID NO: 497567 - DNA, 25 bp, Mus musculus
gagtgtatccagttagtagagagct

SEQ ID NO: 497568 - DNA, 25 bp, Mus musculus
gagtgtatccgcaaacctgtacagt

SEQ ID NO: 497569 - DNA, 25 bp, Mus musculus
gagtgtatccgctaacctgtacagt

SEQ ID NO: 497570 - DNA, 25 bp, Mus musculus
gagtgtatgagtatacccgggcctg

SEQ ID NO: 497571 - DNA, 25 bp, Mus musculus
gagtgtatgagtttacccgggcctg

SEQ ID NO: 497572 - DNA, 25 bp, Mus musculus
gagtgtatgcttccacaggtgctct

SEQ ID NO: 497573 - DNA, 25 bp, Mus musculus
gagtgtatgcttgcacaggtgctct

SEQ ID NO: 497574 - DNA, 25 bp, Mus musculus
gagtgtattagcatcctttgaggca

SEQ ID NO: 497575 - DNA, 25 bp, Mus musculus
gagtgtattagcttcctttgaggca

SEQ ID NO: 497576 - DNA, 25 bp, Mus musculus
gagtgtattcacaaggtatcatcac

SEQ ID NO: 497577 - DNA, 25 bp, Mus musculus
gagtgtattcactaggtatcatcac

SEQ ID NO: 497578 - DNA, 25 bp, Mus musculus
gagtgtattcatcttctggcttaaa

SEQ ID NO: 497579 - DNA, 25 bp, Mus musculus
gagtgtattcatgttctggcttaaa

SEQ ID NO: 497580 - DNA, 25 bp, Mus musculus
gagtgtcaaagccagccatcaaaca

SEQ ID NO: 497581 - DNA, 25 bp, Mus musculus
gagtgtcaaagcgagccatcaaaca

SEQ ID NO: 497582 - DNA, 25 bp, Mus musculus
gagtgtcaaatgatgacacgacaca

SEQ ID NO: 497583 - DNA, 25 bp, Mus musculus
gagtgtcaaatgttgacacgacaca

SEQ ID NO: 497584 - DNA, 25 bp, Mus musculus
gagtgtcaacaaagaaatggagcct

SEQ ID NO: 497585 - DNA, 25 bp, Mus musculus
gagtgtcaacaaagcctttgccaag

SEQ ID NO: 497586 - DNA, 25 bp, Mus musculus
gagtgtcaacaatgaaatggagcct

SEQ ID NO: 497587 - DNA, 25 bp, Mus musculus
gagtgtcaacaatgcctttgccaag

SEQ ID NO: 497588 - DNA, 25 bp, Mus musculus
gagtgtcaactccagtgtctttgtg

SEQ ID NO: 497589 - DNA, 25 bp, Mus musculus
gagtgtcaactcgagtgtctttgtg

SEQ ID NO: 497590 - DNA, 25 bp, Mus musculus
gagtgtcaagctcaccactaggaag

SEQ ID NO: 497591 - DNA, 25 bp, Mus musculus
gagtgtcaagctgaccactaggaag

SEQ ID NO: 497592 - DNA, 25 bp, Mus musculus
gagtgtcaaggccagcctgtgtcct

SEQ ID NO: 497593 - DNA, 25 bp, Mus musculus
gagtgtcaaggcgagcctgtgtcct

SEQ ID NO: 497594 - DNA, 25 bp, Mus musculus
gagtgtcaatcaaagatcctcttta

SEQ ID NO: 497595 - DNA, 25 bp, Mus musculus
gagtgtcaatcatagatcctcttta

SEQ ID NO: 497596 - DNA, 25 bp, Mus musculus
gagtgtcaatctctcaccgggtgat

SEQ ID NO: 497597 - DNA, 25 bp, Mus musculus
gagtgtcaatctgtcaccgggtgat

SEQ ID NO: 497598 - DNA, 25 bp, Mus musculus
gagtgtcaatgcatggcttcttgtt

SEQ ID NO: 497599 - DNA, 25 bp, Mus musculus
gagtgtcaatgcttggcttcttgtt

SEQ ID NO: 497600 - DNA, 25 bp, Mus musculus
gagtgtcacagaccaactcgtcctg

SEQ ID NO: 497601 - DNA, 25 bp, Mus musculus
gagtgtcacagacctgagactagcc

SEQ ID NO: 497602 - DNA, 25 bp, Mus musculus
gagtgtcacagagcaactcgtcctg

SEQ ID NO: 497603 - DNA, 25 bp, Mus musculus
gagtgtcacagagctgagactagcc

SEQ ID NO: 497604 - DNA, 25 bp, Mus musculus
gagtgtcaccagagcagcctgctag

SEQ ID NO: 497605 - DNA, 25 bp, Mus musculus
gagtgtcaccagtgcagcctgctag

SEQ ID NO: 497606 - DNA, 25 bp, Mus musculus
gagtgtcaccatcccttttagtgga

SEQ ID NO: 497607 - DNA, 25 bp, Mus musculus
gagtgtcaccatgccttttagtgga

SEQ ID NO: 497608 - DNA, 25 bp, Mus musculus
gagtgtcacggtatctacaggtcaa

SEQ ID NO: 497609 - DNA, 25 bp, Mus musculus
gagtgtcacggtttctacaggtcaa

SEQ ID NO: 497610 - DNA, 25 bp, Mus musculus
gagtgtcacgtaatattgtacaatg

SEQ ID NO: 497611 - DNA, 25 bp, Mus musculus
gagtgtcacgtattattgtacaatg

SEQ ID NO: 497612 - DNA, 25 bp, Mus musculus
gagtgtcactgtacatatgtctatt

SEQ ID NO: 497613 - DNA, 25 bp, Mus musculus
gagtgtcactgttcatatgtctatt

SEQ ID NO: 497614 - DNA, 25 bp, Mus musculus
gagtgtcagaaaacagcttcagcta

SEQ ID NO: 497615 - DNA, 25 bp, Mus musculus
gagtgtcagaaatcagcttcagcta

SEQ ID NO: 497616 - DNA, 25 bp, Mus musculus
gagtgtcagagtccctgaaactgaa

SEQ ID NO: 497617 - DNA, 25 bp, Mus musculus
gagtgtcagagtgcctgaaactgaa

SEQ ID NO: 497618 - DNA, 25 bp, Mus musculus
gagtgtcaggaaccagaactgcaat

SEQ ID NO: 497619 - DNA, 25 bp, Mus musculus
gagtgtcaggaagcagaactgcaat

SEQ ID NO: 497620 - DNA, 25 bp, Mus musculus
gagtgtcagtgaagcagccctcctg

SEQ ID NO: 497621 - DNA, 25 bp, Mus musculus
gagtgtcagtgatgcagccctcctg

SEQ ID NO: 497622 - DNA, 25 bp, Mus musculus
gagtgtcagttaaatcgccccagcg

SEQ ID NO: 497623 - DNA, 25 bp, Mus musculus
gagtgtcagttatatcgccccagcg

SEQ ID NO: 497624 - DNA, 25 bp, Mus musculus
gagtgtcattgaccccaggttatgc

SEQ ID NO: 497625 - DNA, 25 bp, Mus musculus
gagtgtcattgagcccaggttatgc

SEQ ID NO: 497626 - DNA, 25 bp, Mus musculus
gagtgtcattgcagagaggctcctt

SEQ ID NO: 497627 - DNA, 25 bp, Mus musculus
gagtgtcattgctgagaggctcctt

SEQ ID NO: 497628 - DNA, 25 bp, Mus musculus
gagtgtcatttccagtttcgtactt

SEQ ID NO: 497629 - DNA, 25 bp, Mus musculus
gagtgtcatttcgagtttcgtactt

SEQ ID NO: 497630 - DNA, 25 bp, Mus musculus
gagtgtccaaacacacagtctcacg

SEQ ID NO: 497631 - DNA, 25 bp, Mus musculus
gagtgtccaaacacaggacccagga

SEQ ID NO: 497632 - DNA, 25 bp, Mus musculus
gagtgtccaaactcacagtctcacg

SEQ ID NO: 497633 - DNA, 25 bp, Mus musculus
gagtgtccaaactcaggacccagga

SEQ ID NO: 497634 - DNA, 25 bp, Mus musculus
gagtgtccaacacgttctgagggat

SEQ ID NO: 497635 - DNA, 25 bp, Mus musculus
gagtgtccaacaggttctgagggat

SEQ ID NO: 497636 - DNA, 25 bp, Mus musculus
gagtgtccaattcttctaccaggag

SEQ ID NO: 497637 - DNA, 25 bp, Mus musculus
gagtgtccaattgttctaccaggag

SEQ ID NO: 497638 - DNA, 25 bp, Mus musculus
gagtgtccagtgaatatcaggcatt

SEQ ID NO: 497639 - DNA, 25 bp, Mus musculus
gagtgtccagtgtatatcaggcatt

SEQ ID NO: 497640 - DNA, 25 bp, Mus musculus
gagtgtccatcacgtggcagtactt

SEQ ID NO: 497641 - DNA, 25 bp, Mus musculus
gagtgtccatcaggtggcagtactt

SEQ ID NO: 497642 - DNA, 25 bp, Mus musculus
gagtgtccatctcgtcattcaaagg

SEQ ID NO: 497643 - DNA, 25 bp, Mus musculus
gagtgtccatctggtcattcaaagg

SEQ ID NO: 497644 - DNA, 25 bp, Mus musculus
gagtgtcccaacaagactaccgact

SEQ ID NO: 497645 - DNA, 25 bp, Mus musculus
gagtgtcccaactagactaccgact

SEQ ID NO: 497646 - DNA, 25 bp, Mus musculus
gagtgtccctgaactggctgaatct

SEQ ID NO: 497647 - DNA, 25 bp, Mus musculus
gagtgtccctgatctggctgaatct

SEQ ID NO: 497648 - DNA, 25 bp, Mus musculus
gagtgtcccttgctgaagacattca

SEQ ID NO: 497649 - DNA, 25 bp, Mus musculus
gagtgtcccttggtgaagacattca

SEQ ID NO: 497650 - DNA, 25 bp, Mus musculus
gagtgtccgacaatctctcaaagat

SEQ ID NO: 497651 - DNA, 25 bp, Mus musculus
gagtgtccgacattctctcaaagat

SEQ ID NO: 497652 - DNA, 25 bp, Mus musculus
gagtgtcctagcaagaaagtttcca

SEQ ID NO: 497653 - DNA, 25 bp, Mus musculus
gagtgtcctagctagaaagtttcca

SEQ ID NO: 497654 - DNA, 25 bp, Mus musculus
gagtgtcctccaaaccacataaatg

SEQ ID NO: 497655 - DNA, 25 bp, Mus musculus
gagtgtcctccataccacataaatg

SEQ ID NO: 497656 - DNA, 25 bp, Mus musculus
gagtgtcctccgcagagggcaaatc

SEQ ID NO: 497657 - DNA, 25 bp, Mus musculus
gagtgtcctccggagagggcaaatc

SEQ ID NO: 497658 - DNA, 25 bp, Mus musculus
gagtgtcctctcaaagcgagctgtt

SEQ ID NO: 497659 - DNA, 25 bp, Mus musculus
gagtgtcctctctaagcgagctgtt

SEQ ID NO: 497660 - DNA, 25 bp, Mus musculus
gagtgtcctggaagacttctataca

SEQ ID NO: 497661 - DNA, 25 bp, Mus musculus
gagtgtcctggatgacttctataca

SEQ ID NO: 497662 - DNA, 25 bp, Mus musculus
gagtgtcctttcagaagacagaatt

SEQ ID NO: 497663 - DNA, 25 bp, Mus musculus
gagtgtcctttctgaagacagaatt

SEQ ID NO: 497664 - DNA, 25 bp, Mus musculus
gagtgtcgaataacagccatttgct

SEQ ID NO: 497665 - DNA, 25 bp, Mus musculus
gagtgtcgaatatcagccatttgct

SEQ ID NO: 497666 - DNA, 25 bp, Mus musculus
gagtgtcgcaaaccaaagccatcat

SEQ ID NO: 497667 - DNA, 25 bp, Mus musculus
gagtgtcgcaaagcaaagccatcat

SEQ ID NO: 497668 - DNA, 25 bp, Mus musculus
gagtgtctaactatcattctgaatg

SEQ ID NO: 497669 - DNA, 25 bp, Mus musculus
gagtgtctaactttcattctgaatg

SEQ ID NO: 497670 - DNA, 25 bp, Mus musculus
gagtgtctacagagctatgtgatct

SEQ ID NO: 497671 - DNA, 25 bp, Mus musculus
gagtgtctacagtgctatgtgatct

SEQ ID NO: 497672 - DNA, 25 bp, Mus musculus
gagtgtctacttaccatccacagat

SEQ ID NO: 497673 - DNA, 25 bp, Mus musculus
gagtgtctactttccatccacagat

SEQ ID NO: 497674 - DNA, 25 bp, Mus musculus
gagtgtctaggacttcttgctatag

SEQ ID NO: 497675 - DNA, 25 bp, Mus musculus
gagtgtctaggagttcttgctatag

SEQ ID NO: 497676 - DNA, 25 bp, Mus musculus
gagtgtctagtgagagaacaacatt

SEQ ID NO: 497677 - DNA, 25 bp, Mus musculus
gagtgtctagtgtgagaacaacatt

SEQ ID NO: 497678 - DNA, 25 bp, Mus musculus
gagtgtctatcccatgcaggcagaa

SEQ ID NO: 497679 - DNA, 25 bp, Mus musculus
gagtgtctatccgatgcaggcagaa

SEQ ID NO: 497680 - DNA, 25 bp, Mus musculus
gagtgtctcactatgtcaagtacat

SEQ ID NO: 497681 - DNA, 25 bp, Mus musculus
gagtgtctcactttgtcaagtacat

SEQ ID NO: 497682 - DNA, 25 bp, Mus musculus
gagtgtctcagcacatttcatgaga

SEQ ID NO: 497683 - DNA, 25 bp, Mus musculus
gagtgtctcagctcatttcatgaga

SEQ ID NO: 497684 - DNA, 25 bp, Mus musculus
gagtgtctcagtaatggcaggttca

SEQ ID NO: 497685 - DNA, 25 bp, Mus musculus
gagtgtctcagtacagtgtcaaagg

SEQ ID NO: 497686 - DNA, 25 bp, Mus musculus
gagtgtctcagttatggcaggttca

SEQ ID NO: 497687 - DNA, 25 bp, Mus musculus
gagtgtctcagttcagtgtcaaagg

SEQ ID NO: 497688 - DNA, 25 bp, Mus musculus
gagtgtctctctaccatgtatagtc

SEQ ID NO: 497689 - DNA, 25 bp, Mus musculus
gagtgtctctcttccatgtatagtc

SEQ ID NO: 497690 - DNA, 25 bp, Mus musculus
gagtgtctctggactttatgccaaa

SEQ ID NO: 497691 - DNA, 25 bp, Mus musculus
gagtgtctctggtctttatgccaaa

SEQ ID NO: 497692 - DNA, 25 bp, Mus musculus
gagtgtctgaagacatttggcagca

SEQ ID NO: 497693 - DNA, 25 bp, Mus musculus
gagtgtctgaagtcatttggcagca

SEQ ID NO: 497694 - DNA, 25 bp, Mus musculus
gagtgtctgacacaaggccaacctg

SEQ ID NO: 497695 - DNA, 25 bp, Mus musculus
gagtgtctgacacactttccaggac

SEQ ID NO: 497696 - DNA, 25 bp, Mus musculus
gagtgtctgacagaaggccaacctg

SEQ ID NO: 497697 - DNA, 25 bp, Mus musculus
gagtgtctgacagactttccaggac

SEQ ID NO: 497698 - DNA, 25 bp, Mus musculus
gagtgtctgctgacagttttgtgcg

SEQ ID NO: 497699 - DNA, 25 bp, Mus musculus
gagtgtctgctgtcagttttgtgcg

SEQ ID NO: 497700 - DNA, 25 bp, Mus musculus
gagtgtctggccagttctaaatata

SEQ ID NO: 497701 - DNA, 25 bp, Mus musculus
gagtgtctggcctgttctaaatata

SEQ ID NO: 497702 - DNA, 25 bp, Mus musculus
gagtgtctgggacgcacatttatgc

SEQ ID NO: 497703 - DNA, 25 bp, Mus musculus
gagtgtctgggaggcacatttatgc

SEQ ID NO: 497704 - DNA, 25 bp, Mus musculus
gagtgtctgttcacactcatcaacg

SEQ ID NO: 497705 - DNA, 25 bp, Mus musculus
gagtgtctgttctcactcatcaacg

SEQ ID NO: 497706 - DNA, 25 bp, Mus musculus
gagtgtcttaataccgatgccttga

SEQ ID NO: 497707 - DNA, 25 bp, Mus musculus
gagtgtcttaattccgatgccttga

SEQ ID NO: 497708 - DNA, 25 bp, Mus musculus
gagtgtcttactatcacaggccttg

SEQ ID NO: 497709 - DNA, 25 bp, Mus musculus
gagtgtcttactttcacaggccttg

SEQ ID NO: 497710 - DNA, 25 bp, Mus musculus
gagtgtcttcagaaattggaggcta

SEQ ID NO: 497711 - DNA, 25 bp, Mus musculus
gagtgtcttcagtaattggaggcta

SEQ ID NO: 497712 - DNA, 25 bp, Mus musculus
gagtgtcttctcagttacatcattt

SEQ ID NO: 497713 - DNA, 25 bp, Mus musculus
gagtgtcttctctgttacatcattt

SEQ ID NO: 497714 - DNA, 25 bp, Mus musculus
gagtgtcttgctaagtgtttgccaa

SEQ ID NO: 497715 - DNA, 25 bp, Mus musculus
gagtgtcttgcttagtgtttgccaa

SEQ ID NO: 497716 - DNA, 25 bp, Mus musculus
gagtgtcttgtcacggtttggactt

SEQ ID NO: 497717 - DNA, 25 bp, Mus musculus
gagtgtcttgtctcggtttggactt

SEQ ID NO: 497718 - DNA, 25 bp, Mus musculus
gagtgtctttctctccctagctcca

SEQ ID NO: 497719 - DNA, 25 bp, Mus musculus
gagtgtctttctgtccctagctcca

SEQ ID NO: 497720 - DNA, 25 bp, Mus musculus
gagtgtgaaagcctacatatccttc

SEQ ID NO: 497721 - DNA, 25 bp, Mus musculus
gagtgtgaaagcgtacatatccttc

SEQ ID NO: 497722 - DNA, 25 bp, Mus musculus
gagtgtgaacatacccagtatcctt

SEQ ID NO: 497723 - DNA, 25 bp, Mus musculus
gagtgtgaacatcgcactgctgttc

SEQ ID NO: 497724 - DNA, 25 bp, Mus musculus
gagtgtgaacatggcactgctgttc

SEQ ID NO: 497725 - DNA, 25 bp, Mus musculus
gagtgtgaacattcccagtatcctt

SEQ ID NO: 497726 - DNA, 25 bp, Mus musculus
gagtgtgaaccaaggactccgaggt

SEQ ID NO: 497727 - DNA, 25 bp, Mus musculus
gagtgtgaaccatggactccgaggt

SEQ ID NO: 497728 - DNA, 25 bp, Mus musculus
gagtgtgaacttactgtagtctcta

SEQ ID NO: 497729 - DNA, 25 bp, Mus musculus
gagtgtgaactttctgtagtctcta

SEQ ID NO: 497730 - DNA, 25 bp, Mus musculus
gagtgtgaagctcaccagctcgcga

SEQ ID NO: 497731 - DNA, 25 bp, Mus musculus
gagtgtgaagctgaccagctcgcga

SEQ ID NO: 497732 - DNA, 25 bp, Mus musculus
gagtgtgaaggcagctttggttaca

SEQ ID NO: 497733 - DNA, 25 bp, Mus musculus
gagtgtgaaggctgctttggttaca

SEQ ID NO: 497734 - DNA, 25 bp, Mus musculus
gagtgtgacagtattatgcttttca

SEQ ID NO: 497735 - DNA, 25 bp, Mus musculus
gagtgtgacagttttatgcttttca

SEQ ID NO: 497736 - DNA, 25 bp, Mus musculus
gagtgtgacatgagtttgtgactac

SEQ ID NO: 497737 - DNA, 25 bp, Mus musculus
gagtgtgacatgtgtttgtgactac

SEQ ID NO: 497738 - DNA, 25 bp, Mus musculus
gagtgtgaccccaacaaggataagc

SEQ ID NO: 497739 - DNA, 25 bp, Mus musculus
gagtgtgacccctacaaggataagc

SEQ ID NO: 497740 - DNA, 25 bp, Mus musculus
gagtgtgaccttaggaagtacttcc

SEQ ID NO: 497741 - DNA, 25 bp, Mus musculus
gagtgtgacctttggaagtacttcc

SEQ ID NO: 497742 - DNA, 25 bp, Mus musculus
gagtgtgactcccaccgcaagggaa

SEQ ID NO: 497743 - DNA, 25 bp, Mus musculus
gagtgtgactccgaccgcaagggaa

SEQ ID NO: 497744 - DNA, 25 bp, Mus musculus
gagtgtgagcctaagcctagtcagc

SEQ ID NO: 497745 - DNA, 25 bp, Mus musculus
gagtgtgagccttagcctagtcagc

SEQ ID NO: 497746 - DNA, 25 bp, Mus musculus
gagtgtgaggccatcatttgcaact

SEQ ID NO: 497747 - DNA, 25 bp, Mus musculus
gagtgtgaggccttcatttgcaact

SEQ ID NO: 497748 - DNA, 25 bp, Mus musculus
gagtgtgagtgaacttgtcctgtac

SEQ ID NO: 497749 - DNA, 25 bp, Mus musculus
gagtgtgagtgatcttgtcctgtac

SEQ ID NO: 497750 - DNA, 25 bp, Mus musculus
gagtgtgatcccagaacacatggta

SEQ ID NO: 497751 - DNA, 25 bp, Mus musculus
gagtgtgatccctgaacacatggta

SEQ ID NO: 497752 - DNA, 25 bp, Mus musculus
gagtgtgatcctactggcgcaatgt

SEQ ID NO: 497753 - DNA, 25 bp, Mus musculus
gagtgtgatccttctggcgcaatgt

SEQ ID NO: 497754 - DNA, 25 bp, Mus musculus
gagtgtgatgtcagcatgaaaagat

SEQ ID NO: 497755 - DNA, 25 bp, Mus musculus
gagtgtgatgtctgcatgaaaagat

SEQ ID NO: 497756 - DNA, 25 bp, Mus musculus
gagtgtgattctcctgaaacagcaa

SEQ ID NO: 497757 - DNA, 25 bp, Mus musculus
gagtgtgattctgctgaaacagcaa

SEQ ID NO: 497758 - DNA, 25 bp, Mus musculus
gagtgtgcaacacctgtgtttttac

SEQ ID NO: 497759 - DNA, 25 bp, Mus musculus
gagtgtgcaacagctgtgtttttac

SEQ ID NO: 497760 - DNA, 25 bp, Mus musculus
gagtgtgcaagaaccttctgggata

SEQ ID NO: 497761 - DNA, 25 bp, Mus musculus
gagtgtgcaagatccttctgggata

SEQ ID NO: 497762 - DNA, 25 bp, Mus musculus
gagtgtgcactcagtcataatgaat

SEQ ID NO: 497763 - DNA, 25 bp, Mus musculus
gagtgtgcactctgtcataatgaat

SEQ ID NO: 497764 - DNA, 25 bp, Mus musculus
gagtgtgcagacatcttgatccagc

SEQ ID NO: 497765 - DNA, 25 bp, Mus musculus
gagtgtgcagacttcttgatccagc

SEQ ID NO: 497766 - DNA, 25 bp, Mus musculus
gagtgtgcagagagccgtaccacaa

SEQ ID NO: 497767 - DNA, 25 bp, Mus musculus
gagtgtgcagagtgccgtaccacaa

SEQ ID NO: 497768 - DNA, 25 bp, Mus musculus
gagtgtgcagcacaaatcgcttcac

SEQ ID NO: 497769 - DNA, 25 bp, Mus musculus
gagtgtgcagcagaaatcgcttcac

SEQ ID NO: 497770 - DNA, 25 bp, Mus musculus
gagtgtgccaaaaccgagagtgaag

SEQ ID NO: 497771 - DNA, 25 bp, Mus musculus
gagtgtgccaaatccgagagtgaag

SEQ ID NO: 497772 - DNA, 25 bp, Mus musculus
gagtgtgccagcaagtgtgcctgat

SEQ ID NO: 497773 - DNA, 25 bp, Mus musculus
gagtgtgccagctagtgtgcctgat

SEQ ID NO: 497774 - DNA, 25 bp, Mus musculus
gagtgtgccccgaggtctaaagata

SEQ ID NO: 497775 - DNA, 25 bp, Mus musculus
gagtgtgccccgtggtctaaagata

SEQ ID NO: 497776 - DNA, 25 bp, Mus musculus
gagtgtgccgacctactgtccagtg

SEQ ID NO: 497777 - DNA, 25 bp, Mus musculus
gagtgtgccgacgtactgtccagtg

SEQ ID NO: 497778 - DNA, 25 bp, Mus musculus
gagtgtgcctctagaacctgtatat

SEQ ID NO: 497779 - DNA, 25 bp, Mus musculus
gagtgtgcctcttgaacctgtatat

SEQ ID NO: 497780 - DNA, 25 bp, Mus musculus
gagtgtgcgcagaatccagcagtga

SEQ ID NO: 497781 - DNA, 25 bp, Mus musculus
gagtgtgcgcagtatccagcagtga

SEQ ID NO: 497782 - DNA, 25 bp, Mus musculus
gagtgtgcggatatcctactttcaa

SEQ ID NO: 497783 - DNA, 25 bp, Mus musculus
gagtgtgcggatttcctactttcaa

SEQ ID NO: 497784 - DNA, 25 bp, Mus musculus
gagtgtgcgtatcagacttcttaaa

SEQ ID NO: 497785 - DNA, 25 bp, Mus musculus
gagtgtgcgtatgagacttcttaaa

SEQ ID NO: 497786 - DNA, 25 bp, Mus musculus
gagtgtgctcaacggttctgtctgc

SEQ ID NO: 497787 - DNA, 25 bp, Mus musculus
gagtgtgctcaagggttctgtctgc

SEQ ID NO: 497788 - DNA, 25 bp, Mus musculus
gagtgtgctcagcatagttgcctgc

SEQ ID NO: 497789 - DNA, 25 bp, Mus musculus
gagtgtgctcaggatagttgcctgc

SEQ ID NO: 497790 - DNA, 25 bp, Mus musculus
gagtgtgctcatcagacttgcgtct

SEQ ID NO: 497791 - DNA, 25 bp, Mus musculus
gagtgtgctcatgagacttgcgtct

SEQ ID NO: 497792 - DNA, 25 bp, Mus musculus
gagtgtgctctccaaatgtacttca

SEQ ID NO: 497793 - DNA, 25 bp, Mus musculus
gagtgtgctctcgaaatgtacttca

SEQ ID NO: 497794 - DNA, 25 bp, Mus musculus
gagtgtgctctgcttgtacagtgta

SEQ ID NO: 497795 - DNA, 25 bp, Mus musculus
gagtgtgctctggttgtacagtgta

SEQ ID NO: 497796 - DNA, 25 bp, Mus musculus
gagtgtgctgaaatgtgccgcctcc

SEQ ID NO: 497797 - DNA, 25 bp, Mus musculus
gagtgtgctgaattgtgccgcctcc

SEQ ID NO: 497798 - DNA, 25 bp, Mus musculus
gagtgtgctggcaaagctttctgaa

SEQ ID NO: 497799 - DNA, 25 bp, Mus musculus
gagtgtgctggctaagctttctgaa

SEQ ID NO: 497800 - DNA, 25 bp, Mus musculus
gagtgtgctgttatcttagtgagag

SEQ ID NO: 497801 - DNA, 25 bp, Mus musculus
gagtgtgctgttttcttagtgagag

SEQ ID NO: 497802 - DNA, 25 bp, Mus musculus
gagtgtgctttcatttgaatctcag

SEQ ID NO: 497803 - DNA, 25 bp, Mus musculus
gagtgtgctttcttttgaatctcag

SEQ ID NO: 497804 - DNA, 25 bp, Mus musculus
gagtgtggattcaagcagcagagct

SEQ ID NO: 497805 - DNA, 25 bp, Mus musculus
gagtgtggattctagcagcagagct

SEQ ID NO: 497806 - DNA, 25 bp, Mus musculus
gagtgtggcaagctagaatcacccc

SEQ ID NO: 497807 - DNA, 25 bp, Mus musculus
gagtgtggcaaggtagaatcacccc

SEQ ID NO: 497808 - DNA, 25 bp, Mus musculus
gagtgtggccataaagtctgtctgt

SEQ ID NO: 497809 - DNA, 25 bp, Mus musculus
gagtgtggccatccctaaagcgagc

SEQ ID NO: 497810 - DNA, 25 bp, Mus musculus
gagtgtggccatgcctaaagcgagc

SEQ ID NO: 497811 - DNA, 25 bp, Mus musculus
gagtgtggccattaagtctgtctgt

SEQ ID NO: 497812 - DNA, 25 bp, Mus musculus
gagtgtggctataacatatgtccta

SEQ ID NO: 497813 - DNA, 25 bp, Mus musculus
gagtgtggctattacatatgtccta

SEQ ID NO: 497814 - DNA, 25 bp, Mus musculus
gagtgtgggccgcagcagtcaggag

SEQ ID NO: 497815 - DNA, 25 bp, Mus musculus
gagtgtgggccggagcagtcaggag

SEQ ID NO: 497816 - DNA, 25 bp, Mus musculus
gagtgtggtcacagaggagttcaat

SEQ ID NO: 497817 - DNA, 25 bp, Mus musculus
gagtgtggtcactgaggagttcaat

SEQ ID NO: 497818 - DNA, 25 bp, Mus musculus
gagtgtgtacaaccttggccctgtg

SEQ ID NO: 497819 - DNA, 25 bp, Mus musculus
gagtgtgtacaagcttggccctgtg

SEQ ID NO: 497820 - DNA, 25 bp, Mus musculus
gagtgtgtacacagctggttcggtt

SEQ ID NO: 497821 - DNA, 25 bp, Mus musculus
gagtgtgtacactgctggttcggtt

SEQ ID NO: 497822 - DNA, 25 bp, Mus musculus
gagtgtgtactcatggtgggaacaa

SEQ ID NO: 497823 - DNA, 25 bp, Mus musculus
gagtgtgtactcttggtgggaacaa

SEQ ID NO: 497824 - DNA, 25 bp, Mus musculus
gagtgtgtataccatcatcccattt

SEQ ID NO: 497825 - DNA, 25 bp, Mus musculus
gagtgtgtatacgatcatcccattt

SEQ ID NO: 497826 - DNA, 25 bp, Mus musculus
gagtgtgtcaatatctttccatcac

SEQ ID NO: 497827 - DNA, 25 bp, Mus musculus
gagtgtgtcaatttctttccatcac

SEQ ID NO: 497828 - DNA, 25 bp, Mus musculus
gagtgtgtcagtaagcacccaaggg

SEQ ID NO: 497829 - DNA, 25 bp, Mus musculus
gagtgtgtcagtagctatctgtgta

SEQ ID NO: 497830 - DNA, 25 bp, Mus musculus
gagtgtgtcagttagcacccaaggg

SEQ ID NO: 497831 - DNA, 25 bp, Mus musculus
gagtgtgtcagttgctatctgtgta

SEQ ID NO: 497832 - DNA, 25 bp, Mus musculus
gagtgtgtccataaaagattctatt

SEQ ID NO: 497833 - DNA, 25 bp, Mus musculus
gagtgtgtccattaaagattctatt

SEQ ID NO: 497834 - DNA, 25 bp, Mus musculus
gagtgtgtccccacatgaatgatga

SEQ ID NO: 497835 - DNA, 25 bp, Mus musculus
gagtgtgtcccctcatgaatgatga

SEQ ID NO: 497836 - DNA, 25 bp, Mus musculus
gagtgtgtctctcctaaacatgcca

SEQ ID NO: 497837 - DNA, 25 bp, Mus musculus
gagtgtgtctctgctaaacatgcca

SEQ ID NO: 497838 - DNA, 25 bp, Mus musculus
gagtgtgtctgacctacaggttctg

SEQ ID NO: 497839 - DNA, 25 bp, Mus musculus
gagtgtgtctgagctacaggttctg

SEQ ID NO: 497840 - DNA, 25 bp, Mus musculus
gagtgtgtgacacctgctcaaataa

SEQ ID NO: 497841 - DNA, 25 bp, Mus musculus
gagtgtgtgacagctgctcaaataa

SEQ ID NO: 497842 - DNA, 25 bp, Mus musculus
gagtgtgtgactctcatggtttcaa

SEQ ID NO: 497843 - DNA, 25 bp, Mus musculus
gagtgtgtgactgtcatggtttcaa

SEQ ID NO: 497844 - DNA, 25 bp, Mus musculus
gagtgtgtgtatacgcatccctgaa

SEQ ID NO: 497845 - DNA, 25 bp, Mus musculus
gagtgtgtgtattcgcatccctgaa

SEQ ID NO: 497846 - DNA, 25 bp, Mus musculus
gagtgtgtgttcattcacatcctaa

SEQ ID NO: 497847 - DNA, 25 bp, Mus musculus
gagtgtgtgttcctatgcatgtgca

SEQ ID NO: 497848 - DNA, 25 bp, Mus musculus
gagtgtgtgttcgtatgcatgtgca

SEQ ID NO: 497849 - DNA, 25 bp, Mus musculus
gagtgtgtgttctttcacatcctaa

SEQ ID NO: 497850 - DNA, 25 bp, Mus musculus
gagtgtgtgttgcaattatctctgc

SEQ ID NO: 497851 - DNA, 25 bp, Mus musculus
gagtgtgtgttggaattatctctgc

SEQ ID NO: 497852 - DNA, 25 bp, Mus musculus
gagtgtgttaacagttttgccaagg

SEQ ID NO: 497853 - DNA, 25 bp, Mus musculus
gagtgtgttaactgttttgccaagg

SEQ ID NO: 497854 - DNA, 25 bp, Mus musculus
gagtgtgttaccaaagacctgtcct

SEQ ID NO: 497855 - DNA, 25 bp, Mus musculus
gagtgtgttacctaagacctgtcct

SEQ ID NO: 497856 - DNA, 25 bp, Mus musculus
gagtgtgttcccatgtaggaggtaa

SEQ ID NO: 497857 - DNA, 25 bp, Mus musculus
gagtgtgttcccttgtaggaggtaa

SEQ ID NO: 497858 - DNA, 25 bp, Mus musculus
gagtgtgttctgcatggattcacca

SEQ ID NO: 497859 - DNA, 25 bp, Mus musculus
gagtgtgttctggatggattcacca

SEQ ID NO: 497860 - DNA, 25 bp, Mus musculus
gagtgtgttgttcctagtgacacct

SEQ ID NO: 497861 - DNA, 25 bp, Mus musculus
gagtgtgttgttgctagtgacacct

SEQ ID NO: 497862 - DNA, 25 bp, Mus musculus
gagtgtgtttgactctagtccctgc

SEQ ID NO: 497863 - DNA, 25 bp, Mus musculus
gagtgtgtttgagtctagtccctgc

SEQ ID NO: 497864 - DNA, 25 bp, Mus musculus
gagtgtgttttgactagcctagact

SEQ ID NO: 497865 - DNA, 25 bp, Mus musculus
gagtgtgttttgtctagcctagact

SEQ ID NO: 497866 - DNA, 25 bp, Mus musculus
gagtgttaaaccagagaatcgcgag

SEQ ID NO: 497867 - DNA, 25 bp, Mus musculus
gagtgttaaacctgagaatcgcgag

SEQ ID NO: 497868 - DNA, 25 bp, Mus musculus
gagtgttaacacaactaaggctttc

SEQ ID NO: 497869 - DNA, 25 bp, Mus musculus
gagtgttaacactactaaggctttc

SEQ ID NO: 497870 - DNA, 25 bp, Mus musculus
gagtgttaatggaatctctcccctt

SEQ ID NO: 497871 - DNA, 25 bp, Mus musculus
gagtgttaatggtatctctcccctt

SEQ ID NO: 497872 - DNA, 25 bp, Mus musculus
gagtgttaattgaccacttcaggta

SEQ ID NO: 497873 - DNA, 25 bp, Mus musculus
gagtgttaattgtccacttcaggta

SEQ ID NO: 497874 - DNA, 25 bp, Mus musculus
gagtgttacaggactccttgttaca

SEQ ID NO: 497875 - DNA, 25 bp, Mus musculus
gagtgttacaggtctccttgttaca

SEQ ID NO: 497876 - DNA, 25 bp, Mus musculus
gagtgttaggacaacttgtctccaa

SEQ ID NO: 497877 - DNA, 25 bp, Mus musculus
gagtgttaggactacttgtctccaa

SEQ ID NO: 497878 - DNA, 25 bp, Mus musculus
gagtgttaggttagggccttctcat

SEQ ID NO: 497879 - DNA, 25 bp, Mus musculus
gagtgttaggtttgggccttctcat

SEQ ID NO: 497880 - DNA, 25 bp, Mus musculus
gagtgttagtgtcctcaggctatgt

SEQ ID NO: 497881 - DNA, 25 bp, Mus musculus
gagtgttagtgtgctcaggctatgt

SEQ ID NO: 497882 - DNA, 25 bp, Mus musculus
gagtgttatcatacctgagggctga

SEQ ID NO: 497883 - DNA, 25 bp, Mus musculus
gagtgttatcattcctgagggctga

SEQ ID NO: 497884 - DNA, 25 bp, Mus musculus
gagtgttcacagcactaaatgcctc

SEQ ID NO: 497885 - DNA, 25 bp, Mus musculus
gagtgttcacaggactaaatgcctc

SEQ ID NO: 497886 - DNA, 25 bp, Mus musculus
gagtgttcactgatgtttacgattt

SEQ ID NO: 497887 - DNA, 25 bp, Mus musculus
gagtgttcactgttgtttacgattt

SEQ ID NO: 497888 - DNA, 25 bp, Mus musculus
gagtgttcatgaagcagctttcctg

SEQ ID NO: 497889 - DNA, 25 bp, Mus musculus
gagtgttcatgatgcagctttcctg

SEQ ID NO: 497890 - DNA, 25 bp, Mus musculus
gagtgttcattaaacctaatttcat

SEQ ID NO: 497891 - DNA, 25 bp, Mus musculus
gagtgttcattatacctaatttcat

SEQ ID NO: 497892 - DNA, 25 bp, Mus musculus
gagtgttcattcatccatcgcagcc

SEQ ID NO: 497893 - DNA, 25 bp, Mus musculus
gagtgttcattcttccatcgcagcc

SEQ ID NO: 497894 - DNA, 25 bp, Mus musculus
gagtgttccaacacacttactcaaa

SEQ ID NO: 497895 - DNA, 25 bp, Mus musculus
gagtgttccaactcacttactcaaa

SEQ ID NO: 497896 - DNA, 25 bp, Mus musculus
gagtgttccaggacctacaggtgca

SEQ ID NO: 497897 - DNA, 25 bp, Mus musculus
gagtgttccaggtcctacaggtgca

SEQ ID NO: 497898 - DNA, 25 bp, Mus musculus
gagtgttccagtattcctggtggtt

SEQ ID NO: 497899 - DNA, 25 bp, Mus musculus
gagtgttccagttttcctggtggtt

SEQ ID NO: 497900 - DNA, 25 bp, Mus musculus
gagtgttccatccttggtggcttcc

SEQ ID NO: 497901 - DNA, 25 bp, Mus musculus
gagtgttccatcgttggtggcttcc

SEQ ID NO: 497902 - DNA, 25 bp, Mus musculus
gagtgttccctgcaaatgagactta

SEQ ID NO: 497903 - DNA, 25 bp, Mus musculus
gagtgttccctggaaatgagactta

SEQ ID NO: 497904 - DNA, 25 bp, Mus musculus
gagtgttccgatccctctgtcgaag

SEQ ID NO: 497905 - DNA, 25 bp, Mus musculus
gagtgttccgatgcctctgtcgaag

SEQ ID NO: 497906 - DNA, 25 bp, Mus musculus
gagtgttcctaacagttgtgagcaa

SEQ ID NO: 497907 - DNA, 25 bp, Mus musculus
gagtgttcctaagagttgtgagcaa

SEQ ID NO: 497908 - DNA, 25 bp, Mus musculus
gagtgttcctatccaatcaatcttg

SEQ ID NO: 497909 - DNA, 25 bp, Mus musculus
gagtgttcctatgcaatcaatcttg

SEQ ID NO: 497910 - DNA, 25 bp, Mus musculus
gagtgttccttcccctgaattcatt

SEQ ID NO: 497911 - DNA, 25 bp, Mus musculus
gagtgttccttcgcctgaattcatt

SEQ ID NO: 497912 - DNA, 25 bp, Mus musculus
gagtgttcctttattaataactgtg

SEQ ID NO: 497913 - DNA, 25 bp, Mus musculus
gagtgttccttttttaataactgtg

SEQ ID NO: 497914 - DNA, 25 bp, Mus musculus
gagtgttctatcacccacaattcca

SEQ ID NO: 497915 - DNA, 25 bp, Mus musculus
gagtgttctatctcccacaattcca

SEQ ID NO: 497916 - DNA, 25 bp, Mus musculus
gagtgttctgctctagcattttgga

SEQ ID NO: 497917 - DNA, 25 bp, Mus musculus
gagtgttctgctgtagcattttgga

SEQ ID NO: 497918 - DNA, 25 bp, Mus musculus
gagtgttctgttctatgcattaagc

SEQ ID NO: 497919 - DNA, 25 bp, Mus musculus
gagtgttctgttgtatgcattaagc

SEQ ID NO: 497920 - DNA, 25 bp, Mus musculus
gagtgttcttagacacctaggtgtt

SEQ ID NO: 497921 - DNA, 25 bp, Mus musculus
gagtgttcttagctaccgaggcatc

SEQ ID NO: 497922 - DNA, 25 bp, Mus musculus
gagtgttcttaggtaccgaggcatc

SEQ ID NO: 497923 - DNA, 25 bp, Mus musculus
gagtgttcttagtcacctaggtgtt

SEQ ID NO: 497924 - DNA, 25 bp, Mus musculus
gagtgttcttatacagaatgaccac

SEQ ID NO: 497925 - DNA, 25 bp, Mus musculus
gagtgttcttattcagaatgaccac

SEQ ID NO: 497926 - DNA, 25 bp, Mus musculus
gagtgttcttgacttatcttgtaca

SEQ ID NO: 497927 - DNA, 25 bp, Mus musculus
gagtgttcttgagttatcttgtaca

SEQ ID NO: 497928 - DNA, 25 bp, Mus musculus
gagtgttctttactatctacttctg

SEQ ID NO: 497929 - DNA, 25 bp, Mus musculus
gagtgttctttagtatctacttctg

SEQ ID NO: 497930 - DNA, 25 bp, Mus musculus
gagtgttgaatgatgcctagatagt

SEQ ID NO: 497931 - DNA, 25 bp, Mus musculus
gagtgttgaatgttgcctagatagt

SEQ ID NO: 497932 - DNA, 25 bp, Mus musculus
gagtgttgacagaaatgcagccaca

SEQ ID NO: 497933 - DNA, 25 bp, Mus musculus
gagtgttgacagtaatgcagccaca

SEQ ID NO: 497934 - DNA, 25 bp, Mus musculus
gagtgttgactcaggtgaccatgtc

SEQ ID NO: 497935 - DNA, 25 bp, Mus musculus
gagtgttgactctggtgaccatgtc

SEQ ID NO: 497936 - DNA, 25 bp, Mus musculus
gagtgttgacttccggctaaaacct

SEQ ID NO: 497937 - DNA, 25 bp, Mus musculus
gagtgttgacttgcggctaaaacct

SEQ ID NO: 497938 - DNA, 25 bp, Mus musculus
gagtgttgagtgatcatccatagac

SEQ ID NO: 497939 - DNA, 25 bp, Mus musculus
gagtgttgagtgcattcagacagac

SEQ ID NO: 497940 - DNA, 25 bp, Mus musculus
gagtgttgagtggattcagacagac

SEQ ID NO: 497941 - DNA, 25 bp, Mus musculus
gagtgttgagtgttcatccatagac

SEQ ID NO: 497942 - DNA, 25 bp, Mus musculus
gagtgttgcagaacgagcctcgctg

SEQ ID NO: 497943 - DNA, 25 bp, Mus musculus
gagtgttgcagatcgagcctcgctg

SEQ ID NO: 497944 - DNA, 25 bp, Mus musculus
gagtgttgcattaaattccaagaaa

SEQ ID NO: 497945 - DNA, 25 bp, Mus musculus
gagtgttgcatttaattccaagaaa

SEQ ID NO: 497946 - DNA, 25 bp, Mus musculus
gagtgttgcctaacagatcggctct

SEQ ID NO: 497947 - DNA, 25 bp, Mus musculus
gagtgttgcctatcagatcggctct

SEQ ID NO: 497948 - DNA, 25 bp, Mus musculus
gagtgttgcgttaatctggtagtct

SEQ ID NO: 497949 - DNA, 25 bp, Mus musculus
gagtgttgcgtttatctggtagtct

SEQ ID NO: 497950 - DNA, 25 bp, Mus musculus
gagtgttggaaaccacaccctggtt

SEQ ID NO: 497951 - DNA, 25 bp, Mus musculus
gagtgttggaaagcacaccctggtt

SEQ ID NO: 497952 - DNA, 25 bp, Mus musculus
gagtgttggacccagaggtcaccca

SEQ ID NO: 497953 - DNA, 25 bp, Mus musculus
gagtgttggaccgagaggtcaccca

SEQ ID NO: 497954 - DNA, 25 bp, Mus musculus
gagtgttggcaaccttcatttgtaa

SEQ ID NO: 497955 - DNA, 25 bp, Mus musculus
gagtgttggcaagcttcatttgtaa

SEQ ID NO: 497956 - DNA, 25 bp, Mus musculus
gagtgttgttccctgagattctctt

SEQ ID NO: 497957 - DNA, 25 bp, Mus musculus
gagtgttgttccgtgagattctctt

SEQ ID NO: 497958 - DNA, 25 bp, Mus musculus
gagtgttgtttcctcttaattaggc

SEQ ID NO: 497959 - DNA, 25 bp, Mus musculus
gagtgttgtttcgtcttaattaggc

SEQ ID NO: 497960 - DNA, 25 bp, Mus musculus
gagtgtttactgattcttaataggt

SEQ ID NO: 497961 - DNA, 25 bp, Mus musculus
gagtgtttactgtttcttaataggt

SEQ ID NO: 497962 - DNA, 25 bp, Mus musculus
gagtgtttagcaagagtggtttgcc

SEQ ID NO: 497963 - DNA, 25 bp, Mus musculus
gagtgtttagcatgagtggtttgcc

SEQ ID NO: 497964 - DNA, 25 bp, Mus musculus
gagtgtttatccactcacacccttt

SEQ ID NO: 497965 - DNA, 25 bp, Mus musculus
gagtgtttatcctctcacacccttt

SEQ ID NO: 497966 - DNA, 25 bp, Mus musculus
gagtgtttcattcagcccatgtcat

SEQ ID NO: 497967 - DNA, 25 bp, Mus musculus
gagtgtttcattgagcccatgtcat

SEQ ID NO: 497968 - DNA, 25 bp, Mus musculus
gagtgtttccaaagtggcccttcaa

SEQ ID NO: 497969 - DNA, 25 bp, Mus musculus
gagtgtttccaatgtggcccttcaa

SEQ ID NO: 497970 - DNA, 25 bp, Mus musculus
gagtgtttccttaaagtggatacag

SEQ ID NO: 497971 - DNA, 25 bp, Mus musculus
gagtgtttcctttaagtggatacag

SEQ ID NO: 497972 - DNA, 25 bp, Mus musculus
gagtgtttctgtatggactgaacga

SEQ ID NO: 497973 - DNA, 25 bp, Mus musculus
gagtgtttctgtttggactgaacga

SEQ ID NO: 497974 - DNA, 25 bp, Mus musculus
gagtgtttgagccataacctgcccc

SEQ ID NO: 497975 - DNA, 25 bp, Mus musculus
gagtgtttgagcgataacctgcccc

SEQ ID NO: 497976 - DNA, 25 bp, Mus musculus
gagtgtttgcctacatcatgactat

SEQ ID NO: 497977 - DNA, 25 bp, Mus musculus
gagtgtttgccttcatcatgactat

SEQ ID NO: 497978 - DNA, 25 bp, Mus musculus
gagtgtttgtccctgtcaccggcaa

SEQ ID NO: 497979 - DNA, 25 bp, Mus musculus
gagtgtttgtccgtgtcaccggcaa

SEQ ID NO: 497980 - DNA, 25 bp, Mus musculus
gagtgtttgtttagtgggagccttc

SEQ ID NO: 497981 - DNA, 25 bp, Mus musculus
gagtgtttgttttgtgggagccttc

SEQ ID NO: 497982 - DNA, 25 bp, Mus musculus
gagtgttttaaacggcttcatgtga

SEQ ID NO: 497983 - DNA, 25 bp, Mus musculus
gagtgttttaaagggcttcatgtga

SEQ ID NO: 497984 - DNA, 25 bp, Mus musculus
gagtgttttacaagctgtctggaaa

SEQ ID NO: 497985 - DNA, 25 bp, Mus musculus
gagtgttttacacctgaactttttg

SEQ ID NO: 497986 - DNA, 25 bp, Mus musculus
gagtgttttacagctgaactttttg

SEQ ID NO: 497987 - DNA, 25 bp, Mus musculus
gagtgttttacatgctgtctggaaa

SEQ ID NO: 497988 - DNA, 25 bp, Mus musculus
gagtgttttagtccgagtcctaata

SEQ ID NO: 497989 - DNA, 25 bp, Mus musculus
gagtgttttagtgcgagtcctaata

SEQ ID NO: 497990 - DNA, 25 bp, Mus musculus
gagtgttttcataccacagtggcaa

SEQ ID NO: 497991 - DNA, 25 bp, Mus musculus
gagtgttttcattccacagtggcaa

SEQ ID NO: 497992 - DNA, 25 bp, Mus musculus
gagtgttttcctaagatctttcttt

SEQ ID NO: 497993 - DNA, 25 bp, Mus musculus
gagtgttttcctaggctattagttt

SEQ ID NO: 497994 - DNA, 25 bp, Mus musculus
gagtgttttccttagatctttcttt

SEQ ID NO: 497995 - DNA, 25 bp, Mus musculus
gagtgttttccttggctattagttt

SEQ ID NO: 497996 - DNA, 25 bp, Mus musculus
gagtgttttctaaggcagagatggt

SEQ ID NO: 497997 - DNA, 25 bp, Mus musculus
gagtgttttctacggttctccttag

SEQ ID NO: 497998 - DNA, 25 bp, Mus musculus
gagtgttttctagggttctccttag

SEQ ID NO: 497999 - DNA, 25 bp, Mus musculus
gagtgttttctatggcagagatggt

SEQ ID NO: 498000 - DNA, 25 bp, Mus musculus
gagtgttttctgagcagcggctgca

SEQ ID NO: 498001 - DNA, 25 bp, Mus musculus
gagtgttttctgatgccatgtcagt

SEQ ID NO: 498002 - DNA, 25 bp, Mus musculus
gagtgttttctgtgcagcggctgca

SEQ ID NO: 498003 - DNA, 25 bp, Mus musculus
gagtgttttctgttgccatgtcagt

SEQ ID NO: 498004 - DNA, 25 bp, Mus musculus
gagtgttttggtcgacagtttgcct

SEQ ID NO: 498005 - DNA, 25 bp, Mus musculus
gagtgttttggtggacagtttgcct

SEQ ID NO: 498006 - DNA, 25 bp, Mus musculus
gagtgttttgtgctcttgaaatgta

SEQ ID NO: 498007 - DNA, 25 bp, Mus musculus
gagtgttttgtggtcttgaaatgta

SEQ ID NO: 498008 - DNA, 25 bp, Mus musculus
gagtgtttttaaacacaagaccaga

SEQ ID NO: 498009 - DNA, 25 bp, Mus musculus
gagtgtttttaatcacaagaccaga

SEQ ID NO: 498010 - DNA, 25 bp, Mus musculus
gagtgttttttaatctgaggtccta

SEQ ID NO: 498011 - DNA, 25 bp, Mus musculus
gagtgttttttattctgaggtccta

SEQ ID NO: 498012 - DNA, 25 bp, Mus musculus
gagttaaaaaatctccccaggtgtg

SEQ ID NO: 498013 - DNA, 25 bp, Mus musculus
gagttaaaaaatgtccccaggtgtg

SEQ ID NO: 498014 - DNA, 25 bp, Mus musculus
gagttaaaaatcattccgattccct

SEQ ID NO: 498015 - DNA, 25 bp, Mus musculus
gagttaaaaatctttccgattccct

SEQ ID NO: 498016 - DNA, 25 bp, Mus musculus
gagttaaaacctactccagctctat

SEQ ID NO: 498017 - DNA, 25 bp, Mus musculus
gagttaaaaccttctccagctctat

SEQ ID NO: 498018 - DNA, 25 bp, Mus musculus
gagttaaaagtacacatgctggatc

SEQ ID NO: 498019 - DNA, 25 bp, Mus musculus
gagttaaaagtagacatgctggatc

SEQ ID NO: 498020 - DNA, 25 bp, Mus musculus
gagttaaacggcatttcttatatat

SEQ ID NO: 498021 - DNA, 25 bp, Mus musculus
gagttaaacggcttttcttatatat

SEQ ID NO: 498022 - DNA, 25 bp, Mus musculus
gagttaaacgttcaggcacccagat

SEQ ID NO: 498023 - DNA, 25 bp, Mus musculus
gagttaaacgttgaggcacccagat

SEQ ID NO: 498024 - DNA, 25 bp, Mus musculus
gagttaaactttctgttggcgccgg

SEQ ID NO: 498025 - DNA, 25 bp, Mus musculus
gagttaaactttgtgttggcgccgg

SEQ ID NO: 498026 - DNA, 25 bp, Mus musculus
gagttaaaggacaactcttttgctg

SEQ ID NO: 498027 - DNA, 25 bp, Mus musculus
gagttaaaggactactcttttgctg

SEQ ID NO: 498028 - DNA, 25 bp, Mus musculus
gagttaaagtacacccatcctcctt

SEQ ID NO: 498029 - DNA, 25 bp, Mus musculus
gagttaaagtactcccatcctcctt

SEQ ID NO: 498030 - DNA, 25 bp, Mus musculus
gagttaaagtgcacagatgctgatg

SEQ ID NO: 498031 - DNA, 25 bp, Mus musculus
gagttaaagtgctcagatgctgatg

SEQ ID NO: 498032 - DNA, 25 bp, Mus musculus
gagttaaagtgtaggtccaggctaa

SEQ ID NO: 498033 - DNA, 25 bp, Mus musculus
gagttaaagtgttggtccaggctaa

SEQ ID NO: 498034 - DNA, 25 bp, Mus musculus
gagttaaatgtcagtgtggtctaca

SEQ ID NO: 498035 - DNA, 25 bp, Mus musculus
gagttaaatgtctgtgtggtctaca

SEQ ID NO: 498036 - DNA, 25 bp, Mus musculus
gagttaacaatacgacctctcattt

SEQ ID NO: 498037 - DNA, 25 bp, Mus musculus
gagttaacaataggacctctcattt

SEQ ID NO: 498038 - DNA, 25 bp, Mus musculus
gagttaacagttaccatgtatccgg

SEQ ID NO: 498039 - DNA, 25 bp, Mus musculus
gagttaacagtttccatgtatccgg

SEQ ID NO: 498040 - DNA, 25 bp, Mus musculus
gagttaacattcaggacaatccttt

SEQ ID NO: 498041 - DNA, 25 bp, Mus musculus
gagttaacattctggacaatccttt

SEQ ID NO: 498042 - DNA, 25 bp, Mus musculus
gagttaacattgatgccccaaggct

SEQ ID NO: 498043 - DNA, 25 bp, Mus musculus
gagttaacattgttgccccaaggct

SEQ ID NO: 498044 - DNA, 25 bp, Mus musculus
gagttaacatttaggtctctgctgt

SEQ ID NO: 498045 - DNA, 25 bp, Mus musculus
gagttaacattttggtctctgctgt

SEQ ID NO: 498046 - DNA, 25 bp, Mus musculus
gagttaacctgtactatgtcagcat

SEQ ID NO: 498047 - DNA, 25 bp, Mus musculus
gagttaacctgttctatgtcagcat

SEQ ID NO: 498048 - DNA, 25 bp, Mus musculus
gagttaacggatcgccatgggctac

SEQ ID NO: 498049 - DNA, 25 bp, Mus musculus
gagttaacggatggccatgggctac

SEQ ID NO: 498050 - DNA, 25 bp, Mus musculus
gagttaacgtaactgacgcttacaa

SEQ ID NO: 498051 - DNA, 25 bp, Mus musculus
gagttaacgtaagtgacgcttacaa

SEQ ID NO: 498052 - DNA, 25 bp, Mus musculus
gagttaactctcaattctggctgtt

SEQ ID NO: 498053 - DNA, 25 bp, Mus musculus
gagttaactctctattctggctgtt

SEQ ID NO: 498054 - DNA, 25 bp, Mus musculus
gagttaacttcaatacattggtaaa

SEQ ID NO: 498055 - DNA, 25 bp, Mus musculus
gagttaacttcattacattggtaaa

SEQ ID NO: 498056 - DNA, 25 bp, Mus musculus
gagttaagaatacccatatcccgaa

SEQ ID NO: 498057 - DNA, 25 bp, Mus musculus
gagttaagaatagccatatcccgaa

SEQ ID NO: 498058 - DNA, 25 bp, Mus musculus
gagttaagagtcaccccaaaggctc

SEQ ID NO: 498059 - DNA, 25 bp, Mus musculus
gagttaagagtctccccaaaggctc

SEQ ID NO: 498060 - DNA, 25 bp, Mus musculus
gagttaagcatcacgtgacacgaag

SEQ ID NO: 498061 - DNA, 25 bp, Mus musculus
gagttaagcatctcgtgacacgaag

SEQ ID NO: 498062 - DNA, 25 bp, Mus musculus
gagttaaggcacctgctactaacct

SEQ ID NO: 498063 - DNA, 25 bp, Mus musculus
gagttaaggcacgtgctactaacct

SEQ ID NO: 498064 - DNA, 25 bp, Mus musculus
gagttaagtagcagccatgtatcat

SEQ ID NO: 498065 - DNA, 25 bp, Mus musculus
gagttaagtagctgccatgtatcat

SEQ ID NO: 498066 - DNA, 25 bp, Mus musculus
gagttaagtcatatacagcttcaaa

SEQ ID NO: 498067 - DNA, 25 bp, Mus musculus
gagttaagtcatttacagcttcaaa

SEQ ID NO: 498068 - DNA, 25 bp, Mus musculus
gagttaagtggcagagacaccagaa

SEQ ID NO: 498069 - DNA, 25 bp, Mus musculus
gagttaagtggctgagacaccagaa

SEQ ID NO: 498070 - DNA, 25 bp, Mus musculus
gagttaataaccacctgggttgaag

SEQ ID NO: 498071 - DNA, 25 bp, Mus musculus
gagttaataacctcctgggttgaag

SEQ ID NO: 498072 - DNA, 25 bp, Mus musculus
gagttaatcaacctccacgctgttc

SEQ ID NO: 498073 - DNA, 25 bp, Mus musculus
gagttaatcaacgtccacgctgttc

SEQ ID NO: 498074 - DNA, 25 bp, Mus musculus
gagttaatctcacctcaggcttgtg

SEQ ID NO: 498075 - DNA, 25 bp, Mus musculus
gagttaatctcagctcaggcttgtg

SEQ ID NO: 498076 - DNA, 25 bp, Mus musculus
gagttaatctccacaggctgtaggt

SEQ ID NO: 498077 - DNA, 25 bp, Mus musculus
gagttaatctcctcaggctgtaggt

SEQ ID NO: 498078 - DNA, 25 bp, Mus musculus
gagttaatctgaaagccaacatttg

SEQ ID NO: 498079 - DNA, 25 bp, Mus musculus
gagttaatctgatagccaacatttg

SEQ ID NO: 498080 - DNA, 25 bp, Mus musculus
gagttaatggccaaatcaatcccaa

SEQ ID NO: 498081 - DNA, 25 bp, Mus musculus
gagttaatggcctaatcaatcccaa

SEQ ID NO: 498082 - DNA, 25 bp, Mus musculus
gagttaatggcgcttctggaacaga

SEQ ID NO: 498083 - DNA, 25 bp, Mus musculus
gagttaatggcggttctggaacaga

SEQ ID NO: 498084 - DNA, 25 bp, Mus musculus
gagttaatgtctatcccttctgggt

SEQ ID NO: 498085 - DNA, 25 bp, Mus musculus
gagttaatgtctttcccttctgggt

SEQ ID NO: 498086 - DNA, 25 bp, Mus musculus
gagttaatgttactttttactctct

SEQ ID NO: 498087 - DNA, 25 bp, Mus musculus
gagttaatgttagtttttactctct

SEQ ID NO: 498088 - DNA, 25 bp, Mus musculus
gagttaattaacacttcagtggcta

SEQ ID NO: 498089 - DNA, 25 bp, Mus musculus
gagttaattaactcttcagtggcta

SEQ ID NO: 498090 - DNA, 25 bp, Mus musculus
gagttacaactcaggctttcgaaag

SEQ ID NO: 498091 - DNA, 25 bp, Mus musculus
gagttacaactctggctttcgaaag

SEQ ID NO: 498092 - DNA, 25 bp, Mus musculus
gagttacaagctagacaggtgctaa

SEQ ID NO: 498093 - DNA, 25 bp, Mus musculus
gagttacaagcttgacaggtgctaa

SEQ ID NO: 498094 - DNA, 25 bp, Mus musculus
gagttacaatcacaagaccttgggt

SEQ ID NO: 498095 - DNA, 25 bp, Mus musculus
gagttacaatcagaagaccttgggt

SEQ ID NO: 498096 - DNA, 25 bp, Mus musculus
gagttacaatggaggtctgtggcaa

SEQ ID NO: 498097 - DNA, 25 bp, Mus musculus
gagttacaatggtggtctgtggcaa

SEQ ID NO: 498098 - DNA, 25 bp, Mus musculus
gagttacacctcaagatcacctgga

SEQ ID NO: 498099 - DNA, 25 bp, Mus musculus
gagttacacctctagatcacctgga

SEQ ID NO: 498100 - DNA, 25 bp, Mus musculus
gagttacacggaacacagggtggat

SEQ ID NO: 498101 - DNA, 25 bp, Mus musculus
gagttacacggatcacagggtggat

SEQ ID NO: 498102 - DNA, 25 bp, Mus musculus
gagttacacgttagtttccagatac

SEQ ID NO: 498103 - DNA, 25 bp, Mus musculus
gagttacacgtttgtttccagatac

SEQ ID NO: 498104 - DNA, 25 bp, Mus musculus
gagttacagactccagcgtgtggca

SEQ ID NO: 498105 - DNA, 25 bp, Mus musculus
gagttacagactgcagcgtgtggca

SEQ ID NO: 498106 - DNA, 25 bp, Mus musculus
gagttacagagacagcaagctttat

SEQ ID NO: 498107 - DNA, 25 bp, Mus musculus
gagttacagagagagcaagctttat

SEQ ID NO: 498108 - DNA, 25 bp, Mus musculus
gagttacagagcaccaagtggatca

SEQ ID NO: 498109 - DNA, 25 bp, Mus musculus
gagttacagagctccaagtggatca

SEQ ID NO: 498110 - DNA, 25 bp, Mus musculus
gagttacagcttctcgggacgatgt

SEQ ID NO: 498111 - DNA, 25 bp, Mus musculus
gagttacagcttgtcgggacgatgt

SEQ ID NO: 498112 - DNA, 25 bp, Mus musculus
gagttacagggcatcaatcccgtgt

SEQ ID NO: 498113 - DNA, 25 bp, Mus musculus
gagttacagggcttcaatcccgtgt

SEQ ID NO: 498114 - DNA, 25 bp, Mus musculus
gagttacatatgatactgccctgaa

SEQ ID NO: 498115 - DNA, 25 bp, Mus musculus
gagttacatatgttactgccctgaa

SEQ ID NO: 498116 - DNA, 25 bp, Mus musculus
gagttacatctaaagtcttctgcca

SEQ ID NO: 498117 - DNA, 25 bp, Mus musculus
gagttacatctatagtcttctgcca

SEQ ID NO: 498118 - DNA, 25 bp, Mus musculus
gagttacatgaaagacaccagctaa

SEQ ID NO: 498119 - DNA, 25 bp, Mus musculus
gagttacatgaatgacaccagctaa

SEQ ID NO: 498120 - DNA, 25 bp, Mus musculus
gagttacatgtcaagttcttaggct

SEQ ID NO: 498121 - DNA, 25 bp, Mus musculus
gagttacatgtctagttcttaggct

SEQ ID NO: 498122 - DNA, 25 bp, Mus musculus
gagttacattttcacttttcccctg

SEQ ID NO: 498123 - DNA, 25 bp, Mus musculus
gagttacattttgacttttcccctg

SEQ ID NO: 498124 - DNA, 25 bp, Mus musculus
gagttaccaagcctgggccgagttt

SEQ ID NO: 498125 - DNA, 25 bp, Mus musculus
gagttaccaagcgtgggccgagttt

SEQ ID NO: 498126 - DNA, 25 bp, Mus musculus
gagttaccagacatcatccatttaa

SEQ ID NO: 498127 - DNA, 25 bp, Mus musculus
gagttaccagacttcatccatttaa

SEQ ID NO: 498128 - DNA, 25 bp, Mus musculus
gagttaccataaagggctctctccc

SEQ ID NO: 498129 - DNA, 25 bp, Mus musculus
gagttaccataatgggctctctccc

SEQ ID NO: 498130 - DNA, 25 bp, Mus musculus
gagttacccagcacagtcctggaag

SEQ ID NO: 498131 - DNA, 25 bp, Mus musculus
gagttacccagctcagtcctggaag

SEQ ID NO: 498132 - DNA, 25 bp, Mus musculus
gagttacccatacccctagagttag

SEQ ID NO: 498133 - DNA, 25 bp, Mus musculus
gagttacccatagccctagagttag

SEQ ID NO: 498134 - DNA, 25 bp, Mus musculus
gagttaccctgtctcagctgactgt

SEQ ID NO: 498135 - DNA, 25 bp, Mus musculus
gagttaccctgtgtcagctgactgt

SEQ ID NO: 498136 - DNA, 25 bp, Mus musculus
gagttaccgacccagaacaattctg

SEQ ID NO: 498137 - DNA, 25 bp, Mus musculus
gagttaccgaccgagaacaattctg

SEQ ID NO: 498138 - DNA, 25 bp, Mus musculus
gagttaccgagtctgtggctatcct

SEQ ID NO: 498139 - DNA, 25 bp, Mus musculus
gagttaccgagtgtgtggctatcct

SEQ ID NO: 498140 - DNA, 25 bp, Mus musculus
gagttacctatgagcctataaatct

SEQ ID NO: 498141 - DNA, 25 bp, Mus musculus
gagttacctatgtgcctataaatct

SEQ ID NO: 498142 - DNA, 25 bp, Mus musculus
gagttacctcagatcggttcagcga

SEQ ID NO: 498143 - DNA, 25 bp, Mus musculus
gagttacctcagttcggttcagcga

SEQ ID NO: 498144 - DNA, 25 bp, Mus musculus
gagttacctgcaagcctaaaggagt

SEQ ID NO: 498145 - DNA, 25 bp, Mus musculus
gagttacctgcatgcctaaaggagt

SEQ ID NO: 498146 - DNA, 25 bp, Mus musculus
gagttacctgtactttatgatgcaa

SEQ ID NO: 498147 - DNA, 25 bp, Mus musculus
gagttacctgtagtttatgatgcaa

SEQ ID NO: 498148 - DNA, 25 bp, Mus musculus
gagttacgacggctcgaggaccttt

SEQ ID NO: 498149 - DNA, 25 bp, Mus musculus
gagttacgacgggtcgaggaccttt

SEQ ID NO: 498150 - DNA, 25 bp, Mus musculus
gagttacgacttcatttatcttaaa

SEQ ID NO: 498151 - DNA, 25 bp, Mus musculus
gagttacgacttgatttatcttaaa

SEQ ID NO: 498152 - DNA, 25 bp, Mus musculus
gagttacgagtgagccaactttgga

SEQ ID NO: 498153 - DNA, 25 bp, Mus musculus
gagttacgagtgtgccaactttgga

SEQ ID NO: 498154 - DNA, 25 bp, Mus musculus
gagttacgcaagctgcacagataat

SEQ ID NO: 498155 - DNA, 25 bp, Mus musculus
gagttacgcaaggtgcacagataat

SEQ ID NO: 498156 - DNA, 25 bp, Mus musculus
gagttactaaagataggcacttaat

SEQ ID NO: 498157 - DNA, 25 bp, Mus musculus
gagttactaaagttaggcacttaat

SEQ ID NO: 498158 - DNA, 25 bp, Mus musculus
gagttactacatagacttgtgatgg

SEQ ID NO: 498159 - DNA, 25 bp, Mus musculus
gagttactacattgacttgtgatgg

SEQ ID NO: 498160 - DNA, 25 bp, Mus musculus
gagttactacgcaacagaggctgtt

SEQ ID NO: 498161 - DNA, 25 bp, Mus musculus
gagttactacgctacagaggctgtt

SEQ ID NO: 498162 - DNA, 25 bp, Mus musculus
gagttactactgatgcagggctttt

SEQ ID NO: 498163 - DNA, 25 bp, Mus musculus
gagttactactgttgcagggctttt

SEQ ID NO: 498164 - DNA, 25 bp, Mus musculus
gagttactatgaagaatgccccaag

SEQ ID NO: 498165 - DNA, 25 bp, Mus musculus
gagttactatgatgaatgccccaag

SEQ ID NO: 498166 - DNA, 25 bp, Mus musculus
gagttactcatgaaaccagtgcaca

SEQ ID NO: 498167 - DNA, 25 bp, Mus musculus
gagttactcatgtaaccagtgcaca

SEQ ID NO: 498168 - DNA, 25 bp, Mus musculus
gagttactccagagaaagcaggttt

SEQ ID NO: 498169 - DNA, 25 bp, Mus musculus
gagttactccagtgaaagcaggttt

SEQ ID NO: 498170 - DNA, 25 bp, Mus musculus
gagttactctccatttctgcagagg

SEQ ID NO: 498171 - DNA, 25 bp, Mus musculus
gagttactctccttttctgcagagg

SEQ ID NO: 498172 - DNA, 25 bp, Mus musculus
gagttactctgccagctagaggctg

SEQ ID NO: 498173 - DNA, 25 bp, Mus musculus
gagttactctgcgagctagaggctg

SEQ ID NO: 498174 - DNA, 25 bp, Mus musculus
gagttactctgtatggcttccgttc

SEQ ID NO: 498175 - DNA, 25 bp, Mus musculus
gagttactctgtttggcttccgttc

SEQ ID NO: 498176 - DNA, 25 bp, Mus musculus
gagttactgcaacgtgttcctggag

SEQ ID NO: 498177 - DNA, 25 bp, Mus musculus
gagttactgcaaggtgttcctggag

SEQ ID NO: 498178 - DNA, 25 bp, Mus musculus
gagttactgccacctatttagggtc

SEQ ID NO: 498179 - DNA, 25 bp, Mus musculus
gagttactgccagctatttagggtc

SEQ ID NO: 498180 - DNA, 25 bp, Mus musculus
gagttactggagctgaattccttaa

SEQ ID NO: 498181 - DNA, 25 bp, Mus musculus
gagttactggaggtgaattccttaa

SEQ ID NO: 498182 - DNA, 25 bp, Mus musculus
gagttactggtgactgtgagttgct

SEQ ID NO: 498183 - DNA, 25 bp, Mus musculus
gagttactggtgtctgtgagttgct

SEQ ID NO: 498184 - DNA, 25 bp, Mus musculus
gagttactgtttaaagccagcccta

SEQ ID NO: 498185 - DNA, 25 bp, Mus musculus
gagttactgtttcaggcatatgctg

SEQ ID NO: 498186 - DNA, 25 bp, Mus musculus
gagttactgtttgaggcatatgctg

SEQ ID NO: 498187 - DNA, 25 bp, Mus musculus
gagttactgttttaagccagcccta

SEQ ID NO: 498188 - DNA, 25 bp, Mus musculus
gagttacttaagacaccagcttata

SEQ ID NO: 498189 - DNA, 25 bp, Mus musculus
gagttacttaagtcaccagcttata

SEQ ID NO: 498190 - DNA, 25 bp, Mus musculus
gagttacttattctgaagcgggttt

SEQ ID NO: 498191 - DNA, 25 bp, Mus musculus
gagttacttattgtgaagcgggttt

SEQ ID NO: 498192 - DNA, 25 bp, Mus musculus
gagttacttcagaaagcacgcccca

SEQ ID NO: 498193 - DNA, 25 bp, Mus musculus
gagttacttcagtaagcacgcccca

SEQ ID NO: 498194 - DNA, 25 bp, Mus musculus
gagttacttctcactaatttatcat

SEQ ID NO: 498195 - DNA, 25 bp, Mus musculus
gagttacttctctctaatttatcat

SEQ ID NO: 498196 - DNA, 25 bp, Mus musculus
gagttacttctgacggaagtgtcag

SEQ ID NO: 498197 - DNA, 25 bp, Mus musculus
gagttacttctgtcggaagtgtcag

SEQ ID NO: 498198 - DNA, 25 bp, Mus musculus
gagttacttcttacaaacgccaagg

SEQ ID NO: 498199 - DNA, 25 bp, Mus musculus
gagttacttctttcaaacgccaagg

SEQ ID NO: 498200 - DNA, 25 bp, Mus musculus
gagttacttgacatactgaagcatt

SEQ ID NO: 498201 - DNA, 25 bp, Mus musculus
gagttacttgacttactgaagcatt

SEQ ID NO: 498202 - DNA, 25 bp, Mus musculus
gagttacttgagacttcttaattta

SEQ ID NO: 498203 - DNA, 25 bp, Mus musculus
gagttacttgagtcttcttaattta

SEQ ID NO: 498204 - DNA, 25 bp, Mus musculus
gagttacttgtacatatgcagttga

SEQ ID NO: 498205 - DNA, 25 bp, Mus musculus
gagttacttgtagatatgcagttga

SEQ ID NO: 498206 - DNA, 25 bp, Mus musculus
gagttagaataaagactgcttcaac

SEQ ID NO: 498207 - DNA, 25 bp, Mus musculus
gagttagaataatgactgcttcaac

SEQ ID NO: 498208 - DNA, 25 bp, Mus musculus
gagttagaatgtaccaaaggtagat

SEQ ID NO: 498209 - DNA, 25 bp, Mus musculus
gagttagaatgttccaaaggtagat

SEQ ID NO: 498210 - DNA, 25 bp, Mus musculus
gagttagaattacccctccaacatt

SEQ ID NO: 498211 - DNA, 25 bp, Mus musculus
gagttagaattagccctccaacatt

SEQ ID NO: 498212 - DNA, 25 bp, Mus musculus
gagttagacactctatgggcccatg

SEQ ID NO: 498213 - DNA, 25 bp, Mus musculus
gagttagacactgtatgggcccatg

SEQ ID NO: 498214 - DNA, 25 bp, Mus musculus
gagttagacagtatcaattgggata

SEQ ID NO: 498215 - DNA, 25 bp, Mus musculus
gagttagacagtttcaattgggata

SEQ ID NO: 498216 - DNA, 25 bp, Mus musculus
gagttagacattatccctatgggaa

SEQ ID NO: 498217 - DNA, 25 bp, Mus musculus
gagttagacattttccctatgggaa

SEQ ID NO: 498218 - DNA, 25 bp, Mus musculus
gagttagaccctcacatcctggctg

SEQ ID NO: 498219 - DNA, 25 bp, Mus musculus
gagttagaccctgacatcctggctg

SEQ ID NO: 498220 - DNA, 25 bp, Mus musculus
gagttagactatcgactcctatcta

SEQ ID NO: 498221 - DNA, 25 bp, Mus musculus
gagttagactatggactcctatcta

SEQ ID NO: 498222 - DNA, 25 bp, Mus musculus
gagttagagatgagcctggtccaca

SEQ ID NO: 498223 - DNA, 25 bp, Mus musculus
gagttagagatgtgcctggtccaca

SEQ ID NO: 498224 - DNA, 25 bp, Mus musculus
gagttagagctcctattccaggtct

SEQ ID NO: 498225 - DNA, 25 bp, Mus musculus
gagttagagctcgtattccaggtct

SEQ ID NO: 498226 - DNA, 25 bp, Mus musculus
gagttagatctaatacctatcctga

SEQ ID NO: 498227 - DNA, 25 bp, Mus musculus
gagttagatctattacctatcctga

SEQ ID NO: 498228 - DNA, 25 bp, Mus musculus
gagttagatctgaccagcgtcttac

SEQ ID NO: 498229 - DNA, 25 bp, Mus musculus
gagttagatctgtccagcgtcttac

SEQ ID NO: 498230 - DNA, 25 bp, Mus musculus
gagttagatgctcgatgctgtctct

SEQ ID NO: 498231 - DNA, 25 bp, Mus musculus
gagttagatgctggatgctgtctct

SEQ ID NO: 498232 - DNA, 25 bp, Mus musculus
gagttagcactccatacccttcaaa

SEQ ID NO: 498233 - DNA, 25 bp, Mus musculus
gagttagcactcgatacccttcaaa

SEQ ID NO: 498234 - DNA, 25 bp, Mus musculus
gagttagcatatcttcccagggaag

SEQ ID NO: 498235 - DNA, 25 bp, Mus musculus
gagttagcatatgttcccagggaag

SEQ ID NO: 498236 - DNA, 25 bp, Mus musculus
gagttagcatgtcccaggctcgcag

SEQ ID NO: 498237 - DNA, 25 bp, Mus musculus
gagttagcatgtgccaggctcgcag

SEQ ID NO: 498238 - DNA, 25 bp, Mus musculus
gagttagcatttcctcagagcacat

SEQ ID NO: 498239 - DNA, 25 bp, Mus musculus
gagttagcatttgctcagagcacat

SEQ ID NO: 498240 - DNA, 25 bp, Mus musculus
gagttagcccgactcttacatgctt

SEQ ID NO: 498241 - DNA, 25 bp, Mus musculus
gagttagcccgagtcttacatgctt

SEQ ID NO: 498242 - DNA, 25 bp, Mus musculus
gagttagccggtcattcagtacttg

SEQ ID NO: 498243 - DNA, 25 bp, Mus musculus
gagttagccggtgattcagtacttg

SEQ ID NO: 498244 - DNA, 25 bp, Mus musculus
gagttagcctaaatctctacaaaag

SEQ ID NO: 498245 - DNA, 25 bp, Mus musculus
gagttagcctaattctctacaaaag

SEQ ID NO: 498246 - DNA, 25 bp, Mus musculus
gagttagcctatccttgttgatgaa

SEQ ID NO: 498247 - DNA, 25 bp, Mus musculus
gagttagcctatgcttgttgatgaa

SEQ ID NO: 498248 - DNA, 25 bp, Mus musculus
gagttagcgtgcagtttcggcaaca

SEQ ID NO: 498249 - DNA, 25 bp, Mus musculus
gagttagcgtgctgtttcggcaaca

SEQ ID NO: 498250 - DNA, 25 bp, Mus musculus
gagttagctaatccacacacaaggg

SEQ ID NO: 498251 - DNA, 25 bp, Mus musculus
gagttagctaatgcacacacaaggg

SEQ ID NO: 498252 - DNA, 25 bp, Mus musculus
gagttagctactctgtattaatgag

SEQ ID NO: 498253 - DNA, 25 bp, Mus musculus
gagttagctactgtgtattaatgag

SEQ ID NO: 498254 - DNA, 25 bp, Mus musculus
gagttagctagtctaatggtttcct

SEQ ID NO: 498255 - DNA, 25 bp, Mus musculus
gagttagctagtgtaatggtttcct

SEQ ID NO: 498256 - DNA, 25 bp, Mus musculus
gagttagctcccaaaattcttgggt

SEQ ID NO: 498257 - DNA, 25 bp, Mus musculus
gagttagctcccagatcctaagtga

SEQ ID NO: 498258 - DNA, 25 bp, Mus musculus
gagttagctccctaaattcttgggt

SEQ ID NO: 498259 - DNA, 25 bp, Mus musculus
gagttagctccctgatcctaagtga

SEQ ID NO: 498260 - DNA, 25 bp, Mus musculus
gagttagctcttccttataattcct

SEQ ID NO: 498261 - DNA, 25 bp, Mus musculus
gagttagctcttgcttataattcct

SEQ ID NO: 498262 - DNA, 25 bp, Mus musculus
gagttagctgcacttcctcttagtg

SEQ ID NO: 498263 - DNA, 25 bp, Mus musculus
gagttagctgcagttcctcttagtg

SEQ ID NO: 498264 - DNA, 25 bp, Mus musculus
gagttagctgccaggattaatcagt

SEQ ID NO: 498265 - DNA, 25 bp, Mus musculus
gagttagctgcctggattaatcagt

SEQ ID NO: 498266 - DNA, 25 bp, Mus musculus
gagttagctgtgagttctctctgtg

SEQ ID NO: 498267 - DNA, 25 bp, Mus musculus
gagttagctgtgtgttctctctgtg

SEQ ID NO: 498268 - DNA, 25 bp, Mus musculus
gagttaggacctcgaacaatgacat

SEQ ID NO: 498269 - DNA, 25 bp, Mus musculus
gagttaggacctggaacaatgacat

SEQ ID NO: 498270 - DNA, 25 bp, Mus musculus
gagttaggctggattcaggctttgt

SEQ ID NO: 498271 - DNA, 25 bp, Mus musculus
gagttaggctggtttcaggctttgt

SEQ ID NO: 498272 - DNA, 25 bp, Mus musculus
gagttagggactctcctctaaaata

SEQ ID NO: 498273 - DNA, 25 bp, Mus musculus
gagttagggactgtcctctaaaata

SEQ ID NO: 498274 - DNA, 25 bp, Mus musculus
gagttagggtccaagcacacatgtc

SEQ ID NO: 498275 - DNA, 25 bp, Mus musculus
gagttagggtcctagcacacatgtc

SEQ ID NO: 498276 - DNA, 25 bp, Mus musculus
gagttaggtggtacggccatttctt

SEQ ID NO: 498277 - DNA, 25 bp, Mus musculus
gagttaggtggttcggccatttctt

SEQ ID NO: 498278 - DNA, 25 bp, Mus musculus
gagttagtcatgctcttcttacgat

SEQ ID NO: 498279 - DNA, 25 bp, Mus musculus
gagttagtcatggtcttcttacgat

SEQ ID NO: 498280 - DNA, 25 bp, Mus musculus
gagttagtccatactttgattctta

SEQ ID NO: 498281 - DNA, 25 bp, Mus musculus
gagttagtccattctttgattctta

SEQ ID NO: 498282 - DNA, 25 bp, Mus musculus
gagttagtcctgagcctaaccagtg

SEQ ID NO: 498283 - DNA, 25 bp, Mus musculus
gagttagtcctgtgcctaaccagtg

SEQ ID NO: 498284 - DNA, 25 bp, Mus musculus
gagttagtctgcatgtctgtaggct

SEQ ID NO: 498285 - DNA, 25 bp, Mus musculus
gagttagtctgcttgtctgtaggct

SEQ ID NO: 498286 - DNA, 25 bp, Mus musculus
gagttagtgaggacatgtgcatgaa

SEQ ID NO: 498287 - DNA, 25 bp, Mus musculus
gagttagtgaggtcatgtgcatgaa

SEQ ID NO: 498288 - DNA, 25 bp, Mus musculus
gagttagtggcccagtgaacacatg

SEQ ID NO: 498289 - DNA, 25 bp, Mus musculus
gagttagtggccgagtgaacacatg

SEQ ID NO: 498290 - DNA, 25 bp, Mus musculus
gagttagtgtacagcgtgtttgcta

SEQ ID NO: 498291 - DNA, 25 bp, Mus musculus
gagttagtgtactgcgtgtttgcta

SEQ ID NO: 498292 - DNA, 25 bp, Mus musculus
gagttagttaccagcaggtgtttcc

SEQ ID NO: 498293 - DNA, 25 bp, Mus musculus
gagttagttaccagcttccttgatt

SEQ ID NO: 498294 - DNA, 25 bp, Mus musculus
gagttagttacctgcaggtgtttcc

SEQ ID NO: 498295 - DNA, 25 bp, Mus musculus
gagttagttacctgcttccttgatt

SEQ ID NO: 498296 - DNA, 25 bp, Mus musculus
gagttagttcacagatactgaggaa

SEQ ID NO: 498297 - DNA, 25 bp, Mus musculus
gagttagttcactgatactgaggaa

SEQ ID NO: 498298 - DNA, 25 bp, Mus musculus
gagttagttctgctgtctgcatccc

SEQ ID NO: 498299 - DNA, 25 bp, Mus musculus
gagttagttctggtgtctgcatccc

SEQ ID NO: 498300 - DNA, 25 bp, Mus musculus
gagttagttggacgctccttcaggt

SEQ ID NO: 498301 - DNA, 25 bp, Mus musculus
gagttagttggaggctccttcaggt

SEQ ID NO: 498302 - DNA, 25 bp, Mus musculus
gagttagttgtaagcaccgatatca

SEQ ID NO: 498303 - DNA, 25 bp, Mus musculus
gagttagttgtatgcaccgatatca

SEQ ID NO: 498304 - DNA, 25 bp, Mus musculus
gagttagtttcacatacatcacaat

SEQ ID NO: 498305 - DNA, 25 bp, Mus musculus
gagttagtttcagatacatcacaat

SEQ ID NO: 498306 - DNA, 25 bp, Mus musculus
gagttagttttcatctctgtcatat

SEQ ID NO: 498307 - DNA, 25 bp, Mus musculus
gagttagttttcttctctgtcatat

SEQ ID NO: 498308 - DNA, 25 bp, Mus musculus
gagttataacacatgcgtgtattta

SEQ ID NO: 498309 - DNA, 25 bp, Mus musculus
gagttataacacttgcgtgtattta

SEQ ID NO: 498310 - DNA, 25 bp, Mus musculus
gagttataatctagtagccatcatc

SEQ ID NO: 498311 - DNA, 25 bp, Mus musculus
gagttataatcttgtagccatcatc

SEQ ID NO: 498312 - DNA, 25 bp, Mus musculus
gagttataccctaagtcatgcgtta

SEQ ID NO: 498313 - DNA, 25 bp, Mus musculus
gagttatacccttagtcatgcgtta

SEQ ID NO: 498314 - DNA, 25 bp, Mus musculus
gagttataccttaacctcagtctat

SEQ ID NO: 498315 - DNA, 25 bp, Mus musculus
gagttatacctttacctcagtctat

SEQ ID NO: 498316 - DNA, 25 bp, Mus musculus
gagttatacgctagtaatccccaca

SEQ ID NO: 498317 - DNA, 25 bp, Mus musculus
gagttatacgcttgtaatccccaca

SEQ ID NO: 498318 - DNA, 25 bp, Mus musculus
gagttatactgccttgtctttcaag

SEQ ID NO: 498319 - DNA, 25 bp, Mus musculus
gagttatactgcgttgtctttcaag

SEQ ID NO: 498320 - DNA, 25 bp, Mus musculus
gagttatacttacattggcccctgg

SEQ ID NO: 498321 - DNA, 25 bp, Mus musculus
gagttatacttagattggcccctgg

SEQ ID NO: 498322 - DNA, 25 bp, Mus musculus
gagttatagagaagggccagtccta

SEQ ID NO: 498323 - DNA, 25 bp, Mus musculus
gagttatagagatgggccagtccta

SEQ ID NO: 498324 - DNA, 25 bp, Mus musculus
gagttatagccaacctgaagagagt

SEQ ID NO: 498325 - DNA, 25 bp, Mus musculus
gagttatagccatcctgaagagagt

SEQ ID NO: 498326 - DNA, 25 bp, Mus musculus
gagttataggccaccaccaaagtaa

SEQ ID NO: 498327 - DNA, 25 bp, Mus musculus
gagttataggcctccaccaaagtaa

SEQ ID NO: 498328 - DNA, 25 bp, Mus musculus
gagttatagtcaccgagcacctctt

SEQ ID NO: 498329 - DNA, 25 bp, Mus musculus
gagttatagtcagcgagcacctctt

SEQ ID NO: 498330 - DNA, 25 bp, Mus musculus
gagttatatctcaagaaccccacag

SEQ ID NO: 498331 - DNA, 25 bp, Mus musculus
gagttatatctctagaaccccacag

SEQ ID NO: 498332 - DNA, 25 bp, Mus musculus
gagttatcataacccagtgctgctg

SEQ ID NO: 498333 - DNA, 25 bp, Mus musculus
gagttatcataagccagtgctgctg

SEQ ID NO: 498334 - DNA, 25 bp, Mus musculus
gagttatcattaacactgccagtgt

SEQ ID NO: 498335 - DNA, 25 bp, Mus musculus
gagttatcattatcactgccagtgt

SEQ ID NO: 498336 - DNA, 25 bp, Mus musculus
gagttatccaagcaggacctcatcc

SEQ ID NO: 498337 - DNA, 25 bp, Mus musculus
gagttatccaaggaggacctcatcc

SEQ ID NO: 498338 - DNA, 25 bp, Mus musculus
gagttatccctcagggttgggaatt

SEQ ID NO: 498339 - DNA, 25 bp, Mus musculus
gagttatccctctgggttgggaatt

SEQ ID NO: 498340 - DNA, 25 bp, Mus musculus
gagttatccgcaccattcacaattt

SEQ ID NO: 498341 - DNA, 25 bp, Mus musculus
gagttatccgcagcattcacaattt

SEQ ID NO: 498342 - DNA, 25 bp, Mus musculus
gagttatctagtaatgtttgtcttt

SEQ ID NO: 498343 - DNA, 25 bp, Mus musculus
gagttatctagttatgtttgtcttt

SEQ ID NO: 498344 - DNA, 25 bp, Mus musculus
gagttatctgggaatattcatgtat

SEQ ID NO: 498345 - DNA, 25 bp, Mus musculus
gagttatctgggtatattcatgtat

SEQ ID NO: 498346 - DNA, 25 bp, Mus musculus
gagttatctggtatacttcctttta

SEQ ID NO: 498347 - DNA, 25 bp, Mus musculus
gagttatctggtttacttcctttta

SEQ ID NO: 498348 - DNA, 25 bp, Mus musculus
gagttatctgtcctcacgaaacaca

SEQ ID NO: 498349 - DNA, 25 bp, Mus musculus
gagttatctgtcgtcacgaaacaca

SEQ ID NO: 498350 - DNA, 25 bp, Mus musculus
gagttatctttacgatctgggtata

SEQ ID NO: 498351 - DNA, 25 bp, Mus musculus
gagttatctttaggatctgggtata

SEQ ID NO: 498352 - DNA, 25 bp, Mus musculus
gagttatgaactccttaaatttgct

SEQ ID NO: 498353 - DNA, 25 bp, Mus musculus
gagttatgaactgcttaaatttgct

SEQ ID NO: 498354 - DNA, 25 bp, Mus musculus
gagttatgcctaatctgaaatcctt

SEQ ID NO: 498355 - DNA, 25 bp, Mus musculus
gagttatgcctattctgaaatcctt

SEQ ID NO: 498356 - DNA, 25 bp, Mus musculus
gagttatgcctcacaagtttcattg

SEQ ID NO: 498357 - DNA, 25 bp, Mus musculus
gagttatgcctctcaagtttcattg

SEQ ID NO: 498358 - DNA, 25 bp, Mus musculus
gagttatgccttagtcacggcctta

SEQ ID NO: 498359 - DNA, 25 bp, Mus musculus
gagttatgcctttgtcacggcctta

SEQ ID NO: 498360 - DNA, 25 bp, Mus musculus
gagttatggctaatcccctatgtta

SEQ ID NO: 498361 - DNA, 25 bp, Mus musculus
gagttatggctattcccctatgtta

SEQ ID NO: 498362 - DNA, 25 bp, Mus musculus
gagttatgtattccctgatcctgag

SEQ ID NO: 498363 - DNA, 25 bp, Mus musculus
gagttatgtattgcctgatcctgag

SEQ ID NO: 498364 - DNA, 25 bp, Mus musculus
gagttatgtccccagatctttattt

SEQ ID NO: 498365 - DNA, 25 bp, Mus musculus
gagttatgtcccgagatctttattt

SEQ ID NO: 498366 - DNA, 25 bp, Mus musculus
gagttatgttatacctccggcttat

SEQ ID NO: 498367 - DNA, 25 bp, Mus musculus
gagttatgttattcctccggcttat

SEQ ID NO: 498368 - DNA, 25 bp, Mus musculus
gagttattacacatcactaagctat

SEQ ID NO: 498369 - DNA, 25 bp, Mus musculus
gagttattacacttcactaagctat

SEQ ID NO: 498370 - DNA, 25 bp, Mus musculus
gagttattaccaaaaactcctgtgg

SEQ ID NO: 498371 - DNA, 25 bp, Mus musculus
gagttattaccataaactcctgtgg

SEQ ID NO: 498372 - DNA, 25 bp, Mus musculus
gagttattactaagatttacattgt

SEQ ID NO: 498373 - DNA, 25 bp, Mus musculus
gagttattactatgatttacattgt

SEQ ID NO: 498374 - DNA, 25 bp, Mus musculus
gagttattactcatattggttccat

SEQ ID NO: 498375 - DNA, 25 bp, Mus musculus
gagttattactcttattggttccat

SEQ ID NO: 498376 - DNA, 25 bp, Mus musculus
gagttattccagcaacattgtgttt

SEQ ID NO: 498377 - DNA, 25 bp, Mus musculus
gagttattccaggaacattgtgttt

SEQ ID NO: 498378 - DNA, 25 bp, Mus musculus
gagttattgaatcatcaccctttgt

SEQ ID NO: 498379 - DNA, 25 bp, Mus musculus
gagttattgaatgatcaccctttgt

SEQ ID NO: 498380 - DNA, 25 bp, Mus musculus
gagttattgttaaagtcgctgccct

SEQ ID NO: 498381 - DNA, 25 bp, Mus musculus
gagttattgttatagtcgctgccct

SEQ ID NO: 498382 - DNA, 25 bp, Mus musculus
gagttatttacacacatccgaggaa

SEQ ID NO: 498383 - DNA, 25 bp, Mus musculus
gagttatttacagacatccgaggaa

SEQ ID NO: 498384 - DNA, 25 bp, Mus musculus
gagttatttctgatttgatgggaac

SEQ ID NO: 498385 - DNA, 25 bp, Mus musculus
gagttatttctgttttgatgggaac

SEQ ID NO: 498386 - DNA, 25 bp, Mus musculus
gagttattttagcaccaggcctggt

SEQ ID NO: 498387 - DNA, 25 bp, Mus musculus
gagttattttaggaccaggcctggt

SEQ ID NO: 498388 - DNA, 25 bp, Mus musculus
gagttattttttcagcctctttggc

SEQ ID NO: 498389 - DNA, 25 bp, Mus musculus
gagttattttttgagcctctttggc

SEQ ID NO: 498390 - DNA, 25 bp, Mus musculus
gagttcaaacccaccagtggccgaa

SEQ ID NO: 498391 - DNA, 25 bp, Mus musculus
gagttcaaaccctccagtggccgaa

SEQ ID NO: 498392 - DNA, 25 bp, Mus musculus
gagttcaaacgcataaccttctgtt

SEQ ID NO: 498393 - DNA, 25 bp, Mus musculus
gagttcaaacgcttaaccttctgtt

SEQ ID NO: 498394 - DNA, 25 bp, Mus musculus
gagttcaaactcagcaatccacttg

SEQ ID NO: 498395 - DNA, 25 bp, Mus musculus
gagttcaaactccaaagccagccct

SEQ ID NO: 498396 - DNA, 25 bp, Mus musculus
gagttcaaactcgaaagccagccct

SEQ ID NO: 498397 - DNA, 25 bp, Mus musculus
gagttcaaactctgcaatccacttg

SEQ ID NO: 498398 - DNA, 25 bp, Mus musculus
gagttcaaagaacctttctcactat

SEQ ID NO: 498399 - DNA, 25 bp, Mus musculus
gagttcaaagaagctttctcactat

SEQ ID NO: 498400 - DNA, 25 bp, Mus musculus
gagttcaaagatatcctctgataca

SEQ ID NO: 498401 - DNA, 25 bp, Mus musculus
gagttcaaagatttcctctgataca

SEQ ID NO: 498402 - DNA, 25 bp, Mus musculus
gagttcaaagttcgattcccagaca

SEQ ID NO: 498403 - DNA, 25 bp, Mus musculus
gagttcaaagttggattcccagaca

SEQ ID NO: 498404 - DNA, 25 bp, Mus musculus
gagttcaaatcaacatctttctgga

SEQ ID NO: 498405 - DNA, 25 bp, Mus musculus
gagttcaaatcaccttcagtaccac

SEQ ID NO: 498406 - DNA, 25 bp, Mus musculus
gagttcaaatcagcttcagtaccac

SEQ ID NO: 498407 - DNA, 25 bp, Mus musculus
gagttcaaatcatcatctttctgga

SEQ ID NO: 498408 - DNA, 25 bp, Mus musculus
gagttcaaatcccaattcgacccag

SEQ ID NO: 498409 - DNA, 25 bp, Mus musculus
gagttcaaatccgaattcgacccag

SEQ ID NO: 498410 - DNA, 25 bp, Mus musculus
gagttcaaattcatgaagcctgtgt

SEQ ID NO: 498411 - DNA, 25 bp, Mus musculus
gagttcaaattcttgaagcctgtgt

SEQ ID NO: 498412 - DNA, 25 bp, Mus musculus
gagttcaacccgcagttcgtggcgc

SEQ ID NO: 498413 - DNA, 25 bp, Mus musculus
gagttcaacccggagttcgtggcgc

SEQ ID NO: 498414 - DNA, 25 bp, Mus musculus
gagttcaactaaacctcaatctgta

SEQ ID NO: 498415 - DNA, 25 bp, Mus musculus
gagttcaactaacccaggtttacct

SEQ ID NO: 498416 - DNA, 25 bp, Mus musculus
gagttcaactaagccaggtttacct

SEQ ID NO: 498417 - DNA, 25 bp, Mus musculus
gagttcaactaatcctcaatctgta

SEQ ID NO: 498418 - DNA, 25 bp, Mus musculus
gagttcaactatcaccaccttatta

SEQ ID NO: 498419 - DNA, 25 bp, Mus musculus
gagttcaactatgaccaccttatta

SEQ ID NO: 498420 - DNA, 25 bp, Mus musculus
gagttcaagatcacttacacccggt

SEQ ID NO: 498421 - DNA, 25 bp, Mus musculus
gagttcaagatctcttacacccggt

SEQ ID NO: 498422 - DNA, 25 bp, Mus musculus
gagttcaagcctatgtttcacttat

SEQ ID NO: 498423 - DNA, 25 bp, Mus musculus
gagttcaagcctttgtttcacttat

SEQ ID NO: 498424 - DNA, 25 bp, Mus musculus
gagttcaagcttcgacccattcatt

SEQ ID NO: 498425 - DNA, 25 bp, Mus musculus
gagttcaagcttggacccattcatt

SEQ ID NO: 498426 - DNA, 25 bp, Mus musculus
gagttcaaggacagcctgagtggtt

SEQ ID NO: 498427 - DNA, 25 bp, Mus musculus
gagttcaaggactgcctgagtggtt

SEQ ID NO: 498428 - DNA, 25 bp, Mus musculus
gagttcaaggagagcccggctacat

SEQ ID NO: 498429 - DNA, 25 bp, Mus musculus
gagttcaaggagtgcccggctacat

SEQ ID NO: 498430 - DNA, 25 bp, Mus musculus
gagttcaaggcacacctaggctata

SEQ ID NO: 498431 - DNA, 25 bp, Mus musculus
gagttcaaggcagacctaggctata

SEQ ID NO: 498432 - DNA, 25 bp, Mus musculus
gagttcaagtatacgtgtccacaca

SEQ ID NO: 498433 - DNA, 25 bp, Mus musculus
gagttcaagtattcgtgtccacaca

SEQ ID NO: 498434 - DNA, 25 bp, Mus musculus
gagttcaagtcaacacgccaagtgc

SEQ ID NO: 498435 - DNA, 25 bp, Mus musculus
gagttcaagtcatcacgccaagtgc

SEQ ID NO: 498436 - DNA, 25 bp, Mus musculus
gagttcaagtccaacagttacagga

SEQ ID NO: 498437 - DNA, 25 bp, Mus musculus
gagttcaagtcctacagttacagga

SEQ ID NO: 498438 - DNA, 25 bp, Mus musculus
gagttcaagtgcaaaccgggcgacc

SEQ ID NO: 498439 - DNA, 25 bp, Mus musculus
gagttcaagtgctaaccgggcgacc

SEQ ID NO: 498440 - DNA, 25 bp, Mus musculus
gagttcaagttcaaattctgtcact

SEQ ID NO: 498441 - DNA, 25 bp, Mus musculus
gagttcaagttctaattctgtcact

SEQ ID NO: 498442 - DNA, 25 bp, Mus musculus
gagttcaatcacagcatctctgagg

SEQ ID NO: 498443 - DNA, 25 bp, Mus musculus
gagttcaatcactgcatctctgagg

SEQ ID NO: 498444 - DNA, 25 bp, Mus musculus
gagttcaatcctagggaaccaccca

SEQ ID NO: 498445 - DNA, 25 bp, Mus musculus
gagttcaatccttgggaaccaccca

SEQ ID NO: 498446 - DNA, 25 bp, Mus musculus
gagttcaatctccaataccacataa

SEQ ID NO: 498447 - DNA, 25 bp, Mus musculus
gagttcaatctcgaataccacataa

SEQ ID NO: 498448 - DNA, 25 bp, Mus musculus
gagttcaatgctcctcatttggaaa

SEQ ID NO: 498449 - DNA, 25 bp, Mus musculus
gagttcaatgctgctcatttggaaa

SEQ ID NO: 498450 - DNA, 25 bp, Mus musculus
gagttcaattacagcactcctcaac

SEQ ID NO: 498451 - DNA, 25 bp, Mus musculus
gagttcaattactgcactcctcaac

SEQ ID NO: 498452 - DNA, 25 bp, Mus musculus
gagttcaattcactggtctttattt

SEQ ID NO: 498453 - DNA, 25 bp, Mus musculus
gagttcaattcagtggtctttattt

SEQ ID NO: 498454 - DNA, 25 bp, Mus musculus
gagttcaattccctgtatcctgtta

SEQ ID NO: 498455 - DNA, 25 bp, Mus musculus
gagttcaattccgtgtatcctgtta

SEQ ID NO: 498456 - DNA, 25 bp, Mus musculus
gagttcacacacatacgagcattca

SEQ ID NO: 498457 - DNA, 25 bp, Mus musculus
gagttcacacacttacgagcattca

SEQ ID NO: 498458 - DNA, 25 bp, Mus musculus
gagttcacaccacaaatctgcagtt

SEQ ID NO: 498459 - DNA, 25 bp, Mus musculus
gagttcacaccagaaatctgcagtt

SEQ ID NO: 498460 - DNA, 25 bp, Mus musculus
gagttcacacccaaccaatttgtag

SEQ ID NO: 498461 - DNA, 25 bp, Mus musculus
gagttcacacccataactgctttca

SEQ ID NO: 498462 - DNA, 25 bp, Mus musculus
gagttcacaccctaccaatttgtag

SEQ ID NO: 498463 - DNA, 25 bp, Mus musculus
gagttcacacccttaactgctttca

SEQ ID NO: 498464 - DNA, 25 bp, Mus musculus
gagttcacacctcactgagggtcca

SEQ ID NO: 498465 - DNA, 25 bp, Mus musculus
gagttcacacctgactgagggtcca

SEQ ID NO: 498466 - DNA, 25 bp, Mus musculus
gagttcacactcacatagacacgcc

SEQ ID NO: 498467 - DNA, 25 bp, Mus musculus
gagttcacactctcatagacacgcc

SEQ ID NO: 498468 - DNA, 25 bp, Mus musculus
gagttcacatggcacacactgaaag

SEQ ID NO: 498469 - DNA, 25 bp, Mus musculus
gagttcacatgggacacactgaaag

SEQ ID NO: 498470 - DNA, 25 bp, Mus musculus
gagttcacattaccaagcagcctgg

SEQ ID NO: 498471 - DNA, 25 bp, Mus musculus
gagttcacattagcaagcagcctgg

SEQ ID NO: 498472 - DNA, 25 bp, Mus musculus
gagttcacattcaccccagaactat

SEQ ID NO: 498473 - DNA, 25 bp, Mus musculus
gagttcacattctccccagaactat

SEQ ID NO: 498474 - DNA, 25 bp, Mus musculus
gagttcaccaggctgcccagaagag

SEQ ID NO: 498475 - DNA, 25 bp, Mus musculus
gagttcaccagggtgcccagaagag

SEQ ID NO: 498476 - DNA, 25 bp, Mus musculus
gagttcaccattcgtcaccacttaa

SEQ ID NO: 498477 - DNA, 25 bp, Mus musculus
gagttcaccattggtcaccacttaa

SEQ ID NO: 498478 - DNA, 25 bp, Mus musculus
gagttcaccttgcatggccgggcta

SEQ ID NO: 498479 - DNA, 25 bp, Mus musculus
gagttcaccttggatggccgggcta

SEQ ID NO: 498480 - DNA, 25 bp, Mus musculus
gagttcacggagagcttctcagcca

SEQ ID NO: 498481 - DNA, 25 bp, Mus musculus
gagttcacggagtgcttctcagcca

SEQ ID NO: 498482 - DNA, 25 bp, Mus musculus
gagttcacggtcattgctaggccaa

SEQ ID NO: 498483 - DNA, 25 bp, Mus musculus
gagttcacggtctttgctaggccaa

SEQ ID NO: 498484 - DNA, 25 bp, Mus musculus
gagttcacgtctccctaaagcatag

SEQ ID NO: 498485 - DNA, 25 bp, Mus musculus
gagttcacgtctgcctaaagcatag

SEQ ID NO: 498486 - DNA, 25 bp, Mus musculus
gagttcacgtgactggaatcacccc

SEQ ID NO: 498487 - DNA, 25 bp, Mus musculus
gagttcacgtgagtggaatcacccc

SEQ ID NO: 498488 - DNA, 25 bp, Mus musculus
gagttcacgtggcagaatatccttc

SEQ ID NO: 498489 - DNA, 25 bp, Mus musculus
gagttcacgtgggagaatatccttc

SEQ ID NO: 498490 - DNA, 25 bp, Mus musculus
gagttcactaaaaggccagctgcag

SEQ ID NO: 498491 - DNA, 25 bp, Mus musculus
gagttcactaaatggccagctgcag

SEQ ID NO: 498492 - DNA, 25 bp, Mus musculus
gagttcactagaaagcccatgctca

SEQ ID NO: 498493 - DNA, 25 bp, Mus musculus
gagttcactagatagcccatgctca

SEQ ID NO: 498494 - DNA, 25 bp, Mus musculus
gagttcactctcaatgtcagatcaa

SEQ ID NO: 498495 - DNA, 25 bp, Mus musculus
gagttcactctctatgtcagatcaa

SEQ ID NO: 498496 - DNA, 25 bp, Mus musculus
gagttcactgaaaatgtcctttata

SEQ ID NO: 498497 - DNA, 25 bp, Mus musculus
gagttcactgaaactggaggctttt

SEQ ID NO: 498498 - DNA, 25 bp, Mus musculus
gagttcactgaatatgtcctttata

SEQ ID NO: 498499 - DNA, 25 bp, Mus musculus
gagttcactgaatctggaggctttt

SEQ ID NO: 498500 - DNA, 25 bp, Mus musculus
gagttcactgggaatggtcttcaca

SEQ ID NO: 498501 - DNA, 25 bp, Mus musculus
gagttcactgggtatggtcttcaca

SEQ ID NO: 498502 - DNA, 25 bp, Mus musculus
gagttcacttaccatacctgcagag

SEQ ID NO: 498503 - DNA, 25 bp, Mus musculus
gagttcacttacgatacctgcagag

SEQ ID NO: 498504 - DNA, 25 bp, Mus musculus
gagttcagaaatcatctcctttttg

SEQ ID NO: 498505 - DNA, 25 bp, Mus musculus
gagttcagaaatgatctcctttttg

SEQ ID NO: 498506 - DNA, 25 bp, Mus musculus
gagttcagaacaccatgctctaaag

SEQ ID NO: 498507 - DNA, 25 bp, Mus musculus
gagttcagaacagcatgctctaaag

SEQ ID NO: 498508 - DNA, 25 bp, Mus musculus
gagttcagacaacaattctacagaa

SEQ ID NO: 498509 - DNA, 25 bp, Mus musculus
gagttcagacaacagttcccttcat

SEQ ID NO: 498510 - DNA, 25 bp, Mus musculus
gagttcagacaagaattctacagaa

SEQ ID NO: 498511 - DNA, 25 bp, Mus musculus
gagttcagacaagagttcccttcat

SEQ ID NO: 498512 - DNA, 25 bp, Mus musculus
gagttcagacttctccgaatttaga

SEQ ID NO: 498513 - DNA, 25 bp, Mus musculus
gagttcagacttgtccgaatttaga

SEQ ID NO: 498514 - DNA, 25 bp, Mus musculus
gagttcagagtcaaaagctcttcat

SEQ ID NO: 498515 - DNA, 25 bp, Mus musculus
gagttcagagtctaaagctcttcat

SEQ ID NO: 498516 - DNA, 25 bp, Mus musculus
gagttcagagttcttccactgtata

SEQ ID NO: 498517 - DNA, 25 bp, Mus musculus
gagttcagagttgttccactgtata

SEQ ID NO: 498518 - DNA, 25 bp, Mus musculus
gagttcagatccaagaaacctgtac

SEQ ID NO: 498519 - DNA, 25 bp, Mus musculus
gagttcagatcctagaaacctgtac

SEQ ID NO: 498520 - DNA, 25 bp, Mus musculus
gagttcagatgaatccaaaggctat

SEQ ID NO: 498521 - DNA, 25 bp, Mus musculus
gagttcagatgattccaaaggctat

SEQ ID NO: 498522 - DNA, 25 bp, Mus musculus
gagttcagatttccagaacccatgg

SEQ ID NO: 498523 - DNA, 25 bp, Mus musculus
gagttcagatttgcagaacccatgg

SEQ ID NO: 498524 - DNA, 25 bp, Mus musculus
gagttcagcctgaatgttcatccgt

SEQ ID NO: 498525 - DNA, 25 bp, Mus musculus
gagttcagcctgtatgttcatccgt

SEQ ID NO: 498526 - DNA, 25 bp, Mus musculus
gagttcagcgacagagcctttgtac

SEQ ID NO: 498527 - DNA, 25 bp, Mus musculus
gagttcagcgactgagcctttgtac

SEQ ID NO: 498528 - DNA, 25 bp, Mus musculus
gagttcagctcaagtgacccgtgta

SEQ ID NO: 498529 - DNA, 25 bp, Mus musculus
gagttcagctcatgtgacccgtgta

SEQ ID NO: 498530 - DNA, 25 bp, Mus musculus
gagttcagctgtattctgcaaataa

SEQ ID NO: 498531 - DNA, 25 bp, Mus musculus
gagttcagctgttttctgcaaataa

SEQ ID NO: 498532 - DNA, 25 bp, Mus musculus
gagttcaggagtacagttggagcaa

SEQ ID NO: 498533 - DNA, 25 bp, Mus musculus
gagttcaggagttcagttggagcaa

SEQ ID NO: 498534 - DNA, 25 bp, Mus musculus
gagttcagggacagctttggctaca

SEQ ID NO: 498535 - DNA, 25 bp, Mus musculus
gagttcagggactgctttggctaca

SEQ ID NO: 498536 - DNA, 25 bp, Mus musculus
gagttcagggccagcactgtcttcc

SEQ ID NO: 498537 - DNA, 25 bp, Mus musculus
gagttcagggccagcctagtttaca

SEQ ID NO: 498538 - DNA, 25 bp, Mus musculus
gagttcagggcctgcactgtcttcc

SEQ ID NO: 498539 - DNA, 25 bp, Mus musculus
gagttcagggcctgcctagtttaca

SEQ ID NO: 498540 - DNA, 25 bp, Mus musculus
gagttcagggttagcccaggctatc

SEQ ID NO: 498541 - DNA, 25 bp, Mus musculus
gagttcagggttcaacatgtcctgc

SEQ ID NO: 498542 - DNA, 25 bp, Mus musculus
gagttcagggttgaacatgtcctgc

SEQ ID NO: 498543 - DNA, 25 bp, Mus musculus
gagttcagggtttgcccaggctatc

SEQ ID NO: 498544 - DNA, 25 bp, Mus musculus
gagttcaggtaaagacatgctctta

SEQ ID NO: 498545 - DNA, 25 bp, Mus musculus
gagttcaggtaatgacatgctctta

SEQ ID NO: 498546 - DNA, 25 bp, Mus musculus
gagttcaggtcccaggtattcagta

SEQ ID NO: 498547 - DNA, 25 bp, Mus musculus
gagttcaggtccgaggtattcagta

SEQ ID NO: 498548 - DNA, 25 bp, Mus musculus
gagttcaggttactggttgccaata

SEQ ID NO: 498549 - DNA, 25 bp, Mus musculus
gagttcaggttagtggttgccaata

SEQ ID NO: 498550 - DNA, 25 bp, Mus musculus
gagttcagtacacaacgtcttgcaa

SEQ ID NO: 498551 - DNA, 25 bp, Mus musculus
gagttcagtacagaacgtcttgcaa

SEQ ID NO: 498552 - DNA, 25 bp, Mus musculus
gagttcagtccccaaattgcatgtg

SEQ ID NO: 498553 - DNA, 25 bp, Mus musculus
gagttcagtcccgaaattgcatgtg

SEQ ID NO: 498554 - DNA, 25 bp, Mus musculus
gagttcagtcggaagagggcttgct

SEQ ID NO: 498555 - DNA, 25 bp, Mus musculus
gagttcagtcggtagagggcttgct

SEQ ID NO: 498556 - DNA, 25 bp, Mus musculus
gagttcagtctcaagtcccaaaata

SEQ ID NO: 498557 - DNA, 25 bp, Mus musculus
gagttcagtctctagtcccaaaata

SEQ ID NO: 498558 - DNA, 25 bp, Mus musculus
gagttcagtgcaagctgtcaggaca

SEQ ID NO: 498559 - DNA, 25 bp, Mus musculus
gagttcagtgcatgctgtcaggaca

SEQ ID NO: 498560 - DNA, 25 bp, Mus musculus
gagttcagtgctccggtcatgtaat

SEQ ID NO: 498561 - DNA, 25 bp, Mus musculus
gagttcagtgctgcggtcatgtaat

SEQ ID NO: 498562 - DNA, 25 bp, Mus musculus
gagttcagttccctagatatgtata

SEQ ID NO: 498563 - DNA, 25 bp, Mus musculus
gagttcagttccgtagatatgtata

SEQ ID NO: 498564 - DNA, 25 bp, Mus musculus
gagttcagttctccccgtttgagaa

SEQ ID NO: 498565 - DNA, 25 bp, Mus musculus
gagttcagttctgcccgtttgagaa

SEQ ID NO: 498566 - DNA, 25 bp, Mus musculus
gagttcagttgccaggaccgcctca

SEQ ID NO: 498567 - DNA, 25 bp, Mus musculus
gagttcagttgcgaggaccgcctca

SEQ ID NO: 498568 - DNA, 25 bp, Mus musculus
gagttcagtttgagctgccttatca

SEQ ID NO: 498569 - DNA, 25 bp, Mus musculus
gagttcagtttgtgctgccttatca

SEQ ID NO: 498570 - DNA, 25 bp, Mus musculus
gagttcatacccacagagttgccaa

SEQ ID NO: 498571 - DNA, 25 bp, Mus musculus
gagttcataccctcagagttgccaa

SEQ ID NO: 498572 - DNA, 25 bp, Mus musculus
gagttcatacttcttcatggcaaca

SEQ ID NO: 498573 - DNA, 25 bp, Mus musculus
gagttcatacttgttcatggcaaca

SEQ ID NO: 498574 - DNA, 25 bp, Mus musculus
gagttcatagcaaccaagagtcaag

SEQ ID NO: 498575 - DNA, 25 bp, Mus musculus
gagttcatagcatccaagagtcaag

SEQ ID NO: 498576 - DNA, 25 bp, Mus musculus
gagttcataggcatcatatctgtgt

SEQ ID NO: 498577 - DNA, 25 bp, Mus musculus
gagttcataggcttcatatctgtgt

SEQ ID NO: 498578 - DNA, 25 bp, Mus musculus
gagttcatagttcatttgaaggcat

SEQ ID NO: 498579 - DNA, 25 bp, Mus musculus
gagttcatagttgatttgaaggcat

SEQ ID NO: 498580 - DNA, 25 bp, Mus musculus
gagttcatatcaagtcatctaggga

SEQ ID NO: 498581 - DNA, 25 bp, Mus musculus
gagttcatatcatgtcatctaggga

SEQ ID NO: 498582 - DNA, 25 bp, Mus musculus
gagttcatcagactcttcgtcttca

SEQ ID NO: 498583 - DNA, 25 bp, Mus musculus
gagttcatcagagtcttcgtcttca

SEQ ID NO: 498584 - DNA, 25 bp, Mus musculus
gagttcatcatgctccacacaggcc

SEQ ID NO: 498585 - DNA, 25 bp, Mus musculus
gagttcatcatggtccacacaggcc

SEQ ID NO: 498586 - DNA, 25 bp, Mus musculus
gagttcatccaccatagtacatacc

SEQ ID NO: 498587 - DNA, 25 bp, Mus musculus
gagttcatccacgatagtacatacc

SEQ ID NO: 498588 - DNA, 25 bp, Mus musculus
gagttcatccgccagcttaagagat

SEQ ID NO: 498589 - DNA, 25 bp, Mus musculus
gagttcatccgcgagcttaagagat

SEQ ID NO: 498590 - DNA, 25 bp, Mus musculus
gagttcatcctcaaagtcaaattct

SEQ ID NO: 498591 - DNA, 25 bp, Mus musculus
gagttcatcctctaagtcaaattct

SEQ ID NO: 498592 - DNA, 25 bp, Mus musculus
gagttcatcgtgaacctgctgggag

SEQ ID NO: 498593 - DNA, 25 bp, Mus musculus
gagttcatcgtgctctacatagtga

SEQ ID NO: 498594 - DNA, 25 bp, Mus musculus
gagttcatcgtggtctacatagtga

SEQ ID NO: 498595 - DNA, 25 bp, Mus musculus
gagttcatcgtgtacctgctgggag

SEQ ID NO: 498596 - DNA, 25 bp, Mus musculus
gagttcatctacctctgggatttaa

SEQ ID NO: 498597 - DNA, 25 bp, Mus musculus
gagttcatctacgtctgggatttaa

SEQ ID NO: 498598 - DNA, 25 bp, Mus musculus
gagttcatctcactgcaagcaacaa

SEQ ID NO: 498599 - DNA, 25 bp, Mus musculus
gagttcatctcagtgcaagcaacaa

SEQ ID NO: 498600 - DNA, 25 bp, Mus musculus
gagttcatgaatctttcttctttaa

SEQ ID NO: 498601 - DNA, 25 bp, Mus musculus
gagttcatgaatgtttcttctttaa

SEQ ID NO: 498602 - DNA, 25 bp, Mus musculus
gagttcatgacacttccaagatctt

SEQ ID NO: 498603 - DNA, 25 bp, Mus musculus
gagttcatgacagttccaagatctt

SEQ ID NO: 498604 - DNA, 25 bp, Mus musculus
gagttcatgactatacttctgtttg

SEQ ID NO: 498605 - DNA, 25 bp, Mus musculus
gagttcatgactttacttctgtttg

SEQ ID NO: 498606 - DNA, 25 bp, Mus musculus
gagttcatgatcctctggtttccct

SEQ ID NO: 498607 - DNA, 25 bp, Mus musculus
gagttcatgatcgtctggtttccct

SEQ ID NO: 498608 - DNA, 25 bp, Mus musculus
gagttcatgcaacacccggatgagg

SEQ ID NO: 498609 - DNA, 25 bp, Mus musculus
gagttcatgcaagacccggatgagg

SEQ ID NO: 498610 - DNA, 25 bp, Mus musculus
gagttcatgctgactgagtacgata

SEQ ID NO: 498611 - DNA, 25 bp, Mus musculus
gagttcatgctgatatttagacagt

SEQ ID NO: 498612 - DNA, 25 bp, Mus musculus
gagttcatgctgtctgagtacgata

SEQ ID NO: 498613 - DNA, 25 bp, Mus musculus
gagttcatgctgttatttagacagt

SEQ ID NO: 498614 - DNA, 25 bp, Mus musculus
gagttcatggcacatatggacttag

SEQ ID NO: 498615 - DNA, 25 bp, Mus musculus
gagttcatggcagatatggacttag

SEQ ID NO: 498616 - DNA, 25 bp, Mus musculus
gagttcatgtgccagccacattcag

SEQ ID NO: 498617 - DNA, 25 bp, Mus musculus
gagttcatgtgcgagccacattcag

SEQ ID NO: 498618 - DNA, 25 bp, Mus musculus
gagttcatgtggaatcctcacctgg

SEQ ID NO: 498619 - DNA, 25 bp, Mus musculus
gagttcatgtggtatcctcacctgg

SEQ ID NO: 498620 - DNA, 25 bp, Mus musculus
gagttcatgttcactgtgcacttgg

SEQ ID NO: 498621 - DNA, 25 bp, Mus musculus
gagttcatgttctctgtgcacttgg

SEQ ID NO: 498622 - DNA, 25 bp, Mus musculus
gagttcatgtttcccagttctttgg

SEQ ID NO: 498623 - DNA, 25 bp, Mus musculus
gagttcatgtttgccagttctttgg

SEQ ID NO: 498624 - DNA, 25 bp, Mus musculus
gagttcattatcactgtggtctcat

SEQ ID NO: 498625 - DNA, 25 bp, Mus musculus
gagttcattatctctgtggtctcat

SEQ ID NO: 498626 - DNA, 25 bp, Mus musculus
gagttcattgagatcttggcctttt

SEQ ID NO: 498627 - DNA, 25 bp, Mus musculus
gagttcattgagttcttggcctttt

SEQ ID NO: 498628 - DNA, 25 bp, Mus musculus
gagttcattgatagcttaccactaa

SEQ ID NO: 498629 - DNA, 25 bp, Mus musculus
gagttcattgattgcttaccactaa

SEQ ID NO: 498630 - DNA, 25 bp, Mus musculus
gagttcattgcaaaccatcctgact

SEQ ID NO: 498631 - DNA, 25 bp, Mus musculus
gagttcattgcaatactgtcttaac

SEQ ID NO: 498632 - DNA, 25 bp, Mus musculus
gagttcattgcataccatcctgact

SEQ ID NO: 498633 - DNA, 25 bp, Mus musculus
gagttcattgcattactgtcttaac

SEQ ID NO: 498634 - DNA, 25 bp, Mus musculus
gagttcattggtacttactgtttca

SEQ ID NO: 498635 - DNA, 25 bp, Mus musculus
gagttcattggttcttactgtttca

SEQ ID NO: 498636 - DNA, 25 bp, Mus musculus
gagttcattgtcaatgcaccacatg

SEQ ID NO: 498637 - DNA, 25 bp, Mus musculus
gagttcattgtctatgcaccacatg

SEQ ID NO: 498638 - DNA, 25 bp, Mus musculus
gagttcattttaacctattagagac

SEQ ID NO: 498639 - DNA, 25 bp, Mus musculus
gagttcattttatcctattagagac

SEQ ID NO: 498640 - DNA, 25 bp, Mus musculus
gagttccaagacactggacttcgag

SEQ ID NO: 498641 - DNA, 25 bp, Mus musculus
gagttccaagactctggacttcgag

SEQ ID NO: 498642 - DNA, 25 bp, Mus musculus
gagttccaagccatctgggtctaaa

SEQ ID NO: 498643 - DNA, 25 bp, Mus musculus
gagttccaagccttctgggtctaaa

SEQ ID NO: 498644 - DNA, 25 bp, Mus musculus
gagttccaagctctgtgggaagccc

SEQ ID NO: 498645 - DNA, 25 bp, Mus musculus
gagttccaagctgtgtgggaagccc

SEQ ID NO: 498646 - DNA, 25 bp, Mus musculus
gagttccacaacactgtgttttgaa

SEQ ID NO: 498647 - DNA, 25 bp, Mus musculus
gagttccacaactctgtgttttgaa

SEQ ID NO: 498648 - DNA, 25 bp, Mus musculus
gagttccaccaaatgctttgtttac

SEQ ID NO: 498649 - DNA, 25 bp, Mus musculus
gagttccaccaattgctttgtttac

SEQ ID NO: 498650 - DNA, 25 bp, Mus musculus
gagttccaccagcacttgtcaaggc

SEQ ID NO: 498651 - DNA, 25 bp, Mus musculus
gagttccaccaggacttgtcaaggc

SEQ ID NO: 498652 - DNA, 25 bp, Mus musculus
gagttccacggcaggagtctgtcca

SEQ ID NO: 498653 - DNA, 25 bp, Mus musculus
gagttccacggctggagtctgtcca

SEQ ID NO: 498654 - DNA, 25 bp, Mus musculus
gagttccactctagcatcctcagtg

SEQ ID NO: 498655 - DNA, 25 bp, Mus musculus
gagttccactcttgcatcctcagtg

SEQ ID NO: 498656 - DNA, 25 bp, Mus musculus
gagttccactgaccttgtgtagaaa

SEQ ID NO: 498657 - DNA, 25 bp, Mus musculus
gagttccactgagcttgtgtagaaa

SEQ ID NO: 498658 - DNA, 25 bp, Mus musculus
gagttccactttatggtttagccac

SEQ ID NO: 498659 - DNA, 25 bp, Mus musculus
gagttccactttttggtttagccac

SEQ ID NO: 498660 - DNA, 25 bp, Mus musculus
gagttccagagaagggacgtgcccc

SEQ ID NO: 498661 - DNA, 25 bp, Mus musculus
gagttccagagatgggacgtgcccc

SEQ ID NO: 498662 - DNA, 25 bp, Mus musculus
gagttccagaggactgtcagtcaat

SEQ ID NO: 498663 - DNA, 25 bp, Mus musculus
gagttccagaggtctgtcagtcaat

SEQ ID NO: 498664 - DNA, 25 bp, Mus musculus
gagttccaggaacaagatgagaaga

SEQ ID NO: 498665 - DNA, 25 bp, Mus musculus
gagttccaggaagaagatgagaaga

SEQ ID NO: 498666 - DNA, 25 bp, Mus musculus
gagttccaggagactatggtctaca

SEQ ID NO: 498667 - DNA, 25 bp, Mus musculus
gagttccaggagtctatggtctaca

SEQ ID NO: 498668 - DNA, 25 bp, Mus musculus
gagttccaggcaagctcccctgaca

SEQ ID NO: 498669 - DNA, 25 bp, Mus musculus
gagttccaggcatgctcccctgaca

SEQ ID NO: 498670 - DNA, 25 bp, Mus musculus
gagttccaggctaatgagacctcat

SEQ ID NO: 498671 - DNA, 25 bp, Mus musculus
gagttccaggcttatgagacctcat

SEQ ID NO: 498672 - DNA, 25 bp, Mus musculus
gagttccagggcctttcttaaagtg

SEQ ID NO: 498673 - DNA, 25 bp, Mus musculus
gagttccagggcgtttcttaaagtg

SEQ ID NO: 498674 - DNA, 25 bp, Mus musculus
gagttccaggtgagtcgggccacac

SEQ ID NO: 498675 - DNA, 25 bp, Mus musculus
gagttccaggtgattctgggctaac

SEQ ID NO: 498676 - DNA, 25 bp, Mus musculus
gagttccaggtgtgtcgggccacac

SEQ ID NO: 498677 - DNA, 25 bp, Mus musculus
gagttccaggtgtttctgggctaac

SEQ ID NO: 498678 - DNA, 25 bp, Mus musculus
gagttccagtctagggtccggtgct

SEQ ID NO: 498679 - DNA, 25 bp, Mus musculus
gagttccagtcttgggtccggtgct

SEQ ID NO: 498680 - DNA, 25 bp, Mus musculus
gagttccagtgacaccaaggctatc

SEQ ID NO: 498681 - DNA, 25 bp, Mus musculus
gagttccagtgagaccaaggctatc

SEQ ID NO: 498682 - DNA, 25 bp, Mus musculus
gagttccagtgcaccttcaagaaac

SEQ ID NO: 498683 - DNA, 25 bp, Mus musculus
gagttccagtgctccttcaagaaac

SEQ ID NO: 498684 - DNA, 25 bp, Mus musculus
gagttccatagcacttctgacagta

SEQ ID NO: 498685 - DNA, 25 bp, Mus musculus
gagttccatagctcttctgacagta

SEQ ID NO: 498686 - DNA, 25 bp, Mus musculus
gagttccatagtaagggtaatccac

SEQ ID NO: 498687 - DNA, 25 bp, Mus musculus
gagttccatagttagggtaatccac

SEQ ID NO: 498688 - DNA, 25 bp, Mus musculus
gagttccatcatctgttttctttgt

SEQ ID NO: 498689 - DNA, 25 bp, Mus musculus
gagttccatcatgtgttttctttgt

SEQ ID NO: 498690 - DNA, 25 bp, Mus musculus
gagttccatcctaatggcatcgaga

SEQ ID NO: 498691 - DNA, 25 bp, Mus musculus
gagttccatccttatggcatcgaga

SEQ ID NO: 498692 - DNA, 25 bp, Mus musculus
gagttccatcggctgtctttaaata

SEQ ID NO: 498693 - DNA, 25 bp, Mus musculus
gagttccatcgggtgtctttaaata

SEQ ID NO: 498694 - DNA, 25 bp, Mus musculus
gagttccatgccaataaggccatta

SEQ ID NO: 498695 - DNA, 25 bp, Mus musculus
gagttccatgcctataaggccatta

SEQ ID NO: 498696 - DNA, 25 bp, Mus musculus
gagttccatggtcccaaggtttggt

SEQ ID NO: 498697 - DNA, 25 bp, Mus musculus
gagttccatggtgccaaggtttggt

SEQ ID NO: 498698 - DNA, 25 bp, Mus musculus
gagttccatgtaagacttgccctta

SEQ ID NO: 498699 - DNA, 25 bp, Mus musculus
gagttccatgtaccagtcactgatt

SEQ ID NO: 498700 - DNA, 25 bp, Mus musculus
gagttccatgtagcagtcactgatt

SEQ ID NO: 498701 - DNA, 25 bp, Mus musculus
gagttccatgtatgacttgccctta

SEQ ID NO: 498702 - DNA, 25 bp, Mus musculus
gagttccattacaagtagctgtcgt

SEQ ID NO: 498703 - DNA, 25 bp, Mus musculus
gagttccattactagtagctgtcgt

SEQ ID NO: 498704 - DNA, 25 bp, Mus musculus
gagttccattatctctggtccagtg

SEQ ID NO: 498705 - DNA, 25 bp, Mus musculus
gagttccattatgtctggtccagtg

SEQ ID NO: 498706 - DNA, 25 bp, Mus musculus
gagttcccaagtatcagagggcaaa

SEQ ID NO: 498707 - DNA, 25 bp, Mus musculus
gagttcccaagtttcagagggcaaa

SEQ ID NO: 498708 - DNA, 25 bp, Mus musculus
gagttcccaataagcctctttctaa

SEQ ID NO: 498709 - DNA, 25 bp, Mus musculus
gagttcccaatatgcctctttctaa

SEQ ID NO: 498710 - DNA, 25 bp, Mus musculus
gagttcccacaacgtcatgatccaa

SEQ ID NO: 498711 - DNA, 25 bp, Mus musculus
gagttcccacaaggtcatgatccaa

SEQ ID NO: 498712 - DNA, 25 bp, Mus musculus
gagttcccacacatggcggttggat

SEQ ID NO: 498713 - DNA, 25 bp, Mus musculus
gagttcccacacttggcggttggat

SEQ ID NO: 498714 - DNA, 25 bp, Mus musculus
gagttcccactaagctatggaccta

SEQ ID NO: 498715 - DNA, 25 bp, Mus musculus
gagttcccactatgctatggaccta

SEQ ID NO: 498716 - DNA, 25 bp, Mus musculus
gagttcccagaacgatggtttcttt

SEQ ID NO: 498717 - DNA, 25 bp, Mus musculus
gagttcccagaaggatggtttcttt

SEQ ID NO: 498718 - DNA, 25 bp, Mus musculus
gagttcccaggtcatgggtccaaga

SEQ ID NO: 498719 - DNA, 25 bp, Mus musculus
gagttcccaggtgatgggtccaaga

SEQ ID NO: 498720 - DNA, 25 bp, Mus musculus
gagttcccagtccttaacaagccca

SEQ ID NO: 498721 - DNA, 25 bp, Mus musculus
gagttcccagtcgttaacaagccca

SEQ ID NO: 498722 - DNA, 25 bp, Mus musculus
gagttcccatcaagctttggtgcag

SEQ ID NO: 498723 - DNA, 25 bp, Mus musculus
gagttcccatcatgctttggtgcag

SEQ ID NO: 498724 - DNA, 25 bp, Mus musculus
gagttcccatccaggtatacttgtt

SEQ ID NO: 498725 - DNA, 25 bp, Mus musculus
gagttcccatcctggtatacttgtt

SEQ ID NO: 498726 - DNA, 25 bp, Mus musculus
gagttcccatttacgcttttctgag

SEQ ID NO: 498727 - DNA, 25 bp, Mus musculus
gagttcccattttcgcttttctgag

SEQ ID NO: 498728 - DNA, 25 bp, Mus musculus
gagttccccactctttctgaagatt

SEQ ID NO: 498729 - DNA, 25 bp, Mus musculus
gagttccccactgtttctgaagatt

SEQ ID NO: 498730 - DNA, 25 bp, Mus musculus
gagttcccctgacactgttgtaaga

SEQ ID NO: 498731 - DNA, 25 bp, Mus musculus
gagttcccctgacccattaatatat

SEQ ID NO: 498732 - DNA, 25 bp, Mus musculus
gagttcccctgagactgttgtaaga

SEQ ID NO: 498733 - DNA, 25 bp, Mus musculus
gagttcccctgagccattaatatat

SEQ ID NO: 498734 - DNA, 25 bp, Mus musculus
gagttccccttcactgtcagtttga

SEQ ID NO: 498735 - DNA, 25 bp, Mus musculus
gagttccccttctctgtcagtttga

SEQ ID NO: 498736 - DNA, 25 bp, Mus musculus
gagttcccgaagaaagtacctgaga

SEQ ID NO: 498737 - DNA, 25 bp, Mus musculus
gagttcccgaagtaagtacctgaga

SEQ ID NO: 498738 - DNA, 25 bp, Mus musculus
gagttcccgcaccatatttatactg

SEQ ID NO: 498739 - DNA, 25 bp, Mus musculus
gagttcccgcacgatatttatactg

SEQ ID NO: 498740 - DNA, 25 bp, Mus musculus
gagttcccgcccagacagaaaaagg

SEQ ID NO: 498741 - DNA, 25 bp, Mus musculus
gagttcccgccctgacagaaaaagg

SEQ ID NO: 498742 - DNA, 25 bp, Mus musculus
gagttccctaaaagtgaatacccat

SEQ ID NO: 498743 - DNA, 25 bp, Mus musculus
gagttccctaaatgtgaatacccat

SEQ ID NO: 498744 - DNA, 25 bp, Mus musculus
gagttccctctgcattcaatcattt

SEQ ID NO: 498745 - DNA, 25 bp, Mus musculus
gagttccctctggattcaatcattt

SEQ ID NO: 498746 - DNA, 25 bp, Mus musculus
gagttccctcttaggctcttggcct

SEQ ID NO: 498747 - DNA, 25 bp, Mus musculus
gagttccctctttggctcttggcct

SEQ ID NO: 498748 - DNA, 25 bp, Mus musculus
gagttccctttcagtatctatcaaa

SEQ ID NO: 498749 - DNA, 25 bp, Mus musculus
gagttccctttctgtatctatcaaa

SEQ ID NO: 498750 - DNA, 25 bp, Mus musculus
gagttccctttgcaaaggccctgag

SEQ ID NO: 498751 - DNA, 25 bp, Mus musculus
gagttccctttggaaaggccctgag

SEQ ID NO: 498752 - DNA, 25 bp, Mus musculus
gagttccgacgcactgtggagccca

SEQ ID NO: 498753 - DNA, 25 bp, Mus musculus
gagttccgacgctctgtggagccca

SEQ ID NO: 498754 - DNA, 25 bp, Mus musculus
gagttccgagtcacagccatgtgca

SEQ ID NO: 498755 - DNA, 25 bp, Mus musculus
gagttccgagtctcagccatgtgca

SEQ ID NO: 498756 - DNA, 25 bp, Mus musculus
gagttccgcactcatgaagtatcta

SEQ ID NO: 498757 - DNA, 25 bp, Mus musculus
gagttccgcactgatgaagtatcta

SEQ ID NO: 498758 - DNA, 25 bp, Mus musculus
gagttccggaacatcaagatcatct

SEQ ID NO: 498759 - DNA, 25 bp, Mus musculus
gagttccggaacttcaagatcatct

SEQ ID NO: 498760 - DNA, 25 bp, Mus musculus
gagttccgggtcatctgggacaagc

SEQ ID NO: 498761 - DNA, 25 bp, Mus musculus
gagttccgggtcatggtgtgcattc

SEQ ID NO: 498762 - DNA, 25 bp, Mus musculus
gagttccgggtcttctgggacaagc

SEQ ID NO: 498763 - DNA, 25 bp, Mus musculus
gagttccgggtcttggtgtgcattc

SEQ ID NO: 498764 - DNA, 25 bp, Mus musculus
gagttccggtttcatctttccaaga

SEQ ID NO: 498765 - DNA, 25 bp, Mus musculus
gagttccggtttgatctttccaaga

SEQ ID NO: 498766 - DNA, 25 bp, Mus musculus
gagttccgtaatagggtattcaggt

SEQ ID NO: 498767 - DNA, 25 bp, Mus musculus
gagttccgtaattgggtattcaggt

SEQ ID NO: 498768 - DNA, 25 bp, Mus musculus
gagttccgtataatgggtcagttat

SEQ ID NO: 498769 - DNA, 25 bp, Mus musculus
gagttccgtatattgggtcagttat

SEQ ID NO: 498770 - DNA, 25 bp, Mus musculus
gagttcctaaggctctgaagatgac

SEQ ID NO: 498771 - DNA, 25 bp, Mus musculus
gagttcctaagggtctgaagatgac

SEQ ID NO: 498772 - DNA, 25 bp, Mus musculus
gagttcctactcagtgtcaacataa

SEQ ID NO: 498773 - DNA, 25 bp, Mus musculus
gagttcctactctgtgtcaacataa

SEQ ID NO: 498774 - DNA, 25 bp, Mus musculus
gagttcctagctatcattaagtatt

SEQ ID NO: 498775 - DNA, 25 bp, Mus musculus
gagttcctagctttcattaagtatt

SEQ ID NO: 498776 - DNA, 25 bp, Mus musculus
gagttcctagtccagcctgcttgtt

SEQ ID NO: 498777 - DNA, 25 bp, Mus musculus
gagttcctagtcgagcctgcttgtt

SEQ ID NO: 498778 - DNA, 25 bp, Mus musculus
gagttcctcacaaactgcagttatt

SEQ ID NO: 498779 - DNA, 25 bp, Mus musculus
gagttcctcacatactgcagttatt

SEQ ID NO: 498780 - DNA, 25 bp, Mus musculus
gagttcctcaccctgtctagactag

SEQ ID NO: 498781 - DNA, 25 bp, Mus musculus
gagttcctcaccgtgtctagactag

SEQ ID NO: 498782 - DNA, 25 bp, Mus musculus
gagttcctcagacagtacgttctta

SEQ ID NO: 498783 - DNA, 25 bp, Mus musculus
gagttcctcagagagtacgttctta

SEQ ID NO: 498784 - DNA, 25 bp, Mus musculus
gagttcctcagcaaggcccgagaga

SEQ ID NO: 498785 - DNA, 25 bp, Mus musculus
gagttcctcagctaggcccgagaga

SEQ ID NO: 498786 - DNA, 25 bp, Mus musculus
gagttcctcaggactgactctaagg

SEQ ID NO: 498787 - DNA, 25 bp, Mus musculus
gagttcctcaggtctgactctaagg

SEQ ID NO: 498788 - DNA, 25 bp, Mus musculus
gagttcctcattcttatctctacct

SEQ ID NO: 498789 - DNA, 25 bp, Mus musculus
gagttcctcattgttatctctacct

SEQ ID NO: 498790 - DNA, 25 bp, Mus musculus
gagttcctcccgctttctgagcagg

SEQ ID NO: 498791 - DNA, 25 bp, Mus musculus
gagttcctcccggtttctgagcagg

SEQ ID NO: 498792 - DNA, 25 bp, Mus musculus
gagttcctcctccaaggatctgttt

SEQ ID NO: 498793 - DNA, 25 bp, Mus musculus
gagttcctcctcgaaggatctgttt

SEQ ID NO: 498794 - DNA, 25 bp, Mus musculus
gagttcctcgagaaacaggatggat

SEQ ID NO: 498795 - DNA, 25 bp, Mus musculus
gagttcctcgagtaacaggatggat

SEQ ID NO: 498796 - DNA, 25 bp, Mus musculus
gagttcctcgggattcctggaattc

SEQ ID NO: 498797 - DNA, 25 bp, Mus musculus
gagttcctcgggtttcctggaattc

SEQ ID NO: 498798 - DNA, 25 bp, Mus musculus
gagttcctcgtgacgtcctacaata

SEQ ID NO: 498799 - DNA, 25 bp, Mus musculus
gagttcctcgtgtcgtcctacaata

SEQ ID NO: 498800 - DNA, 25 bp, Mus musculus
gagttcctctatcacgaggtacatc

SEQ ID NO: 498801 - DNA, 25 bp, Mus musculus
gagttcctctatgacgaggtacatc

SEQ ID NO: 498802 - DNA, 25 bp, Mus musculus
gagttcctctctaacagtgcatatg

SEQ ID NO: 498803 - DNA, 25 bp, Mus musculus
gagttcctctctcactaattggctt

SEQ ID NO: 498804 - DNA, 25 bp, Mus musculus
gagttcctctctgactaattggctt

SEQ ID NO: 498805 - DNA, 25 bp, Mus musculus
gagttcctctcttacagtgcatatg

SEQ ID NO: 498806 - DNA, 25 bp, Mus musculus
gagttcctctgtccgatacagacat

SEQ ID NO: 498807 - DNA, 25 bp, Mus musculus
gagttcctctgtgcgatacagacat

SEQ ID NO: 498808 - DNA, 25 bp, Mus musculus
gagttcctgaacattaagaggctac

SEQ ID NO: 498809 - DNA, 25 bp, Mus musculus
gagttcctgaactttaagaggctac

SEQ ID NO: 498810 - DNA, 25 bp, Mus musculus
gagttcctgaatcatggccccaagc

SEQ ID NO: 498811 - DNA, 25 bp, Mus musculus
gagttcctgaatgatggccccaagc

SEQ ID NO: 498812 - DNA, 25 bp, Mus musculus
gagttcctgaccacaaaggtccgat

SEQ ID NO: 498813 - DNA, 25 bp, Mus musculus
gagttcctgacctcaaaggtccgat

SEQ ID NO: 498814 - DNA, 25 bp, Mus musculus
gagttcctgactatgttctttctca

SEQ ID NO: 498815 - DNA, 25 bp, Mus musculus
gagttcctgactttgttctttctca

SEQ ID NO: 498816 - DNA, 25 bp, Mus musculus
gagttcctgagtctggagaacacta

SEQ ID NO: 498817 - DNA, 25 bp, Mus musculus
gagttcctgagtgtggagaacacta

SEQ ID NO: 498818 - DNA, 25 bp, Mus musculus
gagttcctgcgcatcatgaaaaaga

SEQ ID NO: 498819 - DNA, 25 bp, Mus musculus
gagttcctgcgcttcatgaaaaaga

SEQ ID NO: 498820 - DNA, 25 bp, Mus musculus
gagttcctgctgagttttgacacca

SEQ ID NO: 498821 - DNA, 25 bp, Mus musculus
gagttcctgctgtgttttgacacca

SEQ ID NO: 498822 - DNA, 25 bp, Mus musculus
gagttcctggagatcatttctgatg

SEQ ID NO: 498823 - DNA, 25 bp, Mus musculus
gagttcctggagttcatttctgatg

SEQ ID NO: 498824 - DNA, 25 bp, Mus musculus
gagttcctggccacattgaatcaca

SEQ ID NO: 498825 - DNA, 25 bp, Mus musculus
gagttcctggccacggataagtgtc

SEQ ID NO: 498826 - DNA, 25 bp, Mus musculus
gagttcctggcccaccgagagagtt

SEQ ID NO: 498827 - DNA, 25 bp, Mus musculus
gagttcctggccgaccgagagagtt

SEQ ID NO: 498828 - DNA, 25 bp, Mus musculus
gagttcctggcctcattgaatcaca

SEQ ID NO: 498829 - DNA, 25 bp, Mus musculus
gagttcctggcctcggataagtgtc

SEQ ID NO: 498830 - DNA, 25 bp, Mus musculus
gagttcctgggcatcctaacagagc

SEQ ID NO: 498831 - DNA, 25 bp, Mus musculus
gagttcctgggcttcctaacagagc

SEQ ID NO: 498832 - DNA, 25 bp, Mus musculus
gagttcctggttccacactgtgcac

SEQ ID NO: 498833 - DNA, 25 bp, Mus musculus
gagttcctggttgcacactgtgcac

SEQ ID NO: 498834 - DNA, 25 bp, Mus musculus
gagttcctgtcgcatatccttggca

SEQ ID NO: 498835 - DNA, 25 bp, Mus musculus
gagttcctgtcggatatccttggca

SEQ ID NO: 498836 - DNA, 25 bp, Mus musculus
gagttcctgtggcaatgaagtctaa

SEQ ID NO: 498837 - DNA, 25 bp, Mus musculus
gagttcctgtgggaatgaagtctaa

SEQ ID NO: 498838 - DNA, 25 bp, Mus musculus
gagttcctgtgtaaaattcctagca

SEQ ID NO: 498839 - DNA, 25 bp, Mus musculus
gagttcctgtgtaattgagacctat

SEQ ID NO: 498840 - DNA, 25 bp, Mus musculus
gagttcctgtgttaaattcctagca

SEQ ID NO: 498841 - DNA, 25 bp, Mus musculus
gagttcctgtgttattgagacctat

SEQ ID NO: 498842 - DNA, 25 bp, Mus musculus
gagttccttatgaagcacacagcct

SEQ ID NO: 498843 - DNA, 25 bp, Mus musculus
gagttccttatgtagcacacagcct

SEQ ID NO: 498844 - DNA, 25 bp, Mus musculus
gagttccttcaaactgtttagtcaa

SEQ ID NO: 498845 - DNA, 25 bp, Mus musculus
gagttccttcaatctgtttagtcaa

SEQ ID NO: 498846 - DNA, 25 bp, Mus musculus
gagttccttcagagcgtcctagaga

SEQ ID NO: 498847 - DNA, 25 bp, Mus musculus
gagttccttcagtgcgtcctagaga

SEQ ID NO: 498848 - DNA, 25 bp, Mus musculus
gagttccttcatagtcttaaaaagc

SEQ ID NO: 498849 - DNA, 25 bp, Mus musculus
gagttccttcatcgcatctgtccat

SEQ ID NO: 498850 - DNA, 25 bp, Mus musculus
gagttccttcatggcatctgtccat

SEQ ID NO: 498851 - DNA, 25 bp, Mus musculus
gagttccttcattgtcttaaaaagc

SEQ ID NO: 498852 - DNA, 25 bp, Mus musculus
gagttccttccaaaatcgaaaacag

SEQ ID NO: 498853 - DNA, 25 bp, Mus musculus
gagttccttccactgtctcaagtca

SEQ ID NO: 498854 - DNA, 25 bp, Mus musculus
gagttccttccagtgtctcaagtca

SEQ ID NO: 498855 - DNA, 25 bp, Mus musculus
gagttccttccataatcgaaaacag

SEQ ID NO: 498856 - DNA, 25 bp, Mus musculus
gagttccttcctctcacttttgcta

SEQ ID NO: 498857 - DNA, 25 bp, Mus musculus
gagttccttcctgtcacttttgcta

SEQ ID NO: 498858 - DNA, 25 bp, Mus musculus
gagttccttctgctttgagttcttg

SEQ ID NO: 498859 - DNA, 25 bp, Mus musculus
gagttccttctggtttgagttcttg

SEQ ID NO: 498860 - DNA, 25 bp, Mus musculus
gagttccttgctaatgctccacgta

SEQ ID NO: 498861 - DNA, 25 bp, Mus musculus
gagttccttgcttatgctccacgta

SEQ ID NO: 498862 - DNA, 25 bp, Mus musculus
gagttccttgtgctagatacccggg

SEQ ID NO: 498863 - DNA, 25 bp, Mus musculus
gagttccttgtggtagatacccggg

SEQ ID NO: 498864 - DNA, 25 bp, Mus musculus
gagttcgaaccgagacgtagaggcc

SEQ ID NO: 498865 - DNA, 25 bp, Mus musculus
gagttcgaaccgtgacgtagaggcc

SEQ ID NO: 498866 - DNA, 25 bp, Mus musculus
gagttcgaatatctcctggctgctg

SEQ ID NO: 498867 - DNA, 25 bp, Mus musculus
gagttcgaatatgtcctggctgctg

SEQ ID NO: 498868 - DNA, 25 bp, Mus musculus
gagttcgagcacctaaccctatttt

SEQ ID NO: 498869 - DNA, 25 bp, Mus musculus
gagttcgagcacgtaaccctatttt

SEQ ID NO: 498870 - DNA, 25 bp, Mus musculus
gagttcgagcgaaacctggcccgat

SEQ ID NO: 498871 - DNA, 25 bp, Mus musculus
gagttcgagcgatacctggcccgat

SEQ ID NO: 498872 - DNA, 25 bp, Mus musculus
gagttcgaggacagagcgagttcta

SEQ ID NO: 498873 - DNA, 25 bp, Mus musculus
gagttcgaggactgagcgagttcta

SEQ ID NO: 498874 - DNA, 25 bp, Mus musculus
gagttcgaggttagcctggcttatg

SEQ ID NO: 498875 - DNA, 25 bp, Mus musculus
gagttcgaggtttgcctggcttatg

SEQ ID NO: 498876 - DNA, 25 bp, Mus musculus
gagttcgagtgtatatattgtccat

SEQ ID NO: 498877 - DNA, 25 bp, Mus musculus
gagttcgagtgtttatattgtccat

SEQ ID NO: 498878 - DNA, 25 bp, Mus musculus
gagttcgcactgaccgcggacttgt

SEQ ID NO: 498879 - DNA, 25 bp, Mus musculus
gagttcgcactgtccgcggacttgt

SEQ ID NO: 498880 - DNA, 25 bp, Mus musculus
gagttcgcctgccttgacaacttgg

SEQ ID NO: 498881 - DNA, 25 bp, Mus musculus
gagttcgcctgcgttgacaacttgg

SEQ ID NO: 498882 - DNA, 25 bp, Mus musculus
gagttcgccttcaatgacaatacct

SEQ ID NO: 498883 - DNA, 25 bp, Mus musculus
gagttcgccttctatgacaatacct

SEQ ID NO: 498884 - DNA, 25 bp, Mus musculus
gagttcgctgcactgattaacccgc

SEQ ID NO: 498885 - DNA, 25 bp, Mus musculus
gagttcgctgcagtgattaacccgc

SEQ ID NO: 498886 - DNA, 25 bp, Mus musculus
gagttcgctgcccacccagatggat

SEQ ID NO: 498887 - DNA, 25 bp, Mus musculus
gagttcgctgccgacccagatggat

SEQ ID NO: 498888 - DNA, 25 bp, Mus musculus
gagttcggcagtaaagcatgctcac

SEQ ID NO: 498889 - DNA, 25 bp, Mus musculus
gagttcggcagttaagcatgctcac

SEQ ID NO: 498890 - DNA, 25 bp, Mus musculus
gagttcggtacaaggaagccccgct

SEQ ID NO: 498891 - DNA, 25 bp, Mus musculus
gagttcggtacatggaagccccgct

SEQ ID NO: 498892 - DNA, 25 bp, Mus musculus
gagttcggtttcattgacatcattg

SEQ ID NO: 498893 - DNA, 25 bp, Mus musculus
gagttcggtttctttgacatcattg

SEQ ID NO: 498894 - DNA, 25 bp, Mus musculus
gagttcggttttccttgaccttcct

SEQ ID NO: 498895 - DNA, 25 bp, Mus musculus
gagttcggttttgcttgaccttcct

SEQ ID NO: 498896 - DNA, 25 bp, Mus musculus
gagttcgtatacaatcatgggccgt

SEQ ID NO: 498897 - DNA, 25 bp, Mus musculus
gagttcgtatactatcatgggccgt

SEQ ID NO: 498898 - DNA, 25 bp, Mus musculus
gagttcgtgaacatggtgcccacca

SEQ ID NO: 498899 - DNA, 25 bp, Mus musculus
gagttcgtgaacttggtgcccacca

SEQ ID NO: 498900 - DNA, 25 bp, Mus musculus
gagttcgttttgaagtacaccagga

SEQ ID NO: 498901 - DNA, 25 bp, Mus musculus
gagttcgttttgtagtacaccagga

SEQ ID NO: 498902 - DNA, 25 bp, Mus musculus
gagttctaaagaccctgacctacaa

SEQ ID NO: 498903 - DNA, 25 bp, Mus musculus
gagttctaaagagcctgacctacaa

SEQ ID NO: 498904 - DNA, 25 bp, Mus musculus
gagttctaaataaccctatacagta

SEQ ID NO: 498905 - DNA, 25 bp, Mus musculus
gagttctaaatatccctatacagta

SEQ ID NO: 498906 - DNA, 25 bp, Mus musculus
gagttctaaatgacgcacagtgctt

SEQ ID NO: 498907 - DNA, 25 bp, Mus musculus
gagttctaaatgtcgcacagtgctt

SEQ ID NO: 498908 - DNA, 25 bp, Mus musculus
gagttctaacatcgtgcatctctgc

SEQ ID NO: 498909 - DNA, 25 bp, Mus musculus
gagttctaacatggtgcatctctgc

SEQ ID NO: 498910 - DNA, 25 bp, Mus musculus
gagttctaagccaatcagaccctac

SEQ ID NO: 498911 - DNA, 25 bp, Mus musculus
gagttctaagcctatcagaccctac

SEQ ID NO: 498912 - DNA, 25 bp, Mus musculus
gagttctacagacctgctccggcac

SEQ ID NO: 498913 - DNA, 25 bp, Mus musculus
gagttctacagagctgctccggcac

SEQ ID NO: 498914 - DNA, 25 bp, Mus musculus
gagttctacatcaatagagtgtagg

SEQ ID NO: 498915 - DNA, 25 bp, Mus musculus
gagttctacatctatagagtgtagg

SEQ ID NO: 498916 - DNA, 25 bp, Mus musculus
gagttctactccaaagctgatgcac

SEQ ID NO: 498917 - DNA, 25 bp, Mus musculus
gagttctactcctaagctgatgcac

SEQ ID NO: 498918 - DNA, 25 bp, Mus musculus
gagttctagccaatttctttctcag

SEQ ID NO: 498919 - DNA, 25 bp, Mus musculus
gagttctagccattttctttctcag

SEQ ID NO: 498920 - DNA, 25 bp, Mus musculus
gagttctagggcctcgtagatgcca

SEQ ID NO: 498921 - DNA, 25 bp, Mus musculus
gagttctagggcgtcgtagatgcca

SEQ ID NO: 498922 - DNA, 25 bp, Mus musculus
gagttctatctcagggatctacatg

SEQ ID NO: 498923 - DNA, 25 bp, Mus musculus
gagttctatctctgggatctacatg

SEQ ID NO: 498924 - DNA, 25 bp, Mus musculus
gagttctatcttacttccagtctaa

SEQ ID NO: 498925 - DNA, 25 bp, Mus musculus
gagttctatctttcttccagtctaa

SEQ ID NO: 498926 - DNA, 25 bp, Mus musculus
gagttctatgatacaccagatccag

SEQ ID NO: 498927 - DNA, 25 bp, Mus musculus
gagttctatgattcaccagatccag

SEQ ID NO: 498928 - DNA, 25 bp, Mus musculus
gagttctatgtacgtccccgggaag

SEQ ID NO: 498929 - DNA, 25 bp, Mus musculus
gagttctatgtaggtccccgggaag

SEQ ID NO: 498930 - DNA, 25 bp, Mus musculus
gagttctatgtgacaccagaggacc

SEQ ID NO: 498931 - DNA, 25 bp, Mus musculus
gagttctatgtgtcaccagaggacc

SEQ ID NO: 498932 - DNA, 25 bp, Mus musculus
gagttctattgcatcacttcagtgc

SEQ ID NO: 498933 - DNA, 25 bp, Mus musculus
gagttctattgcttcacttcagtgc

SEQ ID NO: 498934 - DNA, 25 bp, Mus musculus
gagttctattttcacagattctaca

SEQ ID NO: 498935 - DNA, 25 bp, Mus musculus
gagttctattttgacagattctaca

SEQ ID NO: 498936 - DNA, 25 bp, Mus musculus
gagttctcaaagacttctcattcca

SEQ ID NO: 498937 - DNA, 25 bp, Mus musculus
gagttctcaaagtcttctcattcca

SEQ ID NO: 498938 - DNA, 25 bp, Mus musculus
gagttctcaaatagtaatagccctg

SEQ ID NO: 498939 - DNA, 25 bp, Mus musculus
gagttctcaaattgtaatagccctg

SEQ ID NO: 498940 - DNA, 25 bp, Mus musculus
gagttctcaagcattatgggtctgt

SEQ ID NO: 498941 - DNA, 25 bp, Mus musculus
gagttctcaagctttatgggtctgt

SEQ ID NO: 498942 - DNA, 25 bp, Mus musculus
gagttctcaagtctttgtgggcata

SEQ ID NO: 498943 - DNA, 25 bp, Mus musculus
gagttctcaagtgtttgtgggcata

SEQ ID NO: 498944 - DNA, 25 bp, Mus musculus
gagttctcaattaaacactttcaag

SEQ ID NO: 498945 - DNA, 25 bp, Mus musculus
gagttctcaatttaacactttcaag

SEQ ID NO: 498946 - DNA, 25 bp, Mus musculus
gagttctcacaacaggctaacggta

SEQ ID NO: 498947 - DNA, 25 bp, Mus musculus
gagttctcacaagaggctaacggta

SEQ ID NO: 498948 - DNA, 25 bp, Mus musculus
gagttctcacctcttgtatactggt

SEQ ID NO: 498949 - DNA, 25 bp, Mus musculus
gagttctcacctgttgtatactggt

SEQ ID NO: 498950 - DNA, 25 bp, Mus musculus
gagttctcagagatagacagcgact

SEQ ID NO: 498951 - DNA, 25 bp, Mus musculus
gagttctcagagcaaacaactatcc

SEQ ID NO: 498952 - DNA, 25 bp, Mus musculus
gagttctcagaggaaacaactatcc

SEQ ID NO: 498953 - DNA, 25 bp, Mus musculus
gagttctcagagttagacagcgact

SEQ ID NO: 498954 - DNA, 25 bp, Mus musculus
gagttctcataacttgggccttcat

SEQ ID NO: 498955 - DNA, 25 bp, Mus musculus
gagttctcataagttgggccttcat

SEQ ID NO: 498956 - DNA, 25 bp, Mus musculus
gagttctcatgcaactgcaggcgga

SEQ ID NO: 498957 - DNA, 25 bp, Mus musculus
gagttctcatgctactgcaggcgga

SEQ ID NO: 498958 - DNA, 25 bp, Mus musculus
gagttctcattacacccgaggtcca

SEQ ID NO: 498959 - DNA, 25 bp, Mus musculus
gagttctcattagacccgaggtcca

SEQ ID NO: 498960 - DNA, 25 bp, Mus musculus
gagttctccaaacttatcaacggta

SEQ ID NO: 498961 - DNA, 25 bp, Mus musculus
gagttctccaaagttatcaacggta

SEQ ID NO: 498962 - DNA, 25 bp, Mus musculus
gagttctccaacagcattataccta

SEQ ID NO: 498963 - DNA, 25 bp, Mus musculus
gagttctccaactgcattataccta

SEQ ID NO: 498964 - DNA, 25 bp, Mus musculus
gagttctccagaatctcctctatgg

SEQ ID NO: 498965 - DNA, 25 bp, Mus musculus
gagttctccagattctcctctatgg

SEQ ID NO: 498966 - DNA, 25 bp, Mus musculus
gagttctccagcactctgaacctta

SEQ ID NO: 498967 - DNA, 25 bp, Mus musculus
gagttctccagctctctgaacctta

SEQ ID NO: 498968 - DNA, 25 bp, Mus musculus
gagttctccagtctgcttgagatct

SEQ ID NO: 498969 - DNA, 25 bp, Mus musculus
gagttctccagtgtgcttgagatct

SEQ ID NO: 498970 - DNA, 25 bp, Mus musculus
gagttctccatcacaggcgagggac

SEQ ID NO: 498971 - DNA, 25 bp, Mus musculus
gagttctccatctcaggcgagggac

SEQ ID NO: 498972 - DNA, 25 bp, Mus musculus
gagttctccattctaaatcctcctc

SEQ ID NO: 498973 - DNA, 25 bp, Mus musculus
gagttctccattgtaaatcctcctc

SEQ ID NO: 498974 - DNA, 25 bp, Mus musculus
gagttctcgatcaattaatcttgtt

SEQ ID NO: 498975 - DNA, 25 bp, Mus musculus
gagttctcgatctattaatcttgtt

SEQ ID NO: 498976 - DNA, 25 bp, Mus musculus
gagttctcgctccatgattttcaag

SEQ ID NO: 498977 - DNA, 25 bp, Mus musculus
gagttctcgctcgatgattttcaag

SEQ ID NO: 498978 - DNA, 25 bp, Mus musculus
gagttctcgtttacatgattcttgt

SEQ ID NO: 498979 - DNA, 25 bp, Mus musculus
gagttctcgttttcatgattcttgt

SEQ ID NO: 498980 - DNA, 25 bp, Mus musculus
gagttctctgaaatttttagccatt

SEQ ID NO: 498981 - DNA, 25 bp, Mus musculus
gagttctctgaattttttagccatt

SEQ ID NO: 498982 - DNA, 25 bp, Mus musculus
gagttctctgagaccaatagcatga

SEQ ID NO: 498983 - DNA, 25 bp, Mus musculus
gagttctctgagagcaactagcaac

SEQ ID NO: 498984 - DNA, 25 bp, Mus musculus
gagttctctgagtccaatagcatga

SEQ ID NO: 498985 - DNA, 25 bp, Mus musculus
gagttctctgagtgcaactagcaac

SEQ ID NO: 498986 - DNA, 25 bp, Mus musculus
gagttctctgccaacaaatctgtag

SEQ ID NO: 498987 - DNA, 25 bp, Mus musculus
gagttctctgcctacaaatctgtag

SEQ ID NO: 498988 - DNA, 25 bp, Mus musculus
gagttctctgttcatctttatgatc

SEQ ID NO: 498989 - DNA, 25 bp, Mus musculus
gagttctctgttgatctttatgatc

SEQ ID NO: 498990 - DNA, 25 bp, Mus musculus
gagttctcttaaatctgtacacctt

SEQ ID NO: 498991 - DNA, 25 bp, Mus musculus
gagttctcttaattctgtacacctt

SEQ ID NO: 498992 - DNA, 25 bp, Mus musculus
gagttctgaaagctgtggtctcaat

SEQ ID NO: 498993 - DNA, 25 bp, Mus musculus
gagttctgaaaggtgtggtctcaat

SEQ ID NO: 498994 - DNA, 25 bp, Mus musculus
gagttctgaaatccatcatagtgac

SEQ ID NO: 498995 - DNA, 25 bp, Mus musculus
gagttctgaaatgcatcatagtgac

SEQ ID NO: 498996 - DNA, 25 bp, Mus musculus
gagttctgaacaaatcttggtctat

SEQ ID NO: 498997 - DNA, 25 bp, Mus musculus
gagttctgaacatatcttggtctat

SEQ ID NO: 498998 - DNA, 25 bp, Mus musculus
gagttctgaactaggtacccacagg

SEQ ID NO: 498999 - DNA, 25 bp, Mus musculus
gagttctgaacttggtacccacagg

SEQ ID NO: 499000 - DNA, 25 bp, Mus musculus
gagttctgaatcaacgctcgatcct

SEQ ID NO: 499001 - DNA, 25 bp, Mus musculus
gagttctgaatctacgctcgatcct

SEQ ID NO: 499002 - DNA, 25 bp, Mus musculus
gagttctgagataacaagtcccttg

SEQ ID NO: 499003 - DNA, 25 bp, Mus musculus
gagttctgagattacaagtcccttg

SEQ ID NO: 499004 - DNA, 25 bp, Mus musculus
gagttctgagcgagctccggcacaa

SEQ ID NO: 499005 - DNA, 25 bp, Mus musculus
gagttctgagcgtgctccggcacaa

SEQ ID NO: 499006 - DNA, 25 bp, Mus musculus
gagttctgagctagactaacctcct

SEQ ID NO: 499007 - DNA, 25 bp, Mus musculus
gagttctgagcttgactaacctcct

SEQ ID NO: 499008 - DNA, 25 bp, Mus musculus
gagttctgaggactgaccttacagc

SEQ ID NO: 499009 - DNA, 25 bp, Mus musculus
gagttctgaggagtgaccttacagc

SEQ ID NO: 499010 - DNA, 25 bp, Mus musculus
gagttctgagtcacctagactggct

SEQ ID NO: 499011 - DNA, 25 bp, Mus musculus
gagttctgagtctcctagactggct

SEQ ID NO: 499012 - DNA, 25 bp, Mus musculus
gagttctgattgcttttggtagcta

SEQ ID NO: 499013 - DNA, 25 bp, Mus musculus
gagttctgattggttttggtagcta

SEQ ID NO: 499014 - DNA, 25 bp, Mus musculus
gagttctgcaaaagatgagacgctt

SEQ ID NO: 499015 - DNA, 25 bp, Mus musculus
gagttctgcaaacctcaatgtatca

SEQ ID NO: 499016 - DNA, 25 bp, Mus musculus
gagttctgcaaagctcaatgtatca

SEQ ID NO: 499017 - DNA, 25 bp, Mus musculus
gagttctgcaaatgatgagacgctt

SEQ ID NO: 499018 - DNA, 25 bp, Mus musculus
gagttctgcagacaaatgactaaaa

SEQ ID NO: 499019 - DNA, 25 bp, Mus musculus
gagttctgcagactttctcccctgg

SEQ ID NO: 499020 - DNA, 25 bp, Mus musculus
gagttctgcagagaaatgactaaaa

SEQ ID NO: 499021 - DNA, 25 bp, Mus musculus
gagttctgcagagtttctcccctgg

SEQ ID NO: 499022 - DNA, 25 bp, Mus musculus
gagttctgcatgctagatttcttta

SEQ ID NO: 499023 - DNA, 25 bp, Mus musculus
gagttctgcatggtagatttcttta

SEQ ID NO: 499024 - DNA, 25 bp, Mus musculus
gagttctgcattacttatcacgcta

SEQ ID NO: 499025 - DNA, 25 bp, Mus musculus
gagttctgcattctctttcaataag

SEQ ID NO: 499026 - DNA, 25 bp, Mus musculus
gagttctgcattgtctttcaataag

SEQ ID NO: 499027 - DNA, 25 bp, Mus musculus
gagttctgcatttcttatcacgcta

SEQ ID NO: 499028 - DNA, 25 bp, Mus musculus
gagttctgccatcaggttgtttagg

SEQ ID NO: 499029 - DNA, 25 bp, Mus musculus
gagttctgccatgaggttgtttagg

SEQ ID NO: 499030 - DNA, 25 bp, Mus musculus
gagttctgcccactatgatgtcagt

SEQ ID NO: 499031 - DNA, 25 bp, Mus musculus
gagttctgcccagtatgatgtcagt

SEQ ID NO: 499032 - DNA, 25 bp, Mus musculus
gagttctgcctcatttctacatata

SEQ ID NO: 499033 - DNA, 25 bp, Mus musculus
gagttctgcctcttttctacatata

SEQ ID NO: 499034 - DNA, 25 bp, Mus musculus
gagttctgcgaaagttatacttgtg

SEQ ID NO: 499035 - DNA, 25 bp, Mus musculus
gagttctgcgaatgttatacttgtg

SEQ ID NO: 499036 - DNA, 25 bp, Mus musculus
gagttctgctcactgcagttgtctt

SEQ ID NO: 499037 - DNA, 25 bp, Mus musculus
gagttctgctcagtgcagttgtctt

SEQ ID NO: 499038 - DNA, 25 bp, Mus musculus
gagttctgctgtacaggttttgcac

SEQ ID NO: 499039 - DNA, 25 bp, Mus musculus
gagttctgctgttcaggttttgcac

SEQ ID NO: 499040 - DNA, 25 bp, Mus musculus
gagttctgcttgctatctgaatgaa

SEQ ID NO: 499041 - DNA, 25 bp, Mus musculus
gagttctgcttggtatctgaatgaa

SEQ ID NO: 499042 - DNA, 25 bp, Mus musculus
gagttctggaacaaccagagctaca

SEQ ID NO: 499043 - DNA, 25 bp, Mus musculus
gagttctggaactaccagagctaca

SEQ ID NO: 499044 - DNA, 25 bp, Mus musculus
gagttctggatactagcgacaccca

SEQ ID NO: 499045 - DNA, 25 bp, Mus musculus
gagttctggatagtagcgacaccca

SEQ ID NO: 499046 - DNA, 25 bp, Mus musculus
gagttctggcttctgtatcagctaa

SEQ ID NO: 499047 - DNA, 25 bp, Mus musculus
gagttctggcttgtgtatcagctaa

SEQ ID NO: 499048 - DNA, 25 bp, Mus musculus
gagttctgggacaccctgagtagct

SEQ ID NO: 499049 - DNA, 25 bp, Mus musculus
gagttctgggactccctgagtagct

SEQ ID NO: 499050 - DNA, 25 bp, Mus musculus
gagttctgggtacagtctccttgac

SEQ ID NO: 499051 - DNA, 25 bp, Mus musculus
gagttctgggtagagtctccttgac

SEQ ID NO: 499052 - DNA, 25 bp, Mus musculus
gagttctgtacacacttgtttgccc

SEQ ID NO: 499053 - DNA, 25 bp, Mus musculus
gagttctgtacagacttgtttgccc

SEQ ID NO: 499054 - DNA, 25 bp, Mus musculus
gagttctgtatccaaaccatgtttt

SEQ ID NO: 499055 - DNA, 25 bp, Mus musculus
gagttctgtatcgaaaccatgtttt

SEQ ID NO: 499056 - DNA, 25 bp, Mus musculus
gagttctgtcagaacgggctctcca

SEQ ID NO: 499057 - DNA, 25 bp, Mus musculus
gagttctgtcagtacgggctctcca

SEQ ID NO: 499058 - DNA, 25 bp, Mus musculus
gagttctgtctcagacagcactact

SEQ ID NO: 499059 - DNA, 25 bp, Mus musculus
gagttctgtctctgacagcactact

SEQ ID NO: 499060 - DNA, 25 bp, Mus musculus
gagttctgtgacaactgaagacaca

SEQ ID NO: 499061 - DNA, 25 bp, Mus musculus
gagttctgtgactactgaagacaca

SEQ ID NO: 499062 - DNA, 25 bp, Mus musculus
gagttctgtgataatttgaccctat

SEQ ID NO: 499063 - DNA, 25 bp, Mus musculus
gagttctgtgattatttgaccctat

SEQ ID NO: 499064 - DNA, 25 bp, Mus musculus
gagttctgtgggaaagaccacctct

SEQ ID NO: 499065 - DNA, 25 bp, Mus musculus
gagttctgtgggtaagaccacctct

SEQ ID NO: 499066 - DNA, 25 bp, Mus musculus
gagttcttaactagtctgagcctcc

SEQ ID NO: 499067 - DNA, 25 bp, Mus musculus
gagttcttaacttgtctgagcctcc

SEQ ID NO: 499068 - DNA, 25 bp, Mus musculus
gagttcttacatccctgacagccaa

SEQ ID NO: 499069 - DNA, 25 bp, Mus musculus
gagttcttacatgcctgacagccaa

SEQ ID NO: 499070 - DNA, 25 bp, Mus musculus
gagttcttactcagcctaggagggc

SEQ ID NO: 499071 - DNA, 25 bp, Mus musculus
gagttcttactctgcctaggagggc

SEQ ID NO: 499072 - DNA, 25 bp, Mus musculus
gagttcttacttactcacgggagga

SEQ ID NO: 499073 - DNA, 25 bp, Mus musculus
gagttcttactttctcacgggagga

SEQ ID NO: 499074 - DNA, 25 bp, Mus musculus
gagttcttagagatgattcctcaag

SEQ ID NO: 499075 - DNA, 25 bp, Mus musculus
gagttcttagagttgattcctcaag

SEQ ID NO: 499076 - DNA, 25 bp, Mus musculus
gagttcttatacagccgagctcata

SEQ ID NO: 499077 - DNA, 25 bp, Mus musculus
gagttcttatactgccgagctcata

SEQ ID NO: 499078 - DNA, 25 bp, Mus musculus
gagttcttatctactcccgggttga

SEQ ID NO: 499079 - DNA, 25 bp, Mus musculus
gagttcttatcttctcccgggttga

SEQ ID NO: 499080 - DNA, 25 bp, Mus musculus
gagttcttcaccaaggagcttacca

SEQ ID NO: 499081 - DNA, 25 bp, Mus musculus
gagttcttcacctaggagcttacca

SEQ ID NO: 499082 - DNA, 25 bp, Mus musculus
gagttcttcactctggcagttctga

SEQ ID NO: 499083 - DNA, 25 bp, Mus musculus
gagttcttcactgtggcagttctga

SEQ ID NO: 499084 - DNA, 25 bp, Mus musculus
gagttcttcagaaagttagagtcta

SEQ ID NO: 499085 - DNA, 25 bp, Mus musculus
gagttcttcagatagttagagtcta

SEQ ID NO: 499086 - DNA, 25 bp, Mus musculus
gagttcttcagtcaattccagcagt

SEQ ID NO: 499087 - DNA, 25 bp, Mus musculus
gagttcttcagtctgttcgcaacaa

SEQ ID NO: 499088 - DNA, 25 bp, Mus musculus
gagttcttcagtgaattccagcagt

SEQ ID NO: 499089 - DNA, 25 bp, Mus musculus
gagttcttcagtgtgttcgcaacaa

SEQ ID NO: 499090 - DNA, 25 bp, Mus musculus
gagttcttccctagttggacagatt

SEQ ID NO: 499091 - DNA, 25 bp, Mus musculus
gagttcttcccttgttggacagatt

SEQ ID NO: 499092 - DNA, 25 bp, Mus musculus
gagttcttcggaaacccaagagtgg

SEQ ID NO: 499093 - DNA, 25 bp, Mus musculus
gagttcttcggatacccaagagtgg

SEQ ID NO: 499094 - DNA, 25 bp, Mus musculus
gagttcttctcactgatgaatgcac

SEQ ID NO: 499095 - DNA, 25 bp, Mus musculus
gagttcttctcagtgatgaatgcac

SEQ ID NO: 499096 - DNA, 25 bp, Mus musculus
gagttcttctccatagacatctaaa

SEQ ID NO: 499097 - DNA, 25 bp, Mus musculus
gagttcttctccttagacatctaaa

SEQ ID NO: 499098 - DNA, 25 bp, Mus musculus
gagttcttctcgatccttgttccaa

SEQ ID NO: 499099 - DNA, 25 bp, Mus musculus
gagttcttctcgttccttgttccaa

SEQ ID NO: 499100 - DNA, 25 bp, Mus musculus
gagttcttctgcacacactgccgcg

SEQ ID NO: 499101 - DNA, 25 bp, Mus musculus
gagttcttctgctcacactgccgcg

SEQ ID NO: 499102 - DNA, 25 bp, Mus musculus
gagttcttctggattttatgtctga

SEQ ID NO: 499103 - DNA, 25 bp, Mus musculus
gagttcttctggtttttatgtctga

SEQ ID NO: 499104 - DNA, 25 bp, Mus musculus
gagttcttcttccagcctcttcaaa

SEQ ID NO: 499105 - DNA, 25 bp, Mus musculus
gagttcttcttcgagcctcttcaaa

SEQ ID NO: 499106 - DNA, 25 bp, Mus musculus
gagttcttgccacacattcttggag

SEQ ID NO: 499107 - DNA, 25 bp, Mus musculus
gagttcttgccagacattcttggag

SEQ ID NO: 499108 - DNA, 25 bp, Mus musculus
gagttcttgcctaccaggagggtga

SEQ ID NO: 499109 - DNA, 25 bp, Mus musculus
gagttcttgcctagcacgagataac

SEQ ID NO: 499110 - DNA, 25 bp, Mus musculus
gagttcttgcctcgagagacttact

SEQ ID NO: 499111 - DNA, 25 bp, Mus musculus
gagttcttgcctggagagacttact

SEQ ID NO: 499112 - DNA, 25 bp, Mus musculus
gagttcttgccttccaggagggtga

SEQ ID NO: 499113 - DNA, 25 bp, Mus musculus
gagttcttgccttgcacgagataac

SEQ ID NO: 499114 - DNA, 25 bp, Mus musculus
gagttcttggacctaaacatgttat

SEQ ID NO: 499115 - DNA, 25 bp, Mus musculus
gagttcttggacgtaaacatgttat

SEQ ID NO: 499116 - DNA, 25 bp, Mus musculus
gagttcttgggtcccttagctatca

SEQ ID NO: 499117 - DNA, 25 bp, Mus musculus
gagttcttgggtgccttagctatca

SEQ ID NO: 499118 - DNA, 25 bp, Mus musculus
gagttcttggtcatgatggtgcgcc

SEQ ID NO: 499119 - DNA, 25 bp, Mus musculus
gagttcttggtcttgatggtgcgcc

SEQ ID NO: 499120 - DNA, 25 bp, Mus musculus
gagttctttagtaagcagttcaggc

SEQ ID NO: 499121 - DNA, 25 bp, Mus musculus
gagttctttagtacctatacacagt

SEQ ID NO: 499122 - DNA, 25 bp, Mus musculus
gagttctttagtccaggccatggtc

SEQ ID NO: 499123 - DNA, 25 bp, Mus musculus
gagttctttagtgcaggccatggtc

SEQ ID NO: 499124 - DNA, 25 bp, Mus musculus
gagttctttagttagcagttcaggc

SEQ ID NO: 499125 - DNA, 25 bp, Mus musculus
gagttctttagttcctatacacagt

SEQ ID NO: 499126 - DNA, 25 bp, Mus musculus
gagttctttctaaaagcactgcaga

SEQ ID NO: 499127 - DNA, 25 bp, Mus musculus
gagttctttctaacacgtaagtcca

SEQ ID NO: 499128 - DNA, 25 bp, Mus musculus
gagttctttctataagcactgcaga

SEQ ID NO: 499129 - DNA, 25 bp, Mus musculus
gagttctttctatcacgtaagtcca

SEQ ID NO: 499130 - DNA, 25 bp, Mus musculus
gagttctttcttcctattgaattgc

SEQ ID NO: 499131 - DNA, 25 bp, Mus musculus
gagttctttcttgctattgaattgc

SEQ ID NO: 499132 - DNA, 25 bp, Mus musculus
gagttctttgaacacctcgcagaca

SEQ ID NO: 499133 - DNA, 25 bp, Mus musculus
gagttctttgaagacctcgcagaca

SEQ ID NO: 499134 - DNA, 25 bp, Mus musculus
gagttctttgacaggcttggtgctg

SEQ ID NO: 499135 - DNA, 25 bp, Mus musculus
gagttctttgacagtgagggttgat

SEQ ID NO: 499136 - DNA, 25 bp, Mus musculus
gagttctttgactggcttggtgctg

SEQ ID NO: 499137 - DNA, 25 bp, Mus musculus
gagttctttgactgtgagggttgat

SEQ ID NO: 499138 - DNA, 25 bp, Mus musculus
gagttctttgatcgcttaaattttg

SEQ ID NO: 499139 - DNA, 25 bp, Mus musculus
gagttctttgatggcttaaattttg

SEQ ID NO: 499140 - DNA, 25 bp, Mus musculus
gagttctttgctaccttaatagaaa

SEQ ID NO: 499141 - DNA, 25 bp, Mus musculus
gagttctttgcttccttaatagaaa

SEQ ID NO: 499142 - DNA, 25 bp, Mus musculus
gagttctttgtcactactgagccaa

SEQ ID NO: 499143 - DNA, 25 bp, Mus musculus
gagttctttgtcattacctttatgt

SEQ ID NO: 499144 - DNA, 25 bp, Mus musculus
gagttctttgtctctactgagccaa

SEQ ID NO: 499145 - DNA, 25 bp, Mus musculus
gagttctttgtctttacctttatgt

SEQ ID NO: 499146 - DNA, 25 bp, Mus musculus
gagttcttttcaatacctgtaaaca

SEQ ID NO: 499147 - DNA, 25 bp, Mus musculus
gagttcttttcattacctgtaaaca

SEQ ID NO: 499148 - DNA, 25 bp, Mus musculus
gagttcttttctctccaatcatctt

SEQ ID NO: 499149 - DNA, 25 bp, Mus musculus
gagttcttttctgtccaatcatctt

SEQ ID NO: 499150 - DNA, 25 bp, Mus musculus
gagttctttttaaccattcttgtat

SEQ ID NO: 499151 - DNA, 25 bp, Mus musculus
gagttctttttacccacaatctttt

SEQ ID NO: 499152 - DNA, 25 bp, Mus musculus
gagttctttttagccacaatctttt

SEQ ID NO: 499153 - DNA, 25 bp, Mus musculus
gagttctttttatccattcttgtat

SEQ ID NO: 499154 - DNA, 25 bp, Mus musculus
gagttgaaaaacagcctcttcacct

SEQ ID NO: 499155 - DNA, 25 bp, Mus musculus
gagttgaaaaactgcctcttcacct

SEQ ID NO: 499156 - DNA, 25 bp, Mus musculus
gagttgaaagtcctccagatgtgca

SEQ ID NO: 499157 - DNA, 25 bp, Mus musculus
gagttgaaagtcgtccagatgtgca

SEQ ID NO: 499158 - DNA, 25 bp, Mus musculus
gagttgaaatcccacttttgtgagg

SEQ ID NO: 499159 - DNA, 25 bp, Mus musculus
gagttgaaatccgacttttgtgagg

SEQ ID NO: 499160 - DNA, 25 bp, Mus musculus
gagttgaacagcatgcagccggtca

SEQ ID NO: 499161 - DNA, 25 bp, Mus musculus
gagttgaacagcttgcagccggtca

SEQ ID NO: 499162 - DNA, 25 bp, Mus musculus
gagttgaactatcgctacttctcca

SEQ ID NO: 499163 - DNA, 25 bp, Mus musculus
gagttgaactatggctacttctcca

SEQ ID NO: 499164 - DNA, 25 bp, Mus musculus
gagttgaagcacattattttggttg

SEQ ID NO: 499165 - DNA, 25 bp, Mus musculus
gagttgaagcactttattttggttg

SEQ ID NO: 499166 - DNA, 25 bp, Mus musculus
gagttgaagcgaccacagatgccaa

SEQ ID NO: 499167 - DNA, 25 bp, Mus musculus
gagttgaagcgagcacagatgccaa

SEQ ID NO: 499168 - DNA, 25 bp, Mus musculus
gagttgaagcttaaggccatgctaa

SEQ ID NO: 499169 - DNA, 25 bp, Mus musculus
gagttgaagctttaggccatgctaa

SEQ ID NO: 499170 - DNA, 25 bp, Mus musculus
gagttgaatgaaccattcttaaacc

SEQ ID NO: 499171 - DNA, 25 bp, Mus musculus
gagttgaatgaagcattcttaaacc

SEQ ID NO: 499172 - DNA, 25 bp, Mus musculus
gagttgaattgcatgtaggaccttt

SEQ ID NO: 499173 - DNA, 25 bp, Mus musculus
gagttgaattgcttgtaggaccttt

SEQ ID NO: 499174 - DNA, 25 bp, Mus musculus
gagttgacactcctttagtaccaaa

SEQ ID NO: 499175 - DNA, 25 bp, Mus musculus
gagttgacactcgtttagtaccaaa

SEQ ID NO: 499176 - DNA, 25 bp, Mus musculus
gagttgaccagactgtctactgaaa

SEQ ID NO: 499177 - DNA, 25 bp, Mus musculus
gagttgaccagagtgtctactgaaa

SEQ ID NO: 499178 - DNA, 25 bp, Mus musculus
gagttgaccgatcagcagttccaga

SEQ ID NO: 499179 - DNA, 25 bp, Mus musculus
gagttgaccgatgagcagttccaga

SEQ ID NO: 499180 - DNA, 25 bp, Mus musculus
gagttgaccggaaccttgttcctca

SEQ ID NO: 499181 - DNA, 25 bp, Mus musculus
gagttgaccggatccttgttcctca

SEQ ID NO: 499182 - DNA, 25 bp, Mus musculus
gagttgacctgtctcacaccagata

SEQ ID NO: 499183 - DNA, 25 bp, Mus musculus
gagttgacctgtgtcacaccagata

SEQ ID NO: 499184 - DNA, 25 bp, Mus musculus
gagttgactataacacactgactgt

SEQ ID NO: 499185 - DNA, 25 bp, Mus musculus
gagttgactatatcacactgactgt

SEQ ID NO: 499186 - DNA, 25 bp, Mus musculus
gagttgactcctcactgaagaacac

SEQ ID NO: 499187 - DNA, 25 bp, Mus musculus
gagttgactcctgactgaagaacac

SEQ ID NO: 499188 - DNA, 25 bp, Mus musculus
gagttgactctgaacatcactttgt

SEQ ID NO: 499189 - DNA, 25 bp, Mus musculus
gagttgactctgtacatcactttgt

SEQ ID NO: 499190 - DNA, 25 bp, Mus musculus
gagttgactgagatgggccagcaaa

SEQ ID NO: 499191 - DNA, 25 bp, Mus musculus
gagttgactgagttgggccagcaaa

SEQ ID NO: 499192 - DNA, 25 bp, Mus musculus
gagttgactgccagctcaatagaat

SEQ ID NO: 499193 - DNA, 25 bp, Mus musculus
gagttgactgcctgctcaatagaat

SEQ ID NO: 499194 - DNA, 25 bp, Mus musculus
gagttgactgtaccttgaattgatg

SEQ ID NO: 499195 - DNA, 25 bp, Mus musculus
gagttgactgtagcttgaattgatg

SEQ ID NO: 499196 - DNA, 25 bp, Mus musculus
gagttgagcaacaagcccacattga

SEQ ID NO: 499197 - DNA, 25 bp, Mus musculus
gagttgagcaactagcccacattga

SEQ ID NO: 499198 - DNA, 25 bp, Mus musculus
gagttgagcagcatctgttgtgatt

SEQ ID NO: 499199 - DNA, 25 bp, Mus musculus
gagttgagcagcatgtccgacagga

SEQ ID NO: 499200 - DNA, 25 bp, Mus musculus
gagttgagcagcttctgttgtgatt

SEQ ID NO: 499201 - DNA, 25 bp, Mus musculus
gagttgagcagcttgtccgacagga

SEQ ID NO: 499202 - DNA, 25 bp, Mus musculus
gagttgagccacactgggtcagagc

SEQ ID NO: 499203 - DNA, 25 bp, Mus musculus
gagttgagccactctgggtcagagc

SEQ ID NO: 499204 - DNA, 25 bp, Mus musculus
gagttgagctggacctctatttaaa

SEQ ID NO: 499205 - DNA, 25 bp, Mus musculus
gagttgagctggtcctctatttaaa

SEQ ID NO: 499206 - DNA, 25 bp, Mus musculus
gagttgagctttatactccaagcat

SEQ ID NO: 499207 - DNA, 25 bp, Mus musculus
gagttgagctttttactccaagcat

SEQ ID NO: 499208 - DNA, 25 bp, Mus musculus
gagttgaggccaagcgattctttaa

SEQ ID NO: 499209 - DNA, 25 bp, Mus musculus
gagttgaggccatgcgattctttaa

SEQ ID NO: 499210 - DNA, 25 bp, Mus musculus
gagttgaggttgaagtcaccattgc

SEQ ID NO: 499211 - DNA, 25 bp, Mus musculus
gagttgaggttgtagtcaccattgc

SEQ ID NO: 499212 - DNA, 25 bp, Mus musculus
gagttgagtaaccactccactgttt

SEQ ID NO: 499213 - DNA, 25 bp, Mus musculus
gagttgagtaacgactccactgttt

SEQ ID NO: 499214 - DNA, 25 bp, Mus musculus
gagttgagtcttaaccaagcttact

SEQ ID NO: 499215 - DNA, 25 bp, Mus musculus
gagttgagtctttaccaagcttact

SEQ ID NO: 499216 - DNA, 25 bp, Mus musculus
gagttgagtgaaaaatctgcttcat

SEQ ID NO: 499217 - DNA, 25 bp, Mus musculus
gagttgagtgaataatctgcttcat

SEQ ID NO: 499218 - DNA, 25 bp, Mus musculus
gagttgataaccccatgttcttccc

SEQ ID NO: 499219 - DNA, 25 bp, Mus musculus
gagttgataaccgcatgttcttccc

SEQ ID NO: 499220 - DNA, 25 bp, Mus musculus
gagttgatacaaccgacacctgatg

SEQ ID NO: 499221 - DNA, 25 bp, Mus musculus
gagttgatacaagcgacacctgatg

SEQ ID NO: 499222 - DNA, 25 bp, Mus musculus
gagttgatatccctctaaagcccga

SEQ ID NO: 499223 - DNA, 25 bp, Mus musculus
gagttgatatccgtctaaagcccga

SEQ ID NO: 499224 - DNA, 25 bp, Mus musculus
gagttgatccagaaggagctcacca

SEQ ID NO: 499225 - DNA, 25 bp, Mus musculus
gagttgatccagtaggagctcacca

SEQ ID NO: 499226 - DNA, 25 bp, Mus musculus
gagttgatgattcccgtgattctag

SEQ ID NO: 499227 - DNA, 25 bp, Mus musculus
gagttgatgattgccgtgattctag

SEQ ID NO: 499228 - DNA, 25 bp, Mus musculus
gagttgatgggcagcgtttaagtta

SEQ ID NO: 499229 - DNA, 25 bp, Mus musculus
gagttgatgggctgcgtttaagtta

SEQ ID NO: 499230 - DNA, 25 bp, Mus musculus
gagttgattcatatctgcacaggga

SEQ ID NO: 499231 - DNA, 25 bp, Mus musculus
gagttgattcatttctgcacaggga

SEQ ID NO: 499232 - DNA, 25 bp, Mus musculus
gagttgattcttagtcctattattg

SEQ ID NO: 499233 - DNA, 25 bp, Mus musculus
gagttgattctttgtcctattattg

SEQ ID NO: 499234 - DNA, 25 bp, Mus musculus
gagttgcaaaccactagtctaggaa

SEQ ID NO: 499235 - DNA, 25 bp, Mus musculus
gagttgcaaaccataatttctgcga

SEQ ID NO: 499236 - DNA, 25 bp, Mus musculus
gagttgcaaacctctagtctaggaa

SEQ ID NO: 499237 - DNA, 25 bp, Mus musculus
gagttgcaaaccttaatttctgcga

SEQ ID NO: 499238 - DNA, 25 bp, Mus musculus
gagttgcaacatctcggatcagcga

SEQ ID NO: 499239 - DNA, 25 bp, Mus musculus
gagttgcaacatgtcggatcagcga

SEQ ID NO: 499240 - DNA, 25 bp, Mus musculus
gagttgcaactcaagcacatggtgc

SEQ ID NO: 499241 - DNA, 25 bp, Mus musculus
gagttgcaactctagcacatggtgc

SEQ ID NO: 499242 - DNA, 25 bp, Mus musculus
gagttgcacaaacccaacgatcagt

SEQ ID NO: 499243 - DNA, 25 bp, Mus musculus
gagttgcacaaagccaacgatcagt

SEQ ID NO: 499244 - DNA, 25 bp, Mus musculus
gagttgcacctcatgaaccaagtat

SEQ ID NO: 499245 - DNA, 25 bp, Mus musculus
gagttgcacctcttgaaccaagtat

SEQ ID NO: 499246 - DNA, 25 bp, Mus musculus
gagttgcactttactcacagatctg

SEQ ID NO: 499247 - DNA, 25 bp, Mus musculus
gagttgcacttttctcacagatctg

SEQ ID NO: 499248 - DNA, 25 bp, Mus musculus
gagttgcagaatccttatttaccag

SEQ ID NO: 499249 - DNA, 25 bp, Mus musculus
gagttgcagaatgcttatttaccag

SEQ ID NO: 499250 - DNA, 25 bp, Mus musculus
gagttgcagacaatgctcacagcct

SEQ ID NO: 499251 - DNA, 25 bp, Mus musculus
gagttgcagacattgctcacagcct

SEQ ID NO: 499252 - DNA, 25 bp, Mus musculus
gagttgcagactctgtgagcctcct

SEQ ID NO: 499253 - DNA, 25 bp, Mus musculus
gagttgcagactgtgtgagcctcct

SEQ ID NO: 499254 - DNA, 25 bp, Mus musculus
gagttgcagcagcttatcagccagc

SEQ ID NO: 499255 - DNA, 25 bp, Mus musculus
gagttgcagcaggttatcagccagc

SEQ ID NO: 499256 - DNA, 25 bp, Mus musculus
gagttgcaggcaaccctttccctcc

SEQ ID NO: 499257 - DNA, 25 bp, Mus musculus
gagttgcaggcatccctttccctcc

SEQ ID NO: 499258 - DNA, 25 bp, Mus musculus
gagttgcatatacagagccctagtc

SEQ ID NO: 499259 - DNA, 25 bp, Mus musculus
gagttgcatatagagagccctagtc

SEQ ID NO: 499260 - DNA, 25 bp, Mus musculus
gagttgccaaagaggtgtccagaat

SEQ ID NO: 499261 - DNA, 25 bp, Mus musculus
gagttgccaaagtggtgtccagaat

SEQ ID NO: 499262 - DNA, 25 bp, Mus musculus
gagttgccagcacgcgcgtcctcag

SEQ ID NO: 499263 - DNA, 25 bp, Mus musculus
gagttgccagcaggcgcgtcctcag

SEQ ID NO: 499264 - DNA, 25 bp, Mus musculus
gagttgccatacatgagatccagca

SEQ ID NO: 499265 - DNA, 25 bp, Mus musculus
gagttgccatacttgagatccagca

SEQ ID NO: 499266 - DNA, 25 bp, Mus musculus
gagttgccatcaaacttcttgtggt

SEQ ID NO: 499267 - DNA, 25 bp, Mus musculus
gagttgccatcatacttcttgtggt

SEQ ID NO: 499268 - DNA, 25 bp, Mus musculus
gagttgcccaacatctgctactcat

SEQ ID NO: 499269 - DNA, 25 bp, Mus musculus
gagttgcccaacttctgctactcat

SEQ ID NO: 499270 - DNA, 25 bp, Mus musculus
gagttgcccggcacctagaccaaac

SEQ ID NO: 499271 - DNA, 25 bp, Mus musculus
gagttgcccggctcctagaccaaac

SEQ ID NO: 499272 - DNA, 25 bp, Mus musculus
gagttgcccgtactcgcgagtgcat

SEQ ID NO: 499273 - DNA, 25 bp, Mus musculus
gagttgcccgtagtcgcgagtgcat

SEQ ID NO: 499274 - DNA, 25 bp, Mus musculus
gagttgcctgagagaatcgctgcgc

SEQ ID NO: 499275 - DNA, 25 bp, Mus musculus
gagttgcctgagtgaatcgctgcgc

SEQ ID NO: 499276 - DNA, 25 bp, Mus musculus
gagttgcctgatcctcagagctttt

SEQ ID NO: 499277 - DNA, 25 bp, Mus musculus
gagttgcctgatcggcaggtcatca

SEQ ID NO: 499278 - DNA, 25 bp, Mus musculus
gagttgcctgatgctcagagctttt

SEQ ID NO: 499279 - DNA, 25 bp, Mus musculus
gagttgcctgatgggcaggtcatca

SEQ ID NO: 499280 - DNA, 25 bp, Mus musculus
gagttgcctggcaacattgctgaaa

SEQ ID NO: 499281 - DNA, 25 bp, Mus musculus
gagttgcctggctacattgctgaaa

SEQ ID NO: 499282 - DNA, 25 bp, Mus musculus
gagttgcctgtaaattctcacaaga

SEQ ID NO: 499283 - DNA, 25 bp, Mus musculus
gagttgcctgtaattgagtctatgt

SEQ ID NO: 499284 - DNA, 25 bp, Mus musculus
gagttgcctgtatattctcacaaga

SEQ ID NO: 499285 - DNA, 25 bp, Mus musculus
gagttgcctgtatttgagtctatgt

SEQ ID NO: 499286 - DNA, 25 bp, Mus musculus
gagttgcctgtcaagaggcccagta

SEQ ID NO: 499287 - DNA, 25 bp, Mus musculus
gagttgcctgtctagaggcccagta

SEQ ID NO: 499288 - DNA, 25 bp, Mus musculus
gagttgcggcatctgtttacatttc

SEQ ID NO: 499289 - DNA, 25 bp, Mus musculus
gagttgcggcatgtgtttacatttc

SEQ ID NO: 499290 - DNA, 25 bp, Mus musculus
gagttgcggcgtaactttgcacagc

SEQ ID NO: 499291 - DNA, 25 bp, Mus musculus
gagttgcggcgttactttgcacagc

SEQ ID NO: 499292 - DNA, 25 bp, Mus musculus
gagttgcggctactgaagaacctaa

SEQ ID NO: 499293 - DNA, 25 bp, Mus musculus
gagttgcggctagtgaagaacctaa

SEQ ID NO: 499294 - DNA, 25 bp, Mus musculus
gagttgctacaaacatttccacctt

SEQ ID NO: 499295 - DNA, 25 bp, Mus musculus
gagttgctacaatcatttccacctt

SEQ ID NO: 499296 - DNA, 25 bp, Mus musculus
gagttgctaccaaacctagatttag

SEQ ID NO: 499297 - DNA, 25 bp, Mus musculus
gagttgctaccatacctagatttag

SEQ ID NO: 499298 - DNA, 25 bp, Mus musculus
gagttgctacctatagtaaccaagt

SEQ ID NO: 499299 - DNA, 25 bp, Mus musculus
gagttgctacctttagtaaccaagt

SEQ ID NO: 499300 - DNA, 25 bp, Mus musculus
gagttgctagtcaacatgtgggtgc

SEQ ID NO: 499301 - DNA, 25 bp, Mus musculus
gagttgctagtctacatgtgggtgc

SEQ ID NO: 499302 - DNA, 25 bp, Mus musculus
gagttgctataaatgactgctgctt

SEQ ID NO: 499303 - DNA, 25 bp, Mus musculus
gagttgctataattgactgctgctt

SEQ ID NO: 499304 - DNA, 25 bp, Mus musculus
gagttgctcacgacacggcttcagt

SEQ ID NO: 499305 - DNA, 25 bp, Mus musculus
gagttgctcacgtcacggcttcagt

SEQ ID NO: 499306 - DNA, 25 bp, Mus musculus
gagttgctctatcgtaggctgctct

SEQ ID NO: 499307 - DNA, 25 bp, Mus musculus
gagttgctctatggtaggctgctct

SEQ ID NO: 499308 - DNA, 25 bp, Mus musculus
gagttgctcttgatccatggatgta

SEQ ID NO: 499309 - DNA, 25 bp, Mus musculus
gagttgctcttgttccatggatgta

SEQ ID NO: 499310 - DNA, 25 bp, Mus musculus
gagttgctgaccatgcacagagctc

SEQ ID NO: 499311 - DNA, 25 bp, Mus musculus
gagttgctgaccttgcacagagctc

SEQ ID NO: 499312 - DNA, 25 bp, Mus musculus
gagttgctgcgacccctgtgtgcac

SEQ ID NO: 499313 - DNA, 25 bp, Mus musculus
gagttgctgcgagccctgtgtgcac

SEQ ID NO: 499314 - DNA, 25 bp, Mus musculus
gagttgctggtcagactggtctgca

SEQ ID NO: 499315 - DNA, 25 bp, Mus musculus
gagttgctggtctgactggtctgca

SEQ ID NO: 499316 - DNA, 25 bp, Mus musculus
gagttgctgtgtattaaatgtcata

SEQ ID NO: 499317 - DNA, 25 bp, Mus musculus
gagttgctgtgttttaaatgtcata

SEQ ID NO: 499318 - DNA, 25 bp, Mus musculus
gagttgctgttcaggtcgcttaggc

SEQ ID NO: 499319 - DNA, 25 bp, Mus musculus
gagttgctgttctggtcgcttaggc

SEQ ID NO: 499320 - DNA, 25 bp, Mus musculus
gagttgcttcaaattgcagatgctt

SEQ ID NO: 499321 - DNA, 25 bp, Mus musculus
gagttgcttcaatttgcagatgctt

SEQ ID NO: 499322 - DNA, 25 bp, Mus musculus
gagttgcttccgatcagtttgtttc

SEQ ID NO: 499323 - DNA, 25 bp, Mus musculus
gagttgcttccgttcagtttgtttc

SEQ ID NO: 499324 - DNA, 25 bp, Mus musculus
gagttgcttcggagtatcttcacaa

SEQ ID NO: 499325 - DNA, 25 bp, Mus musculus
gagttgcttcggtgtatcttcacaa

SEQ ID NO: 499326 - DNA, 25 bp, Mus musculus
gagttgcttgacagtttagttccaa

SEQ ID NO: 499327 - DNA, 25 bp, Mus musculus
gagttgcttgactgtttagttccaa

SEQ ID NO: 499328 - DNA, 25 bp, Mus musculus
gagttgcttggtatgtatttcttaa

SEQ ID NO: 499329 - DNA, 25 bp, Mus musculus
gagttgcttggtttgtatttcttaa

SEQ ID NO: 499330 - DNA, 25 bp, Mus musculus
gagttgcttgtgacttctgaaaccc

SEQ ID NO: 499331 - DNA, 25 bp, Mus musculus
gagttgcttgtgtcttctgaaaccc

SEQ ID NO: 499332 - DNA, 25 bp, Mus musculus
gagttgctttctctcgttttgcatt

SEQ ID NO: 499333 - DNA, 25 bp, Mus musculus
gagttgctttctgtcgttttgcatt

SEQ ID NO: 499334 - DNA, 25 bp, Mus musculus
gagttgctttggatgtctgctaggc

SEQ ID NO: 499335 - DNA, 25 bp, Mus musculus
gagttgctttggttgtctgctaggc

SEQ ID NO: 499336 - DNA, 25 bp, Mus musculus
gagttgctttgtatttcatatcaag

SEQ ID NO: 499337 - DNA, 25 bp, Mus musculus
gagttgctttgtttttcatatcaag

SEQ ID NO: 499338 - DNA, 25 bp, Mus musculus
gagttggaacacaaacacctgtaag

SEQ ID NO: 499339 - DNA, 25 bp, Mus musculus
gagttggaacactaacacctgtaag

SEQ ID NO: 499340 - DNA, 25 bp, Mus musculus
gagttggaacagctgtttcccacag

SEQ ID NO: 499341 - DNA, 25 bp, Mus musculus
gagttggaacaggtgtttcccacag

SEQ ID NO: 499342 - DNA, 25 bp, Mus musculus
gagttggaaccaacccatgcaccag

SEQ ID NO: 499343 - DNA, 25 bp, Mus musculus
gagttggaaccatcccatgcaccag

SEQ ID NO: 499344 - DNA, 25 bp, Mus musculus
gagttggaagtgatttagttactgt

SEQ ID NO: 499345 - DNA, 25 bp, Mus musculus
gagttggaagtgttttagttactgt

SEQ ID NO: 499346 - DNA, 25 bp, Mus musculus
gagttggaatttatctgcatagaac

SEQ ID NO: 499347 - DNA, 25 bp, Mus musculus
gagttggaatttttctgcatagaac

SEQ ID NO: 499348 - DNA, 25 bp, Mus musculus
gagttggacaccctgaatgaagagt

SEQ ID NO: 499349 - DNA, 25 bp, Mus musculus
gagttggacaccgtgaatgaagagt

SEQ ID NO: 499350 - DNA, 25 bp, Mus musculus
gagttggacaggactgagatgaata

SEQ ID NO: 499351 - DNA, 25 bp, Mus musculus
gagttggacaggtctgagatgaata

SEQ ID NO: 499352 - DNA, 25 bp, Mus musculus
gagttggaccacaatattgtgtgtt

SEQ ID NO: 499353 - DNA, 25 bp, Mus musculus
gagttggaccactatattgtgtgtt

SEQ ID NO: 499354 - DNA, 25 bp, Mus musculus
gagttggaccagacacctttctgcc

SEQ ID NO: 499355 - DNA, 25 bp, Mus musculus
gagttggaccagtcacctttctgcc

SEQ ID NO: 499356 - DNA, 25 bp, Mus musculus
gagttggactgcagatatatctgtg

SEQ ID NO: 499357 - DNA, 25 bp, Mus musculus
gagttggactgctgatatatctgtg

SEQ ID NO: 499358 - DNA, 25 bp, Mus musculus
gagttggagcagagtttgcttcctt

SEQ ID NO: 499359 - DNA, 25 bp, Mus musculus
gagttggagcagtgtttgcttcctt

SEQ ID NO: 499360 - DNA, 25 bp, Mus musculus
gagttggagcgaaatgtcacctcct

SEQ ID NO: 499361 - DNA, 25 bp, Mus musculus
gagttggagcgatatgtcacctcct

SEQ ID NO: 499362 - DNA, 25 bp, Mus musculus
gagttggagctcctaagaacccctg

SEQ ID NO: 499363 - DNA, 25 bp, Mus musculus
gagttggagctcgtaagaacccctg

SEQ ID NO: 499364 - DNA, 25 bp, Mus musculus
gagttggaggtcaccctctgcttaa

SEQ ID NO: 499365 - DNA, 25 bp, Mus musculus
gagttggaggtcatcagccttgaat

SEQ ID NO: 499366 - DNA, 25 bp, Mus musculus
gagttggaggtctccctctgcttaa

SEQ ID NO: 499367 - DNA, 25 bp, Mus musculus
gagttggaggtcttcagccttgaat

SEQ ID NO: 499368 - DNA, 25 bp, Mus musculus
gagttggagtgtagtggttacctac

SEQ ID NO: 499369 - DNA, 25 bp, Mus musculus
gagttggagtgttgtggttacctac

SEQ ID NO: 499370 - DNA, 25 bp, Mus musculus
gagttggatataaacgtctccgtcc

SEQ ID NO: 499371 - DNA, 25 bp, Mus musculus
gagttggatatatacgtctccgtcc

SEQ ID NO: 499372 - DNA, 25 bp, Mus musculus
gagttggatccgacttcaaagccac

SEQ ID NO: 499373 - DNA, 25 bp, Mus musculus
gagttggatccgtcttcaaagccac

SEQ ID NO: 499374 - DNA, 25 bp, Mus musculus
gagttggatgtaacctgaggctgca

SEQ ID NO: 499375 - DNA, 25 bp, Mus musculus
gagttggatgtactgactctttaat

SEQ ID NO: 499376 - DNA, 25 bp, Mus musculus
gagttggatgtagtgactctttaat

SEQ ID NO: 499377 - DNA, 25 bp, Mus musculus
gagttggatgtatcctgaggctgca

SEQ ID NO: 499378 - DNA, 25 bp, Mus musculus
gagttggattcccaggaatccgtat

SEQ ID NO: 499379 - DNA, 25 bp, Mus musculus
gagttggattcccatcactcacatg

SEQ ID NO: 499380 - DNA, 25 bp, Mus musculus
gagttggattccgaggaatccgtat

SEQ ID NO: 499381 - DNA, 25 bp, Mus musculus
gagttggattccgatcactcacatg

SEQ ID NO: 499382 - DNA, 25 bp, Mus musculus
gagttggatttgctacctctgtatg

SEQ ID NO: 499383 - DNA, 25 bp, Mus musculus
gagttggatttggtacctctgtatg

SEQ ID NO: 499384 - DNA, 25 bp, Mus musculus
gagttggattttatctcagttcagt

SEQ ID NO: 499385 - DNA, 25 bp, Mus musculus
gagttggattttttctcagttcagt

SEQ ID NO: 499386 - DNA, 25 bp, Mus musculus
gagttggcacacacatgcaaccgtt

SEQ ID NO: 499387 - DNA, 25 bp, Mus musculus
gagttggcacactcatgcaaccgtt

SEQ ID NO: 499388 - DNA, 25 bp, Mus musculus
gagttggccagaaggccccccaaag

SEQ ID NO: 499389 - DNA, 25 bp, Mus musculus
gagttggccagaatcatcttttcta

SEQ ID NO: 499390 - DNA, 25 bp, Mus musculus
gagttggccagactcatgtgttcta

SEQ ID NO: 499391 - DNA, 25 bp, Mus musculus
gagttggccagagtcatgtgttcta

SEQ ID NO: 499392 - DNA, 25 bp, Mus musculus
gagttggccagatggccccccaaag

SEQ ID NO: 499393 - DNA, 25 bp, Mus musculus
gagttggccagattcatcttttcta

SEQ ID NO: 499394 - DNA, 25 bp, Mus musculus
gagttggccctacaggagatcacta

SEQ ID NO: 499395 - DNA, 25 bp, Mus musculus
gagttggccctagaggagatcacta

SEQ ID NO: 499396 - DNA, 25 bp, Mus musculus
gagttggccctgcttggtcttgtat

SEQ ID NO: 499397 - DNA, 25 bp, Mus musculus
gagttggccctggttggtcttgtat

SEQ ID NO: 499398 - DNA, 25 bp, Mus musculus
gagttggccgatcgatacactccca

SEQ ID NO: 499399 - DNA, 25 bp, Mus musculus
gagttggccgatggatacactccca

SEQ ID NO: 499400 - DNA, 25 bp, Mus musculus
gagttggcctatacctgatttttag

SEQ ID NO: 499401 - DNA, 25 bp, Mus musculus
gagttggcctattcctgatttttag

SEQ ID NO: 499402 - DNA, 25 bp, Mus musculus
gagttggcctgcaagggatttccaa

SEQ ID NO: 499403 - DNA, 25 bp, Mus musculus
gagttggcctgctagggatttccaa

SEQ ID NO: 499404 - DNA, 25 bp, Mus musculus
gagttggcctttaagagcatttgct

SEQ ID NO: 499405 - DNA, 25 bp, Mus musculus
gagttggcctttaattcagtaccat

SEQ ID NO: 499406 - DNA, 25 bp, Mus musculus
gagttggccttttagagcatttgct

SEQ ID NO: 499407 - DNA, 25 bp, Mus musculus
gagttggccttttattcagtaccat

SEQ ID NO: 499408 - DNA, 25 bp, Mus musculus
gagttggcgtttatataggtttctg

SEQ ID NO: 499409 - DNA, 25 bp, Mus musculus
gagttggcgtttttataggtttctg

SEQ ID NO: 499410 - DNA, 25 bp, Mus musculus
gagttggctaacattgagttcaagc

SEQ ID NO: 499411 - DNA, 25 bp, Mus musculus
gagttggctaactttgagttcaagc

SEQ ID NO: 499412 - DNA, 25 bp, Mus musculus
gagttggcttataacagtccatctg

SEQ ID NO: 499413 - DNA, 25 bp, Mus musculus
gagttggcttattacagtccatctg

SEQ ID NO: 499414 - DNA, 25 bp, Mus musculus
gagttggctttacccgacctgctac

SEQ ID NO: 499415 - DNA, 25 bp, Mus musculus
gagttggctttagccgacctgctac

SEQ ID NO: 499416 - DNA, 25 bp, Mus musculus
gagttgggcaaaacctatctctgac

SEQ ID NO: 499417 - DNA, 25 bp, Mus musculus
gagttgggcaaatcctatctctgac

SEQ ID NO: 499418 - DNA, 25 bp, Mus musculus
gagttgggcgataactactaggtcc

SEQ ID NO: 499419 - DNA, 25 bp, Mus musculus
gagttgggcgattactactaggtcc

SEQ ID NO: 499420 - DNA, 25 bp, Mus musculus
gagttgggcttaatatatcttattg

SEQ ID NO: 499421 - DNA, 25 bp, Mus musculus
gagttgggcttattatatcttattg

SEQ ID NO: 499422 - DNA, 25 bp, Mus musculus
gagttggtaatacttgaggccagta

SEQ ID NO: 499423 - DNA, 25 bp, Mus musculus
gagttggtaatagttgaggccagta

SEQ ID NO: 499424 - DNA, 25 bp, Mus musculus
gagttggtacgcagcattcgatttg

SEQ ID NO: 499425 - DNA, 25 bp, Mus musculus
gagttggtacgctgcattcgatttg

SEQ ID NO: 499426 - DNA, 25 bp, Mus musculus
gagttggtacttagaatcagttccc

SEQ ID NO: 499427 - DNA, 25 bp, Mus musculus
gagttggtactttgaatcagttccc

SEQ ID NO: 499428 - DNA, 25 bp, Mus musculus
gagttggtattcagtaaattctaaa

SEQ ID NO: 499429 - DNA, 25 bp, Mus musculus
gagttggtattctgtaaattctaaa

SEQ ID NO: 499430 - DNA, 25 bp, Mus musculus
gagttggtcaataacctcttcatta

SEQ ID NO: 499431 - DNA, 25 bp, Mus musculus
gagttggtcaattacctcttcatta

SEQ ID NO: 499432 - DNA, 25 bp, Mus musculus
gagttggtccaaagagggaacatct

SEQ ID NO: 499433 - DNA, 25 bp, Mus musculus
gagttggtccaatgagggaacatct

SEQ ID NO: 499434 - DNA, 25 bp, Mus musculus
gagttggtgactattgctgggaaat

SEQ ID NO: 499435 - DNA, 25 bp, Mus musculus
gagttggtgacttttgctgggaaat

SEQ ID NO: 499436 - DNA, 25 bp, Mus musculus
gagttggtgcagagctcctcagacc

SEQ ID NO: 499437 - DNA, 25 bp, Mus musculus
gagttggtgcagtgctcctcagacc

SEQ ID NO: 499438 - DNA, 25 bp, Mus musculus
gagttggtggaaccagcgccccata

SEQ ID NO: 499439 - DNA, 25 bp, Mus musculus
gagttggtggaagcagcgccccata

SEQ ID NO: 499440 - DNA, 25 bp, Mus musculus
gagttggtggataagccctccctgc

SEQ ID NO: 499441 - DNA, 25 bp, Mus musculus
gagttggtggattagccctccctgc

SEQ ID NO: 499442 - DNA, 25 bp, Mus musculus
gagttggtgtccctaaaggtgccaa

SEQ ID NO: 499443 - DNA, 25 bp, Mus musculus
gagttggtgtccgtaaaggtgccaa

SEQ ID NO: 499444 - DNA, 25 bp, Mus musculus
gagttggttatgaaattacctagta

SEQ ID NO: 499445 - DNA, 25 bp, Mus musculus
gagttggttatgtaattacctagta

SEQ ID NO: 499446 - DNA, 25 bp, Mus musculus
gagttggttcctatgactttatgca

SEQ ID NO: 499447 - DNA, 25 bp, Mus musculus
gagttggttcctttgactttatgca

SEQ ID NO: 499448 - DNA, 25 bp, Mus musculus
gagttggttcttctccagtgactct

SEQ ID NO: 499449 - DNA, 25 bp, Mus musculus
gagttggttcttgtccagtgactct

SEQ ID NO: 499450 - DNA, 25 bp, Mus musculus
gagttggttgtgactgcccctttgc

SEQ ID NO: 499451 - DNA, 25 bp, Mus musculus
gagttggttgtgtctgcccctttgc

SEQ ID NO: 499452 - DNA, 25 bp, Mus musculus
gagttggttgttcaggcgtccccta

SEQ ID NO: 499453 - DNA, 25 bp, Mus musculus
gagttggttgttgaggcgtccccta

SEQ ID NO: 499454 - DNA, 25 bp, Mus musculus
gagttggtttatcagcttgctgtaa

SEQ ID NO: 499455 - DNA, 25 bp, Mus musculus
gagttggtttatgagcttgctgtaa

SEQ ID NO: 499456 - DNA, 25 bp, Mus musculus
gagttgtaacagcacatgtccaagt

SEQ ID NO: 499457 - DNA, 25 bp, Mus musculus
gagttgtaacaggacatgtccaagt

SEQ ID NO: 499458 - DNA, 25 bp, Mus musculus
gagttgtaatggattctccagtttc

SEQ ID NO: 499459 - DNA, 25 bp, Mus musculus
gagttgtaatggtttctccagtttc

SEQ ID NO: 499460 - DNA, 25 bp, Mus musculus
gagttgtacaagcatctggacagca

SEQ ID NO: 499461 - DNA, 25 bp, Mus musculus
gagttgtacaaggatctggacagca

SEQ ID NO: 499462 - DNA, 25 bp, Mus musculus
gagttgtacccgcagctcataccta

SEQ ID NO: 499463 - DNA, 25 bp, Mus musculus
gagttgtacccggagctcataccta

SEQ ID NO: 499464 - DNA, 25 bp, Mus musculus
gagttgtaccttatcactcttttcc

SEQ ID NO: 499465 - DNA, 25 bp, Mus musculus
gagttgtaccttttcactcttttcc

SEQ ID NO: 499466 - DNA, 25 bp, Mus musculus
gagttgtactgaaggctctcttcac

SEQ ID NO: 499467 - DNA, 25 bp, Mus musculus
gagttgtactgatggctctcttcac

SEQ ID NO: 499468 - DNA, 25 bp, Mus musculus
gagttgtagacccaaggccttcttc

SEQ ID NO: 499469 - DNA, 25 bp, Mus musculus
gagttgtagaccgaaggccttcttc

SEQ ID NO: 499470 - DNA, 25 bp, Mus musculus
gagttgtagctgctgttcagatgtc

SEQ ID NO: 499471 - DNA, 25 bp, Mus musculus
gagttgtagctggtgttcagatgtc

SEQ ID NO: 499472 - DNA, 25 bp, Mus musculus
gagttgtaggtgcactgatctgcta

SEQ ID NO: 499473 - DNA, 25 bp, Mus musculus
gagttgtaggtggactgatctgcta

SEQ ID NO: 499474 - DNA, 25 bp, Mus musculus
gagttgtagtccaacttctgtatgg

SEQ ID NO: 499475 - DNA, 25 bp, Mus musculus
gagttgtagtcctacttctgtatgg

SEQ ID NO: 499476 - DNA, 25 bp, Mus musculus
gagttgtataccctttgtctaaata

SEQ ID NO: 499477 - DNA, 25 bp, Mus musculus
gagttgtataccgtttgtctaaata

SEQ ID NO: 499478 - DNA, 25 bp, Mus musculus
gagttgtatagaaagctgagcccac

SEQ ID NO: 499479 - DNA, 25 bp, Mus musculus
gagttgtatagatagctgagcccac

SEQ ID NO: 499480 - DNA, 25 bp, Mus musculus
gagttgtatattatactgcatttta

SEQ ID NO: 499481 - DNA, 25 bp, Mus musculus
gagttgtatattttactgcatttta

SEQ ID NO: 499482 - DNA, 25 bp, Mus musculus
gagttgtatcttatcaatagcataa

SEQ ID NO: 499483 - DNA, 25 bp, Mus musculus
gagttgtatcttttcaatagcataa

SEQ ID NO: 499484 - DNA, 25 bp, Mus musculus
gagttgtattcaaagttcttttccc

SEQ ID NO: 499485 - DNA, 25 bp, Mus musculus
gagttgtattcatagttcttttccc

SEQ ID NO: 499486 - DNA, 25 bp, Mus musculus
gagttgtattccaaggtcttccacc

SEQ ID NO: 499487 - DNA, 25 bp, Mus musculus
gagttgtattcctaggtcttccacc

SEQ ID NO: 499488 - DNA, 25 bp, Mus musculus
gagttgtattttcggaatttcttgt

SEQ ID NO: 499489 - DNA, 25 bp, Mus musculus
gagttgtattttgggaatttcttgt

SEQ ID NO: 499490 - DNA, 25 bp, Mus musculus
gagttgtcaaatccctctatcacca

SEQ ID NO: 499491 - DNA, 25 bp, Mus musculus
gagttgtcaaatgcctctatcacca

SEQ ID NO: 499492 - DNA, 25 bp, Mus musculus
gagttgtcaaggaaagacccatcat

SEQ ID NO: 499493 - DNA, 25 bp, Mus musculus
gagttgtcaaggtaagacccatcat

SEQ ID NO: 499494 - DNA, 25 bp, Mus musculus
gagttgtcacagactgccaacacta

SEQ ID NO: 499495 - DNA, 25 bp, Mus musculus
gagttgtcacagtctgccaacacta

SEQ ID NO: 499496 - DNA, 25 bp, Mus musculus
gagttgtcagctaatattggtaaga

SEQ ID NO: 499497 - DNA, 25 bp, Mus musculus
gagttgtcagcttatattggtaaga

SEQ ID NO: 499498 - DNA, 25 bp, Mus musculus
gagttgtcagtaacaagtacccttt

SEQ ID NO: 499499 - DNA, 25 bp, Mus musculus
gagttgtcagtatcaagtacccttt

SEQ ID NO: 499500 - DNA, 25 bp, Mus musculus
gagttgtcatagaaaacatcttgtt

SEQ ID NO: 499501 - DNA, 25 bp, Mus musculus
gagttgtcatagtaaacatcttgtt

SEQ ID NO: 499502 - DNA, 25 bp, Mus musculus
gagttgtcatctatgcctgaaggca

SEQ ID NO: 499503 - DNA, 25 bp, Mus musculus
gagttgtcatctttgcctgaaggca

SEQ ID NO: 499504 - DNA, 25 bp, Mus musculus
gagttgtcatttatctcttcactgg

SEQ ID NO: 499505 - DNA, 25 bp, Mus musculus
gagttgtcatttttctcttcactgg

SEQ ID NO: 499506 - DNA, 25 bp, Mus musculus
gagttgtccagactagtggcatcaa

SEQ ID NO: 499507 - DNA, 25 bp, Mus musculus
gagttgtccagagtagtggcatcaa

SEQ ID NO: 499508 - DNA, 25 bp, Mus musculus
gagttgtcccctaagcggcagaggc

SEQ ID NO: 499509 - DNA, 25 bp, Mus musculus
gagttgtccccttagcggcagaggc

SEQ ID NO: 499510 - DNA, 25 bp, Mus musculus
gagttgtctaacctcgagataccac

SEQ ID NO: 499511 - DNA, 25 bp, Mus musculus
gagttgtctaacgtcgagataccac

SEQ ID NO: 499512 - DNA, 25 bp, Mus musculus
gagttgtctacaaagtactactatt

SEQ ID NO: 499513 - DNA, 25 bp, Mus musculus
gagttgtctacatagtactactatt

SEQ ID NO: 499514 - DNA, 25 bp, Mus musculus
gagttgtctataactttggtccacc

SEQ ID NO: 499515 - DNA, 25 bp, Mus musculus
gagttgtctatatctttggtccacc

SEQ ID NO: 499516 - DNA, 25 bp, Mus musculus
gagttgtctatgagctgtggcctgg

SEQ ID NO: 499517 - DNA, 25 bp, Mus musculus
gagttgtctatgtgctgtggcctgg

SEQ ID NO: 499518 - DNA, 25 bp, Mus musculus
gagttgtctcaaagactcattaatt

SEQ ID NO: 499519 - DNA, 25 bp, Mus musculus
gagttgtctcaatgactcattaatt

SEQ ID NO: 499520 - DNA, 25 bp, Mus musculus
gagttgtctccaataaaggtgctgt

SEQ ID NO: 499521 - DNA, 25 bp, Mus musculus
gagttgtctccattaaaggtgctgt

SEQ ID NO: 499522 - DNA, 25 bp, Mus musculus
gagttgtctcggctgtccaagaaga

SEQ ID NO: 499523 - DNA, 25 bp, Mus musculus
gagttgtctcgggtgtccaagaaga

SEQ ID NO: 499524 - DNA, 25 bp, Mus musculus
gagttgtctctgatggttgcaattc

SEQ ID NO: 499525 - DNA, 25 bp, Mus musculus
gagttgtctctgttggttgcaattc

SEQ ID NO: 499526 - DNA, 25 bp, Mus musculus
gagttgtctgatcagtccgagtcct

SEQ ID NO: 499527 - DNA, 25 bp, Mus musculus
gagttgtctgatgagtccgagtcct

SEQ ID NO: 499528 - DNA, 25 bp, Mus musculus
gagttgtctggcacactcaggacac

SEQ ID NO: 499529 - DNA, 25 bp, Mus musculus
gagttgtctggctcactcaggacac

SEQ ID NO: 499530 - DNA, 25 bp, Mus musculus
gagttgtctgtaaaaagctatccct

SEQ ID NO: 499531 - DNA, 25 bp, Mus musculus
gagttgtctgtataaagctatccct

SEQ ID NO: 499532 - DNA, 25 bp, Mus musculus
gagttgtctgttaatgcttcatttt

SEQ ID NO: 499533 - DNA, 25 bp, Mus musculus
gagttgtctgtttatgcttcatttt

SEQ ID NO: 499534 - DNA, 25 bp, Mus musculus
gagttgtcttccaatcaaggctgaa

SEQ ID NO: 499535 - DNA, 25 bp, Mus musculus
gagttgtcttcctatcaaggctgaa

SEQ ID NO: 499536 - DNA, 25 bp, Mus musculus
gagttgtcttctacatgtcttgtta

SEQ ID NO: 499537 - DNA, 25 bp, Mus musculus
gagttgtcttcttcatgtcttgtta

SEQ ID NO: 499538 - DNA, 25 bp, Mus musculus
gagttgtcttttcatagctgtaggt

SEQ ID NO: 499539 - DNA, 25 bp, Mus musculus
gagttgtcttttccttctattggta

SEQ ID NO: 499540 - DNA, 25 bp, Mus musculus
gagttgtcttttgatagctgtaggt

SEQ ID NO: 499541 - DNA, 25 bp, Mus musculus
gagttgtcttttgcttctattggta

SEQ ID NO: 499542 - DNA, 25 bp, Mus musculus
gagttgtgatttaaactggtcttta

SEQ ID NO: 499543 - DNA, 25 bp, Mus musculus
gagttgtgattttaactggtcttta

SEQ ID NO: 499544 - DNA, 25 bp, Mus musculus
gagttgtgcacacgatgtctgccct

SEQ ID NO: 499545 - DNA, 25 bp, Mus musculus
gagttgtgcacaggatgtctgccct

SEQ ID NO: 499546 - DNA, 25 bp, Mus musculus
gagttgtgccgaattacttgtcata

SEQ ID NO: 499547 - DNA, 25 bp, Mus musculus
gagttgtgccgatttacttgtcata

SEQ ID NO: 499548 - DNA, 25 bp, Mus musculus
gagttgtgccggcacaatgcccagt

SEQ ID NO: 499549 - DNA, 25 bp, Mus musculus
gagttgtgccgggacaatgcccagt

SEQ ID NO: 499550 - DNA, 25 bp, Mus musculus
gagttgtgggttcaactgcgtcaca

SEQ ID NO: 499551 - DNA, 25 bp, Mus musculus
gagttgtgggttgaactgcgtcaca

SEQ ID NO: 499552 - DNA, 25 bp, Mus musculus
gagttgtgttcaagttacctcttaa

SEQ ID NO: 499553 - DNA, 25 bp, Mus musculus
gagttgtgttcatgttacctcttaa

SEQ ID NO: 499554 - DNA, 25 bp, Mus musculus
gagttgttaactagagcttcatttt

SEQ ID NO: 499555 - DNA, 25 bp, Mus musculus
gagttgttaactatcccatcttttt

SEQ ID NO: 499556 - DNA, 25 bp, Mus musculus
gagttgttaacttgagcttcatttt

SEQ ID NO: 499557 - DNA, 25 bp, Mus musculus
gagttgttaactttcccatcttttt

SEQ ID NO: 499558 - DNA, 25 bp, Mus musculus
gagttgttacaccttttaggccgtg

SEQ ID NO: 499559 - DNA, 25 bp, Mus musculus
gagttgttacacgttttaggccgtg

SEQ ID NO: 499560 - DNA, 25 bp, Mus musculus
gagttgttacagatggcactcaaca

SEQ ID NO: 499561 - DNA, 25 bp, Mus musculus
gagttgttacagttggcactcaaca

SEQ ID NO: 499562 - DNA, 25 bp, Mus musculus
gagttgttacccagtcttcagtaag

SEQ ID NO: 499563 - DNA, 25 bp, Mus musculus
gagttgttaccctgtcttcagtaag

SEQ ID NO: 499564 - DNA, 25 bp, Mus musculus
gagttgttagtgcaacacaccaagt

SEQ ID NO: 499565 - DNA, 25 bp, Mus musculus
gagttgttagtggaacacaccaagt

SEQ ID NO: 499566 - DNA, 25 bp, Mus musculus
gagttgttcagtccgctcggagcat

SEQ ID NO: 499567 - DNA, 25 bp, Mus musculus
gagttgttcagtgcgctcggagcat

SEQ ID NO: 499568 - DNA, 25 bp, Mus musculus
gagttgttcctacttgtaacgttct

SEQ ID NO: 499569 - DNA, 25 bp, Mus musculus
gagttgttcctagttgtaacgttct

SEQ ID NO: 499570 - DNA, 25 bp, Mus musculus
gagttgttctaaatacatgcatcat

SEQ ID NO: 499571 - DNA, 25 bp, Mus musculus
gagttgttctaattacatgcatcat

SEQ ID NO: 499572 - DNA, 25 bp, Mus musculus
gagttgttctgacatttatcacaaa

SEQ ID NO: 499573 - DNA, 25 bp, Mus musculus
gagttgttctgagatttatcacaaa

SEQ ID NO: 499574 - DNA, 25 bp, Mus musculus
gagttgttcttacctgtagagctca

SEQ ID NO: 499575 - DNA, 25 bp, Mus musculus
gagttgttcttagctgtagagctca

SEQ ID NO: 499576 - DNA, 25 bp, Mus musculus
gagttgttgcaaaatttgattatcc

SEQ ID NO: 499577 - DNA, 25 bp, Mus musculus
gagttgttgcaatatttgattatcc

SEQ ID NO: 499578 - DNA, 25 bp, Mus musculus
gagttgttgcctaaatgtatgttga

SEQ ID NO: 499579 - DNA, 25 bp, Mus musculus
gagttgttgccttaatgtatgttga

SEQ ID NO: 499580 - DNA, 25 bp, Mus musculus
gagttgttgctcattagacgtggaa

SEQ ID NO: 499581 - DNA, 25 bp, Mus musculus
gagttgttgctctttagacgtggaa

SEQ ID NO: 499582 - DNA, 25 bp, Mus musculus
gagttgtttaaacagcttccctgca

SEQ ID NO: 499583 - DNA, 25 bp, Mus musculus
gagttgtttaaagagcttccctgca

SEQ ID NO: 499584 - DNA, 25 bp, Mus musculus
gagttgtttactatatagttgccaa

SEQ ID NO: 499585 - DNA, 25 bp, Mus musculus
gagttgtttactttatagttgccaa

SEQ ID NO: 499586 - DNA, 25 bp, Mus musculus
gagttgtttatactttaccctgaag

SEQ ID NO: 499587 - DNA, 25 bp, Mus musculus
gagttgtttatagtttaccctgaag

SEQ ID NO: 499588 - DNA, 25 bp, Mus musculus
gagttgtttcaaattaggccaagta

SEQ ID NO: 499589 - DNA, 25 bp, Mus musculus
gagttgtttcaacccatcatggaac

SEQ ID NO: 499590 - DNA, 25 bp, Mus musculus
gagttgtttcaagccatcatggaac

SEQ ID NO: 499591 - DNA, 25 bp, Mus musculus
gagttgtttcaatttaggccaagta

SEQ ID NO: 499592 - DNA, 25 bp, Mus musculus
gagttgtttcacaaaagagttgttt

SEQ ID NO: 499593 - DNA, 25 bp, Mus musculus
gagttgtttcacagctaaatggcca

SEQ ID NO: 499594 - DNA, 25 bp, Mus musculus
gagttgtttcactaaagagttgttt

SEQ ID NO: 499595 - DNA, 25 bp, Mus musculus
gagttgtttcactgctaaatggcca

SEQ ID NO: 499596 - DNA, 25 bp, Mus musculus
gagttgtttcgtcagtttccatagt

SEQ ID NO: 499597 - DNA, 25 bp, Mus musculus
gagttgtttcgtgagtttccatagt

SEQ ID NO: 499598 - DNA, 25 bp, Mus musculus
gagttgtttgccatgaagtttcaca

SEQ ID NO: 499599 - DNA, 25 bp, Mus musculus
gagttgtttgccttgaagtttcaca

SEQ ID NO: 499600 - DNA, 25 bp, Mus musculus
gagttgtttttcagactataaccac

SEQ ID NO: 499601 - DNA, 25 bp, Mus musculus
gagttgtttttcagtactttttcag

SEQ ID NO: 499602 - DNA, 25 bp, Mus musculus
gagttgtttttctgactataaccac

SEQ ID NO: 499603 - DNA, 25 bp, Mus musculus
gagttgtttttctgtactttttcag

SEQ ID NO: 499604 - DNA, 25 bp, Mus musculus
gagtttaaaacacagtatcttggac

SEQ ID NO: 499605 - DNA, 25 bp, Mus musculus
gagtttaaaacacctctgctcggaa

SEQ ID NO: 499606 - DNA, 25 bp, Mus musculus
gagtttaaaacagagtatcttggac

SEQ ID NO: 499607 - DNA, 25 bp, Mus musculus
gagtttaaaacagctctgctcggaa

SEQ ID NO: 499608 - DNA, 25 bp, Mus musculus
gagtttaaaaccagtgtgaaccaca

SEQ ID NO: 499609 - DNA, 25 bp, Mus musculus
gagtttaaaacctgtgtgaaccaca

SEQ ID NO: 499610 - DNA, 25 bp, Mus musculus
gagtttaaacctatatctgtatgca

SEQ ID NO: 499611 - DNA, 25 bp, Mus musculus
gagtttaaacctttatctgtatgca

SEQ ID NO: 499612 - DNA, 25 bp, Mus musculus
gagtttaaatatccagagttctttt

SEQ ID NO: 499613 - DNA, 25 bp, Mus musculus
gagtttaaatatgcagagttctttt

SEQ ID NO: 499614 - DNA, 25 bp, Mus musculus
gagtttaaatctcaccatcccattt

SEQ ID NO: 499615 - DNA, 25 bp, Mus musculus
gagtttaaatctgaccatcccattt

SEQ ID NO: 499616 - DNA, 25 bp, Mus musculus
gagtttaaccatacagcttgctgtt

SEQ ID NO: 499617 - DNA, 25 bp, Mus musculus
gagtttaaccattcagcttgctgtt

SEQ ID NO: 499618 - DNA, 25 bp, Mus musculus
gagtttaactatcaccgctgagcag

SEQ ID NO: 499619 - DNA, 25 bp, Mus musculus
gagtttaactatgaccgctgagcag

SEQ ID NO: 499620 - DNA, 25 bp, Mus musculus
gagtttaactgacatattccgtgag

SEQ ID NO: 499621 - DNA, 25 bp, Mus musculus
gagtttaactgagatattccgtgag

SEQ ID NO: 499622 - DNA, 25 bp, Mus musculus
gagtttaactgccaatagatgacca

SEQ ID NO: 499623 - DNA, 25 bp, Mus musculus
gagtttaactgcgaatagatgacca

SEQ ID NO: 499624 - DNA, 25 bp, Mus musculus
gagtttaactttctgttgccacgga

SEQ ID NO: 499625 - DNA, 25 bp, Mus musculus
gagtttaactttgtgttgccacgga

SEQ ID NO: 499626 - DNA, 25 bp, Mus musculus
gagtttaagagaacgaacccaatag

SEQ ID NO: 499627 - DNA, 25 bp, Mus musculus
gagtttaagagatcgaacccaatag

SEQ ID NO: 499628 - DNA, 25 bp, Mus musculus
gagtttaagcgtactccaaatttgc

SEQ ID NO: 499629 - DNA, 25 bp, Mus musculus
gagtttaagcgttctccaaatttgc

SEQ ID NO: 499630 - DNA, 25 bp, Mus musculus
gagtttaagggcagcgccttataca

SEQ ID NO: 499631 - DNA, 25 bp, Mus musculus
gagtttaagggctgcgccttataca

SEQ ID NO: 499632 - DNA, 25 bp, Mus musculus
gagtttaagttcatccttggccaca

SEQ ID NO: 499633 - DNA, 25 bp, Mus musculus
gagtttaagttcttccttggccaca

SEQ ID NO: 499634 - DNA, 25 bp, Mus musculus
gagtttaatcctcagtgtaacccca

SEQ ID NO: 499635 - DNA, 25 bp, Mus musculus
gagtttaatcctgagtgtaacccca

SEQ ID NO: 499636 - DNA, 25 bp, Mus musculus
gagtttaatgcacgttctaacatga

SEQ ID NO: 499637 - DNA, 25 bp, Mus musculus
gagtttaatgcaggttctaacatga

SEQ ID NO: 499638 - DNA, 25 bp, Mus musculus
gagtttaatgccacctttatctacc

SEQ ID NO: 499639 - DNA, 25 bp, Mus musculus
gagtttaatgcctcctttatctacc

SEQ ID NO: 499640 - DNA, 25 bp, Mus musculus
gagtttaattccagtgtacatgtag

SEQ ID NO: 499641 - DNA, 25 bp, Mus musculus
gagtttaattcctgtgtacatgtag

SEQ ID NO: 499642 - DNA, 25 bp, Mus musculus
gagtttaattctatatcagccaggc

SEQ ID NO: 499643 - DNA, 25 bp, Mus musculus
gagtttaattctttatcagccaggc

SEQ ID NO: 499644 - DNA, 25 bp, Mus musculus
gagtttacagttaggtcatctgtac

SEQ ID NO: 499645 - DNA, 25 bp, Mus musculus
gagtttacagtttggtcatctgtac

SEQ ID NO: 499646 - DNA, 25 bp, Mus musculus
gagtttacataaatagcttccatta

SEQ ID NO: 499647 - DNA, 25 bp, Mus musculus
gagtttacataattagcttccatta

SEQ ID NO: 499648 - DNA, 25 bp, Mus musculus
gagtttaccagcaagggagcctaca

SEQ ID NO: 499649 - DNA, 25 bp, Mus musculus
gagtttaccagcctgctcactgaaa

SEQ ID NO: 499650 - DNA, 25 bp, Mus musculus
gagtttaccagcgtgctcactgaaa

SEQ ID NO: 499651 - DNA, 25 bp, Mus musculus
gagtttaccagctagggagcctaca

SEQ ID NO: 499652 - DNA, 25 bp, Mus musculus
gagtttacccgaacaccagtctaat

SEQ ID NO: 499653 - DNA, 25 bp, Mus musculus
gagtttacccgatcaccagtctaat

SEQ ID NO: 499654 - DNA, 25 bp, Mus musculus
gagtttaccttgcaactcaatttat

SEQ ID NO: 499655 - DNA, 25 bp, Mus musculus
gagtttaccttggaactcaatttat

SEQ ID NO: 499656 - DNA, 25 bp, Mus musculus
gagtttacggttcttcctcagtgaa

SEQ ID NO: 499657 - DNA, 25 bp, Mus musculus
gagtttacggttgttcctcagtgaa

SEQ ID NO: 499658 - DNA, 25 bp, Mus musculus
gagtttactcaaaaccgttgctatt

SEQ ID NO: 499659 - DNA, 25 bp, Mus musculus
gagtttactcaataccgttgctatt

SEQ ID NO: 499660 - DNA, 25 bp, Mus musculus
gagtttactcatcggactccaagta

SEQ ID NO: 499661 - DNA, 25 bp, Mus musculus
gagtttactcatgggactccaagta

SEQ ID NO: 499662 - DNA, 25 bp, Mus musculus
gagtttactcccatcttttacagct

SEQ ID NO: 499663 - DNA, 25 bp, Mus musculus
gagtttactcccttcttttacagct

SEQ ID NO: 499664 - DNA, 25 bp, Mus musculus
gagtttactcttcgcatggcctgga

SEQ ID NO: 499665 - DNA, 25 bp, Mus musculus
gagtttactcttcgccagggcttca

SEQ ID NO: 499666 - DNA, 25 bp, Mus musculus
gagtttactcttggcatggcctgga

SEQ ID NO: 499667 - DNA, 25 bp, Mus musculus
gagtttactcttggccagggcttca

SEQ ID NO: 499668 - DNA, 25 bp, Mus musculus
gagtttacttaaatgtccacgctgt

SEQ ID NO: 499669 - DNA, 25 bp, Mus musculus
gagtttacttaattgtccacgctgt

SEQ ID NO: 499670 - DNA, 25 bp, Mus musculus
gagtttagagccatttaccggtgta

SEQ ID NO: 499671 - DNA, 25 bp, Mus musculus
gagtttagagccttttaccggtgta

SEQ ID NO: 499672 - DNA, 25 bp, Mus musculus
gagtttagattcagcacccgtgtaa

SEQ ID NO: 499673 - DNA, 25 bp, Mus musculus
gagtttagattctgcacccgtgtaa

SEQ ID NO: 499674 - DNA, 25 bp, Mus musculus
gagtttagccacactcctattttat

SEQ ID NO: 499675 - DNA, 25 bp, Mus musculus
gagtttagccactctcctattttat

SEQ ID NO: 499676 - DNA, 25 bp, Mus musculus
gagtttagcctcagtagcttcactt

SEQ ID NO: 499677 - DNA, 25 bp, Mus musculus
gagtttagcctcctagagccatcta

SEQ ID NO: 499678 - DNA, 25 bp, Mus musculus
gagtttagcctcgtagagccatcta

SEQ ID NO: 499679 - DNA, 25 bp, Mus musculus
gagtttagcctctgtagcttcactt

SEQ ID NO: 499680 - DNA, 25 bp, Mus musculus
gagtttagccttcgagtagagaaca

SEQ ID NO: 499681 - DNA, 25 bp, Mus musculus
gagtttagccttggagtagagaaca

SEQ ID NO: 499682 - DNA, 25 bp, Mus musculus
gagtttagcggtacacagatgtgac

SEQ ID NO: 499683 - DNA, 25 bp, Mus musculus
gagtttagcggttcacagatgtgac

SEQ ID NO: 499684 - DNA, 25 bp, Mus musculus
gagtttaggaagaacttcgccacct

SEQ ID NO: 499685 - DNA, 25 bp, Mus musculus
gagtttaggaagtacttcgccacct

SEQ ID NO: 499686 - DNA, 25 bp, Mus musculus
gagtttaggcaacatcattaattca

SEQ ID NO: 499687 - DNA, 25 bp, Mus musculus
gagtttaggcaagatcattaattca

SEQ ID NO: 499688 - DNA, 25 bp, Mus musculus
gagtttagtattagagcccaggtta

SEQ ID NO: 499689 - DNA, 25 bp, Mus musculus
gagtttagtatttgagcccaggtta

SEQ ID NO: 499690 - DNA, 25 bp, Mus musculus
gagtttagtcataaagagccctctt

SEQ ID NO: 499691 - DNA, 25 bp, Mus musculus
gagtttagtcattaagagccctctt

SEQ ID NO: 499692 - DNA, 25 bp, Mus musculus
gagtttagtctcagaaggtttctta

SEQ ID NO: 499693 - DNA, 25 bp, Mus musculus
gagtttagtctcccgccctttgata

SEQ ID NO: 499694 - DNA, 25 bp, Mus musculus
gagtttagtctcgcgccctttgata

SEQ ID NO: 499695 - DNA, 25 bp, Mus musculus
gagtttagtctctgaaggtttctta

SEQ ID NO: 499696 - DNA, 25 bp, Mus musculus
gagtttagtgctcagtctctacaca

SEQ ID NO: 499697 - DNA, 25 bp, Mus musculus
gagtttagtgctgagtctctacaca

SEQ ID NO: 499698 - DNA, 25 bp, Mus musculus
gagtttataactccagcaatcatgg

SEQ ID NO: 499699 - DNA, 25 bp, Mus musculus
gagtttataactgcagcaatcatgg

SEQ ID NO: 499700 - DNA, 25 bp, Mus musculus
gagtttataagacaagccttggtca

SEQ ID NO: 499701 - DNA, 25 bp, Mus musculus
gagtttataagagaagccttggtca

SEQ ID NO: 499702 - DNA, 25 bp, Mus musculus
gagtttatacacagtctcacaggtg

SEQ ID NO: 499703 - DNA, 25 bp, Mus musculus
gagtttatacactgtctcacaggtg

SEQ ID NO: 499704 - DNA, 25 bp, Mus musculus
gagtttatagtcagtgccgtcatga

SEQ ID NO: 499705 - DNA, 25 bp, Mus musculus
gagtttatagtctgtgccgtcatga

SEQ ID NO: 499706 - DNA, 25 bp, Mus musculus
gagtttatatagaaagtcccaagca

SEQ ID NO: 499707 - DNA, 25 bp, Mus musculus
gagtttatatagtaagtcccaagca

SEQ ID NO: 499708 - DNA, 25 bp, Mus musculus
gagtttatattcaaccagctggaag

SEQ ID NO: 499709 - DNA, 25 bp, Mus musculus
gagtttatattctaccagctggaag

SEQ ID NO: 499710 - DNA, 25 bp, Mus musculus
gagtttatcaatctgtttcttttgt

SEQ ID NO: 499711 - DNA, 25 bp, Mus musculus
gagtttatcaatgtgtttcttttgt

SEQ ID NO: 499712 - DNA, 25 bp, Mus musculus
gagtttatccatcctgcgatgaggc

SEQ ID NO: 499713 - DNA, 25 bp, Mus musculus
gagtttatccatgctgcgatgaggc

SEQ ID NO: 499714 - DNA, 25 bp, Mus musculus
gagtttatcgctctgcatgtgtgga

SEQ ID NO: 499715 - DNA, 25 bp, Mus musculus
gagtttatcgctgtgcatgtgtgga

SEQ ID NO: 499716 - DNA, 25 bp, Mus musculus
gagtttatctctctggagtagtcta

SEQ ID NO: 499717 - DNA, 25 bp, Mus musculus
gagtttatctctgtggagtagtcta

SEQ ID NO: 499718 - DNA, 25 bp, Mus musculus
gagtttatcttccttcggctgaatg

SEQ ID NO: 499719 - DNA, 25 bp, Mus musculus
gagtttatcttcgttcggctgaatg

SEQ ID NO: 499720 - DNA, 25 bp, Mus musculus
gagtttatgaggcactttaccctgt

SEQ ID NO: 499721 - DNA, 25 bp, Mus musculus
gagtttatgagggactttaccctgt

SEQ ID NO: 499722 - DNA, 25 bp, Mus musculus
gagtttatgatactgttacaccaaa

SEQ ID NO: 499723 - DNA, 25 bp, Mus musculus
gagtttatgatagtgttacaccaaa

SEQ ID NO: 499724 - DNA, 25 bp, Mus musculus
gagtttatgcttacatttggttgtc

SEQ ID NO: 499725 - DNA, 25 bp, Mus musculus
gagtttatgctttcatttggttgtc

SEQ ID NO: 499726 - DNA, 25 bp, Mus musculus
gagtttatgtccaggcatctacact

SEQ ID NO: 499727 - DNA, 25 bp, Mus musculus
gagtttatgtcctggcatctacact

SEQ ID NO: 499728 - DNA, 25 bp, Mus musculus
gagtttattcggatcgacctggatc

SEQ ID NO: 499729 - DNA, 25 bp, Mus musculus
gagtttattcggttcgacctggatc

SEQ ID NO: 499730 - DNA, 25 bp, Mus musculus
gagtttattgcccatgagcgctgag

SEQ ID NO: 499731 - DNA, 25 bp, Mus musculus
gagtttattgccgatgagcgctgag

SEQ ID NO: 499732 - DNA, 25 bp, Mus musculus
gagtttatttctccaccatttggtt

SEQ ID NO: 499733 - DNA, 25 bp, Mus musculus
gagtttatttctgcaccatttggtt

SEQ ID NO: 499734 - DNA, 25 bp, Mus musculus
gagtttatttgtatcctttagttct

SEQ ID NO: 499735 - DNA, 25 bp, Mus musculus
gagtttatttgtttcctttagttct

SEQ ID NO: 499736 - DNA, 25 bp, Mus musculus
gagtttcaagagagccaagagtttc

SEQ ID NO: 499737 - DNA, 25 bp, Mus musculus
gagtttcaagagtgccaagagtttc

SEQ ID NO: 499738 - DNA, 25 bp, Mus musculus
gagtttcaagtaatcaccaaactga

SEQ ID NO: 499739 - DNA, 25 bp, Mus musculus
gagtttcaagtattcaccaaactga

SEQ ID NO: 499740 - DNA, 25 bp, Mus musculus
gagtttcaagtcatcatttctttgc

SEQ ID NO: 499741 - DNA, 25 bp, Mus musculus
gagtttcaagtcttcatttctttgc

SEQ ID NO: 499742 - DNA, 25 bp, Mus musculus
gagtttcaagttcatccaaagttgg

SEQ ID NO: 499743 - DNA, 25 bp, Mus musculus
gagtttcaagttgatccaaagttgg

SEQ ID NO: 499744 - DNA, 25 bp, Mus musculus
gagtttcacagcagagaatctttag

SEQ ID NO: 499745 - DNA, 25 bp, Mus musculus
gagtttcacagcatctcacataaaa

SEQ ID NO: 499746 - DNA, 25 bp, Mus musculus
gagtttcacagctgagaatctttag

SEQ ID NO: 499747 - DNA, 25 bp, Mus musculus
gagtttcacagcttctcacataaaa

SEQ ID NO: 499748 - DNA, 25 bp, Mus musculus
gagtttcacataaaaccacagcata

SEQ ID NO: 499749 - DNA, 25 bp, Mus musculus
gagtttcacatataaccacagcata

SEQ ID NO: 499750 - DNA, 25 bp, Mus musculus
gagtttcacctaccttagggtccac

SEQ ID NO: 499751 - DNA, 25 bp, Mus musculus
gagtttcacctagcttagggtccac

SEQ ID NO: 499752 - DNA, 25 bp, Mus musculus
gagtttcacctcctgagatcctgag

SEQ ID NO: 499753 - DNA, 25 bp, Mus musculus
gagtttcacctcgtgagatcctgag

SEQ ID NO: 499754 - DNA, 25 bp, Mus musculus
gagtttcactcaattgctaagcatt

SEQ ID NO: 499755 - DNA, 25 bp, Mus musculus
gagtttcactcatttgctaagcatt

SEQ ID NO: 499756 - DNA, 25 bp, Mus musculus
gagtttcactctatgtagcctacct

SEQ ID NO: 499757 - DNA, 25 bp, Mus musculus
gagtttcactctttgtagcctacct

SEQ ID NO: 499758 - DNA, 25 bp, Mus musculus
gagtttcacttgcaattgcctgcaa

SEQ ID NO: 499759 - DNA, 25 bp, Mus musculus
gagtttcacttggaattgcctgcaa

SEQ ID NO: 499760 - DNA, 25 bp, Mus musculus
gagtttcagaaccatcgcgggggcc

SEQ ID NO: 499761 - DNA, 25 bp, Mus musculus
gagtttcagaacgatcgcgggggcc

SEQ ID NO: 499762 - DNA, 25 bp, Mus musculus
gagtttcagaccagcgtggactaca

SEQ ID NO: 499763 - DNA, 25 bp, Mus musculus
gagtttcagacctgcgtggactaca

SEQ ID NO: 499764 - DNA, 25 bp, Mus musculus
gagtttcagagcacccacattcttt

SEQ ID NO: 499765 - DNA, 25 bp, Mus musculus
gagtttcagagctcccacattcttt

SEQ ID NO: 499766 - DNA, 25 bp, Mus musculus
gagtttcagatcatcagcagctccc

SEQ ID NO: 499767 - DNA, 25 bp, Mus musculus
gagtttcagatcttcagcagctccc

SEQ ID NO: 499768 - DNA, 25 bp, Mus musculus
gagtttcagccacaaattagtacag

SEQ ID NO: 499769 - DNA, 25 bp, Mus musculus
gagtttcagccagaaattagtacag

SEQ ID NO: 499770 - DNA, 25 bp, Mus musculus
gagtttcagttcagtcatctgtcct

SEQ ID NO: 499771 - DNA, 25 bp, Mus musculus
gagtttcagttctgtcatctgtcct

SEQ ID NO: 499772 - DNA, 25 bp, Mus musculus
gagtttcataagattccacctgggt

SEQ ID NO: 499773 - DNA, 25 bp, Mus musculus
gagtttcataagtttccacctgggt

SEQ ID NO: 499774 - DNA, 25 bp, Mus musculus
gagtttcatacaccacacgatgcag

SEQ ID NO: 499775 - DNA, 25 bp, Mus musculus
gagtttcatacagcacacgatgcag

SEQ ID NO: 499776 - DNA, 25 bp, Mus musculus
gagtttcatactcaaccctgagact

SEQ ID NO: 499777 - DNA, 25 bp, Mus musculus
gagtttcatactgaaccctgagact

SEQ ID NO: 499778 - DNA, 25 bp, Mus musculus
gagtttcatcagctaaacccctaaa

SEQ ID NO: 499779 - DNA, 25 bp, Mus musculus
gagtttcatcaggtaaacccctaaa

SEQ ID NO: 499780 - DNA, 25 bp, Mus musculus
gagtttcatggcacctattgaccac

SEQ ID NO: 499781 - DNA, 25 bp, Mus musculus
gagtttcatggctcctattgaccac

SEQ ID NO: 499782 - DNA, 25 bp, Mus musculus
gagtttcatggtaagacggagtgtc

SEQ ID NO: 499783 - DNA, 25 bp, Mus musculus
gagtttcatggttagacggagtgtc

SEQ ID NO: 499784 - DNA, 25 bp, Mus musculus
gagtttcattataaaaatgtcagag

SEQ ID NO: 499785 - DNA, 25 bp, Mus musculus
gagtttcattattaaaatgtcagag

SEQ ID NO: 499786 - DNA, 25 bp, Mus musculus
gagtttcattctagcaccttatttt

SEQ ID NO: 499787 - DNA, 25 bp, Mus musculus
gagtttcattcttgcaccttatttt

SEQ ID NO: 499788 - DNA, 25 bp, Mus musculus
gagtttcattgtatgacgtgccttc

SEQ ID NO: 499789 - DNA, 25 bp, Mus musculus
gagtttcattgtttgacgtgccttc

SEQ ID NO: 499790 - DNA, 25 bp, Mus musculus
gagtttccaaccattgtagaacatt

SEQ ID NO: 499791 - DNA, 25 bp, Mus musculus
gagtttccaacctttgtagaacatt

SEQ ID NO: 499792 - DNA, 25 bp, Mus musculus
gagtttccaagaccatttaacctag

SEQ ID NO: 499793 - DNA, 25 bp, Mus musculus
gagtttccaagagcatttaacctag

SEQ ID NO: 499794 - DNA, 25 bp, Mus musculus
gagtttccaaggatcatattgcaag

SEQ ID NO: 499795 - DNA, 25 bp, Mus musculus
gagtttccaaggttcatattgcaag

SEQ ID NO: 499796 - DNA, 25 bp, Mus musculus
gagtttccacagattctaaggttct

SEQ ID NO: 499797 - DNA, 25 bp, Mus musculus
gagtttccacagctacgaggcagat

SEQ ID NO: 499798 - DNA, 25 bp, Mus musculus
gagtttccacaggtacgaggcagat

SEQ ID NO: 499799 - DNA, 25 bp, Mus musculus
gagtttccacagtttctaaggttct

SEQ ID NO: 499800 - DNA, 25 bp, Mus musculus
gagtttccacgtacttaaatggcaa

SEQ ID NO: 499801 - DNA, 25 bp, Mus musculus
gagtttccacgttcttaaatggcaa

SEQ ID NO: 499802 - DNA, 25 bp, Mus musculus
gagtttccagaaccttgcacatagg

SEQ ID NO: 499803 - DNA, 25 bp, Mus musculus
gagtttccagaacgcagcacagaaa

SEQ ID NO: 499804 - DNA, 25 bp, Mus musculus
gagtttccagaagcttgcacatagg

SEQ ID NO: 499805 - DNA, 25 bp, Mus musculus
gagtttccagaaggcagcacagaaa

SEQ ID NO: 499806 - DNA, 25 bp, Mus musculus
gagtttccagctccagttacaggcc

SEQ ID NO: 499807 - DNA, 25 bp, Mus musculus
gagtttccagctgcagttacaggcc

SEQ ID NO: 499808 - DNA, 25 bp, Mus musculus
gagtttccatttcactgcaagttct

SEQ ID NO: 499809 - DNA, 25 bp, Mus musculus
gagtttccatttgactgcaagttct

SEQ ID NO: 499810 - DNA, 25 bp, Mus musculus
gagtttcccaacatgtgatgactat

SEQ ID NO: 499811 - DNA, 25 bp, Mus musculus
gagtttcccaacttgtgatgactat

SEQ ID NO: 499812 - DNA, 25 bp, Mus musculus
gagtttcccacacagtaatttggca

SEQ ID NO: 499813 - DNA, 25 bp, Mus musculus
gagtttcccacagagtaatttggca

SEQ ID NO: 499814 - DNA, 25 bp, Mus musculus
gagtttccccagagagttactgctt

SEQ ID NO: 499815 - DNA, 25 bp, Mus musculus
gagtttccccagtgagttactgctt

SEQ ID NO: 499816 - DNA, 25 bp, Mus musculus
gagtttccccatcagtagaatcagt

SEQ ID NO: 499817 - DNA, 25 bp, Mus musculus
gagtttccccatgagtagaatcagt

SEQ ID NO: 499818 - DNA, 25 bp, Mus musculus
gagtttcccgcgcaagactgggctg

SEQ ID NO: 499819 - DNA, 25 bp, Mus musculus
gagtttcccgcggaagactgggctg

SEQ ID NO: 499820 - DNA, 25 bp, Mus musculus
gagtttccctgaagatctaggctct

SEQ ID NO: 499821 - DNA, 25 bp, Mus musculus
gagtttccctgatgatctaggctct

SEQ ID NO: 499822 - DNA, 25 bp, Mus musculus
gagtttccctggaacgcaaagaact

SEQ ID NO: 499823 - DNA, 25 bp, Mus musculus
gagtttccctggtacgcaaagaact

SEQ ID NO: 499824 - DNA, 25 bp, Mus musculus
gagtttccggctattaaatcctcag

SEQ ID NO: 499825 - DNA, 25 bp, Mus musculus
gagtttccggcttttaaatcctcag

SEQ ID NO: 499826 - DNA, 25 bp, Mus musculus
gagtttccgttgcacttaaacatgt

SEQ ID NO: 499827 - DNA, 25 bp, Mus musculus
gagtttccgttggacttaaacatgt

SEQ ID NO: 499828 - DNA, 25 bp, Mus musculus
gagtttcctagtaaggcctactcca

SEQ ID NO: 499829 - DNA, 25 bp, Mus musculus
gagtttcctagttaggcctactcca

SEQ ID NO: 499830 - DNA, 25 bp, Mus musculus
gagtttcctcaacaaataactgcag

SEQ ID NO: 499831 - DNA, 25 bp, Mus musculus
gagtttcctcaagaaataactgcag

SEQ ID NO: 499832 - DNA, 25 bp, Mus musculus
gagtttcctggcaatagatcctaac

SEQ ID NO: 499833 - DNA, 25 bp, Mus musculus
gagtttcctggctatagatcctaac

SEQ ID NO: 499834 - DNA, 25 bp, Mus musculus
gagtttcctgggaggcgatgattca

SEQ ID NO: 499835 - DNA, 25 bp, Mus musculus
gagtttcctgggtggcgatgattca

SEQ ID NO: 499836 - DNA, 25 bp, Mus musculus
gagtttcgaagccttctttcctttg

SEQ ID NO: 499837 - DNA, 25 bp, Mus musculus
gagtttcgaagcgttctttcctttg

SEQ ID NO: 499838 - DNA, 25 bp, Mus musculus
gagtttcggaacagggaagacacca

SEQ ID NO: 499839 - DNA, 25 bp, Mus musculus
gagtttcggaactgggaagacacca

SEQ ID NO: 499840 - DNA, 25 bp, Mus musculus
gagtttcgggttacagctagcaaca

SEQ ID NO: 499841 - DNA, 25 bp, Mus musculus
gagtttcgggtttcagctagcaaca

SEQ ID NO: 499842 - DNA, 25 bp, Mus musculus
gagtttctaacccaagagcagtatg

SEQ ID NO: 499843 - DNA, 25 bp, Mus musculus
gagtttctaaccgaagagcagtatg

SEQ ID NO: 499844 - DNA, 25 bp, Mus musculus
gagtttctaactaccctactgaatc

SEQ ID NO: 499845 - DNA, 25 bp, Mus musculus
gagtttctaactagcctacatgtga

SEQ ID NO: 499846 - DNA, 25 bp, Mus musculus
gagtttctaacttccctactgaatc

SEQ ID NO: 499847 - DNA, 25 bp, Mus musculus
gagtttctaacttgcctacatgtga

SEQ ID NO: 499848 - DNA, 25 bp, Mus musculus
gagtttctaagtaaacccactgtgt

SEQ ID NO: 499849 - DNA, 25 bp, Mus musculus
gagtttctaagttaacccactgtgt

SEQ ID NO: 499850 - DNA, 25 bp, Mus musculus
gagtttctaggcactattccatgaa

SEQ ID NO: 499851 - DNA, 25 bp, Mus musculus
gagtttctaggctctattccatgaa

SEQ ID NO: 499852 - DNA, 25 bp, Mus musculus
gagtttctatttcagcgtacaccgt

SEQ ID NO: 499853 - DNA, 25 bp, Mus musculus
gagtttctatttgagcgtacaccgt

SEQ ID NO: 499854 - DNA, 25 bp, Mus musculus
gagtttctcaacctcattggtggct

SEQ ID NO: 499855 - DNA, 25 bp, Mus musculus
gagtttctcaacgtcattggtggct

SEQ ID NO: 499856 - DNA, 25 bp, Mus musculus
gagtttctcagaaccgttttagctg

SEQ ID NO: 499857 - DNA, 25 bp, Mus musculus
gagtttctcagatccgttttagctg

SEQ ID NO: 499858 - DNA, 25 bp, Mus musculus
gagtttctcaggcaactgtctttcg

SEQ ID NO: 499859 - DNA, 25 bp, Mus musculus
gagtttctcagggaactgtctttcg

SEQ ID NO: 499860 - DNA, 25 bp, Mus musculus
gagtttctcatacttgttttataga

SEQ ID NO: 499861 - DNA, 25 bp, Mus musculus
gagtttctcatagttgttttataga

SEQ ID NO: 499862 - DNA, 25 bp, Mus musculus
gagtttctcctcaatgctattagcg

SEQ ID NO: 499863 - DNA, 25 bp, Mus musculus
gagtttctcctctatgctattagcg

SEQ ID NO: 499864 - DNA, 25 bp, Mus musculus
gagtttctctctataagcattctat

SEQ ID NO: 499865 - DNA, 25 bp, Mus musculus
gagtttctctctccttgtcccttac

SEQ ID NO: 499866 - DNA, 25 bp, Mus musculus
gagtttctctctgcttgtcccttac

SEQ ID NO: 499867 - DNA, 25 bp, Mus musculus
gagtttctctctttaagcattctat

SEQ ID NO: 499868 - DNA, 25 bp, Mus musculus
gagtttctctggcaaccacctaatg

SEQ ID NO: 499869 - DNA, 25 bp, Mus musculus
gagtttctctgggaaccacctaatg

SEQ ID NO: 499870 - DNA, 25 bp, Mus musculus
gagtttctgaaacgatgcctccagt

SEQ ID NO: 499871 - DNA, 25 bp, Mus musculus
gagtttctgaaaggatgcctccagt

SEQ ID NO: 499872 - DNA, 25 bp, Mus musculus
gagtttctgacccaaatgcactttt

SEQ ID NO: 499873 - DNA, 25 bp, Mus musculus
gagtttctgacccattgactccagg

SEQ ID NO: 499874 - DNA, 25 bp, Mus musculus
gagtttctgaccgaaatgcactttt

SEQ ID NO: 499875 - DNA, 25 bp, Mus musculus
gagtttctgaccgattgactccagg

SEQ ID NO: 499876 - DNA, 25 bp, Mus musculus
gagtttctgactaaactgtcctctg

SEQ ID NO: 499877 - DNA, 25 bp, Mus musculus
gagtttctgacttaactgtcctctg

SEQ ID NO: 499878 - DNA, 25 bp, Mus musculus
gagtttctgagaatcagcactgcta

SEQ ID NO: 499879 - DNA, 25 bp, Mus musculus
gagtttctgagattcagcactgcta

SEQ ID NO: 499880 - DNA, 25 bp, Mus musculus
gagtttctgagcatttggcttccct

SEQ ID NO: 499881 - DNA, 25 bp, Mus musculus
gagtttctgagcttttggcttccct

SEQ ID NO: 499882 - DNA, 25 bp, Mus musculus
gagtttctgctcattaagtgcttga

SEQ ID NO: 499883 - DNA, 25 bp, Mus musculus
gagtttctgctctttaagtgcttga

SEQ ID NO: 499884 - DNA, 25 bp, Mus musculus
gagtttctggccaaactgaatgcac

SEQ ID NO: 499885 - DNA, 25 bp, Mus musculus
gagtttctggcctaactgaatgcac

SEQ ID NO: 499886 - DNA, 25 bp, Mus musculus
gagtttctgggcaacatattgtgtg

SEQ ID NO: 499887 - DNA, 25 bp, Mus musculus
gagtttctgggctacatattgtgtg

SEQ ID NO: 499888 - DNA, 25 bp, Mus musculus
gagtttctgggtaggacacgccatt

SEQ ID NO: 499889 - DNA, 25 bp, Mus musculus
gagtttctgggttggacacgccatt

SEQ ID NO: 499890 - DNA, 25 bp, Mus musculus
gagtttctggttctattggatgcct

SEQ ID NO: 499891 - DNA, 25 bp, Mus musculus
gagtttctggttgtattggatgcct

SEQ ID NO: 499892 - DNA, 25 bp, Mus musculus
gagtttctgtaaaacgtagtcactc

SEQ ID NO: 499893 - DNA, 25 bp, Mus musculus
gagtttctgtaatacgtagtcactc

SEQ ID NO: 499894 - DNA, 25 bp, Mus musculus
gagtttctgttcataaacctctgtc

SEQ ID NO: 499895 - DNA, 25 bp, Mus musculus
gagtttctgttcttaaacctctgtc

SEQ ID NO: 499896 - DNA, 25 bp, Mus musculus
gagtttcttaagatgtacctgatgc

SEQ ID NO: 499897 - DNA, 25 bp, Mus musculus
gagtttcttaagttgtacctgatgc

SEQ ID NO: 499898 - DNA, 25 bp, Mus musculus
gagtttcttagtcttatttgttgat

SEQ ID NO: 499899 - DNA, 25 bp, Mus musculus
gagtttcttagtgttatttgttgat

SEQ ID NO: 499900 - DNA, 25 bp, Mus musculus
gagtttcttccaacccagatgatga

SEQ ID NO: 499901 - DNA, 25 bp, Mus musculus
gagtttcttccatcccagatgatga

SEQ ID NO: 499902 - DNA, 25 bp, Mus musculus
gagtttcttctacctcacagagatg

SEQ ID NO: 499903 - DNA, 25 bp, Mus musculus
gagtttcttctagctcacagagatg

SEQ ID NO: 499904 - DNA, 25 bp, Mus musculus
gagtttcttctcacgttaaggcctc

SEQ ID NO: 499905 - DNA, 25 bp, Mus musculus
gagtttcttctctcgttaaggcctc

SEQ ID NO: 499906 - DNA, 25 bp, Mus musculus
gagtttcttcttccagaagcctaga

SEQ ID NO: 499907 - DNA, 25 bp, Mus musculus
gagtttcttcttgcagaagcctaga

SEQ ID NO: 499908 - DNA, 25 bp, Mus musculus
gagtttcttgccctgaccatcagag

SEQ ID NO: 499909 - DNA, 25 bp, Mus musculus
gagtttcttgccgtgaccatcagag

SEQ ID NO: 499910 - DNA, 25 bp, Mus musculus
gagtttcttgtgctagcctctcaaa

SEQ ID NO: 499911 - DNA, 25 bp, Mus musculus
gagtttcttgtggtagcctctcaaa

SEQ ID NO: 499912 - DNA, 25 bp, Mus musculus
gagtttctttcccagctgatgacaa

SEQ ID NO: 499913 - DNA, 25 bp, Mus musculus
gagtttctttccctgctcaggatgt

SEQ ID NO: 499914 - DNA, 25 bp, Mus musculus
gagtttctttccgagctgatgacaa

SEQ ID NO: 499915 - DNA, 25 bp, Mus musculus
gagtttctttccgtgctcaggatgt

SEQ ID NO: 499916 - DNA, 25 bp, Mus musculus
gagtttctttgaatgttgactatgc

SEQ ID NO: 499917 - DNA, 25 bp, Mus musculus
gagtttctttgattgttgactatgc

SEQ ID NO: 499918 - DNA, 25 bp, Mus musculus
gagtttgaacagattctgcccatga

SEQ ID NO: 499919 - DNA, 25 bp, Mus musculus
gagtttgaacagtttctgcccatga

SEQ ID NO: 499920 - DNA, 25 bp, Mus musculus
gagtttgacacaaccagaaccccaa

SEQ ID NO: 499921 - DNA, 25 bp, Mus musculus
gagtttgacacatccagaaccccaa

SEQ ID NO: 499922 - DNA, 25 bp, Mus musculus
gagtttgacagcaatgcctctgcca

SEQ ID NO: 499923 - DNA, 25 bp, Mus musculus
gagtttgacagctatgcctctgcca

SEQ ID NO: 499924 - DNA, 25 bp, Mus musculus
gagtttgacatgactattagaaagc

SEQ ID NO: 499925 - DNA, 25 bp, Mus musculus
gagtttgacatgtctattagaaagc

SEQ ID NO: 499926 - DNA, 25 bp, Mus musculus
gagtttgaccagatgctctgccaac

SEQ ID NO: 499927 - DNA, 25 bp, Mus musculus
gagtttgaccagttgctctgccaac

SEQ ID NO: 499928 - DNA, 25 bp, Mus musculus
gagtttgacccacgtacccacatgg

SEQ ID NO: 499929 - DNA, 25 bp, Mus musculus
gagtttgacccaggtacccacatgg

SEQ ID NO: 499930 - DNA, 25 bp, Mus musculus
gagtttgacctcatgccttggcagg

SEQ ID NO: 499931 - DNA, 25 bp, Mus musculus
gagtttgacctcttgccttggcagg

SEQ ID NO: 499932 - DNA, 25 bp, Mus musculus
gagtttgactccatttcctgtgcag

SEQ ID NO: 499933 - DNA, 25 bp, Mus musculus
gagtttgactccttttcctgtgcag

SEQ ID NO: 499934 - DNA, 25 bp, Mus musculus
gagtttgactgcctccgttctgagt

SEQ ID NO: 499935 - DNA, 25 bp, Mus musculus
gagtttgactgcgtccgttctgagt

SEQ ID NO: 499936 - DNA, 25 bp, Mus musculus
gagtttgacttcagtgatcttccct

SEQ ID NO: 499937 - DNA, 25 bp, Mus musculus
gagtttgacttctgtgatcttccct

SEQ ID NO: 499938 - DNA, 25 bp, Mus musculus
gagtttgagacgcttcctcatgaca

SEQ ID NO: 499939 - DNA, 25 bp, Mus musculus
gagtttgagacggttcctcatgaca

SEQ ID NO: 499940 - DNA, 25 bp, Mus musculus
gagtttgagactaccctggttgata

SEQ ID NO: 499941 - DNA, 25 bp, Mus musculus
gagtttgagacttccctggttgata

SEQ ID NO: 499942 - DNA, 25 bp, Mus musculus
gagtttgagagtccctcttactgta

SEQ ID NO: 499943 - DNA, 25 bp, Mus musculus
gagtttgagagtgcctcttactgta

SEQ ID NO: 499944 - DNA, 25 bp, Mus musculus
gagtttgagattcatctcccagatg

SEQ ID NO: 499945 - DNA, 25 bp, Mus musculus
gagtttgagattgatctcccagatg

SEQ ID NO: 499946 - DNA, 25 bp, Mus musculus
gagtttgagccccttagtatcgata

SEQ ID NO: 499947 - DNA, 25 bp, Mus musculus
gagtttgagcccgttagtatcgata

SEQ ID NO: 499948 - DNA, 25 bp, Mus musculus
gagtttgagtccaacttaggctata

SEQ ID NO: 499949 - DNA, 25 bp, Mus musculus
gagtttgagtcctacttaggctata

SEQ ID NO: 499950 - DNA, 25 bp, Mus musculus
gagtttgatactcctctgtgatgcc

SEQ ID NO: 499951 - DNA, 25 bp, Mus musculus
gagtttgatactgctctgtgatgcc

SEQ ID NO: 499952 - DNA, 25 bp, Mus musculus
gagtttgatccgagagtacctttgc

SEQ ID NO: 499953 - DNA, 25 bp, Mus musculus
gagtttgatccgtgagtacctttgc

SEQ ID NO: 499954 - DNA, 25 bp, Mus musculus
gagtttgatcctcaactctcctacc

SEQ ID NO: 499955 - DNA, 25 bp, Mus musculus
gagtttgatcctgaactctcctacc

SEQ ID NO: 499956 - DNA, 25 bp, Mus musculus
gagtttgatcttaaggcctgacttt

SEQ ID NO: 499957 - DNA, 25 bp, Mus musculus
gagtttgatctttaggcctgacttt

SEQ ID NO: 499958 - DNA, 25 bp, Mus musculus
gagtttgatgtcaggcagctcccac

SEQ ID NO: 499959 - DNA, 25 bp, Mus musculus
gagtttgatgtctggcagctcccac

SEQ ID NO: 499960 - DNA, 25 bp, Mus musculus
gagtttgcaagacctctgctgccgt

SEQ ID NO: 499961 - DNA, 25 bp, Mus musculus
gagtttgcaagagctctgctgccgt

SEQ ID NO: 499962 - DNA, 25 bp, Mus musculus
gagtttgcaagtcctgtagccctgc

SEQ ID NO: 499963 - DNA, 25 bp, Mus musculus
gagtttgcaagtgctgtagccctgc

SEQ ID NO: 499964 - DNA, 25 bp, Mus musculus
gagtttgcacaaatggctgatcttg

SEQ ID NO: 499965 - DNA, 25 bp, Mus musculus
gagtttgcacaattggctgatcttg

SEQ ID NO: 499966 - DNA, 25 bp, Mus musculus
gagtttgcacggcagcatcaccaac

SEQ ID NO: 499967 - DNA, 25 bp, Mus musculus
gagtttgcacgggagcatcaccaac

SEQ ID NO: 499968 - DNA, 25 bp, Mus musculus
gagtttgcactaaggtcttgagctg

SEQ ID NO: 499969 - DNA, 25 bp, Mus musculus
gagtttgcactatggtcttgagctg

SEQ ID NO: 499970 - DNA, 25 bp, Mus musculus
gagtttgcacttagatggccccaga

SEQ ID NO: 499971 - DNA, 25 bp, Mus musculus
gagtttgcactttgatggccccaga

SEQ ID NO: 499972 - DNA, 25 bp, Mus musculus
gagtttgcagaacctaacctttcct

SEQ ID NO: 499973 - DNA, 25 bp, Mus musculus
gagtttgcagaagctaacctttcct

SEQ ID NO: 499974 - DNA, 25 bp, Mus musculus
gagtttgcagacagtttgggttata

SEQ ID NO: 499975 - DNA, 25 bp, Mus musculus
gagtttgcagactgtttgggttata

SEQ ID NO: 499976 - DNA, 25 bp, Mus musculus
gagtttgcagccagcgccatggatg

SEQ ID NO: 499977 - DNA, 25 bp, Mus musculus
gagtttgcagcctgcgccatggatg

SEQ ID NO: 499978 - DNA, 25 bp, Mus musculus
gagtttgcagctacatggtgggcta

SEQ ID NO: 499979 - DNA, 25 bp, Mus musculus
gagtttgcagcttcatggtgggcta

SEQ ID NO: 499980 - DNA, 25 bp, Mus musculus
gagtttgcagttatctgaccagcaa

SEQ ID NO: 499981 - DNA, 25 bp, Mus musculus
gagtttgcagttttctgaccagcaa

SEQ ID NO: 499982 - DNA, 25 bp, Mus musculus
gagtttgccaggaacttgccagtcg

SEQ ID NO: 499983 - DNA, 25 bp, Mus musculus
gagtttgccaggtacttgccagtcg

SEQ ID NO: 499984 - DNA, 25 bp, Mus musculus
gagtttgccatccatcccaatgagc

SEQ ID NO: 499985 - DNA, 25 bp, Mus musculus
gagtttgccatcgatcccaatgagc

SEQ ID NO: 499986 - DNA, 25 bp, Mus musculus
gagtttgcccctcacaacaggcata

SEQ ID NO: 499987 - DNA, 25 bp, Mus musculus
gagtttgcccctgacaacaggcata

SEQ ID NO: 499988 - DNA, 25 bp, Mus musculus
gagtttgcccgcatgcaggaccagc

SEQ ID NO: 499989 - DNA, 25 bp, Mus musculus
gagtttgcccgcttgcaggaccagc

SEQ ID NO: 499990 - DNA, 25 bp, Mus musculus
gagtttgcctcacaagactactaaa

SEQ ID NO: 499991 - DNA, 25 bp, Mus musculus
gagtttgcctcagaagactactaaa

SEQ ID NO: 499992 - DNA, 25 bp, Mus musculus
gagtttgcctccatgtggttcaggc

SEQ ID NO: 499993 - DNA, 25 bp, Mus musculus
gagtttgcctccttgtggttcaggc

SEQ ID NO: 499994 - DNA, 25 bp, Mus musculus
gagtttgcctctaatggtgacttaa

SEQ ID NO: 499995 - DNA, 25 bp, Mus musculus
gagtttgcctcttatggtgacttaa

SEQ ID NO: 499996 - DNA, 25 bp, Mus musculus
gagtttgcgaagacctttaaagagt

SEQ ID NO: 499997 - DNA, 25 bp, Mus musculus
gagtttgcgaagtcctttaaagagt

SEQ ID NO: 499998 - DNA, 25 bp, Mus musculus
gagtttgcggacagcgatcctgcca

SEQ ID NO: 499999 - DNA, 25 bp, Mus musculus
gagtttgcggactgcgatcctgcca

SEQ ID NO: 500000 - DNA, 25 bp, Mus musculus
gagtttgctatcattggcctattaa

SEQ ID NO: 500001 - DNA, 25 bp, Mus musculus
gagtttgctatctttggcctattaa

SEQ ID NO: 500002 - DNA, 25 bp, Mus musculus
gagtttgctcagaacttattgaatt

SEQ ID NO: 500003 - DNA, 25 bp, Mus musculus
gagtttgctcagtacttattgaatt

SEQ ID NO: 500004 - DNA, 25 bp, Mus musculus
gagtttgctgcgctgcacagtcaac

SEQ ID NO: 500005 - DNA, 25 bp, Mus musculus
gagtttgctgcggtgcacagtcaac

SEQ ID NO: 500006 - DNA, 25 bp, Mus musculus
gagtttgctgctcatgtacggctta

SEQ ID NO: 500007 - DNA, 25 bp, Mus musculus
gagtttgctgctgatgtacggctta

SEQ ID NO: 500008 - DNA, 25 bp, Mus musculus
gagtttgctgggatctgcagcagtt

SEQ ID NO: 500009 - DNA, 25 bp, Mus musculus
gagtttgctgggttctgcagcagtt

SEQ ID NO: 500010 - DNA, 25 bp, Mus musculus
gagtttgctgttacattgcttcaca

SEQ ID NO: 500011 - DNA, 25 bp, Mus musculus
gagtttgctgtttcattgcttcaca

SEQ ID NO: 500012 - DNA, 25 bp, Mus musculus
gagtttgcttgtcgctttagtgatg

SEQ ID NO: 500013 - DNA, 25 bp, Mus musculus
gagtttgcttgtggctttagtgatg

SEQ ID NO: 500014 - DNA, 25 bp, Mus musculus
gagtttgctttaccattgagacaca

SEQ ID NO: 500015 - DNA, 25 bp, Mus musculus
gagtttgctttagcattgagacaca

SEQ ID NO: 500016 - DNA, 25 bp, Mus musculus
gagtttggagagaccctcagctgta

SEQ ID NO: 500017 - DNA, 25 bp, Mus musculus
gagtttggagagtccctcagctgta

SEQ ID NO: 500018 - DNA, 25 bp, Mus musculus
gagtttggcagtccgtaccagtcac

SEQ ID NO: 500019 - DNA, 25 bp, Mus musculus
gagtttggcagtgcgtaccagtcac

SEQ ID NO: 500020 - DNA, 25 bp, Mus musculus
gagtttggccaaaactaaagggtag

SEQ ID NO: 500021 - DNA, 25 bp, Mus musculus
gagtttggccaatactaaagggtag

SEQ ID NO: 500022 - DNA, 25 bp, Mus musculus
gagtttggcctcagggaagccaata

SEQ ID NO: 500023 - DNA, 25 bp, Mus musculus
gagtttggcctctgggaagccaata

SEQ ID NO: 500024 - DNA, 25 bp, Mus musculus
gagtttggctacagtcgcgtaagga

SEQ ID NO: 500025 - DNA, 25 bp, Mus musculus
gagtttggctactgtcgcgtaagga

SEQ ID NO: 500026 - DNA, 25 bp, Mus musculus
gagtttggctccactaagccgtata

SEQ ID NO: 500027 - DNA, 25 bp, Mus musculus
gagtttggctcctctaagccgtata

SEQ ID NO: 500028 - DNA, 25 bp, Mus musculus
gagtttggctgacctcgtcacagag

SEQ ID NO: 500029 - DNA, 25 bp, Mus musculus
gagtttggctgagctcgtcacagag

SEQ ID NO: 500030 - DNA, 25 bp, Mus musculus
gagtttgggactacagattctgatc

SEQ ID NO: 500031 - DNA, 25 bp, Mus musculus
gagtttgggacttcagattctgatc

SEQ ID NO: 500032 - DNA, 25 bp, Mus musculus
gagtttgggatactttgtttctgtt

SEQ ID NO: 500033 - DNA, 25 bp, Mus musculus
gagtttgggatagtttgtttctgtt

SEQ ID NO: 500034 - DNA, 25 bp, Mus musculus
gagtttgggcttaacacatcagcgc

SEQ ID NO: 500035 - DNA, 25 bp, Mus musculus
gagtttgggctttacacatcagcgc

SEQ ID NO: 500036 - DNA, 25 bp, Mus musculus
gagtttgggtacctgaacacagtat

SEQ ID NO: 500037 - DNA, 25 bp, Mus musculus
gagtttgggtacgtgaacacagtat

SEQ ID NO: 500038 - DNA, 25 bp, Mus musculus
gagtttggtagcatcttcttaaata

SEQ ID NO: 500039 - DNA, 25 bp, Mus musculus
gagtttggtagcttcttcttaaata

SEQ ID NO: 500040 - DNA, 25 bp, Mus musculus
gagtttggtcccaagaattcatata

SEQ ID NO: 500041 - DNA, 25 bp, Mus musculus
gagtttggtccctagaattcatata

SEQ ID NO: 500042 - DNA, 25 bp, Mus musculus
gagtttggtgagacctgctcacaac

SEQ ID NO: 500043 - DNA, 25 bp, Mus musculus
gagtttggtgagtcctgctcacaac

SEQ ID NO: 500044 - DNA, 25 bp, Mus musculus
gagtttggtgcaaggtccaggtaca

SEQ ID NO: 500045 - DNA, 25 bp, Mus musculus
gagtttggtgcatggtccaggtaca

SEQ ID NO: 500046 - DNA, 25 bp, Mus musculus
gagtttggtgttcccgcagccatat

SEQ ID NO: 500047 - DNA, 25 bp, Mus musculus
gagtttggtgttgccgcagccatat

SEQ ID NO: 500048 - DNA, 25 bp, Mus musculus
gagtttggtttaactgcttagtatc

SEQ ID NO: 500049 - DNA, 25 bp, Mus musculus
gagtttggtttatctgcttagtatc

SEQ ID NO: 500050 - DNA, 25 bp, Mus musculus
gagtttggttttctaacaggagaca

SEQ ID NO: 500051 - DNA, 25 bp, Mus musculus
gagtttggttttgtaacaggagaca

SEQ ID NO: 500052 - DNA, 25 bp, Mus musculus
gagtttgtagcacttcattatagga

SEQ ID NO: 500053 - DNA, 25 bp, Mus musculus
gagtttgtagcagttcattatagga

SEQ ID NO: 500054 - DNA, 25 bp, Mus musculus
gagtttgtagccacaagtgttcaag

SEQ ID NO: 500055 - DNA, 25 bp, Mus musculus
gagtttgtagcctcaagtgttcaag

SEQ ID NO: 500056 - DNA, 25 bp, Mus musculus
gagtttgtaggaagctcttacctgt

SEQ ID NO: 500057 - DNA, 25 bp, Mus musculus
gagtttgtaggatgctcttacctgt

SEQ ID NO: 500058 - DNA, 25 bp, Mus musculus
gagtttgtatacctcaggcaccagc

SEQ ID NO: 500059 - DNA, 25 bp, Mus musculus
gagtttgtatacgtcaggcaccagc

SEQ ID NO: 500060 - DNA, 25 bp, Mus musculus
gagtttgtatcactttctgtcccta

SEQ ID NO: 500061 - DNA, 25 bp, Mus musculus
gagtttgtatcagtttctgtcccta

SEQ ID NO: 500062 - DNA, 25 bp, Mus musculus
gagtttgtcataatcctcatgaaac

SEQ ID NO: 500063 - DNA, 25 bp, Mus musculus
gagtttgtcatattcctcatgaaac

SEQ ID NO: 500064 - DNA, 25 bp, Mus musculus
gagtttgtccaaatggcttgttgag

SEQ ID NO: 500065 - DNA, 25 bp, Mus musculus
gagtttgtccaattggcttgttgag

SEQ ID NO: 500066 - DNA, 25 bp, Mus musculus
gagtttgtccctatgatttttaaag

SEQ ID NO: 500067 - DNA, 25 bp, Mus musculus
gagtttgtccctttgatttttaaag

SEQ ID NO: 500068 - DNA, 25 bp, Mus musculus
gagtttgtcgaacgagcactgttta

SEQ ID NO: 500069 - DNA, 25 bp, Mus musculus
gagtttgtcgaaggagcactgttta

SEQ ID NO: 500070 - DNA, 25 bp, Mus musculus
gagtttgtctctactgagtttcaag

SEQ ID NO: 500071 - DNA, 25 bp, Mus musculus
gagtttgtctcttctgagtttcaag

SEQ ID NO: 500072 - DNA, 25 bp, Mus musculus
gagtttgtctgtaactagcaggctt

SEQ ID NO: 500073 - DNA, 25 bp, Mus musculus
gagtttgtctgttactagcaggctt

SEQ ID NO: 500074 - DNA, 25 bp, Mus musculus
gagtttgtcttactgtctcgtgaaa

SEQ ID NO: 500075 - DNA, 25 bp, Mus musculus
gagtttgtcttagtgtctcgtgaaa

SEQ ID NO: 500076 - DNA, 25 bp, Mus musculus
gagtttgtgagcatgtcattgtgct

SEQ ID NO: 500077 - DNA, 25 bp, Mus musculus
gagtttgtgagcttgtcattgtgct

SEQ ID NO: 500078 - DNA, 25 bp, Mus musculus
gagtttgtgataaacatgctcattt

SEQ ID NO: 500079 - DNA, 25 bp, Mus musculus
gagtttgtgatatacatgctcattt

SEQ ID NO: 500080 - DNA, 25 bp, Mus musculus
gagtttgtgatcatattcttttaga

SEQ ID NO: 500081 - DNA, 25 bp, Mus musculus
gagtttgtgatcttattcttttaga

SEQ ID NO: 500082 - DNA, 25 bp, Mus musculus
gagtttgtgctcaaaaagcccctgt

SEQ ID NO: 500083 - DNA, 25 bp, Mus musculus
gagtttgtgctctaaaagcccctgt

SEQ ID NO: 500084 - DNA, 25 bp, Mus musculus
gagtttgtgctgctagcaacagtat

SEQ ID NO: 500085 - DNA, 25 bp, Mus musculus
gagtttgtgctggtagcaacagtat

SEQ ID NO: 500086 - DNA, 25 bp, Mus musculus
gagtttgtggacatccccagcctgg

SEQ ID NO: 500087 - DNA, 25 bp, Mus musculus
gagtttgtggacttccccagcctgg

SEQ ID NO: 500088 - DNA, 25 bp, Mus musculus
gagtttgtggccaactgattgtaca

SEQ ID NO: 500089 - DNA, 25 bp, Mus musculus
gagtttgtggcctactgattgtaca

SEQ ID NO: 500090 - DNA, 25 bp, Mus musculus
gagtttgtggtaccagtgcctgacc

SEQ ID NO: 500091 - DNA, 25 bp, Mus musculus
gagtttgtggtagcagtgcctgacc

SEQ ID NO: 500092 - DNA, 25 bp, Mus musculus
gagtttgtgtcaattctcttagaat

SEQ ID NO: 500093 - DNA, 25 bp, Mus musculus
gagtttgtgtcatttctcttagaat

SEQ ID NO: 500094 - DNA, 25 bp, Mus musculus
gagtttgtgtgcaacagagtcctgt

SEQ ID NO: 500095 - DNA, 25 bp, Mus musculus
gagtttgtgtgcctcaaatccatca

SEQ ID NO: 500096 - DNA, 25 bp, Mus musculus
gagtttgtgtgcgtcaaatccatca

SEQ ID NO: 500097 - DNA, 25 bp, Mus musculus
gagtttgtgtgctacagagtcctgt

SEQ ID NO: 500098 - DNA, 25 bp, Mus musculus
gagtttgtgtttcggtcatcggcca

SEQ ID NO: 500099 - DNA, 25 bp, Mus musculus
gagtttgtgtttgggtcatcggcca

SEQ ID NO: 500100 - DNA, 25 bp, Mus musculus
gagtttgttactcagctctgtagta

SEQ ID NO: 500101 - DNA, 25 bp, Mus musculus
gagtttgttactgagctctgtagta

SEQ ID NO: 500102 - DNA, 25 bp, Mus musculus
gagtttgttagtacagaccccaggg

SEQ ID NO: 500103 - DNA, 25 bp, Mus musculus
gagtttgttagttcagaccccaggg

SEQ ID NO: 500104 - DNA, 25 bp, Mus musculus
gagtttgttcatagtacttggcaca

SEQ ID NO: 500105 - DNA, 25 bp, Mus musculus
gagtttgttcattgtacttggcaca

SEQ ID NO: 500106 - DNA, 25 bp, Mus musculus
gagtttgttcctctcaatcttaagc

SEQ ID NO: 500107 - DNA, 25 bp, Mus musculus
gagtttgttcctgtcaatcttaagc

SEQ ID NO: 500108 - DNA, 25 bp, Mus musculus
gagtttgttgacactccggtcattt

SEQ ID NO: 500109 - DNA, 25 bp, Mus musculus
gagtttgttgactctccggtcattt

SEQ ID NO: 500110 - DNA, 25 bp, Mus musculus
gagtttgttggacatctgcttaggc

SEQ ID NO: 500111 - DNA, 25 bp, Mus musculus
gagtttgttggagatctgcttaggc

SEQ ID NO: 500112 - DNA, 25 bp, Mus musculus
gagtttgttgtactatcttttgtat

SEQ ID NO: 500113 - DNA, 25 bp, Mus musculus
gagtttgttgtagtatcttttgtat

SEQ ID NO: 500114 - DNA, 25 bp, Mus musculus
gagtttgtttccattgtgcataata

SEQ ID NO: 500115 - DNA, 25 bp, Mus musculus
gagtttgtttcctttgtgcataata

SEQ ID NO: 500116 - DNA, 25 bp, Mus musculus
gagtttgtttgcaaatgaaagctgt

SEQ ID NO: 500117 - DNA, 25 bp, Mus musculus
gagtttgtttgctaatgaaagctgt

SEQ ID NO: 500118 - DNA, 25 bp, Mus musculus
gagtttgttttactgttgacctcac

SEQ ID NO: 500119 - DNA, 25 bp, Mus musculus
gagtttgttttagtgttgacctcac

SEQ ID NO: 500120 - DNA, 25 bp, Mus musculus
gagttttaaatccactttccacata

SEQ ID NO: 500121 - DNA, 25 bp, Mus musculus
gagttttaaatcgactttccacata

SEQ ID NO: 500122 - DNA, 25 bp, Mus musculus
gagttttaagctcgacaatctacaa

SEQ ID NO: 500123 - DNA, 25 bp, Mus musculus
gagttttaagctggacaatctacaa

SEQ ID NO: 500124 - DNA, 25 bp, Mus musculus
gagttttaatacaaccaccagtctt

SEQ ID NO: 500125 - DNA, 25 bp, Mus musculus
gagttttaatactaccaccagtctt

SEQ ID NO: 500126 - DNA, 25 bp, Mus musculus
gagttttaattgctcacaaactagt

SEQ ID NO: 500127 - DNA, 25 bp, Mus musculus
gagttttaattggtcacaaactagt

SEQ ID NO: 500128 - DNA, 25 bp, Mus musculus
gagttttacaccaggactccttaca

SEQ ID NO: 500129 - DNA, 25 bp, Mus musculus
gagttttacacctggactccttaca

SEQ ID NO: 500130 - DNA, 25 bp, Mus musculus
gagttttaccaacttatttatgaag

SEQ ID NO: 500131 - DNA, 25 bp, Mus musculus
gagttttaccaagttatttatgaag

SEQ ID NO: 500132 - DNA, 25 bp, Mus musculus
gagttttacttccaagtctcagtcc

SEQ ID NO: 500133 - DNA, 25 bp, Mus musculus
gagttttacttcgaagtctcagtcc

SEQ ID NO: 500134 - DNA, 25 bp, Mus musculus
gagttttagcatctgtttctgtcat

SEQ ID NO: 500135 - DNA, 25 bp, Mus musculus
gagttttagcatgtgtttctgtcat

SEQ ID NO: 500136 - DNA, 25 bp, Mus musculus
gagttttagcccagcagaatgcatg

SEQ ID NO: 500137 - DNA, 25 bp, Mus musculus
gagttttagccctgcagaatgcatg

SEQ ID NO: 500138 - DNA, 25 bp, Mus musculus
gagttttagctcaggcgagtgccaa

SEQ ID NO: 500139 - DNA, 25 bp, Mus musculus
gagttttagctctggcgagtgccaa

SEQ ID NO: 500140 - DNA, 25 bp, Mus musculus
gagttttagttgagttgccagtgaa

SEQ ID NO: 500141 - DNA, 25 bp, Mus musculus
gagttttagttgtgttgccagtgaa

SEQ ID NO: 500142 - DNA, 25 bp, Mus musculus
gagttttagtttcgattcttgttag

SEQ ID NO: 500143 - DNA, 25 bp, Mus musculus
gagttttagtttggattcttgttag

SEQ ID NO: 500144 - DNA, 25 bp, Mus musculus
gagttttatagcaatccttcatttt

SEQ ID NO: 500145 - DNA, 25 bp, Mus musculus
gagttttatagctatccttcatttt

SEQ ID NO: 500146 - DNA, 25 bp, Mus musculus
gagttttatcacatgcaagatgcta

SEQ ID NO: 500147 - DNA, 25 bp, Mus musculus
gagttttatcacttgcaagatgcta

SEQ ID NO: 500148 - DNA, 25 bp, Mus musculus
gagttttatgggattttctgtgaca

SEQ ID NO: 500149 - DNA, 25 bp, Mus musculus
gagttttatgggtttttctgtgaca

SEQ ID NO: 500150 - DNA, 25 bp, Mus musculus
gagttttattcacccttgtccggca

SEQ ID NO: 500151 - DNA, 25 bp, Mus musculus
gagttttattcagccttgtccggca

SEQ ID NO: 500152 - DNA, 25 bp, Mus musculus
gagttttattctccatgcttgatca

SEQ ID NO: 500153 - DNA, 25 bp, Mus musculus
gagttttattctgcatgcttgatca

SEQ ID NO: 500154 - DNA, 25 bp, Mus musculus
gagttttcaaaaccacgctcagtta

SEQ ID NO: 500155 - DNA, 25 bp, Mus musculus
gagttttcaaaagcacgctcagtta

SEQ ID NO: 500156 - DNA, 25 bp, Mus musculus
gagttttcaactcgcctgtgcaagg

SEQ ID NO: 500157 - DNA, 25 bp, Mus musculus
gagttttcaactggcctgtgcaagg

SEQ ID NO: 500158 - DNA, 25 bp, Mus musculus
gagttttcaagaagccttgttgctt

SEQ ID NO: 500159 - DNA, 25 bp, Mus musculus
gagttttcaagatgccttgttgctt

SEQ ID NO: 500160 - DNA, 25 bp, Mus musculus
gagttttcaatcaggcatgtcttca

SEQ ID NO: 500161 - DNA, 25 bp, Mus musculus
gagttttcaatctggcatgtcttca

SEQ ID NO: 500162 - DNA, 25 bp, Mus musculus
gagttttcacacagcatctagtata

SEQ ID NO: 500163 - DNA, 25 bp, Mus musculus
gagttttcacactgcatctagtata

SEQ ID NO: 500164 - DNA, 25 bp, Mus musculus
gagttttcacagcagatggctacct

SEQ ID NO: 500165 - DNA, 25 bp, Mus musculus
gagttttcacaggagatggctacct

SEQ ID NO: 500166 - DNA, 25 bp, Mus musculus
gagttttcactaatgggtggtcttt

SEQ ID NO: 500167 - DNA, 25 bp, Mus musculus
gagttttcactattgggtggtcttt

SEQ ID NO: 500168 - DNA, 25 bp, Mus musculus
gagttttcagacaacagctttggtt

SEQ ID NO: 500169 - DNA, 25 bp, Mus musculus
gagttttcagacctcggacctggaa

SEQ ID NO: 500170 - DNA, 25 bp, Mus musculus
gagttttcagacctgtaagtgacat

SEQ ID NO: 500171 - DNA, 25 bp, Mus musculus
gagttttcagacgtcggacctggaa

SEQ ID NO: 500172 - DNA, 25 bp, Mus musculus
gagttttcagacgtgtaagtgacat

SEQ ID NO: 500173 - DNA, 25 bp, Mus musculus
gagttttcagactacagctttggtt

SEQ ID NO: 500174 - DNA, 25 bp, Mus musculus
gagttttcagagatttctggttctg

SEQ ID NO: 500175 - DNA, 25 bp, Mus musculus
gagttttcagagcaatggtcacagg

SEQ ID NO: 500176 - DNA, 25 bp, Mus musculus
gagttttcagaggaatggtcacagg

SEQ ID NO: 500177 - DNA, 25 bp, Mus musculus
gagttttcagagttttctggttctg

SEQ ID NO: 500178 - DNA, 25 bp, Mus musculus
gagttttcagatcggtcactttgtg

SEQ ID NO: 500179 - DNA, 25 bp, Mus musculus
gagttttcagatgggtcactttgtg

SEQ ID NO: 500180 - DNA, 25 bp, Mus musculus
gagttttcagctaaagccctgtatg

SEQ ID NO: 500181 - DNA, 25 bp, Mus musculus
gagttttcagcttaagccctgtatg

SEQ ID NO: 500182 - DNA, 25 bp, Mus musculus
gagttttcagtacgaagccctgcta

SEQ ID NO: 500183 - DNA, 25 bp, Mus musculus
gagttttcagtaggaagccctgcta

SEQ ID NO: 500184 - DNA, 25 bp, Mus musculus
gagttttcagttatgtcttgttttt

SEQ ID NO: 500185 - DNA, 25 bp, Mus musculus
gagttttcagttttgtcttgttttt

SEQ ID NO: 500186 - DNA, 25 bp, Mus musculus
gagttttcatatctcaaagtcccaa

SEQ ID NO: 500187 - DNA, 25 bp, Mus musculus
gagttttcatatgtcaaagtcccaa

SEQ ID NO: 500188 - DNA, 25 bp, Mus musculus
gagttttcatgcaatcaccgagatc

SEQ ID NO: 500189 - DNA, 25 bp, Mus musculus
gagttttcatgctatcaccgagatc

SEQ ID NO: 500190 - DNA, 25 bp, Mus musculus
gagttttcatggctccaagcaggga

SEQ ID NO: 500191 - DNA, 25 bp, Mus musculus
gagttttcatgggtccaagcaggga

SEQ ID NO: 500192 - DNA, 25 bp, Mus musculus
gagttttcattaatgctgcctttgg

SEQ ID NO: 500193 - DNA, 25 bp, Mus musculus
gagttttcattaatgtgcctctcct

SEQ ID NO: 500194 - DNA, 25 bp, Mus musculus
gagttttcattattgctgcctttgg

SEQ ID NO: 500195 - DNA, 25 bp, Mus musculus
gagttttcattattgtgcctctcct

SEQ ID NO: 500196 - DNA, 25 bp, Mus musculus
gagttttcattcctaggctattttc

SEQ ID NO: 500197 - DNA, 25 bp, Mus musculus
gagttttcattcgtaggctattttc

SEQ ID NO: 500198 - DNA, 25 bp, Mus musculus
gagttttccaacacagctgaagcac

SEQ ID NO: 500199 - DNA, 25 bp, Mus musculus
gagttttccaactcagctgaagcac

SEQ ID NO: 500200 - DNA, 25 bp, Mus musculus
gagttttccactcgagccaaaatat

SEQ ID NO: 500201 - DNA, 25 bp, Mus musculus
gagttttccactggagccaaaatat

SEQ ID NO: 500202 - DNA, 25 bp, Mus musculus
gagttttccagacaactgaagtagc

SEQ ID NO: 500203 - DNA, 25 bp, Mus musculus
gagttttccagagaactgaagtagc

SEQ ID NO: 500204 - DNA, 25 bp, Mus musculus
gagttttccattaacatgccaattg

SEQ ID NO: 500205 - DNA, 25 bp, Mus musculus
gagttttccatttacatgccaattg

SEQ ID NO: 500206 - DNA, 25 bp, Mus musculus
gagttttcccaacgatgttccttgc

SEQ ID NO: 500207 - DNA, 25 bp, Mus musculus
gagttttcccaaggatgttccttgc

SEQ ID NO: 500208 - DNA, 25 bp, Mus musculus
gagttttcctagctccaagttcaaa

SEQ ID NO: 500209 - DNA, 25 bp, Mus musculus
gagttttcctaggtccaagttcaaa

SEQ ID NO: 500210 - DNA, 25 bp, Mus musculus
gagttttcctccagacatacatatg

SEQ ID NO: 500211 - DNA, 25 bp, Mus musculus
gagttttcctcctgacatacatatg

SEQ ID NO: 500212 - DNA, 25 bp, Mus musculus
gagttttcctgtatcatggcggatc

SEQ ID NO: 500213 - DNA, 25 bp, Mus musculus
gagttttcctgtttcatggcggatc

SEQ ID NO: 500214 - DNA, 25 bp, Mus musculus
gagttttccttactcatctttaaat

SEQ ID NO: 500215 - DNA, 25 bp, Mus musculus
gagttttccttagtcatctttaaat

SEQ ID NO: 500216 - DNA, 25 bp, Mus musculus
gagttttcggttccccaatatcttg

SEQ ID NO: 500217 - DNA, 25 bp, Mus musculus
gagttttcggttgcccaatatcttg

SEQ ID NO: 500218 - DNA, 25 bp, Mus musculus
gagttttctaagaatgcgtgtgcct

SEQ ID NO: 500219 - DNA, 25 bp, Mus musculus
gagttttctaagtatgcgtgtgcct

SEQ ID NO: 500220 - DNA, 25 bp, Mus musculus
gagttttctaatatttggctgtcag

SEQ ID NO: 500221 - DNA, 25 bp, Mus musculus
gagttttctaatcttcttgttttag

SEQ ID NO: 500222 - DNA, 25 bp, Mus musculus
gagttttctaatgttcttgttttag

SEQ ID NO: 500223 - DNA, 25 bp, Mus musculus
gagttttctaatttttggctgtcag

SEQ ID NO: 500224 - DNA, 25 bp, Mus musculus
gagttttctactatatgcacctggg

SEQ ID NO: 500225 - DNA, 25 bp, Mus musculus
gagttttctactttatgcacctggg

SEQ ID NO: 500226 - DNA, 25 bp, Mus musculus
gagttttctcagctctttcttatga

SEQ ID NO: 500227 - DNA, 25 bp, Mus musculus
gagttttctcaggtctttcttatga

SEQ ID NO: 500228 - DNA, 25 bp, Mus musculus
gagttttctcatcaccatgtatggt

SEQ ID NO: 500229 - DNA, 25 bp, Mus musculus
gagttttctcatgaccatgtatggt

SEQ ID NO: 500230 - DNA, 25 bp, Mus musculus
gagttttctccacgcagtgttttat

SEQ ID NO: 500231 - DNA, 25 bp, Mus musculus
gagttttctccaggcagtgttttat

SEQ ID NO: 500232 - DNA, 25 bp, Mus musculus
gagttttctcctaccaaagcatgga

SEQ ID NO: 500233 - DNA, 25 bp, Mus musculus
gagttttctccttccaaagcatgga

SEQ ID NO: 500234 - DNA, 25 bp, Mus musculus
gagttttctctgctccatgattaga

SEQ ID NO: 500235 - DNA, 25 bp, Mus musculus
gagttttctctggtccatgattaga

SEQ ID NO: 500236 - DNA, 25 bp, Mus musculus
gagttttcttaacgaggctggctga

SEQ ID NO: 500237 - DNA, 25 bp, Mus musculus
gagttttcttaaggaggctggctga

SEQ ID NO: 500238 - DNA, 25 bp, Mus musculus
gagttttcttccaccccttcaattg

SEQ ID NO: 500239 - DNA, 25 bp, Mus musculus
gagttttcttcctccccttcaattg

SEQ ID NO: 500240 - DNA, 25 bp, Mus musculus
gagttttcttctaaaagcacttgat

SEQ ID NO: 500241 - DNA, 25 bp, Mus musculus
gagttttcttcttaaagcacttgat

SEQ ID NO: 500242 - DNA, 25 bp, Mus musculus
gagttttcttggaacgggatagtca

SEQ ID NO: 500243 - DNA, 25 bp, Mus musculus
gagttttcttggtacgggatagtca

SEQ ID NO: 500244 - DNA, 25 bp, Mus musculus
gagttttcttgtaggtcctgtggac

SEQ ID NO: 500245 - DNA, 25 bp, Mus musculus
gagttttcttgttggtcctgtggac

SEQ ID NO: 500246 - DNA, 25 bp, Mus musculus
gagttttcttttagcctagtcactg

SEQ ID NO: 500247 - DNA, 25 bp, Mus musculus
gagttttcttttcaaggccctctat

SEQ ID NO: 500248 - DNA, 25 bp, Mus musculus
gagttttcttttgaaggccctctat

SEQ ID NO: 500249 - DNA, 25 bp, Mus musculus
gagttttctttttgcctagtcactg

SEQ ID NO: 500250 - DNA, 25 bp, Mus musculus
gagttttgaattacagccctccgct

SEQ ID NO: 500251 - DNA, 25 bp, Mus musculus
gagttttgaatttcagccctccgct

SEQ ID NO: 500252 - DNA, 25 bp, Mus musculus
gagttttgagccaatcagtggttaa

SEQ ID NO: 500253 - DNA, 25 bp, Mus musculus
gagttttgagcctatcagtggttaa

SEQ ID NO: 500254 - DNA, 25 bp, Mus musculus
gagttttgaggcaagtcacagccca

SEQ ID NO: 500255 - DNA, 25 bp, Mus musculus
gagttttgaggctagtcacagccca

SEQ ID NO: 500256 - DNA, 25 bp, Mus musculus
gagttttgagtaaaacacagcccct

SEQ ID NO: 500257 - DNA, 25 bp, Mus musculus
gagttttgagtataacacagcccct

SEQ ID NO: 500258 - DNA, 25 bp, Mus musculus
gagttttgatccctagctaccggag

SEQ ID NO: 500259 - DNA, 25 bp, Mus musculus
gagttttgatccgtagctaccggag

SEQ ID NO: 500260 - DNA, 25 bp, Mus musculus
gagttttgcaccaggtcacaggcgt

SEQ ID NO: 500261 - DNA, 25 bp, Mus musculus
gagttttgcacccttccataaagtg

SEQ ID NO: 500262 - DNA, 25 bp, Mus musculus
gagttttgcaccgttccataaagtg

SEQ ID NO: 500263 - DNA, 25 bp, Mus musculus
gagttttgcacctggtcacaggcgt

SEQ ID NO: 500264 - DNA, 25 bp, Mus musculus
gagttttgcattatcttttctttag

SEQ ID NO: 500265 - DNA, 25 bp, Mus musculus
gagttttgcattattatgtcacatg

SEQ ID NO: 500266 - DNA, 25 bp, Mus musculus
gagttttgcattttcttttctttag

SEQ ID NO: 500267 - DNA, 25 bp, Mus musculus
gagttttgcatttttatgtcacatg

SEQ ID NO: 500268 - DNA, 25 bp, Mus musculus
gagttttgcctacaaaggagatcct

SEQ ID NO: 500269 - DNA, 25 bp, Mus musculus
gagttttgcctagaaaggagatcct

SEQ ID NO: 500270 - DNA, 25 bp, Mus musculus
gagttttgctatctatctcaggtta

SEQ ID NO: 500271 - DNA, 25 bp, Mus musculus
gagttttgctatgtatctcaggtta

SEQ ID NO: 500272 - DNA, 25 bp, Mus musculus
gagttttgctctaggcactgatgta

SEQ ID NO: 500273 - DNA, 25 bp, Mus musculus
gagttttgctcttggcactgatgta

SEQ ID NO: 500274 - DNA, 25 bp, Mus musculus
gagttttggataagctaggcaaaca

SEQ ID NO: 500275 - DNA, 25 bp, Mus musculus
gagttttggatatgctaggcaaaca

SEQ ID NO: 500276 - DNA, 25 bp, Mus musculus
gagttttggcttacattcaggatca

SEQ ID NO: 500277 - DNA, 25 bp, Mus musculus
gagttttggctttcattcaggatca

SEQ ID NO: 500278 - DNA, 25 bp, Mus musculus
gagttttgggctatgttatccaaca

SEQ ID NO: 500279 - DNA, 25 bp, Mus musculus
gagttttgggctttgttatccaaca

SEQ ID NO: 500280 - DNA, 25 bp, Mus musculus
gagttttgggttagactgggctaca

SEQ ID NO: 500281 - DNA, 25 bp, Mus musculus
gagttttgggtttgactgggctaca

SEQ ID NO: 500282 - DNA, 25 bp, Mus musculus
gagttttgtaatatatacgaggact

SEQ ID NO: 500283 - DNA, 25 bp, Mus musculus
gagttttgtaatttatacgaggact

SEQ ID NO: 500284 - DNA, 25 bp, Mus musculus
gagttttgtcagatgtttgaactaa

SEQ ID NO: 500285 - DNA, 25 bp, Mus musculus
gagttttgtcagttgtttgaactaa

SEQ ID NO: 500286 - DNA, 25 bp, Mus musculus
gagttttgtctacctcctgaagtag

SEQ ID NO: 500287 - DNA, 25 bp, Mus musculus
gagttttgtctagctcctgaagtag

SEQ ID NO: 500288 - DNA, 25 bp, Mus musculus
gagttttgtgaaccacatcctggtt

SEQ ID NO: 500289 - DNA, 25 bp, Mus musculus
gagttttgtgaagcacatcctggtt

SEQ ID NO: 500290 - DNA, 25 bp, Mus musculus
gagttttgtgtcatacctagtctag

SEQ ID NO: 500291 - DNA, 25 bp, Mus musculus
gagttttgtgtcttacctagtctag

SEQ ID NO: 500292 - DNA, 25 bp, Mus musculus
gagttttgttatctatcccacggaa

SEQ ID NO: 500293 - DNA, 25 bp, Mus musculus
gagttttgttatgtatcccacggaa

SEQ ID NO: 500294 - DNA, 25 bp, Mus musculus
gagtttttaatgacaagagcccaca

SEQ ID NO: 500295 - DNA, 25 bp, Mus musculus
gagtttttaatgtcaagagcccaca

SEQ ID NO: 500296 - DNA, 25 bp, Mus musculus
gagtttttactgaccttcacccata

SEQ ID NO: 500297 - DNA, 25 bp, Mus musculus
gagtttttactgtccttcacccata

SEQ ID NO: 500298 - DNA, 25 bp, Mus musculus
gagtttttagatatgctgctgctgt

SEQ ID NO: 500299 - DNA, 25 bp, Mus musculus
gagtttttagatttgctgctgctgt

SEQ ID NO: 500300 - DNA, 25 bp, Mus musculus
gagtttttatatctaacccagacta

SEQ ID NO: 500301 - DNA, 25 bp, Mus musculus
gagtttttatatgtaacccagacta

SEQ ID NO: 500302 - DNA, 25 bp, Mus musculus
gagtttttatctaagttccatatga

SEQ ID NO: 500303 - DNA, 25 bp, Mus musculus
gagtttttatcttagttccatatga

SEQ ID NO: 500304 - DNA, 25 bp, Mus musculus
gagtttttatgcaatagttgctggt

SEQ ID NO: 500305 - DNA, 25 bp, Mus musculus
gagtttttatgctatagttgctggt

SEQ ID NO: 500306 - DNA, 25 bp, Mus musculus
gagtttttatttaggttgaggattg

SEQ ID NO: 500307 - DNA, 25 bp, Mus musculus
gagtttttatttccacgtgattaca

SEQ ID NO: 500308 - DNA, 25 bp, Mus musculus
gagtttttatttgcacgtgattaca

SEQ ID NO: 500309 - DNA, 25 bp, Mus musculus
gagtttttattttggttgaggattg

SEQ ID NO: 500310 - DNA, 25 bp, Mus musculus
gagtttttcaatcccatcatcgcgg

SEQ ID NO: 500311 - DNA, 25 bp, Mus musculus
gagtttttcaatgccatcatcgcgg

SEQ ID NO: 500312 - DNA, 25 bp, Mus musculus
gagtttttcacgatgacttcagagg

SEQ ID NO: 500313 - DNA, 25 bp, Mus musculus
gagtttttcacgttgacttcagagg

SEQ ID NO: 500314 - DNA, 25 bp, Mus musculus
gagtttttcaggatgtcagagtaga

SEQ ID NO: 500315 - DNA, 25 bp, Mus musculus
gagtttttcaggttgtcagagtaga

SEQ ID NO: 500316 - DNA, 25 bp, Mus musculus
gagtttttccaaaatgctctaaagt

SEQ ID NO: 500317 - DNA, 25 bp, Mus musculus
gagtttttccaatatgctctaaagt

SEQ ID NO: 500318 - DNA, 25 bp, Mus musculus
gagtttttcggacaagcttcttcct

SEQ ID NO: 500319 - DNA, 25 bp, Mus musculus
gagtttttcggagaagcttcttcct

SEQ ID NO: 500320 - DNA, 25 bp, Mus musculus
gagtttttctaaacattgtagagca

SEQ ID NO: 500321 - DNA, 25 bp, Mus musculus
gagtttttctaatcattgtagagca

SEQ ID NO: 500322 - DNA, 25 bp, Mus musculus
gagtttttctttatatcaaatgaca

SEQ ID NO: 500323 - DNA, 25 bp, Mus musculus
gagtttttctttttatcaaatgaca

SEQ ID NO: 500324 - DNA, 25 bp, Mus musculus
gagtttttgatcattgggacctata

SEQ ID NO: 500325 - DNA, 25 bp, Mus musculus
gagtttttgatctttgggacctata

SEQ ID NO: 500326 - DNA, 25 bp, Mus musculus
gagtttttggaccatctggagccca

SEQ ID NO: 500327 - DNA, 25 bp, Mus musculus
gagtttttggacgatctggagccca

SEQ ID NO: 500328 - DNA, 25 bp, Mus musculus
gagtttttggagacgatcctccact

SEQ ID NO: 500329 - DNA, 25 bp, Mus musculus
gagtttttggagtcgatcctccact

SEQ ID NO: 500330 - DNA, 25 bp, Mus musculus
gagtttttgggtacatctggacata

SEQ ID NO: 500331 - DNA, 25 bp, Mus musculus
gagtttttgggttcatctggacata

SEQ ID NO: 500332 - DNA, 25 bp, Mus musculus
gagtttttgtacacaggctgctttt

SEQ ID NO: 500333 - DNA, 25 bp, Mus musculus
gagtttttgtactcaggctgctttt

SEQ ID NO: 500334 - DNA, 25 bp, Mus musculus
gagttttttcgaaaaagcattcagc

SEQ ID NO: 500335 - DNA, 25 bp, Mus musculus
gagttttttcgataaagcattcagc

SEQ ID NO: 500336 - DNA, 25 bp, Mus musculus
gagttttttgagatgttgccttcca

SEQ ID NO: 500337 - DNA, 25 bp, Mus musculus
gagttttttgagttgttgccttcca

SEQ ID NO: 500338 - DNA, 25 bp, Mus musculus
gagttttttggtagctcagaaacta

SEQ ID NO: 500339 - DNA, 25 bp, Mus musculus
gagttttttggttgctcagaaacta

SEQ ID NO: 500340 - DNA, 25 bp, Mus musculus
gagttttttgttaggtgtgtcttag

SEQ ID NO: 500341 - DNA, 25 bp, Mus musculus
gagttttttgtttggtgtgtcttag

SEQ ID NO: 500342 - DNA, 25 bp, Mus musculus
gataaaaaagccacaatgatgattt

SEQ ID NO: 500343 - DNA, 25 bp, Mus musculus
gataaaaaagcctcaatgatgattt

SEQ ID NO: 500344 - DNA, 25 bp, Mus musculus
gataaaaagcccagcaagaacttct

SEQ ID NO: 500345 - DNA, 25 bp, Mus musculus
gataaaaagccctgcaagaacttct

SEQ ID NO: 500346 - DNA, 25 bp, Mus musculus
gataaaaatgacaaccttcctccct

SEQ ID NO: 500347 - DNA, 25 bp, Mus musculus
gataaaaatgactaccttcctccct

SEQ ID NO: 500348 - DNA, 25 bp, Mus musculus
gataaaacaggcatttcaagagaaa

SEQ ID NO: 500349 - DNA, 25 bp, Mus musculus
gataaaacaggcttttcaagagaaa

SEQ ID NO: 500350 - DNA, 25 bp, Mus musculus
gataaaacccacaggtccaggctct

SEQ ID NO: 500351 - DNA, 25 bp, Mus musculus
gataaaacccactggtccaggctct

SEQ ID NO: 500352 - DNA, 25 bp, Mus musculus
gataaaaccctcaaagtccactact

SEQ ID NO: 500353 - DNA, 25 bp, Mus musculus
gataaaaccctctaagtccactact

SEQ ID NO: 500354 - DNA, 25 bp, Mus musculus
gataaaacgtgcatgggaagtccca

SEQ ID NO: 500355 - DNA, 25 bp, Mus musculus
gataaaacgtgcttgggaagtccca

SEQ ID NO: 500356 - DNA, 25 bp, Mus musculus
gataaaactcctcgacacactgccg

SEQ ID NO: 500357 - DNA, 25 bp, Mus musculus
gataaaactcctggacacactgccg

SEQ ID NO: 500358 - DNA, 25 bp, Mus musculus
gataaaactctcatatcctgctact

SEQ ID NO: 500359 - DNA, 25 bp, Mus musculus
gataaaactctcttatcctgctact

SEQ ID NO: 500360 - DNA, 25 bp, Mus musculus
gataaaagaaccaccacaacccgcg

SEQ ID NO: 500361 - DNA, 25 bp, Mus musculus
gataaaagaacctccacaacccgcg

SEQ ID NO: 500362 - DNA, 25 bp, Mus musculus
gataaaagacacagacctcttgaca

SEQ ID NO: 500363 - DNA, 25 bp, Mus musculus
gataaaagacactgacctcttgaca

SEQ ID NO: 500364 - DNA, 25 bp, Mus musculus
gataaaagatcgcttcatggccccg

SEQ ID NO: 500365 - DNA, 25 bp, Mus musculus
gataaaagatcggttcatggccccg

SEQ ID NO: 500366 - DNA, 25 bp, Mus musculus
gataaaagccaaccagcactgctgg

SEQ ID NO: 500367 - DNA, 25 bp, Mus musculus
gataaaagccaagcagcactgctgg

SEQ ID NO: 500368 - DNA, 25 bp, Mus musculus
gataaaagccaccagttccagtcag

SEQ ID NO: 500369 - DNA, 25 bp, Mus musculus
gataaaagccacgagttccagtcag

SEQ ID NO: 500370 - DNA, 25 bp, Mus musculus
gataaaagtctgacttggcactaca

SEQ ID NO: 500371 - DNA, 25 bp, Mus musculus
gataaaagtctgtcttggcactaca

SEQ ID NO: 500372 - DNA, 25 bp, Mus musculus
gataaaagttatccagaattcagct

SEQ ID NO: 500373 - DNA, 25 bp, Mus musculus
gataaaagttatgcagaattcagct

SEQ ID NO: 500374 - DNA, 25 bp, Mus musculus
gataaaagtttccattgctcacaat

SEQ ID NO: 500375 - DNA, 25 bp, Mus musculus
gataaaagtttcgattgctcacaat

SEQ ID NO: 500376 - DNA, 25 bp, Mus musculus
gataaaatacatcggctcttaggat

SEQ ID NO: 500377 - DNA, 25 bp, Mus musculus
gataaaatacatgggctcttaggat

SEQ ID NO: 500378 - DNA, 25 bp, Mus musculus
gataaaatgagtccatcctgtcccg

SEQ ID NO: 500379 - DNA, 25 bp, Mus musculus
gataaaatgagtgcatcctgtcccg

SEQ ID NO: 500380 - DNA, 25 bp, Mus musculus
gataaaatgctcatcttccatgcga

SEQ ID NO: 500381 - DNA, 25 bp, Mus musculus
gataaaatgctcttcttccatgcga

SEQ ID NO: 500382 - DNA, 25 bp, Mus musculus
gataaaatgctgatctttgctgaat

SEQ ID NO: 500383 - DNA, 25 bp, Mus musculus
gataaaatgctgttctttgctgaat

SEQ ID NO: 500384 - DNA, 25 bp, Mus musculus
gataaaattatactccaccatgtgt

SEQ ID NO: 500385 - DNA, 25 bp, Mus musculus
gataaaattatagtccaccatgtgt

SEQ ID NO: 500386 - DNA, 25 bp, Mus musculus
gataaaattctaagccctcaactgc

SEQ ID NO: 500387 - DNA, 25 bp, Mus musculus
gataaaattctatgccctcaactgc

SEQ ID NO: 500388 - DNA, 25 bp, Mus musculus
gataaaattctcaaactgggtatag

SEQ ID NO: 500389 - DNA, 25 bp, Mus musculus
gataaaattctctaactgggtatag

SEQ ID NO: 500390 - DNA, 25 bp, Mus musculus
gataaaatttaaaccacagtaatgt

SEQ ID NO: 500391 - DNA, 25 bp, Mus musculus
gataaaatttaatccacagtaatgt

SEQ ID NO: 500392 - DNA, 25 bp, Mus musculus
gataaacaactcctaacgctgctat

SEQ ID NO: 500393 - DNA, 25 bp, Mus musculus
gataaacaactcgtaacgctgctat

SEQ ID NO: 500394 - DNA, 25 bp, Mus musculus
gataaacaacttccctcagattggg

SEQ ID NO: 500395 - DNA, 25 bp, Mus musculus
gataaacaacttgcctcagattggg

SEQ ID NO: 500396 - DNA, 25 bp, Mus musculus
gataaacaccatcaccgaaaggtaa

SEQ ID NO: 500397 - DNA, 25 bp, Mus musculus
gataaacaccatgaccgaaaggtaa

SEQ ID NO: 500398 - DNA, 25 bp, Mus musculus
gataaacaccggcaacgtcactgaa

SEQ ID NO: 500399 - DNA, 25 bp, Mus musculus
gataaacaccgggaacgtcactgaa

SEQ ID NO: 500400 - DNA, 25 bp, Mus musculus
gataaacagagtcaaaacttccatg

SEQ ID NO: 500401 - DNA, 25 bp, Mus musculus
gataaacagagtgaaaacttccatg

SEQ ID NO: 500402 - DNA, 25 bp, Mus musculus
gataaacaggctaaggcttaaccct

SEQ ID NO: 500403 - DNA, 25 bp, Mus musculus
gataaacaggcttaggcttaaccct

SEQ ID NO: 500404 - DNA, 25 bp, Mus musculus
gataaacagttccttggtattacaa

SEQ ID NO: 500405 - DNA, 25 bp, Mus musculus
gataaacagttcgttggtattacaa

SEQ ID NO: 500406 - DNA, 25 bp, Mus musculus
gataaacatagaaggttcaccatca

SEQ ID NO: 500407 - DNA, 25 bp, Mus musculus
gataaacatagatggttcaccatca

SEQ ID NO: 500408 - DNA, 25 bp, Mus musculus
gataaacatcatattacccctcttc

SEQ ID NO: 500409 - DNA, 25 bp, Mus musculus
gataaacatcatcaagctcacggag

SEQ ID NO: 500410 - DNA, 25 bp, Mus musculus
gataaacatcatgaagctcacggag

SEQ ID NO: 500411 - DNA, 25 bp, Mus musculus
gataaacatcattttacccctcttc

SEQ ID NO: 500412 - DNA, 25 bp, Mus musculus
gataaacatcccctaaaagaaacag

SEQ ID NO: 500413 - DNA, 25 bp, Mus musculus
gataaacatcccgtaaaagaaacag

SEQ ID NO: 500414 - DNA, 25 bp, Mus musculus
gataaacatgtactagcctggccct

SEQ ID NO: 500415 - DNA, 25 bp, Mus musculus
gataaacatgtagtagcctggccct

SEQ ID NO: 500416 - DNA, 25 bp, Mus musculus
gataaaccacagaatacttttgttt

SEQ ID NO: 500417 - DNA, 25 bp, Mus musculus
gataaaccacagtatacttttgttt

SEQ ID NO: 500418 - DNA, 25 bp, Mus musculus
gataaacccagcaagtggtggactt

SEQ ID NO: 500419 - DNA, 25 bp, Mus musculus
gataaacccagctagtggtggactt

SEQ ID NO: 500420 - DNA, 25 bp, Mus musculus
gataaacccgtcaccatgtctgaga

SEQ ID NO: 500421 - DNA, 25 bp, Mus musculus
gataaacccgtctccatgtctgaga

SEQ ID NO: 500422 - DNA, 25 bp, Mus musculus
gataaacctcaacacctatcctgta

SEQ ID NO: 500423 - DNA, 25 bp, Mus musculus
gataaacctcaagacctatcctgta

SEQ ID NO: 500424 - DNA, 25 bp, Mus musculus
gataaacctggtcttctactttcta

SEQ ID NO: 500425 - DNA, 25 bp, Mus musculus
gataaacctggtgttctactttcta

SEQ ID NO: 500426 - DNA, 25 bp, Mus musculus
gataaaccttgacatgcgcgctctt

SEQ ID NO: 500427 - DNA, 25 bp, Mus musculus
gataaaccttgagatgcgcgctctt

SEQ ID NO: 500428 - DNA, 25 bp, Mus musculus
gataaactactaactgcttcactga

SEQ ID NO: 500429 - DNA, 25 bp, Mus musculus
gataaactactatctgcttcactga

SEQ ID NO: 500430 - DNA, 25 bp, Mus musculus
gataaactacttatctggatctgta

SEQ ID NO: 500431 - DNA, 25 bp, Mus musculus
gataaactacttttctggatctgta

SEQ ID NO: 500432 - DNA, 25 bp, Mus musculus
gataaactatacaactctaggatcc

SEQ ID NO: 500433 - DNA, 25 bp, Mus musculus
gataaactatacacactattcctaa

SEQ ID NO: 500434 - DNA, 25 bp, Mus musculus
gataaactatactactctaggatcc

SEQ ID NO: 500435 - DNA, 25 bp, Mus musculus
gataaactatactcactattcctaa

SEQ ID NO: 500436 - DNA, 25 bp, Mus musculus
gataaactcaatagctccacacaag

SEQ ID NO: 500437 - DNA, 25 bp, Mus musculus
gataaactcaattgctccacacaag

SEQ ID NO: 500438 - DNA, 25 bp, Mus musculus
gataaactcatcacccaacgttaat

SEQ ID NO: 500439 - DNA, 25 bp, Mus musculus
gataaactcatctcccaacgttaat

SEQ ID NO: 500440 - DNA, 25 bp, Mus musculus
gataaactgaagaccgtgctccaca

SEQ ID NO: 500441 - DNA, 25 bp, Mus musculus
gataaactgaagtccgtgctccaca

SEQ ID NO: 500442 - DNA, 25 bp, Mus musculus
gataaactgatcattccgggtagag

SEQ ID NO: 500443 - DNA, 25 bp, Mus musculus
gataaactgatctttccgggtagag

SEQ ID NO: 500444 - DNA, 25 bp, Mus musculus
gataaactgcttaaacttggacatt

SEQ ID NO: 500445 - DNA, 25 bp, Mus musculus
gataaactgctttaacttggacatt

SEQ ID NO: 500446 - DNA, 25 bp, Mus musculus
gataaactggacagtcctctacaga

SEQ ID NO: 500447 - DNA, 25 bp, Mus musculus
gataaactggactgtcctctacaga

SEQ ID NO: 500448 - DNA, 25 bp, Mus musculus
gataaactggtgcttctgcgcactt

SEQ ID NO: 500449 - DNA, 25 bp, Mus musculus
gataaactggtggttctgcgcactt

SEQ ID NO: 500450 - DNA, 25 bp, Mus musculus
gataaacttcacaagttgcctcttg

SEQ ID NO: 500451 - DNA, 25 bp, Mus musculus
gataaacttcactagttgcctcttg

SEQ ID NO: 500452 - DNA, 25 bp, Mus musculus
gataaacttcttactctgcagcgag

SEQ ID NO: 500453 - DNA, 25 bp, Mus musculus
gataaacttctttctctgcagcgag

SEQ ID NO: 500454 - DNA, 25 bp, Mus musculus
gataaacttgaacagcacccttact

SEQ ID NO: 500455 - DNA, 25 bp, Mus musculus
gataaacttgaacctcagggtttat

SEQ ID NO: 500456 - DNA, 25 bp, Mus musculus
gataaacttgaagagcacccttact

SEQ ID NO: 500457 - DNA, 25 bp, Mus musculus
gataaacttgaagctcagggtttat

SEQ ID NO: 500458 - DNA, 25 bp, Mus musculus
gataaacttgctcgtggaacgctaa

SEQ ID NO: 500459 - DNA, 25 bp, Mus musculus
gataaacttgctggtggaacgctaa

SEQ ID NO: 500460 - DNA, 25 bp, Mus musculus
gataaagaatcgctccacctactgg

SEQ ID NO: 500461 - DNA, 25 bp, Mus musculus
gataaagaatcggtccacctactgg

SEQ ID NO: 500462 - DNA, 25 bp, Mus musculus
gataaagacacgattttcctgaaat

SEQ ID NO: 500463 - DNA, 25 bp, Mus musculus
gataaagacacgtttttcctgaaat

SEQ ID NO: 500464 - DNA, 25 bp, Mus musculus
gataaagaccaccatgcacagggag

SEQ ID NO: 500465 - DNA, 25 bp, Mus musculus
gataaagaccacgatgcacagggag

SEQ ID NO: 500466 - DNA, 25 bp, Mus musculus
gataaagacttaccttccccaggct

SEQ ID NO: 500467 - DNA, 25 bp, Mus musculus
gataaagacttagcttccccaggct

SEQ ID NO: 500468 - DNA, 25 bp, Mus musculus
gataaagagtagattatttctcctt

SEQ ID NO: 500469 - DNA, 25 bp, Mus musculus
gataaagagtagtttatttctcctt

SEQ ID NO: 500470 - DNA, 25 bp, Mus musculus
gataaagatttcacccattctgtgg

SEQ ID NO: 500471 - DNA, 25 bp, Mus musculus
gataaagatttctcccattctgtgg

SEQ ID NO: 500472 - DNA, 25 bp, Mus musculus
gataaagcctttactcaaaaatgta

SEQ ID NO: 500473 - DNA, 25 bp, Mus musculus
gataaagccttttctcaaaaatgta

SEQ ID NO: 500474 - DNA, 25 bp, Mus musculus
gataaagcgatcatggagctcagaa

SEQ ID NO: 500475 - DNA, 25 bp, Mus musculus
gataaagcgatcttggagctcagaa

SEQ ID NO: 500476 - DNA, 25 bp, Mus musculus
gataaagcgccaagcatgaacgcag

SEQ ID NO: 500477 - DNA, 25 bp, Mus musculus
gataaagcgccatgcatgaacgcag

SEQ ID NO: 500478 - DNA, 25 bp, Mus musculus
gataaagctacaccctcgggatctc

SEQ ID NO: 500479 - DNA, 25 bp, Mus musculus
gataaagctacagcctcgggatctc

SEQ ID NO: 500480 - DNA, 25 bp, Mus musculus
gataaagctagacgcccaagaagcc

SEQ ID NO: 500481 - DNA, 25 bp, Mus musculus
gataaagctagaggcccaagaagcc

SEQ ID NO: 500482 - DNA, 25 bp, Mus musculus
gataaagctgtaattctgtcacatt

SEQ ID NO: 500483 - DNA, 25 bp, Mus musculus
gataaagctgtatttctgtcacatt

SEQ ID NO: 500484 - DNA, 25 bp, Mus musculus
gataaaggatatattgactgattct

SEQ ID NO: 500485 - DNA, 25 bp, Mus musculus
gataaaggatattttgactgattct

SEQ ID NO: 500486 - DNA, 25 bp, Mus musculus
gataaaggcattcttctgaagtctg

SEQ ID NO: 500487 - DNA, 25 bp, Mus musculus
gataaaggcattgttctgaagtctg

SEQ ID NO: 500488 - DNA, 25 bp, Mus musculus
gataaaggccctccgagatcgagtg

SEQ ID NO: 500489 - DNA, 25 bp, Mus musculus
gataaaggccctgcgagatcgagtg

SEQ ID NO: 500490 - DNA, 25 bp, Mus musculus
gataaaggcgtccacctctatgtcc

SEQ ID NO: 500491 - DNA, 25 bp, Mus musculus
gataaaggcgtcgacctctatgtcc

SEQ ID NO: 500492 - DNA, 25 bp, Mus musculus
gataaaggtacccttgctctctgtg

SEQ ID NO: 500493 - DNA, 25 bp, Mus musculus
gataaaggtaccgttgctctctgtg

SEQ ID NO: 500494 - DNA, 25 bp, Mus musculus
gataaaggtgctacggtaccagccg

SEQ ID NO: 500495 - DNA, 25 bp, Mus musculus
gataaaggtgcttcggtaccagccg

SEQ ID NO: 500496 - DNA, 25 bp, Mus musculus
gataaaggttgcctttctgaatatt

SEQ ID NO: 500497 - DNA, 25 bp, Mus musculus
gataaaggttgcgtttctgaatatt

SEQ ID NO: 500498 - DNA, 25 bp, Mus musculus
gataaagtatctctgtcctttaatt

SEQ ID NO: 500499 - DNA, 25 bp, Mus musculus
gataaagtatctgtgtcctttaatt

SEQ ID NO: 500500 - DNA, 25 bp, Mus musculus
gataaagtcatgctagaagtactag

SEQ ID NO: 500501 - DNA, 25 bp, Mus musculus
gataaagtcatggtagaagtactag

SEQ ID NO: 500502 - DNA, 25 bp, Mus musculus
gataaagtcgggacatcagatgcct

SEQ ID NO: 500503 - DNA, 25 bp, Mus musculus
gataaagtcgggtcatcagatgcct

SEQ ID NO: 500504 - DNA, 25 bp, Mus musculus
gataaagtctagaccagttctcatt

SEQ ID NO: 500505 - DNA, 25 bp, Mus musculus
gataaagtctagtccagttctcatt

SEQ ID NO: 500506 - DNA, 25 bp, Mus musculus
gataaagtctttaccaccaatgggc

SEQ ID NO: 500507 - DNA, 25 bp, Mus musculus
gataaagtcttttccaccaatgggc

SEQ ID NO: 500508 - DNA, 25 bp, Mus musculus
gataaagtgactacctgaacaggat

SEQ ID NO: 500509 - DNA, 25 bp, Mus musculus
gataaagtgacttcctgaacaggat

SEQ ID NO: 500510 - DNA, 25 bp, Mus musculus
gataaagtggttacctccgatgtat

SEQ ID NO: 500511 - DNA, 25 bp, Mus musculus
gataaagtggtttcctccgatgtat

SEQ ID NO: 500512 - DNA, 25 bp, Mus musculus
gataaagtgtgtattcaggctcaat

SEQ ID NO: 500513 - DNA, 25 bp, Mus musculus
gataaagtgtgttttcaggctcaat

SEQ ID NO: 500514 - DNA, 25 bp, Mus musculus
gataaagttccaagagggtgttcaa

SEQ ID NO: 500515 - DNA, 25 bp, Mus musculus
gataaagttccatgagggtgttcaa

SEQ ID NO: 500516 - DNA, 25 bp, Mus musculus
gataaagttgatatattcctgggat

SEQ ID NO: 500517 - DNA, 25 bp, Mus musculus
gataaagttgatttattcctgggat

SEQ ID NO: 500518 - DNA, 25 bp, Mus musculus
gataaatacacacccctggtggacc

SEQ ID NO: 500519 - DNA, 25 bp, Mus musculus
gataaatacacactcccgtcgatga

SEQ ID NO: 500520 - DNA, 25 bp, Mus musculus
gataaatacacagccctggtggacc

SEQ ID NO: 500521 - DNA, 25 bp, Mus musculus
gataaatacacagtcccgtcgatga

SEQ ID NO: 500522 - DNA, 25 bp, Mus musculus
gataaatacccacacgagagcgagc

SEQ ID NO: 500523 - DNA, 25 bp, Mus musculus
gataaatacccagacgagagcgagc

SEQ ID NO: 500524 - DNA, 25 bp, Mus musculus
gataaatagcttactgttctgtata

SEQ ID NO: 500525 - DNA, 25 bp, Mus musculus
gataaatagctttctgttctgtata

SEQ ID NO: 500526 - DNA, 25 bp, Mus musculus
gataaataggcacggcttgtaccag

SEQ ID NO: 500527 - DNA, 25 bp, Mus musculus
gataaataggcagggcttgtaccag

SEQ ID NO: 500528 - DNA, 25 bp, Mus musculus
gataaatcatatatcctaactcaga

SEQ ID NO: 500529 - DNA, 25 bp, Mus musculus
gataaatcatatttcctaactcaga

SEQ ID NO: 500530 - DNA, 25 bp, Mus musculus
gataaatccatcattcaccccaaaa

SEQ ID NO: 500531 - DNA, 25 bp, Mus musculus
gataaatccatctttcaccccaaaa

SEQ ID NO: 500532 - DNA, 25 bp, Mus musculus
gataaatcccagctgtccattgcta

SEQ ID NO: 500533 - DNA, 25 bp, Mus musculus
gataaatcccaggtgtccattgcta

SEQ ID NO: 500534 - DNA, 25 bp, Mus musculus
gataaatcctgaagacattgtcccc

SEQ ID NO: 500535 - DNA, 25 bp, Mus musculus
gataaatcctgatgacattgtcccc

SEQ ID NO: 500536 - DNA, 25 bp, Mus musculus
gataaatcgcctaatgtcactgtgg

SEQ ID NO: 500537 - DNA, 25 bp, Mus musculus
gataaatcgccttatgtcactgtgg

SEQ ID NO: 500538 - DNA, 25 bp, Mus musculus
gataaatctactactttgcatatgg

SEQ ID NO: 500539 - DNA, 25 bp, Mus musculus
gataaatctacttctttgcatatgg

SEQ ID NO: 500540 - DNA, 25 bp, Mus musculus
gataaatctatgacctcgttctttt

SEQ ID NO: 500541 - DNA, 25 bp, Mus musculus
gataaatctatgtcctcgttctttt

SEQ ID NO: 500542 - DNA, 25 bp, Mus musculus
gataaatctctactcgaagtcccgt

SEQ ID NO: 500543 - DNA, 25 bp, Mus musculus
gataaatctctagtcgaagtcccgt

SEQ ID NO: 500544 - DNA, 25 bp, Mus musculus
gataaatctggacaaaacgtaagtt

SEQ ID NO: 500545 - DNA, 25 bp, Mus musculus
gataaatctggagaaaacgtaagtt

SEQ ID NO: 500546 - DNA, 25 bp, Mus musculus
gataaatctggcatcatccttcttc

SEQ ID NO: 500547 - DNA, 25 bp, Mus musculus
gataaatctggcttcatccttcttc

SEQ ID NO: 500548 - DNA, 25 bp, Mus musculus
gataaatcttccaggcttcatcatc

SEQ ID NO: 500549 - DNA, 25 bp, Mus musculus
gataaatcttccatggagtgtgaga

SEQ ID NO: 500550 - DNA, 25 bp, Mus musculus
gataaatcttcctggcttcatcatc

SEQ ID NO: 500551 - DNA, 25 bp, Mus musculus
gataaatcttccttggagtgtgaga

SEQ ID NO: 500552 - DNA, 25 bp, Mus musculus
gataaatgacatacttacggccaga

SEQ ID NO: 500553 - DNA, 25 bp, Mus musculus
gataaatgacattcttacggccaga

SEQ ID NO: 500554 - DNA, 25 bp, Mus musculus
gataaatgagctagccttccaaact

SEQ ID NO: 500555 - DNA, 25 bp, Mus musculus
gataaatgagcttgccttccaaact

SEQ ID NO: 500556 - DNA, 25 bp, Mus musculus
gataaatgatttctatgttgcttgt

SEQ ID NO: 500557 - DNA, 25 bp, Mus musculus
gataaatgatttgtatgttgcttgt

SEQ ID NO: 500558 - DNA, 25 bp, Mus musculus
gataaatgcaacaacagccgctctc

SEQ ID NO: 500559 - DNA, 25 bp, Mus musculus
gataaatgcaactacagccgctctc

SEQ ID NO: 500560 - DNA, 25 bp, Mus musculus
gataaatgcaatcaggtcctttcct

SEQ ID NO: 500561 - DNA, 25 bp, Mus musculus
gataaatgcaatgaggtcctttcct

SEQ ID NO: 500562 - DNA, 25 bp, Mus musculus
gataaatgcacacgcttcgtgttat

SEQ ID NO: 500563 - DNA, 25 bp, Mus musculus
gataaatgcacaggcttcgtgttat

SEQ ID NO: 500564 - DNA, 25 bp, Mus musculus
gataaatgccataagaagagtcctt

SEQ ID NO: 500565 - DNA, 25 bp, Mus musculus
gataaatgccattagaagagtcctt

SEQ ID NO: 500566 - DNA, 25 bp, Mus musculus
gataaatggctcctcttcctgtgtg

SEQ ID NO: 500567 - DNA, 25 bp, Mus musculus
gataaatggctcgtcttcctgtgtg

SEQ ID NO: 500568 - DNA, 25 bp, Mus musculus
gataaatggtttacatcagccggat

SEQ ID NO: 500569 - DNA, 25 bp, Mus musculus
gataaatggttttcatcagccggat

SEQ ID NO: 500570 - DNA, 25 bp, Mus musculus
gataaatgtcataatctctctgaag

SEQ ID NO: 500571 - DNA, 25 bp, Mus musculus
gataaatgtcattatctctctgaag

SEQ ID NO: 500572 - DNA, 25 bp, Mus musculus
gataaatgtcttcagttagccccaa

SEQ ID NO: 500573 - DNA, 25 bp, Mus musculus
gataaatgtcttgagttagccccaa

SEQ ID NO: 500574 - DNA, 25 bp, Mus musculus
gataaatgtgccatctttgagctat

SEQ ID NO: 500575 - DNA, 25 bp, Mus musculus
gataaatgtgccttctttgagctat

SEQ ID NO: 500576 - DNA, 25 bp, Mus musculus
gataaatgtggcacttccaacttta

SEQ ID NO: 500577 - DNA, 25 bp, Mus musculus
gataaatgtggctcttccaacttta

SEQ ID NO: 500578 - DNA, 25 bp, Mus musculus
gataaatgttttcctgccttggtta

SEQ ID NO: 500579 - DNA, 25 bp, Mus musculus
gataaatgttttgctgccttggtta

SEQ ID NO: 500580 - DNA, 25 bp, Mus musculus
gataaattattgctactgctgtggg

SEQ ID NO: 500581 - DNA, 25 bp, Mus musculus
gataaattattggtactgctgtggg

SEQ ID NO: 500582 - DNA, 25 bp, Mus musculus
gataaattatttcaggacctcctcc

SEQ ID NO: 500583 - DNA, 25 bp, Mus musculus
gataaattatttgaggacctcctcc

SEQ ID NO: 500584 - DNA, 25 bp, Mus musculus
gataaattcactattggcacatact

SEQ ID NO: 500585 - DNA, 25 bp, Mus musculus
gataaattcacttttggcacatact

SEQ ID NO: 500586 - DNA, 25 bp, Mus musculus
gataaattcagccatgcatcaacac

SEQ ID NO: 500587 - DNA, 25 bp, Mus musculus
gataaattcagcgatgcatcaacac

SEQ ID NO: 500588 - DNA, 25 bp, Mus musculus
gataaattcatcatccacaaggatc

SEQ ID NO: 500589 - DNA, 25 bp, Mus musculus
gataaattcatcatctccagagaca

SEQ ID NO: 500590 - DNA, 25 bp, Mus musculus
gataaattcatcttccacaaggatc

SEQ ID NO: 500591 - DNA, 25 bp, Mus musculus
gataaattcatcttctccagagaca

SEQ ID NO: 500592 - DNA, 25 bp, Mus musculus
gataaattccaacatctgtctatga

SEQ ID NO: 500593 - DNA, 25 bp, Mus musculus
gataaattccaagatctgtctatga

SEQ ID NO: 500594 - DNA, 25 bp, Mus musculus
gataaattcccacactgacagacag

SEQ ID NO: 500595 - DNA, 25 bp, Mus musculus
gataaattcccagactgacagacag

SEQ ID NO: 500596 - DNA, 25 bp, Mus musculus
gataaattgcctaatgtcaccatgg

SEQ ID NO: 500597 - DNA, 25 bp, Mus musculus
gataaattgccttatgtcaccatgg

SEQ ID NO: 500598 - DNA, 25 bp, Mus musculus
gataaattgtggcttccccggtgtc

SEQ ID NO: 500599 - DNA, 25 bp, Mus musculus
gataaattgtgggttccccggtgtc

SEQ ID NO: 500600 - DNA, 25 bp, Mus musculus
gataaatttcacagtctttggttaa

SEQ ID NO: 500601 - DNA, 25 bp, Mus musculus
gataaatttcactgtctttggttaa

SEQ ID NO: 500602 - DNA, 25 bp, Mus musculus
gataaatttcccaggctctaatcca

SEQ ID NO: 500603 - DNA, 25 bp, Mus musculus
gataaatttccctggctctaatcca

SEQ ID NO: 500604 - DNA, 25 bp, Mus musculus
gataaatttcttaagtcccaataag

SEQ ID NO: 500605 - DNA, 25 bp, Mus musculus
gataaatttctttagtcccaataag

SEQ ID NO: 500606 - DNA, 25 bp, Mus musculus
gataaattttccagacttaccttcg

SEQ ID NO: 500607 - DNA, 25 bp, Mus musculus
gataaattttcctgacttaccttcg

SEQ ID NO: 500608 - DNA, 25 bp, Mus musculus
gataacaaaagacaaggcccggcta

SEQ ID NO: 500609 - DNA, 25 bp, Mus musculus
gataacaaaagagaaggcccggcta

SEQ ID NO: 500610 - DNA, 25 bp, Mus musculus
gataacaaaggtactgccattttaa

SEQ ID NO: 500611 - DNA, 25 bp, Mus musculus
gataacaaaggttctgccattttaa

SEQ ID NO: 500612 - DNA, 25 bp, Mus musculus
gataacaaattaattcccaggaggc

SEQ ID NO: 500613 - DNA, 25 bp, Mus musculus
gataacaaattatttcccaggaggc

SEQ ID NO: 500614 - DNA, 25 bp, Mus musculus
gataacaacctcatacaggccagag

SEQ ID NO: 500615 - DNA, 25 bp, Mus musculus
gataacaacctcttacaggccagag

SEQ ID NO: 500616 - DNA, 25 bp, Mus musculus
gataacaactgtcactagcctacga

SEQ ID NO: 500617 - DNA, 25 bp, Mus musculus
gataacaactgtgactagcctacga

SEQ ID NO: 500618 - DNA, 25 bp, Mus musculus
gataacaaggatacaaacagttctt

SEQ ID NO: 500619 - DNA, 25 bp, Mus musculus
gataacaaggattcaaacagttctt

SEQ ID NO: 500620 - DNA, 25 bp, Mus musculus
gataacaagtgccttcttgctttta

SEQ ID NO: 500621 - DNA, 25 bp, Mus musculus
gataacaagtgcgttcttgctttta

SEQ ID NO: 500622 - DNA, 25 bp, Mus musculus
gataacaatcttccattttgtctaa

SEQ ID NO: 500623 - DNA, 25 bp, Mus musculus
gataacaatcttgcattttgtctaa

SEQ ID NO: 500624 - DNA, 25 bp, Mus musculus
gataacaatgccatcgtacccatgc

SEQ ID NO: 500625 - DNA, 25 bp, Mus musculus
gataacaatgccttcgtacccatgc

SEQ ID NO: 500626 - DNA, 25 bp, Mus musculus
gataacaattctcctattttggaaa

SEQ ID NO: 500627 - DNA, 25 bp, Mus musculus
gataacaattctgctattttggaaa

SEQ ID NO: 500628 - DNA, 25 bp, Mus musculus
gataacaatttccagcaggagtcca

SEQ ID NO: 500629 - DNA, 25 bp, Mus musculus
gataacaatttcgagcaggagtcca

SEQ ID NO: 500630 - DNA, 25 bp, Mus musculus
gataacacacttcagaaagattctg

SEQ ID NO: 500631 - DNA, 25 bp, Mus musculus
gataacacacttgagaaagattctg

SEQ ID NO: 500632 - DNA, 25 bp, Mus musculus
gataacacataccatttgtacacaa

SEQ ID NO: 500633 - DNA, 25 bp, Mus musculus
gataacacatacgatttgtacacaa

SEQ ID NO: 500634 - DNA, 25 bp, Mus musculus
gataacacattcaaattatgcccaa

SEQ ID NO: 500635 - DNA, 25 bp, Mus musculus
gataacacattctaattatgcccaa

SEQ ID NO: 500636 - DNA, 25 bp, Mus musculus
gataacacattgactttctatatta

SEQ ID NO: 500637 - DNA, 25 bp, Mus musculus
gataacacattgcacctactggcta

SEQ ID NO: 500638 - DNA, 25 bp, Mus musculus
gataacacattggacctactggcta

SEQ ID NO: 500639 - DNA, 25 bp, Mus musculus
gataacacattgtctttctatatta

SEQ ID NO: 500640 - DNA, 25 bp, Mus musculus
gataacacccgaacagcagtcactg

SEQ ID NO: 500641 - DNA, 25 bp, Mus musculus
gataacacccgatcagcagtcactg

SEQ ID NO: 500642 - DNA, 25 bp, Mus musculus
gataacacgcaccaggctgctgtaa

SEQ ID NO: 500643 - DNA, 25 bp, Mus musculus
gataacacgcacgaggctgctgtaa

SEQ ID NO: 500644 - DNA, 25 bp, Mus musculus
gataacacgcataaacacattcctg

SEQ ID NO: 500645 - DNA, 25 bp, Mus musculus
gataacacgcattaacacattcctg

SEQ ID NO: 500646 - DNA, 25 bp, Mus musculus
gataacactaaaacggtgaccatcc

SEQ ID NO: 500647 - DNA, 25 bp, Mus musculus
gataacactaaatcggtgaccatcc

SEQ ID NO: 500648 - DNA, 25 bp, Mus musculus
gataacactctgataaaagcaacct

SEQ ID NO: 500649 - DNA, 25 bp, Mus musculus
gataacactctgttaaaagcaacct

SEQ ID NO: 500650 - DNA, 25 bp, Mus musculus
gataacactgtcaactgtcgccata

SEQ ID NO: 500651 - DNA, 25 bp, Mus musculus
gataacactgtctactgtcgccata

SEQ ID NO: 500652 - DNA, 25 bp, Mus musculus
gataacacttgcaacatatcatgtt

SEQ ID NO: 500653 - DNA, 25 bp, Mus musculus
gataacacttgctacatatcatgtt

SEQ ID NO: 500654 - DNA, 25 bp, Mus musculus
gataacacttggatgttttctacat

SEQ ID NO: 500655 - DNA, 25 bp, Mus musculus
gataacacttggttgttttctacat

SEQ ID NO: 500656 - DNA, 25 bp, Mus musculus
gataacagaagcagcctaggcagcc

SEQ ID NO: 500657 - DNA, 25 bp, Mus musculus
gataacagaagctgcctaggcagcc

SEQ ID NO: 500658 - DNA, 25 bp, Mus musculus
gataacagagatatctccccacagt

SEQ ID NO: 500659 - DNA, 25 bp, Mus musculus
gataacagagatttctccccacagt

SEQ ID NO: 500660 - DNA, 25 bp, Mus musculus
gataacagcaatagtcctggacaga

SEQ ID NO: 500661 - DNA, 25 bp, Mus musculus
gataacagcaattgtcctggacaga

SEQ ID NO: 500662 - DNA, 25 bp, Mus musculus
gataacagcacccatccacagattg

SEQ ID NO: 500663 - DNA, 25 bp, Mus musculus
gataacagcaccctgcagagtgaag

SEQ ID NO: 500664 - DNA, 25 bp, Mus musculus
gataacagcaccgatccacagattg

SEQ ID NO: 500665 - DNA, 25 bp, Mus musculus
gataacagcaccgtgcagagtgaag

SEQ ID NO: 500666 - DNA, 25 bp, Mus musculus
gataacagcttgactactgactgat

SEQ ID NO: 500667 - DNA, 25 bp, Mus musculus
gataacagcttgtctactgactgat

SEQ ID NO: 500668 - DNA, 25 bp, Mus musculus
gataacaggagcatcgtgtcgcctt

SEQ ID NO: 500669 - DNA, 25 bp, Mus musculus
gataacaggagcttcgtgtcgcctt

SEQ ID NO: 500670 - DNA, 25 bp, Mus musculus
gataacaggcatctcccagaggcaa

SEQ ID NO: 500671 - DNA, 25 bp, Mus musculus
gataacaggcatgtcccagaggcaa

SEQ ID NO: 500672 - DNA, 25 bp, Mus musculus
gataacagtagtcctaccttaacgg

SEQ ID NO: 500673 - DNA, 25 bp, Mus musculus
gataacagtagtgctaccttaacgg

SEQ ID NO: 500674 - DNA, 25 bp, Mus musculus
gataacagtcaccaagttccttggc

SEQ ID NO: 500675 - DNA, 25 bp, Mus musculus
gataacagtcacgaagttccttggc

SEQ ID NO: 500676 - DNA, 25 bp, Mus musculus
gataacagtcttacaacccaagggt

SEQ ID NO: 500677 - DNA, 25 bp, Mus musculus
gataacagtctttcaacccaagggt

SEQ ID NO: 500678 - DNA, 25 bp, Mus musculus
gataacatacttcggtcataagaca

SEQ ID NO: 500679 - DNA, 25 bp, Mus musculus
gataacatacttgggtcataagaca

SEQ ID NO: 500680 - DNA, 25 bp, Mus musculus
gataacatcagcctatctcctgagg

SEQ ID NO: 500681 - DNA, 25 bp, Mus musculus
gataacatcagcgtatctcctgagg

SEQ ID NO: 500682 - DNA, 25 bp, Mus musculus
gataacatcctcaatggagaccctg

SEQ ID NO: 500683 - DNA, 25 bp, Mus musculus
gataacatcctctatggagaccctg

SEQ ID NO: 500684 - DNA, 25 bp, Mus musculus
gataacatctctagacccagaaaag

SEQ ID NO: 500685 - DNA, 25 bp, Mus musculus
gataacatctcttgacccagaaaag

SEQ ID NO: 500686 - DNA, 25 bp, Mus musculus
gataacatctgacgacacgctacat

SEQ ID NO: 500687 - DNA, 25 bp, Mus musculus
gataacatctgaggacacgctacat

SEQ ID NO: 500688 - DNA, 25 bp, Mus musculus
gataacatgaaaaatggccctcttg

SEQ ID NO: 500689 - DNA, 25 bp, Mus musculus
gataacatgaaatatggccctcttg

SEQ ID NO: 500690 - DNA, 25 bp, Mus musculus
gataacatgctccactgataccata

SEQ ID NO: 500691 - DNA, 25 bp, Mus musculus
gataacatgctcgactgataccata

SEQ ID NO: 500692 - DNA, 25 bp, Mus musculus
gataacattagactccgtgcttcgt

SEQ ID NO: 500693 - DNA, 25 bp, Mus musculus
gataacattagagtccgtgcttcgt

SEQ ID NO: 500694 - DNA, 25 bp, Mus musculus
gataacattataactggtttccctc

SEQ ID NO: 500695 - DNA, 25 bp, Mus musculus
gataacattatatctggtttccctc

SEQ ID NO: 500696 - DNA, 25 bp, Mus musculus
gataacatttggctctccttaggaa

SEQ ID NO: 500697 - DNA, 25 bp, Mus musculus
gataacatttgggtctccttaggaa

SEQ ID NO: 500698 - DNA, 25 bp, Mus musculus
gataaccaactgcactgctgaagtt

SEQ ID NO: 500699 - DNA, 25 bp, Mus musculus
gataaccaactggactgctgaagtt

SEQ ID NO: 500700 - DNA, 25 bp, Mus musculus
gataaccacaaacattcattgacaa

SEQ ID NO: 500701 - DNA, 25 bp, Mus musculus
gataaccacaaagattcattgacaa

SEQ ID NO: 500702 - DNA, 25 bp, Mus musculus
gataaccaccatcccaggaattctc

SEQ ID NO: 500703 - DNA, 25 bp, Mus musculus
gataaccaccatgccaggaattctc

SEQ ID NO: 500704 - DNA, 25 bp, Mus musculus
gataaccaccttcaatcacaggcaa

SEQ ID NO: 500705 - DNA, 25 bp, Mus musculus
gataaccaccttgaatcacaggcaa

SEQ ID NO: 500706 - DNA, 25 bp, Mus musculus
gataaccacggcactgaagcgtcac

SEQ ID NO: 500707 - DNA, 25 bp, Mus musculus
gataaccacggctctgaagcgtcac

SEQ ID NO: 500708 - DNA, 25 bp, Mus musculus
gataaccacggtaccacggcataga

SEQ ID NO: 500709 - DNA, 25 bp, Mus musculus
gataaccacggttccacggcataga

SEQ ID NO: 500710 - DNA, 25 bp, Mus musculus
gataaccagagtcattttctccatc

SEQ ID NO: 500711 - DNA, 25 bp, Mus musculus
gataaccagagtgattttctccatc

SEQ ID NO: 500712 - DNA, 25 bp, Mus musculus
gataaccagatgatgctgcccagga

SEQ ID NO: 500713 - DNA, 25 bp, Mus musculus
gataaccagatgttgctgcccagga

SEQ ID NO: 500714 - DNA, 25 bp, Mus musculus
gataaccatcaacttccttggcaaa

SEQ ID NO: 500715 - DNA, 25 bp, Mus musculus
gataaccatcaagttccttggcaaa

SEQ ID NO: 500716 - DNA, 25 bp, Mus musculus
gataaccatggcacagactgacatc

SEQ ID NO: 500717 - DNA, 25 bp, Mus musculus
gataaccatggctcagactgacatc

SEQ ID NO: 500718 - DNA, 25 bp, Mus musculus
gataacccaataccctgcataccag

SEQ ID NO: 500719 - DNA, 25 bp, Mus musculus
gataacccaatagcctgcataccag

SEQ ID NO: 500720 - DNA, 25 bp, Mus musculus
gataacccaggaaaagatgtcagct

SEQ ID NO: 500721 - DNA, 25 bp, Mus musculus
gataacccaggataagatgtcagct

SEQ ID NO: 500722 - DNA, 25 bp, Mus musculus
gataacccatcccatatgactatgg

SEQ ID NO: 500723 - DNA, 25 bp, Mus musculus
gataacccatccgatatgactatgg

SEQ ID NO: 500724 - DNA, 25 bp, Mus musculus
gataacccatctagaaaagactgct

SEQ ID NO: 500725 - DNA, 25 bp, Mus musculus
gataacccatcttgaaaagactgct

SEQ ID NO: 500726 - DNA, 25 bp, Mus musculus
gataacccattacaagcacaagaat

SEQ ID NO: 500727 - DNA, 25 bp, Mus musculus
gataacccattagaagcacaagaat

SEQ ID NO: 500728 - DNA, 25 bp, Mus musculus
gataacccctatagcgaggacagat

SEQ ID NO: 500729 - DNA, 25 bp, Mus musculus
gataacccctatcaatatggaagtg

SEQ ID NO: 500730 - DNA, 25 bp, Mus musculus
gataacccctatgaatatggaagtg

SEQ ID NO: 500731 - DNA, 25 bp, Mus musculus
gataacccctattgcgaggacagat

SEQ ID NO: 500732 - DNA, 25 bp, Mus musculus
gataacccgcccagaagagagtccg

SEQ ID NO: 500733 - DNA, 25 bp, Mus musculus
gataacccgccctgaagagagtccg

SEQ ID NO: 500734 - DNA, 25 bp, Mus musculus
gataaccctgatacagtactcctgg

SEQ ID NO: 500735 - DNA, 25 bp, Mus musculus
gataaccctgattcagtactcctgg

SEQ ID NO: 500736 - DNA, 25 bp, Mus musculus
gataaccctttaaccaatgacagca

SEQ ID NO: 500737 - DNA, 25 bp, Mus musculus
gataaccctttatccaatgacagca

SEQ ID NO: 500738 - DNA, 25 bp, Mus musculus
gataaccgaattatcccgatgcata

SEQ ID NO: 500739 - DNA, 25 bp, Mus musculus
gataaccgaattttcccgatgcata

SEQ ID NO: 500740 - DNA, 25 bp, Mus musculus
gataaccgacagaaggaggcgcccc

SEQ ID NO: 500741 - DNA, 25 bp, Mus musculus
gataaccgacagtaggaggcgcccc

SEQ ID NO: 500742 - DNA, 25 bp, Mus musculus
gataaccgcaagataactccgctca

SEQ ID NO: 500743 - DNA, 25 bp, Mus musculus
gataaccgcaagttaactccgctca

SEQ ID NO: 500744 - DNA, 25 bp, Mus musculus
gataaccggcgacgctatcctggac

SEQ ID NO: 500745 - DNA, 25 bp, Mus musculus
gataaccggcgaggctatcctggac

SEQ ID NO: 500746 - DNA, 25 bp, Mus musculus
gataaccggtcaaagtctcttccag

SEQ ID NO: 500747 - DNA, 25 bp, Mus musculus
gataaccggtcatagtctcttccag

SEQ ID NO: 500748 - DNA, 25 bp, Mus musculus
gataaccggttaaagcgaacatttc

SEQ ID NO: 500749 - DNA, 25 bp, Mus musculus
gataaccggttatagcgaacatttc

SEQ ID NO: 500750 - DNA, 25 bp, Mus musculus
gataacctaggaactccacatgcac

SEQ ID NO: 500751 - DNA, 25 bp, Mus musculus
gataacctaggatctccacatgcac

SEQ ID NO: 500752 - DNA, 25 bp, Mus musculus
gataacctcagtctagtgatcaata

SEQ ID NO: 500753 - DNA, 25 bp, Mus musculus
gataacctcagtgtagtgatcaata

SEQ ID NO: 500754 - DNA, 25 bp, Mus musculus
gataacctcgttagcattagtttgg

SEQ ID NO: 500755 - DNA, 25 bp, Mus musculus
gataacctcgtttgcattagtttgg

SEQ ID NO: 500756 - DNA, 25 bp, Mus musculus
gataacctgatcaaccaagtggcta

SEQ ID NO: 500757 - DNA, 25 bp, Mus musculus
gataacctgatctaccaagtggcta

SEQ ID NO: 500758 - DNA, 25 bp, Mus musculus
gataacctgattagtgcactaaaca

SEQ ID NO: 500759 - DNA, 25 bp, Mus musculus
gataacctgatttgtgcactaaaca

SEQ ID NO: 500760 - DNA, 25 bp, Mus musculus
gataacctgcaacgcctgagcgagg

SEQ ID NO: 500761 - DNA, 25 bp, Mus musculus
gataacctgcaaggcctgagcgagg

SEQ ID NO: 500762 - DNA, 25 bp, Mus musculus
gataacctgccaatctttcaggata

SEQ ID NO: 500763 - DNA, 25 bp, Mus musculus
gataacctgccattctttcaggata

SEQ ID NO: 500764 - DNA, 25 bp, Mus musculus
gataacctgcccagtggtggccttg

SEQ ID NO: 500765 - DNA, 25 bp, Mus musculus
gataacctgccctgtggtggccttg

SEQ ID NO: 500766 - DNA, 25 bp, Mus musculus
gataacctgctacgcttgagagcat

SEQ ID NO: 500767 - DNA, 25 bp, Mus musculus
gataacctgctaggcttgagagcat

SEQ ID NO: 500768 - DNA, 25 bp, Mus musculus
gataacctgctgagtattcaacttg

SEQ ID NO: 500769 - DNA, 25 bp, Mus musculus
gataacctgctgtgtattcaacttg

SEQ ID NO: 500770 - DNA, 25 bp, Mus musculus
gataacctgggtactggaatcatat

SEQ ID NO: 500771 - DNA, 25 bp, Mus musculus
gataacctgggttctggaatcatat

SEQ ID NO: 500772 - DNA, 25 bp, Mus musculus
gataacctggtgagtgcaacagacc

SEQ ID NO: 500773 - DNA, 25 bp, Mus musculus
gataacctggtgtgtgcaacagacc

SEQ ID NO: 500774 - DNA, 25 bp, Mus musculus
gataaccttgacatagcagctactt

SEQ ID NO: 500775 - DNA, 25 bp, Mus musculus
gataaccttgacttagcagctactt

SEQ ID NO: 500776 - DNA, 25 bp, Mus musculus
gataaccttggcatttcagctgaca

SEQ ID NO: 500777 - DNA, 25 bp, Mus musculus
gataaccttggcttttcagctgaca

SEQ ID NO: 500778 - DNA, 25 bp, Mus musculus
gataacgcacggaggctaagagcac

SEQ ID NO: 500779 - DNA, 25 bp, Mus musculus
gataacgcacggtggctaagagcac

SEQ ID NO: 500780 - DNA, 25 bp, Mus musculus
gataacggatgtccctccatgcatg

SEQ ID NO: 500781 - DNA, 25 bp, Mus musculus
gataacggatgtgcctccatgcatg

SEQ ID NO: 500782 - DNA, 25 bp, Mus musculus
gataacggcttgattcctccaaatg

SEQ ID NO: 500783 - DNA, 25 bp, Mus musculus
gataacggcttgtttcctccaaatg

SEQ ID NO: 500784 - DNA, 25 bp, Mus musculus
gataacgggctgaagactgattttt

SEQ ID NO: 500785 - DNA, 25 bp, Mus musculus
gataacgggctgtagactgattttt

SEQ ID NO: 500786 - DNA, 25 bp, Mus musculus
gataacgggtgaccaaaccagcctt

SEQ ID NO: 500787 - DNA, 25 bp, Mus musculus
gataacgggtgagcaaaccagcctt

SEQ ID NO: 500788 - DNA, 25 bp, Mus musculus
gataacgtccagcatgtcactgagg

SEQ ID NO: 500789 - DNA, 25 bp, Mus musculus
gataacgtccaggatgtcactgagg

SEQ ID NO: 500790 - DNA, 25 bp, Mus musculus
gataacgtccttcgtgtgacatctg

SEQ ID NO: 500791 - DNA, 25 bp, Mus musculus
gataacgtccttggtgtgacatctg

SEQ ID NO: 500792 - DNA, 25 bp, Mus musculus
gataacgtgttcatttgccagttca

SEQ ID NO: 500793 - DNA, 25 bp, Mus musculus
gataacgtgttcttttgccagttca

SEQ ID NO: 500794 - DNA, 25 bp, Mus musculus
gataacgtttctaatgctcatactg

SEQ ID NO: 500795 - DNA, 25 bp, Mus musculus
gataacgtttcttatgctcatactg

SEQ ID NO: 500796 - DNA, 25 bp, Mus musculus
gataactaaaatacttgcaccggag

SEQ ID NO: 500797 - DNA, 25 bp, Mus musculus
gataactaaaattcttgcaccggag

SEQ ID NO: 500798 - DNA, 25 bp, Mus musculus
gataactaagacctctttccccatt

SEQ ID NO: 500799 - DNA, 25 bp, Mus musculus
gataactaagacgtctttccccatt

SEQ ID NO: 500800 - DNA, 25 bp, Mus musculus
gataactaagtcatctccgttgccc

SEQ ID NO: 500801 - DNA, 25 bp, Mus musculus
gataactaagtcttctccgttgccc

SEQ ID NO: 500802 - DNA, 25 bp, Mus musculus
gataactaagttactaccgtttgtg

SEQ ID NO: 500803 - DNA, 25 bp, Mus musculus
gataactaagtttctaccgtttgtg

SEQ ID NO: 500804 - DNA, 25 bp, Mus musculus
gataactacacacaaagtatacatt

SEQ ID NO: 500805 - DNA, 25 bp, Mus musculus
gataactacacagaaagtatacatt

SEQ ID NO: 500806 - DNA, 25 bp, Mus musculus
gataactacactccctgaaagctgt

SEQ ID NO: 500807 - DNA, 25 bp, Mus musculus
gataactacactgcctgaaagctgt

SEQ ID NO: 500808 - DNA, 25 bp, Mus musculus
gataactacttaagagccccttggc

SEQ ID NO: 500809 - DNA, 25 bp, Mus musculus
gataactacttatgagccccttggc

SEQ ID NO: 500810 - DNA, 25 bp, Mus musculus
gataactacttcaacaaaccatatt

SEQ ID NO: 500811 - DNA, 25 bp, Mus musculus
gataactacttctacaaaccatatt

SEQ ID NO: 500812 - DNA, 25 bp, Mus musculus
gataactatacaacctactgccttc

SEQ ID NO: 500813 - DNA, 25 bp, Mus musculus
gataactatacatcctactgccttc

SEQ ID NO: 500814 - DNA, 25 bp, Mus musculus
gataactatcttccttaagcggcat

SEQ ID NO: 500815 - DNA, 25 bp, Mus musculus
gataactatcttgcttaagcggcat

SEQ ID NO: 500816 - DNA, 25 bp, Mus musculus
gataactatgtgctcgtggtctcta

SEQ ID NO: 500817 - DNA, 25 bp, Mus musculus
gataactatgtggtcgtggtctcta

SEQ ID NO: 500818 - DNA, 25 bp, Mus musculus
gataactatttccttgtcctggtct

SEQ ID NO: 500819 - DNA, 25 bp, Mus musculus
gataactatttcgttgtcctggtct

SEQ ID NO: 500820 - DNA, 25 bp, Mus musculus
gataactcaagactacagtactaag

SEQ ID NO: 500821 - DNA, 25 bp, Mus musculus
gataactcaagagtacagtactaag

SEQ ID NO: 500822 - DNA, 25 bp, Mus musculus
gataactcagaaaggtcacttaaaa

SEQ ID NO: 500823 - DNA, 25 bp, Mus musculus
gataactcagaatggtcacttaaaa

SEQ ID NO: 500824 - DNA, 25 bp, Mus musculus
gataactcagatcccaattggtgga

SEQ ID NO: 500825 - DNA, 25 bp, Mus musculus
gataactcagatgccaattggtgga

SEQ ID NO: 500826 - DNA, 25 bp, Mus musculus
gataactcagccactttgaagcatt

SEQ ID NO: 500827 - DNA, 25 bp, Mus musculus
gataactcagcctctttgaagcatt

SEQ ID NO: 500828 - DNA, 25 bp, Mus musculus
gataactcagctattgacacggcta

SEQ ID NO: 500829 - DNA, 25 bp, Mus musculus
gataactcagcttttgacacggcta

SEQ ID NO: 500830 - DNA, 25 bp, Mus musculus
gataactcatcgactgggtttttat

SEQ ID NO: 500831 - DNA, 25 bp, Mus musculus
gataactcatcgtctgggtttttat

SEQ ID NO: 500832 - DNA, 25 bp, Mus musculus
gataactcatttctctatctagaga

SEQ ID NO: 500833 - DNA, 25 bp, Mus musculus
gataactcatttgtctatctagaga

SEQ ID NO: 500834 - DNA, 25 bp, Mus musculus
gataactccactcatgatccagagc

SEQ ID NO: 500835 - DNA, 25 bp, Mus musculus
gataactccactgatgatccagagc

SEQ ID NO: 500836 - DNA, 25 bp, Mus musculus
gataactccagcagtcttgtggctc

SEQ ID NO: 500837 - DNA, 25 bp, Mus musculus
gataactccagctgtcttgtggctc

SEQ ID NO: 500838 - DNA, 25 bp, Mus musculus
gataactcccttacaggtgtacgca

SEQ ID NO: 500839 - DNA, 25 bp, Mus musculus
gataactccctttcaggtgtacgca

SEQ ID NO: 500840 - DNA, 25 bp, Mus musculus
gataactcctgacttggttgtctaa

SEQ ID NO: 500841 - DNA, 25 bp, Mus musculus
gataactcctgagttggttgtctaa

SEQ ID NO: 500842 - DNA, 25 bp, Mus musculus
gataactccttacctctcaatgttc

SEQ ID NO: 500843 - DNA, 25 bp, Mus musculus
gataactccttagctctcaatgttc

SEQ ID NO: 500844 - DNA, 25 bp, Mus musculus
gataactctaccaatgtttctttca

SEQ ID NO: 500845 - DNA, 25 bp, Mus musculus
gataactctacctatgtttctttca

SEQ ID NO: 500846 - DNA, 25 bp, Mus musculus
gataactctcaaagcctgctataat

SEQ ID NO: 500847 - DNA, 25 bp, Mus musculus
gataactctcaatgcctgctataat

SEQ ID NO: 500848 - DNA, 25 bp, Mus musculus
gataactctcctaaagagggaaggg

SEQ ID NO: 500849 - DNA, 25 bp, Mus musculus
gataactctccttaagagggaaggg

SEQ ID NO: 500850 - DNA, 25 bp, Mus musculus
gataactctgataaccttttgaggt

SEQ ID NO: 500851 - DNA, 25 bp, Mus musculus
gataactctgattaccttttgaggt

SEQ ID NO: 500852 - DNA, 25 bp, Mus musculus
gataactgacagattgaagctagcc

SEQ ID NO: 500853 - DNA, 25 bp, Mus musculus
gataactgacagtttgaagctagcc

SEQ ID NO: 500854 - DNA, 25 bp, Mus musculus
gataactgcaccatgttgcacaggc

SEQ ID NO: 500855 - DNA, 25 bp, Mus musculus
gataactgcaccttgttgcacaggc

SEQ ID NO: 500856 - DNA, 25 bp, Mus musculus
gataactgcagaatcactgacagac

SEQ ID NO: 500857 - DNA, 25 bp, Mus musculus
gataactgcagattcactgacagac

SEQ ID NO: 500858 - DNA, 25 bp, Mus musculus
gataactgcatcactatgcacgaga

SEQ ID NO: 500859 - DNA, 25 bp, Mus musculus
gataactgcatctctatgcacgaga

SEQ ID NO: 500860 - DNA, 25 bp, Mus musculus
gataactgctctcatttaacttcat

SEQ ID NO: 500861 - DNA, 25 bp, Mus musculus
gataactgctctgatttaacttcat

SEQ ID NO: 500862 - DNA, 25 bp, Mus musculus
gataactggatgactgctgagctgt

SEQ ID NO: 500863 - DNA, 25 bp, Mus musculus
gataactggatgtctgctgagctgt

SEQ ID NO: 500864 - DNA, 25 bp, Mus musculus
gataactgggacatgggtctaacca

SEQ ID NO: 500865 - DNA, 25 bp, Mus musculus
gataactgggacttgggtctaacca

SEQ ID NO: 500866 - DNA, 25 bp, Mus musculus
gataactgggatctcatagagctaa

SEQ ID NO: 500867 - DNA, 25 bp, Mus musculus
gataactgggatgtcatagagctaa

SEQ ID NO: 500868 - DNA, 25 bp, Mus musculus
gataactgggtaatgtttgatgtga

SEQ ID NO: 500869 - DNA, 25 bp, Mus musculus
gataactgggtattgtttgatgtga

SEQ ID NO: 500870 - DNA, 25 bp, Mus musculus
gataactggtctctaattcttcaat

SEQ ID NO: 500871 - DNA, 25 bp, Mus musculus
gataactggtctgtaattcttcaat

SEQ ID NO: 500872 - DNA, 25 bp, Mus musculus
gataactgtaacagggttggtggcc

SEQ ID NO: 500873 - DNA, 25 bp, Mus musculus
gataactgtaactgggttggtggcc

SEQ ID NO: 500874 - DNA, 25 bp, Mus musculus
gataactgtcaaatccatcgccttt

SEQ ID NO: 500875 - DNA, 25 bp, Mus musculus
gataactgtcaattccatcgccttt

SEQ ID NO: 500876 - DNA, 25 bp, Mus musculus
gataactgtgcaattaagtccaaca

SEQ ID NO: 500877 - DNA, 25 bp, Mus musculus
gataactgtgcatttaagtccaaca

SEQ ID NO: 500878 - DNA, 25 bp, Mus musculus
gataactgtggacatcacggctgaa

SEQ ID NO: 500879 - DNA, 25 bp, Mus musculus
gataactgtggagatcacggctgaa

SEQ ID NO: 500880 - DNA, 25 bp, Mus musculus
gataactgttaaatggcttctgctg

SEQ ID NO: 500881 - DNA, 25 bp, Mus musculus
gataactgttaattggcttctgctg

SEQ ID NO: 500882 - DNA, 25 bp, Mus musculus
gataactgttccaagctgagggaca

SEQ ID NO: 500883 - DNA, 25 bp, Mus musculus
gataactgttcctagctgagggaca

SEQ ID NO: 500884 - DNA, 25 bp, Mus musculus
gataactgttttcagaatccaggaa

SEQ ID NO: 500885 - DNA, 25 bp, Mus musculus
gataactgttttgagaatccaggaa

SEQ ID NO: 500886 - DNA, 25 bp, Mus musculus
gataacttaatccatatgtgtctga

SEQ ID NO: 500887 - DNA, 25 bp, Mus musculus
gataacttaatcgatatgtgtctga

SEQ ID NO: 500888 - DNA, 25 bp, Mus musculus
gataacttacagacagcagtccaac

SEQ ID NO: 500889 - DNA, 25 bp, Mus musculus
gataacttacagtcagcagtccaac

SEQ ID NO: 500890 - DNA, 25 bp, Mus musculus
gataacttaccaatttgaccaaaca

SEQ ID NO: 500891 - DNA, 25 bp, Mus musculus
gataacttaccattttgaccaaaca

SEQ ID NO: 500892 - DNA, 25 bp, Mus musculus
gataacttactccttgaaatagtgt

SEQ ID NO: 500893 - DNA, 25 bp, Mus musculus
gataacttactcgttgaaatagtgt

SEQ ID NO: 500894 - DNA, 25 bp, Mus musculus
gataacttactgactgattgactga

SEQ ID NO: 500895 - DNA, 25 bp, Mus musculus
gataacttactgtctgattgactga

SEQ ID NO: 500896 - DNA, 25 bp, Mus musculus
gataacttccggcataccctgaaga

SEQ ID NO: 500897 - DNA, 25 bp, Mus musculus
gataacttccgggataccctgaaga

SEQ ID NO: 500898 - DNA, 25 bp, Mus musculus
gataacttctgtctgtcatgtccca

SEQ ID NO: 500899 - DNA, 25 bp, Mus musculus
gataacttctgtgtgtcatgtccca

SEQ ID NO: 500900 - DNA, 25 bp, Mus musculus
gataacttgacccttgatccagcca

SEQ ID NO: 500901 - DNA, 25 bp, Mus musculus
gataacttgaccgttgatccagcca

SEQ ID NO: 500902 - DNA, 25 bp, Mus musculus
gataacttgcgtccttgttaccaca

SEQ ID NO: 500903 - DNA, 25 bp, Mus musculus
gataacttgcgtgcttgttaccaca

SEQ ID NO: 500904 - DNA, 25 bp, Mus musculus
gataacttggatagatgcttgggtc

SEQ ID NO: 500905 - DNA, 25 bp, Mus musculus
gataacttggattgatgcttgggtc

SEQ ID NO: 500906 - DNA, 25 bp, Mus musculus
gataacttggtcaccttgtagaacg

SEQ ID NO: 500907 - DNA, 25 bp, Mus musculus
gataacttggtctccttgtagaacg

SEQ ID NO: 500908 - DNA, 25 bp, Mus musculus
gataactttcagacaaaccttctag

SEQ ID NO: 500909 - DNA, 25 bp, Mus musculus
gataactttcagtcaaaccttctag

SEQ ID NO: 500910 - DNA, 25 bp, Mus musculus
gataacttttaaaactcagcagatt

SEQ ID NO: 500911 - DNA, 25 bp, Mus musculus
gataacttttaatactcagcagatt

SEQ ID NO: 500912 - DNA, 25 bp, Mus musculus
gataacttttacatcatgcccattt

SEQ ID NO: 500913 - DNA, 25 bp, Mus musculus
gataacttttacttcatgcccattt

SEQ ID NO: 500914 - DNA, 25 bp, Mus musculus
gataacttttccacttgagaactac

SEQ ID NO: 500915 - DNA, 25 bp, Mus musculus
gataacttttcctcttgagaactac

SEQ ID NO: 500916 - DNA, 25 bp, Mus musculus
gataactttttgagtagccagcctt

SEQ ID NO: 500917 - DNA, 25 bp, Mus musculus
gataactttttgtgtagccagcctt

SEQ ID NO: 500918 - DNA, 25 bp, Mus musculus
gataagaacatccatccccggcaga

SEQ ID NO: 500919 - DNA, 25 bp, Mus musculus
gataagaacatcgatccccggcaga

SEQ ID NO: 500920 - DNA, 25 bp, Mus musculus
gataagaacctcctccaactcgggc

SEQ ID NO: 500921 - DNA, 25 bp, Mus musculus
gataagaacctcgtccaactcgggc

SEQ ID NO: 500922 - DNA, 25 bp, Mus musculus
gataagaacggaatcagcttgggtt

SEQ ID NO: 500923 - DNA, 25 bp, Mus musculus
gataagaacggattcagcttgggtt

SEQ ID NO: 500924 - DNA, 25 bp, Mus musculus
gataagaagcctacagcttcaccct

SEQ ID NO: 500925 - DNA, 25 bp, Mus musculus
gataagaagccttcagcttcaccct

SEQ ID NO: 500926 - DNA, 25 bp, Mus musculus
gataagaaggccagactgtcactcc

SEQ ID NO: 500927 - DNA, 25 bp, Mus musculus
gataagaaggcctgactgtcactcc

SEQ ID NO: 500928 - DNA, 25 bp, Mus musculus
gataagaatattcacatttgggcta

SEQ ID NO: 500929 - DNA, 25 bp, Mus musculus
gataagaatattgacatttgggcta

SEQ ID NO: 500930 - DNA, 25 bp, Mus musculus
gataagacacctaacactcgatatg

SEQ ID NO: 500931 - DNA, 25 bp, Mus musculus
gataagacaccttacactcgatatg

SEQ ID NO: 500932 - DNA, 25 bp, Mus musculus
gataagacacttcgcatcctgctct

SEQ ID NO: 500933 - DNA, 25 bp, Mus musculus
gataagacacttggcatcctgctct

SEQ ID NO: 500934 - DNA, 25 bp, Mus musculus
gataagacccaactctgtgttgaca

SEQ ID NO: 500935 - DNA, 25 bp, Mus musculus
gataagacccaagtctgtgttgaca

SEQ ID NO: 500936 - DNA, 25 bp, Mus musculus
gataagaccggaagtcaagacactg

SEQ ID NO: 500937 - DNA, 25 bp, Mus musculus
gataagaccggatgtcaagacactg

SEQ ID NO: 500938 - DNA, 25 bp, Mus musculus
gataagactctgatgtctgctacaa

SEQ ID NO: 500939 - DNA, 25 bp, Mus musculus
gataagactctgttgtctgctacaa

SEQ ID NO: 500940 - DNA, 25 bp, Mus musculus
gataagactcttcagacttctgaaa

SEQ ID NO: 500941 - DNA, 25 bp, Mus musculus
gataagactcttgagacttctgaaa

SEQ ID NO: 500942 - DNA, 25 bp, Mus musculus
gataagagcacacgaaaggagaaca

SEQ ID NO: 500943 - DNA, 25 bp, Mus musculus
gataagagcacaggaaaggagaaca

SEQ ID NO: 500944 - DNA, 25 bp, Mus musculus
gataagagcagtagcctaccctgtg

SEQ ID NO: 500945 - DNA, 25 bp, Mus musculus
gataagagcagttgcctaccctgtg

SEQ ID NO: 500946 - DNA, 25 bp, Mus musculus
gataagaggttcagtgtccacatcc

SEQ ID NO: 500947 - DNA, 25 bp, Mus musculus
gataagaggttctgtgtccacatcc

SEQ ID NO: 500948 - DNA, 25 bp, Mus musculus
gataagagttcaaatccccggcact

SEQ ID NO: 500949 - DNA, 25 bp, Mus musculus
gataagagttcatatccccggcact

SEQ ID NO: 500950 - DNA, 25 bp, Mus musculus
gataagagttccatggtcccaaggt

SEQ ID NO: 500951 - DNA, 25 bp, Mus musculus
gataagagttccttggtcccaaggt

SEQ ID NO: 500952 - DNA, 25 bp, Mus musculus
gataagagttgcaggctaggcccat

SEQ ID NO: 500953 - DNA, 25 bp, Mus musculus
gataagagttgctggctaggcccat

SEQ ID NO: 500954 - DNA, 25 bp, Mus musculus
gataagatccacctactttttcagc

SEQ ID NO: 500955 - DNA, 25 bp, Mus musculus
gataagatccacgtactttttcagc

SEQ ID NO: 500956 - DNA, 25 bp, Mus musculus
gataagatcctgatccaactaaaga

SEQ ID NO: 500957 - DNA, 25 bp, Mus musculus
gataagatcctgttccaactaaaga

SEQ ID NO: 500958 - DNA, 25 bp, Mus musculus
gataagatccttctcagctgctatt

SEQ ID NO: 500959 - DNA, 25 bp, Mus musculus
gataagatccttgtcagctgctatt

SEQ ID NO: 500960 - DNA, 25 bp, Mus musculus
gataagatctcaataccaccaaaaa

SEQ ID NO: 500961 - DNA, 25 bp, Mus musculus
gataagatctcattaccaccaaaaa

SEQ ID NO: 500962 - DNA, 25 bp, Mus musculus
gataagatgtaacgcctgaagcttc

SEQ ID NO: 500963 - DNA, 25 bp, Mus musculus
gataagatgtaaggcctgaagcttc

SEQ ID NO: 500964 - DNA, 25 bp, Mus musculus
gataagatgtcacctaacttgcttt

SEQ ID NO: 500965 - DNA, 25 bp, Mus musculus
gataagatgtcagctaacttgcttt

SEQ ID NO: 500966 - DNA, 25 bp, Mus musculus
gataagatgttcacaagttgtcctc

SEQ ID NO: 500967 - DNA, 25 bp, Mus musculus
gataagatgttctcaagttgtcctc

SEQ ID NO: 500968 - DNA, 25 bp, Mus musculus
gataagattttgataccaagcagca

SEQ ID NO: 500969 - DNA, 25 bp, Mus musculus
gataagattttgttaccaagcagca

SEQ ID NO: 500970 - DNA, 25 bp, Mus musculus
gataagcaaccgagtatgctcctcg

SEQ ID NO: 500971 - DNA, 25 bp, Mus musculus
gataagcaaccgtgtatgctcctcg

SEQ ID NO: 500972 - DNA, 25 bp, Mus musculus
gataagcaactaaagcagcaccctg

SEQ ID NO: 500973 - DNA, 25 bp, Mus musculus
gataagcaactatagcagcaccctg

SEQ ID NO: 500974 - DNA, 25 bp, Mus musculus
gataagcaactgatgcacccatttt

SEQ ID NO: 500975 - DNA, 25 bp, Mus musculus
gataagcaactgttgcacccatttt

SEQ ID NO: 500976 - DNA, 25 bp, Mus musculus
gataagcaagtgataggcttcagga

SEQ ID NO: 500977 - DNA, 25 bp, Mus musculus
gataagcaagtgttaggcttcagga

SEQ ID NO: 500978 - DNA, 25 bp, Mus musculus
gataagcaattcatctaggccacga

SEQ ID NO: 500979 - DNA, 25 bp, Mus musculus
gataagcaattcttctaggccacga

SEQ ID NO: 500980 - DNA, 25 bp, Mus musculus
gataagcaatttccacgagaaccta

SEQ ID NO: 500981 - DNA, 25 bp, Mus musculus
gataagcaatttgcacgagaaccta

SEQ ID NO: 500982 - DNA, 25 bp, Mus musculus
gataagcacaccaggagtccacagt

SEQ ID NO: 500983 - DNA, 25 bp, Mus musculus
gataagcacacctggagtccacagt

SEQ ID NO: 500984 - DNA, 25 bp, Mus musculus
gataagcacagaccaaggtagccaa

SEQ ID NO: 500985 - DNA, 25 bp, Mus musculus
gataagcacagactatagcgcgtat

SEQ ID NO: 500986 - DNA, 25 bp, Mus musculus
gataagcacagagcaaggtagccaa

SEQ ID NO: 500987 - DNA, 25 bp, Mus musculus
gataagcacagagtatagcgcgtat

SEQ ID NO: 500988 - DNA, 25 bp, Mus musculus
gataagcaccaacatgtcagagtca

SEQ ID NO: 500989 - DNA, 25 bp, Mus musculus
gataagcaccaagatgtcagagtca

SEQ ID NO: 500990 - DNA, 25 bp, Mus musculus
gataagcaccctcatgttgtactcc

SEQ ID NO: 500991 - DNA, 25 bp, Mus musculus
gataagcaccctgatgttgtactcc

SEQ ID NO: 500992 - DNA, 25 bp, Mus musculus
gataagcacctgacaacattctaaa

SEQ ID NO: 500993 - DNA, 25 bp, Mus musculus
gataagcacctgtcaacattctaaa

SEQ ID NO: 500994 - DNA, 25 bp, Mus musculus
gataagcacgagcatagttctcatt

SEQ ID NO: 500995 - DNA, 25 bp, Mus musculus
gataagcacgaggatagttctcatt

SEQ ID NO: 500996 - DNA, 25 bp, Mus musculus
gataagcacggccaggctacagcgc

SEQ ID NO: 500997 - DNA, 25 bp, Mus musculus
gataagcacggcgaggctacagcgc

SEQ ID NO: 500998 - DNA, 25 bp, Mus musculus
gataagcactgcattgagctctatg

SEQ ID NO: 500999 - DNA, 25 bp, Mus musculus
gataagcactgctttgagctctatg

SEQ ID NO: 501000 - DNA, 25 bp, Mus musculus
gataagcactggcttgctgtcccct

SEQ ID NO: 501001 - DNA, 25 bp, Mus musculus
gataagcactgggttgctgtcccct

SEQ ID NO: 501002 - DNA, 25 bp, Mus musculus
gataagcagcacagggaggaacaga

SEQ ID NO: 501003 - DNA, 25 bp, Mus musculus
gataagcagcactgggaggaacaga

SEQ ID NO: 501004 - DNA, 25 bp, Mus musculus
gataagcagctgctctctataaaat

SEQ ID NO: 501005 - DNA, 25 bp, Mus musculus
gataagcagctggtctctataaaat

SEQ ID NO: 501006 - DNA, 25 bp, Mus musculus
gataagcaggaaatctccctcaaag

SEQ ID NO: 501007 - DNA, 25 bp, Mus musculus
gataagcaggaattctccctcaaag

SEQ ID NO: 501008 - DNA, 25 bp, Mus musculus
gataagcatatcattgtactttaaa

SEQ ID NO: 501009 - DNA, 25 bp, Mus musculus
gataagcatatctttgtactttaaa

SEQ ID NO: 501010 - DNA, 25 bp, Mus musculus
gataagcatgttatcccacacagaa

SEQ ID NO: 501011 - DNA, 25 bp, Mus musculus
gataagcatgttttcccacacagaa

SEQ ID NO: 501012 - DNA, 25 bp, Mus musculus
gataagcattagacagtctggaggc

SEQ ID NO: 501013 - DNA, 25 bp, Mus musculus
gataagcattagtcagtctggaggc

SEQ ID NO: 501014 - DNA, 25 bp, Mus musculus
gataagcattgccagtgtcaacaaa

SEQ ID NO: 501015 - DNA, 25 bp, Mus musculus
gataagcattgcgagtgtcaacaaa

SEQ ID NO: 501016 - DNA, 25 bp, Mus musculus
gataagccatccagagtagctgaaa

SEQ ID NO: 501017 - DNA, 25 bp, Mus musculus
gataagccatcctgagtagctgaaa

SEQ ID NO: 501018 - DNA, 25 bp, Mus musculus
gataagccccgtaggaggaagccct

SEQ ID NO: 501019 - DNA, 25 bp, Mus musculus
gataagccccgttggaggaagccct

SEQ ID NO: 501020 - DNA, 25 bp, Mus musculus
gataagccggtacctagccgaccag

SEQ ID NO: 501021 - DNA, 25 bp, Mus musculus
gataagccggtagctagccgaccag

SEQ ID NO: 501022 - DNA, 25 bp, Mus musculus
gataagcctgaacacagatgtgcct

SEQ ID NO: 501023 - DNA, 25 bp, Mus musculus
gataagcctgaagacagatgtgcct

SEQ ID NO: 501024 - DNA, 25 bp, Mus musculus
gataagcctgcaaagtctggccctg

SEQ ID NO: 501025 - DNA, 25 bp, Mus musculus
gataagcctgcatagtctggccctg

SEQ ID NO: 501026 - DNA, 25 bp, Mus musculus
gataagcctgtgattacagacccac

SEQ ID NO: 501027 - DNA, 25 bp, Mus musculus
gataagcctgtgtttacagacccac

SEQ ID NO: 501028 - DNA, 25 bp, Mus musculus
gataagccttacatcttggcagagg

SEQ ID NO: 501029 - DNA, 25 bp, Mus musculus
gataagccttaccagtgcaatgtat

SEQ ID NO: 501030 - DNA, 25 bp, Mus musculus
gataagccttacgagtgcaatgtat

SEQ ID NO: 501031 - DNA, 25 bp, Mus musculus
gataagccttacttcttggcagagg

SEQ ID NO: 501032 - DNA, 25 bp, Mus musculus
gataagcctttcctacagggctggg

SEQ ID NO: 501033 - DNA, 25 bp, Mus musculus
gataagcctttcgtacagggctggg

SEQ ID NO: 501034 - DNA, 25 bp, Mus musculus
gataagcgacaacactattcaccag

SEQ ID NO: 501035 - DNA, 25 bp, Mus musculus
gataagcgacaagactattcaccag

SEQ ID NO: 501036 - DNA, 25 bp, Mus musculus
gataagcgcacaaacagcactgttg

SEQ ID NO: 501037 - DNA, 25 bp, Mus musculus
gataagcgcacatacagcactgttg

SEQ ID NO: 501038 - DNA, 25 bp, Mus musculus
gataagcggagaacatcttccctct

SEQ ID NO: 501039 - DNA, 25 bp, Mus musculus
gataagcggagatcatcttccctct

SEQ ID NO: 501040 - DNA, 25 bp, Mus musculus
gataagctaacaagcactcccttct

SEQ ID NO: 501041 - DNA, 25 bp, Mus musculus
gataagctaacatgcactcccttct

SEQ ID NO: 501042 - DNA, 25 bp, Mus musculus
gataagctacttactaagtgccatg

SEQ ID NO: 501043 - DNA, 25 bp, Mus musculus
gataagctactttctaagtgccatg

SEQ ID NO: 501044 - DNA, 25 bp, Mus musculus
gataagctatgtcggctggactgcc

SEQ ID NO: 501045 - DNA, 25 bp, Mus musculus
gataagctatgtgggctggactgcc

SEQ ID NO: 501046 - DNA, 25 bp, Mus musculus
gataagctctgcaggatccaaggga

SEQ ID NO: 501047 - DNA, 25 bp, Mus musculus
gataagctctgctggatccaaggga

SEQ ID NO: 501048 - DNA, 25 bp, Mus musculus
gataagctgatgaagcccgaggaag

SEQ ID NO: 501049 - DNA, 25 bp, Mus musculus
gataagctgatgtagcccgaggaag

SEQ ID NO: 501050 - DNA, 25 bp, Mus musculus
gataagctgcccagactgtaggcaa

SEQ ID NO: 501051 - DNA, 25 bp, Mus musculus
gataagctgccctgactgtaggcaa

SEQ ID NO: 501052 - DNA, 25 bp, Mus musculus
gataagctgtgtctctcaatggtga

SEQ ID NO: 501053 - DNA, 25 bp, Mus musculus
gataagctgtgtgtctcaatggtga

SEQ ID NO: 501054 - DNA, 25 bp, Mus musculus
gataagcttaataaattgacagaca

SEQ ID NO: 501055 - DNA, 25 bp, Mus musculus
gataagcttaattaattgacagaca

SEQ ID NO: 501056 - DNA, 25 bp, Mus musculus
gataagcttactcgatgtcatctag

SEQ ID NO: 501057 - DNA, 25 bp, Mus musculus
gataagcttactggatgtcatctag

SEQ ID NO: 501058 - DNA, 25 bp, Mus musculus
gataagcttcacattgtcagatgta

SEQ ID NO: 501059 - DNA, 25 bp, Mus musculus
gataagcttcactttgtcagatgta

SEQ ID NO: 501060 - DNA, 25 bp, Mus musculus
gataagcttccacagcgacttggga

SEQ ID NO: 501061 - DNA, 25 bp, Mus musculus
gataagcttccagagcgacttggga

SEQ ID NO: 501062 - DNA, 25 bp, Mus musculus
gataagcttctgcagtatcacagga

SEQ ID NO: 501063 - DNA, 25 bp, Mus musculus
gataagcttctggagtatcacagga

SEQ ID NO: 501064 - DNA, 25 bp, Mus musculus
gataagcttgagcaatttacggcgt

SEQ ID NO: 501065 - DNA, 25 bp, Mus musculus
gataagcttgaggaatttacggcgt

SEQ ID NO: 501066 - DNA, 25 bp, Mus musculus
gataagctttctatccagtcactat

SEQ ID NO: 501067 - DNA, 25 bp, Mus musculus
gataagctttctttccagtcactat

SEQ ID NO: 501068 - DNA, 25 bp, Mus musculus
gataaggaaattattcagcacagga

SEQ ID NO: 501069 - DNA, 25 bp, Mus musculus
gataaggaaatttttcagcacagga

SEQ ID NO: 501070 - DNA, 25 bp, Mus musculus
gataaggaacacattacacaattta

SEQ ID NO: 501071 - DNA, 25 bp, Mus musculus
gataaggaacactttacacaattta

SEQ ID NO: 501072 - DNA, 25 bp, Mus musculus
gataaggaagctccagcgactgcaa

SEQ ID NO: 501073 - DNA, 25 bp, Mus musculus
gataaggaagctgcagcgactgcaa

SEQ ID NO: 501074 - DNA, 25 bp, Mus musculus
gataaggaattaatcccttgtttct

SEQ ID NO: 501075 - DNA, 25 bp, Mus musculus
gataaggaattattcccttgtttct

SEQ ID NO: 501076 - DNA, 25 bp, Mus musculus
gataaggacaggcacatttccatcc

SEQ ID NO: 501077 - DNA, 25 bp, Mus musculus
gataaggacagggacatttccatcc

SEQ ID NO: 501078 - DNA, 25 bp, Mus musculus
gataaggaccacatcaggcatcact

SEQ ID NO: 501079 - DNA, 25 bp, Mus musculus
gataaggaccacttcaggcatcact

SEQ ID NO: 501080 - DNA, 25 bp, Mus musculus
gataaggaccttactttgtcaggca

SEQ ID NO: 501081 - DNA, 25 bp, Mus musculus
gataaggacctttctttgtcaggca

SEQ ID NO: 501082 - DNA, 25 bp, Mus musculus
gataaggagagtactgtccctcacc

SEQ ID NO: 501083 - DNA, 25 bp, Mus musculus
gataaggagagttctgtccctcacc

SEQ ID NO: 501084 - DNA, 25 bp, Mus musculus
gataaggaggttagttcccatgtag

SEQ ID NO: 501085 - DNA, 25 bp, Mus musculus
gataaggaggtttgttcccatgtag

SEQ ID NO: 501086 - DNA, 25 bp, Mus musculus
gataaggatcatacaacttcatgtt

SEQ ID NO: 501087 - DNA, 25 bp, Mus musculus
gataaggatcattcaacttcatgtt

SEQ ID NO: 501088 - DNA, 25 bp, Mus musculus
gataaggatgaaagttccaaggaca

SEQ ID NO: 501089 - DNA, 25 bp, Mus musculus
gataaggatgaatgttccaaggaca

SEQ ID NO: 501090 - DNA, 25 bp, Mus musculus
gataaggattttaacagttcaatag

SEQ ID NO: 501091 - DNA, 25 bp, Mus musculus
gataaggatttttacagttcaatag

SEQ ID NO: 501092 - DNA, 25 bp, Mus musculus
gataaggcaatcacctattgtcaca

SEQ ID NO: 501093 - DNA, 25 bp, Mus musculus
gataaggcaatctcctattgtcaca

SEQ ID NO: 501094 - DNA, 25 bp, Mus musculus
gataaggcacttaccgtttttgcac

SEQ ID NO: 501095 - DNA, 25 bp, Mus musculus
gataaggcactttccgtttttgcac

SEQ ID NO: 501096 - DNA, 25 bp, Mus musculus
gataaggcagcgctctctcactggg

SEQ ID NO: 501097 - DNA, 25 bp, Mus musculus
gataaggcagcggtctctcactggg

SEQ ID NO: 501098 - DNA, 25 bp, Mus musculus
gataaggcaggtcgctgctccccaa

SEQ ID NO: 501099 - DNA, 25 bp, Mus musculus
gataaggcaggtggctgctccccaa

SEQ ID NO: 501100 - DNA, 25 bp, Mus musculus
gataaggccaagctatcaggcaact

SEQ ID NO: 501101 - DNA, 25 bp, Mus musculus
gataaggccaaggtatcaggcaact

SEQ ID NO: 501102 - DNA, 25 bp, Mus musculus
gataaggccttgctttcataaagta

SEQ ID NO: 501103 - DNA, 25 bp, Mus musculus
gataaggccttggtttcataaagta

SEQ ID NO: 501104 - DNA, 25 bp, Mus musculus
gataaggctatacactgtacatatt

SEQ ID NO: 501105 - DNA, 25 bp, Mus musculus
gataaggctatagactgtacatatt

SEQ ID NO: 501106 - DNA, 25 bp, Mus musculus
gataaggctcagaacattcactatt

SEQ ID NO: 501107 - DNA, 25 bp, Mus musculus
gataaggctcagtacattcactatt

SEQ ID NO: 501108 - DNA, 25 bp, Mus musculus
gataaggctgtaagtttctggaaca

SEQ ID NO: 501109 - DNA, 25 bp, Mus musculus
gataaggctgtatgtttctggaaca

SEQ ID NO: 501110 - DNA, 25 bp, Mus musculus
gataagggatatactgagattaaac

SEQ ID NO: 501111 - DNA, 25 bp, Mus musculus
gataagggatattctgagattaaac

SEQ ID NO: 501112 - DNA, 25 bp, Mus musculus
gataagggatcgaccgcgggcttta

SEQ ID NO: 501113 - DNA, 25 bp, Mus musculus
gataagggatcgtccgcgggcttta

SEQ ID NO: 501114 - DNA, 25 bp, Mus musculus
gataagggccagaagcgacttgcga

SEQ ID NO: 501115 - DNA, 25 bp, Mus musculus
gataagggccagtagcgacttgcga

SEQ ID NO: 501116 - DNA, 25 bp, Mus musculus
gataagggctgcatatgaactctaa

SEQ ID NO: 501117 - DNA, 25 bp, Mus musculus
gataagggctgcttatgaactctaa

SEQ ID NO: 501118 - DNA, 25 bp, Mus musculus
gataaggtcattctcacatcgaaac

SEQ ID NO: 501119 - DNA, 25 bp, Mus musculus
gataaggtcattgtcacatcgaaac

SEQ ID NO: 501120 - DNA, 25 bp, Mus musculus
gataaggtccatccttctataatat

SEQ ID NO: 501121 - DNA, 25 bp, Mus musculus
gataaggtccatgcttctataatat

SEQ ID NO: 501122 - DNA, 25 bp, Mus musculus
gataaggtctgtctgcgtctgttca

SEQ ID NO: 501123 - DNA, 25 bp, Mus musculus
gataaggtctgtgtgcgtctgttca

SEQ ID NO: 501124 - DNA, 25 bp, Mus musculus
gataaggtgctgctaccaaaccaga

SEQ ID NO: 501125 - DNA, 25 bp, Mus musculus
gataaggtgctggtaccaaaccaga

SEQ ID NO: 501126 - DNA, 25 bp, Mus musculus
gataaggttctgacccagatgggct

SEQ ID NO: 501127 - DNA, 25 bp, Mus musculus
gataaggttctgtcccagatgggct

SEQ ID NO: 501128 - DNA, 25 bp, Mus musculus
gataaggttgtgattgtacttgtgt

SEQ ID NO: 501129 - DNA, 25 bp, Mus musculus
gataaggttgtgtttgtacttgtgt

SEQ ID NO: 501130 - DNA, 25 bp, Mus musculus
gataaggtttgtacagactggtttg

SEQ ID NO: 501131 - DNA, 25 bp, Mus musculus
gataaggtttgttcagactggtttg

SEQ ID NO: 501132 - DNA, 25 bp, Mus musculus
gataagtactcacagggctacggat

SEQ ID NO: 501133 - DNA, 25 bp, Mus musculus
gataagtactcagagggctacggat

SEQ ID NO: 501134 - DNA, 25 bp, Mus musculus
gataagtactgtatacccttccata

SEQ ID NO: 501135 - DNA, 25 bp, Mus musculus
gataagtactgtttacccttccata

SEQ ID NO: 501136 - DNA, 25 bp, Mus musculus
gataagtagcttattacacttccaa

SEQ ID NO: 501137 - DNA, 25 bp, Mus musculus
gataagtagctttttacacttccaa

SEQ ID NO: 501138 - DNA, 25 bp, Mus musculus
gataagtagtccctccttctgctat

SEQ ID NO: 501139 - DNA, 25 bp, Mus musculus
gataagtagtccgtccttctgctat

SEQ ID NO: 501140 - DNA, 25 bp, Mus musculus
gataagtatgccagtaattacaata

SEQ ID NO: 501141 - DNA, 25 bp, Mus musculus
gataagtatgcctgtaattacaata

SEQ ID NO: 501142 - DNA, 25 bp, Mus musculus
gataagtatgttacttgcctcattg

SEQ ID NO: 501143 - DNA, 25 bp, Mus musculus
gataagtatgtttcttgcctcattg

SEQ ID NO: 501144 - DNA, 25 bp, Mus musculus
gataagtattctaagcactgagcca

SEQ ID NO: 501145 - DNA, 25 bp, Mus musculus
gataagtattcttagcactgagcca

SEQ ID NO: 501146 - DNA, 25 bp, Mus musculus
gataagtattgtaccttggtctctc

SEQ ID NO: 501147 - DNA, 25 bp, Mus musculus
gataagtattgttccttggtctctc

SEQ ID NO: 501148 - DNA, 25 bp, Mus musculus
gataagtatttgctactttcacttt

SEQ ID NO: 501149 - DNA, 25 bp, Mus musculus
gataagtatttggtactttcacttt

SEQ ID NO: 501150 - DNA, 25 bp, Mus musculus
gataagtcatatccaatgttcactg

SEQ ID NO: 501151 - DNA, 25 bp, Mus musculus
gataagtcatatgcaatgttcactg

SEQ ID NO: 501152 - DNA, 25 bp, Mus musculus
gataagtctaataacctgctttgaa

SEQ ID NO: 501153 - DNA, 25 bp, Mus musculus
gataagtctaattacctgctttgaa

SEQ ID NO: 501154 - DNA, 25 bp, Mus musculus
gataagtctagtatgtttgcctggg

SEQ ID NO: 501155 - DNA, 25 bp, Mus musculus
gataagtctagtttgtttgcctggg

SEQ ID NO: 501156 - DNA, 25 bp, Mus musculus
gataagtctatgcatgttaccctgt

SEQ ID NO: 501157 - DNA, 25 bp, Mus musculus
gataagtctatggatgttaccctgt

SEQ ID NO: 501158 - DNA, 25 bp, Mus musculus
gataagtctcggctttttccagctc

SEQ ID NO: 501159 - DNA, 25 bp, Mus musculus
gataagtctcgggtttttccagctc

SEQ ID NO: 501160 - DNA, 25 bp, Mus musculus
gataagtctcttataactatgccat

SEQ ID NO: 501161 - DNA, 25 bp, Mus musculus
gataagtctcttttaactatgccat

SEQ ID NO: 501162 - DNA, 25 bp, Mus musculus
gataagtctgtgcttttggaggaaa

SEQ ID NO: 501163 - DNA, 25 bp, Mus musculus
gataagtctgtggttttggaggaaa

SEQ ID NO: 501164 - DNA, 25 bp, Mus musculus
gataagtgcagcaccaccactcaaa

SEQ ID NO: 501165 - DNA, 25 bp, Mus musculus
gataagtgcagctccaccactcaaa

SEQ ID NO: 501166 - DNA, 25 bp, Mus musculus
gataagtgcatgcaggaccatgact

SEQ ID NO: 501167 - DNA, 25 bp, Mus musculus
gataagtgcatggaggaccatgact

SEQ ID NO: 501168 - DNA, 25 bp, Mus musculus
gataagtgctctataccaatgctcc

SEQ ID NO: 501169 - DNA, 25 bp, Mus musculus
gataagtgctctttaccaatgctcc

SEQ ID NO: 501170 - DNA, 25 bp, Mus musculus
gataagttacccattgaccttcact

SEQ ID NO: 501171 - DNA, 25 bp, Mus musculus
gataagttaccctttgaccttcact

SEQ ID NO: 501172 - DNA, 25 bp, Mus musculus
gataagttatctatgggcccaaaat

SEQ ID NO: 501173 - DNA, 25 bp, Mus musculus
gataagttatctttgggcccaaaat

SEQ ID NO: 501174 - DNA, 25 bp, Mus musculus
gataagttccttcctcttagagggt

SEQ ID NO: 501175 - DNA, 25 bp, Mus musculus
gataagttccttgctcttagagggt

SEQ ID NO: 501176 - DNA, 25 bp, Mus musculus
gataagttgctgcagaccttaccag

SEQ ID NO: 501177 - DNA, 25 bp, Mus musculus
gataagttgctggagaccttaccag

SEQ ID NO: 501178 - DNA, 25 bp, Mus musculus
gataagtttcaacggctctgtgtat

SEQ ID NO: 501179 - DNA, 25 bp, Mus musculus
gataagtttcaagggctctgtgtat

SEQ ID NO: 501180 - DNA, 25 bp, Mus musculus
gataataaaccacctctgaacctac

SEQ ID NO: 501181 - DNA, 25 bp, Mus musculus
gataataaaccagctctgaacctac

SEQ ID NO: 501182 - DNA, 25 bp, Mus musculus
gataataaagttcctctctgctctc

SEQ ID NO: 501183 - DNA, 25 bp, Mus musculus
gataataaagttgctctctgctctc

SEQ ID NO: 501184 - DNA, 25 bp, Mus musculus
gataataaccttcgagccgtttcaa

SEQ ID NO: 501185 - DNA, 25 bp, Mus musculus
gataataaccttggagccgtttcaa

SEQ ID NO: 501186 - DNA, 25 bp, Mus musculus
gataataatccaccagattctcatc

SEQ ID NO: 501187 - DNA, 25 bp, Mus musculus
gataataatccagcagattctcatc

SEQ ID NO: 501188 - DNA, 25 bp, Mus musculus
gataatacaccactacattctgtta

SEQ ID NO: 501189 - DNA, 25 bp, Mus musculus
gataatacaccagtacattctgtta

SEQ ID NO: 501190 - DNA, 25 bp, Mus musculus
gataatacctcactaatgctaccaa

SEQ ID NO: 501191 - DNA, 25 bp, Mus musculus
gataatacctcagtaatgctaccaa

SEQ ID NO: 501192 - DNA, 25 bp, Mus musculus
gataatacctttctaccttgacata

SEQ ID NO: 501193 - DNA, 25 bp, Mus musculus
gataatacctttgtaccttgacata

SEQ ID NO: 501194 - DNA, 25 bp, Mus musculus
gataatacggagcatgagtcaagtc

SEQ ID NO: 501195 - DNA, 25 bp, Mus musculus
gataatacggaggatgagtcaagtc

SEQ ID NO: 501196 - DNA, 25 bp, Mus musculus
gataatactaacatcctgggtttaa

SEQ ID NO: 501197 - DNA, 25 bp, Mus musculus
gataatactaacttcctgggtttaa

SEQ ID NO: 501198 - DNA, 25 bp, Mus musculus
gataatactgcaatctgcaccagtg

SEQ ID NO: 501199 - DNA, 25 bp, Mus musculus
gataatactgcattctgcaccagtg

SEQ ID NO: 501200 - DNA, 25 bp, Mus musculus
gataatactgtactgttcctgtgac

SEQ ID NO: 501201 - DNA, 25 bp, Mus musculus
gataatactgtagtgttcctgtgac

SEQ ID NO: 501202 - DNA, 25 bp, Mus musculus
gataatacttcactaacctacaaca

SEQ ID NO: 501203 - DNA, 25 bp, Mus musculus
gataatacttcagtaacctacaaca

SEQ ID NO: 501204 - DNA, 25 bp, Mus musculus
gataatacttggacccagaagcaca

SEQ ID NO: 501205 - DNA, 25 bp, Mus musculus
gataatacttggtcccagaagcaca

SEQ ID NO: 501206 - DNA, 25 bp, Mus musculus
gataatagccgaaaaagtccaaaat

SEQ ID NO: 501207 - DNA, 25 bp, Mus musculus
gataatagccgataaagtccaaaat

SEQ ID NO: 501208 - DNA, 25 bp, Mus musculus
gataataggaaacaccaaccttgga

SEQ ID NO: 501209 - DNA, 25 bp, Mus musculus
gataataggaaagaccaaccttgga

SEQ ID NO: 501210 - DNA, 25 bp, Mus musculus
gataatagtttccaagtactagtaa

SEQ ID NO: 501211 - DNA, 25 bp, Mus musculus
gataatagtttcgaagtactagtaa

SEQ ID NO: 501212 - DNA, 25 bp, Mus musculus
gataatatagtcactactcctgggt

SEQ ID NO: 501213 - DNA, 25 bp, Mus musculus
gataatatagtctctactcctgggt

SEQ ID NO: 501214 - DNA, 25 bp, Mus musculus
gataatatcaatcgttctcacattt

SEQ ID NO: 501215 - DNA, 25 bp, Mus musculus
gataatatcaatggttctcacattt

SEQ ID NO: 501216 - DNA, 25 bp, Mus musculus
gataatatccccacagtttgtactt

SEQ ID NO: 501217 - DNA, 25 bp, Mus musculus
gataatatcccctcagtttgtactt

SEQ ID NO: 501218 - DNA, 25 bp, Mus musculus
gataatatgaccaccgtgggcattt

SEQ ID NO: 501219 - DNA, 25 bp, Mus musculus
gataatatgacctccgtgggcattt

SEQ ID NO: 501220 - DNA, 25 bp, Mus musculus
gataatatgactctctgtagcccag

SEQ ID NO: 501221 - DNA, 25 bp, Mus musculus
gataatatgactgtctgtagcccag

SEQ ID NO: 501222 - DNA, 25 bp, Mus musculus
gataatatgcgaattcatcctatgt

SEQ ID NO: 501223 - DNA, 25 bp, Mus musculus
gataatatgcgatttcatcctatgt

SEQ ID NO: 501224 - DNA, 25 bp, Mus musculus
gataatatgctgattgatactcaaa

SEQ ID NO: 501225 - DNA, 25 bp, Mus musculus
gataatatgctgtttgatactcaaa

SEQ ID NO: 501226 - DNA, 25 bp, Mus musculus
gataatatgcttcgatctaacacaa

SEQ ID NO: 501227 - DNA, 25 bp, Mus musculus
gataatatgcttggatctaacacaa

SEQ ID NO: 501228 - DNA, 25 bp, Mus musculus
gataatattgttcatctcactgaac

SEQ ID NO: 501229 - DNA, 25 bp, Mus musculus
gataatattgttgatctcactgaac

SEQ ID NO: 501230 - DNA, 25 bp, Mus musculus
gataatatttgactcctactgtaaa

SEQ ID NO: 501231 - DNA, 25 bp, Mus musculus
gataatatttgagtcctactgtaaa

SEQ ID NO: 501232 - DNA, 25 bp, Mus musculus
gataatcaagagacccgtaacgggc

SEQ ID NO: 501233 - DNA, 25 bp, Mus musculus
gataatcaagagtcccgtaacgggc

SEQ ID NO: 501234 - DNA, 25 bp, Mus musculus
gataatcacaaaacctctgtctcta

SEQ ID NO: 501235 - DNA, 25 bp, Mus musculus
gataatcacaaatcctctgtctcta

SEQ ID NO: 501236 - DNA, 25 bp, Mus musculus
gataatcacacaatcacaagggtta

SEQ ID NO: 501237 - DNA, 25 bp, Mus musculus
gataatcacacattcacaagggtta

SEQ ID NO: 501238 - DNA, 25 bp, Mus musculus
gataatcactgacctgctggtcaat

SEQ ID NO: 501239 - DNA, 25 bp, Mus musculus
gataatcactgacgtctatcctacc

SEQ ID NO: 501240 - DNA, 25 bp, Mus musculus
gataatcactgagctgctggtcaat

SEQ ID NO: 501241 - DNA, 25 bp, Mus musculus
gataatcactgaggtctatcctacc

SEQ ID NO: 501242 - DNA, 25 bp, Mus musculus
gataatcagacaagcggagaaggct

SEQ ID NO: 501243 - DNA, 25 bp, Mus musculus
gataatcagacatgcggagaaggct

SEQ ID NO: 501244 - DNA, 25 bp, Mus musculus
gataatcaggccattctttatttta

SEQ ID NO: 501245 - DNA, 25 bp, Mus musculus
gataatcaggcctttctttatttta

SEQ ID NO: 501246 - DNA, 25 bp, Mus musculus
gataatcatctgcacgacattcgga

SEQ ID NO: 501247 - DNA, 25 bp, Mus musculus
gataatcatctggacgacattcgga

SEQ ID NO: 501248 - DNA, 25 bp, Mus musculus
gataatcatttcattgcagcttgtc

SEQ ID NO: 501249 - DNA, 25 bp, Mus musculus
gataatcatttctttgcagcttgtc

SEQ ID NO: 501250 - DNA, 25 bp, Mus musculus
gataatccatacatcacagtgcaac

SEQ ID NO: 501251 - DNA, 25 bp, Mus musculus
gataatccatacttcacagtgcaac

SEQ ID NO: 501252 - DNA, 25 bp, Mus musculus
gataatcccagaatcccttgtgaat

SEQ ID NO: 501253 - DNA, 25 bp, Mus musculus
gataatcccagaatggtaccagaaa

SEQ ID NO: 501254 - DNA, 25 bp, Mus musculus
gataatcccagattcccttgtgaat

SEQ ID NO: 501255 - DNA, 25 bp, Mus musculus
gataatcccagattggtaccagaaa

SEQ ID NO: 501256 - DNA, 25 bp, Mus musculus
gataatccggaaacctatccagttc

SEQ ID NO: 501257 - DNA, 25 bp, Mus musculus
gataatccggaatcctatccagttc

SEQ ID NO: 501258 - DNA, 25 bp, Mus musculus
gataatcctaaacaatggccaactt

SEQ ID NO: 501259 - DNA, 25 bp, Mus musculus
gataatcctaaagaatggccaactt

SEQ ID NO: 501260 - DNA, 25 bp, Mus musculus
gataatcctcaaaaggccttcagct

SEQ ID NO: 501261 - DNA, 25 bp, Mus musculus
gataatcctcaacttcttaaaggca

SEQ ID NO: 501262 - DNA, 25 bp, Mus musculus
gataatcctcaagttcttaaaggca

SEQ ID NO: 501263 - DNA, 25 bp, Mus musculus
gataatcctcaataggccttcagct

SEQ ID NO: 501264 - DNA, 25 bp, Mus musculus
gataatcctgcacttgatggcacaa

SEQ ID NO: 501265 - DNA, 25 bp, Mus musculus
gataatcctgcagttgatggcacaa

SEQ ID NO: 501266 - DNA, 25 bp, Mus musculus
gataatccttctatggtatcatggg

SEQ ID NO: 501267 - DNA, 25 bp, Mus musculus
gataatccttctttggtatcatggg

SEQ ID NO: 501268 - DNA, 25 bp, Mus musculus
gataatcgaattcacagagcccgct

SEQ ID NO: 501269 - DNA, 25 bp, Mus musculus
gataatcgaattgacagagcccgct

SEQ ID NO: 501270 - DNA, 25 bp, Mus musculus
gataatcggtatccagtagcctact

SEQ ID NO: 501271 - DNA, 25 bp, Mus musculus
gataatcggtatgcagtagcctact

SEQ ID NO: 501272 - DNA, 25 bp, Mus musculus
gataatcgtcgaaatgtactagtga

SEQ ID NO: 501273 - DNA, 25 bp, Mus musculus
gataatcgtcgatatgtactagtga

SEQ ID NO: 501274 - DNA, 25 bp, Mus musculus
gataatcgtgttcggcaagaacctt

SEQ ID NO: 501275 - DNA, 25 bp, Mus musculus
gataatcgtgttgggcaagaacctt

SEQ ID NO: 501276 - DNA, 25 bp, Mus musculus
gataatctactcatttctaccaagt

SEQ ID NO: 501277 - DNA, 25 bp, Mus musculus
gataatctactcttttctaccaagt

SEQ ID NO: 501278 - DNA, 25 bp, Mus musculus
gataatctatttactggcacacaaa

SEQ ID NO: 501279 - DNA, 25 bp, Mus musculus
gataatctattttctggcacacaaa

SEQ ID NO: 501280 - DNA, 25 bp, Mus musculus
gataatctcaagagcaaacatcttt

SEQ ID NO: 501281 - DNA, 25 bp, Mus musculus
gataatctcaagtgcaaacatcttt

SEQ ID NO: 501282 - DNA, 25 bp, Mus musculus
gataatctcaggagcaatgctgcag

SEQ ID NO: 501283 - DNA, 25 bp, Mus musculus
gataatctcaggtgcaatgctgcag

SEQ ID NO: 501284 - DNA, 25 bp, Mus musculus
gataatctcattatagttctgcaaa

SEQ ID NO: 501285 - DNA, 25 bp, Mus musculus
gataatctcattttagttctgcaaa

SEQ ID NO: 501286 - DNA, 25 bp, Mus musculus
gataatctcctcagactatgcctat

SEQ ID NO: 501287 - DNA, 25 bp, Mus musculus
gataatctcctctgactatgcctat

SEQ ID NO: 501288 - DNA, 25 bp, Mus musculus
gataatctgaatacccaagtgccag

SEQ ID NO: 501289 - DNA, 25 bp, Mus musculus
gataatctgaattcccaagtgccag

SEQ ID NO: 501290 - DNA, 25 bp, Mus musculus
gataatctgccgctgttctatgaac

SEQ ID NO: 501291 - DNA, 25 bp, Mus musculus
gataatctgccggtgttctatgaac

SEQ ID NO: 501292 - DNA, 25 bp, Mus musculus
gataatcttattacaagtcgccgtg

SEQ ID NO: 501293 - DNA, 25 bp, Mus musculus
gataatcttatttcaagtcgccgtg

SEQ ID NO: 501294 - DNA, 25 bp, Mus musculus
gataatcttgataatacttaacagt

SEQ ID NO: 501295 - DNA, 25 bp, Mus musculus
gataatcttgattatacttaacagt

SEQ ID NO: 501296 - DNA, 25 bp, Mus musculus
gataatcttggactggcaacaaaag

SEQ ID NO: 501297 - DNA, 25 bp, Mus musculus
gataatcttggagtggcaacaaaag

SEQ ID NO: 501298 - DNA, 25 bp, Mus musculus
gataatctttaacgacatttaagga

SEQ ID NO: 501299 - DNA, 25 bp, Mus musculus
gataatctttaaggacatttaagga

SEQ ID NO: 501300 - DNA, 25 bp, Mus musculus
gataatctttggaactccggaacaa

SEQ ID NO: 501301 - DNA, 25 bp, Mus musculus
gataatctttggtactccggaacaa

SEQ ID NO: 501302 - DNA, 25 bp, Mus musculus
gataatgaacaccaagacctacctg

SEQ ID NO: 501303 - DNA, 25 bp, Mus musculus
gataatgaacacgaagacctacctg

SEQ ID NO: 501304 - DNA, 25 bp, Mus musculus
gataatgaatccctcaaactgccct

SEQ ID NO: 501305 - DNA, 25 bp, Mus musculus
gataatgaatccgtcaaactgccct

SEQ ID NO: 501306 - DNA, 25 bp, Mus musculus
gataatgaccacagctcagcgagag

SEQ ID NO: 501307 - DNA, 25 bp, Mus musculus
gataatgaccactgctcagcgagag

SEQ ID NO: 501308 - DNA, 25 bp, Mus musculus
gataatgaccatcctgttggccaaa

SEQ ID NO: 501309 - DNA, 25 bp, Mus musculus
gataatgaccatgctgttggccaaa

SEQ ID NO: 501310 - DNA, 25 bp, Mus musculus
gataatgaccctaaccatggtgata

SEQ ID NO: 501311 - DNA, 25 bp, Mus musculus
gataatgacccttaccatggtgata

SEQ ID NO: 501312 - DNA, 25 bp, Mus musculus
gataatgaccggcaactctccaaag

SEQ ID NO: 501313 - DNA, 25 bp, Mus musculus
gataatgaccgggaactctccaaag

SEQ ID NO: 501314 - DNA, 25 bp, Mus musculus
gataatgacttgctgatagacctcc

SEQ ID NO: 501315 - DNA, 25 bp, Mus musculus
gataatgacttggtgatagacctcc

SEQ ID NO: 501316 - DNA, 25 bp, Mus musculus
gataatgagaacatctgcacccagg

SEQ ID NO: 501317 - DNA, 25 bp, Mus musculus
gataatgagaacttctgcacccagg

SEQ ID NO: 501318 - DNA, 25 bp, Mus musculus
gataatgagccaaactgctccccag

SEQ ID NO: 501319 - DNA, 25 bp, Mus musculus
gataatgagccatactgctccccag

SEQ ID NO: 501320 - DNA, 25 bp, Mus musculus
gataatgaggttaacccagtgctgt

SEQ ID NO: 501321 - DNA, 25 bp, Mus musculus
gataatgaggtttacccagtgctgt

SEQ ID NO: 501322 - DNA, 25 bp, Mus musculus
gataatgatattatgttacagtgtc

SEQ ID NO: 501323 - DNA, 25 bp, Mus musculus
gataatgatattttgttacagtgtc

SEQ ID NO: 501324 - DNA, 25 bp, Mus musculus
gataatgatgaacctctcttgagtg

SEQ ID NO: 501325 - DNA, 25 bp, Mus musculus
gataatgatgaagctctcttgagtg

SEQ ID NO: 501326 - DNA, 25 bp, Mus musculus
gataatgcagatcaccctggcaccc

SEQ ID NO: 501327 - DNA, 25 bp, Mus musculus
gataatgcagatgaccctggcaccc

SEQ ID NO: 501328 - DNA, 25 bp, Mus musculus
gataatgcagcccacaggtacatag

SEQ ID NO: 501329 - DNA, 25 bp, Mus musculus
gataatgcagccgacaggtacatag

SEQ ID NO: 501330 - DNA, 25 bp, Mus musculus
gataatgcagtccagttccttgaac

SEQ ID NO: 501331 - DNA, 25 bp, Mus musculus
gataatgcagtcgagttccttgaac

SEQ ID NO: 501332 - DNA, 25 bp, Mus musculus
gataatgcagtgaatttggtaaagt

SEQ ID NO: 501333 - DNA, 25 bp, Mus musculus
gataatgcagtgtatttggtaaagt

SEQ ID NO: 501334 - DNA, 25 bp, Mus musculus
gataatgcgtacatcggtgtcactt

SEQ ID NO: 501335 - DNA, 25 bp, Mus musculus
gataatgcgtacttcggtgtcactt

SEQ ID NO: 501336 - DNA, 25 bp, Mus musculus
gataatgctatcagcggctggacat

SEQ ID NO: 501337 - DNA, 25 bp, Mus musculus
gataatgctatctgcggctggacat

SEQ ID NO: 501338 - DNA, 25 bp, Mus musculus
gataatgctcttaatcattactagg

SEQ ID NO: 501339 - DNA, 25 bp, Mus musculus
gataatgctctttatcattactagg

SEQ ID NO: 501340 - DNA, 25 bp, Mus musculus
gataatgctgagcttaccctcaatg

SEQ ID NO: 501341 - DNA, 25 bp, Mus musculus
gataatgctgaggttaccctcaatg

SEQ ID NO: 501342 - DNA, 25 bp, Mus musculus
gataatgctggtacagtgtctgaat

SEQ ID NO: 501343 - DNA, 25 bp, Mus musculus
gataatgctggttcagtgtctgaat

SEQ ID NO: 501344 - DNA, 25 bp, Mus musculus
gataatgctgtgatcctgcacccag

SEQ ID NO: 501345 - DNA, 25 bp, Mus musculus
gataatgctgtgttcctgcacccag

SEQ ID NO: 501346 - DNA, 25 bp, Mus musculus
gataatgcttgaactgagttgatac

SEQ ID NO: 501347 - DNA, 25 bp, Mus musculus
gataatgcttgatctgagttgatac

SEQ ID NO: 501348 - DNA, 25 bp, Mus musculus
gataatgcttgtacctaaagtttgt

SEQ ID NO: 501349 - DNA, 25 bp, Mus musculus
gataatgcttgttcctaaagtttgt

SEQ ID NO: 501350 - DNA, 25 bp, Mus musculus
gataatgctttaaagattttacaat

SEQ ID NO: 501351 - DNA, 25 bp, Mus musculus
gataatgctttatagattttacaat

SEQ ID NO: 501352 - DNA, 25 bp, Mus musculus
gataatggaaccatagctcccacct

SEQ ID NO: 501353 - DNA, 25 bp, Mus musculus
gataatggaaccttagctcccacct

SEQ ID NO: 501354 - DNA, 25 bp, Mus musculus
gataatggaataagctagatgctat

SEQ ID NO: 501355 - DNA, 25 bp, Mus musculus
gataatggaatatgctagatgctat

SEQ ID NO: 501356 - DNA, 25 bp, Mus musculus
gataatggatggaccccaacaaaac

SEQ ID NO: 501357 - DNA, 25 bp, Mus musculus
gataatggatggtccccaacaaaac

SEQ ID NO: 501358 - DNA, 25 bp, Mus musculus
gataatggattgcacatagactaag

SEQ ID NO: 501359 - DNA, 25 bp, Mus musculus
gataatggattggacatagactaag

SEQ ID NO: 501360 - DNA, 25 bp, Mus musculus
gataatggcaacctgactggagtat

SEQ ID NO: 501361 - DNA, 25 bp, Mus musculus
gataatggcaacgtgactggagtat

SEQ ID NO: 501362 - DNA, 25 bp, Mus musculus
gataatgggatgatgctaccacaag

SEQ ID NO: 501363 - DNA, 25 bp, Mus musculus
gataatgggatgttgctaccacaag

SEQ ID NO: 501364 - DNA, 25 bp, Mus musculus
gataatgggcacagctgccagccaa

SEQ ID NO: 501365 - DNA, 25 bp, Mus musculus
gataatgggcactgctgccagccaa

SEQ ID NO: 501366 - DNA, 25 bp, Mus musculus
gataatggtattccctcttttacaa

SEQ ID NO: 501367 - DNA, 25 bp, Mus musculus
gataatggtattgcctcttttacaa

SEQ ID NO: 501368 - DNA, 25 bp, Mus musculus
gataatggtcctactgggatgttca

SEQ ID NO: 501369 - DNA, 25 bp, Mus musculus
gataatggtccttctgggatgttca

SEQ ID NO: 501370 - DNA, 25 bp, Mus musculus
gataatggtgtcaacctcacatccg

SEQ ID NO: 501371 - DNA, 25 bp, Mus musculus
gataatggtgtctacctcacatccg

SEQ ID NO: 501372 - DNA, 25 bp, Mus musculus
gataatgtaacacttgggaccaaat

SEQ ID NO: 501373 - DNA, 25 bp, Mus musculus
gataatgtaacagttgggaccaaat

SEQ ID NO: 501374 - DNA, 25 bp, Mus musculus
gataatgtaggcacctcttctagag

SEQ ID NO: 501375 - DNA, 25 bp, Mus musculus
gataatgtaggctcctcttctagag

SEQ ID NO: 501376 - DNA, 25 bp, Mus musculus
gataatgtcagtctattagctgcct

SEQ ID NO: 501377 - DNA, 25 bp, Mus musculus
gataatgtcagtgtattagctgcct

SEQ ID NO: 501378 - DNA, 25 bp, Mus musculus
gataatgtcctacctcaaaagtcag

SEQ ID NO: 501379 - DNA, 25 bp, Mus musculus
gataatgtcctagctcaaaagtcag

SEQ ID NO: 501380 - DNA, 25 bp, Mus musculus
gataatgtcctcatcagttggaaca

SEQ ID NO: 501381 - DNA, 25 bp, Mus musculus
gataatgtcctcttcagttggaaca

SEQ ID NO: 501382 - DNA, 25 bp, Mus musculus
gataatgtctaaactctatttggat

SEQ ID NO: 501383 - DNA, 25 bp, Mus musculus
gataatgtctaatctctatttggat

SEQ ID NO: 501384 - DNA, 25 bp, Mus musculus
gataatgtgcctaatagtcttggaa

SEQ ID NO: 501385 - DNA, 25 bp, Mus musculus
gataatgtgcctccttttgcacagt

SEQ ID NO: 501386 - DNA, 25 bp, Mus musculus
gataatgtgcctgcttttgcacagt

SEQ ID NO: 501387 - DNA, 25 bp, Mus musculus
gataatgtgccttatagtcttggaa

SEQ ID NO: 501388 - DNA, 25 bp, Mus musculus
gataatgtgcttattgagtgataaa

SEQ ID NO: 501389 - DNA, 25 bp, Mus musculus
gataatgtgctttttgagtgataaa

SEQ ID NO: 501390 - DNA, 25 bp, Mus musculus
gataatgttatcacttctgggtttt

SEQ ID NO: 501391 - DNA, 25 bp, Mus musculus
gataatgttatctcttctgggtttt

SEQ ID NO: 501392 - DNA, 25 bp, Mus musculus
gataatgttattaagcccctctgtc

SEQ ID NO: 501393 - DNA, 25 bp, Mus musculus
gataatgttatttagcccctctgtc

SEQ ID NO: 501394 - DNA, 25 bp, Mus musculus
gataatgttgggactttgatttcac

SEQ ID NO: 501395 - DNA, 25 bp, Mus musculus
gataatgttgggtctttgatttcac

SEQ ID NO: 501396 - DNA, 25 bp, Mus musculus
gataatgtttgtcgatgttgagaac

SEQ ID NO: 501397 - DNA, 25 bp, Mus musculus
gataatgtttgtggatgttgagaac

SEQ ID NO: 501398 - DNA, 25 bp, Mus musculus
gataatgttttgcactttttcgtac

SEQ ID NO: 501399 - DNA, 25 bp, Mus musculus
gataatgttttggactttttcgtac

SEQ ID NO: 501400 - DNA, 25 bp, Mus musculus
gataattaaagccatctgcgtcttg

SEQ ID NO: 501401 - DNA, 25 bp, Mus musculus
gataattaaagcgatctgcgtcttg

SEQ ID NO: 501402 - DNA, 25 bp, Mus musculus
gataattaacttaggagcggtttgt

SEQ ID NO: 501403 - DNA, 25 bp, Mus musculus
gataattaactttggagcggtttgt

SEQ ID NO: 501404 - DNA, 25 bp, Mus musculus
gataattaagttatctccctgtact

SEQ ID NO: 501405 - DNA, 25 bp, Mus musculus
gataattaagttttctccctgtact

SEQ ID NO: 501406 - DNA, 25 bp, Mus musculus
gataattacagcctctttcagtttg

SEQ ID NO: 501407 - DNA, 25 bp, Mus musculus
gataattacagcgtctttcagtttg

SEQ ID NO: 501408 - DNA, 25 bp, Mus musculus
gataattacattaaccagttcaaga

SEQ ID NO: 501409 - DNA, 25 bp, Mus musculus
gataattacatttaccagttcaaga

SEQ ID NO: 501410 - DNA, 25 bp, Mus musculus
gataattacctcatatctacgtgaa

SEQ ID NO: 501411 - DNA, 25 bp, Mus musculus
gataattacctcttatctacgtgaa

SEQ ID NO: 501412 - DNA, 25 bp, Mus musculus
gataattactccattgcttgcttgt

SEQ ID NO: 501413 - DNA, 25 bp, Mus musculus
gataattactcctttgcttgcttgt

SEQ ID NO: 501414 - DNA, 25 bp, Mus musculus
gataattacttcctcttatttcaaa

SEQ ID NO: 501415 - DNA, 25 bp, Mus musculus
gataattacttccttaggtcgcctt

SEQ ID NO: 501416 - DNA, 25 bp, Mus musculus
gataattacttcgtcttatttcaaa

SEQ ID NO: 501417 - DNA, 25 bp, Mus musculus
gataattacttcgttaggtcgcctt

SEQ ID NO: 501418 - DNA, 25 bp, Mus musculus
gataattagcatccatcttaccctt

SEQ ID NO: 501419 - DNA, 25 bp, Mus musculus
gataattagcatgcatcttaccctt

SEQ ID NO: 501420 - DNA, 25 bp, Mus musculus
gataattagccaagggttccccaga

SEQ ID NO: 501421 - DNA, 25 bp, Mus musculus
gataattagccacgaagtgtttccc

SEQ ID NO: 501422 - DNA, 25 bp, Mus musculus
gataattagccaggaagtgtttccc

SEQ ID NO: 501423 - DNA, 25 bp, Mus musculus
gataattagccatgggttccccaga

SEQ ID NO: 501424 - DNA, 25 bp, Mus musculus
gataattatggaagctaacagtctt

SEQ ID NO: 501425 - DNA, 25 bp, Mus musculus
gataattatggatgctaacagtctt

SEQ ID NO: 501426 - DNA, 25 bp, Mus musculus
gataattcaagtctgcctagggcta

SEQ ID NO: 501427 - DNA, 25 bp, Mus musculus
gataattcaagtgtgcctagggcta

SEQ ID NO: 501428 - DNA, 25 bp, Mus musculus
gataattcagagcacccagcaaaat

SEQ ID NO: 501429 - DNA, 25 bp, Mus musculus
gataattcagaggacccagcaaaat

SEQ ID NO: 501430 - DNA, 25 bp, Mus musculus
gataattcctacactctgtggaggt

SEQ ID NO: 501431 - DNA, 25 bp, Mus musculus
gataattcctactctctgtggaggt

SEQ ID NO: 501432 - DNA, 25 bp, Mus musculus
gataattcggtccataaagccatgt

SEQ ID NO: 501433 - DNA, 25 bp, Mus musculus
gataattcggtcgataaagccatgt

SEQ ID NO: 501434 - DNA, 25 bp, Mus musculus
gataattctacacccacagctctgg

SEQ ID NO: 501435 - DNA, 25 bp, Mus musculus
gataattctacagccacagctctgg

SEQ ID NO: 501436 - DNA, 25 bp, Mus musculus
gataattctgctaaattttggctga

SEQ ID NO: 501437 - DNA, 25 bp, Mus musculus
gataattctgcttaattttggctga

SEQ ID NO: 501438 - DNA, 25 bp, Mus musculus
gataattctggtatcatgcagtaat

SEQ ID NO: 501439 - DNA, 25 bp, Mus musculus
gataattctggtttcatgcagtaat

SEQ ID NO: 501440 - DNA, 25 bp, Mus musculus
gataattgagttacccttagtaata

SEQ ID NO: 501441 - DNA, 25 bp, Mus musculus
gataattgagtttcccttagtaata

SEQ ID NO: 501442 - DNA, 25 bp, Mus musculus
gataattgcacacagattttacata

SEQ ID NO: 501443 - DNA, 25 bp, Mus musculus
gataattgcacagagattttacata

SEQ ID NO: 501444 - DNA, 25 bp, Mus musculus
gataattgctatcctgtgattgctt

SEQ ID NO: 501445 - DNA, 25 bp, Mus musculus
gataattgctatgctgtgattgctt

SEQ ID NO: 501446 - DNA, 25 bp, Mus musculus
gataattggcaacagagtccttctc

SEQ ID NO: 501447 - DNA, 25 bp, Mus musculus
gataattggcaagagagtccttctc

SEQ ID NO: 501448 - DNA, 25 bp, Mus musculus
gataattgtactaactctcacatgt

SEQ ID NO: 501449 - DNA, 25 bp, Mus musculus
gataattgtacttactctcacatgt

SEQ ID NO: 501450 - DNA, 25 bp, Mus musculus
gataattgtcacatatttctgtgtg

SEQ ID NO: 501451 - DNA, 25 bp, Mus musculus
gataattgtcacttatttctgtgtg

SEQ ID NO: 501452 - DNA, 25 bp, Mus musculus
gataattgtcccatttttagagtca

SEQ ID NO: 501453 - DNA, 25 bp, Mus musculus
gataattgtcccttttttagagtca

SEQ ID NO: 501454 - DNA, 25 bp, Mus musculus
gataatttacgtccattccaagttg

SEQ ID NO: 501455 - DNA, 25 bp, Mus musculus
gataatttacgtgcattccaagttg

SEQ ID NO: 501456 - DNA, 25 bp, Mus musculus
gataatttagctccctactctgttt

SEQ ID NO: 501457 - DNA, 25 bp, Mus musculus
gataatttagctgcctactctgttt

SEQ ID NO: 501458 - DNA, 25 bp, Mus musculus
gataatttatcaactccatcttctg

SEQ ID NO: 501459 - DNA, 25 bp, Mus musculus
gataatttatcatctccatcttctg

SEQ ID NO: 501460 - DNA, 25 bp, Mus musculus
gataatttcaaccaatactacccag

SEQ ID NO: 501461 - DNA, 25 bp, Mus musculus
gataatttcaacgaatactacccag

SEQ ID NO: 501462 - DNA, 25 bp, Mus musculus
gataatttcaatctccttggctccc

SEQ ID NO: 501463 - DNA, 25 bp, Mus musculus
gataatttcaatgtccttggctccc

SEQ ID NO: 501464 - DNA, 25 bp, Mus musculus
gataatttcagaccgcctaccaagg

SEQ ID NO: 501465 - DNA, 25 bp, Mus musculus
gataatttcagagcgcctaccaagg

SEQ ID NO: 501466 - DNA, 25 bp, Mus musculus
gataatttctcacctatagacttaa

SEQ ID NO: 501467 - DNA, 25 bp, Mus musculus
gataatttctcagctatagacttaa

SEQ ID NO: 501468 - DNA, 25 bp, Mus musculus
gataatttctggatgcatcctttgt

SEQ ID NO: 501469 - DNA, 25 bp, Mus musculus
gataatttctggttgcatcctttgt

SEQ ID NO: 501470 - DNA, 25 bp, Mus musculus
gataatttctttactcaatgttcaa

SEQ ID NO: 501471 - DNA, 25 bp, Mus musculus
gataatttcttttctcaatgttcaa

SEQ ID NO: 501472 - DNA, 25 bp, Mus musculus
gataatttgtccacctagtttctgt

SEQ ID NO: 501473 - DNA, 25 bp, Mus musculus
gataatttgtcctcctagtttctgt

SEQ ID NO: 501474 - DNA, 25 bp, Mus musculus
gataatttgtggatttctgtaccgt

SEQ ID NO: 501475 - DNA, 25 bp, Mus musculus
gataatttgtggttttctgtaccgt

SEQ ID NO: 501476 - DNA, 25 bp, Mus musculus
gataattttaagaaagcccagccta

SEQ ID NO: 501477 - DNA, 25 bp, Mus musculus
gataattttaagtaagcccagccta

SEQ ID NO: 501478 - DNA, 25 bp, Mus musculus
gataattttacacattcaatcgtct

SEQ ID NO: 501479 - DNA, 25 bp, Mus musculus
gataattttacagattcaatcgtct

SEQ ID NO: 501480 - DNA, 25 bp, Mus musculus
gataattttggcatttcattctgaa

SEQ ID NO: 501481 - DNA, 25 bp, Mus musculus
gataattttggcttttcattctgaa

SEQ ID NO: 501482 - DNA, 25 bp, Mus musculus
gataattttggtacttggttagtat

SEQ ID NO: 501483 - DNA, 25 bp, Mus musculus
gataattttggtcctcatgtgtttt

SEQ ID NO: 501484 - DNA, 25 bp, Mus musculus
gataattttggtgctcatgtgtttt

SEQ ID NO: 501485 - DNA, 25 bp, Mus musculus
gataattttggttcttggttagtat

SEQ ID NO: 501486 - DNA, 25 bp, Mus musculus
gataattttttccaagactccttct

SEQ ID NO: 501487 - DNA, 25 bp, Mus musculus
gataattttttcgaagactccttct

SEQ ID NO: 501488 - DNA, 25 bp, Mus musculus
gatacaaaagccactactcctcagt

SEQ ID NO: 501489 - DNA, 25 bp, Mus musculus
gatacaaaagcctctactcctcagt

SEQ ID NO: 501490 - DNA, 25 bp, Mus musculus
gatacaaaaggccttcacctcattg

SEQ ID NO: 501491 - DNA, 25 bp, Mus musculus
gatacaaaaggcgttcacctcattg

SEQ ID NO: 501492 - DNA, 25 bp, Mus musculus
gatacaaacaggaaactgcttcttg

SEQ ID NO: 501493 - DNA, 25 bp, Mus musculus
gatacaaacaggcatggcagactct

SEQ ID NO: 501494 - DNA, 25 bp, Mus musculus
gatacaaacagggatggcagactct

SEQ ID NO: 501495 - DNA, 25 bp, Mus musculus
gatacaaacaggtaactgcttcttg

SEQ ID NO: 501496 - DNA, 25 bp, Mus musculus
gatacaaacccgcaagtgctttagc

SEQ ID NO: 501497 - DNA, 25 bp, Mus musculus
gatacaaacccggaagtgctttagc

SEQ ID NO: 501498 - DNA, 25 bp, Mus musculus
gatacaaaccttcttttcttcctga

SEQ ID NO: 501499 - DNA, 25 bp, Mus musculus
gatacaaaccttgttttcttcctga

SEQ ID NO: 501500 - DNA, 25 bp, Mus musculus
gatacaaagctaatcccatctcgtc

SEQ ID NO: 501501 - DNA, 25 bp, Mus musculus
gatacaaagctattcccatctcgtc

SEQ ID NO: 501502 - DNA, 25 bp, Mus musculus
gatacaaagtacaagagcgatcact

SEQ ID NO: 501503 - DNA, 25 bp, Mus musculus
gatacaaagtactagagcgatcact

SEQ ID NO: 501504 - DNA, 25 bp, Mus musculus
gatacaaatgctagcctggatcttt

SEQ ID NO: 501505 - DNA, 25 bp, Mus musculus
gatacaaatgcttgcctggatcttt

SEQ ID NO: 501506 - DNA, 25 bp, Mus musculus
gatacaacagaaatcttgtcatggc

SEQ ID NO: 501507 - DNA, 25 bp, Mus musculus
gatacaacagaattcttgtcatggc

SEQ ID NO: 501508 - DNA, 25 bp, Mus musculus
gatacaacctagaaaatggtacctt

SEQ ID NO: 501509 - DNA, 25 bp, Mus musculus
gatacaacctagtaaatggtacctt

SEQ ID NO: 501510 - DNA, 25 bp, Mus musculus
gatacaacctcacgtctgggtgttc

SEQ ID NO: 501511 - DNA, 25 bp, Mus musculus
gatacaacctcaggtctgggtgttc

SEQ ID NO: 501512 - DNA, 25 bp, Mus musculus
gatacaaccttcaatttatgcactt

SEQ ID NO: 501513 - DNA, 25 bp, Mus musculus
gatacaaccttctatttatgcactt

SEQ ID NO: 501514 - DNA, 25 bp, Mus musculus
gatacaactcccacatacaaacatg

SEQ ID NO: 501515 - DNA, 25 bp, Mus musculus
gatacaactccctcatacaaacatg

SEQ ID NO: 501516 - DNA, 25 bp, Mus musculus
gatacaactgcgctgggatcccaca

SEQ ID NO: 501517 - DNA, 25 bp, Mus musculus
gatacaactgcggtgggatcccaca

SEQ ID NO: 501518 - DNA, 25 bp, Mus musculus
gatacaacttcacaacggtttccgt

SEQ ID NO: 501519 - DNA, 25 bp, Mus musculus
gatacaacttcagaacggtttccgt

SEQ ID NO: 501520 - DNA, 25 bp, Mus musculus
gatacaactttcactcctgtaagac

SEQ ID NO: 501521 - DNA, 25 bp, Mus musculus
gatacaactttctctcctgtaagac

SEQ ID NO: 501522 - DNA, 25 bp, Mus musculus
gatacaagccttctgatcactgagg

SEQ ID NO: 501523 - DNA, 25 bp, Mus musculus
gatacaagccttgtgatcactgagg

SEQ ID NO: 501524 - DNA, 25 bp, Mus musculus
gatacaagctacacaactgggctta

SEQ ID NO: 501525 - DNA, 25 bp, Mus musculus
gatacaagctactcaactgggctta

SEQ ID NO: 501526 - DNA, 25 bp, Mus musculus
gatacaagctgtcgctactgaagcc

SEQ ID NO: 501527 - DNA, 25 bp, Mus musculus
gatacaagctgtggctactgaagcc

SEQ ID NO: 501528 - DNA, 25 bp, Mus musculus
gatacaaggtctctctttgcctggg

SEQ ID NO: 501529 - DNA, 25 bp, Mus musculus
gatacaaggtctgtctttgcctggg

SEQ ID NO: 501530 - DNA, 25 bp, Mus musculus
gatacaagtatcaagtgaacctgga

SEQ ID NO: 501531 - DNA, 25 bp, Mus musculus
gatacaagtatctagtgaacctgga

SEQ ID NO: 501532 - DNA, 25 bp, Mus musculus
gatacaagttctacgaggtcctcgg

SEQ ID NO: 501533 - DNA, 25 bp, Mus musculus
gatacaagttcttcgaggtcctcgg

SEQ ID NO: 501534 - DNA, 25 bp, Mus musculus
gatacaagttgcctcacgctaacag

SEQ ID NO: 501535 - DNA, 25 bp, Mus musculus
gatacaagttgcgtcacgctaacag

SEQ ID NO: 501536 - DNA, 25 bp, Mus musculus
gatacaatatcaccaccagtaactt

SEQ ID NO: 501537 - DNA, 25 bp, Mus musculus
gatacaatatcagcaccagtaactt

SEQ ID NO: 501538 - DNA, 25 bp, Mus musculus
gatacaatcaatacataggcttctt

SEQ ID NO: 501539 - DNA, 25 bp, Mus musculus
gatacaatcaattcataggcttctt

SEQ ID NO: 501540 - DNA, 25 bp, Mus musculus
gatacaatcattagttccctcacgg

SEQ ID NO: 501541 - DNA, 25 bp, Mus musculus
gatacaatcattctccctggagtag

SEQ ID NO: 501542 - DNA, 25 bp, Mus musculus
gatacaatcattgtccctggagtag

SEQ ID NO: 501543 - DNA, 25 bp, Mus musculus
gatacaatcatttgttccctcacgg

SEQ ID NO: 501544 - DNA, 25 bp, Mus musculus
gatacaatctcaagatctgcctggc

SEQ ID NO: 501545 - DNA, 25 bp, Mus musculus
gatacaatctcatgatctgcctggc

SEQ ID NO: 501546 - DNA, 25 bp, Mus musculus
gatacaatctctacctgtcacttat

SEQ ID NO: 501547 - DNA, 25 bp, Mus musculus
gatacaatctcttcctgtcacttat

SEQ ID NO: 501548 - DNA, 25 bp, Mus musculus
gatacaatgatcaccagttcttggg

SEQ ID NO: 501549 - DNA, 25 bp, Mus musculus
gatacaatgatctccagttcttggg

SEQ ID NO: 501550 - DNA, 25 bp, Mus musculus
gatacaatgattactgctcacagca

SEQ ID NO: 501551 - DNA, 25 bp, Mus musculus
gatacaatgatttctgctcacagca

SEQ ID NO: 501552 - DNA, 25 bp, Mus musculus
gatacaatgctaacatgtgtcacca

SEQ ID NO: 501553 - DNA, 25 bp, Mus musculus
gatacaatgctatcatgtgtcacca

SEQ ID NO: 501554 - DNA, 25 bp, Mus musculus
gatacaatttgtctgtactgtactt

SEQ ID NO: 501555 - DNA, 25 bp, Mus musculus
gatacaatttgtgtgtactgtactt

SEQ ID NO: 501556 - DNA, 25 bp, Mus musculus
gatacacaaccaccacttgcagttt

SEQ ID NO: 501557 - DNA, 25 bp, Mus musculus
gatacacaaccagcacttgcagttt

SEQ ID NO: 501558 - DNA, 25 bp, Mus musculus
gatacacaactaattgaggtttaca

SEQ ID NO: 501559 - DNA, 25 bp, Mus musculus
gatacacaactatttgaggtttaca

SEQ ID NO: 501560 - DNA, 25 bp, Mus musculus
gatacacaccatacacagcatgtct

SEQ ID NO: 501561 - DNA, 25 bp, Mus musculus
gatacacaccattcacagcatgtct

SEQ ID NO: 501562 - DNA, 25 bp, Mus musculus
gatacacacgtgcatatgaatgttt

SEQ ID NO: 501563 - DNA, 25 bp, Mus musculus
gatacacacgtggatatgaatgttt

SEQ ID NO: 501564 - DNA, 25 bp, Mus musculus
gatacacacttgactgttagagagc

SEQ ID NO: 501565 - DNA, 25 bp, Mus musculus
gatacacacttgtctgttagagagc

SEQ ID NO: 501566 - DNA, 25 bp, Mus musculus
gatacacagacaaaccagccgtata

SEQ ID NO: 501567 - DNA, 25 bp, Mus musculus
gatacacagacataccagccgtata

SEQ ID NO: 501568 - DNA, 25 bp, Mus musculus
gatacacagctgatttacataagtt

SEQ ID NO: 501569 - DNA, 25 bp, Mus musculus
gatacacagctgttttacataagtt

SEQ ID NO: 501570 - DNA, 25 bp, Mus musculus
gatacacaggacatcagcaaccaca

SEQ ID NO: 501571 - DNA, 25 bp, Mus musculus
gatacacaggacttcagcaaccaca

SEQ ID NO: 501572 - DNA, 25 bp, Mus musculus
gatacacaggagcaactgacccaaa

SEQ ID NO: 501573 - DNA, 25 bp, Mus musculus
gatacacaggaggaactgacccaaa

SEQ ID NO: 501574 - DNA, 25 bp, Mus musculus
gatacacaggcacctggacttctgt

SEQ ID NO: 501575 - DNA, 25 bp, Mus musculus
gatacacaggcagctggacttctgt

SEQ ID NO: 501576 - DNA, 25 bp, Mus musculus
gatacacaggctctcagtgataccc

SEQ ID NO: 501577 - DNA, 25 bp, Mus musculus
gatacacaggctgtcagtgataccc

SEQ ID NO: 501578 - DNA, 25 bp, Mus musculus
gatacacaggttcctattcctcaag

SEQ ID NO: 501579 - DNA, 25 bp, Mus musculus
gatacacaggttgctattcctcaag

SEQ ID NO: 501580 - DNA, 25 bp, Mus musculus
gatacacagtatagcatgtgccgag

SEQ ID NO: 501581 - DNA, 25 bp, Mus musculus
gatacacagtattgcatgtgccgag

SEQ ID NO: 501582 - DNA, 25 bp, Mus musculus
gatacacagtgcaaatcatatggat

SEQ ID NO: 501583 - DNA, 25 bp, Mus musculus
gatacacagtgctaatcatatggat

SEQ ID NO: 501584 - DNA, 25 bp, Mus musculus
gatacacagttcaagtaatctataa

SEQ ID NO: 501585 - DNA, 25 bp, Mus musculus
gatacacagttcatcaagacacctg

SEQ ID NO: 501586 - DNA, 25 bp, Mus musculus
gatacacagttctagtaatctataa

SEQ ID NO: 501587 - DNA, 25 bp, Mus musculus
gatacacagttcttcaagacacctg

SEQ ID NO: 501588 - DNA, 25 bp, Mus musculus
gatacacagtttcctgtcattactg

SEQ ID NO: 501589 - DNA, 25 bp, Mus musculus
gatacacagtttgctgtcattactg

SEQ ID NO: 501590 - DNA, 25 bp, Mus musculus
gatacacataaccacatagttttct

SEQ ID NO: 501591 - DNA, 25 bp, Mus musculus
gatacacataacgacatagttttct

SEQ ID NO: 501592 - DNA, 25 bp, Mus musculus
gatacacataagcatgctcacttgg

SEQ ID NO: 501593 - DNA, 25 bp, Mus musculus
gatacacataaggatgctcacttgg

SEQ ID NO: 501594 - DNA, 25 bp, Mus musculus
gatacacatcatctcgtcttcacac

SEQ ID NO: 501595 - DNA, 25 bp, Mus musculus
gatacacatcatgtcgtcttcacac

SEQ ID NO: 501596 - DNA, 25 bp, Mus musculus
gatacacatgcgataatatttcata

SEQ ID NO: 501597 - DNA, 25 bp, Mus musculus
gatacacatgcgttaatatttcata

SEQ ID NO: 501598 - DNA, 25 bp, Mus musculus
gatacacatgtcaagattgttctaa

SEQ ID NO: 501599 - DNA, 25 bp, Mus musculus
gatacacatgtctagattgttctaa

SEQ ID NO: 501600 - DNA, 25 bp, Mus musculus
gatacaccaggcagtgcatgtcatt

SEQ ID NO: 501601 - DNA, 25 bp, Mus musculus
gatacaccaggctgtgcatgtcatt

SEQ ID NO: 501602 - DNA, 25 bp, Mus musculus
gatacacccaacagcatggtagcca

SEQ ID NO: 501603 - DNA, 25 bp, Mus musculus
gatacacccaactgcatggtagcca

SEQ ID NO: 501604 - DNA, 25 bp, Mus musculus
gatacaccccaaaagtcctggaaga

SEQ ID NO: 501605 - DNA, 25 bp, Mus musculus
gatacaccccaatagtcctggaaga

SEQ ID NO: 501606 - DNA, 25 bp, Mus musculus
gatacaccctggaatattagccctg

SEQ ID NO: 501607 - DNA, 25 bp, Mus musculus
gatacaccctggtatattagccctg

SEQ ID NO: 501608 - DNA, 25 bp, Mus musculus
gatacaccgaacctatttattctgg

SEQ ID NO: 501609 - DNA, 25 bp, Mus musculus
gatacaccgaacgtatttattctgg

SEQ ID NO: 501610 - DNA, 25 bp, Mus musculus
gatacacctcaaaggtaacttggat

SEQ ID NO: 501611 - DNA, 25 bp, Mus musculus
gatacacctcaatggtaacttggat

SEQ ID NO: 501612 - DNA, 25 bp, Mus musculus
gatacacctgtcagatagtccagca

SEQ ID NO: 501613 - DNA, 25 bp, Mus musculus
gatacacctgtctgatagtccagca

SEQ ID NO: 501614 - DNA, 25 bp, Mus musculus
gatacaccttccaatgtggacatcc

SEQ ID NO: 501615 - DNA, 25 bp, Mus musculus
gatacaccttcctatgtggacatcc

SEQ ID NO: 501616 - DNA, 25 bp, Mus musculus
gatacacgagttaatactgaaattc

SEQ ID NO: 501617 - DNA, 25 bp, Mus musculus
gatacacgagtttatactgaaattc

SEQ ID NO: 501618 - DNA, 25 bp, Mus musculus
gatacacgcggcagtttctatctgt

SEQ ID NO: 501619 - DNA, 25 bp, Mus musculus
gatacacgcggctgtttctatctgt

SEQ ID NO: 501620 - DNA, 25 bp, Mus musculus
gatacacgggagatgatcaacaaca

SEQ ID NO: 501621 - DNA, 25 bp, Mus musculus
gatacacgggagttgatcaacaaca

SEQ ID NO: 501622 - DNA, 25 bp, Mus musculus
gatacacgtcaccaaactatctgtg

SEQ ID NO: 501623 - DNA, 25 bp, Mus musculus
gatacacgtcacgaaactatctgtg

SEQ ID NO: 501624 - DNA, 25 bp, Mus musculus
gatacacgtgctcatgcaggcagaa

SEQ ID NO: 501625 - DNA, 25 bp, Mus musculus
gatacacgtgctgatgcaggcagaa

SEQ ID NO: 501626 - DNA, 25 bp, Mus musculus
gatacacgtgtaaggctactctatg

SEQ ID NO: 501627 - DNA, 25 bp, Mus musculus
gatacacgtgtatggctactctatg

SEQ ID NO: 501628 - DNA, 25 bp, Mus musculus
gatacactaaacacagactcccatg

SEQ ID NO: 501629 - DNA, 25 bp, Mus musculus
gatacactaaactcagactcccatg

SEQ ID NO: 501630 - DNA, 25 bp, Mus musculus
gatacactaaggataactcatagcc

SEQ ID NO: 501631 - DNA, 25 bp, Mus musculus
gatacactaaggttaactcatagcc

SEQ ID NO: 501632 - DNA, 25 bp, Mus musculus
gatacactacagaggatctgccagt

SEQ ID NO: 501633 - DNA, 25 bp, Mus musculus
gatacactacagtggatctgccagt

SEQ ID NO: 501634 - DNA, 25 bp, Mus musculus
gatacactaccaaacataccacctt

SEQ ID NO: 501635 - DNA, 25 bp, Mus musculus
gatacactaccatacataccacctt

SEQ ID NO: 501636 - DNA, 25 bp, Mus musculus
gatacactagcaatttttaacaggg

SEQ ID NO: 501637 - DNA, 25 bp, Mus musculus
gatacactagcattttttaacaggg

SEQ ID NO: 501638 - DNA, 25 bp, Mus musculus
gatacactcagaaatccttgtcatt

SEQ ID NO: 501639 - DNA, 25 bp, Mus musculus
gatacactcagatatccttgtcatt

SEQ ID NO: 501640 - DNA, 25 bp, Mus musculus
gatacactcgacatttctgcataca

SEQ ID NO: 501641 - DNA, 25 bp, Mus musculus
gatacactcgacttttctgcataca

SEQ ID NO: 501642 - DNA, 25 bp, Mus musculus
gatacactgaaccaagactcctaca

SEQ ID NO: 501643 - DNA, 25 bp, Mus musculus
gatacactgaacgaagactcctaca

SEQ ID NO: 501644 - DNA, 25 bp, Mus musculus
gatacactgaccctcataatactca

SEQ ID NO: 501645 - DNA, 25 bp, Mus musculus
gatacactgaccgtcataatactca

SEQ ID NO: 501646 - DNA, 25 bp, Mus musculus
gatacactggtacacatgctgtaga

SEQ ID NO: 501647 - DNA, 25 bp, Mus musculus
gatacactggtagacatgctgtaga

SEQ ID NO: 501648 - DNA, 25 bp, Mus musculus
gatacactgtggagcttttcataga

SEQ ID NO: 501649 - DNA, 25 bp, Mus musculus
gatacactgtggtgcttttcataga

SEQ ID NO: 501650 - DNA, 25 bp, Mus musculus
gatacacttacaatttcctttgagg

SEQ ID NO: 501651 - DNA, 25 bp, Mus musculus
gatacacttacattttcctttgagg

SEQ ID NO: 501652 - DNA, 25 bp, Mus musculus
gatacacttcccatgttctgtagct

SEQ ID NO: 501653 - DNA, 25 bp, Mus musculus
gatacacttcccttgttctgtagct

SEQ ID NO: 501654 - DNA, 25 bp, Mus musculus
gatacacttgctaatacagacctgg

SEQ ID NO: 501655 - DNA, 25 bp, Mus musculus
gatacacttgcttatacagacctgg

SEQ ID NO: 501656 - DNA, 25 bp, Mus musculus
gatacacttggcatgatacttgctt

SEQ ID NO: 501657 - DNA, 25 bp, Mus musculus
gatacacttggcttgatacttgctt

SEQ ID NO: 501658 - DNA, 25 bp, Mus musculus
gatacacttggtaatacagcatcag

SEQ ID NO: 501659 - DNA, 25 bp, Mus musculus
gatacacttggttatacagcatcag

SEQ ID NO: 501660 - DNA, 25 bp, Mus musculus
gatacacttttgagctattctgggc

SEQ ID NO: 501661 - DNA, 25 bp, Mus musculus
gatacacttttgtgctattctgggc

SEQ ID NO: 501662 - DNA, 25 bp, Mus musculus
gatacagaagcactgggtgagtccc

SEQ ID NO: 501663 - DNA, 25 bp, Mus musculus
gatacagaagcagtgggtgagtccc

SEQ ID NO: 501664 - DNA, 25 bp, Mus musculus
gatacagaagctactggaattcggg

SEQ ID NO: 501665 - DNA, 25 bp, Mus musculus
gatacagaagcttctggaattcggg

SEQ ID NO: 501666 - DNA, 25 bp, Mus musculus
gatacagacatcaagatttggatat

SEQ ID NO: 501667 - DNA, 25 bp, Mus musculus
gatacagacatcaccgcagtcttct

SEQ ID NO: 501668 - DNA, 25 bp, Mus musculus
gatacagacatctagatttggatat

SEQ ID NO: 501669 - DNA, 25 bp, Mus musculus
gatacagacatctccgcagtcttct

SEQ ID NO: 501670 - DNA, 25 bp, Mus musculus
gatacagacgctcgaactctgccgg

SEQ ID NO: 501671 - DNA, 25 bp, Mus musculus
gatacagacgctggaactctgccgg

SEQ ID NO: 501672 - DNA, 25 bp, Mus musculus
gatacagagacaaaggcgccaggga

SEQ ID NO: 501673 - DNA, 25 bp, Mus musculus
gatacagagacataggcgccaggga

SEQ ID NO: 501674 - DNA, 25 bp, Mus musculus
gatacagagcacagcagcatctcaa

SEQ ID NO: 501675 - DNA, 25 bp, Mus musculus
gatacagagcactgcagcatctcaa

SEQ ID NO: 501676 - DNA, 25 bp, Mus musculus
gatacagaggttagctttcacaaaa

SEQ ID NO: 501677 - DNA, 25 bp, Mus musculus
gatacagaggtttgctttcacaaaa

SEQ ID NO: 501678 - DNA, 25 bp, Mus musculus
gatacagagtctacagcagtttcag

SEQ ID NO: 501679 - DNA, 25 bp, Mus musculus
gatacagagtcttcagcagtttcag

SEQ ID NO: 501680 - DNA, 25 bp, Mus musculus
gatacagatgcaaacccgttttata

SEQ ID NO: 501681 - DNA, 25 bp, Mus musculus
gatacagatgcatacccgttttata

SEQ ID NO: 501682 - DNA, 25 bp, Mus musculus
gatacagattctaggtgtgcatcac

SEQ ID NO: 501683 - DNA, 25 bp, Mus musculus
gatacagattcttggtgtgcatcac

SEQ ID NO: 501684 - DNA, 25 bp, Mus musculus
gatacagattggaacaaatgaagtt

SEQ ID NO: 501685 - DNA, 25 bp, Mus musculus
gatacagattggtacaaatgaagtt

SEQ ID NO: 501686 - DNA, 25 bp, Mus musculus
gatacagcaagaacacctggccaca

SEQ ID NO: 501687 - DNA, 25 bp, Mus musculus
gatacagcaagatcacctggccaca

SEQ ID NO: 501688 - DNA, 25 bp, Mus musculus
gatacagcagagaccaaacattttt

SEQ ID NO: 501689 - DNA, 25 bp, Mus musculus
gatacagcagagtccaaacattttt

SEQ ID NO: 501690 - DNA, 25 bp, Mus musculus
gatacagcatgccttaaggctctga

SEQ ID NO: 501691 - DNA, 25 bp, Mus musculus
gatacagcatgcgttaaggctctga

SEQ ID NO: 501692 - DNA, 25 bp, Mus musculus
gatacagcatggatctgaccccaaa

SEQ ID NO: 501693 - DNA, 25 bp, Mus musculus
gatacagcatggttctgaccccaaa

SEQ ID NO: 501694 - DNA, 25 bp, Mus musculus
gatacagcattcacagcgagtcgcg

SEQ ID NO: 501695 - DNA, 25 bp, Mus musculus
gatacagcattcattagccttgttt

SEQ ID NO: 501696 - DNA, 25 bp, Mus musculus
gatacagcattctcagcgagtcgcg

SEQ ID NO: 501697 - DNA, 25 bp, Mus musculus
gatacagcattctttagccttgttt

SEQ ID NO: 501698 - DNA, 25 bp, Mus musculus
gatacagcatttcttttctaaacct

SEQ ID NO: 501699 - DNA, 25 bp, Mus musculus
gatacagcatttgttttctaaacct

SEQ ID NO: 501700 - DNA, 25 bp, Mus musculus
gatacagccagtcagtctacactag

SEQ ID NO: 501701 - DNA, 25 bp, Mus musculus
gatacagccagtgagtctacactag

SEQ ID NO: 501702 - DNA, 25 bp, Mus musculus
gatacagccggaacacaaactcgta

SEQ ID NO: 501703 - DNA, 25 bp, Mus musculus
gatacagccggatcacaaactcgta

SEQ ID NO: 501704 - DNA, 25 bp, Mus musculus
gatacagccggtctttgctttctta

SEQ ID NO: 501705 - DNA, 25 bp, Mus musculus
gatacagccggtgtttgctttctta

SEQ ID NO: 501706 - DNA, 25 bp, Mus musculus
gatacagcctaaatatcccaggatt

SEQ ID NO: 501707 - DNA, 25 bp, Mus musculus
gatacagcctaattatcccaggatt

SEQ ID NO: 501708 - DNA, 25 bp, Mus musculus
gatacagcctggatgaggtctgctt

SEQ ID NO: 501709 - DNA, 25 bp, Mus musculus
gatacagcctggttgaggtctgctt

SEQ ID NO: 501710 - DNA, 25 bp, Mus musculus
gatacagcctgtaacccactggaac

SEQ ID NO: 501711 - DNA, 25 bp, Mus musculus
gatacagcctgttacccactggaac

SEQ ID NO: 501712 - DNA, 25 bp, Mus musculus
gatacagcgggcacgtgaccgactc

SEQ ID NO: 501713 - DNA, 25 bp, Mus musculus
gatacagcgggctcgtgaccgactc

SEQ ID NO: 501714 - DNA, 25 bp, Mus musculus
gatacagcgtttcggatttgatatt

SEQ ID NO: 501715 - DNA, 25 bp, Mus musculus
gatacagcgtttgggatttgatatt

SEQ ID NO: 501716 - DNA, 25 bp, Mus musculus
gatacagctagaaccacaggccaat

SEQ ID NO: 501717 - DNA, 25 bp, Mus musculus
gatacagctagatccacaggccaat

SEQ ID NO: 501718 - DNA, 25 bp, Mus musculus
gatacagcttatactgctgccacag

SEQ ID NO: 501719 - DNA, 25 bp, Mus musculus
gatacagcttattctgctgccacag

SEQ ID NO: 501720 - DNA, 25 bp, Mus musculus
gatacaggacatagcatggttctaa

SEQ ID NO: 501721 - DNA, 25 bp, Mus musculus
gatacaggacatatgcgcactagat

SEQ ID NO: 501722 - DNA, 25 bp, Mus musculus
gatacaggacattgcatggttctaa

SEQ ID NO: 501723 - DNA, 25 bp, Mus musculus
gatacaggacatttgcgcactagat

SEQ ID NO: 501724 - DNA, 25 bp, Mus musculus
gatacaggacctaggagaaattagg

SEQ ID NO: 501725 - DNA, 25 bp, Mus musculus
gatacaggaccttggagaaattagg

SEQ ID NO: 501726 - DNA, 25 bp, Mus musculus
gatacaggacttacaacagtaccga

SEQ ID NO: 501727 - DNA, 25 bp, Mus musculus
gatacaggactttcaacagtaccga

SEQ ID NO: 501728 - DNA, 25 bp, Mus musculus
gatacaggagtcatggttttttgga

SEQ ID NO: 501729 - DNA, 25 bp, Mus musculus
gatacaggagtcttggttttttgga

SEQ ID NO: 501730 - DNA, 25 bp, Mus musculus
gatacaggattcagtaccctggttg

SEQ ID NO: 501731 - DNA, 25 bp, Mus musculus
gatacaggattctgtaccctggttg

SEQ ID NO: 501732 - DNA, 25 bp, Mus musculus
gatacaggcaggcagcatgctgctc

SEQ ID NO: 501733 - DNA, 25 bp, Mus musculus
gatacaggcagggagcatgctgctc

SEQ ID NO: 501734 - DNA, 25 bp, Mus musculus
gatacaggccatcggcaatggcaat

SEQ ID NO: 501735 - DNA, 25 bp, Mus musculus
gatacaggccatgggcaatggcaat

SEQ ID NO: 501736 - DNA, 25 bp, Mus musculus
gatacaggccccatgtgtatggatt

SEQ ID NO: 501737 - DNA, 25 bp, Mus musculus
gatacaggccccttgtgtatggatt

SEQ ID NO: 501738 - DNA, 25 bp, Mus musculus
gatacaggcctaacttggagactga

SEQ ID NO: 501739 - DNA, 25 bp, Mus musculus
gatacaggcctatcttggagactga

SEQ ID NO: 501740 - DNA, 25 bp, Mus musculus
gatacagggcagagtgacggtcaca

SEQ ID NO: 501741 - DNA, 25 bp, Mus musculus
gatacagggcagtgtgacggtcaca

SEQ ID NO: 501742 - DNA, 25 bp, Mus musculus
gatacagggttcagcccactaaaaa

SEQ ID NO: 501743 - DNA, 25 bp, Mus musculus
gatacagggttctgcccactaaaaa

SEQ ID NO: 501744 - DNA, 25 bp, Mus musculus
gatacaggtaacaatcccactgatt

SEQ ID NO: 501745 - DNA, 25 bp, Mus musculus
gatacaggtaactatcccactgatt

SEQ ID NO: 501746 - DNA, 25 bp, Mus musculus
gatacaggtgtaatatactgccaaa

SEQ ID NO: 501747 - DNA, 25 bp, Mus musculus
gatacaggtgtattatactgccaaa

SEQ ID NO: 501748 - DNA, 25 bp, Mus musculus
gatacaggttaaactgaatcagcgt

SEQ ID NO: 501749 - DNA, 25 bp, Mus musculus
gatacaggttaatctgaatcagcgt

SEQ ID NO: 501750 - DNA, 25 bp, Mus musculus
gatacagtacagacttaatccataa

SEQ ID NO: 501751 - DNA, 25 bp, Mus musculus
gatacagtacagtcttaatccataa

SEQ ID NO: 501752 - DNA, 25 bp, Mus musculus
gatacagtatgtcacagttactatg

SEQ ID NO: 501753 - DNA, 25 bp, Mus musculus
gatacagtatgtgacagttactatg

SEQ ID NO: 501754 - DNA, 25 bp, Mus musculus
gatacagtccagctattcagacagc

SEQ ID NO: 501755 - DNA, 25 bp, Mus musculus
gatacagtccaggtattcagacagc

SEQ ID NO: 501756 - DNA, 25 bp, Mus musculus
gatacagtcctacggtaaggtgctt

SEQ ID NO: 501757 - DNA, 25 bp, Mus musculus
gatacagtcctagggtaaggtgctt

SEQ ID NO: 501758 - DNA, 25 bp, Mus musculus
gatacagtctgcctcatagttctat

SEQ ID NO: 501759 - DNA, 25 bp, Mus musculus
gatacagtctgcgtcatagttctat

SEQ ID NO: 501760 - DNA, 25 bp, Mus musculus
gatacagtctgtaatcatggtgaac

SEQ ID NO: 501761 - DNA, 25 bp, Mus musculus
gatacagtctgttatcatggtgaac

SEQ ID NO: 501762 - DNA, 25 bp, Mus musculus
gatacagtgatacctttaatgccag

SEQ ID NO: 501763 - DNA, 25 bp, Mus musculus
gatacagtgatagctttaatgccag

SEQ ID NO: 501764 - DNA, 25 bp, Mus musculus
gatacagtgcatccgagcctataaa

SEQ ID NO: 501765 - DNA, 25 bp, Mus musculus
gatacagtgcatgcgagcctataaa

SEQ ID NO: 501766 - DNA, 25 bp, Mus musculus
gatacagtggttaacttgtcacagt

SEQ ID NO: 501767 - DNA, 25 bp, Mus musculus
gatacagtggtttacttgtcacagt

SEQ ID NO: 501768 - DNA, 25 bp, Mus musculus
gatacagtgtgcacccttagtgaac

SEQ ID NO: 501769 - DNA, 25 bp, Mus musculus
gatacagtgtgctcccttagtgaac

SEQ ID NO: 501770 - DNA, 25 bp, Mus musculus
gatacagttaatccttggctgcata

SEQ ID NO: 501771 - DNA, 25 bp, Mus musculus
gatacagttaatgcttggctgcata

SEQ ID NO: 501772 - DNA, 25 bp, Mus musculus
gatacagttacacttttaccgtggt

SEQ ID NO: 501773 - DNA, 25 bp, Mus musculus
gatacagttacagttttaccgtggt

SEQ ID NO: 501774 - DNA, 25 bp, Mus musculus
gatacagttatcattctttcaattt

SEQ ID NO: 501775 - DNA, 25 bp, Mus musculus
gatacagttatctttctttcaattt

SEQ ID NO: 501776 - DNA, 25 bp, Mus musculus
gatacagttcttacctttgcaactt

SEQ ID NO: 501777 - DNA, 25 bp, Mus musculus
gatacagttctttcctttgcaactt

SEQ ID NO: 501778 - DNA, 25 bp, Mus musculus
gatacagttgttcacacaggctcaa

SEQ ID NO: 501779 - DNA, 25 bp, Mus musculus
gatacagttgttgacacaggctcaa

SEQ ID NO: 501780 - DNA, 25 bp, Mus musculus
gatacagtttttctcttagtccaga

SEQ ID NO: 501781 - DNA, 25 bp, Mus musculus
gatacagtttttgtcttagtccaga

SEQ ID NO: 501782 - DNA, 25 bp, Mus musculus
gatacataacagacctcaatctttt

SEQ ID NO: 501783 - DNA, 25 bp, Mus musculus
gatacataacagtcctcaatctttt

SEQ ID NO: 501784 - DNA, 25 bp, Mus musculus
gatacatacactctaactccagggc

SEQ ID NO: 501785 - DNA, 25 bp, Mus musculus
gatacatacactgtaactccagggc

SEQ ID NO: 501786 - DNA, 25 bp, Mus musculus
gatacatagatcaggctatcctgga

SEQ ID NO: 501787 - DNA, 25 bp, Mus musculus
gatacatagatctggctatcctgga

SEQ ID NO: 501788 - DNA, 25 bp, Mus musculus
gatacatagcccagacacttttctt

SEQ ID NO: 501789 - DNA, 25 bp, Mus musculus
gatacatagccctgacacttttctt

SEQ ID NO: 501790 - DNA, 25 bp, Mus musculus
gatacataggaccaccagggacctg

SEQ ID NO: 501791 - DNA, 25 bp, Mus musculus
gatacataggacgaccagggacctg

SEQ ID NO: 501792 - DNA, 25 bp, Mus musculus
gatacataggataacacttgtacct

SEQ ID NO: 501793 - DNA, 25 bp, Mus musculus
gatacataggattacacttgtacct

SEQ ID NO: 501794 - DNA, 25 bp, Mus musculus
gatacatagggcaacactcattact

SEQ ID NO: 501795 - DNA, 25 bp, Mus musculus
gatacatagggctacactcattact

SEQ ID NO: 501796 - DNA, 25 bp, Mus musculus
gatacatagtgaagtcctgtttcaa

SEQ ID NO: 501797 - DNA, 25 bp, Mus musculus
gatacatagtgatgtcctgtttcaa

SEQ ID NO: 501798 - DNA, 25 bp, Mus musculus
gatacatatacaaagacccaggcat

SEQ ID NO: 501799 - DNA, 25 bp, Mus musculus
gatacatatacatagacccaggcat

SEQ ID NO: 501800 - DNA, 25 bp, Mus musculus
gatacatattgtcggcttcagttgg

SEQ ID NO: 501801 - DNA, 25 bp, Mus musculus
gatacatattgtgggcttcagttgg

SEQ ID NO: 501802 - DNA, 25 bp, Mus musculus
gatacatcaagtacctttctggtcc

SEQ ID NO: 501803 - DNA, 25 bp, Mus musculus
gatacatcaagttcctttctggtcc

SEQ ID NO: 501804 - DNA, 25 bp, Mus musculus
gatacatcacttaggctggttggag

SEQ ID NO: 501805 - DNA, 25 bp, Mus musculus
gatacatcactttggctggttggag

SEQ ID NO: 501806 - DNA, 25 bp, Mus musculus
gatacatcagctacatcaggcacca

SEQ ID NO: 501807 - DNA, 25 bp, Mus musculus
gatacatcagcttcatcaggcacca

SEQ ID NO: 501808 - DNA, 25 bp, Mus musculus
gatacatcagtgcatttgttgttct

SEQ ID NO: 501809 - DNA, 25 bp, Mus musculus
gatacatcagtggatttgttgttct

SEQ ID NO: 501810 - DNA, 25 bp, Mus musculus
gatacatcagttacacagtaccagt

SEQ ID NO: 501811 - DNA, 25 bp, Mus musculus
gatacatcagtttcacagtaccagt

SEQ ID NO: 501812 - DNA, 25 bp, Mus musculus
gatacatcatccaagacacattcaa

SEQ ID NO: 501813 - DNA, 25 bp, Mus musculus
gatacatcatcctagacacattcaa

SEQ ID NO: 501814 - DNA, 25 bp, Mus musculus
gatacatcatttattcggactcacg

SEQ ID NO: 501815 - DNA, 25 bp, Mus musculus
gatacatcattttttcggactcacg

SEQ ID NO: 501816 - DNA, 25 bp, Mus musculus
gatacatccacaaatccagcaggca

SEQ ID NO: 501817 - DNA, 25 bp, Mus musculus
gatacatccacatatccagcaggca

SEQ ID NO: 501818 - DNA, 25 bp, Mus musculus
gatacatccgcaacacaagcagcat

SEQ ID NO: 501819 - DNA, 25 bp, Mus musculus
gatacatccgcatcacaagcagcat

SEQ ID NO: 501820 - DNA, 25 bp, Mus musculus
gatacatcctatattgaagccagaa

SEQ ID NO: 501821 - DNA, 25 bp, Mus musculus
gatacatcctattttgaagccagaa

SEQ ID NO: 501822 - DNA, 25 bp, Mus musculus
gatacatcgctcatgtcttccattt

SEQ ID NO: 501823 - DNA, 25 bp, Mus musculus
gatacatcgctcttgtcttccattt

SEQ ID NO: 501824 - DNA, 25 bp, Mus musculus
gatacatcggatctatttttggaag

SEQ ID NO: 501825 - DNA, 25 bp, Mus musculus
gatacatcggatgtatttttggaag

SEQ ID NO: 501826 - DNA, 25 bp, Mus musculus
gatacatcgtcacacattttcatat

SEQ ID NO: 501827 - DNA, 25 bp, Mus musculus
gatacatcgtcagacattttcatat

SEQ ID NO: 501828 - DNA, 25 bp, Mus musculus
gatacatcgttacctgttctcgcag

SEQ ID NO: 501829 - DNA, 25 bp, Mus musculus
gatacatcgttagctgttctcgcag

SEQ ID NO: 501830 - DNA, 25 bp, Mus musculus
gatacatctcagagacccagggtgg

SEQ ID NO: 501831 - DNA, 25 bp, Mus musculus
gatacatctcagtgacccagggtgg

SEQ ID NO: 501832 - DNA, 25 bp, Mus musculus
gatacatctctcagatccaagctgg

SEQ ID NO: 501833 - DNA, 25 bp, Mus musculus
gatacatctctctgatccaagctgg

SEQ ID NO: 501834 - DNA, 25 bp, Mus musculus
gatacatctgaactaccttaacccc

SEQ ID NO: 501835 - DNA, 25 bp, Mus musculus
gatacatctgaagtaccttaacccc

SEQ ID NO: 501836 - DNA, 25 bp, Mus musculus
gatacatctggacataccattctga

SEQ ID NO: 501837 - DNA, 25 bp, Mus musculus
gatacatctggacgagaaggccttc

SEQ ID NO: 501838 - DNA, 25 bp, Mus musculus
gatacatctggagataccattctga

SEQ ID NO: 501839 - DNA, 25 bp, Mus musculus
gatacatctggaggagaaggccttc

SEQ ID NO: 501840 - DNA, 25 bp, Mus musculus
gatacatcttaaagcacatgcttat

SEQ ID NO: 501841 - DNA, 25 bp, Mus musculus
gatacatcttaatgcacatgcttat

SEQ ID NO: 501842 - DNA, 25 bp, Mus musculus
gatacatcttcacacaggcttggca

SEQ ID NO: 501843 - DNA, 25 bp, Mus musculus
gatacatcttcagacaggcttggca

SEQ ID NO: 501844 - DNA, 25 bp, Mus musculus
gatacatctttcctcaccataacaa

SEQ ID NO: 501845 - DNA, 25 bp, Mus musculus
gatacatctttcgtcaccataacaa

SEQ ID NO: 501846 - DNA, 25 bp, Mus musculus
gatacatgaaccctcagtcaacggc

SEQ ID NO: 501847 - DNA, 25 bp, Mus musculus
gatacatgaaccgtcagtcaacggc

SEQ ID NO: 501848 - DNA, 25 bp, Mus musculus
gatacatgaactctgccttgggcca

SEQ ID NO: 501849 - DNA, 25 bp, Mus musculus
gatacatgaactgtgccttgggcca

SEQ ID NO: 501850 - DNA, 25 bp, Mus musculus
gatacatgactaactgtagtccacc

SEQ ID NO: 501851 - DNA, 25 bp, Mus musculus
gatacatgactatctgtagtccacc

SEQ ID NO: 501852 - DNA, 25 bp, Mus musculus
gatacatgatccagagcggaaccct

SEQ ID NO: 501853 - DNA, 25 bp, Mus musculus
gatacatgatcctgagcggaaccct

SEQ ID NO: 501854 - DNA, 25 bp, Mus musculus
gatacatgcaacaattttccagcaa

SEQ ID NO: 501855 - DNA, 25 bp, Mus musculus
gatacatgcaactattttccagcaa

SEQ ID NO: 501856 - DNA, 25 bp, Mus musculus
gatacatgcactcaactgtttccac

SEQ ID NO: 501857 - DNA, 25 bp, Mus musculus
gatacatgcactgaactgtttccac

SEQ ID NO: 501858 - DNA, 25 bp, Mus musculus
gatacatgcatgcttgagtcagtct

SEQ ID NO: 501859 - DNA, 25 bp, Mus musculus
gatacatgcatggttgagtcagtct

SEQ ID NO: 501860 - DNA, 25 bp, Mus musculus
gatacatgccataactactggttgg

SEQ ID NO: 501861 - DNA, 25 bp, Mus musculus
gatacatgccattactactggttgg

SEQ ID NO: 501862 - DNA, 25 bp, Mus musculus
gatacatgcctcagtaccagtcgga

SEQ ID NO: 501863 - DNA, 25 bp, Mus musculus
gatacatgcctctgtaccagtcgga

SEQ ID NO: 501864 - DNA, 25 bp, Mus musculus
gatacatgcggtcggaatcctgagc

SEQ ID NO: 501865 - DNA, 25 bp, Mus musculus
gatacatgcggtgggaatcctgagc

SEQ ID NO: 501866 - DNA, 25 bp, Mus musculus
gatacatggaaacccctccatctct

SEQ ID NO: 501867 - DNA, 25 bp, Mus musculus
gatacatggaaagccctccatctct

SEQ ID NO: 501868 - DNA, 25 bp, Mus musculus
gatacatggacccaggctgcttgct

SEQ ID NO: 501869 - DNA, 25 bp, Mus musculus
gatacatggaccgaggctgcttgct

SEQ ID NO: 501870 - DNA, 25 bp, Mus musculus
gatacatggcttaagggactgacag

SEQ ID NO: 501871 - DNA, 25 bp, Mus musculus
gatacatggctttagggactgacag

SEQ ID NO: 501872 - DNA, 25 bp, Mus musculus
gatacatgggttatacttttgagaa

SEQ ID NO: 501873 - DNA, 25 bp, Mus musculus
gatacatgggttttacttttgagaa

SEQ ID NO: 501874 - DNA, 25 bp, Mus musculus
gatacatggtccagatccttgctta

SEQ ID NO: 501875 - DNA, 25 bp, Mus musculus
gatacatggtcctgatccttgctta

SEQ ID NO: 501876 - DNA, 25 bp, Mus musculus
gatacatggtttactgttgagatcc

SEQ ID NO: 501877 - DNA, 25 bp, Mus musculus
gatacatggttttctgttgagatcc

SEQ ID NO: 501878 - DNA, 25 bp, Mus musculus
gatacattacagcatccagccctgg

SEQ ID NO: 501879 - DNA, 25 bp, Mus musculus
gatacattacaggatccagccctgg

SEQ ID NO: 501880 - DNA, 25 bp, Mus musculus
gatacattgagtcgtgagctcctca

SEQ ID NO: 501881 - DNA, 25 bp, Mus musculus
gatacattgagtggtgagctcctca

SEQ ID NO: 501882 - DNA, 25 bp, Mus musculus
gatacattgcagaccagctagacca

SEQ ID NO: 501883 - DNA, 25 bp, Mus musculus
gatacattgcagaggtgcccggagt

SEQ ID NO: 501884 - DNA, 25 bp, Mus musculus
gatacattgcagtccagctagacca

SEQ ID NO: 501885 - DNA, 25 bp, Mus musculus
gatacattgcagtggtgcccggagt

SEQ ID NO: 501886 - DNA, 25 bp, Mus musculus
gatacattgtagaagcttatcacat

SEQ ID NO: 501887 - DNA, 25 bp, Mus musculus
gatacattgtagtagcttatcacat

SEQ ID NO: 501888 - DNA, 25 bp, Mus musculus
gatacattgtctagatttataggaa

SEQ ID NO: 501889 - DNA, 25 bp, Mus musculus
gatacattgtcttgatttataggaa

SEQ ID NO: 501890 - DNA, 25 bp, Mus musculus
gatacattgtttagtgtctaacccc

SEQ ID NO: 501891 - DNA, 25 bp, Mus musculus
gatacattgttttgtgtctaacccc

SEQ ID NO: 501892 - DNA, 25 bp, Mus musculus
gatacatttcaactcctcagaaggg

SEQ ID NO: 501893 - DNA, 25 bp, Mus musculus
gatacatttcaagtcctcagaaggg

SEQ ID NO: 501894 - DNA, 25 bp, Mus musculus
gatacatttgaaagcatggatgatc

SEQ ID NO: 501895 - DNA, 25 bp, Mus musculus
gatacatttgaatgcatggatgatc

SEQ ID NO: 501896 - DNA, 25 bp, Mus musculus
gatacattttatctagccaccatga

SEQ ID NO: 501897 - DNA, 25 bp, Mus musculus
gatacattttatgtagccaccatga

SEQ ID NO: 501898 - DNA, 25 bp, Mus musculus
gatacattttctaagtcggatccaa

SEQ ID NO: 501899 - DNA, 25 bp, Mus musculus
gatacattttcttagtcggatccaa

SEQ ID NO: 501900 - DNA, 25 bp, Mus musculus
gatacattttgacttgcccctcgaa

SEQ ID NO: 501901 - DNA, 25 bp, Mus musculus
gatacattttgagttgcccctcgaa

SEQ ID NO: 501902 - DNA, 25 bp, Mus musculus
gatacatttttgagcatgcctgatg

SEQ ID NO: 501903 - DNA, 25 bp, Mus musculus
gatacatttttgtgcatgcctgatg

SEQ ID NO: 501904 - DNA, 25 bp, Mus musculus
gataccaaaactcatagatgctcaa

SEQ ID NO: 501905 - DNA, 25 bp, Mus musculus
gataccaaaactgatagatgctcaa

SEQ ID NO: 501906 - DNA, 25 bp, Mus musculus
gataccaaacagctccggtgacgct

SEQ ID NO: 501907 - DNA, 25 bp, Mus musculus
gataccaaacaggtccggtgacgct

SEQ ID NO: 501908 - DNA, 25 bp, Mus musculus
gataccaaaggcagcacggttgtcc

SEQ ID NO: 501909 - DNA, 25 bp, Mus musculus
gataccaaaggctgcacggttgtcc

SEQ ID NO: 501910 - DNA, 25 bp, Mus musculus
gataccaaagtgagttgcattttta

SEQ ID NO: 501911 - DNA, 25 bp, Mus musculus
gataccaaagtgtgttgcattttta

SEQ ID NO: 501912 - DNA, 25 bp, Mus musculus
gataccaacaatagaatcctttcag

SEQ ID NO: 501913 - DNA, 25 bp, Mus musculus
gataccaacaattgaatcctttcag

SEQ ID NO: 501914 - DNA, 25 bp, Mus musculus
gataccaacagcatttggccttgct

SEQ ID NO: 501915 - DNA, 25 bp, Mus musculus
gataccaacagcttttggccttgct

SEQ ID NO: 501916 - DNA, 25 bp, Mus musculus
gataccaaccaacatgggcacctga

SEQ ID NO: 501917 - DNA, 25 bp, Mus musculus
gataccaaccaagatgggcacctga

SEQ ID NO: 501918 - DNA, 25 bp, Mus musculus
gataccaactatcacggcagtctgc

SEQ ID NO: 501919 - DNA, 25 bp, Mus musculus
gataccaactatcccacagacgatg

SEQ ID NO: 501920 - DNA, 25 bp, Mus musculus
gataccaactatgacggcagtctgc

SEQ ID NO: 501921 - DNA, 25 bp, Mus musculus
gataccaactatgccacagacgatg

SEQ ID NO: 501922 - DNA, 25 bp, Mus musculus
gataccaagaagctggcttacaaca

SEQ ID NO: 501923 - DNA, 25 bp, Mus musculus
gataccaagaaggtggcttacaaca

SEQ ID NO: 501924 - DNA, 25 bp, Mus musculus
gataccaagaccctctggatttctg

SEQ ID NO: 501925 - DNA, 25 bp, Mus musculus
gataccaagaccgtctggatttctg

SEQ ID NO: 501926 - DNA, 25 bp, Mus musculus
gataccaagccaagagtggccgaat

SEQ ID NO: 501927 - DNA, 25 bp, Mus musculus
gataccaagccatgagtggccgaat

SEQ ID NO: 501928 - DNA, 25 bp, Mus musculus
gataccaaggatcttttccttccca

SEQ ID NO: 501929 - DNA, 25 bp, Mus musculus
gataccaaggatgttttccttccca

SEQ ID NO: 501930 - DNA, 25 bp, Mus musculus
gataccaagttcaatgctgggccta

SEQ ID NO: 501931 - DNA, 25 bp, Mus musculus
gataccaagttctatgctgggccta

SEQ ID NO: 501932 - DNA, 25 bp, Mus musculus
gataccaatgaccagctatccactt

SEQ ID NO: 501933 - DNA, 25 bp, Mus musculus
gataccaatgacgagctatccactt

SEQ ID NO: 501934 - DNA, 25 bp, Mus musculus
gataccaattttcacacctggatta

SEQ ID NO: 501935 - DNA, 25 bp, Mus musculus
gataccaattttgacacctggatta

SEQ ID NO: 501936 - DNA, 25 bp, Mus musculus
gataccacagacctggtttgatgca

SEQ ID NO: 501937 - DNA, 25 bp, Mus musculus
gataccacagacgtggtttgatgca

SEQ ID NO: 501938 - DNA, 25 bp, Mus musculus
gataccacaggcagcaaggaccaca

SEQ ID NO: 501939 - DNA, 25 bp, Mus musculus
gataccacaggctgcaaggaccaca

SEQ ID NO: 501940 - DNA, 25 bp, Mus musculus
gataccacagtgatgcatctggttg

SEQ ID NO: 501941 - DNA, 25 bp, Mus musculus
gataccacagtgttgcatctggttg

SEQ ID NO: 501942 - DNA, 25 bp, Mus musculus
gataccacatagaatgaacacctaa

SEQ ID NO: 501943 - DNA, 25 bp, Mus musculus
gataccacatagtatgaacacctaa

SEQ ID NO: 501944 - DNA, 25 bp, Mus musculus
gataccaccaacataatggaacatg

SEQ ID NO: 501945 - DNA, 25 bp, Mus musculus
gataccaccaacttaatggaacatg

SEQ ID NO: 501946 - DNA, 25 bp, Mus musculus
gataccaccaagcaagtccgactca

SEQ ID NO: 501947 - DNA, 25 bp, Mus musculus
gataccaccaaggaagtccgactca

SEQ ID NO: 501948 - DNA, 25 bp, Mus musculus
gataccaccacgagttagctgaggt

SEQ ID NO: 501949 - DNA, 25 bp, Mus musculus
gataccaccacgtgttagctgaggt

SEQ ID NO: 501950 - DNA, 25 bp, Mus musculus
gataccacctgaccagagtagtttt

SEQ ID NO: 501951 - DNA, 25 bp, Mus musculus
gataccacctgagcagagtagtttt

SEQ ID NO: 501952 - DNA, 25 bp, Mus musculus
gataccacctggcatatgttgacat

SEQ ID NO: 501953 - DNA, 25 bp, Mus musculus
gataccacctgggatatgttgacat

SEQ ID NO: 501954 - DNA, 25 bp, Mus musculus
gataccaccttcattatcttgaaag

SEQ ID NO: 501955 - DNA, 25 bp, Mus musculus
gataccaccttcctcacaggattac

SEQ ID NO: 501956 - DNA, 25 bp, Mus musculus
gataccaccttcgtcacaggattac

SEQ ID NO: 501957 - DNA, 25 bp, Mus musculus
gataccaccttctttatcttgaaag

SEQ ID NO: 501958 - DNA, 25 bp, Mus musculus
gataccacctttcatccacactgtg

SEQ ID NO: 501959 - DNA, 25 bp, Mus musculus
gataccacctttcctcagaagttca

SEQ ID NO: 501960 - DNA, 25 bp, Mus musculus
gataccacctttgatccacactgtg

SEQ ID NO: 501961 - DNA, 25 bp, Mus musculus
gataccacctttgctcagaagttca

SEQ ID NO: 501962 - DNA, 25 bp, Mus musculus
gataccacgacaagaacatctacag

SEQ ID NO: 501963 - DNA, 25 bp, Mus musculus
gataccacgacatgaacatctacag

SEQ ID NO: 501964 - DNA, 25 bp, Mus musculus
gataccactgacaagatgcagacca

SEQ ID NO: 501965 - DNA, 25 bp, Mus musculus
gataccactgacctatgtcctagag

SEQ ID NO: 501966 - DNA, 25 bp, Mus musculus
gataccactgacgtatgtcctagag

SEQ ID NO: 501967 - DNA, 25 bp, Mus musculus
gataccactgactagatgcagacca

SEQ ID NO: 501968 - DNA, 25 bp, Mus musculus
gataccactgccctgaggagtcagt

SEQ ID NO: 501969 - DNA, 25 bp, Mus musculus
gataccactgccgtgaggagtcagt

SEQ ID NO: 501970 - DNA, 25 bp, Mus musculus
gataccactgtactaaggctgtgct

SEQ ID NO: 501971 - DNA, 25 bp, Mus musculus
gataccactgtagtaaggctgtgct

SEQ ID NO: 501972 - DNA, 25 bp, Mus musculus
gataccactgttcccttgaggatta

SEQ ID NO: 501973 - DNA, 25 bp, Mus musculus
gataccactgttgccttgaggatta

SEQ ID NO: 501974 - DNA, 25 bp, Mus musculus
gataccactttaccaaagatacaca

SEQ ID NO: 501975 - DNA, 25 bp, Mus musculus
gataccactttagcaaagatacaca

SEQ ID NO: 501976 - DNA, 25 bp, Mus musculus
gataccagaaatatgggaaggccac

SEQ ID NO: 501977 - DNA, 25 bp, Mus musculus
gataccagaaatcctaccgataagc

SEQ ID NO: 501978 - DNA, 25 bp, Mus musculus
gataccagaaatgctaccgataagc

SEQ ID NO: 501979 - DNA, 25 bp, Mus musculus
gataccagaaatttgggaaggccac

SEQ ID NO: 501980 - DNA, 25 bp, Mus musculus
gataccagaagcctccaaacacggt

SEQ ID NO: 501981 - DNA, 25 bp, Mus musculus
gataccagaagcgtccaaacacggt

SEQ ID NO: 501982 - DNA, 25 bp, Mus musculus
gataccagacccagaagaacccagc

SEQ ID NO: 501983 - DNA, 25 bp, Mus musculus
gataccagaccctgaagaacccagc

SEQ ID NO: 501984 - DNA, 25 bp, Mus musculus
gataccagagcacttgatgcagaca

SEQ ID NO: 501985 - DNA, 25 bp, Mus musculus
gataccagagcagttgatgcagaca

SEQ ID NO: 501986 - DNA, 25 bp, Mus musculus
gataccagcaacatcgatgactatg

SEQ ID NO: 501987 - DNA, 25 bp, Mus musculus
gataccagcaacttcgatgactatg

SEQ ID NO: 501988 - DNA, 25 bp, Mus musculus
gataccagcaggaggtggaccgcat

SEQ ID NO: 501989 - DNA, 25 bp, Mus musculus
gataccagcaggtggtggaccgcat

SEQ ID NO: 501990 - DNA, 25 bp, Mus musculus
gataccagccatctgatgggtctag

SEQ ID NO: 501991 - DNA, 25 bp, Mus musculus
gataccagccatgtgatgggtctag

SEQ ID NO: 501992 - DNA, 25 bp, Mus musculus
gataccagccggagctgttatattt

SEQ ID NO: 501993 - DNA, 25 bp, Mus musculus
gataccagccggtgctgttatattt

SEQ ID NO: 501994 - DNA, 25 bp, Mus musculus
gataccagctacaccaggctagtat

SEQ ID NO: 501995 - DNA, 25 bp, Mus musculus
gataccagctactccaggctagtat

SEQ ID NO: 501996 - DNA, 25 bp, Mus musculus
gataccagctcaccatattggcaga

SEQ ID NO: 501997 - DNA, 25 bp, Mus musculus
gataccagctcagcatattggcaga

SEQ ID NO: 501998 - DNA, 25 bp, Mus musculus
gataccaggactaccttaaacctgt

SEQ ID NO: 501999 - DNA, 25 bp, Mus musculus
gataccaggacttccttaaacctgt

SEQ ID NO: 502000 - DNA, 25 bp, Mus musculus
gataccaggctaccatttcacaagg

SEQ ID NO: 502001 - DNA, 25 bp, Mus musculus
gataccaggctagcatttcacaagg

SEQ ID NO: 502002 - DNA, 25 bp, Mus musculus
gataccagggaacgcattgtgacat

SEQ ID NO: 502003 - DNA, 25 bp, Mus musculus
gataccagggaaggcattgtgacat

SEQ ID NO: 502004 - DNA, 25 bp, Mus musculus
gataccagggcacaagtaccagtct

SEQ ID NO: 502005 - DNA, 25 bp, Mus musculus
gataccagggcagaagtaccagtct

SEQ ID NO: 502006 - DNA, 25 bp, Mus musculus
gataccagtagcatcaacactctca

SEQ ID NO: 502007 - DNA, 25 bp, Mus musculus
gataccagtagcttcaacactctca

SEQ ID NO: 502008 - DNA, 25 bp, Mus musculus
gataccagtgcaagaatgtctttta

SEQ ID NO: 502009 - DNA, 25 bp, Mus musculus
gataccagtgcatgaatgtctttta

SEQ ID NO: 502010 - DNA, 25 bp, Mus musculus
gataccagtgctcatagcatccaga

SEQ ID NO: 502011 - DNA, 25 bp, Mus musculus
gataccagtgctgatagcatccaga

SEQ ID NO: 502012 - DNA, 25 bp, Mus musculus
gataccagtgttctctgtgaccgac

SEQ ID NO: 502013 - DNA, 25 bp, Mus musculus
gataccagtgttgtctgtgaccgac

SEQ ID NO: 502014 - DNA, 25 bp, Mus musculus
gataccagttaaacgaaacctcagc

SEQ ID NO: 502015 - DNA, 25 bp, Mus musculus
gataccagttaatcgaaacctcagc

SEQ ID NO: 502016 - DNA, 25 bp, Mus musculus
gataccagttggaagggcacgaaaa

SEQ ID NO: 502017 - DNA, 25 bp, Mus musculus
gataccagttggtagggcacgaaaa

SEQ ID NO: 502018 - DNA, 25 bp, Mus musculus
gataccataaaaacagagtcacacg

SEQ ID NO: 502019 - DNA, 25 bp, Mus musculus
gataccataaaatcagagtcacacg

SEQ ID NO: 502020 - DNA, 25 bp, Mus musculus
gataccataaatccatagaggccat

SEQ ID NO: 502021 - DNA, 25 bp, Mus musculus
gataccataaatgcatagaggccat

SEQ ID NO: 502022 - DNA, 25 bp, Mus musculus
gataccataatgaatatttctgtag

SEQ ID NO: 502023 - DNA, 25 bp, Mus musculus
gataccataatgtatatttctgtag

SEQ ID NO: 502024 - DNA, 25 bp, Mus musculus
gataccataattcgcatgcaagctt

SEQ ID NO: 502025 - DNA, 25 bp, Mus musculus
gataccataattggcatgcaagctt

SEQ ID NO: 502026 - DNA, 25 bp, Mus musculus
gataccatagtgcagatgtctcctt

SEQ ID NO: 502027 - DNA, 25 bp, Mus musculus
gataccatagtggagatgtctcctt

SEQ ID NO: 502028 - DNA, 25 bp, Mus musculus
gataccatataccaaggctttgctg

SEQ ID NO: 502029 - DNA, 25 bp, Mus musculus
gataccatatacgaaggctttgctg

SEQ ID NO: 502030 - DNA, 25 bp, Mus musculus
gataccatcaagatgcttggactac

SEQ ID NO: 502031 - DNA, 25 bp, Mus musculus
gataccatcaagttgcttggactac

SEQ ID NO: 502032 - DNA, 25 bp, Mus musculus
gataccatcagcactagctctggat

SEQ ID NO: 502033 - DNA, 25 bp, Mus musculus
gataccatcagctctagctctggat

SEQ ID NO: 502034 - DNA, 25 bp, Mus musculus
gataccatcatcatgactagcctct

SEQ ID NO: 502035 - DNA, 25 bp, Mus musculus
gataccatcatcttgactagcctct

SEQ ID NO: 502036 - DNA, 25 bp, Mus musculus
gataccatccagaggacatgagcca

SEQ ID NO: 502037 - DNA, 25 bp, Mus musculus
gataccatccagtggacatgagcca

SEQ ID NO: 502038 - DNA, 25 bp, Mus musculus
gataccatctccatgggtaggcaat

SEQ ID NO: 502039 - DNA, 25 bp, Mus musculus
gataccatctccttgggtaggcaat

SEQ ID NO: 502040 - DNA, 25 bp, Mus musculus
gataccatctgaaaccatgaggcct

SEQ ID NO: 502041 - DNA, 25 bp, Mus musculus
gataccatctgataccatgaggcct

SEQ ID NO: 502042 - DNA, 25 bp, Mus musculus
gataccatgaccaagaaaacttatt

SEQ ID NO: 502043 - DNA, 25 bp, Mus musculus
gataccatgacctagaaaacttatt

SEQ ID NO: 502044 - DNA, 25 bp, Mus musculus
gataccatgctgcaaagagcctctc

SEQ ID NO: 502045 - DNA, 25 bp, Mus musculus
gataccatgctggaaagagcctctc

SEQ ID NO: 502046 - DNA, 25 bp, Mus musculus
gataccattcagctgattctccaaa

SEQ ID NO: 502047 - DNA, 25 bp, Mus musculus
gataccattcaggtgattctccaaa

SEQ ID NO: 502048 - DNA, 25 bp, Mus musculus
gataccattcgaatcagattgtgct

SEQ ID NO: 502049 - DNA, 25 bp, Mus musculus
gataccattcgattcagattgtgct

SEQ ID NO: 502050 - DNA, 25 bp, Mus musculus
gataccattggaacacgggaccttg

SEQ ID NO: 502051 - DNA, 25 bp, Mus musculus
gataccattggatcacgggaccttg

SEQ ID NO: 502052 - DNA, 25 bp, Mus musculus
gataccatttctcaggtctaagtga

SEQ ID NO: 502053 - DNA, 25 bp, Mus musculus
gataccatttctgaggtctaagtga

SEQ ID NO: 502054 - DNA, 25 bp, Mus musculus
gatacccaaaataagcgtctagagc

SEQ ID NO: 502055 - DNA, 25 bp, Mus musculus
gatacccaaaattagcgtctagagc

SEQ ID NO: 502056 - DNA, 25 bp, Mus musculus
gatacccaaatacctggttccattt

SEQ ID NO: 502057 - DNA, 25 bp, Mus musculus
gatacccaaatagctggttccattt

SEQ ID NO: 502058 - DNA, 25 bp, Mus musculus
gatacccaagctaaaaacacggaca

SEQ ID NO: 502059 - DNA, 25 bp, Mus musculus
gatacccaagcttaaaacacggaca

SEQ ID NO: 502060 - DNA, 25 bp, Mus musculus
gatacccaagtcagactaagtcttg

SEQ ID NO: 502061 - DNA, 25 bp, Mus musculus
gatacccaagtctgactaagtcttg

SEQ ID NO: 502062 - DNA, 25 bp, Mus musculus
gatacccaatgccaaataaagatga

SEQ ID NO: 502063 - DNA, 25 bp, Mus musculus
gatacccaatgcgaaataaagatga

SEQ ID NO: 502064 - DNA, 25 bp, Mus musculus
gatacccaatttagtttatgccaga

SEQ ID NO: 502065 - DNA, 25 bp, Mus musculus
gatacccaattttgtttatgccaga

SEQ ID NO: 502066 - DNA, 25 bp, Mus musculus
gatacccacaatatttattctccct

SEQ ID NO: 502067 - DNA, 25 bp, Mus musculus
gatacccacaatttttattctccct

SEQ ID NO: 502068 - DNA, 25 bp, Mus musculus
gatacccacagcactatacttggtg

SEQ ID NO: 502069 - DNA, 25 bp, Mus musculus
gatacccacagctctatacttggtg

SEQ ID NO: 502070 - DNA, 25 bp, Mus musculus
gatacccacatactcttatctggga

SEQ ID NO: 502071 - DNA, 25 bp, Mus musculus
gatacccacatagtcttatctggga

SEQ ID NO: 502072 - DNA, 25 bp, Mus musculus
gatacccacctcagatccatgatta

SEQ ID NO: 502073 - DNA, 25 bp, Mus musculus
gatacccacctctgatccatgatta

SEQ ID NO: 502074 - DNA, 25 bp, Mus musculus
gatacccactaaatttctaactagg

SEQ ID NO: 502075 - DNA, 25 bp, Mus musculus
gatacccactaattttctaactagg

SEQ ID NO: 502076 - DNA, 25 bp, Mus musculus
gatacccagatacttggatgccctg

SEQ ID NO: 502077 - DNA, 25 bp, Mus musculus
gatacccagatagttggatgccctg

SEQ ID NO: 502078 - DNA, 25 bp, Mus musculus
gatacccagatcataaccttgcagg

SEQ ID NO: 502079 - DNA, 25 bp, Mus musculus
gatacccagatcttaaccttgcagg

SEQ ID NO: 502080 - DNA, 25 bp, Mus musculus
gatacccagcctacttgtgtataaa

SEQ ID NO: 502081 - DNA, 25 bp, Mus musculus
gatacccagccttcttgtgtataaa

SEQ ID NO: 502082 - DNA, 25 bp, Mus musculus
gatacccagctaacttcatcatttt

SEQ ID NO: 502083 - DNA, 25 bp, Mus musculus
gatacccagctacgtacagacacta

SEQ ID NO: 502084 - DNA, 25 bp, Mus musculus
gatacccagctaggtacagacacta

SEQ ID NO: 502085 - DNA, 25 bp, Mus musculus
gatacccagctatcttcatcatttt

SEQ ID NO: 502086 - DNA, 25 bp, Mus musculus
gatacccagtatagttttccctgtg

SEQ ID NO: 502087 - DNA, 25 bp, Mus musculus
gatacccagtattgttttccctgtg

SEQ ID NO: 502088 - DNA, 25 bp, Mus musculus
gatacccatacaataatttcagggc

SEQ ID NO: 502089 - DNA, 25 bp, Mus musculus
gatacccatacattaatttcagggc

SEQ ID NO: 502090 - DNA, 25 bp, Mus musculus
gatacccatccacttgttttagcat

SEQ ID NO: 502091 - DNA, 25 bp, Mus musculus
gatacccatccagttgttttagcat

SEQ ID NO: 502092 - DNA, 25 bp, Mus musculus
gatacccatctacggctggacgaaa

SEQ ID NO: 502093 - DNA, 25 bp, Mus musculus
gatacccatctagggctggacgaaa

SEQ ID NO: 502094 - DNA, 25 bp, Mus musculus
gatacccatggtcctttgtaaccgt

SEQ ID NO: 502095 - DNA, 25 bp, Mus musculus
gatacccatggtgctttgtaaccgt

SEQ ID NO: 502096 - DNA, 25 bp, Mus musculus
gataccccaaaactaacagaggcag

SEQ ID NO: 502097 - DNA, 25 bp, Mus musculus
gataccccaaaagtaacagaggcag

SEQ ID NO: 502098 - DNA, 25 bp, Mus musculus
gataccccacttagcttttcttttg

SEQ ID NO: 502099 - DNA, 25 bp, Mus musculus
gataccccactttgcttttcttttg

SEQ ID NO: 502100 - DNA, 25 bp, Mus musculus
gataccccagatattaacactgcac

SEQ ID NO: 502101 - DNA, 25 bp, Mus musculus
gataccccagattttaacactgcac

SEQ ID NO: 502102 - DNA, 25 bp, Mus musculus
gataccccagccaaaaatgcacaaa

SEQ ID NO: 502103 - DNA, 25 bp, Mus musculus
gataccccagcctaaaatgcacaaa

SEQ ID NO: 502104 - DNA, 25 bp, Mus musculus
gataccccatttccagatcaacaca

SEQ ID NO: 502105 - DNA, 25 bp, Mus musculus
gataccccatttgcagatcaacaca

SEQ ID NO: 502106 - DNA, 25 bp, Mus musculus
gatacccctgggaggagtcagaaca

SEQ ID NO: 502107 - DNA, 25 bp, Mus musculus
gatacccctgggtggagtcagaaca

SEQ ID NO: 502108 - DNA, 25 bp, Mus musculus
gataccccttctaggactcttcaag

SEQ ID NO: 502109 - DNA, 25 bp, Mus musculus
gataccccttcttggactcttcaag

SEQ ID NO: 502110 - DNA, 25 bp, Mus musculus
gatacccgcagtaggatccctggat

SEQ ID NO: 502111 - DNA, 25 bp, Mus musculus
gatacccgcagttggatccctggat

SEQ ID NO: 502112 - DNA, 25 bp, Mus musculus
gatacccggacaaacatgacctgga

SEQ ID NO: 502113 - DNA, 25 bp, Mus musculus
gatacccggacatacatgacctgga

SEQ ID NO: 502114 - DNA, 25 bp, Mus musculus
gataccctcatgctcgtcctacttg

SEQ ID NO: 502115 - DNA, 25 bp, Mus musculus
gataccctcatggtcgtcctacttg

SEQ ID NO: 502116 - DNA, 25 bp, Mus musculus
gataccctccatactggatttgttc

SEQ ID NO: 502117 - DNA, 25 bp, Mus musculus
gataccctccattctggatttgttc

SEQ ID NO: 502118 - DNA, 25 bp, Mus musculus
gataccctctgtaaaaccaccaatt

SEQ ID NO: 502119 - DNA, 25 bp, Mus musculus
gataccctctgttaaaccaccaatt

SEQ ID NO: 502120 - DNA, 25 bp, Mus musculus
gataccctgaagctggcacgccctg

SEQ ID NO: 502121 - DNA, 25 bp, Mus musculus
gataccctgaaggtggcacgccctg

SEQ ID NO: 502122 - DNA, 25 bp, Mus musculus
gataccctgcacctggtggacatgg

SEQ ID NO: 502123 - DNA, 25 bp, Mus musculus
gataccctgcacgtggtggacatgg

SEQ ID NO: 502124 - DNA, 25 bp, Mus musculus
gataccctgcatattaggtagttac

SEQ ID NO: 502125 - DNA, 25 bp, Mus musculus
gataccctgcattttaggtagttac

SEQ ID NO: 502126 - DNA, 25 bp, Mus musculus
gataccctgtatcttaggcaatgtt

SEQ ID NO: 502127 - DNA, 25 bp, Mus musculus
gataccctgtatgttaggcaatgtt

SEQ ID NO: 502128 - DNA, 25 bp, Mus musculus
gatacccttactcacaagagagaac

SEQ ID NO: 502129 - DNA, 25 bp, Mus musculus
gatacccttactgacaagagagaac

SEQ ID NO: 502130 - DNA, 25 bp, Mus musculus
gatacccttatactttgtgtcaaat

SEQ ID NO: 502131 - DNA, 25 bp, Mus musculus
gatacccttatagtttgtgtcaaat

SEQ ID NO: 502132 - DNA, 25 bp, Mus musculus
gatacccttgggaacagtcggccag

SEQ ID NO: 502133 - DNA, 25 bp, Mus musculus
gatacccttgggtacagtcggccag

SEQ ID NO: 502134 - DNA, 25 bp, Mus musculus
gatacccttgttaccaagagctact

SEQ ID NO: 502135 - DNA, 25 bp, Mus musculus
gatacccttgtttccaagagctact

SEQ ID NO: 502136 - DNA, 25 bp, Mus musculus
gataccgacaccattccatttaaag

SEQ ID NO: 502137 - DNA, 25 bp, Mus musculus
gataccgacacctttccatttaaag

SEQ ID NO: 502138 - DNA, 25 bp, Mus musculus
gataccgactaaccccaggaatgtg

SEQ ID NO: 502139 - DNA, 25 bp, Mus musculus
gataccgactaagcccaggaatgtg

SEQ ID NO: 502140 - DNA, 25 bp, Mus musculus
gataccgagaggcttatccatctgt

SEQ ID NO: 502141 - DNA, 25 bp, Mus musculus
gataccgagagggttatccatctgt

SEQ ID NO: 502142 - DNA, 25 bp, Mus musculus
gataccgagcctcctcacagagaga

SEQ ID NO: 502143 - DNA, 25 bp, Mus musculus
gataccgagcctgctcacagagaga

SEQ ID NO: 502144 - DNA, 25 bp, Mus musculus
gataccgagtgaacccagtgcattc

SEQ ID NO: 502145 - DNA, 25 bp, Mus musculus
gataccgagtgatcccagtgcattc

SEQ ID NO: 502146 - DNA, 25 bp, Mus musculus
gataccgatctgctgaatagctcaa

SEQ ID NO: 502147 - DNA, 25 bp, Mus musculus
gataccgatctggtgaatagctcaa

SEQ ID NO: 502148 - DNA, 25 bp, Mus musculus
gataccgcaatgaccacagagacag

SEQ ID NO: 502149 - DNA, 25 bp, Mus musculus
gataccgcaatgtccacagagacag

SEQ ID NO: 502150 - DNA, 25 bp, Mus musculus
gataccgcataaacgatcacctgat

SEQ ID NO: 502151 - DNA, 25 bp, Mus musculus
gataccgcataatcgatcacctgat

SEQ ID NO: 502152 - DNA, 25 bp, Mus musculus
gataccgcattcaagaacactcagt

SEQ ID NO: 502153 - DNA, 25 bp, Mus musculus
gataccgcattctagaacactcagt

SEQ ID NO: 502154 - DNA, 25 bp, Mus musculus
gataccggacttctttctttgattt

SEQ ID NO: 502155 - DNA, 25 bp, Mus musculus
gataccggacttgtttctttgattt

SEQ ID NO: 502156 - DNA, 25 bp, Mus musculus
gataccgggagcaaattgacctttt

SEQ ID NO: 502157 - DNA, 25 bp, Mus musculus
gataccgggagctaattgacctttt

SEQ ID NO: 502158 - DNA, 25 bp, Mus musculus
gataccggtcccatgttttaatgat

SEQ ID NO: 502159 - DNA, 25 bp, Mus musculus
gataccggtcccttgttttaatgat

SEQ ID NO: 502160 - DNA, 25 bp, Mus musculus
gataccgtccgaactaggtcattta

SEQ ID NO: 502161 - DNA, 25 bp, Mus musculus
gataccgtccgatctaggtcattta

SEQ ID NO: 502162 - DNA, 25 bp, Mus musculus
gataccgtgtttcccaagatcgaca

SEQ ID NO: 502163 - DNA, 25 bp, Mus musculus
gataccgtgtttgccaagatcgaca

SEQ ID NO: 502164 - DNA, 25 bp, Mus musculus
gatacctaaaagactacccttgcac

SEQ ID NO: 502165 - DNA, 25 bp, Mus musculus
gatacctaaaagtctacccttgcac

SEQ ID NO: 502166 - DNA, 25 bp, Mus musculus
gatacctaattgaaacagtcacttg

SEQ ID NO: 502167 - DNA, 25 bp, Mus musculus
gatacctaattgtaacagtcacttg

SEQ ID NO: 502168 - DNA, 25 bp, Mus musculus
gatacctacagtctattcacctaca

SEQ ID NO: 502169 - DNA, 25 bp, Mus musculus
gatacctacagtgtattcacctaca

SEQ ID NO: 502170 - DNA, 25 bp, Mus musculus
gatacctactcaaaatcttgcagtt

SEQ ID NO: 502171 - DNA, 25 bp, Mus musculus
gatacctactcataatcttgcagtt

SEQ ID NO: 502172 - DNA, 25 bp, Mus musculus
gatacctagaatcaaatctgacatt

SEQ ID NO: 502173 - DNA, 25 bp, Mus musculus
gatacctagaatgaaatctgacatt

SEQ ID NO: 502174 - DNA, 25 bp, Mus musculus
gatacctagaccagacaaatgcatt

SEQ ID NO: 502175 - DNA, 25 bp, Mus musculus
gatacctagacctgacaaatgcatt

SEQ ID NO: 502176 - DNA, 25 bp, Mus musculus
gatacctagggaattgagctcagtt

SEQ ID NO: 502177 - DNA, 25 bp, Mus musculus
gatacctagggatttgagctcagtt

SEQ ID NO: 502178 - DNA, 25 bp, Mus musculus
gatacctaggtcaaatccatgggcc

SEQ ID NO: 502179 - DNA, 25 bp, Mus musculus
gatacctaggtctaatccatgggcc

SEQ ID NO: 502180 - DNA, 25 bp, Mus musculus
gatacctagtgaagcacagcaggca

SEQ ID NO: 502181 - DNA, 25 bp, Mus musculus
gatacctagtgaatcttcaacagaa

SEQ ID NO: 502182 - DNA, 25 bp, Mus musculus
gatacctagtgatgcacagcaggca

SEQ ID NO: 502183 - DNA, 25 bp, Mus musculus
gatacctagtgattcttcaacagaa

SEQ ID NO: 502184 - DNA, 25 bp, Mus musculus
gatacctatagaaaatgtggcccat

SEQ ID NO: 502185 - DNA, 25 bp, Mus musculus
gatacctatagataatgtggcccat

SEQ ID NO: 502186 - DNA, 25 bp, Mus musculus
gatacctatattactgaccagatgt

SEQ ID NO: 502187 - DNA, 25 bp, Mus musculus
gatacctatatttctgaccagatgt

SEQ ID NO: 502188 - DNA, 25 bp, Mus musculus
gatacctcaaaacctgtatacccct

SEQ ID NO: 502189 - DNA, 25 bp, Mus musculus
gatacctcaaaagctgtatacccct

SEQ ID NO: 502190 - DNA, 25 bp, Mus musculus
gatacctccatcagagttagctgca

SEQ ID NO: 502191 - DNA, 25 bp, Mus musculus
gatacctccatctgagttagctgca

SEQ ID NO: 502192 - DNA, 25 bp, Mus musculus
gatacctccatgaacgacagtgaac

SEQ ID NO: 502193 - DNA, 25 bp, Mus musculus
gatacctccatgtacgacagtgaac

SEQ ID NO: 502194 - DNA, 25 bp, Mus musculus
gatacctccctaaccattgctcggg

SEQ ID NO: 502195 - DNA, 25 bp, Mus musculus
gatacctccctatccattgctcggg

SEQ ID NO: 502196 - DNA, 25 bp, Mus musculus
gatacctcgaatagtggtgcagcct

SEQ ID NO: 502197 - DNA, 25 bp, Mus musculus
gatacctcgaattgtggtgcagcct

SEQ ID NO: 502198 - DNA, 25 bp, Mus musculus
gatacctcgagacctccatcaggtg

SEQ ID NO: 502199 - DNA, 25 bp, Mus musculus
gatacctcgagagctccatcaggtg

SEQ ID NO: 502200 - DNA, 25 bp, Mus musculus
gatacctcttgcaattgtagaacgg

SEQ ID NO: 502201 - DNA, 25 bp, Mus musculus
gatacctcttgctattgtagaacgg

SEQ ID NO: 502202 - DNA, 25 bp, Mus musculus
gatacctgaatgacttttcccttaa

SEQ ID NO: 502203 - DNA, 25 bp, Mus musculus
gatacctgaatgtcttttcccttaa

SEQ ID NO: 502204 - DNA, 25 bp, Mus musculus
gatacctgaattattatgaaaatga

SEQ ID NO: 502205 - DNA, 25 bp, Mus musculus
gatacctgaatttttatgaaaatga

SEQ ID NO: 502206 - DNA, 25 bp, Mus musculus
gatacctgacgtaggtaatcactct

SEQ ID NO: 502207 - DNA, 25 bp, Mus musculus
gatacctgacgttggtaatcactct

SEQ ID NO: 502208 - DNA, 25 bp, Mus musculus
gatacctgagacatgccttagggtt

SEQ ID NO: 502209 - DNA, 25 bp, Mus musculus
gatacctgagacttgccttagggtt

SEQ ID NO: 502210 - DNA, 25 bp, Mus musculus
gatacctgatctaccatttaagttt

SEQ ID NO: 502211 - DNA, 25 bp, Mus musculus
gatacctgatcttccatttaagttt

SEQ ID NO: 502212 - DNA, 25 bp, Mus musculus
gatacctgcagcacttcactagaaa

SEQ ID NO: 502213 - DNA, 25 bp, Mus musculus
gatacctgcagctcttcactagaaa

SEQ ID NO: 502214 - DNA, 25 bp, Mus musculus
gatacctgcattacaaagagccact

SEQ ID NO: 502215 - DNA, 25 bp, Mus musculus
gatacctgcatttcaaagagccact

SEQ ID NO: 502216 - DNA, 25 bp, Mus musculus
gatacctgctttctggtaactcgtt

SEQ ID NO: 502217 - DNA, 25 bp, Mus musculus
gatacctgctttgtggtaactcgtt

SEQ ID NO: 502218 - DNA, 25 bp, Mus musculus
gatacctggctgacagtgaaccgca

SEQ ID NO: 502219 - DNA, 25 bp, Mus musculus
gatacctggctgtcagtgaaccgca

SEQ ID NO: 502220 - DNA, 25 bp, Mus musculus
gatacctgggaactcattgtcctta

SEQ ID NO: 502221 - DNA, 25 bp, Mus musculus
gatacctgggaagtcattgtcctta

SEQ ID NO: 502222 - DNA, 25 bp, Mus musculus
gatacctgggtgacatactgtctaa

SEQ ID NO: 502223 - DNA, 25 bp, Mus musculus
gatacctgggtgtcatactgtctaa

SEQ ID NO: 502224 - DNA, 25 bp, Mus musculus
gatacctggtatctgaccctgtgaa

SEQ ID NO: 502225 - DNA, 25 bp, Mus musculus
gatacctggtatgtgaccctgtgaa

SEQ ID NO: 502226 - DNA, 25 bp, Mus musculus
gatacctggtgacacattagcttgt

SEQ ID NO: 502227 - DNA, 25 bp, Mus musculus
gatacctggtgagacattagcttgt

SEQ ID NO: 502228 - DNA, 25 bp, Mus musculus
gatacctggtgccaatgctgtctaa

SEQ ID NO: 502229 - DNA, 25 bp, Mus musculus
gatacctggtgcgaatgctgtctaa

SEQ ID NO: 502230 - DNA, 25 bp, Mus musculus
gatacctgtaagatctgcatgcctc

SEQ ID NO: 502231 - DNA, 25 bp, Mus musculus
gatacctgtaagttctgcatgcctc

SEQ ID NO: 502232 - DNA, 25 bp, Mus musculus
gatacctgtagcagacattactgtt

SEQ ID NO: 502233 - DNA, 25 bp, Mus musculus
gatacctgtagctgacattactgtt

SEQ ID NO: 502234 - DNA, 25 bp, Mus musculus
gatacctgtattaagctttactggg

SEQ ID NO: 502235 - DNA, 25 bp, Mus musculus
gatacctgtatttagctttactggg

SEQ ID NO: 502236 - DNA, 25 bp, Mus musculus
gatacctgtcagaattggagttatt

SEQ ID NO: 502237 - DNA, 25 bp, Mus musculus
gatacctgtcagtattggagttatt

SEQ ID NO: 502238 - DNA, 25 bp, Mus musculus
gatacctgtgaaatcaaggttgtct

SEQ ID NO: 502239 - DNA, 25 bp, Mus musculus
gatacctgtgaattcaaggttgtct

SEQ ID NO: 502240 - DNA, 25 bp, Mus musculus
gatacctgtgacatgttaactcatg

SEQ ID NO: 502241 - DNA, 25 bp, Mus musculus
gatacctgtgacttgttaactcatg

SEQ ID NO: 502242 - DNA, 25 bp, Mus musculus
gatacctgtgatatcactgagcata

SEQ ID NO: 502243 - DNA, 25 bp, Mus musculus
gatacctgtgatcggatcctctcct

SEQ ID NO: 502244 - DNA, 25 bp, Mus musculus
gatacctgtgatgggatcctctcct

SEQ ID NO: 502245 - DNA, 25 bp, Mus musculus
gatacctgtgatttcactgagcata

SEQ ID NO: 502246 - DNA, 25 bp, Mus musculus
gatacctgtgtaactggcatactgg

SEQ ID NO: 502247 - DNA, 25 bp, Mus musculus
gatacctgtgtatctggcatactgg

SEQ ID NO: 502248 - DNA, 25 bp, Mus musculus
gatacctgttagagctacatgtcag

SEQ ID NO: 502249 - DNA, 25 bp, Mus musculus
gatacctgttagtgctacatgtcag

SEQ ID NO: 502250 - DNA, 25 bp, Mus musculus
gatacctgttgcatcttaaggctgg

SEQ ID NO: 502251 - DNA, 25 bp, Mus musculus
gatacctgttgcttcttaaggctgg

SEQ ID NO: 502252 - DNA, 25 bp, Mus musculus
gatacctgtttaatggatccctctg

SEQ ID NO: 502253 - DNA, 25 bp, Mus musculus
gatacctgtttattggatccctctg

SEQ ID NO: 502254 - DNA, 25 bp, Mus musculus
gataccttacccagggaaggtcttg

SEQ ID NO: 502255 - DNA, 25 bp, Mus musculus
gataccttaccctgggaaggtcttg

SEQ ID NO: 502256 - DNA, 25 bp, Mus musculus
gataccttaggcagacactgtatta

SEQ ID NO: 502257 - DNA, 25 bp, Mus musculus
gataccttaggctgacactgtatta

SEQ ID NO: 502258 - DNA, 25 bp, Mus musculus
gataccttattcatttcaatcagca

SEQ ID NO: 502259 - DNA, 25 bp, Mus musculus
gataccttattcttttcaatcagca

SEQ ID NO: 502260 - DNA, 25 bp, Mus musculus
gataccttcaaaacatccttgtgat

SEQ ID NO: 502261 - DNA, 25 bp, Mus musculus
gataccttcaaatcatccttgtgat

SEQ ID NO: 502262 - DNA, 25 bp, Mus musculus
gataccttcactagaacttgaccag

SEQ ID NO: 502263 - DNA, 25 bp, Mus musculus
gataccttcacttgaacttgaccag

SEQ ID NO: 502264 - DNA, 25 bp, Mus musculus
gataccttcatcacagggtttggtt

SEQ ID NO: 502265 - DNA, 25 bp, Mus musculus
gataccttcatctcagggtttggtt

SEQ ID NO: 502266 - DNA, 25 bp, Mus musculus
gataccttctatagtcaaagtgatt

SEQ ID NO: 502267 - DNA, 25 bp, Mus musculus
gataccttctattgtcaaagtgatt

SEQ ID NO: 502268 - DNA, 25 bp, Mus musculus
gataccttctctcgaaagtcactat

SEQ ID NO: 502269 - DNA, 25 bp, Mus musculus
gataccttctctggaaagtcactat

SEQ ID NO: 502270 - DNA, 25 bp, Mus musculus
gataccttgagtattccactcgagc

SEQ ID NO: 502271 - DNA, 25 bp, Mus musculus
gataccttgagttttccactcgagc

SEQ ID NO: 502272 - DNA, 25 bp, Mus musculus
gataccttggatctcatcactggag

SEQ ID NO: 502273 - DNA, 25 bp, Mus musculus
gataccttggatgtcatcactggag

SEQ ID NO: 502274 - DNA, 25 bp, Mus musculus
gataccttggctctggccacggaca

SEQ ID NO: 502275 - DNA, 25 bp, Mus musculus
gataccttggctgtggccacggaca

SEQ ID NO: 502276 - DNA, 25 bp, Mus musculus
gataccttggtgaaacttctcaata

SEQ ID NO: 502277 - DNA, 25 bp, Mus musculus
gataccttggtgtaacttctcaata

SEQ ID NO: 502278 - DNA, 25 bp, Mus musculus
gataccttgtctaaatcagtcaata

SEQ ID NO: 502279 - DNA, 25 bp, Mus musculus
gataccttgtcttaatcagtcaata

SEQ ID NO: 502280 - DNA, 25 bp, Mus musculus
gataccttgtttacagtctagtgag

SEQ ID NO: 502281 - DNA, 25 bp, Mus musculus
gataccttgtttatcccgagtttct

SEQ ID NO: 502282 - DNA, 25 bp, Mus musculus
gataccttgttttcagtctagtgag

SEQ ID NO: 502283 - DNA, 25 bp, Mus musculus
gataccttgtttttcccgagtttct

SEQ ID NO: 502284 - DNA, 25 bp, Mus musculus
gatacctttggccaaattgccacct

SEQ ID NO: 502285 - DNA, 25 bp, Mus musculus
gatacctttggcgaaattgccacct

SEQ ID NO: 502286 - DNA, 25 bp, Mus musculus
gataccttttctacttaggctggaa

SEQ ID NO: 502287 - DNA, 25 bp, Mus musculus
gataccttttcttcttaggctggaa

SEQ ID NO: 502288 - DNA, 25 bp, Mus musculus
gatacgaacacaccaagccactgaa

SEQ ID NO: 502289 - DNA, 25 bp, Mus musculus
gatacgaacacagcaagccactgaa

SEQ ID NO: 502290 - DNA, 25 bp, Mus musculus
gatacgaagttcctgaagacctcct

SEQ ID NO: 502291 - DNA, 25 bp, Mus musculus
gatacgaagttcgtgaagacctcct

SEQ ID NO: 502292 - DNA, 25 bp, Mus musculus
gatacgactacaaggagtgtctcct

SEQ ID NO: 502293 - DNA, 25 bp, Mus musculus
gatacgactacatggagtgtctcct

SEQ ID NO: 502294 - DNA, 25 bp, Mus musculus
gatacgagccaacccagatactgat

SEQ ID NO: 502295 - DNA, 25 bp, Mus musculus
gatacgagccaagccagatactgat

SEQ ID NO: 502296 - DNA, 25 bp, Mus musculus
gatacgatcgacagaatgctcattc

SEQ ID NO: 502297 - DNA, 25 bp, Mus musculus
gatacgatcgactgaatgctcattc

SEQ ID NO: 502298 - DNA, 25 bp, Mus musculus
gatacgatgcaccatcaggttccac

SEQ ID NO: 502299 - DNA, 25 bp, Mus musculus
gatacgatgcacgatcaggttccac

SEQ ID NO: 502300 - DNA, 25 bp, Mus musculus
gatacgattatgatttcccatggaa

SEQ ID NO: 502301 - DNA, 25 bp, Mus musculus
gatacgattatgttttcccatggaa

SEQ ID NO: 502302 - DNA, 25 bp, Mus musculus
gatacgatttagacctccttttaga

SEQ ID NO: 502303 - DNA, 25 bp, Mus musculus
gatacgatttagtcctccttttaga

SEQ ID NO: 502304 - DNA, 25 bp, Mus musculus
gatacgcagacaccttttttgaatt

SEQ ID NO: 502305 - DNA, 25 bp, Mus musculus
gatacgcagacagcttttttgaatt

SEQ ID NO: 502306 - DNA, 25 bp, Mus musculus
gatacgcatagcattttgcatttaa

SEQ ID NO: 502307 - DNA, 25 bp, Mus musculus
gatacgcatagctttttgcatttaa

SEQ ID NO: 502308 - DNA, 25 bp, Mus musculus
gatacgcatttcaattcctagctta

SEQ ID NO: 502309 - DNA, 25 bp, Mus musculus
gatacgcatttctattcctagctta

SEQ ID NO: 502310 - DNA, 25 bp, Mus musculus
gatacgccagatcaggatcccaatt

SEQ ID NO: 502311 - DNA, 25 bp, Mus musculus
gatacgccagatgaggatcccaatt

SEQ ID NO: 502312 - DNA, 25 bp, Mus musculus
gatacgcccaacagcatctctctgg

SEQ ID NO: 502313 - DNA, 25 bp, Mus musculus
gatacgcccaactgcatctctctgg

SEQ ID NO: 502314 - DNA, 25 bp, Mus musculus
gatacgcccactaggcccaactaag

SEQ ID NO: 502315 - DNA, 25 bp, Mus musculus
gatacgcccacttggcccaactaag

SEQ ID NO: 502316 - DNA, 25 bp, Mus musculus
gatacgcctgcgcagggacagcaaa

SEQ ID NO: 502317 - DNA, 25 bp, Mus musculus
gatacgcctgcggagggacagcaaa

SEQ ID NO: 502318 - DNA, 25 bp, Mus musculus
gatacgctagccctcagaggagcag

SEQ ID NO: 502319 - DNA, 25 bp, Mus musculus
gatacgctagccgtcagaggagcag

SEQ ID NO: 502320 - DNA, 25 bp, Mus musculus
gatacgctatccatgctgggattaa

SEQ ID NO: 502321 - DNA, 25 bp, Mus musculus
gatacgctatccttgctgggattaa

SEQ ID NO: 502322 - DNA, 25 bp, Mus musculus
gatacgctcgcaaatatggacattt

SEQ ID NO: 502323 - DNA, 25 bp, Mus musculus
gatacgctcgcatatatggacattt

SEQ ID NO: 502324 - DNA, 25 bp, Mus musculus
gatacgctgcctctgtggagagcac

SEQ ID NO: 502325 - DNA, 25 bp, Mus musculus
gatacgctgcctgtgtggagagcac

SEQ ID NO: 502326 - DNA, 25 bp, Mus musculus
gatacgcttagcacttgagttgtac

SEQ ID NO: 502327 - DNA, 25 bp, Mus musculus
gatacgcttagctcttgagttgtac

SEQ ID NO: 502328 - DNA, 25 bp, Mus musculus
gatacgcttttcagagatcattttg

SEQ ID NO: 502329 - DNA, 25 bp, Mus musculus
gatacgcttttctgagatcattttg

SEQ ID NO: 502330 - DNA, 25 bp, Mus musculus
gatacggaacataagcgcacgctgc

SEQ ID NO: 502331 - DNA, 25 bp, Mus musculus
gatacggaacattagcgcacgctgc

SEQ ID NO: 502332 - DNA, 25 bp, Mus musculus
gatacggaaccactcactgacattg

SEQ ID NO: 502333 - DNA, 25 bp, Mus musculus
gatacggaaccagtcactgacattg

SEQ ID NO: 502334 - DNA, 25 bp, Mus musculus
gatacggaagctcacctaagaaaat

SEQ ID NO: 502335 - DNA, 25 bp, Mus musculus
gatacggaagctgacctaagaaaat

SEQ ID NO: 502336 - DNA, 25 bp, Mus musculus
gatacggacatgaagcgactttcca

SEQ ID NO: 502337 - DNA, 25 bp, Mus musculus
gatacggacatgtagcgactttcca

SEQ ID NO: 502338 - DNA, 25 bp, Mus musculus
gatacggcattcctggatctatttg

SEQ ID NO: 502339 - DNA, 25 bp, Mus musculus
gatacggcattcgtggatctatttg

SEQ ID NO: 502340 - DNA, 25 bp, Mus musculus
gatacggctctgcactcggctccga

SEQ ID NO: 502341 - DNA, 25 bp, Mus musculus
gatacggctctggactcggctccga

SEQ ID NO: 502342 - DNA, 25 bp, Mus musculus
gatacgggaaatctcctgacagtag

SEQ ID NO: 502343 - DNA, 25 bp, Mus musculus
gatacgggaaatgtcctgacagtag

SEQ ID NO: 502344 - DNA, 25 bp, Mus musculus
gatacgggcattaggtacacccctc

SEQ ID NO: 502345 - DNA, 25 bp, Mus musculus
gatacgggcatttggtacacccctc

SEQ ID NO: 502346 - DNA, 25 bp, Mus musculus
gatacgggcttcaaattatagtttc

SEQ ID NO: 502347 - DNA, 25 bp, Mus musculus
gatacgggcttctaattatagtttc

SEQ ID NO: 502348 - DNA, 25 bp, Mus musculus
gatacggtgggtcatcaaaggcaaa

SEQ ID NO: 502349 - DNA, 25 bp, Mus musculus
gatacggtgggtgatcaaaggcaaa

SEQ ID NO: 502350 - DNA, 25 bp, Mus musculus
gatacgtagcaaactttgaaaaaca

SEQ ID NO: 502351 - DNA, 25 bp, Mus musculus
gatacgtagcaatctttgaaaaaca

SEQ ID NO: 502352 - DNA, 25 bp, Mus musculus
gatacgtcaatcaaaatgtctacat

SEQ ID NO: 502353 - DNA, 25 bp, Mus musculus
gatacgtcaatctaaatgtctacat

SEQ ID NO: 502354 - DNA, 25 bp, Mus musculus
gatacgtcattcataaccagtggtg

SEQ ID NO: 502355 - DNA, 25 bp, Mus musculus
gatacgtcattcttaaccagtggtg

SEQ ID NO: 502356 - DNA, 25 bp, Mus musculus
gatacgtccagactgtgtgctttaa

SEQ ID NO: 502357 - DNA, 25 bp, Mus musculus
gatacgtccagagtgtgtgctttaa

SEQ ID NO: 502358 - DNA, 25 bp, Mus musculus
gatacgtccataacccagatggtgt

SEQ ID NO: 502359 - DNA, 25 bp, Mus musculus
gatacgtccatatcccagatggtgt

SEQ ID NO: 502360 - DNA, 25 bp, Mus musculus
gatacgtctgacagttgataccacc

SEQ ID NO: 502361 - DNA, 25 bp, Mus musculus
gatacgtctgactgttgataccacc

SEQ ID NO: 502362 - DNA, 25 bp, Mus musculus
gatacgtcttcaaagacaaggcctg

SEQ ID NO: 502363 - DNA, 25 bp, Mus musculus
gatacgtcttcatagacaaggcctg

SEQ ID NO: 502364 - DNA, 25 bp, Mus musculus
gatacgtgctacagaccttttgaaa

SEQ ID NO: 502365 - DNA, 25 bp, Mus musculus
gatacgtgctactgaccttttgaaa

SEQ ID NO: 502366 - DNA, 25 bp, Mus musculus
gatacgtgggagaagatcctctgtt

SEQ ID NO: 502367 - DNA, 25 bp, Mus musculus
gatacgtgggagtagatcctctgtt

SEQ ID NO: 502368 - DNA, 25 bp, Mus musculus
gatacgtgtttccagatgactccat

SEQ ID NO: 502369 - DNA, 25 bp, Mus musculus
gatacgtgtttcgagatgactccat

SEQ ID NO: 502370 - DNA, 25 bp, Mus musculus
gatacgttaccaagtgctgtgctgc

SEQ ID NO: 502371 - DNA, 25 bp, Mus musculus
gatacgttaccatgtgctgtgctgc

SEQ ID NO: 502372 - DNA, 25 bp, Mus musculus
gatacgttatctcaaggctgggagt

SEQ ID NO: 502373 - DNA, 25 bp, Mus musculus
gatacgttatctgaaggctgggagt

SEQ ID NO: 502374 - DNA, 25 bp, Mus musculus
gatacgttgactattcttcagaaac

SEQ ID NO: 502375 - DNA, 25 bp, Mus musculus
gatacgttgacttttcttcagaaac

SEQ ID NO: 502376 - DNA, 25 bp, Mus musculus
gatacgttgctaagatgtagacatt

SEQ ID NO: 502377 - DNA, 25 bp, Mus musculus
gatacgttgctatgatgtagacatt

SEQ ID NO: 502378 - DNA, 25 bp, Mus musculus
gatacgttgggcattccagttttgt

SEQ ID NO: 502379 - DNA, 25 bp, Mus musculus
gatacgttgggctttccagttttgt

SEQ ID NO: 502380 - DNA, 25 bp, Mus musculus
gatacgttgtccagtgatccaataa

SEQ ID NO: 502381 - DNA, 25 bp, Mus musculus
gatacgttgtcctgtgatccaataa

SEQ ID NO: 502382 - DNA, 25 bp, Mus musculus
gatacgtttgggattccaagctagt

SEQ ID NO: 502383 - DNA, 25 bp, Mus musculus
gatacgtttgggtttccaagctagt

SEQ ID NO: 502384 - DNA, 25 bp, Mus musculus
gatacgttttcactcttccattgtg

SEQ ID NO: 502385 - DNA, 25 bp, Mus musculus
gatacgttttcagtcttccattgtg

SEQ ID NO: 502386 - DNA, 25 bp, Mus musculus
gatactaaactcatgtcccttggat

SEQ ID NO: 502387 - DNA, 25 bp, Mus musculus
gatactaaactcttgtcccttggat

SEQ ID NO: 502388 - DNA, 25 bp, Mus musculus
gatactaactgtagagatggcccta

SEQ ID NO: 502389 - DNA, 25 bp, Mus musculus
gatactaactgttgagatggcccta

SEQ ID NO: 502390 - DNA, 25 bp, Mus musculus
gatactaaggtgctgcccactctgg

SEQ ID NO: 502391 - DNA, 25 bp, Mus musculus
gatactaaggtggtgcccactctgg

SEQ ID NO: 502392 - DNA, 25 bp, Mus musculus
gatactaatgtgagcctctagggct

SEQ ID NO: 502393 - DNA, 25 bp, Mus musculus
gatactaatgtgtgcctctagggct

SEQ ID NO: 502394 - DNA, 25 bp, Mus musculus
gatactacatagaaggtctccaggt

SEQ ID NO: 502395 - DNA, 25 bp, Mus musculus
gatactacatagtaggtctccaggt

SEQ ID NO: 502396 - DNA, 25 bp, Mus musculus
gatactaccaaaagattaggacagc

SEQ ID NO: 502397 - DNA, 25 bp, Mus musculus
gatactaccaaatgattaggacagc

SEQ ID NO: 502398 - DNA, 25 bp, Mus musculus
gatactaccataaactaccatggtc

SEQ ID NO: 502399 - DNA, 25 bp, Mus musculus
gatactaccatatactaccatggtc

SEQ ID NO: 502400 - DNA, 25 bp, Mus musculus
gatactaccttaccagtactaccct

SEQ ID NO: 502401 - DNA, 25 bp, Mus musculus
gatactaccttagcagtactaccct

SEQ ID NO: 502402 - DNA, 25 bp, Mus musculus
gatactacgaatattttctacacag

SEQ ID NO: 502403 - DNA, 25 bp, Mus musculus
gatactacgaattttttctacacag

SEQ ID NO: 502404 - DNA, 25 bp, Mus musculus
gatactactctcaatattgttggaa

SEQ ID NO: 502405 - DNA, 25 bp, Mus musculus
gatactactctctatattgttggaa

SEQ ID NO: 502406 - DNA, 25 bp, Mus musculus
gatactacttccacttgtccattgt

SEQ ID NO: 502407 - DNA, 25 bp, Mus musculus
gatactacttcctcttgtccattgt

SEQ ID NO: 502408 - DNA, 25 bp, Mus musculus
gatactacttctatatcttaaagat

SEQ ID NO: 502409 - DNA, 25 bp, Mus musculus
gatactacttctttatcttaaagat

SEQ ID NO: 502410 - DNA, 25 bp, Mus musculus
gatactactttaaattgaaccctca

SEQ ID NO: 502411 - DNA, 25 bp, Mus musculus
gatactactttatattgaaccctca

SEQ ID NO: 502412 - DNA, 25 bp, Mus musculus
gatactagaaaccaagctcccgtct

SEQ ID NO: 502413 - DNA, 25 bp, Mus musculus
gatactagaaacgaagctcccgtct

SEQ ID NO: 502414 - DNA, 25 bp, Mus musculus
gatactagaatgaacaccgtggaca

SEQ ID NO: 502415 - DNA, 25 bp, Mus musculus
gatactagaatgtacaccgtggaca

SEQ ID NO: 502416 - DNA, 25 bp, Mus musculus
gatactagccagcagggcgctgata

SEQ ID NO: 502417 - DNA, 25 bp, Mus musculus
gatactagccaggagggcgctgata

SEQ ID NO: 502418 - DNA, 25 bp, Mus musculus
gatactagcgaacttgctgacaaga

SEQ ID NO: 502419 - DNA, 25 bp, Mus musculus
gatactagcgaagttgctgacaaga

SEQ ID NO: 502420 - DNA, 25 bp, Mus musculus
gatactagtccacctatctcagcat

SEQ ID NO: 502421 - DNA, 25 bp, Mus musculus
gatactagtccagctatctcagcat

SEQ ID NO: 502422 - DNA, 25 bp, Mus musculus
gatactataacccatcgatgcctag

SEQ ID NO: 502423 - DNA, 25 bp, Mus musculus
gatactataaccgatcgatgcctag

SEQ ID NO: 502424 - DNA, 25 bp, Mus musculus
gatactatcagtattctccctgatg

SEQ ID NO: 502425 - DNA, 25 bp, Mus musculus
gatactatcagtcggaggagacctt

SEQ ID NO: 502426 - DNA, 25 bp, Mus musculus
gatactatcagtgggaggagacctt

SEQ ID NO: 502427 - DNA, 25 bp, Mus musculus
gatactatcagttttctccctgatg

SEQ ID NO: 502428 - DNA, 25 bp, Mus musculus
gatactatctatcaaacatttgttt

SEQ ID NO: 502429 - DNA, 25 bp, Mus musculus
gatactatctatgaaacatttgttt

SEQ ID NO: 502430 - DNA, 25 bp, Mus musculus
gatactatctcacatggagcttgaa

SEQ ID NO: 502431 - DNA, 25 bp, Mus musculus
gatactatctcagatggagcttgaa

SEQ ID NO: 502432 - DNA, 25 bp, Mus musculus
gatactatctgaagccagttgctga

SEQ ID NO: 502433 - DNA, 25 bp, Mus musculus
gatactatctgatgccagttgctga

SEQ ID NO: 502434 - DNA, 25 bp, Mus musculus
gatactatctgtaggaccactgtct

SEQ ID NO: 502435 - DNA, 25 bp, Mus musculus
gatactatctgttggaccactgtct

SEQ ID NO: 502436 - DNA, 25 bp, Mus musculus
gatactatgacgaaaaattcctgag

SEQ ID NO: 502437 - DNA, 25 bp, Mus musculus
gatactatgacgtaaaattcctgag

SEQ ID NO: 502438 - DNA, 25 bp, Mus musculus
gatactatggcaatctctctctaag

SEQ ID NO: 502439 - DNA, 25 bp, Mus musculus
gatactatggcattctctctctaag

SEQ ID NO: 502440 - DNA, 25 bp, Mus musculus
gatactatggttcttatgcagacta

SEQ ID NO: 502441 - DNA, 25 bp, Mus musculus
gatactatggttgttatgcagacta

SEQ ID NO: 502442 - DNA, 25 bp, Mus musculus
gatactatgtaaagttcctacccag

SEQ ID NO: 502443 - DNA, 25 bp, Mus musculus
gatactatgtaatgttcctacccag

SEQ ID NO: 502444 - DNA, 25 bp, Mus musculus
gatactatgttgattcaattttgac

SEQ ID NO: 502445 - DNA, 25 bp, Mus musculus
gatactatgttgtttcaattttgac

SEQ ID NO: 502446 - DNA, 25 bp, Mus musculus
gatactattccaaccatgactgtgg

SEQ ID NO: 502447 - DNA, 25 bp, Mus musculus
gatactattccatccatgactgtgg

SEQ ID NO: 502448 - DNA, 25 bp, Mus musculus
gatactattctgaagctttgtttca

SEQ ID NO: 502449 - DNA, 25 bp, Mus musculus
gatactattctgtagctttgtttca

SEQ ID NO: 502450 - DNA, 25 bp, Mus musculus
gatactattcttagattgcagtttg

SEQ ID NO: 502451 - DNA, 25 bp, Mus musculus
gatactattctttgattgcagtttg

SEQ ID NO: 502452 - DNA, 25 bp, Mus musculus
gatactattggcatggttgtaatcc

SEQ ID NO: 502453 - DNA, 25 bp, Mus musculus
gatactattggcttggttgtaatcc

SEQ ID NO: 502454 - DNA, 25 bp, Mus musculus
gatactatttgacctttaagttttt

SEQ ID NO: 502455 - DNA, 25 bp, Mus musculus
gatactatttgagctttaagttttt

SEQ ID NO: 502456 - DNA, 25 bp, Mus musculus
gatactatttggcacaacggcacca

SEQ ID NO: 502457 - DNA, 25 bp, Mus musculus
gatactatttgggacaacggcacca

SEQ ID NO: 502458 - DNA, 25 bp, Mus musculus
gatactcaaaccaagctcatctgga

SEQ ID NO: 502459 - DNA, 25 bp, Mus musculus
gatactcaaacctagctcatctgga

SEQ ID NO: 502460 - DNA, 25 bp, Mus musculus
gatactcaactcaactctctgaaaa

SEQ ID NO: 502461 - DNA, 25 bp, Mus musculus
gatactcaactctactctctgaaaa

SEQ ID NO: 502462 - DNA, 25 bp, Mus musculus
gatactcaaggccttggagaccctt

SEQ ID NO: 502463 - DNA, 25 bp, Mus musculus
gatactcaaggcgttggagaccctt

SEQ ID NO: 502464 - DNA, 25 bp, Mus musculus
gatactcaatatctggcaaggctgg

SEQ ID NO: 502465 - DNA, 25 bp, Mus musculus
gatactcaatatgtggcaaggctgg

SEQ ID NO: 502466 - DNA, 25 bp, Mus musculus
gatactcagagcctgcaggtttctt

SEQ ID NO: 502467 - DNA, 25 bp, Mus musculus
gatactcagagcgtgcaggtttctt

SEQ ID NO: 502468 - DNA, 25 bp, Mus musculus
gatactcagaggactacatttcttc

SEQ ID NO: 502469 - DNA, 25 bp, Mus musculus
gatactcagaggtctacatttcttc

SEQ ID NO: 502470 - DNA, 25 bp, Mus musculus
gatactcagatcagctccggcgtca

SEQ ID NO: 502471 - DNA, 25 bp, Mus musculus
gatactcagatctgctccggcgtca

SEQ ID NO: 502472 - DNA, 25 bp, Mus musculus
gatactcagattacctcaaacgcaa

SEQ ID NO: 502473 - DNA, 25 bp, Mus musculus
gatactcagatttcctcaaacgcaa

SEQ ID NO: 502474 - DNA, 25 bp, Mus musculus
gatactcagcaacattcagcctgga

SEQ ID NO: 502475 - DNA, 25 bp, Mus musculus
gatactcagcaagattcagcctgga

SEQ ID NO: 502476 - DNA, 25 bp, Mus musculus
gatactcagcatctgccttttcata

SEQ ID NO: 502477 - DNA, 25 bp, Mus musculus
gatactcagcatgtgccttttcata

SEQ ID NO: 502478 - DNA, 25 bp, Mus musculus
gatactcaggtgactacccatgtgt

SEQ ID NO: 502479 - DNA, 25 bp, Mus musculus
gatactcaggtgtctacccatgtgt

SEQ ID NO: 502480 - DNA, 25 bp, Mus musculus
gatactcagtagaatgcaggcttgg

SEQ ID NO: 502481 - DNA, 25 bp, Mus musculus
gatactcagtagtatgcaggcttgg

SEQ ID NO: 502482 - DNA, 25 bp, Mus musculus
gatactcagtgtctctctttctaga

SEQ ID NO: 502483 - DNA, 25 bp, Mus musculus
gatactcagtgtgtctctttctaga

SEQ ID NO: 502484 - DNA, 25 bp, Mus musculus
gatactcatattagcacacttagga

SEQ ID NO: 502485 - DNA, 25 bp, Mus musculus
gatactcatatttgcacacttagga

SEQ ID NO: 502486 - DNA, 25 bp, Mus musculus
gatactcatgacagatctctgacca

SEQ ID NO: 502487 - DNA, 25 bp, Mus musculus
gatactcatgactgatctctgacca

SEQ ID NO: 502488 - DNA, 25 bp, Mus musculus
gatactcatgggagtggagcccttt

SEQ ID NO: 502489 - DNA, 25 bp, Mus musculus
gatactcatgggtgtggagcccttt

SEQ ID NO: 502490 - DNA, 25 bp, Mus musculus
gatactcattttatatactctgcta

SEQ ID NO: 502491 - DNA, 25 bp, Mus musculus
gatactcattttttatactctgcta

SEQ ID NO: 502492 - DNA, 25 bp, Mus musculus
gatactccaagtcccctttaacaga

SEQ ID NO: 502493 - DNA, 25 bp, Mus musculus
gatactccaagtgccctttaacaga

SEQ ID NO: 502494 - DNA, 25 bp, Mus musculus
gatactccagaaatccaaaaagtag

SEQ ID NO: 502495 - DNA, 25 bp, Mus musculus
gatactccagaattccaaaaagtag

SEQ ID NO: 502496 - DNA, 25 bp, Mus musculus
gatactccagacatcttcacaatga

SEQ ID NO: 502497 - DNA, 25 bp, Mus musculus
gatactccagacttcttcacaatga

SEQ ID NO: 502498 - DNA, 25 bp, Mus musculus
gatactccatgaacaaagtgtttca

SEQ ID NO: 502499 - DNA, 25 bp, Mus musculus
gatactccatgatcaaagtgtttca

SEQ ID NO: 502500 - DNA, 25 bp, Mus musculus
gatactcccaaccttcagaatgtca

SEQ ID NO: 502501 - DNA, 25 bp, Mus musculus
gatactcccaacgttcagaatgtca

SEQ ID NO: 502502 - DNA, 25 bp, Mus musculus
gatactccctcacccattgggaagg

SEQ ID NO: 502503 - DNA, 25 bp, Mus musculus
gatactccctcagccattgggaagg

SEQ ID NO: 502504 - DNA, 25 bp, Mus musculus
gatactccgggcactgtgtctttcc

SEQ ID NO: 502505 - DNA, 25 bp, Mus musculus
gatactccgggctctgtgtctttcc

SEQ ID NO: 502506 - DNA, 25 bp, Mus musculus
gatactcctattcgtaatatggaag

SEQ ID NO: 502507 - DNA, 25 bp, Mus musculus
gatactcctattggtaatatggaag

SEQ ID NO: 502508 - DNA, 25 bp, Mus musculus
gatactcctctgacccaaatgtggg

SEQ ID NO: 502509 - DNA, 25 bp, Mus musculus
gatactcctctgtcccaaatgtggg

SEQ ID NO: 502510 - DNA, 25 bp, Mus musculus
gatactcctgagctacccatcaaaa

SEQ ID NO: 502511 - DNA, 25 bp, Mus musculus
gatactcctgaggtacccatcaaaa

SEQ ID NO: 502512 - DNA, 25 bp, Mus musculus
gatactccttagacgtatagaccaa

SEQ ID NO: 502513 - DNA, 25 bp, Mus musculus
gatactccttagtcgtatagaccaa

SEQ ID NO: 502514 - DNA, 25 bp, Mus musculus
gatactcgatgaatctagacttgga

SEQ ID NO: 502515 - DNA, 25 bp, Mus musculus
gatactcgatgattctagacttgga

SEQ ID NO: 502516 - DNA, 25 bp, Mus musculus
gatactcgcagcctttatatttaca

SEQ ID NO: 502517 - DNA, 25 bp, Mus musculus
gatactcgcagcgtttatatttaca

SEQ ID NO: 502518 - DNA, 25 bp, Mus musculus
gatactcgcggaagaaagctctgga

SEQ ID NO: 502519 - DNA, 25 bp, Mus musculus
gatactcgcggatgaaagctctgga

SEQ ID NO: 502520 - DNA, 25 bp, Mus musculus
gatactcgctcaactctgggacagt

SEQ ID NO: 502521 - DNA, 25 bp, Mus musculus
gatactcgctcatctctgggacagt

SEQ ID NO: 502522 - DNA, 25 bp, Mus musculus
gatactcggctgagttctggaagaa

SEQ ID NO: 502523 - DNA, 25 bp, Mus musculus
gatactcggctgtgttctggaagaa

SEQ ID NO: 502524 - DNA, 25 bp, Mus musculus
gatactcgtcagaagtctttattaa

SEQ ID NO: 502525 - DNA, 25 bp, Mus musculus
gatactcgtcagtagtctttattaa

SEQ ID NO: 502526 - DNA, 25 bp, Mus musculus
gatactctaaccacttgtaatgggc

SEQ ID NO: 502527 - DNA, 25 bp, Mus musculus
gatactctaacctcttgtaatgggc

SEQ ID NO: 502528 - DNA, 25 bp, Mus musculus
gatactctatatctagcggccttta

SEQ ID NO: 502529 - DNA, 25 bp, Mus musculus
gatactctatatgtagcggccttta

SEQ ID NO: 502530 - DNA, 25 bp, Mus musculus
gatactctcaacctcttgtatttgg

SEQ ID NO: 502531 - DNA, 25 bp, Mus musculus
gatactctcaacgtcttgtatttgg

SEQ ID NO: 502532 - DNA, 25 bp, Mus musculus
gatactctcaagatctatccaaatt

SEQ ID NO: 502533 - DNA, 25 bp, Mus musculus
gatactctcaagttctatccaaatt

SEQ ID NO: 502534 - DNA, 25 bp, Mus musculus
gatactctcgccatcactttgaaga

SEQ ID NO: 502535 - DNA, 25 bp, Mus musculus
gatactctcgccttcactttgaaga

SEQ ID NO: 502536 - DNA, 25 bp, Mus musculus
gatactctgaatatgctggtcaagg

SEQ ID NO: 502537 - DNA, 25 bp, Mus musculus
gatactctgaatttgctggtcaagg

SEQ ID NO: 502538 - DNA, 25 bp, Mus musculus
gatactctgagaattgctgttgtgc

SEQ ID NO: 502539 - DNA, 25 bp, Mus musculus
gatactctgagatttgctgttgtgc

SEQ ID NO: 502540 - DNA, 25 bp, Mus musculus
gatactctgatgaatcttctccatg

SEQ ID NO: 502541 - DNA, 25 bp, Mus musculus
gatactctgatgtatcttctccatg

SEQ ID NO: 502542 - DNA, 25 bp, Mus musculus
gatactctggacactaaaaggcaca

SEQ ID NO: 502543 - DNA, 25 bp, Mus musculus
gatactctggactctaaaaggcaca

SEQ ID NO: 502544 - DNA, 25 bp, Mus musculus
gatactctggatacatgaaggaaca

SEQ ID NO: 502545 - DNA, 25 bp, Mus musculus
gatactctggattcatgaaggaaca

SEQ ID NO: 502546 - DNA, 25 bp, Mus musculus
gatactctgtcaaagggtgaaacaa

SEQ ID NO: 502547 - DNA, 25 bp, Mus musculus
gatactctgtcatagggtgaaacaa

SEQ ID NO: 502548 - DNA, 25 bp, Mus musculus
gatactctgtgcagctatggcttcc

SEQ ID NO: 502549 - DNA, 25 bp, Mus musculus
gatactctgtgctgctatggcttcc

SEQ ID NO: 502550 - DNA, 25 bp, Mus musculus
gatactctgttcaaagccgcatgct

SEQ ID NO: 502551 - DNA, 25 bp, Mus musculus
gatactctgttctaagccgcatgct

SEQ ID NO: 502552 - DNA, 25 bp, Mus musculus
gatactcttaataatcatatgcatc

SEQ ID NO: 502553 - DNA, 25 bp, Mus musculus
gatactcttaattatcatatgcatc

SEQ ID NO: 502554 - DNA, 25 bp, Mus musculus
gatactcttggaactgattttgaac

SEQ ID NO: 502555 - DNA, 25 bp, Mus musculus
gatactcttggatctgattttgaac

SEQ ID NO: 502556 - DNA, 25 bp, Mus musculus
gatactcttgtaaactgtgacagga

SEQ ID NO: 502557 - DNA, 25 bp, Mus musculus
gatactcttgtatactgtgacagga

SEQ ID NO: 502558 - DNA, 25 bp, Mus musculus
gatactcttgttccctttctacagg

SEQ ID NO: 502559 - DNA, 25 bp, Mus musculus
gatactcttgttgcctttctacagg

SEQ ID NO: 502560 - DNA, 25 bp, Mus musculus
gatactctttggctcctggctcctt

SEQ ID NO: 502561 - DNA, 25 bp, Mus musculus
gatactctttgggtcctggctcctt

SEQ ID NO: 502562 - DNA, 25 bp, Mus musculus
gatactctttttctggttttaatga

SEQ ID NO: 502563 - DNA, 25 bp, Mus musculus
gatactctttttgtggttttaatga

SEQ ID NO: 502564 - DNA, 25 bp, Mus musculus
gatactgaagctaagcaacttgtca

SEQ ID NO: 502565 - DNA, 25 bp, Mus musculus
gatactgaagcttagcaacttgtca

SEQ ID NO: 502566 - DNA, 25 bp, Mus musculus
gatactgaatatctactttcctggg

SEQ ID NO: 502567 - DNA, 25 bp, Mus musculus
gatactgaatatgtactttcctggg

SEQ ID NO: 502568 - DNA, 25 bp, Mus musculus
gatactgaattgacgccaggaactg

SEQ ID NO: 502569 - DNA, 25 bp, Mus musculus
gatactgaattgtcgccaggaactg

SEQ ID NO: 502570 - DNA, 25 bp, Mus musculus
gatactgacattcaaccatttctga

SEQ ID NO: 502571 - DNA, 25 bp, Mus musculus
gatactgacattgaaccatttctga

SEQ ID NO: 502572 - DNA, 25 bp, Mus musculus
gatactgaccatagcatgtgacact

SEQ ID NO: 502573 - DNA, 25 bp, Mus musculus
gatactgaccattgcatgtgacact

SEQ ID NO: 502574 - DNA, 25 bp, Mus musculus
gatactgacctgaacattttgaaca

SEQ ID NO: 502575 - DNA, 25 bp, Mus musculus
gatactgacctgctctgccttgaat

SEQ ID NO: 502576 - DNA, 25 bp, Mus musculus
gatactgacctggtctgccttgaat

SEQ ID NO: 502577 - DNA, 25 bp, Mus musculus
gatactgacctgtacattttgaaca

SEQ ID NO: 502578 - DNA, 25 bp, Mus musculus
gatactgactccagtgtcagcaaaa

SEQ ID NO: 502579 - DNA, 25 bp, Mus musculus
gatactgactcctgtgtcagcaaaa

SEQ ID NO: 502580 - DNA, 25 bp, Mus musculus
gatactgactcgcaggacaccatca

SEQ ID NO: 502581 - DNA, 25 bp, Mus musculus
gatactgactcggaggacaccatca

SEQ ID NO: 502582 - DNA, 25 bp, Mus musculus
gatactgagggcagataatatggct

SEQ ID NO: 502583 - DNA, 25 bp, Mus musculus
gatactgagggctgataatatggct

SEQ ID NO: 502584 - DNA, 25 bp, Mus musculus
gatactgatcacctgtgccagactg

SEQ ID NO: 502585 - DNA, 25 bp, Mus musculus
gatactgatcacgtgtgccagactg

SEQ ID NO: 502586 - DNA, 25 bp, Mus musculus
gatactgatcagacaacagctgcta

SEQ ID NO: 502587 - DNA, 25 bp, Mus musculus
gatactgatcagtcaacagctgcta

SEQ ID NO: 502588 - DNA, 25 bp, Mus musculus
gatactgatcttaacaactgtttaa

SEQ ID NO: 502589 - DNA, 25 bp, Mus musculus
gatactgatctttacaactgtttaa

SEQ ID NO: 502590 - DNA, 25 bp, Mus musculus
gatactgatgctctcatagatgcga

SEQ ID NO: 502591 - DNA, 25 bp, Mus musculus
gatactgatgctgtcatagatgcga

SEQ ID NO: 502592 - DNA, 25 bp, Mus musculus
gatactgatgggaccttagttgttg

SEQ ID NO: 502593 - DNA, 25 bp, Mus musculus
gatactgatgggtccttagttgttg

SEQ ID NO: 502594 - DNA, 25 bp, Mus musculus
gatactgattccaagtcttggctaa

SEQ ID NO: 502595 - DNA, 25 bp, Mus musculus
gatactgattcctagtcttggctaa

SEQ ID NO: 502596 - DNA, 25 bp, Mus musculus
gatactgcaagtcacgtggacattt

SEQ ID NO: 502597 - DNA, 25 bp, Mus musculus
gatactgcaagtgacgtggacattt

SEQ ID NO: 502598 - DNA, 25 bp, Mus musculus
gatactgcaataactgagggaaaaa

SEQ ID NO: 502599 - DNA, 25 bp, Mus musculus
gatactgcaatatctgagggaaaaa

SEQ ID NO: 502600 - DNA, 25 bp, Mus musculus
gatactgcaccacttcttgaggatg

SEQ ID NO: 502601 - DNA, 25 bp, Mus musculus
gatactgcaccagttcttgaggatg

SEQ ID NO: 502602 - DNA, 25 bp, Mus musculus
gatactgcactaagacctcagccag

SEQ ID NO: 502603 - DNA, 25 bp, Mus musculus
gatactgcactatgacctcagccag

SEQ ID NO: 502604 - DNA, 25 bp, Mus musculus
gatactgcactgacctcatagagga

SEQ ID NO: 502605 - DNA, 25 bp, Mus musculus
gatactgcactgtcctcatagagga

SEQ ID NO: 502606 - DNA, 25 bp, Mus musculus
gatactgcagatcaggtcatggctt

SEQ ID NO: 502607 - DNA, 25 bp, Mus musculus
gatactgcagatgaggtcatggctt

SEQ ID NO: 502608 - DNA, 25 bp, Mus musculus
gatactgcagccaaaactggactga

SEQ ID NO: 502609 - DNA, 25 bp, Mus musculus
gatactgcagccctagcagggtgta

SEQ ID NO: 502610 - DNA, 25 bp, Mus musculus
gatactgcagccgtagcagggtgta

SEQ ID NO: 502611 - DNA, 25 bp, Mus musculus
gatactgcagcctaaactggactga

SEQ ID NO: 502612 - DNA, 25 bp, Mus musculus
gatactgcattaagctcacatgaaa

SEQ ID NO: 502613 - DNA, 25 bp, Mus musculus
gatactgcattatgctcacatgaaa

SEQ ID NO: 502614 - DNA, 25 bp, Mus musculus
gatactgccacaagctgcacagtgc

SEQ ID NO: 502615 - DNA, 25 bp, Mus musculus
gatactgccacacaatttccatggg

SEQ ID NO: 502616 - DNA, 25 bp, Mus musculus
gatactgccacagaatttccatggg

SEQ ID NO: 502617 - DNA, 25 bp, Mus musculus
gatactgccacatgctgcacagtgc

SEQ ID NO: 502618 - DNA, 25 bp, Mus musculus
gatactgccctcatgttacttaaag

SEQ ID NO: 502619 - DNA, 25 bp, Mus musculus
gatactgccctcttgttacttaaag

SEQ ID NO: 502620 - DNA, 25 bp, Mus musculus
gatactgccctgaatatgatcacac

SEQ ID NO: 502621 - DNA, 25 bp, Mus musculus
gatactgccctgtatatgatcacac

SEQ ID NO: 502622 - DNA, 25 bp, Mus musculus
gatactgcccttcatatcctaatag

SEQ ID NO: 502623 - DNA, 25 bp, Mus musculus
gatactgcccttgatatcctaatag

SEQ ID NO: 502624 - DNA, 25 bp, Mus musculus
gatactgcggttacactggtgggtt

SEQ ID NO: 502625 - DNA, 25 bp, Mus musculus
gatactgcggtttcactggtgggtt

SEQ ID NO: 502626 - DNA, 25 bp, Mus musculus
gatactgctaccctcactttaaaag

SEQ ID NO: 502627 - DNA, 25 bp, Mus musculus
gatactgctaccgtcactttaaaag

SEQ ID NO: 502628 - DNA, 25 bp, Mus musculus
gatactgctgaccagataaggaggt

SEQ ID NO: 502629 - DNA, 25 bp, Mus musculus
gatactgctgacgagataaggaggt

SEQ ID NO: 502630 - DNA, 25 bp, Mus musculus
gatactgctggaatactctcgggat

SEQ ID NO: 502631 - DNA, 25 bp, Mus musculus
gatactgctggattactctcgggat

SEQ ID NO: 502632 - DNA, 25 bp, Mus musculus
gatactgctgtaagttctccatgaa

SEQ ID NO: 502633 - DNA, 25 bp, Mus musculus
gatactgctgtatgttctccatgaa

SEQ ID NO: 502634 - DNA, 25 bp, Mus musculus
gatactgcttacagcccaatggtca

SEQ ID NO: 502635 - DNA, 25 bp, Mus musculus
gatactgcttactgcccaatggtca

SEQ ID NO: 502636 - DNA, 25 bp, Mus musculus
gatactgcttatccagctgccaatt

SEQ ID NO: 502637 - DNA, 25 bp, Mus musculus
gatactgcttatgcagctgccaatt

SEQ ID NO: 502638 - DNA, 25 bp, Mus musculus
gatactgctttccttgaaaacctgg

SEQ ID NO: 502639 - DNA, 25 bp, Mus musculus
gatactgctttcgttgaaaacctgg

SEQ ID NO: 502640 - DNA, 25 bp, Mus musculus
gatactggaaaactgaacacactgt

SEQ ID NO: 502641 - DNA, 25 bp, Mus musculus
gatactggaaaagtgaacacactgt

SEQ ID NO: 502642 - DNA, 25 bp, Mus musculus
gatactggaaacaagcccactcaga

SEQ ID NO: 502643 - DNA, 25 bp, Mus musculus
gatactggaaactagcccactcaga

SEQ ID NO: 502644 - DNA, 25 bp, Mus musculus
gatactggaactagagtgcacttgt

SEQ ID NO: 502645 - DNA, 25 bp, Mus musculus
gatactggaacttgagtgcacttgt

SEQ ID NO: 502646 - DNA, 25 bp, Mus musculus
gatactggaattctctgttccctca

SEQ ID NO: 502647 - DNA, 25 bp, Mus musculus
gatactggaattgtctgttccctca

SEQ ID NO: 502648 - DNA, 25 bp, Mus musculus
gatactggacatatctagggccctt

SEQ ID NO: 502649 - DNA, 25 bp, Mus musculus
gatactggacatttctagggccctt

SEQ ID NO: 502650 - DNA, 25 bp, Mus musculus
gatactggagtgactttgtctctat

SEQ ID NO: 502651 - DNA, 25 bp, Mus musculus
gatactggagtgtctttgtctctat

SEQ ID NO: 502652 - DNA, 25 bp, Mus musculus
gatactggatgcactcccgtgagca

SEQ ID NO: 502653 - DNA, 25 bp, Mus musculus
gatactggatgctctcccgtgagca

SEQ ID NO: 502654 - DNA, 25 bp, Mus musculus
gatactggcacccagactgattggg

SEQ ID NO: 502655 - DNA, 25 bp, Mus musculus
gatactggcaccgagactgattggg

SEQ ID NO: 502656 - DNA, 25 bp, Mus musculus
gatactgggctcaaaccagacccga

SEQ ID NO: 502657 - DNA, 25 bp, Mus musculus
gatactgggctcaattatcctggtg

SEQ ID NO: 502658 - DNA, 25 bp, Mus musculus
gatactgggctctaaccagacccga

SEQ ID NO: 502659 - DNA, 25 bp, Mus musculus
gatactgggctctattatcctggtg

SEQ ID NO: 502660 - DNA, 25 bp, Mus musculus
gatactgggctgagctccatgcata

SEQ ID NO: 502661 - DNA, 25 bp, Mus musculus
gatactgggctgtgctccatgcata

SEQ ID NO: 502662 - DNA, 25 bp, Mus musculus
gatactgggcttaagctgaaatttt

SEQ ID NO: 502663 - DNA, 25 bp, Mus musculus
gatactgggctttagctgaaatttt

SEQ ID NO: 502664 - DNA, 25 bp, Mus musculus
gatactgggtcaaagtgtacaactg

SEQ ID NO: 502665 - DNA, 25 bp, Mus musculus
gatactgggtcatagtgtacaactg

SEQ ID NO: 502666 - DNA, 25 bp, Mus musculus
gatactggtacacaatagagagttt

SEQ ID NO: 502667 - DNA, 25 bp, Mus musculus
gatactggtacagaatagagagttt

SEQ ID NO: 502668 - DNA, 25 bp, Mus musculus
gatactggtcctcaagtctaccaaa

SEQ ID NO: 502669 - DNA, 25 bp, Mus musculus
gatactggtcctgaagtctaccaaa

SEQ ID NO: 502670 - DNA, 25 bp, Mus musculus
gatactggtgacataactcttttcg

SEQ ID NO: 502671 - DNA, 25 bp, Mus musculus
gatactggtgacttaactcttttcg

SEQ ID NO: 502672 - DNA, 25 bp, Mus musculus
gatactggttttccttgactgactt

SEQ ID NO: 502673 - DNA, 25 bp, Mus musculus
gatactggttttgcttgactgactt

SEQ ID NO: 502674 - DNA, 25 bp, Mus musculus
gatactgtaaacatctgcattatgt

SEQ ID NO: 502675 - DNA, 25 bp, Mus musculus
gatactgtaaacttctgcattatgt

SEQ ID NO: 502676 - DNA, 25 bp, Mus musculus
gatactgtaaagaatataaagccta

SEQ ID NO: 502677 - DNA, 25 bp, Mus musculus
gatactgtaaagtatataaagccta

SEQ ID NO: 502678 - DNA, 25 bp, Mus musculus
gatactgtaaatatggcacccttgg

SEQ ID NO: 502679 - DNA, 25 bp, Mus musculus
gatactgtaaatttggcacccttgg

SEQ ID NO: 502680 - DNA, 25 bp, Mus musculus
gatactgtaatgaagctgctcctga

SEQ ID NO: 502681 - DNA, 25 bp, Mus musculus
gatactgtaatgtagctgctcctga

SEQ ID NO: 502682 - DNA, 25 bp, Mus musculus
gatactgtacggcataactgatttc

SEQ ID NO: 502683 - DNA, 25 bp, Mus musculus
gatactgtacgggataactgatttc

SEQ ID NO: 502684 - DNA, 25 bp, Mus musculus
gatactgtagatactgcaccggcgc

SEQ ID NO: 502685 - DNA, 25 bp, Mus musculus
gatactgtagattctgcaccggcgc

SEQ ID NO: 502686 - DNA, 25 bp, Mus musculus
gatactgtatcactctgctttgact

SEQ ID NO: 502687 - DNA, 25 bp, Mus musculus
gatactgtatcagtctgctttgact

SEQ ID NO: 502688 - DNA, 25 bp, Mus musculus
gatactgtatctcatttcttctaga

SEQ ID NO: 502689 - DNA, 25 bp, Mus musculus
gatactgtatctgatttcttctaga

SEQ ID NO: 502690 - DNA, 25 bp, Mus musculus
gatactgtatgcagctgtcccagat

SEQ ID NO: 502691 - DNA, 25 bp, Mus musculus
gatactgtatgctgctgtcccagat

SEQ ID NO: 502692 - DNA, 25 bp, Mus musculus
gatactgtatgtacagctgaaactc

SEQ ID NO: 502693 - DNA, 25 bp, Mus musculus
gatactgtatgttcagctgaaactc

SEQ ID NO: 502694 - DNA, 25 bp, Mus musculus
gatactgtcaagagctaaaacccgt

SEQ ID NO: 502695 - DNA, 25 bp, Mus musculus
gatactgtcaagtgctaaaacccgt

SEQ ID NO: 502696 - DNA, 25 bp, Mus musculus
gatactgtcccaacacacatatgtg

SEQ ID NO: 502697 - DNA, 25 bp, Mus musculus
gatactgtcccatcacacatatgtg

SEQ ID NO: 502698 - DNA, 25 bp, Mus musculus
gatactgtctaaacatctgcaagga

SEQ ID NO: 502699 - DNA, 25 bp, Mus musculus
gatactgtctaatcatctgcaagga

SEQ ID NO: 502700 - DNA, 25 bp, Mus musculus
gatactgtctacactcaaaaattgc

SEQ ID NO: 502701 - DNA, 25 bp, Mus musculus
gatactgtctactctcaaaaattgc

SEQ ID NO: 502702 - DNA, 25 bp, Mus musculus
gatactgtgaacctatgatgaagag

SEQ ID NO: 502703 - DNA, 25 bp, Mus musculus
gatactgtgaacgtatgatgaagag

SEQ ID NO: 502704 - DNA, 25 bp, Mus musculus
gatactgtgaatacagcccgcgtag

SEQ ID NO: 502705 - DNA, 25 bp, Mus musculus
gatactgtgaattcagcccgcgtag

SEQ ID NO: 502706 - DNA, 25 bp, Mus musculus
gatactgtgcatatggacacaccag

SEQ ID NO: 502707 - DNA, 25 bp, Mus musculus
gatactgtgcatttggacacaccag

SEQ ID NO: 502708 - DNA, 25 bp, Mus musculus
gatactgtggccaccatatttggca

SEQ ID NO: 502709 - DNA, 25 bp, Mus musculus
gatactgtggcctccatatttggca

SEQ ID NO: 502710 - DNA, 25 bp, Mus musculus
gatactgtgtctcaacaaagcttta

SEQ ID NO: 502711 - DNA, 25 bp, Mus musculus
gatactgtgtctgaacaaagcttta

SEQ ID NO: 502712 - DNA, 25 bp, Mus musculus
gatactgtgttaaatgaaaccctat

SEQ ID NO: 502713 - DNA, 25 bp, Mus musculus
gatactgtgttatatgaaaccctat

SEQ ID NO: 502714 - DNA, 25 bp, Mus musculus
gatactgttaaactttcttatgtaa

SEQ ID NO: 502715 - DNA, 25 bp, Mus musculus
gatactgttaaagtttcttatgtaa

SEQ ID NO: 502716 - DNA, 25 bp, Mus musculus
gatactgttagcaattagcccttct

SEQ ID NO: 502717 - DNA, 25 bp, Mus musculus
gatactgttagctattagcccttct

SEQ ID NO: 502718 - DNA, 25 bp, Mus musculus
gatactgttatacacactttgttga

SEQ ID NO: 502719 - DNA, 25 bp, Mus musculus
gatactgttatagacactttgttga

SEQ ID NO: 502720 - DNA, 25 bp, Mus musculus
gatactgttgacatcctagtctctg

SEQ ID NO: 502721 - DNA, 25 bp, Mus musculus
gatactgttgacttcctagtctctg

SEQ ID NO: 502722 - DNA, 25 bp, Mus musculus
gatactgttggccagaacgtcgtcg

SEQ ID NO: 502723 - DNA, 25 bp, Mus musculus
gatactgttggcgagaacgtcgtcg

SEQ ID NO: 502724 - DNA, 25 bp, Mus musculus
gatactgttgggaccatatttactt

SEQ ID NO: 502725 - DNA, 25 bp, Mus musculus
gatactgttgggtccatatttactt

SEQ ID NO: 502726 - DNA, 25 bp, Mus musculus
gatactgttgttatcattttctaca

SEQ ID NO: 502727 - DNA, 25 bp, Mus musculus
gatactgttgttttcattttctaca

SEQ ID NO: 502728 - DNA, 25 bp, Mus musculus
gatactgtttctaaatggccgtttt

SEQ ID NO: 502729 - DNA, 25 bp, Mus musculus
gatactgtttcttaatggccgtttt

SEQ ID NO: 502730 - DNA, 25 bp, Mus musculus
gatactgtttgccttgtactctggt

SEQ ID NO: 502731 - DNA, 25 bp, Mus musculus
gatactgtttgcgttgtactctggt

SEQ ID NO: 502732 - DNA, 25 bp, Mus musculus
gatactgtttttctgttgacgtgga

SEQ ID NO: 502733 - DNA, 25 bp, Mus musculus
gatactgtttttgtgttgacgtgga

SEQ ID NO: 502734 - DNA, 25 bp, Mus musculus
gatacttaaactcctcatggtccag

SEQ ID NO: 502735 - DNA, 25 bp, Mus musculus
gatacttaaactgctcatggtccag

SEQ ID NO: 502736 - DNA, 25 bp, Mus musculus
gatacttaaagcaacaactgtgtga

SEQ ID NO: 502737 - DNA, 25 bp, Mus musculus
gatacttaaagctacaactgtgtga

SEQ ID NO: 502738 - DNA, 25 bp, Mus musculus
gatacttaccttcagacggtctctc

SEQ ID NO: 502739 - DNA, 25 bp, Mus musculus
gatacttaccttcagcaaatgccag

SEQ ID NO: 502740 - DNA, 25 bp, Mus musculus
gatacttaccttgagacggtctctc

SEQ ID NO: 502741 - DNA, 25 bp, Mus musculus
gatacttaccttgagcaaatgccag

SEQ ID NO: 502742 - DNA, 25 bp, Mus musculus
gatacttagcagcaccagtcttttg

SEQ ID NO: 502743 - DNA, 25 bp, Mus musculus
gatacttagcaggaccagtcttttg

SEQ ID NO: 502744 - DNA, 25 bp, Mus musculus
gatacttagggaatggctctcagag

SEQ ID NO: 502745 - DNA, 25 bp, Mus musculus
gatacttagggattggctctcagag

SEQ ID NO: 502746 - DNA, 25 bp, Mus musculus
gatacttcaatcacaaacccagaat

SEQ ID NO: 502747 - DNA, 25 bp, Mus musculus
gatacttcaatctcaaacccagaat

SEQ ID NO: 502748 - DNA, 25 bp, Mus musculus
gatacttcacgactcttgttaatgt

SEQ ID NO: 502749 - DNA, 25 bp, Mus musculus
gatacttcacgagtcttgttaatgt

SEQ ID NO: 502750 - DNA, 25 bp, Mus musculus
gatacttcaggacagacatgtcacc

SEQ ID NO: 502751 - DNA, 25 bp, Mus musculus
gatacttcaggagagacatgtcacc

SEQ ID NO: 502752 - DNA, 25 bp, Mus musculus
gatacttcgataccgttgtgaatag

SEQ ID NO: 502753 - DNA, 25 bp, Mus musculus
gatacttcgatagcgttgtgaatag

SEQ ID NO: 502754 - DNA, 25 bp, Mus musculus
gatacttcgtatatacattgtcctt

SEQ ID NO: 502755 - DNA, 25 bp, Mus musculus
gatacttcgtatttacattgtcctt

SEQ ID NO: 502756 - DNA, 25 bp, Mus musculus
gatacttctaatcctgtcaacatat

SEQ ID NO: 502757 - DNA, 25 bp, Mus musculus
gatacttctaatgctgtcaacatat

SEQ ID NO: 502758 - DNA, 25 bp, Mus musculus
gatacttctccgaaaaggcttttgt

SEQ ID NO: 502759 - DNA, 25 bp, Mus musculus
gatacttctccgtaaaggcttttgt

SEQ ID NO: 502760 - DNA, 25 bp, Mus musculus
gatacttctcctatgtctttactaa

SEQ ID NO: 502761 - DNA, 25 bp, Mus musculus
gatacttctcctttgtctttactaa

SEQ ID NO: 502762 - DNA, 25 bp, Mus musculus
gatacttctctgaatttctctgaac

SEQ ID NO: 502763 - DNA, 25 bp, Mus musculus
gatacttctctgtatttctctgaac

SEQ ID NO: 502764 - DNA, 25 bp, Mus musculus
gatacttctgtcaaaaacctcaccc

SEQ ID NO: 502765 - DNA, 25 bp, Mus musculus
gatacttctgtctaaaacctcaccc

SEQ ID NO: 502766 - DNA, 25 bp, Mus musculus
gatacttcttaacctaggtatagca

SEQ ID NO: 502767 - DNA, 25 bp, Mus musculus
gatacttcttaagctaggtatagca

SEQ ID NO: 502768 - DNA, 25 bp, Mus musculus
gatacttgaatgaagcatggcaggg

SEQ ID NO: 502769 - DNA, 25 bp, Mus musculus
gatacttgaatgtagcatggcaggg

SEQ ID NO: 502770 - DNA, 25 bp, Mus musculus
gatacttgacttcagccattataga

SEQ ID NO: 502771 - DNA, 25 bp, Mus musculus
gatacttgacttgagccattataga

SEQ ID NO: 502772 - DNA, 25 bp, Mus musculus
gatacttgagacatgcaatttggaa

SEQ ID NO: 502773 - DNA, 25 bp, Mus musculus
gatacttgagacttgcaatttggaa

SEQ ID NO: 502774 - DNA, 25 bp, Mus musculus
gatacttgattgacttctcattttg

SEQ ID NO: 502775 - DNA, 25 bp, Mus musculus
gatacttgattgtcttctcattttg

SEQ ID NO: 502776 - DNA, 25 bp, Mus musculus
gatacttgcaaaacatctggtgaaa

SEQ ID NO: 502777 - DNA, 25 bp, Mus musculus
gatacttgcaaaatcacaacacatt

SEQ ID NO: 502778 - DNA, 25 bp, Mus musculus
gatacttgcaaatcatctggtgaaa

SEQ ID NO: 502779 - DNA, 25 bp, Mus musculus
gatacttgcaaattcacaacacatt

SEQ ID NO: 502780 - DNA, 25 bp, Mus musculus
gatacttgcacaccatttgttttgt

SEQ ID NO: 502781 - DNA, 25 bp, Mus musculus
gatacttgcacagcatttgttttgt

SEQ ID NO: 502782 - DNA, 25 bp, Mus musculus
gatacttgcagaaattacaggagct

SEQ ID NO: 502783 - DNA, 25 bp, Mus musculus
gatacttgcagatattacaggagct

SEQ ID NO: 502784 - DNA, 25 bp, Mus musculus
gatacttgcttcaattaccttttat

SEQ ID NO: 502785 - DNA, 25 bp, Mus musculus
gatacttgcttctattaccttttat

SEQ ID NO: 502786 - DNA, 25 bp, Mus musculus
gatacttggcacattgatgcatctg

SEQ ID NO: 502787 - DNA, 25 bp, Mus musculus
gatacttggcactttgatgcatctg

SEQ ID NO: 502788 - DNA, 25 bp, Mus musculus
gatacttggttgaatttcctacata

SEQ ID NO: 502789 - DNA, 25 bp, Mus musculus
gatacttggttgtatttcctacata

SEQ ID NO: 502790 - DNA, 25 bp, Mus musculus
gatacttgtataaagccagcctggt

SEQ ID NO: 502791 - DNA, 25 bp, Mus musculus
gatacttgtatatagccagcctggt

SEQ ID NO: 502792 - DNA, 25 bp, Mus musculus
gatacttgtccaatgtgccatcaga

SEQ ID NO: 502793 - DNA, 25 bp, Mus musculus
gatacttgtccattgtgccatcaga

SEQ ID NO: 502794 - DNA, 25 bp, Mus musculus
gatacttgtgatctctaactctgca

SEQ ID NO: 502795 - DNA, 25 bp, Mus musculus
gatacttgtgatgtctaactctgca

SEQ ID NO: 502796 - DNA, 25 bp, Mus musculus
gatacttgtgttccagttccactta

SEQ ID NO: 502797 - DNA, 25 bp, Mus musculus
gatacttgtgttgcagttccactta

SEQ ID NO: 502798 - DNA, 25 bp, Mus musculus
gatacttgttcaagaatcggaaact

SEQ ID NO: 502799 - DNA, 25 bp, Mus musculus
gatacttgttcatgaatcggaaact

SEQ ID NO: 502800 - DNA, 25 bp, Mus musculus
gatacttgttttcagtgtcaaccaa

SEQ ID NO: 502801 - DNA, 25 bp, Mus musculus
gatacttgttttgagtgtcaaccaa

SEQ ID NO: 502802 - DNA, 25 bp, Mus musculus
gatactttaatcacacccattccat

SEQ ID NO: 502803 - DNA, 25 bp, Mus musculus
gatactttaatctcacccattccat

SEQ ID NO: 502804 - DNA, 25 bp, Mus musculus
gatactttaccacagaactttcccg

SEQ ID NO: 502805 - DNA, 25 bp, Mus musculus
gatactttaccagagaactttcccg

SEQ ID NO: 502806 - DNA, 25 bp, Mus musculus
gatactttaccgaattcatgaacag

SEQ ID NO: 502807 - DNA, 25 bp, Mus musculus
gatactttaccgtattcatgaacag

SEQ ID NO: 502808 - DNA, 25 bp, Mus musculus
gatactttagcccatgaccattttg

SEQ ID NO: 502809 - DNA, 25 bp, Mus musculus
gatactttagccgatgaccattttg

SEQ ID NO: 502810 - DNA, 25 bp, Mus musculus
gatactttatcaaaatacgcatgtc

SEQ ID NO: 502811 - DNA, 25 bp, Mus musculus
gatactttatcataatacgcatgtc

SEQ ID NO: 502812 - DNA, 25 bp, Mus musculus
gatactttcattctgtccaaggagg

SEQ ID NO: 502813 - DNA, 25 bp, Mus musculus
gatactttcattgtgtccaaggagg

SEQ ID NO: 502814 - DNA, 25 bp, Mus musculus
gatactttccaaaaccaaagaggct

SEQ ID NO: 502815 - DNA, 25 bp, Mus musculus
gatactttccaataccaaagaggct

SEQ ID NO: 502816 - DNA, 25 bp, Mus musculus
gatactttctagagttgaattcaat

SEQ ID NO: 502817 - DNA, 25 bp, Mus musculus
gatactttctagtgttgaattcaat

SEQ ID NO: 502818 - DNA, 25 bp, Mus musculus
gatactttctgtaggtggccagttt

SEQ ID NO: 502819 - DNA, 25 bp, Mus musculus
gatactttctgttggtggccagttt

SEQ ID NO: 502820 - DNA, 25 bp, Mus musculus
gatactttcttgactttttcttgtt

SEQ ID NO: 502821 - DNA, 25 bp, Mus musculus
gatactttcttgtctttttcttgtt

SEQ ID NO: 502822 - DNA, 25 bp, Mus musculus
gatactttgacactgttcttagctc

SEQ ID NO: 502823 - DNA, 25 bp, Mus musculus
gatactttgacagtgttcttagctc

SEQ ID NO: 502824 - DNA, 25 bp, Mus musculus
gatactttgctgcacaagtctcccc

SEQ ID NO: 502825 - DNA, 25 bp, Mus musculus
gatactttgctggacaagtctcccc

SEQ ID NO: 502826 - DNA, 25 bp, Mus musculus
gatactttgtaaattcccatcccct

SEQ ID NO: 502827 - DNA, 25 bp, Mus musculus
gatactttgtaatttcccatcccct

SEQ ID NO: 502828 - DNA, 25 bp, Mus musculus
gatactttgtcacttgctgcctggt

SEQ ID NO: 502829 - DNA, 25 bp, Mus musculus
gatactttgtcagttgctgcctggt

SEQ ID NO: 502830 - DNA, 25 bp, Mus musculus
gatacttttatccacattactgtgt

SEQ ID NO: 502831 - DNA, 25 bp, Mus musculus
gatacttttatcgacattactgtgt

SEQ ID NO: 502832 - DNA, 25 bp, Mus musculus
gatacttttccacgaggaggcttca

SEQ ID NO: 502833 - DNA, 25 bp, Mus musculus
gatacttttccaggaggaggcttca

SEQ ID NO: 502834 - DNA, 25 bp, Mus musculus
gatacttttctgaatccaatcctat

SEQ ID NO: 502835 - DNA, 25 bp, Mus musculus
gatacttttctgtatccaatcctat

SEQ ID NO: 502836 - DNA, 25 bp, Mus musculus
gatacttttcttcaatagtttcctt

SEQ ID NO: 502837 - DNA, 25 bp, Mus musculus
gatacttttcttgaatagtttcctt

SEQ ID NO: 502838 - DNA, 25 bp, Mus musculus
gatacttttgagaactctattgaga

SEQ ID NO: 502839 - DNA, 25 bp, Mus musculus
gatacttttgagtactctattgaga

SEQ ID NO: 502840 - DNA, 25 bp, Mus musculus
gatactttttccatggccctctgaa

SEQ ID NO: 502841 - DNA, 25 bp, Mus musculus
gatactttttccttggccctctgaa

SEQ ID NO: 502842 - DNA, 25 bp, Mus musculus
gatacttttttacagcttcagttgc

SEQ ID NO: 502843 - DNA, 25 bp, Mus musculus
gatacttttttagagcttcagttgc

SEQ ID NO: 502844 - DNA, 25 bp, Mus musculus
gatagaaaacccacagtccgggcgt

SEQ ID NO: 502845 - DNA, 25 bp, Mus musculus
gatagaaaaccctcagtccgggcgt

SEQ ID NO: 502846 - DNA, 25 bp, Mus musculus
gatagaaaacggcactgctctgcac

SEQ ID NO: 502847 - DNA, 25 bp, Mus musculus
gatagaaaacgggactgctctgcac

SEQ ID NO: 502848 - DNA, 25 bp, Mus musculus
gatagaaaactgctccctaagccca

SEQ ID NO: 502849 - DNA, 25 bp, Mus musculus
gatagaaaactggtccctaagccca

SEQ ID NO: 502850 - DNA, 25 bp, Mus musculus
gatagaaaattcctgaactgaaaga

SEQ ID NO: 502851 - DNA, 25 bp, Mus musculus
gatagaaaattcgtgaactgaaaga

SEQ ID NO: 502852 - DNA, 25 bp, Mus musculus
gatagaaacaacatgcatcatgttc

SEQ ID NO: 502853 - DNA, 25 bp, Mus musculus
gatagaaacaacttgcatcatgttc

SEQ ID NO: 502854 - DNA, 25 bp, Mus musculus
gatagaaaccatatgcagactgcca

SEQ ID NO: 502855 - DNA, 25 bp, Mus musculus
gatagaaaccatttgcagactgcca

SEQ ID NO: 502856 - DNA, 25 bp, Mus musculus
gatagaaagctactctgcaaccatt

SEQ ID NO: 502857 - DNA, 25 bp, Mus musculus
gatagaaagctagtctgcaaccatt

SEQ ID NO: 502858 - DNA, 25 bp, Mus musculus
gatagaaaggccctagctcctgcta

SEQ ID NO: 502859 - DNA, 25 bp, Mus musculus
gatagaaaggccgtagctcctgcta

SEQ ID NO: 502860 - DNA, 25 bp, Mus musculus
gatagaaatcatctcatcagcattc

SEQ ID NO: 502861 - DNA, 25 bp, Mus musculus
gatagaaatcatgtcatcagcattc

SEQ ID NO: 502862 - DNA, 25 bp, Mus musculus
gatagaaatctacatctctgccttt

SEQ ID NO: 502863 - DNA, 25 bp, Mus musculus
gatagaaatctagatctctgccttt

SEQ ID NO: 502864 - DNA, 25 bp, Mus musculus
gatagaaatgccaaagctctcctca

SEQ ID NO: 502865 - DNA, 25 bp, Mus musculus
gatagaaatgcctaagctctcctca

SEQ ID NO: 502866 - DNA, 25 bp, Mus musculus
gatagaacacagcaggattggtccc

SEQ ID NO: 502867 - DNA, 25 bp, Mus musculus
gatagaacacaggaggattggtccc

SEQ ID NO: 502868 - DNA, 25 bp, Mus musculus
gatagaacactcctcatctagttag

SEQ ID NO: 502869 - DNA, 25 bp, Mus musculus
gatagaacactcgtcatctagttag

SEQ ID NO: 502870 - DNA, 25 bp, Mus musculus
gatagaacactgaatccccttctta

SEQ ID NO: 502871 - DNA, 25 bp, Mus musculus
gatagaacactgtatccccttctta

SEQ ID NO: 502872 - DNA, 25 bp, Mus musculus
gatagaacacttactttttctgctt

SEQ ID NO: 502873 - DNA, 25 bp, Mus musculus
gatagaacactttctttttctgctt

SEQ ID NO: 502874 - DNA, 25 bp, Mus musculus
gatagaacattgcttggcctgtttg

SEQ ID NO: 502875 - DNA, 25 bp, Mus musculus
gatagaacattggttggcctgtttg

SEQ ID NO: 502876 - DNA, 25 bp, Mus musculus
gatagaaccattcggtgccacggtt

SEQ ID NO: 502877 - DNA, 25 bp, Mus musculus
gatagaaccattgggtgccacggtt

SEQ ID NO: 502878 - DNA, 25 bp, Mus musculus
gatagaacccatcttttcactaaca

SEQ ID NO: 502879 - DNA, 25 bp, Mus musculus
gatagaacccatgttttcactaaca

SEQ ID NO: 502880 - DNA, 25 bp, Mus musculus
gatagaaccccacaagccatcttag

SEQ ID NO: 502881 - DNA, 25 bp, Mus musculus
gatagaaccccagaagccatcttag

SEQ ID NO: 502882 - DNA, 25 bp, Mus musculus
gatagaacccttaaggtccaaaatg

SEQ ID NO: 502883 - DNA, 25 bp, Mus musculus
gatagaaccctttaggtccaaaatg

SEQ ID NO: 502884 - DNA, 25 bp, Mus musculus
gatagaacctctatccagactgtaa

SEQ ID NO: 502885 - DNA, 25 bp, Mus musculus
gatagaacctctttccagactgtaa

SEQ ID NO: 502886 - DNA, 25 bp, Mus musculus
gatagaacctgcaccttggttagct

SEQ ID NO: 502887 - DNA, 25 bp, Mus musculus
gatagaacctgctccttggttagct

SEQ ID NO: 502888 - DNA, 25 bp, Mus musculus
gatagaactaaaccccagaatgtat

SEQ ID NO: 502889 - DNA, 25 bp, Mus musculus
gatagaactaaagcccagaatgtat

SEQ ID NO: 502890 - DNA, 25 bp, Mus musculus
gatagaactcggcagccacggccac

SEQ ID NO: 502891 - DNA, 25 bp, Mus musculus
gatagaactcgggagccacggccac

SEQ ID NO: 502892 - DNA, 25 bp, Mus musculus
gatagaacttagcagccctacagat

SEQ ID NO: 502893 - DNA, 25 bp, Mus musculus
gatagaacttaggagccctacagat

SEQ ID NO: 502894 - DNA, 25 bp, Mus musculus
gatagaactttcaaattaccttttg

SEQ ID NO: 502895 - DNA, 25 bp, Mus musculus
gatagaactttctaattaccttttg

SEQ ID NO: 502896 - DNA, 25 bp, Mus musculus
gatagaagacgtcctgagacctctg

SEQ ID NO: 502897 - DNA, 25 bp, Mus musculus
gatagaagacgtgctgagacctctg

SEQ ID NO: 502898 - DNA, 25 bp, Mus musculus
gatagaagacttacccctactactt

SEQ ID NO: 502899 - DNA, 25 bp, Mus musculus
gatagaagactttcccctactactt

SEQ ID NO: 502900 - DNA, 25 bp, Mus musculus
gatagaagctctcggaatgatttat

SEQ ID NO: 502901 - DNA, 25 bp, Mus musculus
gatagaagctctgggaatgatttat

SEQ ID NO: 502902 - DNA, 25 bp, Mus musculus
gatagaagcttaacccaagagagaa

SEQ ID NO: 502903 - DNA, 25 bp, Mus musculus
gatagaagcttatcccaagagagaa

SEQ ID NO: 502904 - DNA, 25 bp, Mus musculus
gatagaagctttacctcatcaggac

SEQ ID NO: 502905 - DNA, 25 bp, Mus musculus
gatagaagcttttcctcatcaggac

SEQ ID NO: 502906 - DNA, 25 bp, Mus musculus
gatagaaggcagactttctcccaag

SEQ ID NO: 502907 - DNA, 25 bp, Mus musculus
gatagaaggcagtctttctcccaag

SEQ ID NO: 502908 - DNA, 25 bp, Mus musculus
gatagaaggccacgccctccagaag

SEQ ID NO: 502909 - DNA, 25 bp, Mus musculus
gatagaaggccaggccctccagaag

SEQ ID NO: 502910 - DNA, 25 bp, Mus musculus
gatagaaggcgcacaaggagtcgaa

SEQ ID NO: 502911 - DNA, 25 bp, Mus musculus
gatagaaggcgctcaaggagtcgaa

SEQ ID NO: 502912 - DNA, 25 bp, Mus musculus
gatagaataaatctgccaacagcct

SEQ ID NO: 502913 - DNA, 25 bp, Mus musculus
gatagaataaatgtgccaacagcct

SEQ ID NO: 502914 - DNA, 25 bp, Mus musculus
gatagaatcaatacgcacattccgc

SEQ ID NO: 502915 - DNA, 25 bp, Mus musculus
gatagaatcaattcgcacattccgc

SEQ ID NO: 502916 - DNA, 25 bp, Mus musculus
gatagaatctcaaatccctgggctg

SEQ ID NO: 502917 - DNA, 25 bp, Mus musculus
gatagaatctcatatccctgggctg

SEQ ID NO: 502918 - DNA, 25 bp, Mus musculus
gatagaatggtaaccagcccactct

SEQ ID NO: 502919 - DNA, 25 bp, Mus musculus
gatagaatggtatccagcccactct

SEQ ID NO: 502920 - DNA, 25 bp, Mus musculus
gatagaatgtgacccgatctccctt

SEQ ID NO: 502921 - DNA, 25 bp, Mus musculus
gatagaatgtgagccgatctccctt

SEQ ID NO: 502922 - DNA, 25 bp, Mus musculus
gatagaattcagatctggttcccta

SEQ ID NO: 502923 - DNA, 25 bp, Mus musculus
gatagaattcagttctggttcccta

SEQ ID NO: 502924 - DNA, 25 bp, Mus musculus
gatagaattctacgccaggctcagc

SEQ ID NO: 502925 - DNA, 25 bp, Mus musculus
gatagaattctaggccaggctcagc

SEQ ID NO: 502926 - DNA, 25 bp, Mus musculus
gatagaattggaaccttgggtcaga

SEQ ID NO: 502927 - DNA, 25 bp, Mus musculus
gatagaattggacaccccccttcat

SEQ ID NO: 502928 - DNA, 25 bp, Mus musculus
gatagaattggagaccccccttcat

SEQ ID NO: 502929 - DNA, 25 bp, Mus musculus
gatagaattggatccttgggtcaga

SEQ ID NO: 502930 - DNA, 25 bp, Mus musculus
gatagacaatagaagacaagccaag

SEQ ID NO: 502931 - DNA, 25 bp, Mus musculus
gatagacaatagtagacaagccaag

SEQ ID NO: 502932 - DNA, 25 bp, Mus musculus
gatagacaccatccttgaggtacac

SEQ ID NO: 502933 - DNA, 25 bp, Mus musculus
gatagacaccatgcttgaggtacac

SEQ ID NO: 502934 - DNA, 25 bp, Mus musculus
gatagacactttcaggatcgaagca

SEQ ID NO: 502935 - DNA, 25 bp, Mus musculus
gatagacactttgaggatcgaagca

SEQ ID NO: 502936 - DNA, 25 bp, Mus musculus
gatagacagacacactttccaagac

SEQ ID NO: 502937 - DNA, 25 bp, Mus musculus
gatagacagacagactttccaagac

SEQ ID NO: 502938 - DNA, 25 bp, Mus musculus
gatagacagccactgatctagggat

SEQ ID NO: 502939 - DNA, 25 bp, Mus musculus
gatagacagccagtgatctagggat

SEQ ID NO: 502940 - DNA, 25 bp, Mus musculus
gatagacagcttagagagaccatgt

SEQ ID NO: 502941 - DNA, 25 bp, Mus musculus
gatagacagcttccacgttgtagaa

SEQ ID NO: 502942 - DNA, 25 bp, Mus musculus
gatagacagcttgcacgttgtagaa

SEQ ID NO: 502943 - DNA, 25 bp, Mus musculus
gatagacagctttgagagaccatgt

SEQ ID NO: 502944 - DNA, 25 bp, Mus musculus
gatagacaggaaatttccagtttta

SEQ ID NO: 502945 - DNA, 25 bp, Mus musculus
gatagacaggaattttccagtttta

SEQ ID NO: 502946 - DNA, 25 bp, Mus musculus
gatagacatcgaacccacagacaag

SEQ ID NO: 502947 - DNA, 25 bp, Mus musculus
gatagacatcgatcccacagacaag

SEQ ID NO: 502948 - DNA, 25 bp, Mus musculus
gatagacatgcaagttctgacagct

SEQ ID NO: 502949 - DNA, 25 bp, Mus musculus
gatagacatgcatgttctgacagct

SEQ ID NO: 502950 - DNA, 25 bp, Mus musculus
gatagacatgggatagccaaaagaa

SEQ ID NO: 502951 - DNA, 25 bp, Mus musculus
gatagacatgggttagccaaaagaa

SEQ ID NO: 502952 - DNA, 25 bp, Mus musculus
gatagacatgttcagttactacttt

SEQ ID NO: 502953 - DNA, 25 bp, Mus musculus
gatagacatgttgagttactacttt

SEQ ID NO: 502954 - DNA, 25 bp, Mus musculus
gatagaccaaatccatatgcacctg

SEQ ID NO: 502955 - DNA, 25 bp, Mus musculus
gatagaccaaatgcatatgcacctg

SEQ ID NO: 502956 - DNA, 25 bp, Mus musculus
gatagaccacctctaaaccagagtt

SEQ ID NO: 502957 - DNA, 25 bp, Mus musculus
gatagaccacctgtaaaccagagtt

SEQ ID NO: 502958 - DNA, 25 bp, Mus musculus
gatagaccacgaccacatggccagg

SEQ ID NO: 502959 - DNA, 25 bp, Mus musculus
gatagaccacgagcacatggccagg

SEQ ID NO: 502960 - DNA, 25 bp, Mus musculus
gatagaccatatactctgggaacta

SEQ ID NO: 502961 - DNA, 25 bp, Mus musculus
gatagaccatattctctgggaacta

SEQ ID NO: 502962 - DNA, 25 bp, Mus musculus
gatagaccgataaaccatggctttg

SEQ ID NO: 502963 - DNA, 25 bp, Mus musculus
gatagaccgatataccatggctttg

SEQ ID NO: 502964 - DNA, 25 bp, Mus musculus
gatagacctccactttaacatacta

SEQ ID NO: 502965 - DNA, 25 bp, Mus musculus
gatagacctccagtttaacatacta

SEQ ID NO: 502966 - DNA, 25 bp, Mus musculus
gatagacctgatagtgtctcccgag

SEQ ID NO: 502967 - DNA, 25 bp, Mus musculus
gatagacctgattgtgtctcccgag

SEQ ID NO: 502968 - DNA, 25 bp, Mus musculus
gatagacgatatcacagctccgccc

SEQ ID NO: 502969 - DNA, 25 bp, Mus musculus
gatagacgatatgacagctccgccc

SEQ ID NO: 502970 - DNA, 25 bp, Mus musculus
gatagacgatttagccaccagggtt

SEQ ID NO: 502971 - DNA, 25 bp, Mus musculus
gatagacgattttgccaccagggtt

SEQ ID NO: 502972 - DNA, 25 bp, Mus musculus
gatagacgcaatccatcgtgtagct

SEQ ID NO: 502973 - DNA, 25 bp, Mus musculus
gatagacgcaatgcatcgtgtagct

SEQ ID NO: 502974 - DNA, 25 bp, Mus musculus
gatagacgccaaaacagacaacctg

SEQ ID NO: 502975 - DNA, 25 bp, Mus musculus
gatagacgccaatacagacaacctg

SEQ ID NO: 502976 - DNA, 25 bp, Mus musculus
gatagacgttgtagtctgaccacca

SEQ ID NO: 502977 - DNA, 25 bp, Mus musculus
gatagacgttgttgtctgaccacca

SEQ ID NO: 502978 - DNA, 25 bp, Mus musculus
gatagactacaaaacctcctatttg

SEQ ID NO: 502979 - DNA, 25 bp, Mus musculus
gatagactacaatacctcctatttg

SEQ ID NO: 502980 - DNA, 25 bp, Mus musculus
gatagactaggcaatccatcagctg

SEQ ID NO: 502981 - DNA, 25 bp, Mus musculus
gatagactaggctatccatcagctg

SEQ ID NO: 502982 - DNA, 25 bp, Mus musculus
gatagactatctccatgaaatcggt

SEQ ID NO: 502983 - DNA, 25 bp, Mus musculus
gatagactatctgcatgaaatcggt

SEQ ID NO: 502984 - DNA, 25 bp, Mus musculus
gatagactcacaatggtagatcctt

SEQ ID NO: 502985 - DNA, 25 bp, Mus musculus
gatagactcacattggtagatcctt

SEQ ID NO: 502986 - DNA, 25 bp, Mus musculus
gatagactcatactccttcataggc

SEQ ID NO: 502987 - DNA, 25 bp, Mus musculus
gatagactcatagtccttcataggc

SEQ ID NO: 502988 - DNA, 25 bp, Mus musculus
gatagactcgtgaccaagaagccaa

SEQ ID NO: 502989 - DNA, 25 bp, Mus musculus
gatagactcgtgtccaagaagccaa

SEQ ID NO: 502990 - DNA, 25 bp, Mus musculus
gatagactcttaacacggttagaag

SEQ ID NO: 502991 - DNA, 25 bp, Mus musculus
gatagactcttatcacggttagaag

SEQ ID NO: 502992 - DNA, 25 bp, Mus musculus
gatagactcttcaccaaaccaacgg

SEQ ID NO: 502993 - DNA, 25 bp, Mus musculus
gatagactcttctccaaaccaacgg

SEQ ID NO: 502994 - DNA, 25 bp, Mus musculus
gatagactctttcatagaaccaaac

SEQ ID NO: 502995 - DNA, 25 bp, Mus musculus
gatagactctttgatagaaccaaac

SEQ ID NO: 502996 - DNA, 25 bp, Mus musculus
gatagactgaccaggatggtttaca

SEQ ID NO: 502997 - DNA, 25 bp, Mus musculus
gatagactgaccatgttttgcaaag

SEQ ID NO: 502998 - DNA, 25 bp, Mus musculus
gatagactgacctggatggtttaca

SEQ ID NO: 502999 - DNA, 25 bp, Mus musculus
gatagactgaccttgttttgcaaag

SEQ ID NO: 503000 - DNA, 25 bp, Mus musculus
gatagactgcccatgcttaagcaaa

SEQ ID NO: 503001 - DNA, 25 bp, Mus musculus
gatagactgcccttgcttaagcaaa

SEQ ID NO: 503002 - DNA, 25 bp, Mus musculus
gatagactgctcacgctgacccttt

SEQ ID NO: 503003 - DNA, 25 bp, Mus musculus
gatagactgctctcgctgacccttt

SEQ ID NO: 503004 - DNA, 25 bp, Mus musculus
gatagactggaactctctggcatgt

SEQ ID NO: 503005 - DNA, 25 bp, Mus musculus
gatagactggaagtctctggcatgt

SEQ ID NO: 503006 - DNA, 25 bp, Mus musculus
gatagactggttctgtgatattcta

SEQ ID NO: 503007 - DNA, 25 bp, Mus musculus
gatagactggttgtgtgatattcta

SEQ ID NO: 503008 - DNA, 25 bp, Mus musculus
gatagacttcatctctctacatcaa

SEQ ID NO: 503009 - DNA, 25 bp, Mus musculus
gatagacttcatgtctctacatcaa

SEQ ID NO: 503010 - DNA, 25 bp, Mus musculus
gatagacttggtaccgatcttgact

SEQ ID NO: 503011 - DNA, 25 bp, Mus musculus
gatagacttggttccgatcttgact

SEQ ID NO: 503012 - DNA, 25 bp, Mus musculus
gatagactttcacgcattcccatac

SEQ ID NO: 503013 - DNA, 25 bp, Mus musculus
gatagactttcaggcattcccatac

SEQ ID NO: 503014 - DNA, 25 bp, Mus musculus
gatagagacaacatagggcttcctg

SEQ ID NO: 503015 - DNA, 25 bp, Mus musculus
gatagagacaacttagggcttcctg

SEQ ID NO: 503016 - DNA, 25 bp, Mus musculus
gatagagactgtcccatttttgcca

SEQ ID NO: 503017 - DNA, 25 bp, Mus musculus
gatagagactgtgccatttttgcca

SEQ ID NO: 503018 - DNA, 25 bp, Mus musculus
gatagagagcagaattcaccgattg

SEQ ID NO: 503019 - DNA, 25 bp, Mus musculus
gatagagagcagtattcaccgattg

SEQ ID NO: 503020 - DNA, 25 bp, Mus musculus
gatagagaggcccactttagcccac

SEQ ID NO: 503021 - DNA, 25 bp, Mus musculus
gatagagaggccgactttagcccac

SEQ ID NO: 503022 - DNA, 25 bp, Mus musculus
gatagagatagtaccgtgtttttcc

SEQ ID NO: 503023 - DNA, 25 bp, Mus musculus
gatagagatagttccgtgtttttcc

SEQ ID NO: 503024 - DNA, 25 bp, Mus musculus
gatagagatatgaccggcacgatgg

SEQ ID NO: 503025 - DNA, 25 bp, Mus musculus
gatagagatatgtccggcacgatgg

SEQ ID NO: 503026 - DNA, 25 bp, Mus musculus
gatagagattcccagtgacttcaga

SEQ ID NO: 503027 - DNA, 25 bp, Mus musculus
gatagagattccgagtgacttcaga

SEQ ID NO: 503028 - DNA, 25 bp, Mus musculus
gatagagatttgaatcgctccttga

SEQ ID NO: 503029 - DNA, 25 bp, Mus musculus
gatagagatttgtatcgctccttga

SEQ ID NO: 503030 - DNA, 25 bp, Mus musculus
gatagagcacatcctagcataaact

SEQ ID NO: 503031 - DNA, 25 bp, Mus musculus
gatagagcacatgctagcataaact

SEQ ID NO: 503032 - DNA, 25 bp, Mus musculus
gatagagcacctcagttactgacct

SEQ ID NO: 503033 - DNA, 25 bp, Mus musculus
gatagagcacctgagttactgacct

SEQ ID NO: 503034 - DNA, 25 bp, Mus musculus
gatagagcagttacccctgtagaat

SEQ ID NO: 503035 - DNA, 25 bp, Mus musculus
gatagagcagtttcccctgtagaat

SEQ ID NO: 503036 - DNA, 25 bp, Mus musculus
gatagagccacaatgactcgctact

SEQ ID NO: 503037 - DNA, 25 bp, Mus musculus
gatagagccacattgactcgctact

SEQ ID NO: 503038 - DNA, 25 bp, Mus musculus
gatagagcccacagtctttggcagt

SEQ ID NO: 503039 - DNA, 25 bp, Mus musculus
gatagagcccactgtctttggcagt

SEQ ID NO: 503040 - DNA, 25 bp, Mus musculus
gatagagcgcctacagtgtactgtt

SEQ ID NO: 503041 - DNA, 25 bp, Mus musculus
gatagagcgccttcagtgtactgtt

SEQ ID NO: 503042 - DNA, 25 bp, Mus musculus
gatagagctaccatagtaaacatga

SEQ ID NO: 503043 - DNA, 25 bp, Mus musculus
gatagagctaccttagtaaacatga

SEQ ID NO: 503044 - DNA, 25 bp, Mus musculus
gatagagctgccacatcttgatgaa

SEQ ID NO: 503045 - DNA, 25 bp, Mus musculus
gatagagctgcctcatcttgatgaa

SEQ ID NO: 503046 - DNA, 25 bp, Mus musculus
gatagaggaacaagcctgctgccaa

SEQ ID NO: 503047 - DNA, 25 bp, Mus musculus
gatagaggaacatgcctgctgccaa

SEQ ID NO: 503048 - DNA, 25 bp, Mus musculus
gatagaggactaactggcctgccag

SEQ ID NO: 503049 - DNA, 25 bp, Mus musculus
gatagaggactatctggcctgccag

SEQ ID NO: 503050 - DNA, 25 bp, Mus musculus
gatagaggagaccatctctgcagaa

SEQ ID NO: 503051 - DNA, 25 bp, Mus musculus
gatagaggagacgatctctgcagaa

SEQ ID NO: 503052 - DNA, 25 bp, Mus musculus
gatagaggatttagccagtgcccac

SEQ ID NO: 503053 - DNA, 25 bp, Mus musculus
gatagaggattttgccagtgcccac

SEQ ID NO: 503054 - DNA, 25 bp, Mus musculus
gatagaggcaatccattattgtgta

SEQ ID NO: 503055 - DNA, 25 bp, Mus musculus
gatagaggcaatgcattattgtgta

SEQ ID NO: 503056 - DNA, 25 bp, Mus musculus
gatagaggcccacacgtaaccctgt

SEQ ID NO: 503057 - DNA, 25 bp, Mus musculus
gatagaggcccagacgtaaccctgt

SEQ ID NO: 503058 - DNA, 25 bp, Mus musculus
gatagaggtaatctgtctcatatta

SEQ ID NO: 503059 - DNA, 25 bp, Mus musculus
gatagaggtaatgtgtctcatatta

SEQ ID NO: 503060 - DNA, 25 bp, Mus musculus
gatagaggtggtcttggctaagcta

SEQ ID NO: 503061 - DNA, 25 bp, Mus musculus
gatagaggtggtgttggctaagcta

SEQ ID NO: 503062 - DNA, 25 bp, Mus musculus
gatagagtaggcctcatagtgtcaa

SEQ ID NO: 503063 - DNA, 25 bp, Mus musculus
gatagagtaggcgtcatagtgtcaa

SEQ ID NO: 503064 - DNA, 25 bp, Mus musculus
gatagagtatgtccatcaaagagta

SEQ ID NO: 503065 - DNA, 25 bp, Mus musculus
gatagagtatgtgcatcaaagagta

SEQ ID NO: 503066 - DNA, 25 bp, Mus musculus
gatagagtcacgagcccaatacaca

SEQ ID NO: 503067 - DNA, 25 bp, Mus musculus
gatagagtcacgtgcccaatacaca

SEQ ID NO: 503068 - DNA, 25 bp, Mus musculus
gatagagtccataccatgcctgtga

SEQ ID NO: 503069 - DNA, 25 bp, Mus musculus
gatagagtccatcaactgtggtttt

SEQ ID NO: 503070 - DNA, 25 bp, Mus musculus
gatagagtccatgaactgtggtttt

SEQ ID NO: 503071 - DNA, 25 bp, Mus musculus
gatagagtccattccatgcctgtga

SEQ ID NO: 503072 - DNA, 25 bp, Mus musculus
gatagagtctgcaggatcttctccc

SEQ ID NO: 503073 - DNA, 25 bp, Mus musculus
gatagagtctgctggatcttctccc

SEQ ID NO: 503074 - DNA, 25 bp, Mus musculus
gatagagtctttacatgtaagctag

SEQ ID NO: 503075 - DNA, 25 bp, Mus musculus
gatagagtcttttcatgtaagctag

SEQ ID NO: 503076 - DNA, 25 bp, Mus musculus
gatagagtgcagctcacgctcaagg

SEQ ID NO: 503077 - DNA, 25 bp, Mus musculus
gatagagtgcaggtcacgctcaagg

SEQ ID NO: 503078 - DNA, 25 bp, Mus musculus
gatagagtgtagagcagagactgaa

SEQ ID NO: 503079 - DNA, 25 bp, Mus musculus
gatagagtgtagtgcagagactgaa

SEQ ID NO: 503080 - DNA, 25 bp, Mus musculus
gatagagtgttcagccaaggatatt

SEQ ID NO: 503081 - DNA, 25 bp, Mus musculus
gatagagtgttctgccaaggatatt

SEQ ID NO: 503082 - DNA, 25 bp, Mus musculus
gatagagttcatcagttactgcaga

SEQ ID NO: 503083 - DNA, 25 bp, Mus musculus
gatagagttcatgagttactgcaga

SEQ ID NO: 503084 - DNA, 25 bp, Mus musculus
gatagagttcccattagtgaccatg

SEQ ID NO: 503085 - DNA, 25 bp, Mus musculus
gatagagttccctttagtgaccatg

SEQ ID NO: 503086 - DNA, 25 bp, Mus musculus
gatagagttgctcttgatgccatat

SEQ ID NO: 503087 - DNA, 25 bp, Mus musculus
gatagagttgctgttgatgccatat

SEQ ID NO: 503088 - DNA, 25 bp, Mus musculus
gatagagtttggagcatggcttaga

SEQ ID NO: 503089 - DNA, 25 bp, Mus musculus
gatagagtttggtgcatggcttaga

SEQ ID NO: 503090 - DNA, 25 bp, Mus musculus
gatagataactaatgtctctgtgag

SEQ ID NO: 503091 - DNA, 25 bp, Mus musculus
gatagataactattgtctctgtgag

SEQ ID NO: 503092 - DNA, 25 bp, Mus musculus
gatagatacattaccaagttgtcat

SEQ ID NO: 503093 - DNA, 25 bp, Mus musculus
gatagatacatttccaagttgtcat

SEQ ID NO: 503094 - DNA, 25 bp, Mus musculus
gatagataccaaaaccatcctctgg

SEQ ID NO: 503095 - DNA, 25 bp, Mus musculus
gatagataccaataccatcctctgg

SEQ ID NO: 503096 - DNA, 25 bp, Mus musculus
gatagatagatcatagtgccttact

SEQ ID NO: 503097 - DNA, 25 bp, Mus musculus
gatagatagatcttagtgccttact

SEQ ID NO: 503098 - DNA, 25 bp, Mus musculus
gatagatattcgaatagagacctct

SEQ ID NO: 503099 - DNA, 25 bp, Mus musculus
gatagatattcgtatagagacctct

SEQ ID NO: 503100 - DNA, 25 bp, Mus musculus
gatagatcacatctgtgcccacttt

SEQ ID NO: 503101 - DNA, 25 bp, Mus musculus
gatagatcacatgtgtgcccacttt

SEQ ID NO: 503102 - DNA, 25 bp, Mus musculus
gatagatcagagacctagctgccta

SEQ ID NO: 503103 - DNA, 25 bp, Mus musculus
gatagatcagagtcctagctgccta

SEQ ID NO: 503104 - DNA, 25 bp, Mus musculus
gatagatcagttcatgaccagcctg

SEQ ID NO: 503105 - DNA, 25 bp, Mus musculus
gatagatcagttgatgaccagcctg

SEQ ID NO: 503106 - DNA, 25 bp, Mus musculus
gatagatcatgtacgccatcagtgt

SEQ ID NO: 503107 - DNA, 25 bp, Mus musculus
gatagatcatgttcgccatcagtgt

SEQ ID NO: 503108 - DNA, 25 bp, Mus musculus
gatagatccacgaggcaccaagatt

SEQ ID NO: 503109 - DNA, 25 bp, Mus musculus
gatagatccacgtggcaccaagatt

SEQ ID NO: 503110 - DNA, 25 bp, Mus musculus
gatagatcccatctatttgatttca

SEQ ID NO: 503111 - DNA, 25 bp, Mus musculus
gatagatcccatgtatttgatttca

SEQ ID NO: 503112 - DNA, 25 bp, Mus musculus
gatagatccttgcttcaggttttag

SEQ ID NO: 503113 - DNA, 25 bp, Mus musculus
gatagatccttggttcaggttttag

SEQ ID NO: 503114 - DNA, 25 bp, Mus musculus
gatagatcggaaacatcagcatata

SEQ ID NO: 503115 - DNA, 25 bp, Mus musculus
gatagatcggaatcatcagcatata

SEQ ID NO: 503116 - DNA, 25 bp, Mus musculus
gatagatctttgacaccttttagag

SEQ ID NO: 503117 - DNA, 25 bp, Mus musculus
gatagatctttgtcaccttttagag

SEQ ID NO: 503118 - DNA, 25 bp, Mus musculus
gatagatgacttaggttcaacacta

SEQ ID NO: 503119 - DNA, 25 bp, Mus musculus
gatagatgactttggttcaacacta

SEQ ID NO: 503120 - DNA, 25 bp, Mus musculus
gatagatgccttaagtagtgtattt

SEQ ID NO: 503121 - DNA, 25 bp, Mus musculus
gatagatgcctttagtagtgtattt

SEQ ID NO: 503122 - DNA, 25 bp, Mus musculus
gatagatgcttgaacatgacttgtg

SEQ ID NO: 503123 - DNA, 25 bp, Mus musculus
gatagatgcttgtacatgacttgtg

SEQ ID NO: 503124 - DNA, 25 bp, Mus musculus
gatagatggttaacatgtacgtttt

SEQ ID NO: 503125 - DNA, 25 bp, Mus musculus
gatagatggttatcatgtacgtttt

SEQ ID NO: 503126 - DNA, 25 bp, Mus musculus
gatagatggttgaagcttttctgat

SEQ ID NO: 503127 - DNA, 25 bp, Mus musculus
gatagatggttgtagcttttctgat

SEQ ID NO: 503128 - DNA, 25 bp, Mus musculus
gatagatgtacaccaggccttgtca

SEQ ID NO: 503129 - DNA, 25 bp, Mus musculus
gatagatgtacagcaggccttgtca

SEQ ID NO: 503130 - DNA, 25 bp, Mus musculus
gatagatgtgttagcttggctttga

SEQ ID NO: 503131 - DNA, 25 bp, Mus musculus
gatagatgtgtttgcttggctttga

SEQ ID NO: 503132 - DNA, 25 bp, Mus musculus
gatagattagctacctgcttcagtt

SEQ ID NO: 503133 - DNA, 25 bp, Mus musculus
gatagattagcttcctgcttcagtt

SEQ ID NO: 503134 - DNA, 25 bp, Mus musculus
gatagattcagtcttgccttacaca

SEQ ID NO: 503135 - DNA, 25 bp, Mus musculus
gatagattcagtgttgccttacaca

SEQ ID NO: 503136 - DNA, 25 bp, Mus musculus
gatagattcccgagtgtgagctcct

SEQ ID NO: 503137 - DNA, 25 bp, Mus musculus
gatagattcccgtgtgtgagctcct

SEQ ID NO: 503138 - DNA, 25 bp, Mus musculus
gatagattccgaagacagctcattg

SEQ ID NO: 503139 - DNA, 25 bp, Mus musculus
gatagattccgatgacagctcattg

SEQ ID NO: 503140 - DNA, 25 bp, Mus musculus
gatagattccttacccagtgaagag

SEQ ID NO: 503141 - DNA, 25 bp, Mus musculus
gatagattcctttcccagtgaagag

SEQ ID NO: 503142 - DNA, 25 bp, Mus musculus
gatagattctatatgctcgatttgg

SEQ ID NO: 503143 - DNA, 25 bp, Mus musculus
gatagattctatttgctcgatttgg

SEQ ID NO: 503144 - DNA, 25 bp, Mus musculus
gatagattctttcacaccattaaat

SEQ ID NO: 503145 - DNA, 25 bp, Mus musculus
gatagattctttgacaccattaaat

SEQ ID NO: 503146 - DNA, 25 bp, Mus musculus
gatagattgccactttgatccctct

SEQ ID NO: 503147 - DNA, 25 bp, Mus musculus
gatagattgccagtttgatccctct

SEQ ID NO: 503148 - DNA, 25 bp, Mus musculus
gatagattggctcccaattcctgct

SEQ ID NO: 503149 - DNA, 25 bp, Mus musculus
gatagattggctgccaattcctgct

SEQ ID NO: 503150 - DNA, 25 bp, Mus musculus
gatagattgtctatgtctctgccta

SEQ ID NO: 503151 - DNA, 25 bp, Mus musculus
gatagattgtctttgtctctgccta

SEQ ID NO: 503152 - DNA, 25 bp, Mus musculus
gatagattgtttatacctcgcattt

SEQ ID NO: 503153 - DNA, 25 bp, Mus musculus
gatagattgtttttacctcgcattt

SEQ ID NO: 503154 - DNA, 25 bp, Mus musculus
gatagatttatgaaagttcaggaac

SEQ ID NO: 503155 - DNA, 25 bp, Mus musculus
gatagatttatgtaagttcaggaac

SEQ ID NO: 503156 - DNA, 25 bp, Mus musculus
gatagattttcacctagactttttt

SEQ ID NO: 503157 - DNA, 25 bp, Mus musculus
gatagattttcagctagactttttt

SEQ ID NO: 503158 - DNA, 25 bp, Mus musculus
gatagcaaccacaaaattttgagtt

SEQ ID NO: 503159 - DNA, 25 bp, Mus musculus
gatagcaaccactaaattttgagtt

SEQ ID NO: 503160 - DNA, 25 bp, Mus musculus
gatagcaacctgcaaccattgaatt

SEQ ID NO: 503161 - DNA, 25 bp, Mus musculus
gatagcaacctggaaccattgaatt

SEQ ID NO: 503162 - DNA, 25 bp, Mus musculus
gatagcaacttgagtgtttctccag

SEQ ID NO: 503163 - DNA, 25 bp, Mus musculus
gatagcaacttgtgtgtttctccag

SEQ ID NO: 503164 - DNA, 25 bp, Mus musculus
gatagcaaggcgacgacgatcctct

SEQ ID NO: 503165 - DNA, 25 bp, Mus musculus
gatagcaaggcgtcgacgatcctct

SEQ ID NO: 503166 - DNA, 25 bp, Mus musculus
gatagcaagtccactgagcagctca

SEQ ID NO: 503167 - DNA, 25 bp, Mus musculus
gatagcaagtcctctgagcagctca

SEQ ID NO: 503168 - DNA, 25 bp, Mus musculus
gatagcaatctcagacgccataaag

SEQ ID NO: 503169 - DNA, 25 bp, Mus musculus
gatagcaatctctgacgccataaag

SEQ ID NO: 503170 - DNA, 25 bp, Mus musculus
gatagcacaaccagggagcgcttgc

SEQ ID NO: 503171 - DNA, 25 bp, Mus musculus
gatagcacaacctgggagcgcttgc

SEQ ID NO: 503172 - DNA, 25 bp, Mus musculus
gatagcacaatcactgggccacccc

SEQ ID NO: 503173 - DNA, 25 bp, Mus musculus
gatagcacaatctctgggccacccc

SEQ ID NO: 503174 - DNA, 25 bp, Mus musculus
gatagcacaccacttctcacagatg

SEQ ID NO: 503175 - DNA, 25 bp, Mus musculus
gatagcacaccagttctcacagatg

SEQ ID NO: 503176 - DNA, 25 bp, Mus musculus
gatagcacagcgaggctggttctgc

SEQ ID NO: 503177 - DNA, 25 bp, Mus musculus
gatagcacagcgtggctggttctgc

SEQ ID NO: 503178 - DNA, 25 bp, Mus musculus
gatagcacagtgctctcggcacagt

SEQ ID NO: 503179 - DNA, 25 bp, Mus musculus
gatagcacagtggtctcggcacagt

SEQ ID NO: 503180 - DNA, 25 bp, Mus musculus
gatagcacatgtctagtgtcaggct

SEQ ID NO: 503181 - DNA, 25 bp, Mus musculus
gatagcacatgtgtagtgtcaggct

SEQ ID NO: 503182 - DNA, 25 bp, Mus musculus
gatagcaccaggagcatttatttac

SEQ ID NO: 503183 - DNA, 25 bp, Mus musculus
gatagcaccaggtgcatttatttac

SEQ ID NO: 503184 - DNA, 25 bp, Mus musculus
gatagcacccatcggctagatgctt

SEQ ID NO: 503185 - DNA, 25 bp, Mus musculus
gatagcacccatgggctagatgctt

SEQ ID NO: 503186 - DNA, 25 bp, Mus musculus
gatagcaccttgcttgaatcacctg

SEQ ID NO: 503187 - DNA, 25 bp, Mus musculus
gatagcaccttggttgaatcacctg

SEQ ID NO: 503188 - DNA, 25 bp, Mus musculus
gatagcactcagcaatatggaagta

SEQ ID NO: 503189 - DNA, 25 bp, Mus musculus
gatagcactcaggaatatggaagta

SEQ ID NO: 503190 - DNA, 25 bp, Mus musculus
gatagcactccaagtattggacatc

SEQ ID NO: 503191 - DNA, 25 bp, Mus musculus
gatagcactccatgtattggacatc

SEQ ID NO: 503192 - DNA, 25 bp, Mus musculus
gatagcagaccaagcaacatctaat

SEQ ID NO: 503193 - DNA, 25 bp, Mus musculus
gatagcagaccatgcaacatctaat

SEQ ID NO: 503194 - DNA, 25 bp, Mus musculus
gatagcagacctcctcgggtccctg

SEQ ID NO: 503195 - DNA, 25 bp, Mus musculus
gatagcagacctgctcgggtccctg

SEQ ID NO: 503196 - DNA, 25 bp, Mus musculus
gatagcagagtgatgacccggacta

SEQ ID NO: 503197 - DNA, 25 bp, Mus musculus
gatagcagagtgttgacccggacta

SEQ ID NO: 503198 - DNA, 25 bp, Mus musculus
gatagcagcaagctcgttcctgaaa

SEQ ID NO: 503199 - DNA, 25 bp, Mus musculus
gatagcagcaaggtcgttcctgaaa

SEQ ID NO: 503200 - DNA, 25 bp, Mus musculus
gatagcagcaataacgttgtttgta

SEQ ID NO: 503201 - DNA, 25 bp, Mus musculus
gatagcagcaattacgttgtttgta

SEQ ID NO: 503202 - DNA, 25 bp, Mus musculus
gatagcagcccgcactaaggattcc

SEQ ID NO: 503203 - DNA, 25 bp, Mus musculus
gatagcagcccggactaaggattcc

SEQ ID NO: 503204 - DNA, 25 bp, Mus musculus
gatagcagctggaagttgtgataaa

SEQ ID NO: 503205 - DNA, 25 bp, Mus musculus
gatagcagctggtagttgtgataaa

SEQ ID NO: 503206 - DNA, 25 bp, Mus musculus
gatagcaggctgaaattttgaacaa

SEQ ID NO: 503207 - DNA, 25 bp, Mus musculus
gatagcaggctgtaattttgaacaa

SEQ ID NO: 503208 - DNA, 25 bp, Mus musculus
gatagcagtttcctaggtccaggct

SEQ ID NO: 503209 - DNA, 25 bp, Mus musculus
gatagcagtttcgtaggtccaggct

SEQ ID NO: 503210 - DNA, 25 bp, Mus musculus
gatagcatacaaactcaataacaat

SEQ ID NO: 503211 - DNA, 25 bp, Mus musculus
gatagcatacaatctcaataacaat

SEQ ID NO: 503212 - DNA, 25 bp, Mus musculus
gatagcatagcgactagggccatct

SEQ ID NO: 503213 - DNA, 25 bp, Mus musculus
gatagcatagcgtctagggccatct

SEQ ID NO: 503214 - DNA, 25 bp, Mus musculus
gatagcataggacggctccgtctgt

SEQ ID NO: 503215 - DNA, 25 bp, Mus musculus
gatagcataggagggctccgtctgt

SEQ ID NO: 503216 - DNA, 25 bp, Mus musculus
gatagcataggcatggtccaagcat

SEQ ID NO: 503217 - DNA, 25 bp, Mus musculus
gatagcataggcttggtccaagcat

SEQ ID NO: 503218 - DNA, 25 bp, Mus musculus
gatagcatagttatctctattgaag

SEQ ID NO: 503219 - DNA, 25 bp, Mus musculus
gatagcatagttttctctattgaag

SEQ ID NO: 503220 - DNA, 25 bp, Mus musculus
gatagcatatagatttgcataatat

SEQ ID NO: 503221 - DNA, 25 bp, Mus musculus
gatagcatatagttttgcataatat

SEQ ID NO: 503222 - DNA, 25 bp, Mus musculus
gatagcatatctcggattttataaa

SEQ ID NO: 503223 - DNA, 25 bp, Mus musculus
gatagcatatctgggattttataaa

SEQ ID NO: 503224 - DNA, 25 bp, Mus musculus
gatagcatcaatctgtaattggcat

SEQ ID NO: 503225 - DNA, 25 bp, Mus musculus
gatagcatcaatgtgtaattggcat

SEQ ID NO: 503226 - DNA, 25 bp, Mus musculus
gatagcatcagaaacccacatgttc

SEQ ID NO: 503227 - DNA, 25 bp, Mus musculus
gatagcatcagatacccacatgttc

SEQ ID NO: 503228 - DNA, 25 bp, Mus musculus
gatagcatcatgaaaatgctccatg

SEQ ID NO: 503229 - DNA, 25 bp, Mus musculus
gatagcatcatgtaaatgctccatg

SEQ ID NO: 503230 - DNA, 25 bp, Mus musculus
gatagcatcctgattggataggcag

SEQ ID NO: 503231 - DNA, 25 bp, Mus musculus
gatagcatcctgtttggataggcag

SEQ ID NO: 503232 - DNA, 25 bp, Mus musculus
gatagcatctgacgacgggcagtca

SEQ ID NO: 503233 - DNA, 25 bp, Mus musculus
gatagcatctgaggacgggcagtca

SEQ ID NO: 503234 - DNA, 25 bp, Mus musculus
gatagcatctttatgtattggtaac

SEQ ID NO: 503235 - DNA, 25 bp, Mus musculus
gatagcatctttttgtattggtaac

SEQ ID NO: 503236 - DNA, 25 bp, Mus musculus
gatagcatgctcatgagattgtggc

SEQ ID NO: 503237 - DNA, 25 bp, Mus musculus
gatagcatgctcttgagattgtggc

SEQ ID NO: 503238 - DNA, 25 bp, Mus musculus
gatagcatgtagcttttaagatttt

SEQ ID NO: 503239 - DNA, 25 bp, Mus musculus
gatagcatgtaggttttaagatttt

SEQ ID NO: 503240 - DNA, 25 bp, Mus musculus
gatagcattaacagtcaccaccgtt

SEQ ID NO: 503241 - DNA, 25 bp, Mus musculus
gatagcattaactgtcaccaccgtt

SEQ ID NO: 503242 - DNA, 25 bp, Mus musculus
gatagcattgaacttctcaggcaga

SEQ ID NO: 503243 - DNA, 25 bp, Mus musculus
gatagcattgaagttctcaggcaga

SEQ ID NO: 503244 - DNA, 25 bp, Mus musculus
gatagcatttaaactttgttggcac

SEQ ID NO: 503245 - DNA, 25 bp, Mus musculus
gatagcatttaatctttgttggcac

SEQ ID NO: 503246 - DNA, 25 bp, Mus musculus
gatagcatttgcagtatagagcgtg

SEQ ID NO: 503247 - DNA, 25 bp, Mus musculus
gatagcatttgctgtatagagcgtg

SEQ ID NO: 503248 - DNA, 25 bp, Mus musculus
gatagcattttcaatgctgttttgc

SEQ ID NO: 503249 - DNA, 25 bp, Mus musculus
gatagcattttctatgctgttttgc

SEQ ID NO: 503250 - DNA, 25 bp, Mus musculus
gatagccaaaagaagggactacctg

SEQ ID NO: 503251 - DNA, 25 bp, Mus musculus
gatagccaaaagtagggactacctg

SEQ ID NO: 503252 - DNA, 25 bp, Mus musculus
gatagccaacatcttttttcagaga

SEQ ID NO: 503253 - DNA, 25 bp, Mus musculus
gatagccaacatgttttttcagaga

SEQ ID NO: 503254 - DNA, 25 bp, Mus musculus
gatagccaagagctgtcccagtgag

SEQ ID NO: 503255 - DNA, 25 bp, Mus musculus
gatagccaagaggtgtcccagtgag

SEQ ID NO: 503256 - DNA, 25 bp, Mus musculus
gatagccaattcagtgctggttgca

SEQ ID NO: 503257 - DNA, 25 bp, Mus musculus
gatagccaattctgtgctggttgca

SEQ ID NO: 503258 - DNA, 25 bp, Mus musculus
gatagccactacatgtaactccagg

SEQ ID NO: 503259 - DNA, 25 bp, Mus musculus
gatagccactacttgtaactccagg

SEQ ID NO: 503260 - DNA, 25 bp, Mus musculus
gatagccagacacacgttcagtgat

SEQ ID NO: 503261 - DNA, 25 bp, Mus musculus
gatagccagacagacgttcagtgat

SEQ ID NO: 503262 - DNA, 25 bp, Mus musculus
gatagccagcatccacttaagaagt

SEQ ID NO: 503263 - DNA, 25 bp, Mus musculus
gatagccagcatgcacttaagaagt

SEQ ID NO: 503264 - DNA, 25 bp, Mus musculus
gatagccagctcataggctgcagtt

SEQ ID NO: 503265 - DNA, 25 bp, Mus musculus
gatagccagctcttaggctgcagtt

SEQ ID NO: 503266 - DNA, 25 bp, Mus musculus
gatagccagggacacacaggaaaaa

SEQ ID NO: 503267 - DNA, 25 bp, Mus musculus
gatagccagggagacacaggaaaaa

SEQ ID NO: 503268 - DNA, 25 bp, Mus musculus
gatagccagggtactgctcatggaa

SEQ ID NO: 503269 - DNA, 25 bp, Mus musculus
gatagccagggttctgctcatggaa

SEQ ID NO: 503270 - DNA, 25 bp, Mus musculus
gatagccagttcaccattgtgttgg

SEQ ID NO: 503271 - DNA, 25 bp, Mus musculus
gatagccagttctccattgtgttgg

SEQ ID NO: 503272 - DNA, 25 bp, Mus musculus
gatagccataatagacccttcattg

SEQ ID NO: 503273 - DNA, 25 bp, Mus musculus
gatagccataattgacccttcattg

SEQ ID NO: 503274 - DNA, 25 bp, Mus musculus
gatagccatatacctttttcagtcg

SEQ ID NO: 503275 - DNA, 25 bp, Mus musculus
gatagccatatagctttttcagtcg

SEQ ID NO: 503276 - DNA, 25 bp, Mus musculus
gatagccatcaacaccgaatgctgt

SEQ ID NO: 503277 - DNA, 25 bp, Mus musculus
gatagccatcaagaccgaatgctgt

SEQ ID NO: 503278 - DNA, 25 bp, Mus musculus
gatagccatcatcgcaagcctttct

SEQ ID NO: 503279 - DNA, 25 bp, Mus musculus
gatagccatcatggcaagcctttct

SEQ ID NO: 503280 - DNA, 25 bp, Mus musculus
gatagccatgatacttgccttgtta

SEQ ID NO: 503281 - DNA, 25 bp, Mus musculus
gatagccatgattcttgccttgtta

SEQ ID NO: 503282 - DNA, 25 bp, Mus musculus
gatagccatggaatgtgaccctgag

SEQ ID NO: 503283 - DNA, 25 bp, Mus musculus
gatagccatggattgtgaccctgag

SEQ ID NO: 503284 - DNA, 25 bp, Mus musculus
gatagccattcactttattatttta

SEQ ID NO: 503285 - DNA, 25 bp, Mus musculus
gatagccattcagtttattatttta

SEQ ID NO: 503286 - DNA, 25 bp, Mus musculus
gatagcccaaatctgcagtacgcaa

SEQ ID NO: 503287 - DNA, 25 bp, Mus musculus
gatagcccaaatgtgcagtacgcaa

SEQ ID NO: 503288 - DNA, 25 bp, Mus musculus
gatagcccaaggacattcactgaaa

SEQ ID NO: 503289 - DNA, 25 bp, Mus musculus
gatagcccaaggcattgcatcctat

SEQ ID NO: 503290 - DNA, 25 bp, Mus musculus
gatagcccaagggattgcatcctat

SEQ ID NO: 503291 - DNA, 25 bp, Mus musculus
gatagcccaaggtcattcactgaaa

SEQ ID NO: 503292 - DNA, 25 bp, Mus musculus
gatagcccaatactgttattagcga

SEQ ID NO: 503293 - DNA, 25 bp, Mus musculus
gatagcccaatagtgttattagcga

SEQ ID NO: 503294 - DNA, 25 bp, Mus musculus
gatagcccagcacgtaaaggttcct

SEQ ID NO: 503295 - DNA, 25 bp, Mus musculus
gatagcccagcaggtaaaggttcct

SEQ ID NO: 503296 - DNA, 25 bp, Mus musculus
gatagcccagcgaaccttgagtaaa

SEQ ID NO: 503297 - DNA, 25 bp, Mus musculus
gatagcccagcgtaccttgagtaaa

SEQ ID NO: 503298 - DNA, 25 bp, Mus musculus
gatagcccaggcccaggaccttagg

SEQ ID NO: 503299 - DNA, 25 bp, Mus musculus
gatagcccaggcgcaggaccttagg

SEQ ID NO: 503300 - DNA, 25 bp, Mus musculus
gatagcccatgaagtactacctttt

SEQ ID NO: 503301 - DNA, 25 bp, Mus musculus
gatagcccatgatgtactacctttt

SEQ ID NO: 503302 - DNA, 25 bp, Mus musculus
gatagcccattcacccaagaattct

SEQ ID NO: 503303 - DNA, 25 bp, Mus musculus
gatagcccattctcccaagaattct

SEQ ID NO: 503304 - DNA, 25 bp, Mus musculus
gatagccccacacccagaagtatgt

SEQ ID NO: 503305 - DNA, 25 bp, Mus musculus
gatagccccacagccagaagtatgt

SEQ ID NO: 503306 - DNA, 25 bp, Mus musculus
gatagcccctttaagaaattcaact

SEQ ID NO: 503307 - DNA, 25 bp, Mus musculus
gatagccccttttagaaattcaact

SEQ ID NO: 503308 - DNA, 25 bp, Mus musculus
gatagcccggccctgaatggagcca

SEQ ID NO: 503309 - DNA, 25 bp, Mus musculus
gatagcccggccgtgaatggagcca

SEQ ID NO: 503310 - DNA, 25 bp, Mus musculus
gatagcccgtttaatcttgcatcgg

SEQ ID NO: 503311 - DNA, 25 bp, Mus musculus
gatagcccgttttatcttgcatcgg

SEQ ID NO: 503312 - DNA, 25 bp, Mus musculus
gatagccctgggactgcggagcttc

SEQ ID NO: 503313 - DNA, 25 bp, Mus musculus
gatagccctgggtctgcggagcttc

SEQ ID NO: 503314 - DNA, 25 bp, Mus musculus
gatagccctgtcaggtacacatcta

SEQ ID NO: 503315 - DNA, 25 bp, Mus musculus
gatagccctgtctggtacacatcta

SEQ ID NO: 503316 - DNA, 25 bp, Mus musculus
gatagccctttgaacacacacgctg

SEQ ID NO: 503317 - DNA, 25 bp, Mus musculus
gatagccctttgtacacacacgctg

SEQ ID NO: 503318 - DNA, 25 bp, Mus musculus
gatagcccttttaccaagcttcctc

SEQ ID NO: 503319 - DNA, 25 bp, Mus musculus
gatagccctttttccaagcttcctc

SEQ ID NO: 503320 - DNA, 25 bp, Mus musculus
gatagccgagcaccaggctgtcaaa

SEQ ID NO: 503321 - DNA, 25 bp, Mus musculus
gatagccgagcagcaggctgtcaaa

SEQ ID NO: 503322 - DNA, 25 bp, Mus musculus
gatagcctaacactttcattttaat

SEQ ID NO: 503323 - DNA, 25 bp, Mus musculus
gatagcctaacagtttcattttaat

SEQ ID NO: 503324 - DNA, 25 bp, Mus musculus
gatagcctagtcaaaacacaggagg

SEQ ID NO: 503325 - DNA, 25 bp, Mus musculus
gatagcctagtctaaacacaggagg

SEQ ID NO: 503326 - DNA, 25 bp, Mus musculus
gatagcctatagaattgcctgaatt

SEQ ID NO: 503327 - DNA, 25 bp, Mus musculus
gatagcctatagtattgcctgaatt

SEQ ID NO: 503328 - DNA, 25 bp, Mus musculus
gatagcctcaacaccaacttagggt

SEQ ID NO: 503329 - DNA, 25 bp, Mus musculus
gatagcctcaaccttcacaaacagg

SEQ ID NO: 503330 - DNA, 25 bp, Mus musculus
gatagcctcaacgttcacaaacagg

SEQ ID NO: 503331 - DNA, 25 bp, Mus musculus
gatagcctcaactccaacttagggt

SEQ ID NO: 503332 - DNA, 25 bp, Mus musculus
gatagcctcagtatcctctgaaatt

SEQ ID NO: 503333 - DNA, 25 bp, Mus musculus
gatagcctcagtttcctctgaaatt

SEQ ID NO: 503334 - DNA, 25 bp, Mus musculus
gatagcctcatcacacatttagctg

SEQ ID NO: 503335 - DNA, 25 bp, Mus musculus
gatagcctcatctcacatttagctg

SEQ ID NO: 503336 - DNA, 25 bp, Mus musculus
gatagcctgccaatctgattttaga

SEQ ID NO: 503337 - DNA, 25 bp, Mus musculus
gatagcctgccattctgattttaga

SEQ ID NO: 503338 - DNA, 25 bp, Mus musculus
gatagcctggccctgcgtcaggtcc

SEQ ID NO: 503339 - DNA, 25 bp, Mus musculus
gatagcctggccgtgcgtcaggtcc

SEQ ID NO: 503340 - DNA, 25 bp, Mus musculus
gatagcctgtgtaagccttaaggtt

SEQ ID NO: 503341 - DNA, 25 bp, Mus musculus
gatagcctgtgttagccttaaggtt

SEQ ID NO: 503342 - DNA, 25 bp, Mus musculus
gatagcctgttcaatctaccttgtg

SEQ ID NO: 503343 - DNA, 25 bp, Mus musculus
gatagcctgttctatctaccttgtg

SEQ ID NO: 503344 - DNA, 25 bp, Mus musculus
gatagcctttggaagaatctggtac

SEQ ID NO: 503345 - DNA, 25 bp, Mus musculus
gatagcctttggtagaatctggtac

SEQ ID NO: 503346 - DNA, 25 bp, Mus musculus
gatagccttttaagcattgaatatt

SEQ ID NO: 503347 - DNA, 25 bp, Mus musculus
gatagccttttatgcattgaatatt

SEQ ID NO: 503348 - DNA, 25 bp, Mus musculus
gatagcgaattcatttcctcaagaa

SEQ ID NO: 503349 - DNA, 25 bp, Mus musculus
gatagcgaattcttttcctcaagaa

SEQ ID NO: 503350 - DNA, 25 bp, Mus musculus
gatagcgataagactccgaagggag

SEQ ID NO: 503351 - DNA, 25 bp, Mus musculus
gatagcgataagtctccgaagggag

SEQ ID NO: 503352 - DNA, 25 bp, Mus musculus
gatagcgatgagactggtccaccta

SEQ ID NO: 503353 - DNA, 25 bp, Mus musculus
gatagcgatgagtctggtccaccta

SEQ ID NO: 503354 - DNA, 25 bp, Mus musculus
gatagcgcagaaccatcttcacacg

SEQ ID NO: 503355 - DNA, 25 bp, Mus musculus
gatagcgcagaagcatcttcacacg

SEQ ID NO: 503356 - DNA, 25 bp, Mus musculus
gatagcgccccaacctaaagtggtc

SEQ ID NO: 503357 - DNA, 25 bp, Mus musculus
gatagcgccccatcctaaagtggtc

SEQ ID NO: 503358 - DNA, 25 bp, Mus musculus
gatagcggccacagagctggagaaa

SEQ ID NO: 503359 - DNA, 25 bp, Mus musculus
gatagcggccactgagctggagaaa

SEQ ID NO: 503360 - DNA, 25 bp, Mus musculus
gatagcgtcaccaaacaaacagttt

SEQ ID NO: 503361 - DNA, 25 bp, Mus musculus
gatagcgtcacctaacaaacagttt

SEQ ID NO: 503362 - DNA, 25 bp, Mus musculus
gatagcgtcatgagtatgatccttt

SEQ ID NO: 503363 - DNA, 25 bp, Mus musculus
gatagcgtcatgtgtatgatccttt

SEQ ID NO: 503364 - DNA, 25 bp, Mus musculus
gatagcgtgaaaattgagtctcttt

SEQ ID NO: 503365 - DNA, 25 bp, Mus musculus
gatagcgtgaaatttgagtctcttt

SEQ ID NO: 503366 - DNA, 25 bp, Mus musculus
gatagcgtgtaacctttgcaaaaca

SEQ ID NO: 503367 - DNA, 25 bp, Mus musculus
gatagcgtgtaactatgcataccat

SEQ ID NO: 503368 - DNA, 25 bp, Mus musculus
gatagcgtgtaagctttgcaaaaca

SEQ ID NO: 503369 - DNA, 25 bp, Mus musculus
gatagcgtgtaagtatgcataccat

SEQ ID NO: 503370 - DNA, 25 bp, Mus musculus
gatagctaaacaaaacactgacgcc

SEQ ID NO: 503371 - DNA, 25 bp, Mus musculus
gatagctaaacataacactgacgcc

SEQ ID NO: 503372 - DNA, 25 bp, Mus musculus
gatagctaaataactcctgagccca

SEQ ID NO: 503373 - DNA, 25 bp, Mus musculus
gatagctaaatatctcctgagccca

SEQ ID NO: 503374 - DNA, 25 bp, Mus musculus
gatagctaacagatccttttataaa

SEQ ID NO: 503375 - DNA, 25 bp, Mus musculus
gatagctaacagttccttttataaa

SEQ ID NO: 503376 - DNA, 25 bp, Mus musculus
gatagctaaccacctgcaagaattg

SEQ ID NO: 503377 - DNA, 25 bp, Mus musculus
gatagctaaccagctgcaagaattg

SEQ ID NO: 503378 - DNA, 25 bp, Mus musculus
gatagctaagtcactgccctacaca

SEQ ID NO: 503379 - DNA, 25 bp, Mus musculus
gatagctaagtctctgccctacaca

SEQ ID NO: 503380 - DNA, 25 bp, Mus musculus
gatagctaataaccatttgtaactc

SEQ ID NO: 503381 - DNA, 25 bp, Mus musculus
gatagctaataagcatttgtaactc

SEQ ID NO: 503382 - DNA, 25 bp, Mus musculus
gatagctacgtgattttctgttcct

SEQ ID NO: 503383 - DNA, 25 bp, Mus musculus
gatagctacgtgtttttctgttcct

SEQ ID NO: 503384 - DNA, 25 bp, Mus musculus
gatagctacttcagtgacgtacctc

SEQ ID NO: 503385 - DNA, 25 bp, Mus musculus
gatagctacttctgtgacgtacctc

SEQ ID NO: 503386 - DNA, 25 bp, Mus musculus
gatagctagactattcttttattac

SEQ ID NO: 503387 - DNA, 25 bp, Mus musculus
gatagctagacttttcttttattac

SEQ ID NO: 503388 - DNA, 25 bp, Mus musculus
gatagctagagcatccacacgtgga

SEQ ID NO: 503389 - DNA, 25 bp, Mus musculus
gatagctagagcttccacacgtgga

SEQ ID NO: 503390 - DNA, 25 bp, Mus musculus
gatagctaggtcaggctgttgcctt

SEQ ID NO: 503391 - DNA, 25 bp, Mus musculus
gatagctaggtctggctgttgcctt

SEQ ID NO: 503392 - DNA, 25 bp, Mus musculus
gatagctatagcaggagaggaaact

SEQ ID NO: 503393 - DNA, 25 bp, Mus musculus
gatagctatagctggagaggaaact

SEQ ID NO: 503394 - DNA, 25 bp, Mus musculus
gatagctatccaccccattgattga

SEQ ID NO: 503395 - DNA, 25 bp, Mus musculus
gatagctatccagcccattgattga

SEQ ID NO: 503396 - DNA, 25 bp, Mus musculus
gatagctatgatctcaagtcgattc

SEQ ID NO: 503397 - DNA, 25 bp, Mus musculus
gatagctatgatgtcaagtcgattc

SEQ ID NO: 503398 - DNA, 25 bp, Mus musculus
gatagctatgcaaccatctttggct

SEQ ID NO: 503399 - DNA, 25 bp, Mus musculus
gatagctatgcatccatctttggct

SEQ ID NO: 503400 - DNA, 25 bp, Mus musculus
gatagctatggtattgtgcattgac

SEQ ID NO: 503401 - DNA, 25 bp, Mus musculus
gatagctatggttttgtgcattgac

SEQ ID NO: 503402 - DNA, 25 bp, Mus musculus
gatagctcaacaaaactggtgaagt

SEQ ID NO: 503403 - DNA, 25 bp, Mus musculus
gatagctcaacataactggtgaagt

SEQ ID NO: 503404 - DNA, 25 bp, Mus musculus
gatagctcaccacttggatgcactt

SEQ ID NO: 503405 - DNA, 25 bp, Mus musculus
gatagctcaccagttggatgcactt

SEQ ID NO: 503406 - DNA, 25 bp, Mus musculus
gatagctcagaaattcccttgtggg

SEQ ID NO: 503407 - DNA, 25 bp, Mus musculus
gatagctcagaatttcccttgtggg

SEQ ID NO: 503408 - DNA, 25 bp, Mus musculus
gatagctcagcaaagtgccatcaag

SEQ ID NO: 503409 - DNA, 25 bp, Mus musculus
gatagctcagcaccgggttgatctg

SEQ ID NO: 503410 - DNA, 25 bp, Mus musculus
gatagctcagcagcgggttgatctg

SEQ ID NO: 503411 - DNA, 25 bp, Mus musculus
gatagctcagcatagtgccatcaag

SEQ ID NO: 503412 - DNA, 25 bp, Mus musculus
gatagctcagtgctttgctcctccc

SEQ ID NO: 503413 - DNA, 25 bp, Mus musculus
gatagctcagtggtttgctcctccc

SEQ ID NO: 503414 - DNA, 25 bp, Mus musculus
gatagctcatctctatataggacat

SEQ ID NO: 503415 - DNA, 25 bp, Mus musculus
gatagctcatctgtatataggacat

SEQ ID NO: 503416 - DNA, 25 bp, Mus musculus
gatagctcattgactgtgcttacaa

SEQ ID NO: 503417 - DNA, 25 bp, Mus musculus
gatagctcattgtctgtgcttacaa

SEQ ID NO: 503418 - DNA, 25 bp, Mus musculus
gatagctccactaacagggtctcat

SEQ ID NO: 503419 - DNA, 25 bp, Mus musculus
gatagctccacttacagggtctcat

SEQ ID NO: 503420 - DNA, 25 bp, Mus musculus
gatagctccctgctaggactttggt

SEQ ID NO: 503421 - DNA, 25 bp, Mus musculus
gatagctccctggtaggactttggt

SEQ ID NO: 503422 - DNA, 25 bp, Mus musculus
gatagctctcttagtttgctgttat

SEQ ID NO: 503423 - DNA, 25 bp, Mus musculus
gatagctctctttgtttgctgttat

SEQ ID NO: 503424 - DNA, 25 bp, Mus musculus
gatagctctgccaattgcaggacaa

SEQ ID NO: 503425 - DNA, 25 bp, Mus musculus
gatagctctgcctattgcaggacaa

SEQ ID NO: 503426 - DNA, 25 bp, Mus musculus
gatagctctgctcaggttcacggga

SEQ ID NO: 503427 - DNA, 25 bp, Mus musculus
gatagctctgctgaggttcacggga

SEQ ID NO: 503428 - DNA, 25 bp, Mus musculus
gatagctctggtcatcctgttggct

SEQ ID NO: 503429 - DNA, 25 bp, Mus musculus
gatagctctggtgatcctgttggct

SEQ ID NO: 503430 - DNA, 25 bp, Mus musculus
gatagctcttcaagttgcactgacc

SEQ ID NO: 503431 - DNA, 25 bp, Mus musculus
gatagctcttcatgttgcactgacc

SEQ ID NO: 503432 - DNA, 25 bp, Mus musculus
gatagctgagatcctcctactgttt

SEQ ID NO: 503433 - DNA, 25 bp, Mus musculus
gatagctgagatgctcctactgttt

SEQ ID NO: 503434 - DNA, 25 bp, Mus musculus
gatagctgagctaaccctaaggttt

SEQ ID NO: 503435 - DNA, 25 bp, Mus musculus
gatagctgagcttaccctaaggttt

SEQ ID NO: 503436 - DNA, 25 bp, Mus musculus
gatagctgcactagggaacccggag

SEQ ID NO: 503437 - DNA, 25 bp, Mus musculus
gatagctgcacttgggaacccggag

SEQ ID NO: 503438 - DNA, 25 bp, Mus musculus
gatagctgctcacagcgttctgaat

SEQ ID NO: 503439 - DNA, 25 bp, Mus musculus
gatagctgctcagagcgttctgaat

SEQ ID NO: 503440 - DNA, 25 bp, Mus musculus
gatagctgctgaacacttgcaggaa

SEQ ID NO: 503441 - DNA, 25 bp, Mus musculus
gatagctgctgatcacttgcaggaa

SEQ ID NO: 503442 - DNA, 25 bp, Mus musculus
gatagctgggatccggacacactca

SEQ ID NO: 503443 - DNA, 25 bp, Mus musculus
gatagctgggatgcggacacactca

SEQ ID NO: 503444 - DNA, 25 bp, Mus musculus
gatagctgggtaccttaactctccc

SEQ ID NO: 503445 - DNA, 25 bp, Mus musculus
gatagctgggtagcttaactctccc

SEQ ID NO: 503446 - DNA, 25 bp, Mus musculus
gatagctgtagtatcttacaaccat

SEQ ID NO: 503447 - DNA, 25 bp, Mus musculus
gatagctgtagtttcttacaaccat

SEQ ID NO: 503448 - DNA, 25 bp, Mus musculus
gatagctgtctcagaagtaactttc

SEQ ID NO: 503449 - DNA, 25 bp, Mus musculus
gatagctgtctctgaagtaactttc

SEQ ID NO: 503450 - DNA, 25 bp, Mus musculus
gatagctgtgatcccaaattctttt

SEQ ID NO: 503451 - DNA, 25 bp, Mus musculus
gatagctgtgatgccaaattctttt

SEQ ID NO: 503452 - DNA, 25 bp, Mus musculus
gatagctgtggtccttcctggtgca

SEQ ID NO: 503453 - DNA, 25 bp, Mus musculus
gatagctgtggtgcttcctggtgca

SEQ ID NO: 503454 - DNA, 25 bp, Mus musculus
gatagctgttagatttactctagaa

SEQ ID NO: 503455 - DNA, 25 bp, Mus musculus
gatagctgttagttttactctagaa

SEQ ID NO: 503456 - DNA, 25 bp, Mus musculus
gatagctgtttacagagctttcagt

SEQ ID NO: 503457 - DNA, 25 bp, Mus musculus
gatagctgtttagagagctttcagt

SEQ ID NO: 503458 - DNA, 25 bp, Mus musculus
gatagcttaaatctccttaaaacaa

SEQ ID NO: 503459 - DNA, 25 bp, Mus musculus
gatagcttaaatgtccttaaaacaa

SEQ ID NO: 503460 - DNA, 25 bp, Mus musculus
gatagcttacaactggatctaaaca

SEQ ID NO: 503461 - DNA, 25 bp, Mus musculus
gatagcttacaagtggatctaaaca

SEQ ID NO: 503462 - DNA, 25 bp, Mus musculus
gatagcttacagctccaggaatcgg

SEQ ID NO: 503463 - DNA, 25 bp, Mus musculus
gatagcttacaggtccaggaatcgg

SEQ ID NO: 503464 - DNA, 25 bp, Mus musculus
gatagcttagctataaccagctact

SEQ ID NO: 503465 - DNA, 25 bp, Mus musculus
gatagcttagctttaaccagctact

SEQ ID NO: 503466 - DNA, 25 bp, Mus musculus
gatagcttatttaggacgtggattc

SEQ ID NO: 503467 - DNA, 25 bp, Mus musculus
gatagcttattttggacgtggattc

SEQ ID NO: 503468 - DNA, 25 bp, Mus musculus
gatagcttcaaacgcttctgctgca

SEQ ID NO: 503469 - DNA, 25 bp, Mus musculus
gatagcttcaaaggcttctgctgca

SEQ ID NO: 503470 - DNA, 25 bp, Mus musculus
gatagcttcagcactcatcatgatc

SEQ ID NO: 503471 - DNA, 25 bp, Mus musculus
gatagcttcagctctcatcatgatc

SEQ ID NO: 503472 - DNA, 25 bp, Mus musculus
gatagcttcatgctaaaagcactag

SEQ ID NO: 503473 - DNA, 25 bp, Mus musculus
gatagcttcatggtaaaagcactag

SEQ ID NO: 503474 - DNA, 25 bp, Mus musculus
gatagcttccagactagtccattag

SEQ ID NO: 503475 - DNA, 25 bp, Mus musculus
gatagcttccagtctagtccattag

SEQ ID NO: 503476 - DNA, 25 bp, Mus musculus
gatagcttcctgaaacgtgtgaagg

SEQ ID NO: 503477 - DNA, 25 bp, Mus musculus
gatagcttcctgtaacgtgtgaagg

SEQ ID NO: 503478 - DNA, 25 bp, Mus musculus
gatagcttctgacagtcatcagtat

SEQ ID NO: 503479 - DNA, 25 bp, Mus musculus
gatagcttctgagagtcatcagtat

SEQ ID NO: 503480 - DNA, 25 bp, Mus musculus
gatagcttctgtaatcacagaacag

SEQ ID NO: 503481 - DNA, 25 bp, Mus musculus
gatagcttctgtcaagatgccataa

SEQ ID NO: 503482 - DNA, 25 bp, Mus musculus
gatagcttctgtgaagatgccataa

SEQ ID NO: 503483 - DNA, 25 bp, Mus musculus
gatagcttctgttatcacagaacag

SEQ ID NO: 503484 - DNA, 25 bp, Mus musculus
gatagcttcttgaagccgaacgtga

SEQ ID NO: 503485 - DNA, 25 bp, Mus musculus
gatagcttcttgtagccgaacgtga

SEQ ID NO: 503486 - DNA, 25 bp, Mus musculus
gatagcttgagcagctgacattgta

SEQ ID NO: 503487 - DNA, 25 bp, Mus musculus
gatagcttgagctgctgacattgta

SEQ ID NO: 503488 - DNA, 25 bp, Mus musculus
gatagcttgcgaagaagagttttca

SEQ ID NO: 503489 - DNA, 25 bp, Mus musculus
gatagcttgcgatgaagagttttca

SEQ ID NO: 503490 - DNA, 25 bp, Mus musculus
gatagcttggaacttggattctact

SEQ ID NO: 503491 - DNA, 25 bp, Mus musculus
gatagcttggaagttggattctact

SEQ ID NO: 503492 - DNA, 25 bp, Mus musculus
gatagcttgggaattcttttctgtt

SEQ ID NO: 503493 - DNA, 25 bp, Mus musculus
gatagcttgggatttcttttctgtt

SEQ ID NO: 503494 - DNA, 25 bp, Mus musculus
gatagcttgttcatactcacctgta

SEQ ID NO: 503495 - DNA, 25 bp, Mus musculus
gatagcttgttcttactcacctgta

SEQ ID NO: 503496 - DNA, 25 bp, Mus musculus
gatagctttatcagtttccatcaca

SEQ ID NO: 503497 - DNA, 25 bp, Mus musculus
gatagctttatctgtttccatcaca

SEQ ID NO: 503498 - DNA, 25 bp, Mus musculus
gatagctttgttacatgtcattcag

SEQ ID NO: 503499 - DNA, 25 bp, Mus musculus
gatagctttgtttcatgtcattcag

SEQ ID NO: 503500 - DNA, 25 bp, Mus musculus
gatagcttttatcttgaacaaataa

SEQ ID NO: 503501 - DNA, 25 bp, Mus musculus
gatagcttttatgttgaacaaataa

SEQ ID NO: 503502 - DNA, 25 bp, Mus musculus
gatagcttttctctagcacatgcaa

SEQ ID NO: 503503 - DNA, 25 bp, Mus musculus
gatagcttttctgtagcacatgcaa

SEQ ID NO: 503504 - DNA, 25 bp, Mus musculus
gatagctttttgaagatttgtgctc

SEQ ID NO: 503505 - DNA, 25 bp, Mus musculus
gatagctttttgtagatttgtgctc

SEQ ID NO: 503506 - DNA, 25 bp, Mus musculus
gataggaaatccacagcactcaaag

SEQ ID NO: 503507 - DNA, 25 bp, Mus musculus
gataggaaatcctcagcactcaaag

SEQ ID NO: 503508 - DNA, 25 bp, Mus musculus
gataggaaccctagcccagatgagc

SEQ ID NO: 503509 - DNA, 25 bp, Mus musculus
gataggaacccttgcccagatgagc

SEQ ID NO: 503510 - DNA, 25 bp, Mus musculus
gataggaacctgatgtcctaccttc

SEQ ID NO: 503511 - DNA, 25 bp, Mus musculus
gataggaacctgttgtcctaccttc

SEQ ID NO: 503512 - DNA, 25 bp, Mus musculus
gataggaagctgatcacctctcacc

SEQ ID NO: 503513 - DNA, 25 bp, Mus musculus
gataggaagctgttcacctctcacc

SEQ ID NO: 503514 - DNA, 25 bp, Mus musculus
gataggaatgctaacagctcacttg

SEQ ID NO: 503515 - DNA, 25 bp, Mus musculus
gataggaatgcttacagctcacttg

SEQ ID NO: 503516 - DNA, 25 bp, Mus musculus
gataggacactgagcgtgccaggca

SEQ ID NO: 503517 - DNA, 25 bp, Mus musculus
gataggacactgtgcgtgccaggca

SEQ ID NO: 503518 - DNA, 25 bp, Mus musculus
gataggacatttacacttcagggtt

SEQ ID NO: 503519 - DNA, 25 bp, Mus musculus
gataggacattttcacttcagggtt

SEQ ID NO: 503520 - DNA, 25 bp, Mus musculus
gataggaccacacgccggtttaatg

SEQ ID NO: 503521 - DNA, 25 bp, Mus musculus
gataggaccacaggccggtttaatg

SEQ ID NO: 503522 - DNA, 25 bp, Mus musculus
gataggaccactcttctcatagaac

SEQ ID NO: 503523 - DNA, 25 bp, Mus musculus
gataggaccactgttctcatagaac

SEQ ID NO: 503524 - DNA, 25 bp, Mus musculus
gataggaccatacaagccatgctaa

SEQ ID NO: 503525 - DNA, 25 bp, Mus musculus
gataggaccatagaagccatgctaa

SEQ ID NO: 503526 - DNA, 25 bp, Mus musculus
gataggaccatcatgctcctcggag

SEQ ID NO: 503527 - DNA, 25 bp, Mus musculus
gataggaccatcttgctcctcggag

SEQ ID NO: 503528 - DNA, 25 bp, Mus musculus
gataggacccatacttgataacagc

SEQ ID NO: 503529 - DNA, 25 bp, Mus musculus
gataggacccattcttgataacagc

SEQ ID NO: 503530 - DNA, 25 bp, Mus musculus
gataggacctaaatgacctggtgta

SEQ ID NO: 503531 - DNA, 25 bp, Mus musculus
gataggacctaattgacctggtgta

SEQ ID NO: 503532 - DNA, 25 bp, Mus musculus
gataggacctagagtttactacagt

SEQ ID NO: 503533 - DNA, 25 bp, Mus musculus
gataggacctagtgtttactacagt

SEQ ID NO: 503534 - DNA, 25 bp, Mus musculus
gataggactcaacccctcagatcag

SEQ ID NO: 503535 - DNA, 25 bp, Mus musculus
gataggactcaagccctcagatcag

SEQ ID NO: 503536 - DNA, 25 bp, Mus musculus
gataggactctaaaatggttcaaaa

SEQ ID NO: 503537 - DNA, 25 bp, Mus musculus
gataggactctataatggttcaaaa

SEQ ID NO: 503538 - DNA, 25 bp, Mus musculus
gataggacttgaagccacaggccca

SEQ ID NO: 503539 - DNA, 25 bp, Mus musculus
gataggacttgatgccacaggccca

SEQ ID NO: 503540 - DNA, 25 bp, Mus musculus
gataggagaaccagtctgtcttaag

SEQ ID NO: 503541 - DNA, 25 bp, Mus musculus
gataggagaacctgtctgtcttaag

SEQ ID NO: 503542 - DNA, 25 bp, Mus musculus
gataggagacaaccacctgacccta

SEQ ID NO: 503543 - DNA, 25 bp, Mus musculus
gataggagacaagcacctgacccta

SEQ ID NO: 503544 - DNA, 25 bp, Mus musculus
gataggagcaagaggccctctagga

SEQ ID NO: 503545 - DNA, 25 bp, Mus musculus
gataggagcaagtggccctctagga

SEQ ID NO: 503546 - DNA, 25 bp, Mus musculus
gataggagccaaagctactttctga

SEQ ID NO: 503547 - DNA, 25 bp, Mus musculus
gataggagccaatgctactttctga

SEQ ID NO: 503548 - DNA, 25 bp, Mus musculus
gataggaggccaacaaaaccagctt

SEQ ID NO: 503549 - DNA, 25 bp, Mus musculus
gataggaggccatcaaaaccagctt

SEQ ID NO: 503550 - DNA, 25 bp, Mus musculus
gataggaggtgacaccatcttccct

SEQ ID NO: 503551 - DNA, 25 bp, Mus musculus
gataggaggtgagaccatcttccct

SEQ ID NO: 503552 - DNA, 25 bp, Mus musculus
gataggatatctagtccgggttcta

SEQ ID NO: 503553 - DNA, 25 bp, Mus musculus
gataggatatcttgtccgggttcta

SEQ ID NO: 503554 - DNA, 25 bp, Mus musculus
gataggatcagtactgtagccgtca

SEQ ID NO: 503555 - DNA, 25 bp, Mus musculus
gataggatcagttctgtagccgtca

SEQ ID NO: 503556 - DNA, 25 bp, Mus musculus
gataggatccctcagggacacagta

SEQ ID NO: 503557 - DNA, 25 bp, Mus musculus
gataggatccctgagggacacagta

SEQ ID NO: 503558 - DNA, 25 bp, Mus musculus
gataggatctcaatttcagtgaact

SEQ ID NO: 503559 - DNA, 25 bp, Mus musculus
gataggatctcattttcagtgaact

SEQ ID NO: 503560 - DNA, 25 bp, Mus musculus
gataggatctctaatgcagctctgt

SEQ ID NO: 503561 - DNA, 25 bp, Mus musculus
gataggatctcttatgcagctctgt

SEQ ID NO: 503562 - DNA, 25 bp, Mus musculus
gataggatttagcacagagacccat

SEQ ID NO: 503563 - DNA, 25 bp, Mus musculus
gataggatttaggacagagacccat

SEQ ID NO: 503564 - DNA, 25 bp, Mus musculus
gataggatttctactgttttcatga

SEQ ID NO: 503565 - DNA, 25 bp, Mus musculus
gataggatttcttctgttttcatga

SEQ ID NO: 503566 - DNA, 25 bp, Mus musculus
gataggcacagcacctgagaagctt

SEQ ID NO: 503567 - DNA, 25 bp, Mus musculus
gataggcacagctcctgagaagctt

SEQ ID NO: 503568 - DNA, 25 bp, Mus musculus
gataggcaccaaccaaatgaatgaa

SEQ ID NO: 503569 - DNA, 25 bp, Mus musculus
gataggcaccaagcaaatgaatgaa

SEQ ID NO: 503570 - DNA, 25 bp, Mus musculus
gataggcagaacagacagagctcaa

SEQ ID NO: 503571 - DNA, 25 bp, Mus musculus
gataggcagaactgacagagctcaa

SEQ ID NO: 503572 - DNA, 25 bp, Mus musculus
gataggcagatccagaaggcattct

SEQ ID NO: 503573 - DNA, 25 bp, Mus musculus
gataggcagatcgagaaggcattct

SEQ ID NO: 503574 - DNA, 25 bp, Mus musculus
gataggcagattcctattgcttttg

SEQ ID NO: 503575 - DNA, 25 bp, Mus musculus
gataggcagattgctattgcttttg

SEQ ID NO: 503576 - DNA, 25 bp, Mus musculus
gataggcagccactgatgtcttttt

SEQ ID NO: 503577 - DNA, 25 bp, Mus musculus
gataggcagccagtgatgtcttttt

SEQ ID NO: 503578 - DNA, 25 bp, Mus musculus
gataggcaggaacacatccacagac

SEQ ID NO: 503579 - DNA, 25 bp, Mus musculus
gataggcaggaagacatccacagac

SEQ ID NO: 503580 - DNA, 25 bp, Mus musculus
gataggcagtatcttgagagcaagc

SEQ ID NO: 503581 - DNA, 25 bp, Mus musculus
gataggcagtatgttgagagcaagc

SEQ ID NO: 503582 - DNA, 25 bp, Mus musculus
gataggcagtgtatagcagtgtcag

SEQ ID NO: 503583 - DNA, 25 bp, Mus musculus
gataggcagtgtttagcagtgtcag

SEQ ID NO: 503584 - DNA, 25 bp, Mus musculus
gataggcatatcatcttgctttgtg

SEQ ID NO: 503585 - DNA, 25 bp, Mus musculus
gataggcatatcttcttgctttgtg

SEQ ID NO: 503586 - DNA, 25 bp, Mus musculus
gataggcatccaagagaccgacacc

SEQ ID NO: 503587 - DNA, 25 bp, Mus musculus
gataggcatccatgagaccgacacc

SEQ ID NO: 503588 - DNA, 25 bp, Mus musculus
gataggcattcccacggtcctaggc

SEQ ID NO: 503589 - DNA, 25 bp, Mus musculus
gataggcattccgacggtcctaggc

SEQ ID NO: 503590 - DNA, 25 bp, Mus musculus
gataggcatttcacggttttttctt

SEQ ID NO: 503591 - DNA, 25 bp, Mus musculus
gataggcatttctcggttttttctt

SEQ ID NO: 503592 - DNA, 25 bp, Mus musculus
gataggccaaacatttgcttctttt

SEQ ID NO: 503593 - DNA, 25 bp, Mus musculus
gataggccaaacttttgcttctttt

SEQ ID NO: 503594 - DNA, 25 bp, Mus musculus
gataggccagagacccgtgaaggct

SEQ ID NO: 503595 - DNA, 25 bp, Mus musculus
gataggccagagtcccgtgaaggct

SEQ ID NO: 503596 - DNA, 25 bp, Mus musculus
gataggccatctaaggacttgcagc

SEQ ID NO: 503597 - DNA, 25 bp, Mus musculus
gataggccatcttaggacttgcagc

SEQ ID NO: 503598 - DNA, 25 bp, Mus musculus
gataggccctacctttgaagtttct

SEQ ID NO: 503599 - DNA, 25 bp, Mus musculus
gataggccctacgtttgaagtttct

SEQ ID NO: 503600 - DNA, 25 bp, Mus musculus
gataggcctaaaccttgtcatgtct

SEQ ID NO: 503601 - DNA, 25 bp, Mus musculus
gataggcctaaagcttgtcatgtct

SEQ ID NO: 503602 - DNA, 25 bp, Mus musculus
gataggcctttcaaggaagaacaaa

SEQ ID NO: 503603 - DNA, 25 bp, Mus musculus
gataggcctttctaggaagaacaaa

SEQ ID NO: 503604 - DNA, 25 bp, Mus musculus
gataggctaaaaacctttgccctgt

SEQ ID NO: 503605 - DNA, 25 bp, Mus musculus
gataggctaaaatcctttgccctgt

SEQ ID NO: 503606 - DNA, 25 bp, Mus musculus
gataggctgaacaaactgcacaaac

SEQ ID NO: 503607 - DNA, 25 bp, Mus musculus
gataggctgaactaactgcacaaac

SEQ ID NO: 503608 - DNA, 25 bp, Mus musculus
gataggctgctgagttacataaggc

SEQ ID NO: 503609 - DNA, 25 bp, Mus musculus
gataggctgctgtgttacataaggc

SEQ ID NO: 503610 - DNA, 25 bp, Mus musculus
gataggctggctaccagctgcttaa

SEQ ID NO: 503611 - DNA, 25 bp, Mus musculus
gataggctggcttccagctgcttaa

SEQ ID NO: 503612 - DNA, 25 bp, Mus musculus
gataggctgtgaccagtggttgtga

SEQ ID NO: 503613 - DNA, 25 bp, Mus musculus
gataggctgtgagcagtggttgtga

SEQ ID NO: 503614 - DNA, 25 bp, Mus musculus
gataggctgttactggtctgttgtc

SEQ ID NO: 503615 - DNA, 25 bp, Mus musculus
gataggctgttagtggtctgttgtc

SEQ ID NO: 503616 - DNA, 25 bp, Mus musculus
gataggcttcatcctgtacaaacca

SEQ ID NO: 503617 - DNA, 25 bp, Mus musculus
gataggcttcatgctgtacaaacca

SEQ ID NO: 503618 - DNA, 25 bp, Mus musculus
gataggcttccaatttgtaatatta

SEQ ID NO: 503619 - DNA, 25 bp, Mus musculus
gataggcttccattttgtaatatta

SEQ ID NO: 503620 - DNA, 25 bp, Mus musculus
gataggcttgatagtctcagaggag

SEQ ID NO: 503621 - DNA, 25 bp, Mus musculus
gataggcttgattgtctcagaggag

SEQ ID NO: 503622 - DNA, 25 bp, Mus musculus
gataggcttgttattatctccgcca

SEQ ID NO: 503623 - DNA, 25 bp, Mus musculus
gataggcttgtttttatctccgcca

SEQ ID NO: 503624 - DNA, 25 bp, Mus musculus
gatagggacaacagacctcctccct

SEQ ID NO: 503625 - DNA, 25 bp, Mus musculus
gatagggacaactgacctcctccct

SEQ ID NO: 503626 - DNA, 25 bp, Mus musculus
gatagggacctcagaacagctctga

SEQ ID NO: 503627 - DNA, 25 bp, Mus musculus
gatagggacctctgaacagctctga

SEQ ID NO: 503628 - DNA, 25 bp, Mus musculus
gatagggacttcatgggtttgcttg

SEQ ID NO: 503629 - DNA, 25 bp, Mus musculus
gatagggacttcttgggtttgcttg

SEQ ID NO: 503630 - DNA, 25 bp, Mus musculus
gatagggatagaccctcctttgctg

SEQ ID NO: 503631 - DNA, 25 bp, Mus musculus
gatagggatagagcctcctttgctg

SEQ ID NO: 503632 - DNA, 25 bp, Mus musculus
gatagggattataactccatcaaac

SEQ ID NO: 503633 - DNA, 25 bp, Mus musculus
gatagggattattactccatcaaac

SEQ ID NO: 503634 - DNA, 25 bp, Mus musculus
gatagggcacaaagagggacctctt

SEQ ID NO: 503635 - DNA, 25 bp, Mus musculus
gatagggcacaatgagggacctctt

SEQ ID NO: 503636 - DNA, 25 bp, Mus musculus
gatagggcacttcattactctggac

SEQ ID NO: 503637 - DNA, 25 bp, Mus musculus
gatagggcacttgattactctggac

SEQ ID NO: 503638 - DNA, 25 bp, Mus musculus
gatagggcagcacatagtgaatcat

SEQ ID NO: 503639 - DNA, 25 bp, Mus musculus
gatagggcagcagatagtgaatcat

SEQ ID NO: 503640 - DNA, 25 bp, Mus musculus
gatagggccttgatgcatacccctg

SEQ ID NO: 503641 - DNA, 25 bp, Mus musculus
gatagggccttgttgcatacccctg

SEQ ID NO: 503642 - DNA, 25 bp, Mus musculus
gatagggcgtagactccagaatagc

SEQ ID NO: 503643 - DNA, 25 bp, Mus musculus
gatagggcgtagtctccagaatagc

SEQ ID NO: 503644 - DNA, 25 bp, Mus musculus
gatagggctggacactgcttttaag

SEQ ID NO: 503645 - DNA, 25 bp, Mus musculus
gatagggctggagactgcttttaag

SEQ ID NO: 503646 - DNA, 25 bp, Mus musculus
gatagggcttcacaacgtggcccaa

SEQ ID NO: 503647 - DNA, 25 bp, Mus musculus
gatagggcttcagaacgtggcccaa

SEQ ID NO: 503648 - DNA, 25 bp, Mus musculus
gatagggtcagtcacatggccagtt

SEQ ID NO: 503649 - DNA, 25 bp, Mus musculus
gatagggtcagtgacatggccagtt

SEQ ID NO: 503650 - DNA, 25 bp, Mus musculus
gatagggtctttctacattatctag

SEQ ID NO: 503651 - DNA, 25 bp, Mus musculus
gatagggtctttgtacattatctag

SEQ ID NO: 503652 - DNA, 25 bp, Mus musculus
gatagggtgggaccaatgtctacat

SEQ ID NO: 503653 - DNA, 25 bp, Mus musculus
gatagggtgggagcaatgtctacat

SEQ ID NO: 503654 - DNA, 25 bp, Mus musculus
gatagggtttggctcttacgtaaag

SEQ ID NO: 503655 - DNA, 25 bp, Mus musculus
gatagggtttgggtcttacgtaaag

SEQ ID NO: 503656 - DNA, 25 bp, Mus musculus
gataggtaaaacaatcttaaccaat

SEQ ID NO: 503657 - DNA, 25 bp, Mus musculus
gataggtaaaactatcttaaccaat

SEQ ID NO: 503658 - DNA, 25 bp, Mus musculus
gataggtaacaaatctacagctcaa

SEQ ID NO: 503659 - DNA, 25 bp, Mus musculus
gataggtaacaattctacagctcaa

SEQ ID NO: 503660 - DNA, 25 bp, Mus musculus
gataggtaacatatgcttgttttat

SEQ ID NO: 503661 - DNA, 25 bp, Mus musculus
gataggtaacatttgcttgttttat

SEQ ID NO: 503662 - DNA, 25 bp, Mus musculus
gataggtaagcccttcaaatcatta

SEQ ID NO: 503663 - DNA, 25 bp, Mus musculus
gataggtaagccgttcaaatcatta

SEQ ID NO: 503664 - DNA, 25 bp, Mus musculus
gataggtacaggaaaagcgaggctt

SEQ ID NO: 503665 - DNA, 25 bp, Mus musculus
gataggtacaggtaaagcgaggctt

SEQ ID NO: 503666 - DNA, 25 bp, Mus musculus
gataggtaggtcacttggccacaaa

SEQ ID NO: 503667 - DNA, 25 bp, Mus musculus
gataggtaggtctcttggccacaaa

SEQ ID NO: 503668 - DNA, 25 bp, Mus musculus
gataggtataacaacttagactccc

SEQ ID NO: 503669 - DNA, 25 bp, Mus musculus
gataggtataactacttagactccc

SEQ ID NO: 503670 - DNA, 25 bp, Mus musculus
gataggtatacaatgctggacagca

SEQ ID NO: 503671 - DNA, 25 bp, Mus musculus
gataggtatacattgctggacagca

SEQ ID NO: 503672 - DNA, 25 bp, Mus musculus
gataggtatcagctccctacaggaa

SEQ ID NO: 503673 - DNA, 25 bp, Mus musculus
gataggtatcaggtccctacaggaa

SEQ ID NO: 503674 - DNA, 25 bp, Mus musculus
gataggtcagggaactaaagcttta

SEQ ID NO: 503675 - DNA, 25 bp, Mus musculus
gataggtcagggtactaaagcttta

SEQ ID NO: 503676 - DNA, 25 bp, Mus musculus
gataggtcagttaaagcttggtttt

SEQ ID NO: 503677 - DNA, 25 bp, Mus musculus
gataggtcagtttaagcttggtttt

SEQ ID NO: 503678 - DNA, 25 bp, Mus musculus
gataggtccagcaggaactgagcct

SEQ ID NO: 503679 - DNA, 25 bp, Mus musculus
gataggtccagctggaactgagcct

SEQ ID NO: 503680 - DNA, 25 bp, Mus musculus
gataggtctgacattatgttacttg

SEQ ID NO: 503681 - DNA, 25 bp, Mus musculus
gataggtctgactttatgttacttg

SEQ ID NO: 503682 - DNA, 25 bp, Mus musculus
gataggtcttatcgacctcgataga

SEQ ID NO: 503683 - DNA, 25 bp, Mus musculus
gataggtcttatggacctcgataga

SEQ ID NO: 503684 - DNA, 25 bp, Mus musculus
gataggtcttgcagaactcctgtta

SEQ ID NO: 503685 - DNA, 25 bp, Mus musculus
gataggtcttgctgaactcctgtta

SEQ ID NO: 503686 - DNA, 25 bp, Mus musculus
gataggtgaggcactacatgccggc

SEQ ID NO: 503687 - DNA, 25 bp, Mus musculus
gataggtgaggctctacatgccggc

SEQ ID NO: 503688 - DNA, 25 bp, Mus musculus
gataggtggactcctttctagaatt

SEQ ID NO: 503689 - DNA, 25 bp, Mus musculus
gataggtggactgctttctagaatt

SEQ ID NO: 503690 - DNA, 25 bp, Mus musculus
gataggtggagcagttagtctgata

SEQ ID NO: 503691 - DNA, 25 bp, Mus musculus
gataggtggagctgttagtctgata

SEQ ID NO: 503692 - DNA, 25 bp, Mus musculus
gataggtgtgcaataaacatcactg

SEQ ID NO: 503693 - DNA, 25 bp, Mus musculus
gataggtgtgcattaaacatcactg

SEQ ID NO: 503694 - DNA, 25 bp, Mus musculus
gataggtgtttcatgggatctttct

SEQ ID NO: 503695 - DNA, 25 bp, Mus musculus
gataggtgtttcttgggatctttct

SEQ ID NO: 503696 - DNA, 25 bp, Mus musculus
gataggttactactctgccatacaa

SEQ ID NO: 503697 - DNA, 25 bp, Mus musculus
gataggttactagtctgccatacaa

SEQ ID NO: 503698 - DNA, 25 bp, Mus musculus
gataggttattgaacttccattcat

SEQ ID NO: 503699 - DNA, 25 bp, Mus musculus
gataggttattgtacttccattcat

SEQ ID NO: 503700 - DNA, 25 bp, Mus musculus
gataggttccatacctaatttcaga

SEQ ID NO: 503701 - DNA, 25 bp, Mus musculus
gataggttccattcctaatttcaga

SEQ ID NO: 503702 - DNA, 25 bp, Mus musculus
gataggttgcataccaggcatccca

SEQ ID NO: 503703 - DNA, 25 bp, Mus musculus
gataggttgcattccaggcatccca

SEQ ID NO: 503704 - DNA, 25 bp, Mus musculus
gataggttgctaagttcactgtgct

SEQ ID NO: 503705 - DNA, 25 bp, Mus musculus
gataggttgctatgttcactgtgct

SEQ ID NO: 503706 - DNA, 25 bp, Mus musculus
gataggttggatactcatctctgat

SEQ ID NO: 503707 - DNA, 25 bp, Mus musculus
gataggttggattctcatctctgat

SEQ ID NO: 503708 - DNA, 25 bp, Mus musculus
gataggtttacaaagttcatggttt

SEQ ID NO: 503709 - DNA, 25 bp, Mus musculus
gataggtttacatagttcatggttt

SEQ ID NO: 503710 - DNA, 25 bp, Mus musculus
gataggtttcggatacccagcctac

SEQ ID NO: 503711 - DNA, 25 bp, Mus musculus
gataggtttcggttacccagcctac

SEQ ID NO: 503712 - DNA, 25 bp, Mus musculus
gataggtttgcacacacctacagtt

SEQ ID NO: 503713 - DNA, 25 bp, Mus musculus
gataggtttgcagacacctacagtt

SEQ ID NO: 503714 - DNA, 25 bp, Mus musculus
gataggtttgccagttttccaccag

SEQ ID NO: 503715 - DNA, 25 bp, Mus musculus
gataggtttgcctgttttccaccag

SEQ ID NO: 503716 - DNA, 25 bp, Mus musculus
gataggttttcgcttgatacttcat

SEQ ID NO: 503717 - DNA, 25 bp, Mus musculus
gataggttttcggttgatacttcat

SEQ ID NO: 503718 - DNA, 25 bp, Mus musculus
gatagtaaaaggcattcaggttctg

SEQ ID NO: 503719 - DNA, 25 bp, Mus musculus
gatagtaaaagggattcaggttctg

SEQ ID NO: 503720 - DNA, 25 bp, Mus musculus
gatagtaacaggcatcccgcaaagc

SEQ ID NO: 503721 - DNA, 25 bp, Mus musculus
gatagtaacagggatcccgcaaagc

SEQ ID NO: 503722 - DNA, 25 bp, Mus musculus
gatagtaacttgaggcagctttctg

SEQ ID NO: 503723 - DNA, 25 bp, Mus musculus
gatagtaacttgtggcagctttctg

SEQ ID NO: 503724 - DNA, 25 bp, Mus musculus
gatagtaactttactctgcccagat

SEQ ID NO: 503725 - DNA, 25 bp, Mus musculus
gatagtaacttttctctgcccagat

SEQ ID NO: 503726 - DNA, 25 bp, Mus musculus
gatagtaagcatccgtatacgttcg

SEQ ID NO: 503727 - DNA, 25 bp, Mus musculus
gatagtaagcatgcgtatacgttcg

SEQ ID NO: 503728 - DNA, 25 bp, Mus musculus
gatagtaattctcctccagatgact

SEQ ID NO: 503729 - DNA, 25 bp, Mus musculus
gatagtaattctgctccagatgact

SEQ ID NO: 503730 - DNA, 25 bp, Mus musculus
gatagtaatttcagtgttcggctcc

SEQ ID NO: 503731 - DNA, 25 bp, Mus musculus
gatagtaatttctgtgttcggctcc

SEQ ID NO: 503732 - DNA, 25 bp, Mus musculus
gatagtacacagacttccaggcaag

SEQ ID NO: 503733 - DNA, 25 bp, Mus musculus
gatagtacacagtcttccaggcaag

SEQ ID NO: 503734 - DNA, 25 bp, Mus musculus
gatagtacagataccccaattagta

SEQ ID NO: 503735 - DNA, 25 bp, Mus musculus
gatagtacagattccccaattagta

SEQ ID NO: 503736 - DNA, 25 bp, Mus musculus
gatagtacagtgatgctgttgtggt

SEQ ID NO: 503737 - DNA, 25 bp, Mus musculus
gatagtacagtgttgctgttgtggt

SEQ ID NO: 503738 - DNA, 25 bp, Mus musculus
gatagtaccattccctgtgggccaa

SEQ ID NO: 503739 - DNA, 25 bp, Mus musculus
gatagtaccattgcctgtgggccaa

SEQ ID NO: 503740 - DNA, 25 bp, Mus musculus
gatagtacctttatcccagaatact

SEQ ID NO: 503741 - DNA, 25 bp, Mus musculus
gatagtacctttttcccagaatact

SEQ ID NO: 503742 - DNA, 25 bp, Mus musculus
gatagtactatcagccatggcaggt

SEQ ID NO: 503743 - DNA, 25 bp, Mus musculus
gatagtactatctgccatggcaggt

SEQ ID NO: 503744 - DNA, 25 bp, Mus musculus
gatagtactgacacctttatgccct

SEQ ID NO: 503745 - DNA, 25 bp, Mus musculus
gatagtactgactcctttatgccct

SEQ ID NO: 503746 - DNA, 25 bp, Mus musculus
gatagtacttggaacaccatttcct

SEQ ID NO: 503747 - DNA, 25 bp, Mus musculus
gatagtacttggtacaccatttcct

SEQ ID NO: 503748 - DNA, 25 bp, Mus musculus
gatagtagcctacactatgtgagac

SEQ ID NO: 503749 - DNA, 25 bp, Mus musculus
gatagtagcctagactatgtgagac

SEQ ID NO: 503750 - DNA, 25 bp, Mus musculus
gatagtagctagcaaagttcacttt

SEQ ID NO: 503751 - DNA, 25 bp, Mus musculus
gatagtagctaggaaagttcacttt

SEQ ID NO: 503752 - DNA, 25 bp, Mus musculus
gatagtatccctagaaaatcattat

SEQ ID NO: 503753 - DNA, 25 bp, Mus musculus
gatagtatcccttgaaaatcattat

SEQ ID NO: 503754 - DNA, 25 bp, Mus musculus
gatagtatctctatcctaactggtg

SEQ ID NO: 503755 - DNA, 25 bp, Mus musculus
gatagtatctctttcctaactggtg

SEQ ID NO: 503756 - DNA, 25 bp, Mus musculus
gatagtatctgcctatttagaccag

SEQ ID NO: 503757 - DNA, 25 bp, Mus musculus
gatagtatctgcgtatttagaccag

SEQ ID NO: 503758 - DNA, 25 bp, Mus musculus
gatagtatgtatagctcttccagag

SEQ ID NO: 503759 - DNA, 25 bp, Mus musculus
gatagtatgtattgctcttccagag

SEQ ID NO: 503760 - DNA, 25 bp, Mus musculus
gatagtattagcaggagccaagcaa

SEQ ID NO: 503761 - DNA, 25 bp, Mus musculus
gatagtattagctggagccaagcaa

SEQ ID NO: 503762 - DNA, 25 bp, Mus musculus
gatagtattattcctttcaaccaaa

SEQ ID NO: 503763 - DNA, 25 bp, Mus musculus
gatagtattattgctttcaaccaaa

SEQ ID NO: 503764 - DNA, 25 bp, Mus musculus
gatagtcaagggacctgttcttctc

SEQ ID NO: 503765 - DNA, 25 bp, Mus musculus
gatagtcaagggtcctgttcttctc

SEQ ID NO: 503766 - DNA, 25 bp, Mus musculus
gatagtcaccatctatactggtaga

SEQ ID NO: 503767 - DNA, 25 bp, Mus musculus
gatagtcaccatgtatactggtaga

SEQ ID NO: 503768 - DNA, 25 bp, Mus musculus
gatagtcacgtaacactttgaactg

SEQ ID NO: 503769 - DNA, 25 bp, Mus musculus
gatagtcacgtatcactttgaactg

SEQ ID NO: 503770 - DNA, 25 bp, Mus musculus
gatagtcactttactgaggtctccc

SEQ ID NO: 503771 - DNA, 25 bp, Mus musculus
gatagtcacttttctgaggtctccc

SEQ ID NO: 503772 - DNA, 25 bp, Mus musculus
gatagtcagatcatcatttcccgtg

SEQ ID NO: 503773 - DNA, 25 bp, Mus musculus
gatagtcagatcttcatttcccgtg

SEQ ID NO: 503774 - DNA, 25 bp, Mus musculus
gatagtcagctaacatcatcctggt

SEQ ID NO: 503775 - DNA, 25 bp, Mus musculus
gatagtcagctatcatcatcctggt

SEQ ID NO: 503776 - DNA, 25 bp, Mus musculus
gatagtcagggcaacgcacataaac

SEQ ID NO: 503777 - DNA, 25 bp, Mus musculus
gatagtcagggctacgcacataaac

SEQ ID NO: 503778 - DNA, 25 bp, Mus musculus
gatagtcatcaacagagcccgggta

SEQ ID NO: 503779 - DNA, 25 bp, Mus musculus
gatagtcatcaagagagcccgggta

SEQ ID NO: 503780 - DNA, 25 bp, Mus musculus
gatagtcatggcaattcatccctgt

SEQ ID NO: 503781 - DNA, 25 bp, Mus musculus
gatagtcatggctattcatccctgt

SEQ ID NO: 503782 - DNA, 25 bp, Mus musculus
gatagtcatgtaacctactggccag

SEQ ID NO: 503783 - DNA, 25 bp, Mus musculus
gatagtcatgtatcctactggccag

SEQ ID NO: 503784 - DNA, 25 bp, Mus musculus
gatagtcatttacctgtttgtccct

SEQ ID NO: 503785 - DNA, 25 bp, Mus musculus
gatagtcatttagctgtttgtccct

SEQ ID NO: 503786 - DNA, 25 bp, Mus musculus
gatagtcatttcctttcatccaaaa

SEQ ID NO: 503787 - DNA, 25 bp, Mus musculus
gatagtcatttcgtttcatccaaaa

SEQ ID NO: 503788 - DNA, 25 bp, Mus musculus
gatagtccagatcacacagccctca

SEQ ID NO: 503789 - DNA, 25 bp, Mus musculus
gatagtccagatgacacagccctca

SEQ ID NO: 503790 - DNA, 25 bp, Mus musculus
gatagtcccatacaatgtttctcgt

SEQ ID NO: 503791 - DNA, 25 bp, Mus musculus
gatagtcccatagaatgtttctcgt

SEQ ID NO: 503792 - DNA, 25 bp, Mus musculus
gatagtcccgaaatcagtctgacca

SEQ ID NO: 503793 - DNA, 25 bp, Mus musculus
gatagtcccgaattcagtctgacca

SEQ ID NO: 503794 - DNA, 25 bp, Mus musculus
gatagtccggacaagccagggtcaa

SEQ ID NO: 503795 - DNA, 25 bp, Mus musculus
gatagtccggactagccagggtcaa

SEQ ID NO: 503796 - DNA, 25 bp, Mus musculus
gatagtcctacactattcacctaga

SEQ ID NO: 503797 - DNA, 25 bp, Mus musculus
gatagtcctacagtattcacctaga

SEQ ID NO: 503798 - DNA, 25 bp, Mus musculus
gatagtcctttaaaagctggtgaca

SEQ ID NO: 503799 - DNA, 25 bp, Mus musculus
gatagtcctttataagctggtgaca

SEQ ID NO: 503800 - DNA, 25 bp, Mus musculus
gatagtctaaatccctgctctcatc

SEQ ID NO: 503801 - DNA, 25 bp, Mus musculus
gatagtctaaatgcctgctctcatc

SEQ ID NO: 503802 - DNA, 25 bp, Mus musculus
gatagtctaagaattggctgccaat

SEQ ID NO: 503803 - DNA, 25 bp, Mus musculus
gatagtctaagatttggctgccaat

SEQ ID NO: 503804 - DNA, 25 bp, Mus musculus
gatagtctcagcaggtcagcgagct

SEQ ID NO: 503805 - DNA, 25 bp, Mus musculus
gatagtctcagctggtcagcgagct

SEQ ID NO: 503806 - DNA, 25 bp, Mus musculus
gatagtctctttactgtacaccttt

SEQ ID NO: 503807 - DNA, 25 bp, Mus musculus
gatagtctcttttctgtacaccttt

SEQ ID NO: 503808 - DNA, 25 bp, Mus musculus
gatagtctgaaactgctgttggctt

SEQ ID NO: 503809 - DNA, 25 bp, Mus musculus
gatagtctgaaagtgctgttggctt

SEQ ID NO: 503810 - DNA, 25 bp, Mus musculus
gatagtctgactcttctaaataggt

SEQ ID NO: 503811 - DNA, 25 bp, Mus musculus
gatagtctgactgttctaaataggt

SEQ ID NO: 503812 - DNA, 25 bp, Mus musculus
gatagtctgatacagtccaatttag

SEQ ID NO: 503813 - DNA, 25 bp, Mus musculus
gatagtctgatagagtccaatttag

SEQ ID NO: 503814 - DNA, 25 bp, Mus musculus
gatagtctgtatatttctctgaaag

SEQ ID NO: 503815 - DNA, 25 bp, Mus musculus
gatagtctgtatttttctctgaaag

SEQ ID NO: 503816 - DNA, 25 bp, Mus musculus
gatagtcttagcctgcccctgttaa

SEQ ID NO: 503817 - DNA, 25 bp, Mus musculus
gatagtcttagcgtgcccctgttaa

SEQ ID NO: 503818 - DNA, 25 bp, Mus musculus
gatagtcttagtagtcccttgtgaa

SEQ ID NO: 503819 - DNA, 25 bp, Mus musculus
gatagtcttagttgtcccttgtgaa

SEQ ID NO: 503820 - DNA, 25 bp, Mus musculus
gatagtcttgaaaaatgtcccattc

SEQ ID NO: 503821 - DNA, 25 bp, Mus musculus
gatagtcttgaataatgtcccattc

SEQ ID NO: 503822 - DNA, 25 bp, Mus musculus
gatagtcttgtcctgtacaactgag

SEQ ID NO: 503823 - DNA, 25 bp, Mus musculus
gatagtcttgtcgtgtacaactgag

SEQ ID NO: 503824 - DNA, 25 bp, Mus musculus
gatagtcttgtgacatttgccagtt

SEQ ID NO: 503825 - DNA, 25 bp, Mus musculus
gatagtcttgtgatttttggcctat

SEQ ID NO: 503826 - DNA, 25 bp, Mus musculus
gatagtcttgtgtcatttgccagtt

SEQ ID NO: 503827 - DNA, 25 bp, Mus musculus
gatagtcttgtgttttttggcctat

SEQ ID NO: 503828 - DNA, 25 bp, Mus musculus
gatagtctttttctgtattcggttt

SEQ ID NO: 503829 - DNA, 25 bp, Mus musculus
gatagtctttttgtgtattcggttt

SEQ ID NO: 503830 - DNA, 25 bp, Mus musculus
gatagtgaacatcgccaagcattca

SEQ ID NO: 503831 - DNA, 25 bp, Mus musculus
gatagtgaacatggccaagcattca

SEQ ID NO: 503832 - DNA, 25 bp, Mus musculus
gatagtgaaccacagtagtcatcta

SEQ ID NO: 503833 - DNA, 25 bp, Mus musculus
gatagtgaaccagagtagtcatcta

SEQ ID NO: 503834 - DNA, 25 bp, Mus musculus
gatagtgaagcaactcccaaaccca

SEQ ID NO: 503835 - DNA, 25 bp, Mus musculus
gatagtgaagcatctcccaaaccca

SEQ ID NO: 503836 - DNA, 25 bp, Mus musculus
gatagtgaatccagacaggcctgca

SEQ ID NO: 503837 - DNA, 25 bp, Mus musculus
gatagtgaatcctgacaggcctgca

SEQ ID NO: 503838 - DNA, 25 bp, Mus musculus
gatagtgacaccaatagcattctgt

SEQ ID NO: 503839 - DNA, 25 bp, Mus musculus
gatagtgacacctatagcattctgt

SEQ ID NO: 503840 - DNA, 25 bp, Mus musculus
gatagtgacagaccccaagtcctcg

SEQ ID NO: 503841 - DNA, 25 bp, Mus musculus
gatagtgacagagcccaagtcctcg

SEQ ID NO: 503842 - DNA, 25 bp, Mus musculus
gatagtgacagtatagttgacttct

SEQ ID NO: 503843 - DNA, 25 bp, Mus musculus
gatagtgacagtttagttgacttct

SEQ ID NO: 503844 - DNA, 25 bp, Mus musculus
gatagtgacctgattgccgatagct

SEQ ID NO: 503845 - DNA, 25 bp, Mus musculus
gatagtgacctgtttgccgatagct

SEQ ID NO: 503846 - DNA, 25 bp, Mus musculus
gatagtgaccttcttgctaagtaca

SEQ ID NO: 503847 - DNA, 25 bp, Mus musculus
gatagtgaccttgttgctaagtaca

SEQ ID NO: 503848 - DNA, 25 bp, Mus musculus
gatagtgacttgatgttgcccagac

SEQ ID NO: 503849 - DNA, 25 bp, Mus musculus
gatagtgacttgttgttgcccagac

SEQ ID NO: 503850 - DNA, 25 bp, Mus musculus
gatagtgagctactaacattttaca

SEQ ID NO: 503851 - DNA, 25 bp, Mus musculus
gatagtgagctagtaacattttaca

SEQ ID NO: 503852 - DNA, 25 bp, Mus musculus
gatagtgatcaacggttttaaaatt

SEQ ID NO: 503853 - DNA, 25 bp, Mus musculus
gatagtgatcaagggttttaaaatt

SEQ ID NO: 503854 - DNA, 25 bp, Mus musculus
gatagtgatcgactccttctgttta

SEQ ID NO: 503855 - DNA, 25 bp, Mus musculus
gatagtgatcgagtccttctgttta

SEQ ID NO: 503856 - DNA, 25 bp, Mus musculus
gatagtgattatcgcagttcaaaaa

SEQ ID NO: 503857 - DNA, 25 bp, Mus musculus
gatagtgattatggcagttcaaaaa

SEQ ID NO: 503858 - DNA, 25 bp, Mus musculus
gatagtgcaatgatcccgactgcag

SEQ ID NO: 503859 - DNA, 25 bp, Mus musculus
gatagtgcaatgttcccgactgcag

SEQ ID NO: 503860 - DNA, 25 bp, Mus musculus
gatagtgcacacatgcacagggccc

SEQ ID NO: 503861 - DNA, 25 bp, Mus musculus
gatagtgcacacttgcacagggccc

SEQ ID NO: 503862 - DNA, 25 bp, Mus musculus
gatagtgcacagctctcagttttat

SEQ ID NO: 503863 - DNA, 25 bp, Mus musculus
gatagtgcacaggtctcagttttat

SEQ ID NO: 503864 - DNA, 25 bp, Mus musculus
gatagtgcagacagaccagccagaa

SEQ ID NO: 503865 - DNA, 25 bp, Mus musculus
gatagtgcagactgaccagccagaa

SEQ ID NO: 503866 - DNA, 25 bp, Mus musculus
gatagtgcagtaccagccattgtaa

SEQ ID NO: 503867 - DNA, 25 bp, Mus musculus
gatagtgcagtagcagccattgtaa

SEQ ID NO: 503868 - DNA, 25 bp, Mus musculus
gatagtgcatagactttgcttccaa

SEQ ID NO: 503869 - DNA, 25 bp, Mus musculus
gatagtgcatagtctttgcttccaa

SEQ ID NO: 503870 - DNA, 25 bp, Mus musculus
gatagtgccaggaattgtccgcaag

SEQ ID NO: 503871 - DNA, 25 bp, Mus musculus
gatagtgccaggtattgtccgcaag

SEQ ID NO: 503872 - DNA, 25 bp, Mus musculus
gatagtgccatccaagtcttcacac

SEQ ID NO: 503873 - DNA, 25 bp, Mus musculus
gatagtgccatcgaagtcttcacac

SEQ ID NO: 503874 - DNA, 25 bp, Mus musculus
gatagtgcctcaaggttttggaaac

SEQ ID NO: 503875 - DNA, 25 bp, Mus musculus
gatagtgcctcatggttttggaaac

SEQ ID NO: 503876 - DNA, 25 bp, Mus musculus
gatagtgctacccacagtaggctgg

SEQ ID NO: 503877 - DNA, 25 bp, Mus musculus
gatagtgctaccgacagtaggctgg

SEQ ID NO: 503878 - DNA, 25 bp, Mus musculus
gatagtgctcgtcaaatcctgcgaa

SEQ ID NO: 503879 - DNA, 25 bp, Mus musculus
gatagtgctcgtgaaatcctgcgaa

SEQ ID NO: 503880 - DNA, 25 bp, Mus musculus
gatagtgctcttacttcaagtctga

SEQ ID NO: 503881 - DNA, 25 bp, Mus musculus
gatagtgctctttcttcaagtctga

SEQ ID NO: 503882 - DNA, 25 bp, Mus musculus
gatagtggatacatcttcaagaacg

SEQ ID NO: 503883 - DNA, 25 bp, Mus musculus
gatagtggataccatgaactacatg

SEQ ID NO: 503884 - DNA, 25 bp, Mus musculus
gatagtggatacgatgaactacatg

SEQ ID NO: 503885 - DNA, 25 bp, Mus musculus
gatagtggatacttcttcaagaacg

SEQ ID NO: 503886 - DNA, 25 bp, Mus musculus
gatagtggccccatttaaaattcat

SEQ ID NO: 503887 - DNA, 25 bp, Mus musculus
gatagtggccccttttaaaattcat

SEQ ID NO: 503888 - DNA, 25 bp, Mus musculus
gatagtgggatccttcgagctctaa

SEQ ID NO: 503889 - DNA, 25 bp, Mus musculus
gatagtgggatcgttcgagctctaa

SEQ ID NO: 503890 - DNA, 25 bp, Mus musculus
gatagtgggccccttttatgacatt

SEQ ID NO: 503891 - DNA, 25 bp, Mus musculus
gatagtgggcccgttttatgacatt

SEQ ID NO: 503892 - DNA, 25 bp, Mus musculus
gatagtgggttcactgtgtgcaatt

SEQ ID NO: 503893 - DNA, 25 bp, Mus musculus
gatagtgggttctctgtgtgcaatt

SEQ ID NO: 503894 - DNA, 25 bp, Mus musculus
gatagtggtagcacatgtctttaat

SEQ ID NO: 503895 - DNA, 25 bp, Mus musculus
gatagtggtagctcatgtctttaat

SEQ ID NO: 503896 - DNA, 25 bp, Mus musculus
gatagtggtattatgttaacagaga

SEQ ID NO: 503897 - DNA, 25 bp, Mus musculus
gatagtggtattttgttaacagaga

SEQ ID NO: 503898 - DNA, 25 bp, Mus musculus
gatagtggtcacatttggttcagaa

SEQ ID NO: 503899 - DNA, 25 bp, Mus musculus
gatagtggtcacttttggttcagaa

SEQ ID NO: 503900 - DNA, 25 bp, Mus musculus
gatagtggtcctcctaacacagaca

SEQ ID NO: 503901 - DNA, 25 bp, Mus musculus
gatagtggtcctgctaacacagaca

SEQ ID NO: 503902 - DNA, 25 bp, Mus musculus
gatagtgtcactctggaattccaaa

SEQ ID NO: 503903 - DNA, 25 bp, Mus musculus
gatagtgtcactgtggaattccaaa

SEQ ID NO: 503904 - DNA, 25 bp, Mus musculus
gatagtgtcagtacaatcatggtta

SEQ ID NO: 503905 - DNA, 25 bp, Mus musculus
gatagtgtcagttcaatcatggtta

SEQ ID NO: 503906 - DNA, 25 bp, Mus musculus
gatagtgtcctcacatttggacagt

SEQ ID NO: 503907 - DNA, 25 bp, Mus musculus
gatagtgtcctctcatttggacagt

SEQ ID NO: 503908 - DNA, 25 bp, Mus musculus
gatagtgtctcaattagcctaggct

SEQ ID NO: 503909 - DNA, 25 bp, Mus musculus
gatagtgtctcacatggtccacaag

SEQ ID NO: 503910 - DNA, 25 bp, Mus musculus
gatagtgtctcaccaggtcttcgat

SEQ ID NO: 503911 - DNA, 25 bp, Mus musculus
gatagtgtctcagatggtccacaag

SEQ ID NO: 503912 - DNA, 25 bp, Mus musculus
gatagtgtctcagcaggtcttcgat

SEQ ID NO: 503913 - DNA, 25 bp, Mus musculus
gatagtgtctcatttagcctaggct

SEQ ID NO: 503914 - DNA, 25 bp, Mus musculus
gatagtgtctctctaacccatctac

SEQ ID NO: 503915 - DNA, 25 bp, Mus musculus
gatagtgtctctgtaacccatctac

SEQ ID NO: 503916 - DNA, 25 bp, Mus musculus
gatagtgtgcatatgttgagtgcct

SEQ ID NO: 503917 - DNA, 25 bp, Mus musculus
gatagtgtgcatttgttgagtgcct

SEQ ID NO: 503918 - DNA, 25 bp, Mus musculus
gatagtgtgcttcagtgacccaaaa

SEQ ID NO: 503919 - DNA, 25 bp, Mus musculus
gatagtgtgcttgagtgacccaaaa

SEQ ID NO: 503920 - DNA, 25 bp, Mus musculus
gatagtgtgtataagctgctcattc

SEQ ID NO: 503921 - DNA, 25 bp, Mus musculus
gatagtgtgtattagctgctcattc

SEQ ID NO: 503922 - DNA, 25 bp, Mus musculus
gatagtgttcctctttagcatttat

SEQ ID NO: 503923 - DNA, 25 bp, Mus musculus
gatagtgttcctgtttagcatttat

SEQ ID NO: 503924 - DNA, 25 bp, Mus musculus
gatagtgttcttccaattaatattt

SEQ ID NO: 503925 - DNA, 25 bp, Mus musculus
gatagtgttcttgcaattaatattt

SEQ ID NO: 503926 - DNA, 25 bp, Mus musculus
gatagtgtttagagacaggactcct

SEQ ID NO: 503927 - DNA, 25 bp, Mus musculus
gatagtgtttagtgacaggactcct

SEQ ID NO: 503928 - DNA, 25 bp, Mus musculus
gatagttaacgactcacactgctaa

SEQ ID NO: 503929 - DNA, 25 bp, Mus musculus
gatagttaacgagtcacactgctaa

SEQ ID NO: 503930 - DNA, 25 bp, Mus musculus
gatagttaagctcttttcatgtgtg

SEQ ID NO: 503931 - DNA, 25 bp, Mus musculus
gatagttaagctgttttcatgtgtg

SEQ ID NO: 503932 - DNA, 25 bp, Mus musculus
gatagttaccagcattctgtacagg

SEQ ID NO: 503933 - DNA, 25 bp, Mus musculus
gatagttaccaggattctgtacagg

SEQ ID NO: 503934 - DNA, 25 bp, Mus musculus
gatagttactcacaccggactttca

SEQ ID NO: 503935 - DNA, 25 bp, Mus musculus
gatagttactcagaccggactttca

SEQ ID NO: 503936 - DNA, 25 bp, Mus musculus
gatagttagaacacaggccactctg

SEQ ID NO: 503937 - DNA, 25 bp, Mus musculus
gatagttagaactcaggccactctg

SEQ ID NO: 503938 - DNA, 25 bp, Mus musculus
gatagttataacctcgatgccacga

SEQ ID NO: 503939 - DNA, 25 bp, Mus musculus
gatagttataacgtcgatgccacga

SEQ ID NO: 503940 - DNA, 25 bp, Mus musculus
gatagttcaaaaaccacatctaaat

SEQ ID NO: 503941 - DNA, 25 bp, Mus musculus
gatagttcaaaatccacatctaaat

SEQ ID NO: 503942 - DNA, 25 bp, Mus musculus
gatagttcaagaacccctgggtctg

SEQ ID NO: 503943 - DNA, 25 bp, Mus musculus
gatagttcaagatcccctgggtctg

SEQ ID NO: 503944 - DNA, 25 bp, Mus musculus
gatagttcactaccctaagatcttt

SEQ ID NO: 503945 - DNA, 25 bp, Mus musculus
gatagttcactagcctaagatcttt

SEQ ID NO: 503946 - DNA, 25 bp, Mus musculus
gatagttcatataccaatccaacat

SEQ ID NO: 503947 - DNA, 25 bp, Mus musculus
gatagttcatattccaatccaacat

SEQ ID NO: 503948 - DNA, 25 bp, Mus musculus
gatagttcatctatgtggatctgca

SEQ ID NO: 503949 - DNA, 25 bp, Mus musculus
gatagttcatctttgtggatctgca

SEQ ID NO: 503950 - DNA, 25 bp, Mus musculus
gatagttcatgcaaatgctgtgcac

SEQ ID NO: 503951 - DNA, 25 bp, Mus musculus
gatagttcatgctaatgctgtgcac

SEQ ID NO: 503952 - DNA, 25 bp, Mus musculus
gatagttcatgtctcatttggcggt

SEQ ID NO: 503953 - DNA, 25 bp, Mus musculus
gatagttcatgtgtcatttggcggt

SEQ ID NO: 503954 - DNA, 25 bp, Mus musculus
gatagttcctctagatttttctatg

SEQ ID NO: 503955 - DNA, 25 bp, Mus musculus
gatagttcctcttgatttttctatg

SEQ ID NO: 503956 - DNA, 25 bp, Mus musculus
gatagttcctgcagaattgtgaccc

SEQ ID NO: 503957 - DNA, 25 bp, Mus musculus
gatagttcctgctgaattgtgaccc

SEQ ID NO: 503958 - DNA, 25 bp, Mus musculus
gatagttctgctatataaccctggc

SEQ ID NO: 503959 - DNA, 25 bp, Mus musculus
gatagttctgctttataaccctggc

SEQ ID NO: 503960 - DNA, 25 bp, Mus musculus
gatagttctgtgcatcactgccatg

SEQ ID NO: 503961 - DNA, 25 bp, Mus musculus
gatagttctgtggatcactgccatg

SEQ ID NO: 503962 - DNA, 25 bp, Mus musculus
gatagttgcccaacacaagagctgc

SEQ ID NO: 503963 - DNA, 25 bp, Mus musculus
gatagttgcccatcacaagagctgc

SEQ ID NO: 503964 - DNA, 25 bp, Mus musculus
gatagttgctagactgactctgaca

SEQ ID NO: 503965 - DNA, 25 bp, Mus musculus
gatagttgctagtctgactctgaca

SEQ ID NO: 503966 - DNA, 25 bp, Mus musculus
gatagttgctgtcggcagccagttc

SEQ ID NO: 503967 - DNA, 25 bp, Mus musculus
gatagttgctgtgggcagccagttc

SEQ ID NO: 503968 - DNA, 25 bp, Mus musculus
gatagttggaatccacatttgatcc

SEQ ID NO: 503969 - DNA, 25 bp, Mus musculus
gatagttggaatgcacatttgatcc

SEQ ID NO: 503970 - DNA, 25 bp, Mus musculus
gatagttggcaacctccagtaagat

SEQ ID NO: 503971 - DNA, 25 bp, Mus musculus
gatagttggcaagctccagtaagat

SEQ ID NO: 503972 - DNA, 25 bp, Mus musculus
gatagttggctcctgtagcagttcc

SEQ ID NO: 503973 - DNA, 25 bp, Mus musculus
gatagttggctcgtgtagcagttcc

SEQ ID NO: 503974 - DNA, 25 bp, Mus musculus
gatagttgttgcagttgctacggct

SEQ ID NO: 503975 - DNA, 25 bp, Mus musculus
gatagttgttgctgttgctacggct

SEQ ID NO: 503976 - DNA, 25 bp, Mus musculus
gatagtttaaggacaggtggtatat

SEQ ID NO: 503977 - DNA, 25 bp, Mus musculus
gatagtttaaggtcaggtggtatat

SEQ ID NO: 503978 - DNA, 25 bp, Mus musculus
gatagtttagaccatgcacagacct

SEQ ID NO: 503979 - DNA, 25 bp, Mus musculus
gatagtttagacgatgcacagacct

SEQ ID NO: 503980 - DNA, 25 bp, Mus musculus
gatagtttagcgactttgattctta

SEQ ID NO: 503981 - DNA, 25 bp, Mus musculus
gatagtttagcgtctttgattctta

SEQ ID NO: 503982 - DNA, 25 bp, Mus musculus
gatagtttaggccaaggccctcctg

SEQ ID NO: 503983 - DNA, 25 bp, Mus musculus
gatagtttaggcgaaggccctcctg

SEQ ID NO: 503984 - DNA, 25 bp, Mus musculus
gatagtttagtcagggttgaataca

SEQ ID NO: 503985 - DNA, 25 bp, Mus musculus
gatagtttagtctgggttgaataca

SEQ ID NO: 503986 - DNA, 25 bp, Mus musculus
gatagtttatcacatggagcaggaa

SEQ ID NO: 503987 - DNA, 25 bp, Mus musculus
gatagtttatcagatggagcaggaa

SEQ ID NO: 503988 - DNA, 25 bp, Mus musculus
gatagtttcaaaaactccactagag

SEQ ID NO: 503989 - DNA, 25 bp, Mus musculus
gatagtttcaaatactccactagag

SEQ ID NO: 503990 - DNA, 25 bp, Mus musculus
gatagtttctctcccatgatacaag

SEQ ID NO: 503991 - DNA, 25 bp, Mus musculus
gatagtttctctgccatgatacaag

SEQ ID NO: 503992 - DNA, 25 bp, Mus musculus
gatagtttgacacgcaattccttga

SEQ ID NO: 503993 - DNA, 25 bp, Mus musculus
gatagtttgacaggcaattccttga

SEQ ID NO: 503994 - DNA, 25 bp, Mus musculus
gatagtttgtgtcttccccttcgtt

SEQ ID NO: 503995 - DNA, 25 bp, Mus musculus
gatagtttgtgtgttccccttcgtt

SEQ ID NO: 503996 - DNA, 25 bp, Mus musculus
gatagttttagccatgtagttttaa

SEQ ID NO: 503997 - DNA, 25 bp, Mus musculus
gatagttttagcgatgtagttttaa

SEQ ID NO: 503998 - DNA, 25 bp, Mus musculus
gatagttttcccatcaagtcaagcg

SEQ ID NO: 503999 - DNA, 25 bp, Mus musculus
gatagttttcccttcaagtcaagcg

SEQ ID NO: 504000 - DNA, 25 bp, Mus musculus
gatagttttctcagcttatccagtg

SEQ ID NO: 504001 - DNA, 25 bp, Mus musculus
gatagttttctctgcttatccagtg

SEQ ID NO: 504002 - DNA, 25 bp, Mus musculus
gatagttttgaaagcagtgctcgct

SEQ ID NO: 504003 - DNA, 25 bp, Mus musculus
gatagttttgaatgcagtgctcgct

SEQ ID NO: 504004 - DNA, 25 bp, Mus musculus
gatagttttgcgatttctccatctt

SEQ ID NO: 504005 - DNA, 25 bp, Mus musculus
gatagttttgcgttttctccatctt

SEQ ID NO: 504006 - DNA, 25 bp, Mus musculus
gatagtttttctcagatcttcgatt

SEQ ID NO: 504007 - DNA, 25 bp, Mus musculus
gatagtttttctgagatcttcgatt

SEQ ID NO: 504008 - DNA, 25 bp, Mus musculus
gatataaaaatcatgttgctctgac

SEQ ID NO: 504009 - DNA, 25 bp, Mus musculus
gatataaaaatcttgttgctctgac

SEQ ID NO: 504010 - DNA, 25 bp, Mus musculus
gatataaacagcagtcaccacccgc

SEQ ID NO: 504011 - DNA, 25 bp, Mus musculus
gatataaacagctgtcaccacccgc

SEQ ID NO: 504012 - DNA, 25 bp, Mus musculus
gatataaaccacatgcatcatgtgt

SEQ ID NO: 504013 - DNA, 25 bp, Mus musculus
gatataaaccacttgcatcatgtgt

SEQ ID NO: 504014 - DNA, 25 bp, Mus musculus
gatataaatagtatcctggtcaaaa

SEQ ID NO: 504015 - DNA, 25 bp, Mus musculus
gatataaatagtttcctggtcaaaa

SEQ ID NO: 504016 - DNA, 25 bp, Mus musculus
gatataacacccatcttcaggaaat

SEQ ID NO: 504017 - DNA, 25 bp, Mus musculus
gatataacacccttcttcaggaaat

SEQ ID NO: 504018 - DNA, 25 bp, Mus musculus
gatataacagatagcgcgtccacgc

SEQ ID NO: 504019 - DNA, 25 bp, Mus musculus
gatataacagattgcgcgtccacgc

SEQ ID NO: 504020 - DNA, 25 bp, Mus musculus
gatataacatgcctacattcctgaa

SEQ ID NO: 504021 - DNA, 25 bp, Mus musculus
gatataacatgcgtacattcctgaa

SEQ ID NO: 504022 - DNA, 25 bp, Mus musculus
gatataaccacaccagtagctgttg

SEQ ID NO: 504023 - DNA, 25 bp, Mus musculus
gatataaccacagcagtagctgttg

SEQ ID NO: 504024 - DNA, 25 bp, Mus musculus
gatataaccacgcattggcatatgt

SEQ ID NO: 504025 - DNA, 25 bp, Mus musculus
gatataaccacggattggcatatgt

SEQ ID NO: 504026 - DNA, 25 bp, Mus musculus
gatataaccagtaacctgaccactt

SEQ ID NO: 504027 - DNA, 25 bp, Mus musculus
gatataaccagttacctgaccactt

SEQ ID NO: 504028 - DNA, 25 bp, Mus musculus
gatataaccatcatgcaagtgttgc

SEQ ID NO: 504029 - DNA, 25 bp, Mus musculus
gatataaccatcttgcaagtgttgc

SEQ ID NO: 504030 - DNA, 25 bp, Mus musculus
gatataaccatgacagagcgagaga

SEQ ID NO: 504031 - DNA, 25 bp, Mus musculus
gatataaccatgtcagagcgagaga

SEQ ID NO: 504032 - DNA, 25 bp, Mus musculus
gatataacccaaaattcaccagctg

SEQ ID NO: 504033 - DNA, 25 bp, Mus musculus
gatataacccaatattcaccagctg

SEQ ID NO: 504034 - DNA, 25 bp, Mus musculus
gatataactaaaaactgtctgtact

SEQ ID NO: 504035 - DNA, 25 bp, Mus musculus
gatataactaaatactgtctgtact

SEQ ID NO: 504036 - DNA, 25 bp, Mus musculus
gatataactcttacctgtttgtctt

SEQ ID NO: 504037 - DNA, 25 bp, Mus musculus
gatataactctttcctgtttgtctt

SEQ ID NO: 504038 - DNA, 25 bp, Mus musculus
gatataactgcacacacgcccaagg

SEQ ID NO: 504039 - DNA, 25 bp, Mus musculus
gatataactgcagacacgcccaagg

SEQ ID NO: 504040 - DNA, 25 bp, Mus musculus
gatataactgtcattgcaccttctt

SEQ ID NO: 504041 - DNA, 25 bp, Mus musculus
gatataactgtctttgcaccttctt

SEQ ID NO: 504042 - DNA, 25 bp, Mus musculus
gatataagctctagctgcaccgtct

SEQ ID NO: 504043 - DNA, 25 bp, Mus musculus
gatataagctcttgctgcaccgtct

SEQ ID NO: 504044 - DNA, 25 bp, Mus musculus
gatataatcaacaacaccctaacat

SEQ ID NO: 504045 - DNA, 25 bp, Mus musculus
gatataatcaactacaccctaacat

SEQ ID NO: 504046 - DNA, 25 bp, Mus musculus
gatataatcatcaccaaagccacag

SEQ ID NO: 504047 - DNA, 25 bp, Mus musculus
gatataatcatctccaaagccacag

SEQ ID NO: 504048 - DNA, 25 bp, Mus musculus
gatataatccacatgctggctggca

SEQ ID NO: 504049 - DNA, 25 bp, Mus musculus
gatataatccacttgctggctggca

SEQ ID NO: 504050 - DNA, 25 bp, Mus musculus
gatataatgatcaacccctgtcaat

SEQ ID NO: 504051 - DNA, 25 bp, Mus musculus
gatataatgatctacccctgtcaat

SEQ ID NO: 504052 - DNA, 25 bp, Mus musculus
gatataattgccagttatgtcttga

SEQ ID NO: 504053 - DNA, 25 bp, Mus musculus
gatataattgcctgttatgtcttga

SEQ ID NO: 504054 - DNA, 25 bp, Mus musculus
gatataatttgtctccattcagctc

SEQ ID NO: 504055 - DNA, 25 bp, Mus musculus
gatataatttgtgtccattcagctc

SEQ ID NO: 504056 - DNA, 25 bp, Mus musculus
gatatacaaggtatacaatggtggt

SEQ ID NO: 504057 - DNA, 25 bp, Mus musculus
gatatacaaggtttacaatggtggt

SEQ ID NO: 504058 - DNA, 25 bp, Mus musculus
gatatacaccacagtctccaaccta

SEQ ID NO: 504059 - DNA, 25 bp, Mus musculus
gatatacaccactgtctccaaccta

SEQ ID NO: 504060 - DNA, 25 bp, Mus musculus
gatatacaccatacagcagggcttt

SEQ ID NO: 504061 - DNA, 25 bp, Mus musculus
gatatacaccattcagcagggcttt

SEQ ID NO: 504062 - DNA, 25 bp, Mus musculus
gatatacatatcagtagtcccagca

SEQ ID NO: 504063 - DNA, 25 bp, Mus musculus
gatatacatatctgtagtcccagca

SEQ ID NO: 504064 - DNA, 25 bp, Mus musculus
gatatacatctgctcattaaagttt

SEQ ID NO: 504065 - DNA, 25 bp, Mus musculus
gatatacatctggtcattaaagttt

SEQ ID NO: 504066 - DNA, 25 bp, Mus musculus
gatatacatttaagcagaacaccaa

SEQ ID NO: 504067 - DNA, 25 bp, Mus musculus
gatatacatttatgcagaacaccaa

SEQ ID NO: 504068 - DNA, 25 bp, Mus musculus
gatataccaactcacctggaccatc

SEQ ID NO: 504069 - DNA, 25 bp, Mus musculus
gatataccaactgacctggaccatc

SEQ ID NO: 504070 - DNA, 25 bp, Mus musculus
gatataccagataccgccgagtttg

SEQ ID NO: 504071 - DNA, 25 bp, Mus musculus
gatataccagattccgccgagtttg

SEQ ID NO: 504072 - DNA, 25 bp, Mus musculus
gatatacccacactgttaaataatg

SEQ ID NO: 504073 - DNA, 25 bp, Mus musculus
gatatacccacagtgttaaataatg

SEQ ID NO: 504074 - DNA, 25 bp, Mus musculus
gatataccccaaacattaggaagtg

SEQ ID NO: 504075 - DNA, 25 bp, Mus musculus
gatataccccaatcattaggaagtg

SEQ ID NO: 504076 - DNA, 25 bp, Mus musculus
gatataccgatacttccctggcttt

SEQ ID NO: 504077 - DNA, 25 bp, Mus musculus
gatataccgatagttccctggcttt

SEQ ID NO: 504078 - DNA, 25 bp, Mus musculus
gatatacctagccagaaatagatgt

SEQ ID NO: 504079 - DNA, 25 bp, Mus musculus
gatatacctagcgagaaatagatgt

SEQ ID NO: 504080 - DNA, 25 bp, Mus musculus
gatatacctgcacaatggctctgtc

SEQ ID NO: 504081 - DNA, 25 bp, Mus musculus
gatatacctgcagaatggctctgtc

SEQ ID NO: 504082 - DNA, 25 bp, Mus musculus
gatataccttaaacttccctgtcac

SEQ ID NO: 504083 - DNA, 25 bp, Mus musculus
gatataccttaatcttccctgtcac

SEQ ID NO: 504084 - DNA, 25 bp, Mus musculus
gatatacgtactaccattgcatttt

SEQ ID NO: 504085 - DNA, 25 bp, Mus musculus
gatatacgtacttccattgcatttt

SEQ ID NO: 504086 - DNA, 25 bp, Mus musculus
gatatacgtgccattaacagataaa

SEQ ID NO: 504087 - DNA, 25 bp, Mus musculus
gatatacgtgcctttaacagataaa

SEQ ID NO: 504088 - DNA, 25 bp, Mus musculus
gatatacgtgtaagcccgtgtgtgt

SEQ ID NO: 504089 - DNA, 25 bp, Mus musculus
gatatacgtgtatgcccgtgtgtgt

SEQ ID NO: 504090 - DNA, 25 bp, Mus musculus
gatatactaaccagtgaccatcatt

SEQ ID NO: 504091 - DNA, 25 bp, Mus musculus
gatatactaacctgtgaccatcatt

SEQ ID NO: 504092 - DNA, 25 bp, Mus musculus
gatatactacctcagttttattaag

SEQ ID NO: 504093 - DNA, 25 bp, Mus musculus
gatatactacctgagttttattaag

SEQ ID NO: 504094 - DNA, 25 bp, Mus musculus
gatatactagagattgcctagcatg

SEQ ID NO: 504095 - DNA, 25 bp, Mus musculus
gatatactagagtttgcctagcatg

SEQ ID NO: 504096 - DNA, 25 bp, Mus musculus
gatatactatcacattctgctttta

SEQ ID NO: 504097 - DNA, 25 bp, Mus musculus
gatatactatcagattctgctttta

SEQ ID NO: 504098 - DNA, 25 bp, Mus musculus
gatatactcacacctccagagaggg

SEQ ID NO: 504099 - DNA, 25 bp, Mus musculus
gatatactcacagctccagagaggg

SEQ ID NO: 504100 - DNA, 25 bp, Mus musculus
gatatactcggtatctgactggcat

SEQ ID NO: 504101 - DNA, 25 bp, Mus musculus
gatatactcggtttctgactggcat

SEQ ID NO: 504102 - DNA, 25 bp, Mus musculus
gatatacttcatacattttctgttg

SEQ ID NO: 504103 - DNA, 25 bp, Mus musculus
gatatacttcatctgcttgtaagcc

SEQ ID NO: 504104 - DNA, 25 bp, Mus musculus
gatatacttcatgtgcttgtaagcc

SEQ ID NO: 504105 - DNA, 25 bp, Mus musculus
gatatacttcattcattttctgttg

SEQ ID NO: 504106 - DNA, 25 bp, Mus musculus
gatatacttctaaatgccacccgga

SEQ ID NO: 504107 - DNA, 25 bp, Mus musculus
gatatacttctatatgccacccgga

SEQ ID NO: 504108 - DNA, 25 bp, Mus musculus
gatatactttgcctcaggaaacctt

SEQ ID NO: 504109 - DNA, 25 bp, Mus musculus
gatatactttgcgtcaggaaacctt

SEQ ID NO: 504110 - DNA, 25 bp, Mus musculus
gatatagaatagctcacccctgatt

SEQ ID NO: 504111 - DNA, 25 bp, Mus musculus
gatatagaataggtcacccctgatt

SEQ ID NO: 504112 - DNA, 25 bp, Mus musculus
gatatagaatgcatcccaagagggc

SEQ ID NO: 504113 - DNA, 25 bp, Mus musculus
gatatagaatgcttcccaagagggc

SEQ ID NO: 504114 - DNA, 25 bp, Mus musculus
gatatagacactaacaagaactttc

SEQ ID NO: 504115 - DNA, 25 bp, Mus musculus
gatatagacacttacaagaactttc

SEQ ID NO: 504116 - DNA, 25 bp, Mus musculus
gatatagaccagagagtccctccac

SEQ ID NO: 504117 - DNA, 25 bp, Mus musculus
gatatagaccagtgagtccctccac

SEQ ID NO: 504118 - DNA, 25 bp, Mus musculus
gatatagagacgaagctcgaaatat

SEQ ID NO: 504119 - DNA, 25 bp, Mus musculus
gatatagagacgtagctcgaaatat

SEQ ID NO: 504120 - DNA, 25 bp, Mus musculus
gatatagataatatggcccacactg

SEQ ID NO: 504121 - DNA, 25 bp, Mus musculus
gatatagataatttggcccacactg

SEQ ID NO: 504122 - DNA, 25 bp, Mus musculus
gatatagatgaactgcctactgctt

SEQ ID NO: 504123 - DNA, 25 bp, Mus musculus
gatatagatgaagtgcctactgctt

SEQ ID NO: 504124 - DNA, 25 bp, Mus musculus
gatatagattgcctgtcataagaca

SEQ ID NO: 504125 - DNA, 25 bp, Mus musculus
gatatagattgcgtgtcataagaca

SEQ ID NO: 504126 - DNA, 25 bp, Mus musculus
gatatagcaatgaggtggccccagc

SEQ ID NO: 504127 - DNA, 25 bp, Mus musculus
gatatagcaatgtggtggccccagc

SEQ ID NO: 504128 - DNA, 25 bp, Mus musculus
gatatagcattgatcacacacagtt

SEQ ID NO: 504129 - DNA, 25 bp, Mus musculus
gatatagcattgttcacacacagtt

SEQ ID NO: 504130 - DNA, 25 bp, Mus musculus
gatatagcccaaaattgggccatag

SEQ ID NO: 504131 - DNA, 25 bp, Mus musculus
gatatagcccaatattgggccatag

SEQ ID NO: 504132 - DNA, 25 bp, Mus musculus
gatatagccctgcaatcatgccaca

SEQ ID NO: 504133 - DNA, 25 bp, Mus musculus
gatatagccctggaatcatgccaca

SEQ ID NO: 504134 - DNA, 25 bp, Mus musculus
gatatagcctcaaagcttcactggg

SEQ ID NO: 504135 - DNA, 25 bp, Mus musculus
gatatagcctcatagcttcactggg

SEQ ID NO: 504136 - DNA, 25 bp, Mus musculus
gatatagcgggtatactctcgttac

SEQ ID NO: 504137 - DNA, 25 bp, Mus musculus
gatatagcgggtttactctcgttac

SEQ ID NO: 504138 - DNA, 25 bp, Mus musculus
gatatagctcttctcatgtcttgat

SEQ ID NO: 504139 - DNA, 25 bp, Mus musculus
gatatagctcttgtcatgtcttgat

SEQ ID NO: 504140 - DNA, 25 bp, Mus musculus
gatatagctgagactcctccatctt

SEQ ID NO: 504141 - DNA, 25 bp, Mus musculus
gatatagctgagtctcctccatctt

SEQ ID NO: 504142 - DNA, 25 bp, Mus musculus
gatatagctgtcagcatcactgtat

SEQ ID NO: 504143 - DNA, 25 bp, Mus musculus
gatatagctgtctgcatcactgtat

SEQ ID NO: 504144 - DNA, 25 bp, Mus musculus
gatatagcttctatcagcctcagga

SEQ ID NO: 504145 - DNA, 25 bp, Mus musculus
gatatagcttctttcagcctcagga

SEQ ID NO: 504146 - DNA, 25 bp, Mus musculus
gatataggccatctgacttagaaga

SEQ ID NO: 504147 - DNA, 25 bp, Mus musculus
gatataggccatgtgacttagaaga

SEQ ID NO: 504148 - DNA, 25 bp, Mus musculus
gatataggcccaccttatcagagtc

SEQ ID NO: 504149 - DNA, 25 bp, Mus musculus
gatataggcccagcttatcagagtc

SEQ ID NO: 504150 - DNA, 25 bp, Mus musculus
gatataggctctactagaacataag

SEQ ID NO: 504151 - DNA, 25 bp, Mus musculus
gatataggctcttctagaacataag

SEQ ID NO: 504152 - DNA, 25 bp, Mus musculus
gatatagggctgaacattttctctc

SEQ ID NO: 504153 - DNA, 25 bp, Mus musculus
gatatagggctgtacattttctctc

SEQ ID NO: 504154 - DNA, 25 bp, Mus musculus
gatatagggcttagcatacttggaa

SEQ ID NO: 504155 - DNA, 25 bp, Mus musculus
gatatagggctttgcatacttggaa

SEQ ID NO: 504156 - DNA, 25 bp, Mus musculus
gatataggtatccaatcagattctt

SEQ ID NO: 504157 - DNA, 25 bp, Mus musculus
gatataggtatcgaatcagattctt

SEQ ID NO: 504158 - DNA, 25 bp, Mus musculus
gatatagtccaacttattatgtatt

SEQ ID NO: 504159 - DNA, 25 bp, Mus musculus
gatatagtccaagttattatgtatt

SEQ ID NO: 504160 - DNA, 25 bp, Mus musculus
gatatagtccatccaagtgggcaag

SEQ ID NO: 504161 - DNA, 25 bp, Mus musculus
gatatagtccatgcaagtgggcaag

SEQ ID NO: 504162 - DNA, 25 bp, Mus musculus
gatatagtcctgaactgtgaatatt

SEQ ID NO: 504163 - DNA, 25 bp, Mus musculus
gatatagtcctgtactgtgaatatt

SEQ ID NO: 504164 - DNA, 25 bp, Mus musculus
gatatagtgtagctagcacccatga

SEQ ID NO: 504165 - DNA, 25 bp, Mus musculus
gatatagtgtaggtagcacccatga

SEQ ID NO: 504166 - DNA, 25 bp, Mus musculus
gatatagtgtctactgtgcggcggc

SEQ ID NO: 504167 - DNA, 25 bp, Mus musculus
gatatagtgtcttctgtgcggcggc

SEQ ID NO: 504168 - DNA, 25 bp, Mus musculus
gatatagttctaccacccttagcat

SEQ ID NO: 504169 - DNA, 25 bp, Mus musculus
gatatagttctagcacccttagcat

SEQ ID NO: 504170 - DNA, 25 bp, Mus musculus
gatatagttctccagacccttttgg

SEQ ID NO: 504171 - DNA, 25 bp, Mus musculus
gatatagttctcgagacccttttgg

SEQ ID NO: 504172 - DNA, 25 bp, Mus musculus
gatatagtttgtaccattgtggcaa

SEQ ID NO: 504173 - DNA, 25 bp, Mus musculus
gatatagtttgttccattgtggcaa

SEQ ID NO: 504174 - DNA, 25 bp, Mus musculus
gatatatacgtgaaatcccagaact

SEQ ID NO: 504175 - DNA, 25 bp, Mus musculus
gatatatacgtgtaatcccagaact

SEQ ID NO: 504176 - DNA, 25 bp, Mus musculus
gatatatatccaagtttccgaagta

SEQ ID NO: 504177 - DNA, 25 bp, Mus musculus
gatatatatccatgtttccgaagta

SEQ ID NO: 504178 - DNA, 25 bp, Mus musculus
gatatatattagaagctgcccatgg

SEQ ID NO: 504179 - DNA, 25 bp, Mus musculus
gatatatattagtagctgcccatgg

SEQ ID NO: 504180 - DNA, 25 bp, Mus musculus
gatatatcaaagagcacagtttgct

SEQ ID NO: 504181 - DNA, 25 bp, Mus musculus
gatatatcaaagtgcacagtttgct

SEQ ID NO: 504182 - DNA, 25 bp, Mus musculus
gatatatcactcagtcttttatttg

SEQ ID NO: 504183 - DNA, 25 bp, Mus musculus
gatatatcactctgtcttttatttg

SEQ ID NO: 504184 - DNA, 25 bp, Mus musculus
gatatatccagcatatttggctttt

SEQ ID NO: 504185 - DNA, 25 bp, Mus musculus
gatatatccagcttatttggctttt

SEQ ID NO: 504186 - DNA, 25 bp, Mus musculus
gatatatccttcaataacccaagct

SEQ ID NO: 504187 - DNA, 25 bp, Mus musculus
gatatatccttctataacccaagct

SEQ ID NO: 504188 - DNA, 25 bp, Mus musculus
gatatatcgaggctctacacgcctg

SEQ ID NO: 504189 - DNA, 25 bp, Mus musculus
gatatatcgagggtctacacgcctg

SEQ ID NO: 504190 - DNA, 25 bp, Mus musculus
gatatatcttggaccacaacacgcg

SEQ ID NO: 504191 - DNA, 25 bp, Mus musculus
gatatatcttggtccacaacacgcg

SEQ ID NO: 504192 - DNA, 25 bp, Mus musculus
gatatatgcatgcttcccccaggtg

SEQ ID NO: 504193 - DNA, 25 bp, Mus musculus
gatatatgcatggttcccccaggtg

SEQ ID NO: 504194 - DNA, 25 bp, Mus musculus
gatatatgctcaaccctgattggac

SEQ ID NO: 504195 - DNA, 25 bp, Mus musculus
gatatatgctcatccctgattggac

SEQ ID NO: 504196 - DNA, 25 bp, Mus musculus
gatatatgcttaattctgtcttagt

SEQ ID NO: 504197 - DNA, 25 bp, Mus musculus
gatatatgcttatttctgtcttagt

SEQ ID NO: 504198 - DNA, 25 bp, Mus musculus
gatatatggtggactcatagagccc

SEQ ID NO: 504199 - DNA, 25 bp, Mus musculus
gatatatggtggtctcatagagccc

SEQ ID NO: 504200 - DNA, 25 bp, Mus musculus
gatatatgtatacccttagctgtga

SEQ ID NO: 504201 - DNA, 25 bp, Mus musculus
gatatatgtatagccttagctgtga

SEQ ID NO: 504202 - DNA, 25 bp, Mus musculus
gatatatgtcttagatagatcagca

SEQ ID NO: 504203 - DNA, 25 bp, Mus musculus
gatatatgtctttgatagatcagca

SEQ ID NO: 504204 - DNA, 25 bp, Mus musculus
gatatatgtgccactcatgctggtt

SEQ ID NO: 504205 - DNA, 25 bp, Mus musculus
gatatatgtgcctctcatgctggtt

SEQ ID NO: 504206 - DNA, 25 bp, Mus musculus
gatatatgttttcctaactattagc

SEQ ID NO: 504207 - DNA, 25 bp, Mus musculus
gatatatgttttgctaactattagc

SEQ ID NO: 504208 - DNA, 25 bp, Mus musculus
gatatattaatgatcctctgagtag

SEQ ID NO: 504209 - DNA, 25 bp, Mus musculus
gatatattaatgttcctctgagtag

SEQ ID NO: 504210 - DNA, 25 bp, Mus musculus
gatatattcaaaactcttagcagct

SEQ ID NO: 504211 - DNA, 25 bp, Mus musculus
gatatattcaaatctcttagcagct

SEQ ID NO: 504212 - DNA, 25 bp, Mus musculus
gatatattccaaacatcagaagcta

SEQ ID NO: 504213 - DNA, 25 bp, Mus musculus
gatatattccaatcatcagaagcta

SEQ ID NO: 504214 - DNA, 25 bp, Mus musculus
gatatattcctgatgtcctttgtcg

SEQ ID NO: 504215 - DNA, 25 bp, Mus musculus
gatatattcctgttgtcctttgtcg

SEQ ID NO: 504216 - DNA, 25 bp, Mus musculus
gatatattctccactacactgtcaa

SEQ ID NO: 504217 - DNA, 25 bp, Mus musculus
gatatattctcctctacactgtcaa

SEQ ID NO: 504218 - DNA, 25 bp, Mus musculus
gatatattgggaaccctgatatgcc

SEQ ID NO: 504219 - DNA, 25 bp, Mus musculus
gatatattgggatccctgatatgcc

SEQ ID NO: 504220 - DNA, 25 bp, Mus musculus
gatatatttcatacccatctcaggg

SEQ ID NO: 504221 - DNA, 25 bp, Mus musculus
gatatatttcattcccatctcaggg

SEQ ID NO: 504222 - DNA, 25 bp, Mus musculus
gatatatttgatccaagacagtcca

SEQ ID NO: 504223 - DNA, 25 bp, Mus musculus
gatatatttgatgcaagacagtcca

SEQ ID NO: 504224 - DNA, 25 bp, Mus musculus
gatatatttgtccttcaactctagt

SEQ ID NO: 504225 - DNA, 25 bp, Mus musculus
gatatatttgtcgttcaactctagt

SEQ ID NO: 504226 - DNA, 25 bp, Mus musculus
gatatattttatctccttactctgt

SEQ ID NO: 504227 - DNA, 25 bp, Mus musculus
gatatattttatgtccttactctgt

SEQ ID NO: 504228 - DNA, 25 bp, Mus musculus
gatatattttccactattagtcttt

SEQ ID NO: 504229 - DNA, 25 bp, Mus musculus
gatatattttcctctattagtcttt

SEQ ID NO: 504230 - DNA, 25 bp, Mus musculus
gatatcaaatgaagtcctgaaccag

SEQ ID NO: 504231 - DNA, 25 bp, Mus musculus
gatatcaaatgatgtcctgaaccag

SEQ ID NO: 504232 - DNA, 25 bp, Mus musculus
gatatcaaccgtcttaataagccca

SEQ ID NO: 504233 - DNA, 25 bp, Mus musculus
gatatcaaccgtgttaataagccca

SEQ ID NO: 504234 - DNA, 25 bp, Mus musculus
gatatcaacgccatcgtatttgaga

SEQ ID NO: 504235 - DNA, 25 bp, Mus musculus
gatatcaacgccttcgtatttgaga

SEQ ID NO: 504236 - DNA, 25 bp, Mus musculus
gatatcaaggtgatttgtttcgcac

SEQ ID NO: 504237 - DNA, 25 bp, Mus musculus
gatatcaaggtgttttgtttcgcac

SEQ ID NO: 504238 - DNA, 25 bp, Mus musculus
gatatcaatagtctgcctttagaaa

SEQ ID NO: 504239 - DNA, 25 bp, Mus musculus
gatatcaatagtgtgcctttagaaa

SEQ ID NO: 504240 - DNA, 25 bp, Mus musculus
gatatcaatttccactgacactatt

SEQ ID NO: 504241 - DNA, 25 bp, Mus musculus
gatatcaatttcgactgacactatt

SEQ ID NO: 504242 - DNA, 25 bp, Mus musculus
gatatcacactgctcggtactagac

SEQ ID NO: 504243 - DNA, 25 bp, Mus musculus
gatatcacactggtcggtactagac

SEQ ID NO: 504244 - DNA, 25 bp, Mus musculus
gatatcacagagcaccttgccaaga

SEQ ID NO: 504245 - DNA, 25 bp, Mus musculus
gatatcacagaggaccttgccaaga

SEQ ID NO: 504246 - DNA, 25 bp, Mus musculus
gatatcacatgcatctattcccagg

SEQ ID NO: 504247 - DNA, 25 bp, Mus musculus
gatatcacatgcttctattcccagg

SEQ ID NO: 504248 - DNA, 25 bp, Mus musculus
gatatcaccaggagttaggccaccc

SEQ ID NO: 504249 - DNA, 25 bp, Mus musculus
gatatcaccaggtgttaggccaccc

SEQ ID NO: 504250 - DNA, 25 bp, Mus musculus
gatatcacggtcatctgtccctggg

SEQ ID NO: 504251 - DNA, 25 bp, Mus musculus
gatatcacggtcttctgtccctggg

SEQ ID NO: 504252 - DNA, 25 bp, Mus musculus
gatatcactagactgcctgtttatg

SEQ ID NO: 504253 - DNA, 25 bp, Mus musculus
gatatcactagagtgcctgtttatg

SEQ ID NO: 504254 - DNA, 25 bp, Mus musculus
gatatcactatcaacctgttgcaag

SEQ ID NO: 504255 - DNA, 25 bp, Mus musculus
gatatcactatctacctgttgcaag

SEQ ID NO: 504256 - DNA, 25 bp, Mus musculus
gatatcactgttacttgtgtctctt

SEQ ID NO: 504257 - DNA, 25 bp, Mus musculus
gatatcactgtttcttgtgtctctt

SEQ ID NO: 504258 - DNA, 25 bp, Mus musculus
gatatcagataccagtgtagtgcat

SEQ ID NO: 504259 - DNA, 25 bp, Mus musculus
gatatcagatacgagtgtagtgcat

SEQ ID NO: 504260 - DNA, 25 bp, Mus musculus
gatatcagcatccagttccttgtca

SEQ ID NO: 504261 - DNA, 25 bp, Mus musculus
gatatcagcatcgagttccttgtca

SEQ ID NO: 504262 - DNA, 25 bp, Mus musculus
gatatcagcattcggctgacgctga

SEQ ID NO: 504263 - DNA, 25 bp, Mus musculus
gatatcagcattgggctgacgctga

SEQ ID NO: 504264 - DNA, 25 bp, Mus musculus
gatatcagccttaaccttcgaggaa

SEQ ID NO: 504265 - DNA, 25 bp, Mus musculus
gatatcagcctttaccttcgaggaa

SEQ ID NO: 504266 - DNA, 25 bp, Mus musculus
gatatcagctataacttttgcctgt

SEQ ID NO: 504267 - DNA, 25 bp, Mus musculus
gatatcagctattacttttgcctgt

SEQ ID NO: 504268 - DNA, 25 bp, Mus musculus
gatatcaggcaaacggtttcctttt

SEQ ID NO: 504269 - DNA, 25 bp, Mus musculus
gatatcaggcaatcggtttcctttt

SEQ ID NO: 504270 - DNA, 25 bp, Mus musculus
gatatcagggttcagttttggtttt

SEQ ID NO: 504271 - DNA, 25 bp, Mus musculus
gatatcagggttgagttttggtttt

SEQ ID NO: 504272 - DNA, 25 bp, Mus musculus
gatatcaggtaaacaggctacagca

SEQ ID NO: 504273 - DNA, 25 bp, Mus musculus
gatatcaggtaatcaggctacagca

SEQ ID NO: 504274 - DNA, 25 bp, Mus musculus
gatatcagtaaaatattgctgctta

SEQ ID NO: 504275 - DNA, 25 bp, Mus musculus
gatatcagtaaattattgctgctta

SEQ ID NO: 504276 - DNA, 25 bp, Mus musculus
gatatcagtataatgctggcttcat

SEQ ID NO: 504277 - DNA, 25 bp, Mus musculus
gatatcagtatattgctggcttcat

SEQ ID NO: 504278 - DNA, 25 bp, Mus musculus
gatatcagtcctagcagatgttgca

SEQ ID NO: 504279 - DNA, 25 bp, Mus musculus
gatatcagtccttgcagatgttgca

SEQ ID NO: 504280 - DNA, 25 bp, Mus musculus
gatatcagtgttcatggttaccatg

SEQ ID NO: 504281 - DNA, 25 bp, Mus musculus
gatatcagtgttgatggttaccatg

SEQ ID NO: 504282 - DNA, 25 bp, Mus musculus
gatatcagttctcggcaagcacact

SEQ ID NO: 504283 - DNA, 25 bp, Mus musculus
gatatcagttctgggcaagcacact

SEQ ID NO: 504284 - DNA, 25 bp, Mus musculus
gatatcatcaagctgtctttgttct

SEQ ID NO: 504285 - DNA, 25 bp, Mus musculus
gatatcatcaaggtgtctttgttct

SEQ ID NO: 504286 - DNA, 25 bp, Mus musculus
gatatcatcaatctttccttaaaga

SEQ ID NO: 504287 - DNA, 25 bp, Mus musculus
gatatcatcaatgtttccttaaaga

SEQ ID NO: 504288 - DNA, 25 bp, Mus musculus
gatatcatcgatactttttatcaag

SEQ ID NO: 504289 - DNA, 25 bp, Mus musculus
gatatcatcgattctttttatcaag

SEQ ID NO: 504290 - DNA, 25 bp, Mus musculus
gatatcatctcaaaaagcgcttttc

SEQ ID NO: 504291 - DNA, 25 bp, Mus musculus
gatatcatctcataaagcgcttttc

SEQ ID NO: 504292 - DNA, 25 bp, Mus musculus
gatatcatgagaccgtatttcacaa

SEQ ID NO: 504293 - DNA, 25 bp, Mus musculus
gatatcatgagagcgtatttcacaa

SEQ ID NO: 504294 - DNA, 25 bp, Mus musculus
gatatcatgaggcttcctggaatta

SEQ ID NO: 504295 - DNA, 25 bp, Mus musculus
gatatcatgagggttcctggaatta

SEQ ID NO: 504296 - DNA, 25 bp, Mus musculus
gatatcatgcttcgtacttggaatt

SEQ ID NO: 504297 - DNA, 25 bp, Mus musculus
gatatcatgcttggtacttggaatt

SEQ ID NO: 504298 - DNA, 25 bp, Mus musculus
gatatcatggacctatttctactca

SEQ ID NO: 504299 - DNA, 25 bp, Mus musculus
gatatcatggacgtatttctactca

SEQ ID NO: 504300 - DNA, 25 bp, Mus musculus
gatatcatggtgcactttatttgca

SEQ ID NO: 504301 - DNA, 25 bp, Mus musculus
gatatcatggtggactttatttgca

SEQ ID NO: 504302 - DNA, 25 bp, Mus musculus
gatatcatgtacacaggcacgcttg

SEQ ID NO: 504303 - DNA, 25 bp, Mus musculus
gatatcatgtacacggcacgccttg

SEQ ID NO: 504304 - DNA, 25 bp, Mus musculus
gatatcatgtactcaggcacgcttg

SEQ ID NO: 504305 - DNA, 25 bp, Mus musculus
gatatcatgtactcggcacgccttg

SEQ ID NO: 504306 - DNA, 25 bp, Mus musculus
gatatcatgtctcggctgcaggctc

SEQ ID NO: 504307 - DNA, 25 bp, Mus musculus
gatatcatgtctgggctgcaggctc

SEQ ID NO: 504308 - DNA, 25 bp, Mus musculus
gatatcattcacaccaattttcttg

SEQ ID NO: 504309 - DNA, 25 bp, Mus musculus
gatatcattcactccaattttcttg

SEQ ID NO: 504310 - DNA, 25 bp, Mus musculus
gatatcattccaactcatgaaaatt

SEQ ID NO: 504311 - DNA, 25 bp, Mus musculus
gatatcattccatctcatgaaaatt

SEQ ID NO: 504312 - DNA, 25 bp, Mus musculus
gatatcattggtactgactagactg

SEQ ID NO: 504313 - DNA, 25 bp, Mus musculus
gatatcattggttctgactagactg

SEQ ID NO: 504314 - DNA, 25 bp, Mus musculus
gatatccaaattattctttcagcta

SEQ ID NO: 504315 - DNA, 25 bp, Mus musculus
gatatccaaatttttctttcagcta

SEQ ID NO: 504316 - DNA, 25 bp, Mus musculus
gatatccaagaaccaatggccacgg

SEQ ID NO: 504317 - DNA, 25 bp, Mus musculus
gatatccaagaagcaatggccacgg

SEQ ID NO: 504318 - DNA, 25 bp, Mus musculus
gatatccaagatagtccctacgcca

SEQ ID NO: 504319 - DNA, 25 bp, Mus musculus
gatatccaagattgtccctacgcca

SEQ ID NO: 504320 - DNA, 25 bp, Mus musculus
gatatccaagtcagtcagccgagaa

SEQ ID NO: 504321 - DNA, 25 bp, Mus musculus
gatatccaagtctgtcagccgagaa

SEQ ID NO: 504322 - DNA, 25 bp, Mus musculus
gatatccaatctaccattcaaagct

SEQ ID NO: 504323 - DNA, 25 bp, Mus musculus
gatatccaatcttccattcaaagct

SEQ ID NO: 504324 - DNA, 25 bp, Mus musculus
gatatccactacatagcccacggaa

SEQ ID NO: 504325 - DNA, 25 bp, Mus musculus
gatatccactacttagcccacggaa

SEQ ID NO: 504326 - DNA, 25 bp, Mus musculus
gatatccagagacagagcccaggcc

SEQ ID NO: 504327 - DNA, 25 bp, Mus musculus
gatatccagagagagagcccaggcc

SEQ ID NO: 504328 - DNA, 25 bp, Mus musculus
gatatccaggaactaaatgggagca

SEQ ID NO: 504329 - DNA, 25 bp, Mus musculus
gatatccaggaagtaaatgggagca

SEQ ID NO: 504330 - DNA, 25 bp, Mus musculus
gatatccagtttaagatcgcccttt

SEQ ID NO: 504331 - DNA, 25 bp, Mus musculus
gatatccagttttagatcgcccttt

SEQ ID NO: 504332 - DNA, 25 bp, Mus musculus
gatatccatactaaatgccagcctc

SEQ ID NO: 504333 - DNA, 25 bp, Mus musculus
gatatccatacttaatgccagcctc

SEQ ID NO: 504334 - DNA, 25 bp, Mus musculus
gatatccatccgagaactgagctgc

SEQ ID NO: 504335 - DNA, 25 bp, Mus musculus
gatatccatccgtgaactgagctgc

SEQ ID NO: 504336 - DNA, 25 bp, Mus musculus
gatatccatgacaaattcgctgaat

SEQ ID NO: 504337 - DNA, 25 bp, Mus musculus
gatatccatgactaattcgctgaat

SEQ ID NO: 504338 - DNA, 25 bp, Mus musculus
gatatccatgccagttttacagaaa

SEQ ID NO: 504339 - DNA, 25 bp, Mus musculus
gatatccatgcctgttttacagaaa

SEQ ID NO: 504340 - DNA, 25 bp, Mus musculus
gatatccattctcttttcacagtgt

SEQ ID NO: 504341 - DNA, 25 bp, Mus musculus
gatatccattctgttttcacagtgt

SEQ ID NO: 504342 - DNA, 25 bp, Mus musculus
gatatcccaggactcagagcgtata

SEQ ID NO: 504343 - DNA, 25 bp, Mus musculus
gatatcccaggagtcagagcgtata

SEQ ID NO: 504344 - DNA, 25 bp, Mus musculus
gatatcccaggcaattcctgtgtct

SEQ ID NO: 504345 - DNA, 25 bp, Mus musculus
gatatcccaggctattcctgtgtct

SEQ ID NO: 504346 - DNA, 25 bp, Mus musculus
gatatcccagtgacctatggcaaaa

SEQ ID NO: 504347 - DNA, 25 bp, Mus musculus
gatatcccagtgtcctatggcaaaa

SEQ ID NO: 504348 - DNA, 25 bp, Mus musculus
gatatcccattcatgtaatttcagc

SEQ ID NO: 504349 - DNA, 25 bp, Mus musculus
gatatcccattcttgtaatttcagc

SEQ ID NO: 504350 - DNA, 25 bp, Mus musculus
gatatccccaggcacacgaagatgg

SEQ ID NO: 504351 - DNA, 25 bp, Mus musculus
gatatccccagggacacgaagatgg

SEQ ID NO: 504352 - DNA, 25 bp, Mus musculus
gatatccccgacagatggatgcaga

SEQ ID NO: 504353 - DNA, 25 bp, Mus musculus
gatatccccgactgatggatgcaga

SEQ ID NO: 504354 - DNA, 25 bp, Mus musculus
gatatcccttagagtgaccattaaa

SEQ ID NO: 504355 - DNA, 25 bp, Mus musculus
gatatcccttagtgtgaccattaaa

SEQ ID NO: 504356 - DNA, 25 bp, Mus musculus
gatatccgaaaaacagggagtccct

SEQ ID NO: 504357 - DNA, 25 bp, Mus musculus
gatatccgaaaatcagggagtccct

SEQ ID NO: 504358 - DNA, 25 bp, Mus musculus
gatatccggcgccaagtgcccgcaa

SEQ ID NO: 504359 - DNA, 25 bp, Mus musculus
gatatccggcgcgaagtgcccgcaa

SEQ ID NO: 504360 - DNA, 25 bp, Mus musculus
gatatccgtgtgcattcaaaaccaa

SEQ ID NO: 504361 - DNA, 25 bp, Mus musculus
gatatccgtgtggattcaaaaccaa

SEQ ID NO: 504362 - DNA, 25 bp, Mus musculus
gatatcctaaaaccagttgtccaga

SEQ ID NO: 504363 - DNA, 25 bp, Mus musculus
gatatcctaaaagcagttgtccaga

SEQ ID NO: 504364 - DNA, 25 bp, Mus musculus
gatatcctagagcttgtatcagcca

SEQ ID NO: 504365 - DNA, 25 bp, Mus musculus
gatatcctagaggttgtatcagcca

SEQ ID NO: 504366 - DNA, 25 bp, Mus musculus
gatatcctaggacagcagatccctt

SEQ ID NO: 504367 - DNA, 25 bp, Mus musculus
gatatcctaggagagcagatccctt

SEQ ID NO: 504368 - DNA, 25 bp, Mus musculus
gatatcctatggctaagcctgcctg

SEQ ID NO: 504369 - DNA, 25 bp, Mus musculus
gatatcctatgggtaagcctgcctg

SEQ ID NO: 504370 - DNA, 25 bp, Mus musculus
gatatcctccaaagaaggtgtgtga

SEQ ID NO: 504371 - DNA, 25 bp, Mus musculus
gatatcctccaatgaaggtgtgtga

SEQ ID NO: 504372 - DNA, 25 bp, Mus musculus
gatatcctcctcattctagtgaact

SEQ ID NO: 504373 - DNA, 25 bp, Mus musculus
gatatcctcctctttctagtgaact

SEQ ID NO: 504374 - DNA, 25 bp, Mus musculus
gatatcctctgaaacataagaagtt

SEQ ID NO: 504375 - DNA, 25 bp, Mus musculus
gatatcctctgatacataagaagtt

SEQ ID NO: 504376 - DNA, 25 bp, Mus musculus
gatatcctgaagatatgaaatgtct

SEQ ID NO: 504377 - DNA, 25 bp, Mus musculus
gatatcctgaagttatgaaatgtct

SEQ ID NO: 504378 - DNA, 25 bp, Mus musculus
gatatcctgagtagtgtggtcttta

SEQ ID NO: 504379 - DNA, 25 bp, Mus musculus
gatatcctgagttgtgtggtcttta

SEQ ID NO: 504380 - DNA, 25 bp, Mus musculus
gatatcctggatcttaagtctataa

SEQ ID NO: 504381 - DNA, 25 bp, Mus musculus
gatatcctggatgttaagtctataa

SEQ ID NO: 504382 - DNA, 25 bp, Mus musculus
gatatcctgggaactgtagttacat

SEQ ID NO: 504383 - DNA, 25 bp, Mus musculus
gatatcctgggatctgtagttacat

SEQ ID NO: 504384 - DNA, 25 bp, Mus musculus
gatatcctgtatcgatccagccctg

SEQ ID NO: 504385 - DNA, 25 bp, Mus musculus
gatatcctgtatggatccagccctg

SEQ ID NO: 504386 - DNA, 25 bp, Mus musculus
gatatcctgtcaagctgacctggag

SEQ ID NO: 504387 - DNA, 25 bp, Mus musculus
gatatcctgtcatgctgacctggag

SEQ ID NO: 504388 - DNA, 25 bp, Mus musculus
gatatcctgtgacaaaaccctgcta

SEQ ID NO: 504389 - DNA, 25 bp, Mus musculus
gatatcctgtgagaaaaccctgcta

SEQ ID NO: 504390 - DNA, 25 bp, Mus musculus
gatatccttattatcatttcattcc

SEQ ID NO: 504391 - DNA, 25 bp, Mus musculus
gatatccttattttcatttcattcc

SEQ ID NO: 504392 - DNA, 25 bp, Mus musculus
gatatccttgagatctgtattctag

SEQ ID NO: 504393 - DNA, 25 bp, Mus musculus
gatatccttgagttctgtattctag

SEQ ID NO: 504394 - DNA, 25 bp, Mus musculus
gatatccttgcaccagtttgttggt

SEQ ID NO: 504395 - DNA, 25 bp, Mus musculus
gatatccttgcagcagtttgttggt

SEQ ID NO: 504396 - DNA, 25 bp, Mus musculus
gatatccttgctctgttagaactta

SEQ ID NO: 504397 - DNA, 25 bp, Mus musculus
gatatccttgctgtgttagaactta

SEQ ID NO: 504398 - DNA, 25 bp, Mus musculus
gatatcctttctagtaaatagtgtg

SEQ ID NO: 504399 - DNA, 25 bp, Mus musculus
gatatcctttcttgtaaatagtgtg

SEQ ID NO: 504400 - DNA, 25 bp, Mus musculus
gatatcgaatcccagaccgaaatcg

SEQ ID NO: 504401 - DNA, 25 bp, Mus musculus
gatatcgaatccgagaccgaaatcg

SEQ ID NO: 504402 - DNA, 25 bp, Mus musculus
gatatcgactccacagcttaattgg

SEQ ID NO: 504403 - DNA, 25 bp, Mus musculus
gatatcgactcctcagcttaattgg

SEQ ID NO: 504404 - DNA, 25 bp, Mus musculus
gatatcgagccaaaatacatgtgag

SEQ ID NO: 504405 - DNA, 25 bp, Mus musculus
gatatcgagccataatacatgtgag

SEQ ID NO: 504406 - DNA, 25 bp, Mus musculus
gatatcgaggttatgaaattccaga

SEQ ID NO: 504407 - DNA, 25 bp, Mus musculus
gatatcgaggttttgaaattccaga

SEQ ID NO: 504408 - DNA, 25 bp, Mus musculus
gatatcgattcgctaattcactgta

SEQ ID NO: 504409 - DNA, 25 bp, Mus musculus
gatatcgattcggtaattcactgta

SEQ ID NO: 504410 - DNA, 25 bp, Mus musculus
gatatcgcatggctacttccggttc

SEQ ID NO: 504411 - DNA, 25 bp, Mus musculus
gatatcgcatgggtacttccggttc

SEQ ID NO: 504412 - DNA, 25 bp, Mus musculus
gatatcgccagtattccaatcaaga

SEQ ID NO: 504413 - DNA, 25 bp, Mus musculus
gatatcgccagttttccaatcaaga

SEQ ID NO: 504414 - DNA, 25 bp, Mus musculus
gatatcgctctgcagattcacttca

SEQ ID NO: 504415 - DNA, 25 bp, Mus musculus
gatatcgctctggagattcacttca

SEQ ID NO: 504416 - DNA, 25 bp, Mus musculus
gatatcgcttcacatgccttcgcta

SEQ ID NO: 504417 - DNA, 25 bp, Mus musculus
gatatcgcttcagatgccttcgcta

SEQ ID NO: 504418 - DNA, 25 bp, Mus musculus
gatatcggataaaacccagttcact

SEQ ID NO: 504419 - DNA, 25 bp, Mus musculus
gatatcggataatacccagttcact

SEQ ID NO: 504420 - DNA, 25 bp, Mus musculus
gatatctaaagaatgctgcttgcaa

SEQ ID NO: 504421 - DNA, 25 bp, Mus musculus
gatatctaaagattgctgcttgcaa

SEQ ID NO: 504422 - DNA, 25 bp, Mus musculus
gatatctaagaacttctattctcca

SEQ ID NO: 504423 - DNA, 25 bp, Mus musculus
gatatctaagaagttctattctcca

SEQ ID NO: 504424 - DNA, 25 bp, Mus musculus
gatatctaattgactagcagttagg

SEQ ID NO: 504425 - DNA, 25 bp, Mus musculus
gatatctaattgtctagcagttagg

SEQ ID NO: 504426 - DNA, 25 bp, Mus musculus
gatatctacaggctatcacacctcc

SEQ ID NO: 504427 - DNA, 25 bp, Mus musculus
gatatctacagggtatcacacctcc

SEQ ID NO: 504428 - DNA, 25 bp, Mus musculus
gatatctaccacaaatcctcaggtt

SEQ ID NO: 504429 - DNA, 25 bp, Mus musculus
gatatctaccactaatcctcaggtt

SEQ ID NO: 504430 - DNA, 25 bp, Mus musculus
gatatctaccttcacttccccaaaa

SEQ ID NO: 504431 - DNA, 25 bp, Mus musculus
gatatctaccttgacttccccaaaa

SEQ ID NO: 504432 - DNA, 25 bp, Mus musculus
gatatctagagtaaatgttcctgtc

SEQ ID NO: 504433 - DNA, 25 bp, Mus musculus
gatatctagagttaatgttcctgtc

SEQ ID NO: 504434 - DNA, 25 bp, Mus musculus
gatatctattggcacatgtcaagac

SEQ ID NO: 504435 - DNA, 25 bp, Mus musculus
gatatctattgggacatgtcaagac

SEQ ID NO: 504436 - DNA, 25 bp, Mus musculus
gatatctcaagcagttaggtcccca

SEQ ID NO: 504437 - DNA, 25 bp, Mus musculus
gatatctcaagctgttaggtcccca

SEQ ID NO: 504438 - DNA, 25 bp, Mus musculus
gatatctcaatcagcagccattctt

SEQ ID NO: 504439 - DNA, 25 bp, Mus musculus
gatatctcaatctgcagccattctt

SEQ ID NO: 504440 - DNA, 25 bp, Mus musculus
gatatctcatggacatattttttat

SEQ ID NO: 504441 - DNA, 25 bp, Mus musculus
gatatctcatggatcttgcatgtct

SEQ ID NO: 504442 - DNA, 25 bp, Mus musculus
gatatctcatggtcatattttttat

SEQ ID NO: 504443 - DNA, 25 bp, Mus musculus
gatatctcatggttcttgcatgtct

SEQ ID NO: 504444 - DNA, 25 bp, Mus musculus
gatatctccctaaacattttcctga

SEQ ID NO: 504445 - DNA, 25 bp, Mus musculus
gatatctccctatacattttcctga

SEQ ID NO: 504446 - DNA, 25 bp, Mus musculus
gatatctctatgattggccagtttg

SEQ ID NO: 504447 - DNA, 25 bp, Mus musculus
gatatctctatgtttggccagtttg

SEQ ID NO: 504448 - DNA, 25 bp, Mus musculus
gatatctctgtgaagtgtgtttgtt

SEQ ID NO: 504449 - DNA, 25 bp, Mus musculus
gatatctctgtgcataaactttggt

SEQ ID NO: 504450 - DNA, 25 bp, Mus musculus
gatatctctgtggataaactttggt

SEQ ID NO: 504451 - DNA, 25 bp, Mus musculus
gatatctctgtgtagtgtgtttgtt

SEQ ID NO: 504452 - DNA, 25 bp, Mus musculus
gatatctctgttagcagttgactgt

SEQ ID NO: 504453 - DNA, 25 bp, Mus musculus
gatatctctgttatcagcacccatg

SEQ ID NO: 504454 - DNA, 25 bp, Mus musculus
gatatctctgtttgcagttgactgt

SEQ ID NO: 504455 - DNA, 25 bp, Mus musculus
gatatctctgttttcagcacccatg

SEQ ID NO: 504456 - DNA, 25 bp, Mus musculus
gatatctgaccactggatgcctcac

SEQ ID NO: 504457 - DNA, 25 bp, Mus musculus
gatatctgaccagtggatgcctcac

SEQ ID NO: 504458 - DNA, 25 bp, Mus musculus
gatatctgacctattgatccagcag

SEQ ID NO: 504459 - DNA, 25 bp, Mus musculus
gatatctgaccttttgatccagcag

SEQ ID NO: 504460 - DNA, 25 bp, Mus musculus
gatatctgcaccatgattcaggttt

SEQ ID NO: 504461 - DNA, 25 bp, Mus musculus
gatatctgcaccttgattcaggttt

SEQ ID NO: 504462 - DNA, 25 bp, Mus musculus
gatatctgcagcaccacacttttgg

SEQ ID NO: 504463 - DNA, 25 bp, Mus musculus
gatatctgcagctccacacttttgg

SEQ ID NO: 504464 - DNA, 25 bp, Mus musculus
gatatctgccaaccttcatgccaag

SEQ ID NO: 504465 - DNA, 25 bp, Mus musculus
gatatctgccaagcttcatgccaag

SEQ ID NO: 504466 - DNA, 25 bp, Mus musculus
gatatctgcctgaatgcaccatgaa

SEQ ID NO: 504467 - DNA, 25 bp, Mus musculus
gatatctgcctgtatgcaccatgaa

SEQ ID NO: 504468 - DNA, 25 bp, Mus musculus
gatatctgccttatctgtaaccagt

SEQ ID NO: 504469 - DNA, 25 bp, Mus musculus
gatatctgccttttctgtaaccagt

SEQ ID NO: 504470 - DNA, 25 bp, Mus musculus
gatatctgctcgcaatgactgcgat

SEQ ID NO: 504471 - DNA, 25 bp, Mus musculus
gatatctgctcggaatgactgcgat

SEQ ID NO: 504472 - DNA, 25 bp, Mus musculus
gatatctggacacggcggtgtccca

SEQ ID NO: 504473 - DNA, 25 bp, Mus musculus
gatatctggacagggcggtgtccca

SEQ ID NO: 504474 - DNA, 25 bp, Mus musculus
gatatctgggtcactttgggacatc

SEQ ID NO: 504475 - DNA, 25 bp, Mus musculus
gatatctgggtctctttgggacatc

SEQ ID NO: 504476 - DNA, 25 bp, Mus musculus
gatatctgtaacatactgtatgctt

SEQ ID NO: 504477 - DNA, 25 bp, Mus musculus
gatatctgtaacttactgtatgctt

SEQ ID NO: 504478 - DNA, 25 bp, Mus musculus
gatatctgtcaaaactcctttatat

SEQ ID NO: 504479 - DNA, 25 bp, Mus musculus
gatatctgtcaatactcctttatat

SEQ ID NO: 504480 - DNA, 25 bp, Mus musculus
gatatctgtcaccaaatcccttaag

SEQ ID NO: 504481 - DNA, 25 bp, Mus musculus
gatatctgtcacgaaatcccttaag

SEQ ID NO: 504482 - DNA, 25 bp, Mus musculus
gatatctgtccgatcaattcacttg

SEQ ID NO: 504483 - DNA, 25 bp, Mus musculus
gatatctgtccgttcaattcacttg

SEQ ID NO: 504484 - DNA, 25 bp, Mus musculus
gatatctgtgtaatacctcagtcat

SEQ ID NO: 504485 - DNA, 25 bp, Mus musculus
gatatctgtgtattacctcagtcat

SEQ ID NO: 504486 - DNA, 25 bp, Mus musculus
gatatctgttgcctagtgtgacttt

SEQ ID NO: 504487 - DNA, 25 bp, Mus musculus
gatatctgttgcgtagtgtgacttt

SEQ ID NO: 504488 - DNA, 25 bp, Mus musculus
gatatctgtttcaatattagggaac

SEQ ID NO: 504489 - DNA, 25 bp, Mus musculus
gatatctgtttctatattagggaac

SEQ ID NO: 504490 - DNA, 25 bp, Mus musculus
gatatcttaaaaccccttgctctta

SEQ ID NO: 504491 - DNA, 25 bp, Mus musculus
gatatcttaaaagcccttgctctta

SEQ ID NO: 504492 - DNA, 25 bp, Mus musculus
gatatcttaccaattactgatactt

SEQ ID NO: 504493 - DNA, 25 bp, Mus musculus
gatatcttaccatttactgatactt

SEQ ID NO: 504494 - DNA, 25 bp, Mus musculus
gatatcttatggctgagggtttttt

SEQ ID NO: 504495 - DNA, 25 bp, Mus musculus
gatatcttatgggtgagggtttttt

SEQ ID NO: 504496 - DNA, 25 bp, Mus musculus
gatatcttcaaacaaattccgaaag

SEQ ID NO: 504497 - DNA, 25 bp, Mus musculus
gatatcttcaaagaaattccgaaag

SEQ ID NO: 504498 - DNA, 25 bp, Mus musculus
gatatcttcaggctctgcactgtga

SEQ ID NO: 504499 - DNA, 25 bp, Mus musculus
gatatcttcagggtctgcactgtga

SEQ ID NO: 504500 - DNA, 25 bp, Mus musculus
gatatcttcataatggtggcaccac

SEQ ID NO: 504501 - DNA, 25 bp, Mus musculus
gatatcttcataccaatgtctccta

SEQ ID NO: 504502 - DNA, 25 bp, Mus musculus
gatatcttcatagcaatgtctccta

SEQ ID NO: 504503 - DNA, 25 bp, Mus musculus
gatatcttcatattggtggcaccac

SEQ ID NO: 504504 - DNA, 25 bp, Mus musculus
gatatcttccatatactgtgtgtat

SEQ ID NO: 504505 - DNA, 25 bp, Mus musculus
gatatcttccatttactgtgtgtat

SEQ ID NO: 504506 - DNA, 25 bp, Mus musculus
gatatcttccggaatagcagcatgg

SEQ ID NO: 504507 - DNA, 25 bp, Mus musculus
gatatcttccggtatagcagcatgg

SEQ ID NO: 504508 - DNA, 25 bp, Mus musculus
gatatcttcggtcttgactttcgca

SEQ ID NO: 504509 - DNA, 25 bp, Mus musculus
gatatcttcggtgttgactttcgca

SEQ ID NO: 504510 - DNA, 25 bp, Mus musculus
gatatcttgatactcagtcctacat

SEQ ID NO: 504511 - DNA, 25 bp, Mus musculus
gatatcttgatagtcagtcctacat

SEQ ID NO: 504512 - DNA, 25 bp, Mus musculus
gatatcttgcaaagtgtccccattt

SEQ ID NO: 504513 - DNA, 25 bp, Mus musculus
gatatcttgcaatgtgtccccattt

SEQ ID NO: 504514 - DNA, 25 bp, Mus musculus
gatatcttgcccatgtttgccaaag

SEQ ID NO: 504515 - DNA, 25 bp, Mus musculus
gatatcttgcccttgtttgccaaag

SEQ ID NO: 504516 - DNA, 25 bp, Mus musculus
gatatcttggctaatggctgcccca

SEQ ID NO: 504517 - DNA, 25 bp, Mus musculus
gatatcttggcttatggctgcccca

SEQ ID NO: 504518 - DNA, 25 bp, Mus musculus
gatatcttgggcactaacccagagc

SEQ ID NO: 504519 - DNA, 25 bp, Mus musculus
gatatcttgggctctaacccagagc

SEQ ID NO: 504520 - DNA, 25 bp, Mus musculus
gatatctttctcctttgctgtgtac

SEQ ID NO: 504521 - DNA, 25 bp, Mus musculus
gatatctttctcgtttgctgtgtac

SEQ ID NO: 504522 - DNA, 25 bp, Mus musculus
gatatctttgaactgtaaaacctgg

SEQ ID NO: 504523 - DNA, 25 bp, Mus musculus
gatatctttgaagtgtaaaacctgg

SEQ ID NO: 504524 - DNA, 25 bp, Mus musculus
gatatctttggtacttactggtttt

SEQ ID NO: 504525 - DNA, 25 bp, Mus musculus
gatatctttggttcttactggtttt

SEQ ID NO: 504526 - DNA, 25 bp, Mus musculus
gatatcttttgacttaccaggcaca

SEQ ID NO: 504527 - DNA, 25 bp, Mus musculus
gatatcttttgagttaccaggcaca

SEQ ID NO: 504528 - DNA, 25 bp, Mus musculus
gatatgaaacccagagacccaaatg

SEQ ID NO: 504529 - DNA, 25 bp, Mus musculus
gatatgaaaccctgagacccaaatg

SEQ ID NO: 504530 - DNA, 25 bp, Mus musculus
gatatgaaatccaaaacatgttcac

SEQ ID NO: 504531 - DNA, 25 bp, Mus musculus
gatatgaaatcctaaacatgttcac

SEQ ID NO: 504532 - DNA, 25 bp, Mus musculus
gatatgaaccatcagccgcaagccc

SEQ ID NO: 504533 - DNA, 25 bp, Mus musculus
gatatgaaccatgagccgcaagccc

SEQ ID NO: 504534 - DNA, 25 bp, Mus musculus
gatatgaagcacatagtctcattaa

SEQ ID NO: 504535 - DNA, 25 bp, Mus musculus
gatatgaagcacttagtctcattaa

SEQ ID NO: 504536 - DNA, 25 bp, Mus musculus
gatatgaaggatatcagcccctgaa

SEQ ID NO: 504537 - DNA, 25 bp, Mus musculus
gatatgaaggatttcagcccctgaa

SEQ ID NO: 504538 - DNA, 25 bp, Mus musculus
gatatgaattgtctcccacagcagc

SEQ ID NO: 504539 - DNA, 25 bp, Mus musculus
gatatgaattgtgtcccacagcagc

SEQ ID NO: 504540 - DNA, 25 bp, Mus musculus
gatatgaatttgacttcctggatat

SEQ ID NO: 504541 - DNA, 25 bp, Mus musculus
gatatgaatttgtcttcctggatat

SEQ ID NO: 504542 - DNA, 25 bp, Mus musculus
gatatgaccaaaccctttaggctct

SEQ ID NO: 504543 - DNA, 25 bp, Mus musculus
gatatgaccaaagcctttaggctct

SEQ ID NO: 504544 - DNA, 25 bp, Mus musculus
gatatgaccagacgcatcctaagat

SEQ ID NO: 504545 - DNA, 25 bp, Mus musculus
gatatgaccagaggcatcctaagat

SEQ ID NO: 504546 - DNA, 25 bp, Mus musculus
gatatgaccattagcatgtcctgca

SEQ ID NO: 504547 - DNA, 25 bp, Mus musculus
gatatgaccatttgcatgtcctgca

SEQ ID NO: 504548 - DNA, 25 bp, Mus musculus
gatatgacccaccaactcaggagat

SEQ ID NO: 504549 - DNA, 25 bp, Mus musculus
gatatgacccacgaactcaggagat

SEQ ID NO: 504550 - DNA, 25 bp, Mus musculus
gatatgacccagctcagcgcacaga

SEQ ID NO: 504551 - DNA, 25 bp, Mus musculus
gatatgacccaggtcagcgcacaga

SEQ ID NO: 504552 - DNA, 25 bp, Mus musculus
gatatgacccatagaaggcctcaga

SEQ ID NO: 504553 - DNA, 25 bp, Mus musculus
gatatgacccattgaaggcctcaga

SEQ ID NO: 504554 - DNA, 25 bp, Mus musculus
gatatgaccccaattacctataaag

SEQ ID NO: 504555 - DNA, 25 bp, Mus musculus
gatatgaccccatttacctataaag

SEQ ID NO: 504556 - DNA, 25 bp, Mus musculus
gatatgacccgacatccttttgcaa

SEQ ID NO: 504557 - DNA, 25 bp, Mus musculus
gatatgacccgagatccttttgcaa

SEQ ID NO: 504558 - DNA, 25 bp, Mus musculus
gatatgactgcccaattttaaagtt

SEQ ID NO: 504559 - DNA, 25 bp, Mus musculus
gatatgactgccgaattttaaagtt

SEQ ID NO: 504560 - DNA, 25 bp, Mus musculus
gatatgagaccgcatctttctacat

SEQ ID NO: 504561 - DNA, 25 bp, Mus musculus
gatatgagaccggatctttctacat

SEQ ID NO: 504562 - DNA, 25 bp, Mus musculus
gatatgagagcactggaccccagct

SEQ ID NO: 504563 - DNA, 25 bp, Mus musculus
gatatgagagcagtggaccccagct

SEQ ID NO: 504564 - DNA, 25 bp, Mus musculus
gatatgagaggaagtttccagaaac

SEQ ID NO: 504565 - DNA, 25 bp, Mus musculus
gatatgagaggatgtttccagaaac

SEQ ID NO: 504566 - DNA, 25 bp, Mus musculus
gatatgagatccatgctctgctgca

SEQ ID NO: 504567 - DNA, 25 bp, Mus musculus
gatatgagatccttgctctgctgca

SEQ ID NO: 504568 - DNA, 25 bp, Mus musculus
gatatgagcatgatctggaggcatt

SEQ ID NO: 504569 - DNA, 25 bp, Mus musculus
gatatgagcatgttctggaggcatt

SEQ ID NO: 504570 - DNA, 25 bp, Mus musculus
gatatgagcggtattttgaaatgga

SEQ ID NO: 504571 - DNA, 25 bp, Mus musculus
gatatgagcggttttttgaaatgga

SEQ ID NO: 504572 - DNA, 25 bp, Mus musculus
gatatgagctgaacccgtggcttgt

SEQ ID NO: 504573 - DNA, 25 bp, Mus musculus
gatatgagctgatcccgtggcttgt

SEQ ID NO: 504574 - DNA, 25 bp, Mus musculus
gatatgagctttaggcagtggccct

SEQ ID NO: 504575 - DNA, 25 bp, Mus musculus
gatatgagcttttggcagtggccct

SEQ ID NO: 504576 - DNA, 25 bp, Mus musculus
gatatgaggcctatacaaaggtttt

SEQ ID NO: 504577 - DNA, 25 bp, Mus musculus
gatatgaggcctttacaaaggtttt

SEQ ID NO: 504578 - DNA, 25 bp, Mus musculus
gatatgagtgttcctgagccaccgc

SEQ ID NO: 504579 - DNA, 25 bp, Mus musculus
gatatgagtgttgctgagccaccgc

SEQ ID NO: 504580 - DNA, 25 bp, Mus musculus
gatatgatacaaacctgtagttcca

SEQ ID NO: 504581 - DNA, 25 bp, Mus musculus
gatatgatacaatcctgtagttcca

SEQ ID NO: 504582 - DNA, 25 bp, Mus musculus
gatatgatacacattcctaacctag

SEQ ID NO: 504583 - DNA, 25 bp, Mus musculus
gatatgatacactttcctaacctag

SEQ ID NO: 504584 - DNA, 25 bp, Mus musculus
gatatgatactcatccagttttaca

SEQ ID NO: 504585 - DNA, 25 bp, Mus musculus
gatatgatactcttccagttttaca

SEQ ID NO: 504586 - DNA, 25 bp, Mus musculus
gatatgatagacctactacttaacc

SEQ ID NO: 504587 - DNA, 25 bp, Mus musculus
gatatgatagacgtactacttaacc

SEQ ID NO: 504588 - DNA, 25 bp, Mus musculus
gatatgatcactaggcttttctggg

SEQ ID NO: 504589 - DNA, 25 bp, Mus musculus
gatatgatcacttggcttttctggg

SEQ ID NO: 504590 - DNA, 25 bp, Mus musculus
gatatgatcatcaggatcctgctga

SEQ ID NO: 504591 - DNA, 25 bp, Mus musculus
gatatgatcatctggatcctgctga

SEQ ID NO: 504592 - DNA, 25 bp, Mus musculus
gatatgatcttcatttctaggtgga

SEQ ID NO: 504593 - DNA, 25 bp, Mus musculus
gatatgatcttcttttctaggtgga

SEQ ID NO: 504594 - DNA, 25 bp, Mus musculus
gatatgatgcatcttgctttctaag

SEQ ID NO: 504595 - DNA, 25 bp, Mus musculus
gatatgatgcatgttgctttctaag

SEQ ID NO: 504596 - DNA, 25 bp, Mus musculus
gatatgatggcccacatccgtaaat

SEQ ID NO: 504597 - DNA, 25 bp, Mus musculus
gatatgatggccgacatccgtaaat

SEQ ID NO: 504598 - DNA, 25 bp, Mus musculus
gatatgatgggcatttccacactct

SEQ ID NO: 504599 - DNA, 25 bp, Mus musculus
gatatgatgggcttttccacactct

SEQ ID NO: 504600 - DNA, 25 bp, Mus musculus
gatatgattattatacctgaaagtt

SEQ ID NO: 504601 - DNA, 25 bp, Mus musculus
gatatgattattttacctgaaagtt

SEQ ID NO: 504602 - DNA, 25 bp, Mus musculus
gatatgattcggacctacatcctac

SEQ ID NO: 504603 - DNA, 25 bp, Mus musculus
gatatgattcggtcctacatcctac

SEQ ID NO: 504604 - DNA, 25 bp, Mus musculus
gatatgattgctactgatgttcagt

SEQ ID NO: 504605 - DNA, 25 bp, Mus musculus
gatatgattgctctattacaccaaa

SEQ ID NO: 504606 - DNA, 25 bp, Mus musculus
gatatgattgctgtattacaccaaa

SEQ ID NO: 504607 - DNA, 25 bp, Mus musculus
gatatgattgcttctgatgttcagt

SEQ ID NO: 504608 - DNA, 25 bp, Mus musculus
gatatgattgtgacccagagccaaa

SEQ ID NO: 504609 - DNA, 25 bp, Mus musculus
gatatgattgtgtcccagagccaaa

SEQ ID NO: 504610 - DNA, 25 bp, Mus musculus
gatatgcaaattacctgccagcagt

SEQ ID NO: 504611 - DNA, 25 bp, Mus musculus
gatatgcaaatttcctgccagcagt

SEQ ID NO: 504612 - DNA, 25 bp, Mus musculus
gatatgcaacaccatgttcaggttg

SEQ ID NO: 504613 - DNA, 25 bp, Mus musculus
gatatgcaacacgatgttcaggttg

SEQ ID NO: 504614 - DNA, 25 bp, Mus musculus
gatatgcaatgcctatactgagctg

SEQ ID NO: 504615 - DNA, 25 bp, Mus musculus
gatatgcaatgcgtatactgagctg

SEQ ID NO: 504616 - DNA, 25 bp, Mus musculus
gatatgcaccgaccgaattttcgac

SEQ ID NO: 504617 - DNA, 25 bp, Mus musculus
gatatgcaccgagcgaattttcgac

SEQ ID NO: 504618 - DNA, 25 bp, Mus musculus
gatatgcacctaattacaatgttca

SEQ ID NO: 504619 - DNA, 25 bp, Mus musculus
gatatgcacctatttacaatgttca

SEQ ID NO: 504620 - DNA, 25 bp, Mus musculus
gatatgcacctgctccatttggaga

SEQ ID NO: 504621 - DNA, 25 bp, Mus musculus
gatatgcacctggtccatttggaga

SEQ ID NO: 504622 - DNA, 25 bp, Mus musculus
gatatgcacgcaatgcacttccatg

SEQ ID NO: 504623 - DNA, 25 bp, Mus musculus
gatatgcacgcattgcacttccatg

SEQ ID NO: 504624 - DNA, 25 bp, Mus musculus
gatatgcagcagcacttggctttaa

SEQ ID NO: 504625 - DNA, 25 bp, Mus musculus
gatatgcagcaggacttggctttaa

SEQ ID NO: 504626 - DNA, 25 bp, Mus musculus
gatatgcagttgctgcgaccttcat

SEQ ID NO: 504627 - DNA, 25 bp, Mus musculus
gatatgcagttggtgcgaccttcat

SEQ ID NO: 504628 - DNA, 25 bp, Mus musculus
gatatgcataccagtcctcaacatg

SEQ ID NO: 504629 - DNA, 25 bp, Mus musculus
gatatgcatacctgtcctcaacatg

SEQ ID NO: 504630 - DNA, 25 bp, Mus musculus
gatatgcattaactcagatacacag

SEQ ID NO: 504631 - DNA, 25 bp, Mus musculus
gatatgcattaagtcagatacacag

SEQ ID NO: 504632 - DNA, 25 bp, Mus musculus
gatatgccagatcagataatgccaa

SEQ ID NO: 504633 - DNA, 25 bp, Mus musculus
gatatgccagatgagataatgccaa

SEQ ID NO: 504634 - DNA, 25 bp, Mus musculus
gatatgccagtcactctgggactta

SEQ ID NO: 504635 - DNA, 25 bp, Mus musculus
gatatgccagtctctctgggactta

SEQ ID NO: 504636 - DNA, 25 bp, Mus musculus
gatatgccagtgattttctacattg

SEQ ID NO: 504637 - DNA, 25 bp, Mus musculus
gatatgccagtgtttttctacattg

SEQ ID NO: 504638 - DNA, 25 bp, Mus musculus
gatatgccatcccatgtgtggtaga

SEQ ID NO: 504639 - DNA, 25 bp, Mus musculus
gatatgccatccgatgtgtggtaga

SEQ ID NO: 504640 - DNA, 25 bp, Mus musculus
gatatgcccttcaagacatggataa

SEQ ID NO: 504641 - DNA, 25 bp, Mus musculus
gatatgcccttctagacatggataa

SEQ ID NO: 504642 - DNA, 25 bp, Mus musculus
gatatgcctaaactccacgtgcttg

SEQ ID NO: 504643 - DNA, 25 bp, Mus musculus
gatatgcctaaagtccacgtgcttg

SEQ ID NO: 504644 - DNA, 25 bp, Mus musculus
gatatgcctactcataagcagtttg

SEQ ID NO: 504645 - DNA, 25 bp, Mus musculus
gatatgcctactgataagcagtttg

SEQ ID NO: 504646 - DNA, 25 bp, Mus musculus
gatatgcctctcaaatcgatctcat

SEQ ID NO: 504647 - DNA, 25 bp, Mus musculus
gatatgcctctctaatcgatctcat

SEQ ID NO: 504648 - DNA, 25 bp, Mus musculus
gatatgcctgctatcactgtggagc

SEQ ID NO: 504649 - DNA, 25 bp, Mus musculus
gatatgcctgctttcactgtggagc

SEQ ID NO: 504650 - DNA, 25 bp, Mus musculus
gatatgccttggacacattccattc

SEQ ID NO: 504651 - DNA, 25 bp, Mus musculus
gatatgccttggagccacgattata

SEQ ID NO: 504652 - DNA, 25 bp, Mus musculus
gatatgccttggtcacattccattc

SEQ ID NO: 504653 - DNA, 25 bp, Mus musculus
gatatgccttggtgccacgattata

SEQ ID NO: 504654 - DNA, 25 bp, Mus musculus
gatatgcctttcagagttgggagta

SEQ ID NO: 504655 - DNA, 25 bp, Mus musculus
gatatgcctttctgagttgggagta

SEQ ID NO: 504656 - DNA, 25 bp, Mus musculus
gatatgcgcaagagtctcccctgcg

SEQ ID NO: 504657 - DNA, 25 bp, Mus musculus
gatatgcgcaagtgtctcccctgcg

SEQ ID NO: 504658 - DNA, 25 bp, Mus musculus
gatatgcgctgaagatgtctagata

SEQ ID NO: 504659 - DNA, 25 bp, Mus musculus
gatatgcgctgatgatgtctagata

SEQ ID NO: 504660 - DNA, 25 bp, Mus musculus
gatatgctaactcctactcttttaa

SEQ ID NO: 504661 - DNA, 25 bp, Mus musculus
gatatgctaactgctactcttttaa

SEQ ID NO: 504662 - DNA, 25 bp, Mus musculus
gatatgctagtcagtgggtccgaga

SEQ ID NO: 504663 - DNA, 25 bp, Mus musculus
gatatgctagtctgtgggtccgaga

SEQ ID NO: 504664 - DNA, 25 bp, Mus musculus
gatatgctccagagttctgagattc

SEQ ID NO: 504665 - DNA, 25 bp, Mus musculus
gatatgctccagtgttctgagattc

SEQ ID NO: 504666 - DNA, 25 bp, Mus musculus
gatatgctctagacaggcacagcca

SEQ ID NO: 504667 - DNA, 25 bp, Mus musculus
gatatgctctagtcaggcacagcca

SEQ ID NO: 504668 - DNA, 25 bp, Mus musculus
gatatgctgaatatccgtggactaa

SEQ ID NO: 504669 - DNA, 25 bp, Mus musculus
gatatgctgaatttccgtggactaa

SEQ ID NO: 504670 - DNA, 25 bp, Mus musculus
gatatgctgcagagcaagtgcccat

SEQ ID NO: 504671 - DNA, 25 bp, Mus musculus
gatatgctgcagtgcaagtgcccat

SEQ ID NO: 504672 - DNA, 25 bp, Mus musculus
gatatgctggccacttctaaatctg

SEQ ID NO: 504673 - DNA, 25 bp, Mus musculus
gatatgctggcctcttctaaatctg

SEQ ID NO: 504674 - DNA, 25 bp, Mus musculus
gatatgctgtggatgtgtatacatt

SEQ ID NO: 504675 - DNA, 25 bp, Mus musculus
gatatgctgtggttgtgtatacatt

SEQ ID NO: 504676 - DNA, 25 bp, Mus musculus
gatatgcttcaaatttttctggaat

SEQ ID NO: 504677 - DNA, 25 bp, Mus musculus
gatatgcttcaattttttctggaat

SEQ ID NO: 504678 - DNA, 25 bp, Mus musculus
gatatgcttccaccttgtgtatatg

SEQ ID NO: 504679 - DNA, 25 bp, Mus musculus
gatatgcttccagcttgtgtatatg

SEQ ID NO: 504680 - DNA, 25 bp, Mus musculus
gatatgcttgtgattgttcccaaca

SEQ ID NO: 504681 - DNA, 25 bp, Mus musculus
gatatgcttgtgtttgttcccaaca

SEQ ID NO: 504682 - DNA, 25 bp, Mus musculus
gatatgctttggctgctatctacag

SEQ ID NO: 504683 - DNA, 25 bp, Mus musculus
gatatgctttgggtgctatctacag

SEQ ID NO: 504684 - DNA, 25 bp, Mus musculus
gatatgcttttaatggccatgctaa

SEQ ID NO: 504685 - DNA, 25 bp, Mus musculus
gatatgcttttattggccatgctaa

SEQ ID NO: 504686 - DNA, 25 bp, Mus musculus
gatatggaaacgcttcatgcattat

SEQ ID NO: 504687 - DNA, 25 bp, Mus musculus
gatatggaaacggttcatgcattat

SEQ ID NO: 504688 - DNA, 25 bp, Mus musculus
gatatggaacacaaaaccctgtttt

SEQ ID NO: 504689 - DNA, 25 bp, Mus musculus
gatatggaacactaaaccctgtttt

SEQ ID NO: 504690 - DNA, 25 bp, Mus musculus
gatatggaaccaacagccgcaaatt

SEQ ID NO: 504691 - DNA, 25 bp, Mus musculus
gatatggaaccatcagccgcaaatt

SEQ ID NO: 504692 - DNA, 25 bp, Mus musculus
gatatggaagttaaaactccttaga

SEQ ID NO: 504693 - DNA, 25 bp, Mus musculus
gatatggaagtttaaactccttaga

SEQ ID NO: 504694 - DNA, 25 bp, Mus musculus
gatatggaatgcctctttaccccag

SEQ ID NO: 504695 - DNA, 25 bp, Mus musculus
gatatggaatgcgtctttaccccag

SEQ ID NO: 504696 - DNA, 25 bp, Mus musculus
gatatggactgcatctggtttacat

SEQ ID NO: 504697 - DNA, 25 bp, Mus musculus
gatatggactgcttctggtttacat

SEQ ID NO: 504698 - DNA, 25 bp, Mus musculus
gatatggagacaccgagttcacagt

SEQ ID NO: 504699 - DNA, 25 bp, Mus musculus
gatatggagacagcgagttcacagt

SEQ ID NO: 504700 - DNA, 25 bp, Mus musculus
gatatggagagtaagatgctggaat

SEQ ID NO: 504701 - DNA, 25 bp, Mus musculus
gatatggagagttagatgctggaat

SEQ ID NO: 504702 - DNA, 25 bp, Mus musculus
gatatggagcacatcttccttcctt

SEQ ID NO: 504703 - DNA, 25 bp, Mus musculus
gatatggagcacttcttccttcctt

SEQ ID NO: 504704 - DNA, 25 bp, Mus musculus
gatatggaggccacactggtgtcct

SEQ ID NO: 504705 - DNA, 25 bp, Mus musculus
gatatggaggcctcactggtgtcct

SEQ ID NO: 504706 - DNA, 25 bp, Mus musculus
gatatggagggacttggacatccac

SEQ ID NO: 504707 - DNA, 25 bp, Mus musculus
gatatggagggagttggacatccac

SEQ ID NO: 504708 - DNA, 25 bp, Mus musculus
gatatggagtttatgacgctctttt

SEQ ID NO: 504709 - DNA, 25 bp, Mus musculus
gatatggagtttttgacgctctttt

SEQ ID NO: 504710 - DNA, 25 bp, Mus musculus
gatatggatgcgagtatggtctcga

SEQ ID NO: 504711 - DNA, 25 bp, Mus musculus
gatatggatgcgtgtatggtctcga

SEQ ID NO: 504712 - DNA, 25 bp, Mus musculus
gatatggatgttaagcaaatggcat

SEQ ID NO: 504713 - DNA, 25 bp, Mus musculus
gatatggatgtttagcaaatggcat

SEQ ID NO: 504714 - DNA, 25 bp, Mus musculus
gatatggcaaaaccttccttggtct

SEQ ID NO: 504715 - DNA, 25 bp, Mus musculus
gatatggcaaaagcttccttggtct

SEQ ID NO: 504716 - DNA, 25 bp, Mus musculus
gatatggcacctactgactttctca

SEQ ID NO: 504717 - DNA, 25 bp, Mus musculus
gatatggcaccttctgactttctca

SEQ ID NO: 504718 - DNA, 25 bp, Mus musculus
gatatggcagagcaacttggcaaat

SEQ ID NO: 504719 - DNA, 25 bp, Mus musculus
gatatggcagaggaacttggcaaat

SEQ ID NO: 504720 - DNA, 25 bp, Mus musculus
gatatggcatctatcctggatacac

SEQ ID NO: 504721 - DNA, 25 bp, Mus musculus
gatatggcatctttcctggatacac

SEQ ID NO: 504722 - DNA, 25 bp, Mus musculus
gatatggcctacattacatgtatgt

SEQ ID NO: 504723 - DNA, 25 bp, Mus musculus
gatatggcctactttacatgtatgt

SEQ ID NO: 504724 - DNA, 25 bp, Mus musculus
gatatggcctttacgataactattt

SEQ ID NO: 504725 - DNA, 25 bp, Mus musculus
gatatggccttttcgataactattt

SEQ ID NO: 504726 - DNA, 25 bp, Mus musculus
gatatggcgttgacccaagggctct

SEQ ID NO: 504727 - DNA, 25 bp, Mus musculus
gatatggcgttgtcccaagggctct

SEQ ID NO: 504728 - DNA, 25 bp, Mus musculus
gatatggctcctcgatgtcctctgc

SEQ ID NO: 504729 - DNA, 25 bp, Mus musculus
gatatggctcctggatgtcctctgc

SEQ ID NO: 504730 - DNA, 25 bp, Mus musculus
gatatggctctgaggctaatagcac

SEQ ID NO: 504731 - DNA, 25 bp, Mus musculus
gatatggctctgtggctaatagcac

SEQ ID NO: 504732 - DNA, 25 bp, Mus musculus
gatatggctgccagcaatgctccag

SEQ ID NO: 504733 - DNA, 25 bp, Mus musculus
gatatggctgccatcaacgagcggc

SEQ ID NO: 504734 - DNA, 25 bp, Mus musculus
gatatggctgcctgcaatgctccag

SEQ ID NO: 504735 - DNA, 25 bp, Mus musculus
gatatggctgccttcaacgagcggc

SEQ ID NO: 504736 - DNA, 25 bp, Mus musculus
gatatggctgtcagcattcggatga

SEQ ID NO: 504737 - DNA, 25 bp, Mus musculus
gatatggctgtctgcattcggatga

SEQ ID NO: 504738 - DNA, 25 bp, Mus musculus
gatatggctgttcgctgtaacattc

SEQ ID NO: 504739 - DNA, 25 bp, Mus musculus
gatatggctgttggctgtaacattc

SEQ ID NO: 504740 - DNA, 25 bp, Mus musculus
gatatgggacaacctcagtagcttt

SEQ ID NO: 504741 - DNA, 25 bp, Mus musculus
gatatgggacaagctcagtagcttt

SEQ ID NO: 504742 - DNA, 25 bp, Mus musculus
gatatgggattaaacagatcttagt

SEQ ID NO: 504743 - DNA, 25 bp, Mus musculus
gatatgggattatacagatcttagt

SEQ ID NO: 504744 - DNA, 25 bp, Mus musculus
gatatgggcgtacgcaccacattct

SEQ ID NO: 504745 - DNA, 25 bp, Mus musculus
gatatgggcgtaggcaccacattct

SEQ ID NO: 504746 - DNA, 25 bp, Mus musculus
gatatgggtaggcattttcccacca

SEQ ID NO: 504747 - DNA, 25 bp, Mus musculus
gatatgggtagggattttcccacca

SEQ ID NO: 504748 - DNA, 25 bp, Mus musculus
gatatgggtctcatggatacaacac

SEQ ID NO: 504749 - DNA, 25 bp, Mus musculus
gatatgggtctcttggatacaacac

SEQ ID NO: 504750 - DNA, 25 bp, Mus musculus
gatatgggttggctacaatccttca

SEQ ID NO: 504751 - DNA, 25 bp, Mus musculus
gatatgggttgggtacaatccttca

SEQ ID NO: 504752 - DNA, 25 bp, Mus musculus
gatatggtagttcctcaagctgtag

SEQ ID NO: 504753 - DNA, 25 bp, Mus musculus
gatatggtagttgctcaagctgtag

SEQ ID NO: 504754 - DNA, 25 bp, Mus musculus
gatatggtcaccaaggtcctgctgt

SEQ ID NO: 504755 - DNA, 25 bp, Mus musculus
gatatggtcacctaggtcctgctgt

SEQ ID NO: 504756 - DNA, 25 bp, Mus musculus
gatatggtccagcaagaagacacga

SEQ ID NO: 504757 - DNA, 25 bp, Mus musculus
gatatggtccaggaagaagacacga

SEQ ID NO: 504758 - DNA, 25 bp, Mus musculus
gatatggtccgtcttctcatctgta

SEQ ID NO: 504759 - DNA, 25 bp, Mus musculus
gatatggtccgtgttctcatctgta

SEQ ID NO: 504760 - DNA, 25 bp, Mus musculus
gatatggtctgcaacacagctcaga

SEQ ID NO: 504761 - DNA, 25 bp, Mus musculus
gatatggtctgctacacagctcaga

SEQ ID NO: 504762 - DNA, 25 bp, Mus musculus
gatatggtgagaaaattttccaaaa

SEQ ID NO: 504763 - DNA, 25 bp, Mus musculus
gatatggtgagataattttccaaaa

SEQ ID NO: 504764 - DNA, 25 bp, Mus musculus
gatatggtgcatagccatacatggg

SEQ ID NO: 504765 - DNA, 25 bp, Mus musculus
gatatggtgcattgccatacatggg

SEQ ID NO: 504766 - DNA, 25 bp, Mus musculus
gatatggtgccccatcctgaagcca

SEQ ID NO: 504767 - DNA, 25 bp, Mus musculus
gatatggtgcccgatcctgaagcca

SEQ ID NO: 504768 - DNA, 25 bp, Mus musculus
gatatggtgcgcctcttgaagctta

SEQ ID NO: 504769 - DNA, 25 bp, Mus musculus
gatatggtgcgcgtcttgaagctta

SEQ ID NO: 504770 - DNA, 25 bp, Mus musculus
gatatggttcatcccagttctggat

SEQ ID NO: 504771 - DNA, 25 bp, Mus musculus
gatatggttcatgccagttctggat

SEQ ID NO: 504772 - DNA, 25 bp, Mus musculus
gatatggttccgcaacttccagatt

SEQ ID NO: 504773 - DNA, 25 bp, Mus musculus
gatatggttccggaacttccagatt

SEQ ID NO: 504774 - DNA, 25 bp, Mus musculus
gatatggttcttccactaacagtgt

SEQ ID NO: 504775 - DNA, 25 bp, Mus musculus
gatatggttcttgcactaacagtgt

SEQ ID NO: 504776 - DNA, 25 bp, Mus musculus
gatatgtaaaatcgccctgtgcctg

SEQ ID NO: 504777 - DNA, 25 bp, Mus musculus
gatatgtaaaatggccctgtgcctg

SEQ ID NO: 504778 - DNA, 25 bp, Mus musculus
gatatgtaaatgattgtttccagca

SEQ ID NO: 504779 - DNA, 25 bp, Mus musculus
gatatgtaaatgtttgtttccagca

SEQ ID NO: 504780 - DNA, 25 bp, Mus musculus
gatatgtaaccgaggccaaccctga

SEQ ID NO: 504781 - DNA, 25 bp, Mus musculus
gatatgtaaccgtggccaaccctga

SEQ ID NO: 504782 - DNA, 25 bp, Mus musculus
gatatgtacagcaaccgcactggaa

SEQ ID NO: 504783 - DNA, 25 bp, Mus musculus
gatatgtacagctaccgcactggaa

SEQ ID NO: 504784 - DNA, 25 bp, Mus musculus
gatatgtacataacacacacctccc

SEQ ID NO: 504785 - DNA, 25 bp, Mus musculus
gatatgtacatactgcatgtccagc

SEQ ID NO: 504786 - DNA, 25 bp, Mus musculus
gatatgtacatagtgcatgtccagc

SEQ ID NO: 504787 - DNA, 25 bp, Mus musculus
gatatgtacatatcacacacctccc

SEQ ID NO: 504788 - DNA, 25 bp, Mus musculus
gatatgtaccaaaaaacctgcagct

SEQ ID NO: 504789 - DNA, 25 bp, Mus musculus
gatatgtaccaataaacctgcagct

SEQ ID NO: 504790 - DNA, 25 bp, Mus musculus
gatatgtacctcatccttaggcctt

SEQ ID NO: 504791 - DNA, 25 bp, Mus musculus
gatatgtacctcttccttaggcctt

SEQ ID NO: 504792 - DNA, 25 bp, Mus musculus
gatatgtagactattgatgacacaa

SEQ ID NO: 504793 - DNA, 25 bp, Mus musculus
gatatgtagacttttgatgacacaa

SEQ ID NO: 504794 - DNA, 25 bp, Mus musculus
gatatgtatcatacagacctgccta

SEQ ID NO: 504795 - DNA, 25 bp, Mus musculus
gatatgtatcattcagacctgccta

SEQ ID NO: 504796 - DNA, 25 bp, Mus musculus
gatatgtatgaacatgcacactcat

SEQ ID NO: 504797 - DNA, 25 bp, Mus musculus
gatatgtatgaagatgcacactcat

SEQ ID NO: 504798 - DNA, 25 bp, Mus musculus
gatatgtcagtcatgctttactttt

SEQ ID NO: 504799 - DNA, 25 bp, Mus musculus
gatatgtcagtcttgctttactttt

SEQ ID NO: 504800 - DNA, 25 bp, Mus musculus
gatatgtcatggacttcctgtgagg

SEQ ID NO: 504801 - DNA, 25 bp, Mus musculus
gatatgtcatggtcttcctgtgagg

SEQ ID NO: 504802 - DNA, 25 bp, Mus musculus
gatatgtcctttctcacttaggttg

SEQ ID NO: 504803 - DNA, 25 bp, Mus musculus
gatatgtcctttgtcacttaggttg

SEQ ID NO: 504804 - DNA, 25 bp, Mus musculus
gatatgtctgtccaagaccttctgc

SEQ ID NO: 504805 - DNA, 25 bp, Mus musculus
gatatgtctgtcgaagaccttctgc

SEQ ID NO: 504806 - DNA, 25 bp, Mus musculus
gatatgtctttaatacttgagttca

SEQ ID NO: 504807 - DNA, 25 bp, Mus musculus
gatatgtctttattacttgagttca

SEQ ID NO: 504808 - DNA, 25 bp, Mus musculus
gatatgtgacttctcatatacacag

SEQ ID NO: 504809 - DNA, 25 bp, Mus musculus
gatatgtgacttgtcatatacacag

SEQ ID NO: 504810 - DNA, 25 bp, Mus musculus
gatatgtgaggcaccatcccaagac

SEQ ID NO: 504811 - DNA, 25 bp, Mus musculus
gatatgtgaggctccatcccaagac

SEQ ID NO: 504812 - DNA, 25 bp, Mus musculus
gatatgtgcataaagagctggagag

SEQ ID NO: 504813 - DNA, 25 bp, Mus musculus
gatatgtgcatatagagctggagag

SEQ ID NO: 504814 - DNA, 25 bp, Mus musculus
gatatgtgcgttcacttctttgacg

SEQ ID NO: 504815 - DNA, 25 bp, Mus musculus
gatatgtgcgttgacttctttgacg

SEQ ID NO: 504816 - DNA, 25 bp, Mus musculus
gatatgtgcttaagtggctttctca

SEQ ID NO: 504817 - DNA, 25 bp, Mus musculus
gatatgtgcttatgtggctttctca

SEQ ID NO: 504818 - DNA, 25 bp, Mus musculus
gatatgtggctgcagaaatcctggc

SEQ ID NO: 504819 - DNA, 25 bp, Mus musculus
gatatgtggctggagaaatcctggc

SEQ ID NO: 504820 - DNA, 25 bp, Mus musculus
gatatgtggtacacccttttgcatt

SEQ ID NO: 504821 - DNA, 25 bp, Mus musculus
gatatgtggtactcccttttgcatt

SEQ ID NO: 504822 - DNA, 25 bp, Mus musculus
gatatgtgtccccaaagccctgctc

SEQ ID NO: 504823 - DNA, 25 bp, Mus musculus
gatatgtgtcccgaaagccctgctc

SEQ ID NO: 504824 - DNA, 25 bp, Mus musculus
gatatgtgtcttacaagatgtccaa

SEQ ID NO: 504825 - DNA, 25 bp, Mus musculus
gatatgtgtctttcaagatgtccaa

SEQ ID NO: 504826 - DNA, 25 bp, Mus musculus
gatatgtgtgttccacggtgccaat

SEQ ID NO: 504827 - DNA, 25 bp, Mus musculus
gatatgtgtgttgcacggtgccaat

SEQ ID NO: 504828 - DNA, 25 bp, Mus musculus
gatatgtgttcccaagtagtaagat

SEQ ID NO: 504829 - DNA, 25 bp, Mus musculus
gatatgtgttccgaagtagtaagat

SEQ ID NO: 504830 - DNA, 25 bp, Mus musculus
gatatgttactgaccggcagcagtt

SEQ ID NO: 504831 - DNA, 25 bp, Mus musculus
gatatgttactgtccggcagcagtt

SEQ ID NO: 504832 - DNA, 25 bp, Mus musculus
gatatgttacttaccagtttttaat

SEQ ID NO: 504833 - DNA, 25 bp, Mus musculus
gatatgttactttccagtttttaat

SEQ ID NO: 504834 - DNA, 25 bp, Mus musculus
gatatgttagggatcagaactggaa

SEQ ID NO: 504835 - DNA, 25 bp, Mus musculus
gatatgttagggttcagaactggaa

SEQ ID NO: 504836 - DNA, 25 bp, Mus musculus
gatatgttctataaacccttaagta

SEQ ID NO: 504837 - DNA, 25 bp, Mus musculus
gatatgttctattaacccttaagta

SEQ ID NO: 504838 - DNA, 25 bp, Mus musculus
gatatgttggccattacagaatgaa

SEQ ID NO: 504839 - DNA, 25 bp, Mus musculus
gatatgttggcctttacagaatgaa

SEQ ID NO: 504840 - DNA, 25 bp, Mus musculus
gatatgttttacaatattgcttagc

SEQ ID NO: 504841 - DNA, 25 bp, Mus musculus
gatatgttttactatattgcttagc

SEQ ID NO: 504842 - DNA, 25 bp, Mus musculus
gatattaacacgatctattagaggt

SEQ ID NO: 504843 - DNA, 25 bp, Mus musculus
gatattaacacgttctattagaggt

SEQ ID NO: 504844 - DNA, 25 bp, Mus musculus
gatattaacgtgattcagaccagca

SEQ ID NO: 504845 - DNA, 25 bp, Mus musculus
gatattaacgtgtttcagaccagca

SEQ ID NO: 504846 - DNA, 25 bp, Mus musculus
gatattaatgtacttcagacccaaa

SEQ ID NO: 504847 - DNA, 25 bp, Mus musculus
gatattaatgtagttcagacccaaa

SEQ ID NO: 504848 - DNA, 25 bp, Mus musculus
gatattaatttccagtattttcatg

SEQ ID NO: 504849 - DNA, 25 bp, Mus musculus
gatattaatttcgagtattttcatg

SEQ ID NO: 504850 - DNA, 25 bp, Mus musculus
gatattacatgaaccatcttttgga

SEQ ID NO: 504851 - DNA, 25 bp, Mus musculus
gatattacatgatccatcttttgga

SEQ ID NO: 504852 - DNA, 25 bp, Mus musculus
gatattaccagcatgccagacacct

SEQ ID NO: 504853 - DNA, 25 bp, Mus musculus
gatattaccagcttgccagacacct

SEQ ID NO: 504854 - DNA, 25 bp, Mus musculus
gatattacctgcaaagtcacacacc

SEQ ID NO: 504855 - DNA, 25 bp, Mus musculus
gatattacctgctaagtcacacacc

SEQ ID NO: 504856 - DNA, 25 bp, Mus musculus
gatattactatgaagacccagccag

SEQ ID NO: 504857 - DNA, 25 bp, Mus musculus
gatattactatgtagacccagccag

SEQ ID NO: 504858 - DNA, 25 bp, Mus musculus
gatattactcaacacattctcatgt

SEQ ID NO: 504859 - DNA, 25 bp, Mus musculus
gatattactcaagacattctcatgt

SEQ ID NO: 504860 - DNA, 25 bp, Mus musculus
gatattagagctcttattccctggc

SEQ ID NO: 504861 - DNA, 25 bp, Mus musculus
gatattagagctgttattccctggc

SEQ ID NO: 504862 - DNA, 25 bp, Mus musculus
gatattagatttatccaagcaactg

SEQ ID NO: 504863 - DNA, 25 bp, Mus musculus
gatattagatttttccaagcaactg

SEQ ID NO: 504864 - DNA, 25 bp, Mus musculus
gatattagcaagactccaactgtta

SEQ ID NO: 504865 - DNA, 25 bp, Mus musculus
gatattagcaagtctccaactgtta

SEQ ID NO: 504866 - DNA, 25 bp, Mus musculus
gatattagcaccaagaactacttgt

SEQ ID NO: 504867 - DNA, 25 bp, Mus musculus
gatattagcacctagaactacttgt

SEQ ID NO: 504868 - DNA, 25 bp, Mus musculus
gatattagttggaagctctcaataa

SEQ ID NO: 504869 - DNA, 25 bp, Mus musculus
gatattagttggtagctctcaataa

SEQ ID NO: 504870 - DNA, 25 bp, Mus musculus
gatattagtttcatccaaatggttg

SEQ ID NO: 504871 - DNA, 25 bp, Mus musculus
gatattagtttcttccaaatggttg

SEQ ID NO: 504872 - DNA, 25 bp, Mus musculus
gatattataaagcaagagattcacc

SEQ ID NO: 504873 - DNA, 25 bp, Mus musculus
gatattataaaggaagagattcacc

SEQ ID NO: 504874 - DNA, 25 bp, Mus musculus
gatattatcaacatcactctgccca

SEQ ID NO: 504875 - DNA, 25 bp, Mus musculus
gatattatcaacttcactctgccca

SEQ ID NO: 504876 - DNA, 25 bp, Mus musculus
gatattatcagaccccagaaagact

SEQ ID NO: 504877 - DNA, 25 bp, Mus musculus
gatattatcagagcccagaaagact

SEQ ID NO: 504878 - DNA, 25 bp, Mus musculus
gatattatcctaaacacagccagtt

SEQ ID NO: 504879 - DNA, 25 bp, Mus musculus
gatattatcctatacacagccagtt

SEQ ID NO: 504880 - DNA, 25 bp, Mus musculus
gatattatctaaattgcttttggta

SEQ ID NO: 504881 - DNA, 25 bp, Mus musculus
gatattatctaatttgcttttggta

SEQ ID NO: 504882 - DNA, 25 bp, Mus musculus
gatattatctatccctggtacctag

SEQ ID NO: 504883 - DNA, 25 bp, Mus musculus
gatattatctatgcctggtacctag

SEQ ID NO: 504884 - DNA, 25 bp, Mus musculus
gatattatcttgacagtacccagtg

SEQ ID NO: 504885 - DNA, 25 bp, Mus musculus
gatattatcttgtcagtacccagtg

SEQ ID NO: 504886 - DNA, 25 bp, Mus musculus
gatattatgaggaactttgtcgaaa

SEQ ID NO: 504887 - DNA, 25 bp, Mus musculus
gatattatgaggtactttgtcgaaa

SEQ ID NO: 504888 - DNA, 25 bp, Mus musculus
gatattatgtatcattggctcgcta

SEQ ID NO: 504889 - DNA, 25 bp, Mus musculus
gatattatgtatgattggctcgcta

SEQ ID NO: 504890 - DNA, 25 bp, Mus musculus
gatattatgtttattgttcctgtaa

SEQ ID NO: 504891 - DNA, 25 bp, Mus musculus
gatattatgttttttgttcctgtaa

SEQ ID NO: 504892 - DNA, 25 bp, Mus musculus
gatattattcccaaacaagcagttc

SEQ ID NO: 504893 - DNA, 25 bp, Mus musculus
gatattattccctaacaagcagttc

SEQ ID NO: 504894 - DNA, 25 bp, Mus musculus
gatattattctactcagccttctga

SEQ ID NO: 504895 - DNA, 25 bp, Mus musculus
gatattattctagtcagccttctga

SEQ ID NO: 504896 - DNA, 25 bp, Mus musculus
gatattattggtacccaaacactgg

SEQ ID NO: 504897 - DNA, 25 bp, Mus musculus
gatattattggttcccaaacactgg

SEQ ID NO: 504898 - DNA, 25 bp, Mus musculus
gatattcaaagaccccagaccggtt

SEQ ID NO: 504899 - DNA, 25 bp, Mus musculus
gatattcaaagagcccagaccggtt

SEQ ID NO: 504900 - DNA, 25 bp, Mus musculus
gatattcaaccacactgggcatgtt

SEQ ID NO: 504901 - DNA, 25 bp, Mus musculus
gatattcaaccagactgggcatgtt

SEQ ID NO: 504902 - DNA, 25 bp, Mus musculus
gatattcacggtattcttcaactgt

SEQ ID NO: 504903 - DNA, 25 bp, Mus musculus
gatattcacggttttcttcaactgt

SEQ ID NO: 504904 - DNA, 25 bp, Mus musculus
gatattcactttatccatcacaagg

SEQ ID NO: 504905 - DNA, 25 bp, Mus musculus
gatattcactttctgcacacgtgtc

SEQ ID NO: 504906 - DNA, 25 bp, Mus musculus
gatattcactttgtgcacacgtgtc

SEQ ID NO: 504907 - DNA, 25 bp, Mus musculus
gatattcactttttccatcacaagg

SEQ ID NO: 504908 - DNA, 25 bp, Mus musculus
gatattcatcaaacagtccctgcca

SEQ ID NO: 504909 - DNA, 25 bp, Mus musculus
gatattcatcaatcagtccctgcca

SEQ ID NO: 504910 - DNA, 25 bp, Mus musculus
gatattcatcataagacaactggag

SEQ ID NO: 504911 - DNA, 25 bp, Mus musculus
gatattcatcattagacaactggag

SEQ ID NO: 504912 - DNA, 25 bp, Mus musculus
gatattccaggacctcacgctgcac

SEQ ID NO: 504913 - DNA, 25 bp, Mus musculus
gatattccaggagctcacgctgcac

SEQ ID NO: 504914 - DNA, 25 bp, Mus musculus
gatattccaggtaatcttatcatga

SEQ ID NO: 504915 - DNA, 25 bp, Mus musculus
gatattccaggttatcttatcatga

SEQ ID NO: 504916 - DNA, 25 bp, Mus musculus
gatattccagttcacacttttgact

SEQ ID NO: 504917 - DNA, 25 bp, Mus musculus
gatattccagttgacacttttgact

SEQ ID NO: 504918 - DNA, 25 bp, Mus musculus
gatattccatctctttttaaacgtg

SEQ ID NO: 504919 - DNA, 25 bp, Mus musculus
gatattccatctgtttttaaacgtg

SEQ ID NO: 504920 - DNA, 25 bp, Mus musculus
gatattcccattctttgacattccc

SEQ ID NO: 504921 - DNA, 25 bp, Mus musculus
gatattcccattgtttgacattccc

SEQ ID NO: 504922 - DNA, 25 bp, Mus musculus
gatattccccatacctggagtacaa

SEQ ID NO: 504923 - DNA, 25 bp, Mus musculus
gatattccccattcctggagtacaa

SEQ ID NO: 504924 - DNA, 25 bp, Mus musculus
gatattccctcgaggcaaataaacc

SEQ ID NO: 504925 - DNA, 25 bp, Mus musculus
gatattccctcgtggcaaataaacc

SEQ ID NO: 504926 - DNA, 25 bp, Mus musculus
gatattccgtacagtggtggttcat

SEQ ID NO: 504927 - DNA, 25 bp, Mus musculus
gatattccgtactgtggtggttcat

SEQ ID NO: 504928 - DNA, 25 bp, Mus musculus
gatattccgtagcaattttcccaat

SEQ ID NO: 504929 - DNA, 25 bp, Mus musculus
gatattccgtaggaattttcccaat

SEQ ID NO: 504930 - DNA, 25 bp, Mus musculus
gatattcctagaattgtcttccaaa

SEQ ID NO: 504931 - DNA, 25 bp, Mus musculus
gatattcctagatttgtcttccaaa

SEQ ID NO: 504932 - DNA, 25 bp, Mus musculus
gatattcctagtatcagcgtgtcct

SEQ ID NO: 504933 - DNA, 25 bp, Mus musculus
gatattcctagtttcagcgtgtcct

SEQ ID NO: 504934 - DNA, 25 bp, Mus musculus
gatattcctcacactggaacttgaa

SEQ ID NO: 504935 - DNA, 25 bp, Mus musculus
gatattcctcactctggaacttgaa

SEQ ID NO: 504936 - DNA, 25 bp, Mus musculus
gatattcctctgagctagtgaatga

SEQ ID NO: 504937 - DNA, 25 bp, Mus musculus
gatattcctctgtgctagtgaatga

SEQ ID NO: 504938 - DNA, 25 bp, Mus musculus
gatattcctgaaaagcagtgtgcaa

SEQ ID NO: 504939 - DNA, 25 bp, Mus musculus
gatattcctgaaacatacacgaatg

SEQ ID NO: 504940 - DNA, 25 bp, Mus musculus
gatattcctgaatagcagtgtgcaa

SEQ ID NO: 504941 - DNA, 25 bp, Mus musculus
gatattcctgaatcatacacgaatg

SEQ ID NO: 504942 - DNA, 25 bp, Mus musculus
gatattcctgatatcaagctgactt

SEQ ID NO: 504943 - DNA, 25 bp, Mus musculus
gatattcctgatttcaagctgactt

SEQ ID NO: 504944 - DNA, 25 bp, Mus musculus
gatattccttaaatgtgcactttgt

SEQ ID NO: 504945 - DNA, 25 bp, Mus musculus
gatattccttaattgtgcactttgt

SEQ ID NO: 504946 - DNA, 25 bp, Mus musculus
gatattcggtttacctagaacctgt

SEQ ID NO: 504947 - DNA, 25 bp, Mus musculus
gatattcggttttcctagaacctgt

SEQ ID NO: 504948 - DNA, 25 bp, Mus musculus
gatattctaactcctgcggcatctc

SEQ ID NO: 504949 - DNA, 25 bp, Mus musculus
gatattctaactgctgcggcatctc

SEQ ID NO: 504950 - DNA, 25 bp, Mus musculus
gatattctaggccaagacacgactt

SEQ ID NO: 504951 - DNA, 25 bp, Mus musculus
gatattctaggcgaagacacgactt

SEQ ID NO: 504952 - DNA, 25 bp, Mus musculus
gatattctagtaaactttggctctc

SEQ ID NO: 504953 - DNA, 25 bp, Mus musculus
gatattctagtatactttggctctc

SEQ ID NO: 504954 - DNA, 25 bp, Mus musculus
gatattctatctcggctgccctttt

SEQ ID NO: 504955 - DNA, 25 bp, Mus musculus
gatattctatctgggctgccctttt

SEQ ID NO: 504956 - DNA, 25 bp, Mus musculus
gatattctcaagaaccatccatgtg

SEQ ID NO: 504957 - DNA, 25 bp, Mus musculus
gatattctcaagtaccatccatgtg

SEQ ID NO: 504958 - DNA, 25 bp, Mus musculus
gatattctcatcagaactccagcct

SEQ ID NO: 504959 - DNA, 25 bp, Mus musculus
gatattctcatctgaactccagcct

SEQ ID NO: 504960 - DNA, 25 bp, Mus musculus
gatattctccagcatcatgggacag

SEQ ID NO: 504961 - DNA, 25 bp, Mus musculus
gatattctccaggatcatgggacag

SEQ ID NO: 504962 - DNA, 25 bp, Mus musculus
gatattctgaaaagtgcttactcaa

SEQ ID NO: 504963 - DNA, 25 bp, Mus musculus
gatattctgaaatgtgcttactcaa

SEQ ID NO: 504964 - DNA, 25 bp, Mus musculus
gatattctgataaaaatctcaagag

SEQ ID NO: 504965 - DNA, 25 bp, Mus musculus
gatattctgatataaatctcaagag

SEQ ID NO: 504966 - DNA, 25 bp, Mus musculus
gatattctgatccacagggaggcat

SEQ ID NO: 504967 - DNA, 25 bp, Mus musculus
gatattctgatcgacagggaggcat

SEQ ID NO: 504968 - DNA, 25 bp, Mus musculus
gatattctgcacattccggtagtta

SEQ ID NO: 504969 - DNA, 25 bp, Mus musculus
gatattctgcactttccggtagtta

SEQ ID NO: 504970 - DNA, 25 bp, Mus musculus
gatattctggtaaccatccagacca

SEQ ID NO: 504971 - DNA, 25 bp, Mus musculus
gatattctggtatccatccagacca

SEQ ID NO: 504972 - DNA, 25 bp, Mus musculus
gatattctgtcaagttaattgttat

SEQ ID NO: 504973 - DNA, 25 bp, Mus musculus
gatattctgtcatgttaattgttat

SEQ ID NO: 504974 - DNA, 25 bp, Mus musculus
gatattcttagccttcatagttagc

SEQ ID NO: 504975 - DNA, 25 bp, Mus musculus
gatattcttagcgttcatagttagc

SEQ ID NO: 504976 - DNA, 25 bp, Mus musculus
gatattcttccactctttctttcta

SEQ ID NO: 504977 - DNA, 25 bp, Mus musculus
gatattcttccagtctttctttcta

SEQ ID NO: 504978 - DNA, 25 bp, Mus musculus
gatattctttatagttacactaagg

SEQ ID NO: 504979 - DNA, 25 bp, Mus musculus
gatattctttattgttacactaagg

SEQ ID NO: 504980 - DNA, 25 bp, Mus musculus
gatattgaaagtagcacccctctgc

SEQ ID NO: 504981 - DNA, 25 bp, Mus musculus
gatattgaaagttgcacccctctgc

SEQ ID NO: 504982 - DNA, 25 bp, Mus musculus
gatattgaagcccagttgatacatg

SEQ ID NO: 504983 - DNA, 25 bp, Mus musculus
gatattgaagccgagttgatacatg

SEQ ID NO: 504984 - DNA, 25 bp, Mus musculus
gatattgacataattcccttctggg

SEQ ID NO: 504985 - DNA, 25 bp, Mus musculus
gatattgacatatttcccttctggg

SEQ ID NO: 504986 - DNA, 25 bp, Mus musculus
gatattgacatgaataaggttttta

SEQ ID NO: 504987 - DNA, 25 bp, Mus musculus
gatattgacatgtataaggttttta

SEQ ID NO: 504988 - DNA, 25 bp, Mus musculus
gatattgatcttcacttctgttcaa

SEQ ID NO: 504989 - DNA, 25 bp, Mus musculus
gatattgatcttgacttctgttcaa

SEQ ID NO: 504990 - DNA, 25 bp, Mus musculus
gatattgatggcactggtgtcttca

SEQ ID NO: 504991 - DNA, 25 bp, Mus musculus
gatattgatggctctggtgtcttca

SEQ ID NO: 504992 - DNA, 25 bp, Mus musculus
gatattgattctagtaagcctgtat

SEQ ID NO: 504993 - DNA, 25 bp, Mus musculus
gatattgattcttgtaagcctgtat

SEQ ID NO: 504994 - DNA, 25 bp, Mus musculus
gatattgatttgagatcctcaggat

SEQ ID NO: 504995 - DNA, 25 bp, Mus musculus
gatattgatttgtgatcctcaggat

SEQ ID NO: 504996 - DNA, 25 bp, Mus musculus
gatattgcaacaaccatactggctt

SEQ ID NO: 504997 - DNA, 25 bp, Mus musculus
gatattgcaacatccatactggctt

SEQ ID NO: 504998 - DNA, 25 bp, Mus musculus
gatattgcacttactcataatggag

SEQ ID NO: 504999 - DNA, 25 bp, Mus musculus
gatattgcactttctcataatggag

SEQ ID NO: 505000 - DNA, 25 bp, Mus musculus
gatattgcagccagagtatttacct

SEQ ID NO: 505001 - DNA, 25 bp, Mus musculus
gatattgcagcctgagtatttacct

SEQ ID NO: 505002 - DNA, 25 bp, Mus musculus
gatattgcatgcacaacttaggata

SEQ ID NO: 505003 - DNA, 25 bp, Mus musculus
gatattgcatgctcaacttaggata

SEQ ID NO: 505004 - DNA, 25 bp, Mus musculus
gatattgccaataaccattctgaat

SEQ ID NO: 505005 - DNA, 25 bp, Mus musculus
gatattgccaattaccattctgaat

SEQ ID NO: 505006 - DNA, 25 bp, Mus musculus
gatattgccagcctctcccagacat

SEQ ID NO: 505007 - DNA, 25 bp, Mus musculus
gatattgccagcgtctcccagacat

SEQ ID NO: 505008 - DNA, 25 bp, Mus musculus
gatattgccagtcggtcctgcagga

SEQ ID NO: 505009 - DNA, 25 bp, Mus musculus
gatattgccagtgggtcctgcagga

SEQ ID NO: 505010 - DNA, 25 bp, Mus musculus
gatattgcccgccaggcacgagaca

SEQ ID NO: 505011 - DNA, 25 bp, Mus musculus
gatattgcccgcgaggcacgagaca

SEQ ID NO: 505012 - DNA, 25 bp, Mus musculus
gatattgccgctactgagacgtatt

SEQ ID NO: 505013 - DNA, 25 bp, Mus musculus
gatattgccgcttctgagacgtatt

SEQ ID NO: 505014 - DNA, 25 bp, Mus musculus
gatattgccgttatgtacatacatt

SEQ ID NO: 505015 - DNA, 25 bp, Mus musculus
gatattgccgttttgtacatacatt

SEQ ID NO: 505016 - DNA, 25 bp, Mus musculus
gatattgcctacatgggcatcacag

SEQ ID NO: 505017 - DNA, 25 bp, Mus musculus
gatattgcctacttgggcatcacag

SEQ ID NO: 505018 - DNA, 25 bp, Mus musculus
gatattgctacaaagtcactgctca

SEQ ID NO: 505019 - DNA, 25 bp, Mus musculus
gatattgctacatagtcactgctca

SEQ ID NO: 505020 - DNA, 25 bp, Mus musculus
gatattgctagaaacctaagactat

SEQ ID NO: 505021 - DNA, 25 bp, Mus musculus
gatattgctagaattggttacataa

SEQ ID NO: 505022 - DNA, 25 bp, Mus musculus
gatattgctagatacctaagactat

SEQ ID NO: 505023 - DNA, 25 bp, Mus musculus
gatattgctagatttggttacataa

SEQ ID NO: 505024 - DNA, 25 bp, Mus musculus
gatattgctcatcaaattttgcctt

SEQ ID NO: 505025 - DNA, 25 bp, Mus musculus
gatattgctcatgaaattttgcctt

SEQ ID NO: 505026 - DNA, 25 bp, Mus musculus
gatattgctccaagatatgccagta

SEQ ID NO: 505027 - DNA, 25 bp, Mus musculus
gatattgctccatgatatgccagta

SEQ ID NO: 505028 - DNA, 25 bp, Mus musculus
gatattggaggccactttaaagcca

SEQ ID NO: 505029 - DNA, 25 bp, Mus musculus
gatattggaggcgactttaaagcca

SEQ ID NO: 505030 - DNA, 25 bp, Mus musculus
gatattggatatcacagacctcttt

SEQ ID NO: 505031 - DNA, 25 bp, Mus musculus
gatattggatatgacagacctcttt

SEQ ID NO: 505032 - DNA, 25 bp, Mus musculus
gatattggcatcacttgagataaaa

SEQ ID NO: 505033 - DNA, 25 bp, Mus musculus
gatattggcatctcttgagataaaa

SEQ ID NO: 505034 - DNA, 25 bp, Mus musculus
gatattggccagagcttagttttag

SEQ ID NO: 505035 - DNA, 25 bp, Mus musculus
gatattggccagtgcttagttttag

SEQ ID NO: 505036 - DNA, 25 bp, Mus musculus
gatattggccatattgagtcccttc

SEQ ID NO: 505037 - DNA, 25 bp, Mus musculus
gatattggccattttgagtcccttc

SEQ ID NO: 505038 - DNA, 25 bp, Mus musculus
gatattggctgacccttgcttggtc

SEQ ID NO: 505039 - DNA, 25 bp, Mus musculus
gatattggctgagccttgcttggtc

SEQ ID NO: 505040 - DNA, 25 bp, Mus musculus
gatattgggacaatggacctcaaag

SEQ ID NO: 505041 - DNA, 25 bp, Mus musculus
gatattgggacattggacctcaaag

SEQ ID NO: 505042 - DNA, 25 bp, Mus musculus
gatattggtctaaggttttcatggg

SEQ ID NO: 505043 - DNA, 25 bp, Mus musculus
gatattggtctatggttttcatggg

SEQ ID NO: 505044 - DNA, 25 bp, Mus musculus
gatattggttccattgaaaccgaag

SEQ ID NO: 505045 - DNA, 25 bp, Mus musculus
gatattggttcctttgaaaccgaag

SEQ ID NO: 505046 - DNA, 25 bp, Mus musculus
gatattgtaaaaccaagcgcaccaa

SEQ ID NO: 505047 - DNA, 25 bp, Mus musculus
gatattgtaaaagcaagcgcaccaa

SEQ ID NO: 505048 - DNA, 25 bp, Mus musculus
gatattgtacagaaagttcctcaga

SEQ ID NO: 505049 - DNA, 25 bp, Mus musculus
gatattgtacagtaagttcctcaga

SEQ ID NO: 505050 - DNA, 25 bp, Mus musculus
gatattgtcaatacttgctcatcgg

SEQ ID NO: 505051 - DNA, 25 bp, Mus musculus
gatattgtcaattcttgctcatcgg

SEQ ID NO: 505052 - DNA, 25 bp, Mus musculus
gatattgtctaaactctgcagaagg

SEQ ID NO: 505053 - DNA, 25 bp, Mus musculus
gatattgtctaatctctgcagaagg

SEQ ID NO: 505054 - DNA, 25 bp, Mus musculus
gatattgtctctaaagcctggtgat

SEQ ID NO: 505055 - DNA, 25 bp, Mus musculus
gatattgtctcttaagcctggtgat

SEQ ID NO: 505056 - DNA, 25 bp, Mus musculus
gatattgtctgcagaaagttcatct

SEQ ID NO: 505057 - DNA, 25 bp, Mus musculus
gatattgtctgctgaaagttcatct

SEQ ID NO: 505058 - DNA, 25 bp, Mus musculus
gatattgtcttaacatagcttctag

SEQ ID NO: 505059 - DNA, 25 bp, Mus musculus
gatattgtcttatcatagcttctag

SEQ ID NO: 505060 - DNA, 25 bp, Mus musculus
gatattgtgataactcccaaccata

SEQ ID NO: 505061 - DNA, 25 bp, Mus musculus
gatattgtgatatctcccaaccata

SEQ ID NO: 505062 - DNA, 25 bp, Mus musculus
gatattgtgggcatcttgacaggat

SEQ ID NO: 505063 - DNA, 25 bp, Mus musculus
gatattgtgggcttcttgacaggat

SEQ ID NO: 505064 - DNA, 25 bp, Mus musculus
gatattgttactccatgactgacct

SEQ ID NO: 505065 - DNA, 25 bp, Mus musculus
gatattgttactgcatgactgacct

SEQ ID NO: 505066 - DNA, 25 bp, Mus musculus
gatatttaaactatgctcctgtagc

SEQ ID NO: 505067 - DNA, 25 bp, Mus musculus
gatatttaaactttgctcctgtagc

SEQ ID NO: 505068 - DNA, 25 bp, Mus musculus
gatatttaaagcaccatctccaatc

SEQ ID NO: 505069 - DNA, 25 bp, Mus musculus
gatatttaaagctccatctccaatc

SEQ ID NO: 505070 - DNA, 25 bp, Mus musculus
gatatttaaatcacctgctctactc

SEQ ID NO: 505071 - DNA, 25 bp, Mus musculus
gatatttaaatctcctgctctactc

SEQ ID NO: 505072 - DNA, 25 bp, Mus musculus
gatatttaacctacttcattgctta

SEQ ID NO: 505073 - DNA, 25 bp, Mus musculus
gatatttaaccttcttcattgctta

SEQ ID NO: 505074 - DNA, 25 bp, Mus musculus
gatatttaacttagttcacttgtct

SEQ ID NO: 505075 - DNA, 25 bp, Mus musculus
gatatttaactttgttcacttgtct

SEQ ID NO: 505076 - DNA, 25 bp, Mus musculus
gatatttacaacactcactggattt

SEQ ID NO: 505077 - DNA, 25 bp, Mus musculus
gatatttacaactctcactggattt

SEQ ID NO: 505078 - DNA, 25 bp, Mus musculus
gatatttaccacatacctagacctc

SEQ ID NO: 505079 - DNA, 25 bp, Mus musculus
gatatttaccacttacctagacctc

SEQ ID NO: 505080 - DNA, 25 bp, Mus musculus
gatatttactgaatgctgattggtg

SEQ ID NO: 505081 - DNA, 25 bp, Mus musculus
gatatttactgattgctgattggtg

SEQ ID NO: 505082 - DNA, 25 bp, Mus musculus
gatatttactgcatgatggatttac

SEQ ID NO: 505083 - DNA, 25 bp, Mus musculus
gatatttactgcttgatggatttac

SEQ ID NO: 505084 - DNA, 25 bp, Mus musculus
gatatttagcgtcctgtggtatgtt

SEQ ID NO: 505085 - DNA, 25 bp, Mus musculus
gatatttagcgtgctgtggtatgtt

SEQ ID NO: 505086 - DNA, 25 bp, Mus musculus
gatatttaggctatcattctagttt

SEQ ID NO: 505087 - DNA, 25 bp, Mus musculus
gatatttaggctttcattctagttt

SEQ ID NO: 505088 - DNA, 25 bp, Mus musculus
gatatttagtatattctgcactgaa

SEQ ID NO: 505089 - DNA, 25 bp, Mus musculus
gatatttagtattttctgcactgaa

SEQ ID NO: 505090 - DNA, 25 bp, Mus musculus
gatatttatcaaagccctctttgac

SEQ ID NO: 505091 - DNA, 25 bp, Mus musculus
gatatttatcaatgccctctttgac

SEQ ID NO: 505092 - DNA, 25 bp, Mus musculus
gatatttatcccaaggtcatgtacg

SEQ ID NO: 505093 - DNA, 25 bp, Mus musculus
gatatttatccctaggtcatgtacg

SEQ ID NO: 505094 - DNA, 25 bp, Mus musculus
gatatttatctcctatgtgctcatt

SEQ ID NO: 505095 - DNA, 25 bp, Mus musculus
gatatttatctcgtatgtgctcatt

SEQ ID NO: 505096 - DNA, 25 bp, Mus musculus
gatatttatgcacggttttgtagtt

SEQ ID NO: 505097 - DNA, 25 bp, Mus musculus
gatatttatgcagggttttgtagtt

SEQ ID NO: 505098 - DNA, 25 bp, Mus musculus
gatatttattgcagaatttctattc

SEQ ID NO: 505099 - DNA, 25 bp, Mus musculus
gatatttattgctgaatttctattc

SEQ ID NO: 505100 - DNA, 25 bp, Mus musculus
gatatttcaaatatactctatgcat

SEQ ID NO: 505101 - DNA, 25 bp, Mus musculus
gatatttcaaatttactctatgcat

SEQ ID NO: 505102 - DNA, 25 bp, Mus musculus
gatatttcaagaactcagcctctgt

SEQ ID NO: 505103 - DNA, 25 bp, Mus musculus
gatatttcaagatctcagcctctgt

SEQ ID NO: 505104 - DNA, 25 bp, Mus musculus
gatatttcaagcacatgtcattatg

SEQ ID NO: 505105 - DNA, 25 bp, Mus musculus
gatatttcaagctcatgtcattatg

SEQ ID NO: 505106 - DNA, 25 bp, Mus musculus
gatatttcaggacatgggccaccaa

SEQ ID NO: 505107 - DNA, 25 bp, Mus musculus
gatatttcaggagatgggccaccaa

SEQ ID NO: 505108 - DNA, 25 bp, Mus musculus
gatatttccagcatcagatcagtga

SEQ ID NO: 505109 - DNA, 25 bp, Mus musculus
gatatttccagcttcagatcagtga

SEQ ID NO: 505110 - DNA, 25 bp, Mus musculus
gatatttccatacagggctgctaat

SEQ ID NO: 505111 - DNA, 25 bp, Mus musculus
gatatttccatagagggctgctaat

SEQ ID NO: 505112 - DNA, 25 bp, Mus musculus
gatatttcccttcaagccctatgaa

SEQ ID NO: 505113 - DNA, 25 bp, Mus musculus
gatatttcccttgaagccctatgaa

SEQ ID NO: 505114 - DNA, 25 bp, Mus musculus
gatatttcctgtacatagagtttgt

SEQ ID NO: 505115 - DNA, 25 bp, Mus musculus
gatatttcctgttcatagagtttgt

SEQ ID NO: 505116 - DNA, 25 bp, Mus musculus
gatatttcctttcctaacattctga

SEQ ID NO: 505117 - DNA, 25 bp, Mus musculus
gatatttcctttgctaacattctga

SEQ ID NO: 505118 - DNA, 25 bp, Mus musculus
gatatttcgcacctttccaattgta

SEQ ID NO: 505119 - DNA, 25 bp, Mus musculus
gatatttcgcacgtttccaattgta

SEQ ID NO: 505120 - DNA, 25 bp, Mus musculus
gatatttctataactttaagaagtc

SEQ ID NO: 505121 - DNA, 25 bp, Mus musculus
gatatttctatatctttaagaagtc

SEQ ID NO: 505122 - DNA, 25 bp, Mus musculus
gatatttctatgaaagtgtaggtac

SEQ ID NO: 505123 - DNA, 25 bp, Mus musculus
gatatttctatgtaagtgtaggtac

SEQ ID NO: 505124 - DNA, 25 bp, Mus musculus
gatatttctctacattcctgaaaca

SEQ ID NO: 505125 - DNA, 25 bp, Mus musculus
gatatttctctagattcctgaaaca

SEQ ID NO: 505126 - DNA, 25 bp, Mus musculus
gatatttctgcaatctctatgacaa

SEQ ID NO: 505127 - DNA, 25 bp, Mus musculus
gatatttctgcattctctatgacaa

SEQ ID NO: 505128 - DNA, 25 bp, Mus musculus
gatatttctgtgacactcaccagtt

SEQ ID NO: 505129 - DNA, 25 bp, Mus musculus
gatatttctgtgtcactcaccagtt

SEQ ID NO: 505130 - DNA, 25 bp, Mus musculus
gatatttcttccaacagactcctga

SEQ ID NO: 505131 - DNA, 25 bp, Mus musculus
gatatttcttccaagaccacagcct

SEQ ID NO: 505132 - DNA, 25 bp, Mus musculus
gatatttcttcctacagactcctga

SEQ ID NO: 505133 - DNA, 25 bp, Mus musculus
gatatttcttcctagaccacagcct

SEQ ID NO: 505134 - DNA, 25 bp, Mus musculus
gatatttgatttacttagggctttt

SEQ ID NO: 505135 - DNA, 25 bp, Mus musculus
gatatttgattttcttagggctttt

SEQ ID NO: 505136 - DNA, 25 bp, Mus musculus
gatatttgcacaagactttcctctt

SEQ ID NO: 505137 - DNA, 25 bp, Mus musculus
gatatttgcacatgactttcctctt

SEQ ID NO: 505138 - DNA, 25 bp, Mus musculus
gatatttgccaacttgagaaaccct

SEQ ID NO: 505139 - DNA, 25 bp, Mus musculus
gatatttgccaagttgagaaaccct

SEQ ID NO: 505140 - DNA, 25 bp, Mus musculus
gatatttgctaactttttataggga

SEQ ID NO: 505141 - DNA, 25 bp, Mus musculus
gatatttgctaagtttttataggga

SEQ ID NO: 505142 - DNA, 25 bp, Mus musculus
gatatttgctttattacactgactt

SEQ ID NO: 505143 - DNA, 25 bp, Mus musculus
gatatttgctttcacacgggtgtat

SEQ ID NO: 505144 - DNA, 25 bp, Mus musculus
gatatttgctttgacacgggtgtat

SEQ ID NO: 505145 - DNA, 25 bp, Mus musculus
gatatttgcttttttacactgactt

SEQ ID NO: 505146 - DNA, 25 bp, Mus musculus
gatatttgggctctcgaagtcataa

SEQ ID NO: 505147 - DNA, 25 bp, Mus musculus
gatatttgggctgtcgaagtcataa

SEQ ID NO: 505148 - DNA, 25 bp, Mus musculus
gatattttaaacatccatggaccag

SEQ ID NO: 505149 - DNA, 25 bp, Mus musculus
gatattttaaacttccatggaccag

SEQ ID NO: 505150 - DNA, 25 bp, Mus musculus
gatattttaactactttctgtatgt

SEQ ID NO: 505151 - DNA, 25 bp, Mus musculus
gatattttaacttctttctgtatgt

SEQ ID NO: 505152 - DNA, 25 bp, Mus musculus
gatattttatatatactgacctcaa

SEQ ID NO: 505153 - DNA, 25 bp, Mus musculus
gatattttatatttactgacctcaa

SEQ ID NO: 505154 - DNA, 25 bp, Mus musculus
gatattttatcacctgatccctatg

SEQ ID NO: 505155 - DNA, 25 bp, Mus musculus
gatattttatcagctgatccctatg

SEQ ID NO: 505156 - DNA, 25 bp, Mus musculus
gatattttcaaaacacagcacacag

SEQ ID NO: 505157 - DNA, 25 bp, Mus musculus
gatattttcaaatcacagcacacag

SEQ ID NO: 505158 - DNA, 25 bp, Mus musculus
gatattttcaggatacttgataagg

SEQ ID NO: 505159 - DNA, 25 bp, Mus musculus
gatattttcaggttacttgataagg

SEQ ID NO: 505160 - DNA, 25 bp, Mus musculus
gatattttcatcaggtttccattga

SEQ ID NO: 505161 - DNA, 25 bp, Mus musculus
gatattttcatctggtttccattga

SEQ ID NO: 505162 - DNA, 25 bp, Mus musculus
gatattttcattaagattcagtagc

SEQ ID NO: 505163 - DNA, 25 bp, Mus musculus
gatattttcatttagattcagtagc

SEQ ID NO: 505164 - DNA, 25 bp, Mus musculus
gatattttccagcatcttcgggatg

SEQ ID NO: 505165 - DNA, 25 bp, Mus musculus
gatattttccaggatcttcgggatg

SEQ ID NO: 505166 - DNA, 25 bp, Mus musculus
gatattttccatatattggccctgc

SEQ ID NO: 505167 - DNA, 25 bp, Mus musculus
gatattttccatttattggccctgc

SEQ ID NO: 505168 - DNA, 25 bp, Mus musculus
gatattttcttcactactttttcta

SEQ ID NO: 505169 - DNA, 25 bp, Mus musculus
gatattttcttctctactttttcta

SEQ ID NO: 505170 - DNA, 25 bp, Mus musculus
gatattttcttgagtagtcccctga

SEQ ID NO: 505171 - DNA, 25 bp, Mus musculus
gatattttcttgtgtagtcccctga

SEQ ID NO: 505172 - DNA, 25 bp, Mus musculus
gatattttgcataatcaaggcattg

SEQ ID NO: 505173 - DNA, 25 bp, Mus musculus
gatattttgcattatcaaggcattg

SEQ ID NO: 505174 - DNA, 25 bp, Mus musculus
gatattttgcctaattgttcacctc

SEQ ID NO: 505175 - DNA, 25 bp, Mus musculus
gatattttgccttattgttcacctc

SEQ ID NO: 505176 - DNA, 25 bp, Mus musculus
gatattttgcttcatttacttaacc

SEQ ID NO: 505177 - DNA, 25 bp, Mus musculus
gatattttgcttgatttacttaacc

SEQ ID NO: 505178 - DNA, 25 bp, Mus musculus
gatattttggacagttacttaggta

SEQ ID NO: 505179 - DNA, 25 bp, Mus musculus
gatattttggactgttacttaggta

SEQ ID NO: 505180 - DNA, 25 bp, Mus musculus
gatatttttagacaaccacaggttc

SEQ ID NO: 505181 - DNA, 25 bp, Mus musculus
gatatttttagagaaccacaggttc

SEQ ID NO: 505182 - DNA, 25 bp, Mus musculus
gatatttttcacaacattgagacag

SEQ ID NO: 505183 - DNA, 25 bp, Mus musculus
gatatttttcactacattgagacag

SEQ ID NO: 505184 - DNA, 25 bp, Mus musculus
gatatttttccaaaagacatcctat

SEQ ID NO: 505185 - DNA, 25 bp, Mus musculus
gatatttttccataagacatcctat

SEQ ID NO: 505186 - DNA, 25 bp, Mus musculus
gatattttttcacttgtgagacatg

SEQ ID NO: 505187 - DNA, 25 bp, Mus musculus
gatattttttcagttgtgagacatg

SEQ ID NO: 505188 - DNA, 25 bp, Mus musculus
gatattttttgcaatatgactgcac

SEQ ID NO: 505189 - DNA, 25 bp, Mus musculus
gatattttttgctatatgactgcac

SEQ ID NO: 505190 - DNA, 25 bp, Mus musculus
gatcaaaaccaacagagtctcccca

SEQ ID NO: 505191 - DNA, 25 bp, Mus musculus
gatcaaaaccaagagagtctcccca

SEQ ID NO: 505192 - DNA, 25 bp, Mus musculus
gatcaaaacccaacattgcacatat

SEQ ID NO: 505193 - DNA, 25 bp, Mus musculus
gatcaaaacccatcattgcacatat

SEQ ID NO: 505194 - DNA, 25 bp, Mus musculus
gatcaaaaccccaattgcaaccatg

SEQ ID NO: 505195 - DNA, 25 bp, Mus musculus
gatcaaaacccctattgcaaccatg

SEQ ID NO: 505196 - DNA, 25 bp, Mus musculus
gatcaaaaccggaaactctcctgtg

SEQ ID NO: 505197 - DNA, 25 bp, Mus musculus
gatcaaaaccggtaactctcctgtg

SEQ ID NO: 505198 - DNA, 25 bp, Mus musculus
gatcaaaactatatacattgcttct

SEQ ID NO: 505199 - DNA, 25 bp, Mus musculus
gatcaaaactatttacattgcttct

SEQ ID NO: 505200 - DNA, 25 bp, Mus musculus
gatcaaaatcccatacgaaccagct

SEQ ID NO: 505201 - DNA, 25 bp, Mus musculus
gatcaaaatcccttacgaaccagct

SEQ ID NO: 505202 - DNA, 25 bp, Mus musculus
gatcaaaatgtgcttctaggtagac

SEQ ID NO: 505203 - DNA, 25 bp, Mus musculus
gatcaaaatgtggttctaggtagac

SEQ ID NO: 505204 - DNA, 25 bp, Mus musculus
gatcaaacaaccatagacacgaagt

SEQ ID NO: 505205 - DNA, 25 bp, Mus musculus
gatcaaacaaccttagacacgaagt

SEQ ID NO: 505206 - DNA, 25 bp, Mus musculus
gatcaaacaagacttcaactccctg

SEQ ID NO: 505207 - DNA, 25 bp, Mus musculus
gatcaaacaagagttcaactccctg

SEQ ID NO: 505208 - DNA, 25 bp, Mus musculus
gatcaaacccacactcagcattatg

SEQ ID NO: 505209 - DNA, 25 bp, Mus musculus
gatcaaacccactctcagcattatg

SEQ ID NO: 505210 - DNA, 25 bp, Mus musculus
gatcaaacccagaattgttctcctt

SEQ ID NO: 505211 - DNA, 25 bp, Mus musculus
gatcaaacccagtattgttctcctt

SEQ ID NO: 505212 - DNA, 25 bp, Mus musculus
gatcaaacccttaaagaggttcctg

SEQ ID NO: 505213 - DNA, 25 bp, Mus musculus
gatcaaaccctttaagaggttcctg

SEQ ID NO: 505214 - DNA, 25 bp, Mus musculus
gatcaaacctccatgggcaatctac

SEQ ID NO: 505215 - DNA, 25 bp, Mus musculus
gatcaaacctccttgggcaatctac

SEQ ID NO: 505216 - DNA, 25 bp, Mus musculus
gatcaaaccttactgactcaacaag

SEQ ID NO: 505217 - DNA, 25 bp, Mus musculus
gatcaaaccttagtgactcaacaag

SEQ ID NO: 505218 - DNA, 25 bp, Mus musculus
gatcaaacgtttatgtggacaaact

SEQ ID NO: 505219 - DNA, 25 bp, Mus musculus
gatcaaacgtttttgtggacaaact

SEQ ID NO: 505220 - DNA, 25 bp, Mus musculus
gatcaaactcaacttgtcaggctat

SEQ ID NO: 505221 - DNA, 25 bp, Mus musculus
gatcaaactcaagttgtcaggctat

SEQ ID NO: 505222 - DNA, 25 bp, Mus musculus
gatcaaactcttcactttggttcca

SEQ ID NO: 505223 - DNA, 25 bp, Mus musculus
gatcaaactcttgactttggttcca

SEQ ID NO: 505224 - DNA, 25 bp, Mus musculus
gatcaaacttgacgcccttcaggag

SEQ ID NO: 505225 - DNA, 25 bp, Mus musculus
gatcaaacttgaggcccttcaggag

SEQ ID NO: 505226 - DNA, 25 bp, Mus musculus
gatcaaacttgcctctaggaactcg

SEQ ID NO: 505227 - DNA, 25 bp, Mus musculus
gatcaaacttgcgtctaggaactcg

SEQ ID NO: 505228 - DNA, 25 bp, Mus musculus
gatcaaactttactcaggctcctgc

SEQ ID NO: 505229 - DNA, 25 bp, Mus musculus
gatcaaactttagtcaggctcctgc

SEQ ID NO: 505230 - DNA, 25 bp, Mus musculus
gatcaaagaactacatgggaccaaa

SEQ ID NO: 505231 - DNA, 25 bp, Mus musculus
gatcaaagaacttcatgggaccaaa

SEQ ID NO: 505232 - DNA, 25 bp, Mus musculus
gatcaaagaggcctcagctggcttt

SEQ ID NO: 505233 - DNA, 25 bp, Mus musculus
gatcaaagaggcgtcagctggcttt

SEQ ID NO: 505234 - DNA, 25 bp, Mus musculus
gatcaaagatcaagtggcctccctg

SEQ ID NO: 505235 - DNA, 25 bp, Mus musculus
gatcaaagatcatgtggcctccctg

SEQ ID NO: 505236 - DNA, 25 bp, Mus musculus
gatcaaagcatgcacctgtaccaat

SEQ ID NO: 505237 - DNA, 25 bp, Mus musculus
gatcaaagcatggacctgtaccaat

SEQ ID NO: 505238 - DNA, 25 bp, Mus musculus
gatcaaagctaacttggtctccaaa

SEQ ID NO: 505239 - DNA, 25 bp, Mus musculus
gatcaaagctaagttggtctccaaa

SEQ ID NO: 505240 - DNA, 25 bp, Mus musculus
gatcaaagctccatactagttccca

SEQ ID NO: 505241 - DNA, 25 bp, Mus musculus
gatcaaagctccttactagttccca

SEQ ID NO: 505242 - DNA, 25 bp, Mus musculus
gatcaaaggcaacggtctctccagc

SEQ ID NO: 505243 - DNA, 25 bp, Mus musculus
gatcaaaggcaagggtctctccagc

SEQ ID NO: 505244 - DNA, 25 bp, Mus musculus
gatcaaagggatacagattggaaca

SEQ ID NO: 505245 - DNA, 25 bp, Mus musculus
gatcaaagggattcagattggaaca

SEQ ID NO: 505246 - DNA, 25 bp, Mus musculus
gatcaaaggtggaatgtgtcatctg

SEQ ID NO: 505247 - DNA, 25 bp, Mus musculus
gatcaaaggtggtatgtgtcatctg

SEQ ID NO: 505248 - DNA, 25 bp, Mus musculus
gatcaaagtatcatgccggaagttg

SEQ ID NO: 505249 - DNA, 25 bp, Mus musculus
gatcaaagtatcttgccggaagttg

SEQ ID NO: 505250 - DNA, 25 bp, Mus musculus
gatcaaagtccaaccagactgtggt

SEQ ID NO: 505251 - DNA, 25 bp, Mus musculus
gatcaaagtccatccagactgtggt

SEQ ID NO: 505252 - DNA, 25 bp, Mus musculus
gatcaaagtgcacattcccactgag

SEQ ID NO: 505253 - DNA, 25 bp, Mus musculus
gatcaaagtgcagattcccactgag

SEQ ID NO: 505254 - DNA, 25 bp, Mus musculus
gatcaaagtgtgacgtgccagtaag

SEQ ID NO: 505255 - DNA, 25 bp, Mus musculus
gatcaaagtgtgtcgtgccagtaag

SEQ ID NO: 505256 - DNA, 25 bp, Mus musculus
gatcaaagttgtatcactgttgtta

SEQ ID NO: 505257 - DNA, 25 bp, Mus musculus
gatcaaagttgtttcactgttgtta

SEQ ID NO: 505258 - DNA, 25 bp, Mus musculus
gatcaaatacctcaacaagtggacg

SEQ ID NO: 505259 - DNA, 25 bp, Mus musculus
gatcaaatacctcatgacgctcatc

SEQ ID NO: 505260 - DNA, 25 bp, Mus musculus
gatcaaatacctgaacaagtggacg

SEQ ID NO: 505261 - DNA, 25 bp, Mus musculus
gatcaaatacctgatgacgctcatc

SEQ ID NO: 505262 - DNA, 25 bp, Mus musculus
gatcaaatagctactcaggagtaca

SEQ ID NO: 505263 - DNA, 25 bp, Mus musculus
gatcaaatagcttctcaggagtaca

SEQ ID NO: 505264 - DNA, 25 bp, Mus musculus
gatcaaatagtcatccctgtacacc

SEQ ID NO: 505265 - DNA, 25 bp, Mus musculus
gatcaaatagtcttccctgtacacc

SEQ ID NO: 505266 - DNA, 25 bp, Mus musculus
gatcaaatatgcctcatttcactag

SEQ ID NO: 505267 - DNA, 25 bp, Mus musculus
gatcaaatatgcgtcatttcactag

SEQ ID NO: 505268 - DNA, 25 bp, Mus musculus
gatcaaatattcagtcaaccttggg

SEQ ID NO: 505269 - DNA, 25 bp, Mus musculus
gatcaaatattctgtcaaccttggg

SEQ ID NO: 505270 - DNA, 25 bp, Mus musculus
gatcaaatcccacagaggccacgtg

SEQ ID NO: 505271 - DNA, 25 bp, Mus musculus
gatcaaatcccagagaggccacgtg

SEQ ID NO: 505272 - DNA, 25 bp, Mus musculus
gatcaaatcctactgggcctgagca

SEQ ID NO: 505273 - DNA, 25 bp, Mus musculus
gatcaaatcctagtgggcctgagca

SEQ ID NO: 505274 - DNA, 25 bp, Mus musculus
gatcaaatccttaacctccaagagg

SEQ ID NO: 505275 - DNA, 25 bp, Mus musculus
gatcaaatcctttacctccaagagg

SEQ ID NO: 505276 - DNA, 25 bp, Mus musculus
gatcaaatctcaatgctttgtgacg

SEQ ID NO: 505277 - DNA, 25 bp, Mus musculus
gatcaaatctcattgctttgtgacg

SEQ ID NO: 505278 - DNA, 25 bp, Mus musculus
gatcaaatgaagaaacccctgggtt

SEQ ID NO: 505279 - DNA, 25 bp, Mus musculus
gatcaaatgaagtaacccctgggtt

SEQ ID NO: 505280 - DNA, 25 bp, Mus musculus
gatcaaatgctgctagaattcttca

SEQ ID NO: 505281 - DNA, 25 bp, Mus musculus
gatcaaatgctggtagaattcttca

SEQ ID NO: 505282 - DNA, 25 bp, Mus musculus
gatcaaatgggaagaccgttcggaa

SEQ ID NO: 505283 - DNA, 25 bp, Mus musculus
gatcaaatgggatgaccgttcggaa

SEQ ID NO: 505284 - DNA, 25 bp, Mus musculus
gatcaaatgtaccttctattaaacc

SEQ ID NO: 505285 - DNA, 25 bp, Mus musculus
gatcaaatgtacgttctattaaacc

SEQ ID NO: 505286 - DNA, 25 bp, Mus musculus
gatcaaatgtatcgcctaactgact

SEQ ID NO: 505287 - DNA, 25 bp, Mus musculus
gatcaaatgtatggcctaactgact

SEQ ID NO: 505288 - DNA, 25 bp, Mus musculus
gatcaaattaatcgctccgcttcac

SEQ ID NO: 505289 - DNA, 25 bp, Mus musculus
gatcaaattaatggctccgcttcac

SEQ ID NO: 505290 - DNA, 25 bp, Mus musculus
gatcaaattatcaaaggatgtctta

SEQ ID NO: 505291 - DNA, 25 bp, Mus musculus
gatcaaattatctaaggatgtctta

SEQ ID NO: 505292 - DNA, 25 bp, Mus musculus
gatcaaattatgactgtccgtccgt

SEQ ID NO: 505293 - DNA, 25 bp, Mus musculus
gatcaaattatgactttgcacactg

SEQ ID NO: 505294 - DNA, 25 bp, Mus musculus
gatcaaattatgctaggtggctttt

SEQ ID NO: 505295 - DNA, 25 bp, Mus musculus
gatcaaattatggtaggtggctttt

SEQ ID NO: 505296 - DNA, 25 bp, Mus musculus
gatcaaattatgtctgtccgtccgt

SEQ ID NO: 505297 - DNA, 25 bp, Mus musculus
gatcaaattatgtctttgcacactg

SEQ ID NO: 505298 - DNA, 25 bp, Mus musculus
gatcaaattcaacttacccggtttg

SEQ ID NO: 505299 - DNA, 25 bp, Mus musculus
gatcaaattcaagttacccggtttg

SEQ ID NO: 505300 - DNA, 25 bp, Mus musculus
gatcaaatttggctctatgggagaa

SEQ ID NO: 505301 - DNA, 25 bp, Mus musculus
gatcaaatttgggtctatgggagaa

SEQ ID NO: 505302 - DNA, 25 bp, Mus musculus
gatcaacaagtaaggtcgccggtcc

SEQ ID NO: 505303 - DNA, 25 bp, Mus musculus
gatcaacaagtatggtcgccggtcc

SEQ ID NO: 505304 - DNA, 25 bp, Mus musculus
gatcaacaatgtctattcctgcctg

SEQ ID NO: 505305 - DNA, 25 bp, Mus musculus
gatcaacaatgtgtattcctgcctg

SEQ ID NO: 505306 - DNA, 25 bp, Mus musculus
gatcaacacctgagggatgtccaga

SEQ ID NO: 505307 - DNA, 25 bp, Mus musculus
gatcaacacctgtgggatgtccaga

SEQ ID NO: 505308 - DNA, 25 bp, Mus musculus
gatcaacagggacacacttgcttca

SEQ ID NO: 505309 - DNA, 25 bp, Mus musculus
gatcaacagggagacacttgcttca

SEQ ID NO: 505310 - DNA, 25 bp, Mus musculus
gatcaacagggcaaataccttgctt

SEQ ID NO: 505311 - DNA, 25 bp, Mus musculus
gatcaacagggctaataccttgctt

SEQ ID NO: 505312 - DNA, 25 bp, Mus musculus
gatcaacagtgacgcaagcagggct

SEQ ID NO: 505313 - DNA, 25 bp, Mus musculus
gatcaacagtgaggcaagcagggct

SEQ ID NO: 505314 - DNA, 25 bp, Mus musculus
gatcaacatcgaagacctgacagaa

SEQ ID NO: 505315 - DNA, 25 bp, Mus musculus
gatcaacatcgatgacctgacagaa

SEQ ID NO: 505316 - DNA, 25 bp, Mus musculus
gatcaacatgtaaccagttttctgt

SEQ ID NO: 505317 - DNA, 25 bp, Mus musculus
gatcaacatgtatccagttttctgt

SEQ ID NO: 505318 - DNA, 25 bp, Mus musculus
gatcaaccaagaaagtgagtcggta

SEQ ID NO: 505319 - DNA, 25 bp, Mus musculus
gatcaaccaagatagtgagtcggta

SEQ ID NO: 505320 - DNA, 25 bp, Mus musculus
gatcaaccagatatactgagtctaa

SEQ ID NO: 505321 - DNA, 25 bp, Mus musculus
gatcaaccagatttactgagtctaa

SEQ ID NO: 505322 - DNA, 25 bp, Mus musculus
gatcaaccagccaatcctacagaag

SEQ ID NO: 505323 - DNA, 25 bp, Mus musculus
gatcaaccagcctatcctacagaag

SEQ ID NO: 505324 - DNA, 25 bp, Mus musculus
gatcaaccgaccaggattccacaaa

SEQ ID NO: 505325 - DNA, 25 bp, Mus musculus
gatcaaccgacctggattccacaaa

SEQ ID NO: 505326 - DNA, 25 bp, Mus musculus
gatcaaccgcagcagccagttctac

SEQ ID NO: 505327 - DNA, 25 bp, Mus musculus
gatcaaccgcaggagccagttctac

SEQ ID NO: 505328 - DNA, 25 bp, Mus musculus
gatcaacctatccctgagtctatat

SEQ ID NO: 505329 - DNA, 25 bp, Mus musculus
gatcaacctatcgctgagtctatat

SEQ ID NO: 505330 - DNA, 25 bp, Mus musculus
gatcaacctgaaagtccggctagac

SEQ ID NO: 505331 - DNA, 25 bp, Mus musculus
gatcaacctgaatgtccggctagac

SEQ ID NO: 505332 - DNA, 25 bp, Mus musculus
gatcaacctgaccagaggaccttcg

SEQ ID NO: 505333 - DNA, 25 bp, Mus musculus
gatcaacctgacgagaggaccttcg

SEQ ID NO: 505334 - DNA, 25 bp, Mus musculus
gatcaacctgagatgttcttaaaga

SEQ ID NO: 505335 - DNA, 25 bp, Mus musculus
gatcaacctgagttgttcttaaaga

SEQ ID NO: 505336 - DNA, 25 bp, Mus musculus
gatcaacctgatacacctattttct

SEQ ID NO: 505337 - DNA, 25 bp, Mus musculus
gatcaacctgatctaatttgccaag

SEQ ID NO: 505338 - DNA, 25 bp, Mus musculus
gatcaacctgatgtaatttgccaag

SEQ ID NO: 505339 - DNA, 25 bp, Mus musculus
gatcaacctgattcacctattttct

SEQ ID NO: 505340 - DNA, 25 bp, Mus musculus
gatcaaccttgaaggcaatggccag

SEQ ID NO: 505341 - DNA, 25 bp, Mus musculus
gatcaaccttgatggcaatggccag

SEQ ID NO: 505342 - DNA, 25 bp, Mus musculus
gatcaacggaaaacggcaagcttct

SEQ ID NO: 505343 - DNA, 25 bp, Mus musculus
gatcaacggaaatcggcaagcttct

SEQ ID NO: 505344 - DNA, 25 bp, Mus musculus
gatcaacgtcaacttcgatgcagtt

SEQ ID NO: 505345 - DNA, 25 bp, Mus musculus
gatcaacgtcaagttcgatgcagtt

SEQ ID NO: 505346 - DNA, 25 bp, Mus musculus
gatcaactaatacctctcctagtaa

SEQ ID NO: 505347 - DNA, 25 bp, Mus musculus
gatcaactaatagctctcctagtaa

SEQ ID NO: 505348 - DNA, 25 bp, Mus musculus
gatcaactacacaatgacaggcgga

SEQ ID NO: 505349 - DNA, 25 bp, Mus musculus
gatcaactacactatgacaggcgga

SEQ ID NO: 505350 - DNA, 25 bp, Mus musculus
gatcaactatttatccatctcctgc

SEQ ID NO: 505351 - DNA, 25 bp, Mus musculus
gatcaactatttttccatctcctgc

SEQ ID NO: 505352 - DNA, 25 bp, Mus musculus
gatcaactcacactgaaacatccgt

SEQ ID NO: 505353 - DNA, 25 bp, Mus musculus
gatcaactcacagtgaaacatccgt

SEQ ID NO: 505354 - DNA, 25 bp, Mus musculus
gatcaactcttcaccagtctagaat

SEQ ID NO: 505355 - DNA, 25 bp, Mus musculus
gatcaactcttctccagtctagaat

SEQ ID NO: 505356 - DNA, 25 bp, Mus musculus
gatcaactgctacgatgtgtttggg

SEQ ID NO: 505357 - DNA, 25 bp, Mus musculus
gatcaactgctaggatgtgtttggg

SEQ ID NO: 505358 - DNA, 25 bp, Mus musculus
gatcaactgtgtacagcgaatactt

SEQ ID NO: 505359 - DNA, 25 bp, Mus musculus
gatcaactgtgttcagcgaatactt

SEQ ID NO: 505360 - DNA, 25 bp, Mus musculus
gatcaacttcttaacagacgccgga

SEQ ID NO: 505361 - DNA, 25 bp, Mus musculus
gatcaacttctttacagacgccgga

SEQ ID NO: 505362 - DNA, 25 bp, Mus musculus
gatcaacttgcacctgagccaggag

SEQ ID NO: 505363 - DNA, 25 bp, Mus musculus
gatcaacttgcagctgagccaggag

SEQ ID NO: 505364 - DNA, 25 bp, Mus musculus
gatcaactttacacttcaacagacc

SEQ ID NO: 505365 - DNA, 25 bp, Mus musculus
gatcaactttactcttcaacagacc

SEQ ID NO: 505366 - DNA, 25 bp, Mus musculus
gatcaagaacatctgggcagccttc

SEQ ID NO: 505367 - DNA, 25 bp, Mus musculus
gatcaagaacatgtgggcagccttc

SEQ ID NO: 505368 - DNA, 25 bp, Mus musculus
gatcaagaagaacggtttaagcaaa

SEQ ID NO: 505369 - DNA, 25 bp, Mus musculus
gatcaagaagaagggtttaagcaaa

SEQ ID NO: 505370 - DNA, 25 bp, Mus musculus
gatcaagaatctccccatttttctg

SEQ ID NO: 505371 - DNA, 25 bp, Mus musculus
gatcaagaatctgcccatttttctg

SEQ ID NO: 505372 - DNA, 25 bp, Mus musculus
gatcaagacaagattaaactttcat

SEQ ID NO: 505373 - DNA, 25 bp, Mus musculus
gatcaagacaagtttaaactttcat

SEQ ID NO: 505374 - DNA, 25 bp, Mus musculus
gatcaagacattagttccctgaagc

SEQ ID NO: 505375 - DNA, 25 bp, Mus musculus
gatcaagacatttgttccctgaagc

SEQ ID NO: 505376 - DNA, 25 bp, Mus musculus
gatcaagactggagccccttgccga

SEQ ID NO: 505377 - DNA, 25 bp, Mus musculus
gatcaagactggtgccccttgccga

SEQ ID NO: 505378 - DNA, 25 bp, Mus musculus
gatcaagatcatagcccctccagaa

SEQ ID NO: 505379 - DNA, 25 bp, Mus musculus
gatcaagatcatagctcctcctgag

SEQ ID NO: 505380 - DNA, 25 bp, Mus musculus
gatcaagatcataggctgcgcagct

SEQ ID NO: 505381 - DNA, 25 bp, Mus musculus
gatcaagatcattgcccctccagaa

SEQ ID NO: 505382 - DNA, 25 bp, Mus musculus
gatcaagatcattgctcctcctgag

SEQ ID NO: 505383 - DNA, 25 bp, Mus musculus
gatcaagatcattggctgcgcagct

SEQ ID NO: 505384 - DNA, 25 bp, Mus musculus
gatcaagatctaaggcagcgcaggc

SEQ ID NO: 505385 - DNA, 25 bp, Mus musculus
gatcaagatctatggcagcgcaggc

SEQ ID NO: 505386 - DNA, 25 bp, Mus musculus
gatcaagatctccatccggaccagg

SEQ ID NO: 505387 - DNA, 25 bp, Mus musculus
gatcaagatctcgatccggaccagg

SEQ ID NO: 505388 - DNA, 25 bp, Mus musculus
gatcaagattctaaacctccgcttc

SEQ ID NO: 505389 - DNA, 25 bp, Mus musculus
gatcaagattcttaacctccgcttc

SEQ ID NO: 505390 - DNA, 25 bp, Mus musculus
gatcaagattggagacctgacttct

SEQ ID NO: 505391 - DNA, 25 bp, Mus musculus
gatcaagattggtgacctgacttct

SEQ ID NO: 505392 - DNA, 25 bp, Mus musculus
gatcaagcaaatcttgtctatgtgg

SEQ ID NO: 505393 - DNA, 25 bp, Mus musculus
gatcaagcaaatgttgtctatgtgg

SEQ ID NO: 505394 - DNA, 25 bp, Mus musculus
gatcaagcaccccattaaagatgac

SEQ ID NO: 505395 - DNA, 25 bp, Mus musculus
gatcaagcacccgattaaagatgac

SEQ ID NO: 505396 - DNA, 25 bp, Mus musculus
gatcaagcacgaaccctcagctgaa

SEQ ID NO: 505397 - DNA, 25 bp, Mus musculus
gatcaagcacgatccctcagctgaa

SEQ ID NO: 505398 - DNA, 25 bp, Mus musculus
gatcaagcaggtcgtccccgagttt

SEQ ID NO: 505399 - DNA, 25 bp, Mus musculus
gatcaagcaggtggtccccgagttt

SEQ ID NO: 505400 - DNA, 25 bp, Mus musculus
gatcaagcagtaaccagttctccaa

SEQ ID NO: 505401 - DNA, 25 bp, Mus musculus
gatcaagcagtatccagttctccaa

SEQ ID NO: 505402 - DNA, 25 bp, Mus musculus
gatcaagcattacgtcaatagaaac

SEQ ID NO: 505403 - DNA, 25 bp, Mus musculus
gatcaagcattaggtcaatagaaac

SEQ ID NO: 505404 - DNA, 25 bp, Mus musculus
gatcaagcatttccgcctgaggggt

SEQ ID NO: 505405 - DNA, 25 bp, Mus musculus
gatcaagcatttgcgcctgaggggt

SEQ ID NO: 505406 - DNA, 25 bp, Mus musculus
gatcaagccctactgccttgagaaa

SEQ ID NO: 505407 - DNA, 25 bp, Mus musculus
gatcaagccctagtgccttgagaaa

SEQ ID NO: 505408 - DNA, 25 bp, Mus musculus
gatcaagcctatagactgacacctc

SEQ ID NO: 505409 - DNA, 25 bp, Mus musculus
gatcaagcctattgactgacacctc

SEQ ID NO: 505410 - DNA, 25 bp, Mus musculus
gatcaagcctgcaaaaatctgacca

SEQ ID NO: 505411 - DNA, 25 bp, Mus musculus
gatcaagcctgctaaaatctgacca

SEQ ID NO: 505412 - DNA, 25 bp, Mus musculus
gatcaagcgggcattccttattgag

SEQ ID NO: 505413 - DNA, 25 bp, Mus musculus
gatcaagcgggctttccttattgag

SEQ ID NO: 505414 - DNA, 25 bp, Mus musculus
gatcaagctaacacaggtccagact

SEQ ID NO: 505415 - DNA, 25 bp, Mus musculus
gatcaagctaactcaggtccagact

SEQ ID NO: 505416 - DNA, 25 bp, Mus musculus
gatcaagctagccaacattccagct

SEQ ID NO: 505417 - DNA, 25 bp, Mus musculus
gatcaagctagcgaacattccagct

SEQ ID NO: 505418 - DNA, 25 bp, Mus musculus
gatcaagctcatctggtacctctga

SEQ ID NO: 505419 - DNA, 25 bp, Mus musculus
gatcaagctcatgtggtacctctga

SEQ ID NO: 505420 - DNA, 25 bp, Mus musculus
gatcaagctctcagcataaagaagt

SEQ ID NO: 505421 - DNA, 25 bp, Mus musculus
gatcaagctctctgcataaagaagt

SEQ ID NO: 505422 - DNA, 25 bp, Mus musculus
gatcaagcttggattctacctgctc

SEQ ID NO: 505423 - DNA, 25 bp, Mus musculus
gatcaagcttggtttctacctgctc

SEQ ID NO: 505424 - DNA, 25 bp, Mus musculus
gatcaaggaagcactcagtcgtcaa

SEQ ID NO: 505425 - DNA, 25 bp, Mus musculus
gatcaaggaagctctcagtcgtcaa

SEQ ID NO: 505426 - DNA, 25 bp, Mus musculus
gatcaaggacttactgctgacagcc

SEQ ID NO: 505427 - DNA, 25 bp, Mus musculus
gatcaaggactttctgctgacagcc

SEQ ID NO: 505428 - DNA, 25 bp, Mus musculus
gatcaaggcaggacgccactgtgcg

SEQ ID NO: 505429 - DNA, 25 bp, Mus musculus
gatcaaggcaggtcgccactgtgcg

SEQ ID NO: 505430 - DNA, 25 bp, Mus musculus
gatcaaggcctcattattcttagta

SEQ ID NO: 505431 - DNA, 25 bp, Mus musculus
gatcaaggcctctttattcttagta

SEQ ID NO: 505432 - DNA, 25 bp, Mus musculus
gatcaaggcctgaatgtgtcatcca

SEQ ID NO: 505433 - DNA, 25 bp, Mus musculus
gatcaaggcctgtatgtgtcatcca

SEQ ID NO: 505434 - DNA, 25 bp, Mus musculus
gatcaagggactcaagatgtcactc

SEQ ID NO: 505435 - DNA, 25 bp, Mus musculus
gatcaagggactgaagatgtcactc

SEQ ID NO: 505436 - DNA, 25 bp, Mus musculus
gatcaagggaggagcttccaccaaa

SEQ ID NO: 505437 - DNA, 25 bp, Mus musculus
gatcaagggaggtgcttccaccaaa

SEQ ID NO: 505438 - DNA, 25 bp, Mus musculus
gatcaagggcgacacatctggagac

SEQ ID NO: 505439 - DNA, 25 bp, Mus musculus
gatcaagggcgagacatctggagac

SEQ ID NO: 505440 - DNA, 25 bp, Mus musculus
gatcaagggctccagactgacgcct

SEQ ID NO: 505441 - DNA, 25 bp, Mus musculus
gatcaagggctcgagactgacgcct

SEQ ID NO: 505442 - DNA, 25 bp, Mus musculus
gatcaagggttcaaggtccgcccca

SEQ ID NO: 505443 - DNA, 25 bp, Mus musculus
gatcaagggttctaggtccgcccca

SEQ ID NO: 505444 - DNA, 25 bp, Mus musculus
gatcaaggtcatccccacgctagct

SEQ ID NO: 505445 - DNA, 25 bp, Mus musculus
gatcaaggtcatgcccacgctagct

SEQ ID NO: 505446 - DNA, 25 bp, Mus musculus
gatcaaggtccccagttacatgttt

SEQ ID NO: 505447 - DNA, 25 bp, Mus musculus
gatcaaggtcccgagttacatgttt

SEQ ID NO: 505448 - DNA, 25 bp, Mus musculus
gatcaaggtctccatgcaaagaaac

SEQ ID NO: 505449 - DNA, 25 bp, Mus musculus
gatcaaggtctcgatgcaaagaaac

SEQ ID NO: 505450 - DNA, 25 bp, Mus musculus
gatcaagtacatccaatatcaacag

SEQ ID NO: 505451 - DNA, 25 bp, Mus musculus
gatcaagtacatgcaatatcaacag

SEQ ID NO: 505452 - DNA, 25 bp, Mus musculus
gatcaagtagaccaagaaatagctt

SEQ ID NO: 505453 - DNA, 25 bp, Mus musculus
gatcaagtagacgaagaaatagctt

SEQ ID NO: 505454 - DNA, 25 bp, Mus musculus
gatcaagtagtgaccttataaagtg

SEQ ID NO: 505455 - DNA, 25 bp, Mus musculus
gatcaagtagtgtccttataaagtg

SEQ ID NO: 505456 - DNA, 25 bp, Mus musculus
gatcaagtatgcattgcgcgtttaa

SEQ ID NO: 505457 - DNA, 25 bp, Mus musculus
gatcaagtatgctttgcgcgtttaa

SEQ ID NO: 505458 - DNA, 25 bp, Mus musculus
gatcaagtcaagaagagcagcctct

SEQ ID NO: 505459 - DNA, 25 bp, Mus musculus
gatcaagtcaagtagagcagcctct

SEQ ID NO: 505460 - DNA, 25 bp, Mus musculus
gatcaagtccgcaatttcaaaggca

SEQ ID NO: 505461 - DNA, 25 bp, Mus musculus
gatcaagtccgctatttcaaaggca

SEQ ID NO: 505462 - DNA, 25 bp, Mus musculus
gatcaagtgtccagatcctgccaaa

SEQ ID NO: 505463 - DNA, 25 bp, Mus musculus
gatcaagtgtcctgatcctgccaaa

SEQ ID NO: 505464 - DNA, 25 bp, Mus musculus
gatcaagtgttgactttacccatta

SEQ ID NO: 505465 - DNA, 25 bp, Mus musculus
gatcaagtgttgtctttacccatta

SEQ ID NO: 505466 - DNA, 25 bp, Mus musculus
gatcaagtgtttacacgtcagcctc

SEQ ID NO: 505467 - DNA, 25 bp, Mus musculus
gatcaagtgttttcacgtcagcctc

SEQ ID NO: 505468 - DNA, 25 bp, Mus musculus
gatcaagttaatcagctgcagcacg

SEQ ID NO: 505469 - DNA, 25 bp, Mus musculus
gatcaagttaatgagctgcagcacg

SEQ ID NO: 505470 - DNA, 25 bp, Mus musculus
gatcaagttatcagtcccaatggtt

SEQ ID NO: 505471 - DNA, 25 bp, Mus musculus
gatcaagttatctgtcccaatggtt

SEQ ID NO: 505472 - DNA, 25 bp, Mus musculus
gatcaagttccgcagacacctaaaa

SEQ ID NO: 505473 - DNA, 25 bp, Mus musculus
gatcaagttccggagacacctaaaa

SEQ ID NO: 505474 - DNA, 25 bp, Mus musculus
gatcaagttcctccagagttaccct

SEQ ID NO: 505475 - DNA, 25 bp, Mus musculus
gatcaagttcctgcagagttaccct

SEQ ID NO: 505476 - DNA, 25 bp, Mus musculus
gatcaagtttgtcgtcctggcagac

SEQ ID NO: 505477 - DNA, 25 bp, Mus musculus
gatcaagtttgtggtcctggcagac

SEQ ID NO: 505478 - DNA, 25 bp, Mus musculus
gatcaagttttcatttcgaggttct

SEQ ID NO: 505479 - DNA, 25 bp, Mus musculus
gatcaagttttcttttcgaggttct

SEQ ID NO: 505480 - DNA, 25 bp, Mus musculus
gatcaagtttttccttatggtgaac

SEQ ID NO: 505481 - DNA, 25 bp, Mus musculus
gatcaagtttttcttcctcatgaaa

SEQ ID NO: 505482 - DNA, 25 bp, Mus musculus
gatcaagtttttgcttatggtgaac

SEQ ID NO: 505483 - DNA, 25 bp, Mus musculus
gatcaagtttttgttcctcatgaaa

SEQ ID NO: 505484 - DNA, 25 bp, Mus musculus
gatcaataaataaacacgtgtctgt

SEQ ID NO: 505485 - DNA, 25 bp, Mus musculus
gatcaataaatatacacgtgtctgt

SEQ ID NO: 505486 - DNA, 25 bp, Mus musculus
gatcaataacctaggcaccattgcc

SEQ ID NO: 505487 - DNA, 25 bp, Mus musculus
gatcaataaccttggcaccattgcc

SEQ ID NO: 505488 - DNA, 25 bp, Mus musculus
gatcaatacaatcatcacccttgga

SEQ ID NO: 505489 - DNA, 25 bp, Mus musculus
gatcaatacaatgatcacccttgga

SEQ ID NO: 505490 - DNA, 25 bp, Mus musculus
gatcaataccagcttccgagaggaa

SEQ ID NO: 505491 - DNA, 25 bp, Mus musculus
gatcaataccaggttccgagaggaa

SEQ ID NO: 505492 - DNA, 25 bp, Mus musculus
gatcaatagatcctcgctgtgtagt

SEQ ID NO: 505493 - DNA, 25 bp, Mus musculus
gatcaatagatcgtcgctgtgtagt

SEQ ID NO: 505494 - DNA, 25 bp, Mus musculus
gatcaatagctcctaagtgcttcag

SEQ ID NO: 505495 - DNA, 25 bp, Mus musculus
gatcaatagctcgtaagtgcttcag

SEQ ID NO: 505496 - DNA, 25 bp, Mus musculus
gatcaatatgtaaagccaggaagtt

SEQ ID NO: 505497 - DNA, 25 bp, Mus musculus
gatcaatatgtatagccaggaagtt

SEQ ID NO: 505498 - DNA, 25 bp, Mus musculus
gatcaatattcaaagcctcacacca

SEQ ID NO: 505499 - DNA, 25 bp, Mus musculus
gatcaatattcatagcctcacacca

SEQ ID NO: 505500 - DNA, 25 bp, Mus musculus
gatcaatccactacaccttgtttaa

SEQ ID NO: 505501 - DNA, 25 bp, Mus musculus
gatcaatccacttcaccttgtttaa

SEQ ID NO: 505502 - DNA, 25 bp, Mus musculus
gatcaatccataccatgagcttccg

SEQ ID NO: 505503 - DNA, 25 bp, Mus musculus
gatcaatccatagcatgagcttccg

SEQ ID NO: 505504 - DNA, 25 bp, Mus musculus
gatcaatccccaataccacagaaga

SEQ ID NO: 505505 - DNA, 25 bp, Mus musculus
gatcaatccccattaccacagaaga

SEQ ID NO: 505506 - DNA, 25 bp, Mus musculus
gatcaatccttccaatccactcaag

SEQ ID NO: 505507 - DNA, 25 bp, Mus musculus
gatcaatccttcgaatccactcaag

SEQ ID NO: 505508 - DNA, 25 bp, Mus musculus
gatcaatgactcaatcccttgtaaa

SEQ ID NO: 505509 - DNA, 25 bp, Mus musculus
gatcaatgactctatcccttgtaaa

SEQ ID NO: 505510 - DNA, 25 bp, Mus musculus
gatcaatgaggcctttgcaagtcag

SEQ ID NO: 505511 - DNA, 25 bp, Mus musculus
gatcaatgaggcgtttgcaagtcag

SEQ ID NO: 505512 - DNA, 25 bp, Mus musculus
gatcaatggcctaatctgttacaca

SEQ ID NO: 505513 - DNA, 25 bp, Mus musculus
gatcaatggccttatctgttacaca

SEQ ID NO: 505514 - DNA, 25 bp, Mus musculus
gatcaatggcttacagatggtcttc

SEQ ID NO: 505515 - DNA, 25 bp, Mus musculus
gatcaatggctttcagatggtcttc

SEQ ID NO: 505516 - DNA, 25 bp, Mus musculus
gatcaatgggctcagtcaagtacat

SEQ ID NO: 505517 - DNA, 25 bp, Mus musculus
gatcaatgggctgagtcaagtacat

SEQ ID NO: 505518 - DNA, 25 bp, Mus musculus
gatcaatgtctaaaagcgcttttac

SEQ ID NO: 505519 - DNA, 25 bp, Mus musculus
gatcaatgtctataagcgcttttac

SEQ ID NO: 505520 - DNA, 25 bp, Mus musculus
gatcaatgtcttacagcattgcttt

SEQ ID NO: 505521 - DNA, 25 bp, Mus musculus
gatcaatgtctttcagcattgcttt

SEQ ID NO: 505522 - DNA, 25 bp, Mus musculus
gatcaatgtgttcaagcaggtagca

SEQ ID NO: 505523 - DNA, 25 bp, Mus musculus
gatcaatgtgttgaagcaggtagca

SEQ ID NO: 505524 - DNA, 25 bp, Mus musculus
gatcaattacagatggatggatgca

SEQ ID NO: 505525 - DNA, 25 bp, Mus musculus
gatcaattacagttggatggatgca

SEQ ID NO: 505526 - DNA, 25 bp, Mus musculus
gatcaattagtcagttcttttaggg

SEQ ID NO: 505527 - DNA, 25 bp, Mus musculus
gatcaattagtctgttcttttaggg

SEQ ID NO: 505528 - DNA, 25 bp, Mus musculus
gatcaattctgtaattctacaacca

SEQ ID NO: 505529 - DNA, 25 bp, Mus musculus
gatcaattctgttattctacaacca

SEQ ID NO: 505530 - DNA, 25 bp, Mus musculus
gatcaattgagtctaatgaccttgt

SEQ ID NO: 505531 - DNA, 25 bp, Mus musculus
gatcaattgagtgtaatgaccttgt

SEQ ID NO: 505532 - DNA, 25 bp, Mus musculus
gatcaattgcttatggtttccgagt

SEQ ID NO: 505533 - DNA, 25 bp, Mus musculus
gatcaattgcttttggtttccgagt

SEQ ID NO: 505534 - DNA, 25 bp, Mus musculus
gatcaattggttcaggccgcgctct

SEQ ID NO: 505535 - DNA, 25 bp, Mus musculus
gatcaattggttgaggccgcgctct

SEQ ID NO: 505536 - DNA, 25 bp, Mus musculus
gatcaatttacgcaaagcactggtg

SEQ ID NO: 505537 - DNA, 25 bp, Mus musculus
gatcaatttacggaaagcactggtg

SEQ ID NO: 505538 - DNA, 25 bp, Mus musculus
gatcaattttacatgtggtaggtat

SEQ ID NO: 505539 - DNA, 25 bp, Mus musculus
gatcaattttacttgtggtaggtat

SEQ ID NO: 505540 - DNA, 25 bp, Mus musculus
gatcacaaccagatgttccaatatt

SEQ ID NO: 505541 - DNA, 25 bp, Mus musculus
gatcacaaccagttgttccaatatt

SEQ ID NO: 505542 - DNA, 25 bp, Mus musculus
gatcacaagagacttgcaactttcc

SEQ ID NO: 505543 - DNA, 25 bp, Mus musculus
gatcacaagagagttgcaactttcc

SEQ ID NO: 505544 - DNA, 25 bp, Mus musculus
gatcacaagagtaactagtttcttt

SEQ ID NO: 505545 - DNA, 25 bp, Mus musculus
gatcacaagagttactagtttcttt

SEQ ID NO: 505546 - DNA, 25 bp, Mus musculus
gatcacaagggcactaaactcacaa

SEQ ID NO: 505547 - DNA, 25 bp, Mus musculus
gatcacaagggctctaaactcacaa

SEQ ID NO: 505548 - DNA, 25 bp, Mus musculus
gatcacaaggttccaggttacccct

SEQ ID NO: 505549 - DNA, 25 bp, Mus musculus
gatcacaaggttgcaggttacccct

SEQ ID NO: 505550 - DNA, 25 bp, Mus musculus
gatcacaagtaaatgttgtccatta

SEQ ID NO: 505551 - DNA, 25 bp, Mus musculus
gatcacaagtaattgttgtccatta

SEQ ID NO: 505552 - DNA, 25 bp, Mus musculus
gatcacaatctactcaatgccagct

SEQ ID NO: 505553 - DNA, 25 bp, Mus musculus
gatcacaatctagtcaatgccagct

SEQ ID NO: 505554 - DNA, 25 bp, Mus musculus
gatcacacagcgctaggatgacact

SEQ ID NO: 505555 - DNA, 25 bp, Mus musculus
gatcacacagcggtaggatgacact

SEQ ID NO: 505556 - DNA, 25 bp, Mus musculus
gatcacacagctcgagaccactcaa

SEQ ID NO: 505557 - DNA, 25 bp, Mus musculus
gatcacacagctggagaccactcaa

SEQ ID NO: 505558 - DNA, 25 bp, Mus musculus
gatcacacgcagagacgcggaagat

SEQ ID NO: 505559 - DNA, 25 bp, Mus musculus
gatcacacgcagtgacgcggaagat

SEQ ID NO: 505560 - DNA, 25 bp, Mus musculus
gatcacacggcaaaacagtaccttt

SEQ ID NO: 505561 - DNA, 25 bp, Mus musculus
gatcacacggcactcgaacatgaat

SEQ ID NO: 505562 - DNA, 25 bp, Mus musculus
gatcacacggcagtcgaacatgaat

SEQ ID NO: 505563 - DNA, 25 bp, Mus musculus
gatcacacggcataacagtaccttt

SEQ ID NO: 505564 - DNA, 25 bp, Mus musculus
gatcacactgaacatgcctcaacat

SEQ ID NO: 505565 - DNA, 25 bp, Mus musculus
gatcacactgaagatgcctcaacat

SEQ ID NO: 505566 - DNA, 25 bp, Mus musculus
gatcacactggccatagcgggtcca

SEQ ID NO: 505567 - DNA, 25 bp, Mus musculus
gatcacactggcgatagcgggtcca

SEQ ID NO: 505568 - DNA, 25 bp, Mus musculus
gatcacactggtcagctctcagaac

SEQ ID NO: 505569 - DNA, 25 bp, Mus musculus
gatcacactggtgagctctcagaac

SEQ ID NO: 505570 - DNA, 25 bp, Mus musculus
gatcacactgtcagaggcgtacatt

SEQ ID NO: 505571 - DNA, 25 bp, Mus musculus
gatcacactgtctgaggcgtacatt

SEQ ID NO: 505572 - DNA, 25 bp, Mus musculus
gatcacagacaacaaataccttccg

SEQ ID NO: 505573 - DNA, 25 bp, Mus musculus
gatcacagacaagaaataccttccg

SEQ ID NO: 505574 - DNA, 25 bp, Mus musculus
gatcacagacgaatgtctctctctt

SEQ ID NO: 505575 - DNA, 25 bp, Mus musculus
gatcacagacgattgtctctctctt

SEQ ID NO: 505576 - DNA, 25 bp, Mus musculus
gatcacagatcgattctttttcccc

SEQ ID NO: 505577 - DNA, 25 bp, Mus musculus
gatcacagatcgtttctttttcccc

SEQ ID NO: 505578 - DNA, 25 bp, Mus musculus
gatcacagatttcaattgcatcagc

SEQ ID NO: 505579 - DNA, 25 bp, Mus musculus
gatcacagatttgaattgcatcagc

SEQ ID NO: 505580 - DNA, 25 bp, Mus musculus
gatcacagcaatccttacacatttt

SEQ ID NO: 505581 - DNA, 25 bp, Mus musculus
gatcacagcaatgcttacacatttt

SEQ ID NO: 505582 - DNA, 25 bp, Mus musculus
gatcacagcacaccttcattataga

SEQ ID NO: 505583 - DNA, 25 bp, Mus musculus
gatcacagcacagcttcattataga

SEQ ID NO: 505584 - DNA, 25 bp, Mus musculus
gatcacagcagtaaaggctcaatct

SEQ ID NO: 505585 - DNA, 25 bp, Mus musculus
gatcacagcagttaaggctcaatct

SEQ ID NO: 505586 - DNA, 25 bp, Mus musculus
gatcacagcataagcttgttttatg

SEQ ID NO: 505587 - DNA, 25 bp, Mus musculus
gatcacagcatatgcttgttttatg

SEQ ID NO: 505588 - DNA, 25 bp, Mus musculus
gatcacagccaaagagcagagccta

SEQ ID NO: 505589 - DNA, 25 bp, Mus musculus
gatcacagccaatgagcagagccta

SEQ ID NO: 505590 - DNA, 25 bp, Mus musculus
gatcacagcccacgcagcaaggtat

SEQ ID NO: 505591 - DNA, 25 bp, Mus musculus
gatcacagcccacttcatgatggag

SEQ ID NO: 505592 - DNA, 25 bp, Mus musculus
gatcacagcccaggcagcaaggtat

SEQ ID NO: 505593 - DNA, 25 bp, Mus musculus
gatcacagcccagttcatgatggag

SEQ ID NO: 505594 - DNA, 25 bp, Mus musculus
gatcacaggagtcctggagtccatt

SEQ ID NO: 505595 - DNA, 25 bp, Mus musculus
gatcacaggagtgctggagtccatt

SEQ ID NO: 505596 - DNA, 25 bp, Mus musculus
gatcacaggcttctgggagtcacgt

SEQ ID NO: 505597 - DNA, 25 bp, Mus musculus
gatcacaggcttgtgggagtcacgt

SEQ ID NO: 505598 - DNA, 25 bp, Mus musculus
gatcacagggatatggggcacagta

SEQ ID NO: 505599 - DNA, 25 bp, Mus musculus
gatcacagggatttggggcacagta

SEQ ID NO: 505600 - DNA, 25 bp, Mus musculus
gatcacaggtataggccacgatgcc

SEQ ID NO: 505601 - DNA, 25 bp, Mus musculus
gatcacaggtatatccattccaaag

SEQ ID NO: 505602 - DNA, 25 bp, Mus musculus
gatcacaggtattggccacgatgcc

SEQ ID NO: 505603 - DNA, 25 bp, Mus musculus
gatcacaggtatttccattccaaag

SEQ ID NO: 505604 - DNA, 25 bp, Mus musculus
gatcacaggtctagtacagttgctt

SEQ ID NO: 505605 - DNA, 25 bp, Mus musculus
gatcacaggtcttgtacagttgctt

SEQ ID NO: 505606 - DNA, 25 bp, Mus musculus
gatcacagtaataacatctcccact

SEQ ID NO: 505607 - DNA, 25 bp, Mus musculus
gatcacagtaattacatctcccact

SEQ ID NO: 505608 - DNA, 25 bp, Mus musculus
gatcacagtatcagactggactggc

SEQ ID NO: 505609 - DNA, 25 bp, Mus musculus
gatcacagtatctgactggactggc

SEQ ID NO: 505610 - DNA, 25 bp, Mus musculus
gatcacagtatgctattgggcttgt

SEQ ID NO: 505611 - DNA, 25 bp, Mus musculus
gatcacagtatggtattgggcttgt

SEQ ID NO: 505612 - DNA, 25 bp, Mus musculus
gatcacagttgtacattgtcttgca

SEQ ID NO: 505613 - DNA, 25 bp, Mus musculus
gatcacagttgtctaccgagttcag

SEQ ID NO: 505614 - DNA, 25 bp, Mus musculus
gatcacagttgtgtaccgagttcag

SEQ ID NO: 505615 - DNA, 25 bp, Mus musculus
gatcacagttgttcattgtcttgca

SEQ ID NO: 505616 - DNA, 25 bp, Mus musculus
gatcacagtttgatcatgtaagttc

SEQ ID NO: 505617 - DNA, 25 bp, Mus musculus
gatcacagtttgttcatgtaagttc

SEQ ID NO: 505618 - DNA, 25 bp, Mus musculus
gatcacagttttaatggtcctttta

SEQ ID NO: 505619 - DNA, 25 bp, Mus musculus
gatcacagtttttatggtcctttta

SEQ ID NO: 505620 - DNA, 25 bp, Mus musculus
gatcacatatctcatcagcacatgc

SEQ ID NO: 505621 - DNA, 25 bp, Mus musculus
gatcacatatctgatcagcacatgc

SEQ ID NO: 505622 - DNA, 25 bp, Mus musculus
gatcacatcacaagcaaagttctta

SEQ ID NO: 505623 - DNA, 25 bp, Mus musculus
gatcacatcacatgcaaagttctta

SEQ ID NO: 505624 - DNA, 25 bp, Mus musculus
gatcacatcctaatctaaatgaaga

SEQ ID NO: 505625 - DNA, 25 bp, Mus musculus
gatcacatcctacaggtcagctgag

SEQ ID NO: 505626 - DNA, 25 bp, Mus musculus
gatcacatcctagaggtcagctgag

SEQ ID NO: 505627 - DNA, 25 bp, Mus musculus
gatcacatcctattctaaatgaaga

SEQ ID NO: 505628 - DNA, 25 bp, Mus musculus
gatcacatcgataggctccttgaga

SEQ ID NO: 505629 - DNA, 25 bp, Mus musculus
gatcacatcgattggctccttgaga

SEQ ID NO: 505630 - DNA, 25 bp, Mus musculus
gatcacatcgtacgactccatggca

SEQ ID NO: 505631 - DNA, 25 bp, Mus musculus
gatcacatcgtaggactccatggca

SEQ ID NO: 505632 - DNA, 25 bp, Mus musculus
gatcacatctcccaaggtactgcag

SEQ ID NO: 505633 - DNA, 25 bp, Mus musculus
gatcacatctccgaaggtactgcag

SEQ ID NO: 505634 - DNA, 25 bp, Mus musculus
gatcacatctgcaggagcctctgga

SEQ ID NO: 505635 - DNA, 25 bp, Mus musculus
gatcacatctgctggagcctctgga

SEQ ID NO: 505636 - DNA, 25 bp, Mus musculus
gatcacatctggaaatcttgcttta

SEQ ID NO: 505637 - DNA, 25 bp, Mus musculus
gatcacatctggtaatcttgcttta

SEQ ID NO: 505638 - DNA, 25 bp, Mus musculus
gatcacatctttattctattttgca

SEQ ID NO: 505639 - DNA, 25 bp, Mus musculus
gatcacatcttttttctattttgca

SEQ ID NO: 505640 - DNA, 25 bp, Mus musculus
gatcacatgagaccgaggactaaat

SEQ ID NO: 505641 - DNA, 25 bp, Mus musculus
gatcacatgagagcgaggactaaat

SEQ ID NO: 505642 - DNA, 25 bp, Mus musculus
gatcacatgggtcgagggtttctct

SEQ ID NO: 505643 - DNA, 25 bp, Mus musculus
gatcacatgggtggagggtttctct

SEQ ID NO: 505644 - DNA, 25 bp, Mus musculus
gatcacatgtatatgtcttccctgc

SEQ ID NO: 505645 - DNA, 25 bp, Mus musculus
gatcacatgtatttgtcttccctgc

SEQ ID NO: 505646 - DNA, 25 bp, Mus musculus
gatcacattaacatgatttcttatc

SEQ ID NO: 505647 - DNA, 25 bp, Mus musculus
gatcacattaacttgatttcttatc

SEQ ID NO: 505648 - DNA, 25 bp, Mus musculus
gatcacattcagatatggtttgcac

SEQ ID NO: 505649 - DNA, 25 bp, Mus musculus
gatcacattcagttatggtttgcac

SEQ ID NO: 505650 - DNA, 25 bp, Mus musculus
gatcaccaaagcagccaagtgctgt

SEQ ID NO: 505651 - DNA, 25 bp, Mus musculus
gatcaccaaagctgccaagtgctgt

SEQ ID NO: 505652 - DNA, 25 bp, Mus musculus
gatcaccaagcaatcttgatggccc

SEQ ID NO: 505653 - DNA, 25 bp, Mus musculus
gatcaccaagcattcttgatggccc

SEQ ID NO: 505654 - DNA, 25 bp, Mus musculus
gatcaccaagtgctaatacttctac

SEQ ID NO: 505655 - DNA, 25 bp, Mus musculus
gatcaccaagtgctccttaggtttt

SEQ ID NO: 505656 - DNA, 25 bp, Mus musculus
gatcaccaagtggtaatacttctac

SEQ ID NO: 505657 - DNA, 25 bp, Mus musculus
gatcaccaagtggtccttaggtttt

SEQ ID NO: 505658 - DNA, 25 bp, Mus musculus
gatcaccacacacgcgtgtgttcat

SEQ ID NO: 505659 - DNA, 25 bp, Mus musculus
gatcaccacacaggcgtgtgttcat

SEQ ID NO: 505660 - DNA, 25 bp, Mus musculus
gatcaccactgacagagggttcaca

SEQ ID NO: 505661 - DNA, 25 bp, Mus musculus
gatcaccactgagagagggttcaca

SEQ ID NO: 505662 - DNA, 25 bp, Mus musculus
gatcaccagcaactcgtctaattga

SEQ ID NO: 505663 - DNA, 25 bp, Mus musculus
gatcaccagcaagtcgtctaattga

SEQ ID NO: 505664 - DNA, 25 bp, Mus musculus
gatcaccagggtcatacccttgtat

SEQ ID NO: 505665 - DNA, 25 bp, Mus musculus
gatcaccagggtgatacccttgtat

SEQ ID NO: 505666 - DNA, 25 bp, Mus musculus
gatcaccaggtcaactagagtcacg

SEQ ID NO: 505667 - DNA, 25 bp, Mus musculus
gatcaccaggtctactagagtcacg

SEQ ID NO: 505668 - DNA, 25 bp, Mus musculus
gatcaccaggtgatcaaagtgagac

SEQ ID NO: 505669 - DNA, 25 bp, Mus musculus
gatcaccaggtgttcaaagtgagac

SEQ ID NO: 505670 - DNA, 25 bp, Mus musculus
gatcaccagtagacggtgtccctgg

SEQ ID NO: 505671 - DNA, 25 bp, Mus musculus
gatcaccagtagtcggtgtccctgg

SEQ ID NO: 505672 - DNA, 25 bp, Mus musculus
gatcaccagtttctaagttcaagat

SEQ ID NO: 505673 - DNA, 25 bp, Mus musculus
gatcaccagtttgtaagttcaagat

SEQ ID NO: 505674 - DNA, 25 bp, Mus musculus
gatcaccatagaagacgttggagca

SEQ ID NO: 505675 - DNA, 25 bp, Mus musculus
gatcaccatagatgacgttggagca

SEQ ID NO: 505676 - DNA, 25 bp, Mus musculus
gatcaccatagtctatctgactggg

SEQ ID NO: 505677 - DNA, 25 bp, Mus musculus
gatcaccatagtgtatctgactggg

SEQ ID NO: 505678 - DNA, 25 bp, Mus musculus
gatcaccatatcaagttttcctaag

SEQ ID NO: 505679 - DNA, 25 bp, Mus musculus
gatcaccatatctagttttcctaag

SEQ ID NO: 505680 - DNA, 25 bp, Mus musculus
gatcaccatcgtcgcgggagtgctt

SEQ ID NO: 505681 - DNA, 25 bp, Mus musculus
gatcaccatcgtggcgggagtgctt

SEQ ID NO: 505682 - DNA, 25 bp, Mus musculus
gatcaccattaaatccccagaaaga

SEQ ID NO: 505683 - DNA, 25 bp, Mus musculus
gatcaccattaattccccagaaaga

SEQ ID NO: 505684 - DNA, 25 bp, Mus musculus
gatcaccatttcctaactggaccag

SEQ ID NO: 505685 - DNA, 25 bp, Mus musculus
gatcaccatttcgtaactggaccag

SEQ ID NO: 505686 - DNA, 25 bp, Mus musculus
gatcaccatttgatctttgtggcat

SEQ ID NO: 505687 - DNA, 25 bp, Mus musculus
gatcaccatttgttctttgtggcat

SEQ ID NO: 505688 - DNA, 25 bp, Mus musculus
gatcacccagagcatggtgtgcgca

SEQ ID NO: 505689 - DNA, 25 bp, Mus musculus
gatcacccagaggatggtgtgcgca

SEQ ID NO: 505690 - DNA, 25 bp, Mus musculus
gatcacccagatccagggtgcctga

SEQ ID NO: 505691 - DNA, 25 bp, Mus musculus
gatcacccagatgcagggtgcctga

SEQ ID NO: 505692 - DNA, 25 bp, Mus musculus
gatcacccattccagaacacacgtg

SEQ ID NO: 505693 - DNA, 25 bp, Mus musculus
gatcacccattcgagaacacacgtg

SEQ ID NO: 505694 - DNA, 25 bp, Mus musculus
gatcacccctttctggtcttcatgc

SEQ ID NO: 505695 - DNA, 25 bp, Mus musculus
gatcacccctttgtggtcttcatgc

SEQ ID NO: 505696 - DNA, 25 bp, Mus musculus
gatcaccctcagctgcaggtacagt

SEQ ID NO: 505697 - DNA, 25 bp, Mus musculus
gatcaccctcaggtgcaggtacagt

SEQ ID NO: 505698 - DNA, 25 bp, Mus musculus
gatcaccctgaccttatccagaatg

SEQ ID NO: 505699 - DNA, 25 bp, Mus musculus
gatcaccctgacgttatccagaatg

SEQ ID NO: 505700 - DNA, 25 bp, Mus musculus
gatcaccctgtcatgtacaatgagg

SEQ ID NO: 505701 - DNA, 25 bp, Mus musculus
gatcaccctgtcttgtacaatgagg

SEQ ID NO: 505702 - DNA, 25 bp, Mus musculus
gatcacccttgcataaactctaatt

SEQ ID NO: 505703 - DNA, 25 bp, Mus musculus
gatcacccttgcttaaactctaatt

SEQ ID NO: 505704 - DNA, 25 bp, Mus musculus
gatcaccgtgtacctgaggcgctga

SEQ ID NO: 505705 - DNA, 25 bp, Mus musculus
gatcaccgtgtagctgaggcgctga

SEQ ID NO: 505706 - DNA, 25 bp, Mus musculus
gatcaccgttgtaccagagcactgt

SEQ ID NO: 505707 - DNA, 25 bp, Mus musculus
gatcaccgttgttccagagcactgt

SEQ ID NO: 505708 - DNA, 25 bp, Mus musculus
gatcacctaacgaaatggacctttg

SEQ ID NO: 505709 - DNA, 25 bp, Mus musculus
gatcacctaacgtaatggacctttg

SEQ ID NO: 505710 - DNA, 25 bp, Mus musculus
gatcacctagtcctgggtgtgctaa

SEQ ID NO: 505711 - DNA, 25 bp, Mus musculus
gatcacctagtcgtgggtgtgctaa

SEQ ID NO: 505712 - DNA, 25 bp, Mus musculus
gatcacctcactcaacagagacagt

SEQ ID NO: 505713 - DNA, 25 bp, Mus musculus
gatcacctcactgaacagagacagt

SEQ ID NO: 505714 - DNA, 25 bp, Mus musculus
gatcacctcttacacctggttttaa

SEQ ID NO: 505715 - DNA, 25 bp, Mus musculus
gatcacctcttagacctggttttaa

SEQ ID NO: 505716 - DNA, 25 bp, Mus musculus
gatcacctgaaccaccggatcagtg

SEQ ID NO: 505717 - DNA, 25 bp, Mus musculus
gatcacctgaacgaccggatcagtg

SEQ ID NO: 505718 - DNA, 25 bp, Mus musculus
gatcacctgcaacagttactgaaga

SEQ ID NO: 505719 - DNA, 25 bp, Mus musculus
gatcacctgcaagagttactgaaga

SEQ ID NO: 505720 - DNA, 25 bp, Mus musculus
gatcacctgcttcaccctctgagtg

SEQ ID NO: 505721 - DNA, 25 bp, Mus musculus
gatcacctgcttgaccctctgagtg

SEQ ID NO: 505722 - DNA, 25 bp, Mus musculus
gatcaccttatcatgcctaaacttt

SEQ ID NO: 505723 - DNA, 25 bp, Mus musculus
gatcaccttatcttgcctaaacttt

SEQ ID NO: 505724 - DNA, 25 bp, Mus musculus
gatcaccttatgctaaagcctcaga

SEQ ID NO: 505725 - DNA, 25 bp, Mus musculus
gatcaccttatggtaaagcctcaga

SEQ ID NO: 505726 - DNA, 25 bp, Mus musculus
gatcacctttcacacatgattagtt

SEQ ID NO: 505727 - DNA, 25 bp, Mus musculus
gatcacctttcagacatgattagtt

SEQ ID NO: 505728 - DNA, 25 bp, Mus musculus
gatcacctttgaaataacccgtatt

SEQ ID NO: 505729 - DNA, 25 bp, Mus musculus
gatcacctttgacagcatgattgta

SEQ ID NO: 505730 - DNA, 25 bp, Mus musculus
gatcacctttgagagcatgattgta

SEQ ID NO: 505731 - DNA, 25 bp, Mus musculus
gatcacctttgatataacccgtatt

SEQ ID NO: 505732 - DNA, 25 bp, Mus musculus
gatcacgaagaacaagagaaagtca

SEQ ID NO: 505733 - DNA, 25 bp, Mus musculus
gatcacgaagaagaagagaaagtca

SEQ ID NO: 505734 - DNA, 25 bp, Mus musculus
gatcacgagaatcacatcctatgac

SEQ ID NO: 505735 - DNA, 25 bp, Mus musculus
gatcacgagaatgacatcctatgac

SEQ ID NO: 505736 - DNA, 25 bp, Mus musculus
gatcacgagattagtgctgcctgtt

SEQ ID NO: 505737 - DNA, 25 bp, Mus musculus
gatcacgagatttgtgctgcctgtt

SEQ ID NO: 505738 - DNA, 25 bp, Mus musculus
gatcacgatacactgtttaagtcca

SEQ ID NO: 505739 - DNA, 25 bp, Mus musculus
gatcacgatacagtgtttaagtcca

SEQ ID NO: 505740 - DNA, 25 bp, Mus musculus
gatcacgattccagaaaccactttc

SEQ ID NO: 505741 - DNA, 25 bp, Mus musculus
gatcacgattcctgaaaccactttc

SEQ ID NO: 505742 - DNA, 25 bp, Mus musculus
gatcacgcagttagctgggttatac

SEQ ID NO: 505743 - DNA, 25 bp, Mus musculus
gatcacgcagtttgctgggttatac

SEQ ID NO: 505744 - DNA, 25 bp, Mus musculus
gatcacgcccggagtagaagcgcat

SEQ ID NO: 505745 - DNA, 25 bp, Mus musculus
gatcacgcccggtgtagaagcgcat

SEQ ID NO: 505746 - DNA, 25 bp, Mus musculus
gatcacgcgtccagatgtgcaggat

SEQ ID NO: 505747 - DNA, 25 bp, Mus musculus
gatcacgcgtcctgatgtgcaggat

SEQ ID NO: 505748 - DNA, 25 bp, Mus musculus
gatcacgctggtctctagtggaagc

SEQ ID NO: 505749 - DNA, 25 bp, Mus musculus
gatcacgctggtgtctagtggaagc

SEQ ID NO: 505750 - DNA, 25 bp, Mus musculus
gatcacggagatcgccaaggagctc

SEQ ID NO: 505751 - DNA, 25 bp, Mus musculus
gatcacggagatggccaaggagctc

SEQ ID NO: 505752 - DNA, 25 bp, Mus musculus
gatcacgggcatcttgctggacatt

SEQ ID NO: 505753 - DNA, 25 bp, Mus musculus
gatcacgggcatgttgctggacatt

SEQ ID NO: 505754 - DNA, 25 bp, Mus musculus
gatcacggtcgacagtttgcaaaat

SEQ ID NO: 505755 - DNA, 25 bp, Mus musculus
gatcacggtcgagagtttgcaaaat

SEQ ID NO: 505756 - DNA, 25 bp, Mus musculus
gatcacggtggcagcttccagggta

SEQ ID NO: 505757 - DNA, 25 bp, Mus musculus
gatcacggtggctgcttccagggta

SEQ ID NO: 505758 - DNA, 25 bp, Mus musculus
gatcacgtaattacgtttctgaaac

SEQ ID NO: 505759 - DNA, 25 bp, Mus musculus
gatcacgtaatttcgtttctgaaac

SEQ ID NO: 505760 - DNA, 25 bp, Mus musculus
gatcacgtacctcgacctgaaggaa

SEQ ID NO: 505761 - DNA, 25 bp, Mus musculus
gatcacgtacctggacctgaaggaa

SEQ ID NO: 505762 - DNA, 25 bp, Mus musculus
gatcacgtctgaaaccactagtact

SEQ ID NO: 505763 - DNA, 25 bp, Mus musculus
gatcacgtctgataccactagtact

SEQ ID NO: 505764 - DNA, 25 bp, Mus musculus
gatcacgtgcatatggaactccgtt

SEQ ID NO: 505765 - DNA, 25 bp, Mus musculus
gatcacgtgcatttggaactccgtt

SEQ ID NO: 505766 - DNA, 25 bp, Mus musculus
gatcacgtggctcttcttgtagttt

SEQ ID NO: 505767 - DNA, 25 bp, Mus musculus
gatcacgtggctgttcttgtagttt

SEQ ID NO: 505768 - DNA, 25 bp, Mus musculus
gatcacgtgggcagcgtttctgtaa

SEQ ID NO: 505769 - DNA, 25 bp, Mus musculus
gatcacgtgggctgcgtttctgtaa

SEQ ID NO: 505770 - DNA, 25 bp, Mus musculus
gatcacgttctgattgagctcaccc

SEQ ID NO: 505771 - DNA, 25 bp, Mus musculus
gatcacgttctgtttgagctcaccc

SEQ ID NO: 505772 - DNA, 25 bp, Mus musculus
gatcactaactcatatgtatgctta

SEQ ID NO: 505773 - DNA, 25 bp, Mus musculus
gatcactaactcttatgtatgctta

SEQ ID NO: 505774 - DNA, 25 bp, Mus musculus
gatcactaagataaactatatctat

SEQ ID NO: 505775 - DNA, 25 bp, Mus musculus
gatcactaagattaactatatctat

SEQ ID NO: 505776 - DNA, 25 bp, Mus musculus
gatcactaaggaagtggtgctccaa

SEQ ID NO: 505777 - DNA, 25 bp, Mus musculus
gatcactaaggatgtggtgctccaa

SEQ ID NO: 505778 - DNA, 25 bp, Mus musculus
gatcactaaggccaaatattttctc

SEQ ID NO: 505779 - DNA, 25 bp, Mus musculus
gatcactaaggcgaaatattttctc

SEQ ID NO: 505780 - DNA, 25 bp, Mus musculus
gatcactaatctcgactggtgggtt

SEQ ID NO: 505781 - DNA, 25 bp, Mus musculus
gatcactaatctggactggtgggtt

SEQ ID NO: 505782 - DNA, 25 bp, Mus musculus
gatcactaccgtagcatcttgctta

SEQ ID NO: 505783 - DNA, 25 bp, Mus musculus
gatcactaccgttgcatcttgctta

SEQ ID NO: 505784 - DNA, 25 bp, Mus musculus
gatcactagaagaacctctacccct

SEQ ID NO: 505785 - DNA, 25 bp, Mus musculus
gatcactagaagtacctctacccct

SEQ ID NO: 505786 - DNA, 25 bp, Mus musculus
gatcactagaccaaaaattcccaag

SEQ ID NO: 505787 - DNA, 25 bp, Mus musculus
gatcactagacctaaaattcccaag

SEQ ID NO: 505788 - DNA, 25 bp, Mus musculus
gatcactagataattttgcctgtag

SEQ ID NO: 505789 - DNA, 25 bp, Mus musculus
gatcactagatatttttgcctgtag

SEQ ID NO: 505790 - DNA, 25 bp, Mus musculus
gatcactagattaggctttcggtca

SEQ ID NO: 505791 - DNA, 25 bp, Mus musculus
gatcactagatttggctttcggtca

SEQ ID NO: 505792 - DNA, 25 bp, Mus musculus
gatcactaggctcgtgctaatggtg

SEQ ID NO: 505793 - DNA, 25 bp, Mus musculus
gatcactaggctggtgctaatggtg

SEQ ID NO: 505794 - DNA, 25 bp, Mus musculus
gatcactaggtcattggcgttctaa

SEQ ID NO: 505795 - DNA, 25 bp, Mus musculus
gatcactaggtctttggcgttctaa

SEQ ID NO: 505796 - DNA, 25 bp, Mus musculus
gatcactagtaaagccatgttttcc

SEQ ID NO: 505797 - DNA, 25 bp, Mus musculus
gatcactagtaatgccatgttttcc

SEQ ID NO: 505798 - DNA, 25 bp, Mus musculus
gatcactatacaattgttctatgct

SEQ ID NO: 505799 - DNA, 25 bp, Mus musculus
gatcactatacatttgttctatgct

SEQ ID NO: 505800 - DNA, 25 bp, Mus musculus
gatcactatattacagccaccagag

SEQ ID NO: 505801 - DNA, 25 bp, Mus musculus
gatcactatatttcagccaccagag

SEQ ID NO: 505802 - DNA, 25 bp, Mus musculus
gatcactatcaacgctatgctgagg

SEQ ID NO: 505803 - DNA, 25 bp, Mus musculus
gatcactatcaaggctatgctgagg

SEQ ID NO: 505804 - DNA, 25 bp, Mus musculus
gatcactatctccagctttgttgtg

SEQ ID NO: 505805 - DNA, 25 bp, Mus musculus
gatcactatctcgagctttgttgtg

SEQ ID NO: 505806 - DNA, 25 bp, Mus musculus
gatcactcagcaagccttagacaag

SEQ ID NO: 505807 - DNA, 25 bp, Mus musculus
gatcactcagcatgccttagacaag

SEQ ID NO: 505808 - DNA, 25 bp, Mus musculus
gatcactcagcccttgagcagtgca

SEQ ID NO: 505809 - DNA, 25 bp, Mus musculus
gatcactcagccgttgagcagtgca

SEQ ID NO: 505810 - DNA, 25 bp, Mus musculus
gatcactcaggcaaaattgtggctt

SEQ ID NO: 505811 - DNA, 25 bp, Mus musculus
gatcactcaggctaaattgtggctt

SEQ ID NO: 505812 - DNA, 25 bp, Mus musculus
gatcactccactcatatcaagcagt

SEQ ID NO: 505813 - DNA, 25 bp, Mus musculus
gatcactccactgatatcaagcagt

SEQ ID NO: 505814 - DNA, 25 bp, Mus musculus
gatcactcgtttatggttggcctag

SEQ ID NO: 505815 - DNA, 25 bp, Mus musculus
gatcactcgtttttggttggcctag

SEQ ID NO: 505816 - DNA, 25 bp, Mus musculus
gatcactctcagatctaaaaaatcc

SEQ ID NO: 505817 - DNA, 25 bp, Mus musculus
gatcactctcagttctaaaaaatcc

SEQ ID NO: 505818 - DNA, 25 bp, Mus musculus
gatcactcttcaacgttatctcttt

SEQ ID NO: 505819 - DNA, 25 bp, Mus musculus
gatcactcttcatcgttatctcttt

SEQ ID NO: 505820 - DNA, 25 bp, Mus musculus
gatcactcttctcccaaattgtata

SEQ ID NO: 505821 - DNA, 25 bp, Mus musculus
gatcactcttctgccaaattgtata

SEQ ID NO: 505822 - DNA, 25 bp, Mus musculus
gatcactctttaagtttggcctacg

SEQ ID NO: 505823 - DNA, 25 bp, Mus musculus
gatcactctttatgtttggcctacg

SEQ ID NO: 505824 - DNA, 25 bp, Mus musculus
gatcactgaaacaggatgatcagtt

SEQ ID NO: 505825 - DNA, 25 bp, Mus musculus
gatcactgaaactggatgatcagtt

SEQ ID NO: 505826 - DNA, 25 bp, Mus musculus
gatcactgaacaactcgttacctgc

SEQ ID NO: 505827 - DNA, 25 bp, Mus musculus
gatcactgaacatctcgttacctgc

SEQ ID NO: 505828 - DNA, 25 bp, Mus musculus
gatcactgaagcctgagtccatgca

SEQ ID NO: 505829 - DNA, 25 bp, Mus musculus
gatcactgaagcgtgagtccatgca

SEQ ID NO: 505830 - DNA, 25 bp, Mus musculus
gatcactgaattcgaggccatcctg

SEQ ID NO: 505831 - DNA, 25 bp, Mus musculus
gatcactgaattggaggccatcctg

SEQ ID NO: 505832 - DNA, 25 bp, Mus musculus
gatcactgacagctttcactctgaa

SEQ ID NO: 505833 - DNA, 25 bp, Mus musculus
gatcactgacaggtttcactctgaa

SEQ ID NO: 505834 - DNA, 25 bp, Mus musculus
gatcactgataaatcctcacttcta

SEQ ID NO: 505835 - DNA, 25 bp, Mus musculus
gatcactgataattcctcacttcta

SEQ ID NO: 505836 - DNA, 25 bp, Mus musculus
gatcactgatatatattgtctggca

SEQ ID NO: 505837 - DNA, 25 bp, Mus musculus
gatcactgatatttattgtctggca

SEQ ID NO: 505838 - DNA, 25 bp, Mus musculus
gatcactgctggcttatttctattt

SEQ ID NO: 505839 - DNA, 25 bp, Mus musculus
gatcactgctgggttatttctattt

SEQ ID NO: 505840 - DNA, 25 bp, Mus musculus
gatcactgctgtaggaaagccccat

SEQ ID NO: 505841 - DNA, 25 bp, Mus musculus
gatcactgctgttggaaagccccat

SEQ ID NO: 505842 - DNA, 25 bp, Mus musculus
gatcactgctttcaaggtcatcctg

SEQ ID NO: 505843 - DNA, 25 bp, Mus musculus
gatcactgctttgaaggtcatcctg

SEQ ID NO: 505844 - DNA, 25 bp, Mus musculus
gatcactggcagcactactaccaat

SEQ ID NO: 505845 - DNA, 25 bp, Mus musculus
gatcactggcaggactactaccaat

SEQ ID NO: 505846 - DNA, 25 bp, Mus musculus
gatcactgggccatgtggaagcatt

SEQ ID NO: 505847 - DNA, 25 bp, Mus musculus
gatcactgggccttgtggaagcatt

SEQ ID NO: 505848 - DNA, 25 bp, Mus musculus
gatcactgtaatactaacacaatgg

SEQ ID NO: 505849 - DNA, 25 bp, Mus musculus
gatcactgtaattctaacacaatgg

SEQ ID NO: 505850 - DNA, 25 bp, Mus musculus
gatcactgtactatcacttccaaag

SEQ ID NO: 505851 - DNA, 25 bp, Mus musculus
gatcactgtactttcacttccaaag

SEQ ID NO: 505852 - DNA, 25 bp, Mus musculus
gatcactgtatccagatgacgtctt

SEQ ID NO: 505853 - DNA, 25 bp, Mus musculus
gatcactgtatcgagatgacgtctt

SEQ ID NO: 505854 - DNA, 25 bp, Mus musculus
gatcactgtcacatcagaggtgcct

SEQ ID NO: 505855 - DNA, 25 bp, Mus musculus
gatcactgtcacttcagaggtgcct

SEQ ID NO: 505856 - DNA, 25 bp, Mus musculus
gatcactgtcttaagttgttccaac

SEQ ID NO: 505857 - DNA, 25 bp, Mus musculus
gatcactgtcttctgtggtctgact

SEQ ID NO: 505858 - DNA, 25 bp, Mus musculus
gatcactgtcttgtgtggtctgact

SEQ ID NO: 505859 - DNA, 25 bp, Mus musculus
gatcactgtctttagttgttccaac

SEQ ID NO: 505860 - DNA, 25 bp, Mus musculus
gatcactgtgaaaccagttccagga

SEQ ID NO: 505861 - DNA, 25 bp, Mus musculus
gatcactgtgaatccagttccagga

SEQ ID NO: 505862 - DNA, 25 bp, Mus musculus
gatcactgtgagatttgcacatgga

SEQ ID NO: 505863 - DNA, 25 bp, Mus musculus
gatcactgtgagttttgcacatgga

SEQ ID NO: 505864 - DNA, 25 bp, Mus musculus
gatcacttagacaaattctcacctt

SEQ ID NO: 505865 - DNA, 25 bp, Mus musculus
gatcacttagaccagccctaaattc

SEQ ID NO: 505866 - DNA, 25 bp, Mus musculus
gatcacttagacgagccctaaattc

SEQ ID NO: 505867 - DNA, 25 bp, Mus musculus
gatcacttagactaattctcacctt

SEQ ID NO: 505868 - DNA, 25 bp, Mus musculus
gatcacttagagaccttcattgcag

SEQ ID NO: 505869 - DNA, 25 bp, Mus musculus
gatcacttagagtccttcattgcag

SEQ ID NO: 505870 - DNA, 25 bp, Mus musculus
gatcacttaggcctagaaggtcttt

SEQ ID NO: 505871 - DNA, 25 bp, Mus musculus
gatcacttaggcgtagaaggtcttt

SEQ ID NO: 505872 - DNA, 25 bp, Mus musculus
gatcacttagtgagtctcctagttc

SEQ ID NO: 505873 - DNA, 25 bp, Mus musculus
gatcacttagtgtgtctcctagttc

SEQ ID NO: 505874 - DNA, 25 bp, Mus musculus
gatcacttatcaaccattcggtatg

SEQ ID NO: 505875 - DNA, 25 bp, Mus musculus
gatcacttatcatccattcggtatg

SEQ ID NO: 505876 - DNA, 25 bp, Mus musculus
gatcacttccggagaaaacccactt

SEQ ID NO: 505877 - DNA, 25 bp, Mus musculus
gatcacttccggtgaaaacccactt

SEQ ID NO: 505878 - DNA, 25 bp, Mus musculus
gatcacttctagaagtaatggctca

SEQ ID NO: 505879 - DNA, 25 bp, Mus musculus
gatcacttctagtagtaatggctca

SEQ ID NO: 505880 - DNA, 25 bp, Mus musculus
gatcacttgaaaactttggcattta

SEQ ID NO: 505881 - DNA, 25 bp, Mus musculus
gatcacttgaaatctttggcattta

SEQ ID NO: 505882 - DNA, 25 bp, Mus musculus
gatcacttgatgactcactggaacc

SEQ ID NO: 505883 - DNA, 25 bp, Mus musculus
gatcacttgatgtctcactggaacc

SEQ ID NO: 505884 - DNA, 25 bp, Mus musculus
gatcacttgattacttgtgcacctg

SEQ ID NO: 505885 - DNA, 25 bp, Mus musculus
gatcacttgatttcttgtgcacctg

SEQ ID NO: 505886 - DNA, 25 bp, Mus musculus
gatcacttggcaatctattccacga

SEQ ID NO: 505887 - DNA, 25 bp, Mus musculus
gatcacttggcattctattccacga

SEQ ID NO: 505888 - DNA, 25 bp, Mus musculus
gatcacttgggaagagactgaccat

SEQ ID NO: 505889 - DNA, 25 bp, Mus musculus
gatcacttgggatgagactgaccat

SEQ ID NO: 505890 - DNA, 25 bp, Mus musculus
gatcacttggtacacagcaggcaga

SEQ ID NO: 505891 - DNA, 25 bp, Mus musculus
gatcacttggtagacagcaggcaga

SEQ ID NO: 505892 - DNA, 25 bp, Mus musculus
gatcacttgtgcagccaaagaccaa

SEQ ID NO: 505893 - DNA, 25 bp, Mus musculus
gatcacttgtgctgccaaagaccaa

SEQ ID NO: 505894 - DNA, 25 bp, Mus musculus
gatcactttcttaagtcacaataaa

SEQ ID NO: 505895 - DNA, 25 bp, Mus musculus
gatcactttctttagtcacaataaa

SEQ ID NO: 505896 - DNA, 25 bp, Mus musculus
gatcacttttatcaagccattctaa

SEQ ID NO: 505897 - DNA, 25 bp, Mus musculus
gatcacttttatgaagccattctaa

SEQ ID NO: 505898 - DNA, 25 bp, Mus musculus
gatcagaaacgcacagttagcacag

SEQ ID NO: 505899 - DNA, 25 bp, Mus musculus
gatcagaaacgctcagttagcacag

SEQ ID NO: 505900 - DNA, 25 bp, Mus musculus
gatcagaaccatagctcaagttttg

SEQ ID NO: 505901 - DNA, 25 bp, Mus musculus
gatcagaaccattgctcaagttttg

SEQ ID NO: 505902 - DNA, 25 bp, Mus musculus
gatcagaaccctaccatttactgtg

SEQ ID NO: 505903 - DNA, 25 bp, Mus musculus
gatcagaacccttccatttactgtg

SEQ ID NO: 505904 - DNA, 25 bp, Mus musculus
gatcagaactccagttcattcacta

SEQ ID NO: 505905 - DNA, 25 bp, Mus musculus
gatcagaactcctgttcattcacta

SEQ ID NO: 505906 - DNA, 25 bp, Mus musculus
gatcagaagattagtgttcctagaa

SEQ ID NO: 505907 - DNA, 25 bp, Mus musculus
gatcagaagatttgtgttcctagaa

SEQ ID NO: 505908 - DNA, 25 bp, Mus musculus
gatcagaagcgtaagaaagccacag

SEQ ID NO: 505909 - DNA, 25 bp, Mus musculus
gatcagaagcgttagaaagccacag

SEQ ID NO: 505910 - DNA, 25 bp, Mus musculus
gatcagaagctgagtgcgttccacc

SEQ ID NO: 505911 - DNA, 25 bp, Mus musculus
gatcagaagctgtgtgcgttccacc

SEQ ID NO: 505912 - DNA, 25 bp, Mus musculus
gatcagaatcgaaccattcgctgtt

SEQ ID NO: 505913 - DNA, 25 bp, Mus musculus
gatcagaatcgatccattcgctgtt

SEQ ID NO: 505914 - DNA, 25 bp, Mus musculus
gatcagaatgtccttccagtgtcat

SEQ ID NO: 505915 - DNA, 25 bp, Mus musculus
gatcagaatgtcgttccagtgtcat

SEQ ID NO: 505916 - DNA, 25 bp, Mus musculus
gatcagacactaagctcaatcccgt

SEQ ID NO: 505917 - DNA, 25 bp, Mus musculus
gatcagacactatgctcaatcccgt

SEQ ID NO: 505918 - DNA, 25 bp, Mus musculus
gatcagacagtaacagggcttctct

SEQ ID NO: 505919 - DNA, 25 bp, Mus musculus
gatcagacagtaagcatacctttct

SEQ ID NO: 505920 - DNA, 25 bp, Mus musculus
gatcagacagtatcagggcttctct

SEQ ID NO: 505921 - DNA, 25 bp, Mus musculus
gatcagacagtatgcatacctttct

SEQ ID NO: 505922 - DNA, 25 bp, Mus musculus
gatcagacatggctaccacctgctt

SEQ ID NO: 505923 - DNA, 25 bp, Mus musculus
gatcagacatgggtaccacctgctt

SEQ ID NO: 505924 - DNA, 25 bp, Mus musculus
gatcagacctgacagccccatatca

SEQ ID NO: 505925 - DNA, 25 bp, Mus musculus
gatcagacctgacattccaaagtta

SEQ ID NO: 505926 - DNA, 25 bp, Mus musculus
gatcagacctgagagccccatatca

SEQ ID NO: 505927 - DNA, 25 bp, Mus musculus
gatcagacctgagattccaaagtta

SEQ ID NO: 505928 - DNA, 25 bp, Mus musculus
gatcagacgacgaccagaatcctgc

SEQ ID NO: 505929 - DNA, 25 bp, Mus musculus
gatcagacgacgtccagaatcctgc

SEQ ID NO: 505930 - DNA, 25 bp, Mus musculus
gatcagacgaggagccagaggccaa

SEQ ID NO: 505931 - DNA, 25 bp, Mus musculus
gatcagacgaggtgccagaggccaa

SEQ ID NO: 505932 - DNA, 25 bp, Mus musculus
gatcagacgctgctttatgctcact

SEQ ID NO: 505933 - DNA, 25 bp, Mus musculus
gatcagacgctggtttatgctcact

SEQ ID NO: 505934 - DNA, 25 bp, Mus musculus
gatcagactcctagtgaaccacaga

SEQ ID NO: 505935 - DNA, 25 bp, Mus musculus
gatcagactccttgtgaaccacaga

SEQ ID NO: 505936 - DNA, 25 bp, Mus musculus
gatcagactgaacctcacagtcctg

SEQ ID NO: 505937 - DNA, 25 bp, Mus musculus
gatcagactgaagctcacagtcctg

SEQ ID NO: 505938 - DNA, 25 bp, Mus musculus
gatcagactgatcgaccagaacctg

SEQ ID NO: 505939 - DNA, 25 bp, Mus musculus
gatcagactgatggaccagaacctg

SEQ ID NO: 505940 - DNA, 25 bp, Mus musculus
gatcagactgtgcatatagccagct

SEQ ID NO: 505941 - DNA, 25 bp, Mus musculus
gatcagactgtggatatagccagct

SEQ ID NO: 505942 - DNA, 25 bp, Mus musculus
gatcagagaccgaagctggcatcct

SEQ ID NO: 505943 - DNA, 25 bp, Mus musculus
gatcagagaccgtagctggcatcct

SEQ ID NO: 505944 - DNA, 25 bp, Mus musculus
gatcagagactacacccatctggct

SEQ ID NO: 505945 - DNA, 25 bp, Mus musculus
gatcagagactagacccatctggct

SEQ ID NO: 505946 - DNA, 25 bp, Mus musculus
gatcagagatgcacagctggaccac

SEQ ID NO: 505947 - DNA, 25 bp, Mus musculus
gatcagagatgctcagctggaccac

SEQ ID NO: 505948 - DNA, 25 bp, Mus musculus
gatcagagcaatcctggagcccata

SEQ ID NO: 505949 - DNA, 25 bp, Mus musculus
gatcagagcaatgctggagcccata

SEQ ID NO: 505950 - DNA, 25 bp, Mus musculus
gatcagagcatcatccaaactgggc

SEQ ID NO: 505951 - DNA, 25 bp, Mus musculus
gatcagagcatcttccaaactgggc

SEQ ID NO: 505952 - DNA, 25 bp, Mus musculus
gatcagaggcgccaaggaaaagaat

SEQ ID NO: 505953 - DNA, 25 bp, Mus musculus
gatcagaggcgcgaaggaaaagaat

SEQ ID NO: 505954 - DNA, 25 bp, Mus musculus
gatcagaggtcaatggttcgtgtaa

SEQ ID NO: 505955 - DNA, 25 bp, Mus musculus
gatcagaggtcattggttcgtgtaa

SEQ ID NO: 505956 - DNA, 25 bp, Mus musculus
gatcagagtggcatacccaggtttt

SEQ ID NO: 505957 - DNA, 25 bp, Mus musculus
gatcagagtggcttacccaggtttt

SEQ ID NO: 505958 - DNA, 25 bp, Mus musculus
gatcagagtgtcctgtttttaaagc

SEQ ID NO: 505959 - DNA, 25 bp, Mus musculus
gatcagagtgtcgtgtttttaaagc

SEQ ID NO: 505960 - DNA, 25 bp, Mus musculus
gatcagatacctacttcaagtctca

SEQ ID NO: 505961 - DNA, 25 bp, Mus musculus
gatcagataccttcttcaagtctca

SEQ ID NO: 505962 - DNA, 25 bp, Mus musculus
gatcagatatcccttacattgtttt

SEQ ID NO: 505963 - DNA, 25 bp, Mus musculus
gatcagatatccgttacattgtttt

SEQ ID NO: 505964 - DNA, 25 bp, Mus musculus
gatcagatatctaacagtcctagct

SEQ ID NO: 505965 - DNA, 25 bp, Mus musculus
gatcagatatcttacagtcctagct

SEQ ID NO: 505966 - DNA, 25 bp, Mus musculus
gatcagatatttcaaagcggcagca

SEQ ID NO: 505967 - DNA, 25 bp, Mus musculus
gatcagatatttgaaagcggcagca

SEQ ID NO: 505968 - DNA, 25 bp, Mus musculus
gatcagatcaccacttctggcgtgt

SEQ ID NO: 505969 - DNA, 25 bp, Mus musculus
gatcagatcacctcttctggcgtgt

SEQ ID NO: 505970 - DNA, 25 bp, Mus musculus
gatcagatcatcaatccaaatttgg

SEQ ID NO: 505971 - DNA, 25 bp, Mus musculus
gatcagatcatctatccaaatttgg

SEQ ID NO: 505972 - DNA, 25 bp, Mus musculus
gatcagatcggtatatcacatgcag

SEQ ID NO: 505973 - DNA, 25 bp, Mus musculus
gatcagatcggtttatcacatgcag

SEQ ID NO: 505974 - DNA, 25 bp, Mus musculus
gatcagatctccacagaataccatt

SEQ ID NO: 505975 - DNA, 25 bp, Mus musculus
gatcagatctcctcagaataccatt

SEQ ID NO: 505976 - DNA, 25 bp, Mus musculus
gatcagatgtctcctatggtcaaga

SEQ ID NO: 505977 - DNA, 25 bp, Mus musculus
gatcagatgtctgctatggtcaaga

SEQ ID NO: 505978 - DNA, 25 bp, Mus musculus
gatcagatgtttatctctccggttc

SEQ ID NO: 505979 - DNA, 25 bp, Mus musculus
gatcagatgtttttctctccggttc

SEQ ID NO: 505980 - DNA, 25 bp, Mus musculus
gatcagattaccacctctgtaaaga

SEQ ID NO: 505981 - DNA, 25 bp, Mus musculus
gatcagattacctcctctgtaaaga

SEQ ID NO: 505982 - DNA, 25 bp, Mus musculus
gatcagattattaattataccctat

SEQ ID NO: 505983 - DNA, 25 bp, Mus musculus
gatcagattatttattataccctat

SEQ ID NO: 505984 - DNA, 25 bp, Mus musculus
gatcagattgtaaccctgaccaggc

SEQ ID NO: 505985 - DNA, 25 bp, Mus musculus
gatcagattgtacctaccccattgt

SEQ ID NO: 505986 - DNA, 25 bp, Mus musculus
gatcagattgtagctaccccattgt

SEQ ID NO: 505987 - DNA, 25 bp, Mus musculus
gatcagattgtatccctgaccaggc

SEQ ID NO: 505988 - DNA, 25 bp, Mus musculus
gatcagattgttaaaccacttgcaa

SEQ ID NO: 505989 - DNA, 25 bp, Mus musculus
gatcagattgtttaaccacttgcaa

SEQ ID NO: 505990 - DNA, 25 bp, Mus musculus
gatcagcaaaatccctggttttcta

SEQ ID NO: 505991 - DNA, 25 bp, Mus musculus
gatcagcaaaatgcctggttttcta

SEQ ID NO: 505992 - DNA, 25 bp, Mus musculus
gatcagcaagtaacactcttcctct

SEQ ID NO: 505993 - DNA, 25 bp, Mus musculus
gatcagcaagtatcactcttcctct

SEQ ID NO: 505994 - DNA, 25 bp, Mus musculus
gatcagcaattcaaggtccatacct

SEQ ID NO: 505995 - DNA, 25 bp, Mus musculus
gatcagcaattctaggtccatacct

SEQ ID NO: 505996 - DNA, 25 bp, Mus musculus
gatcagcacatgagcttggcagata

SEQ ID NO: 505997 - DNA, 25 bp, Mus musculus
gatcagcacatgtgcttggcagata

SEQ ID NO: 505998 - DNA, 25 bp, Mus musculus
gatcagcaccgaacatccgatgaag

SEQ ID NO: 505999 - DNA, 25 bp, Mus musculus
gatcagcaccgatcatccgatgaag

SEQ ID NO: 506000 - DNA, 25 bp, Mus musculus
gatcagcacctaagatgaccactac

SEQ ID NO: 506001 - DNA, 25 bp, Mus musculus
gatcagcacctatgatgaccactac

SEQ ID NO: 506002 - DNA, 25 bp, Mus musculus
gatcagcactgaacaattcccattc

SEQ ID NO: 506003 - DNA, 25 bp, Mus musculus
gatcagcactgaccagggcagagct

SEQ ID NO: 506004 - DNA, 25 bp, Mus musculus
gatcagcactgagcagggcagagct

SEQ ID NO: 506005 - DNA, 25 bp, Mus musculus
gatcagcactgatcaattcccattc

SEQ ID NO: 506006 - DNA, 25 bp, Mus musculus
gatcagcagatacactcttggcaca

SEQ ID NO: 506007 - DNA, 25 bp, Mus musculus
gatcagcagatagactcttggcaca

SEQ ID NO: 506008 - DNA, 25 bp, Mus musculus
gatcagcaggacaactacacgtgtg

SEQ ID NO: 506009 - DNA, 25 bp, Mus musculus
gatcagcaggactactacacgtgtg

SEQ ID NO: 506010 - DNA, 25 bp, Mus musculus
gatcagcagtctagttcttagccca

SEQ ID NO: 506011 - DNA, 25 bp, Mus musculus
gatcagcagtcttgttcttagccca

SEQ ID NO: 506012 - DNA, 25 bp, Mus musculus
gatcagcagtggcactccggagtcc

SEQ ID NO: 506013 - DNA, 25 bp, Mus musculus
gatcagcagtgggactccggagtcc

SEQ ID NO: 506014 - DNA, 25 bp, Mus musculus
gatcagcagtttctacatcagttct

SEQ ID NO: 506015 - DNA, 25 bp, Mus musculus
gatcagcagtttgtacatcagttct

SEQ ID NO: 506016 - DNA, 25 bp, Mus musculus
gatcagcatagtactgcaataacag

SEQ ID NO: 506017 - DNA, 25 bp, Mus musculus
gatcagcatagttctgcaataacag

SEQ ID NO: 506018 - DNA, 25 bp, Mus musculus
gatcagccacgacgtaatgtccaac

SEQ ID NO: 506019 - DNA, 25 bp, Mus musculus
gatcagccacgaggtaatgtccaac

SEQ ID NO: 506020 - DNA, 25 bp, Mus musculus
gatcagccacggactgggaacagca

SEQ ID NO: 506021 - DNA, 25 bp, Mus musculus
gatcagccacggtctgggaacagca

SEQ ID NO: 506022 - DNA, 25 bp, Mus musculus
gatcagccatacaagagtgcccgag

SEQ ID NO: 506023 - DNA, 25 bp, Mus musculus
gatcagccatactagagtgcccgag

SEQ ID NO: 506024 - DNA, 25 bp, Mus musculus
gatcagccatttactttgtctacct

SEQ ID NO: 506025 - DNA, 25 bp, Mus musculus
gatcagccattttctttgtctacct

SEQ ID NO: 506026 - DNA, 25 bp, Mus musculus
gatcagcccaagcacatcgagcttc

SEQ ID NO: 506027 - DNA, 25 bp, Mus musculus
gatcagcccaaggacatcgagcttc

SEQ ID NO: 506028 - DNA, 25 bp, Mus musculus
gatcagcctcatctcaatggagaac

SEQ ID NO: 506029 - DNA, 25 bp, Mus musculus
gatcagcctcatgtcaatggagaac

SEQ ID NO: 506030 - DNA, 25 bp, Mus musculus
gatcagccttcacttcatttttgtt

SEQ ID NO: 506031 - DNA, 25 bp, Mus musculus
gatcagccttcagttcatttttgtt

SEQ ID NO: 506032 - DNA, 25 bp, Mus musculus
gatcagcgacttagggatgtcccgc

SEQ ID NO: 506033 - DNA, 25 bp, Mus musculus
gatcagcgactttgggatgtcccgc

SEQ ID NO: 506034 - DNA, 25 bp, Mus musculus
gatcagcgatgcacacttagcggac

SEQ ID NO: 506035 - DNA, 25 bp, Mus musculus
gatcagcgatgctcacttagcggac

SEQ ID NO: 506036 - DNA, 25 bp, Mus musculus
gatcagcgatttcggtctttccaaa

SEQ ID NO: 506037 - DNA, 25 bp, Mus musculus
gatcagcgatttgggtctttccaaa

SEQ ID NO: 506038 - DNA, 25 bp, Mus musculus
gatcagcgcctcatgggaaaagtca

SEQ ID NO: 506039 - DNA, 25 bp, Mus musculus
gatcagcgcctcttgggaaaagtca

SEQ ID NO: 506040 - DNA, 25 bp, Mus musculus
gatcagcgctagatgattgaatata

SEQ ID NO: 506041 - DNA, 25 bp, Mus musculus
gatcagcgctagttgattgaatata

SEQ ID NO: 506042 - DNA, 25 bp, Mus musculus
gatcagcgctgactgttttctggat

SEQ ID NO: 506043 - DNA, 25 bp, Mus musculus
gatcagcgctgagtgttttctggat

SEQ ID NO: 506044 - DNA, 25 bp, Mus musculus
gatcagcgggagcatctgcatactc

SEQ ID NO: 506045 - DNA, 25 bp, Mus musculus
gatcagcgggaggatctgcatactc

SEQ ID NO: 506046 - DNA, 25 bp, Mus musculus
gatcagcggtttatatcctctttta

SEQ ID NO: 506047 - DNA, 25 bp, Mus musculus
gatcagcggtttttatcctctttta

SEQ ID NO: 506048 - DNA, 25 bp, Mus musculus
gatcagctcaatacaagaagtccta

SEQ ID NO: 506049 - DNA, 25 bp, Mus musculus
gatcagctcaattcaagaagtccta

SEQ ID NO: 506050 - DNA, 25 bp, Mus musculus
gatcagctcatgagacagccatcag

SEQ ID NO: 506051 - DNA, 25 bp, Mus musculus
gatcagctcatgtgacagccatcag

SEQ ID NO: 506052 - DNA, 25 bp, Mus musculus
gatcagctctgaagctaaactctgc

SEQ ID NO: 506053 - DNA, 25 bp, Mus musculus
gatcagctctgatgctaaactctgc

SEQ ID NO: 506054 - DNA, 25 bp, Mus musculus
gatcagctgaccctccactcgtgag

SEQ ID NO: 506055 - DNA, 25 bp, Mus musculus
gatcagctgaccgtccactcgtgag

SEQ ID NO: 506056 - DNA, 25 bp, Mus musculus
gatcagctgcgtctgtagagcagat

SEQ ID NO: 506057 - DNA, 25 bp, Mus musculus
gatcagctgcgtgtgtagagcagat

SEQ ID NO: 506058 - DNA, 25 bp, Mus musculus
gatcagctgctacggctcattcaga

SEQ ID NO: 506059 - DNA, 25 bp, Mus musculus
gatcagctgctagggctcattcaga

SEQ ID NO: 506060 - DNA, 25 bp, Mus musculus
gatcagctggttacctcagcaagaa

SEQ ID NO: 506061 - DNA, 25 bp, Mus musculus
gatcagctggttagggagtcacaca

SEQ ID NO: 506062 - DNA, 25 bp, Mus musculus
gatcagctggtttcctcagcaagaa

SEQ ID NO: 506063 - DNA, 25 bp, Mus musculus
gatcagctggtttgggagtcacaca

SEQ ID NO: 506064 - DNA, 25 bp, Mus musculus
gatcagcttagaatttgatattata

SEQ ID NO: 506065 - DNA, 25 bp, Mus musculus
gatcagcttagattttgatattata

SEQ ID NO: 506066 - DNA, 25 bp, Mus musculus
gatcagcttcaaagacttcttggct

SEQ ID NO: 506067 - DNA, 25 bp, Mus musculus
gatcagcttcaatgacttcttggct

SEQ ID NO: 506068 - DNA, 25 bp, Mus musculus
gatcagcttcccatatgaacatgga

SEQ ID NO: 506069 - DNA, 25 bp, Mus musculus
gatcagcttcccttatgaacatgga

SEQ ID NO: 506070 - DNA, 25 bp, Mus musculus
gatcagcttcgaagtttaccaggct

SEQ ID NO: 506071 - DNA, 25 bp, Mus musculus
gatcagcttcgatgtttaccaggct

SEQ ID NO: 506072 - DNA, 25 bp, Mus musculus
gatcagcttgatctatttcttcaga

SEQ ID NO: 506073 - DNA, 25 bp, Mus musculus
gatcagcttgatgtatttcttcaga

SEQ ID NO: 506074 - DNA, 25 bp, Mus musculus
gatcagcttgcaatggaggtggcca

SEQ ID NO: 506075 - DNA, 25 bp, Mus musculus
gatcagcttgcattggaggtggcca

SEQ ID NO: 506076 - DNA, 25 bp, Mus musculus
gatcagcttgttaggttcatctgct

SEQ ID NO: 506077 - DNA, 25 bp, Mus musculus
gatcagcttgtttggttcatctgct

SEQ ID NO: 506078 - DNA, 25 bp, Mus musculus
gatcagctttacatggttagactaa

SEQ ID NO: 506079 - DNA, 25 bp, Mus musculus
gatcagctttacttggttagactaa

SEQ ID NO: 506080 - DNA, 25 bp, Mus musculus
gatcagctttggattgcatactcct

SEQ ID NO: 506081 - DNA, 25 bp, Mus musculus
gatcagctttggtttgcatactcct

SEQ ID NO: 506082 - DNA, 25 bp, Mus musculus
gatcaggaacctcgccttctgaaat

SEQ ID NO: 506083 - DNA, 25 bp, Mus musculus
gatcaggaacctggccttctgaaat

SEQ ID NO: 506084 - DNA, 25 bp, Mus musculus
gatcaggaagctaagaccatctaca

SEQ ID NO: 506085 - DNA, 25 bp, Mus musculus
gatcaggaagcttagaccatctaca

SEQ ID NO: 506086 - DNA, 25 bp, Mus musculus
gatcaggaccagaggatgatctagg

SEQ ID NO: 506087 - DNA, 25 bp, Mus musculus
gatcaggaccagtggatgatctagg

SEQ ID NO: 506088 - DNA, 25 bp, Mus musculus
gatcaggaccctaaggaaatgtgca

SEQ ID NO: 506089 - DNA, 25 bp, Mus musculus
gatcaggacccttaggaaatgtgca

SEQ ID NO: 506090 - DNA, 25 bp, Mus musculus
gatcaggaccggcaccccattgatg

SEQ ID NO: 506091 - DNA, 25 bp, Mus musculus
gatcaggaccgggaccccattgatg

SEQ ID NO: 506092 - DNA, 25 bp, Mus musculus
gatcaggactccagtgactcgtggg

SEQ ID NO: 506093 - DNA, 25 bp, Mus musculus
gatcaggactcctgtgactcgtggg

SEQ ID NO: 506094 - DNA, 25 bp, Mus musculus
gatcaggactctcgtgttcttaatg

SEQ ID NO: 506095 - DNA, 25 bp, Mus musculus
gatcaggactctggtgttcttaatg

SEQ ID NO: 506096 - DNA, 25 bp, Mus musculus
gatcaggacttcagttactactaac

SEQ ID NO: 506097 - DNA, 25 bp, Mus musculus
gatcaggacttctgttactactaac

SEQ ID NO: 506098 - DNA, 25 bp, Mus musculus
gatcaggacttgctggaagctttgt

SEQ ID NO: 506099 - DNA, 25 bp, Mus musculus
gatcaggacttggtggaagctttgt

SEQ ID NO: 506100 - DNA, 25 bp, Mus musculus
gatcaggagaccatccagctggaga

SEQ ID NO: 506101 - DNA, 25 bp, Mus musculus
gatcaggagaccttccagctggaga

SEQ ID NO: 506102 - DNA, 25 bp, Mus musculus
gatcaggagatcacaaccagcttgg

SEQ ID NO: 506103 - DNA, 25 bp, Mus musculus
gatcaggagatctcaaccagcttgg

SEQ ID NO: 506104 - DNA, 25 bp, Mus musculus
gatcaggagcacctgtggcttggtg

SEQ ID NO: 506105 - DNA, 25 bp, Mus musculus
gatcaggagcacgtgtggcttggtg

SEQ ID NO: 506106 - DNA, 25 bp, Mus musculus
gatcaggagctcagacgacaagctt

SEQ ID NO: 506107 - DNA, 25 bp, Mus musculus
gatcaggagctctgacgacaagctt

SEQ ID NO: 506108 - DNA, 25 bp, Mus musculus
gatcaggagttcagcaccagctcaa

SEQ ID NO: 506109 - DNA, 25 bp, Mus musculus
gatcaggagttctgcaccagctcaa

SEQ ID NO: 506110 - DNA, 25 bp, Mus musculus
gatcaggagttgacacccagtctct

SEQ ID NO: 506111 - DNA, 25 bp, Mus musculus
gatcaggagttgtcacccagtctct

SEQ ID NO: 506112 - DNA, 25 bp, Mus musculus
gatcaggatatcaccttaagaggta

SEQ ID NO: 506113 - DNA, 25 bp, Mus musculus
gatcaggatatctccttaagaggta

SEQ ID NO: 506114 - DNA, 25 bp, Mus musculus
gatcaggatccaactgttcatcaga

SEQ ID NO: 506115 - DNA, 25 bp, Mus musculus
gatcaggatccacctggatctgtca

SEQ ID NO: 506116 - DNA, 25 bp, Mus musculus
gatcaggatccagctggatctgtca

SEQ ID NO: 506117 - DNA, 25 bp, Mus musculus
gatcaggatccatctgttcatcaga

SEQ ID NO: 506118 - DNA, 25 bp, Mus musculus
gatcaggatcctagcactttaaaaa

SEQ ID NO: 506119 - DNA, 25 bp, Mus musculus
gatcaggatccttgcactttaaaaa

SEQ ID NO: 506120 - DNA, 25 bp, Mus musculus
gatcaggatgacagcagtgggcctc

SEQ ID NO: 506121 - DNA, 25 bp, Mus musculus
gatcaggatgactgcagtgggcctc

SEQ ID NO: 506122 - DNA, 25 bp, Mus musculus
gatcaggatgttcgcccagtggttc

SEQ ID NO: 506123 - DNA, 25 bp, Mus musculus
gatcaggatgttggcccagtggttc

SEQ ID NO: 506124 - DNA, 25 bp, Mus musculus
gatcaggcaccgagccgacgcacgt

SEQ ID NO: 506125 - DNA, 25 bp, Mus musculus
gatcaggcaccgaggaatgttcact

SEQ ID NO: 506126 - DNA, 25 bp, Mus musculus
gatcaggcaccgtgccgacgcacgt

SEQ ID NO: 506127 - DNA, 25 bp, Mus musculus
gatcaggcaccgtggaatgttcact

SEQ ID NO: 506128 - DNA, 25 bp, Mus musculus
gatcaggcagcacgttaaggacaac

SEQ ID NO: 506129 - DNA, 25 bp, Mus musculus
gatcaggcagcaggttaaggacaac

SEQ ID NO: 506130 - DNA, 25 bp, Mus musculus
gatcaggcagttactgttctcagtg

SEQ ID NO: 506131 - DNA, 25 bp, Mus musculus
gatcaggcagtttctgttctcagtg

SEQ ID NO: 506132 - DNA, 25 bp, Mus musculus
gatcaggcattacggaccaccatca

SEQ ID NO: 506133 - DNA, 25 bp, Mus musculus
gatcaggcattagggaccaccatca

SEQ ID NO: 506134 - DNA, 25 bp, Mus musculus
gatcaggccagactgtttcatagag

SEQ ID NO: 506135 - DNA, 25 bp, Mus musculus
gatcaggccagagtgtttcatagag

SEQ ID NO: 506136 - DNA, 25 bp, Mus musculus
gatcaggccatcaagtcacagaact

SEQ ID NO: 506137 - DNA, 25 bp, Mus musculus
gatcaggccatctagtcacagaact

SEQ ID NO: 506138 - DNA, 25 bp, Mus musculus
gatcaggcccagaactgcatcaaga

SEQ ID NO: 506139 - DNA, 25 bp, Mus musculus
gatcaggcccagtactgcatcaaga

SEQ ID NO: 506140 - DNA, 25 bp, Mus musculus
gatcaggcccgtctggatgcttctg

SEQ ID NO: 506141 - DNA, 25 bp, Mus musculus
gatcaggcccgtgtggatgcttctg

SEQ ID NO: 506142 - DNA, 25 bp, Mus musculus
gatcaggccctaaagcattgttgtg

SEQ ID NO: 506143 - DNA, 25 bp, Mus musculus
gatcaggccctatagcattgttgtg

SEQ ID NO: 506144 - DNA, 25 bp, Mus musculus
gatcaggctctgctcccttgaggaa

SEQ ID NO: 506145 - DNA, 25 bp, Mus musculus
gatcaggctctggtcccttgaggaa

SEQ ID NO: 506146 - DNA, 25 bp, Mus musculus
gatcaggctgggacagagctagttt

SEQ ID NO: 506147 - DNA, 25 bp, Mus musculus
gatcaggctgggtcagagctagttt

SEQ ID NO: 506148 - DNA, 25 bp, Mus musculus
gatcagggaacgaggcccagaaacc

SEQ ID NO: 506149 - DNA, 25 bp, Mus musculus
gatcagggaacgtggcccagaaacc

SEQ ID NO: 506150 - DNA, 25 bp, Mus musculus
gatcagggatatcccttgaaaacca

SEQ ID NO: 506151 - DNA, 25 bp, Mus musculus
gatcagggatatgccttgaaaacca

SEQ ID NO: 506152 - DNA, 25 bp, Mus musculus
gatcagggattcaatggccaagctc

SEQ ID NO: 506153 - DNA, 25 bp, Mus musculus
gatcagggattctatggccaagctc

SEQ ID NO: 506154 - DNA, 25 bp, Mus musculus
gatcagggcaagagctttgctactt

SEQ ID NO: 506155 - DNA, 25 bp, Mus musculus
gatcagggcaagtgctttgctactt

SEQ ID NO: 506156 - DNA, 25 bp, Mus musculus
gatcagggcagtcactttcacagca

SEQ ID NO: 506157 - DNA, 25 bp, Mus musculus
gatcagggcagtgactttcacagca

SEQ ID NO: 506158 - DNA, 25 bp, Mus musculus
gatcagggttatagttagtggctca

SEQ ID NO: 506159 - DNA, 25 bp, Mus musculus
gatcagggttattgttagtggctca

SEQ ID NO: 506160 - DNA, 25 bp, Mus musculus
gatcaggtaatcattttgccatgac

SEQ ID NO: 506161 - DNA, 25 bp, Mus musculus
gatcaggtaatctttttgccatgac

SEQ ID NO: 506162 - DNA, 25 bp, Mus musculus
gatcaggtacgtacacttggttaag

SEQ ID NO: 506163 - DNA, 25 bp, Mus musculus
gatcaggtacgttcacttggttaag

SEQ ID NO: 506164 - DNA, 25 bp, Mus musculus
gatcaggtagtacccatgttttaaa

SEQ ID NO: 506165 - DNA, 25 bp, Mus musculus
gatcaggtagtagccatgttttaaa

SEQ ID NO: 506166 - DNA, 25 bp, Mus musculus
gatcaggtcactagggttcaaccca

SEQ ID NO: 506167 - DNA, 25 bp, Mus musculus
gatcaggtcacttgggttcaaccca

SEQ ID NO: 506168 - DNA, 25 bp, Mus musculus
gatcaggtcctaaacatggcactta

SEQ ID NO: 506169 - DNA, 25 bp, Mus musculus
gatcaggtcctatacatggcactta

SEQ ID NO: 506170 - DNA, 25 bp, Mus musculus
gatcaggtcctcaggtagcttagta

SEQ ID NO: 506171 - DNA, 25 bp, Mus musculus
gatcaggtcctctggtagcttagta

SEQ ID NO: 506172 - DNA, 25 bp, Mus musculus
gatcaggtggatctgcaggatatca

SEQ ID NO: 506173 - DNA, 25 bp, Mus musculus
gatcaggtggatgtgcaggatatca

SEQ ID NO: 506174 - DNA, 25 bp, Mus musculus
gatcaggtggctccgtaggtatcaa

SEQ ID NO: 506175 - DNA, 25 bp, Mus musculus
gatcaggtggctgcgtaggtatcaa

SEQ ID NO: 506176 - DNA, 25 bp, Mus musculus
gatcaggttccaattactgtactgt

SEQ ID NO: 506177 - DNA, 25 bp, Mus musculus
gatcaggttccatttactgtactgt

SEQ ID NO: 506178 - DNA, 25 bp, Mus musculus
gatcaggttgcgcatagacttgtaa

SEQ ID NO: 506179 - DNA, 25 bp, Mus musculus
gatcaggttgcggatagacttgtaa

SEQ ID NO: 506180 - DNA, 25 bp, Mus musculus
gatcaggtttccaaactgccgttga

SEQ ID NO: 506181 - DNA, 25 bp, Mus musculus
gatcaggtttcctaactgccgttga

SEQ ID NO: 506182 - DNA, 25 bp, Mus musculus
gatcaggtttctcgtgggcttttac

SEQ ID NO: 506183 - DNA, 25 bp, Mus musculus
gatcaggtttctggtgggcttttac

SEQ ID NO: 506184 - DNA, 25 bp, Mus musculus
gatcaggtttgcacactgtcttgag

SEQ ID NO: 506185 - DNA, 25 bp, Mus musculus
gatcaggtttgcaccaaggtcatgt

SEQ ID NO: 506186 - DNA, 25 bp, Mus musculus
gatcaggtttgctcactgtcttgag

SEQ ID NO: 506187 - DNA, 25 bp, Mus musculus
gatcaggtttgctccaaggtcatgt

SEQ ID NO: 506188 - DNA, 25 bp, Mus musculus
gatcagtaccctataagcttagata

SEQ ID NO: 506189 - DNA, 25 bp, Mus musculus
gatcagtaccctttaagcttagata

SEQ ID NO: 506190 - DNA, 25 bp, Mus musculus
gatcagtactcacaatacagccctt

SEQ ID NO: 506191 - DNA, 25 bp, Mus musculus
gatcagtactcagaatacagccctt

SEQ ID NO: 506192 - DNA, 25 bp, Mus musculus
gatcagtagacaaacatcgccttgt

SEQ ID NO: 506193 - DNA, 25 bp, Mus musculus
gatcagtagacatacatcgccttgt

SEQ ID NO: 506194 - DNA, 25 bp, Mus musculus
gatcagtatcagagagcctggctca

SEQ ID NO: 506195 - DNA, 25 bp, Mus musculus
gatcagtatcagtgagcctggctca

SEQ ID NO: 506196 - DNA, 25 bp, Mus musculus
gatcagtatgcaatctgtcgatata

SEQ ID NO: 506197 - DNA, 25 bp, Mus musculus
gatcagtatgcattctgtcgatata

SEQ ID NO: 506198 - DNA, 25 bp, Mus musculus
gatcagtattttagactgtggtgaa

SEQ ID NO: 506199 - DNA, 25 bp, Mus musculus
gatcagtatttttgactgtggtgaa

SEQ ID NO: 506200 - DNA, 25 bp, Mus musculus
gatcagtcagcacagagcgctatgt

SEQ ID NO: 506201 - DNA, 25 bp, Mus musculus
gatcagtcagcagagagcgctatgt

SEQ ID NO: 506202 - DNA, 25 bp, Mus musculus
gatcagtccagtctgtctgctccta

SEQ ID NO: 506203 - DNA, 25 bp, Mus musculus
gatcagtccagtgtgtctgctccta

SEQ ID NO: 506204 - DNA, 25 bp, Mus musculus
gatcagtccatcctgaagacagatt

SEQ ID NO: 506205 - DNA, 25 bp, Mus musculus
gatcagtccatcgtgaagacagatt

SEQ ID NO: 506206 - DNA, 25 bp, Mus musculus
gatcagtcctacaaagttccctgga

SEQ ID NO: 506207 - DNA, 25 bp, Mus musculus
gatcagtcctactaagttccctgga

SEQ ID NO: 506208 - DNA, 25 bp, Mus musculus
gatcagtcctctagcatttccttca

SEQ ID NO: 506209 - DNA, 25 bp, Mus musculus
gatcagtcctcttgcatttccttca

SEQ ID NO: 506210 - DNA, 25 bp, Mus musculus
gatcagtccttcatatagctttagt

SEQ ID NO: 506211 - DNA, 25 bp, Mus musculus
gatcagtccttcttatagctttagt

SEQ ID NO: 506212 - DNA, 25 bp, Mus musculus
gatcagtcgacactcattaacttca

SEQ ID NO: 506213 - DNA, 25 bp, Mus musculus
gatcagtcgacagtcattaacttca

SEQ ID NO: 506214 - DNA, 25 bp, Mus musculus
gatcagtctaaaataagaccctgtt

SEQ ID NO: 506215 - DNA, 25 bp, Mus musculus
gatcagtctaaattaagaccctgtt

SEQ ID NO: 506216 - DNA, 25 bp, Mus musculus
gatcagtcttggctgcagcctataa

SEQ ID NO: 506217 - DNA, 25 bp, Mus musculus
gatcagtcttgggtgcagcctataa

SEQ ID NO: 506218 - DNA, 25 bp, Mus musculus
gatcagtgaaatatgctgtatctta

SEQ ID NO: 506219 - DNA, 25 bp, Mus musculus
gatcagtgaaatttgctgtatctta

SEQ ID NO: 506220 - DNA, 25 bp, Mus musculus
gatcagtgacttacacattcagcca

SEQ ID NO: 506221 - DNA, 25 bp, Mus musculus
gatcagtgactttcacattcagcca

SEQ ID NO: 506222 - DNA, 25 bp, Mus musculus
gatcagtgagagatttattacaaaa

SEQ ID NO: 506223 - DNA, 25 bp, Mus musculus
gatcagtgagagttttattacaaaa

SEQ ID NO: 506224 - DNA, 25 bp, Mus musculus
gatcagtgccttagttggcagcttt

SEQ ID NO: 506225 - DNA, 25 bp, Mus musculus
gatcagtgcctttgttggcagcttt

SEQ ID NO: 506226 - DNA, 25 bp, Mus musculus
gatcagtggctaatgctgaagtaca

SEQ ID NO: 506227 - DNA, 25 bp, Mus musculus
gatcagtggctattgctgaagtaca

SEQ ID NO: 506228 - DNA, 25 bp, Mus musculus
gatcagtggcttagaatgaaatcca

SEQ ID NO: 506229 - DNA, 25 bp, Mus musculus
gatcagtggcttcagtcacacataa

SEQ ID NO: 506230 - DNA, 25 bp, Mus musculus
gatcagtggcttgagtcacacataa

SEQ ID NO: 506231 - DNA, 25 bp, Mus musculus
gatcagtggctttgaatgaaatcca

SEQ ID NO: 506232 - DNA, 25 bp, Mus musculus
gatcagtgggctagggaaacgctcc

SEQ ID NO: 506233 - DNA, 25 bp, Mus musculus
gatcagtgggcttgggaaacgctcc

SEQ ID NO: 506234 - DNA, 25 bp, Mus musculus
gatcagtggtctatgcctcaagaga

SEQ ID NO: 506235 - DNA, 25 bp, Mus musculus
gatcagtggtctttgcctcaagaga

SEQ ID NO: 506236 - DNA, 25 bp, Mus musculus
gatcagtgtactcttacccgaacat

SEQ ID NO: 506237 - DNA, 25 bp, Mus musculus
gatcagtgtactgttacccgaacat

SEQ ID NO: 506238 - DNA, 25 bp, Mus musculus
gatcagtgtcgactgcacagagtct

SEQ ID NO: 506239 - DNA, 25 bp, Mus musculus
gatcagtgtcgagtgcacagagtct

SEQ ID NO: 506240 - DNA, 25 bp, Mus musculus
gatcagtgtcttcaagtgaccacca

SEQ ID NO: 506241 - DNA, 25 bp, Mus musculus
gatcagtgtcttgaagtgaccacca

SEQ ID NO: 506242 - DNA, 25 bp, Mus musculus
gatcagtgttttaccccatatcttt

SEQ ID NO: 506243 - DNA, 25 bp, Mus musculus
gatcagtgtttttccccatatcttt

SEQ ID NO: 506244 - DNA, 25 bp, Mus musculus
gatcagttaaaccactctgttcatg

SEQ ID NO: 506245 - DNA, 25 bp, Mus musculus
gatcagttaaacgactctgttcatg

SEQ ID NO: 506246 - DNA, 25 bp, Mus musculus
gatcagttactaacttttggtagct

SEQ ID NO: 506247 - DNA, 25 bp, Mus musculus
gatcagttactatcttttggtagct

SEQ ID NO: 506248 - DNA, 25 bp, Mus musculus
gatcagttagtgcaggccaggacaa

SEQ ID NO: 506249 - DNA, 25 bp, Mus musculus
gatcagttagtggaggccaggacaa

SEQ ID NO: 506250 - DNA, 25 bp, Mus musculus
gatcagttagttagtaagtttccac

SEQ ID NO: 506251 - DNA, 25 bp, Mus musculus
gatcagttagtttgtaagtttccac

SEQ ID NO: 506252 - DNA, 25 bp, Mus musculus
gatcagttcatcaaaacatcatgtt

SEQ ID NO: 506253 - DNA, 25 bp, Mus musculus
gatcagttcatctaaacatcatgtt

SEQ ID NO: 506254 - DNA, 25 bp, Mus musculus
gatcagttgctacaaaaccctggct

SEQ ID NO: 506255 - DNA, 25 bp, Mus musculus
gatcagttgctagaaaaccctggct

SEQ ID NO: 506256 - DNA, 25 bp, Mus musculus
gatcagttggcactatctactcaag

SEQ ID NO: 506257 - DNA, 25 bp, Mus musculus
gatcagttggcagtatctactcaag

SEQ ID NO: 506258 - DNA, 25 bp, Mus musculus
gatcagttgtttagtctagggagtt

SEQ ID NO: 506259 - DNA, 25 bp, Mus musculus
gatcagttgttttgtctagggagtt

SEQ ID NO: 506260 - DNA, 25 bp, Mus musculus
gatcagtttacccatgcatcaagct

SEQ ID NO: 506261 - DNA, 25 bp, Mus musculus
gatcagtttaccgatgcatcaagct

SEQ ID NO: 506262 - DNA, 25 bp, Mus musculus
gatcagtttcttctctgttactata

SEQ ID NO: 506263 - DNA, 25 bp, Mus musculus
gatcagtttcttgtctgttactata

SEQ ID NO: 506264 - DNA, 25 bp, Mus musculus
gatcagtttggacttcacatttttg

SEQ ID NO: 506265 - DNA, 25 bp, Mus musculus
gatcagtttggagttcacatttttg

SEQ ID NO: 506266 - DNA, 25 bp, Mus musculus
gatcagtttgtcattgaatcgaata

SEQ ID NO: 506267 - DNA, 25 bp, Mus musculus
gatcagtttgtctttgaatcgaata

SEQ ID NO: 506268 - DNA, 25 bp, Mus musculus
gatcagttttctacttaactgttga

SEQ ID NO: 506269 - DNA, 25 bp, Mus musculus
gatcagttttcttcttaactgttga

SEQ ID NO: 506270 - DNA, 25 bp, Mus musculus
gatcagtttttacagtgcccggtag

SEQ ID NO: 506271 - DNA, 25 bp, Mus musculus
gatcagtttttagagtgcccggtag

SEQ ID NO: 506272 - DNA, 25 bp, Mus musculus
gatcataaaaaactccgtggtctca

SEQ ID NO: 506273 - DNA, 25 bp, Mus musculus
gatcataaaaaagtccgtggtctca

SEQ ID NO: 506274 - DNA, 25 bp, Mus musculus
gatcataaaaatccggagaaagctg

SEQ ID NO: 506275 - DNA, 25 bp, Mus musculus
gatcataaaaatgcggagaaagctg

SEQ ID NO: 506276 - DNA, 25 bp, Mus musculus
gatcataaaagcatttcccgtcctc

SEQ ID NO: 506277 - DNA, 25 bp, Mus musculus
gatcataaaagcttttcccgtcctc

SEQ ID NO: 506278 - DNA, 25 bp, Mus musculus
gatcataaacctagcctggacattt

SEQ ID NO: 506279 - DNA, 25 bp, Mus musculus
gatcataaaccttgcctggacattt

SEQ ID NO: 506280 - DNA, 25 bp, Mus musculus
gatcataaacttcccagagcttact

SEQ ID NO: 506281 - DNA, 25 bp, Mus musculus
gatcataaacttgccagagcttact

SEQ ID NO: 506282 - DNA, 25 bp, Mus musculus
gatcataaagtgagactcctcccca

SEQ ID NO: 506283 - DNA, 25 bp, Mus musculus
gatcataaagtgtgactcctcccca

SEQ ID NO: 506284 - DNA, 25 bp, Mus musculus
gatcataaccctaaacttagacact

SEQ ID NO: 506285 - DNA, 25 bp, Mus musculus
gatcataacccttaacttagacact

SEQ ID NO: 506286 - DNA, 25 bp, Mus musculus
gatcataatcctcatgcaattctag

SEQ ID NO: 506287 - DNA, 25 bp, Mus musculus
gatcataatcctgatgcaattctag

SEQ ID NO: 506288 - DNA, 25 bp, Mus musculus
gatcataatcttctctccttttagt

SEQ ID NO: 506289 - DNA, 25 bp, Mus musculus
gatcataatcttgtctccttttagt

SEQ ID NO: 506290 - DNA, 25 bp, Mus musculus
gatcataattaacgaactggtgggc

SEQ ID NO: 506291 - DNA, 25 bp, Mus musculus
gatcataattaaggaactggtgggc

SEQ ID NO: 506292 - DNA, 25 bp, Mus musculus
gatcataatttcaggtgagacgttt

SEQ ID NO: 506293 - DNA, 25 bp, Mus musculus
gatcataatttctggtgagacgttt

SEQ ID NO: 506294 - DNA, 25 bp, Mus musculus
gatcatacaaaaagaggacttgctg

SEQ ID NO: 506295 - DNA, 25 bp, Mus musculus
gatcatacaaaatgaggacttgctg

SEQ ID NO: 506296 - DNA, 25 bp, Mus musculus
gatcatacacggaactctgctgaag

SEQ ID NO: 506297 - DNA, 25 bp, Mus musculus
gatcatacacggtactctgctgaag

SEQ ID NO: 506298 - DNA, 25 bp, Mus musculus
gatcatacacttagagggcaggacc

SEQ ID NO: 506299 - DNA, 25 bp, Mus musculus
gatcatacactttgagggcaggacc

SEQ ID NO: 506300 - DNA, 25 bp, Mus musculus
gatcataccatcaccagtgtgcttt

SEQ ID NO: 506301 - DNA, 25 bp, Mus musculus
gatcataccatctccagtgtgcttt

SEQ ID NO: 506302 - DNA, 25 bp, Mus musculus
gatcataccctaatgcctgtgcaat

SEQ ID NO: 506303 - DNA, 25 bp, Mus musculus
gatcataccctattgcctgtgcaat

SEQ ID NO: 506304 - DNA, 25 bp, Mus musculus
gatcatacctcacctatgtgaagag

SEQ ID NO: 506305 - DNA, 25 bp, Mus musculus
gatcatacctcagctatgtgaagag

SEQ ID NO: 506306 - DNA, 25 bp, Mus musculus
gatcatacctttcctgcttgaatta

SEQ ID NO: 506307 - DNA, 25 bp, Mus musculus
gatcatacctttgctgcttgaatta

SEQ ID NO: 506308 - DNA, 25 bp, Mus musculus
gatcatagaaaaccagccatctcca

SEQ ID NO: 506309 - DNA, 25 bp, Mus musculus
gatcatagaaaagcagccatctcca

SEQ ID NO: 506310 - DNA, 25 bp, Mus musculus
gatcatagaactacctttccagaat

SEQ ID NO: 506311 - DNA, 25 bp, Mus musculus
gatcatagaacttcctttccagaat

SEQ ID NO: 506312 - DNA, 25 bp, Mus musculus
gatcatagcaccagctgtcggcaca

SEQ ID NO: 506313 - DNA, 25 bp, Mus musculus
gatcatagcacctgctgtcggcaca

SEQ ID NO: 506314 - DNA, 25 bp, Mus musculus
gatcataggatgcactacccagttt

SEQ ID NO: 506315 - DNA, 25 bp, Mus musculus
gatcataggatggactacccagttt

SEQ ID NO: 506316 - DNA, 25 bp, Mus musculus
gatcataggtatcttactgtttgaa

SEQ ID NO: 506317 - DNA, 25 bp, Mus musculus
gatcataggtatgttactgtttgaa

SEQ ID NO: 506318 - DNA, 25 bp, Mus musculus
gatcatagttgtcacagctgccttt

SEQ ID NO: 506319 - DNA, 25 bp, Mus musculus
gatcatagttgtgacagctgccttt

SEQ ID NO: 506320 - DNA, 25 bp, Mus musculus
gatcatatacctaccagatacttgc

SEQ ID NO: 506321 - DNA, 25 bp, Mus musculus
gatcatataccttccagatacttgc

SEQ ID NO: 506322 - DNA, 25 bp, Mus musculus
gatcatatcaagactcctagcaagg

SEQ ID NO: 506323 - DNA, 25 bp, Mus musculus
gatcatatcaagtctcctagcaagg

SEQ ID NO: 506324 - DNA, 25 bp, Mus musculus
gatcatatcacacggcactttagaa

SEQ ID NO: 506325 - DNA, 25 bp, Mus musculus
gatcatatcacagggcactttagaa

SEQ ID NO: 506326 - DNA, 25 bp, Mus musculus
gatcatatcgaacctctgttaaaaa

SEQ ID NO: 506327 - DNA, 25 bp, Mus musculus
gatcatatcgaagctctgttaaaaa

SEQ ID NO: 506328 - DNA, 25 bp, Mus musculus
gatcatatctctcaagtctctacta

SEQ ID NO: 506329 - DNA, 25 bp, Mus musculus
gatcatatctctgaagtctctacta

SEQ ID NO: 506330 - DNA, 25 bp, Mus musculus
gatcatatgacaatggcattgcatg

SEQ ID NO: 506331 - DNA, 25 bp, Mus musculus
gatcatatgacattggcattgcatg

SEQ ID NO: 506332 - DNA, 25 bp, Mus musculus
gatcatattacaactggtgcttcta

SEQ ID NO: 506333 - DNA, 25 bp, Mus musculus
gatcatattacatctggtgcttcta

SEQ ID NO: 506334 - DNA, 25 bp, Mus musculus
gatcatcaagaacagcctgggtaca

SEQ ID NO: 506335 - DNA, 25 bp, Mus musculus
gatcatcaagaagagcctgggtaca

SEQ ID NO: 506336 - DNA, 25 bp, Mus musculus
gatcatcaatgacgtgtcgaagccc

SEQ ID NO: 506337 - DNA, 25 bp, Mus musculus
gatcatcaatgaggtgtcgaagccc

SEQ ID NO: 506338 - DNA, 25 bp, Mus musculus
gatcatcacacacccaaatcaacta

SEQ ID NO: 506339 - DNA, 25 bp, Mus musculus
gatcatcacacagccaaatcaacta

SEQ ID NO: 506340 - DNA, 25 bp, Mus musculus
gatcatcacactcctcactcttatt

SEQ ID NO: 506341 - DNA, 25 bp, Mus musculus
gatcatcacactgctcactcttatt

SEQ ID NO: 506342 - DNA, 25 bp, Mus musculus
gatcatcaccagagaagaccaccta

SEQ ID NO: 506343 - DNA, 25 bp, Mus musculus
gatcatcaccagtgaagaccaccta

SEQ ID NO: 506344 - DNA, 25 bp, Mus musculus
gatcatcaccatcggccaggagcgc

SEQ ID NO: 506345 - DNA, 25 bp, Mus musculus
gatcatcaccatgggccaggagcgc

SEQ ID NO: 506346 - DNA, 25 bp, Mus musculus
gatcatcaccttagtctagagacga

SEQ ID NO: 506347 - DNA, 25 bp, Mus musculus
gatcatcacctttgtctagagacga

SEQ ID NO: 506348 - DNA, 25 bp, Mus musculus
gatcatcactggatctggcagttaa

SEQ ID NO: 506349 - DNA, 25 bp, Mus musculus
gatcatcactggttctggcagttaa

SEQ ID NO: 506350 - DNA, 25 bp, Mus musculus
gatcatcagactctgccgcagggct

SEQ ID NO: 506351 - DNA, 25 bp, Mus musculus
gatcatcagactgtgccgcagggct

SEQ ID NO: 506352 - DNA, 25 bp, Mus musculus
gatcatcagccgacgactgggaggc

SEQ ID NO: 506353 - DNA, 25 bp, Mus musculus
gatcatcagccgtcgactgggaggc

SEQ ID NO: 506354 - DNA, 25 bp, Mus musculus
gatcatcagcttctcaatcttctct

SEQ ID NO: 506355 - DNA, 25 bp, Mus musculus
gatcatcagcttgtcaatcttctct

SEQ ID NO: 506356 - DNA, 25 bp, Mus musculus
gatcatcagtcaagcttggccacaa

SEQ ID NO: 506357 - DNA, 25 bp, Mus musculus
gatcatcagtcatgcttggccacaa

SEQ ID NO: 506358 - DNA, 25 bp, Mus musculus
gatcatcagttaaccagactgccag

SEQ ID NO: 506359 - DNA, 25 bp, Mus musculus
gatcatcagttaaggcttctcttct

SEQ ID NO: 506360 - DNA, 25 bp, Mus musculus
gatcatcagttatccagactgccag

SEQ ID NO: 506361 - DNA, 25 bp, Mus musculus
gatcatcagttatggcttctcttct

SEQ ID NO: 506362 - DNA, 25 bp, Mus musculus
gatcatcatcaaagtgaaaccccag

SEQ ID NO: 506363 - DNA, 25 bp, Mus musculus
gatcatcatcaatgtgaaaccccag

SEQ ID NO: 506364 - DNA, 25 bp, Mus musculus
gatcatcatcggcaaaagtaacttt

SEQ ID NO: 506365 - DNA, 25 bp, Mus musculus
gatcatcatcgggaaaagtaacttt

SEQ ID NO: 506366 - DNA, 25 bp, Mus musculus
gatcatcatggaagctgacctctcc

SEQ ID NO: 506367 - DNA, 25 bp, Mus musculus
gatcatcatggatgctgacctctcc

SEQ ID NO: 506368 - DNA, 25 bp, Mus musculus
gatcatcattttcgactgtttcttg

SEQ ID NO: 506369 - DNA, 25 bp, Mus musculus
gatcatcattttggactgtttcttg

SEQ ID NO: 506370 - DNA, 25 bp, Mus musculus
gatcatccaaagctgcagctagtga

SEQ ID NO: 506371 - DNA, 25 bp, Mus musculus
gatcatccaaaggtgcagctagtga

SEQ ID NO: 506372 - DNA, 25 bp, Mus musculus
gatcatccaagcagttgtaaatact

SEQ ID NO: 506373 - DNA, 25 bp, Mus musculus
gatcatccaagctgttgtaaatact

SEQ ID NO: 506374 - DNA, 25 bp, Mus musculus
gatcatccacctaagggctagggtt

SEQ ID NO: 506375 - DNA, 25 bp, Mus musculus
gatcatccaccttagggctagggtt

SEQ ID NO: 506376 - DNA, 25 bp, Mus musculus
gatcatccagaacacagcctgaagg

SEQ ID NO: 506377 - DNA, 25 bp, Mus musculus
gatcatccagaagacagcctgaagg

SEQ ID NO: 506378 - DNA, 25 bp, Mus musculus
gatcatccagccaagattgccaaga

SEQ ID NO: 506379 - DNA, 25 bp, Mus musculus
gatcatccagcctagattgccaaga

SEQ ID NO: 506380 - DNA, 25 bp, Mus musculus
gatcatccatcactagctacatggc

SEQ ID NO: 506381 - DNA, 25 bp, Mus musculus
gatcatccatcagtagctacatggc

SEQ ID NO: 506382 - DNA, 25 bp, Mus musculus
gatcatccatgtatgaagtttctca

SEQ ID NO: 506383 - DNA, 25 bp, Mus musculus
gatcatccatgtttgaagtttctca

SEQ ID NO: 506384 - DNA, 25 bp, Mus musculus
gatcatcccagcaatagtgacagca

SEQ ID NO: 506385 - DNA, 25 bp, Mus musculus
gatcatcccagctatagtgacagca

SEQ ID NO: 506386 - DNA, 25 bp, Mus musculus
gatcatccccagctgggattcgatt

SEQ ID NO: 506387 - DNA, 25 bp, Mus musculus
gatcatccccaggtgggattcgatt

SEQ ID NO: 506388 - DNA, 25 bp, Mus musculus
gatcatccggatcttgttaaaggct

SEQ ID NO: 506389 - DNA, 25 bp, Mus musculus
gatcatccggatgttgttaaaggct

SEQ ID NO: 506390 - DNA, 25 bp, Mus musculus
gatcatccggcaccccaattataat

SEQ ID NO: 506391 - DNA, 25 bp, Mus musculus
gatcatccggcagcccaattataat

SEQ ID NO: 506392 - DNA, 25 bp, Mus musculus
gatcatccgtgtaagccaatcctat

SEQ ID NO: 506393 - DNA, 25 bp, Mus musculus
gatcatccgtgttagccaatcctat

SEQ ID NO: 506394 - DNA, 25 bp, Mus musculus
gatcatcctataactggtttctcct

SEQ ID NO: 506395 - DNA, 25 bp, Mus musculus
gatcatcctatatctggtttctcct

SEQ ID NO: 506396 - DNA, 25 bp, Mus musculus
gatcatcggaagcaaccaacacagg

SEQ ID NO: 506397 - DNA, 25 bp, Mus musculus
gatcatcggaaggaaccaacacagg

SEQ ID NO: 506398 - DNA, 25 bp, Mus musculus
gatcatcggtttactatgcaagcca

SEQ ID NO: 506399 - DNA, 25 bp, Mus musculus
gatcatcggttttctatgcaagcca

SEQ ID NO: 506400 - DNA, 25 bp, Mus musculus
gatcatcgtgatactagttacatta

SEQ ID NO: 506401 - DNA, 25 bp, Mus musculus
gatcatcgtgattctagttacatta

SEQ ID NO: 506402 - DNA, 25 bp, Mus musculus
gatcatcgttaccatttgaaccata

SEQ ID NO: 506403 - DNA, 25 bp, Mus musculus
gatcatcgttacgatttgaaccata

SEQ ID NO: 506404 - DNA, 25 bp, Mus musculus
gatcatctatagaaacagagtttat

SEQ ID NO: 506405 - DNA, 25 bp, Mus musculus
gatcatctatagtaacagagtttat

SEQ ID NO: 506406 - DNA, 25 bp, Mus musculus
gatcatctatggcattcttcccttc

SEQ ID NO: 506407 - DNA, 25 bp, Mus musculus
gatcatctatgggattcttcccttc

SEQ ID NO: 506408 - DNA, 25 bp, Mus musculus
gatcatctccaccttctacatgaga

SEQ ID NO: 506409 - DNA, 25 bp, Mus musculus
gatcatctccacgttctacatgaga

SEQ ID NO: 506410 - DNA, 25 bp, Mus musculus
gatcatctccctaggacatgggtca

SEQ ID NO: 506411 - DNA, 25 bp, Mus musculus
gatcatctcccttggacatgggtca

SEQ ID NO: 506412 - DNA, 25 bp, Mus musculus
gatcatctgcccaatgagtgggatt

SEQ ID NO: 506413 - DNA, 25 bp, Mus musculus
gatcatctgccctatgagtgggatt

SEQ ID NO: 506414 - DNA, 25 bp, Mus musculus
gatcatctgctacgccaggatggac

SEQ ID NO: 506415 - DNA, 25 bp, Mus musculus
gatcatctgctaggccaggatggac

SEQ ID NO: 506416 - DNA, 25 bp, Mus musculus
gatcatctgctcacttatttgttta

SEQ ID NO: 506417 - DNA, 25 bp, Mus musculus
gatcatctgctctcttatttgttta

SEQ ID NO: 506418 - DNA, 25 bp, Mus musculus
gatcatctggtaagtgaccacctgc

SEQ ID NO: 506419 - DNA, 25 bp, Mus musculus
gatcatctggtatgtgaccacctgc

SEQ ID NO: 506420 - DNA, 25 bp, Mus musculus
gatcatctggtcacaatatatctaa

SEQ ID NO: 506421 - DNA, 25 bp, Mus musculus
gatcatctggtctcaatatatctaa

SEQ ID NO: 506422 - DNA, 25 bp, Mus musculus
gatcatctgtgcaacattggataga

SEQ ID NO: 506423 - DNA, 25 bp, Mus musculus
gatcatctgtgctacattggataga

SEQ ID NO: 506424 - DNA, 25 bp, Mus musculus
gatcatctgtgtcacgctcaaggtt

SEQ ID NO: 506425 - DNA, 25 bp, Mus musculus
gatcatctgtgtgacgctcaaggtt

SEQ ID NO: 506426 - DNA, 25 bp, Mus musculus
gatcatctgttcatttgaaggtctt

SEQ ID NO: 506427 - DNA, 25 bp, Mus musculus
gatcatctgttcttttgaaggtctt

SEQ ID NO: 506428 - DNA, 25 bp, Mus musculus
gatcatctgttgcatatgccatgag

SEQ ID NO: 506429 - DNA, 25 bp, Mus musculus
gatcatctgttggatatgccatgag

SEQ ID NO: 506430 - DNA, 25 bp, Mus musculus
gatcatcttataagagaaccccaac

SEQ ID NO: 506431 - DNA, 25 bp, Mus musculus
gatcatcttatatgagaaccccaac

SEQ ID NO: 506432 - DNA, 25 bp, Mus musculus
gatcatcttcaaagtcggccgagtt

SEQ ID NO: 506433 - DNA, 25 bp, Mus musculus
gatcatcttcaaatctatcctttga

SEQ ID NO: 506434 - DNA, 25 bp, Mus musculus
gatcatcttcaatgtcggccgagtt

SEQ ID NO: 506435 - DNA, 25 bp, Mus musculus
gatcatcttcaattctatcctttga

SEQ ID NO: 506436 - DNA, 25 bp, Mus musculus
gatcatcttggtatcattcggtaca

SEQ ID NO: 506437 - DNA, 25 bp, Mus musculus
gatcatcttggtttcattcggtaca

SEQ ID NO: 506438 - DNA, 25 bp, Mus musculus
gatcatctttaaacctttaatcttt

SEQ ID NO: 506439 - DNA, 25 bp, Mus musculus
gatcatctttaatcctttaatcttt

SEQ ID NO: 506440 - DNA, 25 bp, Mus musculus
gatcatctttatcgtgggccgtggc

SEQ ID NO: 506441 - DNA, 25 bp, Mus musculus
gatcatctttatggtgggccgtggc

SEQ ID NO: 506442 - DNA, 25 bp, Mus musculus
gatcatcttttcacatttcggaggc

SEQ ID NO: 506443 - DNA, 25 bp, Mus musculus
gatcatcttttctcatttcggaggc

SEQ ID NO: 506444 - DNA, 25 bp, Mus musculus
gatcatgaacctaggattcttgtgg

SEQ ID NO: 506445 - DNA, 25 bp, Mus musculus
gatcatgaaccttggattcttgtgg

SEQ ID NO: 506446 - DNA, 25 bp, Mus musculus
gatcatgacaacagcgtggtctctg

SEQ ID NO: 506447 - DNA, 25 bp, Mus musculus
gatcatgacaactgcgtggtctctg

SEQ ID NO: 506448 - DNA, 25 bp, Mus musculus
gatcatgacattcctcagatttttt

SEQ ID NO: 506449 - DNA, 25 bp, Mus musculus
gatcatgacattgctcagatttttt

SEQ ID NO: 506450 - DNA, 25 bp, Mus musculus
gatcatgaccatagagctcctggac

SEQ ID NO: 506451 - DNA, 25 bp, Mus musculus
gatcatgaccattgagctcctggac

SEQ ID NO: 506452 - DNA, 25 bp, Mus musculus
gatcatgacccacacagggctggcc

SEQ ID NO: 506453 - DNA, 25 bp, Mus musculus
gatcatgacccagacagggctggcc

SEQ ID NO: 506454 - DNA, 25 bp, Mus musculus
gatcatgagaacaccgtgaccattt

SEQ ID NO: 506455 - DNA, 25 bp, Mus musculus
gatcatgagaactccgtgaccattt

SEQ ID NO: 506456 - DNA, 25 bp, Mus musculus
gatcatgagcccaaaacagatactg

SEQ ID NO: 506457 - DNA, 25 bp, Mus musculus
gatcatgagccctaaacagatactg

SEQ ID NO: 506458 - DNA, 25 bp, Mus musculus
gatcatgagctgcaggcaccggccc

SEQ ID NO: 506459 - DNA, 25 bp, Mus musculus
gatcatgagctggaggcaccggccc

SEQ ID NO: 506460 - DNA, 25 bp, Mus musculus
gatcatgagcttatatatgtctgca

SEQ ID NO: 506461 - DNA, 25 bp, Mus musculus
gatcatgagcttttatatgtctgca

SEQ ID NO: 506462 - DNA, 25 bp, Mus musculus
gatcatgaggaacttcctgttcccg

SEQ ID NO: 506463 - DNA, 25 bp, Mus musculus
gatcatgaggaagttcctgttcccg

SEQ ID NO: 506464 - DNA, 25 bp, Mus musculus
gatcatgaggctagtgtgctgccac

SEQ ID NO: 506465 - DNA, 25 bp, Mus musculus
gatcatgaggcttgtgtgctgccac

SEQ ID NO: 506466 - DNA, 25 bp, Mus musculus
gatcatgaggttatcccaatccctg

SEQ ID NO: 506467 - DNA, 25 bp, Mus musculus
gatcatgaggttttcccaatccctg

SEQ ID NO: 506468 - DNA, 25 bp, Mus musculus
gatcatgagtcaccttatggatgtt

SEQ ID NO: 506469 - DNA, 25 bp, Mus musculus
gatcatgagtcagcttatggatgtt

SEQ ID NO: 506470 - DNA, 25 bp, Mus musculus
gatcatgagtccaatagccaccggc

SEQ ID NO: 506471 - DNA, 25 bp, Mus musculus
gatcatgagtcctatagccaccggc

SEQ ID NO: 506472 - DNA, 25 bp, Mus musculus
gatcatgatagcagcacagaaggga

SEQ ID NO: 506473 - DNA, 25 bp, Mus musculus
gatcatgatagctgcacagaaggga

SEQ ID NO: 506474 - DNA, 25 bp, Mus musculus
gatcatgattaaagtgcgcgtgggc

SEQ ID NO: 506475 - DNA, 25 bp, Mus musculus
gatcatgattaatgtgcgcgtgggc

SEQ ID NO: 506476 - DNA, 25 bp, Mus musculus
gatcatgatttcaccgctaaaattt

SEQ ID NO: 506477 - DNA, 25 bp, Mus musculus
gatcatgatttctccgctaaaattt

SEQ ID NO: 506478 - DNA, 25 bp, Mus musculus
gatcatgcagccatctgagtccaag

SEQ ID NO: 506479 - DNA, 25 bp, Mus musculus
gatcatgcagccttctgagtccaag

SEQ ID NO: 506480 - DNA, 25 bp, Mus musculus
gatcatgcccctagtcttaagttat

SEQ ID NO: 506481 - DNA, 25 bp, Mus musculus
gatcatgccccttgtcttaagttat

SEQ ID NO: 506482 - DNA, 25 bp, Mus musculus
gatcatgcctagcaccaatggctgt

SEQ ID NO: 506483 - DNA, 25 bp, Mus musculus
gatcatgcctaggaccaatggctgt

SEQ ID NO: 506484 - DNA, 25 bp, Mus musculus
gatcatgcctggcattcattagtca

SEQ ID NO: 506485 - DNA, 25 bp, Mus musculus
gatcatgcctggctgttggcaccag

SEQ ID NO: 506486 - DNA, 25 bp, Mus musculus
gatcatgcctgggattcattagtca

SEQ ID NO: 506487 - DNA, 25 bp, Mus musculus
gatcatgcctgggtgttggcaccag

SEQ ID NO: 506488 - DNA, 25 bp, Mus musculus
gatcatgcgcacagccttctgcagg

SEQ ID NO: 506489 - DNA, 25 bp, Mus musculus
gatcatgcgcactgccttctgcagg

SEQ ID NO: 506490 - DNA, 25 bp, Mus musculus
gatcatgctatcaagagcctctgaa

SEQ ID NO: 506491 - DNA, 25 bp, Mus musculus
gatcatgctatctagagcctctgaa

SEQ ID NO: 506492 - DNA, 25 bp, Mus musculus
gatcatgctcagaatgtgacttcac

SEQ ID NO: 506493 - DNA, 25 bp, Mus musculus
gatcatgctcagtatgtgacttcac

SEQ ID NO: 506494 - DNA, 25 bp, Mus musculus
gatcatgcttcaaactgaggcctag

SEQ ID NO: 506495 - DNA, 25 bp, Mus musculus
gatcatgcttcatactgaggcctag

SEQ ID NO: 506496 - DNA, 25 bp, Mus musculus
gatcatgcttttactctgtacagga

SEQ ID NO: 506497 - DNA, 25 bp, Mus musculus
gatcatgctttttctctgtacagga

SEQ ID NO: 506498 - DNA, 25 bp, Mus musculus
gatcatggaaacagttgccgttttt

SEQ ID NO: 506499 - DNA, 25 bp, Mus musculus
gatcatggaaactgttgccgttttt

SEQ ID NO: 506500 - DNA, 25 bp, Mus musculus
gatcatggagctcagaatttttcgt

SEQ ID NO: 506501 - DNA, 25 bp, Mus musculus
gatcatggagctgagaatttttcgt

SEQ ID NO: 506502 - DNA, 25 bp, Mus musculus
gatcatggaggcacacctagacaca

SEQ ID NO: 506503 - DNA, 25 bp, Mus musculus
gatcatggaggctcacctagacaca

SEQ ID NO: 506504 - DNA, 25 bp, Mus musculus
gatcatggagggacatagggtacaa

SEQ ID NO: 506505 - DNA, 25 bp, Mus musculus
gatcatggagggtcatagggtacaa

SEQ ID NO: 506506 - DNA, 25 bp, Mus musculus
gatcatggagtccttgcaacaggta

SEQ ID NO: 506507 - DNA, 25 bp, Mus musculus
gatcatggagtcgttgcaacaggta

SEQ ID NO: 506508 - DNA, 25 bp, Mus musculus
gatcatggcattaactgtacctcat

SEQ ID NO: 506509 - DNA, 25 bp, Mus musculus
gatcatggcatttactgtacctcat

SEQ ID NO: 506510 - DNA, 25 bp, Mus musculus
gatcatggctgactacaacatcaag

SEQ ID NO: 506511 - DNA, 25 bp, Mus musculus
gatcatggctgagtacaacatcaag

SEQ ID NO: 506512 - DNA, 25 bp, Mus musculus
gatcatgggatccttgcaaggagtt

SEQ ID NO: 506513 - DNA, 25 bp, Mus musculus
gatcatgggatcgttgcaaggagtt

SEQ ID NO: 506514 - DNA, 25 bp, Mus musculus
gatcatgggctaaccctcatgtgaa

SEQ ID NO: 506515 - DNA, 25 bp, Mus musculus
gatcatgggctatccctcatgtgaa

SEQ ID NO: 506516 - DNA, 25 bp, Mus musculus
gatcatgggtgactcagttaaccta

SEQ ID NO: 506517 - DNA, 25 bp, Mus musculus
gatcatgggtgagtcagttaaccta

SEQ ID NO: 506518 - DNA, 25 bp, Mus musculus
gatcatggtgagatactgtaatgca

SEQ ID NO: 506519 - DNA, 25 bp, Mus musculus
gatcatggtgagttactgtaatgca

SEQ ID NO: 506520 - DNA, 25 bp, Mus musculus
gatcatggtggaagtcctttgccgc

SEQ ID NO: 506521 - DNA, 25 bp, Mus musculus
gatcatggtggatgtcctttgccgc

SEQ ID NO: 506522 - DNA, 25 bp, Mus musculus
gatcatggtgttctcatgtcccatc

SEQ ID NO: 506523 - DNA, 25 bp, Mus musculus
gatcatggtgttgtcatgtcccatc

SEQ ID NO: 506524 - DNA, 25 bp, Mus musculus
gatcatggttgcctgtctggaacac

SEQ ID NO: 506525 - DNA, 25 bp, Mus musculus
gatcatggttgcgtgtctggaacac

SEQ ID NO: 506526 - DNA, 25 bp, Mus musculus
gatcatgtaactctctaactctgag

SEQ ID NO: 506527 - DNA, 25 bp, Mus musculus
gatcatgtaactgtctaactctgag

SEQ ID NO: 506528 - DNA, 25 bp, Mus musculus
gatcatgtagtcatttttcattact

SEQ ID NO: 506529 - DNA, 25 bp, Mus musculus
gatcatgtagtcttttttcattact

SEQ ID NO: 506530 - DNA, 25 bp, Mus musculus
gatcatgtagttaagtgtgccatac

SEQ ID NO: 506531 - DNA, 25 bp, Mus musculus
gatcatgtagtttagtgtgccatac

SEQ ID NO: 506532 - DNA, 25 bp, Mus musculus
gatcatgtcagtcctctacgtctgg

SEQ ID NO: 506533 - DNA, 25 bp, Mus musculus
gatcatgtcagtgctctacgtctgg

SEQ ID NO: 506534 - DNA, 25 bp, Mus musculus
gatcatgtcccaattgtgttactaa

SEQ ID NO: 506535 - DNA, 25 bp, Mus musculus
gatcatgtcccatttgtgttactaa

SEQ ID NO: 506536 - DNA, 25 bp, Mus musculus
gatcatgtctctctcttcagtgtat

SEQ ID NO: 506537 - DNA, 25 bp, Mus musculus
gatcatgtctctgtcttcagtgtat

SEQ ID NO: 506538 - DNA, 25 bp, Mus musculus
gatcatgtgatccttgcccatcaaa

SEQ ID NO: 506539 - DNA, 25 bp, Mus musculus
gatcatgtgatcgttgcccatcaaa

SEQ ID NO: 506540 - DNA, 25 bp, Mus musculus
gatcatgtgatgctaaactcttctc

SEQ ID NO: 506541 - DNA, 25 bp, Mus musculus
gatcatgtgatggtaaactcttctc

SEQ ID NO: 506542 - DNA, 25 bp, Mus musculus
gatcatgtgcatatcatcccattgt

SEQ ID NO: 506543 - DNA, 25 bp, Mus musculus
gatcatgtgcatttcatcccattgt

SEQ ID NO: 506544 - DNA, 25 bp, Mus musculus
gatcatgtgccaaggctgcggagca

SEQ ID NO: 506545 - DNA, 25 bp, Mus musculus
gatcatgtgccatggctgcggagca

SEQ ID NO: 506546 - DNA, 25 bp, Mus musculus
gatcatgttacacctgttgcctggt

SEQ ID NO: 506547 - DNA, 25 bp, Mus musculus
gatcatgttacagctgttgcctggt

SEQ ID NO: 506548 - DNA, 25 bp, Mus musculus
gatcatgttcaccattgctcaagga

SEQ ID NO: 506549 - DNA, 25 bp, Mus musculus
gatcatgttcacgattgctcaagga

SEQ ID NO: 506550 - DNA, 25 bp, Mus musculus
gatcatgttgatactgaaatcatgt

SEQ ID NO: 506551 - DNA, 25 bp, Mus musculus
gatcatgttgattctgaaatcatgt

SEQ ID NO: 506552 - DNA, 25 bp, Mus musculus
gatcatgttgtcattcaatacaggc

SEQ ID NO: 506553 - DNA, 25 bp, Mus musculus
gatcatgttgtctttcaatacaggc

SEQ ID NO: 506554 - DNA, 25 bp, Mus musculus
gatcatgtttggcaagcggcgcaaa

SEQ ID NO: 506555 - DNA, 25 bp, Mus musculus
gatcatgtttgggaagcggcgcaaa

SEQ ID NO: 506556 - DNA, 25 bp, Mus musculus
gatcattaacataccagtgagatac

SEQ ID NO: 506557 - DNA, 25 bp, Mus musculus
gatcattaacattccagtgagatac

SEQ ID NO: 506558 - DNA, 25 bp, Mus musculus
gatcattaagctcatcttttccttt

SEQ ID NO: 506559 - DNA, 25 bp, Mus musculus
gatcattaagctgatcttttccttt

SEQ ID NO: 506560 - DNA, 25 bp, Mus musculus
gatcattaattcatgcaccctgtgg

SEQ ID NO: 506561 - DNA, 25 bp, Mus musculus
gatcattaattcttgcaccctgtgg

SEQ ID NO: 506562 - DNA, 25 bp, Mus musculus
gatcattacacgcagaacacccaag

SEQ ID NO: 506563 - DNA, 25 bp, Mus musculus
gatcattacacggagaacacccaag

SEQ ID NO: 506564 - DNA, 25 bp, Mus musculus
gatcattacgtaagctctgacatct

SEQ ID NO: 506565 - DNA, 25 bp, Mus musculus
gatcattacgtatgctctgacatct

SEQ ID NO: 506566 - DNA, 25 bp, Mus musculus
gatcattactatcctcatagacccc

SEQ ID NO: 506567 - DNA, 25 bp, Mus musculus
gatcattactatgctcatagacccc

SEQ ID NO: 506568 - DNA, 25 bp, Mus musculus
gatcattagacccaccagggcacgt

SEQ ID NO: 506569 - DNA, 25 bp, Mus musculus
gatcattagaccgaccagggcacgt

SEQ ID NO: 506570 - DNA, 25 bp, Mus musculus
gatcattagccaaagagtcttacaa

SEQ ID NO: 506571 - DNA, 25 bp, Mus musculus
gatcattagccatagagtcttacaa

SEQ ID NO: 506572 - DNA, 25 bp, Mus musculus
gatcattagtacaagtgtgtcacgt

SEQ ID NO: 506573 - DNA, 25 bp, Mus musculus
gatcattagtactagtgtgtcacgt

SEQ ID NO: 506574 - DNA, 25 bp, Mus musculus
gatcattagtctacagcaggtttta

SEQ ID NO: 506575 - DNA, 25 bp, Mus musculus
gatcattagtcttcagcaggtttta

SEQ ID NO: 506576 - DNA, 25 bp, Mus musculus
gatcattagtgtatccctttagtgc

SEQ ID NO: 506577 - DNA, 25 bp, Mus musculus
gatcattagtgtttccctttagtgc

SEQ ID NO: 506578 - DNA, 25 bp, Mus musculus
gatcattattttcatgcttgcttta

SEQ ID NO: 506579 - DNA, 25 bp, Mus musculus
gatcattattttgatgcttgcttta

SEQ ID NO: 506580 - DNA, 25 bp, Mus musculus
gatcattcaaacagtagctaggcag

SEQ ID NO: 506581 - DNA, 25 bp, Mus musculus
gatcattcaaactgtagctaggcag

SEQ ID NO: 506582 - DNA, 25 bp, Mus musculus
gatcattcacacaagagcactttct

SEQ ID NO: 506583 - DNA, 25 bp, Mus musculus
gatcattcacactagagcactttct

SEQ ID NO: 506584 - DNA, 25 bp, Mus musculus
gatcattcagagcatctttcagacg

SEQ ID NO: 506585 - DNA, 25 bp, Mus musculus
gatcattcagaggatctttcagacg

SEQ ID NO: 506586 - DNA, 25 bp, Mus musculus
gatcattcatcgacacagtcagctt

SEQ ID NO: 506587 - DNA, 25 bp, Mus musculus
gatcattcatcgtcacagtcagctt

SEQ ID NO: 506588 - DNA, 25 bp, Mus musculus
gatcattccacaaaacagcaggtat

SEQ ID NO: 506589 - DNA, 25 bp, Mus musculus
gatcattccacataacagcaggtat

SEQ ID NO: 506590 - DNA, 25 bp, Mus musculus
gatcattcctaacttttgacattgg

SEQ ID NO: 506591 - DNA, 25 bp, Mus musculus
gatcattcctaagttttgacattgg

SEQ ID NO: 506592 - DNA, 25 bp, Mus musculus
gatcattcctagaggtgccgacaat

SEQ ID NO: 506593 - DNA, 25 bp, Mus musculus
gatcattcctagtggtgccgacaat

SEQ ID NO: 506594 - DNA, 25 bp, Mus musculus
gatcattcggagagctacagaaaca

SEQ ID NO: 506595 - DNA, 25 bp, Mus musculus
gatcattcggagtgctacagaaaca

SEQ ID NO: 506596 - DNA, 25 bp, Mus musculus
gatcattcttggctctaagggtcag

SEQ ID NO: 506597 - DNA, 25 bp, Mus musculus
gatcattcttgggtctaagggtcag

SEQ ID NO: 506598 - DNA, 25 bp, Mus musculus
gatcattctttcactgctcggtaat

SEQ ID NO: 506599 - DNA, 25 bp, Mus musculus
gatcattctttctctgctcggtaat

SEQ ID NO: 506600 - DNA, 25 bp, Mus musculus
gatcattgacctactttgtttttgt

SEQ ID NO: 506601 - DNA, 25 bp, Mus musculus
gatcattgaccttctttgtttttgt

SEQ ID NO: 506602 - DNA, 25 bp, Mus musculus
gatcattgcaaacattcttctcccg

SEQ ID NO: 506603 - DNA, 25 bp, Mus musculus
gatcattgcaaagattcttctcccg

SEQ ID NO: 506604 - DNA, 25 bp, Mus musculus
gatcattgcagacctcattccagag

SEQ ID NO: 506605 - DNA, 25 bp, Mus musculus
gatcattgcagagctcattccagag

SEQ ID NO: 506606 - DNA, 25 bp, Mus musculus
gatcattgcattagttgtctttgaa

SEQ ID NO: 506607 - DNA, 25 bp, Mus musculus
gatcattgcatttgttgtctttgaa

SEQ ID NO: 506608 - DNA, 25 bp, Mus musculus
gatcattggcgcctaaaaaataatt

SEQ ID NO: 506609 - DNA, 25 bp, Mus musculus
gatcattggcgcgtaaaaaataatt

SEQ ID NO: 506610 - DNA, 25 bp, Mus musculus
gatcattgggacattgcagaactct

SEQ ID NO: 506611 - DNA, 25 bp, Mus musculus
gatcattgggactttgcagaactct

SEQ ID NO: 506612 - DNA, 25 bp, Mus musculus
gatcattggtagcactagcctatca

SEQ ID NO: 506613 - DNA, 25 bp, Mus musculus
gatcattggtaggactagcctatca

SEQ ID NO: 506614 - DNA, 25 bp, Mus musculus
gatcattgtacccatgccttggtat

SEQ ID NO: 506615 - DNA, 25 bp, Mus musculus
gatcattgtaccgatgccttggtat

SEQ ID NO: 506616 - DNA, 25 bp, Mus musculus
gatcattgtgaacacctcgtgagct

SEQ ID NO: 506617 - DNA, 25 bp, Mus musculus
gatcattgtgaagacctcgtgagct

SEQ ID NO: 506618 - DNA, 25 bp, Mus musculus
gatcattgtttgctacagtctcctt

SEQ ID NO: 506619 - DNA, 25 bp, Mus musculus
gatcattgtttggtacagtctcctt

SEQ ID NO: 506620 - DNA, 25 bp, Mus musculus
gatcattgttttcactatcctgcca

SEQ ID NO: 506621 - DNA, 25 bp, Mus musculus
gatcattgttttgactatcctgcca

SEQ ID NO: 506622 - DNA, 25 bp, Mus musculus
gatcatttaatcaggttcctactga

SEQ ID NO: 506623 - DNA, 25 bp, Mus musculus
gatcatttaatctggttcctactga

SEQ ID NO: 506624 - DNA, 25 bp, Mus musculus
gatcatttacgtctcaggaactgct

SEQ ID NO: 506625 - DNA, 25 bp, Mus musculus
gatcatttacgtgtcaggaactgct

SEQ ID NO: 506626 - DNA, 25 bp, Mus musculus
gatcatttagaccttgaatggaaat

SEQ ID NO: 506627 - DNA, 25 bp, Mus musculus
gatcatttagacgttgaatggaaat

SEQ ID NO: 506628 - DNA, 25 bp, Mus musculus
gatcatttagctcttgcagtcttgg

SEQ ID NO: 506629 - DNA, 25 bp, Mus musculus
gatcatttagctgttgcagtcttgg

SEQ ID NO: 506630 - DNA, 25 bp, Mus musculus
gatcatttcaaacctttgtgggcca

SEQ ID NO: 506631 - DNA, 25 bp, Mus musculus
gatcatttcaaagctttgtgggcca

SEQ ID NO: 506632 - DNA, 25 bp, Mus musculus
gatcatttccctcgttaactttcca

SEQ ID NO: 506633 - DNA, 25 bp, Mus musculus
gatcatttccctggttaactttcca

SEQ ID NO: 506634 - DNA, 25 bp, Mus musculus
gatcatttctttctggcctgttatg

SEQ ID NO: 506635 - DNA, 25 bp, Mus musculus
gatcatttctttgtggcctgttatg

SEQ ID NO: 506636 - DNA, 25 bp, Mus musculus
gatcatttgacccttcttgtctgat

SEQ ID NO: 506637 - DNA, 25 bp, Mus musculus
gatcatttgaccgttcttgtctgat

SEQ ID NO: 506638 - DNA, 25 bp, Mus musculus
gatcatttggccaggattgtctccc

SEQ ID NO: 506639 - DNA, 25 bp, Mus musculus
gatcatttggcctggattgtctccc

SEQ ID NO: 506640 - DNA, 25 bp, Mus musculus
gatcatttgggcaattgtccacaag

SEQ ID NO: 506641 - DNA, 25 bp, Mus musculus
gatcatttgggctattgtccacaag

SEQ ID NO: 506642 - DNA, 25 bp, Mus musculus
gatcatttgtcaaggcgtatggctt

SEQ ID NO: 506643 - DNA, 25 bp, Mus musculus
gatcatttgtcatggcgtatggctt

SEQ ID NO: 506644 - DNA, 25 bp, Mus musculus
gatcatttgtggctctggagtctac

SEQ ID NO: 506645 - DNA, 25 bp, Mus musculus
gatcatttgtgggtctggagtctac

SEQ ID NO: 506646 - DNA, 25 bp, Mus musculus
gatcatttgttcagtagctttctcc

SEQ ID NO: 506647 - DNA, 25 bp, Mus musculus
gatcatttgttctgtagctttctcc

SEQ ID NO: 506648 - DNA, 25 bp, Mus musculus
gatcattttacgagactttccaaag

SEQ ID NO: 506649 - DNA, 25 bp, Mus musculus
gatcattttacgtgactttccaaag

SEQ ID NO: 506650 - DNA, 25 bp, Mus musculus
gatcattttactctctaaagtttgc

SEQ ID NO: 506651 - DNA, 25 bp, Mus musculus
gatcattttactgtctaaagtttgc

SEQ ID NO: 506652 - DNA, 25 bp, Mus musculus
gatcattttcacaaaggcacctttt

SEQ ID NO: 506653 - DNA, 25 bp, Mus musculus
gatcattttcactaaggcacctttt

SEQ ID NO: 506654 - DNA, 25 bp, Mus musculus
gatcattttcccagacctttgaaat

SEQ ID NO: 506655 - DNA, 25 bp, Mus musculus
gatcattttccctgacctttgaaat

SEQ ID NO: 506656 - DNA, 25 bp, Mus musculus
gatcattttgatctgcatgttcttg

SEQ ID NO: 506657 - DNA, 25 bp, Mus musculus
gatcattttgatgtgcatgttcttg

SEQ ID NO: 506658 - DNA, 25 bp, Mus musculus
gatcattttgtccagtgagtacctc

SEQ ID NO: 506659 - DNA, 25 bp, Mus musculus
gatcattttgtcgagtgagtacctc

SEQ ID NO: 506660 - DNA, 25 bp, Mus musculus
gatcatttttctctagccatggact

SEQ ID NO: 506661 - DNA, 25 bp, Mus musculus
gatcatttttctgtagccatggact

SEQ ID NO: 506662 - DNA, 25 bp, Mus musculus
gatccaaaagcgagttttcctcaga

SEQ ID NO: 506663 - DNA, 25 bp, Mus musculus
gatccaaaagcgtgttttcctcaga

SEQ ID NO: 506664 - DNA, 25 bp, Mus musculus
gatccaaaatctaatgtaaatagcc

SEQ ID NO: 506665 - DNA, 25 bp, Mus musculus
gatccaaaatcttatgtaaatagcc

SEQ ID NO: 506666 - DNA, 25 bp, Mus musculus
gatccaaaccaccttgggatttgta

SEQ ID NO: 506667 - DNA, 25 bp, Mus musculus
gatccaaaccacgttgggatttgta

SEQ ID NO: 506668 - DNA, 25 bp, Mus musculus
gatccaaacctgacatcctttagat

SEQ ID NO: 506669 - DNA, 25 bp, Mus musculus
gatccaaacctgtcatcctttagat

SEQ ID NO: 506670 - DNA, 25 bp, Mus musculus
gatccaaactaaagttctttctact

SEQ ID NO: 506671 - DNA, 25 bp, Mus musculus
gatccaaactaatgttctttctact

SEQ ID NO: 506672 - DNA, 25 bp, Mus musculus
gatccaaactgacaccttccataga

SEQ ID NO: 506673 - DNA, 25 bp, Mus musculus
gatccaaactgagaccttccataga

SEQ ID NO: 506674 - DNA, 25 bp, Mus musculus
gatccaaagacccaacgtttctctt

SEQ ID NO: 506675 - DNA, 25 bp, Mus musculus
gatccaaagaccgaacgtttctctt

SEQ ID NO: 506676 - DNA, 25 bp, Mus musculus
gatccaaagactctagccgctatat

SEQ ID NO: 506677 - DNA, 25 bp, Mus musculus
gatccaaagactgtagccgctatat

SEQ ID NO: 506678 - DNA, 25 bp, Mus musculus
gatccaaagatcatctcatgctgtg

SEQ ID NO: 506679 - DNA, 25 bp, Mus musculus
gatccaaagatcttctcatgctgtg

SEQ ID NO: 506680 - DNA, 25 bp, Mus musculus
gatccaaagccccagtagaagagaa

SEQ ID NO: 506681 - DNA, 25 bp, Mus musculus
gatccaaagcccgagtagaagagaa

SEQ ID NO: 506682 - DNA, 25 bp, Mus musculus
gatccaaaggtgaacgctatcccag

SEQ ID NO: 506683 - DNA, 25 bp, Mus musculus
gatccaaaggtgtacgctatcccag

SEQ ID NO: 506684 - DNA, 25 bp, Mus musculus
gatccaaataccacattcaaaagca

SEQ ID NO: 506685 - DNA, 25 bp, Mus musculus
gatccaaataccatgtccacattgt

SEQ ID NO: 506686 - DNA, 25 bp, Mus musculus
gatccaaatacctcattcaaaagca

SEQ ID NO: 506687 - DNA, 25 bp, Mus musculus
gatccaaataccttgtccacattgt

SEQ ID NO: 506688 - DNA, 25 bp, Mus musculus
gatccaaatactatgtttccaacca

SEQ ID NO: 506689 - DNA, 25 bp, Mus musculus
gatccaaatactttgtttccaacca

SEQ ID NO: 506690 - DNA, 25 bp, Mus musculus
gatccaaatatgattagctgctata

SEQ ID NO: 506691 - DNA, 25 bp, Mus musculus
gatccaaatatgtttagctgctata

SEQ ID NO: 506692 - DNA, 25 bp, Mus musculus
gatccaacagaacttcaactaagtg

SEQ ID NO: 506693 - DNA, 25 bp, Mus musculus
gatccaacagaagttcaactaagtg

SEQ ID NO: 506694 - DNA, 25 bp, Mus musculus
gatccaacagtcctctttattcttt

SEQ ID NO: 506695 - DNA, 25 bp, Mus musculus
gatccaacagtcgtctttattcttt

SEQ ID NO: 506696 - DNA, 25 bp, Mus musculus
gatccaacatctcggaaaagtactt

SEQ ID NO: 506697 - DNA, 25 bp, Mus musculus
gatccaacatctgggaaaagtactt

SEQ ID NO: 506698 - DNA, 25 bp, Mus musculus
gatccaaccagaacctgtgcatgta

SEQ ID NO: 506699 - DNA, 25 bp, Mus musculus
gatccaaccagatcctgtgcatgta

SEQ ID NO: 506700 - DNA, 25 bp, Mus musculus
gatccaacgtggactttaagcttct

SEQ ID NO: 506701 - DNA, 25 bp, Mus musculus
gatccaacgtggtctttaagcttct

SEQ ID NO: 506702 - DNA, 25 bp, Mus musculus
gatccaacgtttaataggttcatga

SEQ ID NO: 506703 - DNA, 25 bp, Mus musculus
gatccaacgttttataggttcatga

SEQ ID NO: 506704 - DNA, 25 bp, Mus musculus
gatccaactacaatccacagtggta

SEQ ID NO: 506705 - DNA, 25 bp, Mus musculus
gatccaactacattccacagtggta

SEQ ID NO: 506706 - DNA, 25 bp, Mus musculus
gatccaactattaattcttagctca

SEQ ID NO: 506707 - DNA, 25 bp, Mus musculus
gatccaactatttattcttagctca

SEQ ID NO: 506708 - DNA, 25 bp, Mus musculus
gatccaactcaacctattgacctaa

SEQ ID NO: 506709 - DNA, 25 bp, Mus musculus
gatccaactcaagctattgacctaa

SEQ ID NO: 506710 - DNA, 25 bp, Mus musculus
gatccaagaggcagttttcgtttgt

SEQ ID NO: 506711 - DNA, 25 bp, Mus musculus
gatccaagaggctgttttcgtttgt

SEQ ID NO: 506712 - DNA, 25 bp, Mus musculus
gatccaagcaggacgttgcaggaca

SEQ ID NO: 506713 - DNA, 25 bp, Mus musculus
gatccaagcaggtcgttgcaggaca

SEQ ID NO: 506714 - DNA, 25 bp, Mus musculus
gatccaagccaacaagcctgaaagg

SEQ ID NO: 506715 - DNA, 25 bp, Mus musculus
gatccaagccaagaagcctgaaagg

SEQ ID NO: 506716 - DNA, 25 bp, Mus musculus
gatccaagccatctactgaattcta

SEQ ID NO: 506717 - DNA, 25 bp, Mus musculus
gatccaagccatgtactgaattcta

SEQ ID NO: 506718 - DNA, 25 bp, Mus musculus
gatccaagccggcagaaggtacctg

SEQ ID NO: 506719 - DNA, 25 bp, Mus musculus
gatccaagccgggagaaggtacctg

SEQ ID NO: 506720 - DNA, 25 bp, Mus musculus
gatccaagccttagggttggcccag

SEQ ID NO: 506721 - DNA, 25 bp, Mus musculus
gatccaagcctttgggttggcccag

SEQ ID NO: 506722 - DNA, 25 bp, Mus musculus
gatccaagcgggaatgctcacaagt

SEQ ID NO: 506723 - DNA, 25 bp, Mus musculus
gatccaagcgggtatgctcacaagt

SEQ ID NO: 506724 - DNA, 25 bp, Mus musculus
gatccaagcgtgaccagttcagtga

SEQ ID NO: 506725 - DNA, 25 bp, Mus musculus
gatccaagcgtgtccagttcagtga

SEQ ID NO: 506726 - DNA, 25 bp, Mus musculus
gatccaagctcaaccgcaggaagaa

SEQ ID NO: 506727 - DNA, 25 bp, Mus musculus
gatccaagctcatccgcaggaagaa

SEQ ID NO: 506728 - DNA, 25 bp, Mus musculus
gatccaagcttgctggcgcggtaca

SEQ ID NO: 506729 - DNA, 25 bp, Mus musculus
gatccaagcttggtggcgcggtaca

SEQ ID NO: 506730 - DNA, 25 bp, Mus musculus
gatccaaggccaagtagttgaaagg

SEQ ID NO: 506731 - DNA, 25 bp, Mus musculus
gatccaaggccatgtagttgaaagg

SEQ ID NO: 506732 - DNA, 25 bp, Mus musculus
gatccaaggttcaagctgctgttag

SEQ ID NO: 506733 - DNA, 25 bp, Mus musculus
gatccaaggttctagctgctgttag

SEQ ID NO: 506734 - DNA, 25 bp, Mus musculus
gatccaagtgctcctcagaggcaaa

SEQ ID NO: 506735 - DNA, 25 bp, Mus musculus
gatccaagtgctgctcagaggcaaa

SEQ ID NO: 506736 - DNA, 25 bp, Mus musculus
gatccaagtggcagtacaacacaaa

SEQ ID NO: 506737 - DNA, 25 bp, Mus musculus
gatccaagtggctgtacaacacaaa

SEQ ID NO: 506738 - DNA, 25 bp, Mus musculus
gatccaataaatagctttccacctt

SEQ ID NO: 506739 - DNA, 25 bp, Mus musculus
gatccaataaattgctttccacctt

SEQ ID NO: 506740 - DNA, 25 bp, Mus musculus
gatccaatagggaagctggagcact

SEQ ID NO: 506741 - DNA, 25 bp, Mus musculus
gatccaatagggtagctggagcact

SEQ ID NO: 506742 - DNA, 25 bp, Mus musculus
gatccaatattgaccggtctctctt

SEQ ID NO: 506743 - DNA, 25 bp, Mus musculus
gatccaatattgtccggtctctctt

SEQ ID NO: 506744 - DNA, 25 bp, Mus musculus
gatccaatatttagctgtttaactg

SEQ ID NO: 506745 - DNA, 25 bp, Mus musculus
gatccaatattttgctgtttaactg

SEQ ID NO: 506746 - DNA, 25 bp, Mus musculus
gatccaatcagtatatcacctattt

SEQ ID NO: 506747 - DNA, 25 bp, Mus musculus
gatccaatcagtttatcacctattt

SEQ ID NO: 506748 - DNA, 25 bp, Mus musculus
gatccaatccaactcctgcggttga

SEQ ID NO: 506749 - DNA, 25 bp, Mus musculus
gatccaatccaagtcctgcggttga

SEQ ID NO: 506750 - DNA, 25 bp, Mus musculus
gatccaatcccacccttgctgagtg

SEQ ID NO: 506751 - DNA, 25 bp, Mus musculus
gatccaatcccagccttgctgagtg

SEQ ID NO: 506752 - DNA, 25 bp, Mus musculus
gatccaatccccattttgggactct

SEQ ID NO: 506753 - DNA, 25 bp, Mus musculus
gatccaatcccctttttgggactct

SEQ ID NO: 506754 - DNA, 25 bp, Mus musculus
gatccaatcgacagggtttctgtcc

SEQ ID NO: 506755 - DNA, 25 bp, Mus musculus
gatccaatcgactgggtttctgtcc

SEQ ID NO: 506756 - DNA, 25 bp, Mus musculus
gatccaatctgcctcaacagtcaat

SEQ ID NO: 506757 - DNA, 25 bp, Mus musculus
gatccaatctgcgtcaacagtcaat

SEQ ID NO: 506758 - DNA, 25 bp, Mus musculus
gatccaatctttctcttaggtttct

SEQ ID NO: 506759 - DNA, 25 bp, Mus musculus
gatccaatctttgtcttaggtttct

SEQ ID NO: 506760 - DNA, 25 bp, Mus musculus
gatccaatgcccaacaaacacaatg

SEQ ID NO: 506761 - DNA, 25 bp, Mus musculus
gatccaatgccctacaaacacaatg

SEQ ID NO: 506762 - DNA, 25 bp, Mus musculus
gatccaattccaagcctggaggtgg

SEQ ID NO: 506763 - DNA, 25 bp, Mus musculus
gatccaattccatgcctggaggtgg

SEQ ID NO: 506764 - DNA, 25 bp, Mus musculus
gatccacaaagccatacctgctatt

SEQ ID NO: 506765 - DNA, 25 bp, Mus musculus
gatccacaaagcctataaagacaag

SEQ ID NO: 506766 - DNA, 25 bp, Mus musculus
gatccacaaagcgatacctgctatt

SEQ ID NO: 506767 - DNA, 25 bp, Mus musculus
gatccacaaagcgtataaagacaag

SEQ ID NO: 506768 - DNA, 25 bp, Mus musculus
gatccacaaataattgtcctaggga

SEQ ID NO: 506769 - DNA, 25 bp, Mus musculus
gatccacaaatatttgtcctaggga

SEQ ID NO: 506770 - DNA, 25 bp, Mus musculus
gatccacaaatgatctccattgtat

SEQ ID NO: 506771 - DNA, 25 bp, Mus musculus
gatccacaaatgttctccattgtat

SEQ ID NO: 506772 - DNA, 25 bp, Mus musculus
gatccacaacagattgtaactggga

SEQ ID NO: 506773 - DNA, 25 bp, Mus musculus
gatccacaacagtttgtaactggga

SEQ ID NO: 506774 - DNA, 25 bp, Mus musculus
gatccacaagttattactcaatatt

SEQ ID NO: 506775 - DNA, 25 bp, Mus musculus
gatccacaagtttttactcaatatt

SEQ ID NO: 506776 - DNA, 25 bp, Mus musculus
gatccacacaacacacttagcaaag

SEQ ID NO: 506777 - DNA, 25 bp, Mus musculus
gatccacacaactcacttagcaaag

SEQ ID NO: 506778 - DNA, 25 bp, Mus musculus
gatccacacctcatctggaaagcca

SEQ ID NO: 506779 - DNA, 25 bp, Mus musculus
gatccacacctcttctggaaagcca

SEQ ID NO: 506780 - DNA, 25 bp, Mus musculus
gatccacactggcaattgtcaacac

SEQ ID NO: 506781 - DNA, 25 bp, Mus musculus
gatccacactgggaattgtcaacac

SEQ ID NO: 506782 - DNA, 25 bp, Mus musculus
gatccacagagaccttaatgcctag

SEQ ID NO: 506783 - DNA, 25 bp, Mus musculus
gatccacagagagcttaatgcctag

SEQ ID NO: 506784 - DNA, 25 bp, Mus musculus
gatccacagcctctgaattccactt

SEQ ID NO: 506785 - DNA, 25 bp, Mus musculus
gatccacagcctgtgaattccactt

SEQ ID NO: 506786 - DNA, 25 bp, Mus musculus
gatccacagtggcatattctagaag

SEQ ID NO: 506787 - DNA, 25 bp, Mus musculus
gatccacagtgggatattctagaag

SEQ ID NO: 506788 - DNA, 25 bp, Mus musculus
gatccacagttgactgaggcccaaa

SEQ ID NO: 506789 - DNA, 25 bp, Mus musculus
gatccacagttgtctgaggcccaaa

SEQ ID NO: 506790 - DNA, 25 bp, Mus musculus
gatccacatactactcaccaatagg

SEQ ID NO: 506791 - DNA, 25 bp, Mus musculus
gatccacatacttctcaccaatagg

SEQ ID NO: 506792 - DNA, 25 bp, Mus musculus
gatccacatgggagaactttcgtga

SEQ ID NO: 506793 - DNA, 25 bp, Mus musculus
gatccacatgggtgaactttcgtga

SEQ ID NO: 506794 - DNA, 25 bp, Mus musculus
gatccaccaacaatagaggccctga

SEQ ID NO: 506795 - DNA, 25 bp, Mus musculus
gatccaccaacattagaggccctga

SEQ ID NO: 506796 - DNA, 25 bp, Mus musculus
gatccaccaaccaagcgagcaggaa

SEQ ID NO: 506797 - DNA, 25 bp, Mus musculus
gatccaccaacctagcgagcaggaa

SEQ ID NO: 506798 - DNA, 25 bp, Mus musculus
gatccaccaccaaagtaccttatga

SEQ ID NO: 506799 - DNA, 25 bp, Mus musculus
gatccaccaccatagtaccttatga

SEQ ID NO: 506800 - DNA, 25 bp, Mus musculus
gatccaccagcactcttttagttac

SEQ ID NO: 506801 - DNA, 25 bp, Mus musculus
gatccaccagcagtcttttagttac

SEQ ID NO: 506802 - DNA, 25 bp, Mus musculus
gatccaccagctcagaattcgtccg

SEQ ID NO: 506803 - DNA, 25 bp, Mus musculus
gatccaccagctgagaattcgtccg

SEQ ID NO: 506804 - DNA, 25 bp, Mus musculus
gatccaccaggaatgaaggagcttc

SEQ ID NO: 506805 - DNA, 25 bp, Mus musculus
gatccaccaggattgaaggagcttc

SEQ ID NO: 506806 - DNA, 25 bp, Mus musculus
gatccaccaggtccatttgatagcc

SEQ ID NO: 506807 - DNA, 25 bp, Mus musculus
gatccaccaggtgcatttgatagcc

SEQ ID NO: 506808 - DNA, 25 bp, Mus musculus
gatccacccgagcttctggaagaag

SEQ ID NO: 506809 - DNA, 25 bp, Mus musculus
gatccacccgaggttctggaagaag

SEQ ID NO: 506810 - DNA, 25 bp, Mus musculus
gatccaccggccctggcaccggtac

SEQ ID NO: 506811 - DNA, 25 bp, Mus musculus
gatccaccggccgtggcaccggtac

SEQ ID NO: 506812 - DNA, 25 bp, Mus musculus
gatccaccgtcaaaatgcagctgca

SEQ ID NO: 506813 - DNA, 25 bp, Mus musculus
gatccaccgtcataatgcagctgca

SEQ ID NO: 506814 - DNA, 25 bp, Mus musculus
gatccacctacaagtttctgtttcc

SEQ ID NO: 506815 - DNA, 25 bp, Mus musculus
gatccacctacatgtttctgtttcc

SEQ ID NO: 506816 - DNA, 25 bp, Mus musculus
gatccacctactatttcagctgacc

SEQ ID NO: 506817 - DNA, 25 bp, Mus musculus
gatccacctactttttcagctgacc

SEQ ID NO: 506818 - DNA, 25 bp, Mus musculus
gatccacctgaaaaaggttaccatg

SEQ ID NO: 506819 - DNA, 25 bp, Mus musculus
gatccacctgaataaggttaccatg

SEQ ID NO: 506820 - DNA, 25 bp, Mus musculus
gatccaccttagacgaagctcagaa

SEQ ID NO: 506821 - DNA, 25 bp, Mus musculus
gatccaccttagtcgaagctcagaa

SEQ ID NO: 506822 - DNA, 25 bp, Mus musculus
gatccaccttttcaggctgaggcag

SEQ ID NO: 506823 - DNA, 25 bp, Mus musculus
gatccaccttttgaggctgaggcag

SEQ ID NO: 506824 - DNA, 25 bp, Mus musculus
gatccacgacgacatagaggtactg

SEQ ID NO: 506825 - DNA, 25 bp, Mus musculus
gatccacgacgagatagaggtactg

SEQ ID NO: 506826 - DNA, 25 bp, Mus musculus
gatccacgtgttacgcagacgagta

SEQ ID NO: 506827 - DNA, 25 bp, Mus musculus
gatccacgtgtttcgcagacgagta

SEQ ID NO: 506828 - DNA, 25 bp, Mus musculus
gatccactacccaacagtcacggag

SEQ ID NO: 506829 - DNA, 25 bp, Mus musculus
gatccactaccctacagtcacggag

SEQ ID NO: 506830 - DNA, 25 bp, Mus musculus
gatccactctggacactcaacaaga

SEQ ID NO: 506831 - DNA, 25 bp, Mus musculus
gatccactctggtcactcaacaaga

SEQ ID NO: 506832 - DNA, 25 bp, Mus musculus
gatccactgaatattgaagctgcag

SEQ ID NO: 506833 - DNA, 25 bp, Mus musculus
gatccactgaattttgaagctgcag

SEQ ID NO: 506834 - DNA, 25 bp, Mus musculus
gatccactgattctgcactaacctc

SEQ ID NO: 506835 - DNA, 25 bp, Mus musculus
gatccactgattgtgcactaacctc

SEQ ID NO: 506836 - DNA, 25 bp, Mus musculus
gatccactggtgaaactactgtgac

SEQ ID NO: 506837 - DNA, 25 bp, Mus musculus
gatccactggtgtaactactgtgac

SEQ ID NO: 506838 - DNA, 25 bp, Mus musculus
gatccactgttccaataaaacgact

SEQ ID NO: 506839 - DNA, 25 bp, Mus musculus
gatccactgttcgaataaaacgact

SEQ ID NO: 506840 - DNA, 25 bp, Mus musculus
gatccacttcttatcatccatcttt

SEQ ID NO: 506841 - DNA, 25 bp, Mus musculus
gatccacttcttttcatccatcttt

SEQ ID NO: 506842 - DNA, 25 bp, Mus musculus
gatccacttgttctcaacttagatg

SEQ ID NO: 506843 - DNA, 25 bp, Mus musculus
gatccacttgttgtcaacttagatg

SEQ ID NO: 506844 - DNA, 25 bp, Mus musculus
gatccactttatagcatcgaatgaa

SEQ ID NO: 506845 - DNA, 25 bp, Mus musculus
gatccactttattgcatcgaatgaa

SEQ ID NO: 506846 - DNA, 25 bp, Mus musculus
gatccactttgcctaatttgacttt

SEQ ID NO: 506847 - DNA, 25 bp, Mus musculus
gatccactttgcgtaatttgacttt

SEQ ID NO: 506848 - DNA, 25 bp, Mus musculus
gatccacttttgacattccactatg

SEQ ID NO: 506849 - DNA, 25 bp, Mus musculus
gatccacttttgtcattccactatg

SEQ ID NO: 506850 - DNA, 25 bp, Mus musculus
gatccactttttagcatgggactgg

SEQ ID NO: 506851 - DNA, 25 bp, Mus musculus
gatccacttttttgcatgggactgg

SEQ ID NO: 506852 - DNA, 25 bp, Mus musculus
gatccagaaagaacgatttggctct

SEQ ID NO: 506853 - DNA, 25 bp, Mus musculus
gatccagaaagacaacccgaaggtg

SEQ ID NO: 506854 - DNA, 25 bp, Mus musculus
gatccagaaagacctatggctccat

SEQ ID NO: 506855 - DNA, 25 bp, Mus musculus
gatccagaaagagaacccgaaggtg

SEQ ID NO: 506856 - DNA, 25 bp, Mus musculus
gatccagaaagagctatggctccat

SEQ ID NO: 506857 - DNA, 25 bp, Mus musculus
gatccagaaagatcgatttggctct

SEQ ID NO: 506858 - DNA, 25 bp, Mus musculus
gatccagaacagacacactcaagta

SEQ ID NO: 506859 - DNA, 25 bp, Mus musculus
gatccagaacagtcacactcaagta

SEQ ID NO: 506860 - DNA, 25 bp, Mus musculus
gatccagaacttcgctgtgcagcag

SEQ ID NO: 506861 - DNA, 25 bp, Mus musculus
gatccagaacttggctgtgcagcag

SEQ ID NO: 506862 - DNA, 25 bp, Mus musculus
gatccagaagaaaccgtgagtccct

SEQ ID NO: 506863 - DNA, 25 bp, Mus musculus
gatccagaagaacctaccacacaag

SEQ ID NO: 506864 - DNA, 25 bp, Mus musculus
gatccagaagaagctaccacacaag

SEQ ID NO: 506865 - DNA, 25 bp, Mus musculus
gatccagaagaatccgtgagtccct

SEQ ID NO: 506866 - DNA, 25 bp, Mus musculus
gatccagaagagagacccagcctga

SEQ ID NO: 506867 - DNA, 25 bp, Mus musculus
gatccagaagagtgacccagcctga

SEQ ID NO: 506868 - DNA, 25 bp, Mus musculus
gatccagaagttcagggactttgct

SEQ ID NO: 506869 - DNA, 25 bp, Mus musculus
gatccagaagttgagggactttgct

SEQ ID NO: 506870 - DNA, 25 bp, Mus musculus
gatccagacaggaaccagtcatgca

SEQ ID NO: 506871 - DNA, 25 bp, Mus musculus
gatccagacaggtaccagtcatgca

SEQ ID NO: 506872 - DNA, 25 bp, Mus musculus
gatccagacataatccatataccta

SEQ ID NO: 506873 - DNA, 25 bp, Mus musculus
gatccagacatattccatataccta

SEQ ID NO: 506874 - DNA, 25 bp, Mus musculus
gatccagacatgatctatcctgagc

SEQ ID NO: 506875 - DNA, 25 bp, Mus musculus
gatccagacatgttctatcctgagc

SEQ ID NO: 506876 - DNA, 25 bp, Mus musculus
gatccagaccatagcgcagtacaag

SEQ ID NO: 506877 - DNA, 25 bp, Mus musculus
gatccagaccattgcgcagtacaag

SEQ ID NO: 506878 - DNA, 25 bp, Mus musculus
gatccagacccaacctgtggtggag

SEQ ID NO: 506879 - DNA, 25 bp, Mus musculus
gatccagacccatcctgtggtggag

SEQ ID NO: 506880 - DNA, 25 bp, Mus musculus
gatccagacgccacagcccaggagg

SEQ ID NO: 506881 - DNA, 25 bp, Mus musculus
gatccagacgccagaaactttctag

SEQ ID NO: 506882 - DNA, 25 bp, Mus musculus
gatccagacgcctcagcccaggagg

SEQ ID NO: 506883 - DNA, 25 bp, Mus musculus
gatccagacgcctgaaactttctag

SEQ ID NO: 506884 - DNA, 25 bp, Mus musculus
gatccagactccagcagatacactg

SEQ ID NO: 506885 - DNA, 25 bp, Mus musculus
gatccagactcctgcagatacactg

SEQ ID NO: 506886 - DNA, 25 bp, Mus musculus
gatccagactgaaaagtgtcctgca

SEQ ID NO: 506887 - DNA, 25 bp, Mus musculus
gatccagactgataagtgtcctgca

SEQ ID NO: 506888 - DNA, 25 bp, Mus musculus
gatccagagcaacctgagtacatca

SEQ ID NO: 506889 - DNA, 25 bp, Mus musculus
gatccagagcaagctgagtacatca

SEQ ID NO: 506890 - DNA, 25 bp, Mus musculus
gatccagaggctaagcaatgttttc

SEQ ID NO: 506891 - DNA, 25 bp, Mus musculus
gatccagaggcttagcaatgttttc

SEQ ID NO: 506892 - DNA, 25 bp, Mus musculus
gatccagagtcgctcagctcggtct

SEQ ID NO: 506893 - DNA, 25 bp, Mus musculus
gatccagagtcggtcagctcggtct

SEQ ID NO: 506894 - DNA, 25 bp, Mus musculus
gatccagatcagacgaagggacccc

SEQ ID NO: 506895 - DNA, 25 bp, Mus musculus
gatccagatcagtcgaagggacccc

SEQ ID NO: 506896 - DNA, 25 bp, Mus musculus
gatccagatcttcagaccagaagac

SEQ ID NO: 506897 - DNA, 25 bp, Mus musculus
gatccagatcttgagaccagaagac

SEQ ID NO: 506898 - DNA, 25 bp, Mus musculus
gatccagatgttccatcagtaagtg

SEQ ID NO: 506899 - DNA, 25 bp, Mus musculus
gatccagatgttgcatcagtaagtg

SEQ ID NO: 506900 - DNA, 25 bp, Mus musculus
gatccagcaaacatggttgggaaac

SEQ ID NO: 506901 - DNA, 25 bp, Mus musculus
gatccagcaaacttggttgggaaac

SEQ ID NO: 506902 - DNA, 25 bp, Mus musculus
gatccagcaaagcaatatccccatc

SEQ ID NO: 506903 - DNA, 25 bp, Mus musculus
gatccagcaaaggaatatccccatc

SEQ ID NO: 506904 - DNA, 25 bp, Mus musculus
gatccagcaagccaggcccagtcag

SEQ ID NO: 506905 - DNA, 25 bp, Mus musculus
gatccagcaagcgaggcccagtcag

SEQ ID NO: 506906 - DNA, 25 bp, Mus musculus
gatccagcaaggagtctatgtgacg

SEQ ID NO: 506907 - DNA, 25 bp, Mus musculus
gatccagcaaggtgtctatgtgacg

SEQ ID NO: 506908 - DNA, 25 bp, Mus musculus
gatccagcagctagctatttcaggc

SEQ ID NO: 506909 - DNA, 25 bp, Mus musculus
gatccagcagcttgctatttcaggc

SEQ ID NO: 506910 - DNA, 25 bp, Mus musculus
gatccagcagtaaaactcagggtat

SEQ ID NO: 506911 - DNA, 25 bp, Mus musculus
gatccagcagtataactcagggtat

SEQ ID NO: 506912 - DNA, 25 bp, Mus musculus
gatccagcagttactgacgttgcgg

SEQ ID NO: 506913 - DNA, 25 bp, Mus musculus
gatccagcagtttctgacgttgcgg

SEQ ID NO: 506914 - DNA, 25 bp, Mus musculus
gatccagccagcatcagtgtgttga

SEQ ID NO: 506915 - DNA, 25 bp, Mus musculus
gatccagccagcttcagtgtgttga

SEQ ID NO: 506916 - DNA, 25 bp, Mus musculus
gatccagccttaatgtctgacatcc

SEQ ID NO: 506917 - DNA, 25 bp, Mus musculus
gatccagccttattgtctgacatcc

SEQ ID NO: 506918 - DNA, 25 bp, Mus musculus
gatccagcgatcagttcttgtcatt

SEQ ID NO: 506919 - DNA, 25 bp, Mus musculus
gatccagcgatctgttcttgtcatt

SEQ ID NO: 506920 - DNA, 25 bp, Mus musculus
gatccagcggccacaaggatggaat

SEQ ID NO: 506921 - DNA, 25 bp, Mus musculus
gatccagcggcctcaaggatggaat

SEQ ID NO: 506922 - DNA, 25 bp, Mus musculus
gatccagctagtcctcaaacagaag

SEQ ID NO: 506923 - DNA, 25 bp, Mus musculus
gatccagctagtgctcaaacagaag

SEQ ID NO: 506924 - DNA, 25 bp, Mus musculus
gatccagctcctaaactgtttagga

SEQ ID NO: 506925 - DNA, 25 bp, Mus musculus
gatccagctcctaccaaagatgagg

SEQ ID NO: 506926 - DNA, 25 bp, Mus musculus
gatccagctccttaactgtttagga

SEQ ID NO: 506927 - DNA, 25 bp, Mus musculus
gatccagctccttccaaagatgagg

SEQ ID NO: 506928 - DNA, 25 bp, Mus musculus
gatccagctcgacagatgccaggga

SEQ ID NO: 506929 - DNA, 25 bp, Mus musculus
gatccagctcgagagatgccaggga

SEQ ID NO: 506930 - DNA, 25 bp, Mus musculus
gatccagctgaaattctaggttcca

SEQ ID NO: 506931 - DNA, 25 bp, Mus musculus
gatccagctgaatttctaggttcca

SEQ ID NO: 506932 - DNA, 25 bp, Mus musculus
gatccagctgagaagtacggcaaat

SEQ ID NO: 506933 - DNA, 25 bp, Mus musculus
gatccagctgagtagtacggcaaat

SEQ ID NO: 506934 - DNA, 25 bp, Mus musculus
gatccagctgatcttttatgcattt

SEQ ID NO: 506935 - DNA, 25 bp, Mus musculus
gatccagctgatgttttatgcattt

SEQ ID NO: 506936 - DNA, 25 bp, Mus musculus
gatccagctggaaaactgaagtatt

SEQ ID NO: 506937 - DNA, 25 bp, Mus musculus
gatccagctggataactgaagtatt

SEQ ID NO: 506938 - DNA, 25 bp, Mus musculus
gatccagctggtcgctgtaacccag

SEQ ID NO: 506939 - DNA, 25 bp, Mus musculus
gatccagctggtggctgtaacccag

SEQ ID NO: 506940 - DNA, 25 bp, Mus musculus
gatccagctgtacgagactttgtga

SEQ ID NO: 506941 - DNA, 25 bp, Mus musculus
gatccagctgtaggagactttgtga

SEQ ID NO: 506942 - DNA, 25 bp, Mus musculus
gatccagcttctatttcatctttgt

SEQ ID NO: 506943 - DNA, 25 bp, Mus musculus
gatccagcttctttttcatctttgt

SEQ ID NO: 506944 - DNA, 25 bp, Mus musculus
gatccagcttttatagatgccaagt

SEQ ID NO: 506945 - DNA, 25 bp, Mus musculus
gatccagcttttttagatgccaagt

SEQ ID NO: 506946 - DNA, 25 bp, Mus musculus
gatccaggaaatcgtccactcggag

SEQ ID NO: 506947 - DNA, 25 bp, Mus musculus
gatccaggaaatggtccactcggag

SEQ ID NO: 506948 - DNA, 25 bp, Mus musculus
gatccaggaagtaggtgaaccatct

SEQ ID NO: 506949 - DNA, 25 bp, Mus musculus
gatccaggaagttggtgaaccatct

SEQ ID NO: 506950 - DNA, 25 bp, Mus musculus
gatccaggactgagacttaaccatt

SEQ ID NO: 506951 - DNA, 25 bp, Mus musculus
gatccaggactgtgacttaaccatt

SEQ ID NO: 506952 - DNA, 25 bp, Mus musculus
gatccaggagaaactgggcctgacc

SEQ ID NO: 506953 - DNA, 25 bp, Mus musculus
gatccaggagaatctgggcctgacc

SEQ ID NO: 506954 - DNA, 25 bp, Mus musculus
gatccaggagctctgtctaaacatc

SEQ ID NO: 506955 - DNA, 25 bp, Mus musculus
gatccaggagctgtgtctaaacatc

SEQ ID NO: 506956 - DNA, 25 bp, Mus musculus
gatccaggagggctatacacacttc

SEQ ID NO: 506957 - DNA, 25 bp, Mus musculus
gatccaggaggggtatacacacttc

SEQ ID NO: 506958 - DNA, 25 bp, Mus musculus
gatccaggagttccattatagccag

SEQ ID NO: 506959 - DNA, 25 bp, Mus musculus
gatccaggagttgcattatagccag

SEQ ID NO: 506960 - DNA, 25 bp, Mus musculus
gatccaggataacgaaggaattcct

SEQ ID NO: 506961 - DNA, 25 bp, Mus musculus
gatccaggataaggaaggaattcct

SEQ ID NO: 506962 - DNA, 25 bp, Mus musculus
gatccaggatacaccggtattactt

SEQ ID NO: 506963 - DNA, 25 bp, Mus musculus
gatccaggatactccggtattactt

SEQ ID NO: 506964 - DNA, 25 bp, Mus musculus
gatccaggatagaactcaacgcaca

SEQ ID NO: 506965 - DNA, 25 bp, Mus musculus
gatccaggatagtactcaacgcaca

SEQ ID NO: 506966 - DNA, 25 bp, Mus musculus
gatccaggatgcaccacagtgagtt

SEQ ID NO: 506967 - DNA, 25 bp, Mus musculus
gatccaggatgctccacagtgagtt

SEQ ID NO: 506968 - DNA, 25 bp, Mus musculus
gatccaggatgtcggccttatgcca

SEQ ID NO: 506969 - DNA, 25 bp, Mus musculus
gatccaggatgtgggccttatgcca

SEQ ID NO: 506970 - DNA, 25 bp, Mus musculus
gatccaggcccacatggtgaccacg

SEQ ID NO: 506971 - DNA, 25 bp, Mus musculus
gatccaggcccagatggtgaccacg

SEQ ID NO: 506972 - DNA, 25 bp, Mus musculus
gatccaggcggaattcattgtgtta

SEQ ID NO: 506973 - DNA, 25 bp, Mus musculus
gatccaggcggatttcattgtgtta

SEQ ID NO: 506974 - DNA, 25 bp, Mus musculus
gatccaggctgaaaggagtccccag

SEQ ID NO: 506975 - DNA, 25 bp, Mus musculus
gatccaggctgacgacatcaacgga

SEQ ID NO: 506976 - DNA, 25 bp, Mus musculus
gatccaggctgaggacatcaacgga

SEQ ID NO: 506977 - DNA, 25 bp, Mus musculus
gatccaggctgataggagtccccag

SEQ ID NO: 506978 - DNA, 25 bp, Mus musculus
gatccaggcttgattctgcctgatt

SEQ ID NO: 506979 - DNA, 25 bp, Mus musculus
gatccaggcttgtttctgcctgatt

SEQ ID NO: 506980 - DNA, 25 bp, Mus musculus
gatccagggcctccctaggacatgg

SEQ ID NO: 506981 - DNA, 25 bp, Mus musculus
gatccagggcctgcctaggacatgg

SEQ ID NO: 506982 - DNA, 25 bp, Mus musculus
gatccagggtacagctctactttaa

SEQ ID NO: 506983 - DNA, 25 bp, Mus musculus
gatccagggtactgctctactttaa

SEQ ID NO: 506984 - DNA, 25 bp, Mus musculus
gatccaggtcacaaggtggacatct

SEQ ID NO: 506985 - DNA, 25 bp, Mus musculus
gatccaggtcactaggtggacatct

SEQ ID NO: 506986 - DNA, 25 bp, Mus musculus
gatccaggtccactttgtagtaccc

SEQ ID NO: 506987 - DNA, 25 bp, Mus musculus
gatccaggtccagtttgtagtaccc

SEQ ID NO: 506988 - DNA, 25 bp, Mus musculus
gatccaggtccgaaaggcagctata

SEQ ID NO: 506989 - DNA, 25 bp, Mus musculus
gatccaggtccgtaaggcagctata

SEQ ID NO: 506990 - DNA, 25 bp, Mus musculus
gatccaggtggcacagtctatccag

SEQ ID NO: 506991 - DNA, 25 bp, Mus musculus
gatccaggtggctcagtctatccag

SEQ ID NO: 506992 - DNA, 25 bp, Mus musculus
gatccagtaccaaggccaggtgcat

SEQ ID NO: 506993 - DNA, 25 bp, Mus musculus
gatccagtaccatggccaggtgcat

SEQ ID NO: 506994 - DNA, 25 bp, Mus musculus
gatccagtactaagacagggactac

SEQ ID NO: 506995 - DNA, 25 bp, Mus musculus
gatccagtactactccaaatgctct

SEQ ID NO: 506996 - DNA, 25 bp, Mus musculus
gatccagtactagtccaaatgctct

SEQ ID NO: 506997 - DNA, 25 bp, Mus musculus
gatccagtactatgacagggactac

SEQ ID NO: 506998 - DNA, 25 bp, Mus musculus
gatccagtagttcaagctcttgagg

SEQ ID NO: 506999 - DNA, 25 bp, Mus musculus
gatccagtagttgaagctcttgagg

SEQ ID NO: 507000 - DNA, 25 bp, Mus musculus
gatccagtatctaggctaatgctca

SEQ ID NO: 507001 - DNA, 25 bp, Mus musculus
gatccagtatcttggctaatgctca

SEQ ID NO: 507002 - DNA, 25 bp, Mus musculus
gatccagtcactcttaacagccact

SEQ ID NO: 507003 - DNA, 25 bp, Mus musculus
gatccagtcactgttaacagccact

SEQ ID NO: 507004 - DNA, 25 bp, Mus musculus
gatccagtccgtatctgtgtgaact

SEQ ID NO: 507005 - DNA, 25 bp, Mus musculus
gatccagtccgtttctgtgtgaact

SEQ ID NO: 507006 - DNA, 25 bp, Mus musculus
gatccagtccttctttccctttgaa

SEQ ID NO: 507007 - DNA, 25 bp, Mus musculus
gatccagtccttgtttccctttgaa

SEQ ID NO: 507008 - DNA, 25 bp, Mus musculus
gatccagtcgtgactaggagcagct

SEQ ID NO: 507009 - DNA, 25 bp, Mus musculus
gatccagtcgtgtctaggagcagct

SEQ ID NO: 507010 - DNA, 25 bp, Mus musculus
gatccagtctaaaggtgcacagatt

SEQ ID NO: 507011 - DNA, 25 bp, Mus musculus
gatccagtctaatggtgcacagatt

SEQ ID NO: 507012 - DNA, 25 bp, Mus musculus
gatccagtctatattgtctctttct

SEQ ID NO: 507013 - DNA, 25 bp, Mus musculus
gatccagtctattttgtctctttct

SEQ ID NO: 507014 - DNA, 25 bp, Mus musculus
gatccagtgaggagcacccgcgctg

SEQ ID NO: 507015 - DNA, 25 bp, Mus musculus
gatccagtgaggtgcacccgcgctg

SEQ ID NO: 507016 - DNA, 25 bp, Mus musculus
gatccagtgcttagacacctgagga

SEQ ID NO: 507017 - DNA, 25 bp, Mus musculus
gatccagtgctttgacacctgagga

SEQ ID NO: 507018 - DNA, 25 bp, Mus musculus
gatccagtggctacagatctctgaa

SEQ ID NO: 507019 - DNA, 25 bp, Mus musculus
gatccagtggctcagcggctgtctt

SEQ ID NO: 507020 - DNA, 25 bp, Mus musculus
gatccagtggctgagcggctgtctt

SEQ ID NO: 507021 - DNA, 25 bp, Mus musculus
gatccagtggcttcagatctctgaa

SEQ ID NO: 507022 - DNA, 25 bp, Mus musculus
gatccagtggtccacaccgtgcaag

SEQ ID NO: 507023 - DNA, 25 bp, Mus musculus
gatccagtggtcgacaccgtgcaag

SEQ ID NO: 507024 - DNA, 25 bp, Mus musculus
gatccagtgtcaaatggctcccaga

SEQ ID NO: 507025 - DNA, 25 bp, Mus musculus
gatccagtgtcatatggctcccaga

SEQ ID NO: 507026 - DNA, 25 bp, Mus musculus
gatccagtgtgcaggtctttgctgt

SEQ ID NO: 507027 - DNA, 25 bp, Mus musculus
gatccagtgtgctggtctttgctgt

SEQ ID NO: 507028 - DNA, 25 bp, Mus musculus
gatccagtgtgtagctggcacttga

SEQ ID NO: 507029 - DNA, 25 bp, Mus musculus
gatccagtgtgttgctggcacttga

SEQ ID NO: 507030 - DNA, 25 bp, Mus musculus
gatccagtgttaagtacggtgtaat

SEQ ID NO: 507031 - DNA, 25 bp, Mus musculus
gatccagtgttatgtacggtgtaat

SEQ ID NO: 507032 - DNA, 25 bp, Mus musculus
gatccagttacacgtgggactttga

SEQ ID NO: 507033 - DNA, 25 bp, Mus musculus
gatccagttacaggtgggactttga

SEQ ID NO: 507034 - DNA, 25 bp, Mus musculus
gatccagttcccattagacctcgat

SEQ ID NO: 507035 - DNA, 25 bp, Mus musculus
gatccagttccctttagacctcgat

SEQ ID NO: 507036 - DNA, 25 bp, Mus musculus
gatccagttcctctagaaacgcggt

SEQ ID NO: 507037 - DNA, 25 bp, Mus musculus
gatccagttcctgtagaaacgcggt

SEQ ID NO: 507038 - DNA, 25 bp, Mus musculus
gatccagttgctagtctgttcacaa

SEQ ID NO: 507039 - DNA, 25 bp, Mus musculus
gatccagttgcttgtctgttcacaa

SEQ ID NO: 507040 - DNA, 25 bp, Mus musculus
gatccagttggaatagttcagtcaa

SEQ ID NO: 507041 - DNA, 25 bp, Mus musculus
gatccagttggattagttcagtcaa

SEQ ID NO: 507042 - DNA, 25 bp, Mus musculus
gatccagttggtacaagggtcacct

SEQ ID NO: 507043 - DNA, 25 bp, Mus musculus
gatccagttggtcctgcctgttgct

SEQ ID NO: 507044 - DNA, 25 bp, Mus musculus
gatccagttggtgctgcctgttgct

SEQ ID NO: 507045 - DNA, 25 bp, Mus musculus
gatccagttggttcaagggtcacct

SEQ ID NO: 507046 - DNA, 25 bp, Mus musculus
gatccagtttatagactgacagctt

SEQ ID NO: 507047 - DNA, 25 bp, Mus musculus
gatccagtttattgactgacagctt

SEQ ID NO: 507048 - DNA, 25 bp, Mus musculus
gatccagttttactgaaccctcttc

SEQ ID NO: 507049 - DNA, 25 bp, Mus musculus
gatccagttttagtgaaccctcttc

SEQ ID NO: 507050 - DNA, 25 bp, Mus musculus
gatccataactcaaaagctttttgt

SEQ ID NO: 507051 - DNA, 25 bp, Mus musculus
gatccataactctaaagctttttgt

SEQ ID NO: 507052 - DNA, 25 bp, Mus musculus
gatccataagacaacaatgcctcta

SEQ ID NO: 507053 - DNA, 25 bp, Mus musculus
gatccataagactacaatgcctcta

SEQ ID NO: 507054 - DNA, 25 bp, Mus musculus
gatccataagccctttgctaaccgt

SEQ ID NO: 507055 - DNA, 25 bp, Mus musculus
gatccataagccgtttgctaaccgt

SEQ ID NO: 507056 - DNA, 25 bp, Mus musculus
gatccataattgaacttcacaggta

SEQ ID NO: 507057 - DNA, 25 bp, Mus musculus
gatccataattgtacttcacaggta

SEQ ID NO: 507058 - DNA, 25 bp, Mus musculus
gatccatacagtcctagttgcagtt

SEQ ID NO: 507059 - DNA, 25 bp, Mus musculus
gatccatacagtgctagttgcagtt

SEQ ID NO: 507060 - DNA, 25 bp, Mus musculus
gatccatacgtcaaagtcttcctgc

SEQ ID NO: 507061 - DNA, 25 bp, Mus musculus
gatccatacgtctaagtcttcctgc

SEQ ID NO: 507062 - DNA, 25 bp, Mus musculus
gatccatactgaatcatcctttgtg

SEQ ID NO: 507063 - DNA, 25 bp, Mus musculus
gatccatactgattcatcctttgtg

SEQ ID NO: 507064 - DNA, 25 bp, Mus musculus
gatccatacttaagaaggtacgtag

SEQ ID NO: 507065 - DNA, 25 bp, Mus musculus
gatccatacttatgaaggtacgtag

SEQ ID NO: 507066 - DNA, 25 bp, Mus musculus
gatccatagcacaaagccacgggct

SEQ ID NO: 507067 - DNA, 25 bp, Mus musculus
gatccatagcactaagccacgggct

SEQ ID NO: 507068 - DNA, 25 bp, Mus musculus
gatccatagctaacacatttccata

SEQ ID NO: 507069 - DNA, 25 bp, Mus musculus
gatccatagctatcacatttccata

SEQ ID NO: 507070 - DNA, 25 bp, Mus musculus
gatccatagctcatattttttccac

SEQ ID NO: 507071 - DNA, 25 bp, Mus musculus
gatccatagctcttattttttccac

SEQ ID NO: 507072 - DNA, 25 bp, Mus musculus
gatccatatagcacagaaacacaac

SEQ ID NO: 507073 - DNA, 25 bp, Mus musculus
gatccatatagctcagaaacacaac

SEQ ID NO: 507074 - DNA, 25 bp, Mus musculus
gatccatatatcaccagcgaagcag

SEQ ID NO: 507075 - DNA, 25 bp, Mus musculus
gatccatatatcatcaccagagaat

SEQ ID NO: 507076 - DNA, 25 bp, Mus musculus
gatccatatatctccagcgaagcag

SEQ ID NO: 507077 - DNA, 25 bp, Mus musculus
gatccatatatcttcaccagagaat

SEQ ID NO: 507078 - DNA, 25 bp, Mus musculus
gatccatatggcatgcacttgctag

SEQ ID NO: 507079 - DNA, 25 bp, Mus musculus
gatccatatggcttgcacttgctag

SEQ ID NO: 507080 - DNA, 25 bp, Mus musculus
gatccatcacacctgtcttttcttg

SEQ ID NO: 507081 - DNA, 25 bp, Mus musculus
gatccatcacacgtgtcttttcttg

SEQ ID NO: 507082 - DNA, 25 bp, Mus musculus
gatccatcccacattattgacgtag

SEQ ID NO: 507083 - DNA, 25 bp, Mus musculus
gatccatcccactttattgacgtag

SEQ ID NO: 507084 - DNA, 25 bp, Mus musculus
gatccatcccagctattcaaacaag

SEQ ID NO: 507085 - DNA, 25 bp, Mus musculus
gatccatcccaggtattcaaacaag

SEQ ID NO: 507086 - DNA, 25 bp, Mus musculus
gatccatcccataattagctccaaa

SEQ ID NO: 507087 - DNA, 25 bp, Mus musculus
gatccatcccattattagctccaaa

SEQ ID NO: 507088 - DNA, 25 bp, Mus musculus
gatccatccccaccaggatgaagat

SEQ ID NO: 507089 - DNA, 25 bp, Mus musculus
gatccatccccagcaggatgaagat

SEQ ID NO: 507090 - DNA, 25 bp, Mus musculus
gatccatcccgcaaagaaacctaat

SEQ ID NO: 507091 - DNA, 25 bp, Mus musculus
gatccatcccgctaagaaacctaat

SEQ ID NO: 507092 - DNA, 25 bp, Mus musculus
gatccatccctgcttagcaattcca

SEQ ID NO: 507093 - DNA, 25 bp, Mus musculus
gatccatccctggttagcaattcca

SEQ ID NO: 507094 - DNA, 25 bp, Mus musculus
gatccatcctgtagtctgattgttg

SEQ ID NO: 507095 - DNA, 25 bp, Mus musculus
gatccatcctgttgtctgattgttg

SEQ ID NO: 507096 - DNA, 25 bp, Mus musculus
gatccatcgatcaatgttgatttgt

SEQ ID NO: 507097 - DNA, 25 bp, Mus musculus
gatccatcgatccattgacccaggg

SEQ ID NO: 507098 - DNA, 25 bp, Mus musculus
gatccatcgatcgattgacccaggg

SEQ ID NO: 507099 - DNA, 25 bp, Mus musculus
gatccatcgatctatgttgatttgt

SEQ ID NO: 507100 - DNA, 25 bp, Mus musculus
gatccatctattaccttggacatgt

SEQ ID NO: 507101 - DNA, 25 bp, Mus musculus
gatccatctatttccttggacatgt

SEQ ID NO: 507102 - DNA, 25 bp, Mus musculus
gatccatctcaacaggaggctccaa

SEQ ID NO: 507103 - DNA, 25 bp, Mus musculus
gatccatctcaagaggaggctccaa

SEQ ID NO: 507104 - DNA, 25 bp, Mus musculus
gatccatctcagaggagcacacgag

SEQ ID NO: 507105 - DNA, 25 bp, Mus musculus
gatccatctcagtggagcacacgag

SEQ ID NO: 507106 - DNA, 25 bp, Mus musculus
gatccatctcttacccatagttttg

SEQ ID NO: 507107 - DNA, 25 bp, Mus musculus
gatccatctctttcccatagttttg

SEQ ID NO: 507108 - DNA, 25 bp, Mus musculus
gatccatctggaccttactttgcct

SEQ ID NO: 507109 - DNA, 25 bp, Mus musculus
gatccatctggagcttactttgcct

SEQ ID NO: 507110 - DNA, 25 bp, Mus musculus
gatccatctgtgagcttcagctggc

SEQ ID NO: 507111 - DNA, 25 bp, Mus musculus
gatccatctgtgctttaagcccgaa

SEQ ID NO: 507112 - DNA, 25 bp, Mus musculus
gatccatctgtggtttaagcccgaa

SEQ ID NO: 507113 - DNA, 25 bp, Mus musculus
gatccatctgtgtgcttcagctggc

SEQ ID NO: 507114 - DNA, 25 bp, Mus musculus
gatccatctttgctatccctgaaga

SEQ ID NO: 507115 - DNA, 25 bp, Mus musculus
gatccatctttggtatccctgaaga

SEQ ID NO: 507116 - DNA, 25 bp, Mus musculus
gatccatgacatcttgtgagacatt

SEQ ID NO: 507117 - DNA, 25 bp, Mus musculus
gatccatgacatgttgtgagacatt

SEQ ID NO: 507118 - DNA, 25 bp, Mus musculus
gatccatgagtgaatattcctttaa

SEQ ID NO: 507119 - DNA, 25 bp, Mus musculus
gatccatgagtgtatattcctttaa

SEQ ID NO: 507120 - DNA, 25 bp, Mus musculus
gatccatgattacctttcattgccc

SEQ ID NO: 507121 - DNA, 25 bp, Mus musculus
gatccatgattagctttcattgccc

SEQ ID NO: 507122 - DNA, 25 bp, Mus musculus
gatccatgcccaatagtcagtagtt

SEQ ID NO: 507123 - DNA, 25 bp, Mus musculus
gatccatgcccattagtcagtagtt

SEQ ID NO: 507124 - DNA, 25 bp, Mus musculus
gatccatgctgtctacagagtcttc

SEQ ID NO: 507125 - DNA, 25 bp, Mus musculus
gatccatgctgtgtacagagtcttc

SEQ ID NO: 507126 - DNA, 25 bp, Mus musculus
gatccatggagcatgatggtcaccc

SEQ ID NO: 507127 - DNA, 25 bp, Mus musculus
gatccatggagcttgatggtcaccc

SEQ ID NO: 507128 - DNA, 25 bp, Mus musculus
gatccatggatcatcttggtagctt

SEQ ID NO: 507129 - DNA, 25 bp, Mus musculus
gatccatggatcttcttggtagctt

SEQ ID NO: 507130 - DNA, 25 bp, Mus musculus
gatccatggcgcatacttttattca

SEQ ID NO: 507131 - DNA, 25 bp, Mus musculus
gatccatggcgcttacttttattca

SEQ ID NO: 507132 - DNA, 25 bp, Mus musculus
gatccatgggctcgcaatgaggctt

SEQ ID NO: 507133 - DNA, 25 bp, Mus musculus
gatccatgggctggcaatgaggctt

SEQ ID NO: 507134 - DNA, 25 bp, Mus musculus
gatccatgtaatagtggtctaacct

SEQ ID NO: 507135 - DNA, 25 bp, Mus musculus
gatccatgtaattgtggtctaacct

SEQ ID NO: 507136 - DNA, 25 bp, Mus musculus
gatccatgtctacaacacctggtga

SEQ ID NO: 507137 - DNA, 25 bp, Mus musculus
gatccatgtctagaacacctggtga

SEQ ID NO: 507138 - DNA, 25 bp, Mus musculus
gatccatgtctcaggaagctcagag

SEQ ID NO: 507139 - DNA, 25 bp, Mus musculus
gatccatgtctctggaagctcagag

SEQ ID NO: 507140 - DNA, 25 bp, Mus musculus
gatccattagcgattctgaagtcca

SEQ ID NO: 507141 - DNA, 25 bp, Mus musculus
gatccattagcgtttctgaagtcca

SEQ ID NO: 507142 - DNA, 25 bp, Mus musculus
gatccattagtgaactctcagaaca

SEQ ID NO: 507143 - DNA, 25 bp, Mus musculus
gatccattagtgtactctcagaaca

SEQ ID NO: 507144 - DNA, 25 bp, Mus musculus
gatccattattgatctacttctcct

SEQ ID NO: 507145 - DNA, 25 bp, Mus musculus
gatccattattgttctacttctcct

SEQ ID NO: 507146 - DNA, 25 bp, Mus musculus
gatccattcacacgcttgtgtagag

SEQ ID NO: 507147 - DNA, 25 bp, Mus musculus
gatccattcacaggcttgtgtagag

SEQ ID NO: 507148 - DNA, 25 bp, Mus musculus
gatccattccttctttaaaatattg

SEQ ID NO: 507149 - DNA, 25 bp, Mus musculus
gatccattccttgtttaaaatattg

SEQ ID NO: 507150 - DNA, 25 bp, Mus musculus
gatccattgagcattcttttgtgtt

SEQ ID NO: 507151 - DNA, 25 bp, Mus musculus
gatccattgagctttcttttgtgtt

SEQ ID NO: 507152 - DNA, 25 bp, Mus musculus
gatccattgcctatagccttaggac

SEQ ID NO: 507153 - DNA, 25 bp, Mus musculus
gatccattgcctttagccttaggac

SEQ ID NO: 507154 - DNA, 25 bp, Mus musculus
gatccattgctaattaactcttctc

SEQ ID NO: 507155 - DNA, 25 bp, Mus musculus
gatccattgctatttaactcttctc

SEQ ID NO: 507156 - DNA, 25 bp, Mus musculus
gatccattggttactcagtccagga

SEQ ID NO: 507157 - DNA, 25 bp, Mus musculus
gatccattggtttctcagtccagga

SEQ ID NO: 507158 - DNA, 25 bp, Mus musculus
gatccattgtctcttctatttattt

SEQ ID NO: 507159 - DNA, 25 bp, Mus musculus
gatccattgtctgttctatttattt

SEQ ID NO: 507160 - DNA, 25 bp, Mus musculus
gatccattgttacacagcactcagg

SEQ ID NO: 507161 - DNA, 25 bp, Mus musculus
gatccattgttagacagcactcagg

SEQ ID NO: 507162 - DNA, 25 bp, Mus musculus
gatccatttacaatgtgtttagaca

SEQ ID NO: 507163 - DNA, 25 bp, Mus musculus
gatccatttacattgtgtttagaca

SEQ ID NO: 507164 - DNA, 25 bp, Mus musculus
gatccatttataccagtgctcttct

SEQ ID NO: 507165 - DNA, 25 bp, Mus musculus
gatccatttatagcagtgctcttct

SEQ ID NO: 507166 - DNA, 25 bp, Mus musculus
gatccatttcatcagatagcatatc

SEQ ID NO: 507167 - DNA, 25 bp, Mus musculus
gatccatttcatgagatagcatatc

SEQ ID NO: 507168 - DNA, 25 bp, Mus musculus
gatccatttgaaatgcctacttttt

SEQ ID NO: 507169 - DNA, 25 bp, Mus musculus
gatccatttgaattgcctacttttt

SEQ ID NO: 507170 - DNA, 25 bp, Mus musculus
gatccatttgcaaacacttcacgaa

SEQ ID NO: 507171 - DNA, 25 bp, Mus musculus
gatccatttgcatacacttcacgaa

SEQ ID NO: 507172 - DNA, 25 bp, Mus musculus
gatccattttaaatgtgcatcctgg

SEQ ID NO: 507173 - DNA, 25 bp, Mus musculus
gatccattttaattgtgcatcctgg

SEQ ID NO: 507174 - DNA, 25 bp, Mus musculus
gatccattttggaatcccttttggt

SEQ ID NO: 507175 - DNA, 25 bp, Mus musculus
gatccattttggtatcccttttggt

SEQ ID NO: 507176 - DNA, 25 bp, Mus musculus
gatccatttttactattctgtcagt

SEQ ID NO: 507177 - DNA, 25 bp, Mus musculus
gatccatttttagtattctgtcagt

SEQ ID NO: 507178 - DNA, 25 bp, Mus musculus
gatccatttttgcaatagcacagga

SEQ ID NO: 507179 - DNA, 25 bp, Mus musculus
gatccatttttggaatagcacagga

SEQ ID NO: 507180 - DNA, 25 bp, Mus musculus
gatcccaaaaatctgctgaaaatga

SEQ ID NO: 507181 - DNA, 25 bp, Mus musculus
gatcccaaaaatgtgctgaaaatga

SEQ ID NO: 507182 - DNA, 25 bp, Mus musculus
gatcccaaactacttaataggaagc

SEQ ID NO: 507183 - DNA, 25 bp, Mus musculus
gatcccaaactagttaataggaagc

SEQ ID NO: 507184 - DNA, 25 bp, Mus musculus
gatcccaaatttctcatcgcagctc

SEQ ID NO: 507185 - DNA, 25 bp, Mus musculus
gatcccaaatttgtcatcgcagctc

SEQ ID NO: 507186 - DNA, 25 bp, Mus musculus
gatcccaacactcgtattttgatgg

SEQ ID NO: 507187 - DNA, 25 bp, Mus musculus
gatcccaacactggtattttgatgg

SEQ ID NO: 507188 - DNA, 25 bp, Mus musculus
gatcccaaccctcagaactttgtgg

SEQ ID NO: 507189 - DNA, 25 bp, Mus musculus
gatcccaaccctgagaactttgtgg

SEQ ID NO: 507190 - DNA, 25 bp, Mus musculus
gatcccaacttcctacttcatgtat

SEQ ID NO: 507191 - DNA, 25 bp, Mus musculus
gatcccaacttcgtacttcatgtat

SEQ ID NO: 507192 - DNA, 25 bp, Mus musculus
gatcccaagaccaaagcctggctga

SEQ ID NO: 507193 - DNA, 25 bp, Mus musculus
gatcccaagacctaagcctggctga

SEQ ID NO: 507194 - DNA, 25 bp, Mus musculus
gatcccaaggatcctagccagagca

SEQ ID NO: 507195 - DNA, 25 bp, Mus musculus
gatcccaaggatgctagccagagca

SEQ ID NO: 507196 - DNA, 25 bp, Mus musculus
gatcccaagttacccctcactggag

SEQ ID NO: 507197 - DNA, 25 bp, Mus musculus
gatcccaagttagccctcactggag

SEQ ID NO: 507198 - DNA, 25 bp, Mus musculus
gatcccaatgatagattcaatggct

SEQ ID NO: 507199 - DNA, 25 bp, Mus musculus
gatcccaatgattgattcaatggct

SEQ ID NO: 507200 - DNA, 25 bp, Mus musculus
gatcccacaaagatcttgaaatcct

SEQ ID NO: 507201 - DNA, 25 bp, Mus musculus
gatcccacaaagttcttgaaatcct

SEQ ID NO: 507202 - DNA, 25 bp, Mus musculus
gatcccacaactatctcagctatag

SEQ ID NO: 507203 - DNA, 25 bp, Mus musculus
gatcccacaactttctcagctatag

SEQ ID NO: 507204 - DNA, 25 bp, Mus musculus
gatcccacaatcacaaagcgtccaa

SEQ ID NO: 507205 - DNA, 25 bp, Mus musculus
gatcccacaatctcaaagcgtccaa

SEQ ID NO: 507206 - DNA, 25 bp, Mus musculus
gatcccacacgacatccagaagctg

SEQ ID NO: 507207 - DNA, 25 bp, Mus musculus
gatcccacacgagatccagaagctg

SEQ ID NO: 507208 - DNA, 25 bp, Mus musculus
gatcccacagtgaaagaagagccaa

SEQ ID NO: 507209 - DNA, 25 bp, Mus musculus
gatcccacagtgtaagaagagccaa

SEQ ID NO: 507210 - DNA, 25 bp, Mus musculus
gatcccacattcattatgctgcagt

SEQ ID NO: 507211 - DNA, 25 bp, Mus musculus
gatcccacattctttatgctgcagt

SEQ ID NO: 507212 - DNA, 25 bp, Mus musculus
gatcccaccgttctgtctttggaaa

SEQ ID NO: 507213 - DNA, 25 bp, Mus musculus
gatcccaccgttgtgtctttggaaa

SEQ ID NO: 507214 - DNA, 25 bp, Mus musculus
gatcccacctgactggaggatagag

SEQ ID NO: 507215 - DNA, 25 bp, Mus musculus
gatcccacctgagtggaggatagag

SEQ ID NO: 507216 - DNA, 25 bp, Mus musculus
gatcccacgtctcaacagagttgga

SEQ ID NO: 507217 - DNA, 25 bp, Mus musculus
gatcccacgtctgaacagagttgga

SEQ ID NO: 507218 - DNA, 25 bp, Mus musculus
gatcccactaacctgcagtgactta

SEQ ID NO: 507219 - DNA, 25 bp, Mus musculus
gatcccactaacgtgcagtgactta

SEQ ID NO: 507220 - DNA, 25 bp, Mus musculus
gatcccactcagataaggttccaac

SEQ ID NO: 507221 - DNA, 25 bp, Mus musculus
gatcccactcagttaaggttccaac

SEQ ID NO: 507222 - DNA, 25 bp, Mus musculus
gatcccagaacacctgtcccaggag

SEQ ID NO: 507223 - DNA, 25 bp, Mus musculus
gatcccagaacagctgtcccaggag

SEQ ID NO: 507224 - DNA, 25 bp, Mus musculus
gatcccagaatgaacagaactgtca

SEQ ID NO: 507225 - DNA, 25 bp, Mus musculus
gatcccagaatgtacagaactgtca

SEQ ID NO: 507226 - DNA, 25 bp, Mus musculus
gatcccagacttcagtttggccaat

SEQ ID NO: 507227 - DNA, 25 bp, Mus musculus
gatcccagacttgagtttggccaat

SEQ ID NO: 507228 - DNA, 25 bp, Mus musculus
gatcccagagctacaggcttcaaaa

SEQ ID NO: 507229 - DNA, 25 bp, Mus musculus
gatcccagagcttcaggcttcaaaa

SEQ ID NO: 507230 - DNA, 25 bp, Mus musculus
gatcccagaggcagaactaaaccgg

SEQ ID NO: 507231 - DNA, 25 bp, Mus musculus
gatcccagaggctgaactaaaccgg

SEQ ID NO: 507232 - DNA, 25 bp, Mus musculus
gatcccagaggtcagcctttaatcc

SEQ ID NO: 507233 - DNA, 25 bp, Mus musculus
gatcccagaggtgagcctttaatcc

SEQ ID NO: 507234 - DNA, 25 bp, Mus musculus
gatcccagagtaaattttccttctg

SEQ ID NO: 507235 - DNA, 25 bp, Mus musculus
gatcccagagtatattttccttctg

SEQ ID NO: 507236 - DNA, 25 bp, Mus musculus
gatcccagagtcactgagacgcttt

SEQ ID NO: 507237 - DNA, 25 bp, Mus musculus
gatcccagagtctctgagacgcttt

SEQ ID NO: 507238 - DNA, 25 bp, Mus musculus
gatcccagattcctgctaagacttg

SEQ ID NO: 507239 - DNA, 25 bp, Mus musculus
gatcccagattcgtgctaagacttg

SEQ ID NO: 507240 - DNA, 25 bp, Mus musculus
gatcccagcaagatccagttaccag

SEQ ID NO: 507241 - DNA, 25 bp, Mus musculus
gatcccagcaagttccagttaccag

SEQ ID NO: 507242 - DNA, 25 bp, Mus musculus
gatcccagcaatcagcttccataat

SEQ ID NO: 507243 - DNA, 25 bp, Mus musculus
gatcccagcaatgagcttccataat

SEQ ID NO: 507244 - DNA, 25 bp, Mus musculus
gatcccagcatcagtgcaaaagact

SEQ ID NO: 507245 - DNA, 25 bp, Mus musculus
gatcccagcatctgtgcaaaagact

SEQ ID NO: 507246 - DNA, 25 bp, Mus musculus
gatcccagcattactcaattgtgtg

SEQ ID NO: 507247 - DNA, 25 bp, Mus musculus
gatcccagcatttctcaattgtgtg

SEQ ID NO: 507248 - DNA, 25 bp, Mus musculus
gatcccaggaagcattggtcctcct

SEQ ID NO: 507249 - DNA, 25 bp, Mus musculus
gatcccaggaaggattggtcctcct

SEQ ID NO: 507250 - DNA, 25 bp, Mus musculus
gatcccaggcatatactatttctcc

SEQ ID NO: 507251 - DNA, 25 bp, Mus musculus
gatcccaggcatcaggaaaccattt

SEQ ID NO: 507252 - DNA, 25 bp, Mus musculus
gatcccaggcatgaggaaaccattt

SEQ ID NO: 507253 - DNA, 25 bp, Mus musculus
gatcccaggcatttactatttctcc

SEQ ID NO: 507254 - DNA, 25 bp, Mus musculus
gatcccaggccacatgtgcaatgga

SEQ ID NO: 507255 - DNA, 25 bp, Mus musculus
gatcccaggccagatgtgcaatgga

SEQ ID NO: 507256 - DNA, 25 bp, Mus musculus
gatcccaggcccaaatcagtattat

SEQ ID NO: 507257 - DNA, 25 bp, Mus musculus
gatcccaggccctaatcagtattat

SEQ ID NO: 507258 - DNA, 25 bp, Mus musculus
gatcccaggcttaggctctgaggaa

SEQ ID NO: 507259 - DNA, 25 bp, Mus musculus
gatcccaggctttggctctgaggaa

SEQ ID NO: 507260 - DNA, 25 bp, Mus musculus
gatcccagggaaagtgctatgcaca

SEQ ID NO: 507261 - DNA, 25 bp, Mus musculus
gatcccagggaatgtgctatgcaca

SEQ ID NO: 507262 - DNA, 25 bp, Mus musculus
gatcccagtggaattgtacgcacag

SEQ ID NO: 507263 - DNA, 25 bp, Mus musculus
gatcccagtggatttgtacgcacag

SEQ ID NO: 507264 - DNA, 25 bp, Mus musculus
gatcccatcatgaaggaccatggtt

SEQ ID NO: 507265 - DNA, 25 bp, Mus musculus
gatcccatcatgtaggaccatggtt

SEQ ID NO: 507266 - DNA, 25 bp, Mus musculus
gatcccatcttcagagcttattcta

SEQ ID NO: 507267 - DNA, 25 bp, Mus musculus
gatcccatcttcagctgatgtggat

SEQ ID NO: 507268 - DNA, 25 bp, Mus musculus
gatcccatcttctgagcttattcta

SEQ ID NO: 507269 - DNA, 25 bp, Mus musculus
gatcccatcttctgctgatgtggat

SEQ ID NO: 507270 - DNA, 25 bp, Mus musculus
gatcccatgcccctgaaatgaacga

SEQ ID NO: 507271 - DNA, 25 bp, Mus musculus
gatcccatgcccgtgaaatgaacga

SEQ ID NO: 507272 - DNA, 25 bp, Mus musculus
gatcccatgcctaataacgctgtaa

SEQ ID NO: 507273 - DNA, 25 bp, Mus musculus
gatcccatgccttataacgctgtaa

SEQ ID NO: 507274 - DNA, 25 bp, Mus musculus
gatcccatggaactaaagtcacagg

SEQ ID NO: 507275 - DNA, 25 bp, Mus musculus
gatcccatggaagtaaagtcacagg

SEQ ID NO: 507276 - DNA, 25 bp, Mus musculus
gatcccatgtgtctgcagtagacca

SEQ ID NO: 507277 - DNA, 25 bp, Mus musculus
gatcccatgtgtgtgcagtagacca

SEQ ID NO: 507278 - DNA, 25 bp, Mus musculus
gatcccattgcaatatgtaccacat

SEQ ID NO: 507279 - DNA, 25 bp, Mus musculus
gatcccattgcattatgtaccacat

SEQ ID NO: 507280 - DNA, 25 bp, Mus musculus
gatcccattggacctctgttaaagt

SEQ ID NO: 507281 - DNA, 25 bp, Mus musculus
gatcccattggagctctgttaaagt

SEQ ID NO: 507282 - DNA, 25 bp, Mus musculus
gatcccatttagatggacaaccctt

SEQ ID NO: 507283 - DNA, 25 bp, Mus musculus
gatcccatttagttggacaaccctt

SEQ ID NO: 507284 - DNA, 25 bp, Mus musculus
gatccccaacaccacgtagaagtga

SEQ ID NO: 507285 - DNA, 25 bp, Mus musculus
gatccccaacacgacgtagaagtga

SEQ ID NO: 507286 - DNA, 25 bp, Mus musculus
gatccccaactgcactagtgtttaa

SEQ ID NO: 507287 - DNA, 25 bp, Mus musculus
gatccccaactggactagtgtttaa

SEQ ID NO: 507288 - DNA, 25 bp, Mus musculus
gatccccaagagatgaaggccagct

SEQ ID NO: 507289 - DNA, 25 bp, Mus musculus
gatccccaagagttgaaggccagct

SEQ ID NO: 507290 - DNA, 25 bp, Mus musculus
gatccccaaggtaacaggccctatt

SEQ ID NO: 507291 - DNA, 25 bp, Mus musculus
gatccccaaggttacaggccctatt

SEQ ID NO: 507292 - DNA, 25 bp, Mus musculus
gatccccacacacgtgtctgagtac

SEQ ID NO: 507293 - DNA, 25 bp, Mus musculus
gatccccacacaggtgtctgagtac

SEQ ID NO: 507294 - DNA, 25 bp, Mus musculus
gatccccaccttacttcgagatggt

SEQ ID NO: 507295 - DNA, 25 bp, Mus musculus
gatccccacctttcttcgagatggt

SEQ ID NO: 507296 - DNA, 25 bp, Mus musculus
gatccccactcaagtagagcctaga

SEQ ID NO: 507297 - DNA, 25 bp, Mus musculus
gatccccactcatgtagagcctaga

SEQ ID NO: 507298 - DNA, 25 bp, Mus musculus
gatccccagaacacgtgaaaggcca

SEQ ID NO: 507299 - DNA, 25 bp, Mus musculus
gatccccagaactcgtgaaaggcca

SEQ ID NO: 507300 - DNA, 25 bp, Mus musculus
gatccccagatgaggcagtctctag

SEQ ID NO: 507301 - DNA, 25 bp, Mus musculus
gatccccagatgtggcagtctctag

SEQ ID NO: 507302 - DNA, 25 bp, Mus musculus
gatccccagctcaagggcatagtga

SEQ ID NO: 507303 - DNA, 25 bp, Mus musculus
gatccccagctcctactggactgta

SEQ ID NO: 507304 - DNA, 25 bp, Mus musculus
gatccccagctcgtactggactgta

SEQ ID NO: 507305 - DNA, 25 bp, Mus musculus
gatccccagctctagggcatagtga

SEQ ID NO: 507306 - DNA, 25 bp, Mus musculus
gatccccaggacctgctacaaagta

SEQ ID NO: 507307 - DNA, 25 bp, Mus musculus
gatccccaggacgtgctacaaagta

SEQ ID NO: 507308 - DNA, 25 bp, Mus musculus
gatccccaggatagtattaccaggt

SEQ ID NO: 507309 - DNA, 25 bp, Mus musculus
gatccccaggattgtattaccaggt

SEQ ID NO: 507310 - DNA, 25 bp, Mus musculus
gatccccaggcaaagtgacgtgtac

SEQ ID NO: 507311 - DNA, 25 bp, Mus musculus
gatccccaggcatagtgacgtgtac

SEQ ID NO: 507312 - DNA, 25 bp, Mus musculus
gatccccatcgaaaggcccagcagc

SEQ ID NO: 507313 - DNA, 25 bp, Mus musculus
gatccccatcgaaagtgtgtgccct

SEQ ID NO: 507314 - DNA, 25 bp, Mus musculus
gatccccatcgataggcccagcagc

SEQ ID NO: 507315 - DNA, 25 bp, Mus musculus
gatccccatcgatagtgtgtgccct

SEQ ID NO: 507316 - DNA, 25 bp, Mus musculus
gatccccattaactaaatactaagg

SEQ ID NO: 507317 - DNA, 25 bp, Mus musculus
gatccccattaagtaaatactaagg

SEQ ID NO: 507318 - DNA, 25 bp, Mus musculus
gatccccgagatagtcagaagaact

SEQ ID NO: 507319 - DNA, 25 bp, Mus musculus
gatccccgagattgtcagaagaact

SEQ ID NO: 507320 - DNA, 25 bp, Mus musculus
gatccccgccagatgtgtcagcaag

SEQ ID NO: 507321 - DNA, 25 bp, Mus musculus
gatccccgccagttgtgtcagcaag

SEQ ID NO: 507322 - DNA, 25 bp, Mus musculus
gatccccggcagaatgccctggttt

SEQ ID NO: 507323 - DNA, 25 bp, Mus musculus
gatccccggcagtatgccctggttt

SEQ ID NO: 507324 - DNA, 25 bp, Mus musculus
gatccccggtttatacaggttcatg

SEQ ID NO: 507325 - DNA, 25 bp, Mus musculus
gatccccggtttttacaggttcatg

SEQ ID NO: 507326 - DNA, 25 bp, Mus musculus
gatccccgtgtgattgcaggagtgt

SEQ ID NO: 507327 - DNA, 25 bp, Mus musculus
gatccccgtgtgtttgcaggagtgt

SEQ ID NO: 507328 - DNA, 25 bp, Mus musculus
gatcccctataacgagaattacaga

SEQ ID NO: 507329 - DNA, 25 bp, Mus musculus
gatcccctataaggagaattacaga

SEQ ID NO: 507330 - DNA, 25 bp, Mus musculus
gatcccctcacaactgtacaagaaa

SEQ ID NO: 507331 - DNA, 25 bp, Mus musculus
gatcccctcacaagtgctatcaaaa

SEQ ID NO: 507332 - DNA, 25 bp, Mus musculus
gatcccctcacatctgtacaagaaa

SEQ ID NO: 507333 - DNA, 25 bp, Mus musculus
gatcccctcacatgtgctatcaaaa

SEQ ID NO: 507334 - DNA, 25 bp, Mus musculus
gatcccctgactcacatcctgagtg

SEQ ID NO: 507335 - DNA, 25 bp, Mus musculus
gatcccctgactgacatcctgagtg

SEQ ID NO: 507336 - DNA, 25 bp, Mus musculus
gatcccctgcacatgaggagtaaag

SEQ ID NO: 507337 - DNA, 25 bp, Mus musculus
gatcccctgcacttgaggagtaaag

SEQ ID NO: 507338 - DNA, 25 bp, Mus musculus
gatcccctggagctataattatagg

SEQ ID NO: 507339 - DNA, 25 bp, Mus musculus
gatcccctggaggtataattatagg

SEQ ID NO: 507340 - DNA, 25 bp, Mus musculus
gatcccctggataaaagcgtttcac

SEQ ID NO: 507341 - DNA, 25 bp, Mus musculus
gatcccctggattaaagcgtttcac

SEQ ID NO: 507342 - DNA, 25 bp, Mus musculus
gatcccctgttgacttacaaaattg

SEQ ID NO: 507343 - DNA, 25 bp, Mus musculus
gatcccctgttgtcttacaaaattg

SEQ ID NO: 507344 - DNA, 25 bp, Mus musculus
gatccccttaggaggttgtactata

SEQ ID NO: 507345 - DNA, 25 bp, Mus musculus
gatccccttaggtggttgtactata

SEQ ID NO: 507346 - DNA, 25 bp, Mus musculus
gatcccctttctctatgtcgggaca

SEQ ID NO: 507347 - DNA, 25 bp, Mus musculus
gatcccctttctgtatgtcgggaca

SEQ ID NO: 507348 - DNA, 25 bp, Mus musculus
gatccccttttcattagtctgacat

SEQ ID NO: 507349 - DNA, 25 bp, Mus musculus
gatccccttttctttagtctgacat

SEQ ID NO: 507350 - DNA, 25 bp, Mus musculus
gatcccgaaggacaaggtgctttaa

SEQ ID NO: 507351 - DNA, 25 bp, Mus musculus
gatcccgaaggagaaggtgctttaa

SEQ ID NO: 507352 - DNA, 25 bp, Mus musculus
gatcccgaatcaccaaggtggaact

SEQ ID NO: 507353 - DNA, 25 bp, Mus musculus
gatcccgaatcagcaaggtggaact

SEQ ID NO: 507354 - DNA, 25 bp, Mus musculus
gatcccgagcagcagcaccgcagcg

SEQ ID NO: 507355 - DNA, 25 bp, Mus musculus
gatcccgagcaggagcaccgcagcg

SEQ ID NO: 507356 - DNA, 25 bp, Mus musculus
gatcccgagcgcctgcaagctgaag

SEQ ID NO: 507357 - DNA, 25 bp, Mus musculus
gatcccgagcgcgtgcaagctgaag

SEQ ID NO: 507358 - DNA, 25 bp, Mus musculus
gatcccgagggcactgatctagaga

SEQ ID NO: 507359 - DNA, 25 bp, Mus musculus
gatcccgagggctctgatctagaga

SEQ ID NO: 507360 - DNA, 25 bp, Mus musculus
gatcccgaggtgctcaggttctctg

SEQ ID NO: 507361 - DNA, 25 bp, Mus musculus
gatcccgaggtggtcaggttctctg

SEQ ID NO: 507362 - DNA, 25 bp, Mus musculus
gatcccgcgggtacgagggcggagt

SEQ ID NO: 507363 - DNA, 25 bp, Mus musculus
gatcccgcgggttcgagggcggagt

SEQ ID NO: 507364 - DNA, 25 bp, Mus musculus
gatcccgctttactggacaaacaca

SEQ ID NO: 507365 - DNA, 25 bp, Mus musculus
gatcccgctttagtggacaaacaca

SEQ ID NO: 507366 - DNA, 25 bp, Mus musculus
gatcccggaccaaagactgagatga

SEQ ID NO: 507367 - DNA, 25 bp, Mus musculus
gatcccggaccatagactgagatga

SEQ ID NO: 507368 - DNA, 25 bp, Mus musculus
gatcccggagctaccattgatatca

SEQ ID NO: 507369 - DNA, 25 bp, Mus musculus
gatcccggagcttccattgatatca

SEQ ID NO: 507370 - DNA, 25 bp, Mus musculus
gatcccggatctctttgcgggtata

SEQ ID NO: 507371 - DNA, 25 bp, Mus musculus
gatcccggatctgtttgcgggtata

SEQ ID NO: 507372 - DNA, 25 bp, Mus musculus
gatcccggccccatgggatgtccct

SEQ ID NO: 507373 - DNA, 25 bp, Mus musculus
gatcccggccccttgggatgtccct

SEQ ID NO: 507374 - DNA, 25 bp, Mus musculus
gatcccgtgaccaaggtactagcat

SEQ ID NO: 507375 - DNA, 25 bp, Mus musculus
gatcccgtgacctaggtactagcat

SEQ ID NO: 507376 - DNA, 25 bp, Mus musculus
gatcccgtggtaaaagtgtcagaaa

SEQ ID NO: 507377 - DNA, 25 bp, Mus musculus
gatcccgtggtataagtgtcagaaa

SEQ ID NO: 507378 - DNA, 25 bp, Mus musculus
gatccctaaacaacccaatgtgctg

SEQ ID NO: 507379 - DNA, 25 bp, Mus musculus
gatccctaaacatcccaatgtgctg

SEQ ID NO: 507380 - DNA, 25 bp, Mus musculus
gatccctaattcaggagccaacggc

SEQ ID NO: 507381 - DNA, 25 bp, Mus musculus
gatccctaattctggagccaacggc

SEQ ID NO: 507382 - DNA, 25 bp, Mus musculus
gatccctaccacctaagtaagcaga

SEQ ID NO: 507383 - DNA, 25 bp, Mus musculus
gatccctaccacgtaagtaagcaga

SEQ ID NO: 507384 - DNA, 25 bp, Mus musculus
gatccctactgactaattatatagc

SEQ ID NO: 507385 - DNA, 25 bp, Mus musculus
gatccctactgagtaattatatagc

SEQ ID NO: 507386 - DNA, 25 bp, Mus musculus
gatccctagaagagtttttctggtt

SEQ ID NO: 507387 - DNA, 25 bp, Mus musculus
gatccctagaagtgtttttctggtt

SEQ ID NO: 507388 - DNA, 25 bp, Mus musculus
gatccctagagccagcacatgcggt

SEQ ID NO: 507389 - DNA, 25 bp, Mus musculus
gatccctagagcgagcacatgcggt

SEQ ID NO: 507390 - DNA, 25 bp, Mus musculus
gatccctagggaaataccagaatcc

SEQ ID NO: 507391 - DNA, 25 bp, Mus musculus
gatccctagggatataccagaatcc

SEQ ID NO: 507392 - DNA, 25 bp, Mus musculus
gatccctaggttccctttagagaga

SEQ ID NO: 507393 - DNA, 25 bp, Mus musculus
gatccctaggttgcctttagagaga

SEQ ID NO: 507394 - DNA, 25 bp, Mus musculus
gatccctagtgactcgtttagaccg

SEQ ID NO: 507395 - DNA, 25 bp, Mus musculus
gatccctagtgagtcgtttagaccg

SEQ ID NO: 507396 - DNA, 25 bp, Mus musculus
gatccctatccacatgtttctgatt

SEQ ID NO: 507397 - DNA, 25 bp, Mus musculus
gatccctatccagatgtttctgatt

SEQ ID NO: 507398 - DNA, 25 bp, Mus musculus
gatccctatcttagatcctgcataa

SEQ ID NO: 507399 - DNA, 25 bp, Mus musculus
gatccctatctttgatcctgcataa

SEQ ID NO: 507400 - DNA, 25 bp, Mus musculus
gatccctattatacattggcttggc

SEQ ID NO: 507401 - DNA, 25 bp, Mus musculus
gatccctattattcattggcttggc

SEQ ID NO: 507402 - DNA, 25 bp, Mus musculus
gatccctattccatcaacatggcac

SEQ ID NO: 507403 - DNA, 25 bp, Mus musculus
gatccctattccttcaacatggcac

SEQ ID NO: 507404 - DNA, 25 bp, Mus musculus
gatccctcaccacccagggctggag

SEQ ID NO: 507405 - DNA, 25 bp, Mus musculus
gatccctcaccagccagggctggag

SEQ ID NO: 507406 - DNA, 25 bp, Mus musculus
gatccctcagggacacagtagccca

SEQ ID NO: 507407 - DNA, 25 bp, Mus musculus
gatccctcagggtcacagtagccca

SEQ ID NO: 507408 - DNA, 25 bp, Mus musculus
gatccctccaatccggaagtttaag

SEQ ID NO: 507409 - DNA, 25 bp, Mus musculus
gatccctccaatgcggaagtttaag

SEQ ID NO: 507410 - DNA, 25 bp, Mus musculus
gatccctccagactattagaaccat

SEQ ID NO: 507411 - DNA, 25 bp, Mus musculus
gatccctccagagtattagaaccat

SEQ ID NO: 507412 - DNA, 25 bp, Mus musculus
gatccctccataatctaacaagttg

SEQ ID NO: 507413 - DNA, 25 bp, Mus musculus
gatccctccatattctaacaagttg

SEQ ID NO: 507414 - DNA, 25 bp, Mus musculus
gatccctccggacttaagagtactt

SEQ ID NO: 507415 - DNA, 25 bp, Mus musculus
gatccctccggagttaagagtactt

SEQ ID NO: 507416 - DNA, 25 bp, Mus musculus
gatccctcctctatatagattatcc

SEQ ID NO: 507417 - DNA, 25 bp, Mus musculus
gatccctcctctttatagattatcc

SEQ ID NO: 507418 - DNA, 25 bp, Mus musculus
gatccctcgtgtatccgagagacgc

SEQ ID NO: 507419 - DNA, 25 bp, Mus musculus
gatccctcgtgtttccgagagacgc

SEQ ID NO: 507420 - DNA, 25 bp, Mus musculus
gatccctctaaacggcagaactcta

SEQ ID NO: 507421 - DNA, 25 bp, Mus musculus
gatccctctaaagggcagaactcta

SEQ ID NO: 507422 - DNA, 25 bp, Mus musculus
gatccctctacgaaaagcatgctaa

SEQ ID NO: 507423 - DNA, 25 bp, Mus musculus
gatccctctacgtaaagcatgctaa

SEQ ID NO: 507424 - DNA, 25 bp, Mus musculus
gatccctctctgagccatgttctca

SEQ ID NO: 507425 - DNA, 25 bp, Mus musculus
gatccctctctgtgccatgttctca

SEQ ID NO: 507426 - DNA, 25 bp, Mus musculus
gatccctctgggacatgtctaaagg

SEQ ID NO: 507427 - DNA, 25 bp, Mus musculus
gatccctctgggatatctgaaccca

SEQ ID NO: 507428 - DNA, 25 bp, Mus musculus
gatccctctgggtcatgtctaaagg

SEQ ID NO: 507429 - DNA, 25 bp, Mus musculus
gatccctctgggttatctgaaccca

SEQ ID NO: 507430 - DNA, 25 bp, Mus musculus
gatccctctgtcagtttatgcctgg

SEQ ID NO: 507431 - DNA, 25 bp, Mus musculus
gatccctctgtctgtttatgcctgg

SEQ ID NO: 507432 - DNA, 25 bp, Mus musculus
gatccctctgtgcttctggaggcaa

SEQ ID NO: 507433 - DNA, 25 bp, Mus musculus
gatccctctgtggttctggaggcaa

SEQ ID NO: 507434 - DNA, 25 bp, Mus musculus
gatccctgaagtccatcataaactt

SEQ ID NO: 507435 - DNA, 25 bp, Mus musculus
gatccctgaagtgcatcataaactt

SEQ ID NO: 507436 - DNA, 25 bp, Mus musculus
gatccctgaatgcacttttttacta

SEQ ID NO: 507437 - DNA, 25 bp, Mus musculus
gatccctgaatggacttttttacta

SEQ ID NO: 507438 - DNA, 25 bp, Mus musculus
gatccctgagccagtgaagagccaa

SEQ ID NO: 507439 - DNA, 25 bp, Mus musculus
gatccctgagcctgtgaagagccaa

SEQ ID NO: 507440 - DNA, 25 bp, Mus musculus
gatccctgatatccatgtacagcca

SEQ ID NO: 507441 - DNA, 25 bp, Mus musculus
gatccctgatatgcatgtacagcca

SEQ ID NO: 507442 - DNA, 25 bp, Mus musculus
gatccctgccacagggtaatggctt

SEQ ID NO: 507443 - DNA, 25 bp, Mus musculus
gatccctgccactgggtaatggctt

SEQ ID NO: 507444 - DNA, 25 bp, Mus musculus
gatccctgcgtaactctaggatggg

SEQ ID NO: 507445 - DNA, 25 bp, Mus musculus
gatccctgcgtatctctaggatggg

SEQ ID NO: 507446 - DNA, 25 bp, Mus musculus
gatccctgctaaaaccatgtctatg

SEQ ID NO: 507447 - DNA, 25 bp, Mus musculus
gatccctgctaataccatgtctatg

SEQ ID NO: 507448 - DNA, 25 bp, Mus musculus
gatccctgcttcatggtggcttgaa

SEQ ID NO: 507449 - DNA, 25 bp, Mus musculus
gatccctgcttcttggtggcttgaa

SEQ ID NO: 507450 - DNA, 25 bp, Mus musculus
gatccctggacccttaaaaattgct

SEQ ID NO: 507451 - DNA, 25 bp, Mus musculus
gatccctggaccgttaaaaattgct

SEQ ID NO: 507452 - DNA, 25 bp, Mus musculus
gatccctggctcagtgaacactgta

SEQ ID NO: 507453 - DNA, 25 bp, Mus musculus
gatccctggctctgtgaacactgta

SEQ ID NO: 507454 - DNA, 25 bp, Mus musculus
gatccctgggacatcatggtaaaag

SEQ ID NO: 507455 - DNA, 25 bp, Mus musculus
gatccctgggacttcatggtaaaag

SEQ ID NO: 507456 - DNA, 25 bp, Mus musculus
gatccctgtaacaaaacactaactg

SEQ ID NO: 507457 - DNA, 25 bp, Mus musculus
gatccctgtaactaaacactaactg

SEQ ID NO: 507458 - DNA, 25 bp, Mus musculus
gatccctgtacactatgtctatatg

SEQ ID NO: 507459 - DNA, 25 bp, Mus musculus
gatccctgtacagtatgtctatatg

SEQ ID NO: 507460 - DNA, 25 bp, Mus musculus
gatccctgtgacaagagtcacagac

SEQ ID NO: 507461 - DNA, 25 bp, Mus musculus
gatccctgtgactagagtcacagac

SEQ ID NO: 507462 - DNA, 25 bp, Mus musculus
gatccctgtgagaaacttcagctta

SEQ ID NO: 507463 - DNA, 25 bp, Mus musculus
gatccctgtgagtaacttcagctta

SEQ ID NO: 507464 - DNA, 25 bp, Mus musculus
gatccctgtgtacgtttcagacttt

SEQ ID NO: 507465 - DNA, 25 bp, Mus musculus
gatccctgtgtaggtttcagacttt

SEQ ID NO: 507466 - DNA, 25 bp, Mus musculus
gatccctgtgttaccattgaggtgt

SEQ ID NO: 507467 - DNA, 25 bp, Mus musculus
gatccctgtgtttccattgaggtgt

SEQ ID NO: 507468 - DNA, 25 bp, Mus musculus
gatccctgttacctttactctttct

SEQ ID NO: 507469 - DNA, 25 bp, Mus musculus
gatccctgttacgtttactctttct

SEQ ID NO: 507470 - DNA, 25 bp, Mus musculus
gatcccttaatgatccttaaggtct

SEQ ID NO: 507471 - DNA, 25 bp, Mus musculus
gatcccttaatgttccttaaggtct

SEQ ID NO: 507472 - DNA, 25 bp, Mus musculus
gatcccttactccacaaagaaagct

SEQ ID NO: 507473 - DNA, 25 bp, Mus musculus
gatcccttactcgacaaagaaagct

SEQ ID NO: 507474 - DNA, 25 bp, Mus musculus
gatcccttacttagagtggaactct

SEQ ID NO: 507475 - DNA, 25 bp, Mus musculus
gatcccttactttgagtggaactct

SEQ ID NO: 507476 - DNA, 25 bp, Mus musculus
gatcccttagatcgtcgctgaataa

SEQ ID NO: 507477 - DNA, 25 bp, Mus musculus
gatcccttagatggtcgctgaataa

SEQ ID NO: 507478 - DNA, 25 bp, Mus musculus
gatcccttaggaattctctcacatt

SEQ ID NO: 507479 - DNA, 25 bp, Mus musculus
gatcccttaggatttctctcacatt

SEQ ID NO: 507480 - DNA, 25 bp, Mus musculus
gatcccttagtcattattggctcag

SEQ ID NO: 507481 - DNA, 25 bp, Mus musculus
gatcccttagtctttattggctcag

SEQ ID NO: 507482 - DNA, 25 bp, Mus musculus
gatcccttatcgaagtgtctctgag

SEQ ID NO: 507483 - DNA, 25 bp, Mus musculus
gatcccttatcgtagtgtctctgag

SEQ ID NO: 507484 - DNA, 25 bp, Mus musculus
gatcccttcaagattctagttacag

SEQ ID NO: 507485 - DNA, 25 bp, Mus musculus
gatcccttcaagtttctagttacag

SEQ ID NO: 507486 - DNA, 25 bp, Mus musculus
gatcccttcactcctatgttggaca

SEQ ID NO: 507487 - DNA, 25 bp, Mus musculus
gatcccttcactgctatgttggaca

SEQ ID NO: 507488 - DNA, 25 bp, Mus musculus
gatcccttccacatgcatctgatgg

SEQ ID NO: 507489 - DNA, 25 bp, Mus musculus
gatcccttccacttgcatctgatgg

SEQ ID NO: 507490 - DNA, 25 bp, Mus musculus
gatcccttctgtaccgcaaactgaa

SEQ ID NO: 507491 - DNA, 25 bp, Mus musculus
gatcccttctgttccgcaaactgaa

SEQ ID NO: 507492 - DNA, 25 bp, Mus musculus
gatcccttctttattggcatactaa

SEQ ID NO: 507493 - DNA, 25 bp, Mus musculus
gatcccttcttttttggcatactaa

SEQ ID NO: 507494 - DNA, 25 bp, Mus musculus
gatcccttgcatatgcaacaaaagt

SEQ ID NO: 507495 - DNA, 25 bp, Mus musculus
gatcccttgcatttgcaacaaaagt

SEQ ID NO: 507496 - DNA, 25 bp, Mus musculus
gatcccttgcccatgatatctaaac

SEQ ID NO: 507497 - DNA, 25 bp, Mus musculus
gatcccttgcccttgatatctaaac

SEQ ID NO: 507498 - DNA, 25 bp, Mus musculus
gatccctttaagaatagcagacttg

SEQ ID NO: 507499 - DNA, 25 bp, Mus musculus
gatccctttaagtatagcagacttg

SEQ ID NO: 507500 - DNA, 25 bp, Mus musculus
gatccctttaatactgcggtcaaag

SEQ ID NO: 507501 - DNA, 25 bp, Mus musculus
gatccctttaattctgcggtcaaag

SEQ ID NO: 507502 - DNA, 25 bp, Mus musculus
gatccctttatgctgaggtcattca

SEQ ID NO: 507503 - DNA, 25 bp, Mus musculus
gatccctttatggtgaggtcattca

SEQ ID NO: 507504 - DNA, 25 bp, Mus musculus
gatccctttccgatagaaatggtga

SEQ ID NO: 507505 - DNA, 25 bp, Mus musculus
gatccctttccgttagaaatggtga

SEQ ID NO: 507506 - DNA, 25 bp, Mus musculus
gatccctttctgcacacaagaaaac

SEQ ID NO: 507507 - DNA, 25 bp, Mus musculus
gatccctttctggacacaagaaaac

SEQ ID NO: 507508 - DNA, 25 bp, Mus musculus
gatcccttttcaccacttggagcga

SEQ ID NO: 507509 - DNA, 25 bp, Mus musculus
gatcccttttcagcacttggagcga

SEQ ID NO: 507510 - DNA, 25 bp, Mus musculus
gatccgaaaatcagggctcagtgct

SEQ ID NO: 507511 - DNA, 25 bp, Mus musculus
gatccgaaaatctgggctcagtgct

SEQ ID NO: 507512 - DNA, 25 bp, Mus musculus
gatccgaaattgctacttactccgt

SEQ ID NO: 507513 - DNA, 25 bp, Mus musculus
gatccgaaattggtacttactccgt

SEQ ID NO: 507514 - DNA, 25 bp, Mus musculus
gatccgaatatacgaccccatgcct

SEQ ID NO: 507515 - DNA, 25 bp, Mus musculus
gatccgaatataggaccccatgcct

SEQ ID NO: 507516 - DNA, 25 bp, Mus musculus
gatccgaatcttacttaacataagg

SEQ ID NO: 507517 - DNA, 25 bp, Mus musculus
gatccgaatctttcttaacataagg

SEQ ID NO: 507518 - DNA, 25 bp, Mus musculus
gatccgaatgtgctccttagaatcc

SEQ ID NO: 507519 - DNA, 25 bp, Mus musculus
gatccgaatgtggtccttagaatcc

SEQ ID NO: 507520 - DNA, 25 bp, Mus musculus
gatccgaccaggaggtaaggttgta

SEQ ID NO: 507521 - DNA, 25 bp, Mus musculus
gatccgaccaggtggtaaggttgta

SEQ ID NO: 507522 - DNA, 25 bp, Mus musculus
gatccgactgtgcaactacgcgcag

SEQ ID NO: 507523 - DNA, 25 bp, Mus musculus
gatccgactgtggaactacgcgcag

SEQ ID NO: 507524 - DNA, 25 bp, Mus musculus
gatccgagccatagatttgactttg

SEQ ID NO: 507525 - DNA, 25 bp, Mus musculus
gatccgagccattgatttgactttg

SEQ ID NO: 507526 - DNA, 25 bp, Mus musculus
gatccgagctcacaggactgctata

SEQ ID NO: 507527 - DNA, 25 bp, Mus musculus
gatccgagctcagaggactgctata

SEQ ID NO: 507528 - DNA, 25 bp, Mus musculus
gatccgaggcccagtgctgcctgga

SEQ ID NO: 507529 - DNA, 25 bp, Mus musculus
gatccgaggccctgtgctgcctgga

SEQ ID NO: 507530 - DNA, 25 bp, Mus musculus
gatccgatacatctttgcatccttc

SEQ ID NO: 507531 - DNA, 25 bp, Mus musculus
gatccgatacatgtttgcatccttc

SEQ ID NO: 507532 - DNA, 25 bp, Mus musculus
gatccgatatctaaccttcttctga

SEQ ID NO: 507533 - DNA, 25 bp, Mus musculus
gatccgatatcttaccttcttctga

SEQ ID NO: 507534 - DNA, 25 bp, Mus musculus
gatccgatcacaacgatttcaagga

SEQ ID NO: 507535 - DNA, 25 bp, Mus musculus
gatccgatcacatcgatttcaagga

SEQ ID NO: 507536 - DNA, 25 bp, Mus musculus
gatccgatcctaaggttcttccttc

SEQ ID NO: 507537 - DNA, 25 bp, Mus musculus
gatccgatcctatggttcttccttc

SEQ ID NO: 507538 - DNA, 25 bp, Mus musculus
gatccgatttctcattttgcctgac

SEQ ID NO: 507539 - DNA, 25 bp, Mus musculus
gatccgatttctctgtctgatggta

SEQ ID NO: 507540 - DNA, 25 bp, Mus musculus
gatccgatttctgattttgcctgac

SEQ ID NO: 507541 - DNA, 25 bp, Mus musculus
gatccgatttctgtgtctgatggta

SEQ ID NO: 507542 - DNA, 25 bp, Mus musculus
gatccgcagcaacgattcctacatg

SEQ ID NO: 507543 - DNA, 25 bp, Mus musculus
gatccgcagcaaggattcctacatg

SEQ ID NO: 507544 - DNA, 25 bp, Mus musculus
gatccgcatcatcaacacggagcag

SEQ ID NO: 507545 - DNA, 25 bp, Mus musculus
gatccgcatcatgaacacggagcag

SEQ ID NO: 507546 - DNA, 25 bp, Mus musculus
gatccgcatggaacctgacgagacg

SEQ ID NO: 507547 - DNA, 25 bp, Mus musculus
gatccgcatggatcctgacgagacg

SEQ ID NO: 507548 - DNA, 25 bp, Mus musculus
gatccgccagagagcagtcgacaag

SEQ ID NO: 507549 - DNA, 25 bp, Mus musculus
gatccgccagagtgcagtcgacaag

SEQ ID NO: 507550 - DNA, 25 bp, Mus musculus
gatccgcctccgaactgatttcttt

SEQ ID NO: 507551 - DNA, 25 bp, Mus musculus
gatccgcctccgtactgatttcttt

SEQ ID NO: 507552 - DNA, 25 bp, Mus musculus
gatccgctatttagacaactccagt

SEQ ID NO: 507553 - DNA, 25 bp, Mus musculus
gatccgctattttgacaactccagt

SEQ ID NO: 507554 - DNA, 25 bp, Mus musculus
gatccgctgaacagaacagtgccct

SEQ ID NO: 507555 - DNA, 25 bp, Mus musculus
gatccgctgaactgaacagtgccct

SEQ ID NO: 507556 - DNA, 25 bp, Mus musculus
gatccgctggataaaaacatcacct

SEQ ID NO: 507557 - DNA, 25 bp, Mus musculus
gatccgctggattaaaacatcacct

SEQ ID NO: 507558 - DNA, 25 bp, Mus musculus
gatccgctggcgactgacaaaatgg

SEQ ID NO: 507559 - DNA, 25 bp, Mus musculus
gatccgctggcgtctgacaaaatgg

SEQ ID NO: 507560 - DNA, 25 bp, Mus musculus
gatccgcttacacagactttcccag

SEQ ID NO: 507561 - DNA, 25 bp, Mus musculus
gatccgcttacagagactttcccag

SEQ ID NO: 507562 - DNA, 25 bp, Mus musculus
gatccgctttatagcttattttcac

SEQ ID NO: 507563 - DNA, 25 bp, Mus musculus
gatccgctttattgcttattttcac

SEQ ID NO: 507564 - DNA, 25 bp, Mus musculus
gatccggaaggcatgcgagtatttt

SEQ ID NO: 507565 - DNA, 25 bp, Mus musculus
gatccggaaggcttgcgagtatttt

SEQ ID NO: 507566 - DNA, 25 bp, Mus musculus
gatccggactgcctggattcagaac

SEQ ID NO: 507567 - DNA, 25 bp, Mus musculus
gatccggactgcgtggattcagaac

SEQ ID NO: 507568 - DNA, 25 bp, Mus musculus
gatccggagtgcaaatcttctcaaa

SEQ ID NO: 507569 - DNA, 25 bp, Mus musculus
gatccggagtgctaatcttctcaaa

SEQ ID NO: 507570 - DNA, 25 bp, Mus musculus
gatccggatcaacatgcgacgtact

SEQ ID NO: 507571 - DNA, 25 bp, Mus musculus
gatccggatcaagatgcgacgtact

SEQ ID NO: 507572 - DNA, 25 bp, Mus musculus
gatccggattccaaagagactcctt

SEQ ID NO: 507573 - DNA, 25 bp, Mus musculus
gatccggattcctaagagactcctt

SEQ ID NO: 507574 - DNA, 25 bp, Mus musculus
gatccggcagcaatcacagtgtgag

SEQ ID NO: 507575 - DNA, 25 bp, Mus musculus
gatccggcagcattcacagtgtgag

SEQ ID NO: 507576 - DNA, 25 bp, Mus musculus
gatccggcagggagctgcgccaggt

SEQ ID NO: 507577 - DNA, 25 bp, Mus musculus
gatccggcagggtgctgcgccaggt

SEQ ID NO: 507578 - DNA, 25 bp, Mus musculus
gatccggccggaccatgtgttccat

SEQ ID NO: 507579 - DNA, 25 bp, Mus musculus
gatccggccggagcatgtgttccat

SEQ ID NO: 507580 - DNA, 25 bp, Mus musculus
gatccggcgattcttcaataagctg

SEQ ID NO: 507581 - DNA, 25 bp, Mus musculus
gatccggcgattgttcaataagctg

SEQ ID NO: 507582 - DNA, 25 bp, Mus musculus
gatccggcggcaattattcacgact

SEQ ID NO: 507583 - DNA, 25 bp, Mus musculus
gatccggcggcatttattcacgact

SEQ ID NO: 507584 - DNA, 25 bp, Mus musculus
gatccggctccgcatgcagagtgga

SEQ ID NO: 507585 - DNA, 25 bp, Mus musculus
gatccggctccggatgcagagtgga

SEQ ID NO: 507586 - DNA, 25 bp, Mus musculus
gatccgggaacacaatcgctatgat

SEQ ID NO: 507587 - DNA, 25 bp, Mus musculus
gatccgggaacagaatcgctatgat

SEQ ID NO: 507588 - DNA, 25 bp, Mus musculus
gatccgggaggtctgcggcttcgca

SEQ ID NO: 507589 - DNA, 25 bp, Mus musculus
gatccgggaggtgtgcggcttcgca

SEQ ID NO: 507590 - DNA, 25 bp, Mus musculus
gatccgggatgtcatcaaggtgcac

SEQ ID NO: 507591 - DNA, 25 bp, Mus musculus
gatccgggatgtgatcaaggtgcac

SEQ ID NO: 507592 - DNA, 25 bp, Mus musculus
gatccgggccttcaataaagccatt

SEQ ID NO: 507593 - DNA, 25 bp, Mus musculus
gatccgggccttgaataaagccatt

SEQ ID NO: 507594 - DNA, 25 bp, Mus musculus
gatccgggtgagattcaaggcccat

SEQ ID NO: 507595 - DNA, 25 bp, Mus musculus
gatccgggtgagtttcaaggcccat

SEQ ID NO: 507596 - DNA, 25 bp, Mus musculus
gatccggtctctccaggattttcag

SEQ ID NO: 507597 - DNA, 25 bp, Mus musculus
gatccggtctctgcaggattttcag

SEQ ID NO: 507598 - DNA, 25 bp, Mus musculus
gatccggtggatctgcttcacagtt

SEQ ID NO: 507599 - DNA, 25 bp, Mus musculus
gatccggtggatgtgcttcacagtt

SEQ ID NO: 507600 - DNA, 25 bp, Mus musculus
gatccggtggccaagcttgtgccaa

SEQ ID NO: 507601 - DNA, 25 bp, Mus musculus
gatccggtggcctagcttgtgccaa

SEQ ID NO: 507602 - DNA, 25 bp, Mus musculus
gatccggttccccattcagaggaac

SEQ ID NO: 507603 - DNA, 25 bp, Mus musculus
gatccggttcccgattcagaggaac

SEQ ID NO: 507604 - DNA, 25 bp, Mus musculus
gatccgtaaggcaaggcagcagcat

SEQ ID NO: 507605 - DNA, 25 bp, Mus musculus
gatccgtaaggctaggcagcagcat

SEQ ID NO: 507606 - DNA, 25 bp, Mus musculus
gatccgtagaacagttcatcaccag

SEQ ID NO: 507607 - DNA, 25 bp, Mus musculus
gatccgtagaactgttcatcaccag

SEQ ID NO: 507608 - DNA, 25 bp, Mus musculus
gatccgtataccctcagtggaactg

SEQ ID NO: 507609 - DNA, 25 bp, Mus musculus
gatccgtataccgtcagtggaactg

SEQ ID NO: 507610 - DNA, 25 bp, Mus musculus
gatccgtatcagcttcatgtctgta

SEQ ID NO: 507611 - DNA, 25 bp, Mus musculus
gatccgtatcaggttcatgtctgta

SEQ ID NO: 507612 - DNA, 25 bp, Mus musculus
gatccgtattacctattgtgaacct

SEQ ID NO: 507613 - DNA, 25 bp, Mus musculus
gatccgtattacgtattgtgaacct

SEQ ID NO: 507614 - DNA, 25 bp, Mus musculus
gatccgtccagtcaaaaaccagcaa

SEQ ID NO: 507615 - DNA, 25 bp, Mus musculus
gatccgtccagtgaaaaaccagcaa

SEQ ID NO: 507616 - DNA, 25 bp, Mus musculus
gatccgtgacaaccgcacaggcaaa

SEQ ID NO: 507617 - DNA, 25 bp, Mus musculus
gatccgtgacaagcgcacaggcaaa

SEQ ID NO: 507618 - DNA, 25 bp, Mus musculus
gatccgtgtatgactaaacattcta

SEQ ID NO: 507619 - DNA, 25 bp, Mus musculus
gatccgtgtatgtctaaacattcta

SEQ ID NO: 507620 - DNA, 25 bp, Mus musculus
gatccgtgtcatccagcagagtgtg

SEQ ID NO: 507621 - DNA, 25 bp, Mus musculus
gatccgtgtcatgcagcagagtgtg

SEQ ID NO: 507622 - DNA, 25 bp, Mus musculus
gatccgtgtcctcaagaatgcaagt

SEQ ID NO: 507623 - DNA, 25 bp, Mus musculus
gatccgtgtcctgaagaatgcaagt

SEQ ID NO: 507624 - DNA, 25 bp, Mus musculus
gatccgtgtgatctactgtggcctc

SEQ ID NO: 507625 - DNA, 25 bp, Mus musculus
gatccgtgtgatgtactgtggcctc

SEQ ID NO: 507626 - DNA, 25 bp, Mus musculus
gatccgttccataaagctatcagaa

SEQ ID NO: 507627 - DNA, 25 bp, Mus musculus
gatccgttccattaagctatcagaa

SEQ ID NO: 507628 - DNA, 25 bp, Mus musculus
gatccgttgggaaccttcaaggact

SEQ ID NO: 507629 - DNA, 25 bp, Mus musculus
gatccgttgggatccttcaaggact

SEQ ID NO: 507630 - DNA, 25 bp, Mus musculus
gatccgttgttaagtgtgccttaaa

SEQ ID NO: 507631 - DNA, 25 bp, Mus musculus
gatccgttgttatgtgtgccttaaa

SEQ ID NO: 507632 - DNA, 25 bp, Mus musculus
gatccgtttacaccttgacaccttt

SEQ ID NO: 507633 - DNA, 25 bp, Mus musculus
gatccgtttacagcttgacaccttt

SEQ ID NO: 507634 - DNA, 25 bp, Mus musculus
gatccgttttgacgttctttccgct

SEQ ID NO: 507635 - DNA, 25 bp, Mus musculus
gatccgttttgaggttctttccgct

SEQ ID NO: 507636 - DNA, 25 bp, Mus musculus
gatcctaaaaacctgctattctctc

SEQ ID NO: 507637 - DNA, 25 bp, Mus musculus
gatcctaaaaacgtgctattctctc

SEQ ID NO: 507638 - DNA, 25 bp, Mus musculus
gatcctaaaaagacatctcaaagtt

SEQ ID NO: 507639 - DNA, 25 bp, Mus musculus
gatcctaaaaagagcatccctacat

SEQ ID NO: 507640 - DNA, 25 bp, Mus musculus
gatcctaaaaagtcatctcaaagtt

SEQ ID NO: 507641 - DNA, 25 bp, Mus musculus
gatcctaaaaagtgcatccctacat

SEQ ID NO: 507642 - DNA, 25 bp, Mus musculus
gatcctaaaagacttccagagagtt

SEQ ID NO: 507643 - DNA, 25 bp, Mus musculus
gatcctaaaagagttccagagagtt

SEQ ID NO: 507644 - DNA, 25 bp, Mus musculus
gatcctaaacataggactttttgct

SEQ ID NO: 507645 - DNA, 25 bp, Mus musculus
gatcctaaacattggactttttgct

SEQ ID NO: 507646 - DNA, 25 bp, Mus musculus
gatcctaaaggtaatgttttcttat

SEQ ID NO: 507647 - DNA, 25 bp, Mus musculus
gatcctaaaggttatgttttcttat

SEQ ID NO: 507648 - DNA, 25 bp, Mus musculus
gatcctaacatcagggagaggactt

SEQ ID NO: 507649 - DNA, 25 bp, Mus musculus
gatcctaacatctgggagaggactt

SEQ ID NO: 507650 - DNA, 25 bp, Mus musculus
gatcctaagacgcatccctgcaggg

SEQ ID NO: 507651 - DNA, 25 bp, Mus musculus
gatcctaagacggatccctgcaggg

SEQ ID NO: 507652 - DNA, 25 bp, Mus musculus
gatcctaagggaagttattaaacat

SEQ ID NO: 507653 - DNA, 25 bp, Mus musculus
gatcctaagggatgttattaaacat

SEQ ID NO: 507654 - DNA, 25 bp, Mus musculus
gatcctaaggttcttccttccaatc

SEQ ID NO: 507655 - DNA, 25 bp, Mus musculus
gatcctaaggttgttccttccaatc

SEQ ID NO: 507656 - DNA, 25 bp, Mus musculus
gatcctaatgtgaatattgtgccca

SEQ ID NO: 507657 - DNA, 25 bp, Mus musculus
gatcctaatgtgtatattgtgccca

SEQ ID NO: 507658 - DNA, 25 bp, Mus musculus
gatcctaatgttcgacccagctaag

SEQ ID NO: 507659 - DNA, 25 bp, Mus musculus
gatcctaatgttggacccagctaag

SEQ ID NO: 507660 - DNA, 25 bp, Mus musculus
gatcctaattttcttctttcatggt

SEQ ID NO: 507661 - DNA, 25 bp, Mus musculus
gatcctaattttgttctttcatggt

SEQ ID NO: 507662 - DNA, 25 bp, Mus musculus
gatcctacacaaccacgaagttcct

SEQ ID NO: 507663 - DNA, 25 bp, Mus musculus
gatcctacacaagcacgaagttcct

SEQ ID NO: 507664 - DNA, 25 bp, Mus musculus
gatcctacagatacaagctactcaa

SEQ ID NO: 507665 - DNA, 25 bp, Mus musculus
gatcctacagattcaagctactcaa

SEQ ID NO: 507666 - DNA, 25 bp, Mus musculus
gatcctacagctcaggaaccaaggg

SEQ ID NO: 507667 - DNA, 25 bp, Mus musculus
gatcctacagctgaggaaccaaggg

SEQ ID NO: 507668 - DNA, 25 bp, Mus musculus
gatcctacagtcaggaatcctgcag

SEQ ID NO: 507669 - DNA, 25 bp, Mus musculus
gatcctacagtctggaatcctgcag

SEQ ID NO: 507670 - DNA, 25 bp, Mus musculus
gatcctacagtgatagtttgtcagc

SEQ ID NO: 507671 - DNA, 25 bp, Mus musculus
gatcctacagtgttagtttgtcagc

SEQ ID NO: 507672 - DNA, 25 bp, Mus musculus
gatcctaccattaggttattgtagc

SEQ ID NO: 507673 - DNA, 25 bp, Mus musculus
gatcctaccatttggttattgtagc

SEQ ID NO: 507674 - DNA, 25 bp, Mus musculus
gatcctaccctgagaagtatgctga

SEQ ID NO: 507675 - DNA, 25 bp, Mus musculus
gatcctaccctgtgaagtatgctga

SEQ ID NO: 507676 - DNA, 25 bp, Mus musculus
gatcctacctctccctgatagtgaa

SEQ ID NO: 507677 - DNA, 25 bp, Mus musculus
gatcctacctctgcctgatagtgaa

SEQ ID NO: 507678 - DNA, 25 bp, Mus musculus
gatcctacctgactggcagctgaag

SEQ ID NO: 507679 - DNA, 25 bp, Mus musculus
gatcctacctgagtggcagctgaag

SEQ ID NO: 507680 - DNA, 25 bp, Mus musculus
gatcctactcaacaaccacagatag

SEQ ID NO: 507681 - DNA, 25 bp, Mus musculus
gatcctactcaagaaccacagatag

SEQ ID NO: 507682 - DNA, 25 bp, Mus musculus
gatcctactcgaacaggaagggaag

SEQ ID NO: 507683 - DNA, 25 bp, Mus musculus
gatcctactcgatcaggaagggaag

SEQ ID NO: 507684 - DNA, 25 bp, Mus musculus
gatcctactgtgctggttaagtcat

SEQ ID NO: 507685 - DNA, 25 bp, Mus musculus
gatcctactgtggtggttaagtcat

SEQ ID NO: 507686 - DNA, 25 bp, Mus musculus
gatcctacttctatgaccgggctgg

SEQ ID NO: 507687 - DNA, 25 bp, Mus musculus
gatcctacttctttgaccgggctgg

SEQ ID NO: 507688 - DNA, 25 bp, Mus musculus
gatcctagaggaagcacaagtctta

SEQ ID NO: 507689 - DNA, 25 bp, Mus musculus
gatcctagaggatgcacaagtctta

SEQ ID NO: 507690 - DNA, 25 bp, Mus musculus
gatcctagatagatttcccttcaag

SEQ ID NO: 507691 - DNA, 25 bp, Mus musculus
gatcctagatagttttcccttcaag

SEQ ID NO: 507692 - DNA, 25 bp, Mus musculus
gatcctagatgcctgcccttatgaa

SEQ ID NO: 507693 - DNA, 25 bp, Mus musculus
gatcctagatgcgtgcccttatgaa

SEQ ID NO: 507694 - DNA, 25 bp, Mus musculus
gatcctagcaacaacatgacactgg

SEQ ID NO: 507695 - DNA, 25 bp, Mus musculus
gatcctagcaactacatgacactgg

SEQ ID NO: 507696 - DNA, 25 bp, Mus musculus
gatcctagcaccatcttaagcaggt

SEQ ID NO: 507697 - DNA, 25 bp, Mus musculus
gatcctagcaccttcttaagcaggt

SEQ ID NO: 507698 - DNA, 25 bp, Mus musculus
gatcctagccaacactaaggttcct

SEQ ID NO: 507699 - DNA, 25 bp, Mus musculus
gatcctagccaagactaaggttcct

SEQ ID NO: 507700 - DNA, 25 bp, Mus musculus
gatcctaggcagcaaagctcgattc

SEQ ID NO: 507701 - DNA, 25 bp, Mus musculus
gatcctaggcaggaaagctcgattc

SEQ ID NO: 507702 - DNA, 25 bp, Mus musculus
gatcctaggtttatggctgctttgg

SEQ ID NO: 507703 - DNA, 25 bp, Mus musculus
gatcctaggtttttggctgctttgg

SEQ ID NO: 507704 - DNA, 25 bp, Mus musculus
gatcctagtaatattgccaactgca

SEQ ID NO: 507705 - DNA, 25 bp, Mus musculus
gatcctagtaattttgccaactgca

SEQ ID NO: 507706 - DNA, 25 bp, Mus musculus
gatcctagtacccaaacaaaagctg

SEQ ID NO: 507707 - DNA, 25 bp, Mus musculus
gatcctagtaccgaaacaaaagctg

SEQ ID NO: 507708 - DNA, 25 bp, Mus musculus
gatcctagtcataatctcctgagaa

SEQ ID NO: 507709 - DNA, 25 bp, Mus musculus
gatcctagtcattatctcctgagaa

SEQ ID NO: 507710 - DNA, 25 bp, Mus musculus
gatcctagtgaaagcatgttgttac

SEQ ID NO: 507711 - DNA, 25 bp, Mus musculus
gatcctagtgaatgcatgttgttac

SEQ ID NO: 507712 - DNA, 25 bp, Mus musculus
gatcctagtgcaaggcagactctca

SEQ ID NO: 507713 - DNA, 25 bp, Mus musculus
gatcctagtgcatggcagactctca

SEQ ID NO: 507714 - DNA, 25 bp, Mus musculus
gatcctagtgggctctaaccttaga

SEQ ID NO: 507715 - DNA, 25 bp, Mus musculus
gatcctagtggggtctaaccttaga

SEQ ID NO: 507716 - DNA, 25 bp, Mus musculus
gatcctagttagaaggctgttgcta

SEQ ID NO: 507717 - DNA, 25 bp, Mus musculus
gatcctagttagtaggctgttgcta

SEQ ID NO: 507718 - DNA, 25 bp, Mus musculus
gatcctagttttctgggtgagctga

SEQ ID NO: 507719 - DNA, 25 bp, Mus musculus
gatcctagttttgtgggtgagctga

SEQ ID NO: 507720 - DNA, 25 bp, Mus musculus
gatcctatactcatagatacaccaa

SEQ ID NO: 507721 - DNA, 25 bp, Mus musculus
gatcctatactcttagatacaccaa

SEQ ID NO: 507722 - DNA, 25 bp, Mus musculus
gatcctatactgaacaaatcctatg

SEQ ID NO: 507723 - DNA, 25 bp, Mus musculus
gatcctatactgtacaaatcctatg

SEQ ID NO: 507724 - DNA, 25 bp, Mus musculus
gatcctatagttccttgagcctcca

SEQ ID NO: 507725 - DNA, 25 bp, Mus musculus
gatcctatagttgcttgagcctcca

SEQ ID NO: 507726 - DNA, 25 bp, Mus musculus
gatcctatatacatggtccaagcca

SEQ ID NO: 507727 - DNA, 25 bp, Mus musculus
gatcctatatacttggtccaagcca

SEQ ID NO: 507728 - DNA, 25 bp, Mus musculus
gatcctatccccagaaactcagatg

SEQ ID NO: 507729 - DNA, 25 bp, Mus musculus
gatcctatcccctgaaactcagatg

SEQ ID NO: 507730 - DNA, 25 bp, Mus musculus
gatcctatccggatggaatttgaaa

SEQ ID NO: 507731 - DNA, 25 bp, Mus musculus
gatcctatccggttggaatttgaaa

SEQ ID NO: 507732 - DNA, 25 bp, Mus musculus
gatcctatggatccaactcgggtca

SEQ ID NO: 507733 - DNA, 25 bp, Mus musculus
gatcctatggatgcaactcgggtca

SEQ ID NO: 507734 - DNA, 25 bp, Mus musculus
gatcctatggctctctgagggcatc

SEQ ID NO: 507735 - DNA, 25 bp, Mus musculus
gatcctatggctgtctgagggcatc

SEQ ID NO: 507736 - DNA, 25 bp, Mus musculus
gatcctatggtcacagtttctcatg

SEQ ID NO: 507737 - DNA, 25 bp, Mus musculus
gatcctatggtctcagtttctcatg

SEQ ID NO: 507738 - DNA, 25 bp, Mus musculus
gatcctatggtgaccacacttgtgt

SEQ ID NO: 507739 - DNA, 25 bp, Mus musculus
gatcctatggtgtccacacttgtgt

SEQ ID NO: 507740 - DNA, 25 bp, Mus musculus
gatcctatgtttatcatgttctgag

SEQ ID NO: 507741 - DNA, 25 bp, Mus musculus
gatcctatgtttttcatgttctgag

SEQ ID NO: 507742 - DNA, 25 bp, Mus musculus
gatcctattattaattcagcctgtt

SEQ ID NO: 507743 - DNA, 25 bp, Mus musculus
gatcctattatttattcagcctgtt

SEQ ID NO: 507744 - DNA, 25 bp, Mus musculus
gatcctattcttatgaccaaaatta

SEQ ID NO: 507745 - DNA, 25 bp, Mus musculus
gatcctattcttttgaccaaaatta

SEQ ID NO: 507746 - DNA, 25 bp, Mus musculus
gatcctattgcacatggttttgagt

SEQ ID NO: 507747 - DNA, 25 bp, Mus musculus
gatcctattgcagatggttttgagt

SEQ ID NO: 507748 - DNA, 25 bp, Mus musculus
gatcctattttacgctttcaggcaa

SEQ ID NO: 507749 - DNA, 25 bp, Mus musculus
gatcctattttaggctttcaggcaa

SEQ ID NO: 507750 - DNA, 25 bp, Mus musculus
gatcctcaaacaaacatccccaaat

SEQ ID NO: 507751 - DNA, 25 bp, Mus musculus
gatcctcaaacatacatccccaaat

SEQ ID NO: 507752 - DNA, 25 bp, Mus musculus
gatcctcaaagaattaacaagtatt

SEQ ID NO: 507753 - DNA, 25 bp, Mus musculus
gatcctcaaagatttaacaagtatt

SEQ ID NO: 507754 - DNA, 25 bp, Mus musculus
gatcctcaataacaagggacagcaa

SEQ ID NO: 507755 - DNA, 25 bp, Mus musculus
gatcctcaataagaagggacagcaa

SEQ ID NO: 507756 - DNA, 25 bp, Mus musculus
gatcctcaccggaagttcggagcca

SEQ ID NO: 507757 - DNA, 25 bp, Mus musculus
gatcctcaccggtagttcggagcca

SEQ ID NO: 507758 - DNA, 25 bp, Mus musculus
gatcctcagaatatcagtttcacca

SEQ ID NO: 507759 - DNA, 25 bp, Mus musculus
gatcctcagaatttcagtttcacca

SEQ ID NO: 507760 - DNA, 25 bp, Mus musculus
gatcctcagaggatactgtacgtta

SEQ ID NO: 507761 - DNA, 25 bp, Mus musculus
gatcctcagaggttactgtacgtta

SEQ ID NO: 507762 - DNA, 25 bp, Mus musculus
gatcctcaggtccagaattccagca

SEQ ID NO: 507763 - DNA, 25 bp, Mus musculus
gatcctcaggtcgagaattccagca

SEQ ID NO: 507764 - DNA, 25 bp, Mus musculus
gatcctcagtctagatataacgaac

SEQ ID NO: 507765 - DNA, 25 bp, Mus musculus
gatcctcagtcttgatataacgaac

SEQ ID NO: 507766 - DNA, 25 bp, Mus musculus
gatcctcagttcctgttgttcatag

SEQ ID NO: 507767 - DNA, 25 bp, Mus musculus
gatcctcagttcgtgttgttcatag

SEQ ID NO: 507768 - DNA, 25 bp, Mus musculus
gatcctcatacaaataagtggagca

SEQ ID NO: 507769 - DNA, 25 bp, Mus musculus
gatcctcatacatataagtggagca

SEQ ID NO: 507770 - DNA, 25 bp, Mus musculus
gatcctcatggcagatgctgacgga

SEQ ID NO: 507771 - DNA, 25 bp, Mus musculus
gatcctcatggctgatgctgacgga

SEQ ID NO: 507772 - DNA, 25 bp, Mus musculus
gatcctcatgggagttacggcattt

SEQ ID NO: 507773 - DNA, 25 bp, Mus musculus
gatcctcatgggtgttacggcattt

SEQ ID NO: 507774 - DNA, 25 bp, Mus musculus
gatcctcattctctcttcaggaatg

SEQ ID NO: 507775 - DNA, 25 bp, Mus musculus
gatcctcattctgtcttcaggaatg

SEQ ID NO: 507776 - DNA, 25 bp, Mus musculus
gatcctccaagtaccttaactgtta

SEQ ID NO: 507777 - DNA, 25 bp, Mus musculus
gatcctccaagttccttaactgtta

SEQ ID NO: 507778 - DNA, 25 bp, Mus musculus
gatcctccacatcgaatttctccta

SEQ ID NO: 507779 - DNA, 25 bp, Mus musculus
gatcctccacatggaatttctccta

SEQ ID NO: 507780 - DNA, 25 bp, Mus musculus
gatcctccacccaaggatgacgaga

SEQ ID NO: 507781 - DNA, 25 bp, Mus musculus
gatcctccaccctaggatgacgaga

SEQ ID NO: 507782 - DNA, 25 bp, Mus musculus
gatcctccaggcaaacagtaatacg

SEQ ID NO: 507783 - DNA, 25 bp, Mus musculus
gatcctccaggcagtgtttagactt

SEQ ID NO: 507784 - DNA, 25 bp, Mus musculus
gatcctccaggctaacagtaatacg

SEQ ID NO: 507785 - DNA, 25 bp, Mus musculus
gatcctccaggctgtgtttagactt

SEQ ID NO: 507786 - DNA, 25 bp, Mus musculus
gatcctccagttatggccacagaga

SEQ ID NO: 507787 - DNA, 25 bp, Mus musculus
gatcctccagttttggccacagaga

SEQ ID NO: 507788 - DNA, 25 bp, Mus musculus
gatcctccatctaaacaacactaac

SEQ ID NO: 507789 - DNA, 25 bp, Mus musculus
gatcctccatcttaacaacactaac

SEQ ID NO: 507790 - DNA, 25 bp, Mus musculus
gatcctcccaagagaatgacagcca

SEQ ID NO: 507791 - DNA, 25 bp, Mus musculus
gatcctcccaagtgaatgacagcca

SEQ ID NO: 507792 - DNA, 25 bp, Mus musculus
gatcctccctaaccaatcactatag

SEQ ID NO: 507793 - DNA, 25 bp, Mus musculus
gatcctccctaagcaatcactatag

SEQ ID NO: 507794 - DNA, 25 bp, Mus musculus
gatcctccctatcgaccagatgaga

SEQ ID NO: 507795 - DNA, 25 bp, Mus musculus
gatcctccctatggaccagatgaga

SEQ ID NO: 507796 - DNA, 25 bp, Mus musculus
gatcctccgctgataccgggaccat

SEQ ID NO: 507797 - DNA, 25 bp, Mus musculus
gatcctccgctgttaccgggaccat

SEQ ID NO: 507798 - DNA, 25 bp, Mus musculus
gatcctcctgagacaacagggtctt

SEQ ID NO: 507799 - DNA, 25 bp, Mus musculus
gatcctcctgagtcaacagggtctt

SEQ ID NO: 507800 - DNA, 25 bp, Mus musculus
gatcctcctttgaaaaagtctccta

SEQ ID NO: 507801 - DNA, 25 bp, Mus musculus
gatcctcctttgtaaaagtctccta

SEQ ID NO: 507802 - DNA, 25 bp, Mus musculus
gatcctcgactcacactaaacaatg

SEQ ID NO: 507803 - DNA, 25 bp, Mus musculus
gatcctcgactctcactaaacaatg

SEQ ID NO: 507804 - DNA, 25 bp, Mus musculus
gatcctcgctggaacctaactgaag

SEQ ID NO: 507805 - DNA, 25 bp, Mus musculus
gatcctcgctggtacctaactgaag

SEQ ID NO: 507806 - DNA, 25 bp, Mus musculus
gatcctcgggcaagccaagaagcat

SEQ ID NO: 507807 - DNA, 25 bp, Mus musculus
gatcctcgggcatgccaagaagcat

SEQ ID NO: 507808 - DNA, 25 bp, Mus musculus
gatcctcgggtgactaagcagattt

SEQ ID NO: 507809 - DNA, 25 bp, Mus musculus
gatcctcgggtgtctaagcagattt

SEQ ID NO: 507810 - DNA, 25 bp, Mus musculus
gatcctcgggttaatcccacaagtg

SEQ ID NO: 507811 - DNA, 25 bp, Mus musculus
gatcctcgggtttatcccacaagtg

SEQ ID NO: 507812 - DNA, 25 bp, Mus musculus
gatcctcgtagacatgtttttatat

SEQ ID NO: 507813 - DNA, 25 bp, Mus musculus
gatcctcgtagagatgtttttatat

SEQ ID NO: 507814 - DNA, 25 bp, Mus musculus
gatcctcgttgcataggctgagagc

SEQ ID NO: 507815 - DNA, 25 bp, Mus musculus
gatcctcgttgcttaggctgagagc

SEQ ID NO: 507816 - DNA, 25 bp, Mus musculus
gatcctcgttggcatgatcttgtga

SEQ ID NO: 507817 - DNA, 25 bp, Mus musculus
gatcctcgttgggatgatcttgtga

SEQ ID NO: 507818 - DNA, 25 bp, Mus musculus
gatcctcgtttgatggaattacgca

SEQ ID NO: 507819 - DNA, 25 bp, Mus musculus
gatcctcgtttgttggaattacgca

SEQ ID NO: 507820 - DNA, 25 bp, Mus musculus
gatcctctaattcccttggttagat

SEQ ID NO: 507821 - DNA, 25 bp, Mus musculus
gatcctctaattgccttggttagat

SEQ ID NO: 507822 - DNA, 25 bp, Mus musculus
gatcctctacatacatcttatgtcc

SEQ ID NO: 507823 - DNA, 25 bp, Mus musculus
gatcctctacattcatcttatgtcc

SEQ ID NO: 507824 - DNA, 25 bp, Mus musculus
gatcctctagcaaggacagctaagt

SEQ ID NO: 507825 - DNA, 25 bp, Mus musculus
gatcctctagcatggacagctaagt

SEQ ID NO: 507826 - DNA, 25 bp, Mus musculus
gatcctctcactccacaaatatact

SEQ ID NO: 507827 - DNA, 25 bp, Mus musculus
gatcctctcactgcacaaatatact

SEQ ID NO: 507828 - DNA, 25 bp, Mus musculus
gatcctctccggagtttaatttttg

SEQ ID NO: 507829 - DNA, 25 bp, Mus musculus
gatcctctccggtgtttaatttttg

SEQ ID NO: 507830 - DNA, 25 bp, Mus musculus
gatcctctctgcctggtgaagagta

SEQ ID NO: 507831 - DNA, 25 bp, Mus musculus
gatcctctctgcgtggtgaagagta

SEQ ID NO: 507832 - DNA, 25 bp, Mus musculus
gatcctctgcagaccatgtagttaa

SEQ ID NO: 507833 - DNA, 25 bp, Mus musculus
gatcctctgcagtccatgtagttaa

SEQ ID NO: 507834 - DNA, 25 bp, Mus musculus
gatcctctgcctctcagtgtttgta

SEQ ID NO: 507835 - DNA, 25 bp, Mus musculus
gatcctctgcctgtcagtgtttgta

SEQ ID NO: 507836 - DNA, 25 bp, Mus musculus
gatcctctggaacttacacgccatt

SEQ ID NO: 507837 - DNA, 25 bp, Mus musculus
gatcctctggaagttacacgccatt

SEQ ID NO: 507838 - DNA, 25 bp, Mus musculus
gatcctctgggtagggtctttaaga

SEQ ID NO: 507839 - DNA, 25 bp, Mus musculus
gatcctctgggttgggtctttaaga

SEQ ID NO: 507840 - DNA, 25 bp, Mus musculus
gatcctctggtcatagaactcggcc

SEQ ID NO: 507841 - DNA, 25 bp, Mus musculus
gatcctctggtcttagaactcggcc

SEQ ID NO: 507842 - DNA, 25 bp, Mus musculus
gatcctctgttccaatatgtcactt

SEQ ID NO: 507843 - DNA, 25 bp, Mus musculus
gatcctctgttcgaatatgtcactt

SEQ ID NO: 507844 - DNA, 25 bp, Mus musculus
gatcctcttataacccatagactgc

SEQ ID NO: 507845 - DNA, 25 bp, Mus musculus
gatcctcttatatcccatagactgc

SEQ ID NO: 507846 - DNA, 25 bp, Mus musculus
gatcctcttatcaataggctccata

SEQ ID NO: 507847 - DNA, 25 bp, Mus musculus
gatcctcttatctataggctccata

SEQ ID NO: 507848 - DNA, 25 bp, Mus musculus
gatcctcttgccagctagaattatg

SEQ ID NO: 507849 - DNA, 25 bp, Mus musculus
gatcctcttgcctgctagaattatg

SEQ ID NO: 507850 - DNA, 25 bp, Mus musculus
gatcctcttgctctagcagtaacct

SEQ ID NO: 507851 - DNA, 25 bp, Mus musculus
gatcctcttgctgtagcagtaacct

SEQ ID NO: 507852 - DNA, 25 bp, Mus musculus
gatcctcttttgctgtctcgtgtac

SEQ ID NO: 507853 - DNA, 25 bp, Mus musculus
gatcctcttttggtgtctcgtgtac

SEQ ID NO: 507854 - DNA, 25 bp, Mus musculus
gatcctctttttctggttgacatga

SEQ ID NO: 507855 - DNA, 25 bp, Mus musculus
gatcctctttttgtggttgacatga

SEQ ID NO: 507856 - DNA, 25 bp, Mus musculus
gatcctgaaacgcaacaagtgaatg

SEQ ID NO: 507857 - DNA, 25 bp, Mus musculus
gatcctgaaacggaacaagtgaatg

SEQ ID NO: 507858 - DNA, 25 bp, Mus musculus
gatcctgaagaccacaaatgctgca

SEQ ID NO: 507859 - DNA, 25 bp, Mus musculus
gatcctgaagacgacaaatgctgca

SEQ ID NO: 507860 - DNA, 25 bp, Mus musculus
gatcctgaagagactgaccctgtga

SEQ ID NO: 507861 - DNA, 25 bp, Mus musculus
gatcctgaagagtctgaccctgtga

SEQ ID NO: 507862 - DNA, 25 bp, Mus musculus
gatcctgaatctacttgtaagtatc

SEQ ID NO: 507863 - DNA, 25 bp, Mus musculus
gatcctgaatcttcttgtaagtatc

SEQ ID NO: 507864 - DNA, 25 bp, Mus musculus
gatcctgaattgagttaccttccta

SEQ ID NO: 507865 - DNA, 25 bp, Mus musculus
gatcctgaattgtgttaccttccta

SEQ ID NO: 507866 - DNA, 25 bp, Mus musculus
gatcctgacaagatctcatctgata

SEQ ID NO: 507867 - DNA, 25 bp, Mus musculus
gatcctgacaagttctcatctgata

SEQ ID NO: 507868 - DNA, 25 bp, Mus musculus
gatcctgacaccaacactcaagaag

SEQ ID NO: 507869 - DNA, 25 bp, Mus musculus
gatcctgacacctacactcaagaag

SEQ ID NO: 507870 - DNA, 25 bp, Mus musculus
gatcctgacagccatgtttctactg

SEQ ID NO: 507871 - DNA, 25 bp, Mus musculus
gatcctgacagcgatgtttctactg

SEQ ID NO: 507872 - DNA, 25 bp, Mus musculus
gatcctgacatgagcattctgtgtt

SEQ ID NO: 507873 - DNA, 25 bp, Mus musculus
gatcctgacatgtgcattctgtgtt

SEQ ID NO: 507874 - DNA, 25 bp, Mus musculus
gatcctgaccaacccaaaaagtttg

SEQ ID NO: 507875 - DNA, 25 bp, Mus musculus
gatcctgaccaagccaaaaagtttg

SEQ ID NO: 507876 - DNA, 25 bp, Mus musculus
gatcctgaccatcgatgtgagacct

SEQ ID NO: 507877 - DNA, 25 bp, Mus musculus
gatcctgaccatggatgtgagacct

SEQ ID NO: 507878 - DNA, 25 bp, Mus musculus
gatcctgaccgaccgtggctacagc

SEQ ID NO: 507879 - DNA, 25 bp, Mus musculus
gatcctgaccgagcgtggctacagc

SEQ ID NO: 507880 - DNA, 25 bp, Mus musculus
gatcctgactacaatcctgttgccc

SEQ ID NO: 507881 - DNA, 25 bp, Mus musculus
gatcctgactactatcctgttgccc

SEQ ID NO: 507882 - DNA, 25 bp, Mus musculus
gatcctgactggcttgatctcccac

SEQ ID NO: 507883 - DNA, 25 bp, Mus musculus
gatcctgactgggttgatctcccac

SEQ ID NO: 507884 - DNA, 25 bp, Mus musculus
gatcctgagaaacactatgccaaga

SEQ ID NO: 507885 - DNA, 25 bp, Mus musculus
gatcctgagaaagactatgccaaga

SEQ ID NO: 507886 - DNA, 25 bp, Mus musculus
gatcctgagaacatgtcataccaca

SEQ ID NO: 507887 - DNA, 25 bp, Mus musculus
gatcctgagaacttgtcataccaca

SEQ ID NO: 507888 - DNA, 25 bp, Mus musculus
gatcctgagaataccaggacaccca

SEQ ID NO: 507889 - DNA, 25 bp, Mus musculus
gatcctgagaattccaggacaccca

SEQ ID NO: 507890 - DNA, 25 bp, Mus musculus
gatcctgagagtaaacccatttact

SEQ ID NO: 507891 - DNA, 25 bp, Mus musculus
gatcctgagagtcaaaagcccgact

SEQ ID NO: 507892 - DNA, 25 bp, Mus musculus
gatcctgagagtgaaaagcccgact

SEQ ID NO: 507893 - DNA, 25 bp, Mus musculus
gatcctgagagttaacccatttact

SEQ ID NO: 507894 - DNA, 25 bp, Mus musculus
gatcctgagattcttatgtttcgtt

SEQ ID NO: 507895 - DNA, 25 bp, Mus musculus
gatcctgagattgttatgtttcgtt

SEQ ID NO: 507896 - DNA, 25 bp, Mus musculus
gatcctgagcctaataaacctgtgt

SEQ ID NO: 507897 - DNA, 25 bp, Mus musculus
gatcctgagccttataaacctgtgt

SEQ ID NO: 507898 - DNA, 25 bp, Mus musculus
gatcctgaggccaggtagtgacagc

SEQ ID NO: 507899 - DNA, 25 bp, Mus musculus
gatcctgaggcctggtagtgacagc

SEQ ID NO: 507900 - DNA, 25 bp, Mus musculus
gatcctgagtacctggctgctttca

SEQ ID NO: 507901 - DNA, 25 bp, Mus musculus
gatcctgagtacgtggctgctttca

SEQ ID NO: 507902 - DNA, 25 bp, Mus musculus
gatcctgagtgtatttcatgcctgt

SEQ ID NO: 507903 - DNA, 25 bp, Mus musculus
gatcctgagtgtttttcatgcctgt

SEQ ID NO: 507904 - DNA, 25 bp, Mus musculus
gatcctgatcagagttcctgtgcat

SEQ ID NO: 507905 - DNA, 25 bp, Mus musculus
gatcctgatcagctatatacgaccc

SEQ ID NO: 507906 - DNA, 25 bp, Mus musculus
gatcctgatcaggtatatacgaccc

SEQ ID NO: 507907 - DNA, 25 bp, Mus musculus
gatcctgatcagtgttcctgtgcat

SEQ ID NO: 507908 - DNA, 25 bp, Mus musculus
gatcctgatgatccgcttgctcttt

SEQ ID NO: 507909 - DNA, 25 bp, Mus musculus
gatcctgatgatgcgcttgctcttt

SEQ ID NO: 507910 - DNA, 25 bp, Mus musculus
gatcctgatggccttctaggctgag

SEQ ID NO: 507911 - DNA, 25 bp, Mus musculus
gatcctgatggcgttctaggctgag

SEQ ID NO: 507912 - DNA, 25 bp, Mus musculus
gatcctgatggtcatagccagctat

SEQ ID NO: 507913 - DNA, 25 bp, Mus musculus
gatcctgatggtgatagccagctat

SEQ ID NO: 507914 - DNA, 25 bp, Mus musculus
gatcctgattaactgggagcctgaa

SEQ ID NO: 507915 - DNA, 25 bp, Mus musculus
gatcctgattaagtgggagcctgaa

SEQ ID NO: 507916 - DNA, 25 bp, Mus musculus
gatcctgattacaactgcactgacc

SEQ ID NO: 507917 - DNA, 25 bp, Mus musculus
gatcctgattactactgcactgacc

SEQ ID NO: 507918 - DNA, 25 bp, Mus musculus
gatcctgatttcctgtgtctactga

SEQ ID NO: 507919 - DNA, 25 bp, Mus musculus
gatcctgatttcgtgtgtctactga

SEQ ID NO: 507920 - DNA, 25 bp, Mus musculus
gatcctgcaaacatccctgggtgag

SEQ ID NO: 507921 - DNA, 25 bp, Mus musculus
gatcctgcaaacctgaactagcatc

SEQ ID NO: 507922 - DNA, 25 bp, Mus musculus
gatcctgcaaacgtgaactagcatc

SEQ ID NO: 507923 - DNA, 25 bp, Mus musculus
gatcctgcaaacttccctgggtgag

SEQ ID NO: 507924 - DNA, 25 bp, Mus musculus
gatcctgcaagactcccggatgatg

SEQ ID NO: 507925 - DNA, 25 bp, Mus musculus
gatcctgcaagagtcccggatgatg

SEQ ID NO: 507926 - DNA, 25 bp, Mus musculus
gatcctgcacaaattaactcttgta

SEQ ID NO: 507927 - DNA, 25 bp, Mus musculus
gatcctgcacaatttaactcttgta

SEQ ID NO: 507928 - DNA, 25 bp, Mus musculus
gatcctgcatctaatagtgccaggc

SEQ ID NO: 507929 - DNA, 25 bp, Mus musculus
gatcctgcatcttatagtgccaggc

SEQ ID NO: 507930 - DNA, 25 bp, Mus musculus
gatcctgccaatatctttctgagat

SEQ ID NO: 507931 - DNA, 25 bp, Mus musculus
gatcctgccaatttctttctgagat

SEQ ID NO: 507932 - DNA, 25 bp, Mus musculus
gatcctgccatgaaagcttttgctc

SEQ ID NO: 507933 - DNA, 25 bp, Mus musculus
gatcctgccatgcttatacaagcca

SEQ ID NO: 507934 - DNA, 25 bp, Mus musculus
gatcctgccatggttatacaagcca

SEQ ID NO: 507935 - DNA, 25 bp, Mus musculus
gatcctgccatgtaagcttttgctc

SEQ ID NO: 507936 - DNA, 25 bp, Mus musculus
gatcctgcctccatggacactttat

SEQ ID NO: 507937 - DNA, 25 bp, Mus musculus
gatcctgcctccttggacactttat

SEQ ID NO: 507938 - DNA, 25 bp, Mus musculus
gatcctgcctttcttacaagaactc

SEQ ID NO: 507939 - DNA, 25 bp, Mus musculus
gatcctgcctttgttacaagaactc

SEQ ID NO: 507940 - DNA, 25 bp, Mus musculus
gatcctgcgagtcgacaacattatc

SEQ ID NO: 507941 - DNA, 25 bp, Mus musculus
gatcctgcgagtggacaacattatc

SEQ ID NO: 507942 - DNA, 25 bp, Mus musculus
gatcctgcgcttacctggataagaa

SEQ ID NO: 507943 - DNA, 25 bp, Mus musculus
gatcctgcgctttcctggataagaa

SEQ ID NO: 507944 - DNA, 25 bp, Mus musculus
gatcctgcggttcctgcacatagaa

SEQ ID NO: 507945 - DNA, 25 bp, Mus musculus
gatcctgcggttgctgcacatagaa

SEQ ID NO: 507946 - DNA, 25 bp, Mus musculus
gatcctgctaggctgaaactctaaa

SEQ ID NO: 507947 - DNA, 25 bp, Mus musculus
gatcctgctagggtgaaactctaaa

SEQ ID NO: 507948 - DNA, 25 bp, Mus musculus
gatcctgctatcatgaagaaattag

SEQ ID NO: 507949 - DNA, 25 bp, Mus musculus
gatcctgctatcttgaagaaattag

SEQ ID NO: 507950 - DNA, 25 bp, Mus musculus
gatcctgctcatcggagttgtgcta

SEQ ID NO: 507951 - DNA, 25 bp, Mus musculus
gatcctgctcatgggagttgtgcta

SEQ ID NO: 507952 - DNA, 25 bp, Mus musculus
gatcctgctgacagctggcgaaggt

SEQ ID NO: 507953 - DNA, 25 bp, Mus musculus
gatcctgctgactgctggcgaaggt

SEQ ID NO: 507954 - DNA, 25 bp, Mus musculus
gatcctgctgccattagcactcaag

SEQ ID NO: 507955 - DNA, 25 bp, Mus musculus
gatcctgctgcctttagcactcaag

SEQ ID NO: 507956 - DNA, 25 bp, Mus musculus
gatcctgctgtgaccatagtaccca

SEQ ID NO: 507957 - DNA, 25 bp, Mus musculus
gatcctgctgtgtccatagtaccca

SEQ ID NO: 507958 - DNA, 25 bp, Mus musculus
gatcctgctgttctggaagggtcat

SEQ ID NO: 507959 - DNA, 25 bp, Mus musculus
gatcctgctgttgtggaagggtcat

SEQ ID NO: 507960 - DNA, 25 bp, Mus musculus
gatcctggaaatactgggcagccca

SEQ ID NO: 507961 - DNA, 25 bp, Mus musculus
gatcctggaaattctgggcagccca

SEQ ID NO: 507962 - DNA, 25 bp, Mus musculus
gatcctggaactagacctgctggca

SEQ ID NO: 507963 - DNA, 25 bp, Mus musculus
gatcctggaacttgacctgctggca

SEQ ID NO: 507964 - DNA, 25 bp, Mus musculus
gatcctggaatcaatttggcagctt

SEQ ID NO: 507965 - DNA, 25 bp, Mus musculus
gatcctggaatctatttggcagctt

SEQ ID NO: 507966 - DNA, 25 bp, Mus musculus
gatcctggaatgacttccacgcctg

SEQ ID NO: 507967 - DNA, 25 bp, Mus musculus
gatcctggaatgtcttccacgcctg

SEQ ID NO: 507968 - DNA, 25 bp, Mus musculus
gatcctggacatacctttctataag

SEQ ID NO: 507969 - DNA, 25 bp, Mus musculus
gatcctggacatccatcttcattta

SEQ ID NO: 507970 - DNA, 25 bp, Mus musculus
gatcctggacatgcatcttcattta

SEQ ID NO: 507971 - DNA, 25 bp, Mus musculus
gatcctggacattcctttctataag

SEQ ID NO: 507972 - DNA, 25 bp, Mus musculus
gatcctggagaacctaagactgcaa

SEQ ID NO: 507973 - DNA, 25 bp, Mus musculus
gatcctggagaagctaagactgcaa

SEQ ID NO: 507974 - DNA, 25 bp, Mus musculus
gatcctggagagctagggagttccc

SEQ ID NO: 507975 - DNA, 25 bp, Mus musculus
gatcctggagagctttggttttcat

SEQ ID NO: 507976 - DNA, 25 bp, Mus musculus
gatcctggagaggtagggagttccc

SEQ ID NO: 507977 - DNA, 25 bp, Mus musculus
gatcctggagaggtttggttttcat

SEQ ID NO: 507978 - DNA, 25 bp, Mus musculus
gatcctggaggacgtccgctacatc

SEQ ID NO: 507979 - DNA, 25 bp, Mus musculus
gatcctggaggaggtccgctacatc

SEQ ID NO: 507980 - DNA, 25 bp, Mus musculus
gatcctggataacaacgccgtgaat

SEQ ID NO: 507981 - DNA, 25 bp, Mus musculus
gatcctggataagaacgccgtgaat

SEQ ID NO: 507982 - DNA, 25 bp, Mus musculus
gatcctggatgtatctgctgctatg

SEQ ID NO: 507983 - DNA, 25 bp, Mus musculus
gatcctggatgtccttctcgagaaa

SEQ ID NO: 507984 - DNA, 25 bp, Mus musculus
gatcctggatgtgcttctcgagaaa

SEQ ID NO: 507985 - DNA, 25 bp, Mus musculus
gatcctggatgtttctgctgctatg

SEQ ID NO: 507986 - DNA, 25 bp, Mus musculus
gatcctggattcattctaagttcga

SEQ ID NO: 507987 - DNA, 25 bp, Mus musculus
gatcctggattctttctaagttcga

SEQ ID NO: 507988 - DNA, 25 bp, Mus musculus
gatcctggcaatcattggaccttaa

SEQ ID NO: 507989 - DNA, 25 bp, Mus musculus
gatcctggcaatgattggaccttaa

SEQ ID NO: 507990 - DNA, 25 bp, Mus musculus
gatcctggcactcgcaatggctgta

SEQ ID NO: 507991 - DNA, 25 bp, Mus musculus
gatcctggcactggcaatggctgta

SEQ ID NO: 507992 - DNA, 25 bp, Mus musculus
gatcctggcagaaacaccaacgggc

SEQ ID NO: 507993 - DNA, 25 bp, Mus musculus
gatcctggcagatacaccaacgggc

SEQ ID NO: 507994 - DNA, 25 bp, Mus musculus
gatcctggcattatgcacacatttt

SEQ ID NO: 507995 - DNA, 25 bp, Mus musculus
gatcctggcattttgcacacatttt

SEQ ID NO: 507996 - DNA, 25 bp, Mus musculus
gatcctggctcgcagacagacaatt

SEQ ID NO: 507997 - DNA, 25 bp, Mus musculus
gatcctggctcggagacagacaatt

SEQ ID NO: 507998 - DNA, 25 bp, Mus musculus
gatcctggctgcatcacactgtcag

SEQ ID NO: 507999 - DNA, 25 bp, Mus musculus
gatcctggctgcttcacactgtcag

SEQ ID NO: 508000 - DNA, 25 bp, Mus musculus
gatcctggcttcattttattctatg

SEQ ID NO: 508001 - DNA, 25 bp, Mus musculus
gatcctggcttctttttattctatg

SEQ ID NO: 508002 - DNA, 25 bp, Mus musculus
gatcctggcttgctatagatcagcc

SEQ ID NO: 508003 - DNA, 25 bp, Mus musculus
gatcctggcttggtatagatcagcc

SEQ ID NO: 508004 - DNA, 25 bp, Mus musculus
gatcctggctttcaagcacttggta

SEQ ID NO: 508005 - DNA, 25 bp, Mus musculus
gatcctggctttgaagcacttggta

SEQ ID NO: 508006 - DNA, 25 bp, Mus musculus
gatcctgggactagtgaatggctca

SEQ ID NO: 508007 - DNA, 25 bp, Mus musculus
gatcctgggactctcagggaagtca

SEQ ID NO: 508008 - DNA, 25 bp, Mus musculus
gatcctgggactgtcagggaagtca

SEQ ID NO: 508009 - DNA, 25 bp, Mus musculus
gatcctgggacttgtgaatggctca

SEQ ID NO: 508010 - DNA, 25 bp, Mus musculus
gatcctgggctaaagtctgctgagt

SEQ ID NO: 508011 - DNA, 25 bp, Mus musculus
gatcctgggctatagtctgctgagt

SEQ ID NO: 508012 - DNA, 25 bp, Mus musculus
gatcctgggtttctgttcaatttga

SEQ ID NO: 508013 - DNA, 25 bp, Mus musculus
gatcctgggtttgtgttcaatttga

SEQ ID NO: 508014 - DNA, 25 bp, Mus musculus
gatcctggtcatatttaggtgttcc

SEQ ID NO: 508015 - DNA, 25 bp, Mus musculus
gatcctggtcatttttaggtgttcc

SEQ ID NO: 508016 - DNA, 25 bp, Mus musculus
gatcctggtctcatatcgtttaatc

SEQ ID NO: 508017 - DNA, 25 bp, Mus musculus
gatcctggtctcttatcgtttaatc

SEQ ID NO: 508018 - DNA, 25 bp, Mus musculus
gatcctggtgaactcactggacatc

SEQ ID NO: 508019 - DNA, 25 bp, Mus musculus
gatcctggtgaagtcactggacatc

SEQ ID NO: 508020 - DNA, 25 bp, Mus musculus
gatcctggtgataaagcatgcttag

SEQ ID NO: 508021 - DNA, 25 bp, Mus musculus
gatcctggtgattaagcatgcttag

SEQ ID NO: 508022 - DNA, 25 bp, Mus musculus
gatcctggtggtatcttgagtttaa

SEQ ID NO: 508023 - DNA, 25 bp, Mus musculus
gatcctggtggtttcttgagtttaa

SEQ ID NO: 508024 - DNA, 25 bp, Mus musculus
gatcctggtgtgacctgttatccta

SEQ ID NO: 508025 - DNA, 25 bp, Mus musculus
gatcctggtgtgtcctgttatccta

SEQ ID NO: 508026 - DNA, 25 bp, Mus musculus
gatcctgtaagccaccggtatttag

SEQ ID NO: 508027 - DNA, 25 bp, Mus musculus
gatcctgtaagcgaccggtatttag

SEQ ID NO: 508028 - DNA, 25 bp, Mus musculus
gatcctgtaagtaatcttcttagtc

SEQ ID NO: 508029 - DNA, 25 bp, Mus musculus
gatcctgtaagttatcttcttagtc

SEQ ID NO: 508030 - DNA, 25 bp, Mus musculus
gatcctgtaattatagtctctgcta

SEQ ID NO: 508031 - DNA, 25 bp, Mus musculus
gatcctgtaattttagtctctgcta

SEQ ID NO: 508032 - DNA, 25 bp, Mus musculus
gatcctgtacagaaactcttcgtgg

SEQ ID NO: 508033 - DNA, 25 bp, Mus musculus
gatcctgtacagtaactcttcgtgg

SEQ ID NO: 508034 - DNA, 25 bp, Mus musculus
gatcctgtacatacgtagcatctcg

SEQ ID NO: 508035 - DNA, 25 bp, Mus musculus
gatcctgtacattcgtagcatctcg

SEQ ID NO: 508036 - DNA, 25 bp, Mus musculus
gatcctgtacctattattctttgtg

SEQ ID NO: 508037 - DNA, 25 bp, Mus musculus
gatcctgtaccttttattctttgtg

SEQ ID NO: 508038 - DNA, 25 bp, Mus musculus
gatcctgtacggagtggtctatgaa

SEQ ID NO: 508039 - DNA, 25 bp, Mus musculus
gatcctgtacggtgtggtctatgaa

SEQ ID NO: 508040 - DNA, 25 bp, Mus musculus
gatcctgtaggccacactgttcagg

SEQ ID NO: 508041 - DNA, 25 bp, Mus musculus
gatcctgtaggcgacactgttcagg

SEQ ID NO: 508042 - DNA, 25 bp, Mus musculus
gatcctgtataacagactgagtcta

SEQ ID NO: 508043 - DNA, 25 bp, Mus musculus
gatcctgtataagagactgagtcta

SEQ ID NO: 508044 - DNA, 25 bp, Mus musculus
gatcctgtcaaaatacccttctaaa

SEQ ID NO: 508045 - DNA, 25 bp, Mus musculus
gatcctgtcaaattacccttctaaa

SEQ ID NO: 508046 - DNA, 25 bp, Mus musculus
gatcctgtcacaagaaataagcaag

SEQ ID NO: 508047 - DNA, 25 bp, Mus musculus
gatcctgtcacatgaaataagcaag

SEQ ID NO: 508048 - DNA, 25 bp, Mus musculus
gatcctgtcattatcatgtgaccca

SEQ ID NO: 508049 - DNA, 25 bp, Mus musculus
gatcctgtcattttcatgtgaccca

SEQ ID NO: 508050 - DNA, 25 bp, Mus musculus
gatcctgtctcaaagtactacctga

SEQ ID NO: 508051 - DNA, 25 bp, Mus musculus
gatcctgtctcatagtactacctga

SEQ ID NO: 508052 - DNA, 25 bp, Mus musculus
gatcctgtgatactctgttggccgg

SEQ ID NO: 508053 - DNA, 25 bp, Mus musculus
gatcctgtgatagtctgttggccgg

SEQ ID NO: 508054 - DNA, 25 bp, Mus musculus
gatcctgtgcatcagaagtagcctg

SEQ ID NO: 508055 - DNA, 25 bp, Mus musculus
gatcctgtgcatgagaagtagcctg

SEQ ID NO: 508056 - DNA, 25 bp, Mus musculus
gatcctgtgccaaaagattccccaa

SEQ ID NO: 508057 - DNA, 25 bp, Mus musculus
gatcctgtgccataagattccccaa

SEQ ID NO: 508058 - DNA, 25 bp, Mus musculus
gatcctgtggataaacttagcttca

SEQ ID NO: 508059 - DNA, 25 bp, Mus musculus
gatcctgtggattaacttagcttca

SEQ ID NO: 508060 - DNA, 25 bp, Mus musculus
gatcctgtggcaagaatcttacaag

SEQ ID NO: 508061 - DNA, 25 bp, Mus musculus
gatcctgtggcatgaatcttacaag

SEQ ID NO: 508062 - DNA, 25 bp, Mus musculus
gatcctgtggctaaagaggccccta

SEQ ID NO: 508063 - DNA, 25 bp, Mus musculus
gatcctgtggcttaagaggccccta

SEQ ID NO: 508064 - DNA, 25 bp, Mus musculus
gatcctgtgggacaaattgactgta

SEQ ID NO: 508065 - DNA, 25 bp, Mus musculus
gatcctgtgggagaaattgactgta

SEQ ID NO: 508066 - DNA, 25 bp, Mus musculus
gatcctgtggttaaaagactctctc

SEQ ID NO: 508067 - DNA, 25 bp, Mus musculus
gatcctgtggtttaaagactctctc

SEQ ID NO: 508068 - DNA, 25 bp, Mus musculus
gatcctgtgtcccttgggcagaaaa

SEQ ID NO: 508069 - DNA, 25 bp, Mus musculus
gatcctgtgtccgttgggcagaaaa

SEQ ID NO: 508070 - DNA, 25 bp, Mus musculus
gatcctgttaccacatcatgtttgt

SEQ ID NO: 508071 - DNA, 25 bp, Mus musculus
gatcctgttacctcatcatgtttgt

SEQ ID NO: 508072 - DNA, 25 bp, Mus musculus
gatcctgttaggctctggcccatgt

SEQ ID NO: 508073 - DNA, 25 bp, Mus musculus
gatcctgttagggtctggcccatgt

SEQ ID NO: 508074 - DNA, 25 bp, Mus musculus
gatcctgttcaacgtcacatgacgg

SEQ ID NO: 508075 - DNA, 25 bp, Mus musculus
gatcctgttcaaggtcacatgacgg

SEQ ID NO: 508076 - DNA, 25 bp, Mus musculus
gatcctgttctcacattctacaggg

SEQ ID NO: 508077 - DNA, 25 bp, Mus musculus
gatcctgttctctcattctacaggg

SEQ ID NO: 508078 - DNA, 25 bp, Mus musculus
gatcctgttggaagttaacccttgt

SEQ ID NO: 508079 - DNA, 25 bp, Mus musculus
gatcctgttggatgttaacccttgt

SEQ ID NO: 508080 - DNA, 25 bp, Mus musculus
gatcctgtttaaagactctgcgttt

SEQ ID NO: 508081 - DNA, 25 bp, Mus musculus
gatcctgtttaatgactctgcgttt

SEQ ID NO: 508082 - DNA, 25 bp, Mus musculus
gatcctgtttatccgaatcatgccc

SEQ ID NO: 508083 - DNA, 25 bp, Mus musculus
gatcctgtttatgcgaatcatgccc

SEQ ID NO: 508084 - DNA, 25 bp, Mus musculus
gatcctgtttctcaactggaacacc

SEQ ID NO: 508085 - DNA, 25 bp, Mus musculus
gatcctgtttctgaactggaacacc

SEQ ID NO: 508086 - DNA, 25 bp, Mus musculus
gatcctgtttgtagcacacatttat

SEQ ID NO: 508087 - DNA, 25 bp, Mus musculus
gatcctgtttgttgcacacatttat

SEQ ID NO: 508088 - DNA, 25 bp, Mus musculus
gatcctgtttttctgggaaatcctt

SEQ ID NO: 508089 - DNA, 25 bp, Mus musculus
gatcctgtttttgtgggaaatcctt

SEQ ID NO: 508090 - DNA, 25 bp, Mus musculus
gatccttaaccactgcatagcgcat

SEQ ID NO: 508091 - DNA, 25 bp, Mus musculus
gatccttaaccagtgcatagcgcat

SEQ ID NO: 508092 - DNA, 25 bp, Mus musculus
gatccttaatccagggtgcttatga

SEQ ID NO: 508093 - DNA, 25 bp, Mus musculus
gatccttaatcctgggtgcttatga

SEQ ID NO: 508094 - DNA, 25 bp, Mus musculus
gatccttacacactgatatgctttg

SEQ ID NO: 508095 - DNA, 25 bp, Mus musculus
gatccttacacagtgatatgctttg

SEQ ID NO: 508096 - DNA, 25 bp, Mus musculus
gatccttacccgactggaagattat

SEQ ID NO: 508097 - DNA, 25 bp, Mus musculus
gatccttacccgtctggaagattat

SEQ ID NO: 508098 - DNA, 25 bp, Mus musculus
gatccttactacacactgttgcatg

SEQ ID NO: 508099 - DNA, 25 bp, Mus musculus
gatccttactactcactgttgcatg

SEQ ID NO: 508100 - DNA, 25 bp, Mus musculus
gatccttactagacatctgtcatat

SEQ ID NO: 508101 - DNA, 25 bp, Mus musculus
gatccttactagtcatctgtcatat

SEQ ID NO: 508102 - DNA, 25 bp, Mus musculus
gatccttactgtactatagttttcg

SEQ ID NO: 508103 - DNA, 25 bp, Mus musculus
gatccttactgttctatagttttcg

SEQ ID NO: 508104 - DNA, 25 bp, Mus musculus
gatccttagatcagcactcaaccat

SEQ ID NO: 508105 - DNA, 25 bp, Mus musculus
gatccttagatctgcactcaaccat

SEQ ID NO: 508106 - DNA, 25 bp, Mus musculus
gatccttagccacgttattattgag

SEQ ID NO: 508107 - DNA, 25 bp, Mus musculus
gatccttagccaggttattattgag

SEQ ID NO: 508108 - DNA, 25 bp, Mus musculus
gatccttagtgcatatcatctgaga

SEQ ID NO: 508109 - DNA, 25 bp, Mus musculus
gatccttagtgcttatcatctgaga

SEQ ID NO: 508110 - DNA, 25 bp, Mus musculus
gatccttatctgctatctgtgaaat

SEQ ID NO: 508111 - DNA, 25 bp, Mus musculus
gatccttatctggtatctgtgaaat

SEQ ID NO: 508112 - DNA, 25 bp, Mus musculus
gatccttatgcacaatctgctcgtg

SEQ ID NO: 508113 - DNA, 25 bp, Mus musculus
gatccttatgcagaatctgctcgtg

SEQ ID NO: 508114 - DNA, 25 bp, Mus musculus
gatccttatttcaaggtctttcaga

SEQ ID NO: 508115 - DNA, 25 bp, Mus musculus
gatccttatttctaggtctttcaga

SEQ ID NO: 508116 - DNA, 25 bp, Mus musculus
gatccttcaacaaggctctcgagtg

SEQ ID NO: 508117 - DNA, 25 bp, Mus musculus
gatccttcaacatggctctcgagtg

SEQ ID NO: 508118 - DNA, 25 bp, Mus musculus
gatccttcatggcactgcagtcctg

SEQ ID NO: 508119 - DNA, 25 bp, Mus musculus
gatccttcatgggactgcagtcctg

SEQ ID NO: 508120 - DNA, 25 bp, Mus musculus
gatccttccaatcgtgggacttggt

SEQ ID NO: 508121 - DNA, 25 bp, Mus musculus
gatccttccaatggtgggacttggt

SEQ ID NO: 508122 - DNA, 25 bp, Mus musculus
gatccttccagaacgccaaaggacc

SEQ ID NO: 508123 - DNA, 25 bp, Mus musculus
gatccttccagatcgccaaaggacc

SEQ ID NO: 508124 - DNA, 25 bp, Mus musculus
gatccttccgaaacaatccagatgg

SEQ ID NO: 508125 - DNA, 25 bp, Mus musculus
gatccttccgaatcaatccagatgg

SEQ ID NO: 508126 - DNA, 25 bp, Mus musculus
gatccttcctgtaagggacttttct

SEQ ID NO: 508127 - DNA, 25 bp, Mus musculus
gatccttcctgttagggacttttct

SEQ ID NO: 508128 - DNA, 25 bp, Mus musculus
gatccttcctttcgatggtctccaa

SEQ ID NO: 508129 - DNA, 25 bp, Mus musculus
gatccttcctttggatggtctccaa

SEQ ID NO: 508130 - DNA, 25 bp, Mus musculus
gatccttcgcagagctccggagcag

SEQ ID NO: 508131 - DNA, 25 bp, Mus musculus
gatccttcgcagtgctccggagcag

SEQ ID NO: 508132 - DNA, 25 bp, Mus musculus
gatccttctaggacttataatgcca

SEQ ID NO: 508133 - DNA, 25 bp, Mus musculus
gatccttctaggtcttataatgcca

SEQ ID NO: 508134 - DNA, 25 bp, Mus musculus
gatccttctgacacagctgattcag

SEQ ID NO: 508135 - DNA, 25 bp, Mus musculus
gatccttctgactcagctgattcag

SEQ ID NO: 508136 - DNA, 25 bp, Mus musculus
gatccttcttgactatgagatgcta

SEQ ID NO: 508137 - DNA, 25 bp, Mus musculus
gatccttcttgagtatgagatgcta

SEQ ID NO: 508138 - DNA, 25 bp, Mus musculus
gatccttcttgcatggttcagtaga

SEQ ID NO: 508139 - DNA, 25 bp, Mus musculus
gatccttcttgcttggttcagtaga

SEQ ID NO: 508140 - DNA, 25 bp, Mus musculus
gatccttgaaccagtacacaatcta

SEQ ID NO: 508141 - DNA, 25 bp, Mus musculus
gatccttgaacctgtacacaatcta

SEQ ID NO: 508142 - DNA, 25 bp, Mus musculus
gatccttgaagtcaaaagtccaata

SEQ ID NO: 508143 - DNA, 25 bp, Mus musculus
gatccttgaagtcttgcacagtctt

SEQ ID NO: 508144 - DNA, 25 bp, Mus musculus
gatccttgaagtgaaaagtccaata

SEQ ID NO: 508145 - DNA, 25 bp, Mus musculus
gatccttgaagtgttgcacagtctt

SEQ ID NO: 508146 - DNA, 25 bp, Mus musculus
gatccttgagccagattagtgcagt

SEQ ID NO: 508147 - DNA, 25 bp, Mus musculus
gatccttgagcctgattagtgcagt

SEQ ID NO: 508148 - DNA, 25 bp, Mus musculus
gatccttgatttccataaacctgta

SEQ ID NO: 508149 - DNA, 25 bp, Mus musculus
gatccttgatttgcataaacctgta

SEQ ID NO: 508150 - DNA, 25 bp, Mus musculus
gatccttgcctgacttagcatgaat

SEQ ID NO: 508151 - DNA, 25 bp, Mus musculus
gatccttgcctgtcttagcatgaat

SEQ ID NO: 508152 - DNA, 25 bp, Mus musculus
gatccttgctcacattatttttcat

SEQ ID NO: 508153 - DNA, 25 bp, Mus musculus
gatccttgctcagattatttttcat

SEQ ID NO: 508154 - DNA, 25 bp, Mus musculus
gatccttgctgaaaaagactctcct

SEQ ID NO: 508155 - DNA, 25 bp, Mus musculus
gatccttgctgataaagactctcct

SEQ ID NO: 508156 - DNA, 25 bp, Mus musculus
gatccttgctttactaaggcatgtg

SEQ ID NO: 508157 - DNA, 25 bp, Mus musculus
gatccttgcttttctaaggcatgtg

SEQ ID NO: 508158 - DNA, 25 bp, Mus musculus
gatccttggaacaggctatgcttga

SEQ ID NO: 508159 - DNA, 25 bp, Mus musculus
gatccttggaactggctatgcttga

SEQ ID NO: 508160 - DNA, 25 bp, Mus musculus
gatccttggaatccacattatgtgg

SEQ ID NO: 508161 - DNA, 25 bp, Mus musculus
gatccttggaatgcacattatgtgg

SEQ ID NO: 508162 - DNA, 25 bp, Mus musculus
gatccttggcagaggtgctcagaca

SEQ ID NO: 508163 - DNA, 25 bp, Mus musculus
gatccttggcagtggtgctcagaca

SEQ ID NO: 508164 - DNA, 25 bp, Mus musculus
gatccttgggagatcatggccttca

SEQ ID NO: 508165 - DNA, 25 bp, Mus musculus
gatccttgggagttcatggccttca

SEQ ID NO: 508166 - DNA, 25 bp, Mus musculus
gatccttgggcgacacagcgcctta

SEQ ID NO: 508167 - DNA, 25 bp, Mus musculus
gatccttgggcgtcacagcgcctta

SEQ ID NO: 508168 - DNA, 25 bp, Mus musculus
gatccttgtaagaatgagtccttca

SEQ ID NO: 508169 - DNA, 25 bp, Mus musculus
gatccttgtaagtatgagtccttca

SEQ ID NO: 508170 - DNA, 25 bp, Mus musculus
gatccttgtcttaagtcagagtcag

SEQ ID NO: 508171 - DNA, 25 bp, Mus musculus
gatccttgtctttagtcagagtcag

SEQ ID NO: 508172 - DNA, 25 bp, Mus musculus
gatccttgtgccaaccagtgtttta

SEQ ID NO: 508173 - DNA, 25 bp, Mus musculus
gatccttgtgcctaccagtgtttta

SEQ ID NO: 508174 - DNA, 25 bp, Mus musculus
gatccttgtgtaaaccgcattttct

SEQ ID NO: 508175 - DNA, 25 bp, Mus musculus
gatccttgtgtataccgcattttct

SEQ ID NO: 508176 - DNA, 25 bp, Mus musculus
gatccttgttcccatgttaattgta

SEQ ID NO: 508177 - DNA, 25 bp, Mus musculus
gatccttgttccgatgttaattgta

SEQ ID NO: 508178 - DNA, 25 bp, Mus musculus
gatcctttagagacttgaggcctct

SEQ ID NO: 508179 - DNA, 25 bp, Mus musculus
gatcctttagagtcttgaggcctct

SEQ ID NO: 508180 - DNA, 25 bp, Mus musculus
gatcctttaggaaaaatcattgctc

SEQ ID NO: 508181 - DNA, 25 bp, Mus musculus
gatcctttaggataaatcattgctc

SEQ ID NO: 508182 - DNA, 25 bp, Mus musculus
gatcctttaggcataccaggaaggc

SEQ ID NO: 508183 - DNA, 25 bp, Mus musculus
gatcctttaggcttaccaggaaggc

SEQ ID NO: 508184 - DNA, 25 bp, Mus musculus
gatcctttccctcgtgtggacttaa

SEQ ID NO: 508185 - DNA, 25 bp, Mus musculus
gatcctttccctggtgtggacttaa

SEQ ID NO: 508186 - DNA, 25 bp, Mus musculus
gatcctttctagctctggatagcag

SEQ ID NO: 508187 - DNA, 25 bp, Mus musculus
gatcctttctaggtctggatagcag

SEQ ID NO: 508188 - DNA, 25 bp, Mus musculus
gatcctttctgaaggcgatggaact

SEQ ID NO: 508189 - DNA, 25 bp, Mus musculus
gatcctttctgatggcgatggaact

SEQ ID NO: 508190 - DNA, 25 bp, Mus musculus
gatcctttctgtaggctatttcctc

SEQ ID NO: 508191 - DNA, 25 bp, Mus musculus
gatcctttctgtcagcacaaaactg

SEQ ID NO: 508192 - DNA, 25 bp, Mus musculus
gatcctttctgtgagcacaaaactg

SEQ ID NO: 508193 - DNA, 25 bp, Mus musculus
gatcctttctgttggctatttcctc

SEQ ID NO: 508194 - DNA, 25 bp, Mus musculus
gatcctttgaagaaaatgtacctac

SEQ ID NO: 508195 - DNA, 25 bp, Mus musculus
gatcctttgaagtaaatgtacctac

SEQ ID NO: 508196 - DNA, 25 bp, Mus musculus
gatcctttgagtagtcattgttaag

SEQ ID NO: 508197 - DNA, 25 bp, Mus musculus
gatcctttgagttgtcattgttaag

SEQ ID NO: 508198 - DNA, 25 bp, Mus musculus
gatcctttgataaaatccgatattg

SEQ ID NO: 508199 - DNA, 25 bp, Mus musculus
gatcctttgataaagcccaatattg

SEQ ID NO: 508200 - DNA, 25 bp, Mus musculus
gatcctttgatataatccgatattg

SEQ ID NO: 508201 - DNA, 25 bp, Mus musculus
gatcctttgatatagcccaatattg

SEQ ID NO: 508202 - DNA, 25 bp, Mus musculus
gatcctttgccacttatttgacaca

SEQ ID NO: 508203 - DNA, 25 bp, Mus musculus
gatcctttgccagttatttgacaca

SEQ ID NO: 508204 - DNA, 25 bp, Mus musculus
gatcctttgctcagcctggagataa

SEQ ID NO: 508205 - DNA, 25 bp, Mus musculus
gatcctttgctctgcctggagataa

SEQ ID NO: 508206 - DNA, 25 bp, Mus musculus
gatcctttgtgtcaacatcctacag

SEQ ID NO: 508207 - DNA, 25 bp, Mus musculus
gatcctttgtgtgaacatcctacag

SEQ ID NO: 508208 - DNA, 25 bp, Mus musculus
gatccttttaaacacttcaacgctc

SEQ ID NO: 508209 - DNA, 25 bp, Mus musculus
gatccttttaaagacttcaacgctc

SEQ ID NO: 508210 - DNA, 25 bp, Mus musculus
gatccttttaagagggattgctctg

SEQ ID NO: 508211 - DNA, 25 bp, Mus musculus
gatccttttaagtgggattgctctg

SEQ ID NO: 508212 - DNA, 25 bp, Mus musculus
gatccttttatgagctcagggacta

SEQ ID NO: 508213 - DNA, 25 bp, Mus musculus
gatccttttatgtgctcagggacta

SEQ ID NO: 508214 - DNA, 25 bp, Mus musculus
gatccttttgagctcagaacttggg

SEQ ID NO: 508215 - DNA, 25 bp, Mus musculus
gatccttttgaggtcagaacttggg

SEQ ID NO: 508216 - DNA, 25 bp, Mus musculus
gatccttttgcaactccttcaaatg

SEQ ID NO: 508217 - DNA, 25 bp, Mus musculus
gatccttttgcatctccttcaaatg

SEQ ID NO: 508218 - DNA, 25 bp, Mus musculus
gatcctttttgaagacgtgtttagg

SEQ ID NO: 508219 - DNA, 25 bp, Mus musculus
gatcctttttgatgacgtgtttagg

SEQ ID NO: 508220 - DNA, 25 bp, Mus musculus
gatcgaaaacctagcaccagactga

SEQ ID NO: 508221 - DNA, 25 bp, Mus musculus
gatcgaaaaccttgcaccagactga

SEQ ID NO: 508222 - DNA, 25 bp, Mus musculus
gatcgaaactctcttcaagtccaag

SEQ ID NO: 508223 - DNA, 25 bp, Mus musculus
gatcgaaactctgttcaagtccaag

SEQ ID NO: 508224 - DNA, 25 bp, Mus musculus
gatcgaaagtgaaagcctggccctg

SEQ ID NO: 508225 - DNA, 25 bp, Mus musculus
gatcgaaagtgatagcctggccctg

SEQ ID NO: 508226 - DNA, 25 bp, Mus musculus
gatcgaaatagcacatgccctttgc

SEQ ID NO: 508227 - DNA, 25 bp, Mus musculus
gatcgaaatagctcatgccctttgc

SEQ ID NO: 508228 - DNA, 25 bp, Mus musculus
gatcgaaatgtgaacccagaagaca

SEQ ID NO: 508229 - DNA, 25 bp, Mus musculus
gatcgaaatgtgtacccagaagaca

SEQ ID NO: 508230 - DNA, 25 bp, Mus musculus
gatcgaaatgttaagacttgtcact

SEQ ID NO: 508231 - DNA, 25 bp, Mus musculus
gatcgaaatgtttagacttgtcact

SEQ ID NO: 508232 - DNA, 25 bp, Mus musculus
gatcgaacagctatccaatatgatt

SEQ ID NO: 508233 - DNA, 25 bp, Mus musculus
gatcgaacagctttccaatatgatt

SEQ ID NO: 508234 - DNA, 25 bp, Mus musculus
gatcgaaccagaatgggcctacgga

SEQ ID NO: 508235 - DNA, 25 bp, Mus musculus
gatcgaaccagattgggcctacgga

SEQ ID NO: 508236 - DNA, 25 bp, Mus musculus
gatcgaactgaactgaatttctggg

SEQ ID NO: 508237 - DNA, 25 bp, Mus musculus
gatcgaactgaagtgaatttctggg

SEQ ID NO: 508238 - DNA, 25 bp, Mus musculus
gatcgaagttttatctgacccttct

SEQ ID NO: 508239 - DNA, 25 bp, Mus musculus
gatcgaagttttttctgacccttct

SEQ ID NO: 508240 - DNA, 25 bp, Mus musculus
gatcgaataaatccattcactgcat

SEQ ID NO: 508241 - DNA, 25 bp, Mus musculus
gatcgaataaatgcattcactgcat

SEQ ID NO: 508242 - DNA, 25 bp, Mus musculus
gatcgaataagccttcaagcaccct

SEQ ID NO: 508243 - DNA, 25 bp, Mus musculus
gatcgaataagcgttcaagcaccct

SEQ ID NO: 508244 - DNA, 25 bp, Mus musculus
gatcgaatccaaagtcggcatgttc

SEQ ID NO: 508245 - DNA, 25 bp, Mus musculus
gatcgaatccaatgtcggcatgttc

SEQ ID NO: 508246 - DNA, 25 bp, Mus musculus
gatcgaatttacagtggagctggag

SEQ ID NO: 508247 - DNA, 25 bp, Mus musculus
gatcgaatttactgtggagctggag

SEQ ID NO: 508248 - DNA, 25 bp, Mus musculus
gatcgaattttgatccaaggaccac

SEQ ID NO: 508249 - DNA, 25 bp, Mus musculus
gatcgaattttgttccaaggaccac

SEQ ID NO: 508250 - DNA, 25 bp, Mus musculus
gatcgacaacatctgtgcttttgcc

SEQ ID NO: 508251 - DNA, 25 bp, Mus musculus
gatcgacaacatgtgtgcttttgcc

SEQ ID NO: 508252 - DNA, 25 bp, Mus musculus
gatcgacaagatatgccatggattt

SEQ ID NO: 508253 - DNA, 25 bp, Mus musculus
gatcgacaagatttgccatggattt

SEQ ID NO: 508254 - DNA, 25 bp, Mus musculus
gatcgacaagccatagacactttgg

SEQ ID NO: 508255 - DNA, 25 bp, Mus musculus
gatcgacaagccttagacactttgg

SEQ ID NO: 508256 - DNA, 25 bp, Mus musculus
gatcgacacagccatttggtgacac

SEQ ID NO: 508257 - DNA, 25 bp, Mus musculus
gatcgacacagcgatttggtgacac

SEQ ID NO: 508258 - DNA, 25 bp, Mus musculus
gatcgacacccaaaggttaatcccg

SEQ ID NO: 508259 - DNA, 25 bp, Mus musculus
gatcgacacccataggttaatcccg

SEQ ID NO: 508260 - DNA, 25 bp, Mus musculus
gatcgacactgcatgtctttatagg

SEQ ID NO: 508261 - DNA, 25 bp, Mus musculus
gatcgacactgcttgtctttatagg

SEQ ID NO: 508262 - DNA, 25 bp, Mus musculus
gatcgacatcagcatggttctcctc

SEQ ID NO: 508263 - DNA, 25 bp, Mus musculus
gatcgacatcaggatggttctcctc

SEQ ID NO: 508264 - DNA, 25 bp, Mus musculus
gatcgacatcttcgacacagacggc

SEQ ID NO: 508265 - DNA, 25 bp, Mus musculus
gatcgacatcttggacacagacggc

SEQ ID NO: 508266 - DNA, 25 bp, Mus musculus
gatcgacatgtacttcctccagctg

SEQ ID NO: 508267 - DNA, 25 bp, Mus musculus
gatcgacatgtagttcctccagctg

SEQ ID NO: 508268 - DNA, 25 bp, Mus musculus
gatcgacatgttcctccacaaatca

SEQ ID NO: 508269 - DNA, 25 bp, Mus musculus
gatcgacatgttgctccacaaatca

SEQ ID NO: 508270 - DNA, 25 bp, Mus musculus
gatcgaccagatcctggcagctcat

SEQ ID NO: 508271 - DNA, 25 bp, Mus musculus
gatcgaccagatgctggcagctcat

SEQ ID NO: 508272 - DNA, 25 bp, Mus musculus
gatcgacccatcaggtgtttcatat

SEQ ID NO: 508273 - DNA, 25 bp, Mus musculus
gatcgacccatctggtgtttcatat

SEQ ID NO: 508274 - DNA, 25 bp, Mus musculus
gatcgacctgggagaccatactgag

SEQ ID NO: 508275 - DNA, 25 bp, Mus musculus
gatcgacctgggtgaccatactgag

SEQ ID NO: 508276 - DNA, 25 bp, Mus musculus
gatcgacgtcagcaaaaaccccttg

SEQ ID NO: 508277 - DNA, 25 bp, Mus musculus
gatcgacgtcaggaaaaaccccttg

SEQ ID NO: 508278 - DNA, 25 bp, Mus musculus
gatcgactcaggagaactagaccca

SEQ ID NO: 508279 - DNA, 25 bp, Mus musculus
gatcgactcaggtgaactagaccca

SEQ ID NO: 508280 - DNA, 25 bp, Mus musculus
gatcgactgcgtcgagactctggaa

SEQ ID NO: 508281 - DNA, 25 bp, Mus musculus
gatcgactgcgtggagactctggaa

SEQ ID NO: 508282 - DNA, 25 bp, Mus musculus
gatcgacttgaaaaaccgttggttt

SEQ ID NO: 508283 - DNA, 25 bp, Mus musculus
gatcgacttgaataaccgttggttt

SEQ ID NO: 508284 - DNA, 25 bp, Mus musculus
gatcgagaactactccacactggtt

SEQ ID NO: 508285 - DNA, 25 bp, Mus musculus
gatcgagaactagtccacactggtt

SEQ ID NO: 508286 - DNA, 25 bp, Mus musculus
gatcgagaatcactcctttgctcag

SEQ ID NO: 508287 - DNA, 25 bp, Mus musculus
gatcgagaatcagtcctttgctcag

SEQ ID NO: 508288 - DNA, 25 bp, Mus musculus
gatcgagaccggcagaggcgacgta

SEQ ID NO: 508289 - DNA, 25 bp, Mus musculus
gatcgagaccgggagaggcgacgta

SEQ ID NO: 508290 - DNA, 25 bp, Mus musculus
gatcgagactcaaccaaggactcca

SEQ ID NO: 508291 - DNA, 25 bp, Mus musculus
gatcgagactcatccaaggactcca

SEQ ID NO: 508292 - DNA, 25 bp, Mus musculus
gatcgagagaaacggctactgtaac

SEQ ID NO: 508293 - DNA, 25 bp, Mus musculus
gatcgagagaaagggctactgtaac

SEQ ID NO: 508294 - DNA, 25 bp, Mus musculus
gatcgagagtccctcactttaatct

SEQ ID NO: 508295 - DNA, 25 bp, Mus musculus
gatcgagagtccgtcactttaatct

SEQ ID NO: 508296 - DNA, 25 bp, Mus musculus
gatcgagatccaacttcatggaccg

SEQ ID NO: 508297 - DNA, 25 bp, Mus musculus
gatcgagatccatcttcatggaccg

SEQ ID NO: 508298 - DNA, 25 bp, Mus musculus
gatcgagatgagaacatcccaccat

SEQ ID NO: 508299 - DNA, 25 bp, Mus musculus
gatcgagatgagtacatcccaccat

SEQ ID NO: 508300 - DNA, 25 bp, Mus musculus
gatcgagatgatattccttacattg

SEQ ID NO: 508301 - DNA, 25 bp, Mus musculus
gatcgagatgattttccttacattg

SEQ ID NO: 508302 - DNA, 25 bp, Mus musculus
gatcgagcacctcaagcgggagaat

SEQ ID NO: 508303 - DNA, 25 bp, Mus musculus
gatcgagcacctgaagcgggagaat

SEQ ID NO: 508304 - DNA, 25 bp, Mus musculus
gatcgagccctccaaatgtaatagt

SEQ ID NO: 508305 - DNA, 25 bp, Mus musculus
gatcgagccctcgaaatgtaatagt

SEQ ID NO: 508306 - DNA, 25 bp, Mus musculus
gatcgaggagtgcatcttcctggac

SEQ ID NO: 508307 - DNA, 25 bp, Mus musculus
gatcgaggagtggatcttcctggac

SEQ ID NO: 508308 - DNA, 25 bp, Mus musculus
gatcgagggatgcagtacagtcaca

SEQ ID NO: 508309 - DNA, 25 bp, Mus musculus
gatcgagggatggagtacagtcaca

SEQ ID NO: 508310 - DNA, 25 bp, Mus musculus
gatcgagtatacctcgttgctcagc

SEQ ID NO: 508311 - DNA, 25 bp, Mus musculus
gatcgagtatacgtcgttgctcagc

SEQ ID NO: 508312 - DNA, 25 bp, Mus musculus
gatcgagtcagaaaaccagcttgca

SEQ ID NO: 508313 - DNA, 25 bp, Mus musculus
gatcgagtcagataaccagcttgca

SEQ ID NO: 508314 - DNA, 25 bp, Mus musculus
gatcgagtccgtcataacatctgcg

SEQ ID NO: 508315 - DNA, 25 bp, Mus musculus
gatcgagtccgtgataacatctgcg

SEQ ID NO: 508316 - DNA, 25 bp, Mus musculus
gatcgagttggcagacaagaacgag

SEQ ID NO: 508317 - DNA, 25 bp, Mus musculus
gatcgagttggctgacaagaacgag

SEQ ID NO: 508318 - DNA, 25 bp, Mus musculus
gatcgatcacctacatcaatagttt

SEQ ID NO: 508319 - DNA, 25 bp, Mus musculus
gatcgatcaccttcatcaatagttt

SEQ ID NO: 508320 - DNA, 25 bp, Mus musculus
gatcgatctcagctacttccacagg

SEQ ID NO: 508321 - DNA, 25 bp, Mus musculus
gatcgatctcaggtacttccacagg

SEQ ID NO: 508322 - DNA, 25 bp, Mus musculus
gatcgatctgctcgatgattcatgc

SEQ ID NO: 508323 - DNA, 25 bp, Mus musculus
gatcgatctgctggatgattcatgc

SEQ ID NO: 508324 - DNA, 25 bp, Mus musculus
gatcgatgcaaactgaaggtcaacc

SEQ ID NO: 508325 - DNA, 25 bp, Mus musculus
gatcgatgcaaagtgaaggtcaacc

SEQ ID NO: 508326 - DNA, 25 bp, Mus musculus
gatcgatgctggaaggacctgtcac

SEQ ID NO: 508327 - DNA, 25 bp, Mus musculus
gatcgatgctggtaggacctgtcac

SEQ ID NO: 508328 - DNA, 25 bp, Mus musculus
gatcgatggcagatggattctggct

SEQ ID NO: 508329 - DNA, 25 bp, Mus musculus
gatcgatggcagttggattctggct

SEQ ID NO: 508330 - DNA, 25 bp, Mus musculus
gatcgatggtcccaatgctcccgaa

SEQ ID NO: 508331 - DNA, 25 bp, Mus musculus
gatcgatggtccgaatgctcccgaa

SEQ ID NO: 508332 - DNA, 25 bp, Mus musculus
gatcgattgataagatccagttatc

SEQ ID NO: 508333 - DNA, 25 bp, Mus musculus
gatcgattgatatgatccagttatc

SEQ ID NO: 508334 - DNA, 25 bp, Mus musculus
gatcgattggagaccctgagcctga

SEQ ID NO: 508335 - DNA, 25 bp, Mus musculus
gatcgattggagtccctgagcctga

SEQ ID NO: 508336 - DNA, 25 bp, Mus musculus
gatcgatttcctagagcctcagagc

SEQ ID NO: 508337 - DNA, 25 bp, Mus musculus
gatcgatttccttgagcctcagagc

SEQ ID NO: 508338 - DNA, 25 bp, Mus musculus
gatcgatttcgtaggacaatctttg

SEQ ID NO: 508339 - DNA, 25 bp, Mus musculus
gatcgatttcgttggacaatctttg

SEQ ID NO: 508340 - DNA, 25 bp, Mus musculus
gatcgatttgacattgcttccatgc

SEQ ID NO: 508341 - DNA, 25 bp, Mus musculus
gatcgatttgactttgcttccatgc

SEQ ID NO: 508342 - DNA, 25 bp, Mus musculus
gatcgatttttaatggtccactgaa

SEQ ID NO: 508343 - DNA, 25 bp, Mus musculus
gatcgatttttattggtccactgaa

SEQ ID NO: 508344 - DNA, 25 bp, Mus musculus
gatcgcaacgtaacagcaggctggc

SEQ ID NO: 508345 - DNA, 25 bp, Mus musculus
gatcgcaacgtatcagcaggctggc

SEQ ID NO: 508346 - DNA, 25 bp, Mus musculus
gatcgcaattaaccctcagctccag

SEQ ID NO: 508347 - DNA, 25 bp, Mus musculus
gatcgcaattaagcctcagctccag

SEQ ID NO: 508348 - DNA, 25 bp, Mus musculus
gatcgcaattacaaactttctagct

SEQ ID NO: 508349 - DNA, 25 bp, Mus musculus
gatcgcaattactaactttctagct

SEQ ID NO: 508350 - DNA, 25 bp, Mus musculus
gatcgcacatacagtaaacatcaaa

SEQ ID NO: 508351 - DNA, 25 bp, Mus musculus
gatcgcacatactgtaaacatcaaa

SEQ ID NO: 508352 - DNA, 25 bp, Mus musculus
gatcgcactacgctagtaactacgt

SEQ ID NO: 508353 - DNA, 25 bp, Mus musculus
gatcgcactacggtagtaactacgt

SEQ ID NO: 508354 - DNA, 25 bp, Mus musculus
gatcgcagaaacctggtgaccttaa

SEQ ID NO: 508355 - DNA, 25 bp, Mus musculus
gatcgcagaaacgtggtgaccttaa

SEQ ID NO: 508356 - DNA, 25 bp, Mus musculus
gatcgcagaaccagggcatctgcct

SEQ ID NO: 508357 - DNA, 25 bp, Mus musculus
gatcgcagaacctgggcatctgcct

SEQ ID NO: 508358 - DNA, 25 bp, Mus musculus
gatcgcagagagaggccttaaaagc

SEQ ID NO: 508359 - DNA, 25 bp, Mus musculus
gatcgcagagagtggccttaaaagc

SEQ ID NO: 508360 - DNA, 25 bp, Mus musculus
gatcgcagagatccaggacttttct

SEQ ID NO: 508361 - DNA, 25 bp, Mus musculus
gatcgcagagatgcaggacttttct

SEQ ID NO: 508362 - DNA, 25 bp, Mus musculus
gatcgcagcatactatactacaggg

SEQ ID NO: 508363 - DNA, 25 bp, Mus musculus
gatcgcagcatagtatactacaggg

SEQ ID NO: 508364 - DNA, 25 bp, Mus musculus
gatcgcagcctgaaagacctggaca

SEQ ID NO: 508365 - DNA, 25 bp, Mus musculus
gatcgcagcctgtaagacctggaca

SEQ ID NO: 508366 - DNA, 25 bp, Mus musculus
gatcgcagctcccaatactattaaa

SEQ ID NO: 508367 - DNA, 25 bp, Mus musculus
gatcgcagctccgaatactattaaa

SEQ ID NO: 508368 - DNA, 25 bp, Mus musculus
gatcgcagtcccacctgttaaaaca

SEQ ID NO: 508369 - DNA, 25 bp, Mus musculus
gatcgcagtccctcctgttaaaaca

SEQ ID NO: 508370 - DNA, 25 bp, Mus musculus
gatcgcataggcagatgaaatctct

SEQ ID NO: 508371 - DNA, 25 bp, Mus musculus
gatcgcataggctgatgaaatctct

SEQ ID NO: 508372 - DNA, 25 bp, Mus musculus
gatcgcatcattagaatgttccggt

SEQ ID NO: 508373 - DNA, 25 bp, Mus musculus
gatcgcatcatttgaatgttccggt

SEQ ID NO: 508374 - DNA, 25 bp, Mus musculus
gatcgcatctcgacaaacaccagag

SEQ ID NO: 508375 - DNA, 25 bp, Mus musculus
gatcgcatctcgtcaaacaccagag

SEQ ID NO: 508376 - DNA, 25 bp, Mus musculus
gatcgcatgtgcacagatactctcc

SEQ ID NO: 508377 - DNA, 25 bp, Mus musculus
gatcgcatgtgctcagatactctcc

SEQ ID NO: 508378 - DNA, 25 bp, Mus musculus
gatcgccaagtgcaaggccccgcta

SEQ ID NO: 508379 - DNA, 25 bp, Mus musculus
gatcgccaagtggaaggccccgcta

SEQ ID NO: 508380 - DNA, 25 bp, Mus musculus
gatcgccaagttccatcttcgcgtg

SEQ ID NO: 508381 - DNA, 25 bp, Mus musculus
gatcgccaagttgcatcttcgcgtg

SEQ ID NO: 508382 - DNA, 25 bp, Mus musculus
gatcgccaccttcagaggaagcttc

SEQ ID NO: 508383 - DNA, 25 bp, Mus musculus
gatcgccaccttgagaggaagcttc

SEQ ID NO: 508384 - DNA, 25 bp, Mus musculus
gatcgccacgatcactattacagag

SEQ ID NO: 508385 - DNA, 25 bp, Mus musculus
gatcgccacgatgactattacagag

SEQ ID NO: 508386 - DNA, 25 bp, Mus musculus
gatcgccagagtcacttccaaggca

SEQ ID NO: 508387 - DNA, 25 bp, Mus musculus
gatcgccagagtgacttccaaggca

SEQ ID NO: 508388 - DNA, 25 bp, Mus musculus
gatcgccaggcgatttctgagcata

SEQ ID NO: 508389 - DNA, 25 bp, Mus musculus
gatcgccaggcgttttctgagcata

SEQ ID NO: 508390 - DNA, 25 bp, Mus musculus
gatcgccattatccccagcaagaag

SEQ ID NO: 508391 - DNA, 25 bp, Mus musculus
gatcgccattatgcccagcaagaag

SEQ ID NO: 508392 - DNA, 25 bp, Mus musculus
gatcgcccaaacctctaacagattt

SEQ ID NO: 508393 - DNA, 25 bp, Mus musculus
gatcgcccaaacgtctaacagattt

SEQ ID NO: 508394 - DNA, 25 bp, Mus musculus
gatcgcccatgccaatttagaatga

SEQ ID NO: 508395 - DNA, 25 bp, Mus musculus
gatcgcccatgcgaatttagaatga

SEQ ID NO: 508396 - DNA, 25 bp, Mus musculus
gatcgccctgctaagaggaactcag

SEQ ID NO: 508397 - DNA, 25 bp, Mus musculus
gatcgccctgcttagaggaactcag

SEQ ID NO: 508398 - DNA, 25 bp, Mus musculus
gatcgcccttagagagcacctcaaa

SEQ ID NO: 508399 - DNA, 25 bp, Mus musculus
gatcgcccttagtgagcacctcaaa

SEQ ID NO: 508400 - DNA, 25 bp, Mus musculus
gatcgccctttgaaagtcaatagca

SEQ ID NO: 508401 - DNA, 25 bp, Mus musculus
gatcgccctttgatattttctgatt

SEQ ID NO: 508402 - DNA, 25 bp, Mus musculus
gatcgccctttgtaagtcaatagca

SEQ ID NO: 508403 - DNA, 25 bp, Mus musculus
gatcgccctttgttattttctgatt

SEQ ID NO: 508404 - DNA, 25 bp, Mus musculus
gatcgccgatgccctggccagtgct

SEQ ID NO: 508405 - DNA, 25 bp, Mus musculus
gatcgccgatgcgctggccagtgct

SEQ ID NO: 508406 - DNA, 25 bp, Mus musculus
gatcgccgattcataaagtttcaca

SEQ ID NO: 508407 - DNA, 25 bp, Mus musculus
gatcgccgattcttaaagtttcaca

SEQ ID NO: 508408 - DNA, 25 bp, Mus musculus
gatcgccgctggaggattcctgaaa

SEQ ID NO: 508409 - DNA, 25 bp, Mus musculus
gatcgccgctggtggattcctgaaa

SEQ ID NO: 508410 - DNA, 25 bp, Mus musculus
gatcgcctacctctggtctgaagta

SEQ ID NO: 508411 - DNA, 25 bp, Mus musculus
gatcgcctacctgtggtctgaagta

SEQ ID NO: 508412 - DNA, 25 bp, Mus musculus
gatcgcgacttcagtgtatggagcc

SEQ ID NO: 508413 - DNA, 25 bp, Mus musculus
gatcgcgacttctgtgtatggagcc

SEQ ID NO: 508414 - DNA, 25 bp, Mus musculus
gatcgcgcataaattatggtgccct

SEQ ID NO: 508415 - DNA, 25 bp, Mus musculus
gatcgcgcataatttatggtgccct

SEQ ID NO: 508416 - DNA, 25 bp, Mus musculus
gatcgcgctctaccataggccttgt

SEQ ID NO: 508417 - DNA, 25 bp, Mus musculus
gatcgcgctctagcataggccttgt

SEQ ID NO: 508418 - DNA, 25 bp, Mus musculus
gatcgcgggcgcagggcagggcagg

SEQ ID NO: 508419 - DNA, 25 bp, Mus musculus
gatcgcgggcgctgggcagggcagg

SEQ ID NO: 508420 - DNA, 25 bp, Mus musculus
gatcgctaagctagatgacttcttg

SEQ ID NO: 508421 - DNA, 25 bp, Mus musculus
gatcgctaagcttgatgacttcttg

SEQ ID NO: 508422 - DNA, 25 bp, Mus musculus
gatcgctagcacagtaactctggca

SEQ ID NO: 508423 - DNA, 25 bp, Mus musculus
gatcgctagcactgtaactctggca

SEQ ID NO: 508424 - DNA, 25 bp, Mus musculus
gatcgctgactcagtaaaggttctg

SEQ ID NO: 508425 - DNA, 25 bp, Mus musculus
gatcgctgactctgtaaaggttctg

SEQ ID NO: 508426 - DNA, 25 bp, Mus musculus
gatcgctgacttcctttgcttggga

SEQ ID NO: 508427 - DNA, 25 bp, Mus musculus
gatcgctgacttgctttgcttggga

SEQ ID NO: 508428 - DNA, 25 bp, Mus musculus
gatcgctgagaacgttttctattgt

SEQ ID NO: 508429 - DNA, 25 bp, Mus musculus
gatcgctgagaaggttttctattgt

SEQ ID NO: 508430 - DNA, 25 bp, Mus musculus
gatcgctgcgagaatgtttacccaa

SEQ ID NO: 508431 - DNA, 25 bp, Mus musculus
gatcgctgcgagtatgtttacccaa

SEQ ID NO: 508432 - DNA, 25 bp, Mus musculus
gatcgctgcttacacaaggcaccta

SEQ ID NO: 508433 - DNA, 25 bp, Mus musculus
gatcgctgcttagacaaggcaccta

SEQ ID NO: 508434 - DNA, 25 bp, Mus musculus
gatcgctggagtcttggtttgacta

SEQ ID NO: 508435 - DNA, 25 bp, Mus musculus
gatcgctggagtgttggtttgacta

SEQ ID NO: 508436 - DNA, 25 bp, Mus musculus
gatcgctggccccatgatctttgct

SEQ ID NO: 508437 - DNA, 25 bp, Mus musculus
gatcgctggcccgatgatctttgct

SEQ ID NO: 508438 - DNA, 25 bp, Mus musculus
gatcgctggctgacggagaactgca

SEQ ID NO: 508439 - DNA, 25 bp, Mus musculus
gatcgctggctgtcggagaactgca

SEQ ID NO: 508440 - DNA, 25 bp, Mus musculus
gatcgctgtattctgtactggctct

SEQ ID NO: 508441 - DNA, 25 bp, Mus musculus
gatcgctgtattgtgtactggctct

SEQ ID NO: 508442 - DNA, 25 bp, Mus musculus
gatcgctgtggtacttattatcaaa

SEQ ID NO: 508443 - DNA, 25 bp, Mus musculus
gatcgctgtggttcttattatcaaa

SEQ ID NO: 508444 - DNA, 25 bp, Mus musculus
gatcgcttcaacagaacatccttgg

SEQ ID NO: 508445 - DNA, 25 bp, Mus musculus
gatcgcttcaactgaacatccttgg

SEQ ID NO: 508446 - DNA, 25 bp, Mus musculus
gatcgctttaagacttcagctaggg

SEQ ID NO: 508447 - DNA, 25 bp, Mus musculus
gatcgctttaagtcttcagctaggg

SEQ ID NO: 508448 - DNA, 25 bp, Mus musculus
gatcgctttcctaacatgcctacag

SEQ ID NO: 508449 - DNA, 25 bp, Mus musculus
gatcgctttcctcaaaggttaccct

SEQ ID NO: 508450 - DNA, 25 bp, Mus musculus
gatcgctttcctgaaaggttaccct

SEQ ID NO: 508451 - DNA, 25 bp, Mus musculus
gatcgctttccttacatgcctacag

SEQ ID NO: 508452 - DNA, 25 bp, Mus musculus
gatcgctttgtcacatttattaaac

SEQ ID NO: 508453 - DNA, 25 bp, Mus musculus
gatcgctttgtctcatttattaaac

SEQ ID NO: 508454 - DNA, 25 bp, Mus musculus
gatcggaaaagaaacccagagcctt

SEQ ID NO: 508455 - DNA, 25 bp, Mus musculus
gatcggaaaagatacccagagcctt

SEQ ID NO: 508456 - DNA, 25 bp, Mus musculus
gatcggaacctaccatttcagcaaa

SEQ ID NO: 508457 - DNA, 25 bp, Mus musculus
gatcggaacctagcatttcagcaaa

SEQ ID NO: 508458 - DNA, 25 bp, Mus musculus
gatcggaattctacagggacactac

SEQ ID NO: 508459 - DNA, 25 bp, Mus musculus
gatcggaattcttcagggacactac

SEQ ID NO: 508460 - DNA, 25 bp, Mus musculus
gatcggaccaagattagcagtgtta

SEQ ID NO: 508461 - DNA, 25 bp, Mus musculus
gatcggaccaagtttagcagtgtta

SEQ ID NO: 508462 - DNA, 25 bp, Mus musculus
gatcggactagcagcttgccagaaa

SEQ ID NO: 508463 - DNA, 25 bp, Mus musculus
gatcggactagctgcttgccagaaa

SEQ ID NO: 508464 - DNA, 25 bp, Mus musculus
gatcggagacgtattcatcagccac

SEQ ID NO: 508465 - DNA, 25 bp, Mus musculus
gatcggagacgttttcatcagccac

SEQ ID NO: 508466 - DNA, 25 bp, Mus musculus
gatcggagacttaggccttgcaaca

SEQ ID NO: 508467 - DNA, 25 bp, Mus musculus
gatcggagactttggccttgcaaca

SEQ ID NO: 508468 - DNA, 25 bp, Mus musculus
gatcggagctgaatcctgtggctgc

SEQ ID NO: 508469 - DNA, 25 bp, Mus musculus
gatcggagctgattcctgtggctgc

SEQ ID NO: 508470 - DNA, 25 bp, Mus musculus
gatcggagtccgatgcaaaaggtta

SEQ ID NO: 508471 - DNA, 25 bp, Mus musculus
gatcggagtccgttgcaaaaggtta

SEQ ID NO: 508472 - DNA, 25 bp, Mus musculus
gatcggatgaagaaccagaaccaga

SEQ ID NO: 508473 - DNA, 25 bp, Mus musculus
gatcggatgaagtaccagaaccaga

SEQ ID NO: 508474 - DNA, 25 bp, Mus musculus
gatcggattaggaactagcagagtt

SEQ ID NO: 508475 - DNA, 25 bp, Mus musculus
gatcggattaggtactagcagagtt

SEQ ID NO: 508476 - DNA, 25 bp, Mus musculus
gatcggattcccaccaaagaacaat

SEQ ID NO: 508477 - DNA, 25 bp, Mus musculus
gatcggattcccattcttggtatga

SEQ ID NO: 508478 - DNA, 25 bp, Mus musculus
gatcggattccctccaaagaacaat

SEQ ID NO: 508479 - DNA, 25 bp, Mus musculus
gatcggattccctttcttggtatga

SEQ ID NO: 508480 - DNA, 25 bp, Mus musculus
gatcggattggtatgatttcttgtt

SEQ ID NO: 508481 - DNA, 25 bp, Mus musculus
gatcggattggtttgatttcttgtt

SEQ ID NO: 508482 - DNA, 25 bp, Mus musculus
gatcggcaggttaccatcactggat

SEQ ID NO: 508483 - DNA, 25 bp, Mus musculus
gatcggcaggtttccatcactggat

SEQ ID NO: 508484 - DNA, 25 bp, Mus musculus
gatcggcagtcgacactcacttgaa

SEQ ID NO: 508485 - DNA, 25 bp, Mus musculus
gatcggcagtcgtcactcacttgaa

SEQ ID NO: 508486 - DNA, 25 bp, Mus musculus
gatcggcatacccaatgttgccgtt

SEQ ID NO: 508487 - DNA, 25 bp, Mus musculus
gatcggcataccgaatgttgccgtt

SEQ ID NO: 508488 - DNA, 25 bp, Mus musculus
gatcggcattgccaggccctctaag

SEQ ID NO: 508489 - DNA, 25 bp, Mus musculus
gatcggcattgcgaggccctctaag

SEQ ID NO: 508490 - DNA, 25 bp, Mus musculus
gatcggccagttccaagtttctctt

SEQ ID NO: 508491 - DNA, 25 bp, Mus musculus
gatcggccagttgcaagtttctctt

SEQ ID NO: 508492 - DNA, 25 bp, Mus musculus
gatcggcctagaactggcatttgac

SEQ ID NO: 508493 - DNA, 25 bp, Mus musculus
gatcggcctagatctggcatttgac

SEQ ID NO: 508494 - DNA, 25 bp, Mus musculus
gatcggcgcttgaattcgcctggag

SEQ ID NO: 508495 - DNA, 25 bp, Mus musculus
gatcggcgcttgtattcgcctggag

SEQ ID NO: 508496 - DNA, 25 bp, Mus musculus
gatcggctccgtcaccgagtccctg

SEQ ID NO: 508497 - DNA, 25 bp, Mus musculus
gatcggctccgtgaccgagtccctg

SEQ ID NO: 508498 - DNA, 25 bp, Mus musculus
gatcggctgcacagaactgcaccag

SEQ ID NO: 508499 - DNA, 25 bp, Mus musculus
gatcggctgcactgaactgcaccag

SEQ ID NO: 508500 - DNA, 25 bp, Mus musculus
gatcggctgtgacaacgacgaatgc

SEQ ID NO: 508501 - DNA, 25 bp, Mus musculus
gatcggctgtgacaatccagattgt

SEQ ID NO: 508502 - DNA, 25 bp, Mus musculus
gatcggctgtgagaacgacgaatgc

SEQ ID NO: 508503 - DNA, 25 bp, Mus musculus
gatcggctgtgagaatccagattgt

SEQ ID NO: 508504 - DNA, 25 bp, Mus musculus
gatcgggagccaccacagttatgat

SEQ ID NO: 508505 - DNA, 25 bp, Mus musculus
gatcgggagccagcacagttatgat

SEQ ID NO: 508506 - DNA, 25 bp, Mus musculus
gatcgggcagttaacggtcacttag

SEQ ID NO: 508507 - DNA, 25 bp, Mus musculus
gatcgggcagtttacggtcacttag

SEQ ID NO: 508508 - DNA, 25 bp, Mus musculus
gatcgggccagcctgcagaaagtat

SEQ ID NO: 508509 - DNA, 25 bp, Mus musculus
gatcgggccagcgtgcagaaagtat

SEQ ID NO: 508510 - DNA, 25 bp, Mus musculus
gatcgggctgcacgaaaacctgttt

SEQ ID NO: 508511 - DNA, 25 bp, Mus musculus
gatcgggctgcaggaaaacctgttt

SEQ ID NO: 508512 - DNA, 25 bp, Mus musculus
gatcgggtgttcagcaggcagccct

SEQ ID NO: 508513 - DNA, 25 bp, Mus musculus
gatcgggtgttctgcaggcagccct

SEQ ID NO: 508514 - DNA, 25 bp, Mus musculus
gatcgggttactaatggcttgaagc

SEQ ID NO: 508515 - DNA, 25 bp, Mus musculus
gatcgggttacttatggcttgaagc

SEQ ID NO: 508516 - DNA, 25 bp, Mus musculus
gatcgggttattcggaacttcctga

SEQ ID NO: 508517 - DNA, 25 bp, Mus musculus
gatcgggttattgggaacttcctga

SEQ ID NO: 508518 - DNA, 25 bp, Mus musculus
gatcgggttggaaagctaattcagc

SEQ ID NO: 508519 - DNA, 25 bp, Mus musculus
gatcgggttggatagctaattcagc

SEQ ID NO: 508520 - DNA, 25 bp, Mus musculus
gatcggtcacacaattgcaggagca

SEQ ID NO: 508521 - DNA, 25 bp, Mus musculus
gatcggtcacactattgcaggagca

SEQ ID NO: 508522 - DNA, 25 bp, Mus musculus
gatcggtcggtactcttctgtgaaa

SEQ ID NO: 508523 - DNA, 25 bp, Mus musculus
gatcggtcggtagtcttctgtgaaa

SEQ ID NO: 508524 - DNA, 25 bp, Mus musculus
gatcggtgtcagaacctgggacaga

SEQ ID NO: 508525 - DNA, 25 bp, Mus musculus
gatcggtgtcagtacctgggacaga

SEQ ID NO: 508526 - DNA, 25 bp, Mus musculus
gatcggttaagtctttgagtggttt

SEQ ID NO: 508527 - DNA, 25 bp, Mus musculus
gatcggttaagtgtttgagtggttt

SEQ ID NO: 508528 - DNA, 25 bp, Mus musculus
gatcggtttaaactgcttggactgc

SEQ ID NO: 508529 - DNA, 25 bp, Mus musculus
gatcggtttaaagtgcttggactgc

SEQ ID NO: 508530 - DNA, 25 bp, Mus musculus
gatcgtaaactacttgagcttttgt

SEQ ID NO: 508531 - DNA, 25 bp, Mus musculus
gatcgtaaactagttgagcttttgt

SEQ ID NO: 508532 - DNA, 25 bp, Mus musculus
gatcgtaaatgtacattgcctccta

SEQ ID NO: 508533 - DNA, 25 bp, Mus musculus
gatcgtaaatgttcattgcctccta

SEQ ID NO: 508534 - DNA, 25 bp, Mus musculus
gatcgtacctccatcataggaactg

SEQ ID NO: 508535 - DNA, 25 bp, Mus musculus
gatcgtacctccttcataggaactg

SEQ ID NO: 508536 - DNA, 25 bp, Mus musculus
gatcgtagactaagcagagcctgta

SEQ ID NO: 508537 - DNA, 25 bp, Mus musculus
gatcgtagactatgcagagcctgta

SEQ ID NO: 508538 - DNA, 25 bp, Mus musculus
gatcgtagagctagctcacagcggg

SEQ ID NO: 508539 - DNA, 25 bp, Mus musculus
gatcgtagagcttgctcacagcggg

SEQ ID NO: 508540 - DNA, 25 bp, Mus musculus
gatcgtagctagctttgagtgccaa

SEQ ID NO: 508541 - DNA, 25 bp, Mus musculus
gatcgtagctaggtttgagtgccaa

SEQ ID NO: 508542 - DNA, 25 bp, Mus musculus
gatcgtcaaatcacggtttgccatc

SEQ ID NO: 508543 - DNA, 25 bp, Mus musculus
gatcgtcaaatctcggtttgccatc

SEQ ID NO: 508544 - DNA, 25 bp, Mus musculus
gatcgtcagagtaaccttgtcatgt

SEQ ID NO: 508545 - DNA, 25 bp, Mus musculus
gatcgtcagagttaccttgtcatgt

SEQ ID NO: 508546 - DNA, 25 bp, Mus musculus
gatcgtcagcacagaactcatctga

SEQ ID NO: 508547 - DNA, 25 bp, Mus musculus
gatcgtcagcactgaactcatctga

SEQ ID NO: 508548 - DNA, 25 bp, Mus musculus
gatcgtcatcctctctccagacaga

SEQ ID NO: 508549 - DNA, 25 bp, Mus musculus
gatcgtcatcctgtctccagacaga

SEQ ID NO: 508550 - DNA, 25 bp, Mus musculus
gatcgtcatggcaatcttcaaaatg

SEQ ID NO: 508551 - DNA, 25 bp, Mus musculus
gatcgtcatggctatcttcaaaatg

SEQ ID NO: 508552 - DNA, 25 bp, Mus musculus
gatcgtcattctattgataagtatg

SEQ ID NO: 508553 - DNA, 25 bp, Mus musculus
gatcgtcattcttttgataagtatg

SEQ ID NO: 508554 - DNA, 25 bp, Mus musculus
gatcgtcattgaccttcaggagtta

SEQ ID NO: 508555 - DNA, 25 bp, Mus musculus
gatcgtcattgagcttcaggagtta

SEQ ID NO: 508556 - DNA, 25 bp, Mus musculus
gatcgtccagcccttctctgtgtgg

SEQ ID NO: 508557 - DNA, 25 bp, Mus musculus
gatcgtccagccgttctctgtgtgg

SEQ ID NO: 508558 - DNA, 25 bp, Mus musculus
gatcgtccccatcttccaagaaagg

SEQ ID NO: 508559 - DNA, 25 bp, Mus musculus
gatcgtccccatgttccaagaaagg

SEQ ID NO: 508560 - DNA, 25 bp, Mus musculus
gatcgtcccgaaaactgtgttgtgt

SEQ ID NO: 508561 - DNA, 25 bp, Mus musculus
gatcgtcccgaatactgtgttgtgt

SEQ ID NO: 508562 - DNA, 25 bp, Mus musculus
gatcgtccttagattgtcagctcca

SEQ ID NO: 508563 - DNA, 25 bp, Mus musculus
gatcgtccttagtttgtcagctcca

SEQ ID NO: 508564 - DNA, 25 bp, Mus musculus
gatcgtcctttactcagcttctgtg

SEQ ID NO: 508565 - DNA, 25 bp, Mus musculus
gatcgtcctttagtcagcttctgtg

SEQ ID NO: 508566 - DNA, 25 bp, Mus musculus
gatcgtcgtcgtcgaccaatgaaaa

SEQ ID NO: 508567 - DNA, 25 bp, Mus musculus
gatcgtcgtcgtggaccaatgaaaa

SEQ ID NO: 508568 - DNA, 25 bp, Mus musculus
gatcgtcgtgatctgagagacctga

SEQ ID NO: 508569 - DNA, 25 bp, Mus musculus
gatcgtcgtgatgtgagagacctga

SEQ ID NO: 508570 - DNA, 25 bp, Mus musculus
gatcgtctacggatgtttcgcggtt

SEQ ID NO: 508571 - DNA, 25 bp, Mus musculus
gatcgtctacggttgtttcgcggtt

SEQ ID NO: 508572 - DNA, 25 bp, Mus musculus
gatcgtctctggacaacttacaggg

SEQ ID NO: 508573 - DNA, 25 bp, Mus musculus
gatcgtctctggtcaacttacaggg

SEQ ID NO: 508574 - DNA, 25 bp, Mus musculus
gatcgtctgtgcattcaccatatta

SEQ ID NO: 508575 - DNA, 25 bp, Mus musculus
gatcgtctgtgctttcaccatatta

SEQ ID NO: 508576 - DNA, 25 bp, Mus musculus
gatcgtgaatgtctagcaccggctt

SEQ ID NO: 508577 - DNA, 25 bp, Mus musculus
gatcgtgaatgtgtagcaccggctt

SEQ ID NO: 508578 - DNA, 25 bp, Mus musculus
gatcgtgacaccacttgagttgaat

SEQ ID NO: 508579 - DNA, 25 bp, Mus musculus
gatcgtgacacctcttgagttgaat

SEQ ID NO: 508580 - DNA, 25 bp, Mus musculus
gatcgtgacggaagagggccacctc

SEQ ID NO: 508581 - DNA, 25 bp, Mus musculus
gatcgtgacggatgagggccacctc

SEQ ID NO: 508582 - DNA, 25 bp, Mus musculus
gatcgtgagcttccagcacttgaga

SEQ ID NO: 508583 - DNA, 25 bp, Mus musculus
gatcgtgagcttgcagcacttgaga

SEQ ID NO: 508584 - DNA, 25 bp, Mus musculus
gatcgtgatgacaacttctaagcca

SEQ ID NO: 508585 - DNA, 25 bp, Mus musculus
gatcgtgatgactacttctaagcca

SEQ ID NO: 508586 - DNA, 25 bp, Mus musculus
gatcgtgcaaagattggttctgctt

SEQ ID NO: 508587 - DNA, 25 bp, Mus musculus
gatcgtgcaaagtttggttctgctt

SEQ ID NO: 508588 - DNA, 25 bp, Mus musculus
gatcgtgcaacacaaccttgcatgg

SEQ ID NO: 508589 - DNA, 25 bp, Mus musculus
gatcgtgcaacagaaccttgcatgg

SEQ ID NO: 508590 - DNA, 25 bp, Mus musculus
gatcgtgccaccaaacagaagaact

SEQ ID NO: 508591 - DNA, 25 bp, Mus musculus
gatcgtgccacctaacagaagaact

SEQ ID NO: 508592 - DNA, 25 bp, Mus musculus
gatcgtgcccaaaaaattttgtgaa

SEQ ID NO: 508593 - DNA, 25 bp, Mus musculus
gatcgtgcccaataaattttgtgaa

SEQ ID NO: 508594 - DNA, 25 bp, Mus musculus
gatcgtgcgcatcggcaccgcagtt

SEQ ID NO: 508595 - DNA, 25 bp, Mus musculus
gatcgtgcgcatgggcaccgcagtt

SEQ ID NO: 508596 - DNA, 25 bp, Mus musculus
gatcgtgcgtttcacatttgttaca

SEQ ID NO: 508597 - DNA, 25 bp, Mus musculus
gatcgtgcgtttgacatttgttaca

SEQ ID NO: 508598 - DNA, 25 bp, Mus musculus
gatcgtggaaaaagtctcgggctct

SEQ ID NO: 508599 - DNA, 25 bp, Mus musculus
gatcgtggaaaatgtctcgggctct

SEQ ID NO: 508600 - DNA, 25 bp, Mus musculus
gatcgtggaccgcaagtacagcatc

SEQ ID NO: 508601 - DNA, 25 bp, Mus musculus
gatcgtggaccggaagtacagcatc

SEQ ID NO: 508602 - DNA, 25 bp, Mus musculus
gatcgtggttgtagctggagccttc

SEQ ID NO: 508603 - DNA, 25 bp, Mus musculus
gatcgtggttgttgctggagccttc

SEQ ID NO: 508604 - DNA, 25 bp, Mus musculus
gatcgtgtaaaacaggtctcatcaa

SEQ ID NO: 508605 - DNA, 25 bp, Mus musculus
gatcgtgtaaaagaggtctcatcaa

SEQ ID NO: 508606 - DNA, 25 bp, Mus musculus
gatcgtgtactgaaggaatccttct

SEQ ID NO: 508607 - DNA, 25 bp, Mus musculus
gatcgtgtactgtaggaatccttct

SEQ ID NO: 508608 - DNA, 25 bp, Mus musculus
gatcgtgtccacctttgcaagatag

SEQ ID NO: 508609 - DNA, 25 bp, Mus musculus
gatcgtgtccacgtttgcaagatag

SEQ ID NO: 508610 - DNA, 25 bp, Mus musculus
gatcgtgttttaaggtctctgtgaa

SEQ ID NO: 508611 - DNA, 25 bp, Mus musculus
gatcgtgttttatggtctctgtgaa

SEQ ID NO: 508612 - DNA, 25 bp, Mus musculus
gatcgttaacttaatcctgatttaa

SEQ ID NO: 508613 - DNA, 25 bp, Mus musculus
gatcgttaactttatcctgatttaa

SEQ ID NO: 508614 - DNA, 25 bp, Mus musculus
gatcgttcacgtatcctttaacaga

SEQ ID NO: 508615 - DNA, 25 bp, Mus musculus
gatcgttcacgtttcctttaacaga

SEQ ID NO: 508616 - DNA, 25 bp, Mus musculus
gatcgttccgggacagggagcctca

SEQ ID NO: 508617 - DNA, 25 bp, Mus musculus
gatcgttccgggtcagggagcctca

SEQ ID NO: 508618 - DNA, 25 bp, Mus musculus
gatcgttcctctcactgtcagagag

SEQ ID NO: 508619 - DNA, 25 bp, Mus musculus
gatcgttcctctgactgtcagagag

SEQ ID NO: 508620 - DNA, 25 bp, Mus musculus
gatcgttcctttagtactgcggtta

SEQ ID NO: 508621 - DNA, 25 bp, Mus musculus
gatcgttccttttgtactgcggtta

SEQ ID NO: 508622 - DNA, 25 bp, Mus musculus
gatcgttctcctagactttttctta

SEQ ID NO: 508623 - DNA, 25 bp, Mus musculus
gatcgttctccttgactttttctta

SEQ ID NO: 508624 - DNA, 25 bp, Mus musculus
gatcgttcttacagaacttcgcagg

SEQ ID NO: 508625 - DNA, 25 bp, Mus musculus
gatcgttcttactgaacttcgcagg

SEQ ID NO: 508626 - DNA, 25 bp, Mus musculus
gatcgttcttgaaatgtgcaagttg

SEQ ID NO: 508627 - DNA, 25 bp, Mus musculus
gatcgttcttgatatgtgcaagttg

SEQ ID NO: 508628 - DNA, 25 bp, Mus musculus
gatcgttctttgactgttgactgct

SEQ ID NO: 508629 - DNA, 25 bp, Mus musculus
gatcgttctttgtctgttgactgct

SEQ ID NO: 508630 - DNA, 25 bp, Mus musculus
gatcgttgccaaatgacgttctgga

SEQ ID NO: 508631 - DNA, 25 bp, Mus musculus
gatcgttgccaattgacgttctgga

SEQ ID NO: 508632 - DNA, 25 bp, Mus musculus
gatcgttgctgtactgggtgtcctt

SEQ ID NO: 508633 - DNA, 25 bp, Mus musculus
gatcgttgctgttctgggtgtcctt

SEQ ID NO: 508634 - DNA, 25 bp, Mus musculus
gatcgttggcttactgagtactgga

SEQ ID NO: 508635 - DNA, 25 bp, Mus musculus
gatcgttggctttctgagtactgga

SEQ ID NO: 508636 - DNA, 25 bp, Mus musculus
gatcgttgtgccaagatctccagtt

SEQ ID NO: 508637 - DNA, 25 bp, Mus musculus
gatcgttgtgcctagatctccagtt

SEQ ID NO: 508638 - DNA, 25 bp, Mus musculus
gatcgtttagttagcatcattttcc

SEQ ID NO: 508639 - DNA, 25 bp, Mus musculus
gatcgtttagtttgcatcattttcc

SEQ ID NO: 508640 - DNA, 25 bp, Mus musculus
gatcgttttaatagtctgttctctc

SEQ ID NO: 508641 - DNA, 25 bp, Mus musculus
gatcgttttaattgtctgttctctc

SEQ ID NO: 508642 - DNA, 25 bp, Mus musculus
gatcgttttgagacttcaggaccat

SEQ ID NO: 508643 - DNA, 25 bp, Mus musculus
gatcgttttgagtcttcaggaccat

SEQ ID NO: 508644 - DNA, 25 bp, Mus musculus
gatctaaaaaccacttgccacaaaa

SEQ ID NO: 508645 - DNA, 25 bp, Mus musculus
gatctaaaaacctcttgccacaaaa

SEQ ID NO: 508646 - DNA, 25 bp, Mus musculus
gatctaaacttgctcctggagagag

SEQ ID NO: 508647 - DNA, 25 bp, Mus musculus
gatctaaacttggtcctggagagag

SEQ ID NO: 508648 - DNA, 25 bp, Mus musculus
gatctaaaggccctggatttgccct

SEQ ID NO: 508649 - DNA, 25 bp, Mus musculus
gatctaaaggccgtggatttgccct

SEQ ID NO: 508650 - DNA, 25 bp, Mus musculus
gatctaaagggtagtgtcccctgcc

SEQ ID NO: 508651 - DNA, 25 bp, Mus musculus
gatctaaagggttgtgtcccctgcc

SEQ ID NO: 508652 - DNA, 25 bp, Mus musculus
gatctaaataaaatgctaggttcta

SEQ ID NO: 508653 - DNA, 25 bp, Mus musculus
gatctaaataaattgctaggttcta

SEQ ID NO: 508654 - DNA, 25 bp, Mus musculus
gatctaaatcctacattctcattaa

SEQ ID NO: 508655 - DNA, 25 bp, Mus musculus
gatctaaatccttcattctcattaa

SEQ ID NO: 508656 - DNA, 25 bp, Mus musculus
gatctaaatctcaggcgttggaatt

SEQ ID NO: 508657 - DNA, 25 bp, Mus musculus
gatctaaatctctggcgttggaatt

SEQ ID NO: 508658 - DNA, 25 bp, Mus musculus
gatctaaatctgaaagcctggcttc

SEQ ID NO: 508659 - DNA, 25 bp, Mus musculus
gatctaaatctgtaagcctggcttc

SEQ ID NO: 508660 - DNA, 25 bp, Mus musculus
gatctaaatgctcggactgctcttt

SEQ ID NO: 508661 - DNA, 25 bp, Mus musculus
gatctaaatgctgggactgctcttt

SEQ ID NO: 508662 - DNA, 25 bp, Mus musculus
gatctaaatggaaatcctgtttgtc

SEQ ID NO: 508663 - DNA, 25 bp, Mus musculus
gatctaaatggatatcctgtttgtc

SEQ ID NO: 508664 - DNA, 25 bp, Mus musculus
gatctaaattcacaagtgcacacac

SEQ ID NO: 508665 - DNA, 25 bp, Mus musculus
gatctaaattcagaagtgcacacac

SEQ ID NO: 508666 - DNA, 25 bp, Mus musculus
gatctaaatttaactacaccccgaa

SEQ ID NO: 508667 - DNA, 25 bp, Mus musculus
gatctaaatttatctacaccccgaa

SEQ ID NO: 508668 - DNA, 25 bp, Mus musculus
gatctaacatcccagcttcacataa

SEQ ID NO: 508669 - DNA, 25 bp, Mus musculus
gatctaacatccgagcttcacataa

SEQ ID NO: 508670 - DNA, 25 bp, Mus musculus
gatctaacccagaattagtgatgta

SEQ ID NO: 508671 - DNA, 25 bp, Mus musculus
gatctaacccagcagggaagctcct

SEQ ID NO: 508672 - DNA, 25 bp, Mus musculus
gatctaacccaggagggaagctcct

SEQ ID NO: 508673 - DNA, 25 bp, Mus musculus
gatctaacccagtattagtgatgta

SEQ ID NO: 508674 - DNA, 25 bp, Mus musculus
gatctaacgtcaactaactccagga

SEQ ID NO: 508675 - DNA, 25 bp, Mus musculus
gatctaacgtcatctaactccagga

SEQ ID NO: 508676 - DNA, 25 bp, Mus musculus
gatctaagaaatcctatgatgttgg

SEQ ID NO: 508677 - DNA, 25 bp, Mus musculus
gatctaagaaatgctatgatgttgg

SEQ ID NO: 508678 - DNA, 25 bp, Mus musculus
gatctaagaagcaagtctcctgggt

SEQ ID NO: 508679 - DNA, 25 bp, Mus musculus
gatctaagaagctagtctcctgggt

SEQ ID NO: 508680 - DNA, 25 bp, Mus musculus
gatctaagacttccaacctgctcaa

SEQ ID NO: 508681 - DNA, 25 bp, Mus musculus
gatctaagacttgcaacctgctcaa

SEQ ID NO: 508682 - DNA, 25 bp, Mus musculus
gatctaagtcataggaggctagcta

SEQ ID NO: 508683 - DNA, 25 bp, Mus musculus
gatctaagtcattggaggctagcta

SEQ ID NO: 508684 - DNA, 25 bp, Mus musculus
gatctaagtgtactagttacctcag

SEQ ID NO: 508685 - DNA, 25 bp, Mus musculus
gatctaagtgtagtagttacctcag

SEQ ID NO: 508686 - DNA, 25 bp, Mus musculus
gatctaataggccattctgtgtcat

SEQ ID NO: 508687 - DNA, 25 bp, Mus musculus
gatctaataggcgattctgtgtcat

SEQ ID NO: 508688 - DNA, 25 bp, Mus musculus
gatctaatcaagaattccacagcct

SEQ ID NO: 508689 - DNA, 25 bp, Mus musculus
gatctaatcaagtattccacagcct

SEQ ID NO: 508690 - DNA, 25 bp, Mus musculus
gatctaatctttacacaggtgtgct

SEQ ID NO: 508691 - DNA, 25 bp, Mus musculus
gatctaatcttttcacaggtgtgct

SEQ ID NO: 508692 - DNA, 25 bp, Mus musculus
gatctaatgatcagctgtgaggcgt

SEQ ID NO: 508693 - DNA, 25 bp, Mus musculus
gatctaatgatctgctgtgaggcgt

SEQ ID NO: 508694 - DNA, 25 bp, Mus musculus
gatctaatgctaatttctggcttct

SEQ ID NO: 508695 - DNA, 25 bp, Mus musculus
gatctaatgctattttctggcttct

SEQ ID NO: 508696 - DNA, 25 bp, Mus musculus
gatctaatgtaaatcttctccttaa

SEQ ID NO: 508697 - DNA, 25 bp, Mus musculus
gatctaatgtaattcttctccttaa

SEQ ID NO: 508698 - DNA, 25 bp, Mus musculus
gatctaattgacaggttgcttttct

SEQ ID NO: 508699 - DNA, 25 bp, Mus musculus
gatctaattgactggttgcttttct

SEQ ID NO: 508700 - DNA, 25 bp, Mus musculus
gatctaatttgcaaaagctacttta

SEQ ID NO: 508701 - DNA, 25 bp, Mus musculus
gatctaatttgctaaagctacttta

SEQ ID NO: 508702 - DNA, 25 bp, Mus musculus
gatctacaaagtatccaaccgattt

SEQ ID NO: 508703 - DNA, 25 bp, Mus musculus
gatctacaaagtttccaaccgattt

SEQ ID NO: 508704 - DNA, 25 bp, Mus musculus
gatctacaaatcaccttgcatcata

SEQ ID NO: 508705 - DNA, 25 bp, Mus musculus
gatctacaaatctccttgcatcata

SEQ ID NO: 508706 - DNA, 25 bp, Mus musculus
gatctacaagaaccaaaaatgcctc

SEQ ID NO: 508707 - DNA, 25 bp, Mus musculus
gatctacaagaagcaaaaatgcctc

SEQ ID NO: 508708 - DNA, 25 bp, Mus musculus
gatctacaagacacgagccccgcag

SEQ ID NO: 508709 - DNA, 25 bp, Mus musculus
gatctacaagactcgagccccgcag

SEQ ID NO: 508710 - DNA, 25 bp, Mus musculus
gatctacaagtccaatctcggcgtg

SEQ ID NO: 508711 - DNA, 25 bp, Mus musculus
gatctacaagtcgaatctcggcgtg

SEQ ID NO: 508712 - DNA, 25 bp, Mus musculus
gatctacaatcaagcttgacctttt

SEQ ID NO: 508713 - DNA, 25 bp, Mus musculus
gatctacaatcatgcttgacctttt

SEQ ID NO: 508714 - DNA, 25 bp, Mus musculus
gatctacaatgaagctctgaaataa

SEQ ID NO: 508715 - DNA, 25 bp, Mus musculus
gatctacaatgatgctctgaaataa

SEQ ID NO: 508716 - DNA, 25 bp, Mus musculus
gatctacagagaagactgaacaatt

SEQ ID NO: 508717 - DNA, 25 bp, Mus musculus
gatctacagagatgactgaacaatt

SEQ ID NO: 508718 - DNA, 25 bp, Mus musculus
gatctacagcagcaggtttatggca

SEQ ID NO: 508719 - DNA, 25 bp, Mus musculus
gatctacagcaggaggtttatggca

SEQ ID NO: 508720 - DNA, 25 bp, Mus musculus
gatctacaggcacaatcccaggact

SEQ ID NO: 508721 - DNA, 25 bp, Mus musculus
gatctacaggcagaatcccaggact

SEQ ID NO: 508722 - DNA, 25 bp, Mus musculus
gatctacagtttaatcatctgcctt

SEQ ID NO: 508723 - DNA, 25 bp, Mus musculus
gatctacagttttatcatctgcctt

SEQ ID NO: 508724 - DNA, 25 bp, Mus musculus
gatctacatcaaagaccacgaggac

SEQ ID NO: 508725 - DNA, 25 bp, Mus musculus
gatctacatcaacattcccatgggt

SEQ ID NO: 508726 - DNA, 25 bp, Mus musculus
gatctacatcaagattcccatgggt

SEQ ID NO: 508727 - DNA, 25 bp, Mus musculus
gatctacatcaatgaccacgaggac

SEQ ID NO: 508728 - DNA, 25 bp, Mus musculus
gatctacattgaagacctaagccag

SEQ ID NO: 508729 - DNA, 25 bp, Mus musculus
gatctacattgatgacctaagccag

SEQ ID NO: 508730 - DNA, 25 bp, Mus musculus
gatctaccacagaaatttctctggc

SEQ ID NO: 508731 - DNA, 25 bp, Mus musculus
gatctaccacagctgtatggcctta

SEQ ID NO: 508732 - DNA, 25 bp, Mus musculus
gatctaccacaggtgtatggcctta

SEQ ID NO: 508733 - DNA, 25 bp, Mus musculus
gatctaccacagtaatttctctggc

SEQ ID NO: 508734 - DNA, 25 bp, Mus musculus
gatctaccacctctctgaaccgtag

SEQ ID NO: 508735 - DNA, 25 bp, Mus musculus
gatctaccacctgtctgaaccgtag

SEQ ID NO: 508736 - DNA, 25 bp, Mus musculus
gatctaccagcaatatacaactttc

SEQ ID NO: 508737 - DNA, 25 bp, Mus musculus
gatctaccagcattatacaactttc

SEQ ID NO: 508738 - DNA, 25 bp, Mus musculus
gatctaccatctcatcattggatac

SEQ ID NO: 508739 - DNA, 25 bp, Mus musculus
gatctaccatctgatcattggatac

SEQ ID NO: 508740 - DNA, 25 bp, Mus musculus
gatctacccagaacctagacatgga

SEQ ID NO: 508741 - DNA, 25 bp, Mus musculus
gatctacccagatcctagacatgga

SEQ ID NO: 508742 - DNA, 25 bp, Mus musculus
gatctacccgttcgtgtttgaaagc

SEQ ID NO: 508743 - DNA, 25 bp, Mus musculus
gatctacccgttggtgtttgaaagc

SEQ ID NO: 508744 - DNA, 25 bp, Mus musculus
gatctaccctagacatctggaataa

SEQ ID NO: 508745 - DNA, 25 bp, Mus musculus
gatctaccctagtcatctggaataa

SEQ ID NO: 508746 - DNA, 25 bp, Mus musculus
gatctaccctctagctgaagctgat

SEQ ID NO: 508747 - DNA, 25 bp, Mus musculus
gatctaccctcttgctgaagctgat

SEQ ID NO: 508748 - DNA, 25 bp, Mus musculus
gatctaccgccaattcatgtgggtt

SEQ ID NO: 508749 - DNA, 25 bp, Mus musculus
gatctaccgccatttcatgtgggtt

SEQ ID NO: 508750 - DNA, 25 bp, Mus musculus
gatctaccggaactgggcctctgga

SEQ ID NO: 508751 - DNA, 25 bp, Mus musculus
gatctaccggaagtgggcctctgga

SEQ ID NO: 508752 - DNA, 25 bp, Mus musculus
gatctactcagaaaccctgttgggc

SEQ ID NO: 508753 - DNA, 25 bp, Mus musculus
gatctactcagataccctgttgggc

SEQ ID NO: 508754 - DNA, 25 bp, Mus musculus
gatctactcggcaaacctagtgcgt

SEQ ID NO: 508755 - DNA, 25 bp, Mus musculus
gatctactcggctaacctagtgcgt

SEQ ID NO: 508756 - DNA, 25 bp, Mus musculus
gatctactgctgagccagtttctca

SEQ ID NO: 508757 - DNA, 25 bp, Mus musculus
gatctactgctgtgccagtttctca

SEQ ID NO: 508758 - DNA, 25 bp, Mus musculus
gatctactgtctatggcatcctgaa

SEQ ID NO: 508759 - DNA, 25 bp, Mus musculus
gatctactgtctttggcatcctgaa

SEQ ID NO: 508760 - DNA, 25 bp, Mus musculus
gatctacttacaccactgatccagt

SEQ ID NO: 508761 - DNA, 25 bp, Mus musculus
gatctacttacagcactgatccagt

SEQ ID NO: 508762 - DNA, 25 bp, Mus musculus
gatctacttcctacaacaggactga

SEQ ID NO: 508763 - DNA, 25 bp, Mus musculus
gatctacttccttcaacaggactga

SEQ ID NO: 508764 - DNA, 25 bp, Mus musculus
gatctacttggcactacttcaggaa

SEQ ID NO: 508765 - DNA, 25 bp, Mus musculus
gatctacttggctctacttcaggaa

SEQ ID NO: 508766 - DNA, 25 bp, Mus musculus
gatctactttatcagctattctttg

SEQ ID NO: 508767 - DNA, 25 bp, Mus musculus
gatctactttatgagctattctttg

SEQ ID NO: 508768 - DNA, 25 bp, Mus musculus
gatctactttgtctcttcaagattg

SEQ ID NO: 508769 - DNA, 25 bp, Mus musculus
gatctactttgtgtcttcaagattg

SEQ ID NO: 508770 - DNA, 25 bp, Mus musculus
gatctacttttgaaaaagaccatgg

SEQ ID NO: 508771 - DNA, 25 bp, Mus musculus
gatctacttttgtaaaagaccatgg

SEQ ID NO: 508772 - DNA, 25 bp, Mus musculus
gatctagaaccgagtgctcattgaa

SEQ ID NO: 508773 - DNA, 25 bp, Mus musculus
gatctagaaccgtgtgctcattgaa

SEQ ID NO: 508774 - DNA, 25 bp, Mus musculus
gatctagaagtcctttcatctctca

SEQ ID NO: 508775 - DNA, 25 bp, Mus musculus
gatctagaagtcgtttcatctctca

SEQ ID NO: 508776 - DNA, 25 bp, Mus musculus
gatctagaccttcatttggcagggt

SEQ ID NO: 508777 - DNA, 25 bp, Mus musculus
gatctagaccttgatttggcagggt

SEQ ID NO: 508778 - DNA, 25 bp, Mus musculus
gatctagactagacttgggtgacct

SEQ ID NO: 508779 - DNA, 25 bp, Mus musculus
gatctagactagtcttgggtgacct

SEQ ID NO: 508780 - DNA, 25 bp, Mus musculus
gatctagacttccaggcccatggta

SEQ ID NO: 508781 - DNA, 25 bp, Mus musculus
gatctagacttcgaggcccatggta

SEQ ID NO: 508782 - DNA, 25 bp, Mus musculus
gatctagagatgaatggtgtcaact

SEQ ID NO: 508783 - DNA, 25 bp, Mus musculus
gatctagagatgtatggtgtcaact

SEQ ID NO: 508784 - DNA, 25 bp, Mus musculus
gatctagcctctctaggttcatagt

SEQ ID NO: 508785 - DNA, 25 bp, Mus musculus
gatctagcctctgtaggttcatagt

SEQ ID NO: 508786 - DNA, 25 bp, Mus musculus
gatctagccttgactctttaggaaa

SEQ ID NO: 508787 - DNA, 25 bp, Mus musculus
gatctagccttgtctctttaggaaa

SEQ ID NO: 508788 - DNA, 25 bp, Mus musculus
gatctagctaagcttttatgcatgg

SEQ ID NO: 508789 - DNA, 25 bp, Mus musculus
gatctagctaaggttttatgcatgg

SEQ ID NO: 508790 - DNA, 25 bp, Mus musculus
gatctagctacaaaggtctgggcaa

SEQ ID NO: 508791 - DNA, 25 bp, Mus musculus
gatctagctacataggtctgggcaa

SEQ ID NO: 508792 - DNA, 25 bp, Mus musculus
gatctagctgagattttacactgaa

SEQ ID NO: 508793 - DNA, 25 bp, Mus musculus
gatctagctgagtttttacactgaa

SEQ ID NO: 508794 - DNA, 25 bp, Mus musculus
gatctagctgtacgtcatcctgatg

SEQ ID NO: 508795 - DNA, 25 bp, Mus musculus
gatctagctgtaggtcatcctgatg

SEQ ID NO: 508796 - DNA, 25 bp, Mus musculus
gatctagcttccatatcctcaaata

SEQ ID NO: 508797 - DNA, 25 bp, Mus musculus
gatctagcttccttatcctcaaata

SEQ ID NO: 508798 - DNA, 25 bp, Mus musculus
gatctagcttgtatctgcagagaga

SEQ ID NO: 508799 - DNA, 25 bp, Mus musculus
gatctagcttgtttctgcagagaga

SEQ ID NO: 508800 - DNA, 25 bp, Mus musculus
gatctaggaattctgctgacatcaa

SEQ ID NO: 508801 - DNA, 25 bp, Mus musculus
gatctaggaattgtgctgacatcaa

SEQ ID NO: 508802 - DNA, 25 bp, Mus musculus
gatctaggacatccactgccgtcag

SEQ ID NO: 508803 - DNA, 25 bp, Mus musculus
gatctaggacatgcactgccgtcag

SEQ ID NO: 508804 - DNA, 25 bp, Mus musculus
gatctaggatatcccaaggagctgg

SEQ ID NO: 508805 - DNA, 25 bp, Mus musculus
gatctaggatatgccaaggagctgg

SEQ ID NO: 508806 - DNA, 25 bp, Mus musculus
gatctaggcacacgaaggtctcttc

SEQ ID NO: 508807 - DNA, 25 bp, Mus musculus
gatctaggcacaggaaggtctcttc

SEQ ID NO: 508808 - DNA, 25 bp, Mus musculus
gatctagggcagaagtggccaatct

SEQ ID NO: 508809 - DNA, 25 bp, Mus musculus
gatctagggcagtagtggccaatct

SEQ ID NO: 508810 - DNA, 25 bp, Mus musculus
gatctaggtaatctctcataggttt

SEQ ID NO: 508811 - DNA, 25 bp, Mus musculus
gatctaggtaatgtctcataggttt

SEQ ID NO: 508812 - DNA, 25 bp, Mus musculus
gatctagtacctctcaaagcataaa

SEQ ID NO: 508813 - DNA, 25 bp, Mus musculus
gatctagtacctgtcaaagcataaa

SEQ ID NO: 508814 - DNA, 25 bp, Mus musculus
gatctagtagatacttggcccgttt

SEQ ID NO: 508815 - DNA, 25 bp, Mus musculus
gatctagtagattcttggcccgttt

SEQ ID NO: 508816 - DNA, 25 bp, Mus musculus
gatctagtctagatttgtcaatgag

SEQ ID NO: 508817 - DNA, 25 bp, Mus musculus
gatctagtctagttttgtcaatgag

SEQ ID NO: 508818 - DNA, 25 bp, Mus musculus
gatctagtgactcaggcactgccag

SEQ ID NO: 508819 - DNA, 25 bp, Mus musculus
gatctagtgactgaggcactgccag

SEQ ID NO: 508820 - DNA, 25 bp, Mus musculus
gatctagtgctgagttttacttgaa

SEQ ID NO: 508821 - DNA, 25 bp, Mus musculus
gatctagtgctgtgttttacttgaa

SEQ ID NO: 508822 - DNA, 25 bp, Mus musculus
gatctagtgtctcctggtccaaggg

SEQ ID NO: 508823 - DNA, 25 bp, Mus musculus
gatctagtgtctgctggtccaaggg

SEQ ID NO: 508824 - DNA, 25 bp, Mus musculus
gatctagttttacggagtcggagta

SEQ ID NO: 508825 - DNA, 25 bp, Mus musculus
gatctagttttagggagtcggagta

SEQ ID NO: 508826 - DNA, 25 bp, Mus musculus
gatctagttttcagtagtctgcctg

SEQ ID NO: 508827 - DNA, 25 bp, Mus musculus
gatctagttttctgtagtctgcctg

SEQ ID NO: 508828 - DNA, 25 bp, Mus musculus
gatctataatccagctactcatctc

SEQ ID NO: 508829 - DNA, 25 bp, Mus musculus
gatctataatcctgctactcatctc

SEQ ID NO: 508830 - DNA, 25 bp, Mus musculus
gatctatagcccagtactcctttga

SEQ ID NO: 508831 - DNA, 25 bp, Mus musculus
gatctatagccctgtactcctttga

SEQ ID NO: 508832 - DNA, 25 bp, Mus musculus
gatctatagttcacactctgcataa

SEQ ID NO: 508833 - DNA, 25 bp, Mus musculus
gatctatagttctcactctgcataa

SEQ ID NO: 508834 - DNA, 25 bp, Mus musculus
gatctatatcttcatggtatcactg

SEQ ID NO: 508835 - DNA, 25 bp, Mus musculus
gatctatatcttgatggtatcactg

SEQ ID NO: 508836 - DNA, 25 bp, Mus musculus
gatctatcgactatccaatgtttaa

SEQ ID NO: 508837 - DNA, 25 bp, Mus musculus
gatctatcgactttccaatgtttaa

SEQ ID NO: 508838 - DNA, 25 bp, Mus musculus
gatctatctatcaaagcttgctgct

SEQ ID NO: 508839 - DNA, 25 bp, Mus musculus
gatctatctatctaagcttgctgct

SEQ ID NO: 508840 - DNA, 25 bp, Mus musculus
gatctatctcagaggctatagctgg

SEQ ID NO: 508841 - DNA, 25 bp, Mus musculus
gatctatctcagtggctatagctgg

SEQ ID NO: 508842 - DNA, 25 bp, Mus musculus
gatctatctgatcatttaaaagagt

SEQ ID NO: 508843 - DNA, 25 bp, Mus musculus
gatctatctgatgatttaaaagagt

SEQ ID NO: 508844 - DNA, 25 bp, Mus musculus
gatctatctggtccatgatgaactg

SEQ ID NO: 508845 - DNA, 25 bp, Mus musculus
gatctatctggtgcatgatgaactg

SEQ ID NO: 508846 - DNA, 25 bp, Mus musculus
gatctatcttttctaagcgccaggt

SEQ ID NO: 508847 - DNA, 25 bp, Mus musculus
gatctatcttttgtaagcgccaggt

SEQ ID NO: 508848 - DNA, 25 bp, Mus musculus
gatctatgaagtccggcgtggcttt

SEQ ID NO: 508849 - DNA, 25 bp, Mus musculus
gatctatgaagtgcggcgtggcttt

SEQ ID NO: 508850 - DNA, 25 bp, Mus musculus
gatctatgacatattccagaagctc

SEQ ID NO: 508851 - DNA, 25 bp, Mus musculus
gatctatgacattttccagaagctc

SEQ ID NO: 508852 - DNA, 25 bp, Mus musculus
gatctatgacttcaacactgacaat

SEQ ID NO: 508853 - DNA, 25 bp, Mus musculus
gatctatgacttgaacactgacaat

SEQ ID NO: 508854 - DNA, 25 bp, Mus musculus
gatctatgcatcctgtcaagagggt

SEQ ID NO: 508855 - DNA, 25 bp, Mus musculus
gatctatgcatcgtgtcaagagggt

SEQ ID NO: 508856 - DNA, 25 bp, Mus musculus
gatctatgctctcgactgaatctca

SEQ ID NO: 508857 - DNA, 25 bp, Mus musculus
gatctatgctctggactgaatctca

SEQ ID NO: 508858 - DNA, 25 bp, Mus musculus
gatctatgctttcttctgtatttgg

SEQ ID NO: 508859 - DNA, 25 bp, Mus musculus
gatctatgctttgttctgtatttgg

SEQ ID NO: 508860 - DNA, 25 bp, Mus musculus
gatctatggcaaatattctagctag

SEQ ID NO: 508861 - DNA, 25 bp, Mus musculus
gatctatggcaattattctagctag

SEQ ID NO: 508862 - DNA, 25 bp, Mus musculus
gatctatgggtactggagcccttca

SEQ ID NO: 508863 - DNA, 25 bp, Mus musculus
gatctatgggtagtggagcccttca

SEQ ID NO: 508864 - DNA, 25 bp, Mus musculus
gatctatgtctaaattcactactgt

SEQ ID NO: 508865 - DNA, 25 bp, Mus musculus
gatctatgtctatattcactactgt

SEQ ID NO: 508866 - DNA, 25 bp, Mus musculus
gatctatgttatagctctgttttat

SEQ ID NO: 508867 - DNA, 25 bp, Mus musculus
gatctatgttattgctctgttttat

SEQ ID NO: 508868 - DNA, 25 bp, Mus musculus
gatctattaaccatatgctgaactg

SEQ ID NO: 508869 - DNA, 25 bp, Mus musculus
gatctattaaccttatgctgaactg

SEQ ID NO: 508870 - DNA, 25 bp, Mus musculus
gatctattacctatcctggaagaca

SEQ ID NO: 508871 - DNA, 25 bp, Mus musculus
gatctattacctttcctggaagaca

SEQ ID NO: 508872 - DNA, 25 bp, Mus musculus
gatctattagaactttgcggacctc

SEQ ID NO: 508873 - DNA, 25 bp, Mus musculus
gatctattagaagtttgcggacctc

SEQ ID NO: 508874 - DNA, 25 bp, Mus musculus
gatctattcagaagaagtgcttccc

SEQ ID NO: 508875 - DNA, 25 bp, Mus musculus
gatctattcagatgaagtgcttccc

SEQ ID NO: 508876 - DNA, 25 bp, Mus musculus
gatctattcagtagtgtaatcaccg

SEQ ID NO: 508877 - DNA, 25 bp, Mus musculus
gatctattcagttgtgtaatcaccg

SEQ ID NO: 508878 - DNA, 25 bp, Mus musculus
gatctattctacactgttacccatg

SEQ ID NO: 508879 - DNA, 25 bp, Mus musculus
gatctattctactctgttacccatg

SEQ ID NO: 508880 - DNA, 25 bp, Mus musculus
gatctattgcctaatgtccattgtt

SEQ ID NO: 508881 - DNA, 25 bp, Mus musculus
gatctattgccttatgtccattgtt

SEQ ID NO: 508882 - DNA, 25 bp, Mus musculus
gatctattggatccatgggcattta

SEQ ID NO: 508883 - DNA, 25 bp, Mus musculus
gatctattggatgcatgggcattta

SEQ ID NO: 508884 - DNA, 25 bp, Mus musculus
gatctattgtacagtctgtttcttc

SEQ ID NO: 508885 - DNA, 25 bp, Mus musculus
gatctattgtactgtctgtttcttc

SEQ ID NO: 508886 - DNA, 25 bp, Mus musculus
gatctatttcatagcctcttagggc

SEQ ID NO: 508887 - DNA, 25 bp, Mus musculus
gatctatttcattgcctcttagggc

SEQ ID NO: 508888 - DNA, 25 bp, Mus musculus
gatctattttccaaaccgttcctct

SEQ ID NO: 508889 - DNA, 25 bp, Mus musculus
gatctattttcctaaccgttcctct

SEQ ID NO: 508890 - DNA, 25 bp, Mus musculus
gatctattttctcacttctatttta

SEQ ID NO: 508891 - DNA, 25 bp, Mus musculus
gatctattttctgacttctatttta

SEQ ID NO: 508892 - DNA, 25 bp, Mus musculus
gatctattttggacaatacccctga

SEQ ID NO: 508893 - DNA, 25 bp, Mus musculus
gatctattttggtcaatacccctga

SEQ ID NO: 508894 - DNA, 25 bp, Mus musculus
gatctcaaaattcagactccaggtg

SEQ ID NO: 508895 - DNA, 25 bp, Mus musculus
gatctcaaaattgagactccaggtg

SEQ ID NO: 508896 - DNA, 25 bp, Mus musculus
gatctcaaactgcagcagactcggg

SEQ ID NO: 508897 - DNA, 25 bp, Mus musculus
gatctcaaactggagcagactcggg

SEQ ID NO: 508898 - DNA, 25 bp, Mus musculus
gatctcaaagccattaccagcgttt

SEQ ID NO: 508899 - DNA, 25 bp, Mus musculus
gatctcaaagcctttaccagcgttt

SEQ ID NO: 508900 - DNA, 25 bp, Mus musculus
gatctcaacactagtaatgaccagt

SEQ ID NO: 508901 - DNA, 25 bp, Mus musculus
gatctcaacacttgtaatgaccagt

SEQ ID NO: 508902 - DNA, 25 bp, Mus musculus
gatctcaactgtccgaatgtgttca

SEQ ID NO: 508903 - DNA, 25 bp, Mus musculus
gatctcaactgtgcgaatgtgttca

SEQ ID NO: 508904 - DNA, 25 bp, Mus musculus
gatctcaagatactccactgcctga

SEQ ID NO: 508905 - DNA, 25 bp, Mus musculus
gatctcaagatagtccactgcctga

SEQ ID NO: 508906 - DNA, 25 bp, Mus musculus
gatctcaagcatatctgaagggctg

SEQ ID NO: 508907 - DNA, 25 bp, Mus musculus
gatctcaagcatttctgaagggctg

SEQ ID NO: 508908 - DNA, 25 bp, Mus musculus
gatctcaaggcaaaagcacggcgct

SEQ ID NO: 508909 - DNA, 25 bp, Mus musculus
gatctcaaggcataagcacggcgct

SEQ ID NO: 508910 - DNA, 25 bp, Mus musculus
gatctcaataagactctgtaaggca

SEQ ID NO: 508911 - DNA, 25 bp, Mus musculus
gatctcaataagtctctgtaaggca

SEQ ID NO: 508912 - DNA, 25 bp, Mus musculus
gatctcaatcctccaggctgaagtt

SEQ ID NO: 508913 - DNA, 25 bp, Mus musculus
gatctcaatcctgcaggctgaagtt

SEQ ID NO: 508914 - DNA, 25 bp, Mus musculus
gatctcaatctgaggctcctgactt

SEQ ID NO: 508915 - DNA, 25 bp, Mus musculus
gatctcaatctgtggctcctgactt

SEQ ID NO: 508916 - DNA, 25 bp, Mus musculus
gatctcaatgaaagaggactccttg

SEQ ID NO: 508917 - DNA, 25 bp, Mus musculus
gatctcaatgaatgaggactccttg

SEQ ID NO: 508918 - DNA, 25 bp, Mus musculus
gatctcaattccatttggtggctag

SEQ ID NO: 508919 - DNA, 25 bp, Mus musculus
gatctcaattccttttggtggctag

SEQ ID NO: 508920 - DNA, 25 bp, Mus musculus
gatctcacaactacctgtgttcaca

SEQ ID NO: 508921 - DNA, 25 bp, Mus musculus
gatctcacaacttcctgtgttcaca

SEQ ID NO: 508922 - DNA, 25 bp, Mus musculus
gatctcacagatcggccagtggatt

SEQ ID NO: 508923 - DNA, 25 bp, Mus musculus
gatctcacagatgggccagtggatt

SEQ ID NO: 508924 - DNA, 25 bp, Mus musculus
gatctcacagccagttctgtggcaa

SEQ ID NO: 508925 - DNA, 25 bp, Mus musculus
gatctcacagcctgttctgtggcaa

SEQ ID NO: 508926 - DNA, 25 bp, Mus musculus
gatctcacatcaaatttctgggtca

SEQ ID NO: 508927 - DNA, 25 bp, Mus musculus
gatctcacatcatatttctgggtca

SEQ ID NO: 508928 - DNA, 25 bp, Mus musculus
gatctcacatctccattagtgtcag

SEQ ID NO: 508929 - DNA, 25 bp, Mus musculus
gatctcacatctgcattagtgtcag

SEQ ID NO: 508930 - DNA, 25 bp, Mus musculus
gatctcaccatgcaaatctgtacac

SEQ ID NO: 508931 - DNA, 25 bp, Mus musculus
gatctcaccatggaaatctgtacac

SEQ ID NO: 508932 - DNA, 25 bp, Mus musculus
gatctcacccacaggtgctgctggt

SEQ ID NO: 508933 - DNA, 25 bp, Mus musculus
gatctcacccactggtgctgctggt

SEQ ID NO: 508934 - DNA, 25 bp, Mus musculus
gatctcacctacctatcaggaattg

SEQ ID NO: 508935 - DNA, 25 bp, Mus musculus
gatctcacctacgtatcaggaattg

SEQ ID NO: 508936 - DNA, 25 bp, Mus musculus
gatctcacctagcaactcaagtctg

SEQ ID NO: 508937 - DNA, 25 bp, Mus musculus
gatctcacctaggaactcaagtctg

SEQ ID NO: 508938 - DNA, 25 bp, Mus musculus
gatctcacctatacaagtaggcaat

SEQ ID NO: 508939 - DNA, 25 bp, Mus musculus
gatctcacctattcaagtaggcaat

SEQ ID NO: 508940 - DNA, 25 bp, Mus musculus
gatctcactaaaatacccagatagg

SEQ ID NO: 508941 - DNA, 25 bp, Mus musculus
gatctcactaaattacccagatagg

SEQ ID NO: 508942 - DNA, 25 bp, Mus musculus
gatctcactatgaagttggtggctg

SEQ ID NO: 508943 - DNA, 25 bp, Mus musculus
gatctcactatgtagttggtggctg

SEQ ID NO: 508944 - DNA, 25 bp, Mus musculus
gatctcactcaaagcatctgcacac

SEQ ID NO: 508945 - DNA, 25 bp, Mus musculus
gatctcactcaatgcatctgcacac

SEQ ID NO: 508946 - DNA, 25 bp, Mus musculus
gatctcactcagcaacaagtacatt

SEQ ID NO: 508947 - DNA, 25 bp, Mus musculus
gatctcactcaggaacaagtacatt

SEQ ID NO: 508948 - DNA, 25 bp, Mus musculus
gatctcactggactgatgtcacata

SEQ ID NO: 508949 - DNA, 25 bp, Mus musculus
gatctcactggagtgatgtcacata

SEQ ID NO: 508950 - DNA, 25 bp, Mus musculus
gatctcactttgattgtcttaagca

SEQ ID NO: 508951 - DNA, 25 bp, Mus musculus
gatctcactttgtttgtcttaagca

SEQ ID NO: 508952 - DNA, 25 bp, Mus musculus
gatctcagaaggcaactctaagttt

SEQ ID NO: 508953 - DNA, 25 bp, Mus musculus
gatctcagaagggaactctaagttt

SEQ ID NO: 508954 - DNA, 25 bp, Mus musculus
gatctcagacccatctaatcatgtg

SEQ ID NO: 508955 - DNA, 25 bp, Mus musculus
gatctcagacccttctaatcatgtg

SEQ ID NO: 508956 - DNA, 25 bp, Mus musculus
gatctcagacctagcagggtaatca

SEQ ID NO: 508957 - DNA, 25 bp, Mus musculus
gatctcagaccttgcagggtaatca

SEQ ID NO: 508958 - DNA, 25 bp, Mus musculus
gatctcagagacatgaaccttgaag

SEQ ID NO: 508959 - DNA, 25 bp, Mus musculus
gatctcagagacttgaaccttgaag

SEQ ID NO: 508960 - DNA, 25 bp, Mus musculus
gatctcagattaatcattcagttat

SEQ ID NO: 508961 - DNA, 25 bp, Mus musculus
gatctcagattattcattcagttat

SEQ ID NO: 508962 - DNA, 25 bp, Mus musculus
gatctcagcattctgtaccctacat

SEQ ID NO: 508963 - DNA, 25 bp, Mus musculus
gatctcagcattgtgtaccctacat

SEQ ID NO: 508964 - DNA, 25 bp, Mus musculus
gatctcagccaaaagtccgacggac

SEQ ID NO: 508965 - DNA, 25 bp, Mus musculus
gatctcagccaatagtccgacggac

SEQ ID NO: 508966 - DNA, 25 bp, Mus musculus
gatctcagccctacagtgcaaggat

SEQ ID NO: 508967 - DNA, 25 bp, Mus musculus
gatctcagcccttcagtgcaaggat

SEQ ID NO: 508968 - DNA, 25 bp, Mus musculus
gatctcagctcaaggtggttggttt

SEQ ID NO: 508969 - DNA, 25 bp, Mus musculus
gatctcagctcatggtggttggttt

SEQ ID NO: 508970 - DNA, 25 bp, Mus musculus
gatctcagctctacctattcaaaat

SEQ ID NO: 508971 - DNA, 25 bp, Mus musculus
gatctcagctcttcctattcaaaat

SEQ ID NO: 508972 - DNA, 25 bp, Mus musculus
gatctcagcttcagtcatttgggtg

SEQ ID NO: 508973 - DNA, 25 bp, Mus musculus
gatctcagcttctgtcatttgggtg

SEQ ID NO: 508974 - DNA, 25 bp, Mus musculus
gatctcaggaccaaagacacccaga

SEQ ID NO: 508975 - DNA, 25 bp, Mus musculus
gatctcaggacctaagacacccaga

SEQ ID NO: 508976 - DNA, 25 bp, Mus musculus
gatctcaggagacttcaccaaggca

SEQ ID NO: 508977 - DNA, 25 bp, Mus musculus
gatctcaggagagttcaccaaggca

SEQ ID NO: 508978 - DNA, 25 bp, Mus musculus
gatctcaggtatatatcacagtgat

SEQ ID NO: 508979 - DNA, 25 bp, Mus musculus
gatctcaggtatttatcacagtgat

SEQ ID NO: 508980 - DNA, 25 bp, Mus musculus
gatctcaggtctaagcattttgtct

SEQ ID NO: 508981 - DNA, 25 bp, Mus musculus
gatctcaggtcttagcattttgtct

SEQ ID NO: 508982 - DNA, 25 bp, Mus musculus
gatctcagtatcacacatatcattt

SEQ ID NO: 508983 - DNA, 25 bp, Mus musculus
gatctcagtatctcacatatcattt

SEQ ID NO: 508984 - DNA, 25 bp, Mus musculus
gatctcagtgtccagtatgtcttaa

SEQ ID NO: 508985 - DNA, 25 bp, Mus musculus
gatctcagtgtcgagtatgtcttaa

SEQ ID NO: 508986 - DNA, 25 bp, Mus musculus
gatctcagttacacagacaaggtcc

SEQ ID NO: 508987 - DNA, 25 bp, Mus musculus
gatctcagttactcagacaaggtcc

SEQ ID NO: 508988 - DNA, 25 bp, Mus musculus
gatctcatacaaatgccagggcctg

SEQ ID NO: 508989 - DNA, 25 bp, Mus musculus
gatctcatacaattgccagggcctg

SEQ ID NO: 508990 - DNA, 25 bp, Mus musculus
gatctcatcaggaggagcacggtcc

SEQ ID NO: 508991 - DNA, 25 bp, Mus musculus
gatctcatcaggtggagcacggtcc

SEQ ID NO: 508992 - DNA, 25 bp, Mus musculus
gatctcatctatcagaacacaacgg

SEQ ID NO: 508993 - DNA, 25 bp, Mus musculus
gatctcatctatgagaacacaacgg

SEQ ID NO: 508994 - DNA, 25 bp, Mus musculus
gatctcatctcaacgaagcctgaag

SEQ ID NO: 508995 - DNA, 25 bp, Mus musculus
gatctcatctcatcgaagcctgaag

SEQ ID NO: 508996 - DNA, 25 bp, Mus musculus
gatctcatgacacgtctgccagatg

SEQ ID NO: 508997 - DNA, 25 bp, Mus musculus
gatctcatgacaggtctgccagatg

SEQ ID NO: 508998 - DNA, 25 bp, Mus musculus
gatctcatgagaactggcttttacc

SEQ ID NO: 508999 - DNA, 25 bp, Mus musculus
gatctcatgagatctggcttttacc

SEQ ID NO: 509000 - DNA, 25 bp, Mus musculus
gatctcatggctaaagacaagcaaa

SEQ ID NO: 509001 - DNA, 25 bp, Mus musculus
gatctcatggcttaagacaagcaaa

SEQ ID NO: 509002 - DNA, 25 bp, Mus musculus
gatctcatgtggaacaggctggctt

SEQ ID NO: 509003 - DNA, 25 bp, Mus musculus
gatctcatgtggtacaggctggctt

SEQ ID NO: 509004 - DNA, 25 bp, Mus musculus
gatctcatgttaatatcagtatcac

SEQ ID NO: 509005 - DNA, 25 bp, Mus musculus
gatctcatgttattatcagtatcac

SEQ ID NO: 509006 - DNA, 25 bp, Mus musculus
gatctcattactaaaacacactgtc

SEQ ID NO: 509007 - DNA, 25 bp, Mus musculus
gatctcattacttaaacacactgtc

SEQ ID NO: 509008 - DNA, 25 bp, Mus musculus
gatctcattatccaactctaaaagt

SEQ ID NO: 509009 - DNA, 25 bp, Mus musculus
gatctcattatcgaactctaaaagt

SEQ ID NO: 509010 - DNA, 25 bp, Mus musculus
gatctcattatgattgactttcatt

SEQ ID NO: 509011 - DNA, 25 bp, Mus musculus
gatctcattatgtttgactttcatt

SEQ ID NO: 509012 - DNA, 25 bp, Mus musculus
gatctcattccaagacccagaaaaa

SEQ ID NO: 509013 - DNA, 25 bp, Mus musculus
gatctcattccatgacccagaaaaa

SEQ ID NO: 509014 - DNA, 25 bp, Mus musculus
gatctcattccgcatgaagccctga

SEQ ID NO: 509015 - DNA, 25 bp, Mus musculus
gatctcattccggatgaagccctga

SEQ ID NO: 509016 - DNA, 25 bp, Mus musculus
gatctcattggaatgcctccagaag

SEQ ID NO: 509017 - DNA, 25 bp, Mus musculus
gatctcattggacattcatcgtctg

SEQ ID NO: 509018 - DNA, 25 bp, Mus musculus
gatctcattggagattcatcgtctg

SEQ ID NO: 509019 - DNA, 25 bp, Mus musculus
gatctcattggattgcctccagaag

SEQ ID NO: 509020 - DNA, 25 bp, Mus musculus
gatctcattgtcagattttgtgctt

SEQ ID NO: 509021 - DNA, 25 bp, Mus musculus
gatctcattgtctgattttgtgctt

SEQ ID NO: 509022 - DNA, 25 bp, Mus musculus
gatctccaaaggctctatgctcaag

SEQ ID NO: 509023 - DNA, 25 bp, Mus musculus
gatctccaaagggtctatgctcaag

SEQ ID NO: 509024 - DNA, 25 bp, Mus musculus
gatctccaactcatcactctaagag

SEQ ID NO: 509025 - DNA, 25 bp, Mus musculus
gatctccaactcttcactctaagag

SEQ ID NO: 509026 - DNA, 25 bp, Mus musculus
gatctccaagctacttaggtaccat

SEQ ID NO: 509027 - DNA, 25 bp, Mus musculus
gatctccaagcttcttaggtaccat

SEQ ID NO: 509028 - DNA, 25 bp, Mus musculus
gatctccaagggatatgcgtgtagt

SEQ ID NO: 509029 - DNA, 25 bp, Mus musculus
gatctccaagggttatgcgtgtagt

SEQ ID NO: 509030 - DNA, 25 bp, Mus musculus
gatctccaaggtatgtaggtaattt

SEQ ID NO: 509031 - DNA, 25 bp, Mus musculus
gatctccaaggtttgtaggtaattt

SEQ ID NO: 509032 - DNA, 25 bp, Mus musculus
gatctccacagaagtgacccagtac

SEQ ID NO: 509033 - DNA, 25 bp, Mus musculus
gatctccacagatgtgacccagtac

SEQ ID NO: 509034 - DNA, 25 bp, Mus musculus
gatctccacatacaccggtggtcag

SEQ ID NO: 509035 - DNA, 25 bp, Mus musculus
gatctccacatagaccggtggtcag

SEQ ID NO: 509036 - DNA, 25 bp, Mus musculus
gatctccacggactcaaggctttga

SEQ ID NO: 509037 - DNA, 25 bp, Mus musculus
gatctccacggagtcaaggctttga

SEQ ID NO: 509038 - DNA, 25 bp, Mus musculus
gatctccacgtgaaagtgacgggac

SEQ ID NO: 509039 - DNA, 25 bp, Mus musculus
gatctccacgtgtaagtgacgggac

SEQ ID NO: 509040 - DNA, 25 bp, Mus musculus
gatctccagcagaagaaaaaggctt

SEQ ID NO: 509041 - DNA, 25 bp, Mus musculus
gatctccagcagtagaaaaaggctt

SEQ ID NO: 509042 - DNA, 25 bp, Mus musculus
gatctccagcgcagtgaggtcagcc

SEQ ID NO: 509043 - DNA, 25 bp, Mus musculus
gatctccagcgctgtgaggtcagcc

SEQ ID NO: 509044 - DNA, 25 bp, Mus musculus
gatctccagggcaccattcagggag

SEQ ID NO: 509045 - DNA, 25 bp, Mus musculus
gatctccagggctccattcagggag

SEQ ID NO: 509046 - DNA, 25 bp, Mus musculus
gatctccagtacaaaatattctggg

SEQ ID NO: 509047 - DNA, 25 bp, Mus musculus
gatctccagtactaaatattctggg

SEQ ID NO: 509048 - DNA, 25 bp, Mus musculus
gatctccatagtatagctctgacag

SEQ ID NO: 509049 - DNA, 25 bp, Mus musculus
gatctccatagtttagctctgacag

SEQ ID NO: 509050 - DNA, 25 bp, Mus musculus
gatctccatctcacttataacaagg

SEQ ID NO: 509051 - DNA, 25 bp, Mus musculus
gatctccatctctcttataacaagg

SEQ ID NO: 509052 - DNA, 25 bp, Mus musculus
gatctccatgatcaattccagcatc

SEQ ID NO: 509053 - DNA, 25 bp, Mus musculus
gatctccatgatgaattccagcatc

SEQ ID NO: 509054 - DNA, 25 bp, Mus musculus
gatctccattttcagtattatcagg

SEQ ID NO: 509055 - DNA, 25 bp, Mus musculus
gatctccattttgagtattatcagg

SEQ ID NO: 509056 - DNA, 25 bp, Mus musculus
gatctcccaccaatcagtattcttg

SEQ ID NO: 509057 - DNA, 25 bp, Mus musculus
gatctcccaccattcagtattcttg

SEQ ID NO: 509058 - DNA, 25 bp, Mus musculus
gatctcccagatatgtgaggaaggt

SEQ ID NO: 509059 - DNA, 25 bp, Mus musculus
gatctcccagatcctgctgatgttg

SEQ ID NO: 509060 - DNA, 25 bp, Mus musculus
gatctcccagatgctgctgatgttg

SEQ ID NO: 509061 - DNA, 25 bp, Mus musculus
gatctcccagatttgtgaggaaggt

SEQ ID NO: 509062 - DNA, 25 bp, Mus musculus
gatctcccagttatttagtagctaa

SEQ ID NO: 509063 - DNA, 25 bp, Mus musculus
gatctcccagttttttagtagctaa

SEQ ID NO: 509064 - DNA, 25 bp, Mus musculus
gatctccctggcactactagagtat

SEQ ID NO: 509065 - DNA, 25 bp, Mus musculus
gatctccctggcaggagagagtgtt

SEQ ID NO: 509066 - DNA, 25 bp, Mus musculus
gatctccctggctctactagagtat

SEQ ID NO: 509067 - DNA, 25 bp, Mus musculus
gatctccctggctggagagagtgtt

SEQ ID NO: 509068 - DNA, 25 bp, Mus musculus
gatctccgagcacacgtattaagcc

SEQ ID NO: 509069 - DNA, 25 bp, Mus musculus
gatctccgagcagacgtattaagcc

SEQ ID NO: 509070 - DNA, 25 bp, Mus musculus
gatctccgaggacagtgccgaacta

SEQ ID NO: 509071 - DNA, 25 bp, Mus musculus
gatctccgaggagagtgccgaacta

SEQ ID NO: 509072 - DNA, 25 bp, Mus musculus
gatctccggcttaattttgaatgta

SEQ ID NO: 509073 - DNA, 25 bp, Mus musculus
gatctccggctttattttgaatgta

SEQ ID NO: 509074 - DNA, 25 bp, Mus musculus
gatctccgggttaaatccaagggtg

SEQ ID NO: 509075 - DNA, 25 bp, Mus musculus
gatctccgggtttaatccaagggtg

SEQ ID NO: 509076 - DNA, 25 bp, Mus musculus
gatctccgtagaagaagctctccag

SEQ ID NO: 509077 - DNA, 25 bp, Mus musculus
gatctccgtagatgaagctctccag

SEQ ID NO: 509078 - DNA, 25 bp, Mus musculus
gatctccgttggcacagaggcccag

SEQ ID NO: 509079 - DNA, 25 bp, Mus musculus
gatctccgttgggacagaggcccag

SEQ ID NO: 509080 - DNA, 25 bp, Mus musculus
gatctcctagaacccatatatccaa

SEQ ID NO: 509081 - DNA, 25 bp, Mus musculus
gatctcctagaagccatatatccaa

SEQ ID NO: 509082 - DNA, 25 bp, Mus musculus
gatctcctagggagacatctggcac

SEQ ID NO: 509083 - DNA, 25 bp, Mus musculus
gatctcctagggtgacatctggcac

SEQ ID NO: 509084 - DNA, 25 bp, Mus musculus
gatctcctcaaaaccttcagacaag

SEQ ID NO: 509085 - DNA, 25 bp, Mus musculus
gatctcctcaaatccttcagacaag

SEQ ID NO: 509086 - DNA, 25 bp, Mus musculus
gatctcctcaacaatcacagctatg

SEQ ID NO: 509087 - DNA, 25 bp, Mus musculus
gatctcctcaactatcacagctatg

SEQ ID NO: 509088 - DNA, 25 bp, Mus musculus
gatctcctctaaatttccgttgttt

SEQ ID NO: 509089 - DNA, 25 bp, Mus musculus
gatctcctctaattttccgttgttt

SEQ ID NO: 509090 - DNA, 25 bp, Mus musculus
gatctcctgaagcacgctgcctggg

SEQ ID NO: 509091 - DNA, 25 bp, Mus musculus
gatctcctgaaggacgctgcctggg

SEQ ID NO: 509092 - DNA, 25 bp, Mus musculus
gatctcctgaatagacaggtcttcg

SEQ ID NO: 509093 - DNA, 25 bp, Mus musculus
gatctcctgaattgacaggtcttcg

SEQ ID NO: 509094 - DNA, 25 bp, Mus musculus
gatctcctgatcaccatggcagttg

SEQ ID NO: 509095 - DNA, 25 bp, Mus musculus
gatctcctgatctccatggcagttg

SEQ ID NO: 509096 - DNA, 25 bp, Mus musculus
gatctcctgcttactggaaagctca

SEQ ID NO: 509097 - DNA, 25 bp, Mus musculus
gatctcctgctttctggaaagctca

SEQ ID NO: 509098 - DNA, 25 bp, Mus musculus
gatctcctgttactaatgctcttta

SEQ ID NO: 509099 - DNA, 25 bp, Mus musculus
gatctcctgttactggtgccttcca

SEQ ID NO: 509100 - DNA, 25 bp, Mus musculus
gatctcctgttagtaatgctcttta

SEQ ID NO: 509101 - DNA, 25 bp, Mus musculus
gatctcctgttagtggtgccttcca

SEQ ID NO: 509102 - DNA, 25 bp, Mus musculus
gatctccttagtccagcagggtcga

SEQ ID NO: 509103 - DNA, 25 bp, Mus musculus
gatctccttagtgcagcagggtcga

SEQ ID NO: 509104 - DNA, 25 bp, Mus musculus
gatctccttatgaatcttcaggcag

SEQ ID NO: 509105 - DNA, 25 bp, Mus musculus
gatctccttatgtatcttcaggcag

SEQ ID NO: 509106 - DNA, 25 bp, Mus musculus
gatctccttcccctagaagacgatc

SEQ ID NO: 509107 - DNA, 25 bp, Mus musculus
gatctccttcccgtagaagacgatc

SEQ ID NO: 509108 - DNA, 25 bp, Mus musculus
gatctccttcttaagctcaagactt

SEQ ID NO: 509109 - DNA, 25 bp, Mus musculus
gatctccttctttagctcaagactt

SEQ ID NO: 509110 - DNA, 25 bp, Mus musculus
gatctccttgagatgaaagattgga

SEQ ID NO: 509111 - DNA, 25 bp, Mus musculus
gatctccttgagttgaaagattgga

SEQ ID NO: 509112 - DNA, 25 bp, Mus musculus
gatctccttgtcaggcaatcagcct

SEQ ID NO: 509113 - DNA, 25 bp, Mus musculus
gatctccttgtctggcaatcagcct

SEQ ID NO: 509114 - DNA, 25 bp, Mus musculus
gatctcctttgcacactaaatgcca

SEQ ID NO: 509115 - DNA, 25 bp, Mus musculus
gatctcctttgctcactaaatgcca

SEQ ID NO: 509116 - DNA, 25 bp, Mus musculus
gatctccttttgacactgtagcttt

SEQ ID NO: 509117 - DNA, 25 bp, Mus musculus
gatctccttttgtcactgtagcttt

SEQ ID NO: 509118 - DNA, 25 bp, Mus musculus
gatctcgacaggcaatgctttaggt

SEQ ID NO: 509119 - DNA, 25 bp, Mus musculus
gatctcgacagggaatgctttaggt

SEQ ID NO: 509120 - DNA, 25 bp, Mus musculus
gatctcgcgggtcccagcaggtgta

SEQ ID NO: 509121 - DNA, 25 bp, Mus musculus
gatctcgcgggtgccagcaggtgta

SEQ ID NO: 509122 - DNA, 25 bp, Mus musculus
gatctcgctaatatcacagactata

SEQ ID NO: 509123 - DNA, 25 bp, Mus musculus
gatctcgctaatttcacagactata

SEQ ID NO: 509124 - DNA, 25 bp, Mus musculus
gatctcggacgcacagtgggaagat

SEQ ID NO: 509125 - DNA, 25 bp, Mus musculus
gatctcggacgctcagtgggaagat

SEQ ID NO: 509126 - DNA, 25 bp, Mus musculus
gatctcggattcatcttgagaacat

SEQ ID NO: 509127 - DNA, 25 bp, Mus musculus
gatctcggattcttcttgagaacat

SEQ ID NO: 509128 - DNA, 25 bp, Mus musculus
gatctcggatttcgctcgacctcct

SEQ ID NO: 509129 - DNA, 25 bp, Mus musculus
gatctcggatttggctcgacctcct

SEQ ID NO: 509130 - DNA, 25 bp, Mus musculus
gatctcggctcacaaggtccaggtg

SEQ ID NO: 509131 - DNA, 25 bp, Mus musculus
gatctcggctcagaaggtccaggtg

SEQ ID NO: 509132 - DNA, 25 bp, Mus musculus
gatctcgtgctgaatgaaacgctta

SEQ ID NO: 509133 - DNA, 25 bp, Mus musculus
gatctcgtgctgtatgaaacgctta

SEQ ID NO: 509134 - DNA, 25 bp, Mus musculus
gatctctaagaaataagggccagct

SEQ ID NO: 509135 - DNA, 25 bp, Mus musculus
gatctctaagaattaagggccagct

SEQ ID NO: 509136 - DNA, 25 bp, Mus musculus
gatctctaagccaagaacattctct

SEQ ID NO: 509137 - DNA, 25 bp, Mus musculus
gatctctaagcctagaacattctct

SEQ ID NO: 509138 - DNA, 25 bp, Mus musculus
gatctctacaaacacccagaaaaac

SEQ ID NO: 509139 - DNA, 25 bp, Mus musculus
gatctctacaaagacccagaaaaac

SEQ ID NO: 509140 - DNA, 25 bp, Mus musculus
gatctctacaggatttcccagagtc

SEQ ID NO: 509141 - DNA, 25 bp, Mus musculus
gatctctacaggttttcccagagtc

SEQ ID NO: 509142 - DNA, 25 bp, Mus musculus
gatctctaccaaaattctcaattag

SEQ ID NO: 509143 - DNA, 25 bp, Mus musculus
gatctctaccaatattctcaattag

SEQ ID NO: 509144 - DNA, 25 bp, Mus musculus
gatctctaccagctttgttgctttg

SEQ ID NO: 509145 - DNA, 25 bp, Mus musculus
gatctctaccaggtttgttgctttg

SEQ ID NO: 509146 - DNA, 25 bp, Mus musculus
gatctctagactattttaccacaaa

SEQ ID NO: 509147 - DNA, 25 bp, Mus musculus
gatctctagacttttttaccacaaa

SEQ ID NO: 509148 - DNA, 25 bp, Mus musculus
gatctctagcacagcatcaaccaag

SEQ ID NO: 509149 - DNA, 25 bp, Mus musculus
gatctctagcactgcatcaaccaag

SEQ ID NO: 509150 - DNA, 25 bp, Mus musculus
gatctctagtttctctggtgtttgc

SEQ ID NO: 509151 - DNA, 25 bp, Mus musculus
gatctctagtttgtctggtgtttgc

SEQ ID NO: 509152 - DNA, 25 bp, Mus musculus
gatctctatctccatatcctcgatg

SEQ ID NO: 509153 - DNA, 25 bp, Mus musculus
gatctctatctcgatatcctcgatg

SEQ ID NO: 509154 - DNA, 25 bp, Mus musculus
gatctctatgagatttagtccagct

SEQ ID NO: 509155 - DNA, 25 bp, Mus musculus
gatctctatgagttttagtccagct

SEQ ID NO: 509156 - DNA, 25 bp, Mus musculus
gatctctcacaaaatctgagtcctc

SEQ ID NO: 509157 - DNA, 25 bp, Mus musculus
gatctctcacaatatctgagtcctc

SEQ ID NO: 509158 - DNA, 25 bp, Mus musculus
gatctctcagatccatgtaaaggca

SEQ ID NO: 509159 - DNA, 25 bp, Mus musculus
gatctctcagatgcatgtaaaggca

SEQ ID NO: 509160 - DNA, 25 bp, Mus musculus
gatctctcattcacagttggaagac

SEQ ID NO: 509161 - DNA, 25 bp, Mus musculus
gatctctcattctcagttggaagac

SEQ ID NO: 509162 - DNA, 25 bp, Mus musculus
gatctctccattcctggttcagggt

SEQ ID NO: 509163 - DNA, 25 bp, Mus musculus
gatctctccattgctggttcagggt

SEQ ID NO: 509164 - DNA, 25 bp, Mus musculus
gatctctccctgagagtgcatgcca

SEQ ID NO: 509165 - DNA, 25 bp, Mus musculus
gatctctccctgtgagtgcatgcca

SEQ ID NO: 509166 - DNA, 25 bp, Mus musculus
gatctctcctttaatcagccttatt

SEQ ID NO: 509167 - DNA, 25 bp, Mus musculus
gatctctccttttatcagccttatt

SEQ ID NO: 509168 - DNA, 25 bp, Mus musculus
gatctctcggttatacactcgggaa

SEQ ID NO: 509169 - DNA, 25 bp, Mus musculus
gatctctcggttttacactcgggaa

SEQ ID NO: 509170 - DNA, 25 bp, Mus musculus
gatctctctaggatccttgaagtca

SEQ ID NO: 509171 - DNA, 25 bp, Mus musculus
gatctctctaggttccttgaagtca

SEQ ID NO: 509172 - DNA, 25 bp, Mus musculus
gatctctctgttagacctggtcctg

SEQ ID NO: 509173 - DNA, 25 bp, Mus musculus
gatctctctgtttgacctggtcctg

SEQ ID NO: 509174 - DNA, 25 bp, Mus musculus
gatctctcttataggaaactcctag

SEQ ID NO: 509175 - DNA, 25 bp, Mus musculus
gatctctcttattggaaactcctag

SEQ ID NO: 509176 - DNA, 25 bp, Mus musculus
gatctctgaagtcggattgtcttat

SEQ ID NO: 509177 - DNA, 25 bp, Mus musculus
gatctctgaagtgggattgtcttat

SEQ ID NO: 509178 - DNA, 25 bp, Mus musculus
gatctctgagttcacaacggacagc

SEQ ID NO: 509179 - DNA, 25 bp, Mus musculus
gatctctgagttgacaacggacagc

SEQ ID NO: 509180 - DNA, 25 bp, Mus musculus
gatctctgcaaaaataaccctctgt

SEQ ID NO: 509181 - DNA, 25 bp, Mus musculus
gatctctgcaaatataaccctctgt

SEQ ID NO: 509182 - DNA, 25 bp, Mus musculus
gatctctgcaacctggacaatgctg

SEQ ID NO: 509183 - DNA, 25 bp, Mus musculus
gatctctgcaacgtggacaatgctg

SEQ ID NO: 509184 - DNA, 25 bp, Mus musculus
gatctctgccatattgagtacttgt

SEQ ID NO: 509185 - DNA, 25 bp, Mus musculus
gatctctgccattttgagtacttgt

SEQ ID NO: 509186 - DNA, 25 bp, Mus musculus
gatctctgcccgcaatggtaaagca

SEQ ID NO: 509187 - DNA, 25 bp, Mus musculus
gatctctgcccggaatggtaaagca

SEQ ID NO: 509188 - DNA, 25 bp, Mus musculus
gatctctgctaacttctcatttgtt

SEQ ID NO: 509189 - DNA, 25 bp, Mus musculus
gatctctgctaagttctcatttgtt

SEQ ID NO: 509190 - DNA, 25 bp, Mus musculus
gatctctgctcaacatttaaggtga

SEQ ID NO: 509191 - DNA, 25 bp, Mus musculus
gatctctgctcatcatttaaggtga

SEQ ID NO: 509192 - DNA, 25 bp, Mus musculus
gatctctgctgtatttcctatggag

SEQ ID NO: 509193 - DNA, 25 bp, Mus musculus
gatctctgctgtttttcctatggag

SEQ ID NO: 509194 - DNA, 25 bp, Mus musculus
gatctctgcttacacaatggcttct

SEQ ID NO: 509195 - DNA, 25 bp, Mus musculus
gatctctgcttagacaatggcttct

SEQ ID NO: 509196 - DNA, 25 bp, Mus musculus
gatctctggatcaactcaagtgcag

SEQ ID NO: 509197 - DNA, 25 bp, Mus musculus
gatctctggatctactcaagtgcag

SEQ ID NO: 509198 - DNA, 25 bp, Mus musculus
gatctctggcagaggaggaaatctc

SEQ ID NO: 509199 - DNA, 25 bp, Mus musculus
gatctctggcagtggaggaaatctc

SEQ ID NO: 509200 - DNA, 25 bp, Mus musculus
gatctctggcctctagtatgcttta

SEQ ID NO: 509201 - DNA, 25 bp, Mus musculus
gatctctggcctgtagtatgcttta

SEQ ID NO: 509202 - DNA, 25 bp, Mus musculus
gatctctggcggcaaaggtcaattc

SEQ ID NO: 509203 - DNA, 25 bp, Mus musculus
gatctctggcgggaaaggtcaattc

SEQ ID NO: 509204 - DNA, 25 bp, Mus musculus
gatctctgggtaaccttctgttgca

SEQ ID NO: 509205 - DNA, 25 bp, Mus musculus
gatctctgggtatccttctgttgca

SEQ ID NO: 509206 - DNA, 25 bp, Mus musculus
gatctctggtgtctttttcacccaa

SEQ ID NO: 509207 - DNA, 25 bp, Mus musculus
gatctctggtgtgtttttcacccaa

SEQ ID NO: 509208 - DNA, 25 bp, Mus musculus
gatctctgtacacaaacctacatat

SEQ ID NO: 509209 - DNA, 25 bp, Mus musculus
gatctctgtacagaaacctacatat

SEQ ID NO: 509210 - DNA, 25 bp, Mus musculus
gatctctgtcagatcaagtcaagct

SEQ ID NO: 509211 - DNA, 25 bp, Mus musculus
gatctctgtcagttcaagtcaagct

SEQ ID NO: 509212 - DNA, 25 bp, Mus musculus
gatctctgtcttacagtgacacaca

SEQ ID NO: 509213 - DNA, 25 bp, Mus musculus
gatctctgtctttcagtgacacaca

SEQ ID NO: 509214 - DNA, 25 bp, Mus musculus
gatctctgtgagactacatagtgac

SEQ ID NO: 509215 - DNA, 25 bp, Mus musculus
gatctctgtgagtctacatagtgac

SEQ ID NO: 509216 - DNA, 25 bp, Mus musculus
gatctctgttgaaatcagccacctg

SEQ ID NO: 509217 - DNA, 25 bp, Mus musculus
gatctctgttgatatcagccacctg

SEQ ID NO: 509218 - DNA, 25 bp, Mus musculus
gatctcttaaggaattatgacccac

SEQ ID NO: 509219 - DNA, 25 bp, Mus musculus
gatctcttaaggtattatgacccac

SEQ ID NO: 509220 - DNA, 25 bp, Mus musculus
gatctcttacggatagaaaacacaa

SEQ ID NO: 509221 - DNA, 25 bp, Mus musculus
gatctcttacggttagaaaacacaa

SEQ ID NO: 509222 - DNA, 25 bp, Mus musculus
gatctcttagagagcaggagccaga

SEQ ID NO: 509223 - DNA, 25 bp, Mus musculus
gatctcttagagtgcaggagccaga

SEQ ID NO: 509224 - DNA, 25 bp, Mus musculus
gatctcttaggactctgaaaccagc

SEQ ID NO: 509225 - DNA, 25 bp, Mus musculus
gatctcttaggagtctgaaaccagc

SEQ ID NO: 509226 - DNA, 25 bp, Mus musculus
gatctcttcactatcataaccttag

SEQ ID NO: 509227 - DNA, 25 bp, Mus musculus
gatctcttcactttcataaccttag

SEQ ID NO: 509228 - DNA, 25 bp, Mus musculus
gatctcttccaacatgcaccagcag

SEQ ID NO: 509229 - DNA, 25 bp, Mus musculus
gatctcttccaagatgcaccagcag

SEQ ID NO: 509230 - DNA, 25 bp, Mus musculus
gatctcttgagcctggtttcagagg

SEQ ID NO: 509231 - DNA, 25 bp, Mus musculus
gatctcttgagcgtggtttcagagg

SEQ ID NO: 509232 - DNA, 25 bp, Mus musculus
gatctcttgcccagctagacttggt

SEQ ID NO: 509233 - DNA, 25 bp, Mus musculus
gatctcttgccctgctagacttggt

SEQ ID NO: 509234 - DNA, 25 bp, Mus musculus
gatctcttgcttctgatgtcaaacc

SEQ ID NO: 509235 - DNA, 25 bp, Mus musculus
gatctcttgcttgtgatgtcaaacc

SEQ ID NO: 509236 - DNA, 25 bp, Mus musculus
gatctcttgggaatcaccatcaagt

SEQ ID NO: 509237 - DNA, 25 bp, Mus musculus
gatctcttgggattcaccatcaagt

SEQ ID NO: 509238 - DNA, 25 bp, Mus musculus
gatctcttgtgtagttgctctttgt

SEQ ID NO: 509239 - DNA, 25 bp, Mus musculus
gatctcttgtgttgttgctctttgt

SEQ ID NO: 509240 - DNA, 25 bp, Mus musculus
gatctctttagacaaatacgtcgag

SEQ ID NO: 509241 - DNA, 25 bp, Mus musculus
gatctctttagagaaatacgtcgag

SEQ ID NO: 509242 - DNA, 25 bp, Mus musculus
gatctctttagtctctttccactga

SEQ ID NO: 509243 - DNA, 25 bp, Mus musculus
gatctctttagtgtctttccactga

SEQ ID NO: 509244 - DNA, 25 bp, Mus musculus
gatctctttatgacagtgttcctta

SEQ ID NO: 509245 - DNA, 25 bp, Mus musculus
gatctctttatgtcagtgttcctta

SEQ ID NO: 509246 - DNA, 25 bp, Mus musculus
gatctctttcaacaaacagcctcca

SEQ ID NO: 509247 - DNA, 25 bp, Mus musculus
gatctctttcaagaaacagcctcca

SEQ ID NO: 509248 - DNA, 25 bp, Mus musculus
gatctctttgccctgtatttattga

SEQ ID NO: 509249 - DNA, 25 bp, Mus musculus
gatctctttgccgtgtatttattga

SEQ ID NO: 509250 - DNA, 25 bp, Mus musculus
gatctctttggaagatgctggtaaa

SEQ ID NO: 509251 - DNA, 25 bp, Mus musculus
gatctctttggatgatgctggtaaa

SEQ ID NO: 509252 - DNA, 25 bp, Mus musculus
gatctctttgtaactgtttgcttca

SEQ ID NO: 509253 - DNA, 25 bp, Mus musculus
gatctctttgtatctgtttgcttca

SEQ ID NO: 509254 - DNA, 25 bp, Mus musculus
gatctcttttatatagtctacccga

SEQ ID NO: 509255 - DNA, 25 bp, Mus musculus
gatctcttttatttagtctacccga

SEQ ID NO: 509256 - DNA, 25 bp, Mus musculus
gatctcttttcgatcaaggatagtc

SEQ ID NO: 509257 - DNA, 25 bp, Mus musculus
gatctcttttcgttcaaggatagtc

SEQ ID NO: 509258 - DNA, 25 bp, Mus musculus
gatctgaaaaccaatgtcttacatg

SEQ ID NO: 509259 - DNA, 25 bp, Mus musculus
gatctgaaaacctatgtcttacatg

SEQ ID NO: 509260 - DNA, 25 bp, Mus musculus
gatctgaaatctctgtacctgcgta

SEQ ID NO: 509261 - DNA, 25 bp, Mus musculus
gatctgaaatctgtgtacctgcgta

SEQ ID NO: 509262 - DNA, 25 bp, Mus musculus
gatctgaaatgaacccctgtagatt

SEQ ID NO: 509263 - DNA, 25 bp, Mus musculus
gatctgaaatgatcccctgtagatt

SEQ ID NO: 509264 - DNA, 25 bp, Mus musculus
gatctgaaccacctataccaaggct

SEQ ID NO: 509265 - DNA, 25 bp, Mus musculus
gatctgaaccacgtataccaaggct

SEQ ID NO: 509266 - DNA, 25 bp, Mus musculus
gatctgaactctcttcttagcaagg

SEQ ID NO: 509267 - DNA, 25 bp, Mus musculus
gatctgaactctgttcttagcaagg

SEQ ID NO: 509268 - DNA, 25 bp, Mus musculus
gatctgaactttctacaggaactct

SEQ ID NO: 509269 - DNA, 25 bp, Mus musculus
gatctgaactttgtacaggaactct

SEQ ID NO: 509270 - DNA, 25 bp, Mus musculus
gatctgaagaaaacgatggccgaaa

SEQ ID NO: 509271 - DNA, 25 bp, Mus musculus
gatctgaagaaatcgatggccgaaa

SEQ ID NO: 509272 - DNA, 25 bp, Mus musculus
gatctgaagatgaactcgggtgcaa

SEQ ID NO: 509273 - DNA, 25 bp, Mus musculus
gatctgaagatgatcgctcatccca

SEQ ID NO: 509274 - DNA, 25 bp, Mus musculus
gatctgaagatgtactcgggtgcaa

SEQ ID NO: 509275 - DNA, 25 bp, Mus musculus
gatctgaagatgttcgctcatccca

SEQ ID NO: 509276 - DNA, 25 bp, Mus musculus
gatctgaagtctcagcgcaatgtac

SEQ ID NO: 509277 - DNA, 25 bp, Mus musculus
gatctgaagtctgagcgcaatgtac

SEQ ID NO: 509278 - DNA, 25 bp, Mus musculus
gatctgaatccacagcccagaagca

SEQ ID NO: 509279 - DNA, 25 bp, Mus musculus
gatctgaatccagagcccagaagca

SEQ ID NO: 509280 - DNA, 25 bp, Mus musculus
gatctgaatctgaaatcccactcct

SEQ ID NO: 509281 - DNA, 25 bp, Mus musculus
gatctgaatctgtaatcccactcct

SEQ ID NO: 509282 - DNA, 25 bp, Mus musculus
gatctgaatttgcagagcacctgct

SEQ ID NO: 509283 - DNA, 25 bp, Mus musculus
gatctgaatttggagagcacctgct

SEQ ID NO: 509284 - DNA, 25 bp, Mus musculus
gatctgaattttcctacacattgta

SEQ ID NO: 509285 - DNA, 25 bp, Mus musculus
gatctgaattttcttttctgtcatc

SEQ ID NO: 509286 - DNA, 25 bp, Mus musculus
gatctgaattttgctacacattgta

SEQ ID NO: 509287 - DNA, 25 bp, Mus musculus
gatctgaattttgttttctgtcatc

SEQ ID NO: 509288 - DNA, 25 bp, Mus musculus
gatctgacaatcagggaggccaaca

SEQ ID NO: 509289 - DNA, 25 bp, Mus musculus
gatctgacaatctgggaggccaaca

SEQ ID NO: 509290 - DNA, 25 bp, Mus musculus
gatctgacacctctgtgggcacctg

SEQ ID NO: 509291 - DNA, 25 bp, Mus musculus
gatctgacacctgtgtgggcacctg

SEQ ID NO: 509292 - DNA, 25 bp, Mus musculus
gatctgacactgaaaattttgccaa

SEQ ID NO: 509293 - DNA, 25 bp, Mus musculus
gatctgacactgtaaattttgccaa

SEQ ID NO: 509294 - DNA, 25 bp, Mus musculus
gatctgacagacatgcacacgagcc

SEQ ID NO: 509295 - DNA, 25 bp, Mus musculus
gatctgacagacttgcacacgagcc

SEQ ID NO: 509296 - DNA, 25 bp, Mus musculus
gatctgacaggcactggttctttga

SEQ ID NO: 509297 - DNA, 25 bp, Mus musculus
gatctgacaggcatagacgaccgca

SEQ ID NO: 509298 - DNA, 25 bp, Mus musculus
gatctgacaggctctggttctttga

SEQ ID NO: 509299 - DNA, 25 bp, Mus musculus
gatctgacaggcttagacgaccgca

SEQ ID NO: 509300 - DNA, 25 bp, Mus musculus
gatctgacagtgacgtcgtacctgt

SEQ ID NO: 509301 - DNA, 25 bp, Mus musculus
gatctgacagtgtcgtcgtacctgt

SEQ ID NO: 509302 - DNA, 25 bp, Mus musculus
gatctgaccatacctttggactggg

SEQ ID NO: 509303 - DNA, 25 bp, Mus musculus
gatctgaccatagctttggactggg

SEQ ID NO: 509304 - DNA, 25 bp, Mus musculus
gatctgacccagctactgtgatgga

SEQ ID NO: 509305 - DNA, 25 bp, Mus musculus
gatctgacccaggtactgtgatgga

SEQ ID NO: 509306 - DNA, 25 bp, Mus musculus
gatctgaccctccagactttgagaa

SEQ ID NO: 509307 - DNA, 25 bp, Mus musculus
gatctgaccctcgagactttgagaa

SEQ ID NO: 509308 - DNA, 25 bp, Mus musculus
gatctgacccttctgacttcagtgg

SEQ ID NO: 509309 - DNA, 25 bp, Mus musculus
gatctgacccttgtgacttcagtgg

SEQ ID NO: 509310 - DNA, 25 bp, Mus musculus
gatctgacgctccaaatgcttctgg

SEQ ID NO: 509311 - DNA, 25 bp, Mus musculus
gatctgacgctcgaaatgcttctgg

SEQ ID NO: 509312 - DNA, 25 bp, Mus musculus
gatctgactaataacaactcctcct

SEQ ID NO: 509313 - DNA, 25 bp, Mus musculus
gatctgactaattacaactcctcct

SEQ ID NO: 509314 - DNA, 25 bp, Mus musculus
gatctgactactctgcaactcaagg

SEQ ID NO: 509315 - DNA, 25 bp, Mus musculus
gatctgactactgtgcaactcaagg

SEQ ID NO: 509316 - DNA, 25 bp, Mus musculus
gatctgactgaaatgattgggcaat

SEQ ID NO: 509317 - DNA, 25 bp, Mus musculus
gatctgactgaattgattgggcaat

SEQ ID NO: 509318 - DNA, 25 bp, Mus musculus
gatctgactttcaaacaggacgttt

SEQ ID NO: 509319 - DNA, 25 bp, Mus musculus
gatctgactttctaacaggacgttt

SEQ ID NO: 509320 - DNA, 25 bp, Mus musculus
gatctgagaaatctggcccctggtg

SEQ ID NO: 509321 - DNA, 25 bp, Mus musculus
gatctgagaaatgtggcccctggtg

SEQ ID NO: 509322 - DNA, 25 bp, Mus musculus
gatctgagacagatatagcttggca

SEQ ID NO: 509323 - DNA, 25 bp, Mus musculus
gatctgagacagttatagcttggca

SEQ ID NO: 509324 - DNA, 25 bp, Mus musculus
gatctgagactgagcttatcctagt

SEQ ID NO: 509325 - DNA, 25 bp, Mus musculus
gatctgagactgtgcttatcctagt

SEQ ID NO: 509326 - DNA, 25 bp, Mus musculus
gatctgagagccctggtgcccacct

SEQ ID NO: 509327 - DNA, 25 bp, Mus musculus
gatctgagagccgtggtgcccacct

SEQ ID NO: 509328 - DNA, 25 bp, Mus musculus
gatctgagcaacatcttcctggaag

SEQ ID NO: 509329 - DNA, 25 bp, Mus musculus
gatctgagcaacttcttcctggaag

SEQ ID NO: 509330 - DNA, 25 bp, Mus musculus
gatctgagccataacgcagctcaaa

SEQ ID NO: 509331 - DNA, 25 bp, Mus musculus
gatctgagccattacgcagctcaaa

SEQ ID NO: 509332 - DNA, 25 bp, Mus musculus
gatctgagcgggaactgaagccttt

SEQ ID NO: 509333 - DNA, 25 bp, Mus musculus
gatctgagcgggtactgaagccttt

SEQ ID NO: 509334 - DNA, 25 bp, Mus musculus
gatctgagcttccatgttgctctat

SEQ ID NO: 509335 - DNA, 25 bp, Mus musculus
gatctgagcttcgatgttgctctat

SEQ ID NO: 509336 - DNA, 25 bp, Mus musculus
gatctgaggactctaaaacccctgt

SEQ ID NO: 509337 - DNA, 25 bp, Mus musculus
gatctgaggactgtaaaacccctgt

SEQ ID NO: 509338 - DNA, 25 bp, Mus musculus
gatctgaggctgaatccatgatgaa

SEQ ID NO: 509339 - DNA, 25 bp, Mus musculus
gatctgaggctgtatccatgatgaa

SEQ ID NO: 509340 - DNA, 25 bp, Mus musculus
gatctgagggcaaatgctgtggtcc

SEQ ID NO: 509341 - DNA, 25 bp, Mus musculus
gatctgagggcatatgctgtggtcc

SEQ ID NO: 509342 - DNA, 25 bp, Mus musculus
gatctgagtaaccatttcctctgtg

SEQ ID NO: 509343 - DNA, 25 bp, Mus musculus
gatctgagtaacgatttcctctgtg

SEQ ID NO: 509344 - DNA, 25 bp, Mus musculus
gatctgagtcagagaagtccgccga

SEQ ID NO: 509345 - DNA, 25 bp, Mus musculus
gatctgagtcagtgaagtccgccga

SEQ ID NO: 509346 - DNA, 25 bp, Mus musculus
gatctgagtgagacatttcttcctg

SEQ ID NO: 509347 - DNA, 25 bp, Mus musculus
gatctgagtgagtcatttcttcctg

SEQ ID NO: 509348 - DNA, 25 bp, Mus musculus
gatctgagtgcaaaaccatccctcg

SEQ ID NO: 509349 - DNA, 25 bp, Mus musculus
gatctgagtgcataaccatccctcg

SEQ ID NO: 509350 - DNA, 25 bp, Mus musculus
gatctgagttcaagcagtagcctgg

SEQ ID NO: 509351 - DNA, 25 bp, Mus musculus
gatctgagttcatgcagtagcctgg

SEQ ID NO: 509352 - DNA, 25 bp, Mus musculus
gatctgagtttgatctggtgtacag

SEQ ID NO: 509353 - DNA, 25 bp, Mus musculus
gatctgagtttgcaaaccaaccata

SEQ ID NO: 509354 - DNA, 25 bp, Mus musculus
gatctgagtttggaaaccaaccata

SEQ ID NO: 509355 - DNA, 25 bp, Mus musculus
gatctgagtttgttctggtgtacag

SEQ ID NO: 509356 - DNA, 25 bp, Mus musculus
gatctgatccagagcgtgttaacag

SEQ ID NO: 509357 - DNA, 25 bp, Mus musculus
gatctgatccagtgcgtgttaacag

SEQ ID NO: 509358 - DNA, 25 bp, Mus musculus
gatctgatcctcatcgattacctga

SEQ ID NO: 509359 - DNA, 25 bp, Mus musculus
gatctgatcctcttcgattacctga

SEQ ID NO: 509360 - DNA, 25 bp, Mus musculus
gatctgatcgatatgtgttgcctga

SEQ ID NO: 509361 - DNA, 25 bp, Mus musculus
gatctgatcgatttgtgttgcctga

SEQ ID NO: 509362 - DNA, 25 bp, Mus musculus
gatctgatctcaacagggtgtcgta

SEQ ID NO: 509363 - DNA, 25 bp, Mus musculus
gatctgatctcatcagggtgtcgta

SEQ ID NO: 509364 - DNA, 25 bp, Mus musculus
gatctgatcttgctcacagtaggtg

SEQ ID NO: 509365 - DNA, 25 bp, Mus musculus
gatctgatcttggtcacagtaggtg

SEQ ID NO: 509366 - DNA, 25 bp, Mus musculus
gatctgatgctcactaatggactcc

SEQ ID NO: 509367 - DNA, 25 bp, Mus musculus
gatctgatgctctctaatggactcc

SEQ ID NO: 509368 - DNA, 25 bp, Mus musculus
gatctgatggagagagcggccccac

SEQ ID NO: 509369 - DNA, 25 bp, Mus musculus
gatctgatggagtgagcggccccac

SEQ ID NO: 509370 - DNA, 25 bp, Mus musculus
gatctgatggcaccacatgccgaca

SEQ ID NO: 509371 - DNA, 25 bp, Mus musculus
gatctgatggcagcacatgccgaca

SEQ ID NO: 509372 - DNA, 25 bp, Mus musculus
gatctgatggtgatcagggactcca

SEQ ID NO: 509373 - DNA, 25 bp, Mus musculus
gatctgatggtgttcagggactcca

SEQ ID NO: 509374 - DNA, 25 bp, Mus musculus
gatctgatgtctactagattatctg

SEQ ID NO: 509375 - DNA, 25 bp, Mus musculus
gatctgatgtctactctgaccaaga

SEQ ID NO: 509376 - DNA, 25 bp, Mus musculus
gatctgatgtcttctagattatctg

SEQ ID NO: 509377 - DNA, 25 bp, Mus musculus
gatctgatgtcttctctgaccaaga

SEQ ID NO: 509378 - DNA, 25 bp, Mus musculus
gatctgattaccattattgcatcaa

SEQ ID NO: 509379 - DNA, 25 bp, Mus musculus
gatctgattacctttattgcatcaa

SEQ ID NO: 509380 - DNA, 25 bp, Mus musculus
gatctgattcgaactatgccaggca

SEQ ID NO: 509381 - DNA, 25 bp, Mus musculus
gatctgattcgatctatgccaggca

SEQ ID NO: 509382 - DNA, 25 bp, Mus musculus
gatctgattctaataactgttcttt

SEQ ID NO: 509383 - DNA, 25 bp, Mus musculus
gatctgattctattaactgttcttt

SEQ ID NO: 509384 - DNA, 25 bp, Mus musculus
gatctgattgacatctattgaccct

SEQ ID NO: 509385 - DNA, 25 bp, Mus musculus
gatctgattgacttctattgaccct

SEQ ID NO: 509386 - DNA, 25 bp, Mus musculus
gatctgattttgaattagcttggca

SEQ ID NO: 509387 - DNA, 25 bp, Mus musculus
gatctgattttgtattagcttggca

SEQ ID NO: 509388 - DNA, 25 bp, Mus musculus
gatctgcaaactcaaagacatgtac

SEQ ID NO: 509389 - DNA, 25 bp, Mus musculus
gatctgcaaactgaaagacatgtac

SEQ ID NO: 509390 - DNA, 25 bp, Mus musculus
gatctgcaatatatttagggttctt

SEQ ID NO: 509391 - DNA, 25 bp, Mus musculus
gatctgcaatatttttagggttctt

SEQ ID NO: 509392 - DNA, 25 bp, Mus musculus
gatctgcacactctatttctcagta

SEQ ID NO: 509393 - DNA, 25 bp, Mus musculus
gatctgcacactgtatttctcagta

SEQ ID NO: 509394 - DNA, 25 bp, Mus musculus
gatctgcacagacgaatcgactggt

SEQ ID NO: 509395 - DNA, 25 bp, Mus musculus
gatctgcacagaggaatcgactggt

SEQ ID NO: 509396 - DNA, 25 bp, Mus musculus
gatctgcacctgactgtggttgcca

SEQ ID NO: 509397 - DNA, 25 bp, Mus musculus
gatctgcacctgtctgtggttgcca

SEQ ID NO: 509398 - DNA, 25 bp, Mus musculus
gatctgcacgctcagcaggcaggac

SEQ ID NO: 509399 - DNA, 25 bp, Mus musculus
gatctgcacgctgagcaggcaggac

SEQ ID NO: 509400 - DNA, 25 bp, Mus musculus
gatctgcagaaactctgggagacct

SEQ ID NO: 509401 - DNA, 25 bp, Mus musculus
gatctgcagaaagtctgggagacct

SEQ ID NO: 509402 - DNA, 25 bp, Mus musculus
gatctgcagactcgaccttacagct

SEQ ID NO: 509403 - DNA, 25 bp, Mus musculus
gatctgcagactggaccttacagct

SEQ ID NO: 509404 - DNA, 25 bp, Mus musculus
gatctgcagagcaaactgtaccctt

SEQ ID NO: 509405 - DNA, 25 bp, Mus musculus
gatctgcagagctaactgtaccctt

SEQ ID NO: 509406 - DNA, 25 bp, Mus musculus
gatctgcagcaaaataaaggcctgt

SEQ ID NO: 509407 - DNA, 25 bp, Mus musculus
gatctgcagcaatataaaggcctgt

SEQ ID NO: 509408 - DNA, 25 bp, Mus musculus
gatctgcagcatctatcccaaagct

SEQ ID NO: 509409 - DNA, 25 bp, Mus musculus
gatctgcagcatgtatcccaaagct

SEQ ID NO: 509410 - DNA, 25 bp, Mus musculus
gatctgcagctcaggagctaccact

SEQ ID NO: 509411 - DNA, 25 bp, Mus musculus
gatctgcagctctggagctaccact

SEQ ID NO: 509412 - DNA, 25 bp, Mus musculus
gatctgcagggcactgcctgatttg

SEQ ID NO: 509413 - DNA, 25 bp, Mus musculus
gatctgcagggctctgcctgatttg

SEQ ID NO: 509414 - DNA, 25 bp, Mus musculus
gatctgcatggcctgtaatctttga

SEQ ID NO: 509415 - DNA, 25 bp, Mus musculus
gatctgcatggcgtgtaatctttga

SEQ ID NO: 509416 - DNA, 25 bp, Mus musculus
gatctgcatggtactggccagccta

SEQ ID NO: 509417 - DNA, 25 bp, Mus musculus
gatctgcatggttctggccagccta

SEQ ID NO: 509418 - DNA, 25 bp, Mus musculus
gatctgcatgtgagcgtgagattca

SEQ ID NO: 509419 - DNA, 25 bp, Mus musculus
gatctgcatgtgtgcgtgagattca

SEQ ID NO: 509420 - DNA, 25 bp, Mus musculus
gatctgcattttcaagaaggctggc

SEQ ID NO: 509421 - DNA, 25 bp, Mus musculus
gatctgcattttgaagaaggctggc

SEQ ID NO: 509422 - DNA, 25 bp, Mus musculus
gatctgccaacgagtgacagctgca

SEQ ID NO: 509423 - DNA, 25 bp, Mus musculus
gatctgccaacgtgtgacagctgca

SEQ ID NO: 509424 - DNA, 25 bp, Mus musculus
gatctgccaaggattatagtttgct

SEQ ID NO: 509425 - DNA, 25 bp, Mus musculus
gatctgccaaggtttatagtttgct

SEQ ID NO: 509426 - DNA, 25 bp, Mus musculus
gatctgccactaatctaggaggtct

SEQ ID NO: 509427 - DNA, 25 bp, Mus musculus
gatctgccactattctaggaggtct

SEQ ID NO: 509428 - DNA, 25 bp, Mus musculus
gatctgccagtacttctgtacacat

SEQ ID NO: 509429 - DNA, 25 bp, Mus musculus
gatctgccagtagttctgtacacat

SEQ ID NO: 509430 - DNA, 25 bp, Mus musculus
gatctgccatccagtctgtagctgg

SEQ ID NO: 509431 - DNA, 25 bp, Mus musculus
gatctgccatcctgtctgtagctgg

SEQ ID NO: 509432 - DNA, 25 bp, Mus musculus
gatctgccatggattctatttatgc

SEQ ID NO: 509433 - DNA, 25 bp, Mus musculus
gatctgccatggtttctatttatgc

SEQ ID NO: 509434 - DNA, 25 bp, Mus musculus
gatctgcccatgcaaagagcatcta

SEQ ID NO: 509435 - DNA, 25 bp, Mus musculus
gatctgcccatggaaagagcatcta

SEQ ID NO: 509436 - DNA, 25 bp, Mus musculus
gatctgccctaccactactatgaca

SEQ ID NO: 509437 - DNA, 25 bp, Mus musculus
gatctgccctacgactactatgaca

SEQ ID NO: 509438 - DNA, 25 bp, Mus musculus
gatctgccctagagtctcgttgata

SEQ ID NO: 509439 - DNA, 25 bp, Mus musculus
gatctgccctagtgtctcgttgata

SEQ ID NO: 509440 - DNA, 25 bp, Mus musculus
gatctgccgccaccttgaaaatgaa

SEQ ID NO: 509441 - DNA, 25 bp, Mus musculus
gatctgccgccagcttgaaaatgaa

SEQ ID NO: 509442 - DNA, 25 bp, Mus musculus
gatctgccgtggaattggtatcgta

SEQ ID NO: 509443 - DNA, 25 bp, Mus musculus
gatctgccgtggtattggtatcgta

SEQ ID NO: 509444 - DNA, 25 bp, Mus musculus
gatctgcctcttctaaatggagcta

SEQ ID NO: 509445 - DNA, 25 bp, Mus musculus
gatctgcctcttgtaaatggagcta

SEQ ID NO: 509446 - DNA, 25 bp, Mus musculus
gatctgcctgttctagtcttagcct

SEQ ID NO: 509447 - DNA, 25 bp, Mus musculus
gatctgcctgttgtagtcttagcct

SEQ ID NO: 509448 - DNA, 25 bp, Mus musculus
gatctgccttgtatctgtgacttca

SEQ ID NO: 509449 - DNA, 25 bp, Mus musculus
gatctgccttgtttctgtgacttca

SEQ ID NO: 509450 - DNA, 25 bp, Mus musculus
gatctgccttttcggaccttgctag

SEQ ID NO: 509451 - DNA, 25 bp, Mus musculus
gatctgccttttgggaccttgctag

SEQ ID NO: 509452 - DNA, 25 bp, Mus musculus
gatctgcgcagacttgccacataca

SEQ ID NO: 509453 - DNA, 25 bp, Mus musculus
gatctgcgcagagttgccacataca

SEQ ID NO: 509454 - DNA, 25 bp, Mus musculus
gatctgcgtcagctgtatttttgat

SEQ ID NO: 509455 - DNA, 25 bp, Mus musculus
gatctgcgtcaggtgtatttttgat

SEQ ID NO: 509456 - DNA, 25 bp, Mus musculus
gatctgcgtgtgctggatacccaaa

SEQ ID NO: 509457 - DNA, 25 bp, Mus musculus
gatctgcgtgtggtggatacccaaa

SEQ ID NO: 509458 - DNA, 25 bp, Mus musculus
gatctgctactgcaacttcagcgaa

SEQ ID NO: 509459 - DNA, 25 bp, Mus musculus
gatctgctactggaacttcagcgaa

SEQ ID NO: 509460 - DNA, 25 bp, Mus musculus
gatctgctagaacctgtgccaaggt

SEQ ID NO: 509461 - DNA, 25 bp, Mus musculus
gatctgctagaagctgtgccaaggt

SEQ ID NO: 509462 - DNA, 25 bp, Mus musculus
gatctgctatagatctcaccctgaa

SEQ ID NO: 509463 - DNA, 25 bp, Mus musculus
gatctgctatagttctcaccctgaa

SEQ ID NO: 509464 - DNA, 25 bp, Mus musculus
gatctgctccaacaaatgtctgtga

SEQ ID NO: 509465 - DNA, 25 bp, Mus musculus
gatctgctccaagaaatgtctgtga

SEQ ID NO: 509466 - DNA, 25 bp, Mus musculus
gatctgctcctgcaggtggtaacaa

SEQ ID NO: 509467 - DNA, 25 bp, Mus musculus
gatctgctcctggaggtggtaacaa

SEQ ID NO: 509468 - DNA, 25 bp, Mus musculus
gatctgctctctaagaagaggctga

SEQ ID NO: 509469 - DNA, 25 bp, Mus musculus
gatctgctctcttagaagaggctga

SEQ ID NO: 509470 - DNA, 25 bp, Mus musculus
gatctgctgaaaaagtatcttttat

SEQ ID NO: 509471 - DNA, 25 bp, Mus musculus
gatctgctgaaatagtatcttttat

SEQ ID NO: 509472 - DNA, 25 bp, Mus musculus
gatctgctgatgatacgtcgcacag

SEQ ID NO: 509473 - DNA, 25 bp, Mus musculus
gatctgctgatgttacgtcgcacag

SEQ ID NO: 509474 - DNA, 25 bp, Mus musculus
gatctgctgctacgtatgtctgaac

SEQ ID NO: 509475 - DNA, 25 bp, Mus musculus
gatctgctgctaggtatgtctgaac

SEQ ID NO: 509476 - DNA, 25 bp, Mus musculus
gatctgctggaaagactggctgcac

SEQ ID NO: 509477 - DNA, 25 bp, Mus musculus
gatctgctggaatgactggctgcac

SEQ ID NO: 509478 - DNA, 25 bp, Mus musculus
gatctgctggccatgtatagattaa

SEQ ID NO: 509479 - DNA, 25 bp, Mus musculus
gatctgctggccttgtatagattaa

SEQ ID NO: 509480 - DNA, 25 bp, Mus musculus
gatctgctgtagaacttcactgtgg

SEQ ID NO: 509481 - DNA, 25 bp, Mus musculus
gatctgctgtagtacttcactgtgg

SEQ ID NO: 509482 - DNA, 25 bp, Mus musculus
gatctgctgtggcacagggcctctt

SEQ ID NO: 509483 - DNA, 25 bp, Mus musculus
gatctgctgtgggacagggcctctt

SEQ ID NO: 509484 - DNA, 25 bp, Mus musculus
gatctgcttagtaaggtatacctcg

SEQ ID NO: 509485 - DNA, 25 bp, Mus musculus
gatctgcttagttaggtatacctcg

SEQ ID NO: 509486 - DNA, 25 bp, Mus musculus
gatctgcttcagaacagggcccata

SEQ ID NO: 509487 - DNA, 25 bp, Mus musculus
gatctgcttcagacaatccattctc

SEQ ID NO: 509488 - DNA, 25 bp, Mus musculus
gatctgcttcagtacagggcccata

SEQ ID NO: 509489 - DNA, 25 bp, Mus musculus
gatctgcttcagtcaatccattctc

SEQ ID NO: 509490 - DNA, 25 bp, Mus musculus
gatctgcttcataatttcacggtta

SEQ ID NO: 509491 - DNA, 25 bp, Mus musculus
gatctgcttcattatttcacggtta

SEQ ID NO: 509492 - DNA, 25 bp, Mus musculus
gatctgcttccaacatgtctcacag

SEQ ID NO: 509493 - DNA, 25 bp, Mus musculus
gatctgcttccatcatgtctcacag

SEQ ID NO: 509494 - DNA, 25 bp, Mus musculus
gatctgcttcccattgtggtgaatt

SEQ ID NO: 509495 - DNA, 25 bp, Mus musculus
gatctgcttccctttgtggtgaatt

SEQ ID NO: 509496 - DNA, 25 bp, Mus musculus
gatctgcttctgcacagagacccaa

SEQ ID NO: 509497 - DNA, 25 bp, Mus musculus
gatctgcttctggacagagacccaa

SEQ ID NO: 509498 - DNA, 25 bp, Mus musculus
gatctgctttgtcttagaacgccgg

SEQ ID NO: 509499 - DNA, 25 bp, Mus musculus
gatctgctttgtgttagaacgccgg

SEQ ID NO: 509500 - DNA, 25 bp, Mus musculus
gatctgctttttctaagtgtgtggt

SEQ ID NO: 509501 - DNA, 25 bp, Mus musculus
gatctgctttttgtaagtgtgtggt

SEQ ID NO: 509502 - DNA, 25 bp, Mus musculus
gatctggaaaagcaacactgcccaa

SEQ ID NO: 509503 - DNA, 25 bp, Mus musculus
gatctggaaaaggaacactgcccaa

SEQ ID NO: 509504 - DNA, 25 bp, Mus musculus
gatctggaaaggctatgccttccaa

SEQ ID NO: 509505 - DNA, 25 bp, Mus musculus
gatctggaaagggtatgccttccaa

SEQ ID NO: 509506 - DNA, 25 bp, Mus musculus
gatctggaacatcgacacgtctgct

SEQ ID NO: 509507 - DNA, 25 bp, Mus musculus
gatctggaacatggacacgtctgct

SEQ ID NO: 509508 - DNA, 25 bp, Mus musculus
gatctggaagatcaagtctatgcac

SEQ ID NO: 509509 - DNA, 25 bp, Mus musculus
gatctggaagatgaagtctatgcac

SEQ ID NO: 509510 - DNA, 25 bp, Mus musculus
gatctggaatctctggctatgccaa

SEQ ID NO: 509511 - DNA, 25 bp, Mus musculus
gatctggaatctgtggctatgccaa

SEQ ID NO: 509512 - DNA, 25 bp, Mus musculus
gatctggaattcatcagctttagaa

SEQ ID NO: 509513 - DNA, 25 bp, Mus musculus
gatctggaattcttcagctttagaa

SEQ ID NO: 509514 - DNA, 25 bp, Mus musculus
gatctggaattgattactttctaca

SEQ ID NO: 509515 - DNA, 25 bp, Mus musculus
gatctggaattgtttactttctaca

SEQ ID NO: 509516 - DNA, 25 bp, Mus musculus
gatctggacagaattactaatgagt

SEQ ID NO: 509517 - DNA, 25 bp, Mus musculus
gatctggacagactgaaaactagta

SEQ ID NO: 509518 - DNA, 25 bp, Mus musculus
gatctggacagagtgaaaactagta

SEQ ID NO: 509519 - DNA, 25 bp, Mus musculus
gatctggacagatttactaatgagt

SEQ ID NO: 509520 - DNA, 25 bp, Mus musculus
gatctggacatgcagttgtctctga

SEQ ID NO: 509521 - DNA, 25 bp, Mus musculus
gatctggacatggagttgtctctga

SEQ ID NO: 509522 - DNA, 25 bp, Mus musculus
gatctggaccacattgatgaattac

SEQ ID NO: 509523 - DNA, 25 bp, Mus musculus
gatctggaccactttgatgaattac

SEQ ID NO: 509524 - DNA, 25 bp, Mus musculus
gatctggaccctacagttgctttat

SEQ ID NO: 509525 - DNA, 25 bp, Mus musculus
gatctggacccttcagttgctttat

SEQ ID NO: 509526 - DNA, 25 bp, Mus musculus
gatctggactatatttgttgaccta

SEQ ID NO: 509527 - DNA, 25 bp, Mus musculus
gatctggactatttttgttgaccta

SEQ ID NO: 509528 - DNA, 25 bp, Mus musculus
gatctggagattacacagggcaatc

SEQ ID NO: 509529 - DNA, 25 bp, Mus musculus
gatctggagatttcacagggcaatc

SEQ ID NO: 509530 - DNA, 25 bp, Mus musculus
gatctggagcctagtggtctggtct

SEQ ID NO: 509531 - DNA, 25 bp, Mus musculus
gatctggagccttgtggtctggtct

SEQ ID NO: 509532 - DNA, 25 bp, Mus musculus
gatctggagcgcacagttctttatt

SEQ ID NO: 509533 - DNA, 25 bp, Mus musculus
gatctggagcgcatgcaagccgcca

SEQ ID NO: 509534 - DNA, 25 bp, Mus musculus
gatctggagcgctcagttctttatt

SEQ ID NO: 509535 - DNA, 25 bp, Mus musculus
gatctggagcgcttgcaagccgcca

SEQ ID NO: 509536 - DNA, 25 bp, Mus musculus
gatctggagcttaccctcaggtgtg

SEQ ID NO: 509537 - DNA, 25 bp, Mus musculus
gatctggagctttccctcaggtgtg

SEQ ID NO: 509538 - DNA, 25 bp, Mus musculus
gatctggaggacaccaacgttcctg

SEQ ID NO: 509539 - DNA, 25 bp, Mus musculus
gatctggaggactccaacgttcctg

SEQ ID NO: 509540 - DNA, 25 bp, Mus musculus
gatctggaggcgatcctttgacacc

SEQ ID NO: 509541 - DNA, 25 bp, Mus musculus
gatctggaggcgttcctttgacacc

SEQ ID NO: 509542 - DNA, 25 bp, Mus musculus
gatctggagtaactgtgcatccgca

SEQ ID NO: 509543 - DNA, 25 bp, Mus musculus
gatctggagtaagtgtgcatccgca

SEQ ID NO: 509544 - DNA, 25 bp, Mus musculus
gatctggataagacctcactgagac

SEQ ID NO: 509545 - DNA, 25 bp, Mus musculus
gatctggataagtcctcactgagac

SEQ ID NO: 509546 - DNA, 25 bp, Mus musculus
gatctggatgaaaacgagtgtggta

SEQ ID NO: 509547 - DNA, 25 bp, Mus musculus
gatctggatgaatacgagtgtggta

SEQ ID NO: 509548 - DNA, 25 bp, Mus musculus
gatctggatgatactgcacatgcaa

SEQ ID NO: 509549 - DNA, 25 bp, Mus musculus
gatctggatgattctgcacatgcaa

SEQ ID NO: 509550 - DNA, 25 bp, Mus musculus
gatctggattctatcttagcactat

SEQ ID NO: 509551 - DNA, 25 bp, Mus musculus
gatctggattctttcttagcactat

SEQ ID NO: 509552 - DNA, 25 bp, Mus musculus
gatctggcagtcatagcttggcacc

SEQ ID NO: 509553 - DNA, 25 bp, Mus musculus
gatctggcagtcttagcttggcacc

SEQ ID NO: 509554 - DNA, 25 bp, Mus musculus
gatctggcctgcaaagtgtttttct

SEQ ID NO: 509555 - DNA, 25 bp, Mus musculus
gatctggcctgctaagtgtttttct

SEQ ID NO: 509556 - DNA, 25 bp, Mus musculus
gatctgggaagtaaatttcatcatt

SEQ ID NO: 509557 - DNA, 25 bp, Mus musculus
gatctgggaagttaatttcatcatt

SEQ ID NO: 509558 - DNA, 25 bp, Mus musculus
gatctgggacagatttcactctcac

SEQ ID NO: 509559 - DNA, 25 bp, Mus musculus
gatctgggacagttttcactctcac

SEQ ID NO: 509560 - DNA, 25 bp, Mus musculus
gatctgggagaaccaagccttggtt

SEQ ID NO: 509561 - DNA, 25 bp, Mus musculus
gatctgggagaagcaagccttggtt

SEQ ID NO: 509562 - DNA, 25 bp, Mus musculus
gatctgggcaagattattctctcac

SEQ ID NO: 509563 - DNA, 25 bp, Mus musculus
gatctgggcaagtttattctctcac

SEQ ID NO: 509564 - DNA, 25 bp, Mus musculus
gatctgggccacagaatacagctct

SEQ ID NO: 509565 - DNA, 25 bp, Mus musculus
gatctgggccactgaatacagctct

SEQ ID NO: 509566 - DNA, 25 bp, Mus musculus
gatctgggtattattggaccacatt

SEQ ID NO: 509567 - DNA, 25 bp, Mus musculus
gatctgggtatttttggaccacatt

SEQ ID NO: 509568 - DNA, 25 bp, Mus musculus
gatctgggtctaaaaactctcctgc

SEQ ID NO: 509569 - DNA, 25 bp, Mus musculus
gatctgggtctataaactctcctgc

SEQ ID NO: 509570 - DNA, 25 bp, Mus musculus
gatctgggtgccacatgtcctcagg

SEQ ID NO: 509571 - DNA, 25 bp, Mus musculus
gatctgggtgccattgcagtgcagc

SEQ ID NO: 509572 - DNA, 25 bp, Mus musculus
gatctgggtgcctcatgtcctcagg

SEQ ID NO: 509573 - DNA, 25 bp, Mus musculus
gatctgggtgcctttgcagtgcagc

SEQ ID NO: 509574 - DNA, 25 bp, Mus musculus
gatctgggtgtactcaattgcattt

SEQ ID NO: 509575 - DNA, 25 bp, Mus musculus
gatctgggtgtagtcaattgcattt

SEQ ID NO: 509576 - DNA, 25 bp, Mus musculus
gatctgggttcacgcaagggcattt

SEQ ID NO: 509577 - DNA, 25 bp, Mus musculus
gatctgggttcaggcaagggcattt

SEQ ID NO: 509578 - DNA, 25 bp, Mus musculus
gatctgggtttcacctccaggtagg

SEQ ID NO: 509579 - DNA, 25 bp, Mus musculus
gatctgggtttctcctccaggtagg

SEQ ID NO: 509580 - DNA, 25 bp, Mus musculus
gatctggtactcctaactccctggt

SEQ ID NO: 509581 - DNA, 25 bp, Mus musculus
gatctggtactcgtaactccctggt

SEQ ID NO: 509582 - DNA, 25 bp, Mus musculus
gatctggtcaatcgacagcctttta

SEQ ID NO: 509583 - DNA, 25 bp, Mus musculus
gatctggtcaatggacagcctttta

SEQ ID NO: 509584 - DNA, 25 bp, Mus musculus
gatctggtcactatctgccataaat

SEQ ID NO: 509585 - DNA, 25 bp, Mus musculus
gatctggtcactttctgccataaat

SEQ ID NO: 509586 - DNA, 25 bp, Mus musculus
gatctggtcaggacaacatttaggc

SEQ ID NO: 509587 - DNA, 25 bp, Mus musculus
gatctggtcaggtcaacatttaggc

SEQ ID NO: 509588 - DNA, 25 bp, Mus musculus
gatctggtcctgctttccatgacgc

SEQ ID NO: 509589 - DNA, 25 bp, Mus musculus
gatctggtcctggtttccatgacgc

SEQ ID NO: 509590 - DNA, 25 bp, Mus musculus
gatctggtctaccttgatttgggag

SEQ ID NO: 509591 - DNA, 25 bp, Mus musculus
gatctggtctacgttgatttgggag

SEQ ID NO: 509592 - DNA, 25 bp, Mus musculus
gatctggtctccagtagttttggat

SEQ ID NO: 509593 - DNA, 25 bp, Mus musculus
gatctggtctcctgtagttttggat

SEQ ID NO: 509594 - DNA, 25 bp, Mus musculus
gatctggtctttatggctcaactca

SEQ ID NO: 509595 - DNA, 25 bp, Mus musculus
gatctggtctttttggctcaactca

SEQ ID NO: 509596 - DNA, 25 bp, Mus musculus
gatctggtgctacacagcgcttggc

SEQ ID NO: 509597 - DNA, 25 bp, Mus musculus
gatctggtgctagacagcgcttggc

SEQ ID NO: 509598 - DNA, 25 bp, Mus musculus
gatctggtggcccatcaggtagaca

SEQ ID NO: 509599 - DNA, 25 bp, Mus musculus
gatctggtggccgatcaggtagaca

SEQ ID NO: 509600 - DNA, 25 bp, Mus musculus
gatctggtggctcacatcggtgcta

SEQ ID NO: 509601 - DNA, 25 bp, Mus musculus
gatctggtggctgacatcggtgcta

SEQ ID NO: 509602 - DNA, 25 bp, Mus musculus
gatctggtgtccactttggacaaca

SEQ ID NO: 509603 - DNA, 25 bp, Mus musculus
gatctggtgtcctctttggacaaca

SEQ ID NO: 509604 - DNA, 25 bp, Mus musculus
gatctggttccaagttaatgtttct

SEQ ID NO: 509605 - DNA, 25 bp, Mus musculus
gatctggttccatgttaatgtttct

SEQ ID NO: 509606 - DNA, 25 bp, Mus musculus
gatctggttcccaaacagttagtag

SEQ ID NO: 509607 - DNA, 25 bp, Mus musculus
gatctggttccctaacagttagtag

SEQ ID NO: 509608 - DNA, 25 bp, Mus musculus
gatctggttcctcagcccaaaatca

SEQ ID NO: 509609 - DNA, 25 bp, Mus musculus
gatctggttcctgagcccaaaatca

SEQ ID NO: 509610 - DNA, 25 bp, Mus musculus
gatctggttggcaagcatgtgaaac

SEQ ID NO: 509611 - DNA, 25 bp, Mus musculus
gatctggttggctagcatgtgaaac

SEQ ID NO: 509612 - DNA, 25 bp, Mus musculus
gatctgtaactaactgtccaaccca

SEQ ID NO: 509613 - DNA, 25 bp, Mus musculus
gatctgtaactatctgtccaaccca

SEQ ID NO: 509614 - DNA, 25 bp, Mus musculus
gatctgtaagagctccatcctccag

SEQ ID NO: 509615 - DNA, 25 bp, Mus musculus
gatctgtaagaggtccatcctccag

SEQ ID NO: 509616 - DNA, 25 bp, Mus musculus
gatctgtacctacggttccttctga

SEQ ID NO: 509617 - DNA, 25 bp, Mus musculus
gatctgtacctagggttccttctga

SEQ ID NO: 509618 - DNA, 25 bp, Mus musculus
gatctgtaccttctttttagtttgg

SEQ ID NO: 509619 - DNA, 25 bp, Mus musculus
gatctgtaccttgtttttagtttgg

SEQ ID NO: 509620 - DNA, 25 bp, Mus musculus
gatctgtagcagaggtcaccggagt

SEQ ID NO: 509621 - DNA, 25 bp, Mus musculus
gatctgtagcagtggtcaccggagt

SEQ ID NO: 509622 - DNA, 25 bp, Mus musculus
gatctgtatagtagcttacctgata

SEQ ID NO: 509623 - DNA, 25 bp, Mus musculus
gatctgtatagttgcttacctgata

SEQ ID NO: 509624 - DNA, 25 bp, Mus musculus
gatctgtatgatcctattgtttgta

SEQ ID NO: 509625 - DNA, 25 bp, Mus musculus
gatctgtatgatgctattgtttgta

SEQ ID NO: 509626 - DNA, 25 bp, Mus musculus
gatctgtattaacctctctgtattt

SEQ ID NO: 509627 - DNA, 25 bp, Mus musculus
gatctgtattaagctctctgtattt

SEQ ID NO: 509628 - DNA, 25 bp, Mus musculus
gatctgtcaatcatggctggagcct

SEQ ID NO: 509629 - DNA, 25 bp, Mus musculus
gatctgtcaatcttggctggagcct

SEQ ID NO: 509630 - DNA, 25 bp, Mus musculus
gatctgtcaattcctggacttggcc

SEQ ID NO: 509631 - DNA, 25 bp, Mus musculus
gatctgtcaattgctggacttggcc

SEQ ID NO: 509632 - DNA, 25 bp, Mus musculus
gatctgtcacgaccatactcactat

SEQ ID NO: 509633 - DNA, 25 bp, Mus musculus
gatctgtcacgagcatactcactat

SEQ ID NO: 509634 - DNA, 25 bp, Mus musculus
gatctgtcagccaatctgtgaccta

SEQ ID NO: 509635 - DNA, 25 bp, Mus musculus
gatctgtcagcctatctgtgaccta

SEQ ID NO: 509636 - DNA, 25 bp, Mus musculus
gatctgtcagggacactgactctgc

SEQ ID NO: 509637 - DNA, 25 bp, Mus musculus
gatctgtcagggtcactgactctgc

SEQ ID NO: 509638 - DNA, 25 bp, Mus musculus
gatctgtcagtgctttcttagcctc

SEQ ID NO: 509639 - DNA, 25 bp, Mus musculus
gatctgtcagtggtttcttagcctc

SEQ ID NO: 509640 - DNA, 25 bp, Mus musculus
gatctgtcataaataccattctgca

SEQ ID NO: 509641 - DNA, 25 bp, Mus musculus
gatctgtcataattaccattctgca

SEQ ID NO: 509642 - DNA, 25 bp, Mus musculus
gatctgtcattcaggatgcttgcag

SEQ ID NO: 509643 - DNA, 25 bp, Mus musculus
gatctgtcattctggatgcttgcag

SEQ ID NO: 509644 - DNA, 25 bp, Mus musculus
gatctgtccacacggctcttataag

SEQ ID NO: 509645 - DNA, 25 bp, Mus musculus
gatctgtccacagggctcttataag

SEQ ID NO: 509646 - DNA, 25 bp, Mus musculus
gatctgtcctccagtttttctagtt

SEQ ID NO: 509647 - DNA, 25 bp, Mus musculus
gatctgtcctcctgtttttctagtt

SEQ ID NO: 509648 - DNA, 25 bp, Mus musculus
gatctgtcgttcacagggcccattg

SEQ ID NO: 509649 - DNA, 25 bp, Mus musculus
gatctgtcgttctcagggcccattg

SEQ ID NO: 509650 - DNA, 25 bp, Mus musculus
gatctgtctaatcccaagttctggt

SEQ ID NO: 509651 - DNA, 25 bp, Mus musculus
gatctgtctaatgccaagttctggt

SEQ ID NO: 509652 - DNA, 25 bp, Mus musculus
gatctgtctagcacggtgctgatgc

SEQ ID NO: 509653 - DNA, 25 bp, Mus musculus
gatctgtctagctcggtgctgatgc

SEQ ID NO: 509654 - DNA, 25 bp, Mus musculus
gatctgtctatcagggtttatattc

SEQ ID NO: 509655 - DNA, 25 bp, Mus musculus
gatctgtctatctgggtttatattc

SEQ ID NO: 509656 - DNA, 25 bp, Mus musculus
gatctgtctgaaatcggtatccgat

SEQ ID NO: 509657 - DNA, 25 bp, Mus musculus
gatctgtctgaattcggtatccgat

SEQ ID NO: 509658 - DNA, 25 bp, Mus musculus
gatctgtcttgcacagcacaatatt

SEQ ID NO: 509659 - DNA, 25 bp, Mus musculus
gatctgtcttgctcagcacaatatt

SEQ ID NO: 509660 - DNA, 25 bp, Mus musculus
gatctgtgaacaacgatggcgtcaa

SEQ ID NO: 509661 - DNA, 25 bp, Mus musculus
gatctgtgaacatcgatggcgtcaa

SEQ ID NO: 509662 - DNA, 25 bp, Mus musculus
gatctgtgaagaagccttgtctcca

SEQ ID NO: 509663 - DNA, 25 bp, Mus musculus
gatctgtgaagatgccttgtctcca

SEQ ID NO: 509664 - DNA, 25 bp, Mus musculus
gatctgtgaagtctaccttttaaga

SEQ ID NO: 509665 - DNA, 25 bp, Mus musculus
gatctgtgaagtgtaccttttaaga

SEQ ID NO: 509666 - DNA, 25 bp, Mus musculus
gatctgtgacagcttcatgttgtat

SEQ ID NO: 509667 - DNA, 25 bp, Mus musculus
gatctgtgacaggttcatgttgtat

SEQ ID NO: 509668 - DNA, 25 bp, Mus musculus
gatctgtgacatatttaatgtttct

SEQ ID NO: 509669 - DNA, 25 bp, Mus musculus
gatctgtgacatttttaatgtttct

SEQ ID NO: 509670 - DNA, 25 bp, Mus musculus
gatctgtgaggtatccatatcggtt

SEQ ID NO: 509671 - DNA, 25 bp, Mus musculus
gatctgtgaggtttccatatcggtt

SEQ ID NO: 509672 - DNA, 25 bp, Mus musculus
gatctgtgatcaattgattcccctc

SEQ ID NO: 509673 - DNA, 25 bp, Mus musculus
gatctgtgatcatttgattcccctc

SEQ ID NO: 509674 - DNA, 25 bp, Mus musculus
gatctgtgcattcattttggattcc

SEQ ID NO: 509675 - DNA, 25 bp, Mus musculus
gatctgtgcattgattttggattcc

SEQ ID NO: 509676 - DNA, 25 bp, Mus musculus
gatctgtgcctcaaacactatggtg

SEQ ID NO: 509677 - DNA, 25 bp, Mus musculus
gatctgtgcctctaacactatggtg

SEQ ID NO: 509678 - DNA, 25 bp, Mus musculus
gatctgtgccttagagagacctgta

SEQ ID NO: 509679 - DNA, 25 bp, Mus musculus
gatctgtgcctttgagagacctgta

SEQ ID NO: 509680 - DNA, 25 bp, Mus musculus
gatctgtgctagatcttaaccagcc

SEQ ID NO: 509681 - DNA, 25 bp, Mus musculus
gatctgtgctagttcttaaccagcc

SEQ ID NO: 509682 - DNA, 25 bp, Mus musculus
gatctgtgctccacttaatgtttcc

SEQ ID NO: 509683 - DNA, 25 bp, Mus musculus
gatctgtgctcctcttaatgtttcc

SEQ ID NO: 509684 - DNA, 25 bp, Mus musculus
gatctgtggaggacatcccagtagg

SEQ ID NO: 509685 - DNA, 25 bp, Mus musculus
gatctgtggaggtcatcccagtagg

SEQ ID NO: 509686 - DNA, 25 bp, Mus musculus
gatctgtggtatacaatggtcctgc

SEQ ID NO: 509687 - DNA, 25 bp, Mus musculus
gatctgtggtattcaatggtcctgc

SEQ ID NO: 509688 - DNA, 25 bp, Mus musculus
gatctgtggtcaagtcctatacctg

SEQ ID NO: 509689 - DNA, 25 bp, Mus musculus
gatctgtggtcatgtcctatacctg

SEQ ID NO: 509690 - DNA, 25 bp, Mus musculus
gatctgtgtcagctccttgaaaagt

SEQ ID NO: 509691 - DNA, 25 bp, Mus musculus
gatctgtgtcaggtccttgaaaagt

SEQ ID NO: 509692 - DNA, 25 bp, Mus musculus
gatctgtgtctgatgcacatttgct

SEQ ID NO: 509693 - DNA, 25 bp, Mus musculus
gatctgtgtctgttgcacatttgct

SEQ ID NO: 509694 - DNA, 25 bp, Mus musculus
gatctgtgtgccaatgtcagtggaa

SEQ ID NO: 509695 - DNA, 25 bp, Mus musculus
gatctgtgtgcctatgtcagtggaa

SEQ ID NO: 509696 - DNA, 25 bp, Mus musculus
gatctgtgtgtcctgagaacaagtg

SEQ ID NO: 509697 - DNA, 25 bp, Mus musculus
gatctgtgtgtcgtgagaacaagtg

SEQ ID NO: 509698 - DNA, 25 bp, Mus musculus
gatctgtgtgttatctcacttcagt

SEQ ID NO: 509699 - DNA, 25 bp, Mus musculus
gatctgtgtgttttctcacttcagt

SEQ ID NO: 509700 - DNA, 25 bp, Mus musculus
gatctgtgtttactccctgaaaagt

SEQ ID NO: 509701 - DNA, 25 bp, Mus musculus
gatctgtgtttagtccctgaaaagt

SEQ ID NO: 509702 - DNA, 25 bp, Mus musculus
gatctgttagcaccgccatgctcgg

SEQ ID NO: 509703 - DNA, 25 bp, Mus musculus
gatctgttagcagcgccatgctcgg

SEQ ID NO: 509704 - DNA, 25 bp, Mus musculus
gatctgttatcccacaggattcaat

SEQ ID NO: 509705 - DNA, 25 bp, Mus musculus
gatctgttatccgacaggattcaat

SEQ ID NO: 509706 - DNA, 25 bp, Mus musculus
gatctgttatgcagggatcaagcca

SEQ ID NO: 509707 - DNA, 25 bp, Mus musculus
gatctgttatgctgggatcaagcca

SEQ ID NO: 509708 - DNA, 25 bp, Mus musculus
gatctgttcacactcagtacaagtg

SEQ ID NO: 509709 - DNA, 25 bp, Mus musculus
gatctgttcacactctggtctcctt

SEQ ID NO: 509710 - DNA, 25 bp, Mus musculus
gatctgttcacagtcagtacaagtg

SEQ ID NO: 509711 - DNA, 25 bp, Mus musculus
gatctgttcacagtctggtctcctt

SEQ ID NO: 509712 - DNA, 25 bp, Mus musculus
gatctgttcaccatctgatacaaaa

SEQ ID NO: 509713 - DNA, 25 bp, Mus musculus
gatctgttcaccttctgatacaaaa

SEQ ID NO: 509714 - DNA, 25 bp, Mus musculus
gatctgttctaaacaacactgatgt

SEQ ID NO: 509715 - DNA, 25 bp, Mus musculus
gatctgttctaatcaacactgatgt

SEQ ID NO: 509716 - DNA, 25 bp, Mus musculus
gatctgttgcagagcctttgaattg

SEQ ID NO: 509717 - DNA, 25 bp, Mus musculus
gatctgttgcagcagttggactcac

SEQ ID NO: 509718 - DNA, 25 bp, Mus musculus
gatctgttgcaggagttggactcac

SEQ ID NO: 509719 - DNA, 25 bp, Mus musculus
gatctgttgcagtgcctttgaattg

SEQ ID NO: 509720 - DNA, 25 bp, Mus musculus
gatctgttggaaagactgtggctgc

SEQ ID NO: 509721 - DNA, 25 bp, Mus musculus
gatctgttggaatgactgtggctgc

SEQ ID NO: 509722 - DNA, 25 bp, Mus musculus
gatctgttgggccttgtggtcaaaa

SEQ ID NO: 509723 - DNA, 25 bp, Mus musculus
gatctgttgggcgttgtggtcaaaa

SEQ ID NO: 509724 - DNA, 25 bp, Mus musculus
gatctgtttcaacgcaaaccccact

SEQ ID NO: 509725 - DNA, 25 bp, Mus musculus
gatctgtttcaaggcaaaccccact

SEQ ID NO: 509726 - DNA, 25 bp, Mus musculus
gatctgtttcatagaggtcacatag

SEQ ID NO: 509727 - DNA, 25 bp, Mus musculus
gatctgtttcattgaggtcacatag

SEQ ID NO: 509728 - DNA, 25 bp, Mus musculus
gatctgtttgtcaatgtctctggga

SEQ ID NO: 509729 - DNA, 25 bp, Mus musculus
gatctgtttgtctatgtctctggga

SEQ ID NO: 509730 - DNA, 25 bp, Mus musculus
gatctgtttgtgcaactccagacct

SEQ ID NO: 509731 - DNA, 25 bp, Mus musculus
gatctgtttgtggaactccagacct

SEQ ID NO: 509732 - DNA, 25 bp, Mus musculus
gatctgttttgaatttcttttgtgt

SEQ ID NO: 509733 - DNA, 25 bp, Mus musculus
gatctgttttgattttcttttgtgt

SEQ ID NO: 509734 - DNA, 25 bp, Mus musculus
gatcttaaacatatcccagctggtc

SEQ ID NO: 509735 - DNA, 25 bp, Mus musculus
gatcttaaacatttcccagctggtc

SEQ ID NO: 509736 - DNA, 25 bp, Mus musculus
gatcttaaacggaacagggaactgc

SEQ ID NO: 509737 - DNA, 25 bp, Mus musculus
gatcttaaacggtacagggaactgc

SEQ ID NO: 509738 - DNA, 25 bp, Mus musculus
gatcttaaactaaatgtgagtacca

SEQ ID NO: 509739 - DNA, 25 bp, Mus musculus
gatcttaaactatatgtgagtacca

SEQ ID NO: 509740 - DNA, 25 bp, Mus musculus
gatcttaacagcagtaggcagataa

SEQ ID NO: 509741 - DNA, 25 bp, Mus musculus
gatcttaacagctgtaggcagataa

SEQ ID NO: 509742 - DNA, 25 bp, Mus musculus
gatcttaaccacaaagctcttactt

SEQ ID NO: 509743 - DNA, 25 bp, Mus musculus
gatcttaaccactaagctcttactt

SEQ ID NO: 509744 - DNA, 25 bp, Mus musculus
gatcttaacccactgtttaaacctg

SEQ ID NO: 509745 - DNA, 25 bp, Mus musculus
gatcttaacccagtgtttaaacctg

SEQ ID NO: 509746 - DNA, 25 bp, Mus musculus
gatcttaaggcaatctccttgcact

SEQ ID NO: 509747 - DNA, 25 bp, Mus musculus
gatcttaaggcattctccttgcact

SEQ ID NO: 509748 - DNA, 25 bp, Mus musculus
gatcttaatcacatcagctgtgtca

SEQ ID NO: 509749 - DNA, 25 bp, Mus musculus
gatcttaatcacttcagctgtgtca

SEQ ID NO: 509750 - DNA, 25 bp, Mus musculus
gatcttaatctgaattcccctatgg

SEQ ID NO: 509751 - DNA, 25 bp, Mus musculus
gatcttaatctgtattcccctatgg

SEQ ID NO: 509752 - DNA, 25 bp, Mus musculus
gatcttaattgtcgaggtgcaactt

SEQ ID NO: 509753 - DNA, 25 bp, Mus musculus
gatcttaattgtggaggtgcaactt

SEQ ID NO: 509754 - DNA, 25 bp, Mus musculus
gatcttacaataatgttccactctg

SEQ ID NO: 509755 - DNA, 25 bp, Mus musculus
gatcttacaatattgttccactctg

SEQ ID NO: 509756 - DNA, 25 bp, Mus musculus
gatcttaccttactcttctctgaaa

SEQ ID NO: 509757 - DNA, 25 bp, Mus musculus
gatcttaccttagtcttctctgaaa

SEQ ID NO: 509758 - DNA, 25 bp, Mus musculus
gatcttacgggaagccggagtcacc

SEQ ID NO: 509759 - DNA, 25 bp, Mus musculus
gatcttacgggatgccggagtcacc

SEQ ID NO: 509760 - DNA, 25 bp, Mus musculus
gatcttacgtgtaagctttcatcac

SEQ ID NO: 509761 - DNA, 25 bp, Mus musculus
gatcttacgtgttagctttcatcac

SEQ ID NO: 509762 - DNA, 25 bp, Mus musculus
gatcttactacacaatgtgtatatg

SEQ ID NO: 509763 - DNA, 25 bp, Mus musculus
gatcttactacagaatgtgtatatg

SEQ ID NO: 509764 - DNA, 25 bp, Mus musculus
gatcttactataaagggccacctgg

SEQ ID NO: 509765 - DNA, 25 bp, Mus musculus
gatcttactatatagggccacctgg

SEQ ID NO: 509766 - DNA, 25 bp, Mus musculus
gatcttactgaaatgcgtattttat

SEQ ID NO: 509767 - DNA, 25 bp, Mus musculus
gatcttactgaattgcgtattttat

SEQ ID NO: 509768 - DNA, 25 bp, Mus musculus
gatcttactggacagtttgccctgt

SEQ ID NO: 509769 - DNA, 25 bp, Mus musculus
gatcttactggagagtttgccctgt

SEQ ID NO: 509770 - DNA, 25 bp, Mus musculus
gatcttacttaaactgggtcatctg

SEQ ID NO: 509771 - DNA, 25 bp, Mus musculus
gatcttacttaatctgggtcatctg

SEQ ID NO: 509772 - DNA, 25 bp, Mus musculus
gatcttagaatcatttgcctcctac

SEQ ID NO: 509773 - DNA, 25 bp, Mus musculus
gatcttagaatcttttgcctcctac

SEQ ID NO: 509774 - DNA, 25 bp, Mus musculus
gatcttagaccaacttaggctagaa

SEQ ID NO: 509775 - DNA, 25 bp, Mus musculus
gatcttagaccatcttaggctagaa

SEQ ID NO: 509776 - DNA, 25 bp, Mus musculus
gatcttagcttactttggtagttct

SEQ ID NO: 509777 - DNA, 25 bp, Mus musculus
gatcttagcttagtttggtagttct

SEQ ID NO: 509778 - DNA, 25 bp, Mus musculus
gatcttaggaccactgaaggattta

SEQ ID NO: 509779 - DNA, 25 bp, Mus musculus
gatcttaggacctctgaaggattta

SEQ ID NO: 509780 - DNA, 25 bp, Mus musculus
gatcttaggtctacatagctccttg

SEQ ID NO: 509781 - DNA, 25 bp, Mus musculus
gatcttaggtcttcatagctccttg

SEQ ID NO: 509782 - DNA, 25 bp, Mus musculus
gatcttagtaacctagggatgtcca

SEQ ID NO: 509783 - DNA, 25 bp, Mus musculus
gatcttagtaacgtagggatgtcca

SEQ ID NO: 509784 - DNA, 25 bp, Mus musculus
gatcttagtcccaaaggttgtctct

SEQ ID NO: 509785 - DNA, 25 bp, Mus musculus
gatcttagtccctaaggttgtctct

SEQ ID NO: 509786 - DNA, 25 bp, Mus musculus
gatcttagtcctcgtcccaaaagac

SEQ ID NO: 509787 - DNA, 25 bp, Mus musculus
gatcttagtcctggtcccaaaagac

SEQ ID NO: 509788 - DNA, 25 bp, Mus musculus
gatcttagtggtattgcctttcaaa

SEQ ID NO: 509789 - DNA, 25 bp, Mus musculus
gatcttagtggttttgcctttcaaa

SEQ ID NO: 509790 - DNA, 25 bp, Mus musculus
gatcttagttggattcttacccact

SEQ ID NO: 509791 - DNA, 25 bp, Mus musculus
gatcttagttggtttcttacccact

SEQ ID NO: 509792 - DNA, 25 bp, Mus musculus
gatcttatacaacacttacactcta

SEQ ID NO: 509793 - DNA, 25 bp, Mus musculus
gatcttatacaagacttacactcta

SEQ ID NO: 509794 - DNA, 25 bp, Mus musculus
gatcttatacccatcttaccctcag

SEQ ID NO: 509795 - DNA, 25 bp, Mus musculus
gatcttatacccttcttaccctcag

SEQ ID NO: 509796 - DNA, 25 bp, Mus musculus
gatcttatactcaaccatctttttg

SEQ ID NO: 509797 - DNA, 25 bp, Mus musculus
gatcttatactctaccatctttttg

SEQ ID NO: 509798 - DNA, 25 bp, Mus musculus
gatcttatagtcattgtaattctgc

SEQ ID NO: 509799 - DNA, 25 bp, Mus musculus
gatcttatagtctttgtaattctgc

SEQ ID NO: 509800 - DNA, 25 bp, Mus musculus
gatcttatatcactggtgctggcac

SEQ ID NO: 509801 - DNA, 25 bp, Mus musculus
gatcttatatcagtggtgctggcac

SEQ ID NO: 509802 - DNA, 25 bp, Mus musculus
gatcttatccgcaccattaatgacc

SEQ ID NO: 509803 - DNA, 25 bp, Mus musculus
gatcttatccgctccattaatgacc

SEQ ID NO: 509804 - DNA, 25 bp, Mus musculus
gatcttatctcccatctttaaacaa

SEQ ID NO: 509805 - DNA, 25 bp, Mus musculus
gatcttatctccgatctttaaacaa

SEQ ID NO: 509806 - DNA, 25 bp, Mus musculus
gatcttatgatcagccttctgaact

SEQ ID NO: 509807 - DNA, 25 bp, Mus musculus
gatcttatgatctgccttctgaact

SEQ ID NO: 509808 - DNA, 25 bp, Mus musculus
gatcttatgcaccaccttagaccat

SEQ ID NO: 509809 - DNA, 25 bp, Mus musculus
gatcttatgcacgaccttagaccat

SEQ ID NO: 509810 - DNA, 25 bp, Mus musculus
gatcttatgcccaagcatttgctct

SEQ ID NO: 509811 - DNA, 25 bp, Mus musculus
gatcttatgccctagcatttgctct

SEQ ID NO: 509812 - DNA, 25 bp, Mus musculus
gatcttatgtggactctccctacat

SEQ ID NO: 509813 - DNA, 25 bp, Mus musculus
gatcttatgtggtctctccctacat

SEQ ID NO: 509814 - DNA, 25 bp, Mus musculus
gatcttattcccctctgacaggaag

SEQ ID NO: 509815 - DNA, 25 bp, Mus musculus
gatcttattcccgtctgacaggaag

SEQ ID NO: 509816 - DNA, 25 bp, Mus musculus
gatcttattgtcactaggcctgaaa

SEQ ID NO: 509817 - DNA, 25 bp, Mus musculus
gatcttattgtctctaggcctgaaa

SEQ ID NO: 509818 - DNA, 25 bp, Mus musculus
gatcttatttacacacttttacagg

SEQ ID NO: 509819 - DNA, 25 bp, Mus musculus
gatcttatttactcacttttacagg

SEQ ID NO: 509820 - DNA, 25 bp, Mus musculus
gatcttatttttcctatgccttacc

SEQ ID NO: 509821 - DNA, 25 bp, Mus musculus
gatcttatttttgctatgccttacc

SEQ ID NO: 509822 - DNA, 25 bp, Mus musculus
gatcttcaacagcaaatggcaccgt

SEQ ID NO: 509823 - DNA, 25 bp, Mus musculus
gatcttcaacaggaaatggcaccgt

SEQ ID NO: 509824 - DNA, 25 bp, Mus musculus
gatcttcaagaaacgtgtatctcct

SEQ ID NO: 509825 - DNA, 25 bp, Mus musculus
gatcttcaagaacgctggtcacccc

SEQ ID NO: 509826 - DNA, 25 bp, Mus musculus
gatcttcaagaaggctggtcacccc

SEQ ID NO: 509827 - DNA, 25 bp, Mus musculus
gatcttcaagaatcgtgtatctcct

SEQ ID NO: 509828 - DNA, 25 bp, Mus musculus
gatcttcaagacagctacggccagg

SEQ ID NO: 509829 - DNA, 25 bp, Mus musculus
gatcttcaagactgctacggccagg

SEQ ID NO: 509830 - DNA, 25 bp, Mus musculus
gatcttcaatctaatctctacataa

SEQ ID NO: 509831 - DNA, 25 bp, Mus musculus
gatcttcaatcttatctctacataa

SEQ ID NO: 509832 - DNA, 25 bp, Mus musculus
gatcttcacaaaaaccagggagcgg

SEQ ID NO: 509833 - DNA, 25 bp, Mus musculus
gatcttcacaaataccagggagcgg

SEQ ID NO: 509834 - DNA, 25 bp, Mus musculus
gatcttcacagactacttgcagtta

SEQ ID NO: 509835 - DNA, 25 bp, Mus musculus
gatcttcacagagtacttgcagtta

SEQ ID NO: 509836 - DNA, 25 bp, Mus musculus
gatcttcacatcagctttctatttg

SEQ ID NO: 509837 - DNA, 25 bp, Mus musculus
gatcttcacatctgctttctatttg

SEQ ID NO: 509838 - DNA, 25 bp, Mus musculus
gatcttcaccttactgtttgtgtca

SEQ ID NO: 509839 - DNA, 25 bp, Mus musculus
gatcttcacctttctgtttgtgtca

SEQ ID NO: 509840 - DNA, 25 bp, Mus musculus
gatcttcactcaactattaacagct

SEQ ID NO: 509841 - DNA, 25 bp, Mus musculus
gatcttcactcatctattaacagct

SEQ ID NO: 509842 - DNA, 25 bp, Mus musculus
gatcttcagactatcatcattattt

SEQ ID NO: 509843 - DNA, 25 bp, Mus musculus
gatcttcagactttcatcattattt

SEQ ID NO: 509844 - DNA, 25 bp, Mus musculus
gatcttcagcatccttatggtcatt

SEQ ID NO: 509845 - DNA, 25 bp, Mus musculus
gatcttcagcatgcttatggtcatt

SEQ ID NO: 509846 - DNA, 25 bp, Mus musculus
gatcttcaggaacacccatgctggt

SEQ ID NO: 509847 - DNA, 25 bp, Mus musculus
gatcttcaggaagacccatgctggt

SEQ ID NO: 509848 - DNA, 25 bp, Mus musculus
gatcttcaggtgactgccatgaaac

SEQ ID NO: 509849 - DNA, 25 bp, Mus musculus
gatcttcaggtgtctgccatgaaac

SEQ ID NO: 509850 - DNA, 25 bp, Mus musculus
gatcttcaggttcacaagtatcatt

SEQ ID NO: 509851 - DNA, 25 bp, Mus musculus
gatcttcaggttgacaagtatcatt

SEQ ID NO: 509852 - DNA, 25 bp, Mus musculus
gatcttcagttccaaaaaacattat

SEQ ID NO: 509853 - DNA, 25 bp, Mus musculus
gatcttcagttcgaaaaaacattat

SEQ ID NO: 509854 - DNA, 25 bp, Mus musculus
gatcttcatcaaagctattgtggac

SEQ ID NO: 509855 - DNA, 25 bp, Mus musculus
gatcttcatcaatgctattgtggac

SEQ ID NO: 509856 - DNA, 25 bp, Mus musculus
gatcttcatctacaggtaggacctt

SEQ ID NO: 509857 - DNA, 25 bp, Mus musculus
gatcttcatctagaggtaggacctt

SEQ ID NO: 509858 - DNA, 25 bp, Mus musculus
gatcttcatcttatagggacacctc

SEQ ID NO: 509859 - DNA, 25 bp, Mus musculus
gatcttcatcttttagggacacctc

SEQ ID NO: 509860 - DNA, 25 bp, Mus musculus
gatcttcattttactagactgtcac

SEQ ID NO: 509861 - DNA, 25 bp, Mus musculus
gatcttcatttttctagactgtcac

SEQ ID NO: 509862 - DNA, 25 bp, Mus musculus
gatcttccaacccagatgagaccgg

SEQ ID NO: 509863 - DNA, 25 bp, Mus musculus
gatcttccaaccgagatgagaccgg

SEQ ID NO: 509864 - DNA, 25 bp, Mus musculus
gatcttccaagaatcacacataaag

SEQ ID NO: 509865 - DNA, 25 bp, Mus musculus
gatcttccaagattcacacataaag

SEQ ID NO: 509866 - DNA, 25 bp, Mus musculus
gatcttccatcactgtttatctata

SEQ ID NO: 509867 - DNA, 25 bp, Mus musculus
gatcttccatcagtgtttatctata

SEQ ID NO: 509868 - DNA, 25 bp, Mus musculus
gatcttcccagaccagatgtcggca

SEQ ID NO: 509869 - DNA, 25 bp, Mus musculus
gatcttcccagagcagatgtcggca

SEQ ID NO: 509870 - DNA, 25 bp, Mus musculus
gatcttcccgacagggctacatgag

SEQ ID NO: 509871 - DNA, 25 bp, Mus musculus
gatcttcccgactgggctacatgag

SEQ ID NO: 509872 - DNA, 25 bp, Mus musculus
gatcttccctgactctgagcaaaag

SEQ ID NO: 509873 - DNA, 25 bp, Mus musculus
gatcttccctgagtctgagcaaaag

SEQ ID NO: 509874 - DNA, 25 bp, Mus musculus
gatcttccctttcccgagagtgtgg

SEQ ID NO: 509875 - DNA, 25 bp, Mus musculus
gatcttccctttgccgagagtgtgg

SEQ ID NO: 509876 - DNA, 25 bp, Mus musculus
gatcttccgtttattgtttcacata

SEQ ID NO: 509877 - DNA, 25 bp, Mus musculus
gatcttccgttttttgtttcacata

SEQ ID NO: 509878 - DNA, 25 bp, Mus musculus
gatcttcctgatcaacaagcttcac

SEQ ID NO: 509879 - DNA, 25 bp, Mus musculus
gatcttcctgatgaacaagcttcac

SEQ ID NO: 509880 - DNA, 25 bp, Mus musculus
gatcttcctggactcagttgcttaa

SEQ ID NO: 509881 - DNA, 25 bp, Mus musculus
gatcttcctggagtcagttgcttaa

SEQ ID NO: 509882 - DNA, 25 bp, Mus musculus
gatcttcctggcctcttcgcatgtg

SEQ ID NO: 509883 - DNA, 25 bp, Mus musculus
gatcttcctggcgtcttcgcatgtg

SEQ ID NO: 509884 - DNA, 25 bp, Mus musculus
gatcttccttacaagcacatcgtag

SEQ ID NO: 509885 - DNA, 25 bp, Mus musculus
gatcttccttactagcacatcgtag

SEQ ID NO: 509886 - DNA, 25 bp, Mus musculus
gatcttcgaccccaaatgtcagaga

SEQ ID NO: 509887 - DNA, 25 bp, Mus musculus
gatcttcgacccgaaatgtcagaga

SEQ ID NO: 509888 - DNA, 25 bp, Mus musculus
gatcttcgcagtaggaatttgaccc

SEQ ID NO: 509889 - DNA, 25 bp, Mus musculus
gatcttcgcagttggaatttgaccc

SEQ ID NO: 509890 - DNA, 25 bp, Mus musculus
gatcttcgccgtacgcagaactggg

SEQ ID NO: 509891 - DNA, 25 bp, Mus musculus
gatcttcgccgttcgcagaactggg

SEQ ID NO: 509892 - DNA, 25 bp, Mus musculus
gatcttcggcatctgattgcggttt

SEQ ID NO: 509893 - DNA, 25 bp, Mus musculus
gatcttcggcatgtgattgcggttt

SEQ ID NO: 509894 - DNA, 25 bp, Mus musculus
gatcttctacacaacctgacaactc

SEQ ID NO: 509895 - DNA, 25 bp, Mus musculus
gatcttctacactacctgacaactc

SEQ ID NO: 509896 - DNA, 25 bp, Mus musculus
gatcttctaccactgtctttatggg

SEQ ID NO: 509897 - DNA, 25 bp, Mus musculus
gatcttctaccagtgtctttatggg

SEQ ID NO: 509898 - DNA, 25 bp, Mus musculus
gatcttctagctaccattcattttc

SEQ ID NO: 509899 - DNA, 25 bp, Mus musculus
gatcttctagcttccattcattttc

SEQ ID NO: 509900 - DNA, 25 bp, Mus musculus
gatcttctaggtcacagctgagctt

SEQ ID NO: 509901 - DNA, 25 bp, Mus musculus
gatcttctaggtgacagctgagctt

SEQ ID NO: 509902 - DNA, 25 bp, Mus musculus
gatcttctatccaaatctgtagcat

SEQ ID NO: 509903 - DNA, 25 bp, Mus musculus
gatcttctatcctaatctgtagcat

SEQ ID NO: 509904 - DNA, 25 bp, Mus musculus
gatcttctattccactcactaatgg

SEQ ID NO: 509905 - DNA, 25 bp, Mus musculus
gatcttctattcgactcactaatgg

SEQ ID NO: 509906 - DNA, 25 bp, Mus musculus
gatcttctcactatcttattttcta

SEQ ID NO: 509907 - DNA, 25 bp, Mus musculus
gatcttctcactttcttattttcta

SEQ ID NO: 509908 - DNA, 25 bp, Mus musculus
gatcttctcagaagcaatttttctt

SEQ ID NO: 509909 - DNA, 25 bp, Mus musculus
gatcttctcagatgcaatttttctt

SEQ ID NO: 509910 - DNA, 25 bp, Mus musculus
gatcttctctacataggactctttg

SEQ ID NO: 509911 - DNA, 25 bp, Mus musculus
gatcttctctacttaggactctttg

SEQ ID NO: 509912 - DNA, 25 bp, Mus musculus
gatcttctctgaccggcgcagtagt

SEQ ID NO: 509913 - DNA, 25 bp, Mus musculus
gatcttctctgactagctacctcac

SEQ ID NO: 509914 - DNA, 25 bp, Mus musculus
gatcttctctgagcggcgcagtagt

SEQ ID NO: 509915 - DNA, 25 bp, Mus musculus
gatcttctctgagtagctacctcac

SEQ ID NO: 509916 - DNA, 25 bp, Mus musculus
gatcttctgaacaatgcacacttgt

SEQ ID NO: 509917 - DNA, 25 bp, Mus musculus
gatcttctgaactatgcacacttgt

SEQ ID NO: 509918 - DNA, 25 bp, Mus musculus
gatcttctggaacctccaaagctga

SEQ ID NO: 509919 - DNA, 25 bp, Mus musculus
gatcttctggaagctccaaagctga

SEQ ID NO: 509920 - DNA, 25 bp, Mus musculus
gatcttctggtgatgagttcttcta

SEQ ID NO: 509921 - DNA, 25 bp, Mus musculus
gatcttctggtgttgagttcttcta

SEQ ID NO: 509922 - DNA, 25 bp, Mus musculus
gatcttctggttccataacacgact

SEQ ID NO: 509923 - DNA, 25 bp, Mus musculus
gatcttctggttgcataacacgact

SEQ ID NO: 509924 - DNA, 25 bp, Mus musculus
gatcttctgtaaaagccccagctac

SEQ ID NO: 509925 - DNA, 25 bp, Mus musculus
gatcttctgtaatagccccagctac

SEQ ID NO: 509926 - DNA, 25 bp, Mus musculus
gatcttctgtgtagctatcacgggt

SEQ ID NO: 509927 - DNA, 25 bp, Mus musculus
gatcttctgtgttgctatcacgggt

SEQ ID NO: 509928 - DNA, 25 bp, Mus musculus
gatcttcttgctagtgtagcttcta

SEQ ID NO: 509929 - DNA, 25 bp, Mus musculus
gatcttcttgcttgtgtagcttcta

SEQ ID NO: 509930 - DNA, 25 bp, Mus musculus
gatcttcttgtgctcttcttaatgg

SEQ ID NO: 509931 - DNA, 25 bp, Mus musculus
gatcttcttgtggtcttcttaatgg

SEQ ID NO: 509932 - DNA, 25 bp, Mus musculus
gatcttgaaccgctcaacaatgcat

SEQ ID NO: 509933 - DNA, 25 bp, Mus musculus
gatcttgaaccggtcaacaatgcat

SEQ ID NO: 509934 - DNA, 25 bp, Mus musculus
gatcttgaagatccatcggaacggg

SEQ ID NO: 509935 - DNA, 25 bp, Mus musculus
gatcttgaagatgcatcggaacggg

SEQ ID NO: 509936 - DNA, 25 bp, Mus musculus
gatcttgaattactcttttccattg

SEQ ID NO: 509937 - DNA, 25 bp, Mus musculus
gatcttgaattagtcttttccattg

SEQ ID NO: 509938 - DNA, 25 bp, Mus musculus
gatcttgaatttactagcctgcaga

SEQ ID NO: 509939 - DNA, 25 bp, Mus musculus
gatcttgaattttctagcctgcaga

SEQ ID NO: 509940 - DNA, 25 bp, Mus musculus
gatcttgacataattctggctagca

SEQ ID NO: 509941 - DNA, 25 bp, Mus musculus
gatcttgacatatttctggctagca

SEQ ID NO: 509942 - DNA, 25 bp, Mus musculus
gatcttgacatgcttctgccggtga

SEQ ID NO: 509943 - DNA, 25 bp, Mus musculus
gatcttgacatggttctgccggtga

SEQ ID NO: 509944 - DNA, 25 bp, Mus musculus
gatcttgaccacacatggaagcagg

SEQ ID NO: 509945 - DNA, 25 bp, Mus musculus
gatcttgaccactcatggaagcagg

SEQ ID NO: 509946 - DNA, 25 bp, Mus musculus
gatcttgactacacagaatactgct

SEQ ID NO: 509947 - DNA, 25 bp, Mus musculus
gatcttgactactcagaatactgct

SEQ ID NO: 509948 - DNA, 25 bp, Mus musculus
gatcttgactcaacgtcacaaccag

SEQ ID NO: 509949 - DNA, 25 bp, Mus musculus
gatcttgactcatcgtcacaaccag

SEQ ID NO: 509950 - DNA, 25 bp, Mus musculus
gatcttgactctctgcgttgtttga

SEQ ID NO: 509951 - DNA, 25 bp, Mus musculus
gatcttgactctgtgcgttgtttga

SEQ ID NO: 509952 - DNA, 25 bp, Mus musculus
gatcttgagacacactcattggact

SEQ ID NO: 509953 - DNA, 25 bp, Mus musculus
gatcttgagacagactcattggact

SEQ ID NO: 509954 - DNA, 25 bp, Mus musculus
gatcttgagacgctgttcctgacat

SEQ ID NO: 509955 - DNA, 25 bp, Mus musculus
gatcttgagacggtgttcctgacat

SEQ ID NO: 509956 - DNA, 25 bp, Mus musculus
gatcttgagagcatacagggaccgt

SEQ ID NO: 509957 - DNA, 25 bp, Mus musculus
gatcttgagagcttacagggaccgt

SEQ ID NO: 509958 - DNA, 25 bp, Mus musculus
gatcttgagcacctcgagggcctgc

SEQ ID NO: 509959 - DNA, 25 bp, Mus musculus
gatcttgagcacgtcgagggcctgc

SEQ ID NO: 509960 - DNA, 25 bp, Mus musculus
gatcttgagctactggcaacttgta

SEQ ID NO: 509961 - DNA, 25 bp, Mus musculus
gatcttgagctagtggcaacttgta

SEQ ID NO: 509962 - DNA, 25 bp, Mus musculus
gatcttgagtctagtctcttgactt

SEQ ID NO: 509963 - DNA, 25 bp, Mus musculus
gatcttgagtcttgtctcttgactt

SEQ ID NO: 509964 - DNA, 25 bp, Mus musculus
gatcttgatgtccttcgtgcttgtt

SEQ ID NO: 509965 - DNA, 25 bp, Mus musculus
gatcttgatgtcgttcgtgcttgtt

SEQ ID NO: 509966 - DNA, 25 bp, Mus musculus
gatcttgcacatctggcatccaggg

SEQ ID NO: 509967 - DNA, 25 bp, Mus musculus
gatcttgcacatgtggcatccaggg

SEQ ID NO: 509968 - DNA, 25 bp, Mus musculus
gatcttgcagctccttattgggtac

SEQ ID NO: 509969 - DNA, 25 bp, Mus musculus
gatcttgcagctgcttattgggtac

SEQ ID NO: 509970 - DNA, 25 bp, Mus musculus
gatcttgcatgaactgcagacccat

SEQ ID NO: 509971 - DNA, 25 bp, Mus musculus
gatcttgcatgatctgcagacccat

SEQ ID NO: 509972 - DNA, 25 bp, Mus musculus
gatcttgcatggagcaatctcgcag

SEQ ID NO: 509973 - DNA, 25 bp, Mus musculus
gatcttgcatggtgcaatctcgcag

SEQ ID NO: 509974 - DNA, 25 bp, Mus musculus
gatcttgccaaacgttcctagtgct

SEQ ID NO: 509975 - DNA, 25 bp, Mus musculus
gatcttgccaaaggttcctagtgct

SEQ ID NO: 509976 - DNA, 25 bp, Mus musculus
gatcttgccataagcctttaataaa

SEQ ID NO: 509977 - DNA, 25 bp, Mus musculus
gatcttgccatatgcctttaataaa

SEQ ID NO: 509978 - DNA, 25 bp, Mus musculus
gatcttgccatcacattatttcctt

SEQ ID NO: 509979 - DNA, 25 bp, Mus musculus
gatcttgccatctcattatttcctt

SEQ ID NO: 509980 - DNA, 25 bp, Mus musculus
gatcttgcgtctctcatttgggtct

SEQ ID NO: 509981 - DNA, 25 bp, Mus musculus
gatcttgcgtctgtcatttgggtct

SEQ ID NO: 509982 - DNA, 25 bp, Mus musculus
gatcttgctaaacctagcagtggtg

SEQ ID NO: 509983 - DNA, 25 bp, Mus musculus
gatcttgctaaagctagcagtggtg

SEQ ID NO: 509984 - DNA, 25 bp, Mus musculus
gatcttgctagaaacttccctgggc

SEQ ID NO: 509985 - DNA, 25 bp, Mus musculus
gatcttgctagatacttccctgggc

SEQ ID NO: 509986 - DNA, 25 bp, Mus musculus
gatcttgctatcactgtaaccaact

SEQ ID NO: 509987 - DNA, 25 bp, Mus musculus
gatcttgctatctctgtaaccaact

SEQ ID NO: 509988 - DNA, 25 bp, Mus musculus
gatcttgctcagagctagatggaca

SEQ ID NO: 509989 - DNA, 25 bp, Mus musculus
gatcttgctcagtgctagatggaca

SEQ ID NO: 509990 - DNA, 25 bp, Mus musculus
gatcttgcttaccttttactgaacc

SEQ ID NO: 509991 - DNA, 25 bp, Mus musculus
gatcttgcttacgttttactgaacc

SEQ ID NO: 509992 - DNA, 25 bp, Mus musculus
gatcttgctttgaagtccagactag

SEQ ID NO: 509993 - DNA, 25 bp, Mus musculus
gatcttgctttgtagtccagactag

SEQ ID NO: 509994 - DNA, 25 bp, Mus musculus
gatcttggaaggcaacacggctcct

SEQ ID NO: 509995 - DNA, 25 bp, Mus musculus
gatcttggaagggaacacggctcct

SEQ ID NO: 509996 - DNA, 25 bp, Mus musculus
gatcttggacgcactgctgcagaca

SEQ ID NO: 509997 - DNA, 25 bp, Mus musculus
gatcttggacgctctgctgcagaca

SEQ ID NO: 509998 - DNA, 25 bp, Mus musculus
gatcttggagccctcccgatttttt

SEQ ID NO: 509999 - DNA, 25 bp, Mus musculus
gatcttggagccgtcccgatttttt

SEQ ID NO: 510000 - DNA, 25 bp, Mus musculus
gatcttggaggaacctgaagaactt

SEQ ID NO: 510001 - DNA, 25 bp, Mus musculus
gatcttggaggatcctgaagaactt

SEQ ID NO: 510002 - DNA, 25 bp, Mus musculus
gatcttggatttaatctggcatcag

SEQ ID NO: 510003 - DNA, 25 bp, Mus musculus
gatcttggatttaccctatatgcaa

SEQ ID NO: 510004 - DNA, 25 bp, Mus musculus
gatcttggattttatctggcatcag

SEQ ID NO: 510005 - DNA, 25 bp, Mus musculus
gatcttggattttccctatatgcaa

SEQ ID NO: 510006 - DNA, 25 bp, Mus musculus
gatcttggcaacatggttctgcgac

SEQ ID NO: 510007 - DNA, 25 bp, Mus musculus
gatcttggcaacttggttctgcgac

SEQ ID NO: 510008 - DNA, 25 bp, Mus musculus
gatcttggccacagcacagggctct

SEQ ID NO: 510009 - DNA, 25 bp, Mus musculus
gatcttggccactgcacagggctct

SEQ ID NO: 510010 - DNA, 25 bp, Mus musculus
gatcttggcgtactatatagtcaag

SEQ ID NO: 510011 - DNA, 25 bp, Mus musculus
gatcttggcgtagtatatagtcaag

SEQ ID NO: 510012 - DNA, 25 bp, Mus musculus
gatcttggctgaccgagcacggtcc

SEQ ID NO: 510013 - DNA, 25 bp, Mus musculus
gatcttggctgagcgagcacggtcc

SEQ ID NO: 510014 - DNA, 25 bp, Mus musculus
gatcttgggattcttgcagacatac

SEQ ID NO: 510015 - DNA, 25 bp, Mus musculus
gatcttgggattgttgcagacatac

SEQ ID NO: 510016 - DNA, 25 bp, Mus musculus
gatcttgggcacagttcttacattc

SEQ ID NO: 510017 - DNA, 25 bp, Mus musculus
gatcttgggcactgttcttacattc

SEQ ID NO: 510018 - DNA, 25 bp, Mus musculus
gatcttgggttaacagcagcttgag

SEQ ID NO: 510019 - DNA, 25 bp, Mus musculus
gatcttgggttatcagcagcttgag

SEQ ID NO: 510020 - DNA, 25 bp, Mus musculus
gatcttggtcatacttgcttgcaat

SEQ ID NO: 510021 - DNA, 25 bp, Mus musculus
gatcttggtcattcttgcttgcaat

SEQ ID NO: 510022 - DNA, 25 bp, Mus musculus
gatcttggtctgcatttcatggtct

SEQ ID NO: 510023 - DNA, 25 bp, Mus musculus
gatcttggtctggatttcatggtct

SEQ ID NO: 510024 - DNA, 25 bp, Mus musculus
gatcttggtgatccacttgattgta

SEQ ID NO: 510025 - DNA, 25 bp, Mus musculus
gatcttggtgatgcacttgattgta

SEQ ID NO: 510026 - DNA, 25 bp, Mus musculus
gatcttggtgccctagcttcttacc

SEQ ID NO: 510027 - DNA, 25 bp, Mus musculus
gatcttggtgccgtagcttcttacc

SEQ ID NO: 510028 - DNA, 25 bp, Mus musculus
gatcttggttatactgtttatagct

SEQ ID NO: 510029 - DNA, 25 bp, Mus musculus
gatcttggttattctgtttatagct

SEQ ID NO: 510030 - DNA, 25 bp, Mus musculus
gatcttgtactcacctctaagtcag

SEQ ID NO: 510031 - DNA, 25 bp, Mus musculus
gatcttgtactctcctctaagtcag

SEQ ID NO: 510032 - DNA, 25 bp, Mus musculus
gatcttgtagaaccattttctccat

SEQ ID NO: 510033 - DNA, 25 bp, Mus musculus
gatcttgtagaagcattttctccat

SEQ ID NO: 510034 - DNA, 25 bp, Mus musculus
gatcttgtagatccacgttttccca

SEQ ID NO: 510035 - DNA, 25 bp, Mus musculus
gatcttgtagatgcacgttttccca

SEQ ID NO: 510036 - DNA, 25 bp, Mus musculus
gatcttgtagcacctgtaactgttt

SEQ ID NO: 510037 - DNA, 25 bp, Mus musculus
gatcttgtagcagctgtaactgttt

SEQ ID NO: 510038 - DNA, 25 bp, Mus musculus
gatcttgtatagctgtctggttatt

SEQ ID NO: 510039 - DNA, 25 bp, Mus musculus
gatcttgtataggtgtctggttatt

SEQ ID NO: 510040 - DNA, 25 bp, Mus musculus
gatcttgtatgtctcgccagttaga

SEQ ID NO: 510041 - DNA, 25 bp, Mus musculus
gatcttgtatgtgtcgccagttaga

SEQ ID NO: 510042 - DNA, 25 bp, Mus musculus
gatcttgtcactaagaaacgtggct

SEQ ID NO: 510043 - DNA, 25 bp, Mus musculus
gatcttgtcacttagaaacgtggct

SEQ ID NO: 510044 - DNA, 25 bp, Mus musculus
gatcttgtccagaaaatggcttctc

SEQ ID NO: 510045 - DNA, 25 bp, Mus musculus
gatcttgtccagtaaatggcttctc

SEQ ID NO: 510046 - DNA, 25 bp, Mus musculus
gatcttgtcttgatagagtttgctg

SEQ ID NO: 510047 - DNA, 25 bp, Mus musculus
gatcttgtcttgttagagtttgctg

SEQ ID NO: 510048 - DNA, 25 bp, Mus musculus
gatcttgtgattatggaatgtgcca

SEQ ID NO: 510049 - DNA, 25 bp, Mus musculus
gatcttgtgattttggaatgtgcca

SEQ ID NO: 510050 - DNA, 25 bp, Mus musculus
gatcttgtgcaactgacttttctgg

SEQ ID NO: 510051 - DNA, 25 bp, Mus musculus
gatcttgtgcaagtgacttttctgg

SEQ ID NO: 510052 - DNA, 25 bp, Mus musculus
gatcttgtgccaactttggtgacat

SEQ ID NO: 510053 - DNA, 25 bp, Mus musculus
gatcttgtgccatctttggtgacat

SEQ ID NO: 510054 - DNA, 25 bp, Mus musculus
gatcttgtggctcatctaaactgtt

SEQ ID NO: 510055 - DNA, 25 bp, Mus musculus
gatcttgtggctgatctaaactgtt

SEQ ID NO: 510056 - DNA, 25 bp, Mus musculus
gatcttgtggttatgctttgaactt

SEQ ID NO: 510057 - DNA, 25 bp, Mus musculus
gatcttgtggttttgctttgaactt

SEQ ID NO: 510058 - DNA, 25 bp, Mus musculus
gatcttgttatcagactcactgaca

SEQ ID NO: 510059 - DNA, 25 bp, Mus musculus
gatcttgttatctgactcactgaca

SEQ ID NO: 510060 - DNA, 25 bp, Mus musculus
gatcttgttcttaccaatatctact

SEQ ID NO: 510061 - DNA, 25 bp, Mus musculus
gatcttgttctttccaatatctact

SEQ ID NO: 510062 - DNA, 25 bp, Mus musculus
gatcttgttgagagccatgtgctgt

SEQ ID NO: 510063 - DNA, 25 bp, Mus musculus
gatcttgttgagtgccatgtgctgt

SEQ ID NO: 510064 - DNA, 25 bp, Mus musculus
gatctttaaaagagagcgcaaacct

SEQ ID NO: 510065 - DNA, 25 bp, Mus musculus
gatctttaaaagtgagcgcaaacct

SEQ ID NO: 510066 - DNA, 25 bp, Mus musculus
gatctttaactacactgttggtttc

SEQ ID NO: 510067 - DNA, 25 bp, Mus musculus
gatctttaactagactgttggtttc

SEQ ID NO: 510068 - DNA, 25 bp, Mus musculus
gatctttaagtacaccaggagccag

SEQ ID NO: 510069 - DNA, 25 bp, Mus musculus
gatctttaagtagaccaggagccag

SEQ ID NO: 510070 - DNA, 25 bp, Mus musculus
gatctttaatacctacatgtcgctg

SEQ ID NO: 510071 - DNA, 25 bp, Mus musculus
gatctttaatacgtacatgtcgctg

SEQ ID NO: 510072 - DNA, 25 bp, Mus musculus
gatctttacagcatccttaagtggg

SEQ ID NO: 510073 - DNA, 25 bp, Mus musculus
gatctttacagcttccttaagtggg

SEQ ID NO: 510074 - DNA, 25 bp, Mus musculus
gatctttacataccacaagactttt

SEQ ID NO: 510075 - DNA, 25 bp, Mus musculus
gatctttacatagcacaagactttt

SEQ ID NO: 510076 - DNA, 25 bp, Mus musculus
gatctttacattcccagatcgctgg

SEQ ID NO: 510077 - DNA, 25 bp, Mus musculus
gatctttacattgccagatcgctgg

SEQ ID NO: 510078 - DNA, 25 bp, Mus musculus
gatctttaccggaccttcgatgcct

SEQ ID NO: 510079 - DNA, 25 bp, Mus musculus
gatctttaccggtccttcgatgcct

SEQ ID NO: 510080 - DNA, 25 bp, Mus musculus
gatctttacctgaggctaagctacc

SEQ ID NO: 510081 - DNA, 25 bp, Mus musculus
gatctttacctgtggctaagctacc

SEQ ID NO: 510082 - DNA, 25 bp, Mus musculus
gatctttacggaacaattgccttta

SEQ ID NO: 510083 - DNA, 25 bp, Mus musculus
gatctttacggatcaattgccttta

SEQ ID NO: 510084 - DNA, 25 bp, Mus musculus
gatctttactgacgattgagcagca

SEQ ID NO: 510085 - DNA, 25 bp, Mus musculus
gatctttactgaggattgagcagca

SEQ ID NO: 510086 - DNA, 25 bp, Mus musculus
gatctttagcgccaattcaatatag

SEQ ID NO: 510087 - DNA, 25 bp, Mus musculus
gatctttagcgcgaattcaatatag

SEQ ID NO: 510088 - DNA, 25 bp, Mus musculus
gatctttagtatatcctgaaatccc

SEQ ID NO: 510089 - DNA, 25 bp, Mus musculus
gatctttagtatttcctgaaatccc

SEQ ID NO: 510090 - DNA, 25 bp, Mus musculus
gatctttagtgcctttgtttccaca

SEQ ID NO: 510091 - DNA, 25 bp, Mus musculus
gatctttagtgcgtttgtttccaca

SEQ ID NO: 510092 - DNA, 25 bp, Mus musculus
gatctttagttacggatgaccataa

SEQ ID NO: 510093 - DNA, 25 bp, Mus musculus
gatctttagttagggatgaccataa

SEQ ID NO: 510094 - DNA, 25 bp, Mus musculus
gatctttatcaactctacatctcat

SEQ ID NO: 510095 - DNA, 25 bp, Mus musculus
gatctttatcaagtctacatctcat

SEQ ID NO: 510096 - DNA, 25 bp, Mus musculus
gatctttatcatccttggaggcgtg

SEQ ID NO: 510097 - DNA, 25 bp, Mus musculus
gatctttatcatgcttggaggcgtg

SEQ ID NO: 510098 - DNA, 25 bp, Mus musculus
gatctttatcccaaagcatgcacac

SEQ ID NO: 510099 - DNA, 25 bp, Mus musculus
gatctttatccctaagcatgcacac

SEQ ID NO: 510100 - DNA, 25 bp, Mus musculus
gatctttatcctatagaagctccga

SEQ ID NO: 510101 - DNA, 25 bp, Mus musculus
gatctttatcctttagaagctccga

SEQ ID NO: 510102 - DNA, 25 bp, Mus musculus
gatctttatgatctaggcacacgaa

SEQ ID NO: 510103 - DNA, 25 bp, Mus musculus
gatctttatgatgtaggcacacgaa

SEQ ID NO: 510104 - DNA, 25 bp, Mus musculus
gatctttattatacacctctaccag

SEQ ID NO: 510105 - DNA, 25 bp, Mus musculus
gatctttattatacatcctccatga

SEQ ID NO: 510106 - DNA, 25 bp, Mus musculus
gatctttattattcacctctaccag

SEQ ID NO: 510107 - DNA, 25 bp, Mus musculus
gatctttattattcatcctccatga

SEQ ID NO: 510108 - DNA, 25 bp, Mus musculus
gatctttattccagattgtttgata

SEQ ID NO: 510109 - DNA, 25 bp, Mus musculus
gatctttattccataagttggcgtg

SEQ ID NO: 510110 - DNA, 25 bp, Mus musculus
gatctttattcctgattgtttgata

SEQ ID NO: 510111 - DNA, 25 bp, Mus musculus
gatctttattccttaagttggcgtg

SEQ ID NO: 510112 - DNA, 25 bp, Mus musculus
gatctttcaaccacatctgttttct

SEQ ID NO: 510113 - DNA, 25 bp, Mus musculus
gatctttcaacctcatctgttttct

SEQ ID NO: 510114 - DNA, 25 bp, Mus musculus
gatctttcatggctttcacttgcaa

SEQ ID NO: 510115 - DNA, 25 bp, Mus musculus
gatctttcatgggtttcacttgcaa

SEQ ID NO: 510116 - DNA, 25 bp, Mus musculus
gatctttcatgtctttgacctatgc

SEQ ID NO: 510117 - DNA, 25 bp, Mus musculus
gatctttcatgtgtttgacctatgc

SEQ ID NO: 510118 - DNA, 25 bp, Mus musculus
gatctttccaaactgttgcagtgtg

SEQ ID NO: 510119 - DNA, 25 bp, Mus musculus
gatctttccaaagtgttgcagtgtg

SEQ ID NO: 510120 - DNA, 25 bp, Mus musculus
gatctttccagactttgggtcctca

SEQ ID NO: 510121 - DNA, 25 bp, Mus musculus
gatctttccagagtttgggtcctca

SEQ ID NO: 510122 - DNA, 25 bp, Mus musculus
gatctttccagtctgccatcaaagg

SEQ ID NO: 510123 - DNA, 25 bp, Mus musculus
gatctttccagtgtgccatcaaagg

SEQ ID NO: 510124 - DNA, 25 bp, Mus musculus
gatctttcccagactgtagattgct

SEQ ID NO: 510125 - DNA, 25 bp, Mus musculus
gatctttcccagtctgtagattgct

SEQ ID NO: 510126 - DNA, 25 bp, Mus musculus
gatctttccgcactagcagcaacct

SEQ ID NO: 510127 - DNA, 25 bp, Mus musculus
gatctttccgcagtagcagcaacct

SEQ ID NO: 510128 - DNA, 25 bp, Mus musculus
gatctttcctgccttgacttcagaa

SEQ ID NO: 510129 - DNA, 25 bp, Mus musculus
gatctttcctgcgttgacttcagaa

SEQ ID NO: 510130 - DNA, 25 bp, Mus musculus
gatctttcctgtagtctgcactggg

SEQ ID NO: 510131 - DNA, 25 bp, Mus musculus
gatctttcctgttgtctgcactggg

SEQ ID NO: 510132 - DNA, 25 bp, Mus musculus
gatctttcggacaacttgacacaag

SEQ ID NO: 510133 - DNA, 25 bp, Mus musculus
gatctttcggactacttgacacaag

SEQ ID NO: 510134 - DNA, 25 bp, Mus musculus
gatctttctaagcatctggtactat

SEQ ID NO: 510135 - DNA, 25 bp, Mus musculus
gatctttctaaggatctggtactat

SEQ ID NO: 510136 - DNA, 25 bp, Mus musculus
gatctttctacaattagccttcctt

SEQ ID NO: 510137 - DNA, 25 bp, Mus musculus
gatctttctacatttagccttcctt

SEQ ID NO: 510138 - DNA, 25 bp, Mus musculus
gatctttctccgatttgcattgcaa

SEQ ID NO: 510139 - DNA, 25 bp, Mus musculus
gatctttctccgttttgcattgcaa

SEQ ID NO: 510140 - DNA, 25 bp, Mus musculus
gatctttctctgatacatattgagt

SEQ ID NO: 510141 - DNA, 25 bp, Mus musculus
gatctttctctgttacatattgagt

SEQ ID NO: 510142 - DNA, 25 bp, Mus musculus
gatctttctgctcacaacttaggtt

SEQ ID NO: 510143 - DNA, 25 bp, Mus musculus
gatctttctgctgacaacttaggtt

SEQ ID NO: 510144 - DNA, 25 bp, Mus musculus
gatctttctgtacattctattctct

SEQ ID NO: 510145 - DNA, 25 bp, Mus musculus
gatctttctgtagattctattctct

SEQ ID NO: 510146 - DNA, 25 bp, Mus musculus
gatctttctttcatagaccttgacc

SEQ ID NO: 510147 - DNA, 25 bp, Mus musculus
gatctttctttcttagaccttgacc

SEQ ID NO: 510148 - DNA, 25 bp, Mus musculus
gatctttcttttagccttgtaacat

SEQ ID NO: 510149 - DNA, 25 bp, Mus musculus
gatctttctttttgccttgtaacat

SEQ ID NO: 510150 - DNA, 25 bp, Mus musculus
gatctttgaaataccctttgttgca

SEQ ID NO: 510151 - DNA, 25 bp, Mus musculus
gatctttgaaattccctttgttgca

SEQ ID NO: 510152 - DNA, 25 bp, Mus musculus
gatctttgaaccatgtatgctcctc

SEQ ID NO: 510153 - DNA, 25 bp, Mus musculus
gatctttgaaccttgtatgctcctc

SEQ ID NO: 510154 - DNA, 25 bp, Mus musculus
gatctttgaagaaccgggaccctca

SEQ ID NO: 510155 - DNA, 25 bp, Mus musculus
gatctttgaagatccgggaccctca

SEQ ID NO: 510156 - DNA, 25 bp, Mus musculus
gatctttgagagatggtgcttgtta

SEQ ID NO: 510157 - DNA, 25 bp, Mus musculus
gatctttgagagttggtgcttgtta

SEQ ID NO: 510158 - DNA, 25 bp, Mus musculus
gatctttgaggtccacctttgagaa

SEQ ID NO: 510159 - DNA, 25 bp, Mus musculus
gatctttgaggtgcacctttgagaa

SEQ ID NO: 510160 - DNA, 25 bp, Mus musculus
gatctttgcagtctaattctttgtt

SEQ ID NO: 510161 - DNA, 25 bp, Mus musculus
gatctttgcagtgtaattctttgtt

SEQ ID NO: 510162 - DNA, 25 bp, Mus musculus
gatctttgccccactgcaaaaagga

SEQ ID NO: 510163 - DNA, 25 bp, Mus musculus
gatctttgcccctctgcaaaaagga

SEQ ID NO: 510164 - DNA, 25 bp, Mus musculus
gatctttgctatcaattgatgccta

SEQ ID NO: 510165 - DNA, 25 bp, Mus musculus
gatctttgctatgaattgatgccta

SEQ ID NO: 510166 - DNA, 25 bp, Mus musculus
gatctttgctgccatactgtgggag

SEQ ID NO: 510167 - DNA, 25 bp, Mus musculus
gatctttgctgcgatactgtgggag

SEQ ID NO: 510168 - DNA, 25 bp, Mus musculus
gatctttgctgtattactgtatgaa

SEQ ID NO: 510169 - DNA, 25 bp, Mus musculus
gatctttgctgttttactgtatgaa

SEQ ID NO: 510170 - DNA, 25 bp, Mus musculus
gatctttggataatgaccaccttta

SEQ ID NO: 510171 - DNA, 25 bp, Mus musculus
gatctttggataccatggtctctaa

SEQ ID NO: 510172 - DNA, 25 bp, Mus musculus
gatctttggatagcatggtctctaa

SEQ ID NO: 510173 - DNA, 25 bp, Mus musculus
gatctttggatattgaccaccttta

SEQ ID NO: 510174 - DNA, 25 bp, Mus musculus
gatctttggatcagctagaggccct

SEQ ID NO: 510175 - DNA, 25 bp, Mus musculus
gatctttggatctgctagaggccct

SEQ ID NO: 510176 - DNA, 25 bp, Mus musculus
gatctttggattaacttgcatctct

SEQ ID NO: 510177 - DNA, 25 bp, Mus musculus
gatctttggatttacttgcatctct

SEQ ID NO: 510178 - DNA, 25 bp, Mus musculus
gatctttggcaactgcgcacagctg

SEQ ID NO: 510179 - DNA, 25 bp, Mus musculus
gatctttggcaagtgcgcacagctg

SEQ ID NO: 510180 - DNA, 25 bp, Mus musculus
gatctttggcttccacgtatacatg

SEQ ID NO: 510181 - DNA, 25 bp, Mus musculus
gatctttggcttgcacgtatacatg

SEQ ID NO: 510182 - DNA, 25 bp, Mus musculus
gatctttgggttatcctgacactga

SEQ ID NO: 510183 - DNA, 25 bp, Mus musculus
gatctttgggttttcctgacactga

SEQ ID NO: 510184 - DNA, 25 bp, Mus musculus
gatctttgtacaaattagcttctat

SEQ ID NO: 510185 - DNA, 25 bp, Mus musculus
gatctttgtacatattagcttctat

SEQ ID NO: 510186 - DNA, 25 bp, Mus musculus
gatctttgtatcattcatatttgga

SEQ ID NO: 510187 - DNA, 25 bp, Mus musculus
gatctttgtatccaatgtcaggcca

SEQ ID NO: 510188 - DNA, 25 bp, Mus musculus
gatctttgtatcgaatgtcaggcca

SEQ ID NO: 510189 - DNA, 25 bp, Mus musculus
gatctttgtatctttcatatttgga

SEQ ID NO: 510190 - DNA, 25 bp, Mus musculus
gatctttgtgaaaaccttaactggt

SEQ ID NO: 510191 - DNA, 25 bp, Mus musculus
gatctttgtgaataccttaactggt

SEQ ID NO: 510192 - DNA, 25 bp, Mus musculus
gatctttgttcacggcatcatgtgg

SEQ ID NO: 510193 - DNA, 25 bp, Mus musculus
gatctttgttcagggcatcatgtgg

SEQ ID NO: 510194 - DNA, 25 bp, Mus musculus
gatcttttaatgaaccatctcctat

SEQ ID NO: 510195 - DNA, 25 bp, Mus musculus
gatcttttaatgtaccatctcctat

SEQ ID NO: 510196 - DNA, 25 bp, Mus musculus
gatcttttagtgaagtgtggaggtc

SEQ ID NO: 510197 - DNA, 25 bp, Mus musculus
gatcttttagtgtagtgtggaggtc

SEQ ID NO: 510198 - DNA, 25 bp, Mus musculus
gatcttttagttatgagccctgcga

SEQ ID NO: 510199 - DNA, 25 bp, Mus musculus
gatcttttagttttgagccctgcga

SEQ ID NO: 510200 - DNA, 25 bp, Mus musculus
gatcttttatgacctagtgcggcaa

SEQ ID NO: 510201 - DNA, 25 bp, Mus musculus
gatcttttatgagctagtgcggcaa

SEQ ID NO: 510202 - DNA, 25 bp, Mus musculus
gatcttttattaatggcttccacga

SEQ ID NO: 510203 - DNA, 25 bp, Mus musculus
gatcttttattattggcttccacga

SEQ ID NO: 510204 - DNA, 25 bp, Mus musculus
gatcttttcaatcttctccagctga

SEQ ID NO: 510205 - DNA, 25 bp, Mus musculus
gatcttttcaatgttctccagctga

SEQ ID NO: 510206 - DNA, 25 bp, Mus musculus
gatcttttcactctttttcttcagg

SEQ ID NO: 510207 - DNA, 25 bp, Mus musculus
gatcttttcactgtttttcttcagg

SEQ ID NO: 510208 - DNA, 25 bp, Mus musculus
gatcttttcataattgtgttgctgg

SEQ ID NO: 510209 - DNA, 25 bp, Mus musculus
gatcttttcatatttgtgttgctgg

SEQ ID NO: 510210 - DNA, 25 bp, Mus musculus
gatcttttccagagctgtgggagga

SEQ ID NO: 510211 - DNA, 25 bp, Mus musculus
gatcttttccagatgggccatacta

SEQ ID NO: 510212 - DNA, 25 bp, Mus musculus
gatcttttccagtgctgtgggagga

SEQ ID NO: 510213 - DNA, 25 bp, Mus musculus
gatcttttccagttgggccatacta

SEQ ID NO: 510214 - DNA, 25 bp, Mus musculus
gatcttttccataattgtgaccttt

SEQ ID NO: 510215 - DNA, 25 bp, Mus musculus
gatcttttccattattgtgaccttt

SEQ ID NO: 510216 - DNA, 25 bp, Mus musculus
gatcttttcccaattatgctgggaa

SEQ ID NO: 510217 - DNA, 25 bp, Mus musculus
gatcttttcccatttatgctgggaa

SEQ ID NO: 510218 - DNA, 25 bp, Mus musculus
gatcttttcttgaacttttgtctga

SEQ ID NO: 510219 - DNA, 25 bp, Mus musculus
gatcttttcttgtacttttgtctga

SEQ ID NO: 510220 - DNA, 25 bp, Mus musculus
gatcttttctttccccagcgagaga

SEQ ID NO: 510221 - DNA, 25 bp, Mus musculus
gatcttttctttgcccagcgagaga

SEQ ID NO: 510222 - DNA, 25 bp, Mus musculus
gatcttttgataatctgctacctgg

SEQ ID NO: 510223 - DNA, 25 bp, Mus musculus
gatcttttgatattctgctacctgg

SEQ ID NO: 510224 - DNA, 25 bp, Mus musculus
gatcttttgccacaactctagacgt

SEQ ID NO: 510225 - DNA, 25 bp, Mus musculus
gatcttttgccagaactctagacgt

SEQ ID NO: 510226 - DNA, 25 bp, Mus musculus
gatcttttgcttagaactctgacga

SEQ ID NO: 510227 - DNA, 25 bp, Mus musculus
gatcttttgctttgaactctgacga

SEQ ID NO: 510228 - DNA, 25 bp, Mus musculus
gatcttttggatcaagggttccctt

SEQ ID NO: 510229 - DNA, 25 bp, Mus musculus
gatcttttggatgaagggttccctt

SEQ ID NO: 510230 - DNA, 25 bp, Mus musculus
gatcttttgtggcttatatgctagt

SEQ ID NO: 510231 - DNA, 25 bp, Mus musculus
gatcttttgtgggttatatgctagt

SEQ ID NO: 510232 - DNA, 25 bp, Mus musculus
gatctttttataccccgccaacaag

SEQ ID NO: 510233 - DNA, 25 bp, Mus musculus
gatctttttatagcccgccaacaag

SEQ ID NO: 510234 - DNA, 25 bp, Mus musculus
gatctttttcctaagaagtggtctt

SEQ ID NO: 510235 - DNA, 25 bp, Mus musculus
gatctttttccttagaagtggtctt

SEQ ID NO: 510236 - DNA, 25 bp, Mus musculus
gatctttttgacataatgtccttca

SEQ ID NO: 510237 - DNA, 25 bp, Mus musculus
gatctttttgacttaatgtccttca

SEQ ID NO: 510238 - DNA, 25 bp, Mus musculus
gatctttttgctatccaaatgcgtt

SEQ ID NO: 510239 - DNA, 25 bp, Mus musculus
gatctttttgctttccaaatgcgtt

SEQ ID NO: 510240 - DNA, 25 bp, Mus musculus
gatcttttttaaaactgttgctgac

SEQ ID NO: 510241 - DNA, 25 bp, Mus musculus
gatcttttttaatactgttgctgac

SEQ ID NO: 510242 - DNA, 25 bp, Mus musculus
gatcttttttcaaatggctcgtgta

SEQ ID NO: 510243 - DNA, 25 bp, Mus musculus
gatcttttttcatatggctcgtgta

SEQ ID NO: 510244 - DNA, 25 bp, Mus musculus
gatgaaaacccaagtgggacccatt

SEQ ID NO: 510245 - DNA, 25 bp, Mus musculus
gatgaaaacccatgtgggacccatt

SEQ ID NO: 510246 - DNA, 25 bp, Mus musculus
gatgaaaactacaacaaggcccaga

SEQ ID NO: 510247 - DNA, 25 bp, Mus musculus
gatgaaaactactacaaggcccaga

SEQ ID NO: 510248 - DNA, 25 bp, Mus musculus
gatgaaaagcatactgtgtgattgt

SEQ ID NO: 510249 - DNA, 25 bp, Mus musculus
gatgaaaagcattctgtgtgattgt

SEQ ID NO: 510250 - DNA, 25 bp, Mus musculus
gatgaaaattctatattaccctctt

SEQ ID NO: 510251 - DNA, 25 bp, Mus musculus
gatgaaaattctattgcctcagcaa

SEQ ID NO: 510252 - DNA, 25 bp, Mus musculus
gatgaaaattctttattaccctctt

SEQ ID NO: 510253 - DNA, 25 bp, Mus musculus
gatgaaaattcttttgcctcagcaa

SEQ ID NO: 510254 - DNA, 25 bp, Mus musculus
gatgaaacagcaagctttggagaac

SEQ ID NO: 510255 - DNA, 25 bp, Mus musculus
gatgaaacagcatgctttggagaac

SEQ ID NO: 510256 - DNA, 25 bp, Mus musculus
gatgaaacagtgagaagcccctagg

SEQ ID NO: 510257 - DNA, 25 bp, Mus musculus
gatgaaacagtgtgaagcccctagg

SEQ ID NO: 510258 - DNA, 25 bp, Mus musculus
gatgaaacattaccctttggcggac

SEQ ID NO: 510259 - DNA, 25 bp, Mus musculus
gatgaaacattagcctttggcggac

SEQ ID NO: 510260 - DNA, 25 bp, Mus musculus
gatgaaaccactactaagtctgcta

SEQ ID NO: 510261 - DNA, 25 bp, Mus musculus
gatgaaaccacttctaagtctgcta

SEQ ID NO: 510262 - DNA, 25 bp, Mus musculus
gatgaaaccagtcctgttgatacca

SEQ ID NO: 510263 - DNA, 25 bp, Mus musculus
gatgaaaccagtgctgttgatacca

SEQ ID NO: 510264 - DNA, 25 bp, Mus musculus
gatgaaacccaaacacagtatgcta

SEQ ID NO: 510265 - DNA, 25 bp, Mus musculus
gatgaaacccaatcacagtatgcta

SEQ ID NO: 510266 - DNA, 25 bp, Mus musculus
gatgaaacccatctctaaattttta

SEQ ID NO: 510267 - DNA, 25 bp, Mus musculus
gatgaaacccatgtctaaattttta

SEQ ID NO: 510268 - DNA, 25 bp, Mus musculus
gatgaaacctgtcctgagaagccac

SEQ ID NO: 510269 - DNA, 25 bp, Mus musculus
gatgaaacctgtgctgagaagccac

SEQ ID NO: 510270 - DNA, 25 bp, Mus musculus
gatgaaacctttcctaacgtgaatg

SEQ ID NO: 510271 - DNA, 25 bp, Mus musculus
gatgaaacctttgctaacgtgaatg

SEQ ID NO: 510272 - DNA, 25 bp, Mus musculus
gatgaaacgccgcaagggtcgccct

SEQ ID NO: 510273 - DNA, 25 bp, Mus musculus
gatgaaacgccggaagggtcgccct

SEQ ID NO: 510274 - DNA, 25 bp, Mus musculus
gatgaaactaaaagtgtccaccatg

SEQ ID NO: 510275 - DNA, 25 bp, Mus musculus
gatgaaactaaatgtgtccaccatg

SEQ ID NO: 510276 - DNA, 25 bp, Mus musculus
gatgaaactacgacagattcctgtt

SEQ ID NO: 510277 - DNA, 25 bp, Mus musculus
gatgaaactacgcaacagcaaattt

SEQ ID NO: 510278 - DNA, 25 bp, Mus musculus
gatgaaactacggaacagcaaattt

SEQ ID NO: 510279 - DNA, 25 bp, Mus musculus
gatgaaactacgtcagattcctgtt

SEQ ID NO: 510280 - DNA, 25 bp, Mus musculus
gatgaaactcatccttcggaaacga

SEQ ID NO: 510281 - DNA, 25 bp, Mus musculus
gatgaaactcatgcttcggaaacga

SEQ ID NO: 510282 - DNA, 25 bp, Mus musculus
gatgaaactgtaatccgaagactta

SEQ ID NO: 510283 - DNA, 25 bp, Mus musculus
gatgaaactgtattccgaagactta

SEQ ID NO: 510284 - DNA, 25 bp, Mus musculus
gatgaaacttttcagccagtgaatg

SEQ ID NO: 510285 - DNA, 25 bp, Mus musculus
gatgaaacttttgagccagtgaatg

SEQ ID NO: 510286 - DNA, 25 bp, Mus musculus
gatgaaagacatagtggcacacatt

SEQ ID NO: 510287 - DNA, 25 bp, Mus musculus
gatgaaagacattgtggcacacatt

SEQ ID NO: 510288 - DNA, 25 bp, Mus musculus
gatgaaagacgaaggtgtgttccct

SEQ ID NO: 510289 - DNA, 25 bp, Mus musculus
gatgaaagacgatggtgtgttccct

SEQ ID NO: 510290 - DNA, 25 bp, Mus musculus
gatgaaagagacactgagttcttaa

SEQ ID NO: 510291 - DNA, 25 bp, Mus musculus
gatgaaagagactctgagttcttaa

SEQ ID NO: 510292 - DNA, 25 bp, Mus musculus
gatgaaagatgtccggctgccttgc

SEQ ID NO: 510293 - DNA, 25 bp, Mus musculus
gatgaaagatgtgcggctgccttgc

SEQ ID NO: 510294 - DNA, 25 bp, Mus musculus
gatgaaagcacaatacttccaatag

SEQ ID NO: 510295 - DNA, 25 bp, Mus musculus
gatgaaagcacattacttccaatag

SEQ ID NO: 510296 - DNA, 25 bp, Mus musculus
gatgaaagcattcctctctcaccag

SEQ ID NO: 510297 - DNA, 25 bp, Mus musculus
gatgaaagcattgctctctcaccag

SEQ ID NO: 510298 - DNA, 25 bp, Mus musculus
gatgaaagcctgacacgagaccctg

SEQ ID NO: 510299 - DNA, 25 bp, Mus musculus
gatgaaagcctgtcacgagaccctg

SEQ ID NO: 510300 - DNA, 25 bp, Mus musculus
gatgaaagcgagagggctccaccct

SEQ ID NO: 510301 - DNA, 25 bp, Mus musculus
gatgaaagcgagtgggctccaccct

SEQ ID NO: 510302 - DNA, 25 bp, Mus musculus
gatgaaagggtcatctggccagcaa

SEQ ID NO: 510303 - DNA, 25 bp, Mus musculus
gatgaaagggtcttctggccagcaa

SEQ ID NO: 510304 - DNA, 25 bp, Mus musculus
gatgaaagggttatgtcctagctaa

SEQ ID NO: 510305 - DNA, 25 bp, Mus musculus
gatgaaagggttttgtcctagctaa

SEQ ID NO: 510306 - DNA, 25 bp, Mus musculus
gatgaaaggtttatatccctgccgc

SEQ ID NO: 510307 - DNA, 25 bp, Mus musculus
gatgaaaggtttttatccctgccgc

SEQ ID NO: 510308 - DNA, 25 bp, Mus musculus
gatgaaagtaccatacagatgccaa

SEQ ID NO: 510309 - DNA, 25 bp, Mus musculus
gatgaaagtaccttacagatgccaa

SEQ ID NO: 510310 - DNA, 25 bp, Mus musculus
gatgaaagtccaccccaagggcagg

SEQ ID NO: 510311 - DNA, 25 bp, Mus musculus
gatgaaagtccagcccaagggcagg

SEQ ID NO: 510312 - DNA, 25 bp, Mus musculus
gatgaaagtcttacctagaaccagg

SEQ ID NO: 510313 - DNA, 25 bp, Mus musculus
gatgaaagtctttcctagaaccagg

SEQ ID NO: 510314 - DNA, 25 bp, Mus musculus
gatgaaagtgaaccctagtaggcaa

SEQ ID NO: 510315 - DNA, 25 bp, Mus musculus
gatgaaagtgaagcctagtaggcaa

SEQ ID NO: 510316 - DNA, 25 bp, Mus musculus
gatgaaagtggcactctgccattcc

SEQ ID NO: 510317 - DNA, 25 bp, Mus musculus
gatgaaagtggctctctgccattcc

SEQ ID NO: 510318 - DNA, 25 bp, Mus musculus
gatgaaagttctcaagtttgcttgt

SEQ ID NO: 510319 - DNA, 25 bp, Mus musculus
gatgaaagttctgaagtttgcttgt

SEQ ID NO: 510320 - DNA, 25 bp, Mus musculus
gatgaaatacctatgtaagagctct

SEQ ID NO: 510321 - DNA, 25 bp, Mus musculus
gatgaaatacctttgtaagagctct

SEQ ID NO: 510322 - DNA, 25 bp, Mus musculus
gatgaaatactaaccacatggaagt

SEQ ID NO: 510323 - DNA, 25 bp, Mus musculus
gatgaaatactatccacatggaagt

SEQ ID NO: 510324 - DNA, 25 bp, Mus musculus
gatgaaatagatacaaggccaatta

SEQ ID NO: 510325 - DNA, 25 bp, Mus musculus
gatgaaatagattcaaggccaatta

SEQ ID NO: 510326 - DNA, 25 bp, Mus musculus
gatgaaatatgacccggtggcctcc

SEQ ID NO: 510327 - DNA, 25 bp, Mus musculus
gatgaaatatgagccggtggcctcc

SEQ ID NO: 510328 - DNA, 25 bp, Mus musculus
gatgaaatcaagaatgcaacccagc

SEQ ID NO: 510329 - DNA, 25 bp, Mus musculus
gatgaaatcaagtatgcaacccagc

SEQ ID NO: 510330 - DNA, 25 bp, Mus musculus
gatgaaatcatgactagaagtctgg

SEQ ID NO: 510331 - DNA, 25 bp, Mus musculus
gatgaaatcatgtctagaagtctgg

SEQ ID NO: 510332 - DNA, 25 bp, Mus musculus
gatgaaatccatcccagcttgcctg

SEQ ID NO: 510333 - DNA, 25 bp, Mus musculus
gatgaaatccatgccagcttgcctg

SEQ ID NO: 510334 - DNA, 25 bp, Mus musculus
gatgaaatcgaacagtcgctgaacg

SEQ ID NO: 510335 - DNA, 25 bp, Mus musculus
gatgaaatcgaagagtcgctgaacg

SEQ ID NO: 510336 - DNA, 25 bp, Mus musculus
gatgaaatcgacagctcgtccatgt

SEQ ID NO: 510337 - DNA, 25 bp, Mus musculus
gatgaaatcgactgctcgtccatgt

SEQ ID NO: 510338 - DNA, 25 bp, Mus musculus
gatgaaatctgcacactgagctccc

SEQ ID NO: 510339 - DNA, 25 bp, Mus musculus
gatgaaatctgctcactgagctccc

SEQ ID NO: 510340 - DNA, 25 bp, Mus musculus
gatgaaatgagtacattgcctccct

SEQ ID NO: 510341 - DNA, 25 bp, Mus musculus
gatgaaatgagttcattgcctccct

SEQ ID NO: 510342 - DNA, 25 bp, Mus musculus
gatgaaatggagactccttcctaga

SEQ ID NO: 510343 - DNA, 25 bp, Mus musculus
gatgaaatggagtctccttcctaga

SEQ ID NO: 510344 - DNA, 25 bp, Mus musculus
gatgaaatggtgctggtccttcttc

SEQ ID NO: 510345 - DNA, 25 bp, Mus musculus
gatgaaatggtggtggtccttcttc

SEQ ID NO: 510346 - DNA, 25 bp, Mus musculus
gatgaaatggttctcaaagtactcc

SEQ ID NO: 510347 - DNA, 25 bp, Mus musculus
gatgaaatggttgtcaaagtactcc

SEQ ID NO: 510348 - DNA, 25 bp, Mus musculus
gatgaaatgtctcaccttctccaca

SEQ ID NO: 510349 - DNA, 25 bp, Mus musculus
gatgaaatgtctgaccttctccaca

SEQ ID NO: 510350 - DNA, 25 bp, Mus musculus
gatgaaattagacccaccccattgt

SEQ ID NO: 510351 - DNA, 25 bp, Mus musculus
gatgaaattagagccaccccattgt

SEQ ID NO: 510352 - DNA, 25 bp, Mus musculus
gatgaaattcgactgtcccgttacc

SEQ ID NO: 510353 - DNA, 25 bp, Mus musculus
gatgaaattcgagtgtcccgttacc

SEQ ID NO: 510354 - DNA, 25 bp, Mus musculus
gatgaaattctaccccaagagattt

SEQ ID NO: 510355 - DNA, 25 bp, Mus musculus
gatgaaattctagcccaagagattt

SEQ ID NO: 510356 - DNA, 25 bp, Mus musculus
gatgaaattgcacaagcccaggcca

SEQ ID NO: 510357 - DNA, 25 bp, Mus musculus
gatgaaattgcagaagcccaggcca

SEQ ID NO: 510358 - DNA, 25 bp, Mus musculus
gatgaaattttccttgtctttggct

SEQ ID NO: 510359 - DNA, 25 bp, Mus musculus
gatgaaattttcgttgtctttggct

SEQ ID NO: 510360 - DNA, 25 bp, Mus musculus
gatgaacaaagccagtaccccgggc

SEQ ID NO: 510361 - DNA, 25 bp, Mus musculus
gatgaacaaagcgagtaccccgggc

SEQ ID NO: 510362 - DNA, 25 bp, Mus musculus
gatgaacaacctaggtaggcgtaca

SEQ ID NO: 510363 - DNA, 25 bp, Mus musculus
gatgaacaaccttggtaggcgtaca

SEQ ID NO: 510364 - DNA, 25 bp, Mus musculus
gatgaacaaggtcaaaaatcccctc

SEQ ID NO: 510365 - DNA, 25 bp, Mus musculus
gatgaacaaggtgaaaaatcccctc

SEQ ID NO: 510366 - DNA, 25 bp, Mus musculus
gatgaacaatcacctggagccacta

SEQ ID NO: 510367 - DNA, 25 bp, Mus musculus
gatgaacaatcagctggagccacta

SEQ ID NO: 510368 - DNA, 25 bp, Mus musculus
gatgaacacaagaccagtctcacca

SEQ ID NO: 510369 - DNA, 25 bp, Mus musculus
gatgaacacaagtccagtctcacca

SEQ ID NO: 510370 - DNA, 25 bp, Mus musculus
gatgaacacagtaccataggacatt

SEQ ID NO: 510371 - DNA, 25 bp, Mus musculus
gatgaacacagtactgctggcagat

SEQ ID NO: 510372 - DNA, 25 bp, Mus musculus
gatgaacacagttccataggacatt

SEQ ID NO: 510373 - DNA, 25 bp, Mus musculus
gatgaacacagttctgctggcagat

SEQ ID NO: 510374 - DNA, 25 bp, Mus musculus
gatgaacacattactattttaagtt

SEQ ID NO: 510375 - DNA, 25 bp, Mus musculus
gatgaacacatttctattttaagtt

SEQ ID NO: 510376 - DNA, 25 bp, Mus musculus
gatgaacacccacaccgttttgtat

SEQ ID NO: 510377 - DNA, 25 bp, Mus musculus
gatgaacacccagaccgttttgtat

SEQ ID NO: 510378 - DNA, 25 bp, Mus musculus
gatgaacaccctaagccagagcaag

SEQ ID NO: 510379 - DNA, 25 bp, Mus musculus
gatgaacacccttagccagagcaag

SEQ ID NO: 510380 - DNA, 25 bp, Mus musculus
gatgaacactaaaacccagcaccag

SEQ ID NO: 510381 - DNA, 25 bp, Mus musculus
gatgaacactaatacccagcaccag

SEQ ID NO: 510382 - DNA, 25 bp, Mus musculus
gatgaacactccatatagctactga

SEQ ID NO: 510383 - DNA, 25 bp, Mus musculus
gatgaacactccttatagctactga

SEQ ID NO: 510384 - DNA, 25 bp, Mus musculus
gatgaacactcgatgctgcaaaggg

SEQ ID NO: 510385 - DNA, 25 bp, Mus musculus
gatgaacactcgttgctgcaaaggg

SEQ ID NO: 510386 - DNA, 25 bp, Mus musculus
gatgaacacttaattgagcttatgt

SEQ ID NO: 510387 - DNA, 25 bp, Mus musculus
gatgaacacttatttgagcttatgt

SEQ ID NO: 510388 - DNA, 25 bp, Mus musculus
gatgaacagaggaccctgcagtgca

SEQ ID NO: 510389 - DNA, 25 bp, Mus musculus
gatgaacagaggtccctgcagtgca

SEQ ID NO: 510390 - DNA, 25 bp, Mus musculus
gatgaacagcctacttacagctatg

SEQ ID NO: 510391 - DNA, 25 bp, Mus musculus
gatgaacagccttcttacagctatg

SEQ ID NO: 510392 - DNA, 25 bp, Mus musculus
gatgaacagctcaaacctggcgtgc

SEQ ID NO: 510393 - DNA, 25 bp, Mus musculus
gatgaacagctctaacctggcgtgc

SEQ ID NO: 510394 - DNA, 25 bp, Mus musculus
gatgaacagtacacgccaacagtct

SEQ ID NO: 510395 - DNA, 25 bp, Mus musculus
gatgaacagtactcgccaacagtct

SEQ ID NO: 510396 - DNA, 25 bp, Mus musculus
gatgaacagtcactccagccatggg

SEQ ID NO: 510397 - DNA, 25 bp, Mus musculus
gatgaacagtcagtccagccatggg

SEQ ID NO: 510398 - DNA, 25 bp, Mus musculus
gatgaacagtggatcctagctgaag

SEQ ID NO: 510399 - DNA, 25 bp, Mus musculus
gatgaacagtggttcctagctgaag

SEQ ID NO: 510400 - DNA, 25 bp, Mus musculus
gatgaacagtttagcctctgtaata

SEQ ID NO: 510401 - DNA, 25 bp, Mus musculus
gatgaacagttttgcctctgtaata

SEQ ID NO: 510402 - DNA, 25 bp, Mus musculus
gatgaacatcacaatggcgatcaat

SEQ ID NO: 510403 - DNA, 25 bp, Mus musculus
gatgaacatcactatggcgatcaat

SEQ ID NO: 510404 - DNA, 25 bp, Mus musculus
gatgaacatccccacagtgggcatt

SEQ ID NO: 510405 - DNA, 25 bp, Mus musculus
gatgaacatcccgacagtgggcatt

SEQ ID NO: 510406 - DNA, 25 bp, Mus musculus
gatgaacatgccaggattctgtgaa

SEQ ID NO: 510407 - DNA, 25 bp, Mus musculus
gatgaacatgcctggattctgtgaa

SEQ ID NO: 510408 - DNA, 25 bp, Mus musculus
gatgaacattccacccttgactgag

SEQ ID NO: 510409 - DNA, 25 bp, Mus musculus
gatgaacattcctcccttgactgag

SEQ ID NO: 510410 - DNA, 25 bp, Mus musculus
gatgaaccaagcaagtctccaaaag

SEQ ID NO: 510411 - DNA, 25 bp, Mus musculus
gatgaaccaagcctagacacggcat

SEQ ID NO: 510412 - DNA, 25 bp, Mus musculus
gatgaaccaagcgtagacacggcat

SEQ ID NO: 510413 - DNA, 25 bp, Mus musculus
gatgaaccaagctagtctccaaaag

SEQ ID NO: 510414 - DNA, 25 bp, Mus musculus
gatgaaccaattccagactacgctg

SEQ ID NO: 510415 - DNA, 25 bp, Mus musculus
gatgaaccaattgcagactacgctg

SEQ ID NO: 510416 - DNA, 25 bp, Mus musculus
gatgaaccaccacaagtaccgtaaa

SEQ ID NO: 510417 - DNA, 25 bp, Mus musculus
gatgaaccaccagaagtaccgtaaa

SEQ ID NO: 510418 - DNA, 25 bp, Mus musculus
gatgaaccactgaacttagggaagc

SEQ ID NO: 510419 - DNA, 25 bp, Mus musculus
gatgaaccactgcagctagacctgg

SEQ ID NO: 510420 - DNA, 25 bp, Mus musculus
gatgaaccactggagctagacctgg

SEQ ID NO: 510421 - DNA, 25 bp, Mus musculus
gatgaaccactgtacttagggaagc

SEQ ID NO: 510422 - DNA, 25 bp, Mus musculus
gatgaaccacttacacctataaatt

SEQ ID NO: 510423 - DNA, 25 bp, Mus musculus
gatgaaccactttcacctataaatt

SEQ ID NO: 510424 - DNA, 25 bp, Mus musculus
gatgaacccattactccactggatt

SEQ ID NO: 510425 - DNA, 25 bp, Mus musculus
gatgaacccatttctccactggatt

SEQ ID NO: 510426 - DNA, 25 bp, Mus musculus
gatgaacccgacatctcctatagga

SEQ ID NO: 510427 - DNA, 25 bp, Mus musculus
gatgaacccgacttctcctatagga

SEQ ID NO: 510428 - DNA, 25 bp, Mus musculus
gatgaaccctaccatagtcatttat

SEQ ID NO: 510429 - DNA, 25 bp, Mus musculus
gatgaaccctacgatagtcatttat

SEQ ID NO: 510430 - DNA, 25 bp, Mus musculus
gatgaaccggttaggagaattgact

SEQ ID NO: 510431 - DNA, 25 bp, Mus musculus
gatgaaccggttcatgtccctgtta

SEQ ID NO: 510432 - DNA, 25 bp, Mus musculus
gatgaaccggttgatgtccctgtta

SEQ ID NO: 510433 - DNA, 25 bp, Mus musculus
gatgaaccggtttggagaattgact

SEQ ID NO: 510434 - DNA, 25 bp, Mus musculus
gatgaacctacccatgaagtctctt

SEQ ID NO: 510435 - DNA, 25 bp, Mus musculus
gatgaacctaccgatgaagtctctt

SEQ ID NO: 510436 - DNA, 25 bp, Mus musculus
gatgaacctactattgtacctgcca

SEQ ID NO: 510437 - DNA, 25 bp, Mus musculus
gatgaacctacttttgtacctgcca

SEQ ID NO: 510438 - DNA, 25 bp, Mus musculus
gatgaacctagtcatactgcagctt

SEQ ID NO: 510439 - DNA, 25 bp, Mus musculus
gatgaacctagtgatactgcagctt

SEQ ID NO: 510440 - DNA, 25 bp, Mus musculus
gatgaacctatcagacccagggaaa

SEQ ID NO: 510441 - DNA, 25 bp, Mus musculus
gatgaacctatctgacccagggaaa

SEQ ID NO: 510442 - DNA, 25 bp, Mus musculus
gatgaacctgatccacatggcttga

SEQ ID NO: 510443 - DNA, 25 bp, Mus musculus
gatgaacctgatgcacatggcttga

SEQ ID NO: 510444 - DNA, 25 bp, Mus musculus
gatgaacctggacggcactgtgcta

SEQ ID NO: 510445 - DNA, 25 bp, Mus musculus
gatgaacctggagggcactgtgcta

SEQ ID NO: 510446 - DNA, 25 bp, Mus musculus
gatgaacctttgcagaacttctcaa

SEQ ID NO: 510447 - DNA, 25 bp, Mus musculus
gatgaacctttggagaacttctcaa

SEQ ID NO: 510448 - DNA, 25 bp, Mus musculus
gatgaacgaacacactcaggcgatg

SEQ ID NO: 510449 - DNA, 25 bp, Mus musculus
gatgaacgaacagactcaggcgatg

SEQ ID NO: 510450 - DNA, 25 bp, Mus musculus
gatgaacgaatgctgggcctaccct

SEQ ID NO: 510451 - DNA, 25 bp, Mus musculus
gatgaacgaatggtgggcctaccct

SEQ ID NO: 510452 - DNA, 25 bp, Mus musculus
gatgaacgcagaccaaagattgaat

SEQ ID NO: 510453 - DNA, 25 bp, Mus musculus
gatgaacgcagagcaaagattgaat

SEQ ID NO: 510454 - DNA, 25 bp, Mus musculus
gatgaacggaatacaccatgggtat

SEQ ID NO: 510455 - DNA, 25 bp, Mus musculus
gatgaacggaattcaccatgggtat

SEQ ID NO: 510456 - DNA, 25 bp, Mus musculus
gatgaacgtgggacgcttcacagag

SEQ ID NO: 510457 - DNA, 25 bp, Mus musculus
gatgaacgtgggtcgcttcacagag

SEQ ID NO: 510458 - DNA, 25 bp, Mus musculus
gatgaactaagtaacaggccccaga

SEQ ID NO: 510459 - DNA, 25 bp, Mus musculus
gatgaactaagtcattggtaaaccc

SEQ ID NO: 510460 - DNA, 25 bp, Mus musculus
gatgaactaagtgattggtaaaccc

SEQ ID NO: 510461 - DNA, 25 bp, Mus musculus
gatgaactaagttacaggccccaga

SEQ ID NO: 510462 - DNA, 25 bp, Mus musculus
gatgaactacatatggcacgttact

SEQ ID NO: 510463 - DNA, 25 bp, Mus musculus
gatgaactacatctctagccaacta

SEQ ID NO: 510464 - DNA, 25 bp, Mus musculus
gatgaactacatgtctagccaacta

SEQ ID NO: 510465 - DNA, 25 bp, Mus musculus
gatgaactacatttggcacgttact

SEQ ID NO: 510466 - DNA, 25 bp, Mus musculus
gatgaactattacacgggaaacccg

SEQ ID NO: 510467 - DNA, 25 bp, Mus musculus
gatgaactattagacgggaaacccg

SEQ ID NO: 510468 - DNA, 25 bp, Mus musculus
gatgaactcactaaaccttcctgtg

SEQ ID NO: 510469 - DNA, 25 bp, Mus musculus
gatgaactcacttaaccttcctgtg

SEQ ID NO: 510470 - DNA, 25 bp, Mus musculus
gatgaactcatcaggtctagctaac

SEQ ID NO: 510471 - DNA, 25 bp, Mus musculus
gatgaactcatctggtctagctaac

SEQ ID NO: 510472 - DNA, 25 bp, Mus musculus
gatgaactccaaacttttccagaaa

SEQ ID NO: 510473 - DNA, 25 bp, Mus musculus
gatgaactccaatcttttccagaaa

SEQ ID NO: 510474 - DNA, 25 bp, Mus musculus
gatgaactccaccagcagacagtgt

SEQ ID NO: 510475 - DNA, 25 bp, Mus musculus
gatgaactccacgagcagacagtgt

SEQ ID NO: 510476 - DNA, 25 bp, Mus musculus
gatgaactcccaaggtggctactcc

SEQ ID NO: 510477 - DNA, 25 bp, Mus musculus
gatgaactcccatggtggctactcc

SEQ ID NO: 510478 - DNA, 25 bp, Mus musculus
gatgaactcccgaaacttcaagtgg

SEQ ID NO: 510479 - DNA, 25 bp, Mus musculus
gatgaactcccgtaacttcaagtgg

SEQ ID NO: 510480 - DNA, 25 bp, Mus musculus
gatgaactccctacttgtaacgcta

SEQ ID NO: 510481 - DNA, 25 bp, Mus musculus
gatgaactcccttcttgtaacgcta

SEQ ID NO: 510482 - DNA, 25 bp, Mus musculus
gatgaactcctgacctgatatgtgc

SEQ ID NO: 510483 - DNA, 25 bp, Mus musculus
gatgaactcctgattggtgacgtgg

SEQ ID NO: 510484 - DNA, 25 bp, Mus musculus
gatgaactcctgtcctgatatgtgc

SEQ ID NO: 510485 - DNA, 25 bp, Mus musculus
gatgaactcctgtttggtgacgtgg

SEQ ID NO: 510486 - DNA, 25 bp, Mus musculus
gatgaactcgatacccctgatgaag

SEQ ID NO: 510487 - DNA, 25 bp, Mus musculus
gatgaactcgattcccctgatgaag

SEQ ID NO: 510488 - DNA, 25 bp, Mus musculus
gatgaactctgtaattgccaactct

SEQ ID NO: 510489 - DNA, 25 bp, Mus musculus
gatgaactctgttattgccaactct

SEQ ID NO: 510490 - DNA, 25 bp, Mus musculus
gatgaactcttgatgctgaggccga

SEQ ID NO: 510491 - DNA, 25 bp, Mus musculus
gatgaactcttgttgctgaggccga

SEQ ID NO: 510492 - DNA, 25 bp, Mus musculus
gatgaactgaacaagctccgagtgt

SEQ ID NO: 510493 - DNA, 25 bp, Mus musculus
gatgaactgaactagctccgagtgt

SEQ ID NO: 510494 - DNA, 25 bp, Mus musculus
gatgaactgatcacaccacagggct

SEQ ID NO: 510495 - DNA, 25 bp, Mus musculus
gatgaactgatctcaccacagggct

SEQ ID NO: 510496 - DNA, 25 bp, Mus musculus
gatgaactgcaaacagctctgtctc

SEQ ID NO: 510497 - DNA, 25 bp, Mus musculus
gatgaactgcaatcagctctgtctc

SEQ ID NO: 510498 - DNA, 25 bp, Mus musculus
gatgaactgcacaacttggaaggtc

SEQ ID NO: 510499 - DNA, 25 bp, Mus musculus
gatgaactgcactacttggaaggtc

SEQ ID NO: 510500 - DNA, 25 bp, Mus musculus
gatgaactgcctcacttgtgacacc

SEQ ID NO: 510501 - DNA, 25 bp, Mus musculus
gatgaactgcctgacttgtgacacc

SEQ ID NO: 510502 - DNA, 25 bp, Mus musculus
gatgaactggaaaagcgattcctta

SEQ ID NO: 510503 - DNA, 25 bp, Mus musculus
gatgaactggaatagcgattcctta

SEQ ID NO: 510504 - DNA, 25 bp, Mus musculus
gatgaactggacaagccgttgggaa

SEQ ID NO: 510505 - DNA, 25 bp, Mus musculus
gatgaactggactagccgttgggaa

SEQ ID NO: 510506 - DNA, 25 bp, Mus musculus
gatgaactgggcaagctgtctccca

SEQ ID NO: 510507 - DNA, 25 bp, Mus musculus
gatgaactgggctagctgtctccca

SEQ ID NO: 510508 - DNA, 25 bp, Mus musculus
gatgaactgtgaaagcaacgtgagc

SEQ ID NO: 510509 - DNA, 25 bp, Mus musculus
gatgaactgtgatagcaacgtgagc

SEQ ID NO: 510510 - DNA, 25 bp, Mus musculus
gatgaacttagaactttggaaaggc

SEQ ID NO: 510511 - DNA, 25 bp, Mus musculus
gatgaacttagatctttggaaaggc

SEQ ID NO: 510512 - DNA, 25 bp, Mus musculus
gatgaacttagcctctgagcaaccc

SEQ ID NO: 510513 - DNA, 25 bp, Mus musculus
gatgaacttagcgtctgagcaaccc

SEQ ID NO: 510514 - DNA, 25 bp, Mus musculus
gatgaacttaggattcacccatgat

SEQ ID NO: 510515 - DNA, 25 bp, Mus musculus
gatgaacttaggtttcacccatgat

SEQ ID NO: 510516 - DNA, 25 bp, Mus musculus
gatgaacttagtcccctactttccg

SEQ ID NO: 510517 - DNA, 25 bp, Mus musculus
gatgaacttagtgccctactttccg

SEQ ID NO: 510518 - DNA, 25 bp, Mus musculus
gatgaacttatgctaccacgctttt

SEQ ID NO: 510519 - DNA, 25 bp, Mus musculus
gatgaacttatggtaccacgctttt

SEQ ID NO: 510520 - DNA, 25 bp, Mus musculus
gatgaacttcagagcctagaccaga

SEQ ID NO: 510521 - DNA, 25 bp, Mus musculus
gatgaacttcagctccacatgtgac

SEQ ID NO: 510522 - DNA, 25 bp, Mus musculus
gatgaacttcaggtccacatgtgac

SEQ ID NO: 510523 - DNA, 25 bp, Mus musculus
gatgaacttcagtgcctagaccaga

SEQ ID NO: 510524 - DNA, 25 bp, Mus musculus
gatgaacttcatatccactctgatg

SEQ ID NO: 510525 - DNA, 25 bp, Mus musculus
gatgaacttcatttccactctgatg

SEQ ID NO: 510526 - DNA, 25 bp, Mus musculus
gatgaacttccaccttttgtatttt

SEQ ID NO: 510527 - DNA, 25 bp, Mus musculus
gatgaacttccagcttttgtatttt

SEQ ID NO: 510528 - DNA, 25 bp, Mus musculus
gatgaacttcggcatcaggaaaaga

SEQ ID NO: 510529 - DNA, 25 bp, Mus musculus
gatgaacttcggctgttagaggact

SEQ ID NO: 510530 - DNA, 25 bp, Mus musculus
gatgaacttcgggatcaggaaaaga

SEQ ID NO: 510531 - DNA, 25 bp, Mus musculus
gatgaacttcgggtgttagaggact

SEQ ID NO: 510532 - DNA, 25 bp, Mus musculus
gatgaacttcgtatccagatagttt

SEQ ID NO: 510533 - DNA, 25 bp, Mus musculus
gatgaacttcgtttccagatagttt

SEQ ID NO: 510534 - DNA, 25 bp, Mus musculus
gatgaacttgagagttttgcttttg

SEQ ID NO: 510535 - DNA, 25 bp, Mus musculus
gatgaacttgagtgttttgcttttg

SEQ ID NO: 510536 - DNA, 25 bp, Mus musculus
gatgaactttagaaccccgatgctt

SEQ ID NO: 510537 - DNA, 25 bp, Mus musculus
gatgaactttagtaccccgatgctt

SEQ ID NO: 510538 - DNA, 25 bp, Mus musculus
gatgaacttttcactggaaaccttg

SEQ ID NO: 510539 - DNA, 25 bp, Mus musculus
gatgaacttttctctggaaaccttg

SEQ ID NO: 510540 - DNA, 25 bp, Mus musculus
gatgaagaaattaggctgtaggctg

SEQ ID NO: 510541 - DNA, 25 bp, Mus musculus
gatgaagaaatttggctgtaggctg

SEQ ID NO: 510542 - DNA, 25 bp, Mus musculus
gatgaagaacttcgctttgggtcct

SEQ ID NO: 510543 - DNA, 25 bp, Mus musculus
gatgaagaacttggctttgggtcct

SEQ ID NO: 510544 - DNA, 25 bp, Mus musculus
gatgaagaaggtcaccctagaccct

SEQ ID NO: 510545 - DNA, 25 bp, Mus musculus
gatgaagaaggtgaccctagaccct

SEQ ID NO: 510546 - DNA, 25 bp, Mus musculus
gatgaagaatcactagttggcaaaa

SEQ ID NO: 510547 - DNA, 25 bp, Mus musculus
gatgaagaatcagtagttggcaaaa

SEQ ID NO: 510548 - DNA, 25 bp, Mus musculus
gatgaagaattccaggatgcaaacc

SEQ ID NO: 510549 - DNA, 25 bp, Mus musculus
gatgaagaattcgaggatgcaaacc

SEQ ID NO: 510550 - DNA, 25 bp, Mus musculus
gatgaagaatttaaactagccacat

SEQ ID NO: 510551 - DNA, 25 bp, Mus musculus
gatgaagaatttatacaactgcccc

SEQ ID NO: 510552 - DNA, 25 bp, Mus musculus
gatgaagaattttaactagccacat

SEQ ID NO: 510553 - DNA, 25 bp, Mus musculus
gatgaagaatttttacaactgcccc

SEQ ID NO: 510554 - DNA, 25 bp, Mus musculus
gatgaagacctacaggttttccgaa

SEQ ID NO: 510555 - DNA, 25 bp, Mus musculus
gatgaagacctagaggttttccgaa

SEQ ID NO: 510556 - DNA, 25 bp, Mus musculus
gatgaagacctcaggatctctgctc

SEQ ID NO: 510557 - DNA, 25 bp, Mus musculus
gatgaagacctctggatctctgctc

SEQ ID NO: 510558 - DNA, 25 bp, Mus musculus
gatgaagacctgagcggaatccctc

SEQ ID NO: 510559 - DNA, 25 bp, Mus musculus
gatgaagacctgcacagtagcagcc

SEQ ID NO: 510560 - DNA, 25 bp, Mus musculus
gatgaagacctggacagtagcagcc

SEQ ID NO: 510561 - DNA, 25 bp, Mus musculus
gatgaagacctgtgcggaatccctc

SEQ ID NO: 510562 - DNA, 25 bp, Mus musculus
gatgaagacgacaatcccaacggct

SEQ ID NO: 510563 - DNA, 25 bp, Mus musculus
gatgaagacgactatcccaacggct

SEQ ID NO: 510564 - DNA, 25 bp, Mus musculus
gatgaagacggtattgctttataaa

SEQ ID NO: 510565 - DNA, 25 bp, Mus musculus
gatgaagacggttttgctttataaa

SEQ ID NO: 510566 - DNA, 25 bp, Mus musculus
gatgaagactgaactcttccgcctg

SEQ ID NO: 510567 - DNA, 25 bp, Mus musculus
gatgaagactgatctcttccgcctg

SEQ ID NO: 510568 - DNA, 25 bp, Mus musculus
gatgaagactggctctggttccttt

SEQ ID NO: 510569 - DNA, 25 bp, Mus musculus
gatgaagactgggtctggttccttt

SEQ ID NO: 510570 - DNA, 25 bp, Mus musculus
gatgaagagacccatacctactact

SEQ ID NO: 510571 - DNA, 25 bp, Mus musculus
gatgaagagaccgatacctactact

SEQ ID NO: 510572 - DNA, 25 bp, Mus musculus
gatgaagagccacccgtcagagaca

SEQ ID NO: 510573 - DNA, 25 bp, Mus musculus
gatgaagagccagccgtcagagaca

SEQ ID NO: 510574 - DNA, 25 bp, Mus musculus
gatgaagaggacagatggcgttcct

SEQ ID NO: 510575 - DNA, 25 bp, Mus musculus
gatgaagaggactgatggcgttcct

SEQ ID NO: 510576 - DNA, 25 bp, Mus musculus
gatgaagaggatacatcccaagcaa

SEQ ID NO: 510577 - DNA, 25 bp, Mus musculus
gatgaagaggattcatcccaagcaa

SEQ ID NO: 510578 - DNA, 25 bp, Mus musculus
gatgaagagtccagttgccaacata

SEQ ID NO: 510579 - DNA, 25 bp, Mus musculus
gatgaagagtcctgttgccaacata

SEQ ID NO: 510580 - DNA, 25 bp, Mus musculus
gatgaagagtctaagccagcctcct

SEQ ID NO: 510581 - DNA, 25 bp, Mus musculus
gatgaagagtctacagagagcagga

SEQ ID NO: 510582 - DNA, 25 bp, Mus musculus
gatgaagagtcttagccagcctcct

SEQ ID NO: 510583 - DNA, 25 bp, Mus musculus
gatgaagagtcttcagagagcagga

SEQ ID NO: 510584 - DNA, 25 bp, Mus musculus
gatgaagagtttacagattctgagg

SEQ ID NO: 510585 - DNA, 25 bp, Mus musculus
gatgaagagttttcagattctgagg

SEQ ID NO: 510586 - DNA, 25 bp, Mus musculus
gatgaagatcacaaagtcctgctca

SEQ ID NO: 510587 - DNA, 25 bp, Mus musculus
gatgaagatcactaagtcctgctca

SEQ ID NO: 510588 - DNA, 25 bp, Mus musculus
gatgaagatcttccccaattaccac

SEQ ID NO: 510589 - DNA, 25 bp, Mus musculus
gatgaagatcttgcccaattaccac

SEQ ID NO: 510590 - DNA, 25 bp, Mus musculus
gatgaagatgagctgtaaccccaaa

SEQ ID NO: 510591 - DNA, 25 bp, Mus musculus
gatgaagatgaggtgtaaccccaaa

SEQ ID NO: 510592 - DNA, 25 bp, Mus musculus
gatgaagatgctcatacctggccat

SEQ ID NO: 510593 - DNA, 25 bp, Mus musculus
gatgaagatgctgatacctggccat

SEQ ID NO: 510594 - DNA, 25 bp, Mus musculus
gatgaagattcaccaaataagctat

SEQ ID NO: 510595 - DNA, 25 bp, Mus musculus
gatgaagattcagcaaataagctat

SEQ ID NO: 510596 - DNA, 25 bp, Mus musculus
gatgaagatttcagcccttttcctg

SEQ ID NO: 510597 - DNA, 25 bp, Mus musculus
gatgaagatttcctgcaggcagcaa

SEQ ID NO: 510598 - DNA, 25 bp, Mus musculus
gatgaagatttcgtgcaggcagcaa

SEQ ID NO: 510599 - DNA, 25 bp, Mus musculus
gatgaagatttctgcccttttcctg

SEQ ID NO: 510600 - DNA, 25 bp, Mus musculus
gatgaagcactgctcgccaagagtc

SEQ ID NO: 510601 - DNA, 25 bp, Mus musculus
gatgaagcactggtcgccaagagtc

SEQ ID NO: 510602 - DNA, 25 bp, Mus musculus
gatgaagcacttcagagctctggaa

SEQ ID NO: 510603 - DNA, 25 bp, Mus musculus
gatgaagcacttgagagctctggaa

SEQ ID NO: 510604 - DNA, 25 bp, Mus musculus
gatgaagcattgacccgatggtgcg

SEQ ID NO: 510605 - DNA, 25 bp, Mus musculus
gatgaagcattgtcccgatggtgcg

SEQ ID NO: 510606 - DNA, 25 bp, Mus musculus
gatgaagccaaaaccccaggatctt

SEQ ID NO: 510607 - DNA, 25 bp, Mus musculus
gatgaagccaaatccccaggatctt

SEQ ID NO: 510608 - DNA, 25 bp, Mus musculus
gatgaagccacgacagctctggata

SEQ ID NO: 510609 - DNA, 25 bp, Mus musculus
gatgaagccacgtcagctctggata

SEQ ID NO: 510610 - DNA, 25 bp, Mus musculus
gatgaagccactaccaatggagcta

SEQ ID NO: 510611 - DNA, 25 bp, Mus musculus
gatgaagccacttccaatggagcta

SEQ ID NO: 510612 - DNA, 25 bp, Mus musculus
gatgaagccagcatcattctgtccc

SEQ ID NO: 510613 - DNA, 25 bp, Mus musculus
gatgaagccagcttcattctgtccc

SEQ ID NO: 510614 - DNA, 25 bp, Mus musculus
gatgaagccattccacaacacagtt

SEQ ID NO: 510615 - DNA, 25 bp, Mus musculus
gatgaagccattgcacaacacagtt

SEQ ID NO: 510616 - DNA, 25 bp, Mus musculus
gatgaagcccatcctgagtctgtgg

SEQ ID NO: 510617 - DNA, 25 bp, Mus musculus
gatgaagcccatgctgagtctgtgg

SEQ ID NO: 510618 - DNA, 25 bp, Mus musculus
gatgaagcccctcttctattgagtg

SEQ ID NO: 510619 - DNA, 25 bp, Mus musculus
gatgaagcccctgttctattgagtg

SEQ ID NO: 510620 - DNA, 25 bp, Mus musculus
gatgaagcccttagtgaacatgtgc

SEQ ID NO: 510621 - DNA, 25 bp, Mus musculus
gatgaagccctttgtgaacatgtgc

SEQ ID NO: 510622 - DNA, 25 bp, Mus musculus
gatgaagcctaccttattggccgtg

SEQ ID NO: 510623 - DNA, 25 bp, Mus musculus
gatgaagcctacgttattggccgtg

SEQ ID NO: 510624 - DNA, 25 bp, Mus musculus
gatgaagcctgcaaaaaaagccttt

SEQ ID NO: 510625 - DNA, 25 bp, Mus musculus
gatgaagcctgctaaaaaagccttt

SEQ ID NO: 510626 - DNA, 25 bp, Mus musculus
gatgaagcgggcagtagcacacagc

SEQ ID NO: 510627 - DNA, 25 bp, Mus musculus
gatgaagcgggctgtagcacacagc

SEQ ID NO: 510628 - DNA, 25 bp, Mus musculus
gatgaagctaagaatactccttact

SEQ ID NO: 510629 - DNA, 25 bp, Mus musculus
gatgaagctaagagagctcacttct

SEQ ID NO: 510630 - DNA, 25 bp, Mus musculus
gatgaagctaagtatactccttact

SEQ ID NO: 510631 - DNA, 25 bp, Mus musculus
gatgaagctaagtgagctcacttct

SEQ ID NO: 510632 - DNA, 25 bp, Mus musculus
gatgaagctactcaccagcctggtc

SEQ ID NO: 510633 - DNA, 25 bp, Mus musculus
gatgaagctactgaccagcctggtc

SEQ ID NO: 510634 - DNA, 25 bp, Mus musculus
gatgaagctctcacatccagagtaa

SEQ ID NO: 510635 - DNA, 25 bp, Mus musculus
gatgaagctctctcatccagagtaa

SEQ ID NO: 510636 - DNA, 25 bp, Mus musculus
gatgaagctgacagggagccccaga

SEQ ID NO: 510637 - DNA, 25 bp, Mus musculus
gatgaagctgactgggagccccaga

SEQ ID NO: 510638 - DNA, 25 bp, Mus musculus
gatgaagctgagaacacaccctgcc

SEQ ID NO: 510639 - DNA, 25 bp, Mus musculus
gatgaagctgagtacacaccctgcc

SEQ ID NO: 510640 - DNA, 25 bp, Mus musculus
gatgaagctgcaatccagaaggtga

SEQ ID NO: 510641 - DNA, 25 bp, Mus musculus
gatgaagctgcattccagaaggtga

SEQ ID NO: 510642 - DNA, 25 bp, Mus musculus
gatgaagctgtaccgttgtccctgc

SEQ ID NO: 510643 - DNA, 25 bp, Mus musculus
gatgaagctgtagcgttgtccctgc

SEQ ID NO: 510644 - DNA, 25 bp, Mus musculus
gatgaagcttccacactagggactg

SEQ ID NO: 510645 - DNA, 25 bp, Mus musculus
gatgaagcttcctcactagggactg

SEQ ID NO: 510646 - DNA, 25 bp, Mus musculus
gatgaagcttttcaggtggtttcaa

SEQ ID NO: 510647 - DNA, 25 bp, Mus musculus
gatgaagcttttcgagaactctcta

SEQ ID NO: 510648 - DNA, 25 bp, Mus musculus
gatgaagcttttgaggtggtttcaa

SEQ ID NO: 510649 - DNA, 25 bp, Mus musculus
gatgaagcttttggagaactctcta

SEQ ID NO: 510650 - DNA, 25 bp, Mus musculus
gatgaaggacgcagatgagagccca

SEQ ID NO: 510651 - DNA, 25 bp, Mus musculus
gatgaaggacgctgatgagagccca

SEQ ID NO: 510652 - DNA, 25 bp, Mus musculus
gatgaaggactcacccttctatcaa

SEQ ID NO: 510653 - DNA, 25 bp, Mus musculus
gatgaaggactcagctgtacgtgtt

SEQ ID NO: 510654 - DNA, 25 bp, Mus musculus
gatgaaggactctcccttctatcaa

SEQ ID NO: 510655 - DNA, 25 bp, Mus musculus
gatgaaggactctgctgtacgtgtt

SEQ ID NO: 510656 - DNA, 25 bp, Mus musculus
gatgaaggatttccgctaacccggc

SEQ ID NO: 510657 - DNA, 25 bp, Mus musculus
gatgaaggatttgcgctaacccggc

SEQ ID NO: 510658 - DNA, 25 bp, Mus musculus
gatgaaggcatccatagccatgatg

SEQ ID NO: 510659 - DNA, 25 bp, Mus musculus
gatgaaggcatcgatagccatgatg

SEQ ID NO: 510660 - DNA, 25 bp, Mus musculus
gatgaaggcctcaattttgctactg

SEQ ID NO: 510661 - DNA, 25 bp, Mus musculus
gatgaaggcctctattttgctactg

SEQ ID NO: 510662 - DNA, 25 bp, Mus musculus
gatgaaggctcccaatgagtgctag

SEQ ID NO: 510663 - DNA, 25 bp, Mus musculus
gatgaaggctccgaatgagtgctag

SEQ ID NO: 510664 - DNA, 25 bp, Mus musculus
gatgaaggcttaacactcgactttt

SEQ ID NO: 510665 - DNA, 25 bp, Mus musculus
gatgaaggcttatcactcgactttt

SEQ ID NO: 510666 - DNA, 25 bp, Mus musculus
gatgaaggcttgaccgcagctactt

SEQ ID NO: 510667 - DNA, 25 bp, Mus musculus
gatgaaggcttgcacatcacacaag

SEQ ID NO: 510668 - DNA, 25 bp, Mus musculus
gatgaaggcttggacatcacacaag

SEQ ID NO: 510669 - DNA, 25 bp, Mus musculus
gatgaaggcttgtccgcagctactt

SEQ ID NO: 510670 - DNA, 25 bp, Mus musculus
gatgaagggacacgccctccccctc

SEQ ID NO: 510671 - DNA, 25 bp, Mus musculus
gatgaagggacaggccctccccctc

SEQ ID NO: 510672 - DNA, 25 bp, Mus musculus
gatgaagggctccactgttgttata

SEQ ID NO: 510673 - DNA, 25 bp, Mus musculus
gatgaagggctcgactgttgttata

SEQ ID NO: 510674 - DNA, 25 bp, Mus musculus
gatgaagggtatatcttcctctcct

SEQ ID NO: 510675 - DNA, 25 bp, Mus musculus
gatgaagggtatttcttcctctcct

SEQ ID NO: 510676 - DNA, 25 bp, Mus musculus
gatgaagggtccctattttcactta

SEQ ID NO: 510677 - DNA, 25 bp, Mus musculus
gatgaagggtccgtattttcactta

SEQ ID NO: 510678 - DNA, 25 bp, Mus musculus
gatgaagggtgcaatttctacatat

SEQ ID NO: 510679 - DNA, 25 bp, Mus musculus
gatgaagggtgctatttctacatat

SEQ ID NO: 510680 - DNA, 25 bp, Mus musculus
gatgaaggtcttagtgcccactggc

SEQ ID NO: 510681 - DNA, 25 bp, Mus musculus
gatgaaggtctttgtgcccactggc

SEQ ID NO: 510682 - DNA, 25 bp, Mus musculus
gatgaaggtgtcaccggacgagctc

SEQ ID NO: 510683 - DNA, 25 bp, Mus musculus
gatgaaggtgtctccggacgagctc

SEQ ID NO: 510684 - DNA, 25 bp, Mus musculus
gatgaagtaattatctttccctctt

SEQ ID NO: 510685 - DNA, 25 bp, Mus musculus
gatgaagtaattttctttccctctt

SEQ ID NO: 510686 - DNA, 25 bp, Mus musculus
gatgaagtcactcctaaggaaggga

SEQ ID NO: 510687 - DNA, 25 bp, Mus musculus
gatgaagtcactgctaaggaaggga

SEQ ID NO: 510688 - DNA, 25 bp, Mus musculus
gatgaagtcagacccagaaagccgg

SEQ ID NO: 510689 - DNA, 25 bp, Mus musculus
gatgaagtcagagccagaaagccgg

SEQ ID NO: 510690 - DNA, 25 bp, Mus musculus
gatgaagtcaggatccctccagtgg

SEQ ID NO: 510691 - DNA, 25 bp, Mus musculus
gatgaagtcaggttccctccagtgg

SEQ ID NO: 510692 - DNA, 25 bp, Mus musculus
gatgaagtcatgctcaggatgctgt

SEQ ID NO: 510693 - DNA, 25 bp, Mus musculus
gatgaagtcatggtcaggatgctgt

SEQ ID NO: 510694 - DNA, 25 bp, Mus musculus
gatgaagtccacactcctcattgag

SEQ ID NO: 510695 - DNA, 25 bp, Mus musculus
gatgaagtccactctcctcattgag

SEQ ID NO: 510696 - DNA, 25 bp, Mus musculus
gatgaagtccttaacagtgaactgg

SEQ ID NO: 510697 - DNA, 25 bp, Mus musculus
gatgaagtcctttacagtgaactgg

SEQ ID NO: 510698 - DNA, 25 bp, Mus musculus
gatgaagtcggacgattctcttttt

SEQ ID NO: 510699 - DNA, 25 bp, Mus musculus
gatgaagtcggaggattctcttttt

SEQ ID NO: 510700 - DNA, 25 bp, Mus musculus
gatgaagtctacagctcaacttgag

SEQ ID NO: 510701 - DNA, 25 bp, Mus musculus
gatgaagtctaccactcaagaacgc

SEQ ID NO: 510702 - DNA, 25 bp, Mus musculus
gatgaagtctacgactcaagaacgc

SEQ ID NO: 510703 - DNA, 25 bp, Mus musculus
gatgaagtctactgctcaacttgag

SEQ ID NO: 510704 - DNA, 25 bp, Mus musculus
gatgaagtctagagccaattttgtc

SEQ ID NO: 510705 - DNA, 25 bp, Mus musculus
gatgaagtctagtgccaattttgtc

SEQ ID NO: 510706 - DNA, 25 bp, Mus musculus
gatgaagtctatccacagaagatga

SEQ ID NO: 510707 - DNA, 25 bp, Mus musculus
gatgaagtctatgcacagaagatga

SEQ ID NO: 510708 - DNA, 25 bp, Mus musculus
gatgaagtgtgaactgctcaccttc

SEQ ID NO: 510709 - DNA, 25 bp, Mus musculus
gatgaagtgtgatctgctcaccttc

SEQ ID NO: 510710 - DNA, 25 bp, Mus musculus
gatgaagttaaacgtctccttccca

SEQ ID NO: 510711 - DNA, 25 bp, Mus musculus
gatgaagttaaaggtctccttccca

SEQ ID NO: 510712 - DNA, 25 bp, Mus musculus
gatgaagttcttcattcggcagcaa

SEQ ID NO: 510713 - DNA, 25 bp, Mus musculus
gatgaagttcttccacgctctggac

SEQ ID NO: 510714 - DNA, 25 bp, Mus musculus
gatgaagttcttgattcggcagcaa

SEQ ID NO: 510715 - DNA, 25 bp, Mus musculus
gatgaagttcttgcacgctctggac

SEQ ID NO: 510716 - DNA, 25 bp, Mus musculus
gatgaagttgtaaaggccacctcca

SEQ ID NO: 510717 - DNA, 25 bp, Mus musculus
gatgaagttgtataggccacctcca

SEQ ID NO: 510718 - DNA, 25 bp, Mus musculus
gatgaataaaggagggaattcccac

SEQ ID NO: 510719 - DNA, 25 bp, Mus musculus
gatgaataaaggtgggaattcccac

SEQ ID NO: 510720 - DNA, 25 bp, Mus musculus
gatgaataagttccctttaagctat

SEQ ID NO: 510721 - DNA, 25 bp, Mus musculus
gatgaataagttcgttctagcgcag

SEQ ID NO: 510722 - DNA, 25 bp, Mus musculus
gatgaataagttgcctttaagctat

SEQ ID NO: 510723 - DNA, 25 bp, Mus musculus
gatgaataagttggttctagcgcag

SEQ ID NO: 510724 - DNA, 25 bp, Mus musculus
gatgaatacaacagcctcagcgagg

SEQ ID NO: 510725 - DNA, 25 bp, Mus musculus
gatgaatacaactgcctcagcgagg

SEQ ID NO: 510726 - DNA, 25 bp, Mus musculus
gatgaatacacaccactagcgtctt

SEQ ID NO: 510727 - DNA, 25 bp, Mus musculus
gatgaatacacagcactagcgtctt

SEQ ID NO: 510728 - DNA, 25 bp, Mus musculus
gatgaatacattaccctctagcatt

SEQ ID NO: 510729 - DNA, 25 bp, Mus musculus
gatgaatacatttccctctagcatt

SEQ ID NO: 510730 - DNA, 25 bp, Mus musculus
gatgaataccatctcctgaaacatg

SEQ ID NO: 510731 - DNA, 25 bp, Mus musculus
gatgaataccatgtcctgaaacatg

SEQ ID NO: 510732 - DNA, 25 bp, Mus musculus
gatgaatactgactccaccgaagaa

SEQ ID NO: 510733 - DNA, 25 bp, Mus musculus
gatgaatactgagtccaccgaagaa

SEQ ID NO: 510734 - DNA, 25 bp, Mus musculus
gatgaatacttgatctctctcattc

SEQ ID NO: 510735 - DNA, 25 bp, Mus musculus
gatgaatacttgttctctctcattc

SEQ ID NO: 510736 - DNA, 25 bp, Mus musculus
gatgaataggttccacagggctctg

SEQ ID NO: 510737 - DNA, 25 bp, Mus musculus
gatgaataggttgcacagggctctg

SEQ ID NO: 510738 - DNA, 25 bp, Mus musculus
gatgaatagttgctaatcttccttt

SEQ ID NO: 510739 - DNA, 25 bp, Mus musculus
gatgaatagttggtaatcttccttt

SEQ ID NO: 510740 - DNA, 25 bp, Mus musculus
gatgaatatgccacagaatcgtttg

SEQ ID NO: 510741 - DNA, 25 bp, Mus musculus
gatgaatatgcctcagaatcgtttg

SEQ ID NO: 510742 - DNA, 25 bp, Mus musculus
gatgaatatggcctaagtcctactt

SEQ ID NO: 510743 - DNA, 25 bp, Mus musculus
gatgaatatggcgtaagtcctactt

SEQ ID NO: 510744 - DNA, 25 bp, Mus musculus
gatgaatcaccaaggttctgtccca

SEQ ID NO: 510745 - DNA, 25 bp, Mus musculus
gatgaatcaccatggttctgtccca

SEQ ID NO: 510746 - DNA, 25 bp, Mus musculus
gatgaatccattacttctatagcca

SEQ ID NO: 510747 - DNA, 25 bp, Mus musculus
gatgaatccatttcttctatagcca

SEQ ID NO: 510748 - DNA, 25 bp, Mus musculus
gatgaatcccaaacgttagtttcca

SEQ ID NO: 510749 - DNA, 25 bp, Mus musculus
gatgaatcccaatcgttagtttcca

SEQ ID NO: 510750 - DNA, 25 bp, Mus musculus
gatgaatcccctctggaacaccatg

SEQ ID NO: 510751 - DNA, 25 bp, Mus musculus
gatgaatcccctgtggaacaccatg

SEQ ID NO: 510752 - DNA, 25 bp, Mus musculus
gatgaatcccggagatcctcaactg

SEQ ID NO: 510753 - DNA, 25 bp, Mus musculus
gatgaatcccggtgatcctcaactg

SEQ ID NO: 510754 - DNA, 25 bp, Mus musculus
gatgaatcccttcagtgtaacccag

SEQ ID NO: 510755 - DNA, 25 bp, Mus musculus
gatgaatcccttgagtgtaacccag

SEQ ID NO: 510756 - DNA, 25 bp, Mus musculus
gatgaatccgctacaggctgggaga

SEQ ID NO: 510757 - DNA, 25 bp, Mus musculus
gatgaatccgcttcaggctgggaga

SEQ ID NO: 510758 - DNA, 25 bp, Mus musculus
gatgaatcctatatgatcaaccaga

SEQ ID NO: 510759 - DNA, 25 bp, Mus musculus
gatgaatcctatttgatcaaccaga

SEQ ID NO: 510760 - DNA, 25 bp, Mus musculus
gatgaatcctccaaaaccgaaagtg

SEQ ID NO: 510761 - DNA, 25 bp, Mus musculus
gatgaatcctcctaaaccgaaagtg

SEQ ID NO: 510762 - DNA, 25 bp, Mus musculus
gatgaatcctgaacctgtgatgaca

SEQ ID NO: 510763 - DNA, 25 bp, Mus musculus
gatgaatcctgatcctgtgatgaca

SEQ ID NO: 510764 - DNA, 25 bp, Mus musculus
gatgaatctccacgtggcacagtga

SEQ ID NO: 510765 - DNA, 25 bp, Mus musculus
gatgaatctccaggtggcacagtga

SEQ ID NO: 510766 - DNA, 25 bp, Mus musculus
gatgaatctgaacatattgccaagg

SEQ ID NO: 510767 - DNA, 25 bp, Mus musculus
gatgaatctgaagatattgccaagg

SEQ ID NO: 510768 - DNA, 25 bp, Mus musculus
gatgaatctggcacctagctcttag

SEQ ID NO: 510769 - DNA, 25 bp, Mus musculus
gatgaatctggctcctagctcttag

SEQ ID NO: 510770 - DNA, 25 bp, Mus musculus
gatgaatctttcatgttggacgaag

SEQ ID NO: 510771 - DNA, 25 bp, Mus musculus
gatgaatctttcttgttggacgaag

SEQ ID NO: 510772 - DNA, 25 bp, Mus musculus
gatgaatcttttaccattggcaagc

SEQ ID NO: 510773 - DNA, 25 bp, Mus musculus
gatgaatctttttccattggcaagc

SEQ ID NO: 510774 - DNA, 25 bp, Mus musculus
gatgaatgaattccattgtgctact

SEQ ID NO: 510775 - DNA, 25 bp, Mus musculus
gatgaatgaattgcattgtgctact

SEQ ID NO: 510776 - DNA, 25 bp, Mus musculus
gatgaatgagagctccaccagccca

SEQ ID NO: 510777 - DNA, 25 bp, Mus musculus
gatgaatgagaggtccaccagccca

SEQ ID NO: 510778 - DNA, 25 bp, Mus musculus
gatgaatgagttatgcccagttttt

SEQ ID NO: 510779 - DNA, 25 bp, Mus musculus
gatgaatgagttttgcccagttttt

SEQ ID NO: 510780 - DNA, 25 bp, Mus musculus
gatgaatgcactacagtctttggga

SEQ ID NO: 510781 - DNA, 25 bp, Mus musculus
gatgaatgcacttcagtctttggga

SEQ ID NO: 510782 - DNA, 25 bp, Mus musculus
gatgaatgcaggctgtgctaccatt

SEQ ID NO: 510783 - DNA, 25 bp, Mus musculus
gatgaatgcagggtgtgctaccatt

SEQ ID NO: 510784 - DNA, 25 bp, Mus musculus
gatgaatgcccacggtagcccgtaa

SEQ ID NO: 510785 - DNA, 25 bp, Mus musculus
gatgaatgcccagggtagcccgtaa

SEQ ID NO: 510786 - DNA, 25 bp, Mus musculus
gatgaatgcccgctctaagaatgtt

SEQ ID NO: 510787 - DNA, 25 bp, Mus musculus
gatgaatgcccggtctaagaatgtt

SEQ ID NO: 510788 - DNA, 25 bp, Mus musculus
gatgaatgctaacaaaatcgagttt

SEQ ID NO: 510789 - DNA, 25 bp, Mus musculus
gatgaatgctaagaaaatcgagttt

SEQ ID NO: 510790 - DNA, 25 bp, Mus musculus
gatgaatgctgacaaacgctctcac

SEQ ID NO: 510791 - DNA, 25 bp, Mus musculus
gatgaatgctgagaaacgctctcac

SEQ ID NO: 510792 - DNA, 25 bp, Mus musculus
gatgaatggattcctgtccgcaggt

SEQ ID NO: 510793 - DNA, 25 bp, Mus musculus
gatgaatggattgctgtccgcaggt

SEQ ID NO: 510794 - DNA, 25 bp, Mus musculus
gatgaatggcagaaccttttatatt

SEQ ID NO: 510795 - DNA, 25 bp, Mus musculus
gatgaatggcagtaccttttatatt

SEQ ID NO: 510796 - DNA, 25 bp, Mus musculus
gatgaatggcttcgccatcgcagat

SEQ ID NO: 510797 - DNA, 25 bp, Mus musculus
gatgaatggcttggccatcgcagat

SEQ ID NO: 510798 - DNA, 25 bp, Mus musculus
gatgaatgggagacccctactccta

SEQ ID NO: 510799 - DNA, 25 bp, Mus musculus
gatgaatgggagtcccctactccta

SEQ ID NO: 510800 - DNA, 25 bp, Mus musculus
gatgaatgggctacgagtgaatgtg

SEQ ID NO: 510801 - DNA, 25 bp, Mus musculus
gatgaatgggcttcgagtgaatgtg

SEQ ID NO: 510802 - DNA, 25 bp, Mus musculus
gatgaatggtggctcctcagtccta

SEQ ID NO: 510803 - DNA, 25 bp, Mus musculus
gatgaatggtgggtcctcagtccta

SEQ ID NO: 510804 - DNA, 25 bp, Mus musculus
gatgaatgtaatccccaatccttaa

SEQ ID NO: 510805 - DNA, 25 bp, Mus musculus
gatgaatgtaatgcccaatccttaa

SEQ ID NO: 510806 - DNA, 25 bp, Mus musculus
gatgaatgtaccagtgccgtgagca

SEQ ID NO: 510807 - DNA, 25 bp, Mus musculus
gatgaatgtacctgtgccgtgagca

SEQ ID NO: 510808 - DNA, 25 bp, Mus musculus
gatgaatgtgaaactctctgacaat

SEQ ID NO: 510809 - DNA, 25 bp, Mus musculus
gatgaatgtgaatctctctgacaat

SEQ ID NO: 510810 - DNA, 25 bp, Mus musculus
gatgaatgttggcaatcccttcctg

SEQ ID NO: 510811 - DNA, 25 bp, Mus musculus
gatgaatgttgggaatcccttcctg

SEQ ID NO: 510812 - DNA, 25 bp, Mus musculus
gatgaatgttttcccaatttgctta

SEQ ID NO: 510813 - DNA, 25 bp, Mus musculus
gatgaatgttttgccaatttgctta

SEQ ID NO: 510814 - DNA, 25 bp, Mus musculus
gatgaattaaggactattagctcga

SEQ ID NO: 510815 - DNA, 25 bp, Mus musculus
gatgaattaaggtctattagctcga

SEQ ID NO: 510816 - DNA, 25 bp, Mus musculus
gatgaattaataactagctaacatg

SEQ ID NO: 510817 - DNA, 25 bp, Mus musculus
gatgaattaatatctagctaacatg

SEQ ID NO: 510818 - DNA, 25 bp, Mus musculus
gatgaattaattagttactgactaa

SEQ ID NO: 510819 - DNA, 25 bp, Mus musculus
gatgaattaatttgttactgactaa

SEQ ID NO: 510820 - DNA, 25 bp, Mus musculus
gatgaattaccgacggctaggaggt

SEQ ID NO: 510821 - DNA, 25 bp, Mus musculus
gatgaattaccgtcggctaggaggt

SEQ ID NO: 510822 - DNA, 25 bp, Mus musculus
gatgaattcaacaccagcggtctca

SEQ ID NO: 510823 - DNA, 25 bp, Mus musculus
gatgaattcaactccagcggtctca

SEQ ID NO: 510824 - DNA, 25 bp, Mus musculus
gatgaattcacaacccacttcaatc

SEQ ID NO: 510825 - DNA, 25 bp, Mus musculus
gatgaattcacatcccacttcaatc

SEQ ID NO: 510826 - DNA, 25 bp, Mus musculus
gatgaattccagatcacctgggaaa

SEQ ID NO: 510827 - DNA, 25 bp, Mus musculus
gatgaattccagttcacctgggaaa

SEQ ID NO: 510828 - DNA, 25 bp, Mus musculus
gatgaattccgaacagtcctgtgac

SEQ ID NO: 510829 - DNA, 25 bp, Mus musculus
gatgaattccgatcagtcctgtgac

SEQ ID NO: 510830 - DNA, 25 bp, Mus musculus
gatgaattcctaccccagagaggtc

SEQ ID NO: 510831 - DNA, 25 bp, Mus musculus
gatgaattcctagcccagagaggtc

SEQ ID NO: 510832 - DNA, 25 bp, Mus musculus
gatgaattctccattcagtgaagga

SEQ ID NO: 510833 - DNA, 25 bp, Mus musculus
gatgaattctcctttcagtgaagga

SEQ ID NO: 510834 - DNA, 25 bp, Mus musculus
gatgaattctgccttatgccttgac

SEQ ID NO: 510835 - DNA, 25 bp, Mus musculus
gatgaattctgcgttatgccttgac

SEQ ID NO: 510836 - DNA, 25 bp, Mus musculus
gatgaattgcctatcacatttgagc

SEQ ID NO: 510837 - DNA, 25 bp, Mus musculus
gatgaattgcctttcacatttgagc

SEQ ID NO: 510838 - DNA, 25 bp, Mus musculus
gatgaattgctactacagggataca

SEQ ID NO: 510839 - DNA, 25 bp, Mus musculus
gatgaattgctagtacagggataca

SEQ ID NO: 510840 - DNA, 25 bp, Mus musculus
gatgaattgtgcagaaccataacca

SEQ ID NO: 510841 - DNA, 25 bp, Mus musculus
gatgaattgtgctgaaccataacca

SEQ ID NO: 510842 - DNA, 25 bp, Mus musculus
gatgaattgttgctccacccaaatc

SEQ ID NO: 510843 - DNA, 25 bp, Mus musculus
gatgaattgttggtccacccaaatc

SEQ ID NO: 510844 - DNA, 25 bp, Mus musculus
gatgaatttactccctaccaaaggt

SEQ ID NO: 510845 - DNA, 25 bp, Mus musculus
gatgaatttactgcctaccaaaggt

SEQ ID NO: 510846 - DNA, 25 bp, Mus musculus
gatgaatttcagcatgttcctacaa

SEQ ID NO: 510847 - DNA, 25 bp, Mus musculus
gatgaatttcaggatgttcctacaa

SEQ ID NO: 510848 - DNA, 25 bp, Mus musculus
gatgaatttgaactgtccactgtgt

SEQ ID NO: 510849 - DNA, 25 bp, Mus musculus
gatgaatttgaagtgtccactgtgt

SEQ ID NO: 510850 - DNA, 25 bp, Mus musculus
gatgaatttgacctaccttgtgcca

SEQ ID NO: 510851 - DNA, 25 bp, Mus musculus
gatgaatttgacgtaccttgtgcca

SEQ ID NO: 510852 - DNA, 25 bp, Mus musculus
gatgaatttgtaccacctccaggta

SEQ ID NO: 510853 - DNA, 25 bp, Mus musculus
gatgaatttgtagcacctccaggta

SEQ ID NO: 510854 - DNA, 25 bp, Mus musculus
gatgaattttgtccaactgtgtaga

SEQ ID NO: 510855 - DNA, 25 bp, Mus musculus
gatgaattttgtgcaactgtgtaga

SEQ ID NO: 510856 - DNA, 25 bp, Mus musculus
gatgaattttttacagtgaagttca

SEQ ID NO: 510857 - DNA, 25 bp, Mus musculus
gatgaatttttttcagtgaagttca

SEQ ID NO: 510858 - DNA, 25 bp, Mus musculus
gatgacaaaaggagtcccctccttt

SEQ ID NO: 510859 - DNA, 25 bp, Mus musculus
gatgacaaaaggtgtcccctccttt

SEQ ID NO: 510860 - DNA, 25 bp, Mus musculus
gatgacaaaatgaatcagactatca

SEQ ID NO: 510861 - DNA, 25 bp, Mus musculus
gatgacaaaatgtatcagactatca

SEQ ID NO: 510862 - DNA, 25 bp, Mus musculus
gatgacaaaggacccatgagcctct

SEQ ID NO: 510863 - DNA, 25 bp, Mus musculus
gatgacaaaggagccatgagcctct

SEQ ID NO: 510864 - DNA, 25 bp, Mus musculus
gatgacaaagtgcttcccggacaac

SEQ ID NO: 510865 - DNA, 25 bp, Mus musculus
gatgacaaagtggttcccggacaac

SEQ ID NO: 510866 - DNA, 25 bp, Mus musculus
gatgacaaatatacaagacaccgaa

SEQ ID NO: 510867 - DNA, 25 bp, Mus musculus
gatgacaaatattcaagacaccgaa

SEQ ID NO: 510868 - DNA, 25 bp, Mus musculus
gatgacaaattaaatccccagcttc

SEQ ID NO: 510869 - DNA, 25 bp, Mus musculus
gatgacaaattatatccccagcttc

SEQ ID NO: 510870 - DNA, 25 bp, Mus musculus
gatgacaacatgatccagattggaa

SEQ ID NO: 510871 - DNA, 25 bp, Mus musculus
gatgacaacatgttccagattggaa

SEQ ID NO: 510872 - DNA, 25 bp, Mus musculus
gatgacaaccggaaccacgaggaca

SEQ ID NO: 510873 - DNA, 25 bp, Mus musculus
gatgacaaccggtaccacgaggaca

SEQ ID NO: 510874 - DNA, 25 bp, Mus musculus
gatgacaacgacaataaagtgcgag

SEQ ID NO: 510875 - DNA, 25 bp, Mus musculus
gatgacaacgactataaagtgcgag

SEQ ID NO: 510876 - DNA, 25 bp, Mus musculus
gatgacaactacattggactgccca

SEQ ID NO: 510877 - DNA, 25 bp, Mus musculus
gatgacaactactttggactgccca

SEQ ID NO: 510878 - DNA, 25 bp, Mus musculus
gatgacaagctgcaatggtcttact

SEQ ID NO: 510879 - DNA, 25 bp, Mus musculus
gatgacaagctggaatggtcttact

SEQ ID NO: 510880 - DNA, 25 bp, Mus musculus
gatgacaaggataatttcttattta

SEQ ID NO: 510881 - DNA, 25 bp, Mus musculus
gatgacaaggattatttcttattta

SEQ ID NO: 510882 - DNA, 25 bp, Mus musculus
gatgacaagtccctgcaggaggcat

SEQ ID NO: 510883 - DNA, 25 bp, Mus musculus
gatgacaagtccgtgcaggaggcat

SEQ ID NO: 510884 - DNA, 25 bp, Mus musculus
gatgacaagttgctattataccttt

SEQ ID NO: 510885 - DNA, 25 bp, Mus musculus
gatgacaagttggtattataccttt

SEQ ID NO: 510886 - DNA, 25 bp, Mus musculus
gatgacaatagcatggttcctcccg

SEQ ID NO: 510887 - DNA, 25 bp, Mus musculus
gatgacaatagcttggttcctcccg

SEQ ID NO: 510888 - DNA, 25 bp, Mus musculus
gatgacaatattcttgactattccc

SEQ ID NO: 510889 - DNA, 25 bp, Mus musculus
gatgacaatattgttgactattccc

SEQ ID NO: 510890 - DNA, 25 bp, Mus musculus
gatgacaatcaaagcttgcccgagg

SEQ ID NO: 510891 - DNA, 25 bp, Mus musculus
gatgacaatcaatgcttgcccgagg

SEQ ID NO: 510892 - DNA, 25 bp, Mus musculus
gatgacaatcatacccagttggtct

SEQ ID NO: 510893 - DNA, 25 bp, Mus musculus
gatgacaatcattcccagttggtct

SEQ ID NO: 510894 - DNA, 25 bp, Mus musculus
gatgacaatcgtctaaatgtactag

SEQ ID NO: 510895 - DNA, 25 bp, Mus musculus
gatgacaatcgtgtaaatgtactag

SEQ ID NO: 510896 - DNA, 25 bp, Mus musculus
gatgacaatgcgctctagtagcaaa

SEQ ID NO: 510897 - DNA, 25 bp, Mus musculus
gatgacaatgcggtctagtagcaaa

SEQ ID NO: 510898 - DNA, 25 bp, Mus musculus
gatgacaatgggactcggctctcgg

SEQ ID NO: 510899 - DNA, 25 bp, Mus musculus
gatgacaatgggtctcggctctcgg

SEQ ID NO: 510900 - DNA, 25 bp, Mus musculus
gatgacaatggtatccttctaggat

SEQ ID NO: 510901 - DNA, 25 bp, Mus musculus
gatgacaatggtttccttctaggat

SEQ ID NO: 510902 - DNA, 25 bp, Mus musculus
gatgacaatgtcaaggcttacttca

SEQ ID NO: 510903 - DNA, 25 bp, Mus musculus
gatgacaatgtccttctattagaaa

SEQ ID NO: 510904 - DNA, 25 bp, Mus musculus
gatgacaatgtcgttctattagaaa

SEQ ID NO: 510905 - DNA, 25 bp, Mus musculus
gatgacaatgtctaggcttacttca

SEQ ID NO: 510906 - DNA, 25 bp, Mus musculus
gatgacacaattctcatctgggact

SEQ ID NO: 510907 - DNA, 25 bp, Mus musculus
gatgacacaattgtcatctgggact

SEQ ID NO: 510908 - DNA, 25 bp, Mus musculus
gatgacacacaactgccagtccaaa

SEQ ID NO: 510909 - DNA, 25 bp, Mus musculus
gatgacacacaacttcatgcggcgg

SEQ ID NO: 510910 - DNA, 25 bp, Mus musculus
gatgacacacaagtgccagtccaaa

SEQ ID NO: 510911 - DNA, 25 bp, Mus musculus
gatgacacacaagttcatgcggcgg

SEQ ID NO: 510912 - DNA, 25 bp, Mus musculus
gatgacacacagacctatgtactta

SEQ ID NO: 510913 - DNA, 25 bp, Mus musculus
gatgacacacagcaagttctctagg

SEQ ID NO: 510914 - DNA, 25 bp, Mus musculus
gatgacacacaggaagttctctagg

SEQ ID NO: 510915 - DNA, 25 bp, Mus musculus
gatgacacacagtcctatgtactta

SEQ ID NO: 510916 - DNA, 25 bp, Mus musculus
gatgacacacccagaccaaaggaaa

SEQ ID NO: 510917 - DNA, 25 bp, Mus musculus
gatgacacaccctgaccaaaggaaa

SEQ ID NO: 510918 - DNA, 25 bp, Mus musculus
gatgacacactacggcaccataaga

SEQ ID NO: 510919 - DNA, 25 bp, Mus musculus
gatgacacactagggcaccataaga

SEQ ID NO: 510920 - DNA, 25 bp, Mus musculus
gatgacacaggactattctttatag

SEQ ID NO: 510921 - DNA, 25 bp, Mus musculus
gatgacacaggagtattctttatag

SEQ ID NO: 510922 - DNA, 25 bp, Mus musculus
gatgacacagtcaacatgggcaaag

SEQ ID NO: 510923 - DNA, 25 bp, Mus musculus
gatgacacagtctacatgggcaaag

SEQ ID NO: 510924 - DNA, 25 bp, Mus musculus
gatgacacagttatcctaaacccta

SEQ ID NO: 510925 - DNA, 25 bp, Mus musculus
gatgacacagttttcctaaacccta

SEQ ID NO: 510926 - DNA, 25 bp, Mus musculus
gatgacacatgccaggaatcccaat

SEQ ID NO: 510927 - DNA, 25 bp, Mus musculus
gatgacacatgcgaggaatcccaat

SEQ ID NO: 510928 - DNA, 25 bp, Mus musculus
gatgacacatttcctaccagataag

SEQ ID NO: 510929 - DNA, 25 bp, Mus musculus
gatgacacatttgctaccagataag

SEQ ID NO: 510930 - DNA, 25 bp, Mus musculus
gatgacacccagcagaagactcttg

SEQ ID NO: 510931 - DNA, 25 bp, Mus musculus
gatgacacccaggagaagactcttg

SEQ ID NO: 510932 - DNA, 25 bp, Mus musculus
gatgacaccgaccatcaggcagatg

SEQ ID NO: 510933 - DNA, 25 bp, Mus musculus
gatgacaccgacgatcaggcagatg

SEQ ID NO: 510934 - DNA, 25 bp, Mus musculus
gatgacaccgagactgggctactta

SEQ ID NO: 510935 - DNA, 25 bp, Mus musculus
gatgacaccgagtctgggctactta

SEQ ID NO: 510936 - DNA, 25 bp, Mus musculus
gatgacacctcgctcacctgagtga

SEQ ID NO: 510937 - DNA, 25 bp, Mus musculus
gatgacacctcggtcacctgagtga

SEQ ID NO: 510938 - DNA, 25 bp, Mus musculus
gatgacacctttagcaggcttctga

SEQ ID NO: 510939 - DNA, 25 bp, Mus musculus
gatgacaccttttgcaggcttctga

SEQ ID NO: 510940 - DNA, 25 bp, Mus musculus
gatgacactaaacacactctggttt

SEQ ID NO: 510941 - DNA, 25 bp, Mus musculus
gatgacactaaagacactctggttt

SEQ ID NO: 510942 - DNA, 25 bp, Mus musculus
gatgacactaacatgcatgctcacc

SEQ ID NO: 510943 - DNA, 25 bp, Mus musculus
gatgacactaacttgcatgctcacc

SEQ ID NO: 510944 - DNA, 25 bp, Mus musculus
gatgacactagaacagtctccctag

SEQ ID NO: 510945 - DNA, 25 bp, Mus musculus
gatgacactagatcagtctccctag

SEQ ID NO: 510946 - DNA, 25 bp, Mus musculus
gatgacactcatacctgggtctagt

SEQ ID NO: 510947 - DNA, 25 bp, Mus musculus
gatgacactcattcctgggtctagt

SEQ ID NO: 510948 - DNA, 25 bp, Mus musculus
gatgacactgaaagttgatgcacct

SEQ ID NO: 510949 - DNA, 25 bp, Mus musculus
gatgacactgaatgttgatgcacct

SEQ ID NO: 510950 - DNA, 25 bp, Mus musculus
gatgacactgccaaaggtggcccca

SEQ ID NO: 510951 - DNA, 25 bp, Mus musculus
gatgacactgcctaaggtggcccca

SEQ ID NO: 510952 - DNA, 25 bp, Mus musculus
gatgacactgtcagccaggtgactc

SEQ ID NO: 510953 - DNA, 25 bp, Mus musculus
gatgacactgtctgccaggtgactc

SEQ ID NO: 510954 - DNA, 25 bp, Mus musculus
gatgacactgtgcacgtgtgtgctt

SEQ ID NO: 510955 - DNA, 25 bp, Mus musculus
gatgacactgtggacgtgtgtgctt

SEQ ID NO: 510956 - DNA, 25 bp, Mus musculus
gatgacacttggagctcctgagcaa

SEQ ID NO: 510957 - DNA, 25 bp, Mus musculus
gatgacacttggtgctcctgagcaa

SEQ ID NO: 510958 - DNA, 25 bp, Mus musculus
gatgacagaagaaagtccactcaaa

SEQ ID NO: 510959 - DNA, 25 bp, Mus musculus
gatgacagaagaatttccccactgg

SEQ ID NO: 510960 - DNA, 25 bp, Mus musculus
gatgacagaagatagtccactcaaa

SEQ ID NO: 510961 - DNA, 25 bp, Mus musculus
gatgacagaagattttccccactgg

SEQ ID NO: 510962 - DNA, 25 bp, Mus musculus
gatgacagacacatttgcaacattt

SEQ ID NO: 510963 - DNA, 25 bp, Mus musculus
gatgacagacacttttgcaacattt

SEQ ID NO: 510964 - DNA, 25 bp, Mus musculus
gatgacagagataagggcggttcct

SEQ ID NO: 510965 - DNA, 25 bp, Mus musculus
gatgacagagattagggcggttcct

SEQ ID NO: 510966 - DNA, 25 bp, Mus musculus
gatgacagaggactcagccagtctt

SEQ ID NO: 510967 - DNA, 25 bp, Mus musculus
gatgacagaggagtcagccagtctt

SEQ ID NO: 510968 - DNA, 25 bp, Mus musculus
gatgacagatacctgcgtgcagcca

SEQ ID NO: 510969 - DNA, 25 bp, Mus musculus
gatgacagatacgtgcgtgcagcca

SEQ ID NO: 510970 - DNA, 25 bp, Mus musculus
gatgacagatctcggcttctgtgat

SEQ ID NO: 510971 - DNA, 25 bp, Mus musculus
gatgacagatctgggcttctgtgat

SEQ ID NO: 510972 - DNA, 25 bp, Mus musculus
gatgacagatttctttatgcttgta

SEQ ID NO: 510973 - DNA, 25 bp, Mus musculus
gatgacagatttgtttatgcttgta

SEQ ID NO: 510974 - DNA, 25 bp, Mus musculus
gatgacagcaaacactcgaaaggca

SEQ ID NO: 510975 - DNA, 25 bp, Mus musculus
gatgacagcaaagactcgaaaggca

SEQ ID NO: 510976 - DNA, 25 bp, Mus musculus
gatgacagcaagagagtcctcccct

SEQ ID NO: 510977 - DNA, 25 bp, Mus musculus
gatgacagcaagctagaggcgctct

SEQ ID NO: 510978 - DNA, 25 bp, Mus musculus
gatgacagcaaggtagaggcgctct

SEQ ID NO: 510979 - DNA, 25 bp, Mus musculus
gatgacagcaagtgagtcctcccct

SEQ ID NO: 510980 - DNA, 25 bp, Mus musculus
gatgacagcataaccctggtggttt

SEQ ID NO: 510981 - DNA, 25 bp, Mus musculus
gatgacagcatatccctggtggttt

SEQ ID NO: 510982 - DNA, 25 bp, Mus musculus
gatgacagccataaatgtaaccttt

SEQ ID NO: 510983 - DNA, 25 bp, Mus musculus
gatgacagccattaatgtaaccttt

SEQ ID NO: 510984 - DNA, 25 bp, Mus musculus
gatgacagcctaagtttctggccct

SEQ ID NO: 510985 - DNA, 25 bp, Mus musculus
gatgacagcctatgtttctggccct

SEQ ID NO: 510986 - DNA, 25 bp, Mus musculus
gatgacagcgaccaagacctcttac

SEQ ID NO: 510987 - DNA, 25 bp, Mus musculus
gatgacagcgacgaagacctcttac

SEQ ID NO: 510988 - DNA, 25 bp, Mus musculus
gatgacagcgataatgttacattat

SEQ ID NO: 510989 - DNA, 25 bp, Mus musculus
gatgacagcgatcgcacttcagcac

SEQ ID NO: 510990 - DNA, 25 bp, Mus musculus
gatgacagcgatggcacttcagcac

SEQ ID NO: 510991 - DNA, 25 bp, Mus musculus
gatgacagcgattatgttacattat

SEQ ID NO: 510992 - DNA, 25 bp, Mus musculus
gatgacagctggacactgtggaaac

SEQ ID NO: 510993 - DNA, 25 bp, Mus musculus
gatgacagctggtcactgtggaaac

SEQ ID NO: 510994 - DNA, 25 bp, Mus musculus
gatgacagctgtagtatatcagact

SEQ ID NO: 510995 - DNA, 25 bp, Mus musculus
gatgacagctgtcttcttacaaaaa

SEQ ID NO: 510996 - DNA, 25 bp, Mus musculus
gatgacagctgtgttcttacaaaaa

SEQ ID NO: 510997 - DNA, 25 bp, Mus musculus
gatgacagctgttgtatatcagact

SEQ ID NO: 510998 - DNA, 25 bp, Mus musculus
gatgacaggaacacccatggtggct

SEQ ID NO: 510999 - DNA, 25 bp, Mus musculus
gatgacaggaactcccatggtggct

SEQ ID NO: 511000 - DNA, 25 bp, Mus musculus
gatgacaggactaaccactgacctt

SEQ ID NO: 511001 - DNA, 25 bp, Mus musculus
gatgacaggacttaccactgacctt

SEQ ID NO: 511002 - DNA, 25 bp, Mus musculus
gatgacaggtgtaactagttttcta

SEQ ID NO: 511003 - DNA, 25 bp, Mus musculus
gatgacaggtgttactagttttcta

SEQ ID NO: 511004 - DNA, 25 bp, Mus musculus
gatgacagtagactgacttttacac

SEQ ID NO: 511005 - DNA, 25 bp, Mus musculus
gatgacagtagagtgacttttacac

SEQ ID NO: 511006 - DNA, 25 bp, Mus musculus
gatgacagtcatcatttgataaaac

SEQ ID NO: 511007 - DNA, 25 bp, Mus musculus
gatgacagtcatgatttgataaaac

SEQ ID NO: 511008 - DNA, 25 bp, Mus musculus
gatgacagtcccacacaaggatctg

SEQ ID NO: 511009 - DNA, 25 bp, Mus musculus
gatgacagtccctcacaaggatctg

SEQ ID NO: 511010 - DNA, 25 bp, Mus musculus
gatgacagtctgcttaaaaacctag

SEQ ID NO: 511011 - DNA, 25 bp, Mus musculus
gatgacagtctggttaaaaacctag

SEQ ID NO: 511012 - DNA, 25 bp, Mus musculus
gatgacagtgagaggaactattccc

SEQ ID NO: 511013 - DNA, 25 bp, Mus musculus
gatgacagtgagtggaactattccc

SEQ ID NO: 511014 - DNA, 25 bp, Mus musculus
gatgacagtggcctaacagaacaga

SEQ ID NO: 511015 - DNA, 25 bp, Mus musculus
gatgacagtggcgtaacagaacaga

SEQ ID NO: 511016 - DNA, 25 bp, Mus musculus
gatgacagtgtaattcaggtcactt

SEQ ID NO: 511017 - DNA, 25 bp, Mus musculus
gatgacagtgtatttcaggtcactt

SEQ ID NO: 511018 - DNA, 25 bp, Mus musculus
gatgacagtgttcctccacagaaca

SEQ ID NO: 511019 - DNA, 25 bp, Mus musculus
gatgacagtgttgctccacagaaca

SEQ ID NO: 511020 - DNA, 25 bp, Mus musculus
gatgacagttgcacagctctatata

SEQ ID NO: 511021 - DNA, 25 bp, Mus musculus
gatgacagttgctcagctctatata

SEQ ID NO: 511022 - DNA, 25 bp, Mus musculus
gatgacagttttacagctgctgcac

SEQ ID NO: 511023 - DNA, 25 bp, Mus musculus
gatgacagtttttcagctgctgcac

SEQ ID NO: 511024 - DNA, 25 bp, Mus musculus
gatgacatacctacatatctgccaa

SEQ ID NO: 511025 - DNA, 25 bp, Mus musculus
gatgacataccttcatatctgccaa

SEQ ID NO: 511026 - DNA, 25 bp, Mus musculus
gatgacatactgagatgcccacgct

SEQ ID NO: 511027 - DNA, 25 bp, Mus musculus
gatgacatactgtgatgcccacgct

SEQ ID NO: 511028 - DNA, 25 bp, Mus musculus
gatgacatatacacgcacttctctc

SEQ ID NO: 511029 - DNA, 25 bp, Mus musculus
gatgacatatactcgcacttctctc

SEQ ID NO: 511030 - DNA, 25 bp, Mus musculus
gatgacatatcaaagttccgaccat

SEQ ID NO: 511031 - DNA, 25 bp, Mus musculus
gatgacatatcatagttccgaccat

SEQ ID NO: 511032 - DNA, 25 bp, Mus musculus
gatgacatatctacctacttatttt

SEQ ID NO: 511033 - DNA, 25 bp, Mus musculus
gatgacatatcttcctacttatttt

SEQ ID NO: 511034 - DNA, 25 bp, Mus musculus
gatgacatatttaactggcctacgt

SEQ ID NO: 511035 - DNA, 25 bp, Mus musculus
gatgacatattttactggcctacgt

SEQ ID NO: 511036 - DNA, 25 bp, Mus musculus
gatgacatcaacacctggaatcttt

SEQ ID NO: 511037 - DNA, 25 bp, Mus musculus
gatgacatcaactcctggaatcttt

SEQ ID NO: 511038 - DNA, 25 bp, Mus musculus
gatgacatcaccactgagcagcagg

SEQ ID NO: 511039 - DNA, 25 bp, Mus musculus
gatgacatcacctctgagcagcagg

SEQ ID NO: 511040 - DNA, 25 bp, Mus musculus
gatgacatcagactcccacgattat

SEQ ID NO: 511041 - DNA, 25 bp, Mus musculus
gatgacatcagagtcccacgattat

SEQ ID NO: 511042 - DNA, 25 bp, Mus musculus
gatgacatcatcacgcagcgggagg

SEQ ID NO: 511043 - DNA, 25 bp, Mus musculus
gatgacatcatcactgacattgaga

SEQ ID NO: 511044 - DNA, 25 bp, Mus musculus
gatgacatcatctcgcagcgggagg

SEQ ID NO: 511045 - DNA, 25 bp, Mus musculus
gatgacatcatctctgacattgaga

SEQ ID NO: 511046 - DNA, 25 bp, Mus musculus
gatgacatcccgcaacctaaggaca

SEQ ID NO: 511047 - DNA, 25 bp, Mus musculus
gatgacatcccggaacctaaggaca

SEQ ID NO: 511048 - DNA, 25 bp, Mus musculus
gatgacatccctaaactagtaactg

SEQ ID NO: 511049 - DNA, 25 bp, Mus musculus
gatgacatcccttaactagtaactg

SEQ ID NO: 511050 - DNA, 25 bp, Mus musculus
gatgacatccgcatccatgtggcca

SEQ ID NO: 511051 - DNA, 25 bp, Mus musculus
gatgacatccgcttccatgtggcca

SEQ ID NO: 511052 - DNA, 25 bp, Mus musculus
gatgacatccggattctcagggaca

SEQ ID NO: 511053 - DNA, 25 bp, Mus musculus
gatgacatccggtttctcagggaca

SEQ ID NO: 511054 - DNA, 25 bp, Mus musculus
gatgacatccgtcacagaaccagga

SEQ ID NO: 511055 - DNA, 25 bp, Mus musculus
gatgacatccgtgacagaaccagga

SEQ ID NO: 511056 - DNA, 25 bp, Mus musculus
gatgacatccttatctttactttgg

SEQ ID NO: 511057 - DNA, 25 bp, Mus musculus
gatgacatccttttctttactttgg

SEQ ID NO: 511058 - DNA, 25 bp, Mus musculus
gatgacatcgaaatgctcccggaag

SEQ ID NO: 511059 - DNA, 25 bp, Mus musculus
gatgacatcgaattgctcccggaag

SEQ ID NO: 511060 - DNA, 25 bp, Mus musculus
gatgacatcgtgcttcacagtggca

SEQ ID NO: 511061 - DNA, 25 bp, Mus musculus
gatgacatcgtggttcacagtggca

SEQ ID NO: 511062 - DNA, 25 bp, Mus musculus
gatgacatgactaaccacagacagc

SEQ ID NO: 511063 - DNA, 25 bp, Mus musculus
gatgacatgacttaccacagacagc

SEQ ID NO: 511064 - DNA, 25 bp, Mus musculus
gatgacatgctcagccaataacggg

SEQ ID NO: 511065 - DNA, 25 bp, Mus musculus
gatgacatgctctgccaataacggg

SEQ ID NO: 511066 - DNA, 25 bp, Mus musculus
gatgacatgcttacagattagtaaa

SEQ ID NO: 511067 - DNA, 25 bp, Mus musculus
gatgacatgcttccagcatcagaga

SEQ ID NO: 511068 - DNA, 25 bp, Mus musculus
gatgacatgcttgcagcatcagaga

SEQ ID NO: 511069 - DNA, 25 bp, Mus musculus
gatgacatgctttcagattagtaaa

SEQ ID NO: 511070 - DNA, 25 bp, Mus musculus
gatgacatggatattacacagctga

SEQ ID NO: 511071 - DNA, 25 bp, Mus musculus
gatgacatggattttacacagctga

SEQ ID NO: 511072 - DNA, 25 bp, Mus musculus
gatgacatgtatatttagacttttg

SEQ ID NO: 511073 - DNA, 25 bp, Mus musculus
gatgacatgtatttttagacttttg

SEQ ID NO: 511074 - DNA, 25 bp, Mus musculus
gatgacatgtttcttcttttttagc

SEQ ID NO: 511075 - DNA, 25 bp, Mus musculus
gatgacatgtttgttcttttttagc

SEQ ID NO: 511076 - DNA, 25 bp, Mus musculus
gatgacattcacagcccaaccatga

SEQ ID NO: 511077 - DNA, 25 bp, Mus musculus
gatgacattcactgcccaaccatga

SEQ ID NO: 511078 - DNA, 25 bp, Mus musculus
gatgacattccacattgtaaaaacc

SEQ ID NO: 511079 - DNA, 25 bp, Mus musculus
gatgacattccagattgtaaaaacc

SEQ ID NO: 511080 - DNA, 25 bp, Mus musculus
gatgacattcctacattggtgaaag

SEQ ID NO: 511081 - DNA, 25 bp, Mus musculus
gatgacattccttcattggtgaaag

SEQ ID NO: 511082 - DNA, 25 bp, Mus musculus
gatgacattctcctggtccactaag

SEQ ID NO: 511083 - DNA, 25 bp, Mus musculus
gatgacattctcgtggtccactaag

SEQ ID NO: 511084 - DNA, 25 bp, Mus musculus
gatgacattgatcctgatgtgctgc

SEQ ID NO: 511085 - DNA, 25 bp, Mus musculus
gatgacattgatgctgatgtgctgc

SEQ ID NO: 511086 - DNA, 25 bp, Mus musculus
gatgacattgtcactggccacaaga

SEQ ID NO: 511087 - DNA, 25 bp, Mus musculus
gatgacattgtcaggtggctctaag

SEQ ID NO: 511088 - DNA, 25 bp, Mus musculus
gatgacattgtctctggccacaaga

SEQ ID NO: 511089 - DNA, 25 bp, Mus musculus
gatgacattgtctggtggctctaag

SEQ ID NO: 511090 - DNA, 25 bp, Mus musculus
gatgacatttcgcttttaaaacttg

SEQ ID NO: 511091 - DNA, 25 bp, Mus musculus
gatgacatttcggttttaaaacttg

SEQ ID NO: 511092 - DNA, 25 bp, Mus musculus
gatgacattttcctcgataacacgc

SEQ ID NO: 511093 - DNA, 25 bp, Mus musculus
gatgacattttcgtcgataacacgc

SEQ ID NO: 511094 - DNA, 25 bp, Mus musculus
gatgacattttgcaggttcaatatg

SEQ ID NO: 511095 - DNA, 25 bp, Mus musculus
gatgacattttggaggttcaatatg

SEQ ID NO: 511096 - DNA, 25 bp, Mus musculus
gatgacatttttcctaccaattcca

SEQ ID NO: 511097 - DNA, 25 bp, Mus musculus
gatgacatttttgctaccaattcca

SEQ ID NO: 511098 - DNA, 25 bp, Mus musculus
gatgaccaagaactgactttactgt

SEQ ID NO: 511099 - DNA, 25 bp, Mus musculus
gatgaccaagaagtgactttactgt

SEQ ID NO: 511100 - DNA, 25 bp, Mus musculus
gatgaccaagccctcgtcatgggac

SEQ ID NO: 511101 - DNA, 25 bp, Mus musculus
gatgaccaagccgtcgtcatgggac

SEQ ID NO: 511102 - DNA, 25 bp, Mus musculus
gatgaccaagtccaaggttgaccag

SEQ ID NO: 511103 - DNA, 25 bp, Mus musculus
gatgaccaagtcgaaggttgaccag

SEQ ID NO: 511104 - DNA, 25 bp, Mus musculus
gatgaccaattactgcttagttaac

SEQ ID NO: 511105 - DNA, 25 bp, Mus musculus
gatgaccaattagtgcttagttaac

SEQ ID NO: 511106 - DNA, 25 bp, Mus musculus
gatgaccacaccaatactttgactt

SEQ ID NO: 511107 - DNA, 25 bp, Mus musculus
gatgaccacacctatactttgactt

SEQ ID NO: 511108 - DNA, 25 bp, Mus musculus
gatgaccacataatgcctgaggcac

SEQ ID NO: 511109 - DNA, 25 bp, Mus musculus
gatgaccacatattgcctgaggcac

SEQ ID NO: 511110 - DNA, 25 bp, Mus musculus
gatgaccacgtacctgggccaactt

SEQ ID NO: 511111 - DNA, 25 bp, Mus musculus
gatgaccacgtagctgggccaactt

SEQ ID NO: 511112 - DNA, 25 bp, Mus musculus
gatgaccactacagcctacagagca

SEQ ID NO: 511113 - DNA, 25 bp, Mus musculus
gatgaccactactgcctacagagca

SEQ ID NO: 511114 - DNA, 25 bp, Mus musculus
gatgaccactcgctgtttcaaagga

SEQ ID NO: 511115 - DNA, 25 bp, Mus musculus
gatgaccactcggtgtttcaaagga

SEQ ID NO: 511116 - DNA, 25 bp, Mus musculus
gatgaccactttaataaactagcca

SEQ ID NO: 511117 - DNA, 25 bp, Mus musculus
gatgaccacttttataaactagcca

SEQ ID NO: 511118 - DNA, 25 bp, Mus musculus
gatgaccagacaaacctctcaacta

SEQ ID NO: 511119 - DNA, 25 bp, Mus musculus
gatgaccagacatacctctcaacta

SEQ ID NO: 511120 - DNA, 25 bp, Mus musculus
gatgaccagagtaacccttattttg

SEQ ID NO: 511121 - DNA, 25 bp, Mus musculus
gatgaccagagttacccttattttg

SEQ ID NO: 511122 - DNA, 25 bp, Mus musculus
gatgaccagcatagtattcgtgaat

SEQ ID NO: 511123 - DNA, 25 bp, Mus musculus
gatgaccagcattgtattcgtgaat

SEQ ID NO: 511124 - DNA, 25 bp, Mus musculus
gatgaccagggtataatccccagca

SEQ ID NO: 511125 - DNA, 25 bp, Mus musculus
gatgaccagggtttaatccccagca

SEQ ID NO: 511126 - DNA, 25 bp, Mus musculus
gatgaccagtcccaggagtagaaca

SEQ ID NO: 511127 - DNA, 25 bp, Mus musculus
gatgaccagtccgaggagtagaaca

SEQ ID NO: 511128 - DNA, 25 bp, Mus musculus
gatgaccagtgtccaacttctgctt

SEQ ID NO: 511129 - DNA, 25 bp, Mus musculus
gatgaccagtgtgcaacttctgctt

SEQ ID NO: 511130 - DNA, 25 bp, Mus musculus
gatgaccagttcacagctgtggtgt

SEQ ID NO: 511131 - DNA, 25 bp, Mus musculus
gatgaccagttcatcatccttgcat

SEQ ID NO: 511132 - DNA, 25 bp, Mus musculus
gatgaccagttctcagctgtggtgt

SEQ ID NO: 511133 - DNA, 25 bp, Mus musculus
gatgaccagttcttcatccttgcat

SEQ ID NO: 511134 - DNA, 25 bp, Mus musculus
gatgaccatcataagcaagcagctg

SEQ ID NO: 511135 - DNA, 25 bp, Mus musculus
gatgaccatcattagcaagcagctg

SEQ ID NO: 511136 - DNA, 25 bp, Mus musculus
gatgaccatcttatgtagaatgttt

SEQ ID NO: 511137 - DNA, 25 bp, Mus musculus
gatgaccatcttttgtagaatgttt

SEQ ID NO: 511138 - DNA, 25 bp, Mus musculus
gatgaccatgacagacgcttacaaa

SEQ ID NO: 511139 - DNA, 25 bp, Mus musculus
gatgaccatgactgacgcttacaaa

SEQ ID NO: 511140 - DNA, 25 bp, Mus musculus
gatgaccatgatcattccattctgc

SEQ ID NO: 511141 - DNA, 25 bp, Mus musculus
gatgaccatgatgattccattctgc

SEQ ID NO: 511142 - DNA, 25 bp, Mus musculus
gatgaccattctcatacaactgctt

SEQ ID NO: 511143 - DNA, 25 bp, Mus musculus
gatgaccattctgatacaactgctt

SEQ ID NO: 511144 - DNA, 25 bp, Mus musculus
gatgaccattgaagacttgaatgag

SEQ ID NO: 511145 - DNA, 25 bp, Mus musculus
gatgaccattgactgtccttgatct

SEQ ID NO: 511146 - DNA, 25 bp, Mus musculus
gatgaccattgagtgtccttgatct

SEQ ID NO: 511147 - DNA, 25 bp, Mus musculus
gatgaccattgatgacttgaatgag

SEQ ID NO: 511148 - DNA, 25 bp, Mus musculus
gatgacccacatactctagcatgaa

SEQ ID NO: 511149 - DNA, 25 bp, Mus musculus
gatgacccacattctctagcatgaa

SEQ ID NO: 511150 - DNA, 25 bp, Mus musculus
gatgacccagcaaggtagctagcca

SEQ ID NO: 511151 - DNA, 25 bp, Mus musculus
gatgacccagcatggtagctagcca

SEQ ID NO: 511152 - DNA, 25 bp, Mus musculus
gatgacccagctcctgtgtgtccaa

SEQ ID NO: 511153 - DNA, 25 bp, Mus musculus
gatgacccagctgctgtgtgtccaa

SEQ ID NO: 511154 - DNA, 25 bp, Mus musculus
gatgacccaggtattagattgacta

SEQ ID NO: 511155 - DNA, 25 bp, Mus musculus
gatgacccaggttttagattgacta

SEQ ID NO: 511156 - DNA, 25 bp, Mus musculus
gatgacccagtcagtgttttttctc

SEQ ID NO: 511157 - DNA, 25 bp, Mus musculus
gatgacccagtctgtgttttttctc

SEQ ID NO: 511158 - DNA, 25 bp, Mus musculus
gatgacccatttctatcatccattc

SEQ ID NO: 511159 - DNA, 25 bp, Mus musculus
gatgacccatttgtatcatccattc

SEQ ID NO: 511160 - DNA, 25 bp, Mus musculus
gatgacccctttagctgtattgaaa

SEQ ID NO: 511161 - DNA, 25 bp, Mus musculus
gatgaccccttttgctgtattgaaa

SEQ ID NO: 511162 - DNA, 25 bp, Mus musculus
gatgacccgaatataatccttgcaa

SEQ ID NO: 511163 - DNA, 25 bp, Mus musculus
gatgacccgaatttaatccttgcaa

SEQ ID NO: 511164 - DNA, 25 bp, Mus musculus
gatgacccgagtataaatctctaga

SEQ ID NO: 511165 - DNA, 25 bp, Mus musculus
gatgacccgagtttaaatctctaga

SEQ ID NO: 511166 - DNA, 25 bp, Mus musculus
gatgacccgatcatgggcggagata

SEQ ID NO: 511167 - DNA, 25 bp, Mus musculus
gatgacccgatcttgggcggagata

SEQ ID NO: 511168 - DNA, 25 bp, Mus musculus
gatgacccgatgcagttccacttca

SEQ ID NO: 511169 - DNA, 25 bp, Mus musculus
gatgacccgatggagttccacttca

SEQ ID NO: 511170 - DNA, 25 bp, Mus musculus
gatgacccggaacctggaagagcca

SEQ ID NO: 511171 - DNA, 25 bp, Mus musculus
gatgacccggaagctggaagagcca

SEQ ID NO: 511172 - DNA, 25 bp, Mus musculus
gatgacccgtgcagtcactaggtag

SEQ ID NO: 511173 - DNA, 25 bp, Mus musculus
gatgacccgtgctgtcactaggtag

SEQ ID NO: 511174 - DNA, 25 bp, Mus musculus
gatgaccctcagctggcagtgatta

SEQ ID NO: 511175 - DNA, 25 bp, Mus musculus
gatgaccctcaggtggcagtgatta

SEQ ID NO: 511176 - DNA, 25 bp, Mus musculus
gatgaccctgacctctgggtccgga

SEQ ID NO: 511177 - DNA, 25 bp, Mus musculus
gatgaccctgacgtctgggtccgga

SEQ ID NO: 511178 - DNA, 25 bp, Mus musculus
gatgaccctgctatgaaatctcgac

SEQ ID NO: 511179 - DNA, 25 bp, Mus musculus
gatgaccctgctttgaaatctcgac

SEQ ID NO: 511180 - DNA, 25 bp, Mus musculus
gatgaccctggacggattctgtcct

SEQ ID NO: 511181 - DNA, 25 bp, Mus musculus
gatgaccctggagggattctgtcct

SEQ ID NO: 511182 - DNA, 25 bp, Mus musculus
gatgaccctgtaagtagtcctcagt

SEQ ID NO: 511183 - DNA, 25 bp, Mus musculus
gatgaccctgtatgtagtcctcagt

SEQ ID NO: 511184 - DNA, 25 bp, Mus musculus
gatgaccgcatacctgaaggcacat

SEQ ID NO: 511185 - DNA, 25 bp, Mus musculus
gatgaccgcatagctgaaggcacat

SEQ ID NO: 511186 - DNA, 25 bp, Mus musculus
gatgaccgcatcagctgggaccatg

SEQ ID NO: 511187 - DNA, 25 bp, Mus musculus
gatgaccgcatctgctgggaccatg

SEQ ID NO: 511188 - DNA, 25 bp, Mus musculus
gatgaccgctccattcattctggag

SEQ ID NO: 511189 - DNA, 25 bp, Mus musculus
gatgaccgctcctttcattctggag

SEQ ID NO: 511190 - DNA, 25 bp, Mus musculus
gatgaccggcccagacagaagcgag

SEQ ID NO: 511191 - DNA, 25 bp, Mus musculus
gatgaccggccctgacagaagcgag

SEQ ID NO: 511192 - DNA, 25 bp, Mus musculus
gatgaccgggacaattacagcagat

SEQ ID NO: 511193 - DNA, 25 bp, Mus musculus
gatgaccgggactattacagcagat

SEQ ID NO: 511194 - DNA, 25 bp, Mus musculus
gatgaccgggagcagttctacaaga

SEQ ID NO: 511195 - DNA, 25 bp, Mus musculus
gatgaccgggaggagttctacaaga

SEQ ID NO: 511196 - DNA, 25 bp, Mus musculus
gatgaccgggttcttgagcttcctc

SEQ ID NO: 511197 - DNA, 25 bp, Mus musculus
gatgaccgggttgttgagcttcctc

SEQ ID NO: 511198 - DNA, 25 bp, Mus musculus
gatgaccggtaaagagcctgtttaa

SEQ ID NO: 511199 - DNA, 25 bp, Mus musculus
gatgaccggtaatgagcctgtttaa

SEQ ID NO: 511200 - DNA, 25 bp, Mus musculus
gatgaccgtggtacaatacttcttt

SEQ ID NO: 511201 - DNA, 25 bp, Mus musculus
gatgaccgtggttcaatacttcttt

SEQ ID NO: 511202 - DNA, 25 bp, Mus musculus
gatgacctacaaattgattctcaag

SEQ ID NO: 511203 - DNA, 25 bp, Mus musculus
gatgacctacaatttgattctcaag

SEQ ID NO: 511204 - DNA, 25 bp, Mus musculus
gatgacctaggaattagcctcttaa

SEQ ID NO: 511205 - DNA, 25 bp, Mus musculus
gatgacctaggatttagcctcttaa

SEQ ID NO: 511206 - DNA, 25 bp, Mus musculus
gatgacctatgaaccctggtgtgaa

SEQ ID NO: 511207 - DNA, 25 bp, Mus musculus
gatgacctatgatccctggtgtgaa

SEQ ID NO: 511208 - DNA, 25 bp, Mus musculus
gatgacctcaaaccatcagactctg

SEQ ID NO: 511209 - DNA, 25 bp, Mus musculus
gatgacctcaaagcatcagactctg

SEQ ID NO: 511210 - DNA, 25 bp, Mus musculus
gatgacctcaacacagtagcagctg

SEQ ID NO: 511211 - DNA, 25 bp, Mus musculus
gatgacctcaactcagtagcagctg

SEQ ID NO: 511212 - DNA, 25 bp, Mus musculus
gatgacctcacacagcgagcggcaa

SEQ ID NO: 511213 - DNA, 25 bp, Mus musculus
gatgacctcacacccaagcatgggg

SEQ ID NO: 511214 - DNA, 25 bp, Mus musculus
gatgacctcacagagcgagcggcaa

SEQ ID NO: 511215 - DNA, 25 bp, Mus musculus
gatgacctcacagccaagcatgggg

SEQ ID NO: 511216 - DNA, 25 bp, Mus musculus
gatgacctcacgaatagtctccaaa

SEQ ID NO: 511217 - DNA, 25 bp, Mus musculus
gatgacctcacgtatagtctccaaa

SEQ ID NO: 511218 - DNA, 25 bp, Mus musculus
gatgacctcagacttgatactttct

SEQ ID NO: 511219 - DNA, 25 bp, Mus musculus
gatgacctcagagttgatactttct

SEQ ID NO: 511220 - DNA, 25 bp, Mus musculus
gatgacctcagcaacagatgtgttt

SEQ ID NO: 511221 - DNA, 25 bp, Mus musculus
gatgacctcagctacagatgtgttt

SEQ ID NO: 511222 - DNA, 25 bp, Mus musculus
gatgacctcaggagaccagtgccca

SEQ ID NO: 511223 - DNA, 25 bp, Mus musculus
gatgacctcaggtgaccagtgccca

SEQ ID NO: 511224 - DNA, 25 bp, Mus musculus
gatgacctcattatgatgttaaaaa

SEQ ID NO: 511225 - DNA, 25 bp, Mus musculus
gatgacctcattttgatgttaaaaa

SEQ ID NO: 511226 - DNA, 25 bp, Mus musculus
gatgacctccaaatccacttgagaa

SEQ ID NO: 511227 - DNA, 25 bp, Mus musculus
gatgacctccaattccacttgagaa

SEQ ID NO: 511228 - DNA, 25 bp, Mus musculus
gatgacctcgcgcccgagttagaga

SEQ ID NO: 511229 - DNA, 25 bp, Mus musculus
gatgacctcgcggccgagttagaga

SEQ ID NO: 511230 - DNA, 25 bp, Mus musculus
gatgacctctaccactgtcttgtct

SEQ ID NO: 511231 - DNA, 25 bp, Mus musculus
gatgacctctacgactgtcttgtct

SEQ ID NO: 511232 - DNA, 25 bp, Mus musculus
gatgacctcttaatccttggaactt

SEQ ID NO: 511233 - DNA, 25 bp, Mus musculus
gatgacctcttattccttggaactt

SEQ ID NO: 511234 - DNA, 25 bp, Mus musculus
gatgacctgacccctggctggcagc

SEQ ID NO: 511235 - DNA, 25 bp, Mus musculus
gatgacctgaccgctggctggcagc

SEQ ID NO: 511236 - DNA, 25 bp, Mus musculus
gatgacctgactaggaaactgctta

SEQ ID NO: 511237 - DNA, 25 bp, Mus musculus
gatgacctgacttggaaactgctta

SEQ ID NO: 511238 - DNA, 25 bp, Mus musculus
gatgacctgcacattagatttcttt

SEQ ID NO: 511239 - DNA, 25 bp, Mus musculus
gatgacctgcactttagatttcttt

SEQ ID NO: 511240 - DNA, 25 bp, Mus musculus
gatgacctgggtcttaatttgaatt

SEQ ID NO: 511241 - DNA, 25 bp, Mus musculus
gatgacctgggtgttaatttgaatt

SEQ ID NO: 511242 - DNA, 25 bp, Mus musculus
gatgacctgtcaagtgcttttagac

SEQ ID NO: 511243 - DNA, 25 bp, Mus musculus
gatgacctgtcatgtgcttttagac

SEQ ID NO: 511244 - DNA, 25 bp, Mus musculus
gatgacctgtctctggatgatactc

SEQ ID NO: 511245 - DNA, 25 bp, Mus musculus
gatgacctgtctgtggatgatactc

SEQ ID NO: 511246 - DNA, 25 bp, Mus musculus
gatgacctgttaccttctttttaaa

SEQ ID NO: 511247 - DNA, 25 bp, Mus musculus
gatgacctgttagcttctttttaaa

SEQ ID NO: 511248 - DNA, 25 bp, Mus musculus
gatgaccttaacagcatgtttcttg

SEQ ID NO: 511249 - DNA, 25 bp, Mus musculus
gatgaccttaactgcatgtttcttg

SEQ ID NO: 511250 - DNA, 25 bp, Mus musculus
gatgaccttcaaagtgcctatctga

SEQ ID NO: 511251 - DNA, 25 bp, Mus musculus
gatgaccttcaatgtgcctatctga

SEQ ID NO: 511252 - DNA, 25 bp, Mus musculus
gatgaccttcggagcggacctcaag

SEQ ID NO: 511253 - DNA, 25 bp, Mus musculus
gatgaccttcggtgcggacctcaag

SEQ ID NO: 511254 - DNA, 25 bp, Mus musculus
gatgaccttggacttctaagatcat

SEQ ID NO: 511255 - DNA, 25 bp, Mus musculus
gatgaccttggagttctaagatcat

SEQ ID NO: 511256 - DNA, 25 bp, Mus musculus
gatgaccttggcattggaaatttca

SEQ ID NO: 511257 - DNA, 25 bp, Mus musculus
gatgaccttggctttggaaatttca

SEQ ID NO: 511258 - DNA, 25 bp, Mus musculus
gatgaccttttgagcttcgaatcct

SEQ ID NO: 511259 - DNA, 25 bp, Mus musculus
gatgaccttttgtgcttcgaatcct

SEQ ID NO: 511260 - DNA, 25 bp, Mus musculus
gatgacgaaaaactgatgccaaatt

SEQ ID NO: 511261 - DNA, 25 bp, Mus musculus
gatgacgaaaaagtgatgccaaatt

SEQ ID NO: 511262 - DNA, 25 bp, Mus musculus
gatgacgaactacccttcagcaaag

SEQ ID NO: 511263 - DNA, 25 bp, Mus musculus
gatgacgaactacgagagcgcgccc

SEQ ID NO: 511264 - DNA, 25 bp, Mus musculus
gatgacgaactagccttcagcaaag

SEQ ID NO: 511265 - DNA, 25 bp, Mus musculus
gatgacgaactaggagagcgcgccc

SEQ ID NO: 511266 - DNA, 25 bp, Mus musculus
gatgacgaagaaaccccagctgagg

SEQ ID NO: 511267 - DNA, 25 bp, Mus musculus
gatgacgaagaatccccagctgagg

SEQ ID NO: 511268 - DNA, 25 bp, Mus musculus
gatgacgacaggacttccgatttct

SEQ ID NO: 511269 - DNA, 25 bp, Mus musculus
gatgacgacaggtcttccgatttct

SEQ ID NO: 511270 - DNA, 25 bp, Mus musculus
gatgacgacctcatctgaggcagaa

SEQ ID NO: 511271 - DNA, 25 bp, Mus musculus
gatgacgacctcttctgaggcagaa

SEQ ID NO: 511272 - DNA, 25 bp, Mus musculus
gatgacgacctgctgatcgacattc

SEQ ID NO: 511273 - DNA, 25 bp, Mus musculus
gatgacgacctggtgatcgacattc

SEQ ID NO: 511274 - DNA, 25 bp, Mus musculus
gatgacgactgcagctgttacacat

SEQ ID NO: 511275 - DNA, 25 bp, Mus musculus
gatgacgactgctgctgttacacat

SEQ ID NO: 511276 - DNA, 25 bp, Mus musculus
gatgacgactttcgaaacatgcaag

SEQ ID NO: 511277 - DNA, 25 bp, Mus musculus
gatgacgactttggaaacatgcaag

SEQ ID NO: 511278 - DNA, 25 bp, Mus musculus
gatgacgagactacctgtatcctta

SEQ ID NO: 511279 - DNA, 25 bp, Mus musculus
gatgacgagacttcctgtatcctta

SEQ ID NO: 511280 - DNA, 25 bp, Mus musculus
gatgacgaggaccactttcacccaa

SEQ ID NO: 511281 - DNA, 25 bp, Mus musculus
gatgacgaggacgactttcacccaa

SEQ ID NO: 511282 - DNA, 25 bp, Mus musculus
gatgacgaggcaattggctacctta

SEQ ID NO: 511283 - DNA, 25 bp, Mus musculus
gatgacgaggcatttggctacctta

SEQ ID NO: 511284 - DNA, 25 bp, Mus musculus
gatgacgatagcacccaatcgccct

SEQ ID NO: 511285 - DNA, 25 bp, Mus musculus
gatgacgatagctcccaatcgccct

SEQ ID NO: 511286 - DNA, 25 bp, Mus musculus
gatgacgatgatactgcagctcttc

SEQ ID NO: 511287 - DNA, 25 bp, Mus musculus
gatgacgatgattctgcagctcttc

SEQ ID NO: 511288 - DNA, 25 bp, Mus musculus
gatgacgatggcaccgaattccatg

SEQ ID NO: 511289 - DNA, 25 bp, Mus musculus
gatgacgatggctccgaattccatg

SEQ ID NO: 511290 - DNA, 25 bp, Mus musculus
gatgacgcaattcctgattcaggca

SEQ ID NO: 511291 - DNA, 25 bp, Mus musculus
gatgacgcaattgctgattcaggca

SEQ ID NO: 511292 - DNA, 25 bp, Mus musculus
gatgacgcacagattgtattcctcc

SEQ ID NO: 511293 - DNA, 25 bp, Mus musculus
gatgacgcacagtttgtattcctcc

SEQ ID NO: 511294 - DNA, 25 bp, Mus musculus
gatgacgcagaactggcccactggt

SEQ ID NO: 511295 - DNA, 25 bp, Mus musculus
gatgacgcagaagtggcccactggt

SEQ ID NO: 511296 - DNA, 25 bp, Mus musculus
gatgacgcagccacaaaggatgatt

SEQ ID NO: 511297 - DNA, 25 bp, Mus musculus
gatgacgcagcctcaaaggatgatt

SEQ ID NO: 511298 - DNA, 25 bp, Mus musculus
gatgacgccaggaccgtgggactct

SEQ ID NO: 511299 - DNA, 25 bp, Mus musculus
gatgacgccaggtccgtgggactct

SEQ ID NO: 511300 - DNA, 25 bp, Mus musculus
gatgacgcctttccggactgtgatg

SEQ ID NO: 511301 - DNA, 25 bp, Mus musculus
gatgacgcctttgcggactgtgatg

SEQ ID NO: 511302 - DNA, 25 bp, Mus musculus
gatgacgctctcacgctgtacttgg

SEQ ID NO: 511303 - DNA, 25 bp, Mus musculus
gatgacgctctctcgctgtacttgg

SEQ ID NO: 511304 - DNA, 25 bp, Mus musculus
gatgacgctgatcagtttggctaca

SEQ ID NO: 511305 - DNA, 25 bp, Mus musculus
gatgacgctgatgagtttggctaca

SEQ ID NO: 511306 - DNA, 25 bp, Mus musculus
gatgacggcatacccggacatcagg

SEQ ID NO: 511307 - DNA, 25 bp, Mus musculus
gatgacggcatagccggacatcagg

SEQ ID NO: 511308 - DNA, 25 bp, Mus musculus
gatgacggcggaagacgattcctcc

SEQ ID NO: 511309 - DNA, 25 bp, Mus musculus
gatgacggcggatgacgattcctcc

SEQ ID NO: 511310 - DNA, 25 bp, Mus musculus
gatgacggctgcactgatatggtgc

SEQ ID NO: 511311 - DNA, 25 bp, Mus musculus
gatgacggctgctctgatatggtgc

SEQ ID NO: 511312 - DNA, 25 bp, Mus musculus
gatgacgggacacttcctggtctat

SEQ ID NO: 511313 - DNA, 25 bp, Mus musculus
gatgacgggacagttcctggtctat

SEQ ID NO: 511314 - DNA, 25 bp, Mus musculus
gatgacgggtttagtttggctcaca

SEQ ID NO: 511315 - DNA, 25 bp, Mus musculus
gatgacgggttttgtttggctcaca

SEQ ID NO: 511316 - DNA, 25 bp, Mus musculus
gatgacggtcttaacccccactgta

SEQ ID NO: 511317 - DNA, 25 bp, Mus musculus
gatgacggtctttacccccactgta

SEQ ID NO: 511318 - DNA, 25 bp, Mus musculus
gatgacgtaaaaacagccctggagc

SEQ ID NO: 511319 - DNA, 25 bp, Mus musculus
gatgacgtaaaatcagccctggagc

SEQ ID NO: 511320 - DNA, 25 bp, Mus musculus
gatgacgtaaccagttgacccttca

SEQ ID NO: 511321 - DNA, 25 bp, Mus musculus
gatgacgtaacctgttgacccttca

SEQ ID NO: 511322 - DNA, 25 bp, Mus musculus
gatgacgtaggccagcaattgcttt

SEQ ID NO: 511323 - DNA, 25 bp, Mus musculus
gatgacgtaggcgagcaattgcttt

SEQ ID NO: 511324 - DNA, 25 bp, Mus musculus
gatgacgtaggtacaggttccgctc

SEQ ID NO: 511325 - DNA, 25 bp, Mus musculus
gatgacgtaggttcaggttccgctc

SEQ ID NO: 511326 - DNA, 25 bp, Mus musculus
gatgacgtattactctacacctgat

SEQ ID NO: 511327 - DNA, 25 bp, Mus musculus
gatgacgtattagtctacacctgat

SEQ ID NO: 511328 - DNA, 25 bp, Mus musculus
gatgacgtcattcgtgttcgacccc

SEQ ID NO: 511329 - DNA, 25 bp, Mus musculus
gatgacgtcattggtgttcgacccc

SEQ ID NO: 511330 - DNA, 25 bp, Mus musculus
gatgacgtcgcaaacactgtcctga

SEQ ID NO: 511331 - DNA, 25 bp, Mus musculus
gatgacgtcgcatacactgtcctga

SEQ ID NO: 511332 - DNA, 25 bp, Mus musculus
gatgacgtctaaccaccagaaaagt

SEQ ID NO: 511333 - DNA, 25 bp, Mus musculus
gatgacgtctaagcaccagaaaagt

SEQ ID NO: 511334 - DNA, 25 bp, Mus musculus
gatgacgtcttaataaagcccagca

SEQ ID NO: 511335 - DNA, 25 bp, Mus musculus
gatgacgtcttattaaagcccagca

SEQ ID NO: 511336 - DNA, 25 bp, Mus musculus
gatgacgtgatcagccgcattgaca

SEQ ID NO: 511337 - DNA, 25 bp, Mus musculus
gatgacgtgatctgccgcattgaca

SEQ ID NO: 511338 - DNA, 25 bp, Mus musculus
gatgacgtggaaaaaagagctcttt

SEQ ID NO: 511339 - DNA, 25 bp, Mus musculus
gatgacgtggaataaagagctcttt

SEQ ID NO: 511340 - DNA, 25 bp, Mus musculus
gatgacgttatgatgatttctgtga

SEQ ID NO: 511341 - DNA, 25 bp, Mus musculus
gatgacgttatgttgatttctgtga

SEQ ID NO: 511342 - DNA, 25 bp, Mus musculus
gatgacgtttcacaaacctcatgat

SEQ ID NO: 511343 - DNA, 25 bp, Mus musculus
gatgacgtttcagaaacctcatgat

SEQ ID NO: 511344 - DNA, 25 bp, Mus musculus
gatgactaaagccttcactgccttc

SEQ ID NO: 511345 - DNA, 25 bp, Mus musculus
gatgactaaagcgttcactgccttc

SEQ ID NO: 511346 - DNA, 25 bp, Mus musculus
gatgactaagatcttatacccatct

SEQ ID NO: 511347 - DNA, 25 bp, Mus musculus
gatgactaagatgttatacccatct

SEQ ID NO: 511348 - DNA, 25 bp, Mus musculus
gatgactaaggactgcccatatctg

SEQ ID NO: 511349 - DNA, 25 bp, Mus musculus
gatgactaaggagtgcccatatctg

SEQ ID NO: 511350 - DNA, 25 bp, Mus musculus
gatgactaaggcacagtaccagcga

SEQ ID NO: 511351 - DNA, 25 bp, Mus musculus
gatgactaaggctcagtaccagcga

SEQ ID NO: 511352 - DNA, 25 bp, Mus musculus
gatgactacagtccagacaccatgc

SEQ ID NO: 511353 - DNA, 25 bp, Mus musculus
gatgactacagtgcagacaccatgc

SEQ ID NO: 511354 - DNA, 25 bp, Mus musculus
gatgactaccatctacggtggcaaa

SEQ ID NO: 511355 - DNA, 25 bp, Mus musculus
gatgactaccatgtacggtggcaaa

SEQ ID NO: 511356 - DNA, 25 bp, Mus musculus
gatgactacccacgaactaccaaca

SEQ ID NO: 511357 - DNA, 25 bp, Mus musculus
gatgactacccaggaactaccaaca

SEQ ID NO: 511358 - DNA, 25 bp, Mus musculus
gatgactaccggcaagacctgactc

SEQ ID NO: 511359 - DNA, 25 bp, Mus musculus
gatgactaccgggaagacctgactc

SEQ ID NO: 511360 - DNA, 25 bp, Mus musculus
gatgactacgtgaacgtctttccgt

SEQ ID NO: 511361 - DNA, 25 bp, Mus musculus
gatgactacgtgtacgtctttccgt

SEQ ID NO: 511362 - DNA, 25 bp, Mus musculus
gatgactactaaccgagcaggtgtt

SEQ ID NO: 511363 - DNA, 25 bp, Mus musculus
gatgactactaagcgagcaggtgtt

SEQ ID NO: 511364 - DNA, 25 bp, Mus musculus
gatgactactgaccagcctgtccca

SEQ ID NO: 511365 - DNA, 25 bp, Mus musculus
gatgactactgagcagcctgtccca

SEQ ID NO: 511366 - DNA, 25 bp, Mus musculus
gatgactacttcacgaaagcctgga

SEQ ID NO: 511367 - DNA, 25 bp, Mus musculus
gatgactacttctcgaaagcctgga

SEQ ID NO: 511368 - DNA, 25 bp, Mus musculus
gatgactatcacatggcacctgggt

SEQ ID NO: 511369 - DNA, 25 bp, Mus musculus
gatgactatcacttggcacctgggt

SEQ ID NO: 511370 - DNA, 25 bp, Mus musculus
gatgactatgctatttgactgaacc

SEQ ID NO: 511371 - DNA, 25 bp, Mus musculus
gatgactatgctttttgactgaacc

SEQ ID NO: 511372 - DNA, 25 bp, Mus musculus
gatgactattgcagcatacccggat

SEQ ID NO: 511373 - DNA, 25 bp, Mus musculus
gatgactattgctgcatacccggat

SEQ ID NO: 511374 - DNA, 25 bp, Mus musculus
gatgactatttcagtggaattcgta

SEQ ID NO: 511375 - DNA, 25 bp, Mus musculus
gatgactatttctgtggaattcgta

SEQ ID NO: 511376 - DNA, 25 bp, Mus musculus
gatgactcaaagattccagctacca

SEQ ID NO: 511377 - DNA, 25 bp, Mus musculus
gatgactcaaagtttccagctacca

SEQ ID NO: 511378 - DNA, 25 bp, Mus musculus
gatgactcaataagtacccatgtgt

SEQ ID NO: 511379 - DNA, 25 bp, Mus musculus
gatgactcaatatgtacccatgtgt

SEQ ID NO: 511380 - DNA, 25 bp, Mus musculus
gatgactcaatcaatttctaccaaa

SEQ ID NO: 511381 - DNA, 25 bp, Mus musculus
gatgactcaatctatttctaccaaa

SEQ ID NO: 511382 - DNA, 25 bp, Mus musculus
gatgactcacagcagttgcatatca

SEQ ID NO: 511383 - DNA, 25 bp, Mus musculus
gatgactcacaggagttgcatatca

SEQ ID NO: 511384 - DNA, 25 bp, Mus musculus
gatgactcagaacccagacagttgc

SEQ ID NO: 511385 - DNA, 25 bp, Mus musculus
gatgactcagaagccagacagttgc

SEQ ID NO: 511386 - DNA, 25 bp, Mus musculus
gatgactcagacattggcgtagaac

SEQ ID NO: 511387 - DNA, 25 bp, Mus musculus
gatgactcagactttggcgtagaac

SEQ ID NO: 511388 - DNA, 25 bp, Mus musculus
gatgactcagctcctaatgaaatgg

SEQ ID NO: 511389 - DNA, 25 bp, Mus musculus
gatgactcagctctgaaggcgctcc

SEQ ID NO: 511390 - DNA, 25 bp, Mus musculus
gatgactcagctgctaatgaaatgg

SEQ ID NO: 511391 - DNA, 25 bp, Mus musculus
gatgactcagctgtgaaggcgctcc

SEQ ID NO: 511392 - DNA, 25 bp, Mus musculus
gatgactcatgtaacagaccttgat

SEQ ID NO: 511393 - DNA, 25 bp, Mus musculus
gatgactcatgttacagaccttgat

SEQ ID NO: 511394 - DNA, 25 bp, Mus musculus
gatgactcattgcttcaaagccctt

SEQ ID NO: 511395 - DNA, 25 bp, Mus musculus
gatgactcattggttcaaagccctt

SEQ ID NO: 511396 - DNA, 25 bp, Mus musculus
gatgactcatttcagcctcattatt

SEQ ID NO: 511397 - DNA, 25 bp, Mus musculus
gatgactcatttgagcctcattatt

SEQ ID NO: 511398 - DNA, 25 bp, Mus musculus
gatgactccataattgaacacttcc

SEQ ID NO: 511399 - DNA, 25 bp, Mus musculus
gatgactccatatttgaacacttcc

SEQ ID NO: 511400 - DNA, 25 bp, Mus musculus
gatgactccattccctaatgagctt

SEQ ID NO: 511401 - DNA, 25 bp, Mus musculus
gatgactccattgcctaatgagctt

SEQ ID NO: 511402 - DNA, 25 bp, Mus musculus
gatgactcctacctcttgtccggtt

SEQ ID NO: 511403 - DNA, 25 bp, Mus musculus
gatgactcctacgtcttgtccggtt

SEQ ID NO: 511404 - DNA, 25 bp, Mus musculus
gatgactcctctactgacagacaaa

SEQ ID NO: 511405 - DNA, 25 bp, Mus musculus
gatgactcctcttctgacagacaaa

SEQ ID NO: 511406 - DNA, 25 bp, Mus musculus
gatgactcctggcagatagcagttt

SEQ ID NO: 511407 - DNA, 25 bp, Mus musculus
gatgactcctgggagatagcagttt

SEQ ID NO: 511408 - DNA, 25 bp, Mus musculus
gatgactcggatactccaggactct

SEQ ID NO: 511409 - DNA, 25 bp, Mus musculus
gatgactcggattctccaggactct

SEQ ID NO: 511410 - DNA, 25 bp, Mus musculus
gatgactcgggccatgtaccaggaa

SEQ ID NO: 511411 - DNA, 25 bp, Mus musculus
gatgactcgggcgatgtaccaggaa

SEQ ID NO: 511412 - DNA, 25 bp, Mus musculus
gatgactctacacagcaactttgaa

SEQ ID NO: 511413 - DNA, 25 bp, Mus musculus
gatgactctacagagcaactttgaa

SEQ ID NO: 511414 - DNA, 25 bp, Mus musculus
gatgactctagcagagattcctagc

SEQ ID NO: 511415 - DNA, 25 bp, Mus musculus
gatgactctagctgagattcctagc

SEQ ID NO: 511416 - DNA, 25 bp, Mus musculus
gatgactctatcattctagttgccc

SEQ ID NO: 511417 - DNA, 25 bp, Mus musculus
gatgactctatctttctagttgccc

SEQ ID NO: 511418 - DNA, 25 bp, Mus musculus
gatgactctgatacacttggcgatt

SEQ ID NO: 511419 - DNA, 25 bp, Mus musculus
gatgactctgatctcattctcaatg

SEQ ID NO: 511420 - DNA, 25 bp, Mus musculus
gatgactctgatgtcattctcaatg

SEQ ID NO: 511421 - DNA, 25 bp, Mus musculus
gatgactctgattcacttggcgatt

SEQ ID NO: 511422 - DNA, 25 bp, Mus musculus
gatgactctgggagaaaccaccagt

SEQ ID NO: 511423 - DNA, 25 bp, Mus musculus
gatgactctgggtgaaaccaccagt

SEQ ID NO: 511424 - DNA, 25 bp, Mus musculus
gatgactctggtccacataatctct

SEQ ID NO: 511425 - DNA, 25 bp, Mus musculus
gatgactctggtgcacataatctct

SEQ ID NO: 511426 - DNA, 25 bp, Mus musculus
gatgactcttccatagttagctact

SEQ ID NO: 511427 - DNA, 25 bp, Mus musculus
gatgactcttccttagttagctact

SEQ ID NO: 511428 - DNA, 25 bp, Mus musculus
gatgactcttggcacccacatgaac

SEQ ID NO: 511429 - DNA, 25 bp, Mus musculus
gatgactcttgggacccacatgaac

SEQ ID NO: 511430 - DNA, 25 bp, Mus musculus
gatgactcttttccgtttagatcac

SEQ ID NO: 511431 - DNA, 25 bp, Mus musculus
gatgactcttttgcgtttagatcac

SEQ ID NO: 511432 - DNA, 25 bp, Mus musculus
gatgactgaatgagcagcactgtgt

SEQ ID NO: 511433 - DNA, 25 bp, Mus musculus
gatgactgaatgtgcagcactgtgt

SEQ ID NO: 511434 - DNA, 25 bp, Mus musculus
gatgactgaccaattcctgttgaaa

SEQ ID NO: 511435 - DNA, 25 bp, Mus musculus
gatgactgaccatttcctgttgaaa

SEQ ID NO: 511436 - DNA, 25 bp, Mus musculus
gatgactgactgactatgatgggct

SEQ ID NO: 511437 - DNA, 25 bp, Mus musculus
gatgactgactgtctatgatgggct

SEQ ID NO: 511438 - DNA, 25 bp, Mus musculus
gatgactgcacaagggcagctccca

SEQ ID NO: 511439 - DNA, 25 bp, Mus musculus
gatgactgcacatgggcagctccca

SEQ ID NO: 511440 - DNA, 25 bp, Mus musculus
gatgactgcaccattggctacattg

SEQ ID NO: 511441 - DNA, 25 bp, Mus musculus
gatgactgcacctttggctacattg

SEQ ID NO: 511442 - DNA, 25 bp, Mus musculus
gatgactgcagacaggccacagccc

SEQ ID NO: 511443 - DNA, 25 bp, Mus musculus
gatgactgcagagaggccacagccc

SEQ ID NO: 511444 - DNA, 25 bp, Mus musculus
gatgactgcagtatcagatgccatt

SEQ ID NO: 511445 - DNA, 25 bp, Mus musculus
gatgactgcagtcccttagaagacc

SEQ ID NO: 511446 - DNA, 25 bp, Mus musculus
gatgactgcagtcggcctctgccag

SEQ ID NO: 511447 - DNA, 25 bp, Mus musculus
gatgactgcagtgccttagaagacc

SEQ ID NO: 511448 - DNA, 25 bp, Mus musculus
gatgactgcagtgggcctctgccag

SEQ ID NO: 511449 - DNA, 25 bp, Mus musculus
gatgactgcagtttcagatgccatt

SEQ ID NO: 511450 - DNA, 25 bp, Mus musculus
gatgactgcatcatgtactcggaga

SEQ ID NO: 511451 - DNA, 25 bp, Mus musculus
gatgactgcatcttgtactcggaga

SEQ ID NO: 511452 - DNA, 25 bp, Mus musculus
gatgactgccctcaaacgcagggtt

SEQ ID NO: 511453 - DNA, 25 bp, Mus musculus
gatgactgccctgaaacgcagggtt

SEQ ID NO: 511454 - DNA, 25 bp, Mus musculus
gatgactgcctgacctaccagagat

SEQ ID NO: 511455 - DNA, 25 bp, Mus musculus
gatgactgcctgtcctaccagagat

SEQ ID NO: 511456 - DNA, 25 bp, Mus musculus
gatgactgctacacttcagccagag

SEQ ID NO: 511457 - DNA, 25 bp, Mus musculus
gatgactgctactcttcagccagag

SEQ ID NO: 511458 - DNA, 25 bp, Mus musculus
gatgactggcttcttgactgagcaa

SEQ ID NO: 511459 - DNA, 25 bp, Mus musculus
gatgactggcttgttgactgagcaa

SEQ ID NO: 511460 - DNA, 25 bp, Mus musculus
gatgactgggctatcagctctaaga

SEQ ID NO: 511461 - DNA, 25 bp, Mus musculus
gatgactgggctttcagctctaaga

SEQ ID NO: 511462 - DNA, 25 bp, Mus musculus
gatgactggtgaagccacgcaataa

SEQ ID NO: 511463 - DNA, 25 bp, Mus musculus
gatgactggtgatgccacgcaataa

SEQ ID NO: 511464 - DNA, 25 bp, Mus musculus
gatgactgtactcccttgaaaacca

SEQ ID NO: 511465 - DNA, 25 bp, Mus musculus
gatgactgtactgccttgaaaacca

SEQ ID NO: 511466 - DNA, 25 bp, Mus musculus
gatgactgtcaaccgtctttccctt

SEQ ID NO: 511467 - DNA, 25 bp, Mus musculus
gatgactgtcaagcgtctttccctt

SEQ ID NO: 511468 - DNA, 25 bp, Mus musculus
gatgactgtgccagtgtggtatcag

SEQ ID NO: 511469 - DNA, 25 bp, Mus musculus
gatgactgtgcctgtgtggtatcag

SEQ ID NO: 511470 - DNA, 25 bp, Mus musculus
gatgactgttggatcctgacatgtt

SEQ ID NO: 511471 - DNA, 25 bp, Mus musculus
gatgactgttggttcctgacatgtt

SEQ ID NO: 511472 - DNA, 25 bp, Mus musculus
gatgactgtttcctgacgattcttt

SEQ ID NO: 511473 - DNA, 25 bp, Mus musculus
gatgactgtttcgtgacgattcttt

SEQ ID NO: 511474 - DNA, 25 bp, Mus musculus
gatgacttacttacacaggtacctg

SEQ ID NO: 511475 - DNA, 25 bp, Mus musculus
gatgacttactttcacaggtacctg

SEQ ID NO: 511476 - DNA, 25 bp, Mus musculus
gatgacttagaccacttgctgtaca

SEQ ID NO: 511477 - DNA, 25 bp, Mus musculus
gatgacttagacgacttgctgtaca

SEQ ID NO: 511478 - DNA, 25 bp, Mus musculus
gatgacttaggtcgaactgtagata

SEQ ID NO: 511479 - DNA, 25 bp, Mus musculus
gatgacttaggtggaactgtagata

SEQ ID NO: 511480 - DNA, 25 bp, Mus musculus
gatgacttatatcctgcagttctct

SEQ ID NO: 511481 - DNA, 25 bp, Mus musculus
gatgacttatatgctgcagttctct

SEQ ID NO: 511482 - DNA, 25 bp, Mus musculus
gatgacttatcccacaatttctttc

SEQ ID NO: 511483 - DNA, 25 bp, Mus musculus
gatgacttatccgacaatttctttc

SEQ ID NO: 511484 - DNA, 25 bp, Mus musculus
gatgacttcactaagattcccaatg

SEQ ID NO: 511485 - DNA, 25 bp, Mus musculus
gatgacttcacttagattcccaatg

SEQ ID NO: 511486 - DNA, 25 bp, Mus musculus
gatgacttcagacgacaaatgtcag

SEQ ID NO: 511487 - DNA, 25 bp, Mus musculus
gatgacttcagaggacaaatgtcag

SEQ ID NO: 511488 - DNA, 25 bp, Mus musculus
gatgacttcagtagtaccacatttt

SEQ ID NO: 511489 - DNA, 25 bp, Mus musculus
gatgacttcagttgtaccacatttt

SEQ ID NO: 511490 - DNA, 25 bp, Mus musculus
gatgacttcatgatcgaactctcag

SEQ ID NO: 511491 - DNA, 25 bp, Mus musculus
gatgacttcatgttcgaactctcag

SEQ ID NO: 511492 - DNA, 25 bp, Mus musculus
gatgacttccatcaagaaacggaga

SEQ ID NO: 511493 - DNA, 25 bp, Mus musculus
gatgacttccatgaagaaacggaga

SEQ ID NO: 511494 - DNA, 25 bp, Mus musculus
gatgacttccgcactgacccaaggg

SEQ ID NO: 511495 - DNA, 25 bp, Mus musculus
gatgacttccgctctgacccaaggg

SEQ ID NO: 511496 - DNA, 25 bp, Mus musculus
gatgacttcctgacagacatcactg

SEQ ID NO: 511497 - DNA, 25 bp, Mus musculus
gatgacttcctgtcagacatcactg

SEQ ID NO: 511498 - DNA, 25 bp, Mus musculus
gatgacttcgataaaacaaatttat

SEQ ID NO: 511499 - DNA, 25 bp, Mus musculus
gatgacttcgattaaacaaatttat

SEQ ID NO: 511500 - DNA, 25 bp, Mus musculus
gatgacttcgctcaccttgaaaact

SEQ ID NO: 511501 - DNA, 25 bp, Mus musculus
gatgacttcgctgaccttgaaaact

SEQ ID NO: 511502 - DNA, 25 bp, Mus musculus
gatgacttctagatgcactccttac

SEQ ID NO: 511503 - DNA, 25 bp, Mus musculus
gatgacttctagttgcactccttac

SEQ ID NO: 511504 - DNA, 25 bp, Mus musculus
gatgacttctgaacgtcaggcccat

SEQ ID NO: 511505 - DNA, 25 bp, Mus musculus
gatgacttctgatcgtcaggcccat

SEQ ID NO: 511506 - DNA, 25 bp, Mus musculus
gatgacttctgcagtcctgaacact

SEQ ID NO: 511507 - DNA, 25 bp, Mus musculus
gatgacttctgctgtcctgaacact

SEQ ID NO: 511508 - DNA, 25 bp, Mus musculus
gatgacttctggacaagacctggct

SEQ ID NO: 511509 - DNA, 25 bp, Mus musculus
gatgacttctggtcaagacctggct

SEQ ID NO: 511510 - DNA, 25 bp, Mus musculus
gatgacttgagtcagacctgcagaa

SEQ ID NO: 511511 - DNA, 25 bp, Mus musculus
gatgacttgagtgagacctgcagaa

SEQ ID NO: 511512 - DNA, 25 bp, Mus musculus
gatgacttgcagctttgaagacact

SEQ ID NO: 511513 - DNA, 25 bp, Mus musculus
gatgacttgcaggtttgaagacact

SEQ ID NO: 511514 - DNA, 25 bp, Mus musculus
gatgacttggacaaataccaaatcc

SEQ ID NO: 511515 - DNA, 25 bp, Mus musculus
gatgacttggactaataccaaatcc

SEQ ID NO: 511516 - DNA, 25 bp, Mus musculus
gatgacttgtagacattgccttgtt

SEQ ID NO: 511517 - DNA, 25 bp, Mus musculus
gatgacttgtagtcattgccttgtt

SEQ ID NO: 511518 - DNA, 25 bp, Mus musculus
gatgactttatacctttatttccag

SEQ ID NO: 511519 - DNA, 25 bp, Mus musculus
gatgactttatagctttatttccag

SEQ ID NO: 511520 - DNA, 25 bp, Mus musculus
gatgactttattaatggacctttgg

SEQ ID NO: 511521 - DNA, 25 bp, Mus musculus
gatgactttatttatggacctttgg

SEQ ID NO: 511522 - DNA, 25 bp, Mus musculus
gatgactttcacctggaatccatag

SEQ ID NO: 511523 - DNA, 25 bp, Mus musculus
gatgactttcacgtggaatccatag

SEQ ID NO: 511524 - DNA, 25 bp, Mus musculus
gatgactttcgcatagtttcagaat

SEQ ID NO: 511525 - DNA, 25 bp, Mus musculus
gatgactttcgcttagtttcagaat

SEQ ID NO: 511526 - DNA, 25 bp, Mus musculus
gatgactttctaagtacattttcag

SEQ ID NO: 511527 - DNA, 25 bp, Mus musculus
gatgactttctatgtacattttcag

SEQ ID NO: 511528 - DNA, 25 bp, Mus musculus
gatgactttcttaactctgtacttg

SEQ ID NO: 511529 - DNA, 25 bp, Mus musculus
gatgactttctttactctgtacttg

SEQ ID NO: 511530 - DNA, 25 bp, Mus musculus
gatgactttgacaacttggccctga

SEQ ID NO: 511531 - DNA, 25 bp, Mus musculus
gatgactttgactacttggccctga

SEQ ID NO: 511532 - DNA, 25 bp, Mus musculus
gatgactttgctataaccacacacg

SEQ ID NO: 511533 - DNA, 25 bp, Mus musculus
gatgactttgctttaaccacacacg

SEQ ID NO: 511534 - DNA, 25 bp, Mus musculus
gatgactttgtaatgttacctatat

SEQ ID NO: 511535 - DNA, 25 bp, Mus musculus
gatgactttgtattgttacctatat

SEQ ID NO: 511536 - DNA, 25 bp, Mus musculus
gatgactttgtcaatatggtgttgg

SEQ ID NO: 511537 - DNA, 25 bp, Mus musculus
gatgactttgtcaggtactgcttct

SEQ ID NO: 511538 - DNA, 25 bp, Mus musculus
gatgactttgtctatatggtgttgg

SEQ ID NO: 511539 - DNA, 25 bp, Mus musculus
gatgactttgtctggtactgcttct

SEQ ID NO: 511540 - DNA, 25 bp, Mus musculus
gatgactttgtgaccagctgagaag

SEQ ID NO: 511541 - DNA, 25 bp, Mus musculus
gatgactttgtgtccagctgagaag

SEQ ID NO: 511542 - DNA, 25 bp, Mus musculus
gatgacttttaaccaccccagttaa

SEQ ID NO: 511543 - DNA, 25 bp, Mus musculus
gatgacttttaagcaccccagttaa

SEQ ID NO: 511544 - DNA, 25 bp, Mus musculus
gatgacttttaccacagtgcttaag

SEQ ID NO: 511545 - DNA, 25 bp, Mus musculus
gatgacttttacgacagtgcttaag

SEQ ID NO: 511546 - DNA, 25 bp, Mus musculus
gatgagaaaacaaccatttatcctt

SEQ ID NO: 511547 - DNA, 25 bp, Mus musculus
gatgagaaaacatccatttatcctt

SEQ ID NO: 511548 - DNA, 25 bp, Mus musculus
gatgagaaaagaagccccgcagcac

SEQ ID NO: 511549 - DNA, 25 bp, Mus musculus
gatgagaaaagatgccccgcagcac

SEQ ID NO: 511550 - DNA, 25 bp, Mus musculus
gatgagaaacttcaaggcaagatca

SEQ ID NO: 511551 - DNA, 25 bp, Mus musculus
gatgagaaacttgaaggcaagatca

SEQ ID NO: 511552 - DNA, 25 bp, Mus musculus
gatgagaaatccatccagtaccagg

SEQ ID NO: 511553 - DNA, 25 bp, Mus musculus
gatgagaaatccttccagtaccagg

SEQ ID NO: 511554 - DNA, 25 bp, Mus musculus
gatgagaaatgcactagggtcccgt

SEQ ID NO: 511555 - DNA, 25 bp, Mus musculus
gatgagaaatgctctagggtcccgt

SEQ ID NO: 511556 - DNA, 25 bp, Mus musculus
gatgagaaatgtctcccacggtctc

SEQ ID NO: 511557 - DNA, 25 bp, Mus musculus
gatgagaaatgtgtcccacggtctc

SEQ ID NO: 511558 - DNA, 25 bp, Mus musculus
gatgagaacaaccagttccctttcc

SEQ ID NO: 511559 - DNA, 25 bp, Mus musculus
gatgagaacaacgagttccctttcc

SEQ ID NO: 511560 - DNA, 25 bp, Mus musculus
gatgagaacccacatagcctaatag

SEQ ID NO: 511561 - DNA, 25 bp, Mus musculus
gatgagaacccagatagcctaatag

SEQ ID NO: 511562 - DNA, 25 bp, Mus musculus
gatgagaactccattagctggctag

SEQ ID NO: 511563 - DNA, 25 bp, Mus musculus
gatgagaactcctttagctggctag

SEQ ID NO: 511564 - DNA, 25 bp, Mus musculus
gatgagaactctctactttaagctg

SEQ ID NO: 511565 - DNA, 25 bp, Mus musculus
gatgagaactctgtactttaagctg

SEQ ID NO: 511566 - DNA, 25 bp, Mus musculus
gatgagaacttcaaggcctgcttta

SEQ ID NO: 511567 - DNA, 25 bp, Mus musculus
gatgagaacttctaggcctgcttta

SEQ ID NO: 511568 - DNA, 25 bp, Mus musculus
gatgagaagaatatgctgcattgca

SEQ ID NO: 511569 - DNA, 25 bp, Mus musculus
gatgagaagaatttgctgcattgca

SEQ ID NO: 511570 - DNA, 25 bp, Mus musculus
gatgagaagcccaggttcaagagca

SEQ ID NO: 511571 - DNA, 25 bp, Mus musculus
gatgagaagcccctggaagccatta

SEQ ID NO: 511572 - DNA, 25 bp, Mus musculus
gatgagaagcccgtggaagccatta

SEQ ID NO: 511573 - DNA, 25 bp, Mus musculus
gatgagaagccctggttcaagagca

SEQ ID NO: 511574 - DNA, 25 bp, Mus musculus
gatgagaaggctatggtttccttct

SEQ ID NO: 511575 - DNA, 25 bp, Mus musculus
gatgagaaggctttggtttccttct

SEQ ID NO: 511576 - DNA, 25 bp, Mus musculus
gatgagaagtctctcccattttttc

SEQ ID NO: 511577 - DNA, 25 bp, Mus musculus
gatgagaagtctgtcccattttttc

SEQ ID NO: 511578 - DNA, 25 bp, Mus musculus
gatgagaatgaaacttggtacttag

SEQ ID NO: 511579 - DNA, 25 bp, Mus musculus
gatgagaatgaatcttggtacttag

SEQ ID NO: 511580 - DNA, 25 bp, Mus musculus
gatgagacacaacacatttggcgga

SEQ ID NO: 511581 - DNA, 25 bp, Mus musculus
gatgagacacaagacatttggcgga

SEQ ID NO: 511582 - DNA, 25 bp, Mus musculus
gatgagacacctctggtgaccggaa

SEQ ID NO: 511583 - DNA, 25 bp, Mus musculus
gatgagacacctgtggtgaccggaa

SEQ ID NO: 511584 - DNA, 25 bp, Mus musculus
gatgagacagatatccgtggacagc

SEQ ID NO: 511585 - DNA, 25 bp, Mus musculus
gatgagacagatttccgtggacagc

SEQ ID NO: 511586 - DNA, 25 bp, Mus musculus
gatgagacaggcagattccatgaca

SEQ ID NO: 511587 - DNA, 25 bp, Mus musculus
gatgagacaggctgattccatgaca

SEQ ID NO: 511588 - DNA, 25 bp, Mus musculus
gatgagacatccctgaatacaaaca

SEQ ID NO: 511589 - DNA, 25 bp, Mus musculus
gatgagacatccgtgaatacaaaca

SEQ ID NO: 511590 - DNA, 25 bp, Mus musculus
gatgagacatttatcgagacacaga

SEQ ID NO: 511591 - DNA, 25 bp, Mus musculus
gatgagacatttttcgagacacaga

SEQ ID NO: 511592 - DNA, 25 bp, Mus musculus
gatgagaccaatacaacctctaaga

SEQ ID NO: 511593 - DNA, 25 bp, Mus musculus
gatgagaccaattcaacctctaaga

SEQ ID NO: 511594 - DNA, 25 bp, Mus musculus
gatgagaccctccagtgaatgcacg

SEQ ID NO: 511595 - DNA, 25 bp, Mus musculus
gatgagaccctcgagtgaatgcacg

SEQ ID NO: 511596 - DNA, 25 bp, Mus musculus
gatgagaccgacaaccgccaggagg

SEQ ID NO: 511597 - DNA, 25 bp, Mus musculus
gatgagaccgactaccgccaggagg

SEQ ID NO: 511598 - DNA, 25 bp, Mus musculus
gatgagaccgggctaaggcacgtat

SEQ ID NO: 511599 - DNA, 25 bp, Mus musculus
gatgagaccggggtaaggcacgtat

SEQ ID NO: 511600 - DNA, 25 bp, Mus musculus
gatgagacctccactgaagcagcca

SEQ ID NO: 511601 - DNA, 25 bp, Mus musculus
gatgagacctcctctgaagcagcca

SEQ ID NO: 511602 - DNA, 25 bp, Mus musculus
gatgagacctgcctggactcgtttg

SEQ ID NO: 511603 - DNA, 25 bp, Mus musculus
gatgagacctgcgtggactcgtttg

SEQ ID NO: 511604 - DNA, 25 bp, Mus musculus
gatgagactatccagcaggtatatg

SEQ ID NO: 511605 - DNA, 25 bp, Mus musculus
gatgagactatcgagcaggtatatg

SEQ ID NO: 511606 - DNA, 25 bp, Mus musculus
gatgagactcaaaactggccttttt

SEQ ID NO: 511607 - DNA, 25 bp, Mus musculus
gatgagactcaatactggccttttt

SEQ ID NO: 511608 - DNA, 25 bp, Mus musculus
gatgagactccaataccttactttg

SEQ ID NO: 511609 - DNA, 25 bp, Mus musculus
gatgagactccattaccttactttg

SEQ ID NO: 511610 - DNA, 25 bp, Mus musculus
gatgagactgataatttaactgaag

SEQ ID NO: 511611 - DNA, 25 bp, Mus musculus
gatgagactgattatttaactgaag

SEQ ID NO: 511612 - DNA, 25 bp, Mus musculus
gatgagactgtcatccttagcagga

SEQ ID NO: 511613 - DNA, 25 bp, Mus musculus
gatgagactgtcttccttagcagga

SEQ ID NO: 511614 - DNA, 25 bp, Mus musculus
gatgagacttctatgggtcaccctg

SEQ ID NO: 511615 - DNA, 25 bp, Mus musculus
gatgagacttctttgggtcaccctg

SEQ ID NO: 511616 - DNA, 25 bp, Mus musculus
gatgagacttggattgtgtcaagtt

SEQ ID NO: 511617 - DNA, 25 bp, Mus musculus
gatgagacttggtttgtgtcaagtt

SEQ ID NO: 511618 - DNA, 25 bp, Mus musculus
gatgagagaccacgaagcaccacct

SEQ ID NO: 511619 - DNA, 25 bp, Mus musculus
gatgagagaccaggaagcaccacct

SEQ ID NO: 511620 - DNA, 25 bp, Mus musculus
gatgagagagtgctggtaccccaac

SEQ ID NO: 511621 - DNA, 25 bp, Mus musculus
gatgagagagtggtggtaccccaac

SEQ ID NO: 511622 - DNA, 25 bp, Mus musculus
gatgagagcaggattgcaccgccag

SEQ ID NO: 511623 - DNA, 25 bp, Mus musculus
gatgagagcaggtttgcaccgccag

SEQ ID NO: 511624 - DNA, 25 bp, Mus musculus
gatgagagccaaccagctccttgtt

SEQ ID NO: 511625 - DNA, 25 bp, Mus musculus
gatgagagccaagcagctccttgtt

SEQ ID NO: 511626 - DNA, 25 bp, Mus musculus
gatgagagctgcacagcccaggaat

SEQ ID NO: 511627 - DNA, 25 bp, Mus musculus
gatgagagctgctcagcccaggaat

SEQ ID NO: 511628 - DNA, 25 bp, Mus musculus
gatgagagtgtacctcgctgtattt

SEQ ID NO: 511629 - DNA, 25 bp, Mus musculus
gatgagagtgtagctcgctgtattt

SEQ ID NO: 511630 - DNA, 25 bp, Mus musculus
gatgagagttgtattctgctttaat

SEQ ID NO: 511631 - DNA, 25 bp, Mus musculus
gatgagagttgttttctgctttaat

SEQ ID NO: 511632 - DNA, 25 bp, Mus musculus
gatgagatacagaagctccaaatat

SEQ ID NO: 511633 - DNA, 25 bp, Mus musculus
gatgagatacagtagctccaaatat

SEQ ID NO: 511634 - DNA, 25 bp, Mus musculus
gatgagatacctagtgggcagaact

SEQ ID NO: 511635 - DNA, 25 bp, Mus musculus
gatgagataccttgtgggcagaact

SEQ ID NO: 511636 - DNA, 25 bp, Mus musculus
gatgagatactcattctttcctgtc

SEQ ID NO: 511637 - DNA, 25 bp, Mus musculus
gatgagatactctttctttcctgtc

SEQ ID NO: 511638 - DNA, 25 bp, Mus musculus
gatgagatcactcccagctttcgca

SEQ ID NO: 511639 - DNA, 25 bp, Mus musculus
gatgagatcactgccagctttcgca

SEQ ID NO: 511640 - DNA, 25 bp, Mus musculus
gatgagatccgacaacagcagcaga

SEQ ID NO: 511641 - DNA, 25 bp, Mus musculus
gatgagatccgagaacagcagcaga

SEQ ID NO: 511642 - DNA, 25 bp, Mus musculus
gatgagatcttgctaatcccgactt

SEQ ID NO: 511643 - DNA, 25 bp, Mus musculus
gatgagatcttggtaatcccgactt

SEQ ID NO: 511644 - DNA, 25 bp, Mus musculus
gatgagatgctaacagtgcaaagct

SEQ ID NO: 511645 - DNA, 25 bp, Mus musculus
gatgagatgctatcagtgcaaagct

SEQ ID NO: 511646 - DNA, 25 bp, Mus musculus
gatgagatggttacctcctttgtac

SEQ ID NO: 511647 - DNA, 25 bp, Mus musculus
gatgagatggtttcctcctttgtac

SEQ ID NO: 511648 - DNA, 25 bp, Mus musculus
gatgagattaccacagtccggaaga

SEQ ID NO: 511649 - DNA, 25 bp, Mus musculus
gatgagattacccagacgagccaaa

SEQ ID NO: 511650 - DNA, 25 bp, Mus musculus
gatgagattaccgagacgagccaaa

SEQ ID NO: 511651 - DNA, 25 bp, Mus musculus
gatgagattacctcagtccggaaga

SEQ ID NO: 511652 - DNA, 25 bp, Mus musculus
gatgagattagacatttgccaactg

SEQ ID NO: 511653 - DNA, 25 bp, Mus musculus
gatgagattagagatttgccaactg

SEQ ID NO: 511654 - DNA, 25 bp, Mus musculus
gatgagattatccacatgaaaacgg

SEQ ID NO: 511655 - DNA, 25 bp, Mus musculus
gatgagattatcgacatgaaaacgg

SEQ ID NO: 511656 - DNA, 25 bp, Mus musculus
gatgagattcacactatttgtatca

SEQ ID NO: 511657 - DNA, 25 bp, Mus musculus
gatgagattcactctatttgtatca

SEQ ID NO: 511658 - DNA, 25 bp, Mus musculus
gatgagattccaacatttgcatctt

SEQ ID NO: 511659 - DNA, 25 bp, Mus musculus
gatgagattccatcatttgcatctt

SEQ ID NO: 511660 - DNA, 25 bp, Mus musculus
gatgagattctccaacttttaagga

SEQ ID NO: 511661 - DNA, 25 bp, Mus musculus
gatgagattctcgaacttttaagga

SEQ ID NO: 511662 - DNA, 25 bp, Mus musculus
gatgagattctgcagcatgtaacag

SEQ ID NO: 511663 - DNA, 25 bp, Mus musculus
gatgagattctggagcatgtaacag

SEQ ID NO: 511664 - DNA, 25 bp, Mus musculus
gatgagattgacaacttcttctgtg

SEQ ID NO: 511665 - DNA, 25 bp, Mus musculus
gatgagattgactacttcttctgtg

SEQ ID NO: 511666 - DNA, 25 bp, Mus musculus
gatgagattgatccagctctggatt

SEQ ID NO: 511667 - DNA, 25 bp, Mus musculus
gatgagattgatgcagctctggatt

SEQ ID NO: 511668 - DNA, 25 bp, Mus musculus
gatgagcaacccagagacaaatacc

SEQ ID NO: 511669 - DNA, 25 bp, Mus musculus
gatgagcaaccctgagacaaatacc

SEQ ID NO: 511670 - DNA, 25 bp, Mus musculus
gatgagcaaggaatttctgccctcc

SEQ ID NO: 511671 - DNA, 25 bp, Mus musculus
gatgagcaaggattttctgccctcc

SEQ ID NO: 511672 - DNA, 25 bp, Mus musculus
gatgagcaatcacacttatgtttta

SEQ ID NO: 511673 - DNA, 25 bp, Mus musculus
gatgagcaatcagacttatgtttta

SEQ ID NO: 511674 - DNA, 25 bp, Mus musculus
gatgagcacaatcccaggactgccc

SEQ ID NO: 511675 - DNA, 25 bp, Mus musculus
gatgagcacaatgccaggactgccc

SEQ ID NO: 511676 - DNA, 25 bp, Mus musculus
gatgagcaccaacacatggtccatt

SEQ ID NO: 511677 - DNA, 25 bp, Mus musculus
gatgagcaccaagacatggtccatt

SEQ ID NO: 511678 - DNA, 25 bp, Mus musculus
gatgagcaccctagagaaatccaaa

SEQ ID NO: 511679 - DNA, 25 bp, Mus musculus
gatgagcacccttgagaaatccaaa

SEQ ID NO: 511680 - DNA, 25 bp, Mus musculus
gatgagcaccgcattggtagcaatt

SEQ ID NO: 511681 - DNA, 25 bp, Mus musculus
gatgagcaccgctttggtagcaatt

SEQ ID NO: 511682 - DNA, 25 bp, Mus musculus
gatgagcacctcatgcatggtacac

SEQ ID NO: 511683 - DNA, 25 bp, Mus musculus
gatgagcacctcttgcatggtacac

SEQ ID NO: 511684 - DNA, 25 bp, Mus musculus
gatgagcacgctcggagacctttcc

SEQ ID NO: 511685 - DNA, 25 bp, Mus musculus
gatgagcacgctgggagacctttcc

SEQ ID NO: 511686 - DNA, 25 bp, Mus musculus
gatgagcactacaagcagcagatga

SEQ ID NO: 511687 - DNA, 25 bp, Mus musculus
gatgagcactactagcagcagatga

SEQ ID NO: 511688 - DNA, 25 bp, Mus musculus
gatgagcagagcaatgactcctatg

SEQ ID NO: 511689 - DNA, 25 bp, Mus musculus
gatgagcagagctatgactcctatg

SEQ ID NO: 511690 - DNA, 25 bp, Mus musculus
gatgagcagcagagagtaccccgaa

SEQ ID NO: 511691 - DNA, 25 bp, Mus musculus
gatgagcagcagagcctccaaaagt

SEQ ID NO: 511692 - DNA, 25 bp, Mus musculus
gatgagcagcagtgagtaccccgaa

SEQ ID NO: 511693 - DNA, 25 bp, Mus musculus
gatgagcagcagtgcctccaaaagt

SEQ ID NO: 511694 - DNA, 25 bp, Mus musculus
gatgagcagcatcacccagaaccta

SEQ ID NO: 511695 - DNA, 25 bp, Mus musculus
gatgagcagcatgacccagaaccta

SEQ ID NO: 511696 - DNA, 25 bp, Mus musculus
gatgagcagctaactctcacacaca

SEQ ID NO: 511697 - DNA, 25 bp, Mus musculus
gatgagcagctatctctcacacaca

SEQ ID NO: 511698 - DNA, 25 bp, Mus musculus
gatgagcagtgcattcgccaattag

SEQ ID NO: 511699 - DNA, 25 bp, Mus musculus
gatgagcagtgctttcgccaattag

SEQ ID NO: 511700 - DNA, 25 bp, Mus musculus
gatgagcatctgctgacagcttcaa

SEQ ID NO: 511701 - DNA, 25 bp, Mus musculus
gatgagcatctggtgacagcttcaa

SEQ ID NO: 511702 - DNA, 25 bp, Mus musculus
gatgagcatcttcgccatgatcaac

SEQ ID NO: 511703 - DNA, 25 bp, Mus musculus
gatgagcatcttggccatgatcaac

SEQ ID NO: 511704 - DNA, 25 bp, Mus musculus
gatgagcatgacctcagtgacctcc

SEQ ID NO: 511705 - DNA, 25 bp, Mus musculus
gatgagcatgacgtcagtgacctcc

SEQ ID NO: 511706 - DNA, 25 bp, Mus musculus
gatgagcatgcccacagtgtaagga

SEQ ID NO: 511707 - DNA, 25 bp, Mus musculus
gatgagcatgccgacagtgtaagga

SEQ ID NO: 511708 - DNA, 25 bp, Mus musculus
gatgagcattagatggtccacccca

SEQ ID NO: 511709 - DNA, 25 bp, Mus musculus
gatgagcattagttggtccacccca

SEQ ID NO: 511710 - DNA, 25 bp, Mus musculus
gatgagccaatgacaccaaaggact

SEQ ID NO: 511711 - DNA, 25 bp, Mus musculus
gatgagccaatgtcaccaaaggact

SEQ ID NO: 511712 - DNA, 25 bp, Mus musculus
gatgagccaggtcctttcatgtgct

SEQ ID NO: 511713 - DNA, 25 bp, Mus musculus
gatgagccaggtgctttcatgtgct

SEQ ID NO: 511714 - DNA, 25 bp, Mus musculus
gatgagccagtgaagttcctccact

SEQ ID NO: 511715 - DNA, 25 bp, Mus musculus
gatgagccagtgtagttcctccact

SEQ ID NO: 511716 - DNA, 25 bp, Mus musculus
gatgagccatggacagttttctaca

SEQ ID NO: 511717 - DNA, 25 bp, Mus musculus
gatgagccatggtcagttttctaca

SEQ ID NO: 511718 - DNA, 25 bp, Mus musculus
gatgagccccagaaagggtactttc

SEQ ID NO: 511719 - DNA, 25 bp, Mus musculus
gatgagccccagtaagggtactttc

SEQ ID NO: 511720 - DNA, 25 bp, Mus musculus
gatgagcccctgaagacgaggtgaa

SEQ ID NO: 511721 - DNA, 25 bp, Mus musculus
gatgagcccctgatgggagtcacac

SEQ ID NO: 511722 - DNA, 25 bp, Mus musculus
gatgagcccctgtagacgaggtgaa

SEQ ID NO: 511723 - DNA, 25 bp, Mus musculus
gatgagcccctgttgggagtcacac

SEQ ID NO: 511724 - DNA, 25 bp, Mus musculus
gatgagccctcaagcgtattgatat

SEQ ID NO: 511725 - DNA, 25 bp, Mus musculus
gatgagccctcatgcgtattgatat

SEQ ID NO: 511726 - DNA, 25 bp, Mus musculus
gatgagccctgtcaagttgcttcag

SEQ ID NO: 511727 - DNA, 25 bp, Mus musculus
gatgagccctgtgaagttgcttcag

SEQ ID NO: 511728 - DNA, 25 bp, Mus musculus
gatgagccgaatcaccatgaccaaa

SEQ ID NO: 511729 - DNA, 25 bp, Mus musculus
gatgagccgaatgaccatgaccaaa

SEQ ID NO: 511730 - DNA, 25 bp, Mus musculus
gatgagccggcaaagtgactgtgac

SEQ ID NO: 511731 - DNA, 25 bp, Mus musculus
gatgagccggcatagtgactgtgac

SEQ ID NO: 511732 - DNA, 25 bp, Mus musculus
gatgagcctagactttgccactgga

SEQ ID NO: 511733 - DNA, 25 bp, Mus musculus
gatgagcctagagtttgccactgga

SEQ ID NO: 511734 - DNA, 25 bp, Mus musculus
gatgagcctgttaagctggtcacat

SEQ ID NO: 511735 - DNA, 25 bp, Mus musculus
gatgagcctgtttagctggtcacat

SEQ ID NO: 511736 - DNA, 25 bp, Mus musculus
gatgagccttaactagactttacag

SEQ ID NO: 511737 - DNA, 25 bp, Mus musculus
gatgagccttaagtagactttacag

SEQ ID NO: 511738 - DNA, 25 bp, Mus musculus
gatgagccttcacaagcacttgcct

SEQ ID NO: 511739 - DNA, 25 bp, Mus musculus
gatgagccttcagaagcacttgcct

SEQ ID NO: 511740 - DNA, 25 bp, Mus musculus
gatgagcctttgatggaccctgaag

SEQ ID NO: 511741 - DNA, 25 bp, Mus musculus
gatgagcctttgttggaccctgaag

SEQ ID NO: 511742 - DNA, 25 bp, Mus musculus
gatgagcgagaaacaatagaggaga

SEQ ID NO: 511743 - DNA, 25 bp, Mus musculus
gatgagcgagaatcaatagaggaga

SEQ ID NO: 511744 - DNA, 25 bp, Mus musculus
gatgagcgcctcacttggattacag

SEQ ID NO: 511745 - DNA, 25 bp, Mus musculus
gatgagcgcctctcttggattacag

SEQ ID NO: 511746 - DNA, 25 bp, Mus musculus
gatgagcggcgtactctatagtttt

SEQ ID NO: 511747 - DNA, 25 bp, Mus musculus
gatgagcggcgttctctatagtttt

SEQ ID NO: 511748 - DNA, 25 bp, Mus musculus
gatgagcgtactcctggttgtatta

SEQ ID NO: 511749 - DNA, 25 bp, Mus musculus
gatgagcgtactgctggttgtatta

SEQ ID NO: 511750 - DNA, 25 bp, Mus musculus
gatgagcgtagcaacggcaacagaa

SEQ ID NO: 511751 - DNA, 25 bp, Mus musculus
gatgagcgtagctacggcaacagaa

SEQ ID NO: 511752 - DNA, 25 bp, Mus musculus
gatgagctacatctacacctggagg

SEQ ID NO: 511753 - DNA, 25 bp, Mus musculus
gatgagctacatgtacacctggagg

SEQ ID NO: 511754 - DNA, 25 bp, Mus musculus
gatgagctacgccagtgctgtcagc

SEQ ID NO: 511755 - DNA, 25 bp, Mus musculus
gatgagctacgcgagtgctgtcagc

SEQ ID NO: 511756 - DNA, 25 bp, Mus musculus
gatgagctactactggtcagcctgt

SEQ ID NO: 511757 - DNA, 25 bp, Mus musculus
gatgagctactagtggtcagcctgt

SEQ ID NO: 511758 - DNA, 25 bp, Mus musculus
gatgagctagtgaccacataactat

SEQ ID NO: 511759 - DNA, 25 bp, Mus musculus
gatgagctagtgtccacataactat

SEQ ID NO: 511760 - DNA, 25 bp, Mus musculus
gatgagctatccagagagttcttta

SEQ ID NO: 511761 - DNA, 25 bp, Mus musculus
gatgagctatcctgagagttcttta

SEQ ID NO: 511762 - DNA, 25 bp, Mus musculus
gatgagctatctattggcacagtac

SEQ ID NO: 511763 - DNA, 25 bp, Mus musculus
gatgagctatcttttggcacagtac

SEQ ID NO: 511764 - DNA, 25 bp, Mus musculus
gatgagctcagcatcaaggccggag

SEQ ID NO: 511765 - DNA, 25 bp, Mus musculus
gatgagctcagcttcaaggccggag

SEQ ID NO: 511766 - DNA, 25 bp, Mus musculus
gatgagctcatcagggagacccaaa

SEQ ID NO: 511767 - DNA, 25 bp, Mus musculus
gatgagctcatctgggagacccaaa

SEQ ID NO: 511768 - DNA, 25 bp, Mus musculus
gatgagctgaccaccatgtaagcag

SEQ ID NO: 511769 - DNA, 25 bp, Mus musculus
gatgagctgacctccatgtaagcag

SEQ ID NO: 511770 - DNA, 25 bp, Mus musculus
gatgagctgactccggatttcctgt

SEQ ID NO: 511771 - DNA, 25 bp, Mus musculus
gatgagctgactgcggatttcctgt

SEQ ID NO: 511772 - DNA, 25 bp, Mus musculus
gatgagctgatgcatactcaagcca

SEQ ID NO: 511773 - DNA, 25 bp, Mus musculus
gatgagctgatgcatcattcacata

SEQ ID NO: 511774 - DNA, 25 bp, Mus musculus
gatgagctgatggatactcaagcca

SEQ ID NO: 511775 - DNA, 25 bp, Mus musculus
gatgagctgatggatcattcacata

SEQ ID NO: 511776 - DNA, 25 bp, Mus musculus
gatgagctgcaaactgtcttggatt

SEQ ID NO: 511777 - DNA, 25 bp, Mus musculus
gatgagctgcaatctgtcttggatt

SEQ ID NO: 511778 - DNA, 25 bp, Mus musculus
gatgagctgcatctgggtctgccca

SEQ ID NO: 511779 - DNA, 25 bp, Mus musculus
gatgagctgcatgtgggtctgccca

SEQ ID NO: 511780 - DNA, 25 bp, Mus musculus
gatgagctgctaaatgcatgcatat

SEQ ID NO: 511781 - DNA, 25 bp, Mus musculus
gatgagctgctatatgcatgcatat

SEQ ID NO: 511782 - DNA, 25 bp, Mus musculus
gatgagctgctgaatgatcctgaga

SEQ ID NO: 511783 - DNA, 25 bp, Mus musculus
gatgagctgctgtatgatcctgaga

SEQ ID NO: 511784 - DNA, 25 bp, Mus musculus
gatgagctggatacacacactatgg

SEQ ID NO: 511785 - DNA, 25 bp, Mus musculus
gatgagctggattcacacactatgg

SEQ ID NO: 511786 - DNA, 25 bp, Mus musculus
gatgagctgggcaactttgtgctca

SEQ ID NO: 511787 - DNA, 25 bp, Mus musculus
gatgagctgggcattttgtctcttg

SEQ ID NO: 511788 - DNA, 25 bp, Mus musculus
gatgagctgggctactttgtgctca

SEQ ID NO: 511789 - DNA, 25 bp, Mus musculus
gatgagctgggctttttgtctcttg

SEQ ID NO: 511790 - DNA, 25 bp, Mus musculus
gatgagctgtaccaatgccaacctg

SEQ ID NO: 511791 - DNA, 25 bp, Mus musculus
gatgagctgtacgaatgccaacctg

SEQ ID NO: 511792 - DNA, 25 bp, Mus musculus
gatgagctgtataacctgcagatgt

SEQ ID NO: 511793 - DNA, 25 bp, Mus musculus
gatgagctgtattacctgcagatgt

SEQ ID NO: 511794 - DNA, 25 bp, Mus musculus
gatgagctgtgaaccagaccactac

SEQ ID NO: 511795 - DNA, 25 bp, Mus musculus
gatgagctgtgatccagaccactac

SEQ ID NO: 511796 - DNA, 25 bp, Mus musculus
gatgagctttctaccaaatgacagg

SEQ ID NO: 511797 - DNA, 25 bp, Mus musculus
gatgagctttcttccaaatgacagg

SEQ ID NO: 511798 - DNA, 25 bp, Mus musculus
gatgagcttttcaaccagtttagaa

SEQ ID NO: 511799 - DNA, 25 bp, Mus musculus
gatgagcttttctaccagtttagaa

SEQ ID NO: 511800 - DNA, 25 bp, Mus musculus
gatgagctttttactaggcagacag

SEQ ID NO: 511801 - DNA, 25 bp, Mus musculus
gatgagcttttttctaggcagacag

SEQ ID NO: 511802 - DNA, 25 bp, Mus musculus
gatgaggaaactacttagggcttat

SEQ ID NO: 511803 - DNA, 25 bp, Mus musculus
gatgaggaaactattacccatctaa

SEQ ID NO: 511804 - DNA, 25 bp, Mus musculus
gatgaggaaacttcttagggcttat

SEQ ID NO: 511805 - DNA, 25 bp, Mus musculus
gatgaggaaacttttacccatctaa

SEQ ID NO: 511806 - DNA, 25 bp, Mus musculus
gatgaggaaatgaacgccttcaagc

SEQ ID NO: 511807 - DNA, 25 bp, Mus musculus
gatgaggaaatgtacgccttcaagc

SEQ ID NO: 511808 - DNA, 25 bp, Mus musculus
gatgaggaatgaccccaagcattaa

SEQ ID NO: 511809 - DNA, 25 bp, Mus musculus
gatgaggaatgagcccaagcattaa

SEQ ID NO: 511810 - DNA, 25 bp, Mus musculus
gatgaggacaagcttccagttttgc

SEQ ID NO: 511811 - DNA, 25 bp, Mus musculus
gatgaggacaaggttccagttttgc

SEQ ID NO: 511812 - DNA, 25 bp, Mus musculus
gatgaggacagcagctccgagcaca

SEQ ID NO: 511813 - DNA, 25 bp, Mus musculus
gatgaggacagctgctccgagcaca

SEQ ID NO: 511814 - DNA, 25 bp, Mus musculus
gatgaggacatactaacactctacc

SEQ ID NO: 511815 - DNA, 25 bp, Mus musculus
gatgaggacatagtaacactctacc

SEQ ID NO: 511816 - DNA, 25 bp, Mus musculus
gatgaggacattctcgaccgggacc

SEQ ID NO: 511817 - DNA, 25 bp, Mus musculus
gatgaggacattgtcgaccgggacc

SEQ ID NO: 511818 - DNA, 25 bp, Mus musculus
gatgaggacctgagccagacgctca

SEQ ID NO: 511819 - DNA, 25 bp, Mus musculus
gatgaggacctgtgccagacgctca

SEQ ID NO: 511820 - DNA, 25 bp, Mus musculus
gatgaggagctactgcacctgctgc

SEQ ID NO: 511821 - DNA, 25 bp, Mus musculus
gatgaggagctagtgcacctgctgc

SEQ ID NO: 511822 - DNA, 25 bp, Mus musculus
gatgaggaggatccaccctctacag

SEQ ID NO: 511823 - DNA, 25 bp, Mus musculus
gatgaggaggatgcaccctctacag

SEQ ID NO: 511824 - DNA, 25 bp, Mus musculus
gatgaggagtctccttccactagca

SEQ ID NO: 511825 - DNA, 25 bp, Mus musculus
gatgaggagtctgcttccactagca

SEQ ID NO: 511826 - DNA, 25 bp, Mus musculus
gatgaggatccaaaaaccgctgaaa

SEQ ID NO: 511827 - DNA, 25 bp, Mus musculus
gatgaggatccataaaccgctgaaa

SEQ ID NO: 511828 - DNA, 25 bp, Mus musculus
gatgaggatctgatcctgcagctta

SEQ ID NO: 511829 - DNA, 25 bp, Mus musculus
gatgaggatctgttcctgcagctta

SEQ ID NO: 511830 - DNA, 25 bp, Mus musculus
gatgaggatgctccagtcactgaaa

SEQ ID NO: 511831 - DNA, 25 bp, Mus musculus
gatgaggatgctgcagtcactgaaa

SEQ ID NO: 511832 - DNA, 25 bp, Mus musculus
gatgaggatttaaggctctgcagag

SEQ ID NO: 511833 - DNA, 25 bp, Mus musculus
gatgaggatttatggctctgcagag

SEQ ID NO: 511834 - DNA, 25 bp, Mus musculus
gatgaggcaaagcatcatgcctaga

SEQ ID NO: 511835 - DNA, 25 bp, Mus musculus
gatgaggcaaaggatcatgcctaga

SEQ ID NO: 511836 - DNA, 25 bp, Mus musculus
gatgaggcacacattccaacttcaa

SEQ ID NO: 511837 - DNA, 25 bp, Mus musculus
gatgaggcacactttccaacttcaa

SEQ ID NO: 511838 - DNA, 25 bp, Mus musculus
gatgaggcagatctttgtccagaga

SEQ ID NO: 511839 - DNA, 25 bp, Mus musculus
gatgaggcagatgtttgtccagaga

SEQ ID NO: 511840 - DNA, 25 bp, Mus musculus
gatgaggccatcacccagactatgg

SEQ ID NO: 511841 - DNA, 25 bp, Mus musculus
gatgaggccatctcccagactatgg

SEQ ID NO: 511842 - DNA, 25 bp, Mus musculus
gatgaggcccctcgtagtgattcat

SEQ ID NO: 511843 - DNA, 25 bp, Mus musculus
gatgaggcccctggtagtgattcat

SEQ ID NO: 511844 - DNA, 25 bp, Mus musculus
gatgaggccgggagtcttcactgac

SEQ ID NO: 511845 - DNA, 25 bp, Mus musculus
gatgaggccgggtgtcttcactgac

SEQ ID NO: 511846 - DNA, 25 bp, Mus musculus
gatgaggcctttatggagttggtaa

SEQ ID NO: 511847 - DNA, 25 bp, Mus musculus
gatgaggcctttttggagttggtaa

SEQ ID NO: 511848 - DNA, 25 bp, Mus musculus
gatgaggcggtcattgtctggaaca

SEQ ID NO: 511849 - DNA, 25 bp, Mus musculus
gatgaggcggtctttgtctggaaca

SEQ ID NO: 511850 - DNA, 25 bp, Mus musculus
gatgaggctaccagcgccctggacg

SEQ ID NO: 511851 - DNA, 25 bp, Mus musculus
gatgaggctacctgcgccctggacg

SEQ ID NO: 511852 - DNA, 25 bp, Mus musculus
gatgaggctagacttgaggaccaca

SEQ ID NO: 511853 - DNA, 25 bp, Mus musculus
gatgaggctagagttgaggaccaca

SEQ ID NO: 511854 - DNA, 25 bp, Mus musculus
gatgaggctcctaagggagtctcta

SEQ ID NO: 511855 - DNA, 25 bp, Mus musculus
gatgaggctccttagggagtctcta

SEQ ID NO: 511856 - DNA, 25 bp, Mus musculus
gatgaggctgtgactggtccctgga

SEQ ID NO: 511857 - DNA, 25 bp, Mus musculus
gatgaggctgtgtctggtccctgga

SEQ ID NO: 511858 - DNA, 25 bp, Mus musculus
gatgaggctttcataccaacatgtg

SEQ ID NO: 511859 - DNA, 25 bp, Mus musculus
gatgaggctttcttaccaacatgtg

SEQ ID NO: 511860 - DNA, 25 bp, Mus musculus
gatgagggcataacaccgatgtgag

SEQ ID NO: 511861 - DNA, 25 bp, Mus musculus
gatgagggcatatcaccgatgtgag

SEQ ID NO: 511862 - DNA, 25 bp, Mus musculus
gatgagggcatcacagctcttcata

SEQ ID NO: 511863 - DNA, 25 bp, Mus musculus
gatgagggcatctcagctcttcata

SEQ ID NO: 511864 - DNA, 25 bp, Mus musculus
gatgagggctccagtactgcctata

SEQ ID NO: 511865 - DNA, 25 bp, Mus musculus
gatgagggctcctgtactgcctata

SEQ ID NO: 511866 - DNA, 25 bp, Mus musculus
gatgagggtgatcaccccgtttgcc

SEQ ID NO: 511867 - DNA, 25 bp, Mus musculus
gatgagggtgatgaccccgtttgcc

SEQ ID NO: 511868 - DNA, 25 bp, Mus musculus
gatgagggtgtgaaagctttgtaat

SEQ ID NO: 511869 - DNA, 25 bp, Mus musculus
gatgagggtgtgtaagctttgtaat

SEQ ID NO: 511870 - DNA, 25 bp, Mus musculus
gatgaggtaaaacccttcatgatcc

SEQ ID NO: 511871 - DNA, 25 bp, Mus musculus
gatgaggtaaaagccttcatgatcc

SEQ ID NO: 511872 - DNA, 25 bp, Mus musculus
gatgaggtaggcaccttgccaccct

SEQ ID NO: 511873 - DNA, 25 bp, Mus musculus
gatgaggtaggctccttgccaccct

SEQ ID NO: 511874 - DNA, 25 bp, Mus musculus
gatgaggtcagtagccgtgagtata

SEQ ID NO: 511875 - DNA, 25 bp, Mus musculus
gatgaggtcagttgccgtgagtata

SEQ ID NO: 511876 - DNA, 25 bp, Mus musculus
gatgaggtcatgactgtgctcagtg

SEQ ID NO: 511877 - DNA, 25 bp, Mus musculus
gatgaggtcatgtctgtgctcagtg

SEQ ID NO: 511878 - DNA, 25 bp, Mus musculus
gatgaggtcattatacacaggaaac

SEQ ID NO: 511879 - DNA, 25 bp, Mus musculus
gatgaggtcattttacacaggaaac

SEQ ID NO: 511880 - DNA, 25 bp, Mus musculus
gatgaggtccaaacacgcctgcagg

SEQ ID NO: 511881 - DNA, 25 bp, Mus musculus
gatgaggtccaatcacgcctgcagg

SEQ ID NO: 511882 - DNA, 25 bp, Mus musculus
gatgaggtctgactccactactatt

SEQ ID NO: 511883 - DNA, 25 bp, Mus musculus
gatgaggtctgagtccactactatt

SEQ ID NO: 511884 - DNA, 25 bp, Mus musculus
gatgaggtgaacctgccactgcaca

SEQ ID NO: 511885 - DNA, 25 bp, Mus musculus
gatgaggtgaacgtgccactgcaca

SEQ ID NO: 511886 - DNA, 25 bp, Mus musculus
gatgaggtgttgaaggccagtcttt

SEQ ID NO: 511887 - DNA, 25 bp, Mus musculus
gatgaggtgttgtaggccagtcttt

SEQ ID NO: 511888 - DNA, 25 bp, Mus musculus
gatgaggttattcccaactttttat

SEQ ID NO: 511889 - DNA, 25 bp, Mus musculus
gatgaggttattgccaactttttat

SEQ ID NO: 511890 - DNA, 25 bp, Mus musculus
gatgaggttcggacatctgcagacc

SEQ ID NO: 511891 - DNA, 25 bp, Mus musculus
gatgaggttcggtcatctgcagacc

SEQ ID NO: 511892 - DNA, 25 bp, Mus musculus
gatgaggttgctcaccataacttta

SEQ ID NO: 511893 - DNA, 25 bp, Mus musculus
gatgaggttgctgaccataacttta

SEQ ID NO: 511894 - DNA, 25 bp, Mus musculus
gatgaggtttttaccacgttaatag

SEQ ID NO: 511895 - DNA, 25 bp, Mus musculus
gatgaggttttttccacgttaatag

SEQ ID NO: 511896 - DNA, 25 bp, Mus musculus
gatgagtaagctatctgaagacttt

SEQ ID NO: 511897 - DNA, 25 bp, Mus musculus
gatgagtaagctttctgaagacttt

SEQ ID NO: 511898 - DNA, 25 bp, Mus musculus
gatgagtaattccttctgttcgcaa

SEQ ID NO: 511899 - DNA, 25 bp, Mus musculus
gatgagtaattcgttctgttcgcaa

SEQ ID NO: 511900 - DNA, 25 bp, Mus musculus
gatgagtacatcctgttatccagat

SEQ ID NO: 511901 - DNA, 25 bp, Mus musculus
gatgagtacatcgtgttatccagat

SEQ ID NO: 511902 - DNA, 25 bp, Mus musculus
gatgagtacatgaacctcgtattag

SEQ ID NO: 511903 - DNA, 25 bp, Mus musculus
gatgagtacatgtacctcgtattag

SEQ ID NO: 511904 - DNA, 25 bp, Mus musculus
gatgagtagattacagccctcctaa

SEQ ID NO: 511905 - DNA, 25 bp, Mus musculus
gatgagtagatttcagccctcctaa

SEQ ID NO: 511906 - DNA, 25 bp, Mus musculus
gatgagtatcttctgcgtgtttagg

SEQ ID NO: 511907 - DNA, 25 bp, Mus musculus
gatgagtatcttgtgcgtgtttagg

SEQ ID NO: 511908 - DNA, 25 bp, Mus musculus
gatgagtatgctccttccatttaca

SEQ ID NO: 511909 - DNA, 25 bp, Mus musculus
gatgagtatgctgcttccatttaca

SEQ ID NO: 511910 - DNA, 25 bp, Mus musculus
gatgagtatttccaagaacggcaga

SEQ ID NO: 511911 - DNA, 25 bp, Mus musculus
gatgagtatttcgaagaacggcaga

SEQ ID NO: 511912 - DNA, 25 bp, Mus musculus
gatgagtcagatctggccctttgct

SEQ ID NO: 511913 - DNA, 25 bp, Mus musculus
gatgagtcagatgtggccctttgct

SEQ ID NO: 511914 - DNA, 25 bp, Mus musculus
gatgagtcatctctcactgggcagc

SEQ ID NO: 511915 - DNA, 25 bp, Mus musculus
gatgagtcatctgtcactgggcagc

SEQ ID NO: 511916 - DNA, 25 bp, Mus musculus
gatgagtccacgctgtcagcatagc

SEQ ID NO: 511917 - DNA, 25 bp, Mus musculus
gatgagtccacggtgtcagcatagc

SEQ ID NO: 511918 - DNA, 25 bp, Mus musculus
gatgagtccccaatcttcaaagaat

SEQ ID NO: 511919 - DNA, 25 bp, Mus musculus
gatgagtccccattcttcaaagaat

SEQ ID NO: 511920 - DNA, 25 bp, Mus musculus
gatgagtctacaattctccatccta

SEQ ID NO: 511921 - DNA, 25 bp, Mus musculus
gatgagtctacatttctccatccta

SEQ ID NO: 511922 - DNA, 25 bp, Mus musculus
gatgagtctataaacaggagcaact

SEQ ID NO: 511923 - DNA, 25 bp, Mus musculus
gatgagtctatatacaggagcaact

SEQ ID NO: 511924 - DNA, 25 bp, Mus musculus
gatgagtctctcctgaaatctgtca

SEQ ID NO: 511925 - DNA, 25 bp, Mus musculus
gatgagtctctcgtgaaatctgtca

SEQ ID NO: 511926 - DNA, 25 bp, Mus musculus
gatgagtctgatagacctgcccagc

SEQ ID NO: 511927 - DNA, 25 bp, Mus musculus
gatgagtctgattgacctgcccagc

SEQ ID NO: 511928 - DNA, 25 bp, Mus musculus
gatgagtctgcacagggacctgcca

SEQ ID NO: 511929 - DNA, 25 bp, Mus musculus
gatgagtctgcagagggacctgcca

SEQ ID NO: 511930 - DNA, 25 bp, Mus musculus
gatgagtctgccatgagaacttgct

SEQ ID NO: 511931 - DNA, 25 bp, Mus musculus
gatgagtctgccttgagaacttgct

SEQ ID NO: 511932 - DNA, 25 bp, Mus musculus
gatgagtctgctccactgaaaatgt

SEQ ID NO: 511933 - DNA, 25 bp, Mus musculus
gatgagtctgctgcactgaaaatgt

SEQ ID NO: 511934 - DNA, 25 bp, Mus musculus
gatgagtctgttatgtcacctaaaa

SEQ ID NO: 511935 - DNA, 25 bp, Mus musculus
gatgagtctgttttgtcacctaaaa

SEQ ID NO: 511936 - DNA, 25 bp, Mus musculus
gatgagtgaattcagttccctacca

SEQ ID NO: 511937 - DNA, 25 bp, Mus musculus
gatgagtgaattgagttccctacca

SEQ ID NO: 511938 - DNA, 25 bp, Mus musculus
gatgagtgctataccaatttaaggt

SEQ ID NO: 511939 - DNA, 25 bp, Mus musculus
gatgagtgctattccaatttaaggt

SEQ ID NO: 511940 - DNA, 25 bp, Mus musculus
gatgagtgctgccagtcagcttgtt

SEQ ID NO: 511941 - DNA, 25 bp, Mus musculus
gatgagtgctgcgagtcagcttgtt

SEQ ID NO: 511942 - DNA, 25 bp, Mus musculus
gatgagtgctttcttcacaaacctg

SEQ ID NO: 511943 - DNA, 25 bp, Mus musculus
gatgagtgctttgttcacaaacctg

SEQ ID NO: 511944 - DNA, 25 bp, Mus musculus
gatgagtgtcggcttctgtatgata

SEQ ID NO: 511945 - DNA, 25 bp, Mus musculus
gatgagtgtcgggttctgtatgata

SEQ ID NO: 511946 - DNA, 25 bp, Mus musculus
gatgagtgtgccaacaggtgtatca

SEQ ID NO: 511947 - DNA, 25 bp, Mus musculus
gatgagtgtgcctacaggtgtatca

SEQ ID NO: 511948 - DNA, 25 bp, Mus musculus
gatgagtgtggaagctgtagaaatt

SEQ ID NO: 511949 - DNA, 25 bp, Mus musculus
gatgagtgtggatgctgtagaaatt

SEQ ID NO: 511950 - DNA, 25 bp, Mus musculus
gatgagtgtggcattgctcctcaat

SEQ ID NO: 511951 - DNA, 25 bp, Mus musculus
gatgagtgtggcctttgccactctc

SEQ ID NO: 511952 - DNA, 25 bp, Mus musculus
gatgagtgtggcgtttgccactctc

SEQ ID NO: 511953 - DNA, 25 bp, Mus musculus
gatgagtgtggctttgctcctcaat

SEQ ID NO: 511954 - DNA, 25 bp, Mus musculus
gatgagtgttcacattaagctcgaa

SEQ ID NO: 511955 - DNA, 25 bp, Mus musculus
gatgagtgttcagattaagctcgaa

SEQ ID NO: 511956 - DNA, 25 bp, Mus musculus
gatgagtgttctatcacccacaatt

SEQ ID NO: 511957 - DNA, 25 bp, Mus musculus
gatgagtgttctttcacccacaatt

SEQ ID NO: 511958 - DNA, 25 bp, Mus musculus
gatgagttacgcaagctgcacagat

SEQ ID NO: 511959 - DNA, 25 bp, Mus musculus
gatgagttacgctagctgcacagat

SEQ ID NO: 511960 - DNA, 25 bp, Mus musculus
gatgagttagaacgtccagcccctg

SEQ ID NO: 511961 - DNA, 25 bp, Mus musculus
gatgagttagaaggtccagcccctg

SEQ ID NO: 511962 - DNA, 25 bp, Mus musculus
gatgagttaggcaatctacacactg

SEQ ID NO: 511963 - DNA, 25 bp, Mus musculus
gatgagttaggctatctacacactg

SEQ ID NO: 511964 - DNA, 25 bp, Mus musculus
gatgagttcagccactgtagtgcag

SEQ ID NO: 511965 - DNA, 25 bp, Mus musculus
gatgagttcagcgactgtagtgcag

SEQ ID NO: 511966 - DNA, 25 bp, Mus musculus
gatgagttccttatactagccaggg

SEQ ID NO: 511967 - DNA, 25 bp, Mus musculus
gatgagttccttttactagccaggg

SEQ ID NO: 511968 - DNA, 25 bp, Mus musculus
gatgagttctccatctattttatga

SEQ ID NO: 511969 - DNA, 25 bp, Mus musculus
gatgagttctccttctattttatga

SEQ ID NO: 511970 - DNA, 25 bp, Mus musculus
gatgagttcttcagctcacactgcc

SEQ ID NO: 511971 - DNA, 25 bp, Mus musculus
gatgagttcttctgctcacactgcc

SEQ ID NO: 511972 - DNA, 25 bp, Mus musculus
gatgagttggacatactttccgtag

SEQ ID NO: 511973 - DNA, 25 bp, Mus musculus
gatgagttggacttactttccgtag

SEQ ID NO: 511974 - DNA, 25 bp, Mus musculus
gatgagttgtgacccacggcccagc

SEQ ID NO: 511975 - DNA, 25 bp, Mus musculus
gatgagttgtgagccacggcccagc

SEQ ID NO: 511976 - DNA, 25 bp, Mus musculus
gatgagtttcacattctccaaggtg

SEQ ID NO: 511977 - DNA, 25 bp, Mus musculus
gatgagtttcactttctccaaggtg

SEQ ID NO: 511978 - DNA, 25 bp, Mus musculus
gatgagtttccaccgaaatgtcgga

SEQ ID NO: 511979 - DNA, 25 bp, Mus musculus
gatgagtttccagcgaaatgtcgga

SEQ ID NO: 511980 - DNA, 25 bp, Mus musculus
gatgagtttgcaagcctggtgaatc

SEQ ID NO: 511981 - DNA, 25 bp, Mus musculus
gatgagtttgcatgcctggtgaatc

SEQ ID NO: 511982 - DNA, 25 bp, Mus musculus
gatgagttttacatgattcccagtg

SEQ ID NO: 511983 - DNA, 25 bp, Mus musculus
gatgagttttacttgattcccagtg

SEQ ID NO: 511984 - DNA, 25 bp, Mus musculus
gatgataaacctaccaactacagtg

SEQ ID NO: 511985 - DNA, 25 bp, Mus musculus
gatgataaaccttccaactacagtg

SEQ ID NO: 511986 - DNA, 25 bp, Mus musculus
gatgataaataaaccaccacggtca

SEQ ID NO: 511987 - DNA, 25 bp, Mus musculus
gatgataaataatccaccacggtca

SEQ ID NO: 511988 - DNA, 25 bp, Mus musculus
gatgataacaaaaccaggctgcggt

SEQ ID NO: 511989 - DNA, 25 bp, Mus musculus
gatgataacaaatccaggctgcggt

SEQ ID NO: 511990 - DNA, 25 bp, Mus musculus
gatgataaccttcaactagcaccct

SEQ ID NO: 511991 - DNA, 25 bp, Mus musculus
gatgataaccttgaactagcaccct

SEQ ID NO: 511992 - DNA, 25 bp, Mus musculus
gatgataacggactgtaagccagcc

SEQ ID NO: 511993 - DNA, 25 bp, Mus musculus
gatgataacggagtgtaagccagcc

SEQ ID NO: 511994 - DNA, 25 bp, Mus musculus
gatgataactttaactgctctgcag

SEQ ID NO: 511995 - DNA, 25 bp, Mus musculus
gatgataactttatcccacaggttc

SEQ ID NO: 511996 - DNA, 25 bp, Mus musculus
gatgataacttttactgctctgcag

SEQ ID NO: 511997 - DNA, 25 bp, Mus musculus
gatgataactttttcccacaggttc

SEQ ID NO: 511998 - DNA, 25 bp, Mus musculus
gatgataagagaccccaaacacaca

SEQ ID NO: 511999 - DNA, 25 bp, Mus musculus
gatgataagagagcccaaacacaca

SEQ ID NO: 512000 - DNA, 25 bp, Mus musculus
gatgataagtagaccctccttctgc

SEQ ID NO: 512001 - DNA, 25 bp, Mus musculus
gatgataagtagtccctccttctgc

SEQ ID NO: 512002 - DNA, 25 bp, Mus musculus
gatgataatctacacaggttattca

SEQ ID NO: 512003 - DNA, 25 bp, Mus musculus
gatgataatctagacaggttattca

SEQ ID NO: 512004 - DNA, 25 bp, Mus musculus
gatgataatgaactctagccctctg

SEQ ID NO: 512005 - DNA, 25 bp, Mus musculus
gatgataatgaagtctagccctctg

SEQ ID NO: 512006 - DNA, 25 bp, Mus musculus
gatgataatgatactccacattgac

SEQ ID NO: 512007 - DNA, 25 bp, Mus musculus
gatgataatgattctccacattgac

SEQ ID NO: 512008 - DNA, 25 bp, Mus musculus
gatgatacaagtacaagccatggaa

SEQ ID NO: 512009 - DNA, 25 bp, Mus musculus
gatgatacaagttcaagccatggaa

SEQ ID NO: 512010 - DNA, 25 bp, Mus musculus
gatgatacacctattgatgaaccac

SEQ ID NO: 512011 - DNA, 25 bp, Mus musculus
gatgatacaccttttgatgaaccac

SEQ ID NO: 512012 - DNA, 25 bp, Mus musculus
gatgatacactacatgaaactgaag

SEQ ID NO: 512013 - DNA, 25 bp, Mus musculus
gatgatacactagatgaaactgaag

SEQ ID NO: 512014 - DNA, 25 bp, Mus musculus
gatgatacagtcactaaattcagaa

SEQ ID NO: 512015 - DNA, 25 bp, Mus musculus
gatgatacagtctctaaattcagaa

SEQ ID NO: 512016 - DNA, 25 bp, Mus musculus
gatgatacatccaataaccctggtt

SEQ ID NO: 512017 - DNA, 25 bp, Mus musculus
gatgatacatcctataaccctggtt

SEQ ID NO: 512018 - DNA, 25 bp, Mus musculus
gatgatacatttctgctggagctgc

SEQ ID NO: 512019 - DNA, 25 bp, Mus musculus
gatgatacatttgtgctggagctgc

SEQ ID NO: 512020 - DNA, 25 bp, Mus musculus
gatgataccactccaggtctcaaca

SEQ ID NO: 512021 - DNA, 25 bp, Mus musculus
gatgataccactgcaggtctcaaca

SEQ ID NO: 512022 - DNA, 25 bp, Mus musculus
gatgataccagaaggcagcatctga

SEQ ID NO: 512023 - DNA, 25 bp, Mus musculus
gatgataccagacacctgcttgtcc

SEQ ID NO: 512024 - DNA, 25 bp, Mus musculus
gatgataccagagacctgcttgtcc

SEQ ID NO: 512025 - DNA, 25 bp, Mus musculus
gatgataccagatggcagcatctga

SEQ ID NO: 512026 - DNA, 25 bp, Mus musculus
gatgataccccacttgtgaagagca

SEQ ID NO: 512027 - DNA, 25 bp, Mus musculus
gatgataccccagttgtgaagagca

SEQ ID NO: 512028 - DNA, 25 bp, Mus musculus
gatgataccctaccatttaacctaa

SEQ ID NO: 512029 - DNA, 25 bp, Mus musculus
gatgataccctagcatttaacctaa

SEQ ID NO: 512030 - DNA, 25 bp, Mus musculus
gatgataccctcattgctcgtacaa

SEQ ID NO: 512031 - DNA, 25 bp, Mus musculus
gatgataccctctttgctcgtacaa

SEQ ID NO: 512032 - DNA, 25 bp, Mus musculus
gatgataccctgacttgagcacagc

SEQ ID NO: 512033 - DNA, 25 bp, Mus musculus
gatgataccctgtcttgagcacagc

SEQ ID NO: 512034 - DNA, 25 bp, Mus musculus
gatgatacctttcatccagaacttg

SEQ ID NO: 512035 - DNA, 25 bp, Mus musculus
gatgatacctttgatccagaacttg

SEQ ID NO: 512036 - DNA, 25 bp, Mus musculus
gatgatacgaaaccccgccagatga

SEQ ID NO: 512037 - DNA, 25 bp, Mus musculus
gatgatacgaaagcccgccagatga

SEQ ID NO: 512038 - DNA, 25 bp, Mus musculus
gatgatactaccctccggaaacggg

SEQ ID NO: 512039 - DNA, 25 bp, Mus musculus
gatgatactaccgtccggaaacggg

SEQ ID NO: 512040 - DNA, 25 bp, Mus musculus
gatgatactcataattttgggcgtg

SEQ ID NO: 512041 - DNA, 25 bp, Mus musculus
gatgatactcattattttgggcgtg

SEQ ID NO: 512042 - DNA, 25 bp, Mus musculus
gatgatactctacacattatgcatt

SEQ ID NO: 512043 - DNA, 25 bp, Mus musculus
gatgatactctagacattatgcatt

SEQ ID NO: 512044 - DNA, 25 bp, Mus musculus
gatgatactgaactatactgtagag

SEQ ID NO: 512045 - DNA, 25 bp, Mus musculus
gatgatactgaagtatactgtagag

SEQ ID NO: 512046 - DNA, 25 bp, Mus musculus
gatgatacttaaagactctcttgct

SEQ ID NO: 512047 - DNA, 25 bp, Mus musculus
gatgatacttaatgactctcttgct

SEQ ID NO: 512048 - DNA, 25 bp, Mus musculus
gatgatacttatacattctttccag

SEQ ID NO: 512049 - DNA, 25 bp, Mus musculus
gatgatacttattcattctttccag

SEQ ID NO: 512050 - DNA, 25 bp, Mus musculus
gatgatactttaagcataatacact

SEQ ID NO: 512051 - DNA, 25 bp, Mus musculus
gatgatactttatgcataatacact

SEQ ID NO: 512052 - DNA, 25 bp, Mus musculus
gatgatacttttctctacttcaggc

SEQ ID NO: 512053 - DNA, 25 bp, Mus musculus
gatgatacttttgtctacttcaggc

SEQ ID NO: 512054 - DNA, 25 bp, Mus musculus
gatgatagaggaattatgccaggtt

SEQ ID NO: 512055 - DNA, 25 bp, Mus musculus
gatgatagaggatttatgccaggtt

SEQ ID NO: 512056 - DNA, 25 bp, Mus musculus
gatgatagatacaagtgcacccact

SEQ ID NO: 512057 - DNA, 25 bp, Mus musculus
gatgatagatactagtgcacccact

SEQ ID NO: 512058 - DNA, 25 bp, Mus musculus
gatgatagatcccagcactcctttt

SEQ ID NO: 512059 - DNA, 25 bp, Mus musculus
gatgatagatccgagcactcctttt

SEQ ID NO: 512060 - DNA, 25 bp, Mus musculus
gatgatagatcgacaaggcccctgc

SEQ ID NO: 512061 - DNA, 25 bp, Mus musculus
gatgatagatcgtcaaggcccctgc

SEQ ID NO: 512062 - DNA, 25 bp, Mus musculus
gatgatagccatctctatgatataa

SEQ ID NO: 512063 - DNA, 25 bp, Mus musculus
gatgatagccatgtctatgatataa

SEQ ID NO: 512064 - DNA, 25 bp, Mus musculus
gatgatagccgtaccagcattttgc

SEQ ID NO: 512065 - DNA, 25 bp, Mus musculus
gatgatagccgttccagcattttgc

SEQ ID NO: 512066 - DNA, 25 bp, Mus musculus
gatgatagctctcttagtttgctgt

SEQ ID NO: 512067 - DNA, 25 bp, Mus musculus
gatgatagctctgttagtttgctgt

SEQ ID NO: 512068 - DNA, 25 bp, Mus musculus
gatgataggcctcgcataaagcccc

SEQ ID NO: 512069 - DNA, 25 bp, Mus musculus
gatgataggcctggcataaagcccc

SEQ ID NO: 512070 - DNA, 25 bp, Mus musculus
gatgatagggaccttcagagctgtc

SEQ ID NO: 512071 - DNA, 25 bp, Mus musculus
gatgatagggacgttcagagctgtc

SEQ ID NO: 512072 - DNA, 25 bp, Mus musculus
gatgatagtagtattgctctcctta

SEQ ID NO: 512073 - DNA, 25 bp, Mus musculus
gatgatagtagttttgctctcctta

SEQ ID NO: 512074 - DNA, 25 bp, Mus musculus
gatgatagtcccacttaggacagga

SEQ ID NO: 512075 - DNA, 25 bp, Mus musculus
gatgatagtccctcttaggacagga

SEQ ID NO: 512076 - DNA, 25 bp, Mus musculus
gatgatatacaaatcagtggcatct

SEQ ID NO: 512077 - DNA, 25 bp, Mus musculus
gatgatatacaattcagtggcatct

SEQ ID NO: 512078 - DNA, 25 bp, Mus musculus
gatgatatacttagttgccttttaa

SEQ ID NO: 512079 - DNA, 25 bp, Mus musculus
gatgatatacttcggttttcttttc

SEQ ID NO: 512080 - DNA, 25 bp, Mus musculus
gatgatatacttgggttttcttttc

SEQ ID NO: 512081 - DNA, 25 bp, Mus musculus
gatgatatactttgttgccttttaa

SEQ ID NO: 512082 - DNA, 25 bp, Mus musculus
gatgatatagataccacagtgtctt

SEQ ID NO: 512083 - DNA, 25 bp, Mus musculus
gatgatatagattccacagtgtctt

SEQ ID NO: 512084 - DNA, 25 bp, Mus musculus
gatgatatcactaccagctctgaat

SEQ ID NO: 512085 - DNA, 25 bp, Mus musculus
gatgatatcacttccagctctgaat

SEQ ID NO: 512086 - DNA, 25 bp, Mus musculus
gatgatatcatcaacgtgctgcaag

SEQ ID NO: 512087 - DNA, 25 bp, Mus musculus
gatgatatcatctacgtgctgcaag

SEQ ID NO: 512088 - DNA, 25 bp, Mus musculus
gatgatatcatgacgcagaacctgc

SEQ ID NO: 512089 - DNA, 25 bp, Mus musculus
gatgatatcatgattcagaagcctg

SEQ ID NO: 512090 - DNA, 25 bp, Mus musculus
gatgatatcatgtcgcagaacctgc

SEQ ID NO: 512091 - DNA, 25 bp, Mus musculus
gatgatatcatgtttcagaagcctg

SEQ ID NO: 512092 - DNA, 25 bp, Mus musculus
gatgatatcattactgcttggcccc

SEQ ID NO: 512093 - DNA, 25 bp, Mus musculus
gatgatatcatttctgcttggcccc

SEQ ID NO: 512094 - DNA, 25 bp, Mus musculus
gatgatatccaaaatgagcccagta

SEQ ID NO: 512095 - DNA, 25 bp, Mus musculus
gatgatatccaatatgagcccagta

SEQ ID NO: 512096 - DNA, 25 bp, Mus musculus
gatgatatctgcacctctgtaaagt

SEQ ID NO: 512097 - DNA, 25 bp, Mus musculus
gatgatatctgctcctctgtaaagt

SEQ ID NO: 512098 - DNA, 25 bp, Mus musculus
gatgatatgatccttttattctgaa

SEQ ID NO: 512099 - DNA, 25 bp, Mus musculus
gatgatatgatcgttttattctgaa

SEQ ID NO: 512100 - DNA, 25 bp, Mus musculus
gatgatatggctctgatacattagg

SEQ ID NO: 512101 - DNA, 25 bp, Mus musculus
gatgatatggctgtgatacattagg

SEQ ID NO: 512102 - DNA, 25 bp, Mus musculus
gatgatatggtgagtgctgctgact

SEQ ID NO: 512103 - DNA, 25 bp, Mus musculus
gatgatatggtgtgtgctgctgact

SEQ ID NO: 512104 - DNA, 25 bp, Mus musculus
gatgatattcatccgtgcacactac

SEQ ID NO: 512105 - DNA, 25 bp, Mus musculus
gatgatattcatgcgtgcacactac

SEQ ID NO: 512106 - DNA, 25 bp, Mus musculus
gatgatattcctctttgggaccaag

SEQ ID NO: 512107 - DNA, 25 bp, Mus musculus
gatgatattcctgtttgggaccaag

SEQ ID NO: 512108 - DNA, 25 bp, Mus musculus
gatgatatttctcttctctcaactc

SEQ ID NO: 512109 - DNA, 25 bp, Mus musculus
gatgatatttctgttctctcaactc

SEQ ID NO: 512110 - DNA, 25 bp, Mus musculus
gatgatattttcactcaagctgtca

SEQ ID NO: 512111 - DNA, 25 bp, Mus musculus
gatgatattttctctcaagctgtca

SEQ ID NO: 512112 - DNA, 25 bp, Mus musculus
gatgatatttttcactgggctcagt

SEQ ID NO: 512113 - DNA, 25 bp, Mus musculus
gatgatatttttgactgggctcagt

SEQ ID NO: 512114 - DNA, 25 bp, Mus musculus
gatgatcaacaacaagtcgtgtgag

SEQ ID NO: 512115 - DNA, 25 bp, Mus musculus
gatgatcaacaagaagtcgtgtgag

SEQ ID NO: 512116 - DNA, 25 bp, Mus musculus
gatgatcaacacacaagctccgatg

SEQ ID NO: 512117 - DNA, 25 bp, Mus musculus
gatgatcaacactcaagctccgatg

SEQ ID NO: 512118 - DNA, 25 bp, Mus musculus
gatgatcaagcgcaaccagctgctc

SEQ ID NO: 512119 - DNA, 25 bp, Mus musculus
gatgatcaagcggaaccagctgctc

SEQ ID NO: 512120 - DNA, 25 bp, Mus musculus
gatgatcaatggcagtgacctaccc

SEQ ID NO: 512121 - DNA, 25 bp, Mus musculus
gatgatcaatgggagtgacctaccc

SEQ ID NO: 512122 - DNA, 25 bp, Mus musculus
gatgatcaattaccctttctgttat

SEQ ID NO: 512123 - DNA, 25 bp, Mus musculus
gatgatcaattagcctttctgttat

SEQ ID NO: 512124 - DNA, 25 bp, Mus musculus
gatgatcacaaaccactccgtgatg

SEQ ID NO: 512125 - DNA, 25 bp, Mus musculus
gatgatcacaaacctcctgaatgcc

SEQ ID NO: 512126 - DNA, 25 bp, Mus musculus
gatgatcacaaagcactccgtgatg

SEQ ID NO: 512127 - DNA, 25 bp, Mus musculus
gatgatcacaaagctcctgaatgcc

SEQ ID NO: 512128 - DNA, 25 bp, Mus musculus
gatgatcacatccattggctccttg

SEQ ID NO: 512129 - DNA, 25 bp, Mus musculus
gatgatcacatcgattggctccttg

SEQ ID NO: 512130 - DNA, 25 bp, Mus musculus
gatgatcagcaacaatccctaaaca

SEQ ID NO: 512131 - DNA, 25 bp, Mus musculus
gatgatcagcaagaatccctaaaca

SEQ ID NO: 512132 - DNA, 25 bp, Mus musculus
gatgatcagcatcgccacacagctc

SEQ ID NO: 512133 - DNA, 25 bp, Mus musculus
gatgatcagcatggccacacagctc

SEQ ID NO: 512134 - DNA, 25 bp, Mus musculus
gatgatcagctcagaagctaaactc

SEQ ID NO: 512135 - DNA, 25 bp, Mus musculus
gatgatcagctctgaagctaaactc

SEQ ID NO: 512136 - DNA, 25 bp, Mus musculus
gatgatcagggtctgtgcccacgta

SEQ ID NO: 512137 - DNA, 25 bp, Mus musculus
gatgatcagggtgtgtgcccacgta

SEQ ID NO: 512138 - DNA, 25 bp, Mus musculus
gatgatcagtccatctcaagtgttt

SEQ ID NO: 512139 - DNA, 25 bp, Mus musculus
gatgatcagtccttctcaagtgttt

SEQ ID NO: 512140 - DNA, 25 bp, Mus musculus
gatgatcagtgcatgcttcacggca

SEQ ID NO: 512141 - DNA, 25 bp, Mus musculus
gatgatcagtgcttgcttcacggca

SEQ ID NO: 512142 - DNA, 25 bp, Mus musculus
gatgatcagtttacatgtcctctcg

SEQ ID NO: 512143 - DNA, 25 bp, Mus musculus
gatgatcagttttcatgtcctctcg

SEQ ID NO: 512144 - DNA, 25 bp, Mus musculus
gatgatcatctgatagaccagggat

SEQ ID NO: 512145 - DNA, 25 bp, Mus musculus
gatgatcatctgttagaccagggat

SEQ ID NO: 512146 - DNA, 25 bp, Mus musculus
gatgatcatgttcactgctttggca

SEQ ID NO: 512147 - DNA, 25 bp, Mus musculus
gatgatcatgttgactgctttggca

SEQ ID NO: 512148 - DNA, 25 bp, Mus musculus
gatgatccaaagactgacatgctct

SEQ ID NO: 512149 - DNA, 25 bp, Mus musculus
gatgatccaaagtctgacatgctct

SEQ ID NO: 512150 - DNA, 25 bp, Mus musculus
gatgatccaatccaagtgtctaaag

SEQ ID NO: 512151 - DNA, 25 bp, Mus musculus
gatgatccaatcgaagtgtctaaag

SEQ ID NO: 512152 - DNA, 25 bp, Mus musculus
gatgatccacaactcttagctgttg

SEQ ID NO: 512153 - DNA, 25 bp, Mus musculus
gatgatccacaagtcttagctgttg

SEQ ID NO: 512154 - DNA, 25 bp, Mus musculus
gatgatccagctcagcttagatggc

SEQ ID NO: 512155 - DNA, 25 bp, Mus musculus
gatgatccagctgagcttagatggc

SEQ ID NO: 512156 - DNA, 25 bp, Mus musculus
gatgatccatacatgtcttgggata

SEQ ID NO: 512157 - DNA, 25 bp, Mus musculus
gatgatccatacttgtcttgggata

SEQ ID NO: 512158 - DNA, 25 bp, Mus musculus
gatgatcccaaaaacagcaatgatg

SEQ ID NO: 512159 - DNA, 25 bp, Mus musculus
gatgatcccaaatacagcaatgatg

SEQ ID NO: 512160 - DNA, 25 bp, Mus musculus
gatgatcccaatctgacccaaggcc

SEQ ID NO: 512161 - DNA, 25 bp, Mus musculus
gatgatcccaatgtgacccaaggcc

SEQ ID NO: 512162 - DNA, 25 bp, Mus musculus
gatgatcccagcattgtgctcaagg

SEQ ID NO: 512163 - DNA, 25 bp, Mus musculus
gatgatcccagctttgtgctcaagg

SEQ ID NO: 512164 - DNA, 25 bp, Mus musculus
gatgatccctgaccaatcttaatac

SEQ ID NO: 512165 - DNA, 25 bp, Mus musculus
gatgatccctgagcaatcttaatac

SEQ ID NO: 512166 - DNA, 25 bp, Mus musculus
gatgatccctgcagtattgatttcc

SEQ ID NO: 512167 - DNA, 25 bp, Mus musculus
gatgatccctgctgtattgatttcc

SEQ ID NO: 512168 - DNA, 25 bp, Mus musculus
gatgatcccttgatcttaacgtaac

SEQ ID NO: 512169 - DNA, 25 bp, Mus musculus
gatgatcccttgttcttaacgtaac

SEQ ID NO: 512170 - DNA, 25 bp, Mus musculus
gatgatccggagcacttagctgcca

SEQ ID NO: 512171 - DNA, 25 bp, Mus musculus
gatgatccggaggacttagctgcca

SEQ ID NO: 512172 - DNA, 25 bp, Mus musculus
gatgatccgggacatgagaacaaaa

SEQ ID NO: 512173 - DNA, 25 bp, Mus musculus
gatgatccgggagatgagaacaaaa

SEQ ID NO: 512174 - DNA, 25 bp, Mus musculus
gatgatcctagccaccaagcaaatt

SEQ ID NO: 512175 - DNA, 25 bp, Mus musculus
gatgatcctagcgaccaagcaaatt

SEQ ID NO: 512176 - DNA, 25 bp, Mus musculus
gatgatcctcgtaagttggagcctt

SEQ ID NO: 512177 - DNA, 25 bp, Mus musculus
gatgatcctcgttagttggagcctt

SEQ ID NO: 512178 - DNA, 25 bp, Mus musculus
gatgatcctctgacagcgcttatgg

SEQ ID NO: 512179 - DNA, 25 bp, Mus musculus
gatgatcctctgtcagcgcttatgg

SEQ ID NO: 512180 - DNA, 25 bp, Mus musculus
gatgatcctgtgacctgactgggtg

SEQ ID NO: 512181 - DNA, 25 bp, Mus musculus
gatgatcctgtgtcctgactgggtg

SEQ ID NO: 512182 - DNA, 25 bp, Mus musculus
gatgatcgactgattctcgactctg

SEQ ID NO: 512183 - DNA, 25 bp, Mus musculus
gatgatcgactgtttctcgactctg

SEQ ID NO: 512184 - DNA, 25 bp, Mus musculus
gatgatctaaccatgagcctgtgga

SEQ ID NO: 512185 - DNA, 25 bp, Mus musculus
gatgatctaaccttgagcctgtgga

SEQ ID NO: 512186 - DNA, 25 bp, Mus musculus
gatgatctaagcacaaggtgaacct

SEQ ID NO: 512187 - DNA, 25 bp, Mus musculus
gatgatctaagctcaaggtgaacct

SEQ ID NO: 512188 - DNA, 25 bp, Mus musculus
gatgatctacccagtaattcttgta

SEQ ID NO: 512189 - DNA, 25 bp, Mus musculus
gatgatctaccctgtaattcttgta

SEQ ID NO: 512190 - DNA, 25 bp, Mus musculus
gatgatctattgcattcacgcgcta

SEQ ID NO: 512191 - DNA, 25 bp, Mus musculus
gatgatctattggattcacgcgcta

SEQ ID NO: 512192 - DNA, 25 bp, Mus musculus
gatgatctcacacaacttgaactct

SEQ ID NO: 512193 - DNA, 25 bp, Mus musculus
gatgatctcacagaacttgaactct

SEQ ID NO: 512194 - DNA, 25 bp, Mus musculus
gatgatctcatgacagggtctcccc

SEQ ID NO: 512195 - DNA, 25 bp, Mus musculus
gatgatctcatgcatgtggccctga

SEQ ID NO: 512196 - DNA, 25 bp, Mus musculus
gatgatctcatggatgtggccctga

SEQ ID NO: 512197 - DNA, 25 bp, Mus musculus
gatgatctcatgtcagggtctcccc

SEQ ID NO: 512198 - DNA, 25 bp, Mus musculus
gatgatctccatagcattgatatag

SEQ ID NO: 512199 - DNA, 25 bp, Mus musculus
gatgatctccattgcattgatatag

SEQ ID NO: 512200 - DNA, 25 bp, Mus musculus
gatgatctcctgaagccaggtgttc

SEQ ID NO: 512201 - DNA, 25 bp, Mus musculus
gatgatctcctgtagccaggtgttc

SEQ ID NO: 512202 - DNA, 25 bp, Mus musculus
gatgatctctagaccagcgttggca

SEQ ID NO: 512203 - DNA, 25 bp, Mus musculus
gatgatctctagtccagcgttggca

SEQ ID NO: 512204 - DNA, 25 bp, Mus musculus
gatgatctctttattgaactaccca

SEQ ID NO: 512205 - DNA, 25 bp, Mus musculus
gatgatctcttttttgaactaccca

SEQ ID NO: 512206 - DNA, 25 bp, Mus musculus
gatgatctgatcaatgcatactctt

SEQ ID NO: 512207 - DNA, 25 bp, Mus musculus
gatgatctgatctatgcatactctt

SEQ ID NO: 512208 - DNA, 25 bp, Mus musculus
gatgatctgtgcctcggacaacaac

SEQ ID NO: 512209 - DNA, 25 bp, Mus musculus
gatgatctgtgcgtcggacaacaac

SEQ ID NO: 512210 - DNA, 25 bp, Mus musculus
gatgatctgttcatgagctgtcagc

SEQ ID NO: 512211 - DNA, 25 bp, Mus musculus
gatgatctgttcttgagctgtcagc

SEQ ID NO: 512212 - DNA, 25 bp, Mus musculus
gatgatctgttgattgcgttgaact

SEQ ID NO: 512213 - DNA, 25 bp, Mus musculus
gatgatctgttgtttgcgttgaact

SEQ ID NO: 512214 - DNA, 25 bp, Mus musculus
gatgatcttaaaacacctgctgagc

SEQ ID NO: 512215 - DNA, 25 bp, Mus musculus
gatgatcttaaatcacctgctgagc

SEQ ID NO: 512216 - DNA, 25 bp, Mus musculus
gatgatcttaacactagccaaagta

SEQ ID NO: 512217 - DNA, 25 bp, Mus musculus
gatgatcttaactctagccaaagta

SEQ ID NO: 512218 - DNA, 25 bp, Mus musculus
gatgatcttcatattgtgctccagt

SEQ ID NO: 512219 - DNA, 25 bp, Mus musculus
gatgatcttcattttgtgctccagt

SEQ ID NO: 512220 - DNA, 25 bp, Mus musculus
gatgatgaaaacctggccaataata

SEQ ID NO: 512221 - DNA, 25 bp, Mus musculus
gatgatgaaaacgtggccaataata

SEQ ID NO: 512222 - DNA, 25 bp, Mus musculus
gatgatgaacctccttcgagacaaa

SEQ ID NO: 512223 - DNA, 25 bp, Mus musculus
gatgatgaacctgcttcgagacaaa

SEQ ID NO: 512224 - DNA, 25 bp, Mus musculus
gatgatgaactgatggctgtactgt

SEQ ID NO: 512225 - DNA, 25 bp, Mus musculus
gatgatgaactgttggctgtactgt

SEQ ID NO: 512226 - DNA, 25 bp, Mus musculus
gatgatgaagcacggatacattggt

SEQ ID NO: 512227 - DNA, 25 bp, Mus musculus
gatgatgaagcagggatacattggt

SEQ ID NO: 512228 - DNA, 25 bp, Mus musculus
gatgatgaagcgatcagccagccac

SEQ ID NO: 512229 - DNA, 25 bp, Mus musculus
gatgatgaagcgttcagccagccac

SEQ ID NO: 512230 - DNA, 25 bp, Mus musculus
gatgatgaaggaccctctctgagga

SEQ ID NO: 512231 - DNA, 25 bp, Mus musculus
gatgatgaaggagcctctctgagga

SEQ ID NO: 512232 - DNA, 25 bp, Mus musculus
gatgatgaattcctaccccagagag

SEQ ID NO: 512233 - DNA, 25 bp, Mus musculus
gatgatgaattcgtaccccagagag

SEQ ID NO: 512234 - DNA, 25 bp, Mus musculus
gatgatgacaaacttatgcttctcc

SEQ ID NO: 512235 - DNA, 25 bp, Mus musculus
gatgatgacaaagttatgcttctcc

SEQ ID NO: 512236 - DNA, 25 bp, Mus musculus
gatgatgacacaccaacacagaaat

SEQ ID NO: 512237 - DNA, 25 bp, Mus musculus
gatgatgacacagcaacacagaaat

SEQ ID NO: 512238 - DNA, 25 bp, Mus musculus
gatgatgacacccagtggctgacgt

SEQ ID NO: 512239 - DNA, 25 bp, Mus musculus
gatgatgacaccgagtggctgacgt

SEQ ID NO: 512240 - DNA, 25 bp, Mus musculus
gatgatgaccacataaaggacctgt

SEQ ID NO: 512241 - DNA, 25 bp, Mus musculus
gatgatgaccacttaaaggacctgt

SEQ ID NO: 512242 - DNA, 25 bp, Mus musculus
gatgatgaccagatgggccattgtc

SEQ ID NO: 512243 - DNA, 25 bp, Mus musculus
gatgatgaccagttgggccattgtc

SEQ ID NO: 512244 - DNA, 25 bp, Mus musculus
gatgatgaccggacagcaggcattc

SEQ ID NO: 512245 - DNA, 25 bp, Mus musculus
gatgatgaccggtcagcaggcattc

SEQ ID NO: 512246 - DNA, 25 bp, Mus musculus
gatgatgacgagcaatcggaagccc

SEQ ID NO: 512247 - DNA, 25 bp, Mus musculus
gatgatgacgaggaatcggaagccc

SEQ ID NO: 512248 - DNA, 25 bp, Mus musculus
gatgatgacgcaagtaaataaagct

SEQ ID NO: 512249 - DNA, 25 bp, Mus musculus
gatgatgacgcatgtaaataaagct

SEQ ID NO: 512250 - DNA, 25 bp, Mus musculus
gatgatgactaccagcaaaagcgaa

SEQ ID NO: 512251 - DNA, 25 bp, Mus musculus
gatgatgactacgagcaaaagcgaa

SEQ ID NO: 512252 - DNA, 25 bp, Mus musculus
gatgatgactatcacttcaagcaaa

SEQ ID NO: 512253 - DNA, 25 bp, Mus musculus
gatgatgactatgacttcaagcaaa

SEQ ID NO: 512254 - DNA, 25 bp, Mus musculus
gatgatgactgtccctgtattccta

SEQ ID NO: 512255 - DNA, 25 bp, Mus musculus
gatgatgactgtgcctgtattccta

SEQ ID NO: 512256 - DNA, 25 bp, Mus musculus
gatgatgacttaaccaacgctctgt

SEQ ID NO: 512257 - DNA, 25 bp, Mus musculus
gatgatgacttacttgtgggcgcaa

SEQ ID NO: 512258 - DNA, 25 bp, Mus musculus
gatgatgacttagttgtgggcgcaa

SEQ ID NO: 512259 - DNA, 25 bp, Mus musculus
gatgatgacttatccaacgctctgt

SEQ ID NO: 512260 - DNA, 25 bp, Mus musculus
gatgatgagaccattcaggcagagc

SEQ ID NO: 512261 - DNA, 25 bp, Mus musculus
gatgatgagacctttcaggcagagc

SEQ ID NO: 512262 - DNA, 25 bp, Mus musculus
gatgatgagtgaaccgtgtcctcaa

SEQ ID NO: 512263 - DNA, 25 bp, Mus musculus
gatgatgagtgatccgtgtcctcaa

SEQ ID NO: 512264 - DNA, 25 bp, Mus musculus
gatgatgatagcctttccgtctctt

SEQ ID NO: 512265 - DNA, 25 bp, Mus musculus
gatgatgatagcgtttccgtctctt

SEQ ID NO: 512266 - DNA, 25 bp, Mus musculus
gatgatgatcccagattgccagcgt

SEQ ID NO: 512267 - DNA, 25 bp, Mus musculus
gatgatgatccctgattgccagcgt

SEQ ID NO: 512268 - DNA, 25 bp, Mus musculus
gatgatgatcgtcgtcgtggaccaa

SEQ ID NO: 512269 - DNA, 25 bp, Mus musculus
gatgatgatcgtggtcgtggaccaa

SEQ ID NO: 512270 - DNA, 25 bp, Mus musculus
gatgatgatctcatcagctctgcca

SEQ ID NO: 512271 - DNA, 25 bp, Mus musculus
gatgatgatctcttcagctctgcca

SEQ ID NO: 512272 - DNA, 25 bp, Mus musculus
gatgatgatggcacctccgttagct

SEQ ID NO: 512273 - DNA, 25 bp, Mus musculus
gatgatgatggctcctccgttagct

SEQ ID NO: 512274 - DNA, 25 bp, Mus musculus
gatgatgcaaaaagtctccgtggag

SEQ ID NO: 512275 - DNA, 25 bp, Mus musculus
gatgatgcaaaatgtctccgtggag

SEQ ID NO: 512276 - DNA, 25 bp, Mus musculus
gatgatgcacagctcctgcaaacag

SEQ ID NO: 512277 - DNA, 25 bp, Mus musculus
gatgatgcacaggtcctgcaaacag

SEQ ID NO: 512278 - DNA, 25 bp, Mus musculus
gatgatgcaccccataggccatttc

SEQ ID NO: 512279 - DNA, 25 bp, Mus musculus
gatgatgcacccgataggccatttc

SEQ ID NO: 512280 - DNA, 25 bp, Mus musculus
gatgatgcagagcttgaggctattc

SEQ ID NO: 512281 - DNA, 25 bp, Mus musculus
gatgatgcagaggttgaggctattc

SEQ ID NO: 512282 - DNA, 25 bp, Mus musculus
gatgatgcagatacctctttcttcc

SEQ ID NO: 512283 - DNA, 25 bp, Mus musculus
gatgatgcagattcctctttcttcc

SEQ ID NO: 512284 - DNA, 25 bp, Mus musculus
gatgatgcagtcaggacgcaaagga

SEQ ID NO: 512285 - DNA, 25 bp, Mus musculus
gatgatgcagtcaggccggaaaggg

SEQ ID NO: 512286 - DNA, 25 bp, Mus musculus
gatgatgcagtctggacgcaaagga

SEQ ID NO: 512287 - DNA, 25 bp, Mus musculus
gatgatgcagtctggccggaaaggg

SEQ ID NO: 512288 - DNA, 25 bp, Mus musculus
gatgatgcatgacgccctacagctc

SEQ ID NO: 512289 - DNA, 25 bp, Mus musculus
gatgatgcatgaggccctacagctc

SEQ ID NO: 512290 - DNA, 25 bp, Mus musculus
gatgatgcatttaaacacctggatt

SEQ ID NO: 512291 - DNA, 25 bp, Mus musculus
gatgatgcattttaacacctggatt

SEQ ID NO: 512292 - DNA, 25 bp, Mus musculus
gatgatgccaggaaactcactttag

SEQ ID NO: 512293 - DNA, 25 bp, Mus musculus
gatgatgccaggtaactcactttag

SEQ ID NO: 512294 - DNA, 25 bp, Mus musculus
gatgatgccatcagacacttccata

SEQ ID NO: 512295 - DNA, 25 bp, Mus musculus
gatgatgccatctgacacttccata

SEQ ID NO: 512296 - DNA, 25 bp, Mus musculus
gatgatgcccaaacggagccaatct

SEQ ID NO: 512297 - DNA, 25 bp, Mus musculus
gatgatgcccaatcggagccaatct

SEQ ID NO: 512298 - DNA, 25 bp, Mus musculus
gatgatgccctcattggtatcacat

SEQ ID NO: 512299 - DNA, 25 bp, Mus musculus
gatgatgccctctttggtatcacat

SEQ ID NO: 512300 - DNA, 25 bp, Mus musculus
gatgatgcccttcccatacagagct

SEQ ID NO: 512301 - DNA, 25 bp, Mus musculus
gatgatgcccttgccatacagagct

SEQ ID NO: 512302 - DNA, 25 bp, Mus musculus
gatgatgccggacttcattcactgt

SEQ ID NO: 512303 - DNA, 25 bp, Mus musculus
gatgatgccggagttcattcactgt

SEQ ID NO: 512304 - DNA, 25 bp, Mus musculus
gatgatgccggcactgacgtcacag

SEQ ID NO: 512305 - DNA, 25 bp, Mus musculus
gatgatgccggctctgacgtcacag

SEQ ID NO: 512306 - DNA, 25 bp, Mus musculus
gatgatgccgtacttctcgaaggcc

SEQ ID NO: 512307 - DNA, 25 bp, Mus musculus
gatgatgccgtagttctcgaaggcc

SEQ ID NO: 512308 - DNA, 25 bp, Mus musculus
gatgatgcctacagtattgcttctt

SEQ ID NO: 512309 - DNA, 25 bp, Mus musculus
gatgatgcctactgtattgcttctt

SEQ ID NO: 512310 - DNA, 25 bp, Mus musculus
gatgatgcgggcctacctccagcag

SEQ ID NO: 512311 - DNA, 25 bp, Mus musculus
gatgatgcgggcgtacctccagcag

SEQ ID NO: 512312 - DNA, 25 bp, Mus musculus
gatgatgcgtctcaacaactctttt

SEQ ID NO: 512313 - DNA, 25 bp, Mus musculus
gatgatgcgtctgaacaactctttt

SEQ ID NO: 512314 - DNA, 25 bp, Mus musculus
gatgatgctagcctgtacaagcctg

SEQ ID NO: 512315 - DNA, 25 bp, Mus musculus
gatgatgctagcgtgtacaagcctg

SEQ ID NO: 512316 - DNA, 25 bp, Mus musculus
gatgatgctccaagcatccaaggcg

SEQ ID NO: 512317 - DNA, 25 bp, Mus musculus
gatgatgctccatgcatccaaggcg

SEQ ID NO: 512318 - DNA, 25 bp, Mus musculus
gatgatgctgcaatgacaagaacat

SEQ ID NO: 512319 - DNA, 25 bp, Mus musculus
gatgatgctgcattgacaagaacat

SEQ ID NO: 512320 - DNA, 25 bp, Mus musculus
gatgatgctggacaaccacgccctg

SEQ ID NO: 512321 - DNA, 25 bp, Mus musculus
gatgatgctggagaaccacgccctg

SEQ ID NO: 512322 - DNA, 25 bp, Mus musculus
gatgatgctggcctaccgattccgg

SEQ ID NO: 512323 - DNA, 25 bp, Mus musculus
gatgatgctggcgtaccgattccgg

SEQ ID NO: 512324 - DNA, 25 bp, Mus musculus
gatgatgctgttacttcctgcactc

SEQ ID NO: 512325 - DNA, 25 bp, Mus musculus
gatgatgctgtttcttcctgcactc

SEQ ID NO: 512326 - DNA, 25 bp, Mus musculus
gatgatggaaccaaccacccaagtg

SEQ ID NO: 512327 - DNA, 25 bp, Mus musculus
gatgatggaacctaccacccaagtg

SEQ ID NO: 512328 - DNA, 25 bp, Mus musculus
gatgatggacttccacttgggaatc

SEQ ID NO: 512329 - DNA, 25 bp, Mus musculus
gatgatggacttgcacttgggaatc

SEQ ID NO: 512330 - DNA, 25 bp, Mus musculus
gatgatggcctgctaagagctgcct

SEQ ID NO: 512331 - DNA, 25 bp, Mus musculus
gatgatggcctggtaagagctgcct

SEQ ID NO: 512332 - DNA, 25 bp, Mus musculus
gatgatggcgacagttctcatggtg

SEQ ID NO: 512333 - DNA, 25 bp, Mus musculus
gatgatggcgactgttctcatggtg

SEQ ID NO: 512334 - DNA, 25 bp, Mus musculus
gatgatggcttccatccctgatagt

SEQ ID NO: 512335 - DNA, 25 bp, Mus musculus
gatgatggcttcgatccctgatagt

SEQ ID NO: 512336 - DNA, 25 bp, Mus musculus
gatgatgggactcagacgcacttca

SEQ ID NO: 512337 - DNA, 25 bp, Mus musculus
gatgatgggactgagacgcacttca

SEQ ID NO: 512338 - DNA, 25 bp, Mus musculus
gatgatggtccaatctcaccagcag

SEQ ID NO: 512339 - DNA, 25 bp, Mus musculus
gatgatggtccattctcaccagcag

SEQ ID NO: 512340 - DNA, 25 bp, Mus musculus
gatgatggtctcactaatgctactg

SEQ ID NO: 512341 - DNA, 25 bp, Mus musculus
gatgatggtctctctaatgctactg

SEQ ID NO: 512342 - DNA, 25 bp, Mus musculus
gatgatggtctgagaagacggtcca

SEQ ID NO: 512343 - DNA, 25 bp, Mus musculus
gatgatggtctgtgaagacggtcca

SEQ ID NO: 512344 - DNA, 25 bp, Mus musculus
gatgatggtgaaaacaaccccacag

SEQ ID NO: 512345 - DNA, 25 bp, Mus musculus
gatgatggtgaatacaaccccacag

SEQ ID NO: 512346 - DNA, 25 bp, Mus musculus
gatgatggttatacggcacccagaa

SEQ ID NO: 512347 - DNA, 25 bp, Mus musculus
gatgatggttattcggcacccagaa

SEQ ID NO: 512348 - DNA, 25 bp, Mus musculus
gatgatggttctcttttcatattat

SEQ ID NO: 512349 - DNA, 25 bp, Mus musculus
gatgatggttctgttttcatattat

SEQ ID NO: 512350 - DNA, 25 bp, Mus musculus
gatgatgtacagatgcccctgggtc

SEQ ID NO: 512351 - DNA, 25 bp, Mus musculus
gatgatgtacagttgcccctgggtc

SEQ ID NO: 512352 - DNA, 25 bp, Mus musculus
gatgatgtacgacaccttgctgttt

SEQ ID NO: 512353 - DNA, 25 bp, Mus musculus
gatgatgtacgagaccttgctgttt

SEQ ID NO: 512354 - DNA, 25 bp, Mus musculus
gatgatgtacgtctatcctccaggg

SEQ ID NO: 512355 - DNA, 25 bp, Mus musculus
gatgatgtacgtgtatcctccaggg

SEQ ID NO: 512356 - DNA, 25 bp, Mus musculus
gatgatgtatctccattcctggatg

SEQ ID NO: 512357 - DNA, 25 bp, Mus musculus
gatgatgtatctgcattcctggatg

SEQ ID NO: 512358 - DNA, 25 bp, Mus musculus
gatgatgtcacgattgtcttgagca

SEQ ID NO: 512359 - DNA, 25 bp, Mus musculus
gatgatgtcacgtttgtcttgagca

SEQ ID NO: 512360 - DNA, 25 bp, Mus musculus
gatgatgtcactctattgaatagct

SEQ ID NO: 512361 - DNA, 25 bp, Mus musculus
gatgatgtcactgtattgaatagct

SEQ ID NO: 512362 - DNA, 25 bp, Mus musculus
gatgatgtcatcagctgagacctca

SEQ ID NO: 512363 - DNA, 25 bp, Mus musculus
gatgatgtcatccagggtgccagct

SEQ ID NO: 512364 - DNA, 25 bp, Mus musculus
gatgatgtcatcgagggtgccagct

SEQ ID NO: 512365 - DNA, 25 bp, Mus musculus
gatgatgtcatctgctgagacctca

SEQ ID NO: 512366 - DNA, 25 bp, Mus musculus
gatgatgtcattcgcctcttaacta

SEQ ID NO: 512367 - DNA, 25 bp, Mus musculus
gatgatgtcattggcctcttaacta

SEQ ID NO: 512368 - DNA, 25 bp, Mus musculus
gatgatgtccatcagtttatcaaga

SEQ ID NO: 512369 - DNA, 25 bp, Mus musculus
gatgatgtccatgagtttatcaaga

SEQ ID NO: 512370 - DNA, 25 bp, Mus musculus
gatgatgtcctcagtgtggcctctg

SEQ ID NO: 512371 - DNA, 25 bp, Mus musculus
gatgatgtcctctgtgtggcctctg

SEQ ID NO: 512372 - DNA, 25 bp, Mus musculus
gatgatgtccttcccaaaaccagcc

SEQ ID NO: 512373 - DNA, 25 bp, Mus musculus
gatgatgtccttctggcaacttaat

SEQ ID NO: 512374 - DNA, 25 bp, Mus musculus
gatgatgtccttgccaaaaccagcc

SEQ ID NO: 512375 - DNA, 25 bp, Mus musculus
gatgatgtccttgtggcaacttaat

SEQ ID NO: 512376 - DNA, 25 bp, Mus musculus
gatgatgtctatatagttcatcctt

SEQ ID NO: 512377 - DNA, 25 bp, Mus musculus
gatgatgtctatttagttcatcctt

SEQ ID NO: 512378 - DNA, 25 bp, Mus musculus
gatgatgtctgaagctgcactcaat

SEQ ID NO: 512379 - DNA, 25 bp, Mus musculus
gatgatgtctgatgctgcactcaat

SEQ ID NO: 512380 - DNA, 25 bp, Mus musculus
gatgatgtctggatcctgaccaaga

SEQ ID NO: 512381 - DNA, 25 bp, Mus musculus
gatgatgtctggttcctgaccaaga

SEQ ID NO: 512382 - DNA, 25 bp, Mus musculus
gatgatgtcttcagggaattttttg

SEQ ID NO: 512383 - DNA, 25 bp, Mus musculus
gatgatgtcttctgggaattttttg

SEQ ID NO: 512384 - DNA, 25 bp, Mus musculus
gatgatgtgcatcccactatacctg

SEQ ID NO: 512385 - DNA, 25 bp, Mus musculus
gatgatgtgcatgccactatacctg

SEQ ID NO: 512386 - DNA, 25 bp, Mus musculus
gatgatgtgcggattctggaagttc

SEQ ID NO: 512387 - DNA, 25 bp, Mus musculus
gatgatgtgcggtttctggaagttc

SEQ ID NO: 512388 - DNA, 25 bp, Mus musculus
gatgatgtgctaacttcacttcagg

SEQ ID NO: 512389 - DNA, 25 bp, Mus musculus
gatgatgtgctatcttcacttcagg

SEQ ID NO: 512390 - DNA, 25 bp, Mus musculus
gatgatgtgctccaaacaccgtgaa

SEQ ID NO: 512391 - DNA, 25 bp, Mus musculus
gatgatgtgctcgaaacaccgtgaa

SEQ ID NO: 512392 - DNA, 25 bp, Mus musculus
gatgatgtgtaaccccatatcccag

SEQ ID NO: 512393 - DNA, 25 bp, Mus musculus
gatgatgtgtaagcccatatcccag

SEQ ID NO: 512394 - DNA, 25 bp, Mus musculus
gatgatgttacacttttgctttaat

SEQ ID NO: 512395 - DNA, 25 bp, Mus musculus
gatgatgttacagttttgctttaat

SEQ ID NO: 512396 - DNA, 25 bp, Mus musculus
gatgatgttagcaaactcgccaaac

SEQ ID NO: 512397 - DNA, 25 bp, Mus musculus
gatgatgttagctaactcgccaaac

SEQ ID NO: 512398 - DNA, 25 bp, Mus musculus
gatgatgttcatatggctacaggaa

SEQ ID NO: 512399 - DNA, 25 bp, Mus musculus
gatgatgttcatttggctacaggaa

SEQ ID NO: 512400 - DNA, 25 bp, Mus musculus
gatgatgttccgatgacgcctttgc

SEQ ID NO: 512401 - DNA, 25 bp, Mus musculus
gatgatgttccgttgacgcctttgc

SEQ ID NO: 512402 - DNA, 25 bp, Mus musculus
gatgatgttggcctgttaccctagc

SEQ ID NO: 512403 - DNA, 25 bp, Mus musculus
gatgatgttggcgtgttaccctagc

SEQ ID NO: 512404 - DNA, 25 bp, Mus musculus
gatgatgtttaactgctctgtgagc

SEQ ID NO: 512405 - DNA, 25 bp, Mus musculus
gatgatgtttaagtgctctgtgagc

SEQ ID NO: 512406 - DNA, 25 bp, Mus musculus
gatgatgtttcacattcaccagctt

SEQ ID NO: 512407 - DNA, 25 bp, Mus musculus
gatgatgtttcagattcaccagctt

SEQ ID NO: 512408 - DNA, 25 bp, Mus musculus
gatgattaacacaagacgccgcagg

SEQ ID NO: 512409 - DNA, 25 bp, Mus musculus
gatgattaacactagacgccgcagg

SEQ ID NO: 512410 - DNA, 25 bp, Mus musculus
gatgattaagaaatggtctccagaa

SEQ ID NO: 512411 - DNA, 25 bp, Mus musculus
gatgattaagaattggtctccagaa

SEQ ID NO: 512412 - DNA, 25 bp, Mus musculus
gatgattaagatcatctcccctccc

SEQ ID NO: 512413 - DNA, 25 bp, Mus musculus
gatgattaagatgatctcccctccc

SEQ ID NO: 512414 - DNA, 25 bp, Mus musculus
gatgattagcaacaccttttcctcc

SEQ ID NO: 512415 - DNA, 25 bp, Mus musculus
gatgattagcaagaccttttcctcc

SEQ ID NO: 512416 - DNA, 25 bp, Mus musculus
gatgattagcacacatgcgccttgt

SEQ ID NO: 512417 - DNA, 25 bp, Mus musculus
gatgattagcactcatgcgccttgt

SEQ ID NO: 512418 - DNA, 25 bp, Mus musculus
gatgattatcctacaaagtggccaa

SEQ ID NO: 512419 - DNA, 25 bp, Mus musculus
gatgattatccttcaaagtggccaa

SEQ ID NO: 512420 - DNA, 25 bp, Mus musculus
gatgattatgtaattggccccagtg

SEQ ID NO: 512421 - DNA, 25 bp, Mus musculus
gatgattatgtatttggccccagtg

SEQ ID NO: 512422 - DNA, 25 bp, Mus musculus
gatgattcagacacctggacccttg

SEQ ID NO: 512423 - DNA, 25 bp, Mus musculus
gatgattcagactcctggacccttg

SEQ ID NO: 512424 - DNA, 25 bp, Mus musculus
gatgattcagagaatacagcctggt

SEQ ID NO: 512425 - DNA, 25 bp, Mus musculus
gatgattcagagtatacagcctggt

SEQ ID NO: 512426 - DNA, 25 bp, Mus musculus
gatgattcagatcgacacgtacagc

SEQ ID NO: 512427 - DNA, 25 bp, Mus musculus
gatgattcagatggacacgtacagc

SEQ ID NO: 512428 - DNA, 25 bp, Mus musculus
gatgattccaaaagtagtgtctacc

SEQ ID NO: 512429 - DNA, 25 bp, Mus musculus
gatgattccaaatgtagtgtctacc

SEQ ID NO: 512430 - DNA, 25 bp, Mus musculus
gatgattccagacgaccaaggataa

SEQ ID NO: 512431 - DNA, 25 bp, Mus musculus
gatgattccagaggaccaaggataa

SEQ ID NO: 512432 - DNA, 25 bp, Mus musculus
gatgattccagcaagcagctactag

SEQ ID NO: 512433 - DNA, 25 bp, Mus musculus
gatgattccagctagcagctactag

SEQ ID NO: 512434 - DNA, 25 bp, Mus musculus
gatgattccagtcgaggaccactaa

SEQ ID NO: 512435 - DNA, 25 bp, Mus musculus
gatgattccagtggaggaccactaa

SEQ ID NO: 512436 - DNA, 25 bp, Mus musculus
gatgattccatgcaacagctgcgaa

SEQ ID NO: 512437 - DNA, 25 bp, Mus musculus
gatgattccatggaacagctgcgaa

SEQ ID NO: 512438 - DNA, 25 bp, Mus musculus
gatgattccctcctgagtgggagtt

SEQ ID NO: 512439 - DNA, 25 bp, Mus musculus
gatgattccctcgtgagtgggagtt

SEQ ID NO: 512440 - DNA, 25 bp, Mus musculus
gatgattccgtacaaaggtacctga

SEQ ID NO: 512441 - DNA, 25 bp, Mus musculus
gatgattccgtagaaaggtacctga

SEQ ID NO: 512442 - DNA, 25 bp, Mus musculus
gatgattcctcaagtttacagctgt

SEQ ID NO: 512443 - DNA, 25 bp, Mus musculus
gatgattcctcatgtttacagctgt

SEQ ID NO: 512444 - DNA, 25 bp, Mus musculus
gatgattcctgaatgagtaagacct

SEQ ID NO: 512445 - DNA, 25 bp, Mus musculus
gatgattcctgattgagtaagacct

SEQ ID NO: 512446 - DNA, 25 bp, Mus musculus
gatgattcctggacctcagctgaaa

SEQ ID NO: 512447 - DNA, 25 bp, Mus musculus
gatgattcctggtcctcagctgaaa

SEQ ID NO: 512448 - DNA, 25 bp, Mus musculus
gatgattcgactcttgatgaccttc

SEQ ID NO: 512449 - DNA, 25 bp, Mus musculus
gatgattcgactgttgatgaccttc

SEQ ID NO: 512450 - DNA, 25 bp, Mus musculus
gatgattcgccaacgtgagatggaa

SEQ ID NO: 512451 - DNA, 25 bp, Mus musculus
gatgattcgccatcgtgagatggaa

SEQ ID NO: 512452 - DNA, 25 bp, Mus musculus
gatgattctagacttttcccagctt

SEQ ID NO: 512453 - DNA, 25 bp, Mus musculus
gatgattctagagttttcccagctt

SEQ ID NO: 512454 - DNA, 25 bp, Mus musculus
gatgattctattctccgattggcta

SEQ ID NO: 512455 - DNA, 25 bp, Mus musculus
gatgattctattgtccgattggcta

SEQ ID NO: 512456 - DNA, 25 bp, Mus musculus
gatgattctcggaacactgctcttc

SEQ ID NO: 512457 - DNA, 25 bp, Mus musculus
gatgattctcggtacactgctcttc

SEQ ID NO: 512458 - DNA, 25 bp, Mus musculus
gatgattctgaaaaagcctgggctc

SEQ ID NO: 512459 - DNA, 25 bp, Mus musculus
gatgattctgaataagcctgggctc

SEQ ID NO: 512460 - DNA, 25 bp, Mus musculus
gatgattctgttactgcttttcctt

SEQ ID NO: 512461 - DNA, 25 bp, Mus musculus
gatgattctgtttctgcttttcctt

SEQ ID NO: 512462 - DNA, 25 bp, Mus musculus
gatgattctttgatgtcagctacat

SEQ ID NO: 512463 - DNA, 25 bp, Mus musculus
gatgattctttgttgtcagctacat

SEQ ID NO: 512464 - DNA, 25 bp, Mus musculus
gatgattgaagaccgctactacatt

SEQ ID NO: 512465 - DNA, 25 bp, Mus musculus
gatgattgaagagcgctactacatt

SEQ ID NO: 512466 - DNA, 25 bp, Mus musculus
gatgattgataactgtcctgctgac

SEQ ID NO: 512467 - DNA, 25 bp, Mus musculus
gatgattgataagtgtcctgctgac

SEQ ID NO: 512468 - DNA, 25 bp, Mus musculus
gatgattgcattcagggtccgacct

SEQ ID NO: 512469 - DNA, 25 bp, Mus musculus
gatgattgcattgagggtccgacct

SEQ ID NO: 512470 - DNA, 25 bp, Mus musculus
gatgattgccgtcgctccatttaaa

SEQ ID NO: 512471 - DNA, 25 bp, Mus musculus
gatgattgccgtggctccatttaaa

SEQ ID NO: 512472 - DNA, 25 bp, Mus musculus
gatgattggagcatgccatgccagc

SEQ ID NO: 512473 - DNA, 25 bp, Mus musculus
gatgattggagcttgccatgccagc

SEQ ID NO: 512474 - DNA, 25 bp, Mus musculus
gatgattggctgcaaccatctgcat

SEQ ID NO: 512475 - DNA, 25 bp, Mus musculus
gatgattggctggaaccatctgcat

SEQ ID NO: 512476 - DNA, 25 bp, Mus musculus
gatgattgggaaaccgtctataacc

SEQ ID NO: 512477 - DNA, 25 bp, Mus musculus
gatgattgggaatccgtctataacc

SEQ ID NO: 512478 - DNA, 25 bp, Mus musculus
gatgattggtcaaaggctttttctt

SEQ ID NO: 512479 - DNA, 25 bp, Mus musculus
gatgattggtcataggctttttctt

SEQ ID NO: 512480 - DNA, 25 bp, Mus musculus
gatgattgtcgaaagttccctctcc

SEQ ID NO: 512481 - DNA, 25 bp, Mus musculus
gatgattgtcgatagttccctctcc

SEQ ID NO: 512482 - DNA, 25 bp, Mus musculus
gatgattgtgaactcctggtcaccc

SEQ ID NO: 512483 - DNA, 25 bp, Mus musculus
gatgattgtgaagtcctggtcaccc

SEQ ID NO: 512484 - DNA, 25 bp, Mus musculus
gatgattgtgggaacaggctcctga

SEQ ID NO: 512485 - DNA, 25 bp, Mus musculus
gatgattgtgggtacaggctcctga

SEQ ID NO: 512486 - DNA, 25 bp, Mus musculus
gatgattgttccattttcatccact

SEQ ID NO: 512487 - DNA, 25 bp, Mus musculus
gatgattgttcctttttcatccact

SEQ ID NO: 512488 - DNA, 25 bp, Mus musculus
gatgatttaaaccttgactctgtat

SEQ ID NO: 512489 - DNA, 25 bp, Mus musculus
gatgatttaaacgttgactctgtat

SEQ ID NO: 512490 - DNA, 25 bp, Mus musculus
gatgatttaagcactgactctgagc

SEQ ID NO: 512491 - DNA, 25 bp, Mus musculus
gatgatttaagctctgactctgagc

SEQ ID NO: 512492 - DNA, 25 bp, Mus musculus
gatgatttacacagcttcagggagg

SEQ ID NO: 512493 - DNA, 25 bp, Mus musculus
gatgatttacactgcttcagggagg

SEQ ID NO: 512494 - DNA, 25 bp, Mus musculus
gatgatttatttcttccacgaccct

SEQ ID NO: 512495 - DNA, 25 bp, Mus musculus
gatgatttatttgttccacgaccct

SEQ ID NO: 512496 - DNA, 25 bp, Mus musculus
gatgatttcactacatgatactcag

SEQ ID NO: 512497 - DNA, 25 bp, Mus musculus
gatgatttcacttcatgatactcag

SEQ ID NO: 512498 - DNA, 25 bp, Mus musculus
gatgatttcagtacgtgaagccaaa

SEQ ID NO: 512499 - DNA, 25 bp, Mus musculus
gatgatttcagttcgtgaagccaaa

SEQ ID NO: 512500 - DNA, 25 bp, Mus musculus
gatgatttcattactgggccactat

SEQ ID NO: 512501 - DNA, 25 bp, Mus musculus
gatgatttcatttctgggccactat

SEQ ID NO: 512502 - DNA, 25 bp, Mus musculus
gatgatttcctcaggatggtcttcc

SEQ ID NO: 512503 - DNA, 25 bp, Mus musculus
gatgatttcctctggatggtcttcc

SEQ ID NO: 512504 - DNA, 25 bp, Mus musculus
gatgatttcgttctagttccatcca

SEQ ID NO: 512505 - DNA, 25 bp, Mus musculus
gatgatttcgttgtagttccatcca

SEQ ID NO: 512506 - DNA, 25 bp, Mus musculus
gatgatttctataatatttggcagt

SEQ ID NO: 512507 - DNA, 25 bp, Mus musculus
gatgatttctattatatttggcagt

SEQ ID NO: 512508 - DNA, 25 bp, Mus musculus
gatgatttctcaatctattcatttt

SEQ ID NO: 512509 - DNA, 25 bp, Mus musculus
gatgatttctcattctattcatttt

SEQ ID NO: 512510 - DNA, 25 bp, Mus musculus
gatgatttgaacatctttaatcaaa

SEQ ID NO: 512511 - DNA, 25 bp, Mus musculus
gatgatttgaacttctttaatcaaa

SEQ ID NO: 512512 - DNA, 25 bp, Mus musculus
gatgatttgcttccgatctgagctc

SEQ ID NO: 512513 - DNA, 25 bp, Mus musculus
gatgatttgcttcgatctaaacagt

SEQ ID NO: 512514 - DNA, 25 bp, Mus musculus
gatgatttgcttgcgatctgagctc

SEQ ID NO: 512515 - DNA, 25 bp, Mus musculus
gatgatttgcttggatctaaacagt

SEQ ID NO: 512516 - DNA, 25 bp, Mus musculus
gatgatttgggtatctcttacgtct

SEQ ID NO: 512517 - DNA, 25 bp, Mus musculus
gatgatttgggtttctcttacgtct

SEQ ID NO: 512518 - DNA, 25 bp, Mus musculus
gatgatttgtctctccaggtctacc

SEQ ID NO: 512519 - DNA, 25 bp, Mus musculus
gatgatttgtctgtccaggtctacc

SEQ ID NO: 512520 - DNA, 25 bp, Mus musculus
gatgatttgtggcatctcaaccaag

SEQ ID NO: 512521 - DNA, 25 bp, Mus musculus
gatgatttgtgggatctcaaccaag

SEQ ID NO: 512522 - DNA, 25 bp, Mus musculus
gatgattttacaagtgcacaagtga

SEQ ID NO: 512523 - DNA, 25 bp, Mus musculus
gatgattttacatgtgcacaagtga

SEQ ID NO: 512524 - DNA, 25 bp, Mus musculus
gatgattttctacttacatgctaat

SEQ ID NO: 512525 - DNA, 25 bp, Mus musculus
gatgattttctagttacatgctaat

SEQ ID NO: 512526 - DNA, 25 bp, Mus musculus
gatgattttctcaatagcttcaagg

SEQ ID NO: 512527 - DNA, 25 bp, Mus musculus
gatgattttctctatagcttcaagg

SEQ ID NO: 512528 - DNA, 25 bp, Mus musculus
gatgattttctgacttcagaaacta

SEQ ID NO: 512529 - DNA, 25 bp, Mus musculus
gatgattttctgtcttcagaaacta

SEQ ID NO: 512530 - DNA, 25 bp, Mus musculus
gatgattttcttaccgaggttctga

SEQ ID NO: 512531 - DNA, 25 bp, Mus musculus
gatgattttctttccgaggttctga

SEQ ID NO: 512532 - DNA, 25 bp, Mus musculus
gatgattttgggatactggaccaag

SEQ ID NO: 512533 - DNA, 25 bp, Mus musculus
gatgattttgggttactggaccaag

SEQ ID NO: 512534 - DNA, 25 bp, Mus musculus
gatgatttttagacccactgtgtgt

SEQ ID NO: 512535 - DNA, 25 bp, Mus musculus
gatgatttttagtcccactgtgtgt

SEQ ID NO: 512536 - DNA, 25 bp, Mus musculus
gatgatttttatacttgtgggtcca

SEQ ID NO: 512537 - DNA, 25 bp, Mus musculus
gatgatttttattcttgtgggtcca

SEQ ID NO: 512538 - DNA, 25 bp, Mus musculus
gatgatttttcaaagaccacacact

SEQ ID NO: 512539 - DNA, 25 bp, Mus musculus
gatgatttttcatagaccacacact

SEQ ID NO: 512540 - DNA, 25 bp, Mus musculus
gatgatttttgcatgatgtctccat

SEQ ID NO: 512541 - DNA, 25 bp, Mus musculus
gatgatttttgcttgatgtctccat

SEQ ID NO: 512542 - DNA, 25 bp, Mus musculus
gatgattttttccagataagcttaa

SEQ ID NO: 512543 - DNA, 25 bp, Mus musculus
gatgattttttcgagataagcttaa

SEQ ID NO: 512544 - DNA, 25 bp, Mus musculus
gatgattttttgagaccagctcttt

SEQ ID NO: 512545 - DNA, 25 bp, Mus musculus
gatgattttttgtgaccagctcttt

SEQ ID NO: 512546 - DNA, 25 bp, Mus musculus
gatgcaaaaaccagaccaggcccaa

SEQ ID NO: 512547 - DNA, 25 bp, Mus musculus
gatgcaaaaacctgaccaggcccaa

SEQ ID NO: 512548 - DNA, 25 bp, Mus musculus
gatgcaaaaccaaccttcagcatgg

SEQ ID NO: 512549 - DNA, 25 bp, Mus musculus
gatgcaaaaccatccttcagcatgg

SEQ ID NO: 512550 - DNA, 25 bp, Mus musculus
gatgcaaaagcaaccatgttctaag

SEQ ID NO: 512551 - DNA, 25 bp, Mus musculus
gatgcaaaagcatccatgttctaag

SEQ ID NO: 512552 - DNA, 25 bp, Mus musculus
gatgcaaaatatacaggtcttcctg

SEQ ID NO: 512553 - DNA, 25 bp, Mus musculus
gatgcaaaatattcaggtcttcctg

SEQ ID NO: 512554 - DNA, 25 bp, Mus musculus
gatgcaaaattgagctccttttata

SEQ ID NO: 512555 - DNA, 25 bp, Mus musculus
gatgcaaaattgtgctccttttata

SEQ ID NO: 512556 - DNA, 25 bp, Mus musculus
gatgcaaaccaaagctgattagttg

SEQ ID NO: 512557 - DNA, 25 bp, Mus musculus
gatgcaaaccaatgctgattagttg

SEQ ID NO: 512558 - DNA, 25 bp, Mus musculus
gatgcaaacccaccaatgagccctg

SEQ ID NO: 512559 - DNA, 25 bp, Mus musculus
gatgcaaacccagcaatgagccctg

SEQ ID NO: 512560 - DNA, 25 bp, Mus musculus
gatgcaaacctgagggctagctgtc

SEQ ID NO: 512561 - DNA, 25 bp, Mus musculus
gatgcaaacctgtgggctagctgtc

SEQ ID NO: 512562 - DNA, 25 bp, Mus musculus
gatgcaaacgctactggaggacgtc

SEQ ID NO: 512563 - DNA, 25 bp, Mus musculus
gatgcaaacgcttctggaggacgtc

SEQ ID NO: 512564 - DNA, 25 bp, Mus musculus
gatgcaaacggacgcccagcacgag

SEQ ID NO: 512565 - DNA, 25 bp, Mus musculus
gatgcaaacggaggcccagcacgag

SEQ ID NO: 512566 - DNA, 25 bp, Mus musculus
gatgcaaacggccagcactgattcc

SEQ ID NO: 512567 - DNA, 25 bp, Mus musculus
gatgcaaacggcgagcactgattcc

SEQ ID NO: 512568 - DNA, 25 bp, Mus musculus
gatgcaaagcaacacaccgatggac

SEQ ID NO: 512569 - DNA, 25 bp, Mus musculus
gatgcaaagcaagacaccgatggac

SEQ ID NO: 512570 - DNA, 25 bp, Mus musculus
gatgcaaagcctaagctcaagggtt

SEQ ID NO: 512571 - DNA, 25 bp, Mus musculus
gatgcaaagccttagctcaagggtt

SEQ ID NO: 512572 - DNA, 25 bp, Mus musculus
gatgcaaataccagatccattgtta

SEQ ID NO: 512573 - DNA, 25 bp, Mus musculus
gatgcaaatacctgatccattgtta

SEQ ID NO: 512574 - DNA, 25 bp, Mus musculus
gatgcaaatcctagatcgccgagct

SEQ ID NO: 512575 - DNA, 25 bp, Mus musculus
gatgcaaatccttgatcgccgagct

SEQ ID NO: 512576 - DNA, 25 bp, Mus musculus
gatgcaaatctcagtttccaaacgc

SEQ ID NO: 512577 - DNA, 25 bp, Mus musculus
gatgcaaatctctgtttccaaacgc

SEQ ID NO: 512578 - DNA, 25 bp, Mus musculus
gatgcaaatgggaatcattccattc

SEQ ID NO: 512579 - DNA, 25 bp, Mus musculus
gatgcaaatgggtatcattccattc

SEQ ID NO: 512580 - DNA, 25 bp, Mus musculus
gatgcaaatgtgctgagactccaca

SEQ ID NO: 512581 - DNA, 25 bp, Mus musculus
gatgcaaatgtggtgagactccaca

SEQ ID NO: 512582 - DNA, 25 bp, Mus musculus
gatgcaaatttcacagagtacctca

SEQ ID NO: 512583 - DNA, 25 bp, Mus musculus
gatgcaaatttcagttcgagagtca

SEQ ID NO: 512584 - DNA, 25 bp, Mus musculus
gatgcaaatttctcagagtacctca

SEQ ID NO: 512585 - DNA, 25 bp, Mus musculus
gatgcaaatttctgttcgagagtca

SEQ ID NO: 512586 - DNA, 25 bp, Mus musculus
gatgcaacacttatatgagtcttga

SEQ ID NO: 512587 - DNA, 25 bp, Mus musculus
gatgcaacacttttatgagtcttga

SEQ ID NO: 512588 - DNA, 25 bp, Mus musculus
gatgcaacagatcctcgcacgagtt

SEQ ID NO: 512589 - DNA, 25 bp, Mus musculus
gatgcaacagatgctcgcacgagtt

SEQ ID NO: 512590 - DNA, 25 bp, Mus musculus
gatgcaacaggccagtttctcagcc

SEQ ID NO: 512591 - DNA, 25 bp, Mus musculus
gatgcaacaggcgagtttctcagcc

SEQ ID NO: 512592 - DNA, 25 bp, Mus musculus
gatgcaacatctattctgatctccg

SEQ ID NO: 512593 - DNA, 25 bp, Mus musculus
gatgcaacatctcctttctgcacaa

SEQ ID NO: 512594 - DNA, 25 bp, Mus musculus
gatgcaacatctctgtagtgatcca

SEQ ID NO: 512595 - DNA, 25 bp, Mus musculus
gatgcaacatctgctttctgcacaa

SEQ ID NO: 512596 - DNA, 25 bp, Mus musculus
gatgcaacatctgtgtagtgatcca

SEQ ID NO: 512597 - DNA, 25 bp, Mus musculus
gatgcaacatcttttctgatctccg

SEQ ID NO: 512598 - DNA, 25 bp, Mus musculus
gatgcaacatgccattgcccgggag

SEQ ID NO: 512599 - DNA, 25 bp, Mus musculus
gatgcaacatgcgattgcccgggag

SEQ ID NO: 512600 - DNA, 25 bp, Mus musculus
gatgcaacattcattcgtgtttctt

SEQ ID NO: 512601 - DNA, 25 bp, Mus musculus
gatgcaacattctttcgtgtttctt

SEQ ID NO: 512602 - DNA, 25 bp, Mus musculus
gatgcaaccccactggattcttaaa

SEQ ID NO: 512603 - DNA, 25 bp, Mus musculus
gatgcaaccccagtggattcttaaa

SEQ ID NO: 512604 - DNA, 25 bp, Mus musculus
gatgcaacccttctaggagttccat

SEQ ID NO: 512605 - DNA, 25 bp, Mus musculus
gatgcaacccttgtaggagttccat

SEQ ID NO: 512606 - DNA, 25 bp, Mus musculus
gatgcaaccggaagaattctttggc

SEQ ID NO: 512607 - DNA, 25 bp, Mus musculus
gatgcaaccggatgaattctttggc

SEQ ID NO: 512608 - DNA, 25 bp, Mus musculus
gatgcaacctagagtctggctttaa

SEQ ID NO: 512609 - DNA, 25 bp, Mus musculus
gatgcaacctagtgtctggctttaa

SEQ ID NO: 512610 - DNA, 25 bp, Mus musculus
gatgcaacgagcacacaagaaacac

SEQ ID NO: 512611 - DNA, 25 bp, Mus musculus
gatgcaacgagctcacaagaaacac

SEQ ID NO: 512612 - DNA, 25 bp, Mus musculus
gatgcaacgattagcccagcagcac

SEQ ID NO: 512613 - DNA, 25 bp, Mus musculus
gatgcaacgatttgcccagcagcac

SEQ ID NO: 512614 - DNA, 25 bp, Mus musculus
gatgcaactaaaaataccagtgaaa

SEQ ID NO: 512615 - DNA, 25 bp, Mus musculus
gatgcaactaaatataccagtgaaa

SEQ ID NO: 512616 - DNA, 25 bp, Mus musculus
gatgcaactactaagaactatttta

SEQ ID NO: 512617 - DNA, 25 bp, Mus musculus
gatgcaactacttagaactatttta

SEQ ID NO: 512618 - DNA, 25 bp, Mus musculus
gatgcaactcagacacaacttgcta

SEQ ID NO: 512619 - DNA, 25 bp, Mus musculus
gatgcaactcagtcacaacttgcta

SEQ ID NO: 512620 - DNA, 25 bp, Mus musculus
gatgcaactgaacccagccgtggtt

SEQ ID NO: 512621 - DNA, 25 bp, Mus musculus
gatgcaactgaagccagccgtggtt

SEQ ID NO: 512622 - DNA, 25 bp, Mus musculus
gatgcaactgacattgagtcaccct

SEQ ID NO: 512623 - DNA, 25 bp, Mus musculus
gatgcaactgactttgagtcaccct

SEQ ID NO: 512624 - DNA, 25 bp, Mus musculus
gatgcaactggaaacactcctcaaa

SEQ ID NO: 512625 - DNA, 25 bp, Mus musculus
gatgcaactggatacactcctcaaa

SEQ ID NO: 512626 - DNA, 25 bp, Mus musculus
gatgcaagactgagctcaccagcaa

SEQ ID NO: 512627 - DNA, 25 bp, Mus musculus
gatgcaagactgtgctcaccagcaa

SEQ ID NO: 512628 - DNA, 25 bp, Mus musculus
gatgcaagcatcacatgtgaacagt

SEQ ID NO: 512629 - DNA, 25 bp, Mus musculus
gatgcaagcatctcatgtgaacagt

SEQ ID NO: 512630 - DNA, 25 bp, Mus musculus
gatgcaagctagacagtgactactt

SEQ ID NO: 512631 - DNA, 25 bp, Mus musculus
gatgcaagctagtcagtgactactt

SEQ ID NO: 512632 - DNA, 25 bp, Mus musculus
gatgcaagctatctccaacaacaag

SEQ ID NO: 512633 - DNA, 25 bp, Mus musculus
gatgcaagctatgtccaacaacaag

SEQ ID NO: 512634 - DNA, 25 bp, Mus musculus
gatgcaaggagcactccagggtcac

SEQ ID NO: 512635 - DNA, 25 bp, Mus musculus
gatgcaaggagcatccttaatacct

SEQ ID NO: 512636 - DNA, 25 bp, Mus musculus
gatgcaaggagctctccagggtcac

SEQ ID NO: 512637 - DNA, 25 bp, Mus musculus
gatgcaaggagcttccttaatacct

SEQ ID NO: 512638 - DNA, 25 bp, Mus musculus
gatgcaaggatcatccaaaggccct

SEQ ID NO: 512639 - DNA, 25 bp, Mus musculus
gatgcaaggatcttccaaaggccct

SEQ ID NO: 512640 - DNA, 25 bp, Mus musculus
gatgcaaggattacagaaactgatg

SEQ ID NO: 512641 - DNA, 25 bp, Mus musculus
gatgcaaggatttcagaaactgatg

SEQ ID NO: 512642 - DNA, 25 bp, Mus musculus
gatgcaaggcaaccccactatggtg

SEQ ID NO: 512643 - DNA, 25 bp, Mus musculus
gatgcaaggcaagcccactatggtg

SEQ ID NO: 512644 - DNA, 25 bp, Mus musculus
gatgcaaggcctacacagtttggaa

SEQ ID NO: 512645 - DNA, 25 bp, Mus musculus
gatgcaaggccttcacagtttggaa

SEQ ID NO: 512646 - DNA, 25 bp, Mus musculus
gatgcaagtcccagaagatttttag

SEQ ID NO: 512647 - DNA, 25 bp, Mus musculus
gatgcaagtccctgaagatttttag

SEQ ID NO: 512648 - DNA, 25 bp, Mus musculus
gatgcaataaatactccctctcaca

SEQ ID NO: 512649 - DNA, 25 bp, Mus musculus
gatgcaataaattctccctctcaca

SEQ ID NO: 512650 - DNA, 25 bp, Mus musculus
gatgcaatactaacttaatgtccct

SEQ ID NO: 512651 - DNA, 25 bp, Mus musculus
gatgcaatactatcttaatgtccct

SEQ ID NO: 512652 - DNA, 25 bp, Mus musculus
gatgcaatcactagtggacatgcgt

SEQ ID NO: 512653 - DNA, 25 bp, Mus musculus
gatgcaatcacttgtggacatgcgt

SEQ ID NO: 512654 - DNA, 25 bp, Mus musculus
gatgcaatccacagaggtcgcgccg

SEQ ID NO: 512655 - DNA, 25 bp, Mus musculus
gatgcaatccactgaggtcgcgccg

SEQ ID NO: 512656 - DNA, 25 bp, Mus musculus
gatgcaatcctaatgggttggtcca

SEQ ID NO: 512657 - DNA, 25 bp, Mus musculus
gatgcaatcctattgggttggtcca

SEQ ID NO: 512658 - DNA, 25 bp, Mus musculus
gatgcaatcgatcccttattattca

SEQ ID NO: 512659 - DNA, 25 bp, Mus musculus
gatgcaatcgatgccttattattca

SEQ ID NO: 512660 - DNA, 25 bp, Mus musculus
gatgcaatctgtccttcagacttgt

SEQ ID NO: 512661 - DNA, 25 bp, Mus musculus
gatgcaatctgtgcttcagacttgt

SEQ ID NO: 512662 - DNA, 25 bp, Mus musculus
gatgcaatgaccatatgtgcttagt

SEQ ID NO: 512663 - DNA, 25 bp, Mus musculus
gatgcaatgaccttatgtgcttagt

SEQ ID NO: 512664 - DNA, 25 bp, Mus musculus
gatgcaatgagtatgcagtttaaac

SEQ ID NO: 512665 - DNA, 25 bp, Mus musculus
gatgcaatgagtttgcagtttaaac

SEQ ID NO: 512666 - DNA, 25 bp, Mus musculus
gatgcaatgcagatttgcggccctg

SEQ ID NO: 512667 - DNA, 25 bp, Mus musculus
gatgcaatgcagttttgcggccctg

SEQ ID NO: 512668 - DNA, 25 bp, Mus musculus
gatgcaatggatccagaacctctca

SEQ ID NO: 512669 - DNA, 25 bp, Mus musculus
gatgcaatggatgcagaacctctca

SEQ ID NO: 512670 - DNA, 25 bp, Mus musculus
gatgcaatggcacagcttaatgaag

SEQ ID NO: 512671 - DNA, 25 bp, Mus musculus
gatgcaatggcagagcttaatgaag

SEQ ID NO: 512672 - DNA, 25 bp, Mus musculus
gatgcaatgtgccacttcactgtag

SEQ ID NO: 512673 - DNA, 25 bp, Mus musculus
gatgcaatgtgcgacttcactgtag

SEQ ID NO: 512674 - DNA, 25 bp, Mus musculus
gatgcaatgttcacgtagccacaat

SEQ ID NO: 512675 - DNA, 25 bp, Mus musculus
gatgcaatgttctcgtagccacaat

SEQ ID NO: 512676 - DNA, 25 bp, Mus musculus
gatgcaattaacatgttacagccca

SEQ ID NO: 512677 - DNA, 25 bp, Mus musculus
gatgcaattaacttgttacagccca

SEQ ID NO: 512678 - DNA, 25 bp, Mus musculus
gatgcaattatactacaccctcaca

SEQ ID NO: 512679 - DNA, 25 bp, Mus musculus
gatgcaattatagtacaccctcaca

SEQ ID NO: 512680 - DNA, 25 bp, Mus musculus
gatgcaattatcaccacatggtctc

SEQ ID NO: 512681 - DNA, 25 bp, Mus musculus
gatgcaattatctccacatggtctc

SEQ ID NO: 512682 - DNA, 25 bp, Mus musculus
gatgcaattgtcatcatagtgaaag

SEQ ID NO: 512683 - DNA, 25 bp, Mus musculus
gatgcaattgtcttcatagtgaaag

SEQ ID NO: 512684 - DNA, 25 bp, Mus musculus
gatgcacaaccaatgatttcatgat

SEQ ID NO: 512685 - DNA, 25 bp, Mus musculus
gatgcacaaccattgatttcatgat

SEQ ID NO: 512686 - DNA, 25 bp, Mus musculus
gatgcacaaccccttctggagtgag

SEQ ID NO: 512687 - DNA, 25 bp, Mus musculus
gatgcacaacccgttctggagtgag

SEQ ID NO: 512688 - DNA, 25 bp, Mus musculus
gatgcacaacctcactttgtaccta

SEQ ID NO: 512689 - DNA, 25 bp, Mus musculus
gatgcacaacctgactttgtaccta

SEQ ID NO: 512690 - DNA, 25 bp, Mus musculus
gatgcacaagcacgtgaccccgagg

SEQ ID NO: 512691 - DNA, 25 bp, Mus musculus
gatgcacaagcaggtgaccccgagg

SEQ ID NO: 512692 - DNA, 25 bp, Mus musculus
gatgcacaagccattctacaggtct

SEQ ID NO: 512693 - DNA, 25 bp, Mus musculus
gatgcacaagcctttctacaggtct

SEQ ID NO: 512694 - DNA, 25 bp, Mus musculus
gatgcacaagtgatgtcatgacgat

SEQ ID NO: 512695 - DNA, 25 bp, Mus musculus
gatgcacaagtgttgtcatgacgat

SEQ ID NO: 512696 - DNA, 25 bp, Mus musculus
gatgcacactcaaaagtctgggtcc

SEQ ID NO: 512697 - DNA, 25 bp, Mus musculus
gatgcacactcataagtctgggtcc

SEQ ID NO: 512698 - DNA, 25 bp, Mus musculus
gatgcacagactcgacaagctattg

SEQ ID NO: 512699 - DNA, 25 bp, Mus musculus
gatgcacagactggacaagctattg

SEQ ID NO: 512700 - DNA, 25 bp, Mus musculus
gatgcacagcggatgatcttaaagg

SEQ ID NO: 512701 - DNA, 25 bp, Mus musculus
gatgcacagcggttgatcttaaagg

SEQ ID NO: 512702 - DNA, 25 bp, Mus musculus
gatgcacaggacacggatccatgat

SEQ ID NO: 512703 - DNA, 25 bp, Mus musculus
gatgcacaggactcggatccatgat

SEQ ID NO: 512704 - DNA, 25 bp, Mus musculus
gatgcacaggatcctttagtcccca

SEQ ID NO: 512705 - DNA, 25 bp, Mus musculus
gatgcacaggatgctttagtcccca

SEQ ID NO: 512706 - DNA, 25 bp, Mus musculus
gatgcacagggaatgcaccaattat

SEQ ID NO: 512707 - DNA, 25 bp, Mus musculus
gatgcacagggattgcaccaattat

SEQ ID NO: 512708 - DNA, 25 bp, Mus musculus
gatgcacagggcctagggcctctcc

SEQ ID NO: 512709 - DNA, 25 bp, Mus musculus
gatgcacagggcgtagggcctctcc

SEQ ID NO: 512710 - DNA, 25 bp, Mus musculus
gatgcacaggtactccactctggaa

SEQ ID NO: 512711 - DNA, 25 bp, Mus musculus
gatgcacaggtagtccactctggaa

SEQ ID NO: 512712 - DNA, 25 bp, Mus musculus
gatgcacagtgcatcgtgatgctca

SEQ ID NO: 512713 - DNA, 25 bp, Mus musculus
gatgcacagtgcttcgtgatgctca

SEQ ID NO: 512714 - DNA, 25 bp, Mus musculus
gatgcacagttactccagatctact

SEQ ID NO: 512715 - DNA, 25 bp, Mus musculus
gatgcacagttagtccagatctact

SEQ ID NO: 512716 - DNA, 25 bp, Mus musculus
gatgcacatccaatgatttcccagt

SEQ ID NO: 512717 - DNA, 25 bp, Mus musculus
gatgcacatccacggatttccattt

SEQ ID NO: 512718 - DNA, 25 bp, Mus musculus
gatgcacatccagggatttccattt

SEQ ID NO: 512719 - DNA, 25 bp, Mus musculus
gatgcacatccattgatttcccagt

SEQ ID NO: 512720 - DNA, 25 bp, Mus musculus
gatgcacatggacaattttcaactg

SEQ ID NO: 512721 - DNA, 25 bp, Mus musculus
gatgcacatggagaattttcaactg

SEQ ID NO: 512722 - DNA, 25 bp, Mus musculus
gatgcacatgtgagtccgcccactt

SEQ ID NO: 512723 - DNA, 25 bp, Mus musculus
gatgcacatgtgtgtccgcccactt

SEQ ID NO: 512724 - DNA, 25 bp, Mus musculus
gatgcacattccagagacactaaag

SEQ ID NO: 512725 - DNA, 25 bp, Mus musculus
gatgcacattcctgagacactaaag

SEQ ID NO: 512726 - DNA, 25 bp, Mus musculus
gatgcaccaaggaagccagctgcag

SEQ ID NO: 512727 - DNA, 25 bp, Mus musculus
gatgcaccaaggtagccagctgcag

SEQ ID NO: 512728 - DNA, 25 bp, Mus musculus
gatgcaccacaaacacatcttatat

SEQ ID NO: 512729 - DNA, 25 bp, Mus musculus
gatgcaccacaatcacatcttatat

SEQ ID NO: 512730 - DNA, 25 bp, Mus musculus
gatgcaccactaatgagaactccta

SEQ ID NO: 512731 - DNA, 25 bp, Mus musculus
gatgcaccactaccaacacaaatga

SEQ ID NO: 512732 - DNA, 25 bp, Mus musculus
gatgcaccactagcaacacaaatga

SEQ ID NO: 512733 - DNA, 25 bp, Mus musculus
gatgcaccactattgagaactccta

SEQ ID NO: 512734 - DNA, 25 bp, Mus musculus
gatgcaccatccagatcggcacagt

SEQ ID NO: 512735 - DNA, 25 bp, Mus musculus
gatgcaccatcctgatcggcacagt

SEQ ID NO: 512736 - DNA, 25 bp, Mus musculus
gatgcaccattgaagatgtcaggct

SEQ ID NO: 512737 - DNA, 25 bp, Mus musculus
gatgcaccattgtagatgtcaggct

SEQ ID NO: 512738 - DNA, 25 bp, Mus musculus
gatgcaccatttagtggagaccttt

SEQ ID NO: 512739 - DNA, 25 bp, Mus musculus
gatgcaccattttgtggagaccttt

SEQ ID NO: 512740 - DNA, 25 bp, Mus musculus
gatgcacccacactttaaagtgctt

SEQ ID NO: 512741 - DNA, 25 bp, Mus musculus
gatgcacccacagtttaaagtgctt

SEQ ID NO: 512742 - DNA, 25 bp, Mus musculus
gatgcacccaggaactttcaacagt

SEQ ID NO: 512743 - DNA, 25 bp, Mus musculus
gatgcacccaggcttctgggagcct

SEQ ID NO: 512744 - DNA, 25 bp, Mus musculus
gatgcacccagggttctgggagcct

SEQ ID NO: 512745 - DNA, 25 bp, Mus musculus
gatgcacccaggtactttcaacagt

SEQ ID NO: 512746 - DNA, 25 bp, Mus musculus
gatgcacccgaaaccgggacgacaa

SEQ ID NO: 512747 - DNA, 25 bp, Mus musculus
gatgcacccgaatccgggacgacaa

SEQ ID NO: 512748 - DNA, 25 bp, Mus musculus
gatgcacccgtcattagaaccaaaa

SEQ ID NO: 512749 - DNA, 25 bp, Mus musculus
gatgcacccgtctttagaaccaaaa

SEQ ID NO: 512750 - DNA, 25 bp, Mus musculus
gatgcacctcacatgtccagactga

SEQ ID NO: 512751 - DNA, 25 bp, Mus musculus
gatgcacctcacttgtccagactga

SEQ ID NO: 512752 - DNA, 25 bp, Mus musculus
gatgcacctcagattcttgggttct

SEQ ID NO: 512753 - DNA, 25 bp, Mus musculus
gatgcacctcagtttcttgggttct

SEQ ID NO: 512754 - DNA, 25 bp, Mus musculus
gatgcacctgaaatggtacctcaca

SEQ ID NO: 512755 - DNA, 25 bp, Mus musculus
gatgcacctgaattggtacctcaca

SEQ ID NO: 512756 - DNA, 25 bp, Mus musculus
gatgcacctgatatcacgtttctac

SEQ ID NO: 512757 - DNA, 25 bp, Mus musculus
gatgcacctgatttcacgtttctac

SEQ ID NO: 512758 - DNA, 25 bp, Mus musculus
gatgcacctgcacatttgcacatga

SEQ ID NO: 512759 - DNA, 25 bp, Mus musculus
gatgcacctgcagatttgcacatga

SEQ ID NO: 512760 - DNA, 25 bp, Mus musculus
gatgcacctggcataggtgggtcat

SEQ ID NO: 512761 - DNA, 25 bp, Mus musculus
gatgcacctggcttaggtgggtcat

SEQ ID NO: 512762 - DNA, 25 bp, Mus musculus
gatgcacctggtaactgggcacaat

SEQ ID NO: 512763 - DNA, 25 bp, Mus musculus
gatgcacctggttactgggcacaat

SEQ ID NO: 512764 - DNA, 25 bp, Mus musculus
gatgcacctgtcatgagacagcccc

SEQ ID NO: 512765 - DNA, 25 bp, Mus musculus
gatgcacctgtcttgagacagcccc

SEQ ID NO: 512766 - DNA, 25 bp, Mus musculus
gatgcacctgttcatgtgtctgctt

SEQ ID NO: 512767 - DNA, 25 bp, Mus musculus
gatgcacctgttgatgtgtctgctt

SEQ ID NO: 512768 - DNA, 25 bp, Mus musculus
gatgcacgacgacgaataacctctc

SEQ ID NO: 512769 - DNA, 25 bp, Mus musculus
gatgcacgacgaggaataacctctc

SEQ ID NO: 512770 - DNA, 25 bp, Mus musculus
gatgcacgattcacacggcagacgc

SEQ ID NO: 512771 - DNA, 25 bp, Mus musculus
gatgcacgattctcacggcagacgc

SEQ ID NO: 512772 - DNA, 25 bp, Mus musculus
gatgcacgctagcatcgtgtgtgtc

SEQ ID NO: 512773 - DNA, 25 bp, Mus musculus
gatgcacgctaggatcgtgtgtgtc

SEQ ID NO: 512774 - DNA, 25 bp, Mus musculus
gatgcacgcttacagcgcagcagct

SEQ ID NO: 512775 - DNA, 25 bp, Mus musculus
gatgcacgcttagagcgcagcagct

SEQ ID NO: 512776 - DNA, 25 bp, Mus musculus
gatgcacggcgacatgagatgtcat

SEQ ID NO: 512777 - DNA, 25 bp, Mus musculus
gatgcacggcgagatgagatgtcat

SEQ ID NO: 512778 - DNA, 25 bp, Mus musculus
gatgcacgggccagcatcacagagc

SEQ ID NO: 512779 - DNA, 25 bp, Mus musculus
gatgcacgggcctgcatcacagagc

SEQ ID NO: 512780 - DNA, 25 bp, Mus musculus
gatgcactacatcgaaatttggcta

SEQ ID NO: 512781 - DNA, 25 bp, Mus musculus
gatgcactacatggaaatttggcta

SEQ ID NO: 512782 - DNA, 25 bp, Mus musculus
gatgcactactacactcatacgctg

SEQ ID NO: 512783 - DNA, 25 bp, Mus musculus
gatgcactactagactcatacgctg

SEQ ID NO: 512784 - DNA, 25 bp, Mus musculus
gatgcactatttactgtcctatact

SEQ ID NO: 512785 - DNA, 25 bp, Mus musculus
gatgcactattttctgtcctatact

SEQ ID NO: 512786 - DNA, 25 bp, Mus musculus
gatgcactcaccattgccgaagtat

SEQ ID NO: 512787 - DNA, 25 bp, Mus musculus
gatgcactcacctttgccgaagtat

SEQ ID NO: 512788 - DNA, 25 bp, Mus musculus
gatgcactcatgcagacagctgtca

SEQ ID NO: 512789 - DNA, 25 bp, Mus musculus
gatgcactcatggagacagctgtca

SEQ ID NO: 512790 - DNA, 25 bp, Mus musculus
gatgcactcattaaacgacgggaat

SEQ ID NO: 512791 - DNA, 25 bp, Mus musculus
gatgcactcatttaacgacgggaat

SEQ ID NO: 512792 - DNA, 25 bp, Mus musculus
gatgcactcctgaagatacccgaat

SEQ ID NO: 512793 - DNA, 25 bp, Mus musculus
gatgcactcctgtagatacccgaat

SEQ ID NO: 512794 - DNA, 25 bp, Mus musculus
gatgcactgaaacttattgaggaga

SEQ ID NO: 512795 - DNA, 25 bp, Mus musculus
gatgcactgaaagttattgaggaga

SEQ ID NO: 512796 - DNA, 25 bp, Mus musculus
gatgcactgatactctctcactggg

SEQ ID NO: 512797 - DNA, 25 bp, Mus musculus
gatgcactgatagtctctcactggg

SEQ ID NO: 512798 - DNA, 25 bp, Mus musculus
gatgcactgattcttctagccactt

SEQ ID NO: 512799 - DNA, 25 bp, Mus musculus
gatgcactgattgttctagccactt

SEQ ID NO: 512800 - DNA, 25 bp, Mus musculus
gatgcactgcagatggcacaaacaa

SEQ ID NO: 512801 - DNA, 25 bp, Mus musculus
gatgcactgcagttggcacaaacaa

SEQ ID NO: 512802 - DNA, 25 bp, Mus musculus
gatgcactgcatcgctagcagcagc

SEQ ID NO: 512803 - DNA, 25 bp, Mus musculus
gatgcactgcatggctagcagcagc

SEQ ID NO: 512804 - DNA, 25 bp, Mus musculus
gatgcactggatcccgagccttcta

SEQ ID NO: 512805 - DNA, 25 bp, Mus musculus
gatgcactggatgccgagccttcta

SEQ ID NO: 512806 - DNA, 25 bp, Mus musculus
gatgcactgggcaaagtaccgagtg

SEQ ID NO: 512807 - DNA, 25 bp, Mus musculus
gatgcactgggctaagtaccgagtg

SEQ ID NO: 512808 - DNA, 25 bp, Mus musculus
gatgcacttattcagccaaggtctg

SEQ ID NO: 512809 - DNA, 25 bp, Mus musculus
gatgcacttattgagccaaggtctg

SEQ ID NO: 512810 - DNA, 25 bp, Mus musculus
gatgcacttccaacccaaggctttg

SEQ ID NO: 512811 - DNA, 25 bp, Mus musculus
gatgcacttccacacttgtgactgt

SEQ ID NO: 512812 - DNA, 25 bp, Mus musculus
gatgcacttccagacttgtgactgt

SEQ ID NO: 512813 - DNA, 25 bp, Mus musculus
gatgcacttccatcccaaggctttg

SEQ ID NO: 512814 - DNA, 25 bp, Mus musculus
gatgcacttgccagcaactgagagt

SEQ ID NO: 512815 - DNA, 25 bp, Mus musculus
gatgcacttgcctgcaactgagagt

SEQ ID NO: 512816 - DNA, 25 bp, Mus musculus
gatgcactttggcaatatcctcgaa

SEQ ID NO: 512817 - DNA, 25 bp, Mus musculus
gatgcactttgggaatatcctcgaa

SEQ ID NO: 512818 - DNA, 25 bp, Mus musculus
gatgcagaaaataggctgtgccctc

SEQ ID NO: 512819 - DNA, 25 bp, Mus musculus
gatgcagaaaattggctgtgccctc

SEQ ID NO: 512820 - DNA, 25 bp, Mus musculus
gatgcagaaatccttttttcccatt

SEQ ID NO: 512821 - DNA, 25 bp, Mus musculus
gatgcagaaatcgttttttcccatt

SEQ ID NO: 512822 - DNA, 25 bp, Mus musculus
gatgcagaaattcagagctttcggg

SEQ ID NO: 512823 - DNA, 25 bp, Mus musculus
gatgcagaaattgagagctttcggg

SEQ ID NO: 512824 - DNA, 25 bp, Mus musculus
gatgcagaacatcaacccatgaggg

SEQ ID NO: 512825 - DNA, 25 bp, Mus musculus
gatgcagaacatgaacccatgaggg

SEQ ID NO: 512826 - DNA, 25 bp, Mus musculus
gatgcagaaccgctctatgattttg

SEQ ID NO: 512827 - DNA, 25 bp, Mus musculus
gatgcagaaccggtctatgattttg

SEQ ID NO: 512828 - DNA, 25 bp, Mus musculus
gatgcagaacgtctatagaataaac

SEQ ID NO: 512829 - DNA, 25 bp, Mus musculus
gatgcagaacgtgtatagaataaac

SEQ ID NO: 512830 - DNA, 25 bp, Mus musculus
gatgcagaactacactcggtcccca

SEQ ID NO: 512831 - DNA, 25 bp, Mus musculus
gatgcagaactacagctgctcacac

SEQ ID NO: 512832 - DNA, 25 bp, Mus musculus
gatgcagaactagactcggtcccca

SEQ ID NO: 512833 - DNA, 25 bp, Mus musculus
gatgcagaactagagctgctcacac

SEQ ID NO: 512834 - DNA, 25 bp, Mus musculus
gatgcagaactcacgggctggtgag

SEQ ID NO: 512835 - DNA, 25 bp, Mus musculus
gatgcagaactcctggaaattaaaa

SEQ ID NO: 512836 - DNA, 25 bp, Mus musculus
gatgcagaactcgtggaaattaaaa

SEQ ID NO: 512837 - DNA, 25 bp, Mus musculus
gatgcagaactctcgggctggtgag

SEQ ID NO: 512838 - DNA, 25 bp, Mus musculus
gatgcagaactgatgcctgcagaga

SEQ ID NO: 512839 - DNA, 25 bp, Mus musculus
gatgcagaactgttgcctgcagaga

SEQ ID NO: 512840 - DNA, 25 bp, Mus musculus
gatgcagaagaaaccaaaagttcaa

SEQ ID NO: 512841 - DNA, 25 bp, Mus musculus
gatgcagaagaaacttctccaccct

SEQ ID NO: 512842 - DNA, 25 bp, Mus musculus
gatgcagaagaatccaaaagttcaa

SEQ ID NO: 512843 - DNA, 25 bp, Mus musculus
gatgcagaagaatcttctccaccct

SEQ ID NO: 512844 - DNA, 25 bp, Mus musculus
gatgcagaagttatagtaacaagca

SEQ ID NO: 512845 - DNA, 25 bp, Mus musculus
gatgcagaagttttagtaacaagca

SEQ ID NO: 512846 - DNA, 25 bp, Mus musculus
gatgcagaatctccggagcctaagt

SEQ ID NO: 512847 - DNA, 25 bp, Mus musculus
gatgcagaatctgcggagcctaagt

SEQ ID NO: 512848 - DNA, 25 bp, Mus musculus
gatgcagacacgaattacaatgctg

SEQ ID NO: 512849 - DNA, 25 bp, Mus musculus
gatgcagacacgcacaactacactc

SEQ ID NO: 512850 - DNA, 25 bp, Mus musculus
gatgcagacacggacaactacactc

SEQ ID NO: 512851 - DNA, 25 bp, Mus musculus
gatgcagacacgtattacaatgctg

SEQ ID NO: 512852 - DNA, 25 bp, Mus musculus
gatgcagacctcagtgttgagccga

SEQ ID NO: 512853 - DNA, 25 bp, Mus musculus
gatgcagacctctgtgttgagccga

SEQ ID NO: 512854 - DNA, 25 bp, Mus musculus
gatgcagacggacccagtgttcctc

SEQ ID NO: 512855 - DNA, 25 bp, Mus musculus
gatgcagacggagccagtgttcctc

SEQ ID NO: 512856 - DNA, 25 bp, Mus musculus
gatgcagactgactgtgcctgacac

SEQ ID NO: 512857 - DNA, 25 bp, Mus musculus
gatgcagactgagtgtgcctgacac

SEQ ID NO: 512858 - DNA, 25 bp, Mus musculus
gatgcagagaaacccgtgatcgact

SEQ ID NO: 512859 - DNA, 25 bp, Mus musculus
gatgcagagaaagccgtgatcgact

SEQ ID NO: 512860 - DNA, 25 bp, Mus musculus
gatgcagaggagatggccgacttct

SEQ ID NO: 512861 - DNA, 25 bp, Mus musculus
gatgcagaggagttggccgacttct

SEQ ID NO: 512862 - DNA, 25 bp, Mus musculus
gatgcagagtctacaacaaacaccc

SEQ ID NO: 512863 - DNA, 25 bp, Mus musculus
gatgcagagtcttcaacaaacaccc

SEQ ID NO: 512864 - DNA, 25 bp, Mus musculus
gatgcagagtggcagcctatctcaa

SEQ ID NO: 512865 - DNA, 25 bp, Mus musculus
gatgcagagtgggagcctatctcaa

SEQ ID NO: 512866 - DNA, 25 bp, Mus musculus
gatgcagatcaactcctgggagctg

SEQ ID NO: 512867 - DNA, 25 bp, Mus musculus
gatgcagatcaagtcctgggagctg

SEQ ID NO: 512868 - DNA, 25 bp, Mus musculus
gatgcagatctgaaaaccactaaaa

SEQ ID NO: 512869 - DNA, 25 bp, Mus musculus
gatgcagatctgtaaaccactaaaa

SEQ ID NO: 512870 - DNA, 25 bp, Mus musculus
gatgcagatcttaggagctcattac

SEQ ID NO: 512871 - DNA, 25 bp, Mus musculus
gatgcagatctttggagctcattac

SEQ ID NO: 512872 - DNA, 25 bp, Mus musculus
gatgcagatgcccaccaagggacat

SEQ ID NO: 512873 - DNA, 25 bp, Mus musculus
gatgcagatgccgaccaagggacat

SEQ ID NO: 512874 - DNA, 25 bp, Mus musculus
gatgcagatgttccagagcctacct

SEQ ID NO: 512875 - DNA, 25 bp, Mus musculus
gatgcagatgttgcagagcctacct

SEQ ID NO: 512876 - DNA, 25 bp, Mus musculus
gatgcagcaactagtatccctgtcc

SEQ ID NO: 512877 - DNA, 25 bp, Mus musculus
gatgcagcaacttgtatccctgtcc

SEQ ID NO: 512878 - DNA, 25 bp, Mus musculus
gatgcagcacaacagacgtgttttt

SEQ ID NO: 512879 - DNA, 25 bp, Mus musculus
gatgcagcacaagagacgtgttttt

SEQ ID NO: 512880 - DNA, 25 bp, Mus musculus
gatgcagcacatcattgtatcttaa

SEQ ID NO: 512881 - DNA, 25 bp, Mus musculus
gatgcagcacatcccttttggtcaa

SEQ ID NO: 512882 - DNA, 25 bp, Mus musculus
gatgcagcacatgattgtatcttaa

SEQ ID NO: 512883 - DNA, 25 bp, Mus musculus
gatgcagcacatgccttttggtcaa

SEQ ID NO: 512884 - DNA, 25 bp, Mus musculus
gatgcagcagctaactcagaactgt

SEQ ID NO: 512885 - DNA, 25 bp, Mus musculus
gatgcagcagctctaagtagcccac

SEQ ID NO: 512886 - DNA, 25 bp, Mus musculus
gatgcagcagctgtaagtagcccac

SEQ ID NO: 512887 - DNA, 25 bp, Mus musculus
gatgcagcagcttactcagaactgt

SEQ ID NO: 512888 - DNA, 25 bp, Mus musculus
gatgcagcatccacataatggccat

SEQ ID NO: 512889 - DNA, 25 bp, Mus musculus
gatgcagcatcctcataatggccat

SEQ ID NO: 512890 - DNA, 25 bp, Mus musculus
gatgcagcatgccagtggccagaaa

SEQ ID NO: 512891 - DNA, 25 bp, Mus musculus
gatgcagcatgcgagtggccagaaa

SEQ ID NO: 512892 - DNA, 25 bp, Mus musculus
gatgcagcattacatcccttaatag

SEQ ID NO: 512893 - DNA, 25 bp, Mus musculus
gatgcagcattagatcccttaatag

SEQ ID NO: 512894 - DNA, 25 bp, Mus musculus
gatgcagccaccattgtatttcagg

SEQ ID NO: 512895 - DNA, 25 bp, Mus musculus
gatgcagccacctttgtatttcagg

SEQ ID NO: 512896 - DNA, 25 bp, Mus musculus
gatgcagcccaactgaatttcctgt

SEQ ID NO: 512897 - DNA, 25 bp, Mus musculus
gatgcagcccaagtgaatttcctgt

SEQ ID NO: 512898 - DNA, 25 bp, Mus musculus
gatgcagccctgcacaatactaaca

SEQ ID NO: 512899 - DNA, 25 bp, Mus musculus
gatgcagccctggacaatactaaca

SEQ ID NO: 512900 - DNA, 25 bp, Mus musculus
gatgcagccgttccaggcgaagttg

SEQ ID NO: 512901 - DNA, 25 bp, Mus musculus
gatgcagccgttgcaggcgaagttg

SEQ ID NO: 512902 - DNA, 25 bp, Mus musculus
gatgcagcctaaagagtctctttcc

SEQ ID NO: 512903 - DNA, 25 bp, Mus musculus
gatgcagcctaatgagtctctttcc

SEQ ID NO: 512904 - DNA, 25 bp, Mus musculus
gatgcagcctgaaggtatctggaaa

SEQ ID NO: 512905 - DNA, 25 bp, Mus musculus
gatgcagcctgatggtatctggaaa

SEQ ID NO: 512906 - DNA, 25 bp, Mus musculus
gatgcagcgaatcaaggccacggcc

SEQ ID NO: 512907 - DNA, 25 bp, Mus musculus
gatgcagcgaatgaaggccacggcc

SEQ ID NO: 512908 - DNA, 25 bp, Mus musculus
gatgcagctaaactaaacagtgctt

SEQ ID NO: 512909 - DNA, 25 bp, Mus musculus
gatgcagctaaagtaaacagtgctt

SEQ ID NO: 512910 - DNA, 25 bp, Mus musculus
gatgcagctaccattgacgtcacat

SEQ ID NO: 512911 - DNA, 25 bp, Mus musculus
gatgcagctacctttgacgtcacat

SEQ ID NO: 512912 - DNA, 25 bp, Mus musculus
gatgcagctcacactgactggtcag

SEQ ID NO: 512913 - DNA, 25 bp, Mus musculus
gatgcagctcactctgactggtcag

SEQ ID NO: 512914 - DNA, 25 bp, Mus musculus
gatgcagctcataggcagactgctt

SEQ ID NO: 512915 - DNA, 25 bp, Mus musculus
gatgcagctcattggcagactgctt

SEQ ID NO: 512916 - DNA, 25 bp, Mus musculus
gatgcagctctgatagagaaggact

SEQ ID NO: 512917 - DNA, 25 bp, Mus musculus
gatgcagctctgttagagaaggact

SEQ ID NO: 512918 - DNA, 25 bp, Mus musculus
gatgcagcttcaaatctttgtgatg

SEQ ID NO: 512919 - DNA, 25 bp, Mus musculus
gatgcagcttcatatctttgtgatg

SEQ ID NO: 512920 - DNA, 25 bp, Mus musculus
gatgcagcttgtaacacctgatatg

SEQ ID NO: 512921 - DNA, 25 bp, Mus musculus
gatgcagcttgttacacctgatatg

SEQ ID NO: 512922 - DNA, 25 bp, Mus musculus
gatgcagcttttaaaccagtagttc

SEQ ID NO: 512923 - DNA, 25 bp, Mus musculus
gatgcagctttttaaccagtagttc

SEQ ID NO: 512924 - DNA, 25 bp, Mus musculus
gatgcaggacctcaaggtgctctcc

SEQ ID NO: 512925 - DNA, 25 bp, Mus musculus
gatgcaggacctgaaggtgctctcc

SEQ ID NO: 512926 - DNA, 25 bp, Mus musculus
gatgcaggatcaagaggccctggaa

SEQ ID NO: 512927 - DNA, 25 bp, Mus musculus
gatgcaggatcatgaggccctggaa

SEQ ID NO: 512928 - DNA, 25 bp, Mus musculus
gatgcaggatctagggcctattacc

SEQ ID NO: 512929 - DNA, 25 bp, Mus musculus
gatgcaggatcttgggcctattacc

SEQ ID NO: 512930 - DNA, 25 bp, Mus musculus
gatgcaggcagaacctgtagcctct

SEQ ID NO: 512931 - DNA, 25 bp, Mus musculus
gatgcaggcagatcctgtagcctct

SEQ ID NO: 512932 - DNA, 25 bp, Mus musculus
gatgcaggcattactttggaagact

SEQ ID NO: 512933 - DNA, 25 bp, Mus musculus
gatgcaggcattataacttgtgttg

SEQ ID NO: 512934 - DNA, 25 bp, Mus musculus
gatgcaggcatttctttggaagact

SEQ ID NO: 512935 - DNA, 25 bp, Mus musculus
gatgcaggcattttaacttgtgttg

SEQ ID NO: 512936 - DNA, 25 bp, Mus musculus
gatgcaggcgtaatactattcagac

SEQ ID NO: 512937 - DNA, 25 bp, Mus musculus
gatgcaggcgtattactattcagac

SEQ ID NO: 512938 - DNA, 25 bp, Mus musculus
gatgcaggctagagtaatttggaac

SEQ ID NO: 512939 - DNA, 25 bp, Mus musculus
gatgcaggctagtgtaatttggaac

SEQ ID NO: 512940 - DNA, 25 bp, Mus musculus
gatgcagggactctgatatcctgac

SEQ ID NO: 512941 - DNA, 25 bp, Mus musculus
gatgcagggactgtgatatcctgac

SEQ ID NO: 512942 - DNA, 25 bp, Mus musculus
gatgcagggccaaacaaatgacgtt

SEQ ID NO: 512943 - DNA, 25 bp, Mus musculus
gatgcagggccaagaagatcagaac

SEQ ID NO: 512944 - DNA, 25 bp, Mus musculus
gatgcagggccatacaaatgacgtt

SEQ ID NO: 512945 - DNA, 25 bp, Mus musculus
gatgcagggccatgaagatcagaac

SEQ ID NO: 512946 - DNA, 25 bp, Mus musculus
gatgcagggtgaccactttgtgata

SEQ ID NO: 512947 - DNA, 25 bp, Mus musculus
gatgcagggtgagcactttgtgata

SEQ ID NO: 512948 - DNA, 25 bp, Mus musculus
gatgcagggtgcctcaaggacacac

SEQ ID NO: 512949 - DNA, 25 bp, Mus musculus
gatgcagggtgcgtcaaggacacac

SEQ ID NO: 512950 - DNA, 25 bp, Mus musculus
gatgcaggtatcctgtcctgtagaa

SEQ ID NO: 512951 - DNA, 25 bp, Mus musculus
gatgcaggtatcgtgtcctgtagaa

SEQ ID NO: 512952 - DNA, 25 bp, Mus musculus
gatgcaggtatgacgttacggattt

SEQ ID NO: 512953 - DNA, 25 bp, Mus musculus
gatgcaggtatgcttttgctattat

SEQ ID NO: 512954 - DNA, 25 bp, Mus musculus
gatgcaggtatggttttgctattat

SEQ ID NO: 512955 - DNA, 25 bp, Mus musculus
gatgcaggtatgtcgttacggattt

SEQ ID NO: 512956 - DNA, 25 bp, Mus musculus
gatgcaggtctgaccctggagaatg

SEQ ID NO: 512957 - DNA, 25 bp, Mus musculus
gatgcaggtctgtccctggagaatg

SEQ ID NO: 512958 - DNA, 25 bp, Mus musculus
gatgcaggtcttacttatacccaga

SEQ ID NO: 512959 - DNA, 25 bp, Mus musculus
gatgcaggtctttcttatacccaga

SEQ ID NO: 512960 - DNA, 25 bp, Mus musculus
gatgcaggtgtaaactgacatactc

SEQ ID NO: 512961 - DNA, 25 bp, Mus musculus
gatgcaggtgtatactgacatactc

SEQ ID NO: 512962 - DNA, 25 bp, Mus musculus
gatgcaggttcactttacaaaaata

SEQ ID NO: 512963 - DNA, 25 bp, Mus musculus
gatgcaggttcagtttacaaaaata

SEQ ID NO: 512964 - DNA, 25 bp, Mus musculus
gatgcaggttggacccagatttctc

SEQ ID NO: 512965 - DNA, 25 bp, Mus musculus
gatgcaggttggtcccagatttctc

SEQ ID NO: 512966 - DNA, 25 bp, Mus musculus
gatgcagtaaataaagtcttggccc

SEQ ID NO: 512967 - DNA, 25 bp, Mus musculus
gatgcagtaaattaagtcttggccc

SEQ ID NO: 512968 - DNA, 25 bp, Mus musculus
gatgcagtaacaattgagctggcct

SEQ ID NO: 512969 - DNA, 25 bp, Mus musculus
gatgcagtaacatttgagctggcct

SEQ ID NO: 512970 - DNA, 25 bp, Mus musculus
gatgcagtcaatatcctgctgctac

SEQ ID NO: 512971 - DNA, 25 bp, Mus musculus
gatgcagtcaatttcctgctgctac

SEQ ID NO: 512972 - DNA, 25 bp, Mus musculus
gatgcagtcattctcacaagagaca

SEQ ID NO: 512973 - DNA, 25 bp, Mus musculus
gatgcagtcattgtcacaagagaca

SEQ ID NO: 512974 - DNA, 25 bp, Mus musculus
gatgcagtccaaaagtcagacccca

SEQ ID NO: 512975 - DNA, 25 bp, Mus musculus
gatgcagtccaatagtcagacccca

SEQ ID NO: 512976 - DNA, 25 bp, Mus musculus
gatgcagtcctcaatttcaaaagac

SEQ ID NO: 512977 - DNA, 25 bp, Mus musculus
gatgcagtcctctatttcaaaagac

SEQ ID NO: 512978 - DNA, 25 bp, Mus musculus
gatgcagtcgagattcttacactca

SEQ ID NO: 512979 - DNA, 25 bp, Mus musculus
gatgcagtcgagtttcttacactca

SEQ ID NO: 512980 - DNA, 25 bp, Mus musculus
gatgcagtcggcagacggacccgaa

SEQ ID NO: 512981 - DNA, 25 bp, Mus musculus
gatgcagtcggctgacggacccgaa

SEQ ID NO: 512982 - DNA, 25 bp, Mus musculus
gatgcagtgaacacggctttctcaa

SEQ ID NO: 512983 - DNA, 25 bp, Mus musculus
gatgcagtgaactcggctttctcaa

SEQ ID NO: 512984 - DNA, 25 bp, Mus musculus
gatgcagtgaatcttgaaccattta

SEQ ID NO: 512985 - DNA, 25 bp, Mus musculus
gatgcagtgaatgttgaaccattta

SEQ ID NO: 512986 - DNA, 25 bp, Mus musculus
gatgcagtgagcaatgacaaacctt

SEQ ID NO: 512987 - DNA, 25 bp, Mus musculus
gatgcagtgagctatgacaaacctt

SEQ ID NO: 512988 - DNA, 25 bp, Mus musculus
gatgcagtgcatccatgcgtgccat

SEQ ID NO: 512989 - DNA, 25 bp, Mus musculus
gatgcagtgcatcttcttctaaaaa

SEQ ID NO: 512990 - DNA, 25 bp, Mus musculus
gatgcagtgcatgcatgcgtgccat

SEQ ID NO: 512991 - DNA, 25 bp, Mus musculus
gatgcagtgcatgttcttctaaaaa

SEQ ID NO: 512992 - DNA, 25 bp, Mus musculus
gatgcagtgcctatatggttttact

SEQ ID NO: 512993 - DNA, 25 bp, Mus musculus
gatgcagtgcctttatggttttact

SEQ ID NO: 512994 - DNA, 25 bp, Mus musculus
gatgcagtgctaatttccagcctag

SEQ ID NO: 512995 - DNA, 25 bp, Mus musculus
gatgcagtgctattttccagcctag

SEQ ID NO: 512996 - DNA, 25 bp, Mus musculus
gatgcagtgtgaaccttttccatta

SEQ ID NO: 512997 - DNA, 25 bp, Mus musculus
gatgcagtgtgatccttttccatta

SEQ ID NO: 512998 - DNA, 25 bp, Mus musculus
gatgcagttattctagccacattga

SEQ ID NO: 512999 - DNA, 25 bp, Mus musculus
gatgcagttattgtagccacattga

SEQ ID NO: 513000 - DNA, 25 bp, Mus musculus
gatgcagttcatcatctgtctgctg

SEQ ID NO: 513001 - DNA, 25 bp, Mus musculus
gatgcagttcatgatctgtctgctg

SEQ ID NO: 513002 - DNA, 25 bp, Mus musculus
gatgcagttcctaagaagcgcaaac

SEQ ID NO: 513003 - DNA, 25 bp, Mus musculus
gatgcagttccttagaagcgcaaac

SEQ ID NO: 513004 - DNA, 25 bp, Mus musculus
gatgcagttgtaaaagctcggataa

SEQ ID NO: 513005 - DNA, 25 bp, Mus musculus
gatgcagttgtataagctcggataa

SEQ ID NO: 513006 - DNA, 25 bp, Mus musculus
gatgcagtttctaagctttccaagc

SEQ ID NO: 513007 - DNA, 25 bp, Mus musculus
gatgcagtttcttagctttccaagc

SEQ ID NO: 513008 - DNA, 25 bp, Mus musculus
gatgcagtttgaagtgaacccacac

SEQ ID NO: 513009 - DNA, 25 bp, Mus musculus
gatgcagtttgaccacaacgctggc

SEQ ID NO: 513010 - DNA, 25 bp, Mus musculus
gatgcagtttgagcacaacgctggc

SEQ ID NO: 513011 - DNA, 25 bp, Mus musculus
gatgcagtttgatgtgaacccacac

SEQ ID NO: 513012 - DNA, 25 bp, Mus musculus
gatgcagttttcctaaatcttagtt

SEQ ID NO: 513013 - DNA, 25 bp, Mus musculus
gatgcagttttcgtaaatcttagtt

SEQ ID NO: 513014 - DNA, 25 bp, Mus musculus
gatgcataacagctattatctaggg

SEQ ID NO: 513015 - DNA, 25 bp, Mus musculus
gatgcataacaggtattatctaggg

SEQ ID NO: 513016 - DNA, 25 bp, Mus musculus
gatgcataattcatggaatcctttt

SEQ ID NO: 513017 - DNA, 25 bp, Mus musculus
gatgcataattcttggaatcctttt

SEQ ID NO: 513018 - DNA, 25 bp, Mus musculus
gatgcatactccctgtaacgagacg

SEQ ID NO: 513019 - DNA, 25 bp, Mus musculus
gatgcatactccgtgtaacgagacg

SEQ ID NO: 513020 - DNA, 25 bp, Mus musculus
gatgcatactgtattggtgttttaa

SEQ ID NO: 513021 - DNA, 25 bp, Mus musculus
gatgcatactgttttggtgttttaa

SEQ ID NO: 513022 - DNA, 25 bp, Mus musculus
gatgcatagcatagtgacccagggt

SEQ ID NO: 513023 - DNA, 25 bp, Mus musculus
gatgcatagcatcctccatgaatgg

SEQ ID NO: 513024 - DNA, 25 bp, Mus musculus
gatgcatagcatgctccatgaatgg

SEQ ID NO: 513025 - DNA, 25 bp, Mus musculus
gatgcatagcattgtgacccagggt

SEQ ID NO: 513026 - DNA, 25 bp, Mus musculus
gatgcatagcgtacggcactaggaa

SEQ ID NO: 513027 - DNA, 25 bp, Mus musculus
gatgcatagcgttcggcactaggaa

SEQ ID NO: 513028 - DNA, 25 bp, Mus musculus
gatgcatagcttccagagtaattga

SEQ ID NO: 513029 - DNA, 25 bp, Mus musculus
gatgcatagcttgcagagtaattga

SEQ ID NO: 513030 - DNA, 25 bp, Mus musculus
gatgcatagtttactccagtagacc

SEQ ID NO: 513031 - DNA, 25 bp, Mus musculus
gatgcatagttttctccagtagacc

SEQ ID NO: 513032 - DNA, 25 bp, Mus musculus
gatgcatatatgctggcctccgggc

SEQ ID NO: 513033 - DNA, 25 bp, Mus musculus
gatgcatatatggtggcctccgggc

SEQ ID NO: 513034 - DNA, 25 bp, Mus musculus
gatgcatatattatcacccacacca

SEQ ID NO: 513035 - DNA, 25 bp, Mus musculus
gatgcatatattttcacccacacca

SEQ ID NO: 513036 - DNA, 25 bp, Mus musculus
gatgcatatcttctataccatgttg

SEQ ID NO: 513037 - DNA, 25 bp, Mus musculus
gatgcatatcttgtataccatgttg

SEQ ID NO: 513038 - DNA, 25 bp, Mus musculus
gatgcatatgatcagcactattatt

SEQ ID NO: 513039 - DNA, 25 bp, Mus musculus
gatgcatatgatgagcactattatt

SEQ ID NO: 513040 - DNA, 25 bp, Mus musculus
gatgcatattccaaactactgtatt

SEQ ID NO: 513041 - DNA, 25 bp, Mus musculus
gatgcatattccaaggtttgatttt

SEQ ID NO: 513042 - DNA, 25 bp, Mus musculus
gatgcatattcctaactactgtatt

SEQ ID NO: 513043 - DNA, 25 bp, Mus musculus
gatgcatattcctaggtttgatttt

SEQ ID NO: 513044 - DNA, 25 bp, Mus musculus
gatgcatcaagaaaggaccctgaca

SEQ ID NO: 513045 - DNA, 25 bp, Mus musculus
gatgcatcaagataggaccctgaca

SEQ ID NO: 513046 - DNA, 25 bp, Mus musculus
gatgcatcaagcatcactttgtagg

SEQ ID NO: 513047 - DNA, 25 bp, Mus musculus
gatgcatcaagcttcactttgtagg

SEQ ID NO: 513048 - DNA, 25 bp, Mus musculus
gatgcatcacatcttgtatgaatat

SEQ ID NO: 513049 - DNA, 25 bp, Mus musculus
gatgcatcacatgttgtatgaatat

SEQ ID NO: 513050 - DNA, 25 bp, Mus musculus
gatgcatcacccacgtgtaactaag

SEQ ID NO: 513051 - DNA, 25 bp, Mus musculus
gatgcatcaccctcgtgtaactaag

SEQ ID NO: 513052 - DNA, 25 bp, Mus musculus
gatgcatcagccatggtccgctgaa

SEQ ID NO: 513053 - DNA, 25 bp, Mus musculus
gatgcatcagccatttgtgggatct

SEQ ID NO: 513054 - DNA, 25 bp, Mus musculus
gatgcatcagccttggtccgctgaa

SEQ ID NO: 513055 - DNA, 25 bp, Mus musculus
gatgcatcagccttttgtgggatct

SEQ ID NO: 513056 - DNA, 25 bp, Mus musculus
gatgcatcatatatgagcctcattg

SEQ ID NO: 513057 - DNA, 25 bp, Mus musculus
gatgcatcatatttgagcctcattg

SEQ ID NO: 513058 - DNA, 25 bp, Mus musculus
gatgcatcattgacttcctgttcaa

SEQ ID NO: 513059 - DNA, 25 bp, Mus musculus
gatgcatcattgtcttcctgttcaa

SEQ ID NO: 513060 - DNA, 25 bp, Mus musculus
gatgcatccaccatggagaacagct

SEQ ID NO: 513061 - DNA, 25 bp, Mus musculus
gatgcatccaccttggagaacagct

SEQ ID NO: 513062 - DNA, 25 bp, Mus musculus
gatgcatcccataatgacagtgaaa

SEQ ID NO: 513063 - DNA, 25 bp, Mus musculus
gatgcatcccattatgacagtgaaa

SEQ ID NO: 513064 - DNA, 25 bp, Mus musculus
gatgcatccggtcctgcagctgata

SEQ ID NO: 513065 - DNA, 25 bp, Mus musculus
gatgcatccggtgctgcagctgata

SEQ ID NO: 513066 - DNA, 25 bp, Mus musculus
gatgcatctaagaaagattaatcac

SEQ ID NO: 513067 - DNA, 25 bp, Mus musculus
gatgcatctaagtaagattaatcac

SEQ ID NO: 513068 - DNA, 25 bp, Mus musculus
gatgcatctagtaatccacacacga

SEQ ID NO: 513069 - DNA, 25 bp, Mus musculus
gatgcatctagttatccacacacga

SEQ ID NO: 513070 - DNA, 25 bp, Mus musculus
gatgcatctcggaaatactgctgac

SEQ ID NO: 513071 - DNA, 25 bp, Mus musculus
gatgcatctcggtaatactgctgac

SEQ ID NO: 513072 - DNA, 25 bp, Mus musculus
gatgcatctcgtataatcctgacaa

SEQ ID NO: 513073 - DNA, 25 bp, Mus musculus
gatgcatctcgtttaatcctgacaa

SEQ ID NO: 513074 - DNA, 25 bp, Mus musculus
gatgcatctgacactctagctttgc

SEQ ID NO: 513075 - DNA, 25 bp, Mus musculus
gatgcatctgactctctagctttgc

SEQ ID NO: 513076 - DNA, 25 bp, Mus musculus
gatgcatctgtgaatcctaacagca

SEQ ID NO: 513077 - DNA, 25 bp, Mus musculus
gatgcatctgtgtatcctaacagca

SEQ ID NO: 513078 - DNA, 25 bp, Mus musculus
gatgcatctgttacattttacacat

SEQ ID NO: 513079 - DNA, 25 bp, Mus musculus
gatgcatctgtttcattttacacat

SEQ ID NO: 513080 - DNA, 25 bp, Mus musculus
gatgcatcttctcctaagcaggctt

SEQ ID NO: 513081 - DNA, 25 bp, Mus musculus
gatgcatcttctgctaagcaggctt

SEQ ID NO: 513082 - DNA, 25 bp, Mus musculus
gatgcatcttgcatcattactttcc

SEQ ID NO: 513083 - DNA, 25 bp, Mus musculus
gatgcatcttgcctttctacatatt

SEQ ID NO: 513084 - DNA, 25 bp, Mus musculus
gatgcatcttgcgtttctacatatt

SEQ ID NO: 513085 - DNA, 25 bp, Mus musculus
gatgcatcttgcttcattactttcc

SEQ ID NO: 513086 - DNA, 25 bp, Mus musculus
gatgcatgattcaagtttgtccaat

SEQ ID NO: 513087 - DNA, 25 bp, Mus musculus
gatgcatgattctagtttgtccaat

SEQ ID NO: 513088 - DNA, 25 bp, Mus musculus
gatgcatgccgccttcagtagctgc

SEQ ID NO: 513089 - DNA, 25 bp, Mus musculus
gatgcatgccgcgttcagtagctgc

SEQ ID NO: 513090 - DNA, 25 bp, Mus musculus
gatgcatgcgaaataaccaaactca

SEQ ID NO: 513091 - DNA, 25 bp, Mus musculus
gatgcatgcgaattaaccaaactca

SEQ ID NO: 513092 - DNA, 25 bp, Mus musculus
gatgcatgctttcattggacagcgt

SEQ ID NO: 513093 - DNA, 25 bp, Mus musculus
gatgcatgctttgattggacagcgt

SEQ ID NO: 513094 - DNA, 25 bp, Mus musculus
gatgcatgtcaaacgcttaatcctt

SEQ ID NO: 513095 - DNA, 25 bp, Mus musculus
gatgcatgtcaatcgcttaatcctt

SEQ ID NO: 513096 - DNA, 25 bp, Mus musculus
gatgcatgtgagacatttcaccaaa

SEQ ID NO: 513097 - DNA, 25 bp, Mus musculus
gatgcatgtgagtcatttcaccaaa

SEQ ID NO: 513098 - DNA, 25 bp, Mus musculus
gatgcatgtggacagccagtcccat

SEQ ID NO: 513099 - DNA, 25 bp, Mus musculus
gatgcatgtggagagccagtcccat

SEQ ID NO: 513100 - DNA, 25 bp, Mus musculus
gatgcatgttctacaggcagcttgg

SEQ ID NO: 513101 - DNA, 25 bp, Mus musculus
gatgcatgttcttcaggcagcttgg

SEQ ID NO: 513102 - DNA, 25 bp, Mus musculus
gatgcatgtttgagcttcttgggct

SEQ ID NO: 513103 - DNA, 25 bp, Mus musculus
gatgcatgtttgtgcttcttgggct

SEQ ID NO: 513104 - DNA, 25 bp, Mus musculus
gatgcattaaagacaccatgtgaat

SEQ ID NO: 513105 - DNA, 25 bp, Mus musculus
gatgcattaaagtcaccatgtgaat

SEQ ID NO: 513106 - DNA, 25 bp, Mus musculus
gatgcattaagcagctacctggtgg

SEQ ID NO: 513107 - DNA, 25 bp, Mus musculus
gatgcattaagctgctacctggtgg

SEQ ID NO: 513108 - DNA, 25 bp, Mus musculus
gatgcattacagatcctgtgtggat

SEQ ID NO: 513109 - DNA, 25 bp, Mus musculus
gatgcattacagttcctgtgtggat

SEQ ID NO: 513110 - DNA, 25 bp, Mus musculus
gatgcattatcaccccagggatttt

SEQ ID NO: 513111 - DNA, 25 bp, Mus musculus
gatgcattatcactaactcccagaa

SEQ ID NO: 513112 - DNA, 25 bp, Mus musculus
gatgcattatcagcccagggatttt

SEQ ID NO: 513113 - DNA, 25 bp, Mus musculus
gatgcattatcagtaactcccagaa

SEQ ID NO: 513114 - DNA, 25 bp, Mus musculus
gatgcattatttagctacttttcaa

SEQ ID NO: 513115 - DNA, 25 bp, Mus musculus
gatgcattattttgctacttttcaa

SEQ ID NO: 513116 - DNA, 25 bp, Mus musculus
gatgcattcaatactcaggtcacag

SEQ ID NO: 513117 - DNA, 25 bp, Mus musculus
gatgcattcaatcgctacttttttc

SEQ ID NO: 513118 - DNA, 25 bp, Mus musculus
gatgcattcaatggctacttttttc

SEQ ID NO: 513119 - DNA, 25 bp, Mus musculus
gatgcattcaattctcaggtcacag

SEQ ID NO: 513120 - DNA, 25 bp, Mus musculus
gatgcattcagtcctgtgataaact

SEQ ID NO: 513121 - DNA, 25 bp, Mus musculus
gatgcattcagtgctgtgataaact

SEQ ID NO: 513122 - DNA, 25 bp, Mus musculus
gatgcattcattatcttgggattaa

SEQ ID NO: 513123 - DNA, 25 bp, Mus musculus
gatgcattcattttcttgggattaa

SEQ ID NO: 513124 - DNA, 25 bp, Mus musculus
gatgcattccaacggtttcttcctt

SEQ ID NO: 513125 - DNA, 25 bp, Mus musculus
gatgcattccaagggtttcttcctt

SEQ ID NO: 513126 - DNA, 25 bp, Mus musculus
gatgcattccgtccctgttatttta

SEQ ID NO: 513127 - DNA, 25 bp, Mus musculus
gatgcattccgtgcctgttatttta

SEQ ID NO: 513128 - DNA, 25 bp, Mus musculus
gatgcattcctactgctctgagagc

SEQ ID NO: 513129 - DNA, 25 bp, Mus musculus
gatgcattcctagtgctctgagagc

SEQ ID NO: 513130 - DNA, 25 bp, Mus musculus
gatgcattcctgagagactggctgg

SEQ ID NO: 513131 - DNA, 25 bp, Mus musculus
gatgcattcctgtgagactggctgg

SEQ ID NO: 513132 - DNA, 25 bp, Mus musculus
gatgcattccttcaagggctgcact

SEQ ID NO: 513133 - DNA, 25 bp, Mus musculus
gatgcattccttgaagggctgcact

SEQ ID NO: 513134 - DNA, 25 bp, Mus musculus
gatgcattctgtactgtcagttgcc

SEQ ID NO: 513135 - DNA, 25 bp, Mus musculus
gatgcattctgttctgtcagttgcc

SEQ ID NO: 513136 - DNA, 25 bp, Mus musculus
gatgcattgcttcctttaaaagaca

SEQ ID NO: 513137 - DNA, 25 bp, Mus musculus
gatgcattgcttgctttaaaagaca

SEQ ID NO: 513138 - DNA, 25 bp, Mus musculus
gatgcattgggtcatgtctccagag

SEQ ID NO: 513139 - DNA, 25 bp, Mus musculus
gatgcattgggtgatgtctccagag

SEQ ID NO: 513140 - DNA, 25 bp, Mus musculus
gatgcattggttatcttacctccaa

SEQ ID NO: 513141 - DNA, 25 bp, Mus musculus
gatgcattggttttcttacctccaa

SEQ ID NO: 513142 - DNA, 25 bp, Mus musculus
gatgcattgtggactcacagtcaca

SEQ ID NO: 513143 - DNA, 25 bp, Mus musculus
gatgcattgtggtctcacagtcaca

SEQ ID NO: 513144 - DNA, 25 bp, Mus musculus
gatgcattgttaactgtttcccagg

SEQ ID NO: 513145 - DNA, 25 bp, Mus musculus
gatgcattgttatctgtttcccagg

SEQ ID NO: 513146 - DNA, 25 bp, Mus musculus
gatgcatttctaaatttgtgtatga

SEQ ID NO: 513147 - DNA, 25 bp, Mus musculus
gatgcatttctatatttgtgtatga

SEQ ID NO: 513148 - DNA, 25 bp, Mus musculus
gatgcatttcttcttaacttcagtg

SEQ ID NO: 513149 - DNA, 25 bp, Mus musculus
gatgcatttcttgttaacttcagtg

SEQ ID NO: 513150 - DNA, 25 bp, Mus musculus
gatgcatttgtcagctgtaattttt

SEQ ID NO: 513151 - DNA, 25 bp, Mus musculus
gatgcatttgtctgctgtaattttt

SEQ ID NO: 513152 - DNA, 25 bp, Mus musculus
gatgcatttgtgcactcttggcaga

SEQ ID NO: 513153 - DNA, 25 bp, Mus musculus
gatgcatttgtggactcttggcaga

SEQ ID NO: 513154 - DNA, 25 bp, Mus musculus
gatgcattttcaaaacagtttccct

SEQ ID NO: 513155 - DNA, 25 bp, Mus musculus
gatgcattttcataacagtttccct

SEQ ID NO: 513156 - DNA, 25 bp, Mus musculus
gatgcattttctcagctgtgtcaag

SEQ ID NO: 513157 - DNA, 25 bp, Mus musculus
gatgcattttctgagctgtgtcaag

SEQ ID NO: 513158 - DNA, 25 bp, Mus musculus
gatgcattttgtacatttccccttt

SEQ ID NO: 513159 - DNA, 25 bp, Mus musculus
gatgcattttgttcatttccccttt

SEQ ID NO: 513160 - DNA, 25 bp, Mus musculus
gatgccaaaaggacactttcccatt

SEQ ID NO: 513161 - DNA, 25 bp, Mus musculus
gatgccaaaaggtcactttcccatt

SEQ ID NO: 513162 - DNA, 25 bp, Mus musculus
gatgccaaagatatactgccaacct

SEQ ID NO: 513163 - DNA, 25 bp, Mus musculus
gatgccaaagatttactgccaacct

SEQ ID NO: 513164 - DNA, 25 bp, Mus musculus
gatgccaaagcccaggtgaagacag

SEQ ID NO: 513165 - DNA, 25 bp, Mus musculus
gatgccaaagccgaggtgaagacag

SEQ ID NO: 513166 - DNA, 25 bp, Mus musculus
gatgccaaaggaacttatccagtga

SEQ ID NO: 513167 - DNA, 25 bp, Mus musculus
gatgccaaaggatcttatccagtga

SEQ ID NO: 513168 - DNA, 25 bp, Mus musculus
gatgccaaatctagggaaactttcc

SEQ ID NO: 513169 - DNA, 25 bp, Mus musculus
gatgccaaatcttgggaaactttcc

SEQ ID NO: 513170 - DNA, 25 bp, Mus musculus
gatgccaacaaccaatagctgtgag

SEQ ID NO: 513171 - DNA, 25 bp, Mus musculus
gatgccaacaacgaatagctgtgag

SEQ ID NO: 513172 - DNA, 25 bp, Mus musculus
gatgccaacagacgactattcggag

SEQ ID NO: 513173 - DNA, 25 bp, Mus musculus
gatgccaacagaggactattcggag

SEQ ID NO: 513174 - DNA, 25 bp, Mus musculus
gatgccaaccatcacttcctggtaa

SEQ ID NO: 513175 - DNA, 25 bp, Mus musculus
gatgccaaccatgacttcctggtaa

SEQ ID NO: 513176 - DNA, 25 bp, Mus musculus
gatgccaaccccagggactgcagtt

SEQ ID NO: 513177 - DNA, 25 bp, Mus musculus
gatgccaacccctgggactgcagtt

SEQ ID NO: 513178 - DNA, 25 bp, Mus musculus
gatgccaactgcctgctccaaggga

SEQ ID NO: 513179 - DNA, 25 bp, Mus musculus
gatgccaactgcgtgctccaaggga

SEQ ID NO: 513180 - DNA, 25 bp, Mus musculus
gatgccaactgtacataggacccta

SEQ ID NO: 513181 - DNA, 25 bp, Mus musculus
gatgccaactgttcataggacccta

SEQ ID NO: 513182 - DNA, 25 bp, Mus musculus
gatgccaagactcctgaatgtccac

SEQ ID NO: 513183 - DNA, 25 bp, Mus musculus
gatgccaagactgctgaatgtccac

SEQ ID NO: 513184 - DNA, 25 bp, Mus musculus
gatgccaagatcctgaatgacgttc

SEQ ID NO: 513185 - DNA, 25 bp, Mus musculus
gatgccaagatcgtgaatgacgttc

SEQ ID NO: 513186 - DNA, 25 bp, Mus musculus
gatgccaagattcactcactgatga

SEQ ID NO: 513187 - DNA, 25 bp, Mus musculus
gatgccaagattgactcactgatga

SEQ ID NO: 513188 - DNA, 25 bp, Mus musculus
gatgccaaggacagcacagatcttc

SEQ ID NO: 513189 - DNA, 25 bp, Mus musculus
gatgccaaggactgcacagatcttc

SEQ ID NO: 513190 - DNA, 25 bp, Mus musculus
gatgccaagtctagcggattcccgg

SEQ ID NO: 513191 - DNA, 25 bp, Mus musculus
gatgccaagtcttgcggattcccgg

SEQ ID NO: 513192 - DNA, 25 bp, Mus musculus
gatgccaagtgtatcaattcatatt

SEQ ID NO: 513193 - DNA, 25 bp, Mus musculus
gatgccaagtgtttcaattcatatt

SEQ ID NO: 513194 - DNA, 25 bp, Mus musculus
gatgccaagtttcagccattaaatt

SEQ ID NO: 513195 - DNA, 25 bp, Mus musculus
gatgccaagtttgagccattaaatt

SEQ ID NO: 513196 - DNA, 25 bp, Mus musculus
gatgccaataatctctgccacctat

SEQ ID NO: 513197 - DNA, 25 bp, Mus musculus
gatgccaataatgtctgccacctat

SEQ ID NO: 513198 - DNA, 25 bp, Mus musculus
gatgccaatacaatcctgcttcaaa

SEQ ID NO: 513199 - DNA, 25 bp, Mus musculus
gatgccaatacattcctgcttcaaa

SEQ ID NO: 513200 - DNA, 25 bp, Mus musculus
gatgccaatcaacccgaggcggaga

SEQ ID NO: 513201 - DNA, 25 bp, Mus musculus
gatgccaatcaagccgaggcggaga

SEQ ID NO: 513202 - DNA, 25 bp, Mus musculus
gatgccaatctgatttctctgctgc

SEQ ID NO: 513203 - DNA, 25 bp, Mus musculus
gatgccaatctgttttctctgctgc

SEQ ID NO: 513204 - DNA, 25 bp, Mus musculus
gatgccaatggccatctgctgcaga

SEQ ID NO: 513205 - DNA, 25 bp, Mus musculus
gatgccaatggcgatctgctgcaga

SEQ ID NO: 513206 - DNA, 25 bp, Mus musculus
gatgccaatgggaatattcagcaga

SEQ ID NO: 513207 - DNA, 25 bp, Mus musculus
gatgccaatgggtatattcagcaga

SEQ ID NO: 513208 - DNA, 25 bp, Mus musculus
gatgccaatttaccctctgtgtgtt

SEQ ID NO: 513209 - DNA, 25 bp, Mus musculus
gatgccaatttagcctctgtgtgtt

SEQ ID NO: 513210 - DNA, 25 bp, Mus musculus
gatgccaattttatagctccgaaga

SEQ ID NO: 513211 - DNA, 25 bp, Mus musculus
gatgccaattttttagctccgaaga

SEQ ID NO: 513212 - DNA, 25 bp, Mus musculus
gatgccacaaagaaatccgacatgt

SEQ ID NO: 513213 - DNA, 25 bp, Mus musculus
gatgccacaaagtaatccgacatgt

SEQ ID NO: 513214 - DNA, 25 bp, Mus musculus
gatgccacaactagtcctgctgaca

SEQ ID NO: 513215 - DNA, 25 bp, Mus musculus
gatgccacaacttgtcctgctgaca

SEQ ID NO: 513216 - DNA, 25 bp, Mus musculus
gatgccacaatcataagagcctctg

SEQ ID NO: 513217 - DNA, 25 bp, Mus musculus
gatgccacaatcttaagagcctctg

SEQ ID NO: 513218 - DNA, 25 bp, Mus musculus
gatgccacacagaggcagctctctg

SEQ ID NO: 513219 - DNA, 25 bp, Mus musculus
gatgccacacagtggcagctctctg

SEQ ID NO: 513220 - DNA, 25 bp, Mus musculus
gatgccacaccacgaggtaaccaat

SEQ ID NO: 513221 - DNA, 25 bp, Mus musculus
gatgccacaccaggaggtaaccaat

SEQ ID NO: 513222 - DNA, 25 bp, Mus musculus
gatgccacagacatagggccatatt

SEQ ID NO: 513223 - DNA, 25 bp, Mus musculus
gatgccacagacttagggccatatt

SEQ ID NO: 513224 - DNA, 25 bp, Mus musculus
gatgccacagcacaacgtcttgctg

SEQ ID NO: 513225 - DNA, 25 bp, Mus musculus
gatgccacagcagaacgtcttgctg

SEQ ID NO: 513226 - DNA, 25 bp, Mus musculus
gatgccacagccaatgatgtgcctt

SEQ ID NO: 513227 - DNA, 25 bp, Mus musculus
gatgccacagcctatgatgtgcctt

SEQ ID NO: 513228 - DNA, 25 bp, Mus musculus
gatgccacagctcatgttatatcta

SEQ ID NO: 513229 - DNA, 25 bp, Mus musculus
gatgccacagctgatgttatatcta

SEQ ID NO: 513230 - DNA, 25 bp, Mus musculus
gatgccacagtgaatcgtgtctcta

SEQ ID NO: 513231 - DNA, 25 bp, Mus musculus
gatgccacagtgtatcgtgtctcta

SEQ ID NO: 513232 - DNA, 25 bp, Mus musculus
gatgccacatggactctgtgtgaca

SEQ ID NO: 513233 - DNA, 25 bp, Mus musculus
gatgccacatggtctctgtgtgaca

SEQ ID NO: 513234 - DNA, 25 bp, Mus musculus
gatgccacatttatcatgaagaacc

SEQ ID NO: 513235 - DNA, 25 bp, Mus musculus
gatgccacatttttcatgaagaacc

SEQ ID NO: 513236 - DNA, 25 bp, Mus musculus
gatgccaccagaattacccagatgt

SEQ ID NO: 513237 - DNA, 25 bp, Mus musculus
gatgccaccagatttacccagatgt

SEQ ID NO: 513238 - DNA, 25 bp, Mus musculus
gatgccacccatccgtgaatgttga

SEQ ID NO: 513239 - DNA, 25 bp, Mus musculus
gatgccacccatctattttgtatgt

SEQ ID NO: 513240 - DNA, 25 bp, Mus musculus
gatgccacccatgcgtgaatgttga

SEQ ID NO: 513241 - DNA, 25 bp, Mus musculus
gatgccacccatgtattttgtatgt

SEQ ID NO: 513242 - DNA, 25 bp, Mus musculus
gatgccacccgacaggagtcagact

SEQ ID NO: 513243 - DNA, 25 bp, Mus musculus
gatgccacccgagaggagtcagact

SEQ ID NO: 513244 - DNA, 25 bp, Mus musculus
gatgccaccgttcccaggagggaca

SEQ ID NO: 513245 - DNA, 25 bp, Mus musculus
gatgccaccgttgccaggagggaca

SEQ ID NO: 513246 - DNA, 25 bp, Mus musculus
gatgccacctgactcttagatgttg

SEQ ID NO: 513247 - DNA, 25 bp, Mus musculus
gatgccacctgagtcttagatgttg

SEQ ID NO: 513248 - DNA, 25 bp, Mus musculus
gatgccacctgtatcgaggttgaca

SEQ ID NO: 513249 - DNA, 25 bp, Mus musculus
gatgccacctgtttcgaggttgaca

SEQ ID NO: 513250 - DNA, 25 bp, Mus musculus
gatgccacgaatcctgcagtttctc

SEQ ID NO: 513251 - DNA, 25 bp, Mus musculus
gatgccacgaatgctgcagtttctc

SEQ ID NO: 513252 - DNA, 25 bp, Mus musculus
gatgccacggttcctataacttatt

SEQ ID NO: 513253 - DNA, 25 bp, Mus musculus
gatgccacggttgctataacttatt

SEQ ID NO: 513254 - DNA, 25 bp, Mus musculus
gatgccactaagcacacttacgtca

SEQ ID NO: 513255 - DNA, 25 bp, Mus musculus
gatgccactaaggacacttacgtca

SEQ ID NO: 513256 - DNA, 25 bp, Mus musculus
gatgccactcagctagtagacggat

SEQ ID NO: 513257 - DNA, 25 bp, Mus musculus
gatgccactcaggtagtagacggat

SEQ ID NO: 513258 - DNA, 25 bp, Mus musculus
gatgccactcttatagttatgctgt

SEQ ID NO: 513259 - DNA, 25 bp, Mus musculus
gatgccactcttttagttatgctgt

SEQ ID NO: 513260 - DNA, 25 bp, Mus musculus
gatgccactggaagggcacagctgt

SEQ ID NO: 513261 - DNA, 25 bp, Mus musculus
gatgccactggatgggcacagctgt

SEQ ID NO: 513262 - DNA, 25 bp, Mus musculus
gatgccagaaacctcagcgtggtca

SEQ ID NO: 513263 - DNA, 25 bp, Mus musculus
gatgccagaaacgtcagcgtggtca

SEQ ID NO: 513264 - DNA, 25 bp, Mus musculus
gatgccagacacatcacattgttct

SEQ ID NO: 513265 - DNA, 25 bp, Mus musculus
gatgccagacacttcacattgttct

SEQ ID NO: 513266 - DNA, 25 bp, Mus musculus
gatgccagacgcatggttctgagga

SEQ ID NO: 513267 - DNA, 25 bp, Mus musculus
gatgccagacgcttggttctgagga

SEQ ID NO: 513268 - DNA, 25 bp, Mus musculus
gatgccagactaacacgtctaaatg

SEQ ID NO: 513269 - DNA, 25 bp, Mus musculus
gatgccagactatcacgtctaaatg

SEQ ID NO: 513270 - DNA, 25 bp, Mus musculus
gatgccagactcacaaggagcctga

SEQ ID NO: 513271 - DNA, 25 bp, Mus musculus
gatgccagactctcaaggagcctga

SEQ ID NO: 513272 - DNA, 25 bp, Mus musculus
gatgccagagaaccctgtccagcag

SEQ ID NO: 513273 - DNA, 25 bp, Mus musculus
gatgccagagaagcctgtccagcag

SEQ ID NO: 513274 - DNA, 25 bp, Mus musculus
gatgccagagacatgtctgctaaag

SEQ ID NO: 513275 - DNA, 25 bp, Mus musculus
gatgccagagacttgtctgctaaag

SEQ ID NO: 513276 - DNA, 25 bp, Mus musculus
gatgccagaggaagttctcagattt

SEQ ID NO: 513277 - DNA, 25 bp, Mus musculus
gatgccagaggatgttctcagattt

SEQ ID NO: 513278 - DNA, 25 bp, Mus musculus
gatgccagaggcacccgaggtactg

SEQ ID NO: 513279 - DNA, 25 bp, Mus musculus
gatgccagaggctcccgaggtactg

SEQ ID NO: 513280 - DNA, 25 bp, Mus musculus
gatgccagagttcagccgtgaagct

SEQ ID NO: 513281 - DNA, 25 bp, Mus musculus
gatgccagagttgagccgtgaagct

SEQ ID NO: 513282 - DNA, 25 bp, Mus musculus
gatgccagcaacagcacagaatgca

SEQ ID NO: 513283 - DNA, 25 bp, Mus musculus
gatgccagcaactgcacagaatgca

SEQ ID NO: 513284 - DNA, 25 bp, Mus musculus
gatgccagcaagcagtccctgagac

SEQ ID NO: 513285 - DNA, 25 bp, Mus musculus
gatgccagcaaggagtccctgagac

SEQ ID NO: 513286 - DNA, 25 bp, Mus musculus
gatgccagctatcttgcttctgaaa

SEQ ID NO: 513287 - DNA, 25 bp, Mus musculus
gatgccagctatgttgcttctgaaa

SEQ ID NO: 513288 - DNA, 25 bp, Mus musculus
gatgccagctgtccatgagcagaaa

SEQ ID NO: 513289 - DNA, 25 bp, Mus musculus
gatgccagctgtgcatgagcagaaa

SEQ ID NO: 513290 - DNA, 25 bp, Mus musculus
gatgccaggacgactatctatctgt

SEQ ID NO: 513291 - DNA, 25 bp, Mus musculus
gatgccaggacgcagttgtttcgat

SEQ ID NO: 513292 - DNA, 25 bp, Mus musculus
gatgccaggacggagttgtttcgat

SEQ ID NO: 513293 - DNA, 25 bp, Mus musculus
gatgccaggacgtctatctatctgt

SEQ ID NO: 513294 - DNA, 25 bp, Mus musculus
gatgccaggagtctgtttctgtcag

SEQ ID NO: 513295 - DNA, 25 bp, Mus musculus
gatgccaggagtgtgtttctgtcag

SEQ ID NO: 513296 - DNA, 25 bp, Mus musculus
gatgccaggccgagtcagagcccag

SEQ ID NO: 513297 - DNA, 25 bp, Mus musculus
gatgccaggccgtgtcagagcccag

SEQ ID NO: 513298 - DNA, 25 bp, Mus musculus
gatgccagtacaagaaccacagagc

SEQ ID NO: 513299 - DNA, 25 bp, Mus musculus
gatgccagtacatgaaccacagagc

SEQ ID NO: 513300 - DNA, 25 bp, Mus musculus
gatgccagtattccatgcccgagga

SEQ ID NO: 513301 - DNA, 25 bp, Mus musculus
gatgccagtattgcatgcccgagga

SEQ ID NO: 513302 - DNA, 25 bp, Mus musculus
gatgccagtctaaagcgggtaccag

SEQ ID NO: 513303 - DNA, 25 bp, Mus musculus
gatgccagtctatagcgggtaccag

SEQ ID NO: 513304 - DNA, 25 bp, Mus musculus
gatgccagtgacaaggtattcgaag

SEQ ID NO: 513305 - DNA, 25 bp, Mus musculus
gatgccagtgactaggtattcgaag

SEQ ID NO: 513306 - DNA, 25 bp, Mus musculus
gatgccagtgctctacggagttttc

SEQ ID NO: 513307 - DNA, 25 bp, Mus musculus
gatgccagtgctgtacggagttttc

SEQ ID NO: 513308 - DNA, 25 bp, Mus musculus
gatgccagtgttcctagtctctggt

SEQ ID NO: 513309 - DNA, 25 bp, Mus musculus
gatgccagtgttgctagtctctggt

SEQ ID NO: 513310 - DNA, 25 bp, Mus musculus
gatgccagttgcagactttgtaaat

SEQ ID NO: 513311 - DNA, 25 bp, Mus musculus
gatgccagttgctgactttgtaaat

SEQ ID NO: 513312 - DNA, 25 bp, Mus musculus
gatgccataaaacgagccagtacac

SEQ ID NO: 513313 - DNA, 25 bp, Mus musculus
gatgccataaaaggagccagtacac

SEQ ID NO: 513314 - DNA, 25 bp, Mus musculus
gatgccataaagcatctcccagcct

SEQ ID NO: 513315 - DNA, 25 bp, Mus musculus
gatgccataaaggatctcccagcct

SEQ ID NO: 513316 - DNA, 25 bp, Mus musculus
gatgccataaatacgtgtgtcacag

SEQ ID NO: 513317 - DNA, 25 bp, Mus musculus
gatgccataaattcgtgtgtcacag

SEQ ID NO: 513318 - DNA, 25 bp, Mus musculus
gatgccatactgaaaaagcccctgc

SEQ ID NO: 513319 - DNA, 25 bp, Mus musculus
gatgccatactgtaaaagcccctgc

SEQ ID NO: 513320 - DNA, 25 bp, Mus musculus
gatgccatagctcttctgaatagta

SEQ ID NO: 513321 - DNA, 25 bp, Mus musculus
gatgccatagctgttctgaatagta

SEQ ID NO: 513322 - DNA, 25 bp, Mus musculus
gatgccatatccctctaaatctagt

SEQ ID NO: 513323 - DNA, 25 bp, Mus musculus
gatgccatatccgtctaaatctagt

SEQ ID NO: 513324 - DNA, 25 bp, Mus musculus
gatgccatattacaggccaactaat

SEQ ID NO: 513325 - DNA, 25 bp, Mus musculus
gatgccatattagaggccaactaat

SEQ ID NO: 513326 - DNA, 25 bp, Mus musculus
gatgccatattgaagaggttttgtc

SEQ ID NO: 513327 - DNA, 25 bp, Mus musculus
gatgccatattgtagaggttttgtc

SEQ ID NO: 513328 - DNA, 25 bp, Mus musculus
gatgccatcagcatcgcttttatag

SEQ ID NO: 513329 - DNA, 25 bp, Mus musculus
gatgccatcagcttcgcttttatag

SEQ ID NO: 513330 - DNA, 25 bp, Mus musculus
gatgccatccaaatatcatttcatt

SEQ ID NO: 513331 - DNA, 25 bp, Mus musculus
gatgccatccaattatcatttcatt

SEQ ID NO: 513332 - DNA, 25 bp, Mus musculus
gatgccatccagactattagaccca

SEQ ID NO: 513333 - DNA, 25 bp, Mus musculus
gatgccatccagtctattagaccca

SEQ ID NO: 513334 - DNA, 25 bp, Mus musculus
gatgccatccttcctcaggagaagt

SEQ ID NO: 513335 - DNA, 25 bp, Mus musculus
gatgccatccttgctcaggagaagt

SEQ ID NO: 513336 - DNA, 25 bp, Mus musculus
gatgccatcgatcccctcatgaaga

SEQ ID NO: 513337 - DNA, 25 bp, Mus musculus
gatgccatcgatgccctcatgaaga

SEQ ID NO: 513338 - DNA, 25 bp, Mus musculus
gatgccatcgtgagtcctctggagt

SEQ ID NO: 513339 - DNA, 25 bp, Mus musculus
gatgccatcgtgtgtcctctggagt

SEQ ID NO: 513340 - DNA, 25 bp, Mus musculus
gatgccatctccattttggttgacc

SEQ ID NO: 513341 - DNA, 25 bp, Mus musculus
gatgccatctcctttttggttgacc

SEQ ID NO: 513342 - DNA, 25 bp, Mus musculus
gatgccatgaagaagccgtggacat

SEQ ID NO: 513343 - DNA, 25 bp, Mus musculus
gatgccatgaagaagtcaaccgata

SEQ ID NO: 513344 - DNA, 25 bp, Mus musculus
gatgccatgaagtagccgtggacat

SEQ ID NO: 513345 - DNA, 25 bp, Mus musculus
gatgccatgaagtagtcaaccgata

SEQ ID NO: 513346 - DNA, 25 bp, Mus musculus
gatgccatgccgattactttaagag

SEQ ID NO: 513347 - DNA, 25 bp, Mus musculus
gatgccatgccgtttactttaagag

SEQ ID NO: 513348 - DNA, 25 bp, Mus musculus
gatgccatggcaatctttgaaaacc

SEQ ID NO: 513349 - DNA, 25 bp, Mus musculus
gatgccatggcattctttgaaaacc

SEQ ID NO: 513350 - DNA, 25 bp, Mus musculus
gatgccatgggcacctccagccaag

SEQ ID NO: 513351 - DNA, 25 bp, Mus musculus
gatgccatgggctcctccagccaag

SEQ ID NO: 513352 - DNA, 25 bp, Mus musculus
gatgccatgtgtccatttgaagctg

SEQ ID NO: 513353 - DNA, 25 bp, Mus musculus
gatgccatgtgtgcatttgaagctg

SEQ ID NO: 513354 - DNA, 25 bp, Mus musculus
gatgccatgtttacagatagcttct

SEQ ID NO: 513355 - DNA, 25 bp, Mus musculus
gatgccatgtttaggcctctctgga

SEQ ID NO: 513356 - DNA, 25 bp, Mus musculus
gatgccatgttttcagatagcttct

SEQ ID NO: 513357 - DNA, 25 bp, Mus musculus
gatgccatgttttggcctctctgga

SEQ ID NO: 513358 - DNA, 25 bp, Mus musculus
gatgccattactctgcaggcttgga

SEQ ID NO: 513359 - DNA, 25 bp, Mus musculus
gatgccattactgtgcaggcttgga

SEQ ID NO: 513360 - DNA, 25 bp, Mus musculus
gatgccattattcggacggacgctc

SEQ ID NO: 513361 - DNA, 25 bp, Mus musculus
gatgccattattgggacggacgctc

SEQ ID NO: 513362 - DNA, 25 bp, Mus musculus
gatgccattcatctgtaattcctgg

SEQ ID NO: 513363 - DNA, 25 bp, Mus musculus
gatgccattcatgtgtaattcctgg

SEQ ID NO: 513364 - DNA, 25 bp, Mus musculus
gatgccattcctaagagctggactc

SEQ ID NO: 513365 - DNA, 25 bp, Mus musculus
gatgccattccttagagctggactc

SEQ ID NO: 513366 - DNA, 25 bp, Mus musculus
gatgccattcttctggattcagcaa

SEQ ID NO: 513367 - DNA, 25 bp, Mus musculus
gatgccattcttgtggattcagcaa

SEQ ID NO: 513368 - DNA, 25 bp, Mus musculus
gatgccattgagaaactccatccta

SEQ ID NO: 513369 - DNA, 25 bp, Mus musculus
gatgccattgagtaactccatccta

SEQ ID NO: 513370 - DNA, 25 bp, Mus musculus
gatgccattgcgacactatggtgaa

SEQ ID NO: 513371 - DNA, 25 bp, Mus musculus
gatgccattgcgtcactatggtgaa

SEQ ID NO: 513372 - DNA, 25 bp, Mus musculus
gatgccattggcatgaggtcacatg

SEQ ID NO: 513373 - DNA, 25 bp, Mus musculus
gatgccattggcttgaggtcacatg

SEQ ID NO: 513374 - DNA, 25 bp, Mus musculus
gatgccatttcactgtcagcaagag

SEQ ID NO: 513375 - DNA, 25 bp, Mus musculus
gatgccatttcagtgtcagcaagag

SEQ ID NO: 513376 - DNA, 25 bp, Mus musculus
gatgcccaactgatgtgtagctctt

SEQ ID NO: 513377 - DNA, 25 bp, Mus musculus
gatgcccaactgttgtgtagctctt

SEQ ID NO: 513378 - DNA, 25 bp, Mus musculus
gatgcccaaggcaacagcagaacta

SEQ ID NO: 513379 - DNA, 25 bp, Mus musculus
gatgcccaaggcaagggtacccgag

SEQ ID NO: 513380 - DNA, 25 bp, Mus musculus
gatgcccaaggctacagcagaacta

SEQ ID NO: 513381 - DNA, 25 bp, Mus musculus
gatgcccaaggctagggtacccgag

SEQ ID NO: 513382 - DNA, 25 bp, Mus musculus
gatgcccaagggagtgggttcctcc

SEQ ID NO: 513383 - DNA, 25 bp, Mus musculus
gatgcccaagggtgtgggttcctcc

SEQ ID NO: 513384 - DNA, 25 bp, Mus musculus
gatgcccaatccatgtttcttgtgg

SEQ ID NO: 513385 - DNA, 25 bp, Mus musculus
gatgcccaatccttgtttcttgtgg

SEQ ID NO: 513386 - DNA, 25 bp, Mus musculus
gatgcccaatgcagagaccgctaca

SEQ ID NO: 513387 - DNA, 25 bp, Mus musculus
gatgcccaatgctgagaccgctaca

SEQ ID NO: 513388 - DNA, 25 bp, Mus musculus
gatgcccaatggcaagacctacttc

SEQ ID NO: 513389 - DNA, 25 bp, Mus musculus
gatgcccaatgggaagacctacttc

SEQ ID NO: 513390 - DNA, 25 bp, Mus musculus
gatgcccaatgtccaaatgcaatcc

SEQ ID NO: 513391 - DNA, 25 bp, Mus musculus
gatgcccaatgtgcaaatgcaatcc

SEQ ID NO: 513392 - DNA, 25 bp, Mus musculus
gatgcccacccactgtggaaatgga

SEQ ID NO: 513393 - DNA, 25 bp, Mus musculus
gatgcccacccagtgtggaaatgga

SEQ ID NO: 513394 - DNA, 25 bp, Mus musculus
gatgcccacgcactcagaggtggac

SEQ ID NO: 513395 - DNA, 25 bp, Mus musculus
gatgcccacgcagtcagaggtggac

SEQ ID NO: 513396 - DNA, 25 bp, Mus musculus
gatgcccactatcccaagataatga

SEQ ID NO: 513397 - DNA, 25 bp, Mus musculus
gatgcccactatgccaagataatga

SEQ ID NO: 513398 - DNA, 25 bp, Mus musculus
gatgcccactgaccaatctcaaaat

SEQ ID NO: 513399 - DNA, 25 bp, Mus musculus
gatgcccactgagcaatctcaaaat

SEQ ID NO: 513400 - DNA, 25 bp, Mus musculus
gatgcccactgcagatagggtgacc

SEQ ID NO: 513401 - DNA, 25 bp, Mus musculus
gatgcccactgctgatagggtgacc

SEQ ID NO: 513402 - DNA, 25 bp, Mus musculus
gatgcccagcctattataaaaatgt

SEQ ID NO: 513403 - DNA, 25 bp, Mus musculus
gatgcccagccttttataaaaatgt

SEQ ID NO: 513404 - DNA, 25 bp, Mus musculus
gatgcccaggctatgagagcttgtt

SEQ ID NO: 513405 - DNA, 25 bp, Mus musculus
gatgcccaggctttgagagcttgtt

SEQ ID NO: 513406 - DNA, 25 bp, Mus musculus
gatgcccagggaatgaactctagtt

SEQ ID NO: 513407 - DNA, 25 bp, Mus musculus
gatgcccagggattgaactctagtt

SEQ ID NO: 513408 - DNA, 25 bp, Mus musculus
gatgcccagggcaatgtgttaaagc

SEQ ID NO: 513409 - DNA, 25 bp, Mus musculus
gatgcccagggctatgtgttaaagc

SEQ ID NO: 513410 - DNA, 25 bp, Mus musculus
gatgcccatccaaagaaagtgccta

SEQ ID NO: 513411 - DNA, 25 bp, Mus musculus
gatgcccatccatagaaagtgccta

SEQ ID NO: 513412 - DNA, 25 bp, Mus musculus
gatgcccatccgcaatgtgtacaaa

SEQ ID NO: 513413 - DNA, 25 bp, Mus musculus
gatgcccatccggaatgtgtacaaa

SEQ ID NO: 513414 - DNA, 25 bp, Mus musculus
gatgcccatggaagaattctgtgtt

SEQ ID NO: 513415 - DNA, 25 bp, Mus musculus
gatgcccatggatgaattctgtgtt

SEQ ID NO: 513416 - DNA, 25 bp, Mus musculus
gatgcccatggcaccacgagtcttg

SEQ ID NO: 513417 - DNA, 25 bp, Mus musculus
gatgcccatggctccacgagtcttg

SEQ ID NO: 513418 - DNA, 25 bp, Mus musculus
gatgcccatgttcgcggccctggtt

SEQ ID NO: 513419 - DNA, 25 bp, Mus musculus
gatgcccatgttggcggccctggtt

SEQ ID NO: 513420 - DNA, 25 bp, Mus musculus
gatgcccattcacacatgagagcct

SEQ ID NO: 513421 - DNA, 25 bp, Mus musculus
gatgcccattcagacatgagagcct

SEQ ID NO: 513422 - DNA, 25 bp, Mus musculus
gatgcccattttagttcttcagaaa

SEQ ID NO: 513423 - DNA, 25 bp, Mus musculus
gatgcccattttccagcagttattt

SEQ ID NO: 513424 - DNA, 25 bp, Mus musculus
gatgcccattttgcagcagttattt

SEQ ID NO: 513425 - DNA, 25 bp, Mus musculus
gatgcccatttttgttcttcagaaa

SEQ ID NO: 513426 - DNA, 25 bp, Mus musculus
gatgccccaactctggaacccatta

SEQ ID NO: 513427 - DNA, 25 bp, Mus musculus
gatgccccaactgtggaacccatta

SEQ ID NO: 513428 - DNA, 25 bp, Mus musculus
gatgccccacacaagagggcggttt

SEQ ID NO: 513429 - DNA, 25 bp, Mus musculus
gatgccccacactagagggcggttt

SEQ ID NO: 513430 - DNA, 25 bp, Mus musculus
gatgccccataacacagatctgtgc

SEQ ID NO: 513431 - DNA, 25 bp, Mus musculus
gatgccccataagacagatctgtgc

SEQ ID NO: 513432 - DNA, 25 bp, Mus musculus
gatgccccgcagctcgatgtagact

SEQ ID NO: 513433 - DNA, 25 bp, Mus musculus
gatgccccgcaggtcgatgtagact

SEQ ID NO: 513434 - DNA, 25 bp, Mus musculus
gatgccccggaccagttcagagacc

SEQ ID NO: 513435 - DNA, 25 bp, Mus musculus
gatgccccggacgagttcagagacc

SEQ ID NO: 513436 - DNA, 25 bp, Mus musculus
gatgccccggtactgtctttttgga

SEQ ID NO: 513437 - DNA, 25 bp, Mus musculus
gatgccccggtagtgtctttttgga

SEQ ID NO: 513438 - DNA, 25 bp, Mus musculus
gatgcccctaaaagtttgcctgtaa

SEQ ID NO: 513439 - DNA, 25 bp, Mus musculus
gatgcccctaaatgtttgcctgtaa

SEQ ID NO: 513440 - DNA, 25 bp, Mus musculus
gatgcccctataagtagtaccttcg

SEQ ID NO: 513441 - DNA, 25 bp, Mus musculus
gatgcccctatatgtagtaccttcg

SEQ ID NO: 513442 - DNA, 25 bp, Mus musculus
gatgcccctcttagagcattataca

SEQ ID NO: 513443 - DNA, 25 bp, Mus musculus
gatgcccctctttgagcattataca

SEQ ID NO: 513444 - DNA, 25 bp, Mus musculus
gatgcccctttaaaagacattacgg

SEQ ID NO: 513445 - DNA, 25 bp, Mus musculus
gatgcccctttataagacattacgg

SEQ ID NO: 513446 - DNA, 25 bp, Mus musculus
gatgcccgacatccacacctggata

SEQ ID NO: 513447 - DNA, 25 bp, Mus musculus
gatgcccgacatgcacacctggata

SEQ ID NO: 513448 - DNA, 25 bp, Mus musculus
gatgcccgcagtattcttgactaaa

SEQ ID NO: 513449 - DNA, 25 bp, Mus musculus
gatgcccgcagttttcttgactaaa

SEQ ID NO: 513450 - DNA, 25 bp, Mus musculus
gatgcccggaccacccatgatgaga

SEQ ID NO: 513451 - DNA, 25 bp, Mus musculus
gatgcccggacctcccatgatgaga

SEQ ID NO: 513452 - DNA, 25 bp, Mus musculus
gatgcccggatgctgatgtaccaac

SEQ ID NO: 513453 - DNA, 25 bp, Mus musculus
gatgcccggatggtgatgtaccaac

SEQ ID NO: 513454 - DNA, 25 bp, Mus musculus
gatgcccgggaaaaggctcttgctc

SEQ ID NO: 513455 - DNA, 25 bp, Mus musculus
gatgcccgggaataggctcttgctc

SEQ ID NO: 513456 - DNA, 25 bp, Mus musculus
gatgccctaaagctgtattatgtta

SEQ ID NO: 513457 - DNA, 25 bp, Mus musculus
gatgccctaaaggtgtattatgtta

SEQ ID NO: 513458 - DNA, 25 bp, Mus musculus
gatgccctactgagtatttgcatta

SEQ ID NO: 513459 - DNA, 25 bp, Mus musculus
gatgccctactgtgtatttgcatta

SEQ ID NO: 513460 - DNA, 25 bp, Mus musculus
gatgccctaggaagtttattattga

SEQ ID NO: 513461 - DNA, 25 bp, Mus musculus
gatgccctaggatgtttattattga

SEQ ID NO: 513462 - DNA, 25 bp, Mus musculus
gatgccctattaacttcagaactcc

SEQ ID NO: 513463 - DNA, 25 bp, Mus musculus
gatgccctattatcttcagaactcc

SEQ ID NO: 513464 - DNA, 25 bp, Mus musculus
gatgccctcaacctgcacagaagta

SEQ ID NO: 513465 - DNA, 25 bp, Mus musculus
gatgccctcaacgtgcacagaagta

SEQ ID NO: 513466 - DNA, 25 bp, Mus musculus
gatgccctcgatcaacatgtgtcac

SEQ ID NO: 513467 - DNA, 25 bp, Mus musculus
gatgccctcgatgaacatgtgtcac

SEQ ID NO: 513468 - DNA, 25 bp, Mus musculus
gatgccctctataagcagatcagct

SEQ ID NO: 513469 - DNA, 25 bp, Mus musculus
gatgccctctattagcagatcagct

SEQ ID NO: 513470 - DNA, 25 bp, Mus musculus
gatgccctgagcagacaagtttcaa

SEQ ID NO: 513471 - DNA, 25 bp, Mus musculus
gatgccctgagccaagtgtgcctgc

SEQ ID NO: 513472 - DNA, 25 bp, Mus musculus
gatgccctgagcgaagtgtgcctgc

SEQ ID NO: 513473 - DNA, 25 bp, Mus musculus
gatgccctgagctgacaagtttcaa

SEQ ID NO: 513474 - DNA, 25 bp, Mus musculus
gatgccctgagtctccaagatcctt

SEQ ID NO: 513475 - DNA, 25 bp, Mus musculus
gatgccctgagtgtccaagatcctt

SEQ ID NO: 513476 - DNA, 25 bp, Mus musculus
gatgccctgcatccctgtatgaggt

SEQ ID NO: 513477 - DNA, 25 bp, Mus musculus
gatgccctgcatgcctgtatgaggt

SEQ ID NO: 513478 - DNA, 25 bp, Mus musculus
gatgccctgcctagtttttaatgtc

SEQ ID NO: 513479 - DNA, 25 bp, Mus musculus
gatgccctgccttgtttttaatgtc

SEQ ID NO: 513480 - DNA, 25 bp, Mus musculus
gatgccctgcgcaggatgccgaagc

SEQ ID NO: 513481 - DNA, 25 bp, Mus musculus
gatgccctgcgctggatgccgaagc

SEQ ID NO: 513482 - DNA, 25 bp, Mus musculus
gatgccctggacctaactgatgtgg

SEQ ID NO: 513483 - DNA, 25 bp, Mus musculus
gatgccctggacgtaactgatgtgg

SEQ ID NO: 513484 - DNA, 25 bp, Mus musculus
gatgccctggcaatgtagattacca

SEQ ID NO: 513485 - DNA, 25 bp, Mus musculus
gatgccctggcattgtagattacca

SEQ ID NO: 513486 - DNA, 25 bp, Mus musculus
gatgccctggcgctaagttcaccag

SEQ ID NO: 513487 - DNA, 25 bp, Mus musculus
gatgccctggcggtaagttcaccag

SEQ ID NO: 513488 - DNA, 25 bp, Mus musculus
gatgccctggtaaacttcaccgtct

SEQ ID NO: 513489 - DNA, 25 bp, Mus musculus
gatgccctggtatacttcaccgtct

SEQ ID NO: 513490 - DNA, 25 bp, Mus musculus
gatgccctggtcaggagtgtctgaa

SEQ ID NO: 513491 - DNA, 25 bp, Mus musculus
gatgccctggtctggagtgtctgaa

SEQ ID NO: 513492 - DNA, 25 bp, Mus musculus
gatgccctggttcctagtgccaaag

SEQ ID NO: 513493 - DNA, 25 bp, Mus musculus
gatgccctggttgctagtgccaaag

SEQ ID NO: 513494 - DNA, 25 bp, Mus musculus
gatgccctgtatcttaatgtagaaa

SEQ ID NO: 513495 - DNA, 25 bp, Mus musculus
gatgccctgtatgttaatgtagaaa

SEQ ID NO: 513496 - DNA, 25 bp, Mus musculus
gatgcccttataatggagtctccat

SEQ ID NO: 513497 - DNA, 25 bp, Mus musculus
gatgcccttatattggagtctccat

SEQ ID NO: 513498 - DNA, 25 bp, Mus musculus
gatgcccttatgatttttgtcacaa

SEQ ID NO: 513499 - DNA, 25 bp, Mus musculus
gatgcccttatgttttttgtcacaa

SEQ ID NO: 513500 - DNA, 25 bp, Mus musculus
gatgcccttcgcaagatgatcaact

SEQ ID NO: 513501 - DNA, 25 bp, Mus musculus
gatgcccttcgctagatgatcaact

SEQ ID NO: 513502 - DNA, 25 bp, Mus musculus
gatgcccttgatccttgacaggtgc

SEQ ID NO: 513503 - DNA, 25 bp, Mus musculus
gatgcccttgatcgctgcccagaaa

SEQ ID NO: 513504 - DNA, 25 bp, Mus musculus
gatgcccttgatgcttgacaggtgc

SEQ ID NO: 513505 - DNA, 25 bp, Mus musculus
gatgcccttgatggctgcccagaaa

SEQ ID NO: 513506 - DNA, 25 bp, Mus musculus
gatgccctttctaagcagagttgct

SEQ ID NO: 513507 - DNA, 25 bp, Mus musculus
gatgccctttcttagcagagttgct

SEQ ID NO: 513508 - DNA, 25 bp, Mus musculus
gatgccctttggaccgtaaaacctg

SEQ ID NO: 513509 - DNA, 25 bp, Mus musculus
gatgccctttggtccgtaaaacctg

SEQ ID NO: 513510 - DNA, 25 bp, Mus musculus
gatgccctttttcatataagtagca

SEQ ID NO: 513511 - DNA, 25 bp, Mus musculus
gatgccctttttgatataagtagca

SEQ ID NO: 513512 - DNA, 25 bp, Mus musculus
gatgccgaattgactttgctaagag

SEQ ID NO: 513513 - DNA, 25 bp, Mus musculus
gatgccgaattgtctttgctaagag

SEQ ID NO: 513514 - DNA, 25 bp, Mus musculus
gatgccgacaagcaagacatagcag

SEQ ID NO: 513515 - DNA, 25 bp, Mus musculus
gatgccgacaaggaagacatagcag

SEQ ID NO: 513516 - DNA, 25 bp, Mus musculus
gatgccgacactcatgctacatgta

SEQ ID NO: 513517 - DNA, 25 bp, Mus musculus
gatgccgacactgatgctacatgta

SEQ ID NO: 513518 - DNA, 25 bp, Mus musculus
gatgccgacagacttggttcagttt

SEQ ID NO: 513519 - DNA, 25 bp, Mus musculus
gatgccgacagagttggttcagttt

SEQ ID NO: 513520 - DNA, 25 bp, Mus musculus
gatgccgagaatcatgggaaaaagc

SEQ ID NO: 513521 - DNA, 25 bp, Mus musculus
gatgccgagaatgatgggaaaaagc

SEQ ID NO: 513522 - DNA, 25 bp, Mus musculus
gatgccgatggcaaccttaagttgg

SEQ ID NO: 513523 - DNA, 25 bp, Mus musculus
gatgccgatggctaccttaagttgg

SEQ ID NO: 513524 - DNA, 25 bp, Mus musculus
gatgccgcctttaattgcccaagga

SEQ ID NO: 513525 - DNA, 25 bp, Mus musculus
gatgccgccttttattgcccaagga

SEQ ID NO: 513526 - DNA, 25 bp, Mus musculus
gatgccgcggtcatcaccggggctt

SEQ ID NO: 513527 - DNA, 25 bp, Mus musculus
gatgccgcggtcttcaccggggctt

SEQ ID NO: 513528 - DNA, 25 bp, Mus musculus
gatgccgctaaacacactggttgtt

SEQ ID NO: 513529 - DNA, 25 bp, Mus musculus
gatgccgctaaagacactggttgtt

SEQ ID NO: 513530 - DNA, 25 bp, Mus musculus
gatgccgctaatactagatagtaat

SEQ ID NO: 513531 - DNA, 25 bp, Mus musculus
gatgccgctaattctagatagtaat

SEQ ID NO: 513532 - DNA, 25 bp, Mus musculus
gatgccgctattcaatctgctggag

SEQ ID NO: 513533 - DNA, 25 bp, Mus musculus
gatgccgctattgaatctgctggag

SEQ ID NO: 513534 - DNA, 25 bp, Mus musculus
gatgccgctcttccaacacttgctg

SEQ ID NO: 513535 - DNA, 25 bp, Mus musculus
gatgccgctcttgcaacacttgctg

SEQ ID NO: 513536 - DNA, 25 bp, Mus musculus
gatgccggaactctgacagtataaa

SEQ ID NO: 513537 - DNA, 25 bp, Mus musculus
gatgccggaactgtgacagtataaa

SEQ ID NO: 513538 - DNA, 25 bp, Mus musculus
gatgccggatacaaaagactctatt

SEQ ID NO: 513539 - DNA, 25 bp, Mus musculus
gatgccggatactaaagactctatt

SEQ ID NO: 513540 - DNA, 25 bp, Mus musculus
gatgccggcttacccaagtctggca

SEQ ID NO: 513541 - DNA, 25 bp, Mus musculus
gatgccggcttagccaagtctggca

SEQ ID NO: 513542 - DNA, 25 bp, Mus musculus
gatgccggctttctgagtagagtta

SEQ ID NO: 513543 - DNA, 25 bp, Mus musculus
gatgccggctttgtgagtagagtta

SEQ ID NO: 513544 - DNA, 25 bp, Mus musculus
gatgccgggataatagttcaattgc

SEQ ID NO: 513545 - DNA, 25 bp, Mus musculus
gatgccgggatattagttcaattgc

SEQ ID NO: 513546 - DNA, 25 bp, Mus musculus
gatgccggttaccagactgcagaac

SEQ ID NO: 513547 - DNA, 25 bp, Mus musculus
gatgccggttacgagactgcagaac

SEQ ID NO: 513548 - DNA, 25 bp, Mus musculus
gatgccgtcagtatcactgtggcaa

SEQ ID NO: 513549 - DNA, 25 bp, Mus musculus
gatgccgtcagtttcactgtggcaa

SEQ ID NO: 513550 - DNA, 25 bp, Mus musculus
gatgccgtcatgaaagcccgcaaag

SEQ ID NO: 513551 - DNA, 25 bp, Mus musculus
gatgccgtcatgtaagcccgcaaag

SEQ ID NO: 513552 - DNA, 25 bp, Mus musculus
gatgccgtcgggagaatttgcacgt

SEQ ID NO: 513553 - DNA, 25 bp, Mus musculus
gatgccgtcgggtgaatttgcacgt

SEQ ID NO: 513554 - DNA, 25 bp, Mus musculus
gatgccgtgaagcattcttattaaa

SEQ ID NO: 513555 - DNA, 25 bp, Mus musculus
gatgccgtgaaggattcttattaaa

SEQ ID NO: 513556 - DNA, 25 bp, Mus musculus
gatgccgtgcggatagattggtttt

SEQ ID NO: 513557 - DNA, 25 bp, Mus musculus
gatgccgtgcggttagattggtttt

SEQ ID NO: 513558 - DNA, 25 bp, Mus musculus
gatgcctaaagaactctggacttgg

SEQ ID NO: 513559 - DNA, 25 bp, Mus musculus
gatgcctaaagatctctggacttgg

SEQ ID NO: 513560 - DNA, 25 bp, Mus musculus
gatgcctaacaaactctatttttaa

SEQ ID NO: 513561 - DNA, 25 bp, Mus musculus
gatgcctaacaatctctatttttaa

SEQ ID NO: 513562 - DNA, 25 bp, Mus musculus
gatgcctaacccaggtcatgttgga

SEQ ID NO: 513563 - DNA, 25 bp, Mus musculus
gatgcctaaccctggtcatgttgga

SEQ ID NO: 513564 - DNA, 25 bp, Mus musculus
gatgcctaacctaagctactgagcg

SEQ ID NO: 513565 - DNA, 25 bp, Mus musculus
gatgcctaaccttagctactgagcg

SEQ ID NO: 513566 - DNA, 25 bp, Mus musculus
gatgcctaagcccaacctagtgtca

SEQ ID NO: 513567 - DNA, 25 bp, Mus musculus
gatgcctaagccgaacctagtgtca

SEQ ID NO: 513568 - DNA, 25 bp, Mus musculus
gatgcctaagcgactgccgaggttt

SEQ ID NO: 513569 - DNA, 25 bp, Mus musculus
gatgcctaagcgtctgccgaggttt

SEQ ID NO: 513570 - DNA, 25 bp, Mus musculus
gatgcctacactagggtttatttat

SEQ ID NO: 513571 - DNA, 25 bp, Mus musculus
gatgcctacacttgggtttatttat

SEQ ID NO: 513572 - DNA, 25 bp, Mus musculus
gatgcctacagtataacagagttat

SEQ ID NO: 513573 - DNA, 25 bp, Mus musculus
gatgcctacagtttaacagagttat

SEQ ID NO: 513574 - DNA, 25 bp, Mus musculus
gatgcctacattcgcacctgttgta

SEQ ID NO: 513575 - DNA, 25 bp, Mus musculus
gatgcctacattggcacctgttgta

SEQ ID NO: 513576 - DNA, 25 bp, Mus musculus
gatgcctaccctccagtgcagaaga

SEQ ID NO: 513577 - DNA, 25 bp, Mus musculus
gatgcctaccctgcagtgcagaaga

SEQ ID NO: 513578 - DNA, 25 bp, Mus musculus
gatgcctacttgctaagggactgca

SEQ ID NO: 513579 - DNA, 25 bp, Mus musculus
gatgcctacttggtaagggactgca

SEQ ID NO: 513580 - DNA, 25 bp, Mus musculus
gatgcctaggatctactgtttaccc

SEQ ID NO: 513581 - DNA, 25 bp, Mus musculus
gatgcctaggatgtactgtttaccc

SEQ ID NO: 513582 - DNA, 25 bp, Mus musculus
gatgcctatctgactcttcaagaac

SEQ ID NO: 513583 - DNA, 25 bp, Mus musculus
gatgcctatctgtctcttcaagaac

SEQ ID NO: 513584 - DNA, 25 bp, Mus musculus
gatgcctatgggaaccactccagtg

SEQ ID NO: 513585 - DNA, 25 bp, Mus musculus
gatgcctatgggtaccactccagtg

SEQ ID NO: 513586 - DNA, 25 bp, Mus musculus
gatgcctatgttaggctgccagctt

SEQ ID NO: 513587 - DNA, 25 bp, Mus musculus
gatgcctatgtttggctgccagctt

SEQ ID NO: 513588 - DNA, 25 bp, Mus musculus
gatgcctattatcactaaggcttct

SEQ ID NO: 513589 - DNA, 25 bp, Mus musculus
gatgcctattatgactaaggcttct

SEQ ID NO: 513590 - DNA, 25 bp, Mus musculus
gatgcctattcacttcttgtgctta

SEQ ID NO: 513591 - DNA, 25 bp, Mus musculus
gatgcctattcagttcttgtgctta

SEQ ID NO: 513592 - DNA, 25 bp, Mus musculus
gatgcctattcgcagctgtctgaga

SEQ ID NO: 513593 - DNA, 25 bp, Mus musculus
gatgcctattcggagctgtctgaga

SEQ ID NO: 513594 - DNA, 25 bp, Mus musculus
gatgcctcacagaagatacagcccc

SEQ ID NO: 513595 - DNA, 25 bp, Mus musculus
gatgcctcacagctacaaagtccaa

SEQ ID NO: 513596 - DNA, 25 bp, Mus musculus
gatgcctcacaggtacaaagtccaa

SEQ ID NO: 513597 - DNA, 25 bp, Mus musculus
gatgcctcacagtagatacagcccc

SEQ ID NO: 513598 - DNA, 25 bp, Mus musculus
gatgcctcactcatgctaaacaagt

SEQ ID NO: 513599 - DNA, 25 bp, Mus musculus
gatgcctcactcttgctaaacaagt

SEQ ID NO: 513600 - DNA, 25 bp, Mus musculus
gatgcctcacttagatgtctcatat

SEQ ID NO: 513601 - DNA, 25 bp, Mus musculus
gatgcctcactttgatgtctcatat

SEQ ID NO: 513602 - DNA, 25 bp, Mus musculus
gatgcctcagcacttccagaagaag

SEQ ID NO: 513603 - DNA, 25 bp, Mus musculus
gatgcctcagcagttccagaagaag

SEQ ID NO: 513604 - DNA, 25 bp, Mus musculus
gatgcctccaatatcctcaagaggc

SEQ ID NO: 513605 - DNA, 25 bp, Mus musculus
gatgcctccaatttcctcaagaggc

SEQ ID NO: 513606 - DNA, 25 bp, Mus musculus
gatgcctccatacttgaagggttat

SEQ ID NO: 513607 - DNA, 25 bp, Mus musculus
gatgcctccatagttgaagggttat

SEQ ID NO: 513608 - DNA, 25 bp, Mus musculus
gatgcctcccataatggtaagccaa

SEQ ID NO: 513609 - DNA, 25 bp, Mus musculus
gatgcctcccattatggtaagccaa

SEQ ID NO: 513610 - DNA, 25 bp, Mus musculus
gatgcctccctcctagaggagttga

SEQ ID NO: 513611 - DNA, 25 bp, Mus musculus
gatgcctccctcgtagaggagttga

SEQ ID NO: 513612 - DNA, 25 bp, Mus musculus
gatgcctccgaaaaatagggatgct

SEQ ID NO: 513613 - DNA, 25 bp, Mus musculus
gatgcctccgaataatagggatgct

SEQ ID NO: 513614 - DNA, 25 bp, Mus musculus
gatgcctcctaaacaaaccacttag

SEQ ID NO: 513615 - DNA, 25 bp, Mus musculus
gatgcctcctaatcaaaccacttag

SEQ ID NO: 513616 - DNA, 25 bp, Mus musculus
gatgcctcctctcaaaagtcttgac

SEQ ID NO: 513617 - DNA, 25 bp, Mus musculus
gatgcctcctctgaaaagtcttgac

SEQ ID NO: 513618 - DNA, 25 bp, Mus musculus
gatgcctctccaaatttgggttgca

SEQ ID NO: 513619 - DNA, 25 bp, Mus musculus
gatgcctctccatatttgggttgca

SEQ ID NO: 513620 - DNA, 25 bp, Mus musculus
gatgcctctcctagctttgaaagat

SEQ ID NO: 513621 - DNA, 25 bp, Mus musculus
gatgcctctccttgctttgaaagat

SEQ ID NO: 513622 - DNA, 25 bp, Mus musculus
gatgcctctcggcagttaccttttt

SEQ ID NO: 513623 - DNA, 25 bp, Mus musculus
gatgcctctcgggagttaccttttt

SEQ ID NO: 513624 - DNA, 25 bp, Mus musculus
gatgcctctctacatcatttttgat

SEQ ID NO: 513625 - DNA, 25 bp, Mus musculus
gatgcctctctagatcatttttgat

SEQ ID NO: 513626 - DNA, 25 bp, Mus musculus
gatgcctctgccctggttcttggtg

SEQ ID NO: 513627 - DNA, 25 bp, Mus musculus
gatgcctctgccgtggttcttggtg

SEQ ID NO: 513628 - DNA, 25 bp, Mus musculus
gatgcctctggcagtactcgttctc

SEQ ID NO: 513629 - DNA, 25 bp, Mus musculus
gatgcctctggctgtactcgttctc

SEQ ID NO: 513630 - DNA, 25 bp, Mus musculus
gatgcctctgtacgtgaaggtgctt

SEQ ID NO: 513631 - DNA, 25 bp, Mus musculus
gatgcctctgtaggtgaaggtgctt

SEQ ID NO: 513632 - DNA, 25 bp, Mus musculus
gatgcctcttatcatcagaactctt

SEQ ID NO: 513633 - DNA, 25 bp, Mus musculus
gatgcctcttatgatcagaactctt

SEQ ID NO: 513634 - DNA, 25 bp, Mus musculus
gatgcctcttctaattcaatcttaa

SEQ ID NO: 513635 - DNA, 25 bp, Mus musculus
gatgcctcttcttattcaatcttaa

SEQ ID NO: 513636 - DNA, 25 bp, Mus musculus
gatgcctcttgcaattaaaagtcgg

SEQ ID NO: 513637 - DNA, 25 bp, Mus musculus
gatgcctcttgctattaaaagtcgg

SEQ ID NO: 513638 - DNA, 25 bp, Mus musculus
gatgcctctttgatgtttaacatag

SEQ ID NO: 513639 - DNA, 25 bp, Mus musculus
gatgcctctttgctgattaatgtca

SEQ ID NO: 513640 - DNA, 25 bp, Mus musculus
gatgcctctttggtgattaatgtca

SEQ ID NO: 513641 - DNA, 25 bp, Mus musculus
gatgcctctttgttgtttaacatag

SEQ ID NO: 513642 - DNA, 25 bp, Mus musculus
gatgcctgaaggcttctgaattcat

SEQ ID NO: 513643 - DNA, 25 bp, Mus musculus
gatgcctgaagggttctgaattcat

SEQ ID NO: 513644 - DNA, 25 bp, Mus musculus
gatgcctgaattaaaccctactgac

SEQ ID NO: 513645 - DNA, 25 bp, Mus musculus
gatgcctgaatttaaccctactgac

SEQ ID NO: 513646 - DNA, 25 bp, Mus musculus
gatgcctgacagcatattttctgtg

SEQ ID NO: 513647 - DNA, 25 bp, Mus musculus
gatgcctgacaggatattttctgtg

SEQ ID NO: 513648 - DNA, 25 bp, Mus musculus
gatgcctgacgacatatttttcttt

SEQ ID NO: 513649 - DNA, 25 bp, Mus musculus
gatgcctgacgagatatttttcttt

SEQ ID NO: 513650 - DNA, 25 bp, Mus musculus
gatgcctgactgatggatagcctgg

SEQ ID NO: 513651 - DNA, 25 bp, Mus musculus
gatgcctgactgttggatagcctgg

SEQ ID NO: 513652 - DNA, 25 bp, Mus musculus
gatgcctgagtgactaccactggct

SEQ ID NO: 513653 - DNA, 25 bp, Mus musculus
gatgcctgagtgtctaccactggct

SEQ ID NO: 513654 - DNA, 25 bp, Mus musculus
gatgcctgatataacgctggtccat

SEQ ID NO: 513655 - DNA, 25 bp, Mus musculus
gatgcctgatattacgctggtccat

SEQ ID NO: 513656 - DNA, 25 bp, Mus musculus
gatgcctgatcacatcactgatcac

SEQ ID NO: 513657 - DNA, 25 bp, Mus musculus
gatgcctgatcagatcactgatcac

SEQ ID NO: 513658 - DNA, 25 bp, Mus musculus
gatgcctgatctattaccacaactt

SEQ ID NO: 513659 - DNA, 25 bp, Mus musculus
gatgcctgatcttttaccacaactt

SEQ ID NO: 513660 - DNA, 25 bp, Mus musculus
gatgcctgatgaccctgaagagcca

SEQ ID NO: 513661 - DNA, 25 bp, Mus musculus
gatgcctgatgagcctgaagagcca

SEQ ID NO: 513662 - DNA, 25 bp, Mus musculus
gatgcctgcaagcacgcgcgcacag

SEQ ID NO: 513663 - DNA, 25 bp, Mus musculus
gatgcctgcaaggacgcgcgcacag

SEQ ID NO: 513664 - DNA, 25 bp, Mus musculus
gatgcctgcacaattgctttgttag

SEQ ID NO: 513665 - DNA, 25 bp, Mus musculus
gatgcctgcacatttgctttgttag

SEQ ID NO: 513666 - DNA, 25 bp, Mus musculus
gatgcctgcagtctcaggagaccaa

SEQ ID NO: 513667 - DNA, 25 bp, Mus musculus
gatgcctgcagtgtcaggagaccaa

SEQ ID NO: 513668 - DNA, 25 bp, Mus musculus
gatgcctgcatacatgggagcccag

SEQ ID NO: 513669 - DNA, 25 bp, Mus musculus
gatgcctgcatagatgggagcccag

SEQ ID NO: 513670 - DNA, 25 bp, Mus musculus
gatgcctgccaaaaacttagaaaat

SEQ ID NO: 513671 - DNA, 25 bp, Mus musculus
gatgcctgccaataacttagaaaat

SEQ ID NO: 513672 - DNA, 25 bp, Mus musculus
gatgcctgccagatggaaccagagg

SEQ ID NO: 513673 - DNA, 25 bp, Mus musculus
gatgcctgccagttggaaccagagg

SEQ ID NO: 513674 - DNA, 25 bp, Mus musculus
gatgcctgccggagagcacattaca

SEQ ID NO: 513675 - DNA, 25 bp, Mus musculus
gatgcctgccggtgagcacattaca

SEQ ID NO: 513676 - DNA, 25 bp, Mus musculus
gatgcctgcctgctgaggtattcaa

SEQ ID NO: 513677 - DNA, 25 bp, Mus musculus
gatgcctgcctggtgaggtattcaa

SEQ ID NO: 513678 - DNA, 25 bp, Mus musculus
gatgcctgctctatggaagacgcca

SEQ ID NO: 513679 - DNA, 25 bp, Mus musculus
gatgcctgctctttggaagacgcca

SEQ ID NO: 513680 - DNA, 25 bp, Mus musculus
gatgcctgcttcactttctaaaaat

SEQ ID NO: 513681 - DNA, 25 bp, Mus musculus
gatgcctgcttctctttctaaaaat

SEQ ID NO: 513682 - DNA, 25 bp, Mus musculus
gatgcctgcttgactatcttggttg

SEQ ID NO: 513683 - DNA, 25 bp, Mus musculus
gatgcctgcttgtctatcttggttg

SEQ ID NO: 513684 - DNA, 25 bp, Mus musculus
gatgcctgctttctataatctattt

SEQ ID NO: 513685 - DNA, 25 bp, Mus musculus
gatgcctgctttgtataatctattt

SEQ ID NO: 513686 - DNA, 25 bp, Mus musculus
gatgcctggaagatcaacatcttga

SEQ ID NO: 513687 - DNA, 25 bp, Mus musculus
gatgcctggaagttcaacatcttga

SEQ ID NO: 513688 - DNA, 25 bp, Mus musculus
gatgcctggatgagccaacgtaaaa

SEQ ID NO: 513689 - DNA, 25 bp, Mus musculus
gatgcctggatgtgccaacgtaaaa

SEQ ID NO: 513690 - DNA, 25 bp, Mus musculus
gatgcctggcatcaaatactccaag

SEQ ID NO: 513691 - DNA, 25 bp, Mus musculus
gatgcctggcatcaactttaaataa

SEQ ID NO: 513692 - DNA, 25 bp, Mus musculus
gatgcctggcatgaaatactccaag

SEQ ID NO: 513693 - DNA, 25 bp, Mus musculus
gatgcctggcatgaactttaaataa

SEQ ID NO: 513694 - DNA, 25 bp, Mus musculus
gatgcctgggcaacctctaattaga

SEQ ID NO: 513695 - DNA, 25 bp, Mus musculus
gatgcctgggcatcctctaattaga

SEQ ID NO: 513696 - DNA, 25 bp, Mus musculus
gatgcctgtgacctaaccatagacg

SEQ ID NO: 513697 - DNA, 25 bp, Mus musculus
gatgcctgtgacgtaaccatagacg

SEQ ID NO: 513698 - DNA, 25 bp, Mus musculus
gatgcctgtgagattgggtctagcc

SEQ ID NO: 513699 - DNA, 25 bp, Mus musculus
gatgcctgtgagtttgggtctagcc

SEQ ID NO: 513700 - DNA, 25 bp, Mus musculus
gatgcctgtggcaccataatatgtg

SEQ ID NO: 513701 - DNA, 25 bp, Mus musculus
gatgcctgtggctccataatatgtg

SEQ ID NO: 513702 - DNA, 25 bp, Mus musculus
gatgcctgtgtgaccagagtgcaga

SEQ ID NO: 513703 - DNA, 25 bp, Mus musculus
gatgcctgtgtgtccagagtgcaga

SEQ ID NO: 513704 - DNA, 25 bp, Mus musculus
gatgcctgtgttaatcattgtctga

SEQ ID NO: 513705 - DNA, 25 bp, Mus musculus
gatgcctgtgtttatcattgtctga

SEQ ID NO: 513706 - DNA, 25 bp, Mus musculus
gatgcctgttccaaaatggctccag

SEQ ID NO: 513707 - DNA, 25 bp, Mus musculus
gatgcctgttcctaaatggctccag

SEQ ID NO: 513708 - DNA, 25 bp, Mus musculus
gatgccttaataattgcatgataag

SEQ ID NO: 513709 - DNA, 25 bp, Mus musculus
gatgccttaatatttgcatgataag

SEQ ID NO: 513710 - DNA, 25 bp, Mus musculus
gatgccttaatgacctccgatttta

SEQ ID NO: 513711 - DNA, 25 bp, Mus musculus
gatgccttaatgtcctccgatttta

SEQ ID NO: 513712 - DNA, 25 bp, Mus musculus
gatgccttaattattagtgtccatt

SEQ ID NO: 513713 - DNA, 25 bp, Mus musculus
gatgccttaatttttagtgtccatt

SEQ ID NO: 513714 - DNA, 25 bp, Mus musculus
gatgccttacggattccaagactac

SEQ ID NO: 513715 - DNA, 25 bp, Mus musculus
gatgccttacggtttccaagactac

SEQ ID NO: 513716 - DNA, 25 bp, Mus musculus
gatgccttactaagggaacagaaaa

SEQ ID NO: 513717 - DNA, 25 bp, Mus musculus
gatgccttactatgggaacagaaaa

SEQ ID NO: 513718 - DNA, 25 bp, Mus musculus
gatgccttacttcctaatgtgtact

SEQ ID NO: 513719 - DNA, 25 bp, Mus musculus
gatgccttacttgctaatgtgtact

SEQ ID NO: 513720 - DNA, 25 bp, Mus musculus
gatgccttagatatggaccggatga

SEQ ID NO: 513721 - DNA, 25 bp, Mus musculus
gatgccttagatttggaccggatga

SEQ ID NO: 513722 - DNA, 25 bp, Mus musculus
gatgccttagcacgtacttgctgtg

SEQ ID NO: 513723 - DNA, 25 bp, Mus musculus
gatgccttagcaggtacttgctgtg

SEQ ID NO: 513724 - DNA, 25 bp, Mus musculus
gatgccttatctacagattggtcag

SEQ ID NO: 513725 - DNA, 25 bp, Mus musculus
gatgccttatcttcagattggtcag

SEQ ID NO: 513726 - DNA, 25 bp, Mus musculus
gatgccttcaaaatagctcacagta

SEQ ID NO: 513727 - DNA, 25 bp, Mus musculus
gatgccttcaaattagctcacagta

SEQ ID NO: 513728 - DNA, 25 bp, Mus musculus
gatgccttcaagcagtttgatgcca

SEQ ID NO: 513729 - DNA, 25 bp, Mus musculus
gatgccttcaaggagtttgatgcca

SEQ ID NO: 513730 - DNA, 25 bp, Mus musculus
gatgccttcaatacagggactgata

SEQ ID NO: 513731 - DNA, 25 bp, Mus musculus
gatgccttcaattcagggactgata

SEQ ID NO: 513732 - DNA, 25 bp, Mus musculus
gatgccttcacccagagggatcaat

SEQ ID NO: 513733 - DNA, 25 bp, Mus musculus
gatgccttcaccgagagggatcaat

SEQ ID NO: 513734 - DNA, 25 bp, Mus musculus
gatgccttcagaaaggcttcagtga

SEQ ID NO: 513735 - DNA, 25 bp, Mus musculus
gatgccttcagataggcttcagtga

SEQ ID NO: 513736 - DNA, 25 bp, Mus musculus
gatgccttcagcaattagttttcct

SEQ ID NO: 513737 - DNA, 25 bp, Mus musculus
gatgccttcagctattagttttcct

SEQ ID NO: 513738 - DNA, 25 bp, Mus musculus
gatgccttccttagaaaagcaggac

SEQ ID NO: 513739 - DNA, 25 bp, Mus musculus
gatgccttcctttgaaaagcaggac

SEQ ID NO: 513740 - DNA, 25 bp, Mus musculus
gatgccttcgatctacattgcactg

SEQ ID NO: 513741 - DNA, 25 bp, Mus musculus
gatgccttcgatgtacattgcactg

SEQ ID NO: 513742 - DNA, 25 bp, Mus musculus
gatgccttcttcacaaatgaggcct

SEQ ID NO: 513743 - DNA, 25 bp, Mus musculus
gatgccttcttctcaaatgaggcct

SEQ ID NO: 513744 - DNA, 25 bp, Mus musculus
gatgccttgaacctcagcacttggg

SEQ ID NO: 513745 - DNA, 25 bp, Mus musculus
gatgccttgaacgtcagcacttggg

SEQ ID NO: 513746 - DNA, 25 bp, Mus musculus
gatgccttgaagattgtctctgcca

SEQ ID NO: 513747 - DNA, 25 bp, Mus musculus
gatgccttgaagtttgtctctgcca

SEQ ID NO: 513748 - DNA, 25 bp, Mus musculus
gatgccttgcctaatgctttggaat

SEQ ID NO: 513749 - DNA, 25 bp, Mus musculus
gatgccttgccttatgctttggaat

SEQ ID NO: 513750 - DNA, 25 bp, Mus musculus
gatgccttggatcgaagtgctttta

SEQ ID NO: 513751 - DNA, 25 bp, Mus musculus
gatgccttggatggaagtgctttta

SEQ ID NO: 513752 - DNA, 25 bp, Mus musculus
gatgccttgtttaccaagcattgta

SEQ ID NO: 513753 - DNA, 25 bp, Mus musculus
gatgccttgttttccaagcattgta

SEQ ID NO: 513754 - DNA, 25 bp, Mus musculus
gatgcctttattatagatccaggag

SEQ ID NO: 513755 - DNA, 25 bp, Mus musculus
gatgcctttattctctgggcggcac

SEQ ID NO: 513756 - DNA, 25 bp, Mus musculus
gatgcctttattgtctgggcggcac

SEQ ID NO: 513757 - DNA, 25 bp, Mus musculus
gatgcctttattttagatccaggag

SEQ ID NO: 513758 - DNA, 25 bp, Mus musculus
gatgcctttcataggtgagccaagg

SEQ ID NO: 513759 - DNA, 25 bp, Mus musculus
gatgcctttcatataacctgggtgg

SEQ ID NO: 513760 - DNA, 25 bp, Mus musculus
gatgcctttcattggtgagccaagg

SEQ ID NO: 513761 - DNA, 25 bp, Mus musculus
gatgcctttcatttaacctgggtgg

SEQ ID NO: 513762 - DNA, 25 bp, Mus musculus
gatgcctttctacgtggtacagctg

SEQ ID NO: 513763 - DNA, 25 bp, Mus musculus
gatgcctttctaggtggtacagctg

SEQ ID NO: 513764 - DNA, 25 bp, Mus musculus
gatgcctttctgaacactgatttag

SEQ ID NO: 513765 - DNA, 25 bp, Mus musculus
gatgcctttctgtacactgatttag

SEQ ID NO: 513766 - DNA, 25 bp, Mus musculus
gatgcctttcttccgattggaggat

SEQ ID NO: 513767 - DNA, 25 bp, Mus musculus
gatgcctttcttgcgattggaggat

SEQ ID NO: 513768 - DNA, 25 bp, Mus musculus
gatgcctttgatcgtttggtgagac

SEQ ID NO: 513769 - DNA, 25 bp, Mus musculus
gatgcctttgatggtttggtgagac

SEQ ID NO: 513770 - DNA, 25 bp, Mus musculus
gatgcctttgctcaacgagcgtacc

SEQ ID NO: 513771 - DNA, 25 bp, Mus musculus
gatgcctttgctgaacgagcgtacc

SEQ ID NO: 513772 - DNA, 25 bp, Mus musculus
gatgcctttgtacttgctgtttgca

SEQ ID NO: 513773 - DNA, 25 bp, Mus musculus
gatgcctttgtagttgctgtttgca

SEQ ID NO: 513774 - DNA, 25 bp, Mus musculus
gatgcctttgtcaagcactggtgtg

SEQ ID NO: 513775 - DNA, 25 bp, Mus musculus
gatgcctttgtctagcactggtgtg

SEQ ID NO: 513776 - DNA, 25 bp, Mus musculus
gatgcctttgttacctacagtgagc

SEQ ID NO: 513777 - DNA, 25 bp, Mus musculus
gatgcctttgttagcaaaacacttg

SEQ ID NO: 513778 - DNA, 25 bp, Mus musculus
gatgcctttgtttcctacagtgagc

SEQ ID NO: 513779 - DNA, 25 bp, Mus musculus
gatgcctttgtttgcaaaacacttg

SEQ ID NO: 513780 - DNA, 25 bp, Mus musculus
gatgccttttcaccctcttaactga

SEQ ID NO: 513781 - DNA, 25 bp, Mus musculus
gatgccttttcagcctcttaactga

SEQ ID NO: 513782 - DNA, 25 bp, Mus musculus
gatgccttttgtacaatgttatcaa

SEQ ID NO: 513783 - DNA, 25 bp, Mus musculus
gatgccttttgttcaatgttatcaa

SEQ ID NO: 513784 - DNA, 25 bp, Mus musculus
gatgcgaaagaacagctggttgtac

SEQ ID NO: 513785 - DNA, 25 bp, Mus musculus
gatgcgaaagaagagctggttgtac

SEQ ID NO: 513786 - DNA, 25 bp, Mus musculus
gatgcgaacatcaggctgggcctca

SEQ ID NO: 513787 - DNA, 25 bp, Mus musculus
gatgcgaacatctggctgggcctca

SEQ ID NO: 513788 - DNA, 25 bp, Mus musculus
gatgcgaacccacatgcagcagatg

SEQ ID NO: 513789 - DNA, 25 bp, Mus musculus
gatgcgaacccagatgcagcagatg

SEQ ID NO: 513790 - DNA, 25 bp, Mus musculus
gatgcgaagaagacccaggcccaga

SEQ ID NO: 513791 - DNA, 25 bp, Mus musculus
gatgcgaagaagtcccaggcccaga

SEQ ID NO: 513792 - DNA, 25 bp, Mus musculus
gatgcgaccttgagattttagccgt

SEQ ID NO: 513793 - DNA, 25 bp, Mus musculus
gatgcgaccttgtgattttagccgt

SEQ ID NO: 513794 - DNA, 25 bp, Mus musculus
gatgcgacgtctaagcgtatgcctt

SEQ ID NO: 513795 - DNA, 25 bp, Mus musculus
gatgcgacgtcttagcgtatgcctt

SEQ ID NO: 513796 - DNA, 25 bp, Mus musculus
gatgcgaggctcactcagatgcaaa

SEQ ID NO: 513797 - DNA, 25 bp, Mus musculus
gatgcgaggctctctcagatgcaaa

SEQ ID NO: 513798 - DNA, 25 bp, Mus musculus
gatgcgagtttactcccttctttta

SEQ ID NO: 513799 - DNA, 25 bp, Mus musculus
gatgcgagtttagtcccttctttta

SEQ ID NO: 513800 - DNA, 25 bp, Mus musculus
gatgcgatgaccctcttttccttga

SEQ ID NO: 513801 - DNA, 25 bp, Mus musculus
gatgcgatgaccgtcttttccttga

SEQ ID NO: 513802 - DNA, 25 bp, Mus musculus
gatgcgatggttattcagtaatgga

SEQ ID NO: 513803 - DNA, 25 bp, Mus musculus
gatgcgatggtttttcagtaatgga

SEQ ID NO: 513804 - DNA, 25 bp, Mus musculus
gatgcgattgtacatagcctttcta

SEQ ID NO: 513805 - DNA, 25 bp, Mus musculus
gatgcgattgtagatagcctttcta

SEQ ID NO: 513806 - DNA, 25 bp, Mus musculus
gatgcgatttttagttgccaagtct

SEQ ID NO: 513807 - DNA, 25 bp, Mus musculus
gatgcgattttttgttgccaagtct

SEQ ID NO: 513808 - DNA, 25 bp, Mus musculus
gatgcgcaatgccacgtcgagattg

SEQ ID NO: 513809 - DNA, 25 bp, Mus musculus
gatgcgcaatgcgacgtcgagattg

SEQ ID NO: 513810 - DNA, 25 bp, Mus musculus
gatgcgcacatacccaatgcagcaa

SEQ ID NO: 513811 - DNA, 25 bp, Mus musculus
gatgcgcacatagccaatgcagcaa

SEQ ID NO: 513812 - DNA, 25 bp, Mus musculus
gatgcgcagatgagagcagcgatta

SEQ ID NO: 513813 - DNA, 25 bp, Mus musculus
gatgcgcagatgtgagcagcgatta

SEQ ID NO: 513814 - DNA, 25 bp, Mus musculus
gatgcgcatcggagcaaacagttgc

SEQ ID NO: 513815 - DNA, 25 bp, Mus musculus
gatgcgcatcggtgcaaacagttgc

SEQ ID NO: 513816 - DNA, 25 bp, Mus musculus
gatgcgcccatgacccaggtgtacg

SEQ ID NO: 513817 - DNA, 25 bp, Mus musculus
gatgcgcccatgtcccaggtgtacg

SEQ ID NO: 513818 - DNA, 25 bp, Mus musculus
gatgcgccccgtcagaaataatgag

SEQ ID NO: 513819 - DNA, 25 bp, Mus musculus
gatgcgccccgtgagaaataatgag

SEQ ID NO: 513820 - DNA, 25 bp, Mus musculus
gatgcgcccctgaaaagtgatgact

SEQ ID NO: 513821 - DNA, 25 bp, Mus musculus
gatgcgcccctgtaaagtgatgact

SEQ ID NO: 513822 - DNA, 25 bp, Mus musculus
gatgcgcctcacaaaaggattcaag

SEQ ID NO: 513823 - DNA, 25 bp, Mus musculus
gatgcgcctcactaaaggattcaag

SEQ ID NO: 513824 - DNA, 25 bp, Mus musculus
gatgcgcctgacaaaggagcacctg

SEQ ID NO: 513825 - DNA, 25 bp, Mus musculus
gatgcgcctgactaaggagcacctg

SEQ ID NO: 513826 - DNA, 25 bp, Mus musculus
gatgcgcctgtgaatccaaagctgg

SEQ ID NO: 513827 - DNA, 25 bp, Mus musculus
gatgcgcctgtgtatccaaagctgg

SEQ ID NO: 513828 - DNA, 25 bp, Mus musculus
gatgcgctacagactgagaaaccta

SEQ ID NO: 513829 - DNA, 25 bp, Mus musculus
gatgcgctacagtctgagaaaccta

SEQ ID NO: 513830 - DNA, 25 bp, Mus musculus
gatgcgctataaacagcctccttat

SEQ ID NO: 513831 - DNA, 25 bp, Mus musculus
gatgcgctataatcagcctccttat

SEQ ID NO: 513832 - DNA, 25 bp, Mus musculus
gatgcgctctaaattctttccaaag

SEQ ID NO: 513833 - DNA, 25 bp, Mus musculus
gatgcgctctaatttctttccaaag

SEQ ID NO: 513834 - DNA, 25 bp, Mus musculus
gatgcgctgagacctctctgcaaag

SEQ ID NO: 513835 - DNA, 25 bp, Mus musculus
gatgcgctgagagctctctgcaaag

SEQ ID NO: 513836 - DNA, 25 bp, Mus musculus
gatgcgctggacacgtgacagcccc

SEQ ID NO: 513837 - DNA, 25 bp, Mus musculus
gatgcgctggactcgtgacagcccc

SEQ ID NO: 513838 - DNA, 25 bp, Mus musculus
gatgcgctggtccagaagcacttga

SEQ ID NO: 513839 - DNA, 25 bp, Mus musculus
gatgcgctggtcgagaagcacttga

SEQ ID NO: 513840 - DNA, 25 bp, Mus musculus
gatgcgcttaaaattgtccgttcca

SEQ ID NO: 513841 - DNA, 25 bp, Mus musculus
gatgcgcttaaatttgtccgttcca

SEQ ID NO: 513842 - DNA, 25 bp, Mus musculus
gatgcgcttcttaggtttaatcaca

SEQ ID NO: 513843 - DNA, 25 bp, Mus musculus
gatgcgcttctttggtttaatcaca

SEQ ID NO: 513844 - DNA, 25 bp, Mus musculus
gatgcgcttggcactgtttaatcca

SEQ ID NO: 513845 - DNA, 25 bp, Mus musculus
gatgcgcttggctctgtttaatcca

SEQ ID NO: 513846 - DNA, 25 bp, Mus musculus
gatgcggaaaccagacggctccacg

SEQ ID NO: 513847 - DNA, 25 bp, Mus musculus
gatgcggaaacctgacggctccacg

SEQ ID NO: 513848 - DNA, 25 bp, Mus musculus
gatgcggaagccctttattccattg

SEQ ID NO: 513849 - DNA, 25 bp, Mus musculus
gatgcggaagccgtttattccattg

SEQ ID NO: 513850 - DNA, 25 bp, Mus musculus
gatgcggaagctacattcctactgt

SEQ ID NO: 513851 - DNA, 25 bp, Mus musculus
gatgcggaagcttcattcctactgt

SEQ ID NO: 513852 - DNA, 25 bp, Mus musculus
gatgcggacattatagccaggtttc

SEQ ID NO: 513853 - DNA, 25 bp, Mus musculus
gatgcggacattttagccaggtttc

SEQ ID NO: 513854 - DNA, 25 bp, Mus musculus
gatgcggactgtccggcgctaaccc

SEQ ID NO: 513855 - DNA, 25 bp, Mus musculus
gatgcggactgtgcggcgctaaccc

SEQ ID NO: 513856 - DNA, 25 bp, Mus musculus
gatgcggagctacctttatgtttta

SEQ ID NO: 513857 - DNA, 25 bp, Mus musculus
gatgcggagctagctttatgtttta

SEQ ID NO: 513858 - DNA, 25 bp, Mus musculus
gatgcggattccatgtgatgacact

SEQ ID NO: 513859 - DNA, 25 bp, Mus musculus
gatgcggattccttgtgatgacact

SEQ ID NO: 513860 - DNA, 25 bp, Mus musculus
gatgcggcatctctttggtcctcta

SEQ ID NO: 513861 - DNA, 25 bp, Mus musculus
gatgcggcatctgtttggtcctcta

SEQ ID NO: 513862 - DNA, 25 bp, Mus musculus
gatgcggcggcgatattcccatgac

SEQ ID NO: 513863 - DNA, 25 bp, Mus musculus
gatgcggcggcgttattcccatgac

SEQ ID NO: 513864 - DNA, 25 bp, Mus musculus
gatgcggctccaccgacaccgtgat

SEQ ID NO: 513865 - DNA, 25 bp, Mus musculus
gatgcggctccagcgacaccgtgat

SEQ ID NO: 513866 - DNA, 25 bp, Mus musculus
gatgcggctcctaggaattattcca

SEQ ID NO: 513867 - DNA, 25 bp, Mus musculus
gatgcggctccttggaattattcca

SEQ ID NO: 513868 - DNA, 25 bp, Mus musculus
gatgcggctgcaaaagctgcttgtg

SEQ ID NO: 513869 - DNA, 25 bp, Mus musculus
gatgcggctgcataagctgcttgtg

SEQ ID NO: 513870 - DNA, 25 bp, Mus musculus
gatgcggctggaaacttggacatta

SEQ ID NO: 513871 - DNA, 25 bp, Mus musculus
gatgcggctggatacttggacatta

SEQ ID NO: 513872 - DNA, 25 bp, Mus musculus
gatgcgggaaggcacttgtctttaa

SEQ ID NO: 513873 - DNA, 25 bp, Mus musculus
gatgcgggaagggacttgtctttaa

SEQ ID NO: 513874 - DNA, 25 bp, Mus musculus
gatgcgggaatcaccaccaagcttt

SEQ ID NO: 513875 - DNA, 25 bp, Mus musculus
gatgcgggaatctccaccaagcttt

SEQ ID NO: 513876 - DNA, 25 bp, Mus musculus
gatgcgggacttccctagatgatgc

SEQ ID NO: 513877 - DNA, 25 bp, Mus musculus
gatgcgggacttgcctagatgatgc

SEQ ID NO: 513878 - DNA, 25 bp, Mus musculus
gatgcgggcaggaacatctgcgatt

SEQ ID NO: 513879 - DNA, 25 bp, Mus musculus
gatgcgggcaggtacatctgcgatt

SEQ ID NO: 513880 - DNA, 25 bp, Mus musculus
gatgcgggctacaacatatgcacag

SEQ ID NO: 513881 - DNA, 25 bp, Mus musculus
gatgcgggctactacatatgcacag

SEQ ID NO: 513882 - DNA, 25 bp, Mus musculus
gatgcgggtttaatcatctctctaa

SEQ ID NO: 513883 - DNA, 25 bp, Mus musculus
gatgcgggtttattcatctctctaa

SEQ ID NO: 513884 - DNA, 25 bp, Mus musculus
gatgcggtattcaagtggttcacag

SEQ ID NO: 513885 - DNA, 25 bp, Mus musculus
gatgcggtattctagtggttcacag

SEQ ID NO: 513886 - DNA, 25 bp, Mus musculus
gatgcggtcgcccatatgaccgaac

SEQ ID NO: 513887 - DNA, 25 bp, Mus musculus
gatgcggtcgccgatatgaccgaac

SEQ ID NO: 513888 - DNA, 25 bp, Mus musculus
gatgcggtcttcaggctcatggagc

SEQ ID NO: 513889 - DNA, 25 bp, Mus musculus
gatgcggtcttctggctcatggagc

SEQ ID NO: 513890 - DNA, 25 bp, Mus musculus
gatgcggtcttgagagatttctccc

SEQ ID NO: 513891 - DNA, 25 bp, Mus musculus
gatgcggtcttgtgagatttctccc

SEQ ID NO: 513892 - DNA, 25 bp, Mus musculus
gatgcggtgaccatgaatcttcaag

SEQ ID NO: 513893 - DNA, 25 bp, Mus musculus
gatgcggtgaccttgaatcttcaag

SEQ ID NO: 513894 - DNA, 25 bp, Mus musculus
gatgcggtgagtcccaaaacctcgg

SEQ ID NO: 513895 - DNA, 25 bp, Mus musculus
gatgcggtgagtgccaaaacctcgg

SEQ ID NO: 513896 - DNA, 25 bp, Mus musculus
gatgcggtggctaatgtactactta

SEQ ID NO: 513897 - DNA, 25 bp, Mus musculus
gatgcggtggcttatgtactactta

SEQ ID NO: 513898 - DNA, 25 bp, Mus musculus
gatgcggttacgcttcagagatacc

SEQ ID NO: 513899 - DNA, 25 bp, Mus musculus
gatgcggttacggttcagagatacc

SEQ ID NO: 513900 - DNA, 25 bp, Mus musculus
gatgcggttgatcttttccttcaag

SEQ ID NO: 513901 - DNA, 25 bp, Mus musculus
gatgcggttgatgttttccttcaag

SEQ ID NO: 513902 - DNA, 25 bp, Mus musculus
gatgcgtaatgaagagctgtttgtt

SEQ ID NO: 513903 - DNA, 25 bp, Mus musculus
gatgcgtaatgatgagctgtttgtt

SEQ ID NO: 513904 - DNA, 25 bp, Mus musculus
gatgcgtaatttataacacactgat

SEQ ID NO: 513905 - DNA, 25 bp, Mus musculus
gatgcgtaatttttaacacactgat

SEQ ID NO: 513906 - DNA, 25 bp, Mus musculus
gatgcgtaccacagcatttggttta

SEQ ID NO: 513907 - DNA, 25 bp, Mus musculus
gatgcgtaccactgcatttggttta

SEQ ID NO: 513908 - DNA, 25 bp, Mus musculus
gatgcgtattaacagggctagaaga

SEQ ID NO: 513909 - DNA, 25 bp, Mus musculus
gatgcgtattaagagggctagaaga

SEQ ID NO: 513910 - DNA, 25 bp, Mus musculus
gatgcgtgaaaacttggccacagtt

SEQ ID NO: 513911 - DNA, 25 bp, Mus musculus
gatgcgtgaaaagttggccacagtt

SEQ ID NO: 513912 - DNA, 25 bp, Mus musculus
gatgcgtgaaatcttcctccaggaa

SEQ ID NO: 513913 - DNA, 25 bp, Mus musculus
gatgcgtgaaatgttcctccaggaa

SEQ ID NO: 513914 - DNA, 25 bp, Mus musculus
gatgcgtgcacacgttttcagggaa

SEQ ID NO: 513915 - DNA, 25 bp, Mus musculus
gatgcgtgcacaggttttcagggaa

SEQ ID NO: 513916 - DNA, 25 bp, Mus musculus
gatgcgtgctaaacagattcctgaa

SEQ ID NO: 513917 - DNA, 25 bp, Mus musculus
gatgcgtgctaatcagattcctgaa

SEQ ID NO: 513918 - DNA, 25 bp, Mus musculus
gatgcgtgtcacatgaggtacatgc

SEQ ID NO: 513919 - DNA, 25 bp, Mus musculus
gatgcgtgtcacttgaggtacatgc

SEQ ID NO: 513920 - DNA, 25 bp, Mus musculus
gatgcgtgtggaccttagagacaac

SEQ ID NO: 513921 - DNA, 25 bp, Mus musculus
gatgcgtgtggagcttagagacaac

SEQ ID NO: 513922 - DNA, 25 bp, Mus musculus
gatgcgtgtttgatgtactctgtca

SEQ ID NO: 513923 - DNA, 25 bp, Mus musculus
gatgcgtgtttgttgtactctgtca

SEQ ID NO: 513924 - DNA, 25 bp, Mus musculus
gatgcgttctgcatttcctgatgac

SEQ ID NO: 513925 - DNA, 25 bp, Mus musculus
gatgcgttctgcttttcctgatgac

SEQ ID NO: 513926 - DNA, 25 bp, Mus musculus
gatgcgttgaagcacatcaacacct

SEQ ID NO: 513927 - DNA, 25 bp, Mus musculus
gatgcgttgaaggacatcaacacct

SEQ ID NO: 513928 - DNA, 25 bp, Mus musculus
gatgcgtttgagagtgagcccaatc

SEQ ID NO: 513929 - DNA, 25 bp, Mus musculus
gatgcgtttgagtgtgagcccaatc

SEQ ID NO: 513930 - DNA, 25 bp, Mus musculus
gatgcgtttgcaccttttgttggga

SEQ ID NO: 513931 - DNA, 25 bp, Mus musculus
gatgcgtttgcagcttttgttggga

SEQ ID NO: 513932 - DNA, 25 bp, Mus musculus
gatgcgttttccagacggtggcagc

SEQ ID NO: 513933 - DNA, 25 bp, Mus musculus
gatgcgttttcctgacggtggcagc

SEQ ID NO: 513934 - DNA, 25 bp, Mus musculus
gatgctaaaagcaatccaggatttt

SEQ ID NO: 513935 - DNA, 25 bp, Mus musculus
gatgctaaaagcagagccctctttc

SEQ ID NO: 513936 - DNA, 25 bp, Mus musculus
gatgctaaaagctatccaggatttt

SEQ ID NO: 513937 - DNA, 25 bp, Mus musculus
gatgctaaaagctgagccctctttc

SEQ ID NO: 513938 - DNA, 25 bp, Mus musculus
gatgctaacaacactggccaagcct

SEQ ID NO: 513939 - DNA, 25 bp, Mus musculus
gatgctaacaactctggccaagcct

SEQ ID NO: 513940 - DNA, 25 bp, Mus musculus
gatgctaacacaacaattcagggct

SEQ ID NO: 513941 - DNA, 25 bp, Mus musculus
gatgctaacacatcaattcagggct

SEQ ID NO: 513942 - DNA, 25 bp, Mus musculus
gatgctaacccaagtaatatatcat

SEQ ID NO: 513943 - DNA, 25 bp, Mus musculus
gatgctaacccatgtaatatatcat

SEQ ID NO: 513944 - DNA, 25 bp, Mus musculus
gatgctaacgtgacagaatccttaa

SEQ ID NO: 513945 - DNA, 25 bp, Mus musculus
gatgctaacgtgtcagaatccttaa

SEQ ID NO: 513946 - DNA, 25 bp, Mus musculus
gatgctaacgttctaacctgtcagt

SEQ ID NO: 513947 - DNA, 25 bp, Mus musculus
gatgctaacgttgtaacctgtcagt

SEQ ID NO: 513948 - DNA, 25 bp, Mus musculus
gatgctaagcaacaaagtcacacta

SEQ ID NO: 513949 - DNA, 25 bp, Mus musculus
gatgctaagcaagaaagtcacacta

SEQ ID NO: 513950 - DNA, 25 bp, Mus musculus
gatgctaagcatctggttcccttta

SEQ ID NO: 513951 - DNA, 25 bp, Mus musculus
gatgctaagcatgtggttcccttta

SEQ ID NO: 513952 - DNA, 25 bp, Mus musculus
gatgctaatataatctagttttatc

SEQ ID NO: 513953 - DNA, 25 bp, Mus musculus
gatgctaatatattctagttttatc

SEQ ID NO: 513954 - DNA, 25 bp, Mus musculus
gatgctaatcatcagcctccaattt

SEQ ID NO: 513955 - DNA, 25 bp, Mus musculus
gatgctaatcatgagcctccaattt

SEQ ID NO: 513956 - DNA, 25 bp, Mus musculus
gatgctaatgacatgaactgggaac

SEQ ID NO: 513957 - DNA, 25 bp, Mus musculus
gatgctaatgacttgaactgggaac

SEQ ID NO: 513958 - DNA, 25 bp, Mus musculus
gatgctaatgtacagctgccttcct

SEQ ID NO: 513959 - DNA, 25 bp, Mus musculus
gatgctaatgtagagctgccttcct

SEQ ID NO: 513960 - DNA, 25 bp, Mus musculus
gatgctaattaaactcctccaggac

SEQ ID NO: 513961 - DNA, 25 bp, Mus musculus
gatgctaattaatctcctccaggac

SEQ ID NO: 513962 - DNA, 25 bp, Mus musculus
gatgctaattgtcttctgtatctga

SEQ ID NO: 513963 - DNA, 25 bp, Mus musculus
gatgctaattgtgttctgtatctga

SEQ ID NO: 513964 - DNA, 25 bp, Mus musculus
gatgctaattttactgtcctattaa

SEQ ID NO: 513965 - DNA, 25 bp, Mus musculus
gatgctaatttttctgtcctattaa

SEQ ID NO: 513966 - DNA, 25 bp, Mus musculus
gatgctacaatgagatgtgcctgga

SEQ ID NO: 513967 - DNA, 25 bp, Mus musculus
gatgctacaatgtgatgtgcctgga

SEQ ID NO: 513968 - DNA, 25 bp, Mus musculus
gatgctacagggacattgtttattt

SEQ ID NO: 513969 - DNA, 25 bp, Mus musculus
gatgctacagggtcattgtttattt

SEQ ID NO: 513970 - DNA, 25 bp, Mus musculus
gatgctaccagcaaattgatagacg

SEQ ID NO: 513971 - DNA, 25 bp, Mus musculus
gatgctaccagctaattgatagacg

SEQ ID NO: 513972 - DNA, 25 bp, Mus musculus
gatgctaccgagagaccttttgctg

SEQ ID NO: 513973 - DNA, 25 bp, Mus musculus
gatgctaccgagtgaccttttgctg

SEQ ID NO: 513974 - DNA, 25 bp, Mus musculus
gatgctaccgtacgcggccaacagc

SEQ ID NO: 513975 - DNA, 25 bp, Mus musculus
gatgctaccgtaggcggccaacagc

SEQ ID NO: 513976 - DNA, 25 bp, Mus musculus
gatgctacctagaacatatgcacaa

SEQ ID NO: 513977 - DNA, 25 bp, Mus musculus
gatgctacctagtacatatgcacaa

SEQ ID NO: 513978 - DNA, 25 bp, Mus musculus
gatgctaccttacagtcagaataac

SEQ ID NO: 513979 - DNA, 25 bp, Mus musculus
gatgctaccttagagtcagaataac

SEQ ID NO: 513980 - DNA, 25 bp, Mus musculus
gatgctacgggtatgccaggcgcct

SEQ ID NO: 513981 - DNA, 25 bp, Mus musculus
gatgctacgggtttgccaggcgcct

SEQ ID NO: 513982 - DNA, 25 bp, Mus musculus
gatgctactacaatgttttacacat

SEQ ID NO: 513983 - DNA, 25 bp, Mus musculus
gatgctactacattgttttacacat

SEQ ID NO: 513984 - DNA, 25 bp, Mus musculus
gatgctactattagtggtactgact

SEQ ID NO: 513985 - DNA, 25 bp, Mus musculus
gatgctactatttgtggtactgact

SEQ ID NO: 513986 - DNA, 25 bp, Mus musculus
gatgctactcctcttgctaattcaa

SEQ ID NO: 513987 - DNA, 25 bp, Mus musculus
gatgctactcctgttgctaattcaa

SEQ ID NO: 513988 - DNA, 25 bp, Mus musculus
gatgctactgtgaagggctccacat

SEQ ID NO: 513989 - DNA, 25 bp, Mus musculus
gatgctactgtgtagggctccacat

SEQ ID NO: 513990 - DNA, 25 bp, Mus musculus
gatgctacttcaattcaccttatgg

SEQ ID NO: 513991 - DNA, 25 bp, Mus musculus
gatgctacttcacgagtcagccttg

SEQ ID NO: 513992 - DNA, 25 bp, Mus musculus
gatgctacttcaggagtcagccttg

SEQ ID NO: 513993 - DNA, 25 bp, Mus musculus
gatgctacttcatttcaccttatgg

SEQ ID NO: 513994 - DNA, 25 bp, Mus musculus
gatgctagaaatagggtccttttac

SEQ ID NO: 513995 - DNA, 25 bp, Mus musculus
gatgctagaaattgggtccttttac

SEQ ID NO: 513996 - DNA, 25 bp, Mus musculus
gatgctagaagcagactgcccatgt

SEQ ID NO: 513997 - DNA, 25 bp, Mus musculus
gatgctagaagctgactgcccatgt

SEQ ID NO: 513998 - DNA, 25 bp, Mus musculus
gatgctagacataaatctttcaggt

SEQ ID NO: 513999 - DNA, 25 bp, Mus musculus
gatgctagacattaatctttcaggt

SEQ ID NO: 514000 - DNA, 25 bp, Mus musculus
gatgctagagagattcacttgaaca

SEQ ID NO: 514001 - DNA, 25 bp, Mus musculus
gatgctagagagtttcacttgaaca

SEQ ID NO: 514002 - DNA, 25 bp, Mus musculus
gatgctagagccacagtctgaaaac

SEQ ID NO: 514003 - DNA, 25 bp, Mus musculus
gatgctagagcctcagtctgaaaac

SEQ ID NO: 514004 - DNA, 25 bp, Mus musculus
gatgctagcaccacagagggcctca

SEQ ID NO: 514005 - DNA, 25 bp, Mus musculus
gatgctagcacctcagagggcctca

SEQ ID NO: 514006 - DNA, 25 bp, Mus musculus
gatgctagcatcagaggaacttttt

SEQ ID NO: 514007 - DNA, 25 bp, Mus musculus
gatgctagcatctgaggaacttttt

SEQ ID NO: 514008 - DNA, 25 bp, Mus musculus
gatgctagcttaaaacgccctacag

SEQ ID NO: 514009 - DNA, 25 bp, Mus musculus
gatgctagcttataacgccctacag

SEQ ID NO: 514010 - DNA, 25 bp, Mus musculus
gatgctaggaacagctactgcttta

SEQ ID NO: 514011 - DNA, 25 bp, Mus musculus
gatgctaggaactgctactgcttta

SEQ ID NO: 514012 - DNA, 25 bp, Mus musculus
gatgctaggaatccacatggtgtaa

SEQ ID NO: 514013 - DNA, 25 bp, Mus musculus
gatgctaggaatgcacatggtgtaa

SEQ ID NO: 514014 - DNA, 25 bp, Mus musculus
gatgctaggagtccaacgtccaaag

SEQ ID NO: 514015 - DNA, 25 bp, Mus musculus
gatgctaggagtgcaacgtccaaag

SEQ ID NO: 514016 - DNA, 25 bp, Mus musculus
gatgctaggatgctggttttactgt

SEQ ID NO: 514017 - DNA, 25 bp, Mus musculus
gatgctaggatggtggttttactgt

SEQ ID NO: 514018 - DNA, 25 bp, Mus musculus
gatgctaggcccaactaggagcaat

SEQ ID NO: 514019 - DNA, 25 bp, Mus musculus
gatgctaggccctactaggagcaat

SEQ ID NO: 514020 - DNA, 25 bp, Mus musculus
gatgctaggtacacacaaactggat

SEQ ID NO: 514021 - DNA, 25 bp, Mus musculus
gatgctaggtactcacaaactggat

SEQ ID NO: 514022 - DNA, 25 bp, Mus musculus
gatgctaggtcactggtacaggcca

SEQ ID NO: 514023 - DNA, 25 bp, Mus musculus
gatgctaggtcagtggtacaggcca

SEQ ID NO: 514024 - DNA, 25 bp, Mus musculus
gatgctaggtgcagaatctcacggt

SEQ ID NO: 514025 - DNA, 25 bp, Mus musculus
gatgctaggtgctgaatctcacggt

SEQ ID NO: 514026 - DNA, 25 bp, Mus musculus
gatgctatacaacaagccaggctca

SEQ ID NO: 514027 - DNA, 25 bp, Mus musculus
gatgctatacaagaagccaggctca

SEQ ID NO: 514028 - DNA, 25 bp, Mus musculus
gatgctatacagaagatggcttcct

SEQ ID NO: 514029 - DNA, 25 bp, Mus musculus
gatgctatacagtagatggcttcct

SEQ ID NO: 514030 - DNA, 25 bp, Mus musculus
gatgctatacttattgtgtgttagg

SEQ ID NO: 514031 - DNA, 25 bp, Mus musculus
gatgctatactttttgtgtgttagg

SEQ ID NO: 514032 - DNA, 25 bp, Mus musculus
gatgctatagctcttcattaaagga

SEQ ID NO: 514033 - DNA, 25 bp, Mus musculus
gatgctatagctgttcattaaagga

SEQ ID NO: 514034 - DNA, 25 bp, Mus musculus
gatgctataggcatgctcaactgct

SEQ ID NO: 514035 - DNA, 25 bp, Mus musculus
gatgctataggcttgctcaactgct

SEQ ID NO: 514036 - DNA, 25 bp, Mus musculus
gatgctatatgccagcgcaccagtc

SEQ ID NO: 514037 - DNA, 25 bp, Mus musculus
gatgctatatgcgagcgcaccagtc

SEQ ID NO: 514038 - DNA, 25 bp, Mus musculus
gatgctatgactctgattcacaagt

SEQ ID NO: 514039 - DNA, 25 bp, Mus musculus
gatgctatgactgtgattcacaagt

SEQ ID NO: 514040 - DNA, 25 bp, Mus musculus
gatgctatgagtacaccacttccaa

SEQ ID NO: 514041 - DNA, 25 bp, Mus musculus
gatgctatgagttcaccacttccaa

SEQ ID NO: 514042 - DNA, 25 bp, Mus musculus
gatgctatggatcctttcttttctt

SEQ ID NO: 514043 - DNA, 25 bp, Mus musculus
gatgctatggatgctttcttttctt

SEQ ID NO: 514044 - DNA, 25 bp, Mus musculus
gatgctatggcccttgaacagagtt

SEQ ID NO: 514045 - DNA, 25 bp, Mus musculus
gatgctatggccgttgaacagagtt

SEQ ID NO: 514046 - DNA, 25 bp, Mus musculus
gatgctatgtaaccgtttcccagct

SEQ ID NO: 514047 - DNA, 25 bp, Mus musculus
gatgctatgtaagcgtttcccagct

SEQ ID NO: 514048 - DNA, 25 bp, Mus musculus
gatgctatgtatcctctgaactggc

SEQ ID NO: 514049 - DNA, 25 bp, Mus musculus
gatgctatgtatgctctgaactggc

SEQ ID NO: 514050 - DNA, 25 bp, Mus musculus
gatgctattaataccttatggctac

SEQ ID NO: 514051 - DNA, 25 bp, Mus musculus
gatgctattaattccttatggctac

SEQ ID NO: 514052 - DNA, 25 bp, Mus musculus
gatgctattataacctgtctgtcta

SEQ ID NO: 514053 - DNA, 25 bp, Mus musculus
gatgctattatatcctgtctgtcta

SEQ ID NO: 514054 - DNA, 25 bp, Mus musculus
gatgctattcataagggctcccaag

SEQ ID NO: 514055 - DNA, 25 bp, Mus musculus
gatgctattcattagggctcccaag

SEQ ID NO: 514056 - DNA, 25 bp, Mus musculus
gatgctattctcagatctaacagct

SEQ ID NO: 514057 - DNA, 25 bp, Mus musculus
gatgctattctctgatctaacagct

SEQ ID NO: 514058 - DNA, 25 bp, Mus musculus
gatgctattcttcattgctatgccc

SEQ ID NO: 514059 - DNA, 25 bp, Mus musculus
gatgctattcttgattgctatgccc

SEQ ID NO: 514060 - DNA, 25 bp, Mus musculus
gatgctatttgaaaccaagggcttt

SEQ ID NO: 514061 - DNA, 25 bp, Mus musculus
gatgctatttgataccaagggcttt

SEQ ID NO: 514062 - DNA, 25 bp, Mus musculus
gatgctatttgcatatttgatgtta

SEQ ID NO: 514063 - DNA, 25 bp, Mus musculus
gatgctatttgcttatttgatgtta

SEQ ID NO: 514064 - DNA, 25 bp, Mus musculus
gatgctcaaacacaatcctgtgctg

SEQ ID NO: 514065 - DNA, 25 bp, Mus musculus
gatgctcaaacagaatcctgtgctg

SEQ ID NO: 514066 - DNA, 25 bp, Mus musculus
gatgctcaaactattgtggcgctct

SEQ ID NO: 514067 - DNA, 25 bp, Mus musculus
gatgctcaaacttttgtggcgctct

SEQ ID NO: 514068 - DNA, 25 bp, Mus musculus
gatgctcaacctcacgaaagtcagt

SEQ ID NO: 514069 - DNA, 25 bp, Mus musculus
gatgctcaacctgacgaaagtcagt

SEQ ID NO: 514070 - DNA, 25 bp, Mus musculus
gatgctcaacggagctgtcttcaga

SEQ ID NO: 514071 - DNA, 25 bp, Mus musculus
gatgctcaacggtgctgtcttcaga

SEQ ID NO: 514072 - DNA, 25 bp, Mus musculus
gatgctcaagaacgccagaggccag

SEQ ID NO: 514073 - DNA, 25 bp, Mus musculus
gatgctcaagaaggccagaggccag

SEQ ID NO: 514074 - DNA, 25 bp, Mus musculus
gatgctcaagcaagtcgtaaaccca

SEQ ID NO: 514075 - DNA, 25 bp, Mus musculus
gatgctcaagcatgtcgtaaaccca

SEQ ID NO: 514076 - DNA, 25 bp, Mus musculus
gatgctcaagtgatcaggctgcctg

SEQ ID NO: 514077 - DNA, 25 bp, Mus musculus
gatgctcaagtgttcaggctgcctg

SEQ ID NO: 514078 - DNA, 25 bp, Mus musculus
gatgctcacagaaaatttattcccc

SEQ ID NO: 514079 - DNA, 25 bp, Mus musculus
gatgctcacagataatttattcccc

SEQ ID NO: 514080 - DNA, 25 bp, Mus musculus
gatgctcacagcctagggcacattt

SEQ ID NO: 514081 - DNA, 25 bp, Mus musculus
gatgctcacagcgtagggcacattt

SEQ ID NO: 514082 - DNA, 25 bp, Mus musculus
gatgctcacatacctgtgttctttg

SEQ ID NO: 514083 - DNA, 25 bp, Mus musculus
gatgctcacatagctgtgttctttg

SEQ ID NO: 514084 - DNA, 25 bp, Mus musculus
gatgctcaccatagaatggcagact

SEQ ID NO: 514085 - DNA, 25 bp, Mus musculus
gatgctcaccattgaatggcagact

SEQ ID NO: 514086 - DNA, 25 bp, Mus musculus
gatgctcaccctaacttcagatttg

SEQ ID NO: 514087 - DNA, 25 bp, Mus musculus
gatgctcacccttacttcagatttg

SEQ ID NO: 514088 - DNA, 25 bp, Mus musculus
gatgctcacgagattgggccagtgt

SEQ ID NO: 514089 - DNA, 25 bp, Mus musculus
gatgctcacgagtttgggccagtgt

SEQ ID NO: 514090 - DNA, 25 bp, Mus musculus
gatgctcacgcaaacatgcagacaa

SEQ ID NO: 514091 - DNA, 25 bp, Mus musculus
gatgctcacgcatacatgcagacaa

SEQ ID NO: 514092 - DNA, 25 bp, Mus musculus
gatgctcactagagaaccccaggga

SEQ ID NO: 514093 - DNA, 25 bp, Mus musculus
gatgctcactagtgaaccccaggga

SEQ ID NO: 514094 - DNA, 25 bp, Mus musculus
gatgctcactcaagacagcgtgtgc

SEQ ID NO: 514095 - DNA, 25 bp, Mus musculus
gatgctcactcatgacagcgtgtgc

SEQ ID NO: 514096 - DNA, 25 bp, Mus musculus
gatgctcacttgcaagttattacaa

SEQ ID NO: 514097 - DNA, 25 bp, Mus musculus
gatgctcacttggaagttattacaa

SEQ ID NO: 514098 - DNA, 25 bp, Mus musculus
gatgctcagaccacatgtattctat

SEQ ID NO: 514099 - DNA, 25 bp, Mus musculus
gatgctcagacctcatgtattctat

SEQ ID NO: 514100 - DNA, 25 bp, Mus musculus
gatgctcagagaataggtattcata

SEQ ID NO: 514101 - DNA, 25 bp, Mus musculus
gatgctcagagacctcaagtgcagc

SEQ ID NO: 514102 - DNA, 25 bp, Mus musculus
gatgctcagagagctcaagtgcagc

SEQ ID NO: 514103 - DNA, 25 bp, Mus musculus
gatgctcagagattaggtattcata

SEQ ID NO: 514104 - DNA, 25 bp, Mus musculus
gatgctcagaggcaagatcagatgt

SEQ ID NO: 514105 - DNA, 25 bp, Mus musculus
gatgctcagagggaagatcagatgt

SEQ ID NO: 514106 - DNA, 25 bp, Mus musculus
gatgctcagataaaccaacggtcct

SEQ ID NO: 514107 - DNA, 25 bp, Mus musculus
gatgctcagatataccaacggtcct

SEQ ID NO: 514108 - DNA, 25 bp, Mus musculus
gatgctcagattatacctgtccagt

SEQ ID NO: 514109 - DNA, 25 bp, Mus musculus
gatgctcagattttacctgtccagt

SEQ ID NO: 514110 - DNA, 25 bp, Mus musculus
gatgctcagcataaaacctagggac

SEQ ID NO: 514111 - DNA, 25 bp, Mus musculus
gatgctcagcattaaacctagggac

SEQ ID NO: 514112 - DNA, 25 bp, Mus musculus
gatgctcagcccacatgaaaatgac

SEQ ID NO: 514113 - DNA, 25 bp, Mus musculus
gatgctcagccctcatgaaaatgac

SEQ ID NO: 514114 - DNA, 25 bp, Mus musculus
gatgctcagctgacacatcaaagga

SEQ ID NO: 514115 - DNA, 25 bp, Mus musculus
gatgctcagctgagatcacttcatt

SEQ ID NO: 514116 - DNA, 25 bp, Mus musculus
gatgctcagctgctaatcttgctct

SEQ ID NO: 514117 - DNA, 25 bp, Mus musculus
gatgctcagctggtaatcttgctct

SEQ ID NO: 514118 - DNA, 25 bp, Mus musculus
gatgctcagctgtcacatcaaagga

SEQ ID NO: 514119 - DNA, 25 bp, Mus musculus
gatgctcagctgtgatcacttcatt

SEQ ID NO: 514120 - DNA, 25 bp, Mus musculus
gatgctcagcttcgagccttgaaga

SEQ ID NO: 514121 - DNA, 25 bp, Mus musculus
gatgctcagcttggagccttgaaga

SEQ ID NO: 514122 - DNA, 25 bp, Mus musculus
gatgctcaggagatccactgcaggc

SEQ ID NO: 514123 - DNA, 25 bp, Mus musculus
gatgctcaggagattacccagtgcc

SEQ ID NO: 514124 - DNA, 25 bp, Mus musculus
gatgctcaggagttccactgcaggc

SEQ ID NO: 514125 - DNA, 25 bp, Mus musculus
gatgctcaggagtttacccagtgcc

SEQ ID NO: 514126 - DNA, 25 bp, Mus musculus
gatgctcaggccatttttctagtgc

SEQ ID NO: 514127 - DNA, 25 bp, Mus musculus
gatgctcaggccttttttctagtgc

SEQ ID NO: 514128 - DNA, 25 bp, Mus musculus
gatgctcaggcgagctgaagtccat

SEQ ID NO: 514129 - DNA, 25 bp, Mus musculus
gatgctcaggcgtgctgaagtccat

SEQ ID NO: 514130 - DNA, 25 bp, Mus musculus
gatgctcaggtaatcaactccaaat

SEQ ID NO: 514131 - DNA, 25 bp, Mus musculus
gatgctcaggtattcaactccaaat

SEQ ID NO: 514132 - DNA, 25 bp, Mus musculus
gatgctcagtatatattgtgaacct

SEQ ID NO: 514133 - DNA, 25 bp, Mus musculus
gatgctcagtatcctaaggtctaag

SEQ ID NO: 514134 - DNA, 25 bp, Mus musculus
gatgctcagtatgctaaggtctaag

SEQ ID NO: 514135 - DNA, 25 bp, Mus musculus
gatgctcagtatttattgtgaacct

SEQ ID NO: 514136 - DNA, 25 bp, Mus musculus
gatgctcagtggctgtatgataacc

SEQ ID NO: 514137 - DNA, 25 bp, Mus musculus
gatgctcagtgggtgtatgataacc

SEQ ID NO: 514138 - DNA, 25 bp, Mus musculus
gatgctcataaactttttctcaacc

SEQ ID NO: 514139 - DNA, 25 bp, Mus musculus
gatgctcataaagtttttctcaacc

SEQ ID NO: 514140 - DNA, 25 bp, Mus musculus
gatgctcatgacatctacaaagggt

SEQ ID NO: 514141 - DNA, 25 bp, Mus musculus
gatgctcatgacttctacaaagggt

SEQ ID NO: 514142 - DNA, 25 bp, Mus musculus
gatgctcatgatcaaatgctccctt

SEQ ID NO: 514143 - DNA, 25 bp, Mus musculus
gatgctcatgatgaaatgctccctt

SEQ ID NO: 514144 - DNA, 25 bp, Mus musculus
gatgctcatgcaaaagtctctctgg

SEQ ID NO: 514145 - DNA, 25 bp, Mus musculus
gatgctcatgcataagtctctctgg

SEQ ID NO: 514146 - DNA, 25 bp, Mus musculus
gatgctcatgcccattttattctta

SEQ ID NO: 514147 - DNA, 25 bp, Mus musculus
gatgctcatgccgattttattctta

SEQ ID NO: 514148 - DNA, 25 bp, Mus musculus
gatgctcatggaaccagttcttagc

SEQ ID NO: 514149 - DNA, 25 bp, Mus musculus
gatgctcatggatccagttcttagc

SEQ ID NO: 514150 - DNA, 25 bp, Mus musculus
gatgctcatggcctgtattttgtat

SEQ ID NO: 514151 - DNA, 25 bp, Mus musculus
gatgctcatggcgtgtattttgtat

SEQ ID NO: 514152 - DNA, 25 bp, Mus musculus
gatgctcatgtgcttactgtactgt

SEQ ID NO: 514153 - DNA, 25 bp, Mus musculus
gatgctcatgtggttactgtactgt

SEQ ID NO: 514154 - DNA, 25 bp, Mus musculus
gatgctcattttctctgaactgtga

SEQ ID NO: 514155 - DNA, 25 bp, Mus musculus
gatgctcattttgtctgaactgtga

SEQ ID NO: 514156 - DNA, 25 bp, Mus musculus
gatgctccacctattctatcctgga

SEQ ID NO: 514157 - DNA, 25 bp, Mus musculus
gatgctccaccttttctatcctgga

SEQ ID NO: 514158 - DNA, 25 bp, Mus musculus
gatgctccagaaattgctgacgcca

SEQ ID NO: 514159 - DNA, 25 bp, Mus musculus
gatgctccagaatttgctgacgcca

SEQ ID NO: 514160 - DNA, 25 bp, Mus musculus
gatgctccagctccaatcaggcctt

SEQ ID NO: 514161 - DNA, 25 bp, Mus musculus
gatgctccagctccctagaatctga

SEQ ID NO: 514162 - DNA, 25 bp, Mus musculus
gatgctccagctgcaatcaggcctt

SEQ ID NO: 514163 - DNA, 25 bp, Mus musculus
gatgctccagctgcctagaatctga

SEQ ID NO: 514164 - DNA, 25 bp, Mus musculus
gatgctccagggatttgtcacctga

SEQ ID NO: 514165 - DNA, 25 bp, Mus musculus
gatgctccagggttttgtcacctga

SEQ ID NO: 514166 - DNA, 25 bp, Mus musculus
gatgctccagtgaaccaatcacttg

SEQ ID NO: 514167 - DNA, 25 bp, Mus musculus
gatgctccagtgtaccaatcacttg

SEQ ID NO: 514168 - DNA, 25 bp, Mus musculus
gatgctccatcacttctaatgtcta

SEQ ID NO: 514169 - DNA, 25 bp, Mus musculus
gatgctccatcagttctaatgtcta

SEQ ID NO: 514170 - DNA, 25 bp, Mus musculus
gatgctccattacactccgtgcaga

SEQ ID NO: 514171 - DNA, 25 bp, Mus musculus
gatgctccattagactccgtgcaga

SEQ ID NO: 514172 - DNA, 25 bp, Mus musculus
gatgctccatttacctggtttacga

SEQ ID NO: 514173 - DNA, 25 bp, Mus musculus
gatgctccattttcctggtttacga

SEQ ID NO: 514174 - DNA, 25 bp, Mus musculus
gatgctccccggctgattgaagagt

SEQ ID NO: 514175 - DNA, 25 bp, Mus musculus
gatgctccccgggtgattgaagagt

SEQ ID NO: 514176 - DNA, 25 bp, Mus musculus
gatgctccctgcaaagctttagtgt

SEQ ID NO: 514177 - DNA, 25 bp, Mus musculus
gatgctccctgctaagctttagtgt

SEQ ID NO: 514178 - DNA, 25 bp, Mus musculus
gatgctccgagacctactgcatctg

SEQ ID NO: 514179 - DNA, 25 bp, Mus musculus
gatgctccgagagctactgcatctg

SEQ ID NO: 514180 - DNA, 25 bp, Mus musculus
gatgctcctagcaaaagaatgcttt

SEQ ID NO: 514181 - DNA, 25 bp, Mus musculus
gatgctcctagctaaagaatgcttt

SEQ ID NO: 514182 - DNA, 25 bp, Mus musculus
gatgctcctcagcaaggatgaccag

SEQ ID NO: 514183 - DNA, 25 bp, Mus musculus
gatgctcctcaggaaggatgaccag

SEQ ID NO: 514184 - DNA, 25 bp, Mus musculus
gatgctcctgacaaaagcttgacaa

SEQ ID NO: 514185 - DNA, 25 bp, Mus musculus
gatgctcctgactaaagcttgacaa

SEQ ID NO: 514186 - DNA, 25 bp, Mus musculus
gatgctcctgggactttttaaacat

SEQ ID NO: 514187 - DNA, 25 bp, Mus musculus
gatgctcctgggtctttttaaacat

SEQ ID NO: 514188 - DNA, 25 bp, Mus musculus
gatgctcctgttaagcttttacact

SEQ ID NO: 514189 - DNA, 25 bp, Mus musculus
gatgctcctgtttagcttttacact

SEQ ID NO: 514190 - DNA, 25 bp, Mus musculus
gatgctcgacatagtggacgccatt

SEQ ID NO: 514191 - DNA, 25 bp, Mus musculus
gatgctcgacattgtggacgccatt

SEQ ID NO: 514192 - DNA, 25 bp, Mus musculus
gatgctcgagcaattggctctgctt

SEQ ID NO: 514193 - DNA, 25 bp, Mus musculus
gatgctcgagcatttggctctgctt

SEQ ID NO: 514194 - DNA, 25 bp, Mus musculus
gatgctcgcccgatggccggagtct

SEQ ID NO: 514195 - DNA, 25 bp, Mus musculus
gatgctcgcccgttggccggagtct

SEQ ID NO: 514196 - DNA, 25 bp, Mus musculus
gatgctcgctgtcaaggtctaggat

SEQ ID NO: 514197 - DNA, 25 bp, Mus musculus
gatgctcgctgtgaaggtctaggat

SEQ ID NO: 514198 - DNA, 25 bp, Mus musculus
gatgctcggaagacagcctcttatt

SEQ ID NO: 514199 - DNA, 25 bp, Mus musculus
gatgctcggaagtcagcctcttatt

SEQ ID NO: 514200 - DNA, 25 bp, Mus musculus
gatgctcggatcattttacagcaga

SEQ ID NO: 514201 - DNA, 25 bp, Mus musculus
gatgctcggatctttttacagcaga

SEQ ID NO: 514202 - DNA, 25 bp, Mus musculus
gatgctcgtcttagctcaacttgat

SEQ ID NO: 514203 - DNA, 25 bp, Mus musculus
gatgctcgtctttgctcaacttgat

SEQ ID NO: 514204 - DNA, 25 bp, Mus musculus
gatgctcgtgagcatcgtggcacaa

SEQ ID NO: 514205 - DNA, 25 bp, Mus musculus
gatgctcgtgaggatcgtggcacaa

SEQ ID NO: 514206 - DNA, 25 bp, Mus musculus
gatgctctaaagagcaactcctagc

SEQ ID NO: 514207 - DNA, 25 bp, Mus musculus
gatgctctaaagtgcaactcctagc

SEQ ID NO: 514208 - DNA, 25 bp, Mus musculus
gatgctctaaatcagtgcagtaggt

SEQ ID NO: 514209 - DNA, 25 bp, Mus musculus
gatgctctaaatgagtgcagtaggt

SEQ ID NO: 514210 - DNA, 25 bp, Mus musculus
gatgctctaactagatgatcgacct

SEQ ID NO: 514211 - DNA, 25 bp, Mus musculus
gatgctctaacttgatgatcgacct

SEQ ID NO: 514212 - DNA, 25 bp, Mus musculus
gatgctctagcacttaattaaactc

SEQ ID NO: 514213 - DNA, 25 bp, Mus musculus
gatgctctagcagttaattaaactc

SEQ ID NO: 514214 - DNA, 25 bp, Mus musculus
gatgctctagccaagactactattt

SEQ ID NO: 514215 - DNA, 25 bp, Mus musculus
gatgctctagcctagactactattt

SEQ ID NO: 514216 - DNA, 25 bp, Mus musculus
gatgctctatagaatccaccagtct

SEQ ID NO: 514217 - DNA, 25 bp, Mus musculus
gatgctctatagtatccaccagtct

SEQ ID NO: 514218 - DNA, 25 bp, Mus musculus
gatgctctcacacgacttgaggctt

SEQ ID NO: 514219 - DNA, 25 bp, Mus musculus
gatgctctcacaggacttgaggctt

SEQ ID NO: 514220 - DNA, 25 bp, Mus musculus
gatgctctcaggaggatgctctcag

SEQ ID NO: 514221 - DNA, 25 bp, Mus musculus
gatgctctcaggtggatgctctcag

SEQ ID NO: 514222 - DNA, 25 bp, Mus musculus
gatgctctcgaccatttccagaaat

SEQ ID NO: 514223 - DNA, 25 bp, Mus musculus
gatgctctcgacgatttccagaaat

SEQ ID NO: 514224 - DNA, 25 bp, Mus musculus
gatgctctcgatcggcaccaggaac

SEQ ID NO: 514225 - DNA, 25 bp, Mus musculus
gatgctctcgatgggcaccaggaac

SEQ ID NO: 514226 - DNA, 25 bp, Mus musculus
gatgctctctagagttattctacct

SEQ ID NO: 514227 - DNA, 25 bp, Mus musculus
gatgctctctagtgttattctacct

SEQ ID NO: 514228 - DNA, 25 bp, Mus musculus
gatgctctctctacctttaagtgag

SEQ ID NO: 514229 - DNA, 25 bp, Mus musculus
gatgctctctctataaggtcttggg

SEQ ID NO: 514230 - DNA, 25 bp, Mus musculus
gatgctctctctataggatctggta

SEQ ID NO: 514231 - DNA, 25 bp, Mus musculus
gatgctctctcttcctttaagtgag

SEQ ID NO: 514232 - DNA, 25 bp, Mus musculus
gatgctctctctttaaggtcttggg

SEQ ID NO: 514233 - DNA, 25 bp, Mus musculus
gatgctctctctttaggatctggta

SEQ ID NO: 514234 - DNA, 25 bp, Mus musculus
gatgctctctggatcagtctcttga

SEQ ID NO: 514235 - DNA, 25 bp, Mus musculus
gatgctctctggttcagtctcttga

SEQ ID NO: 514236 - DNA, 25 bp, Mus musculus
gatgctctctgtaggaactcagacc

SEQ ID NO: 514237 - DNA, 25 bp, Mus musculus
gatgctctctgttggaactcagacc

SEQ ID NO: 514238 - DNA, 25 bp, Mus musculus
gatgctctgaacaggcatgcttaca

SEQ ID NO: 514239 - DNA, 25 bp, Mus musculus
gatgctctgaactggcatgcttaca

SEQ ID NO: 514240 - DNA, 25 bp, Mus musculus
gatgctctgagcaacccagcattca

SEQ ID NO: 514241 - DNA, 25 bp, Mus musculus
gatgctctgagctacccagcattca

SEQ ID NO: 514242 - DNA, 25 bp, Mus musculus
gatgctctgccaacaaagataaaca

SEQ ID NO: 514243 - DNA, 25 bp, Mus musculus
gatgctctgccacaggagatcgagt

SEQ ID NO: 514244 - DNA, 25 bp, Mus musculus
gatgctctgccagaggagatcgagt

SEQ ID NO: 514245 - DNA, 25 bp, Mus musculus
gatgctctgccatcaaagataaaca

SEQ ID NO: 514246 - DNA, 25 bp, Mus musculus
gatgctctgctgacatagataagca

SEQ ID NO: 514247 - DNA, 25 bp, Mus musculus
gatgctctgctgtcatagataagca

SEQ ID NO: 514248 - DNA, 25 bp, Mus musculus
gatgctctggctacaatgcacttag

SEQ ID NO: 514249 - DNA, 25 bp, Mus musculus
gatgctctggcttcaatgcacttag

SEQ ID NO: 514250 - DNA, 25 bp, Mus musculus
gatgctctggtgagtggtatgccac

SEQ ID NO: 514251 - DNA, 25 bp, Mus musculus
gatgctctggtgtgtggtatgccac

SEQ ID NO: 514252 - DNA, 25 bp, Mus musculus
gatgctctgtacactctggaggatg

SEQ ID NO: 514253 - DNA, 25 bp, Mus musculus
gatgctctgtactctctggaggatg

SEQ ID NO: 514254 - DNA, 25 bp, Mus musculus
gatgctctgtatcagtctctacttt

SEQ ID NO: 514255 - DNA, 25 bp, Mus musculus
gatgctctgtatccaacgctgtcga

SEQ ID NO: 514256 - DNA, 25 bp, Mus musculus
gatgctctgtatgagtctctacttt

SEQ ID NO: 514257 - DNA, 25 bp, Mus musculus
gatgctctgtatgcaacgctgtcga

SEQ ID NO: 514258 - DNA, 25 bp, Mus musculus
gatgctctgtgactgtaggtttcta

SEQ ID NO: 514259 - DNA, 25 bp, Mus musculus
gatgctctgtgagtgtaggtttcta

SEQ ID NO: 514260 - DNA, 25 bp, Mus musculus
gatgctctgttaccacacagacctt

SEQ ID NO: 514261 - DNA, 25 bp, Mus musculus
gatgctctgttagcacacagacctt

SEQ ID NO: 514262 - DNA, 25 bp, Mus musculus
gatgctcttaaaacagccctggtgt

SEQ ID NO: 514263 - DNA, 25 bp, Mus musculus
gatgctcttaaatcagccctggtgt

SEQ ID NO: 514264 - DNA, 25 bp, Mus musculus
gatgctcttacactctgcctgggat

SEQ ID NO: 514265 - DNA, 25 bp, Mus musculus
gatgctcttacagtctgcctgggat

SEQ ID NO: 514266 - DNA, 25 bp, Mus musculus
gatgctcttagcagagtgtcccgcg

SEQ ID NO: 514267 - DNA, 25 bp, Mus musculus
gatgctcttagctgagtgtcccgcg

SEQ ID NO: 514268 - DNA, 25 bp, Mus musculus
gatgctcttcctaaattcactggta

SEQ ID NO: 514269 - DNA, 25 bp, Mus musculus
gatgctcttccttaattcactggta

SEQ ID NO: 514270 - DNA, 25 bp, Mus musculus
gatgctcttgaaccttgttgaactt

SEQ ID NO: 514271 - DNA, 25 bp, Mus musculus
gatgctcttgaactagtcctcatta

SEQ ID NO: 514272 - DNA, 25 bp, Mus musculus
gatgctcttgaagcttgttgaactt

SEQ ID NO: 514273 - DNA, 25 bp, Mus musculus
gatgctcttgaagtagtcctcatta

SEQ ID NO: 514274 - DNA, 25 bp, Mus musculus
gatgctcttgagcaccatcaagtgt

SEQ ID NO: 514275 - DNA, 25 bp, Mus musculus
gatgctcttgaggaccatcaagtgt

SEQ ID NO: 514276 - DNA, 25 bp, Mus musculus
gatgctctttccaaacacatggaat

SEQ ID NO: 514277 - DNA, 25 bp, Mus musculus
gatgctctttcctaacacatggaat

SEQ ID NO: 514278 - DNA, 25 bp, Mus musculus
gatgctctttgaacatggtatcttt

SEQ ID NO: 514279 - DNA, 25 bp, Mus musculus
gatgctctttgaagggtctgaacag

SEQ ID NO: 514280 - DNA, 25 bp, Mus musculus
gatgctctttgatcatggtatcttt

SEQ ID NO: 514281 - DNA, 25 bp, Mus musculus
gatgctctttgatgggtctgaacag

SEQ ID NO: 514282 - DNA, 25 bp, Mus musculus
gatgctctttggacttctaacagga

SEQ ID NO: 514283 - DNA, 25 bp, Mus musculus
gatgctctttggtcttctaacagga

SEQ ID NO: 514284 - DNA, 25 bp, Mus musculus
gatgctgaaacacataggctaatgg

SEQ ID NO: 514285 - DNA, 25 bp, Mus musculus
gatgctgaaacagataggctaatgg

SEQ ID NO: 514286 - DNA, 25 bp, Mus musculus
gatgctgaaataacccagtgacttc

SEQ ID NO: 514287 - DNA, 25 bp, Mus musculus
gatgctgaaatatcccagtgacttc

SEQ ID NO: 514288 - DNA, 25 bp, Mus musculus
gatgctgaaatgaaaggttctctct

SEQ ID NO: 514289 - DNA, 25 bp, Mus musculus
gatgctgaaatgtaaggttctctct

SEQ ID NO: 514290 - DNA, 25 bp, Mus musculus
gatgctgaacacaagacctctgtat

SEQ ID NO: 514291 - DNA, 25 bp, Mus musculus
gatgctgaacactagacctctgtat

SEQ ID NO: 514292 - DNA, 25 bp, Mus musculus
gatgctgaaccaaagctttcctaat

SEQ ID NO: 514293 - DNA, 25 bp, Mus musculus
gatgctgaaccatagctttcctaat

SEQ ID NO: 514294 - DNA, 25 bp, Mus musculus
gatgctgaacctcagacgccaggct

SEQ ID NO: 514295 - DNA, 25 bp, Mus musculus
gatgctgaacctgagacgccaggct

SEQ ID NO: 514296 - DNA, 25 bp, Mus musculus
gatgctgaacgtagtcctctaagat

SEQ ID NO: 514297 - DNA, 25 bp, Mus musculus
gatgctgaacgttgtcctctaagat

SEQ ID NO: 514298 - DNA, 25 bp, Mus musculus
gatgctgaactcaggccctatctcc

SEQ ID NO: 514299 - DNA, 25 bp, Mus musculus
gatgctgaactctggccctatctcc

SEQ ID NO: 514300 - DNA, 25 bp, Mus musculus
gatgctgaagacagtccacactcca

SEQ ID NO: 514301 - DNA, 25 bp, Mus musculus
gatgctgaagactgtccacactcca

SEQ ID NO: 514302 - DNA, 25 bp, Mus musculus
gatgctgaagttccaaacagttcga

SEQ ID NO: 514303 - DNA, 25 bp, Mus musculus
gatgctgaagttgcaaacagttcga

SEQ ID NO: 514304 - DNA, 25 bp, Mus musculus
gatgctgacaaaataactctgggac

SEQ ID NO: 514305 - DNA, 25 bp, Mus musculus
gatgctgacaaattaactctgggac

SEQ ID NO: 514306 - DNA, 25 bp, Mus musculus
gatgctgacaccatgtctggagctt

SEQ ID NO: 514307 - DNA, 25 bp, Mus musculus
gatgctgacaccttgtctggagctt

SEQ ID NO: 514308 - DNA, 25 bp, Mus musculus
gatgctgacatgctctgagacttag

SEQ ID NO: 514309 - DNA, 25 bp, Mus musculus
gatgctgacatggtctgagacttag

SEQ ID NO: 514310 - DNA, 25 bp, Mus musculus
gatgctgaccatcacttaactccac

SEQ ID NO: 514311 - DNA, 25 bp, Mus musculus
gatgctgaccatgacttaactccac

SEQ ID NO: 514312 - DNA, 25 bp, Mus musculus
gatgctgactctccactctgatgcg

SEQ ID NO: 514313 - DNA, 25 bp, Mus musculus
gatgctgactctgcactctgatgcg

SEQ ID NO: 514314 - DNA, 25 bp, Mus musculus
gatgctgagacccatgactgaacat

SEQ ID NO: 514315 - DNA, 25 bp, Mus musculus
gatgctgagaccgatgactgaacat

SEQ ID NO: 514316 - DNA, 25 bp, Mus musculus
gatgctgagactcagtccttgtcct

SEQ ID NO: 514317 - DNA, 25 bp, Mus musculus
gatgctgagactgagtccttgtcct

SEQ ID NO: 514318 - DNA, 25 bp, Mus musculus
gatgctgagagccaagacccaggtt

SEQ ID NO: 514319 - DNA, 25 bp, Mus musculus
gatgctgagagcctactgtgtatgt

SEQ ID NO: 514320 - DNA, 25 bp, Mus musculus
gatgctgagagcgaagacccaggtt

SEQ ID NO: 514321 - DNA, 25 bp, Mus musculus
gatgctgagagcgtactgtgtatgt

SEQ ID NO: 514322 - DNA, 25 bp, Mus musculus
gatgctgagcagctttctaggcccg

SEQ ID NO: 514323 - DNA, 25 bp, Mus musculus
gatgctgagcaggtttctaggcccg

SEQ ID NO: 514324 - DNA, 25 bp, Mus musculus
gatgctgagcatctgtgctccacag

SEQ ID NO: 514325 - DNA, 25 bp, Mus musculus
gatgctgagcatgtgtgctccacag

SEQ ID NO: 514326 - DNA, 25 bp, Mus musculus
gatgctgagccgcattgagaagcaa

SEQ ID NO: 514327 - DNA, 25 bp, Mus musculus
gatgctgagccggattgagaagcaa

SEQ ID NO: 514328 - DNA, 25 bp, Mus musculus
gatgctgagggcaccttgcataaag

SEQ ID NO: 514329 - DNA, 25 bp, Mus musculus
gatgctgagggctccttgcataaag

SEQ ID NO: 514330 - DNA, 25 bp, Mus musculus
gatgctgagtacctcttttctattt

SEQ ID NO: 514331 - DNA, 25 bp, Mus musculus
gatgctgagtacgtcttttctattt

SEQ ID NO: 514332 - DNA, 25 bp, Mus musculus
gatgctgagtccactaatttagccg

SEQ ID NO: 514333 - DNA, 25 bp, Mus musculus
gatgctgagtcctctaatttagccg

SEQ ID NO: 514334 - DNA, 25 bp, Mus musculus
gatgctgataaaaacgacttgacca

SEQ ID NO: 514335 - DNA, 25 bp, Mus musculus
gatgctgataaatacgacttgacca

SEQ ID NO: 514336 - DNA, 25 bp, Mus musculus
gatgctgataggaagggaggcccct

SEQ ID NO: 514337 - DNA, 25 bp, Mus musculus
gatgctgataggtagggaggcccct

SEQ ID NO: 514338 - DNA, 25 bp, Mus musculus
gatgctgatcacctgtgatggtcta

SEQ ID NO: 514339 - DNA, 25 bp, Mus musculus
gatgctgatcacgtgtgatggtcta

SEQ ID NO: 514340 - DNA, 25 bp, Mus musculus
gatgctgatctaattatgcttggtc

SEQ ID NO: 514341 - DNA, 25 bp, Mus musculus
gatgctgatctaccaggtttagctc

SEQ ID NO: 514342 - DNA, 25 bp, Mus musculus
gatgctgatctagcaggtttagctc

SEQ ID NO: 514343 - DNA, 25 bp, Mus musculus
gatgctgatctatttatgcttggtc

SEQ ID NO: 514344 - DNA, 25 bp, Mus musculus
gatgctgatgcaagaggacctctga

SEQ ID NO: 514345 - DNA, 25 bp, Mus musculus
gatgctgatgcatgaggacctctga

SEQ ID NO: 514346 - DNA, 25 bp, Mus musculus
gatgctgatgcgcacttgtgatccc

SEQ ID NO: 514347 - DNA, 25 bp, Mus musculus
gatgctgatgcggacttgtgatccc

SEQ ID NO: 514348 - DNA, 25 bp, Mus musculus
gatgctgatgctatgggactccaca

SEQ ID NO: 514349 - DNA, 25 bp, Mus musculus
gatgctgatgctcggaacctgtatt

SEQ ID NO: 514350 - DNA, 25 bp, Mus musculus
gatgctgatgctgggaacctgtatt

SEQ ID NO: 514351 - DNA, 25 bp, Mus musculus
gatgctgatgctttgggactccaca

SEQ ID NO: 514352 - DNA, 25 bp, Mus musculus
gatgctgatggcagacaaagtcctt

SEQ ID NO: 514353 - DNA, 25 bp, Mus musculus
gatgctgatggctgacaaagtcctt

SEQ ID NO: 514354 - DNA, 25 bp, Mus musculus
gatgctgatgtaattgttctatgct

SEQ ID NO: 514355 - DNA, 25 bp, Mus musculus
gatgctgatgtatttgttctatgct

SEQ ID NO: 514356 - DNA, 25 bp, Mus musculus
gatgctgatgtcatggagagtgaat

SEQ ID NO: 514357 - DNA, 25 bp, Mus musculus
gatgctgatgtcttggagagtgaat

SEQ ID NO: 514358 - DNA, 25 bp, Mus musculus
gatgctgatgtgctgcagaattacc

SEQ ID NO: 514359 - DNA, 25 bp, Mus musculus
gatgctgatgtggtgcagaattacc

SEQ ID NO: 514360 - DNA, 25 bp, Mus musculus
gatgctgattatagagtcccctgat

SEQ ID NO: 514361 - DNA, 25 bp, Mus musculus
gatgctgattattgagtcccctgat

SEQ ID NO: 514362 - DNA, 25 bp, Mus musculus
gatgctgcaacacttaaaaccatga

SEQ ID NO: 514363 - DNA, 25 bp, Mus musculus
gatgctgcaacagttaaaaccatga

SEQ ID NO: 514364 - DNA, 25 bp, Mus musculus
gatgctgcaatgaatttctgtcaac

SEQ ID NO: 514365 - DNA, 25 bp, Mus musculus
gatgctgcaatgtatttctgtcaac

SEQ ID NO: 514366 - DNA, 25 bp, Mus musculus
gatgctgcaattatcccttttaaga

SEQ ID NO: 514367 - DNA, 25 bp, Mus musculus
gatgctgcaattcttgctgtggaac

SEQ ID NO: 514368 - DNA, 25 bp, Mus musculus
gatgctgcaattgttgctgtggaac

SEQ ID NO: 514369 - DNA, 25 bp, Mus musculus
gatgctgcaattttcccttttaaga

SEQ ID NO: 514370 - DNA, 25 bp, Mus musculus
gatgctgcaccaagatttgcttcag

SEQ ID NO: 514371 - DNA, 25 bp, Mus musculus
gatgctgcaccatgatttgcttcag

SEQ ID NO: 514372 - DNA, 25 bp, Mus musculus
gatgctgcacgtactgacaagggaa

SEQ ID NO: 514373 - DNA, 25 bp, Mus musculus
gatgctgcacgttctgacaagggaa

SEQ ID NO: 514374 - DNA, 25 bp, Mus musculus
gatgctgcactcagaggtcttgaaa

SEQ ID NO: 514375 - DNA, 25 bp, Mus musculus
gatgctgcactcatttgcaaaacca

SEQ ID NO: 514376 - DNA, 25 bp, Mus musculus
gatgctgcactctgaggtcttgaaa

SEQ ID NO: 514377 - DNA, 25 bp, Mus musculus
gatgctgcactcttttgcaaaacca

SEQ ID NO: 514378 - DNA, 25 bp, Mus musculus
gatgctgcactgaggcctcactttt

SEQ ID NO: 514379 - DNA, 25 bp, Mus musculus
gatgctgcactgtggcctcactttt

SEQ ID NO: 514380 - DNA, 25 bp, Mus musculus
gatgctgcagagactacgggtgaac

SEQ ID NO: 514381 - DNA, 25 bp, Mus musculus
gatgctgcagagtctacgggtgaac

SEQ ID NO: 514382 - DNA, 25 bp, Mus musculus
gatgctgcagttcccttaatgcaaa

SEQ ID NO: 514383 - DNA, 25 bp, Mus musculus
gatgctgcagttgccttaatgcaaa

SEQ ID NO: 514384 - DNA, 25 bp, Mus musculus
gatgctgccaacaggtttaacaacc

SEQ ID NO: 514385 - DNA, 25 bp, Mus musculus
gatgctgccaactggtttaacaacc

SEQ ID NO: 514386 - DNA, 25 bp, Mus musculus
gatgctgccagccaactacgtggag

SEQ ID NO: 514387 - DNA, 25 bp, Mus musculus
gatgctgccagcgaactacgtggag

SEQ ID NO: 514388 - DNA, 25 bp, Mus musculus
gatgctgccataaggtggttgtacc

SEQ ID NO: 514389 - DNA, 25 bp, Mus musculus
gatgctgccataatagtgcgccagt

SEQ ID NO: 514390 - DNA, 25 bp, Mus musculus
gatgctgccatacgatcgggctgca

SEQ ID NO: 514391 - DNA, 25 bp, Mus musculus
gatgctgccataggatcgggctgca

SEQ ID NO: 514392 - DNA, 25 bp, Mus musculus
gatgctgccatatggtggttgtacc

SEQ ID NO: 514393 - DNA, 25 bp, Mus musculus
gatgctgccatattagtgcgccagt

SEQ ID NO: 514394 - DNA, 25 bp, Mus musculus
gatgctgccatccagattcaaggtc

SEQ ID NO: 514395 - DNA, 25 bp, Mus musculus
gatgctgccatcgagattcaaggtc

SEQ ID NO: 514396 - DNA, 25 bp, Mus musculus
gatgctgccattcttacctgaggag

SEQ ID NO: 514397 - DNA, 25 bp, Mus musculus
gatgctgccattgttacctgaggag

SEQ ID NO: 514398 - DNA, 25 bp, Mus musculus
gatgctgcccacacgattgttacta

SEQ ID NO: 514399 - DNA, 25 bp, Mus musculus
gatgctgcccactcgattgttacta

SEQ ID NO: 514400 - DNA, 25 bp, Mus musculus
gatgctgcccggaattggaatggaa

SEQ ID NO: 514401 - DNA, 25 bp, Mus musculus
gatgctgcccggtattggaatggaa

SEQ ID NO: 514402 - DNA, 25 bp, Mus musculus
gatgctgccgagatgcatgcaatct

SEQ ID NO: 514403 - DNA, 25 bp, Mus musculus
gatgctgccgagttgcatgcaatct

SEQ ID NO: 514404 - DNA, 25 bp, Mus musculus
gatgctgccggtaaaaagtactcca

SEQ ID NO: 514405 - DNA, 25 bp, Mus musculus
gatgctgccggttaaaagtactcca

SEQ ID NO: 514406 - DNA, 25 bp, Mus musculus
gatgctgccgttactggccatataa

SEQ ID NO: 514407 - DNA, 25 bp, Mus musculus
gatgctgccgtttctggccatataa

SEQ ID NO: 514408 - DNA, 25 bp, Mus musculus
gatgctgcctttctgactagcctgt

SEQ ID NO: 514409 - DNA, 25 bp, Mus musculus
gatgctgcctttgtgactagcctgt

SEQ ID NO: 514410 - DNA, 25 bp, Mus musculus
gatgctgcgacgaatttctgtgctc

SEQ ID NO: 514411 - DNA, 25 bp, Mus musculus
gatgctgcgacgtatttctgtgctc

SEQ ID NO: 514412 - DNA, 25 bp, Mus musculus
gatgctgcgggaatctacagctcag

SEQ ID NO: 514413 - DNA, 25 bp, Mus musculus
gatgctgcgggattctacagctcag

SEQ ID NO: 514414 - DNA, 25 bp, Mus musculus
gatgctgctaaacttgagccctcag

SEQ ID NO: 514415 - DNA, 25 bp, Mus musculus
gatgctgctaaagttgagccctcag

SEQ ID NO: 514416 - DNA, 25 bp, Mus musculus
gatgctgctaatccttcagaatgcc

SEQ ID NO: 514417 - DNA, 25 bp, Mus musculus
gatgctgctaatctgtggtgttctt

SEQ ID NO: 514418 - DNA, 25 bp, Mus musculus
gatgctgctaatgcttcagaatgcc

SEQ ID NO: 514419 - DNA, 25 bp, Mus musculus
gatgctgctaatgtgtggtgttctt

SEQ ID NO: 514420 - DNA, 25 bp, Mus musculus
gatgctgctacgaaatccatacttg

SEQ ID NO: 514421 - DNA, 25 bp, Mus musculus
gatgctgctacgagggattggcctc

SEQ ID NO: 514422 - DNA, 25 bp, Mus musculus
gatgctgctacgtaatccatacttg

SEQ ID NO: 514423 - DNA, 25 bp, Mus musculus
gatgctgctacgtgggattggcctc

SEQ ID NO: 514424 - DNA, 25 bp, Mus musculus
gatgctgctagcctgggcacaaagt

SEQ ID NO: 514425 - DNA, 25 bp, Mus musculus
gatgctgctagcgtgggcacaaagt

SEQ ID NO: 514426 - DNA, 25 bp, Mus musculus
gatgctgctatgattaatgactatg

SEQ ID NO: 514427 - DNA, 25 bp, Mus musculus
gatgctgctatgtttaatgactatg

SEQ ID NO: 514428 - DNA, 25 bp, Mus musculus
gatgctgctcaactgcagatccaga

SEQ ID NO: 514429 - DNA, 25 bp, Mus musculus
gatgctgctcaagtgcagatccaga

SEQ ID NO: 514430 - DNA, 25 bp, Mus musculus
gatgctgctcatcattgtatgtcac

SEQ ID NO: 514431 - DNA, 25 bp, Mus musculus
gatgctgctcatgattgtatgtcac

SEQ ID NO: 514432 - DNA, 25 bp, Mus musculus
gatgctgctcgcaaatgagtgtcca

SEQ ID NO: 514433 - DNA, 25 bp, Mus musculus
gatgctgctcgctaatgagtgtcca

SEQ ID NO: 514434 - DNA, 25 bp, Mus musculus
gatgctgctgacctgacaaaggtag

SEQ ID NO: 514435 - DNA, 25 bp, Mus musculus
gatgctgctgacgtgacaaaggtag

SEQ ID NO: 514436 - DNA, 25 bp, Mus musculus
gatgctgctggcaaacacgttgttt

SEQ ID NO: 514437 - DNA, 25 bp, Mus musculus
gatgctgctggctaacacgttgttt

SEQ ID NO: 514438 - DNA, 25 bp, Mus musculus
gatgctgcttataggattggttccc

SEQ ID NO: 514439 - DNA, 25 bp, Mus musculus
gatgctgcttattggattggttccc

SEQ ID NO: 514440 - DNA, 25 bp, Mus musculus
gatgctgcttcaaatttcagcctga

SEQ ID NO: 514441 - DNA, 25 bp, Mus musculus
gatgctgcttcatatttcagcctga

SEQ ID NO: 514442 - DNA, 25 bp, Mus musculus
gatgctgctttgctattgaacgagg

SEQ ID NO: 514443 - DNA, 25 bp, Mus musculus
gatgctgctttggtattgaacgagg

SEQ ID NO: 514444 - DNA, 25 bp, Mus musculus
gatgctggaagtaggctgagtcact

SEQ ID NO: 514445 - DNA, 25 bp, Mus musculus
gatgctggaagttggctgagtcact

SEQ ID NO: 514446 - DNA, 25 bp, Mus musculus
gatgctggaattcccatgttgtctg

SEQ ID NO: 514447 - DNA, 25 bp, Mus musculus
gatgctggaattgccatgttgtctg

SEQ ID NO: 514448 - DNA, 25 bp, Mus musculus
gatgctggacagaaggctttcctca

SEQ ID NO: 514449 - DNA, 25 bp, Mus musculus
gatgctggacagtaggctttcctca

SEQ ID NO: 514450 - DNA, 25 bp, Mus musculus
gatgctggacatcctggacaagtca

SEQ ID NO: 514451 - DNA, 25 bp, Mus musculus
gatgctggacatgctggacaagtca

SEQ ID NO: 514452 - DNA, 25 bp, Mus musculus
gatgctggagatccccaatccttgt

SEQ ID NO: 514453 - DNA, 25 bp, Mus musculus
gatgctggagatgcccaatccttgt

SEQ ID NO: 514454 - DNA, 25 bp, Mus musculus
gatgctggagcccttgtggcaccat

SEQ ID NO: 514455 - DNA, 25 bp, Mus musculus
gatgctggagccgttgtggcaccat

SEQ ID NO: 514456 - DNA, 25 bp, Mus musculus
gatgctggagtgactagacatgaca

SEQ ID NO: 514457 - DNA, 25 bp, Mus musculus
gatgctggagtgtctagacatgaca

SEQ ID NO: 514458 - DNA, 25 bp, Mus musculus
gatgctggatagaacccaaatcact

SEQ ID NO: 514459 - DNA, 25 bp, Mus musculus
gatgctggatagtacccaaatcact

SEQ ID NO: 514460 - DNA, 25 bp, Mus musculus
gatgctggatatcgaacctgtgtcc

SEQ ID NO: 514461 - DNA, 25 bp, Mus musculus
gatgctggatatggaacctgtgtcc

SEQ ID NO: 514462 - DNA, 25 bp, Mus musculus
gatgctggcaggctgcgctaaacta

SEQ ID NO: 514463 - DNA, 25 bp, Mus musculus
gatgctggcagggtgcgctaaacta

SEQ ID NO: 514464 - DNA, 25 bp, Mus musculus
gatgctggcatgaggactgtagaat

SEQ ID NO: 514465 - DNA, 25 bp, Mus musculus
gatgctggcatgtggactgtagaat

SEQ ID NO: 514466 - DNA, 25 bp, Mus musculus
gatgctggccaacttctggagaagt

SEQ ID NO: 514467 - DNA, 25 bp, Mus musculus
gatgctggccaagttctggagaagt

SEQ ID NO: 514468 - DNA, 25 bp, Mus musculus
gatgctggcctgagtatgcttttaa

SEQ ID NO: 514469 - DNA, 25 bp, Mus musculus
gatgctggcctgtgtatgcttttaa

SEQ ID NO: 514470 - DNA, 25 bp, Mus musculus
gatgctggctacacatctgaggact

SEQ ID NO: 514471 - DNA, 25 bp, Mus musculus
gatgctggctactcatctgaggact

SEQ ID NO: 514472 - DNA, 25 bp, Mus musculus
gatgctggctgcaagccttacatgg

SEQ ID NO: 514473 - DNA, 25 bp, Mus musculus
gatgctggctgctagccttacatgg

SEQ ID NO: 514474 - DNA, 25 bp, Mus musculus
gatgctggcttcaggtcacgggacc

SEQ ID NO: 514475 - DNA, 25 bp, Mus musculus
gatgctggcttctggtcacgggacc

SEQ ID NO: 514476 - DNA, 25 bp, Mus musculus
gatgctgggataatgctgactgtca

SEQ ID NO: 514477 - DNA, 25 bp, Mus musculus
gatgctgggatattgctgactgtca

SEQ ID NO: 514478 - DNA, 25 bp, Mus musculus
gatgctgggatcagggctgacttaa

SEQ ID NO: 514479 - DNA, 25 bp, Mus musculus
gatgctgggatctgggctgacttaa

SEQ ID NO: 514480 - DNA, 25 bp, Mus musculus
gatgctgggattcacctccatggtg

SEQ ID NO: 514481 - DNA, 25 bp, Mus musculus
gatgctgggattgacctccatggtg

SEQ ID NO: 514482 - DNA, 25 bp, Mus musculus
gatgctgggctaacacattcaccaa

SEQ ID NO: 514483 - DNA, 25 bp, Mus musculus
gatgctgggctactccaggaaagct

SEQ ID NO: 514484 - DNA, 25 bp, Mus musculus
gatgctgggctagtccaggaaagct

SEQ ID NO: 514485 - DNA, 25 bp, Mus musculus
gatgctgggctatcacattcaccaa

SEQ ID NO: 514486 - DNA, 25 bp, Mus musculus
gatgctgggctgacaagattaaaat

SEQ ID NO: 514487 - DNA, 25 bp, Mus musculus
gatgctgggctgtcaagattaaaat

SEQ ID NO: 514488 - DNA, 25 bp, Mus musculus
gatgctgggttcagtctgtcactca

SEQ ID NO: 514489 - DNA, 25 bp, Mus musculus
gatgctgggttctgtctgtcactca

SEQ ID NO: 514490 - DNA, 25 bp, Mus musculus
gatgctggtactactggaattgaca

SEQ ID NO: 514491 - DNA, 25 bp, Mus musculus
gatgctggtacttctggaattgaca

SEQ ID NO: 514492 - DNA, 25 bp, Mus musculus
gatgctggtatccaactctggttct

SEQ ID NO: 514493 - DNA, 25 bp, Mus musculus
gatgctggtatcgaactctggttct

SEQ ID NO: 514494 - DNA, 25 bp, Mus musculus
gatgctggtcatattctacaagatg

SEQ ID NO: 514495 - DNA, 25 bp, Mus musculus
gatgctggtcattttctacaagatg

SEQ ID NO: 514496 - DNA, 25 bp, Mus musculus
gatgctggtgctcaacaacttgact

SEQ ID NO: 514497 - DNA, 25 bp, Mus musculus
gatgctggtgctgaacaacttgact

SEQ ID NO: 514498 - DNA, 25 bp, Mus musculus
gatgctggttacactggtcaacact

SEQ ID NO: 514499 - DNA, 25 bp, Mus musculus
gatgctggttactctggtcaacact

SEQ ID NO: 514500 - DNA, 25 bp, Mus musculus
gatgctggttagcaacttctcaccc

SEQ ID NO: 514501 - DNA, 25 bp, Mus musculus
gatgctggttaggaacttctcaccc

SEQ ID NO: 514502 - DNA, 25 bp, Mus musculus
gatgctggttttcgctctggactcg

SEQ ID NO: 514503 - DNA, 25 bp, Mus musculus
gatgctggttttggctctggactcg

SEQ ID NO: 514504 - DNA, 25 bp, Mus musculus
gatgctgtaaaactctatggctttt

SEQ ID NO: 514505 - DNA, 25 bp, Mus musculus
gatgctgtaaaagtctatggctttt

SEQ ID NO: 514506 - DNA, 25 bp, Mus musculus
gatgctgtaaatagtaatgttgtat

SEQ ID NO: 514507 - DNA, 25 bp, Mus musculus
gatgctgtaaattgtaatgttgtat

SEQ ID NO: 514508 - DNA, 25 bp, Mus musculus
gatgctgtagacacacatcgtgaca

SEQ ID NO: 514509 - DNA, 25 bp, Mus musculus
gatgctgtagactcacatcgtgaca

SEQ ID NO: 514510 - DNA, 25 bp, Mus musculus
gatgctgtagtcatgtgagatgtcc

SEQ ID NO: 514511 - DNA, 25 bp, Mus musculus
gatgctgtagtcttgtgagatgtcc

SEQ ID NO: 514512 - DNA, 25 bp, Mus musculus
gatgctgtatacaccagcagcctta

SEQ ID NO: 514513 - DNA, 25 bp, Mus musculus
gatgctgtatactccagcagcctta

SEQ ID NO: 514514 - DNA, 25 bp, Mus musculus
gatgctgtatctaaccaaagctgtg

SEQ ID NO: 514515 - DNA, 25 bp, Mus musculus
gatgctgtatcttaccaaagctgtg

SEQ ID NO: 514516 - DNA, 25 bp, Mus musculus
gatgctgtatgaatcacgcaacaat

SEQ ID NO: 514517 - DNA, 25 bp, Mus musculus
gatgctgtatgattcacgcaacaat

SEQ ID NO: 514518 - DNA, 25 bp, Mus musculus
gatgctgtatggacctgcagtagac

SEQ ID NO: 514519 - DNA, 25 bp, Mus musculus
gatgctgtatggtcctgcagtagac

SEQ ID NO: 514520 - DNA, 25 bp, Mus musculus
gatgctgtattcaggttcaacgcta

SEQ ID NO: 514521 - DNA, 25 bp, Mus musculus
gatgctgtattctggttcaacgcta

SEQ ID NO: 514522 - DNA, 25 bp, Mus musculus
gatgctgtcaagacaaatacctcta

SEQ ID NO: 514523 - DNA, 25 bp, Mus musculus
gatgctgtcaagtcaaatacctcta

SEQ ID NO: 514524 - DNA, 25 bp, Mus musculus
gatgctgtcacaagtctagtttcta

SEQ ID NO: 514525 - DNA, 25 bp, Mus musculus
gatgctgtcacatgtctagtttcta

SEQ ID NO: 514526 - DNA, 25 bp, Mus musculus
gatgctgtcagactgcttagaaaga

SEQ ID NO: 514527 - DNA, 25 bp, Mus musculus
gatgctgtcagagtgcttagaaaga

SEQ ID NO: 514528 - DNA, 25 bp, Mus musculus
gatgctgtcaggacgtattttaata

SEQ ID NO: 514529 - DNA, 25 bp, Mus musculus
gatgctgtcaggtcgtattttaata

SEQ ID NO: 514530 - DNA, 25 bp, Mus musculus
gatgctgtcctaaatacctattaaa

SEQ ID NO: 514531 - DNA, 25 bp, Mus musculus
gatgctgtcctatatacctattaaa

SEQ ID NO: 514532 - DNA, 25 bp, Mus musculus
gatgctgtccttaagtagtgagtga

SEQ ID NO: 514533 - DNA, 25 bp, Mus musculus
gatgctgtccttcgaggtatttaat

SEQ ID NO: 514534 - DNA, 25 bp, Mus musculus
gatgctgtccttggaggtatttaat

SEQ ID NO: 514535 - DNA, 25 bp, Mus musculus
gatgctgtcctttagtagtgagtga

SEQ ID NO: 514536 - DNA, 25 bp, Mus musculus
gatgctgtcgtcctcttgttagata

SEQ ID NO: 514537 - DNA, 25 bp, Mus musculus
gatgctgtcgtcgtcttgttagata

SEQ ID NO: 514538 - DNA, 25 bp, Mus musculus
gatgctgtctaacccaagttatcag

SEQ ID NO: 514539 - DNA, 25 bp, Mus musculus
gatgctgtctaagccaagttatcag

SEQ ID NO: 514540 - DNA, 25 bp, Mus musculus
gatgctgtctatatgcttaagcaag

SEQ ID NO: 514541 - DNA, 25 bp, Mus musculus
gatgctgtctatttgcttaagcaag

SEQ ID NO: 514542 - DNA, 25 bp, Mus musculus
gatgctgtctgaagtctgttaccaa

SEQ ID NO: 514543 - DNA, 25 bp, Mus musculus
gatgctgtctgaccccaaggacaaa

SEQ ID NO: 514544 - DNA, 25 bp, Mus musculus
gatgctgtctgagcccaaggacaaa

SEQ ID NO: 514545 - DNA, 25 bp, Mus musculus
gatgctgtctgatgtctgttaccaa

SEQ ID NO: 514546 - DNA, 25 bp, Mus musculus
gatgctgtcttactttgaactggag

SEQ ID NO: 514547 - DNA, 25 bp, Mus musculus
gatgctgtcttagtttgaactggag

SEQ ID NO: 514548 - DNA, 25 bp, Mus musculus
gatgctgtcttcaatcagacggtca

SEQ ID NO: 514549 - DNA, 25 bp, Mus musculus
gatgctgtcttctatcagacggtca

SEQ ID NO: 514550 - DNA, 25 bp, Mus musculus
gatgctgtctttagttatagtccca

SEQ ID NO: 514551 - DNA, 25 bp, Mus musculus
gatgctgtctttctggcctctgtag

SEQ ID NO: 514552 - DNA, 25 bp, Mus musculus
gatgctgtctttgtggcctctgtag

SEQ ID NO: 514553 - DNA, 25 bp, Mus musculus
gatgctgtcttttgttatagtccca

SEQ ID NO: 514554 - DNA, 25 bp, Mus musculus
gatgctgtgaatatcgacgtttttt

SEQ ID NO: 514555 - DNA, 25 bp, Mus musculus
gatgctgtgaatttcgacgtttttt

SEQ ID NO: 514556 - DNA, 25 bp, Mus musculus
gatgctgtgagcagacatggaaaac

SEQ ID NO: 514557 - DNA, 25 bp, Mus musculus
gatgctgtgagctgacatggaaaac

SEQ ID NO: 514558 - DNA, 25 bp, Mus musculus
gatgctgtgaggctgaaccgctata

SEQ ID NO: 514559 - DNA, 25 bp, Mus musculus
gatgctgtgagggtgaaccgctata

SEQ ID NO: 514560 - DNA, 25 bp, Mus musculus
gatgctgtgatgacacccaggccga

SEQ ID NO: 514561 - DNA, 25 bp, Mus musculus
gatgctgtgatgtcacccaggccga

SEQ ID NO: 514562 - DNA, 25 bp, Mus musculus
gatgctgtgattaaaccccttggag

SEQ ID NO: 514563 - DNA, 25 bp, Mus musculus
gatgctgtgatttaaccccttggag

SEQ ID NO: 514564 - DNA, 25 bp, Mus musculus
gatgctgtgcctctctggaggcaac

SEQ ID NO: 514565 - DNA, 25 bp, Mus musculus
gatgctgtgcctgtctggaggcaac

SEQ ID NO: 514566 - DNA, 25 bp, Mus musculus
gatgctgtggtgatgtggtccacat

SEQ ID NO: 514567 - DNA, 25 bp, Mus musculus
gatgctgtggtgttgtggtccacat

SEQ ID NO: 514568 - DNA, 25 bp, Mus musculus
gatgctgtgtgcagagctgtaacaa

SEQ ID NO: 514569 - DNA, 25 bp, Mus musculus
gatgctgtgtgccaagaagccagaa

SEQ ID NO: 514570 - DNA, 25 bp, Mus musculus
gatgctgtgtgcgaagaagccagaa

SEQ ID NO: 514571 - DNA, 25 bp, Mus musculus
gatgctgtgtgctgagctgtaacaa

SEQ ID NO: 514572 - DNA, 25 bp, Mus musculus
gatgctgtgttaaaagattctctac

SEQ ID NO: 514573 - DNA, 25 bp, Mus musculus
gatgctgtgttaagtatattattcc

SEQ ID NO: 514574 - DNA, 25 bp, Mus musculus
gatgctgtgttataagattctctac

SEQ ID NO: 514575 - DNA, 25 bp, Mus musculus
gatgctgtgttatgtatattattcc

SEQ ID NO: 514576 - DNA, 25 bp, Mus musculus
gatgctgttacccatgcggcagaag

SEQ ID NO: 514577 - DNA, 25 bp, Mus musculus
gatgctgttaccgatgcggcagaag

SEQ ID NO: 514578 - DNA, 25 bp, Mus musculus
gatgctgttagcagctgtgaatctt

SEQ ID NO: 514579 - DNA, 25 bp, Mus musculus
gatgctgttagctgctgtgaatctt

SEQ ID NO: 514580 - DNA, 25 bp, Mus musculus
gatgctgttcagatcttgcaggatt

SEQ ID NO: 514581 - DNA, 25 bp, Mus musculus
gatgctgttcagttcttgcaggatt

SEQ ID NO: 514582 - DNA, 25 bp, Mus musculus
gatgctgttcatctacagtcacttc

SEQ ID NO: 514583 - DNA, 25 bp, Mus musculus
gatgctgttcatcttgctttgaagt

SEQ ID NO: 514584 - DNA, 25 bp, Mus musculus
gatgctgttcatgtacagtcacttc

SEQ ID NO: 514585 - DNA, 25 bp, Mus musculus
gatgctgttcatgttgctttgaagt

SEQ ID NO: 514586 - DNA, 25 bp, Mus musculus
gatgctgttcgaaccctgagataca

SEQ ID NO: 514587 - DNA, 25 bp, Mus musculus
gatgctgttcgatccctgagataca

SEQ ID NO: 514588 - DNA, 25 bp, Mus musculus
gatgctgttcgcaagggtacctcaa

SEQ ID NO: 514589 - DNA, 25 bp, Mus musculus
gatgctgttcgctagggtacctcaa

SEQ ID NO: 514590 - DNA, 25 bp, Mus musculus
gatgctgttctcaatcattttcaga

SEQ ID NO: 514591 - DNA, 25 bp, Mus musculus
gatgctgttctctatcattttcaga

SEQ ID NO: 514592 - DNA, 25 bp, Mus musculus
gatgctgttggtactttttagtctt

SEQ ID NO: 514593 - DNA, 25 bp, Mus musculus
gatgctgttggttctttttagtctt

SEQ ID NO: 514594 - DNA, 25 bp, Mus musculus
gatgctgtttggagaaacctacacc

SEQ ID NO: 514595 - DNA, 25 bp, Mus musculus
gatgctgtttggtgaaacctacacc

SEQ ID NO: 514596 - DNA, 25 bp, Mus musculus
gatgctgttttccttgtgagtacct

SEQ ID NO: 514597 - DNA, 25 bp, Mus musculus
gatgctgttttcgttgtgagtacct

SEQ ID NO: 514598 - DNA, 25 bp, Mus musculus
gatgctgtttttcagcctgacaaaa

SEQ ID NO: 514599 - DNA, 25 bp, Mus musculus
gatgctgtttttgagcctgacaaaa

SEQ ID NO: 514600 - DNA, 25 bp, Mus musculus
gatgcttaatggcacacacctggct

SEQ ID NO: 514601 - DNA, 25 bp, Mus musculus
gatgcttaatgggacacacctggct

SEQ ID NO: 514602 - DNA, 25 bp, Mus musculus
gatgcttaatgtccaaaacaagaac

SEQ ID NO: 514603 - DNA, 25 bp, Mus musculus
gatgcttaatgtgcaaaacaagaac

SEQ ID NO: 514604 - DNA, 25 bp, Mus musculus
gatgcttacagaaatccattggatg

SEQ ID NO: 514605 - DNA, 25 bp, Mus musculus
gatgcttacagatatccattggatg

SEQ ID NO: 514606 - DNA, 25 bp, Mus musculus
gatgcttacagcatagaccacagaa

SEQ ID NO: 514607 - DNA, 25 bp, Mus musculus
gatgcttacagcttagaccacagaa

SEQ ID NO: 514608 - DNA, 25 bp, Mus musculus
gatgcttacccgaacagtagtcttg

SEQ ID NO: 514609 - DNA, 25 bp, Mus musculus
gatgcttacccgtacagtagtcttg

SEQ ID NO: 514610 - DNA, 25 bp, Mus musculus
gatgcttacgacaacatttctactt

SEQ ID NO: 514611 - DNA, 25 bp, Mus musculus
gatgcttacgactacatttctactt

SEQ ID NO: 514612 - DNA, 25 bp, Mus musculus
gatgcttagacccttggatgcagct

SEQ ID NO: 514613 - DNA, 25 bp, Mus musculus
gatgcttagaccgttggatgcagct

SEQ ID NO: 514614 - DNA, 25 bp, Mus musculus
gatgcttagccacttttacattagg

SEQ ID NO: 514615 - DNA, 25 bp, Mus musculus
gatgcttagccagttttacattagg

SEQ ID NO: 514616 - DNA, 25 bp, Mus musculus
gatgcttagcgcatataagcactaa

SEQ ID NO: 514617 - DNA, 25 bp, Mus musculus
gatgcttagcgcttataagcactaa

SEQ ID NO: 514618 - DNA, 25 bp, Mus musculus
gatgcttagctgcaatagcctcact

SEQ ID NO: 514619 - DNA, 25 bp, Mus musculus
gatgcttagctggaatagcctcact

SEQ ID NO: 514620 - DNA, 25 bp, Mus musculus
gatgcttaggaaaaagagccaccaa

SEQ ID NO: 514621 - DNA, 25 bp, Mus musculus
gatgcttaggaataagagccaccaa

SEQ ID NO: 514622 - DNA, 25 bp, Mus musculus
gatgcttaggtcacagttcctctaa

SEQ ID NO: 514623 - DNA, 25 bp, Mus musculus
gatgcttaggtctcagttcctctaa

SEQ ID NO: 514624 - DNA, 25 bp, Mus musculus
gatgcttatatccagtgctttcttc

SEQ ID NO: 514625 - DNA, 25 bp, Mus musculus
gatgcttatatcgagtgctttcttc

SEQ ID NO: 514626 - DNA, 25 bp, Mus musculus
gatgcttatcttagctgagacttga

SEQ ID NO: 514627 - DNA, 25 bp, Mus musculus
gatgcttatcttatatacacacctt

SEQ ID NO: 514628 - DNA, 25 bp, Mus musculus
gatgcttatctttgctgagacttga

SEQ ID NO: 514629 - DNA, 25 bp, Mus musculus
gatgcttatcttttatacacacctt

SEQ ID NO: 514630 - DNA, 25 bp, Mus musculus
gatgcttatgtgctaataccttttt

SEQ ID NO: 514631 - DNA, 25 bp, Mus musculus
gatgcttatgtgctccaacagacat

SEQ ID NO: 514632 - DNA, 25 bp, Mus musculus
gatgcttatgtggtaataccttttt

SEQ ID NO: 514633 - DNA, 25 bp, Mus musculus
gatgcttatgtggtccaacagacat

SEQ ID NO: 514634 - DNA, 25 bp, Mus musculus
gatgcttattataacagtgtttctc

SEQ ID NO: 514635 - DNA, 25 bp, Mus musculus
gatgcttattattacagtgtttctc

SEQ ID NO: 514636 - DNA, 25 bp, Mus musculus
gatgcttcaaacaatacctcctggg

SEQ ID NO: 514637 - DNA, 25 bp, Mus musculus
gatgcttcaaactatacctcctggg

SEQ ID NO: 514638 - DNA, 25 bp, Mus musculus
gatgcttcaagaactctcactggta

SEQ ID NO: 514639 - DNA, 25 bp, Mus musculus
gatgcttcaagatctctcactggta

SEQ ID NO: 514640 - DNA, 25 bp, Mus musculus
gatgcttcaaggactggattttatc

SEQ ID NO: 514641 - DNA, 25 bp, Mus musculus
gatgcttcaaggtctggattttatc

SEQ ID NO: 514642 - DNA, 25 bp, Mus musculus
gatgcttcaccaagtaggacacttg

SEQ ID NO: 514643 - DNA, 25 bp, Mus musculus
gatgcttcaccatgtaggacacttg

SEQ ID NO: 514644 - DNA, 25 bp, Mus musculus
gatgcttcactgaagtcttaggcct

SEQ ID NO: 514645 - DNA, 25 bp, Mus musculus
gatgcttcactgacacccaggacag

SEQ ID NO: 514646 - DNA, 25 bp, Mus musculus
gatgcttcactgtagtcttaggcct

SEQ ID NO: 514647 - DNA, 25 bp, Mus musculus
gatgcttcactgtcacccaggacag

SEQ ID NO: 514648 - DNA, 25 bp, Mus musculus
gatgcttcacttatgaatactttag

SEQ ID NO: 514649 - DNA, 25 bp, Mus musculus
gatgcttcacttttgaatactttag

SEQ ID NO: 514650 - DNA, 25 bp, Mus musculus
gatgcttcagagatgtgaggtctta

SEQ ID NO: 514651 - DNA, 25 bp, Mus musculus
gatgcttcagagttgtgaggtctta

SEQ ID NO: 514652 - DNA, 25 bp, Mus musculus
gatgcttcaggactacagcttgcta

SEQ ID NO: 514653 - DNA, 25 bp, Mus musculus
gatgcttcaggagtacagcttgcta

SEQ ID NO: 514654 - DNA, 25 bp, Mus musculus
gatgcttcatcactttgtgggctaa

SEQ ID NO: 514655 - DNA, 25 bp, Mus musculus
gatgcttcatcagtttgtgggctaa

SEQ ID NO: 514656 - DNA, 25 bp, Mus musculus
gatgcttcatttaggcttggctatg

SEQ ID NO: 514657 - DNA, 25 bp, Mus musculus
gatgcttcattttggcttggctatg

SEQ ID NO: 514658 - DNA, 25 bp, Mus musculus
gatgcttccaagacaatacgccttt

SEQ ID NO: 514659 - DNA, 25 bp, Mus musculus
gatgcttccaagcactcgggttgat

SEQ ID NO: 514660 - DNA, 25 bp, Mus musculus
gatgcttccaaggactcgggttgat

SEQ ID NO: 514661 - DNA, 25 bp, Mus musculus
gatgcttccaagtcaatacgccttt

SEQ ID NO: 514662 - DNA, 25 bp, Mus musculus
gatgcttccaccaatagcaacgagt

SEQ ID NO: 514663 - DNA, 25 bp, Mus musculus
gatgcttccacctatagcaacgagt

SEQ ID NO: 514664 - DNA, 25 bp, Mus musculus
gatgcttccagaactgaagcagccc

SEQ ID NO: 514665 - DNA, 25 bp, Mus musculus
gatgcttccagatctgaagcagccc

SEQ ID NO: 514666 - DNA, 25 bp, Mus musculus
gatgcttccaggacaaatcggcttc

SEQ ID NO: 514667 - DNA, 25 bp, Mus musculus
gatgcttccaggtcaaatcggcttc

SEQ ID NO: 514668 - DNA, 25 bp, Mus musculus
gatgcttccccgaaggatggcaccc

SEQ ID NO: 514669 - DNA, 25 bp, Mus musculus
gatgcttccccgtaggatggcaccc

SEQ ID NO: 514670 - DNA, 25 bp, Mus musculus
gatgcttcccttattgaagacttta

SEQ ID NO: 514671 - DNA, 25 bp, Mus musculus
gatgcttcccttcgtttttggagtt

SEQ ID NO: 514672 - DNA, 25 bp, Mus musculus
gatgcttcccttggtttttggagtt

SEQ ID NO: 514673 - DNA, 25 bp, Mus musculus
gatgcttccctttttgaagacttta

SEQ ID NO: 514674 - DNA, 25 bp, Mus musculus
gatgcttcctgaagttcccgtgttg

SEQ ID NO: 514675 - DNA, 25 bp, Mus musculus
gatgcttcctgatgttcccgtgttg

SEQ ID NO: 514676 - DNA, 25 bp, Mus musculus
gatgcttccttcattactggacatt

SEQ ID NO: 514677 - DNA, 25 bp, Mus musculus
gatgcttccttctttactggacatt

SEQ ID NO: 514678 - DNA, 25 bp, Mus musculus
gatgcttcctttcatggtgataatg

SEQ ID NO: 514679 - DNA, 25 bp, Mus musculus
gatgcttcctttgatggtgataatg

SEQ ID NO: 514680 - DNA, 25 bp, Mus musculus
gatgcttcggagacaggtccttaga

SEQ ID NO: 514681 - DNA, 25 bp, Mus musculus
gatgcttcggagtcaggtccttaga

SEQ ID NO: 514682 - DNA, 25 bp, Mus musculus
gatgcttcggctatccagagaggaa

SEQ ID NO: 514683 - DNA, 25 bp, Mus musculus
gatgcttcggctttccagagaggaa

SEQ ID NO: 514684 - DNA, 25 bp, Mus musculus
gatgcttcggtcaatagggccccga

SEQ ID NO: 514685 - DNA, 25 bp, Mus musculus
gatgcttcggtctatagggccccga

SEQ ID NO: 514686 - DNA, 25 bp, Mus musculus
gatgcttcgtacaagcagcttcgcg

SEQ ID NO: 514687 - DNA, 25 bp, Mus musculus
gatgcttcgtactagcagcttcgcg

SEQ ID NO: 514688 - DNA, 25 bp, Mus musculus
gatgcttctaagaccgtacgtaatg

SEQ ID NO: 514689 - DNA, 25 bp, Mus musculus
gatgcttctaagtccgtacgtaatg

SEQ ID NO: 514690 - DNA, 25 bp, Mus musculus
gatgcttctattaacctttgtcctg

SEQ ID NO: 514691 - DNA, 25 bp, Mus musculus
gatgcttctatttacctttgtcctg

SEQ ID NO: 514692 - DNA, 25 bp, Mus musculus
gatgcttctcaacgttcaatctcag

SEQ ID NO: 514693 - DNA, 25 bp, Mus musculus
gatgcttctcaaggttcaatctcag

SEQ ID NO: 514694 - DNA, 25 bp, Mus musculus
gatgcttctcacatatgacatgatt

SEQ ID NO: 514695 - DNA, 25 bp, Mus musculus
gatgcttctcacttatgacatgatt

SEQ ID NO: 514696 - DNA, 25 bp, Mus musculus
gatgcttctcatcgaaggtgctcac

SEQ ID NO: 514697 - DNA, 25 bp, Mus musculus
gatgcttctcatggaaggtgctcac

SEQ ID NO: 514698 - DNA, 25 bp, Mus musculus
gatgcttctctcagaaggccgacaa

SEQ ID NO: 514699 - DNA, 25 bp, Mus musculus
gatgcttctctctgaaggccgacaa

SEQ ID NO: 514700 - DNA, 25 bp, Mus musculus
gatgcttctcttccaataacaacct

SEQ ID NO: 514701 - DNA, 25 bp, Mus musculus
gatgcttctcttgcaataacaacct

SEQ ID NO: 514702 - DNA, 25 bp, Mus musculus
gatgcttctgatcacttagatgatt

SEQ ID NO: 514703 - DNA, 25 bp, Mus musculus
gatgcttctgatgacttagatgatt

SEQ ID NO: 514704 - DNA, 25 bp, Mus musculus
gatgcttctgccaggcgtgctagct

SEQ ID NO: 514705 - DNA, 25 bp, Mus musculus
gatgcttctgcctggcgtgctagct

SEQ ID NO: 514706 - DNA, 25 bp, Mus musculus
gatgcttctggaacgctatggtgac

SEQ ID NO: 514707 - DNA, 25 bp, Mus musculus
gatgcttctggatcgctatggtgac

SEQ ID NO: 514708 - DNA, 25 bp, Mus musculus
gatgcttctgtactgactcaaacct

SEQ ID NO: 514709 - DNA, 25 bp, Mus musculus
gatgcttctgtagtgactcaaacct

SEQ ID NO: 514710 - DNA, 25 bp, Mus musculus
gatgcttcttgtcaacgtgggcgtc

SEQ ID NO: 514711 - DNA, 25 bp, Mus musculus
gatgcttcttgtgaacgtgggcgtc

SEQ ID NO: 514712 - DNA, 25 bp, Mus musculus
gatgcttgaaaaactcaaccaaatc

SEQ ID NO: 514713 - DNA, 25 bp, Mus musculus
gatgcttgaaaatctcaaccaaatc

SEQ ID NO: 514714 - DNA, 25 bp, Mus musculus
gatgcttgaatcaggcactatgttg

SEQ ID NO: 514715 - DNA, 25 bp, Mus musculus
gatgcttgaatctggcactatgttg

SEQ ID NO: 514716 - DNA, 25 bp, Mus musculus
gatgcttgatcaatactgtgtgagt

SEQ ID NO: 514717 - DNA, 25 bp, Mus musculus
gatgcttgatcattactgtgtgagt

SEQ ID NO: 514718 - DNA, 25 bp, Mus musculus
gatgcttgcaggaactggaccgttt

SEQ ID NO: 514719 - DNA, 25 bp, Mus musculus
gatgcttgcaggtactggaccgttt

SEQ ID NO: 514720 - DNA, 25 bp, Mus musculus
gatgcttgcctaccaccgacaaagc

SEQ ID NO: 514721 - DNA, 25 bp, Mus musculus
gatgcttgcctacccgatgagaggt

SEQ ID NO: 514722 - DNA, 25 bp, Mus musculus
gatgcttgcctagcaccgacaaagc

SEQ ID NO: 514723 - DNA, 25 bp, Mus musculus
gatgcttgcctagccgatgagaggt

SEQ ID NO: 514724 - DNA, 25 bp, Mus musculus
gatgcttgcgaacaagcccgtgaat

SEQ ID NO: 514725 - DNA, 25 bp, Mus musculus
gatgcttgcgaagaagcccgtgaat

SEQ ID NO: 514726 - DNA, 25 bp, Mus musculus
gatgcttgcgacctctgtggacctg

SEQ ID NO: 514727 - DNA, 25 bp, Mus musculus
gatgcttgcgacgtctgtggacctg

SEQ ID NO: 514728 - DNA, 25 bp, Mus musculus
gatgcttgctggagctagattgtca

SEQ ID NO: 514729 - DNA, 25 bp, Mus musculus
gatgcttgctggtgctagattgtca

SEQ ID NO: 514730 - DNA, 25 bp, Mus musculus
gatgcttgcttactgttcagtagag

SEQ ID NO: 514731 - DNA, 25 bp, Mus musculus
gatgcttgcttagtgttcagtagag

SEQ ID NO: 514732 - DNA, 25 bp, Mus musculus
gatgcttggactacagaaggcacac

SEQ ID NO: 514733 - DNA, 25 bp, Mus musculus
gatgcttggacttcagaaggcacac

SEQ ID NO: 514734 - DNA, 25 bp, Mus musculus
gatgcttggataagaacagtgggat

SEQ ID NO: 514735 - DNA, 25 bp, Mus musculus
gatgcttggatatgaacagtgggat

SEQ ID NO: 514736 - DNA, 25 bp, Mus musculus
gatgcttggcagatgtccttatgga

SEQ ID NO: 514737 - DNA, 25 bp, Mus musculus
gatgcttggcagttgtccttatgga

SEQ ID NO: 514738 - DNA, 25 bp, Mus musculus
gatgcttgggtcaagggactttgaa

SEQ ID NO: 514739 - DNA, 25 bp, Mus musculus
gatgcttgggtctagggactttgaa

SEQ ID NO: 514740 - DNA, 25 bp, Mus musculus
gatgcttgtactatgatatggccca

SEQ ID NO: 514741 - DNA, 25 bp, Mus musculus
gatgcttgtactttgatatggccca

SEQ ID NO: 514742 - DNA, 25 bp, Mus musculus
gatgcttgtatcatgaggaaggcca

SEQ ID NO: 514743 - DNA, 25 bp, Mus musculus
gatgcttgtatcttgaggaaggcca

SEQ ID NO: 514744 - DNA, 25 bp, Mus musculus
gatgcttgtcaacctcagaagttag

SEQ ID NO: 514745 - DNA, 25 bp, Mus musculus
gatgcttgtcaagctcagaagttag

SEQ ID NO: 514746 - DNA, 25 bp, Mus musculus
gatgcttgtcagacgttacagttac

SEQ ID NO: 514747 - DNA, 25 bp, Mus musculus
gatgcttgtcagtcgttacagttac

SEQ ID NO: 514748 - DNA, 25 bp, Mus musculus
gatgcttgtcctcatatagtctcag

SEQ ID NO: 514749 - DNA, 25 bp, Mus musculus
gatgcttgtcctgatatagtctcag

SEQ ID NO: 514750 - DNA, 25 bp, Mus musculus
gatgcttgtggaatggtaagaccaa

SEQ ID NO: 514751 - DNA, 25 bp, Mus musculus
gatgcttgtggacttcagtgcaatt

SEQ ID NO: 514752 - DNA, 25 bp, Mus musculus
gatgcttgtggagttcagtgcaatt

SEQ ID NO: 514753 - DNA, 25 bp, Mus musculus
gatgcttgtggattggtaagaccaa

SEQ ID NO: 514754 - DNA, 25 bp, Mus musculus
gatgcttgtggtctgaaccttccca

SEQ ID NO: 514755 - DNA, 25 bp, Mus musculus
gatgcttgtggtgtgaaccttccca

SEQ ID NO: 514756 - DNA, 25 bp, Mus musculus
gatgcttgttggatgatccctaccc

SEQ ID NO: 514757 - DNA, 25 bp, Mus musculus
gatgcttgttggttgatccctaccc

SEQ ID NO: 514758 - DNA, 25 bp, Mus musculus
gatgctttaaccctgcatggacatt

SEQ ID NO: 514759 - DNA, 25 bp, Mus musculus
gatgctttaaccgtgcatggacatt

SEQ ID NO: 514760 - DNA, 25 bp, Mus musculus
gatgctttaagcaaccaggcttcat

SEQ ID NO: 514761 - DNA, 25 bp, Mus musculus
gatgctttaagctaccaggcttcat

SEQ ID NO: 514762 - DNA, 25 bp, Mus musculus
gatgctttagagcaagttacctgct

SEQ ID NO: 514763 - DNA, 25 bp, Mus musculus
gatgctttagaggaagttacctgct

SEQ ID NO: 514764 - DNA, 25 bp, Mus musculus
gatgctttagcgcttgctttgtcat

SEQ ID NO: 514765 - DNA, 25 bp, Mus musculus
gatgctttagcggttgctttgtcat

SEQ ID NO: 514766 - DNA, 25 bp, Mus musculus
gatgctttagctatatgtgggaata

SEQ ID NO: 514767 - DNA, 25 bp, Mus musculus
gatgctttagctttatgtgggaata

SEQ ID NO: 514768 - DNA, 25 bp, Mus musculus
gatgctttaggcatgtcttatggaa

SEQ ID NO: 514769 - DNA, 25 bp, Mus musculus
gatgctttaggcttgtcttatggaa

SEQ ID NO: 514770 - DNA, 25 bp, Mus musculus
gatgctttagttcccatattttata

SEQ ID NO: 514771 - DNA, 25 bp, Mus musculus
gatgctttagttgccatattttata

SEQ ID NO: 514772 - DNA, 25 bp, Mus musculus
gatgctttatggcttgatccacgcc

SEQ ID NO: 514773 - DNA, 25 bp, Mus musculus
gatgctttatgggttgatccacgcc

SEQ ID NO: 514774 - DNA, 25 bp, Mus musculus
gatgctttcaacacacaaacctgat

SEQ ID NO: 514775 - DNA, 25 bp, Mus musculus
gatgctttcaactcacaaacctgat

SEQ ID NO: 514776 - DNA, 25 bp, Mus musculus
gatgctttcaggacgcatgtacata

SEQ ID NO: 514777 - DNA, 25 bp, Mus musculus
gatgctttcaggtcgcatgtacata

SEQ ID NO: 514778 - DNA, 25 bp, Mus musculus
gatgctttccaaatcagcctttgaa

SEQ ID NO: 514779 - DNA, 25 bp, Mus musculus
gatgctttccaattcagcctttgaa

SEQ ID NO: 514780 - DNA, 25 bp, Mus musculus
gatgctttccacaatagacagttag

SEQ ID NO: 514781 - DNA, 25 bp, Mus musculus
gatgctttccactatagacagttag

SEQ ID NO: 514782 - DNA, 25 bp, Mus musculus
gatgctttcccaactaagtagacag

SEQ ID NO: 514783 - DNA, 25 bp, Mus musculus
gatgctttcccatctaagtagacag

SEQ ID NO: 514784 - DNA, 25 bp, Mus musculus
gatgctttccctaacatcgagaagg

SEQ ID NO: 514785 - DNA, 25 bp, Mus musculus
gatgctttcccttacatcgagaagg

SEQ ID NO: 514786 - DNA, 25 bp, Mus musculus
gatgctttcctcctgtgagtagtca

SEQ ID NO: 514787 - DNA, 25 bp, Mus musculus
gatgctttcctcgtgtgagtagtca

SEQ ID NO: 514788 - DNA, 25 bp, Mus musculus
gatgctttcctgacaggctcacatt

SEQ ID NO: 514789 - DNA, 25 bp, Mus musculus
gatgctttcctgtcaggctcacatt

SEQ ID NO: 514790 - DNA, 25 bp, Mus musculus
gatgctttcgtaacttatctgtaga

SEQ ID NO: 514791 - DNA, 25 bp, Mus musculus
gatgctttcgtatcttatctgtaga

SEQ ID NO: 514792 - DNA, 25 bp, Mus musculus
gatgctttctgaagattcacctcct

SEQ ID NO: 514793 - DNA, 25 bp, Mus musculus
gatgctttctgatgattcacctcct

SEQ ID NO: 514794 - DNA, 25 bp, Mus musculus
gatgctttctgtacatatacctgca

SEQ ID NO: 514795 - DNA, 25 bp, Mus musculus
gatgctttctgttcatatacctgca

SEQ ID NO: 514796 - DNA, 25 bp, Mus musculus
gatgctttcttaacttctaccttat

SEQ ID NO: 514797 - DNA, 25 bp, Mus musculus
gatgctttcttatcttctaccttat

SEQ ID NO: 514798 - DNA, 25 bp, Mus musculus
gatgctttgaatcatgtactatgtc

SEQ ID NO: 514799 - DNA, 25 bp, Mus musculus
gatgctttgaatgatgtactatgtc

SEQ ID NO: 514800 - DNA, 25 bp, Mus musculus
gatgctttgactcactctaagactt

SEQ ID NO: 514801 - DNA, 25 bp, Mus musculus
gatgctttgactgactctaagactt

SEQ ID NO: 514802 - DNA, 25 bp, Mus musculus
gatgctttgagcagtagaaatgagg

SEQ ID NO: 514803 - DNA, 25 bp, Mus musculus
gatgctttgagctgtagaaatgagg

SEQ ID NO: 514804 - DNA, 25 bp, Mus musculus
gatgctttgcacatgacatattcca

SEQ ID NO: 514805 - DNA, 25 bp, Mus musculus
gatgctttgcacttgacatattcca

SEQ ID NO: 514806 - DNA, 25 bp, Mus musculus
gatgctttgccaccaccatgtgaat

SEQ ID NO: 514807 - DNA, 25 bp, Mus musculus
gatgctttgccagcaccatgtgaat

SEQ ID NO: 514808 - DNA, 25 bp, Mus musculus
gatgctttgcccaccctacagatca

SEQ ID NO: 514809 - DNA, 25 bp, Mus musculus
gatgctttgccctccctacagatca

SEQ ID NO: 514810 - DNA, 25 bp, Mus musculus
gatgctttgctaaaattgccacact

SEQ ID NO: 514811 - DNA, 25 bp, Mus musculus
gatgctttgctataattgccacact

SEQ ID NO: 514812 - DNA, 25 bp, Mus musculus
gatgctttggaaaactcttgactta

SEQ ID NO: 514813 - DNA, 25 bp, Mus musculus
gatgctttggaatactcttgactta

SEQ ID NO: 514814 - DNA, 25 bp, Mus musculus
gatgctttgggactccacaactact

SEQ ID NO: 514815 - DNA, 25 bp, Mus musculus
gatgctttgggagtccacaactact

SEQ ID NO: 514816 - DNA, 25 bp, Mus musculus
gatgctttgtctcattcttattaac

SEQ ID NO: 514817 - DNA, 25 bp, Mus musculus
gatgctttgtctgattcttattaac

SEQ ID NO: 514818 - DNA, 25 bp, Mus musculus
gatgctttgtgccaacctaagactc

SEQ ID NO: 514819 - DNA, 25 bp, Mus musculus
gatgctttgtgcgaacctaagactc

SEQ ID NO: 514820 - DNA, 25 bp, Mus musculus
gatgctttgtggaatgctctgggaa

SEQ ID NO: 514821 - DNA, 25 bp, Mus musculus
gatgctttgtggtatgctctgggaa

SEQ ID NO: 514822 - DNA, 25 bp, Mus musculus
gatgcttttaccattgcagtctggc

SEQ ID NO: 514823 - DNA, 25 bp, Mus musculus
gatgcttttacctttgcagtctggc

SEQ ID NO: 514824 - DNA, 25 bp, Mus musculus
gatgcttttctactctacctgaatg

SEQ ID NO: 514825 - DNA, 25 bp, Mus musculus
gatgcttttctagtctacctgaatg

SEQ ID NO: 514826 - DNA, 25 bp, Mus musculus
gatgcttttctcaaagttcccagac

SEQ ID NO: 514827 - DNA, 25 bp, Mus musculus
gatgcttttctcaacaggctcagtt

SEQ ID NO: 514828 - DNA, 25 bp, Mus musculus
gatgcttttctctaagttcccagac

SEQ ID NO: 514829 - DNA, 25 bp, Mus musculus
gatgcttttctctacaggctcagtt

SEQ ID NO: 514830 - DNA, 25 bp, Mus musculus
gatgcttttgatcatgtggacccag

SEQ ID NO: 514831 - DNA, 25 bp, Mus musculus
gatgcttttgatgatgtggacccag

SEQ ID NO: 514832 - DNA, 25 bp, Mus musculus
gatgcttttgcactaggtatcttgt

SEQ ID NO: 514833 - DNA, 25 bp, Mus musculus
gatgcttttgcagtaggtatcttgt

SEQ ID NO: 514834 - DNA, 25 bp, Mus musculus
gatgcttttggaaatcgtgactcaa

SEQ ID NO: 514835 - DNA, 25 bp, Mus musculus
gatgcttttggatatcgtgactcaa

SEQ ID NO: 514836 - DNA, 25 bp, Mus musculus
gatgcttttgtacaagatctctgcc

SEQ ID NO: 514837 - DNA, 25 bp, Mus musculus
gatgcttttgtagaagatctctgcc

SEQ ID NO: 514838 - DNA, 25 bp, Mus musculus
gatgcttttgtgcttgtatcattgc

SEQ ID NO: 514839 - DNA, 25 bp, Mus musculus
gatgcttttgtggttgtatcattgc

SEQ ID NO: 514840 - DNA, 25 bp, Mus musculus
gatgctttttctactatttaattgc

SEQ ID NO: 514841 - DNA, 25 bp, Mus musculus
gatgctttttcttctatttaattgc

SEQ ID NO: 514842 - DNA, 25 bp, Mus musculus
gatgcttttttgctgtctggccatt

SEQ ID NO: 514843 - DNA, 25 bp, Mus musculus
gatgcttttttggtgtctggccatt

SEQ ID NO: 514844 - DNA, 25 bp, Mus musculus
gatggaaaaagcatcttgctggact

SEQ ID NO: 514845 - DNA, 25 bp, Mus musculus
gatggaaaaagcttcttgctggact

SEQ ID NO: 514846 - DNA, 25 bp, Mus musculus
gatggaaaacctcagcatactcttt

SEQ ID NO: 514847 - DNA, 25 bp, Mus musculus
gatggaaaacctgagcatactcttt

SEQ ID NO: 514848 - DNA, 25 bp, Mus musculus
gatggaaaagaaaccttccctcaac

SEQ ID NO: 514849 - DNA, 25 bp, Mus musculus
gatggaaaagaatccttccctcaac

SEQ ID NO: 514850 - DNA, 25 bp, Mus musculus
gatggaaaagccacgaatcctgagc

SEQ ID NO: 514851 - DNA, 25 bp, Mus musculus
gatggaaaagcctcgaatcctgagc

SEQ ID NO: 514852 - DNA, 25 bp, Mus musculus
gatggaaaagctcatcccagccatt

SEQ ID NO: 514853 - DNA, 25 bp, Mus musculus
gatggaaaagctgatcccagccatt

SEQ ID NO: 514854 - DNA, 25 bp, Mus musculus
gatggaaaaggaatcctaccgccgc

SEQ ID NO: 514855 - DNA, 25 bp, Mus musculus
gatggaaaaggattcctaccgccgc

SEQ ID NO: 514856 - DNA, 25 bp, Mus musculus
gatggaaaatttctacttataggtc

SEQ ID NO: 514857 - DNA, 25 bp, Mus musculus
gatggaaaatttgtacttataggtc

SEQ ID NO: 514858 - DNA, 25 bp, Mus musculus
gatggaaacatcagtcgttgtcatg

SEQ ID NO: 514859 - DNA, 25 bp, Mus musculus
gatggaaacatctgtcgttgtcatg

SEQ ID NO: 514860 - DNA, 25 bp, Mus musculus
gatggaaaccagactttctcctact

SEQ ID NO: 514861 - DNA, 25 bp, Mus musculus
gatggaaaccagtctttctcctact

SEQ ID NO: 514862 - DNA, 25 bp, Mus musculus
gatggaaacctcaatactagccttg

SEQ ID NO: 514863 - DNA, 25 bp, Mus musculus
gatggaaacctctatactagccttg

SEQ ID NO: 514864 - DNA, 25 bp, Mus musculus
gatggaaactccacccactaaaact

SEQ ID NO: 514865 - DNA, 25 bp, Mus musculus
gatggaaactcctcccactaaaact

SEQ ID NO: 514866 - DNA, 25 bp, Mus musculus
gatggaaactggcacgcttccctga

SEQ ID NO: 514867 - DNA, 25 bp, Mus musculus
gatggaaactgggacgcttccctga

SEQ ID NO: 514868 - DNA, 25 bp, Mus musculus
gatggaaagaacatcccagggtata

SEQ ID NO: 514869 - DNA, 25 bp, Mus musculus
gatggaaagaacttcccagggtata

SEQ ID NO: 514870 - DNA, 25 bp, Mus musculus
gatggaaagatccttcccttcgctc

SEQ ID NO: 514871 - DNA, 25 bp, Mus musculus
gatggaaagatcgttcccttcgctc

SEQ ID NO: 514872 - DNA, 25 bp, Mus musculus
gatggaaagcaaaaggtgctcattt

SEQ ID NO: 514873 - DNA, 25 bp, Mus musculus
gatggaaagcaataggtgctcattt

SEQ ID NO: 514874 - DNA, 25 bp, Mus musculus
gatggaaatactctaactgatcgca

SEQ ID NO: 514875 - DNA, 25 bp, Mus musculus
gatggaaatactgtaactgatcgca

SEQ ID NO: 514876 - DNA, 25 bp, Mus musculus
gatggaaatccgacagaaaccctaa

SEQ ID NO: 514877 - DNA, 25 bp, Mus musculus
gatggaaatccgagtgtatatttaa

SEQ ID NO: 514878 - DNA, 25 bp, Mus musculus
gatggaaatccgtcagaaaccctaa

SEQ ID NO: 514879 - DNA, 25 bp, Mus musculus
gatggaaatccgtgtgtatatttaa

SEQ ID NO: 514880 - DNA, 25 bp, Mus musculus
gatggaacaagtcaccctgatctcg

SEQ ID NO: 514881 - DNA, 25 bp, Mus musculus
gatggaacaagtgaccctgatctcg

SEQ ID NO: 514882 - DNA, 25 bp, Mus musculus
gatggaacacaccaatgtcatgtca

SEQ ID NO: 514883 - DNA, 25 bp, Mus musculus
gatggaacacacgaatgtcatgtca

SEQ ID NO: 514884 - DNA, 25 bp, Mus musculus
gatggaacactacaaaggctacttt

SEQ ID NO: 514885 - DNA, 25 bp, Mus musculus
gatggaacactagaaaggctacttt

SEQ ID NO: 514886 - DNA, 25 bp, Mus musculus
gatggaacagctcgatcctaccctt

SEQ ID NO: 514887 - DNA, 25 bp, Mus musculus
gatggaacagctggatcctaccctt

SEQ ID NO: 514888 - DNA, 25 bp, Mus musculus
gatggaacaggaagggctttgcata

SEQ ID NO: 514889 - DNA, 25 bp, Mus musculus
gatggaacaggatgggctttgcata

SEQ ID NO: 514890 - DNA, 25 bp, Mus musculus
gatggaacaggtccgccagttacag

SEQ ID NO: 514891 - DNA, 25 bp, Mus musculus
gatggaacaggtgcgccagttacag

SEQ ID NO: 514892 - DNA, 25 bp, Mus musculus
gatggaacagtacgacccttcccgt

SEQ ID NO: 514893 - DNA, 25 bp, Mus musculus
gatggaacagtaggacccttcccgt

SEQ ID NO: 514894 - DNA, 25 bp, Mus musculus
gatggaacatctccacttaacacag

SEQ ID NO: 514895 - DNA, 25 bp, Mus musculus
gatggaacatctgcacttaacacag

SEQ ID NO: 514896 - DNA, 25 bp, Mus musculus
gatggaacattgaagcccagctgtg

SEQ ID NO: 514897 - DNA, 25 bp, Mus musculus
gatggaacattgtagcccagctgtg

SEQ ID NO: 514898 - DNA, 25 bp, Mus musculus
gatggaaccaccagcatcatgagcc

SEQ ID NO: 514899 - DNA, 25 bp, Mus musculus
gatggaaccaccatgagtcaggaca

SEQ ID NO: 514900 - DNA, 25 bp, Mus musculus
gatggaaccacctgcatcatgagcc

SEQ ID NO: 514901 - DNA, 25 bp, Mus musculus
gatggaaccaccttgagtcaggaca

SEQ ID NO: 514902 - DNA, 25 bp, Mus musculus
gatggaaccgaacaacgaggacttt

SEQ ID NO: 514903 - DNA, 25 bp, Mus musculus
gatggaaccgaagaacgaggacttt

SEQ ID NO: 514904 - DNA, 25 bp, Mus musculus
gatggaacctgacatcccaggccat

SEQ ID NO: 514905 - DNA, 25 bp, Mus musculus
gatggaacctgagatcccaggccat

SEQ ID NO: 514906 - DNA, 25 bp, Mus musculus
gatggaacctttcgtaccgtagact

SEQ ID NO: 514907 - DNA, 25 bp, Mus musculus
gatggaacctttggtaccgtagact

SEQ ID NO: 514908 - DNA, 25 bp, Mus musculus
gatggaacgatgctctcagactcct

SEQ ID NO: 514909 - DNA, 25 bp, Mus musculus
gatggaacgatggtctcagactcct

SEQ ID NO: 514910 - DNA, 25 bp, Mus musculus
gatggaactcaaagctttatgtact

SEQ ID NO: 514911 - DNA, 25 bp, Mus musculus
gatggaactcaatgctttatgtact

SEQ ID NO: 514912 - DNA, 25 bp, Mus musculus
gatggaactcctaatgttatcatat

SEQ ID NO: 514913 - DNA, 25 bp, Mus musculus
gatggaactccttatgttatcatat

SEQ ID NO: 514914 - DNA, 25 bp, Mus musculus
gatggaactcttactggtagaacac

SEQ ID NO: 514915 - DNA, 25 bp, Mus musculus
gatggaactctttctggtagaacac

SEQ ID NO: 514916 - DNA, 25 bp, Mus musculus
gatggaacttacaacgtctacggga

SEQ ID NO: 514917 - DNA, 25 bp, Mus musculus
gatggaacttactacgtctacggga

SEQ ID NO: 514918 - DNA, 25 bp, Mus musculus
gatggaacttctactgggatgggca

SEQ ID NO: 514919 - DNA, 25 bp, Mus musculus
gatggaacttcttctgggatgggca

SEQ ID NO: 514920 - DNA, 25 bp, Mus musculus
gatggaacttggacctgggcagtac

SEQ ID NO: 514921 - DNA, 25 bp, Mus musculus
gatggaacttggtcctgggcagtac

SEQ ID NO: 514922 - DNA, 25 bp, Mus musculus
gatggaagacaccacctctgccatg

SEQ ID NO: 514923 - DNA, 25 bp, Mus musculus
gatggaagacacgacctctgccatg

SEQ ID NO: 514924 - DNA, 25 bp, Mus musculus
gatggaagacccctcaagacctttg

SEQ ID NO: 514925 - DNA, 25 bp, Mus musculus
gatggaagacccgtcaagacctttg

SEQ ID NO: 514926 - DNA, 25 bp, Mus musculus
gatggaagagccacagtctcatacc

SEQ ID NO: 514927 - DNA, 25 bp, Mus musculus
gatggaagagcctcagtctcatacc

SEQ ID NO: 514928 - DNA, 25 bp, Mus musculus
gatggaagattaacccggtcataac

SEQ ID NO: 514929 - DNA, 25 bp, Mus musculus
gatggaagattatcccggtcataac

SEQ ID NO: 514930 - DNA, 25 bp, Mus musculus
gatggaagccacatgggcagtaaac

SEQ ID NO: 514931 - DNA, 25 bp, Mus musculus
gatggaagccacttgggcagtaaac

SEQ ID NO: 514932 - DNA, 25 bp, Mus musculus
gatggaagccatccttctggacaag

SEQ ID NO: 514933 - DNA, 25 bp, Mus musculus
gatggaagccatcttacctcttgat

SEQ ID NO: 514934 - DNA, 25 bp, Mus musculus
gatggaagccatgcttctggacaag

SEQ ID NO: 514935 - DNA, 25 bp, Mus musculus
gatggaagccatgttacctcttgat

SEQ ID NO: 514936 - DNA, 25 bp, Mus musculus
gatggaagctacagaacaccccact

SEQ ID NO: 514937 - DNA, 25 bp, Mus musculus
gatggaagctactgaacaccccact

SEQ ID NO: 514938 - DNA, 25 bp, Mus musculus
gatggaagctagccctgctaggcaa

SEQ ID NO: 514939 - DNA, 25 bp, Mus musculus
gatggaagctaggcctgctaggcaa

SEQ ID NO: 514940 - DNA, 25 bp, Mus musculus
gatggaagctcccatattgttttaa

SEQ ID NO: 514941 - DNA, 25 bp, Mus musculus
gatggaagctccgatattgttttaa

SEQ ID NO: 514942 - DNA, 25 bp, Mus musculus
gatggaaggactcccggaaacgctt

SEQ ID NO: 514943 - DNA, 25 bp, Mus musculus
gatggaaggactgccggaaacgctt

SEQ ID NO: 514944 - DNA, 25 bp, Mus musculus
gatggaaggatgagactctgacgac

SEQ ID NO: 514945 - DNA, 25 bp, Mus musculus
gatggaaggatgtgactctgacgac

SEQ ID NO: 514946 - DNA, 25 bp, Mus musculus
gatggaaggccgaaacttcgtttat

SEQ ID NO: 514947 - DNA, 25 bp, Mus musculus
gatggaaggccgtaacttcgtttat

SEQ ID NO: 514948 - DNA, 25 bp, Mus musculus
gatggaaggcttctacgtggtcttt

SEQ ID NO: 514949 - DNA, 25 bp, Mus musculus
gatggaaggcttgtacgtggtcttt

SEQ ID NO: 514950 - DNA, 25 bp, Mus musculus
gatggaaggtgccactcacctaggc

SEQ ID NO: 514951 - DNA, 25 bp, Mus musculus
gatggaaggtgcgactcacctaggc

SEQ ID NO: 514952 - DNA, 25 bp, Mus musculus
gatggaagtaaacactaacttctaa

SEQ ID NO: 514953 - DNA, 25 bp, Mus musculus
gatggaagtaaagactaacttctaa

SEQ ID NO: 514954 - DNA, 25 bp, Mus musculus
gatggaagtccacgagttaagtaga

SEQ ID NO: 514955 - DNA, 25 bp, Mus musculus
gatggaagtccaggagttaagtaga

SEQ ID NO: 514956 - DNA, 25 bp, Mus musculus
gatggaagtcctcagtctgttctgt

SEQ ID NO: 514957 - DNA, 25 bp, Mus musculus
gatggaagtcctgagtctgttctgt

SEQ ID NO: 514958 - DNA, 25 bp, Mus musculus
gatggaagtctgagcacactctcac

SEQ ID NO: 514959 - DNA, 25 bp, Mus musculus
gatggaagtctgtgcacactctcac

SEQ ID NO: 514960 - DNA, 25 bp, Mus musculus
gatggaagtgacctgagtgacaaca

SEQ ID NO: 514961 - DNA, 25 bp, Mus musculus
gatggaagtgacgtgagtgacaaca

SEQ ID NO: 514962 - DNA, 25 bp, Mus musculus
gatggaagttgaccactcggtccct

SEQ ID NO: 514963 - DNA, 25 bp, Mus musculus
gatggaagttgagcactcggtccct

SEQ ID NO: 514964 - DNA, 25 bp, Mus musculus
gatggaatcatgattcttggagaac

SEQ ID NO: 514965 - DNA, 25 bp, Mus musculus
gatggaatcatgtttcttggagaac

SEQ ID NO: 514966 - DNA, 25 bp, Mus musculus
gatggaatccctcaaatactgcaaa

SEQ ID NO: 514967 - DNA, 25 bp, Mus musculus
gatggaatccctgaaatactgcaaa

SEQ ID NO: 514968 - DNA, 25 bp, Mus musculus
gatggaatcctgactctttagtgtg

SEQ ID NO: 514969 - DNA, 25 bp, Mus musculus
gatggaatcctgtctctttagtgtg

SEQ ID NO: 514970 - DNA, 25 bp, Mus musculus
gatggaatcgatccactcttatagt

SEQ ID NO: 514971 - DNA, 25 bp, Mus musculus
gatggaatcgatgcactcttatagt

SEQ ID NO: 514972 - DNA, 25 bp, Mus musculus
gatggaatcgttacatttctcatgt

SEQ ID NO: 514973 - DNA, 25 bp, Mus musculus
gatggaatcgtttcatttctcatgt

SEQ ID NO: 514974 - DNA, 25 bp, Mus musculus
gatggaatgactaaccaacaggcaa

SEQ ID NO: 514975 - DNA, 25 bp, Mus musculus
gatggaatgactactgatgcctctt

SEQ ID NO: 514976 - DNA, 25 bp, Mus musculus
gatggaatgacttaccaacaggcaa

SEQ ID NO: 514977 - DNA, 25 bp, Mus musculus
gatggaatgacttctgatgcctctt

SEQ ID NO: 514978 - DNA, 25 bp, Mus musculus
gatggaatgctcaccacagagttgt

SEQ ID NO: 514979 - DNA, 25 bp, Mus musculus
gatggaatgctctccacagagttgt

SEQ ID NO: 514980 - DNA, 25 bp, Mus musculus
gatggaatgttcagagcctgtggca

SEQ ID NO: 514981 - DNA, 25 bp, Mus musculus
gatggaatgttctgagcctgtggca

SEQ ID NO: 514982 - DNA, 25 bp, Mus musculus
gatggaattaacagccagccagcca

SEQ ID NO: 514983 - DNA, 25 bp, Mus musculus
gatggaattaactgccagccagcca

SEQ ID NO: 514984 - DNA, 25 bp, Mus musculus
gatggaattcaaattgtcaacattt

SEQ ID NO: 514985 - DNA, 25 bp, Mus musculus
gatggaattcaatttgtcaacattt

SEQ ID NO: 514986 - DNA, 25 bp, Mus musculus
gatggaattcggctttcaggcataa

SEQ ID NO: 514987 - DNA, 25 bp, Mus musculus
gatggaattcgggtttcaggcataa

SEQ ID NO: 514988 - DNA, 25 bp, Mus musculus
gatggaattgaaagagcacagcctg

SEQ ID NO: 514989 - DNA, 25 bp, Mus musculus
gatggaattgaatgagcacagcctg

SEQ ID NO: 514990 - DNA, 25 bp, Mus musculus
gatggaatttctcacttttctatca

SEQ ID NO: 514991 - DNA, 25 bp, Mus musculus
gatggaatttctgacttttctatca

SEQ ID NO: 514992 - DNA, 25 bp, Mus musculus
gatggaattttgcttcttgtatttc

SEQ ID NO: 514993 - DNA, 25 bp, Mus musculus
gatggaattttggttcttgtatttc

SEQ ID NO: 514994 - DNA, 25 bp, Mus musculus
gatggacaaatcaggacaagctctt

SEQ ID NO: 514995 - DNA, 25 bp, Mus musculus
gatggacaaatctggacaagctctt

SEQ ID NO: 514996 - DNA, 25 bp, Mus musculus
gatggacaactacagaagctccctg

SEQ ID NO: 514997 - DNA, 25 bp, Mus musculus
gatggacaactagagaagctccctg

SEQ ID NO: 514998 - DNA, 25 bp, Mus musculus
gatggacaagccatcctggcgcact

SEQ ID NO: 514999 - DNA, 25 bp, Mus musculus
gatggacaagccttcctggcgcact

SEQ ID NO: 515000 - DNA, 25 bp, Mus musculus
gatggacaatagaagctgccctgct

SEQ ID NO: 515001 - DNA, 25 bp, Mus musculus
gatggacaatagtagctgccctgct

SEQ ID NO: 515002 - DNA, 25 bp, Mus musculus
gatggacaatatatcccagagtaga

SEQ ID NO: 515003 - DNA, 25 bp, Mus musculus
gatggacaatatttcccagagtaga

SEQ ID NO: 515004 - DNA, 25 bp, Mus musculus
gatggacacactctaaacccctggg

SEQ ID NO: 515005 - DNA, 25 bp, Mus musculus
gatggacacactgtaaacccctggg

SEQ ID NO: 515006 - DNA, 25 bp, Mus musculus
gatggacacaggccttacatttcca

SEQ ID NO: 515007 - DNA, 25 bp, Mus musculus
gatggacacagggcttacatttcca

SEQ ID NO: 515008 - DNA, 25 bp, Mus musculus
gatggacacatgctacctgagcaca

SEQ ID NO: 515009 - DNA, 25 bp, Mus musculus
gatggacacatggtacctgagcaca

SEQ ID NO: 515010 - DNA, 25 bp, Mus musculus
gatggacaccaccagctatgatgtg

SEQ ID NO: 515011 - DNA, 25 bp, Mus musculus
gatggacaccacgagctatgatgtg

SEQ ID NO: 515012 - DNA, 25 bp, Mus musculus
gatggacaccagcatgggttacctg

SEQ ID NO: 515013 - DNA, 25 bp, Mus musculus
gatggacaccaggatgggttacctg

SEQ ID NO: 515014 - DNA, 25 bp, Mus musculus
gatggacaccatcgccactgtgtaa

SEQ ID NO: 515015 - DNA, 25 bp, Mus musculus
gatggacaccatggccactgtgtaa

SEQ ID NO: 515016 - DNA, 25 bp, Mus musculus
gatggacaccttcctggacttgaag

SEQ ID NO: 515017 - DNA, 25 bp, Mus musculus
gatggacaccttgctggacttgaag

SEQ ID NO: 515018 - DNA, 25 bp, Mus musculus
gatggacactggagaagtttctgat

SEQ ID NO: 515019 - DNA, 25 bp, Mus musculus
gatggacactggtgaagtttctgat

SEQ ID NO: 515020 - DNA, 25 bp, Mus musculus
gatggacactgtaggctcaatcttg

SEQ ID NO: 515021 - DNA, 25 bp, Mus musculus
gatggacactgttggctcaatcttg

SEQ ID NO: 515022 - DNA, 25 bp, Mus musculus
gatggacagaccattcagagcttct

SEQ ID NO: 515023 - DNA, 25 bp, Mus musculus
gatggacagacctttcagagcttct

SEQ ID NO: 515024 - DNA, 25 bp, Mus musculus
gatggacagactacggcattgctgt

SEQ ID NO: 515025 - DNA, 25 bp, Mus musculus
gatggacagactagcaggcttcctg

SEQ ID NO: 515026 - DNA, 25 bp, Mus musculus
gatggacagacttcggcattgctgt

SEQ ID NO: 515027 - DNA, 25 bp, Mus musculus
gatggacagacttgcaggcttcctg

SEQ ID NO: 515028 - DNA, 25 bp, Mus musculus
gatggacagataaggacacacacag

SEQ ID NO: 515029 - DNA, 25 bp, Mus musculus
gatggacagatatggacacacacag

SEQ ID NO: 515030 - DNA, 25 bp, Mus musculus
gatggacagcaccattctatggcct

SEQ ID NO: 515031 - DNA, 25 bp, Mus musculus
gatggacagcacgattctatggcct

SEQ ID NO: 515032 - DNA, 25 bp, Mus musculus
gatggacagcgacatttcaagtcta

SEQ ID NO: 515033 - DNA, 25 bp, Mus musculus
gatggacagcgagatttcaagtcta

SEQ ID NO: 515034 - DNA, 25 bp, Mus musculus
gatggacagcttctttgcccaaaat

SEQ ID NO: 515035 - DNA, 25 bp, Mus musculus
gatggacagcttgtttgcccaaaat

SEQ ID NO: 515036 - DNA, 25 bp, Mus musculus
gatggacagtgcactagtgtgtgca

SEQ ID NO: 515037 - DNA, 25 bp, Mus musculus
gatggacagtgctctagtgtgtgca

SEQ ID NO: 515038 - DNA, 25 bp, Mus musculus
gatggacatctgctgatggtgctcc

SEQ ID NO: 515039 - DNA, 25 bp, Mus musculus
gatggacatctggtgatggtgctcc

SEQ ID NO: 515040 - DNA, 25 bp, Mus musculus
gatggacatttaagggaccagccgt

SEQ ID NO: 515041 - DNA, 25 bp, Mus musculus
gatggacatttatgggaccagccgt

SEQ ID NO: 515042 - DNA, 25 bp, Mus musculus
gatggacatttcagcttcctttttt

SEQ ID NO: 515043 - DNA, 25 bp, Mus musculus
gatggacatttcctttgcagtggct

SEQ ID NO: 515044 - DNA, 25 bp, Mus musculus
gatggacatttcgtttgcagtggct

SEQ ID NO: 515045 - DNA, 25 bp, Mus musculus
gatggacatttctgcttcctttttt

SEQ ID NO: 515046 - DNA, 25 bp, Mus musculus
gatggacattttatcctcttatggt

SEQ ID NO: 515047 - DNA, 25 bp, Mus musculus
gatggacattttttcctcttatggt

SEQ ID NO: 515048 - DNA, 25 bp, Mus musculus
gatggaccaacccagatggagccac

SEQ ID NO: 515049 - DNA, 25 bp, Mus musculus
gatggaccaaccgagatggagccac

SEQ ID NO: 515050 - DNA, 25 bp, Mus musculus
gatggaccaactcagatctacaagt

SEQ ID NO: 515051 - DNA, 25 bp, Mus musculus
gatggaccaactgagatctacaagt

SEQ ID NO: 515052 - DNA, 25 bp, Mus musculus
gatggaccaaggattgaccccaagt

SEQ ID NO: 515053 - DNA, 25 bp, Mus musculus
gatggaccaaggtttgaccccaagt

SEQ ID NO: 515054 - DNA, 25 bp, Mus musculus
gatggaccagaaagccttttctctt

SEQ ID NO: 515055 - DNA, 25 bp, Mus musculus
gatggaccagaatgccttttctctt

SEQ ID NO: 515056 - DNA, 25 bp, Mus musculus
gatggaccaggacttctgcgacacg

SEQ ID NO: 515057 - DNA, 25 bp, Mus musculus
gatggaccaggagttctgcgacacg

SEQ ID NO: 515058 - DNA, 25 bp, Mus musculus
gatggaccatctcctggtgttacca

SEQ ID NO: 515059 - DNA, 25 bp, Mus musculus
gatggaccatctgctggtgttacca

SEQ ID NO: 515060 - DNA, 25 bp, Mus musculus
gatggacccaggatactccagtgag

SEQ ID NO: 515061 - DNA, 25 bp, Mus musculus
gatggacccaggttactccagtgag

SEQ ID NO: 515062 - DNA, 25 bp, Mus musculus
gatggaccccatacctgttgagcaa

SEQ ID NO: 515063 - DNA, 25 bp, Mus musculus
gatggaccccattcctgttgagcaa

SEQ ID NO: 515064 - DNA, 25 bp, Mus musculus
gatggaccccgaacattaaagacat

SEQ ID NO: 515065 - DNA, 25 bp, Mus musculus
gatggaccccgatcattaaagacat

SEQ ID NO: 515066 - DNA, 25 bp, Mus musculus
gatggaccggtcagtggaacatgac

SEQ ID NO: 515067 - DNA, 25 bp, Mus musculus
gatggaccggtctgtggaacatgac

SEQ ID NO: 515068 - DNA, 25 bp, Mus musculus
gatggacctcatctctgagctaaaa

SEQ ID NO: 515069 - DNA, 25 bp, Mus musculus
gatggacctcatgtctgagctaaaa

SEQ ID NO: 515070 - DNA, 25 bp, Mus musculus
gatggacctccacggttgaatgttt

SEQ ID NO: 515071 - DNA, 25 bp, Mus musculus
gatggacctccagggttgaatgttt

SEQ ID NO: 515072 - DNA, 25 bp, Mus musculus
gatggacctctgctatttggataat

SEQ ID NO: 515073 - DNA, 25 bp, Mus musculus
gatggacctctggtatttggataat

SEQ ID NO: 515074 - DNA, 25 bp, Mus musculus
gatggacctgttagtactacatttt

SEQ ID NO: 515075 - DNA, 25 bp, Mus musculus
gatggacctgtttgtactacatttt

SEQ ID NO: 515076 - DNA, 25 bp, Mus musculus
gatggacgatggacgattgacctcc

SEQ ID NO: 515077 - DNA, 25 bp, Mus musculus
gatggacgatggtcgattgacctcc

SEQ ID NO: 515078 - DNA, 25 bp, Mus musculus
gatggacgattgacctccagttagg

SEQ ID NO: 515079 - DNA, 25 bp, Mus musculus
gatggacgattgtcctccagttagg

SEQ ID NO: 515080 - DNA, 25 bp, Mus musculus
gatggacgcaggagaactttcacaa

SEQ ID NO: 515081 - DNA, 25 bp, Mus musculus
gatggacgcaggtgaactttcacaa

SEQ ID NO: 515082 - DNA, 25 bp, Mus musculus
gatggacgccacacatgagagtctc

SEQ ID NO: 515083 - DNA, 25 bp, Mus musculus
gatggacgccactcatgagagtctc

SEQ ID NO: 515084 - DNA, 25 bp, Mus musculus
gatggacgccatagctagagacaat

SEQ ID NO: 515085 - DNA, 25 bp, Mus musculus
gatggacgccattgctagagacaat

SEQ ID NO: 515086 - DNA, 25 bp, Mus musculus
gatggacgcttccaagtggcatcca

SEQ ID NO: 515087 - DNA, 25 bp, Mus musculus
gatggacgcttcgaagtggcatcca

SEQ ID NO: 515088 - DNA, 25 bp, Mus musculus
gatggacggactctcactctgggaa

SEQ ID NO: 515089 - DNA, 25 bp, Mus musculus
gatggacggactgtcactctgggaa

SEQ ID NO: 515090 - DNA, 25 bp, Mus musculus
gatggactacatatgcagcgagcta

SEQ ID NO: 515091 - DNA, 25 bp, Mus musculus
gatggactacatttgcagcgagcta

SEQ ID NO: 515092 - DNA, 25 bp, Mus musculus
gatggactacttcggttctcggcaa

SEQ ID NO: 515093 - DNA, 25 bp, Mus musculus
gatggactacttgggttctcggcaa

SEQ ID NO: 515094 - DNA, 25 bp, Mus musculus
gatggactaggcctaatccctccca

SEQ ID NO: 515095 - DNA, 25 bp, Mus musculus
gatggactaggcgtaatccctccca

SEQ ID NO: 515096 - DNA, 25 bp, Mus musculus
gatggactatggactacagtttacc

SEQ ID NO: 515097 - DNA, 25 bp, Mus musculus
gatggactatggtctacagtttacc

SEQ ID NO: 515098 - DNA, 25 bp, Mus musculus
gatggactcagtcttgtcagcacca

SEQ ID NO: 515099 - DNA, 25 bp, Mus musculus
gatggactcagtgttgtcagcacca

SEQ ID NO: 515100 - DNA, 25 bp, Mus musculus
gatggactcctaagattgtcctctg

SEQ ID NO: 515101 - DNA, 25 bp, Mus musculus
gatggactcctatgattgtcctctg

SEQ ID NO: 515102 - DNA, 25 bp, Mus musculus
gatggactcctgcatcttttgtggc

SEQ ID NO: 515103 - DNA, 25 bp, Mus musculus
gatggactcctggatcttttgtggc

SEQ ID NO: 515104 - DNA, 25 bp, Mus musculus
gatggactccttcctcctcgtgatg

SEQ ID NO: 515105 - DNA, 25 bp, Mus musculus
gatggactccttgctcctcgtgatg

SEQ ID NO: 515106 - DNA, 25 bp, Mus musculus
gatggactcgggaaaaaccctagcg

SEQ ID NO: 515107 - DNA, 25 bp, Mus musculus
gatggactcgggtaaaaccctagcg

SEQ ID NO: 515108 - DNA, 25 bp, Mus musculus
gatggactctcaaagggctgtttca

SEQ ID NO: 515109 - DNA, 25 bp, Mus musculus
gatggactctcatagggctgtttca

SEQ ID NO: 515110 - DNA, 25 bp, Mus musculus
gatggactgaccctgaaccggactc

SEQ ID NO: 515111 - DNA, 25 bp, Mus musculus
gatggactgaccgtgaaccggactc

SEQ ID NO: 515112 - DNA, 25 bp, Mus musculus
gatggactgatcattggtttggttt

SEQ ID NO: 515113 - DNA, 25 bp, Mus musculus
gatggactgatctttggtttggttt

SEQ ID NO: 515114 - DNA, 25 bp, Mus musculus
gatggactgcagaggttgcccatac

SEQ ID NO: 515115 - DNA, 25 bp, Mus musculus
gatggactgcagtggttgcccatac

SEQ ID NO: 515116 - DNA, 25 bp, Mus musculus
gatggactgcatcatttgagtgttc

SEQ ID NO: 515117 - DNA, 25 bp, Mus musculus
gatggactgcatgatttgagtgttc

SEQ ID NO: 515118 - DNA, 25 bp, Mus musculus
gatggactggatatcttccatgttt

SEQ ID NO: 515119 - DNA, 25 bp, Mus musculus
gatggactggatttcttccatgttt

SEQ ID NO: 515120 - DNA, 25 bp, Mus musculus
gatggactggcccaagttcaaggct

SEQ ID NO: 515121 - DNA, 25 bp, Mus musculus
gatggactggccgaagttcaaggct

SEQ ID NO: 515122 - DNA, 25 bp, Mus musculus
gatggactgtctagctaccagttcc

SEQ ID NO: 515123 - DNA, 25 bp, Mus musculus
gatggactgtcttgctaccagttcc

SEQ ID NO: 515124 - DNA, 25 bp, Mus musculus
gatggactgtgtaaacctctggaga

SEQ ID NO: 515125 - DNA, 25 bp, Mus musculus
gatggactgtgttaacctctggaga

SEQ ID NO: 515126 - DNA, 25 bp, Mus musculus
gatggactgttgcatggacttgtca

SEQ ID NO: 515127 - DNA, 25 bp, Mus musculus
gatggactgttggatggacttgtca

SEQ ID NO: 515128 - DNA, 25 bp, Mus musculus
gatggacttcacactgtctcaaaag

SEQ ID NO: 515129 - DNA, 25 bp, Mus musculus
gatggacttcactctgtctcaaaag

SEQ ID NO: 515130 - DNA, 25 bp, Mus musculus
gatggacttccaaaaaattctccta

SEQ ID NO: 515131 - DNA, 25 bp, Mus musculus
gatggacttccataaaattctccta

SEQ ID NO: 515132 - DNA, 25 bp, Mus musculus
gatggacttctcacagtcagcagcc

SEQ ID NO: 515133 - DNA, 25 bp, Mus musculus
gatggacttctctcagtcagcagcc

SEQ ID NO: 515134 - DNA, 25 bp, Mus musculus
gatggacttgaacctacctttgttt

SEQ ID NO: 515135 - DNA, 25 bp, Mus musculus
gatggacttgaagctacctttgttt

SEQ ID NO: 515136 - DNA, 25 bp, Mus musculus
gatggacttgagcaaaacaccacat

SEQ ID NO: 515137 - DNA, 25 bp, Mus musculus
gatggacttgaggaaaacaccacat

SEQ ID NO: 515138 - DNA, 25 bp, Mus musculus
gatggacttgtaaaaaaccctgagg

SEQ ID NO: 515139 - DNA, 25 bp, Mus musculus
gatggacttgtataaaaccctgagg

SEQ ID NO: 515140 - DNA, 25 bp, Mus musculus
gatggacttgtcatttctgatcaat

SEQ ID NO: 515141 - DNA, 25 bp, Mus musculus
gatggacttgtcttttctgatcaat

SEQ ID NO: 515142 - DNA, 25 bp, Mus musculus
gatggacttttccttaacattgacc

SEQ ID NO: 515143 - DNA, 25 bp, Mus musculus
gatggacttttcgttaacattgacc

SEQ ID NO: 515144 - DNA, 25 bp, Mus musculus
gatggagaaatgcttggacctttaa

SEQ ID NO: 515145 - DNA, 25 bp, Mus musculus
gatggagaaatggttggacctttaa

SEQ ID NO: 515146 - DNA, 25 bp, Mus musculus
gatggagaaattcacggaaacaaag

SEQ ID NO: 515147 - DNA, 25 bp, Mus musculus
gatggagaaattgacggaaacaaag

SEQ ID NO: 515148 - DNA, 25 bp, Mus musculus
gatggagaaccccagctcctgtgtt

SEQ ID NO: 515149 - DNA, 25 bp, Mus musculus
gatggagaacccgagctcctgtgtt

SEQ ID NO: 515150 - DNA, 25 bp, Mus musculus
gatggagaacctacagcgttaagaa

SEQ ID NO: 515151 - DNA, 25 bp, Mus musculus
gatggagaaccttcagcgttaagaa

SEQ ID NO: 515152 - DNA, 25 bp, Mus musculus
gatggagaacgccatgcgagtctct

SEQ ID NO: 515153 - DNA, 25 bp, Mus musculus
gatggagaacgcgatgcgagtctct

SEQ ID NO: 515154 - DNA, 25 bp, Mus musculus
gatggagaacgtagtctgtgccctc

SEQ ID NO: 515155 - DNA, 25 bp, Mus musculus
gatggagaacgttgtctgtgccctc

SEQ ID NO: 515156 - DNA, 25 bp, Mus musculus
gatggagaactcaacaatgaagtca

SEQ ID NO: 515157 - DNA, 25 bp, Mus musculus
gatggagaactctacaatgaagtca

SEQ ID NO: 515158 - DNA, 25 bp, Mus musculus
gatggagaagctcacttccagctgt

SEQ ID NO: 515159 - DNA, 25 bp, Mus musculus
gatggagaagctgacttccagctgt

SEQ ID NO: 515160 - DNA, 25 bp, Mus musculus
gatggagaatgccacgtttctcgca

SEQ ID NO: 515161 - DNA, 25 bp, Mus musculus
gatggagaatgcgacgtttctcgca

SEQ ID NO: 515162 - DNA, 25 bp, Mus musculus
gatggagacaagatttaagtggaca

SEQ ID NO: 515163 - DNA, 25 bp, Mus musculus
gatggagacaagttttaagtggaca

SEQ ID NO: 515164 - DNA, 25 bp, Mus musculus
gatggagacacaacccagaacaccc

SEQ ID NO: 515165 - DNA, 25 bp, Mus musculus
gatggagacacatcccagaacaccc

SEQ ID NO: 515166 - DNA, 25 bp, Mus musculus
gatggagacacgcaaacgcctggct

SEQ ID NO: 515167 - DNA, 25 bp, Mus musculus
gatggagacacggaaacgcctggct

SEQ ID NO: 515168 - DNA, 25 bp, Mus musculus
gatggagacactccacttagctgga

SEQ ID NO: 515169 - DNA, 25 bp, Mus musculus
gatggagacactgcacttagctgga

SEQ ID NO: 515170 - DNA, 25 bp, Mus musculus
gatggagaccacaatagtaactttt

SEQ ID NO: 515171 - DNA, 25 bp, Mus musculus
gatggagaccacatgctgtcaatat

SEQ ID NO: 515172 - DNA, 25 bp, Mus musculus
gatggagaccactatagtaactttt

SEQ ID NO: 515173 - DNA, 25 bp, Mus musculus
gatggagaccacttgctgtcaatat

SEQ ID NO: 515174 - DNA, 25 bp, Mus musculus
gatggagaccatcacgacggatacc

SEQ ID NO: 515175 - DNA, 25 bp, Mus musculus
gatggagaccatgacgacggatacc

SEQ ID NO: 515176 - DNA, 25 bp, Mus musculus
gatggagaccccagaactcattgag

SEQ ID NO: 515177 - DNA, 25 bp, Mus musculus
gatggagacccctgaactcattgag

SEQ ID NO: 515178 - DNA, 25 bp, Mus musculus
gatggagacctgacataggccccac

SEQ ID NO: 515179 - DNA, 25 bp, Mus musculus
gatggagacctgtcataggccccac

SEQ ID NO: 515180 - DNA, 25 bp, Mus musculus
gatggagaccttagaccctaacatt

SEQ ID NO: 515181 - DNA, 25 bp, Mus musculus
gatggagacctttgaccctaacatt

SEQ ID NO: 515182 - DNA, 25 bp, Mus musculus
gatggagacgaacattgtttcctgc

SEQ ID NO: 515183 - DNA, 25 bp, Mus musculus
gatggagacgaagattgtttcctgc

SEQ ID NO: 515184 - DNA, 25 bp, Mus musculus
gatggagactccaacttaaggccct

SEQ ID NO: 515185 - DNA, 25 bp, Mus musculus
gatggagactccatctgagatgcag

SEQ ID NO: 515186 - DNA, 25 bp, Mus musculus
gatggagactcctacttaaggccct

SEQ ID NO: 515187 - DNA, 25 bp, Mus musculus
gatggagactccttctgagatgcag

SEQ ID NO: 515188 - DNA, 25 bp, Mus musculus
gatggagagcccagcgtcagtgctc

SEQ ID NO: 515189 - DNA, 25 bp, Mus musculus
gatggagagccctgcgtcagtgctc

SEQ ID NO: 515190 - DNA, 25 bp, Mus musculus
gatggagagcgcagactgtagttaa

SEQ ID NO: 515191 - DNA, 25 bp, Mus musculus
gatggagagcgctgactgtagttaa

SEQ ID NO: 515192 - DNA, 25 bp, Mus musculus
gatggagaggacctttacccctgta

SEQ ID NO: 515193 - DNA, 25 bp, Mus musculus
gatggagaggacgtttacccctgta

SEQ ID NO: 515194 - DNA, 25 bp, Mus musculus
gatggagagtgcactgaaatatttt

SEQ ID NO: 515195 - DNA, 25 bp, Mus musculus
gatggagagtgctctgaaatatttt

SEQ ID NO: 515196 - DNA, 25 bp, Mus musculus
gatggagagttcaccagtcctactt

SEQ ID NO: 515197 - DNA, 25 bp, Mus musculus
gatggagagttctccagtcctactt

SEQ ID NO: 515198 - DNA, 25 bp, Mus musculus
gatggagatacacaggttgctcttc

SEQ ID NO: 515199 - DNA, 25 bp, Mus musculus
gatggagatacagaggttgctcttc

SEQ ID NO: 515200 - DNA, 25 bp, Mus musculus
gatggagatactaactacaatggga

SEQ ID NO: 515201 - DNA, 25 bp, Mus musculus
gatggagatacttactacaatggga

SEQ ID NO: 515202 - DNA, 25 bp, Mus musculus
gatggagatcatacagtcagactgc

SEQ ID NO: 515203 - DNA, 25 bp, Mus musculus
gatggagatcattcagtcagactgc

SEQ ID NO: 515204 - DNA, 25 bp, Mus musculus
gatggagatgaccaacagccacctg

SEQ ID NO: 515205 - DNA, 25 bp, Mus musculus
gatggagatgacgaacagccacctg

SEQ ID NO: 515206 - DNA, 25 bp, Mus musculus
gatggagatgtcagcggtccacgca

SEQ ID NO: 515207 - DNA, 25 bp, Mus musculus
gatggagatgtctgcggtccacgca

SEQ ID NO: 515208 - DNA, 25 bp, Mus musculus
gatggagattccagagcctctggac

SEQ ID NO: 515209 - DNA, 25 bp, Mus musculus
gatggagattccaggcccgatgcca

SEQ ID NO: 515210 - DNA, 25 bp, Mus musculus
gatggagattcctgagcctctggac

SEQ ID NO: 515211 - DNA, 25 bp, Mus musculus
gatggagattcctggcccgatgcca

SEQ ID NO: 515212 - DNA, 25 bp, Mus musculus
gatggagattgacagaatcctcttt

SEQ ID NO: 515213 - DNA, 25 bp, Mus musculus
gatggagattgagagaatcctcttt

SEQ ID NO: 515214 - DNA, 25 bp, Mus musculus
gatggagcaaataagcatgctttga

SEQ ID NO: 515215 - DNA, 25 bp, Mus musculus
gatggagcaaattagcatgctttga

SEQ ID NO: 515216 - DNA, 25 bp, Mus musculus
gatggagcaactacctcatctccta

SEQ ID NO: 515217 - DNA, 25 bp, Mus musculus
gatggagcaacttcctcatctccta

SEQ ID NO: 515218 - DNA, 25 bp, Mus musculus
gatggagcaatgctggctttctttt

SEQ ID NO: 515219 - DNA, 25 bp, Mus musculus
gatggagcaatggtggctttctttt

SEQ ID NO: 515220 - DNA, 25 bp, Mus musculus
gatggagcagcacactagtaaccct

SEQ ID NO: 515221 - DNA, 25 bp, Mus musculus
gatggagcagcacttgctatatcca

SEQ ID NO: 515222 - DNA, 25 bp, Mus musculus
gatggagcagcagactagtaaccct

SEQ ID NO: 515223 - DNA, 25 bp, Mus musculus
gatggagcagcagttgctatatcca

SEQ ID NO: 515224 - DNA, 25 bp, Mus musculus
gatggagcaggccatagtcctaaca

SEQ ID NO: 515225 - DNA, 25 bp, Mus musculus
gatggagcaggcgatagtcctaaca

SEQ ID NO: 515226 - DNA, 25 bp, Mus musculus
gatggagcagtcaagccactccctt

SEQ ID NO: 515227 - DNA, 25 bp, Mus musculus
gatggagcagtctagccactccctt

SEQ ID NO: 515228 - DNA, 25 bp, Mus musculus
gatggagcagtgacgggctctcatc

SEQ ID NO: 515229 - DNA, 25 bp, Mus musculus
gatggagcagtgtcgggctctcatc

SEQ ID NO: 515230 - DNA, 25 bp, Mus musculus
gatggagcatgccaaccagcagacc

SEQ ID NO: 515231 - DNA, 25 bp, Mus musculus
gatggagcatgcgaaccagcagacc

SEQ ID NO: 515232 - DNA, 25 bp, Mus musculus
gatggagccacactgggtcccaatt

SEQ ID NO: 515233 - DNA, 25 bp, Mus musculus
gatggagccacagtgggtcccaatt

SEQ ID NO: 515234 - DNA, 25 bp, Mus musculus
gatggagccacccttacaggataag

SEQ ID NO: 515235 - DNA, 25 bp, Mus musculus
gatggagccaccgttacaggataag

SEQ ID NO: 515236 - DNA, 25 bp, Mus musculus
gatggagcccaacgtttccaatgaa

SEQ ID NO: 515237 - DNA, 25 bp, Mus musculus
gatggagcccaaggtttccaatgaa

SEQ ID NO: 515238 - DNA, 25 bp, Mus musculus
gatggagcccatacaaggagcattt

SEQ ID NO: 515239 - DNA, 25 bp, Mus musculus
gatggagcccattcaaggagcattt

SEQ ID NO: 515240 - DNA, 25 bp, Mus musculus
gatggagcccgtatgcagtcatgag

SEQ ID NO: 515241 - DNA, 25 bp, Mus musculus
gatggagcccgtttgcagtcatgag

SEQ ID NO: 515242 - DNA, 25 bp, Mus musculus
gatggagccctaatctatgtaaatg

SEQ ID NO: 515243 - DNA, 25 bp, Mus musculus
gatggagccctattctatgtaaatg

SEQ ID NO: 515244 - DNA, 25 bp, Mus musculus
gatggagcctcacaacgaccacgaa

SEQ ID NO: 515245 - DNA, 25 bp, Mus musculus
gatggagcctcagaacgaccacgaa

SEQ ID NO: 515246 - DNA, 25 bp, Mus musculus
gatggagcctccatgtatgaagtga

SEQ ID NO: 515247 - DNA, 25 bp, Mus musculus
gatggagcctccttgtatgaagtga

SEQ ID NO: 515248 - DNA, 25 bp, Mus musculus
gatggagcctcgcagtcttgatcat

SEQ ID NO: 515249 - DNA, 25 bp, Mus musculus
gatggagcctcggagtcttgatcat

SEQ ID NO: 515250 - DNA, 25 bp, Mus musculus
gatggagcctctctgtatctcagaa

SEQ ID NO: 515251 - DNA, 25 bp, Mus musculus
gatggagcctctgtgtatctcagaa

SEQ ID NO: 515252 - DNA, 25 bp, Mus musculus
gatggagcctgtatctgccctccag

SEQ ID NO: 515253 - DNA, 25 bp, Mus musculus
gatggagcctgtttctgccctccag

SEQ ID NO: 515254 - DNA, 25 bp, Mus musculus
gatggagcggctcaggatgagcctt

SEQ ID NO: 515255 - DNA, 25 bp, Mus musculus
gatggagcggctgaggatgagcctt

SEQ ID NO: 515256 - DNA, 25 bp, Mus musculus
gatggagcggtcatttatccttcat

SEQ ID NO: 515257 - DNA, 25 bp, Mus musculus
gatggagcggtcttttatccttcat

SEQ ID NO: 515258 - DNA, 25 bp, Mus musculus
gatggagcggtgcattttcctccaa

SEQ ID NO: 515259 - DNA, 25 bp, Mus musculus
gatggagcggtggattttcctccaa

SEQ ID NO: 515260 - DNA, 25 bp, Mus musculus
gatggagctaaaacgggccttgaga

SEQ ID NO: 515261 - DNA, 25 bp, Mus musculus
gatggagctaaatcgggccttgaga

SEQ ID NO: 515262 - DNA, 25 bp, Mus musculus
gatggagctacaagatctcagcaag

SEQ ID NO: 515263 - DNA, 25 bp, Mus musculus
gatggagctacatgatctcagcaag

SEQ ID NO: 515264 - DNA, 25 bp, Mus musculus
gatggagctacgcacatggaagcct

SEQ ID NO: 515265 - DNA, 25 bp, Mus musculus
gatggagctacggacatggaagcct

SEQ ID NO: 515266 - DNA, 25 bp, Mus musculus
gatggagctctgataggtcatacat

SEQ ID NO: 515267 - DNA, 25 bp, Mus musculus
gatggagctctgttaggtcatacat

SEQ ID NO: 515268 - DNA, 25 bp, Mus musculus
gatggagcttatccaacaagcagct

SEQ ID NO: 515269 - DNA, 25 bp, Mus musculus
gatggagcttatgcaacaagcagct

SEQ ID NO: 515270 - DNA, 25 bp, Mus musculus
gatggagcttcacgccaaactcaca

SEQ ID NO: 515271 - DNA, 25 bp, Mus musculus
gatggagcttcaggccaaactcaca

SEQ ID NO: 515272 - DNA, 25 bp, Mus musculus
gatggagcttgtatgtcaaatcaga

SEQ ID NO: 515273 - DNA, 25 bp, Mus musculus
gatggagcttgtttgtcaaatcaga

SEQ ID NO: 515274 - DNA, 25 bp, Mus musculus
gatggaggaagcaatagaggcacat

SEQ ID NO: 515275 - DNA, 25 bp, Mus musculus
gatggaggaagctatagaggcacat

SEQ ID NO: 515276 - DNA, 25 bp, Mus musculus
gatggaggacatcacgcaaatcgtg

SEQ ID NO: 515277 - DNA, 25 bp, Mus musculus
gatggaggacatgacgcaaatcgtg

SEQ ID NO: 515278 - DNA, 25 bp, Mus musculus
gatggaggcaaactcttctgcacct

SEQ ID NO: 515279 - DNA, 25 bp, Mus musculus
gatggaggcaaagtcttctgcacct

SEQ ID NO: 515280 - DNA, 25 bp, Mus musculus
gatggaggcatgacagtcctctcgc

SEQ ID NO: 515281 - DNA, 25 bp, Mus musculus
gatggaggcatgtcagtcctctcgc

SEQ ID NO: 515282 - DNA, 25 bp, Mus musculus
gatggaggccaaacactcatgcaca

SEQ ID NO: 515283 - DNA, 25 bp, Mus musculus
gatggaggccaatcactcatgcaca

SEQ ID NO: 515284 - DNA, 25 bp, Mus musculus
gatggaggccttaatcctgaggcta

SEQ ID NO: 515285 - DNA, 25 bp, Mus musculus
gatggaggcctttatcctgaggcta

SEQ ID NO: 515286 - DNA, 25 bp, Mus musculus
gatggaggctctacaagattgacaa

SEQ ID NO: 515287 - DNA, 25 bp, Mus musculus
gatggaggctcttcaagattgacaa

SEQ ID NO: 515288 - DNA, 25 bp, Mus musculus
gatggaggcttgactatccctcata

SEQ ID NO: 515289 - DNA, 25 bp, Mus musculus
gatggaggcttgatctccaagactg

SEQ ID NO: 515290 - DNA, 25 bp, Mus musculus
gatggaggcttgtctatccctcata

SEQ ID NO: 515291 - DNA, 25 bp, Mus musculus
gatggaggcttgttctccaagactg

SEQ ID NO: 515292 - DNA, 25 bp, Mus musculus
gatggagggatacccaaggcttcct

SEQ ID NO: 515293 - DNA, 25 bp, Mus musculus
gatggagggatagccaaggcttcct

SEQ ID NO: 515294 - DNA, 25 bp, Mus musculus
gatggaggtataaccttccactccc

SEQ ID NO: 515295 - DNA, 25 bp, Mus musculus
gatggaggtatatccttccactccc

SEQ ID NO: 515296 - DNA, 25 bp, Mus musculus
gatggaggtcacatgtgtgcccacc

SEQ ID NO: 515297 - DNA, 25 bp, Mus musculus
gatggaggtcacttgtgtgcccacc

SEQ ID NO: 515298 - DNA, 25 bp, Mus musculus
gatggaggtccacaaacgccagcgc

SEQ ID NO: 515299 - DNA, 25 bp, Mus musculus
gatggaggtccagaaacgccagcgc

SEQ ID NO: 515300 - DNA, 25 bp, Mus musculus
gatggaggtggtaacttcagctaaa

SEQ ID NO: 515301 - DNA, 25 bp, Mus musculus
gatggaggtggttacttcagctaaa

SEQ ID NO: 515302 - DNA, 25 bp, Mus musculus
gatggagtaactacagccaactttt

SEQ ID NO: 515303 - DNA, 25 bp, Mus musculus
gatggagtaacttcagccaactttt

SEQ ID NO: 515304 - DNA, 25 bp, Mus musculus
gatggagtcaaacttgtggcttaca

SEQ ID NO: 515305 - DNA, 25 bp, Mus musculus
gatggagtcaaagttgtggcttaca

SEQ ID NO: 515306 - DNA, 25 bp, Mus musculus
gatggagtcactaaaggcgcaaaca

SEQ ID NO: 515307 - DNA, 25 bp, Mus musculus
gatggagtcacttaaggcgcaaaca

SEQ ID NO: 515308 - DNA, 25 bp, Mus musculus
gatggagtccatattcctgagaagg

SEQ ID NO: 515309 - DNA, 25 bp, Mus musculus
gatggagtccattttcctgagaagg

SEQ ID NO: 515310 - DNA, 25 bp, Mus musculus
gatggagtcggcaacacagctctct

SEQ ID NO: 515311 - DNA, 25 bp, Mus musculus
gatggagtcggctacacagctctct

SEQ ID NO: 515312 - DNA, 25 bp, Mus musculus
gatggagtctataagccctactgga

SEQ ID NO: 515313 - DNA, 25 bp, Mus musculus
gatggagtctattagccctactgga

SEQ ID NO: 515314 - DNA, 25 bp, Mus musculus
gatggagtcttaagctcctgcaacc

SEQ ID NO: 515315 - DNA, 25 bp, Mus musculus
gatggagtcttatgctcctgcaacc

SEQ ID NO: 515316 - DNA, 25 bp, Mus musculus
gatggagtctttctcacccatgaga

SEQ ID NO: 515317 - DNA, 25 bp, Mus musculus
gatggagtctttgtcacccatgaga

SEQ ID NO: 515318 - DNA, 25 bp, Mus musculus
gatggagtgactaactccagcgcct

SEQ ID NO: 515319 - DNA, 25 bp, Mus musculus
gatggagtgacttactccagcgcct

SEQ ID NO: 515320 - DNA, 25 bp, Mus musculus
gatggagtgccaattccgattccgc

SEQ ID NO: 515321 - DNA, 25 bp, Mus musculus
gatggagtgccatttccgattccgc

SEQ ID NO: 515322 - DNA, 25 bp, Mus musculus
gatggagtgcggagacatgtcttta

SEQ ID NO: 515323 - DNA, 25 bp, Mus musculus
gatggagtgcggtgacatgtcttta

SEQ ID NO: 515324 - DNA, 25 bp, Mus musculus
gatggagtgctcatgagctcctaat

SEQ ID NO: 515325 - DNA, 25 bp, Mus musculus
gatggagtgctcttgagctcctaat

SEQ ID NO: 515326 - DNA, 25 bp, Mus musculus
gatggagttggtattcacctccaca

SEQ ID NO: 515327 - DNA, 25 bp, Mus musculus
gatggagttggttttcacctccaca

SEQ ID NO: 515328 - DNA, 25 bp, Mus musculus
gatggataagcaaccccactgcttt

SEQ ID NO: 515329 - DNA, 25 bp, Mus musculus
gatggataagcatccccactgcttt

SEQ ID NO: 515330 - DNA, 25 bp, Mus musculus
gatggatacatgagacctcgtcatt

SEQ ID NO: 515331 - DNA, 25 bp, Mus musculus
gatggatacatgtgacctcgtcatt

SEQ ID NO: 515332 - DNA, 25 bp, Mus musculus
gatggatacattacctaccttcaaa

SEQ ID NO: 515333 - DNA, 25 bp, Mus musculus
gatggatacatttcctaccttcaaa

SEQ ID NO: 515334 - DNA, 25 bp, Mus musculus
gatggataccacacagtgaacgcta

SEQ ID NO: 515335 - DNA, 25 bp, Mus musculus
gatggataccactcagtgaacgcta

SEQ ID NO: 515336 - DNA, 25 bp, Mus musculus
gatggatacgtgatccacctggctc

SEQ ID NO: 515337 - DNA, 25 bp, Mus musculus
gatggatacgtgttccacctggctc

SEQ ID NO: 515338 - DNA, 25 bp, Mus musculus
gatggatagaagaatacacactatg

SEQ ID NO: 515339 - DNA, 25 bp, Mus musculus
gatggatagaagtatacacactatg

SEQ ID NO: 515340 - DNA, 25 bp, Mus musculus
gatggatagaccagggagcccaatg

SEQ ID NO: 515341 - DNA, 25 bp, Mus musculus
gatggatagacctgggagcccaatg

SEQ ID NO: 515342 - DNA, 25 bp, Mus musculus
gatggatagggtacctgctcccgaa

SEQ ID NO: 515343 - DNA, 25 bp, Mus musculus
gatggatagggttcctgctcccgaa

SEQ ID NO: 515344 - DNA, 25 bp, Mus musculus
gatggatatcgaagccgggttgttt

SEQ ID NO: 515345 - DNA, 25 bp, Mus musculus
gatggatatcgatgccgggttgttt

SEQ ID NO: 515346 - DNA, 25 bp, Mus musculus
gatggatatgttaatgtgctcgtat

SEQ ID NO: 515347 - DNA, 25 bp, Mus musculus
gatggatatgtttatgtgctcgtat

SEQ ID NO: 515348 - DNA, 25 bp, Mus musculus
gatggatcaaacctttaaaactgta

SEQ ID NO: 515349 - DNA, 25 bp, Mus musculus
gatggatcaaacgtttaaaactgta

SEQ ID NO: 515350 - DNA, 25 bp, Mus musculus
gatggatcacaaccgaaaccgcagg

SEQ ID NO: 515351 - DNA, 25 bp, Mus musculus
gatggatcacaagcgaaaccgcagg

SEQ ID NO: 515352 - DNA, 25 bp, Mus musculus
gatggatcagccacagcaaacagcc

SEQ ID NO: 515353 - DNA, 25 bp, Mus musculus
gatggatcagcctcagcaaacagcc

SEQ ID NO: 515354 - DNA, 25 bp, Mus musculus
gatggatcagttacctagtatgctc

SEQ ID NO: 515355 - DNA, 25 bp, Mus musculus
gatggatcagttctcattgcgcgaa

SEQ ID NO: 515356 - DNA, 25 bp, Mus musculus
gatggatcagttgtcattgcgcgaa

SEQ ID NO: 515357 - DNA, 25 bp, Mus musculus
gatggatcagtttcctagtatgctc

SEQ ID NO: 515358 - DNA, 25 bp, Mus musculus
gatggatccacacaagcactgcaga

SEQ ID NO: 515359 - DNA, 25 bp, Mus musculus
gatggatccacagaagcactgcaga

SEQ ID NO: 515360 - DNA, 25 bp, Mus musculus
gatggatccactaacaagccacagt

SEQ ID NO: 515361 - DNA, 25 bp, Mus musculus
gatggatccacttacaagccacagt

SEQ ID NO: 515362 - DNA, 25 bp, Mus musculus
gatggatccagtctaaaggtgcaca

SEQ ID NO: 515363 - DNA, 25 bp, Mus musculus
gatggatccagtgtaaaggtgcaca

SEQ ID NO: 515364 - DNA, 25 bp, Mus musculus
gatggatccttccagcagagaaata

SEQ ID NO: 515365 - DNA, 25 bp, Mus musculus
gatggatccttcgagcagagaaata

SEQ ID NO: 515366 - DNA, 25 bp, Mus musculus
gatggatcgagtcaacagactcaac

SEQ ID NO: 515367 - DNA, 25 bp, Mus musculus
gatggatcgagtgaacagactcaac

SEQ ID NO: 515368 - DNA, 25 bp, Mus musculus
gatggatcgatgacagcctcagcta

SEQ ID NO: 515369 - DNA, 25 bp, Mus musculus
gatggatcgatgtcagcctcagcta

SEQ ID NO: 515370 - DNA, 25 bp, Mus musculus
gatggatcgcttcctacacaagata

SEQ ID NO: 515371 - DNA, 25 bp, Mus musculus
gatggatcgcttgctacacaagata

SEQ ID NO: 515372 - DNA, 25 bp, Mus musculus
gatggatctatcagttggttttgga

SEQ ID NO: 515373 - DNA, 25 bp, Mus musculus
gatggatctatctgttggttttgga

SEQ ID NO: 515374 - DNA, 25 bp, Mus musculus
gatggatctcatacactttttcact

SEQ ID NO: 515375 - DNA, 25 bp, Mus musculus
gatggatctcattcactttttcact

SEQ ID NO: 515376 - DNA, 25 bp, Mus musculus
gatggatctcgtctagttttatgta

SEQ ID NO: 515377 - DNA, 25 bp, Mus musculus
gatggatctcgtgtagttttatgta

SEQ ID NO: 515378 - DNA, 25 bp, Mus musculus
gatggatgaccacactagaccacga

SEQ ID NO: 515379 - DNA, 25 bp, Mus musculus
gatggatgaccagactagaccacga

SEQ ID NO: 515380 - DNA, 25 bp, Mus musculus
gatggatgactcaggaatccagtat

SEQ ID NO: 515381 - DNA, 25 bp, Mus musculus
gatggatgactctggaatccagtat

SEQ ID NO: 515382 - DNA, 25 bp, Mus musculus
gatggatgccccaaggaccagcaga

SEQ ID NO: 515383 - DNA, 25 bp, Mus musculus
gatggatgcccctaggaccagcaga

SEQ ID NO: 515384 - DNA, 25 bp, Mus musculus
gatggatgctagctatttgaaaaac

SEQ ID NO: 515385 - DNA, 25 bp, Mus musculus
gatggatgctaggtatttgaaaaac

SEQ ID NO: 515386 - DNA, 25 bp, Mus musculus
gatggatgctccagttactcatggt

SEQ ID NO: 515387 - DNA, 25 bp, Mus musculus
gatggatgctcctgttactcatggt

SEQ ID NO: 515388 - DNA, 25 bp, Mus musculus
gatggatgctctaacactaacatta

SEQ ID NO: 515389 - DNA, 25 bp, Mus musculus
gatggatgctcttacactaacatta

SEQ ID NO: 515390 - DNA, 25 bp, Mus musculus
gatggatgctgactcatgatcacat

SEQ ID NO: 515391 - DNA, 25 bp, Mus musculus
gatggatgctgagtcatgatcacat

SEQ ID NO: 515392 - DNA, 25 bp, Mus musculus
gatggatggactctaacctgtaaga

SEQ ID NO: 515393 - DNA, 25 bp, Mus musculus
gatggatggactctgctctgaacta

SEQ ID NO: 515394 - DNA, 25 bp, Mus musculus
gatggatggactgtaacctgtaaga

SEQ ID NO: 515395 - DNA, 25 bp, Mus musculus
gatggatggactgtgctctgaacta

SEQ ID NO: 515396 - DNA, 25 bp, Mus musculus
gatggatggatcatgacttttcata

SEQ ID NO: 515397 - DNA, 25 bp, Mus musculus
gatggatggatcttgacttttcata

SEQ ID NO: 515398 - DNA, 25 bp, Mus musculus
gatggatggccacagtcggttccta

SEQ ID NO: 515399 - DNA, 25 bp, Mus musculus
gatggatggccagagtcggttccta

SEQ ID NO: 515400 - DNA, 25 bp, Mus musculus
gatggatggctcactaaagctagtg

SEQ ID NO: 515401 - DNA, 25 bp, Mus musculus
gatggatggctctctaaagctagtg

SEQ ID NO: 515402 - DNA, 25 bp, Mus musculus
gatggatgggttacctacagttact

SEQ ID NO: 515403 - DNA, 25 bp, Mus musculus
gatggatgggtttcctacagttact

SEQ ID NO: 515404 - DNA, 25 bp, Mus musculus
gatggatggtggacttatgctaaat

SEQ ID NO: 515405 - DNA, 25 bp, Mus musculus
gatggatggtggtcttatgctaaat

SEQ ID NO: 515406 - DNA, 25 bp, Mus musculus
gatggatgtattaactgcaccgagg

SEQ ID NO: 515407 - DNA, 25 bp, Mus musculus
gatggatgtatttactgcaccgagg

SEQ ID NO: 515408 - DNA, 25 bp, Mus musculus
gatggatgtcatattgtgccaccat

SEQ ID NO: 515409 - DNA, 25 bp, Mus musculus
gatggatgtcattttgtgccaccat

SEQ ID NO: 515410 - DNA, 25 bp, Mus musculus
gatggatgtgaaaatcccacaccgt

SEQ ID NO: 515411 - DNA, 25 bp, Mus musculus
gatggatgtgaatatcccacaccgt

SEQ ID NO: 515412 - DNA, 25 bp, Mus musculus
gatggatgtggactatcccagcgat

SEQ ID NO: 515413 - DNA, 25 bp, Mus musculus
gatggatgtggagtatcccagcgat

SEQ ID NO: 515414 - DNA, 25 bp, Mus musculus
gatggattactactagccaagctac

SEQ ID NO: 515415 - DNA, 25 bp, Mus musculus
gatggattactagtagccaagctac

SEQ ID NO: 515416 - DNA, 25 bp, Mus musculus
gatggattagggacttcaggatgaa

SEQ ID NO: 515417 - DNA, 25 bp, Mus musculus
gatggattagggtcttcaggatgaa

SEQ ID NO: 515418 - DNA, 25 bp, Mus musculus
gatggattcaccaacttcagtgttt

SEQ ID NO: 515419 - DNA, 25 bp, Mus musculus
gatggattcacctacttcagtgttt

SEQ ID NO: 515420 - DNA, 25 bp, Mus musculus
gatggattcctgaggaatggccact

SEQ ID NO: 515421 - DNA, 25 bp, Mus musculus
gatggattcctgtggaatggccact

SEQ ID NO: 515422 - DNA, 25 bp, Mus musculus
gatggattctatcattacggtcgga

SEQ ID NO: 515423 - DNA, 25 bp, Mus musculus
gatggattctatgattacggtcgga

SEQ ID NO: 515424 - DNA, 25 bp, Mus musculus
gatggattctccacatactgatctg

SEQ ID NO: 515425 - DNA, 25 bp, Mus musculus
gatggattctcctcatactgatctg

SEQ ID NO: 515426 - DNA, 25 bp, Mus musculus
gatggattctgaccaagttctgact

SEQ ID NO: 515427 - DNA, 25 bp, Mus musculus
gatggattctgagcaagttctgact

SEQ ID NO: 515428 - DNA, 25 bp, Mus musculus
gatggattgccaaactcttaggttt

SEQ ID NO: 515429 - DNA, 25 bp, Mus musculus
gatggattgccatactcttaggttt

SEQ ID NO: 515430 - DNA, 25 bp, Mus musculus
gatggattgcttctagtcccaaagc

SEQ ID NO: 515431 - DNA, 25 bp, Mus musculus
gatggattgcttgtagtcccaaagc

SEQ ID NO: 515432 - DNA, 25 bp, Mus musculus
gatggattgtagcattcccataatc

SEQ ID NO: 515433 - DNA, 25 bp, Mus musculus
gatggattgtaggattcccataatc

SEQ ID NO: 515434 - DNA, 25 bp, Mus musculus
gatggattgttacacctggctgcat

SEQ ID NO: 515435 - DNA, 25 bp, Mus musculus
gatggattgttagacctggctgcat

SEQ ID NO: 515436 - DNA, 25 bp, Mus musculus
gatggattgttccaaattggcagga

SEQ ID NO: 515437 - DNA, 25 bp, Mus musculus
gatggattgttcgaaattggcagga

SEQ ID NO: 515438 - DNA, 25 bp, Mus musculus
gatggatttattacaccaatggatg

SEQ ID NO: 515439 - DNA, 25 bp, Mus musculus
gatggatttatttcaccaatggatg

SEQ ID NO: 515440 - DNA, 25 bp, Mus musculus
gatggatttcctctgaacctggtag

SEQ ID NO: 515441 - DNA, 25 bp, Mus musculus
gatggatttcctgtgaacctggtag

SEQ ID NO: 515442 - DNA, 25 bp, Mus musculus
gatggatttctccaaggccaaattc

SEQ ID NO: 515443 - DNA, 25 bp, Mus musculus
gatggatttctcgaaggccaaattc

SEQ ID NO: 515444 - DNA, 25 bp, Mus musculus
gatggatttgacacggtgccgctga

SEQ ID NO: 515445 - DNA, 25 bp, Mus musculus
gatggatttgactcggtgccgctga

SEQ ID NO: 515446 - DNA, 25 bp, Mus musculus
gatggatttggacgaatatcaccag

SEQ ID NO: 515447 - DNA, 25 bp, Mus musculus
gatggatttggaggaatatcaccag

SEQ ID NO: 515448 - DNA, 25 bp, Mus musculus
gatggatttgttaccaactgtcaat

SEQ ID NO: 515449 - DNA, 25 bp, Mus musculus
gatggatttgtttccaactgtcaat

SEQ ID NO: 515450 - DNA, 25 bp, Mus musculus
gatggattttccacatgtaaagtat

SEQ ID NO: 515451 - DNA, 25 bp, Mus musculus
gatggattttcctcatgtaaagtat

SEQ ID NO: 515452 - DNA, 25 bp, Mus musculus
gatggattttctcttacctctgttc

SEQ ID NO: 515453 - DNA, 25 bp, Mus musculus
gatggattttctgttacctctgttc

SEQ ID NO: 515454 - DNA, 25 bp, Mus musculus
gatggcaaaagtcagatgatcttca

SEQ ID NO: 515455 - DNA, 25 bp, Mus musculus
gatggcaaaagtgagatgatcttca

SEQ ID NO: 515456 - DNA, 25 bp, Mus musculus
gatggcaaaattctttacaccgatg

SEQ ID NO: 515457 - DNA, 25 bp, Mus musculus
gatggcaaaattgtttacaccgatg

SEQ ID NO: 515458 - DNA, 25 bp, Mus musculus
gatggcaaacggctcgtccttctag

SEQ ID NO: 515459 - DNA, 25 bp, Mus musculus
gatggcaaacgggtcgtccttctag

SEQ ID NO: 515460 - DNA, 25 bp, Mus musculus
gatggcaaacttatttattatgaac

SEQ ID NO: 515461 - DNA, 25 bp, Mus musculus
gatggcaaacttttttattatgaac

SEQ ID NO: 515462 - DNA, 25 bp, Mus musculus
gatggcaaagccacccttggtctga

SEQ ID NO: 515463 - DNA, 25 bp, Mus musculus
gatggcaaagcctcccttggtctga

SEQ ID NO: 515464 - DNA, 25 bp, Mus musculus
gatggcaaaggaccagtgctgcttt

SEQ ID NO: 515465 - DNA, 25 bp, Mus musculus
gatggcaaaggagcagtgctgcttt

SEQ ID NO: 515466 - DNA, 25 bp, Mus musculus
gatggcaaatccacacctctagggt

SEQ ID NO: 515467 - DNA, 25 bp, Mus musculus
gatggcaaatcctcacctctagggt

SEQ ID NO: 515468 - DNA, 25 bp, Mus musculus
gatggcaaatggcaactgtgacaaa

SEQ ID NO: 515469 - DNA, 25 bp, Mus musculus
gatggcaaatgggaactgtgacaaa

SEQ ID NO: 515470 - DNA, 25 bp, Mus musculus
gatggcaaatgtacgaaagtctctt

SEQ ID NO: 515471 - DNA, 25 bp, Mus musculus
gatggcaaatgttcgaaagtctctt

SEQ ID NO: 515472 - DNA, 25 bp, Mus musculus
gatggcaaccagctgattctgtaca

SEQ ID NO: 515473 - DNA, 25 bp, Mus musculus
gatggcaaccaggtgattctgtaca

SEQ ID NO: 515474 - DNA, 25 bp, Mus musculus
gatggcaaccttatcttactcaaat

SEQ ID NO: 515475 - DNA, 25 bp, Mus musculus
gatggcaaccttttcttactcaaat

SEQ ID NO: 515476 - DNA, 25 bp, Mus musculus
gatggcaacgctaactggagagtta

SEQ ID NO: 515477 - DNA, 25 bp, Mus musculus
gatggcaacgcttactggagagtta

SEQ ID NO: 515478 - DNA, 25 bp, Mus musculus
gatggcaacgtgcaagcagtgattt

SEQ ID NO: 515479 - DNA, 25 bp, Mus musculus
gatggcaacgtggaagcagtgattt

SEQ ID NO: 515480 - DNA, 25 bp, Mus musculus
gatggcaactctactagcagctggg

SEQ ID NO: 515481 - DNA, 25 bp, Mus musculus
gatggcaactcttctagcagctggg

SEQ ID NO: 515482 - DNA, 25 bp, Mus musculus
gatggcaactgaagtcgctggctgc

SEQ ID NO: 515483 - DNA, 25 bp, Mus musculus
gatggcaactgatgtcgctggctgc

SEQ ID NO: 515484 - DNA, 25 bp, Mus musculus
gatggcaactggctacaaatgtatg

SEQ ID NO: 515485 - DNA, 25 bp, Mus musculus
gatggcaactgggtacaaatgtatg

SEQ ID NO: 515486 - DNA, 25 bp, Mus musculus
gatggcaacttcattatgtcagcct

SEQ ID NO: 515487 - DNA, 25 bp, Mus musculus
gatggcaacttctttatgtcagcct

SEQ ID NO: 515488 - DNA, 25 bp, Mus musculus
gatggcaactttaacaacgcaacaa

SEQ ID NO: 515489 - DNA, 25 bp, Mus musculus
gatggcaacttttacaacgcaacaa

SEQ ID NO: 515490 - DNA, 25 bp, Mus musculus
gatggcaagaccaacaaaactcagt

SEQ ID NO: 515491 - DNA, 25 bp, Mus musculus
gatggcaagacctacaaaactcagt

SEQ ID NO: 515492 - DNA, 25 bp, Mus musculus
gatggcaagaggatcctccctagag

SEQ ID NO: 515493 - DNA, 25 bp, Mus musculus
gatggcaagaggttcctccctagag

SEQ ID NO: 515494 - DNA, 25 bp, Mus musculus
gatggcaagcacctagattctctca

SEQ ID NO: 515495 - DNA, 25 bp, Mus musculus
gatggcaagcacgtagattctctca

SEQ ID NO: 515496 - DNA, 25 bp, Mus musculus
gatggcaagcagaagtcaaaatccc

SEQ ID NO: 515497 - DNA, 25 bp, Mus musculus
gatggcaagcagtagtcaaaatccc

SEQ ID NO: 515498 - DNA, 25 bp, Mus musculus
gatggcaagctgaggctcagtaccg

SEQ ID NO: 515499 - DNA, 25 bp, Mus musculus
gatggcaagctgtggctcagtaccg

SEQ ID NO: 515500 - DNA, 25 bp, Mus musculus
gatggcaaggtcatatttcacgtca

SEQ ID NO: 515501 - DNA, 25 bp, Mus musculus
gatggcaaggtcttatttcacgtca

SEQ ID NO: 515502 - DNA, 25 bp, Mus musculus
gatggcaataacacagactctgagt

SEQ ID NO: 515503 - DNA, 25 bp, Mus musculus
gatggcaataactcagactctgagt

SEQ ID NO: 515504 - DNA, 25 bp, Mus musculus
gatggcaataataacaacacacctt

SEQ ID NO: 515505 - DNA, 25 bp, Mus musculus
gatggcaataattacaacacacctt

SEQ ID NO: 515506 - DNA, 25 bp, Mus musculus
gatggcaatacaaaggtgtgagaaa

SEQ ID NO: 515507 - DNA, 25 bp, Mus musculus
gatggcaatacataggtgtgagaaa

SEQ ID NO: 515508 - DNA, 25 bp, Mus musculus
gatggcaatctcatccaaaggaaac

SEQ ID NO: 515509 - DNA, 25 bp, Mus musculus
gatggcaatctcttccaaaggaaac

SEQ ID NO: 515510 - DNA, 25 bp, Mus musculus
gatggcaatcttatccatcctgtgg

SEQ ID NO: 515511 - DNA, 25 bp, Mus musculus
gatggcaatcttttccatcctgtgg

SEQ ID NO: 515512 - DNA, 25 bp, Mus musculus
gatggcaatggcaatattagtgcag

SEQ ID NO: 515513 - DNA, 25 bp, Mus musculus
gatggcaatggctatattagtgcag

SEQ ID NO: 515514 - DNA, 25 bp, Mus musculus
gatggcacaagtacagcaggctcaa

SEQ ID NO: 515515 - DNA, 25 bp, Mus musculus
gatggcacaagttcagcaggctcaa

SEQ ID NO: 515516 - DNA, 25 bp, Mus musculus
gatggcacagcacatacttgttgtt

SEQ ID NO: 515517 - DNA, 25 bp, Mus musculus
gatggcacagcagatacttgttgtt

SEQ ID NO: 515518 - DNA, 25 bp, Mus musculus
gatggcacaggcctagctaaccctc

SEQ ID NO: 515519 - DNA, 25 bp, Mus musculus
gatggcacaggcgtagctaaccctc

SEQ ID NO: 515520 - DNA, 25 bp, Mus musculus
gatggcacagttccctcaaaagatt

SEQ ID NO: 515521 - DNA, 25 bp, Mus musculus
gatggcacagttgcctcaaaagatt

SEQ ID NO: 515522 - DNA, 25 bp, Mus musculus
gatggcacatatcctggtagctata

SEQ ID NO: 515523 - DNA, 25 bp, Mus musculus
gatggcacatatgctggtagctata

SEQ ID NO: 515524 - DNA, 25 bp, Mus musculus
gatggcaccaggcttggatattcat

SEQ ID NO: 515525 - DNA, 25 bp, Mus musculus
gatggcaccagggttggatattcat

SEQ ID NO: 515526 - DNA, 25 bp, Mus musculus
gatggcaccagtagtgagcagatca

SEQ ID NO: 515527 - DNA, 25 bp, Mus musculus
gatggcaccagttgtgagcagatca

SEQ ID NO: 515528 - DNA, 25 bp, Mus musculus
gatggcaccataagtcaccatgaca

SEQ ID NO: 515529 - DNA, 25 bp, Mus musculus
gatggcaccatatgtcaccatgaca

SEQ ID NO: 515530 - DNA, 25 bp, Mus musculus
gatggcaccatgagtgaccaaggca

SEQ ID NO: 515531 - DNA, 25 bp, Mus musculus
gatggcaccatgtgtgaccaaggca

SEQ ID NO: 515532 - DNA, 25 bp, Mus musculus
gatggcaccattaaagctctgggta

SEQ ID NO: 515533 - DNA, 25 bp, Mus musculus
gatggcaccatttaagctctgggta

SEQ ID NO: 515534 - DNA, 25 bp, Mus musculus
gatggcaccctcataccgcttagaa

SEQ ID NO: 515535 - DNA, 25 bp, Mus musculus
gatggcaccctcatgctctgtaggc

SEQ ID NO: 515536 - DNA, 25 bp, Mus musculus
gatggcaccctcttaccgcttagaa

SEQ ID NO: 515537 - DNA, 25 bp, Mus musculus
gatggcaccctcttgctctgtaggc

SEQ ID NO: 515538 - DNA, 25 bp, Mus musculus
gatggcaccctgatccagaagtcag

SEQ ID NO: 515539 - DNA, 25 bp, Mus musculus
gatggcaccctgttccagaagtcag

SEQ ID NO: 515540 - DNA, 25 bp, Mus musculus
gatggcacctaaacttgtaatggtt

SEQ ID NO: 515541 - DNA, 25 bp, Mus musculus
gatggcacctaatcttgtaatggtt

SEQ ID NO: 515542 - DNA, 25 bp, Mus musculus
gatggcacggtaccctgcaacatgc

SEQ ID NO: 515543 - DNA, 25 bp, Mus musculus
gatggcacggtagcctgcaacatgc

SEQ ID NO: 515544 - DNA, 25 bp, Mus musculus
gatggcacggttattcatttcaaca

SEQ ID NO: 515545 - DNA, 25 bp, Mus musculus
gatggcacggtttttcatttcaaca

SEQ ID NO: 515546 - DNA, 25 bp, Mus musculus
gatggcactatgactggatacttat

SEQ ID NO: 515547 - DNA, 25 bp, Mus musculus
gatggcactatgtctggatacttat

SEQ ID NO: 515548 - DNA, 25 bp, Mus musculus
gatggcactcatacttcagcttaag

SEQ ID NO: 515549 - DNA, 25 bp, Mus musculus
gatggcactcattcttcagcttaag

SEQ ID NO: 515550 - DNA, 25 bp, Mus musculus
gatggcactcgtcaacagaaacaga

SEQ ID NO: 515551 - DNA, 25 bp, Mus musculus
gatggcactcgtgaacagaaacaga

SEQ ID NO: 515552 - DNA, 25 bp, Mus musculus
gatggcactgagaccaatgtctgga

SEQ ID NO: 515553 - DNA, 25 bp, Mus musculus
gatggcactgagtccaatgtctgga

SEQ ID NO: 515554 - DNA, 25 bp, Mus musculus
gatggcactggactcgccagtattt

SEQ ID NO: 515555 - DNA, 25 bp, Mus musculus
gatggcactggagtcgccagtattt

SEQ ID NO: 515556 - DNA, 25 bp, Mus musculus
gatggcacttagcattttcacagta

SEQ ID NO: 515557 - DNA, 25 bp, Mus musculus
gatggcacttaggattttcacagta

SEQ ID NO: 515558 - DNA, 25 bp, Mus musculus
gatggcacttcacgagcttaacaga

SEQ ID NO: 515559 - DNA, 25 bp, Mus musculus
gatggcacttcaggagcttaacaga

SEQ ID NO: 515560 - DNA, 25 bp, Mus musculus
gatggcagacctcaagacctttctc

SEQ ID NO: 515561 - DNA, 25 bp, Mus musculus
gatggcagacctgaagacctttctc

SEQ ID NO: 515562 - DNA, 25 bp, Mus musculus
gatggcagagatccccatcggttca

SEQ ID NO: 515563 - DNA, 25 bp, Mus musculus
gatggcagagatgcccatcggttca

SEQ ID NO: 515564 - DNA, 25 bp, Mus musculus
gatggcagatacacctcaatggcat

SEQ ID NO: 515565 - DNA, 25 bp, Mus musculus
gatggcagatactcctcaatggcat

SEQ ID NO: 515566 - DNA, 25 bp, Mus musculus
gatggcagatgtcgcatccagcagc

SEQ ID NO: 515567 - DNA, 25 bp, Mus musculus
gatggcagatgtggcatccagcagc

SEQ ID NO: 515568 - DNA, 25 bp, Mus musculus
gatggcagattgcactcgagctcag

SEQ ID NO: 515569 - DNA, 25 bp, Mus musculus
gatggcagattggactcgagctcag

SEQ ID NO: 515570 - DNA, 25 bp, Mus musculus
gatggcagatttaagaacctcagag

SEQ ID NO: 515571 - DNA, 25 bp, Mus musculus
gatggcagattttagaacctcagag

SEQ ID NO: 515572 - DNA, 25 bp, Mus musculus
gatggcagcaagacagcaaaggcga

SEQ ID NO: 515573 - DNA, 25 bp, Mus musculus
gatggcagcaagctcgctaggtccc

SEQ ID NO: 515574 - DNA, 25 bp, Mus musculus
gatggcagcaaggtcgctaggtccc

SEQ ID NO: 515575 - DNA, 25 bp, Mus musculus
gatggcagcaagtcagcaaaggcga

SEQ ID NO: 515576 - DNA, 25 bp, Mus musculus
gatggcagcatccacaatgattctc

SEQ ID NO: 515577 - DNA, 25 bp, Mus musculus
gatggcagcatcgacaatgattctc

SEQ ID NO: 515578 - DNA, 25 bp, Mus musculus
gatggcagcggtactatcgactttg

SEQ ID NO: 515579 - DNA, 25 bp, Mus musculus
gatggcagcggttctatcgactttg

SEQ ID NO: 515580 - DNA, 25 bp, Mus musculus
gatggcagctaacgccccgctatgt

SEQ ID NO: 515581 - DNA, 25 bp, Mus musculus
gatggcagctaaggccccgctatgt

SEQ ID NO: 515582 - DNA, 25 bp, Mus musculus
gatggcagctcaaactatctataat

SEQ ID NO: 515583 - DNA, 25 bp, Mus musculus
gatggcagctcatactatctataat

SEQ ID NO: 515584 - DNA, 25 bp, Mus musculus
gatggcagctcgacccagtacacag

SEQ ID NO: 515585 - DNA, 25 bp, Mus musculus
gatggcagctcgtcccagtacacag

SEQ ID NO: 515586 - DNA, 25 bp, Mus musculus
gatggcagctttccttggacctgga

SEQ ID NO: 515587 - DNA, 25 bp, Mus musculus
gatggcagctttgcttggacctgga

SEQ ID NO: 515588 - DNA, 25 bp, Mus musculus
gatggcaggaatccagcgatactcc

SEQ ID NO: 515589 - DNA, 25 bp, Mus musculus
gatggcaggaatgcagcgatactcc

SEQ ID NO: 515590 - DNA, 25 bp, Mus musculus
gatggcaggcaaccagttttgagtt

SEQ ID NO: 515591 - DNA, 25 bp, Mus musculus
gatggcaggcaagcagttttgagtt

SEQ ID NO: 515592 - DNA, 25 bp, Mus musculus
gatggcagggataatcggaactatc

SEQ ID NO: 515593 - DNA, 25 bp, Mus musculus
gatggcagggattatcggaactatc

SEQ ID NO: 515594 - DNA, 25 bp, Mus musculus
gatggcaggttgctctatttccact

SEQ ID NO: 515595 - DNA, 25 bp, Mus musculus
gatggcaggttggtctatttccact

SEQ ID NO: 515596 - DNA, 25 bp, Mus musculus
gatggcagtcaccttcattggaaac

SEQ ID NO: 515597 - DNA, 25 bp, Mus musculus
gatggcagtcacgttcattggaaac

SEQ ID NO: 515598 - DNA, 25 bp, Mus musculus
gatggcagtcttcaactgtgtgttg

SEQ ID NO: 515599 - DNA, 25 bp, Mus musculus
gatggcagtcttgaactgtgtgttg

SEQ ID NO: 515600 - DNA, 25 bp, Mus musculus
gatggcagtgcaattggtcaggtca

SEQ ID NO: 515601 - DNA, 25 bp, Mus musculus
gatggcagtgcatttggtcaggtca

SEQ ID NO: 515602 - DNA, 25 bp, Mus musculus
gatggcagtgcgattaggagaccct

SEQ ID NO: 515603 - DNA, 25 bp, Mus musculus
gatggcagtgcgtttaggagaccct

SEQ ID NO: 515604 - DNA, 25 bp, Mus musculus
gatggcagtgtcaaaatgaaacctc

SEQ ID NO: 515605 - DNA, 25 bp, Mus musculus
gatggcagtgtctaaatgaaacctc

SEQ ID NO: 515606 - DNA, 25 bp, Mus musculus
gatggcagttctattgatcctcaga

SEQ ID NO: 515607 - DNA, 25 bp, Mus musculus
gatggcagttcttttgatcctcaga

SEQ ID NO: 515608 - DNA, 25 bp, Mus musculus
gatggcagttttccgctacacattt

SEQ ID NO: 515609 - DNA, 25 bp, Mus musculus
gatggcagttttgcgctacacattt

SEQ ID NO: 515610 - DNA, 25 bp, Mus musculus
gatggcatatatcaccgggttgata

SEQ ID NO: 515611 - DNA, 25 bp, Mus musculus
gatggcatatatgaccgggttgata

SEQ ID NO: 515612 - DNA, 25 bp, Mus musculus
gatggcatcagacgaaacgtcacct

SEQ ID NO: 515613 - DNA, 25 bp, Mus musculus
gatggcatcagaggaaacgtcacct

SEQ ID NO: 515614 - DNA, 25 bp, Mus musculus
gatggcatcgagaactggattgtcc

SEQ ID NO: 515615 - DNA, 25 bp, Mus musculus
gatggcatcgagtactggattgtcc

SEQ ID NO: 515616 - DNA, 25 bp, Mus musculus
gatggcatcgtgatcctcttgaagc

SEQ ID NO: 515617 - DNA, 25 bp, Mus musculus
gatggcatcgtgttcctcttgaagc

SEQ ID NO: 515618 - DNA, 25 bp, Mus musculus
gatggcatctacaataatctggact

SEQ ID NO: 515619 - DNA, 25 bp, Mus musculus
gatggcatctactataatctggact

SEQ ID NO: 515620 - DNA, 25 bp, Mus musculus
gatggcatctagagctcagctagct

SEQ ID NO: 515621 - DNA, 25 bp, Mus musculus
gatggcatctagtgctcagctagct

SEQ ID NO: 515622 - DNA, 25 bp, Mus musculus
gatggcatctcactagggagctacc

SEQ ID NO: 515623 - DNA, 25 bp, Mus musculus
gatggcatctcagtagggagctacc

SEQ ID NO: 515624 - DNA, 25 bp, Mus musculus
gatggcatgaacagggtctgcaaga

SEQ ID NO: 515625 - DNA, 25 bp, Mus musculus
gatggcatgaactgggtctgcaaga

SEQ ID NO: 515626 - DNA, 25 bp, Mus musculus
gatggcatgccaattacatatataa

SEQ ID NO: 515627 - DNA, 25 bp, Mus musculus
gatggcatgccatttacatatataa

SEQ ID NO: 515628 - DNA, 25 bp, Mus musculus
gatggcatgctcctttgctgggtac

SEQ ID NO: 515629 - DNA, 25 bp, Mus musculus
gatggcatgctcgtttgctgggtac

SEQ ID NO: 515630 - DNA, 25 bp, Mus musculus
gatggcatggctctgtcccgctctt

SEQ ID NO: 515631 - DNA, 25 bp, Mus musculus
gatggcatggctgtgtcccgctctt

SEQ ID NO: 515632 - DNA, 25 bp, Mus musculus
gatggcatgttcattattttccgag

SEQ ID NO: 515633 - DNA, 25 bp, Mus musculus
gatggcatgttctttattttccgag

SEQ ID NO: 515634 - DNA, 25 bp, Mus musculus
gatggcattcaaaattcagtgctca

SEQ ID NO: 515635 - DNA, 25 bp, Mus musculus
gatggcattcaatattcagtgctca

SEQ ID NO: 515636 - DNA, 25 bp, Mus musculus
gatggcattcagaattttccgaact

SEQ ID NO: 515637 - DNA, 25 bp, Mus musculus
gatggcattcagtattttccgaact

SEQ ID NO: 515638 - DNA, 25 bp, Mus musculus
gatggcattcttaagattttaacta

SEQ ID NO: 515639 - DNA, 25 bp, Mus musculus
gatggcattctttagattttaacta

SEQ ID NO: 515640 - DNA, 25 bp, Mus musculus
gatggcattggtcacatgtttcccc

SEQ ID NO: 515641 - DNA, 25 bp, Mus musculus
gatggcattggtgacatgtttcccc

SEQ ID NO: 515642 - DNA, 25 bp, Mus musculus
gatggccaaattcaggatcccggat

SEQ ID NO: 515643 - DNA, 25 bp, Mus musculus
gatggccaaattgaggatcccggat

SEQ ID NO: 515644 - DNA, 25 bp, Mus musculus
gatggccaactcaagacttgtgctg

SEQ ID NO: 515645 - DNA, 25 bp, Mus musculus
gatggccaactctagacttgtgctg

SEQ ID NO: 515646 - DNA, 25 bp, Mus musculus
gatggccaagatattaatagcttcg

SEQ ID NO: 515647 - DNA, 25 bp, Mus musculus
gatggccaagattttaatagcttcg

SEQ ID NO: 515648 - DNA, 25 bp, Mus musculus
gatggccaagcaacattgggtgtcc

SEQ ID NO: 515649 - DNA, 25 bp, Mus musculus
gatggccaagcatcattgggtgtcc

SEQ ID NO: 515650 - DNA, 25 bp, Mus musculus
gatggccaagccagaaactgctctt

SEQ ID NO: 515651 - DNA, 25 bp, Mus musculus
gatggccaagcctgaaactgctctt

SEQ ID NO: 515652 - DNA, 25 bp, Mus musculus
gatggccaagtactggctgagctct

SEQ ID NO: 515653 - DNA, 25 bp, Mus musculus
gatggccaagtagtggctgagctct

SEQ ID NO: 515654 - DNA, 25 bp, Mus musculus
gatggccaagttatgactcgttttc

SEQ ID NO: 515655 - DNA, 25 bp, Mus musculus
gatggccaagttttgactcgttttc

SEQ ID NO: 515656 - DNA, 25 bp, Mus musculus
gatggccaatggagtggcagccctc

SEQ ID NO: 515657 - DNA, 25 bp, Mus musculus
gatggccaatggtgtggcagccctc

SEQ ID NO: 515658 - DNA, 25 bp, Mus musculus
gatggccacaaaatccagctcttta

SEQ ID NO: 515659 - DNA, 25 bp, Mus musculus
gatggccacaaattccagctcttta

SEQ ID NO: 515660 - DNA, 25 bp, Mus musculus
gatggccacacgcaacaagatttgt

SEQ ID NO: 515661 - DNA, 25 bp, Mus musculus
gatggccacacggaacaagatttgt

SEQ ID NO: 515662 - DNA, 25 bp, Mus musculus
gatggccacatccttaggagacaac

SEQ ID NO: 515663 - DNA, 25 bp, Mus musculus
gatggccacatcgttaggagacaac

SEQ ID NO: 515664 - DNA, 25 bp, Mus musculus
gatggccaccttagtcaatgtgtac

SEQ ID NO: 515665 - DNA, 25 bp, Mus musculus
gatggccacctttgtcaatgtgtac

SEQ ID NO: 515666 - DNA, 25 bp, Mus musculus
gatggccacgagacaagggtcctgt

SEQ ID NO: 515667 - DNA, 25 bp, Mus musculus
gatggccacgagtcaagggtcctgt

SEQ ID NO: 515668 - DNA, 25 bp, Mus musculus
gatggccacgtcctttgtcggaagt

SEQ ID NO: 515669 - DNA, 25 bp, Mus musculus
gatggccacgtcgtttgtcggaagt

SEQ ID NO: 515670 - DNA, 25 bp, Mus musculus
gatggccactccagtagacgagagc

SEQ ID NO: 515671 - DNA, 25 bp, Mus musculus
gatggccactcctgtagacgagagc

SEQ ID NO: 515672 - DNA, 25 bp, Mus musculus
gatggccagactatgagcagagatt

SEQ ID NO: 515673 - DNA, 25 bp, Mus musculus
gatggccagactcacacttagcttt

SEQ ID NO: 515674 - DNA, 25 bp, Mus musculus
gatggccagactgacacttagcttt

SEQ ID NO: 515675 - DNA, 25 bp, Mus musculus
gatggccagactttgagcagagatt

SEQ ID NO: 515676 - DNA, 25 bp, Mus musculus
gatggccagtatacattggcaatac

SEQ ID NO: 515677 - DNA, 25 bp, Mus musculus
gatggccagtattcattggcaatac

SEQ ID NO: 515678 - DNA, 25 bp, Mus musculus
gatggccatcacaggactcaaattt

SEQ ID NO: 515679 - DNA, 25 bp, Mus musculus
gatggccatcactggactcaaattt

SEQ ID NO: 515680 - DNA, 25 bp, Mus musculus
gatggccatcatatccaggtccagg

SEQ ID NO: 515681 - DNA, 25 bp, Mus musculus
gatggccatcatttccaggtccagg

SEQ ID NO: 515682 - DNA, 25 bp, Mus musculus
gatggccatcttctctattacttct

SEQ ID NO: 515683 - DNA, 25 bp, Mus musculus
gatggccatcttgtctattacttct

SEQ ID NO: 515684 - DNA, 25 bp, Mus musculus
gatggccatggacaaagtgtgtctt

SEQ ID NO: 515685 - DNA, 25 bp, Mus musculus
gatggccatggagaaagtgtgtctt

SEQ ID NO: 515686 - DNA, 25 bp, Mus musculus
gatggccatgttcagtcttttacgt

SEQ ID NO: 515687 - DNA, 25 bp, Mus musculus
gatggccatgttgagtcttttacgt

SEQ ID NO: 515688 - DNA, 25 bp, Mus musculus
gatggccattgaatgtgctcatgca

SEQ ID NO: 515689 - DNA, 25 bp, Mus musculus
gatggccattgattgtgctcatgca

SEQ ID NO: 515690 - DNA, 25 bp, Mus musculus
gatggccatttacctaacgcttcat

SEQ ID NO: 515691 - DNA, 25 bp, Mus musculus
gatggccatttagctaacgcttcat

SEQ ID NO: 515692 - DNA, 25 bp, Mus musculus
gatggccattttcccttgcacaggg

SEQ ID NO: 515693 - DNA, 25 bp, Mus musculus
gatggccattttgccttgcacaggg

SEQ ID NO: 515694 - DNA, 25 bp, Mus musculus
gatggcccacagaaaccagtggccc

SEQ ID NO: 515695 - DNA, 25 bp, Mus musculus
gatggcccacagtaaccagtggccc

SEQ ID NO: 515696 - DNA, 25 bp, Mus musculus
gatggcccagaaacatacagatgtt

SEQ ID NO: 515697 - DNA, 25 bp, Mus musculus
gatggcccagaatcatacagatgtt

SEQ ID NO: 515698 - DNA, 25 bp, Mus musculus
gatggcccagagataaaggcagact

SEQ ID NO: 515699 - DNA, 25 bp, Mus musculus
gatggcccagagttaaaggcagact

SEQ ID NO: 515700 - DNA, 25 bp, Mus musculus
gatggcccaggacatttaatagttg

SEQ ID NO: 515701 - DNA, 25 bp, Mus musculus
gatggcccaggagatttaatagttg

SEQ ID NO: 515702 - DNA, 25 bp, Mus musculus
gatggcccagggaaaagtaagtttg

SEQ ID NO: 515703 - DNA, 25 bp, Mus musculus
gatggcccagggtaaagtaagtttg

SEQ ID NO: 515704 - DNA, 25 bp, Mus musculus
gatggcccagttagcatctttcatg

SEQ ID NO: 515705 - DNA, 25 bp, Mus musculus
gatggcccagtttgcatctttcatg

SEQ ID NO: 515706 - DNA, 25 bp, Mus musculus
gatggcccatcacaagcggttcatt

SEQ ID NO: 515707 - DNA, 25 bp, Mus musculus
gatggcccatcagaagcggttcatt

SEQ ID NO: 515708 - DNA, 25 bp, Mus musculus
gatggcccccgcatataatcaaggg

SEQ ID NO: 515709 - DNA, 25 bp, Mus musculus
gatggcccccgcttataatcaaggg

SEQ ID NO: 515710 - DNA, 25 bp, Mus musculus
gatggccccgtcaggaaagtagtta

SEQ ID NO: 515711 - DNA, 25 bp, Mus musculus
gatggccccgtctggaaagtagtta

SEQ ID NO: 515712 - DNA, 25 bp, Mus musculus
gatggcccctatcttgaggtggtca

SEQ ID NO: 515713 - DNA, 25 bp, Mus musculus
gatggcccctatgttgaggtggtca

SEQ ID NO: 515714 - DNA, 25 bp, Mus musculus
gatggcccctgaacgatttttattg

SEQ ID NO: 515715 - DNA, 25 bp, Mus musculus
gatggcccctgatcgatttttattg

SEQ ID NO: 515716 - DNA, 25 bp, Mus musculus
gatggcccgcccaagcaggaagaga

SEQ ID NO: 515717 - DNA, 25 bp, Mus musculus
gatggcccgccctagcaggaagaga

SEQ ID NO: 515718 - DNA, 25 bp, Mus musculus
gatggcccgctgaagtggctcagat

SEQ ID NO: 515719 - DNA, 25 bp, Mus musculus
gatggcccgctgtagtggctcagat

SEQ ID NO: 515720 - DNA, 25 bp, Mus musculus
gatggccctcagaggacagctgcaa

SEQ ID NO: 515721 - DNA, 25 bp, Mus musculus
gatggccctcagtggacagctgcaa

SEQ ID NO: 515722 - DNA, 25 bp, Mus musculus
gatggccctctacctaggctgaaaa

SEQ ID NO: 515723 - DNA, 25 bp, Mus musculus
gatggccctctagctaggctgaaaa

SEQ ID NO: 515724 - DNA, 25 bp, Mus musculus
gatggccctttccacataccatagg

SEQ ID NO: 515725 - DNA, 25 bp, Mus musculus
gatggccctttcgacataccatagg

SEQ ID NO: 515726 - DNA, 25 bp, Mus musculus
gatggccgaaaaatcacgcaaggat

SEQ ID NO: 515727 - DNA, 25 bp, Mus musculus
gatggccgaaaattcacgcaaggat

SEQ ID NO: 515728 - DNA, 25 bp, Mus musculus
gatggccgacgaaaactggcccaaa

SEQ ID NO: 515729 - DNA, 25 bp, Mus musculus
gatggccgacgataactggcccaaa

SEQ ID NO: 515730 - DNA, 25 bp, Mus musculus
gatggccgacttaatggttttgtga

SEQ ID NO: 515731 - DNA, 25 bp, Mus musculus
gatggccgactttatggttttgtga

SEQ ID NO: 515732 - DNA, 25 bp, Mus musculus
gatggccgagaacatatgagcactt

SEQ ID NO: 515733 - DNA, 25 bp, Mus musculus
gatggccgagaagatatgagcactt

SEQ ID NO: 515734 - DNA, 25 bp, Mus musculus
gatggccgatgaagcttgtgacatt

SEQ ID NO: 515735 - DNA, 25 bp, Mus musculus
gatggccgatgatgcttgtgacatt

SEQ ID NO: 515736 - DNA, 25 bp, Mus musculus
gatggccggaaacttgtctgccacc

SEQ ID NO: 515737 - DNA, 25 bp, Mus musculus
gatggccggaaagttgtctgccacc

SEQ ID NO: 515738 - DNA, 25 bp, Mus musculus
gatggccgtaatcctttcagttcag

SEQ ID NO: 515739 - DNA, 25 bp, Mus musculus
gatggccgtaatgctttcagttcag

SEQ ID NO: 515740 - DNA, 25 bp, Mus musculus
gatggccgtaggaagacctcacttt

SEQ ID NO: 515741 - DNA, 25 bp, Mus musculus
gatggccgtaggtagacctcacttt

SEQ ID NO: 515742 - DNA, 25 bp, Mus musculus
gatggccgtcagaggcctgtgccaa

SEQ ID NO: 515743 - DNA, 25 bp, Mus musculus
gatggccgtcagtggcctgtgccaa

SEQ ID NO: 515744 - DNA, 25 bp, Mus musculus
gatggcctaaggaggcagtgcccaa

SEQ ID NO: 515745 - DNA, 25 bp, Mus musculus
gatggcctaaggtggcagtgcccaa

SEQ ID NO: 515746 - DNA, 25 bp, Mus musculus
gatggcctacaacccttaacctaga

SEQ ID NO: 515747 - DNA, 25 bp, Mus musculus
gatggcctacaacctctaaggtgca

SEQ ID NO: 515748 - DNA, 25 bp, Mus musculus
gatggcctacaagccttaacctaga

SEQ ID NO: 515749 - DNA, 25 bp, Mus musculus
gatggcctacaagctctaaggtgca

SEQ ID NO: 515750 - DNA, 25 bp, Mus musculus
gatggcctagagctctgcaagatct

SEQ ID NO: 515751 - DNA, 25 bp, Mus musculus
gatggcctagaggtctgcaagatct

SEQ ID NO: 515752 - DNA, 25 bp, Mus musculus
gatggcctagtaccagtagcagctg

SEQ ID NO: 515753 - DNA, 25 bp, Mus musculus
gatggcctagtagcagtagcagctg

SEQ ID NO: 515754 - DNA, 25 bp, Mus musculus
gatggcctattcaaatctactgaga

SEQ ID NO: 515755 - DNA, 25 bp, Mus musculus
gatggcctattctaatctactgaga

SEQ ID NO: 515756 - DNA, 25 bp, Mus musculus
gatggcctcaagcacgaatatttcc

SEQ ID NO: 515757 - DNA, 25 bp, Mus musculus
gatggcctcaaggacgaatatttcc

SEQ ID NO: 515758 - DNA, 25 bp, Mus musculus
gatggcctcactcattgttgatagc

SEQ ID NO: 515759 - DNA, 25 bp, Mus musculus
gatggcctcactgattgttgatagc

SEQ ID NO: 515760 - DNA, 25 bp, Mus musculus
gatggcctcataccagtcattgtta

SEQ ID NO: 515761 - DNA, 25 bp, Mus musculus
gatggcctcatagcagtcattgtta

SEQ ID NO: 515762 - DNA, 25 bp, Mus musculus
gatggcctccacattgagcactaag

SEQ ID NO: 515763 - DNA, 25 bp, Mus musculus
gatggcctccactttgagcactaag

SEQ ID NO: 515764 - DNA, 25 bp, Mus musculus
gatggcctccggatacagacagtat

SEQ ID NO: 515765 - DNA, 25 bp, Mus musculus
gatggcctccggttacagacagtat

SEQ ID NO: 515766 - DNA, 25 bp, Mus musculus
gatggcctccttataattaatagca

SEQ ID NO: 515767 - DNA, 25 bp, Mus musculus
gatggcctccttttaattaatagca

SEQ ID NO: 515768 - DNA, 25 bp, Mus musculus
gatggcctcgtcaagcggatgctgc

SEQ ID NO: 515769 - DNA, 25 bp, Mus musculus
gatggcctcgtctagcggatgctgc

SEQ ID NO: 515770 - DNA, 25 bp, Mus musculus
gatggcctctatatcactgaacagc

SEQ ID NO: 515771 - DNA, 25 bp, Mus musculus
gatggcctctatttcactgaacagc

SEQ ID NO: 515772 - DNA, 25 bp, Mus musculus
gatggcctctgactgccttggtgaa

SEQ ID NO: 515773 - DNA, 25 bp, Mus musculus
gatggcctctgagtgccttggtgaa

SEQ ID NO: 515774 - DNA, 25 bp, Mus musculus
gatggcctctgtctaatccgtactc

SEQ ID NO: 515775 - DNA, 25 bp, Mus musculus
gatggcctctgtgtaatccgtactc

SEQ ID NO: 515776 - DNA, 25 bp, Mus musculus
gatggcctcttacagcacatgcacc

SEQ ID NO: 515777 - DNA, 25 bp, Mus musculus
gatggcctcttagagcacatgcacc

SEQ ID NO: 515778 - DNA, 25 bp, Mus musculus
gatggcctgaacaaaaactttcgat

SEQ ID NO: 515779 - DNA, 25 bp, Mus musculus
gatggcctgaactaaaactttcgat

SEQ ID NO: 515780 - DNA, 25 bp, Mus musculus
gatggcctgagaaccctgagatagc

SEQ ID NO: 515781 - DNA, 25 bp, Mus musculus
gatggcctgagatccctgagatagc

SEQ ID NO: 515782 - DNA, 25 bp, Mus musculus
gatggcctgcagagtgtgtttccac

SEQ ID NO: 515783 - DNA, 25 bp, Mus musculus
gatggcctgcagtgtgtgtttccac

SEQ ID NO: 515784 - DNA, 25 bp, Mus musculus
gatggcctgccaaagtgcatacata

SEQ ID NO: 515785 - DNA, 25 bp, Mus musculus
gatggcctgccatagtgcatacata

SEQ ID NO: 515786 - DNA, 25 bp, Mus musculus
gatggcctgcttctctgcacatagt

SEQ ID NO: 515787 - DNA, 25 bp, Mus musculus
gatggcctgcttgtctgcacatagt

SEQ ID NO: 515788 - DNA, 25 bp, Mus musculus
gatggcctgggcacgccttacctat

SEQ ID NO: 515789 - DNA, 25 bp, Mus musculus
gatggcctgggctcgccttacctat

SEQ ID NO: 515790 - DNA, 25 bp, Mus musculus
gatggcctggtccgccatgattgga

SEQ ID NO: 515791 - DNA, 25 bp, Mus musculus
gatggcctggtcggccatgattgga

SEQ ID NO: 515792 - DNA, 25 bp, Mus musculus
gatggcctgtacactacacagcaga

SEQ ID NO: 515793 - DNA, 25 bp, Mus musculus
gatggcctgtactctacacagcaga

SEQ ID NO: 515794 - DNA, 25 bp, Mus musculus
gatggcctgtgacaaccagcacatg

SEQ ID NO: 515795 - DNA, 25 bp, Mus musculus
gatggcctgtgagaaccagcacatg

SEQ ID NO: 515796 - DNA, 25 bp, Mus musculus
gatggcctgtgcacaagatgtcacc

SEQ ID NO: 515797 - DNA, 25 bp, Mus musculus
gatggcctgtgcattgtcttttttg

SEQ ID NO: 515798 - DNA, 25 bp, Mus musculus
gatggcctgtgctcaagatgtcacc

SEQ ID NO: 515799 - DNA, 25 bp, Mus musculus
gatggcctgtgctttgtcttttttg

SEQ ID NO: 515800 - DNA, 25 bp, Mus musculus
gatggccttatgcttgatgctcaca

SEQ ID NO: 515801 - DNA, 25 bp, Mus musculus
gatggccttatggttgatgctcaca

SEQ ID NO: 515802 - DNA, 25 bp, Mus musculus
gatggccttcttacaagtagtactg

SEQ ID NO: 515803 - DNA, 25 bp, Mus musculus
gatggccttctttcaagtagtactg

SEQ ID NO: 515804 - DNA, 25 bp, Mus musculus
gatggccttgagactgtctgaaaaa

SEQ ID NO: 515805 - DNA, 25 bp, Mus musculus
gatggccttgagtctgtctgaaaaa

SEQ ID NO: 515806 - DNA, 25 bp, Mus musculus
gatggccttgatagcccctcaaagc

SEQ ID NO: 515807 - DNA, 25 bp, Mus musculus
gatggccttgatcaccttaacgtgc

SEQ ID NO: 515808 - DNA, 25 bp, Mus musculus
gatggccttgatgaccttaacgtgc

SEQ ID NO: 515809 - DNA, 25 bp, Mus musculus
gatggccttgattgcccctcaaagc

SEQ ID NO: 515810 - DNA, 25 bp, Mus musculus
gatggccttgccaagctcaagagga

SEQ ID NO: 515811 - DNA, 25 bp, Mus musculus
gatggccttgcctagctcaagagga

SEQ ID NO: 515812 - DNA, 25 bp, Mus musculus
gatggccttttgctgacgaatttta

SEQ ID NO: 515813 - DNA, 25 bp, Mus musculus
gatggccttttggtgacgaatttta

SEQ ID NO: 515814 - DNA, 25 bp, Mus musculus
gatggcgaaaccacggtgcttttct

SEQ ID NO: 515815 - DNA, 25 bp, Mus musculus
gatggcgaaacctcggtgcttttct

SEQ ID NO: 515816 - DNA, 25 bp, Mus musculus
gatggcgaagacaggcggcaccacc

SEQ ID NO: 515817 - DNA, 25 bp, Mus musculus
gatggcgaagactggcggcaccacc

SEQ ID NO: 515818 - DNA, 25 bp, Mus musculus
gatggcgacaagaagcttcctgaga

SEQ ID NO: 515819 - DNA, 25 bp, Mus musculus
gatggcgacaagtagcttcctgaga

SEQ ID NO: 515820 - DNA, 25 bp, Mus musculus
gatggcgacagacgatcctacgatc

SEQ ID NO: 515821 - DNA, 25 bp, Mus musculus
gatggcgacagaggatcctacgatc

SEQ ID NO: 515822 - DNA, 25 bp, Mus musculus
gatggcgaccacatgatcatccgca

SEQ ID NO: 515823 - DNA, 25 bp, Mus musculus
gatggcgaccacttgatcatccgca

SEQ ID NO: 515824 - DNA, 25 bp, Mus musculus
gatggcgatagccatgccaacccag

SEQ ID NO: 515825 - DNA, 25 bp, Mus musculus
gatggcgatagcgatgccaacccag

SEQ ID NO: 515826 - DNA, 25 bp, Mus musculus
gatggcgatcctatccgtgcttagc

SEQ ID NO: 515827 - DNA, 25 bp, Mus musculus
gatggcgatcctttccgtgcttagc

SEQ ID NO: 515828 - DNA, 25 bp, Mus musculus
gatggcgatcttattactaatttcc

SEQ ID NO: 515829 - DNA, 25 bp, Mus musculus
gatggcgatctttttactaatttcc

SEQ ID NO: 515830 - DNA, 25 bp, Mus musculus
gatggcgccattcctggcatcgtga

SEQ ID NO: 515831 - DNA, 25 bp, Mus musculus
gatggcgccattgctggcatcgtga

SEQ ID NO: 515832 - DNA, 25 bp, Mus musculus
gatggcgcctcgattaaggaagctt

SEQ ID NO: 515833 - DNA, 25 bp, Mus musculus
gatggcgcctcgtttaaggaagctt

SEQ ID NO: 515834 - DNA, 25 bp, Mus musculus
gatggcgcgacccagttcggtttat

SEQ ID NO: 515835 - DNA, 25 bp, Mus musculus
gatggcgcgaccgagttcggtttat

SEQ ID NO: 515836 - DNA, 25 bp, Mus musculus
gatggcgctgtccaatcacctgaat

SEQ ID NO: 515837 - DNA, 25 bp, Mus musculus
gatggcgctgtcgaatcacctgaat

SEQ ID NO: 515838 - DNA, 25 bp, Mus musculus
gatggcgcttccctatttatatttg

SEQ ID NO: 515839 - DNA, 25 bp, Mus musculus
gatggcgcttccgtatttatatttg

SEQ ID NO: 515840 - DNA, 25 bp, Mus musculus
gatggcgcttgaccaccgcatcggc

SEQ ID NO: 515841 - DNA, 25 bp, Mus musculus
gatggcgcttgagcaccgcatcggc

SEQ ID NO: 515842 - DNA, 25 bp, Mus musculus
gatggcggagccatcaagaccccat

SEQ ID NO: 515843 - DNA, 25 bp, Mus musculus
gatggcggagccttcaagaccccat

SEQ ID NO: 515844 - DNA, 25 bp, Mus musculus
gatggcgggcggcatcgtgggatag

SEQ ID NO: 515845 - DNA, 25 bp, Mus musculus
gatggcgggcgggatcgtgggatag

SEQ ID NO: 515846 - DNA, 25 bp, Mus musculus
gatggcggtggactcgcgcgttacc

SEQ ID NO: 515847 - DNA, 25 bp, Mus musculus
gatggcggtggagtcgcgcgttacc

SEQ ID NO: 515848 - DNA, 25 bp, Mus musculus
gatggcgtagtgacattttcagacc

SEQ ID NO: 515849 - DNA, 25 bp, Mus musculus
gatggcgtagtgtcattttcagacc

SEQ ID NO: 515850 - DNA, 25 bp, Mus musculus
gatggcgtgatgatgtagtcttgta

SEQ ID NO: 515851 - DNA, 25 bp, Mus musculus
gatggcgtgatgttgtagtcttgta

SEQ ID NO: 515852 - DNA, 25 bp, Mus musculus
gatggcgtgcagcagccagcataca

SEQ ID NO: 515853 - DNA, 25 bp, Mus musculus
gatggcgtgcaggagccagcataca

SEQ ID NO: 515854 - DNA, 25 bp, Mus musculus
gatggcgtgggaagtactgacaaca

SEQ ID NO: 515855 - DNA, 25 bp, Mus musculus
gatggcgtgggatgtactgacaaca

SEQ ID NO: 515856 - DNA, 25 bp, Mus musculus
gatggcgtgtacaccagtaggctag

SEQ ID NO: 515857 - DNA, 25 bp, Mus musculus
gatggcgtgtactccagtaggctag

SEQ ID NO: 515858 - DNA, 25 bp, Mus musculus
gatggcgtgtgcacttcacctgaag

SEQ ID NO: 515859 - DNA, 25 bp, Mus musculus
gatggcgtgtgctcttcacctgaag

SEQ ID NO: 515860 - DNA, 25 bp, Mus musculus
gatggcgttatcaaaccctagcctt

SEQ ID NO: 515861 - DNA, 25 bp, Mus musculus
gatggcgttatctaaccctagcctt

SEQ ID NO: 515862 - DNA, 25 bp, Mus musculus
gatggcgttctgagtatacctgaat

SEQ ID NO: 515863 - DNA, 25 bp, Mus musculus
gatggcgttctgtgtatacctgaat

SEQ ID NO: 515864 - DNA, 25 bp, Mus musculus
gatggcgttgtcattttagtaggac

SEQ ID NO: 515865 - DNA, 25 bp, Mus musculus
gatggcgttgtctttttagtaggac

SEQ ID NO: 515866 - DNA, 25 bp, Mus musculus
gatggcgtttaaaggctgctgtcca

SEQ ID NO: 515867 - DNA, 25 bp, Mus musculus
gatggcgtttaatggctgctgtcca

SEQ ID NO: 515868 - DNA, 25 bp, Mus musculus
gatggctaatctagctgagccctgg

SEQ ID NO: 515869 - DNA, 25 bp, Mus musculus
gatggctaatcttgctgagccctgg

SEQ ID NO: 515870 - DNA, 25 bp, Mus musculus
gatggctacaatccttaacctagag

SEQ ID NO: 515871 - DNA, 25 bp, Mus musculus
gatggctacaatgcttaacctagag

SEQ ID NO: 515872 - DNA, 25 bp, Mus musculus
gatggctacaggcacgaccagataa

SEQ ID NO: 515873 - DNA, 25 bp, Mus musculus
gatggctacagggacgaccagataa

SEQ ID NO: 515874 - DNA, 25 bp, Mus musculus
gatggctacattatgatacattttc

SEQ ID NO: 515875 - DNA, 25 bp, Mus musculus
gatggctacattttgatacattttc

SEQ ID NO: 515876 - DNA, 25 bp, Mus musculus
gatggctaccagattcaggctcaag

SEQ ID NO: 515877 - DNA, 25 bp, Mus musculus
gatggctaccagtttcaggctcaag

SEQ ID NO: 515878 - DNA, 25 bp, Mus musculus
gatggctaccatatacttccttttc

SEQ ID NO: 515879 - DNA, 25 bp, Mus musculus
gatggctaccatttacttccttttc

SEQ ID NO: 515880 - DNA, 25 bp, Mus musculus
gatggctaccctactgtttccagga

SEQ ID NO: 515881 - DNA, 25 bp, Mus musculus
gatggctacccttctgtttccagga

SEQ ID NO: 515882 - DNA, 25 bp, Mus musculus
gatggctactaactggatccaggaa

SEQ ID NO: 515883 - DNA, 25 bp, Mus musculus
gatggctactaagtggatccaggaa

SEQ ID NO: 515884 - DNA, 25 bp, Mus musculus
gatggctactatcagatcggcaact

SEQ ID NO: 515885 - DNA, 25 bp, Mus musculus
gatggctactatgagatcggcaact

SEQ ID NO: 515886 - DNA, 25 bp, Mus musculus
gatggctactgaatctgaactccag

SEQ ID NO: 515887 - DNA, 25 bp, Mus musculus
gatggctactgattctgaactccag

SEQ ID NO: 515888 - DNA, 25 bp, Mus musculus
gatggctagccaatcctatagagac

SEQ ID NO: 515889 - DNA, 25 bp, Mus musculus
gatggctagccattcctatagagac

SEQ ID NO: 515890 - DNA, 25 bp, Mus musculus
gatggctataaaattcctctgaagg

SEQ ID NO: 515891 - DNA, 25 bp, Mus musculus
gatggctataaatttcctctgaagg

SEQ ID NO: 515892 - DNA, 25 bp, Mus musculus
gatggctatggcaacctggcgccac

SEQ ID NO: 515893 - DNA, 25 bp, Mus musculus
gatggctatggctacctggcgccac

SEQ ID NO: 515894 - DNA, 25 bp, Mus musculus
gatggctattagcactgtacagtta

SEQ ID NO: 515895 - DNA, 25 bp, Mus musculus
gatggctattaggactgtacagtta

SEQ ID NO: 515896 - DNA, 25 bp, Mus musculus
gatggctcaagtcagtaataccact

SEQ ID NO: 515897 - DNA, 25 bp, Mus musculus
gatggctcaagtgagtaataccact

SEQ ID NO: 515898 - DNA, 25 bp, Mus musculus
gatggctcacagcacttcaacgaaa

SEQ ID NO: 515899 - DNA, 25 bp, Mus musculus
gatggctcacagctacccgtaatga

SEQ ID NO: 515900 - DNA, 25 bp, Mus musculus
gatggctcacaggacttcaacgaaa

SEQ ID NO: 515901 - DNA, 25 bp, Mus musculus
gatggctcacaggtacccgtaatga

SEQ ID NO: 515902 - DNA, 25 bp, Mus musculus
gatggctcacatctgctgttcagtt

SEQ ID NO: 515903 - DNA, 25 bp, Mus musculus
gatggctcacatgtgctgttcagtt

SEQ ID NO: 515904 - DNA, 25 bp, Mus musculus
gatggctcacttcagaaagtcactt

SEQ ID NO: 515905 - DNA, 25 bp, Mus musculus
gatggctcacttgagaaagtcactt

SEQ ID NO: 515906 - DNA, 25 bp, Mus musculus
gatggctcagatcagcaccaatatt

SEQ ID NO: 515907 - DNA, 25 bp, Mus musculus
gatggctcagatgagcaccaatatt

SEQ ID NO: 515908 - DNA, 25 bp, Mus musculus
gatggctcagcacgactcagcagca

SEQ ID NO: 515909 - DNA, 25 bp, Mus musculus
gatggctcagcaggactcagcagca

SEQ ID NO: 515910 - DNA, 25 bp, Mus musculus
gatggctcagtgcaggcagacacat

SEQ ID NO: 515911 - DNA, 25 bp, Mus musculus
gatggctcagtggaggcagacacat

SEQ ID NO: 515912 - DNA, 25 bp, Mus musculus
gatggctcattcagtctatgtctag

SEQ ID NO: 515913 - DNA, 25 bp, Mus musculus
gatggctcattctgtctatgtctag

SEQ ID NO: 515914 - DNA, 25 bp, Mus musculus
gatggctccaaaatcctgataagta

SEQ ID NO: 515915 - DNA, 25 bp, Mus musculus
gatggctccaaattcctgataagta

SEQ ID NO: 515916 - DNA, 25 bp, Mus musculus
gatggctccagaacttccatggatg

SEQ ID NO: 515917 - DNA, 25 bp, Mus musculus
gatggctccagatcttccatggatg

SEQ ID NO: 515918 - DNA, 25 bp, Mus musculus
gatggctccatcaacagggacttgg

SEQ ID NO: 515919 - DNA, 25 bp, Mus musculus
gatggctccatctacagggacttgg

SEQ ID NO: 515920 - DNA, 25 bp, Mus musculus
gatggctcccttctcctaacctgat

SEQ ID NO: 515921 - DNA, 25 bp, Mus musculus
gatggctcccttgtcctaacctgat

SEQ ID NO: 515922 - DNA, 25 bp, Mus musculus
gatggctccgcactgtgagatccac

SEQ ID NO: 515923 - DNA, 25 bp, Mus musculus
gatggctccgcagtgtgagatccac

SEQ ID NO: 515924 - DNA, 25 bp, Mus musculus
gatggctcctagatttaagttcttc

SEQ ID NO: 515925 - DNA, 25 bp, Mus musculus
gatggctcctagttttaagttcttc

SEQ ID NO: 515926 - DNA, 25 bp, Mus musculus
gatggctcctgcatacagctgtaaa

SEQ ID NO: 515927 - DNA, 25 bp, Mus musculus
gatggctcctgcttacagctgtaaa

SEQ ID NO: 515928 - DNA, 25 bp, Mus musculus
gatggctcgtggagggaccttcatc

SEQ ID NO: 515929 - DNA, 25 bp, Mus musculus
gatggctcgtggtgggaccttcatc

SEQ ID NO: 515930 - DNA, 25 bp, Mus musculus
gatggctctactcagcatgcggtta

SEQ ID NO: 515931 - DNA, 25 bp, Mus musculus
gatggctctactgagcatgcggtta

SEQ ID NO: 515932 - DNA, 25 bp, Mus musculus
gatggctctatacatgtgtacatgt

SEQ ID NO: 515933 - DNA, 25 bp, Mus musculus
gatggctctatagatgtgtacatgt

SEQ ID NO: 515934 - DNA, 25 bp, Mus musculus
gatggctctattcttatgtcaacta

SEQ ID NO: 515935 - DNA, 25 bp, Mus musculus
gatggctctattgttatgtcaacta

SEQ ID NO: 515936 - DNA, 25 bp, Mus musculus
gatggctctcgtcacaagcaatatt

SEQ ID NO: 515937 - DNA, 25 bp, Mus musculus
gatggctctcgtgacaagcaatatt

SEQ ID NO: 515938 - DNA, 25 bp, Mus musculus
gatggctctgcaataccagacattg

SEQ ID NO: 515939 - DNA, 25 bp, Mus musculus
gatggctctgcattaccagacattg

SEQ ID NO: 515940 - DNA, 25 bp, Mus musculus
gatggctctgtacgcagtactctgt

SEQ ID NO: 515941 - DNA, 25 bp, Mus musculus
gatggctctgtaggcagtactctgt

SEQ ID NO: 515942 - DNA, 25 bp, Mus musculus
gatggctcttagctttgcaatgaga

SEQ ID NO: 515943 - DNA, 25 bp, Mus musculus
gatggctcttaggtttgcaatgaga

SEQ ID NO: 515944 - DNA, 25 bp, Mus musculus
gatggctctttgattaatagtggta

SEQ ID NO: 515945 - DNA, 25 bp, Mus musculus
gatggctctttgtttaatagtggta

SEQ ID NO: 515946 - DNA, 25 bp, Mus musculus
gatggctgaacaagcatttctgaat

SEQ ID NO: 515947 - DNA, 25 bp, Mus musculus
gatggctgaacatgcatttctgaat

SEQ ID NO: 515948 - DNA, 25 bp, Mus musculus
gatggctgactgcacctctggaatg

SEQ ID NO: 515949 - DNA, 25 bp, Mus musculus
gatggctgactggacctctggaatg

SEQ ID NO: 515950 - DNA, 25 bp, Mus musculus
gatggctgagggatctccaggaaca

SEQ ID NO: 515951 - DNA, 25 bp, Mus musculus
gatggctgagggttctccaggaaca

SEQ ID NO: 515952 - DNA, 25 bp, Mus musculus
gatggctgagtacaacatgccccag

SEQ ID NO: 515953 - DNA, 25 bp, Mus musculus
gatggctgagtagaacatgccccag

SEQ ID NO: 515954 - DNA, 25 bp, Mus musculus
gatggctgatggactctgccctgta

SEQ ID NO: 515955 - DNA, 25 bp, Mus musculus
gatggctgatggtctctgccctgta

SEQ ID NO: 515956 - DNA, 25 bp, Mus musculus
gatggctgcaaaagaccaacctaga

SEQ ID NO: 515957 - DNA, 25 bp, Mus musculus
gatggctgcaaacttcctagattgt

SEQ ID NO: 515958 - DNA, 25 bp, Mus musculus
gatggctgcaaagttcctagattgt

SEQ ID NO: 515959 - DNA, 25 bp, Mus musculus
gatggctgcaaatgaccaacctaga

SEQ ID NO: 515960 - DNA, 25 bp, Mus musculus
gatggctgcacgaaacacactggta

SEQ ID NO: 515961 - DNA, 25 bp, Mus musculus
gatggctgcacgtaacacactggta

SEQ ID NO: 515962 - DNA, 25 bp, Mus musculus
gatggctgccaccattaaacagctg

SEQ ID NO: 515963 - DNA, 25 bp, Mus musculus
gatggctgccacgattaaacagctg

SEQ ID NO: 515964 - DNA, 25 bp, Mus musculus
gatggctgccatatactgacaaacc

SEQ ID NO: 515965 - DNA, 25 bp, Mus musculus
gatggctgccatttactgacaaacc

SEQ ID NO: 515966 - DNA, 25 bp, Mus musculus
gatggctgccttatattcaagtttg

SEQ ID NO: 515967 - DNA, 25 bp, Mus musculus
gatggctgccttttattcaagtttg

SEQ ID NO: 515968 - DNA, 25 bp, Mus musculus
gatggctgctacatgtctgagagga

SEQ ID NO: 515969 - DNA, 25 bp, Mus musculus
gatggctgctacttgtctgagagga

SEQ ID NO: 515970 - DNA, 25 bp, Mus musculus
gatggctgctcacgtcgaggcctac

SEQ ID NO: 515971 - DNA, 25 bp, Mus musculus
gatggctgctcaggtcgaggcctac

SEQ ID NO: 515972 - DNA, 25 bp, Mus musculus
gatggctgctgtagagtggcacata

SEQ ID NO: 515973 - DNA, 25 bp, Mus musculus
gatggctgctgttgagtggcacata

SEQ ID NO: 515974 - DNA, 25 bp, Mus musculus
gatggctggattatcagttgctgtg

SEQ ID NO: 515975 - DNA, 25 bp, Mus musculus
gatggctggattttcagttgctgtg

SEQ ID NO: 515976 - DNA, 25 bp, Mus musculus
gatggctgggcgaaaacttgctcta

SEQ ID NO: 515977 - DNA, 25 bp, Mus musculus
gatggctgggcgtaaacttgctcta

SEQ ID NO: 515978 - DNA, 25 bp, Mus musculus
gatggctggttcagattccgtgttc

SEQ ID NO: 515979 - DNA, 25 bp, Mus musculus
gatggctggttctgattccgtgttc

SEQ ID NO: 515980 - DNA, 25 bp, Mus musculus
gatggctgtaacctagtattcagaa

SEQ ID NO: 515981 - DNA, 25 bp, Mus musculus
gatggctgtaacgtagtattcagaa

SEQ ID NO: 515982 - DNA, 25 bp, Mus musculus
gatggctgtaatcgcatacaactaa

SEQ ID NO: 515983 - DNA, 25 bp, Mus musculus
gatggctgtaatggcatacaactaa

SEQ ID NO: 515984 - DNA, 25 bp, Mus musculus
gatggctgtatcacacggtccaaaa

SEQ ID NO: 515985 - DNA, 25 bp, Mus musculus
gatggctgtatcacgaaggaggaaa

SEQ ID NO: 515986 - DNA, 25 bp, Mus musculus
gatggctgtatctcacggtccaaaa

SEQ ID NO: 515987 - DNA, 25 bp, Mus musculus
gatggctgtatctcgaaggaggaaa

SEQ ID NO: 515988 - DNA, 25 bp, Mus musculus
gatggctgtattctgatcccaccgt

SEQ ID NO: 515989 - DNA, 25 bp, Mus musculus
gatggctgtattgtgatcccaccgt

SEQ ID NO: 515990 - DNA, 25 bp, Mus musculus
gatggctgtcagaatgccctgtgca

SEQ ID NO: 515991 - DNA, 25 bp, Mus musculus
gatggctgtcagtatgccctgtgca

SEQ ID NO: 515992 - DNA, 25 bp, Mus musculus
gatggctgtcctctctaaggagtat

SEQ ID NO: 515993 - DNA, 25 bp, Mus musculus
gatggctgtcctgtctaaggagtat

SEQ ID NO: 515994 - DNA, 25 bp, Mus musculus
gatggctgtctactgcaagggacct

SEQ ID NO: 515995 - DNA, 25 bp, Mus musculus
gatggctgtctagtgcaagggacct

SEQ ID NO: 515996 - DNA, 25 bp, Mus musculus
gatggctgtctcacataactcaggg

SEQ ID NO: 515997 - DNA, 25 bp, Mus musculus
gatggctgtctctcataactcaggg

SEQ ID NO: 515998 - DNA, 25 bp, Mus musculus
gatggctgtgaaccagaccttcaag

SEQ ID NO: 515999 - DNA, 25 bp, Mus musculus
gatggctgtgaagcagaccttcaag

SEQ ID NO: 516000 - DNA, 25 bp, Mus musculus
gatggctgtgcaatgcattgacttt

SEQ ID NO: 516001 - DNA, 25 bp, Mus musculus
gatggctgtgcattgcattgacttt

SEQ ID NO: 516002 - DNA, 25 bp, Mus musculus
gatggctgtggcacacacgcagcag

SEQ ID NO: 516003 - DNA, 25 bp, Mus musculus
gatggctgtggctcacacgcagcag

SEQ ID NO: 516004 - DNA, 25 bp, Mus musculus
gatggctgtggtctcaaatatatcc

SEQ ID NO: 516005 - DNA, 25 bp, Mus musculus
gatggctgtggtgtcaaatatatcc

SEQ ID NO: 516006 - DNA, 25 bp, Mus musculus
gatggctgttgcctgtgctagctac

SEQ ID NO: 516007 - DNA, 25 bp, Mus musculus
gatggctgttgcgtgtgctagctac

SEQ ID NO: 516008 - DNA, 25 bp, Mus musculus
gatggctgtttgagttccgacattc

SEQ ID NO: 516009 - DNA, 25 bp, Mus musculus
gatggctgtttgtgttccgacattc

SEQ ID NO: 516010 - DNA, 25 bp, Mus musculus
gatggcttagccatatccttaagtg

SEQ ID NO: 516011 - DNA, 25 bp, Mus musculus
gatggcttagccttatccttaagtg

SEQ ID NO: 516012 - DNA, 25 bp, Mus musculus
gatggcttagctagtagataaatac

SEQ ID NO: 516013 - DNA, 25 bp, Mus musculus
gatggcttagcttgtagataaatac

SEQ ID NO: 516014 - DNA, 25 bp, Mus musculus
gatggcttaggactccagagcgcct

SEQ ID NO: 516015 - DNA, 25 bp, Mus musculus
gatggcttaggagtccagagcgcct

SEQ ID NO: 516016 - DNA, 25 bp, Mus musculus
gatggcttagtgaaattatcagcaa

SEQ ID NO: 516017 - DNA, 25 bp, Mus musculus
gatggcttagtgtaattatcagcaa

SEQ ID NO: 516018 - DNA, 25 bp, Mus musculus
gatggcttatcgagttgttcttaca

SEQ ID NO: 516019 - DNA, 25 bp, Mus musculus
gatggcttatcgtgttgttcttaca

SEQ ID NO: 516020 - DNA, 25 bp, Mus musculus
gatggcttatgcatagtaccaagat

SEQ ID NO: 516021 - DNA, 25 bp, Mus musculus
gatggcttatgcttagtaccaagat

SEQ ID NO: 516022 - DNA, 25 bp, Mus musculus
gatggcttatggcacatccatatta

SEQ ID NO: 516023 - DNA, 25 bp, Mus musculus
gatggcttatgggacatccatatta

SEQ ID NO: 516024 - DNA, 25 bp, Mus musculus
gatggcttattgctaccaccattag

SEQ ID NO: 516025 - DNA, 25 bp, Mus musculus
gatggcttattggtaccaccattag

SEQ ID NO: 516026 - DNA, 25 bp, Mus musculus
gatggcttcaagcttacttcgcgga

SEQ ID NO: 516027 - DNA, 25 bp, Mus musculus
gatggcttcaaggttacttcgcgga

SEQ ID NO: 516028 - DNA, 25 bp, Mus musculus
gatggcttcatcactaacctaacca

SEQ ID NO: 516029 - DNA, 25 bp, Mus musculus
gatggcttcatctctaacctaacca

SEQ ID NO: 516030 - DNA, 25 bp, Mus musculus
gatggcttcattcaaaaaccacacg

SEQ ID NO: 516031 - DNA, 25 bp, Mus musculus
gatggcttcattgaaaaaccacacg

SEQ ID NO: 516032 - DNA, 25 bp, Mus musculus
gatggcttccaacttcgaggcctgt

SEQ ID NO: 516033 - DNA, 25 bp, Mus musculus
gatggcttccaagttcgaggcctgt

SEQ ID NO: 516034 - DNA, 25 bp, Mus musculus
gatggcttccatccctgatagtccg

SEQ ID NO: 516035 - DNA, 25 bp, Mus musculus
gatggcttccatgcctgatagtccg

SEQ ID NO: 516036 - DNA, 25 bp, Mus musculus
gatggcttccccacttaaaggtgta

SEQ ID NO: 516037 - DNA, 25 bp, Mus musculus
gatggcttcccctcttaaaggtgta

SEQ ID NO: 516038 - DNA, 25 bp, Mus musculus
gatggcttcccgctgtatcaggaaa

SEQ ID NO: 516039 - DNA, 25 bp, Mus musculus
gatggcttcccggtgtatcaggaaa

SEQ ID NO: 516040 - DNA, 25 bp, Mus musculus
gatggcttccggatctgtaagattg

SEQ ID NO: 516041 - DNA, 25 bp, Mus musculus
gatggcttccggttctgtaagattg

SEQ ID NO: 516042 - DNA, 25 bp, Mus musculus
gatggcttcgagactccaaagtttc

SEQ ID NO: 516043 - DNA, 25 bp, Mus musculus
gatggcttcgagtctccaaagtttc

SEQ ID NO: 516044 - DNA, 25 bp, Mus musculus
gatggcttctatcggaacacagact

SEQ ID NO: 516045 - DNA, 25 bp, Mus musculus
gatggcttctatgggaacacagact

SEQ ID NO: 516046 - DNA, 25 bp, Mus musculus
gatggcttctcacggcaagtcataa

SEQ ID NO: 516047 - DNA, 25 bp, Mus musculus
gatggcttctcagggcaagtcataa

SEQ ID NO: 516048 - DNA, 25 bp, Mus musculus
gatggcttctggatacctgagggtt

SEQ ID NO: 516049 - DNA, 25 bp, Mus musculus
gatggcttctggttacctgagggtt

SEQ ID NO: 516050 - DNA, 25 bp, Mus musculus
gatggcttctttctgaagtccgagc

SEQ ID NO: 516051 - DNA, 25 bp, Mus musculus
gatggcttctttctgagaattgtcc

SEQ ID NO: 516052 - DNA, 25 bp, Mus musculus
gatggcttctttgtgaagtccgagc

SEQ ID NO: 516053 - DNA, 25 bp, Mus musculus
gatggcttctttgtgagaattgtcc

SEQ ID NO: 516054 - DNA, 25 bp, Mus musculus
gatggcttgccacaagataccggtg

SEQ ID NO: 516055 - DNA, 25 bp, Mus musculus
gatggcttgccagaagataccggtg

SEQ ID NO: 516056 - DNA, 25 bp, Mus musculus
gatggcttgcgcatagcccaatgat

SEQ ID NO: 516057 - DNA, 25 bp, Mus musculus
gatggcttgcgcttagcccaatgat

SEQ ID NO: 516058 - DNA, 25 bp, Mus musculus
gatggcttggagctcataccaggaa

SEQ ID NO: 516059 - DNA, 25 bp, Mus musculus
gatggcttggaggtcataccaggaa

SEQ ID NO: 516060 - DNA, 25 bp, Mus musculus
gatggcttgtttcggcaacgtaaaa

SEQ ID NO: 516061 - DNA, 25 bp, Mus musculus
gatggcttgtttgggcaacgtaaaa

SEQ ID NO: 516062 - DNA, 25 bp, Mus musculus
gatggctttaagaatcccaggccct

SEQ ID NO: 516063 - DNA, 25 bp, Mus musculus
gatggctttaagtatcccaggccct

SEQ ID NO: 516064 - DNA, 25 bp, Mus musculus
gatggctttagtcacactaacagtt

SEQ ID NO: 516065 - DNA, 25 bp, Mus musculus
gatggctttagtgacactaacagtt

SEQ ID NO: 516066 - DNA, 25 bp, Mus musculus
gatggctttatgacctcagagttta

SEQ ID NO: 516067 - DNA, 25 bp, Mus musculus
gatggctttatgtcctcagagttta

SEQ ID NO: 516068 - DNA, 25 bp, Mus musculus
gatggctttattagcatccaagcag

SEQ ID NO: 516069 - DNA, 25 bp, Mus musculus
gatggctttattaggcacccagcat

SEQ ID NO: 516070 - DNA, 25 bp, Mus musculus
gatggctttattcgctttgtagagg

SEQ ID NO: 516071 - DNA, 25 bp, Mus musculus
gatggctttattggctttgtagagg

SEQ ID NO: 516072 - DNA, 25 bp, Mus musculus
gatggctttatttgcatccaagcag

SEQ ID NO: 516073 - DNA, 25 bp, Mus musculus
gatggctttatttggcacccagcat

SEQ ID NO: 516074 - DNA, 25 bp, Mus musculus
gatggctttcagacactctgtgact

SEQ ID NO: 516075 - DNA, 25 bp, Mus musculus
gatggctttcagagcctttgtagta

SEQ ID NO: 516076 - DNA, 25 bp, Mus musculus
gatggctttcagtcactctgtgact

SEQ ID NO: 516077 - DNA, 25 bp, Mus musculus
gatggctttcagtgcctttgtagta

SEQ ID NO: 516078 - DNA, 25 bp, Mus musculus
gatggctttctaatgtactgctgcg

SEQ ID NO: 516079 - DNA, 25 bp, Mus musculus
gatggctttctaccaagattaagat

SEQ ID NO: 516080 - DNA, 25 bp, Mus musculus
gatggctttctagcaagattaagat

SEQ ID NO: 516081 - DNA, 25 bp, Mus musculus
gatggctttctattgtactgctgcg

SEQ ID NO: 516082 - DNA, 25 bp, Mus musculus
gatggctttcttaggttcatagtgt

SEQ ID NO: 516083 - DNA, 25 bp, Mus musculus
gatggctttcttctcaagtgacttt

SEQ ID NO: 516084 - DNA, 25 bp, Mus musculus
gatggctttcttgtcaagtgacttt

SEQ ID NO: 516085 - DNA, 25 bp, Mus musculus
gatggctttctttggttcatagtgt

SEQ ID NO: 516086 - DNA, 25 bp, Mus musculus
gatggctttggaccagacactcaaa

SEQ ID NO: 516087 - DNA, 25 bp, Mus musculus
gatggctttggagcagacactcaaa

SEQ ID NO: 516088 - DNA, 25 bp, Mus musculus
gatggctttgttatgcattcaccat

SEQ ID NO: 516089 - DNA, 25 bp, Mus musculus
gatggctttgttttgcattcaccat

SEQ ID NO: 516090 - DNA, 25 bp, Mus musculus
gatggcttttaacactgaccttgac

SEQ ID NO: 516091 - DNA, 25 bp, Mus musculus
gatggcttttaagactgaccttgac

SEQ ID NO: 516092 - DNA, 25 bp, Mus musculus
gatggcttttctacgaatatgtgga

SEQ ID NO: 516093 - DNA, 25 bp, Mus musculus
gatggcttttctcgtgtttgaggca

SEQ ID NO: 516094 - DNA, 25 bp, Mus musculus
gatggcttttctggtgtttgaggca

SEQ ID NO: 516095 - DNA, 25 bp, Mus musculus
gatggcttttcttcgaatatgtgga

SEQ ID NO: 516096 - DNA, 25 bp, Mus musculus
gatggcttttggattggtaaccctt

SEQ ID NO: 516097 - DNA, 25 bp, Mus musculus
gatggcttttggcacaatcatgacc

SEQ ID NO: 516098 - DNA, 25 bp, Mus musculus
gatggcttttgggacaatcatgacc

SEQ ID NO: 516099 - DNA, 25 bp, Mus musculus
gatggcttttggtttggtaaccctt

SEQ ID NO: 516100 - DNA, 25 bp, Mus musculus
gatggctttttaatacaagagctaa

SEQ ID NO: 516101 - DNA, 25 bp, Mus musculus
gatggctttttattacaagagctaa

SEQ ID NO: 516102 - DNA, 25 bp, Mus musculus
gatgggaaacacaccagactcagcc

SEQ ID NO: 516103 - DNA, 25 bp, Mus musculus
gatgggaaacactccagactcagcc

SEQ ID NO: 516104 - DNA, 25 bp, Mus musculus
gatgggaaactgactcagtagtgta

SEQ ID NO: 516105 - DNA, 25 bp, Mus musculus
gatgggaaactgtctcagtagtgta

SEQ ID NO: 516106 - DNA, 25 bp, Mus musculus
gatgggaaagaaccacctcctgtgg

SEQ ID NO: 516107 - DNA, 25 bp, Mus musculus
gatgggaaagaagcacctcctgtgg

SEQ ID NO: 516108 - DNA, 25 bp, Mus musculus
gatgggaaagctcccactatgccct

SEQ ID NO: 516109 - DNA, 25 bp, Mus musculus
gatgggaaagctgccactatgccct

SEQ ID NO: 516110 - DNA, 25 bp, Mus musculus
gatgggaacacaatctgtgaggagt

SEQ ID NO: 516111 - DNA, 25 bp, Mus musculus
gatgggaacacattctgtgaggagt

SEQ ID NO: 516112 - DNA, 25 bp, Mus musculus
gatgggaacagaacattttgttgtt

SEQ ID NO: 516113 - DNA, 25 bp, Mus musculus
gatgggaacagatcattttgttgtt

SEQ ID NO: 516114 - DNA, 25 bp, Mus musculus
gatgggaacatcaagcccctaacca

SEQ ID NO: 516115 - DNA, 25 bp, Mus musculus
gatgggaacatctagcccctaacca

SEQ ID NO: 516116 - DNA, 25 bp, Mus musculus
gatgggaaccataacaccagcatgt

SEQ ID NO: 516117 - DNA, 25 bp, Mus musculus
gatgggaaccattacaccagcatgt

SEQ ID NO: 516118 - DNA, 25 bp, Mus musculus
gatgggaaccctcatcccaagggta

SEQ ID NO: 516119 - DNA, 25 bp, Mus musculus
gatgggaaccctgatcccaagggta

SEQ ID NO: 516120 - DNA, 25 bp, Mus musculus
gatgggaacctcagcgacactgtag

SEQ ID NO: 516121 - DNA, 25 bp, Mus musculus
gatgggaacctctgcgacactgtag

SEQ ID NO: 516122 - DNA, 25 bp, Mus musculus
gatgggaacgctatgtccacagtga

SEQ ID NO: 516123 - DNA, 25 bp, Mus musculus
gatgggaacgctttgtccacagtga

SEQ ID NO: 516124 - DNA, 25 bp, Mus musculus
gatgggaactccagatgtgcgcatt

SEQ ID NO: 516125 - DNA, 25 bp, Mus musculus
gatgggaactcctgatgtgcgcatt

SEQ ID NO: 516126 - DNA, 25 bp, Mus musculus
gatgggaacttaaatagcacagact

SEQ ID NO: 516127 - DNA, 25 bp, Mus musculus
gatgggaacttatatagcacagact

SEQ ID NO: 516128 - DNA, 25 bp, Mus musculus
gatgggaagctaatgtgtaagcaga

SEQ ID NO: 516129 - DNA, 25 bp, Mus musculus
gatgggaagctattgtgtaagcaga

SEQ ID NO: 516130 - DNA, 25 bp, Mus musculus
gatgggaaggcacctggactctaca

SEQ ID NO: 516131 - DNA, 25 bp, Mus musculus
gatgggaaggcagctggactctaca

SEQ ID NO: 516132 - DNA, 25 bp, Mus musculus
gatgggaagttcagtctctggcctc

SEQ ID NO: 516133 - DNA, 25 bp, Mus musculus
gatgggaagttctgtctctggcctc

SEQ ID NO: 516134 - DNA, 25 bp, Mus musculus
gatgggaataaacgtccctgccctg

SEQ ID NO: 516135 - DNA, 25 bp, Mus musculus
gatgggaataaaggtccctgccctg

SEQ ID NO: 516136 - DNA, 25 bp, Mus musculus
gatgggaatcctaatacagttttga

SEQ ID NO: 516137 - DNA, 25 bp, Mus musculus
gatgggaatccttatacagttttga

SEQ ID NO: 516138 - DNA, 25 bp, Mus musculus
gatgggaatgagattctttagccaa

SEQ ID NO: 516139 - DNA, 25 bp, Mus musculus
gatgggaatgagtttctttagccaa

SEQ ID NO: 516140 - DNA, 25 bp, Mus musculus
gatgggaatgttacacggcagtgca

SEQ ID NO: 516141 - DNA, 25 bp, Mus musculus
gatgggaatgtttcacggcagtgca

SEQ ID NO: 516142 - DNA, 25 bp, Mus musculus
gatgggacaaggacacccggacttt

SEQ ID NO: 516143 - DNA, 25 bp, Mus musculus
gatgggacaaggtcacccggacttt

SEQ ID NO: 516144 - DNA, 25 bp, Mus musculus
gatgggacactaaggtgccactgag

SEQ ID NO: 516145 - DNA, 25 bp, Mus musculus
gatgggacactatggtgccactgag

SEQ ID NO: 516146 - DNA, 25 bp, Mus musculus
gatgggacactgagtgccgttgcaa

SEQ ID NO: 516147 - DNA, 25 bp, Mus musculus
gatgggacactgtgtgccgttgcaa

SEQ ID NO: 516148 - DNA, 25 bp, Mus musculus
gatgggacagtcacaagcgcacaag

SEQ ID NO: 516149 - DNA, 25 bp, Mus musculus
gatgggacagtctcaagcgcacaag

SEQ ID NO: 516150 - DNA, 25 bp, Mus musculus
gatgggacatctagtgggatctcac

SEQ ID NO: 516151 - DNA, 25 bp, Mus musculus
gatgggacatcttgtgggatctcac

SEQ ID NO: 516152 - DNA, 25 bp, Mus musculus
gatgggaccactctttcagtttcct

SEQ ID NO: 516153 - DNA, 25 bp, Mus musculus
gatgggaccactgtttcagtttcct

SEQ ID NO: 516154 - DNA, 25 bp, Mus musculus
gatgggacccaaatcccttgatcaa

SEQ ID NO: 516155 - DNA, 25 bp, Mus musculus
gatgggacccaattcccttgatcaa

SEQ ID NO: 516156 - DNA, 25 bp, Mus musculus
gatgggaccccacagtctcttgtca

SEQ ID NO: 516157 - DNA, 25 bp, Mus musculus
gatgggaccccagagtctcttgtca

SEQ ID NO: 516158 - DNA, 25 bp, Mus musculus
gatgggaccctcacaagttttgttc

SEQ ID NO: 516159 - DNA, 25 bp, Mus musculus
gatgggaccctctcaagttttgttc

SEQ ID NO: 516160 - DNA, 25 bp, Mus musculus
gatgggacctatccagccagagaag

SEQ ID NO: 516161 - DNA, 25 bp, Mus musculus
gatgggacctatgcagccagagaag

SEQ ID NO: 516162 - DNA, 25 bp, Mus musculus
gatgggactataagactatccttta

SEQ ID NO: 516163 - DNA, 25 bp, Mus musculus
gatgggactatatgactatccttta

SEQ ID NO: 516164 - DNA, 25 bp, Mus musculus
gatgggactcaaatatattttttat

SEQ ID NO: 516165 - DNA, 25 bp, Mus musculus
gatgggactcaattatattttttat

SEQ ID NO: 516166 - DNA, 25 bp, Mus musculus
gatgggactccaattatatttttta

SEQ ID NO: 516167 - DNA, 25 bp, Mus musculus
gatgggactccatttatatttttta

SEQ ID NO: 516168 - DNA, 25 bp, Mus musculus
gatgggactctgcagtctgtccatc

SEQ ID NO: 516169 - DNA, 25 bp, Mus musculus
gatgggactctggagtctgtccatc

SEQ ID NO: 516170 - DNA, 25 bp, Mus musculus
gatgggactcttacatctctggaac

SEQ ID NO: 516171 - DNA, 25 bp, Mus musculus
gatgggactctttcatctctggaac

SEQ ID NO: 516172 - DNA, 25 bp, Mus musculus
gatgggactgagcacccactttccc

SEQ ID NO: 516173 - DNA, 25 bp, Mus musculus
gatgggactgaggacccactttccc

SEQ ID NO: 516174 - DNA, 25 bp, Mus musculus
gatgggactgggatatacagctcaa

SEQ ID NO: 516175 - DNA, 25 bp, Mus musculus
gatgggactgggttatacagctcaa

SEQ ID NO: 516176 - DNA, 25 bp, Mus musculus
gatgggactgtcaagggcactcagt

SEQ ID NO: 516177 - DNA, 25 bp, Mus musculus
gatgggactgtctagggcactcagt

SEQ ID NO: 516178 - DNA, 25 bp, Mus musculus
gatgggacttcaaatattgaaccac

SEQ ID NO: 516179 - DNA, 25 bp, Mus musculus
gatgggacttcatatattgaaccac

SEQ ID NO: 516180 - DNA, 25 bp, Mus musculus
gatgggagaagcacctgccacagcc

SEQ ID NO: 516181 - DNA, 25 bp, Mus musculus
gatgggagaagctcctgccacagcc

SEQ ID NO: 516182 - DNA, 25 bp, Mus musculus
gatgggagaagtaattcgtcatgaa

SEQ ID NO: 516183 - DNA, 25 bp, Mus musculus
gatgggagaagttattcgtcatgaa

SEQ ID NO: 516184 - DNA, 25 bp, Mus musculus
gatgggagacaacgactctttgacc

SEQ ID NO: 516185 - DNA, 25 bp, Mus musculus
gatgggagacaaggactctttgacc

SEQ ID NO: 516186 - DNA, 25 bp, Mus musculus
gatgggagacacagtcgcaacgcat

SEQ ID NO: 516187 - DNA, 25 bp, Mus musculus
gatgggagacactgtcgcaacgcat

SEQ ID NO: 516188 - DNA, 25 bp, Mus musculus
gatgggagacagaccctgcggaccc

SEQ ID NO: 516189 - DNA, 25 bp, Mus musculus
gatgggagacagtccctgcggaccc

SEQ ID NO: 516190 - DNA, 25 bp, Mus musculus
gatgggagcagacctccctgacagt

SEQ ID NO: 516191 - DNA, 25 bp, Mus musculus
gatgggagcagagctccctgacagt

SEQ ID NO: 516192 - DNA, 25 bp, Mus musculus
gatgggagccataacaagatcccct

SEQ ID NO: 516193 - DNA, 25 bp, Mus musculus
gatgggagccattacaagatcccct

SEQ ID NO: 516194 - DNA, 25 bp, Mus musculus
gatgggagccctactcaaaatcaga

SEQ ID NO: 516195 - DNA, 25 bp, Mus musculus
gatgggagcccttctcaaaatcaga

SEQ ID NO: 516196 - DNA, 25 bp, Mus musculus
gatgggagccttactcagtgagata

SEQ ID NO: 516197 - DNA, 25 bp, Mus musculus
gatgggagcctttctcagtgagata

SEQ ID NO: 516198 - DNA, 25 bp, Mus musculus
gatgggagctgtaacaccttggttc

SEQ ID NO: 516199 - DNA, 25 bp, Mus musculus
gatgggagctgtacttatcctaaac

SEQ ID NO: 516200 - DNA, 25 bp, Mus musculus
gatgggagctgttacaccttggttc

SEQ ID NO: 516201 - DNA, 25 bp, Mus musculus
gatgggagctgttcttatcctaaac

SEQ ID NO: 516202 - DNA, 25 bp, Mus musculus
gatgggaggcccctcaggtcctgga

SEQ ID NO: 516203 - DNA, 25 bp, Mus musculus
gatgggaggcccgtcaggtcctgga

SEQ ID NO: 516204 - DNA, 25 bp, Mus musculus
gatgggagtcaaacctggtctctga

SEQ ID NO: 516205 - DNA, 25 bp, Mus musculus
gatgggagtcaatcctggtctctga

SEQ ID NO: 516206 - DNA, 25 bp, Mus musculus
gatgggagtggaattcgtcctaaat

SEQ ID NO: 516207 - DNA, 25 bp, Mus musculus
gatgggagtggatttcgtcctaaat

SEQ ID NO: 516208 - DNA, 25 bp, Mus musculus
gatgggagtttgagacctgttgacc

SEQ ID NO: 516209 - DNA, 25 bp, Mus musculus
gatgggagtttgtgacctgttgacc

SEQ ID NO: 516210 - DNA, 25 bp, Mus musculus
gatgggatactcatgctatttactc

SEQ ID NO: 516211 - DNA, 25 bp, Mus musculus
gatgggatactcttgctatttactc

SEQ ID NO: 516212 - DNA, 25 bp, Mus musculus
gatgggatcaaccttgtagctcaag

SEQ ID NO: 516213 - DNA, 25 bp, Mus musculus
gatgggatcaacgttgtagctcaag

SEQ ID NO: 516214 - DNA, 25 bp, Mus musculus
gatgggatcacacacaccagcggag

SEQ ID NO: 516215 - DNA, 25 bp, Mus musculus
gatgggatcacagacaccagcggag

SEQ ID NO: 516216 - DNA, 25 bp, Mus musculus
gatgggatcaccacagtcaagaact

SEQ ID NO: 516217 - DNA, 25 bp, Mus musculus
gatgggatcacctcagtcaagaact

SEQ ID NO: 516218 - DNA, 25 bp, Mus musculus
gatgggatcaggaccccaagttatt

SEQ ID NO: 516219 - DNA, 25 bp, Mus musculus
gatgggatcaggtccccaagttatt

SEQ ID NO: 516220 - DNA, 25 bp, Mus musculus
gatgggatcatacgcctgtactgct

SEQ ID NO: 516221 - DNA, 25 bp, Mus musculus
gatgggatcataggcctgtactgct

SEQ ID NO: 516222 - DNA, 25 bp, Mus musculus
gatgggatccctctgagaatgcgaa

SEQ ID NO: 516223 - DNA, 25 bp, Mus musculus
gatgggatccctgtgagaatgcgaa

SEQ ID NO: 516224 - DNA, 25 bp, Mus musculus
gatgggatccgactttgactttgag

SEQ ID NO: 516225 - DNA, 25 bp, Mus musculus
gatgggatccgagtttgactttgag

SEQ ID NO: 516226 - DNA, 25 bp, Mus musculus
gatgggatccggctgaagaaatacc

SEQ ID NO: 516227 - DNA, 25 bp, Mus musculus
gatgggatccgggtgaagaaatacc

SEQ ID NO: 516228 - DNA, 25 bp, Mus musculus
gatgggatcctgctctcttatcgtt

SEQ ID NO: 516229 - DNA, 25 bp, Mus musculus
gatgggatcctggtctcttatcgtt

SEQ ID NO: 516230 - DNA, 25 bp, Mus musculus
gatgggatctatcccgcctcagcgg

SEQ ID NO: 516231 - DNA, 25 bp, Mus musculus
gatgggatctatgccgcctcagcgg

SEQ ID NO: 516232 - DNA, 25 bp, Mus musculus
gatgggattagtctgatcacttaat

SEQ ID NO: 516233 - DNA, 25 bp, Mus musculus
gatgggattagtgtgatcacttaat

SEQ ID NO: 516234 - DNA, 25 bp, Mus musculus
gatgggattcaacactcagacagcc

SEQ ID NO: 516235 - DNA, 25 bp, Mus musculus
gatgggattcaagactcagacagcc

SEQ ID NO: 516236 - DNA, 25 bp, Mus musculus
gatgggattcccagaggactctact

SEQ ID NO: 516237 - DNA, 25 bp, Mus musculus
gatgggattccctgaggactctact

SEQ ID NO: 516238 - DNA, 25 bp, Mus musculus
gatgggattctcagcagctatgttg

SEQ ID NO: 516239 - DNA, 25 bp, Mus musculus
gatgggattctctgcagctatgttg

SEQ ID NO: 516240 - DNA, 25 bp, Mus musculus
gatgggattctgaattttttgcaaa

SEQ ID NO: 516241 - DNA, 25 bp, Mus musculus
gatgggattctgtattttttgcaaa

SEQ ID NO: 516242 - DNA, 25 bp, Mus musculus
gatgggattgacactgtgcatgctc

SEQ ID NO: 516243 - DNA, 25 bp, Mus musculus
gatgggattgactctgtgcatgctc

SEQ ID NO: 516244 - DNA, 25 bp, Mus musculus
gatgggatttagagtagacattctt

SEQ ID NO: 516245 - DNA, 25 bp, Mus musculus
gatgggatttagtgtagacattctt

SEQ ID NO: 516246 - DNA, 25 bp, Mus musculus
gatgggatttatcccgggtgccaac

SEQ ID NO: 516247 - DNA, 25 bp, Mus musculus
gatgggatttatgccgggtgccaac

SEQ ID NO: 516248 - DNA, 25 bp, Mus musculus
gatgggcaacccacacggagataca

SEQ ID NO: 516249 - DNA, 25 bp, Mus musculus
gatgggcaaccctcacggagataca

SEQ ID NO: 516250 - DNA, 25 bp, Mus musculus
gatgggcaagcaaccagcacattga

SEQ ID NO: 516251 - DNA, 25 bp, Mus musculus
gatgggcaagcatccagcacattga

SEQ ID NO: 516252 - DNA, 25 bp, Mus musculus
gatgggcaagctccaccttgtggat

SEQ ID NO: 516253 - DNA, 25 bp, Mus musculus
gatgggcaagctgcaccttgtggat

SEQ ID NO: 516254 - DNA, 25 bp, Mus musculus
gatgggcacatcaacttctgaactg

SEQ ID NO: 516255 - DNA, 25 bp, Mus musculus
gatgggcacatctacttctgaactg

SEQ ID NO: 516256 - DNA, 25 bp, Mus musculus
gatgggcaccagagacacaggcctg

SEQ ID NO: 516257 - DNA, 25 bp, Mus musculus
gatgggcaccagcaaccgctccaga

SEQ ID NO: 516258 - DNA, 25 bp, Mus musculus
gatgggcaccaggaaccgctccaga

SEQ ID NO: 516259 - DNA, 25 bp, Mus musculus
gatgggcaccagtgacacaggcctg

SEQ ID NO: 516260 - DNA, 25 bp, Mus musculus
gatgggcacctcaccatcgatgagg

SEQ ID NO: 516261 - DNA, 25 bp, Mus musculus
gatgggcacctctccatcgatgagg

SEQ ID NO: 516262 - DNA, 25 bp, Mus musculus
gatgggcactggctacatgcccagt

SEQ ID NO: 516263 - DNA, 25 bp, Mus musculus
gatgggcactgggtacatgcccagt

SEQ ID NO: 516264 - DNA, 25 bp, Mus musculus
gatgggcagaccattaaagaacact

SEQ ID NO: 516265 - DNA, 25 bp, Mus musculus
gatgggcagacctttaaagaacact

SEQ ID NO: 516266 - DNA, 25 bp, Mus musculus
gatgggcagagaaccagcacctaaa

SEQ ID NO: 516267 - DNA, 25 bp, Mus musculus
gatgggcagagatccagcacctaaa

SEQ ID NO: 516268 - DNA, 25 bp, Mus musculus
gatgggcagagcactacacaaccga

SEQ ID NO: 516269 - DNA, 25 bp, Mus musculus
gatgggcagagctctacacaaccga

SEQ ID NO: 516270 - DNA, 25 bp, Mus musculus
gatgggcagcaccaatctggatata

SEQ ID NO: 516271 - DNA, 25 bp, Mus musculus
gatgggcagcacgaatctggatata

SEQ ID NO: 516272 - DNA, 25 bp, Mus musculus
gatgggcagcctaaccagatagcca

SEQ ID NO: 516273 - DNA, 25 bp, Mus musculus
gatgggcagccttaccagatagcca

SEQ ID NO: 516274 - DNA, 25 bp, Mus musculus
gatgggcagcggaggaattcagctt

SEQ ID NO: 516275 - DNA, 25 bp, Mus musculus
gatgggcagcggtggaattcagctt

SEQ ID NO: 516276 - DNA, 25 bp, Mus musculus
gatgggcaggctaatttgtcaactt

SEQ ID NO: 516277 - DNA, 25 bp, Mus musculus
gatgggcaggcttatttgtcaactt

SEQ ID NO: 516278 - DNA, 25 bp, Mus musculus
gatgggcaggtcctgcagtcccacc

SEQ ID NO: 516279 - DNA, 25 bp, Mus musculus
gatgggcaggtcgtgcagtcccacc

SEQ ID NO: 516280 - DNA, 25 bp, Mus musculus
gatgggcagtacaccagtagaatct

SEQ ID NO: 516281 - DNA, 25 bp, Mus musculus
gatgggcagtactccagtagaatct

SEQ ID NO: 516282 - DNA, 25 bp, Mus musculus
gatgggcatacccacctcagaaaac

SEQ ID NO: 516283 - DNA, 25 bp, Mus musculus
gatgggcataccgacctcagaaaac

SEQ ID NO: 516284 - DNA, 25 bp, Mus musculus
gatgggcatcccaggattctgctaa

SEQ ID NO: 516285 - DNA, 25 bp, Mus musculus
gatgggcatccctggattctgctaa

SEQ ID NO: 516286 - DNA, 25 bp, Mus musculus
gatgggcatctgatcccgcatgaca

SEQ ID NO: 516287 - DNA, 25 bp, Mus musculus
gatgggcatctgttcccgcatgaca

SEQ ID NO: 516288 - DNA, 25 bp, Mus musculus
gatgggcatgctatgctacagcgct

SEQ ID NO: 516289 - DNA, 25 bp, Mus musculus
gatgggcatgctttgctacagcgct

SEQ ID NO: 516290 - DNA, 25 bp, Mus musculus
gatgggccaaatccatgttgacttt

SEQ ID NO: 516291 - DNA, 25 bp, Mus musculus
gatgggccaaatgcatgttgacttt

SEQ ID NO: 516292 - DNA, 25 bp, Mus musculus
gatgggccaagaaaattgatgccag

SEQ ID NO: 516293 - DNA, 25 bp, Mus musculus
gatgggccaagataattgatgccag

SEQ ID NO: 516294 - DNA, 25 bp, Mus musculus
gatgggccaagtcaactctagtctc

SEQ ID NO: 516295 - DNA, 25 bp, Mus musculus
gatgggccaagtgaactctagtctc

SEQ ID NO: 516296 - DNA, 25 bp, Mus musculus
gatgggccactcagctcacagtggt

SEQ ID NO: 516297 - DNA, 25 bp, Mus musculus
gatgggccactctgctcacagtggt

SEQ ID NO: 516298 - DNA, 25 bp, Mus musculus
gatgggccagtccaaaaaggaagct

SEQ ID NO: 516299 - DNA, 25 bp, Mus musculus
gatgggccagtcgaaaaaggaagct

SEQ ID NO: 516300 - DNA, 25 bp, Mus musculus
gatgggccatctccaggatagacct

SEQ ID NO: 516301 - DNA, 25 bp, Mus musculus
gatgggccatctgcaggatagacct

SEQ ID NO: 516302 - DNA, 25 bp, Mus musculus
gatgggccattcctggaacaatcgt

SEQ ID NO: 516303 - DNA, 25 bp, Mus musculus
gatgggccattcgtggaacaatcgt

SEQ ID NO: 516304 - DNA, 25 bp, Mus musculus
gatgggcccacaagtgctatttatt

SEQ ID NO: 516305 - DNA, 25 bp, Mus musculus
gatgggcccacatgtgctatttatt

SEQ ID NO: 516306 - DNA, 25 bp, Mus musculus
gatgggcccatgattgttcacgatg

SEQ ID NO: 516307 - DNA, 25 bp, Mus musculus
gatgggcccatgtttgttcacgatg

SEQ ID NO: 516308 - DNA, 25 bp, Mus musculus
gatgggccccgtccatcactagtaa

SEQ ID NO: 516309 - DNA, 25 bp, Mus musculus
gatgggccccgtgcatcactagtaa

SEQ ID NO: 516310 - DNA, 25 bp, Mus musculus
gatgggccctagatgtagacattct

SEQ ID NO: 516311 - DNA, 25 bp, Mus musculus
gatgggccctagttgtagacattct

SEQ ID NO: 516312 - DNA, 25 bp, Mus musculus
gatgggcctcccctccaagcatggg

SEQ ID NO: 516313 - DNA, 25 bp, Mus musculus
gatgggcctcccgtccaagcatggg

SEQ ID NO: 516314 - DNA, 25 bp, Mus musculus
gatgggcctcgcctgtaaaaggaac

SEQ ID NO: 516315 - DNA, 25 bp, Mus musculus
gatgggcctcgcgtgtaaaaggaac

SEQ ID NO: 516316 - DNA, 25 bp, Mus musculus
gatgggcctgagcttagcacagcac

SEQ ID NO: 516317 - DNA, 25 bp, Mus musculus
gatgggcctgaggttagcacagcac

SEQ ID NO: 516318 - DNA, 25 bp, Mus musculus
gatgggccttatccgaatgatcgca

SEQ ID NO: 516319 - DNA, 25 bp, Mus musculus
gatgggccttatgcgaatgatcgca

SEQ ID NO: 516320 - DNA, 25 bp, Mus musculus
gatgggccttcaagctttatgactt

SEQ ID NO: 516321 - DNA, 25 bp, Mus musculus
gatgggccttcatgctttatgactt

SEQ ID NO: 516322 - DNA, 25 bp, Mus musculus
gatgggcgagcgatatatcacgcac

SEQ ID NO: 516323 - DNA, 25 bp, Mus musculus
gatgggcgagcgttatatcacgcac

SEQ ID NO: 516324 - DNA, 25 bp, Mus musculus
gatgggcgatgaatgttcctgttct

SEQ ID NO: 516325 - DNA, 25 bp, Mus musculus
gatgggcgatgattgttcctgttct

SEQ ID NO: 516326 - DNA, 25 bp, Mus musculus
gatgggcgtccaacttgaatgcatt

SEQ ID NO: 516327 - DNA, 25 bp, Mus musculus
gatgggcgtccatcttgaatgcatt

SEQ ID NO: 516328 - DNA, 25 bp, Mus musculus
gatgggctacagaacaggaactcaa

SEQ ID NO: 516329 - DNA, 25 bp, Mus musculus
gatgggctacagtacaggaactcaa

SEQ ID NO: 516330 - DNA, 25 bp, Mus musculus
gatgggctacatacaggacaaatta

SEQ ID NO: 516331 - DNA, 25 bp, Mus musculus
gatgggctacatatgtgtctccaca

SEQ ID NO: 516332 - DNA, 25 bp, Mus musculus
gatgggctacatcataaatggctca

SEQ ID NO: 516333 - DNA, 25 bp, Mus musculus
gatgggctacatgataaatggctca

SEQ ID NO: 516334 - DNA, 25 bp, Mus musculus
gatgggctacattcaggacaaatta

SEQ ID NO: 516335 - DNA, 25 bp, Mus musculus
gatgggctacatttgtgtctccaca

SEQ ID NO: 516336 - DNA, 25 bp, Mus musculus
gatgggctactaaaaagggcctgcc

SEQ ID NO: 516337 - DNA, 25 bp, Mus musculus
gatgggctactataaagggcctgcc

SEQ ID NO: 516338 - DNA, 25 bp, Mus musculus
gatgggctagatcgactggctcttc

SEQ ID NO: 516339 - DNA, 25 bp, Mus musculus
gatgggctagatggactggctcttc

SEQ ID NO: 516340 - DNA, 25 bp, Mus musculus
gatgggctatgacagagtccttgaa

SEQ ID NO: 516341 - DNA, 25 bp, Mus musculus
gatgggctatgagagagtccttgaa

SEQ ID NO: 516342 - DNA, 25 bp, Mus musculus
gatgggctcaggattcttactcaga

SEQ ID NO: 516343 - DNA, 25 bp, Mus musculus
gatgggctcaggtttcttactcaga

SEQ ID NO: 516344 - DNA, 25 bp, Mus musculus
gatgggctccaaactgtgtgaactt

SEQ ID NO: 516345 - DNA, 25 bp, Mus musculus
gatgggctccaatctgtgtgaactt

SEQ ID NO: 516346 - DNA, 25 bp, Mus musculus
gatgggctccagctctgagtgaaaa

SEQ ID NO: 516347 - DNA, 25 bp, Mus musculus
gatgggctccaggtctgagtgaaaa

SEQ ID NO: 516348 - DNA, 25 bp, Mus musculus
gatgggctcctcctaatgggaaagc

SEQ ID NO: 516349 - DNA, 25 bp, Mus musculus
gatgggctcctcgtaatgggaaagc

SEQ ID NO: 516350 - DNA, 25 bp, Mus musculus
gatgggctcctgacacctaatggac

SEQ ID NO: 516351 - DNA, 25 bp, Mus musculus
gatgggctcctgtcacctaatggac

SEQ ID NO: 516352 - DNA, 25 bp, Mus musculus
gatgggctctatagcatgcaactgt

SEQ ID NO: 516353 - DNA, 25 bp, Mus musculus
gatgggctctattgcatgcaactgt

SEQ ID NO: 516354 - DNA, 25 bp, Mus musculus
gatgggctctgtcaacaatggccag

SEQ ID NO: 516355 - DNA, 25 bp, Mus musculus
gatgggctctgtgaacaatggccag

SEQ ID NO: 516356 - DNA, 25 bp, Mus musculus
gatgggctgactcacattaaaggca

SEQ ID NO: 516357 - DNA, 25 bp, Mus musculus
gatgggctgactgacattaaaggca

SEQ ID NO: 516358 - DNA, 25 bp, Mus musculus
gatgggctgcatagtatccccaact

SEQ ID NO: 516359 - DNA, 25 bp, Mus musculus
gatgggctgcattgtatccccaact

SEQ ID NO: 516360 - DNA, 25 bp, Mus musculus
gatgggctgctcagtcttcatgaca

SEQ ID NO: 516361 - DNA, 25 bp, Mus musculus
gatgggctgctctgtcttcatgaca

SEQ ID NO: 516362 - DNA, 25 bp, Mus musculus
gatgggctggagaaacagtcccttt

SEQ ID NO: 516363 - DNA, 25 bp, Mus musculus
gatgggctggagtaacagtcccttt

SEQ ID NO: 516364 - DNA, 25 bp, Mus musculus
gatgggctgtacacttacacgtttg

SEQ ID NO: 516365 - DNA, 25 bp, Mus musculus
gatgggctgtacatcttcaaaattc

SEQ ID NO: 516366 - DNA, 25 bp, Mus musculus
gatgggctgtactcttacacgtttg

SEQ ID NO: 516367 - DNA, 25 bp, Mus musculus
gatgggctgtacttcttcaaaattc

SEQ ID NO: 516368 - DNA, 25 bp, Mus musculus
gatgggctgtgactttccccaaata

SEQ ID NO: 516369 - DNA, 25 bp, Mus musculus
gatgggctgtgagtttccccaaata

SEQ ID NO: 516370 - DNA, 25 bp, Mus musculus
gatgggcttacaccgccctctggag

SEQ ID NO: 516371 - DNA, 25 bp, Mus musculus
gatgggcttacagcgccctctggag

SEQ ID NO: 516372 - DNA, 25 bp, Mus musculus
gatgggcttataaccaaacggagaa

SEQ ID NO: 516373 - DNA, 25 bp, Mus musculus
gatgggcttatatccaaacggagaa

SEQ ID NO: 516374 - DNA, 25 bp, Mus musculus
gatgggcttattcgcgcaagaacct

SEQ ID NO: 516375 - DNA, 25 bp, Mus musculus
gatgggcttattggcgcaagaacct

SEQ ID NO: 516376 - DNA, 25 bp, Mus musculus
gatgggcttcacactgacagaacat

SEQ ID NO: 516377 - DNA, 25 bp, Mus musculus
gatgggcttcactctgacagaacat

SEQ ID NO: 516378 - DNA, 25 bp, Mus musculus
gatgggcttccaacctgatcctgcg

SEQ ID NO: 516379 - DNA, 25 bp, Mus musculus
gatgggcttccatcctgatcctgcg

SEQ ID NO: 516380 - DNA, 25 bp, Mus musculus
gatgggcttccccttgatgataaga

SEQ ID NO: 516381 - DNA, 25 bp, Mus musculus
gatgggcttcccgttgatgataaga

SEQ ID NO: 516382 - DNA, 25 bp, Mus musculus
gatgggcttcgacaggctgtttctc

SEQ ID NO: 516383 - DNA, 25 bp, Mus musculus
gatgggcttcgagaggctgtttctc

SEQ ID NO: 516384 - DNA, 25 bp, Mus musculus
gatgggctttacacttacttgataa

SEQ ID NO: 516385 - DNA, 25 bp, Mus musculus
gatgggctttacagcatgacactta

SEQ ID NO: 516386 - DNA, 25 bp, Mus musculus
gatgggctttaccaaggcctggact

SEQ ID NO: 516387 - DNA, 25 bp, Mus musculus
gatgggctttacgaaggcctggact

SEQ ID NO: 516388 - DNA, 25 bp, Mus musculus
gatgggctttactcttacttgataa

SEQ ID NO: 516389 - DNA, 25 bp, Mus musculus
gatgggctttactgcatgacactta

SEQ ID NO: 516390 - DNA, 25 bp, Mus musculus
gatgggctttttcaaacgtgtccga

SEQ ID NO: 516391 - DNA, 25 bp, Mus musculus
gatgggctttttgaaacgtgtccga

SEQ ID NO: 516392 - DNA, 25 bp, Mus musculus
gatggggaccggaatccttcatttc

SEQ ID NO: 516393 - DNA, 25 bp, Mus musculus
gatggggaccggtatccttcatttc

SEQ ID NO: 516394 - DNA, 25 bp, Mus musculus
gatgggtaactaacaatcactttac

SEQ ID NO: 516395 - DNA, 25 bp, Mus musculus
gatgggtaactatcaatcactttac

SEQ ID NO: 516396 - DNA, 25 bp, Mus musculus
gatgggtataaaatgtaggacttga

SEQ ID NO: 516397 - DNA, 25 bp, Mus musculus
gatgggtataaattgtaggacttga

SEQ ID NO: 516398 - DNA, 25 bp, Mus musculus
gatgggtatgtgcaccctgtgccac

SEQ ID NO: 516399 - DNA, 25 bp, Mus musculus
gatgggtatgtggaccctgtgccac

SEQ ID NO: 516400 - DNA, 25 bp, Mus musculus
gatgggtcacagctatttcccatgt

SEQ ID NO: 516401 - DNA, 25 bp, Mus musculus
gatgggtcacaggtatttcccatgt

SEQ ID NO: 516402 - DNA, 25 bp, Mus musculus
gatgggtcaccacgaaatcagggta

SEQ ID NO: 516403 - DNA, 25 bp, Mus musculus
gatgggtcaccaggaaatcagggta

SEQ ID NO: 516404 - DNA, 25 bp, Mus musculus
gatgggtcatggctggtttcctcat

SEQ ID NO: 516405 - DNA, 25 bp, Mus musculus
gatgggtcatgggtggtttcctcat

SEQ ID NO: 516406 - DNA, 25 bp, Mus musculus
gatgggtccattattatttctctaa

SEQ ID NO: 516407 - DNA, 25 bp, Mus musculus
gatgggtccattcatgcctgcaaag

SEQ ID NO: 516408 - DNA, 25 bp, Mus musculus
gatgggtccattgatgcctgcaaag

SEQ ID NO: 516409 - DNA, 25 bp, Mus musculus
gatgggtccatttttatttctctaa

SEQ ID NO: 516410 - DNA, 25 bp, Mus musculus
gatgggtcccacatacacagctttt

SEQ ID NO: 516411 - DNA, 25 bp, Mus musculus
gatgggtcccacttacacagctttt

SEQ ID NO: 516412 - DNA, 25 bp, Mus musculus
gatgggtctgtaaattggctcccgg

SEQ ID NO: 516413 - DNA, 25 bp, Mus musculus
gatgggtctgtatattggctcccgg

SEQ ID NO: 516414 - DNA, 25 bp, Mus musculus
gatgggtcttctcgaggcattttct

SEQ ID NO: 516415 - DNA, 25 bp, Mus musculus
gatgggtcttctggaggcattttct

SEQ ID NO: 516416 - DNA, 25 bp, Mus musculus
gatgggtctttgctactggacctac

SEQ ID NO: 516417 - DNA, 25 bp, Mus musculus
gatgggtctttggtactggacctac

SEQ ID NO: 516418 - DNA, 25 bp, Mus musculus
gatgggtgaacaaaaatgttcttcc

SEQ ID NO: 516419 - DNA, 25 bp, Mus musculus
gatgggtgaacataaatgttcttcc

SEQ ID NO: 516420 - DNA, 25 bp, Mus musculus
gatgggtgactacatgacctgtatg

SEQ ID NO: 516421 - DNA, 25 bp, Mus musculus
gatgggtgactagatgacctgtatg

SEQ ID NO: 516422 - DNA, 25 bp, Mus musculus
gatgggtgactgacagccctggctc

SEQ ID NO: 516423 - DNA, 25 bp, Mus musculus
gatgggtgactgtcagccctggctc

SEQ ID NO: 516424 - DNA, 25 bp, Mus musculus
gatgggtgatgcaaatcagatttca

SEQ ID NO: 516425 - DNA, 25 bp, Mus musculus
gatgggtgatgctaatcagatttca

SEQ ID NO: 516426 - DNA, 25 bp, Mus musculus
gatgggtgcacaattctgagaacgt

SEQ ID NO: 516427 - DNA, 25 bp, Mus musculus
gatgggtgcacatttctgagaacgt

SEQ ID NO: 516428 - DNA, 25 bp, Mus musculus
gatgggtgcccgacataatactgaa

SEQ ID NO: 516429 - DNA, 25 bp, Mus musculus
gatgggtgcccgtcataatactgaa

SEQ ID NO: 516430 - DNA, 25 bp, Mus musculus
gatgggtgccctcaaagtcaaggac

SEQ ID NO: 516431 - DNA, 25 bp, Mus musculus
gatgggtgccctgaaagtcaaggac

SEQ ID NO: 516432 - DNA, 25 bp, Mus musculus
gatgggtgccttaggtccccagcag

SEQ ID NO: 516433 - DNA, 25 bp, Mus musculus
gatgggtgcctttggtccccagcag

SEQ ID NO: 516434 - DNA, 25 bp, Mus musculus
gatgggtgtccgaaaaattctggaa

SEQ ID NO: 516435 - DNA, 25 bp, Mus musculus
gatgggtgtccgtaaaattctggaa

SEQ ID NO: 516436 - DNA, 25 bp, Mus musculus
gatgggtgtcctcccaagtgaatca

SEQ ID NO: 516437 - DNA, 25 bp, Mus musculus
gatgggtgtcctgccaagtgaatca

SEQ ID NO: 516438 - DNA, 25 bp, Mus musculus
gatgggtgtctcagcatttgccctt

SEQ ID NO: 516439 - DNA, 25 bp, Mus musculus
gatgggtgtctctgcatttgccctt

SEQ ID NO: 516440 - DNA, 25 bp, Mus musculus
gatgggtgtgcaatctgtggcctac

SEQ ID NO: 516441 - DNA, 25 bp, Mus musculus
gatgggtgtgcattctgtggcctac

SEQ ID NO: 516442 - DNA, 25 bp, Mus musculus
gatgggtgttcaacacccctgaaaa

SEQ ID NO: 516443 - DNA, 25 bp, Mus musculus
gatgggtgttcatcacccctgaaaa

SEQ ID NO: 516444 - DNA, 25 bp, Mus musculus
gatgggttaacgagctgttcttgaa

SEQ ID NO: 516445 - DNA, 25 bp, Mus musculus
gatgggttaacgtgctgttcttgaa

SEQ ID NO: 516446 - DNA, 25 bp, Mus musculus
gatgggttacaaatgtagctcagtt

SEQ ID NO: 516447 - DNA, 25 bp, Mus musculus
gatgggttacaattgtagctcagtt

SEQ ID NO: 516448 - DNA, 25 bp, Mus musculus
gatgggttactacgccaaggcttca

SEQ ID NO: 516449 - DNA, 25 bp, Mus musculus
gatgggttactaggccaaggcttca

SEQ ID NO: 516450 - DNA, 25 bp, Mus musculus
gatgggttagctctggctcttcaca

SEQ ID NO: 516451 - DNA, 25 bp, Mus musculus
gatgggttagctgtggctcttcaca

SEQ ID NO: 516452 - DNA, 25 bp, Mus musculus
gatgggttatgtaacgaaggctgct

SEQ ID NO: 516453 - DNA, 25 bp, Mus musculus
gatgggttatgttacgaaggctgct

SEQ ID NO: 516454 - DNA, 25 bp, Mus musculus
gatgggttcagcacaagctctggct

SEQ ID NO: 516455 - DNA, 25 bp, Mus musculus
gatgggttcagctcaagctctggct

SEQ ID NO: 516456 - DNA, 25 bp, Mus musculus
gatgggttcccaccagttgagaaac

SEQ ID NO: 516457 - DNA, 25 bp, Mus musculus
gatgggttcccagcagttgagaaac

SEQ ID NO: 516458 - DNA, 25 bp, Mus musculus
gatgggttctggaaggccacctgtc

SEQ ID NO: 516459 - DNA, 25 bp, Mus musculus
gatgggttctggtaggccacctgtc

SEQ ID NO: 516460 - DNA, 25 bp, Mus musculus
gatgggttgaagacagctccgtccc

SEQ ID NO: 516461 - DNA, 25 bp, Mus musculus
gatgggttgaagtcagctccgtccc

SEQ ID NO: 516462 - DNA, 25 bp, Mus musculus
gatgggttgactatatttggtttca

SEQ ID NO: 516463 - DNA, 25 bp, Mus musculus
gatgggttgactttatttggtttca

SEQ ID NO: 516464 - DNA, 25 bp, Mus musculus
gatgggttgatcaattcagctcctt

SEQ ID NO: 516465 - DNA, 25 bp, Mus musculus
gatgggttgatctattcagctcctt

SEQ ID NO: 516466 - DNA, 25 bp, Mus musculus
gatgggttgcttctaatgtcttcat

SEQ ID NO: 516467 - DNA, 25 bp, Mus musculus
gatgggttgcttgtaatgtcttcat

SEQ ID NO: 516468 - DNA, 25 bp, Mus musculus
gatgggttggcaagcccacttttct

SEQ ID NO: 516469 - DNA, 25 bp, Mus musculus
gatgggttggcatgcccacttttct

SEQ ID NO: 516470 - DNA, 25 bp, Mus musculus
gatgggttggttaccacaagctttc

SEQ ID NO: 516471 - DNA, 25 bp, Mus musculus
gatgggttggtttccacaagctttc

SEQ ID NO: 516472 - DNA, 25 bp, Mus musculus
gatgggtttatcattgtactactcc

SEQ ID NO: 516473 - DNA, 25 bp, Mus musculus
gatgggtttatctttgtactactcc

SEQ ID NO: 516474 - DNA, 25 bp, Mus musculus
gatgggtttcaacacactacacaga

SEQ ID NO: 516475 - DNA, 25 bp, Mus musculus
gatgggtttcaagacactacacaga

SEQ ID NO: 516476 - DNA, 25 bp, Mus musculus
gatgggtttcataatattagctttc

SEQ ID NO: 516477 - DNA, 25 bp, Mus musculus
gatgggtttcattatattagctttc

SEQ ID NO: 516478 - DNA, 25 bp, Mus musculus
gatgggtttcctactttatgagcac

SEQ ID NO: 516479 - DNA, 25 bp, Mus musculus
gatgggtttccttctttatgagcac

SEQ ID NO: 516480 - DNA, 25 bp, Mus musculus
gatgggtttctgcacagagctcttc

SEQ ID NO: 516481 - DNA, 25 bp, Mus musculus
gatgggtttctggacagagctcttc

SEQ ID NO: 516482 - DNA, 25 bp, Mus musculus
gatgggtttgagatttcagcacaga

SEQ ID NO: 516483 - DNA, 25 bp, Mus musculus
gatgggtttgagttttcagcacaga

SEQ ID NO: 516484 - DNA, 25 bp, Mus musculus
gatgggttttgcacatccctctgag

SEQ ID NO: 516485 - DNA, 25 bp, Mus musculus
gatgggttttgctcatccctctgag

SEQ ID NO: 516486 - DNA, 25 bp, Mus musculus
gatgggtttttccagacttaaagag

SEQ ID NO: 516487 - DNA, 25 bp, Mus musculus
gatgggtttttcgagacttaaagag

SEQ ID NO: 516488 - DNA, 25 bp, Mus musculus
gatggtaaatgccacccactgtgtg

SEQ ID NO: 516489 - DNA, 25 bp, Mus musculus
gatggtaaatgcgacccactgtgtg

SEQ ID NO: 516490 - DNA, 25 bp, Mus musculus
gatggtaaatttcggtcctgcctgg

SEQ ID NO: 516491 - DNA, 25 bp, Mus musculus
gatggtaaatttgggtcctgcctgg

SEQ ID NO: 516492 - DNA, 25 bp, Mus musculus
gatggtaacaccaatggtctcccca

SEQ ID NO: 516493 - DNA, 25 bp, Mus musculus
gatggtaacacctatggtctcccca

SEQ ID NO: 516494 - DNA, 25 bp, Mus musculus
gatggtaacaggatggtctttcaac

SEQ ID NO: 516495 - DNA, 25 bp, Mus musculus
gatggtaacaggttggtctttcaac

SEQ ID NO: 516496 - DNA, 25 bp, Mus musculus
gatggtaaccgtctgttccaagcac

SEQ ID NO: 516497 - DNA, 25 bp, Mus musculus
gatggtaaccgtgtgttccaagcac

SEQ ID NO: 516498 - DNA, 25 bp, Mus musculus
gatggtaactgaaacacgggctcaa

SEQ ID NO: 516499 - DNA, 25 bp, Mus musculus
gatggtaactgatacacgggctcaa

SEQ ID NO: 516500 - DNA, 25 bp, Mus musculus
gatggtaagaagaaaagcacgtttt

SEQ ID NO: 516501 - DNA, 25 bp, Mus musculus
gatggtaagaagtaaagcacgtttt

SEQ ID NO: 516502 - DNA, 25 bp, Mus musculus
gatggtaagaatagccaccacctta

SEQ ID NO: 516503 - DNA, 25 bp, Mus musculus
gatggtaagaattgccaccacctta

SEQ ID NO: 516504 - DNA, 25 bp, Mus musculus
gatggtaagccaattcccctaatgc

SEQ ID NO: 516505 - DNA, 25 bp, Mus musculus
gatggtaagccatttcccctaatgc

SEQ ID NO: 516506 - DNA, 25 bp, Mus musculus
gatggtaagctaagtggtttattta

SEQ ID NO: 516507 - DNA, 25 bp, Mus musculus
gatggtaagctatgtggtttattta

SEQ ID NO: 516508 - DNA, 25 bp, Mus musculus
gatggtaatattctgccaaggattt

SEQ ID NO: 516509 - DNA, 25 bp, Mus musculus
gatggtaatattgtgccaaggattt

SEQ ID NO: 516510 - DNA, 25 bp, Mus musculus
gatggtaatgttcgttcttccttta

SEQ ID NO: 516511 - DNA, 25 bp, Mus musculus
gatggtaatgttggttcttccttta

SEQ ID NO: 516512 - DNA, 25 bp, Mus musculus
gatggtaattatactgtgcaccaga

SEQ ID NO: 516513 - DNA, 25 bp, Mus musculus
gatggtaattattctgtgcaccaga

SEQ ID NO: 516514 - DNA, 25 bp, Mus musculus
gatggtacaagtatccctaagtatc

SEQ ID NO: 516515 - DNA, 25 bp, Mus musculus
gatggtacaagtttccctaagtatc

SEQ ID NO: 516516 - DNA, 25 bp, Mus musculus
gatggtacaggaattctccacccta

SEQ ID NO: 516517 - DNA, 25 bp, Mus musculus
gatggtacaggatttctccacccta

SEQ ID NO: 516518 - DNA, 25 bp, Mus musculus
gatggtacagttactcaagtgattt

SEQ ID NO: 516519 - DNA, 25 bp, Mus musculus
gatggtacagtttctcaagtgattt

SEQ ID NO: 516520 - DNA, 25 bp, Mus musculus
gatggtaccagcagacttccaaccc

SEQ ID NO: 516521 - DNA, 25 bp, Mus musculus
gatggtaccagctgacttccaaccc

SEQ ID NO: 516522 - DNA, 25 bp, Mus musculus
gatggtaccagtaatgtctgtctga

SEQ ID NO: 516523 - DNA, 25 bp, Mus musculus
gatggtaccagttatgtctgtctga

SEQ ID NO: 516524 - DNA, 25 bp, Mus musculus
gatggtaccatgagccgaggcctca

SEQ ID NO: 516525 - DNA, 25 bp, Mus musculus
gatggtaccatgtgccgaggcctca

SEQ ID NO: 516526 - DNA, 25 bp, Mus musculus
gatggtacccaaccttattactcaa

SEQ ID NO: 516527 - DNA, 25 bp, Mus musculus
gatggtacccaagcttattactcaa

SEQ ID NO: 516528 - DNA, 25 bp, Mus musculus
gatggtacccatatattcggacctc

SEQ ID NO: 516529 - DNA, 25 bp, Mus musculus
gatggtacccatttattcggacctc

SEQ ID NO: 516530 - DNA, 25 bp, Mus musculus
gatggtacctacacttttcccgagt

SEQ ID NO: 516531 - DNA, 25 bp, Mus musculus
gatggtacctactcttttcccgagt

SEQ ID NO: 516532 - DNA, 25 bp, Mus musculus
gatggtacctatatggaaacagcag

SEQ ID NO: 516533 - DNA, 25 bp, Mus musculus
gatggtacctatttggaaacagcag

SEQ ID NO: 516534 - DNA, 25 bp, Mus musculus
gatggtacgtttctgaaatgctcaa

SEQ ID NO: 516535 - DNA, 25 bp, Mus musculus
gatggtacgtttgtgaaatgctcaa

SEQ ID NO: 516536 - DNA, 25 bp, Mus musculus
gatggtactcaaaactggaactaca

SEQ ID NO: 516537 - DNA, 25 bp, Mus musculus
gatggtactcaatactggaactaca

SEQ ID NO: 516538 - DNA, 25 bp, Mus musculus
gatggtactcgaaactggaactaca

SEQ ID NO: 516539 - DNA, 25 bp, Mus musculus
gatggtactcgatactggaactaca

SEQ ID NO: 516540 - DNA, 25 bp, Mus musculus
gatggtactctgaatgtcatggaca

SEQ ID NO: 516541 - DNA, 25 bp, Mus musculus
gatggtactctgtatgtcatggaca

SEQ ID NO: 516542 - DNA, 25 bp, Mus musculus
gatggtagaaacagaagcttgggtt

SEQ ID NO: 516543 - DNA, 25 bp, Mus musculus
gatggtagaaactgaagcttgggtt

SEQ ID NO: 516544 - DNA, 25 bp, Mus musculus
gatggtagacacagcttttctttct

SEQ ID NO: 516545 - DNA, 25 bp, Mus musculus
gatggtagacactgcttttctttct

SEQ ID NO: 516546 - DNA, 25 bp, Mus musculus
gatggtagcaaaacttcagagagta

SEQ ID NO: 516547 - DNA, 25 bp, Mus musculus
gatggtagcaaatcttcagagagta

SEQ ID NO: 516548 - DNA, 25 bp, Mus musculus
gatggtaggataatcccgagagctg

SEQ ID NO: 516549 - DNA, 25 bp, Mus musculus
gatggtaggatattcccgagagctg

SEQ ID NO: 516550 - DNA, 25 bp, Mus musculus
gatggtaggcgaaacctcccagaat

SEQ ID NO: 516551 - DNA, 25 bp, Mus musculus
gatggtaggcgatacctcccagaat

SEQ ID NO: 516552 - DNA, 25 bp, Mus musculus
gatggtagtcctactagctgaggcg

SEQ ID NO: 516553 - DNA, 25 bp, Mus musculus
gatggtagtccttctagctgaggcg

SEQ ID NO: 516554 - DNA, 25 bp, Mus musculus
gatggtagtgccatgaacacagcca

SEQ ID NO: 516555 - DNA, 25 bp, Mus musculus
gatggtagtgccttgaacacagcca

SEQ ID NO: 516556 - DNA, 25 bp, Mus musculus
gatggtagtgtcacacaccttcagt

SEQ ID NO: 516557 - DNA, 25 bp, Mus musculus
gatggtagtgtctcacaccttcagt

SEQ ID NO: 516558 - DNA, 25 bp, Mus musculus
gatggtatacagatttcagtaatgt

SEQ ID NO: 516559 - DNA, 25 bp, Mus musculus
gatggtatacagttttcagtaatgt

SEQ ID NO: 516560 - DNA, 25 bp, Mus musculus
gatggtatacctcatgagcgctggt

SEQ ID NO: 516561 - DNA, 25 bp, Mus musculus
gatggtatacctgatgagcgctggt

SEQ ID NO: 516562 - DNA, 25 bp, Mus musculus
gatggtatatatactgatcctaagg

SEQ ID NO: 516563 - DNA, 25 bp, Mus musculus
gatggtatatattctgatcctaagg

SEQ ID NO: 516564 - DNA, 25 bp, Mus musculus
gatggtatcaggcttcatacctatg

SEQ ID NO: 516565 - DNA, 25 bp, Mus musculus
gatggtatcagggttcatacctatg

SEQ ID NO: 516566 - DNA, 25 bp, Mus musculus
gatggtatccaaccaacatgtctct

SEQ ID NO: 516567 - DNA, 25 bp, Mus musculus
gatggtatccaagcaacatgtctct

SEQ ID NO: 516568 - DNA, 25 bp, Mus musculus
gatggtatcccaagttcaacacttg

SEQ ID NO: 516569 - DNA, 25 bp, Mus musculus
gatggtatcccatgttcaacacttg

SEQ ID NO: 516570 - DNA, 25 bp, Mus musculus
gatggtatcgttactgtaccaccag

SEQ ID NO: 516571 - DNA, 25 bp, Mus musculus
gatggtatcgtttctgtaccaccag

SEQ ID NO: 516572 - DNA, 25 bp, Mus musculus
gatggtatctgcatccagaggtgtg

SEQ ID NO: 516573 - DNA, 25 bp, Mus musculus
gatggtatctgcttccagaggtgtg

SEQ ID NO: 516574 - DNA, 25 bp, Mus musculus
gatggtatgcagctgcttgcagaca

SEQ ID NO: 516575 - DNA, 25 bp, Mus musculus
gatggtatgcaggtgcttgcagaca

SEQ ID NO: 516576 - DNA, 25 bp, Mus musculus
gatggtatgcttattgggcctccaa

SEQ ID NO: 516577 - DNA, 25 bp, Mus musculus
gatggtatgctttttgggcctccaa

SEQ ID NO: 516578 - DNA, 25 bp, Mus musculus
gatggtatgggcaatcctacatagt

SEQ ID NO: 516579 - DNA, 25 bp, Mus musculus
gatggtatgggctatcctacatagt

SEQ ID NO: 516580 - DNA, 25 bp, Mus musculus
gatggtatgtcaaatcttctttcta

SEQ ID NO: 516581 - DNA, 25 bp, Mus musculus
gatggtatgtcatatcttctttcta

SEQ ID NO: 516582 - DNA, 25 bp, Mus musculus
gatggtatttagactgtaattcagt

SEQ ID NO: 516583 - DNA, 25 bp, Mus musculus
gatggtatttagtctgtaattcagt

SEQ ID NO: 516584 - DNA, 25 bp, Mus musculus
gatggtcaacacatacatagttttt

SEQ ID NO: 516585 - DNA, 25 bp, Mus musculus
gatggtcaacacttacatagttttt

SEQ ID NO: 516586 - DNA, 25 bp, Mus musculus
gatggtcaagcgagctcctacgtta

SEQ ID NO: 516587 - DNA, 25 bp, Mus musculus
gatggtcaagcgtgctcctacgtta

SEQ ID NO: 516588 - DNA, 25 bp, Mus musculus
gatggtcaagtgagaccctcgccac

SEQ ID NO: 516589 - DNA, 25 bp, Mus musculus
gatggtcaagtgtgaccctcgccac

SEQ ID NO: 516590 - DNA, 25 bp, Mus musculus
gatggtcacattacggatggccttg

SEQ ID NO: 516591 - DNA, 25 bp, Mus musculus
gatggtcacatttcggatggccttg

SEQ ID NO: 516592 - DNA, 25 bp, Mus musculus
gatggtcaccatcaattcccttatg

SEQ ID NO: 516593 - DNA, 25 bp, Mus musculus
gatggtcaccatgaattcccttatg

SEQ ID NO: 516594 - DNA, 25 bp, Mus musculus
gatggtcacgagacctttgccctgt

SEQ ID NO: 516595 - DNA, 25 bp, Mus musculus
gatggtcacgagtcctttgccctgt

SEQ ID NO: 516596 - DNA, 25 bp, Mus musculus
gatggtcacttcaggctttgataca

SEQ ID NO: 516597 - DNA, 25 bp, Mus musculus
gatggtcacttctggctttgataca

SEQ ID NO: 516598 - DNA, 25 bp, Mus musculus
gatggtcactttacactgaaagctg

SEQ ID NO: 516599 - DNA, 25 bp, Mus musculus
gatggtcacttttcactgaaagctg

SEQ ID NO: 516600 - DNA, 25 bp, Mus musculus
gatggtcagaacagcttcagaagca

SEQ ID NO: 516601 - DNA, 25 bp, Mus musculus
gatggtcagaactgcttcagaagca

SEQ ID NO: 516602 - DNA, 25 bp, Mus musculus
gatggtcagaccaacaccgaagctg

SEQ ID NO: 516603 - DNA, 25 bp, Mus musculus
gatggtcagacctacaccgaagctg

SEQ ID NO: 516604 - DNA, 25 bp, Mus musculus
gatggtcagcaacacctaatgaatg

SEQ ID NO: 516605 - DNA, 25 bp, Mus musculus
gatggtcagcaagacctaatgaatg

SEQ ID NO: 516606 - DNA, 25 bp, Mus musculus
gatggtcagcccagtggcagtgctc

SEQ ID NO: 516607 - DNA, 25 bp, Mus musculus
gatggtcagccctgtggcagtgctc

SEQ ID NO: 516608 - DNA, 25 bp, Mus musculus
gatggtcagcctatagtatcagttt

SEQ ID NO: 516609 - DNA, 25 bp, Mus musculus
gatggtcagcctttagtatcagttt

SEQ ID NO: 516610 - DNA, 25 bp, Mus musculus
gatggtcagctaaagcttcacccgc

SEQ ID NO: 516611 - DNA, 25 bp, Mus musculus
gatggtcagctatagcttcacccgc

SEQ ID NO: 516612 - DNA, 25 bp, Mus musculus
gatggtcagcttagttagtatttac

SEQ ID NO: 516613 - DNA, 25 bp, Mus musculus
gatggtcagcttcatttggagacgt

SEQ ID NO: 516614 - DNA, 25 bp, Mus musculus
gatggtcagcttgatttggagacgt

SEQ ID NO: 516615 - DNA, 25 bp, Mus musculus
gatggtcagctttgttagtatttac

SEQ ID NO: 516616 - DNA, 25 bp, Mus musculus
gatggtcagggcatcaaggtcaccc

SEQ ID NO: 516617 - DNA, 25 bp, Mus musculus
gatggtcagggcttcaaggtcaccc

SEQ ID NO: 516618 - DNA, 25 bp, Mus musculus
gatggtcagttaaccagccctgtaa

SEQ ID NO: 516619 - DNA, 25 bp, Mus musculus
gatggtcagttatccagccctgtaa

SEQ ID NO: 516620 - DNA, 25 bp, Mus musculus
gatggtcataggacagtcttccaag

SEQ ID NO: 516621 - DNA, 25 bp, Mus musculus
gatggtcataggtcagtcttccaag

SEQ ID NO: 516622 - DNA, 25 bp, Mus musculus
gatggtcatccaacacgacagtatt

SEQ ID NO: 516623 - DNA, 25 bp, Mus musculus
gatggtcatccatcacgacagtatt

SEQ ID NO: 516624 - DNA, 25 bp, Mus musculus
gatggtcatgcacgtatttctaagt

SEQ ID NO: 516625 - DNA, 25 bp, Mus musculus
gatggtcatgcaggtatttctaagt

SEQ ID NO: 516626 - DNA, 25 bp, Mus musculus
gatggtcatgcgcaggcactgccac

SEQ ID NO: 516627 - DNA, 25 bp, Mus musculus
gatggtcatgcggaggcactgccac

SEQ ID NO: 516628 - DNA, 25 bp, Mus musculus
gatggtcattatatctgcgagccac

SEQ ID NO: 516629 - DNA, 25 bp, Mus musculus
gatggtcattatttctgcgagccac

SEQ ID NO: 516630 - DNA, 25 bp, Mus musculus
gatggtcattccaatggcactgcag

SEQ ID NO: 516631 - DNA, 25 bp, Mus musculus
gatggtcattcctatggcactgcag

SEQ ID NO: 516632 - DNA, 25 bp, Mus musculus
gatggtcatttgattctgcttaaag

SEQ ID NO: 516633 - DNA, 25 bp, Mus musculus
gatggtcatttgtttctgcttaaag

SEQ ID NO: 516634 - DNA, 25 bp, Mus musculus
gatggtcattttactacttggtcaa

SEQ ID NO: 516635 - DNA, 25 bp, Mus musculus
gatggtcattttagctgaggcctcc

SEQ ID NO: 516636 - DNA, 25 bp, Mus musculus
gatggtcatttttctacttggtcaa

SEQ ID NO: 516637 - DNA, 25 bp, Mus musculus
gatggtcatttttgctgaggcctcc

SEQ ID NO: 516638 - DNA, 25 bp, Mus musculus
gatggtccaataaacctgaggagac

SEQ ID NO: 516639 - DNA, 25 bp, Mus musculus
gatggtccaatatacctgaggagac

SEQ ID NO: 516640 - DNA, 25 bp, Mus musculus
gatggtccacatcatgttcctttcg

SEQ ID NO: 516641 - DNA, 25 bp, Mus musculus
gatggtccacatgatgttcctttcg

SEQ ID NO: 516642 - DNA, 25 bp, Mus musculus
gatggtccagcgattgacataccgc

SEQ ID NO: 516643 - DNA, 25 bp, Mus musculus
gatggtccagcgtttgacataccgc

SEQ ID NO: 516644 - DNA, 25 bp, Mus musculus
gatggtccaggcaaagagattcaag

SEQ ID NO: 516645 - DNA, 25 bp, Mus musculus
gatggtccaggctaagagattcaag

SEQ ID NO: 516646 - DNA, 25 bp, Mus musculus
gatggtccagttcaaccagtgttgt

SEQ ID NO: 516647 - DNA, 25 bp, Mus musculus
gatggtccagttgaaccagtgttgt

SEQ ID NO: 516648 - DNA, 25 bp, Mus musculus
gatggtccattgacactggtacttt

SEQ ID NO: 516649 - DNA, 25 bp, Mus musculus
gatggtccattgaggctaacaccca

SEQ ID NO: 516650 - DNA, 25 bp, Mus musculus
gatggtccattgtcactggtacttt

SEQ ID NO: 516651 - DNA, 25 bp, Mus musculus
gatggtccattgtggctaacaccca

SEQ ID NO: 516652 - DNA, 25 bp, Mus musculus
gatggtcccatgcttagagtcagtg

SEQ ID NO: 516653 - DNA, 25 bp, Mus musculus
gatggtcccatggttagagtcagtg

SEQ ID NO: 516654 - DNA, 25 bp, Mus musculus
gatggtcccctcaaatgctctggaa

SEQ ID NO: 516655 - DNA, 25 bp, Mus musculus
gatggtcccctctaatgctctggaa

SEQ ID NO: 516656 - DNA, 25 bp, Mus musculus
gatggtcccgaaccccagggcagct

SEQ ID NO: 516657 - DNA, 25 bp, Mus musculus
gatggtcccgaagcccagggcagct

SEQ ID NO: 516658 - DNA, 25 bp, Mus musculus
gatggtccgcaacagagtgctgttc

SEQ ID NO: 516659 - DNA, 25 bp, Mus musculus
gatggtccgcaagagagtgctgttc

SEQ ID NO: 516660 - DNA, 25 bp, Mus musculus
gatggtccggatatttattagtctt

SEQ ID NO: 516661 - DNA, 25 bp, Mus musculus
gatggtccggatttttattagtctt

SEQ ID NO: 516662 - DNA, 25 bp, Mus musculus
gatggtccggtaaatctccaacaag

SEQ ID NO: 516663 - DNA, 25 bp, Mus musculus
gatggtccggtatatctccaacaag

SEQ ID NO: 516664 - DNA, 25 bp, Mus musculus
gatggtcctcagaccaaaagcctaa

SEQ ID NO: 516665 - DNA, 25 bp, Mus musculus
gatggtcctcagtccaaaagcctaa

SEQ ID NO: 516666 - DNA, 25 bp, Mus musculus
gatggtcctgtaatattccgatttt

SEQ ID NO: 516667 - DNA, 25 bp, Mus musculus
gatggtcctgtattattccgatttt

SEQ ID NO: 516668 - DNA, 25 bp, Mus musculus
gatggtccttagcaagtcccaggaa

SEQ ID NO: 516669 - DNA, 25 bp, Mus musculus
gatggtccttaggaagtcccaggaa

SEQ ID NO: 516670 - DNA, 25 bp, Mus musculus
gatggtccttcaaagctgagactga

SEQ ID NO: 516671 - DNA, 25 bp, Mus musculus
gatggtccttcatagctgagactga

SEQ ID NO: 516672 - DNA, 25 bp, Mus musculus
gatggtcgctatcagcaaggctctg

SEQ ID NO: 516673 - DNA, 25 bp, Mus musculus
gatggtcgctatgagcaaggctctg

SEQ ID NO: 516674 - DNA, 25 bp, Mus musculus
gatggtcggattaggccttttctat

SEQ ID NO: 516675 - DNA, 25 bp, Mus musculus
gatggtcggatttggccttttctat

SEQ ID NO: 516676 - DNA, 25 bp, Mus musculus
gatggtcgtgacaaggaatctccta

SEQ ID NO: 516677 - DNA, 25 bp, Mus musculus
gatggtcgtgactaggaatctccta

SEQ ID NO: 516678 - DNA, 25 bp, Mus musculus
gatggtctaaataagcgggtgtgca

SEQ ID NO: 516679 - DNA, 25 bp, Mus musculus
gatggtctaaattagcgggtgtgca

SEQ ID NO: 516680 - DNA, 25 bp, Mus musculus
gatggtctacggactgcttggctca

SEQ ID NO: 516681 - DNA, 25 bp, Mus musculus
gatggtctacggtctgcttggctca

SEQ ID NO: 516682 - DNA, 25 bp, Mus musculus
gatggtctagaaactcagaacagga

SEQ ID NO: 516683 - DNA, 25 bp, Mus musculus
gatggtctagaaagttgtaccttca

SEQ ID NO: 516684 - DNA, 25 bp, Mus musculus
gatggtctagaatctcagaacagga

SEQ ID NO: 516685 - DNA, 25 bp, Mus musculus
gatggtctagaatgttgtaccttca

SEQ ID NO: 516686 - DNA, 25 bp, Mus musculus
gatggtctataaccgtgacatttaa

SEQ ID NO: 516687 - DNA, 25 bp, Mus musculus
gatggtctataagcgtgacatttaa

SEQ ID NO: 516688 - DNA, 25 bp, Mus musculus
gatggtctatgcagtgtgctcacca

SEQ ID NO: 516689 - DNA, 25 bp, Mus musculus
gatggtctatgctgtgtgctcacca

SEQ ID NO: 516690 - DNA, 25 bp, Mus musculus
gatggtctattgcagcccagttctg

SEQ ID NO: 516691 - DNA, 25 bp, Mus musculus
gatggtctattggagcccagttctg

SEQ ID NO: 516692 - DNA, 25 bp, Mus musculus
gatggtctatttcgcgtttacgtga

SEQ ID NO: 516693 - DNA, 25 bp, Mus musculus
gatggtctatttggcgtttacgtga

SEQ ID NO: 516694 - DNA, 25 bp, Mus musculus
gatggtctcaccagttgctgaaaca

SEQ ID NO: 516695 - DNA, 25 bp, Mus musculus
gatggtctcacctgttgctgaaaca

SEQ ID NO: 516696 - DNA, 25 bp, Mus musculus
gatggtctcagaagctttcctgtgt

SEQ ID NO: 516697 - DNA, 25 bp, Mus musculus
gatggtctcagatgctttcctgtgt

SEQ ID NO: 516698 - DNA, 25 bp, Mus musculus
gatggtctccagcaacctgtcaaaa

SEQ ID NO: 516699 - DNA, 25 bp, Mus musculus
gatggtctccaggaacctgtcaaaa

SEQ ID NO: 516700 - DNA, 25 bp, Mus musculus
gatggtctcctcaaagaggttcctg

SEQ ID NO: 516701 - DNA, 25 bp, Mus musculus
gatggtctcctctaagaggttcctg

SEQ ID NO: 516702 - DNA, 25 bp, Mus musculus
gatggtctctaactcctattgtcgg

SEQ ID NO: 516703 - DNA, 25 bp, Mus musculus
gatggtctctaagtcctattgtcgg

SEQ ID NO: 516704 - DNA, 25 bp, Mus musculus
gatggtctctcaaaagtatttttgt

SEQ ID NO: 516705 - DNA, 25 bp, Mus musculus
gatggtctctcacagctggtgactt

SEQ ID NO: 516706 - DNA, 25 bp, Mus musculus
gatggtctctcagagctggtgactt

SEQ ID NO: 516707 - DNA, 25 bp, Mus musculus
gatggtctctcataagtatttttgt

SEQ ID NO: 516708 - DNA, 25 bp, Mus musculus
gatggtctctctaactttaagtgaa

SEQ ID NO: 516709 - DNA, 25 bp, Mus musculus
gatggtctctctcgattctggcaaa

SEQ ID NO: 516710 - DNA, 25 bp, Mus musculus
gatggtctctctggattctggcaaa

SEQ ID NO: 516711 - DNA, 25 bp, Mus musculus
gatggtctctcttactttaagtgaa

SEQ ID NO: 516712 - DNA, 25 bp, Mus musculus
gatggtctgccaagggtcgcactgc

SEQ ID NO: 516713 - DNA, 25 bp, Mus musculus
gatggtctgccatgggtcgcactgc

SEQ ID NO: 516714 - DNA, 25 bp, Mus musculus
gatggtctggcaatacggtaaacaa

SEQ ID NO: 516715 - DNA, 25 bp, Mus musculus
gatggtctggcattacggtaaacaa

SEQ ID NO: 516716 - DNA, 25 bp, Mus musculus
gatggtctggtacacacaccaacag

SEQ ID NO: 516717 - DNA, 25 bp, Mus musculus
gatggtctggtagacacaccaacag

SEQ ID NO: 516718 - DNA, 25 bp, Mus musculus
gatggtcttaggagatcccagtgaa

SEQ ID NO: 516719 - DNA, 25 bp, Mus musculus
gatggtcttaggtgatcccagtgaa

SEQ ID NO: 516720 - DNA, 25 bp, Mus musculus
gatggtcttcatctgagttgtcttc

SEQ ID NO: 516721 - DNA, 25 bp, Mus musculus
gatggtcttcatgtgagttgtcttc

SEQ ID NO: 516722 - DNA, 25 bp, Mus musculus
gatggtcttctgatgtctcctacaa

SEQ ID NO: 516723 - DNA, 25 bp, Mus musculus
gatggtcttctgttgtctcctacaa

SEQ ID NO: 516724 - DNA, 25 bp, Mus musculus
gatggtcttcttaacttcaagatag

SEQ ID NO: 516725 - DNA, 25 bp, Mus musculus
gatggtcttcttacttccagacttg

SEQ ID NO: 516726 - DNA, 25 bp, Mus musculus
gatggtcttctttacttcaagatag

SEQ ID NO: 516727 - DNA, 25 bp, Mus musculus
gatggtcttctttcttccagacttg

SEQ ID NO: 516728 - DNA, 25 bp, Mus musculus
gatggtcttggactgcctaaacctt

SEQ ID NO: 516729 - DNA, 25 bp, Mus musculus
gatggtcttggagtgcctaaacctt

SEQ ID NO: 516730 - DNA, 25 bp, Mus musculus
gatggtcttgttcaaatccaatttc

SEQ ID NO: 516731 - DNA, 25 bp, Mus musculus
gatggtcttgttgaaatccaatttc

SEQ ID NO: 516732 - DNA, 25 bp, Mus musculus
gatggtctttatcatccactctttc

SEQ ID NO: 516733 - DNA, 25 bp, Mus musculus
gatggtctttatgatccactctttc

SEQ ID NO: 516734 - DNA, 25 bp, Mus musculus
gatggtctttcaacacattgtgatt

SEQ ID NO: 516735 - DNA, 25 bp, Mus musculus
gatggtctttcatcacattgtgatt

SEQ ID NO: 516736 - DNA, 25 bp, Mus musculus
gatggtctttctcaacaggagaata

SEQ ID NO: 516737 - DNA, 25 bp, Mus musculus
gatggtctttctcttttcgttaata

SEQ ID NO: 516738 - DNA, 25 bp, Mus musculus
gatggtctttctgaacaggagaata

SEQ ID NO: 516739 - DNA, 25 bp, Mus musculus
gatggtctttctgttttcgttaata

SEQ ID NO: 516740 - DNA, 25 bp, Mus musculus
gatggtctttggacctgatcacaga

SEQ ID NO: 516741 - DNA, 25 bp, Mus musculus
gatggtctttggtcctgatcacaga

SEQ ID NO: 516742 - DNA, 25 bp, Mus musculus
gatggtcttttgcaagagtagcaat

SEQ ID NO: 516743 - DNA, 25 bp, Mus musculus
gatggtcttttggaagagtagcaat

SEQ ID NO: 516744 - DNA, 25 bp, Mus musculus
gatggtgaaactagctacctccacg

SEQ ID NO: 516745 - DNA, 25 bp, Mus musculus
gatggtgaaacttgctacctccacg

SEQ ID NO: 516746 - DNA, 25 bp, Mus musculus
gatggtgaacacattgtacagccac

SEQ ID NO: 516747 - DNA, 25 bp, Mus musculus
gatggtgaacactttgtacagccac

SEQ ID NO: 516748 - DNA, 25 bp, Mus musculus
gatggtgaactccaggcaacctaag

SEQ ID NO: 516749 - DNA, 25 bp, Mus musculus
gatggtgaactcgaggcaacctaag

SEQ ID NO: 516750 - DNA, 25 bp, Mus musculus
gatggtgaagacctagagtgactta

SEQ ID NO: 516751 - DNA, 25 bp, Mus musculus
gatggtgaagacgtagagtgactta

SEQ ID NO: 516752 - DNA, 25 bp, Mus musculus
gatggtgaagcacagggaacctttc

SEQ ID NO: 516753 - DNA, 25 bp, Mus musculus
gatggtgaagcagagggaacctttc

SEQ ID NO: 516754 - DNA, 25 bp, Mus musculus
gatggtgaagttactgctgctcaac

SEQ ID NO: 516755 - DNA, 25 bp, Mus musculus
gatggtgaagtttctgctgctcaac

SEQ ID NO: 516756 - DNA, 25 bp, Mus musculus
gatggtgacaagaagtttctgtttt

SEQ ID NO: 516757 - DNA, 25 bp, Mus musculus
gatggtgacaagtagtttctgtttt

SEQ ID NO: 516758 - DNA, 25 bp, Mus musculus
gatggtgacaccaggcttccaatga

SEQ ID NO: 516759 - DNA, 25 bp, Mus musculus
gatggtgacacctggcttccaatga

SEQ ID NO: 516760 - DNA, 25 bp, Mus musculus
gatggtgaccagctataagacccca

SEQ ID NO: 516761 - DNA, 25 bp, Mus musculus
gatggtgaccaggtataagacccca

SEQ ID NO: 516762 - DNA, 25 bp, Mus musculus
gatggtgacccaacttgccttcaga

SEQ ID NO: 516763 - DNA, 25 bp, Mus musculus
gatggtgacccatcttgccttcaga

SEQ ID NO: 516764 - DNA, 25 bp, Mus musculus
gatggtgaccctcttgacttgagaa

SEQ ID NO: 516765 - DNA, 25 bp, Mus musculus
gatggtgaccctgttgacttgagaa

SEQ ID NO: 516766 - DNA, 25 bp, Mus musculus
gatggtgacctcaggtctctagtct

SEQ ID NO: 516767 - DNA, 25 bp, Mus musculus
gatggtgacctctggtctctagtct

SEQ ID NO: 516768 - DNA, 25 bp, Mus musculus
gatggtgactgtctacagctgtgca

SEQ ID NO: 516769 - DNA, 25 bp, Mus musculus
gatggtgactgtgtacagctgtgca

SEQ ID NO: 516770 - DNA, 25 bp, Mus musculus
gatggtgagggacaactgctttctc

SEQ ID NO: 516771 - DNA, 25 bp, Mus musculus
gatggtgagggagaactgctttctc

SEQ ID NO: 516772 - DNA, 25 bp, Mus musculus
gatggtgaggtaaagtcacattatt

SEQ ID NO: 516773 - DNA, 25 bp, Mus musculus
gatggtgaggtatagtcacattatt

SEQ ID NO: 516774 - DNA, 25 bp, Mus musculus
gatggtgataacaacgttcgtcgca

SEQ ID NO: 516775 - DNA, 25 bp, Mus musculus
gatggtgataactacgttcgtcgca

SEQ ID NO: 516776 - DNA, 25 bp, Mus musculus
gatggtgataggattacagtaagaa

SEQ ID NO: 516777 - DNA, 25 bp, Mus musculus
gatggtgataggtttacagtaagaa

SEQ ID NO: 516778 - DNA, 25 bp, Mus musculus
gatggtgatattcacttcctgaaga

SEQ ID NO: 516779 - DNA, 25 bp, Mus musculus
gatggtgatattgacttcctgaaga

SEQ ID NO: 516780 - DNA, 25 bp, Mus musculus
gatggtgatcagataggctcttcct

SEQ ID NO: 516781 - DNA, 25 bp, Mus musculus
gatggtgatcagttaggctcttcct

SEQ ID NO: 516782 - DNA, 25 bp, Mus musculus
gatggtgatcatcacttgtacatca

SEQ ID NO: 516783 - DNA, 25 bp, Mus musculus
gatggtgatcatcctcgctattgga

SEQ ID NO: 516784 - DNA, 25 bp, Mus musculus
gatggtgatcatgacttgtacatca

SEQ ID NO: 516785 - DNA, 25 bp, Mus musculus
gatggtgatcatgctcgctattgga

SEQ ID NO: 516786 - DNA, 25 bp, Mus musculus
gatggtgatgatcgctgacgaccca

SEQ ID NO: 516787 - DNA, 25 bp, Mus musculus
gatggtgatgatggctgacgaccca

SEQ ID NO: 516788 - DNA, 25 bp, Mus musculus
gatggtgatgttagattttctttta

SEQ ID NO: 516789 - DNA, 25 bp, Mus musculus
gatggtgatgtttgattttctttta

SEQ ID NO: 516790 - DNA, 25 bp, Mus musculus
gatggtgattatatcatattccttt

SEQ ID NO: 516791 - DNA, 25 bp, Mus musculus
gatggtgattatttcatattccttt

SEQ ID NO: 516792 - DNA, 25 bp, Mus musculus
gatggtgatttgattcctggttttt

SEQ ID NO: 516793 - DNA, 25 bp, Mus musculus
gatggtgatttgtttcctggttttt

SEQ ID NO: 516794 - DNA, 25 bp, Mus musculus
gatggtgcaaaacgcctttaatctc

SEQ ID NO: 516795 - DNA, 25 bp, Mus musculus
gatggtgcaaaaggcctttaatctc

SEQ ID NO: 516796 - DNA, 25 bp, Mus musculus
gatggtgcaccaaacctttgatatg

SEQ ID NO: 516797 - DNA, 25 bp, Mus musculus
gatggtgcaccatacctttgatatg

SEQ ID NO: 516798 - DNA, 25 bp, Mus musculus
gatggtgcacgtagaaaacccacgc

SEQ ID NO: 516799 - DNA, 25 bp, Mus musculus
gatggtgcacgttgaaaacccacgc

SEQ ID NO: 516800 - DNA, 25 bp, Mus musculus
gatggtgcatacctgtctctgtgtc

SEQ ID NO: 516801 - DNA, 25 bp, Mus musculus
gatggtgcatacgtgtctctgtgtc

SEQ ID NO: 516802 - DNA, 25 bp, Mus musculus
gatggtgcatctcaaaaatccagtc

SEQ ID NO: 516803 - DNA, 25 bp, Mus musculus
gatggtgcatctgaaaaatccagtc

SEQ ID NO: 516804 - DNA, 25 bp, Mus musculus
gatggtgccacacaggatgtgctat

SEQ ID NO: 516805 - DNA, 25 bp, Mus musculus
gatggtgccacagaggatgtgctat

SEQ ID NO: 516806 - DNA, 25 bp, Mus musculus
gatggtgccactcaagctttagcga

SEQ ID NO: 516807 - DNA, 25 bp, Mus musculus
gatggtgccactgaagctttagcga

SEQ ID NO: 516808 - DNA, 25 bp, Mus musculus
gatggtgccatacaagcctttgaca

SEQ ID NO: 516809 - DNA, 25 bp, Mus musculus
gatggtgccatagaagcctttgaca

SEQ ID NO: 516810 - DNA, 25 bp, Mus musculus
gatggtgccatgaacccaactgatt

SEQ ID NO: 516811 - DNA, 25 bp, Mus musculus
gatggtgccatgtacccaactgatt

SEQ ID NO: 516812 - DNA, 25 bp, Mus musculus
gatggtgcccaacgtttaggtctat

SEQ ID NO: 516813 - DNA, 25 bp, Mus musculus
gatggtgcccaaggtttaggtctat

SEQ ID NO: 516814 - DNA, 25 bp, Mus musculus
gatggtgccccacgatcatgagcat

SEQ ID NO: 516815 - DNA, 25 bp, Mus musculus
gatggtgccccaggatcatgagcat

SEQ ID NO: 516816 - DNA, 25 bp, Mus musculus
gatggtgccctaagaacactgttct

SEQ ID NO: 516817 - DNA, 25 bp, Mus musculus
gatggtgccctatgaacactgttct

SEQ ID NO: 516818 - DNA, 25 bp, Mus musculus
gatggtgccttcactcaacatggaa

SEQ ID NO: 516819 - DNA, 25 bp, Mus musculus
gatggtgccttctctcaacatggaa

SEQ ID NO: 516820 - DNA, 25 bp, Mus musculus
gatggtgcgtacctttaatcccggc

SEQ ID NO: 516821 - DNA, 25 bp, Mus musculus
gatggtgcgtacgtttaatcccggc

SEQ ID NO: 516822 - DNA, 25 bp, Mus musculus
gatggtgctaacaccctcaaggcag

SEQ ID NO: 516823 - DNA, 25 bp, Mus musculus
gatggtgctaactccctcaaggcag

SEQ ID NO: 516824 - DNA, 25 bp, Mus musculus
gatggtgctactctgggtcttccac

SEQ ID NO: 516825 - DNA, 25 bp, Mus musculus
gatggtgctactctgtctggcctga

SEQ ID NO: 516826 - DNA, 25 bp, Mus musculus
gatggtgctactgtgggtcttccac

SEQ ID NO: 516827 - DNA, 25 bp, Mus musculus
gatggtgctactgtgtctggcctga

SEQ ID NO: 516828 - DNA, 25 bp, Mus musculus
gatggtgctcatctctccagcgagg

SEQ ID NO: 516829 - DNA, 25 bp, Mus musculus
gatggtgctcatgtctccagcgagg

SEQ ID NO: 516830 - DNA, 25 bp, Mus musculus
gatggtgctgcaagtcttctgaata

SEQ ID NO: 516831 - DNA, 25 bp, Mus musculus
gatggtgctgcatgtcttctgaata

SEQ ID NO: 516832 - DNA, 25 bp, Mus musculus
gatggtgcttttccagatttcaaac

SEQ ID NO: 516833 - DNA, 25 bp, Mus musculus
gatggtgcttttgcagatttcaaac

SEQ ID NO: 516834 - DNA, 25 bp, Mus musculus
gatggtggaactcttactgcaggct

SEQ ID NO: 516835 - DNA, 25 bp, Mus musculus
gatggtggaactgttactgcaggct

SEQ ID NO: 516836 - DNA, 25 bp, Mus musculus
gatggtggaattatgagctctgtgt

SEQ ID NO: 516837 - DNA, 25 bp, Mus musculus
gatggtggaattttgagctctgtgt

SEQ ID NO: 516838 - DNA, 25 bp, Mus musculus
gatggtggaccaactgatctctgag

SEQ ID NO: 516839 - DNA, 25 bp, Mus musculus
gatggtggaccatctgatctctgag

SEQ ID NO: 516840 - DNA, 25 bp, Mus musculus
gatggtggagctaggttccttttcc

SEQ ID NO: 516841 - DNA, 25 bp, Mus musculus
gatggtggagcttggttccttttcc

SEQ ID NO: 516842 - DNA, 25 bp, Mus musculus
gatggtggaggcatcaactcagctc

SEQ ID NO: 516843 - DNA, 25 bp, Mus musculus
gatggtggaggcttcaactcagctc

SEQ ID NO: 516844 - DNA, 25 bp, Mus musculus
gatggtggattaccctgctttccta

SEQ ID NO: 516845 - DNA, 25 bp, Mus musculus
gatggtggattagcctgctttccta

SEQ ID NO: 516846 - DNA, 25 bp, Mus musculus
gatggtggcactcagaaatctaaca

SEQ ID NO: 516847 - DNA, 25 bp, Mus musculus
gatggtggcactgagaaatctaaca

SEQ ID NO: 516848 - DNA, 25 bp, Mus musculus
gatggtggcatccatcagccacaat

SEQ ID NO: 516849 - DNA, 25 bp, Mus musculus
gatggtggcatcgatcagccacaat

SEQ ID NO: 516850 - DNA, 25 bp, Mus musculus
gatggtggccgtcctacgcagacaa

SEQ ID NO: 516851 - DNA, 25 bp, Mus musculus
gatggtggccgtgctacgcagacaa

SEQ ID NO: 516852 - DNA, 25 bp, Mus musculus
gatggtggcctaccatgggcggaga

SEQ ID NO: 516853 - DNA, 25 bp, Mus musculus
gatggtggcctagcatgggcggaga

SEQ ID NO: 516854 - DNA, 25 bp, Mus musculus
gatggtggcgctaccaacctaaagg

SEQ ID NO: 516855 - DNA, 25 bp, Mus musculus
gatggtggcgcttccaacctaaagg

SEQ ID NO: 516856 - DNA, 25 bp, Mus musculus
gatggtggctcaaatgctatattca

SEQ ID NO: 516857 - DNA, 25 bp, Mus musculus
gatggtggctcatatgctatattca

SEQ ID NO: 516858 - DNA, 25 bp, Mus musculus
gatggtggctctcatactgacccag

SEQ ID NO: 516859 - DNA, 25 bp, Mus musculus
gatggtggctctgatactgacccag

SEQ ID NO: 516860 - DNA, 25 bp, Mus musculus
gatggtggctgaaaatttactctac

SEQ ID NO: 516861 - DNA, 25 bp, Mus musculus
gatggtggctgataatttactctac

SEQ ID NO: 516862 - DNA, 25 bp, Mus musculus
gatggtggcttgaaatttctctaac

SEQ ID NO: 516863 - DNA, 25 bp, Mus musculus
gatggtggcttgtaatttctctaac

SEQ ID NO: 516864 - DNA, 25 bp, Mus musculus
gatggtgggattactcgcagactct

SEQ ID NO: 516865 - DNA, 25 bp, Mus musculus
gatggtgggatttctcgcagactct

SEQ ID NO: 516866 - DNA, 25 bp, Mus musculus
gatggtgggcagattgaagtggaaa

SEQ ID NO: 516867 - DNA, 25 bp, Mus musculus
gatggtgggcagtttgaagtggaaa

SEQ ID NO: 516868 - DNA, 25 bp, Mus musculus
gatggtggtactagaattgactctt

SEQ ID NO: 516869 - DNA, 25 bp, Mus musculus
gatggtggtacttgaattgactctt

SEQ ID NO: 516870 - DNA, 25 bp, Mus musculus
gatggtggtagcatcttcagtaagt

SEQ ID NO: 516871 - DNA, 25 bp, Mus musculus
gatggtggtagcttcttcagtaagt

SEQ ID NO: 516872 - DNA, 25 bp, Mus musculus
gatggtggtataacgcctgtgctca

SEQ ID NO: 516873 - DNA, 25 bp, Mus musculus
gatggtggtatatcgcctgtgctca

SEQ ID NO: 516874 - DNA, 25 bp, Mus musculus
gatggtggtgagaaaactgcccagt

SEQ ID NO: 516875 - DNA, 25 bp, Mus musculus
gatggtggtgagtaaactgcccagt

SEQ ID NO: 516876 - DNA, 25 bp, Mus musculus
gatggtgtaaccacttcagctgtgt

SEQ ID NO: 516877 - DNA, 25 bp, Mus musculus
gatggtgtaacctcttcagctgtgt

SEQ ID NO: 516878 - DNA, 25 bp, Mus musculus
gatggtgtacaaatctcacttgaca

SEQ ID NO: 516879 - DNA, 25 bp, Mus musculus
gatggtgtacaattctcacttgaca

SEQ ID NO: 516880 - DNA, 25 bp, Mus musculus
gatggtgtacacaccgttaatccca

SEQ ID NO: 516881 - DNA, 25 bp, Mus musculus
gatggtgtacactccgttaatccca

SEQ ID NO: 516882 - DNA, 25 bp, Mus musculus
gatggtgtacatccttcaaaagaac

SEQ ID NO: 516883 - DNA, 25 bp, Mus musculus
gatggtgtacatgcttcaaaagaac

SEQ ID NO: 516884 - DNA, 25 bp, Mus musculus
gatggtgtatccatcctgcatacat

SEQ ID NO: 516885 - DNA, 25 bp, Mus musculus
gatggtgtatccttcctgcatacat

SEQ ID NO: 516886 - DNA, 25 bp, Mus musculus
gatggtgtcacacaagctatggatg

SEQ ID NO: 516887 - DNA, 25 bp, Mus musculus
gatggtgtcacagaagctatggatg

SEQ ID NO: 516888 - DNA, 25 bp, Mus musculus
gatggtgtcttcacttaggagacca

SEQ ID NO: 516889 - DNA, 25 bp, Mus musculus
gatggtgtcttctcttaggagacca

SEQ ID NO: 516890 - DNA, 25 bp, Mus musculus
gatggtgtgaatatgctgacgtgtt

SEQ ID NO: 516891 - DNA, 25 bp, Mus musculus
gatggtgtgaatttgctgacgtgtt

SEQ ID NO: 516892 - DNA, 25 bp, Mus musculus
gatggtgtgaccaggacctaaggat

SEQ ID NO: 516893 - DNA, 25 bp, Mus musculus
gatggtgtgacctggacctaaggat

SEQ ID NO: 516894 - DNA, 25 bp, Mus musculus
gatggtgtgcacatattccctaact

SEQ ID NO: 516895 - DNA, 25 bp, Mus musculus
gatggtgtgcacttattccctaact

SEQ ID NO: 516896 - DNA, 25 bp, Mus musculus
gatggtgtgcctaaaaatgtgtaat

SEQ ID NO: 516897 - DNA, 25 bp, Mus musculus
gatggtgtgccttaaaatgtgtaat

SEQ ID NO: 516898 - DNA, 25 bp, Mus musculus
gatggtgtgctgatactgtgatgtt

SEQ ID NO: 516899 - DNA, 25 bp, Mus musculus
gatggtgtgctgttactgtgatgtt

SEQ ID NO: 516900 - DNA, 25 bp, Mus musculus
gatggtgtggtaatgaccctgccca

SEQ ID NO: 516901 - DNA, 25 bp, Mus musculus
gatggtgtggtattgaccctgccca

SEQ ID NO: 516902 - DNA, 25 bp, Mus musculus
gatggtgtgtgactaccttggccca

SEQ ID NO: 516903 - DNA, 25 bp, Mus musculus
gatggtgtgtgagtaccttggccca

SEQ ID NO: 516904 - DNA, 25 bp, Mus musculus
gatggtgtgtttcattaatgtcaga

SEQ ID NO: 516905 - DNA, 25 bp, Mus musculus
gatggtgtgtttgattaatgtcaga

SEQ ID NO: 516906 - DNA, 25 bp, Mus musculus
gatggtgttacacatggtttggcat

SEQ ID NO: 516907 - DNA, 25 bp, Mus musculus
gatggtgttacagatggtttggcat

SEQ ID NO: 516908 - DNA, 25 bp, Mus musculus
gatggtgttcagaggtatagatccc

SEQ ID NO: 516909 - DNA, 25 bp, Mus musculus
gatggtgttcagtggtatagatccc

SEQ ID NO: 516910 - DNA, 25 bp, Mus musculus
gatggtgttgatcgatggctctcta

SEQ ID NO: 516911 - DNA, 25 bp, Mus musculus
gatggtgttgatggatggctctcta

SEQ ID NO: 516912 - DNA, 25 bp, Mus musculus
gatggtgtttaaattccgacctgaa

SEQ ID NO: 516913 - DNA, 25 bp, Mus musculus
gatggtgtttaactttagtgtccag

SEQ ID NO: 516914 - DNA, 25 bp, Mus musculus
gatggtgtttaagtttagtgtccag

SEQ ID NO: 516915 - DNA, 25 bp, Mus musculus
gatggtgtttaatttccgacctgaa

SEQ ID NO: 516916 - DNA, 25 bp, Mus musculus
gatggttaacaccatgtgactccag

SEQ ID NO: 516917 - DNA, 25 bp, Mus musculus
gatggttaacacgatgtgactccag

SEQ ID NO: 516918 - DNA, 25 bp, Mus musculus
gatggttaacctcacaatgccttat

SEQ ID NO: 516919 - DNA, 25 bp, Mus musculus
gatggttaacctgacaatgccttat

SEQ ID NO: 516920 - DNA, 25 bp, Mus musculus
gatggttaactcattctcagcaact

SEQ ID NO: 516921 - DNA, 25 bp, Mus musculus
gatggttaactctttctcagcaact

SEQ ID NO: 516922 - DNA, 25 bp, Mus musculus
gatggttaagaactccaaacctgag

SEQ ID NO: 516923 - DNA, 25 bp, Mus musculus
gatggttaagaagtccaaacctgag

SEQ ID NO: 516924 - DNA, 25 bp, Mus musculus
gatggttacaaactggcctggtgcc

SEQ ID NO: 516925 - DNA, 25 bp, Mus musculus
gatggttacaaagtggcctggtgcc

SEQ ID NO: 516926 - DNA, 25 bp, Mus musculus
gatggttacatgagccaagactcag

SEQ ID NO: 516927 - DNA, 25 bp, Mus musculus
gatggttacatgtgccaagactcag

SEQ ID NO: 516928 - DNA, 25 bp, Mus musculus
gatggttacccgctcacgtgaaaga

SEQ ID NO: 516929 - DNA, 25 bp, Mus musculus
gatggttacccggtcacgtgaaaga

SEQ ID NO: 516930 - DNA, 25 bp, Mus musculus
gatggttaccgaatagcccagccaa

SEQ ID NO: 516931 - DNA, 25 bp, Mus musculus
gatggttaccgattagcccagccaa

SEQ ID NO: 516932 - DNA, 25 bp, Mus musculus
gatggttactgcattgtagcccaca

SEQ ID NO: 516933 - DNA, 25 bp, Mus musculus
gatggttactgctttgtagcccaca

SEQ ID NO: 516934 - DNA, 25 bp, Mus musculus
gatggttagaaaactccttgctgtt

SEQ ID NO: 516935 - DNA, 25 bp, Mus musculus
gatggttagaaatctccttgctgtt

SEQ ID NO: 516936 - DNA, 25 bp, Mus musculus
gatggttagctcaaggctgtgacct

SEQ ID NO: 516937 - DNA, 25 bp, Mus musculus
gatggttagctctaggctgtgacct

SEQ ID NO: 516938 - DNA, 25 bp, Mus musculus
gatggttatcagaaagtctgacaac

SEQ ID NO: 516939 - DNA, 25 bp, Mus musculus
gatggttatcagtaagtctgacaac

SEQ ID NO: 516940 - DNA, 25 bp, Mus musculus
gatggttatccaagaaggtcaaggc

SEQ ID NO: 516941 - DNA, 25 bp, Mus musculus
gatggttatccatgaaggtcaaggc

SEQ ID NO: 516942 - DNA, 25 bp, Mus musculus
gatggttatccgattagcgtcacca

SEQ ID NO: 516943 - DNA, 25 bp, Mus musculus
gatggttatccgtttagcgtcacca

SEQ ID NO: 516944 - DNA, 25 bp, Mus musculus
gatggttcaagtagtcagctgcctt

SEQ ID NO: 516945 - DNA, 25 bp, Mus musculus
gatggttcaagttgtcagctgcctt

SEQ ID NO: 516946 - DNA, 25 bp, Mus musculus
gatggttcacagatgcttttagctc

SEQ ID NO: 516947 - DNA, 25 bp, Mus musculus
gatggttcacagttgcttttagctc

SEQ ID NO: 516948 - DNA, 25 bp, Mus musculus
gatggttcacatattccatatatat

SEQ ID NO: 516949 - DNA, 25 bp, Mus musculus
gatggttcacattttccatatatat

SEQ ID NO: 516950 - DNA, 25 bp, Mus musculus
gatggttcagagacgtgcaaggtac

SEQ ID NO: 516951 - DNA, 25 bp, Mus musculus
gatggttcagagtcgtgcaaggtac

SEQ ID NO: 516952 - DNA, 25 bp, Mus musculus
gatggttcagatcggccgccacaaa

SEQ ID NO: 516953 - DNA, 25 bp, Mus musculus
gatggttcagatgggccgccacaaa

SEQ ID NO: 516954 - DNA, 25 bp, Mus musculus
gatggttcattcagcccttatttag

SEQ ID NO: 516955 - DNA, 25 bp, Mus musculus
gatggttcattctgcccttatttag

SEQ ID NO: 516956 - DNA, 25 bp, Mus musculus
gatggttccaaacaagcacacaata

SEQ ID NO: 516957 - DNA, 25 bp, Mus musculus
gatggttccaaagaagcacacaata

SEQ ID NO: 516958 - DNA, 25 bp, Mus musculus
gatggttccctccatatagtaggtg

SEQ ID NO: 516959 - DNA, 25 bp, Mus musculus
gatggttccctcgatatagtaggtg

SEQ ID NO: 516960 - DNA, 25 bp, Mus musculus
gatggttccctgaagtcagcctcgg

SEQ ID NO: 516961 - DNA, 25 bp, Mus musculus
gatggttccctgtagtcagcctcgg

SEQ ID NO: 516962 - DNA, 25 bp, Mus musculus
gatggttcctctccacaacactaga

SEQ ID NO: 516963 - DNA, 25 bp, Mus musculus
gatggttcctctgcacaacactaga

SEQ ID NO: 516964 - DNA, 25 bp, Mus musculus
gatggttcctggatagtatgttttt

SEQ ID NO: 516965 - DNA, 25 bp, Mus musculus
gatggttcctggttagtatgttttt

SEQ ID NO: 516966 - DNA, 25 bp, Mus musculus
gatggttccttccatgtgaaaccct

SEQ ID NO: 516967 - DNA, 25 bp, Mus musculus
gatggttccttcgatgtgaaaccct

SEQ ID NO: 516968 - DNA, 25 bp, Mus musculus
gatggttcgacaatgaagctgttac

SEQ ID NO: 516969 - DNA, 25 bp, Mus musculus
gatggttcgacattgaagctgttac

SEQ ID NO: 516970 - DNA, 25 bp, Mus musculus
gatggttcgagcattttctggatac

SEQ ID NO: 516971 - DNA, 25 bp, Mus musculus
gatggttcgagctttttctggatac

SEQ ID NO: 516972 - DNA, 25 bp, Mus musculus
gatggttcgcagatggttcccgtct

SEQ ID NO: 516973 - DNA, 25 bp, Mus musculus
gatggttcgcagttggttcccgtct

SEQ ID NO: 516974 - DNA, 25 bp, Mus musculus
gatggttcgggaataggattctcac

SEQ ID NO: 516975 - DNA, 25 bp, Mus musculus
gatggttcgggattaggattctcac

SEQ ID NO: 516976 - DNA, 25 bp, Mus musculus
gatggttctagtagctcttattctc

SEQ ID NO: 516977 - DNA, 25 bp, Mus musculus
gatggttctagttgctcttattctc

SEQ ID NO: 516978 - DNA, 25 bp, Mus musculus
gatggttctccccttattgatattt

SEQ ID NO: 516979 - DNA, 25 bp, Mus musculus
gatggttctcccgttattgatattt

SEQ ID NO: 516980 - DNA, 25 bp, Mus musculus
gatggttctgacctacccagtggac

SEQ ID NO: 516981 - DNA, 25 bp, Mus musculus
gatggttctgacgtacccagtggac

SEQ ID NO: 516982 - DNA, 25 bp, Mus musculus
gatggttctggaaagctttgctgcc

SEQ ID NO: 516983 - DNA, 25 bp, Mus musculus
gatggttctggatagctttgctgcc

SEQ ID NO: 516984 - DNA, 25 bp, Mus musculus
gatggttctgtaaccttgtgctttt

SEQ ID NO: 516985 - DNA, 25 bp, Mus musculus
gatggttctgtatccttgtgctttt

SEQ ID NO: 516986 - DNA, 25 bp, Mus musculus
gatggttcttggaggtctaacccaa

SEQ ID NO: 516987 - DNA, 25 bp, Mus musculus
gatggttcttggagtcccatgagac

SEQ ID NO: 516988 - DNA, 25 bp, Mus musculus
gatggttcttggtggtctaacccaa

SEQ ID NO: 516989 - DNA, 25 bp, Mus musculus
gatggttcttggtgtcccatgagac

SEQ ID NO: 516990 - DNA, 25 bp, Mus musculus
gatggttctttaactctcctttaat

SEQ ID NO: 516991 - DNA, 25 bp, Mus musculus
gatggttctttatctctcctttaat

SEQ ID NO: 516992 - DNA, 25 bp, Mus musculus
gatggttctttgctgtcgctgtctc

SEQ ID NO: 516993 - DNA, 25 bp, Mus musculus
gatggttctttggtgtcgctgtctc

SEQ ID NO: 516994 - DNA, 25 bp, Mus musculus
gatggttcttttccatatgcatccc

SEQ ID NO: 516995 - DNA, 25 bp, Mus musculus
gatggttcttttgcatatgcatccc

SEQ ID NO: 516996 - DNA, 25 bp, Mus musculus
gatggttgaatgctgtattttgtaa

SEQ ID NO: 516997 - DNA, 25 bp, Mus musculus
gatggttgaatggtgtattttgtaa

SEQ ID NO: 516998 - DNA, 25 bp, Mus musculus
gatggttgacagagagatcccagct

SEQ ID NO: 516999 - DNA, 25 bp, Mus musculus
gatggttgacagtgagatcccagct

SEQ ID NO: 517000 - DNA, 25 bp, Mus musculus
gatggttgatgtagcccaatactgc

SEQ ID NO: 517001 - DNA, 25 bp, Mus musculus
gatggttgatgttgcccaatactgc

SEQ ID NO: 517002 - DNA, 25 bp, Mus musculus
gatggttgctgtcatcagtgcttta

SEQ ID NO: 517003 - DNA, 25 bp, Mus musculus
gatggttgctgtgatcagtgcttta

SEQ ID NO: 517004 - DNA, 25 bp, Mus musculus
gatggttggacactctgcccagagc

SEQ ID NO: 517005 - DNA, 25 bp, Mus musculus
gatggttggacagtctgcccagagc

SEQ ID NO: 517006 - DNA, 25 bp, Mus musculus
gatggttggctacatgtcacttgac

SEQ ID NO: 517007 - DNA, 25 bp, Mus musculus
gatggttggctagatgtcacttgac

SEQ ID NO: 517008 - DNA, 25 bp, Mus musculus
gatggttgtactactggaaagattt

SEQ ID NO: 517009 - DNA, 25 bp, Mus musculus
gatggttgtacttctggaaagattt

SEQ ID NO: 517010 - DNA, 25 bp, Mus musculus
gatggttgtcaaacgactgaccgaa

SEQ ID NO: 517011 - DNA, 25 bp, Mus musculus
gatggttgtcaatcgactgaccgaa

SEQ ID NO: 517012 - DNA, 25 bp, Mus musculus
gatggtttacagcagattttatttc

SEQ ID NO: 517013 - DNA, 25 bp, Mus musculus
gatggtttacaggagattttatttc

SEQ ID NO: 517014 - DNA, 25 bp, Mus musculus
gatggtttacatctcgaatggtcag

SEQ ID NO: 517015 - DNA, 25 bp, Mus musculus
gatggtttacatgtcgaatggtcag

SEQ ID NO: 517016 - DNA, 25 bp, Mus musculus
gatggtttatccacaagaactggtc

SEQ ID NO: 517017 - DNA, 25 bp, Mus musculus
gatggtttatcctcaagaactggtc

SEQ ID NO: 517018 - DNA, 25 bp, Mus musculus
gatggtttatgactgcaccagctct

SEQ ID NO: 517019 - DNA, 25 bp, Mus musculus
gatggtttatgagtgcaccagctct

SEQ ID NO: 517020 - DNA, 25 bp, Mus musculus
gatggtttcaacaggcatcctgtct

SEQ ID NO: 517021 - DNA, 25 bp, Mus musculus
gatggtttcaactggcatcctgtct

SEQ ID NO: 517022 - DNA, 25 bp, Mus musculus
gatggtttcataaccccacaagagc

SEQ ID NO: 517023 - DNA, 25 bp, Mus musculus
gatggtttcatatccccacaagagc

SEQ ID NO: 517024 - DNA, 25 bp, Mus musculus
gatggtttcattcagcgacaccttc

SEQ ID NO: 517025 - DNA, 25 bp, Mus musculus
gatggtttcattgagcgacaccttc

SEQ ID NO: 517026 - DNA, 25 bp, Mus musculus
gatggtttcggcacttaatctgagc

SEQ ID NO: 517027 - DNA, 25 bp, Mus musculus
gatggtttcggctcttaatctgagc

SEQ ID NO: 517028 - DNA, 25 bp, Mus musculus
gatggtttctagattttcttcctct

SEQ ID NO: 517029 - DNA, 25 bp, Mus musculus
gatggtttctagtttttcttcctct

SEQ ID NO: 517030 - DNA, 25 bp, Mus musculus
gatggtttctgtagttctgctaata

SEQ ID NO: 517031 - DNA, 25 bp, Mus musculus
gatggtttctgttgttctgctaata

SEQ ID NO: 517032 - DNA, 25 bp, Mus musculus
gatggtttctttctctttcagcaaa

SEQ ID NO: 517033 - DNA, 25 bp, Mus musculus
gatggtttctttgtctttcagcaaa

SEQ ID NO: 517034 - DNA, 25 bp, Mus musculus
gatggtttgacaatctcaagacgtt

SEQ ID NO: 517035 - DNA, 25 bp, Mus musculus
gatggtttgacattctcaagacgtt

SEQ ID NO: 517036 - DNA, 25 bp, Mus musculus
gatggtttgagcaagtccctctgca

SEQ ID NO: 517037 - DNA, 25 bp, Mus musculus
gatggtttgagctagtccctctgca

SEQ ID NO: 517038 - DNA, 25 bp, Mus musculus
gatggtttgcatatgtttctgaaac

SEQ ID NO: 517039 - DNA, 25 bp, Mus musculus
gatggtttgcatttgtttctgaaac

SEQ ID NO: 517040 - DNA, 25 bp, Mus musculus
gatggtttgcctccaaaatccgctc

SEQ ID NO: 517041 - DNA, 25 bp, Mus musculus
gatggtttgcctgcaaaatccgctc

SEQ ID NO: 517042 - DNA, 25 bp, Mus musculus
gatggtttgctacttctgcaggcat

SEQ ID NO: 517043 - DNA, 25 bp, Mus musculus
gatggtttgctagttctgcaggcat

SEQ ID NO: 517044 - DNA, 25 bp, Mus musculus
gatggtttgctcaagtctgtcctgc

SEQ ID NO: 517045 - DNA, 25 bp, Mus musculus
gatggtttgctctagtctgtcctgc

SEQ ID NO: 517046 - DNA, 25 bp, Mus musculus
gatggttttacacgccaaggccttg

SEQ ID NO: 517047 - DNA, 25 bp, Mus musculus
gatggttttacaggccaaggccttg

SEQ ID NO: 517048 - DNA, 25 bp, Mus musculus
gatggttttactataggacgtcacg

SEQ ID NO: 517049 - DNA, 25 bp, Mus musculus
gatggttttactttaggacgtcacg

SEQ ID NO: 517050 - DNA, 25 bp, Mus musculus
gatggttttaggacccaaatataca

SEQ ID NO: 517051 - DNA, 25 bp, Mus musculus
gatggttttaggtcccaaatataca

SEQ ID NO: 517052 - DNA, 25 bp, Mus musculus
gatggttttccaactatatgtttag

SEQ ID NO: 517053 - DNA, 25 bp, Mus musculus
gatggttttccatctatatgtttag

SEQ ID NO: 517054 - DNA, 25 bp, Mus musculus
gatggttttctcacttgtaacatgc

SEQ ID NO: 517055 - DNA, 25 bp, Mus musculus
gatggttttctcaggtattaaggct

SEQ ID NO: 517056 - DNA, 25 bp, Mus musculus
gatggttttctctcttgtaacatgc

SEQ ID NO: 517057 - DNA, 25 bp, Mus musculus
gatggttttctctggtattaaggct

SEQ ID NO: 517058 - DNA, 25 bp, Mus musculus
gatggttttgcgattctgtttaaga

SEQ ID NO: 517059 - DNA, 25 bp, Mus musculus
gatggttttgcgtttctgtttaaga

SEQ ID NO: 517060 - DNA, 25 bp, Mus musculus
gatggttttggtaatttccagctgc

SEQ ID NO: 517061 - DNA, 25 bp, Mus musculus
gatggttttggttatttccagctgc

SEQ ID NO: 517062 - DNA, 25 bp, Mus musculus
gatggtttttaaagggctacagggt

SEQ ID NO: 517063 - DNA, 25 bp, Mus musculus
gatggtttttaatgggctacagggt

SEQ ID NO: 517064 - DNA, 25 bp, Mus musculus
gatggtttttagaactataatatca

SEQ ID NO: 517065 - DNA, 25 bp, Mus musculus
gatggtttttagtactataatatca

SEQ ID NO: 517066 - DNA, 25 bp, Mus musculus
gatggtttttcaacaacctttatgc

SEQ ID NO: 517067 - DNA, 25 bp, Mus musculus
gatggtttttcatcaacctttatgc

SEQ ID NO: 517068 - DNA, 25 bp, Mus musculus
gatgtaaaacataagtctgctgtgt

SEQ ID NO: 517069 - DNA, 25 bp, Mus musculus
gatgtaaaacattagtctgctgtgt

SEQ ID NO: 517070 - DNA, 25 bp, Mus musculus
gatgtaaaacccatgagtacagctt

SEQ ID NO: 517071 - DNA, 25 bp, Mus musculus
gatgtaaaacccttgagtacagctt

SEQ ID NO: 517072 - DNA, 25 bp, Mus musculus
gatgtaaacccacggcatcccaagg

SEQ ID NO: 517073 - DNA, 25 bp, Mus musculus
gatgtaaacccagggcatcccaagg

SEQ ID NO: 517074 - DNA, 25 bp, Mus musculus
gatgtaaacgtgatttatgagtgta

SEQ ID NO: 517075 - DNA, 25 bp, Mus musculus
gatgtaaacgtgttttatgagtgta

SEQ ID NO: 517076 - DNA, 25 bp, Mus musculus
gatgtaaagccaactgcacttgcac

SEQ ID NO: 517077 - DNA, 25 bp, Mus musculus
gatgtaaagccatctgcacttgcac

SEQ ID NO: 517078 - DNA, 25 bp, Mus musculus
gatgtaaagccgagccatcgtttta

SEQ ID NO: 517079 - DNA, 25 bp, Mus musculus
gatgtaaagccgtgccatcgtttta

SEQ ID NO: 517080 - DNA, 25 bp, Mus musculus
gatgtaaagcctctgtttgtctaat

SEQ ID NO: 517081 - DNA, 25 bp, Mus musculus
gatgtaaagcctgtgtttgtctaat

SEQ ID NO: 517082 - DNA, 25 bp, Mus musculus
gatgtaaatattccttccactttct

SEQ ID NO: 517083 - DNA, 25 bp, Mus musculus
gatgtaaatattgcttccactttct

SEQ ID NO: 517084 - DNA, 25 bp, Mus musculus
gatgtaaatgaacccataaggttga

SEQ ID NO: 517085 - DNA, 25 bp, Mus musculus
gatgtaaatgaagccataaggttga

SEQ ID NO: 517086 - DNA, 25 bp, Mus musculus
gatgtaaatgataggcactgagtgt

SEQ ID NO: 517087 - DNA, 25 bp, Mus musculus
gatgtaaatgattggcactgagtgt

SEQ ID NO: 517088 - DNA, 25 bp, Mus musculus
gatgtaaatgctcagtcagacacgt

SEQ ID NO: 517089 - DNA, 25 bp, Mus musculus
gatgtaaatgctgagtcagacacgt

SEQ ID NO: 517090 - DNA, 25 bp, Mus musculus
gatgtaaattagctccgtggaaaat

SEQ ID NO: 517091 - DNA, 25 bp, Mus musculus
gatgtaaattaggtccgtggaaaat

SEQ ID NO: 517092 - DNA, 25 bp, Mus musculus
gatgtaaattcccttctcaaatatt

SEQ ID NO: 517093 - DNA, 25 bp, Mus musculus
gatgtaaattccgttctcaaatatt

SEQ ID NO: 517094 - DNA, 25 bp, Mus musculus
gatgtaacaccaaaggcgacctggc

SEQ ID NO: 517095 - DNA, 25 bp, Mus musculus
gatgtaacaccataggcgacctggc

SEQ ID NO: 517096 - DNA, 25 bp, Mus musculus
gatgtaacagaaatgctagagccac

SEQ ID NO: 517097 - DNA, 25 bp, Mus musculus
gatgtaacagaattgctagagccac

SEQ ID NO: 517098 - DNA, 25 bp, Mus musculus
gatgtaaccaacctttctgttcctt

SEQ ID NO: 517099 - DNA, 25 bp, Mus musculus
gatgtaaccaacgtttctgttcctt

SEQ ID NO: 517100 - DNA, 25 bp, Mus musculus
gatgtaacctccaatagcctagacc

SEQ ID NO: 517101 - DNA, 25 bp, Mus musculus
gatgtaacctcctatagcctagacc

SEQ ID NO: 517102 - DNA, 25 bp, Mus musculus
gatgtaactaacagagagccttcca

SEQ ID NO: 517103 - DNA, 25 bp, Mus musculus
gatgtaactaactgagagccttcca

SEQ ID NO: 517104 - DNA, 25 bp, Mus musculus
gatgtaactcagaccgtacctgcat

SEQ ID NO: 517105 - DNA, 25 bp, Mus musculus
gatgtaactcagtccgtacctgcat

SEQ ID NO: 517106 - DNA, 25 bp, Mus musculus
gatgtaactcggacctcccagggtt

SEQ ID NO: 517107 - DNA, 25 bp, Mus musculus
gatgtaactcggtcctcccagggtt

SEQ ID NO: 517108 - DNA, 25 bp, Mus musculus
gatgtaactctgcttatttcagtca

SEQ ID NO: 517109 - DNA, 25 bp, Mus musculus
gatgtaactctggttatttcagtca

SEQ ID NO: 517110 - DNA, 25 bp, Mus musculus
gatgtaactcttcttcggtgactga

SEQ ID NO: 517111 - DNA, 25 bp, Mus musculus
gatgtaactcttgttcggtgactga

SEQ ID NO: 517112 - DNA, 25 bp, Mus musculus
gatgtaacttgcatgctttctgaaa

SEQ ID NO: 517113 - DNA, 25 bp, Mus musculus
gatgtaacttgcttgctttctgaaa

SEQ ID NO: 517114 - DNA, 25 bp, Mus musculus
gatgtaagacatatgatcccctgtt

SEQ ID NO: 517115 - DNA, 25 bp, Mus musculus
gatgtaagacatttgatcccctgtt

SEQ ID NO: 517116 - DNA, 25 bp, Mus musculus
gatgtaagacttctagcagcccacc

SEQ ID NO: 517117 - DNA, 25 bp, Mus musculus
gatgtaagacttgtagcagcccacc

SEQ ID NO: 517118 - DNA, 25 bp, Mus musculus
gatgtaagatgcaaacctcctggcc

SEQ ID NO: 517119 - DNA, 25 bp, Mus musculus
gatgtaagatgctaacctcctggcc

SEQ ID NO: 517120 - DNA, 25 bp, Mus musculus
gatgtaagcaaactctctgtcacag

SEQ ID NO: 517121 - DNA, 25 bp, Mus musculus
gatgtaagcaaagtctctgtcacag

SEQ ID NO: 517122 - DNA, 25 bp, Mus musculus
gatgtaagccatagtgtgtctctag

SEQ ID NO: 517123 - DNA, 25 bp, Mus musculus
gatgtaagccattgtgtgtctctag

SEQ ID NO: 517124 - DNA, 25 bp, Mus musculus
gatgtaagccctctgtatcctatcc

SEQ ID NO: 517125 - DNA, 25 bp, Mus musculus
gatgtaagccctgtgtatcctatcc

SEQ ID NO: 517126 - DNA, 25 bp, Mus musculus
gatgtaaggccaccagaaaggcaga

SEQ ID NO: 517127 - DNA, 25 bp, Mus musculus
gatgtaaggccagcagaaaggcaga

SEQ ID NO: 517128 - DNA, 25 bp, Mus musculus
gatgtaagtccacatggatcctagg

SEQ ID NO: 517129 - DNA, 25 bp, Mus musculus
gatgtaagtccagatggatcctagg

SEQ ID NO: 517130 - DNA, 25 bp, Mus musculus
gatgtaataatcaccagtggccaaa

SEQ ID NO: 517131 - DNA, 25 bp, Mus musculus
gatgtaataatctccagtggccaaa

SEQ ID NO: 517132 - DNA, 25 bp, Mus musculus
gatgtaatacatacggcccttcggg

SEQ ID NO: 517133 - DNA, 25 bp, Mus musculus
gatgtaatacattcggcccttcggg

SEQ ID NO: 517134 - DNA, 25 bp, Mus musculus
gatgtaatacctcagccgtgaacag

SEQ ID NO: 517135 - DNA, 25 bp, Mus musculus
gatgtaatacctgagccgtgaacag

SEQ ID NO: 517136 - DNA, 25 bp, Mus musculus
gatgtaatcactcccatactgcatc

SEQ ID NO: 517137 - DNA, 25 bp, Mus musculus
gatgtaatcactgccatactgcatc

SEQ ID NO: 517138 - DNA, 25 bp, Mus musculus
gatgtaattaatcttgctgctgaga

SEQ ID NO: 517139 - DNA, 25 bp, Mus musculus
gatgtaattaatgttgctgctgaga

SEQ ID NO: 517140 - DNA, 25 bp, Mus musculus
gatgtaattgtaaaagactgccctt

SEQ ID NO: 517141 - DNA, 25 bp, Mus musculus
gatgtaattgtataagactgccctt

SEQ ID NO: 517142 - DNA, 25 bp, Mus musculus
gatgtaatttccctgcctggtcgct

SEQ ID NO: 517143 - DNA, 25 bp, Mus musculus
gatgtaatttccgtgcctggtcgct

SEQ ID NO: 517144 - DNA, 25 bp, Mus musculus
gatgtaatttctaccatgaccccag

SEQ ID NO: 517145 - DNA, 25 bp, Mus musculus
gatgtaatttcttccatgaccccag

SEQ ID NO: 517146 - DNA, 25 bp, Mus musculus
gatgtaatttttaagggaagccagt

SEQ ID NO: 517147 - DNA, 25 bp, Mus musculus
gatgtaattttttagggaagccagt

SEQ ID NO: 517148 - DNA, 25 bp, Mus musculus
gatgtacaaaaccaaccatgatgac

SEQ ID NO: 517149 - DNA, 25 bp, Mus musculus
gatgtacaaaacgaaccatgatgac

SEQ ID NO: 517150 - DNA, 25 bp, Mus musculus
gatgtacaactactttgcctgcgtt

SEQ ID NO: 517151 - DNA, 25 bp, Mus musculus
gatgtacaactagtttgcctgcgtt

SEQ ID NO: 517152 - DNA, 25 bp, Mus musculus
gatgtacaacttattgacctccaga

SEQ ID NO: 517153 - DNA, 25 bp, Mus musculus
gatgtacaactttttgacctccaga

SEQ ID NO: 517154 - DNA, 25 bp, Mus musculus
gatgtacacagtcctctgacagccc

SEQ ID NO: 517155 - DNA, 25 bp, Mus musculus
gatgtacacagtcctggaaatttca

SEQ ID NO: 517156 - DNA, 25 bp, Mus musculus
gatgtacacagtgctctgacagccc

SEQ ID NO: 517157 - DNA, 25 bp, Mus musculus
gatgtacacagtgctggaaatttca

SEQ ID NO: 517158 - DNA, 25 bp, Mus musculus
gatgtacacatccaggcacgagact

SEQ ID NO: 517159 - DNA, 25 bp, Mus musculus
gatgtacacatcgaggcacgagact

SEQ ID NO: 517160 - DNA, 25 bp, Mus musculus
gatgtacaccttaaattgtagcaca

SEQ ID NO: 517161 - DNA, 25 bp, Mus musculus
gatgtacacctttaattgtagcaca

SEQ ID NO: 517162 - DNA, 25 bp, Mus musculus
gatgtacacgggagcagtcactgct

SEQ ID NO: 517163 - DNA, 25 bp, Mus musculus
gatgtacacgggtgcagtcactgct

SEQ ID NO: 517164 - DNA, 25 bp, Mus musculus
gatgtacactcaacccaaaaaaccc

SEQ ID NO: 517165 - DNA, 25 bp, Mus musculus
gatgtacactcatcccaaaaaaccc

SEQ ID NO: 517166 - DNA, 25 bp, Mus musculus
gatgtacactggatctttttaaaca

SEQ ID NO: 517167 - DNA, 25 bp, Mus musculus
gatgtacactggttctttttaaaca

SEQ ID NO: 517168 - DNA, 25 bp, Mus musculus
gatgtacacttccattttatgtatt

SEQ ID NO: 517169 - DNA, 25 bp, Mus musculus
gatgtacacttcgattttatgtatt

SEQ ID NO: 517170 - DNA, 25 bp, Mus musculus
gatgtacagtccctttccacaacgt

SEQ ID NO: 517171 - DNA, 25 bp, Mus musculus
gatgtacagtccgtttccacaacgt

SEQ ID NO: 517172 - DNA, 25 bp, Mus musculus
gatgtacagtgcaatagctccccgt

SEQ ID NO: 517173 - DNA, 25 bp, Mus musculus
gatgtacagtgctatagctccccgt

SEQ ID NO: 517174 - DNA, 25 bp, Mus musculus
gatgtacagtgtacttattataatg

SEQ ID NO: 517175 - DNA, 25 bp, Mus musculus
gatgtacagtgttcttattataatg

SEQ ID NO: 517176 - DNA, 25 bp, Mus musculus
gatgtacattttacaattccacacc

SEQ ID NO: 517177 - DNA, 25 bp, Mus musculus
gatgtacatttttcaattccacacc

SEQ ID NO: 517178 - DNA, 25 bp, Mus musculus
gatgtaccactacagcagtgcacct

SEQ ID NO: 517179 - DNA, 25 bp, Mus musculus
gatgtaccactagagcagtgcacct

SEQ ID NO: 517180 - DNA, 25 bp, Mus musculus
gatgtaccagacagagttccaggcc

SEQ ID NO: 517181 - DNA, 25 bp, Mus musculus
gatgtaccagactgagttccaggcc

SEQ ID NO: 517182 - DNA, 25 bp, Mus musculus
gatgtacccatcacgagagctatga

SEQ ID NO: 517183 - DNA, 25 bp, Mus musculus
gatgtacccatctcgagagctatga

SEQ ID NO: 517184 - DNA, 25 bp, Mus musculus
gatgtaccgcaaatagcacccagca

SEQ ID NO: 517185 - DNA, 25 bp, Mus musculus
gatgtaccgcaattagcacccagca

SEQ ID NO: 517186 - DNA, 25 bp, Mus musculus
gatgtacctaaaatatgaccatttg

SEQ ID NO: 517187 - DNA, 25 bp, Mus musculus
gatgtacctaaattatgaccatttg

SEQ ID NO: 517188 - DNA, 25 bp, Mus musculus
gatgtacctagtctgcatttgctac

SEQ ID NO: 517189 - DNA, 25 bp, Mus musculus
gatgtacctagtgtgcatttgctac

SEQ ID NO: 517190 - DNA, 25 bp, Mus musculus
gatgtacctgaactctcaaatcatg

SEQ ID NO: 517191 - DNA, 25 bp, Mus musculus
gatgtacctgaagtctcaaatcatg

SEQ ID NO: 517192 - DNA, 25 bp, Mus musculus
gatgtacctgagctttcttatttct

SEQ ID NO: 517193 - DNA, 25 bp, Mus musculus
gatgtacctgagcttttttatgtct

SEQ ID NO: 517194 - DNA, 25 bp, Mus musculus
gatgtacctgaggtttcttatttct

SEQ ID NO: 517195 - DNA, 25 bp, Mus musculus
gatgtacctgaggttttttatgtct

SEQ ID NO: 517196 - DNA, 25 bp, Mus musculus
gatgtacctggcaagggcagctcta

SEQ ID NO: 517197 - DNA, 25 bp, Mus musculus
gatgtacctggctagggcagctcta

SEQ ID NO: 517198 - DNA, 25 bp, Mus musculus
gatgtacctgtgacacaatgcctgc

SEQ ID NO: 517199 - DNA, 25 bp, Mus musculus
gatgtacctgtgtcacaatgcctgc

SEQ ID NO: 517200 - DNA, 25 bp, Mus musculus
gatgtacgatttatctctgatacta

SEQ ID NO: 517201 - DNA, 25 bp, Mus musculus
gatgtacgatttttctctgatacta

SEQ ID NO: 517202 - DNA, 25 bp, Mus musculus
gatgtacggtttcttttagtgacaa

SEQ ID NO: 517203 - DNA, 25 bp, Mus musculus
gatgtacggtttgttttagtgacaa

SEQ ID NO: 517204 - DNA, 25 bp, Mus musculus
gatgtacgtgttatcatgtgtgaga

SEQ ID NO: 517205 - DNA, 25 bp, Mus musculus
gatgtacgtgttttcatgtgtgaga

SEQ ID NO: 517206 - DNA, 25 bp, Mus musculus
gatgtactacagaccaaccctaaac

SEQ ID NO: 517207 - DNA, 25 bp, Mus musculus
gatgtactacagtccaaccctaaac

SEQ ID NO: 517208 - DNA, 25 bp, Mus musculus
gatgtactactcagtgattgccctg

SEQ ID NO: 517209 - DNA, 25 bp, Mus musculus
gatgtactactcattagccatggct

SEQ ID NO: 517210 - DNA, 25 bp, Mus musculus
gatgtactactctgtgattgccctg

SEQ ID NO: 517211 - DNA, 25 bp, Mus musculus
gatgtactactctttagccatggct

SEQ ID NO: 517212 - DNA, 25 bp, Mus musculus
gatgtactactgacttcagtctgga

SEQ ID NO: 517213 - DNA, 25 bp, Mus musculus
gatgtactactgtcttcagtctgga

SEQ ID NO: 517214 - DNA, 25 bp, Mus musculus
gatgtactagctcagattcctgaac

SEQ ID NO: 517215 - DNA, 25 bp, Mus musculus
gatgtactagctgagattcctgaac

SEQ ID NO: 517216 - DNA, 25 bp, Mus musculus
gatgtactatacatattttcctttt

SEQ ID NO: 517217 - DNA, 25 bp, Mus musculus
gatgtactatacttattttcctttt

SEQ ID NO: 517218 - DNA, 25 bp, Mus musculus
gatgtactcagtatgatgctcacat

SEQ ID NO: 517219 - DNA, 25 bp, Mus musculus
gatgtactcagtttgatgctcacat

SEQ ID NO: 517220 - DNA, 25 bp, Mus musculus
gatgtactcgggagactgtgatcct

SEQ ID NO: 517221 - DNA, 25 bp, Mus musculus
gatgtactcgggtgactgtgatcct

SEQ ID NO: 517222 - DNA, 25 bp, Mus musculus
gatgtactctatctaggtagtgaca

SEQ ID NO: 517223 - DNA, 25 bp, Mus musculus
gatgtactctatgtaggtagtgaca

SEQ ID NO: 517224 - DNA, 25 bp, Mus musculus
gatgtactcttgctctgtcaagctc

SEQ ID NO: 517225 - DNA, 25 bp, Mus musculus
gatgtactcttggtctgtcaagctc

SEQ ID NO: 517226 - DNA, 25 bp, Mus musculus
gatgtactgccccaatccacagggt

SEQ ID NO: 517227 - DNA, 25 bp, Mus musculus
gatgtactgcccgaatccacagggt

SEQ ID NO: 517228 - DNA, 25 bp, Mus musculus
gatgtactgctacgactggagagat

SEQ ID NO: 517229 - DNA, 25 bp, Mus musculus
gatgtactgctaggactggagagat

SEQ ID NO: 517230 - DNA, 25 bp, Mus musculus
gatgtactgcttactctatgtggga

SEQ ID NO: 517231 - DNA, 25 bp, Mus musculus
gatgtactgctttctctatgtggga

SEQ ID NO: 517232 - DNA, 25 bp, Mus musculus
gatgtactggacagtcctcacacca

SEQ ID NO: 517233 - DNA, 25 bp, Mus musculus
gatgtactggactgtcctcacacca

SEQ ID NO: 517234 - DNA, 25 bp, Mus musculus
gatgtactggatacctaccgtctga

SEQ ID NO: 517235 - DNA, 25 bp, Mus musculus
gatgtactggattcctaccgtctga

SEQ ID NO: 517236 - DNA, 25 bp, Mus musculus
gatgtactgggcaaggcatcataca

SEQ ID NO: 517237 - DNA, 25 bp, Mus musculus
gatgtactgggctaggcatcataca

SEQ ID NO: 517238 - DNA, 25 bp, Mus musculus
gatgtactgtacagcagctgaagat

SEQ ID NO: 517239 - DNA, 25 bp, Mus musculus
gatgtactgtactgcagctgaagat

SEQ ID NO: 517240 - DNA, 25 bp, Mus musculus
gatgtacttcggatttactcactgc

SEQ ID NO: 517241 - DNA, 25 bp, Mus musculus
gatgtacttcggttttactcactgc

SEQ ID NO: 517242 - DNA, 25 bp, Mus musculus
gatgtacttctcagtggcagtatta

SEQ ID NO: 517243 - DNA, 25 bp, Mus musculus
gatgtacttctctgtggcagtatta

SEQ ID NO: 517244 - DNA, 25 bp, Mus musculus
gatgtacttctgagatttacttgtt

SEQ ID NO: 517245 - DNA, 25 bp, Mus musculus
gatgtacttctgtgatttacttgtt

SEQ ID NO: 517246 - DNA, 25 bp, Mus musculus
gatgtacttcttctaataaggctac

SEQ ID NO: 517247 - DNA, 25 bp, Mus musculus
gatgtacttcttgtaataaggctac

SEQ ID NO: 517248 - DNA, 25 bp, Mus musculus
gatgtacttgcactatcgtttgaag

SEQ ID NO: 517249 - DNA, 25 bp, Mus musculus
gatgtacttgcagtatcgtttgaag

SEQ ID NO: 517250 - DNA, 25 bp, Mus musculus
gatgtacttggtattcagtctcaat

SEQ ID NO: 517251 - DNA, 25 bp, Mus musculus
gatgtacttggttttcagtctcaat

SEQ ID NO: 517252 - DNA, 25 bp, Mus musculus
gatgtactttaaatttgagaacctg

SEQ ID NO: 517253 - DNA, 25 bp, Mus musculus
gatgtactttaattttgagaacctg

SEQ ID NO: 517254 - DNA, 25 bp, Mus musculus
gatgtactttccctactatggcaaa

SEQ ID NO: 517255 - DNA, 25 bp, Mus musculus
gatgtactttccgtactatggcaaa

SEQ ID NO: 517256 - DNA, 25 bp, Mus musculus
gatgtacttttgctttggctctccc

SEQ ID NO: 517257 - DNA, 25 bp, Mus musculus
gatgtacttttggtttggctctccc

SEQ ID NO: 517258 - DNA, 25 bp, Mus musculus
gatgtagaaaacagagctggctcgt

SEQ ID NO: 517259 - DNA, 25 bp, Mus musculus
gatgtagaaaactgagctggctcgt

SEQ ID NO: 517260 - DNA, 25 bp, Mus musculus
gatgtagaacctcccctccggaaga

SEQ ID NO: 517261 - DNA, 25 bp, Mus musculus
gatgtagaacctgccctccggaaga

SEQ ID NO: 517262 - DNA, 25 bp, Mus musculus
gatgtagacagaatgccaaggccaa

SEQ ID NO: 517263 - DNA, 25 bp, Mus musculus
gatgtagacagattgccaaggccaa

SEQ ID NO: 517264 - DNA, 25 bp, Mus musculus
gatgtagacagtcattccagtgttt

SEQ ID NO: 517265 - DNA, 25 bp, Mus musculus
gatgtagacagtgattccagtgttt

SEQ ID NO: 517266 - DNA, 25 bp, Mus musculus
gatgtagactgacttcctgcatgac

SEQ ID NO: 517267 - DNA, 25 bp, Mus musculus
gatgtagactgagttcctgcatgac

SEQ ID NO: 517268 - DNA, 25 bp, Mus musculus
gatgtagacttcaacaaggccaagt

SEQ ID NO: 517269 - DNA, 25 bp, Mus musculus
gatgtagacttctacaaggccaagt

SEQ ID NO: 517270 - DNA, 25 bp, Mus musculus
gatgtagagaacactccccaacaca

SEQ ID NO: 517271 - DNA, 25 bp, Mus musculus
gatgtagagaactctccccaacaca

SEQ ID NO: 517272 - DNA, 25 bp, Mus musculus
gatgtagagtgaaccatttgcttac

SEQ ID NO: 517273 - DNA, 25 bp, Mus musculus
gatgtagagtgatccatttgcttac

SEQ ID NO: 517274 - DNA, 25 bp, Mus musculus
gatgtagatatcagccacctcggtg

SEQ ID NO: 517275 - DNA, 25 bp, Mus musculus
gatgtagatatctgccacctcggtg

SEQ ID NO: 517276 - DNA, 25 bp, Mus musculus
gatgtagatgcaagttctgccacaa

SEQ ID NO: 517277 - DNA, 25 bp, Mus musculus
gatgtagatgcatgttctgccacaa

SEQ ID NO: 517278 - DNA, 25 bp, Mus musculus
gatgtagatggtacaatttgccctt

SEQ ID NO: 517279 - DNA, 25 bp, Mus musculus
gatgtagatggttcaatttgccctt

SEQ ID NO: 517280 - DNA, 25 bp, Mus musculus
gatgtagattccagctagcaccata

SEQ ID NO: 517281 - DNA, 25 bp, Mus musculus
gatgtagattcctgctagcaccata

SEQ ID NO: 517282 - DNA, 25 bp, Mus musculus
gatgtagattcgacctttattggta

SEQ ID NO: 517283 - DNA, 25 bp, Mus musculus
gatgtagattcgtcctttattggta

SEQ ID NO: 517284 - DNA, 25 bp, Mus musculus
gatgtagcagctctaccacaagaga

SEQ ID NO: 517285 - DNA, 25 bp, Mus musculus
gatgtagcagctgtaccacaagaga

SEQ ID NO: 517286 - DNA, 25 bp, Mus musculus
gatgtagcatggaccgcttagctgg

SEQ ID NO: 517287 - DNA, 25 bp, Mus musculus
gatgtagcatggtccgcttagctgg

SEQ ID NO: 517288 - DNA, 25 bp, Mus musculus
gatgtagccaacaggcctttttgaa

SEQ ID NO: 517289 - DNA, 25 bp, Mus musculus
gatgtagccaactggcctttttgaa

SEQ ID NO: 517290 - DNA, 25 bp, Mus musculus
gatgtagccactatccctgtgtata

SEQ ID NO: 517291 - DNA, 25 bp, Mus musculus
gatgtagccactttccctgtgtata

SEQ ID NO: 517292 - DNA, 25 bp, Mus musculus
gatgtagcccaaagaaggtttccgt

SEQ ID NO: 517293 - DNA, 25 bp, Mus musculus
gatgtagcccaatgaaggtttccgt

SEQ ID NO: 517294 - DNA, 25 bp, Mus musculus
gatgtagcccagaggctggacacac

SEQ ID NO: 517295 - DNA, 25 bp, Mus musculus
gatgtagcccagtggctggacacac

SEQ ID NO: 517296 - DNA, 25 bp, Mus musculus
gatgtagcccatcgtagagtcaact

SEQ ID NO: 517297 - DNA, 25 bp, Mus musculus
gatgtagcccatggtagagtcaact

SEQ ID NO: 517298 - DNA, 25 bp, Mus musculus
gatgtagcctacaacttccttattg

SEQ ID NO: 517299 - DNA, 25 bp, Mus musculus
gatgtagcctactacttccttattg

SEQ ID NO: 517300 - DNA, 25 bp, Mus musculus
gatgtagcgctgaccggcaagtgca

SEQ ID NO: 517301 - DNA, 25 bp, Mus musculus
gatgtagcgctgtccggcaagtgca

SEQ ID NO: 517302 - DNA, 25 bp, Mus musculus
gatgtagctgccatttgaaactgtt

SEQ ID NO: 517303 - DNA, 25 bp, Mus musculus
gatgtagctgccttttgaaactgtt

SEQ ID NO: 517304 - DNA, 25 bp, Mus musculus
gatgtagctgctcttctagattgta

SEQ ID NO: 517305 - DNA, 25 bp, Mus musculus
gatgtagctgctgttctagattgta

SEQ ID NO: 517306 - DNA, 25 bp, Mus musculus
gatgtagctgtcactcaggaaatcc

SEQ ID NO: 517307 - DNA, 25 bp, Mus musculus
gatgtagctgtctctcaggaaatcc

SEQ ID NO: 517308 - DNA, 25 bp, Mus musculus
gatgtagcttcccaatttgaaccga

SEQ ID NO: 517309 - DNA, 25 bp, Mus musculus
gatgtagcttccgaatttgaaccga

SEQ ID NO: 517310 - DNA, 25 bp, Mus musculus
gatgtagcttggaggcatttgccag

SEQ ID NO: 517311 - DNA, 25 bp, Mus musculus
gatgtagcttggtggcatttgccag

SEQ ID NO: 517312 - DNA, 25 bp, Mus musculus
gatgtagctttccacaactcattgc

SEQ ID NO: 517313 - DNA, 25 bp, Mus musculus
gatgtagctttcgacaactcattgc

SEQ ID NO: 517314 - DNA, 25 bp, Mus musculus
gatgtaggagttatgtcttagttac

SEQ ID NO: 517315 - DNA, 25 bp, Mus musculus
gatgtaggagttttgtcttagttac

SEQ ID NO: 517316 - DNA, 25 bp, Mus musculus
gatgtaggcaataatgtttgagctt

SEQ ID NO: 517317 - DNA, 25 bp, Mus musculus
gatgtaggcaattatgtttgagctt

SEQ ID NO: 517318 - DNA, 25 bp, Mus musculus
gatgtagtaatcctgctgtggcctt

SEQ ID NO: 517319 - DNA, 25 bp, Mus musculus
gatgtagtaatcgtgctgtggcctt

SEQ ID NO: 517320 - DNA, 25 bp, Mus musculus
gatgtagtagctcgccatttcatgc

SEQ ID NO: 517321 - DNA, 25 bp, Mus musculus
gatgtagtagctggccatttcatgc

SEQ ID NO: 517322 - DNA, 25 bp, Mus musculus
gatgtagtagtgacttactggtttt

SEQ ID NO: 517323 - DNA, 25 bp, Mus musculus
gatgtagtagtgtcttactggtttt

SEQ ID NO: 517324 - DNA, 25 bp, Mus musculus
gatgtagtcacacctttgaatgttt

SEQ ID NO: 517325 - DNA, 25 bp, Mus musculus
gatgtagtcacacgagtctgccttt

SEQ ID NO: 517326 - DNA, 25 bp, Mus musculus
gatgtagtcacagctttgaatgttt

SEQ ID NO: 517327 - DNA, 25 bp, Mus musculus
gatgtagtcacaggagtctgccttt

SEQ ID NO: 517328 - DNA, 25 bp, Mus musculus
gatgtagtcctgaggtagaccagag

SEQ ID NO: 517329 - DNA, 25 bp, Mus musculus
gatgtagtcctgtggtagaccagag

SEQ ID NO: 517330 - DNA, 25 bp, Mus musculus
gatgtagtgctaagtgacaacgttc

SEQ ID NO: 517331 - DNA, 25 bp, Mus musculus
gatgtagtgctatgtgacaacgttc

SEQ ID NO: 517332 - DNA, 25 bp, Mus musculus
gatgtagtgctcatagtgcttcaga

SEQ ID NO: 517333 - DNA, 25 bp, Mus musculus
gatgtagtgctcttagtgcttcaga

SEQ ID NO: 517334 - DNA, 25 bp, Mus musculus
gatgtagtgggcagtcctctaagtg

SEQ ID NO: 517335 - DNA, 25 bp, Mus musculus
gatgtagtgggctgtcctctaagtg

SEQ ID NO: 517336 - DNA, 25 bp, Mus musculus
gatgtagtgtttacttgtacgtaac

SEQ ID NO: 517337 - DNA, 25 bp, Mus musculus
gatgtagtgttttcttgtacgtaac

SEQ ID NO: 517338 - DNA, 25 bp, Mus musculus
gatgtagttcagatgcttgcctgtc

SEQ ID NO: 517339 - DNA, 25 bp, Mus musculus
gatgtagttcagttgcttgcctgtc

SEQ ID NO: 517340 - DNA, 25 bp, Mus musculus
gatgtagttgctcacactattaaac

SEQ ID NO: 517341 - DNA, 25 bp, Mus musculus
gatgtagttgctgacactattaaac

SEQ ID NO: 517342 - DNA, 25 bp, Mus musculus
gatgtagtttcactcattctcatga

SEQ ID NO: 517343 - DNA, 25 bp, Mus musculus
gatgtagtttcagtcattctcatga

SEQ ID NO: 517344 - DNA, 25 bp, Mus musculus
gatgtagtttgcctagcagactcaa

SEQ ID NO: 517345 - DNA, 25 bp, Mus musculus
gatgtagtttgcgtagcagactcaa

SEQ ID NO: 517346 - DNA, 25 bp, Mus musculus
gatgtagtttgtctcctgaaagctc

SEQ ID NO: 517347 - DNA, 25 bp, Mus musculus
gatgtagtttgtgtcctgaaagctc

SEQ ID NO: 517348 - DNA, 25 bp, Mus musculus
gatgtatacaatagctattaaaatg

SEQ ID NO: 517349 - DNA, 25 bp, Mus musculus
gatgtatacaattgctattaaaatg

SEQ ID NO: 517350 - DNA, 25 bp, Mus musculus
gatgtatagaccattctccctacac

SEQ ID NO: 517351 - DNA, 25 bp, Mus musculus
gatgtatagacctttctccctacac

SEQ ID NO: 517352 - DNA, 25 bp, Mus musculus
gatgtatatcccagcgactacttcc

SEQ ID NO: 517353 - DNA, 25 bp, Mus musculus
gatgtatatccctgcgactacttcc

SEQ ID NO: 517354 - DNA, 25 bp, Mus musculus
gatgtatatgccaatcccaggaaca

SEQ ID NO: 517355 - DNA, 25 bp, Mus musculus
gatgtatatgcctatcccaggaaca

SEQ ID NO: 517356 - DNA, 25 bp, Mus musculus
gatgtatatgtccaaggcttggaag

SEQ ID NO: 517357 - DNA, 25 bp, Mus musculus
gatgtatatgtcgaaggcttggaag

SEQ ID NO: 517358 - DNA, 25 bp, Mus musculus
gatgtatattaaccagcagccctag

SEQ ID NO: 517359 - DNA, 25 bp, Mus musculus
gatgtatattaagcagcagccctag

SEQ ID NO: 517360 - DNA, 25 bp, Mus musculus
gatgtatattcacgcttccgtgtcc

SEQ ID NO: 517361 - DNA, 25 bp, Mus musculus
gatgtatattcaggcttccgtgtcc

SEQ ID NO: 517362 - DNA, 25 bp, Mus musculus
gatgtatcacttaacgcattttcag

SEQ ID NO: 517363 - DNA, 25 bp, Mus musculus
gatgtatcactttacgcattttcag

SEQ ID NO: 517364 - DNA, 25 bp, Mus musculus
gatgtatcagcccaaggctccagaa

SEQ ID NO: 517365 - DNA, 25 bp, Mus musculus
gatgtatcagccgaaggctccagaa

SEQ ID NO: 517366 - DNA, 25 bp, Mus musculus
gatgtatcaggtctcgagcttgcag

SEQ ID NO: 517367 - DNA, 25 bp, Mus musculus
gatgtatcaggtgtcgagcttgcag

SEQ ID NO: 517368 - DNA, 25 bp, Mus musculus
gatgtatccaaaaccacactggtga

SEQ ID NO: 517369 - DNA, 25 bp, Mus musculus
gatgtatccaaatccacactggtga

SEQ ID NO: 517370 - DNA, 25 bp, Mus musculus
gatgtatcctgaaacagctctgtca

SEQ ID NO: 517371 - DNA, 25 bp, Mus musculus
gatgtatcctgatacagctctgtca

SEQ ID NO: 517372 - DNA, 25 bp, Mus musculus
gatgtatcctgtatgcaaaggcaca

SEQ ID NO: 517373 - DNA, 25 bp, Mus musculus
gatgtatcctgtttgcaaaggcaca

SEQ ID NO: 517374 - DNA, 25 bp, Mus musculus
gatgtatccttcatgtatctgacct

SEQ ID NO: 517375 - DNA, 25 bp, Mus musculus
gatgtatccttcttgtatctgacct

SEQ ID NO: 517376 - DNA, 25 bp, Mus musculus
gatgtatcgaccctccaaagtttca

SEQ ID NO: 517377 - DNA, 25 bp, Mus musculus
gatgtatcgaccgtccaaagtttca

SEQ ID NO: 517378 - DNA, 25 bp, Mus musculus
gatgtatcgcctctacatggcagaa

SEQ ID NO: 517379 - DNA, 25 bp, Mus musculus
gatgtatcgcctgtacatggcagaa

SEQ ID NO: 517380 - DNA, 25 bp, Mus musculus
gatgtatcgttcaatacggtgactt

SEQ ID NO: 517381 - DNA, 25 bp, Mus musculus
gatgtatcgttctatacggtgactt

SEQ ID NO: 517382 - DNA, 25 bp, Mus musculus
gatgtatctagtagtctctgaccaa

SEQ ID NO: 517383 - DNA, 25 bp, Mus musculus
gatgtatctagttgtctctgaccaa

SEQ ID NO: 517384 - DNA, 25 bp, Mus musculus
gatgtatctggaacgtgcattcatt

SEQ ID NO: 517385 - DNA, 25 bp, Mus musculus
gatgtatctggatcgtgcattcatt

SEQ ID NO: 517386 - DNA, 25 bp, Mus musculus
gatgtatgaaacctgggctgtccaa

SEQ ID NO: 517387 - DNA, 25 bp, Mus musculus
gatgtatgaaacgtgggctgtccaa

SEQ ID NO: 517388 - DNA, 25 bp, Mus musculus
gatgtatgaactcttgctcaagcgt

SEQ ID NO: 517389 - DNA, 25 bp, Mus musculus
gatgtatgaactgttgctcaagcgt

SEQ ID NO: 517390 - DNA, 25 bp, Mus musculus
gatgtatgacagattcccaagacta

SEQ ID NO: 517391 - DNA, 25 bp, Mus musculus
gatgtatgacagtttcccaagacta

SEQ ID NO: 517392 - DNA, 25 bp, Mus musculus
gatgtatgactactttgacttcttc

SEQ ID NO: 517393 - DNA, 25 bp, Mus musculus
gatgtatgactagtttgacttcttc

SEQ ID NO: 517394 - DNA, 25 bp, Mus musculus
gatgtatgagtcagctgttgttaaa

SEQ ID NO: 517395 - DNA, 25 bp, Mus musculus
gatgtatgagtctgctgttgttaaa

SEQ ID NO: 517396 - DNA, 25 bp, Mus musculus
gatgtatgccacaggaccctaatta

SEQ ID NO: 517397 - DNA, 25 bp, Mus musculus
gatgtatgccactggaccctaatta

SEQ ID NO: 517398 - DNA, 25 bp, Mus musculus
gatgtatgccatctactactgaaca

SEQ ID NO: 517399 - DNA, 25 bp, Mus musculus
gatgtatgccatgtactactgaaca

SEQ ID NO: 517400 - DNA, 25 bp, Mus musculus
gatgtatggacacacggatgagtaa

SEQ ID NO: 517401 - DNA, 25 bp, Mus musculus
gatgtatggacagacggatgagtaa

SEQ ID NO: 517402 - DNA, 25 bp, Mus musculus
gatgtatggcttcctacgattcaac

SEQ ID NO: 517403 - DNA, 25 bp, Mus musculus
gatgtatggcttgctacgattcaac

SEQ ID NO: 517404 - DNA, 25 bp, Mus musculus
gatgtatggttgacacattacactt

SEQ ID NO: 517405 - DNA, 25 bp, Mus musculus
gatgtatggttgtcacattacactt

SEQ ID NO: 517406 - DNA, 25 bp, Mus musculus
gatgtatgtgttattagctccctat

SEQ ID NO: 517407 - DNA, 25 bp, Mus musculus
gatgtatgtgtttttagctccctat

SEQ ID NO: 517408 - DNA, 25 bp, Mus musculus
gatgtatgtttaaaagttggcccac

SEQ ID NO: 517409 - DNA, 25 bp, Mus musculus
gatgtatgtttataagttggcccac

SEQ ID NO: 517410 - DNA, 25 bp, Mus musculus
gatgtattacacagatttcaactaa

SEQ ID NO: 517411 - DNA, 25 bp, Mus musculus
gatgtattacactgatttcaactaa

SEQ ID NO: 517412 - DNA, 25 bp, Mus musculus
gatgtattccaaatactgcccctga

SEQ ID NO: 517413 - DNA, 25 bp, Mus musculus
gatgtattccaattactgcccctga

SEQ ID NO: 517414 - DNA, 25 bp, Mus musculus
gatgtattccttacatggatactgg

SEQ ID NO: 517415 - DNA, 25 bp, Mus musculus
gatgtattcctttcatggatactgg

SEQ ID NO: 517416 - DNA, 25 bp, Mus musculus
gatgtattctcacatgtaattttat

SEQ ID NO: 517417 - DNA, 25 bp, Mus musculus
gatgtattctcagatgtaattttat

SEQ ID NO: 517418 - DNA, 25 bp, Mus musculus
gatgtattctccatgtatggccact

SEQ ID NO: 517419 - DNA, 25 bp, Mus musculus
gatgtattctccttgtatggccact

SEQ ID NO: 517420 - DNA, 25 bp, Mus musculus
gatgtattcttgctttaacacttac

SEQ ID NO: 517421 - DNA, 25 bp, Mus musculus
gatgtattcttggtttaacacttac

SEQ ID NO: 517422 - DNA, 25 bp, Mus musculus
gatgtattgctaccgatccgttgaa

SEQ ID NO: 517423 - DNA, 25 bp, Mus musculus
gatgtattgctagcgatccgttgaa

SEQ ID NO: 517424 - DNA, 25 bp, Mus musculus
gatgtattgggcaaatcctatttga

SEQ ID NO: 517425 - DNA, 25 bp, Mus musculus
gatgtattgggctaatcctatttga

SEQ ID NO: 517426 - DNA, 25 bp, Mus musculus
gatgtattggtactctcccttagga

SEQ ID NO: 517427 - DNA, 25 bp, Mus musculus
gatgtattggtagtctcccttagga

SEQ ID NO: 517428 - DNA, 25 bp, Mus musculus
gatgtattgtatctaccctttaata

SEQ ID NO: 517429 - DNA, 25 bp, Mus musculus
gatgtattgtatgtaccctttaata

SEQ ID NO: 517430 - DNA, 25 bp, Mus musculus
gatgtattgttaatgccactggctg

SEQ ID NO: 517431 - DNA, 25 bp, Mus musculus
gatgtattgttattgccactggctg

SEQ ID NO: 517432 - DNA, 25 bp, Mus musculus
gatgtattgtttctgacttagatgt

SEQ ID NO: 517433 - DNA, 25 bp, Mus musculus
gatgtattgtttgtgacttagatgt

SEQ ID NO: 517434 - DNA, 25 bp, Mus musculus
gatgtatttaacaggtgcactttgt

SEQ ID NO: 517435 - DNA, 25 bp, Mus musculus
gatgtatttaacagtgcccaccaat

SEQ ID NO: 517436 - DNA, 25 bp, Mus musculus
gatgtatttaactggtgcactttgt

SEQ ID NO: 517437 - DNA, 25 bp, Mus musculus
gatgtatttaactgtgcccaccaat

SEQ ID NO: 517438 - DNA, 25 bp, Mus musculus
gatgtatttcaacgcttcccaagtt

SEQ ID NO: 517439 - DNA, 25 bp, Mus musculus
gatgtatttcaaggcttcccaagtt

SEQ ID NO: 517440 - DNA, 25 bp, Mus musculus
gatgtatttcctaaccaggtacaaa

SEQ ID NO: 517441 - DNA, 25 bp, Mus musculus
gatgtatttcctacgttatgaccaa

SEQ ID NO: 517442 - DNA, 25 bp, Mus musculus
gatgtatttccttaccaggtacaaa

SEQ ID NO: 517443 - DNA, 25 bp, Mus musculus
gatgtatttccttcgttatgaccaa

SEQ ID NO: 517444 - DNA, 25 bp, Mus musculus
gatgtatttgatcctcatggaacat

SEQ ID NO: 517445 - DNA, 25 bp, Mus musculus
gatgtatttgatgctcatggaacat

SEQ ID NO: 517446 - DNA, 25 bp, Mus musculus
gatgtatttgcaaggcattcctcaa

SEQ ID NO: 517447 - DNA, 25 bp, Mus musculus
gatgtatttgcatggcattcctcaa

SEQ ID NO: 517448 - DNA, 25 bp, Mus musculus
gatgtattttacatgagtgccttaa

SEQ ID NO: 517449 - DNA, 25 bp, Mus musculus
gatgtattttacttgagtgccttaa

SEQ ID NO: 517450 - DNA, 25 bp, Mus musculus
gatgtattttataccctccagcttt

SEQ ID NO: 517451 - DNA, 25 bp, Mus musculus
gatgtattttatcgacagtccgtcc

SEQ ID NO: 517452 - DNA, 25 bp, Mus musculus
gatgtattttatggacagtccgtcc

SEQ ID NO: 517453 - DNA, 25 bp, Mus musculus
gatgtattttattccctccagcttt

SEQ ID NO: 517454 - DNA, 25 bp, Mus musculus
gatgtattttcaaatgcacgtctta

SEQ ID NO: 517455 - DNA, 25 bp, Mus musculus
gatgtattttcatatgcacgtctta

SEQ ID NO: 517456 - DNA, 25 bp, Mus musculus
gatgtattttctcttcatagtgtgt

SEQ ID NO: 517457 - DNA, 25 bp, Mus musculus
gatgtattttctgttcatagtgtgt

SEQ ID NO: 517458 - DNA, 25 bp, Mus musculus
gatgtattttggacctgtactgaaa

SEQ ID NO: 517459 - DNA, 25 bp, Mus musculus
gatgtattttggtcctgtactgaaa

SEQ ID NO: 517460 - DNA, 25 bp, Mus musculus
gatgtattttgtatacacaccggga

SEQ ID NO: 517461 - DNA, 25 bp, Mus musculus
gatgtattttgtttacacaccggga

SEQ ID NO: 517462 - DNA, 25 bp, Mus musculus
gatgtcaaaccaatagtcttgttgt

SEQ ID NO: 517463 - DNA, 25 bp, Mus musculus
gatgtcaaaccattagtcttgttgt

SEQ ID NO: 517464 - DNA, 25 bp, Mus musculus
gatgtcaaatatacacttcttagtt

SEQ ID NO: 517465 - DNA, 25 bp, Mus musculus
gatgtcaaatattcacttcttagtt

SEQ ID NO: 517466 - DNA, 25 bp, Mus musculus
gatgtcaacacaccgcccttattga

SEQ ID NO: 517467 - DNA, 25 bp, Mus musculus
gatgtcaacacagcgcccttattga

SEQ ID NO: 517468 - DNA, 25 bp, Mus musculus
gatgtcaaccaaaatacaggctcta

SEQ ID NO: 517469 - DNA, 25 bp, Mus musculus
gatgtcaaccaatatacaggctcta

SEQ ID NO: 517470 - DNA, 25 bp, Mus musculus
gatgtcaacgttatcctggattcta

SEQ ID NO: 517471 - DNA, 25 bp, Mus musculus
gatgtcaacgttttcctggattcta

SEQ ID NO: 517472 - DNA, 25 bp, Mus musculus
gatgtcaagacaccttctttctacc

SEQ ID NO: 517473 - DNA, 25 bp, Mus musculus
gatgtcaagacagcttctttctacc

SEQ ID NO: 517474 - DNA, 25 bp, Mus musculus
gatgtcaagcttcagatgctgagaa

SEQ ID NO: 517475 - DNA, 25 bp, Mus musculus
gatgtcaagcttgagatgctgagaa

SEQ ID NO: 517476 - DNA, 25 bp, Mus musculus
gatgtcaaggacagataaagcccac

SEQ ID NO: 517477 - DNA, 25 bp, Mus musculus
gatgtcaaggactgataaagcccac

SEQ ID NO: 517478 - DNA, 25 bp, Mus musculus
gatgtcaaggttactattaggtttc

SEQ ID NO: 517479 - DNA, 25 bp, Mus musculus
gatgtcaaggtttctattaggtttc

SEQ ID NO: 517480 - DNA, 25 bp, Mus musculus
gatgtcaagttactattggccaaga

SEQ ID NO: 517481 - DNA, 25 bp, Mus musculus
gatgtcaagttagtattggccaaga

SEQ ID NO: 517482 - DNA, 25 bp, Mus musculus
gatgtcaatattctcattcgttagt

SEQ ID NO: 517483 - DNA, 25 bp, Mus musculus
gatgtcaatattgtcattcgttagt

SEQ ID NO: 517484 - DNA, 25 bp, Mus musculus
gatgtcaatgccaaggctagccaga

SEQ ID NO: 517485 - DNA, 25 bp, Mus musculus
gatgtcaatgcctaggctagccaga

SEQ ID NO: 517486 - DNA, 25 bp, Mus musculus
gatgtcaatgggatctgattttata

SEQ ID NO: 517487 - DNA, 25 bp, Mus musculus
gatgtcaatgggttctgattttata

SEQ ID NO: 517488 - DNA, 25 bp, Mus musculus
gatgtcacaataagatccccaggag

SEQ ID NO: 517489 - DNA, 25 bp, Mus musculus
gatgtcacaatatgatccccaggag

SEQ ID NO: 517490 - DNA, 25 bp, Mus musculus
gatgtcacacagattagagcctcga

SEQ ID NO: 517491 - DNA, 25 bp, Mus musculus
gatgtcacacagtttagagcctcga

SEQ ID NO: 517492 - DNA, 25 bp, Mus musculus
gatgtcacaccgatgagagcagcaa

SEQ ID NO: 517493 - DNA, 25 bp, Mus musculus
gatgtcacaccgttgagagcagcaa

SEQ ID NO: 517494 - DNA, 25 bp, Mus musculus
gatgtcacactacttctgtacctag

SEQ ID NO: 517495 - DNA, 25 bp, Mus musculus
gatgtcacactagttctgtacctag

SEQ ID NO: 517496 - DNA, 25 bp, Mus musculus
gatgtcacagccaaaggaggtgtta

SEQ ID NO: 517497 - DNA, 25 bp, Mus musculus
gatgtcacagcctaaggaggtgtta

SEQ ID NO: 517498 - DNA, 25 bp, Mus musculus
gatgtcacatatatataagctgtac

SEQ ID NO: 517499 - DNA, 25 bp, Mus musculus
gatgtcacatatttataagctgtac

SEQ ID NO: 517500 - DNA, 25 bp, Mus musculus
gatgtcacatctctagtcaaaacca

SEQ ID NO: 517501 - DNA, 25 bp, Mus musculus
gatgtcacatctgtagtcaaaacca

SEQ ID NO: 517502 - DNA, 25 bp, Mus musculus
gatgtcacatttcacttgtctctta

SEQ ID NO: 517503 - DNA, 25 bp, Mus musculus
gatgtcacatttcgtccacttgttg

SEQ ID NO: 517504 - DNA, 25 bp, Mus musculus
gatgtcacatttgacttgtctctta

SEQ ID NO: 517505 - DNA, 25 bp, Mus musculus
gatgtcacatttggtccacttgttg

SEQ ID NO: 517506 - DNA, 25 bp, Mus musculus
gatgtcaccaagctgctttgactca

SEQ ID NO: 517507 - DNA, 25 bp, Mus musculus
gatgtcaccaaggtgctttgactca

SEQ ID NO: 517508 - DNA, 25 bp, Mus musculus
gatgtcaccagcattgaaggctcca

SEQ ID NO: 517509 - DNA, 25 bp, Mus musculus
gatgtcaccagctttgaaggctcca

SEQ ID NO: 517510 - DNA, 25 bp, Mus musculus
gatgtcacccagaggcgtgtacctg

SEQ ID NO: 517511 - DNA, 25 bp, Mus musculus
gatgtcacccagtggcgtgtacctg

SEQ ID NO: 517512 - DNA, 25 bp, Mus musculus
gatgtcacccgtcaatcttgtacaa

SEQ ID NO: 517513 - DNA, 25 bp, Mus musculus
gatgtcacccgtgaatcttgtacaa

SEQ ID NO: 517514 - DNA, 25 bp, Mus musculus
gatgtcacctgcagatttacgtaga

SEQ ID NO: 517515 - DNA, 25 bp, Mus musculus
gatgtcacctgctgatttacgtaga

SEQ ID NO: 517516 - DNA, 25 bp, Mus musculus
gatgtcactcatctctctcgggaac

SEQ ID NO: 517517 - DNA, 25 bp, Mus musculus
gatgtcactcatgtctctcgggaac

SEQ ID NO: 517518 - DNA, 25 bp, Mus musculus
gatgtcactcctaatgttgtggcag

SEQ ID NO: 517519 - DNA, 25 bp, Mus musculus
gatgtcactccttatgttgtggcag

SEQ ID NO: 517520 - DNA, 25 bp, Mus musculus
gatgtcactctgactcagcttgtaa

SEQ ID NO: 517521 - DNA, 25 bp, Mus musculus
gatgtcactctgctgaagacgcaac

SEQ ID NO: 517522 - DNA, 25 bp, Mus musculus
gatgtcactctggtgaagacgcaac

SEQ ID NO: 517523 - DNA, 25 bp, Mus musculus
gatgtcactctgtctcagcttgtaa

SEQ ID NO: 517524 - DNA, 25 bp, Mus musculus
gatgtcactgaaaggtgccactccc

SEQ ID NO: 517525 - DNA, 25 bp, Mus musculus
gatgtcactgaatggtgccactccc

SEQ ID NO: 517526 - DNA, 25 bp, Mus musculus
gatgtcactgaccatctatcttttt

SEQ ID NO: 517527 - DNA, 25 bp, Mus musculus
gatgtcactgacgatctatcttttt

SEQ ID NO: 517528 - DNA, 25 bp, Mus musculus
gatgtcactgtacagggtatttgct

SEQ ID NO: 517529 - DNA, 25 bp, Mus musculus
gatgtcactgtagagggtatttgct

SEQ ID NO: 517530 - DNA, 25 bp, Mus musculus
gatgtcacttgtaaaattcactgta

SEQ ID NO: 517531 - DNA, 25 bp, Mus musculus
gatgtcacttgttaaattcactgta

SEQ ID NO: 517532 - DNA, 25 bp, Mus musculus
gatgtcagaacacaaggtacttaca

SEQ ID NO: 517533 - DNA, 25 bp, Mus musculus
gatgtcagaacagaaggtacttaca

SEQ ID NO: 517534 - DNA, 25 bp, Mus musculus
gatgtcagactgaaaagttttgtgt

SEQ ID NO: 517535 - DNA, 25 bp, Mus musculus
gatgtcagactgtaaagttttgtgt

SEQ ID NO: 517536 - DNA, 25 bp, Mus musculus
gatgtcagcaatattgacccagact

SEQ ID NO: 517537 - DNA, 25 bp, Mus musculus
gatgtcagcaattttgacccagact

SEQ ID NO: 517538 - DNA, 25 bp, Mus musculus
gatgtcagcatgaacacacacctta

SEQ ID NO: 517539 - DNA, 25 bp, Mus musculus
gatgtcagcatgtacacacacctta

SEQ ID NO: 517540 - DNA, 25 bp, Mus musculus
gatgtcagccacataggaagctaag

SEQ ID NO: 517541 - DNA, 25 bp, Mus musculus
gatgtcagccacttaggaagctaag

SEQ ID NO: 517542 - DNA, 25 bp, Mus musculus
gatgtcagccatcggcactaggcca

SEQ ID NO: 517543 - DNA, 25 bp, Mus musculus
gatgtcagccatgggcactaggcca

SEQ ID NO: 517544 - DNA, 25 bp, Mus musculus
gatgtcagccccacagaactgtcca

SEQ ID NO: 517545 - DNA, 25 bp, Mus musculus
gatgtcagccccaggagtgaggacc

SEQ ID NO: 517546 - DNA, 25 bp, Mus musculus
gatgtcagcccctcagaactgtcca

SEQ ID NO: 517547 - DNA, 25 bp, Mus musculus
gatgtcagcccctggagtgaggacc

SEQ ID NO: 517548 - DNA, 25 bp, Mus musculus
gatgtcagccggacataggcagttt

SEQ ID NO: 517549 - DNA, 25 bp, Mus musculus
gatgtcagccggtcataggcagttt

SEQ ID NO: 517550 - DNA, 25 bp, Mus musculus
gatgtcagcctgagcgccgcatacg

SEQ ID NO: 517551 - DNA, 25 bp, Mus musculus
gatgtcagcctgtgcgccgcatacg

SEQ ID NO: 517552 - DNA, 25 bp, Mus musculus
gatgtcagcgtgagcctacgagtcc

SEQ ID NO: 517553 - DNA, 25 bp, Mus musculus
gatgtcagcgtgtgcctacgagtcc

SEQ ID NO: 517554 - DNA, 25 bp, Mus musculus
gatgtcagctgtaggttcctgctca

SEQ ID NO: 517555 - DNA, 25 bp, Mus musculus
gatgtcagctgttggttcctgctca

SEQ ID NO: 517556 - DNA, 25 bp, Mus musculus
gatgtcagggatatcttcagtgcca

SEQ ID NO: 517557 - DNA, 25 bp, Mus musculus
gatgtcagggatttcttcagtgcca

SEQ ID NO: 517558 - DNA, 25 bp, Mus musculus
gatgtcaggtgcatataaaccaaac

SEQ ID NO: 517559 - DNA, 25 bp, Mus musculus
gatgtcaggtgcttataaaccaaac

SEQ ID NO: 517560 - DNA, 25 bp, Mus musculus
gatgtcaggttgagcttggtgatca

SEQ ID NO: 517561 - DNA, 25 bp, Mus musculus
gatgtcaggttgtgcttggtgatca

SEQ ID NO: 517562 - DNA, 25 bp, Mus musculus
gatgtcagtcttcagcttagagctc

SEQ ID NO: 517563 - DNA, 25 bp, Mus musculus
gatgtcagtcttgagcttagagctc

SEQ ID NO: 517564 - DNA, 25 bp, Mus musculus
gatgtcagttctaactactatgtaa

SEQ ID NO: 517565 - DNA, 25 bp, Mus musculus
gatgtcagttcttactactatgtaa

SEQ ID NO: 517566 - DNA, 25 bp, Mus musculus
gatgtcataattctgggtgtcactg

SEQ ID NO: 517567 - DNA, 25 bp, Mus musculus
gatgtcataattgtgggtgtcactg

SEQ ID NO: 517568 - DNA, 25 bp, Mus musculus
gatgtcatacaaagtcagaccatag

SEQ ID NO: 517569 - DNA, 25 bp, Mus musculus
gatgtcatacaatgtcagaccatag

SEQ ID NO: 517570 - DNA, 25 bp, Mus musculus
gatgtcatacctattatcctaaatg

SEQ ID NO: 517571 - DNA, 25 bp, Mus musculus
gatgtcataccttttatcctaaatg

SEQ ID NO: 517572 - DNA, 25 bp, Mus musculus
gatgtcatactgactggaggctaac

SEQ ID NO: 517573 - DNA, 25 bp, Mus musculus
gatgtcatactgtctggaggctaac

SEQ ID NO: 517574 - DNA, 25 bp, Mus musculus
gatgtcatagtaattggctgccggg

SEQ ID NO: 517575 - DNA, 25 bp, Mus musculus
gatgtcatagtatttggctgccggg

SEQ ID NO: 517576 - DNA, 25 bp, Mus musculus
gatgtcatagttagtctctgtgtct

SEQ ID NO: 517577 - DNA, 25 bp, Mus musculus
gatgtcatagtttgtctctgtgtct

SEQ ID NO: 517578 - DNA, 25 bp, Mus musculus
gatgtcatattgagccaccatgggg

SEQ ID NO: 517579 - DNA, 25 bp, Mus musculus
gatgtcatattgtgccaccatgggg

SEQ ID NO: 517580 - DNA, 25 bp, Mus musculus
gatgtcatcaccaccagtttgatgg

SEQ ID NO: 517581 - DNA, 25 bp, Mus musculus
gatgtcatcacctccagtttgatgg

SEQ ID NO: 517582 - DNA, 25 bp, Mus musculus
gatgtcatcatgcttttactcgatc

SEQ ID NO: 517583 - DNA, 25 bp, Mus musculus
gatgtcatcatggttttactcgatc

SEQ ID NO: 517584 - DNA, 25 bp, Mus musculus
gatgtcatccctaaaactatggtgg

SEQ ID NO: 517585 - DNA, 25 bp, Mus musculus
gatgtcatcccttaaactatggtgg

SEQ ID NO: 517586 - DNA, 25 bp, Mus musculus
gatgtcatccgaactttggtttcag

SEQ ID NO: 517587 - DNA, 25 bp, Mus musculus
gatgtcatccgatctttggtttcag

SEQ ID NO: 517588 - DNA, 25 bp, Mus musculus
gatgtcatccggacacctgcaggaa

SEQ ID NO: 517589 - DNA, 25 bp, Mus musculus
gatgtcatccggtcacctgcaggaa

SEQ ID NO: 517590 - DNA, 25 bp, Mus musculus
gatgtcatcctcataagctgtgcag

SEQ ID NO: 517591 - DNA, 25 bp, Mus musculus
gatgtcatcctcttaagctgtgcag

SEQ ID NO: 517592 - DNA, 25 bp, Mus musculus
gatgtcatccttctgatggcatgct

SEQ ID NO: 517593 - DNA, 25 bp, Mus musculus
gatgtcatccttgtgatggcatgct

SEQ ID NO: 517594 - DNA, 25 bp, Mus musculus
gatgtcatcgagagtgttcaattca

SEQ ID NO: 517595 - DNA, 25 bp, Mus musculus
gatgtcatcgagtgtgttcaattca

SEQ ID NO: 517596 - DNA, 25 bp, Mus musculus
gatgtcatcggcaacattttccgag

SEQ ID NO: 517597 - DNA, 25 bp, Mus musculus
gatgtcatcggctacattttccgag

SEQ ID NO: 517598 - DNA, 25 bp, Mus musculus
gatgtcatctccaatagagctccga

SEQ ID NO: 517599 - DNA, 25 bp, Mus musculus
gatgtcatctcctatagagctccga

SEQ ID NO: 517600 - DNA, 25 bp, Mus musculus
gatgtcatctgaagagagcaccatg

SEQ ID NO: 517601 - DNA, 25 bp, Mus musculus
gatgtcatctgatgagagcaccatg

SEQ ID NO: 517602 - DNA, 25 bp, Mus musculus
gatgtcatctggctagagactaatg

SEQ ID NO: 517603 - DNA, 25 bp, Mus musculus
gatgtcatctgggtagagactaatg

SEQ ID NO: 517604 - DNA, 25 bp, Mus musculus
gatgtcatcttacgactgcttgtgt

SEQ ID NO: 517605 - DNA, 25 bp, Mus musculus
gatgtcatcttaggactgcttgtgt

SEQ ID NO: 517606 - DNA, 25 bp, Mus musculus
gatgtcatctttccggagagggctt

SEQ ID NO: 517607 - DNA, 25 bp, Mus musculus
gatgtcatctttgcggagagggctt

SEQ ID NO: 517608 - DNA, 25 bp, Mus musculus
gatgtcatgctcacaaactatcctc

SEQ ID NO: 517609 - DNA, 25 bp, Mus musculus
gatgtcatgctctcaaactatcctc

SEQ ID NO: 517610 - DNA, 25 bp, Mus musculus
gatgtcatgctgagtacaatagaga

SEQ ID NO: 517611 - DNA, 25 bp, Mus musculus
gatgtcatgctgagtgcaggagaga

SEQ ID NO: 517612 - DNA, 25 bp, Mus musculus
gatgtcatgctgtgtacaatagaga

SEQ ID NO: 517613 - DNA, 25 bp, Mus musculus
gatgtcatgctgtgtgcaggagaga

SEQ ID NO: 517614 - DNA, 25 bp, Mus musculus
gatgtcatgggtcttctgactcaga

SEQ ID NO: 517615 - DNA, 25 bp, Mus musculus
gatgtcatgggtgttctgactcaga

SEQ ID NO: 517616 - DNA, 25 bp, Mus musculus
gatgtcatgtcaatctcttggctac

SEQ ID NO: 517617 - DNA, 25 bp, Mus musculus
gatgtcatgtcattctcttggctac

SEQ ID NO: 517618 - DNA, 25 bp, Mus musculus
gatgtcattacaaactcccaagata

SEQ ID NO: 517619 - DNA, 25 bp, Mus musculus
gatgtcattacatactcccaagata

SEQ ID NO: 517620 - DNA, 25 bp, Mus musculus
gatgtcattactacctgtattgtca

SEQ ID NO: 517621 - DNA, 25 bp, Mus musculus
gatgtcattacttcctgtattgtca

SEQ ID NO: 517622 - DNA, 25 bp, Mus musculus
gatgtcattatgcaaccccagctgg

SEQ ID NO: 517623 - DNA, 25 bp, Mus musculus
gatgtcattatggaaccccagctgg

SEQ ID NO: 517624 - DNA, 25 bp, Mus musculus
gatgtcattgagcagttcagccata

SEQ ID NO: 517625 - DNA, 25 bp, Mus musculus
gatgtcattgaggagttcagccata

SEQ ID NO: 517626 - DNA, 25 bp, Mus musculus
gatgtcattgatcgctgctcggaga

SEQ ID NO: 517627 - DNA, 25 bp, Mus musculus
gatgtcattgatggctgctcggaga

SEQ ID NO: 517628 - DNA, 25 bp, Mus musculus
gatgtcatttccagtgcgtttccag

SEQ ID NO: 517629 - DNA, 25 bp, Mus musculus
gatgtcatttcctgtgcgtttccag

SEQ ID NO: 517630 - DNA, 25 bp, Mus musculus
gatgtcatttgcattttgtaccatg

SEQ ID NO: 517631 - DNA, 25 bp, Mus musculus
gatgtcatttgctttttgtaccatg

SEQ ID NO: 517632 - DNA, 25 bp, Mus musculus
gatgtcattttaaaccaccaacctg

SEQ ID NO: 517633 - DNA, 25 bp, Mus musculus
gatgtcattttataccaccaacctg

SEQ ID NO: 517634 - DNA, 25 bp, Mus musculus
gatgtcattttcattaacttgttca

SEQ ID NO: 517635 - DNA, 25 bp, Mus musculus
gatgtcattttctttaacttgttca

SEQ ID NO: 517636 - DNA, 25 bp, Mus musculus
gatgtccaaatccaagcactgtcac

SEQ ID NO: 517637 - DNA, 25 bp, Mus musculus
gatgtccaaatcgaagcactgtcac

SEQ ID NO: 517638 - DNA, 25 bp, Mus musculus
gatgtccaaatgcaccaatcaccat

SEQ ID NO: 517639 - DNA, 25 bp, Mus musculus
gatgtccaaatggaccaatcaccat

SEQ ID NO: 517640 - DNA, 25 bp, Mus musculus
gatgtccaacagataatccactaag

SEQ ID NO: 517641 - DNA, 25 bp, Mus musculus
gatgtccaacagttaatccactaag

SEQ ID NO: 517642 - DNA, 25 bp, Mus musculus
gatgtccaagacatctaaggcacca

SEQ ID NO: 517643 - DNA, 25 bp, Mus musculus
gatgtccaagacttctaaggcacca

SEQ ID NO: 517644 - DNA, 25 bp, Mus musculus
gatgtccaagcacgaagcctccaga

SEQ ID NO: 517645 - DNA, 25 bp, Mus musculus
gatgtccaagcaggaagcctccaga

SEQ ID NO: 517646 - DNA, 25 bp, Mus musculus
gatgtccaatacatctctgtaatca

SEQ ID NO: 517647 - DNA, 25 bp, Mus musculus
gatgtccaatacttctctgtaatca

SEQ ID NO: 517648 - DNA, 25 bp, Mus musculus
gatgtccactgaccaacgataggta

SEQ ID NO: 517649 - DNA, 25 bp, Mus musculus
gatgtccactgagcaacgataggta

SEQ ID NO: 517650 - DNA, 25 bp, Mus musculus
gatgtccacttcatccggcaggcgg

SEQ ID NO: 517651 - DNA, 25 bp, Mus musculus
gatgtccacttcttccggcaggcgg

SEQ ID NO: 517652 - DNA, 25 bp, Mus musculus
gatgtccacttgaaaatttcacgca

SEQ ID NO: 517653 - DNA, 25 bp, Mus musculus
gatgtccacttgctgagaaccagga

SEQ ID NO: 517654 - DNA, 25 bp, Mus musculus
gatgtccacttggtgagaaccagga

SEQ ID NO: 517655 - DNA, 25 bp, Mus musculus
gatgtccacttgtaaatttcacgca

SEQ ID NO: 517656 - DNA, 25 bp, Mus musculus
gatgtccagaaaagtcactccctga

SEQ ID NO: 517657 - DNA, 25 bp, Mus musculus
gatgtccagaaatgtcactccctga

SEQ ID NO: 517658 - DNA, 25 bp, Mus musculus
gatgtccagaagaggttgctccaaa

SEQ ID NO: 517659 - DNA, 25 bp, Mus musculus
gatgtccagaagtggttgctccaaa

SEQ ID NO: 517660 - DNA, 25 bp, Mus musculus
gatgtccagattcgcgtatgcaata

SEQ ID NO: 517661 - DNA, 25 bp, Mus musculus
gatgtccagattcttgatctcaatg

SEQ ID NO: 517662 - DNA, 25 bp, Mus musculus
gatgtccagattggcgtatgcaata

SEQ ID NO: 517663 - DNA, 25 bp, Mus musculus
gatgtccagattgttgatctcaatg

SEQ ID NO: 517664 - DNA, 25 bp, Mus musculus
gatgtccagctgactgaatttggct

SEQ ID NO: 517665 - DNA, 25 bp, Mus musculus
gatgtccagctgtctgaatttggct

SEQ ID NO: 517666 - DNA, 25 bp, Mus musculus
gatgtccaggctacagacacgagta

SEQ ID NO: 517667 - DNA, 25 bp, Mus musculus
gatgtccaggcttcagacacgagta

SEQ ID NO: 517668 - DNA, 25 bp, Mus musculus
gatgtccatactcgtttttccaaaa

SEQ ID NO: 517669 - DNA, 25 bp, Mus musculus
gatgtccatactggtttttccaaaa

SEQ ID NO: 517670 - DNA, 25 bp, Mus musculus
gatgtccataggatacactgtgttc

SEQ ID NO: 517671 - DNA, 25 bp, Mus musculus
gatgtccataggttacactgtgttc

SEQ ID NO: 517672 - DNA, 25 bp, Mus musculus
gatgtccatcacctgatgcatgtat

SEQ ID NO: 517673 - DNA, 25 bp, Mus musculus
gatgtccatcacgtgatgcatgtat

SEQ ID NO: 517674 - DNA, 25 bp, Mus musculus
gatgtccatctaaagaggttcccca

SEQ ID NO: 517675 - DNA, 25 bp, Mus musculus
gatgtccatctatagaggttcccca

SEQ ID NO: 517676 - DNA, 25 bp, Mus musculus
gatgtccatcttataaccagactac

SEQ ID NO: 517677 - DNA, 25 bp, Mus musculus
gatgtccatcttttaaccagactac

SEQ ID NO: 517678 - DNA, 25 bp, Mus musculus
gatgtccatgctaacgatcctaaaa

SEQ ID NO: 517679 - DNA, 25 bp, Mus musculus
gatgtccatgcttacgatcctaaaa

SEQ ID NO: 517680 - DNA, 25 bp, Mus musculus
gatgtccatgtaaggcagattgccc

SEQ ID NO: 517681 - DNA, 25 bp, Mus musculus
gatgtccatgtaagtggtgagtcca

SEQ ID NO: 517682 - DNA, 25 bp, Mus musculus
gatgtccatgtatggcagattgccc

SEQ ID NO: 517683 - DNA, 25 bp, Mus musculus
gatgtccatgtatgtggtgagtcca

SEQ ID NO: 517684 - DNA, 25 bp, Mus musculus
gatgtccatttgatactgtgtttgt

SEQ ID NO: 517685 - DNA, 25 bp, Mus musculus
gatgtccatttgttactgtgtttgt

SEQ ID NO: 517686 - DNA, 25 bp, Mus musculus
gatgtcccacatcccaggctgagga

SEQ ID NO: 517687 - DNA, 25 bp, Mus musculus
gatgtcccacatgccaggctgagga

SEQ ID NO: 517688 - DNA, 25 bp, Mus musculus
gatgtcccagaaattatgatcctgt

SEQ ID NO: 517689 - DNA, 25 bp, Mus musculus
gatgtcccagaatttatgatcctgt

SEQ ID NO: 517690 - DNA, 25 bp, Mus musculus
gatgtcccagcaaaggcagacactt

SEQ ID NO: 517691 - DNA, 25 bp, Mus musculus
gatgtcccagcataggcagacactt

SEQ ID NO: 517692 - DNA, 25 bp, Mus musculus
gatgtcccatgtcatgctttattat

SEQ ID NO: 517693 - DNA, 25 bp, Mus musculus
gatgtcccatgtgatgctttattat

SEQ ID NO: 517694 - DNA, 25 bp, Mus musculus
gatgtccccaatcgattatgtgcca

SEQ ID NO: 517695 - DNA, 25 bp, Mus musculus
gatgtccccaatggattatgtgcca

SEQ ID NO: 517696 - DNA, 25 bp, Mus musculus
gatgtccccgttacaagcatcattg

SEQ ID NO: 517697 - DNA, 25 bp, Mus musculus
gatgtccccgtttcaagcatcattg

SEQ ID NO: 517698 - DNA, 25 bp, Mus musculus
gatgtcccctacaaaatccatggtg

SEQ ID NO: 517699 - DNA, 25 bp, Mus musculus
gatgtcccctactaaatccatggtg

SEQ ID NO: 517700 - DNA, 25 bp, Mus musculus
gatgtcccctgtcgcggtagacaga

SEQ ID NO: 517701 - DNA, 25 bp, Mus musculus
gatgtcccctgtctgtggacagtga

SEQ ID NO: 517702 - DNA, 25 bp, Mus musculus
gatgtcccctgtggcggtagacaga

SEQ ID NO: 517703 - DNA, 25 bp, Mus musculus
gatgtcccctgtgtgtggacagtga

SEQ ID NO: 517704 - DNA, 25 bp, Mus musculus
gatgtccccttaaaaagctctcgct

SEQ ID NO: 517705 - DNA, 25 bp, Mus musculus
gatgtccccttataaagctctcgct

SEQ ID NO: 517706 - DNA, 25 bp, Mus musculus
gatgtccctattctccacactgaga

SEQ ID NO: 517707 - DNA, 25 bp, Mus musculus
gatgtccctattgtccacactgaga

SEQ ID NO: 517708 - DNA, 25 bp, Mus musculus
gatgtccctcccagacccatggagg

SEQ ID NO: 517709 - DNA, 25 bp, Mus musculus
gatgtccctccccagattttgaata

SEQ ID NO: 517710 - DNA, 25 bp, Mus musculus
gatgtccctcccgagattttgaata

SEQ ID NO: 517711 - DNA, 25 bp, Mus musculus
gatgtccctccctgacccatggagg

SEQ ID NO: 517712 - DNA, 25 bp, Mus musculus
gatgtccctgcccatcgggatgtgc

SEQ ID NO: 517713 - DNA, 25 bp, Mus musculus
gatgtccctgccgatcgggatgtgc

SEQ ID NO: 517714 - DNA, 25 bp, Mus musculus
gatgtcccttaaagtaaccttctct

SEQ ID NO: 517715 - DNA, 25 bp, Mus musculus
gatgtcccttaatgtaaccttctct

SEQ ID NO: 517716 - DNA, 25 bp, Mus musculus
gatgtcccttacacctaggaaatct

SEQ ID NO: 517717 - DNA, 25 bp, Mus musculus
gatgtcccttactcctaggaaatct

SEQ ID NO: 517718 - DNA, 25 bp, Mus musculus
gatgtccgagtcaagttgtcctgat

SEQ ID NO: 517719 - DNA, 25 bp, Mus musculus
gatgtccgagtctagttgtcctgat

SEQ ID NO: 517720 - DNA, 25 bp, Mus musculus
gatgtccgcaaaaacacttagtgtt

SEQ ID NO: 517721 - DNA, 25 bp, Mus musculus
gatgtccgcaaatacacttagtgtt

SEQ ID NO: 517722 - DNA, 25 bp, Mus musculus
gatgtccgccagaatgttgtcagga

SEQ ID NO: 517723 - DNA, 25 bp, Mus musculus
gatgtccgccagtatgttgtcagga

SEQ ID NO: 517724 - DNA, 25 bp, Mus musculus
gatgtccgtagcctatataaaacct

SEQ ID NO: 517725 - DNA, 25 bp, Mus musculus
gatgtccgtagcgtatataaaacct

SEQ ID NO: 517726 - DNA, 25 bp, Mus musculus
gatgtcctaaaaatgcctatgatgc

SEQ ID NO: 517727 - DNA, 25 bp, Mus musculus
gatgtcctaaaattgcctatgatgc

SEQ ID NO: 517728 - DNA, 25 bp, Mus musculus
gatgtcctaggacaccgtgtgtctt

SEQ ID NO: 517729 - DNA, 25 bp, Mus musculus
gatgtcctaggagaccgtgtgtctt

SEQ ID NO: 517730 - DNA, 25 bp, Mus musculus
gatgtcctaggcaaatgtgtcaaaa

SEQ ID NO: 517731 - DNA, 25 bp, Mus musculus
gatgtcctaggctaatgtgtcaaaa

SEQ ID NO: 517732 - DNA, 25 bp, Mus musculus
gatgtcctcagcacatattatttaa

SEQ ID NO: 517733 - DNA, 25 bp, Mus musculus
gatgtcctcagctcatattatttaa

SEQ ID NO: 517734 - DNA, 25 bp, Mus musculus
gatgtcctccaactctgtgacatat

SEQ ID NO: 517735 - DNA, 25 bp, Mus musculus
gatgtcctccaagtctgtgacatat

SEQ ID NO: 517736 - DNA, 25 bp, Mus musculus
gatgtcctccttctgagacaagctg

SEQ ID NO: 517737 - DNA, 25 bp, Mus musculus
gatgtcctccttgtgagacaagctg

SEQ ID NO: 517738 - DNA, 25 bp, Mus musculus
gatgtcctcttcagtgaatgataat

SEQ ID NO: 517739 - DNA, 25 bp, Mus musculus
gatgtcctcttctgtgaatgataat

SEQ ID NO: 517740 - DNA, 25 bp, Mus musculus
gatgtcctcttgaaagcttgtgtgt

SEQ ID NO: 517741 - DNA, 25 bp, Mus musculus
gatgtcctcttgtaagcttgtgtgt

SEQ ID NO: 517742 - DNA, 25 bp, Mus musculus
gatgtcctgaaaaaccagctgtccg

SEQ ID NO: 517743 - DNA, 25 bp, Mus musculus
gatgtcctgaaataccagctgtccg

SEQ ID NO: 517744 - DNA, 25 bp, Mus musculus
gatgtcctgacaacaaattgctact

SEQ ID NO: 517745 - DNA, 25 bp, Mus musculus
gatgtcctgacaagcaatcgcatta

SEQ ID NO: 517746 - DNA, 25 bp, Mus musculus
gatgtcctgacatcaaattgctact

SEQ ID NO: 517747 - DNA, 25 bp, Mus musculus
gatgtcctgacatgcaatcgcatta

SEQ ID NO: 517748 - DNA, 25 bp, Mus musculus
gatgtcctggcacgatttgcccaag

SEQ ID NO: 517749 - DNA, 25 bp, Mus musculus
gatgtcctggcaggatttgcccaag

SEQ ID NO: 517750 - DNA, 25 bp, Mus musculus
gatgtcctgggccattacaagttgc

SEQ ID NO: 517751 - DNA, 25 bp, Mus musculus
gatgtcctgggcgattacaagttgc

SEQ ID NO: 517752 - DNA, 25 bp, Mus musculus
gatgtcctggtccacagtggcctcc

SEQ ID NO: 517753 - DNA, 25 bp, Mus musculus
gatgtcctggtcgacagtggcctcc

SEQ ID NO: 517754 - DNA, 25 bp, Mus musculus
gatgtcctgtagacttggttctact

SEQ ID NO: 517755 - DNA, 25 bp, Mus musculus
gatgtcctgtagtcttggttctact

SEQ ID NO: 517756 - DNA, 25 bp, Mus musculus
gatgtcctgtctcgcatgcctggga

SEQ ID NO: 517757 - DNA, 25 bp, Mus musculus
gatgtcctgtctctattgttgtgaa

SEQ ID NO: 517758 - DNA, 25 bp, Mus musculus
gatgtcctgtctggcatgcctggga

SEQ ID NO: 517759 - DNA, 25 bp, Mus musculus
gatgtcctgtctgtattgttgtgaa

SEQ ID NO: 517760 - DNA, 25 bp, Mus musculus
gatgtccttaaaaattacccaagct

SEQ ID NO: 517761 - DNA, 25 bp, Mus musculus
gatgtccttaaatattacccaagct

SEQ ID NO: 517762 - DNA, 25 bp, Mus musculus
gatgtccttgatcaacaccgaatat

SEQ ID NO: 517763 - DNA, 25 bp, Mus musculus
gatgtccttgatgaacaccgaatat

SEQ ID NO: 517764 - DNA, 25 bp, Mus musculus
gatgtccttggtacggatatccgga

SEQ ID NO: 517765 - DNA, 25 bp, Mus musculus
gatgtccttggttcggatatccgga

SEQ ID NO: 517766 - DNA, 25 bp, Mus musculus
gatgtcctttaacagctcagcagcg

SEQ ID NO: 517767 - DNA, 25 bp, Mus musculus
gatgtcctttaagagctcagcagcg

SEQ ID NO: 517768 - DNA, 25 bp, Mus musculus
gatgtccttttcaagaccttgttag

SEQ ID NO: 517769 - DNA, 25 bp, Mus musculus
gatgtccttttctagaccttgttag

SEQ ID NO: 517770 - DNA, 25 bp, Mus musculus
gatgtcgaaggactcccttctaggt

SEQ ID NO: 517771 - DNA, 25 bp, Mus musculus
gatgtcgaaggagtcccttctaggt

SEQ ID NO: 517772 - DNA, 25 bp, Mus musculus
gatgtcgacctcagtgaaacgcaca

SEQ ID NO: 517773 - DNA, 25 bp, Mus musculus
gatgtcgacctctgtgaaacgcaca

SEQ ID NO: 517774 - DNA, 25 bp, Mus musculus
gatgtcgagattacacaggtcacta

SEQ ID NO: 517775 - DNA, 25 bp, Mus musculus
gatgtcgagatttcacaggtcacta

SEQ ID NO: 517776 - DNA, 25 bp, Mus musculus
gatgtcgatgctatggactgcacac

SEQ ID NO: 517777 - DNA, 25 bp, Mus musculus
gatgtcgatgctttggactgcacac

SEQ ID NO: 517778 - DNA, 25 bp, Mus musculus
gatgtcgcagtccagatcatatcca

SEQ ID NO: 517779 - DNA, 25 bp, Mus musculus
gatgtcgcagtcgagatcatatcca

SEQ ID NO: 517780 - DNA, 25 bp, Mus musculus
gatgtcgccattccactgagtgagc

SEQ ID NO: 517781 - DNA, 25 bp, Mus musculus
gatgtcgccattgcactgagtgagc

SEQ ID NO: 517782 - DNA, 25 bp, Mus musculus
gatgtcggaaccactgaccaacagt

SEQ ID NO: 517783 - DNA, 25 bp, Mus musculus
gatgtcggaacctctgaccaacagt

SEQ ID NO: 517784 - DNA, 25 bp, Mus musculus
gatgtcggtgagatcaaaaccatct

SEQ ID NO: 517785 - DNA, 25 bp, Mus musculus
gatgtcggtgagttcaaaaccatct

SEQ ID NO: 517786 - DNA, 25 bp, Mus musculus
gatgtcgtcaatcaagtcccaattt

SEQ ID NO: 517787 - DNA, 25 bp, Mus musculus
gatgtcgtcaatgaagtcccaattt

SEQ ID NO: 517788 - DNA, 25 bp, Mus musculus
gatgtcgtcatcaatagctctgaga

SEQ ID NO: 517789 - DNA, 25 bp, Mus musculus
gatgtcgtcatctatagctctgaga

SEQ ID NO: 517790 - DNA, 25 bp, Mus musculus
gatgtcgtgctacacactttggagc

SEQ ID NO: 517791 - DNA, 25 bp, Mus musculus
gatgtcgtgctagacactttggagc

SEQ ID NO: 517792 - DNA, 25 bp, Mus musculus
gatgtctaaacaagactttctgtga

SEQ ID NO: 517793 - DNA, 25 bp, Mus musculus
gatgtctaaacatgactttctgtga

SEQ ID NO: 517794 - DNA, 25 bp, Mus musculus
gatgtctaacatccggtattgccat

SEQ ID NO: 517795 - DNA, 25 bp, Mus musculus
gatgtctaacatgcggtattgccat

SEQ ID NO: 517796 - DNA, 25 bp, Mus musculus
gatgtctaagtaagcctcagtgggt

SEQ ID NO: 517797 - DNA, 25 bp, Mus musculus
gatgtctaagtatgcctcagtgggt

SEQ ID NO: 517798 - DNA, 25 bp, Mus musculus
gatgtctacaggagatctgacctca

SEQ ID NO: 517799 - DNA, 25 bp, Mus musculus
gatgtctacaggtgatctgacctca

SEQ ID NO: 517800 - DNA, 25 bp, Mus musculus
gatgtctacggaaattttatcctaa

SEQ ID NO: 517801 - DNA, 25 bp, Mus musculus
gatgtctacggatattttatcctaa

SEQ ID NO: 517802 - DNA, 25 bp, Mus musculus
gatgtctactgaaggaaattcgtta

SEQ ID NO: 517803 - DNA, 25 bp, Mus musculus
gatgtctactgatggaaattcgtta

SEQ ID NO: 517804 - DNA, 25 bp, Mus musculus
gatgtctagacacctatctccgaga

SEQ ID NO: 517805 - DNA, 25 bp, Mus musculus
gatgtctagacagctatctccgaga

SEQ ID NO: 517806 - DNA, 25 bp, Mus musculus
gatgtctaggtcaccatgcctcgtt

SEQ ID NO: 517807 - DNA, 25 bp, Mus musculus
gatgtctaggtctccatgcctcgtt

SEQ ID NO: 517808 - DNA, 25 bp, Mus musculus
gatgtctagttcaggacacttccac

SEQ ID NO: 517809 - DNA, 25 bp, Mus musculus
gatgtctagttctggacacttccac

SEQ ID NO: 517810 - DNA, 25 bp, Mus musculus
gatgtctatggaagtatgcagcctt

SEQ ID NO: 517811 - DNA, 25 bp, Mus musculus
gatgtctatggatgtatgcagcctt

SEQ ID NO: 517812 - DNA, 25 bp, Mus musculus
gatgtctattcaattgactttacat

SEQ ID NO: 517813 - DNA, 25 bp, Mus musculus
gatgtctattcatttgactttacat

SEQ ID NO: 517814 - DNA, 25 bp, Mus musculus
gatgtctcaactaagggttgctgag

SEQ ID NO: 517815 - DNA, 25 bp, Mus musculus
gatgtctcaacttagggttgctgag

SEQ ID NO: 517816 - DNA, 25 bp, Mus musculus
gatgtctcaccaactaagtctctca

SEQ ID NO: 517817 - DNA, 25 bp, Mus musculus
gatgtctcaccatctaagtctctca

SEQ ID NO: 517818 - DNA, 25 bp, Mus musculus
gatgtctcacctcttcatattttta

SEQ ID NO: 517819 - DNA, 25 bp, Mus musculus
gatgtctcacctgttcatattttta

SEQ ID NO: 517820 - DNA, 25 bp, Mus musculus
gatgtctcaggaattcttcagtgca

SEQ ID NO: 517821 - DNA, 25 bp, Mus musculus
gatgtctcaggatttcttcagtgca

SEQ ID NO: 517822 - DNA, 25 bp, Mus musculus
gatgtctcattgcttaggaccgccg

SEQ ID NO: 517823 - DNA, 25 bp, Mus musculus
gatgtctcattggttaggaccgccg

SEQ ID NO: 517824 - DNA, 25 bp, Mus musculus
gatgtctcatttactggtatattat

SEQ ID NO: 517825 - DNA, 25 bp, Mus musculus
gatgtctcattttctggtatattat

SEQ ID NO: 517826 - DNA, 25 bp, Mus musculus
gatgtctccaacaagccagagacta

SEQ ID NO: 517827 - DNA, 25 bp, Mus musculus
gatgtctccaactagccagagacta

SEQ ID NO: 517828 - DNA, 25 bp, Mus musculus
gatgtctccaagaggaccgtgtcat

SEQ ID NO: 517829 - DNA, 25 bp, Mus musculus
gatgtctccaagtggaccgtgtcat

SEQ ID NO: 517830 - DNA, 25 bp, Mus musculus
gatgtctccaataagctatacaatt

SEQ ID NO: 517831 - DNA, 25 bp, Mus musculus
gatgtctccaatcttgctcttgtat

SEQ ID NO: 517832 - DNA, 25 bp, Mus musculus
gatgtctccaatgttgctcttgtat

SEQ ID NO: 517833 - DNA, 25 bp, Mus musculus
gatgtctccaattagctatacaatt

SEQ ID NO: 517834 - DNA, 25 bp, Mus musculus
gatgtctccatgatgtagggtcaat

SEQ ID NO: 517835 - DNA, 25 bp, Mus musculus
gatgtctccatgttgtagggtcaat

SEQ ID NO: 517836 - DNA, 25 bp, Mus musculus
gatgtctccattatcagcacagtgc

SEQ ID NO: 517837 - DNA, 25 bp, Mus musculus
gatgtctccattttcagcacagtgc

SEQ ID NO: 517838 - DNA, 25 bp, Mus musculus
gatgtctccgctatactttgatagg

SEQ ID NO: 517839 - DNA, 25 bp, Mus musculus
gatgtctccgctttactttgatagg

SEQ ID NO: 517840 - DNA, 25 bp, Mus musculus
gatgtctccgtgagtgagtggtacc

SEQ ID NO: 517841 - DNA, 25 bp, Mus musculus
gatgtctccgtgattgtgattcctt

SEQ ID NO: 517842 - DNA, 25 bp, Mus musculus
gatgtctccgtgtgtgagtggtacc

SEQ ID NO: 517843 - DNA, 25 bp, Mus musculus
gatgtctccgtgtttgtgattcctt

SEQ ID NO: 517844 - DNA, 25 bp, Mus musculus
gatgtctcctagaaactaatgtaac

SEQ ID NO: 517845 - DNA, 25 bp, Mus musculus
gatgtctcctagtaactaatgtaac

SEQ ID NO: 517846 - DNA, 25 bp, Mus musculus
gatgtctcctgaaaagcctatgggt

SEQ ID NO: 517847 - DNA, 25 bp, Mus musculus
gatgtctcctgataagcctatgggt

SEQ ID NO: 517848 - DNA, 25 bp, Mus musculus
gatgtctcgaagctctagtaggtga

SEQ ID NO: 517849 - DNA, 25 bp, Mus musculus
gatgtctcgaaggtctagtaggtga

SEQ ID NO: 517850 - DNA, 25 bp, Mus musculus
gatgtctcggcaataatccgtttat

SEQ ID NO: 517851 - DNA, 25 bp, Mus musculus
gatgtctcggcattaatccgtttat

SEQ ID NO: 517852 - DNA, 25 bp, Mus musculus
gatgtctcggtcctttgtgttatac

SEQ ID NO: 517853 - DNA, 25 bp, Mus musculus
gatgtctcggtcgtttgtgttatac

SEQ ID NO: 517854 - DNA, 25 bp, Mus musculus
gatgtctcgtgcacaactggaacag

SEQ ID NO: 517855 - DNA, 25 bp, Mus musculus
gatgtctcgtgctcaactggaacag

SEQ ID NO: 517856 - DNA, 25 bp, Mus musculus
gatgtctctccaagtgagccctagg

SEQ ID NO: 517857 - DNA, 25 bp, Mus musculus
gatgtctctccatgtgagccctagg

SEQ ID NO: 517858 - DNA, 25 bp, Mus musculus
gatgtctctcctcagagaagttagt

SEQ ID NO: 517859 - DNA, 25 bp, Mus musculus
gatgtctctcctgagagaagttagt

SEQ ID NO: 517860 - DNA, 25 bp, Mus musculus
gatgtctctcggagtggagcacaca

SEQ ID NO: 517861 - DNA, 25 bp, Mus musculus
gatgtctctcggtgtggagcacaca

SEQ ID NO: 517862 - DNA, 25 bp, Mus musculus
gatgtctctcttaaatctacaacct

SEQ ID NO: 517863 - DNA, 25 bp, Mus musculus
gatgtctctctttaatctacaacct

SEQ ID NO: 517864 - DNA, 25 bp, Mus musculus
gatgtctctgcgcatttcaagctta

SEQ ID NO: 517865 - DNA, 25 bp, Mus musculus
gatgtctctgcggatttcaagctta

SEQ ID NO: 517866 - DNA, 25 bp, Mus musculus
gatgtctctggccaagttcccagcg

SEQ ID NO: 517867 - DNA, 25 bp, Mus musculus
gatgtctctggcgaagttcccagcg

SEQ ID NO: 517868 - DNA, 25 bp, Mus musculus
gatgtctctgggaatatctcaaggg

SEQ ID NO: 517869 - DNA, 25 bp, Mus musculus
gatgtctctgggtatatctcaaggg

SEQ ID NO: 517870 - DNA, 25 bp, Mus musculus
gatgtctctgtccaacatgttctga

SEQ ID NO: 517871 - DNA, 25 bp, Mus musculus
gatgtctctgtcgaacatgttctga

SEQ ID NO: 517872 - DNA, 25 bp, Mus musculus
gatgtctcttcacctgtgggtggca

SEQ ID NO: 517873 - DNA, 25 bp, Mus musculus
gatgtctcttcagctgtgggtggca

SEQ ID NO: 517874 - DNA, 25 bp, Mus musculus
gatgtctcttgaccactttcaatgt

SEQ ID NO: 517875 - DNA, 25 bp, Mus musculus
gatgtctcttgagcactttcaatgt

SEQ ID NO: 517876 - DNA, 25 bp, Mus musculus
gatgtctcttgtatctttgtacttt

SEQ ID NO: 517877 - DNA, 25 bp, Mus musculus
gatgtctcttgtttctttgtacttt

SEQ ID NO: 517878 - DNA, 25 bp, Mus musculus
gatgtctctttacctttagtccaaa

SEQ ID NO: 517879 - DNA, 25 bp, Mus musculus
gatgtctctttagctttagtccaaa

SEQ ID NO: 517880 - DNA, 25 bp, Mus musculus
gatgtctgacagaattatgctttga

SEQ ID NO: 517881 - DNA, 25 bp, Mus musculus
gatgtctgacagtattatgctttga

SEQ ID NO: 517882 - DNA, 25 bp, Mus musculus
gatgtctgacccagtatgtgcttgt

SEQ ID NO: 517883 - DNA, 25 bp, Mus musculus
gatgtctgaccctgtatgtgcttgt

SEQ ID NO: 517884 - DNA, 25 bp, Mus musculus
gatgtctgagacatcactttgccat

SEQ ID NO: 517885 - DNA, 25 bp, Mus musculus
gatgtctgagacttcactttgccat

SEQ ID NO: 517886 - DNA, 25 bp, Mus musculus
gatgtctgatgaattatcgcctcaa

SEQ ID NO: 517887 - DNA, 25 bp, Mus musculus
gatgtctgatgatttatcgcctcaa

SEQ ID NO: 517888 - DNA, 25 bp, Mus musculus
gatgtctgcaaaacaactagttagg

SEQ ID NO: 517889 - DNA, 25 bp, Mus musculus
gatgtctgcaaatcaactagttagg

SEQ ID NO: 517890 - DNA, 25 bp, Mus musculus
gatgtctgcagcctttctttagttc

SEQ ID NO: 517891 - DNA, 25 bp, Mus musculus
gatgtctgcagcgtttctttagttc

SEQ ID NO: 517892 - DNA, 25 bp, Mus musculus
gatgtctgccggaatatttcagtca

SEQ ID NO: 517893 - DNA, 25 bp, Mus musculus
gatgtctgccggtatatttcagtca

SEQ ID NO: 517894 - DNA, 25 bp, Mus musculus
gatgtctgccttccctgccgaagat

SEQ ID NO: 517895 - DNA, 25 bp, Mus musculus
gatgtctgccttgcctgccgaagat

SEQ ID NO: 517896 - DNA, 25 bp, Mus musculus
gatgtctgctacactgaattttgag

SEQ ID NO: 517897 - DNA, 25 bp, Mus musculus
gatgtctgctactctgaattttgag

SEQ ID NO: 517898 - DNA, 25 bp, Mus musculus
gatgtctggctgagggtctctttca

SEQ ID NO: 517899 - DNA, 25 bp, Mus musculus
gatgtctggctgtgggtctctttca

SEQ ID NO: 517900 - DNA, 25 bp, Mus musculus
gatgtctgggtcaaaatacaccttc

SEQ ID NO: 517901 - DNA, 25 bp, Mus musculus
gatgtctgggtctaaatacaccttc

SEQ ID NO: 517902 - DNA, 25 bp, Mus musculus
gatgtctggtcgatcggagttttaa

SEQ ID NO: 517903 - DNA, 25 bp, Mus musculus
gatgtctggtcgttcggagttttaa

SEQ ID NO: 517904 - DNA, 25 bp, Mus musculus
gatgtctgtaaactcacaatcctgt

SEQ ID NO: 517905 - DNA, 25 bp, Mus musculus
gatgtctgtaaagtcacaatcctgt

SEQ ID NO: 517906 - DNA, 25 bp, Mus musculus
gatgtctgtacacaacattccctgg

SEQ ID NO: 517907 - DNA, 25 bp, Mus musculus
gatgtctgtacagaacattccctgg

SEQ ID NO: 517908 - DNA, 25 bp, Mus musculus
gatgtctgtagccatcaaccgacag

SEQ ID NO: 517909 - DNA, 25 bp, Mus musculus
gatgtctgtagcgatcaaccgacag

SEQ ID NO: 517910 - DNA, 25 bp, Mus musculus
gatgtctgtagtcgtgattacctcc

SEQ ID NO: 517911 - DNA, 25 bp, Mus musculus
gatgtctgtagtggtgattacctcc

SEQ ID NO: 517912 - DNA, 25 bp, Mus musculus
gatgtctgtatcaccacagactgga

SEQ ID NO: 517913 - DNA, 25 bp, Mus musculus
gatgtctgtatctccacagactgga

SEQ ID NO: 517914 - DNA, 25 bp, Mus musculus
gatgtctgtcttacgtactggatac

SEQ ID NO: 517915 - DNA, 25 bp, Mus musculus
gatgtctgtcttcactttgtagagg

SEQ ID NO: 517916 - DNA, 25 bp, Mus musculus
gatgtctgtcttgactttgtagagg

SEQ ID NO: 517917 - DNA, 25 bp, Mus musculus
gatgtctgtctttcgtactggatac

SEQ ID NO: 517918 - DNA, 25 bp, Mus musculus
gatgtctgtgcaatctgctatcatg

SEQ ID NO: 517919 - DNA, 25 bp, Mus musculus
gatgtctgtgcattctgctatcatg

SEQ ID NO: 517920 - DNA, 25 bp, Mus musculus
gatgtctgtgtgcttggttctgcac

SEQ ID NO: 517921 - DNA, 25 bp, Mus musculus
gatgtctgtgtggttggttctgcac

SEQ ID NO: 517922 - DNA, 25 bp, Mus musculus
gatgtctgttaaagtctccaacgtg

SEQ ID NO: 517923 - DNA, 25 bp, Mus musculus
gatgtctgttaatgtctccaacgtg

SEQ ID NO: 517924 - DNA, 25 bp, Mus musculus
gatgtctgttatatccataagctcc

SEQ ID NO: 517925 - DNA, 25 bp, Mus musculus
gatgtctgttatccaaggttctgat

SEQ ID NO: 517926 - DNA, 25 bp, Mus musculus
gatgtctgttatgcaaggttctgat

SEQ ID NO: 517927 - DNA, 25 bp, Mus musculus
gatgtctgttatttccataagctcc

SEQ ID NO: 517928 - DNA, 25 bp, Mus musculus
gatgtcttaacaaaccagcagtccg

SEQ ID NO: 517929 - DNA, 25 bp, Mus musculus
gatgtcttaacataccagcagtccg

SEQ ID NO: 517930 - DNA, 25 bp, Mus musculus
gatgtcttacagctgaactcgatga

SEQ ID NO: 517931 - DNA, 25 bp, Mus musculus
gatgtcttacaggtgaactcgatga

SEQ ID NO: 517932 - DNA, 25 bp, Mus musculus
gatgtcttacctatgcagtgagtac

SEQ ID NO: 517933 - DNA, 25 bp, Mus musculus
gatgtcttacctttgcagtgagtac

SEQ ID NO: 517934 - DNA, 25 bp, Mus musculus
gatgtcttagtgcagtcagagccct

SEQ ID NO: 517935 - DNA, 25 bp, Mus musculus
gatgtcttagtggagtcagagccct

SEQ ID NO: 517936 - DNA, 25 bp, Mus musculus
gatgtcttattcctgcactatggca

SEQ ID NO: 517937 - DNA, 25 bp, Mus musculus
gatgtcttattcgtgcactatggca

SEQ ID NO: 517938 - DNA, 25 bp, Mus musculus
gatgtcttcaagatccctgtacact

SEQ ID NO: 517939 - DNA, 25 bp, Mus musculus
gatgtcttcaagttccctgtacact

SEQ ID NO: 517940 - DNA, 25 bp, Mus musculus
gatgtcttcaggagcaacttcagtt

SEQ ID NO: 517941 - DNA, 25 bp, Mus musculus
gatgtcttcaggcaattttttggtg

SEQ ID NO: 517942 - DNA, 25 bp, Mus musculus
gatgtcttcagggaattttttggtg

SEQ ID NO: 517943 - DNA, 25 bp, Mus musculus
gatgtcttcaggtgcaacttcagtt

SEQ ID NO: 517944 - DNA, 25 bp, Mus musculus
gatgtcttcagtcagtgtttgcctc

SEQ ID NO: 517945 - DNA, 25 bp, Mus musculus
gatgtcttcagtgagtgtttgcctc

SEQ ID NO: 517946 - DNA, 25 bp, Mus musculus
gatgtcttccatagatacacgtcac

SEQ ID NO: 517947 - DNA, 25 bp, Mus musculus
gatgtcttccattgatacacgtcac

SEQ ID NO: 517948 - DNA, 25 bp, Mus musculus
gatgtcttcctacgttccagtaact

SEQ ID NO: 517949 - DNA, 25 bp, Mus musculus
gatgtcttcctaggttccagtaact

SEQ ID NO: 517950 - DNA, 25 bp, Mus musculus
gatgtcttccttaagctgcaccaag

SEQ ID NO: 517951 - DNA, 25 bp, Mus musculus
gatgtcttcctttagctgcaccaag

SEQ ID NO: 517952 - DNA, 25 bp, Mus musculus
gatgtcttctgcctgttatataact

SEQ ID NO: 517953 - DNA, 25 bp, Mus musculus
gatgtcttctgcgtgttatataact

SEQ ID NO: 517954 - DNA, 25 bp, Mus musculus
gatgtcttgatcaggagtcaatcct

SEQ ID NO: 517955 - DNA, 25 bp, Mus musculus
gatgtcttgatctggagtcaatcct

SEQ ID NO: 517956 - DNA, 25 bp, Mus musculus
gatgtcttgtctagccattttggaa

SEQ ID NO: 517957 - DNA, 25 bp, Mus musculus
gatgtcttgtcttgccattttggaa

SEQ ID NO: 517958 - DNA, 25 bp, Mus musculus
gatgtcttgtttaccagaatccctg

SEQ ID NO: 517959 - DNA, 25 bp, Mus musculus
gatgtcttgtttcacgaattaaata

SEQ ID NO: 517960 - DNA, 25 bp, Mus musculus
gatgtcttgtttgacgaattaaata

SEQ ID NO: 517961 - DNA, 25 bp, Mus musculus
gatgtcttgttttccagaatccctg

SEQ ID NO: 517962 - DNA, 25 bp, Mus musculus
gatgtctttaaacccatatccttca

SEQ ID NO: 517963 - DNA, 25 bp, Mus musculus
gatgtctttaaagccatatccttca

SEQ ID NO: 517964 - DNA, 25 bp, Mus musculus
gatgtctttaccaatcactactggg

SEQ ID NO: 517965 - DNA, 25 bp, Mus musculus
gatgtctttacctatcactactggg

SEQ ID NO: 517966 - DNA, 25 bp, Mus musculus
gatgtctttatcagttaccggagga

SEQ ID NO: 517967 - DNA, 25 bp, Mus musculus
gatgtctttatctgttaccggagga

SEQ ID NO: 517968 - DNA, 25 bp, Mus musculus
gatgtctttcatcggtgaggccaat

SEQ ID NO: 517969 - DNA, 25 bp, Mus musculus
gatgtctttcatgggtgaggccaat

SEQ ID NO: 517970 - DNA, 25 bp, Mus musculus
gatgtctttcttcgtatggaaaggg

SEQ ID NO: 517971 - DNA, 25 bp, Mus musculus
gatgtctttcttggtatggaaaggg

SEQ ID NO: 517972 - DNA, 25 bp, Mus musculus
gatgtctttgaaccaaaccgtcctt

SEQ ID NO: 517973 - DNA, 25 bp, Mus musculus
gatgtctttgaagcaaaccgtcctt

SEQ ID NO: 517974 - DNA, 25 bp, Mus musculus
gatgtctttgtgatgattcactcat

SEQ ID NO: 517975 - DNA, 25 bp, Mus musculus
gatgtctttgtgttgattcactcat

SEQ ID NO: 517976 - DNA, 25 bp, Mus musculus
gatgtctttttactcagtggccttt

SEQ ID NO: 517977 - DNA, 25 bp, Mus musculus
gatgtctttttagtcagtggccttt

SEQ ID NO: 517978 - DNA, 25 bp, Mus musculus
gatgtctttttgacctcttggaaac

SEQ ID NO: 517979 - DNA, 25 bp, Mus musculus
gatgtctttttgtcctcttggaaac

SEQ ID NO: 517980 - DNA, 25 bp, Mus musculus
gatgtgaaaagcaatccaggacctt

SEQ ID NO: 517981 - DNA, 25 bp, Mus musculus
gatgtgaaaagctatccaggacctt

SEQ ID NO: 517982 - DNA, 25 bp, Mus musculus
gatgtgaaaaggaccaagttgctac

SEQ ID NO: 517983 - DNA, 25 bp, Mus musculus
gatgtgaaaaggtccaagttgctac

SEQ ID NO: 517984 - DNA, 25 bp, Mus musculus
gatgtgaaaatgaaccaatggctgc

SEQ ID NO: 517985 - DNA, 25 bp, Mus musculus
gatgtgaaaatgtaccaatggctgc

SEQ ID NO: 517986 - DNA, 25 bp, Mus musculus
gatgtgaaagttctctacgcagatt

SEQ ID NO: 517987 - DNA, 25 bp, Mus musculus
gatgtgaaagttgtctacgcagatt

SEQ ID NO: 517988 - DNA, 25 bp, Mus musculus
gatgtgaaatagctcacactggaga

SEQ ID NO: 517989 - DNA, 25 bp, Mus musculus
gatgtgaaataggtcacactggaga

SEQ ID NO: 517990 - DNA, 25 bp, Mus musculus
gatgtgaaatgtccaggttgctaca

SEQ ID NO: 517991 - DNA, 25 bp, Mus musculus
gatgtgaaatgtgcaggttgctaca

SEQ ID NO: 517992 - DNA, 25 bp, Mus musculus
gatgtgaacactcctgtacctggag

SEQ ID NO: 517993 - DNA, 25 bp, Mus musculus
gatgtgaacactgctgtacctggag

SEQ ID NO: 517994 - DNA, 25 bp, Mus musculus
gatgtgaacatgactcccaaaggcc

SEQ ID NO: 517995 - DNA, 25 bp, Mus musculus
gatgtgaacatgtctcccaaaggcc

SEQ ID NO: 517996 - DNA, 25 bp, Mus musculus
gatgtgaaccacagatccagacaga

SEQ ID NO: 517997 - DNA, 25 bp, Mus musculus
gatgtgaaccactgatccagacaga

SEQ ID NO: 517998 - DNA, 25 bp, Mus musculus
gatgtgaacctactgatccgtcttg

SEQ ID NO: 517999 - DNA, 25 bp, Mus musculus
gatgtgaacctagtgatccgtcttg

SEQ ID NO: 518000 - DNA, 25 bp, Mus musculus
gatgtgaacctgagatgggaacccc

SEQ ID NO: 518001 - DNA, 25 bp, Mus musculus
gatgtgaacctgtgatgggaacccc

SEQ ID NO: 518002 - DNA, 25 bp, Mus musculus
gatgtgaactagagaccacaaaaaa

SEQ ID NO: 518003 - DNA, 25 bp, Mus musculus
gatgtgaactagtgaccacaaaaaa

SEQ ID NO: 518004 - DNA, 25 bp, Mus musculus
gatgtgaactcaaagctttgtggat

SEQ ID NO: 518005 - DNA, 25 bp, Mus musculus
gatgtgaactcatagctttgtggat

SEQ ID NO: 518006 - DNA, 25 bp, Mus musculus
gatgtgaagcacagctgctaacccc

SEQ ID NO: 518007 - DNA, 25 bp, Mus musculus
gatgtgaagcacattccgttctgaa

SEQ ID NO: 518008 - DNA, 25 bp, Mus musculus
gatgtgaagcactgctgctaacccc

SEQ ID NO: 518009 - DNA, 25 bp, Mus musculus
gatgtgaagcactttccgttctgaa

SEQ ID NO: 518010 - DNA, 25 bp, Mus musculus
gatgtgaagcttcccagaatgcata

SEQ ID NO: 518011 - DNA, 25 bp, Mus musculus
gatgtgaagcttgccagaatgcata

SEQ ID NO: 518012 - DNA, 25 bp, Mus musculus
gatgtgaataccaccatattccctg

SEQ ID NO: 518013 - DNA, 25 bp, Mus musculus
gatgtgaatacctccatattccctg

SEQ ID NO: 518014 - DNA, 25 bp, Mus musculus
gatgtgaatcacactggcccaggaa

SEQ ID NO: 518015 - DNA, 25 bp, Mus musculus
gatgtgaatcactctggcccaggaa

SEQ ID NO: 518016 - DNA, 25 bp, Mus musculus
gatgtgaatgctcccatagctgcca

SEQ ID NO: 518017 - DNA, 25 bp, Mus musculus
gatgtgaatgctgccatagctgcca

SEQ ID NO: 518018 - DNA, 25 bp, Mus musculus
gatgtgaatgtgacctattttgttg

SEQ ID NO: 518019 - DNA, 25 bp, Mus musculus
gatgtgaatgtgtcctattttgttg

SEQ ID NO: 518020 - DNA, 25 bp, Mus musculus
gatgtgaattgacctgatcagactt

SEQ ID NO: 518021 - DNA, 25 bp, Mus musculus
gatgtgaattgagctgatcagactt

SEQ ID NO: 518022 - DNA, 25 bp, Mus musculus
gatgtgacaacgcttgtagctcaat

SEQ ID NO: 518023 - DNA, 25 bp, Mus musculus
gatgtgacaacggttgtagctcaat

SEQ ID NO: 518024 - DNA, 25 bp, Mus musculus
gatgtgacacagaactcagagccaa

SEQ ID NO: 518025 - DNA, 25 bp, Mus musculus
gatgtgacacagtactcagagccaa

SEQ ID NO: 518026 - DNA, 25 bp, Mus musculus
gatgtgacactacgttctgcagaga

SEQ ID NO: 518027 - DNA, 25 bp, Mus musculus
gatgtgacactaggttctgcagaga

SEQ ID NO: 518028 - DNA, 25 bp, Mus musculus
gatgtgacagctatctcaattttta

SEQ ID NO: 518029 - DNA, 25 bp, Mus musculus
gatgtgacagctttctcaattttta

SEQ ID NO: 518030 - DNA, 25 bp, Mus musculus
gatgtgacataccagttaccttcat

SEQ ID NO: 518031 - DNA, 25 bp, Mus musculus
gatgtgacatacgagttaccttcat

SEQ ID NO: 518032 - DNA, 25 bp, Mus musculus
gatgtgaccaatcaacagtccttca

SEQ ID NO: 518033 - DNA, 25 bp, Mus musculus
gatgtgaccaatgaacagtccttca

SEQ ID NO: 518034 - DNA, 25 bp, Mus musculus
gatgtgaccatcatcatttccgatg

SEQ ID NO: 518035 - DNA, 25 bp, Mus musculus
gatgtgaccatcttcatttccgatg

SEQ ID NO: 518036 - DNA, 25 bp, Mus musculus
gatgtgacccatccaaggatgcgcc

SEQ ID NO: 518037 - DNA, 25 bp, Mus musculus
gatgtgacccatgcaaggatgcgcc

SEQ ID NO: 518038 - DNA, 25 bp, Mus musculus
gatgtgacctacagtgagtctctca

SEQ ID NO: 518039 - DNA, 25 bp, Mus musculus
gatgtgacctactgtgagtctctca

SEQ ID NO: 518040 - DNA, 25 bp, Mus musculus
gatgtgacctatcagcgcgtaagca

SEQ ID NO: 518041 - DNA, 25 bp, Mus musculus
gatgtgacctatgagcgcgtaagca

SEQ ID NO: 518042 - DNA, 25 bp, Mus musculus
gatgtgacgcagatgcccctaaaga

SEQ ID NO: 518043 - DNA, 25 bp, Mus musculus
gatgtgacgcagttgcccctaaaga

SEQ ID NO: 518044 - DNA, 25 bp, Mus musculus
gatgtgacgttgcactgtgtctcaa

SEQ ID NO: 518045 - DNA, 25 bp, Mus musculus
gatgtgacgttggactgtgtctcaa

SEQ ID NO: 518046 - DNA, 25 bp, Mus musculus
gatgtgactcgacattgcagttgca

SEQ ID NO: 518047 - DNA, 25 bp, Mus musculus
gatgtgactcgagattgcagttgca

SEQ ID NO: 518048 - DNA, 25 bp, Mus musculus
gatgtgactgagctggaccaatacc

SEQ ID NO: 518049 - DNA, 25 bp, Mus musculus
gatgtgactgaggtggaccaatacc

SEQ ID NO: 518050 - DNA, 25 bp, Mus musculus
gatgtgactggcagttagggacccc

SEQ ID NO: 518051 - DNA, 25 bp, Mus musculus
gatgtgactggctgttagggacccc

SEQ ID NO: 518052 - DNA, 25 bp, Mus musculus
gatgtgactgggatgcttgcattgt

SEQ ID NO: 518053 - DNA, 25 bp, Mus musculus
gatgtgactgggttgcttgcattgt

SEQ ID NO: 518054 - DNA, 25 bp, Mus musculus
gatgtgacttcacacgtatacagtg

SEQ ID NO: 518055 - DNA, 25 bp, Mus musculus
gatgtgacttcagacgtatacagtg

SEQ ID NO: 518056 - DNA, 25 bp, Mus musculus
gatgtgacttcccatctaaggatgc

SEQ ID NO: 518057 - DNA, 25 bp, Mus musculus
gatgtgacttccgatctaaggatgc

SEQ ID NO: 518058 - DNA, 25 bp, Mus musculus
gatgtgacttgccaaaacttttctg

SEQ ID NO: 518059 - DNA, 25 bp, Mus musculus
gatgtgacttgcgaaaacttttctg

SEQ ID NO: 518060 - DNA, 25 bp, Mus musculus
gatgtgacttgtcatccagtattaa

SEQ ID NO: 518061 - DNA, 25 bp, Mus musculus
gatgtgacttgtgatccagtattaa

SEQ ID NO: 518062 - DNA, 25 bp, Mus musculus
gatgtgactttaatgtatcttaaca

SEQ ID NO: 518063 - DNA, 25 bp, Mus musculus
gatgtgactttattgtatcttaaca

SEQ ID NO: 518064 - DNA, 25 bp, Mus musculus
gatgtgagaagccagccaacagcca

SEQ ID NO: 518065 - DNA, 25 bp, Mus musculus
gatgtgagaagcgagccaacagcca

SEQ ID NO: 518066 - DNA, 25 bp, Mus musculus
gatgtgagagacacctgctcactgt

SEQ ID NO: 518067 - DNA, 25 bp, Mus musculus
gatgtgagagactcctgctcactgt

SEQ ID NO: 518068 - DNA, 25 bp, Mus musculus
gatgtgagatggatcaatacccagg

SEQ ID NO: 518069 - DNA, 25 bp, Mus musculus
gatgtgagatggttcaatacccagg

SEQ ID NO: 518070 - DNA, 25 bp, Mus musculus
gatgtgagcattcatgacctgaagc

SEQ ID NO: 518071 - DNA, 25 bp, Mus musculus
gatgtgagcattgatgacctgaagc

SEQ ID NO: 518072 - DNA, 25 bp, Mus musculus
gatgtgaggcttacatttgaggata

SEQ ID NO: 518073 - DNA, 25 bp, Mus musculus
gatgtgaggctttcatttgaggata

SEQ ID NO: 518074 - DNA, 25 bp, Mus musculus
gatgtgagggacacgctcaccttag

SEQ ID NO: 518075 - DNA, 25 bp, Mus musculus
gatgtgagggactcgctcaccttag

SEQ ID NO: 518076 - DNA, 25 bp, Mus musculus
gatgtgagtgcactagtgagtcccc

SEQ ID NO: 518077 - DNA, 25 bp, Mus musculus
gatgtgagtgcagtagtgagtcccc

SEQ ID NO: 518078 - DNA, 25 bp, Mus musculus
gatgtgagttaacgccactccacaa

SEQ ID NO: 518079 - DNA, 25 bp, Mus musculus
gatgtgagttaaggccactccacaa

SEQ ID NO: 518080 - DNA, 25 bp, Mus musculus
gatgtgataactactggagcctaat

SEQ ID NO: 518081 - DNA, 25 bp, Mus musculus
gatgtgataacttctggagcctaat

SEQ ID NO: 518082 - DNA, 25 bp, Mus musculus
gatgtgataatcattgtcctggtat

SEQ ID NO: 518083 - DNA, 25 bp, Mus musculus
gatgtgataatctttgtcctggtat

SEQ ID NO: 518084 - DNA, 25 bp, Mus musculus
gatgtgataatgatgccggtcccct

SEQ ID NO: 518085 - DNA, 25 bp, Mus musculus
gatgtgataatgttgccggtcccct

SEQ ID NO: 518086 - DNA, 25 bp, Mus musculus
gatgtgatacacaggccacgtggcc

SEQ ID NO: 518087 - DNA, 25 bp, Mus musculus
gatgtgatacactggccacgtggcc

SEQ ID NO: 518088 - DNA, 25 bp, Mus musculus
gatgtgatagaaccaccgagctata

SEQ ID NO: 518089 - DNA, 25 bp, Mus musculus
gatgtgatagaagcaccgagctata

SEQ ID NO: 518090 - DNA, 25 bp, Mus musculus
gatgtgatagaccttacctggccaa

SEQ ID NO: 518091 - DNA, 25 bp, Mus musculus
gatgtgatagacgttacctggccaa

SEQ ID NO: 518092 - DNA, 25 bp, Mus musculus
gatgtgatcacacctgcagtttggg

SEQ ID NO: 518093 - DNA, 25 bp, Mus musculus
gatgtgatcacagctgcagtttggg

SEQ ID NO: 518094 - DNA, 25 bp, Mus musculus
gatgtgatcactcctgtttggaagc

SEQ ID NO: 518095 - DNA, 25 bp, Mus musculus
gatgtgatcactgctgtttggaagc

SEQ ID NO: 518096 - DNA, 25 bp, Mus musculus
gatgtgatcagaccttcaaacagaa

SEQ ID NO: 518097 - DNA, 25 bp, Mus musculus
gatgtgatcagagcttcaaacagaa

SEQ ID NO: 518098 - DNA, 25 bp, Mus musculus
gatgtgatcagcaatctgtacagtt

SEQ ID NO: 518099 - DNA, 25 bp, Mus musculus
gatgtgatcagctatctgtacagtt

SEQ ID NO: 518100 - DNA, 25 bp, Mus musculus
gatgtgatcatacctagggcctcaa

SEQ ID NO: 518101 - DNA, 25 bp, Mus musculus
gatgtgatcatagctagggcctcaa

SEQ ID NO: 518102 - DNA, 25 bp, Mus musculus
gatgtgatcattctaaggtctcttt

SEQ ID NO: 518103 - DNA, 25 bp, Mus musculus
gatgtgatcattgtaaggtctcttt

SEQ ID NO: 518104 - DNA, 25 bp, Mus musculus
gatgtgatccgtcccatgaacgtca

SEQ ID NO: 518105 - DNA, 25 bp, Mus musculus
gatgtgatccgtgccatgaacgtca

SEQ ID NO: 518106 - DNA, 25 bp, Mus musculus
gatgtgatccttcagccaaacgtga

SEQ ID NO: 518107 - DNA, 25 bp, Mus musculus
gatgtgatccttgagccaaacgtga

SEQ ID NO: 518108 - DNA, 25 bp, Mus musculus
gatgtgatgatcagcgcaggcgcca

SEQ ID NO: 518109 - DNA, 25 bp, Mus musculus
gatgtgatgatctgcgcaggcgcca

SEQ ID NO: 518110 - DNA, 25 bp, Mus musculus
gatgtgatgtttccttggtcagtgt

SEQ ID NO: 518111 - DNA, 25 bp, Mus musculus
gatgtgatgtttgcttggtcagtgt

SEQ ID NO: 518112 - DNA, 25 bp, Mus musculus
gatgtgattagtcaactgttgatgt

SEQ ID NO: 518113 - DNA, 25 bp, Mus musculus
gatgtgattagtgaactgttgatgt

SEQ ID NO: 518114 - DNA, 25 bp, Mus musculus
gatgtgattccaaacaatcctctga

SEQ ID NO: 518115 - DNA, 25 bp, Mus musculus
gatgtgattccatacaatcctctga

SEQ ID NO: 518116 - DNA, 25 bp, Mus musculus
gatgtgcaaccccaggcgtgcgtac

SEQ ID NO: 518117 - DNA, 25 bp, Mus musculus
gatgtgcaacccgaggcgtgcgtac

SEQ ID NO: 518118 - DNA, 25 bp, Mus musculus
gatgtgcaatataaaccaggtgtaa

SEQ ID NO: 518119 - DNA, 25 bp, Mus musculus
gatgtgcaatattaaccaggtgtaa

SEQ ID NO: 518120 - DNA, 25 bp, Mus musculus
gatgtgcaatcacgtgtctctcacc

SEQ ID NO: 518121 - DNA, 25 bp, Mus musculus
gatgtgcaatcaggtgtctctcacc

SEQ ID NO: 518122 - DNA, 25 bp, Mus musculus
gatgtgcaatgcactcaacagcctg

SEQ ID NO: 518123 - DNA, 25 bp, Mus musculus
gatgtgcaatgctctcaacagcctg

SEQ ID NO: 518124 - DNA, 25 bp, Mus musculus
gatgtgcacactcatggtcccagag

SEQ ID NO: 518125 - DNA, 25 bp, Mus musculus
gatgtgcacactgatggtcccagag

SEQ ID NO: 518126 - DNA, 25 bp, Mus musculus
gatgtgcacagacctatattctgaa

SEQ ID NO: 518127 - DNA, 25 bp, Mus musculus
gatgtgcacagagctatattctgaa

SEQ ID NO: 518128 - DNA, 25 bp, Mus musculus
gatgtgcacagtccagatgttcatt

SEQ ID NO: 518129 - DNA, 25 bp, Mus musculus
gatgtgcacagtgcagatgttcatt

SEQ ID NO: 518130 - DNA, 25 bp, Mus musculus
gatgtgcaccacaggaacaccttga

SEQ ID NO: 518131 - DNA, 25 bp, Mus musculus
gatgtgcaccactggaacaccttga

SEQ ID NO: 518132 - DNA, 25 bp, Mus musculus
gatgtgcacgagaatgcccggacat

SEQ ID NO: 518133 - DNA, 25 bp, Mus musculus
gatgtgcacgagtatgcccggacat

SEQ ID NO: 518134 - DNA, 25 bp, Mus musculus
gatgtgcagcaaatccctactgtga

SEQ ID NO: 518135 - DNA, 25 bp, Mus musculus
gatgtgcagcaattccctactgtga

SEQ ID NO: 518136 - DNA, 25 bp, Mus musculus
gatgtgcagcacagggtctagaatg

SEQ ID NO: 518137 - DNA, 25 bp, Mus musculus
gatgtgcagcactgggtctagaatg

SEQ ID NO: 518138 - DNA, 25 bp, Mus musculus
gatgtgcagcatatcctgctttctg

SEQ ID NO: 518139 - DNA, 25 bp, Mus musculus
gatgtgcagcatcacaggccaggat

SEQ ID NO: 518140 - DNA, 25 bp, Mus musculus
gatgtgcagcatgacaggccaggat

SEQ ID NO: 518141 - DNA, 25 bp, Mus musculus
gatgtgcagcatttcctgctttctg

SEQ ID NO: 518142 - DNA, 25 bp, Mus musculus
gatgtgcagctgctagatttctcaa

SEQ ID NO: 518143 - DNA, 25 bp, Mus musculus
gatgtgcagctggtagatttctcaa

SEQ ID NO: 518144 - DNA, 25 bp, Mus musculus
gatgtgcagtccatgtatcagccgc

SEQ ID NO: 518145 - DNA, 25 bp, Mus musculus
gatgtgcagtccttgtatcagccgc

SEQ ID NO: 518146 - DNA, 25 bp, Mus musculus
gatgtgcataacatcttacctgtct

SEQ ID NO: 518147 - DNA, 25 bp, Mus musculus
gatgtgcataacttcttacctgtct

SEQ ID NO: 518148 - DNA, 25 bp, Mus musculus
gatgtgcatctaattttcttgactt

SEQ ID NO: 518149 - DNA, 25 bp, Mus musculus
gatgtgcatctatttttcttgactt

SEQ ID NO: 518150 - DNA, 25 bp, Mus musculus
gatgtgcatctgaaaactgatgaca

SEQ ID NO: 518151 - DNA, 25 bp, Mus musculus
gatgtgcatctgaatgctcacttgt

SEQ ID NO: 518152 - DNA, 25 bp, Mus musculus
gatgtgcatctgacttctgagacct

SEQ ID NO: 518153 - DNA, 25 bp, Mus musculus
gatgtgcatctgtaaactgatgaca

SEQ ID NO: 518154 - DNA, 25 bp, Mus musculus
gatgtgcatctgtatgctcacttgt

SEQ ID NO: 518155 - DNA, 25 bp, Mus musculus
gatgtgcatctgtcttctgagacct

SEQ ID NO: 518156 - DNA, 25 bp, Mus musculus
gatgtgcatgcaatcaaaggctatg

SEQ ID NO: 518157 - DNA, 25 bp, Mus musculus
gatgtgcatgcattcaaaggctatg

SEQ ID NO: 518158 - DNA, 25 bp, Mus musculus
gatgtgcatgcgatcctgatggaga

SEQ ID NO: 518159 - DNA, 25 bp, Mus musculus
gatgtgcatgcgttcctgatggaga

SEQ ID NO: 518160 - DNA, 25 bp, Mus musculus
gatgtgcattaaattctcagtcgta

SEQ ID NO: 518161 - DNA, 25 bp, Mus musculus
gatgtgcattaatttctcagtcgta

SEQ ID NO: 518162 - DNA, 25 bp, Mus musculus
gatgtgccaatcactttgaagcgtt

SEQ ID NO: 518163 - DNA, 25 bp, Mus musculus
gatgtgccaatctctttgaagcgtt

SEQ ID NO: 518164 - DNA, 25 bp, Mus musculus
gatgtgccacaaacctcagcaaata

SEQ ID NO: 518165 - DNA, 25 bp, Mus musculus
gatgtgccacaatcctcagcaaata

SEQ ID NO: 518166 - DNA, 25 bp, Mus musculus
gatgtgccacagatcttttgttttt

SEQ ID NO: 518167 - DNA, 25 bp, Mus musculus
gatgtgccacagattctagtttctc

SEQ ID NO: 518168 - DNA, 25 bp, Mus musculus
gatgtgccacagttcttttgttttt

SEQ ID NO: 518169 - DNA, 25 bp, Mus musculus
gatgtgccacagtttctagtttctc

SEQ ID NO: 518170 - DNA, 25 bp, Mus musculus
gatgtgccagacctgtttgatacag

SEQ ID NO: 518171 - DNA, 25 bp, Mus musculus
gatgtgccagacgtgtttgatacag

SEQ ID NO: 518172 - DNA, 25 bp, Mus musculus
gatgtgccagatcgcagatgtcctc

SEQ ID NO: 518173 - DNA, 25 bp, Mus musculus
gatgtgccagatggcagatgtcctc

SEQ ID NO: 518174 - DNA, 25 bp, Mus musculus
gatgtgccagggagtcctgatgcac

SEQ ID NO: 518175 - DNA, 25 bp, Mus musculus
gatgtgccagggatgtttccggaat

SEQ ID NO: 518176 - DNA, 25 bp, Mus musculus
gatgtgccagggtgtcctgatgcac

SEQ ID NO: 518177 - DNA, 25 bp, Mus musculus
gatgtgccagggttgtttccggaat

SEQ ID NO: 518178 - DNA, 25 bp, Mus musculus
gatgtgcccaaaccacttgggagac

SEQ ID NO: 518179 - DNA, 25 bp, Mus musculus
gatgtgcccaaactgtgaccatgct

SEQ ID NO: 518180 - DNA, 25 bp, Mus musculus
gatgtgcccaaagcacttgggagac

SEQ ID NO: 518181 - DNA, 25 bp, Mus musculus
gatgtgcccaaagtgtgaccatgct

SEQ ID NO: 518182 - DNA, 25 bp, Mus musculus
gatgtgcccaagatcaaggttcatt

SEQ ID NO: 518183 - DNA, 25 bp, Mus musculus
gatgtgcccaagttcaaggttcatt

SEQ ID NO: 518184 - DNA, 25 bp, Mus musculus
gatgtgcccatcatcgccatggaga

SEQ ID NO: 518185 - DNA, 25 bp, Mus musculus
gatgtgcccatcctgacattgtatg

SEQ ID NO: 518186 - DNA, 25 bp, Mus musculus
gatgtgcccatcgtgacattgtatg

SEQ ID NO: 518187 - DNA, 25 bp, Mus musculus
gatgtgcccatcttcgccatggaga

SEQ ID NO: 518188 - DNA, 25 bp, Mus musculus
gatgtgccccatcgacatatcacct

SEQ ID NO: 518189 - DNA, 25 bp, Mus musculus
gatgtgccccatggacatatcacct

SEQ ID NO: 518190 - DNA, 25 bp, Mus musculus
gatgtgccggttatgtggactgtaa

SEQ ID NO: 518191 - DNA, 25 bp, Mus musculus
gatgtgccggttttgtggactgtaa

SEQ ID NO: 518192 - DNA, 25 bp, Mus musculus
gatgtgcctagaagaatggtcccaa

SEQ ID NO: 518193 - DNA, 25 bp, Mus musculus
gatgtgcctagatgaatggtcccaa

SEQ ID NO: 518194 - DNA, 25 bp, Mus musculus
gatgtgcctcctccaaagagtcgga

SEQ ID NO: 518195 - DNA, 25 bp, Mus musculus
gatgtgcctcctgcaaagagtcgga

SEQ ID NO: 518196 - DNA, 25 bp, Mus musculus
gatgtgcctgctaataatctgccat

SEQ ID NO: 518197 - DNA, 25 bp, Mus musculus
gatgtgcctgcttataatctgccat

SEQ ID NO: 518198 - DNA, 25 bp, Mus musculus
gatgtgcctgggagtcacctaccgt

SEQ ID NO: 518199 - DNA, 25 bp, Mus musculus
gatgtgcctgggtgtcacctaccgt

SEQ ID NO: 518200 - DNA, 25 bp, Mus musculus
gatgtgcctgtgagggtatttccag

SEQ ID NO: 518201 - DNA, 25 bp, Mus musculus
gatgtgcctgtgtgggtatttccag

SEQ ID NO: 518202 - DNA, 25 bp, Mus musculus
gatgtgccttctccatatgaagtca

SEQ ID NO: 518203 - DNA, 25 bp, Mus musculus
gatgtgccttctgcatatgaagtca

SEQ ID NO: 518204 - DNA, 25 bp, Mus musculus
gatgtgcctttaacctctaatgccc

SEQ ID NO: 518205 - DNA, 25 bp, Mus musculus
gatgtgcctttatcctctaatgccc

SEQ ID NO: 518206 - DNA, 25 bp, Mus musculus
gatgtgcggattctggaagttccca

SEQ ID NO: 518207 - DNA, 25 bp, Mus musculus
gatgtgcggattgtggaagttccca

SEQ ID NO: 518208 - DNA, 25 bp, Mus musculus
gatgtgcgtacgaaaggaatttcga

SEQ ID NO: 518209 - DNA, 25 bp, Mus musculus
gatgtgcgtacgtaaggaatttcga

SEQ ID NO: 518210 - DNA, 25 bp, Mus musculus
gatgtgctaagtctgttggcttctg

SEQ ID NO: 518211 - DNA, 25 bp, Mus musculus
gatgtgctaagtgtgttggcttctg

SEQ ID NO: 518212 - DNA, 25 bp, Mus musculus
gatgtgctacaactttctaggctga

SEQ ID NO: 518213 - DNA, 25 bp, Mus musculus
gatgtgctacaagtttctaggctga

SEQ ID NO: 518214 - DNA, 25 bp, Mus musculus
gatgtgctatctctgggcatttcct

SEQ ID NO: 518215 - DNA, 25 bp, Mus musculus
gatgtgctatctgtgggcatttcct

SEQ ID NO: 518216 - DNA, 25 bp, Mus musculus
gatgtgctatgaagagcttgtacaa

SEQ ID NO: 518217 - DNA, 25 bp, Mus musculus
gatgtgctatgatgagcttgtacaa

SEQ ID NO: 518218 - DNA, 25 bp, Mus musculus
gatgtgctcagaagatgctcggccc

SEQ ID NO: 518219 - DNA, 25 bp, Mus musculus
gatgtgctcagatgatgctcggccc

SEQ ID NO: 518220 - DNA, 25 bp, Mus musculus
gatgtgctcgggaaagtgcaaacaa

SEQ ID NO: 518221 - DNA, 25 bp, Mus musculus
gatgtgctcgggtaagtgcaaacaa

SEQ ID NO: 518222 - DNA, 25 bp, Mus musculus
gatgtgctctcaaccaaccacccac

SEQ ID NO: 518223 - DNA, 25 bp, Mus musculus
gatgtgctctcatccaaccacccac

SEQ ID NO: 518224 - DNA, 25 bp, Mus musculus
gatgtgctgagacaccttctgattc

SEQ ID NO: 518225 - DNA, 25 bp, Mus musculus
gatgtgctgagagaccttctgattc

SEQ ID NO: 518226 - DNA, 25 bp, Mus musculus
gatgtgctggcgatactctaaaaca

SEQ ID NO: 518227 - DNA, 25 bp, Mus musculus
gatgtgctggcgttactctaaaaca

SEQ ID NO: 518228 - DNA, 25 bp, Mus musculus
gatgtgctgggtacctacatgggaa

SEQ ID NO: 518229 - DNA, 25 bp, Mus musculus
gatgtgctgggttcctacatgggaa

SEQ ID NO: 518230 - DNA, 25 bp, Mus musculus
gatgtgctggttaatcatggctatt

SEQ ID NO: 518231 - DNA, 25 bp, Mus musculus
gatgtgctggtttatcatggctatt

SEQ ID NO: 518232 - DNA, 25 bp, Mus musculus
gatgtgctgtacatcctgacagagc

SEQ ID NO: 518233 - DNA, 25 bp, Mus musculus
gatgtgctgtacttcctgacagagc

SEQ ID NO: 518234 - DNA, 25 bp, Mus musculus
gatgtgctgtgtccctgagagtaca

SEQ ID NO: 518235 - DNA, 25 bp, Mus musculus
gatgtgctgtgtgcctgagagtaca

SEQ ID NO: 518236 - DNA, 25 bp, Mus musculus
gatgtgcttgggatccaggtcatat

SEQ ID NO: 518237 - DNA, 25 bp, Mus musculus
gatgtgcttgggttccaggtcatat

SEQ ID NO: 518238 - DNA, 25 bp, Mus musculus
gatgtgcttgtaaatccagtatcaa

SEQ ID NO: 518239 - DNA, 25 bp, Mus musculus
gatgtgcttgtatatccagtatcaa

SEQ ID NO: 518240 - DNA, 25 bp, Mus musculus
gatgtgctttctaatgatcccaccg

SEQ ID NO: 518241 - DNA, 25 bp, Mus musculus
gatgtgctttctattccagggatct

SEQ ID NO: 518242 - DNA, 25 bp, Mus musculus
gatgtgctttcttatgatcccaccg

SEQ ID NO: 518243 - DNA, 25 bp, Mus musculus
gatgtgctttcttttccagggatct

SEQ ID NO: 518244 - DNA, 25 bp, Mus musculus
gatgtgcttttccagtatcttcagt

SEQ ID NO: 518245 - DNA, 25 bp, Mus musculus
gatgtgcttttcgagtatcttcagt

SEQ ID NO: 518246 - DNA, 25 bp, Mus musculus
gatgtggaaaacctatcggcgttat

SEQ ID NO: 518247 - DNA, 25 bp, Mus musculus
gatgtggaaaacgtatcggcgttat

SEQ ID NO: 518248 - DNA, 25 bp, Mus musculus
gatgtggaacttcgctcttccagca

SEQ ID NO: 518249 - DNA, 25 bp, Mus musculus
gatgtggaacttggctcttccagca

SEQ ID NO: 518250 - DNA, 25 bp, Mus musculus
gatgtggaagcccttgtactttgca

SEQ ID NO: 518251 - DNA, 25 bp, Mus musculus
gatgtggaagccgttgtactttgca

SEQ ID NO: 518252 - DNA, 25 bp, Mus musculus
gatgtggaagcgctgcacccaagaa

SEQ ID NO: 518253 - DNA, 25 bp, Mus musculus
gatgtggaagcggtgcacccaagaa

SEQ ID NO: 518254 - DNA, 25 bp, Mus musculus
gatgtggaatgcacgtgttccagta

SEQ ID NO: 518255 - DNA, 25 bp, Mus musculus
gatgtggaatgctcgtgttccagta

SEQ ID NO: 518256 - DNA, 25 bp, Mus musculus
gatgtggaattaactacaaccttta

SEQ ID NO: 518257 - DNA, 25 bp, Mus musculus
gatgtggaattatctacaaccttta

SEQ ID NO: 518258 - DNA, 25 bp, Mus musculus
gatgtggacaccattgcagttcatt

SEQ ID NO: 518259 - DNA, 25 bp, Mus musculus
gatgtggacacctttgcagttcatt

SEQ ID NO: 518260 - DNA, 25 bp, Mus musculus
gatgtggacagtccggtaccgtcat

SEQ ID NO: 518261 - DNA, 25 bp, Mus musculus
gatgtggacagtgcggtaccgtcat

SEQ ID NO: 518262 - DNA, 25 bp, Mus musculus
gatgtggacatcaatctcctgacct

SEQ ID NO: 518263 - DNA, 25 bp, Mus musculus
gatgtggacatctatctcctgacct

SEQ ID NO: 518264 - DNA, 25 bp, Mus musculus
gatgtggacatgctttgtgatgctt

SEQ ID NO: 518265 - DNA, 25 bp, Mus musculus
gatgtggacatggtttgtgatgctt

SEQ ID NO: 518266 - DNA, 25 bp, Mus musculus
gatgtggaccatccgttgtgctttc

SEQ ID NO: 518267 - DNA, 25 bp, Mus musculus
gatgtggaccatgcgttgtgctttc

SEQ ID NO: 518268 - DNA, 25 bp, Mus musculus
gatgtggaccctccaattcctttgg

SEQ ID NO: 518269 - DNA, 25 bp, Mus musculus
gatgtggaccctgcaattcctttgg

SEQ ID NO: 518270 - DNA, 25 bp, Mus musculus
gatgtggacgtcaactgttaggctc

SEQ ID NO: 518271 - DNA, 25 bp, Mus musculus
gatgtggacgtctactgttaggctc

SEQ ID NO: 518272 - DNA, 25 bp, Mus musculus
gatgtggacttaaaactggcaagag

SEQ ID NO: 518273 - DNA, 25 bp, Mus musculus
gatgtggacttataactggcaagag

SEQ ID NO: 518274 - DNA, 25 bp, Mus musculus
gatgtggagaataaacagcagctat

SEQ ID NO: 518275 - DNA, 25 bp, Mus musculus
gatgtggagaattaacagcagctat

SEQ ID NO: 518276 - DNA, 25 bp, Mus musculus
gatgtggagcttctaaaaccgtgga

SEQ ID NO: 518277 - DNA, 25 bp, Mus musculus
gatgtggagcttgtaaaaccgtgga

SEQ ID NO: 518278 - DNA, 25 bp, Mus musculus
gatgtggatacaccggaacagcccc

SEQ ID NO: 518279 - DNA, 25 bp, Mus musculus
gatgtggatacagcggaacagcccc

SEQ ID NO: 518280 - DNA, 25 bp, Mus musculus
gatgtggatataatctgtacagaaa

SEQ ID NO: 518281 - DNA, 25 bp, Mus musculus
gatgtggatatattctgtacagaaa

SEQ ID NO: 518282 - DNA, 25 bp, Mus musculus
gatgtggatgccctccttctgtgtc

SEQ ID NO: 518283 - DNA, 25 bp, Mus musculus
gatgtggatgccgtccttctgtgtc

SEQ ID NO: 518284 - DNA, 25 bp, Mus musculus
gatgtggatgctccttttctcagta

SEQ ID NO: 518285 - DNA, 25 bp, Mus musculus
gatgtggatgctgcttttctcagta

SEQ ID NO: 518286 - DNA, 25 bp, Mus musculus
gatgtggcacatctgacgtggtatt

SEQ ID NO: 518287 - DNA, 25 bp, Mus musculus
gatgtggcacatgtgacgtggtatt

SEQ ID NO: 518288 - DNA, 25 bp, Mus musculus
gatgtggcatttaactggctactga

SEQ ID NO: 518289 - DNA, 25 bp, Mus musculus
gatgtggcattttactggctactga

SEQ ID NO: 518290 - DNA, 25 bp, Mus musculus
gatgtggccagaacctgagagccca

SEQ ID NO: 518291 - DNA, 25 bp, Mus musculus
gatgtggccagatcctgagagccca

SEQ ID NO: 518292 - DNA, 25 bp, Mus musculus
gatgtggcccttccatttagaaagt

SEQ ID NO: 518293 - DNA, 25 bp, Mus musculus
gatgtggcccttgcatttagaaagt

SEQ ID NO: 518294 - DNA, 25 bp, Mus musculus
gatgtggcctctagggagtctccta

SEQ ID NO: 518295 - DNA, 25 bp, Mus musculus
gatgtggcctcttgggagtctccta

SEQ ID NO: 518296 - DNA, 25 bp, Mus musculus
gatgtggccttgaagaaaatttgtc

SEQ ID NO: 518297 - DNA, 25 bp, Mus musculus
gatgtggccttgaattttaactctg

SEQ ID NO: 518298 - DNA, 25 bp, Mus musculus
gatgtggccttgtagaaaatttgtc

SEQ ID NO: 518299 - DNA, 25 bp, Mus musculus
gatgtggccttgtattttaactctg

SEQ ID NO: 518300 - DNA, 25 bp, Mus musculus
gatgtggcgtccagttggatgctcc

SEQ ID NO: 518301 - DNA, 25 bp, Mus musculus
gatgtggcgtcctgttggatgctcc

SEQ ID NO: 518302 - DNA, 25 bp, Mus musculus
gatgtggctatcattgttggccgcc

SEQ ID NO: 518303 - DNA, 25 bp, Mus musculus
gatgtggctatctttgttggccgcc

SEQ ID NO: 518304 - DNA, 25 bp, Mus musculus
gatgtggctgcaagattcttgctat

SEQ ID NO: 518305 - DNA, 25 bp, Mus musculus
gatgtggctgcatgattcttgctat

SEQ ID NO: 518306 - DNA, 25 bp, Mus musculus
gatgtggctgccattccccgtgctg

SEQ ID NO: 518307 - DNA, 25 bp, Mus musculus
gatgtggctgcctttccccgtgctg

SEQ ID NO: 518308 - DNA, 25 bp, Mus musculus
gatgtggctggaactcttcacagca

SEQ ID NO: 518309 - DNA, 25 bp, Mus musculus
gatgtggctggatctcttcacagca

SEQ ID NO: 518310 - DNA, 25 bp, Mus musculus
gatgtggctgtgattctgacccata

SEQ ID NO: 518311 - DNA, 25 bp, Mus musculus
gatgtggctgtgtttctgacccata

SEQ ID NO: 518312 - DNA, 25 bp, Mus musculus
gatgtggctgttatgcgtagcattg

SEQ ID NO: 518313 - DNA, 25 bp, Mus musculus
gatgtggctgttttgcgtagcattg

SEQ ID NO: 518314 - DNA, 25 bp, Mus musculus
gatgtgggaaaaccaattcctttga

SEQ ID NO: 518315 - DNA, 25 bp, Mus musculus
gatgtgggaaaagcaattcctttga

SEQ ID NO: 518316 - DNA, 25 bp, Mus musculus
gatgtgggaaccctcttcgtttgcc

SEQ ID NO: 518317 - DNA, 25 bp, Mus musculus
gatgtgggaaccgtcttcgtttgcc

SEQ ID NO: 518318 - DNA, 25 bp, Mus musculus
gatgtgggcatcagttgcagcagaa

SEQ ID NO: 518319 - DNA, 25 bp, Mus musculus
gatgtgggcatctgttgcagcagaa

SEQ ID NO: 518320 - DNA, 25 bp, Mus musculus
gatgtgggcatgagatctgttgcac

SEQ ID NO: 518321 - DNA, 25 bp, Mus musculus
gatgtgggcatgtgatctgttgcac

SEQ ID NO: 518322 - DNA, 25 bp, Mus musculus
gatgtgggcattcagctccgacgac

SEQ ID NO: 518323 - DNA, 25 bp, Mus musculus
gatgtgggcattgagctccgacgac

SEQ ID NO: 518324 - DNA, 25 bp, Mus musculus
gatgtgggccaactcacagaagagt

SEQ ID NO: 518325 - DNA, 25 bp, Mus musculus
gatgtgggccaagtcacagaagagt

SEQ ID NO: 518326 - DNA, 25 bp, Mus musculus
gatgtgggccataatgaacctgcaa

SEQ ID NO: 518327 - DNA, 25 bp, Mus musculus
gatgtgggccattatgaacctgcaa

SEQ ID NO: 518328 - DNA, 25 bp, Mus musculus
gatgtgggcccaaggttctaatacc

SEQ ID NO: 518329 - DNA, 25 bp, Mus musculus
gatgtgggcccatggttctaatacc

SEQ ID NO: 518330 - DNA, 25 bp, Mus musculus
gatgtgggccgcatgttcaaacagt

SEQ ID NO: 518331 - DNA, 25 bp, Mus musculus
gatgtgggccgcttgttcaaacagt

SEQ ID NO: 518332 - DNA, 25 bp, Mus musculus
gatgtgggtcaaaaattattatgat

SEQ ID NO: 518333 - DNA, 25 bp, Mus musculus
gatgtgggtcaaagctctgaaggca

SEQ ID NO: 518334 - DNA, 25 bp, Mus musculus
gatgtgggtcaataattattatgat

SEQ ID NO: 518335 - DNA, 25 bp, Mus musculus
gatgtgggtcaatgctctgaaggca

SEQ ID NO: 518336 - DNA, 25 bp, Mus musculus
gatgtgggttccattgcctgcagca

SEQ ID NO: 518337 - DNA, 25 bp, Mus musculus
gatgtgggttcctttgcctgcagca

SEQ ID NO: 518338 - DNA, 25 bp, Mus musculus
gatgtgggtttcagtcactggagca

SEQ ID NO: 518339 - DNA, 25 bp, Mus musculus
gatgtgggtttctgtcactggagca

SEQ ID NO: 518340 - DNA, 25 bp, Mus musculus
gatgtggtcacaaagctccatgtac

SEQ ID NO: 518341 - DNA, 25 bp, Mus musculus
gatgtggtcacactgttccgcgagt

SEQ ID NO: 518342 - DNA, 25 bp, Mus musculus
gatgtggtcacagtgttccgcgagt

SEQ ID NO: 518343 - DNA, 25 bp, Mus musculus
gatgtggtcacatagctccatgtac

SEQ ID NO: 518344 - DNA, 25 bp, Mus musculus
gatgtggtcatcacgagaaacagaa

SEQ ID NO: 518345 - DNA, 25 bp, Mus musculus
gatgtggtcatctcgagaaacagaa

SEQ ID NO: 518346 - DNA, 25 bp, Mus musculus
gatgtggtccaaatctgtgttttta

SEQ ID NO: 518347 - DNA, 25 bp, Mus musculus
gatgtggtccaattctgtgttttta

SEQ ID NO: 518348 - DNA, 25 bp, Mus musculus
gatgtggtcctgagtaaaacgttca

SEQ ID NO: 518349 - DNA, 25 bp, Mus musculus
gatgtggtcctgtgtaaaacgttca

SEQ ID NO: 518350 - DNA, 25 bp, Mus musculus
gatgtggtcttaaagcagcttgcat

SEQ ID NO: 518351 - DNA, 25 bp, Mus musculus
gatgtggtcttaactccgagagatc

SEQ ID NO: 518352 - DNA, 25 bp, Mus musculus
gatgtggtcttatagcagcttgcat

SEQ ID NO: 518353 - DNA, 25 bp, Mus musculus
gatgtggtcttatctccgagagatc

SEQ ID NO: 518354 - DNA, 25 bp, Mus musculus
gatgtggtgatgctgctgctctatc

SEQ ID NO: 518355 - DNA, 25 bp, Mus musculus
gatgtggtgatggtgctgctctatc

SEQ ID NO: 518356 - DNA, 25 bp, Mus musculus
gatgtggtggcaaatgtctttaaca

SEQ ID NO: 518357 - DNA, 25 bp, Mus musculus
gatgtggtggcatatgtctttaaca

SEQ ID NO: 518358 - DNA, 25 bp, Mus musculus
gatgtggtgtataccctggccaact

SEQ ID NO: 518359 - DNA, 25 bp, Mus musculus
gatgtggtgtattccctggccaact

SEQ ID NO: 518360 - DNA, 25 bp, Mus musculus
gatgtggtgtttattaatttcccag

SEQ ID NO: 518361 - DNA, 25 bp, Mus musculus
gatgtggtgttttttaatttcccag

SEQ ID NO: 518362 - DNA, 25 bp, Mus musculus
gatgtggttcagacggtagagtaat

SEQ ID NO: 518363 - DNA, 25 bp, Mus musculus
gatgtggttcagtcggtagagtaat

SEQ ID NO: 518364 - DNA, 25 bp, Mus musculus
gatgtggttgccaaagtgacaccat

SEQ ID NO: 518365 - DNA, 25 bp, Mus musculus
gatgtggttgcctaagtgacaccat

SEQ ID NO: 518366 - DNA, 25 bp, Mus musculus
gatgtggttggtccctgcaaatcac

SEQ ID NO: 518367 - DNA, 25 bp, Mus musculus
gatgtggttggtgcctgcaaatcac

SEQ ID NO: 518368 - DNA, 25 bp, Mus musculus
gatgtggtttctcctactgtattct

SEQ ID NO: 518369 - DNA, 25 bp, Mus musculus
gatgtggtttctgctactgtattct

SEQ ID NO: 518370 - DNA, 25 bp, Mus musculus
gatgtggtttgaataacgcctcccc

SEQ ID NO: 518371 - DNA, 25 bp, Mus musculus
gatgtggtttgattaacgcctcccc

SEQ ID NO: 518372 - DNA, 25 bp, Mus musculus
gatgtggttttaaatcggagagatc

SEQ ID NO: 518373 - DNA, 25 bp, Mus musculus
gatgtggttttatatcggagagatc

SEQ ID NO: 518374 - DNA, 25 bp, Mus musculus
gatgtggttttgcttcagccagaac

SEQ ID NO: 518375 - DNA, 25 bp, Mus musculus
gatgtggttttggttcagccagaac

SEQ ID NO: 518376 - DNA, 25 bp, Mus musculus
gatgtgtaaatcaatcccatggatc

SEQ ID NO: 518377 - DNA, 25 bp, Mus musculus
gatgtgtaaatctatcccatggatc

SEQ ID NO: 518378 - DNA, 25 bp, Mus musculus
gatgtgtaacgtaactgtcttccca

SEQ ID NO: 518379 - DNA, 25 bp, Mus musculus
gatgtgtaacgttactgtcttccca

SEQ ID NO: 518380 - DNA, 25 bp, Mus musculus
gatgtgtaactcctggtctaattaa

SEQ ID NO: 518381 - DNA, 25 bp, Mus musculus
gatgtgtaactcgtggtctaattaa

SEQ ID NO: 518382 - DNA, 25 bp, Mus musculus
gatgtgtaactgatctcaagctggt

SEQ ID NO: 518383 - DNA, 25 bp, Mus musculus
gatgtgtaactgttctcaagctggt

SEQ ID NO: 518384 - DNA, 25 bp, Mus musculus
gatgtgtaagaacctgtgtttgatc

SEQ ID NO: 518385 - DNA, 25 bp, Mus musculus
gatgtgtaagaagctgtgtttgatc

SEQ ID NO: 518386 - DNA, 25 bp, Mus musculus
gatgtgtacatcacgattgcagact

SEQ ID NO: 518387 - DNA, 25 bp, Mus musculus
gatgtgtacatctcgattgcagact

SEQ ID NO: 518388 - DNA, 25 bp, Mus musculus
gatgtgtacattccaaacagccctg

SEQ ID NO: 518389 - DNA, 25 bp, Mus musculus
gatgtgtacattgcaaacagccctg

SEQ ID NO: 518390 - DNA, 25 bp, Mus musculus
gatgtgtaccacaatagccaactgt

SEQ ID NO: 518391 - DNA, 25 bp, Mus musculus
gatgtgtaccactatagccaactgt

SEQ ID NO: 518392 - DNA, 25 bp, Mus musculus
gatgtgtaccttccataagcagtag

SEQ ID NO: 518393 - DNA, 25 bp, Mus musculus
gatgtgtaccttgcataagcagtag

SEQ ID NO: 518394 - DNA, 25 bp, Mus musculus
gatgtgtacgtgactacccatactc

SEQ ID NO: 518395 - DNA, 25 bp, Mus musculus
gatgtgtacgtgtctacccatactc

SEQ ID NO: 518396 - DNA, 25 bp, Mus musculus
gatgtgtagaagctcttcaagcatt

SEQ ID NO: 518397 - DNA, 25 bp, Mus musculus
gatgtgtagaaggtcttcaagcatt

SEQ ID NO: 518398 - DNA, 25 bp, Mus musculus
gatgtgtagcccaaaccagcttgga

SEQ ID NO: 518399 - DNA, 25 bp, Mus musculus
gatgtgtagccctaaccagcttgga

SEQ ID NO: 518400 - DNA, 25 bp, Mus musculus
gatgtgtagctgcaccgactgctca

SEQ ID NO: 518401 - DNA, 25 bp, Mus musculus
gatgtgtagctggaccgactgctca

SEQ ID NO: 518402 - DNA, 25 bp, Mus musculus
gatgtgtatagccagatctttgcaa

SEQ ID NO: 518403 - DNA, 25 bp, Mus musculus
gatgtgtatagcgagatctttgcaa

SEQ ID NO: 518404 - DNA, 25 bp, Mus musculus
gatgtgtatatgcacatgtgcataa

SEQ ID NO: 518405 - DNA, 25 bp, Mus musculus
gatgtgtatatggacatgtgcataa

SEQ ID NO: 518406 - DNA, 25 bp, Mus musculus
gatgtgtatcctctaaacctgggag

SEQ ID NO: 518407 - DNA, 25 bp, Mus musculus
gatgtgtatcctgtaaacctgggag

SEQ ID NO: 518408 - DNA, 25 bp, Mus musculus
gatgtgtatctgaaacctcataact

SEQ ID NO: 518409 - DNA, 25 bp, Mus musculus
gatgtgtatctgtaacctcataact

SEQ ID NO: 518410 - DNA, 25 bp, Mus musculus
gatgtgtcacggataatgctagggt

SEQ ID NO: 518411 - DNA, 25 bp, Mus musculus
gatgtgtcacggttaatgctagggt

SEQ ID NO: 518412 - DNA, 25 bp, Mus musculus
gatgtgtcagccatgaccgtgccaa

SEQ ID NO: 518413 - DNA, 25 bp, Mus musculus
gatgtgtcagccttgaccgtgccaa

SEQ ID NO: 518414 - DNA, 25 bp, Mus musculus
gatgtgtcaggactttacctggtta

SEQ ID NO: 518415 - DNA, 25 bp, Mus musculus
gatgtgtcaggagtttacctggtta

SEQ ID NO: 518416 - DNA, 25 bp, Mus musculus
gatgtgtcattgacccaggaagtcc

SEQ ID NO: 518417 - DNA, 25 bp, Mus musculus
gatgtgtcattgtcccaggaagtcc

SEQ ID NO: 518418 - DNA, 25 bp, Mus musculus
gatgtgtccctaaatgtcatgttaa

SEQ ID NO: 518419 - DNA, 25 bp, Mus musculus
gatgtgtccctatatgtcatgttaa

SEQ ID NO: 518420 - DNA, 25 bp, Mus musculus
gatgtgtccgaaaccaagctcgggt

SEQ ID NO: 518421 - DNA, 25 bp, Mus musculus
gatgtgtccgaatccaagctcgggt

SEQ ID NO: 518422 - DNA, 25 bp, Mus musculus
gatgtgtcctctagggatccaaatt

SEQ ID NO: 518423 - DNA, 25 bp, Mus musculus
gatgtgtcctcttgggatccaaatt

SEQ ID NO: 518424 - DNA, 25 bp, Mus musculus
gatgtgtctattaccttatcctaaa

SEQ ID NO: 518425 - DNA, 25 bp, Mus musculus
gatgtgtctatttccttatcctaaa

SEQ ID NO: 518426 - DNA, 25 bp, Mus musculus
gatgtgtctcataacgcagtggaag

SEQ ID NO: 518427 - DNA, 25 bp, Mus musculus
gatgtgtctcattacgcagtggaag

SEQ ID NO: 518428 - DNA, 25 bp, Mus musculus
gatgtgtctcctattgttgtgagta

SEQ ID NO: 518429 - DNA, 25 bp, Mus musculus
gatgtgtctccttttgttgtgagta

SEQ ID NO: 518430 - DNA, 25 bp, Mus musculus
gatgtgtctctgatgggagcagggc

SEQ ID NO: 518431 - DNA, 25 bp, Mus musculus
gatgtgtctctgttgggagcagggc

SEQ ID NO: 518432 - DNA, 25 bp, Mus musculus
gatgtgtctgacaagacctcaggtt

SEQ ID NO: 518433 - DNA, 25 bp, Mus musculus
gatgtgtctgacagactgaaccagc

SEQ ID NO: 518434 - DNA, 25 bp, Mus musculus
gatgtgtctgactagacctcaggtt

SEQ ID NO: 518435 - DNA, 25 bp, Mus musculus
gatgtgtctgactgactgaaccagc

SEQ ID NO: 518436 - DNA, 25 bp, Mus musculus
gatgtgtctgccctcaaaatgacat

SEQ ID NO: 518437 - DNA, 25 bp, Mus musculus
gatgtgtctgccgtcaaaatgacat

SEQ ID NO: 518438 - DNA, 25 bp, Mus musculus
gatgtgtctgctacacagccagcag

SEQ ID NO: 518439 - DNA, 25 bp, Mus musculus
gatgtgtctgcttcacagccagcag

SEQ ID NO: 518440 - DNA, 25 bp, Mus musculus
gatgtgtcttggacatatctatcct

SEQ ID NO: 518441 - DNA, 25 bp, Mus musculus
gatgtgtcttggtcatatctatcct

SEQ ID NO: 518442 - DNA, 25 bp, Mus musculus
gatgtgtgaacactcagaccggctt

SEQ ID NO: 518443 - DNA, 25 bp, Mus musculus
gatgtgtgaacagtcagaccggctt

SEQ ID NO: 518444 - DNA, 25 bp, Mus musculus
gatgtgtgaaccaggagcaccgagt

SEQ ID NO: 518445 - DNA, 25 bp, Mus musculus
gatgtgtgaaccatgtcagccaccg

SEQ ID NO: 518446 - DNA, 25 bp, Mus musculus
gatgtgtgaacctggagcaccgagt

SEQ ID NO: 518447 - DNA, 25 bp, Mus musculus
gatgtgtgaaccttgtcagccaccg

SEQ ID NO: 518448 - DNA, 25 bp, Mus musculus
gatgtgtgaccccaccacaattaac

SEQ ID NO: 518449 - DNA, 25 bp, Mus musculus
gatgtgtgacccgaccacaattaac

SEQ ID NO: 518450 - DNA, 25 bp, Mus musculus
gatgtgtgcactaagctcaggacaa

SEQ ID NO: 518451 - DNA, 25 bp, Mus musculus
gatgtgtgcacttagctcaggacaa

SEQ ID NO: 518452 - DNA, 25 bp, Mus musculus
gatgtgtgcataaacccagcaccag

SEQ ID NO: 518453 - DNA, 25 bp, Mus musculus
gatgtgtgcatatacccagcaccag

SEQ ID NO: 518454 - DNA, 25 bp, Mus musculus
gatgtgtgccacaatgctcctctaa

SEQ ID NO: 518455 - DNA, 25 bp, Mus musculus
gatgtgtgccactatgctcctctaa

SEQ ID NO: 518456 - DNA, 25 bp, Mus musculus
gatgtgtgcccaaaggaacttgaca

SEQ ID NO: 518457 - DNA, 25 bp, Mus musculus
gatgtgtgcccataggaacttgaca

SEQ ID NO: 518458 - DNA, 25 bp, Mus musculus
gatgtgtgccgtctctttcatctgt

SEQ ID NO: 518459 - DNA, 25 bp, Mus musculus
gatgtgtgccgtgtctttcatctgt

SEQ ID NO: 518460 - DNA, 25 bp, Mus musculus
gatgtgtgcttgataccatgcgtct

SEQ ID NO: 518461 - DNA, 25 bp, Mus musculus
gatgtgtgcttgttaccatgcgtct

SEQ ID NO: 518462 - DNA, 25 bp, Mus musculus
gatgtgtggaaactcagatcctgcc

SEQ ID NO: 518463 - DNA, 25 bp, Mus musculus
gatgtgtggaaagtcagatcctgcc

SEQ ID NO: 518464 - DNA, 25 bp, Mus musculus
gatgtgtggacactccatgctgagc

SEQ ID NO: 518465 - DNA, 25 bp, Mus musculus
gatgtgtggacagtccatgctgagc

SEQ ID NO: 518466 - DNA, 25 bp, Mus musculus
gatgtgtgggttaatttcttaccga

SEQ ID NO: 518467 - DNA, 25 bp, Mus musculus
gatgtgtgggtttatttcttaccga

SEQ ID NO: 518468 - DNA, 25 bp, Mus musculus
gatgtgtggttaactttcctttctc

SEQ ID NO: 518469 - DNA, 25 bp, Mus musculus
gatgtgtggttatctttcctttctc

SEQ ID NO: 518470 - DNA, 25 bp, Mus musculus
gatgtgtggttcactatggttttat

SEQ ID NO: 518471 - DNA, 25 bp, Mus musculus
gatgtgtggttctctatggttttat

SEQ ID NO: 518472 - DNA, 25 bp, Mus musculus
gatgtgtgtccgaggttatctggct

SEQ ID NO: 518473 - DNA, 25 bp, Mus musculus
gatgtgtgtccgtggttatctggct

SEQ ID NO: 518474 - DNA, 25 bp, Mus musculus
gatgtgtgtctaacaggagactcta

SEQ ID NO: 518475 - DNA, 25 bp, Mus musculus
gatgtgtgtctatcaggagactcta

SEQ ID NO: 518476 - DNA, 25 bp, Mus musculus
gatgtgtgtgccattgctaagcttt

SEQ ID NO: 518477 - DNA, 25 bp, Mus musculus
gatgtgtgtgcctttgctaagcttt

SEQ ID NO: 518478 - DNA, 25 bp, Mus musculus
gatgtgtgtgttcgtttatcacaac

SEQ ID NO: 518479 - DNA, 25 bp, Mus musculus
gatgtgtgtgttggtttatcacaac

SEQ ID NO: 518480 - DNA, 25 bp, Mus musculus
gatgtgtgtttaattctgagctaaa

SEQ ID NO: 518481 - DNA, 25 bp, Mus musculus
gatgtgtgtttatttctgagctaaa

SEQ ID NO: 518482 - DNA, 25 bp, Mus musculus
gatgtgttaaacaggcctggctgtg

SEQ ID NO: 518483 - DNA, 25 bp, Mus musculus
gatgtgttaaactggcctggctgtg

SEQ ID NO: 518484 - DNA, 25 bp, Mus musculus
gatgtgttacatcaggccctgcagg

SEQ ID NO: 518485 - DNA, 25 bp, Mus musculus
gatgtgttacatgaggccctgcagg

SEQ ID NO: 518486 - DNA, 25 bp, Mus musculus
gatgtgttagagcttgagaccccaa

SEQ ID NO: 518487 - DNA, 25 bp, Mus musculus
gatgtgttagaggttgagaccccaa

SEQ ID NO: 518488 - DNA, 25 bp, Mus musculus
gatgtgttcaatccttgtaagtcaa

SEQ ID NO: 518489 - DNA, 25 bp, Mus musculus
gatgtgttcaatgcttgtaagtcaa

SEQ ID NO: 518490 - DNA, 25 bp, Mus musculus
gatgtgttcagtcttgaatagcatt

SEQ ID NO: 518491 - DNA, 25 bp, Mus musculus
gatgtgttcagtgttgaatagcatt

SEQ ID NO: 518492 - DNA, 25 bp, Mus musculus
gatgtgttcataaaatctgctattt

SEQ ID NO: 518493 - DNA, 25 bp, Mus musculus
gatgtgttcatataatctgctattt

SEQ ID NO: 518494 - DNA, 25 bp, Mus musculus
gatgtgttcatcaaccaatacatga

SEQ ID NO: 518495 - DNA, 25 bp, Mus musculus
gatgtgttcatctaccaatacatga

SEQ ID NO: 518496 - DNA, 25 bp, Mus musculus
gatgtgttccacagctcctgaaata

SEQ ID NO: 518497 - DNA, 25 bp, Mus musculus
gatgtgttccactgctcctgaaata

SEQ ID NO: 518498 - DNA, 25 bp, Mus musculus
gatgtgttccagctttagcctaggg

SEQ ID NO: 518499 - DNA, 25 bp, Mus musculus
gatgtgttccaggtttagcctaggg

SEQ ID NO: 518500 - DNA, 25 bp, Mus musculus
gatgtgttccataccattggcgaga

SEQ ID NO: 518501 - DNA, 25 bp, Mus musculus
gatgtgttccattccattggcgaga

SEQ ID NO: 518502 - DNA, 25 bp, Mus musculus
gatgtgttctatacaggagcctgca

SEQ ID NO: 518503 - DNA, 25 bp, Mus musculus
gatgtgttctatactatacccacag

SEQ ID NO: 518504 - DNA, 25 bp, Mus musculus
gatgtgttctatcctgggacaggcc

SEQ ID NO: 518505 - DNA, 25 bp, Mus musculus
gatgtgttctatgctgggacaggcc

SEQ ID NO: 518506 - DNA, 25 bp, Mus musculus
gatgtgttctattcaggagcctgca

SEQ ID NO: 518507 - DNA, 25 bp, Mus musculus
gatgtgttctattctatacccacag

SEQ ID NO: 518508 - DNA, 25 bp, Mus musculus
gatgtgttctgtaaacaccgagcaa

SEQ ID NO: 518509 - DNA, 25 bp, Mus musculus
gatgtgttctgttaacaccgagcaa

SEQ ID NO: 518510 - DNA, 25 bp, Mus musculus
gatgtgttgatcatatgctcagcat

SEQ ID NO: 518511 - DNA, 25 bp, Mus musculus
gatgtgttgatcttatgctcagcat

SEQ ID NO: 518512 - DNA, 25 bp, Mus musculus
gatgtgttggcactggattttaacc

SEQ ID NO: 518513 - DNA, 25 bp, Mus musculus
gatgtgttggcagtggattttaacc

SEQ ID NO: 518514 - DNA, 25 bp, Mus musculus
gatgtgttgtggctcactgtgccaa

SEQ ID NO: 518515 - DNA, 25 bp, Mus musculus
gatgtgttgtgggtcactgtgccaa

SEQ ID NO: 518516 - DNA, 25 bp, Mus musculus
gatgtgtttaacagtgaggctattt

SEQ ID NO: 518517 - DNA, 25 bp, Mus musculus
gatgtgtttaactgtgaggctattt

SEQ ID NO: 518518 - DNA, 25 bp, Mus musculus
gatgtgtttaccatcagtgtctcct

SEQ ID NO: 518519 - DNA, 25 bp, Mus musculus
gatgtgtttaccttcagtgtctcct

SEQ ID NO: 518520 - DNA, 25 bp, Mus musculus
gatgtgtttcagacattcatgttta

SEQ ID NO: 518521 - DNA, 25 bp, Mus musculus
gatgtgtttcagatgatgagttact

SEQ ID NO: 518522 - DNA, 25 bp, Mus musculus
gatgtgtttcagtcattcatgttta

SEQ ID NO: 518523 - DNA, 25 bp, Mus musculus
gatgtgtttcagttgatgagttact

SEQ ID NO: 518524 - DNA, 25 bp, Mus musculus
gatgtgtttccactgttgtgtgagc

SEQ ID NO: 518525 - DNA, 25 bp, Mus musculus
gatgtgtttccagtgttgtgtgagc

SEQ ID NO: 518526 - DNA, 25 bp, Mus musculus
gatgtgtttctaccctggtggagcc

SEQ ID NO: 518527 - DNA, 25 bp, Mus musculus
gatgtgtttctagcctggtggagcc

SEQ ID NO: 518528 - DNA, 25 bp, Mus musculus
gatgtgtttgaaatgcgctttgcca

SEQ ID NO: 518529 - DNA, 25 bp, Mus musculus
gatgtgtttgaattgcgctttgcca

SEQ ID NO: 518530 - DNA, 25 bp, Mus musculus
gatgtgtttgttccttagtgagacc

SEQ ID NO: 518531 - DNA, 25 bp, Mus musculus
gatgtgtttgttgcttagtgagacc

SEQ ID NO: 518532 - DNA, 25 bp, Mus musculus
gatgtgttttataaacttgtgtttg

SEQ ID NO: 518533 - DNA, 25 bp, Mus musculus
gatgtgttttattaacttgtgtttg

SEQ ID NO: 518534 - DNA, 25 bp, Mus musculus
gatgtgttttgaaattggctccgaa

SEQ ID NO: 518535 - DNA, 25 bp, Mus musculus
gatgtgttttgatattggctccgaa

SEQ ID NO: 518536 - DNA, 25 bp, Mus musculus
gatgtgttttgtacatccagagaac

SEQ ID NO: 518537 - DNA, 25 bp, Mus musculus
gatgtgttttgttcatccagagaac

SEQ ID NO: 518538 - DNA, 25 bp, Mus musculus
gatgttaaagaccaaaccgcatttt

SEQ ID NO: 518539 - DNA, 25 bp, Mus musculus
gatgttaaagacgaaaccgcatttt

SEQ ID NO: 518540 - DNA, 25 bp, Mus musculus
gatgttaaatgcaagcctgaatgct

SEQ ID NO: 518541 - DNA, 25 bp, Mus musculus
gatgttaaatgctagcctgaatgct

SEQ ID NO: 518542 - DNA, 25 bp, Mus musculus
gatgttaactcccaagaccgactat

SEQ ID NO: 518543 - DNA, 25 bp, Mus musculus
gatgttaactccgaagaccgactat

SEQ ID NO: 518544 - DNA, 25 bp, Mus musculus
gatgttaactgacacctcattccaa

SEQ ID NO: 518545 - DNA, 25 bp, Mus musculus
gatgttaactgagacctcattccaa

SEQ ID NO: 518546 - DNA, 25 bp, Mus musculus
gatgttaactgcacactggatggtg

SEQ ID NO: 518547 - DNA, 25 bp, Mus musculus
gatgttaactgcatttgagctttga

SEQ ID NO: 518548 - DNA, 25 bp, Mus musculus
gatgttaactgctcactggatggtg

SEQ ID NO: 518549 - DNA, 25 bp, Mus musculus
gatgttaactgcttttgagctttga

SEQ ID NO: 518550 - DNA, 25 bp, Mus musculus
gatgttaactggaaatccacccctc

SEQ ID NO: 518551 - DNA, 25 bp, Mus musculus
gatgttaactggtaatccacccctc

SEQ ID NO: 518552 - DNA, 25 bp, Mus musculus
gatgttaagcaccttcagaagacca

SEQ ID NO: 518553 - DNA, 25 bp, Mus musculus
gatgttaagcacgttcagaagacca

SEQ ID NO: 518554 - DNA, 25 bp, Mus musculus
gatgttaagcctctgttttccgctt

SEQ ID NO: 518555 - DNA, 25 bp, Mus musculus
gatgttaagcctgtgttttccgctt

SEQ ID NO: 518556 - DNA, 25 bp, Mus musculus
gatgttaatttgaccattcattgag

SEQ ID NO: 518557 - DNA, 25 bp, Mus musculus
gatgttaatttgtccattcattgag

SEQ ID NO: 518558 - DNA, 25 bp, Mus musculus
gatgttacagaacgaatgggtcaat

SEQ ID NO: 518559 - DNA, 25 bp, Mus musculus
gatgttacagaaggaatgggtcaat

SEQ ID NO: 518560 - DNA, 25 bp, Mus musculus
gatgttacagatagactctaaaagg

SEQ ID NO: 518561 - DNA, 25 bp, Mus musculus
gatgttacagatccaaagacataga

SEQ ID NO: 518562 - DNA, 25 bp, Mus musculus
gatgttacagatgcaaagacataga

SEQ ID NO: 518563 - DNA, 25 bp, Mus musculus
gatgttacagattgactctaaaagg

SEQ ID NO: 518564 - DNA, 25 bp, Mus musculus
gatgttaccactaaagagagcctac

SEQ ID NO: 518565 - DNA, 25 bp, Mus musculus
gatgttaccacttaagagagcctac

SEQ ID NO: 518566 - DNA, 25 bp, Mus musculus
gatgttaccaggctcacctgaccaa

SEQ ID NO: 518567 - DNA, 25 bp, Mus musculus
gatgttaccagggtcacctgaccaa

SEQ ID NO: 518568 - DNA, 25 bp, Mus musculus
gatgttaccattcacagttgggtta

SEQ ID NO: 518569 - DNA, 25 bp, Mus musculus
gatgttaccattgacagttgggtta

SEQ ID NO: 518570 - DNA, 25 bp, Mus musculus
gatgttacctacagtattaggctga

SEQ ID NO: 518571 - DNA, 25 bp, Mus musculus
gatgttacctactgtattaggctga

SEQ ID NO: 518572 - DNA, 25 bp, Mus musculus
gatgttaccttcacctctgatgttg

SEQ ID NO: 518573 - DNA, 25 bp, Mus musculus
gatgttaccttctcctctgatgttg

SEQ ID NO: 518574 - DNA, 25 bp, Mus musculus
gatgttacctttccttatcagcatt

SEQ ID NO: 518575 - DNA, 25 bp, Mus musculus
gatgttacctttgcttatcagcatt

SEQ ID NO: 518576 - DNA, 25 bp, Mus musculus
gatgttacggatcaagacttgaata

SEQ ID NO: 518577 - DNA, 25 bp, Mus musculus
gatgttacggatgaagacttgaata

SEQ ID NO: 518578 - DNA, 25 bp, Mus musculus
gatgttactataactactgcagaag

SEQ ID NO: 518579 - DNA, 25 bp, Mus musculus
gatgttactatatctactgcagaag

SEQ ID NO: 518580 - DNA, 25 bp, Mus musculus
gatgttactcttccactaaatcttg

SEQ ID NO: 518581 - DNA, 25 bp, Mus musculus
gatgttactcttgcactaaatcttg

SEQ ID NO: 518582 - DNA, 25 bp, Mus musculus
gatgttagacagctggtcaggccac

SEQ ID NO: 518583 - DNA, 25 bp, Mus musculus
gatgttagacaggtggtcaggccac

SEQ ID NO: 518584 - DNA, 25 bp, Mus musculus
gatgttagatgacacaactctgctt

SEQ ID NO: 518585 - DNA, 25 bp, Mus musculus
gatgttagatgagacaactctgctt

SEQ ID NO: 518586 - DNA, 25 bp, Mus musculus
gatgttagcaaactcgccaaacaaa

SEQ ID NO: 518587 - DNA, 25 bp, Mus musculus
gatgttagcaaagtcgccaaacaaa

SEQ ID NO: 518588 - DNA, 25 bp, Mus musculus
gatgttagcacacgaaggttctcct

SEQ ID NO: 518589 - DNA, 25 bp, Mus musculus
gatgttagcacaggaaggttctcct

SEQ ID NO: 518590 - DNA, 25 bp, Mus musculus
gatgttagccttccttatgtgtctt

SEQ ID NO: 518591 - DNA, 25 bp, Mus musculus
gatgttagccttgcttatgtgtctt

SEQ ID NO: 518592 - DNA, 25 bp, Mus musculus
gatgttagctagctggatgctgttt

SEQ ID NO: 518593 - DNA, 25 bp, Mus musculus
gatgttagctaggtggatgctgttt

SEQ ID NO: 518594 - DNA, 25 bp, Mus musculus
gatgttagctgcaggctccccatgg

SEQ ID NO: 518595 - DNA, 25 bp, Mus musculus
gatgttagctgctggctccccatgg

SEQ ID NO: 518596 - DNA, 25 bp, Mus musculus
gatgttagtatgagccccaagtcct

SEQ ID NO: 518597 - DNA, 25 bp, Mus musculus
gatgttagtatgtgccccaagtcct

SEQ ID NO: 518598 - DNA, 25 bp, Mus musculus
gatgttagtgcaatcctattacctc

SEQ ID NO: 518599 - DNA, 25 bp, Mus musculus
gatgttagtgcattcctattacctc

SEQ ID NO: 518600 - DNA, 25 bp, Mus musculus
gatgttataggcagtctttgtgagt

SEQ ID NO: 518601 - DNA, 25 bp, Mus musculus
gatgttataggctgtctttgtgagt

SEQ ID NO: 518602 - DNA, 25 bp, Mus musculus
gatgttatcaccaaatttgagctga

SEQ ID NO: 518603 - DNA, 25 bp, Mus musculus
gatgttatcacctaatttgagctga

SEQ ID NO: 518604 - DNA, 25 bp, Mus musculus
gatgttatcagtcagtgactctggt

SEQ ID NO: 518605 - DNA, 25 bp, Mus musculus
gatgttatcagtgagtgactctggt

SEQ ID NO: 518606 - DNA, 25 bp, Mus musculus
gatgttatccatcctgttcaaccag

SEQ ID NO: 518607 - DNA, 25 bp, Mus musculus
gatgttatccatgctgttcaaccag

SEQ ID NO: 518608 - DNA, 25 bp, Mus musculus
gatgttatctgaacttctttgggat

SEQ ID NO: 518609 - DNA, 25 bp, Mus musculus
gatgttatctgatcttctttgggat

SEQ ID NO: 518610 - DNA, 25 bp, Mus musculus
gatgttatgctgaactatggctgat

SEQ ID NO: 518611 - DNA, 25 bp, Mus musculus
gatgttatgctgtactatggctgat

SEQ ID NO: 518612 - DNA, 25 bp, Mus musculus
gatgttatgggcagactcggccaac

SEQ ID NO: 518613 - DNA, 25 bp, Mus musculus
gatgttatgggctgactcggccaac

SEQ ID NO: 518614 - DNA, 25 bp, Mus musculus
gatgttatgtccaagcatgcagttt

SEQ ID NO: 518615 - DNA, 25 bp, Mus musculus
gatgttatgtcctagcatgcagttt

SEQ ID NO: 518616 - DNA, 25 bp, Mus musculus
gatgttattacacttcttgtttagt

SEQ ID NO: 518617 - DNA, 25 bp, Mus musculus
gatgttattacagttcttgtttagt

SEQ ID NO: 518618 - DNA, 25 bp, Mus musculus
gatgttattactctactttccccaa

SEQ ID NO: 518619 - DNA, 25 bp, Mus musculus
gatgttattactgtactttccccaa

SEQ ID NO: 518620 - DNA, 25 bp, Mus musculus
gatgttattatcacttattactgtt

SEQ ID NO: 518621 - DNA, 25 bp, Mus musculus
gatgttattatctcttattactgtt

SEQ ID NO: 518622 - DNA, 25 bp, Mus musculus
gatgttattcgcaagcctcccgtat

SEQ ID NO: 518623 - DNA, 25 bp, Mus musculus
gatgttattcgctagcctcccgtat

SEQ ID NO: 518624 - DNA, 25 bp, Mus musculus
gatgttattcttccttatgccattc

SEQ ID NO: 518625 - DNA, 25 bp, Mus musculus
gatgttattcttgcttatgccattc

SEQ ID NO: 518626 - DNA, 25 bp, Mus musculus
gatgttatttacactatccatgtga

SEQ ID NO: 518627 - DNA, 25 bp, Mus musculus
gatgttatttactctatccatgtga

SEQ ID NO: 518628 - DNA, 25 bp, Mus musculus
gatgttatttggatggagttgctga

SEQ ID NO: 518629 - DNA, 25 bp, Mus musculus
gatgttatttggttggagttgctga

SEQ ID NO: 518630 - DNA, 25 bp, Mus musculus
gatgttattttgatatctcgggata

SEQ ID NO: 518631 - DNA, 25 bp, Mus musculus
gatgttattttgttatctcgggata

SEQ ID NO: 518632 - DNA, 25 bp, Mus musculus
gatgttcaaaaacccacacttccca

SEQ ID NO: 518633 - DNA, 25 bp, Mus musculus
gatgttcaaaaagccacacttccca

SEQ ID NO: 518634 - DNA, 25 bp, Mus musculus
gatgttcaacatctcccaatttctt

SEQ ID NO: 518635 - DNA, 25 bp, Mus musculus
gatgttcaacatgtcccaatttctt

SEQ ID NO: 518636 - DNA, 25 bp, Mus musculus
gatgttcaacttaccaagactataa

SEQ ID NO: 518637 - DNA, 25 bp, Mus musculus
gatgttcaactttccaagactataa

SEQ ID NO: 518638 - DNA, 25 bp, Mus musculus
gatgttcaatctataacttcatggg

SEQ ID NO: 518639 - DNA, 25 bp, Mus musculus
gatgttcaatctttaacttcatggg

SEQ ID NO: 518640 - DNA, 25 bp, Mus musculus
gatgttcaatgtaagcaaccacttg

SEQ ID NO: 518641 - DNA, 25 bp, Mus musculus
gatgttcaatgttagcaaccacttg

SEQ ID NO: 518642 - DNA, 25 bp, Mus musculus
gatgttcacaaacccatctgcttgg

SEQ ID NO: 518643 - DNA, 25 bp, Mus musculus
gatgttcacaaagccatctgcttgg

SEQ ID NO: 518644 - DNA, 25 bp, Mus musculus
gatgttcacactcagatatttatta

SEQ ID NO: 518645 - DNA, 25 bp, Mus musculus
gatgttcacactgagatatttatta

SEQ ID NO: 518646 - DNA, 25 bp, Mus musculus
gatgttcacccacatgtatcagaag

SEQ ID NO: 518647 - DNA, 25 bp, Mus musculus
gatgttcacccagatgtatcagaag

SEQ ID NO: 518648 - DNA, 25 bp, Mus musculus
gatgttcacggactttttccttcta

SEQ ID NO: 518649 - DNA, 25 bp, Mus musculus
gatgttcacggagtttttccttcta

SEQ ID NO: 518650 - DNA, 25 bp, Mus musculus
gatgttcacggtccgctcagacaag

SEQ ID NO: 518651 - DNA, 25 bp, Mus musculus
gatgttcacggtgcgctcagacaag

SEQ ID NO: 518652 - DNA, 25 bp, Mus musculus
gatgttcactgaacagaacccacaa

SEQ ID NO: 518653 - DNA, 25 bp, Mus musculus
gatgttcactgacttgaagcttagc

SEQ ID NO: 518654 - DNA, 25 bp, Mus musculus
gatgttcactgagttgaagcttagc

SEQ ID NO: 518655 - DNA, 25 bp, Mus musculus
gatgttcactgatcagaacccacaa

SEQ ID NO: 518656 - DNA, 25 bp, Mus musculus
gatgttcactttacgtttgactgat

SEQ ID NO: 518657 - DNA, 25 bp, Mus musculus
gatgttcacttttcgtttgactgat

SEQ ID NO: 518658 - DNA, 25 bp, Mus musculus
gatgttcagagaactttagcgccaa

SEQ ID NO: 518659 - DNA, 25 bp, Mus musculus
gatgttcagagatctttagcgccaa

SEQ ID NO: 518660 - DNA, 25 bp, Mus musculus
gatgttcagagccaggaccacggaa

SEQ ID NO: 518661 - DNA, 25 bp, Mus musculus
gatgttcagagcgaggaccacggaa

SEQ ID NO: 518662 - DNA, 25 bp, Mus musculus
gatgttcagatacccaatggacttg

SEQ ID NO: 518663 - DNA, 25 bp, Mus musculus
gatgttcagatagccaatggacttg

SEQ ID NO: 518664 - DNA, 25 bp, Mus musculus
gatgttcagccaattcctggcaatt

SEQ ID NO: 518665 - DNA, 25 bp, Mus musculus
gatgttcagccatttcctggcaatt

SEQ ID NO: 518666 - DNA, 25 bp, Mus musculus
gatgttcagcctcctatggatgcca

SEQ ID NO: 518667 - DNA, 25 bp, Mus musculus
gatgttcagcctgctatggatgcca

SEQ ID NO: 518668 - DNA, 25 bp, Mus musculus
gatgttcagcgtctcctagagagta

SEQ ID NO: 518669 - DNA, 25 bp, Mus musculus
gatgttcagcgtgtcctagagagta

SEQ ID NO: 518670 - DNA, 25 bp, Mus musculus
gatgttcaggacaatgccgataata

SEQ ID NO: 518671 - DNA, 25 bp, Mus musculus
gatgttcaggactatgccgataata

SEQ ID NO: 518672 - DNA, 25 bp, Mus musculus
gatgttcaggagaggctctgacccc

SEQ ID NO: 518673 - DNA, 25 bp, Mus musculus
gatgttcaggagtggctctgacccc

SEQ ID NO: 518674 - DNA, 25 bp, Mus musculus
gatgttcagtacctttttcactatt

SEQ ID NO: 518675 - DNA, 25 bp, Mus musculus
gatgttcagtacgtttttcactatt

SEQ ID NO: 518676 - DNA, 25 bp, Mus musculus
gatgttcagtatatatattgtctat

SEQ ID NO: 518677 - DNA, 25 bp, Mus musculus
gatgttcagtatttatattgtctat

SEQ ID NO: 518678 - DNA, 25 bp, Mus musculus
gatgttcataagactgctaatacct

SEQ ID NO: 518679 - DNA, 25 bp, Mus musculus
gatgttcataagtctgctaatacct

SEQ ID NO: 518680 - DNA, 25 bp, Mus musculus
gatgttcatactcatgggattctgt

SEQ ID NO: 518681 - DNA, 25 bp, Mus musculus
gatgttcatactgatgggattctgt

SEQ ID NO: 518682 - DNA, 25 bp, Mus musculus
gatgttcatgaaagcttacctccag

SEQ ID NO: 518683 - DNA, 25 bp, Mus musculus
gatgttcatgaatgcttacctccag

SEQ ID NO: 518684 - DNA, 25 bp, Mus musculus
gatgttcatgatccagaccattgcg

SEQ ID NO: 518685 - DNA, 25 bp, Mus musculus
gatgttcatgatgcagaccattgcg

SEQ ID NO: 518686 - DNA, 25 bp, Mus musculus
gatgttcatgctacaggttgccact

SEQ ID NO: 518687 - DNA, 25 bp, Mus musculus
gatgttcatgcttcaggttgccact

SEQ ID NO: 518688 - DNA, 25 bp, Mus musculus
gatgttcatggtcttttcaactcca

SEQ ID NO: 518689 - DNA, 25 bp, Mus musculus
gatgttcatggtgttttcaactcca

SEQ ID NO: 518690 - DNA, 25 bp, Mus musculus
gatgttccaaacatattgctcacta

SEQ ID NO: 518691 - DNA, 25 bp, Mus musculus
gatgttccaaacttattgctcacta

SEQ ID NO: 518692 - DNA, 25 bp, Mus musculus
gatgttccagaccacacgttggaga

SEQ ID NO: 518693 - DNA, 25 bp, Mus musculus
gatgttccagacgacacgttggaga

SEQ ID NO: 518694 - DNA, 25 bp, Mus musculus
gatgttccagcaagtgcccatggta

SEQ ID NO: 518695 - DNA, 25 bp, Mus musculus
gatgttccagcatgtgcccatggta

SEQ ID NO: 518696 - DNA, 25 bp, Mus musculus
gatgttccatgaaaatgacactgat

SEQ ID NO: 518697 - DNA, 25 bp, Mus musculus
gatgttccatgataatgacactgat

SEQ ID NO: 518698 - DNA, 25 bp, Mus musculus
gatgttccattcctgagtttctttc

SEQ ID NO: 518699 - DNA, 25 bp, Mus musculus
gatgttccattcgtgagtttctttc

SEQ ID NO: 518700 - DNA, 25 bp, Mus musculus
gatgttcccatgcttagccacctag

SEQ ID NO: 518701 - DNA, 25 bp, Mus musculus
gatgttcccatggttagccacctag

SEQ ID NO: 518702 - DNA, 25 bp, Mus musculus
gatgttcccctgagcaaagaggact

SEQ ID NO: 518703 - DNA, 25 bp, Mus musculus
gatgttcccctgtgcaaagaggact

SEQ ID NO: 518704 - DNA, 25 bp, Mus musculus
gatgttcccgtaactcataggttct

SEQ ID NO: 518705 - DNA, 25 bp, Mus musculus
gatgttcccgtatctcataggttct

SEQ ID NO: 518706 - DNA, 25 bp, Mus musculus
gatgttccctctagcactgaataat

SEQ ID NO: 518707 - DNA, 25 bp, Mus musculus
gatgttccctctcaaagattgttct

SEQ ID NO: 518708 - DNA, 25 bp, Mus musculus
gatgttccctctgaaagattgttct

SEQ ID NO: 518709 - DNA, 25 bp, Mus musculus
gatgttccctcttgcactgaataat

SEQ ID NO: 518710 - DNA, 25 bp, Mus musculus
gatgttccctgtcagtctgcgggct

SEQ ID NO: 518711 - DNA, 25 bp, Mus musculus
gatgttccctgtgagtctgcgggct

SEQ ID NO: 518712 - DNA, 25 bp, Mus musculus
gatgttccgatgcactcattaaacg

SEQ ID NO: 518713 - DNA, 25 bp, Mus musculus
gatgttccgatggactcattaaacg

SEQ ID NO: 518714 - DNA, 25 bp, Mus musculus
gatgttcctggcattagcagatttt

SEQ ID NO: 518715 - DNA, 25 bp, Mus musculus
gatgttcctggctttagcagatttt

SEQ ID NO: 518716 - DNA, 25 bp, Mus musculus
gatgttccttgaccttcaggttcag

SEQ ID NO: 518717 - DNA, 25 bp, Mus musculus
gatgttccttgagcttcaggttcag

SEQ ID NO: 518718 - DNA, 25 bp, Mus musculus
gatgttccttggatgtttaatcaag

SEQ ID NO: 518719 - DNA, 25 bp, Mus musculus
gatgttccttggttgtttaatcaag

SEQ ID NO: 518720 - DNA, 25 bp, Mus musculus
gatgttcgagacctttgacttcaac

SEQ ID NO: 518721 - DNA, 25 bp, Mus musculus
gatgttcgagacgtttgacttcaac

SEQ ID NO: 518722 - DNA, 25 bp, Mus musculus
gatgttcgcaataagctttgtttta

SEQ ID NO: 518723 - DNA, 25 bp, Mus musculus
gatgttcgcaattagctttgtttta

SEQ ID NO: 518724 - DNA, 25 bp, Mus musculus
gatgttcgcgataatcttctatatc

SEQ ID NO: 518725 - DNA, 25 bp, Mus musculus
gatgttcgcgattatcttctatatc

SEQ ID NO: 518726 - DNA, 25 bp, Mus musculus
gatgttcggcagaacgttctggaga

SEQ ID NO: 518727 - DNA, 25 bp, Mus musculus
gatgttcggcagtacgttctggaga

SEQ ID NO: 518728 - DNA, 25 bp, Mus musculus
gatgttcggctgatctggtaatgaa

SEQ ID NO: 518729 - DNA, 25 bp, Mus musculus
gatgttcggctgttctggtaatgaa

SEQ ID NO: 518730 - DNA, 25 bp, Mus musculus
gatgttcgttcaaatgtccttacaa

SEQ ID NO: 518731 - DNA, 25 bp, Mus musculus
gatgttcgttcatatgtccttacaa

SEQ ID NO: 518732 - DNA, 25 bp, Mus musculus
gatgttctaactacatacttttcaa

SEQ ID NO: 518733 - DNA, 25 bp, Mus musculus
gatgttctaacttcatacttttcaa

SEQ ID NO: 518734 - DNA, 25 bp, Mus musculus
gatgttctacaaactcaccagtggt

SEQ ID NO: 518735 - DNA, 25 bp, Mus musculus
gatgttctacaatctcaccagtggt

SEQ ID NO: 518736 - DNA, 25 bp, Mus musculus
gatgttctacaccatatctacagtg

SEQ ID NO: 518737 - DNA, 25 bp, Mus musculus
gatgttctacacgatatctacagtg

SEQ ID NO: 518738 - DNA, 25 bp, Mus musculus
gatgttctagaactcctgtctttct

SEQ ID NO: 518739 - DNA, 25 bp, Mus musculus
gatgttctagaagtcctgtctttct

SEQ ID NO: 518740 - DNA, 25 bp, Mus musculus
gatgttctagacagttctacccaaa

SEQ ID NO: 518741 - DNA, 25 bp, Mus musculus
gatgttctagactgttctacccaaa

SEQ ID NO: 518742 - DNA, 25 bp, Mus musculus
gatgttctcagcactcagatcccac

SEQ ID NO: 518743 - DNA, 25 bp, Mus musculus
gatgttctcagctctcagatcccac

SEQ ID NO: 518744 - DNA, 25 bp, Mus musculus
gatgttctcccaacaaggatgatag

SEQ ID NO: 518745 - DNA, 25 bp, Mus musculus
gatgttctcccatcaaggatgatag

SEQ ID NO: 518746 - DNA, 25 bp, Mus musculus
gatgttctccgtctaatcggcaata

SEQ ID NO: 518747 - DNA, 25 bp, Mus musculus
gatgttctccgtgtaatcggcaata

SEQ ID NO: 518748 - DNA, 25 bp, Mus musculus
gatgttctctaacaagccgcacggg

SEQ ID NO: 518749 - DNA, 25 bp, Mus musculus
gatgttctctaagaagccgcacggg

SEQ ID NO: 518750 - DNA, 25 bp, Mus musculus
gatgttctctcaagtttcaaactta

SEQ ID NO: 518751 - DNA, 25 bp, Mus musculus
gatgttctctcatgtttcaaactta

SEQ ID NO: 518752 - DNA, 25 bp, Mus musculus
gatgttctgaagatcccaggagcgc

SEQ ID NO: 518753 - DNA, 25 bp, Mus musculus
gatgttctgaagttcccaggagcgc

SEQ ID NO: 518754 - DNA, 25 bp, Mus musculus
gatgttctgagacccaggacagtcc

SEQ ID NO: 518755 - DNA, 25 bp, Mus musculus
gatgttctgagagccaggacagtcc

SEQ ID NO: 518756 - DNA, 25 bp, Mus musculus
gatgttctgcaacgccttggacagt

SEQ ID NO: 518757 - DNA, 25 bp, Mus musculus
gatgttctgcaaggccttggacagt

SEQ ID NO: 518758 - DNA, 25 bp, Mus musculus
gatgttctgggcagtcccacggcca

SEQ ID NO: 518759 - DNA, 25 bp, Mus musculus
gatgttctgggctgtcccacggcca

SEQ ID NO: 518760 - DNA, 25 bp, Mus musculus
gatgttctgtatattcctcttgggt

SEQ ID NO: 518761 - DNA, 25 bp, Mus musculus
gatgttctgtattttcctcttgggt

SEQ ID NO: 518762 - DNA, 25 bp, Mus musculus
gatgttcttagactggccttattat

SEQ ID NO: 518763 - DNA, 25 bp, Mus musculus
gatgttcttagagtggccttattat

SEQ ID NO: 518764 - DNA, 25 bp, Mus musculus
gatgttcttatcagattggagcttg

SEQ ID NO: 518765 - DNA, 25 bp, Mus musculus
gatgttcttatcattgtttccccaa

SEQ ID NO: 518766 - DNA, 25 bp, Mus musculus
gatgttcttatctgattggagcttg

SEQ ID NO: 518767 - DNA, 25 bp, Mus musculus
gatgttcttatctttgtttccccaa

SEQ ID NO: 518768 - DNA, 25 bp, Mus musculus
gatgttcttcacaaaggcaaactgc

SEQ ID NO: 518769 - DNA, 25 bp, Mus musculus
gatgttcttcactaaggcaaactgc

SEQ ID NO: 518770 - DNA, 25 bp, Mus musculus
gatgttcttccacagttggtctctg

SEQ ID NO: 518771 - DNA, 25 bp, Mus musculus
gatgttcttccagagttggtctctg

SEQ ID NO: 518772 - DNA, 25 bp, Mus musculus
gatgttcttgaaaatggccagccac

SEQ ID NO: 518773 - DNA, 25 bp, Mus musculus
gatgttcttgaatatggccagccac

SEQ ID NO: 518774 - DNA, 25 bp, Mus musculus
gatgttctttcacagcggatgaatg

SEQ ID NO: 518775 - DNA, 25 bp, Mus musculus
gatgttctttcagagcggatgaatg

SEQ ID NO: 518776 - DNA, 25 bp, Mus musculus
gatgttctttgacctgcttacattt

SEQ ID NO: 518777 - DNA, 25 bp, Mus musculus
gatgttctttgagctgcttacattt

SEQ ID NO: 518778 - DNA, 25 bp, Mus musculus
gatgttctttgtctgtgctacacat

SEQ ID NO: 518779 - DNA, 25 bp, Mus musculus
gatgttctttgtgtgtgctacacat

SEQ ID NO: 518780 - DNA, 25 bp, Mus musculus
gatgttgaaaatctcagtctttttt

SEQ ID NO: 518781 - DNA, 25 bp, Mus musculus
gatgttgaaaatgtcagtctttttt

SEQ ID NO: 518782 - DNA, 25 bp, Mus musculus
gatgttgaaacactgccataagatt

SEQ ID NO: 518783 - DNA, 25 bp, Mus musculus
gatgttgaaacagtgccataagatt

SEQ ID NO: 518784 - DNA, 25 bp, Mus musculus
gatgttgaaactactccttcaggta

SEQ ID NO: 518785 - DNA, 25 bp, Mus musculus
gatgttgaaacttctccttcaggta

SEQ ID NO: 518786 - DNA, 25 bp, Mus musculus
gatgttgaatttaacgacaccccta

SEQ ID NO: 518787 - DNA, 25 bp, Mus musculus
gatgttgaattttacgacaccccta

SEQ ID NO: 518788 - DNA, 25 bp, Mus musculus
gatgttgacatcagagtgcccatca

SEQ ID NO: 518789 - DNA, 25 bp, Mus musculus
gatgttgacatctgagtgcccatca

SEQ ID NO: 518790 - DNA, 25 bp, Mus musculus
gatgttgacttaactaactggctaa

SEQ ID NO: 518791 - DNA, 25 bp, Mus musculus
gatgttgacttatctaactggctaa

SEQ ID NO: 518792 - DNA, 25 bp, Mus musculus
gatgttgactttctaccatacgtga

SEQ ID NO: 518793 - DNA, 25 bp, Mus musculus
gatgttgactttgtaccatacgtga

SEQ ID NO: 518794 - DNA, 25 bp, Mus musculus
gatgttgagaagaccccttgagcgt

SEQ ID NO: 518795 - DNA, 25 bp, Mus musculus
gatgttgagaagtccccttgagcgt

SEQ ID NO: 518796 - DNA, 25 bp, Mus musculus
gatgttgagaatagtgtgccgccca

SEQ ID NO: 518797 - DNA, 25 bp, Mus musculus
gatgttgagaattgtgtgccgccca

SEQ ID NO: 518798 - DNA, 25 bp, Mus musculus
gatgttgagccaacaacctcgacat

SEQ ID NO: 518799 - DNA, 25 bp, Mus musculus
gatgttgagccatcaacctcgacat

SEQ ID NO: 518800 - DNA, 25 bp, Mus musculus
gatgttgatacccactctgattatt

SEQ ID NO: 518801 - DNA, 25 bp, Mus musculus
gatgttgataccgactctgattatt

SEQ ID NO: 518802 - DNA, 25 bp, Mus musculus
gatgttgatatgaaactgccaccat

SEQ ID NO: 518803 - DNA, 25 bp, Mus musculus
gatgttgatatgtaactgccaccat

SEQ ID NO: 518804 - DNA, 25 bp, Mus musculus
gatgttgatattctacctttttccc

SEQ ID NO: 518805 - DNA, 25 bp, Mus musculus
gatgttgatattgtacctttttccc

SEQ ID NO: 518806 - DNA, 25 bp, Mus musculus
gatgttgatcaaaggtagagcactt

SEQ ID NO: 518807 - DNA, 25 bp, Mus musculus
gatgttgatcaaatgtctgagctga

SEQ ID NO: 518808 - DNA, 25 bp, Mus musculus
gatgttgatcaatggtagagcactt

SEQ ID NO: 518809 - DNA, 25 bp, Mus musculus
gatgttgatcaattgtctgagctga

SEQ ID NO: 518810 - DNA, 25 bp, Mus musculus
gatgttgatctgaagctctgatttt

SEQ ID NO: 518811 - DNA, 25 bp, Mus musculus
gatgttgatctgtagctctgatttt

SEQ ID NO: 518812 - DNA, 25 bp, Mus musculus
gatgttgcaatcactgctattttaa

SEQ ID NO: 518813 - DNA, 25 bp, Mus musculus
gatgttgcaatctctgctattttaa

SEQ ID NO: 518814 - DNA, 25 bp, Mus musculus
gatgttgcactgctggcaattcatc

SEQ ID NO: 518815 - DNA, 25 bp, Mus musculus
gatgttgcactggtggcaattcatc

SEQ ID NO: 518816 - DNA, 25 bp, Mus musculus
gatgttgcagaaacacatggtttca

SEQ ID NO: 518817 - DNA, 25 bp, Mus musculus
gatgttgcagaatcacatggtttca

SEQ ID NO: 518818 - DNA, 25 bp, Mus musculus
gatgttgcagagaccgatttctcca

SEQ ID NO: 518819 - DNA, 25 bp, Mus musculus
gatgttgcagagtccgatttctcca

SEQ ID NO: 518820 - DNA, 25 bp, Mus musculus
gatgttgcatctaagttcaatcaga

SEQ ID NO: 518821 - DNA, 25 bp, Mus musculus
gatgttgcatcttagttcaatcaga

SEQ ID NO: 518822 - DNA, 25 bp, Mus musculus
gatgttgcattgattttcactgtaa

SEQ ID NO: 518823 - DNA, 25 bp, Mus musculus
gatgttgcattgcttttcagttacc

SEQ ID NO: 518824 - DNA, 25 bp, Mus musculus
gatgttgcattggttttcagttacc

SEQ ID NO: 518825 - DNA, 25 bp, Mus musculus
gatgttgcattgtttttcactgtaa

SEQ ID NO: 518826 - DNA, 25 bp, Mus musculus
gatgttgcatttagtgtgaccgtcc

SEQ ID NO: 518827 - DNA, 25 bp, Mus musculus
gatgttgcattttgtgtgaccgtcc

SEQ ID NO: 518828 - DNA, 25 bp, Mus musculus
gatgttgccatgctactagatgaag

SEQ ID NO: 518829 - DNA, 25 bp, Mus musculus
gatgttgccatggtactagatgaag

SEQ ID NO: 518830 - DNA, 25 bp, Mus musculus
gatgttgccattctgacgatctaga

SEQ ID NO: 518831 - DNA, 25 bp, Mus musculus
gatgttgccattgtgacgatctaga

SEQ ID NO: 518832 - DNA, 25 bp, Mus musculus
gatgttgcctggcacttgactgtaa

SEQ ID NO: 518833 - DNA, 25 bp, Mus musculus
gatgttgcctgggacttgactgtaa

SEQ ID NO: 518834 - DNA, 25 bp, Mus musculus
gatgttgcctgtactgaccacaagg

SEQ ID NO: 518835 - DNA, 25 bp, Mus musculus
gatgttgcctgttctgaccacaagg

SEQ ID NO: 518836 - DNA, 25 bp, Mus musculus
gatgttgccttgagtccaagacata

SEQ ID NO: 518837 - DNA, 25 bp, Mus musculus
gatgttgccttgtgtccaagacata

SEQ ID NO: 518838 - DNA, 25 bp, Mus musculus
gatgttgcgactcttcaagcacaca

SEQ ID NO: 518839 - DNA, 25 bp, Mus musculus
gatgttgcgactgttcaagcacaca

SEQ ID NO: 518840 - DNA, 25 bp, Mus musculus
gatgttgcgatactgacatgcagtt

SEQ ID NO: 518841 - DNA, 25 bp, Mus musculus
gatgttgcgatagtgacatgcagtt

SEQ ID NO: 518842 - DNA, 25 bp, Mus musculus
gatgttgcggttatgactttgtttt

SEQ ID NO: 518843 - DNA, 25 bp, Mus musculus
gatgttgcggttttgactttgtttt

SEQ ID NO: 518844 - DNA, 25 bp, Mus musculus
gatgttgctacgaggtgtggcccca

SEQ ID NO: 518845 - DNA, 25 bp, Mus musculus
gatgttgctacgtggtgtggcccca

SEQ ID NO: 518846 - DNA, 25 bp, Mus musculus
gatgttgctgcacactgtgaagtca

SEQ ID NO: 518847 - DNA, 25 bp, Mus musculus
gatgttgctgcagactgtgaagtca

SEQ ID NO: 518848 - DNA, 25 bp, Mus musculus
gatgttgctgtcattcttcgttctc

SEQ ID NO: 518849 - DNA, 25 bp, Mus musculus
gatgttgctgtctttcttcgttctc

SEQ ID NO: 518850 - DNA, 25 bp, Mus musculus
gatgttgctgttcaaattgccagga

SEQ ID NO: 518851 - DNA, 25 bp, Mus musculus
gatgttgctgttgaaattgccagga

SEQ ID NO: 518852 - DNA, 25 bp, Mus musculus
gatgttgcttgcattctaatggtaa

SEQ ID NO: 518853 - DNA, 25 bp, Mus musculus
gatgttgcttgctttctaatggtaa

SEQ ID NO: 518854 - DNA, 25 bp, Mus musculus
gatgttgcttgtactgttttcaggg

SEQ ID NO: 518855 - DNA, 25 bp, Mus musculus
gatgttgcttgttctgttttcaggg

SEQ ID NO: 518856 - DNA, 25 bp, Mus musculus
gatgttggactacacaatttcttaa

SEQ ID NO: 518857 - DNA, 25 bp, Mus musculus
gatgttggactagacaatttcttaa

SEQ ID NO: 518858 - DNA, 25 bp, Mus musculus
gatgttggagtgaattactgtcaaa

SEQ ID NO: 518859 - DNA, 25 bp, Mus musculus
gatgttggagtgtattactgtcaaa

SEQ ID NO: 518860 - DNA, 25 bp, Mus musculus
gatgttggcataatggcttctttct

SEQ ID NO: 518861 - DNA, 25 bp, Mus musculus
gatgttggcatattggcttctttct

SEQ ID NO: 518862 - DNA, 25 bp, Mus musculus
gatgttggccttccggataagttcc

SEQ ID NO: 518863 - DNA, 25 bp, Mus musculus
gatgttggccttgcggataagttcc

SEQ ID NO: 518864 - DNA, 25 bp, Mus musculus
gatgttggctatcaaattgctgtgt

SEQ ID NO: 518865 - DNA, 25 bp, Mus musculus
gatgttggctatgaaattgctgtgt

SEQ ID NO: 518866 - DNA, 25 bp, Mus musculus
gatgttggctgacaaagcctgctga

SEQ ID NO: 518867 - DNA, 25 bp, Mus musculus
gatgttggctgagaaagcctgctga

SEQ ID NO: 518868 - DNA, 25 bp, Mus musculus
gatgttgggaaacttcctccccact

SEQ ID NO: 518869 - DNA, 25 bp, Mus musculus
gatgttgggaaagttcctccccact

SEQ ID NO: 518870 - DNA, 25 bp, Mus musculus
gatgttgggcatatgaccctttatt

SEQ ID NO: 518871 - DNA, 25 bp, Mus musculus
gatgttgggcatttgaccctttatt

SEQ ID NO: 518872 - DNA, 25 bp, Mus musculus
gatgttgggtttagtcttctgaaga

SEQ ID NO: 518873 - DNA, 25 bp, Mus musculus
gatgttgggttttgtcttctgaaga

SEQ ID NO: 518874 - DNA, 25 bp, Mus musculus
gatgttggtactctgtcatggtcac

SEQ ID NO: 518875 - DNA, 25 bp, Mus musculus
gatgttggtactgtgtcatggtcac

SEQ ID NO: 518876 - DNA, 25 bp, Mus musculus
gatgttggtatacactgcctgctga

SEQ ID NO: 518877 - DNA, 25 bp, Mus musculus
gatgttggtatagactgcctgctga

SEQ ID NO: 518878 - DNA, 25 bp, Mus musculus
gatgttggtcctagaaagtatgcac

SEQ ID NO: 518879 - DNA, 25 bp, Mus musculus
gatgttggtccttgaaagtatgcac

SEQ ID NO: 518880 - DNA, 25 bp, Mus musculus
gatgttggttgaatcccaggggcat

SEQ ID NO: 518881 - DNA, 25 bp, Mus musculus
gatgttggttgattcccaggggcat

SEQ ID NO: 518882 - DNA, 25 bp, Mus musculus
gatgttggtttcacagtgtgtgatc

SEQ ID NO: 518883 - DNA, 25 bp, Mus musculus
gatgttggtttctcagtgtgtgatc

SEQ ID NO: 518884 - DNA, 25 bp, Mus musculus
gatgttgtaactaccactctcagca

SEQ ID NO: 518885 - DNA, 25 bp, Mus musculus
gatgttgtaacttccactctcagca

SEQ ID NO: 518886 - DNA, 25 bp, Mus musculus
gatgttgtacacagctttacttaac

SEQ ID NO: 518887 - DNA, 25 bp, Mus musculus
gatgttgtacactgctttacttaac

SEQ ID NO: 518888 - DNA, 25 bp, Mus musculus
gatgttgtacagaaaactcttttaa

SEQ ID NO: 518889 - DNA, 25 bp, Mus musculus
gatgttgtacagtaaactcttttaa

SEQ ID NO: 518890 - DNA, 25 bp, Mus musculus
gatgttgtagccacaaatgcagaac

SEQ ID NO: 518891 - DNA, 25 bp, Mus musculus
gatgttgtagcctcaaatgcagaac

SEQ ID NO: 518892 - DNA, 25 bp, Mus musculus
gatgttgtatccagtggaccagaaa

SEQ ID NO: 518893 - DNA, 25 bp, Mus musculus
gatgttgtatcctgtggaccagaaa

SEQ ID NO: 518894 - DNA, 25 bp, Mus musculus
gatgttgtcatacactgccaggcac

SEQ ID NO: 518895 - DNA, 25 bp, Mus musculus
gatgttgtcatagactgccaggcac

SEQ ID NO: 518896 - DNA, 25 bp, Mus musculus
gatgttgtctagagtagctatctat

SEQ ID NO: 518897 - DNA, 25 bp, Mus musculus
gatgttgtctagtgtagctatctat

SEQ ID NO: 518898 - DNA, 25 bp, Mus musculus
gatgttgtctataggcttgctgcaa

SEQ ID NO: 518899 - DNA, 25 bp, Mus musculus
gatgttgtctattggcttgctgcaa

SEQ ID NO: 518900 - DNA, 25 bp, Mus musculus
gatgttgtgaggctacatccatttg

SEQ ID NO: 518901 - DNA, 25 bp, Mus musculus
gatgttgtgagggtacatccatttg

SEQ ID NO: 518902 - DNA, 25 bp, Mus musculus
gatgttgtgatcaacgtgttctgcc

SEQ ID NO: 518903 - DNA, 25 bp, Mus musculus
gatgttgtgatctacgtgttctgcc

SEQ ID NO: 518904 - DNA, 25 bp, Mus musculus
gatgttgtgctcaattatcccatgt

SEQ ID NO: 518905 - DNA, 25 bp, Mus musculus
gatgttgtgctctattatcccatgt

SEQ ID NO: 518906 - DNA, 25 bp, Mus musculus
gatgttgtggtcagcaccgtgagcc

SEQ ID NO: 518907 - DNA, 25 bp, Mus musculus
gatgttgtggtctgcaccgtgagcc

SEQ ID NO: 518908 - DNA, 25 bp, Mus musculus
gatgttgtgtccatactgcggagta

SEQ ID NO: 518909 - DNA, 25 bp, Mus musculus
gatgttgtgtccttactgcggagta

SEQ ID NO: 518910 - DNA, 25 bp, Mus musculus
gatgttgtgttcctaagtccacctt

SEQ ID NO: 518911 - DNA, 25 bp, Mus musculus
gatgttgtgttcgtaagtccacctt

SEQ ID NO: 518912 - DNA, 25 bp, Mus musculus
gatgttgttacacagatattgcata

SEQ ID NO: 518913 - DNA, 25 bp, Mus musculus
gatgttgttacagagatattgcata

SEQ ID NO: 518914 - DNA, 25 bp, Mus musculus
gatgttgttcgaacaggctactaca

SEQ ID NO: 518915 - DNA, 25 bp, Mus musculus
gatgttgttcgatcaggctactaca

SEQ ID NO: 518916 - DNA, 25 bp, Mus musculus
gatgttgttcgcatcaacagcgatg

SEQ ID NO: 518917 - DNA, 25 bp, Mus musculus
gatgttgttcgcttcaacagcgatg

SEQ ID NO: 518918 - DNA, 25 bp, Mus musculus
gatgttgttgtcctgccaaatccct

SEQ ID NO: 518919 - DNA, 25 bp, Mus musculus
gatgttgttgtcgtgccaaatccct

SEQ ID NO: 518920 - DNA, 25 bp, Mus musculus
gatgtttaaaatctgccgtaattgg

SEQ ID NO: 518921 - DNA, 25 bp, Mus musculus
gatgtttaaaatgtgccgtaattgg

SEQ ID NO: 518922 - DNA, 25 bp, Mus musculus
gatgtttaaatgcaggacttcccag

SEQ ID NO: 518923 - DNA, 25 bp, Mus musculus
gatgtttaaatggaggacttcccag

SEQ ID NO: 518924 - DNA, 25 bp, Mus musculus
gatgtttaacttcagatgagggcta

SEQ ID NO: 518925 - DNA, 25 bp, Mus musculus
gatgtttaacttgagatgagggcta

SEQ ID NO: 518926 - DNA, 25 bp, Mus musculus
gatgtttaatccactgtaccacctt

SEQ ID NO: 518927 - DNA, 25 bp, Mus musculus
gatgtttaatcctctgtaccacctt

SEQ ID NO: 518928 - DNA, 25 bp, Mus musculus
gatgtttaatctacactcaataatt

SEQ ID NO: 518929 - DNA, 25 bp, Mus musculus
gatgtttaatcttcactcaataatt

SEQ ID NO: 518930 - DNA, 25 bp, Mus musculus
gatgtttaatgtcttgcttggcttc

SEQ ID NO: 518931 - DNA, 25 bp, Mus musculus
gatgtttaatgtgttgcttggcttc

SEQ ID NO: 518932 - DNA, 25 bp, Mus musculus
gatgtttacaacagccacgaagtcg

SEQ ID NO: 518933 - DNA, 25 bp, Mus musculus
gatgtttacaactgccacgaagtcg

SEQ ID NO: 518934 - DNA, 25 bp, Mus musculus
gatgtttacatcagggctcagacgt

SEQ ID NO: 518935 - DNA, 25 bp, Mus musculus
gatgtttacatctgggctcagacgt

SEQ ID NO: 518936 - DNA, 25 bp, Mus musculus
gatgtttacctacatgtctggcaaa

SEQ ID NO: 518937 - DNA, 25 bp, Mus musculus
gatgtttacctagatgtctggcaaa

SEQ ID NO: 518938 - DNA, 25 bp, Mus musculus
gatgtttacttgaaattgtgctttt

SEQ ID NO: 518939 - DNA, 25 bp, Mus musculus
gatgtttacttgtaattgtgctttt

SEQ ID NO: 518940 - DNA, 25 bp, Mus musculus
gatgtttactttatactagatttca

SEQ ID NO: 518941 - DNA, 25 bp, Mus musculus
gatgtttactttttactagatttca

SEQ ID NO: 518942 - DNA, 25 bp, Mus musculus
gatgtttagatcatcccttaagggc

SEQ ID NO: 518943 - DNA, 25 bp, Mus musculus
gatgtttagatcttcccttaagggc

SEQ ID NO: 518944 - DNA, 25 bp, Mus musculus
gatgtttagcacaacacactttgta

SEQ ID NO: 518945 - DNA, 25 bp, Mus musculus
gatgtttagcactacacactttgta

SEQ ID NO: 518946 - DNA, 25 bp, Mus musculus
gatgtttagcgtatctctttgcact

SEQ ID NO: 518947 - DNA, 25 bp, Mus musculus
gatgtttagcgtttctctttgcact

SEQ ID NO: 518948 - DNA, 25 bp, Mus musculus
gatgtttagctcatggttgcaagca

SEQ ID NO: 518949 - DNA, 25 bp, Mus musculus
gatgtttagctcttggttgcaagca

SEQ ID NO: 518950 - DNA, 25 bp, Mus musculus
gatgtttaggtcaccttagacctca

SEQ ID NO: 518951 - DNA, 25 bp, Mus musculus
gatgtttaggtcctatttttcaatt

SEQ ID NO: 518952 - DNA, 25 bp, Mus musculus
gatgtttaggtcgtatttttcaatt

SEQ ID NO: 518953 - DNA, 25 bp, Mus musculus
gatgtttaggtctccttagacctca

SEQ ID NO: 518954 - DNA, 25 bp, Mus musculus
gatgtttatcaaattgtttaccaag

SEQ ID NO: 518955 - DNA, 25 bp, Mus musculus
gatgtttatcaatttgtttaccaag

SEQ ID NO: 518956 - DNA, 25 bp, Mus musculus
gatgtttattatcccggttgagctt

SEQ ID NO: 518957 - DNA, 25 bp, Mus musculus
gatgtttattatgccggttgagctt

SEQ ID NO: 518958 - DNA, 25 bp, Mus musculus
gatgtttcaagcaactgcagcggaa

SEQ ID NO: 518959 - DNA, 25 bp, Mus musculus
gatgtttcaagctactgcagcggaa

SEQ ID NO: 518960 - DNA, 25 bp, Mus musculus
gatgtttcactaagcaggaacctag

SEQ ID NO: 518961 - DNA, 25 bp, Mus musculus
gatgtttcactatgcaggaacctag

SEQ ID NO: 518962 - DNA, 25 bp, Mus musculus
gatgtttcaggtccccagtctggaa

SEQ ID NO: 518963 - DNA, 25 bp, Mus musculus
gatgtttcaggtgcccagtctggaa

SEQ ID NO: 518964 - DNA, 25 bp, Mus musculus
gatgtttcatggattctacctcaaa

SEQ ID NO: 518965 - DNA, 25 bp, Mus musculus
gatgtttcatggtttctacctcaaa

SEQ ID NO: 518966 - DNA, 25 bp, Mus musculus
gatgtttcatttatctcagctcact

SEQ ID NO: 518967 - DNA, 25 bp, Mus musculus
gatgtttcatttttctcagctcact

SEQ ID NO: 518968 - DNA, 25 bp, Mus musculus
gatgtttccaagacttctgagccaa

SEQ ID NO: 518969 - DNA, 25 bp, Mus musculus
gatgtttccaagtcttctgagccaa

SEQ ID NO: 518970 - DNA, 25 bp, Mus musculus
gatgtttccagacgattgtgttctt

SEQ ID NO: 518971 - DNA, 25 bp, Mus musculus
gatgtttccagaggattgtgttctt

SEQ ID NO: 518972 - DNA, 25 bp, Mus musculus
gatgtttccatcacaatgatattgt

SEQ ID NO: 518973 - DNA, 25 bp, Mus musculus
gatgtttccatctcaatgatattgt

SEQ ID NO: 518974 - DNA, 25 bp, Mus musculus
gatgtttcccgaccccagagagatt

SEQ ID NO: 518975 - DNA, 25 bp, Mus musculus
gatgtttcccgagcccagagagatt

SEQ ID NO: 518976 - DNA, 25 bp, Mus musculus
gatgtttccctacaataacaacctt

SEQ ID NO: 518977 - DNA, 25 bp, Mus musculus
gatgtttccctagaataacaacctt

SEQ ID NO: 518978 - DNA, 25 bp, Mus musculus
gatgtttcctcaagaatggttccaa

SEQ ID NO: 518979 - DNA, 25 bp, Mus musculus
gatgtttcctcaatcttacacagta

SEQ ID NO: 518980 - DNA, 25 bp, Mus musculus
gatgtttcctcatgaatggttccaa

SEQ ID NO: 518981 - DNA, 25 bp, Mus musculus
gatgtttcctcattcttacacagta

SEQ ID NO: 518982 - DNA, 25 bp, Mus musculus
gatgtttcctggctatcctccaaga

SEQ ID NO: 518983 - DNA, 25 bp, Mus musculus
gatgtttcctgggtatcctccaaga

SEQ ID NO: 518984 - DNA, 25 bp, Mus musculus
gatgtttccttcacgactacggtaa

SEQ ID NO: 518985 - DNA, 25 bp, Mus musculus
gatgtttccttctcgactacggtaa

SEQ ID NO: 518986 - DNA, 25 bp, Mus musculus
gatgtttcgtctactcgcttgtcaa

SEQ ID NO: 518987 - DNA, 25 bp, Mus musculus
gatgtttcgtcttctcgcttgtcaa

SEQ ID NO: 518988 - DNA, 25 bp, Mus musculus
gatgtttctaagaagctgaattcct

SEQ ID NO: 518989 - DNA, 25 bp, Mus musculus
gatgtttctaagtagctgaattcct

SEQ ID NO: 518990 - DNA, 25 bp, Mus musculus
gatgtttctcccattgacttagtca

SEQ ID NO: 518991 - DNA, 25 bp, Mus musculus
gatgtttctccccaagattcttgat

SEQ ID NO: 518992 - DNA, 25 bp, Mus musculus
gatgtttctcccgaagattcttgat

SEQ ID NO: 518993 - DNA, 25 bp, Mus musculus
gatgtttctccctttgacttagtca

SEQ ID NO: 518994 - DNA, 25 bp, Mus musculus
gatgtttctctgaatttcactggtt

SEQ ID NO: 518995 - DNA, 25 bp, Mus musculus
gatgtttctctgtatttcactggtt

SEQ ID NO: 518996 - DNA, 25 bp, Mus musculus
gatgtttctgacacatgcgtgggtt

SEQ ID NO: 518997 - DNA, 25 bp, Mus musculus
gatgtttctgactcatgcgtgggtt

SEQ ID NO: 518998 - DNA, 25 bp, Mus musculus
gatgtttctggcattttgttctcaa

SEQ ID NO: 518999 - DNA, 25 bp, Mus musculus
gatgtttctggctttttgttctcaa

SEQ ID NO: 519000 - DNA, 25 bp, Mus musculus
gatgtttctgtcaggcggaagaatt

SEQ ID NO: 519001 - DNA, 25 bp, Mus musculus
gatgtttctgtctggcggaagaatt

SEQ ID NO: 519002 - DNA, 25 bp, Mus musculus
gatgtttctgttagctaatcctgct

SEQ ID NO: 519003 - DNA, 25 bp, Mus musculus
gatgtttctgtttgctaatcctgct

SEQ ID NO: 519004 - DNA, 25 bp, Mus musculus
gatgtttcttgccttgtgtttgtta

SEQ ID NO: 519005 - DNA, 25 bp, Mus musculus
gatgtttcttgcgttgtgtttgtta

SEQ ID NO: 519006 - DNA, 25 bp, Mus musculus
gatgtttgaaagcttggtacccagt

SEQ ID NO: 519007 - DNA, 25 bp, Mus musculus
gatgtttgaaaggttggtacccagt

SEQ ID NO: 519008 - DNA, 25 bp, Mus musculus
gatgtttgagttagcaaggctgcct

SEQ ID NO: 519009 - DNA, 25 bp, Mus musculus
gatgtttgagtttgcaaggctgcct

SEQ ID NO: 519010 - DNA, 25 bp, Mus musculus
gatgtttgatctacaacagcttaga

SEQ ID NO: 519011 - DNA, 25 bp, Mus musculus
gatgtttgatcttcaacagcttaga

SEQ ID NO: 519012 - DNA, 25 bp, Mus musculus
gatgtttgattgatggtgtgctctt

SEQ ID NO: 519013 - DNA, 25 bp, Mus musculus
gatgtttgattgttggtgtgctctt

SEQ ID NO: 519014 - DNA, 25 bp, Mus musculus
gatgtttgcacaatagagctttcag

SEQ ID NO: 519015 - DNA, 25 bp, Mus musculus
gatgtttgcacattagagctttcag

SEQ ID NO: 519016 - DNA, 25 bp, Mus musculus
gatgtttgcagcatacagtgtcatt

SEQ ID NO: 519017 - DNA, 25 bp, Mus musculus
gatgtttgcagcttacagtgtcatt

SEQ ID NO: 519018 - DNA, 25 bp, Mus musculus
gatgtttgccataaaacctcaactt

SEQ ID NO: 519019 - DNA, 25 bp, Mus musculus
gatgtttgccattaaacctcaactt

SEQ ID NO: 519020 - DNA, 25 bp, Mus musculus
gatgtttgcctcacttacagtctag

SEQ ID NO: 519021 - DNA, 25 bp, Mus musculus
gatgtttgcctctcttacagtctag

SEQ ID NO: 519022 - DNA, 25 bp, Mus musculus
gatgtttggacaagctggattaccc

SEQ ID NO: 519023 - DNA, 25 bp, Mus musculus
gatgtttggacacagaccaaagacc

SEQ ID NO: 519024 - DNA, 25 bp, Mus musculus
gatgtttggacacttcgttttgagt

SEQ ID NO: 519025 - DNA, 25 bp, Mus musculus
gatgtttggacagagaccaaagacc

SEQ ID NO: 519026 - DNA, 25 bp, Mus musculus
gatgtttggacagttcgttttgagt

SEQ ID NO: 519027 - DNA, 25 bp, Mus musculus
gatgtttggacatgctggattaccc

SEQ ID NO: 519028 - DNA, 25 bp, Mus musculus
gatgtttggcatctcggtctcgcag

SEQ ID NO: 519029 - DNA, 25 bp, Mus musculus
gatgtttggcatgtcggtctcgcag

SEQ ID NO: 519030 - DNA, 25 bp, Mus musculus
gatgtttgtaacagatacgttgtgg

SEQ ID NO: 519031 - DNA, 25 bp, Mus musculus
gatgtttgtaactgatacgttgtgg

SEQ ID NO: 519032 - DNA, 25 bp, Mus musculus
gatgtttgtagacctggagaacctc

SEQ ID NO: 519033 - DNA, 25 bp, Mus musculus
gatgtttgtagagctggagaacctc

SEQ ID NO: 519034 - DNA, 25 bp, Mus musculus
gatgtttgtattactagtgtgagca

SEQ ID NO: 519035 - DNA, 25 bp, Mus musculus
gatgtttgtatttctagtgtgagca

SEQ ID NO: 519036 - DNA, 25 bp, Mus musculus
gatgtttgtcaaatgtagctaatga

SEQ ID NO: 519037 - DNA, 25 bp, Mus musculus
gatgtttgtcaattgtagctaatga

SEQ ID NO: 519038 - DNA, 25 bp, Mus musculus
gatgtttgtccactcataattttta

SEQ ID NO: 519039 - DNA, 25 bp, Mus musculus
gatgtttgtccagtcataattttta

SEQ ID NO: 519040 - DNA, 25 bp, Mus musculus
gatgtttgtgatatgccgaccttgc

SEQ ID NO: 519041 - DNA, 25 bp, Mus musculus
gatgtttgtgatttgccgaccttgc

SEQ ID NO: 519042 - DNA, 25 bp, Mus musculus
gatgtttgtggaattggggctttaa

SEQ ID NO: 519043 - DNA, 25 bp, Mus musculus
gatgtttgtggacctgaaccctgac

SEQ ID NO: 519044 - DNA, 25 bp, Mus musculus
gatgtttgtggagctgaaccctgac

SEQ ID NO: 519045 - DNA, 25 bp, Mus musculus
gatgtttgtggatttggggctttaa

SEQ ID NO: 519046 - DNA, 25 bp, Mus musculus
gatgtttgtgtaatcacttgcttat

SEQ ID NO: 519047 - DNA, 25 bp, Mus musculus
gatgtttgtgtattcacttgcttat

SEQ ID NO: 519048 - DNA, 25 bp, Mus musculus
gatgtttgttctcttgtcctttttt

SEQ ID NO: 519049 - DNA, 25 bp, Mus musculus
gatgtttgttctgttgtcctttttt

SEQ ID NO: 519050 - DNA, 25 bp, Mus musculus
gatgtttgttgtacactatccttag

SEQ ID NO: 519051 - DNA, 25 bp, Mus musculus
gatgtttgttgttcactatccttag

SEQ ID NO: 519052 - DNA, 25 bp, Mus musculus
gatgttttacatattcttactggct

SEQ ID NO: 519053 - DNA, 25 bp, Mus musculus
gatgttttacattttcttactggct

SEQ ID NO: 519054 - DNA, 25 bp, Mus musculus
gatgttttaggcatgtgacacacgt

SEQ ID NO: 519055 - DNA, 25 bp, Mus musculus
gatgttttaggcttgtgacacacgt

SEQ ID NO: 519056 - DNA, 25 bp, Mus musculus
gatgttttataacttcctgggtcct

SEQ ID NO: 519057 - DNA, 25 bp, Mus musculus
gatgttttataagttcctgggtcct

SEQ ID NO: 519058 - DNA, 25 bp, Mus musculus
gatgttttcaaaccccgggtgctgc

SEQ ID NO: 519059 - DNA, 25 bp, Mus musculus
gatgttttcaaagcccgggtgctgc

SEQ ID NO: 519060 - DNA, 25 bp, Mus musculus
gatgttttcaagattcctgcagctc

SEQ ID NO: 519061 - DNA, 25 bp, Mus musculus
gatgttttcaagtttcctgcagctc

SEQ ID NO: 519062 - DNA, 25 bp, Mus musculus
gatgttttcactcattctcttgccc

SEQ ID NO: 519063 - DNA, 25 bp, Mus musculus
gatgttttcactgattctcttgccc

SEQ ID NO: 519064 - DNA, 25 bp, Mus musculus
gatgttttcagtacattgtgttttg

SEQ ID NO: 519065 - DNA, 25 bp, Mus musculus
gatgttttcagttcattgtgttttg

SEQ ID NO: 519066 - DNA, 25 bp, Mus musculus
gatgttttcatgaatctacctcact

SEQ ID NO: 519067 - DNA, 25 bp, Mus musculus
gatgttttcatgtatctacctcact

SEQ ID NO: 519068 - DNA, 25 bp, Mus musculus
gatgttttcccgactagcaaatcta

SEQ ID NO: 519069 - DNA, 25 bp, Mus musculus
gatgttttcccgtctagcaaatcta

SEQ ID NO: 519070 - DNA, 25 bp, Mus musculus
gatgttttccgaatttctgaaccta

SEQ ID NO: 519071 - DNA, 25 bp, Mus musculus
gatgttttccgattttctgaaccta

SEQ ID NO: 519072 - DNA, 25 bp, Mus musculus
gatgttttctaaaccaactcctaat

SEQ ID NO: 519073 - DNA, 25 bp, Mus musculus
gatgttttctaatccaactcctaat

SEQ ID NO: 519074 - DNA, 25 bp, Mus musculus
gatgttttctggatatactcaatgt

SEQ ID NO: 519075 - DNA, 25 bp, Mus musculus
gatgttttctggttatactcaatgt

SEQ ID NO: 519076 - DNA, 25 bp, Mus musculus
gatgttttcttaagtcatttactgt

SEQ ID NO: 519077 - DNA, 25 bp, Mus musculus
gatgttttcttacagtcagcacacg

SEQ ID NO: 519078 - DNA, 25 bp, Mus musculus
gatgttttcttagagtcagcacacg

SEQ ID NO: 519079 - DNA, 25 bp, Mus musculus
gatgttttcttatgtcatttactgt

SEQ ID NO: 519080 - DNA, 25 bp, Mus musculus
gatgttttgaacctgaggcttcctt

SEQ ID NO: 519081 - DNA, 25 bp, Mus musculus
gatgttttgaacgtgaggcttcctt

SEQ ID NO: 519082 - DNA, 25 bp, Mus musculus
gatgttttgacaatgcccaacctaa

SEQ ID NO: 519083 - DNA, 25 bp, Mus musculus
gatgttttgacattgcccaacctaa

SEQ ID NO: 519084 - DNA, 25 bp, Mus musculus
gatgttttgactagttttctagctt

SEQ ID NO: 519085 - DNA, 25 bp, Mus musculus
gatgttttgacttgttttctagctt

SEQ ID NO: 519086 - DNA, 25 bp, Mus musculus
gatgttttgcttactctgtgtgaga

SEQ ID NO: 519087 - DNA, 25 bp, Mus musculus
gatgttttgctttctctgtgtgaga

SEQ ID NO: 519088 - DNA, 25 bp, Mus musculus
gatgttttggctcttacaacgacta

SEQ ID NO: 519089 - DNA, 25 bp, Mus musculus
gatgttttggctgttacaacgacta

SEQ ID NO: 519090 - DNA, 25 bp, Mus musculus
gatgttttgtaaactcaaacaacaa

SEQ ID NO: 519091 - DNA, 25 bp, Mus musculus
gatgttttgtaaagcgttctgagat

SEQ ID NO: 519092 - DNA, 25 bp, Mus musculus
gatgttttgtaatctcaaacaacaa

SEQ ID NO: 519093 - DNA, 25 bp, Mus musculus
gatgttttgtaatgcgttctgagat

SEQ ID NO: 519094 - DNA, 25 bp, Mus musculus
gatgttttgtagacagcactggtct

SEQ ID NO: 519095 - DNA, 25 bp, Mus musculus
gatgttttgtagtcagcactggtct

SEQ ID NO: 519096 - DNA, 25 bp, Mus musculus
gatgttttgtatcacgtggagacag

SEQ ID NO: 519097 - DNA, 25 bp, Mus musculus
gatgttttgtatgacgtggagacag

SEQ ID NO: 519098 - DNA, 25 bp, Mus musculus
gatgttttgttccttccgtatttat

SEQ ID NO: 519099 - DNA, 25 bp, Mus musculus
gatgttttgttcgttccgtatttat

SEQ ID NO: 519100 - DNA, 25 bp, Mus musculus
gatgtttttacactgatgaccgtta

SEQ ID NO: 519101 - DNA, 25 bp, Mus musculus
gatgtttttacagtgatgaccgtta

SEQ ID NO: 519102 - DNA, 25 bp, Mus musculus
gatgtttttagtcatatacctgcag

SEQ ID NO: 519103 - DNA, 25 bp, Mus musculus
gatgtttttagtgatatacctgcag

SEQ ID NO: 519104 - DNA, 25 bp, Mus musculus
gatgtttttattctcctccttacct

SEQ ID NO: 519105 - DNA, 25 bp, Mus musculus
gatgtttttattgtcctccttacct

SEQ ID NO: 519106 - DNA, 25 bp, Mus musculus
gatgtttttccaaggccagtataaa

SEQ ID NO: 519107 - DNA, 25 bp, Mus musculus
gatgtttttccacctcttattattt

SEQ ID NO: 519108 - DNA, 25 bp, Mus musculus
gatgtttttccagctcttattattt

SEQ ID NO: 519109 - DNA, 25 bp, Mus musculus
gatgtttttccatggccagtataaa

SEQ ID NO: 519110 - DNA, 25 bp, Mus musculus
gatgtttttcccagtttcattgtct

SEQ ID NO: 519111 - DNA, 25 bp, Mus musculus
gatgtttttccctgtttcattgtct

SEQ ID NO: 519112 - DNA, 25 bp, Mus musculus
gatgtttttgccacagcttttgcag

SEQ ID NO: 519113 - DNA, 25 bp, Mus musculus
gatgtttttgcctcagcttttgcag

SEQ ID NO: 519114 - DNA, 25 bp, Mus musculus
gatgtttttgctccagaatttcgaa

SEQ ID NO: 519115 - DNA, 25 bp, Mus musculus
gatgtttttgctgcagaatttcgaa

SEQ ID NO: 519116 - DNA, 25 bp, Mus musculus
gatgtttttgtgcttattgtgaatt

SEQ ID NO: 519117 - DNA, 25 bp, Mus musculus
gatgtttttgtggttattgtgaatt

SEQ ID NO: 519118 - DNA, 25 bp, Mus musculus
gattaaaaaattccactttcctatg

SEQ ID NO: 519119 - DNA, 25 bp, Mus musculus
gattaaaaaattgcactttcctatg

SEQ ID NO: 519120 - DNA, 25 bp, Mus musculus
gattaaaaacctatgcagactcaca

SEQ ID NO: 519121 - DNA, 25 bp, Mus musculus
gattaaaaacctttgcagactcaca

SEQ ID NO: 519122 - DNA, 25 bp, Mus musculus
gattaaaaagtgcttgtcactgcca

SEQ ID NO: 519123 - DNA, 25 bp, Mus musculus
gattaaaaagtggttgtcactgcca

SEQ ID NO: 519124 - DNA, 25 bp, Mus musculus
gattaaaataccactgctcagccct

SEQ ID NO: 519125 - DNA, 25 bp, Mus musculus
gattaaaatacctctgctcagccct

SEQ ID NO: 519126 - DNA, 25 bp, Mus musculus
gattaaaatgaaaagctcacttgag

SEQ ID NO: 519127 - DNA, 25 bp, Mus musculus
gattaaaatgaatagctcacttgag

SEQ ID NO: 519128 - DNA, 25 bp, Mus musculus
gattaaacaactccaccacaattcc

SEQ ID NO: 519129 - DNA, 25 bp, Mus musculus
gattaaacaactgcaccacaattcc

SEQ ID NO: 519130 - DNA, 25 bp, Mus musculus
gattaaacaagaccccatgtctcct

SEQ ID NO: 519131 - DNA, 25 bp, Mus musculus
gattaaacaagagcccatgtctcct

SEQ ID NO: 519132 - DNA, 25 bp, Mus musculus
gattaaacagttacaccagatgaaa

SEQ ID NO: 519133 - DNA, 25 bp, Mus musculus
gattaaacagtttcaccagatgaaa

SEQ ID NO: 519134 - DNA, 25 bp, Mus musculus
gattaaacatctaagccatctctaa

SEQ ID NO: 519135 - DNA, 25 bp, Mus musculus
gattaaacatcttagccatctctaa

SEQ ID NO: 519136 - DNA, 25 bp, Mus musculus
gattaaactggcatctgagtctgtt

SEQ ID NO: 519137 - DNA, 25 bp, Mus musculus
gattaaactggcttctgagtctgtt

SEQ ID NO: 519138 - DNA, 25 bp, Mus musculus
gattaaactgtacatactgtgcata

SEQ ID NO: 519139 - DNA, 25 bp, Mus musculus
gattaaactgtagatactgtgcata

SEQ ID NO: 519140 - DNA, 25 bp, Mus musculus
gattaaagaactcctagatactaga

SEQ ID NO: 519141 - DNA, 25 bp, Mus musculus
gattaaagaactgctagatactaga

SEQ ID NO: 519142 - DNA, 25 bp, Mus musculus
gattaaagacatattcaggcatgga

SEQ ID NO: 519143 - DNA, 25 bp, Mus musculus
gattaaagacattttcaggcatgga

SEQ ID NO: 519144 - DNA, 25 bp, Mus musculus
gattaaagacttctacggacttgtt

SEQ ID NO: 519145 - DNA, 25 bp, Mus musculus
gattaaagacttgtacggacttgtt

SEQ ID NO: 519146 - DNA, 25 bp, Mus musculus
gattaaagagttccatggatacatc

SEQ ID NO: 519147 - DNA, 25 bp, Mus musculus
gattaaagagttgcatggatacatc

SEQ ID NO: 519148 - DNA, 25 bp, Mus musculus
gattaaagcagcactccctaacaac

SEQ ID NO: 519149 - DNA, 25 bp, Mus musculus
gattaaagcagctctccctaacaac

SEQ ID NO: 519150 - DNA, 25 bp, Mus musculus
gattaaagccaaatgtccagtcatg

SEQ ID NO: 519151 - DNA, 25 bp, Mus musculus
gattaaagccaactggtccctgtgg

SEQ ID NO: 519152 - DNA, 25 bp, Mus musculus
gattaaagccaagtggtccctgtgg

SEQ ID NO: 519153 - DNA, 25 bp, Mus musculus
gattaaagccaattgtccagtcatg

SEQ ID NO: 519154 - DNA, 25 bp, Mus musculus
gattaaagccatctcacgtaagagc

SEQ ID NO: 519155 - DNA, 25 bp, Mus musculus
gattaaagccatgtcacgtaagagc

SEQ ID NO: 519156 - DNA, 25 bp, Mus musculus
gattaaaggcaacatccacaatgat

SEQ ID NO: 519157 - DNA, 25 bp, Mus musculus
gattaaaggcaagatccacaatgat

SEQ ID NO: 519158 - DNA, 25 bp, Mus musculus
gattaaaggcacatgctaccacagt

SEQ ID NO: 519159 - DNA, 25 bp, Mus musculus
gattaaaggcacttgctaccacagt

SEQ ID NO: 519160 - DNA, 25 bp, Mus musculus
gattaaatcgaaccctcttgagtgg

SEQ ID NO: 519161 - DNA, 25 bp, Mus musculus
gattaaatcgaagcctcttgagtgg

SEQ ID NO: 519162 - DNA, 25 bp, Mus musculus
gattaaatcttgctttgattgagaa

SEQ ID NO: 519163 - DNA, 25 bp, Mus musculus
gattaaatcttggtttgattgagaa

SEQ ID NO: 519164 - DNA, 25 bp, Mus musculus
gattaaatgtaacccctctccacta

SEQ ID NO: 519165 - DNA, 25 bp, Mus musculus
gattaaatgtaagccctctccacta

SEQ ID NO: 519166 - DNA, 25 bp, Mus musculus
gattaaatgtccagccagcgagcgt

SEQ ID NO: 519167 - DNA, 25 bp, Mus musculus
gattaaatgtcctgccagcgagcgt

SEQ ID NO: 519168 - DNA, 25 bp, Mus musculus
gattaaattctaacgcatgagacat

SEQ ID NO: 519169 - DNA, 25 bp, Mus musculus
gattaaattctatcgcatgagacat

SEQ ID NO: 519170 - DNA, 25 bp, Mus musculus
gattaacaactgctgattcaagtca

SEQ ID NO: 519171 - DNA, 25 bp, Mus musculus
gattaacaactggtgattcaagtca

SEQ ID NO: 519172 - DNA, 25 bp, Mus musculus
gattaacaattcatttagaccatta

SEQ ID NO: 519173 - DNA, 25 bp, Mus musculus
gattaacaattcttttagaccatta

SEQ ID NO: 519174 - DNA, 25 bp, Mus musculus
gattaacacacgcacagccaggtaa

SEQ ID NO: 519175 - DNA, 25 bp, Mus musculus
gattaacacacggacagccaggtaa

SEQ ID NO: 519176 - DNA, 25 bp, Mus musculus
gattaacacactacaaggccctaac

SEQ ID NO: 519177 - DNA, 25 bp, Mus musculus
gattaacacacttcaaggccctaac

SEQ ID NO: 519178 - DNA, 25 bp, Mus musculus
gattaacacgacattggttgtcacc

SEQ ID NO: 519179 - DNA, 25 bp, Mus musculus
gattaacacgactttggttgtcacc

SEQ ID NO: 519180 - DNA, 25 bp, Mus musculus
gattaacactctcgaggagcgcctg

SEQ ID NO: 519181 - DNA, 25 bp, Mus musculus
gattaacactctggaggagcgcctg

SEQ ID NO: 519182 - DNA, 25 bp, Mus musculus
gattaacacttcaatttctcctaga

SEQ ID NO: 519183 - DNA, 25 bp, Mus musculus
gattaacacttctatttctcctaga

SEQ ID NO: 519184 - DNA, 25 bp, Mus musculus
gattaacagaaaatatctctcaagc

SEQ ID NO: 519185 - DNA, 25 bp, Mus musculus
gattaacagaaattatctctcaagc

SEQ ID NO: 519186 - DNA, 25 bp, Mus musculus
gattaacagaccaggagaaccccag

SEQ ID NO: 519187 - DNA, 25 bp, Mus musculus
gattaacagacctggagaaccccag

SEQ ID NO: 519188 - DNA, 25 bp, Mus musculus
gattaacagttcctcattcaatttc

SEQ ID NO: 519189 - DNA, 25 bp, Mus musculus
gattaacagttcgtcattcaatttc

SEQ ID NO: 519190 - DNA, 25 bp, Mus musculus
gattaacatcacaggttgctcttgc

SEQ ID NO: 519191 - DNA, 25 bp, Mus musculus
gattaacatcactggttgctcttgc

SEQ ID NO: 519192 - DNA, 25 bp, Mus musculus
gattaacatggaagcagccccagct

SEQ ID NO: 519193 - DNA, 25 bp, Mus musculus
gattaacatggatgcagccccagct

SEQ ID NO: 519194 - DNA, 25 bp, Mus musculus
gattaacatgggagctctccccaaa

SEQ ID NO: 519195 - DNA, 25 bp, Mus musculus
gattaacatgggtgctctccccaaa

SEQ ID NO: 519196 - DNA, 25 bp, Mus musculus
gattaacatttcactgcaaaggcag

SEQ ID NO: 519197 - DNA, 25 bp, Mus musculus
gattaacatttctctgcaaaggcag

SEQ ID NO: 519198 - DNA, 25 bp, Mus musculus
gattaaccacctctagccaggactc

SEQ ID NO: 519199 - DNA, 25 bp, Mus musculus
gattaaccacctgtagccaggactc

SEQ ID NO: 519200 - DNA, 25 bp, Mus musculus
gattaaccagaaatccttgtgagat

SEQ ID NO: 519201 - DNA, 25 bp, Mus musculus
gattaaccagaattccttgtgagat

SEQ ID NO: 519202 - DNA, 25 bp, Mus musculus
gattaaccaggcagttttctctctc

SEQ ID NO: 519203 - DNA, 25 bp, Mus musculus
gattaaccaggctgttttctctctc

SEQ ID NO: 519204 - DNA, 25 bp, Mus musculus
gattaacccactcttgtcgagttct

SEQ ID NO: 519205 - DNA, 25 bp, Mus musculus
gattaacccactgttgtcgagttct

SEQ ID NO: 519206 - DNA, 25 bp, Mus musculus
gattaacccatcattctcactcaaa

SEQ ID NO: 519207 - DNA, 25 bp, Mus musculus
gattaacccatctttctcactcaaa

SEQ ID NO: 519208 - DNA, 25 bp, Mus musculus
gattaaccctgtaacataacccgct

SEQ ID NO: 519209 - DNA, 25 bp, Mus musculus
gattaaccctgttacataacccgct

SEQ ID NO: 519210 - DNA, 25 bp, Mus musculus
gattaaccttctctccataagttct

SEQ ID NO: 519211 - DNA, 25 bp, Mus musculus
gattaaccttctgtccataagttct

SEQ ID NO: 519212 - DNA, 25 bp, Mus musculus
gattaacgtgtcagtgtcaggatct

SEQ ID NO: 519213 - DNA, 25 bp, Mus musculus
gattaacgtgtctgtgtcaggatct

SEQ ID NO: 519214 - DNA, 25 bp, Mus musculus
gattaacgtgtgctctcttgaaggt

SEQ ID NO: 519215 - DNA, 25 bp, Mus musculus
gattaacgtgtggtctcttgaaggt

SEQ ID NO: 519216 - DNA, 25 bp, Mus musculus
gattaactatctcaacaaggccctg

SEQ ID NO: 519217 - DNA, 25 bp, Mus musculus
gattaactatctcctgaagacatct

SEQ ID NO: 519218 - DNA, 25 bp, Mus musculus
gattaactatctgaacaaggccctg

SEQ ID NO: 519219 - DNA, 25 bp, Mus musculus
gattaactatctgctgaagacatct

SEQ ID NO: 519220 - DNA, 25 bp, Mus musculus
gattaactattacccctgaagtact

SEQ ID NO: 519221 - DNA, 25 bp, Mus musculus
gattaactattagccctgaagtact

SEQ ID NO: 519222 - DNA, 25 bp, Mus musculus
gattaactgacaattggatgctcta

SEQ ID NO: 519223 - DNA, 25 bp, Mus musculus
gattaactgacatttggatgctcta

SEQ ID NO: 519224 - DNA, 25 bp, Mus musculus
gattaacttatgcaagcctttgtgt

SEQ ID NO: 519225 - DNA, 25 bp, Mus musculus
gattaacttatggaagcctttgtgt

SEQ ID NO: 519226 - DNA, 25 bp, Mus musculus
gattaacttccccttgttcaatgca

SEQ ID NO: 519227 - DNA, 25 bp, Mus musculus
gattaacttcccgttgttcaatgca

SEQ ID NO: 519228 - DNA, 25 bp, Mus musculus
gattaacttctgacccaaaaggtat

SEQ ID NO: 519229 - DNA, 25 bp, Mus musculus
gattaacttctgtcccaaaaggtat

SEQ ID NO: 519230 - DNA, 25 bp, Mus musculus
gattaacttgttctggtgtctcttc

SEQ ID NO: 519231 - DNA, 25 bp, Mus musculus
gattaacttgttgtggtgtctcttc

SEQ ID NO: 519232 - DNA, 25 bp, Mus musculus
gattaagacactcttagacgctaaa

SEQ ID NO: 519233 - DNA, 25 bp, Mus musculus
gattaagacactgttagacgctaaa

SEQ ID NO: 519234 - DNA, 25 bp, Mus musculus
gattaagacccgaaacaacctgcaa

SEQ ID NO: 519235 - DNA, 25 bp, Mus musculus
gattaagacccgtaacaacctgcaa

SEQ ID NO: 519236 - DNA, 25 bp, Mus musculus
gattaagaccctcggttagagccgg

SEQ ID NO: 519237 - DNA, 25 bp, Mus musculus
gattaagaccctgggttagagccgg

SEQ ID NO: 519238 - DNA, 25 bp, Mus musculus
gattaagacctaagctaccaacgac

SEQ ID NO: 519239 - DNA, 25 bp, Mus musculus
gattaagacctacccatggcagtgt

SEQ ID NO: 519240 - DNA, 25 bp, Mus musculus
gattaagacctagccatggcagtgt

SEQ ID NO: 519241 - DNA, 25 bp, Mus musculus
gattaagacctatgctaccaacgac

SEQ ID NO: 519242 - DNA, 25 bp, Mus musculus
gattaagaccttccgtaataggcta

SEQ ID NO: 519243 - DNA, 25 bp, Mus musculus
gattaagaccttgcgtaataggcta

SEQ ID NO: 519244 - DNA, 25 bp, Mus musculus
gattaagagagtatgcctcccctct

SEQ ID NO: 519245 - DNA, 25 bp, Mus musculus
gattaagagagtttgcctcccctct

SEQ ID NO: 519246 - DNA, 25 bp, Mus musculus
gattaagagtcactccagcctggca

SEQ ID NO: 519247 - DNA, 25 bp, Mus musculus
gattaagagtcagtccagcctggca

SEQ ID NO: 519248 - DNA, 25 bp, Mus musculus
gattaagataacagagcacttctct

SEQ ID NO: 519249 - DNA, 25 bp, Mus musculus
gattaagataactgagcacttctct

SEQ ID NO: 519250 - DNA, 25 bp, Mus musculus
gattaagattttagggccggaagca

SEQ ID NO: 519251 - DNA, 25 bp, Mus musculus
gattaagatttttgggccggaagca

SEQ ID NO: 519252 - DNA, 25 bp, Mus musculus
gattaagcagatcccacgtatcctg

SEQ ID NO: 519253 - DNA, 25 bp, Mus musculus
gattaagcagatgccacgtatcctg

SEQ ID NO: 519254 - DNA, 25 bp, Mus musculus
gattaagccagtaaagtgcactttg

SEQ ID NO: 519255 - DNA, 25 bp, Mus musculus
gattaagccagttaagtgcactttg

SEQ ID NO: 519256 - DNA, 25 bp, Mus musculus
gattaagcggtgctacccggcagtt

SEQ ID NO: 519257 - DNA, 25 bp, Mus musculus
gattaagcggtggtacccggcagtt

SEQ ID NO: 519258 - DNA, 25 bp, Mus musculus
gattaagctctcaatatctggtcgt

SEQ ID NO: 519259 - DNA, 25 bp, Mus musculus
gattaagctctctatatctggtcgt

SEQ ID NO: 519260 - DNA, 25 bp, Mus musculus
gattaagctgatctttgcaggactg

SEQ ID NO: 519261 - DNA, 25 bp, Mus musculus
gattaagctgatgtttgcaggactg

SEQ ID NO: 519262 - DNA, 25 bp, Mus musculus
gattaagctgcactttgatctcact

SEQ ID NO: 519263 - DNA, 25 bp, Mus musculus
gattaagctgcagtttgatctcact

SEQ ID NO: 519264 - DNA, 25 bp, Mus musculus
gattaagctgtacaaccctggtttc

SEQ ID NO: 519265 - DNA, 25 bp, Mus musculus
gattaagctgtagaaccctggtttc

SEQ ID NO: 519266 - DNA, 25 bp, Mus musculus
gattaaggcagcagctctttgacct

SEQ ID NO: 519267 - DNA, 25 bp, Mus musculus
gattaaggcagctgctctttgacct

SEQ ID NO: 519268 - DNA, 25 bp, Mus musculus
gattaaggcattcattaacctctca

SEQ ID NO: 519269 - DNA, 25 bp, Mus musculus
gattaaggcattgattaacctctca

SEQ ID NO: 519270 - DNA, 25 bp, Mus musculus
gattaaggcgaacatctgagatgtg

SEQ ID NO: 519271 - DNA, 25 bp, Mus musculus
gattaaggcgaagatctgagatgtg

SEQ ID NO: 519272 - DNA, 25 bp, Mus musculus
gattaaggcttcaacatggatttgg

SEQ ID NO: 519273 - DNA, 25 bp, Mus musculus
gattaaggcttctacatggatttgg

SEQ ID NO: 519274 - DNA, 25 bp, Mus musculus
gattaagggaatcccgtctgccctg

SEQ ID NO: 519275 - DNA, 25 bp, Mus musculus
gattaagggaatgccgtctgccctg

SEQ ID NO: 519276 - DNA, 25 bp, Mus musculus
gattaagggcatcgactaccaccgc

SEQ ID NO: 519277 - DNA, 25 bp, Mus musculus
gattaagggcatggactaccaccgc

SEQ ID NO: 519278 - DNA, 25 bp, Mus musculus
gattaagggcgcatcccgaggtaca

SEQ ID NO: 519279 - DNA, 25 bp, Mus musculus
gattaagggcgcttcccgaggtaca

SEQ ID NO: 519280 - DNA, 25 bp, Mus musculus
gattaaggtagacccggccacagag

SEQ ID NO: 519281 - DNA, 25 bp, Mus musculus
gattaaggtagagccggccacagag

SEQ ID NO: 519282 - DNA, 25 bp, Mus musculus
gattaaggttgtccaccacaaggcc

SEQ ID NO: 519283 - DNA, 25 bp, Mus musculus
gattaaggttgtgcaccacaaggcc

SEQ ID NO: 519284 - DNA, 25 bp, Mus musculus
gattaagtcccgaacaggcccagag

SEQ ID NO: 519285 - DNA, 25 bp, Mus musculus
gattaagtcccgtacaggcccagag

SEQ ID NO: 519286 - DNA, 25 bp, Mus musculus
gattaagtctatatgcacgtgtgtt

SEQ ID NO: 519287 - DNA, 25 bp, Mus musculus
gattaagtctatttgcacgtgtgtt

SEQ ID NO: 519288 - DNA, 25 bp, Mus musculus
gattaagtgaccatgcagaaagtct

SEQ ID NO: 519289 - DNA, 25 bp, Mus musculus
gattaagtgaccttgcagaaagtct

SEQ ID NO: 519290 - DNA, 25 bp, Mus musculus
gattaagtgcgtcgcctttgagtga

SEQ ID NO: 519291 - DNA, 25 bp, Mus musculus
gattaagtgcgtggcctttgagtga

SEQ ID NO: 519292 - DNA, 25 bp, Mus musculus
gattaagtgctacagtttcatacta

SEQ ID NO: 519293 - DNA, 25 bp, Mus musculus
gattaagtgctagagtttcatacta

SEQ ID NO: 519294 - DNA, 25 bp, Mus musculus
gattaagtgggtcaccagcctgcaa

SEQ ID NO: 519295 - DNA, 25 bp, Mus musculus
gattaagtgggtgaccagcctgcaa

SEQ ID NO: 519296 - DNA, 25 bp, Mus musculus
gattaagtggttcccacacacaagg

SEQ ID NO: 519297 - DNA, 25 bp, Mus musculus
gattaagtggttgccacacacaagg

SEQ ID NO: 519298 - DNA, 25 bp, Mus musculus
gattaagtgtctctttaccttctag

SEQ ID NO: 519299 - DNA, 25 bp, Mus musculus
gattaagtgtctgtttaccttctag

SEQ ID NO: 519300 - DNA, 25 bp, Mus musculus
gattaatagtgcctgcctgttctct

SEQ ID NO: 519301 - DNA, 25 bp, Mus musculus
gattaatagtgcgtgcctgttctct

SEQ ID NO: 519302 - DNA, 25 bp, Mus musculus
gattaatagtgtcccctaccactgc

SEQ ID NO: 519303 - DNA, 25 bp, Mus musculus
gattaatagtgtgccctaccactgc

SEQ ID NO: 519304 - DNA, 25 bp, Mus musculus
gattaatatatccaatccactcaag

SEQ ID NO: 519305 - DNA, 25 bp, Mus musculus
gattaatatatcgaatccactcaag

SEQ ID NO: 519306 - DNA, 25 bp, Mus musculus
gattaatattacatggatttctgag

SEQ ID NO: 519307 - DNA, 25 bp, Mus musculus
gattaatattacttggatttctgag

SEQ ID NO: 519308 - DNA, 25 bp, Mus musculus
gattaatatttcacacgttcactaa

SEQ ID NO: 519309 - DNA, 25 bp, Mus musculus
gattaatatttctcacgttcactaa

SEQ ID NO: 519310 - DNA, 25 bp, Mus musculus
gattaatcgtaacccatacttcatt

SEQ ID NO: 519311 - DNA, 25 bp, Mus musculus
gattaatcgtaagccatacttcatt

SEQ ID NO: 519312 - DNA, 25 bp, Mus musculus
gattaatctccacattttcctactg

SEQ ID NO: 519313 - DNA, 25 bp, Mus musculus
gattaatctccagattttcctactg

SEQ ID NO: 519314 - DNA, 25 bp, Mus musculus
gattaatgctgtagctatggaagct

SEQ ID NO: 519315 - DNA, 25 bp, Mus musculus
gattaatgctgttgctatggaagct

SEQ ID NO: 519316 - DNA, 25 bp, Mus musculus
gattaatgttcactcttcagccagt

SEQ ID NO: 519317 - DNA, 25 bp, Mus musculus
gattaatgttcagtcttcagccagt

SEQ ID NO: 519318 - DNA, 25 bp, Mus musculus
gattaattactgacactggacatgt

SEQ ID NO: 519319 - DNA, 25 bp, Mus musculus
gattaattactgtcactggacatgt

SEQ ID NO: 519320 - DNA, 25 bp, Mus musculus
gattaattagtcctcatatgtccac

SEQ ID NO: 519321 - DNA, 25 bp, Mus musculus
gattaattagtcgtcatatgtccac

SEQ ID NO: 519322 - DNA, 25 bp, Mus musculus
gattaattctcacgtgggtccgtaa

SEQ ID NO: 519323 - DNA, 25 bp, Mus musculus
gattaattctcaggtgggtccgtaa

SEQ ID NO: 519324 - DNA, 25 bp, Mus musculus
gattaattctggaacccttcccaga

SEQ ID NO: 519325 - DNA, 25 bp, Mus musculus
gattaattctggtacccttcccaga

SEQ ID NO: 519326 - DNA, 25 bp, Mus musculus
gattaattgctcactgtatgtactt

SEQ ID NO: 519327 - DNA, 25 bp, Mus musculus
gattaattgctctctgtatgtactt

SEQ ID NO: 519328 - DNA, 25 bp, Mus musculus
gattacaaagcactggaaaggccca

SEQ ID NO: 519329 - DNA, 25 bp, Mus musculus
gattacaaagcagtggaaaggccca

SEQ ID NO: 519330 - DNA, 25 bp, Mus musculus
gattacaaaggtctctacttacaga

SEQ ID NO: 519331 - DNA, 25 bp, Mus musculus
gattacaaaggtgtctacttacaga

SEQ ID NO: 519332 - DNA, 25 bp, Mus musculus
gattacaaatgtacacttcgatttc

SEQ ID NO: 519333 - DNA, 25 bp, Mus musculus
gattacaaatgttcacttcgatttc

SEQ ID NO: 519334 - DNA, 25 bp, Mus musculus
gattacaacagactacggcctacaa

SEQ ID NO: 519335 - DNA, 25 bp, Mus musculus
gattacaacagagtacggcctacaa

SEQ ID NO: 519336 - DNA, 25 bp, Mus musculus
gattacaaccttccatcttggaaga

SEQ ID NO: 519337 - DNA, 25 bp, Mus musculus
gattacaaccttgcatcttggaaga

SEQ ID NO: 519338 - DNA, 25 bp, Mus musculus
gattacaagcatcgatcacatctgg

SEQ ID NO: 519339 - DNA, 25 bp, Mus musculus
gattacaagcatctgctctcatgcc

SEQ ID NO: 519340 - DNA, 25 bp, Mus musculus
gattacaagcatggatcacatctgg

SEQ ID NO: 519341 - DNA, 25 bp, Mus musculus
gattacaagcatgtgctctcatgcc

SEQ ID NO: 519342 - DNA, 25 bp, Mus musculus
gattacaagccaccattctatgatg

SEQ ID NO: 519343 - DNA, 25 bp, Mus musculus
gattacaagccagcattctatgatg

SEQ ID NO: 519344 - DNA, 25 bp, Mus musculus
gattacaagcggaggcgctgccgcg

SEQ ID NO: 519345 - DNA, 25 bp, Mus musculus
gattacaagcggtggcgctgccgcg

SEQ ID NO: 519346 - DNA, 25 bp, Mus musculus
gattacaagtacatacatggtgata

SEQ ID NO: 519347 - DNA, 25 bp, Mus musculus
gattacaagtacttacatggtgata

SEQ ID NO: 519348 - DNA, 25 bp, Mus musculus
gattacaatagacctctcggaagaa

SEQ ID NO: 519349 - DNA, 25 bp, Mus musculus
gattacaatagagctctcggaagaa

SEQ ID NO: 519350 - DNA, 25 bp, Mus musculus
gattacacagggaggaaaggcccgc

SEQ ID NO: 519351 - DNA, 25 bp, Mus musculus
gattacacagggtggaaaggcccgc

SEQ ID NO: 519352 - DNA, 25 bp, Mus musculus
gattacacataactggctcacaccc

SEQ ID NO: 519353 - DNA, 25 bp, Mus musculus
gattacacataagtggctcacaccc

SEQ ID NO: 519354 - DNA, 25 bp, Mus musculus
gattacacccttagaactaactagt

SEQ ID NO: 519355 - DNA, 25 bp, Mus musculus
gattacaccctttgaactaactagt

SEQ ID NO: 519356 - DNA, 25 bp, Mus musculus
gattacaccgtgcagcctggatgaa

SEQ ID NO: 519357 - DNA, 25 bp, Mus musculus
gattacaccgtggagcctggatgaa

SEQ ID NO: 519358 - DNA, 25 bp, Mus musculus
gattacacctaacagatcattcagg

SEQ ID NO: 519359 - DNA, 25 bp, Mus musculus
gattacacctaagagatcattcagg

SEQ ID NO: 519360 - DNA, 25 bp, Mus musculus
gattacacctagcattcacatttat

SEQ ID NO: 519361 - DNA, 25 bp, Mus musculus
gattacacctaggattcacatttat

SEQ ID NO: 519362 - DNA, 25 bp, Mus musculus
gattacacgcatatgtcttgtctgg

SEQ ID NO: 519363 - DNA, 25 bp, Mus musculus
gattacacgcatttgtcttgtctgg

SEQ ID NO: 519364 - DNA, 25 bp, Mus musculus
gattacactggactagattcattca

SEQ ID NO: 519365 - DNA, 25 bp, Mus musculus
gattacactggagtagattcattca

SEQ ID NO: 519366 - DNA, 25 bp, Mus musculus
gattacactgtaataaaataccttg

SEQ ID NO: 519367 - DNA, 25 bp, Mus musculus
gattacactgtattaaaataccttg

SEQ ID NO: 519368 - DNA, 25 bp, Mus musculus
gattacactttcaggttagttcctt

SEQ ID NO: 519369 - DNA, 25 bp, Mus musculus
gattacactttctggttagttcctt

SEQ ID NO: 519370 - DNA, 25 bp, Mus musculus
gattacagacatccaaggcctggat

SEQ ID NO: 519371 - DNA, 25 bp, Mus musculus
gattacagacatgcaaggcctggat

SEQ ID NO: 519372 - DNA, 25 bp, Mus musculus
gattacagacgaacatatccggaat

SEQ ID NO: 519373 - DNA, 25 bp, Mus musculus
gattacagacgatcatatccggaat

SEQ ID NO: 519374 - DNA, 25 bp, Mus musculus
gattacagatccacacagacatgag

SEQ ID NO: 519375 - DNA, 25 bp, Mus musculus
gattacagatcctcacagacatgag

SEQ ID NO: 519376 - DNA, 25 bp, Mus musculus
gattacagattaaacaccagctcat

SEQ ID NO: 519377 - DNA, 25 bp, Mus musculus
gattacagattatacaccagctcat

SEQ ID NO: 519378 - DNA, 25 bp, Mus musculus
gattacagcagcctcgttagtgtca

SEQ ID NO: 519379 - DNA, 25 bp, Mus musculus
gattacagcagcgtcgttagtgtca

SEQ ID NO: 519380 - DNA, 25 bp, Mus musculus
gattacagcatgaacagttgctttt

SEQ ID NO: 519381 - DNA, 25 bp, Mus musculus
gattacagcatgtacagttgctttt

SEQ ID NO: 519382 - DNA, 25 bp, Mus musculus
gattacagcattatgttcaccctga

SEQ ID NO: 519383 - DNA, 25 bp, Mus musculus
gattacagcattttgttcaccctga

SEQ ID NO: 519384 - DNA, 25 bp, Mus musculus
gattacagcccgcaatgagcaactt

SEQ ID NO: 519385 - DNA, 25 bp, Mus musculus
gattacagcccggaatgagcaactt

SEQ ID NO: 519386 - DNA, 25 bp, Mus musculus
gattacagctacagctttatgcatg

SEQ ID NO: 519387 - DNA, 25 bp, Mus musculus
gattacagctactgctttatgcatg

SEQ ID NO: 519388 - DNA, 25 bp, Mus musculus
gattacagctcaaacggaaccaaat

SEQ ID NO: 519389 - DNA, 25 bp, Mus musculus
gattacagctcacgcgcatgtttgg

SEQ ID NO: 519390 - DNA, 25 bp, Mus musculus
gattacagctcaggcgcatgtttgg

SEQ ID NO: 519391 - DNA, 25 bp, Mus musculus
gattacagctcatacggaaccaaat

SEQ ID NO: 519392 - DNA, 25 bp, Mus musculus
gattacagctgtcaccttatttaac

SEQ ID NO: 519393 - DNA, 25 bp, Mus musculus
gattacagctgtgaccttatttaac

SEQ ID NO: 519394 - DNA, 25 bp, Mus musculus
gattacagcttcagagcgttccgga

SEQ ID NO: 519395 - DNA, 25 bp, Mus musculus
gattacagcttctgagcgttccgga

SEQ ID NO: 519396 - DNA, 25 bp, Mus musculus
gattacagcttgattttctcctaat

SEQ ID NO: 519397 - DNA, 25 bp, Mus musculus
gattacagcttgtttttctcctaat

SEQ ID NO: 519398 - DNA, 25 bp, Mus musculus
gattacaggagactcatgctcaaaa

SEQ ID NO: 519399 - DNA, 25 bp, Mus musculus
gattacaggagagtcatgctcaaaa

SEQ ID NO: 519400 - DNA, 25 bp, Mus musculus
gattacaggagcaaccacaagcccc

SEQ ID NO: 519401 - DNA, 25 bp, Mus musculus
gattacaggagctaccacaagcccc

SEQ ID NO: 519402 - DNA, 25 bp, Mus musculus
gattacaggttcagcttaccttctc

SEQ ID NO: 519403 - DNA, 25 bp, Mus musculus
gattacaggttctgcttaccttctc

SEQ ID NO: 519404 - DNA, 25 bp, Mus musculus
gattacagtacactttaatgttaca

SEQ ID NO: 519405 - DNA, 25 bp, Mus musculus
gattacagtacagtttaatgttaca

SEQ ID NO: 519406 - DNA, 25 bp, Mus musculus
gattacagtataatccctaacccac

SEQ ID NO: 519407 - DNA, 25 bp, Mus musculus
gattacagtatattccctaacccac

SEQ ID NO: 519408 - DNA, 25 bp, Mus musculus
gattacagtttccacatagaagcat

SEQ ID NO: 519409 - DNA, 25 bp, Mus musculus
gattacagtttcgacatagaagcat

SEQ ID NO: 519410 - DNA, 25 bp, Mus musculus
gattacatacctacaacctgacaag

SEQ ID NO: 519411 - DNA, 25 bp, Mus musculus
gattacataccttcaacctgacaag

SEQ ID NO: 519412 - DNA, 25 bp, Mus musculus
gattacatagctccttagtctgata

SEQ ID NO: 519413 - DNA, 25 bp, Mus musculus
gattacatagctgcttagtctgata

SEQ ID NO: 519414 - DNA, 25 bp, Mus musculus
gattacataggacaaatccattttt

SEQ ID NO: 519415 - DNA, 25 bp, Mus musculus
gattacataggagaaatccattttt

SEQ ID NO: 519416 - DNA, 25 bp, Mus musculus
gattacatcaatattcctgacccat

SEQ ID NO: 519417 - DNA, 25 bp, Mus musculus
gattacatcaattttcctgacccat

SEQ ID NO: 519418 - DNA, 25 bp, Mus musculus
gattacatcatacgaactgtgaatg

SEQ ID NO: 519419 - DNA, 25 bp, Mus musculus
gattacatcataggaactgtgaatg

SEQ ID NO: 519420 - DNA, 25 bp, Mus musculus
gattacatccagaagcccgggtgac

SEQ ID NO: 519421 - DNA, 25 bp, Mus musculus
gattacatccagtagcccgggtgac

SEQ ID NO: 519422 - DNA, 25 bp, Mus musculus
gattacatcctactctcagaacgag

SEQ ID NO: 519423 - DNA, 25 bp, Mus musculus
gattacatcctagtctcagaacgag

SEQ ID NO: 519424 - DNA, 25 bp, Mus musculus
gattacatggataacgtccctctgt

SEQ ID NO: 519425 - DNA, 25 bp, Mus musculus
gattacatggattacgtccctctgt

SEQ ID NO: 519426 - DNA, 25 bp, Mus musculus
gattacatggccagaaccccacagt

SEQ ID NO: 519427 - DNA, 25 bp, Mus musculus
gattacatggcctgaaccccacagt

SEQ ID NO: 519428 - DNA, 25 bp, Mus musculus
gattacattcacaaagaattcacag

SEQ ID NO: 519429 - DNA, 25 bp, Mus musculus
gattacattcactaagaattcacag

SEQ ID NO: 519430 - DNA, 25 bp, Mus musculus
gattacattgccaggtcagataact

SEQ ID NO: 519431 - DNA, 25 bp, Mus musculus
gattacattgcctggtcagataact

SEQ ID NO: 519432 - DNA, 25 bp, Mus musculus
gattaccaaagacgcttcctaagag

SEQ ID NO: 519433 - DNA, 25 bp, Mus musculus
gattaccaaagaggcttcctaagag

SEQ ID NO: 519434 - DNA, 25 bp, Mus musculus
gattaccaaggaacgctatctatag

SEQ ID NO: 519435 - DNA, 25 bp, Mus musculus
gattaccaaggatcgctatctatag

SEQ ID NO: 519436 - DNA, 25 bp, Mus musculus
gattaccaaggtcaaccaccacaga

SEQ ID NO: 519437 - DNA, 25 bp, Mus musculus
gattaccaaggtgaaccaccacaga

SEQ ID NO: 519438 - DNA, 25 bp, Mus musculus
gattaccaatctaacccagggaact

SEQ ID NO: 519439 - DNA, 25 bp, Mus musculus
gattaccaatcttacccagggaact

SEQ ID NO: 519440 - DNA, 25 bp, Mus musculus
gattaccaccttatatttctgccag

SEQ ID NO: 519441 - DNA, 25 bp, Mus musculus
gattaccaccttttatttctgccag

SEQ ID NO: 519442 - DNA, 25 bp, Mus musculus
gattaccagcagaagccatgaccgt

SEQ ID NO: 519443 - DNA, 25 bp, Mus musculus
gattaccagcagcaagccgacaaca

SEQ ID NO: 519444 - DNA, 25 bp, Mus musculus
gattaccagcaggaagccgacaaca

SEQ ID NO: 519445 - DNA, 25 bp, Mus musculus
gattaccagcagtagccatgaccgt

SEQ ID NO: 519446 - DNA, 25 bp, Mus musculus
gattaccagtctaagctggccatgt

SEQ ID NO: 519447 - DNA, 25 bp, Mus musculus
gattaccagtcttagctggccatgt

SEQ ID NO: 519448 - DNA, 25 bp, Mus musculus
gattaccatgcaatcctgattctga

SEQ ID NO: 519449 - DNA, 25 bp, Mus musculus
gattaccatgcattcctgattctga

SEQ ID NO: 519450 - DNA, 25 bp, Mus musculus
gattacccaagtaccatcagaacca

SEQ ID NO: 519451 - DNA, 25 bp, Mus musculus
gattacccaagttccatcagaacca

SEQ ID NO: 519452 - DNA, 25 bp, Mus musculus
gattacccacctagttgcagaaatg

SEQ ID NO: 519453 - DNA, 25 bp, Mus musculus
gattacccaccttgttgcagaaatg

SEQ ID NO: 519454 - DNA, 25 bp, Mus musculus
gattacccagcaactgtattctctg

SEQ ID NO: 519455 - DNA, 25 bp, Mus musculus
gattacccagcatctgtattctctg

SEQ ID NO: 519456 - DNA, 25 bp, Mus musculus
gattacccattaagcatttctattt

SEQ ID NO: 519457 - DNA, 25 bp, Mus musculus
gattacccattatgcatttctattt

SEQ ID NO: 519458 - DNA, 25 bp, Mus musculus
gattaccccaaacgagacgcttcta

SEQ ID NO: 519459 - DNA, 25 bp, Mus musculus
gattaccccaaaggagacgcttcta

SEQ ID NO: 519460 - DNA, 25 bp, Mus musculus
gattaccccgatagaagtctctgaa

SEQ ID NO: 519461 - DNA, 25 bp, Mus musculus
gattaccccgattgaagtctctgaa

SEQ ID NO: 519462 - DNA, 25 bp, Mus musculus
gattacccgagtatgaattagtcac

SEQ ID NO: 519463 - DNA, 25 bp, Mus musculus
gattacccgagtttgaattagtcac

SEQ ID NO: 519464 - DNA, 25 bp, Mus musculus
gattaccctaatacctacagattta

SEQ ID NO: 519465 - DNA, 25 bp, Mus musculus
gattaccctaattcctacagattta

SEQ ID NO: 519466 - DNA, 25 bp, Mus musculus
gattaccctcaacttactacacttt

SEQ ID NO: 519467 - DNA, 25 bp, Mus musculus
gattaccctcaagttactacacttt

SEQ ID NO: 519468 - DNA, 25 bp, Mus musculus
gattaccctgtcatggcatagatta

SEQ ID NO: 519469 - DNA, 25 bp, Mus musculus
gattaccctgtcttggcatagatta

SEQ ID NO: 519470 - DNA, 25 bp, Mus musculus
gattaccgggtaagcagacgttcaa

SEQ ID NO: 519471 - DNA, 25 bp, Mus musculus
gattaccgggtatgcagacgttcaa

SEQ ID NO: 519472 - DNA, 25 bp, Mus musculus
gattacctacatccttttgtcaaga

SEQ ID NO: 519473 - DNA, 25 bp, Mus musculus
gattacctacatgcttttgtcaaga

SEQ ID NO: 519474 - DNA, 25 bp, Mus musculus
gattacctagcaacaccagatatgg

SEQ ID NO: 519475 - DNA, 25 bp, Mus musculus
gattacctagcatcaccagatatgg

SEQ ID NO: 519476 - DNA, 25 bp, Mus musculus
gattacctatagcagaagccattgt

SEQ ID NO: 519477 - DNA, 25 bp, Mus musculus
gattacctataggagaagccattgt

SEQ ID NO: 519478 - DNA, 25 bp, Mus musculus
gattacctatccataagtttcccat

SEQ ID NO: 519479 - DNA, 25 bp, Mus musculus
gattacctatccttaagtttcccat

SEQ ID NO: 519480 - DNA, 25 bp, Mus musculus
gattacctctcactaaatccttata

SEQ ID NO: 519481 - DNA, 25 bp, Mus musculus
gattacctctcagtaaatccttata

SEQ ID NO: 519482 - DNA, 25 bp, Mus musculus
gattacctgacgcatagtactggaa

SEQ ID NO: 519483 - DNA, 25 bp, Mus musculus
gattacctgacggatagtactggaa

SEQ ID NO: 519484 - DNA, 25 bp, Mus musculus
gattacctgagaacccagttggaac

SEQ ID NO: 519485 - DNA, 25 bp, Mus musculus
gattacctgagatcccagttggaac

SEQ ID NO: 519486 - DNA, 25 bp, Mus musculus
gattacctgatgacctgaacttgaa

SEQ ID NO: 519487 - DNA, 25 bp, Mus musculus
gattacctgatgatcaactactcca

SEQ ID NO: 519488 - DNA, 25 bp, Mus musculus
gattacctgatgtcctgaacttgaa

SEQ ID NO: 519489 - DNA, 25 bp, Mus musculus
gattacctgatgttcaactactcca

SEQ ID NO: 519490 - DNA, 25 bp, Mus musculus
gattacctggatatcggcaacaacc

SEQ ID NO: 519491 - DNA, 25 bp, Mus musculus
gattacctggatttcggcaacaacc

SEQ ID NO: 519492 - DNA, 25 bp, Mus musculus
gattacctgtgcctgtattgatact

SEQ ID NO: 519493 - DNA, 25 bp, Mus musculus
gattacctgtgcgtgtattgatact

SEQ ID NO: 519494 - DNA, 25 bp, Mus musculus
gattaccttcaacaaaaccattgct

SEQ ID NO: 519495 - DNA, 25 bp, Mus musculus
gattaccttcaagaaaaccattgct

SEQ ID NO: 519496 - DNA, 25 bp, Mus musculus
gattacctttgaatatttgggccat

SEQ ID NO: 519497 - DNA, 25 bp, Mus musculus
gattacctttgattatttgggccat

SEQ ID NO: 519498 - DNA, 25 bp, Mus musculus
gattacgaaggaagacacacactat

SEQ ID NO: 519499 - DNA, 25 bp, Mus musculus
gattacgaaggatgacacacactat

SEQ ID NO: 519500 - DNA, 25 bp, Mus musculus
gattacgactacataaatgactggg

SEQ ID NO: 519501 - DNA, 25 bp, Mus musculus
gattacgactacttaaatgactggg

SEQ ID NO: 519502 - DNA, 25 bp, Mus musculus
gattacgagaaacttggtttccagg

SEQ ID NO: 519503 - DNA, 25 bp, Mus musculus
gattacgagaaagttggtttccagg

SEQ ID NO: 519504 - DNA, 25 bp, Mus musculus
gattacgaggaaattccttactggg

SEQ ID NO: 519505 - DNA, 25 bp, Mus musculus
gattacgaggaatttccttactggg

SEQ ID NO: 519506 - DNA, 25 bp, Mus musculus
gattacgaggccactggttcagaac

SEQ ID NO: 519507 - DNA, 25 bp, Mus musculus
gattacgaggcctctggttcagaac

SEQ ID NO: 519508 - DNA, 25 bp, Mus musculus
gattacgccttccatgactcagctc

SEQ ID NO: 519509 - DNA, 25 bp, Mus musculus
gattacgccttcgatgactcagctc

SEQ ID NO: 519510 - DNA, 25 bp, Mus musculus
gattacggagagatagctttgaaat

SEQ ID NO: 519511 - DNA, 25 bp, Mus musculus
gattacggagagttagctttgaaat

SEQ ID NO: 519512 - DNA, 25 bp, Mus musculus
gattacggtcaccatggcacaaaga

SEQ ID NO: 519513 - DNA, 25 bp, Mus musculus
gattacggtcacgatggcacaaaga

SEQ ID NO: 519514 - DNA, 25 bp, Mus musculus
gattacggttggaagatttgcatgt

SEQ ID NO: 519515 - DNA, 25 bp, Mus musculus
gattacggttggtagatttgcatgt

SEQ ID NO: 519516 - DNA, 25 bp, Mus musculus
gattacgtcgtcaactttgactact

SEQ ID NO: 519517 - DNA, 25 bp, Mus musculus
gattacgtcgtctactttgactact

SEQ ID NO: 519518 - DNA, 25 bp, Mus musculus
gattacgtgcttcatcttgcattgt

SEQ ID NO: 519519 - DNA, 25 bp, Mus musculus
gattacgtgcttgatcttgcattgt

SEQ ID NO: 519520 - DNA, 25 bp, Mus musculus
gattacgtggctatcaataaaacag

SEQ ID NO: 519521 - DNA, 25 bp, Mus musculus
gattacgtggctttcaataaaacag

SEQ ID NO: 519522 - DNA, 25 bp, Mus musculus
gattactaattcatttggatacttt

SEQ ID NO: 519523 - DNA, 25 bp, Mus musculus
gattactaattcttttggatacttt

SEQ ID NO: 519524 - DNA, 25 bp, Mus musculus
gattactacaaaaaccaatgcaaag

SEQ ID NO: 519525 - DNA, 25 bp, Mus musculus
gattactacaaataccaatgcaaag

SEQ ID NO: 519526 - DNA, 25 bp, Mus musculus
gattactacagtattcagccatgca

SEQ ID NO: 519527 - DNA, 25 bp, Mus musculus
gattactacagttttcagccatgca

SEQ ID NO: 519528 - DNA, 25 bp, Mus musculus
gattactacccaccattttctgcag

SEQ ID NO: 519529 - DNA, 25 bp, Mus musculus
gattactacccagcattttctgcag

SEQ ID NO: 519530 - DNA, 25 bp, Mus musculus
gattactactatagcaccattagag

SEQ ID NO: 519531 - DNA, 25 bp, Mus musculus
gattactactattgcaccattagag

SEQ ID NO: 519532 - DNA, 25 bp, Mus musculus
gattactagttccatgtgacgcaca

SEQ ID NO: 519533 - DNA, 25 bp, Mus musculus
gattactagttcgatgtgacgcaca

SEQ ID NO: 519534 - DNA, 25 bp, Mus musculus
gattactataagctcttggtgtaca

SEQ ID NO: 519535 - DNA, 25 bp, Mus musculus
gattactataaggtcttggtgtaca

SEQ ID NO: 519536 - DNA, 25 bp, Mus musculus
gattactatcaacactggaagcatt

SEQ ID NO: 519537 - DNA, 25 bp, Mus musculus
gattactatcaagactggaagcatt

SEQ ID NO: 519538 - DNA, 25 bp, Mus musculus
gattactatcacaatcacagctaaa

SEQ ID NO: 519539 - DNA, 25 bp, Mus musculus
gattactatcactatcacagctaaa

SEQ ID NO: 519540 - DNA, 25 bp, Mus musculus
gattactatcttcagaggtgcccac

SEQ ID NO: 519541 - DNA, 25 bp, Mus musculus
gattactatcttgagaggtgcccac

SEQ ID NO: 519542 - DNA, 25 bp, Mus musculus
gattactatgaccatcctcagcagt

SEQ ID NO: 519543 - DNA, 25 bp, Mus musculus
gattactatgacgatcctcagcagt

SEQ ID NO: 519544 - DNA, 25 bp, Mus musculus
gattactcataactcaggatgcctt

SEQ ID NO: 519545 - DNA, 25 bp, Mus musculus
gattactcataagtcaggatgcctt

SEQ ID NO: 519546 - DNA, 25 bp, Mus musculus
gattactcattcatcttgttcactc

SEQ ID NO: 519547 - DNA, 25 bp, Mus musculus
gattactcattcttcttgttcactc

SEQ ID NO: 519548 - DNA, 25 bp, Mus musculus
gattactcccttacaagaacacact

SEQ ID NO: 519549 - DNA, 25 bp, Mus musculus
gattactcccttcactgtgcaggaa

SEQ ID NO: 519550 - DNA, 25 bp, Mus musculus
gattactcccttgactgtgcaggaa

SEQ ID NO: 519551 - DNA, 25 bp, Mus musculus
gattactccctttcaagaacacact

SEQ ID NO: 519552 - DNA, 25 bp, Mus musculus
gattactccgcactcaagcacatat

SEQ ID NO: 519553 - DNA, 25 bp, Mus musculus
gattactccgcacttaagggcgctg

SEQ ID NO: 519554 - DNA, 25 bp, Mus musculus
gattactccgcagtcaagcacatat

SEQ ID NO: 519555 - DNA, 25 bp, Mus musculus
gattactccgcagttaagggcgctg

SEQ ID NO: 519556 - DNA, 25 bp, Mus musculus
gattactccgtgattgagtcagagg

SEQ ID NO: 519557 - DNA, 25 bp, Mus musculus
gattactccgtgtttgagtcagagg

SEQ ID NO: 519558 - DNA, 25 bp, Mus musculus
gattactcgaggaccattcctggga

SEQ ID NO: 519559 - DNA, 25 bp, Mus musculus
gattactcgaggtccattcctggga

SEQ ID NO: 519560 - DNA, 25 bp, Mus musculus
gattactctatgagcagtgctttgc

SEQ ID NO: 519561 - DNA, 25 bp, Mus musculus
gattactctatgtgcagtgctttgc

SEQ ID NO: 519562 - DNA, 25 bp, Mus musculus
gattactctggccagtttctacatc

SEQ ID NO: 519563 - DNA, 25 bp, Mus musculus
gattactctggcgagtttctacatc

SEQ ID NO: 519564 - DNA, 25 bp, Mus musculus
gattactctgtgagccagatctccc

SEQ ID NO: 519565 - DNA, 25 bp, Mus musculus
gattactctgtgtgccagatctccc

SEQ ID NO: 519566 - DNA, 25 bp, Mus musculus
gattactctttgactgtaccttctg

SEQ ID NO: 519567 - DNA, 25 bp, Mus musculus
gattactctttgtctgtaccttctg

SEQ ID NO: 519568 - DNA, 25 bp, Mus musculus
gattactgaattatctgtctcccct

SEQ ID NO: 519569 - DNA, 25 bp, Mus musculus
gattactgaattttctgtctcccct

SEQ ID NO: 519570 - DNA, 25 bp, Mus musculus
gattactgacagcactcaccaatag

SEQ ID NO: 519571 - DNA, 25 bp, Mus musculus
gattactgacaggactcaccaatag

SEQ ID NO: 519572 - DNA, 25 bp, Mus musculus
gattactgagttagttggcaaggga

SEQ ID NO: 519573 - DNA, 25 bp, Mus musculus
gattactgagtttgttggcaaggga

SEQ ID NO: 519574 - DNA, 25 bp, Mus musculus
gattactgcagtcaactaccacagc

SEQ ID NO: 519575 - DNA, 25 bp, Mus musculus
gattactgcagtgaactaccacagc

SEQ ID NO: 519576 - DNA, 25 bp, Mus musculus
gattactgccggacctcagtgtcag

SEQ ID NO: 519577 - DNA, 25 bp, Mus musculus
gattactgccggtcctcagtgtcag

SEQ ID NO: 519578 - DNA, 25 bp, Mus musculus
gattactggcctattccatttatct

SEQ ID NO: 519579 - DNA, 25 bp, Mus musculus
gattactggccttttccatttatct

SEQ ID NO: 519580 - DNA, 25 bp, Mus musculus
gattactgggataaaaatactgact

SEQ ID NO: 519581 - DNA, 25 bp, Mus musculus
gattactgggattaaaatactgact

SEQ ID NO: 519582 - DNA, 25 bp, Mus musculus
gattactggggtcctaactctggcc

SEQ ID NO: 519583 - DNA, 25 bp, Mus musculus
gattactggggtgctaactctggcc

SEQ ID NO: 519584 - DNA, 25 bp, Mus musculus
gattactgggttagctgtgaactca

SEQ ID NO: 519585 - DNA, 25 bp, Mus musculus
gattactgggtttgctgtgaactca

SEQ ID NO: 519586 - DNA, 25 bp, Mus musculus
gattactgtccgacacaagtgggtg

SEQ ID NO: 519587 - DNA, 25 bp, Mus musculus
gattactgtccgtcacaagtgggtg

SEQ ID NO: 519588 - DNA, 25 bp, Mus musculus
gattactgtctacgctccattttga

SEQ ID NO: 519589 - DNA, 25 bp, Mus musculus
gattactgtctaggctccattttga

SEQ ID NO: 519590 - DNA, 25 bp, Mus musculus
gattactgtgacagcggacccagtg

SEQ ID NO: 519591 - DNA, 25 bp, Mus musculus
gattactgtgactgcggacccagtg

SEQ ID NO: 519592 - DNA, 25 bp, Mus musculus
gattactgtgagagtgatgtcatcc

SEQ ID NO: 519593 - DNA, 25 bp, Mus musculus
gattactgtgagtgtgatgtcatcc

SEQ ID NO: 519594 - DNA, 25 bp, Mus musculus
gattactgtggtacatgccccagaa

SEQ ID NO: 519595 - DNA, 25 bp, Mus musculus
gattactgtggttcatgccccagaa

SEQ ID NO: 519596 - DNA, 25 bp, Mus musculus
gattactgttgaaactatttgagct

SEQ ID NO: 519597 - DNA, 25 bp, Mus musculus
gattactgttgatactatttgagct

SEQ ID NO: 519598 - DNA, 25 bp, Mus musculus
gattacttcaatcctcggagagaac

SEQ ID NO: 519599 - DNA, 25 bp, Mus musculus
gattacttcaatgctcggagagaac

SEQ ID NO: 519600 - DNA, 25 bp, Mus musculus
gattacttcctacataatgctgtac

SEQ ID NO: 519601 - DNA, 25 bp, Mus musculus
gattacttcctagataatgctgtac

SEQ ID NO: 519602 - DNA, 25 bp, Mus musculus
gattacttcgtacatctcgcaaggc

SEQ ID NO: 519603 - DNA, 25 bp, Mus musculus
gattacttcgtagatctcgcaaggc

SEQ ID NO: 519604 - DNA, 25 bp, Mus musculus
gattacttctacatttggcttttgg

SEQ ID NO: 519605 - DNA, 25 bp, Mus musculus
gattacttctacttttggcttttgg

SEQ ID NO: 519606 - DNA, 25 bp, Mus musculus
gattacttctttagcctatctaaat

SEQ ID NO: 519607 - DNA, 25 bp, Mus musculus
gattacttcttttgcctatctaaat

SEQ ID NO: 519608 - DNA, 25 bp, Mus musculus
gattacttggccctggaggactact

SEQ ID NO: 519609 - DNA, 25 bp, Mus musculus
gattacttggccgtggaggactact

SEQ ID NO: 519610 - DNA, 25 bp, Mus musculus
gattacttgtttatccatctctgta

SEQ ID NO: 519611 - DNA, 25 bp, Mus musculus
gattacttgtttttccatctctgta

SEQ ID NO: 519612 - DNA, 25 bp, Mus musculus
gattactttagtaagcatgcgcgct

SEQ ID NO: 519613 - DNA, 25 bp, Mus musculus
gattactttagttagcatgcgcgct

SEQ ID NO: 519614 - DNA, 25 bp, Mus musculus
gattactttatcatccagtggaccc

SEQ ID NO: 519615 - DNA, 25 bp, Mus musculus
gattactttatcttccagtggaccc

SEQ ID NO: 519616 - DNA, 25 bp, Mus musculus
gattactttgagcacagtccactct

SEQ ID NO: 519617 - DNA, 25 bp, Mus musculus
gattactttgaggacagtccactct

SEQ ID NO: 519618 - DNA, 25 bp, Mus musculus
gattactttggacttgctgcaacaa

SEQ ID NO: 519619 - DNA, 25 bp, Mus musculus
gattactttggagttgctgcaacaa

SEQ ID NO: 519620 - DNA, 25 bp, Mus musculus
gattactttgttcttgtgctctggc

SEQ ID NO: 519621 - DNA, 25 bp, Mus musculus
gattactttgttgttgtgctctggc

SEQ ID NO: 519622 - DNA, 25 bp, Mus musculus
gattacttttaaaccacccagataa

SEQ ID NO: 519623 - DNA, 25 bp, Mus musculus
gattacttttaatccacccagataa

SEQ ID NO: 519624 - DNA, 25 bp, Mus musculus
gattacttttcacatgttggctagg

SEQ ID NO: 519625 - DNA, 25 bp, Mus musculus
gattacttttcagatgttggctagg

SEQ ID NO: 519626 - DNA, 25 bp, Mus musculus
gattagaacttgattcgacagagta

SEQ ID NO: 519627 - DNA, 25 bp, Mus musculus
gattagaacttgtttcgacagagta

SEQ ID NO: 519628 - DNA, 25 bp, Mus musculus
gattagaagataacacccaggaatt

SEQ ID NO: 519629 - DNA, 25 bp, Mus musculus
gattagaagatatcacccaggaatt

SEQ ID NO: 519630 - DNA, 25 bp, Mus musculus
gattagaaggatcggtgtgacccac

SEQ ID NO: 519631 - DNA, 25 bp, Mus musculus
gattagaaggatgggtgtgacccac

SEQ ID NO: 519632 - DNA, 25 bp, Mus musculus
gattagaagtatatgggctcgccca

SEQ ID NO: 519633 - DNA, 25 bp, Mus musculus
gattagaagtatttgggctcgccca

SEQ ID NO: 519634 - DNA, 25 bp, Mus musculus
gattagaatcagatcggccagcact

SEQ ID NO: 519635 - DNA, 25 bp, Mus musculus
gattagaatcagttcggccagcact

SEQ ID NO: 519636 - DNA, 25 bp, Mus musculus
gattagacaaacctctagattctgg

SEQ ID NO: 519637 - DNA, 25 bp, Mus musculus
gattagacaaacgtctagattctgg

SEQ ID NO: 519638 - DNA, 25 bp, Mus musculus
gattagacatttcccaactgtcagt

SEQ ID NO: 519639 - DNA, 25 bp, Mus musculus
gattagacatttgccaactgtcagt

SEQ ID NO: 519640 - DNA, 25 bp, Mus musculus
gattagactctgctccatggacttc

SEQ ID NO: 519641 - DNA, 25 bp, Mus musculus
gattagactctggtccatggacttc

SEQ ID NO: 519642 - DNA, 25 bp, Mus musculus
gattagactgacaggaagccaggct

SEQ ID NO: 519643 - DNA, 25 bp, Mus musculus
gattagactgactggaagccaggct

SEQ ID NO: 519644 - DNA, 25 bp, Mus musculus
gattagactggcaaagactcagcaa

SEQ ID NO: 519645 - DNA, 25 bp, Mus musculus
gattagactggctaagactcagcaa

SEQ ID NO: 519646 - DNA, 25 bp, Mus musculus
gattagagcaagactgtctgtattt

SEQ ID NO: 519647 - DNA, 25 bp, Mus musculus
gattagagcaagtctgtctgtattt

SEQ ID NO: 519648 - DNA, 25 bp, Mus musculus
gattagagccgcataatatccctct

SEQ ID NO: 519649 - DNA, 25 bp, Mus musculus
gattagagccgcttaatatccctct

SEQ ID NO: 519650 - DNA, 25 bp, Mus musculus
gattagagtaccaaggaagcccttt

SEQ ID NO: 519651 - DNA, 25 bp, Mus musculus
gattagagtacctaggaagcccttt

SEQ ID NO: 519652 - DNA, 25 bp, Mus musculus
gattagagtcagcaaggttcgcctt

SEQ ID NO: 519653 - DNA, 25 bp, Mus musculus
gattagagtcaggaaggttcgcctt

SEQ ID NO: 519654 - DNA, 25 bp, Mus musculus
gattagatagtcatttcataagtgg

SEQ ID NO: 519655 - DNA, 25 bp, Mus musculus
gattagatagtcttttcataagtgg

SEQ ID NO: 519656 - DNA, 25 bp, Mus musculus
gattagatcaacacagcatccctgt

SEQ ID NO: 519657 - DNA, 25 bp, Mus musculus
gattagatcaactcagcatccctgt

SEQ ID NO: 519658 - DNA, 25 bp, Mus musculus
gattagatcaccacacctgggcatg

SEQ ID NO: 519659 - DNA, 25 bp, Mus musculus
gattagatcacctcacctgggcatg

SEQ ID NO: 519660 - DNA, 25 bp, Mus musculus
gattagatcattagctcagtgacct

SEQ ID NO: 519661 - DNA, 25 bp, Mus musculus
gattagatcatttgctcagtgacct

SEQ ID NO: 519662 - DNA, 25 bp, Mus musculus
gattagatcccaataagcatagtat

SEQ ID NO: 519663 - DNA, 25 bp, Mus musculus
gattagatcccattaagcatagtat

SEQ ID NO: 519664 - DNA, 25 bp, Mus musculus
gattagatcgttactcttggctggg

SEQ ID NO: 519665 - DNA, 25 bp, Mus musculus
gattagatcgtttctcttggctggg

SEQ ID NO: 519666 - DNA, 25 bp, Mus musculus
gattagatctagaaatggccattgc

SEQ ID NO: 519667 - DNA, 25 bp, Mus musculus
gattagatctagtaatggccattgc

SEQ ID NO: 519668 - DNA, 25 bp, Mus musculus
gattagatgctgatcctcattgtcc

SEQ ID NO: 519669 - DNA, 25 bp, Mus musculus
gattagatgctgttcctcattgtcc

SEQ ID NO: 519670 - DNA, 25 bp, Mus musculus
gattagattataactgtgcctctca

SEQ ID NO: 519671 - DNA, 25 bp, Mus musculus
gattagattatatctgtgcctctca

SEQ ID NO: 519672 - DNA, 25 bp, Mus musculus
gattagattgtcatatcataccaat

SEQ ID NO: 519673 - DNA, 25 bp, Mus musculus
gattagattgtcttatcataccaat

SEQ ID NO: 519674 - DNA, 25 bp, Mus musculus
gattagatttgaacccttccagcta

SEQ ID NO: 519675 - DNA, 25 bp, Mus musculus
gattagatttgatcccttccagcta

SEQ ID NO: 519676 - DNA, 25 bp, Mus musculus
gattagcaactgcatacactcagca

SEQ ID NO: 519677 - DNA, 25 bp, Mus musculus
gattagcaactggatacactcagca

SEQ ID NO: 519678 - DNA, 25 bp, Mus musculus
gattagcaagtcaacacccaaacct

SEQ ID NO: 519679 - DNA, 25 bp, Mus musculus
gattagcaagtctacacccaaacct

SEQ ID NO: 519680 - DNA, 25 bp, Mus musculus
gattagcaatctcactgtacccagt

SEQ ID NO: 519681 - DNA, 25 bp, Mus musculus
gattagcaatctgactgtacccagt

SEQ ID NO: 519682 - DNA, 25 bp, Mus musculus
gattagcacagcacccgaatctgaa

SEQ ID NO: 519683 - DNA, 25 bp, Mus musculus
gattagcacagctcccgaatctgaa

SEQ ID NO: 519684 - DNA, 25 bp, Mus musculus
gattagcactagataaggattcatt

SEQ ID NO: 519685 - DNA, 25 bp, Mus musculus
gattagcactagttaaggattcatt

SEQ ID NO: 519686 - DNA, 25 bp, Mus musculus
gattagcagcttatggcatttataa

SEQ ID NO: 519687 - DNA, 25 bp, Mus musculus
gattagcagcttttggcatttataa

SEQ ID NO: 519688 - DNA, 25 bp, Mus musculus
gattagcatttaaccatcaatagga

SEQ ID NO: 519689 - DNA, 25 bp, Mus musculus
gattagcatttatccatcaatagga

SEQ ID NO: 519690 - DNA, 25 bp, Mus musculus
gattagcccatcaatccaattggtg

SEQ ID NO: 519691 - DNA, 25 bp, Mus musculus
gattagcccatctatccaattggtg

SEQ ID NO: 519692 - DNA, 25 bp, Mus musculus
gattagcccctaacttcaaagaagg

SEQ ID NO: 519693 - DNA, 25 bp, Mus musculus
gattagcccctacgaaagacacaag

SEQ ID NO: 519694 - DNA, 25 bp, Mus musculus
gattagcccctaggaaagacacaag

SEQ ID NO: 519695 - DNA, 25 bp, Mus musculus
gattagcccctatcttcaaagaagg

SEQ ID NO: 519696 - DNA, 25 bp, Mus musculus
gattagccgagaccgcagcaaacat

SEQ ID NO: 519697 - DNA, 25 bp, Mus musculus
gattagccgagagcgcagcaaacat

SEQ ID NO: 519698 - DNA, 25 bp, Mus musculus
gattagcctcgaacagggtgacaac

SEQ ID NO: 519699 - DNA, 25 bp, Mus musculus
gattagcctcgatcagggtgacaac

SEQ ID NO: 519700 - DNA, 25 bp, Mus musculus
gattagcctgctctgttccttattt

SEQ ID NO: 519701 - DNA, 25 bp, Mus musculus
gattagcctgctgtgttccttattt

SEQ ID NO: 519702 - DNA, 25 bp, Mus musculus
gattagctatcactgtacaagacat

SEQ ID NO: 519703 - DNA, 25 bp, Mus musculus
gattagctatcagtgtacaagacat

SEQ ID NO: 519704 - DNA, 25 bp, Mus musculus
gattagctatgtctcctaggcatcc

SEQ ID NO: 519705 - DNA, 25 bp, Mus musculus
gattagctatgtgtcctaggcatcc

SEQ ID NO: 519706 - DNA, 25 bp, Mus musculus
gattagctcaaacttcccatttctg

SEQ ID NO: 519707 - DNA, 25 bp, Mus musculus
gattagctcaaagttcccatttctg

SEQ ID NO: 519708 - DNA, 25 bp, Mus musculus
gattagctcagtccctgatgggcga

SEQ ID NO: 519709 - DNA, 25 bp, Mus musculus
gattagctcagtgcctgatgggcga

SEQ ID NO: 519710 - DNA, 25 bp, Mus musculus
gattagctctagcatttgggaagga

SEQ ID NO: 519711 - DNA, 25 bp, Mus musculus
gattagctctaggatttgggaagga

SEQ ID NO: 519712 - DNA, 25 bp, Mus musculus
gattagctgctacgtcctgctgaca

SEQ ID NO: 519713 - DNA, 25 bp, Mus musculus
gattagctgctaggtcctgctgaca

SEQ ID NO: 519714 - DNA, 25 bp, Mus musculus
gattagctgctcaggatattcgctc

SEQ ID NO: 519715 - DNA, 25 bp, Mus musculus
gattagctgctctggatattcgctc

SEQ ID NO: 519716 - DNA, 25 bp, Mus musculus
gattagctggagcacatgtgccaag

SEQ ID NO: 519717 - DNA, 25 bp, Mus musculus
gattagctggaggacatgtgccaag

SEQ ID NO: 519718 - DNA, 25 bp, Mus musculus
gattagctgtgactcctgcatatgt

SEQ ID NO: 519719 - DNA, 25 bp, Mus musculus
gattagctgtgagtcctgcatatgt

SEQ ID NO: 519720 - DNA, 25 bp, Mus musculus
gattagctgtgcagggacctttgta

SEQ ID NO: 519721 - DNA, 25 bp, Mus musculus
gattagctgtgctgggacctttgta

SEQ ID NO: 519722 - DNA, 25 bp, Mus musculus
gattagcttacacagtgcttgcctg

SEQ ID NO: 519723 - DNA, 25 bp, Mus musculus
gattagcttacagagtgcttgcctg

SEQ ID NO: 519724 - DNA, 25 bp, Mus musculus
gattagcttctcattagtcaaccca

SEQ ID NO: 519725 - DNA, 25 bp, Mus musculus
gattagcttctctttagtcaaccca

SEQ ID NO: 519726 - DNA, 25 bp, Mus musculus
gattagctttatccagcggacattt

SEQ ID NO: 519727 - DNA, 25 bp, Mus musculus
gattagctttatctgggccattgac

SEQ ID NO: 519728 - DNA, 25 bp, Mus musculus
gattagctttatgcagcggacattt

SEQ ID NO: 519729 - DNA, 25 bp, Mus musculus
gattagctttatgtgggccattgac

SEQ ID NO: 519730 - DNA, 25 bp, Mus musculus
gattaggaacctaagtgtgacttaa

SEQ ID NO: 519731 - DNA, 25 bp, Mus musculus
gattaggaaccttagtgtgacttaa

SEQ ID NO: 519732 - DNA, 25 bp, Mus musculus
gattaggaactcaccttctgcaaca

SEQ ID NO: 519733 - DNA, 25 bp, Mus musculus
gattaggaactctccttctgcaaca

SEQ ID NO: 519734 - DNA, 25 bp, Mus musculus
gattaggaagggattggcacacttg

SEQ ID NO: 519735 - DNA, 25 bp, Mus musculus
gattaggaagggtttggcacacttg

SEQ ID NO: 519736 - DNA, 25 bp, Mus musculus
gattaggaattacaaggacaactta

SEQ ID NO: 519737 - DNA, 25 bp, Mus musculus
gattaggaattagaaggacaactta

SEQ ID NO: 519738 - DNA, 25 bp, Mus musculus
gattaggacggcatgcctgttctca

SEQ ID NO: 519739 - DNA, 25 bp, Mus musculus
gattaggacggcttgcctgttctca

SEQ ID NO: 519740 - DNA, 25 bp, Mus musculus
gattaggagaaaccgagtacttgct

SEQ ID NO: 519741 - DNA, 25 bp, Mus musculus
gattaggagaaagcgagtacttgct

SEQ ID NO: 519742 - DNA, 25 bp, Mus musculus
gattaggagggtatctgctggccct

SEQ ID NO: 519743 - DNA, 25 bp, Mus musculus
gattaggagggtttctgctggccct

SEQ ID NO: 519744 - DNA, 25 bp, Mus musculus
gattaggagtcacccatttctcaga

SEQ ID NO: 519745 - DNA, 25 bp, Mus musculus
gattaggagtcagccatttctcaga

SEQ ID NO: 519746 - DNA, 25 bp, Mus musculus
gattaggataccacattgcaacatg

SEQ ID NO: 519747 - DNA, 25 bp, Mus musculus
gattaggatacctcattgcaacatg

SEQ ID NO: 519748 - DNA, 25 bp, Mus musculus
gattaggatagtccttacctagctt

SEQ ID NO: 519749 - DNA, 25 bp, Mus musculus
gattaggatagtgcttacctagctt

SEQ ID NO: 519750 - DNA, 25 bp, Mus musculus
gattaggatcttacttaaccttcat

SEQ ID NO: 519751 - DNA, 25 bp, Mus musculus
gattaggatctttcttaaccttcat

SEQ ID NO: 519752 - DNA, 25 bp, Mus musculus
gattaggatgttattgaaggtttca

SEQ ID NO: 519753 - DNA, 25 bp, Mus musculus
gattaggatgtttttgaaggtttca

SEQ ID NO: 519754 - DNA, 25 bp, Mus musculus
gattaggattttcgcgttcattcgc

SEQ ID NO: 519755 - DNA, 25 bp, Mus musculus
gattaggattttggcgttcattcgc

SEQ ID NO: 519756 - DNA, 25 bp, Mus musculus
gattaggcactgatcttcctaacct

SEQ ID NO: 519757 - DNA, 25 bp, Mus musculus
gattaggcactgttcttcctaacct

SEQ ID NO: 519758 - DNA, 25 bp, Mus musculus
gattaggcatttaagggactcattt

SEQ ID NO: 519759 - DNA, 25 bp, Mus musculus
gattaggcattttagggactcattt

SEQ ID NO: 519760 - DNA, 25 bp, Mus musculus
gattaggcccacacttcaggttcat

SEQ ID NO: 519761 - DNA, 25 bp, Mus musculus
gattaggcccactcttcaggttcat

SEQ ID NO: 519762 - DNA, 25 bp, Mus musculus
gattaggcctttcctcatgctatag

SEQ ID NO: 519763 - DNA, 25 bp, Mus musculus
gattaggcctttgctcatgctatag

SEQ ID NO: 519764 - DNA, 25 bp, Mus musculus
gattaggctatgactttgacatgta

SEQ ID NO: 519765 - DNA, 25 bp, Mus musculus
gattaggctatgtctttgacatgta

SEQ ID NO: 519766 - DNA, 25 bp, Mus musculus
gattaggctgtgaaggcttctcctt

SEQ ID NO: 519767 - DNA, 25 bp, Mus musculus
gattaggctgtgtaggcttctcctt

SEQ ID NO: 519768 - DNA, 25 bp, Mus musculus
gattaggcttatattctctgcgctt

SEQ ID NO: 519769 - DNA, 25 bp, Mus musculus
gattaggcttattttctctgcgctt

SEQ ID NO: 519770 - DNA, 25 bp, Mus musculus
gattagggcataaggttagcttata

SEQ ID NO: 519771 - DNA, 25 bp, Mus musculus
gattagggcatatggttagcttata

SEQ ID NO: 519772 - DNA, 25 bp, Mus musculus
gattagggcgtcagcagcagtctta

SEQ ID NO: 519773 - DNA, 25 bp, Mus musculus
gattagggcgtctgcagcagtctta

SEQ ID NO: 519774 - DNA, 25 bp, Mus musculus
gattaggtagctcttaacatcacag

SEQ ID NO: 519775 - DNA, 25 bp, Mus musculus
gattaggtagctgttaacatcacag

SEQ ID NO: 519776 - DNA, 25 bp, Mus musculus
gattaggtattacaggccatgattt

SEQ ID NO: 519777 - DNA, 25 bp, Mus musculus
gattaggtattagaggccatgattt

SEQ ID NO: 519778 - DNA, 25 bp, Mus musculus
gattaggtccccatatggcaggaag

SEQ ID NO: 519779 - DNA, 25 bp, Mus musculus
gattaggtccccttatggcaggaag

SEQ ID NO: 519780 - DNA, 25 bp, Mus musculus
gattaggtctaactcagggccagga

SEQ ID NO: 519781 - DNA, 25 bp, Mus musculus
gattaggtctaagtcagggccagga

SEQ ID NO: 519782 - DNA, 25 bp, Mus musculus
gattaggtctggatagctcctggct

SEQ ID NO: 519783 - DNA, 25 bp, Mus musculus
gattaggtctggttagctcctggct

SEQ ID NO: 519784 - DNA, 25 bp, Mus musculus
gattaggtggttatgctctttaaca

SEQ ID NO: 519785 - DNA, 25 bp, Mus musculus
gattaggtggttttgctctttaaca

SEQ ID NO: 519786 - DNA, 25 bp, Mus musculus
gattaggtgtcaattcctacttgat

SEQ ID NO: 519787 - DNA, 25 bp, Mus musculus
gattaggtgtcatttcctacttgat

SEQ ID NO: 519788 - DNA, 25 bp, Mus musculus
gattaggttacaccacatgggtcat

SEQ ID NO: 519789 - DNA, 25 bp, Mus musculus
gattaggttacagcacatgggtcat

SEQ ID NO: 519790 - DNA, 25 bp, Mus musculus
gattaggttgctcgttttggctttt

SEQ ID NO: 519791 - DNA, 25 bp, Mus musculus
gattaggttgctggttttggctttt

SEQ ID NO: 519792 - DNA, 25 bp, Mus musculus
gattagtaaaccatgaacactcctc

SEQ ID NO: 519793 - DNA, 25 bp, Mus musculus
gattagtaaaccttgaacactcctc

SEQ ID NO: 519794 - DNA, 25 bp, Mus musculus
gattagtaagtaaccaccattagct

SEQ ID NO: 519795 - DNA, 25 bp, Mus musculus
gattagtaagtatccaccattagct

SEQ ID NO: 519796 - DNA, 25 bp, Mus musculus
gattagtaatgaactcccttgagag

SEQ ID NO: 519797 - DNA, 25 bp, Mus musculus
gattagtaatgatctcccttgagag

SEQ ID NO: 519798 - DNA, 25 bp, Mus musculus
gattagtaatttccctgttctttat

SEQ ID NO: 519799 - DNA, 25 bp, Mus musculus
gattagtaatttgcctgttctttat

SEQ ID NO: 519800 - DNA, 25 bp, Mus musculus
gattagtagatgctgatggccctct

SEQ ID NO: 519801 - DNA, 25 bp, Mus musculus
gattagtagatggtgatggccctct

SEQ ID NO: 519802 - DNA, 25 bp, Mus musculus
gattagtaggccatggcctttccag

SEQ ID NO: 519803 - DNA, 25 bp, Mus musculus
gattagtaggccttggcctttccag

SEQ ID NO: 519804 - DNA, 25 bp, Mus musculus
gattagtatctcagtgcctagcact

SEQ ID NO: 519805 - DNA, 25 bp, Mus musculus
gattagtatctctgtgcctagcact

SEQ ID NO: 519806 - DNA, 25 bp, Mus musculus
gattagtcattgaatttggtcaaga

SEQ ID NO: 519807 - DNA, 25 bp, Mus musculus
gattagtcattgtatttggtcaaga

SEQ ID NO: 519808 - DNA, 25 bp, Mus musculus
gattagtcctacatctgggcttttt

SEQ ID NO: 519809 - DNA, 25 bp, Mus musculus
gattagtcctacttctgggcttttt

SEQ ID NO: 519810 - DNA, 25 bp, Mus musculus
gattagtcctctcatgagttctatg

SEQ ID NO: 519811 - DNA, 25 bp, Mus musculus
gattagtcctctgatgagttctatg

SEQ ID NO: 519812 - DNA, 25 bp, Mus musculus
gattagtccttgactggatcactta

SEQ ID NO: 519813 - DNA, 25 bp, Mus musculus
gattagtccttgtctggatcactta

SEQ ID NO: 519814 - DNA, 25 bp, Mus musculus
gattagtgacttccacgggttgtcc

SEQ ID NO: 519815 - DNA, 25 bp, Mus musculus
gattagtgacttgcacgggttgtcc

SEQ ID NO: 519816 - DNA, 25 bp, Mus musculus
gattagtgatctcgcagagctggcc

SEQ ID NO: 519817 - DNA, 25 bp, Mus musculus
gattagtgatctggcagagctggcc

SEQ ID NO: 519818 - DNA, 25 bp, Mus musculus
gattagtggagtactgtgcaacagc

SEQ ID NO: 519819 - DNA, 25 bp, Mus musculus
gattagtggagttctgtgcaacagc

SEQ ID NO: 519820 - DNA, 25 bp, Mus musculus
gattagtggcctctttgatcattaa

SEQ ID NO: 519821 - DNA, 25 bp, Mus musculus
gattagtggcctgtttgatcattaa

SEQ ID NO: 519822 - DNA, 25 bp, Mus musculus
gattagtggtcaatccgctcaacga

SEQ ID NO: 519823 - DNA, 25 bp, Mus musculus
gattagtggtcattccgctcaacga

SEQ ID NO: 519824 - DNA, 25 bp, Mus musculus
gattagtgttttcaatgctatgaca

SEQ ID NO: 519825 - DNA, 25 bp, Mus musculus
gattagtgttttgaatgctatgaca

SEQ ID NO: 519826 - DNA, 25 bp, Mus musculus
gattagttaaacctgtctcctcaac

SEQ ID NO: 519827 - DNA, 25 bp, Mus musculus
gattagttaaacgtgtctcctcaac

SEQ ID NO: 519828 - DNA, 25 bp, Mus musculus
gattagttatctagcctagcttcct

SEQ ID NO: 519829 - DNA, 25 bp, Mus musculus
gattagttatcttgcctagcttcct

SEQ ID NO: 519830 - DNA, 25 bp, Mus musculus
gattagttattaatactctgaggca

SEQ ID NO: 519831 - DNA, 25 bp, Mus musculus
gattagttattattactctgaggca

SEQ ID NO: 519832 - DNA, 25 bp, Mus musculus
gattagttcgttaagttgactgtaa

SEQ ID NO: 519833 - DNA, 25 bp, Mus musculus
gattagttcgtttagttgactgtaa

SEQ ID NO: 519834 - DNA, 25 bp, Mus musculus
gattagttgctgaattataccttca

SEQ ID NO: 519835 - DNA, 25 bp, Mus musculus
gattagttgctgtattataccttca

SEQ ID NO: 519836 - DNA, 25 bp, Mus musculus
gattagttgggccaagtgaaagccc

SEQ ID NO: 519837 - DNA, 25 bp, Mus musculus
gattagttgggcgaagtgaaagccc

SEQ ID NO: 519838 - DNA, 25 bp, Mus musculus
gattagtttatcaattccatgtgga

SEQ ID NO: 519839 - DNA, 25 bp, Mus musculus
gattagtttatctattccatgtgga

SEQ ID NO: 519840 - DNA, 25 bp, Mus musculus
gattagttttgaacccatttcagag

SEQ ID NO: 519841 - DNA, 25 bp, Mus musculus
gattagttttgatcccatttcagag

SEQ ID NO: 519842 - DNA, 25 bp, Mus musculus
gattataaaaacctggtctaaccag

SEQ ID NO: 519843 - DNA, 25 bp, Mus musculus
gattataaaaacgtggtctaaccag

SEQ ID NO: 519844 - DNA, 25 bp, Mus musculus
gattataaaagaagacgccagtcct

SEQ ID NO: 519845 - DNA, 25 bp, Mus musculus
gattataaaagatgacgccagtcct

SEQ ID NO: 519846 - DNA, 25 bp, Mus musculus
gattataaactgagtctcgacctgt

SEQ ID NO: 519847 - DNA, 25 bp, Mus musculus
gattataaactgtgtctcgacctgt

SEQ ID NO: 519848 - DNA, 25 bp, Mus musculus
gattataaagtacggatgcaacaat

SEQ ID NO: 519849 - DNA, 25 bp, Mus musculus
gattataaagtagggatgcaacaat

SEQ ID NO: 519850 - DNA, 25 bp, Mus musculus
gattataaatgcaattgttcctttg

SEQ ID NO: 519851 - DNA, 25 bp, Mus musculus
gattataaatgctattgttcctttg

SEQ ID NO: 519852 - DNA, 25 bp, Mus musculus
gattataacacacgcgaccggtttc

SEQ ID NO: 519853 - DNA, 25 bp, Mus musculus
gattataacacaggcgaccggtttc

SEQ ID NO: 519854 - DNA, 25 bp, Mus musculus
gattataactggcactggactcttc

SEQ ID NO: 519855 - DNA, 25 bp, Mus musculus
gattataactgggactggactcttc

SEQ ID NO: 519856 - DNA, 25 bp, Mus musculus
gattataagctgagggactagagaa

SEQ ID NO: 519857 - DNA, 25 bp, Mus musculus
gattataagctgtgggactagagaa

SEQ ID NO: 519858 - DNA, 25 bp, Mus musculus
gattataatcaacttttcctggtac

SEQ ID NO: 519859 - DNA, 25 bp, Mus musculus
gattataatcaagttttcctggtac

SEQ ID NO: 519860 - DNA, 25 bp, Mus musculus
gattataatcgaccagcagatttca

SEQ ID NO: 519861 - DNA, 25 bp, Mus musculus
gattataatcgagcagcagatttca

SEQ ID NO: 519862 - DNA, 25 bp, Mus musculus
gattataatgctactatcttctaca

SEQ ID NO: 519863 - DNA, 25 bp, Mus musculus
gattataatgcttctatcttctaca

SEQ ID NO: 519864 - DNA, 25 bp, Mus musculus
gattatacaccaatggaagacagtg

SEQ ID NO: 519865 - DNA, 25 bp, Mus musculus
gattatacaccattggaagacagtg

SEQ ID NO: 519866 - DNA, 25 bp, Mus musculus
gattatacacttagtccagcaccac

SEQ ID NO: 519867 - DNA, 25 bp, Mus musculus
gattatacactttgtccagcaccac

SEQ ID NO: 519868 - DNA, 25 bp, Mus musculus
gattatacagtgatcattgaggctg

SEQ ID NO: 519869 - DNA, 25 bp, Mus musculus
gattatacagtgttcattgaggctg

SEQ ID NO: 519870 - DNA, 25 bp, Mus musculus
gattatacatccataccactgcatg

SEQ ID NO: 519871 - DNA, 25 bp, Mus musculus
gattatacatccttaccactgcatg

SEQ ID NO: 519872 - DNA, 25 bp, Mus musculus
gattatacctatcgtgcagagtcgc

SEQ ID NO: 519873 - DNA, 25 bp, Mus musculus
gattatacctatggtgcagagtcgc

SEQ ID NO: 519874 - DNA, 25 bp, Mus musculus
gattatacgactagtccaggccttc

SEQ ID NO: 519875 - DNA, 25 bp, Mus musculus
gattatacgacttgtccaggccttc

SEQ ID NO: 519876 - DNA, 25 bp, Mus musculus
gattatacttgaactggaccagaga

SEQ ID NO: 519877 - DNA, 25 bp, Mus musculus
gattatacttgatctggaccagaga

SEQ ID NO: 519878 - DNA, 25 bp, Mus musculus
gattatagcaaaatggaccagggta

SEQ ID NO: 519879 - DNA, 25 bp, Mus musculus
gattatagcaaattggaccagggta

SEQ ID NO: 519880 - DNA, 25 bp, Mus musculus
gattatagctccaaaaattctgaat

SEQ ID NO: 519881 - DNA, 25 bp, Mus musculus
gattatagctcctaaaattctgaat

SEQ ID NO: 519882 - DNA, 25 bp, Mus musculus
gattataggcatacagtgctgtgtc

SEQ ID NO: 519883 - DNA, 25 bp, Mus musculus
gattataggcattcagtgctgtgtc

SEQ ID NO: 519884 - DNA, 25 bp, Mus musculus
gattataggtatatgtcactgtgtc

SEQ ID NO: 519885 - DNA, 25 bp, Mus musculus
gattataggtatttgtcactgtgtc

SEQ ID NO: 519886 - DNA, 25 bp, Mus musculus
gattatagtcacctgccactaagct

SEQ ID NO: 519887 - DNA, 25 bp, Mus musculus
gattatagtcacgtgccactaagct

SEQ ID NO: 519888 - DNA, 25 bp, Mus musculus
gattatagtcatctccacgtccagc

SEQ ID NO: 519889 - DNA, 25 bp, Mus musculus
gattatagtcatgtccacgtccagc

SEQ ID NO: 519890 - DNA, 25 bp, Mus musculus
gattatagtggtcccaagactcaat

SEQ ID NO: 519891 - DNA, 25 bp, Mus musculus
gattatagtggtgccaagactcaat

SEQ ID NO: 519892 - DNA, 25 bp, Mus musculus
gattatagtgtgacaactctatctt

SEQ ID NO: 519893 - DNA, 25 bp, Mus musculus
gattatagtgtgtcaactctatctt

SEQ ID NO: 519894 - DNA, 25 bp, Mus musculus
gattatataagtaactgtctgagac

SEQ ID NO: 519895 - DNA, 25 bp, Mus musculus
gattatataagttactgtctgagac

SEQ ID NO: 519896 - DNA, 25 bp, Mus musculus
gattatatacatctccttttcagaa

SEQ ID NO: 519897 - DNA, 25 bp, Mus musculus
gattatatacatgtccttttcagaa

SEQ ID NO: 519898 - DNA, 25 bp, Mus musculus
gattatatagcaaaagtccacctca

SEQ ID NO: 519899 - DNA, 25 bp, Mus musculus
gattatatagcacagagattctcca

SEQ ID NO: 519900 - DNA, 25 bp, Mus musculus
gattatatagcagagagattctcca

SEQ ID NO: 519901 - DNA, 25 bp, Mus musculus
gattatatagcataagtccacctca

SEQ ID NO: 519902 - DNA, 25 bp, Mus musculus
gattatatataaccgccacacacta

SEQ ID NO: 519903 - DNA, 25 bp, Mus musculus
gattatatataagcgccacacacta

SEQ ID NO: 519904 - DNA, 25 bp, Mus musculus
gattatatatttaccaaagccattg

SEQ ID NO: 519905 - DNA, 25 bp, Mus musculus
gattatatattttccaaagccattg

SEQ ID NO: 519906 - DNA, 25 bp, Mus musculus
gattatatcaggcacacatgggact

SEQ ID NO: 519907 - DNA, 25 bp, Mus musculus
gattatatcagggacacatgggact

SEQ ID NO: 519908 - DNA, 25 bp, Mus musculus
gattatcaacctagtttttgtacag

SEQ ID NO: 519909 - DNA, 25 bp, Mus musculus
gattatcaaccttgtttttgtacag

SEQ ID NO: 519910 - DNA, 25 bp, Mus musculus
gattatcaacttcgtaccagctaga

SEQ ID NO: 519911 - DNA, 25 bp, Mus musculus
gattatcaacttggtaccagctaga

SEQ ID NO: 519912 - DNA, 25 bp, Mus musculus
gattatcaattccttgttcacatct

SEQ ID NO: 519913 - DNA, 25 bp, Mus musculus
gattatcaattcgttgttcacatct

SEQ ID NO: 519914 - DNA, 25 bp, Mus musculus
gattatcacaacaactgcattcagg

SEQ ID NO: 519915 - DNA, 25 bp, Mus musculus
gattatcacaactactgcattcagg

SEQ ID NO: 519916 - DNA, 25 bp, Mus musculus
gattatcacatcctttgaattctac

SEQ ID NO: 519917 - DNA, 25 bp, Mus musculus
gattatcacatcgtttgaattctac

SEQ ID NO: 519918 - DNA, 25 bp, Mus musculus
gattatcacatgaacctgggccaat

SEQ ID NO: 519919 - DNA, 25 bp, Mus musculus
gattatcacatgtacctgggccaat

SEQ ID NO: 519920 - DNA, 25 bp, Mus musculus
gattatcaccaccatcaacgttttt

SEQ ID NO: 519921 - DNA, 25 bp, Mus musculus
gattatcaccacgatcaacgttttt

SEQ ID NO: 519922 - DNA, 25 bp, Mus musculus
gattatcactctactctgataggtt

SEQ ID NO: 519923 - DNA, 25 bp, Mus musculus
gattatcactcttctctgataggtt

SEQ ID NO: 519924 - DNA, 25 bp, Mus musculus
gattatcagagaccagaacaaccac

SEQ ID NO: 519925 - DNA, 25 bp, Mus musculus
gattatcagagagcagaacaaccac

SEQ ID NO: 519926 - DNA, 25 bp, Mus musculus
gattatcaggcacttccaccttaag

SEQ ID NO: 519927 - DNA, 25 bp, Mus musculus
gattatcaggcagttccaccttaag

SEQ ID NO: 519928 - DNA, 25 bp, Mus musculus
gattatcagggtcaaccatgccttg

SEQ ID NO: 519929 - DNA, 25 bp, Mus musculus
gattatcagggtgaaccatgccttg

SEQ ID NO: 519930 - DNA, 25 bp, Mus musculus
gattatcagtaaactcaagctcctg

SEQ ID NO: 519931 - DNA, 25 bp, Mus musculus
gattatcagtaacagaattcctcct

SEQ ID NO: 519932 - DNA, 25 bp, Mus musculus
gattatcagtaagagaattcctcct

SEQ ID NO: 519933 - DNA, 25 bp, Mus musculus
gattatcagtaatctcaagctcctg

SEQ ID NO: 519934 - DNA, 25 bp, Mus musculus
gattatcagtcaactattccacata

SEQ ID NO: 519935 - DNA, 25 bp, Mus musculus
gattatcagtcatctattccacata

SEQ ID NO: 519936 - DNA, 25 bp, Mus musculus
gattatcataaactattcgggtcca

SEQ ID NO: 519937 - DNA, 25 bp, Mus musculus
gattatcataaagtattcgggtcca

SEQ ID NO: 519938 - DNA, 25 bp, Mus musculus
gattatcatcctattcagtcttttt

SEQ ID NO: 519939 - DNA, 25 bp, Mus musculus
gattatcatccttttcagtcttttt

SEQ ID NO: 519940 - DNA, 25 bp, Mus musculus
gattatcattttctgtctcattgag

SEQ ID NO: 519941 - DNA, 25 bp, Mus musculus
gattatcattttgtgtctcattgag

SEQ ID NO: 519942 - DNA, 25 bp, Mus musculus
gattatccaaacattgtgtccgtac

SEQ ID NO: 519943 - DNA, 25 bp, Mus musculus
gattatccaaactttgtgtccgtac

SEQ ID NO: 519944 - DNA, 25 bp, Mus musculus
gattatccaccacaaagatcccttc

SEQ ID NO: 519945 - DNA, 25 bp, Mus musculus
gattatccaccagaaagatcccttc

SEQ ID NO: 519946 - DNA, 25 bp, Mus musculus
gattatccagctcatcgaaggcaaa

SEQ ID NO: 519947 - DNA, 25 bp, Mus musculus
gattatccagctgatcgaaggcaaa

SEQ ID NO: 519948 - DNA, 25 bp, Mus musculus
gattatccatgaaccattagaccat

SEQ ID NO: 519949 - DNA, 25 bp, Mus musculus
gattatccatgatccattagaccat

SEQ ID NO: 519950 - DNA, 25 bp, Mus musculus
gattatccatggctcacaagaggca

SEQ ID NO: 519951 - DNA, 25 bp, Mus musculus
gattatccatgggtcacaagaggca

SEQ ID NO: 519952 - DNA, 25 bp, Mus musculus
gattatccattgcccgatgtcctct

SEQ ID NO: 519953 - DNA, 25 bp, Mus musculus
gattatccattggccgatgtcctct

SEQ ID NO: 519954 - DNA, 25 bp, Mus musculus
gattatcccatcattactttttctg

SEQ ID NO: 519955 - DNA, 25 bp, Mus musculus
gattatcccatctttactttttctg

SEQ ID NO: 519956 - DNA, 25 bp, Mus musculus
gattatccctagaccctaaggtgtg

SEQ ID NO: 519957 - DNA, 25 bp, Mus musculus
gattatccctagtccctaaggtgtg

SEQ ID NO: 519958 - DNA, 25 bp, Mus musculus
gattatccgctactggaactacagc

SEQ ID NO: 519959 - DNA, 25 bp, Mus musculus
gattatccgctagtggaactacagc

SEQ ID NO: 519960 - DNA, 25 bp, Mus musculus
gattatccgtgacccacgtagcaat

SEQ ID NO: 519961 - DNA, 25 bp, Mus musculus
gattatccgtgagccacgtagcaat

SEQ ID NO: 519962 - DNA, 25 bp, Mus musculus
gattatcctacaaacgcactagctg

SEQ ID NO: 519963 - DNA, 25 bp, Mus musculus
gattatcctacatacgcactagctg

SEQ ID NO: 519964 - DNA, 25 bp, Mus musculus
gattatcctggaactttgtccttta

SEQ ID NO: 519965 - DNA, 25 bp, Mus musculus
gattatcctggatctttgtccttta

SEQ ID NO: 519966 - DNA, 25 bp, Mus musculus
gattatcctgtcagcttctttcttc

SEQ ID NO: 519967 - DNA, 25 bp, Mus musculus
gattatcctgtctgcttctttcttc

SEQ ID NO: 519968 - DNA, 25 bp, Mus musculus
gattatcgccgcaaaggaagcaatt

SEQ ID NO: 519969 - DNA, 25 bp, Mus musculus
gattatcgccgctaaggaagcaatt

SEQ ID NO: 519970 - DNA, 25 bp, Mus musculus
gattatcgcttcctataagcacaca

SEQ ID NO: 519971 - DNA, 25 bp, Mus musculus
gattatcgcttcgtataagcacaca

SEQ ID NO: 519972 - DNA, 25 bp, Mus musculus
gattatctacctatcaatcaacatg

SEQ ID NO: 519973 - DNA, 25 bp, Mus musculus
gattatctacctttcaatcaacatg

SEQ ID NO: 519974 - DNA, 25 bp, Mus musculus
gattatctcataagtcagcatttta

SEQ ID NO: 519975 - DNA, 25 bp, Mus musculus
gattatctcatatgtcagcatttta

SEQ ID NO: 519976 - DNA, 25 bp, Mus musculus
gattatctcatcaagtctgcgagac

SEQ ID NO: 519977 - DNA, 25 bp, Mus musculus
gattatctcatctagtctgcgagac

SEQ ID NO: 519978 - DNA, 25 bp, Mus musculus
gattatctcggaagatttgtcccaa

SEQ ID NO: 519979 - DNA, 25 bp, Mus musculus
gattatctcggatgatttgtcccaa

SEQ ID NO: 519980 - DNA, 25 bp, Mus musculus
gattatctgagcaatgctgtgtgtg

SEQ ID NO: 519981 - DNA, 25 bp, Mus musculus
gattatctgagctatgctgtgtgtg

SEQ ID NO: 519982 - DNA, 25 bp, Mus musculus
gattatctgcaacaggtgcccgtcc

SEQ ID NO: 519983 - DNA, 25 bp, Mus musculus
gattatctgcaagaggtgcccgtcc

SEQ ID NO: 519984 - DNA, 25 bp, Mus musculus
gattatctgcataggttgctataaa

SEQ ID NO: 519985 - DNA, 25 bp, Mus musculus
gattatctgcatctacatcggcgta

SEQ ID NO: 519986 - DNA, 25 bp, Mus musculus
gattatctgcatgtacatcggcgta

SEQ ID NO: 519987 - DNA, 25 bp, Mus musculus
gattatctgcattggttgctataaa

SEQ ID NO: 519988 - DNA, 25 bp, Mus musculus
gattatctgctcatctctattgtac

SEQ ID NO: 519989 - DNA, 25 bp, Mus musculus
gattatctgctcttctctattgtac

SEQ ID NO: 519990 - DNA, 25 bp, Mus musculus
gattatctggctctaatagcatact

SEQ ID NO: 519991 - DNA, 25 bp, Mus musculus
gattatctggctgtaatagcatact

SEQ ID NO: 519992 - DNA, 25 bp, Mus musculus
gattatcttaaaccacggccatgtg

SEQ ID NO: 519993 - DNA, 25 bp, Mus musculus
gattatcttaaagcacggccatgtg

SEQ ID NO: 519994 - DNA, 25 bp, Mus musculus
gattatcttaccattgatttccaag

SEQ ID NO: 519995 - DNA, 25 bp, Mus musculus
gattatcttacctttgatttccaag

SEQ ID NO: 519996 - DNA, 25 bp, Mus musculus
gattatcttcaaaagaccacccttt

SEQ ID NO: 519997 - DNA, 25 bp, Mus musculus
gattatcttcaatagaccacccttt

SEQ ID NO: 519998 - DNA, 25 bp, Mus musculus
gattatcttcacatagagcatgaga

SEQ ID NO: 519999 - DNA, 25 bp, Mus musculus
gattatcttcacttagagcatgaga

SEQ ID NO: 520000 - DNA, 25 bp, Mus musculus
gattatcttcataaattgacgtcat

SEQ ID NO: 520001 - DNA, 25 bp, Mus musculus
gattatcttcatattacaggtgggt

SEQ ID NO: 520002 - DNA, 25 bp, Mus musculus
gattatcttcattaattgacgtcat

SEQ ID NO: 520003 - DNA, 25 bp, Mus musculus
gattatcttcattttacaggtgggt

SEQ ID NO: 520004 - DNA, 25 bp, Mus musculus
gattatcttccacttacagctttag

SEQ ID NO: 520005 - DNA, 25 bp, Mus musculus
gattatcttccagttacagctttag

SEQ ID NO: 520006 - DNA, 25 bp, Mus musculus
gattatcttgccaatgactttcatt

SEQ ID NO: 520007 - DNA, 25 bp, Mus musculus
gattatcttgcctatgactttcatt

SEQ ID NO: 520008 - DNA, 25 bp, Mus musculus
gattatcttgtgatcatagcacctg

SEQ ID NO: 520009 - DNA, 25 bp, Mus musculus
gattatcttgtgttcatagcacctg

SEQ ID NO: 520010 - DNA, 25 bp, Mus musculus
gattatctttatatcctgacccctc

SEQ ID NO: 520011 - DNA, 25 bp, Mus musculus
gattatctttatttcctgacccctc

SEQ ID NO: 520012 - DNA, 25 bp, Mus musculus
gattatctttccatagtttctctaa

SEQ ID NO: 520013 - DNA, 25 bp, Mus musculus
gattatctttccttagtttctctaa

SEQ ID NO: 520014 - DNA, 25 bp, Mus musculus
gattatctttggaatgttcacttgt

SEQ ID NO: 520015 - DNA, 25 bp, Mus musculus
gattatctttggtatgttcacttgt

SEQ ID NO: 520016 - DNA, 25 bp, Mus musculus
gattatgaaactatgctgtgggccc

SEQ ID NO: 520017 - DNA, 25 bp, Mus musculus
gattatgaaactttgctgtgggccc

SEQ ID NO: 520018 - DNA, 25 bp, Mus musculus
gattatgaaatcacctctcaaactc

SEQ ID NO: 520019 - DNA, 25 bp, Mus musculus
gattatgaaatctcctctcaaactc

SEQ ID NO: 520020 - DNA, 25 bp, Mus musculus
gattatgacaggaccttgagccgcc

SEQ ID NO: 520021 - DNA, 25 bp, Mus musculus
gattatgacaggtccttgagccgcc

SEQ ID NO: 520022 - DNA, 25 bp, Mus musculus
gattatgaccgaaatagacgctctc

SEQ ID NO: 520023 - DNA, 25 bp, Mus musculus
gattatgaccgatatagacgctctc

SEQ ID NO: 520024 - DNA, 25 bp, Mus musculus
gattatgagcaacatccagcgcatc

SEQ ID NO: 520025 - DNA, 25 bp, Mus musculus
gattatgagcaagatccagcgcatc

SEQ ID NO: 520026 - DNA, 25 bp, Mus musculus
gattatgagccaagatgatgtgaca

SEQ ID NO: 520027 - DNA, 25 bp, Mus musculus
gattatgagccatgatgatgtgaca

SEQ ID NO: 520028 - DNA, 25 bp, Mus musculus
gattatgaggctacaggcaggtgtc

SEQ ID NO: 520029 - DNA, 25 bp, Mus musculus
gattatgaggcttcaggcaggtgtc

SEQ ID NO: 520030 - DNA, 25 bp, Mus musculus
gattatgatgaccatgacggcggaa

SEQ ID NO: 520031 - DNA, 25 bp, Mus musculus
gattatgatgacgatgacggcggaa

SEQ ID NO: 520032 - DNA, 25 bp, Mus musculus
gattatgatgccaacgatgctcaag

SEQ ID NO: 520033 - DNA, 25 bp, Mus musculus
gattatgatgcctacgatgctcaag

SEQ ID NO: 520034 - DNA, 25 bp, Mus musculus
gattatgatgtgatggcttctgact

SEQ ID NO: 520035 - DNA, 25 bp, Mus musculus
gattatgatgtgttggcttctgact

SEQ ID NO: 520036 - DNA, 25 bp, Mus musculus
gattatgcaggcaatgccactgctg

SEQ ID NO: 520037 - DNA, 25 bp, Mus musculus
gattatgcaggctatgccactgctg

SEQ ID NO: 520038 - DNA, 25 bp, Mus musculus
gattatgcagtaatagcttcctata

SEQ ID NO: 520039 - DNA, 25 bp, Mus musculus
gattatgcagtattagcttcctata

SEQ ID NO: 520040 - DNA, 25 bp, Mus musculus
gattatgcattgctccaagtagaga

SEQ ID NO: 520041 - DNA, 25 bp, Mus musculus
gattatgcattggtccaagtagaga

SEQ ID NO: 520042 - DNA, 25 bp, Mus musculus
gattatgccaatctacactccaaag

SEQ ID NO: 520043 - DNA, 25 bp, Mus musculus
gattatgccaatgtacactccaaag

SEQ ID NO: 520044 - DNA, 25 bp, Mus musculus
gattatgcccacagaacggctggag

SEQ ID NO: 520045 - DNA, 25 bp, Mus musculus
gattatgcccactgaacggctggag

SEQ ID NO: 520046 - DNA, 25 bp, Mus musculus
gattatgccccgaagttccagggca

SEQ ID NO: 520047 - DNA, 25 bp, Mus musculus
gattatgccccgtagttccagggca

SEQ ID NO: 520048 - DNA, 25 bp, Mus musculus
gattatgcctgcaatgcctttgtgc

SEQ ID NO: 520049 - DNA, 25 bp, Mus musculus
gattatgcctgctatgcctttgtgc

SEQ ID NO: 520050 - DNA, 25 bp, Mus musculus
gattatgctcacatggtgtgtccag

SEQ ID NO: 520051 - DNA, 25 bp, Mus musculus
gattatgctcacttggtgtgtccag

SEQ ID NO: 520052 - DNA, 25 bp, Mus musculus
gattatgctcagattgcatgtctct

SEQ ID NO: 520053 - DNA, 25 bp, Mus musculus
gattatgctcagtttgcatgtctct

SEQ ID NO: 520054 - DNA, 25 bp, Mus musculus
gattatgctttcattcattttgatg

SEQ ID NO: 520055 - DNA, 25 bp, Mus musculus
gattatgctttctttcattttgatg

SEQ ID NO: 520056 - DNA, 25 bp, Mus musculus
gattatggaaagacctagagccttt

SEQ ID NO: 520057 - DNA, 25 bp, Mus musculus
gattatggaaagtcctagagccttt

SEQ ID NO: 520058 - DNA, 25 bp, Mus musculus
gattatggagctagccgtgcatgcc

SEQ ID NO: 520059 - DNA, 25 bp, Mus musculus
gattatggagcttgccgtgcatgcc

SEQ ID NO: 520060 - DNA, 25 bp, Mus musculus
gattatggatcacgacctaggccgc

SEQ ID NO: 520061 - DNA, 25 bp, Mus musculus
gattatggatcaggacctaggccgc

SEQ ID NO: 520062 - DNA, 25 bp, Mus musculus
gattatggatttcggtctccttccc

SEQ ID NO: 520063 - DNA, 25 bp, Mus musculus
gattatggatttgggtctccttccc

SEQ ID NO: 520064 - DNA, 25 bp, Mus musculus
gattatggcatcaccagcttctaat

SEQ ID NO: 520065 - DNA, 25 bp, Mus musculus
gattatggcatctccagcttctaat

SEQ ID NO: 520066 - DNA, 25 bp, Mus musculus
gattatggcctacatttttgtttgt

SEQ ID NO: 520067 - DNA, 25 bp, Mus musculus
gattatggcctagatttttgtttgt

SEQ ID NO: 520068 - DNA, 25 bp, Mus musculus
gattatggcttccagggacatcctt

SEQ ID NO: 520069 - DNA, 25 bp, Mus musculus
gattatggcttcgagggacatcctt

SEQ ID NO: 520070 - DNA, 25 bp, Mus musculus
gattatgggttcatgccaccaggcc

SEQ ID NO: 520071 - DNA, 25 bp, Mus musculus
gattatgggttcttgccaccaggcc

SEQ ID NO: 520072 - DNA, 25 bp, Mus musculus
gattatggtataaccaaggcccagg

SEQ ID NO: 520073 - DNA, 25 bp, Mus musculus
gattatggtatatccaaggcccagg

SEQ ID NO: 520074 - DNA, 25 bp, Mus musculus
gattatggtttcaatgtatctcctt

SEQ ID NO: 520075 - DNA, 25 bp, Mus musculus
gattatggtttctatgtatctcctt

SEQ ID NO: 520076 - DNA, 25 bp, Mus musculus
gattatgtacgacatcctcatgccc

SEQ ID NO: 520077 - DNA, 25 bp, Mus musculus
gattatgtacgagatcctcatgccc

SEQ ID NO: 520078 - DNA, 25 bp, Mus musculus
gattatgtactcacatttgatttga

SEQ ID NO: 520079 - DNA, 25 bp, Mus musculus
gattatgtactctcatttgatttga

SEQ ID NO: 520080 - DNA, 25 bp, Mus musculus
gattatgtcactatgcacgcgactt

SEQ ID NO: 520081 - DNA, 25 bp, Mus musculus
gattatgtcactttgcacgcgactt

SEQ ID NO: 520082 - DNA, 25 bp, Mus musculus
gattatgtccatcaattttgccggt

SEQ ID NO: 520083 - DNA, 25 bp, Mus musculus
gattatgtccatgaattttgccggt

SEQ ID NO: 520084 - DNA, 25 bp, Mus musculus
gattatgtctacctactgtttctga

SEQ ID NO: 520085 - DNA, 25 bp, Mus musculus
gattatgtctacgtactgtttctga

SEQ ID NO: 520086 - DNA, 25 bp, Mus musculus
gattatgtctatatgctgtgcattt

SEQ ID NO: 520087 - DNA, 25 bp, Mus musculus
gattatgtctatttgctgtgcattt

SEQ ID NO: 520088 - DNA, 25 bp, Mus musculus
gattatgtcttcattgtattgtgtt

SEQ ID NO: 520089 - DNA, 25 bp, Mus musculus
gattatgtcttctttgtattgtgtt

SEQ ID NO: 520090 - DNA, 25 bp, Mus musculus
gattatgtgcaacccctcattttca

SEQ ID NO: 520091 - DNA, 25 bp, Mus musculus
gattatgtgcaagccctcattttca

SEQ ID NO: 520092 - DNA, 25 bp, Mus musculus
gattatgtgcctatggagcccagag

SEQ ID NO: 520093 - DNA, 25 bp, Mus musculus
gattatgtgcctttggagcccagag

SEQ ID NO: 520094 - DNA, 25 bp, Mus musculus
gattatgtgtcaacgggaccatcta

SEQ ID NO: 520095 - DNA, 25 bp, Mus musculus
gattatgtgtcatcgggaccatcta

SEQ ID NO: 520096 - DNA, 25 bp, Mus musculus
gattatgttattcctggtgctgaac

SEQ ID NO: 520097 - DNA, 25 bp, Mus musculus
gattatgttattgctggtgctgaac

SEQ ID NO: 520098 - DNA, 25 bp, Mus musculus
gattatgttcaaccccaggatgagt

SEQ ID NO: 520099 - DNA, 25 bp, Mus musculus
gattatgttcaagcccaggatgagt

SEQ ID NO: 520100 - DNA, 25 bp, Mus musculus
gattatgttccaagtttttggcccc

SEQ ID NO: 520101 - DNA, 25 bp, Mus musculus
gattatgttccatgtttttggcccc

SEQ ID NO: 520102 - DNA, 25 bp, Mus musculus
gattatgttctacactgacacttag

SEQ ID NO: 520103 - DNA, 25 bp, Mus musculus
gattatgttctagactgacacttag

SEQ ID NO: 520104 - DNA, 25 bp, Mus musculus
gattatgttcttatggtggcctctg

SEQ ID NO: 520105 - DNA, 25 bp, Mus musculus
gattatgttcttccttgcttgctac

SEQ ID NO: 520106 - DNA, 25 bp, Mus musculus
gattatgttcttgcttgcttgctac

SEQ ID NO: 520107 - DNA, 25 bp, Mus musculus
gattatgttcttttggtggcctctg

SEQ ID NO: 520108 - DNA, 25 bp, Mus musculus
gattatgttgatccttaatacgcag

SEQ ID NO: 520109 - DNA, 25 bp, Mus musculus
gattatgttgatgcttaatacgcag

SEQ ID NO: 520110 - DNA, 25 bp, Mus musculus
gattatgttgtacactcatgtttca

SEQ ID NO: 520111 - DNA, 25 bp, Mus musculus
gattatgttgtagactcatgtttca

SEQ ID NO: 520112 - DNA, 25 bp, Mus musculus
gattatgtttccatacggagccacc

SEQ ID NO: 520113 - DNA, 25 bp, Mus musculus
gattatgtttccttacggagccacc

SEQ ID NO: 520114 - DNA, 25 bp, Mus musculus
gattatgttttcatcaccaggctgt

SEQ ID NO: 520115 - DNA, 25 bp, Mus musculus
gattatgttttcttcaccaggctgt

SEQ ID NO: 520116 - DNA, 25 bp, Mus musculus
gattattaacgtacaatttttagcg

SEQ ID NO: 520117 - DNA, 25 bp, Mus musculus
gattattaacgttcaatttttagcg

SEQ ID NO: 520118 - DNA, 25 bp, Mus musculus
gattattaatgaacccagcccactg

SEQ ID NO: 520119 - DNA, 25 bp, Mus musculus
gattattaatgatcccagcccactg

SEQ ID NO: 520120 - DNA, 25 bp, Mus musculus
gattattacccaagcagtactggag

SEQ ID NO: 520121 - DNA, 25 bp, Mus musculus
gattattacccatgcagtactggag

SEQ ID NO: 520122 - DNA, 25 bp, Mus musculus
gattattacctgatgttggaagtca

SEQ ID NO: 520123 - DNA, 25 bp, Mus musculus
gattattacctgttgttggaagtca

SEQ ID NO: 520124 - DNA, 25 bp, Mus musculus
gattattactgtaaccaatgccata

SEQ ID NO: 520125 - DNA, 25 bp, Mus musculus
gattattactgttaccaatgccata

SEQ ID NO: 520126 - DNA, 25 bp, Mus musculus
gattattaggttatgctctgagtta

SEQ ID NO: 520127 - DNA, 25 bp, Mus musculus
gattattaggttttgctctgagtta

SEQ ID NO: 520128 - DNA, 25 bp, Mus musculus
gattattagtttatagtgaggttgg

SEQ ID NO: 520129 - DNA, 25 bp, Mus musculus
gattattagtttttagtgaggttgg

SEQ ID NO: 520130 - DNA, 25 bp, Mus musculus
gattattataccagaaagtttaaca

SEQ ID NO: 520131 - DNA, 25 bp, Mus musculus
gattattatacctgaaagtttaaca

SEQ ID NO: 520132 - DNA, 25 bp, Mus musculus
gattattatggcatagtaggttttt

SEQ ID NO: 520133 - DNA, 25 bp, Mus musculus
gattattatggcttagtaggttttt

SEQ ID NO: 520134 - DNA, 25 bp, Mus musculus
gattattattggatcgtggattcag

SEQ ID NO: 520135 - DNA, 25 bp, Mus musculus
gattattattggttcgtggattcag

SEQ ID NO: 520136 - DNA, 25 bp, Mus musculus
gattattatttcctgacctttctga

SEQ ID NO: 520137 - DNA, 25 bp, Mus musculus
gattattatttcgtgacctttctga

SEQ ID NO: 520138 - DNA, 25 bp, Mus musculus
gattattcatccctttttaagcctg

SEQ ID NO: 520139 - DNA, 25 bp, Mus musculus
gattattcatccgtttttaagcctg

SEQ ID NO: 520140 - DNA, 25 bp, Mus musculus
gattattcatgtcctcaacttggca

SEQ ID NO: 520141 - DNA, 25 bp, Mus musculus
gattattcatgtgctcaacttggca

SEQ ID NO: 520142 - DNA, 25 bp, Mus musculus
gattattccagccagcctcgtcatt

SEQ ID NO: 520143 - DNA, 25 bp, Mus musculus
gattattccagcgagcctcgtcatt

SEQ ID NO: 520144 - DNA, 25 bp, Mus musculus
gattattccagtattgttcccattt

SEQ ID NO: 520145 - DNA, 25 bp, Mus musculus
gattattccagttttgttcccattt

SEQ ID NO: 520146 - DNA, 25 bp, Mus musculus
gattattccattagtccttgtcaat

SEQ ID NO: 520147 - DNA, 25 bp, Mus musculus
gattattccatttgtccttgtcaat

SEQ ID NO: 520148 - DNA, 25 bp, Mus musculus
gattattccgacattaattgatttc

SEQ ID NO: 520149 - DNA, 25 bp, Mus musculus
gattattccgactttaattgatttc

SEQ ID NO: 520150 - DNA, 25 bp, Mus musculus
gattattcctccatgctataaaaaa

SEQ ID NO: 520151 - DNA, 25 bp, Mus musculus
gattattcctccttgctataaaaaa

SEQ ID NO: 520152 - DNA, 25 bp, Mus musculus
gattattctagcctttttattttgg

SEQ ID NO: 520153 - DNA, 25 bp, Mus musculus
gattattctagcgtttttattttgg

SEQ ID NO: 520154 - DNA, 25 bp, Mus musculus
gattattctatgaactctctcacca

SEQ ID NO: 520155 - DNA, 25 bp, Mus musculus
gattattctatgtactctctcacca

SEQ ID NO: 520156 - DNA, 25 bp, Mus musculus
gattattctcttcgtttccagattt

SEQ ID NO: 520157 - DNA, 25 bp, Mus musculus
gattattctcttggtttccagattt

SEQ ID NO: 520158 - DNA, 25 bp, Mus musculus
gattattctgagattcatgcggagt

SEQ ID NO: 520159 - DNA, 25 bp, Mus musculus
gattattctgagtttcatgcggagt

SEQ ID NO: 520160 - DNA, 25 bp, Mus musculus
gattattctggccagcttgattctc

SEQ ID NO: 520161 - DNA, 25 bp, Mus musculus
gattattctggcgagcttgattctc

SEQ ID NO: 520162 - DNA, 25 bp, Mus musculus
gattattcttaaccctctattttct

SEQ ID NO: 520163 - DNA, 25 bp, Mus musculus
gattattcttaacttggcatttcat

SEQ ID NO: 520164 - DNA, 25 bp, Mus musculus
gattattcttaagcctctattttct

SEQ ID NO: 520165 - DNA, 25 bp, Mus musculus
gattattcttaagttggcatttcat

SEQ ID NO: 520166 - DNA, 25 bp, Mus musculus
gattattgaaataacttccgagttc

SEQ ID NO: 520167 - DNA, 25 bp, Mus musculus
gattattgaaattacttccgagttc

SEQ ID NO: 520168 - DNA, 25 bp, Mus musculus
gattattgaagtctgcctggccctc

SEQ ID NO: 520169 - DNA, 25 bp, Mus musculus
gattattgaagtgtgcctggccctc

SEQ ID NO: 520170 - DNA, 25 bp, Mus musculus
gattattgacacctccatgcgaggg

SEQ ID NO: 520171 - DNA, 25 bp, Mus musculus
gattattgacacgtccatgcgaggg

SEQ ID NO: 520172 - DNA, 25 bp, Mus musculus
gattattgcacacaggatctacggg

SEQ ID NO: 520173 - DNA, 25 bp, Mus musculus
gattattgcacagaggatctacggg

SEQ ID NO: 520174 - DNA, 25 bp, Mus musculus
gattattgcctcattggtggttctt

SEQ ID NO: 520175 - DNA, 25 bp, Mus musculus
gattattgcctctttggtggttctt

SEQ ID NO: 520176 - DNA, 25 bp, Mus musculus
gattattgctgaccctcgggacaga

SEQ ID NO: 520177 - DNA, 25 bp, Mus musculus
gattattgctgagcctcgggacaga

SEQ ID NO: 520178 - DNA, 25 bp, Mus musculus
gattattggtttctttcatgctgtg

SEQ ID NO: 520179 - DNA, 25 bp, Mus musculus
gattattggtttgtttcatgctgtg

SEQ ID NO: 520180 - DNA, 25 bp, Mus musculus
gattattgttaccttcagtctcata

SEQ ID NO: 520181 - DNA, 25 bp, Mus musculus
gattattgttacgttcagtctcata

SEQ ID NO: 520182 - DNA, 25 bp, Mus musculus
gattattgtttcagtgtcagtcccc

SEQ ID NO: 520183 - DNA, 25 bp, Mus musculus
gattattgtttctgtgtcagtcccc

SEQ ID NO: 520184 - DNA, 25 bp, Mus musculus
gattatttacaacagctcaccggag

SEQ ID NO: 520185 - DNA, 25 bp, Mus musculus
gattatttacaagagctcaccggag

SEQ ID NO: 520186 - DNA, 25 bp, Mus musculus
gattatttagccagtagcatacata

SEQ ID NO: 520187 - DNA, 25 bp, Mus musculus
gattatttagcctgtagcatacata

SEQ ID NO: 520188 - DNA, 25 bp, Mus musculus
gattatttattactctggctgggaa

SEQ ID NO: 520189 - DNA, 25 bp, Mus musculus
gattatttattagtctggctgggaa

SEQ ID NO: 520190 - DNA, 25 bp, Mus musculus
gattatttcatcatttcccacaatt

SEQ ID NO: 520191 - DNA, 25 bp, Mus musculus
gattatttcatcttttcccacaatt

SEQ ID NO: 520192 - DNA, 25 bp, Mus musculus
gattatttcattcctctggagtccg

SEQ ID NO: 520193 - DNA, 25 bp, Mus musculus
gattatttcattgctctggagtccg

SEQ ID NO: 520194 - DNA, 25 bp, Mus musculus
gattatttccggaatcttgctgaag

SEQ ID NO: 520195 - DNA, 25 bp, Mus musculus
gattatttccggtatcttgctgaag

SEQ ID NO: 520196 - DNA, 25 bp, Mus musculus
gattatttctatctcatcgacagaa

SEQ ID NO: 520197 - DNA, 25 bp, Mus musculus
gattatttctatgtcatcgacagaa

SEQ ID NO: 520198 - DNA, 25 bp, Mus musculus
gattatttctctatcactcaccaaa

SEQ ID NO: 520199 - DNA, 25 bp, Mus musculus
gattatttctctttcactcaccaaa

SEQ ID NO: 520200 - DNA, 25 bp, Mus musculus
gattatttgacacaagtgcctctta

SEQ ID NO: 520201 - DNA, 25 bp, Mus musculus
gattatttgacagaagtgcctctta

SEQ ID NO: 520202 - DNA, 25 bp, Mus musculus
gattatttgagtctttgttcagtga

SEQ ID NO: 520203 - DNA, 25 bp, Mus musculus
gattatttgagtgtttgttcagtga

SEQ ID NO: 520204 - DNA, 25 bp, Mus musculus
gattatttggctatatattgcctga

SEQ ID NO: 520205 - DNA, 25 bp, Mus musculus
gattatttggctttatattgcctga

SEQ ID NO: 520206 - DNA, 25 bp, Mus musculus
gattattttaatactttagattctc

SEQ ID NO: 520207 - DNA, 25 bp, Mus musculus
gattattttaattctttagattctc

SEQ ID NO: 520208 - DNA, 25 bp, Mus musculus
gattattttagacctctacctcctg

SEQ ID NO: 520209 - DNA, 25 bp, Mus musculus
gattattttagagctctacctcctg

SEQ ID NO: 520210 - DNA, 25 bp, Mus musculus
gattattttagcattacattggatt

SEQ ID NO: 520211 - DNA, 25 bp, Mus musculus
gattattttagctttacattggatt

SEQ ID NO: 520212 - DNA, 25 bp, Mus musculus
gattattttatcagacactttccca

SEQ ID NO: 520213 - DNA, 25 bp, Mus musculus
gattattttatctgacactttccca

SEQ ID NO: 520214 - DNA, 25 bp, Mus musculus
gattattttatgctgcctcttccaa

SEQ ID NO: 520215 - DNA, 25 bp, Mus musculus
gattattttatggtgcctcttccaa

SEQ ID NO: 520216 - DNA, 25 bp, Mus musculus
gattattttcacagtccttttgggt

SEQ ID NO: 520217 - DNA, 25 bp, Mus musculus
gattattttcactgtccttttgggt

SEQ ID NO: 520218 - DNA, 25 bp, Mus musculus
gattattttccaatcctagttagcg

SEQ ID NO: 520219 - DNA, 25 bp, Mus musculus
gattattttccactgaagcctttgc

SEQ ID NO: 520220 - DNA, 25 bp, Mus musculus
gattattttccagtgaagcctttgc

SEQ ID NO: 520221 - DNA, 25 bp, Mus musculus
gattattttccattcctagttagcg

SEQ ID NO: 520222 - DNA, 25 bp, Mus musculus
gattattttctacagctttattgag

SEQ ID NO: 520223 - DNA, 25 bp, Mus musculus
gattattttctagagctttattgag

SEQ ID NO: 520224 - DNA, 25 bp, Mus musculus
gattattttgacatgggctggtgag

SEQ ID NO: 520225 - DNA, 25 bp, Mus musculus
gattattttgacttgggctggtgag

SEQ ID NO: 520226 - DNA, 25 bp, Mus musculus
gattcaaaaagtctgggtccccatg

SEQ ID NO: 520227 - DNA, 25 bp, Mus musculus
gattcaaaaagtgtgggtccccatg

SEQ ID NO: 520228 - DNA, 25 bp, Mus musculus
gattcaaaacaccattgctgcaaac

SEQ ID NO: 520229 - DNA, 25 bp, Mus musculus
gattcaaaacacgattgctgcaaac

SEQ ID NO: 520230 - DNA, 25 bp, Mus musculus
gattcaaaattgaagtcagaccctt

SEQ ID NO: 520231 - DNA, 25 bp, Mus musculus
gattcaaaattgtagtcagaccctt

SEQ ID NO: 520232 - DNA, 25 bp, Mus musculus
gattcaaacaatctgcagagcttgc

SEQ ID NO: 520233 - DNA, 25 bp, Mus musculus
gattcaaacaatgtgcagagcttgc

SEQ ID NO: 520234 - DNA, 25 bp, Mus musculus
gattcaaaccatctatcaccttctg

SEQ ID NO: 520235 - DNA, 25 bp, Mus musculus
gattcaaaccatgtatcaccttctg

SEQ ID NO: 520236 - DNA, 25 bp, Mus musculus
gattcaaaccgtcagcgtgttcagt

SEQ ID NO: 520237 - DNA, 25 bp, Mus musculus
gattcaaaccgtgagcgtgttcagt

SEQ ID NO: 520238 - DNA, 25 bp, Mus musculus
gattcaaagcctaacacacttccag

SEQ ID NO: 520239 - DNA, 25 bp, Mus musculus
gattcaaagccttacacacttccag

SEQ ID NO: 520240 - DNA, 25 bp, Mus musculus
gattcaaaggaccaccgacctggac

SEQ ID NO: 520241 - DNA, 25 bp, Mus musculus
gattcaaaggacgaccgacctggac

SEQ ID NO: 520242 - DNA, 25 bp, Mus musculus
gattcaaagtgacttccctcatttc

SEQ ID NO: 520243 - DNA, 25 bp, Mus musculus
gattcaaagtgagttccctcatttc

SEQ ID NO: 520244 - DNA, 25 bp, Mus musculus
gattcaaatcaaatgttttcccagt

SEQ ID NO: 520245 - DNA, 25 bp, Mus musculus
gattcaaatcaattgttttcccagt

SEQ ID NO: 520246 - DNA, 25 bp, Mus musculus
gattcaaatccaacctggcttgcat

SEQ ID NO: 520247 - DNA, 25 bp, Mus musculus
gattcaaatccatcctggcttgcat

SEQ ID NO: 520248 - DNA, 25 bp, Mus musculus
gattcaaatgcccaacatgccatgc

SEQ ID NO: 520249 - DNA, 25 bp, Mus musculus
gattcaaatgccgaacatgccatgc

SEQ ID NO: 520250 - DNA, 25 bp, Mus musculus
gattcaaatttgacttggctgcttt

SEQ ID NO: 520251 - DNA, 25 bp, Mus musculus
gattcaaatttgtcttggctgcttt

SEQ ID NO: 520252 - DNA, 25 bp, Mus musculus
gattcaacactcaatgggagaccag

SEQ ID NO: 520253 - DNA, 25 bp, Mus musculus
gattcaacactctatgggagaccag

SEQ ID NO: 520254 - DNA, 25 bp, Mus musculus
gattcaacagcccaaagagttccct

SEQ ID NO: 520255 - DNA, 25 bp, Mus musculus
gattcaacagccgaaagagttccct

SEQ ID NO: 520256 - DNA, 25 bp, Mus musculus
gattcaacaggaccgattactggat

SEQ ID NO: 520257 - DNA, 25 bp, Mus musculus
gattcaacaggagcgattactggat

SEQ ID NO: 520258 - DNA, 25 bp, Mus musculus
gattcaacaggcatttcaggcctcc

SEQ ID NO: 520259 - DNA, 25 bp, Mus musculus
gattcaacaggcttttcaggcctcc

SEQ ID NO: 520260 - DNA, 25 bp, Mus musculus
gattcaacatcactgtttgtgcagc

SEQ ID NO: 520261 - DNA, 25 bp, Mus musculus
gattcaacatcagtgtttgtgcagc

SEQ ID NO: 520262 - DNA, 25 bp, Mus musculus
gattcaaccagtattacccagcaac

SEQ ID NO: 520263 - DNA, 25 bp, Mus musculus
gattcaaccagttttacccagcaac

SEQ ID NO: 520264 - DNA, 25 bp, Mus musculus
gattcaacccacagcaccaatgcaa

SEQ ID NO: 520265 - DNA, 25 bp, Mus musculus
gattcaacccactgcaccaatgcaa

SEQ ID NO: 520266 - DNA, 25 bp, Mus musculus
gattcaacccatcgtcagtgggcac

SEQ ID NO: 520267 - DNA, 25 bp, Mus musculus
gattcaacccatggtcagtgggcac

SEQ ID NO: 520268 - DNA, 25 bp, Mus musculus
gattcaaccttgagctattaaccaa

SEQ ID NO: 520269 - DNA, 25 bp, Mus musculus
gattcaaccttgtgctattaaccaa

SEQ ID NO: 520270 - DNA, 25 bp, Mus musculus
gattcaacgtttctaacagatacct

SEQ ID NO: 520271 - DNA, 25 bp, Mus musculus
gattcaacgtttgtaacagatacct

SEQ ID NO: 520272 - DNA, 25 bp, Mus musculus
gattcaactctactggagtgctcct

SEQ ID NO: 520273 - DNA, 25 bp, Mus musculus
gattcaactctagtggagtgctcct

SEQ ID NO: 520274 - DNA, 25 bp, Mus musculus
gattcaactgtcattttctcaaact

SEQ ID NO: 520275 - DNA, 25 bp, Mus musculus
gattcaactgtctttttctcaaact

SEQ ID NO: 520276 - DNA, 25 bp, Mus musculus
gattcaactgttaccaaatcaacaa

SEQ ID NO: 520277 - DNA, 25 bp, Mus musculus
gattcaactgtttccaaatcaacaa

SEQ ID NO: 520278 - DNA, 25 bp, Mus musculus
gattcaacttcgaatacaacagatg

SEQ ID NO: 520279 - DNA, 25 bp, Mus musculus
gattcaacttcgtatacaacagatg

SEQ ID NO: 520280 - DNA, 25 bp, Mus musculus
gattcaacttggaccatttcacttg

SEQ ID NO: 520281 - DNA, 25 bp, Mus musculus
gattcaacttggtccatttcacttg

SEQ ID NO: 520282 - DNA, 25 bp, Mus musculus
gattcaagaactcttccagctgccc

SEQ ID NO: 520283 - DNA, 25 bp, Mus musculus
gattcaagaactgttccagctgccc

SEQ ID NO: 520284 - DNA, 25 bp, Mus musculus
gattcaagcagaacgcctctttgtt

SEQ ID NO: 520285 - DNA, 25 bp, Mus musculus
gattcaagcagatcgcctctttgtt

SEQ ID NO: 520286 - DNA, 25 bp, Mus musculus
gattcaagcatcagctttgccagta

SEQ ID NO: 520287 - DNA, 25 bp, Mus musculus
gattcaagcatctgctttgccagta

SEQ ID NO: 520288 - DNA, 25 bp, Mus musculus
gattcaagcttcaccttatcagagg

SEQ ID NO: 520289 - DNA, 25 bp, Mus musculus
gattcaagcttctccttatcagagg

SEQ ID NO: 520290 - DNA, 25 bp, Mus musculus
gattcaaggctgagcgcgcagactt

SEQ ID NO: 520291 - DNA, 25 bp, Mus musculus
gattcaaggctgtgcgcgcagactt

SEQ ID NO: 520292 - DNA, 25 bp, Mus musculus
gattcaaggtctcaaagatctggat

SEQ ID NO: 520293 - DNA, 25 bp, Mus musculus
gattcaaggtctgaaagatctggat

SEQ ID NO: 520294 - DNA, 25 bp, Mus musculus
gattcaaggttcagtcagtcagtat

SEQ ID NO: 520295 - DNA, 25 bp, Mus musculus
gattcaaggttctgtcagtcagtat

SEQ ID NO: 520296 - DNA, 25 bp, Mus musculus
gattcaaggttgctcattacagtta

SEQ ID NO: 520297 - DNA, 25 bp, Mus musculus
gattcaaggttggtcattacagtta

SEQ ID NO: 520298 - DNA, 25 bp, Mus musculus
gattcaagtcagaacattaccactc

SEQ ID NO: 520299 - DNA, 25 bp, Mus musculus
gattcaagtcagtacattaccactc

SEQ ID NO: 520300 - DNA, 25 bp, Mus musculus
gattcaagttacagaagtgaatacc

SEQ ID NO: 520301 - DNA, 25 bp, Mus musculus
gattcaagttactgaagtgaatacc

SEQ ID NO: 520302 - DNA, 25 bp, Mus musculus
gattcaagttcgatacatcaaccaa

SEQ ID NO: 520303 - DNA, 25 bp, Mus musculus
gattcaagttcgttacatcaaccaa

SEQ ID NO: 520304 - DNA, 25 bp, Mus musculus
gattcaagttggctttcccgagagc

SEQ ID NO: 520305 - DNA, 25 bp, Mus musculus
gattcaagttgggtttcccgagagc

SEQ ID NO: 520306 - DNA, 25 bp, Mus musculus
gattcaagtttccatggggcctaga

SEQ ID NO: 520307 - DNA, 25 bp, Mus musculus
gattcaagtttcgatggggcctaga

SEQ ID NO: 520308 - DNA, 25 bp, Mus musculus
gattcaatacaaatttctttatagc

SEQ ID NO: 520309 - DNA, 25 bp, Mus musculus
gattcaatacaattttctttatagc

SEQ ID NO: 520310 - DNA, 25 bp, Mus musculus
gattcaataccaagtcaactccaat

SEQ ID NO: 520311 - DNA, 25 bp, Mus musculus
gattcaataccatgtcaactccaat

SEQ ID NO: 520312 - DNA, 25 bp, Mus musculus
gattcaattagactccatttgtgtg

SEQ ID NO: 520313 - DNA, 25 bp, Mus musculus
gattcaattagagtccatttgtgtg

SEQ ID NO: 520314 - DNA, 25 bp, Mus musculus
gattcacaaaaaactcatcaaagaa

SEQ ID NO: 520315 - DNA, 25 bp, Mus musculus
gattcacaaaaatctcatcaaagaa

SEQ ID NO: 520316 - DNA, 25 bp, Mus musculus
gattcacacaaccttgagactggcc

SEQ ID NO: 520317 - DNA, 25 bp, Mus musculus
gattcacacaacgttgagactggcc

SEQ ID NO: 520318 - DNA, 25 bp, Mus musculus
gattcacacattcaggtgttggaga

SEQ ID NO: 520319 - DNA, 25 bp, Mus musculus
gattcacacattgaggtgttggaga

SEQ ID NO: 520320 - DNA, 25 bp, Mus musculus
gattcacaccagagtggcggcacag

SEQ ID NO: 520321 - DNA, 25 bp, Mus musculus
gattcacaccagctctttggagtaa

SEQ ID NO: 520322 - DNA, 25 bp, Mus musculus
gattcacaccaggtctttggagtaa

SEQ ID NO: 520323 - DNA, 25 bp, Mus musculus
gattcacaccagtgtggcggcacag

SEQ ID NO: 520324 - DNA, 25 bp, Mus musculus
gattcacactgtaaatgctctaacc

SEQ ID NO: 520325 - DNA, 25 bp, Mus musculus
gattcacactgttaatgctctaacc

SEQ ID NO: 520326 - DNA, 25 bp, Mus musculus
gattcacacttaagacacttgcgtt

SEQ ID NO: 520327 - DNA, 25 bp, Mus musculus
gattcacacttatgacacttgcgtt

SEQ ID NO: 520328 - DNA, 25 bp, Mus musculus
gattcacagaaaagcccggtccttg

SEQ ID NO: 520329 - DNA, 25 bp, Mus musculus
gattcacagaaatgcccggtccttg

SEQ ID NO: 520330 - DNA, 25 bp, Mus musculus
gattcacagagacttttcataccag

SEQ ID NO: 520331 - DNA, 25 bp, Mus musculus
gattcacagagagttttcataccag

SEQ ID NO: 520332 - DNA, 25 bp, Mus musculus
gattcacagagtccatgacacgctg

SEQ ID NO: 520333 - DNA, 25 bp, Mus musculus
gattcacagagtgcatgacacgctg

SEQ ID NO: 520334 - DNA, 25 bp, Mus musculus
gattcacagccgaattgctgtcatc

SEQ ID NO: 520335 - DNA, 25 bp, Mus musculus
gattcacagccgaggaacagcagga

SEQ ID NO: 520336 - DNA, 25 bp, Mus musculus
gattcacagccgtattgctgtcatc

SEQ ID NO: 520337 - DNA, 25 bp, Mus musculus
gattcacagccgtggaacagcagga

SEQ ID NO: 520338 - DNA, 25 bp, Mus musculus
gattcacaggaacgctcgacaccgc

SEQ ID NO: 520339 - DNA, 25 bp, Mus musculus
gattcacaggaaggctcgacaccgc

SEQ ID NO: 520340 - DNA, 25 bp, Mus musculus
gattcacaggcaaggaccgtcccac

SEQ ID NO: 520341 - DNA, 25 bp, Mus musculus
gattcacaggcatggaccgtcccac

SEQ ID NO: 520342 - DNA, 25 bp, Mus musculus
gattcacagtatcgaccgattgacc

SEQ ID NO: 520343 - DNA, 25 bp, Mus musculus
gattcacagtatggaccgattgacc

SEQ ID NO: 520344 - DNA, 25 bp, Mus musculus
gattcacagtcaatattctttgttg

SEQ ID NO: 520345 - DNA, 25 bp, Mus musculus
gattcacagtcattattctttgttg

SEQ ID NO: 520346 - DNA, 25 bp, Mus musculus
gattcacagtcccagaacgaggcct

SEQ ID NO: 520347 - DNA, 25 bp, Mus musculus
gattcacagtccgagaacgaggcct

SEQ ID NO: 520348 - DNA, 25 bp, Mus musculus
gattcacagtggatgaggcctgaca

SEQ ID NO: 520349 - DNA, 25 bp, Mus musculus
gattcacagtggttgaggcctgaca

SEQ ID NO: 520350 - DNA, 25 bp, Mus musculus
gattcacagttgcttatgctggccc

SEQ ID NO: 520351 - DNA, 25 bp, Mus musculus
gattcacagttggttatgctggccc

SEQ ID NO: 520352 - DNA, 25 bp, Mus musculus
gattcacataatattttgtaggcca

SEQ ID NO: 520353 - DNA, 25 bp, Mus musculus
gattcacataattttttgtaggcca

SEQ ID NO: 520354 - DNA, 25 bp, Mus musculus
gattcacatcggaagtaaggattca

SEQ ID NO: 520355 - DNA, 25 bp, Mus musculus
gattcacatcggtagtaaggattca

SEQ ID NO: 520356 - DNA, 25 bp, Mus musculus
gattcacatctactacatttgtgtc

SEQ ID NO: 520357 - DNA, 25 bp, Mus musculus
gattcacatctagtacatttgtgtc

SEQ ID NO: 520358 - DNA, 25 bp, Mus musculus
gattcacattgtccctttatataag

SEQ ID NO: 520359 - DNA, 25 bp, Mus musculus
gattcacattgtgcctttatataag

SEQ ID NO: 520360 - DNA, 25 bp, Mus musculus
gattcacatttgactcataccagct

SEQ ID NO: 520361 - DNA, 25 bp, Mus musculus
gattcacatttgtctcataccagct

SEQ ID NO: 520362 - DNA, 25 bp, Mus musculus
gattcacattttacactacagccca

SEQ ID NO: 520363 - DNA, 25 bp, Mus musculus
gattcacattttatccatgcaaaca

SEQ ID NO: 520364 - DNA, 25 bp, Mus musculus
gattcacatttttcactacagccca

SEQ ID NO: 520365 - DNA, 25 bp, Mus musculus
gattcacattttttccatgcaaaca

SEQ ID NO: 520366 - DNA, 25 bp, Mus musculus
gattcaccaaaaacactgagcctcc

SEQ ID NO: 520367 - DNA, 25 bp, Mus musculus
gattcaccaaaatcactgagcctcc

SEQ ID NO: 520368 - DNA, 25 bp, Mus musculus
gattcaccaactatttcccatcaat

SEQ ID NO: 520369 - DNA, 25 bp, Mus musculus
gattcaccaactttttcccatcaat

SEQ ID NO: 520370 - DNA, 25 bp, Mus musculus
gattcaccactgagacctgagcaag

SEQ ID NO: 520371 - DNA, 25 bp, Mus musculus
gattcaccactgtgacctgagcaag

SEQ ID NO: 520372 - DNA, 25 bp, Mus musculus
gattcaccatacatggtgtctgtgt

SEQ ID NO: 520373 - DNA, 25 bp, Mus musculus
gattcaccatacttggtgtctgtgt

SEQ ID NO: 520374 - DNA, 25 bp, Mus musculus
gattcacccacacgcagaaagcaga

SEQ ID NO: 520375 - DNA, 25 bp, Mus musculus
gattcacccacaggcagaaagcaga

SEQ ID NO: 520376 - DNA, 25 bp, Mus musculus
gattcacccaggaggctacaggcca

SEQ ID NO: 520377 - DNA, 25 bp, Mus musculus
gattcacccaggtggctacaggcca

SEQ ID NO: 520378 - DNA, 25 bp, Mus musculus
gattcacccatcacttggattggat

SEQ ID NO: 520379 - DNA, 25 bp, Mus musculus
gattcacccatctcttggattggat

SEQ ID NO: 520380 - DNA, 25 bp, Mus musculus
gattcaccctcactgacggatgtga

SEQ ID NO: 520381 - DNA, 25 bp, Mus musculus
gattcaccctcagtgacggatgtga

SEQ ID NO: 520382 - DNA, 25 bp, Mus musculus
gattcaccgtgcctttgttgttagt

SEQ ID NO: 520383 - DNA, 25 bp, Mus musculus
gattcaccgtgcgtttgttgttagt

SEQ ID NO: 520384 - DNA, 25 bp, Mus musculus
gattcacctagcacataacatagaa

SEQ ID NO: 520385 - DNA, 25 bp, Mus musculus
gattcacctagctcataacatagaa

SEQ ID NO: 520386 - DNA, 25 bp, Mus musculus
gattcacctgagctcctacacagga

SEQ ID NO: 520387 - DNA, 25 bp, Mus musculus
gattcacctgaggtcctacacagga

SEQ ID NO: 520388 - DNA, 25 bp, Mus musculus
gattcacctgcgctaggaccagaaa

SEQ ID NO: 520389 - DNA, 25 bp, Mus musculus
gattcacctgcggtaggaccagaaa

SEQ ID NO: 520390 - DNA, 25 bp, Mus musculus
gattcacctgtgagatgttccatcc

SEQ ID NO: 520391 - DNA, 25 bp, Mus musculus
gattcacctgtgtgatgttccatcc

SEQ ID NO: 520392 - DNA, 25 bp, Mus musculus
gattcacgaactctgcggttgctaa

SEQ ID NO: 520393 - DNA, 25 bp, Mus musculus
gattcacgaactgtgcggttgctaa

SEQ ID NO: 520394 - DNA, 25 bp, Mus musculus
gattcacgccgactggccttgagca

SEQ ID NO: 520395 - DNA, 25 bp, Mus musculus
gattcacgccgagtggccttgagca

SEQ ID NO: 520396 - DNA, 25 bp, Mus musculus
gattcacggagcatctgcagagctg

SEQ ID NO: 520397 - DNA, 25 bp, Mus musculus
gattcacggagcttctgcagagctg

SEQ ID NO: 520398 - DNA, 25 bp, Mus musculus
gattcacggtaactacttgtatttt

SEQ ID NO: 520399 - DNA, 25 bp, Mus musculus
gattcacggtaagtacttgtatttt

SEQ ID NO: 520400 - DNA, 25 bp, Mus musculus
gattcacgtgtgacccagagaccat

SEQ ID NO: 520401 - DNA, 25 bp, Mus musculus
gattcacgtgtgtcccagagaccat

SEQ ID NO: 520402 - DNA, 25 bp, Mus musculus
gattcactacctattcggaagcttg

SEQ ID NO: 520403 - DNA, 25 bp, Mus musculus
gattcactaccttttcggaagcttg

SEQ ID NO: 520404 - DNA, 25 bp, Mus musculus
gattcactcactaatctctatagtt

SEQ ID NO: 520405 - DNA, 25 bp, Mus musculus
gattcactcacttatctctatagtt

SEQ ID NO: 520406 - DNA, 25 bp, Mus musculus
gattcactcagacacctgtctgaag

SEQ ID NO: 520407 - DNA, 25 bp, Mus musculus
gattcactcagagacctgtctgaag

SEQ ID NO: 520408 - DNA, 25 bp, Mus musculus
gattcactcataattccgtggtagt

SEQ ID NO: 520409 - DNA, 25 bp, Mus musculus
gattcactcatatttccgtggtagt

SEQ ID NO: 520410 - DNA, 25 bp, Mus musculus
gattcactcctcattccagtcagtt

SEQ ID NO: 520411 - DNA, 25 bp, Mus musculus
gattcactcctcattgtggaaacta

SEQ ID NO: 520412 - DNA, 25 bp, Mus musculus
gattcactcctctttccagtcagtt

SEQ ID NO: 520413 - DNA, 25 bp, Mus musculus
gattcactcctctttgtggaaacta

SEQ ID NO: 520414 - DNA, 25 bp, Mus musculus
gattcactcgttcgttcataaaggt

SEQ ID NO: 520415 - DNA, 25 bp, Mus musculus
gattcactcgttggttcataaaggt

SEQ ID NO: 520416 - DNA, 25 bp, Mus musculus
gattcactctatcagctgtcactca

SEQ ID NO: 520417 - DNA, 25 bp, Mus musculus
gattcactctatgagctgtcactca

SEQ ID NO: 520418 - DNA, 25 bp, Mus musculus
gattcactcttcaaacatacttttt

SEQ ID NO: 520419 - DNA, 25 bp, Mus musculus
gattcactcttccatcctaatgaaa

SEQ ID NO: 520420 - DNA, 25 bp, Mus musculus
gattcactcttcgatcctaatgaaa

SEQ ID NO: 520421 - DNA, 25 bp, Mus musculus
gattcactcttctaacatacttttt

SEQ ID NO: 520422 - DNA, 25 bp, Mus musculus
gattcactgatcaccccaaagaaga

SEQ ID NO: 520423 - DNA, 25 bp, Mus musculus
gattcactgatctccccaaagaaga

SEQ ID NO: 520424 - DNA, 25 bp, Mus musculus
gattcactggaaaatgctggattct

SEQ ID NO: 520425 - DNA, 25 bp, Mus musculus
gattcactggaatatgctggattct

SEQ ID NO: 520426 - DNA, 25 bp, Mus musculus
gattcactggagaattaagtctgat

SEQ ID NO: 520427 - DNA, 25 bp, Mus musculus
gattcactggagtattaagtctgat

SEQ ID NO: 520428 - DNA, 25 bp, Mus musculus
gattcactgggaacattcaggacaa

SEQ ID NO: 520429 - DNA, 25 bp, Mus musculus
gattcactgggatcattcaggacaa

SEQ ID NO: 520430 - DNA, 25 bp, Mus musculus
gattcactgggtcctaaagccttgg

SEQ ID NO: 520431 - DNA, 25 bp, Mus musculus
gattcactgggtgctaaagccttgg

SEQ ID NO: 520432 - DNA, 25 bp, Mus musculus
gattcactgttacatctttcttata

SEQ ID NO: 520433 - DNA, 25 bp, Mus musculus
gattcactgttagatctttcttata

SEQ ID NO: 520434 - DNA, 25 bp, Mus musculus
gattcactgttgcttcttacagggt

SEQ ID NO: 520435 - DNA, 25 bp, Mus musculus
gattcactgttggttcttacagggt

SEQ ID NO: 520436 - DNA, 25 bp, Mus musculus
gattcacttaaaacagcagtctgaa

SEQ ID NO: 520437 - DNA, 25 bp, Mus musculus
gattcacttaaatcagcagtctgaa

SEQ ID NO: 520438 - DNA, 25 bp, Mus musculus
gattcacttctccagggatttttta

SEQ ID NO: 520439 - DNA, 25 bp, Mus musculus
gattcacttctcgagggatttttta

SEQ ID NO: 520440 - DNA, 25 bp, Mus musculus
gattcactttctcaacagtggccag

SEQ ID NO: 520441 - DNA, 25 bp, Mus musculus
gattcactttctgaacagtggccag

SEQ ID NO: 520442 - DNA, 25 bp, Mus musculus
gattcagaaaacctgtcagccaaag

SEQ ID NO: 520443 - DNA, 25 bp, Mus musculus
gattcagaaaacgtgtcagccaaag

SEQ ID NO: 520444 - DNA, 25 bp, Mus musculus
gattcagaaaccacactggtgctag

SEQ ID NO: 520445 - DNA, 25 bp, Mus musculus
gattcagaaacctcactggtgctag

SEQ ID NO: 520446 - DNA, 25 bp, Mus musculus
gattcagaaactcgatgaccttcac

SEQ ID NO: 520447 - DNA, 25 bp, Mus musculus
gattcagaaactggatgaccttcac

SEQ ID NO: 520448 - DNA, 25 bp, Mus musculus
gattcagaaatcacatcggatcagt

SEQ ID NO: 520449 - DNA, 25 bp, Mus musculus
gattcagaaatctcatcggatcagt

SEQ ID NO: 520450 - DNA, 25 bp, Mus musculus
gattcagaacacaaacattgacaat

SEQ ID NO: 520451 - DNA, 25 bp, Mus musculus
gattcagaacactaacattgacaat

SEQ ID NO: 520452 - DNA, 25 bp, Mus musculus
gattcagaacctcttacatggaaag

SEQ ID NO: 520453 - DNA, 25 bp, Mus musculus
gattcagaacctgttacatggaaag

SEQ ID NO: 520454 - DNA, 25 bp, Mus musculus
gattcagaacgtcttattcctccca

SEQ ID NO: 520455 - DNA, 25 bp, Mus musculus
gattcagaacgtgttattcctccca

SEQ ID NO: 520456 - DNA, 25 bp, Mus musculus
gattcagaatccatctcttcgtgaa

SEQ ID NO: 520457 - DNA, 25 bp, Mus musculus
gattcagaatccttctcttcgtgaa

SEQ ID NO: 520458 - DNA, 25 bp, Mus musculus
gattcagaatgcctccaccatttag

SEQ ID NO: 520459 - DNA, 25 bp, Mus musculus
gattcagaatgcgtccaccatttag

SEQ ID NO: 520460 - DNA, 25 bp, Mus musculus
gattcagaatggagctgccaccagc

SEQ ID NO: 520461 - DNA, 25 bp, Mus musculus
gattcagaatggtgctgccaccagc

SEQ ID NO: 520462 - DNA, 25 bp, Mus musculus
gattcagacagaatcacagccttca

SEQ ID NO: 520463 - DNA, 25 bp, Mus musculus
gattcagacagattcacagccttca

SEQ ID NO: 520464 - DNA, 25 bp, Mus musculus
gattcagacagtctttctgtaaaac

SEQ ID NO: 520465 - DNA, 25 bp, Mus musculus
gattcagacagtgtttctgtaaaac

SEQ ID NO: 520466 - DNA, 25 bp, Mus musculus
gattcagacatcacattatctacct

SEQ ID NO: 520467 - DNA, 25 bp, Mus musculus
gattcagacatctcattatctacct

SEQ ID NO: 520468 - DNA, 25 bp, Mus musculus
gattcagaccagctccatcaagcaa

SEQ ID NO: 520469 - DNA, 25 bp, Mus musculus
gattcagaccaggtccatcaagcaa

SEQ ID NO: 520470 - DNA, 25 bp, Mus musculus
gattcagaccctcaagtgctcactg

SEQ ID NO: 520471 - DNA, 25 bp, Mus musculus
gattcagaccctgaagtgctcactg

SEQ ID NO: 520472 - DNA, 25 bp, Mus musculus
gattcagacctgctgtgtggaccgc

SEQ ID NO: 520473 - DNA, 25 bp, Mus musculus
gattcagacctggtgtgtggaccgc

SEQ ID NO: 520474 - DNA, 25 bp, Mus musculus
gattcagactcaaccaatatacatg

SEQ ID NO: 520475 - DNA, 25 bp, Mus musculus
gattcagactcatccaatatacatg

SEQ ID NO: 520476 - DNA, 25 bp, Mus musculus
gattcagactccagaggagttcctt

SEQ ID NO: 520477 - DNA, 25 bp, Mus musculus
gattcagactcctgaggagttcctt

SEQ ID NO: 520478 - DNA, 25 bp, Mus musculus
gattcagactttctctccaaatgtg

SEQ ID NO: 520479 - DNA, 25 bp, Mus musculus
gattcagactttgtctccaaatgtg

SEQ ID NO: 520480 - DNA, 25 bp, Mus musculus
gattcagagactacgggtagaacat

SEQ ID NO: 520481 - DNA, 25 bp, Mus musculus
gattcagagacttcgggtagaacat

SEQ ID NO: 520482 - DNA, 25 bp, Mus musculus
gattcagagagacacaggcccagga

SEQ ID NO: 520483 - DNA, 25 bp, Mus musculus
gattcagagagactacctttccacg

SEQ ID NO: 520484 - DNA, 25 bp, Mus musculus
gattcagagagagacaggcccagga

SEQ ID NO: 520485 - DNA, 25 bp, Mus musculus
gattcagagagagtacctttccacg

SEQ ID NO: 520486 - DNA, 25 bp, Mus musculus
gattcagagcttctcatgccagtac

SEQ ID NO: 520487 - DNA, 25 bp, Mus musculus
gattcagagcttgtcatgccagtac

SEQ ID NO: 520488 - DNA, 25 bp, Mus musculus
gattcagaggcaagtccttgttgta

SEQ ID NO: 520489 - DNA, 25 bp, Mus musculus
gattcagaggcatgtccttgttgta

SEQ ID NO: 520490 - DNA, 25 bp, Mus musculus
gattcagaggcccataatagccacg

SEQ ID NO: 520491 - DNA, 25 bp, Mus musculus
gattcagaggccgataatagccacg

SEQ ID NO: 520492 - DNA, 25 bp, Mus musculus
gattcagagttgaccagaagctcaa

SEQ ID NO: 520493 - DNA, 25 bp, Mus musculus
gattcagagttgcttcctgatctgc

SEQ ID NO: 520494 - DNA, 25 bp, Mus musculus
gattcagagttggttcctgatctgc

SEQ ID NO: 520495 - DNA, 25 bp, Mus musculus
gattcagagttgtccagaagctcaa

SEQ ID NO: 520496 - DNA, 25 bp, Mus musculus
gattcagataacatgcatattttca

SEQ ID NO: 520497 - DNA, 25 bp, Mus musculus
gattcagataacttgcatattttca

SEQ ID NO: 520498 - DNA, 25 bp, Mus musculus
gattcagatacactaactttccata

SEQ ID NO: 520499 - DNA, 25 bp, Mus musculus
gattcagatacagtaactttccata

SEQ ID NO: 520500 - DNA, 25 bp, Mus musculus
gattcagattttcagtaactcggta

SEQ ID NO: 520501 - DNA, 25 bp, Mus musculus
gattcagattttgagtaactcggta

SEQ ID NO: 520502 - DNA, 25 bp, Mus musculus
gattcagcaacgagaagcctcagaa

SEQ ID NO: 520503 - DNA, 25 bp, Mus musculus
gattcagcaacgtgaagcctcagaa

SEQ ID NO: 520504 - DNA, 25 bp, Mus musculus
gattcagcactaaacccagtgagca

SEQ ID NO: 520505 - DNA, 25 bp, Mus musculus
gattcagcactatacccagtgagca

SEQ ID NO: 520506 - DNA, 25 bp, Mus musculus
gattcagcagcaagttccaggtgct

SEQ ID NO: 520507 - DNA, 25 bp, Mus musculus
gattcagcagcatgttccaggtgct

SEQ ID NO: 520508 - DNA, 25 bp, Mus musculus
gattcagcatgaagtgggtgcaata

SEQ ID NO: 520509 - DNA, 25 bp, Mus musculus
gattcagcatgatgtgggtgcaata

SEQ ID NO: 520510 - DNA, 25 bp, Mus musculus
gattcagcattaactgtcagtttta

SEQ ID NO: 520511 - DNA, 25 bp, Mus musculus
gattcagcattatctgtcagtttta

SEQ ID NO: 520512 - DNA, 25 bp, Mus musculus
gattcagcattcagcaatggtcact

SEQ ID NO: 520513 - DNA, 25 bp, Mus musculus
gattcagcattctgcaatggtcact

SEQ ID NO: 520514 - DNA, 25 bp, Mus musculus
gattcagccggcacatttccaaggg

SEQ ID NO: 520515 - DNA, 25 bp, Mus musculus
gattcagccggcatgaagactttgc

SEQ ID NO: 520516 - DNA, 25 bp, Mus musculus
gattcagccggctcatttccaaggg

SEQ ID NO: 520517 - DNA, 25 bp, Mus musculus
gattcagccggcttgaagactttgc

SEQ ID NO: 520518 - DNA, 25 bp, Mus musculus
gattcagcctaaatgagaggagtgt

SEQ ID NO: 520519 - DNA, 25 bp, Mus musculus
gattcagcctaattgagaggagtgt

SEQ ID NO: 520520 - DNA, 25 bp, Mus musculus
gattcagcctagaagttacttcccc

SEQ ID NO: 520521 - DNA, 25 bp, Mus musculus
gattcagcctagtagttacttcccc

SEQ ID NO: 520522 - DNA, 25 bp, Mus musculus
gattcagcctgaatgcagacgtccc

SEQ ID NO: 520523 - DNA, 25 bp, Mus musculus
gattcagcctgattgcagacgtccc

SEQ ID NO: 520524 - DNA, 25 bp, Mus musculus
gattcagcgctgagaaattgtaact

SEQ ID NO: 520525 - DNA, 25 bp, Mus musculus
gattcagcgctgtgaaattgtaact

SEQ ID NO: 520526 - DNA, 25 bp, Mus musculus
gattcagctgttattgatgtttctt

SEQ ID NO: 520527 - DNA, 25 bp, Mus musculus
gattcagctgtttttgatgtttctt

SEQ ID NO: 520528 - DNA, 25 bp, Mus musculus
gattcaggaacaccaataggcattt

SEQ ID NO: 520529 - DNA, 25 bp, Mus musculus
gattcaggaacagcaataggcattt

SEQ ID NO: 520530 - DNA, 25 bp, Mus musculus
gattcaggaccaccagtaactcaag

SEQ ID NO: 520531 - DNA, 25 bp, Mus musculus
gattcaggaccagcagtaactcaag

SEQ ID NO: 520532 - DNA, 25 bp, Mus musculus
gattcaggagacaatgtcagaagca

SEQ ID NO: 520533 - DNA, 25 bp, Mus musculus
gattcaggagactatgtcagaagca

SEQ ID NO: 520534 - DNA, 25 bp, Mus musculus
gattcaggagatcaaccacaatgtt

SEQ ID NO: 520535 - DNA, 25 bp, Mus musculus
gattcaggagatgaaccacaatgtt

SEQ ID NO: 520536 - DNA, 25 bp, Mus musculus
gattcaggagccacgatgcggatta

SEQ ID NO: 520537 - DNA, 25 bp, Mus musculus
gattcaggagcctcgatgcggatta

SEQ ID NO: 520538 - DNA, 25 bp, Mus musculus
gattcaggagctatcatggaacact

SEQ ID NO: 520539 - DNA, 25 bp, Mus musculus
gattcaggagctttcatggaacact

SEQ ID NO: 520540 - DNA, 25 bp, Mus musculus
gattcaggatccacttgtaccattt

SEQ ID NO: 520541 - DNA, 25 bp, Mus musculus
gattcaggatcctcttgtaccattt

SEQ ID NO: 520542 - DNA, 25 bp, Mus musculus
gattcaggcaccatgacatgtgaca

SEQ ID NO: 520543 - DNA, 25 bp, Mus musculus
gattcaggcaccttgacatgtgaca

SEQ ID NO: 520544 - DNA, 25 bp, Mus musculus
gattcaggcactatcaagatcatag

SEQ ID NO: 520545 - DNA, 25 bp, Mus musculus
gattcaggcactttcaagatcatag

SEQ ID NO: 520546 - DNA, 25 bp, Mus musculus
gattcaggcatccagaggtttgaat

SEQ ID NO: 520547 - DNA, 25 bp, Mus musculus
gattcaggcatcgagaggtttgaat

SEQ ID NO: 520548 - DNA, 25 bp, Mus musculus
gattcaggcatgctgtttccctact

SEQ ID NO: 520549 - DNA, 25 bp, Mus musculus
gattcaggcatggtgtttccctact

SEQ ID NO: 520550 - DNA, 25 bp, Mus musculus
gattcaggctcaaggtgacacctac

SEQ ID NO: 520551 - DNA, 25 bp, Mus musculus
gattcaggctcatggtgacacctac

SEQ ID NO: 520552 - DNA, 25 bp, Mus musculus
gattcaggctctatattgtgccaga

SEQ ID NO: 520553 - DNA, 25 bp, Mus musculus
gattcaggctctttattgtgccaga

SEQ ID NO: 520554 - DNA, 25 bp, Mus musculus
gattcagggatcagtttacttcata

SEQ ID NO: 520555 - DNA, 25 bp, Mus musculus
gattcagggatctgtttacttcata

SEQ ID NO: 520556 - DNA, 25 bp, Mus musculus
gattcagggattagggatccaggaa

SEQ ID NO: 520557 - DNA, 25 bp, Mus musculus
gattcagggatttgggatccaggaa

SEQ ID NO: 520558 - DNA, 25 bp, Mus musculus
gattcagggccaaaatttcttcaga

SEQ ID NO: 520559 - DNA, 25 bp, Mus musculus
gattcagggccataatttcttcaga

SEQ ID NO: 520560 - DNA, 25 bp, Mus musculus
gattcagggcgaacctttaaagagt

SEQ ID NO: 520561 - DNA, 25 bp, Mus musculus
gattcagggcgatcctttaaagagt

SEQ ID NO: 520562 - DNA, 25 bp, Mus musculus
gattcagggctccaatttgctacca

SEQ ID NO: 520563 - DNA, 25 bp, Mus musculus
gattcagggctcgaatttgctacca

SEQ ID NO: 520564 - DNA, 25 bp, Mus musculus
gattcagggtagcttgtcttcccct

SEQ ID NO: 520565 - DNA, 25 bp, Mus musculus
gattcagggtaggttgtcttcccct

SEQ ID NO: 520566 - DNA, 25 bp, Mus musculus
gattcagggttgataagactcctca

SEQ ID NO: 520567 - DNA, 25 bp, Mus musculus
gattcagggttgttaagactcctca

SEQ ID NO: 520568 - DNA, 25 bp, Mus musculus
gattcaggtatgatgccttcacggt

SEQ ID NO: 520569 - DNA, 25 bp, Mus musculus
gattcaggtatgttgccttcacggt

SEQ ID NO: 520570 - DNA, 25 bp, Mus musculus
gattcaggtcacctatgactgcagt

SEQ ID NO: 520571 - DNA, 25 bp, Mus musculus
gattcaggtcacgtatgactgcagt

SEQ ID NO: 520572 - DNA, 25 bp, Mus musculus
gattcaggtgctaaacatatcattt

SEQ ID NO: 520573 - DNA, 25 bp, Mus musculus
gattcaggtgcttaacatatcattt

SEQ ID NO: 520574 - DNA, 25 bp, Mus musculus
gattcaggtggacaatttggttaaa

SEQ ID NO: 520575 - DNA, 25 bp, Mus musculus
gattcaggtggagaatttggttaaa

SEQ ID NO: 520576 - DNA, 25 bp, Mus musculus
gattcaggtgtaactggtagctcct

SEQ ID NO: 520577 - DNA, 25 bp, Mus musculus
gattcaggtgtatctggtagctcct

SEQ ID NO: 520578 - DNA, 25 bp, Mus musculus
gattcaggtttgatactttaccatt

SEQ ID NO: 520579 - DNA, 25 bp, Mus musculus
gattcaggtttgttactttaccatt

SEQ ID NO: 520580 - DNA, 25 bp, Mus musculus
gattcagtagcacatgccgttcaaa

SEQ ID NO: 520581 - DNA, 25 bp, Mus musculus
gattcagtagcagatgccgttcaaa

SEQ ID NO: 520582 - DNA, 25 bp, Mus musculus
gattcagtagccacagtccaaagtc

SEQ ID NO: 520583 - DNA, 25 bp, Mus musculus
gattcagtagcctcagtccaaagtc

SEQ ID NO: 520584 - DNA, 25 bp, Mus musculus
gattcagtctacaggccatgtgact

SEQ ID NO: 520585 - DNA, 25 bp, Mus musculus
gattcagtctactggccatgtgact

SEQ ID NO: 520586 - DNA, 25 bp, Mus musculus
gattcagtctctaacaacgtgtgca

SEQ ID NO: 520587 - DNA, 25 bp, Mus musculus
gattcagtctcttacaacgtgtgca

SEQ ID NO: 520588 - DNA, 25 bp, Mus musculus
gattcagtgacaacacagaacctgg

SEQ ID NO: 520589 - DNA, 25 bp, Mus musculus
gattcagtgacatcacagaacctgg

SEQ ID NO: 520590 - DNA, 25 bp, Mus musculus
gattcagtgcagagctggtcaaact

SEQ ID NO: 520591 - DNA, 25 bp, Mus musculus
gattcagtgcagtgctggtcaaact

SEQ ID NO: 520592 - DNA, 25 bp, Mus musculus
gattcagtggccacttggtctccac

SEQ ID NO: 520593 - DNA, 25 bp, Mus musculus
gattcagtggcctcttggtctccac

SEQ ID NO: 520594 - DNA, 25 bp, Mus musculus
gattcagtgggtactactttaactt

SEQ ID NO: 520595 - DNA, 25 bp, Mus musculus
gattcagtgggttctactttaactt

SEQ ID NO: 520596 - DNA, 25 bp, Mus musculus
gattcagtgtgaagtaggtcctccc

SEQ ID NO: 520597 - DNA, 25 bp, Mus musculus
gattcagtgtgatgtaggtcctccc

SEQ ID NO: 520598 - DNA, 25 bp, Mus musculus
gattcagtgttgagctggcctctca

SEQ ID NO: 520599 - DNA, 25 bp, Mus musculus
gattcagtgttgtgctggcctctca

SEQ ID NO: 520600 - DNA, 25 bp, Mus musculus
gattcagttccaaagtcactgtaac

SEQ ID NO: 520601 - DNA, 25 bp, Mus musculus
gattcagttccatagtcactgtaac

SEQ ID NO: 520602 - DNA, 25 bp, Mus musculus
gattcagttctcagtaccctaacta

SEQ ID NO: 520603 - DNA, 25 bp, Mus musculus
gattcagttctctgtaccctaacta

SEQ ID NO: 520604 - DNA, 25 bp, Mus musculus
gattcagttggtctgtggacagaaa

SEQ ID NO: 520605 - DNA, 25 bp, Mus musculus
gattcagttggtgtgtggacagaaa

SEQ ID NO: 520606 - DNA, 25 bp, Mus musculus
gattcagttgtaatagccctctgca

SEQ ID NO: 520607 - DNA, 25 bp, Mus musculus
gattcagttgtattagccctctgca

SEQ ID NO: 520608 - DNA, 25 bp, Mus musculus
gattcataaccaattttcccattct

SEQ ID NO: 520609 - DNA, 25 bp, Mus musculus
gattcataaccatttttcccattct

SEQ ID NO: 520610 - DNA, 25 bp, Mus musculus
gattcataccaaaatatggccaact

SEQ ID NO: 520611 - DNA, 25 bp, Mus musculus
gattcataccaatatatggccaact

SEQ ID NO: 520612 - DNA, 25 bp, Mus musculus
gattcatacctgagcatgaaaatac

SEQ ID NO: 520613 - DNA, 25 bp, Mus musculus
gattcatacctgtgcatgaaaatac

SEQ ID NO: 520614 - DNA, 25 bp, Mus musculus
gattcatacgtgattctgcgagtga

SEQ ID NO: 520615 - DNA, 25 bp, Mus musculus
gattcatacgtgtttctgcgagtga

SEQ ID NO: 520616 - DNA, 25 bp, Mus musculus
gattcatagacacgaaaggccaaca

SEQ ID NO: 520617 - DNA, 25 bp, Mus musculus
gattcatagacaggaaaggccaaca

SEQ ID NO: 520618 - DNA, 25 bp, Mus musculus
gattcatagagcaggtcgcgctgct

SEQ ID NO: 520619 - DNA, 25 bp, Mus musculus
gattcatagagctggtcgcgctgct

SEQ ID NO: 520620 - DNA, 25 bp, Mus musculus
gattcatagagtaccgggcctggga

SEQ ID NO: 520621 - DNA, 25 bp, Mus musculus
gattcatagagttccgggcctggga

SEQ ID NO: 520622 - DNA, 25 bp, Mus musculus
gattcatagtgtcaatccgagttga

SEQ ID NO: 520623 - DNA, 25 bp, Mus musculus
gattcatagtgtgaatccgagttga

SEQ ID NO: 520624 - DNA, 25 bp, Mus musculus
gattcatataaacaaccacgctaga

SEQ ID NO: 520625 - DNA, 25 bp, Mus musculus
gattcatataaagaaccacgctaga

SEQ ID NO: 520626 - DNA, 25 bp, Mus musculus
gattcatataggattggccccagga

SEQ ID NO: 520627 - DNA, 25 bp, Mus musculus
gattcatataggtttggccccagga

SEQ ID NO: 520628 - DNA, 25 bp, Mus musculus
gattcatattatccctcagggacat

SEQ ID NO: 520629 - DNA, 25 bp, Mus musculus
gattcatattatgcctcagggacat

SEQ ID NO: 520630 - DNA, 25 bp, Mus musculus
gattcatcaatcagagcgactgctc

SEQ ID NO: 520631 - DNA, 25 bp, Mus musculus
gattcatcaatctgagcgactgctc

SEQ ID NO: 520632 - DNA, 25 bp, Mus musculus
gattcatcacctagatttgtctgga

SEQ ID NO: 520633 - DNA, 25 bp, Mus musculus
gattcatcaccttgatttgtctgga

SEQ ID NO: 520634 - DNA, 25 bp, Mus musculus
gattcatcattaaccaaagagccag

SEQ ID NO: 520635 - DNA, 25 bp, Mus musculus
gattcatcattatccaaagagccag

SEQ ID NO: 520636 - DNA, 25 bp, Mus musculus
gattcatcccccacaagtagccgag

SEQ ID NO: 520637 - DNA, 25 bp, Mus musculus
gattcatccccctcaagtagccgag

SEQ ID NO: 520638 - DNA, 25 bp, Mus musculus
gattcatccctcaagcgcattctaa

SEQ ID NO: 520639 - DNA, 25 bp, Mus musculus
gattcatccctctagcgcattctaa

SEQ ID NO: 520640 - DNA, 25 bp, Mus musculus
gattcatcctttacacatggctgaa

SEQ ID NO: 520641 - DNA, 25 bp, Mus musculus
gattcatccttttcacatggctgaa

SEQ ID NO: 520642 - DNA, 25 bp, Mus musculus
gattcatcggttcagattaaacaag

SEQ ID NO: 520643 - DNA, 25 bp, Mus musculus
gattcatcggttgagattaaacaag

SEQ ID NO: 520644 - DNA, 25 bp, Mus musculus
gattcatcgtgtagttcttcccaat

SEQ ID NO: 520645 - DNA, 25 bp, Mus musculus
gattcatcgtgttgttcttcccaat

SEQ ID NO: 520646 - DNA, 25 bp, Mus musculus
gattcatctattaactcttaccact

SEQ ID NO: 520647 - DNA, 25 bp, Mus musculus
gattcatctatttactcttaccact

SEQ ID NO: 520648 - DNA, 25 bp, Mus musculus
gattcatctctgattgctcaattgg

SEQ ID NO: 520649 - DNA, 25 bp, Mus musculus
gattcatctctgtttgctcaattgg

SEQ ID NO: 520650 - DNA, 25 bp, Mus musculus
gattcatcttgaatacactagggaa

SEQ ID NO: 520651 - DNA, 25 bp, Mus musculus
gattcatcttgattacactagggaa

SEQ ID NO: 520652 - DNA, 25 bp, Mus musculus
gattcatgaagcatgtgcgtccttt

SEQ ID NO: 520653 - DNA, 25 bp, Mus musculus
gattcatgaagccacgggcatgcct

SEQ ID NO: 520654 - DNA, 25 bp, Mus musculus
gattcatgaagcgacgggcatgcct

SEQ ID NO: 520655 - DNA, 25 bp, Mus musculus
gattcatgaagcttgtgcgtccttt

SEQ ID NO: 520656 - DNA, 25 bp, Mus musculus
gattcatgaatgccccttagcattt

SEQ ID NO: 520657 - DNA, 25 bp, Mus musculus
gattcatgaatggcccttagcattt

SEQ ID NO: 520658 - DNA, 25 bp, Mus musculus
gattcatgaattcgaagccaggtgg

SEQ ID NO: 520659 - DNA, 25 bp, Mus musculus
gattcatgaattggaagccaggtgg

SEQ ID NO: 520660 - DNA, 25 bp, Mus musculus
gattcatgctagattcttgtctatt

SEQ ID NO: 520661 - DNA, 25 bp, Mus musculus
gattcatgctagtttcttgtctatt

SEQ ID NO: 520662 - DNA, 25 bp, Mus musculus
gattcatggaatcttcagactccaa

SEQ ID NO: 520663 - DNA, 25 bp, Mus musculus
gattcatggaatgttcagactccaa

SEQ ID NO: 520664 - DNA, 25 bp, Mus musculus
gattcatgggccacccaacaaagga

SEQ ID NO: 520665 - DNA, 25 bp, Mus musculus
gattcatgggcctcccaacaaagga

SEQ ID NO: 520666 - DNA, 25 bp, Mus musculus
gattcatggtttaaagcttggccca

SEQ ID NO: 520667 - DNA, 25 bp, Mus musculus
gattcatggttttaagcttggccca

SEQ ID NO: 520668 - DNA, 25 bp, Mus musculus
gattcatgtacactttgaacacaca

SEQ ID NO: 520669 - DNA, 25 bp, Mus musculus
gattcatgtacagtttgaacacaca

SEQ ID NO: 520670 - DNA, 25 bp, Mus musculus
gattcatgtaggaattggtgttttc

SEQ ID NO: 520671 - DNA, 25 bp, Mus musculus
gattcatgtaggtattggtgttttc

SEQ ID NO: 520672 - DNA, 25 bp, Mus musculus
gattcatgtctacatttgctttaca

SEQ ID NO: 520673 - DNA, 25 bp, Mus musculus
gattcatgtctagatttgctttaca

SEQ ID NO: 520674 - DNA, 25 bp, Mus musculus
gattcatgtctcagaagcaggcctg

SEQ ID NO: 520675 - DNA, 25 bp, Mus musculus
gattcatgtctctgaagcaggcctg

SEQ ID NO: 520676 - DNA, 25 bp, Mus musculus
gattcatgtggcaaaccatccttaa

SEQ ID NO: 520677 - DNA, 25 bp, Mus musculus
gattcatgtggctaaccatccttaa

SEQ ID NO: 520678 - DNA, 25 bp, Mus musculus
gattcatgtgtcctggaacgtcgct

SEQ ID NO: 520679 - DNA, 25 bp, Mus musculus
gattcatgtgtcgtggaacgtcgct

SEQ ID NO: 520680 - DNA, 25 bp, Mus musculus
gattcatgttcaaagtctgtgagtt

SEQ ID NO: 520681 - DNA, 25 bp, Mus musculus
gattcatgttcatagtctgtgagtt

SEQ ID NO: 520682 - DNA, 25 bp, Mus musculus
gattcattagggattattgcagctg

SEQ ID NO: 520683 - DNA, 25 bp, Mus musculus
gattcattagggtttattgcagctg

SEQ ID NO: 520684 - DNA, 25 bp, Mus musculus
gattcattcaatctgcgatttctga

SEQ ID NO: 520685 - DNA, 25 bp, Mus musculus
gattcattcaatgtgcgatttctga

SEQ ID NO: 520686 - DNA, 25 bp, Mus musculus
gattcattcagtcctcatttttctt

SEQ ID NO: 520687 - DNA, 25 bp, Mus musculus
gattcattcagtgctcatttttctt

SEQ ID NO: 520688 - DNA, 25 bp, Mus musculus
gattcattcatgctcacctgatcag

SEQ ID NO: 520689 - DNA, 25 bp, Mus musculus
gattcattcatggtcacctgatcag

SEQ ID NO: 520690 - DNA, 25 bp, Mus musculus
gattcattcattattctggtcctgc

SEQ ID NO: 520691 - DNA, 25 bp, Mus musculus
gattcattcatttttctggtcctgc

SEQ ID NO: 520692 - DNA, 25 bp, Mus musculus
gattcattccggaaagtcacctgct

SEQ ID NO: 520693 - DNA, 25 bp, Mus musculus
gattcattccggtaagtcacctgct

SEQ ID NO: 520694 - DNA, 25 bp, Mus musculus
gattcattcggtcctagaattagtt

SEQ ID NO: 520695 - DNA, 25 bp, Mus musculus
gattcattcggtgctagaattagtt

SEQ ID NO: 520696 - DNA, 25 bp, Mus musculus
gattcattctacattctcttaaata

SEQ ID NO: 520697 - DNA, 25 bp, Mus musculus
gattcattctactttctcttaaata

SEQ ID NO: 520698 - DNA, 25 bp, Mus musculus
gattcattctatcttccttcaggta

SEQ ID NO: 520699 - DNA, 25 bp, Mus musculus
gattcattctatgttccttcaggta

SEQ ID NO: 520700 - DNA, 25 bp, Mus musculus
gattcattctccataaatgttcttt

SEQ ID NO: 520701 - DNA, 25 bp, Mus musculus
gattcattctccttaaatgttcttt

SEQ ID NO: 520702 - DNA, 25 bp, Mus musculus
gattcattctctccagtatgggaca

SEQ ID NO: 520703 - DNA, 25 bp, Mus musculus
gattcattctctgcagtatgggaca

SEQ ID NO: 520704 - DNA, 25 bp, Mus musculus
gattcattgaatccagtttcagcaa

SEQ ID NO: 520705 - DNA, 25 bp, Mus musculus
gattcattgaatgcagtttcagcaa

SEQ ID NO: 520706 - DNA, 25 bp, Mus musculus
gattcattgtttccctctaggactt

SEQ ID NO: 520707 - DNA, 25 bp, Mus musculus
gattcattgtttgcctctaggactt

SEQ ID NO: 520708 - DNA, 25 bp, Mus musculus
gattcatttatgcatttcacagagg

SEQ ID NO: 520709 - DNA, 25 bp, Mus musculus
gattcatttatggatttcacagagg

SEQ ID NO: 520710 - DNA, 25 bp, Mus musculus
gattcatttctgatgcacatagcag

SEQ ID NO: 520711 - DNA, 25 bp, Mus musculus
gattcatttctgttgcacatagcag

SEQ ID NO: 520712 - DNA, 25 bp, Mus musculus
gattcatttgaacctgcttaattac

SEQ ID NO: 520713 - DNA, 25 bp, Mus musculus
gattcatttgaagctgcttaattac

SEQ ID NO: 520714 - DNA, 25 bp, Mus musculus
gattccaaaattcatgcctcaacag

SEQ ID NO: 520715 - DNA, 25 bp, Mus musculus
gattccaaaattgatgcctcaacag

SEQ ID NO: 520716 - DNA, 25 bp, Mus musculus
gattccaaagccatcatgcgttact

SEQ ID NO: 520717 - DNA, 25 bp, Mus musculus
gattccaaagccttcatgcgttact

SEQ ID NO: 520718 - DNA, 25 bp, Mus musculus
gattccaaaggaaagtacagtgaca

SEQ ID NO: 520719 - DNA, 25 bp, Mus musculus
gattccaaaggatagtacagtgaca

SEQ ID NO: 520720 - DNA, 25 bp, Mus musculus
gattccaaatagatgcacccagttg

SEQ ID NO: 520721 - DNA, 25 bp, Mus musculus
gattccaaatagatttccacacccg

SEQ ID NO: 520722 - DNA, 25 bp, Mus musculus
gattccaaatagttgcacccagttg

SEQ ID NO: 520723 - DNA, 25 bp, Mus musculus
gattccaaatagttttccacacccg

SEQ ID NO: 520724 - DNA, 25 bp, Mus musculus
gattccaacccgctgggcaggaaaa

SEQ ID NO: 520725 - DNA, 25 bp, Mus musculus
gattccaacccggtgggcaggaaaa

SEQ ID NO: 520726 - DNA, 25 bp, Mus musculus
gattccaacgtgagctaacggctgc

SEQ ID NO: 520727 - DNA, 25 bp, Mus musculus
gattccaacgtgtgctaacggctgc

SEQ ID NO: 520728 - DNA, 25 bp, Mus musculus
gattccaagatgcttcctgtgactg

SEQ ID NO: 520729 - DNA, 25 bp, Mus musculus
gattccaagatggttcctgtgactg

SEQ ID NO: 520730 - DNA, 25 bp, Mus musculus
gattccaagctcctactactcaggg

SEQ ID NO: 520731 - DNA, 25 bp, Mus musculus
gattccaagctcgtactactcaggg

SEQ ID NO: 520732 - DNA, 25 bp, Mus musculus
gattccaaggaactgtcagttacat

SEQ ID NO: 520733 - DNA, 25 bp, Mus musculus
gattccaaggaagtgtcagttacat

SEQ ID NO: 520734 - DNA, 25 bp, Mus musculus
gattccaatccgctacaatctgcta

SEQ ID NO: 520735 - DNA, 25 bp, Mus musculus
gattccaatccggtacaatctgcta

SEQ ID NO: 520736 - DNA, 25 bp, Mus musculus
gattccaatctcagtttggcacttg

SEQ ID NO: 520737 - DNA, 25 bp, Mus musculus
gattccaatctctgtttggcacttg

SEQ ID NO: 520738 - DNA, 25 bp, Mus musculus
gattccaatgaaatctccacttcta

SEQ ID NO: 520739 - DNA, 25 bp, Mus musculus
gattccaatgaattctccacttcta

SEQ ID NO: 520740 - DNA, 25 bp, Mus musculus
gattccaatgcaagccgagagcgat

SEQ ID NO: 520741 - DNA, 25 bp, Mus musculus
gattccaatgcatgccgagagcgat

SEQ ID NO: 520742 - DNA, 25 bp, Mus musculus
gattccaattcaactgccttgtagc

SEQ ID NO: 520743 - DNA, 25 bp, Mus musculus
gattccaattcatctgccttgtagc

SEQ ID NO: 520744 - DNA, 25 bp, Mus musculus
gattccacaagcacctaggcttagg

SEQ ID NO: 520745 - DNA, 25 bp, Mus musculus
gattccacaagctcctaggcttagg

SEQ ID NO: 520746 - DNA, 25 bp, Mus musculus
gattccacataaatacgcttagtac

SEQ ID NO: 520747 - DNA, 25 bp, Mus musculus
gattccacataattacgcttagtac

SEQ ID NO: 520748 - DNA, 25 bp, Mus musculus
gattccacatagcttgtttcatgaa

SEQ ID NO: 520749 - DNA, 25 bp, Mus musculus
gattccacataggttgtttcatgaa

SEQ ID NO: 520750 - DNA, 25 bp, Mus musculus
gattccacccctaggacaacagaag

SEQ ID NO: 520751 - DNA, 25 bp, Mus musculus
gattccaccccttggacaacagaag

SEQ ID NO: 520752 - DNA, 25 bp, Mus musculus
gattccacctcaccaaatatatggc

SEQ ID NO: 520753 - DNA, 25 bp, Mus musculus
gattccacctcagcaaatatatggc

SEQ ID NO: 520754 - DNA, 25 bp, Mus musculus
gattccacgggcactggcagaaaat

SEQ ID NO: 520755 - DNA, 25 bp, Mus musculus
gattccacgggctctggcagaaaat

SEQ ID NO: 520756 - DNA, 25 bp, Mus musculus
gattccacgtggaaagttttgacgg

SEQ ID NO: 520757 - DNA, 25 bp, Mus musculus
gattccacgtggtaagttttgacgg

SEQ ID NO: 520758 - DNA, 25 bp, Mus musculus
gattccactccacgcacgtgtaaac

SEQ ID NO: 520759 - DNA, 25 bp, Mus musculus
gattccactccaggcacgtgtaaac

SEQ ID NO: 520760 - DNA, 25 bp, Mus musculus
gattccactctgattggtgttcacc

SEQ ID NO: 520761 - DNA, 25 bp, Mus musculus
gattccactctgtttggtgttcacc

SEQ ID NO: 520762 - DNA, 25 bp, Mus musculus
gattccactgtaactgcctaattgt

SEQ ID NO: 520763 - DNA, 25 bp, Mus musculus
gattccactgtatctgcctaattgt

SEQ ID NO: 520764 - DNA, 25 bp, Mus musculus
gattccacttccagcattgctttga

SEQ ID NO: 520765 - DNA, 25 bp, Mus musculus
gattccacttcctgcattgctttga

SEQ ID NO: 520766 - DNA, 25 bp, Mus musculus
gattccactttaatttagcaccttg

SEQ ID NO: 520767 - DNA, 25 bp, Mus musculus
gattccactttattttagcaccttg

SEQ ID NO: 520768 - DNA, 25 bp, Mus musculus
gattccagaaatagtcccttttgct

SEQ ID NO: 520769 - DNA, 25 bp, Mus musculus
gattccagaaattgtcccttttgct

SEQ ID NO: 520770 - DNA, 25 bp, Mus musculus
gattccagaatcaggtccacgtgct

SEQ ID NO: 520771 - DNA, 25 bp, Mus musculus
gattccagaatctggtccacgtgct

SEQ ID NO: 520772 - DNA, 25 bp, Mus musculus
gattccagacatagtcttccaggtg

SEQ ID NO: 520773 - DNA, 25 bp, Mus musculus
gattccagacattgtcttccaggtg

SEQ ID NO: 520774 - DNA, 25 bp, Mus musculus
gattccagagagagaccccgcagac

SEQ ID NO: 520775 - DNA, 25 bp, Mus musculus
gattccagagagtgaccccgcagac

SEQ ID NO: 520776 - DNA, 25 bp, Mus musculus
gattccagaggtcttcagcgtgaga

SEQ ID NO: 520777 - DNA, 25 bp, Mus musculus
gattccagaggtgttcagcgtgaga

SEQ ID NO: 520778 - DNA, 25 bp, Mus musculus
gattccagataaccctttcctacag

SEQ ID NO: 520779 - DNA, 25 bp, Mus musculus
gattccagataagcctttcctacag

SEQ ID NO: 520780 - DNA, 25 bp, Mus musculus
gattccagatcaacacttacgttag

SEQ ID NO: 520781 - DNA, 25 bp, Mus musculus
gattccagatcatcacttacgttag

SEQ ID NO: 520782 - DNA, 25 bp, Mus musculus
gattccagatccatcaagttcatga

SEQ ID NO: 520783 - DNA, 25 bp, Mus musculus
gattccagatccttcaagttcatga

SEQ ID NO: 520784 - DNA, 25 bp, Mus musculus
gattccagatgaccgctaaacctat

SEQ ID NO: 520785 - DNA, 25 bp, Mus musculus
gattccagatgagcgctaaacctat

SEQ ID NO: 520786 - DNA, 25 bp, Mus musculus
gattccagattgaccatcagaggct

SEQ ID NO: 520787 - DNA, 25 bp, Mus musculus
gattccagattgtccatcagaggct

SEQ ID NO: 520788 - DNA, 25 bp, Mus musculus
gattccagccaacactttggtacag

SEQ ID NO: 520789 - DNA, 25 bp, Mus musculus
gattccagccaagactttggtacag

SEQ ID NO: 520790 - DNA, 25 bp, Mus musculus
gattccagccatatatctccagatt

SEQ ID NO: 520791 - DNA, 25 bp, Mus musculus
gattccagccatttatctccagatt

SEQ ID NO: 520792 - DNA, 25 bp, Mus musculus
gattccagccgtaaggtttctagtc

SEQ ID NO: 520793 - DNA, 25 bp, Mus musculus
gattccagccgttaggtttctagtc

SEQ ID NO: 520794 - DNA, 25 bp, Mus musculus
gattccagctatacatgtaagcaga

SEQ ID NO: 520795 - DNA, 25 bp, Mus musculus
gattccagctattcatgtaagcaga

SEQ ID NO: 520796 - DNA, 25 bp, Mus musculus
gattccaggcagaactattgagcat

SEQ ID NO: 520797 - DNA, 25 bp, Mus musculus
gattccaggcagtactattgagcat

SEQ ID NO: 520798 - DNA, 25 bp, Mus musculus
gattccagggaaacacaccaaggtc

SEQ ID NO: 520799 - DNA, 25 bp, Mus musculus
gattccagggaatcacaccaaggtc

SEQ ID NO: 520800 - DNA, 25 bp, Mus musculus
gattccaggtgtcagtcggcatgcc

SEQ ID NO: 520801 - DNA, 25 bp, Mus musculus
gattccaggtgtgagtcggcatgcc

SEQ ID NO: 520802 - DNA, 25 bp, Mus musculus
gattccagtaacagcaatttctttt

SEQ ID NO: 520803 - DNA, 25 bp, Mus musculus
gattccagtaactgcaatttctttt

SEQ ID NO: 520804 - DNA, 25 bp, Mus musculus
gattccagtaccactgaaatggtga

SEQ ID NO: 520805 - DNA, 25 bp, Mus musculus
gattccagtacctctgaaatggtga

SEQ ID NO: 520806 - DNA, 25 bp, Mus musculus
gattccagtcttcacagtcgactga

SEQ ID NO: 520807 - DNA, 25 bp, Mus musculus
gattccagtcttgacagtcgactga

SEQ ID NO: 520808 - DNA, 25 bp, Mus musculus
gattccagtgacattacctactagt

SEQ ID NO: 520809 - DNA, 25 bp, Mus musculus
gattccagtgactttacctactagt

SEQ ID NO: 520810 - DNA, 25 bp, Mus musculus
gattccagtgatccccaggaataca

SEQ ID NO: 520811 - DNA, 25 bp, Mus musculus
gattccagtgatgcccaggaataca

SEQ ID NO: 520812 - DNA, 25 bp, Mus musculus
gattccataacacatagctgttgta

SEQ ID NO: 520813 - DNA, 25 bp, Mus musculus
gattccataacagatagctgttgta

SEQ ID NO: 520814 - DNA, 25 bp, Mus musculus
gattccatacagaggccctctctca

SEQ ID NO: 520815 - DNA, 25 bp, Mus musculus
gattccatacagtggccctctctca

SEQ ID NO: 520816 - DNA, 25 bp, Mus musculus
gattccatagacaggatcccttgct

SEQ ID NO: 520817 - DNA, 25 bp, Mus musculus
gattccatagactggatcccttgct

SEQ ID NO: 520818 - DNA, 25 bp, Mus musculus
gattccatccaactgttgctaagat

SEQ ID NO: 520819 - DNA, 25 bp, Mus musculus
gattccatccaacttttaactgcat

SEQ ID NO: 520820 - DNA, 25 bp, Mus musculus
gattccatccaagtgttgctaagat

SEQ ID NO: 520821 - DNA, 25 bp, Mus musculus
gattccatccaagttttaactgcat

SEQ ID NO: 520822 - DNA, 25 bp, Mus musculus
gattccatccacagcagaagtcccc

SEQ ID NO: 520823 - DNA, 25 bp, Mus musculus
gattccatccactgcagaagtcccc

SEQ ID NO: 520824 - DNA, 25 bp, Mus musculus
gattccatcttaaaactaccagtgt

SEQ ID NO: 520825 - DNA, 25 bp, Mus musculus
gattccatcttataactaccagtgt

SEQ ID NO: 520826 - DNA, 25 bp, Mus musculus
gattccatgaacacgtgacttgaca

SEQ ID NO: 520827 - DNA, 25 bp, Mus musculus
gattccatgaactcgtgacttgaca

SEQ ID NO: 520828 - DNA, 25 bp, Mus musculus
gattccatggatattgtactactca

SEQ ID NO: 520829 - DNA, 25 bp, Mus musculus
gattccatggatctccattagagac

SEQ ID NO: 520830 - DNA, 25 bp, Mus musculus
gattccatggatgtccattagagac

SEQ ID NO: 520831 - DNA, 25 bp, Mus musculus
gattccatggattttgtactactca

SEQ ID NO: 520832 - DNA, 25 bp, Mus musculus
gattccatgtgcatatcttacctcc

SEQ ID NO: 520833 - DNA, 25 bp, Mus musculus
gattccatgtgcttatcttacctcc

SEQ ID NO: 520834 - DNA, 25 bp, Mus musculus
gattccattcccaaattcaactgca

SEQ ID NO: 520835 - DNA, 25 bp, Mus musculus
gattccattccctaattcaactgca

SEQ ID NO: 520836 - DNA, 25 bp, Mus musculus
gattccattgcacacaaggttttag

SEQ ID NO: 520837 - DNA, 25 bp, Mus musculus
gattccattgcagacaaggttttag

SEQ ID NO: 520838 - DNA, 25 bp, Mus musculus
gattccattgtccaagatgtgcctt

SEQ ID NO: 520839 - DNA, 25 bp, Mus musculus
gattccattgtcgaagatgtgcctt

SEQ ID NO: 520840 - DNA, 25 bp, Mus musculus
gattccatttctctattctctcgag

SEQ ID NO: 520841 - DNA, 25 bp, Mus musculus
gattccatttctcttagttctttac

SEQ ID NO: 520842 - DNA, 25 bp, Mus musculus
gattccatttctgtattctctcgag

SEQ ID NO: 520843 - DNA, 25 bp, Mus musculus
gattccatttctgttagttctttac

SEQ ID NO: 520844 - DNA, 25 bp, Mus musculus
gattcccaaagaaatccatgctgct

SEQ ID NO: 520845 - DNA, 25 bp, Mus musculus
gattcccaaagatatccatgctgct

SEQ ID NO: 520846 - DNA, 25 bp, Mus musculus
gattcccaaggaatcagcgcgttac

SEQ ID NO: 520847 - DNA, 25 bp, Mus musculus
gattcccaaggattcagcgcgttac

SEQ ID NO: 520848 - DNA, 25 bp, Mus musculus
gattcccacataatttagctctttc

SEQ ID NO: 520849 - DNA, 25 bp, Mus musculus
gattcccacatattttagctctttc

SEQ ID NO: 520850 - DNA, 25 bp, Mus musculus
gattcccaccatcgagcaaggagtt

SEQ ID NO: 520851 - DNA, 25 bp, Mus musculus
gattcccaccatggagcaaggagtt

SEQ ID NO: 520852 - DNA, 25 bp, Mus musculus
gattcccaccctcaactctagagaa

SEQ ID NO: 520853 - DNA, 25 bp, Mus musculus
gattcccaccctgaactctagagaa

SEQ ID NO: 520854 - DNA, 25 bp, Mus musculus
gattcccagagcatgatccctgagt

SEQ ID NO: 520855 - DNA, 25 bp, Mus musculus
gattcccagagcttgatccctgagt

SEQ ID NO: 520856 - DNA, 25 bp, Mus musculus
gattcccaggaaaccgtatggtggg

SEQ ID NO: 520857 - DNA, 25 bp, Mus musculus
gattcccaggaactagtgttagaaa

SEQ ID NO: 520858 - DNA, 25 bp, Mus musculus
gattcccaggaagtagtgttagaaa

SEQ ID NO: 520859 - DNA, 25 bp, Mus musculus
gattcccaggaatccgtatggtggg

SEQ ID NO: 520860 - DNA, 25 bp, Mus musculus
gattcccaggatccaatgtctcact

SEQ ID NO: 520861 - DNA, 25 bp, Mus musculus
gattcccaggatgcaatgtctcact

SEQ ID NO: 520862 - DNA, 25 bp, Mus musculus
gattcccaggcaaagtcagccagcg

SEQ ID NO: 520863 - DNA, 25 bp, Mus musculus
gattcccaggcatagtcagccagcg

SEQ ID NO: 520864 - DNA, 25 bp, Mus musculus
gattcccaggtgagcttcagtaaag

SEQ ID NO: 520865 - DNA, 25 bp, Mus musculus
gattcccaggtgtgcttcagtaaag

SEQ ID NO: 520866 - DNA, 25 bp, Mus musculus
gattcccagtagcactcaagtcaag

SEQ ID NO: 520867 - DNA, 25 bp, Mus musculus
gattcccagtagcttatattatctg

SEQ ID NO: 520868 - DNA, 25 bp, Mus musculus
gattcccagtaggactcaagtcaag

SEQ ID NO: 520869 - DNA, 25 bp, Mus musculus
gattcccagtaggttatattatctg

SEQ ID NO: 520870 - DNA, 25 bp, Mus musculus
gattcccagtgtatctgattgatat

SEQ ID NO: 520871 - DNA, 25 bp, Mus musculus
gattcccagtgtttctgattgatat

SEQ ID NO: 520872 - DNA, 25 bp, Mus musculus
gattcccagttcatttaccactaaa

SEQ ID NO: 520873 - DNA, 25 bp, Mus musculus
gattcccagttcttttaccactaaa

SEQ ID NO: 520874 - DNA, 25 bp, Mus musculus
gattcccataacatgattttgtgtt

SEQ ID NO: 520875 - DNA, 25 bp, Mus musculus
gattcccataacttgattttgtgtt

SEQ ID NO: 520876 - DNA, 25 bp, Mus musculus
gattcccatggaacacgtgcagctg

SEQ ID NO: 520877 - DNA, 25 bp, Mus musculus
gattcccatggatcacgtgcagctg

SEQ ID NO: 520878 - DNA, 25 bp, Mus musculus
gattcccatggtcatctttggcagc

SEQ ID NO: 520879 - DNA, 25 bp, Mus musculus
gattcccatggtgatctttggcagc

SEQ ID NO: 520880 - DNA, 25 bp, Mus musculus
gattcccattgaatctagtctatgt

SEQ ID NO: 520881 - DNA, 25 bp, Mus musculus
gattcccattgattctagtctatgt

SEQ ID NO: 520882 - DNA, 25 bp, Mus musculus
gattcccattggatttatcccgctg

SEQ ID NO: 520883 - DNA, 25 bp, Mus musculus
gattcccattggttttatcccgctg

SEQ ID NO: 520884 - DNA, 25 bp, Mus musculus
gattccccagataatttctgggttt

SEQ ID NO: 520885 - DNA, 25 bp, Mus musculus
gattccccagattatttctgggttt

SEQ ID NO: 520886 - DNA, 25 bp, Mus musculus
gattccccaggaaggtgtcaccaaa

SEQ ID NO: 520887 - DNA, 25 bp, Mus musculus
gattccccaggacacgaggcagagt

SEQ ID NO: 520888 - DNA, 25 bp, Mus musculus
gattccccaggacagaacaacggta

SEQ ID NO: 520889 - DNA, 25 bp, Mus musculus
gattccccaggagacgaggcagagt

SEQ ID NO: 520890 - DNA, 25 bp, Mus musculus
gattccccaggagagaacaacggta

SEQ ID NO: 520891 - DNA, 25 bp, Mus musculus
gattccccaggatggtgtcaccaaa

SEQ ID NO: 520892 - DNA, 25 bp, Mus musculus
gattccccccaactcttgttatatt

SEQ ID NO: 520893 - DNA, 25 bp, Mus musculus
gattccccccaagtcttgttatatt

SEQ ID NO: 520894 - DNA, 25 bp, Mus musculus
gattcccccccaaggcccaggaagg

SEQ ID NO: 520895 - DNA, 25 bp, Mus musculus
gattcccccccatggcccaggaagg

SEQ ID NO: 520896 - DNA, 25 bp, Mus musculus
gattccccgattccagctatagtgg

SEQ ID NO: 520897 - DNA, 25 bp, Mus musculus
gattccccgattgcagctatagtgg

SEQ ID NO: 520898 - DNA, 25 bp, Mus musculus
gattcccctattcatgtaaaaaatt

SEQ ID NO: 520899 - DNA, 25 bp, Mus musculus
gattcccctattgatgtaaaaaatt

SEQ ID NO: 520900 - DNA, 25 bp, Mus musculus
gattcccctcacagtgttagctgga

SEQ ID NO: 520901 - DNA, 25 bp, Mus musculus
gattcccctcactgtgttagctgga

SEQ ID NO: 520902 - DNA, 25 bp, Mus musculus
gattcccctcctctacaagaagaaa

SEQ ID NO: 520903 - DNA, 25 bp, Mus musculus
gattcccctcctgtacaagaagaaa

SEQ ID NO: 520904 - DNA, 25 bp, Mus musculus
gattcccctgagaaaaaagtagcca

SEQ ID NO: 520905 - DNA, 25 bp, Mus musculus
gattcccctgagtaaaaagtagcca

SEQ ID NO: 520906 - DNA, 25 bp, Mus musculus
gattcccctgtcaatcctaatattt

SEQ ID NO: 520907 - DNA, 25 bp, Mus musculus
gattcccctgtctatcctaatattt

SEQ ID NO: 520908 - DNA, 25 bp, Mus musculus
gattcccgcgcccctgctgggagag

SEQ ID NO: 520909 - DNA, 25 bp, Mus musculus
gattcccgcgccgctgctgggagag

SEQ ID NO: 520910 - DNA, 25 bp, Mus musculus
gattcccgggaacttgatttgcatt

SEQ ID NO: 520911 - DNA, 25 bp, Mus musculus
gattcccgggaagttgatttgcatt

SEQ ID NO: 520912 - DNA, 25 bp, Mus musculus
gattcccggttcaagtgtgttcctg

SEQ ID NO: 520913 - DNA, 25 bp, Mus musculus
gattcccggttctagtgtgttcctg

SEQ ID NO: 520914 - DNA, 25 bp, Mus musculus
gattcccgtcctaaagtctatatac

SEQ ID NO: 520915 - DNA, 25 bp, Mus musculus
gattcccgtccttaagtctatatac

SEQ ID NO: 520916 - DNA, 25 bp, Mus musculus
gattcccgtgctcccctagaaagag

SEQ ID NO: 520917 - DNA, 25 bp, Mus musculus
gattcccgtgctgccctagaaagag

SEQ ID NO: 520918 - DNA, 25 bp, Mus musculus
gattccctaactcaggagtgactga

SEQ ID NO: 520919 - DNA, 25 bp, Mus musculus
gattccctaactgaggagtgactga

SEQ ID NO: 520920 - DNA, 25 bp, Mus musculus
gattccctaaggcaatttgagtatc

SEQ ID NO: 520921 - DNA, 25 bp, Mus musculus
gattccctaagggaatttgagtatc

SEQ ID NO: 520922 - DNA, 25 bp, Mus musculus
gattccctagttagtgttggtcagt

SEQ ID NO: 520923 - DNA, 25 bp, Mus musculus
gattccctagtttgtgttggtcagt

SEQ ID NO: 520924 - DNA, 25 bp, Mus musculus
gattccctcaataaaccctgtgtag

SEQ ID NO: 520925 - DNA, 25 bp, Mus musculus
gattccctcaattaaccctgtgtag

SEQ ID NO: 520926 - DNA, 25 bp, Mus musculus
gattccctcaccataggagaggtgg

SEQ ID NO: 520927 - DNA, 25 bp, Mus musculus
gattccctcaccttaggagaggtgg

SEQ ID NO: 520928 - DNA, 25 bp, Mus musculus
gattccctcaggagttccgaggcag

SEQ ID NO: 520929 - DNA, 25 bp, Mus musculus
gattccctcaggtgttccgaggcag

SEQ ID NO: 520930 - DNA, 25 bp, Mus musculus
gattccctgaggattctagatgtta

SEQ ID NO: 520931 - DNA, 25 bp, Mus musculus
gattccctgaggtttctagatgtta

SEQ ID NO: 520932 - DNA, 25 bp, Mus musculus
gattccctgagtctgagggacccat

SEQ ID NO: 520933 - DNA, 25 bp, Mus musculus
gattccctgagtgtgagggacccat

SEQ ID NO: 520934 - DNA, 25 bp, Mus musculus
gattccctgcgcaacatagtgagca

SEQ ID NO: 520935 - DNA, 25 bp, Mus musculus
gattccctgcgctacatagtgagca

SEQ ID NO: 520936 - DNA, 25 bp, Mus musculus
gattccctgctaacagtgctgctgg

SEQ ID NO: 520937 - DNA, 25 bp, Mus musculus
gattccctgctatcagtgctgctgg

SEQ ID NO: 520938 - DNA, 25 bp, Mus musculus
gattccctggacagcttacttttca

SEQ ID NO: 520939 - DNA, 25 bp, Mus musculus
gattccctggactgcttacttttca

SEQ ID NO: 520940 - DNA, 25 bp, Mus musculus
gattccctggagatcacaaacacct

SEQ ID NO: 520941 - DNA, 25 bp, Mus musculus
gattccctggagttcacaaacacct

SEQ ID NO: 520942 - DNA, 25 bp, Mus musculus
gattccctggtcaacttgaggagca

SEQ ID NO: 520943 - DNA, 25 bp, Mus musculus
gattccctggtctacttgaggagca

SEQ ID NO: 520944 - DNA, 25 bp, Mus musculus
gattccctggttaattcctaaagca

SEQ ID NO: 520945 - DNA, 25 bp, Mus musculus
gattccctggtttattcctaaagca

SEQ ID NO: 520946 - DNA, 25 bp, Mus musculus
gattccctgttgctttggtgtactg

SEQ ID NO: 520947 - DNA, 25 bp, Mus musculus
gattccctgttggtttggtgtactg

SEQ ID NO: 520948 - DNA, 25 bp, Mus musculus
gattccctgtttcgtgtactaattg

SEQ ID NO: 520949 - DNA, 25 bp, Mus musculus
gattccctgtttggtgtactaattg

SEQ ID NO: 520950 - DNA, 25 bp, Mus musculus
gattcccttaggaacattccttatt

SEQ ID NO: 520951 - DNA, 25 bp, Mus musculus
gattcccttaggtacattccttatt

SEQ ID NO: 520952 - DNA, 25 bp, Mus musculus
gattcccttgaaatgtgtttcgatg

SEQ ID NO: 520953 - DNA, 25 bp, Mus musculus
gattcccttgaattgtgtttcgatg

SEQ ID NO: 520954 - DNA, 25 bp, Mus musculus
gattcccttgtgcttctaggagcac

SEQ ID NO: 520955 - DNA, 25 bp, Mus musculus
gattcccttgtggttctaggagcac

SEQ ID NO: 520956 - DNA, 25 bp, Mus musculus
gattcccttttgaaaatcaatggct

SEQ ID NO: 520957 - DNA, 25 bp, Mus musculus
gattcccttttgtaaatcaatggct

SEQ ID NO: 520958 - DNA, 25 bp, Mus musculus
gattccgaaaacagacccgagagta

SEQ ID NO: 520959 - DNA, 25 bp, Mus musculus
gattccgaaaactgacccgagagta

SEQ ID NO: 520960 - DNA, 25 bp, Mus musculus
gattccgagaatcaattccaactgg

SEQ ID NO: 520961 - DNA, 25 bp, Mus musculus
gattccgagaatgaattccaactgg

SEQ ID NO: 520962 - DNA, 25 bp, Mus musculus
gattccgagtagcaagactccccga

SEQ ID NO: 520963 - DNA, 25 bp, Mus musculus
gattccgagtaggaagactccccga

SEQ ID NO: 520964 - DNA, 25 bp, Mus musculus
gattccgagtatcttcttgtacctt

SEQ ID NO: 520965 - DNA, 25 bp, Mus musculus
gattccgagtatgttcttgtacctt

SEQ ID NO: 520966 - DNA, 25 bp, Mus musculus
gattccgagtgacactcgccaagca

SEQ ID NO: 520967 - DNA, 25 bp, Mus musculus
gattccgagtgagactcgccaagca

SEQ ID NO: 520968 - DNA, 25 bp, Mus musculus
gattccgatgatcacctaagtggct

SEQ ID NO: 520969 - DNA, 25 bp, Mus musculus
gattccgatgatgacctaagtggct

SEQ ID NO: 520970 - DNA, 25 bp, Mus musculus
gattccgccaccagatggcactagt

SEQ ID NO: 520971 - DNA, 25 bp, Mus musculus
gattccgccacctgatggcactagt

SEQ ID NO: 520972 - DNA, 25 bp, Mus musculus
gattccgccccgagctgaagctgac

SEQ ID NO: 520973 - DNA, 25 bp, Mus musculus
gattccgccccgtgctgaagctgac

SEQ ID NO: 520974 - DNA, 25 bp, Mus musculus
gattccgctgccagacctgtggcta

SEQ ID NO: 520975 - DNA, 25 bp, Mus musculus
gattccgctgcctgacctgtggcta

SEQ ID NO: 520976 - DNA, 25 bp, Mus musculus
gattccggagcacgaaactctggta

SEQ ID NO: 520977 - DNA, 25 bp, Mus musculus
gattccggagcaggaaactctggta

SEQ ID NO: 520978 - DNA, 25 bp, Mus musculus
gattccggatacaggcattttgtgg

SEQ ID NO: 520979 - DNA, 25 bp, Mus musculus
gattccggatactggcattttgtgg

SEQ ID NO: 520980 - DNA, 25 bp, Mus musculus
gattccggcaccattaggaggcgct

SEQ ID NO: 520981 - DNA, 25 bp, Mus musculus
gattccggcacctttaggaggcgct

SEQ ID NO: 520982 - DNA, 25 bp, Mus musculus
gattccggggatagagatcctcaat

SEQ ID NO: 520983 - DNA, 25 bp, Mus musculus
gattccggggattgagatcctcaat

SEQ ID NO: 520984 - DNA, 25 bp, Mus musculus
gattccggtaccctttacagcctgt

SEQ ID NO: 520985 - DNA, 25 bp, Mus musculus
gattccggtaccgtttacagcctgt

SEQ ID NO: 520986 - DNA, 25 bp, Mus musculus
gattccgtaaagctagaagcctgac

SEQ ID NO: 520987 - DNA, 25 bp, Mus musculus
gattccgtaaaggtagaagcctgac

SEQ ID NO: 520988 - DNA, 25 bp, Mus musculus
gattccgtacaaataatggccttgg

SEQ ID NO: 520989 - DNA, 25 bp, Mus musculus
gattccgtacaattaatggccttgg

SEQ ID NO: 520990 - DNA, 25 bp, Mus musculus
gattccgtagtgctgattgtgattt

SEQ ID NO: 520991 - DNA, 25 bp, Mus musculus
gattccgtagtggtgattgtgattt

SEQ ID NO: 520992 - DNA, 25 bp, Mus musculus
gattccgtatagatctccatctgga

SEQ ID NO: 520993 - DNA, 25 bp, Mus musculus
gattccgtatagttctccatctgga

SEQ ID NO: 520994 - DNA, 25 bp, Mus musculus
gattccgtcaacattccagatttaa

SEQ ID NO: 520995 - DNA, 25 bp, Mus musculus
gattccgtcaactttccagatttaa

SEQ ID NO: 520996 - DNA, 25 bp, Mus musculus
gattccgtccatagtgactcaggag

SEQ ID NO: 520997 - DNA, 25 bp, Mus musculus
gattccgtccattgtgactcaggag

SEQ ID NO: 520998 - DNA, 25 bp, Mus musculus
gattccgtgaggcaacaacgccgaa

SEQ ID NO: 520999 - DNA, 25 bp, Mus musculus
gattccgtgagggaacaacgccgaa

SEQ ID NO: 521000 - DNA, 25 bp, Mus musculus
gattccgtgagtccagctggttaga

SEQ ID NO: 521001 - DNA, 25 bp, Mus musculus
gattccgtgagtgcagctggttaga

SEQ ID NO: 521002 - DNA, 25 bp, Mus musculus
gattccgttaccctgaaagacctat

SEQ ID NO: 521003 - DNA, 25 bp, Mus musculus
gattccgttaccgtgaaagacctat

SEQ ID NO: 521004 - DNA, 25 bp, Mus musculus
gattccgttagtaccttatgacttc

SEQ ID NO: 521005 - DNA, 25 bp, Mus musculus
gattccgttagttccttatgacttc

SEQ ID NO: 521006 - DNA, 25 bp, Mus musculus
gattccgttttcatttttgctgtga

SEQ ID NO: 521007 - DNA, 25 bp, Mus musculus
gattccgttttcttttttgctgtga

SEQ ID NO: 521008 - DNA, 25 bp, Mus musculus
gattcctaagccaaccagctagtgt

SEQ ID NO: 521009 - DNA, 25 bp, Mus musculus
gattcctaagcctaccagctagtgt

SEQ ID NO: 521010 - DNA, 25 bp, Mus musculus
gattcctaaggtccttctcagcaga

SEQ ID NO: 521011 - DNA, 25 bp, Mus musculus
gattcctaaggtgcttctcagcaga

SEQ ID NO: 521012 - DNA, 25 bp, Mus musculus
gattcctacttgagtttttgtcttg

SEQ ID NO: 521013 - DNA, 25 bp, Mus musculus
gattcctacttgtgtttttgtcttg

SEQ ID NO: 521014 - DNA, 25 bp, Mus musculus
gattcctagaggcttccctacgatt

SEQ ID NO: 521015 - DNA, 25 bp, Mus musculus
gattcctagagggttccctacgatt

SEQ ID NO: 521016 - DNA, 25 bp, Mus musculus
gattcctagattaacttttgatttc

SEQ ID NO: 521017 - DNA, 25 bp, Mus musculus
gattcctagatttacttttgatttc

SEQ ID NO: 521018 - DNA, 25 bp, Mus musculus
gattcctaggataccattgtgatgg

SEQ ID NO: 521019 - DNA, 25 bp, Mus musculus
gattcctaggattccattgtgatgg

SEQ ID NO: 521020 - DNA, 25 bp, Mus musculus
gattcctagtctaggctaaatgcaa

SEQ ID NO: 521021 - DNA, 25 bp, Mus musculus
gattcctagtcttggctaaatgcaa

SEQ ID NO: 521022 - DNA, 25 bp, Mus musculus
gattcctagtgcctacataacagtt

SEQ ID NO: 521023 - DNA, 25 bp, Mus musculus
gattcctagtgcgtacataacagtt

SEQ ID NO: 521024 - DNA, 25 bp, Mus musculus
gattcctataaacatctccagctgt

SEQ ID NO: 521025 - DNA, 25 bp, Mus musculus
gattcctataaagatctccagctgt

SEQ ID NO: 521026 - DNA, 25 bp, Mus musculus
gattcctatatgacctatattattg

SEQ ID NO: 521027 - DNA, 25 bp, Mus musculus
gattcctatatgtcctatattattg

SEQ ID NO: 521028 - DNA, 25 bp, Mus musculus
gattcctatgccaggaacatctctt

SEQ ID NO: 521029 - DNA, 25 bp, Mus musculus
gattcctatgcctggaacatctctt

SEQ ID NO: 521030 - DNA, 25 bp, Mus musculus
gattcctcacttctctaagggctga

SEQ ID NO: 521031 - DNA, 25 bp, Mus musculus
gattcctcacttgtctaagggctga

SEQ ID NO: 521032 - DNA, 25 bp, Mus musculus
gattcctcagcgactttgttttata

SEQ ID NO: 521033 - DNA, 25 bp, Mus musculus
gattcctcagcgtctttgttttata

SEQ ID NO: 521034 - DNA, 25 bp, Mus musculus
gattcctcaggtcaacactatcatt

SEQ ID NO: 521035 - DNA, 25 bp, Mus musculus
gattcctcaggtgaacactatcatt

SEQ ID NO: 521036 - DNA, 25 bp, Mus musculus
gattcctcatctccacgcgaagaca

SEQ ID NO: 521037 - DNA, 25 bp, Mus musculus
gattcctcatctgcacgcgaagaca

SEQ ID NO: 521038 - DNA, 25 bp, Mus musculus
gattcctcatggagcttgtttatta

SEQ ID NO: 521039 - DNA, 25 bp, Mus musculus
gattcctcatggtgcttgtttatta

SEQ ID NO: 521040 - DNA, 25 bp, Mus musculus
gattcctccaaaccatggcattgtg

SEQ ID NO: 521041 - DNA, 25 bp, Mus musculus
gattcctccaaagcatggcattgtg

SEQ ID NO: 521042 - DNA, 25 bp, Mus musculus
gattcctccaagctagtcaccaaga

SEQ ID NO: 521043 - DNA, 25 bp, Mus musculus
gattcctccaaggtagtcaccaaga

SEQ ID NO: 521044 - DNA, 25 bp, Mus musculus
gattcctccactataagattgctca

SEQ ID NO: 521045 - DNA, 25 bp, Mus musculus
gattcctccactttaagattgctca

SEQ ID NO: 521046 - DNA, 25 bp, Mus musculus
gattcctcccatcagtatctgatgt

SEQ ID NO: 521047 - DNA, 25 bp, Mus musculus
gattcctcccatgagtatctgatgt

SEQ ID NO: 521048 - DNA, 25 bp, Mus musculus
gattcctcctgacacgatactcaga

SEQ ID NO: 521049 - DNA, 25 bp, Mus musculus
gattcctcctgagacgatactcaga

SEQ ID NO: 521050 - DNA, 25 bp, Mus musculus
gattcctccttaagtgccttgtttg

SEQ ID NO: 521051 - DNA, 25 bp, Mus musculus
gattcctccttatgtgccttgtttg

SEQ ID NO: 521052 - DNA, 25 bp, Mus musculus
gattcctcggaaagtcaagtgcata

SEQ ID NO: 521053 - DNA, 25 bp, Mus musculus
gattcctcggaatgtcaagtgcata

SEQ ID NO: 521054 - DNA, 25 bp, Mus musculus
gattcctcggctaaataacttgact

SEQ ID NO: 521055 - DNA, 25 bp, Mus musculus
gattcctcggcttaataacttgact

SEQ ID NO: 521056 - DNA, 25 bp, Mus musculus
gattcctctctcatagtcagtgtca

SEQ ID NO: 521057 - DNA, 25 bp, Mus musculus
gattcctctctcttagtcagtgtca

SEQ ID NO: 521058 - DNA, 25 bp, Mus musculus
gattcctctctgcattatttgtccg

SEQ ID NO: 521059 - DNA, 25 bp, Mus musculus
gattcctctctggattatttgtccg

SEQ ID NO: 521060 - DNA, 25 bp, Mus musculus
gattcctctgatacagtcgaagaag

SEQ ID NO: 521061 - DNA, 25 bp, Mus musculus
gattcctctgattcagtcgaagaag

SEQ ID NO: 521062 - DNA, 25 bp, Mus musculus
gattcctctgcgaacttttggtaag

SEQ ID NO: 521063 - DNA, 25 bp, Mus musculus
gattcctctgcgtacttttggtaag

SEQ ID NO: 521064 - DNA, 25 bp, Mus musculus
gattcctctgtgaaagactggactt

SEQ ID NO: 521065 - DNA, 25 bp, Mus musculus
gattcctctgtgtaagactggactt

SEQ ID NO: 521066 - DNA, 25 bp, Mus musculus
gattcctctttcactcaggatggag

SEQ ID NO: 521067 - DNA, 25 bp, Mus musculus
gattcctctttctctcaggatggag

SEQ ID NO: 521068 - DNA, 25 bp, Mus musculus
gattcctgaaccattctaggtggga

SEQ ID NO: 521069 - DNA, 25 bp, Mus musculus
gattcctgaacctttctaggtggga

SEQ ID NO: 521070 - DNA, 25 bp, Mus musculus
gattcctgaacgaatacctggactt

SEQ ID NO: 521071 - DNA, 25 bp, Mus musculus
gattcctgaacgattgggctggacc

SEQ ID NO: 521072 - DNA, 25 bp, Mus musculus
gattcctgaacgtatacctggactt

SEQ ID NO: 521073 - DNA, 25 bp, Mus musculus
gattcctgaacgtttgggctggacc

SEQ ID NO: 521074 - DNA, 25 bp, Mus musculus
gattcctgaaggacactggccaagc

SEQ ID NO: 521075 - DNA, 25 bp, Mus musculus
gattcctgaaggacgtgtgctgccc

SEQ ID NO: 521076 - DNA, 25 bp, Mus musculus
gattcctgaaggtcactggccaagc

SEQ ID NO: 521077 - DNA, 25 bp, Mus musculus
gattcctgaaggtcgtgtgctgccc

SEQ ID NO: 521078 - DNA, 25 bp, Mus musculus
gattcctgactcactagacattatg

SEQ ID NO: 521079 - DNA, 25 bp, Mus musculus
gattcctgactcacttttaattgca

SEQ ID NO: 521080 - DNA, 25 bp, Mus musculus
gattcctgactcagaaacccagcag

SEQ ID NO: 521081 - DNA, 25 bp, Mus musculus
gattcctgactctctagacattatg

SEQ ID NO: 521082 - DNA, 25 bp, Mus musculus
gattcctgactctcttttaattgca

SEQ ID NO: 521083 - DNA, 25 bp, Mus musculus
gattcctgactctgaaacccagcag

SEQ ID NO: 521084 - DNA, 25 bp, Mus musculus
gattcctgatggctgaaacacactg

SEQ ID NO: 521085 - DNA, 25 bp, Mus musculus
gattcctgatgggtgaaacacactg

SEQ ID NO: 521086 - DNA, 25 bp, Mus musculus
gattcctgcaagatactgtctttca

SEQ ID NO: 521087 - DNA, 25 bp, Mus musculus
gattcctgcaagttactgtctttca

SEQ ID NO: 521088 - DNA, 25 bp, Mus musculus
gattcctgcagacatcaagacctct

SEQ ID NO: 521089 - DNA, 25 bp, Mus musculus
gattcctgcagagatcaagacctct

SEQ ID NO: 521090 - DNA, 25 bp, Mus musculus
gattcctgcagcactacataaaatt

SEQ ID NO: 521091 - DNA, 25 bp, Mus musculus
gattcctgcagctctacataaaatt

SEQ ID NO: 521092 - DNA, 25 bp, Mus musculus
gattcctgccacaataacagagaga

SEQ ID NO: 521093 - DNA, 25 bp, Mus musculus
gattcctgccactataacagagaga

SEQ ID NO: 521094 - DNA, 25 bp, Mus musculus
gattcctgcctgaacttacatccca

SEQ ID NO: 521095 - DNA, 25 bp, Mus musculus
gattcctgcctgtacttacatccca

SEQ ID NO: 521096 - DNA, 25 bp, Mus musculus
gattcctgcgaacacagttcttcac

SEQ ID NO: 521097 - DNA, 25 bp, Mus musculus
gattcctgcgaagacagttcttcac

SEQ ID NO: 521098 - DNA, 25 bp, Mus musculus
gattcctgcgatagtgttatgtttg

SEQ ID NO: 521099 - DNA, 25 bp, Mus musculus
gattcctgcgattgtgttatgtttg

SEQ ID NO: 521100 - DNA, 25 bp, Mus musculus
gattcctgctatactctggtgacct

SEQ ID NO: 521101 - DNA, 25 bp, Mus musculus
gattcctgctattctctggtgacct

SEQ ID NO: 521102 - DNA, 25 bp, Mus musculus
gattcctggaaaaccgagtctgtgt

SEQ ID NO: 521103 - DNA, 25 bp, Mus musculus
gattcctggaaatccgagtctgtgt

SEQ ID NO: 521104 - DNA, 25 bp, Mus musculus
gattcctggattaggcacttgtgtt

SEQ ID NO: 521105 - DNA, 25 bp, Mus musculus
gattcctggatttggcacttgtgtt

SEQ ID NO: 521106 - DNA, 25 bp, Mus musculus
gattcctggctaacgaatgcactta

SEQ ID NO: 521107 - DNA, 25 bp, Mus musculus
gattcctggctatcgaatgcactta

SEQ ID NO: 521108 - DNA, 25 bp, Mus musculus
gattcctggctgatgaaactctcgc

SEQ ID NO: 521109 - DNA, 25 bp, Mus musculus
gattcctggctgttgaaactctcgc

SEQ ID NO: 521110 - DNA, 25 bp, Mus musculus
gattcctggcttaatacatgattgt

SEQ ID NO: 521111 - DNA, 25 bp, Mus musculus
gattcctggctttatacatgattgt

SEQ ID NO: 521112 - DNA, 25 bp, Mus musculus
gattcctgggagattctattgcact

SEQ ID NO: 521113 - DNA, 25 bp, Mus musculus
gattcctgggagtttctattgcact

SEQ ID NO: 521114 - DNA, 25 bp, Mus musculus
gattcctgggatcaaccggtttgga

SEQ ID NO: 521115 - DNA, 25 bp, Mus musculus
gattcctgggatgaaccggtttgga

SEQ ID NO: 521116 - DNA, 25 bp, Mus musculus
gattcctggtatcggaattcccatg

SEQ ID NO: 521117 - DNA, 25 bp, Mus musculus
gattcctggtatgggaattcccatg

SEQ ID NO: 521118 - DNA, 25 bp, Mus musculus
gattcctgtaagatttgcttgccac

SEQ ID NO: 521119 - DNA, 25 bp, Mus musculus
gattcctgtaagttttgcttgccac

SEQ ID NO: 521120 - DNA, 25 bp, Mus musculus
gattcctgtacaccttgatccaaag

SEQ ID NO: 521121 - DNA, 25 bp, Mus musculus
gattcctgtacagcttgatccaaag

SEQ ID NO: 521122 - DNA, 25 bp, Mus musculus
gattcctgtagcatctgagagagtt

SEQ ID NO: 521123 - DNA, 25 bp, Mus musculus
gattcctgtagcttctgagagagtt

SEQ ID NO: 521124 - DNA, 25 bp, Mus musculus
gattcctgtataaaatagggcatgc

SEQ ID NO: 521125 - DNA, 25 bp, Mus musculus
gattcctgtatataatagggcatgc

SEQ ID NO: 521126 - DNA, 25 bp, Mus musculus
gattcctgtcagatgatactatgcc

SEQ ID NO: 521127 - DNA, 25 bp, Mus musculus
gattcctgtcagttgatactatgcc

SEQ ID NO: 521128 - DNA, 25 bp, Mus musculus
gattcctgtcctctttttactaact

SEQ ID NO: 521129 - DNA, 25 bp, Mus musculus
gattcctgtcctgtttttactaact

SEQ ID NO: 521130 - DNA, 25 bp, Mus musculus
gattcctgtctcacatctgatacaa

SEQ ID NO: 521131 - DNA, 25 bp, Mus musculus
gattcctgtctctcatctgatacaa

SEQ ID NO: 521132 - DNA, 25 bp, Mus musculus
gattcctgtcttcaacccacatcag

SEQ ID NO: 521133 - DNA, 25 bp, Mus musculus
gattcctgtcttgaacccacatcag

SEQ ID NO: 521134 - DNA, 25 bp, Mus musculus
gattcctgtgaaagagttattcaac

SEQ ID NO: 521135 - DNA, 25 bp, Mus musculus
gattcctgtgaaaggcctttgggcc

SEQ ID NO: 521136 - DNA, 25 bp, Mus musculus
gattcctgtgaaccccagggtggaa

SEQ ID NO: 521137 - DNA, 25 bp, Mus musculus
gattcctgtgaagcccagggtggaa

SEQ ID NO: 521138 - DNA, 25 bp, Mus musculus
gattcctgtgaatgagttattcaac

SEQ ID NO: 521139 - DNA, 25 bp, Mus musculus
gattcctgtgaatggcctttgggcc

SEQ ID NO: 521140 - DNA, 25 bp, Mus musculus
gattcctgtgcaacacctcgaagga

SEQ ID NO: 521141 - DNA, 25 bp, Mus musculus
gattcctgtgcatcacctcgaagga

SEQ ID NO: 521142 - DNA, 25 bp, Mus musculus
gattcctgtggaaccttctgcgggc

SEQ ID NO: 521143 - DNA, 25 bp, Mus musculus
gattcctgtggatccttctgcgggc

SEQ ID NO: 521144 - DNA, 25 bp, Mus musculus
gattcctgtggcaaccatatgagac

SEQ ID NO: 521145 - DNA, 25 bp, Mus musculus
gattcctgtggctaccatatgagac

SEQ ID NO: 521146 - DNA, 25 bp, Mus musculus
gattcctgtgttcattttactctct

SEQ ID NO: 521147 - DNA, 25 bp, Mus musculus
gattcctgtgttgattttactctct

SEQ ID NO: 521148 - DNA, 25 bp, Mus musculus
gattcctgttaaagctctctgtact

SEQ ID NO: 521149 - DNA, 25 bp, Mus musculus
gattcctgttaatgctctctgtact

SEQ ID NO: 521150 - DNA, 25 bp, Mus musculus
gattcctgttcaccttatgcagtac

SEQ ID NO: 521151 - DNA, 25 bp, Mus musculus
gattcctgttcagcttatgcagtac

SEQ ID NO: 521152 - DNA, 25 bp, Mus musculus
gattcctgtttgcagccagtcctag

SEQ ID NO: 521153 - DNA, 25 bp, Mus musculus
gattcctgtttggagccagtcctag

SEQ ID NO: 521154 - DNA, 25 bp, Mus musculus
gattccttaatccaacttataccgg

SEQ ID NO: 521155 - DNA, 25 bp, Mus musculus
gattccttaatcgaacttataccgg

SEQ ID NO: 521156 - DNA, 25 bp, Mus musculus
gattccttacttatcccatgggagg

SEQ ID NO: 521157 - DNA, 25 bp, Mus musculus
gattccttacttttcccatgggagg

SEQ ID NO: 521158 - DNA, 25 bp, Mus musculus
gattccttattaactcaggactcta

SEQ ID NO: 521159 - DNA, 25 bp, Mus musculus
gattccttattatctcaggactcta

SEQ ID NO: 521160 - DNA, 25 bp, Mus musculus
gattccttcaagagtcatggccgga

SEQ ID NO: 521161 - DNA, 25 bp, Mus musculus
gattccttcaagtgtcatggccgga

SEQ ID NO: 521162 - DNA, 25 bp, Mus musculus
gattccttcagcatacaagttactc

SEQ ID NO: 521163 - DNA, 25 bp, Mus musculus
gattccttcagcttacaagttactc

SEQ ID NO: 521164 - DNA, 25 bp, Mus musculus
gattccttcatacaaggtacttcaa

SEQ ID NO: 521165 - DNA, 25 bp, Mus musculus
gattccttcatagaaggtacttcaa

SEQ ID NO: 521166 - DNA, 25 bp, Mus musculus
gattccttccatagcaggtcttaac

SEQ ID NO: 521167 - DNA, 25 bp, Mus musculus
gattccttccattgcaggtcttaac

SEQ ID NO: 521168 - DNA, 25 bp, Mus musculus
gattccttccctaacttttgcaaag

SEQ ID NO: 521169 - DNA, 25 bp, Mus musculus
gattccttcccttacttttgcaaag

SEQ ID NO: 521170 - DNA, 25 bp, Mus musculus
gattccttccgtcacagcttttaga

SEQ ID NO: 521171 - DNA, 25 bp, Mus musculus
gattccttccgtgacagcttttaga

SEQ ID NO: 521172 - DNA, 25 bp, Mus musculus
gattccttcggaaccatggtggcgt

SEQ ID NO: 521173 - DNA, 25 bp, Mus musculus
gattccttcggatccatggtggcgt

SEQ ID NO: 521174 - DNA, 25 bp, Mus musculus
gattccttctgcatgatctgggccc

SEQ ID NO: 521175 - DNA, 25 bp, Mus musculus
gattccttctgccaatcaaatctct

SEQ ID NO: 521176 - DNA, 25 bp, Mus musculus
gattccttctgcgaatcaaatctct

SEQ ID NO: 521177 - DNA, 25 bp, Mus musculus
gattccttctgcttgatctgggccc

SEQ ID NO: 521178 - DNA, 25 bp, Mus musculus
gattccttctgtaaacatagcatgt

SEQ ID NO: 521179 - DNA, 25 bp, Mus musculus
gattccttctgttaacatagcatgt

SEQ ID NO: 521180 - DNA, 25 bp, Mus musculus
gattccttgaacaacgtaccatgca

SEQ ID NO: 521181 - DNA, 25 bp, Mus musculus
gattccttgaactacgtaccatgca

SEQ ID NO: 521182 - DNA, 25 bp, Mus musculus
gattccttgaccatgccattatggc

SEQ ID NO: 521183 - DNA, 25 bp, Mus musculus
gattccttgaccttgccattatggc

SEQ ID NO: 521184 - DNA, 25 bp, Mus musculus
gattccttgatgacctctatgtcaa

SEQ ID NO: 521185 - DNA, 25 bp, Mus musculus
gattccttgatgtcctctatgtcaa

SEQ ID NO: 521186 - DNA, 25 bp, Mus musculus
gattccttgcctagtctagttttgc

SEQ ID NO: 521187 - DNA, 25 bp, Mus musculus
gattccttgccttgtctagttttgc

SEQ ID NO: 521188 - DNA, 25 bp, Mus musculus
gattccttggagatgaccttgcctg

SEQ ID NO: 521189 - DNA, 25 bp, Mus musculus
gattccttggagttgaccttgcctg

SEQ ID NO: 521190 - DNA, 25 bp, Mus musculus
gattccttggcacgcagcgagacac

SEQ ID NO: 521191 - DNA, 25 bp, Mus musculus
gattccttggcaggcagcgagacac

SEQ ID NO: 521192 - DNA, 25 bp, Mus musculus
gattccttgggacatgcttggccat

SEQ ID NO: 521193 - DNA, 25 bp, Mus musculus
gattccttgggagatgcttggccat

SEQ ID NO: 521194 - DNA, 25 bp, Mus musculus
gattccttggttatcggctagtgat

SEQ ID NO: 521195 - DNA, 25 bp, Mus musculus
gattccttggttctagagccttttc

SEQ ID NO: 521196 - DNA, 25 bp, Mus musculus
gattccttggttgtagagccttttc

SEQ ID NO: 521197 - DNA, 25 bp, Mus musculus
gattccttggttttcggctagtgat

SEQ ID NO: 521198 - DNA, 25 bp, Mus musculus
gattccttgttgctgagagctgcgc

SEQ ID NO: 521199 - DNA, 25 bp, Mus musculus
gattccttgttggtgagagctgcgc

SEQ ID NO: 521200 - DNA, 25 bp, Mus musculus
gattcctttcacaattatccgggta

SEQ ID NO: 521201 - DNA, 25 bp, Mus musculus
gattcctttcactattatccgggta

SEQ ID NO: 521202 - DNA, 25 bp, Mus musculus
gattcctttcagcaccttccagttt

SEQ ID NO: 521203 - DNA, 25 bp, Mus musculus
gattcctttcaggaccttccagttt

SEQ ID NO: 521204 - DNA, 25 bp, Mus musculus
gattcctttctgattggtagctgaa

SEQ ID NO: 521205 - DNA, 25 bp, Mus musculus
gattcctttctgtttggtagctgaa

SEQ ID NO: 521206 - DNA, 25 bp, Mus musculus
gattcctttgtaagggtgggtgcat

SEQ ID NO: 521207 - DNA, 25 bp, Mus musculus
gattcctttgtatgggtgggtgcat

SEQ ID NO: 521208 - DNA, 25 bp, Mus musculus
gattcctttgtgatcggctcgggct

SEQ ID NO: 521209 - DNA, 25 bp, Mus musculus
gattcctttgtgttcggctcgggct

SEQ ID NO: 521210 - DNA, 25 bp, Mus musculus
gattcctttgttaccttgaagtagt

SEQ ID NO: 521211 - DNA, 25 bp, Mus musculus
gattcctttgtttccttgaagtagt

SEQ ID NO: 521212 - DNA, 25 bp, Mus musculus
gattccttttcaatccttgtttgcc

SEQ ID NO: 521213 - DNA, 25 bp, Mus musculus
gattccttttcattccttgtttgcc

SEQ ID NO: 521214 - DNA, 25 bp, Mus musculus
gattcgaaatttatgttgcatagat

SEQ ID NO: 521215 - DNA, 25 bp, Mus musculus
gattcgaaatttttgttgcatagat

SEQ ID NO: 521216 - DNA, 25 bp, Mus musculus
gattcgaacaggcagttcccttact

SEQ ID NO: 521217 - DNA, 25 bp, Mus musculus
gattcgaacagggagttcccttact

SEQ ID NO: 521218 - DNA, 25 bp, Mus musculus
gattcgaattaactcttagtctctg

SEQ ID NO: 521219 - DNA, 25 bp, Mus musculus
gattcgaattaagtcttagtctctg

SEQ ID NO: 521220 - DNA, 25 bp, Mus musculus
gattcgacaaaacgatgctcacaaa

SEQ ID NO: 521221 - DNA, 25 bp, Mus musculus
gattcgacaaaaggatgctcacaaa

SEQ ID NO: 521222 - DNA, 25 bp, Mus musculus
gattcgacatttctattcatagaag

SEQ ID NO: 521223 - DNA, 25 bp, Mus musculus
gattcgacatttgtattcatagaag

SEQ ID NO: 521224 - DNA, 25 bp, Mus musculus
gattcgacctcacagcagtgagtga

SEQ ID NO: 521225 - DNA, 25 bp, Mus musculus
gattcgacctcagagcagtgagtga

SEQ ID NO: 521226 - DNA, 25 bp, Mus musculus
gattcgactgacaactaccaagtgg

SEQ ID NO: 521227 - DNA, 25 bp, Mus musculus
gattcgactgactactaccaagtgg

SEQ ID NO: 521228 - DNA, 25 bp, Mus musculus
gattcgagcgaaattctttgcaacc

SEQ ID NO: 521229 - DNA, 25 bp, Mus musculus
gattcgagcgaatttctttgcaacc

SEQ ID NO: 521230 - DNA, 25 bp, Mus musculus
gattcgagttttcccatccctcttt

SEQ ID NO: 521231 - DNA, 25 bp, Mus musculus
gattcgagttttgccatccctcttt

SEQ ID NO: 521232 - DNA, 25 bp, Mus musculus
gattcgatcatactggttgcatctg

SEQ ID NO: 521233 - DNA, 25 bp, Mus musculus
gattcgatcatagtggttgcatctg

SEQ ID NO: 521234 - DNA, 25 bp, Mus musculus
gattcgatgaagactcagctccaga

SEQ ID NO: 521235 - DNA, 25 bp, Mus musculus
gattcgatgaagtctcagctccaga

SEQ ID NO: 521236 - DNA, 25 bp, Mus musculus
gattcgatgtatattcttccgtgat

SEQ ID NO: 521237 - DNA, 25 bp, Mus musculus
gattcgatgtattttcttccgtgat

SEQ ID NO: 521238 - DNA, 25 bp, Mus musculus
gattcgattcaaaggtccttaagac

SEQ ID NO: 521239 - DNA, 25 bp, Mus musculus
gattcgattcaatggtccttaagac

SEQ ID NO: 521240 - DNA, 25 bp, Mus musculus
gattcgattcttcaactattgaagg

SEQ ID NO: 521241 - DNA, 25 bp, Mus musculus
gattcgattcttgaactattgaagg

SEQ ID NO: 521242 - DNA, 25 bp, Mus musculus
gattcgcaagtacagccagaccatt

SEQ ID NO: 521243 - DNA, 25 bp, Mus musculus
gattcgcaagtagagccagaccatt

SEQ ID NO: 521244 - DNA, 25 bp, Mus musculus
gattcgcacgatcagtgtaaagaac

SEQ ID NO: 521245 - DNA, 25 bp, Mus musculus
gattcgcacgatgagtgtaaagaac

SEQ ID NO: 521246 - DNA, 25 bp, Mus musculus
gattcgcccagcagattgagcagag

SEQ ID NO: 521247 - DNA, 25 bp, Mus musculus
gattcgcccagctgattgagcagag

SEQ ID NO: 521248 - DNA, 25 bp, Mus musculus
gattcgccggtacaaggccaacaag

SEQ ID NO: 521249 - DNA, 25 bp, Mus musculus
gattcgccggtagaaggccaacaag

SEQ ID NO: 521250 - DNA, 25 bp, Mus musculus
gattcgcctggacggcaatccaatt

SEQ ID NO: 521251 - DNA, 25 bp, Mus musculus
gattcgcctggagggcaatccaatt

SEQ ID NO: 521252 - DNA, 25 bp, Mus musculus
gattcgcctttgcatggatcaaacc

SEQ ID NO: 521253 - DNA, 25 bp, Mus musculus
gattcgcctttggatggatcaaacc

SEQ ID NO: 521254 - DNA, 25 bp, Mus musculus
gattcgctacgtcgactatggtgga

SEQ ID NO: 521255 - DNA, 25 bp, Mus musculus
gattcgctacgtggactatggtgga

SEQ ID NO: 521256 - DNA, 25 bp, Mus musculus
gattcgctcaccagcccggaggacg

SEQ ID NO: 521257 - DNA, 25 bp, Mus musculus
gattcgctcacctgcccggaggacg

SEQ ID NO: 521258 - DNA, 25 bp, Mus musculus
gattcgctggacctatgcaagatca

SEQ ID NO: 521259 - DNA, 25 bp, Mus musculus
gattcgctggacgtatgcaagatca

SEQ ID NO: 521260 - DNA, 25 bp, Mus musculus
gattcgcttgatcaacagaactgat

SEQ ID NO: 521261 - DNA, 25 bp, Mus musculus
gattcgcttgatgaacagaactgat

SEQ ID NO: 521262 - DNA, 25 bp, Mus musculus
gattcgctttgtacattggagtaca

SEQ ID NO: 521263 - DNA, 25 bp, Mus musculus
gattcgctttgttcattggagtaca

SEQ ID NO: 521264 - DNA, 25 bp, Mus musculus
gattcgcttttgaaaattccaccta

SEQ ID NO: 521265 - DNA, 25 bp, Mus musculus
gattcgcttttgtaaattccaccta

SEQ ID NO: 521266 - DNA, 25 bp, Mus musculus
gattcgctttttcggaccagctcca

SEQ ID NO: 521267 - DNA, 25 bp, Mus musculus
gattcgctttttgggaccagctcca

SEQ ID NO: 521268 - DNA, 25 bp, Mus musculus
gattcggaacagatccaccctgaaa

SEQ ID NO: 521269 - DNA, 25 bp, Mus musculus
gattcggaacagttccaccctgaaa

SEQ ID NO: 521270 - DNA, 25 bp, Mus musculus
gattcggacagtcacggccgcatca

SEQ ID NO: 521271 - DNA, 25 bp, Mus musculus
gattcggacagtgacggccgcatca

SEQ ID NO: 521272 - DNA, 25 bp, Mus musculus
gattcggagcgacgaacactttcag

SEQ ID NO: 521273 - DNA, 25 bp, Mus musculus
gattcggagcgaggaacactttcag

SEQ ID NO: 521274 - DNA, 25 bp, Mus musculus
gattcggatggcctcttcaagtatg

SEQ ID NO: 521275 - DNA, 25 bp, Mus musculus
gattcggatggcgtcttcaagtatg

SEQ ID NO: 521276 - DNA, 25 bp, Mus musculus
gattcggcaggaagcagattctgtg

SEQ ID NO: 521277 - DNA, 25 bp, Mus musculus
gattcggcaggatgcagattctgtg

SEQ ID NO: 521278 - DNA, 25 bp, Mus musculus
gattcggcatcaaccctgtgggagg

SEQ ID NO: 521279 - DNA, 25 bp, Mus musculus
gattcggcatcatccctgtgggagg

SEQ ID NO: 521280 - DNA, 25 bp, Mus musculus
gattcggcggtacaagaacttcttc

SEQ ID NO: 521281 - DNA, 25 bp, Mus musculus
gattcggcggtagaagaacttcttc

SEQ ID NO: 521282 - DNA, 25 bp, Mus musculus
gattcggctaccagaaaacaaagaa

SEQ ID NO: 521283 - DNA, 25 bp, Mus musculus
gattcggctacctgaaaacaaagaa

SEQ ID NO: 521284 - DNA, 25 bp, Mus musculus
gattcggctcgaagaatgaagcact

SEQ ID NO: 521285 - DNA, 25 bp, Mus musculus
gattcggctcgatgaatgaagcact

SEQ ID NO: 521286 - DNA, 25 bp, Mus musculus
gattcgggcgggaggcagtggatca

SEQ ID NO: 521287 - DNA, 25 bp, Mus musculus
gattcgggcgggtggcagtggatca

SEQ ID NO: 521288 - DNA, 25 bp, Mus musculus
gattcgggctctaggcctcaataaa

SEQ ID NO: 521289 - DNA, 25 bp, Mus musculus
gattcgggctcttggcctcaataaa

SEQ ID NO: 521290 - DNA, 25 bp, Mus musculus
gattcggtatgtacttttccctcct

SEQ ID NO: 521291 - DNA, 25 bp, Mus musculus
gattcggtatgttcttttccctcct

SEQ ID NO: 521292 - DNA, 25 bp, Mus musculus
gattcggtcagccacccgggtgata

SEQ ID NO: 521293 - DNA, 25 bp, Mus musculus
gattcggtcagcgacccgggtgata

SEQ ID NO: 521294 - DNA, 25 bp, Mus musculus
gattcggtttcacatccagaggaac

SEQ ID NO: 521295 - DNA, 25 bp, Mus musculus
gattcggtttcagatccagaggaac

SEQ ID NO: 521296 - DNA, 25 bp, Mus musculus
gattcggttttcaatctacttggag

SEQ ID NO: 521297 - DNA, 25 bp, Mus musculus
gattcggttttcagaactgtacaca

SEQ ID NO: 521298 - DNA, 25 bp, Mus musculus
gattcggttttctatctacttggag

SEQ ID NO: 521299 - DNA, 25 bp, Mus musculus
gattcggttttctgaactgtacaca

SEQ ID NO: 521300 - DNA, 25 bp, Mus musculus
gattcgtaagcccttgtggtccaag

SEQ ID NO: 521301 - DNA, 25 bp, Mus musculus
gattcgtaagccgttgtggtccaag

SEQ ID NO: 521302 - DNA, 25 bp, Mus musculus
gattcgtacggtcgatttgtgcagc

SEQ ID NO: 521303 - DNA, 25 bp, Mus musculus
gattcgtacggtggatttgtgcagc

SEQ ID NO: 521304 - DNA, 25 bp, Mus musculus
gattcgtagtcccttcgcgccacgg

SEQ ID NO: 521305 - DNA, 25 bp, Mus musculus
gattcgtagtccgttcgcgccacgg

SEQ ID NO: 521306 - DNA, 25 bp, Mus musculus
gattcgtcaataactaggttaggta

SEQ ID NO: 521307 - DNA, 25 bp, Mus musculus
gattcgtcaatatctaggttaggta

SEQ ID NO: 521308 - DNA, 25 bp, Mus musculus
gattcgtcttcaaaacatacattta

SEQ ID NO: 521309 - DNA, 25 bp, Mus musculus
gattcgtcttcataacatacattta

SEQ ID NO: 521310 - DNA, 25 bp, Mus musculus
gattcgtctttgatcattgtttggt

SEQ ID NO: 521311 - DNA, 25 bp, Mus musculus
gattcgtctttgttcattgtttggt

SEQ ID NO: 521312 - DNA, 25 bp, Mus musculus
gattcgtgagataccgagcctgccg

SEQ ID NO: 521313 - DNA, 25 bp, Mus musculus
gattcgtgagattccgagcctgccg

SEQ ID NO: 521314 - DNA, 25 bp, Mus musculus
gattcgtgcacccattgttaatgtt

SEQ ID NO: 521315 - DNA, 25 bp, Mus musculus
gattcgtgcaccgattgttaatgtt

SEQ ID NO: 521316 - DNA, 25 bp, Mus musculus
gattcgtgcatcacaccccaatggg

SEQ ID NO: 521317 - DNA, 25 bp, Mus musculus
gattcgtgcatctcaccccaatggg

SEQ ID NO: 521318 - DNA, 25 bp, Mus musculus
gattcgtgctggagaatggaatttg

SEQ ID NO: 521319 - DNA, 25 bp, Mus musculus
gattcgtgctggtgaatggaatttg

SEQ ID NO: 521320 - DNA, 25 bp, Mus musculus
gattcgtggtagaaattgtgtttat

SEQ ID NO: 521321 - DNA, 25 bp, Mus musculus
gattcgtggtagtaattgtgtttat

SEQ ID NO: 521322 - DNA, 25 bp, Mus musculus
gattcgtgtgttattcaggtggata

SEQ ID NO: 521323 - DNA, 25 bp, Mus musculus
gattcgtgtgtttttcaggtggata

SEQ ID NO: 521324 - DNA, 25 bp, Mus musculus
gattcgtgtttcaactacacctgat

SEQ ID NO: 521325 - DNA, 25 bp, Mus musculus
gattcgtgtttctactacacctgat

SEQ ID NO: 521326 - DNA, 25 bp, Mus musculus
gattcgtgtttgagctgtccagctt

SEQ ID NO: 521327 - DNA, 25 bp, Mus musculus
gattcgtgtttgtgctgtccagctt

SEQ ID NO: 521328 - DNA, 25 bp, Mus musculus
gattctaaacatacttctcaggaca

SEQ ID NO: 521329 - DNA, 25 bp, Mus musculus
gattctaaacattcttctcaggaca

SEQ ID NO: 521330 - DNA, 25 bp, Mus musculus
gattctaaactgaatcctcctggtt

SEQ ID NO: 521331 - DNA, 25 bp, Mus musculus
gattctaaactgtatcctcctggtt

SEQ ID NO: 521332 - DNA, 25 bp, Mus musculus
gattctaaatctctatgcagaggaa

SEQ ID NO: 521333 - DNA, 25 bp, Mus musculus
gattctaaatctgtatgcagaggaa

SEQ ID NO: 521334 - DNA, 25 bp, Mus musculus
gattctaacaagagaccaggtctgg

SEQ ID NO: 521335 - DNA, 25 bp, Mus musculus
gattctaacaagtgaccaggtctgg

SEQ ID NO: 521336 - DNA, 25 bp, Mus musculus
gattctaacagaagcctcttgccag

SEQ ID NO: 521337 - DNA, 25 bp, Mus musculus
gattctaacagatgcctcttgccag

SEQ ID NO: 521338 - DNA, 25 bp, Mus musculus
gattctaacagcaaggagaccacat

SEQ ID NO: 521339 - DNA, 25 bp, Mus musculus
gattctaacagctaggagaccacat

SEQ ID NO: 521340 - DNA, 25 bp, Mus musculus
gattctaactttcctgtgttcctag

SEQ ID NO: 521341 - DNA, 25 bp, Mus musculus
gattctaactttgctgtgttcctag

SEQ ID NO: 521342 - DNA, 25 bp, Mus musculus
gattctaagccccactgatatcaag

SEQ ID NO: 521343 - DNA, 25 bp, Mus musculus
gattctaagcccgactgatatcaag

SEQ ID NO: 521344 - DNA, 25 bp, Mus musculus
gattctaatctgctttgacttcatt

SEQ ID NO: 521345 - DNA, 25 bp, Mus musculus
gattctaatctggtttgacttcatt

SEQ ID NO: 521346 - DNA, 25 bp, Mus musculus
gattctaatgggattgactgactgg

SEQ ID NO: 521347 - DNA, 25 bp, Mus musculus
gattctaatgggtttgactgactgg

SEQ ID NO: 521348 - DNA, 25 bp, Mus musculus
gattctacacgacttttacattgag

SEQ ID NO: 521349 - DNA, 25 bp, Mus musculus
gattctacacgagttttacattgag

SEQ ID NO: 521350 - DNA, 25 bp, Mus musculus
gattctacaggcctggtggactgat

SEQ ID NO: 521351 - DNA, 25 bp, Mus musculus
gattctacaggcgtggtggactgat

SEQ ID NO: 521352 - DNA, 25 bp, Mus musculus
gattctacagttcaacccagcacct

SEQ ID NO: 521353 - DNA, 25 bp, Mus musculus
gattctacagttgaacccagcacct

SEQ ID NO: 521354 - DNA, 25 bp, Mus musculus
gattctaccaatctggctttcacca

SEQ ID NO: 521355 - DNA, 25 bp, Mus musculus
gattctaccaatgtggctttcacca

SEQ ID NO: 521356 - DNA, 25 bp, Mus musculus
gattctacccgtaaaattggacctg

SEQ ID NO: 521357 - DNA, 25 bp, Mus musculus
gattctacccgttaaattggacctg

SEQ ID NO: 521358 - DNA, 25 bp, Mus musculus
gattctaccctaaatttctgacatg

SEQ ID NO: 521359 - DNA, 25 bp, Mus musculus
gattctaccctatatttctgacatg

SEQ ID NO: 521360 - DNA, 25 bp, Mus musculus
gattctacggatcgacagtgtcatt

SEQ ID NO: 521361 - DNA, 25 bp, Mus musculus
gattctacggatggacagtgtcatt

SEQ ID NO: 521362 - DNA, 25 bp, Mus musculus
gattctactctgattatcttacttt

SEQ ID NO: 521363 - DNA, 25 bp, Mus musculus
gattctactctgtttatcttacttt

SEQ ID NO: 521364 - DNA, 25 bp, Mus musculus
gattctactgccagcactgggagga

SEQ ID NO: 521365 - DNA, 25 bp, Mus musculus
gattctactgcctgcactgggagga

SEQ ID NO: 521366 - DNA, 25 bp, Mus musculus
gattctactgcgagtgacctatgtc

SEQ ID NO: 521367 - DNA, 25 bp, Mus musculus
gattctactgcgtgtgacctatgtc

SEQ ID NO: 521368 - DNA, 25 bp, Mus musculus
gattctactgggagactccatgtca

SEQ ID NO: 521369 - DNA, 25 bp, Mus musculus
gattctactgggtgactccatgtca

SEQ ID NO: 521370 - DNA, 25 bp, Mus musculus
gattctactgtactgacttggtcta

SEQ ID NO: 521371 - DNA, 25 bp, Mus musculus
gattctactgtagtgacttggtcta

SEQ ID NO: 521372 - DNA, 25 bp, Mus musculus
gattctactgtgaacaccgagtccg

SEQ ID NO: 521373 - DNA, 25 bp, Mus musculus
gattctactgtgtacaccgagtccg

SEQ ID NO: 521374 - DNA, 25 bp, Mus musculus
gattctacttcgcttggcccggcat

SEQ ID NO: 521375 - DNA, 25 bp, Mus musculus
gattctacttcggttggcccggcat

SEQ ID NO: 521376 - DNA, 25 bp, Mus musculus
gattctagaatcacgggaaggtccg

SEQ ID NO: 521377 - DNA, 25 bp, Mus musculus
gattctagaatctcgggaaggtccg

SEQ ID NO: 521378 - DNA, 25 bp, Mus musculus
gattctagacaaacacctcaaaact

SEQ ID NO: 521379 - DNA, 25 bp, Mus musculus
gattctagacaatcacctcaaaact

SEQ ID NO: 521380 - DNA, 25 bp, Mus musculus
gattctagaccaattctcatttaaa

SEQ ID NO: 521381 - DNA, 25 bp, Mus musculus
gattctagaccatttctcatttaaa

SEQ ID NO: 521382 - DNA, 25 bp, Mus musculus
gattctagagttccagatgtctgag

SEQ ID NO: 521383 - DNA, 25 bp, Mus musculus
gattctagagttgcagatgtctgag

SEQ ID NO: 521384 - DNA, 25 bp, Mus musculus
gattctagataaatcatttcacttg

SEQ ID NO: 521385 - DNA, 25 bp, Mus musculus
gattctagataattcatttcacttg

SEQ ID NO: 521386 - DNA, 25 bp, Mus musculus
gattctagctatccactggccagga

SEQ ID NO: 521387 - DNA, 25 bp, Mus musculus
gattctagctatgcactggccagga

SEQ ID NO: 521388 - DNA, 25 bp, Mus musculus
gattctagctgtcttgagatgacat

SEQ ID NO: 521389 - DNA, 25 bp, Mus musculus
gattctagctgtgttgagatgacat

SEQ ID NO: 521390 - DNA, 25 bp, Mus musculus
gattctaggtctcatccagtacttc

SEQ ID NO: 521391 - DNA, 25 bp, Mus musculus
gattctaggtctgatccagtacttc

SEQ ID NO: 521392 - DNA, 25 bp, Mus musculus
gattctagtacaaggttcaactgct

SEQ ID NO: 521393 - DNA, 25 bp, Mus musculus
gattctagtacatggttcaactgct

SEQ ID NO: 521394 - DNA, 25 bp, Mus musculus
gattctagtggtatctggtgcacct

SEQ ID NO: 521395 - DNA, 25 bp, Mus musculus
gattctagtggtttctggtgcacct

SEQ ID NO: 521396 - DNA, 25 bp, Mus musculus
gattctagtttaacttaaaggtggt

SEQ ID NO: 521397 - DNA, 25 bp, Mus musculus
gattctagtttatcttaaaggtggt

SEQ ID NO: 521398 - DNA, 25 bp, Mus musculus
gattctagtttgacagtggctgtat

SEQ ID NO: 521399 - DNA, 25 bp, Mus musculus
gattctagtttgtcagtggctgtat

SEQ ID NO: 521400 - DNA, 25 bp, Mus musculus
gattctataacaacacccattctgc

SEQ ID NO: 521401 - DNA, 25 bp, Mus musculus
gattctataacatcacccattctgc

SEQ ID NO: 521402 - DNA, 25 bp, Mus musculus
gattctataagcatcatgagcggaa

SEQ ID NO: 521403 - DNA, 25 bp, Mus musculus
gattctataagcttcatgagcggaa

SEQ ID NO: 521404 - DNA, 25 bp, Mus musculus
gattctatactcaataaccacactt

SEQ ID NO: 521405 - DNA, 25 bp, Mus musculus
gattctatactctataaccacactt

SEQ ID NO: 521406 - DNA, 25 bp, Mus musculus
gattctatagatccttaatgtcatg

SEQ ID NO: 521407 - DNA, 25 bp, Mus musculus
gattctatagatgcttaatgtcatg

SEQ ID NO: 521408 - DNA, 25 bp, Mus musculus
gattctatagggacacagtgccatt

SEQ ID NO: 521409 - DNA, 25 bp, Mus musculus
gattctatagggtcacagtgccatt

SEQ ID NO: 521410 - DNA, 25 bp, Mus musculus
gattctatcacacaacagtcctaag

SEQ ID NO: 521411 - DNA, 25 bp, Mus musculus
gattctatcacagaacagtcctaag

SEQ ID NO: 521412 - DNA, 25 bp, Mus musculus
gattctatcgtaacccccatgaagt

SEQ ID NO: 521413 - DNA, 25 bp, Mus musculus
gattctatcgtatcccccatgaagt

SEQ ID NO: 521414 - DNA, 25 bp, Mus musculus
gattctatctcactgctaatcagaa

SEQ ID NO: 521415 - DNA, 25 bp, Mus musculus
gattctatctcagtgctaatcagaa

SEQ ID NO: 521416 - DNA, 25 bp, Mus musculus
gattctatcttcagacgcacgtttg

SEQ ID NO: 521417 - DNA, 25 bp, Mus musculus
gattctatcttctgacgcacgtttg

SEQ ID NO: 521418 - DNA, 25 bp, Mus musculus
gattctatctttataaactgcattc

SEQ ID NO: 521419 - DNA, 25 bp, Mus musculus
gattctatctttttaaactgcattc

SEQ ID NO: 521420 - DNA, 25 bp, Mus musculus
gattctatgacaatgatagcagctc

SEQ ID NO: 521421 - DNA, 25 bp, Mus musculus
gattctatgacattgatagcagctc

SEQ ID NO: 521422 - DNA, 25 bp, Mus musculus
gattctatgactcatttctatgtat

SEQ ID NO: 521423 - DNA, 25 bp, Mus musculus
gattctatgactgatttctatgtat

SEQ ID NO: 521424 - DNA, 25 bp, Mus musculus
gattctatggcacttaagtctcctg

SEQ ID NO: 521425 - DNA, 25 bp, Mus musculus
gattctatggcagttaagtctcctg

SEQ ID NO: 521426 - DNA, 25 bp, Mus musculus
gattctatgggtaagctaagctcct

SEQ ID NO: 521427 - DNA, 25 bp, Mus musculus
gattctatgggttagctaagctcct

SEQ ID NO: 521428 - DNA, 25 bp, Mus musculus
gattctatgtgacttcttactccaa

SEQ ID NO: 521429 - DNA, 25 bp, Mus musculus
gattctatgtgagttcttactccaa

SEQ ID NO: 521430 - DNA, 25 bp, Mus musculus
gattctattagcctgcactgggata

SEQ ID NO: 521431 - DNA, 25 bp, Mus musculus
gattctattagcgtgcactgggata

SEQ ID NO: 521432 - DNA, 25 bp, Mus musculus
gattctattgctatggttctccttt

SEQ ID NO: 521433 - DNA, 25 bp, Mus musculus
gattctattgctttggttctccttt

SEQ ID NO: 521434 - DNA, 25 bp, Mus musculus
gattctattggaccatagcaccttg

SEQ ID NO: 521435 - DNA, 25 bp, Mus musculus
gattctattggagcatagcaccttg

SEQ ID NO: 521436 - DNA, 25 bp, Mus musculus
gattctatttccacggcttctgaat

SEQ ID NO: 521437 - DNA, 25 bp, Mus musculus
gattctatttcctcggcttctgaat

SEQ ID NO: 521438 - DNA, 25 bp, Mus musculus
gattctatttctcagtacctcttta

SEQ ID NO: 521439 - DNA, 25 bp, Mus musculus
gattctatttctgagtacctcttta

SEQ ID NO: 521440 - DNA, 25 bp, Mus musculus
gattctattttcagtgattctcaca

SEQ ID NO: 521441 - DNA, 25 bp, Mus musculus
gattctattttctgtgattctcaca

SEQ ID NO: 521442 - DNA, 25 bp, Mus musculus
gattctcaaacgacggcttcgaaca

SEQ ID NO: 521443 - DNA, 25 bp, Mus musculus
gattctcaaacgtcggcttcgaaca

SEQ ID NO: 521444 - DNA, 25 bp, Mus musculus
gattctcaaactccgttgtattttg

SEQ ID NO: 521445 - DNA, 25 bp, Mus musculus
gattctcaaactgcgttgtattttg

SEQ ID NO: 521446 - DNA, 25 bp, Mus musculus
gattctcaaattactcaaggcagtt

SEQ ID NO: 521447 - DNA, 25 bp, Mus musculus
gattctcaaatttctcaaggcagtt

SEQ ID NO: 521448 - DNA, 25 bp, Mus musculus
gattctcaacccacaattcctaaga

SEQ ID NO: 521449 - DNA, 25 bp, Mus musculus
gattctcaaccctcaattcctaaga

SEQ ID NO: 521450 - DNA, 25 bp, Mus musculus
gattctcaagagctttctctggatt

SEQ ID NO: 521451 - DNA, 25 bp, Mus musculus
gattctcaagaggtttctctggatt

SEQ ID NO: 521452 - DNA, 25 bp, Mus musculus
gattctcaatctaccaattttttac

SEQ ID NO: 521453 - DNA, 25 bp, Mus musculus
gattctcaatcttccaattttttac

SEQ ID NO: 521454 - DNA, 25 bp, Mus musculus
gattctcacaagcatctttagtttt

SEQ ID NO: 521455 - DNA, 25 bp, Mus musculus
gattctcacaaggatctttagtttt

SEQ ID NO: 521456 - DNA, 25 bp, Mus musculus
gattctcacagtcgtgccctaggaa

SEQ ID NO: 521457 - DNA, 25 bp, Mus musculus
gattctcacagtggtgccctaggaa

SEQ ID NO: 521458 - DNA, 25 bp, Mus musculus
gattctcacatgcaccccactttta

SEQ ID NO: 521459 - DNA, 25 bp, Mus musculus
gattctcacatggaccccactttta

SEQ ID NO: 521460 - DNA, 25 bp, Mus musculus
gattctcacattcaccagttggtga

SEQ ID NO: 521461 - DNA, 25 bp, Mus musculus
gattctcacattgaccagttggtga

SEQ ID NO: 521462 - DNA, 25 bp, Mus musculus
gattctcaccggacagacagacatc

SEQ ID NO: 521463 - DNA, 25 bp, Mus musculus
gattctcaccggtcagacagacatc

SEQ ID NO: 521464 - DNA, 25 bp, Mus musculus
gattctcactggagcggagggcaaa

SEQ ID NO: 521465 - DNA, 25 bp, Mus musculus
gattctcactggtgcggagggcaaa

SEQ ID NO: 521466 - DNA, 25 bp, Mus musculus
gattctcactgtactgtgttatgat

SEQ ID NO: 521467 - DNA, 25 bp, Mus musculus
gattctcactgttctgtgttatgat

SEQ ID NO: 521468 - DNA, 25 bp, Mus musculus
gattctcacttgatcccatcagcag

SEQ ID NO: 521469 - DNA, 25 bp, Mus musculus
gattctcacttgttcccatcagcag

SEQ ID NO: 521470 - DNA, 25 bp, Mus musculus
gattctcagaatattaggaaacaag

SEQ ID NO: 521471 - DNA, 25 bp, Mus musculus
gattctcagaatccaaaacctgctt

SEQ ID NO: 521472 - DNA, 25 bp, Mus musculus
gattctcagaatgcaaaacctgctt

SEQ ID NO: 521473 - DNA, 25 bp, Mus musculus
gattctcagaattttaggaaacaag

SEQ ID NO: 521474 - DNA, 25 bp, Mus musculus
gattctcagagtaccatttgcattg

SEQ ID NO: 521475 - DNA, 25 bp, Mus musculus
gattctcagagttccatttgcattg

SEQ ID NO: 521476 - DNA, 25 bp, Mus musculus
gattctcagcacagtcttcttgttt

SEQ ID NO: 521477 - DNA, 25 bp, Mus musculus
gattctcagcactgtcttcttgttt

SEQ ID NO: 521478 - DNA, 25 bp, Mus musculus
gattctcagccgcttttctagaaga

SEQ ID NO: 521479 - DNA, 25 bp, Mus musculus
gattctcagccggttttctagaaga

SEQ ID NO: 521480 - DNA, 25 bp, Mus musculus
gattctcagctaaagcccacaaggt

SEQ ID NO: 521481 - DNA, 25 bp, Mus musculus
gattctcagctatagcccacaaggt

SEQ ID NO: 521482 - DNA, 25 bp, Mus musculus
gattctcagcttagagctctcagat

SEQ ID NO: 521483 - DNA, 25 bp, Mus musculus
gattctcagctttgagctctcagat

SEQ ID NO: 521484 - DNA, 25 bp, Mus musculus
gattctcaggcaagtagacaaccat

SEQ ID NO: 521485 - DNA, 25 bp, Mus musculus
gattctcaggcatgtagacaaccat

SEQ ID NO: 521486 - DNA, 25 bp, Mus musculus
gattctcaggcgcaggcagctgtac

SEQ ID NO: 521487 - DNA, 25 bp, Mus musculus
gattctcaggcggaggcagctgtac

SEQ ID NO: 521488 - DNA, 25 bp, Mus musculus
gattctcagtggagattaggagcaa

SEQ ID NO: 521489 - DNA, 25 bp, Mus musculus
gattctcagtggtgattaggagcaa

SEQ ID NO: 521490 - DNA, 25 bp, Mus musculus
gattctcagttgctatggctacact

SEQ ID NO: 521491 - DNA, 25 bp, Mus musculus
gattctcagttggtatggctacact

SEQ ID NO: 521492 - DNA, 25 bp, Mus musculus
gattctcatatcagtcaatagggag

SEQ ID NO: 521493 - DNA, 25 bp, Mus musculus
gattctcatatctgtcaatagggag

SEQ ID NO: 521494 - DNA, 25 bp, Mus musculus
gattctcatgaacgtgtactgcaat

SEQ ID NO: 521495 - DNA, 25 bp, Mus musculus
gattctcatgaaggtgtactgcaat

SEQ ID NO: 521496 - DNA, 25 bp, Mus musculus
gattctcatgagatttcttactttg

SEQ ID NO: 521497 - DNA, 25 bp, Mus musculus
gattctcatgagttttcttactttg

SEQ ID NO: 521498 - DNA, 25 bp, Mus musculus
gattctcattctcttgtcacgctat

SEQ ID NO: 521499 - DNA, 25 bp, Mus musculus
gattctcattctgttgtcacgctat

SEQ ID NO: 521500 - DNA, 25 bp, Mus musculus
gattctccaggcatttaagggtcgc

SEQ ID NO: 521501 - DNA, 25 bp, Mus musculus
gattctccaggcttttaagggtcgc

SEQ ID NO: 521502 - DNA, 25 bp, Mus musculus
gattctccatagagaggtcttttta

SEQ ID NO: 521503 - DNA, 25 bp, Mus musculus
gattctccatagtgaggtcttttta

SEQ ID NO: 521504 - DNA, 25 bp, Mus musculus
gattctcccgtactaaagcctttgt

SEQ ID NO: 521505 - DNA, 25 bp, Mus musculus
gattctcccgtagtaaagcctttgt

SEQ ID NO: 521506 - DNA, 25 bp, Mus musculus
gattctcccttcctaaaaacaatgg

SEQ ID NO: 521507 - DNA, 25 bp, Mus musculus
gattctcccttcgtaaaaacaatgg

SEQ ID NO: 521508 - DNA, 25 bp, Mus musculus
gattctccctttcgattgagttccc

SEQ ID NO: 521509 - DNA, 25 bp, Mus musculus
gattctccctttggattgagttccc

SEQ ID NO: 521510 - DNA, 25 bp, Mus musculus
gattctccgtgtctgttatgcgagc

SEQ ID NO: 521511 - DNA, 25 bp, Mus musculus
gattctccgtgtgtgttatgcgagc

SEQ ID NO: 521512 - DNA, 25 bp, Mus musculus
gattctccgttcctcaaaatcttta

SEQ ID NO: 521513 - DNA, 25 bp, Mus musculus
gattctccgttcgtcaaaatcttta

SEQ ID NO: 521514 - DNA, 25 bp, Mus musculus
gattctcctctgctgtggatgggaa

SEQ ID NO: 521515 - DNA, 25 bp, Mus musculus
gattctcctctggtgtggatgggaa

SEQ ID NO: 521516 - DNA, 25 bp, Mus musculus
gattctcctgagaccagatctgatt

SEQ ID NO: 521517 - DNA, 25 bp, Mus musculus
gattctcctgagtccagatctgatt

SEQ ID NO: 521518 - DNA, 25 bp, Mus musculus
gattctcctggaatcaaagtaaact

SEQ ID NO: 521519 - DNA, 25 bp, Mus musculus
gattctcctggaatttcatttctta

SEQ ID NO: 521520 - DNA, 25 bp, Mus musculus
gattctcctggattcaaagtaaact

SEQ ID NO: 521521 - DNA, 25 bp, Mus musculus
gattctcctggattttcatttctta

SEQ ID NO: 521522 - DNA, 25 bp, Mus musculus
gattctcctgtcatctgagttcagt

SEQ ID NO: 521523 - DNA, 25 bp, Mus musculus
gattctcctgtcttctgagttcagt

SEQ ID NO: 521524 - DNA, 25 bp, Mus musculus
gattctccttgaacagattgtccca

SEQ ID NO: 521525 - DNA, 25 bp, Mus musculus
gattctccttgatcagattgtccca

SEQ ID NO: 521526 - DNA, 25 bp, Mus musculus
gattctcctttaattttcttgccag

SEQ ID NO: 521527 - DNA, 25 bp, Mus musculus
gattctcctttatttttcttgccag

SEQ ID NO: 521528 - DNA, 25 bp, Mus musculus
gattctcggagtaatcccatcaggc

SEQ ID NO: 521529 - DNA, 25 bp, Mus musculus
gattctcggagttatcccatcaggc

SEQ ID NO: 521530 - DNA, 25 bp, Mus musculus
gattctcgtttgacacaagtgccgc

SEQ ID NO: 521531 - DNA, 25 bp, Mus musculus
gattctcgtttgtcacaagtgccgc

SEQ ID NO: 521532 - DNA, 25 bp, Mus musculus
gattctctaaagaagtgggctccag

SEQ ID NO: 521533 - DNA, 25 bp, Mus musculus
gattctctaaagtagtgggctccag

SEQ ID NO: 521534 - DNA, 25 bp, Mus musculus
gattctctaggacatcggttcccaa

SEQ ID NO: 521535 - DNA, 25 bp, Mus musculus
gattctctaggagatcggttcccaa

SEQ ID NO: 521536 - DNA, 25 bp, Mus musculus
gattctctatgaaagctggcttcag

SEQ ID NO: 521537 - DNA, 25 bp, Mus musculus
gattctctatgatagctggcttcag

SEQ ID NO: 521538 - DNA, 25 bp, Mus musculus
gattctctcaacattctttggcact

SEQ ID NO: 521539 - DNA, 25 bp, Mus musculus
gattctctcaactttctttggcact

SEQ ID NO: 521540 - DNA, 25 bp, Mus musculus
gattctctcactctagcattcttgg

SEQ ID NO: 521541 - DNA, 25 bp, Mus musculus
gattctctcactgtagcattcttgg

SEQ ID NO: 521542 - DNA, 25 bp, Mus musculus
gattctctcatcatcaagagcttcc

SEQ ID NO: 521543 - DNA, 25 bp, Mus musculus
gattctctcatcttcaagagcttcc

SEQ ID NO: 521544 - DNA, 25 bp, Mus musculus
gattctctcccacgtaactgtgtct

SEQ ID NO: 521545 - DNA, 25 bp, Mus musculus
gattctctcccaggtaactgtgtct

SEQ ID NO: 521546 - DNA, 25 bp, Mus musculus
gattctctctgcataaatggcttgt

SEQ ID NO: 521547 - DNA, 25 bp, Mus musculus
gattctctctgcttaaatggcttgt

SEQ ID NO: 521548 - DNA, 25 bp, Mus musculus
gattctctgatcaaggagtcaaaga

SEQ ID NO: 521549 - DNA, 25 bp, Mus musculus
gattctctgatctaggagtcaaaga

SEQ ID NO: 521550 - DNA, 25 bp, Mus musculus
gattctctgcaaaaacaatgtctgt

SEQ ID NO: 521551 - DNA, 25 bp, Mus musculus
gattctctgcaataacaatgtctgt

SEQ ID NO: 521552 - DNA, 25 bp, Mus musculus
gattctctgcagctatgttgcttca

SEQ ID NO: 521553 - DNA, 25 bp, Mus musculus
gattctctgcaggtatgttgcttca

SEQ ID NO: 521554 - DNA, 25 bp, Mus musculus
gattctctgcatactgcatctagaa

SEQ ID NO: 521555 - DNA, 25 bp, Mus musculus
gattctctgcattctgcatctagaa

SEQ ID NO: 521556 - DNA, 25 bp, Mus musculus
gattctctggaacatttcgtggaaa

SEQ ID NO: 521557 - DNA, 25 bp, Mus musculus
gattctctggaagatttcgtggaaa

SEQ ID NO: 521558 - DNA, 25 bp, Mus musculus
gattctctggagctcctgcttgtag

SEQ ID NO: 521559 - DNA, 25 bp, Mus musculus
gattctctggaggtcctgcttgtag

SEQ ID NO: 521560 - DNA, 25 bp, Mus musculus
gattctctggtgattgtgttacaac

SEQ ID NO: 521561 - DNA, 25 bp, Mus musculus
gattctctggtgtttgtgttacaac

SEQ ID NO: 521562 - DNA, 25 bp, Mus musculus
gattctctggttctgcttaaagact

SEQ ID NO: 521563 - DNA, 25 bp, Mus musculus
gattctctggttgtgcttaaagact

SEQ ID NO: 521564 - DNA, 25 bp, Mus musculus
gattctctgtatactcatttactga

SEQ ID NO: 521565 - DNA, 25 bp, Mus musculus
gattctctgtattctcatttactga

SEQ ID NO: 521566 - DNA, 25 bp, Mus musculus
gattctctgtttccagacaactcct

SEQ ID NO: 521567 - DNA, 25 bp, Mus musculus
gattctctgtttgcagacaactcct

SEQ ID NO: 521568 - DNA, 25 bp, Mus musculus
gattctcttacacccttaccctgga

SEQ ID NO: 521569 - DNA, 25 bp, Mus musculus
gattctcttacagccttaccctgga

SEQ ID NO: 521570 - DNA, 25 bp, Mus musculus
gattctcttcacagagggacctcaa

SEQ ID NO: 521571 - DNA, 25 bp, Mus musculus
gattctcttcactgagggacctcaa

SEQ ID NO: 521572 - DNA, 25 bp, Mus musculus
gattctcttcctcttctatgaagat

SEQ ID NO: 521573 - DNA, 25 bp, Mus musculus
gattctcttcctgttctatgaagat

SEQ ID NO: 521574 - DNA, 25 bp, Mus musculus
gattctcttgggaccacataatagc

SEQ ID NO: 521575 - DNA, 25 bp, Mus musculus
gattctcttgggtccacataatagc

SEQ ID NO: 521576 - DNA, 25 bp, Mus musculus
gattctcttgtgattttgcaccggc

SEQ ID NO: 521577 - DNA, 25 bp, Mus musculus
gattctcttgtgtttttgcaccggc

SEQ ID NO: 521578 - DNA, 25 bp, Mus musculus
gattctctttgcaccaactgtaaca

SEQ ID NO: 521579 - DNA, 25 bp, Mus musculus
gattctctttgctccaactgtaaca

SEQ ID NO: 521580 - DNA, 25 bp, Mus musculus
gattctgaaaatcgaaccctattaa

SEQ ID NO: 521581 - DNA, 25 bp, Mus musculus
gattctgaaaatggaaccctattaa

SEQ ID NO: 521582 - DNA, 25 bp, Mus musculus
gattctgaaacgattcctcaactca

SEQ ID NO: 521583 - DNA, 25 bp, Mus musculus
gattctgaaacgtttcctcaactca

SEQ ID NO: 521584 - DNA, 25 bp, Mus musculus
gattctgaaataacccggcactgtt

SEQ ID NO: 521585 - DNA, 25 bp, Mus musculus
gattctgaaatatcccggcactgtt

SEQ ID NO: 521586 - DNA, 25 bp, Mus musculus
gattctgaaatcaccttacagtctg

SEQ ID NO: 521587 - DNA, 25 bp, Mus musculus
gattctgaaatctccttacagtctg

SEQ ID NO: 521588 - DNA, 25 bp, Mus musculus
gattctgaaatgatcactaacggat

SEQ ID NO: 521589 - DNA, 25 bp, Mus musculus
gattctgaaatgttcactaacggat

SEQ ID NO: 521590 - DNA, 25 bp, Mus musculus
gattctgaacagatagccgcctgtt

SEQ ID NO: 521591 - DNA, 25 bp, Mus musculus
gattctgaacagctatcacatccga

SEQ ID NO: 521592 - DNA, 25 bp, Mus musculus
gattctgaacaggtatcacatccga

SEQ ID NO: 521593 - DNA, 25 bp, Mus musculus
gattctgaacagttagccgcctgtt

SEQ ID NO: 521594 - DNA, 25 bp, Mus musculus
gattctgaacatacctgtgtctcac

SEQ ID NO: 521595 - DNA, 25 bp, Mus musculus
gattctgaacattcctgtgtctcac

SEQ ID NO: 521596 - DNA, 25 bp, Mus musculus
gattctgaacctcggatctgaacca

SEQ ID NO: 521597 - DNA, 25 bp, Mus musculus
gattctgaacctgggatctgaacca

SEQ ID NO: 521598 - DNA, 25 bp, Mus musculus
gattctgaagtgatgaaacgttact

SEQ ID NO: 521599 - DNA, 25 bp, Mus musculus
gattctgaagtgttgaaacgttact

SEQ ID NO: 521600 - DNA, 25 bp, Mus musculus
gattctgaatatatagcagctcact

SEQ ID NO: 521601 - DNA, 25 bp, Mus musculus
gattctgaatatttagcagctcact

SEQ ID NO: 521602 - DNA, 25 bp, Mus musculus
gattctgaatttatgcccgtgtggt

SEQ ID NO: 521603 - DNA, 25 bp, Mus musculus
gattctgaatttttgcccgtgtggt

SEQ ID NO: 521604 - DNA, 25 bp, Mus musculus
gattctgacaaaattccctgcggat

SEQ ID NO: 521605 - DNA, 25 bp, Mus musculus
gattctgacaaatttccctgcggat

SEQ ID NO: 521606 - DNA, 25 bp, Mus musculus
gattctgacacaaacccgacaagac

SEQ ID NO: 521607 - DNA, 25 bp, Mus musculus
gattctgacacatacccgacaagac

SEQ ID NO: 521608 - DNA, 25 bp, Mus musculus
gattctgacataatcactaacacgg

SEQ ID NO: 521609 - DNA, 25 bp, Mus musculus
gattctgacatattcactaacacgg

SEQ ID NO: 521610 - DNA, 25 bp, Mus musculus
gattctgaccacctccttaagggaa

SEQ ID NO: 521611 - DNA, 25 bp, Mus musculus
gattctgaccacgtccttaagggaa

SEQ ID NO: 521612 - DNA, 25 bp, Mus musculus
gattctgactccacaccaagtagaa

SEQ ID NO: 521613 - DNA, 25 bp, Mus musculus
gattctgactcctcaccaagtagaa

SEQ ID NO: 521614 - DNA, 25 bp, Mus musculus
gattctgactgcactaagtactttg

SEQ ID NO: 521615 - DNA, 25 bp, Mus musculus
gattctgactgcatttgattcctca

SEQ ID NO: 521616 - DNA, 25 bp, Mus musculus
gattctgactgctctaagtactttg

SEQ ID NO: 521617 - DNA, 25 bp, Mus musculus
gattctgactgcttttgattcctca

SEQ ID NO: 521618 - DNA, 25 bp, Mus musculus
gattctgagacactagttgaccaat

SEQ ID NO: 521619 - DNA, 25 bp, Mus musculus
gattctgagacagtagttgaccaat

SEQ ID NO: 521620 - DNA, 25 bp, Mus musculus
gattctgagataatgtttgctccaa

SEQ ID NO: 521621 - DNA, 25 bp, Mus musculus
gattctgagatattgtttgctccaa

SEQ ID NO: 521622 - DNA, 25 bp, Mus musculus
gattctgaggatccatcggcaagcg

SEQ ID NO: 521623 - DNA, 25 bp, Mus musculus
gattctgaggatgcatcggcaagcg

SEQ ID NO: 521624 - DNA, 25 bp, Mus musculus
gattctgagggaccaaccggacaat

SEQ ID NO: 521625 - DNA, 25 bp, Mus musculus
gattctgagggagcaaccggacaat

SEQ ID NO: 521626 - DNA, 25 bp, Mus musculus
gattctgaggtacgaccacaattca

SEQ ID NO: 521627 - DNA, 25 bp, Mus musculus
gattctgaggtactgagctccttgg

SEQ ID NO: 521628 - DNA, 25 bp, Mus musculus
gattctgaggtaggaccacaattca

SEQ ID NO: 521629 - DNA, 25 bp, Mus musculus
gattctgaggtagtgagctccttgg

SEQ ID NO: 521630 - DNA, 25 bp, Mus musculus
gattctgagtatatcttctttgtag

SEQ ID NO: 521631 - DNA, 25 bp, Mus musculus
gattctgagtatttcttctttgtag

SEQ ID NO: 521632 - DNA, 25 bp, Mus musculus
gattctgatagcaaagcgactttag

SEQ ID NO: 521633 - DNA, 25 bp, Mus musculus
gattctgatagctaagcgactttag

SEQ ID NO: 521634 - DNA, 25 bp, Mus musculus
gattctgatcaaaaggcaccttggc

SEQ ID NO: 521635 - DNA, 25 bp, Mus musculus
gattctgatcaataggcaccttggc

SEQ ID NO: 521636 - DNA, 25 bp, Mus musculus
gattctgatcccatgttcttcatct

SEQ ID NO: 521637 - DNA, 25 bp, Mus musculus
gattctgatcccttgttcttcatct

SEQ ID NO: 521638 - DNA, 25 bp, Mus musculus
gattctgatctcaacgagatcccta

SEQ ID NO: 521639 - DNA, 25 bp, Mus musculus
gattctgatctcaatgcttgtgtga

SEQ ID NO: 521640 - DNA, 25 bp, Mus musculus
gattctgatctcagacctcccattt

SEQ ID NO: 521641 - DNA, 25 bp, Mus musculus
gattctgatctctacgagatcccta

SEQ ID NO: 521642 - DNA, 25 bp, Mus musculus
gattctgatctctatgcttgtgtga

SEQ ID NO: 521643 - DNA, 25 bp, Mus musculus
gattctgatctctgacctcccattt

SEQ ID NO: 521644 - DNA, 25 bp, Mus musculus
gattctgatctgatttcccaaaagt

SEQ ID NO: 521645 - DNA, 25 bp, Mus musculus
gattctgatctgttttcccaaaagt

SEQ ID NO: 521646 - DNA, 25 bp, Mus musculus
gattctgatgacactctgaccaaaa

SEQ ID NO: 521647 - DNA, 25 bp, Mus musculus
gattctgatgactctctgaccaaaa

SEQ ID NO: 521648 - DNA, 25 bp, Mus musculus
gattctgatgagacctacgttccca

SEQ ID NO: 521649 - DNA, 25 bp, Mus musculus
gattctgatgagatgatgtggccat

SEQ ID NO: 521650 - DNA, 25 bp, Mus musculus
gattctgatgagtcctacgttccca

SEQ ID NO: 521651 - DNA, 25 bp, Mus musculus
gattctgatgagttgatgtggccat

SEQ ID NO: 521652 - DNA, 25 bp, Mus musculus
gattctgattccatttgtcttgggt

SEQ ID NO: 521653 - DNA, 25 bp, Mus musculus
gattctgattccttttgtcttgggt

SEQ ID NO: 521654 - DNA, 25 bp, Mus musculus
gattctgattgcctgggagatagct

SEQ ID NO: 521655 - DNA, 25 bp, Mus musculus
gattctgattgcgtgggagatagct

SEQ ID NO: 521656 - DNA, 25 bp, Mus musculus
gattctgcacgaccttctttgaaga

SEQ ID NO: 521657 - DNA, 25 bp, Mus musculus
gattctgcacgagcttctttgaaga

SEQ ID NO: 521658 - DNA, 25 bp, Mus musculus
gattctgcagagatccacactttga

SEQ ID NO: 521659 - DNA, 25 bp, Mus musculus
gattctgcagagttccacactttga

SEQ ID NO: 521660 - DNA, 25 bp, Mus musculus
gattctgcagcaatgtttgatattt

SEQ ID NO: 521661 - DNA, 25 bp, Mus musculus
gattctgcagcattgtttgatattt

SEQ ID NO: 521662 - DNA, 25 bp, Mus musculus
gattctgcagctaaaatttaggacc

SEQ ID NO: 521663 - DNA, 25 bp, Mus musculus
gattctgcagcttaaatttaggacc

SEQ ID NO: 521664 - DNA, 25 bp, Mus musculus
gattctgcataactgctcctttctg

SEQ ID NO: 521665 - DNA, 25 bp, Mus musculus
gattctgcataagtgctcctttctg

SEQ ID NO: 521666 - DNA, 25 bp, Mus musculus
gattctgcatagattgatcccactc

SEQ ID NO: 521667 - DNA, 25 bp, Mus musculus
gattctgcatagtttgatcccactc

SEQ ID NO: 521668 - DNA, 25 bp, Mus musculus
gattctgccaaacctttgtgctagc

SEQ ID NO: 521669 - DNA, 25 bp, Mus musculus
gattctgccaaagctttgtgctagc

SEQ ID NO: 521670 - DNA, 25 bp, Mus musculus
gattctgcccagactcagtatggta

SEQ ID NO: 521671 - DNA, 25 bp, Mus musculus
gattctgcccagtctcagtatggta

SEQ ID NO: 521672 - DNA, 25 bp, Mus musculus
gattctgccctgaaacatagtacca

SEQ ID NO: 521673 - DNA, 25 bp, Mus musculus
gattctgccctgtaacatagtacca

SEQ ID NO: 521674 - DNA, 25 bp, Mus musculus
gattctgcctccctttacacagagc

SEQ ID NO: 521675 - DNA, 25 bp, Mus musculus
gattctgcctccgtttacacagagc

SEQ ID NO: 521676 - DNA, 25 bp, Mus musculus
gattctgcctgtactaaagttgtca

SEQ ID NO: 521677 - DNA, 25 bp, Mus musculus
gattctgcctgttctaaagttgtca

SEQ ID NO: 521678 - DNA, 25 bp, Mus musculus
gattctgcgaaaatgttactgagct

SEQ ID NO: 521679 - DNA, 25 bp, Mus musculus
gattctgcgaaattgttactgagct

SEQ ID NO: 521680 - DNA, 25 bp, Mus musculus
gattctgcgacacgcagctgaacct

SEQ ID NO: 521681 - DNA, 25 bp, Mus musculus
gattctgcgacaggcagctgaacct

SEQ ID NO: 521682 - DNA, 25 bp, Mus musculus
gattctgcgataatgtttggacttt

SEQ ID NO: 521683 - DNA, 25 bp, Mus musculus
gattctgcgatattgtttggacttt

SEQ ID NO: 521684 - DNA, 25 bp, Mus musculus
gattctgcgttgacaatggagccat

SEQ ID NO: 521685 - DNA, 25 bp, Mus musculus
gattctgcgttgtcaatggagccat

SEQ ID NO: 521686 - DNA, 25 bp, Mus musculus
gattctgctaaactgcctactgcaa

SEQ ID NO: 521687 - DNA, 25 bp, Mus musculus
gattctgctaaagtgcctactgcaa

SEQ ID NO: 521688 - DNA, 25 bp, Mus musculus
gattctgctaccaatagaaaccagt

SEQ ID NO: 521689 - DNA, 25 bp, Mus musculus
gattctgctacctatagaaaccagt

SEQ ID NO: 521690 - DNA, 25 bp, Mus musculus
gattctgctagccttaggatttctc

SEQ ID NO: 521691 - DNA, 25 bp, Mus musculus
gattctgctagcgttaggatttctc

SEQ ID NO: 521692 - DNA, 25 bp, Mus musculus
gattctgctcaacccctgaaaaatg

SEQ ID NO: 521693 - DNA, 25 bp, Mus musculus
gattctgctcaagccctgaaaaatg

SEQ ID NO: 521694 - DNA, 25 bp, Mus musculus
gattctgctggactgttctgcattc

SEQ ID NO: 521695 - DNA, 25 bp, Mus musculus
gattctgctggagtgttctgcattc

SEQ ID NO: 521696 - DNA, 25 bp, Mus musculus
gattctgcttataatgggttatcca

SEQ ID NO: 521697 - DNA, 25 bp, Mus musculus
gattctgcttattatgggttatcca

SEQ ID NO: 521698 - DNA, 25 bp, Mus musculus
gattctgcttctaatcgtctatgaa

SEQ ID NO: 521699 - DNA, 25 bp, Mus musculus
gattctgcttcttatcgtctatgaa

SEQ ID NO: 521700 - DNA, 25 bp, Mus musculus
gattctgcttgtctgttttgaccat

SEQ ID NO: 521701 - DNA, 25 bp, Mus musculus
gattctgcttgtgtgttttgaccat

SEQ ID NO: 521702 - DNA, 25 bp, Mus musculus
gattctggaaagagagcctccccat

SEQ ID NO: 521703 - DNA, 25 bp, Mus musculus
gattctggaaagtgagcctccccat

SEQ ID NO: 521704 - DNA, 25 bp, Mus musculus
gattctggaacactccaaggccctg

SEQ ID NO: 521705 - DNA, 25 bp, Mus musculus
gattctggaacagtccaaggccctg

SEQ ID NO: 521706 - DNA, 25 bp, Mus musculus
gattctggaatcatgaacatggagt

SEQ ID NO: 521707 - DNA, 25 bp, Mus musculus
gattctggaatcttgaacatggagt

SEQ ID NO: 521708 - DNA, 25 bp, Mus musculus
gattctggaccaatcgggatccaac

SEQ ID NO: 521709 - DNA, 25 bp, Mus musculus
gattctggaccattcgggatccaac

SEQ ID NO: 521710 - DNA, 25 bp, Mus musculus
gattctggagaaaacaactacgatc

SEQ ID NO: 521711 - DNA, 25 bp, Mus musculus
gattctggagaatacaactacgatc

SEQ ID NO: 521712 - DNA, 25 bp, Mus musculus
gattctggatgaagttcaggacaat

SEQ ID NO: 521713 - DNA, 25 bp, Mus musculus
gattctggatgatgttcaggacaat

SEQ ID NO: 521714 - DNA, 25 bp, Mus musculus
gattctggcaaacatgtaggtgcga

SEQ ID NO: 521715 - DNA, 25 bp, Mus musculus
gattctggcaaagatgtaggtgcga

SEQ ID NO: 521716 - DNA, 25 bp, Mus musculus
gattctggcaagactagaccagggc

SEQ ID NO: 521717 - DNA, 25 bp, Mus musculus
gattctggcaagtctagaccagggc

SEQ ID NO: 521718 - DNA, 25 bp, Mus musculus
gattctggcagccatgaagatttcc

SEQ ID NO: 521719 - DNA, 25 bp, Mus musculus
gattctggcagcgatgaagatttcc

SEQ ID NO: 521720 - DNA, 25 bp, Mus musculus
gattctggcatcaggaacttcttga

SEQ ID NO: 521721 - DNA, 25 bp, Mus musculus
gattctggcatctggaacttcttga

SEQ ID NO: 521722 - DNA, 25 bp, Mus musculus
gattctggcattagtttctcgctca

SEQ ID NO: 521723 - DNA, 25 bp, Mus musculus
gattctggcatttgtttctcgctca

SEQ ID NO: 521724 - DNA, 25 bp, Mus musculus
gattctggcctaattcaggctgttt

SEQ ID NO: 521725 - DNA, 25 bp, Mus musculus
gattctggcctatttcaggctgttt

SEQ ID NO: 521726 - DNA, 25 bp, Mus musculus
gattctggcgagacagcgttctggc

SEQ ID NO: 521727 - DNA, 25 bp, Mus musculus
gattctggcgagtcagcgttctggc

SEQ ID NO: 521728 - DNA, 25 bp, Mus musculus
gattctggcttaactgtaactctgg

SEQ ID NO: 521729 - DNA, 25 bp, Mus musculus
gattctggcttatctgtaactctgg

SEQ ID NO: 521730 - DNA, 25 bp, Mus musculus
gattctgggaagatcacttgttact

SEQ ID NO: 521731 - DNA, 25 bp, Mus musculus
gattctgggaagttcacttgttact

SEQ ID NO: 521732 - DNA, 25 bp, Mus musculus
gattctgggacacaagtctctcttt

SEQ ID NO: 521733 - DNA, 25 bp, Mus musculus
gattctgggacagaagtctctcttt

SEQ ID NO: 521734 - DNA, 25 bp, Mus musculus
gattctgggagcaacacaagtacaa

SEQ ID NO: 521735 - DNA, 25 bp, Mus musculus
gattctgggagctacacaagtacaa

SEQ ID NO: 521736 - DNA, 25 bp, Mus musculus
gattctgggagtatgaacccaacct

SEQ ID NO: 521737 - DNA, 25 bp, Mus musculus
gattctgggagtttgaacccaacct

SEQ ID NO: 521738 - DNA, 25 bp, Mus musculus
gattctgggtcacttctcaacacta

SEQ ID NO: 521739 - DNA, 25 bp, Mus musculus
gattctgggtcagttctcaacacta

SEQ ID NO: 521740 - DNA, 25 bp, Mus musculus
gattctggtaaaaggtcttgtgccc

SEQ ID NO: 521741 - DNA, 25 bp, Mus musculus
gattctggtaaatggtcttgtgccc

SEQ ID NO: 521742 - DNA, 25 bp, Mus musculus
gattctggtacccatcagtgtgctt

SEQ ID NO: 521743 - DNA, 25 bp, Mus musculus
gattctggtaccgatcagtgtgctt

SEQ ID NO: 521744 - DNA, 25 bp, Mus musculus
gattctggtagcacagatctttggt

SEQ ID NO: 521745 - DNA, 25 bp, Mus musculus
gattctggtagctcagatctttggt

SEQ ID NO: 521746 - DNA, 25 bp, Mus musculus
gattctggtctaagagctcctaacg

SEQ ID NO: 521747 - DNA, 25 bp, Mus musculus
gattctggtctatgagctcctaacg

SEQ ID NO: 521748 - DNA, 25 bp, Mus musculus
gattctggtgaaaggcatccgccac

SEQ ID NO: 521749 - DNA, 25 bp, Mus musculus
gattctggtgaatggcatccgccac

SEQ ID NO: 521750 - DNA, 25 bp, Mus musculus
gattctggttatacacaggcttcag

SEQ ID NO: 521751 - DNA, 25 bp, Mus musculus
gattctggttattcacaggcttcag

SEQ ID NO: 521752 - DNA, 25 bp, Mus musculus
gattctggttgaattgctgtgttga

SEQ ID NO: 521753 - DNA, 25 bp, Mus musculus
gattctggttgatttgctgtgttga

SEQ ID NO: 521754 - DNA, 25 bp, Mus musculus
gattctgtaacacttctgagttttg

SEQ ID NO: 521755 - DNA, 25 bp, Mus musculus
gattctgtaacagttctgagttttg

SEQ ID NO: 521756 - DNA, 25 bp, Mus musculus
gattctgtaagaagcataaacttga

SEQ ID NO: 521757 - DNA, 25 bp, Mus musculus
gattctgtaagatgcataaacttga

SEQ ID NO: 521758 - DNA, 25 bp, Mus musculus
gattctgtaataaagttccactggg

SEQ ID NO: 521759 - DNA, 25 bp, Mus musculus
gattctgtaatatagttccactggg

SEQ ID NO: 521760 - DNA, 25 bp, Mus musculus
gattctgtacagcagtgaggcctaa

SEQ ID NO: 521761 - DNA, 25 bp, Mus musculus
gattctgtacaggagtgaggcctaa

SEQ ID NO: 521762 - DNA, 25 bp, Mus musculus
gattctgtacctcgtaaaacctaga

SEQ ID NO: 521763 - DNA, 25 bp, Mus musculus
gattctgtacctggtaaaacctaga

SEQ ID NO: 521764 - DNA, 25 bp, Mus musculus
gattctgtactcatagctgttaaaa

SEQ ID NO: 521765 - DNA, 25 bp, Mus musculus
gattctgtactcttagctgttaaaa

SEQ ID NO: 521766 - DNA, 25 bp, Mus musculus
gattctgtatacagtagacttagtt

SEQ ID NO: 521767 - DNA, 25 bp, Mus musculus
gattctgtatactgtagacttagtt

SEQ ID NO: 521768 - DNA, 25 bp, Mus musculus
gattctgtatgcctgtatacttggc

SEQ ID NO: 521769 - DNA, 25 bp, Mus musculus
gattctgtatgcgtgtatacttggc

SEQ ID NO: 521770 - DNA, 25 bp, Mus musculus
gattctgtattcattcgctacttga

SEQ ID NO: 521771 - DNA, 25 bp, Mus musculus
gattctgtattctttcgctacttga

SEQ ID NO: 521772 - DNA, 25 bp, Mus musculus
gattctgtcaaacccaatcttgtaa

SEQ ID NO: 521773 - DNA, 25 bp, Mus musculus
gattctgtcaaagccaatcttgtaa

SEQ ID NO: 521774 - DNA, 25 bp, Mus musculus
gattctgtcattcgaggacctcatt

SEQ ID NO: 521775 - DNA, 25 bp, Mus musculus
gattctgtcattggaggacctcatt

SEQ ID NO: 521776 - DNA, 25 bp, Mus musculus
gattctgtccagagaccactcggcc

SEQ ID NO: 521777 - DNA, 25 bp, Mus musculus
gattctgtccagtgaccactcggcc

SEQ ID NO: 521778 - DNA, 25 bp, Mus musculus
gattctgtccggcagattctgtcag

SEQ ID NO: 521779 - DNA, 25 bp, Mus musculus
gattctgtccgggagattctgtcag

SEQ ID NO: 521780 - DNA, 25 bp, Mus musculus
gattctgtctgtaagggctcacaca

SEQ ID NO: 521781 - DNA, 25 bp, Mus musculus
gattctgtctgttagggctcacaca

SEQ ID NO: 521782 - DNA, 25 bp, Mus musculus
gattctgtgagtctcattctttaag

SEQ ID NO: 521783 - DNA, 25 bp, Mus musculus
gattctgtgagtgtcattctttaag

SEQ ID NO: 521784 - DNA, 25 bp, Mus musculus
gattctgtgatcacatggtgtgcag

SEQ ID NO: 521785 - DNA, 25 bp, Mus musculus
gattctgtgatctcatggtgtgcag

SEQ ID NO: 521786 - DNA, 25 bp, Mus musculus
gattctgtgcccattgtaggtaact

SEQ ID NO: 521787 - DNA, 25 bp, Mus musculus
gattctgtgccctttgtaggtaact

SEQ ID NO: 521788 - DNA, 25 bp, Mus musculus
gattctgtgcttacgatgtagtccc

SEQ ID NO: 521789 - DNA, 25 bp, Mus musculus
gattctgtgctttcgatgtagtccc

SEQ ID NO: 521790 - DNA, 25 bp, Mus musculus
gattctgtgtttacctgggagattt

SEQ ID NO: 521791 - DNA, 25 bp, Mus musculus
gattctgtgtttctagcacctgtga

SEQ ID NO: 521792 - DNA, 25 bp, Mus musculus
gattctgtgtttgtagcacctgtga

SEQ ID NO: 521793 - DNA, 25 bp, Mus musculus
gattctgtgttttcctgggagattt

SEQ ID NO: 521794 - DNA, 25 bp, Mus musculus
gattctgttagacggaggaaacctt

SEQ ID NO: 521795 - DNA, 25 bp, Mus musculus
gattctgttagagggaggaaacctt

SEQ ID NO: 521796 - DNA, 25 bp, Mus musculus
gattctgttagcagaatgctttcca

SEQ ID NO: 521797 - DNA, 25 bp, Mus musculus
gattctgttagctgaatgctttcca

SEQ ID NO: 521798 - DNA, 25 bp, Mus musculus
gattctgttaggcagttatattgct

SEQ ID NO: 521799 - DNA, 25 bp, Mus musculus
gattctgttagggagttatattgct

SEQ ID NO: 521800 - DNA, 25 bp, Mus musculus
gattctgttcagcactcattgcact

SEQ ID NO: 521801 - DNA, 25 bp, Mus musculus
gattctgttcaggactcattgcact

SEQ ID NO: 521802 - DNA, 25 bp, Mus musculus
gattctgttctacctttcagtactg

SEQ ID NO: 521803 - DNA, 25 bp, Mus musculus
gattctgttctagctttcagtactg

SEQ ID NO: 521804 - DNA, 25 bp, Mus musculus
gattctgttgagcatgggctctgaa

SEQ ID NO: 521805 - DNA, 25 bp, Mus musculus
gattctgttgaggatgggctctgaa

SEQ ID NO: 521806 - DNA, 25 bp, Mus musculus
gattctgttgccatttgtgtaaata

SEQ ID NO: 521807 - DNA, 25 bp, Mus musculus
gattctgttgccttttgtgtaaata

SEQ ID NO: 521808 - DNA, 25 bp, Mus musculus
gattctgttgctacaaaccttgata

SEQ ID NO: 521809 - DNA, 25 bp, Mus musculus
gattctgttgcttcaaaccttgata

SEQ ID NO: 521810 - DNA, 25 bp, Mus musculus
gattctgttgtgactgcagacaaca

SEQ ID NO: 521811 - DNA, 25 bp, Mus musculus
gattctgttgtgtctgcagacaaca

SEQ ID NO: 521812 - DNA, 25 bp, Mus musculus
gattctgtttatactctggcacaat

SEQ ID NO: 521813 - DNA, 25 bp, Mus musculus
gattctgtttattctctggcacaat

SEQ ID NO: 521814 - DNA, 25 bp, Mus musculus
gattctgtttgaacgaagatgtcca

SEQ ID NO: 521815 - DNA, 25 bp, Mus musculus
gattctgtttgatcgaagatgtcca

SEQ ID NO: 521816 - DNA, 25 bp, Mus musculus
gattctgtttttcgaaagattttat

SEQ ID NO: 521817 - DNA, 25 bp, Mus musculus
gattctgtttttggaaagattttat

SEQ ID NO: 521818 - DNA, 25 bp, Mus musculus
gattcttaatctctagttctttgtt

SEQ ID NO: 521819 - DNA, 25 bp, Mus musculus
gattcttaatctgtagttctttgtt

SEQ ID NO: 521820 - DNA, 25 bp, Mus musculus
gattcttacataacatggaggatga

SEQ ID NO: 521821 - DNA, 25 bp, Mus musculus
gattcttacatatcatggaggatga

SEQ ID NO: 521822 - DNA, 25 bp, Mus musculus
gattcttaccaactccagttgttat

SEQ ID NO: 521823 - DNA, 25 bp, Mus musculus
gattcttaccaagtccagttgttat

SEQ ID NO: 521824 - DNA, 25 bp, Mus musculus
gattcttacccactacatggtggct

SEQ ID NO: 521825 - DNA, 25 bp, Mus musculus
gattcttacccagtacatggtggct

SEQ ID NO: 521826 - DNA, 25 bp, Mus musculus
gattcttaccgaaggactctattga

SEQ ID NO: 521827 - DNA, 25 bp, Mus musculus
gattcttaccgatggactctattga

SEQ ID NO: 521828 - DNA, 25 bp, Mus musculus
gattcttacctcctacatgttgttt

SEQ ID NO: 521829 - DNA, 25 bp, Mus musculus
gattcttacctcgtacatgttgttt

SEQ ID NO: 521830 - DNA, 25 bp, Mus musculus
gattcttactaaatgccagtctcat

SEQ ID NO: 521831 - DNA, 25 bp, Mus musculus
gattcttactaattgccagtctcat

SEQ ID NO: 521832 - DNA, 25 bp, Mus musculus
gattcttactggagacacacattac

SEQ ID NO: 521833 - DNA, 25 bp, Mus musculus
gattcttactggtgacacacattac

SEQ ID NO: 521834 - DNA, 25 bp, Mus musculus
gattcttactgtatgatggtcatct

SEQ ID NO: 521835 - DNA, 25 bp, Mus musculus
gattcttactgtttgatggtcatct

SEQ ID NO: 521836 - DNA, 25 bp, Mus musculus
gattcttactttcgccaacgtggac

SEQ ID NO: 521837 - DNA, 25 bp, Mus musculus
gattcttactttggccaacgtggac

SEQ ID NO: 521838 - DNA, 25 bp, Mus musculus
gattcttagaacatggcactatctt

SEQ ID NO: 521839 - DNA, 25 bp, Mus musculus
gattcttagaacttggcactatctt

SEQ ID NO: 521840 - DNA, 25 bp, Mus musculus
gattcttagcaaaagacatagtctt

SEQ ID NO: 521841 - DNA, 25 bp, Mus musculus
gattcttagcaatagacatagtctt

SEQ ID NO: 521842 - DNA, 25 bp, Mus musculus
gattcttaggacattttattcagtg

SEQ ID NO: 521843 - DNA, 25 bp, Mus musculus
gattcttaggactttttattcagtg

SEQ ID NO: 521844 - DNA, 25 bp, Mus musculus
gattcttagtatcactttccgagag

SEQ ID NO: 521845 - DNA, 25 bp, Mus musculus
gattcttagtatgactttccgagag

SEQ ID NO: 521846 - DNA, 25 bp, Mus musculus
gattcttataaaatcagagcccttg

SEQ ID NO: 521847 - DNA, 25 bp, Mus musculus
gattcttataaattcagagcccttg

SEQ ID NO: 521848 - DNA, 25 bp, Mus musculus
gattcttatatcagtcactctatct

SEQ ID NO: 521849 - DNA, 25 bp, Mus musculus
gattcttatatctgtcactctatct

SEQ ID NO: 521850 - DNA, 25 bp, Mus musculus
gattcttatcataggctgtctggta

SEQ ID NO: 521851 - DNA, 25 bp, Mus musculus
gattcttatcattggctgtctggta

SEQ ID NO: 521852 - DNA, 25 bp, Mus musculus
gattcttatctaatactactttcta

SEQ ID NO: 521853 - DNA, 25 bp, Mus musculus
gattcttatctattactactttcta

SEQ ID NO: 521854 - DNA, 25 bp, Mus musculus
gattcttatgtgacgttcctgacta

SEQ ID NO: 521855 - DNA, 25 bp, Mus musculus
gattcttatgtgtcgttcctgacta

SEQ ID NO: 521856 - DNA, 25 bp, Mus musculus
gattcttcaaatcaagttctcgagt

SEQ ID NO: 521857 - DNA, 25 bp, Mus musculus
gattcttcaaatcactaccagggca

SEQ ID NO: 521858 - DNA, 25 bp, Mus musculus
gattcttcaaatgaagttctcgagt

SEQ ID NO: 521859 - DNA, 25 bp, Mus musculus
gattcttcaaatgactaccagggca

SEQ ID NO: 521860 - DNA, 25 bp, Mus musculus
gattcttcatccacagtgatggtgt

SEQ ID NO: 521861 - DNA, 25 bp, Mus musculus
gattcttcatcctcagtgatggtgt

SEQ ID NO: 521862 - DNA, 25 bp, Mus musculus
gattcttcatggaatccttacccag

SEQ ID NO: 521863 - DNA, 25 bp, Mus musculus
gattcttcatggtatccttacccag

SEQ ID NO: 521864 - DNA, 25 bp, Mus musculus
gattcttccagcactttgtgtatta

SEQ ID NO: 521865 - DNA, 25 bp, Mus musculus
gattcttccagctctttgtgtatta

SEQ ID NO: 521866 - DNA, 25 bp, Mus musculus
gattcttccagtattctgtgtgctg

SEQ ID NO: 521867 - DNA, 25 bp, Mus musculus
gattcttccagttttctgtgtgctg

SEQ ID NO: 521868 - DNA, 25 bp, Mus musculus
gattcttccattacttccgttacta

SEQ ID NO: 521869 - DNA, 25 bp, Mus musculus
gattcttccatttcttccgttacta

SEQ ID NO: 521870 - DNA, 25 bp, Mus musculus
gattcttcctccagaatgaggtttt

SEQ ID NO: 521871 - DNA, 25 bp, Mus musculus
gattcttcctcctgaatgaggtttt

SEQ ID NO: 521872 - DNA, 25 bp, Mus musculus
gattcttctaacattcctatgctaa

SEQ ID NO: 521873 - DNA, 25 bp, Mus musculus
gattcttctaactttcctatgctaa

SEQ ID NO: 521874 - DNA, 25 bp, Mus musculus
gattcttctcacctgatcggcttaa

SEQ ID NO: 521875 - DNA, 25 bp, Mus musculus
gattcttctcacgtgatcggcttaa

SEQ ID NO: 521876 - DNA, 25 bp, Mus musculus
gattcttcttcaccttgttctctga

SEQ ID NO: 521877 - DNA, 25 bp, Mus musculus
gattcttcttcagcttgttctctga

SEQ ID NO: 521878 - DNA, 25 bp, Mus musculus
gattcttcttctcattgacattgag

SEQ ID NO: 521879 - DNA, 25 bp, Mus musculus
gattcttcttctgattgacattgag

SEQ ID NO: 521880 - DNA, 25 bp, Mus musculus
gattcttgaaccctgaagcaaacct

SEQ ID NO: 521881 - DNA, 25 bp, Mus musculus
gattcttgaaccgtgaagcaaacct

SEQ ID NO: 521882 - DNA, 25 bp, Mus musculus
gattcttgaattcccacacagttaa

SEQ ID NO: 521883 - DNA, 25 bp, Mus musculus
gattcttgaattgccacacagttaa

SEQ ID NO: 521884 - DNA, 25 bp, Mus musculus
gattcttgacagctgcgtaaaccta

SEQ ID NO: 521885 - DNA, 25 bp, Mus musculus
gattcttgacaggtgcgtaaaccta

SEQ ID NO: 521886 - DNA, 25 bp, Mus musculus
gattcttgacctcggtatctgcagt

SEQ ID NO: 521887 - DNA, 25 bp, Mus musculus
gattcttgacctgggtatctgcagt

SEQ ID NO: 521888 - DNA, 25 bp, Mus musculus
gattcttgatctctgcaagggcact

SEQ ID NO: 521889 - DNA, 25 bp, Mus musculus
gattcttgatctgtgcaagggcact

SEQ ID NO: 521890 - DNA, 25 bp, Mus musculus
gattcttgatttaccatgattccaa

SEQ ID NO: 521891 - DNA, 25 bp, Mus musculus
gattcttgattttccatgattccaa

SEQ ID NO: 521892 - DNA, 25 bp, Mus musculus
gattcttgcaatctatgtgccttat

SEQ ID NO: 521893 - DNA, 25 bp, Mus musculus
gattcttgcaatgtatgtgccttat

SEQ ID NO: 521894 - DNA, 25 bp, Mus musculus
gattcttgcaccatagaccagccaa

SEQ ID NO: 521895 - DNA, 25 bp, Mus musculus
gattcttgcaccttagaccagccaa

SEQ ID NO: 521896 - DNA, 25 bp, Mus musculus
gattcttgcatacagaaattttcaa

SEQ ID NO: 521897 - DNA, 25 bp, Mus musculus
gattcttgcatagagaaattttcaa

SEQ ID NO: 521898 - DNA, 25 bp, Mus musculus
gattcttgccacagtttccagtaaa

SEQ ID NO: 521899 - DNA, 25 bp, Mus musculus
gattcttgccactgtttccagtaaa

SEQ ID NO: 521900 - DNA, 25 bp, Mus musculus
gattcttgccatccatatattcaac

SEQ ID NO: 521901 - DNA, 25 bp, Mus musculus
gattcttgccatgcatatattcaac

SEQ ID NO: 521902 - DNA, 25 bp, Mus musculus
gattcttgcgacagtggataccata

SEQ ID NO: 521903 - DNA, 25 bp, Mus musculus
gattcttgcgactgtggataccata

SEQ ID NO: 521904 - DNA, 25 bp, Mus musculus
gattcttgctccattcatggtggta

SEQ ID NO: 521905 - DNA, 25 bp, Mus musculus
gattcttgctcctttcatggtggta

SEQ ID NO: 521906 - DNA, 25 bp, Mus musculus
gattcttgctgactttgactacaca

SEQ ID NO: 521907 - DNA, 25 bp, Mus musculus
gattcttgctgagtttgactacaca

SEQ ID NO: 521908 - DNA, 25 bp, Mus musculus
gattcttgctgcctggctataccag

SEQ ID NO: 521909 - DNA, 25 bp, Mus musculus
gattcttgctgcgtggctataccag

SEQ ID NO: 521910 - DNA, 25 bp, Mus musculus
gattcttgcttcaccaaattccgag

SEQ ID NO: 521911 - DNA, 25 bp, Mus musculus
gattcttgcttcctaaaagcgccag

SEQ ID NO: 521912 - DNA, 25 bp, Mus musculus
gattcttgcttcgtaaaagcgccag

SEQ ID NO: 521913 - DNA, 25 bp, Mus musculus
gattcttgcttctccaaattccgag

SEQ ID NO: 521914 - DNA, 25 bp, Mus musculus
gattcttggaatcgtcttatttatt

SEQ ID NO: 521915 - DNA, 25 bp, Mus musculus
gattcttggaatggtcttatttatt

SEQ ID NO: 521916 - DNA, 25 bp, Mus musculus
gattcttggcaaccaggttgttata

SEQ ID NO: 521917 - DNA, 25 bp, Mus musculus
gattcttggcaagcaggttgttata

SEQ ID NO: 521918 - DNA, 25 bp, Mus musculus
gattcttggcagatgcagggataaa

SEQ ID NO: 521919 - DNA, 25 bp, Mus musculus
gattcttggcagttgcagggataaa

SEQ ID NO: 521920 - DNA, 25 bp, Mus musculus
gattcttggccaccctaaggcgcat

SEQ ID NO: 521921 - DNA, 25 bp, Mus musculus
gattcttggccagcctaaggcgcat

SEQ ID NO: 521922 - DNA, 25 bp, Mus musculus
gattcttggcctagctcacataaaa

SEQ ID NO: 521923 - DNA, 25 bp, Mus musculus
gattcttggccttgctcacataaaa

SEQ ID NO: 521924 - DNA, 25 bp, Mus musculus
gattcttggtcaatttggttgtgta

SEQ ID NO: 521925 - DNA, 25 bp, Mus musculus
gattcttggtcattttggttgtgta

SEQ ID NO: 521926 - DNA, 25 bp, Mus musculus
gattcttggttgatcacccttcaat

SEQ ID NO: 521927 - DNA, 25 bp, Mus musculus
gattcttggttgttcacccttcaat

SEQ ID NO: 521928 - DNA, 25 bp, Mus musculus
gattcttgtatcaacctggttacag

SEQ ID NO: 521929 - DNA, 25 bp, Mus musculus
gattcttgtatctacctggttacag

SEQ ID NO: 521930 - DNA, 25 bp, Mus musculus
gattcttgtcatagctgaccattgt

SEQ ID NO: 521931 - DNA, 25 bp, Mus musculus
gattcttgtcattgctgaccattgt

SEQ ID NO: 521932 - DNA, 25 bp, Mus musculus
gattcttgtggaaacttgacaggga

SEQ ID NO: 521933 - DNA, 25 bp, Mus musculus
gattcttgtggatacttgacaggga

SEQ ID NO: 521934 - DNA, 25 bp, Mus musculus
gattcttgtggtacgaactgacctt

SEQ ID NO: 521935 - DNA, 25 bp, Mus musculus
gattcttgtggttcgaactgacctt

SEQ ID NO: 521936 - DNA, 25 bp, Mus musculus
gattcttgtgttctaggctcgatac

SEQ ID NO: 521937 - DNA, 25 bp, Mus musculus
gattcttgtgttgtaggctcgatac

SEQ ID NO: 521938 - DNA, 25 bp, Mus musculus
gattcttgttacacattgaaaatac

SEQ ID NO: 521939 - DNA, 25 bp, Mus musculus
gattcttgttactcattgaaaatac

SEQ ID NO: 521940 - DNA, 25 bp, Mus musculus
gattcttgttccagtgatgtacaca

SEQ ID NO: 521941 - DNA, 25 bp, Mus musculus
gattcttgttcctgtgatgtacaca

SEQ ID NO: 521942 - DNA, 25 bp, Mus musculus
gattcttgtttgctggattcccatt

SEQ ID NO: 521943 - DNA, 25 bp, Mus musculus
gattcttgtttggtggattcccatt

SEQ ID NO: 521944 - DNA, 25 bp, Mus musculus
gattctttaaacacctgagccttgg

SEQ ID NO: 521945 - DNA, 25 bp, Mus musculus
gattctttaaactcctgagccttgg

SEQ ID NO: 521946 - DNA, 25 bp, Mus musculus
gattctttaaatcgtgttatcttca

SEQ ID NO: 521947 - DNA, 25 bp, Mus musculus
gattctttaaatggtgttatcttca

SEQ ID NO: 521948 - DNA, 25 bp, Mus musculus
gattctttaagactgacctggagtc

SEQ ID NO: 521949 - DNA, 25 bp, Mus musculus
gattctttaagagtgacctggagtc

SEQ ID NO: 521950 - DNA, 25 bp, Mus musculus
gattctttaagcatccaactccaca

SEQ ID NO: 521951 - DNA, 25 bp, Mus musculus
gattctttaagcttccaactccaca

SEQ ID NO: 521952 - DNA, 25 bp, Mus musculus
gattctttagacaatgcctttttct

SEQ ID NO: 521953 - DNA, 25 bp, Mus musculus
gattctttagactatgcctttttct

SEQ ID NO: 521954 - DNA, 25 bp, Mus musculus
gattctttagccctaacaaatagtt

SEQ ID NO: 521955 - DNA, 25 bp, Mus musculus
gattctttagccgtaacaaatagtt

SEQ ID NO: 521956 - DNA, 25 bp, Mus musculus
gattctttaggaccaagtgccatag

SEQ ID NO: 521957 - DNA, 25 bp, Mus musculus
gattctttaggagcaagtgccatag

SEQ ID NO: 521958 - DNA, 25 bp, Mus musculus
gattctttagggaactcctgacgtc

SEQ ID NO: 521959 - DNA, 25 bp, Mus musculus
gattctttagggtactcctgacgtc

SEQ ID NO: 521960 - DNA, 25 bp, Mus musculus
gattctttatgactcttgccctaag

SEQ ID NO: 521961 - DNA, 25 bp, Mus musculus
gattctttatgagtcttgccctaag

SEQ ID NO: 521962 - DNA, 25 bp, Mus musculus
gattctttcaatactattgccaggt

SEQ ID NO: 521963 - DNA, 25 bp, Mus musculus
gattctttcaattctattgccaggt

SEQ ID NO: 521964 - DNA, 25 bp, Mus musculus
gattctttcactaatacacttctaa

SEQ ID NO: 521965 - DNA, 25 bp, Mus musculus
gattctttcacttatacacttctaa

SEQ ID NO: 521966 - DNA, 25 bp, Mus musculus
gattctttccagatgcaaatcactg

SEQ ID NO: 521967 - DNA, 25 bp, Mus musculus
gattctttccagttgcaaatcactg

SEQ ID NO: 521968 - DNA, 25 bp, Mus musculus
gattctttcctgcaaaatgggacca

SEQ ID NO: 521969 - DNA, 25 bp, Mus musculus
gattctttcctggaaaatgggacca

SEQ ID NO: 521970 - DNA, 25 bp, Mus musculus
gattctttctacattctgcctatta

SEQ ID NO: 521971 - DNA, 25 bp, Mus musculus
gattctttctactttctgcctatta

SEQ ID NO: 521972 - DNA, 25 bp, Mus musculus
gattctttctctaggctagtgatgc

SEQ ID NO: 521973 - DNA, 25 bp, Mus musculus
gattctttctcttggctagtgatgc

SEQ ID NO: 521974 - DNA, 25 bp, Mus musculus
gattctttctgcacattgatgttag

SEQ ID NO: 521975 - DNA, 25 bp, Mus musculus
gattctttctgctcattgatgttag

SEQ ID NO: 521976 - DNA, 25 bp, Mus musculus
gattctttgacaactgtgaccctgt

SEQ ID NO: 521977 - DNA, 25 bp, Mus musculus
gattctttgacatctgtgaccctgt

SEQ ID NO: 521978 - DNA, 25 bp, Mus musculus
gattctttgagccatggtatcatag

SEQ ID NO: 521979 - DNA, 25 bp, Mus musculus
gattctttgagcgatggtatcatag

SEQ ID NO: 521980 - DNA, 25 bp, Mus musculus
gattctttgagtctagcactagtct

SEQ ID NO: 521981 - DNA, 25 bp, Mus musculus
gattctttgagtgtagcactagtct

SEQ ID NO: 521982 - DNA, 25 bp, Mus musculus
gattctttgattctgttggtctcct

SEQ ID NO: 521983 - DNA, 25 bp, Mus musculus
gattctttgattgtgttggtctcct

SEQ ID NO: 521984 - DNA, 25 bp, Mus musculus
gattctttgccgaggagcctgacac

SEQ ID NO: 521985 - DNA, 25 bp, Mus musculus
gattctttgccgtggagcctgacac

SEQ ID NO: 521986 - DNA, 25 bp, Mus musculus
gattctttgctacccacatgcgtgt

SEQ ID NO: 521987 - DNA, 25 bp, Mus musculus
gattctttgctagccacatgcgtgt

SEQ ID NO: 521988 - DNA, 25 bp, Mus musculus
gattctttgcttcagaaccgttggg

SEQ ID NO: 521989 - DNA, 25 bp, Mus musculus
gattctttgcttgagaaccgttggg

SEQ ID NO: 521990 - DNA, 25 bp, Mus musculus
gattctttgtaccattcttgaaact

SEQ ID NO: 521991 - DNA, 25 bp, Mus musculus
gattctttgtacgattcttgaaact

SEQ ID NO: 521992 - DNA, 25 bp, Mus musculus
gattctttgtttactcctgagatct

SEQ ID NO: 521993 - DNA, 25 bp, Mus musculus
gattctttgtttcttaagcaggcta

SEQ ID NO: 521994 - DNA, 25 bp, Mus musculus
gattctttgtttgttaagcaggcta

SEQ ID NO: 521995 - DNA, 25 bp, Mus musculus
gattctttgttttctcctgagatct

SEQ ID NO: 521996 - DNA, 25 bp, Mus musculus
gattcttttaagagatggcctggca

SEQ ID NO: 521997 - DNA, 25 bp, Mus musculus
gattcttttaagtgatggcctggca

SEQ ID NO: 521998 - DNA, 25 bp, Mus musculus
gattcttttaataactcttctgtgc

SEQ ID NO: 521999 - DNA, 25 bp, Mus musculus
gattcttttaattactcttctgtgc

SEQ ID NO: 522000 - DNA, 25 bp, Mus musculus
gattcttttagacttgttatacttc

SEQ ID NO: 522001 - DNA, 25 bp, Mus musculus
gattcttttagagttgttatacttc

SEQ ID NO: 522002 - DNA, 25 bp, Mus musculus
gattcttttaggcattggttcttac

SEQ ID NO: 522003 - DNA, 25 bp, Mus musculus
gattcttttagggattggttcttac

SEQ ID NO: 522004 - DNA, 25 bp, Mus musculus
gattcttttctcatctgtatcatgc

SEQ ID NO: 522005 - DNA, 25 bp, Mus musculus
gattcttttctcttctgtatcatgc

SEQ ID NO: 522006 - DNA, 25 bp, Mus musculus
gattcttttgccaactctcaagatg

SEQ ID NO: 522007 - DNA, 25 bp, Mus musculus
gattcttttgcctactctcaagatg

SEQ ID NO: 522008 - DNA, 25 bp, Mus musculus
gattctttttcgactttgaaggctt

SEQ ID NO: 522009 - DNA, 25 bp, Mus musculus
gattctttttcgtctttgaaggctt

SEQ ID NO: 522010 - DNA, 25 bp, Mus musculus
gattctttttctaacacttttctat

SEQ ID NO: 522011 - DNA, 25 bp, Mus musculus
gattctttttcttacacttttctat

SEQ ID NO: 522012 - DNA, 25 bp, Mus musculus
gattctttttgacggttcaccggag

SEQ ID NO: 522013 - DNA, 25 bp, Mus musculus
gattctttttgagggttcaccggag

SEQ ID NO: 522014 - DNA, 25 bp, Mus musculus
gattctttttgtcattgcttctcaa

SEQ ID NO: 522015 - DNA, 25 bp, Mus musculus
gattctttttgtgattgcttctcaa

SEQ ID NO: 522016 - DNA, 25 bp, Mus musculus
gattgaaaaatgcagaccaccaagg

SEQ ID NO: 522017 - DNA, 25 bp, Mus musculus
gattgaaaaatggagaccaccaagg

SEQ ID NO: 522018 - DNA, 25 bp, Mus musculus
gattgaaaactacgtccactggaat

SEQ ID NO: 522019 - DNA, 25 bp, Mus musculus
gattgaaaactaggtccactggaat

SEQ ID NO: 522020 - DNA, 25 bp, Mus musculus
gattgaaacaaacacactgcaccag

SEQ ID NO: 522021 - DNA, 25 bp, Mus musculus
gattgaaacaaagacactgcaccag

SEQ ID NO: 522022 - DNA, 25 bp, Mus musculus
gattgaaaggctcatctgtcctgtt

SEQ ID NO: 522023 - DNA, 25 bp, Mus musculus
gattgaaaggctgatctgtcctgtt

SEQ ID NO: 522024 - DNA, 25 bp, Mus musculus
gattgaaagtgtccatcacggcagc

SEQ ID NO: 522025 - DNA, 25 bp, Mus musculus
gattgaaagtgtgcatcacggcagc

SEQ ID NO: 522026 - DNA, 25 bp, Mus musculus
gattgaaatacacgcctgcattcga

SEQ ID NO: 522027 - DNA, 25 bp, Mus musculus
gattgaaatacaggcctgcattcga

SEQ ID NO: 522028 - DNA, 25 bp, Mus musculus
gattgaaatattccaccctgcatgg

SEQ ID NO: 522029 - DNA, 25 bp, Mus musculus
gattgaaatattgcaccctgcatgg

SEQ ID NO: 522030 - DNA, 25 bp, Mus musculus
gattgaacacagcacaggacatgaa

SEQ ID NO: 522031 - DNA, 25 bp, Mus musculus
gattgaacacaggacaggacatgaa

SEQ ID NO: 522032 - DNA, 25 bp, Mus musculus
gattgaacacctatcttacaggaag

SEQ ID NO: 522033 - DNA, 25 bp, Mus musculus
gattgaacacctttcttacaggaag

SEQ ID NO: 522034 - DNA, 25 bp, Mus musculus
gattgaacactgctttcaggtgcat

SEQ ID NO: 522035 - DNA, 25 bp, Mus musculus
gattgaacactggtttcaggtgcat

SEQ ID NO: 522036 - DNA, 25 bp, Mus musculus
gattgaacatgacagctgtattagc

SEQ ID NO: 522037 - DNA, 25 bp, Mus musculus
gattgaacatgagagctgtattagc

SEQ ID NO: 522038 - DNA, 25 bp, Mus musculus
gattgaaccaccatagacctagtaa

SEQ ID NO: 522039 - DNA, 25 bp, Mus musculus
gattgaaccaccttagacctagtaa

SEQ ID NO: 522040 - DNA, 25 bp, Mus musculus
gattgaacccaacaataggcacatg

SEQ ID NO: 522041 - DNA, 25 bp, Mus musculus
gattgaacccaagaataggcacatg

SEQ ID NO: 522042 - DNA, 25 bp, Mus musculus
gattgaacccatcattctttttgac

SEQ ID NO: 522043 - DNA, 25 bp, Mus musculus
gattgaacccatgattctttttgac

SEQ ID NO: 522044 - DNA, 25 bp, Mus musculus
gattgaaccccacactatgcacatg

SEQ ID NO: 522045 - DNA, 25 bp, Mus musculus
gattgaaccccagactatgcacatg

SEQ ID NO: 522046 - DNA, 25 bp, Mus musculus
gattgaaccgttccgtatggtgtag

SEQ ID NO: 522047 - DNA, 25 bp, Mus musculus
gattgaaccgttgcgtatggtgtag

SEQ ID NO: 522048 - DNA, 25 bp, Mus musculus
gattgaacctatcctcttcatgcgt

SEQ ID NO: 522049 - DNA, 25 bp, Mus musculus
gattgaacctatgctcttcatgcgt

SEQ ID NO: 522050 - DNA, 25 bp, Mus musculus
gattgaacctgtaaattttgaagtt

SEQ ID NO: 522051 - DNA, 25 bp, Mus musculus
gattgaacctgttaattttgaagtt

SEQ ID NO: 522052 - DNA, 25 bp, Mus musculus
gattgaactatcctgggcttaaacc

SEQ ID NO: 522053 - DNA, 25 bp, Mus musculus
gattgaactatcgtgggcttaaacc

SEQ ID NO: 522054 - DNA, 25 bp, Mus musculus
gattgaactctgcactaaacacgga

SEQ ID NO: 522055 - DNA, 25 bp, Mus musculus
gattgaactctggactaaacacgga

SEQ ID NO: 522056 - DNA, 25 bp, Mus musculus
gattgaacttctacgacatgaggga

SEQ ID NO: 522057 - DNA, 25 bp, Mus musculus
gattgaacttcttcgacatgaggga

SEQ ID NO: 522058 - DNA, 25 bp, Mus musculus
gattgaagaccacaaactctacatg

SEQ ID NO: 522059 - DNA, 25 bp, Mus musculus
gattgaagaccagaaactctacatg

SEQ ID NO: 522060 - DNA, 25 bp, Mus musculus
gattgaagcactccattctgcagga

SEQ ID NO: 522061 - DNA, 25 bp, Mus musculus
gattgaagcactgcattctgcagga

SEQ ID NO: 522062 - DNA, 25 bp, Mus musculus
gattgaagcaggcagcttcccgtac

SEQ ID NO: 522063 - DNA, 25 bp, Mus musculus
gattgaagcagggagcttcccgtac

SEQ ID NO: 522064 - DNA, 25 bp, Mus musculus
gattgaagcgtcaagggtcgcaaat

SEQ ID NO: 522065 - DNA, 25 bp, Mus musculus
gattgaagcgtctagggtcgcaaat

SEQ ID NO: 522066 - DNA, 25 bp, Mus musculus
gattgaaggtagcatgaaccaccat

SEQ ID NO: 522067 - DNA, 25 bp, Mus musculus
gattgaaggtaggatgaaccaccat

SEQ ID NO: 522068 - DNA, 25 bp, Mus musculus
gattgaagtcccacacgtgactcat

SEQ ID NO: 522069 - DNA, 25 bp, Mus musculus
gattgaagtccctcacgtgactcat

SEQ ID NO: 522070 - DNA, 25 bp, Mus musculus
gattgaataacaattcctgacatgg

SEQ ID NO: 522071 - DNA, 25 bp, Mus musculus
gattgaataacatttcctgacatgg

SEQ ID NO: 522072 - DNA, 25 bp, Mus musculus
gattgaataaggaccctccatccca

SEQ ID NO: 522073 - DNA, 25 bp, Mus musculus
gattgaataaggtccctccatccca

SEQ ID NO: 522074 - DNA, 25 bp, Mus musculus
gattgaatacccaaggttcgcctct

SEQ ID NO: 522075 - DNA, 25 bp, Mus musculus
gattgaataccctaggttcgcctct

SEQ ID NO: 522076 - DNA, 25 bp, Mus musculus
gattgaatatccctgtgacttaaaa

SEQ ID NO: 522077 - DNA, 25 bp, Mus musculus
gattgaatatccgtgtgacttaaaa

SEQ ID NO: 522078 - DNA, 25 bp, Mus musculus
gattgaatcatcatcactccctgta

SEQ ID NO: 522079 - DNA, 25 bp, Mus musculus
gattgaatcatcttcactccctgta

SEQ ID NO: 522080 - DNA, 25 bp, Mus musculus
gattgaatcattaggttctcctaaa

SEQ ID NO: 522081 - DNA, 25 bp, Mus musculus
gattgaatcatttggttctcctaaa

SEQ ID NO: 522082 - DNA, 25 bp, Mus musculus
gattgaatgcttacacaggagcggg

SEQ ID NO: 522083 - DNA, 25 bp, Mus musculus
gattgaatgctttcacaggagcggg

SEQ ID NO: 522084 - DNA, 25 bp, Mus musculus
gattgaatgttacctccttctctag

SEQ ID NO: 522085 - DNA, 25 bp, Mus musculus
gattgaatgttagctccttctctag

SEQ ID NO: 522086 - DNA, 25 bp, Mus musculus
gattgaattgttaggtgagtgtaga

SEQ ID NO: 522087 - DNA, 25 bp, Mus musculus
gattgaattgtttggtgagtgtaga

SEQ ID NO: 522088 - DNA, 25 bp, Mus musculus
gattgaatttcaagtctgtaataac

SEQ ID NO: 522089 - DNA, 25 bp, Mus musculus
gattgaatttcacccagctcgacca

SEQ ID NO: 522090 - DNA, 25 bp, Mus musculus
gattgaatttcagccagctcgacca

SEQ ID NO: 522091 - DNA, 25 bp, Mus musculus
gattgaatttcatgtctgtaataac

SEQ ID NO: 522092 - DNA, 25 bp, Mus musculus
gattgaatttcgagatgccttggtt

SEQ ID NO: 522093 - DNA, 25 bp, Mus musculus
gattgaatttcgtgatgccttggtt

SEQ ID NO: 522094 - DNA, 25 bp, Mus musculus
gattgaattttaaccagtggtaata

SEQ ID NO: 522095 - DNA, 25 bp, Mus musculus
gattgaattttatccagtggtaata

SEQ ID NO: 522096 - DNA, 25 bp, Mus musculus
gattgacaaattagcccacgcctat

SEQ ID NO: 522097 - DNA, 25 bp, Mus musculus
gattgacaaatttgcccacgcctat

SEQ ID NO: 522098 - DNA, 25 bp, Mus musculus
gattgacaagatctacacgcccctg

SEQ ID NO: 522099 - DNA, 25 bp, Mus musculus
gattgacaagatgtacacgcccctg

SEQ ID NO: 522100 - DNA, 25 bp, Mus musculus
gattgacaaggcacccattgtcttc

SEQ ID NO: 522101 - DNA, 25 bp, Mus musculus
gattgacaaggctcccattgtcttc

SEQ ID NO: 522102 - DNA, 25 bp, Mus musculus
gattgacaccaaagtcgctgccaga

SEQ ID NO: 522103 - DNA, 25 bp, Mus musculus
gattgacaccaatgtcgctgccaga

SEQ ID NO: 522104 - DNA, 25 bp, Mus musculus
gattgacaccatcaaaaccaaccct

SEQ ID NO: 522105 - DNA, 25 bp, Mus musculus
gattgacaccatgaaaaccaaccct

SEQ ID NO: 522106 - DNA, 25 bp, Mus musculus
gattgacacccaccttacagataaa

SEQ ID NO: 522107 - DNA, 25 bp, Mus musculus
gattgacacccagcttacagataaa

SEQ ID NO: 522108 - DNA, 25 bp, Mus musculus
gattgacaccctaacagagtgtggt

SEQ ID NO: 522109 - DNA, 25 bp, Mus musculus
gattgacacccttacagagtgtggt

SEQ ID NO: 522110 - DNA, 25 bp, Mus musculus
gattgacaccggactctcagagatg

SEQ ID NO: 522111 - DNA, 25 bp, Mus musculus
gattgacaccggtctctcagagatg

SEQ ID NO: 522112 - DNA, 25 bp, Mus musculus
gattgacaccttcaagaaccagcgt

SEQ ID NO: 522113 - DNA, 25 bp, Mus musculus
gattgacaccttgaagaaccagcgt

SEQ ID NO: 522114 - DNA, 25 bp, Mus musculus
gattgacacttcatgcctcaaatgg

SEQ ID NO: 522115 - DNA, 25 bp, Mus musculus
gattgacacttcttgcctcaaatgg

SEQ ID NO: 522116 - DNA, 25 bp, Mus musculus
gattgacagcagcatggcgcactca

SEQ ID NO: 522117 - DNA, 25 bp, Mus musculus
gattgacagcaggatggcgcactca

SEQ ID NO: 522118 - DNA, 25 bp, Mus musculus
gattgacagcatctacatggtcaca

SEQ ID NO: 522119 - DNA, 25 bp, Mus musculus
gattgacagcatgtacatggtcaca

SEQ ID NO: 522120 - DNA, 25 bp, Mus musculus
gattgacagctgctagacactccct

SEQ ID NO: 522121 - DNA, 25 bp, Mus musculus
gattgacagctggtagacactccct

SEQ ID NO: 522122 - DNA, 25 bp, Mus musculus
gattgacaggccatcaagaccacca

SEQ ID NO: 522123 - DNA, 25 bp, Mus musculus
gattgacaggccttcaagaccacca

SEQ ID NO: 522124 - DNA, 25 bp, Mus musculus
gattgacagtcaaggccagagtaga

SEQ ID NO: 522125 - DNA, 25 bp, Mus musculus
gattgacagtcatggccagagtaga

SEQ ID NO: 522126 - DNA, 25 bp, Mus musculus
gattgacattggctttctattgata

SEQ ID NO: 522127 - DNA, 25 bp, Mus musculus
gattgacattgggtttctattgata

SEQ ID NO: 522128 - DNA, 25 bp, Mus musculus
gattgaccaagccaccaagcagtgc

SEQ ID NO: 522129 - DNA, 25 bp, Mus musculus
gattgaccaagcgaccaagcagtgc

SEQ ID NO: 522130 - DNA, 25 bp, Mus musculus
gattgaccagaacgacctaatccat

SEQ ID NO: 522131 - DNA, 25 bp, Mus musculus
gattgaccagaaggacctaatccat

SEQ ID NO: 522132 - DNA, 25 bp, Mus musculus
gattgaccagtgaagccatcctatt

SEQ ID NO: 522133 - DNA, 25 bp, Mus musculus
gattgaccagtgtagccatcctatt

SEQ ID NO: 522134 - DNA, 25 bp, Mus musculus
gattgacctcaacagtgtgctacaa

SEQ ID NO: 522135 - DNA, 25 bp, Mus musculus
gattgacctcaagagtgtgctacaa

SEQ ID NO: 522136 - DNA, 25 bp, Mus musculus
gattgacctcagatccatagcctac

SEQ ID NO: 522137 - DNA, 25 bp, Mus musculus
gattgacctcagttccatagcctac

SEQ ID NO: 522138 - DNA, 25 bp, Mus musculus
gattgaccttccacagcagctagag

SEQ ID NO: 522139 - DNA, 25 bp, Mus musculus
gattgaccttcctcagcagctagag

SEQ ID NO: 522140 - DNA, 25 bp, Mus musculus
gattgaccttggaattctgcagttt

SEQ ID NO: 522141 - DNA, 25 bp, Mus musculus
gattgaccttggtattctgcagttt

SEQ ID NO: 522142 - DNA, 25 bp, Mus musculus
gattgaccttgtatgaatactgagg

SEQ ID NO: 522143 - DNA, 25 bp, Mus musculus
gattgaccttgtttgaatactgagg

SEQ ID NO: 522144 - DNA, 25 bp, Mus musculus
gattgacgctgccttggataacacc

SEQ ID NO: 522145 - DNA, 25 bp, Mus musculus
gattgacgctgcgttggataacacc

SEQ ID NO: 522146 - DNA, 25 bp, Mus musculus
gattgacgctgtctcaggaccttga

SEQ ID NO: 522147 - DNA, 25 bp, Mus musculus
gattgacgctgtgtcaggaccttga

SEQ ID NO: 522148 - DNA, 25 bp, Mus musculus
gattgacggtgtcatgcggattttt

SEQ ID NO: 522149 - DNA, 25 bp, Mus musculus
gattgacggtgtgatgcggattttt

SEQ ID NO: 522150 - DNA, 25 bp, Mus musculus
gattgactagggactcagcaatgtc

SEQ ID NO: 522151 - DNA, 25 bp, Mus musculus
gattgactagggtctcagcaatgtc

SEQ ID NO: 522152 - DNA, 25 bp, Mus musculus
gattgactatgcagccaagtctctt

SEQ ID NO: 522153 - DNA, 25 bp, Mus musculus
gattgactatgctgccaagtctctt

SEQ ID NO: 522154 - DNA, 25 bp, Mus musculus
gattgactatttactcatctggttt

SEQ ID NO: 522155 - DNA, 25 bp, Mus musculus
gattgactattttctcatctggttt

SEQ ID NO: 522156 - DNA, 25 bp, Mus musculus
gattgactcacaagtttgagccagt

SEQ ID NO: 522157 - DNA, 25 bp, Mus musculus
gattgactcacatgtttgagccagt

SEQ ID NO: 522158 - DNA, 25 bp, Mus musculus
gattgactctagaaacctggctgct

SEQ ID NO: 522159 - DNA, 25 bp, Mus musculus
gattgactctagaatcaggcttttg

SEQ ID NO: 522160 - DNA, 25 bp, Mus musculus
gattgactctagtaacctggctgct

SEQ ID NO: 522161 - DNA, 25 bp, Mus musculus
gattgactctagtatcaggcttttg

SEQ ID NO: 522162 - DNA, 25 bp, Mus musculus
gattgactgagaacgtctctctgcc

SEQ ID NO: 522163 - DNA, 25 bp, Mus musculus
gattgactgagatcgtctctctgcc

SEQ ID NO: 522164 - DNA, 25 bp, Mus musculus
gattgactgagccatgcagtactga

SEQ ID NO: 522165 - DNA, 25 bp, Mus musculus
gattgactgagcgatgcagtactga

SEQ ID NO: 522166 - DNA, 25 bp, Mus musculus
gattgacttcagctaagggagccaa

SEQ ID NO: 522167 - DNA, 25 bp, Mus musculus
gattgacttcaggtaagggagccaa

SEQ ID NO: 522168 - DNA, 25 bp, Mus musculus
gattgagaaacactgccctagacaa

SEQ ID NO: 522169 - DNA, 25 bp, Mus musculus
gattgagaaacagtgccctagacaa

SEQ ID NO: 522170 - DNA, 25 bp, Mus musculus
gattgagaacagctaccctggtaca

SEQ ID NO: 522171 - DNA, 25 bp, Mus musculus
gattgagaacaggtaccctggtaca

SEQ ID NO: 522172 - DNA, 25 bp, Mus musculus
gattgagaaccaccagcagagagaa

SEQ ID NO: 522173 - DNA, 25 bp, Mus musculus
gattgagaaccactgtcctaagaca

SEQ ID NO: 522174 - DNA, 25 bp, Mus musculus
gattgagaaccagcagcagagagaa

SEQ ID NO: 522175 - DNA, 25 bp, Mus musculus
gattgagaaccagtgtcctaagaca

SEQ ID NO: 522176 - DNA, 25 bp, Mus musculus
gattgagaatacatagaggtttgtt

SEQ ID NO: 522177 - DNA, 25 bp, Mus musculus
gattgagaatacttagaggtttgtt

SEQ ID NO: 522178 - DNA, 25 bp, Mus musculus
gattgagaatgcatagaggttttgt

SEQ ID NO: 522179 - DNA, 25 bp, Mus musculus
gattgagaatgcttagaggttttgt

SEQ ID NO: 522180 - DNA, 25 bp, Mus musculus
gattgagaatttccacaccacagca

SEQ ID NO: 522181 - DNA, 25 bp, Mus musculus
gattgagaatttgcacaccacagca

SEQ ID NO: 522182 - DNA, 25 bp, Mus musculus
gattgagactggattctttagccca

SEQ ID NO: 522183 - DNA, 25 bp, Mus musculus
gattgagactggtttctttagccca

SEQ ID NO: 522184 - DNA, 25 bp, Mus musculus
gattgagagagaactggcggaagct

SEQ ID NO: 522185 - DNA, 25 bp, Mus musculus
gattgagagagatctggcggaagct

SEQ ID NO: 522186 - DNA, 25 bp, Mus musculus
gattgagagcttaggaatgattccc

SEQ ID NO: 522187 - DNA, 25 bp, Mus musculus
gattgagagctttggaatgattccc

SEQ ID NO: 522188 - DNA, 25 bp, Mus musculus
gattgagaggagaaaccatttttaa

SEQ ID NO: 522189 - DNA, 25 bp, Mus musculus
gattgagaggagtaaccatttttaa

SEQ ID NO: 522190 - DNA, 25 bp, Mus musculus
gattgagaggtcatagggtccagaa

SEQ ID NO: 522191 - DNA, 25 bp, Mus musculus
gattgagaggtcttagggtccagaa

SEQ ID NO: 522192 - DNA, 25 bp, Mus musculus
gattgagatctacctcggctgggtt

SEQ ID NO: 522193 - DNA, 25 bp, Mus musculus
gattgagatctagctcggctgggtt

SEQ ID NO: 522194 - DNA, 25 bp, Mus musculus
gattgagattatataccgcatgcat

SEQ ID NO: 522195 - DNA, 25 bp, Mus musculus
gattgagattatttaccgcatgcat

SEQ ID NO: 522196 - DNA, 25 bp, Mus musculus
gattgagcaagaatttgccacagct

SEQ ID NO: 522197 - DNA, 25 bp, Mus musculus
gattgagcaagattttgccacagct

SEQ ID NO: 522198 - DNA, 25 bp, Mus musculus
gattgagcacagacaggcatttgta

SEQ ID NO: 522199 - DNA, 25 bp, Mus musculus
gattgagcacagtcaggcatttgta

SEQ ID NO: 522200 - DNA, 25 bp, Mus musculus
gattgagcacatcaagcactcaaag

SEQ ID NO: 522201 - DNA, 25 bp, Mus musculus
gattgagcacatgaagcactcaaag

SEQ ID NO: 522202 - DNA, 25 bp, Mus musculus
gattgagccccgagaacgagccaag

SEQ ID NO: 522203 - DNA, 25 bp, Mus musculus
gattgagccccgtgaacgagccaag

SEQ ID NO: 522204 - DNA, 25 bp, Mus musculus
gattgagcccttattccaaagacct

SEQ ID NO: 522205 - DNA, 25 bp, Mus musculus
gattgagccctttttccaaagacct

SEQ ID NO: 522206 - DNA, 25 bp, Mus musculus
gattgagccttacacgttggttttt

SEQ ID NO: 522207 - DNA, 25 bp, Mus musculus
gattgagccttagacgttggttttt

SEQ ID NO: 522208 - DNA, 25 bp, Mus musculus
gattgagctaccctatgtgcattaa

SEQ ID NO: 522209 - DNA, 25 bp, Mus musculus
gattgagctaccgtatgtgcattaa

SEQ ID NO: 522210 - DNA, 25 bp, Mus musculus
gattgagctatacctttatttagct

SEQ ID NO: 522211 - DNA, 25 bp, Mus musculus
gattgagctatagctttatttagct

SEQ ID NO: 522212 - DNA, 25 bp, Mus musculus
gattgagctattagacttgacttca

SEQ ID NO: 522213 - DNA, 25 bp, Mus musculus
gattgagctatttgacttgacttca

SEQ ID NO: 522214 - DNA, 25 bp, Mus musculus
gattgagctcagactgttaggcttg

SEQ ID NO: 522215 - DNA, 25 bp, Mus musculus
gattgagctcagtctgttaggcttg

SEQ ID NO: 522216 - DNA, 25 bp, Mus musculus
gattgagctcttcatttggtgggaa

SEQ ID NO: 522217 - DNA, 25 bp, Mus musculus
gattgagctcttgatttggtgggaa

SEQ ID NO: 522218 - DNA, 25 bp, Mus musculus
gattgagctgaaacacctgagctgt

SEQ ID NO: 522219 - DNA, 25 bp, Mus musculus
gattgagctgaatcacctgagctgt

SEQ ID NO: 522220 - DNA, 25 bp, Mus musculus
gattgagctgcaatcataactggag

SEQ ID NO: 522221 - DNA, 25 bp, Mus musculus
gattgagctgcattcataactggag

SEQ ID NO: 522222 - DNA, 25 bp, Mus musculus
gattgaggaaaacttgcttagctta

SEQ ID NO: 522223 - DNA, 25 bp, Mus musculus
gattgaggaaaagttgcttagctta

SEQ ID NO: 522224 - DNA, 25 bp, Mus musculus
gattgaggaagcacccgaagcagcc

SEQ ID NO: 522225 - DNA, 25 bp, Mus musculus
gattgaggaagctcccgaagcagcc

SEQ ID NO: 522226 - DNA, 25 bp, Mus musculus
gattgaggcagtacctgagccgcca

SEQ ID NO: 522227 - DNA, 25 bp, Mus musculus
gattgaggcagttcctgagccgcca

SEQ ID NO: 522228 - DNA, 25 bp, Mus musculus
gattgaggctagagccatctctgga

SEQ ID NO: 522229 - DNA, 25 bp, Mus musculus
gattgaggctagtgccatctctgga

SEQ ID NO: 522230 - DNA, 25 bp, Mus musculus
gattgaggctcacaaattatttttc

SEQ ID NO: 522231 - DNA, 25 bp, Mus musculus
gattgaggctcaccattcactggtg

SEQ ID NO: 522232 - DNA, 25 bp, Mus musculus
gattgaggctcagaaattatttttc

SEQ ID NO: 522233 - DNA, 25 bp, Mus musculus
gattgaggctcagcattcactggtg

SEQ ID NO: 522234 - DNA, 25 bp, Mus musculus
gattgagggtcaacacaccatgagg

SEQ ID NO: 522235 - DNA, 25 bp, Mus musculus
gattgagggtcatcacaccatgagg

SEQ ID NO: 522236 - DNA, 25 bp, Mus musculus
gattgaggtaagatttttggtgttg

SEQ ID NO: 522237 - DNA, 25 bp, Mus musculus
gattgaggtaagttttttggtgttg

SEQ ID NO: 522238 - DNA, 25 bp, Mus musculus
gattgaggtccacggcaagcacgaa

SEQ ID NO: 522239 - DNA, 25 bp, Mus musculus
gattgaggtccagggcaagcacgaa

SEQ ID NO: 522240 - DNA, 25 bp, Mus musculus
gattgaggtcttacatttcctgggc

SEQ ID NO: 522241 - DNA, 25 bp, Mus musculus
gattgaggtctttcatttcctgggc

SEQ ID NO: 522242 - DNA, 25 bp, Mus musculus
gattgagtacgtattgctcttctag

SEQ ID NO: 522243 - DNA, 25 bp, Mus musculus
gattgagtacgttttgctcttctag

SEQ ID NO: 522244 - DNA, 25 bp, Mus musculus
gattgagtcatactgcatatgccct

SEQ ID NO: 522245 - DNA, 25 bp, Mus musculus
gattgagtcatagtgcatatgccct

SEQ ID NO: 522246 - DNA, 25 bp, Mus musculus
gattgagtccagatacatgagtgtg

SEQ ID NO: 522247 - DNA, 25 bp, Mus musculus
gattgagtccagttacatgagtgtg

SEQ ID NO: 522248 - DNA, 25 bp, Mus musculus
gattgagtctccagtatgtttctta

SEQ ID NO: 522249 - DNA, 25 bp, Mus musculus
gattgagtctcctgtatgtttctta

SEQ ID NO: 522250 - DNA, 25 bp, Mus musculus
gattgagtgatcatactccagcctg

SEQ ID NO: 522251 - DNA, 25 bp, Mus musculus
gattgagtgatcttactccagcctg

SEQ ID NO: 522252 - DNA, 25 bp, Mus musculus
gattgagttcagcttacctgactta

SEQ ID NO: 522253 - DNA, 25 bp, Mus musculus
gattgagttcaggttacctgactta

SEQ ID NO: 522254 - DNA, 25 bp, Mus musculus
gattgagttcatcttattccactat

SEQ ID NO: 522255 - DNA, 25 bp, Mus musculus
gattgagttcatgttattccactat

SEQ ID NO: 522256 - DNA, 25 bp, Mus musculus
gattgagttgggacctagccagcct

SEQ ID NO: 522257 - DNA, 25 bp, Mus musculus
gattgagttgggtcctagccagcct

SEQ ID NO: 522258 - DNA, 25 bp, Mus musculus
gattgagtttagattcccatcaccc

SEQ ID NO: 522259 - DNA, 25 bp, Mus musculus
gattgagtttagtttcccatcaccc

SEQ ID NO: 522260 - DNA, 25 bp, Mus musculus
gattgagtttccaatgcccaacgag

SEQ ID NO: 522261 - DNA, 25 bp, Mus musculus
gattgagtttcctatgcccaacgag

SEQ ID NO: 522262 - DNA, 25 bp, Mus musculus
gattgataacgcattccatgttgaa

SEQ ID NO: 522263 - DNA, 25 bp, Mus musculus
gattgataacgctttccatgttgaa

SEQ ID NO: 522264 - DNA, 25 bp, Mus musculus
gattgataattcagcctaaaagtca

SEQ ID NO: 522265 - DNA, 25 bp, Mus musculus
gattgataattctgcctaaaagtca

SEQ ID NO: 522266 - DNA, 25 bp, Mus musculus
gattgataccccaacattcttttta

SEQ ID NO: 522267 - DNA, 25 bp, Mus musculus
gattgatacccctacattcttttta

SEQ ID NO: 522268 - DNA, 25 bp, Mus musculus
gattgatacgcaagcttgactctcc

SEQ ID NO: 522269 - DNA, 25 bp, Mus musculus
gattgatacgcatgcttgactctcc

SEQ ID NO: 522270 - DNA, 25 bp, Mus musculus
gattgatactttagtgcagctgtgc

SEQ ID NO: 522271 - DNA, 25 bp, Mus musculus
gattgatacttttgtgcagctgtgc

SEQ ID NO: 522272 - DNA, 25 bp, Mus musculus
gattgatagctactaatgctcctct

SEQ ID NO: 522273 - DNA, 25 bp, Mus musculus
gattgatagctagtaatgctcctct

SEQ ID NO: 522274 - DNA, 25 bp, Mus musculus
gattgatagctcattctcgattccg

SEQ ID NO: 522275 - DNA, 25 bp, Mus musculus
gattgatagctctttctcgattccg

SEQ ID NO: 522276 - DNA, 25 bp, Mus musculus
gattgatataggctcttctagaaca

SEQ ID NO: 522277 - DNA, 25 bp, Mus musculus
gattgatatagggtcttctagaaca

SEQ ID NO: 522278 - DNA, 25 bp, Mus musculus
gattgatatcacctctctggtggcc

SEQ ID NO: 522279 - DNA, 25 bp, Mus musculus
gattgatatcacgtctctggtggcc

SEQ ID NO: 522280 - DNA, 25 bp, Mus musculus
gattgatatcgcagcgaccctggag

SEQ ID NO: 522281 - DNA, 25 bp, Mus musculus
gattgatatcgctgcgaccctggag

SEQ ID NO: 522282 - DNA, 25 bp, Mus musculus
gattgatcatgcactgtattcacag

SEQ ID NO: 522283 - DNA, 25 bp, Mus musculus
gattgatcatgctctgtattcacag

SEQ ID NO: 522284 - DNA, 25 bp, Mus musculus
gattgatcattgcatcactagaatc

SEQ ID NO: 522285 - DNA, 25 bp, Mus musculus
gattgatcattggatcactagaatc

SEQ ID NO: 522286 - DNA, 25 bp, Mus musculus
gattgatccaatctcagggtaatta

SEQ ID NO: 522287 - DNA, 25 bp, Mus musculus
gattgatccaatgtcagggtaatta

SEQ ID NO: 522288 - DNA, 25 bp, Mus musculus
gattgatccactcggtgcctgatgg

SEQ ID NO: 522289 - DNA, 25 bp, Mus musculus
gattgatccactgggtgcctgatgg

SEQ ID NO: 522290 - DNA, 25 bp, Mus musculus
gattgatccagaaaagctctccgta

SEQ ID NO: 522291 - DNA, 25 bp, Mus musculus
gattgatccagataagctctccgta

SEQ ID NO: 522292 - DNA, 25 bp, Mus musculus
gattgatcccaacagctatgcagat

SEQ ID NO: 522293 - DNA, 25 bp, Mus musculus
gattgatcccaacgctagtctggaa

SEQ ID NO: 522294 - DNA, 25 bp, Mus musculus
gattgatcccaagagctatgcagat

SEQ ID NO: 522295 - DNA, 25 bp, Mus musculus
gattgatcccaaggctagtctggaa

SEQ ID NO: 522296 - DNA, 25 bp, Mus musculus
gattgatcctaaaagtggtggtact

SEQ ID NO: 522297 - DNA, 25 bp, Mus musculus
gattgatcctaatagtggtggtact

SEQ ID NO: 522298 - DNA, 25 bp, Mus musculus
gattgatcggaccagtttcctgctg

SEQ ID NO: 522299 - DNA, 25 bp, Mus musculus
gattgatcggacgagtttcctgctg

SEQ ID NO: 522300 - DNA, 25 bp, Mus musculus
gattgatctgttatggatgttgcta

SEQ ID NO: 522301 - DNA, 25 bp, Mus musculus
gattgatctgttctagcctagtgag

SEQ ID NO: 522302 - DNA, 25 bp, Mus musculus
gattgatctgttgtagcctagtgag

SEQ ID NO: 522303 - DNA, 25 bp, Mus musculus
gattgatctgttttggatgttgcta

SEQ ID NO: 522304 - DNA, 25 bp, Mus musculus
gattgatgacatagtctctggccac

SEQ ID NO: 522305 - DNA, 25 bp, Mus musculus
gattgatgacattgtctctggccac

SEQ ID NO: 522306 - DNA, 25 bp, Mus musculus
gattgatgattcctccactcggatc

SEQ ID NO: 522307 - DNA, 25 bp, Mus musculus
gattgatgattcgtccactcggatc

SEQ ID NO: 522308 - DNA, 25 bp, Mus musculus
gattgatgcccaagaccacttcgaa

SEQ ID NO: 522309 - DNA, 25 bp, Mus musculus
gattgatgcccatgaccacttcgaa

SEQ ID NO: 522310 - DNA, 25 bp, Mus musculus
gattgatggcttacgggcttattac

SEQ ID NO: 522311 - DNA, 25 bp, Mus musculus
gattgatggcttctgactccgtgat

SEQ ID NO: 522312 - DNA, 25 bp, Mus musculus
gattgatggcttgtgactccgtgat

SEQ ID NO: 522313 - DNA, 25 bp, Mus musculus
gattgatggctttcgggcttattac

SEQ ID NO: 522314 - DNA, 25 bp, Mus musculus
gattgatggtgaatggtatgctagt

SEQ ID NO: 522315 - DNA, 25 bp, Mus musculus
gattgatggtgattggtatgctagt

SEQ ID NO: 522316 - DNA, 25 bp, Mus musculus
gattgatgtattcttaggttgccca

SEQ ID NO: 522317 - DNA, 25 bp, Mus musculus
gattgatgtattgttaggttgccca

SEQ ID NO: 522318 - DNA, 25 bp, Mus musculus
gattgatgtccacaattatccggat

SEQ ID NO: 522319 - DNA, 25 bp, Mus musculus
gattgatgtccagaattatccggat

SEQ ID NO: 522320 - DNA, 25 bp, Mus musculus
gattgatgttaacagactcgagtaa

SEQ ID NO: 522321 - DNA, 25 bp, Mus musculus
gattgatgttaagagactcgagtaa

SEQ ID NO: 522322 - DNA, 25 bp, Mus musculus
gattgattacgtccctgcagccatg

SEQ ID NO: 522323 - DNA, 25 bp, Mus musculus
gattgattacgtgcctgcagccatg

SEQ ID NO: 522324 - DNA, 25 bp, Mus musculus
gattgattgactccccgagactttc

SEQ ID NO: 522325 - DNA, 25 bp, Mus musculus
gattgattgactgcccgagactttc

SEQ ID NO: 522326 - DNA, 25 bp, Mus musculus
gattgatttacgccgctaaggatga

SEQ ID NO: 522327 - DNA, 25 bp, Mus musculus
gattgatttacggcgctaaggatga

SEQ ID NO: 522328 - DNA, 25 bp, Mus musculus
gattgatttcctattcggtgctcct

SEQ ID NO: 522329 - DNA, 25 bp, Mus musculus
gattgatttccttttcggtgctcct

SEQ ID NO: 522330 - DNA, 25 bp, Mus musculus
gattgattttacactgttctcctaa

SEQ ID NO: 522331 - DNA, 25 bp, Mus musculus
gattgattttactctgttctcctaa

SEQ ID NO: 522332 - DNA, 25 bp, Mus musculus
gattgatttttgacaacggcttctg

SEQ ID NO: 522333 - DNA, 25 bp, Mus musculus
gattgatttttgtcaacggcttctg

SEQ ID NO: 522334 - DNA, 25 bp, Mus musculus
gattgcaaagtcctgtgatcactga

SEQ ID NO: 522335 - DNA, 25 bp, Mus musculus
gattgcaaagtcgtgtgatcactga

SEQ ID NO: 522336 - DNA, 25 bp, Mus musculus
gattgcaaatgaaaattgacctgta

SEQ ID NO: 522337 - DNA, 25 bp, Mus musculus
gattgcaaatgataattgacctgta

SEQ ID NO: 522338 - DNA, 25 bp, Mus musculus
gattgcaaatttcagcccagtctgg

SEQ ID NO: 522339 - DNA, 25 bp, Mus musculus
gattgcaaatttgagcccagtctgg

SEQ ID NO: 522340 - DNA, 25 bp, Mus musculus
gattgcaacaggcagcagaacttga

SEQ ID NO: 522341 - DNA, 25 bp, Mus musculus
gattgcaacagggagcagaacttga

SEQ ID NO: 522342 - DNA, 25 bp, Mus musculus
gattgcaagctaagtagtgacctat

SEQ ID NO: 522343 - DNA, 25 bp, Mus musculus
gattgcaagctatgtagtgacctat

SEQ ID NO: 522344 - DNA, 25 bp, Mus musculus
gattgcaaggtgaatagaaactagc

SEQ ID NO: 522345 - DNA, 25 bp, Mus musculus
gattgcaaggtgtatagaaactagc

SEQ ID NO: 522346 - DNA, 25 bp, Mus musculus
gattgcaatcaaagccattggccaa

SEQ ID NO: 522347 - DNA, 25 bp, Mus musculus
gattgcaatcaatgccattggccaa

SEQ ID NO: 522348 - DNA, 25 bp, Mus musculus
gattgcaattagagacacctggttt

SEQ ID NO: 522349 - DNA, 25 bp, Mus musculus
gattgcaattagcttaacattacgt

SEQ ID NO: 522350 - DNA, 25 bp, Mus musculus
gattgcaattaggttaacattacgt

SEQ ID NO: 522351 - DNA, 25 bp, Mus musculus
gattgcaattagtgacacctggttt

SEQ ID NO: 522352 - DNA, 25 bp, Mus musculus
gattgcaattataccccatgaacga

SEQ ID NO: 522353 - DNA, 25 bp, Mus musculus
gattgcaattattccccatgaacga

SEQ ID NO: 522354 - DNA, 25 bp, Mus musculus
gattgcacaaaacttgggaccagta

SEQ ID NO: 522355 - DNA, 25 bp, Mus musculus
gattgcacaaaagttgggaccagta

SEQ ID NO: 522356 - DNA, 25 bp, Mus musculus
gattgcacacatcataatttacgag

SEQ ID NO: 522357 - DNA, 25 bp, Mus musculus
gattgcacacatgataatttacgag

SEQ ID NO: 522358 - DNA, 25 bp, Mus musculus
gattgcacagcactcacgtcataat

SEQ ID NO: 522359 - DNA, 25 bp, Mus musculus
gattgcacagcagtcacgtcataat

SEQ ID NO: 522360 - DNA, 25 bp, Mus musculus
gattgcacagctcaacttggctagt

SEQ ID NO: 522361 - DNA, 25 bp, Mus musculus
gattgcacagctgaacttggctagt

SEQ ID NO: 522362 - DNA, 25 bp, Mus musculus
gattgcacagtcagtcactgctgtc

SEQ ID NO: 522363 - DNA, 25 bp, Mus musculus
gattgcacagtctgtcactgctgtc

SEQ ID NO: 522364 - DNA, 25 bp, Mus musculus
gattgcacatatcacaggcctgcag

SEQ ID NO: 522365 - DNA, 25 bp, Mus musculus
gattgcacatatctgttatcctaat

SEQ ID NO: 522366 - DNA, 25 bp, Mus musculus
gattgcacatatgacaggcctgcag

SEQ ID NO: 522367 - DNA, 25 bp, Mus musculus
gattgcacatatgtgttatcctaat

SEQ ID NO: 522368 - DNA, 25 bp, Mus musculus
gattgcacatgcaaagtcagagaat

SEQ ID NO: 522369 - DNA, 25 bp, Mus musculus
gattgcacatgctaagtcagagaat

SEQ ID NO: 522370 - DNA, 25 bp, Mus musculus
gattgcacattgagattttcctgga

SEQ ID NO: 522371 - DNA, 25 bp, Mus musculus
gattgcacattgtgattttcctgga

SEQ ID NO: 522372 - DNA, 25 bp, Mus musculus
gattgcaccaagatttcagttgaga

SEQ ID NO: 522373 - DNA, 25 bp, Mus musculus
gattgcaccaagttttcagttgaga

SEQ ID NO: 522374 - DNA, 25 bp, Mus musculus
gattgcaccaggctgactgagagtt

SEQ ID NO: 522375 - DNA, 25 bp, Mus musculus
gattgcaccagggtgactgagagtt

SEQ ID NO: 522376 - DNA, 25 bp, Mus musculus
gattgcacccagatgatgggatgtg

SEQ ID NO: 522377 - DNA, 25 bp, Mus musculus
gattgcacccagttgatgggatgtg

SEQ ID NO: 522378 - DNA, 25 bp, Mus musculus
gattgcacctccacaaaatgacaga

SEQ ID NO: 522379 - DNA, 25 bp, Mus musculus
gattgcacctcctcaaaatgacaga

SEQ ID NO: 522380 - DNA, 25 bp, Mus musculus
gattgcacctggaaatcacgtgaag

SEQ ID NO: 522381 - DNA, 25 bp, Mus musculus
gattgcacctggtaatcacgtgaag

SEQ ID NO: 522382 - DNA, 25 bp, Mus musculus
gattgcacctttagtatcttaagct

SEQ ID NO: 522383 - DNA, 25 bp, Mus musculus
gattgcaccttttgtatcttaagct

SEQ ID NO: 522384 - DNA, 25 bp, Mus musculus
gattgcacggctaccatgaagtctg

SEQ ID NO: 522385 - DNA, 25 bp, Mus musculus
gattgcacggcttccatgaagtctg

SEQ ID NO: 522386 - DNA, 25 bp, Mus musculus
gattgcacgttaacatgtgtcctta

SEQ ID NO: 522387 - DNA, 25 bp, Mus musculus
gattgcacgttatcatgtgtcctta

SEQ ID NO: 522388 - DNA, 25 bp, Mus musculus
gattgcactactcttttccagactg

SEQ ID NO: 522389 - DNA, 25 bp, Mus musculus
gattgcactactgttttccagactg

SEQ ID NO: 522390 - DNA, 25 bp, Mus musculus
gattgcactccaaggaaagttccta

SEQ ID NO: 522391 - DNA, 25 bp, Mus musculus
gattgcactccatggaaagttccta

SEQ ID NO: 522392 - DNA, 25 bp, Mus musculus
gattgcactgcacgaggataaacac

SEQ ID NO: 522393 - DNA, 25 bp, Mus musculus
gattgcactgcaggaggataaacac

SEQ ID NO: 522394 - DNA, 25 bp, Mus musculus
gattgcactgccctaagatgactgg

SEQ ID NO: 522395 - DNA, 25 bp, Mus musculus
gattgcactgccgtaagatgactgg

SEQ ID NO: 522396 - DNA, 25 bp, Mus musculus
gattgcactggtatggagtcccgga

SEQ ID NO: 522397 - DNA, 25 bp, Mus musculus
gattgcactggtttggagtcccgga

SEQ ID NO: 522398 - DNA, 25 bp, Mus musculus
gattgcactgtcaggtgagccagtt

SEQ ID NO: 522399 - DNA, 25 bp, Mus musculus
gattgcactgtctggtgagccagtt

SEQ ID NO: 522400 - DNA, 25 bp, Mus musculus
gattgcagaaggatgagaccaggct

SEQ ID NO: 522401 - DNA, 25 bp, Mus musculus
gattgcagaaggttgagaccaggct

SEQ ID NO: 522402 - DNA, 25 bp, Mus musculus
gattgcagaccgctccaggttgctc

SEQ ID NO: 522403 - DNA, 25 bp, Mus musculus
gattgcagaccggtccaggttgctc

SEQ ID NO: 522404 - DNA, 25 bp, Mus musculus
gattgcagatgcatgtcacctgacc

SEQ ID NO: 522405 - DNA, 25 bp, Mus musculus
gattgcagatgcttgtcacctgacc

SEQ ID NO: 522406 - DNA, 25 bp, Mus musculus
gattgcagcaaaccaggtaacaaca

SEQ ID NO: 522407 - DNA, 25 bp, Mus musculus
gattgcagcaaagcaggtaacaaca

SEQ ID NO: 522408 - DNA, 25 bp, Mus musculus
gattgcagcatgaactgtcctgtag

SEQ ID NO: 522409 - DNA, 25 bp, Mus musculus
gattgcagcatgtactgtcctgtag

SEQ ID NO: 522410 - DNA, 25 bp, Mus musculus
gattgcagccgactatgctgtcagg

SEQ ID NO: 522411 - DNA, 25 bp, Mus musculus
gattgcagccgagtatgctgtcagg

SEQ ID NO: 522412 - DNA, 25 bp, Mus musculus
gattgcagcgaaaactcagagaaca

SEQ ID NO: 522413 - DNA, 25 bp, Mus musculus
gattgcagcgaatactcagagaaca

SEQ ID NO: 522414 - DNA, 25 bp, Mus musculus
gattgcagctcaccgtctaattaga

SEQ ID NO: 522415 - DNA, 25 bp, Mus musculus
gattgcagctcagcgtctaattaga

SEQ ID NO: 522416 - DNA, 25 bp, Mus musculus
gattgcagctgccagccttggccac

SEQ ID NO: 522417 - DNA, 25 bp, Mus musculus
gattgcagctgcgagccttggccac

SEQ ID NO: 522418 - DNA, 25 bp, Mus musculus
gattgcaggagaaacagctctggat

SEQ ID NO: 522419 - DNA, 25 bp, Mus musculus
gattgcaggagatacagctctggat

SEQ ID NO: 522420 - DNA, 25 bp, Mus musculus
gattgcaggctcaccattggttcct

SEQ ID NO: 522421 - DNA, 25 bp, Mus musculus
gattgcaggctctccattggttcct

SEQ ID NO: 522422 - DNA, 25 bp, Mus musculus
gattgcagtaagaacatacattttc

SEQ ID NO: 522423 - DNA, 25 bp, Mus musculus
gattgcagtaagtacatacattttc

SEQ ID NO: 522424 - DNA, 25 bp, Mus musculus
gattgcagtggacattccatgccca

SEQ ID NO: 522425 - DNA, 25 bp, Mus musculus
gattgcagtggagattccatgccca

SEQ ID NO: 522426 - DNA, 25 bp, Mus musculus
gattgcagtgtgatgtgctactttc

SEQ ID NO: 522427 - DNA, 25 bp, Mus musculus
gattgcagtgtgttgtgctactttc

SEQ ID NO: 522428 - DNA, 25 bp, Mus musculus
gattgcagttagcttgatttccttt

SEQ ID NO: 522429 - DNA, 25 bp, Mus musculus
gattgcagttaggttgatttccttt

SEQ ID NO: 522430 - DNA, 25 bp, Mus musculus
gattgcatatacctagacccagaat

SEQ ID NO: 522431 - DNA, 25 bp, Mus musculus
gattgcatatacgtagacccagaat

SEQ ID NO: 522432 - DNA, 25 bp, Mus musculus
gattgcatcactcctttgatgtctc

SEQ ID NO: 522433 - DNA, 25 bp, Mus musculus
gattgcatcactgctttgatgtctc

SEQ ID NO: 522434 - DNA, 25 bp, Mus musculus
gattgcatcaggcaacggctgatca

SEQ ID NO: 522435 - DNA, 25 bp, Mus musculus
gattgcatcagggaacggctgatca

SEQ ID NO: 522436 - DNA, 25 bp, Mus musculus
gattgcatccgacggtgattgcgcc

SEQ ID NO: 522437 - DNA, 25 bp, Mus musculus
gattgcatccgagggtgattgcgcc

SEQ ID NO: 522438 - DNA, 25 bp, Mus musculus
gattgcatcctgatacttgacttgt

SEQ ID NO: 522439 - DNA, 25 bp, Mus musculus
gattgcatcctgttacttgacttgt

SEQ ID NO: 522440 - DNA, 25 bp, Mus musculus
gattgcatgagacccaccttttcta

SEQ ID NO: 522441 - DNA, 25 bp, Mus musculus
gattgcatgagagccaccttttcta

SEQ ID NO: 522442 - DNA, 25 bp, Mus musculus
gattgcatgagcctgtcaactgcac

SEQ ID NO: 522443 - DNA, 25 bp, Mus musculus
gattgcatgagcgtgtcaactgcac

SEQ ID NO: 522444 - DNA, 25 bp, Mus musculus
gattgcatgatcctcacggtagtta

SEQ ID NO: 522445 - DNA, 25 bp, Mus musculus
gattgcatgatcgtcacggtagtta

SEQ ID NO: 522446 - DNA, 25 bp, Mus musculus
gattgcatgctaagatgacggtcta

SEQ ID NO: 522447 - DNA, 25 bp, Mus musculus
gattgcatgctatgatgacggtcta

SEQ ID NO: 522448 - DNA, 25 bp, Mus musculus
gattgcatggttataagtctgagtc

SEQ ID NO: 522449 - DNA, 25 bp, Mus musculus
gattgcatggttttaagtctgagtc

SEQ ID NO: 522450 - DNA, 25 bp, Mus musculus
gattgcattaatatctgaccgccct

SEQ ID NO: 522451 - DNA, 25 bp, Mus musculus
gattgcattaatttctgaccgccct

SEQ ID NO: 522452 - DNA, 25 bp, Mus musculus
gattgcattcgcaacatcacgagac

SEQ ID NO: 522453 - DNA, 25 bp, Mus musculus
gattgcattcgctacatcacgagac

SEQ ID NO: 522454 - DNA, 25 bp, Mus musculus
gattgcattcgtacttcaaggaaca

SEQ ID NO: 522455 - DNA, 25 bp, Mus musculus
gattgcattcgttcttcaaggaaca

SEQ ID NO: 522456 - DNA, 25 bp, Mus musculus
gattgcatttatagtttccagattg

SEQ ID NO: 522457 - DNA, 25 bp, Mus musculus
gattgcatttattgtttccagattg

SEQ ID NO: 522458 - DNA, 25 bp, Mus musculus
gattgcatttcaccgatcctgtggt

SEQ ID NO: 522459 - DNA, 25 bp, Mus musculus
gattgcatttcagcgatcctgtggt

SEQ ID NO: 522460 - DNA, 25 bp, Mus musculus
gattgcatttgtaggtgtttgaaaa

SEQ ID NO: 522461 - DNA, 25 bp, Mus musculus
gattgcatttgtagtgctgtttcca

SEQ ID NO: 522462 - DNA, 25 bp, Mus musculus
gattgcatttgttggtgtttgaaaa

SEQ ID NO: 522463 - DNA, 25 bp, Mus musculus
gattgcatttgttgtgctgtttcca

SEQ ID NO: 522464 - DNA, 25 bp, Mus musculus
gattgcattttcaacacataggatt

SEQ ID NO: 522465 - DNA, 25 bp, Mus musculus
gattgcattttcagatttcaacctc

SEQ ID NO: 522466 - DNA, 25 bp, Mus musculus
gattgcattttctacacataggatt

SEQ ID NO: 522467 - DNA, 25 bp, Mus musculus
gattgcattttctgatttcaacctc

SEQ ID NO: 522468 - DNA, 25 bp, Mus musculus
gattgccaaagaccagggaaaccac

SEQ ID NO: 522469 - DNA, 25 bp, Mus musculus
gattgccaaagagcagggaaaccac

SEQ ID NO: 522470 - DNA, 25 bp, Mus musculus
gattgccaaatgcttaaatgccagg

SEQ ID NO: 522471 - DNA, 25 bp, Mus musculus
gattgccaaatggttaaatgccagg

SEQ ID NO: 522472 - DNA, 25 bp, Mus musculus
gattgccaacccacttgagacagag

SEQ ID NO: 522473 - DNA, 25 bp, Mus musculus
gattgccaaccctcttgagacagag

SEQ ID NO: 522474 - DNA, 25 bp, Mus musculus
gattgccaacgaaaccggaggtcac

SEQ ID NO: 522475 - DNA, 25 bp, Mus musculus
gattgccaacgataccggaggtcac

SEQ ID NO: 522476 - DNA, 25 bp, Mus musculus
gattgccaaggcacaagtggcccag

SEQ ID NO: 522477 - DNA, 25 bp, Mus musculus
gattgccaaggctcaagtggcccag

SEQ ID NO: 522478 - DNA, 25 bp, Mus musculus
gattgccaagtaccagaggtttcta

SEQ ID NO: 522479 - DNA, 25 bp, Mus musculus
gattgccaagtagcagaggtttcta

SEQ ID NO: 522480 - DNA, 25 bp, Mus musculus
gattgccacaatctctccaggaatg

SEQ ID NO: 522481 - DNA, 25 bp, Mus musculus
gattgccacaatgtctccaggaatg

SEQ ID NO: 522482 - DNA, 25 bp, Mus musculus
gattgccacattaaagttctcccac

SEQ ID NO: 522483 - DNA, 25 bp, Mus musculus
gattgccacatttaagttctcccac

SEQ ID NO: 522484 - DNA, 25 bp, Mus musculus
gattgccacctcaaatgatgctttt

SEQ ID NO: 522485 - DNA, 25 bp, Mus musculus
gattgccacctctaatgatgctttt

SEQ ID NO: 522486 - DNA, 25 bp, Mus musculus
gattgccacgctagctagaactgtg

SEQ ID NO: 522487 - DNA, 25 bp, Mus musculus
gattgccacgcttgctagaactgtg

SEQ ID NO: 522488 - DNA, 25 bp, Mus musculus
gattgccacgggattgagatcagtc

SEQ ID NO: 522489 - DNA, 25 bp, Mus musculus
gattgccacgggtttgagatcagtc

SEQ ID NO: 522490 - DNA, 25 bp, Mus musculus
gattgccagaagacagaagtgtttt

SEQ ID NO: 522491 - DNA, 25 bp, Mus musculus
gattgccagaagtcagaagtgtttt

SEQ ID NO: 522492 - DNA, 25 bp, Mus musculus
gattgccagagcacactgcagaagt

SEQ ID NO: 522493 - DNA, 25 bp, Mus musculus
gattgccagagcagattcattggta

SEQ ID NO: 522494 - DNA, 25 bp, Mus musculus
gattgccagagctcactgcagaagt

SEQ ID NO: 522495 - DNA, 25 bp, Mus musculus
gattgccagagctgattcattggta

SEQ ID NO: 522496 - DNA, 25 bp, Mus musculus
gattgccagatgcaattccctgagc

SEQ ID NO: 522497 - DNA, 25 bp, Mus musculus
gattgccagatggaattccctgagc

SEQ ID NO: 522498 - DNA, 25 bp, Mus musculus
gattgccagcgtattggatggcatt

SEQ ID NO: 522499 - DNA, 25 bp, Mus musculus
gattgccagcgttttggatggcatt

SEQ ID NO: 522500 - DNA, 25 bp, Mus musculus
gattgccatcggagtacaacatgat

SEQ ID NO: 522501 - DNA, 25 bp, Mus musculus
gattgccatcggtgtacaacatgat

SEQ ID NO: 522502 - DNA, 25 bp, Mus musculus
gattgccatcttccttttgggcaga

SEQ ID NO: 522503 - DNA, 25 bp, Mus musculus
gattgccatcttgcttttgggcaga

SEQ ID NO: 522504 - DNA, 25 bp, Mus musculus
gattgccatggcaacagctatagga

SEQ ID NO: 522505 - DNA, 25 bp, Mus musculus
gattgccatggctacagctatagga

SEQ ID NO: 522506 - DNA, 25 bp, Mus musculus
gattgcccaaagcttagccacttag

SEQ ID NO: 522507 - DNA, 25 bp, Mus musculus
gattgcccaaaggttagccacttag

SEQ ID NO: 522508 - DNA, 25 bp, Mus musculus
gattgcccaggtactaaggacagca

SEQ ID NO: 522509 - DNA, 25 bp, Mus musculus
gattgcccaggttctaaggacagca

SEQ ID NO: 522510 - DNA, 25 bp, Mus musculus
gattgcccagtcctgtacatgtaga

SEQ ID NO: 522511 - DNA, 25 bp, Mus musculus
gattgcccagtcgtgtacatgtaga

SEQ ID NO: 522512 - DNA, 25 bp, Mus musculus
gattgcccatcgagactacggctgg

SEQ ID NO: 522513 - DNA, 25 bp, Mus musculus
gattgcccatcgtgactacggctgg

SEQ ID NO: 522514 - DNA, 25 bp, Mus musculus
gattgcccatctcgacgggctggat

SEQ ID NO: 522515 - DNA, 25 bp, Mus musculus
gattgcccatctggacgggctggat

SEQ ID NO: 522516 - DNA, 25 bp, Mus musculus
gattgccccaacaccggagcaggag

SEQ ID NO: 522517 - DNA, 25 bp, Mus musculus
gattgccccaactccggagcaggag

SEQ ID NO: 522518 - DNA, 25 bp, Mus musculus
gattgccccagtcttttttgaaaat

SEQ ID NO: 522519 - DNA, 25 bp, Mus musculus
gattgccccagtgttttttgaaaat

SEQ ID NO: 522520 - DNA, 25 bp, Mus musculus
gattgcccccacagaatatattctt

SEQ ID NO: 522521 - DNA, 25 bp, Mus musculus
gattgcccccactgaatatattctt

SEQ ID NO: 522522 - DNA, 25 bp, Mus musculus
gattgcccgggtcgagaattcttat

SEQ ID NO: 522523 - DNA, 25 bp, Mus musculus
gattgcccgggtggagaattcttat

SEQ ID NO: 522524 - DNA, 25 bp, Mus musculus
gattgccctgccagagccgacagag

SEQ ID NO: 522525 - DNA, 25 bp, Mus musculus
gattgccctgcctgagccgacagag

SEQ ID NO: 522526 - DNA, 25 bp, Mus musculus
gattgccgaatgcttcctttgctgc

SEQ ID NO: 522527 - DNA, 25 bp, Mus musculus
gattgccgaatggttcctttgctgc

SEQ ID NO: 522528 - DNA, 25 bp, Mus musculus
gattgccgagctcgctcagtagtga

SEQ ID NO: 522529 - DNA, 25 bp, Mus musculus
gattgccgagctggctcagtagtga

SEQ ID NO: 522530 - DNA, 25 bp, Mus musculus
gattgccgccaaagctatgggccaa

SEQ ID NO: 522531 - DNA, 25 bp, Mus musculus
gattgccgccaatgctatgggccaa

SEQ ID NO: 522532 - DNA, 25 bp, Mus musculus
gattgcctaacacccttagttttga

SEQ ID NO: 522533 - DNA, 25 bp, Mus musculus
gattgcctaacagccttagttttga

SEQ ID NO: 522534 - DNA, 25 bp, Mus musculus
gattgcctaattcagtcgttgtcag

SEQ ID NO: 522535 - DNA, 25 bp, Mus musculus
gattgcctaattgagtcgttgtcag

SEQ ID NO: 522536 - DNA, 25 bp, Mus musculus
gattgcctaccaaatgcaagtccct

SEQ ID NO: 522537 - DNA, 25 bp, Mus musculus
gattgcctaccatatgcaagtccct

SEQ ID NO: 522538 - DNA, 25 bp, Mus musculus
gattgcctcacaagttgtctgttta

SEQ ID NO: 522539 - DNA, 25 bp, Mus musculus
gattgcctcacatgttgtctgttta

SEQ ID NO: 522540 - DNA, 25 bp, Mus musculus
gattgcctcatcaaccgagaattgg

SEQ ID NO: 522541 - DNA, 25 bp, Mus musculus
gattgcctcatctaccgagaattgg

SEQ ID NO: 522542 - DNA, 25 bp, Mus musculus
gattgcctcgccaatgtcagaggga

SEQ ID NO: 522543 - DNA, 25 bp, Mus musculus
gattgcctcgcctatgtcagaggga

SEQ ID NO: 522544 - DNA, 25 bp, Mus musculus
gattgcctctagatggctcatcact

SEQ ID NO: 522545 - DNA, 25 bp, Mus musculus
gattgcctctagttggctcatcact

SEQ ID NO: 522546 - DNA, 25 bp, Mus musculus
gattgcctctttcacatttttgcca

SEQ ID NO: 522547 - DNA, 25 bp, Mus musculus
gattgcctctttgacatttttgcca

SEQ ID NO: 522548 - DNA, 25 bp, Mus musculus
gattgcctgaaacatccaggtccct

SEQ ID NO: 522549 - DNA, 25 bp, Mus musculus
gattgcctgaaagatccaggtccct

SEQ ID NO: 522550 - DNA, 25 bp, Mus musculus
gattgcctgagcatcttgaaagatt

SEQ ID NO: 522551 - DNA, 25 bp, Mus musculus
gattgcctgagcttcttgaaagatt

SEQ ID NO: 522552 - DNA, 25 bp, Mus musculus
gattgccttaggatgtcttgacact

SEQ ID NO: 522553 - DNA, 25 bp, Mus musculus
gattgccttaggcacagttacccag

SEQ ID NO: 522554 - DNA, 25 bp, Mus musculus
gattgccttagggacagttacccag

SEQ ID NO: 522555 - DNA, 25 bp, Mus musculus
gattgccttaggttgtcttgacact

SEQ ID NO: 522556 - DNA, 25 bp, Mus musculus
gattgccttgacagataattccttg

SEQ ID NO: 522557 - DNA, 25 bp, Mus musculus
gattgccttgactgataattccttg

SEQ ID NO: 522558 - DNA, 25 bp, Mus musculus
gattgccttgtcatcagtgaacagg

SEQ ID NO: 522559 - DNA, 25 bp, Mus musculus
gattgccttgtcttcagtgaacagg

SEQ ID NO: 522560 - DNA, 25 bp, Mus musculus
gattgcctttcaattcatggtagag

SEQ ID NO: 522561 - DNA, 25 bp, Mus musculus
gattgcctttcatttcatggtagag

SEQ ID NO: 522562 - DNA, 25 bp, Mus musculus
gattgcctttggattttggttgaac

SEQ ID NO: 522563 - DNA, 25 bp, Mus musculus
gattgcctttggtttttggttgaac

SEQ ID NO: 522564 - DNA, 25 bp, Mus musculus
gattgcgaagtgacattttgttttt

SEQ ID NO: 522565 - DNA, 25 bp, Mus musculus
gattgcgaagtgtcattttgttttt

SEQ ID NO: 522566 - DNA, 25 bp, Mus musculus
gattgcgcacaaatgtaggcttagc

SEQ ID NO: 522567 - DNA, 25 bp, Mus musculus
gattgcgcacaattgtaggcttagc

SEQ ID NO: 522568 - DNA, 25 bp, Mus musculus
gattgcgccccacatccaggatttg

SEQ ID NO: 522569 - DNA, 25 bp, Mus musculus
gattgcgccccagatccaggatttg

SEQ ID NO: 522570 - DNA, 25 bp, Mus musculus
gattgcgctcatacgcaggactttc

SEQ ID NO: 522571 - DNA, 25 bp, Mus musculus
gattgcgctcattcgcaggactttc

SEQ ID NO: 522572 - DNA, 25 bp, Mus musculus
gattgcgcttcaacctgccagtgaa

SEQ ID NO: 522573 - DNA, 25 bp, Mus musculus
gattgcgcttcatcctgccagtgaa

SEQ ID NO: 522574 - DNA, 25 bp, Mus musculus
gattgcggagctaaaggagagatta

SEQ ID NO: 522575 - DNA, 25 bp, Mus musculus
gattgcggagcttaaggagagatta

SEQ ID NO: 522576 - DNA, 25 bp, Mus musculus
gattgcggcaagaggcggacatcac

SEQ ID NO: 522577 - DNA, 25 bp, Mus musculus
gattgcggcaagtggcggacatcac

SEQ ID NO: 522578 - DNA, 25 bp, Mus musculus
gattgcggcttgaacctacaggcaa

SEQ ID NO: 522579 - DNA, 25 bp, Mus musculus
gattgcggcttgtacctacaggcaa

SEQ ID NO: 522580 - DNA, 25 bp, Mus musculus
gattgcgtcaatcaacacacttttt

SEQ ID NO: 522581 - DNA, 25 bp, Mus musculus
gattgcgtcaatgaacacacttttt

SEQ ID NO: 522582 - DNA, 25 bp, Mus musculus
gattgcgtccggatgggaaactgaa

SEQ ID NO: 522583 - DNA, 25 bp, Mus musculus
gattgcgtccggttgggaaactgaa

SEQ ID NO: 522584 - DNA, 25 bp, Mus musculus
gattgcgttacgctctgagatgcct

SEQ ID NO: 522585 - DNA, 25 bp, Mus musculus
gattgcgttacggtctgagatgcct

SEQ ID NO: 522586 - DNA, 25 bp, Mus musculus
gattgctaacacaggtcacactcag

SEQ ID NO: 522587 - DNA, 25 bp, Mus musculus
gattgctaacactggtcacactcag

SEQ ID NO: 522588 - DNA, 25 bp, Mus musculus
gattgctaacccagtgaatttgtct

SEQ ID NO: 522589 - DNA, 25 bp, Mus musculus
gattgctaaccctgtgaatttgtct

SEQ ID NO: 522590 - DNA, 25 bp, Mus musculus
gattgctaaggtatgcccatgattc

SEQ ID NO: 522591 - DNA, 25 bp, Mus musculus
gattgctaaggtttgcccatgattc

SEQ ID NO: 522592 - DNA, 25 bp, Mus musculus
gattgctacaataaaatgttccctt

SEQ ID NO: 522593 - DNA, 25 bp, Mus musculus
gattgctacaattaaatgttccctt

SEQ ID NO: 522594 - DNA, 25 bp, Mus musculus
gattgctacataccttggacttgag

SEQ ID NO: 522595 - DNA, 25 bp, Mus musculus
gattgctacatagcttggacttgag

SEQ ID NO: 522596 - DNA, 25 bp, Mus musculus
gattgctaccttatcagctaggtgc

SEQ ID NO: 522597 - DNA, 25 bp, Mus musculus
gattgctaccttttcagctaggtgc

SEQ ID NO: 522598 - DNA, 25 bp, Mus musculus
gattgctactgtacatgtgcaaatg

SEQ ID NO: 522599 - DNA, 25 bp, Mus musculus
gattgctactgttcatgtgcaaatg

SEQ ID NO: 522600 - DNA, 25 bp, Mus musculus
gattgctagacacactaagagtgga

SEQ ID NO: 522601 - DNA, 25 bp, Mus musculus
gattgctagacagactaagagtgga

SEQ ID NO: 522602 - DNA, 25 bp, Mus musculus
gattgctagggcactgaaattaaca

SEQ ID NO: 522603 - DNA, 25 bp, Mus musculus
gattgctagggctctgaaattaaca

SEQ ID NO: 522604 - DNA, 25 bp, Mus musculus
gattgctatacacaaaataaactca

SEQ ID NO: 522605 - DNA, 25 bp, Mus musculus
gattgctatacagaaaataaactca

SEQ ID NO: 522606 - DNA, 25 bp, Mus musculus
gattgctatcttaaggtggattctc

SEQ ID NO: 522607 - DNA, 25 bp, Mus musculus
gattgctatctttaggtggattctc

SEQ ID NO: 522608 - DNA, 25 bp, Mus musculus
gattgctatgcccaggtgacaatgt

SEQ ID NO: 522609 - DNA, 25 bp, Mus musculus
gattgctatgccgaggtgacaatgt

SEQ ID NO: 522610 - DNA, 25 bp, Mus musculus
gattgctatgtgagactttccattt

SEQ ID NO: 522611 - DNA, 25 bp, Mus musculus
gattgctatgtgtgactttccattt

SEQ ID NO: 522612 - DNA, 25 bp, Mus musculus
gattgctcagtgctgccacatcaga

SEQ ID NO: 522613 - DNA, 25 bp, Mus musculus
gattgctcagtggtgccacatcaga

SEQ ID NO: 522614 - DNA, 25 bp, Mus musculus
gattgctcagttagagtcttcagca

SEQ ID NO: 522615 - DNA, 25 bp, Mus musculus
gattgctcagtttgagtcttcagca

SEQ ID NO: 522616 - DNA, 25 bp, Mus musculus
gattgctcatatacttcaactccag

SEQ ID NO: 522617 - DNA, 25 bp, Mus musculus
gattgctcatattcttcaactccag

SEQ ID NO: 522618 - DNA, 25 bp, Mus musculus
gattgctcatcgatttgacttgcga

SEQ ID NO: 522619 - DNA, 25 bp, Mus musculus
gattgctcatcgttttgacttgcga

SEQ ID NO: 522620 - DNA, 25 bp, Mus musculus
gattgctcatgcaacacaagtggga

SEQ ID NO: 522621 - DNA, 25 bp, Mus musculus
gattgctcatgctacacaagtggga

SEQ ID NO: 522622 - DNA, 25 bp, Mus musculus
gattgctcccatccgtcggtggatt

SEQ ID NO: 522623 - DNA, 25 bp, Mus musculus
gattgctcccatgcgtcggtggatt

SEQ ID NO: 522624 - DNA, 25 bp, Mus musculus
gattgctccggaatcctttaagggc

SEQ ID NO: 522625 - DNA, 25 bp, Mus musculus
gattgctccggattcctttaagggc

SEQ ID NO: 522626 - DNA, 25 bp, Mus musculus
gattgctcctaaaaactgaaacggg

SEQ ID NO: 522627 - DNA, 25 bp, Mus musculus
gattgctcctaataactgaaacggg

SEQ ID NO: 522628 - DNA, 25 bp, Mus musculus
gattgctcctccactggcttggaaa

SEQ ID NO: 522629 - DNA, 25 bp, Mus musculus
gattgctcctcctctggcttggaaa

SEQ ID NO: 522630 - DNA, 25 bp, Mus musculus
gattgctcgatcacttggtaagttt

SEQ ID NO: 522631 - DNA, 25 bp, Mus musculus
gattgctcgatctcttggtaagttt

SEQ ID NO: 522632 - DNA, 25 bp, Mus musculus
gattgctcgcaacaccaaggacatt

SEQ ID NO: 522633 - DNA, 25 bp, Mus musculus
gattgctcgcaagaccaaggacatt

SEQ ID NO: 522634 - DNA, 25 bp, Mus musculus
gattgctctagcagggacccaagtt

SEQ ID NO: 522635 - DNA, 25 bp, Mus musculus
gattgctctagctgggacccaagtt

SEQ ID NO: 522636 - DNA, 25 bp, Mus musculus
gattgctctagtaatctcaaccaga

SEQ ID NO: 522637 - DNA, 25 bp, Mus musculus
gattgctctagttatctcaaccaga

SEQ ID NO: 522638 - DNA, 25 bp, Mus musculus
gattgctctcaaaagaggagtgtca

SEQ ID NO: 522639 - DNA, 25 bp, Mus musculus
gattgctctcaatagaggagtgtca

SEQ ID NO: 522640 - DNA, 25 bp, Mus musculus
gattgctctgaacgcttgcttgcct

SEQ ID NO: 522641 - DNA, 25 bp, Mus musculus
gattgctctgaaggcttgcttgcct

SEQ ID NO: 522642 - DNA, 25 bp, Mus musculus
gattgctctgagacaacttcatcat

SEQ ID NO: 522643 - DNA, 25 bp, Mus musculus
gattgctctgagtcaacttcatcat

SEQ ID NO: 522644 - DNA, 25 bp, Mus musculus
gattgctgaactattttgtgctctg

SEQ ID NO: 522645 - DNA, 25 bp, Mus musculus
gattgctgaacttttttgtgctctg

SEQ ID NO: 522646 - DNA, 25 bp, Mus musculus
gattgctgacaaccctgaaggctta

SEQ ID NO: 522647 - DNA, 25 bp, Mus musculus
gattgctgacaagcctgaaggctta

SEQ ID NO: 522648 - DNA, 25 bp, Mus musculus
gattgctgaccacaccaagttttac

SEQ ID NO: 522649 - DNA, 25 bp, Mus musculus
gattgctgaccagaccaagttttac

SEQ ID NO: 522650 - DNA, 25 bp, Mus musculus
gattgctgacgtcgacacggactcc

SEQ ID NO: 522651 - DNA, 25 bp, Mus musculus
gattgctgacgtggacacggactcc

SEQ ID NO: 522652 - DNA, 25 bp, Mus musculus
gattgctgagccatgctgagaacaa

SEQ ID NO: 522653 - DNA, 25 bp, Mus musculus
gattgctgagccttgctgagaacaa

SEQ ID NO: 522654 - DNA, 25 bp, Mus musculus
gattgctgcagcacatgtaggtttg

SEQ ID NO: 522655 - DNA, 25 bp, Mus musculus
gattgctgcagctcatgtaggtttg

SEQ ID NO: 522656 - DNA, 25 bp, Mus musculus
gattgctgcattaaaaaaccactga

SEQ ID NO: 522657 - DNA, 25 bp, Mus musculus
gattgctgcatttaaaaaccactga

SEQ ID NO: 522658 - DNA, 25 bp, Mus musculus
gattgctgcctgaagggcatgactt

SEQ ID NO: 522659 - DNA, 25 bp, Mus musculus
gattgctgcctgtagggcatgactt

SEQ ID NO: 522660 - DNA, 25 bp, Mus musculus
gattgctgccttcctggctagccca

SEQ ID NO: 522661 - DNA, 25 bp, Mus musculus
gattgctgccttgctggctagccca

SEQ ID NO: 522662 - DNA, 25 bp, Mus musculus
gattgctgcgtaccaactgtgtgtt

SEQ ID NO: 522663 - DNA, 25 bp, Mus musculus
gattgctgcgtagcaactgtgtgtt

SEQ ID NO: 522664 - DNA, 25 bp, Mus musculus
gattgctgctgcctatgtagctgaa

SEQ ID NO: 522665 - DNA, 25 bp, Mus musculus
gattgctgctgcgtatgtagctgaa

SEQ ID NO: 522666 - DNA, 25 bp, Mus musculus
gattgctggccacaaatcccaatgt

SEQ ID NO: 522667 - DNA, 25 bp, Mus musculus
gattgctggccagaaatcccaatgt

SEQ ID NO: 522668 - DNA, 25 bp, Mus musculus
gattgctgggatacctgatcttcca

SEQ ID NO: 522669 - DNA, 25 bp, Mus musculus
gattgctgggattcctgatcttcca

SEQ ID NO: 522670 - DNA, 25 bp, Mus musculus
gattgctgggcaattaaaggaccct

SEQ ID NO: 522671 - DNA, 25 bp, Mus musculus
gattgctgggcatttaaaggaccct

SEQ ID NO: 522672 - DNA, 25 bp, Mus musculus
gattgctgggtgactcatgactttt

SEQ ID NO: 522673 - DNA, 25 bp, Mus musculus
gattgctgggtgtctcatgactttt

SEQ ID NO: 522674 - DNA, 25 bp, Mus musculus
gattgctgtaggcactgttctcacc

SEQ ID NO: 522675 - DNA, 25 bp, Mus musculus
gattgctgtagggactgttctcacc

SEQ ID NO: 522676 - DNA, 25 bp, Mus musculus
gattgctgtagtatacactttgtat

SEQ ID NO: 522677 - DNA, 25 bp, Mus musculus
gattgctgtagtttacactttgtat

SEQ ID NO: 522678 - DNA, 25 bp, Mus musculus
gattgctgtattacaccaaaagtat

SEQ ID NO: 522679 - DNA, 25 bp, Mus musculus
gattgctgtattctcactttctgaa

SEQ ID NO: 522680 - DNA, 25 bp, Mus musculus
gattgctgtattgtcactttctgaa

SEQ ID NO: 522681 - DNA, 25 bp, Mus musculus
gattgctgtatttcaccaaaagtat

SEQ ID NO: 522682 - DNA, 25 bp, Mus musculus
gattgctgtcaaaacaaggcttgga

SEQ ID NO: 522683 - DNA, 25 bp, Mus musculus
gattgctgtcaatacaaggcttgga

SEQ ID NO: 522684 - DNA, 25 bp, Mus musculus
gattgctgtcccctctaaaggaggt

SEQ ID NO: 522685 - DNA, 25 bp, Mus musculus
gattgctgtcccgtctaaaggaggt

SEQ ID NO: 522686 - DNA, 25 bp, Mus musculus
gattgctgttcactggctcggttac

SEQ ID NO: 522687 - DNA, 25 bp, Mus musculus
gattgctgttcagtggctcggttac

SEQ ID NO: 522688 - DNA, 25 bp, Mus musculus
gattgcttaacacaatttgggactt

SEQ ID NO: 522689 - DNA, 25 bp, Mus musculus
gattgcttaacagaatttgggactt

SEQ ID NO: 522690 - DNA, 25 bp, Mus musculus
gattgcttactcatgggcatgtgac

SEQ ID NO: 522691 - DNA, 25 bp, Mus musculus
gattgcttactcttgggcatgtgac

SEQ ID NO: 522692 - DNA, 25 bp, Mus musculus
gattgcttagacattattggtgaca

SEQ ID NO: 522693 - DNA, 25 bp, Mus musculus
gattgcttagactttattggtgaca

SEQ ID NO: 522694 - DNA, 25 bp, Mus musculus
gattgcttagttccttagctggcat

SEQ ID NO: 522695 - DNA, 25 bp, Mus musculus
gattgcttagttgcttagctggcat

SEQ ID NO: 522696 - DNA, 25 bp, Mus musculus
gattgcttatagataggccacatga

SEQ ID NO: 522697 - DNA, 25 bp, Mus musculus
gattgcttatagttaggccacatga

SEQ ID NO: 522698 - DNA, 25 bp, Mus musculus
gattgcttatccactaggactggcc

SEQ ID NO: 522699 - DNA, 25 bp, Mus musculus
gattgcttatcctctaggactggcc

SEQ ID NO: 522700 - DNA, 25 bp, Mus musculus
gattgcttatgtctgcctatgtgta

SEQ ID NO: 522701 - DNA, 25 bp, Mus musculus
gattgcttatgtgtgcctatgtgta

SEQ ID NO: 522702 - DNA, 25 bp, Mus musculus
gattgcttattaaggacctcctaat

SEQ ID NO: 522703 - DNA, 25 bp, Mus musculus
gattgcttattatggacctcctaat

SEQ ID NO: 522704 - DNA, 25 bp, Mus musculus
gattgcttcacccaaggctacttat

SEQ ID NO: 522705 - DNA, 25 bp, Mus musculus
gattgcttcaccgaaggctacttat

SEQ ID NO: 522706 - DNA, 25 bp, Mus musculus
gattgcttccagatgctgcgtccaa

SEQ ID NO: 522707 - DNA, 25 bp, Mus musculus
gattgcttccagttgctgcgtccaa

SEQ ID NO: 522708 - DNA, 25 bp, Mus musculus
gattgcttcggacgacacagaccaa

SEQ ID NO: 522709 - DNA, 25 bp, Mus musculus
gattgcttcggaggacacagaccaa

SEQ ID NO: 522710 - DNA, 25 bp, Mus musculus
gattgcttcgtgagctgacggttca

SEQ ID NO: 522711 - DNA, 25 bp, Mus musculus
gattgcttcgtgtgctgacggttca

SEQ ID NO: 522712 - DNA, 25 bp, Mus musculus
gattgcttctcaacatagttcctag

SEQ ID NO: 522713 - DNA, 25 bp, Mus musculus
gattgcttctcatcatagttcctag

SEQ ID NO: 522714 - DNA, 25 bp, Mus musculus
gattgcttgactcctggacagagaa

SEQ ID NO: 522715 - DNA, 25 bp, Mus musculus
gattgcttgactcctttttaggttt

SEQ ID NO: 522716 - DNA, 25 bp, Mus musculus
gattgcttgactgctggacagagaa

SEQ ID NO: 522717 - DNA, 25 bp, Mus musculus
gattgcttgactgctttttaggttt

SEQ ID NO: 522718 - DNA, 25 bp, Mus musculus
gattgcttgagactagccctttggg

SEQ ID NO: 522719 - DNA, 25 bp, Mus musculus
gattgcttgagagtagccctttggg

SEQ ID NO: 522720 - DNA, 25 bp, Mus musculus
gattgcttgcaacgttcttgccttt

SEQ ID NO: 522721 - DNA, 25 bp, Mus musculus
gattgcttgcaaggttcttgccttt

SEQ ID NO: 522722 - DNA, 25 bp, Mus musculus
gattgcttgcacattacatttctag

SEQ ID NO: 522723 - DNA, 25 bp, Mus musculus
gattgcttgcactttacatttctag

SEQ ID NO: 522724 - DNA, 25 bp, Mus musculus
gattgcttgtagacccaaagctcat

SEQ ID NO: 522725 - DNA, 25 bp, Mus musculus
gattgcttgtagtcccaaagctcat

SEQ ID NO: 522726 - DNA, 25 bp, Mus musculus
gattgctttaatctgccttatgaat

SEQ ID NO: 522727 - DNA, 25 bp, Mus musculus
gattgctttaatctgtggcacaacc

SEQ ID NO: 522728 - DNA, 25 bp, Mus musculus
gattgctttaatgtgccttatgaat

SEQ ID NO: 522729 - DNA, 25 bp, Mus musculus
gattgctttaatgtgtggcacaacc

SEQ ID NO: 522730 - DNA, 25 bp, Mus musculus
gattgctttactcgtgttctaatac

SEQ ID NO: 522731 - DNA, 25 bp, Mus musculus
gattgctttactggtgttctaatac

SEQ ID NO: 522732 - DNA, 25 bp, Mus musculus
gattgctttctgatgtgaacttatt

SEQ ID NO: 522733 - DNA, 25 bp, Mus musculus
gattgctttctgttgtgaacttatt

SEQ ID NO: 522734 - DNA, 25 bp, Mus musculus
gattgctttgcgataaccttcaaga

SEQ ID NO: 522735 - DNA, 25 bp, Mus musculus
gattgctttgcgttaaccttcaaga

SEQ ID NO: 522736 - DNA, 25 bp, Mus musculus
gattgcttttcaaagctttcccctt

SEQ ID NO: 522737 - DNA, 25 bp, Mus musculus
gattgcttttcatagctttcccctt

SEQ ID NO: 522738 - DNA, 25 bp, Mus musculus
gattgcttttgccaggattttctcc

SEQ ID NO: 522739 - DNA, 25 bp, Mus musculus
gattgcttttgcgaggattttctcc

SEQ ID NO: 522740 - DNA, 25 bp, Mus musculus
gattgcttttgtaaggatggccact

SEQ ID NO: 522741 - DNA, 25 bp, Mus musculus
gattgcttttgttaggatggccact

SEQ ID NO: 522742 - DNA, 25 bp, Mus musculus
gattggaaaatactcctgcacacaa

SEQ ID NO: 522743 - DNA, 25 bp, Mus musculus
gattggaaaatagtcctgcacacaa

SEQ ID NO: 522744 - DNA, 25 bp, Mus musculus
gattggaaacctacatgttgtcaga

SEQ ID NO: 522745 - DNA, 25 bp, Mus musculus
gattggaaaccttcatgttgtcaga

SEQ ID NO: 522746 - DNA, 25 bp, Mus musculus
gattggaaactcactaaccgtaaag

SEQ ID NO: 522747 - DNA, 25 bp, Mus musculus
gattggaaactctctaaccgtaaag

SEQ ID NO: 522748 - DNA, 25 bp, Mus musculus
gattggaaactgactcgtctctgga

SEQ ID NO: 522749 - DNA, 25 bp, Mus musculus
gattggaaactgtctcgtctctgga

SEQ ID NO: 522750 - DNA, 25 bp, Mus musculus
gattggaaacttctgaagcagctag

SEQ ID NO: 522751 - DNA, 25 bp, Mus musculus
gattggaaacttgtgaagcagctag

SEQ ID NO: 522752 - DNA, 25 bp, Mus musculus
gattggaacttgaggatctcctttc

SEQ ID NO: 522753 - DNA, 25 bp, Mus musculus
gattggaacttgtggatctcctttc

SEQ ID NO: 522754 - DNA, 25 bp, Mus musculus
gattggaaggatagatcctaatagt

SEQ ID NO: 522755 - DNA, 25 bp, Mus musculus
gattggaaggattgatcctaatagt

SEQ ID NO: 522756 - DNA, 25 bp, Mus musculus
gattggaataaaccactcttctcgt

SEQ ID NO: 522757 - DNA, 25 bp, Mus musculus
gattggaataaagcactcttctcgt

SEQ ID NO: 522758 - DNA, 25 bp, Mus musculus
gattggaatacaacatgaactctgg

SEQ ID NO: 522759 - DNA, 25 bp, Mus musculus
gattggaatacatcatgaactctgg

SEQ ID NO: 522760 - DNA, 25 bp, Mus musculus
gattggaatcttacctcttgctcta

SEQ ID NO: 522761 - DNA, 25 bp, Mus musculus
gattggaatctttcctcttgctcta

SEQ ID NO: 522762 - DNA, 25 bp, Mus musculus
gattggacacatcatatgcctcttg

SEQ ID NO: 522763 - DNA, 25 bp, Mus musculus
gattggacacatgatatgcctcttg

SEQ ID NO: 522764 - DNA, 25 bp, Mus musculus
gattggacacgtcagactgtgacat

SEQ ID NO: 522765 - DNA, 25 bp, Mus musculus
gattggacacgtgagactgtgacat

SEQ ID NO: 522766 - DNA, 25 bp, Mus musculus
gattggacagcgcatgcctcggtat

SEQ ID NO: 522767 - DNA, 25 bp, Mus musculus
gattggacagcggatgcctcggtat

SEQ ID NO: 522768 - DNA, 25 bp, Mus musculus
gattggacatgacctttgctccctc

SEQ ID NO: 522769 - DNA, 25 bp, Mus musculus
gattggacatgagctttgctccctc

SEQ ID NO: 522770 - DNA, 25 bp, Mus musculus
gattggacctgcagaagtcacctgt

SEQ ID NO: 522771 - DNA, 25 bp, Mus musculus
gattggacctgctgaagtcacctgt

SEQ ID NO: 522772 - DNA, 25 bp, Mus musculus
gattggactagcacttaagacacta

SEQ ID NO: 522773 - DNA, 25 bp, Mus musculus
gattggactagctcttaagacacta

SEQ ID NO: 522774 - DNA, 25 bp, Mus musculus
gattggactcagactaataaatttt

SEQ ID NO: 522775 - DNA, 25 bp, Mus musculus
gattggactcagtctaataaatttt

SEQ ID NO: 522776 - DNA, 25 bp, Mus musculus
gattggactccaacatcttttgtac

SEQ ID NO: 522777 - DNA, 25 bp, Mus musculus
gattggactccatcatcttttgtac

SEQ ID NO: 522778 - DNA, 25 bp, Mus musculus
gattggacttctcgaatccactggg

SEQ ID NO: 522779 - DNA, 25 bp, Mus musculus
gattggacttctggaatccactggg

SEQ ID NO: 522780 - DNA, 25 bp, Mus musculus
gattggacttggaactcagcgaaaa

SEQ ID NO: 522781 - DNA, 25 bp, Mus musculus
gattggacttggtactcagcgaaaa

SEQ ID NO: 522782 - DNA, 25 bp, Mus musculus
gattggagcccgaattaaatgaagc

SEQ ID NO: 522783 - DNA, 25 bp, Mus musculus
gattggagcccgtattaaatgaagc

SEQ ID NO: 522784 - DNA, 25 bp, Mus musculus
gattggagcgttaccttgcctgcat

SEQ ID NO: 522785 - DNA, 25 bp, Mus musculus
gattggagcgtttccttgcctgcat

SEQ ID NO: 522786 - DNA, 25 bp, Mus musculus
gattggagctatatatccaggaaat

SEQ ID NO: 522787 - DNA, 25 bp, Mus musculus
gattggagctatttatccaggaaat

SEQ ID NO: 522788 - DNA, 25 bp, Mus musculus
gattggagctctcggccggaggctg

SEQ ID NO: 522789 - DNA, 25 bp, Mus musculus
gattggagctctgggccggaggctg

SEQ ID NO: 522790 - DNA, 25 bp, Mus musculus
gattggagcttgatacttaatgggc

SEQ ID NO: 522791 - DNA, 25 bp, Mus musculus
gattggagcttgttacttaatgggc

SEQ ID NO: 522792 - DNA, 25 bp, Mus musculus
gattggaggtagaaagacatttgat

SEQ ID NO: 522793 - DNA, 25 bp, Mus musculus
gattggaggtagtaagacatttgat

SEQ ID NO: 522794 - DNA, 25 bp, Mus musculus
gattggaggtttcttttgagttctt

SEQ ID NO: 522795 - DNA, 25 bp, Mus musculus
gattggaggtttgttttgagttctt

SEQ ID NO: 522796 - DNA, 25 bp, Mus musculus
gattggagtaccaggtcgccggcca

SEQ ID NO: 522797 - DNA, 25 bp, Mus musculus
gattggagtacctggtcgccggcca

SEQ ID NO: 522798 - DNA, 25 bp, Mus musculus
gattggatatccaggctaggtccca

SEQ ID NO: 522799 - DNA, 25 bp, Mus musculus
gattggatatcctggctaggtccca

SEQ ID NO: 522800 - DNA, 25 bp, Mus musculus
gattggatcatcactacttctgtat

SEQ ID NO: 522801 - DNA, 25 bp, Mus musculus
gattggatcatctctacttctgtat

SEQ ID NO: 522802 - DNA, 25 bp, Mus musculus
gattggattctgagcttagacctgg

SEQ ID NO: 522803 - DNA, 25 bp, Mus musculus
gattggattctgtgcttagacctgg

SEQ ID NO: 522804 - DNA, 25 bp, Mus musculus
gattggattcttcaaaaggccacta

SEQ ID NO: 522805 - DNA, 25 bp, Mus musculus
gattggattcttgaaaaggccacta

SEQ ID NO: 522806 - DNA, 25 bp, Mus musculus
gattggattgagctgccgattcctg

SEQ ID NO: 522807 - DNA, 25 bp, Mus musculus
gattggattgaggtgccgattcctg

SEQ ID NO: 522808 - DNA, 25 bp, Mus musculus
gattggattgcactcttaattggaa

SEQ ID NO: 522809 - DNA, 25 bp, Mus musculus
gattggattgcagtcttaattggaa

SEQ ID NO: 522810 - DNA, 25 bp, Mus musculus
gattggatttataattcaccgatgg

SEQ ID NO: 522811 - DNA, 25 bp, Mus musculus
gattggatttattattcaccgatgg

SEQ ID NO: 522812 - DNA, 25 bp, Mus musculus
gattggatttgacgcatgtcggaca

SEQ ID NO: 522813 - DNA, 25 bp, Mus musculus
gattggatttgaggcatgtcggaca

SEQ ID NO: 522814 - DNA, 25 bp, Mus musculus
gattggcaaaacagctcagcaggta

SEQ ID NO: 522815 - DNA, 25 bp, Mus musculus
gattggcaaaactgctcagcaggta

SEQ ID NO: 522816 - DNA, 25 bp, Mus musculus
gattggcaaatccattgagtggcta

SEQ ID NO: 522817 - DNA, 25 bp, Mus musculus
gattggcaaatcgattgagtggcta

SEQ ID NO: 522818 - DNA, 25 bp, Mus musculus
gattggcaacacctaagtaattcct

SEQ ID NO: 522819 - DNA, 25 bp, Mus musculus
gattggcaacacgtaagtaattcct

SEQ ID NO: 522820 - DNA, 25 bp, Mus musculus
gattggcaactcagcatgatctaga

SEQ ID NO: 522821 - DNA, 25 bp, Mus musculus
gattggcaactctgcatgatctaga

SEQ ID NO: 522822 - DNA, 25 bp, Mus musculus
gattggcaagctaacctttcttttc

SEQ ID NO: 522823 - DNA, 25 bp, Mus musculus
gattggcaagcttacctttcttttc

SEQ ID NO: 522824 - DNA, 25 bp, Mus musculus
gattggcaaggtaaagattactact

SEQ ID NO: 522825 - DNA, 25 bp, Mus musculus
gattggcaaggttaagattactact

SEQ ID NO: 522826 - DNA, 25 bp, Mus musculus
gattggcaatgaacctcttaacttg

SEQ ID NO: 522827 - DNA, 25 bp, Mus musculus
gattggcaatgatcctcttaacttg

SEQ ID NO: 522828 - DNA, 25 bp, Mus musculus
gattggcacatgaaacactggcgag

SEQ ID NO: 522829 - DNA, 25 bp, Mus musculus
gattggcacatgtaacactggcgag

SEQ ID NO: 522830 - DNA, 25 bp, Mus musculus
gattggcaccaaacagccagagcta

SEQ ID NO: 522831 - DNA, 25 bp, Mus musculus
gattggcaccaatcagccagagcta

SEQ ID NO: 522832 - DNA, 25 bp, Mus musculus
gattggcaccagacagactctgtag

SEQ ID NO: 522833 - DNA, 25 bp, Mus musculus
gattggcaccagtcagactctgtag

SEQ ID NO: 522834 - DNA, 25 bp, Mus musculus
gattggcacctaagctgggctctcg

SEQ ID NO: 522835 - DNA, 25 bp, Mus musculus
gattggcacctatgctgggctctcg

SEQ ID NO: 522836 - DNA, 25 bp, Mus musculus
gattggcagcagagaacataacata

SEQ ID NO: 522837 - DNA, 25 bp, Mus musculus
gattggcagcagtgaacataacata

SEQ ID NO: 522838 - DNA, 25 bp, Mus musculus
gattggcagcataaccaagggcaca

SEQ ID NO: 522839 - DNA, 25 bp, Mus musculus
gattggcagcattaccaagggcaca

SEQ ID NO: 522840 - DNA, 25 bp, Mus musculus
gattggcagcgaaccggagctcctg

SEQ ID NO: 522841 - DNA, 25 bp, Mus musculus
gattggcagcgatccggagctcctg

SEQ ID NO: 522842 - DNA, 25 bp, Mus musculus
gattggcagctgagcaatgctaaac

SEQ ID NO: 522843 - DNA, 25 bp, Mus musculus
gattggcagctgtgcaatgctaaac

SEQ ID NO: 522844 - DNA, 25 bp, Mus musculus
gattggcaggaaccacttcatgact

SEQ ID NO: 522845 - DNA, 25 bp, Mus musculus
gattggcaggaagcacttcatgact

SEQ ID NO: 522846 - DNA, 25 bp, Mus musculus
gattggcagggcaatgcatcccata

SEQ ID NO: 522847 - DNA, 25 bp, Mus musculus
gattggcagggctatgcatcccata

SEQ ID NO: 522848 - DNA, 25 bp, Mus musculus
gattggcagtggatgttctcccttt

SEQ ID NO: 522849 - DNA, 25 bp, Mus musculus
gattggcagtggttgttctcccttt

SEQ ID NO: 522850 - DNA, 25 bp, Mus musculus
gattggcataagcactatgtctcca

SEQ ID NO: 522851 - DNA, 25 bp, Mus musculus
gattggcataaggactatgtctcca

SEQ ID NO: 522852 - DNA, 25 bp, Mus musculus
gattggcataatccagcgcttgtaa

SEQ ID NO: 522853 - DNA, 25 bp, Mus musculus
gattggcataatgcagcgcttgtaa

SEQ ID NO: 522854 - DNA, 25 bp, Mus musculus
gattggcatcagatgtagtccacaa

SEQ ID NO: 522855 - DNA, 25 bp, Mus musculus
gattggcatcagttgtagtccacaa

SEQ ID NO: 522856 - DNA, 25 bp, Mus musculus
gattggccaatcatctaggactcct

SEQ ID NO: 522857 - DNA, 25 bp, Mus musculus
gattggccaatcttctaggactcct

SEQ ID NO: 522858 - DNA, 25 bp, Mus musculus
gattggccagagaagtgcccctaga

SEQ ID NO: 522859 - DNA, 25 bp, Mus musculus
gattggccagagtagtgcccctaga

SEQ ID NO: 522860 - DNA, 25 bp, Mus musculus
gattggccagtcatgacagccgtgg

SEQ ID NO: 522861 - DNA, 25 bp, Mus musculus
gattggccagtcttgacagccgtgg

SEQ ID NO: 522862 - DNA, 25 bp, Mus musculus
gattggccatatcaacatcagcggt

SEQ ID NO: 522863 - DNA, 25 bp, Mus musculus
gattggccatatgaacatcagcggt

SEQ ID NO: 522864 - DNA, 25 bp, Mus musculus
gattggccatgaattcagctatggt

SEQ ID NO: 522865 - DNA, 25 bp, Mus musculus
gattggccatgatttcagctatggt

SEQ ID NO: 522866 - DNA, 25 bp, Mus musculus
gattggcccaagaaaattctaatgt

SEQ ID NO: 522867 - DNA, 25 bp, Mus musculus
gattggcccaagtaaattctaatgt

SEQ ID NO: 522868 - DNA, 25 bp, Mus musculus
gattggcccaggctttgtgaaccga

SEQ ID NO: 522869 - DNA, 25 bp, Mus musculus
gattggcccagggtttgtgaaccga

SEQ ID NO: 522870 - DNA, 25 bp, Mus musculus
gattggcccatcagaagtttacctc

SEQ ID NO: 522871 - DNA, 25 bp, Mus musculus
gattggcccatctgaagtttacctc

SEQ ID NO: 522872 - DNA, 25 bp, Mus musculus
gattggcccgaaaggcagaggcttt

SEQ ID NO: 522873 - DNA, 25 bp, Mus musculus
gattggcccgaatggcagaggcttt

SEQ ID NO: 522874 - DNA, 25 bp, Mus musculus
gattggccgctaccgcatgatcaag

SEQ ID NO: 522875 - DNA, 25 bp, Mus musculus
gattggccgctagcgcatgatcaag

SEQ ID NO: 522876 - DNA, 25 bp, Mus musculus
gattggccggcgagattgtctgacc

SEQ ID NO: 522877 - DNA, 25 bp, Mus musculus
gattggccggcgtgattgtctgacc

SEQ ID NO: 522878 - DNA, 25 bp, Mus musculus
gattggcctataattcttacttgaa

SEQ ID NO: 522879 - DNA, 25 bp, Mus musculus
gattggcctatatttcttacttgaa

SEQ ID NO: 522880 - DNA, 25 bp, Mus musculus
gattggcctcagagtccatttggga

SEQ ID NO: 522881 - DNA, 25 bp, Mus musculus
gattggcctcagtgtccatttggga

SEQ ID NO: 522882 - DNA, 25 bp, Mus musculus
gattggcctttaacttatactacca

SEQ ID NO: 522883 - DNA, 25 bp, Mus musculus
gattggcctttatcttatactacca

SEQ ID NO: 522884 - DNA, 25 bp, Mus musculus
gattggccttttccggccagagagc

SEQ ID NO: 522885 - DNA, 25 bp, Mus musculus
gattggccttttgcggccagagagc

SEQ ID NO: 522886 - DNA, 25 bp, Mus musculus
gattggcgacagagagcatcctgtt

SEQ ID NO: 522887 - DNA, 25 bp, Mus musculus
gattggcgacagtgagcatcctgtt

SEQ ID NO: 522888 - DNA, 25 bp, Mus musculus
gattggcgacctcaagtttaccagc

SEQ ID NO: 522889 - DNA, 25 bp, Mus musculus
gattggcgacctgaagtttaccagc

SEQ ID NO: 522890 - DNA, 25 bp, Mus musculus
gattggcgaggtacaggtggcctgt

SEQ ID NO: 522891 - DNA, 25 bp, Mus musculus
gattggcgaggttcaggtggcctgt

SEQ ID NO: 522892 - DNA, 25 bp, Mus musculus
gattggcgtcatcccagataccagg

SEQ ID NO: 522893 - DNA, 25 bp, Mus musculus
gattggcgtcatgccagataccagg

SEQ ID NO: 522894 - DNA, 25 bp, Mus musculus
gattggctagaacactgaagaccct

SEQ ID NO: 522895 - DNA, 25 bp, Mus musculus
gattggctagaagactgaagaccct

SEQ ID NO: 522896 - DNA, 25 bp, Mus musculus
gattggctaggtcaagactgtaaga

SEQ ID NO: 522897 - DNA, 25 bp, Mus musculus
gattggctaggtgaagactgtaaga

SEQ ID NO: 522898 - DNA, 25 bp, Mus musculus
gattggctagttcctctattccgag

SEQ ID NO: 522899 - DNA, 25 bp, Mus musculus
gattggctagttgctctattccgag

SEQ ID NO: 522900 - DNA, 25 bp, Mus musculus
gattggctcaaaccatccacatctc

SEQ ID NO: 522901 - DNA, 25 bp, Mus musculus
gattggctcaaagcatccacatctc

SEQ ID NO: 522902 - DNA, 25 bp, Mus musculus
gattggctcattctaattgcagcta

SEQ ID NO: 522903 - DNA, 25 bp, Mus musculus
gattggctcattgtaattgcagcta

SEQ ID NO: 522904 - DNA, 25 bp, Mus musculus
gattggctcgctaagaagaaatttc

SEQ ID NO: 522905 - DNA, 25 bp, Mus musculus
gattggctcgcttagaagaaatttc

SEQ ID NO: 522906 - DNA, 25 bp, Mus musculus
gattggctcggcatcgactgaggcc

SEQ ID NO: 522907 - DNA, 25 bp, Mus musculus
gattggctcggcttcgactgaggcc

SEQ ID NO: 522908 - DNA, 25 bp, Mus musculus
gattggctctacagagaacctgaag

SEQ ID NO: 522909 - DNA, 25 bp, Mus musculus
gattggctctactgagaacctgaag

SEQ ID NO: 522910 - DNA, 25 bp, Mus musculus
gattggctctgtcattgatttctgt

SEQ ID NO: 522911 - DNA, 25 bp, Mus musculus
gattggctctgtgattgatttctgt

SEQ ID NO: 522912 - DNA, 25 bp, Mus musculus
gattggctgagtatctatgtagctc

SEQ ID NO: 522913 - DNA, 25 bp, Mus musculus
gattggctgagtttctatgtagctc

SEQ ID NO: 522914 - DNA, 25 bp, Mus musculus
gattggctgcttaagttgtaataat

SEQ ID NO: 522915 - DNA, 25 bp, Mus musculus
gattggctgctttagttgtaataat

SEQ ID NO: 522916 - DNA, 25 bp, Mus musculus
gattggctggtgacaacactgttgc

SEQ ID NO: 522917 - DNA, 25 bp, Mus musculus
gattggctggtgacgatgcttccaa

SEQ ID NO: 522918 - DNA, 25 bp, Mus musculus
gattggctggtgtcaacactgttgc

SEQ ID NO: 522919 - DNA, 25 bp, Mus musculus
gattggctggtgtcgatgcttccaa

SEQ ID NO: 522920 - DNA, 25 bp, Mus musculus
gattggctgtctaatcagctccgga

SEQ ID NO: 522921 - DNA, 25 bp, Mus musculus
gattggctgtcttatcagctccgga

SEQ ID NO: 522922 - DNA, 25 bp, Mus musculus
gattggctgttgctcacatcactca

SEQ ID NO: 522923 - DNA, 25 bp, Mus musculus
gattggctgttggtcacatcactca

SEQ ID NO: 522924 - DNA, 25 bp, Mus musculus
gattggcttgggattgactcttatt

SEQ ID NO: 522925 - DNA, 25 bp, Mus musculus
gattggcttgggtttgactcttatt

SEQ ID NO: 522926 - DNA, 25 bp, Mus musculus
gattggcttgtcacaggtttcttcc

SEQ ID NO: 522927 - DNA, 25 bp, Mus musculus
gattggcttgtctcaggtttcttcc

SEQ ID NO: 522928 - DNA, 25 bp, Mus musculus
gattggcttgttcttatgcttataa

SEQ ID NO: 522929 - DNA, 25 bp, Mus musculus
gattggcttgttgttatgcttataa

SEQ ID NO: 522930 - DNA, 25 bp, Mus musculus
gattggctttctactcacctttgtt

SEQ ID NO: 522931 - DNA, 25 bp, Mus musculus
gattggctttctagtttcccagaga

SEQ ID NO: 522932 - DNA, 25 bp, Mus musculus
gattggctttcttctcacctttgtt

SEQ ID NO: 522933 - DNA, 25 bp, Mus musculus
gattggctttcttgtttcccagaga

SEQ ID NO: 522934 - DNA, 25 bp, Mus musculus
gattggctttgaaccatgtctcggt

SEQ ID NO: 522935 - DNA, 25 bp, Mus musculus
gattggctttgacttaactgttgct

SEQ ID NO: 522936 - DNA, 25 bp, Mus musculus
gattggctttgagttaactgttgct

SEQ ID NO: 522937 - DNA, 25 bp, Mus musculus
gattggctttgatccatgtctcggt

SEQ ID NO: 522938 - DNA, 25 bp, Mus musculus
gattgggaaaccatccgggcaagca

SEQ ID NO: 522939 - DNA, 25 bp, Mus musculus
gattgggaaaccttccgggcaagca

SEQ ID NO: 522940 - DNA, 25 bp, Mus musculus
gattgggaaattacttcccctggcg

SEQ ID NO: 522941 - DNA, 25 bp, Mus musculus
gattgggaaatttcttcccctggcg

SEQ ID NO: 522942 - DNA, 25 bp, Mus musculus
gattgggaactacaactccttggta

SEQ ID NO: 522943 - DNA, 25 bp, Mus musculus
gattgggaactagaactccttggta

SEQ ID NO: 522944 - DNA, 25 bp, Mus musculus
gattgggaagacaagctcatcttta

SEQ ID NO: 522945 - DNA, 25 bp, Mus musculus
gattgggaagactagctcatcttta

SEQ ID NO: 522946 - DNA, 25 bp, Mus musculus
gattgggactgcatctgtccttcat

SEQ ID NO: 522947 - DNA, 25 bp, Mus musculus
gattgggactgcttctgtccttcat

SEQ ID NO: 522948 - DNA, 25 bp, Mus musculus
gattgggagactctgcctcaatgaa

SEQ ID NO: 522949 - DNA, 25 bp, Mus musculus
gattgggagactgtgcctcaatgaa

SEQ ID NO: 522950 - DNA, 25 bp, Mus musculus
gattgggagggtcccatctgtttca

SEQ ID NO: 522951 - DNA, 25 bp, Mus musculus
gattgggagggtgccatctgtttca

SEQ ID NO: 522952 - DNA, 25 bp, Mus musculus
gattgggagtggcacttccacccga

SEQ ID NO: 522953 - DNA, 25 bp, Mus musculus
gattgggagtgggacttccacccga

SEQ ID NO: 522954 - DNA, 25 bp, Mus musculus
gattgggatcatcctgtgtttacag

SEQ ID NO: 522955 - DNA, 25 bp, Mus musculus
gattgggatcatgctgtgtttacag

SEQ ID NO: 522956 - DNA, 25 bp, Mus musculus
gattgggcaactcctgtcaggcata

SEQ ID NO: 522957 - DNA, 25 bp, Mus musculus
gattgggcaactgctgtcaggcata

SEQ ID NO: 522958 - DNA, 25 bp, Mus musculus
gattgggcaagccagctatgctcaa

SEQ ID NO: 522959 - DNA, 25 bp, Mus musculus
gattgggcaagcgagctatgctcaa

SEQ ID NO: 522960 - DNA, 25 bp, Mus musculus
gattgggcaagtacccttgcagcca

SEQ ID NO: 522961 - DNA, 25 bp, Mus musculus
gattgggcaagttcccttgcagcca

SEQ ID NO: 522962 - DNA, 25 bp, Mus musculus
gattgggccaacaatgtctgcctta

SEQ ID NO: 522963 - DNA, 25 bp, Mus musculus
gattgggccaactatgtctgcctta

SEQ ID NO: 522964 - DNA, 25 bp, Mus musculus
gattgggcccagaatcagatttgca

SEQ ID NO: 522965 - DNA, 25 bp, Mus musculus
gattgggcccagtatcagatttgca

SEQ ID NO: 522966 - DNA, 25 bp, Mus musculus
gattgggcccatactagacaaacta

SEQ ID NO: 522967 - DNA, 25 bp, Mus musculus
gattgggcccattctagacaaacta

SEQ ID NO: 522968 - DNA, 25 bp, Mus musculus
gattgggcgcttcccagatcacaag

SEQ ID NO: 522969 - DNA, 25 bp, Mus musculus
gattgggcgcttgccagatcacaag

SEQ ID NO: 522970 - DNA, 25 bp, Mus musculus
gattgggctgtgacccttaaattga

SEQ ID NO: 522971 - DNA, 25 bp, Mus musculus
gattgggctgtgtcccttaaattga

SEQ ID NO: 522972 - DNA, 25 bp, Mus musculus
gattgggctttgcaacttctggttc

SEQ ID NO: 522973 - DNA, 25 bp, Mus musculus
gattgggctttggaacttctggttc

SEQ ID NO: 522974 - DNA, 25 bp, Mus musculus
gattgggtactgctcacacatgatg

SEQ ID NO: 522975 - DNA, 25 bp, Mus musculus
gattgggtactggtcacacatgatg

SEQ ID NO: 522976 - DNA, 25 bp, Mus musculus
gattgggtcaacagtgccttgaact

SEQ ID NO: 522977 - DNA, 25 bp, Mus musculus
gattgggtcaactgtgccttgaact

SEQ ID NO: 522978 - DNA, 25 bp, Mus musculus
gattgggtccatcttccccagggag

SEQ ID NO: 522979 - DNA, 25 bp, Mus musculus
gattgggtccatgttccccagggag

SEQ ID NO: 522980 - DNA, 25 bp, Mus musculus
gattgggtgacacaccctctaaact

SEQ ID NO: 522981 - DNA, 25 bp, Mus musculus
gattgggtgacagaccctctaaact

SEQ ID NO: 522982 - DNA, 25 bp, Mus musculus
gattgggtgatcaggaccgagtcaa

SEQ ID NO: 522983 - DNA, 25 bp, Mus musculus
gattgggtgatctggaccgagtcaa

SEQ ID NO: 522984 - DNA, 25 bp, Mus musculus
gattgggtggaaatcctctgtgttt

SEQ ID NO: 522985 - DNA, 25 bp, Mus musculus
gattgggtggaattcctctgtgttt

SEQ ID NO: 522986 - DNA, 25 bp, Mus musculus
gattgggtgttcaagttttgtctgt

SEQ ID NO: 522987 - DNA, 25 bp, Mus musculus
gattgggtgttctagttttgtctgt

SEQ ID NO: 522988 - DNA, 25 bp, Mus musculus
gattgggttaaccttccctgaacag

SEQ ID NO: 522989 - DNA, 25 bp, Mus musculus
gattgggttaacgttccctgaacag

SEQ ID NO: 522990 - DNA, 25 bp, Mus musculus
gattgggttatacatccccacccca

SEQ ID NO: 522991 - DNA, 25 bp, Mus musculus
gattgggttatagatccccacccca

SEQ ID NO: 522992 - DNA, 25 bp, Mus musculus
gattgggttcctcaatgcaccataa

SEQ ID NO: 522993 - DNA, 25 bp, Mus musculus
gattgggttcctgaatgcaccataa

SEQ ID NO: 522994 - DNA, 25 bp, Mus musculus
gattgggttggtcccgatcctcaaa

SEQ ID NO: 522995 - DNA, 25 bp, Mus musculus
gattgggttggtgccgatcctcaaa

SEQ ID NO: 522996 - DNA, 25 bp, Mus musculus
gattgggttttactacgtggctctg

SEQ ID NO: 522997 - DNA, 25 bp, Mus musculus
gattgggttttagtacgtggctctg

SEQ ID NO: 522998 - DNA, 25 bp, Mus musculus
gattgggttttcattcctggtagga

SEQ ID NO: 522999 - DNA, 25 bp, Mus musculus
gattgggttttctttcctggtagga

SEQ ID NO: 523000 - DNA, 25 bp, Mus musculus
gattggtaaaccctaagccctgtat

SEQ ID NO: 523001 - DNA, 25 bp, Mus musculus
gattggtaaaccgtaagccctgtat

SEQ ID NO: 523002 - DNA, 25 bp, Mus musculus
gattggtaaagcagactttattcag

SEQ ID NO: 523003 - DNA, 25 bp, Mus musculus
gattggtaaagctgactttattcag

SEQ ID NO: 523004 - DNA, 25 bp, Mus musculus
gattggtaatacacatctcaaaata

SEQ ID NO: 523005 - DNA, 25 bp, Mus musculus
gattggtaatactcatctcaaaata

SEQ ID NO: 523006 - DNA, 25 bp, Mus musculus
gattggtaattccaaccactggatt

SEQ ID NO: 523007 - DNA, 25 bp, Mus musculus
gattggtaattcgaaccactggatt

SEQ ID NO: 523008 - DNA, 25 bp, Mus musculus
gattggtacagcattctgggtgcag

SEQ ID NO: 523009 - DNA, 25 bp, Mus musculus
gattggtacagctttctgggtgcag

SEQ ID NO: 523010 - DNA, 25 bp, Mus musculus
gattggtacctacctggtcccggat

SEQ ID NO: 523011 - DNA, 25 bp, Mus musculus
gattggtacctagctggtcccggat

SEQ ID NO: 523012 - DNA, 25 bp, Mus musculus
gattggtagactcaggcatagaaac

SEQ ID NO: 523013 - DNA, 25 bp, Mus musculus
gattggtagactgaggcatagaaac

SEQ ID NO: 523014 - DNA, 25 bp, Mus musculus
gattggtattcaagtttagtttttg

SEQ ID NO: 523015 - DNA, 25 bp, Mus musculus
gattggtattcatgtttagtttttg

SEQ ID NO: 523016 - DNA, 25 bp, Mus musculus
gattggtattggctcatgattcctt

SEQ ID NO: 523017 - DNA, 25 bp, Mus musculus
gattggtattgggtcatgattcctt

SEQ ID NO: 523018 - DNA, 25 bp, Mus musculus
gattggtattttcaatgctgtgaca

SEQ ID NO: 523019 - DNA, 25 bp, Mus musculus
gattggtattttgaatgctgtgaca

SEQ ID NO: 523020 - DNA, 25 bp, Mus musculus
gattggtcaaggctacctcatcaag

SEQ ID NO: 523021 - DNA, 25 bp, Mus musculus
gattggtcaagggtacctcatcaag

SEQ ID NO: 523022 - DNA, 25 bp, Mus musculus
gattggtcactgacatggtttgcca

SEQ ID NO: 523023 - DNA, 25 bp, Mus musculus
gattggtcactgtcatggtttgcca

SEQ ID NO: 523024 - DNA, 25 bp, Mus musculus
gattggtcacttatacagctaattt

SEQ ID NO: 523025 - DNA, 25 bp, Mus musculus
gattggtcacttttacagctaattt

SEQ ID NO: 523026 - DNA, 25 bp, Mus musculus
gattggtcagacacacattgtttag

SEQ ID NO: 523027 - DNA, 25 bp, Mus musculus
gattggtcagactcacattgtttag

SEQ ID NO: 523028 - DNA, 25 bp, Mus musculus
gattggtcagctataccattagctt

SEQ ID NO: 523029 - DNA, 25 bp, Mus musculus
gattggtcagctttaccattagctt

SEQ ID NO: 523030 - DNA, 25 bp, Mus musculus
gattggtccactatgctacccaagg

SEQ ID NO: 523031 - DNA, 25 bp, Mus musculus
gattggtccactcatgttctacctg

SEQ ID NO: 523032 - DNA, 25 bp, Mus musculus
gattggtccactgatgttctacctg

SEQ ID NO: 523033 - DNA, 25 bp, Mus musculus
gattggtccactttgctacccaagg

SEQ ID NO: 523034 - DNA, 25 bp, Mus musculus
gattggtcccagatcaatactctgt

SEQ ID NO: 523035 - DNA, 25 bp, Mus musculus
gattggtcccagttcaatactctgt

SEQ ID NO: 523036 - DNA, 25 bp, Mus musculus
gattggtctcaaagtgaattgttct

SEQ ID NO: 523037 - DNA, 25 bp, Mus musculus
gattggtctcaatgtgaattgttct

SEQ ID NO: 523038 - DNA, 25 bp, Mus musculus
gattggtctgtgacagtccgtttgt

SEQ ID NO: 523039 - DNA, 25 bp, Mus musculus
gattggtctgtgtcagtccgtttgt

SEQ ID NO: 523040 - DNA, 25 bp, Mus musculus
gattggtcttctatctcctgaagtt

SEQ ID NO: 523041 - DNA, 25 bp, Mus musculus
gattggtcttctttctcctgaagtt

SEQ ID NO: 523042 - DNA, 25 bp, Mus musculus
gattggtgaccaaaagccttcaagt

SEQ ID NO: 523043 - DNA, 25 bp, Mus musculus
gattggtgaccataagccttcaagt

SEQ ID NO: 523044 - DNA, 25 bp, Mus musculus
gattggtgacctcacaagtgcctgg

SEQ ID NO: 523045 - DNA, 25 bp, Mus musculus
gattggtgacctgacaagtgcctgg

SEQ ID NO: 523046 - DNA, 25 bp, Mus musculus
gattggtgatacacggctaagcact

SEQ ID NO: 523047 - DNA, 25 bp, Mus musculus
gattggtgatactcggctaagcact

SEQ ID NO: 523048 - DNA, 25 bp, Mus musculus
gattggtgatgtattcctgtcattt

SEQ ID NO: 523049 - DNA, 25 bp, Mus musculus
gattggtgatgttttcctgtcattt

SEQ ID NO: 523050 - DNA, 25 bp, Mus musculus
gattggtgccatacagtcatttgcc

SEQ ID NO: 523051 - DNA, 25 bp, Mus musculus
gattggtgccattcagtcatttgcc

SEQ ID NO: 523052 - DNA, 25 bp, Mus musculus
gattggtgctgcagtcactcaggag

SEQ ID NO: 523053 - DNA, 25 bp, Mus musculus
gattggtgctgctgtcactcaggag

SEQ ID NO: 523054 - DNA, 25 bp, Mus musculus
gattggtggaccattatagcctcag

SEQ ID NO: 523055 - DNA, 25 bp, Mus musculus
gattggtggacctttatagcctcag

SEQ ID NO: 523056 - DNA, 25 bp, Mus musculus
gattggtggcacaatcctgtatgcc

SEQ ID NO: 523057 - DNA, 25 bp, Mus musculus
gattggtggcacagagaccttctct

SEQ ID NO: 523058 - DNA, 25 bp, Mus musculus
gattggtggcactatcctgtatgcc

SEQ ID NO: 523059 - DNA, 25 bp, Mus musculus
gattggtggcactgagaccttctct

SEQ ID NO: 523060 - DNA, 25 bp, Mus musculus
gattggtggcatccctcaaagcatt

SEQ ID NO: 523061 - DNA, 25 bp, Mus musculus
gattggtggcatgcctcaaagcatt

SEQ ID NO: 523062 - DNA, 25 bp, Mus musculus
gattggtggcctaatagactccaaa

SEQ ID NO: 523063 - DNA, 25 bp, Mus musculus
gattggtggccttatagactccaaa

SEQ ID NO: 523064 - DNA, 25 bp, Mus musculus
gattggtggctacagcaaacactaa

SEQ ID NO: 523065 - DNA, 25 bp, Mus musculus
gattggtggctagagcaaacactaa

SEQ ID NO: 523066 - DNA, 25 bp, Mus musculus
gattggtggctgatcagtttctact

SEQ ID NO: 523067 - DNA, 25 bp, Mus musculus
gattggtggctgctagtgcattaaa

SEQ ID NO: 523068 - DNA, 25 bp, Mus musculus
gattggtggctggtagtgcattaaa

SEQ ID NO: 523069 - DNA, 25 bp, Mus musculus
gattggtggctgttcagtttctact

SEQ ID NO: 523070 - DNA, 25 bp, Mus musculus
gattggttagtcatgtcagtgcagg

SEQ ID NO: 523071 - DNA, 25 bp, Mus musculus
gattggttagtcttgtcagtgcagg

SEQ ID NO: 523072 - DNA, 25 bp, Mus musculus
gattggttatatcctcattcaccct

SEQ ID NO: 523073 - DNA, 25 bp, Mus musculus
gattggttatatgctcattcaccct

SEQ ID NO: 523074 - DNA, 25 bp, Mus musculus
gattggttatttctatactgattgc

SEQ ID NO: 523075 - DNA, 25 bp, Mus musculus
gattggttatttgtatactgattgc

SEQ ID NO: 523076 - DNA, 25 bp, Mus musculus
gattggttcaagctctatattcatg

SEQ ID NO: 523077 - DNA, 25 bp, Mus musculus
gattggttcaaggtctatattcatg

SEQ ID NO: 523078 - DNA, 25 bp, Mus musculus
gattggttccgtcaagtacctggag

SEQ ID NO: 523079 - DNA, 25 bp, Mus musculus
gattggttccgtgaagtacctggag

SEQ ID NO: 523080 - DNA, 25 bp, Mus musculus
gattggttcgcaccagaagctctga

SEQ ID NO: 523081 - DNA, 25 bp, Mus musculus
gattggttcgcagcagaagctctga

SEQ ID NO: 523082 - DNA, 25 bp, Mus musculus
gattggttctgtatataccttccca

SEQ ID NO: 523083 - DNA, 25 bp, Mus musculus
gattggttctgtttataccttccca

SEQ ID NO: 523084 - DNA, 25 bp, Mus musculus
gattggttcttaattgatttggact

SEQ ID NO: 523085 - DNA, 25 bp, Mus musculus
gattggttcttatttgatttggact

SEQ ID NO: 523086 - DNA, 25 bp, Mus musculus
gattggttgtatactgttgcactct

SEQ ID NO: 523087 - DNA, 25 bp, Mus musculus
gattggttgtattctgttgcactct

SEQ ID NO: 523088 - DNA, 25 bp, Mus musculus
gattggttgttaaactaccttttgt

SEQ ID NO: 523089 - DNA, 25 bp, Mus musculus
gattggttgttatactaccttttgt

SEQ ID NO: 523090 - DNA, 25 bp, Mus musculus
gattggtttctaagagaatcacaga

SEQ ID NO: 523091 - DNA, 25 bp, Mus musculus
gattggtttctatgagaatcacaga

SEQ ID NO: 523092 - DNA, 25 bp, Mus musculus
gattggtttctcaagtccagaactg

SEQ ID NO: 523093 - DNA, 25 bp, Mus musculus
gattggtttctctagtccagaactg

SEQ ID NO: 523094 - DNA, 25 bp, Mus musculus
gattgtaaaagcaaagtcactccct

SEQ ID NO: 523095 - DNA, 25 bp, Mus musculus
gattgtaaaagctaagtcactccct

SEQ ID NO: 523096 - DNA, 25 bp, Mus musculus
gattgtaaagggaaacatcaaatta

SEQ ID NO: 523097 - DNA, 25 bp, Mus musculus
gattgtaaagggtaacatcaaatta

SEQ ID NO: 523098 - DNA, 25 bp, Mus musculus
gattgtaaattcacccatagagcaa

SEQ ID NO: 523099 - DNA, 25 bp, Mus musculus
gattgtaaattccatctttcaggga

SEQ ID NO: 523100 - DNA, 25 bp, Mus musculus
gattgtaaattcgatctttcaggga

SEQ ID NO: 523101 - DNA, 25 bp, Mus musculus
gattgtaaattctcccatagagcaa

SEQ ID NO: 523102 - DNA, 25 bp, Mus musculus
gattgtaacactcctgtgtacagta

SEQ ID NO: 523103 - DNA, 25 bp, Mus musculus
gattgtaacactgctgtgtacagta

SEQ ID NO: 523104 - DNA, 25 bp, Mus musculus
gattgtaacataagctcactcccta

SEQ ID NO: 523105 - DNA, 25 bp, Mus musculus
gattgtaacatatgctcactcccta

SEQ ID NO: 523106 - DNA, 25 bp, Mus musculus
gattgtaactgaaccgtcaactgtt

SEQ ID NO: 523107 - DNA, 25 bp, Mus musculus
gattgtaactgatccgtcaactgtt

SEQ ID NO: 523108 - DNA, 25 bp, Mus musculus
gattgtaagattagtccagcttcta

SEQ ID NO: 523109 - DNA, 25 bp, Mus musculus
gattgtaagatttgtccagcttcta

SEQ ID NO: 523110 - DNA, 25 bp, Mus musculus
gattgtaatccgatggtcctaacct

SEQ ID NO: 523111 - DNA, 25 bp, Mus musculus
gattgtaatccgttggtcctaacct

SEQ ID NO: 523112 - DNA, 25 bp, Mus musculus
gattgtaatttcacagatgcgcttc

SEQ ID NO: 523113 - DNA, 25 bp, Mus musculus
gattgtaatttctcagatgcgcttc

SEQ ID NO: 523114 - DNA, 25 bp, Mus musculus
gattgtacaaatcacactgatggat

SEQ ID NO: 523115 - DNA, 25 bp, Mus musculus
gattgtacaaatgacactgatggat

SEQ ID NO: 523116 - DNA, 25 bp, Mus musculus
gattgtacatacattgcctactcct

SEQ ID NO: 523117 - DNA, 25 bp, Mus musculus
gattgtacatactttgcctactcct

SEQ ID NO: 523118 - DNA, 25 bp, Mus musculus
gattgtaccagtcactttctttata

SEQ ID NO: 523119 - DNA, 25 bp, Mus musculus
gattgtaccagtgactttctttata

SEQ ID NO: 523120 - DNA, 25 bp, Mus musculus
gattgtaccgatcacgattcgttcg

SEQ ID NO: 523121 - DNA, 25 bp, Mus musculus
gattgtaccgatgacgattcgttcg

SEQ ID NO: 523122 - DNA, 25 bp, Mus musculus
gattgtaccttaatggtcgctgtgg

SEQ ID NO: 523123 - DNA, 25 bp, Mus musculus
gattgtaccttattggtcgctgtgg

SEQ ID NO: 523124 - DNA, 25 bp, Mus musculus
gattgtacgacaaggctgctcagac

SEQ ID NO: 523125 - DNA, 25 bp, Mus musculus
gattgtacgacatggctgctcagac

SEQ ID NO: 523126 - DNA, 25 bp, Mus musculus
gattgtactaaccacacatgtaatg

SEQ ID NO: 523127 - DNA, 25 bp, Mus musculus
gattgtactaacgacacatgtaatg

SEQ ID NO: 523128 - DNA, 25 bp, Mus musculus
gattgtactaggactttccatacga

SEQ ID NO: 523129 - DNA, 25 bp, Mus musculus
gattgtactaggtctttccatacga

SEQ ID NO: 523130 - DNA, 25 bp, Mus musculus
gattgtactgcaagggcgagacaaa

SEQ ID NO: 523131 - DNA, 25 bp, Mus musculus
gattgtactgcatgggcgagacaaa

SEQ ID NO: 523132 - DNA, 25 bp, Mus musculus
gattgtacttaaatttcttctgact

SEQ ID NO: 523133 - DNA, 25 bp, Mus musculus
gattgtacttaattttcttctgact

SEQ ID NO: 523134 - DNA, 25 bp, Mus musculus
gattgtagaaacagccccaggactt

SEQ ID NO: 523135 - DNA, 25 bp, Mus musculus
gattgtagaaactgccccaggactt

SEQ ID NO: 523136 - DNA, 25 bp, Mus musculus
gattgtagcctcaatcacacggtac

SEQ ID NO: 523137 - DNA, 25 bp, Mus musculus
gattgtagcctctatcacacggtac

SEQ ID NO: 523138 - DNA, 25 bp, Mus musculus
gattgtagctctccatagagaactt

SEQ ID NO: 523139 - DNA, 25 bp, Mus musculus
gattgtagctctgcatagagaactt

SEQ ID NO: 523140 - DNA, 25 bp, Mus musculus
gattgtagcttcaagtgtctcaaag

SEQ ID NO: 523141 - DNA, 25 bp, Mus musculus
gattgtagcttctagtgtctcaaag

SEQ ID NO: 523142 - DNA, 25 bp, Mus musculus
gattgtaggcaaattccaacagata

SEQ ID NO: 523143 - DNA, 25 bp, Mus musculus
gattgtaggcaatttccaacagata

SEQ ID NO: 523144 - DNA, 25 bp, Mus musculus
gattgtaggtgtaatccttagcttt

SEQ ID NO: 523145 - DNA, 25 bp, Mus musculus
gattgtaggtgtctgaccccgtgcc

SEQ ID NO: 523146 - DNA, 25 bp, Mus musculus
gattgtaggtgtgtgaccccgtgcc

SEQ ID NO: 523147 - DNA, 25 bp, Mus musculus
gattgtaggtgttatccttagcttt

SEQ ID NO: 523148 - DNA, 25 bp, Mus musculus
gattgtagtgatccatccgtactca

SEQ ID NO: 523149 - DNA, 25 bp, Mus musculus
gattgtagtgatgcatccgtactca

SEQ ID NO: 523150 - DNA, 25 bp, Mus musculus
gattgtatcacccatatattcttga

SEQ ID NO: 523151 - DNA, 25 bp, Mus musculus
gattgtatcaccgatatattcttga

SEQ ID NO: 523152 - DNA, 25 bp, Mus musculus
gattgtatctggaaaccttcggatc

SEQ ID NO: 523153 - DNA, 25 bp, Mus musculus
gattgtatctggtaaccttcggatc

SEQ ID NO: 523154 - DNA, 25 bp, Mus musculus
gattgtatctgtccctgagcaaagg

SEQ ID NO: 523155 - DNA, 25 bp, Mus musculus
gattgtatctgtgcctgagcaaagg

SEQ ID NO: 523156 - DNA, 25 bp, Mus musculus
gattgtatcttgcagagtagccaac

SEQ ID NO: 523157 - DNA, 25 bp, Mus musculus
gattgtatcttggagagtagccaac

SEQ ID NO: 523158 - DNA, 25 bp, Mus musculus
gattgtatgagcctcctgtgtttga

SEQ ID NO: 523159 - DNA, 25 bp, Mus musculus
gattgtatgagcgtcctgtgtttga

SEQ ID NO: 523160 - DNA, 25 bp, Mus musculus
gattgtatgaggctcttcaccaaag

SEQ ID NO: 523161 - DNA, 25 bp, Mus musculus
gattgtatgagggtcttcaccaaag

SEQ ID NO: 523162 - DNA, 25 bp, Mus musculus
gattgtatgatcagcttctcagtta

SEQ ID NO: 523163 - DNA, 25 bp, Mus musculus
gattgtatgatctgcttctcagtta

SEQ ID NO: 523164 - DNA, 25 bp, Mus musculus
gattgtatgctaatatgtcttgtaa

SEQ ID NO: 523165 - DNA, 25 bp, Mus musculus
gattgtatgctattatgtcttgtaa

SEQ ID NO: 523166 - DNA, 25 bp, Mus musculus
gattgtatggtcaacactcaggaag

SEQ ID NO: 523167 - DNA, 25 bp, Mus musculus
gattgtatggtctacactcaggaag

SEQ ID NO: 523168 - DNA, 25 bp, Mus musculus
gattgtattagtatctgatgtctct

SEQ ID NO: 523169 - DNA, 25 bp, Mus musculus
gattgtattagtttctgatgtctct

SEQ ID NO: 523170 - DNA, 25 bp, Mus musculus
gattgtattatgagcaactcagttg

SEQ ID NO: 523171 - DNA, 25 bp, Mus musculus
gattgtattatgtgcaactcagttg

SEQ ID NO: 523172 - DNA, 25 bp, Mus musculus
gattgtattccccagcatatatctc

SEQ ID NO: 523173 - DNA, 25 bp, Mus musculus
gattgtattcccgagcatatatctc

SEQ ID NO: 523174 - DNA, 25 bp, Mus musculus
gattgtattcttacttactctagta

SEQ ID NO: 523175 - DNA, 25 bp, Mus musculus
gattgtattctttcttactctagta

SEQ ID NO: 523176 - DNA, 25 bp, Mus musculus
gattgtattgcacgtcattaagctg

SEQ ID NO: 523177 - DNA, 25 bp, Mus musculus
gattgtattgcaggtcattaagctg

SEQ ID NO: 523178 - DNA, 25 bp, Mus musculus
gattgtatttccaatttcttgttca

SEQ ID NO: 523179 - DNA, 25 bp, Mus musculus
gattgtatttccctctaagtgcctt

SEQ ID NO: 523180 - DNA, 25 bp, Mus musculus
gattgtatttccgtctaagtgcctt

SEQ ID NO: 523181 - DNA, 25 bp, Mus musculus
gattgtatttcctatttcttgttca

SEQ ID NO: 523182 - DNA, 25 bp, Mus musculus
gattgtcaaagcagtggtcccttct

SEQ ID NO: 523183 - DNA, 25 bp, Mus musculus
gattgtcaaagctgtggtcccttct

SEQ ID NO: 523184 - DNA, 25 bp, Mus musculus
gattgtcaacggcaaccactactgt

SEQ ID NO: 523185 - DNA, 25 bp, Mus musculus
gattgtcaacgggaaccactactgt

SEQ ID NO: 523186 - DNA, 25 bp, Mus musculus
gattgtcaagaaagtcagctgtcag

SEQ ID NO: 523187 - DNA, 25 bp, Mus musculus
gattgtcaagaatgtcagctgtcag

SEQ ID NO: 523188 - DNA, 25 bp, Mus musculus
gattgtcaagtcatccaagtttgca

SEQ ID NO: 523189 - DNA, 25 bp, Mus musculus
gattgtcaagtcttccaagtttgca

SEQ ID NO: 523190 - DNA, 25 bp, Mus musculus
gattgtcacactcactgtcttttgt

SEQ ID NO: 523191 - DNA, 25 bp, Mus musculus
gattgtcacactgactgtcttttgt

SEQ ID NO: 523192 - DNA, 25 bp, Mus musculus
gattgtcacgcaatctgtgactcct

SEQ ID NO: 523193 - DNA, 25 bp, Mus musculus
gattgtcacgcattctgtgactcct

SEQ ID NO: 523194 - DNA, 25 bp, Mus musculus
gattgtcacgtgagctcaacagtcc

SEQ ID NO: 523195 - DNA, 25 bp, Mus musculus
gattgtcacgtgtgctcaacagtcc

SEQ ID NO: 523196 - DNA, 25 bp, Mus musculus
gattgtcacttcagttttatttctg

SEQ ID NO: 523197 - DNA, 25 bp, Mus musculus
gattgtcacttctgttttatttctg

SEQ ID NO: 523198 - DNA, 25 bp, Mus musculus
gattgtcagacacctaccaagggtc

SEQ ID NO: 523199 - DNA, 25 bp, Mus musculus
gattgtcagacagctaccaagggtc

SEQ ID NO: 523200 - DNA, 25 bp, Mus musculus
gattgtcagggaccactacagggct

SEQ ID NO: 523201 - DNA, 25 bp, Mus musculus
gattgtcagggagcactacagggct

SEQ ID NO: 523202 - DNA, 25 bp, Mus musculus
gattgtcaggttccatttgtgtcaa

SEQ ID NO: 523203 - DNA, 25 bp, Mus musculus
gattgtcaggttgcatttgtgtcaa

SEQ ID NO: 523204 - DNA, 25 bp, Mus musculus
gattgtcagtacaccattacgtcaa

SEQ ID NO: 523205 - DNA, 25 bp, Mus musculus
gattgtcagtactccattacgtcaa

SEQ ID NO: 523206 - DNA, 25 bp, Mus musculus
gattgtcagtctactgtcatctctg

SEQ ID NO: 523207 - DNA, 25 bp, Mus musculus
gattgtcagtctaggacctctgcat

SEQ ID NO: 523208 - DNA, 25 bp, Mus musculus
gattgtcagtcttctgtcatctctg

SEQ ID NO: 523209 - DNA, 25 bp, Mus musculus
gattgtcagtcttggacctctgcat

SEQ ID NO: 523210 - DNA, 25 bp, Mus musculus
gattgtcatcctattggctatcata

SEQ ID NO: 523211 - DNA, 25 bp, Mus musculus
gattgtcatccttttggctatcata

SEQ ID NO: 523212 - DNA, 25 bp, Mus musculus
gattgtcatgcacaagatccggcca

SEQ ID NO: 523213 - DNA, 25 bp, Mus musculus
gattgtcatgcagaagatccggcca

SEQ ID NO: 523214 - DNA, 25 bp, Mus musculus
gattgtcatggtcatcctggtgctt

SEQ ID NO: 523215 - DNA, 25 bp, Mus musculus
gattgtcatggtgatcctggtgctt

SEQ ID NO: 523216 - DNA, 25 bp, Mus musculus
gattgtcattcacaacccatgtgag

SEQ ID NO: 523217 - DNA, 25 bp, Mus musculus
gattgtcattcagaacccatgtgag

SEQ ID NO: 523218 - DNA, 25 bp, Mus musculus
gattgtcattttaaatagtcctacc

SEQ ID NO: 523219 - DNA, 25 bp, Mus musculus
gattgtcattttagccaaaccggca

SEQ ID NO: 523220 - DNA, 25 bp, Mus musculus
gattgtcatttttaatagtcctacc

SEQ ID NO: 523221 - DNA, 25 bp, Mus musculus
gattgtcatttttgccaaaccggca

SEQ ID NO: 523222 - DNA, 25 bp, Mus musculus
gattgtccaactaccctacaaatgt

SEQ ID NO: 523223 - DNA, 25 bp, Mus musculus
gattgtccaacttccctacaaatgt

SEQ ID NO: 523224 - DNA, 25 bp, Mus musculus
gattgtccaagtcatccgcaatcct

SEQ ID NO: 523225 - DNA, 25 bp, Mus musculus
gattgtccaagtgatccgcaatcct

SEQ ID NO: 523226 - DNA, 25 bp, Mus musculus
gattgtccaatacagtggttccact

SEQ ID NO: 523227 - DNA, 25 bp, Mus musculus
gattgtccaatagagtggttccact

SEQ ID NO: 523228 - DNA, 25 bp, Mus musculus
gattgtccacagattgaggcattag

SEQ ID NO: 523229 - DNA, 25 bp, Mus musculus
gattgtccacagtttgaggcattag

SEQ ID NO: 523230 - DNA, 25 bp, Mus musculus
gattgtccactaatattccctaata

SEQ ID NO: 523231 - DNA, 25 bp, Mus musculus
gattgtccactattattccctaata

SEQ ID NO: 523232 - DNA, 25 bp, Mus musculus
gattgtccactcctcataagtatct

SEQ ID NO: 523233 - DNA, 25 bp, Mus musculus
gattgtccactcgtcataagtatct

SEQ ID NO: 523234 - DNA, 25 bp, Mus musculus
gattgtccagaaagccatcctgcaa

SEQ ID NO: 523235 - DNA, 25 bp, Mus musculus
gattgtccagaatgccatcctgcaa

SEQ ID NO: 523236 - DNA, 25 bp, Mus musculus
gattgtccatctatcaaattctgta

SEQ ID NO: 523237 - DNA, 25 bp, Mus musculus
gattgtccatctttcaaattctgta

SEQ ID NO: 523238 - DNA, 25 bp, Mus musculus
gattgtcccacaacaaataagagat

SEQ ID NO: 523239 - DNA, 25 bp, Mus musculus
gattgtcccacatcaaataagagat

SEQ ID NO: 523240 - DNA, 25 bp, Mus musculus
gattgtcccactcatgattgatatg

SEQ ID NO: 523241 - DNA, 25 bp, Mus musculus
gattgtcccactctaaatgttcaca

SEQ ID NO: 523242 - DNA, 25 bp, Mus musculus
gattgtcccactgatgattgatatg

SEQ ID NO: 523243 - DNA, 25 bp, Mus musculus
gattgtcccactgtaaatgttcaca

SEQ ID NO: 523244 - DNA, 25 bp, Mus musculus
gattgtcccattcagtggtttcact

SEQ ID NO: 523245 - DNA, 25 bp, Mus musculus
gattgtcccattgagtggtttcact

SEQ ID NO: 523246 - DNA, 25 bp, Mus musculus
gattgtccccgtcaatataaataat

SEQ ID NO: 523247 - DNA, 25 bp, Mus musculus
gattgtccccgtgaatataaataat

SEQ ID NO: 523248 - DNA, 25 bp, Mus musculus
gattgtccctcccatgtgaaagaat

SEQ ID NO: 523249 - DNA, 25 bp, Mus musculus
gattgtccctccgatgtgaaagaat

SEQ ID NO: 523250 - DNA, 25 bp, Mus musculus
gattgtccctgtcactgctgcttcc

SEQ ID NO: 523251 - DNA, 25 bp, Mus musculus
gattgtccctgtgactgctgcttcc

SEQ ID NO: 523252 - DNA, 25 bp, Mus musculus
gattgtcccttcaatgaacagccag

SEQ ID NO: 523253 - DNA, 25 bp, Mus musculus
gattgtcccttctatgaacagccag

SEQ ID NO: 523254 - DNA, 25 bp, Mus musculus
gattgtccgaaaatcatggggcgaa

SEQ ID NO: 523255 - DNA, 25 bp, Mus musculus
gattgtccgaaattcatggggcgaa

SEQ ID NO: 523256 - DNA, 25 bp, Mus musculus
gattgtccgtcgctatgctgacgaa

SEQ ID NO: 523257 - DNA, 25 bp, Mus musculus
gattgtccgtcggtatgctgacgaa

SEQ ID NO: 523258 - DNA, 25 bp, Mus musculus
gattgtccgtggaattcacaccatc

SEQ ID NO: 523259 - DNA, 25 bp, Mus musculus
gattgtccgtggtattcacaccatc

SEQ ID NO: 523260 - DNA, 25 bp, Mus musculus
gattgtcctatcaccagcggccctg

SEQ ID NO: 523261 - DNA, 25 bp, Mus musculus
gattgtcctatctccagcggccctg

SEQ ID NO: 523262 - DNA, 25 bp, Mus musculus
gattgtcctgtaccctgtaatgcac

SEQ ID NO: 523263 - DNA, 25 bp, Mus musculus
gattgtcctgtagcctgtaatgcac

SEQ ID NO: 523264 - DNA, 25 bp, Mus musculus
gattgtcctgtcaaggtctgggatt

SEQ ID NO: 523265 - DNA, 25 bp, Mus musculus
gattgtcctgtctaggtctgggatt

SEQ ID NO: 523266 - DNA, 25 bp, Mus musculus
gattgtcctgtgatgtcttctaagt

SEQ ID NO: 523267 - DNA, 25 bp, Mus musculus
gattgtcctgtgttgtcttctaagt

SEQ ID NO: 523268 - DNA, 25 bp, Mus musculus
gattgtcctttaatattagcttctg

SEQ ID NO: 523269 - DNA, 25 bp, Mus musculus
gattgtcctttattattagcttctg

SEQ ID NO: 523270 - DNA, 25 bp, Mus musculus
gattgtcctttgaggcaggcagcat

SEQ ID NO: 523271 - DNA, 25 bp, Mus musculus
gattgtcctttgtggcaggcagcat

SEQ ID NO: 523272 - DNA, 25 bp, Mus musculus
gattgtcgagatagcgtcctggctg

SEQ ID NO: 523273 - DNA, 25 bp, Mus musculus
gattgtcgagattgcgtcctggctg

SEQ ID NO: 523274 - DNA, 25 bp, Mus musculus
gattgtcgatccatttcagatactt

SEQ ID NO: 523275 - DNA, 25 bp, Mus musculus
gattgtcgatccttttcagatactt

SEQ ID NO: 523276 - DNA, 25 bp, Mus musculus
gattgtcgatggagcaccgtttcag

SEQ ID NO: 523277 - DNA, 25 bp, Mus musculus
gattgtcgatggtgcaccgtttcag

SEQ ID NO: 523278 - DNA, 25 bp, Mus musculus
gattgtcgcctgcagacataataat

SEQ ID NO: 523279 - DNA, 25 bp, Mus musculus
gattgtcgcctggagacataataat

SEQ ID NO: 523280 - DNA, 25 bp, Mus musculus
gattgtcgtcgtagttcatctacag

SEQ ID NO: 523281 - DNA, 25 bp, Mus musculus
gattgtcgtcgttgttcatctacag

SEQ ID NO: 523282 - DNA, 25 bp, Mus musculus
gattgtcgtctcaaccgtgttttaa

SEQ ID NO: 523283 - DNA, 25 bp, Mus musculus
gattgtcgtctctaccgtgttttaa

SEQ ID NO: 523284 - DNA, 25 bp, Mus musculus
gattgtcgttgtaactgtccactca

SEQ ID NO: 523285 - DNA, 25 bp, Mus musculus
gattgtcgttgttactgtccactca

SEQ ID NO: 523286 - DNA, 25 bp, Mus musculus
gattgtcgtttactagacctgccct

SEQ ID NO: 523287 - DNA, 25 bp, Mus musculus
gattgtcgtttagtagacctgccct

SEQ ID NO: 523288 - DNA, 25 bp, Mus musculus
gattgtctaaacatgaggtcagaac

SEQ ID NO: 523289 - DNA, 25 bp, Mus musculus
gattgtctaaacttgaggtcagaac

SEQ ID NO: 523290 - DNA, 25 bp, Mus musculus
gattgtctaattctatggctagcaa

SEQ ID NO: 523291 - DNA, 25 bp, Mus musculus
gattgtctaattgtatggctagcaa

SEQ ID NO: 523292 - DNA, 25 bp, Mus musculus
gattgtctagaaaccaggattccct

SEQ ID NO: 523293 - DNA, 25 bp, Mus musculus
gattgtctagaatccaggattccct

SEQ ID NO: 523294 - DNA, 25 bp, Mus musculus
gattgtctataaattcctgtgggaa

SEQ ID NO: 523295 - DNA, 25 bp, Mus musculus
gattgtctataatttcctgtgggaa

SEQ ID NO: 523296 - DNA, 25 bp, Mus musculus
gattgtctcaggacagttctgttag

SEQ ID NO: 523297 - DNA, 25 bp, Mus musculus
gattgtctcaggtcagttctgttag

SEQ ID NO: 523298 - DNA, 25 bp, Mus musculus
gattgtctcgctcctattgttattt

SEQ ID NO: 523299 - DNA, 25 bp, Mus musculus
gattgtctcgctgctattgttattt

SEQ ID NO: 523300 - DNA, 25 bp, Mus musculus
gattgtctctggaaaggtccggttc

SEQ ID NO: 523301 - DNA, 25 bp, Mus musculus
gattgtctctggtaaggtccggttc

SEQ ID NO: 523302 - DNA, 25 bp, Mus musculus
gattgtctgaaaacacctgactctg

SEQ ID NO: 523303 - DNA, 25 bp, Mus musculus
gattgtctgaaatcacctgactctg

SEQ ID NO: 523304 - DNA, 25 bp, Mus musculus
gattgtctgactcgtgggagcacct

SEQ ID NO: 523305 - DNA, 25 bp, Mus musculus
gattgtctgactggtgggagcacct

SEQ ID NO: 523306 - DNA, 25 bp, Mus musculus
gattgtctgcacagagctcaatgag

SEQ ID NO: 523307 - DNA, 25 bp, Mus musculus
gattgtctgcactgagctcaatgag

SEQ ID NO: 523308 - DNA, 25 bp, Mus musculus
gattgtctggatctgtagttaaaga

SEQ ID NO: 523309 - DNA, 25 bp, Mus musculus
gattgtctggatgtgtagttaaaga

SEQ ID NO: 523310 - DNA, 25 bp, Mus musculus
gattgtctggccaccagggtgccaa

SEQ ID NO: 523311 - DNA, 25 bp, Mus musculus
gattgtctggcctccagggtgccaa

SEQ ID NO: 523312 - DNA, 25 bp, Mus musculus
gattgtctgtccatgaattctttta

SEQ ID NO: 523313 - DNA, 25 bp, Mus musculus
gattgtctgtccttgaattctttta

SEQ ID NO: 523314 - DNA, 25 bp, Mus musculus
gattgtcttatactgtagcaactgg

SEQ ID NO: 523315 - DNA, 25 bp, Mus musculus
gattgtcttatagtgtagcaactgg

SEQ ID NO: 523316 - DNA, 25 bp, Mus musculus
gattgtcttctaaaaacttcgcaag

SEQ ID NO: 523317 - DNA, 25 bp, Mus musculus
gattgtcttctataaacttcgcaag

SEQ ID NO: 523318 - DNA, 25 bp, Mus musculus
gattgtcttgaaagccaactatgtc

SEQ ID NO: 523319 - DNA, 25 bp, Mus musculus
gattgtcttgaatgccaactatgtc

SEQ ID NO: 523320 - DNA, 25 bp, Mus musculus
gattgtcttgtgatcatactctctc

SEQ ID NO: 523321 - DNA, 25 bp, Mus musculus
gattgtcttgtgttcatactctctc

SEQ ID NO: 523322 - DNA, 25 bp, Mus musculus
gattgtctttgaaattgtggttgat

SEQ ID NO: 523323 - DNA, 25 bp, Mus musculus
gattgtctttgatattgtggttgat

SEQ ID NO: 523324 - DNA, 25 bp, Mus musculus
gattgtctttgtatatcttggcaaa

SEQ ID NO: 523325 - DNA, 25 bp, Mus musculus
gattgtctttgtttatcttggcaaa

SEQ ID NO: 523326 - DNA, 25 bp, Mus musculus
gattgtgaaactaagcccgtgggag

SEQ ID NO: 523327 - DNA, 25 bp, Mus musculus
gattgtgaaactacccatatgcaaa

SEQ ID NO: 523328 - DNA, 25 bp, Mus musculus
gattgtgaaacttagcccgtgggag

SEQ ID NO: 523329 - DNA, 25 bp, Mus musculus
gattgtgaaacttcccatatgcaaa

SEQ ID NO: 523330 - DNA, 25 bp, Mus musculus
gattgtgaaatcaccttccatgcaa

SEQ ID NO: 523331 - DNA, 25 bp, Mus musculus
gattgtgaaatctccttccatgcaa

SEQ ID NO: 523332 - DNA, 25 bp, Mus musculus
gattgtgaacaactttcaagccacc

SEQ ID NO: 523333 - DNA, 25 bp, Mus musculus
gattgtgaacaagtttcaagccacc

SEQ ID NO: 523334 - DNA, 25 bp, Mus musculus
gattgtgaacagctaaacagggagc

SEQ ID NO: 523335 - DNA, 25 bp, Mus musculus
gattgtgaacaggtaaacagggagc

SEQ ID NO: 523336 - DNA, 25 bp, Mus musculus
gattgtgaagttctacgaggcctac

SEQ ID NO: 523337 - DNA, 25 bp, Mus musculus
gattgtgaagttgtacgaggcctac

SEQ ID NO: 523338 - DNA, 25 bp, Mus musculus
gattgtgaccctctcccgaaagaaa

SEQ ID NO: 523339 - DNA, 25 bp, Mus musculus
gattgtgaccctgtcccgaaagaaa

SEQ ID NO: 523340 - DNA, 25 bp, Mus musculus
gattgtgaccttcatttccatgtta

SEQ ID NO: 523341 - DNA, 25 bp, Mus musculus
gattgtgaccttgatttccatgtta

SEQ ID NO: 523342 - DNA, 25 bp, Mus musculus
gattgtgacggaatacaaaccataa

SEQ ID NO: 523343 - DNA, 25 bp, Mus musculus
gattgtgacggattacaaaccataa

SEQ ID NO: 523344 - DNA, 25 bp, Mus musculus
gattgtgactcacgctgtaccaggc

SEQ ID NO: 523345 - DNA, 25 bp, Mus musculus
gattgtgactcaggctgtaccaggc

SEQ ID NO: 523346 - DNA, 25 bp, Mus musculus
gattgtgagagtcctaatgaccagt

SEQ ID NO: 523347 - DNA, 25 bp, Mus musculus
gattgtgagagtgctaatgaccagt

SEQ ID NO: 523348 - DNA, 25 bp, Mus musculus
gattgtgagatactcctgagcttat

SEQ ID NO: 523349 - DNA, 25 bp, Mus musculus
gattgtgagatagtcctgagcttat

SEQ ID NO: 523350 - DNA, 25 bp, Mus musculus
gattgtgaggaaagccagtcccaaa

SEQ ID NO: 523351 - DNA, 25 bp, Mus musculus
gattgtgaggaatgccagtcccaaa

SEQ ID NO: 523352 - DNA, 25 bp, Mus musculus
gattgtgagtgtactgtgtttttat

SEQ ID NO: 523353 - DNA, 25 bp, Mus musculus
gattgtgagtgtctggcccttacat

SEQ ID NO: 523354 - DNA, 25 bp, Mus musculus
gattgtgagtgtgtggcccttacat

SEQ ID NO: 523355 - DNA, 25 bp, Mus musculus
gattgtgagtgttctgtgtttttat

SEQ ID NO: 523356 - DNA, 25 bp, Mus musculus
gattgtgatcccaggaagtcccacg

SEQ ID NO: 523357 - DNA, 25 bp, Mus musculus
gattgtgatccctggaagtcccacg

SEQ ID NO: 523358 - DNA, 25 bp, Mus musculus
gattgtgattcccagagctcccttg

SEQ ID NO: 523359 - DNA, 25 bp, Mus musculus
gattgtgattccgagagctcccttg

SEQ ID NO: 523360 - DNA, 25 bp, Mus musculus
gattgtgattgtattgactttttac

SEQ ID NO: 523361 - DNA, 25 bp, Mus musculus
gattgtgattgttttgactttttac

SEQ ID NO: 523362 - DNA, 25 bp, Mus musculus
gattgtgcaaacacctgcattcatg

SEQ ID NO: 523363 - DNA, 25 bp, Mus musculus
gattgtgcaaactcctgcattcatg

SEQ ID NO: 523364 - DNA, 25 bp, Mus musculus
gattgtgcaaatcctgggcacgctt

SEQ ID NO: 523365 - DNA, 25 bp, Mus musculus
gattgtgcaaatgctgggcacgctt

SEQ ID NO: 523366 - DNA, 25 bp, Mus musculus
gattgtgcacacagaccttctacaa

SEQ ID NO: 523367 - DNA, 25 bp, Mus musculus
gattgtgcacactgaccttctacaa

SEQ ID NO: 523368 - DNA, 25 bp, Mus musculus
gattgtgccaccctgtgattgtata

SEQ ID NO: 523369 - DNA, 25 bp, Mus musculus
gattgtgccaccgtgtgattgtata

SEQ ID NO: 523370 - DNA, 25 bp, Mus musculus
gattgtgccactagtaggctcccat

SEQ ID NO: 523371 - DNA, 25 bp, Mus musculus
gattgtgccacttgtaggctcccat

SEQ ID NO: 523372 - DNA, 25 bp, Mus musculus
gattgtgcctctaaaaaatgtgtgt

SEQ ID NO: 523373 - DNA, 25 bp, Mus musculus
gattgtgcctcttaaaaatgtgtgt

SEQ ID NO: 523374 - DNA, 25 bp, Mus musculus
gattgtgctcatatagctgggcccg

SEQ ID NO: 523375 - DNA, 25 bp, Mus musculus
gattgtgctcatttagctgggcccg

SEQ ID NO: 523376 - DNA, 25 bp, Mus musculus
gattgtgctgaccaagctgctcgtg

SEQ ID NO: 523377 - DNA, 25 bp, Mus musculus
gattgtgctgacgaagctgctcgtg

SEQ ID NO: 523378 - DNA, 25 bp, Mus musculus
gattgtgctgtacacctatcagttg

SEQ ID NO: 523379 - DNA, 25 bp, Mus musculus
gattgtgctgtagacctatcagttg

SEQ ID NO: 523380 - DNA, 25 bp, Mus musculus
gattgtggaactcctgcaggcccca

SEQ ID NO: 523381 - DNA, 25 bp, Mus musculus
gattgtggaactgctgcaggcccca

SEQ ID NO: 523382 - DNA, 25 bp, Mus musculus
gattgtggacaaacctggcagttga

SEQ ID NO: 523383 - DNA, 25 bp, Mus musculus
gattgtggacaatcctggcagttga

SEQ ID NO: 523384 - DNA, 25 bp, Mus musculus
gattgtggaggcattctccgaggat

SEQ ID NO: 523385 - DNA, 25 bp, Mus musculus
gattgtggaggctttctccgaggat

SEQ ID NO: 523386 - DNA, 25 bp, Mus musculus
gattgtggcaaaatattgatttctt

SEQ ID NO: 523387 - DNA, 25 bp, Mus musculus
gattgtggcaaattattgatttctt

SEQ ID NO: 523388 - DNA, 25 bp, Mus musculus
gattgtggcacacgaggagaactca

SEQ ID NO: 523389 - DNA, 25 bp, Mus musculus
gattgtggcacaggaggagaactca

SEQ ID NO: 523390 - DNA, 25 bp, Mus musculus
gattgtggctgtaacatctgtgtga

SEQ ID NO: 523391 - DNA, 25 bp, Mus musculus
gattgtggctgttacatctgtgtga

SEQ ID NO: 523392 - DNA, 25 bp, Mus musculus
gattgtgggacacttgtctctggct

SEQ ID NO: 523393 - DNA, 25 bp, Mus musculus
gattgtgggacagttgtctctggct

SEQ ID NO: 523394 - DNA, 25 bp, Mus musculus
gattgtgggtctcagttttttaagg

SEQ ID NO: 523395 - DNA, 25 bp, Mus musculus
gattgtgggtctgagttttttaagg

SEQ ID NO: 523396 - DNA, 25 bp, Mus musculus
gattgtggtattaagccccttccat

SEQ ID NO: 523397 - DNA, 25 bp, Mus musculus
gattgtggtatttagccccttccat

SEQ ID NO: 523398 - DNA, 25 bp, Mus musculus
gattgtggtgacaggctggcgacct

SEQ ID NO: 523399 - DNA, 25 bp, Mus musculus
gattgtggtgactggctggcgacct

SEQ ID NO: 523400 - DNA, 25 bp, Mus musculus
gattgtggttgaatatggtgtctga

SEQ ID NO: 523401 - DNA, 25 bp, Mus musculus
gattgtggttgattatggtgtctga

SEQ ID NO: 523402 - DNA, 25 bp, Mus musculus
gattgtggtttgaatgcttcttgtt

SEQ ID NO: 523403 - DNA, 25 bp, Mus musculus
gattgtggtttgtatgcttcttgtt

SEQ ID NO: 523404 - DNA, 25 bp, Mus musculus
gattgtgtaagaacccaggccctag

SEQ ID NO: 523405 - DNA, 25 bp, Mus musculus
gattgtgtaagatcccaggccctag

SEQ ID NO: 523406 - DNA, 25 bp, Mus musculus
gattgtgtaattacttgcatatgca

SEQ ID NO: 523407 - DNA, 25 bp, Mus musculus
gattgtgtaatttcttgcatatgca

SEQ ID NO: 523408 - DNA, 25 bp, Mus musculus
gattgtgtagccattcacaagggca

SEQ ID NO: 523409 - DNA, 25 bp, Mus musculus
gattgtgtagcctttcacaagggca

SEQ ID NO: 523410 - DNA, 25 bp, Mus musculus
gattgtgtattgctttcaacccaag

SEQ ID NO: 523411 - DNA, 25 bp, Mus musculus
gattgtgtattggtttcaacccaag

SEQ ID NO: 523412 - DNA, 25 bp, Mus musculus
gattgtgtccagaagggctcctgaa

SEQ ID NO: 523413 - DNA, 25 bp, Mus musculus
gattgtgtccagtagggctcctgaa

SEQ ID NO: 523414 - DNA, 25 bp, Mus musculus
gattgtgtctgaaaactgagttggc

SEQ ID NO: 523415 - DNA, 25 bp, Mus musculus
gattgtgtctgataactgagttggc

SEQ ID NO: 523416 - DNA, 25 bp, Mus musculus
gattgtgtgaatcatacctcaagga

SEQ ID NO: 523417 - DNA, 25 bp, Mus musculus
gattgtgtgaatgatacctcaagga

SEQ ID NO: 523418 - DNA, 25 bp, Mus musculus
gattgtgtgactcaattccttcagg

SEQ ID NO: 523419 - DNA, 25 bp, Mus musculus
gattgtgtgactgaattccttcagg

SEQ ID NO: 523420 - DNA, 25 bp, Mus musculus
gattgtgtgtctcccatttaggttt

SEQ ID NO: 523421 - DNA, 25 bp, Mus musculus
gattgtgtgtctgccatttaggttt

SEQ ID NO: 523422 - DNA, 25 bp, Mus musculus
gattgtgttagtactgcctgtttaa

SEQ ID NO: 523423 - DNA, 25 bp, Mus musculus
gattgtgttagttctgcctgtttaa

SEQ ID NO: 523424 - DNA, 25 bp, Mus musculus
gattgtgttccaatgtgattgtttt

SEQ ID NO: 523425 - DNA, 25 bp, Mus musculus
gattgtgttccattgtgattgtttt

SEQ ID NO: 523426 - DNA, 25 bp, Mus musculus
gattgtgttcctaccgaatgagaca

SEQ ID NO: 523427 - DNA, 25 bp, Mus musculus
gattgtgttccttccgaatgagaca

SEQ ID NO: 523428 - DNA, 25 bp, Mus musculus
gattgtgttcgtattattcatcaac

SEQ ID NO: 523429 - DNA, 25 bp, Mus musculus
gattgtgttcgttttattcatcaac

SEQ ID NO: 523430 - DNA, 25 bp, Mus musculus
gattgtgttctgagactttggtact

SEQ ID NO: 523431 - DNA, 25 bp, Mus musculus
gattgtgttctgtgactttggtact

SEQ ID NO: 523432 - DNA, 25 bp, Mus musculus
gattgtgttgataatagatgacgac

SEQ ID NO: 523433 - DNA, 25 bp, Mus musculus
gattgtgttgattatagatgacgac

SEQ ID NO: 523434 - DNA, 25 bp, Mus musculus
gattgtgtttatcccagattggaaa

SEQ ID NO: 523435 - DNA, 25 bp, Mus musculus
gattgtgtttatgccagattggaaa

SEQ ID NO: 523436 - DNA, 25 bp, Mus musculus
gattgtgtttcacgctccatcacat

SEQ ID NO: 523437 - DNA, 25 bp, Mus musculus
gattgtgtttcaggctccatcacat

SEQ ID NO: 523438 - DNA, 25 bp, Mus musculus
gattgtgtttccatgaactcaccga

SEQ ID NO: 523439 - DNA, 25 bp, Mus musculus
gattgtgtttccttgaactcaccga

SEQ ID NO: 523440 - DNA, 25 bp, Mus musculus
gattgtgttttcaagtcatggctta

SEQ ID NO: 523441 - DNA, 25 bp, Mus musculus
gattgtgttttctagtcatggctta

SEQ ID NO: 523442 - DNA, 25 bp, Mus musculus
gattgttaacatcttgagctagggc

SEQ ID NO: 523443 - DNA, 25 bp, Mus musculus
gattgttaacatgttgagctagggc

SEQ ID NO: 523444 - DNA, 25 bp, Mus musculus
gattgttaagcacattacttccatc

SEQ ID NO: 523445 - DNA, 25 bp, Mus musculus
gattgttaagcagattacttccatc

SEQ ID NO: 523446 - DNA, 25 bp, Mus musculus
gattgttaatctcacaaccatccaa

SEQ ID NO: 523447 - DNA, 25 bp, Mus musculus
gattgttaatctgacaaccatccaa

SEQ ID NO: 523448 - DNA, 25 bp, Mus musculus
gattgttaattgcaacgtatgttgt

SEQ ID NO: 523449 - DNA, 25 bp, Mus musculus
gattgttaattggaacgtatgttgt

SEQ ID NO: 523450 - DNA, 25 bp, Mus musculus
gattgttacctcctgaagtctgcat

SEQ ID NO: 523451 - DNA, 25 bp, Mus musculus
gattgttacctcgtgaagtctgcat

SEQ ID NO: 523452 - DNA, 25 bp, Mus musculus
gattgttaccttacctaaagccaga

SEQ ID NO: 523453 - DNA, 25 bp, Mus musculus
gattgttacctttcctaaagccaga

SEQ ID NO: 523454 - DNA, 25 bp, Mus musculus
gattgttactggctacagagctcca

SEQ ID NO: 523455 - DNA, 25 bp, Mus musculus
gattgttactgggtacagagctcca

SEQ ID NO: 523456 - DNA, 25 bp, Mus musculus
gattgttacttgatgctagctggaa

SEQ ID NO: 523457 - DNA, 25 bp, Mus musculus
gattgttacttgttgctagctggaa

SEQ ID NO: 523458 - DNA, 25 bp, Mus musculus
gattgttagcaaaccggtgatcaac

SEQ ID NO: 523459 - DNA, 25 bp, Mus musculus
gattgttagcaatccggtgatcaac

SEQ ID NO: 523460 - DNA, 25 bp, Mus musculus
gattgttagccaacatgtgagtgct

SEQ ID NO: 523461 - DNA, 25 bp, Mus musculus
gattgttagccatcatgtgagtgct

SEQ ID NO: 523462 - DNA, 25 bp, Mus musculus
gattgttagcttacaaaaagtccat

SEQ ID NO: 523463 - DNA, 25 bp, Mus musculus
gattgttagctttcaaaaagtccat

SEQ ID NO: 523464 - DNA, 25 bp, Mus musculus
gattgttagtacaaaattgtgactt

SEQ ID NO: 523465 - DNA, 25 bp, Mus musculus
gattgttagtactaaattgtgactt

SEQ ID NO: 523466 - DNA, 25 bp, Mus musculus
gattgttagtatctcactttgtgtg

SEQ ID NO: 523467 - DNA, 25 bp, Mus musculus
gattgttagtatgtcactttgtgtg

SEQ ID NO: 523468 - DNA, 25 bp, Mus musculus
gattgttagtgtattggggcctaga

SEQ ID NO: 523469 - DNA, 25 bp, Mus musculus
gattgttagtgttttggggcctaga

SEQ ID NO: 523470 - DNA, 25 bp, Mus musculus
gattgttatccgaggcctgcagaag

SEQ ID NO: 523471 - DNA, 25 bp, Mus musculus
gattgttatccgtggcctgcagaag

SEQ ID NO: 523472 - DNA, 25 bp, Mus musculus
gattgttatcgacggctttcagacc

SEQ ID NO: 523473 - DNA, 25 bp, Mus musculus
gattgttatcgagggctttcagacc

SEQ ID NO: 523474 - DNA, 25 bp, Mus musculus
gattgttcacatctatacactcaga

SEQ ID NO: 523475 - DNA, 25 bp, Mus musculus
gattgttcacatgtatacactcaga

SEQ ID NO: 523476 - DNA, 25 bp, Mus musculus
gattgttcaccactggtcagtgtga

SEQ ID NO: 523477 - DNA, 25 bp, Mus musculus
gattgttcaccagtggtcagtgtga

SEQ ID NO: 523478 - DNA, 25 bp, Mus musculus
gattgttcactgaactctacatgga

SEQ ID NO: 523479 - DNA, 25 bp, Mus musculus
gattgttcactgtactctacatgga

SEQ ID NO: 523480 - DNA, 25 bp, Mus musculus
gattgttcagttaaccctaaagact

SEQ ID NO: 523481 - DNA, 25 bp, Mus musculus
gattgttcagtttaccctaaagact

SEQ ID NO: 523482 - DNA, 25 bp, Mus musculus
gattgttcatataaaccaccagcca

SEQ ID NO: 523483 - DNA, 25 bp, Mus musculus
gattgttcatattaaccaccagcca

SEQ ID NO: 523484 - DNA, 25 bp, Mus musculus
gattgttcatcaacaacagtctaac

SEQ ID NO: 523485 - DNA, 25 bp, Mus musculus
gattgttcatcatcaacagtctaac

SEQ ID NO: 523486 - DNA, 25 bp, Mus musculus
gattgttccaaaaactcagcagagt

SEQ ID NO: 523487 - DNA, 25 bp, Mus musculus
gattgttccaaatactcagcagagt

SEQ ID NO: 523488 - DNA, 25 bp, Mus musculus
gattgttccaacctgctcttaaaat

SEQ ID NO: 523489 - DNA, 25 bp, Mus musculus
gattgttccaacgtgctcttaaaat

SEQ ID NO: 523490 - DNA, 25 bp, Mus musculus
gattgttccaggatctgaaatctgc

SEQ ID NO: 523491 - DNA, 25 bp, Mus musculus
gattgttccaggttctgaaatctgc

SEQ ID NO: 523492 - DNA, 25 bp, Mus musculus
gattgttcccttcatgcatggatac

SEQ ID NO: 523493 - DNA, 25 bp, Mus musculus
gattgttcccttgatgcatggatac

SEQ ID NO: 523494 - DNA, 25 bp, Mus musculus
gattgttctcctcagttatctactt

SEQ ID NO: 523495 - DNA, 25 bp, Mus musculus
gattgttctcctgagttatctactt

SEQ ID NO: 523496 - DNA, 25 bp, Mus musculus
gattgttctcttagtccatgtaacg

SEQ ID NO: 523497 - DNA, 25 bp, Mus musculus
gattgttctctttgtccatgtaacg

SEQ ID NO: 523498 - DNA, 25 bp, Mus musculus
gattgttctgtgaagggtctcactt

SEQ ID NO: 523499 - DNA, 25 bp, Mus musculus
gattgttctgtgtagggtctcactt

SEQ ID NO: 523500 - DNA, 25 bp, Mus musculus
gattgttctgttagcactttctcac

SEQ ID NO: 523501 - DNA, 25 bp, Mus musculus
gattgttctgtttgcactttctcac

SEQ ID NO: 523502 - DNA, 25 bp, Mus musculus
gattgttcttatcacttgtattctg

SEQ ID NO: 523503 - DNA, 25 bp, Mus musculus
gattgttcttatcctaactttcaag

SEQ ID NO: 523504 - DNA, 25 bp, Mus musculus
gattgttcttatgacttgtattctg

SEQ ID NO: 523505 - DNA, 25 bp, Mus musculus
gattgttcttatgctaactttcaag

SEQ ID NO: 523506 - DNA, 25 bp, Mus musculus
gattgttcttgaacacgcagaccct

SEQ ID NO: 523507 - DNA, 25 bp, Mus musculus
gattgttcttgatcacgcagaccct

SEQ ID NO: 523508 - DNA, 25 bp, Mus musculus
gattgttgccccaaagcatcagtta

SEQ ID NO: 523509 - DNA, 25 bp, Mus musculus
gattgttgcccctaagcatcagtta

SEQ ID NO: 523510 - DNA, 25 bp, Mus musculus
gattgttgctaaacccctgatctgc

SEQ ID NO: 523511 - DNA, 25 bp, Mus musculus
gattgttgctaacttctgttgtcct

SEQ ID NO: 523512 - DNA, 25 bp, Mus musculus
gattgttgctaagttctgttgtcct

SEQ ID NO: 523513 - DNA, 25 bp, Mus musculus
gattgttgctaatcccctgatctgc

SEQ ID NO: 523514 - DNA, 25 bp, Mus musculus
gattgttgctccatagagtctgttg

SEQ ID NO: 523515 - DNA, 25 bp, Mus musculus
gattgttgctccttagagtctgttg

SEQ ID NO: 523516 - DNA, 25 bp, Mus musculus
gattgttgctggctcactatactga

SEQ ID NO: 523517 - DNA, 25 bp, Mus musculus
gattgttgctgggtcactatactga

SEQ ID NO: 523518 - DNA, 25 bp, Mus musculus
gattgttgctgtaggattccaagtc

SEQ ID NO: 523519 - DNA, 25 bp, Mus musculus
gattgttgctgttggattccaagtc

SEQ ID NO: 523520 - DNA, 25 bp, Mus musculus
gattgttggagaatatgacttcacc

SEQ ID NO: 523521 - DNA, 25 bp, Mus musculus
gattgttggagattatgacttcacc

SEQ ID NO: 523522 - DNA, 25 bp, Mus musculus
gattgttggagcaactccggcctga

SEQ ID NO: 523523 - DNA, 25 bp, Mus musculus
gattgttggagctactccggcctga

SEQ ID NO: 523524 - DNA, 25 bp, Mus musculus
gattgttgggccaagtgtcctaaac

SEQ ID NO: 523525 - DNA, 25 bp, Mus musculus
gattgttgggcctagtgtcctaaac

SEQ ID NO: 523526 - DNA, 25 bp, Mus musculus
gattgttggtttcccattgtaacct

SEQ ID NO: 523527 - DNA, 25 bp, Mus musculus
gattgttggtttgccattgtaacct

SEQ ID NO: 523528 - DNA, 25 bp, Mus musculus
gattgttgtcctcgaaaccttgcct

SEQ ID NO: 523529 - DNA, 25 bp, Mus musculus
gattgttgtcctggaaaccttgcct

SEQ ID NO: 523530 - DNA, 25 bp, Mus musculus
gattgttgtgccatgtcacactttt

SEQ ID NO: 523531 - DNA, 25 bp, Mus musculus
gattgttgtgccttgtcacactttt

SEQ ID NO: 523532 - DNA, 25 bp, Mus musculus
gattgttgttgcacgcttgtctgac

SEQ ID NO: 523533 - DNA, 25 bp, Mus musculus
gattgttgttgctcgcttgtctgac

SEQ ID NO: 523534 - DNA, 25 bp, Mus musculus
gattgttgttgtacaaacattttat

SEQ ID NO: 523535 - DNA, 25 bp, Mus musculus
gattgttgttgttcaaacattttat

SEQ ID NO: 523536 - DNA, 25 bp, Mus musculus
gattgtttacataccctcgtgttga

SEQ ID NO: 523537 - DNA, 25 bp, Mus musculus
gattgtttacattccctcgtgttga

SEQ ID NO: 523538 - DNA, 25 bp, Mus musculus
gattgtttacccatggactcagaga

SEQ ID NO: 523539 - DNA, 25 bp, Mus musculus
gattgtttacccttggactcagaga

SEQ ID NO: 523540 - DNA, 25 bp, Mus musculus
gattgtttacctctacaccaagaag

SEQ ID NO: 523541 - DNA, 25 bp, Mus musculus
gattgtttacctgtacaccaagaag

SEQ ID NO: 523542 - DNA, 25 bp, Mus musculus
gattgtttactacctaggaacctta

SEQ ID NO: 523543 - DNA, 25 bp, Mus musculus
gattgtttactagctaggaacctta

SEQ ID NO: 523544 - DNA, 25 bp, Mus musculus
gattgtttactgaagcgtgtctgac

SEQ ID NO: 523545 - DNA, 25 bp, Mus musculus
gattgtttactgtagcgtgtctgac

SEQ ID NO: 523546 - DNA, 25 bp, Mus musculus
gattgtttacttaagctgttcagag

SEQ ID NO: 523547 - DNA, 25 bp, Mus musculus
gattgtttactttagctgttcagag

SEQ ID NO: 523548 - DNA, 25 bp, Mus musculus
gattgtttatctatccattcactgg

SEQ ID NO: 523549 - DNA, 25 bp, Mus musculus
gattgtttatctttccattcactgg

SEQ ID NO: 523550 - DNA, 25 bp, Mus musculus
gattgtttatgaatgagcaagcctt

SEQ ID NO: 523551 - DNA, 25 bp, Mus musculus
gattgtttatgattgagcaagcctt

SEQ ID NO: 523552 - DNA, 25 bp, Mus musculus
gattgtttcactagatatagcttcc

SEQ ID NO: 523553 - DNA, 25 bp, Mus musculus
gattgtttcacttgatatagcttcc

SEQ ID NO: 523554 - DNA, 25 bp, Mus musculus
gattgtttcgatcgctaccgcctgg

SEQ ID NO: 523555 - DNA, 25 bp, Mus musculus
gattgtttcgatggctaccgcctgg

SEQ ID NO: 523556 - DNA, 25 bp, Mus musculus
gattgtttctagaattatctgccct

SEQ ID NO: 523557 - DNA, 25 bp, Mus musculus
gattgtttctagtattatctgccct

SEQ ID NO: 523558 - DNA, 25 bp, Mus musculus
gattgtttctccatgcttgttatat

SEQ ID NO: 523559 - DNA, 25 bp, Mus musculus
gattgtttctccttgcttgttatat

SEQ ID NO: 523560 - DNA, 25 bp, Mus musculus
gattgtttctttagatacacgtgac

SEQ ID NO: 523561 - DNA, 25 bp, Mus musculus
gattgtttcttttgatacacgtgac

SEQ ID NO: 523562 - DNA, 25 bp, Mus musculus
gattgtttgataagtgccattgcct

SEQ ID NO: 523563 - DNA, 25 bp, Mus musculus
gattgtttgatatgtgccattgcct

SEQ ID NO: 523564 - DNA, 25 bp, Mus musculus
gattgtttgattactggctcctccc

SEQ ID NO: 523565 - DNA, 25 bp, Mus musculus
gattgtttgatttctggctcctccc

SEQ ID NO: 523566 - DNA, 25 bp, Mus musculus
gattgtttgctcaagtttactacca

SEQ ID NO: 523567 - DNA, 25 bp, Mus musculus
gattgtttgctctagtttactacca

SEQ ID NO: 523568 - DNA, 25 bp, Mus musculus
gattgtttggtcatttcttattaca

SEQ ID NO: 523569 - DNA, 25 bp, Mus musculus
gattgtttggtcttttcttattaca

SEQ ID NO: 523570 - DNA, 25 bp, Mus musculus
gattgtttgtcgcaagtcttatgtg

SEQ ID NO: 523571 - DNA, 25 bp, Mus musculus
gattgtttgtcggaagtcttatgtg

SEQ ID NO: 523572 - DNA, 25 bp, Mus musculus
gattgtttgttacactcaaaaccag

SEQ ID NO: 523573 - DNA, 25 bp, Mus musculus
gattgtttgttagactcaaaaccag

SEQ ID NO: 523574 - DNA, 25 bp, Mus musculus
gattgttttaaaaaaggccctgtct

SEQ ID NO: 523575 - DNA, 25 bp, Mus musculus
gattgttttaaactcagtttagcct

SEQ ID NO: 523576 - DNA, 25 bp, Mus musculus
gattgttttaaagtcagtttagcct

SEQ ID NO: 523577 - DNA, 25 bp, Mus musculus
gattgttttaaataaggccctgtct

SEQ ID NO: 523578 - DNA, 25 bp, Mus musculus
gattgttttacactcttgagttgaa

SEQ ID NO: 523579 - DNA, 25 bp, Mus musculus
gattgttttacagtcttgagttgaa

SEQ ID NO: 523580 - DNA, 25 bp, Mus musculus
gattgttttagtccagatttctcct

SEQ ID NO: 523581 - DNA, 25 bp, Mus musculus
gattgttttagtgcagatttctcct

SEQ ID NO: 523582 - DNA, 25 bp, Mus musculus
gattgttttcagacgttgatccacc
